United States Patent 11,640,849 (METHODS FOR HISTOLOGICAL DIAGNOSIS AND TREATMENT OF DISEASES) - sequence listing, part 88

SEQ ID NO: 3353282 - protein, 23 aa, Plasmodium falciparum
DCFKNTYFDTVNKYNLFLSSKGK

SEQ ID NO: 3353283 - protein, 21 aa, Plasmodium falciparum
DCFYPSYIISHMIEYNINNKD

SEQ ID NO: 3353284 - protein, 18 aa, Plasmodium falciparum
DCGSTIGTMIKVNNYHVL

SEQ ID NO: 3353285 - protein, 19 aa, Plasmodium falciparum
DCIFLALKAIFEVVELSSK

SEQ ID NO: 3353286 - protein, 17 aa, Plasmodium falciparum
DCIGFVCDEEYMCEKLH

SEQ ID NO: 3353287 - protein, 21 aa, Plasmodium falciparum
DCKHVYDWVIGKHGIKINFTI

SEQ ID NO: 3353288 - protein, 17 aa, Plasmodium falciparum
DCKYAQSGRKDYMRNSG

SEQ ID NO: 3353289 - protein, 17 aa, Plasmodium falciparum
DCLCWYEGTVSFYNKLQ

SEQ ID NO: 3353290 - protein, 21 aa, Plasmodium falciparum
DCLMNCLKHNASNLKTNEDYE

SEQ ID NO: 3353291 - protein, 19 aa, Plasmodium falciparum
DCLSIFPLSSKKYLNNNYF

SEQ ID NO: 3353292 - protein, 20 aa, Plasmodium falciparum
DCMLKDSLCITNLLKNEFQK

SEQ ID NO: 3353293 - protein, 20 aa, Plasmodium falciparum
DCNNSIIFRIIIQKSSGIEY

SEQ ID NO: 3353294 - protein, 18 aa, Plasmodium falciparum
DCRVGLKTSDKELLHFFD

SEQ ID NO: 3353295 - protein, 18 aa, Plasmodium falciparum
DCSIQLWDLYNIDMLEPL

SEQ ID NO: 3353296 - protein, 21 aa, Plasmodium falciparum
DCSKLPNYILEYIKKMGSIDI

SEQ ID NO: 3353297 - protein, 17 aa, Plasmodium falciparum
DCSWVGNIILELLDLSY

SEQ ID NO: 3353298 - protein, 20 aa, Plasmodium falciparum
DCTRIVHLTNLVTPEEVDET

SEQ ID NO: 3353299 - protein, 26 aa, Plasmodium falciparum
DDAINLLYLCYKKWPYDISILNSLII

SEQ ID NO: 3353300 - protein, 23 aa, Plasmodium falciparum
DDAYYKKLFESEGKYDSFNNDKD

SEQ ID NO: 3353301 - protein, 22 aa, Plasmodium falciparum
DDCISLCSILKTDDCNYMESHV

SEQ ID NO: 3353302 - protein, 24 aa, Plasmodium falciparum
DDDDLSIKLNRYLKNEKADMENNT

SEQ ID NO: 3353303 - protein, 24 aa, Plasmodium falciparum
DDDDMLYTIGYNFLRNSDTKFMGE

SEQ ID NO: 3353304 - protein, 20 aa, Plasmodium falciparum
DDDGINCCTNLFKDDDTLSA

SEQ ID NO: 3353305 - protein, 23 aa, Plasmodium falciparum
DDDIMKIIFNYFYILKDNKFIKL

SEQ ID NO: 3353306 - protein, 19 aa, Plasmodium falciparum
DDDLYAIFMENWDESNVYD

SEQ ID NO: 3353307 - protein, 23 aa, Plasmodium falciparum
DDEFLIICCDGIFDVITSQEAVN

SEQ ID NO: 3353308 - protein, 23 aa, Plasmodium falciparum
DDEIKLTLFFAVKLYKKNIIRIK

SEQ ID NO: 3353309 - protein, 24 aa, Plasmodium falciparum
DDEKISCIKCTFVNETHNDNSNNK

SEQ ID NO: 3353310 - protein, 21 aa, Plasmodium falciparum
DDELLKALLYIDVQTEEYRKR

SEQ ID NO: 3353311 - protein, 17 aa, Plasmodium falciparum
DDEPFYCGIKYNNMPPM

SEQ ID NO: 3353312 - protein, 24 aa, Plasmodium falciparum
DDEVVASWVIGLGLLSYPYNKSPS

SEQ ID NO: 3353313 - protein, 18 aa, Plasmodium falciparum
DDEYCFVEYDLSLCKEFF

SEQ ID NO: 3353314 - protein, 20 aa, Plasmodium falciparum
DDFIRYLLNNAHLYNNKLHM

SEQ ID NO: 3353315 - protein, 17 aa, Plasmodium falciparum
DDFKNYWDSPLGKNNSI

SEQ ID NO: 3353316 - protein, 24 aa, Plasmodium falciparum
DDFPLEYFDSIFLDMPNPWLCVDN

SEQ ID NO: 3353317 - protein, 23 aa, Plasmodium falciparum
DDGEIEFEGWVEFVTKNGNDDTN

SEQ ID NO: 3353318 - protein, 27 aa, Plasmodium falciparum
DDGIYRMNFECYKKALKCNEFLKLLGI

SEQ ID NO: 3353319 - protein, 23 aa, Plasmodium falciparum
DDGRYFCISGMYPPQVGLYDTKE

SEQ ID NO: 3353320 - protein, 20 aa, Plasmodium falciparum
DDGWRNSIAQKNMMNNNNNN

SEQ ID NO: 3353321 - protein, 73 aa, Plasmodium falciparum
DDHEIKRKLIKLINTNFYIDKCIHFKKFSKDELYKTFIYSNFLTKALILYPSLMPYVECIIEKIKKIKNENIT

SEQ ID NO: 3353322 - protein, 17 aa, Plasmodium falciparum
DDHIEIILDNKNITPKP

SEQ ID NO: 3353323 - protein, 26 aa, Plasmodium falciparum
DDIENTIRFAIYFEECKNKTQKNNIY

SEQ ID NO: 3353324 - protein, 18 aa, Plasmodium falciparum
DDIFKDKNVGLLQHEERS

SEQ ID NO: 3353325 - protein, 17 aa, Plasmodium falciparum
DDIIKKKFFISSVNSHY

SEQ ID NO: 3353326 - protein, 20 aa, Plasmodium falciparum
DDIKLAYDIIRNENDYNNDE

SEQ ID NO: 3353327 - protein, 34 aa, Plasmodium falciparum
DDIKLDCPLCYDIFLKYLRFSILDNIIDKNYIFK

SEQ ID NO: 3353328 - protein, 23 aa, Plasmodium falciparum
DDIKSDILKLVLDYIKVTVVQDN

SEQ ID NO: 3353329 - protein, 21 aa, Plasmodium falciparum
DDISPQFNNMCNLNYTPQNYD

SEQ ID NO: 3353330 - protein, 20 aa, Plasmodium falciparum
DDISRLNVLVGYVEQVEIHP

SEQ ID NO: 3353331 - protein, 31 aa, Plasmodium falciparum
DDIYYRSGDIFRCILEVRGPEKYIGNIKLDY

SEQ ID NO: 3353332 - protein, 17 aa, Plasmodium falciparum
DDKELMTHYSIIDNRDN

SEQ ID NO: 3353333 - protein, 22 aa, Plasmodium falciparum
DDKGILILIMFGLPPLYHCDDT

SEQ ID NO: 3353334 - protein, 18 aa, Plasmodium falciparum
DDKIKSDDNIICDDNIIC

SEQ ID NO: 3353335 - protein, 19 aa, Plasmodium falciparum
DDKKGKHIYCIDIEPYNTN

SEQ ID NO: 3353336 - protein, 17 aa, Plasmodium falciparum
DDKLLATITVKWTIQYT

SEQ ID NO: 3353337 - protein, 22 aa, Plasmodium falciparum
DDKLYSFGCNDMGVLGRKTYSS

SEQ ID NO: 3353338 - protein, 21 aa, Plasmodium falciparum
DDKNCRLLDKCTLQMNKKRKM

SEQ ID NO: 3353339 - protein, 29 aa, Plasmodium falciparum
DDKTCTVIFFYWRKDIFNIQPQDVNVTEI

SEQ ID NO: 3353340 - protein, 21 aa, Plasmodium falciparum
DDKVECLLYIYNLFYNYDRDV

SEQ ID NO: 3353341 - protein, 18 aa, Plasmodium falciparum
DDLEEVCESFSLINENVD

SEQ ID NO: 3353342 - protein, 25 aa, Plasmodium falciparum
DDLFKTPPSCSFRKSNTINDKNMNE

SEQ ID NO: 3353343 - protein, 19 aa, Plasmodium falciparum
DDLILWLDVKENYLFNFPS

SEQ ID NO: 3353344 - protein, 22 aa, Plasmodium falciparum
DDLKIALKLSMEEYIKNMVPPL

SEQ ID NO: 3353345 - protein, 17 aa, Plasmodium falciparum
DDLKIIETRGIVLLQDI

SEQ ID NO: 3353346 - protein, 26 aa, Plasmodium falciparum
DDLKKKLQEQILIQRGLLKIKEQQQV

SEQ ID NO: 3353347 - protein, 23 aa, Plasmodium falciparum
DDLKNLPCSIDFNNVENYVISEL

SEQ ID NO: 3353348 - protein, 27 aa, Plasmodium falciparum
DDLKNYYCNINIPWIGKTCTNPSSSMS

SEQ ID NO: 3353349 - protein, 21 aa, Plasmodium falciparum
DDLKRIPGVYYDKNSQRWFGE

SEQ ID NO: 3353350 - protein, 21 aa, Plasmodium falciparum
DDLRSLGFGYRSNYVIESAKM

SEQ ID NO: 3353351 - protein, 17 aa, Plasmodium falciparum
DDMARRVLKIMDSQLSK

SEQ ID NO: 3353352 - protein, 17 aa, Plasmodium falciparum
DDMFYACILGRVNYINK

SEQ ID NO: 3353353 - protein, 23 aa, Plasmodium falciparum
DDMKDGKFSNVINLNNIHLNDDN

SEQ ID NO: 3353354 - protein, 24 aa, Plasmodium falciparum
DDMKSINIPLEMYNMKNNINTKQN

SEQ ID NO: 3353355 - protein, 19 aa, Plasmodium falciparum
DDMVLDMCAAPGGKCTFMC

SEQ ID NO: 3353356 - protein, 25 aa, Plasmodium falciparum
DDNDYQKSCAISEFEKSMARSEYER

SEQ ID NO: 3353357 - protein, 20 aa, Plasmodium falciparum
DDNFLAVGFINGYIHVILFE

SEQ ID NO: 3353358 - protein, 23 aa, Plasmodium falciparum
DDNLYIYMVMPFAVHGDLFEVMK

SEQ ID NO: 3353359 - protein, 20 aa, Plasmodium falciparum
DDNMEIRFCAFDVLESLMVD

SEQ ID NO: 3353360 - protein, 17 aa, Plasmodium falciparum
DDQIYLPVYDNEYTKDD

SEQ ID NO: 3353361 - protein, 29 aa, Plasmodium falciparum
DDQIYNYFLRYPVVRTILTQYRKQVLKGF

SEQ ID NO: 3353362 - protein, 19 aa, Plasmodium falciparum
DDRGCIFYNNYINSLTQYL

SEQ ID NO: 3353363 - protein, 23 aa, Plasmodium falciparum
DDRKKREIRFLNILTSMINNKGK

SEQ ID NO: 3353364 - protein, 26 aa, Plasmodium falciparum
DDRNYHCWNYRSYIISCIHIIHKKLN

SEQ ID NO: 3353365 - protein, 26 aa, Plasmodium falciparum
DDRTELFKNFLYQWRETNKAGQKFYD

SEQ ID NO: 3353366 - protein, 24 aa, Plasmodium falciparum
DDSCKLPSVSLENFFKDCEIEKLL

SEQ ID NO: 3353367 - protein, 23 aa, Plasmodium falciparum
DDSKKERQGLELTEEKVLEENIN

SEQ ID NO: 3353368 - protein, 19 aa, Plasmodium falciparum
DDSNCLKSIENRNNNRDIK

SEQ ID NO: 3353369 - protein, 25 aa, Plasmodium falciparum
DDSNRFRIEILFSSGAKDGFGQNYE

SEQ ID NO: 3353370 - protein, 17 aa, Plasmodium falciparum
DDSRGDIQIGLREQNGI

SEQ ID NO: 3353371 - protein, 17 aa, Plasmodium falciparum
DDTCNFLKKSIKKEYGV

SEQ ID NO: 3353372 - protein, 23 aa, Plasmodium falciparum
DDTILKNDVNLILNNNNVVNHSV

SEQ ID NO: 3353373 - protein, 23 aa, Plasmodium falciparum
DDTKEILNNILLSKYKAEKDNVI

SEQ ID NO: 3353374 - protein, 24 aa, Plasmodium falciparum
DDTLIPTCWIRSYLYSKYIGNCEK

SEQ ID NO: 3353375 - protein, 19 aa, Plasmodium falciparum
DDTNVCPVIKGLTSKKKNN

SEQ ID NO: 3353376 - protein, 18 aa, Plasmodium falciparum
DDTSIPSIYVKKSNKRIC

SEQ ID NO: 3353377 - protein, 17 aa, Plasmodium falciparum
DDVFVMFQVLKKMIEET

SEQ ID NO: 3353378 - protein, 26 aa, Plasmodium falciparum
DDVKKPFLVFSLPKSRNIKKRRKPIE

SEQ ID NO: 3353379 - protein, 17 aa, Plasmodium falciparum
DDVLYPAFLSDIYKLHI

SEQ ID NO: 3353380 - protein, 19 aa, Plasmodium falciparum
DDWELISYDNLDVFEKKIL

SEQ ID NO: 3353381 - protein, 25 aa, Plasmodium falciparum
DDYDLFLSKHVNGLYILSISKYSNI

SEQ ID NO: 3353382 - protein, 24 aa, Plasmodium falciparum
DDYSMKTQNTFLCIYDENNKEMFD

SEQ ID NO: 3353383 - protein, 30 aa, Plasmodium falciparum
DEAIGKRAEYLWNLALSAVYINVKLSMKYI

SEQ ID NO: 3353384 - protein, 21 aa, Plasmodium falciparum
DEAKQKMPAIIGVYNTNGLKK

SEQ ID NO: 3353385 - protein, 25 aa, Plasmodium falciparum
DEALLRPGRFELHIEISLPNKEGRI

SEQ ID NO: 3353386 - protein, 36 aa, Plasmodium falciparum
DEANKCFRIKINGYRKAYSVIRRGVKEAYKLSIESI

SEQ ID NO: 3353387 - protein, 24 aa, Plasmodium falciparum
DECCQCTEPLCYIPISLSKKNVFL

SEQ ID NO: 3353388 - protein, 23 aa, Plasmodium falciparum
DECNEVKCDFSYNDHKIEANKDG

SEQ ID NO: 3353389 - protein, 26 aa, Plasmodium falciparum
DECYMWYYFKEDFFEIYYLKDEYNII

SEQ ID NO: 3353390 - protein, 22 aa, Plasmodium falciparum
DEDDEEICLTSSTLSTSSVGTQ

SEQ ID NO: 3353391 - protein, 26 aa, Plasmodium falciparum
DEDDVLRLLSYNSLFNKKTNQDLTYQ

SEQ ID NO: 3353392 - protein, 20 aa, Plasmodium falciparum
DEDELWALNFEKSIKKDIIS

SEQ ID NO: 3353393 - protein, 21 aa, Plasmodium falciparum
DEDILKNGEMKNMSDIDETEG

SEQ ID NO: 3353394 - protein, 23 aa, Plasmodium falciparum
DEDKFFFVIFVTFIFNLENEYIN

SEQ ID NO: 3353395 - protein, 25 aa, Plasmodium falciparum
DEDLFGRSHLFNIFNNEEEIDINQK

SEQ ID NO: 3353396 - protein, 24 aa, Plasmodium falciparum
DEDMNLMFSDFFLDESFGDNEKKK

SEQ ID NO: 3353397 - protein, 32 aa, Plasmodium falciparum
DEEEIYEQFLLIFPRCVYYWNKYAELKIKKKE

SEQ ID NO: 3353398 - protein, 17 aa, Plasmodium falciparum
DEEFILFGGEYNDNNEL

SEQ ID NO: 3353399 - protein, 18 aa, Plasmodium falciparum
DEEIVIFDLFINNECLYL

SEQ ID NO: 3353400 - protein, 23 aa, Plasmodium falciparum
DEEKKYICIKRIMNIINNKVESF

SEQ ID NO: 3353401 - protein, 23 aa, Plasmodium falciparum
DEEKRINVLYFINRFLYSNKTPL

SEQ ID NO: 3353402 - protein, 34 aa, Plasmodium falciparum
DEEQWICPLCSYLRSQIFFIDDVNAFKIIRRLCC

SEQ ID NO: 3353403 - protein, 39 aa, Plasmodium falciparum
DEESVNLAIKEYVLKTIYRKKNVDFLYEKLEFQQKDNLM

SEQ ID NO: 3353404 - protein, 33 aa, Plasmodium falciparum
DEEYNRLNIFARFSLKNYYLFDINKNLCSIYAF

SEQ ID NO: 3353405 - protein, 24 aa, Plasmodium falciparum
DEEYSSVNFMKFLKNCNDNEREVN

SEQ ID NO: 3353406 - protein, 27 aa, Plasmodium falciparum
DEFIDFCILCGCDYCDTIKGIGSKTAY

SEQ ID NO: 3353407 - protein, 31 aa, Plasmodium falciparum
DEFKNDLNCNFLWRHYEKILQDINHLSIDKL

SEQ ID NO: 3353408 - protein, 21 aa, Plasmodium falciparum
DEFNYEWLIDSYLKSNKSNIE

SEQ ID NO: 3353409 - protein, 17 aa, Plasmodium falciparum
DEFYEYWSNFTTVKKVD

SEQ ID NO: 3353410 - protein, 27 aa, Plasmodium falciparum
DEFYKNIIKKLLRVKNKIRAYKIQEAY

SEQ ID NO: 3353411 - protein, 23 aa, Plasmodium falciparum
DEGKGRQMCICYTKKDLNIHTIT

SEQ ID NO: 3353412 - protein, 18 aa, Plasmodium falciparum
DEGKKHIIGIKHENDNVK

SEQ ID NO: 3353413 - protein, 39 aa, Plasmodium falciparum
DEGMIFLWVTGRAMELARECLQIWGYKRVEEILWVKTNH

SEQ ID NO: 3353414 - protein, 17 aa, Plasmodium falciparum
DEHTSIFDICKEFESSE

SEQ ID NO: 3353415 - protein, 18 aa, Plasmodium falciparum
DEIEEIREAFNLLDTDGT

SEQ ID NO: 3353416 - protein, 20 aa, Plasmodium falciparum
DEIFKPIAYEKNGINIINKQ

SEQ ID NO: 3353417 - protein, 21 aa, Plasmodium falciparum
DEIHLVYKKRPIIIIEKNQII

SEQ ID NO: 3353418 - protein, 19 aa, Plasmodium falciparum
DEIISPCPWVVTPEFLEKY

SEQ ID NO: 3353419 - protein, 17 aa, Plasmodium falciparum
DEIKISCMMNHPNVVKT

SEQ ID NO: 3353420 - protein, 17 aa, Plasmodium falciparum
DEIKLKWNKNGSSLLLQ

SEQ ID NO: 3353421 - protein, 21 aa, Plasmodium falciparum
DEILKKSCEIEKLQDRLLDYE

SEQ ID NO: 3353422 - protein, 22 aa, Plasmodium falciparum
DEILKSSSFLYFLENSSKIVER

SEQ ID NO: 3353423 - protein, 21 aa, Plasmodium falciparum
DEIMFPIKFNFEKLKKNIYVI

SEQ ID NO: 3353424 - protein, 24 aa, Plasmodium falciparum
DEINKLCLQRGLYYNEHFTKQKKI

SEQ ID NO: 3353425 - protein, 18 aa, Plasmodium falciparum
DEINNCLNMVSLYNEQIS

SEQ ID NO: 3353426 - protein, 18 aa, Plasmodium falciparum
DEIPKINLGKNILNNNKI

SEQ ID NO: 3353427 - protein, 22 aa, Plasmodium falciparum
DEIPNKQWLYFLKSYKKRISKN

SEQ ID NO: 3353428 - protein, 21 aa, Plasmodium falciparum
DEISKWIPNRCNVTCVNDNAK

SEQ ID NO: 3353429 - protein, 20 aa, Plasmodium falciparum
DEITSRFALYCTLNNIQKII

SEQ ID NO: 3353430 - protein, 23 aa, Plasmodium falciparum
DEIYNRRKDILKKLENRNKKNMD

SEQ ID NO: 3353431 - protein, 24 aa, Plasmodium falciparum
DEKAGRKLLYLIKGLSMVHDKNTE

SEQ ID NO: 3353432 - protein, 24 aa, Plasmodium falciparum
DEKEQSKGFGFVCFASQEEANKAV

SEQ ID NO: 3353433 - protein, 26 aa, Plasmodium falciparum
DEKERIEELLKFYITNNRGINLEYNK

SEQ ID NO: 3353434 - protein, 24 aa, Plasmodium falciparum
DEKERMVLHINDYYNGLGTSRYVI

SEQ ID NO: 3353435 - protein, 24 aa, Plasmodium falciparum
DEKERRGLILLPENYIRYNLNEDN

SEQ ID NO: 3353436 - protein, 18 aa, Plasmodium falciparum
DEKFSVSSNALYDMSKVL

SEQ ID NO: 3353437 - protein, 42 aa, Plasmodium falciparum
DEKILLRMNIFTIRHKNHFYKLKFNNNFVIKRNKVFNKKNGK

SEQ ID NO: 3353438 - protein, 29 aa, Plasmodium falciparum
DEKKETFYFIFTFFMEPHFIWEELNIPIF

SEQ ID NO: 3353439 - protein, 26 aa, Plasmodium falciparum
DEKKFWFLHFSDIMKDIINNFIENEN

SEQ ID NO: 3353440 - protein, 24 aa, Plasmodium falciparum
DEKLKCKDKLFIKDEKVAQYLHIK

SEQ ID NO: 3353441 - protein, 18 aa, Plasmodium falciparum
DEKMLFDIFSSFGQIMTV

SEQ ID NO: 3353442 - protein, 44 aa, Plasmodium falciparum
DEKTSFLYHLNRLRSAVTVVDLHNYIAVFGPCLSYNKLPSTWNI

SEQ ID NO: 3353443 - protein, 20 aa, Plasmodium falciparum
DEKVILKLYQDRTHRIDSHV

SEQ ID NO: 3353444 - protein, 24 aa, Plasmodium falciparum
DEKWKRLNVHEGAQCFQELNRNPI

SEQ ID NO: 3353445 - protein, 17 aa, Plasmodium falciparum
DEKWSSIPIYKRQFYLH

SEQ ID NO: 3353446 - protein, 23 aa, Plasmodium falciparum
DELDRKKHEILELEIKKRRKMTD

SEQ ID NO: 3353447 - protein, 20 aa, Plasmodium falciparum
DELGIIFAYHLMKQYEKKNI

SEQ ID NO: 3353448 - protein, 17 aa, Plasmodium falciparum
DELIPHVIKEIKKREDA

SEQ ID NO: 3353449 - protein, 20 aa, Plasmodium falciparum
DELLYLRFWGIIKGTHNDYY

SEQ ID NO: 3353450 - protein, 34 aa, Plasmodium falciparum
DELRGSGKALRLCTKFFLDGYCNKSDKCPMAHHI

SEQ ID NO: 3353451 - protein, 24 aa, Plasmodium falciparum
DELRKIKDWDLKKWQPVIEDRFFL

SEQ ID NO: 3353452 - protein, 26 aa, Plasmodium falciparum
DELTKLKFYFLREFIIFIKKIKKLKT

SEQ ID NO: 3353453 - protein, 20 aa, Plasmodium falciparum
DELYFEPGYLIGNTNEEDSR

SEQ ID NO: 3353454 - protein, 20 aa, Plasmodium falciparum
DELYKTVLYFEKKNKKILKM

SEQ ID NO: 3353455 - protein, 32 aa, Plasmodium falciparum
DELYNRVKLLFEIRPIWCKDVLLEHVENISTY

SEQ ID NO: 3353456 - protein, 22 aa, Plasmodium falciparum
DEMKRNDLINEFFTNSDTLPLN

SEQ ID NO: 3353457 - protein, 21 aa, Plasmodium falciparum
DEMRMKIEIEMMNTGDENMSL

SEQ ID NO: 3353458 - protein, 30 aa, Plasmodium falciparum
DENKDICNMKSRFLKLEKYVNIKKKKIINI

SEQ ID NO: 3353459 - protein, 20 aa, Plasmodium falciparum
DENKFCFKENIKKPNDIYNE

SEQ ID NO: 3353460 - protein, 29 aa, Plasmodium falciparum
DENKKGCGQFKCFACDIYFINNDAKIQHE

SEQ ID NO: 3353461 - protein, 24 aa, Plasmodium falciparum
DENLIRGIYVYGFGSFNEICADAH

SEQ ID NO: 3353462 - protein, 23 aa, Plasmodium falciparum
DENLNLEFLKSSSENYTYKITSR

SEQ ID NO: 3353463 - protein, 20 aa, Plasmodium falciparum
DENLWKKYVQNVFIISSYLD

SEQ ID NO: 3353464 - protein, 25 aa, Plasmodium falciparum
DENNFSLPYFIFVLRDVNKEEFSKM

SEQ ID NO: 3353465 - protein, 17 aa, Plasmodium falciparum
DENRLADNYNVMNDERS

SEQ ID NO: 3353466 - protein, 31 aa, Plasmodium falciparum
DEPEKSFDCIQWKNLYSLDFIIKCFNSIGVL

SEQ ID NO: 3353467 - protein, 23 aa, Plasmodium falciparum
DEQEIDAELALIEDSILDENVEQ

SEQ ID NO: 3353468 - protein, 19 aa, Plasmodium falciparum
DEQFLKYFESFGEIEDGII

SEQ ID NO: 3353469 - protein, 19 aa, Plasmodium falciparum
DERCFKKTKGHVTVEINGD

SEQ ID NO: 3353470 - protein, 22 aa, Plasmodium falciparum
DERRLKKLILFAEHEILIEADV

SEQ ID NO: 3353471 - protein, 25 aa, Plasmodium falciparum
DESHLKSLLYFFGLSDEQIKSIMPL

SEQ ID NO: 3353472 - protein, 25 aa, Plasmodium falciparum
DESIARGCVLSAAMVSKHYKVKEYE

SEQ ID NO: 3353473 - protein, 22 aa, Plasmodium falciparum
DETAKVFSRRCGCDLGERHDEN

SEQ ID NO: 3353474 - protein, 27 aa, Plasmodium falciparum
DETGCVYVKLCMKYKEYSQVDNTIMLA

SEQ ID NO: 3353475 - protein, 24 aa, Plasmodium falciparum
DETIIYFNLFKLHNIMSLNILRSS

SEQ ID NO: 3353476 - protein, 17 aa, Plasmodium falciparum
DETKLIYPYALTLQKTF

SEQ ID NO: 3353477 - protein, 18 aa, Plasmodium falciparum
DETLMCFYEQLICELVEY

SEQ ID NO: 3353478 - protein, 17 aa, Plasmodium falciparum
DETLSTLDYVFRAKNIK

SEQ ID NO: 3353479 - protein, 25 aa, Plasmodium falciparum
DEVEEQVFLSSWIPSYLNEIKDIRT

SEQ ID NO: 3353480 - protein, 19 aa, Plasmodium falciparum
DEYFDICFDLLKKGNMYYT

SEQ ID NO: 3353481 - protein, 24 aa, Plasmodium falciparum
DEYFMSISFFSYVIEKWKILINKD

SEQ ID NO: 3353482 - protein, 25 aa, Plasmodium falciparum
DEYIKKEDCGDCQMVESTQMFDEEI

SEQ ID NO: 3353483 - protein, 22 aa, Plasmodium falciparum
DEYKCIGVSITKKGIDINSGTR

SEQ ID NO: 3353484 - protein, 17 aa, Plasmodium falciparum
DEYKKCFNYISLCDIIQ

SEQ ID NO: 3353485 - protein, 27 aa, Plasmodium falciparum
DEYKKCKETYLYLCANSNININNYTNL

SEQ ID NO: 3353486 - protein, 18 aa, Plasmodium falciparum
DEYLGTIVNAFGHMCVIS

SEQ ID NO: 3353487 - protein, 17 aa, Plasmodium falciparum
DEYPLFIGYSRKRFIAH

SEQ ID NO: 3353488 - protein, 26 aa, Plasmodium falciparum
DFAKAFGWKKIDRMLNHSFLFDVLKK

SEQ ID NO: 3353489 - protein, 18 aa, Plasmodium falciparum
DFASFFKQDLNSVKKQME

SEQ ID NO: 3353490 - protein, 30 aa, Plasmodium falciparum
DFATRMMEKMGWKKGEGLGKDKQGIKAPLI

SEQ ID NO: 3353491 - protein, 23 aa, Plasmodium falciparum
DFCDKCIYYRTVIKTSDSNVHMN

SEQ ID NO: 3353492 - protein, 20 aa, Plasmodium falciparum
DFCRKYRILNYLSDEEIKWL

SEQ ID NO: 3353493 - protein, 21 aa, Plasmodium falciparum
DFDLDSFLVLATDGILNVLSD

SEQ ID NO: 3353494 - protein, 23 aa, Plasmodium falciparum
DFDNRLKDLFSRENNEESTKHNW

SEQ ID NO: 3353495 - protein, 24 aa, Plasmodium falciparum
DFDVCLKHPLIILCYDDNMIRILN

SEQ ID NO: 3353496 - protein, 18 aa, Plasmodium falciparum
DFEGFLVDIYFEYKNEKY

SEQ ID NO: 3353497 - protein, 25 aa, Plasmodium falciparum
DFESFKKYCPIEYPKNRSINGMDDF

SEQ ID NO: 3353498 - protein, 21 aa, Plasmodium falciparum
DFEYSCPMERAYDIANHFNEY

SEQ ID NO: 3353499 - protein, 28 aa, Plasmodium falciparum
DFFIYFFPHHMCKYRNIEKYKFANEEKN

SEQ ID NO: 3353500 - protein, 32 aa, Plasmodium falciparum
DFFLESLPSLPKGLPKEVIKLIENSKLPQPDN

SEQ ID NO: 3353501 - protein, 20 aa, Plasmodium falciparum
DFFMYYVLNKEILKNKKKKK

SEQ ID NO: 3353502 - protein, 20 aa, Plasmodium falciparum
DFGCSAMEYATYYLENSKNF

SEQ ID NO: 3353503 - protein, 21 aa, Plasmodium falciparum
DFISFMMCKGLNIIKLINTLL

SEQ ID NO: 3353504 - protein, 21 aa, Plasmodium falciparum
DFITSFNWFFSQEANFQNKDK

SEQ ID NO: 3353505 - protein, 28 aa, Plasmodium falciparum
DFKESWFYKKIKPCIKKYMPKYTNEGHI

SEQ ID NO: 3353506 - protein, 22 aa, Plasmodium falciparum
DFKKLFEIYECDPLFEFTAVDL

SEQ ID NO: 3353507 - protein, 18 aa, Plasmodium falciparum
DFLFDDKTIICVGSNKDY

SEQ ID NO: 3353508 - protein, 19 aa, Plasmodium falciparum
DFLMYILRIYLHMIEVKNG

SEQ ID NO: 3353509 - protein, 27 aa, Plasmodium falciparum
DFLNFKYGFPYFWINALVEKPYSLSEK

SEQ ID NO: 3353510 - protein, 25 aa, Plasmodium falciparum
DFLYIQLNMCYIRYINNDAIEKYII

SEQ ID NO: 3353511 - protein, 26 aa, Plasmodium falciparum
DFMSSEKPLTCLVKAGSVNLPKNVFE

SEQ ID NO: 3353512 - protein, 22 aa, Plasmodium falciparum
DFNILNMFLKILINTNSFIHIK

SEQ ID NO: 3353513 - protein, 25 aa, Plasmodium falciparum
DFNINYLLCYKNNFGKCHIRVLQIF

SEQ ID NO: 3353514 - protein, 19 aa, Plasmodium falciparum
DFNKCRNAVINIFQNDHNM

SEQ ID NO: 3353515 - protein, 22 aa, Plasmodium falciparum
DFNKSDPFIQLNAWNVNVAYTY

SEQ ID NO: 3353516 - protein, 26 aa, Plasmodium falciparum
DFNNAYGNICSYNYNVNKNILNNNKV

SEQ ID NO: 3353517 - protein, 21 aa, Plasmodium falciparum
DFNSLHICPELDYFKEELKKH

SEQ ID NO: 3353518 - protein, 26 aa, Plasmodium falciparum
DFNWFYKKYKLISISLNRTYRKNLKK

SEQ ID NO: 3353519 - protein, 22 aa, Plasmodium falciparum
DFNYKACLDKWVPEPDKEPDND

SEQ ID NO: 3353520 - protein, 22 aa, Plasmodium falciparum
DFPLKQYRLHLGVQVNINDPKE

SEQ ID NO: 3353521 - protein, 19 aa, Plasmodium falciparum
DFPSSGPVNNSLFYINAIE

SEQ ID NO: 3353522 - protein, 25 aa, Plasmodium falciparum
DFQKYLRKYEELYQKFTPENDAENN

SEQ ID NO: 3353523 - protein, 24 aa, Plasmodium falciparum
DFRNFLKKKMDIIKECQQCNIVND

SEQ ID NO: 3353524 - protein, 18 aa, Plasmodium falciparum
DFRQMYWDLLKQIKKKYY

SEQ ID NO: 3353525 - protein, 22 aa, Plasmodium falciparum
DFRVKDCNHISLACNRNNKYIQ

SEQ ID NO: 3353526 - protein, 22 aa, Plasmodium falciparum
DFSDIYFSCNLANDKFINTQGA

SEQ ID NO: 3353527 - protein, 26 aa, Plasmodium falciparum
DFSEKFYRKKSYMLCYDKKNNKYIFG

SEQ ID NO: 3353528 - protein, 29 aa, Plasmodium falciparum
DFSLDYAKKVLCFWELDLGLNHVIKKHIL

SEQ ID NO: 3353529 - protein, 25 aa, Plasmodium falciparum
DFSLKCLKKNMEFILRKRQNKVISN

SEQ ID NO: 3353530 - protein, 18 aa, Plasmodium falciparum
DFSNSVWTEIVINSKIGS

SEQ ID NO: 3353531 - protein, 32 aa, Plasmodium falciparum
DFTAKACLKCFAKQDIIYSWGGFTDIPFDHNF

SEQ ID NO: 3353532 - protein, 23 aa, Plasmodium falciparum
DFVKLFNCLILFLKENDHNIYEQ

SEQ ID NO: 3353533 - protein, 21 aa, Plasmodium falciparum
DFVLNRGIKIYKEYDDVELAT

SEQ ID NO: 3353534 - protein, 25 aa, Plasmodium falciparum
DFVYLRALGIFYLRLIGKSLEVYNH

SEQ ID NO: 3353535 - protein, 19 aa, Plasmodium falciparum
DFYCRNNLNDSFDSLNNND

SEQ ID NO: 3353536 - protein, 26 aa, Plasmodium falciparum
DFYGGCSDYNIAVLLLYKRKNISCTP

SEQ ID NO: 3353537 - protein, 19 aa, Plasmodium falciparum
DFYHHFNIFIKKYISLKNK

SEQ ID NO: 3353538 - protein, 17 aa, Plasmodium falciparum
DFYIKKYFNEDLEDNNF

SEQ ID NO: 3353539 - protein, 24 aa, Plasmodium falciparum
DFYIYRQNFNFFPKELEVQLRKKK

SEQ ID NO: 3353540 - protein, 17 aa, Plasmodium falciparum
DGDNIILTMIWNINNIS

SEQ ID NO: 3353541 - protein, 24 aa, Plasmodium falciparum
DGDVEWITPSFLFQEILKQSTNNT

SEQ ID NO: 3353542 - protein, 19 aa, Plasmodium falciparum
DGEEVLKANVDDITYKKKN

SEQ ID NO: 3353543 - protein, 24 aa, Plasmodium falciparum
DGEKIKYNDVCIILDNEKNKMKEL

SEQ ID NO: 3353544 - protein, 24 aa, Plasmodium falciparum
DGELLKMFFHMSFEKQYKTFIYAK

SEQ ID NO: 3353545 - protein, 18 aa, Plasmodium falciparum
DGGRLCRPLIIIENGKSK

SEQ ID NO: 3353546 - protein, 17 aa, Plasmodium falciparum
DGIKLCSDKNCKHKMCS

SEQ ID NO: 3353547 - protein, 20 aa, Plasmodium falciparum
DGILKIKLPALAKKEPSIVT

SEQ ID NO: 3353548 - protein, 19 aa, Plasmodium falciparum
DGINKVPLWLAAWATASAP

SEQ ID NO: 3353549 - protein, 38 aa, Plasmodium falciparum
DGIVTNVSGATWIYAPPELLTCHPLKQSSDYNFLDHTK

SEQ ID NO: 3353550 - protein, 18 aa, Plasmodium falciparum
DGIWCMLPKNFPEMYDVY

SEQ ID NO: 3353551 - protein, 24 aa, Plasmodium falciparum
DGIYKSFIDCMEYLNKQKREYNEN

SEQ ID NO: 3353552 - protein, 20 aa, Plasmodium falciparum
DGKDKIIFVPVGTIVRKRIS

SEQ ID NO: 3353553 - protein, 21 aa, Plasmodium falciparum
DGKEVRYAVILSEAEKIIAYR

SEQ ID NO: 3353554 - protein, 19 aa, Plasmodium falciparum
DGKNLKFSQFLSSNSSNGV

SEQ ID NO: 3353555 - protein, 23 aa, Plasmodium falciparum
DGLKCNILSAIHCDEKNVLFYSL

SEQ ID NO: 3353556 - protein, 19 aa, Plasmodium falciparum
DGTLRKDRNVWINWNPNNA

SEQ ID NO: 3353557 - protein, 18 aa, Plasmodium falciparum
DGTVLPANMNHPNNMLNV

SEQ ID NO: 3353558 - protein, 22 aa, Plasmodium falciparum
DGVKIKCIWGKVCRTHGNSGVI

SEQ ID NO: 3353559 - protein, 17 aa, Plasmodium falciparum
DGVKRLCHIRGKMRKRV

SEQ ID NO: 3353560 - protein, 21 aa, Plasmodium falciparum
DGVLKIWDLRMNLFNISKKSS

SEQ ID NO: 3353561 - protein, 17 aa, Plasmodium falciparum
DGWNNLRANINFFDDLI

SEQ ID NO: 3353562 - protein, 20 aa, Plasmodium falciparum
DGYDKFRQGHVVDKDLNSTN

SEQ ID NO: 3353563 - protein, 26 aa, Plasmodium falciparum
DGYIGCGRKIFNYGGGCLNNEEGAAL

SEQ ID NO: 3353564 - protein, 33 aa, Plasmodium falciparum
DGYIKLWDLRFLKDSFFTTNIHSHWITSIHFNH

SEQ ID NO: 3353565 - protein, 20 aa, Plasmodium falciparum
DGYVIPKNYNFIISANRKLC

SEQ ID NO: 3353566 - protein, 33 aa, Plasmodium falciparum
DGYVIVPIHCEWLKRILENFFFIIKNNNIISYN

SEQ ID NO: 3353567 - protein, 20 aa, Plasmodium falciparum
DHAYLLKFDKLGRLYHEEPI

SEQ ID NO: 3353568 - protein, 24 aa, Plasmodium falciparum
DHEKYCTRKKKNIYCSYMNKSERF

SEQ ID NO: 3353569 - protein, 19 aa, Plasmodium falciparum
DHELWPFELDDMIIHIKKH

SEQ ID NO: 3353570 - protein, 23 aa, Plasmodium falciparum
DHHICKKGGGLDYINMNISKECK

SEQ ID NO: 3353571 - protein, 17 aa, Plasmodium falciparum
DHIKPEKKSYVNIDIDM

SEQ ID NO: 3353572 - protein, 25 aa, Plasmodium falciparum
DHIKRLEYQNNIFLNNMLNMYYVCI

SEQ ID NO: 3353573 - protein, 26 aa, Plasmodium falciparum
DHIKSCKKFNINVNIIKCCLKMYPKI

SEQ ID NO: 3353574 - protein, 18 aa, Plasmodium falciparum
DHILSLFYIKCESNKVDD

SEQ ID NO: 3353575 - protein, 25 aa, Plasmodium falciparum
DHKLGIKTTYAFIKNSIPFNFFHMV

SEQ ID NO: 3353576 - protein, 17 aa, Plasmodium falciparum
DHKSLEHKIHYNNNYTI

SEQ ID NO: 3353577 - protein, 17 aa, Plasmodium falciparum
DHLKIHLLGHKISEEKN

SEQ ID NO: 3353578 - protein, 21 aa, Plasmodium falciparum
DHLKKLSVCSNCYSKHHDLAK

SEQ ID NO: 3353579 - protein, 27 aa, Plasmodium falciparum
DHLKLIKEMFIHVFGVPNYHPLSKPFY

SEQ ID NO: 3353580 - protein, 17 aa, Plasmodium falciparum
DHLLDYKMFSAFLNGQI

SEQ ID NO: 3353581 - protein, 17 aa, Plasmodium falciparum
DHLNLLKNYNLNNYINL

SEQ ID NO: 3353582 - protein, 23 aa, Plasmodium falciparum
DHLPCDIKCFKIYKVTKSFDARK

SEQ ID NO: 3353583 - protein, 18 aa, Plasmodium falciparum
DHLTLLNIYLQWRSHNYS

SEQ ID NO: 3353584 - protein, 28 aa, Plasmodium falciparum
DHMNNTCPACRRSYEEKNFIYNKETHEK

SEQ ID NO: 3353585 - protein, 23 aa, Plasmodium falciparum
DHPDEYWTLYEMYKYNEMLQNKY

SEQ ID NO: 3353586 - protein, 22 aa, Plasmodium falciparum
DHPNIYRKNSFLLEQTLFSDDE

SEQ ID NO: 3353587 - protein, 40 aa, Plasmodium falciparum
DHPNSLKSACKWNLVFLNGQCSSFLNIFFKVFEAAKKNRP

SEQ ID NO: 3353588 - protein, 20 aa, Plasmodium falciparum
DHVIRKCYRYQQNSIVLKLE

SEQ ID NO: 3353589 - protein, 23 aa, Plasmodium falciparum
DHVPRVQLLPFFISSNYLYKNNK

SEQ ID NO: 3353590 - protein, 23 aa, Plasmodium falciparum
DHYENVCHFKSSVLTSQSSEEDS

SEQ ID NO: 3353591 - protein, 22 aa, Plasmodium falciparum
DHYYYYNCCRNEEYKYNDNNYI

SEQ ID NO: 3353592 - protein, 26 aa, Plasmodium falciparum
DICDEKKLNQYIVTFISSSSRDEFVN

SEQ ID NO: 3353593 - protein, 25 aa, Plasmodium falciparum
DICFVEELKCLLILTDDPYTSMSLW

SEQ ID NO: 3353594 - protein, 19 aa, Plasmodium falciparum
DICICPWNTNLLLALDNLG

SEQ ID NO: 3353595 - protein, 25 aa, Plasmodium falciparum
DIDEQRCIYNTCSKNNIYSINHYSG

SEQ ID NO: 3353596 - protein, 19 aa, Plasmodium falciparum
DIDKFLFNQNESISMDGTK

SEQ ID NO: 3353597 - protein, 25 aa, Plasmodium falciparum
DIDKLKPGFKLIRGNHEILTLIDAR

SEQ ID NO: 3353598 - protein, 23 aa, Plasmodium falciparum
DIDMRIKKLLNIEDHDNFKKKKK

SEQ ID NO: 3353599 - protein, 25 aa, Plasmodium falciparum
DIDNELKEALILSLREYTEKNKLEN

SEQ ID NO: 3353600 - protein, 24 aa, Plasmodium falciparum
DIDRKIRWFKMNNMLNPVKEAKSI

SEQ ID NO: 3353601 - protein, 18 aa, Plasmodium falciparum
DIEDFFIFDHALSYLNND

SEQ ID NO: 3353602 - protein, 21 aa, Plasmodium falciparum
DIEDRMKYLLILLNDTKKNNI

SEQ ID NO: 3353603 - protein, 18 aa, Plasmodium falciparum
DIEKLWIYLQNMYIYSEE

SEQ ID NO: 3353604 - protein, 19 aa, Plasmodium falciparum
DIENFLIERIFLLKEMNTS

SEQ ID NO: 3353605 - protein, 17 aa, Plasmodium falciparum
DIESIKDDVLIEYYDCQ

SEQ ID NO: 3353606 - protein, 27 aa, Plasmodium falciparum
DIESLLFKRVYDLAGTCSVRVYLNGQR

SEQ ID NO: 3353607 - protein, 19 aa, Plasmodium falciparum
DIESVKFLIENNADINALS

SEQ ID NO: 3353608 - protein, 19 aa, Plasmodium falciparum
DIFCDHCSSVYHMNVVTSL

SEQ ID NO: 3353609 - protein, 18 aa, Plasmodium falciparum
DIFEKCHIYEKNEEYENY

SEQ ID NO: 3353610 - protein, 20 aa, Plasmodium falciparum
DIFFHPKFSNALGVCDDNGY

SEQ ID NO: 3353611 - protein, 20 aa, Plasmodium falciparum
DIFNNLLYYFLSKIDLNKLR

SEQ ID NO: 3353612 - protein, 23 aa, Plasmodium falciparum
DIFQLNMRNPYIVNSYGNNSTNN

SEQ ID NO: 3353613 - protein, 23 aa, Plasmodium falciparum
DIFSKEIVEFIQASKISFNINDV

SEQ ID NO: 3353614 - protein, 25 aa, Plasmodium falciparum
DIGLNKKRYAHFIYIKEESELRLVA

SEQ ID NO: 3353615 - protein, 31 aa, Plasmodium falciparum
DIGTLIRSCFLLKWQCIFNIDNLNRKRKNKI

SEQ ID NO: 3353616 - protein, 19 aa, Plasmodium falciparum
DIGVCIILRAMGYESDQEI

SEQ ID NO: 3353617 - protein, 33 aa, Plasmodium falciparum
DIGVGANCIYPLLGNNIYKWSFLGTDINIDSLK

SEQ ID NO: 3353618 - protein, 20 aa, Plasmodium falciparum
DIHDELKRQLTIQEENNKTE

SEQ ID NO: 3353619 - protein, 30 aa, Plasmodium falciparum
DIHERCPLLLSENTLSLWLDVEKKYTDIID

SEQ ID NO: 3353620 - protein, 26 aa, Plasmodium falciparum
DIHGPKHIYHDLLYLYFKKLPDKKND

SEQ ID NO: 3353621 - protein, 23 aa, Plasmodium falciparum
DIHHLKNTLLYKVSTKDNINVHT

SEQ ID NO: 3353622 - protein, 18 aa, Plasmodium falciparum
DIHKCSDSHILYKGIGEC

SEQ ID NO: 3353623 - protein, 19 aa, Plasmodium falciparum
DIHLGHLAYTFLLEKTPKQ

SEQ ID NO: 3353624 - protein, 36 aa, Plasmodium falciparum
DIHRLNKYLFLFRVFQAEILMFFHINAWNNLYLKKY

SEQ ID NO: 3353625 - protein, 30 aa, Plasmodium falciparum
DIIDHIKYTLKYYITNLFRLKDLFNNEKEK

SEQ ID NO: 3353626 - protein, 18 aa, Plasmodium falciparum
DIIIKPLLYNSGHSYQMI

SEQ ID NO: 3353627 - protein, 19 aa, Plasmodium falciparum
DIIIKRCIENLSSKNVIFD

SEQ ID NO: 3353628 - protein, 25 aa, Plasmodium falciparum
DIIKEALLLRPPIPIKNKSLNIYYA

SEQ ID NO: 3353629 - protein, 17 aa, Plasmodium falciparum
DIIKPKRHYDLLCRILF

SEQ ID NO: 3353630 - protein, 24 aa, Plasmodium falciparum
DIIPKCFKIYASDFTLHMKDEKNI

SEQ ID NO: 3353631 - protein, 32 aa, Plasmodium falciparum
DIIPSRRGNITFKFGKHRLNDFLKNNQLKLII

SEQ ID NO: 3353632 - protein, 19 aa, Plasmodium falciparum
DIIQCSFCLIIKREEEEKS

SEQ ID NO: 3353633 - protein, 23 aa, Plasmodium falciparum
DIIQRAFMRIQIIYDDIIKDELI

SEQ ID NO: 3353634 - protein, 21 aa, Plasmodium falciparum
DIIRMKYYKSKFHLDDNDAIE

SEQ ID NO: 3353635 - protein, 19 aa, Plasmodium falciparum
DIISLLLLTCSKFQYFIEN

SEQ ID NO: 3353636 - protein, 20 aa, Plasmodium falciparum
DIISPLSVNSFISFDSYNSY

SEQ ID NO: 3353637 - protein, 21 aa, Plasmodium falciparum
DIKAKGRGGYASEIVKSNILK

SEQ ID NO: 3353638 - protein, 20 aa, Plasmodium falciparum
DIKALDFLLFDMLKDNLPNN

SEQ ID NO: 3353639 - protein, 24 aa, Plasmodium falciparum
DIKEKCSKAVCDMNSSDIEERNEK

SEQ ID NO: 3353640 - protein, 26 aa, Plasmodium falciparum
DIKEKIKHHYFFFFLQISDYLKYFYI

SEQ ID NO: 3353641 - protein, 23 aa, Plasmodium falciparum
DIKEKLCYIALNFDEEMKTSEQS

SEQ ID NO: 3353642 - protein, 29 aa, Plasmodium falciparum
DIKEVKYFYDFWYNFNNWRDFSYQNEYDY

SEQ ID NO: 3353643 - protein, 20 aa, Plasmodium falciparum
DIKGIPFVNIYKRISDSRKI

SEQ ID NO: 3353644 - protein, 24 aa, Plasmodium falciparum
DIKGLRYGSLMIMTDQDYDGSHIK

SEQ ID NO: 3353645 - protein, 29 aa, Plasmodium falciparum
DIKGSSKKKGFCFIEFYNINMAKKVMNNM

SEQ ID NO: 3353646 - protein, 26 aa, Plasmodium falciparum
DIKIFYANCDDILFLGCDGLFEMLSW

SEQ ID NO: 3353647 - protein, 24 aa, Plasmodium falciparum
DIKKCSQKKISERNPFSIHHYVKQ

SEQ ID NO: 3353648 - protein, 22 aa, Plasmodium falciparum
DIKKSYKKIVLLYHPDKNTHLC

SEQ ID NO: 3353649 - protein, 22 aa, Plasmodium falciparum
DIKKVCTNISSNYGSLNYVNRD

SEQ ID NO: 3353650 - protein, 26 aa, Plasmodium falciparum
DIKLKIPGMRIENIILPYKYNNDILR

SEQ ID NO: 3353651 - protein, 17 aa, Plasmodium falciparum
DIKNLYSTNNFVYVIFK

SEQ ID NO: 3353652 - protein, 22 aa, Plasmodium falciparum
DIKNRFPYININMVTLNGHVIS

SEQ ID NO: 3353653 - protein, 20 aa, Plasmodium falciparum
DIKSYRMISNVLLNINNIYQ

SEQ ID NO: 3353654 - protein, 23 aa, Plasmodium falciparum
DILCDNNIYNHCHDLGTYNPTYE

SEQ ID NO: 3353655 - protein, 21 aa, Plasmodium falciparum
DILCGLKVRTIFNEFLDEYVG

SEQ ID NO: 3353656 - protein, 20 aa, Plasmodium falciparum
DILDILPLSFIINIKNYEWK

SEQ ID NO: 3353657 - protein, 32 aa, Plasmodium falciparum
DILEMKPNILLSRFIFIYKLVDNISEDEIDEL

SEQ ID NO: 3353658 - protein, 24 aa, Plasmodium falciparum
DILFCSSRVLLSMSDYCMSEKDTN

SEQ ID NO: 3353659 - protein, 25 aa, Plasmodium falciparum
DILIEGVNIPWLYIGTLFSTFCWHT

SEQ ID NO: 3353660 - protein, 26 aa, Plasmodium falciparum
DILISGDWNGQVIIWKIEMNKLNENC

SEQ ID NO: 3353661 - protein, 20 aa, Plasmodium falciparum
DILKENKNNFSFLEKQPSDI

SEQ ID NO: 3353662 - protein, 24 aa, Plasmodium falciparum
DILLCTPGRLSFLLQETKLSLEKV

SEQ ID NO: 3353663 - protein, 18 aa, Plasmodium falciparum
DILMKRGADVSVRDINGD

SEQ ID NO: 3353664 - protein, 25 aa, Plasmodium falciparum
DILMNCIPQVFHLYKNINTSNDIKL

SEQ ID NO: 3353665 - protein, 22 aa, Plasmodium falciparum
DILMNLKILILDEADVLHTQEF

SEQ ID NO: 3353666 - protein, 17 aa, Plasmodium falciparum
DILNCVKNAYVFIYTCI

SEQ ID NO: 3353667 - protein, 24 aa, Plasmodium falciparum
DILNFAIPMGCNFIAASFIQSADD

SEQ ID NO: 3353668 - protein, 19 aa, Plasmodium falciparum
DILNSCINKNIESFIQEEK

SEQ ID NO: 3353669 - protein, 21 aa, Plasmodium falciparum
DILNTPLFVEPIFNDKHNVSN

SEQ ID NO: 3353670 - protein, 18 aa, Plasmodium falciparum
DILNVLRKYKIFKTEKYE

SEQ ID NO: 3353671 - protein, 24 aa, Plasmodium falciparum
DILQEYYLKFIITINTFCSFLKIL

SEQ ID NO: 3353672 - protein, 21 aa, Plasmodium falciparum
DILQKGICEEENYSSSSTNVA

SEQ ID NO: 3353673 - protein, 21 aa, Plasmodium falciparum
DILSQYGLTNCFYKIKKNNLG

SEQ ID NO: 3353674 - protein, 20 aa, Plasmodium falciparum
DILTPRWGYRYENENKKYLP

SEQ ID NO: 3353675 - protein, 23 aa, Plasmodium falciparum
DILVSKCLGNWCMFIGNDEELKK

SEQ ID NO: 3353676 - protein, 33 aa, Plasmodium falciparum
DILYIIDIYTRWCGPCIFTFEMINKIYKNNLIF

SEQ ID NO: 3353677 - protein, 26 aa, Plasmodium falciparum
DILYYQKLLLCLKYVGDHNSAINNNE

SEQ ID NO: 3353678 - protein, 18 aa, Plasmodium falciparum
DIMCSDIKYEKKIKRKKK

SEQ ID NO: 3353679 - protein, 27 aa, Plasmodium falciparum
DIMINKLFSCFTFLIRKKYNDLIKQKN

SEQ ID NO: 3353680 - protein, 27 aa, Plasmodium falciparum
DIMNKIKRFTHILSIHIIENDVANINF

SEQ ID NO: 3353681 - protein, 21 aa, Plasmodium falciparum
DINARNNFMYNQFNNPSVDHI

SEQ ID NO: 3353682 - protein, 24 aa, Plasmodium falciparum
DINCISCYIFLCITLGYHENMFYN

SEQ ID NO: 3353683 - protein, 18 aa, Plasmodium falciparum
DINKEIICEIITKKRKLR

SEQ ID NO: 3353684 - protein, 18 aa, Plasmodium falciparum
DINKLLETLIRFINSEYN

SEQ ID NO: 3353685 - protein, 17 aa, Plasmodium falciparum
DINRNGFRMSQLLSDDG

SEQ ID NO: 3353686 - protein, 17 aa, Plasmodium falciparum
DINSCTDSLLYIKHVLH

SEQ ID NO: 3353687 - protein, 20 aa, Plasmodium falciparum
DINSSCFVEDCMRIRRSKLN

SEQ ID NO: 3353688 - protein, 22 aa, Plasmodium falciparum
DIPHIIKKSVDIHLSTNIDTKI

SEQ ID NO: 3353689 - protein, 30 aa, Plasmodium falciparum
DIPKCKVQILPSQICSPGVSSPFISAPKQA

SEQ ID NO: 3353690 - protein, 19 aa, Plasmodium falciparum
DIPKRLKSKWFNVNILPYN

SEQ ID NO: 3353691 - protein, 20 aa, Plasmodium falciparum
DIPSNCWFNCQIASKQIHNC

SEQ ID NO: 3353692 - protein, 17 aa, Plasmodium falciparum
DIQEKYNSLDIVDKNKT

SEQ ID NO: 3353693 - protein, 25 aa, Plasmodium falciparum
DIQEYYVGVPYSWEYVEDSKSWFIV

SEQ ID NO: 3353694 - protein, 24 aa, Plasmodium falciparum
DIQNCLSCALHSYKLNAPLNNIDS

SEQ ID NO: 3353695 - protein, 20 aa, Plasmodium falciparum
DIRCSKCKKLFNHINDLPNH

SEQ ID NO: 3353696 - protein, 23 aa, Plasmodium falciparum
DIRKELLQSIVITGGSSLFPGLI

SEQ ID NO: 3353697 - protein, 25 aa, Plasmodium falciparum
DIRKKEVLVTLLLCSLINKNSFVLC

SEQ ID NO: 3353698 - protein, 18 aa, Plasmodium falciparum
DIRLWKYIKTVECNKNDI

SEQ ID NO: 3353699 - protein, 20 aa, Plasmodium falciparum
DIRMIDFANTIYLQDNPSAD

SEQ ID NO: 3353700 - protein, 18 aa, Plasmodium falciparum
DIRNCYKISHEGIYPLKF

SEQ ID NO: 3353701 - protein, 20 aa, Plasmodium falciparum
DIRSRKCIHQFYSHTDTIFN

SEQ ID NO: 3353702 - protein, 17 aa, Plasmodium falciparum
DISAKVCIDKLSKGQYD

SEQ ID NO: 3353703 - protein, 19 aa, Plasmodium falciparum
DISDVLLKSLIYRYDEYKY

SEQ ID NO: 3353704 - protein, 25 aa, Plasmodium falciparum
DISEIKLQEGSVCRSTKDIDEDNYN

SEQ ID NO: 3353705 - protein, 19 aa, Plasmodium falciparum
DISEMKAFEQIQRDIEHTR

SEQ ID NO: 3353706 - protein, 20 aa, Plasmodium falciparum
DISFICYYLGYKSCPYLICC

SEQ ID NO: 3353707 - protein, 34 aa, Plasmodium falciparum
DISFLDYKEWWNVVGSFRCSGVINSIIWSNNDTL

SEQ ID NO: 3353708 - protein, 25 aa, Plasmodium falciparum
DISFLHLSCTWELFDNVENDTSYYD

SEQ ID NO: 3353709 - protein, 18 aa, Plasmodium falciparum
DISLKRIEKIRMKNKIFH

SEQ ID NO: 3353710 - protein, 19 aa, Plasmodium falciparum
DISNFKFIDFMPIKDHLLK

SEQ ID NO: 3353711 - protein, 23 aa, Plasmodium falciparum
DISRKGNEFQFLREQELLCHFNC

SEQ ID NO: 3353712 - protein, 25 aa, Plasmodium falciparum
DISTLKKVSWAFGLIDKNFYFTDFI

SEQ ID NO: 3353713 - protein, 24 aa, Plasmodium falciparum
DISTRPDNSYGRSVYVSNLSEDIS

SEQ ID NO: 3353714 - protein, 25 aa, Plasmodium falciparum
DISVSRFHALIKFHNGNFYIEDCKS

SEQ ID NO: 3353715 - protein, 26 aa, Plasmodium falciparum
DITFLNNRFITWDSYFEDSEIQKCSS

SEQ ID NO: 3353716 - protein, 20 aa, Plasmodium falciparum
DITPEFERSLYLYGPSRSLS

SEQ ID NO: 3353717 - protein, 17 aa, Plasmodium falciparum
DIVDIYCTLYIHLVQNL

SEQ ID NO: 3353718 - protein, 18 aa, Plasmodium falciparum
DIVKCGDRVRVWGVYRAN

SEQ ID NO: 3353719 - protein, 25 aa, Plasmodium falciparum
DIVKSELFHFYSYDEPNNFITNKIN

SEQ ID NO: 3353720 - protein, 21 aa, Plasmodium falciparum
DIVKSHCKLGLTATLVREDLL

SEQ ID NO: 3353721 - protein, 18 aa, Plasmodium falciparum
DIVTEFVEYIRKTYTKGI

SEQ ID NO: 3353722 - protein, 17 aa, Plasmodium falciparum
DIVYRKNIDIVCAKDLF

SEQ ID NO: 3353723 - protein, 23 aa, Plasmodium falciparum
DIYDCPYKSIFYLWNEKNIYINI

SEQ ID NO: 3353724 - protein, 17 aa, Plasmodium falciparum
DIYDYIINISYILNEKY

SEQ ID NO: 3353725 - protein, 19 aa, Plasmodium falciparum
DIYESYKLVFASERELEDI

SEQ ID NO: 3353726 - protein, 25 aa, Plasmodium falciparum
DIYGNACDVIACKENMYINEKDSYS

SEQ ID NO: 3353727 - protein, 27 aa, Plasmodium falciparum
DIYGYKNCKKRCIQFIEDDTICNDDID

SEQ ID NO: 3353728 - protein, 19 aa, Plasmodium falciparum
DIYKKVHLENNVYDNIIYD

SEQ ID NO: 3353729 - protein, 19 aa, Plasmodium falciparum
DIYKYSILIFLSSKNGNFI

SEQ ID NO: 3353730 - protein, 30 aa, Plasmodium falciparum
DIYLCGKCDNCVYCLNLIKKKNGIKTNKIN

SEQ ID NO: 3353731 - protein, 21 aa, Plasmodium falciparum
DIYLCGSEYIIDLIKNLADIL

SEQ ID NO: 3353732 - protein, 24 aa, Plasmodium falciparum
DIYLKNLLLNFLNYIYQGSYILTT

SEQ ID NO: 3353733 - protein, 24 aa, Plasmodium falciparum
DIYMLGVLFLRIWNSKPLWLIANI

SEQ ID NO: 3353734 - protein, 18 aa, Plasmodium falciparum
DIYSVSMILLYEYLKGLQ

SEQ ID NO: 3353735 - protein, 19 aa, Plasmodium falciparum
DIYTNVFFFSGNKEKKINN

SEQ ID NO: 3353736 - protein, 21 aa, Plasmodium falciparum
DKAKQFLFKAFVVGSSDNLLY

SEQ ID NO: 3353737 - protein, 20 aa, Plasmodium falciparum
DKCHVLRNIPTFYMSSFSGS

SEQ ID NO: 3353738 - protein, 19 aa, Plasmodium falciparum
DKDEIKLHCGVNIKINKLK

SEQ ID NO: 3353739 - protein, 20 aa, Plasmodium falciparum
DKDIHICLKKGKKRNNSMEH

SEQ ID NO: 3353740 - protein, 20 aa, Plasmodium falciparum
DKDIKRRKKKEHFNNSFSKT

SEQ ID NO: 3353741 - protein, 17 aa, Plasmodium falciparum
DKDILKEKCYTEGTKDL

SEQ ID NO: 3353742 - protein, 19 aa, Plasmodium falciparum
DKEDLFFNDQDDFLLHDDN

SEQ ID NO: 3353743 - protein, 19 aa, Plasmodium falciparum
DKEEIKKDIYLLNIRDSQN

SEQ ID NO: 3353744 - protein, 23 aa, Plasmodium falciparum
DKEISLSNNISMLLDRISDNSDI

SEQ ID NO: 3353745 - protein, 22 aa, Plasmodium falciparum
DKEIYSLWYFCDKKIHSAKLKG

SEQ ID NO: 3353746 - protein, 20 aa, Plasmodium falciparum
DKEKECPVNLLNQNNSSVLY

SEQ ID NO: 3353747 - protein, 25 aa, Plasmodium falciparum
DKEKELFQYLILKAINEIEQISTKL

SEQ ID NO: 3353748 - protein, 18 aa, Plasmodium falciparum
DKEKINTLMELYKNENIY

SEQ ID NO: 3353749 - protein, 26 aa, Plasmodium falciparum
DKEKKLIEKIVWPEIYNKKIDVNKIK

SEQ ID NO: 3353750 - protein, 24 aa, Plasmodium falciparum
DKEKRKICRIFFLTHFHADHYTNI

SEQ ID NO: 3353751 - protein, 23 aa, Plasmodium falciparum
DKEKYCNNEKVWAHNMNESKEKI

SEQ ID NO: 3353752 - protein, 20 aa, Plasmodium falciparum
DKELLHFFDRYNIKYQIVLS

SEQ ID NO: 3353753 - protein, 18 aa, Plasmodium falciparum
DKELQIGCFLKEENNNNK

SEQ ID NO: 3353754 - protein, 23 aa, Plasmodium falciparum
DKELRKILFEQIHNFSKFISDPD

SEQ ID NO: 3353755 - protein, 19 aa, Plasmodium falciparum
DKEPFFFSIQLPNMLPALL

SEQ ID NO: 3353756 - protein, 40 aa, Plasmodium falciparum
DKESEILKIKGEKNILITCIETWKCFCKNSKEEISRLKEI

SEQ ID NO: 3353757 - protein, 26 aa, Plasmodium falciparum
DKESIYFKCLFSDLINDFEYIQNKKY

SEQ ID NO: 3353758 - protein, 37 aa, Plasmodium falciparum
DKETFLQFFPLPGLWGERLFLKFNFKNTGFIDFEEFI

SEQ ID NO: 3353759 - protein, 18 aa, Plasmodium falciparum
DKEVKGNNVGTHTTLLRK

SEQ ID NO: 3353760 - protein, 19 aa, Plasmodium falciparum
DKEVLYLVCISKVNESINY

SEQ ID NO: 3353761 - protein, 21 aa, Plasmodium falciparum
DKEWPQVHAYLKKRWSKETNI

SEQ ID NO: 3353762 - protein, 20 aa, Plasmodium falciparum
DKFFYELNMEYIEKEILEKY

SEQ ID NO: 3353763 - protein, 18 aa, Plasmodium falciparum
DKFLCKIPKELFIENQSL

SEQ ID NO: 3353764 - protein, 18 aa, Plasmodium falciparum
DKFRLYIEHYFLYCNTFE

SEQ ID NO: 3353765 - protein, 23 aa, Plasmodium falciparum
DKFSESIPRWLTFLRGIVDSENL

SEQ ID NO: 3353766 - protein, 23 aa, Plasmodium falciparum
DKFWKISECYVRGNSIKYIRVQD

SEQ ID NO: 3353767 - protein, 25 aa, Plasmodium falciparum
DKFYDIKRFMCLGSTIRDNDNLYDI

SEQ ID NO: 3353768 - protein, 17 aa, Plasmodium falciparum
DKGPLIKCSFEETVEIL

SEQ ID NO: 3353769 - protein, 24 aa, Plasmodium falciparum
DKGSFKLNNCYEGDINSRTSSNIN

SEQ ID NO: 3353770 - protein, 17 aa, Plasmodium falciparum
DKHEILIPLEGYDKKKY

SEQ ID NO: 3353771 - protein, 17 aa, Plasmodium falciparum
DKHGCLHLIIDEMRDLF

SEQ ID NO: 3353772 - protein, 33 aa, Plasmodium falciparum
DKHIKLKKCRALLNALNRTSCIIFTKKKKREKK

SEQ ID NO: 3353773 - protein, 18 aa, Plasmodium falciparum
DKHKLIYHVLRVNKKYNF

SEQ ID NO: 3353774 - protein, 17 aa, Plasmodium falciparum
DKHKWYISFKKAQLNYI

SEQ ID NO: 3353775 - protein, 18 aa, Plasmodium falciparum
DKHLFEYLLNPKLYIPGT

SEQ ID NO: 3353776 - protein, 19 aa, Plasmodium falciparum
DKHLWKSCNHGYYKNFKKK

SEQ ID NO: 3353777 - protein, 25 aa, Plasmodium falciparum
DKHNIDLIAKIIFQLLDELTYYNKN

SEQ ID NO: 3353778 - protein, 24 aa, Plasmodium falciparum
DKIALSRRVDKHWRLIGWGQINKG

SEQ ID NO: 3353779 - protein, 18 aa, Plasmodium falciparum
DKICDKICDKKYDKIYDK

SEQ ID NO: 3353780 - protein, 19 aa, Plasmodium falciparum
DKIDISSINLFFLNNYTIK

SEQ ID NO: 3353781 - protein, 20 aa, Plasmodium falciparum
DKIDTLNCYINEKLNMDCQN

SEQ ID NO: 3353782 - protein, 20 aa, Plasmodium falciparum
DKIGEILCRLNFSLINVNRG

SEQ ID NO: 3353783 - protein, 19 aa, Plasmodium falciparum
DKIHKCPLTNYPVDIKDMS

SEQ ID NO: 3353784 - protein, 28 aa, Plasmodium falciparum
DKIIHFCIFKFIYYMCMDILYNNRNENF

SEQ ID NO: 3353785 - protein, 30 aa, Plasmodium falciparum
DKIILMDGIKSARAQADMSIANDIKNKIKI

SEQ ID NO: 3353786 - protein, 24 aa, Plasmodium falciparum
DKIKEFTVTLSILEIYNEVIYDLI

SEQ ID NO: 3353787 - protein, 17 aa, Plasmodium falciparum
DKIKEILDPSINQESIS

SEQ ID NO: 3353788 - protein, 19 aa, Plasmodium falciparum
DKIKKNKEELLNYDKELKN

SEQ ID NO: 3353789 - protein, 37 aa, Plasmodium falciparum
DKIKKVKVIPGKWEGNGLLGIHISYEFLNALNEGVRI

SEQ ID NO: 3353790 - protein, 22 aa, Plasmodium falciparum
DKIKNRLLYDENFENNSDPTYF

SEQ ID NO: 3353791 - protein, 23 aa, Plasmodium falciparum
DKIKRSKIANIFNKHFKNDNIQN

SEQ ID NO: 3353792 - protein, 23 aa, Plasmodium falciparum
DKIKSSLLCFIKNIHFSPVTWIL

SEQ ID NO: 3353793 - protein, 18 aa, Plasmodium falciparum
DKIKTALISLNTIKKNNY

SEQ ID NO: 3353794 - protein, 18 aa, Plasmodium falciparum
DKILFTYIIDEFLYRATI

SEQ ID NO: 3353795 - protein, 19 aa, Plasmodium falciparum
DKILKIALLMDIFMAILDT

SEQ ID NO: 3353796 - protein, 19 aa, Plasmodium falciparum
DKILLWLGANVMVEFPFDE

SEQ ID NO: 3353797 - protein, 25 aa, Plasmodium falciparum
DKINEIKCSYAFLKNKNNWIDQVTR

SEQ ID NO: 3353798 - protein, 30 aa, Plasmodium falciparum
DKINKKETLNCSDISIKLKNNMNSDKDEKD

SEQ ID NO: 3353799 - protein, 17 aa, Plasmodium falciparum
DKINLLNQIGYITNEEK

SEQ ID NO: 3353800 - protein, 24 aa, Plasmodium falciparum
DKISEQMISPFIKDDIIKHKQYCI

SEQ ID NO: 3353801 - protein, 25 aa, Plasmodium falciparum
DKITYELSQNIILAFDNHENINNKD

SEQ ID NO: 3353802 - protein, 24 aa, Plasmodium falciparum
DKIYDPRCALLYSSLSYMNIVDSS

SEQ ID NO: 3353803 - protein, 23 aa, Plasmodium falciparum
DKIYNELCIFDFYDFNNRKKLYN

SEQ ID NO: 3353804 - protein, 21 aa, Plasmodium falciparum
DKKAIRLFAILKPLKVIITNY

SEQ ID NO: 3353805 - protein, 20 aa, Plasmodium falciparum
DKKASLGSVKETYEKETQTE

SEQ ID NO: 3353806 - protein, 19 aa, Plasmodium falciparum
DKKCKYAHTNIELRATENL

SEQ ID NO: 3353807 - protein, 24 aa, Plasmodium falciparum
DKKDLCLLMLLFIKCKKKCKTFIY

SEQ ID NO: 3353808 - protein, 24 aa, Plasmodium falciparum
DKKDYYKLISFFTLLLSTNWFNED

SEQ ID NO: 3353809 - protein, 24 aa, Plasmodium falciparum
DKKEERFIYTLGTFDGSVYFYDSE

SEQ ID NO: 3353810 - protein, 17 aa, Plasmodium falciparum
DKKELIEGYNILRSFKN

SEQ ID NO: 3353811 - protein, 18 aa, Plasmodium falciparum
DKKEPFKIHCTKDKIYIK

SEQ ID NO: 3353812 - protein, 25 aa, Plasmodium falciparum
DKKGHFFGDILVRFINKEQKYLALK

SEQ ID NO: 3353813 - protein, 17 aa, Plasmodium falciparum
DKKGVVHINIWKEELGK

SEQ ID NO: 3353814 - protein, 20 aa, Plasmodium falciparum
DKKKERAYTLGAINGIGDID

SEQ ID NO: 3353815 - protein, 24 aa, Plasmodium falciparum
DKKKLNHFANEFIRINNKNNTNNN

SEQ ID NO: 3353816 - protein, 19 aa, Plasmodium falciparum
DKKKPCGIYKNTNSNSNTN

SEQ ID NO: 3353817 - protein, 24 aa, Plasmodium falciparum
DKKLEKFKSFIIEDSNSSSSGKKK

SEQ ID NO: 3353818 - protein, 21 aa, Plasmodium falciparum
DKKLTEGFYCFTQHENVIGLT

SEQ ID NO: 3353819 - protein, 23 aa, Plasmodium falciparum
DKKNNKYIFGYFILILANQIKWK

SEQ ID NO: 3353820 - protein, 17 aa, Plasmodium falciparum
DKKVELFDVLKNTTHKL

SEQ ID NO: 3353821 - protein, 33 aa, Plasmodium falciparum
DKKWLHLYKIWKLIPLTLKFKAINSRDVNICKP

SEQ ID NO: 3353822 - protein, 23 aa, Plasmodium falciparum
DKLELFDEILIHIKRNFYEKILN

SEQ ID NO: 3353823 - protein, 23 aa, Plasmodium falciparum
DKLKEKIILISLIKNKDIFQTLI

SEQ ID NO: 3353824 - protein, 23 aa, Plasmodium falciparum
DKLKTVILGLSYYHSLLLGRFLY

SEQ ID NO: 3353825 - protein, 18 aa, Plasmodium falciparum
DKLLKNVMKKEEIDKKEK

SEQ ID NO: 3353826 - protein, 17 aa, Plasmodium falciparum
DKLRQELLFALTTETAW

SEQ ID NO: 3353827 - protein, 21 aa, Plasmodium falciparum
DKLYEDVYMIRSLNADMDEET

SEQ ID NO: 3353828 - protein, 19 aa, Plasmodium falciparum
DKMEGFITCNIVKSKKVIL

SEQ ID NO: 3353829 - protein, 20 aa, Plasmodium falciparum
DKMLDMGFELQIRKIVDQIR

SEQ ID NO: 3353830 - protein, 24 aa, Plasmodium falciparum
DKMLMLRNNFHMDNNIHNRSNSSN

SEQ ID NO: 3353831 - protein, 19 aa, Plasmodium falciparum
DKNCYAMGCNQFYQINYDK

SEQ ID NO: 3353832 - protein, 33 aa, Plasmodium falciparum
DKNEAHINWTIWEKKWDKWRNNIDHILTQHNKN

SEQ ID NO: 3353833 - protein, 25 aa, Plasmodium falciparum
DKNEFERIKFETIQHDDMIRTMENK

SEQ ID NO: 3353834 - protein, 24 aa, Plasmodium falciparum
DKNFKLSELMYLFEYVISKHIVES

SEQ ID NO: 3353835 - protein, 24 aa, Plasmodium falciparum
DKNFLECILLQLVHVKKFKNTYYN

SEQ ID NO: 3353836 - protein, 18 aa, Plasmodium falciparum
DKNISLIFYNLLVLASND

SEQ ID NO: 3353837 - protein, 17 aa, Plasmodium falciparum
DKNKCSHNINNSTPESI

SEQ ID NO: 3353838 - protein, 31 aa, Plasmodium falciparum
DKNKFLLLQNRRLKCIIIESNCNKDFICRKS

SEQ ID NO: 3353839 - protein, 17 aa, Plasmodium falciparum
DKNKIHLLKSVDMHDNL

SEQ ID NO: 3353840 - protein, 25 aa, Plasmodium falciparum
DKNKKNLVCSIEIFLSNSGNNAYNR

SEQ ID NO: 3353841 - protein, 20 aa, Plasmodium falciparum
DKNKNFVIGRKRYVKRNLKK

SEQ ID NO: 3353842 - protein, 20 aa, Plasmodium falciparum
DKNKPSSCDIKWIDFTYSLQ

SEQ ID NO: 3353843 - protein, 22 aa, Plasmodium falciparum
DKNKRKIILNTLEEICSVNDNS

SEQ ID NO: 3353844 - protein, 23 aa, Plasmodium falciparum
DKNLDQKIILFIGSPFHVNEKQL

SEQ ID NO: 3353845 - protein, 27 aa, Plasmodium falciparum
DKNLPTEKYPGAVLETVDNNFGYPNYE

SEQ ID NO: 3353846 - protein, 23 aa, Plasmodium falciparum
DKNNVICPLCVEVLDETDRNFFP

SEQ ID NO: 3353847 - protein, 19 aa, Plasmodium falciparum
DKNTCPHIRKESLSKYETK

SEQ ID NO: 3353848 - protein, 19 aa, Plasmodium falciparum
DKNWCKYMKILHKKKIVKA

SEQ ID NO: 3353849 - protein, 27 aa, Plasmodium falciparum
DKPEWGLKYLFYQSIISNYILKMLLNY

SEQ ID NO: 3353850 - protein, 19 aa, Plasmodium falciparum
DKPFFCGSEIIIRDDDSGP

SEQ ID NO: 3353851 - protein, 23 aa, Plasmodium falciparum
DKPQLPPYCRYSSTMKSSMGLGN

SEQ ID NO: 3353852 - protein, 22 aa, Plasmodium falciparum
DKQNVVHFICNIEKFIEKNMNL

SEQ ID NO: 3353853 - protein, 23 aa, Plasmodium falciparum
DKREYGFNNCMNYTNINCSNINQ

SEQ ID NO: 3353854 - protein, 19 aa, Plasmodium falciparum
DKRFRADHDLTIGVEFGAR

SEQ ID NO: 3353855 - protein, 19 aa, Plasmodium falciparum
DKRIDNFEMTYMNTTHGKI

SEQ ID NO: 3353856 - protein, 20 aa, Plasmodium falciparum
DKRLKKFRFRQVLVDEATQS

SEQ ID NO: 3353857 - protein, 18 aa, Plasmodium falciparum
DKRMCDDLLSPGIDDSIE

SEQ ID NO: 3353858 - protein, 21 aa, Plasmodium falciparum
DKRNSSCVRKVDAMQNEMKAV

SEQ ID NO: 3353859 - protein, 27 aa, Plasmodium falciparum
DKSCLLKKWHVGLIIALRNIISKRIDH

SEQ ID NO: 3353860 - protein, 29 aa, Plasmodium falciparum
DKSGGEKVRILFLSLFLKKSNLLLLDEIN

SEQ ID NO: 3353861 - protein, 17 aa, Plasmodium falciparum
DKSHACMDDNILNSYAI

SEQ ID NO: 3353862 - protein, 21 aa, Plasmodium falciparum
DKSNNTSICDINKNESLSSLH

SEQ ID NO: 3353863 - protein, 25 aa, Plasmodium falciparum
DKSSEDWKQYKLINLVDDDKLKKNQ

SEQ ID NO: 3353864 - protein, 29 aa, Plasmodium falciparum
DKSVEYYFCCNICGIPCVNKFKKHKSCKL

SEQ ID NO: 3353865 - protein, 28 aa, Plasmodium falciparum
DKSVYFCKEYEAFLCLCDDNLYSFKIDE

SEQ ID NO: 3353866 - protein, 24 aa, Plasmodium falciparum
DKSYKNLLVYDILYKVLQNYRKSM

SEQ ID NO: 3353867 - protein, 18 aa, Plasmodium falciparum
DKTILKYLLNQNISFLQN

SEQ ID NO: 3353868 - protein, 21 aa, Plasmodium falciparum
DKTKCVNGNEIIICSDDESYE

SEQ ID NO: 3353869 - protein, 18 aa, Plasmodium falciparum
DKTLFLFYNVLLKVSVHI

SEQ ID NO: 3353870 - protein, 19 aa, Plasmodium falciparum
DKTLWRVVQDIADVVCARA

SEQ ID NO: 3353871 - protein, 17 aa, Plasmodium falciparum
DKTSIIFNRKNKIQQNN

SEQ ID NO: 3353872 - protein, 17 aa, Plasmodium falciparum
DKTTCIINTTSKENVSD

SEQ ID NO: 3353873 - protein, 27 aa, Plasmodium falciparum
DKVDRMIIGGGMAYTFKKVLNNMKIGT

SEQ ID NO: 3353874 - protein, 31 aa, Plasmodium falciparum
DKVLEDMKSLIPLNCNGAIKKSSTNTQKKNV

SEQ ID NO: 3353875 - protein, 29 aa, Plasmodium falciparum
DKVMKFSKFCVYPDFLHACNKNRNKHNNN

SEQ ID NO: 3353876 - protein, 44 aa, Plasmodium falciparum
DKVNRKAYIVKRVPVNKNISFNLAKFIAEKYINMLRKNLRKREI

SEQ ID NO: 3353877 - protein, 20 aa, Plasmodium falciparum
DKVSKGWVRRFQKKQIKLNE

SEQ ID NO: 3353878 - protein, 18 aa, Plasmodium falciparum
DKVWKCYCAFEKASDNFN

SEQ ID NO: 3353879 - protein, 23 aa, Plasmodium falciparum
DKVYFFKFIKIFDMKPNYRFKQK

SEQ ID NO: 3353880 - protein, 22 aa, Plasmodium falciparum
DKWITIKFGRQILNSIKNLNND

SEQ ID NO: 3353881 - protein, 21 aa, Plasmodium falciparum
DKWLECEATINLYLKDLILPS

SEQ ID NO: 3353882 - protein, 24 aa, Plasmodium falciparum
DKWLLESCLKLLKNHPIQIPIVIC

SEQ ID NO: 3353883 - protein, 27 aa, Plasmodium falciparum
DKWLVELDNSIPIKIREKCSVHTKEYI

SEQ ID NO: 3353884 - protein, 21 aa, Plasmodium falciparum
DKYDLMGKFKLYEHIESELKE

SEQ ID NO: 3353885 - protein, 24 aa, Plasmodium falciparum
DKYGKLQFNKSFFQQFIKEKYSKY

SEQ ID NO: 3353886 - protein, 18 aa, Plasmodium falciparum
DKYKFKHEYLFKNASFEV

SEQ ID NO: 3353887 - protein, 23 aa, Plasmodium falciparum
DKYKMEHEEFISLENNKNSNTND

SEQ ID NO: 3353888 - protein, 32 aa, Plasmodium falciparum
DKYLQCIHASVLKKKHYAPIVFQALHSTYINI

SEQ ID NO: 3353889 - protein, 17 aa, Plasmodium falciparum
DKYLYKQFIIFSDDNTN

SEQ ID NO: 3353890 - protein, 22 aa, Plasmodium falciparum
DKYNYCFKKYYELYLLNKDSDN

SEQ ID NO: 3353891 - protein, 22 aa, Plasmodium falciparum
DKYPCLFNCSYYVDSMKTIKYD

SEQ ID NO: 3353892 - protein, 18 aa, Plasmodium falciparum
DKYPEGYINQTILNNNNN

SEQ ID NO: 3353893 - protein, 23 aa, Plasmodium falciparum
DKYRKPRIGMYLFATQNYKQNLD

SEQ ID NO: 3353894 - protein, 19 aa, Plasmodium falciparum
DLAKAIICRVTKMHFEANY

SEQ ID NO: 3353895 - protein, 21 aa, Plasmodium falciparum
DLCKYKYDNFLSSYKKNVATQ

SEQ ID NO: 3353896 - protein, 26 aa, Plasmodium falciparum
DLDKCGRRDIGMFLILCTGNTAKHNK

SEQ ID NO: 3353897 - protein, 20 aa, Plasmodium falciparum
DLDNIYSIDCEMCETTNHQR

SEQ ID NO: 3353898 - protein, 18 aa, Plasmodium falciparum
DLEIKRFKEQIGDMHNRI

SEQ ID NO: 3353899 - protein, 18 aa, Plasmodium falciparum
DLEKKFELSLSIGNLQLC

SEQ ID NO: 3353900 - protein, 23 aa, Plasmodium falciparum
DLENYCAKKLMNIEKFKRPNHNQ

SEQ ID NO: 3353901 - protein, 23 aa, Plasmodium falciparum
DLERRSYNIISFRNYISSIKISD

SEQ ID NO: 3353902 - protein, 25 aa, Plasmodium falciparum
DLETIKSCYKKLILLFHPDKNKGTA

SEQ ID NO: 3353903 - protein, 17 aa, Plasmodium falciparum
DLEYLFNMLQLKNNEKE

SEQ ID NO: 3353904 - protein, 24 aa, Plasmodium falciparum
DLFEAMKAFMKYNGNMMNNEKGEL

SEQ ID NO: 3353905 - protein, 18 aa, Plasmodium falciparum
DLFISFKAGKEVNHGNVL

SEQ ID NO: 3353906 - protein, 20 aa, Plasmodium falciparum
DLFLMLVYHVDMCINSVDYK

SEQ ID NO: 3353907 - protein, 17 aa, Plasmodium falciparum
DLFYWIEYESAQGQDIT

SEQ ID NO: 3353908 - protein, 22 aa, Plasmodium falciparum
DLGIPIKIFLETLSKSKNAKSV

SEQ ID NO: 3353909 - protein, 18 aa, Plasmodium falciparum
DLGLCRELKNDGDMTPTV

SEQ ID NO: 3353910 - protein, 24 aa, Plasmodium falciparum
DLHALKIAHNYVIDTSIIYCNSGY

SEQ ID NO: 3353911 - protein, 32 aa, Plasmodium falciparum
DLHEIKILSPHILKTLFQKEANKTYHSSLKDG

SEQ ID NO: 3353912 - protein, 24 aa, Plasmodium falciparum
DLIDCKRILREITILNRLKSDYII

SEQ ID NO: 3353913 - protein, 21 aa, Plasmodium falciparum
DLIECSFDLLSRILSVINSSI

SEQ ID NO: 3353914 - protein, 25 aa, Plasmodium falciparum
DLIFNCLHPNFNIRYNINEALNHDW

SEQ ID NO: 3353915 - protein, 20 aa, Plasmodium falciparum
DLIHHHSYLGSGLDKAFEIY

SEQ ID NO: 3353916 - protein, 22 aa, Plasmodium falciparum
DLIKRGDICICNAAVREDRVSH

SEQ ID NO: 3353917 - protein, 24 aa, Plasmodium falciparum
DLILKEPFCMLVSLIDHQEGIGVT

SEQ ID NO: 3353918 - protein, 27 aa, Plasmodium falciparum
DLILQRYKHGINISLNFSDIRQRNKII

SEQ ID NO: 3353919 - protein, 20 aa, Plasmodium falciparum
DLINLCYWMLKKDWKDRPTI

SEQ ID NO: 3353920 - protein, 19 aa, Plasmodium falciparum
DLINRLSLNNSLMNSQKIE

SEQ ID NO: 3353921 - protein, 25 aa, Plasmodium falciparum
DLKEICYACEQFLFSIKEEHIKCFS

SEQ ID NO: 3353922 - protein, 29 aa, Plasmodium falciparum
DLKELFSYYKGAHDIRILADKAAAQITFN

SEQ ID NO: 3353923 - protein, 17 aa, Plasmodium falciparum
DLKENYFSIDIYDVSYK

SEQ ID NO: 3353924 - protein, 23 aa, Plasmodium falciparum
DLKFEHIKKLKILIIGLGTLGCM

SEQ ID NO: 3353925 - protein, 20 aa, Plasmodium falciparum
DLKKICAEHVDIPVEAQRII

SEQ ID NO: 3353926 - protein, 25 aa, Plasmodium falciparum
DLKNKLKLKDEVIEYTHKEIENIKE

SEQ ID NO: 3353927 - protein, 24 aa, Plasmodium falciparum
DLKNVKYNSSINLEDQKKCMPNSS

SEQ ID NO: 3353928 - protein, 22 aa, Plasmodium falciparum
DLKPENIFLCKIQISQKEKTLI

SEQ ID NO: 3353929 - protein, 21 aa, Plasmodium falciparum
DLKRASECFQKVLKLTKDKNS

SEQ ID NO: 3353930 - protein, 21 aa, Plasmodium falciparum
DLKTFLNLCNKNMSRNSSIDF

SEQ ID NO: 3353931 - protein, 20 aa, Plasmodium falciparum
DLKVSSNLNQNGINVTNSTT

SEQ ID NO: 3353932 - protein, 20 aa, Plasmodium falciparum
DLKYKIVHIEYYNRTKEELN

SEQ ID NO: 3353933 - protein, 19 aa, Plasmodium falciparum
DLLCECLEKNFSNPDRVKS

SEQ ID NO: 3353934 - protein, 25 aa, Plasmodium falciparum
DLLEEAKIYFKKNMEEINSLYRENK

SEQ ID NO: 3353935 - protein, 17 aa, Plasmodium falciparum
DLLESMLRFNAQKRITI

SEQ ID NO: 3353936 - protein, 26 aa, Plasmodium falciparum
DLLEYMHTNFIIFQGLLSNIILLQKN

SEQ ID NO: 3353937 - protein, 22 aa, Plasmodium falciparum
DLLKIKCILFAIPDSRDRSRAI

SEQ ID NO: 3353938 - protein, 18 aa, Plasmodium falciparum
DLLKILNLNLTYACIYIY

SEQ ID NO: 3353939 - protein, 42 aa, Plasmodium falciparum
DLLLKTFIPDIVYRKLSLGCNIFFNEIRKVTIIFVSVKDIDA

SEQ ID NO: 3353940 - protein, 19 aa, Plasmodium falciparum
DLLNHKFLIKKRYIKKKPS

SEQ ID NO: 3353941 - protein, 25 aa, Plasmodium falciparum
DLLQIKEIFCEKILECIDNINDINK

SEQ ID NO: 3353942 - protein, 27 aa, Plasmodium falciparum
DLLRECKEKLGLFEWIHDININITFIN

SEQ ID NO: 3353943 - protein, 18 aa, Plasmodium falciparum
DLLSCAHVCHALNNLNYV

SEQ ID NO: 3353944 - protein, 37 aa, Plasmodium falciparum
DLLTKELKETFSFCGKIKAIEFFNDRLKTIDMNMINN

SEQ ID NO: 3353945 - protein, 18 aa, Plasmodium falciparum
DLLYKRKIDKDDNLSKKK

SEQ ID NO: 3353946 - protein, 24 aa, Plasmodium falciparum
DLMKNGNMINGYKLNMQEVQKGMN

SEQ ID NO: 3353947 - protein, 19 aa, Plasmodium falciparum
DLMKQTCLFYAAREGHLNL

SEQ ID NO: 3353948 - protein, 21 aa, Plasmodium falciparum
DLNFYIKIFNFLFEIITGKNI

SEQ ID NO: 3353949 - protein, 24 aa, Plasmodium falciparum
DLNHKLCIYACQIEKLNSSKKDNN

SEQ ID NO: 3353950 - protein, 19 aa, Plasmodium falciparum
DLNHSIIYSRNFDKSTARN

SEQ ID NO: 3353951 - protein, 20 aa, Plasmodium falciparum
DLNMPCSCSSHLRNQKNHFC

SEQ ID NO: 3353952 - protein, 21 aa, Plasmodium falciparum
DLNNKILFEFFQFPESTYVSE

SEQ ID NO: 3353953 - protein, 23 aa, Plasmodium falciparum
DLNRYLHKIKHSIYNITNKEDYN

SEQ ID NO: 3353954 - protein, 25 aa, Plasmodium falciparum
DLNSKVIFCKLEIFCRRLKKLVDLF

SEQ ID NO: 3353955 - protein, 24 aa, Plasmodium falciparum
DLNVKLKTLKIMKHLCDKKRADFR

SEQ ID NO: 3353956 - protein, 26 aa, Plasmodium falciparum
DLQKLFMYLMSWYFSGYYSGKMSVLK

SEQ ID NO: 3353957 - protein, 25 aa, Plasmodium falciparum
DLREVNASLKLPATWDNLENFELLQ

SEQ ID NO: 3353958 - protein, 25 aa, Plasmodium falciparum
DLRRLKFYICKRLNKKKHIFKSAVK

SEQ ID NO: 3353959 - protein, 22 aa, Plasmodium falciparum
DLRVHMVKLFKTYGGQCRIGKV

SEQ ID NO: 3353960 - protein, 24 aa, Plasmodium falciparum
DLRYKYPSTCLYNDNIIIETMYTK

SEQ ID NO: 3353961 - protein, 22 aa, Plasmodium falciparum
DLSCLKGKHVLIVEDIIDTGKT

SEQ ID NO: 3353962 - protein, 17 aa, Plasmodium falciparum
DLSKPVGCLNKNRLNSL

SEQ ID NO: 3353963 - protein, 25 aa, Plasmodium falciparum
DLSMKKDVGGDIILNKHSLEEKNNC

SEQ ID NO: 3353964 - protein, 20 aa, Plasmodium falciparum
DLSNPLLLQYNWVIWEQVSD

SEQ ID NO: 3353965 - protein, 24 aa, Plasmodium falciparum
DLSRHDILLLISFFIQLQNEQKKN

SEQ ID NO: 3353966 - protein, 18 aa, Plasmodium falciparum
DLSYYAFNPINFENLKTN

SEQ ID NO: 3353967 - protein, 19 aa, Plasmodium falciparum
DLTEIEGFDFKKMKSGQRQ

SEQ ID NO: 3353968 - protein, 17 aa, Plasmodium falciparum
DLVEIAVKRQKTKFEIE

SEQ ID NO: 3353969 - protein, 36 aa, Plasmodium falciparum
DLVGCTNTSCFFHKYRITGCNEKKCINANNNYVNSC

SEQ ID NO: 3353970 - protein, 22 aa, Plasmodium falciparum
DLVPLVLKFFIICIYTGNYNTI

SEQ ID NO: 3353971 - protein, 17 aa, Plasmodium falciparum
DLVWCGLTKRWISDESL

SEQ ID NO: 3353972 - protein, 26 aa, Plasmodium falciparum
DLYDFQLLLYTCISKSPIMDLKYSKI

SEQ ID NO: 3353973 - protein, 19 aa, Plasmodium falciparum
DLYDGCSYNSNHIIKNVEE

SEQ ID NO: 3353974 - protein, 21 aa, Plasmodium falciparum
DLYDIYECAHIVVPTKDTYLC

SEQ ID NO: 3353975 - protein, 26 aa, Plasmodium falciparum
DLYDYLEMVISYILAMRLEEERNVTS

SEQ ID NO: 3353976 - protein, 31 aa, Plasmodium falciparum
DLYLRIATELPLKMLIVGGIDKVYEIGKVFR

SEQ ID NO: 3353977 - protein, 33 aa, Plasmodium falciparum
DLYVDEIGRLLLLSFDNLCTLLVDQIKDVKLGS

SEQ ID NO: 3353978 - protein, 36 aa, Plasmodium falciparum
DMATSDFLRIFGIFCYNKLIYVDKCVHKNIMIITHL

SEQ ID NO: 3353979 - protein, 21 aa, Plasmodium falciparum
DMDCIKYLSLSLCNYNNLKTL

SEQ ID NO: 3353980 - protein, 17 aa, Plasmodium falciparum
DMDCKYAQSGRKDYMRN

SEQ ID NO: 3353981 - protein, 18 aa, Plasmodium falciparum
DMDSRTFVKILKDAKLLN

SEQ ID NO: 3353982 - protein, 17 aa, Plasmodium falciparum
DMEKEKDMCLINEKNSY

SEQ ID NO: 3353983 - protein, 18 aa, Plasmodium falciparum
DMEQTLCRNNNDNMELLE

SEQ ID NO: 3353984 - protein, 25 aa, Plasmodium falciparum
DMIMKCKNMKGSISMDNNSSNSNSN

SEQ ID NO: 3353985 - protein, 24 aa, Plasmodium falciparum
DMISCNKEKCEFTDYLDNKIKDKT

SEQ ID NO: 3353986 - protein, 31 aa, Plasmodium falciparum
DMKNFLEYFERSWLSEDEFVLDPTRITLFTG

SEQ ID NO: 3353987 - protein, 18 aa, Plasmodium falciparum
DMKRCYDKIEAQNLIKYY

SEQ ID NO: 3353988 - protein, 24 aa, Plasmodium falciparum
DMLLKRDTYRMMCDKIHMHKETVN

SEQ ID NO: 3353989 - protein, 25 aa, Plasmodium falciparum
DMNELKPTFLITVPRILQKIHDSVM

SEQ ID NO: 3353990 - protein, 21 aa, Plasmodium falciparum
DMNIVIKLSFIPRTGEFIYSS

SEQ ID NO: 3353991 - protein, 19 aa, Plasmodium falciparum
DMNKMCATNVDINKMSVNN

SEQ ID NO: 3353992 - protein, 23 aa, Plasmodium falciparum
DMNLKFYFNDVIKKYHIFSVQNI

SEQ ID NO: 3353993 - protein, 25 aa, Plasmodium falciparum
DMNNTFSYICCDMRKRRSLDSSTGF

SEQ ID NO: 3353994 - protein, 26 aa, Plasmodium falciparum
DMNNYATCYEIYIRNLHIDITKEEIY

SEQ ID NO: 3353995 - protein, 18 aa, Plasmodium falciparum
DMNYIYNSYEEFYINNNT

SEQ ID NO: 3353996 - protein, 24 aa, Plasmodium falciparum
DMPNPWLCVDNMKKVLKERGVFVI

SEQ ID NO: 3353997 - protein, 25 aa, Plasmodium falciparum
DMPSDKQKLIFSGKILKDEDKATDI

SEQ ID NO: 3353998 - protein, 18 aa, Plasmodium falciparum
DMQEEFYNNMNININRCL

SEQ ID NO: 3353999 - protein, 20 aa, Plasmodium falciparum
DMRNICFFLGQILAIKGKKE

SEQ ID NO: 3354000 - protein, 23 aa, Plasmodium falciparum
DMRTKKMIYSIFIKEEETKKNKN

SEQ ID NO: 3354001 - protein, 19 aa, Plasmodium falciparum
DMWHRFQLDKSEITSDACD

SEQ ID NO: 3354002 - protein, 26 aa, Plasmodium falciparum
DMWIFSFDSILWIRINYLCDDIPMGR

SEQ ID NO: 3354003 - protein, 22 aa, Plasmodium falciparum
DMYKSYIYSIAFILLNNQYKTK

SEQ ID NO: 3354004 - protein, 22 aa, Plasmodium falciparum
DMYSYKLANHYIKSKDNSINNY

SEQ ID NO: 3354005 - protein, 24 aa, Plasmodium falciparum
DMYTHWPFCTSFFNLISMVMAKAS

SEQ ID NO: 3354006 - protein, 18 aa, Plasmodium falciparum
DNALEWLKEISKKKKKKD

SEQ ID NO: 3354007 - protein, 24 aa, Plasmodium falciparum
DNALWFDARIQNVSKRKETKKKAF

SEQ ID NO: 3354008 - protein, 18 aa, Plasmodium falciparum
DNAVDTINGHICKDEKML

SEQ ID NO: 3354009 - protein, 26 aa, Plasmodium falciparum
DNCKYKHCLPQGYVLKKQEPTEAEKD

SEQ ID NO: 3354010 - protein, 25 aa, Plasmodium falciparum
DNCNFLKDNYHIISSTLEDIYFRIR

SEQ ID NO: 3354011 - protein, 17 aa, Plasmodium falciparum
DNCNLENPFLINVNKNI

SEQ ID NO: 3354012 - protein, 22 aa, Plasmodium falciparum
DNDIKLAVKIAVQVLLNNQPFP

SEQ ID NO: 3354013 - protein, 27 aa, Plasmodium falciparum
DNDIPKIVFKFIYPKVLPKQNNSYDCG

SEQ ID NO: 3354014 - protein, 30 aa, Plasmodium falciparum
DNDNFLSFYLKRKVSSFSDYNKESDNNSYL

SEQ ID NO: 3354015 - protein, 22 aa, Plasmodium falciparum
DNDNLIPFDVFNINEAHLSLDQ

SEQ ID NO: 3354016 - protein, 18 aa, Plasmodium falciparum
DNDVEVFKLLNLLNKILM

SEQ ID NO: 3354017 - protein, 21 aa, Plasmodium falciparum
DNEDFKRCDFTISEYDEFLKN

SEQ ID NO: 3354018 - protein, 44 aa, Plasmodium falciparum
DNEFVCPRCEYFKVKKKIGFCSYCPRLDGFLNCFEDKGKKELLF

SEQ ID NO: 3354019 - protein, 22 aa, Plasmodium falciparum
DNEIPKWSIFEWFTTDELQDKP

SEQ ID NO: 3354020 - protein, 23 aa, Plasmodium falciparum
DNEKEFFNFLFIQLNKYNEYMLP

SEQ ID NO: 3354021 - protein, 22 aa, Plasmodium falciparum
DNELPIGFILMGDFISLKFDYN

SEQ ID NO: 3354022 - protein, 21 aa, Plasmodium falciparum
DNEVMKELLINDIQSDVEENN

SEQ ID NO: 3354023 - protein, 38 aa, Plasmodium falciparum
DNFCLREFLKYCKDLTCIDFSNCWKVNNTFCNLNGLEI

SEQ ID NO: 3354024 - protein, 24 aa, Plasmodium falciparum
DNFDFFSLCTFINSYGKVNVGNKN

SEQ ID NO: 3354025 - protein, 26 aa, Plasmodium falciparum
DNFDTLPFCNRWLDDLGQTRHFMALK

SEQ ID NO: 3354026 - protein, 24 aa, Plasmodium falciparum
DNFLKKKYETYECKLDGYINEDKE

SEQ ID NO: 3354027 - protein, 17 aa, Plasmodium falciparum
DNFLRQLLQFYIISDSI

SEQ ID NO: 3354028 - protein, 18 aa, Plasmodium falciparum
DNFMMSKMKSILISQNEE

SEQ ID NO: 3354029 - protein, 25 aa, Plasmodium falciparum
DNFPTLRSLCMIGGISAYEQGREIQ

SEQ ID NO: 3354030 - protein, 24 aa, Plasmodium falciparum
DNGIRIPLKYTRLLVDYIHENKLN

SEQ ID NO: 3354031 - protein, 40 aa, Plasmodium falciparum
DNGKRYYKSFSAKTHGFYKSKFWAIKVRLSKVKGQTIFGK

SEQ ID NO: 3354032 - protein, 18 aa, Plasmodium falciparum
DNGKYEIINSSNVKDVHQ

SEQ ID NO: 3354033 - protein, 22 aa, Plasmodium falciparum
DNGVCCIDEFCLMKNENKNAIH

SEQ ID NO: 3354034 - protein, 18 aa, Plasmodium falciparum
DNHFKKICNDETTQMLNA

SEQ ID NO: 3354035 - protein, 21 aa, Plasmodium falciparum
DNHKFLSLLFFIYKYKFDEIK

SEQ ID NO: 3354036 - protein, 25 aa, Plasmodium falciparum
DNHPFYFYPRFYLPMYPYDYPHNET

SEQ ID NO: 3354037 - protein, 23 aa, Plasmodium falciparum
DNIASQCIHTCIKENIIDDKNYD

SEQ ID NO: 3354038 - protein, 28 aa, Plasmodium falciparum
DNICYSISRNCCLILLFEYFINKLEHNI

SEQ ID NO: 3354039 - protein, 25 aa, Plasmodium falciparum
DNIDICNKINLPRVYDNIIQSDSNN

SEQ ID NO: 3354040 - protein, 17 aa, Plasmodium falciparum
DNIECLNKYVSVLNTND

SEQ ID NO: 3354041 - protein, 17 aa, Plasmodium falciparum
DNIEYICGILNDKDISE

SEQ ID NO: 3354042 - protein, 19 aa, Plasmodium falciparum
DNIHLIAEKFCKRENISIS

SEQ ID NO: 3354043 - protein, 22 aa, Plasmodium falciparum
DNIIFKKAFKIIKNMKNTKQII

SEQ ID NO: 3354044 - protein, 35 aa, Plasmodium falciparum
DNIIIIKFNILKLFKLGSCYLYIINRNLKEIQMLK

SEQ ID NO: 3354045 - protein, 35 aa, Plasmodium falciparum
DNIIYYNLIYSCRHIKNSTDLFSHLNLFKDVINKK

SEQ ID NO: 3354046 - protein, 18 aa, Plasmodium falciparum
DNIKGSYPNIGLITNEFL

SEQ ID NO: 3354047 - protein, 17 aa, Plasmodium falciparum
DNIKHDLQLCGSKTMSN

SEQ ID NO: 3354048 - protein, 41 aa, Plasmodium falciparum
DNIKKAHLYFFFLRICKLLYYNIRPIFIFDGNPPELKRKTI

SEQ ID NO: 3354049 - protein, 25 aa, Plasmodium falciparum
DNIKKFLQTSGWKFEEQEGDVNMVL

SEQ ID NO: 3354050 - protein, 25 aa, Plasmodium falciparum
DNIKKLLYDYCIFREDTIKTKTNIS

SEQ ID NO: 3354051 - protein, 25 aa, Plasmodium falciparum
DNILLKLKFDFNFYDFARVGNIYEI

SEQ ID NO: 3354052 - protein, 22 aa, Plasmodium falciparum
DNILSSLSFCMGFVQNNEATNL

SEQ ID NO: 3354053 - protein, 17 aa, Plasmodium falciparum
DNIMKSDIINLINNIKN

SEQ ID NO: 3354054 - protein, 23 aa, Plasmodium falciparum
DNIMKYLIFFTSYIRNIQYDINS

SEQ ID NO: 3354055 - protein, 26 aa, Plasmodium falciparum
DNINGECPLMICIRTRNENLALLILN

SEQ ID NO: 3354056 - protein, 17 aa, Plasmodium falciparum
DNINKWCEISGRKNVNA

SEQ ID NO: 3354057 - protein, 26 aa, Plasmodium falciparum
DNIQKCKTKVFFYINPKYIIEPLKRK

SEQ ID NO: 3354058 - protein, 17 aa, Plasmodium falciparum
DNIRFIITDEIVNDIYK

SEQ ID NO: 3354059 - protein, 20 aa, Plasmodium falciparum
DNIRITSPYLTKYEKARIIG

SEQ ID NO: 3354060 - protein, 39 aa, Plasmodium falciparum
DNISIVIQFIKFMSFIVYEQFPLFTSFYYTITSLISLDN

SEQ ID NO: 3354061 - protein, 26 aa, Plasmodium falciparum
DNIWKNCKLLHSFYIYLSYYKNILNY

SEQ ID NO: 3354062 - protein, 24 aa, Plasmodium falciparum
DNIYFRYFFHELCQTKKNDKKVIL

SEQ ID NO: 3354063 - protein, 45 aa, Plasmodium falciparum
DNIYLKKQCLKKNLKEGKDYICTNKYMWRFLQFLYNGGPCIKRIS

SEQ ID NO: 3354064 - protein, 21 aa, Plasmodium falciparum
DNIYNCIDKVIGLQINETFEL

SEQ ID NO: 3354065 - protein, 34 aa, Plasmodium falciparum
DNIYTWRCPFLLGKSCNKAMRIDHFIVSKEFLNR

SEQ ID NO: 3354066 - protein, 17 aa, Plasmodium falciparum
DNKANIEITNFNNANKS

SEQ ID NO: 3354067 - protein, 22 aa, Plasmodium falciparum
DNKCLFKSLYMHMLSLENEACT

SEQ ID NO: 3354068 - protein, 24 aa, Plasmodium falciparum
DNKFNMNKMHVIKNEMDGNANDNK

SEQ ID NO: 3354069 - protein, 19 aa, Plasmodium falciparum
DNKKSIINFKCNINKKNNN

SEQ ID NO: 3354070 - protein, 22 aa, Plasmodium falciparum
DNKKYYAVKVVRNIKKYTRSAK

SEQ ID NO: 3354071 - protein, 21 aa, Plasmodium falciparum
DNKNFLSYPFHASSHIDTDQN

SEQ ID NO: 3354072 - protein, 19 aa, Plasmodium falciparum
DNKRVIIKSVLFMDNTHKE

SEQ ID NO: 3354073 - protein, 33 aa, Plasmodium falciparum
DNKYMSVLFHMWQKMELNFFFKKYYQNNKYKEI

SEQ ID NO: 3354074 - protein, 21 aa, Plasmodium falciparum
DNLDMKPLFCFVEKKKNSTIS

SEQ ID NO: 3354075 - protein, 19 aa, Plasmodium falciparum
DNLHLCVVNSMKLKHFHKK

SEQ ID NO: 3354076 - protein, 30 aa, Plasmodium falciparum
DNLINLRKILKFHHKLFFENHSKELRKISR

SEQ ID NO: 3354077 - protein, 17 aa, Plasmodium falciparum
DNLKLLLPHHKMENKWD

SEQ ID NO: 3354078 - protein, 19 aa, Plasmodium falciparum
DNLKSLIIKNIHKFENDEI

SEQ ID NO: 3354079 - protein, 23 aa, Plasmodium falciparum
DNLKTFSKNVIDIFYELKDLVKV

SEQ ID NO: 3354080 - protein, 24 aa, Plasmodium falciparum
DNLLKSCFYCFSNGKEYITVYDIL

SEQ ID NO: 3354081 - protein, 24 aa, Plasmodium falciparum
DNLNRKRISSVFLGSGQKMNNNKI

SEQ ID NO: 3354082 - protein, 24 aa, Plasmodium falciparum
DNLRIHNYYFFFLYFLKKLGDEEQ

SEQ ID NO: 3354083 - protein, 23 aa, Plasmodium falciparum
DNLRVICEPGRYMVAASSTLAVK

SEQ ID NO: 3354084 - protein, 22 aa, Plasmodium falciparum
DNLSIDLSLVFSKHGVKDLDNN

SEQ ID NO: 3354085 - protein, 23 aa, Plasmodium falciparum
DNLTKRLSFIESKIKEKDFGLDI

SEQ ID NO: 3354086 - protein, 36 aa, Plasmodium falciparum
DNMELLECMEAYDKDCSRPMKGVSYNDRKGSWLAYW

SEQ ID NO: 3354087 - protein, 26 aa, Plasmodium falciparum
DNMKMKIRMNNCLHQNITKQEHITKD

SEQ ID NO: 3354088 - protein, 24 aa, Plasmodium falciparum
DNMVCDLSYLLSIFENIKEHDFFV

SEQ ID NO: 3354089 - protein, 25 aa, Plasmodium falciparum
DNNFSNYKICEGIIKNFLNNKSMNS

SEQ ID NO: 3354090 - protein, 19 aa, Plasmodium falciparum
DNNIFKSYIKENVVKNQES

SEQ ID NO: 3354091 - protein, 17 aa, Plasmodium falciparum
DNNIICIDLLDTEKEYK

SEQ ID NO: 3354092 - protein, 37 aa, Plasmodium falciparum
DNNIITCILKLISISHIFTRHILKFNFDKNEQIENIT

SEQ ID NO: 3354093 - protein, 18 aa, Plasmodium falciparum
DNNKEMMIGMSHMNHDDQ

SEQ ID NO: 3354094 - protein, 25 aa, Plasmodium falciparum
DNNKYEYIKSFLYSLRNNHINFEIM

SEQ ID NO: 3354095 - protein, 20 aa, Plasmodium falciparum
DNNLKYVHNTTINKFNDLTN

SEQ ID NO: 3354096 - protein, 22 aa, Plasmodium falciparum
DNNLWCGISIKPKTDVQKLVPI

SEQ ID NO: 3354097 - protein, 25 aa, Plasmodium falciparum
DNNRIKYCRNLWYYNYFSRDININN

SEQ ID NO: 3354098 - protein, 23 aa, Plasmodium falciparum
DNPAPPVKRKRGRPKMKKNTPEE

SEQ ID NO: 3354099 - protein, 23 aa, Plasmodium falciparum
DNPKPDLIRFFFSEINTPIINDN

SEQ ID NO: 3354100 - protein, 25 aa, Plasmodium falciparum
DNPLKKLKFLWSYKNKEHEDNNKYI

SEQ ID NO: 3354101 - protein, 17 aa, Plasmodium falciparum
DNREILGSLTYVDKYYL

SEQ ID NO: 3354102 - protein, 23 aa, Plasmodium falciparum
DNRTFKNYTFLKGENINNNTICM

SEQ ID NO: 3354103 - protein, 23 aa, Plasmodium falciparum
DNRYSHILPCDILPHGTQMPDIN

SEQ ID NO: 3354104 - protein, 22 aa, Plasmodium falciparum
DNSEKWKKLAIENKLRKIRKIM

SEQ ID NO: 3354105 - protein, 18 aa, Plasmodium falciparum
DNSFKIFIDNKLKKISFY

SEQ ID NO: 3354106 - protein, 17 aa, Plasmodium falciparum
DNSFSFEIMELLRNRIL

SEQ ID NO: 3354107 - protein, 18 aa, Plasmodium falciparum
DNSILLVCGTFFVFDEVL

SEQ ID NO: 3354108 - protein, 24 aa, Plasmodium falciparum
DNSKDSDCLFSYNSSNISDYLNNL

SEQ ID NO: 3354109 - protein, 20 aa, Plasmodium falciparum
DNSKRMSFNRNSYISNVPTN

SEQ ID NO: 3354110 - protein, 23 aa, Plasmodium falciparum
DNSLFRRGIFVPSINCVQNKWNH

SEQ ID NO: 3354111 - protein, 21 aa, Plasmodium falciparum
DNTCHAICTYSVYDGKDVHSF

SEQ ID NO: 3354112 - protein, 25 aa, Plasmodium falciparum
DNTLLSYPNSYLINGANNVSMINQN

SEQ ID NO: 3354113 - protein, 25 aa, Plasmodium falciparum
DNTSFMPRLRTWRPRDRGEGQSTEN

SEQ ID NO: 3354114 - protein, 18 aa, Plasmodium falciparum
DNVIYRKNYEYIYYNCII

SEQ ID NO: 3354115 - protein, 26 aa, Plasmodium falciparum
DNVKILIRYLGWKNYSGCITPNLFKN

SEQ ID NO: 3354116 - protein, 18 aa, Plasmodium falciparum
DNVLPLYLLELFSIPIEQ

SEQ ID NO: 3354117 - protein, 23 aa, Plasmodium falciparum
DNVWRCMLCKAEVGDNIIKGLVD

SEQ ID NO: 3354118 - protein, 17 aa, Plasmodium falciparum
DNWKKLLLQTNYTNDER

SEQ ID NO: 3354119 - protein, 28 aa, Plasmodium falciparum
DNWVQCDLCEKWRRLPQNINMENLPKVW

SEQ ID NO: 3354120 - protein, 23 aa, Plasmodium falciparum
DNYEYFRRLIVSGFLEARKHSEE

SEQ ID NO: 3354121 - protein, 31 aa, Plasmodium falciparum
DNYFRKRKRTHLKGKYVLQRQENDLDVMCNM

SEQ ID NO: 3354122 - protein, 36 aa, Plasmodium falciparum
DNYKRLGEPNFPYWCLGKYLPFVLVLETLNFEKEID

SEQ ID NO: 3354123 - protein, 20 aa, Plasmodium falciparum
DNYLHVFILNNGNIYGSGKK

SEQ ID NO: 3354124 - protein, 22 aa, Plasmodium falciparum
DNYPLVKISNGIKKKYILNNKR

SEQ ID NO: 3354125 - protein, 21 aa, Plasmodium falciparum
DNYQTPYCCNIYTKDKIENKK

SEQ ID NO: 3354126 - protein, 27 aa, Plasmodium falciparum
DNYRIGICKIIPMIIEKSIKEGQSTFV

SEQ ID NO: 3354127 - protein, 19 aa, Plasmodium falciparum
DNYSFIYFIFLHNINEHVE

SEQ ID NO: 3354128 - protein, 19 aa, Plasmodium falciparum
DNYYYCGYNNYINNIHDEE

SEQ ID NO: 3354129 - protein, 21 aa, Plasmodium falciparum
DPALMRPGRFDRIIYVPLPNY

SEQ ID NO: 3354130 - protein, 19 aa, Plasmodium falciparum
DPCNIPWEAIKKILNEAIY

SEQ ID NO: 3354131 - protein, 19 aa, Plasmodium falciparum
DPENFPFVIIGNKVDETNK

SEQ ID NO: 3354132 - protein, 38 aa, Plasmodium falciparum
DPFENKIVIIVKMKYDICVKSKVFIFENMKDLESEYEY

SEQ ID NO: 3354133 - protein, 19 aa, Plasmodium falciparum
DPFFFLFLFNFIIKNIQNN

SEQ ID NO: 3354134 - protein, 26 aa, Plasmodium falciparum
DPFHGTNFLDCIKLFLEDDQTECILL

SEQ ID NO: 3354135 - protein, 32 aa, Plasmodium falciparum
DPFMKTKCLNNFCFLCHKHISENMCHNTRSQY

SEQ ID NO: 3354136 - protein, 33 aa, Plasmodium falciparum
DPFQYCGPLNIKIAAECVSAADNCLKYHILKYV

SEQ ID NO: 3354137 - protein, 20 aa, Plasmodium falciparum
DPFVCLNFLVSKGLLQGNNN

SEQ ID NO: 3354138 - protein, 20 aa, Plasmodium falciparum
DPILSRFDLITVLRDIPNVD

SEQ ID NO: 3354139 - protein, 24 aa, Plasmodium falciparum
DPINIKNLVMWPIASRTMNNQNEI

SEQ ID NO: 3354140 - protein, 28 aa, Plasmodium falciparum
DPIYIKLFYSYLLPCISFDKRIEIFLIY

SEQ ID NO: 3354141 - protein, 19 aa, Plasmodium falciparum
DPKVSKALFSWKDMNKNVH

SEQ ID NO: 3354142 - protein, 21 aa, Plasmodium falciparum
DPKYLSWKILQNSGKTAFKEI

SEQ ID NO: 3354143 - protein, 18 aa, Plasmodium falciparum
DPLNFKIFVEYKNKCNLI

SEQ ID NO: 3354144 - protein, 18 aa, Plasmodium falciparum
DPNFTVYEPLPWESFLKG

SEQ ID NO: 3354145 - protein, 17 aa, Plasmodium falciparum
DPNIFGKDIEFFTNKNV

SEQ ID NO: 3354146 - protein, 21 aa, Plasmodium falciparum
DPNSIPINYDEGAWFNNNQMN

SEQ ID NO: 3354147 - protein, 23 aa, Plasmodium falciparum
DPNSNCPIHISLDIDSVDNVFAP

SEQ ID NO: 3354148 - protein, 17 aa, Plasmodium falciparum
DPQKKFHISDEVKEFYK

SEQ ID NO: 3354149 - protein, 21 aa, Plasmodium falciparum
DPRKQEICNSFLIHDGGKSTK

SEQ ID NO: 3354150 - protein, 25 aa, Plasmodium falciparum
DPRRSLELMAYFTCCSLQNSHLYLV

SEQ ID NO: 3354151 - protein, 23 aa, Plasmodium falciparum
DPSCGKSQLLRYVMSIMPGTVSA

SEQ ID NO: 3354152 - protein, 22 aa, Plasmodium falciparum
DPTTYFKIGGGDMFYDINDPFL

SEQ ID NO: 3354153 - protein, 18 aa, Plasmodium falciparum
DPTWHCVVGRNFGSYVTH

SEQ ID NO: 3354154 - protein, 22 aa, Plasmodium falciparum
DPVNNMKTYMCRNRKGNYPYDE

SEQ ID NO: 3354155 - protein, 18 aa, Plasmodium falciparum
DPYFYVWIKCLKNSIPVP

SEQ ID NO: 3354156 - protein, 19 aa, Plasmodium falciparum
DPYILGGLILQIGNQVYDF

SEQ ID NO: 3354157 - protein, 21 aa, Plasmodium falciparum
DPYMKSNYMSPSIINKNDDIK

SEQ ID NO: 3354158 - protein, 19 aa, Plasmodium falciparum
DPYSYSWFAKYLENENSKE

SEQ ID NO: 3354159 - protein, 18 aa, Plasmodium falciparum
DQALRWLSHLIREEHICV

SEQ ID NO: 3354160 - protein, 26 aa, Plasmodium falciparum
DQAMGLCFSVPIGVKIPPSLKNILKE

SEQ ID NO: 3354161 - protein, 27 aa, Plasmodium falciparum
DQEKLDVPSLVEICKQQLIVILKDMCS

SEQ ID NO: 3354162 - protein, 25 aa, Plasmodium falciparum
DQESYEAQELISLFTTINYEHDSII

SEQ ID NO: 3354163 - protein, 18 aa, Plasmodium falciparum
DQFMKIEGDNIFDNSTSN

SEQ ID NO: 3354164 - protein, 17 aa, Plasmodium falciparum
DQIKFKLPFTQENNISS

SEQ ID NO: 3354165 - protein, 22 aa, Plasmodium falciparum
DQKKLKNCNLVKPRVILTNSEK

SEQ ID NO: 3354166 - protein, 21 aa, Plasmodium falciparum
DQKKWTSSIIKSKKKDENVTR

SEQ ID NO: 3354167 - protein, 21 aa, Plasmodium falciparum
DQKLLKKSCMSSNQFNNVDTY

SEQ ID NO: 3354168 - protein, 28 aa, Plasmodium falciparum
DQKVKFFNDNFLKFLKQITNHNINSYNI

SEQ ID NO: 3354169 - protein, 17 aa, Plasmodium falciparum
DQLDIQKDCSFLSAEEF

SEQ ID NO: 3354170 - protein, 24 aa, Plasmodium falciparum
DQLILPFLVKYTWNNYALEDSIDN

SEQ ID NO: 3354171 - protein, 21 aa, Plasmodium falciparum
DQLKPRMVLYKTAIQVNELPL

SEQ ID NO: 3354172 - protein, 21 aa, Plasmodium falciparum
DQMKGGLNVGGMNSFNNNNVN

SEQ ID NO: 3354173 - protein, 17 aa, Plasmodium falciparum
DQNCVKTSSGILNKEEN

SEQ ID NO: 3354174 - protein, 26 aa, Plasmodium falciparum
DQNGSCSKTLLKNISFELPKEERQDK

SEQ ID NO: 3354175 - protein, 25 aa, Plasmodium falciparum
DQPIFSGSSMSYSFDKEKYLYRSND

SEQ ID NO: 3354176 - protein, 24 aa, Plasmodium falciparum
DQPIKLFVIPGIREDTKFQPKTRK

SEQ ID NO: 3354177 - protein, 24 aa, Plasmodium falciparum
DQQYCDDEAILLYNIRRMYESNTK

SEQ ID NO: 3354178 - protein, 21 aa, Plasmodium falciparum
DQRNLYFFISNFNLMDKIFSD

SEQ ID NO: 3354179 - protein, 23 aa, Plasmodium falciparum
DQRYLKNIFCFPFKDSLPKKMEQ

SEQ ID NO: 3354180 - protein, 23 aa, Plasmodium falciparum
DQSIKLPQGVFYQDSKKAFCANW

SEQ ID NO: 3354181 - protein, 23 aa, Plasmodium falciparum
DQSLWEFYKWFLFQNGNDKEEIL

SEQ ID NO: 3354182 - protein, 28 aa, Plasmodium falciparum
DQSNKFLRERKNKRMHNNYDNFYDNSFK

SEQ ID NO: 3354183 - protein, 21 aa, Plasmodium falciparum
DQYNFRTGIPPAKEEGKKLME

SEQ ID NO: 3354184 - protein, 19 aa, Plasmodium falciparum
DRDHYKLSLGQCSYVSKSL

SEQ ID NO: 3354185 - protein, 26 aa, Plasmodium falciparum
DRDSELFRIILNFLRNPLTIPIPKDL

SEQ ID NO: 3354186 - protein, 21 aa, Plasmodium falciparum
DRERMLFCLLSSLIEKKEYSF

SEQ ID NO: 3354187 - protein, 17 aa, Plasmodium falciparum
DRFKEIPQDGAICDLLW

SEQ ID NO: 3354188 - protein, 36 aa, Plasmodium falciparum
DRGNITYTEFMAGCYRWKNIESTFLKAAFNKIDKDE

SEQ ID NO: 3354189 - protein, 28 aa, Plasmodium falciparum
DRGYYGSLCFLPYKKSLFVFGGTDNSED

SEQ ID NO: 3354190 - protein, 17 aa, Plasmodium falciparum
DRIKKINNFICTNTVIN

SEQ ID NO: 3354191 - protein, 24 aa, Plasmodium falciparum
DRILKRRLRKVKQDIDRKRKVRVY

SEQ ID NO: 3354192 - protein, 26 aa, Plasmodium falciparum
DRIPEPRYAHSLIFSFYGNAKLVFLF

SEQ ID NO: 3354193 - protein, 27 aa, Plasmodium falciparum
DRKDIFYNRMNLMYGDNHLGDYNYKKD

SEQ ID NO: 3354194 - protein, 22 aa, Plasmodium falciparum
DRKHFKRMRFPPFDDEEPPLDY

SEQ ID NO: 3354195 - protein, 22 aa, Plasmodium falciparum
DRKKQKYKKKAEDVVHKVMNNK

SEQ ID NO: 3354196 - protein, 25 aa, Plasmodium falciparum
DRKRARKSLYENFELLKEQKLDEHD

SEQ ID NO: 3354197 - protein, 19 aa, Plasmodium falciparum
DRKSFKRLLGPIEDILHRN

SEQ ID NO: 3354198 - protein, 21 aa, Plasmodium falciparum
DRLKNISCITIYNFTNLLKNI

SEQ ID NO: 3354199 - protein, 18 aa, Plasmodium falciparum
DRLLDLGFESQIYNILRN

SEQ ID NO: 3354200 - protein, 23 aa, Plasmodium falciparum
DRLLREERLIIGKMIKKIASTGC

SEQ ID NO: 3354201 - protein, 23 aa, Plasmodium falciparum
DRLPISQPVLLGICKILCESLLR

SEQ ID NO: 3354202 - protein, 18 aa, Plasmodium falciparum
DRLSCAICKTRFTKSLLR

SEQ ID NO: 3354203 - protein, 24 aa, Plasmodium falciparum
DRMLDMGFSPQIRSIVNDYDMPGN

SEQ ID NO: 3354204 - protein, 19 aa, Plasmodium falciparum
DRNEYASSYSEKNTNINET

SEQ ID NO: 3354205 - protein, 35 aa, Plasmodium falciparum
DRNFFPCDCGYQICLWCLYYIRDHMNNTCPACRRS

SEQ ID NO: 3354206 - protein, 25 aa, Plasmodium falciparum
DRQNLPKVLQVRRGKFGKQGQSKYT

SEQ ID NO: 3354207 - protein, 19 aa, Plasmodium falciparum
DRQTLMWSATWPKEVQALA

SEQ ID NO: 3354208 - protein, 24 aa, Plasmodium falciparum
DRSKPGILPCILKSLVEKRSVIKK

SEQ ID NO: 3354209 - protein, 24 aa, Plasmodium falciparum
DRTFATEMFHFFLTSKEIILPYNL

SEQ ID NO: 3354210 - protein, 17 aa, Plasmodium falciparum
DRYGRKQVGKGFNVNSS

SEQ ID NO: 3354211 - protein, 21 aa, Plasmodium falciparum
DRYHIPRILFINKLDRDGANV

SEQ ID NO: 3354212 - protein, 28 aa, Plasmodium falciparum
DRYWLSDKGNLFISFIFLWNKNQMNKIN

SEQ ID NO: 3354213 - protein, 27 aa, Plasmodium falciparum
DSCYIRACGFLYLRYVHSPANLWMWFE

SEQ ID NO: 3354214 - protein, 20 aa, Plasmodium falciparum
DSDGLLRLHSTFRHDFKIFT

SEQ ID NO: 3354215 - protein, 25 aa, Plasmodium falciparum
DSDIEIRDLSSFIIHKDKNNLKLNE

SEQ ID NO: 3354216 - protein, 24 aa, Plasmodium falciparum
DSDILICSPLGLDIIIKESKENDS

SEQ ID NO: 3354217 - protein, 24 aa, Plasmodium falciparum
DSDLFLYKNESGLGKRVDNNNNNC

SEQ ID NO: 3354218 - protein, 24 aa, Plasmodium falciparum
DSDMSPNYHAHVKMSMMNYNNNES

SEQ ID NO: 3354219 - protein, 17 aa, Plasmodium falciparum
DSEKIGGKIEVDNKMIS

SEQ ID NO: 3354220 - protein, 24 aa, Plasmodium falciparum
DSETFIHRIGRTCRLNNKGKCISF

SEQ ID NO: 3354221 - protein, 19 aa, Plasmodium falciparum
DSEYLYFQNMIRNITKYNN

SEQ ID NO: 3354222 - protein, 35 aa, Plasmodium falciparum
DSFCYECYHGGNLVCCDNCIRSYHLYCLSSSDKPQ

SEQ ID NO: 3354223 - protein, 23 aa, Plasmodium falciparum
DSFEKIKEFWSSSNVTSTTNKNN

SEQ ID NO: 3354224 - protein, 23 aa, Plasmodium falciparum
DSFKENFLFFKEKILPSKKDTCV

SEQ ID NO: 3354225 - protein, 18 aa, Plasmodium falciparum
DSFLLLRPQENGITQHIK

SEQ ID NO: 3354226 - protein, 20 aa, Plasmodium falciparum
DSFNKIPCMCLIEVGGTVGD

SEQ ID NO: 3354227 - protein, 19 aa, Plasmodium falciparum
DSFVVLRHSYLYFKGACYF

SEQ ID NO: 3354228 - protein, 22 aa, Plasmodium falciparum
DSHNYLKDKFENLLNLNEKLKY

SEQ ID NO: 3354229 - protein, 17 aa, Plasmodium falciparum
DSHVRKFVLNNQLDNKK

SEQ ID NO: 3354230 - protein, 24 aa, Plasmodium falciparum
DSIDYRISINIEYTKPISKLYLSK

SEQ ID NO: 3354231 - protein, 18 aa, Plasmodium falciparum
DSIGEEFTGYVFRITGGN

SEQ ID NO: 3354232 - protein, 17 aa, Plasmodium falciparum
DSIKLTTYCLDEIIDHV

SEQ ID NO: 3354233 - protein, 18 aa, Plasmodium falciparum
DSIKYHEIMKEYKLGPNG

SEQ ID NO: 3354234 - protein, 29 aa, Plasmodium falciparum
DSKDIRFSVKSGKKIFLDTSFQNKKLMVH

SEQ ID NO: 3354235 - protein, 24 aa, Plasmodium falciparum
DSKEMIRLTINILQNYNFLNNLKI

SEQ ID NO: 3354236 - protein, 23 aa, Plasmodium falciparum
DSKKFTSLISNYFSELLDKKKKK

SEQ ID NO: 3354237 - protein, 29 aa, Plasmodium falciparum
DSKKYLLCCLFLRICMNVRKPPLDIFITA

SEQ ID NO: 3354238 - protein, 18 aa, Plasmodium falciparum
DSKRILLNCNKYIEDNNM

SEQ ID NO: 3354239 - protein, 18 aa, Plasmodium falciparum
DSKVAFDVTNCLKDNIIL

SEQ ID NO: 3354240 - protein, 24 aa, Plasmodium falciparum
DSKVYKNRCDGVCVLNDNIYIFDK

SEQ ID NO: 3354241 - protein, 19 aa, Plasmodium falciparum
DSLFACSTSSLLINNNKNE

SEQ ID NO: 3354242 - protein, 25 aa, Plasmodium falciparum
DSLFKKVEIRNNLELNEDIKSSITN

SEQ ID NO: 3354243 - protein, 26 aa, Plasmodium falciparum
DSLIKLWDIRNFKLLYSYKNDQIQNN

SEQ ID NO: 3354244 - protein, 38 aa, Plasmodium falciparum
DSLIPMGPLPTGVYFDSARKLWRCQWKENGKFKTKGFS

SEQ ID NO: 3354245 - protein, 17 aa, Plasmodium falciparum
DSLQDKIMYNPMNDYNC

SEQ ID NO: 3354246 - protein, 18 aa, Plasmodium falciparum
DSLRRRYGKFIATVVFKN

SEQ ID NO: 3354247 - protein, 25 aa, Plasmodium falciparum
DSLVPLCSSHPIPLESYPYYHYYYS

SEQ ID NO: 3354248 - protein, 18 aa, Plasmodium falciparum
DSNDFYVLEAREKNGEDN

SEQ ID NO: 3354249 - protein, 17 aa, Plasmodium falciparum
DSNHFILNNNENESLDI

SEQ ID NO: 3354250 - protein, 17 aa, Plasmodium falciparum
DSNLFLFFKNEKNKKDN

SEQ ID NO: 3354251 - protein, 23 aa, Plasmodium falciparum
DSNNKFLYIIFSDIDIFPRQCYL

SEQ ID NO: 3354252 - protein, 20 aa, Plasmodium falciparum
DSNTCVINFVECINKENQNV

SEQ ID NO: 3354253 - protein, 18 aa, Plasmodium falciparum
DSNWSYNSSICYDIIQVS

SEQ ID NO: 3354254 - protein, 24 aa, Plasmodium falciparum
DSQIYDHNICGLIKEHQDIQTISL

SEQ ID NO: 3354255 - protein, 20 aa, Plasmodium falciparum
DSSLLIYDIRYFKLLKNYIC

SEQ ID NO: 3354256 - protein, 17 aa, Plasmodium falciparum
DSSMEHLNLIYPINSHM

SEQ ID NO: 3354257 - protein, 17 aa, Plasmodium falciparum
DSSNYKSDEFLSLDNSE

SEQ ID NO: 3354258 - protein, 27 aa, Plasmodium falciparum
DSSQGKFTCCLIACYIYQIKIDVIKNF

SEQ ID NO: 3354259 - protein, 29 aa, Plasmodium falciparum
DSSSRNVSSCSSFELKNNMITNDSRKNIS

SEQ ID NO: 3354260 - protein, 28 aa, Plasmodium falciparum
DSSYYSLKLPKFIDVCLDIKKKKNNNIN

SEQ ID NO: 3354261 - protein, 25 aa, Plasmodium falciparum
DSTDGLKCVEILFNKAGTNCLLPVD

SEQ ID NO: 3354262 - protein, 24 aa, Plasmodium falciparum
DSTGRNSGFGFVSYDNVISAQHAI

SEQ ID NO: 3354263 - protein, 18 aa, Plasmodium falciparum
DSTKLLSNVMRNDKEKNI

SEQ ID NO: 3354264 - protein, 21 aa, Plasmodium falciparum
DSTKWMEIMDFNWQNTQEKSP

SEQ ID NO: 3354265 - protein, 20 aa, Plasmodium falciparum
DSVDKYSFYNTRHVQHTNKK

SEQ ID NO: 3354266 - protein, 24 aa, Plasmodium falciparum
DSVLLRHEIAYVIGQISNEKCNNI

SEQ ID NO: 3354267 - protein, 24 aa, Plasmodium falciparum
DSVNEISFLLSQIRIYIKEIDILL

SEQ ID NO: 3354268 - protein, 28 aa, Plasmodium falciparum
DSVYKGCWSKTDAWVFSSLSYDGKCVVH

SEQ ID NO: 3354269 - protein, 18 aa, Plasmodium falciparum
DSYALIFPNALPVKQVLW

SEQ ID NO: 3354270 - protein, 23 aa, Plasmodium falciparum
DSYFFYLSFHSLRAIHDGQNNLI

SEQ ID NO: 3354271 - protein, 19 aa, Plasmodium falciparum
DSYISSLLCNEYKLNHILN

SEQ ID NO: 3354272 - protein, 23 aa, Plasmodium falciparum
DSYLIYCNFDLSSIYNIGKHYNF

SEQ ID NO: 3354273 - protein, 30 aa, Plasmodium falciparum
DSYNIYNPLKWHLCISDFGCSAMEYATYYL

SEQ ID NO: 3354274 - protein, 21 aa, Plasmodium falciparum
DSYNKISACISTFQKQINDAI

SEQ ID NO: 3354275 - protein, 24 aa, Plasmodium falciparum
DSYYDDMNFCYDKDYNMILKKGVN

SEQ ID NO: 3354276 - protein, 17 aa, Plasmodium falciparum
DTCFFNIIISFKKLKIY

SEQ ID NO: 3354277 - protein, 19 aa, Plasmodium falciparum
DTCYSWWIFSTLIVLKKYN

SEQ ID NO: 3354278 - protein, 23 aa, Plasmodium falciparum
DTDLKFALNINAKFYTPEDLFLN

SEQ ID NO: 3354279 - protein, 30 aa, Plasmodium falciparum
DTEKEYKSDCDMQSFPFNNKWFDNDLLNRE

SEQ ID NO: 3354280 - protein, 23 aa, Plasmodium falciparum
DTELPSLVFHNFVQLDDKFAFIF

SEQ ID NO: 3354281 - protein, 22 aa, Plasmodium falciparum
DTERKFKMYLVYKKCEDNRKKW

SEQ ID NO: 3354282 - protein, 18 aa, Plasmodium falciparum
DTETDFVYIYKIRKNVYL

SEQ ID NO: 3354283 - protein, 17 aa, Plasmodium falciparum
DTFFCFLELMQRQKDVF

SEQ ID NO: 3354284 - protein, 23 aa, Plasmodium falciparum
DTFKDLKHLKVFDLSYNEINNIS

SEQ ID NO: 3354285 - protein, 19 aa, Plasmodium falciparum
DTFRLTKELLDDLNKRNEA

SEQ ID NO: 3354286 - protein, 30 aa, Plasmodium falciparum
DTFSKKDWYLLNNFAIKMMQYRKGDKKSED

SEQ ID NO: 3354287 - protein, 26 aa, Plasmodium falciparum
DTFVDSSIGFKHMYINNVQSACFEKR

SEQ ID NO: 3354288 - protein, 22 aa, Plasmodium falciparum
DTGLIFRVTKRIFDILNKRKEE

SEQ ID NO: 3354289 - protein, 23 aa, Plasmodium falciparum
DTHKNFWKSFGLNNEAGKLLYHL

SEQ ID NO: 3354290 - protein, 20 aa, Plasmodium falciparum
DTHLRVYKNINEYDIIELKI

SEQ ID NO: 3354291 - protein, 20 aa, Plasmodium falciparum
DTIFIYSLEQFHLIYQEKFK

SEQ ID NO: 3354292 - protein, 19 aa, Plasmodium falciparum
DTIHGRLRPEPEIIENILE

SEQ ID NO: 3354293 - protein, 24 aa, Plasmodium falciparum
DTILKIKVVKIICKKKDPWNMNIS

SEQ ID NO: 3354294 - protein, 28 aa, Plasmodium falciparum
DTKEGNLHLEALCMFLNTVGEILDTHEK

SEQ ID NO: 3354295 - protein, 23 aa, Plasmodium falciparum
DTKGVIYHLGIDVDEDVIPPNLY

SEQ ID NO: 3354296 - protein, 23 aa, Plasmodium falciparum
DTKHFIRFLRKCHALKFEKNINH

SEQ ID NO: 3354297 - protein, 17 aa, Plasmodium falciparum
DTKKFNGLVKRIVNNKA

SEQ ID NO: 3354298 - protein, 24 aa, Plasmodium falciparum
DTKLNALHNYICVISPKNDNNNIN

SEQ ID NO: 3354299 - protein, 25 aa, Plasmodium falciparum
DTKRPDALRDKCWQYVDPKGVVQGP

SEQ ID NO: 3354300 - protein, 24 aa, Plasmodium falciparum
DTKYIFSQSVPKKWIYDASETEIS

SEQ ID NO: 3354301 - protein, 22 aa, Plasmodium falciparum
DTLKEEKLVDCYMNSNMEEEHL

SEQ ID NO: 3354302 - protein, 39 aa, Plasmodium falciparum
DTLKLEKIDMLIMKRIQMCLEKIKNTLLLTCTINNVQEI

SEQ ID NO: 3354303 - protein, 26 aa, Plasmodium falciparum
DTLPLHPGHPLEFIHLQNKWINQDTT

SEQ ID NO: 3354304 - protein, 25 aa, Plasmodium falciparum
DTMCYQEKLKMLGILNKKDDDNLSE

SEQ ID NO: 3354305 - protein, 17 aa, Plasmodium falciparum
DTMKNNRIEGFGNTVFD

SEQ ID NO: 3354306 - protein, 17 aa, Plasmodium falciparum
DTNEIIEVINILDTDNE

SEQ ID NO: 3354307 - protein, 19 aa, Plasmodium falciparum
DTNKYRNNDIINHNINGRN

SEQ ID NO: 3354308 - protein, 31 aa, Plasmodium falciparum
DTNNFWKEQLFEICNMSPEDLKIHNLPISRI

SEQ ID NO: 3354309 - protein, 20 aa, Plasmodium falciparum
DTPEGYRVLKNEERNYVLKE

SEQ ID NO: 3354310 - protein, 21 aa, Plasmodium falciparum
DTRAHSFFRRANIYFNNKTSA

SEQ ID NO: 3354311 - protein, 21 aa, Plasmodium falciparum
DTRLQRCIQNIFQYNKYASPI

SEQ ID NO: 3354312 - protein, 22 aa, Plasmodium falciparum
DTRRNFYKRRSYTHDHYMNTEN

SEQ ID NO: 3354313 - protein, 19 aa, Plasmodium falciparum
DTSFLFKNFLLDIFNKKKQ

SEQ ID NO: 3354314 - protein, 24 aa, Plasmodium falciparum
DTSGEVCPINWKKGQKAFKPTTES

SEQ ID NO: 3354315 - protein, 26 aa, Plasmodium falciparum
DTSICGPYICCIFILSKKENVNIEYI

SEQ ID NO: 3354316 - protein, 17 aa, Plasmodium falciparum
DTSLPFACIKCKKKWKI

SEQ ID NO: 3354317 - protein, 26 aa, Plasmodium falciparum
DTSRGFKFFFFKVLRSIKTKTIDMEN

SEQ ID NO: 3354318 - protein, 18 aa, Plasmodium falciparum
DTTDFGILEYLYLEQNII

SEQ ID NO: 3354319 - protein, 27 aa, Plasmodium falciparum
DTTNEATCDFILYLLSFFIYKMKAIKN

SEQ ID NO: 3354320 - protein, 17 aa, Plasmodium falciparum
DTYCYRHKINIKENIRS

SEQ ID NO: 3354321 - protein, 22 aa, Plasmodium falciparum
DTYKEWNKYLLSKKKDIAKLIE

SEQ ID NO: 3354322 - protein, 23 aa, Plasmodium falciparum
DTYLYYPNFKMFISENNNNNKNN

SEQ ID NO: 3354323 - protein, 27 aa, Plasmodium falciparum
DTYPHLFRWFHHISSLPEFILNQYDEE

SEQ ID NO: 3354324 - protein, 24 aa, Plasmodium falciparum
DTYVLCKASLILSQQYGCLLKITC

SEQ ID NO: 3354325 - protein, 17 aa, Plasmodium falciparum
DTYYDWTHFSIVETINF

SEQ ID NO: 3354326 - protein, 17 aa, Plasmodium falciparum
DVADFPYLTTGVKTNKV

SEQ ID NO: 3354327 - protein, 23 aa, Plasmodium falciparum
DVADLFYSLTIFQILQGYPKGTI

SEQ ID NO: 3354328 - protein, 26 aa, Plasmodium falciparum
DVAEFIGKMRVCYRLSINKDYVNNEK

SEQ ID NO: 3354329 - protein, 20 aa, Plasmodium falciparum
DVAYTIVFRYIQIIIQKIRE

SEQ ID NO: 3354330 - protein, 17 aa, Plasmodium falciparum
DVCPANWKKGKVAMKPS

SEQ ID NO: 3354331 - protein, 18 aa, Plasmodium falciparum
DVDECVHNLLALLKKKKN

SEQ ID NO: 3354332 - protein, 17 aa, Plasmodium falciparum
DVDLSWICSEWLLCLFC

SEQ ID NO: 3354333 - protein, 23 aa, Plasmodium falciparum
DVDSNFKFAGLMKKLEELSISLA

SEQ ID NO: 3354334 - protein, 19 aa, Plasmodium falciparum
DVEDVSGSAYLYRSVEDKI

SEQ ID NO: 3354335 - protein, 21 aa, Plasmodium falciparum
DVEFPFWFYIKNFINIKEQEY

SEQ ID NO: 3354336 - protein, 28 aa, Plasmodium falciparum
DVEIFIKNLCVAKCKSIENNKNKENILY

SEQ ID NO: 3354337 - protein, 24 aa, Plasmodium falciparum
DVEKELYECFSLFDTNKCGYIDIR

SEQ ID NO: 3354338 - protein, 30 aa, Plasmodium falciparum
DVENPRIIILDMFKLCFIGNEKLHKDILFI

SEQ ID NO: 3354339 - protein, 23 aa, Plasmodium falciparum
DVENVDGLSLWEMYKDKNNNIFY

SEQ ID NO: 3354340 - protein, 25 aa, Plasmodium falciparum
DVFIYKDWPEKFLGKNINSKDDGNN

SEQ ID NO: 3354341 - protein, 23 aa, Plasmodium falciparum
DVFKHFVFDFNFHIKKKDEDFIK

SEQ ID NO: 3354342 - protein, 23 aa, Plasmodium falciparum
DVFLKNNVKSLIVYDTGGIDIEL

SEQ ID NO: 3354343 - protein, 22 aa, Plasmodium falciparum
DVHGVKLVINFDMPKDIESYTH

SEQ ID NO: 3354344 - protein, 19 aa, Plasmodium falciparum
DVIFKIFAVINSKRFNGDM

SEQ ID NO: 3354345 - protein, 17 aa, Plasmodium falciparum
DVIIIKRMFSSHTSKFY

SEQ ID NO: 3354346 - protein, 24 aa, Plasmodium falciparum
DVILPCLKKAYQTSTDFLSSAANN

SEQ ID NO: 3354347 - protein, 17 aa, Plasmodium falciparum
DVINTLATFYIDKKINI

SEQ ID NO: 3354348 - protein, 21 aa, Plasmodium falciparum
DVIRRVLNIFLILNYSHASVI

SEQ ID NO: 3354349 - protein, 33 aa, Plasmodium falciparum
DVIYSEFFRLSSKRKKNCNELLNGEKHVEKNKT

SEQ ID NO: 3354350 - protein, 24 aa, Plasmodium falciparum
DVKEDPKRGFVVIGIQEETVTSID

SEQ ID NO: 3354351 - protein, 27 aa, Plasmodium falciparum
DVKEIIKNIKMRLGFYSNEESDSHDIK

SEQ ID NO: 3354352 - protein, 21 aa, Plasmodium falciparum
DVKMLVGSILVRMSQLEGMTK

SEQ ID NO: 3354353 - protein, 25 aa, Plasmodium falciparum
DVLASYPCYYGLRIKDEPKDEIKKE

SEQ ID NO: 3354354 - protein, 22 aa, Plasmodium falciparum
DVLCFQEVRLPAMNLSEPCDNK

SEQ ID NO: 3354355 - protein, 29 aa, Plasmodium falciparum
DVLFFFVKCELLYWDPLYQFFMSKKKKKR

SEQ ID NO: 3354356 - protein, 25 aa, Plasmodium falciparum
DVLFLKNVFIKIHIMMDIIMMCYTV

SEQ ID NO: 3354357 - protein, 31 aa, Plasmodium falciparum
DVLIKKTKKILCNKCSEEIPSFNNINNILKD

SEQ ID NO: 3354358 - protein, 24 aa, Plasmodium falciparum
DVLKAYLNTTGWIKKLNKKIYEYT

SEQ ID NO: 3354359 - protein, 19 aa, Plasmodium falciparum
DVLKNEWSPALTIRTALLS

SEQ ID NO: 3354360 - protein, 25 aa, Plasmodium falciparum
DVLNISWKIIRIFNLHQKKINQFVF

SEQ ID NO: 3354361 - protein, 18 aa, Plasmodium falciparum
DVLNKSLIKSEEHVKLYT

SEQ ID NO: 3354362 - protein, 19 aa, Plasmodium falciparum
DVLPLDMLKNNSYIATNKN

SEQ ID NO: 3354363 - protein, 17 aa, Plasmodium falciparum
DVLPNELFLEVTRNENF

SEQ ID NO: 3354364 - protein, 32 aa, Plasmodium falciparum
DVLRKLQTLVVRRLDCENLYYQKILVITCLLF

SEQ ID NO: 3354365 - protein, 19 aa, Plasmodium falciparum
DVLVGIFPIIWEYINQLPF

SEQ ID NO: 3354366 - protein, 23 aa, Plasmodium falciparum
DVMKAIELDPTFVKAYSRKGNLH

SEQ ID NO: 3354367 - protein, 45 aa, Plasmodium falciparum
DVNCKFTNICSFEYTKGLCIFDMLNIPLYHGWVISSDDIIFYSYL

SEQ ID NO: 3354368 - protein, 31 aa, Plasmodium falciparum
DVNKFFEELLCNIKACFLEILDYLKEYCRSK

SEQ ID NO: 3354369 - protein, 26 aa, Plasmodium falciparum
DVNKLFNLFSIYGFVTRIKILREKPD

SEQ ID NO: 3354370 - protein, 19 aa, Plasmodium falciparum
DVNVGYELLGRVVDALGNC

SEQ ID NO: 3354371 - protein, 23 aa, Plasmodium falciparum
DVPKKIYVCKNVPNSIDKHFSEN

SEQ ID NO: 3354372 - protein, 18 aa, Plasmodium falciparum
DVPVPYMVPKPVVVNVEV

SEQ ID NO: 3354373 - protein, 24 aa, Plasmodium falciparum
DVPYKVKHHMLSWCVNLDNSLIIE

SEQ ID NO: 3354374 - protein, 28 aa, Plasmodium falciparum
DVQDVKSLIRLYGILQFVHVYKLNKDRY

SEQ ID NO: 3354375 - protein, 17 aa, Plasmodium falciparum
DVQTGDCIITFSRNNIM

SEQ ID NO: 3354376 - protein, 26 aa, Plasmodium falciparum
DVRDRRKGFRNVDREKAHIYKSEDKN

SEQ ID NO: 3354377 - protein, 19 aa, Plasmodium falciparum
DVSKKSSFHIYNKRTLTSN

SEQ ID NO: 3354378 - protein, 35 aa, Plasmodium falciparum
DVSLSPLSICISYFTFSIKCFDFLFDDKTIICVGS

SEQ ID NO: 3354379 - protein, 25 aa, Plasmodium falciparum
DVSYICLQRAFKMCYEHMHNRKIMD

SEQ ID NO: 3354380 - protein, 25 aa, Plasmodium falciparum
DVSYRKCSIINFFNAIKEENKNYIE

SEQ ID NO: 3354381 - protein, 23 aa, Plasmodium falciparum
DVVKKLRTIFCVPMFEGYGMTES

SEQ ID NO: 3354382 - protein, 27 aa, Plasmodium falciparum
DVVWFFREYFYRLAINKNIFFPLIEHV

SEQ ID NO: 3354383 - protein, 27 aa, Plasmodium falciparum
DVVYKYVEGLAWVLAYYFQSCPMWHWY

SEQ ID NO: 3354384 - protein, 17 aa, Plasmodium falciparum
DVYKILLQFEISRSEIL

SEQ ID NO: 3354385 - protein, 36 aa, Plasmodium falciparum
DVYKYHPLCHNIRRDAYKKYACCKVGDKNDKTFSNL

SEQ ID NO: 3354386 - protein, 23 aa, Plasmodium falciparum
DVYMKKFMFETCDEIIIENIQSS

SEQ ID NO: 3354387 - protein, 25 aa, Plasmodium falciparum
DWCISRQLWWGHRIPAYKIVFKNDV

SEQ ID NO: 3354388 - protein, 27 aa, Plasmodium falciparum
DWIKNFCWFCSLHILDEILEKQIYKEK

SEQ ID NO: 3354389 - protein, 19 aa, Plasmodium falciparum
DWRAGRCALSNIIPASTGA

SEQ ID NO: 3354390 - protein, 22 aa, Plasmodium falciparum
DWSCSRSYGLGTYMPQFDQNNQ

SEQ ID NO: 3354391 - protein, 17 aa, Plasmodium falciparum
DYCPSYYSIGFGGVLSR

SEQ ID NO: 3354392 - protein, 17 aa, Plasmodium falciparum
DYDEIYFLYLRCVNDKK

SEQ ID NO: 3354393 - protein, 24 aa, Plasmodium falciparum
DYDHFAFPCAMKIYSDKITHKKDI

SEQ ID NO: 3354394 - protein, 32 aa, Plasmodium falciparum
DYDHILKVHTLWLYHCRGTLEKRHSSNFDADN

SEQ ID NO: 3354395 - protein, 22 aa, Plasmodium falciparum
DYDKLKFVEYINSFSDVKKSSS

SEQ ID NO: 3354396 - protein, 33 aa, Plasmodium falciparum
DYDLLYASIFYRFLKRLPCKEEENIDNFIYYNR

SEQ ID NO: 3354397 - protein, 22 aa, Plasmodium falciparum
DYEHVKKFIICNSNEYFKRLQE

SEQ ID NO: 3354398 - protein, 17 aa, Plasmodium falciparum
DYEKIFIPSGYDNLELI

SEQ ID NO: 3354399 - protein, 24 aa, Plasmodium falciparum
DYEKQKIYSILFYNSPHSYVCNEY

SEQ ID NO: 3354400 - protein, 17 aa, Plasmodium falciparum
DYEKVFLEDNLHLKQTP

SEQ ID NO: 3354401 - protein, 18 aa, Plasmodium falciparum
DYFFEKTDTLDLLNKKIY

SEQ ID NO: 3354402 - protein, 17 aa, Plasmodium falciparum
DYFKNEIIILINGILRN

SEQ ID NO: 3354403 - protein, 17 aa, Plasmodium falciparum
DYHIRQALDIYGVQLAS

SEQ ID NO: 3354404 - protein, 19 aa, Plasmodium falciparum
DYICIPINLFNFIGTVAFD

SEQ ID NO: 3354405 - protein, 37 aa, Plasmodium falciparum
DYIFSIWEFELEYCIYKFKSDYAISYFDMSFFHNHLH

SEQ ID NO: 3354406 - protein, 18 aa, Plasmodium falciparum
DYIISKNNFNWVLWDELI

SEQ ID NO: 3354407 - protein, 17 aa, Plasmodium falciparum
DYIKAYLLGFTLEDSLA

SEQ ID NO: 3354408 - protein, 26 aa, Plasmodium falciparum
DYIKNYRWERCISYLHYSNCLKDKNI

SEQ ID NO: 3354409 - protein, 18 aa, Plasmodium falciparum
DYILEIVWTSGFKDQAML

SEQ ID NO: 3354410 - protein, 24 aa, Plasmodium falciparum
DYILFLNDCELFYSINETNKNMHT

SEQ ID NO: 3354411 - protein, 24 aa, Plasmodium falciparum
DYILPRIAECFSYHNIYISNSHLT

SEQ ID NO: 3354412 - protein, 25 aa, Plasmodium falciparum
DYINYKKSCLFQSSLNKKKENHSNA

SEQ ID NO: 3354413 - protein, 23 aa, Plasmodium falciparum
DYIPCCTEKIIADHNLLTDICFK

SEQ ID NO: 3354414 - protein, 18 aa, Plasmodium falciparum
DYKPRLDKYTNELKESEK

SEQ ID NO: 3354415 - protein, 19 aa, Plasmodium falciparum
DYKVRRKDVKKSKKEKDKI

SEQ ID NO: 3354416 - protein, 17 aa, Plasmodium falciparum
DYLKIYGPKEIDSHWDE

SEQ ID NO: 3354417 - protein, 22 aa, Plasmodium falciparum
DYLLKYSHYKNNVFFEDNTLDI

SEQ ID NO: 3354418 - protein, 29 aa, Plasmodium falciparum
DYLNEKYFKFGLTHIKNEFVVYMQLPFKP

SEQ ID NO: 3354419 - protein, 20 aa, Plasmodium falciparum
DYLNTCIMYQNFYRNNNSGC

SEQ ID NO: 3354420 - protein, 43 aa, Plasmodium falciparum
DYMPPEIINQIPYDCNVDLWCLGIVIFELLVGFPPFTDDTQER

SEQ ID NO: 3354421 - protein, 17 aa, Plasmodium falciparum
DYMRNSGKVEEQIMNMN

SEQ ID NO: 3354422 - protein, 20 aa, Plasmodium falciparum
DYNFNSSIRICYVPFYNNYY

SEQ ID NO: 3354423 - protein, 33 aa, Plasmodium falciparum
DYNKEKELIFCFSFIKYYSWIKALQILNIPIDF

SEQ ID NO: 3354424 - protein, 27 aa, Plasmodium falciparum
DYNRNCRIIYKNAFENFHYNNKNTNVN

SEQ ID NO: 3354425 - protein, 25 aa, Plasmodium falciparum
DYPFYCNKNRVLPLDYACLKVKNID

SEQ ID NO: 3354426 - protein, 24 aa, Plasmodium falciparum
DYPQELNILKKRGSKSIESVASEN

SEQ ID NO: 3354427 - protein, 18 aa, Plasmodium falciparum
DYRNDVCSLWMGDIDNLD

SEQ ID NO: 3354428 - protein, 20 aa, Plasmodium falciparum
DYSSIYNYLSFKKILGYGAF

SEQ ID NO: 3354429 - protein, 24 aa, Plasmodium falciparum
DYSVKKYLTEFFVNMNKSDDHKMS

SEQ ID NO: 3354430 - protein, 45 aa, Plasmodium falciparum
DYSYAIAELDCRQSQQLLLDLGLYCNGIKLNIEHFKEKKKFIDNK

SEQ ID NO: 3354431 - protein, 32 aa, Plasmodium falciparum
DYTITIELFYRLKKYNNIFSIEQILGTQYPSI

SEQ ID NO: 3354432 - protein, 25 aa, Plasmodium falciparum
DYTTIPIPIHFEWDENIIDLFEDES

SEQ ID NO: 3354433 - protein, 35 aa, Plasmodium falciparum
DYTYKKKKKIWSCFPDFEKSRRLKFIRKKKKEKTK

SEQ ID NO: 3354434 - protein, 21 aa, Plasmodium falciparum
DYVIRHIIHVNLTIGCNLLKG

SEQ ID NO: 3354435 - protein, 21 aa, Plasmodium falciparum
DYYGFYVILEFFYNIEQMDKD

SEQ ID NO: 3354436 - protein, 26 aa, Plasmodium falciparum
DYYGKKCFRNWLYLSRIAATKEYAYL

SEQ ID NO: 3354437 - protein, 25 aa, Plasmodium falciparum
DYYKCPRTILKKTCEFVKNEGIADK

SEQ ID NO: 3354438 - protein, 17 aa, Plasmodium falciparum
DYYRYISEFSCDEGKKE

SEQ ID NO: 3354439 - protein, 17 aa, Plasmodium falciparum
EAAKVCSLEMNRDEKKV

SEQ ID NO: 3354440 - protein, 19 aa, Plasmodium falciparum
EACIDYKLLYQSLVNAIET

SEQ ID NO: 3354441 - protein, 19 aa, Plasmodium falciparum
EACVTYQAFIKKWKTQYEV

SEQ ID NO: 3354442 - protein, 31 aa, Plasmodium falciparum
EADISEIKHIIKKYIYNIFSQVVNKCKNVIH

SEQ ID NO: 3354443 - protein, 22 aa, Plasmodium falciparum
EADLEWKIFYISAVNNEGESNQ

SEQ ID NO: 3354444 - protein, 22 aa, Plasmodium falciparum
EADSKWSYFKKMNIFRKDNNND

SEQ ID NO: 3354445 - protein, 19 aa, Plasmodium falciparum
EAEEGLKGNVYENKNEDKK

SEQ ID NO: 3354446 - protein, 20 aa, Plasmodium falciparum
EAEKCIKPFLYKNSSIDDEE

SEQ ID NO: 3354447 - protein, 17 aa, Plasmodium falciparum
EAEKMLVDLVYQRELEM

SEQ ID NO: 3354448 - protein, 28 aa, Plasmodium falciparum
EAFIKYKKKLLVVILWIKIYMSVLEEYV

SEQ ID NO: 3354449 - protein, 20 aa, Plasmodium falciparum
EAFLNGYLYFSRIGHNINLL

SEQ ID NO: 3354450 - protein, 20 aa, Plasmodium falciparum
EAFRVFDRDGDGYISADELR

SEQ ID NO: 3354451 - protein, 21 aa, Plasmodium falciparum
EAFVSKWFIGLNVHVLTFESL

SEQ ID NO: 3354452 - protein, 17 aa, Plasmodium falciparum
EAFYLCEQKYKVIKKYY

SEQ ID NO: 3354453 - protein, 18 aa, Plasmodium falciparum
EAGKTWKNFITIKKNDKL

SEQ ID NO: 3354454 - protein, 26 aa, Plasmodium falciparum
EAHLKECFYFSYFNSFYILGDNNYFF

SEQ ID NO: 3354455 - protein, 19 aa, Plasmodium falciparum
EAICYEFITQPLIIYEEDI

SEQ ID NO: 3354456 - protein, 17 aa, Plasmodium falciparum
EAIEIFNYMFQHMNELK

SEQ ID NO: 3354457 - protein, 25 aa, Plasmodium falciparum
EAIENFESLGYVMSGSRHKRMNAIR

SEQ ID NO: 3354458 - protein, 18 aa, Plasmodium falciparum
EAIKDSNKLFTILFTILN

SEQ ID NO: 3354459 - protein, 22 aa, Plasmodium falciparum
EAIKEKRKCINIVKDIKNNNNK

SEQ ID NO: 3354460 - protein, 20 aa, Plasmodium falciparum
EAIVDIMLEECEFLDNDKIT

SEQ ID NO: 3354461 - protein, 18 aa, Plasmodium falciparum
EAKEELKKIISINKKENN

SEQ ID NO: 3354462 - protein, 30 aa, Plasmodium falciparum
EAKELATPLCMWKLPNKELINRNIANKSEH

SEQ ID NO: 3354463 - protein, 22 aa, Plasmodium falciparum
EAKKVVANALRQRWRRIQVSDD

SEQ ID NO: 3354464 - protein, 18 aa, Plasmodium falciparum
EAKYHSVLSHVNIIKMYG

SEQ ID NO: 3354465 - protein, 20 aa, Plasmodium falciparum
EALGGFGTYGVRADGPGLVP

SEQ ID NO: 3354466 - protein, 26 aa, Plasmodium falciparum
EALILTGAMSRTWGMGFQLFECEYNA

SEQ ID NO: 3354467 - protein, 30 aa, Plasmodium falciparum
EALKSYFDKCLYKIIKRRTRTCDNNLCCGL

SEQ ID NO: 3354468 - protein, 19 aa, Plasmodium falciparum
EALLRPGRIDRKIEFPNPN

SEQ ID NO: 3354469 - protein, 29 aa, Plasmodium falciparum
EALNHDWFKGNIFPIHNFNLYINKDNNNK

SEQ ID NO: 3354470 - protein, 27 aa, Plasmodium falciparum
EALNTYKLSKFKIGENKIMEDISEGNK

SEQ ID NO: 3354471 - protein, 20 aa, Plasmodium falciparum
EAMNKLSLISLYPNNNHIIN

SEQ ID NO: 3354472 - protein, 19 aa, Plasmodium falciparum
EANAKMRLSHQIYSKDVDY

SEQ ID NO: 3354473 - protein, 23 aa, Plasmodium falciparum
EANFKREDCCMATDTYEPNIYDD

SEQ ID NO: 3354474 - protein, 21 aa, Plasmodium falciparum
EANKKRILFVKEINEIKKIIQ

SEQ ID NO: 3354475 - protein, 18 aa, Plasmodium falciparum
EANLRYLSISIYQNIIPI

SEQ ID NO: 3354476 - protein, 25 aa, Plasmodium falciparum
EAQIHIVDINYSYIFPKIDKRKFLN

SEQ ID NO: 3354477 - protein, 20 aa, Plasmodium falciparum
EAQLKCNILSMYEKNNLVVP

SEQ ID NO: 3354478 - protein, 19 aa, Plasmodium falciparum
EARIKEEILKEKRLKEEER

SEQ ID NO: 3354479 - protein, 23 aa, Plasmodium falciparum
EARIKKAGGYIANGRVDGNLNLT

SEQ ID NO: 3354480 - protein, 24 aa, Plasmodium falciparum
EARNHFSNKCNYELNNREETYKYI

SEQ ID NO: 3354481 - protein, 26 aa, Plasmodium falciparum
EASKLSDKVMRMFGQELVLINSQILE

SEQ ID NO: 3354482 - protein, 24 aa, Plasmodium falciparum
EASKRIMDIFRTLNSNGLVSQESL

SEQ ID NO: 3354483 - protein, 20 aa, Plasmodium falciparum
EATDLIKLIYSYDATENVMK

SEQ ID NO: 3354484 - protein, 22 aa, Plasmodium falciparum
EAVAKLKFSHFVDVKHVEIACS

SEQ ID NO: 3354485 - protein, 17 aa, Plasmodium falciparum
EAVELPLTHPELYEDIG

SEQ ID NO: 3354486 - protein, 19 aa, Plasmodium falciparum
EAVLYEIFNTVGHVSSIRV

SEQ ID NO: 3354487 - protein, 30 aa, Plasmodium falciparum
EAVSCKELIRSFGWDASDVFTQQDTHELLK

SEQ ID NO: 3354488 - protein, 21 aa, Plasmodium falciparum
EAYESKWTQCIKLIDQGGENL

SEQ ID NO: 3354489 - protein, 25 aa, Plasmodium falciparum
EAYFSRRILYSTTLLMDIRKTLSKK

SEQ ID NO: 3354490 - protein, 26 aa, Plasmodium falciparum
EAYLFKINKIRGYHILKLTDKELKKL

SEQ ID NO: 3354491 - protein, 30 aa, Plasmodium falciparum
EAYRISPKLYKGRICKVVLRDWPYSTQLRN

SEQ ID NO: 3354492 - protein, 20 aa, Plasmodium falciparum
ECECKRDILQNQEFLSTKRC

SEQ ID NO: 3354493 - protein, 24 aa, Plasmodium falciparum
ECENDIRLGIPLIEQAEEALNTLN

SEQ ID NO: 3354494 - protein, 26 aa, Plasmodium falciparum
ECEYKYDIVVYYAFMESFDTIPLSAV

SEQ ID NO: 3354495 - protein, 25 aa, Plasmodium falciparum
ECIDASSLLCKPGSVGKYLYESNSS

SEQ ID NO: 3354496 - protein, 35 aa, Plasmodium falciparum
ECIKKMINVFNEFYTDVLFRIYVINVPSFFKKVWC

SEQ ID NO: 3354497 - protein, 17 aa, Plasmodium falciparum
ECILTNVNVVWSVFNND

SEQ ID NO: 3354498 - protein, 30 aa, Plasmodium falciparum
ECIQCKQCKKKFHRECLQAEGLMDNEQLKD

SEQ ID NO: 3354499 - protein, 18 aa, Plasmodium falciparum
ECKEECKEEGKKECKEEG

SEQ ID NO: 3354500 - protein, 26 aa, Plasmodium falciparum
ECKICKNVFTHFRWKPGENSRYKQTV

SEQ ID NO: 3354501 - protein, 21 aa, Plasmodium falciparum
ECKIKHNMDNFVFSNDEMIYK

SEQ ID NO: 3354502 - protein, 24 aa, Plasmodium falciparum
ECKRRYSVKLWKTFIDCFNCLPVA

SEQ ID NO: 3354503 - protein, 25 aa, Plasmodium falciparum
ECLDIPNDISYHLSIDLKKNSTLLV

SEQ ID NO: 3354504 - protein, 23 aa, Plasmodium falciparum
ECLEGYQRCAFKIDEMSKSEKVD

SEQ ID NO: 3354505 - protein, 20 aa, Plasmodium falciparum
ECLEIKNIIDRVLKTSNIIN

SEQ ID NO: 3354506 - protein, 26 aa, Plasmodium falciparum
ECLHEFHRPLLCSYIKKWYELENNDD

SEQ ID NO: 3354507 - protein, 23 aa, Plasmodium falciparum
ECLKEIIRALILSDINVSYLKDI

SEQ ID NO: 3354508 - protein, 27 aa, Plasmodium falciparum
ECLLDDSNLLPFSRNMNIFPMNRRRNH

SEQ ID NO: 3354509 - protein, 17 aa, Plasmodium falciparum
ECNEIFVDNFIKKYLFL

SEQ ID NO: 3354510 - protein, 24 aa, Plasmodium falciparum
ECNLSYYIVLHIFRVLIKSKINKG

SEQ ID NO: 3354511 - protein, 21 aa, Plasmodium falciparum
ECNPYDKIKFYIFKHKINIPL

SEQ ID NO: 3354512 - protein, 18 aa, Plasmodium falciparum
ECPCCKNEDPLLNQGHKR

SEQ ID NO: 3354513 - protein, 22 aa, Plasmodium falciparum
ECPYKKKRCIYDKVKEYVKNNS

SEQ ID NO: 3354514 - protein, 22 aa, Plasmodium falciparum
ECSAGYFLLKIEEWEQIGNTEE

SEQ ID NO: 3354515 - protein, 19 aa, Plasmodium falciparum
ECSPYCCKEKKNGEDLHTN

SEQ ID NO: 3354516 - protein, 17 aa, Plasmodium falciparum
ECSSPLIHRDIKPTNIV

SEQ ID NO: 3354517 - protein, 25 aa, Plasmodium falciparum
ECSVGRLWTILKCKDLMISMRKCLK

SEQ ID NO: 3354518 - protein, 36 aa, Plasmodium falciparum
ECTFKPQTLWNQSFKKTISFVDEFFVKLKPYIEQQQ

SEQ ID NO: 3354519 - protein, 17 aa, Plasmodium falciparum
ECTPRYNSNLILGLPLG

SEQ ID NO: 3354520 - protein, 19 aa, Plasmodium falciparum
ECVHDYIFLYFNKKALHKH

SEQ ID NO: 3354521 - protein, 24 aa, Plasmodium falciparum
EDALKHFLSKEMLAGENGYYCEKC

SEQ ID NO: 3354522 - protein, 39 aa, Plasmodium falciparum
EDDEIKSNQMVSADTPVLLAKACELFIMELTSNAWKYTE

SEQ ID NO: 3354523 - protein, 20 aa, Plasmodium falciparum
EDDICIHCENLIVENRDTQV

SEQ ID NO: 3354524 - protein, 18 aa, Plasmodium falciparum
EDDLTLKLLDIVKTNIQL

SEQ ID NO: 3354525 - protein, 18 aa, Plasmodium falciparum
EDDNILCGKDIIKNKTKN

SEQ ID NO: 3354526 - protein, 20 aa, Plasmodium falciparum
EDDSWVVIGSFFGSHGLVNQ

SEQ ID NO: 3354527 - protein, 27 aa, Plasmodium falciparum
EDDTQYSLGEWVLRIQLTNIHVNEKKL

SEQ ID NO: 3354528 - protein, 23 aa, Plasmodium falciparum
EDEEMKIHLAMEKNNVYKSNYNN

SEQ ID NO: 3354529 - protein, 21 aa, Plasmodium falciparum
EDELLQLYGHEMKELYFYKKK

SEQ ID NO: 3354530 - protein, 19 aa, Plasmodium falciparum
EDENLSIQLDEEIKNIEEH

SEQ ID NO: 3354531 - protein, 25 aa, Plasmodium falciparum
EDETNFYLCEFCEQNIFDMNNMIKK

SEQ ID NO: 3354532 - protein, 34 aa, Plasmodium falciparum
EDEYNRLRNIPSYELSKYLYLFYELGKMTEKLNT

SEQ ID NO: 3354533 - protein, 25 aa, Plasmodium falciparum
EDFEFNVKCSFNYVNPPSYGLKINR

SEQ ID NO: 3354534 - protein, 18 aa, Plasmodium falciparum
EDFEVRKEAAWAISNASS

SEQ ID NO: 3354535 - protein, 25 aa, Plasmodium falciparum
EDFFYFVKCDMNFDNFELTKNWPNE

SEQ ID NO: 3354536 - protein, 25 aa, Plasmodium falciparum
EDFLKSEYFKLILKLYMHEKENIYK

SEQ ID NO: 3354537 - protein, 19 aa, Plasmodium falciparum
EDGDRFNFVLSQENDNLLD

SEQ ID NO: 3354538 - protein, 25 aa, Plasmodium falciparum
EDGEIKANFFGKAVDKWFDFIEVGK

SEQ ID NO: 3354539 - protein, 24 aa, Plasmodium falciparum
EDGGHTWGDFSRDKIGNVKKKEKQ

SEQ ID NO: 3354540 - protein, 23 aa, Plasmodium falciparum
EDGHLSLLFSARLFRVHIHGKVV

SEQ ID NO: 3354541 - protein, 18 aa, Plasmodium falciparum
EDGIKWLEYTYLFIRMKK

SEQ ID NO: 3354542 - protein, 20 aa, Plasmodium falciparum
EDGKESIVIIVPTRSIPIII

SEQ ID NO: 3354543 - protein, 19 aa, Plasmodium falciparum
EDHKKCKICDEIHVDTSKQ

SEQ ID NO: 3354544 - protein, 21 aa, Plasmodium falciparum
EDHLRKLLSKHIHRNEQLLNT

SEQ ID NO: 3354545 - protein, 17 aa, Plasmodium falciparum
EDHTLKILLKNNYVREV

SEQ ID NO: 3354546 - protein, 37 aa, Plasmodium falciparum
EDHWKLCNFKIMFIAYKWTLGVSFAELLEQCELEEGL

SEQ ID NO: 3354547 - protein, 29 aa, Plasmodium falciparum
EDICVKNSCPISLLSSHDIILSKKVKEYF

SEQ ID NO: 3354548 - protein, 24 aa, Plasmodium falciparum
EDICYKYEKSLCIFDSKNKYIEER

SEQ ID NO: 3354549 - protein, 22 aa, Plasmodium falciparum
EDIDVLPYREELALIENMLAYL

SEQ ID NO: 3354550 - protein, 23 aa, Plasmodium falciparum
EDIFLKNHRSIYGSYYDKEKNKW

SEQ ID NO: 3354551 - protein, 30 aa, Plasmodium falciparum
EDIFYSPRIWFIFKMYGFKNVQILNGGLNK

SEQ ID NO: 3354552 - protein, 23 aa, Plasmodium falciparum
EDIIPFIPCNNFLQQILNNNDYK

SEQ ID NO: 3354553 - protein, 25 aa, Plasmodium falciparum
EDIKLYCIEILKALNYLRKMSLTHT

SEQ ID NO: 3354554 - protein, 17 aa, Plasmodium falciparum
EDIKNGLSINSEHNDLK

SEQ ID NO: 3354555 - protein, 19 aa, Plasmodium falciparum
EDILLKLQKTINMKLNEKK

SEQ ID NO: 3354556 - protein, 23 aa, Plasmodium falciparum
EDILNKLNEEWTIEHNEDLLDIP

SEQ ID NO: 3354557 - protein, 17 aa, Plasmodium falciparum
EDILRKSINEYKETINI

SEQ ID NO: 3354558 - protein, 22 aa, Plasmodium falciparum
EDINGVNMCKYDGNYTNRNHLN

SEQ ID NO: 3354559 - protein, 27 aa, Plasmodium falciparum
EDIRVDLISGYILDIAGKGAENYKNSN

SEQ ID NO: 3354560 - protein, 17 aa, Plasmodium falciparum
EDISNCINLFIHDYIYL

SEQ ID NO: 3354561 - protein, 27 aa, Plasmodium falciparum
EDIVPNRFLSQIDCVNVLCCNKTSLHY

SEQ ID NO: 3354562 - protein, 20 aa, Plasmodium falciparum
EDIYDLLSFDCVSPIKTVYG

SEQ ID NO: 3354563 - protein, 20 aa, Plasmodium falciparum
EDIYFKDFIHAIHIKNNTKF

SEQ ID NO: 3354564 - protein, 19 aa, Plasmodium falciparum
EDIYFYPIQYLKREYTKMY

SEQ ID NO: 3354565 - protein, 24 aa, Plasmodium falciparum
EDKEESLSRVVNFHELFPVLETKK

SEQ ID NO: 3354566 - protein, 18 aa, Plasmodium falciparum
EDKKECIQKVSFENNMYI

SEQ ID NO: 3354567 - protein, 24 aa, Plasmodium falciparum
EDKKLGGTCLNRGCIPSKSLLHIS

SEQ ID NO: 3354568 - protein, 22 aa, Plasmodium falciparum
EDKKRLKKELLYKENEISNLKK

SEQ ID NO: 3354569 - protein, 23 aa, Plasmodium falciparum
EDKNICTMIKKNIQYNIVEKYRY

SEQ ID NO: 3354570 - protein, 27 aa, Plasmodium falciparum
EDKYKKLSIYILKYGCHTLPGEPDSKS

SEQ ID NO: 3354571 - protein, 26 aa, Plasmodium falciparum
EDKYLFMCGRLVFKVFYNMKKEMIVY

SEQ ID NO: 3354572 - protein, 27 aa, Plasmodium falciparum
EDLIINICGTICHKAFNNIKTIFNTYE

SEQ ID NO: 3354573 - protein, 22 aa, Plasmodium falciparum
EDLLKILITYSYKSKVFKNKFV

SEQ ID NO: 3354574 - protein, 21 aa, Plasmodium falciparum
EDLNSLYVLKLFKNINPYHVK

SEQ ID NO: 3354575 - protein, 19 aa, Plasmodium falciparum
EDLPAELYKNIRPINQRVT

SEQ ID NO: 3354576 - protein, 22 aa, Plasmodium falciparum
EDLRKAAECHRQVRKHMQAFIK

SEQ ID NO: 3354577 - protein, 40 aa, Plasmodium falciparum
EDLRSIPDLKRTKLCYKLLKGEKCFNKKCNYAHNQDELKS

SEQ ID NO: 3354578 - protein, 34 aa, Plasmodium falciparum
EDLSRFRTKQCKRLLNGGCNFGLDRCQYSHNEFW

SEQ ID NO: 3354579 - protein, 19 aa, Plasmodium falciparum
EDLYCTKKVLSSVHEKMLC

SEQ ID NO: 3354580 - protein, 28 aa, Plasmodium falciparum
EDLYIRWPYFYNRMDVLEPFYITNTACV

SEQ ID NO: 3354581 - protein, 17 aa, Plasmodium falciparum
EDMEHPYNFGVYQDPIT

SEQ ID NO: 3354582 - protein, 19 aa, Plasmodium falciparum
EDNCIKFTYVSSIELDTSP

SEQ ID NO: 3354583 - protein, 20 aa, Plasmodium falciparum
EDNIKGKDNIKCEDNIKCED

SEQ ID NO: 3354584 - protein, 24 aa, Plasmodium falciparum
EDNSFCKNDLWILNIKKCKKGKET

SEQ ID NO: 3354585 - protein, 22 aa, Plasmodium falciparum
EDPDFPHKMMTEALNNNNTIDG

SEQ ID NO: 3354586 - protein, 24 aa, Plasmodium falciparum
EDPIKGVTVSNIFEVCTTSVEEIM

SEQ ID NO: 3354587 - protein, 26 aa, Plasmodium falciparum
EDPLYIVDIFCKIHALKNENKQILYD

SEQ ID NO: 3354588 - protein, 17 aa, Plasmodium falciparum
EDQKKCMPNSSYHDIKA

SEQ ID NO: 3354589 - protein, 35 aa, Plasmodium falciparum
EDQRLIYGKPDWQKFLCPLCDKKYYPPNSYIKNYT

SEQ ID NO: 3354590 - protein, 24 aa, Plasmodium falciparum
EDSKIKFFVKMLLFEKRYSSYDVN

SEQ ID NO: 3354591 - protein, 24 aa, Plasmodium falciparum
EDSLKRIENVLGRGWEQHSEGKIL

SEQ ID NO: 3354592 - protein, 23 aa, Plasmodium falciparum
EDSRLKYKINEIMERKNSLNNHN

SEQ ID NO: 3354593 - protein, 19 aa, Plasmodium falciparum
EDSSLFLLNYIIPNYNYFY

SEQ ID NO: 3354594 - protein, 24 aa, Plasmodium falciparum
EDTKSMLIKVCLHDLQNYICNYKL

SEQ ID NO: 3354595 - protein, 22 aa, Plasmodium falciparum
EDTMSSNLCTSIINYNDNKEIK

SEQ ID NO: 3354596 - protein, 26 aa, Plasmodium falciparum
EDTSYKLKSLYLLNEYLNVEPTNNVY

SEQ ID NO: 3354597 - protein, 27 aa, Plasmodium falciparum
EDVKEIIDLCFKYRKTYSTKKNRVSSR

SEQ ID NO: 3354598 - protein, 24 aa, Plasmodium falciparum
EDVNIPICGSSKSPLNIQNNNIEI

SEQ ID NO: 3354599 - protein, 18 aa, Plasmodium falciparum
EDVPEMLENANLLEDREH

SEQ ID NO: 3354600 - protein, 19 aa, Plasmodium falciparum
EDYFYKVFYFYHIYLSNEM

SEQ ID NO: 3354601 - protein, 20 aa, Plasmodium falciparum
EDYLYALKLNEALNGSGAND

SEQ ID NO: 3354602 - protein, 18 aa, Plasmodium falciparum
EEANDCRDDMLIGSFNGD

SEQ ID NO: 3354603 - protein, 26 aa, Plasmodium falciparum
EECGADVRLGNLYVQVHEGFTERLME

SEQ ID NO: 3354604 - protein, 24 aa, Plasmodium falciparum
EEDALFEVCGSLKNDDILYKDNKL

SEQ ID NO: 3354605 - protein, 17 aa, Plasmodium falciparum
EEDCTPLAHSIKITKNY

SEQ ID NO: 3354606 - protein, 19 aa, Plasmodium falciparum
EEDELYKGQYDQMYEGEDE

SEQ ID NO: 3354607 - protein, 18 aa, Plasmodium falciparum
EEDIKAFFQNVGNTTSYK

SEQ ID NO: 3354608 - protein, 24 aa, Plasmodium falciparum
EEDRSKKDICSRASEEKEQKIDKE

SEQ ID NO: 3354609 - protein, 21 aa, Plasmodium falciparum
EEDSLKCKQKTKREMHSDIFF

SEQ ID NO: 3354610 - protein, 25 aa, Plasmodium falciparum
EEDSSFIFKPTFNYLGKNNNNNNNH

SEQ ID NO: 3354611 - protein, 18 aa, Plasmodium falciparum
EEEARYLFHQILLAIKFL

SEQ ID NO: 3354612 - protein, 33 aa, Plasmodium falciparum
EEEGMKLLREKICFKMLKSIDIYITEIIMKSCF

SEQ ID NO: 3354613 - protein, 24 aa, Plasmodium falciparum
EEEIYKKLFEKLNLDIEKERLISK

SEQ ID NO: 3354614 - protein, 23 aa, Plasmodium falciparum
EEEKDCFQDILLNEIWDIYDNQE

SEQ ID NO: 3354615 - protein, 24 aa, Plasmodium falciparum
EEEKRKRKLSSLKNYEKDLKQTIN

SEQ ID NO: 3354616 - protein, 25 aa, Plasmodium falciparum
EEELKCLFLKRLNFGTAGLRGKMCV

SEQ ID NO: 3354617 - protein, 22 aa, Plasmodium falciparum
EEELRELFNRYGNVTEVYIMKN

SEQ ID NO: 3354618 - protein, 21 aa, Plasmodium falciparum
EEEMNCIKKENQEIINNYNEL

SEQ ID NO: 3354619 - protein, 25 aa, Plasmodium falciparum
EEENDWKIPPCVSNWKNNKGYNIPL

SEQ ID NO: 3354620 - protein, 23 aa, Plasmodium falciparum
EEEQCGKGVACICDKNEDVDDLF

SEQ ID NO: 3354621 - protein, 24 aa, Plasmodium falciparum
EEEQFCKRRIFLNTYSLSLNGKYL

SEQ ID NO: 3354622 - protein, 24 aa, Plasmodium falciparum
EEERKCNICNMTFINNQLMMRHVN

SEQ ID NO: 3354623 - protein, 22 aa, Plasmodium falciparum
EEETKGSSVFSINNEHCGTTKF

SEQ ID NO: 3354624 - protein, 26 aa, Plasmodium falciparum
EEEYELWKIRHINRLKRDELDRKKHE

SEQ ID NO: 3354625 - protein, 24 aa, Plasmodium falciparum
EEFEQNNFFCAAKEIYSNNSENVQ

SEQ ID NO: 3354626 - protein, 18 aa, Plasmodium falciparum
EEFESLKCFFEENNSTSI

SEQ ID NO: 3354627 - protein, 18 aa, Plasmodium falciparum
EEFHLKLLQHFKEYQNLV

SEQ ID NO: 3354628 - protein, 29 aa, Plasmodium falciparum
EEFKLRKDFLNMYCDCLSIEITNHEKEFL

SEQ ID NO: 3354629 - protein, 17 aa, Plasmodium falciparum
EEFKLSYLLEVLQKTGP

SEQ ID NO: 3354630 - protein, 25 aa, Plasmodium falciparum
EEFKNRFVECGGVVNLINLFYDEDL

SEQ ID NO: 3354631 - protein, 17 aa, Plasmodium falciparum
EEFKTIFRRTFASRIYP

SEQ ID NO: 3354632 - protein, 20 aa, Plasmodium falciparum
EEFVLKWIIERKTLNDLSAS

SEQ ID NO: 3354633 - protein, 25 aa, Plasmodium falciparum
EEGISRLLVGRTFAYFPKYVDGKNN

SEQ ID NO: 3354634 - protein, 28 aa, Plasmodium falciparum
EEHFSKKERLCDIISAYRSICLSQYNNA

SEQ ID NO: 3354635 - protein, 24 aa, Plasmodium falciparum
EEHIKHFPFILAYDKNHFLIEHLE

SEQ ID NO: 3354636 - protein, 26 aa, Plasmodium falciparum
EEHSDICPFLFCYLWLKSNDYKIDKW

SEQ ID NO: 3354637 - protein, 17 aa, Plasmodium falciparum
EEICNFHEGLVLKGKVE

SEQ ID NO: 3354638 - protein, 20 aa, Plasmodium falciparum
EEIFKYVCKEIFNFQVDENR

SEQ ID NO: 3354639 - protein, 20 aa, Plasmodium falciparum
EEIIKALINNIGYSHEHNNN

SEQ ID NO: 3354640 - protein, 17 aa, Plasmodium falciparum
EEIISIIVLPFNYLGLS

SEQ ID NO: 3354641 - protein, 24 aa, Plasmodium falciparum
EEIKWLKCKSELNINIKNLWENDI

SEQ ID NO: 3354642 - protein, 17 aa, Plasmodium falciparum
EEILYHPLFYKTKRCED

SEQ ID NO: 3354643 - protein, 17 aa, Plasmodium falciparum
EEINCVKGIWDELKIIY

SEQ ID NO: 3354644 - protein, 24 aa, Plasmodium falciparum
EEINKNIIFCPSKNAYRFIEDVNE

SEQ ID NO: 3354645 - protein, 19 aa, Plasmodium falciparum
EEIREAFNLLDTDGTGTID

SEQ ID NO: 3354646 - protein, 29 aa, Plasmodium falciparum
EEIRKLKEDLMKWKFTYNENENLLKKKQE

SEQ ID NO: 3354647 - protein, 20 aa, Plasmodium falciparum
EEISRFLLYINRRRRKLRSK

SEQ ID NO: 3354648 - protein, 18 aa, Plasmodium falciparum
EEIYCAKKKKIRRIKRKQ

SEQ ID NO: 3354649 - protein, 20 aa, Plasmodium falciparum
EEIYFCITNFSLKKVLNDLL

SEQ ID NO: 3354650 - protein, 17 aa, Plasmodium falciparum
EEIYKLNNDIDMLSNNC

SEQ ID NO: 3354651 - protein, 24 aa, Plasmodium falciparum
EEIYKTLICILLLGNINFVESAND

SEQ ID NO: 3354652 - protein, 17 aa, Plasmodium falciparum
EEIYLPYVNDLLYEQIK

SEQ ID NO: 3354653 - protein, 22 aa, Plasmodium falciparum
EEKAIRLNKNIYRVVNINKEEE

SEQ ID NO: 3354654 - protein, 24 aa, Plasmodium falciparum
EEKCSYYKNKYSVLYKDNENYSNN

SEQ ID NO: 3354655 - protein, 23 aa, Plasmodium falciparum
EEKDILIRENISLSQLNLKIKEL

SEQ ID NO: 3354656 - protein, 21 aa, Plasmodium falciparum
EEKEEFSECNQLFKNTKTLSS

SEQ ID NO: 3354657 - protein, 24 aa, Plasmodium falciparum
EEKEERKEIFTSRNNDSLVDVDYN

SEQ ID NO: 3354658 - protein, 22 aa, Plasmodium falciparum
EEKEKKLSALDLNNNMNNENNY

SEQ ID NO: 3354659 - protein, 25 aa, Plasmodium falciparum
EEKESAKNWFAVENIKLRNKLKKLK

SEQ ID NO: 3354660 - protein, 19 aa, Plasmodium falciparum
EEKGIRHLINILLHTNKSI

SEQ ID NO: 3354661 - protein, 25 aa, Plasmodium falciparum
EEKISFEYFRNCFNDLNYDIKVSDI

SEQ ID NO: 3354662 - protein, 24 aa, Plasmodium falciparum
EEKKEFDIIVAFEIFSDDSFKIVQ

SEQ ID NO: 3354663 - protein, 25 aa, Plasmodium falciparum
EEKKEFKLYLEQKYKENFENEKSGL

SEQ ID NO: 3354664 - protein, 24 aa, Plasmodium falciparum
EEKKKADPSFSFSSSSSSSFSSYP

SEQ ID NO: 3354665 - protein, 21 aa, Plasmodium falciparum
EEKKKGSIIEISKNDKTKEKT

SEQ ID NO: 3354666 - protein, 21 aa, Plasmodium falciparum
EEKKRQVGILYNEIKKTDIDK

SEQ ID NO: 3354667 - protein, 18 aa, Plasmodium falciparum
EEKLHEWLEYELTNQTNI

SEQ ID NO: 3354668 - protein, 19 aa, Plasmodium falciparum
EEKLLLVYLHIEYDDVSYF

SEQ ID NO: 3354669 - protein, 24 aa, Plasmodium falciparum
EEKLRNAVFRCFERENNLFSDLLK

SEQ ID NO: 3354670 - protein, 23 aa, Plasmodium falciparum
EEKMKFKAIVYVAREYNDTQKKI

SEQ ID NO: 3354671 - protein, 26 aa, Plasmodium falciparum
EEKNEIFYFLLKKIITSFEKKKKGNI

SEQ ID NO: 3354672 - protein, 17 aa, Plasmodium falciparum
EEKPCLHERTCKINEFI

SEQ ID NO: 3354673 - protein, 20 aa, Plasmodium falciparum
EEKRKIKIFVWNKLTLEILS

SEQ ID NO: 3354674 - protein, 18 aa, Plasmodium falciparum
EEKRKIQICYSLQHHIFS

SEQ ID NO: 3354675 - protein, 19 aa, Plasmodium falciparum
EEKYILAFNTYMYDVQKEI

SEQ ID NO: 3354676 - protein, 23 aa, Plasmodium falciparum
EEKYNICMLFYKYISNSTYLVHL

SEQ ID NO: 3354677 - protein, 19 aa, Plasmodium falciparum
EELCYKRALEAFNVSEEEW

SEQ ID NO: 3354678 - protein, 24 aa, Plasmodium falciparum
EELDKVVRNEMDMINSLKDEKVIG

SEQ ID NO: 3354679 - protein, 23 aa, Plasmodium falciparum
EELEKRLKNKNSNVLNVTLSDKL

SEQ ID NO: 3354680 - protein, 30 aa, Plasmodium falciparum
EELENPINIHRWRNLEGNDPTSFDLIQKLK

SEQ ID NO: 3354681 - protein, 25 aa, Plasmodium falciparum
EELFLCFHHKLYALGKHYNSVIDLP

SEQ ID NO: 3354682 - protein, 25 aa, Plasmodium falciparum
EELILKMIDGVLLRKIGVNSQNDES

SEQ ID NO: 3354683 - protein, 41 aa, Plasmodium falciparum
EELILNPTVCKYVPGELYNRILKCYEKLDFMITNLNNINEE

SEQ ID NO: 3354684 - protein, 19 aa, Plasmodium falciparum
EELKEARLIAMVEKKKKED

SEQ ID NO: 3354685 - protein, 20 aa, Plasmodium falciparum
EELTEKLVQLHIPPKFNEKL

SEQ ID NO: 3354686 - protein, 24 aa, Plasmodium falciparum
EELYFKIRQLFIVQAPDYDCVNDD

SEQ ID NO: 3354687 - protein, 20 aa, Plasmodium falciparum
EEMFDLKEQIMIMKKKNLLL

SEQ ID NO: 3354688 - protein, 19 aa, Plasmodium falciparum
EEMGLSRIAIKDMEEIKKD

SEQ ID NO: 3354689 - protein, 24 aa, Plasmodium falciparum
EEMSLRKNTLLSLCSSDIKNDINV

SEQ ID NO: 3354690 - protein, 20 aa, Plasmodium falciparum
EEMVKEDSNHFILNNNENES

SEQ ID NO: 3354691 - protein, 20 aa, Plasmodium falciparum
EENIKLLGNEKVYETKKNSN

SEQ ID NO: 3354692 - protein, 17 aa, Plasmodium falciparum
EENKCTIIFIDEIEILC

SEQ ID NO: 3354693 - protein, 21 aa, Plasmodium falciparum
EENKKGIGINGNFGSESNSSS

SEQ ID NO: 3354694 - protein, 23 aa, Plasmodium falciparum
EENKKLKLQNEVISTKNDTISTV

SEQ ID NO: 3354695 - protein, 22 aa, Plasmodium falciparum
EENKMNCSEHLNIVPINHNNNN

SEQ ID NO: 3354696 - protein, 30 aa, Plasmodium falciparum
EENKNIFTIKEFFRIIQIPDIINEAKPINV

SEQ ID NO: 3354697 - protein, 42 aa, Plasmodium falciparum
EENLCSGCKKVLIKKLSCPICLKNKIFSYFCNQECFKGSWKE

SEQ ID NO: 3354698 - protein, 20 aa, Plasmodium falciparum
EENNHPLLHTCFFKNAEDFE

SEQ ID NO: 3354699 - protein, 26 aa, Plasmodium falciparum
EENNSRPPLYEDLFLKKTKITNIDDK

SEQ ID NO: 3354700 - protein, 23 aa, Plasmodium falciparum
EENRRKKHHLVLINEKCEESEYD

SEQ ID NO: 3354701 - protein, 32 aa, Plasmodium falciparum
EEPCPRYRHASVFVRRYIKKSKSIYIFYTYGG

SEQ ID NO: 3354702 - protein, 19 aa, Plasmodium falciparum
EEPFSFNFYEHGNIKIIDR

SEQ ID NO: 3354703 - protein, 19 aa, Plasmodium falciparum
EEQKCKNKNKSIIKNEQDI

SEQ ID NO: 3354704 - protein, 25 aa, Plasmodium falciparum
EEQKEFLNSLTIISKQIKYKCPHPI

SEQ ID NO: 3354705 - protein, 17 aa, Plasmodium falciparum
EEQKYFVTPSFLPGQNE

SEQ ID NO: 3354706 - protein, 21 aa, Plasmodium falciparum
EEQYNIKHCNIINNNNFNDVH

SEQ ID NO: 3354707 - protein, 17 aa, Plasmodium falciparum
EERIKIVNELNRKINEQ

SEQ ID NO: 3354708 - protein, 21 aa, Plasmodium falciparum
EERIPFLICSCCYTKYKDLRK

SEQ ID NO: 3354709 - protein, 26 aa, Plasmodium falciparum
EERIRILKCGGIIANINGINRIITKH

SEQ ID NO: 3354710 - protein, 20 aa, Plasmodium falciparum
EERKANVYEIFENAKKLEPN

SEQ ID NO: 3354711 - protein, 26 aa, Plasmodium falciparum
EERLTYSCIFCFNKDFDIIDISVKKC

SEQ ID NO: 3354712 - protein, 19 aa, Plasmodium falciparum
EERNALIKCLKREFVNHSP

SEQ ID NO: 3354713 - protein, 21 aa, Plasmodium falciparum
EERRYRSVGNIGITNLNELSA

SEQ ID NO: 3354714 - protein, 18 aa, Plasmodium falciparum
EESDCSVILIESDDTQNE

SEQ ID NO: 3354715 - protein, 32 aa, Plasmodium falciparum
EESDFRINYHLFYSTDLCWSNNGKYLGVTYNT

SEQ ID NO: 3354716 - protein, 18 aa, Plasmodium falciparum
EESDHLYKNIEYINKKKT

SEQ ID NO: 3354717 - protein, 23 aa, Plasmodium falciparum
EESIKEKIKLIGIESYYKSIEEI

SEQ ID NO: 3354718 - protein, 21 aa, Plasmodium falciparum
EESIYRYLTLNPLQINKTVVI

SEQ ID NO: 3354719 - protein, 20 aa, Plasmodium falciparum
EESKNMFSDIMYKLKNISEY

SEQ ID NO: 3354720 - protein, 23 aa, Plasmodium falciparum
EESKRGIIYLSYVPIGLSVSKIR

SEQ ID NO: 3354721 - protein, 27 aa, Plasmodium falciparum
EESKYIFKYFFLFEHPHHIHFKDKING

SEQ ID NO: 3354722 - protein, 17 aa, Plasmodium falciparum
EESLILQHCPGGSLEKY

SEQ ID NO: 3354723 - protein, 21 aa, Plasmodium falciparum
EESMGVFCLKEKVKNKINKKY

SEQ ID NO: 3354724 - protein, 24 aa, Plasmodium falciparum
EESRGIRLYVKRVFINDKFSESIP

SEQ ID NO: 3354725 - protein, 17 aa, Plasmodium falciparum
EESSPWFIFTFHTQQIN

SEQ ID NO: 3354726 - protein, 24 aa, Plasmodium falciparum
EESTYSKLRVVKNMNTANNTVSYV

SEQ ID NO: 3354727 - protein, 25 aa, Plasmodium falciparum
EETDYLFNLCEKYDCHFIIVNDVYD

SEQ ID NO: 3354728 - protein, 25 aa, Plasmodium falciparum
EETRSYPNNDYRNIINPNNLNSNNV

SEQ ID NO: 3354729 - protein, 20 aa, Plasmodium falciparum
EETYKYSCVVPYKNDNIFTL

SEQ ID NO: 3354730 - protein, 24 aa, Plasmodium falciparum
EEVCDLKRKLSLKESEMKMMKEEH

SEQ ID NO: 3354731 - protein, 20 aa, Plasmodium falciparum
EEVEKMKVIMLEDIEKNKEK

SEQ ID NO: 3354732 - protein, 18 aa, Plasmodium falciparum
EEVSRQLLVYGRKISLAE

SEQ ID NO: 3354733 - protein, 24 aa, Plasmodium falciparum
EEYIPLEIVLSIMNGELFIEEAYI

SEQ ID NO: 3354734 - protein, 19 aa, Plasmodium falciparum
EEYKMKVLLLEDIKRQCIR

SEQ ID NO: 3354735 - protein, 24 aa, Plasmodium falciparum
EEYLFTYDKINAIKYCSSNEENNN

SEQ ID NO: 3354736 - protein, 17 aa, Plasmodium falciparum
EEYLIIKGMNNYIYIYR

SEQ ID NO: 3354737 - protein, 19 aa, Plasmodium falciparum
EEYLNCYDALLLLYNNKKN

SEQ ID NO: 3354738 - protein, 23 aa, Plasmodium falciparum
EEYMKEFHNIFDIDTFKIPIKEL

SEQ ID NO: 3354739 - protein, 17 aa, Plasmodium falciparum
EEYPCINTQELIVKSNK

SEQ ID NO: 3354740 - protein, 22 aa, Plasmodium falciparum
EEYRETFKYIYEKITNIRNNMW

SEQ ID NO: 3354741 - protein, 17 aa, Plasmodium falciparum
EEYRGLLKVTYPINHGI

SEQ ID NO: 3354742 - protein, 25 aa, Plasmodium falciparum
EEYSDIYPVSSWQVFEPNLSSKTLN

SEQ ID NO: 3354743 - protein, 30 aa, Plasmodium falciparum
EEYSRKSLILSRNFCCSKNYGYYEENLNTF

SEQ ID NO: 3354744 - protein, 19 aa, Plasmodium falciparum
EEYVKFSIDIEEFTKNEMK

SEQ ID NO: 3354745 - protein, 19 aa, Plasmodium falciparum
EFAESLLVIPKILALNASY

SEQ ID NO: 3354746 - protein, 22 aa, Plasmodium falciparum
EFEKKLLCISKKNLDNVKSTFS

SEQ ID NO: 3354747 - protein, 26 aa, Plasmodium falciparum
EFELKKKKFRPGVISEKLRNALNIEP

SEQ ID NO: 3354748 - protein, 23 aa, Plasmodium falciparum
EFELMYPDGFIKYIEKGREFLKR

SEQ ID NO: 3354749 - protein, 20 aa, Plasmodium falciparum
EFERICNKHFFFSNNSYTSK

SEQ ID NO: 3354750 - protein, 20 aa, Plasmodium falciparum
EFFCYYCLKQNNYVKNVIIY

SEQ ID NO: 3354751 - protein, 21 aa, Plasmodium falciparum
EFGILKGYDIILLRYSYEVIY

SEQ ID NO: 3354752 - protein, 33 aa, Plasmodium falciparum
EFIDSCFTLDKFFCLFSLLKIKNKIYIFLKDIK

SEQ ID NO: 3354753 - protein, 26 aa, Plasmodium falciparum
EFIKKLKFLFYFNCINLDNKINDKDL

SEQ ID NO: 3354754 - protein, 22 aa, Plasmodium falciparum
EFIKRHLFYKGPSKDIYINLLD

SEQ ID NO: 3354755 - protein, 29 aa, Plasmodium falciparum
EFKKKNCKIIKRLLWGELFEEKKKRIRKV

SEQ ID NO: 3354756 - protein, 21 aa, Plasmodium falciparum
EFKPCHYISSIYKRVKNIERK

SEQ ID NO: 3354757 - protein, 19 aa, Plasmodium falciparum
EFLEQNWNTNIWKNKYDQH

SEQ ID NO: 3354758 - protein, 26 aa, Plasmodium falciparum
EFLFYGCREVCKIYILNNNLLIVHLS

SEQ ID NO: 3354759 - protein, 19 aa, Plasmodium falciparum
EFLIREGICALEHIRIHGA

SEQ ID NO: 3354760 - protein, 24 aa, Plasmodium falciparum
EFLSRPSERLQWIGNELPSDDLSI

SEQ ID NO: 3354761 - protein, 24 aa, Plasmodium falciparum
EFMHELSIALKYFIEHKITNDEKW

SEQ ID NO: 3354762 - protein, 43 aa, Plasmodium falciparum
EFNDIAFQLCPWKKGIQWNLLKKMWTCKLWDNKGNEITKNIHI

SEQ ID NO: 3354763 - protein, 23 aa, Plasmodium falciparum
EFNKLMSGLIIYGTNEVEYIYEK

SEQ ID NO: 3354764 - protein, 25 aa, Plasmodium falciparum
EFNSRLYPIIICNILSDTKNIDINV

SEQ ID NO: 3354765 - protein, 21 aa, Plasmodium falciparum
EFRGKTGFSDNIWGNTGDVKY

SEQ ID NO: 3354766 - protein, 23 aa, Plasmodium falciparum
EFRKYCKSRCLKINKIYFENECL

SEQ ID NO: 3354767 - protein, 24 aa, Plasmodium falciparum
EFRRMKKGNVPKEFIGQPGCTDFE

SEQ ID NO: 3354768 - protein, 21 aa, Plasmodium falciparum
EFSELPKLLKKHISIQKPIVL

SEQ ID NO: 3354769 - protein, 18 aa, Plasmodium falciparum
EFSLEFKEQLYFYLNKKD

SEQ ID NO: 3354770 - protein, 26 aa, Plasmodium falciparum
EFSLIDLCGLQLCIRDNEMFFKIWMK

SEQ ID NO: 3354771 - protein, 20 aa, Plasmodium falciparum
EFSSNILYKCVKKNDKINKS

SEQ ID NO: 3354772 - protein, 24 aa, Plasmodium falciparum
EFSYQPYICLKDVMKKTNKQTFRP

SEQ ID NO: 3354773 - protein, 20 aa, Plasmodium falciparum
EFTFLYDLFDYIKIDIYFNY

SEQ ID NO: 3354774 - protein, 17 aa, Plasmodium falciparum
EFTKSRKSLKIFNYHIP

SEQ ID NO: 3354775 - protein, 24 aa, Plasmodium falciparum
EFTVPLKGCRIINNITEIGPCIHI

SEQ ID NO: 3354776 - protein, 19 aa, Plasmodium falciparum
EFWMIEPEIAFADLYDNME

SEQ ID NO: 3354777 - protein, 20 aa, Plasmodium falciparum
EFYNSKGLCPINVFLSYQKE

SEQ ID NO: 3354778 - protein, 18 aa, Plasmodium falciparum
EFYYLTKNFFSLKKLLLV

SEQ ID NO: 3354779 - protein, 19 aa, Plasmodium falciparum
EGALYNFSSIYNAKQRRPY

SEQ ID NO: 3354780 - protein, 17 aa, Plasmodium falciparum
EGATVLEPIKGYYIEPI

SEQ ID NO: 3354781 - protein, 21 aa, Plasmodium falciparum
EGCNKVHNGIHYFKQHDEYSM

SEQ ID NO: 3354782 - protein, 17 aa, Plasmodium falciparum
EGCYKNGDIYNMEIINN

SEQ ID NO: 3354783 - protein, 26 aa, Plasmodium falciparum
EGDFYFDKGKMGSTMGNIENMTNLEF

SEQ ID NO: 3354784 - protein, 25 aa, Plasmodium falciparum
EGDNSSIIKLKWGVDTNENESIKRE

SEQ ID NO: 3354785 - protein, 22 aa, Plasmodium falciparum
EGDPKLKIYSKLNVETKSDIKN

SEQ ID NO: 3354786 - protein, 29 aa, Plasmodium falciparum
EGEEEKKKLCVMWELDLSYNYFKEISIDN

SEQ ID NO: 3354787 - protein, 22 aa, Plasmodium falciparum
EGEKGCKQESYGLSLLEDKQNI

SEQ ID NO: 3354788 - protein, 22 aa, Plasmodium falciparum
EGEKGLLRWDFRNNIYTPNKKE

SEQ ID NO: 3354789 - protein, 21 aa, Plasmodium falciparum
EGELDWKIIAINKEDKHYEDI

SEQ ID NO: 3354790 - protein, 24 aa, Plasmodium falciparum
EGEMIKRIMGISEFSTTYNKCHKS

SEQ ID NO: 3354791 - protein, 18 aa, Plasmodium falciparum
EGENRWELLNNIEMVHPI

SEQ ID NO: 3354792 - protein, 19 aa, Plasmodium falciparum
EGESVNVLDILGGDNTNVG

SEQ ID NO: 3354793 - protein, 19 aa, Plasmodium falciparum
EGFGISWSVAHYILNTIKC

SEQ ID NO: 3354794 - protein, 18 aa, Plasmodium falciparum
EGFQFFANICEDKLKVLL

SEQ ID NO: 3354795 - protein, 23 aa, Plasmodium falciparum
EGFTEFLNYIISRLLYKDKKVII

SEQ ID NO: 3354796 - protein, 19 aa, Plasmodium falciparum
EGGTCEWTICALDRQSTIA

SEQ ID NO: 3354797 - protein, 19 aa, Plasmodium falciparum
EGGYHPVKINEIYNDRYRI

SEQ ID NO: 3354798 - protein, 19 aa, Plasmodium falciparum
EGHKHFPFCDENFTNNIIH

SEQ ID NO: 3354799 - protein, 17 aa, Plasmodium falciparum
EGHLIYHYIPSIHKVNT

SEQ ID NO: 3354800 - protein, 20 aa, Plasmodium falciparum
EGIFYKNLKIVKCVCYALLG

SEQ ID NO: 3354801 - protein, 17 aa, Plasmodium falciparum
EGIKFFYTKDELIRVRI

SEQ ID NO: 3354802 - protein, 40 aa, Plasmodium falciparum
EGIKPYIKELRNISSGKRIAWKLAKKHPLLNADINNQYFS

SEQ ID NO: 3354803 - protein, 19 aa, Plasmodium falciparum
EGIKYKFLEDCIYLLKEER

SEQ ID NO: 3354804 - protein, 17 aa, Plasmodium falciparum
EGIKYKKNEIFLDVVES

SEQ ID NO: 3354805 - protein, 18 aa, Plasmodium falciparum
EGILKINLDIDNFIEDNE

SEQ ID NO: 3354806 - protein, 31 aa, Plasmodium falciparum
EGIMKKNYFNCIFYNVGFLDINVDVMNPLYK

SEQ ID NO: 3354807 - protein, 17 aa, Plasmodium falciparum
EGINICRDYQYPFYSPP

SEQ ID NO: 3354808 - protein, 22 aa, Plasmodium falciparum
EGKELADSCNIQFLETSAKIAH

SEQ ID NO: 3354809 - protein, 30 aa, Plasmodium falciparum
EGKKEKHSFNLLPHNICHIDKKVDENNGHI

SEQ ID NO: 3354810 - protein, 22 aa, Plasmodium falciparum
EGKKNKRATHKINEQKVLTPTK

SEQ ID NO: 3354811 - protein, 24 aa, Plasmodium falciparum
EGKKSGNGFLTLKCNDPSNNIFSI

SEQ ID NO: 3354812 - protein, 21 aa, Plasmodium falciparum
EGKLNVLKHFGFIDDQNNLTV

SEQ ID NO: 3354813 - protein, 19 aa, Plasmodium falciparum
EGKNPIAAVTHNRSDLDNE

SEQ ID NO: 3354814 - protein, 19 aa, Plasmodium falciparum
EGKSFKGRHYLNTSAIHFK

SEQ ID NO: 3354815 - protein, 19 aa, Plasmodium falciparum
EGKYFLLPIRCMNDQIILN

SEQ ID NO: 3354816 - protein, 23 aa, Plasmodium falciparum
EGLDIECGHNILGDVQYDGTYNI

SEQ ID NO: 3354817 - protein, 17 aa, Plasmodium falciparum
EGLECCINLIALYLNCN

SEQ ID NO: 3354818 - protein, 21 aa, Plasmodium falciparum
EGLIDFDLCAFFAVVKIIKKT

SEQ ID NO: 3354819 - protein, 26 aa, Plasmodium falciparum
EGLIVITWDKFVHFFTDVEDASPQWS

SEQ ID NO: 3354820 - protein, 24 aa, Plasmodium falciparum
EGLKISDKVSIFFEDWNEDILPVQ

SEQ ID NO: 3354821 - protein, 19 aa, Plasmodium falciparum
EGLLYPYIVREFAIIGNTP

SEQ ID NO: 3354822 - protein, 17 aa, Plasmodium falciparum
EGLSILENMNMQDVVIL

SEQ ID NO: 3354823 - protein, 19 aa, Plasmodium falciparum
EGLVKFYRYVIAKIEVMAL

SEQ ID NO: 3354824 - protein, 19 aa, Plasmodium falciparum
EGLYKSSFYYIKLNENSRY

SEQ ID NO: 3354825 - protein, 19 aa, Plasmodium falciparum
EGMFSHADVLFKMRFIDGI

SEQ ID NO: 3354826 - protein, 18 aa, Plasmodium falciparum
EGMLKKFAISKEKMDITK

SEQ ID NO: 3354827 - protein, 27 aa, Plasmodium falciparum
EGNDEDTMKKFSVDTSENEDDKEDDDD

SEQ ID NO: 3354828 - protein, 20 aa, Plasmodium falciparum
EGNDIFSLQKINVYETKKED

SEQ ID NO: 3354829 - protein, 20 aa, Plasmodium falciparum
EGNIYNHLNVGFNANINSMK

SEQ ID NO: 3354830 - protein, 18 aa, Plasmodium falciparum
EGNLSNTLTHYVTNQQDN

SEQ ID NO: 3354831 - protein, 19 aa, Plasmodium falciparum
EGNNGTIIIWEWKSESYIL

SEQ ID NO: 3354832 - protein, 26 aa, Plasmodium falciparum
EGNNTIYICPMKDYFKNKYKSNDDSN

SEQ ID NO: 3354833 - protein, 19 aa, Plasmodium falciparum
EGPLWKEHIDDVVNENKKK

SEQ ID NO: 3354834 - protein, 25 aa, Plasmodium falciparum
EGQKKICYIYRLFCTGTIDEKVYQR

SEQ ID NO: 3354835 - protein, 30 aa, Plasmodium falciparum
EGRCAIPSNFDCNYCYALGYNAALLIDHKK

SEQ ID NO: 3354836 - protein, 25 aa, Plasmodium falciparum
EGRIRKEDCLDIIKKVIDIVSNEPN

SEQ ID NO: 3354837 - protein, 24 aa, Plasmodium falciparum
EGRTCNICKMVFANKKLMKRHLMC

SEQ ID NO: 3354838 - protein, 29 aa, Plasmodium falciparum
EGSLCEEIEPKFILPNCVGQIRKKNIFHI

SEQ ID NO: 3354839 - protein, 23 aa, Plasmodium falciparum
EGSLLRLFRCEYFDTHLHIRYLY

SEQ ID NO: 3354840 - protein, 18 aa, Plasmodium falciparum
EGSVSYGDNNMCNNRNGY

SEQ ID NO: 3354841 - protein, 23 aa, Plasmodium falciparum
EGTFRPERIVAIAKRYGLHPTDC

SEQ ID NO: 3354842 - protein, 26 aa, Plasmodium falciparum
EGTKKNCLRYDRFHIYDDKIKNIDDI

SEQ ID NO: 3354843 - protein, 24 aa, Plasmodium falciparum
EGTKSPCKNSFTPDGNLSYDKECV

SEQ ID NO: 3354844 - protein, 19 aa, Plasmodium falciparum
EGVASIKDVSYFTYGNNMN

SEQ ID NO: 3354845 - protein, 28 aa, Plasmodium falciparum
EGVDFKHIISNHVINVFQVLGIEAARIT

SEQ ID NO: 3354846 - protein, 33 aa, Plasmodium falciparum
EGVGLSWSPSNMCPDIFFQDIQNFINFAKRKER

SEQ ID NO: 3354847 - protein, 21 aa, Plasmodium falciparum
EGWLHLKKPFILCGPPGSGKT

SEQ ID NO: 3354848 - protein, 17 aa, Plasmodium falciparum
EGYFPSSNKDVLKKQSF

SEQ ID NO: 3354849 - protein, 20 aa, Plasmodium falciparum
EGYLNKKSSIFNMNNEEENK

SEQ ID NO: 3354850 - protein, 19 aa, Plasmodium falciparum
EGYMVKKKEKNKVKEKERK

SEQ ID NO: 3354851 - protein, 17 aa, Plasmodium falciparum
EGYWNKYSMKAHLNGVA

SEQ ID NO: 3354852 - protein, 19 aa, Plasmodium falciparum
EGYYKAMVGEVIDKRYSVV

SEQ ID NO: 3354853 - protein, 20 aa, Plasmodium falciparum
EHAPSIIFMDEIDSIGSQRI

SEQ ID NO: 3354854 - protein, 23 aa, Plasmodium falciparum
EHCVAWGRLIFETFFCKNDNETL

SEQ ID NO: 3354855 - protein, 45 aa, Plasmodium falciparum
EHDNFFNDFMLFRNMYQQIFNPSFRAADAEVHFTAAVGSSNNSND

SEQ ID NO: 3354856 - protein, 24 aa, Plasmodium falciparum
EHDVCLIDPCLHEEEFMSSKISIA

SEQ ID NO: 3354857 - protein, 17 aa, Plasmodium falciparum
EHEEIKELISSNGKRYF

SEQ ID NO: 3354858 - protein, 24 aa, Plasmodium falciparum
EHENILKIWSFFNNFKDDIFHTNI

SEQ ID NO: 3354859 - protein, 27 aa, Plasmodium falciparum
EHFLDFFKPSLGEFGYEGVYKQKTKEI

SEQ ID NO: 3354860 - protein, 17 aa, Plasmodium falciparum
EHFLSFRKGSFVDDISW

SEQ ID NO: 3354861 - protein, 21 aa, Plasmodium falciparum
EHFSKCGGCMFQHIDYNFEKQ

SEQ ID NO: 3354862 - protein, 23 aa, Plasmodium falciparum
EHGEKKLKVFYEIDEKKNLLKNT

SEQ ID NO: 3354863 - protein, 25 aa, Plasmodium falciparum
EHHYFKKLLKHIGFLYNQNVDEWIL

SEQ ID NO: 3354864 - protein, 25 aa, Plasmodium falciparum
EHICFCQNGSFFLYYIVNPNRIEIS

SEQ ID NO: 3354865 - protein, 17 aa, Plasmodium falciparum
EHIDCLIFGQSFSSGCG

SEQ ID NO: 3354866 - protein, 22 aa, Plasmodium falciparum
EHIGSVIGKKGRTINKIQEDTF

SEQ ID NO: 3354867 - protein, 34 aa, Plasmodium falciparum
EHILCKQFIKFTVPCYHIFLKRNQINSIRQKQSK

SEQ ID NO: 3354868 - protein, 19 aa, Plasmodium falciparum
EHINPLNAFELLKRYKEEI

SEQ ID NO: 3354869 - protein, 24 aa, Plasmodium falciparum
EHINPVFNNKCCDIITNQENEKFN

SEQ ID NO: 3354870 - protein, 34 aa, Plasmodium falciparum
EHIYKIKDSFYNLTNPSIAWSFNKIINRTTSQLN

SEQ ID NO: 3354871 - protein, 22 aa, Plasmodium falciparum
EHKCILQTCRFLQTKGFEVTYL

SEQ ID NO: 3354872 - protein, 21 aa, Plasmodium falciparum
EHKEYQLPLSYYNVTQNDTSN

SEQ ID NO: 3354873 - protein, 26 aa, Plasmodium falciparum
EHKLSEVWLNHMFVKNININEECTNN

SEQ ID NO: 3354874 - protein, 21 aa, Plasmodium falciparum
EHMKCNYVSHIISAYSKQINI

SEQ ID NO: 3354875 - protein, 27 aa, Plasmodium falciparum
EHMNEIKSLLLKGIWVVCDRYAYSGVA

SEQ ID NO: 3354876 - protein, 18 aa, Plasmodium falciparum
EHMSSPWGTHNLHNDDND

SEQ ID NO: 3354877 - protein, 19 aa, Plasmodium falciparum
EHNCLAFAGLNADARVLVN

SEQ ID NO: 3354878 - protein, 22 aa, Plasmodium falciparum
EHNKNVFMSNNWDKIYNNNNNN

SEQ ID NO: 3354879 - protein, 20 aa, Plasmodium falciparum
EHNKYYGIRGLIILPTKELV

SEQ ID NO: 3354880 - protein, 34 aa, Plasmodium falciparum
EHQLSYNVPYYIYELNKFVFIKFMKFEKYINKNH

SEQ ID NO: 3354881 - protein, 17 aa, Plasmodium falciparum
EHQREGVQFVFECLMNI

SEQ ID NO: 3354882 - protein, 25 aa, Plasmodium falciparum
EHQVKEKRASFEINTGKTSTTKKNE

SEQ ID NO: 3354883 - protein, 18 aa, Plasmodium falciparum
EHRSESKYGRRSIRKSER

SEQ ID NO: 3354884 - protein, 23 aa, Plasmodium falciparum
EHTHLVKGLDFLLLNKVRNKLID

SEQ ID NO: 3354885 - protein, 23 aa, Plasmodium falciparum
EHTLYICSYLKQFQLLTKSKMNI

SEQ ID NO: 3354886 - protein, 25 aa, Plasmodium falciparum
EHTSVVWCVTFNFDGSQFATCSDDK

SEQ ID NO: 3354887 - protein, 24 aa, Plasmodium falciparum
EHVENLKYLFFFYSSIVQTNYSHA

SEQ ID NO: 3354888 - protein, 24 aa, Plasmodium falciparum
EHVGEKPFCYYTHNYNNNVSNINF

SEQ ID NO: 3354889 - protein, 18 aa, Plasmodium falciparum
EHVIKMLLQILVDQDVRV

SEQ ID NO: 3354890 - protein, 23 aa, Plasmodium falciparum
EHVKSVKKIACCPKKIKENQTKA

SEQ ID NO: 3354891 - protein, 21 aa, Plasmodium falciparum
EHVRQDLKEGMLIQNELNDLL

SEQ ID NO: 3354892 - protein, 30 aa, Plasmodium falciparum
EHWMNRKILGGYIIFPCKLIHEKEDMEQSK

SEQ ID NO: 3354893 - protein, 26 aa, Plasmodium falciparum
EHYERQRLKRTWGEIIKMHYIKYRND

SEQ ID NO: 3354894 - protein, 22 aa, Plasmodium falciparum
EHYESRRICFIGFLNNYHCQCF

SEQ ID NO: 3354895 - protein, 33 aa, Plasmodium falciparum
EHYKKKDILLSLWWKNLIDLYSDIIITNLCNNI

SEQ ID NO: 3354896 - protein, 19 aa, Plasmodium falciparum
EHYKSSLISANKVNNSSFS

SEQ ID NO: 3354897 - protein, 31 aa, Plasmodium falciparum
EHYVFKKVICKKTNIEYILPLYLINNGDNIG

SEQ ID NO: 3354898 - protein, 19 aa, Plasmodium falciparum
EIAFAVFFCPLISKLHHSC

SEQ ID NO: 3354899 - protein, 22 aa, Plasmodium falciparum
EIAKDLNIEYVIIGHFERRKYF

SEQ ID NO: 3354900 - protein, 24 aa, Plasmodium falciparum
EIANFLYEHIELFIEIKKEEKRTK

SEQ ID NO: 3354901 - protein, 25 aa, Plasmodium falciparum
EIARIWRGGCIIRAVFLDRIANAYK

SEQ ID NO: 3354902 - protein, 17 aa, Plasmodium falciparum
EIARLQYFVGAIAVGDL

SEQ ID NO: 3354903 - protein, 18 aa, Plasmodium falciparum
EIASFLFCLSKVRYDTNL

SEQ ID NO: 3354904 - protein, 17 aa, Plasmodium falciparum
EICSHLFYNNRIKNAKR

SEQ ID NO: 3354905 - protein, 23 aa, Plasmodium falciparum
EICSQQFHYARLSTELLLTHLVK

SEQ ID NO: 3354906 - protein, 34 aa, Plasmodium falciparum
EIDEVKDLFCTRYLLNIPRYVRLASWNKNIEDHL

SEQ ID NO: 3354907 - protein, 19 aa, Plasmodium falciparum
EIDINFIRYFSKLTGDLNS

SEQ ID NO: 3354908 - protein, 27 aa, Plasmodium falciparum
EIDISTISCAWVFFERLVMKGYVHKYN

SEQ ID NO: 3354909 - protein, 23 aa, Plasmodium falciparum
EIDKIFICGSYPCFSFSTLKNNV

SEQ ID NO: 3354910 - protein, 25 aa, Plasmodium falciparum
EIDKKEKSNICICKYIDKYDMKNLI

SEQ ID NO: 3354911 - protein, 19 aa, Plasmodium falciparum
EIDNGSSLINSPYFSNQYE

SEQ ID NO: 3354912 - protein, 17 aa, Plasmodium falciparum
EIDNIYFHPPKGSHIKI

SEQ ID NO: 3354913 - protein, 23 aa, Plasmodium falciparum
EIDNKLDVCETVKNALKIENLKE

SEQ ID NO: 3354914 - protein, 20 aa, Plasmodium falciparum
EIDNSYKFWNEEDEHTSIFD

SEQ ID NO: 3354915 - protein, 42 aa, Plasmodium falciparum
EIEHIKKNHGYLHFMWLKRKTLCIEIIKCIATLTEKDTKGVI

SEQ ID NO: 3354916 - protein, 19 aa, Plasmodium falciparum
EIEKDGYIIFAFNIIPITI

SEQ ID NO: 3354917 - protein, 27 aa, Plasmodium falciparum
EIEKLIEGVCKFKNNWEQISEYIQTKT

SEQ ID NO: 3354918 - protein, 24 aa, Plasmodium falciparum
EIEKLRNALNLSREKRGVYLDTEE

SEQ ID NO: 3354919 - protein, 24 aa, Plasmodium falciparum
EIEKVLEEMIVWKVPNFYEEKELI

SEQ ID NO: 3354920 - protein, 21 aa, Plasmodium falciparum
EIENAYIWWSTLFKNEHPIKI

SEQ ID NO: 3354921 - protein, 20 aa, Plasmodium falciparum
EIENRISIMNTRYLCNFSLR

SEQ ID NO: 3354922 - protein, 24 aa, Plasmodium falciparum
EIESLKRENEHILLKVDNLEKNKK

SEQ ID NO: 3354923 - protein, 20 aa, Plasmodium falciparum
EIFFKNVCLYLVRKQIKKKF

SEQ ID NO: 3354924 - protein, 19 aa, Plasmodium falciparum
EIFLFKYSIALCKTLEKEI

SEQ ID NO: 3354925 - protein, 32 aa, Plasmodium falciparum
EIFYPLHKKFRYLNCVNSVFKVACEPINPSEL

SEQ ID NO: 3354926 - protein, 18 aa, Plasmodium falciparum
EIGEGMLTVAGPRSQTEL

SEQ ID NO: 3354927 - protein, 23 aa, Plasmodium falciparum
EIHKFIDYCLKNYGNRNIMDVLN

SEQ ID NO: 3354928 - protein, 34 aa, Plasmodium falciparum
EIHKGFKITRIRNFYMRKVKICQELFREKLQNII

SEQ ID NO: 3354929 - protein, 20 aa, Plasmodium falciparum
EIHKSRFFITLCPSINDIML

SEQ ID NO: 3354930 - protein, 26 aa, Plasmodium falciparum
EIHSDFRYSRKDSIRSINTENNSIYN

SEQ ID NO: 3354931 - protein, 26 aa, Plasmodium falciparum
EIIDKIKKIICMNSCNNREYNILLKY

SEQ ID NO: 3354932 - protein, 26 aa, Plasmodium falciparum
EIIEPWKELGYLFPPYKNYNIIEECI

SEQ ID NO: 3354933 - protein, 21 aa, Plasmodium falciparum
EIIEYFKLRFDKYQVNKKKRK

SEQ ID NO: 3354934 - protein, 25 aa, Plasmodium falciparum
EIIGNMLYDEHICMDDEDLFGRSHL

SEQ ID NO: 3354935 - protein, 20 aa, Plasmodium falciparum
EIIIKFPNCLNEEIFEAVIV

SEQ ID NO: 3354936 - protein, 23 aa, Plasmodium falciparum
EIIKRPNNNLFFEVIRGKKRKNM

SEQ ID NO: 3354937 - protein, 25 aa, Plasmodium falciparum
EIIMTLRIPYLKNYKSTTFTNFNHI

SEQ ID NO: 3354938 - protein, 19 aa, Plasmodium falciparum
EIINKLIGFNLYDIHIYNI

SEQ ID NO: 3354939 - protein, 23 aa, Plasmodium falciparum
EIIQIKCSYIIEKYKNKLKKLKE

SEQ ID NO: 3354940 - protein, 18 aa, Plasmodium falciparum
EIIQLPLINVCIKNNEET

SEQ ID NO: 3354941 - protein, 19 aa, Plasmodium falciparum
EIISLLFCVNSLSLNQYHF

SEQ ID NO: 3354942 - protein, 28 aa, Plasmodium falciparum
EIITFIGKIVFCFSELIHIYGPKIFELN

SEQ ID NO: 3354943 - protein, 24 aa, Plasmodium falciparum
EIIYGGHITDIWDRRINKTYVKNI

SEQ ID NO: 3354944 - protein, 18 aa, Plasmodium falciparum
EIIYKMGYVPSKEDINEF

SEQ ID NO: 3354945 - protein, 18 aa, Plasmodium falciparum
EIIYYYDINVYQFYMNLI

SEQ ID NO: 3354946 - protein, 21 aa, Plasmodium falciparum
EIKAAKIFFLLNINRQDIVNE

SEQ ID NO: 3354947 - protein, 18 aa, Plasmodium falciparum
EIKEIKKKIILKEHVLEE

SEQ ID NO: 3354948 - protein, 24 aa, Plasmodium falciparum
EIKENKILLKKDIDMYVNNIHILE

SEQ ID NO: 3354949 - protein, 24 aa, Plasmodium falciparum
EIKNRSYCDIIWYIDSNSIKDNSF

SEQ ID NO: 3354950 - protein, 22 aa, Plasmodium falciparum
EIKNYFLPDHELSHCTLHSTHC

SEQ ID NO: 3354951 - protein, 22 aa, Plasmodium falciparum
EIKQAYRKLALKYHPDRNPNNR

SEQ ID NO: 3354952 - protein, 29 aa, Plasmodium falciparum
EIKRHYKINDCWIIANGYVYDVSTFINHH

SEQ ID NO: 3354953 - protein, 19 aa, Plasmodium falciparum
EIKSLKVVWNPNKDADNQN

SEQ ID NO: 3354954 - protein, 19 aa, Plasmodium falciparum
EIKTRVSLIDTEIKILKNE

SEQ ID NO: 3354955 - protein, 26 aa, Plasmodium falciparum
EILCHRLGLIPFKFDADLINYKEDNE

SEQ ID NO: 3354956 - protein, 19 aa, Plasmodium falciparum
EILDIPISIVKNIHLCPIT

SEQ ID NO: 3354957 - protein, 28 aa, Plasmodium falciparum
EILDKIFLDAHVNFRLFLSAAIPNEKDT

SEQ ID NO: 3354958 - protein, 22 aa, Plasmodium falciparum
EILEHISWYKQFLVYNNLKNKY

SEQ ID NO: 3354959 - protein, 24 aa, Plasmodium falciparum
EILERKLKESNEMYNLLNDKYNIL

SEQ ID NO: 3354960 - protein, 22 aa, Plasmodium falciparum
EILGIPLCHIMKIKKKNKNVAQ

SEQ ID NO: 3354961 - protein, 18 aa, Plasmodium falciparum
EILHNSSYINIKEARIII

SEQ ID NO: 3354962 - protein, 18 aa, Plasmodium falciparum
EILIKILSKIFLKGNYSL

SEQ ID NO: 3354963 - protein, 18 aa, Plasmodium falciparum
EILLKMSNMKNVDMLLLL

SEQ ID NO: 3354964 - protein, 40 aa, Plasmodium falciparum
EILPQRIQKDILYSLKHFHIEKICSLYREYIDYNMLNFIN

SEQ ID NO: 3354965 - protein, 20 aa, Plasmodium falciparum
EILRIIKLDAERTFNKEENR

SEQ ID NO: 3354966 - protein, 25 aa, Plasmodium falciparum
EILRIYNYESLYSFNDCESEHTERL

SEQ ID NO: 3354967 - protein, 27 aa, Plasmodium falciparum
EILYSESSIKISKFIKKNEKYDWSGYL

SEQ ID NO: 3354968 - protein, 18 aa, Plasmodium falciparum
EILYTLFPHEPHTFMFLY

SEQ ID NO: 3354969 - protein, 25 aa, Plasmodium falciparum
EIMHPSGCGINKNKAFSVIIDNLLN

SEQ ID NO: 3354970 - protein, 38 aa, Plasmodium falciparum
EIMKEYKLGPNGAIMTCLNLFATRFDKVIEILEKRKSK

SEQ ID NO: 3354971 - protein, 20 aa, Plasmodium falciparum
EIMNGLRVRRNSNLYKYVSF

SEQ ID NO: 3354972 - protein, 17 aa, Plasmodium falciparum
EINCVRFNKNGRYIASG

SEQ ID NO: 3354973 - protein, 17 aa, Plasmodium falciparum
EINDLKMDLNFLKSECH

SEQ ID NO: 3354974 - protein, 21 aa, Plasmodium falciparum
EINECDFLFEDEKCRYNTEHN

SEQ ID NO: 3354975 - protein, 22 aa, Plasmodium falciparum
EINELNISFDVRMQNVEELFTK

SEQ ID NO: 3354976 - protein, 21 aa, Plasmodium falciparum
EINENLTFLQIIQYLCSKIEK

SEQ ID NO: 3354977 - protein, 33 aa, Plasmodium falciparum
EINIHIHCHRHIFIVKLEFFFVFGSATNLLVGM

SEQ ID NO: 3354978 - protein, 25 aa, Plasmodium falciparum
EINKEIFEKLPLKLQYQILQDIKEE

SEQ ID NO: 3354979 - protein, 26 aa, Plasmodium falciparum
EINKSYIPICVHKECSTDLIKQNKCS

SEQ ID NO: 3354980 - protein, 19 aa, Plasmodium falciparum
EINKTLSAYEKFYLEKMKV

SEQ ID NO: 3354981 - protein, 17 aa, Plasmodium falciparum
EINNLYLCFLVTEPFLE

SEQ ID NO: 3354982 - protein, 20 aa, Plasmodium falciparum
EINQALSFNLINNVDDDEID

SEQ ID NO: 3354983 - protein, 18 aa, Plasmodium falciparum
EINRTTLRNRKSLSLSST

SEQ ID NO: 3354984 - protein, 17 aa, Plasmodium falciparum
EINSFSFDRRPLVVKKR

SEQ ID NO: 3354985 - protein, 17 aa, Plasmodium falciparum
EIPEIREITKFVESVKV

SEQ ID NO: 3354986 - protein, 22 aa, Plasmodium falciparum
EIPIMCLTATCTKNVQSDILKN

SEQ ID NO: 3354987 - protein, 28 aa, Plasmodium falciparum
EIQDKTYVCPMWNYFKDYKIEKIYKKFK

SEQ ID NO: 3354988 - protein, 18 aa, Plasmodium falciparum
EIQEKNKYISIIKNDLSF

SEQ ID NO: 3354989 - protein, 20 aa, Plasmodium falciparum
EIQKMLTMYFNKYVYPLKKY

SEQ ID NO: 3354990 - protein, 25 aa, Plasmodium falciparum
EIQQRACEFHEFMNPQWDQIRDSIL

SEQ ID NO: 3354991 - protein, 23 aa, Plasmodium falciparum
EIQRCEISSMILLLKSLGMDDII

SEQ ID NO: 3354992 - protein, 20 aa, Plasmodium falciparum
EIRAEFDIVNDFTREEEKQI

SEQ ID NO: 3354993 - protein, 20 aa, Plasmodium falciparum
EIRHLKLKSKNSIVKEQTCI

SEQ ID NO: 3354994 - protein, 19 aa, Plasmodium falciparum
EIRKYILRCTSFNNNGCNN

SEQ ID NO: 3354995 - protein, 29 aa, Plasmodium falciparum
EIRRKVESILKIRMPHFNYGSNKNNVFLN

SEQ ID NO: 3354996 - protein, 21 aa, Plasmodium falciparum
EIRTGKGGGHYDIQHNNEKRV

SEQ ID NO: 3354997 - protein, 25 aa, Plasmodium falciparum
EISIIKIKMLLLRRPDIKTIAEKSI

SEQ ID NO: 3354998 - protein, 24 aa, Plasmodium falciparum
EISKNFKFLISFIGNVNNCNYICY

SEQ ID NO: 3354999 - protein, 21 aa, Plasmodium falciparum
EISLRKYYDMIKCRRNKEEHF

SEQ ID NO: 3355000 - protein, 24 aa, Plasmodium falciparum
EISNEIKKKLCVVIKNKPAEWNHY

SEQ ID NO: 3355001 - protein, 26 aa, Plasmodium falciparum
EITAEGQVMFTFLGRSEIKDYKNVKK

SEQ ID NO: 3355002 - protein, 21 aa, Plasmodium falciparum
EITDPRFLLLTNMNKAFEKNI

SEQ ID NO: 3355003 - protein, 18 aa, Plasmodium falciparum
EITGPVGANIFIFHIPNE

SEQ ID NO: 3355004 - protein, 19 aa, Plasmodium falciparum
EITNSSGSKPCARWGHSSQ

SEQ ID NO: 3355005 - protein, 20 aa, Plasmodium falciparum
EITRRINLESIWQAIYTAGV

SEQ ID NO: 3355006 - protein, 18 aa, Plasmodium falciparum
EITYSCGTNNSLNINNLK

SEQ ID NO: 3355007 - protein, 21 aa, Plasmodium falciparum
EIVEGIKFDRGYISPYFINNS

SEQ ID NO: 3355008 - protein, 21 aa, Plasmodium falciparum
EIVNIKLFFSKTLYLFENVKI

SEQ ID NO: 3355009 - protein, 19 aa, Plasmodium falciparum
EIVVFSLVCSNYFKNIGFL

SEQ ID NO: 3355010 - protein, 19 aa, Plasmodium falciparum
EIWSNKVNLSYDWMNDLDN

SEQ ID NO: 3355011 - protein, 21 aa, Plasmodium falciparum
EIYFNGFLKYSKKKQKKKPLG

SEQ ID NO: 3355012 - protein, 17 aa, Plasmodium falciparum
EIYIEKNIMCSDKNINE

SEQ ID NO: 3355013 - protein, 26 aa, Plasmodium falciparum
EIYMTKLLKKIKVDFLKTQEYLTKEI

SEQ ID NO: 3355014 - protein, 20 aa, Plasmodium falciparum
EIYNNLRLQEEIDQKELFCN

SEQ ID NO: 3355015 - protein, 24 aa, Plasmodium falciparum
EIYVSKLFITLLYKKYFSKKKQKC

SEQ ID NO: 3355016 - protein, 28 aa, Plasmodium falciparum
EKADIFSLGVVFFEMFHEPFSTSMERSI

SEQ ID NO: 3355017 - protein, 25 aa, Plasmodium falciparum
EKAIKRSDVCILVIDSFNGISTQDI

SEQ ID NO: 3355018 - protein, 19 aa, Plasmodium falciparum
EKAIYRFVITRGGLENNRD

SEQ ID NO: 3355019 - protein, 25 aa, Plasmodium falciparum
EKAKEFMEPLTLVKHVTFDNNQEKV

SEQ ID NO: 3355020 - protein, 19 aa, Plasmodium falciparum
EKAKLCSKEQTPVFLNKKH

SEQ ID NO: 3355021 - protein, 23 aa, Plasmodium falciparum
EKALKFGIVLDFDYVRENFENNL

SEQ ID NO: 3355022 - protein, 18 aa, Plasmodium falciparum
EKCASWIYFDPLTWSKKT

SEQ ID NO: 3355023 - protein, 22 aa, Plasmodium falciparum
EKCDNIIKKYCPIHPDEHVNMY

SEQ ID NO: 3355024 - protein, 18 aa, Plasmodium falciparum
EKCFTRNDINIYKKEKKK

SEQ ID NO: 3355025 - protein, 18 aa, Plasmodium falciparum
EKCKYKKNMSFVKNNMLR

SEQ ID NO: 3355026 - protein, 18 aa, Plasmodium falciparum
EKCMCCSERVILKYQEDK

SEQ ID NO: 3355027 - protein, 19 aa, Plasmodium falciparum
EKCSFGKNCNMIFQNKNIE

SEQ ID NO: 3355028 - protein, 22 aa, Plasmodium falciparum
EKCSNFSTPLVDVFNRLNKLDI

SEQ ID NO: 3355029 - protein, 19 aa, Plasmodium falciparum
EKCVDKVMYDFINNNIDKE

SEQ ID NO: 3355030 - protein, 18 aa, Plasmodium falciparum
EKCYCIGTIFKKMELRPS

SEQ ID NO: 3355031 - protein, 18 aa, Plasmodium falciparum
EKCYDIGNYYSGKLYPEG

SEQ ID NO: 3355032 - protein, 27 aa, Plasmodium falciparum
EKDEEMKKKLQFLLIGGDEKKQMEFME

SEQ ID NO: 3355033 - protein, 37 aa, Plasmodium falciparum
EKDELKPKAPHIFCIKCKEVLVTNRFLDKYKTKIIMI

SEQ ID NO: 3355034 - protein, 44 aa, Plasmodium falciparum
EKDHLKCLLEEYSKTLEIYKMGKIQLEFELKCCKEKLNEEIEKN

SEQ ID NO: 3355035 - protein, 22 aa, Plasmodium falciparum
EKDIPKNILVNNVVNMEEQKKM

SEQ ID NO: 3355036 - protein, 18 aa, Plasmodium falciparum
EKDKVYKKCCSLKQNRMI

SEQ ID NO: 3355037 - protein, 23 aa, Plasmodium falciparum
EKDLFLKRVQKLCSLIKNKKFNY

SEQ ID NO: 3355038 - protein, 25 aa, Plasmodium falciparum
EKDLKNILKQICLEDNSILIFTDKN

SEQ ID NO: 3355039 - protein, 18 aa, Plasmodium falciparum
EKDMCLINEKNSYSFGKD

SEQ ID NO: 3355040 - protein, 19 aa, Plasmodium falciparum
EKDRMIVLHNILKDCIIAK

SEQ ID NO: 3355041 - protein, 24 aa, Plasmodium falciparum
EKEASKILCGLGFDSNLQKKKVNS

SEQ ID NO: 3355042 - protein, 26 aa, Plasmodium falciparum
EKEDICISILCLLKTELEIIDDENKK

SEQ ID NO: 3355043 - protein, 19 aa, Plasmodium falciparum
EKEECPLKEINKNIQHNKN

SEQ ID NO: 3355044 - protein, 19 aa, Plasmodium falciparum
EKEEVLVLFFHSTLLDNNY

SEQ ID NO: 3355045 - protein, 22 aa, Plasmodium falciparum
EKEFIRIAYYMNSFYKDMELRE

SEQ ID NO: 3355046 - protein, 20 aa, Plasmodium falciparum
EKEFLIPFLQSFNISLKKSD

SEQ ID NO: 3355047 - protein, 27 aa, Plasmodium falciparum
EKEFPKIHKRRGRRRKKDIEQYSNEFK

SEQ ID NO: 3355048 - protein, 21 aa, Plasmodium falciparum
EKEINHNLNIRIEKDNEKNEQ

SEQ ID NO: 3355049 - protein, 21 aa, Plasmodium falciparum
EKEIQKWLLKFSGRDCSLILK

SEQ ID NO: 3355050 - protein, 26 aa, Plasmodium falciparum
EKEKAKELLLILKYIFHLNVDYDKYI

SEQ ID NO: 3355051 - protein, 24 aa, Plasmodium falciparum
EKEKKKLFLYGYEQQLLYGRINWK

SEQ ID NO: 3355052 - protein, 24 aa, Plasmodium falciparum
EKEKRILREKAVEYTLQNEEEYKQ

SEQ ID NO: 3355053 - protein, 28 aa, Plasmodium falciparum
EKELFSYAKNGFKKYVNFLNNYKNTIKE

SEQ ID NO: 3355054 - protein, 20 aa, Plasmodium falciparum
EKELLDEQTVIQIDRNSLEA

SEQ ID NO: 3355055 - protein, 20 aa, Plasmodium falciparum
EKENICKYNKSLFDSDDDQI

SEQ ID NO: 3355056 - protein, 21 aa, Plasmodium falciparum
EKENLVSVAWLLNPKVDKTNN

SEQ ID NO: 3355057 - protein, 22 aa, Plasmodium falciparum
EKESNLLFNVCNEKSDLTDFSK

SEQ ID NO: 3355058 - protein, 23 aa, Plasmodium falciparum
EKETKIRKGMLFFSDNDTDKRKR

SEQ ID NO: 3355059 - protein, 33 aa, Plasmodium falciparum
EKEVGNIYCDVEKKGDIKYINRISNKNENIEEK

SEQ ID NO: 3355060 - protein, 21 aa, Plasmodium falciparum
EKFDFLMLNIAKECGDINNLM

SEQ ID NO: 3355061 - protein, 25 aa, Plasmodium falciparum
EKFFVKNADMSPSFSDDNILHEIPL

SEQ ID NO: 3355062 - protein, 17 aa, Plasmodium falciparum
EKFGYKYNNGLKPSEGY

SEQ ID NO: 3355063 - protein, 25 aa, Plasmodium falciparum
EKFINKYHIFRTCHNNMYNSKDNNS

SEQ ID NO: 3355064 - protein, 33 aa, Plasmodium falciparum
EKFINWKKIKTYNVPSPRAFQASCVVNLGRNGV

SEQ ID NO: 3355065 - protein, 25 aa, Plasmodium falciparum
EKFKSIKKKKCFFILSLNIDKKNEE

SEQ ID NO: 3355066 - protein, 20 aa, Plasmodium falciparum
EKFLNEIFEYCINKLQPCIL

SEQ ID NO: 3355067 - protein, 19 aa, Plasmodium falciparum
EKFLRMSNINNMNNMNIMN

SEQ ID NO: 3355068 - protein, 25 aa, Plasmodium falciparum
EKFNEPILFLWRNNRSIIIGKNQNI

SEQ ID NO: 3355069 - protein, 18 aa, Plasmodium falciparum
EKFNEQYPICVKKRSSKM

SEQ ID NO: 3355070 - protein, 19 aa, Plasmodium falciparum
EKFNLCFKLHEIYKEEFES

SEQ ID NO: 3355071 - protein, 19 aa, Plasmodium falciparum
EKFNTFKDDMTGVGTFNND

SEQ ID NO: 3355072 - protein, 18 aa, Plasmodium falciparum
EKFRKALLYKQHIHMKIN

SEQ ID NO: 3355073 - protein, 27 aa, Plasmodium falciparum
EKFYKYKIFIEQALDDFIIKTEREHAN

SEQ ID NO: 3355074 - protein, 18 aa, Plasmodium falciparum
EKGEIGGIVNHGKDKFFV

SEQ ID NO: 3355075 - protein, 24 aa, Plasmodium falciparum
EKGGISYVYLCYGIHNCLNIVTNI

SEQ ID NO: 3355076 - protein, 20 aa, Plasmodium falciparum
EKGKELNNLLYIINIKNKKI

SEQ ID NO: 3355077 - protein, 20 aa, Plasmodium falciparum
EKGKERRGSKNVSKKVSNSK

SEQ ID NO: 3355078 - protein, 23 aa, Plasmodium falciparum
EKGKKCKRKRSILNNIGNNKDAE

SEQ ID NO: 3355079 - protein, 21 aa, Plasmodium falciparum
EKGKRTRRKSSDKNMKAPKLT

SEQ ID NO: 3355080 - protein, 25 aa, Plasmodium falciparum
EKGNLKSKWYIKLRNRSYDSYFFNR

SEQ ID NO: 3355081 - protein, 21 aa, Plasmodium falciparum
EKGQHIKKRVESILYTLTNLI

SEQ ID NO: 3355082 - protein, 24 aa, Plasmodium falciparum
EKGRPEYAVILAFDVKIDPEAEKE

SEQ ID NO: 3355083 - protein, 38 aa, Plasmodium falciparum
EKGSHIYIMKLHLRVTVNIYKILPLCDINDNINVYCLP

SEQ ID NO: 3355084 - protein, 24 aa, Plasmodium falciparum
EKHEYVESPFFFKREENENSYEEE

SEQ ID NO: 3355085 - protein, 24 aa, Plasmodium falciparum
EKHIEECRRNVGLNIKDKNDVIYF

SEQ ID NO: 3355086 - protein, 19 aa, Plasmodium falciparum
EKHIFKQIQMESLKEKLSL

SEQ ID NO: 3355087 - protein, 21 aa, Plasmodium falciparum
EKHKKNKIVLGYKSCSCVHNI

SEQ ID NO: 3355088 - protein, 23 aa, Plasmodium falciparum
EKHLKKRKRKFIERKNLIDHYEI

SEQ ID NO: 3355089 - protein, 19 aa, Plasmodium falciparum
EKHLLPLELEYNLVSSDEK

SEQ ID NO: 3355090 - protein, 17 aa, Plasmodium falciparum
EKHMLLDHLLIYYSLNE

SEQ ID NO: 3355091 - protein, 24 aa, Plasmodium falciparum
EKHNRLGNLLVWNVKDKNILCSFK

SEQ ID NO: 3355092 - protein, 24 aa, Plasmodium falciparum
EKHPPKILKYSLRAISRYSMYINK

SEQ ID NO: 3355093 - protein, 23 aa, Plasmodium falciparum
EKHQYMFALTFNKKVFNDRKHVV

SEQ ID NO: 3355094 - protein, 23 aa, Plasmodium falciparum
EKICELKNIYNFLFNNVNIDYNN

SEQ ID NO: 3355095 - protein, 23 aa, Plasmodium falciparum
EKICGMAGILDTSRYCSLIADKL

SEQ ID NO: 3355096 - protein, 24 aa, Plasmodium falciparum
EKIDEFYDELSFILNNEEVQSTDI

SEQ ID NO: 3355097 - protein, 28 aa, Plasmodium falciparum
EKIEILNLLPRLKDIYVQNAKQKNDLNK

SEQ ID NO: 3355098 - protein, 22 aa, Plasmodium falciparum
EKIEKIICSILLSRNIKKANYL

SEQ ID NO: 3355099 - protein, 19 aa, Plasmodium falciparum
EKIEPSISYDVKFLENKNM

SEQ ID NO: 3355100 - protein, 35 aa, Plasmodium falciparum
EKIFPCKDIKEIMLKYVYCTTFFDNYILSIKNELE

SEQ ID NO: 3355101 - protein, 25 aa, Plasmodium falciparum
EKIHLNKMLPYLVANVVESLDLEDE

SEQ ID NO: 3355102 - protein, 23 aa, Plasmodium falciparum
EKIIFMLWGNFAIKKCKNIDINK

SEQ ID NO: 3355103 - protein, 19 aa, Plasmodium falciparum
EKIISNKLNNTIINNNNQT

SEQ ID NO: 3355104 - protein, 17 aa, Plasmodium falciparum
EKIISSFVDLKKKNLKD

SEQ ID NO: 3355105 - protein, 18 aa, Plasmodium falciparum
EKIKYIIMENEYTKKEKL

SEQ ID NO: 3355106 - protein, 22 aa, Plasmodium falciparum
EKILENKCCFKLNVRNKRKNEK

SEQ ID NO: 3355107 - protein, 17 aa, Plasmodium falciparum
EKILFKKWIDILPSTNL

SEQ ID NO: 3355108 - protein, 22 aa, Plasmodium falciparum
EKILGCGGFGYVMKVKNKKFNI

SEQ ID NO: 3355109 - protein, 20 aa, Plasmodium falciparum
EKILHVFKRIITMKPNALEI

SEQ ID NO: 3355110 - protein, 25 aa, Plasmodium falciparum
EKILKLIKILLHLYGLNDFNAITYF

SEQ ID NO: 3355111 - protein, 24 aa, Plasmodium falciparum
EKILKRNISNILYECISRKHCLFL

SEQ ID NO: 3355112 - protein, 21 aa, Plasmodium falciparum
EKILNIRKLYFGDYNADKPSE

SEQ ID NO: 3355113 - protein, 18 aa, Plasmodium falciparum
EKILTIFGKKENKKKALE

SEQ ID NO: 3355114 - protein, 36 aa, Plasmodium falciparum
EKINIFLKYLKMIDVNSLSHLFQYFVDREKDEEMKK

SEQ ID NO: 3355115 - protein, 20 aa, Plasmodium falciparum
EKINWKRAEELKITKHSGSS

SEQ ID NO: 3355116 - protein, 19 aa, Plasmodium falciparum
EKIQEGMFPPCEEFINSIN

SEQ ID NO: 3355117 - protein, 19 aa, Plasmodium falciparum
EKISDFLLKHTILVRDIRL

SEQ ID NO: 3355118 - protein, 21 aa, Plasmodium falciparum
EKISNFFWYYSDVINQLLREE

SEQ ID NO: 3355119 - protein, 17 aa, Plasmodium falciparum
EKIVKSYLIKNGLLSCD

SEQ ID NO: 3355120 - protein, 28 aa, Plasmodium falciparum
EKIVLDWRLPIGVLFDIYCDLDKSQKEY

SEQ ID NO: 3355121 - protein, 24 aa, Plasmodium falciparum
EKIVSGIRGFCLLHDLKTDILNLN

SEQ ID NO: 3355122 - protein, 18 aa, Plasmodium falciparum
EKKACDVLNRGCIKEQVQ

SEQ ID NO: 3355123 - protein, 20 aa, Plasmodium falciparum
EKKDLLKFTFLHDKKDDEKR

SEQ ID NO: 3355124 - protein, 21 aa, Plasmodium falciparum
EKKDNINIFINNNIYELKEIN

SEQ ID NO: 3355125 - protein, 26 aa, Plasmodium falciparum
EKKDRRASTNTCCSTLGNTFTKRQVQ

SEQ ID NO: 3355126 - protein, 34 aa, Plasmodium falciparum
EKKEANESLHLCVSCQKYDHYILAKKLIEQLLVK

SEQ ID NO: 3355127 - protein, 17 aa, Plasmodium falciparum
EKKEINDSLSFYNYNNK

SEQ ID NO: 3355128 - protein, 38 aa, Plasmodium falciparum
EKKEKEKKNCIIFREQCEYCLTNFSISGHLILTKESLL

SEQ ID NO: 3355129 - protein, 22 aa, Plasmodium falciparum
EKKEKGYSCEILLDGNNINKKN

SEQ ID NO: 3355130 - protein, 25 aa, Plasmodium falciparum
EKKEKLKLIKLITEKLASPLKATSD

SEQ ID NO: 3355131 - protein, 19 aa, Plasmodium falciparum
EKKELLLIQSLSIKLISNS

SEQ ID NO: 3355132 - protein, 19 aa, Plasmodium falciparum
EKKELRNEEILYYEDEHED

SEQ ID NO: 3355133 - protein, 21 aa, Plasmodium falciparum
EKKESLCFLLELADTSLEKLF

SEQ ID NO: 3355134 - protein, 17 aa, Plasmodium falciparum
EKKFESFNFKTSSNEVG

SEQ ID NO: 3355135 - protein, 27 aa, Plasmodium falciparum
EKKFKKECIFHPTIKDNVKIFLSDLPN

SEQ ID NO: 3355136 - protein, 19 aa, Plasmodium falciparum
EKKGICSEKNKLPTPTEVY

SEQ ID NO: 3355137 - protein, 26 aa, Plasmodium falciparum
EKKIEFIKMDYMYQLGRYKDKQMKND

SEQ ID NO: 3355138 - protein, 20 aa, Plasmodium falciparum
EKKIFMDTVHEIRKMTLPYL

SEQ ID NO: 3355139 - protein, 34 aa, Plasmodium falciparum
EKKIIKKNIPLLIILLNFLKNLNINLNHLKTTLI

SEQ ID NO: 3355140 - protein, 26 aa, Plasmodium falciparum
EKKIKKRKRNVLKYLSQYNMNVFDFF

SEQ ID NO: 3355141 - protein, 25 aa, Plasmodium falciparum
EKKIKRIQEDLVFIPWRDSKLTRIL

SEQ ID NO: 3355142 - protein, 17 aa, Plasmodium falciparum
EKKINIINEKYLILEKE

SEQ ID NO: 3355143 - protein, 18 aa, Plasmodium falciparum
EKKIPIFGICYGMQEIAV

SEQ ID NO: 3355144 - protein, 21 aa, Plasmodium falciparum
EKKISIMIKVNYKRTYRGFTS

SEQ ID NO: 3355145 - protein, 20 aa, Plasmodium falciparum
EKKISYNKFHNFDFVNNYDL

SEQ ID NO: 3355146 - protein, 24 aa, Plasmodium falciparum
EKKITRIEKVLGIDKMSMLPYDDL

SEQ ID NO: 3355147 - protein, 18 aa, Plasmodium falciparum
EKKIYYDSIENLDDVVKK

SEQ ID NO: 3355148 - protein, 22 aa, Plasmodium falciparum
EKKKCGTTTFLNRKNVTHNLFQ

SEQ ID NO: 3355149 - protein, 39 aa, Plasmodium falciparum
EKKKEKEKEECIAIINFLRWKKVRKNFYEILKLKKKRKE

SEQ ID NO: 3355150 - protein, 24 aa, Plasmodium falciparum
EKKKFIPKRVIMYQQELKEKEERN

SEQ ID NO: 3355151 - protein, 20 aa, Plasmodium falciparum
EKKKGGGWISNLFTYNKDDK

SEQ ID NO: 3355152 - protein, 20 aa, Plasmodium falciparum
EKKKICFLYEIKDGASNKSY

SEQ ID NO: 3355153 - protein, 25 aa, Plasmodium falciparum
EKKKIKYKVFYGFKKSYENEQNVPH

SEQ ID NO: 3355154 - protein, 18 aa, Plasmodium falciparum
EKKKIYMRYFKKGIKDKI

SEQ ID NO: 3355155 - protein, 30 aa, Plasmodium falciparum
EKKKKEKSLLCPLSNNLLELSDLFSNEIDE

SEQ ID NO: 3355156 - protein, 25 aa, Plasmodium falciparum
EKKKKKKEKALQLENIISKKNPHRV

SEQ ID NO: 3355157 - protein, 23 aa, Plasmodium falciparum
EKKKKKNCLFCKNTISQNNKDIV

SEQ ID NO: 3355158 - protein, 20 aa, Plasmodium falciparum
EKKKKLKKATVEDSTATKGQ

SEQ ID NO: 3355159 - protein, 25 aa, Plasmodium falciparum
EKKKRHGRNRNHTVSLCNIAKDDIV

SEQ ID NO: 3355160 - protein, 24 aa, Plasmodium falciparum
EKKKRKIEKIACIGKYKELFDDEN

SEQ ID NO: 3355161 - protein, 19 aa, Plasmodium falciparum
EKKKRKSMFEYVPNNNVTK

SEQ ID NO: 3355162 - protein, 23 aa, Plasmodium falciparum
EKKKYVSNALFCIDQTSYIFDTR

SEQ ID NO: 3355163 - protein, 27 aa, Plasmodium falciparum
EKKLIKLMLLVFKFTYDYKNDNNKYEY

SEQ ID NO: 3355164 - protein, 20 aa, Plasmodium falciparum
EKKMCAHNYHELLQFYNLKE

SEQ ID NO: 3355165 - protein, 19 aa, Plasmodium falciparum
EKKMKRRKKGELDKNNIII

SEQ ID NO: 3355166 - protein, 22 aa, Plasmodium falciparum
EKKMRKKSCNIDRNTIDNENNK

SEQ ID NO: 3355167 - protein, 19 aa, Plasmodium falciparum
EKKMSIDFEPFRPINTSLY

SEQ ID NO: 3355168 - protein, 21 aa, Plasmodium falciparum
EKKNCINIDFYINFRLKNKIY

SEQ ID NO: 3355169 - protein, 20 aa, Plasmodium falciparum
EKKNELEINISLLNEENMNI

SEQ ID NO: 3355170 - protein, 25 aa, Plasmodium falciparum
EKKNMLPRLLLKINKILDDNNLDHK

SEQ ID NO: 3355171 - protein, 21 aa, Plasmodium falciparum
EKKNYVGLTEKLNCLKLEKTN

SEQ ID NO: 3355172 - protein, 20 aa, Plasmodium falciparum
EKKPATAKLQIIDNVCKILT

SEQ ID NO: 3355173 - protein, 18 aa, Plasmodium falciparum
EKKPWFFTYTQNNFSVLY

SEQ ID NO: 3355174 - protein, 22 aa, Plasmodium falciparum
EKKRIHRDYVHSYHMKKKQKKR

SEQ ID NO: 3355175 - protein, 17 aa, Plasmodium falciparum
EKKRKLDSFLMDQENEL

SEQ ID NO: 3355176 - protein, 24 aa, Plasmodium falciparum
EKKRKLEWDGGLVQKDIRQKNIEE

SEQ ID NO: 3355177 - protein, 23 aa, Plasmodium falciparum
EKKRLEELNSLKVEEEKKKKKNM

SEQ ID NO: 3355178 - protein, 23 aa, Plasmodium falciparum
EKKTKRSLCSYKLRKMKHLCVEN

SEQ ID NO: 3355179 - protein, 34 aa, Plasmodium falciparum
EKKWYEKNKHIFPASKWEIYKPLKTYTTSYTDLF

SEQ ID NO: 3355180 - protein, 25 aa, Plasmodium falciparum
EKKYKLKKKMHLNFIDYIKKEEKEK

SEQ ID NO: 3355181 - protein, 23 aa, Plasmodium falciparum
EKLEKEITSLLGEMKKIEEENKV

SEQ ID NO: 3355182 - protein, 23 aa, Plasmodium falciparum
EKLEQRPSGFVINNINELKSLTS

SEQ ID NO: 3355183 - protein, 23 aa, Plasmodium falciparum
EKLFKKPRICVYNVINNGNKYDN

SEQ ID NO: 3355184 - protein, 35 aa, Plasmodium falciparum
EKLFKKYILKYSFHKLRIFYEYKIEMEKLKKNYIH

SEQ ID NO: 3355185 - protein, 17 aa, Plasmodium falciparum
EKLFSLIDLLFKRAIPK

SEQ ID NO: 3355186 - protein, 25 aa, Plasmodium falciparum
EKLHKRKNIYSKRGNIFSKSKTFGK

SEQ ID NO: 3355187 - protein, 20 aa, Plasmodium falciparum
EKLIDYKLAFQLQNILHHSK

SEQ ID NO: 3355188 - protein, 18 aa, Plasmodium falciparum
EKLIERVMINKLTKITCH

SEQ ID NO: 3355189 - protein, 19 aa, Plasmodium falciparum
EKLIYYCFFLLKYNEKNVK

SEQ ID NO: 3355190 - protein, 18 aa, Plasmodium falciparum
EKLKDVCKNFIKKDYSIH

SEQ ID NO: 3355191 - protein, 23 aa, Plasmodium falciparum
EKLKELMGDNTLCYDNLIKCLKK

SEQ ID NO: 3355192 - protein, 24 aa, Plasmodium falciparum
EKLKKCKLDHDILYKDTTNNYYDH

SEQ ID NO: 3355193 - protein, 23 aa, Plasmodium falciparum
EKLKKECLPKFIISHENLVSEKF

SEQ ID NO: 3355194 - protein, 25 aa, Plasmodium falciparum
EKLKKEFFLQNRISEKTLLLNLYVD

SEQ ID NO: 3355195 - protein, 22 aa, Plasmodium falciparum
EKLKKYKVNLIFSENKDINYIL

SEQ ID NO: 3355196 - protein, 19 aa, Plasmodium falciparum
EKLKNGIISGNWLILQNCH

SEQ ID NO: 3355197 - protein, 17 aa, Plasmodium falciparum
EKLKNKKIKSITNNNNN

SEQ ID NO: 3355198 - protein, 19 aa, Plasmodium falciparum
EKLLDMDWMRIPKLETKKI

SEQ ID NO: 3355199 - protein, 27 aa, Plasmodium falciparum
EKLLPLVKLNMGFVFCKDDLSEIRNII

SEQ ID NO: 3355200 - protein, 22 aa, Plasmodium falciparum
EKLLQYRKEIYQTFQEKKETIK

SEQ ID NO: 3355201 - protein, 24 aa, Plasmodium falciparum
EKLLRGIYSYGFEKPSAIQQRGIK

SEQ ID NO: 3355202 - protein, 25 aa, Plasmodium falciparum
EKLNKLFYLPRCKPQEIAYEKYYDV

SEQ ID NO: 3355203 - protein, 22 aa, Plasmodium falciparum
EKLPHVVLIFGPFLYIRNFSET

SEQ ID NO: 3355204 - protein, 29 aa, Plasmodium falciparum
EKLREVVEMPLLQPERFVTLGIDPPKGVL

SEQ ID NO: 3355205 - protein, 27 aa, Plasmodium falciparum
EKLTIIGCQTLEWLHIFRNCSFPLLKK

SEQ ID NO: 3355206 - protein, 21 aa, Plasmodium falciparum
EKLYNLPLKILKFENLFSYTM

SEQ ID NO: 3355207 - protein, 22 aa, Plasmodium falciparum
EKMDAIFPFYIDKNICKNIHEQ

SEQ ID NO: 3355208 - protein, 20 aa, Plasmodium falciparum
EKMKRIYLKNHDMIGKKRIK

SEQ ID NO: 3355209 - protein, 17 aa, Plasmodium falciparum
EKMPEFFQVATMVNSSD

SEQ ID NO: 3355210 - protein, 20 aa, Plasmodium falciparum
EKMSSNFLNKIYKENKKEQV

SEQ ID NO: 3355211 - protein, 18 aa, Plasmodium falciparum
EKMWLFIKKKEEILNEFF

SEQ ID NO: 3355212 - protein, 21 aa, Plasmodium falciparum
EKNAYKRVRHKEINKEDMHIG

SEQ ID NO: 3355213 - protein, 17 aa, Plasmodium falciparum
EKNDIPIYMPNLSLLGN

SEQ ID NO: 3355214 - protein, 17 aa, Plasmodium falciparum
EKNECVLNGGNKKEVDF

SEQ ID NO: 3355215 - protein, 27 aa, Plasmodium falciparum
EKNEMKPIILMGLSMGGCIALRTLETI

SEQ ID NO: 3355216 - protein, 24 aa, Plasmodium falciparum
EKNEVNELCKMYKNECGRLRELLV

SEQ ID NO: 3355217 - protein, 18 aa, Plasmodium falciparum
EKNFCEISPLVSYDGTFF

SEQ ID NO: 3355218 - protein, 22 aa, Plasmodium falciparum
EKNFLKRTGLIYGSQEVYKNIL

SEQ ID NO: 3355219 - protein, 25 aa, Plasmodium falciparum
EKNFNFTLNMMKMLFSNTNNNENKL

SEQ ID NO: 3355220 - protein, 20 aa, Plasmodium falciparum
EKNFRKYHIKSNMNNNQNIL

SEQ ID NO: 3355221 - protein, 21 aa, Plasmodium falciparum
EKNGDVLNKIMDVMMNIQNDL

SEQ ID NO: 3355222 - protein, 22 aa, Plasmodium falciparum
EKNIAFSVCQSFSKNMSLYGER

SEQ ID NO: 3355223 - protein, 21 aa, Plasmodium falciparum
EKNICKCLLLAGPSGSGKTAI

SEQ ID NO: 3355224 - protein, 22 aa, Plasmodium falciparum
EKNIKRKKINDIINKYKKKMII

SEQ ID NO: 3355225 - protein, 30 aa, Plasmodium falciparum
EKNINICFICLRKFLNEEMLQRHIDVSNLH

SEQ ID NO: 3355226 - protein, 17 aa, Plasmodium falciparum
EKNKCSYNLHDKINNLL

SEQ ID NO: 3355227 - protein, 25 aa, Plasmodium falciparum
EKNKEIRILINYILRKNKKKCFTVV

SEQ ID NO: 3355228 - protein, 17 aa, Plasmodium falciparum
EKNLCVQKKGDIIESSI

SEQ ID NO: 3355229 - protein, 18 aa, Plasmodium falciparum
EKNLIILKNMIDYLKKQK

SEQ ID NO: 3355230 - protein, 29 aa, Plasmodium falciparum
EKNLKEKIPYHMKNKYLVMSSQNNNNCAY

SEQ ID NO: 3355231 - protein, 21 aa, Plasmodium falciparum
EKNLKSSLCIGTHIYSKERAV

SEQ ID NO: 3355232 - protein, 23 aa, Plasmodium falciparum
EKNLLINFFLQFPSLNKKLEYNK

SEQ ID NO: 3355233 - protein, 20 aa, Plasmodium falciparum
EKNMKHTIIFDYVENEKDKN

SEQ ID NO: 3355234 - protein, 21 aa, Plasmodium falciparum
EKNMKKKINVLKFKDNNGDDN

SEQ ID NO: 3355235 - protein, 17 aa, Plasmodium falciparum
EKNNCLTTKYDKDNDNE

SEQ ID NO: 3355236 - protein, 36 aa, Plasmodium falciparum
EKNNVIMNARLCILQEIQKALCVRLDKERKLKVIEN

SEQ ID NO: 3355237 - protein, 24 aa, Plasmodium falciparum
EKNQSFNVSYTWETDTISGLRFIN

SEQ ID NO: 3355238 - protein, 19 aa, Plasmodium falciparum
EKNSHIDVVNNMEDEKVNI

SEQ ID NO: 3355239 - protein, 17 aa, Plasmodium falciparum
EKNSTNIIPLWKNEAEK

SEQ ID NO: 3355240 - protein, 20 aa, Plasmodium falciparum
EKNVLLKDVEIFIKNLCVAK

SEQ ID NO: 3355241 - protein, 23 aa, Plasmodium falciparum
EKNVPAYFLTYGNIINNIISNEE

SEQ ID NO: 3355242 - protein, 24 aa, Plasmodium falciparum
EKNYENELLKYIVVNEDEKSQKNK

SEQ ID NO: 3355243 - protein, 18 aa, Plasmodium falciparum
EKPKLLNMKGKTFTLKKL

SEQ ID NO: 3355244 - protein, 26 aa, Plasmodium falciparum
EKPLYLRRLEEYRKKKKLESQANDTA

SEQ ID NO: 3355245 - protein, 25 aa, Plasmodium falciparum
EKPSPRSNCSITFINDEEFILFGGE

SEQ ID NO: 3355246 - protein, 24 aa, Plasmodium falciparum
EKQDKIRIGLMPPPPPKMKLSNLM

SEQ ID NO: 3355247 - protein, 18 aa, Plasmodium falciparum
EKQFLNNLFDTFLEKNLN

SEQ ID NO: 3355248 - protein, 19 aa, Plasmodium falciparum
EKQNVSIFGSRSKNTPLFG

SEQ ID NO: 3355249 - protein, 20 aa, Plasmodium falciparum
EKQQKINMCLAIDEKVKPIY

SEQ ID NO: 3355250 - protein, 23 aa, Plasmodium falciparum
EKQSSVQYFVPINLRLKNKLNDV

SEQ ID NO: 3355251 - protein, 21 aa, Plasmodium falciparum
EKRENAVLIDTQYFKSNDMRN

SEQ ID NO: 3355252 - protein, 17 aa, Plasmodium falciparum
EKRIHQFIKTLYEKKKI

SEQ ID NO: 3355253 - protein, 29 aa, Plasmodium falciparum
EKRINWLINEYLCRYGYFDTVSIFCKRYN

SEQ ID NO: 3355254 - protein, 17 aa, Plasmodium falciparum
EKRKALIKELVKLNPSV

SEQ ID NO: 3355255 - protein, 25 aa, Plasmodium falciparum
EKRKKIFFVKFMLYYIYKKEYVHAN

SEQ ID NO: 3355256 - protein, 20 aa, Plasmodium falciparum
EKRKNIGFVNCFILRNNKIR

SEQ ID NO: 3355257 - protein, 24 aa, Plasmodium falciparum
EKRNDFRNVLTFSIDPPGCQDIDD

SEQ ID NO: 3355258 - protein, 19 aa, Plasmodium falciparum
EKRNEKVYIKQRRMMEKKG

SEQ ID NO: 3355259 - protein, 23 aa, Plasmodium falciparum
EKRNINIIIIKFIEIFKEKFNVD

SEQ ID NO: 3355260 - protein, 29 aa, Plasmodium falciparum
EKRSMLEYYSRVAKRNCNRLIQKDNVRSY

SEQ ID NO: 3355261 - protein, 21 aa, Plasmodium falciparum
EKRTVSVRSIYLCIHTHSRYI

SEQ ID NO: 3355262 - protein, 25 aa, Plasmodium falciparum
EKRVVIKLKESFFKGNRNVNSFLDI

SEQ ID NO: 3355263 - protein, 21 aa, Plasmodium falciparum
EKRWDKNTWKKTSNIQSVEEN

SEQ ID NO: 3355264 - protein, 19 aa, Plasmodium falciparum
EKRYAVCSSIAASGVTSLV

SEQ ID NO: 3355265 - protein, 26 aa, Plasmodium falciparum
EKSEHSNLKKCCICCENYQHNDNVIF

SEQ ID NO: 3355266 - protein, 20 aa, Plasmodium falciparum
EKSEVFSSFVYSNAEDRDKL

SEQ ID NO: 3355267 - protein, 18 aa, Plasmodium falciparum
EKSGELINNIIDNINENK

SEQ ID NO: 3355268 - protein, 24 aa, Plasmodium falciparum
EKSISRGCSLKGSMENIFDKNILT

SEQ ID NO: 3355269 - protein, 23 aa, Plasmodium falciparum
EKSKKCQKPHTFVNTVKNSNKNN

SEQ ID NO: 3355270 - protein, 21 aa, Plasmodium falciparum
EKSKMPLLCNYTNVSKSLYHI

SEQ ID NO: 3355271 - protein, 18 aa, Plasmodium falciparum
EKSLKLCLKSCIKKYTLI

SEQ ID NO: 3355272 - protein, 22 aa, Plasmodium falciparum
EKSLKYSMSISANMKNEYNWLR

SEQ ID NO: 3355273 - protein, 23 aa, Plasmodium falciparum
EKSPCGFCFVVYKKKEGYTQAVN

SEQ ID NO: 3355274 - protein, 18 aa, Plasmodium falciparum
EKSQLVWQQKMLQMKANM

SEQ ID NO: 3355275 - protein, 29 aa, Plasmodium falciparum
EKSYRRRYRRGGRGGDRFRSYRRNYYETS

SEQ ID NO: 3355276 - protein, 23 aa, Plasmodium falciparum
EKTEEIKLQWALLQHENLYTVNE

SEQ ID NO: 3355277 - protein, 18 aa, Plasmodium falciparum
EKTFGENHMNGWSAEDMF

SEQ ID NO: 3355278 - protein, 24 aa, Plasmodium falciparum
EKTGYGVFCKRDIKNGELICEYVG

SEQ ID NO: 3355279 - protein, 21 aa, Plasmodium falciparum
EKTIHSNSIYKNCNGSSDDAN

SEQ ID NO: 3355280 - protein, 25 aa, Plasmodium falciparum
EKTKFKKIIRYLIQNYKIKNINQAN

SEQ ID NO: 3355281 - protein, 17 aa, Plasmodium falciparum
EKTKKFPLCISSNEQIA

SEQ ID NO: 3355282 - protein, 19 aa, Plasmodium falciparum
EKTKLFLHNPIYVSHEQKN

SEQ ID NO: 3355283 - protein, 44 aa, Plasmodium falciparum
EKTLIRVGKLPSCIEYDLKIGDFGACCINEKNKLHHDIVGTLSY

SEQ ID NO: 3355284 - protein, 20 aa, Plasmodium falciparum
EKTNFLRKDKIFIDNAKRNK

SEQ ID NO: 3355285 - protein, 18 aa, Plasmodium falciparum
EKTNIVGILNVNYDSFSD

SEQ ID NO: 3355286 - protein, 30 aa, Plasmodium falciparum
EKTTKLLLKNGLDYGKVRFMKVNELYHYMY

SEQ ID NO: 3355287 - protein, 23 aa, Plasmodium falciparum
EKTWKCLYICNSIEYDLTKKVCD

SEQ ID NO: 3355288 - protein, 20 aa, Plasmodium falciparum
EKTYHTWKKITGKNYVHNKS

SEQ ID NO: 3355289 - protein, 22 aa, Plasmodium falciparum
EKVEFLLLLNLVYYINDIIIRK

SEQ ID NO: 3355290 - protein, 27 aa, Plasmodium falciparum
EKVEIAYKYYVAKKMMTKCEEKIEDAK

SEQ ID NO: 3355291 - protein, 28 aa, Plasmodium falciparum
EKVELVLMPELRKIRIYIQRDTIYEQRY

SEQ ID NO: 3355292 - protein, 27 aa, Plasmodium falciparum
EKVIYWFAQRVDLILLIFDAHKLDISD

SEQ ID NO: 3355293 - protein, 24 aa, Plasmodium falciparum
EKVKEKRLGVLLVGIGGNNATTML

SEQ ID NO: 3355294 - protein, 20 aa, Plasmodium falciparum
EKVKERKVRKSRKNQNFVED

SEQ ID NO: 3355295 - protein, 24 aa, Plasmodium falciparum
EKVKLLKQREEIFYEEKKNFEKEK

SEQ ID NO: 3355296 - protein, 17 aa, Plasmodium falciparum
EKVKLWYIYNSVISESM

SEQ ID NO: 3355297 - protein, 20 aa, Plasmodium falciparum
EKVLPCVSNSCLGDKLMPSH

SEQ ID NO: 3355298 - protein, 18 aa, Plasmodium falciparum
EKVQYCYYLSSDQYCTYV

SEQ ID NO: 3355299 - protein, 19 aa, Plasmodium falciparum
EKVSVIIFTIKFIGQKLKR

SEQ ID NO: 3355300 - protein, 18 aa, Plasmodium falciparum
EKYDILSYKRKNQIFEQV

SEQ ID NO: 3355301 - protein, 21 aa, Plasmodium falciparum
EKYEYLYVNLLAMLKHYNYFS

SEQ ID NO: 3355302 - protein, 24 aa, Plasmodium falciparum
EKYGHTFISAALYYIQKKKLFHTN

SEQ ID NO: 3355303 - protein, 20 aa, Plasmodium falciparum
EKYIDYFVQSIILNIKNFLR

SEQ ID NO: 3355304 - protein, 27 aa, Plasmodium falciparum
EKYIHMLMKNFNMYSNDLLNFDYKINT

SEQ ID NO: 3355305 - protein, 22 aa, Plasmodium falciparum
EKYIIKECLKVGTNFSSVYKKT

SEQ ID NO: 3355306 - protein, 21 aa, Plasmodium falciparum
EKYIIRFLCEGSSYNLSELVN

SEQ ID NO: 3355307 - protein, 24 aa, Plasmodium falciparum
EKYIKIRLCRNCFIYINELKYIIN

SEQ ID NO: 3355308 - protein, 21 aa, Plasmodium falciparum
EKYILRKAFEGYLPEHILYRQ

SEQ ID NO: 3355309 - protein, 29 aa, Plasmodium falciparum
EKYIPRLVPVNVYVPRYFGISAKAKGEPE

SEQ ID NO: 3355310 - protein, 23 aa, Plasmodium falciparum
EKYNELKEVLKYTTEEIEKENSK

SEQ ID NO: 3355311 - protein, 26 aa, Plasmodium falciparum
EKYNIRKKSKFSIEKKIDLFHMNSLN

SEQ ID NO: 3355312 - protein, 27 aa, Plasmodium falciparum
EKYNVGDIYLFLCLAKSNYTFSYINSI

SEQ ID NO: 3355313 - protein, 25 aa, Plasmodium falciparum
EKYWDNPPLHYSKKNNYDIFTLGDI

SEQ ID NO: 3355314 - protein, 28 aa, Plasmodium falciparum
EKYYDTKEILAYLLPYHTYYLDEVRIAS

SEQ ID NO: 3355315 - protein, 18 aa, Plasmodium falciparum
EKYYNIGNDFKYDNLQIN

SEQ ID NO: 3355316 - protein, 25 aa, Plasmodium falciparum
ELACKEYLILFLVPMSAVRDVITTI

SEQ ID NO: 3355317 - protein, 23 aa, Plasmodium falciparum
ELAEAYIKYCIDYVLNNNFHDIY

SEQ ID NO: 3355318 - protein, 24 aa, Plasmodium falciparum
ELAKNWKCQLGWHPFTPEYAFKIL

SEQ ID NO: 3355319 - protein, 24 aa, Plasmodium falciparum
ELAPKYRNLVILPIYSSLPVEYQA

SEQ ID NO: 3355320 - protein, 20 aa, Plasmodium falciparum
ELCFLNYKKKILIFNNICDN

SEQ ID NO: 3355321 - protein, 17 aa, Plasmodium falciparum
ELCSVIIVMRHGDRKPK

SEQ ID NO: 3355322 - protein, 18 aa, Plasmodium falciparum
ELDEGLALDIKENLNEFF

SEQ ID NO: 3355323 - protein, 20 aa, Plasmodium falciparum
ELDLRIKALEKKMEQFEFEK

SEQ ID NO: 3355324 - protein, 28 aa, Plasmodium falciparum
ELDPSRYGLSCMQGWRKNMEDAHICYNN

SEQ ID NO: 3355325 - protein, 18 aa, Plasmodium falciparum
ELDTDGIWCMLPKNFPEM

SEQ ID NO: 3355326 - protein, 17 aa, Plasmodium falciparum
ELEALKYIYVLDSELNI

SEQ ID NO: 3355327 - protein, 20 aa, Plasmodium falciparum
ELEAPIKICGDIHGQFYDLL

SEQ ID NO: 3355328 - protein, 25 aa, Plasmodium falciparum
ELEELVEKRCCMIYKEKPNKNTHYE

SEQ ID NO: 3355329 - protein, 27 aa, Plasmodium falciparum
ELEFEASVDIFGREKFNTFKDDMTGVG

SEQ ID NO: 3355330 - protein, 25 aa, Plasmodium falciparum
ELEIALYLNLSICYSNVEKYNEAYD

SEQ ID NO: 3355331 - protein, 19 aa, Plasmodium falciparum
ELEIKRGEYEVMIENHKTL

SEQ ID NO: 3355332 - protein, 22 aa, Plasmodium falciparum
ELELRLLNDVAFIGIENSGKTS

SEQ ID NO: 3355333 - protein, 22 aa, Plasmodium falciparum
ELEMKIDLTMRAIHFGDKQVLN

SEQ ID NO: 3355334 - protein, 21 aa, Plasmodium falciparum
ELFCYINRYNINEIIENGEEK

SEQ ID NO: 3355335 - protein, 19 aa, Plasmodium falciparum
ELFFDKKLKFVYLTENLEI

SEQ ID NO: 3355336 - protein, 19 aa, Plasmodium falciparum
ELFKCSLDKDIYWKMFKNK

SEQ ID NO: 3355337 - protein, 20 aa, Plasmodium falciparum
ELFNKWKKGMILLSNENGIV

SEQ ID NO: 3355338 - protein, 24 aa, Plasmodium falciparum
ELFTKLKKLIHFEKLFCHGYTTNE

SEQ ID NO: 3355339 - protein, 19 aa, Plasmodium falciparum
ELGDANFLYKLKTFDKDTI

SEQ ID NO: 3355340 - protein, 25 aa, Plasmodium falciparum
ELGEDHPRCKFQYYRSQIACTAEQL

SEQ ID NO: 3355341 - protein, 18 aa, Plasmodium falciparum
ELHIEICLKDLKDEYAQI

SEQ ID NO: 3355342 - protein, 26 aa, Plasmodium falciparum
ELHNKKFPALFLYYTKDVKTKHTIMY

SEQ ID NO: 3355343 - protein, 20 aa, Plasmodium falciparum
ELHSVELWFGKELVAGEIGN

SEQ ID NO: 3355344 - protein, 25 aa, Plasmodium falciparum
ELIDIWKLLIKLINNFFPVQEKEKC

SEQ ID NO: 3355345 - protein, 18 aa, Plasmodium falciparum
ELIDKFRLFYTYLSPLIT

SEQ ID NO: 3355346 - protein, 25 aa, Plasmodium falciparum
ELIHKNKCLCCDINYNNSILCSGGS

SEQ ID NO: 3355347 - protein, 18 aa, Plasmodium falciparum
ELIIFKNNINCVKNNEVI

SEQ ID NO: 3355348 - protein, 19 aa, Plasmodium falciparum
ELIIKIKTAMIINEKQMDI

SEQ ID NO: 3355349 - protein, 18 aa, Plasmodium falciparum
ELIKEFLYHVNWGILDYL

SEQ ID NO: 3355350 - protein, 17 aa, Plasmodium falciparum
ELIKLMLTYDYNKRITA

SEQ ID NO: 3355351 - protein, 21 aa, Plasmodium falciparum
ELIKYATDIISLFDNNKKEVR

SEQ ID NO: 3355352 - protein, 26 aa, Plasmodium falciparum
ELINISLLCGCDYTIGVHGIGIVNAL

SEQ ID NO: 3355353 - protein, 27 aa, Plasmodium falciparum
ELINKEKHVLLYLELLVLKNMYRNYLV

SEQ ID NO: 3355354 - protein, 18 aa, Plasmodium falciparum
ELIYKRKSDIYVNNEEEI

SEQ ID NO: 3355355 - protein, 27 aa, Plasmodium falciparum
ELIYVFKKQLDLIVILKKQINLLQNNK

SEQ ID NO: 3355356 - protein, 18 aa, Plasmodium falciparum
ELKESVKITKIETQELQE

SEQ ID NO: 3355357 - protein, 17 aa, Plasmodium falciparum
ELKHHKIKHYKCPYENC

SEQ ID NO: 3355358 - protein, 21 aa, Plasmodium falciparum
ELKIADFGLARAFGIPVRKYT

SEQ ID NO: 3355359 - protein, 20 aa, Plasmodium falciparum
ELKISLYDFIMLKKKTISTN

SEQ ID NO: 3355360 - protein, 27 aa, Plasmodium falciparum
ELKKIAQLKLLLSIENRKNYYKKKIKS

SEQ ID NO: 3355361 - protein, 17 aa, Plasmodium falciparum
ELKKNCNNYNIGNNNMN

SEQ ID NO: 3355362 - protein, 19 aa, Plasmodium falciparum
ELKLGLNDKLLFNKNLNNY

SEQ ID NO: 3355363 - protein, 20 aa, Plasmodium falciparum
ELKLLINIILNNNYKNVAIQ

SEQ ID NO: 3355364 - protein, 19 aa, Plasmodium falciparum
ELKNEKRENAVLIDTQYFK

SEQ ID NO: 3355365 - protein, 27 aa, Plasmodium falciparum
ELKRRYACLSKPDGRYIFLGAPGSGKG

SEQ ID NO: 3355366 - protein, 24 aa, Plasmodium falciparum
ELKSDRSKLILGFLKKKKEQNRYD

SEQ ID NO: 3355367 - protein, 25 aa, Plasmodium falciparum
ELKTLLNCISSLKGKTGLSTVCKIL

SEQ ID NO: 3355368 - protein, 20 aa, Plasmodium falciparum
ELKYNFFMIYAIGTNIIKEN

SEQ ID NO: 3355369 - protein, 21 aa, Plasmodium falciparum
ELLCTYAALILHEEKMSITSD

SEQ ID NO: 3355370 - protein, 18 aa, Plasmodium falciparum
ELLEKIVLHNSEFSDNKN

SEQ ID NO: 3355371 - protein, 17 aa, Plasmodium falciparum
ELLEYSDNMYIVKIVDR

SEQ ID NO: 3355372 - protein, 25 aa, Plasmodium falciparum
ELLIKNYFFFFKYFNFYNSMINFGL

SEQ ID NO: 3355373 - protein, 17 aa, Plasmodium falciparum
ELLKRKKVHFVSMDQWN

SEQ ID NO: 3355374 - protein, 22 aa, Plasmodium falciparum
ELLKTSIIICLNDILMNCIPQV

SEQ ID NO: 3355375 - protein, 24 aa, Plasmodium falciparum
ELLLYETINFLLLNNIPNDKFSLC

SEQ ID NO: 3355376 - protein, 24 aa, Plasmodium falciparum
ELLNHWQKFVCLYKYNMEKKEKQK

SEQ ID NO: 3355377 - protein, 20 aa, Plasmodium falciparum
ELLRECGYFYLRVNVGQKKL

SEQ ID NO: 3355378 - protein, 24 aa, Plasmodium falciparum
ELLRKDLKINHMIKNEVDHVTQTC

SEQ ID NO: 3355379 - protein, 31 aa, Plasmodium falciparum
ELLRSEISILRLLRHPNVIYLKEIINTKETL

SEQ ID NO: 3355380 - protein, 18 aa, Plasmodium falciparum
ELLSNIIFNASNETDSNN

SEQ ID NO: 3355381 - protein, 19 aa, Plasmodium falciparum
ELMDDFYLNLLDWSKKNII

SEQ ID NO: 3355382 - protein, 24 aa, Plasmodium falciparum
ELNELHEIFVRYNFNSDSEEKPCL

SEQ ID NO: 3355383 - protein, 18 aa, Plasmodium falciparum
ELNERIKQINVFRNNVST

SEQ ID NO: 3355384 - protein, 19 aa, Plasmodium falciparum
ELNEYNNLILPDGSEAINR

SEQ ID NO: 3355385 - protein, 24 aa, Plasmodium falciparum
ELNGTCLKSKVSHKSLKHKTAKDN

SEQ ID NO: 3355386 - protein, 25 aa, Plasmodium falciparum
ELNHIKRSLNELDIYTKNKSDLFNN

SEQ ID NO: 3355387 - protein, 25 aa, Plasmodium falciparum
ELNKELRNAHNLSIINYDNNNNNNN

SEQ ID NO: 3355388 - protein, 32 aa, Plasmodium falciparum
ELNKINVKNIFKYKGYIIHLIQQSNVFCKIFK

SEQ ID NO: 3355389 - protein, 23 aa, Plasmodium falciparum
ELNKKEYFHSWKKSIHTLKNNSD

SEQ ID NO: 3355390 - protein, 18 aa, Plasmodium falciparum
ELNKNCYQHINYEVQNLI

SEQ ID NO: 3355391 - protein, 17 aa, Plasmodium falciparum
ELNLDYPSITYLNVSHN

SEQ ID NO: 3355392 - protein, 18 aa, Plasmodium falciparum
ELNQAKKIMLPLLNDFIQ

SEQ ID NO: 3355393 - protein, 19 aa, Plasmodium falciparum
ELNVCYKDVIIAIADKYIL

SEQ ID NO: 3355394 - protein, 21 aa, Plasmodium falciparum
ELQDLLLKRFQVFKNEEIRIL

SEQ ID NO: 3355395 - protein, 23 aa, Plasmodium falciparum
ELQEIIKIVIWLKHHNNKLNIKV

SEQ ID NO: 3355396 - protein, 23 aa, Plasmodium falciparum
ELQEMLRHFNPLDFGIKEKLSES

SEQ ID NO: 3355397 - protein, 31 aa, Plasmodium falciparum
ELQHLPKPLSVFYLPLCKLDLENDSVKYRLG

SEQ ID NO: 3355398 - protein, 23 aa, Plasmodium falciparum
ELQIVQEFLCPKIEARYKEIPVP

SEQ ID NO: 3355399 - protein, 18 aa, Plasmodium falciparum
ELQIYAWIDITMREIVTL

SEQ ID NO: 3355400 - protein, 19 aa, Plasmodium falciparum
ELQKELRLMCDNLENVIEA

SEQ ID NO: 3355401 - protein, 32 aa, Plasmodium falciparum
ELQKSCPLCKSSCCKKNLLCIHYEINEDNNIK

SEQ ID NO: 3355402 - protein, 23 aa, Plasmodium falciparum
ELQNKYEQCLNYLEKLKMKYDQQ

SEQ ID NO: 3355403 - protein, 18 aa, Plasmodium falciparum
ELQNQCCNNLTGLQNVTK

SEQ ID NO: 3355404 - protein, 20 aa, Plasmodium falciparum
ELQPKNLPLHLLKKKNNLKN

SEQ ID NO: 3355405 - protein, 26 aa, Plasmodium falciparum
ELQYFKDLCKNQCNKIITFDESLITA

SEQ ID NO: 3355406 - protein, 19 aa, Plasmodium falciparum
ELRDPCIKLPKYIDKLPEL

SEQ ID NO: 3355407 - protein, 20 aa, Plasmodium falciparum
ELRELFSLKDTKVILDKKNY

SEQ ID NO: 3355408 - protein, 25 aa, Plasmodium falciparum
ELRGKDIYKILGLHINDCNNENAKN

SEQ ID NO: 3355409 - protein, 19 aa, Plasmodium falciparum
ELRGSSNYKYFGAAKNLKG

SEQ ID NO: 3355410 - protein, 19 aa, Plasmodium falciparum
ELRIYKRLIDLYSQCEVVT

SEQ ID NO: 3355411 - protein, 19 aa, Plasmodium falciparum
ELRKLCVLMQIKTTDDETK

SEQ ID NO: 3355412 - protein, 17 aa, Plasmodium falciparum
ELRTSCTSNGPWVDNIT

SEQ ID NO: 3355413 - protein, 35 aa, Plasmodium falciparum
ELRVLQVSQCFDSKCRVFICLCSLFEDKISKELLE

SEQ ID NO: 3355414 - protein, 24 aa, Plasmodium falciparum
ELSELSCAVHGWFKEHNSISKFYP

SEQ ID NO: 3355415 - protein, 21 aa, Plasmodium falciparum
ELSLISYFHFCIKDSEHKYNH

SEQ ID NO: 3355416 - protein, 23 aa, Plasmodium falciparum
ELSLLKKKFCTITQNKTSKQLNN

SEQ ID NO: 3355417 - protein, 18 aa, Plasmodium falciparum
ELSLSDIFNTIECTSNNI

SEQ ID NO: 3355418 - protein, 30 aa, Plasmodium falciparum
ELSSSFIYFLYCIKNNYSFQTYLLSPLQFG

SEQ ID NO: 3355419 - protein, 27 aa, Plasmodium falciparum
ELTCQKLKECESIFCDSNDEHGEKKLK

SEQ ID NO: 3355420 - protein, 21 aa, Plasmodium falciparum
ELTFKFFNFYPFIMSSLNLMA

SEQ ID NO: 3355421 - protein, 21 aa, Plasmodium falciparum
ELTIDYFLFLMIFEKKVEQNF

SEQ ID NO: 3355422 - protein, 27 aa, Plasmodium falciparum
ELVAEKHWSLKGEAYGYNRPKNSILNL

SEQ ID NO: 3355423 - protein, 18 aa, Plasmodium falciparum
ELVFKKAQHKLSINDKVI

SEQ ID NO: 3355424 - protein, 25 aa, Plasmodium falciparum
ELVRKLDCSCGINMDLFNKMSDDTY

SEQ ID NO: 3355425 - protein, 25 aa, Plasmodium falciparum
ELVSLTLKLEQEWKIIKKNYAILES

SEQ ID NO: 3355426 - protein, 23 aa, Plasmodium falciparum
ELYEILCKVGVVRNVRIKYDVDK

SEQ ID NO: 3355427 - protein, 28 aa, Plasmodium falciparum
ELYEIPKPELPYIIIELMNDRNKGFYIV

SEQ ID NO: 3355428 - protein, 22 aa, Plasmodium falciparum
ELYELMKGSDFDIFKKYKNFYL

SEQ ID NO: 3355429 - protein, 22 aa, Plasmodium falciparum
ELYESWRIFTPLLKELQEKQVK

SEQ ID NO: 3355430 - protein, 17 aa, Plasmodium falciparum
ELYKCIKEEITKKYENI

SEQ ID NO: 3355431 - protein, 21 aa, Plasmodium falciparum
ELYKHLVCTNNKNGLNETLTQ

SEQ ID NO: 3355432 - protein, 24 aa, Plasmodium falciparum
ELYNARLGGWYNISMDKEMIDSII

SEQ ID NO: 3355433 - protein, 23 aa, Plasmodium falciparum
ELYNYRSSNKILKGFHKDKTKNA

SEQ ID NO: 3355434 - protein, 18 aa, Plasmodium falciparum
ELYRKGYDPYKDINKIKK

SEQ ID NO: 3355435 - protein, 43 aa, Plasmodium falciparum
ELYSLPNSYPFFLIYYVSFCYRNSINAWNGWPSFNDLYKTYNI

SEQ ID NO: 3355436 - protein, 17 aa, Plasmodium falciparum
EMDYVLKSSINKVGSNS

SEQ ID NO: 3355437 - protein, 18 aa, Plasmodium falciparum
EMFCFLLNRGCDFKHIND

SEQ ID NO: 3355438 - protein, 30 aa, Plasmodium falciparum
EMFYIKYIMDYYDIVSLQWGDEIIQNERIK

SEQ ID NO: 3355439 - protein, 18 aa, Plasmodium falciparum
EMINCIYVFIKYYDTLPN

SEQ ID NO: 3355440 - protein, 26 aa, Plasmodium falciparum
EMKDHPSFEYHIFKKLDINNTQDKKI

SEQ ID NO: 3355441 - protein, 22 aa, Plasmodium falciparum
EMKINYNKPCIVHLKKKNDIPK

SEQ ID NO: 3355442 - protein, 26 aa, Plasmodium falciparum
EMKYHYIDRMFLYRHAKNVIDDADYE

SEQ ID NO: 3355443 - protein, 23 aa, Plasmodium falciparum
EMLKCSRKEIYLHHKKTNYKHND

SEQ ID NO: 3355444 - protein, 20 aa, Plasmodium falciparum
EMLLRKELNELINKDDLSED

SEQ ID NO: 3355445 - protein, 17 aa, Plasmodium falciparum
EMLYLKYHFFYKHYYYF

SEQ ID NO: 3355446 - protein, 24 aa, Plasmodium falciparum
EMMETSWLLAQKRMEGIQLEEKSD

SEQ ID NO: 3355447 - protein, 25 aa, Plasmodium falciparum
EMNDDIKLLLNFFGIPYIQSPCEAE

SEQ ID NO: 3355448 - protein, 25 aa, Plasmodium falciparum
EMNDHIKHSLGYDNTCYDNNKDDIK

SEQ ID NO: 3355449 - protein, 27 aa, Plasmodium falciparum
EMNEKRILADEILKKYIEMREEDKNKN

SEQ ID NO: 3355450 - protein, 33 aa, Plasmodium falciparum
EMNESELFLSFNDFYVYPSKFFLLSKKCKKIIL

SEQ ID NO: 3355451 - protein, 22 aa, Plasmodium falciparum
EMNKNCSYDSCDNIVKINYDEL

SEQ ID NO: 3355452 - protein, 31 aa, Plasmodium falciparum
EMNLRDNCIVCFKYLKIGEWQGKKLESHART

SEQ ID NO: 3355453 - protein, 25 aa, Plasmodium falciparum
EMNQLLCNKDYIFSKIIMESLENNE

SEQ ID NO: 3355454 - protein, 24 aa, Plasmodium falciparum
EMNSLKLIYNYINNLNINNKKTNV

SEQ ID NO: 3355455 - protein, 20 aa, Plasmodium falciparum
EMRSRIDLFCKQLFANMYHD

SEQ ID NO: 3355456 - protein, 18 aa, Plasmodium falciparum
EMSYFEWLANEKKKKEII

SEQ ID NO: 3355457 - protein, 26 aa, Plasmodium falciparum
ENAYKIKTGYFYFRSGVPVITPHIEQ

SEQ ID NO: 3355458 - protein, 24 aa, Plasmodium falciparum
ENCIKKKIICDKIKGIEKLKEPTN

SEQ ID NO: 3355459 - protein, 17 aa, Plasmodium falciparum
ENCKSDCSKYCNSNNMS

SEQ ID NO: 3355460 - protein, 20 aa, Plasmodium falciparum
ENCKYHIDMDNVHNAVNSVN

SEQ ID NO: 3355461 - protein, 27 aa, Plasmodium falciparum
ENCNNCLKYIPKYVNAFDTQIQAYEYL

SEQ ID NO: 3355462 - protein, 18 aa, Plasmodium falciparum
ENCVKDLIVKFMELKGVP

SEQ ID NO: 3355463 - protein, 29 aa, Plasmodium falciparum
ENDCGYYCYPIDALFVFISIIYNNYTHNT

SEQ ID NO: 3355464 - protein, 26 aa, Plasmodium falciparum
ENDIIKLGRFRLKVRQFIESVDTLNT

SEQ ID NO: 3355465 - protein, 23 aa, Plasmodium falciparum
ENDIPLKKKRIVKNENIEENTNE

SEQ ID NO: 3355466 - protein, 18 aa, Plasmodium falciparum
ENDKICANSHISSNMNQT

SEQ ID NO: 3355467 - protein, 25 aa, Plasmodium falciparum
ENDNFMDYKFLKSLDNSYNVNSNYV

SEQ ID NO: 3355468 - protein, 20 aa, Plasmodium falciparum
ENEDICSLKIRIHQKEKELQ

SEQ ID NO: 3355469 - protein, 24 aa, Plasmodium falciparum
ENEEECKFPSFSNFMSHEEKYKND

SEQ ID NO: 3355470 - protein, 17 aa, Plasmodium falciparum
ENEEIINENELLIKKKK

SEQ ID NO: 3355471 - protein, 25 aa, Plasmodium falciparum
ENEELPINANHNFYINNFLLNQHFN

SEQ ID NO: 3355472 - protein, 23 aa, Plasmodium falciparum
ENEFKNILYMSIDKYNEQISIIR

SEQ ID NO: 3355473 - protein, 38 aa, Plasmodium falciparum
ENEILRPHFPGSYACISPLCLILCPTRELVIQIQNEVN

SEQ ID NO: 3355474 - protein, 17 aa, Plasmodium falciparum
ENEISLIYDFYFDMKLK

SEQ ID NO: 3355475 - protein, 18 aa, Plasmodium falciparum
ENEKECYLLSQKKKQSTY

SEQ ID NO: 3355476 - protein, 18 aa, Plasmodium falciparum
ENEKEVKEDDILTDGETL

SEQ ID NO: 3355477 - protein, 22 aa, Plasmodium falciparum
ENEKKKKSCLINLSDCEPVDFI

SEQ ID NO: 3355478 - protein, 21 aa, Plasmodium falciparum
ENEKVIRICRCWQSAKFPYCD

SEQ ID NO: 3355479 - protein, 18 aa, Plasmodium falciparum
ENELGLSNIHLFNISYKN

SEQ ID NO: 3355480 - protein, 24 aa, Plasmodium falciparum
ENEMKIITPFNVWYRYKGEWKEDI

SEQ ID NO: 3355481 - protein, 31 aa, Plasmodium falciparum
ENEQKNIFTWGILPVRAFDHPNIFVPLPCGF

SEQ ID NO: 3355482 - protein, 24 aa, Plasmodium falciparum
ENESKMKAYEWSRDYFKKKLLEDN

SEQ ID NO: 3355483 - protein, 23 aa, Plasmodium falciparum
ENEYISFNVCYDDSVNNIKELIK

SEQ ID NO: 3355484 - protein, 24 aa, Plasmodium falciparum
ENFDELKNIFQIQLNEENFNALAA

SEQ ID NO: 3355485 - protein, 19 aa, Plasmodium falciparum
ENFISKYFYPRISYKKFSY

SEQ ID NO: 3355486 - protein, 25 aa, Plasmodium falciparum
ENFPNDIQSFFKFLNSKDVKDETKG

SEQ ID NO: 3355487 - protein, 23 aa, Plasmodium falciparum
ENFRAHNSFVIFYKKGYKCVNTD

SEQ ID NO: 3355488 - protein, 30 aa, Plasmodium falciparum
ENFYETPWYMCVKMGDKEVCMMSYEMNITH

SEQ ID NO: 3355489 - protein, 28 aa, Plasmodium falciparum
ENGIIYDSRFSIIYLEHDLIYLKKNNLK

SEQ ID NO: 3355490 - protein, 18 aa, Plasmodium falciparum
ENGIKFLVQNKCLEVVQE

SEQ ID NO: 3355491 - protein, 17 aa, Plasmodium falciparum
ENGKMFFGEELSVQEHQ

SEQ ID NO: 3355492 - protein, 33 aa, Plasmodium falciparum
ENGKNSFKEYCMEVSRIFTSHIIDLVSLSHVPH

SEQ ID NO: 3355493 - protein, 17 aa, Plasmodium falciparum
ENGLLRFQFTLKEYNMN

SEQ ID NO: 3355494 - protein, 18 aa, Plasmodium falciparum
ENGLVVEKCNFFKEDKRI

SEQ ID NO: 3355495 - protein, 24 aa, Plasmodium falciparum
ENGNCPHLTSLLSHEKGLINNNIN

SEQ ID NO: 3355496 - protein, 24 aa, Plasmodium falciparum
ENHIFKMNTTWNKMLNNVHMSSNK

SEQ ID NO: 3355497 - protein, 26 aa, Plasmodium falciparum
ENHKRRIWSICWSPDGNYLASVGADK

SEQ ID NO: 3355498 - protein, 24 aa, Plasmodium falciparum
ENHKRWTDEYNIDEMFIKKNDIEH

SEQ ID NO: 3355499 - protein, 33 aa, Plasmodium falciparum
ENHLDFLQSFNIYKLYNRYLLITNIPTNLRDTH

SEQ ID NO: 3355500 - protein, 26 aa, Plasmodium falciparum
ENIAKIVFENCNMCNINVDFVQDDND

SEQ ID NO: 3355501 - protein, 21 aa, Plasmodium falciparum
ENICTCAKTLIELYDKNPQKK

SEQ ID NO: 3355502 - protein, 28 aa, Plasmodium falciparum
ENIDKVILCTINLFGRLKKHLLPVPSRF

SEQ ID NO: 3355503 - protein, 23 aa, Plasmodium falciparum
ENIEHFPKKNICEQIEHHNKIYN

SEQ ID NO: 3355504 - protein, 20 aa, Plasmodium falciparum
ENIESIPYDKNCSQDNIQYN

SEQ ID NO: 3355505 - protein, 23 aa, Plasmodium falciparum
ENIFLSLCCPINYMDFSDSINMV

SEQ ID NO: 3355506 - protein, 17 aa, Plasmodium falciparum
ENIFWKKYAHLEEILNN

SEQ ID NO: 3355507 - protein, 32 aa, Plasmodium falciparum
ENIIKACIYENVKIILIINCIDKLIMDLRLPP

SEQ ID NO: 3355508 - protein, 25 aa, Plasmodium falciparum
ENIIKFIRHFEGIYTPKLKILSKLK

SEQ ID NO: 3355509 - protein, 26 aa, Plasmodium falciparum
ENIILKKQIKCMKDNYHILNPKSSTV

SEQ ID NO: 3355510 - protein, 23 aa, Plasmodium falciparum
ENIILPFAEKNIMTNDKIEKGIQ

SEQ ID NO: 3355511 - protein, 20 aa, Plasmodium falciparum
ENIINKICVNIQRIQDKLNN

SEQ ID NO: 3355512 - protein, 23 aa, Plasmodium falciparum
ENIKECIIFLIGGGNYIEVSALN

SEQ ID NO: 3355513 - protein, 17 aa, Plasmodium falciparum
ENIKFIKEKEIMRENNK

SEQ ID NO: 3355514 - protein, 21 aa, Plasmodium falciparum
ENIKKNYACSNSFDNEINKYH

SEQ ID NO: 3355515 - protein, 25 aa, Plasmodium falciparum
ENIKMNMCACIRVIFDSIKGRCIYA

SEQ ID NO: 3355516 - protein, 43 aa, Plasmodium falciparum
ENIKMTFNVTNRFTVLGCDWDNISSVDIFYLFESYYNFEKRKK

SEQ ID NO: 3355517 - protein, 26 aa, Plasmodium falciparum
ENIKNLKCQICQQIFDSRNKLFQHIQ

SEQ ID NO: 3355518 - protein, 23 aa, Plasmodium falciparum
ENIKRILYNKALTTANIGHTHNN

SEQ ID NO: 3355519 - protein, 20 aa, Plasmodium falciparum
ENIKTFLSLFHYFNDKNNLF

SEQ ID NO: 3355520 - protein, 17 aa, Plasmodium falciparum
ENIKYKMNQNMSKKKKK

SEQ ID NO: 3355521 - protein, 25 aa, Plasmodium falciparum
ENILKAILKNMMWEKSNMNSNNNNN

SEQ ID NO: 3355522 - protein, 19 aa, Plasmodium falciparum
ENILKCPSCSLTIKILYTP

SEQ ID NO: 3355523 - protein, 48 aa, Plasmodium falciparum
ENILQKYKGIFCNYEYYFDLEVKYNREYFLRQLLLKQAFNDLYNFSQC

SEQ ID NO: 3355524 - protein, 19 aa, Plasmodium falciparum
ENINFLKIQNMNTMIDDKE

SEQ ID NO: 3355525 - protein, 19 aa, Plasmodium falciparum
ENINFSSLFYKNPKINDEK

SEQ ID NO: 3355526 - protein, 26 aa, Plasmodium falciparum
ENINKEIFVLFSRYVHNIKQQKKIIG

SEQ ID NO: 3355527 - protein, 26 aa, Plasmodium falciparum
ENINRHKINEFQWEKSNKIDIEKNNC

SEQ ID NO: 3355528 - protein, 21 aa, Plasmodium falciparum
ENIPLYLYESFMDKLYTTIRF

SEQ ID NO: 3355529 - protein, 21 aa, Plasmodium falciparum
ENIRIKPLFYKDDNKDDIKLN

SEQ ID NO: 3355530 - protein, 18 aa, Plasmodium falciparum
ENISKCYDDILLEDFSGI

SEQ ID NO: 3355531 - protein, 26 aa, Plasmodium falciparum
ENITFRLDNQMIFKKIAETLNIDESV

SEQ ID NO: 3355532 - protein, 19 aa, Plasmodium falciparum
ENIVSFKLLDCPNRHLIKN

SEQ ID NO: 3355533 - protein, 24 aa, Plasmodium falciparum
ENIYNICCSFPYERHLIDLISYED

SEQ ID NO: 3355534 - protein, 20 aa, Plasmodium falciparum
ENIYPCTYNTVVENNAYLKN

SEQ ID NO: 3355535 - protein, 17 aa, Plasmodium falciparum
ENIYTMCDLKSEQEEVK

SEQ ID NO: 3355536 - protein, 20 aa, Plasmodium falciparum
ENKCFKSHCFSKVENNSKST

SEQ ID NO: 3355537 - protein, 22 aa, Plasmodium falciparum
ENKEFIKNFFVENNADHINFME

SEQ ID NO: 3355538 - protein, 25 aa, Plasmodium falciparum
ENKEYVIKLFFGNLAPITTEKDMHN

SEQ ID NO: 3355539 - protein, 20 aa, Plasmodium falciparum
ENKIREAFDIKGTPIKIYYK

SEQ ID NO: 3355540 - protein, 22 aa, Plasmodium falciparum
ENKKDCFDILNNQMRSENLKNV

SEQ ID NO: 3355541 - protein, 21 aa, Plasmodium falciparum
ENKKKIELINCTINNKNKENN

SEQ ID NO: 3355542 - protein, 21 aa, Plasmodium falciparum
ENKKRDSLHSLSCSNITKQTI

SEQ ID NO: 3355543 - protein, 21 aa, Plasmodium falciparum
ENKKSCLNDDMYSYKLANHYI

SEQ ID NO: 3355544 - protein, 19 aa, Plasmodium falciparum
ENKLFILAADISFLHLSCT

SEQ ID NO: 3355545 - protein, 23 aa, Plasmodium falciparum
ENKLIQNLHCTINLREIENIKRQ

SEQ ID NO: 3355546 - protein, 20 aa, Plasmodium falciparum
ENKLKEKKSIYVYGDNDDIM

SEQ ID NO: 3355547 - protein, 17 aa, Plasmodium falciparum
ENKLRFECELEFLQSLC

SEQ ID NO: 3355548 - protein, 28 aa, Plasmodium falciparum
ENKLRGHCIIKNIFYMKGLKIENVPFAS

SEQ ID NO: 3355549 - protein, 40 aa, Plasmodium falciparum
ENKNDFVIMYSKIINIRFIYSTDMLKHYNHPSINLFNTNN

SEQ ID NO: 3355550 - protein, 22 aa, Plasmodium falciparum
ENKNIYFNLFFGKKSKKNNNNN

SEQ ID NO: 3355551 - protein, 25 aa, Plasmodium falciparum
ENKNLCYIKDCPNFSEVAKIIPQWK

SEQ ID NO: 3355552 - protein, 32 aa, Plasmodium falciparum
ENKNRMNIKNVKFRDCHCMFNNYSQCYVNVKN

SEQ ID NO: 3355553 - protein, 20 aa, Plasmodium falciparum
ENKNVCSIHDLSLIMLTYYN

SEQ ID NO: 3355554 - protein, 26 aa, Plasmodium falciparum
ENKQYGWFWVCPNGGDNCKYKHCLPQ

SEQ ID NO: 3355555 - protein, 27 aa, Plasmodium falciparum
ENKRIIKGFGETGCSNLLLDNLVNCEI

SEQ ID NO: 3355556 - protein, 24 aa, Plasmodium falciparum
ENKSSMCKNVLSTKRLKDVQKDKY

SEQ ID NO: 3355557 - protein, 26 aa, Plasmodium falciparum
ENLAIFRSFFPKILLNIYSKCENPAQ

SEQ ID NO: 3355558 - protein, 17 aa, Plasmodium falciparum
ENLCKEYNYELENRDKL

SEQ ID NO: 3355559 - protein, 24 aa, Plasmodium falciparum
ENLDDFEFYIKWKNYDSDENTWEP

SEQ ID NO: 3355560 - protein, 21 aa, Plasmodium falciparum
ENLECLDCLEDLNLSNNCLGS

SEQ ID NO: 3355561 - protein, 17 aa, Plasmodium falciparum
ENLEFLKNNSYFNIIQQ

SEQ ID NO: 3355562 - protein, 24 aa, Plasmodium falciparum
ENLIEEFMDLFIVIKLIKNAKHKE

SEQ ID NO: 3355563 - protein, 27 aa, Plasmodium falciparum
ENLKAANNCLTELKKSIYIKNKNKNMN

SEQ ID NO: 3355564 - protein, 27 aa, Plasmodium falciparum
ENLKNCTPSFISRSRIVYMNEDEFNYE

SEQ ID NO: 3355565 - protein, 26 aa, Plasmodium falciparum
ENLLKRKRFRNWKCEDIKGETSRILK

SEQ ID NO: 3355566 - protein, 18 aa, Plasmodium falciparum
ENLLKYFSKHNIKDGSYK

SEQ ID NO: 3355567 - protein, 18 aa, Plasmodium falciparum
ENLLMCVIRYIVPHKDHR

SEQ ID NO: 3355568 - protein, 25 aa, Plasmodium falciparum
ENLLRKGECLFDLIKNKNMNTNNLI

SEQ ID NO: 3355569 - protein, 23 aa, Plasmodium falciparum
ENLMNDLDYCRDISLYEKRYDRG

SEQ ID NO: 3355570 - protein, 21 aa, Plasmodium falciparum
ENLNEFFLRTKDHWLKELNKI

SEQ ID NO: 3355571 - protein, 19 aa, Plasmodium falciparum
ENLNMNILIRQFLKKNLNE

SEQ ID NO: 3355572 - protein, 17 aa, Plasmodium falciparum
ENLPRTKGKIDLNYVKY

SEQ ID NO: 3355573 - protein, 23 aa, Plasmodium falciparum
ENLQKLIIGFDVWFDNLEGHIYN

SEQ ID NO: 3355574 - protein, 22 aa, Plasmodium falciparum
ENLQLHGKKYSSFNLKNDEKKN

SEQ ID NO: 3355575 - protein, 33 aa, Plasmodium falciparum
ENLTPSLIFSVEFLVYRLLEFSLQHTYENIRPH

SEQ ID NO: 3355576 - protein, 17 aa, Plasmodium falciparum
ENLVVGSEVACKINYIN

SEQ ID NO: 3355577 - protein, 18 aa, Plasmodium falciparum
ENLWPFSESIKIKKKFDE

SEQ ID NO: 3355578 - protein, 18 aa, Plasmodium falciparum
ENLYSINVNEIYESILLD

SEQ ID NO: 3355579 - protein, 25 aa, Plasmodium falciparum
ENMKFCKWGRNIFARRLRGATFPET

SEQ ID NO: 3355580 - protein, 26 aa, Plasmodium falciparum
ENMTQWYKRIGIITPYATEKFFLKKI

SEQ ID NO: 3355581 - protein, 29 aa, Plasmodium falciparum
ENNAENLFKISYSCNDLVLGKNNEIILDR

SEQ ID NO: 3355582 - protein, 17 aa, Plasmodium falciparum
ENNCSYNNIKFGNIKNE

SEQ ID NO: 3355583 - protein, 18 aa, Plasmodium falciparum
ENNDIFLINELKNNSKDE

SEQ ID NO: 3355584 - protein, 22 aa, Plasmodium falciparum
ENNEILTLYILRKNLKNDKIEV

SEQ ID NO: 3355585 - protein, 18 aa, Plasmodium falciparum
ENNFLKEYVTILKNRKKD

SEQ ID NO: 3355586 - protein, 22 aa, Plasmodium falciparum
ENNGNMIVCTNIDIEEQNNTQK

SEQ ID NO: 3355587 - protein, 21 aa, Plasmodium falciparum
ENNIDLILSHPFYKHYIEEIS

SEQ ID NO: 3355588 - protein, 18 aa, Plasmodium falciparum
ENNILCNLLYKMKWKNIY

SEQ ID NO: 3355589 - protein, 18 aa, Plasmodium falciparum
ENNKLKFDNFPVIRYYLY

SEQ ID NO: 3355590 - protein, 18 aa, Plasmodium falciparum
ENNKLRSFSIFPNDNEQI

SEQ ID NO: 3355591 - protein, 26 aa, Plasmodium falciparum
ENNNIKLYGLDSFHKPDLIKNKNVTK

SEQ ID NO: 3355592 - protein, 18 aa, Plasmodium falciparum
ENNPRLFFVASRDIKEGE

SEQ ID NO: 3355593 - protein, 17 aa, Plasmodium falciparum
ENNRGGSSYDYNNRKHR

SEQ ID NO: 3355594 - protein, 26 aa, Plasmodium falciparum
ENNSFLINVIDSFYLNHINGNDIVAN

SEQ ID NO: 3355595 - protein, 21 aa, Plasmodium falciparum
ENNSIEVVNLLDLSKDDENKS

SEQ ID NO: 3355596 - protein, 25 aa, Plasmodium falciparum
ENNTICKGEDHIKPQINVSNMDEVA

SEQ ID NO: 3355597 - protein, 22 aa, Plasmodium falciparum
ENNVICGIKLSLITPDVDTYDE

SEQ ID NO: 3355598 - protein, 29 aa, Plasmodium falciparum
ENNYKIVIMLMEYCERGNLLNIFQKNKDK

SEQ ID NO: 3355599 - protein, 17 aa, Plasmodium falciparum
ENNYVKTEFEDMNFMNS

SEQ ID NO: 3355600 - protein, 21 aa, Plasmodium falciparum
ENPSSWFFGNCCTANNNEYFY

SEQ ID NO: 3355601 - protein, 20 aa, Plasmodium falciparum
ENPTFLEIQFKKSLLENENI

SEQ ID NO: 3355602 - protein, 32 aa, Plasmodium falciparum
ENPTFLSKFCMLKRKFVYNFFLVKKEIVKKRL

SEQ ID NO: 3355603 - protein, 38 aa, Plasmodium falciparum
ENQKELFESFNILSNRIILEFPSSFYLHLKQKELVEFM

SEQ ID NO: 3355604 - protein, 25 aa, Plasmodium falciparum
ENQQLKINAFEYIKKDVQDNYVTLN

SEQ ID NO: 3355605 - protein, 19 aa, Plasmodium falciparum
ENRAFPKKASPALKRIKEE

SEQ ID NO: 3355606 - protein, 25 aa, Plasmodium falciparum
ENRDYSVEILPDFICGDFDSIYPHV

SEQ ID NO: 3355607 - protein, 18 aa, Plasmodium falciparum
ENREKRFSTNNISYNNVG

SEQ ID NO: 3355608 - protein, 27 aa, Plasmodium falciparum
ENRFNLKYEDIIVLSLFNNNNCVFRVI

SEQ ID NO: 3355609 - protein, 28 aa, Plasmodium falciparum
ENRKKYTAFLPYLKHFYPNRLKDLIEQL

SEQ ID NO: 3355610 - protein, 18 aa, Plasmodium falciparum
ENRLFKIYPSLYNDEIYK

SEQ ID NO: 3355611 - protein, 21 aa, Plasmodium falciparum
ENRVLTIIFYDSLFACSTSSL

SEQ ID NO: 3355612 - protein, 23 aa, Plasmodium falciparum
ENSFDMPIINGIRESKYISNNNN

SEQ ID NO: 3355613 - protein, 21 aa, Plasmodium falciparum
ENSFKVFFISYIDSIVNSKLI

SEQ ID NO: 3355614 - protein, 17 aa, Plasmodium falciparum
ENSILPCLCNVHEKIHR

SEQ ID NO: 3355615 - protein, 28 aa, Plasmodium falciparum
ENSLKEIKRVVGLILIRGENIVSFTAEQ

SEQ ID NO: 3355616 - protein, 18 aa, Plasmodium falciparum
ENSLKMFILNDEMFNNIN

SEQ ID NO: 3355617 - protein, 27 aa, Plasmodium falciparum
ENSLNYICGLGLRKREELMKLLHNTNL

SEQ ID NO: 3355618 - protein, 31 aa, Plasmodium falciparum
ENSPFADIIRLCLNYDPNLRPTASEIVQLLN

SEQ ID NO: 3355619 - protein, 32 aa, Plasmodium falciparum
ENTICNLVKIPLCYLEPLAIVKYEKNNYFNLH

SEQ ID NO: 3355620 - protein, 19 aa, Plasmodium falciparum
ENTLKLFFNQIFALLQYST

SEQ ID NO: 3355621 - protein, 24 aa, Plasmodium falciparum
ENVEEIQEAPALALVSSSPSSLSS

SEQ ID NO: 3355622 - protein, 19 aa, Plasmodium falciparum
ENVEICLGVDKIELTNRGK

SEQ ID NO: 3355623 - protein, 25 aa, Plasmodium falciparum
ENVEIKRTLNYKGVSNFYINDKLVD

SEQ ID NO: 3355624 - protein, 20 aa, Plasmodium falciparum
ENVFIDECCVLGKNINIPCN

SEQ ID NO: 3355625 - protein, 24 aa, Plasmodium falciparum
ENVILRSSLNFKDAKDRIVNILST

SEQ ID NO: 3355626 - protein, 17 aa, Plasmodium falciparum
ENVKINNMFKCGFYSFK

SEQ ID NO: 3355627 - protein, 18 aa, Plasmodium falciparum
ENVLKKPILNIISDDENN

SEQ ID NO: 3355628 - protein, 18 aa, Plasmodium falciparum
ENVPEFMNEYKLYNEKVK

SEQ ID NO: 3355629 - protein, 19 aa, Plasmodium falciparum
ENVRITNDVIEIVSELEDN

SEQ ID NO: 3355630 - protein, 20 aa, Plasmodium falciparum
ENYFCPSKLHSNKYNKLETE

SEQ ID NO: 3355631 - protein, 22 aa, Plasmodium falciparum
ENYKGNTFKGFGSVDINDKVNY

SEQ ID NO: 3355632 - protein, 17 aa, Plasmodium falciparum
ENYKKYYIDQLKENIKK

SEQ ID NO: 3355633 - protein, 28 aa, Plasmodium falciparum
ENYKNHIIRIKIQHMLQRTKMENMKKKA

SEQ ID NO: 3355634 - protein, 24 aa, Plasmodium falciparum
ENYKNVCNNKCTMKKNIYTTNMKM

SEQ ID NO: 3355635 - protein, 30 aa, Plasmodium falciparum
ENYKYKYKVLSIIKHLLFFRTNEEKETLIE

SEQ ID NO: 3355636 - protein, 17 aa, Plasmodium falciparum
ENYLKSLIVQYENEEKL

SEQ ID NO: 3355637 - protein, 19 aa, Plasmodium falciparum
ENYLSEGQYELVIKNDYEL

SEQ ID NO: 3355638 - protein, 17 aa, Plasmodium falciparum
ENYNLNVLFFFISTSSH

SEQ ID NO: 3355639 - protein, 21 aa, Plasmodium falciparum
ENYNPLLIYHNEWNHFLKDQK

SEQ ID NO: 3355640 - protein, 25 aa, Plasmodium falciparum
ENYSKNVKNLTCIYNELLKNENIEE

SEQ ID NO: 3355641 - protein, 20 aa, Plasmodium falciparum
EPCKRKMSYVDFGFNEDDLD

SEQ ID NO: 3355642 - protein, 21 aa, Plasmodium falciparum
EPEGVNLYNGKIKNMSNENTV

SEQ ID NO: 3355643 - protein, 19 aa, Plasmodium falciparum
EPFKKRITKVNSHPTDMTN

SEQ ID NO: 3355644 - protein, 25 aa, Plasmodium falciparum
EPFVLRLPFPASFRGLKDEQLQTVS

SEQ ID NO: 3355645 - protein, 24 aa, Plasmodium falciparum
EPGSNNDGWAWVGFENKEAALKVI

SEQ ID NO: 3355646 - protein, 19 aa, Plasmodium falciparum
EPGVTHIIAAKNCTDNLIK

SEQ ID NO: 3355647 - protein, 24 aa, Plasmodium falciparum
EPHTRNGKGISHIFVYILPKIFGH

SEQ ID NO: 3355648 - protein, 25 aa, Plasmodium falciparum
EPILPFYVICDYVDFIERKYYVNKI

SEQ ID NO: 3355649 - protein, 20 aa, Plasmodium falciparum
EPIPKLVNFMLPEPRDTKND

SEQ ID NO: 3355650 - protein, 25 aa, Plasmodium falciparum
EPIVSFKPKHIWRYNMIPYGENNPD

SEQ ID NO: 3355651 - protein, 28 aa, Plasmodium falciparum
EPKKETCKFFFKKGKCIHNDKCTYSHDV

SEQ ID NO: 3355652 - protein, 20 aa, Plasmodium falciparum
EPKKVRCSLLNKKYEDKDLF

SEQ ID NO: 3355653 - protein, 17 aa, Plasmodium falciparum
EPLKKKNIFNLFNTNAL

SEQ ID NO: 3355654 - protein, 18 aa, Plasmodium falciparum
EPLKRLNPIEALADPFFD

SEQ ID NO: 3355655 - protein, 18 aa, Plasmodium falciparum
EPLPWLINMQKYGLPPSF

SEQ ID NO: 3355656 - protein, 20 aa, Plasmodium falciparum
EPLWKPSLKLNNLNQYIQDI

SEQ ID NO: 3355657 - protein, 19 aa, Plasmodium falciparum
EPNFPYYLAKNGKAINMNL

SEQ ID NO: 3355658 - protein, 20 aa, Plasmodium falciparum
EPNLTFKNDIYVIQKGNMKE

SEQ ID NO: 3355659 - protein, 28 aa, Plasmodium falciparum
EPNNVGIIPHCINYIFNYINYHKQQDKI

SEQ ID NO: 3355660 - protein, 18 aa, Plasmodium falciparum
EPNRGYLWNKITKRVENW

SEQ ID NO: 3355661 - protein, 19 aa, Plasmodium falciparum
EPNWCPLKINIENIQKKRF

SEQ ID NO: 3355662 - protein, 25 aa, Plasmodium falciparum
EPPVGIKFSILRSFSLFLENRELCE

SEQ ID NO: 3355663 - protein, 26 aa, Plasmodium falciparum
EPQPEIFKFTGFWPNKFVHQISSQIK

SEQ ID NO: 3355664 - protein, 18 aa, Plasmodium falciparum
EPRVALKDSHTLREEQLS

SEQ ID NO: 3355665 - protein, 24 aa, Plasmodium falciparum
EPSLYKCDEILKMNSTTEDRNKKE

SEQ ID NO: 3355666 - protein, 19 aa, Plasmodium falciparum
EPSSFKDCFYRLNDKRINI

SEQ ID NO: 3355667 - protein, 17 aa, Plasmodium falciparum
EPTFFNSTSFTIKKITK

SEQ ID NO: 3355668 - protein, 23 aa, Plasmodium falciparum
EPTKFPCYDIFLENIDTYNLNHN

SEQ ID NO: 3355669 - protein, 26 aa, Plasmodium falciparum
EPVILIDKIERCLVVEWYENNIRREQ

SEQ ID NO: 3355670 - protein, 41 aa, Plasmodium falciparum
EQAKTRKGHLILKKREGVYEESSKYCLFIGSNKRSLILKNF

SEQ ID NO: 3355671 - protein, 28 aa, Plasmodium falciparum
EQDIIKLIYYFMENFIFKKKKENRQMNG

SEQ ID NO: 3355672 - protein, 23 aa, Plasmodium falciparum
EQEHICSSGFILNVPSEADHEIV

SEQ ID NO: 3355673 - protein, 22 aa, Plasmodium falciparum
EQELKQLFNPFGDILDVEIHRD

SEQ ID NO: 3355674 - protein, 22 aa, Plasmodium falciparum
EQELRAEMIFQALNNSYKDKRN

SEQ ID NO: 3355675 - protein, 19 aa, Plasmodium falciparum
EQEMLLRSLLFFYFKKKFI

SEQ ID NO: 3355676 - protein, 17 aa, Plasmodium falciparum
EQEPYITQEPYITQEPV

SEQ ID NO: 3355677 - protein, 25 aa, Plasmodium falciparum
EQERRKQMRFEINLDRKGNNQNKQL

SEQ ID NO: 3355678 - protein, 28 aa, Plasmodium falciparum
EQFELLAKCLIKEPYLALPAYQAAIKEL

SEQ ID NO: 3355679 - protein, 18 aa, Plasmodium falciparum
EQFFNIPIQYNDLKNTEE

SEQ ID NO: 3355680 - protein, 21 aa, Plasmodium falciparum
EQFIDFCILSGCDYSAKIPGI

SEQ ID NO: 3355681 - protein, 31 aa, Plasmodium falciparum
EQFLKKCCLAYKYLRYHSQLIISLLDAMCDA

SEQ ID NO: 3355682 - protein, 27 aa, Plasmodium falciparum
EQIKISEFQLKWLVHFDNEIKNAINKK

SEQ ID NO: 3355683 - protein, 25 aa, Plasmodium falciparum
EQIKNAYLPFIYHMLNIPCHDTNVN

SEQ ID NO: 3355684 - protein, 29 aa, Plasmodium falciparum
EQINLKKKEFTNFSSSSSFNMSNNNNNNN

SEQ ID NO: 3355685 - protein, 19 aa, Plasmodium falciparum
EQIRKIGLMYREIDIPLED

SEQ ID NO: 3355686 - protein, 26 aa, Plasmodium falciparum
EQKCITRKFHFAFLVTNIIFSKDNRL

SEQ ID NO: 3355687 - protein, 20 aa, Plasmodium falciparum
EQKKIPIKHIAAALYTNNYM

SEQ ID NO: 3355688 - protein, 25 aa, Plasmodium falciparum
EQKKKELLKMLPLIRKESSCELNNL

SEQ ID NO: 3355689 - protein, 22 aa, Plasmodium falciparum
EQKLEFNYDVFLISIYDSNEKK

SEQ ID NO: 3355690 - protein, 20 aa, Plasmodium falciparum
EQKLFSLIDTWFTYSKNMCL

SEQ ID NO: 3355691 - protein, 26 aa, Plasmodium falciparum
EQKLKGESLILFLKNQIKMYKKELSI

SEQ ID NO: 3355692 - protein, 21 aa, Plasmodium falciparum
EQKRGNYLLKIEKEINNETNF

SEQ ID NO: 3355693 - protein, 19 aa, Plasmodium falciparum
EQLALGFKIVTNAYKTRVT

SEQ ID NO: 3355694 - protein, 19 aa, Plasmodium falciparum
EQLDSEWINNILRQLSYAY

SEQ ID NO: 3355695 - protein, 18 aa, Plasmodium falciparum
EQLFKMRYINTYQDQNGT

SEQ ID NO: 3355696 - protein, 20 aa, Plasmodium falciparum
EQLFNCNIEIPVYPVHFRDF

SEQ ID NO: 3355697 - protein, 20 aa, Plasmodium falciparum
EQLFPLKSDHLNQAHEIKHN

SEQ ID NO: 3355698 - protein, 23 aa, Plasmodium falciparum
EQLKAYICKLRKELRNYKMRELH

SEQ ID NO: 3355699 - protein, 22 aa, Plasmodium falciparum
EQLKKLIYGIGFYNVKAKQILQ

SEQ ID NO: 3355700 - protein, 17 aa, Plasmodium falciparum
EQLLFFKSAENINTSGS

SEQ ID NO: 3355701 - protein, 36 aa, Plasmodium falciparum
EQLNSLKGMGFTDVEKCLKALIKSKGNVEGAIDFLL

SEQ ID NO: 3355702 - protein, 20 aa, Plasmodium falciparum
EQLVQELFDYLCVHEKNNLE

SEQ ID NO: 3355703 - protein, 28 aa, Plasmodium falciparum
EQMHKNKVRGNMLFVGELVKSGIISIPI

SEQ ID NO: 3355704 - protein, 22 aa, Plasmodium falciparum
EQMKYRSDKNLKYDEKLYNNNI

SEQ ID NO: 3355705 - protein, 22 aa, Plasmodium falciparum
EQNIKGLLCLNSLDKSFIQVPL

SEQ ID NO: 3355706 - protein, 17 aa, Plasmodium falciparum
EQPKRSSMFSFNSSDFF

SEQ ID NO: 3355707 - protein, 19 aa, Plasmodium falciparum
EQPYKALLLKNDMGINSSE

SEQ ID NO: 3355708 - protein, 18 aa, Plasmodium falciparum
EQPYRLGNRILVNTPLQS

SEQ ID NO: 3355709 - protein, 27 aa, Plasmodium falciparum
EQQDCHEFLLLVFDFIHNMVKVIDESV

SEQ ID NO: 3355710 - protein, 23 aa, Plasmodium falciparum
EQQIIKRRTHPVIKNAKLSDGFL

SEQ ID NO: 3355711 - protein, 27 aa, Plasmodium falciparum
EQQQHCIKKLVKKCIKKYKKLLKLIKK

SEQ ID NO: 3355712 - protein, 24 aa, Plasmodium falciparum
EQRRYNMNSSHIFDYCLDTNEKKL

SEQ ID NO: 3355713 - protein, 19 aa, Plasmodium falciparum
EQSKWLSQKNVLLNILKNQ

SEQ ID NO: 3355714 - protein, 17 aa, Plasmodium falciparum
EQWKENTNLLGWKIKYY

SEQ ID NO: 3355715 - protein, 19 aa, Plasmodium falciparum
EQYDEMRSRIDLFCKQLFA

SEQ ID NO: 3355716 - protein, 17 aa, Plasmodium falciparum
EQYEHFLSFRKGSFVDD

SEQ ID NO: 3355717 - protein, 19 aa, Plasmodium falciparum
EQYKICDFLEDYKENEKIT

SEQ ID NO: 3355718 - protein, 19 aa, Plasmodium falciparum
EQYVKVIGQIKVKRNAFFT

SEQ ID NO: 3355719 - protein, 30 aa, Plasmodium falciparum
ERALTMDGMICKGVALKVSRPNDYSTNTVK

SEQ ID NO: 3355720 - protein, 18 aa, Plasmodium falciparum
ERALYTWKSTNPKYYDMK

SEQ ID NO: 3355721 - protein, 20 aa, Plasmodium falciparum
ERCKERRVTSVTIGIKKTPN

SEQ ID NO: 3355722 - protein, 19 aa, Plasmodium falciparum
ERCPGCKKYYVTLITDDLI

SEQ ID NO: 3355723 - protein, 21 aa, Plasmodium falciparum
ERCYHIFYEILKGMNDEMKKK

SEQ ID NO: 3355724 - protein, 19 aa, Plasmodium falciparum
ERDILKEDMLERKPLNENI

SEQ ID NO: 3355725 - protein, 24 aa, Plasmodium falciparum
ERDIYEFFSEVAGKVRDIQCIKDQ

SEQ ID NO: 3355726 - protein, 21 aa, Plasmodium falciparum
ERDSFRGRKRDTFRSRDRGSF

SEQ ID NO: 3355727 - protein, 19 aa, Plasmodium falciparum
ERDSLKGRERDSLKGRERG

SEQ ID NO: 3355728 - protein, 27 aa, Plasmodium falciparum
EREGFSFKWKFKNLFSSQSIHQDVNDK

SEQ ID NO: 3355729 - protein, 21 aa, Plasmodium falciparum
EREKFYFLLQIKEMMETSWLL

SEQ ID NO: 3355730 - protein, 24 aa, Plasmodium falciparum
ERERRKEMERRKELERERRKYLDK

SEQ ID NO: 3355731 - protein, 18 aa, Plasmodium falciparum
EREYSKKVHLEYMDDKDN

SEQ ID NO: 3355732 - protein, 21 aa, Plasmodium falciparum
ERFTDEFLKHTSFLTLHTYGC

SEQ ID NO: 3355733 - protein, 24 aa, Plasmodium falciparum
ERGPYEWPGAKYIIRDNGTKYDLR

SEQ ID NO: 3355734 - protein, 18 aa, Plasmodium falciparum
ERIGPRLICYYVGDEYDL

SEQ ID NO: 3355735 - protein, 23 aa, Plasmodium falciparum
ERIKKMGGDVICLQNVYRVKANA

SEQ ID NO: 3355736 - protein, 21 aa, Plasmodium falciparum
ERIKNVCIDLSKINIKCIKVV

SEQ ID NO: 3355737 - protein, 23 aa, Plasmodium falciparum
ERIRNELKLDNYSRIQNVSDEKA

SEQ ID NO: 3355738 - protein, 18 aa, Plasmodium falciparum
ERKEEVYLEKLYYAHKNK

SEQ ID NO: 3355739 - protein, 26 aa, Plasmodium falciparum
ERKEKNMKSAIRFMKESNYEDPHLNA

SEQ ID NO: 3355740 - protein, 22 aa, Plasmodium falciparum
ERKHTFLFNDIKSMFVNVENVN

SEQ ID NO: 3355741 - protein, 20 aa, Plasmodium falciparum
ERKIKVLPGYADFCKHIFIE

SEQ ID NO: 3355742 - protein, 23 aa, Plasmodium falciparum
ERKKNGNNIFCFSDYEDDNNLTS

SEQ ID NO: 3355743 - protein, 19 aa, Plasmodium falciparum
ERKLQLLFNHIKKYTNMYY

SEQ ID NO: 3355744 - protein, 20 aa, Plasmodium falciparum
ERKLRFNAPAAKRMILNSLS

SEQ ID NO: 3355745 - protein, 32 aa, Plasmodium falciparum
ERKPSAHQKFAFIKSICEYLNYNYIIRNTYKS

SEQ ID NO: 3355746 - protein, 20 aa, Plasmodium falciparum
ERKVAESILIKVNHIDNKFY

SEQ ID NO: 3355747 - protein, 20 aa, Plasmodium falciparum
ERKVFRFTLVKEYNMMENEI

SEQ ID NO: 3355748 - protein, 20 aa, Plasmodium falciparum
ERLFVIYLCVLKEYEKHPPK

SEQ ID NO: 3355749 - protein, 19 aa, Plasmodium falciparum
ERLMKRKSFYSKLFNIDDN

SEQ ID NO: 3355750 - protein, 19 aa, Plasmodium falciparum
ERLNRVTNYLYYKKALKKY

SEQ ID NO: 3355751 - protein, 19 aa, Plasmodium falciparum
ERLRKERELERERREKIRE

SEQ ID NO: 3355752 - protein, 32 aa, Plasmodium falciparum
ERMIVLVKNIICRNHGYFLIVMDPSGQMPASV

SEQ ID NO: 3355753 - protein, 17 aa, Plasmodium falciparum
ERMKENYLSEGQYELVI

SEQ ID NO: 3355754 - protein, 17 aa, Plasmodium falciparum
ERNHISIKNKKDLQKKK

SEQ ID NO: 3355755 - protein, 17 aa, Plasmodium falciparum
ERNIKQKILLPSNYTLN

SEQ ID NO: 3355756 - protein, 19 aa, Plasmodium falciparum
ERPNYVPVIKYRDIPIEKI

SEQ ID NO: 3355757 - protein, 23 aa, Plasmodium falciparum
ERPTLKTGSAFLDKVNSTLDATL

SEQ ID NO: 3355758 - protein, 24 aa, Plasmodium falciparum
ERQKEIALELGATIFTNYDEPGVT

SEQ ID NO: 3355759 - protein, 26 aa, Plasmodium falciparum
ERQKELFVAYWLNGIVDLLKRGFKNG

SEQ ID NO: 3355760 - protein, 19 aa, Plasmodium falciparum
ERQKIEWNEINKIKDQILN

SEQ ID NO: 3355761 - protein, 24 aa, Plasmodium falciparum
ERQKKKLLRLEKFKKLTKKTKKGQ

SEQ ID NO: 3355762 - protein, 19 aa, Plasmodium falciparum
ERQKNCTHILPVLRNVPIL

SEQ ID NO: 3355763 - protein, 25 aa, Plasmodium falciparum
ERQVLKEIIIQASLKHINILELIAY

SEQ ID NO: 3355764 - protein, 24 aa, Plasmodium falciparum
ERRDGYKFDGFRLRVEHSGENRSF

SEQ ID NO: 3355765 - protein, 18 aa, Plasmodium falciparum
ERRGDSRRDSSRRDSSRR

SEQ ID NO: 3355766 - protein, 18 aa, Plasmodium falciparum
ERRHKKYINENCRNDYFE

SEQ ID NO: 3355767 - protein, 22 aa, Plasmodium falciparum
ERSKSFFKRHYLDFDKLEKLNV

SEQ ID NO: 3355768 - protein, 24 aa, Plasmodium falciparum
ERSQRKAFEMKLLEKKRLEREKKE

SEQ ID NO: 3355769 - protein, 22 aa, Plasmodium falciparum
ERSVVAKECALIRTAFKEEDNI

SEQ ID NO: 3355770 - protein, 26 aa, Plasmodium falciparum
ERTIHYSKDYFGYDIEPFNMKNELTQ

SEQ ID NO: 3355771 - protein, 22 aa, Plasmodium falciparum
ERTKEFWIRMNKHSMNAGFTTL

SEQ ID NO: 3355772 - protein, 25 aa, Plasmodium falciparum
ERTLCRACGRHILKQKFATEHYQRN

SEQ ID NO: 3355773 - protein, 23 aa, Plasmodium falciparum
ERTLLDDMWIFKVHNNVHISANS

SEQ ID NO: 3355774 - protein, 21 aa, Plasmodium falciparum
ERVILKKNMWVQVVDKNVADN

SEQ ID NO: 3355775 - protein, 20 aa, Plasmodium falciparum
ERVIPPTLLKIVTFEQILER

SEQ ID NO: 3355776 - protein, 19 aa, Plasmodium falciparum
ERVKPRKSKNAMMNEEKSG

SEQ ID NO: 3355777 - protein, 24 aa, Plasmodium falciparum
ERWICSTCGKLSFAGNKKCIKLEN

SEQ ID NO: 3355778 - protein, 19 aa, Plasmodium falciparum
ERWQFCATTKFLREHGLMY

SEQ ID NO: 3355779 - protein, 32 aa, Plasmodium falciparum
ERYASIVPLYYRGATCAIVVFDISNSNTLDRA

SEQ ID NO: 3355780 - protein, 19 aa, Plasmodium falciparum
ERYKSRRNYVLSNDVNEFM

SEQ ID NO: 3355781 - protein, 17 aa, Plasmodium falciparum
ERYKYANLFSIGEIKNI

SEQ ID NO: 3355782 - protein, 18 aa, Plasmodium falciparum
ERYPILSYAVDHLDDALS

SEQ ID NO: 3355783 - protein, 33 aa, Plasmodium falciparum
ERYVYEILNKFNRTYCKELYKENHVYQKQSIQN

SEQ ID NO: 3355784 - protein, 28 aa, Plasmodium falciparum
ERYYCFIKANIFYIYKLRGDYKPHVIFL

SEQ ID NO: 3355785 - protein, 21 aa, Plasmodium falciparum
ESACTMIQKMFRGYQGRKSFH

SEQ ID NO: 3355786 - protein, 17 aa, Plasmodium falciparum
ESAFKIKYTENVEKGSK

SEQ ID NO: 3355787 - protein, 25 aa, Plasmodium falciparum
ESAKNWGIKCMRYEIRDIILPVNIK

SEQ ID NO: 3355788 - protein, 25 aa, Plasmodium falciparum
ESAYLFMIIKFITFFSTNTLSSYKN

SEQ ID NO: 3355789 - protein, 27 aa, Plasmodium falciparum
ESDFKLMKIYAIIPVKFTHNYSSILRS

SEQ ID NO: 3355790 - protein, 21 aa, Plasmodium falciparum
ESDISIVLFLIIPKKKEHINE

SEQ ID NO: 3355791 - protein, 26 aa, Plasmodium falciparum
ESDKSLKYHAVFCINCNNHIAYFEIQ

SEQ ID NO: 3355792 - protein, 19 aa, Plasmodium falciparum
ESDVPLITKEFERICNKHF

SEQ ID NO: 3355793 - protein, 19 aa, Plasmodium falciparum
ESDVYFYNDIQRWKNTIKV

SEQ ID NO: 3355794 - protein, 46 aa, Plasmodium falciparum
ESEEVTGYILPGFKGKHMVGFTCFLKRGTQNPVPPPPAPPLTNNQG

SEQ ID NO: 3355795 - protein, 24 aa, Plasmodium falciparum
ESEKGRGRSSVLLLSSEKKGGYGI

SEQ ID NO: 3355796 - protein, 21 aa, Plasmodium falciparum
ESEKSIFVPLLSKLSDKNYPN

SEQ ID NO: 3355797 - protein, 22 aa, Plasmodium falciparum
ESELIIKMSLTYLDNTTKQNIY

SEQ ID NO: 3355798 - protein, 22 aa, Plasmodium falciparum
ESESLISPSYYYIYVHRYMYLS

SEQ ID NO: 3355799 - protein, 18 aa, Plasmodium falciparum
ESFLKDVCNEIFLCEYEN

SEQ ID NO: 3355800 - protein, 19 aa, Plasmodium falciparum
ESFMSNKLFSFIATDNYYD

SEQ ID NO: 3355801 - protein, 17 aa, Plasmodium falciparum
ESFNFNGINGYKSPEKK

SEQ ID NO: 3355802 - protein, 22 aa, Plasmodium falciparum
ESGWKIIREEAIEKIEKYLENE

SEQ ID NO: 3355803 - protein, 26 aa, Plasmodium falciparum
ESHIFKTIIYLSCLFMNNEEKKRMDN

SEQ ID NO: 3355804 - protein, 20 aa, Plasmodium falciparum
ESHYEYLSNEILKFMIKYNE

SEQ ID NO: 3355805 - protein, 24 aa, Plasmodium falciparum
ESIGVCKGISFLHINKNINISCIG

SEQ ID NO: 3355806 - protein, 17 aa, Plasmodium falciparum
ESIKRESIIKMGSEPIH

SEQ ID NO: 3355807 - protein, 20 aa, Plasmodium falciparum
ESIKYIFKYYPYQITTTLFY

SEQ ID NO: 3355808 - protein, 26 aa, Plasmodium falciparum
ESILRLARELLLKYKFMEHAFVSRQI

SEQ ID NO: 3355809 - protein, 18 aa, Plasmodium falciparum
ESINLFSSKINRTSNIYR

SEQ ID NO: 3355810 - protein, 20 aa, Plasmodium falciparum
ESIPFCIFNASQVYSCEVKK

SEQ ID NO: 3355811 - protein, 24 aa, Plasmodium falciparum
ESIPKLKVCKNIYEYEIPNIIGSK

SEQ ID NO: 3355812 - protein, 30 aa, Plasmodium falciparum
ESIPKTFKGFLCMRRPVDIIDISNYNTEML

SEQ ID NO: 3355813 - protein, 23 aa, Plasmodium falciparum
ESIVGMDFLPRGEGIVTRRPIEF

SEQ ID NO: 3355814 - protein, 33 aa, Plasmodium falciparum
ESKDYKLNLSVHSSWLPVLFNMPIVNEIPEWLK

SEQ ID NO: 3355815 - protein, 23 aa, Plasmodium falciparum
ESKKKIRCDFKGDRETEGKNDIN

SEQ ID NO: 3355816 - protein, 22 aa, Plasmodium falciparum
ESKLKRLGLNMFAYDYSGYGQS

SEQ ID NO: 3355817 - protein, 24 aa, Plasmodium falciparum
ESKNVLKMDVNVVGDMVKKTNQPN

SEQ ID NO: 3355818 - protein, 25 aa, Plasmodium falciparum
ESLFKKKVFNVLCCTSTLAWGVNLP

SEQ ID NO: 3355819 - protein, 23 aa, Plasmodium falciparum
ESLKENKYSCVILKGKMSNDERK

SEQ ID NO: 3355820 - protein, 20 aa, Plasmodium falciparum
ESLKKILSQDICNKLEEYKK

SEQ ID NO: 3355821 - protein, 17 aa, Plasmodium falciparum
ESLLKMNLGLSQPSNLC

SEQ ID NO: 3355822 - protein, 24 aa, Plasmodium falciparum
ESLNLKSLFFNDLYLFDMNKEHWS

SEQ ID NO: 3355823 - protein, 20 aa, Plasmodium falciparum
ESLPTYILQYEQLRKNECVY

SEQ ID NO: 3355824 - protein, 22 aa, Plasmodium falciparum
ESLRKKNMISILMYNKKNILLI

SEQ ID NO: 3355825 - protein, 19 aa, Plasmodium falciparum
ESLWNFVRIISGLPIDAHI

SEQ ID NO: 3355826 - protein, 25 aa, Plasmodium falciparum
ESLYEDRILPLLFNIKGRADEYEYR

SEQ ID NO: 3355827 - protein, 27 aa, Plasmodium falciparum
ESNISLDSSCSFKWEAHLEKEKMNDGM

SEQ ID NO: 3355828 - protein, 20 aa, Plasmodium falciparum
ESNKFIGRTCSLNYENKMVY

SEQ ID NO: 3355829 - protein, 22 aa, Plasmodium falciparum
ESNRKSLSCDMCSVQNESIRKK

SEQ ID NO: 3355830 - protein, 32 aa, Plasmodium falciparum
ESNRNDMCYYLPGASRHSFSFRDNNLKSNNND

SEQ ID NO: 3355831 - protein, 21 aa, Plasmodium falciparum
ESNSQHFICPLLYNTYSVPAL

SEQ ID NO: 3355832 - protein, 26 aa, Plasmodium falciparum
ESNVYFKFLTLEQRSFFTTLMDRKIM

SEQ ID NO: 3355833 - protein, 18 aa, Plasmodium falciparum
ESPIGFKGYNIAKEEREK

SEQ ID NO: 3355834 - protein, 18 aa, Plasmodium falciparum
ESPIWLHIDIMVKVITPG

SEQ ID NO: 3355835 - protein, 21 aa, Plasmodium falciparum
ESPVKITHCKDILNNDNENYD

SEQ ID NO: 3355836 - protein, 20 aa, Plasmodium falciparum
ESQNTCALLTTFNECDMSKA

SEQ ID NO: 3355837 - protein, 19 aa, Plasmodium falciparum
ESRAKRFSIVTHKMEEENK

SEQ ID NO: 3355838 - protein, 28 aa, Plasmodium falciparum
ESRCIQVRWCFFDKLILSAHENGEIVVW

SEQ ID NO: 3355839 - protein, 25 aa, Plasmodium falciparum
ESRHANLLYEFERGITKNKKKDELY

SEQ ID NO: 3355840 - protein, 26 aa, Plasmodium falciparum
ESSDLFYYYKWRVFSFAQGDSYKNWR

SEQ ID NO: 3355841 - protein, 23 aa, Plasmodium falciparum
ESSFWCFDALYIPQQHPSRDLQD

SEQ ID NO: 3355842 - protein, 35 aa, Plasmodium falciparum
ESSFYSYQCLRCFQCPFCFSTLITCHELVDETKNN

SEQ ID NO: 3355843 - protein, 17 aa, Plasmodium falciparum
ESSLRYALHLITLANLV

SEQ ID NO: 3355844 - protein, 26 aa, Plasmodium falciparum
ESSMKKRFVKDIKRNCEIKSIRFGIM

SEQ ID NO: 3355845 - protein, 25 aa, Plasmodium falciparum
ESSNCFKYSHNVNMCNVLINNSSYR

SEQ ID NO: 3355846 - protein, 17 aa, Plasmodium falciparum
ESTFHLIYHNLKLYIYK

SEQ ID NO: 3355847 - protein, 26 aa, Plasmodium falciparum
ESTILKKCFTIIFYIDELIKNGVREI

SEQ ID NO: 3355848 - protein, 20 aa, Plasmodium falciparum
ESTLHLVLRLRGGAIEPSLA

SEQ ID NO: 3355849 - protein, 30 aa, Plasmodium falciparum
ESVCMKCFCTLCPSCILIGTHSKCFDQDDD

SEQ ID NO: 3355850 - protein, 28 aa, Plasmodium falciparum
ESVEHYFIYSVIWCFGGFLGEKDNVNYK

SEQ ID NO: 3355851 - protein, 25 aa, Plasmodium falciparum
ESVKAHFILGLTLLHLNSLEEGLKK

SEQ ID NO: 3355852 - protein, 19 aa, Plasmodium falciparum
ESVKRYNIVGGLFEDVYHE

SEQ ID NO: 3355853 - protein, 25 aa, Plasmodium falciparum
ESVKSLKSNSAYIFKYKNSHIPNSL

SEQ ID NO: 3355854 - protein, 25 aa, Plasmodium falciparum
ESVLRLWVNECCRSLGDQLILQTER

SEQ ID NO: 3355855 - protein, 19 aa, Plasmodium falciparum
ESYERIIGLSELYMYYMIP

SEQ ID NO: 3355856 - protein, 18 aa, Plasmodium falciparum
ESYLALNHCLLYIKKNKG

SEQ ID NO: 3355857 - protein, 19 aa, Plasmodium falciparum
ESYNMFCINGILFNHESPR

SEQ ID NO: 3355858 - protein, 29 aa, Plasmodium falciparum
ESYSGNITRWIICWSYYNPEQIDALKKLY

SEQ ID NO: 3355859 - protein, 17 aa, Plasmodium falciparum
ESYSYKYICKLFLKSDM

SEQ ID NO: 3355860 - protein, 21 aa, Plasmodium falciparum
ESYTKMKLKIITAGITVIQVD

SEQ ID NO: 3355861 - protein, 19 aa, Plasmodium falciparum
ETAKQCLIFETMSPLEQKA

SEQ ID NO: 3355862 - protein, 17 aa, Plasmodium falciparum
ETALMLGTYGLHYDIVK

SEQ ID NO: 3355863 - protein, 19 aa, Plasmodium falciparum
ETAVELCLHKNRMADALLL

SEQ ID NO: 3355864 - protein, 23 aa, Plasmodium falciparum
ETCKISSYCFDKCVSYPEKSLSN

SEQ ID NO: 3355865 - protein, 23 aa, Plasmodium falciparum
ETCKTCCIPEGYEIVDASLNDIK

SEQ ID NO: 3355866 - protein, 23 aa, Plasmodium falciparum
ETDFKLNICNSTSLNKDFLVSPD

SEQ ID NO: 3355867 - protein, 34 aa, Plasmodium falciparum
ETDKFYQAIEMFGIDLMMVRALIPKFNDKQIRDK

SEQ ID NO: 3355868 - protein, 24 aa, Plasmodium falciparum
ETDKMKIIMFFINIIRDSNICNEF

SEQ ID NO: 3355869 - protein, 24 aa, Plasmodium falciparum
ETDLYYSNCRFIQLACIYNKKKFI

SEQ ID NO: 3355870 - protein, 17 aa, Plasmodium falciparum
ETEKIIPDINFDKLDKE

SEQ ID NO: 3355871 - protein, 22 aa, Plasmodium falciparum
ETEMSLRHKVDYFRSTKKNFIF

SEQ ID NO: 3355872 - protein, 17 aa, Plasmodium falciparum
ETFFWPNINELILNKDI

SEQ ID NO: 3355873 - protein, 24 aa, Plasmodium falciparum
ETFISLCVLDKCIIVIDSKEGVQI

SEQ ID NO: 3355874 - protein, 22 aa, Plasmodium falciparum
ETFRNSTFFNAIRDMALSNPQR

SEQ ID NO: 3355875 - protein, 19 aa, Plasmodium falciparum
ETFSSLLIFLKRIFNKNDN

SEQ ID NO: 3355876 - protein, 19 aa, Plasmodium falciparum
ETHQSFKRHDSFNHPYKEG

SEQ ID NO: 3355877 - protein, 23 aa, Plasmodium falciparum
ETIEAFNLFFMNNFFPHIILGLN

SEQ ID NO: 3355878 - protein, 20 aa, Plasmodium falciparum
ETIIKLKWDKFQPGILSSST

SEQ ID NO: 3355879 - protein, 20 aa, Plasmodium falciparum
ETINYPYVMNIKKDSFLDNR

SEQ ID NO: 3355880 - protein, 17 aa, Plasmodium falciparum
ETISTIIRRNGTISRTR

SEQ ID NO: 3355881 - protein, 24 aa, Plasmodium falciparum
ETKISEAHARICYITHRSKILEER

SEQ ID NO: 3355882 - protein, 26 aa, Plasmodium falciparum
ETKKKIPCTYKWTRVYYNKECELVEK

SEQ ID NO: 3355883 - protein, 27 aa, Plasmodium falciparum
ETKLACSELKPQRGVYFDKSQKAWIGS

SEQ ID NO: 3355884 - protein, 26 aa, Plasmodium falciparum
ETKNILKFFINFNFKRYSLNFINDEQ

SEQ ID NO: 3355885 - protein, 24 aa, Plasmodium falciparum
ETKNRIREIVKYVPAKSKFIELLK

SEQ ID NO: 3355886 - protein, 23 aa, Plasmodium falciparum
ETKRKADIIERFLSNQKLNAVCI

SEQ ID NO: 3355887 - protein, 18 aa, Plasmodium falciparum
ETKSKFTNIMLGVSSVSM

SEQ ID NO: 3355888 - protein, 24 aa, Plasmodium falciparum
ETKVKRINLIVGNAANFVLSQNTK

SEQ ID NO: 3355889 - protein, 20 aa, Plasmodium falciparum
ETLARLLTEITFGDKKNLFN

SEQ ID NO: 3355890 - protein, 18 aa, Plasmodium falciparum
ETLFYIFYNLPRDVLQAY

SEQ ID NO: 3355891 - protein, 18 aa, Plasmodium falciparum
ETLHYLIDICQDYYNKTN

SEQ ID NO: 3355892 - protein, 19 aa, Plasmodium falciparum
ETLRICKLLNISSLIKLST

SEQ ID NO: 3355893 - protein, 19 aa, Plasmodium falciparum
ETLSSLKLVSKARKIPLGN

SEQ ID NO: 3355894 - protein, 25 aa, Plasmodium falciparum
ETLTGFKWIINKAIEYNEQNYTILY

SEQ ID NO: 3355895 - protein, 17 aa, Plasmodium falciparum
ETLYILNSILFYSYKLK

SEQ ID NO: 3355896 - protein, 24 aa, Plasmodium falciparum
ETMPKYASSPILTFLDNSYNRVMT

SEQ ID NO: 3355897 - protein, 24 aa, Plasmodium falciparum
ETNEKLKCLDKTISNNTNDQEDHN

SEQ ID NO: 3355898 - protein, 22 aa, Plasmodium falciparum
ETNNLLLPGYHNVTFENVSENN

SEQ ID NO: 3355899 - protein, 27 aa, Plasmodium falciparum
ETNSRCTTYRRSVRLLLLNKEKNTNLT

SEQ ID NO: 3355900 - protein, 33 aa, Plasmodium falciparum
ETNVIKFIFFKNEKVIGCSYISITNLLNLGLEG

SEQ ID NO: 3355901 - protein, 18 aa, Plasmodium falciparum
ETPLKLNIHKCIDSTGHI

SEQ ID NO: 3355902 - protein, 19 aa, Plasmodium falciparum
ETPNAIGTNMGNYISQDED

SEQ ID NO: 3355903 - protein, 19 aa, Plasmodium falciparum
ETPPIHKSPITRKSKNNIM

SEQ ID NO: 3355904 - protein, 25 aa, Plasmodium falciparum
ETQLRYIFLKEIQSFHADLIIPAKL

SEQ ID NO: 3355905 - protein, 21 aa, Plasmodium falciparum
ETRRNKHCWYLLKDVEIKNAV

SEQ ID NO: 3355906 - protein, 20 aa, Plasmodium falciparum
ETSYCPYKYKISQNKEKQKH

SEQ ID NO: 3355907 - protein, 24 aa, Plasmodium falciparum
ETSYFKNNMDLFIDMVKREVQNKG

SEQ ID NO: 3355908 - protein, 18 aa, Plasmodium falciparum
ETTAELFLALIQNHRHKL

SEQ ID NO: 3355909 - protein, 22 aa, Plasmodium falciparum
ETTFKLFLITLLISKGHVEFYK

SEQ ID NO: 3355910 - protein, 22 aa, Plasmodium falciparum
ETTIPYKIVKEINLINENLNDF

SEQ ID NO: 3355911 - protein, 18 aa, Plasmodium falciparum
ETTNMLSIDNINKKYYEQ

SEQ ID NO: 3355912 - protein, 17 aa, Plasmodium falciparum
ETYFNLHFSLYCTQIQD

SEQ ID NO: 3355913 - protein, 17 aa, Plasmodium falciparum
ETYKISNKILIDSFSMN

SEQ ID NO: 3355914 - protein, 21 aa, Plasmodium falciparum
ETYLNFSYMKNIEKFKELLIN

SEQ ID NO: 3355915 - protein, 30 aa, Plasmodium falciparum
ETYTRIFIYNCEEMNKLHFFHFLKKKYKNF

SEQ ID NO: 3355916 - protein, 20 aa, Plasmodium falciparum
EVAEALYTYKDVRGRPASLI

SEQ ID NO: 3355917 - protein, 25 aa, Plasmodium falciparum
EVAVCNLASIALCKFVDLEKKEFNF

SEQ ID NO: 3355918 - protein, 24 aa, Plasmodium falciparum
EVDFPKIVTILGIPKVESEKHGRL

SEQ ID NO: 3355919 - protein, 18 aa, Plasmodium falciparum
EVDPELMVPIAKNNPQHL

SEQ ID NO: 3355920 - protein, 27 aa, Plasmodium falciparum
EVDTLKGRERDSLKGKERDSLKGRERD

SEQ ID NO: 3355921 - protein, 20 aa, Plasmodium falciparum
EVEGIKLDYVQFVLYVNSSG

SEQ ID NO: 3355922 - protein, 17 aa, Plasmodium falciparum
EVEISIPGGIYATFVDL

SEQ ID NO: 3355923 - protein, 21 aa, Plasmodium falciparum
EVERLKEIISFDEKKGKYTLE

SEQ ID NO: 3355924 - protein, 26 aa, Plasmodium falciparum
EVFFPSRRLGICFRGLDGYYRYPEVK

SEQ ID NO: 3355925 - protein, 18 aa, Plasmodium falciparum
EVFIYRLCCKNTIEEAIL

SEQ ID NO: 3355926 - protein, 21 aa, Plasmodium falciparum
EVFKSSYLEKHLKIEDLDECI

SEQ ID NO: 3355927 - protein, 18 aa, Plasmodium falciparum
EVFYFKQNIHLLENNNLT

SEQ ID NO: 3355928 - protein, 29 aa, Plasmodium falciparum
EVGNSGIFRPEMLRSMGFSEEVSVIAWGL

SEQ ID NO: 3355929 - protein, 19 aa, Plasmodium falciparum
EVHKDAFATTKGNSLSFDG

SEQ ID NO: 3355930 - protein, 19 aa, Plasmodium falciparum
EVIELPVKHPEIFESLGIS

SEQ ID NO: 3355931 - protein, 27 aa, Plasmodium falciparum
EVIHLFKKLYIPHVFDDSYLLINDEDK

SEQ ID NO: 3355932 - protein, 20 aa, Plasmodium falciparum
EVIHPVSTYFFFYKPNEYYF

SEQ ID NO: 3355933 - protein, 26 aa, Plasmodium falciparum
EVIKYINCFRFTKAQLDFIRKKMSSY

SEQ ID NO: 3355934 - protein, 17 aa, Plasmodium falciparum
EVIKYKIYEEKCLNVHT

SEQ ID NO: 3355935 - protein, 19 aa, Plasmodium falciparum
EVIRRFTVDLPKKHGRGGQ

SEQ ID NO: 3355936 - protein, 18 aa, Plasmodium falciparum
EVKDASACMNNYTNFISI

SEQ ID NO: 3355937 - protein, 22 aa, Plasmodium falciparum
EVKDGYSVIHLSRACLNNPEHE

SEQ ID NO: 3355938 - protein, 23 aa, Plasmodium falciparum
EVKEEIKGDMNFIQSGDAASGDV

SEQ ID NO: 3355939 - protein, 18 aa, Plasmodium falciparum
EVKFKGIIPDGITRKEWC

SEQ ID NO: 3355940 - protein, 26 aa, Plasmodium falciparum
EVKISSDMATVWILERSVYKENIKPM

SEQ ID NO: 3355941 - protein, 18 aa, Plasmodium falciparum
EVLENIRKLLQCKENIDD

SEQ ID NO: 3355942 - protein, 28 aa, Plasmodium falciparum
EVLKEAIIFPLKFPKLFNSSTLPYKGIL

SEQ ID NO: 3355943 - protein, 25 aa, Plasmodium falciparum
EVLKFPFKKLENVKLGIFKNEIIIK

SEQ ID NO: 3355944 - protein, 17 aa, Plasmodium falciparum
EVLYKKQYFEGIMTVDP

SEQ ID NO: 3355945 - protein, 22 aa, Plasmodium falciparum
EVNESYAPLYYTVIKKPMYINK

SEQ ID NO: 3355946 - protein, 19 aa, Plasmodium falciparum
EVNIIRYALSMKMDSNEQV

SEQ ID NO: 3355947 - protein, 17 aa, Plasmodium falciparum
EVPSSTLNHKVTRSYRR

SEQ ID NO: 3355948 - protein, 24 aa, Plasmodium falciparum
EVPVEVPCLYPPKIMPKVVTQYVE

SEQ ID NO: 3355949 - protein, 24 aa, Plasmodium falciparum
EVQILKLVIIPAIKQNINNPITSI

SEQ ID NO: 3355950 - protein, 18 aa, Plasmodium falciparum
EVQTRFEVAISEMPNKID

SEQ ID NO: 3355951 - protein, 18 aa, Plasmodium falciparum
EVQYRMHPALSEFPSYVF

SEQ ID NO: 3355952 - protein, 21 aa, Plasmodium falciparum
EVRGKGLLCAIEFKNDLVNVW

SEQ ID NO: 3355953 - protein, 28 aa, Plasmodium falciparum
EVRKERIINIPLSVPMELLQSVQNKEST

SEQ ID NO: 3355954 - protein, 19 aa, Plasmodium falciparum
EVSKPWWVKESEKMKMRQK

SEQ ID NO: 3355955 - protein, 22 aa, Plasmodium falciparum
EVSSYIPLRKINIITNKIMCTI

SEQ ID NO: 3355956 - protein, 25 aa, Plasmodium falciparum
EVSVDCALEKLVIFMQSCFSVQSYD

SEQ ID NO: 3355957 - protein, 17 aa, Plasmodium falciparum
EVTKIKRNVIYSATEAA

SEQ ID NO: 3355958 - protein, 19 aa, Plasmodium falciparum
EVTNCYSCNVVFNVRVRKH

SEQ ID NO: 3355959 - protein, 26 aa, Plasmodium falciparum
EVTYMDFILSYLIFNDTFFFKYIQKI

SEQ ID NO: 3355960 - protein, 39 aa, Plasmodium falciparum
EVVDENYILYCMFYEFAEDIIRIKLCKEKSNQKNSYAFI

SEQ ID NO: 3355961 - protein, 20 aa, Plasmodium falciparum
EVVEKISLTDWVIGNYKKYG

SEQ ID NO: 3355962 - protein, 19 aa, Plasmodium falciparum
EVVNDFFVIYKMNKDLFSE

SEQ ID NO: 3355963 - protein, 18 aa, Plasmodium falciparum
EVVPDFTPYTWKTPIQKF

SEQ ID NO: 3355964 - protein, 17 aa, Plasmodium falciparum
EVVTPLGDVYIINEKTQ

SEQ ID NO: 3355965 - protein, 22 aa, Plasmodium falciparum
EVWWKKHGPKIWEGMLCGLSHA

SEQ ID NO: 3355966 - protein, 21 aa, Plasmodium falciparum
EVYDLFGKYGRIKYIDIKPSR

SEQ ID NO: 3355967 - protein, 21 aa, Plasmodium falciparum
EVYLYFKKKNVHDIVIVLNSV

SEQ ID NO: 3355968 - protein, 18 aa, Plasmodium falciparum
EWEEKFKISRMITNKFRN

SEQ ID NO: 3355969 - protein, 23 aa, Plasmodium falciparum
EWFEHFKRLLISLKNCKWKIFLN

SEQ ID NO: 3355970 - protein, 19 aa, Plasmodium falciparum
EWIQTDLLSAFSPFGNIIS

SEQ ID NO: 3355971 - protein, 18 aa, Plasmodium falciparum
EWISKIINSVEEWEHEYW

SEQ ID NO: 3355972 - protein, 22 aa, Plasmodium falciparum
EWKKKAESAFKEASLAILGCQQ

SEQ ID NO: 3355973 - protein, 26 aa, Plasmodium falciparum
EWLENGVPMKARWSCKKVGNDEAQKR

SEQ ID NO: 3355974 - protein, 19 aa, Plasmodium falciparum
EWLIIKLKHPCIIYGIELN

SEQ ID NO: 3355975 - protein, 26 aa, Plasmodium falciparum
EWNAYNLMISKIYKALDMKKFEYYQR

SEQ ID NO: 3355976 - protein, 22 aa, Plasmodium falciparum
EWPDSWSSFIPDIVNSAKLNQN

SEQ ID NO: 3355977 - protein, 22 aa, Plasmodium falciparum
EWPENDFRIFCGNLGNEVSSDI

SEQ ID NO: 3355978 - protein, 23 aa, Plasmodium falciparum
EWYDLKAPKMFLVRNFGKTLVTK

SEQ ID NO: 3355979 - protein, 23 aa, Plasmodium falciparum
EWYTDNRIKAIKSKDDMDVFSQV

SEQ ID NO: 3355980 - protein, 18 aa, Plasmodium falciparum
EWYWTYEGIKFFYTKDEL

SEQ ID NO: 3355981 - protein, 28 aa, Plasmodium falciparum
EYADYDLWEFLKIRSVGVNEKITFNIIL

SEQ ID NO: 3355982 - protein, 19 aa, Plasmodium falciparum
EYALCKIGNIFEDEELEER

SEQ ID NO: 3355983 - protein, 19 aa, Plasmodium falciparum
EYALHIFLTNGIRSNNNKI

SEQ ID NO: 3355984 - protein, 22 aa, Plasmodium falciparum
EYCDAGDLISYVRNKLYLDEVS

SEQ ID NO: 3355985 - protein, 24 aa, Plasmodium falciparum
EYCNDFIVCLCIDEGFKTYIIHDD

SEQ ID NO: 3355986 - protein, 25 aa, Plasmodium falciparum
EYCTLKYLLYEKMFDLHIEKKEKYT

SEQ ID NO: 3355987 - protein, 19 aa, Plasmodium falciparum
EYDIICTQFHTCIRRSNDN

SEQ ID NO: 3355988 - protein, 18 aa, Plasmodium falciparum
EYEDCLGIVNSKSSNCVF

SEQ ID NO: 3355989 - protein, 23 aa, Plasmodium falciparum
EYEEIVNILLHFIEKLKEKYEIN

SEQ ID NO: 3355990 - protein, 27 aa, Plasmodium falciparum
EYEFPLLNNFCNLELKKNIEMNTENIN

SEQ ID NO: 3355991 - protein, 22 aa, Plasmodium falciparum
EYEIHLPIDILHFINRVEYHMK

SEQ ID NO: 3355992 - protein, 23 aa, Plasmodium falciparum
EYEKKLDNIIIDFNKLKENCITK

SEQ ID NO: 3355993 - protein, 18 aa, Plasmodium falciparum
EYENEFFIYGGINSKNEY

SEQ ID NO: 3355994 - protein, 24 aa, Plasmodium falciparum
EYEPKIPICVGMVLAKIHNGNIIH

SEQ ID NO: 3355995 - protein, 18 aa, Plasmodium falciparum
EYFEKKKVPFVFFSALRE

SEQ ID NO: 3355996 - protein, 19 aa, Plasmodium falciparum
EYFFHCMSGREGLIDTAVK

SEQ ID NO: 3355997 - protein, 19 aa, Plasmodium falciparum
EYFNIKILICSNEEENKKD

SEQ ID NO: 3355998 - protein, 23 aa, Plasmodium falciparum
EYFYSYFPLFLIETQQLINNKKE

SEQ ID NO: 3355999 - protein, 23 aa, Plasmodium falciparum
EYHALLLKVIRFLLMHIPKTKNP

SEQ ID NO: 3356000 - protein, 18 aa, Plasmodium falciparum
EYIAACQFDKYNFIRYKK

SEQ ID NO: 3356001 - protein, 25 aa, Plasmodium falciparum
EYIAHSFNSILLQLSNYIFNIECKQ

SEQ ID NO: 3356002 - protein, 23 aa, Plasmodium falciparum
EYIDPKGVVLGRGPYAQSSYKKI

SEQ ID NO: 3356003 - protein, 19 aa, Plasmodium falciparum
EYIEAKIIKVEKAIKRKMT

SEQ ID NO: 3356004 - protein, 18 aa, Plasmodium falciparum
EYIESLKCEIEENIQEDN

SEQ ID NO: 3356005 - protein, 20 aa, Plasmodium falciparum
EYIIKWNKKTGVSIYYNKNL

SEQ ID NO: 3356006 - protein, 24 aa, Plasmodium falciparum
EYIIYRIECKLSNMINNNNNNNDL

SEQ ID NO: 3356007 - protein, 20 aa, Plasmodium falciparum
EYIKDPKIFNGLQKLIAAGI

SEQ ID NO: 3356008 - protein, 18 aa, Plasmodium falciparum
EYIKGVANGNNFVAVVTS

SEQ ID NO: 3356009 - protein, 24 aa, Plasmodium falciparum
EYIKKKKMNIIYEKTIYDDNLNKK

SEQ ID NO: 3356010 - protein, 27 aa, Plasmodium falciparum
EYIKRKRLKLLKVRRPAYLQQKKIKKR

SEQ ID NO: 3356011 - protein, 18 aa, Plasmodium falciparum
EYINGYTLLKCAKLSEGF

SEQ ID NO: 3356012 - protein, 26 aa, Plasmodium falciparum
EYIPKVNEILELSTTIENWEELTEKL

SEQ ID NO: 3356013 - protein, 18 aa, Plasmodium falciparum
EYIRLIDIYFRILYEYNG

SEQ ID NO: 3356014 - protein, 19 aa, Plasmodium falciparum
EYIRLKNELTMFLEATPFC

SEQ ID NO: 3356015 - protein, 21 aa, Plasmodium falciparum
EYIRVLYLFCCMNSSKCNMNK

SEQ ID NO: 3356016 - protein, 26 aa, Plasmodium falciparum
EYISKEVLYNFIKNMSKVAVNPKQLD

SEQ ID NO: 3356017 - protein, 24 aa, Plasmodium falciparum
EYIYKLTHEYIYKHIELIKYNKDI

SEQ ID NO: 3356018 - protein, 19 aa, Plasmodium falciparum
EYKDIIPDIEIQIENLLKK

SEQ ID NO: 3356019 - protein, 24 aa, Plasmodium falciparum
EYKERKINCPYKYYENKRKRDFLF

SEQ ID NO: 3356020 - protein, 45 aa, Plasmodium falciparum
EYKERLVYSSGKICLLEKLLIRLKERGNRVLIFSQMVKMLNILSE

SEQ ID NO: 3356021 - protein, 22 aa, Plasmodium falciparum
EYKESVCNYFVFIYYTSKMKAP

SEQ ID NO: 3356022 - protein, 23 aa, Plasmodium falciparum
EYKFIELLVCQFIKSSDEITKEN

SEQ ID NO: 3356023 - protein, 18 aa, Plasmodium falciparum
EYKFLFERPKHFAHIDDE

SEQ ID NO: 3356024 - protein, 21 aa, Plasmodium falciparum
EYKFNKRFEHAHHIKEMKHND

SEQ ID NO: 3356025 - protein, 20 aa, Plasmodium falciparum
EYKFVSAFMEHDYVILVFSV

SEQ ID NO: 3356026 - protein, 20 aa, Plasmodium falciparum
EYKIKLCNDENVKIKSEKME

SEQ ID NO: 3356027 - protein, 18 aa, Plasmodium falciparum
EYKKFLLDSHKFNKLLEL

SEQ ID NO: 3356028 - protein, 21 aa, Plasmodium falciparum
EYKLVFKRYASLFFIACIDKG

SEQ ID NO: 3356029 - protein, 26 aa, Plasmodium falciparum
EYKNIIFINFLRLCQLNNMNVKKYHD

SEQ ID NO: 3356030 - protein, 21 aa, Plasmodium falciparum
EYLEEFCKAFYYIILNEILKT

SEQ ID NO: 3356031 - protein, 23 aa, Plasmodium falciparum
EYLEPFHLKGLCLLRKYEKGAIL

SEQ ID NO: 3356032 - protein, 17 aa, Plasmodium falciparum
EYLKRINKNNVHINCII

SEQ ID NO: 3356033 - protein, 24 aa, Plasmodium falciparum
EYLKRKELILKYIYKVCKDNVCNE

SEQ ID NO: 3356034 - protein, 25 aa, Plasmodium falciparum
EYLLKDLFFDTSFNMERCLDDFIFI

SEQ ID NO: 3356035 - protein, 23 aa, Plasmodium falciparum
EYLMKPVKFVSAGFLNNKKNINN

SEQ ID NO: 3356036 - protein, 19 aa, Plasmodium falciparum
EYLNKCRLKQKNKINTEQK

SEQ ID NO: 3356037 - protein, 19 aa, Plasmodium falciparum
EYLSPILIKALKIVHNSAD

SEQ ID NO: 3356038 - protein, 22 aa, Plasmodium falciparum
EYLSSFLKKKVKDEHKMNLSYF

SEQ ID NO: 3356039 - protein, 27 aa, Plasmodium falciparum
EYLTLRGFKHQRLDGTMTKEMRKKAMN

SEQ ID NO: 3356040 - protein, 20 aa, Plasmodium falciparum
EYMQRSSMRTRGAERSANRN

SEQ ID NO: 3356041 - protein, 17 aa, Plasmodium falciparum
EYNCKREELRERLNSEM

SEQ ID NO: 3356042 - protein, 25 aa, Plasmodium falciparum
EYNCNYNYIHGYKVDTSKCYNDTNK

SEQ ID NO: 3356043 - protein, 17 aa, Plasmodium falciparum
EYNEAIKDCFKKKEQKD

SEQ ID NO: 3356044 - protein, 20 aa, Plasmodium falciparum
EYNFIPLVHKYCLKLQNIKF

SEQ ID NO: 3356045 - protein, 36 aa, Plasmodium falciparum
EYNIELEKYFDILSDISLDILNYIKMYTKQKSLLKE

SEQ ID NO: 3356046 - protein, 18 aa, Plasmodium falciparum
EYNINVLKKNEFIGNLLL

SEQ ID NO: 3356047 - protein, 25 aa, Plasmodium falciparum
EYNIPSKFELFISINGVRTSYKCYL

SEQ ID NO: 3356048 - protein, 23 aa, Plasmodium falciparum
EYNKIRARIFSNFNKKQKNVQKT

SEQ ID NO: 3356049 - protein, 21 aa, Plasmodium falciparum
EYNLDELWTYLNHVHNAEDSR

SEQ ID NO: 3356050 - protein, 17 aa, Plasmodium falciparum
EYNLLYFCNHIYIIDVS

SEQ ID NO: 3356051 - protein, 23 aa, Plasmodium falciparum
EYNNIYHILKLVNLPFLVPTLTE

SEQ ID NO: 3356052 - protein, 19 aa, Plasmodium falciparum
EYNNLELYEPLFTNYTSNF

SEQ ID NO: 3356053 - protein, 19 aa, Plasmodium falciparum
EYNSCAVLNDVLIKNEDEN

SEQ ID NO: 3356054 - protein, 19 aa, Plasmodium falciparum
EYNVLKIPPQVFDYPIEKL

SEQ ID NO: 3356055 - protein, 24 aa, Plasmodium falciparum
EYNYQSCYPLSYLNVYNNNNNNNH

SEQ ID NO: 3356056 - protein, 18 aa, Plasmodium falciparum
EYPLKSFPWPNAKCPMFF

SEQ ID NO: 3356057 - protein, 24 aa, Plasmodium falciparum
EYQFLRWFAEWGEDFCKHKEKELK

SEQ ID NO: 3356058 - protein, 18 aa, Plasmodium falciparum
EYQVVNWMKSKVFNEHYA

SEQ ID NO: 3356059 - protein, 20 aa, Plasmodium falciparum
EYQYISAIIFEIIKEYEFNN

SEQ ID NO: 3356060 - protein, 26 aa, Plasmodium falciparum
EYRNKCIYILASIIKYIGEKNSKPDS

SEQ ID NO: 3356061 - protein, 23 aa, Plasmodium falciparum
EYSCMPVAGSFYFTDNILKGKVY

SEQ ID NO: 3356062 - protein, 25 aa, Plasmodium falciparum
EYSFKLPLKKCEEVTGEDDENGKNN

SEQ ID NO: 3356063 - protein, 25 aa, Plasmodium falciparum
EYSKRKHTCAGLLTIVQVEDKKYSS

SEQ ID NO: 3356064 - protein, 23 aa, Plasmodium falciparum
EYSTYNIFIWFLNYMHSKLEIRK

SEQ ID NO: 3356065 - protein, 18 aa, Plasmodium falciparum
EYTFLYSQGNSWNKRKGK

SEQ ID NO: 3356066 - protein, 26 aa, Plasmodium falciparum
EYTGKCGISSLGDSVCMILRREFLPG

SEQ ID NO: 3356067 - protein, 18 aa, Plasmodium falciparum
EYVKGCTINFILKNLKEY

SEQ ID NO: 3356068 - protein, 22 aa, Plasmodium falciparum
EYYFKKFSKMIIKKSILEECVS

SEQ ID NO: 3356069 - protein, 30 aa, Plasmodium falciparum
EYYICKCLYKRHRDLIAIILRYMHANLYII

SEQ ID NO: 3356070 - protein, 27 aa, Plasmodium falciparum
EYYKHRNSSFCFFKGSVKRFVSKNEVE

SEQ ID NO: 3356071 - protein, 23 aa, Plasmodium falciparum
EYYKPSWTFHSKGIWIMDNMKSM

SEQ ID NO: 3356072 - protein, 42 aa, Plasmodium falciparum
EYYQRRVYDTDIFKRDFKKRCAYDFGMKIIGKPRSRRKTKRW

SEQ ID NO: 3356073 - protein, 19 aa, Plasmodium falciparum
EYYSCNEILEMILKGDLHK

SEQ ID NO: 3356074 - protein, 23 aa, Plasmodium falciparum
EYYYLKKTELFGISESREKQLQN

SEQ ID NO: 3356075 - protein, 23 aa, Plasmodium falciparum
FAAFKDIALYLGYKEKDINTIQV

SEQ ID NO: 3356076 - protein, 20 aa, Plasmodium falciparum
FACMVFELVTGDFLFNPQKG

SEQ ID NO: 3356077 - protein, 19 aa, Plasmodium falciparum
FADGACALVLMSEQKLKEL

SEQ ID NO: 3356078 - protein, 22 aa, Plasmodium falciparum
FAFKYIHVSSHPKYRNFKFGGL

SEQ ID NO: 3356079 - protein, 19 aa, Plasmodium falciparum
FAFYGTSLLFVFDSDPSKK

SEQ ID NO: 3356080 - protein, 24 aa, Plasmodium falciparum
FAHAEARKSPALDGKVCRTSDGKE

SEQ ID NO: 3356081 - protein, 19 aa, Plasmodium falciparum
FAHKLEGPTTLSVLHDKIL

SEQ ID NO: 3356082 - protein, 19 aa, Plasmodium falciparum
FAIEVKDLYFYFEGSECPL

SEQ ID NO: 3356083 - protein, 19 aa, Plasmodium falciparum
FAIKCKTLDTKLIVSILTE

SEQ ID NO: 3356084 - protein, 18 aa, Plasmodium falciparum
FAKLKFVHPKFFNYLFQH

SEQ ID NO: 3356085 - protein, 24 aa, Plasmodium falciparum
FAKLRYRNVNMIHMLLLKIKENID

SEQ ID NO: 3356086 - protein, 17 aa, Plasmodium falciparum
FAKNLFTVFQMMFVIQI

SEQ ID NO: 3356087 - protein, 34 aa, Plasmodium falciparum
FAKNTYCYRKDYSFKSNRPYVLYMNNPLYIWDIS

SEQ ID NO: 3356088 - protein, 25 aa, Plasmodium falciparum
FAKTECPYCIKAISILKGYNLNSHM

SEQ ID NO: 3356089 - protein, 17 aa, Plasmodium falciparum
FALRGLFIIDKNGCVRH

SEQ ID NO: 3356090 - protein, 18 aa, Plasmodium falciparum
FALYRKEERLTLIRKKIQ

SEQ ID NO: 3356091 - protein, 28 aa, Plasmodium falciparum
FANFYFKPIYYYSLPYKIIHAWYTGPAH

SEQ ID NO: 3356092 - protein, 23 aa, Plasmodium falciparum
FAQLWECLGYLASEEDPQILKIV

SEQ ID NO: 3356093 - protein, 25 aa, Plasmodium falciparum
FARPKILILCPFRYNAKEYVDLICN

SEQ ID NO: 3356094 - protein, 21 aa, Plasmodium falciparum
FARYRALFRGGYEVLRELLRR

SEQ ID NO: 3356095 - protein, 25 aa, Plasmodium falciparum
FASFFKIELFLFIKGYSKEEKVVIY

SEQ ID NO: 3356096 - protein, 18 aa, Plasmodium falciparum
FASFIMKQIFSVLNYLHI

SEQ ID NO: 3356097 - protein, 23 aa, Plasmodium falciparum
FASQFYKQEWWEWITEKERDEVF

SEQ ID NO: 3356098 - protein, 19 aa, Plasmodium falciparum
FAVRCRLNPAYKLLRSLAV

SEQ ID NO: 3356099 - protein, 18 aa, Plasmodium falciparum
FCAFIPFETAERALDNLL

SEQ ID NO: 3356100 - protein, 22 aa, Plasmodium falciparum
FCALHGFKTVWLADSAFDINTN

SEQ ID NO: 3356101 - protein, 28 aa, Plasmodium falciparum
FCDVFLNKWLCPFFEDFIINLQNYDKNK

SEQ ID NO: 3356102 - protein, 19 aa, Plasmodium falciparum
FCEAYKTVEKMQINHYTVE

SEQ ID NO: 3356103 - protein, 27 aa, Plasmodium falciparum
FCENKNRINVALSRAKSQIIIVAHNNF

SEQ ID NO: 3356104 - protein, 18 aa, Plasmodium falciparum
FCESGTKYLIKYKIYNLI

SEQ ID NO: 3356105 - protein, 29 aa, Plasmodium falciparum
FCEYKDVETCLLAFKYINGYEIKGRKLKV

SEQ ID NO: 3356106 - protein, 31 aa, Plasmodium falciparum
FCFTMYKIYLRRILFGYLRIRDNRINIKNVI

SEQ ID NO: 3356107 - protein, 24 aa, Plasmodium falciparum
FCGNNIAAFVFRRRGHIPKILNTV

SEQ ID NO: 3356108 - protein, 26 aa, Plasmodium falciparum
FCHKENDCLDILKSPRSFNNKRTDNI

SEQ ID NO: 3356109 - protein, 25 aa, Plasmodium falciparum
FCKDKKYLFCACNDGSLYIYLIYEY

SEQ ID NO: 3356110 - protein, 17 aa, Plasmodium falciparum
FCKEYSKFYDLSIDIIK

SEQ ID NO: 3356111 - protein, 24 aa, Plasmodium falciparum
FCLKGMALRSVEIYMSALLKCSLL

SEQ ID NO: 3356112 - protein, 17 aa, Plasmodium falciparum
FCNFDKSIISAFENHIK

SEQ ID NO: 3356113 - protein, 17 aa, Plasmodium falciparum
FCNKLWNAVKFFLKTLP

SEQ ID NO: 3356114 - protein, 21 aa, Plasmodium falciparum
FCNSCKYVGCSKYSFFDIVSI

SEQ ID NO: 3356115 - protein, 33 aa, Plasmodium falciparum
FCQKNFDMGKNISFKIQHQIGLIKKSLKSLKNK

SEQ ID NO: 3356116 - protein, 21 aa, Plasmodium falciparum
FCSDFSLKEHVINFHKGIKRF

SEQ ID NO: 3356117 - protein, 23 aa, Plasmodium falciparum
FCSELLPFYCKSEIIHQGDIFNV

SEQ ID NO: 3356118 - protein, 21 aa, Plasmodium falciparum
FCSLFPYFYFYELKLKILLFF

SEQ ID NO: 3356119 - protein, 17 aa, Plasmodium falciparum
FCSLHRYADAHNCTFDY

SEQ ID NO: 3356120 - protein, 19 aa, Plasmodium falciparum
FCSLNRFSWYRQDVRLDNV

SEQ ID NO: 3356121 - protein, 17 aa, Plasmodium falciparum
FCSLTLWVSNPQETKAC

SEQ ID NO: 3356122 - protein, 23 aa, Plasmodium falciparum
FCSMERKGTVLLSNMSIKKIDNA

SEQ ID NO: 3356123 - protein, 17 aa, Plasmodium falciparum
FCSSSNKKLKSYMFNGG

SEQ ID NO: 3356124 - protein, 17 aa, Plasmodium falciparum
FCTLLGNYFKGFIIICE

SEQ ID NO: 3356125 - protein, 18 aa, Plasmodium falciparum
FCTTCYTPIGYLENNNKN

SEQ ID NO: 3356126 - protein, 17 aa, Plasmodium falciparum
FCVQKCCEKSVQVCKDL

SEQ ID NO: 3356127 - protein, 26 aa, Plasmodium falciparum
FDANENIRIGKTDHPKYLNGKDYAYT

SEQ ID NO: 3356128 - protein, 20 aa, Plasmodium falciparum
FDCICKPHISPFIKTLLPLL

SEQ ID NO: 3356129 - protein, 17 aa, Plasmodium falciparum
FDCVSPIKTVYGLLKER

SEQ ID NO: 3356130 - protein, 21 aa, Plasmodium falciparum
FDDKECFYINFKKSSKGHNDT

SEQ ID NO: 3356131 - protein, 17 aa, Plasmodium falciparum
FDDSCVNSNRFCNPNDS

SEQ ID NO: 3356132 - protein, 52 aa, Plasmodium falciparum
FDEEDLWFLCDLCNNPISPLCYVYECNICDNFALCKKCYKKNKHEHNLKKIL

SEQ ID NO: 3356133 - protein, 17 aa, Plasmodium falciparum
FDEFNRLIPEVLSVCSI

SEQ ID NO: 3356134 - protein, 18 aa, Plasmodium falciparum
FDEFSRIDESVIVIIVEQ

SEQ ID NO: 3356135 - protein, 18 aa, Plasmodium falciparum
FDEFYKYKKSCEENEHKR

SEQ ID NO: 3356136 - protein, 22 aa, Plasmodium falciparum
FDEHQICLKDGHKYEYVDKRCY

SEQ ID NO: 3356137 - protein, 24 aa, Plasmodium falciparum
FDEKEIFKCLQIKNDFLKKENKKI

SEQ ID NO: 3356138 - protein, 22 aa, Plasmodium falciparum
FDELSYNPNGIFLEKNTITNYN

SEQ ID NO: 3356139 - protein, 18 aa, Plasmodium falciparum
FDENDLKELFSYYKGAHD

SEQ ID NO: 3356140 - protein, 21 aa, Plasmodium falciparum
FDETLCVLKKGRDIDGTALLK

SEQ ID NO: 3356141 - protein, 23 aa, Plasmodium falciparum
FDEVQFAPAPSFRRINDIVKSHC

SEQ ID NO: 3356142 - protein, 20 aa, Plasmodium falciparum
FDFGKRLFIEKEIKKYMKNQ

SEQ ID NO: 3356143 - protein, 17 aa, Plasmodium falciparum
FDFLPENILLLTDSLPS

SEQ ID NO: 3356144 - protein, 23 aa, Plasmodium falciparum
FDFLSKDKIEYISMLSPTINEIK

SEQ ID NO: 3356145 - protein, 17 aa, Plasmodium falciparum
FDFLSNFHFDMPYNSSV

SEQ ID NO: 3356146 - protein, 17 aa, Plasmodium falciparum
FDFRKYKIDMVVGLHCC

SEQ ID NO: 3356147 - protein, 22 aa, Plasmodium falciparum
FDFWKNCYDLNFSSVLPIIKEE

SEQ ID NO: 3356148 - protein, 18 aa, Plasmodium falciparum
FDGSNHFDHTIFDKHDNI

SEQ ID NO: 3356149 - protein, 19 aa, Plasmodium falciparum
FDGVGSWSLEGIDASKFSI

SEQ ID NO: 3356150 - protein, 19 aa, Plasmodium falciparum
FDGVLTCFFLDTAKNLFMY

SEQ ID NO: 3356151 - protein, 18 aa, Plasmodium falciparum
FDHIEESFNYPENKEFIK

SEQ ID NO: 3356152 - protein, 22 aa, Plasmodium falciparum
FDHLVEVGVLYKFFYQIKDSEE

SEQ ID NO: 3356153 - protein, 23 aa, Plasmodium falciparum
FDHNQIRWIAYWKNENNKQIQKH

SEQ ID NO: 3356154 - protein, 30 aa, Plasmodium falciparum
FDHPNIFVPLPCGFKHNNKNLAYYTSCNDK

SEQ ID NO: 3356155 - protein, 19 aa, Plasmodium falciparum
FDHSDLKNMFPLNHQNSKL

SEQ ID NO: 3356156 - protein, 27 aa, Plasmodium falciparum
FDIDEIYTFTGPILIAVNPFKIIKDLY

SEQ ID NO: 3356157 - protein, 17 aa, Plasmodium falciparum
FDIELKSIIQEYYDIKK

SEQ ID NO: 3356158 - protein, 26 aa, Plasmodium falciparum
FDIFPLFRFLGIKPYGTIEWWNKEIV

SEQ ID NO: 3356159 - protein, 29 aa, Plasmodium falciparum
FDIKKATILRIFFWVIGQYMFNEHMIINF

SEQ ID NO: 3356160 - protein, 23 aa, Plasmodium falciparum
FDILFDVFMKIIKTIGYHCKKFS

SEQ ID NO: 3356161 - protein, 19 aa, Plasmodium falciparum
FDILKIENIHHVYDNNTIS

SEQ ID NO: 3356162 - protein, 24 aa, Plasmodium falciparum
FDINSICVSLKLKLKIKNNNEASN

SEQ ID NO: 3356163 - protein, 24 aa, Plasmodium falciparum
FDIPYLYRRCEINNLSVSREIGFI

SEQ ID NO: 3356164 - protein, 25 aa, Plasmodium falciparum
FDISFEFKRNLSIIEVKKYCKHVPN

SEQ ID NO: 3356165 - protein, 23 aa, Plasmodium falciparum
FDITWRIVRDWMLLKDVPEYSFN

SEQ ID NO: 3356166 - protein, 30 aa, Plasmodium falciparum
FDIYDYIMKMGYKFIKIYLSSWLYINERII

SEQ ID NO: 3356167 - protein, 17 aa, Plasmodium falciparum
FDIYKCDNVYLFINYIK

SEQ ID NO: 3356168 - protein, 26 aa, Plasmodium falciparum
FDKARAAAPCVLFFDELDSIGTQRGS

SEQ ID NO: 3356169 - protein, 18 aa, Plasmodium falciparum
FDKDHLFLYVSFFNNKNK

SEQ ID NO: 3356170 - protein, 22 aa, Plasmodium falciparum
FDKHYGKCVILFGIPYQYTLSK

SEQ ID NO: 3356171 - protein, 18 aa, Plasmodium falciparum
FDKIKIIDFNSCIYESDK

SEQ ID NO: 3356172 - protein, 19 aa, Plasmodium falciparum
FDKKIFCTKLNEELKSFSI

SEQ ID NO: 3356173 - protein, 31 aa, Plasmodium falciparum
FDKNICINELWIILLAFKSAYSYKNVFKKYS

SEQ ID NO: 3356174 - protein, 27 aa, Plasmodium falciparum
FDKNRQRWIAHWKIDGKYHKHYFPISQ

SEQ ID NO: 3356175 - protein, 17 aa, Plasmodium falciparum
FDKNVIIYKEVNINKYE

SEQ ID NO: 3356176 - protein, 35 aa, Plasmodium falciparum
FDKNVPYLLVDNIIKHKFIHDVSCGENHIAFLSKE

SEQ ID NO: 3356177 - protein, 17 aa, Plasmodium falciparum
FDKPREGFTSTFGKYSS

SEQ ID NO: 3356178 - protein, 17 aa, Plasmodium falciparum
FDKSLGTKFEDKCNLIL

SEQ ID NO: 3356179 - protein, 25 aa, Plasmodium falciparum
FDKSQKAWIGSWYEEGKQIKRRFKI

SEQ ID NO: 3356180 - protein, 17 aa, Plasmodium falciparum
FDKYSYVHKSFHDLPPY

SEQ ID NO: 3356181 - protein, 22 aa, Plasmodium falciparum
FDLDNTLILSRGFFKPAQNEKD

SEQ ID NO: 3356182 - protein, 18 aa, Plasmodium falciparum
FDLEFLIHRCNVHNLNSY

SEQ ID NO: 3356183 - protein, 20 aa, Plasmodium falciparum
FDLFLNYEESIFCNEVIFYV

SEQ ID NO: 3356184 - protein, 20 aa, Plasmodium falciparum
FDLQNCLIKRSSVNKKNLFY

SEQ ID NO: 3356185 - protein, 18 aa, Plasmodium falciparum
FDLSQYFPLLTTKKLFLR

SEQ ID NO: 3356186 - protein, 26 aa, Plasmodium falciparum
FDLWIKAEKYLCCIYESKNEIIDKIK

SEQ ID NO: 3356187 - protein, 20 aa, Plasmodium falciparum
FDLYICFIDINYIFNSLSWD

SEQ ID NO: 3356188 - protein, 17 aa, Plasmodium falciparum
FDMADFTIENVLKKKDN

SEQ ID NO: 3356189 - protein, 20 aa, Plasmodium falciparum
FDMADTIILYDHFIINNNEN

SEQ ID NO: 3356190 - protein, 24 aa, Plasmodium falciparum
FDMKKEWNYEIIIQFENLYHFCNI

SEQ ID NO: 3356191 - protein, 24 aa, Plasmodium falciparum
FDMKLKKLVKWNVGPFKMPRNINS

SEQ ID NO: 3356192 - protein, 24 aa, Plasmodium falciparum
FDMKTCKNNDMFTCPMKKEKPIDA

SEQ ID NO: 3356193 - protein, 21 aa, Plasmodium falciparum
FDMNAAPRVNRRSDFPRNTCH

SEQ ID NO: 3356194 - protein, 26 aa, Plasmodium falciparum
FDMSGCAAVLGCAYCVGTLKPENVEI

SEQ ID NO: 3356195 - protein, 17 aa, Plasmodium falciparum
FDNCEIINYDLSNNIND

SEQ ID NO: 3356196 - protein, 24 aa, Plasmodium falciparum
FDNFTNLFECLKKFKYIFKNKNYM

SEQ ID NO: 3356197 - protein, 34 aa, Plasmodium falciparum
FDNHKELFLELLSILKHDYLDIYLTNLRKIISSE

SEQ ID NO: 3356198 - protein, 30 aa, Plasmodium falciparum
FDNIKIPFPLLSRFDLVFLLADNISEEKDY

SEQ ID NO: 3356199 - protein, 18 aa, Plasmodium falciparum
FDNKEHFLKEIKKKKKNK

SEQ ID NO: 3356200 - protein, 19 aa, Plasmodium falciparum
FDNKFRFLLYELQQLILPH

SEQ ID NO: 3356201 - protein, 24 aa, Plasmodium falciparum
FDNSPNHKLICFIVSKQIPHQNTM

SEQ ID NO: 3356202 - protein, 27 aa, Plasmodium falciparum
FDNVGLPFLAFCFYNINYEPTKKKQMC

SEQ ID NO: 3356203 - protein, 18 aa, Plasmodium falciparum
FDPPIPLYDLLLVAVNNS

SEQ ID NO: 3356204 - protein, 29 aa, Plasmodium falciparum
FDQKIPESRKVDMAIVRGRKKKIYSSSEE

SEQ ID NO: 3356205 - protein, 20 aa, Plasmodium falciparum
FDRARFLLKKSRVQCNTPKI

SEQ ID NO: 3356206 - protein, 56 aa, Plasmodium falciparum
FDRRETSEYFYLPVDCPRMKKCDDAYCPLAHTKLEKIFHPIVYKTQACQMAKDGAC

SEQ ID NO: 3356207 - protein, 18 aa, Plasmodium falciparum
FDSFSTLTNLNCEKLIVL

SEQ ID NO: 3356208 - protein, 32 aa, Plasmodium falciparum
FDSIKGRCIYAASNMYKLDFICEYVGDLLTYN

SEQ ID NO: 3356209 - protein, 24 aa, Plasmodium falciparum
FDSLKMYSNEFIKMKGNMEDLIKL

SEQ ID NO: 3356210 - protein, 25 aa, Plasmodium falciparum
FDSSFPIKVDLYFLKGSKVMPLNTG

SEQ ID NO: 3356211 - protein, 18 aa, Plasmodium falciparum
FDSSKCSICEGTLLYIND

SEQ ID NO: 3356212 - protein, 20 aa, Plasmodium falciparum
FDSSPFWLKNYKNISNYSNN

SEQ ID NO: 3356213 - protein, 36 aa, Plasmodium falciparum
FDVISIVCEYVQYNVRVHLMACDIYGDILKYIYLDN

SEQ ID NO: 3356214 - protein, 21 aa, Plasmodium falciparum
FDVTNCLKDNIILNCTEQTNY

SEQ ID NO: 3356215 - protein, 18 aa, Plasmodium falciparum
FDVYETKGYIPLSNEHKQ

SEQ ID NO: 3356216 - protein, 19 aa, Plasmodium falciparum
FDYDLPIDFEEHFLQIIEN

SEQ ID NO: 3356217 - protein, 25 aa, Plasmodium falciparum
FDYLNYYFLCEIVFDDFSFKSPYHC

SEQ ID NO: 3356218 - protein, 18 aa, Plasmodium falciparum
FDYSNLYKIQDFLNNIIG

SEQ ID NO: 3356219 - protein, 24 aa, Plasmodium falciparum
FDYTPGIPPPYLVRSNASMDSYKN

SEQ ID NO: 3356220 - protein, 24 aa, Plasmodium falciparum
FDYVVCADLIKTCDYTYSFLPTLD

SEQ ID NO: 3356221 - protein, 27 aa, Plasmodium falciparum
FEAIEKEYLRILILDINDIYDNTIECY

SEQ ID NO: 3356222 - protein, 17 aa, Plasmodium falciparum
FEALNRWNNIDTNKSNY

SEQ ID NO: 3356223 - protein, 20 aa, Plasmodium falciparum
FEAVCCTCNKIVKLNKIMLQ

SEQ ID NO: 3356224 - protein, 24 aa, Plasmodium falciparum
FECRGIELIDFFPSNNFIVEDTKG

SEQ ID NO: 3356225 - protein, 20 aa, Plasmodium falciparum
FEDDILYEYCISQLKQSKEK

SEQ ID NO: 3356226 - protein, 26 aa, Plasmodium falciparum
FEDNFRIVGEPDFNEVFEVEKIIMAR

SEQ ID NO: 3356227 - protein, 18 aa, Plasmodium falciparum
FEDPHVWIYENVLLNKTL

SEQ ID NO: 3356228 - protein, 19 aa, Plasmodium falciparum
FEEDENYSLVNYVHSDQEY

SEQ ID NO: 3356229 - protein, 18 aa, Plasmodium falciparum
FEEELKISRERNKLIEKN

SEQ ID NO: 3356230 - protein, 29 aa, Plasmodium falciparum
FEEELPKAHKARYEYAYNVVETLKKHTPK

SEQ ID NO: 3356231 - protein, 20 aa, Plasmodium falciparum
FEEFKQFCLQNGNDQTRKKR

SEQ ID NO: 3356232 - protein, 24 aa, Plasmodium falciparum
FEEIAEILFRYGFNCSSKELLYSG

SEQ ID NO: 3356233 - protein, 26 aa, Plasmodium falciparum
FEEILNFKLNIEKVFYESLSNEERNI

SEQ ID NO: 3356234 - protein, 25 aa, Plasmodium falciparum
FEEIYYIICSAIKKRRTAETAYNKK

SEQ ID NO: 3356235 - protein, 17 aa, Plasmodium falciparum
FEELYKHLVCTNNKNGL

SEQ ID NO: 3356236 - protein, 18 aa, Plasmodium falciparum
FEEMNGYRYIGSIDDKRL

SEQ ID NO: 3356237 - protein, 34 aa, Plasmodium falciparum
FEENKSSFSMLYLFGKVKFYISIIDIIHNKTNSH

SEQ ID NO: 3356238 - protein, 24 aa, Plasmodium falciparum
FEEQRKKVELKWLEEEKRKEELKK

SEQ ID NO: 3356239 - protein, 23 aa, Plasmodium falciparum
FEESRKYIHGEITKTLKANSVKI

SEQ ID NO: 3356240 - protein, 19 aa, Plasmodium falciparum
FEEVMRRKNEKKKMELQKN

SEQ ID NO: 3356241 - protein, 28 aa, Plasmodium falciparum
FEEWKKSKLPLILFHETYVLLLHIDNLK

SEQ ID NO: 3356242 - protein, 24 aa, Plasmodium falciparum
FEEWRLLQNHYFILVAFNCYNNIN

SEQ ID NO: 3356243 - protein, 22 aa, Plasmodium falciparum
FEEYLFVCYIMITLVEIEVDKL

SEQ ID NO: 3356244 - protein, 20 aa, Plasmodium falciparum
FEFMTTRNLMRFKVSNYESD

SEQ ID NO: 3356245 - protein, 18 aa, Plasmodium falciparum
FEFPKWIQPQYIRDINLR

SEQ ID NO: 3356246 - protein, 18 aa, Plasmodium falciparum
FEGAKGWIHELKSVHSND

SEQ ID NO: 3356247 - protein, 24 aa, Plasmodium falciparum
FEGKRYSISYNRMMTPNLYTGFKR

SEQ ID NO: 3356248 - protein, 23 aa, Plasmodium falciparum
FEIKRGHYVYGYIYMDLFERENK

SEQ ID NO: 3356249 - protein, 20 aa, Plasmodium falciparum
FEISNLVQLFYAFVKIEYYP

SEQ ID NO: 3356250 - protein, 20 aa, Plasmodium falciparum
FEITEIFSKYGPLLGQGIYF

SEQ ID NO: 3356251 - protein, 23 aa, Plasmodium falciparum
FEKAKLRIGIGITEEAQDLFDFI

SEQ ID NO: 3356252 - protein, 26 aa, Plasmodium falciparum
FEKEEMWWIVIGIKKMNLLLSIKKLS

SEQ ID NO: 3356253 - protein, 17 aa, Plasmodium falciparum
FEKEKAKDMRILFLETG

SEQ ID NO: 3356254 - protein, 22 aa, Plasmodium falciparum
FEKELAQLFLTFNHMKKSNFLE

SEQ ID NO: 3356255 - protein, 29 aa, Plasmodium falciparum
FEKHFYEWRHSFGMKCLKIPNTLHFKEIT

SEQ ID NO: 3356256 - protein, 24 aa, Plasmodium falciparum
FEKHLFKRTPIFYKDILYSEINYS

SEQ ID NO: 3356257 - protein, 20 aa, Plasmodium falciparum
FEKIKCIVLGGPGFFKNDFF

SEQ ID NO: 3356258 - protein, 25 aa, Plasmodium falciparum
FEKKNKKILKMRRSLKRKRKSPKNE

SEQ ID NO: 3356259 - protein, 36 aa, Plasmodium falciparum
FEKLCSISLSNLHVYACLVCGLYFQGIGKGTHAYTH

SEQ ID NO: 3356260 - protein, 25 aa, Plasmodium falciparum
FEKLNAVISRCLKCYDVNQKDSHLA

SEQ ID NO: 3356261 - protein, 17 aa, Plasmodium falciparum
FEKLSVLLISKFKLILQ

SEQ ID NO: 3356262 - protein, 23 aa, Plasmodium falciparum
FEKNKKMYSAKCYKENDNTFEKM

SEQ ID NO: 3356263 - protein, 18 aa, Plasmodium falciparum
FEKPFLWLARRLSNQPNL

SEQ ID NO: 3356264 - protein, 28 aa, Plasmodium falciparum
FEKQLKRNLLISLCEKYNINILYSNQNY

SEQ ID NO: 3356265 - protein, 23 aa, Plasmodium falciparum
FEKRNNFIFFHAFSSLRKYKSQH

SEQ ID NO: 3356266 - protein, 23 aa, Plasmodium falciparum
FEKVFFYKHIIELIDSLAADVVY

SEQ ID NO: 3356267 - protein, 20 aa, Plasmodium falciparum
FELCRRIHFKSAKEWKQFMN

SEQ ID NO: 3356268 - protein, 17 aa, Plasmodium falciparum
FELHLLIDYKKKLEDLL

SEQ ID NO: 3356269 - protein, 17 aa, Plasmodium falciparum
FELLKLDGVKEFLDTFK

SEQ ID NO: 3356270 - protein, 30 aa, Plasmodium falciparum
FELMLKLLSERKFLCFPSLKIFAILLNDIE

SEQ ID NO: 3356271 - protein, 26 aa, Plasmodium falciparum
FELNFLYTKECIFYIKSQFEKYINKY

SEQ ID NO: 3356272 - protein, 17 aa, Plasmodium falciparum
FELRRGVEIVIGTPGRL

SEQ ID NO: 3356273 - protein, 19 aa, Plasmodium falciparum
FELSTKLRFKDFKKYFPFK

SEQ ID NO: 3356274 - protein, 17 aa, Plasmodium falciparum
FELTGLIKHIGSGTDYG

SEQ ID NO: 3356275 - protein, 22 aa, Plasmodium falciparum
FELWHNNCCFSSKQLIKLSEVT

SEQ ID NO: 3356276 - protein, 26 aa, Plasmodium falciparum
FENAKAGLWSSFAIREKTSFSSYNMT

SEQ ID NO: 3356277 - protein, 21 aa, Plasmodium falciparum
FENFCIHRGYDIIKDKTYSNE

SEQ ID NO: 3356278 - protein, 20 aa, Plasmodium falciparum
FENFRKLILQKIGKTNGDIK

SEQ ID NO: 3356279 - protein, 18 aa, Plasmodium falciparum
FENLFSYTMDDVVKFIGK

SEQ ID NO: 3356280 - protein, 38 aa, Plasmodium falciparum
FENLKKLKVLCVDYLRILKRLTPLWGSTDRTFESHYVN

SEQ ID NO: 3356281 - protein, 30 aa, Plasmodium falciparum
FENNNFCPIFLKLLKIDIYNTCYTVDTKVN

SEQ ID NO: 3356282 - protein, 19 aa, Plasmodium falciparum
FENSDRIYLASSYKKTISN

SEQ ID NO: 3356283 - protein, 20 aa, Plasmodium falciparum
FENSYWKDIEFYNIEDLYIN

SEQ ID NO: 3356284 - protein, 23 aa, Plasmodium falciparum
FEPFKEKHMLTIITNKVTNTFTY

SEQ ID NO: 3356285 - protein, 20 aa, Plasmodium falciparum
FEPFSSMYYYTGLHNYRTFY

SEQ ID NO: 3356286 - protein, 25 aa, Plasmodium falciparum
FEQMRRKSYEPILYNEVNRNQHINE

SEQ ID NO: 3356287 - protein, 34 aa, Plasmodium falciparum
FEQSINMEGFRCILSKMMINYEGDMLVDDQEEEE

SEQ ID NO: 3356288 - protein, 28 aa, Plasmodium falciparum
FEQYGLGFKILRKMGYEDGIGKNMKTNI

SEQ ID NO: 3356289 - protein, 24 aa, Plasmodium falciparum
FERNSMCYQDLYAKLLNIEVYSKK

SEQ ID NO: 3356290 - protein, 17 aa, Plasmodium falciparum
FERRNSFYMNKVDQNGV

SEQ ID NO: 3356291 - protein, 18 aa, Plasmodium falciparum
FERRRRGVKTNEYYDYFV

SEQ ID NO: 3356292 - protein, 19 aa, Plasmodium falciparum
FESGALPYLISGMKSNIDG

SEQ ID NO: 3356293 - protein, 17 aa, Plasmodium falciparum
FESQIYNILRNCRKDKQ

SEQ ID NO: 3356294 - protein, 17 aa, Plasmodium falciparum
FESRFLKDITKINNDDI

SEQ ID NO: 3356295 - protein, 21 aa, Plasmodium falciparum
FETNGNISIWCFDKSEKIFDE

SEQ ID NO: 3356296 - protein, 28 aa, Plasmodium falciparum
FETPSGIEYPSFCKYDYNSTSNQKIEVI

SEQ ID NO: 3356297 - protein, 20 aa, Plasmodium falciparum
FEVGIFILQFINSIFSKYPL

SEQ ID NO: 3356298 - protein, 17 aa, Plasmodium falciparum
FEVPYTIICKKCNKYIY

SEQ ID NO: 3356299 - protein, 18 aa, Plasmodium falciparum
FEWDSKVVLYKLLKNQDL

SEQ ID NO: 3356300 - protein, 19 aa, Plasmodium falciparum
FEYMRRYIVDEMKDKKQKD

SEQ ID NO: 3356301 - protein, 17 aa, Plasmodium falciparum
FEYPECIPDDYDEEEED

SEQ ID NO: 3356302 - protein, 17 aa, Plasmodium falciparum
FFCRGVNNICGKKNSGK

SEQ ID NO: 3356303 - protein, 32 aa, Plasmodium falciparum
FFCSIEYLKINFCKDCYIICLSVEMITTLFNC

SEQ ID NO: 3356304 - protein, 21 aa, Plasmodium falciparum
FFDIYKKKLFLNADILKEILY

SEQ ID NO: 3356305 - protein, 19 aa, Plasmodium falciparum
FFDNSCGLVGQFKAREASL

SEQ ID NO: 3356306 - protein, 22 aa, Plasmodium falciparum
FFEDLKSLYISAGQMNKKTTFL

SEQ ID NO: 3356307 - protein, 19 aa, Plasmodium falciparum
FFELSKYDIISHFKEPTTA

SEQ ID NO: 3356308 - protein, 27 aa, Plasmodium falciparum
FFEQNCPNIKNYAIFFKYIKDASHFYD

SEQ ID NO: 3356309 - protein, 18 aa, Plasmodium falciparum
FFESSLLLEKWANEQNNT

SEQ ID NO: 3356310 - protein, 32 aa, Plasmodium falciparum
FFEVSFCSDLFLILCHMCKSINEVNCSLRKND

SEQ ID NO: 3356311 - protein, 26 aa, Plasmodium falciparum
FFEYIKKKFLLHGAVEIDTPIFELKE

SEQ ID NO: 3356312 - protein, 24 aa, Plasmodium falciparum
FFFKDISKYIKFHIIEKIINSNIY

SEQ ID NO: 3356313 - protein, 40 aa, Plasmodium falciparum
FFFRLTSLPERKNVRSFSVLKCTYAYILYKYNMDKNYKYI

SEQ ID NO: 3356314 - protein, 17 aa, Plasmodium falciparum
FFGKSIFIEDIFYYVGK

SEQ ID NO: 3356315 - protein, 27 aa, Plasmodium falciparum
FFGSKEIIELITFLRFLLNVDDNIIFK

SEQ ID NO: 3356316 - protein, 17 aa, Plasmodium falciparum
FFGSSIIRLTKKDFQYL

SEQ ID NO: 3356317 - protein, 25 aa, Plasmodium falciparum
FFHFLKKKYKNFYIHIVNLNTLFGI

SEQ ID NO: 3356318 - protein, 18 aa, Plasmodium falciparum
FFHINAWNNLYLKKYNKI

SEQ ID NO: 3356319 - protein, 31 aa, Plasmodium falciparum
FFHIPNKSILPLCSIRLLQINDAMKFTKVLN

SEQ ID NO: 3356320 - protein, 17 aa, Plasmodium falciparum
FFHKSIHYVMWNNNNIK

SEQ ID NO: 3356321 - protein, 26 aa, Plasmodium falciparum
FFHNRRELINLIIFLIVVKKLSKTSQ

SEQ ID NO: 3356322 - protein, 18 aa, Plasmodium falciparum
FFHPLTIRASSGYLLDIP

SEQ ID NO: 3356323 - protein, 18 aa, Plasmodium falciparum
FFIICIYTGNYNTIYNLA

SEQ ID NO: 3356324 - protein, 19 aa, Plasmodium falciparum
FFIKNQHLENIVSVRKNFE

SEQ ID NO: 3356325 - protein, 19 aa, Plasmodium falciparum
FFIKTDDYFSVSIENIKIE

SEQ ID NO: 3356326 - protein, 25 aa, Plasmodium falciparum
FFILKENYYYLSIDNLYLYLEILHR

SEQ ID NO: 3356327 - protein, 17 aa, Plasmodium falciparum
FFIPLLAEYYINKSKLL

SEQ ID NO: 3356328 - protein, 17 aa, Plasmodium falciparum
FFISYIDSIVNSKLIYV

SEQ ID NO: 3356329 - protein, 20 aa, Plasmodium falciparum
FFITLCPSINDIMLFFENLN

SEQ ID NO: 3356330 - protein, 18 aa, Plasmodium falciparum
FFIYGGINSKNEYLDEFL

SEQ ID NO: 3356331 - protein, 19 aa, Plasmodium falciparum
FFIYGKWSQEIYIAYVKDM

SEQ ID NO: 3356332 - protein, 27 aa, Plasmodium falciparum
FFKDRKWLKVEFDHIFKEGLKNYDETI

SEQ ID NO: 3356333 - protein, 22 aa, Plasmodium falciparum
FFKKYYESYPYTDITKVSAYHI

SEQ ID NO: 3356334 - protein, 20 aa, Plasmodium falciparum
FFKLYGICEYDKYLIDLEEN

SEQ ID NO: 3356335 - protein, 17 aa, Plasmodium falciparum
FFKNVKFTKFYNFFNEK

SEQ ID NO: 3356336 - protein, 25 aa, Plasmodium falciparum
FFLFPFKLLHRLKKAILILKYIMHI

SEQ ID NO: 3356337 - protein, 22 aa, Plasmodium falciparum
FFLNTVKCMLAAHIYNFNVELS

SEQ ID NO: 3356338 - protein, 27 aa, Plasmodium falciparum
FFLPRLKPLMWCYEKEIVLYAFHLKLD

SEQ ID NO: 3356339 - protein, 19 aa, Plasmodium falciparum
FFLTHKISLAVAFDGALLK

SEQ ID NO: 3356340 - protein, 23 aa, Plasmodium falciparum
FFMCWKKCRFNNLTKVFLHSSND

SEQ ID NO: 3356341 - protein, 24 aa, Plasmodium falciparum
FFMHKHKPLIFLFINGMKNNSNIK

SEQ ID NO: 3356342 - protein, 25 aa, Plasmodium falciparum
FFMKRQCLKRSGGFGDILTGIVSVF

SEQ ID NO: 3356343 - protein, 17 aa, Plasmodium falciparum
FFMLKDSYDSICIPCIK

SEQ ID NO: 3356344 - protein, 17 aa, Plasmodium falciparum
FFMNSNFDIVKNHKNIS

SEQ ID NO: 3356345 - protein, 17 aa, Plasmodium falciparum
FFNFCVQLSILSNKCKI

SEQ ID NO: 3356346 - protein, 17 aa, Plasmodium falciparum
FFNFSSLLFENIKPNET

SEQ ID NO: 3356347 - protein, 40 aa, Plasmodium falciparum
FFNILIKIIDYWGGDIIKFSGDAVLVIWPLHNVLKNKKKK

SEQ ID NO: 3356348 - protein, 23 aa, Plasmodium falciparum
FFNKEIFNFLKIEIEKNISSFSL

SEQ ID NO: 3356349 - protein, 22 aa, Plasmodium falciparum
FFNKELQTCVSCYQYIKEKVPS

SEQ ID NO: 3356350 - protein, 19 aa, Plasmodium falciparum
FFNKERMFIKLLRPGSELS

SEQ ID NO: 3356351 - protein, 23 aa, Plasmodium falciparum
FFNKKLFNYGIEYYIDVSDQEII

SEQ ID NO: 3356352 - protein, 21 aa, Plasmodium falciparum
FFPEIYNWKWIAHIEDLRYQY

SEQ ID NO: 3356353 - protein, 22 aa, Plasmodium falciparum
FFPHHYNAGGFFIAVIQKGENF

SEQ ID NO: 3356354 - protein, 18 aa, Plasmodium falciparum
FFPYPLNNMELFISKNNV

SEQ ID NO: 3356355 - protein, 32 aa, Plasmodium falciparum
FFQIKQDIFIIIWICLKLGIDSLNVSKYKKSL

SEQ ID NO: 3356356 - protein, 35 aa, Plasmodium falciparum
FFQTAKPLIPHVFKGINCTVFAYGATGSGKTYTML

SEQ ID NO: 3356357 - protein, 17 aa, Plasmodium falciparum
FFQVYGILSEESSDYDS

SEQ ID NO: 3356358 - protein, 25 aa, Plasmodium falciparum
FFRKNVYAIKFFRDDLRTINEEGIS

SEQ ID NO: 3356359 - protein, 17 aa, Plasmodium falciparum
FFRRANIYFNNKTSATN

SEQ ID NO: 3356360 - protein, 17 aa, Plasmodium falciparum
FFRSEFIKDYNMNYNDC

SEQ ID NO: 3356361 - protein, 19 aa, Plasmodium falciparum
FFSACSKNKPVSLYSAFDG

SEQ ID NO: 3356362 - protein, 41 aa, Plasmodium falciparum
FFSNSCVYKDFRYEYIFKTKIAYMLIKKFYAADDIENTIRF

SEQ ID NO: 3356363 - protein, 34 aa, Plasmodium falciparum
FFSNYKRLNVALTRARFNLFIFGNCKFLKHCDEW

SEQ ID NO: 3356364 - protein, 25 aa, Plasmodium falciparum
FFSPPKFVFMYSELIKNLSKDPNSS

SEQ ID NO: 3356365 - protein, 17 aa, Plasmodium falciparum
FFSRLPPYNLLPLCSGC

SEQ ID NO: 3356366 - protein, 26 aa, Plasmodium falciparum
FFSYDHLCFLERNFLLEKIEDMNELT

SEQ ID NO: 3356367 - protein, 19 aa, Plasmodium falciparum
FFTDLIKFFPLNNLDKCSL

SEQ ID NO: 3356368 - protein, 19 aa, Plasmodium falciparum
FFTEPNSQESLKWLNGEIN

SEQ ID NO: 3356369 - protein, 17 aa, Plasmodium falciparum
FFTGRMGIKRMYQKIPA

SEQ ID NO: 3356370 - protein, 21 aa, Plasmodium falciparum
FFTLLKRKILYSINNSNNNEN

SEQ ID NO: 3356371 - protein, 24 aa, Plasmodium falciparum
FFTPNWREQQSIFIDNLHFDMVPD

SEQ ID NO: 3356372 - protein, 22 aa, Plasmodium falciparum
FFTSSCILETLNNYYINNILRD

SEQ ID NO: 3356373 - protein, 39 aa, Plasmodium falciparum
FFTVNKLWSKAKWVFNIKDCRVFSELIGYDKDDKETTSE

SEQ ID NO: 3356374 - protein, 24 aa, Plasmodium falciparum
FFVKCDCYFRVGIYGFEKSKELAV

SEQ ID NO: 3356375 - protein, 26 aa, Plasmodium falciparum
FFVLKVRFNKRLIKKCGKTYIHTINN

SEQ ID NO: 3356376 - protein, 18 aa, Plasmodium falciparum
FFVNISYDSIIHANIFFG

SEQ ID NO: 3356377 - protein, 17 aa, Plasmodium falciparum
FFVNSCIPGNYVEALGI

SEQ ID NO: 3356378 - protein, 17 aa, Plasmodium falciparum
FFWPNINELILNKDIKE

SEQ ID NO: 3356379 - protein, 17 aa, Plasmodium falciparum
FFYDILNVIQLNENTWK

SEQ ID NO: 3356380 - protein, 20 aa, Plasmodium falciparum
FFYLDVNNYCIRWNSKKKKL

SEQ ID NO: 3356381 - protein, 19 aa, Plasmodium falciparum
FFYYTHIIYLSLIKSQNNK

SEQ ID NO: 3356382 - protein, 27 aa, Plasmodium falciparum
FGARNLRRWICSPLLDCEKIRERLDVV

SEQ ID NO: 3356383 - protein, 17 aa, Plasmodium falciparum
FGDAEECEDGIVTNVSG

SEQ ID NO: 3356384 - protein, 18 aa, Plasmodium falciparum
FGDISYKIPRKIVQCKPF

SEQ ID NO: 3356385 - protein, 22 aa, Plasmodium falciparum
FGDPWLYISWNMKRTFDQVQNK

SEQ ID NO: 3356386 - protein, 18 aa, Plasmodium falciparum
FGDVVSRYEKYSIYDELN

SEQ ID NO: 3356387 - protein, 30 aa, Plasmodium falciparum
FGEKNGHGKYIYKKCKSILEGNWVEGYLSY

SEQ ID NO: 3356388 - protein, 17 aa, Plasmodium falciparum
FGFIINRNEVMKGSSII

SEQ ID NO: 3356389 - protein, 17 aa, Plasmodium falciparum
FGFLTTEALLPPDGKTY

SEQ ID NO: 3356390 - protein, 17 aa, Plasmodium falciparum
FGFSCQLKNKRQKRSTF

SEQ ID NO: 3356391 - protein, 17 aa, Plasmodium falciparum
FGGCCYYNPYDISLINY

SEQ ID NO: 3356392 - protein, 18 aa, Plasmodium falciparum
FGGISLKKTYSIFRVNNP

SEQ ID NO: 3356393 - protein, 26 aa, Plasmodium falciparum
FGGKPECFRLFLSDEFKDSYCTESDF

SEQ ID NO: 3356394 - protein, 19 aa, Plasmodium falciparum
FGGQTALNCALMLDQKKVL

SEQ ID NO: 3356395 - protein, 26 aa, Plasmodium falciparum
FGHATAKKIALNFLRSLGVNADYLEN

SEQ ID NO: 3356396 - protein, 27 aa, Plasmodium falciparum
FGHTCPEAISLIKRRSSLMDFFKIKLK

SEQ ID NO: 3356397 - protein, 21 aa, Plasmodium falciparum
FGHVSFKYKNIIFIHGGNMGN

SEQ ID NO: 3356398 - protein, 17 aa, Plasmodium falciparum
FGIAAAHYRTNMHNRHQ

SEQ ID NO: 3356399 - protein, 29 aa, Plasmodium falciparum
FGIEGFCNILPIYLDFILNPTLENNMFLS

SEQ ID NO: 3356400 - protein, 19 aa, Plasmodium falciparum
FGILLCRLKKYNPVTTGDI

SEQ ID NO: 3356401 - protein, 24 aa, Plasmodium falciparum
FGIQELRANISLIALDNMSSKNKK

SEQ ID NO: 3356402 - protein, 18 aa, Plasmodium falciparum
FGIRGYRFDFLGESQSLS

SEQ ID NO: 3356403 - protein, 17 aa, Plasmodium falciparum
FGKVKLVLRENKYYIEA

SEQ ID NO: 3356404 - protein, 17 aa, Plasmodium falciparum
FGLKSLKCLKEFRKHED

SEQ ID NO: 3356405 - protein, 19 aa, Plasmodium falciparum
FGLSTIYRKNCLLTTSCGS

SEQ ID NO: 3356406 - protein, 17 aa, Plasmodium falciparum
FGNCCTANNNEYFYERQ

SEQ ID NO: 3356407 - protein, 26 aa, Plasmodium falciparum
FGNDIKNKFILEKVNECILDNENDKK

SEQ ID NO: 3356408 - protein, 19 aa, Plasmodium falciparum
FGNRLKEGKSLFSNPQGQN

SEQ ID NO: 3356409 - protein, 21 aa, Plasmodium falciparum
FGNVCELDLIFNFHKAYYLLD

SEQ ID NO: 3356410 - protein, 18 aa, Plasmodium falciparum
FGNYVVQYILNLGNEKVN

SEQ ID NO: 3356411 - protein, 17 aa, Plasmodium falciparum
FGQTCLFYASREGKTDC

SEQ ID NO: 3356412 - protein, 20 aa, Plasmodium falciparum
FGSGLQGWAFTLETFSRIYS

SEQ ID NO: 3356413 - protein, 24 aa, Plasmodium falciparum
FGSGWICLIGESFSFNISAKENSF

SEQ ID NO: 3356414 - protein, 17 aa, Plasmodium falciparum
FGSNIFIPSNNKVYENK

SEQ ID NO: 3356415 - protein, 17 aa, Plasmodium falciparum
FGSRSKNTPLFGNKTEV

SEQ ID NO: 3356416 - protein, 25 aa, Plasmodium falciparum
FGSTSLFGSSIFKASPSKDNVTSNT

SEQ ID NO: 3356417 - protein, 21 aa, Plasmodium falciparum
FGTALLKNDYIFSTDEKYNNK

SEQ ID NO: 3356418 - protein, 22 aa, Plasmodium falciparum
FGYLICDDCPILKKYVPPSAHE

SEQ ID NO: 3356419 - protein, 20 aa, Plasmodium falciparum
FGYRGEGLSGMSYLKNEVLD

SEQ ID NO: 3356420 - protein, 25 aa, Plasmodium falciparum
FGYSLGCSVTLQLVLDIAKSLYNDF

SEQ ID NO: 3356421 - protein, 20 aa, Plasmodium falciparum
FHDLPPYGIPSLFNIKFDRS

SEQ ID NO: 3356422 - protein, 26 aa, Plasmodium falciparum
FHDNLKLEGWFPLYDSLAGLKGELYC

SEQ ID NO: 3356423 - protein, 23 aa, Plasmodium falciparum
FHELSALHLDYIDHTNFSHMYTS

SEQ ID NO: 3356424 - protein, 19 aa, Plasmodium falciparum
FHFDMPYNSSVPFNNSMFS

SEQ ID NO: 3356425 - protein, 25 aa, Plasmodium falciparum
FHFEHFKGPFLFDSDEGIYSSTDHN

SEQ ID NO: 3356426 - protein, 18 aa, Plasmodium falciparum
FHFYEFPKIQVLSKLKED

SEQ ID NO: 3356427 - protein, 17 aa, Plasmodium falciparum
FHHGKNYICIGYIIGNT

SEQ ID NO: 3356428 - protein, 18 aa, Plasmodium falciparum
FHIIKNIFQKKDFKEPIE

SEQ ID NO: 3356429 - protein, 25 aa, Plasmodium falciparum
FHIKKRKRRIFVFTHFLNFIKRNYD

SEQ ID NO: 3356430 - protein, 19 aa, Plasmodium falciparum
FHILYDYLFHVIKKENLYN

SEQ ID NO: 3356431 - protein, 24 aa, Plasmodium falciparum
FHINEIRLSIFLKILCSHNKNIIQ

SEQ ID NO: 3356432 - protein, 35 aa, Plasmodium falciparum
FHIPSEWTDLDLFQHFCCFGNIISSKIQRDSTGRN

SEQ ID NO: 3356433 - protein, 24 aa, Plasmodium falciparum
FHIQCFKNYIEYNILPYYFLTKLN

SEQ ID NO: 3356434 - protein, 27 aa, Plasmodium falciparum
FHITKYDYKITHFLIDIIQNESLKILK

SEQ ID NO: 3356435 - protein, 25 aa, Plasmodium falciparum
FHKKKLRLVERWNRVAQESKLLSDY

SEQ ID NO: 3356436 - protein, 17 aa, Plasmodium falciparum
FHKKSFSLFAIIENVKG

SEQ ID NO: 3356437 - protein, 20 aa, Plasmodium falciparum
FHKLCKIKKLAVTCIAYQLN

SEQ ID NO: 3356438 - protein, 17 aa, Plasmodium falciparum
FHKNLFVNMDSCNSWIV

SEQ ID NO: 3356439 - protein, 23 aa, Plasmodium falciparum
FHKPHKCHFFIYNILEGEKGKKP

SEQ ID NO: 3356440 - protein, 17 aa, Plasmodium falciparum
FHKRKSKDIYNIINQYD

SEQ ID NO: 3356441 - protein, 23 aa, Plasmodium falciparum
FHKVNLRPITGFIQSYKKEKEKK

SEQ ID NO: 3356442 - protein, 26 aa, Plasmodium falciparum
FHLENFKLKTPCHFTLAQNTDFLNSI

SEQ ID NO: 3356443 - protein, 18 aa, Plasmodium falciparum
FHLYKNYINMILLFSNCQ

SEQ ID NO: 3356444 - protein, 19 aa, Plasmodium falciparum
FHMYENFCRVRNYDYEMKE

SEQ ID NO: 3356445 - protein, 25 aa, Plasmodium falciparum
FHNNKRKKDCIESTLTNLYTNNCDV

SEQ ID NO: 3356446 - protein, 21 aa, Plasmodium falciparum
FHPEEISSMVLKKMKEVAETY

SEQ ID NO: 3356447 - protein, 34 aa, Plasmodium falciparum
FHPPKGSHIKIKFKSMICMNNFLKAYKNTPDKWK

SEQ ID NO: 3356448 - protein, 19 aa, Plasmodium falciparum
FHPYFMMKNYTVHYMDPII

SEQ ID NO: 3356449 - protein, 17 aa, Plasmodium falciparum
FHQSYKSAIEIPEIDID

SEQ ID NO: 3356450 - protein, 19 aa, Plasmodium falciparum
FHRDLKLSNILLDENQNAV

SEQ ID NO: 3356451 - protein, 17 aa, Plasmodium falciparum
FHRKSFFKHDGYDNTKR

SEQ ID NO: 3356452 - protein, 22 aa, Plasmodium falciparum
FHRNKNGLSRSFVSSDVKRNNS

SEQ ID NO: 3356453 - protein, 24 aa, Plasmodium falciparum
FHSFIVEYKKLYNIKIKRQKIKQT

SEQ ID NO: 3356454 - protein, 18 aa, Plasmodium falciparum
FHSKRLGDIIHLVQLAIH

SEQ ID NO: 3356455 - protein, 17 aa, Plasmodium falciparum
FHSTSLIYKMFNKSIKF

SEQ ID NO: 3356456 - protein, 23 aa, Plasmodium falciparum
FHTKLSLNISNFIIYQKKHQLLM

SEQ ID NO: 3356457 - protein, 18 aa, Plasmodium falciparum
FHTYGRPIYEKKSKNPNN

SEQ ID NO: 3356458 - protein, 24 aa, Plasmodium falciparum
FHVIPCNKFKVLIKLNEIRIPLII

SEQ ID NO: 3356459 - protein, 21 aa, Plasmodium falciparum
FICESKYQLLFLRKGNDYKNI

SEQ ID NO: 3356460 - protein, 18 aa, Plasmodium falciparum
FICFYDWSDYSLIRKIDI

SEQ ID NO: 3356461 - protein, 24 aa, Plasmodium falciparum
FICRKSNMKNHNFLKYQINYPNDL

SEQ ID NO: 3356462 - protein, 18 aa, Plasmodium falciparum
FIDCKTLLKLKGCSKIDS

SEQ ID NO: 3356463 - protein, 18 aa, Plasmodium falciparum
FIDESFMKKISKLLRTTT

SEQ ID NO: 3356464 - protein, 17 aa, Plasmodium falciparum
FIDFMPIKDHLLKLREE

SEQ ID NO: 3356465 - protein, 20 aa, Plasmodium falciparum
FIDFNYKNCILNFPVSGQEY

SEQ ID NO: 3356466 - protein, 18 aa, Plasmodium falciparum
FIDMPKKHSLIIKLPLNN

SEQ ID NO: 3356467 - protein, 17 aa, Plasmodium falciparum
FIEEAYIAYNLKKSLLN

SEQ ID NO: 3356468 - protein, 19 aa, Plasmodium falciparum
FIEEQKFNTTLGYVQNVKL

SEQ ID NO: 3356469 - protein, 17 aa, Plasmodium falciparum
FIEFLIDIQCEGKCEEF

SEQ ID NO: 3356470 - protein, 23 aa, Plasmodium falciparum
FIEFPFNGLRIMTVIGNCLIYQC

SEQ ID NO: 3356471 - protein, 24 aa, Plasmodium falciparum
FIEGNYFICGSAYGRIQKMYKFNT

SEQ ID NO: 3356472 - protein, 29 aa, Plasmodium falciparum
FIEHELLETAILFDDLWETFNMLNEDQKK

SEQ ID NO: 3356473 - protein, 25 aa, Plasmodium falciparum
FIEHFKSKFLIFSTYFISVYVQSYK

SEQ ID NO: 3356474 - protein, 24 aa, Plasmodium falciparum
FIEMYVLCPHCLLPETDIVVKKGI

SEQ ID NO: 3356475 - protein, 28 aa, Plasmodium falciparum
FIEPIKKYNLCGVIVHRGLNSNCGHYIC

SEQ ID NO: 3356476 - protein, 47 aa, Plasmodium falciparum
FIEQKKKLKGLVVMPHEMYNLYKGKGKNLPKQWEYEFEEFSDDDSDD

SEQ ID NO: 3356477 - protein, 33 aa, Plasmodium falciparum
FIESTCLNCGQFIKKSLCLILIELLKPQVQNIL

SEQ ID NO: 3356478 - protein, 25 aa, Plasmodium falciparum
FIETNKNFHLFLSHLNQLEKSILTF

SEQ ID NO: 3356479 - protein, 23 aa, Plasmodium falciparum
FIFFRKFFLIYNMDKLLSNRKNI

SEQ ID NO: 3356480 - protein, 18 aa, Plasmodium falciparum
FIFIGDVKQLGFVLKSKN

SEQ ID NO: 3356481 - protein, 17 aa, Plasmodium falciparum
FIFQICPNISCVTIKNN

SEQ ID NO: 3356482 - protein, 18 aa, Plasmodium falciparum
FIGINALNLEPALPKLDE

SEQ ID NO: 3356483 - protein, 19 aa, Plasmodium falciparum
FIGINALNLEPALPKLDEK

SEQ ID NO: 3356484 - protein, 17 aa, Plasmodium falciparum
FIGNSDFFCHLNKNNDD

SEQ ID NO: 3356485 - protein, 17 aa, Plasmodium falciparum
FIGRVAIVELLEHKPII

SEQ ID NO: 3356486 - protein, 17 aa, Plasmodium falciparum
FIHDGVYLLIKRIHHNV

SEQ ID NO: 3356487 - protein, 25 aa, Plasmodium falciparum
FIHSLFWCNIEGFNYIGSLNNKGII

SEQ ID NO: 3356488 - protein, 17 aa, Plasmodium falciparum
FIHTYNMLFINIFYNII

SEQ ID NO: 3356489 - protein, 24 aa, Plasmodium falciparum
FIIFNYRSGTSLNINIEDDAWKIS

SEQ ID NO: 3356490 - protein, 27 aa, Plasmodium falciparum
FIKDDISIKCLGRFIGHSGEINCVRFN

SEQ ID NO: 3356491 - protein, 21 aa, Plasmodium falciparum
FIKDEKEAICAEMKESYLKEM

SEQ ID NO: 3356492 - protein, 17 aa, Plasmodium falciparum
FIKDIINYHLLKKKDDI

SEQ ID NO: 3356493 - protein, 21 aa, Plasmodium falciparum
FIKELECLNQKEGERQNSMNE

SEQ ID NO: 3356494 - protein, 21 aa, Plasmodium falciparum
FIKKKCIQKKKAMPWIQSEVS

SEQ ID NO: 3356495 - protein, 22 aa, Plasmodium falciparum
FIKMFKNFFLVLYYFIVLEDNF

SEQ ID NO: 3356496 - protein, 26 aa, Plasmodium falciparum
FILHPYHKIDICLSETISDLYPDIFN

SEQ ID NO: 3356497 - protein, 19 aa, Plasmodium falciparum
FILICPMIINIKTVRLESF

SEQ ID NO: 3356498 - protein, 20 aa, Plasmodium falciparum
FILKYLKKIILERNMELRNI

SEQ ID NO: 3356499 - protein, 17 aa, Plasmodium falciparum
FILKYLVNIKNDYIEKQ

SEQ ID NO: 3356500 - protein, 17 aa, Plasmodium falciparum
FILNEIVDILNEVKLEW

SEQ ID NO: 3356501 - protein, 17 aa, Plasmodium falciparum
FILSPSMLYLLINKQLK

SEQ ID NO: 3356502 - protein, 17 aa, Plasmodium falciparum
FIMGGPMGYTSTDTGTK

SEQ ID NO: 3356503 - protein, 26 aa, Plasmodium falciparum
FINANKLFCFENFLYNPFNHLYNFLI

SEQ ID NO: 3356504 - protein, 18 aa, Plasmodium falciparum
FINCKNGKQIIYDKKIKI

SEQ ID NO: 3356505 - protein, 17 aa, Plasmodium falciparum
FINEIYYSINLYTLKEF

SEQ ID NO: 3356506 - protein, 17 aa, Plasmodium falciparum
FINEKSYQYHIYFKHKF

SEQ ID NO: 3356507 - protein, 17 aa, Plasmodium falciparum
FINFLKLNFPEENLENG

SEQ ID NO: 3356508 - protein, 39 aa, Plasmodium falciparum
FINHPGEEFKLLRYYLIYDHLKYIVIRLRHIHKRILIFF

SEQ ID NO: 3356509 - protein, 26 aa, Plasmodium falciparum
FINKKFKLGELVYKIPKYVKPQKIYT

SEQ ID NO: 3356510 - protein, 18 aa, Plasmodium falciparum
FINLKCLFLNNNCIKKID

SEQ ID NO: 3356511 - protein, 20 aa, Plasmodium falciparum
FINNEYYKNGIVTLEQNIQN

SEQ ID NO: 3356512 - protein, 27 aa, Plasmodium falciparum
FINNIMKKKCDLFFKSNFNNIHVQSPE

SEQ ID NO: 3356513 - protein, 18 aa, Plasmodium falciparum
FINNKVFVLRNVIQQFRL

SEQ ID NO: 3356514 - protein, 20 aa, Plasmodium falciparum
FINNKWYLIFVNLYLPYNKN

SEQ ID NO: 3356515 - protein, 22 aa, Plasmodium falciparum
FINNSMHGYGYIFYIQSPCQNN

SEQ ID NO: 3356516 - protein, 23 aa, Plasmodium falciparum
FINPEFYGKIDLIKKNDIYEKCE

SEQ ID NO: 3356517 - protein, 18 aa, Plasmodium falciparum
FINPSICNRKGGKSKNGD

SEQ ID NO: 3356518 - protein, 18 aa, Plasmodium falciparum
FINRCSNNSYVRVINRTN

SEQ ID NO: 3356519 - protein, 20 aa, Plasmodium falciparum
FINSLIFAKRCKMIKQKIKK

SEQ ID NO: 3356520 - protein, 24 aa, Plasmodium falciparum
FINYKIYAYYAIIQFIFHILQNND

SEQ ID NO: 3356521 - protein, 19 aa, Plasmodium falciparum
FIPEERESINMSKKKNNIN

SEQ ID NO: 3356522 - protein, 19 aa, Plasmodium falciparum
FIPLSRYVAYFFPTFRPSP

SEQ ID NO: 3356523 - protein, 18 aa, Plasmodium falciparum
FIPMSGFGSFILNKGGPE

SEQ ID NO: 3356524 - protein, 17 aa, Plasmodium falciparum
FIPNILYELNIKDMNNI

SEQ ID NO: 3356525 - protein, 34 aa, Plasmodium falciparum
FIQFSFRWVNCLLLREFPINISVRLLDTYISDIC

SEQ ID NO: 3356526 - protein, 21 aa, Plasmodium falciparum
FIQLNAWNVNVAYTYGDDIDD

SEQ ID NO: 3356527 - protein, 22 aa, Plasmodium falciparum
FIRCNIKPLFNLNVCNLNRIKN

SEQ ID NO: 3356528 - protein, 19 aa, Plasmodium falciparum
FIRDNMCSDEDLPMNELKE

SEQ ID NO: 3356529 - protein, 24 aa, Plasmodium falciparum
FIRRDIFRLVFHKYILQNTRNKIK

SEQ ID NO: 3356530 - protein, 23 aa, Plasmodium falciparum
FISDAIQALEIFINEWKEKNEMK

SEQ ID NO: 3356531 - protein, 32 aa, Plasmodium falciparum
FISFYEIYCGKLYDLLQKRKMVAALENGKKEV

SEQ ID NO: 3356532 - protein, 22 aa, Plasmodium falciparum
FISGSYDGYVHFWQFKNMNKIS

SEQ ID NO: 3356533 - protein, 20 aa, Plasmodium falciparum
FISIKSYLLFLNILKVLDMK

SEQ ID NO: 3356534 - protein, 22 aa, Plasmodium falciparum
FISIWQRDVVSFYLNKITKKEN

SEQ ID NO: 3356535 - protein, 17 aa, Plasmodium falciparum
FISKIYIIRNIHNYYIV

SEQ ID NO: 3356536 - protein, 17 aa, Plasmodium falciparum
FISMAINLNHMYTHCNT

SEQ ID NO: 3356537 - protein, 23 aa, Plasmodium falciparum
FISRLKNTMTLNGHTSFVNRLKW

SEQ ID NO: 3356538 - protein, 17 aa, Plasmodium falciparum
FISSLFLLNNPFFNKSF

SEQ ID NO: 3356539 - protein, 21 aa, Plasmodium falciparum
FITDFCLLYFLTHYFEEITIH

SEQ ID NO: 3356540 - protein, 21 aa, Plasmodium falciparum
FITKGCNGLTHSFNFISKKDI

SEQ ID NO: 3356541 - protein, 23 aa, Plasmodium falciparum
FIVLKKELKNMLVLLESLNYIEV

SEQ ID NO: 3356542 - protein, 20 aa, Plasmodium falciparum
FIVSHNFGYFSIFTLNKNSC

SEQ ID NO: 3356543 - protein, 19 aa, Plasmodium falciparum
FIWKFLFSHMNTEKSKEEI

SEQ ID NO: 3356544 - protein, 25 aa, Plasmodium falciparum
FIYELMKKYKVTHVFCAHLHANREN

SEQ ID NO: 3356545 - protein, 26 aa, Plasmodium falciparum
FIYSIVSYIGPFPFYMINNCRIPHIF

SEQ ID NO: 3356546 - protein, 24 aa, Plasmodium falciparum
FIYSYKINGGFLKYENYNKGGMLL

SEQ ID NO: 3356547 - protein, 42 aa, Plasmodium falciparum
FKAESLDDCYLHFAVKVLRYFWPNFKYKFGSEEFAVNEYNIM

SEQ ID NO: 3356548 - protein, 23 aa, Plasmodium falciparum
FKAETKKLLQIVAHSLYTDKEVF

SEQ ID NO: 3356549 - protein, 22 aa, Plasmodium falciparum
FKAHSREQLLIKSFRKHQINYI

SEQ ID NO: 3356550 - protein, 17 aa, Plasmodium falciparum
FKCKGYDTIYHQLQTRS

SEQ ID NO: 3356551 - protein, 25 aa, Plasmodium falciparum
FKCKIKDCNKQFCSDFSLKEHVINF

SEQ ID NO: 3356552 - protein, 21 aa, Plasmodium falciparum
FKCLQSLFMQNYLYFKDISYK

SEQ ID NO: 3356553 - protein, 26 aa, Plasmodium falciparum
FKCLVSDKAHAVWRSRGRIERNAIKA

SEQ ID NO: 3356554 - protein, 17 aa, Plasmodium falciparum
FKCPCWLNDNKNIKLNN

SEQ ID NO: 3356555 - protein, 24 aa, Plasmodium falciparum
FKDCKSIRSDQYFYDEMPRNEHVM

SEQ ID NO: 3356556 - protein, 19 aa, Plasmodium falciparum
FKDENWLDEFDKLKRIIKN

SEQ ID NO: 3356557 - protein, 27 aa, Plasmodium falciparum
FKDGKYKILSFGFVELNFVDFSEKFYR

SEQ ID NO: 3356558 - protein, 25 aa, Plasmodium falciparum
FKDIKNYLTKCMNQNFSPISSDHLK

SEQ ID NO: 3356559 - protein, 19 aa, Plasmodium falciparum
FKDKEGNDILLKNNNSSGP

SEQ ID NO: 3356560 - protein, 20 aa, Plasmodium falciparum
FKDNEIEKILQLININYSSE

SEQ ID NO: 3356561 - protein, 17 aa, Plasmodium falciparum
FKDSILYLYNTINDKNF

SEQ ID NO: 3356562 - protein, 17 aa, Plasmodium falciparum
FKDVYSYNIYNENMERI

SEQ ID NO: 3356563 - protein, 20 aa, Plasmodium falciparum
FKEALKAASDLKINYKSNVI

SEQ ID NO: 3356564 - protein, 46 aa, Plasmodium falciparum
FKEDEYELLDSFTCEYFCFSVCVKNEFNTYLEFYKNIVRPDNNDDE

SEQ ID NO: 3356565 - protein, 34 aa, Plasmodium falciparum
FKEDLLYKKMFENVSRKGLIFILTIQDVLIKKTK

SEQ ID NO: 3356566 - protein, 19 aa, Plasmodium falciparum
FKEEKELSELLAYENEIKK

SEQ ID NO: 3356567 - protein, 20 aa, Plasmodium falciparum
FKEFTIRNTNYFLYEESKKS

SEQ ID NO: 3356568 - protein, 22 aa, Plasmodium falciparum
FKEKIITLLKYFFIFLSNKVIQ

SEQ ID NO: 3356569 - protein, 28 aa, Plasmodium falciparum
FKELLDERTLLFKLIIYYKNINYNYKQH

SEQ ID NO: 3356570 - protein, 20 aa, Plasmodium falciparum
FKELTHLSLVLKKGDNTNVI

SEQ ID NO: 3356571 - protein, 21 aa, Plasmodium falciparum
FKENCLLELFTYLSHDVAYTI

SEQ ID NO: 3356572 - protein, 20 aa, Plasmodium falciparum
FKENIISFLVVDKIIQKYTE

SEQ ID NO: 3356573 - protein, 17 aa, Plasmodium falciparum
FKEPIEINVSDIIENEL

SEQ ID NO: 3356574 - protein, 19 aa, Plasmodium falciparum
FKEQLNLLMTRIKETEPHF

SEQ ID NO: 3356575 - protein, 23 aa, Plasmodium falciparum
FKEYPSSSFLSNISYLRNRKEKK

SEQ ID NO: 3356576 - protein, 25 aa, Plasmodium falciparum
FKEYSNKIQNMWLHLTNNYSKYFIP

SEQ ID NO: 3356577 - protein, 21 aa, Plasmodium falciparum
FKFDNPYIYKILCVSKNYSIV

SEQ ID NO: 3356578 - protein, 23 aa, Plasmodium falciparum
FKFKKHVTCRLGYELLNAINNLN

SEQ ID NO: 3356579 - protein, 20 aa, Plasmodium falciparum
FKFMICKVDKDVSYTSICLC

SEQ ID NO: 3356580 - protein, 19 aa, Plasmodium falciparum
FKFPDCSKYNINQLKKYID

SEQ ID NO: 3356581 - protein, 20 aa, Plasmodium falciparum
FKGHKHWVNCLTLNSERLLK

SEQ ID NO: 3356582 - protein, 17 aa, Plasmodium falciparum
FKGKGYILKGVNKEFID

SEQ ID NO: 3356583 - protein, 17 aa, Plasmodium falciparum
FKGNPFNDFNGIVTSNN

SEQ ID NO: 3356584 - protein, 19 aa, Plasmodium falciparum
FKGRHYLNTSAIHFKIVKC

SEQ ID NO: 3356585 - protein, 21 aa, Plasmodium falciparum
FKGVDINNHLLLSYLASSKQI

SEQ ID NO: 3356586 - protein, 17 aa, Plasmodium falciparum
FKHEYLFKNASFEVDMD

SEQ ID NO: 3356587 - protein, 23 aa, Plasmodium falciparum
FKHIYIIGRRGFWQSSFTNSELR

SEQ ID NO: 3356588 - protein, 17 aa, Plasmodium falciparum
FKHSFSNSKLKGVKHNT

SEQ ID NO: 3356589 - protein, 18 aa, Plasmodium falciparum
FKIDISYFTQLHEHKINI

SEQ ID NO: 3356590 - protein, 20 aa, Plasmodium falciparum
FKIDLDFYQVHNSLICIVDE

SEQ ID NO: 3356591 - protein, 19 aa, Plasmodium falciparum
FKIERLLKSSYKKCIYLLF

SEQ ID NO: 3356592 - protein, 18 aa, Plasmodium falciparum
FKIFNYGICNNMDNKLYE

SEQ ID NO: 3356593 - protein, 25 aa, Plasmodium falciparum
FKIFVEYKNKCNLIKNKKIIAHNKI

SEQ ID NO: 3356594 - protein, 24 aa, Plasmodium falciparum
FKIHKWSAVAAWSWDISVDNCAIC

SEQ ID NO: 3356595 - protein, 17 aa, Plasmodium falciparum
FKIKSILVIKDTMRKYQ

SEQ ID NO: 3356596 - protein, 20 aa, Plasmodium falciparum
FKILGIWSKNRSEWFITDLA

SEQ ID NO: 3356597 - protein, 17 aa, Plasmodium falciparum
FKILHHVDYNPKKAIEL

SEQ ID NO: 3356598 - protein, 17 aa, Plasmodium falciparum
FKILQALFNKSKQSTQN

SEQ ID NO: 3356599 - protein, 19 aa, Plasmodium falciparum
FKINLNKFFSSSFINNEAN

SEQ ID NO: 3356600 - protein, 17 aa, Plasmodium falciparum
FKINYSYKTKNHLHEND

SEQ ID NO: 3356601 - protein, 18 aa, Plasmodium falciparum
FKIPDWFLNRRKDLKEGK

SEQ ID NO: 3356602 - protein, 19 aa, Plasmodium falciparum
FKIQCYDTLTGIKIFIVHK

SEQ ID NO: 3356603 - protein, 27 aa, Plasmodium falciparum
FKISEPKFWRCKIHTLAKNKYFDELYN

SEQ ID NO: 3356604 - protein, 20 aa, Plasmodium falciparum
FKISLIHGHQIIPWGDMNAL

SEQ ID NO: 3356605 - protein, 21 aa, Plasmodium falciparum
FKITNVWGGIISKASHFSTQH

SEQ ID NO: 3356606 - protein, 24 aa, Plasmodium falciparum
FKIVKCKLFDIGEGISEVEITKWH

SEQ ID NO: 3356607 - protein, 18 aa, Plasmodium falciparum
FKIYECDDIDELFLELLL

SEQ ID NO: 3356608 - protein, 26 aa, Plasmodium falciparum
FKKDFFLWKPFIIFSDKNIIKKIYPN

SEQ ID NO: 3356609 - protein, 18 aa, Plasmodium falciparum
FKKDLLLDDSQIFGDSLL

SEQ ID NO: 3356610 - protein, 28 aa, Plasmodium falciparum
FKKDNFKKVFHAWCNKGKHEINYDNKKF

SEQ ID NO: 3356611 - protein, 20 aa, Plasmodium falciparum
FKKEKFSTFNQKKERTLNSV

SEQ ID NO: 3356612 - protein, 22 aa, Plasmodium falciparum
FKKELNSLHFGYKKLQNLLMAE

SEQ ID NO: 3356613 - protein, 21 aa, Plasmodium falciparum
FKKFFSKRFIDGEKDPSYYND

SEQ ID NO: 3356614 - protein, 24 aa, Plasmodium falciparum
FKKFSLEREKWYFSDRDKVEEGDN

SEQ ID NO: 3356615 - protein, 20 aa, Plasmodium falciparum
FKKHNCKSFDTFLTYNHYFI

SEQ ID NO: 3356616 - protein, 17 aa, Plasmodium falciparum
FKKIECDNILNIEESIL

SEQ ID NO: 3356617 - protein, 26 aa, Plasmodium falciparum
FKKKENMSPIEYMERQVKSLLNKLTV

SEQ ID NO: 3356618 - protein, 20 aa, Plasmodium falciparum
FKKKMKMIKVLNVKKNKEIK

SEQ ID NO: 3356619 - protein, 22 aa, Plasmodium falciparum
FKKKPVLMKVRLSYVKNNESFQ

SEQ ID NO: 3356620 - protein, 20 aa, Plasmodium falciparum
FKKKSVSIDSCIDKKDNDKI

SEQ ID NO: 3356621 - protein, 21 aa, Plasmodium falciparum
FKKKVLYAIEVLKNILEITKQ

SEQ ID NO: 3356622 - protein, 19 aa, Plasmodium falciparum
FKKLENLYESNIIFEYDGC

SEQ ID NO: 3356623 - protein, 21 aa, Plasmodium falciparum
FKKLITSTINTCYPKIKSNND

SEQ ID NO: 3356624 - protein, 17 aa, Plasmodium falciparum
FKKLKSKIIKKTILNDN

SEQ ID NO: 3356625 - protein, 17 aa, Plasmodium falciparum
FKKLMFHNSDEFEEILL

SEQ ID NO: 3356626 - protein, 21 aa, Plasmodium falciparum
FKKLRGVQHITSMDVHTNESY

SEQ ID NO: 3356627 - protein, 26 aa, Plasmodium falciparum
FKKMELRPSILNEYLSEISILNNTIN

SEQ ID NO: 3356628 - protein, 17 aa, Plasmodium falciparum
FKKNAPFLLLSISHQSG

SEQ ID NO: 3356629 - protein, 21 aa, Plasmodium falciparum
FKKNLPHVTPFYSVKSNNDEV

SEQ ID NO: 3356630 - protein, 20 aa, Plasmodium falciparum
FKKNYSIRQNLQYLCMQQLK

SEQ ID NO: 3356631 - protein, 17 aa, Plasmodium falciparum
FKKQNICEQNRIKIKHY

SEQ ID NO: 3356632 - protein, 22 aa, Plasmodium falciparum
FKKSHILSFKYSRTNFVKLDTN

SEQ ID NO: 3356633 - protein, 19 aa, Plasmodium falciparum
FKKVSKIFIRKSRSELKNE

SEQ ID NO: 3356634 - protein, 25 aa, Plasmodium falciparum
FKKYKNFYLNHFININNIFSTIISF

SEQ ID NO: 3356635 - protein, 19 aa, Plasmodium falciparum
FKKYNILDHFNMNFLERLN

SEQ ID NO: 3356636 - protein, 22 aa, Plasmodium falciparum
FKLFNLLSLSSLSVFDKFVHFN

SEQ ID NO: 3356637 - protein, 19 aa, Plasmodium falciparum
FKLIHKFCIDNYKELHNST

SEQ ID NO: 3356638 - protein, 17 aa, Plasmodium falciparum
FKLKKMIILLKGTNYMD

SEQ ID NO: 3356639 - protein, 21 aa, Plasmodium falciparum
FKLLENIPMPWEQIKNTKVIY

SEQ ID NO: 3356640 - protein, 20 aa, Plasmodium falciparum
FKLLGIYGSNSINWLVADLG

SEQ ID NO: 3356641 - protein, 23 aa, Plasmodium falciparum
FKLNYINETFVFKLLNHYISSLN

SEQ ID NO: 3356642 - protein, 17 aa, Plasmodium falciparum
FKLPIKVESGGVYKESS

SEQ ID NO: 3356643 - protein, 23 aa, Plasmodium falciparum
FKLPREYNGVVPFLAGKTLDYDI

SEQ ID NO: 3356644 - protein, 25 aa, Plasmodium falciparum
FKLRTEQNILKRCYEHFLNNLSDVN

SEQ ID NO: 3356645 - protein, 18 aa, Plasmodium falciparum
FKLSKTFKKFSLEREKWY

SEQ ID NO: 3356646 - protein, 18 aa, Plasmodium falciparum
FKLVCDFNNTLLKVLYIN

SEQ ID NO: 3356647 - protein, 30 aa, Plasmodium falciparum
FKLWTRTEKNFKYLITWWKEKGYWNRQNER

SEQ ID NO: 3356648 - protein, 18 aa, Plasmodium falciparum
FKMISLKYFSYFKKGPKV

SEQ ID NO: 3356649 - protein, 20 aa, Plasmodium falciparum
FKNALSLLIVDDNKGNTNFK

SEQ ID NO: 3356650 - protein, 26 aa, Plasmodium falciparum
FKNDKPRSSQNNIFRLYNRNNNSNYR

SEQ ID NO: 3356651 - protein, 20 aa, Plasmodium falciparum
FKNEIIILINGILRNNKDGK

SEQ ID NO: 3356652 - protein, 19 aa, Plasmodium falciparum
FKNENIFNFKNIIKEDNNT

SEQ ID NO: 3356653 - protein, 19 aa, Plasmodium falciparum
FKNETRGIFQLNDEEAKKL

SEQ ID NO: 3356654 - protein, 19 aa, Plasmodium falciparum
FKNFFYYNNINSFDLTLLC

SEQ ID NO: 3356655 - protein, 25 aa, Plasmodium falciparum
FKNFKRLAPNQRKAALEIIQDDLGI

SEQ ID NO: 3356656 - protein, 17 aa, Plasmodium falciparum
FKNFRPNNRNQFYNNQN

SEQ ID NO: 3356657 - protein, 18 aa, Plasmodium falciparum
FKNGNICGSNSVGKKIAE

SEQ ID NO: 3356658 - protein, 17 aa, Plasmodium falciparum
FKNGRIMLTGTRTKKDS

SEQ ID NO: 3356659 - protein, 23 aa, Plasmodium falciparum
FKNIDPCYLKTNYRSHLLIHDIN

SEQ ID NO: 3356660 - protein, 27 aa, Plasmodium falciparum
FKNILKRYYIDFSDLYPSGLSEANKIN

SEQ ID NO: 3356661 - protein, 20 aa, Plasmodium falciparum
FKNINCYKSSVKIKLNGNDK

SEQ ID NO: 3356662 - protein, 20 aa, Plasmodium falciparum
FKNKIILRILQLVNNYENKL

SEQ ID NO: 3356663 - protein, 22 aa, Plasmodium falciparum
FKNLDIFMNIHLPFEHLSLPLC

SEQ ID NO: 3356664 - protein, 19 aa, Plasmodium falciparum
FKNLGRFSFTTSKKKNNKS

SEQ ID NO: 3356665 - protein, 20 aa, Plasmodium falciparum
FKNMNIKKVNTKNCNITNSK

SEQ ID NO: 3356666 - protein, 23 aa, Plasmodium falciparum
FKNNMYNEGSINFVNTHSINNNI

SEQ ID NO: 3356667 - protein, 24 aa, Plasmodium falciparum
FKNPELLYYEVLFYCLNRLPIQRY

SEQ ID NO: 3356668 - protein, 19 aa, Plasmodium falciparum
FKNSNMNYNSWINNQQGND

SEQ ID NO: 3356669 - protein, 20 aa, Plasmodium falciparum
FKNSYPVTVDSLLNNSDIIK

SEQ ID NO: 3356670 - protein, 26 aa, Plasmodium falciparum
FKNSYYAQEFYPFLNPLLNNKDLIGT

SEQ ID NO: 3356671 - protein, 19 aa, Plasmodium falciparum
FKNTKHILNDYGVINKCVE

SEQ ID NO: 3356672 - protein, 20 aa, Plasmodium falciparum
FKNTNPYNERHIIVDKTNKN

SEQ ID NO: 3356673 - protein, 19 aa, Plasmodium falciparum
FKNVHLFFKDINDIINKNI

SEQ ID NO: 3356674 - protein, 20 aa, Plasmodium falciparum
FKNVLCNDINQYFKDIFKNL

SEQ ID NO: 3356675 - protein, 29 aa, Plasmodium falciparum
FKNYAPIIFKNIRNFYGIKSKEYLTSVGP

SEQ ID NO: 3356676 - protein, 20 aa, Plasmodium falciparum
FKPNLNCYHYFFHLKHIFKI

SEQ ID NO: 3356677 - protein, 23 aa, Plasmodium falciparum
FKPPNFYLICQFSLTSIGFKNSK

SEQ ID NO: 3356678 - protein, 21 aa, Plasmodium falciparum
FKQDLLIYILHFYKNKNINFC

SEQ ID NO: 3356679 - protein, 26 aa, Plasmodium falciparum
FKQFIFRLHIFTSIIIQKYLIQITDM

SEQ ID NO: 3356680 - protein, 19 aa, Plasmodium falciparum
FKQFKHMHNFLPFISEMLN

SEQ ID NO: 3356681 - protein, 28 aa, Plasmodium falciparum
FKQNFRPLFDEYPNGFICTVKNANHFKN

SEQ ID NO: 3356682 - protein, 17 aa, Plasmodium falciparum
FKRALDLGMIYLKPTDI

SEQ ID NO: 3356683 - protein, 17 aa, Plasmodium falciparum
FKRHEYMYNSDGSTKYL

SEQ ID NO: 3356684 - protein, 21 aa, Plasmodium falciparum
FKRKILPIVNIPLMERGYVQL

SEQ ID NO: 3356685 - protein, 19 aa, Plasmodium falciparum
FKRKLLQKYAIYSGSHYFL

SEQ ID NO: 3356686 - protein, 22 aa, Plasmodium falciparum
FKRMQNTCWLKCIPDVHDSFLS

SEQ ID NO: 3356687 - protein, 19 aa, Plasmodium falciparum
FKRSLFSSEEMLPSFFRRI

SEQ ID NO: 3356688 - protein, 17 aa, Plasmodium falciparum
FKRYQVKYRRRREGKTD

SEQ ID NO: 3356689 - protein, 18 aa, Plasmodium falciparum
FKSCPCRIYEKFILSLLL

SEQ ID NO: 3356690 - protein, 20 aa, Plasmodium falciparum
FKSKENVKMLFELLDTNKKG

SEQ ID NO: 3356691 - protein, 21 aa, Plasmodium falciparum
FKSKRKRVHKISEDDGLEYCE

SEQ ID NO: 3356692 - protein, 18 aa, Plasmodium falciparum
FKSLIPIKTFKEVVDEIH

SEQ ID NO: 3356693 - protein, 17 aa, Plasmodium falciparum
FKSLVKKGANIFMKTIC

SEQ ID NO: 3356694 - protein, 18 aa, Plasmodium falciparum
FKSNVIFIKAKQFKKNYV

SEQ ID NO: 3356695 - protein, 18 aa, Plasmodium falciparum
FKSVDFSYTFFIYLLQDE

SEQ ID NO: 3356696 - protein, 29 aa, Plasmodium falciparum
FKTIFRRTFASRIYPNYIIKQLSIKHVKG

SEQ ID NO: 3356697 - protein, 21 aa, Plasmodium falciparum
FKTKSSYVIDEFLIKENKESN

SEQ ID NO: 3356698 - protein, 19 aa, Plasmodium falciparum
FKTSIKLYYNNSGSEEEES

SEQ ID NO: 3356699 - protein, 17 aa, Plasmodium falciparum
FKTTKSFFYFNKSSSLN

SEQ ID NO: 3356700 - protein, 17 aa, Plasmodium falciparum
FKVEKEFNLKVIYGDTD

SEQ ID NO: 3356701 - protein, 17 aa, Plasmodium falciparum
FKVLKQVHPETGVTKKS

SEQ ID NO: 3356702 - protein, 20 aa, Plasmodium falciparum
FKVNNKLILKSKEFKSNNNN

SEQ ID NO: 3356703 - protein, 20 aa, Plasmodium falciparum
FKVTIPFYRSDIMHCCDIIE

SEQ ID NO: 3356704 - protein, 20 aa, Plasmodium falciparum
FKVTYNMILKLLINKQINIE

SEQ ID NO: 3356705 - protein, 34 aa, Plasmodium falciparum
FKYFYDKCFNDICTYHFISLIFQCFYNHGNDDMK

SEQ ID NO: 3356706 - protein, 20 aa, Plasmodium falciparum
FKYIKKTVVNDFNKEYNKIC

SEQ ID NO: 3356707 - protein, 18 aa, Plasmodium falciparum
FKYKILKIHFNCFGSGDL

SEQ ID NO: 3356708 - protein, 19 aa, Plasmodium falciparum
FKYKNTWYELFFYNNQNNK

SEQ ID NO: 3356709 - protein, 21 aa, Plasmodium falciparum
FKYLSYDSIQKEWVVTYDYDN

SEQ ID NO: 3356710 - protein, 21 aa, Plasmodium falciparum
FKYLYPFYFYYIMVFEKQEKD

SEQ ID NO: 3356711 - protein, 17 aa, Plasmodium falciparum
FKYNNNSIFLLSKKEIN

SEQ ID NO: 3356712 - protein, 28 aa, Plasmodium falciparum
FKYTPIKMVTFFIKKIVKNMYENIIKSC

SEQ ID NO: 3356713 - protein, 20 aa, Plasmodium falciparum
FKYYNIHIFHIDKILVTFSQ

SEQ ID NO: 3356714 - protein, 17 aa, Plasmodium falciparum
FLALACSNECNMNFFNV

SEQ ID NO: 3356715 - protein, 19 aa, Plasmodium falciparum
FLCLWKHECERVLIDKLSR

SEQ ID NO: 3356716 - protein, 28 aa, Plasmodium falciparum
FLDAFYHFISIRIYNLFSVSNVFHEYII

SEQ ID NO: 3356717 - protein, 17 aa, Plasmodium falciparum
FLDDILIHIYKHKNLEI

SEQ ID NO: 3356718 - protein, 19 aa, Plasmodium falciparum
FLDYICLHIYSKFKNKYDN

SEQ ID NO: 3356719 - protein, 18 aa, Plasmodium falciparum
FLECCKDNSILLVCGTFF

SEQ ID NO: 3356720 - protein, 18 aa, Plasmodium falciparum
FLEDCIYLLKEERGQTFF

SEQ ID NO: 3356721 - protein, 17 aa, Plasmodium falciparum
FLEDVHENISSILKIKT

SEQ ID NO: 3356722 - protein, 18 aa, Plasmodium falciparum
FLEEFKIIREYHNIKMAK

SEQ ID NO: 3356723 - protein, 23 aa, Plasmodium falciparum
FLEILKEVMVKKNNLSNMDYFKI

SEQ ID NO: 3356724 - protein, 41 aa, Plasmodium falciparum
FLEKDYSNIFPYAYNNLLFYAFDCYKFYRHIKSKFQDTYKI

SEQ ID NO: 3356725 - protein, 19 aa, Plasmodium falciparum
FLFNHNFHVHKKCLQNKNI

SEQ ID NO: 3356726 - protein, 27 aa, Plasmodium falciparum
FLFSSDFCHYGPRFRFTNILQKYSDTF

SEQ ID NO: 3356727 - protein, 17 aa, Plasmodium falciparum
FLFVEINHIKKFTQNDW

SEQ ID NO: 3356728 - protein, 18 aa, Plasmodium falciparum
FLHSKKMALRDISLENIL

SEQ ID NO: 3356729 - protein, 18 aa, Plasmodium falciparum
FLIGTYVFNHLNKKCSIY

SEQ ID NO: 3356730 - protein, 19 aa, Plasmodium falciparum
FLIIDEVDKIVAYTQCNIC

SEQ ID NO: 3356731 - protein, 17 aa, Plasmodium falciparum
FLIKKLLSYSGDISICT

SEQ ID NO: 3356732 - protein, 17 aa, Plasmodium falciparum
FLILKDKYESWTVTNVI

SEQ ID NO: 3356733 - protein, 17 aa, Plasmodium falciparum
FLINLLLACIDDNPFMR

SEQ ID NO: 3356734 - protein, 32 aa, Plasmodium falciparum
FLIQYSLKYKGICKWPNYSNLFVINYNLNENF

SEQ ID NO: 3356735 - protein, 24 aa, Plasmodium falciparum
FLITIKMRNNWDIYKELKNNVGKL

SEQ ID NO: 3356736 - protein, 24 aa, Plasmodium falciparum
FLIYFCFICGYNCLISEIDLNILQ

SEQ ID NO: 3356737 - protein, 17 aa, Plasmodium falciparum
FLKAARCNKRLKIYIIF

SEQ ID NO: 3356738 - protein, 18 aa, Plasmodium falciparum
FLKCCSYDISQMLIGYEF

SEQ ID NO: 3356739 - protein, 28 aa, Plasmodium falciparum
FLKDRPEVKIAEGMCLRNMFKDKYSTNI

SEQ ID NO: 3356740 - protein, 26 aa, Plasmodium falciparum
FLKDYRRLNVAVTRAKRHLVIVGNSN

SEQ ID NO: 3356741 - protein, 23 aa, Plasmodium falciparum
FLKENCKFVMDITDSILILQTIN

SEQ ID NO: 3356742 - protein, 20 aa, Plasmodium falciparum
FLKGCEAYGQIISKCKEKLF

SEQ ID NO: 3356743 - protein, 24 aa, Plasmodium falciparum
FLKIKLYILCLIKLIEKYKLDPHS

SEQ ID NO: 3356744 - protein, 17 aa, Plasmodium falciparum
FLKKIILNYNCNIYNKR

SEQ ID NO: 3356745 - protein, 25 aa, Plasmodium falciparum
FLKKKLRILFHKFLNKKVKNYLNSS

SEQ ID NO: 3356746 - protein, 22 aa, Plasmodium falciparum
FLKKSKVGNALNATKNMLETLK

SEQ ID NO: 3356747 - protein, 23 aa, Plasmodium falciparum
FLKKVCKNKYLGLILLSVLVHRK

SEQ ID NO: 3356748 - protein, 35 aa, Plasmodium falciparum
FLKKYKDTYNIFKEKKLPLCNNIDELFHNNYNNDK

SEQ ID NO: 3356749 - protein, 30 aa, Plasmodium falciparum
FLKNDEHTNCRICLYGEIIEIIDNNCTYKK

SEQ ID NO: 3356750 - protein, 20 aa, Plasmodium falciparum
FLKNEYTYNNVLSKEDKENI

SEQ ID NO: 3356751 - protein, 27 aa, Plasmodium falciparum
FLKNFKKADEIYTFLQHSVEDKKKLNH

SEQ ID NO: 3356752 - protein, 28 aa, Plasmodium falciparum
FLKNFLHKILPYFFKELQFIESYISLIT

SEQ ID NO: 3356753 - protein, 29 aa, Plasmodium falciparum
FLKNLDLYCILKFIITNNIEIYNEESYNV

SEQ ID NO: 3356754 - protein, 35 aa, Plasmodium falciparum
FLKQGLKNECIPLFQRLQQNLFFLVMLANQPEDNL

SEQ ID NO: 3356755 - protein, 23 aa, Plasmodium falciparum
FLKTKKLLFAIHKWENNQYLFHY

SEQ ID NO: 3356756 - protein, 25 aa, Plasmodium falciparum
FLKTQPRNSLSIDNSKRMSFNRNSY

SEQ ID NO: 3356757 - protein, 26 aa, Plasmodium falciparum
FLKVLCSKRGVLPIIGILYIILNGNL

SEQ ID NO: 3356758 - protein, 28 aa, Plasmodium falciparum
FLKYYNLLKDWDWCYGKTPKFQNHIWKQ

SEQ ID NO: 3356759 - protein, 28 aa, Plasmodium falciparum
FLLDGELYLGYDISVFILLVKAEHFEYC

SEQ ID NO: 3356760 - protein, 20 aa, Plasmodium falciparum
FLLFYDKINLSIDIVKTKLI

SEQ ID NO: 3356761 - protein, 17 aa, Plasmodium falciparum
FLLNLLILEKKNLNTYF

SEQ ID NO: 3356762 - protein, 28 aa, Plasmodium falciparum
FLLPKIFSSCVDFEKWFVKSLHNEKDVY

SEQ ID NO: 3356763 - protein, 18 aa, Plasmodium falciparum
FLLTNIIYKLSYLNVNYL

SEQ ID NO: 3356764 - protein, 18 aa, Plasmodium falciparum
FLMHFNIFNFYYLNKIYK

SEQ ID NO: 3356765 - protein, 23 aa, Plasmodium falciparum
FLMRKYLCNYHMNRSNKNCFNHY

SEQ ID NO: 3356766 - protein, 25 aa, Plasmodium falciparum
FLNAHIPLFLYPFLNAESKNRPFEY

SEQ ID NO: 3356767 - protein, 19 aa, Plasmodium falciparum
FLNCIGGRSRKDFSQYPIY

SEQ ID NO: 3356768 - protein, 17 aa, Plasmodium falciparum
FLNEKRIKVDKNILKKD

SEQ ID NO: 3356769 - protein, 21 aa, Plasmodium falciparum
FLNELPFQYGCSDSIEYNIVD

SEQ ID NO: 3356770 - protein, 28 aa, Plasmodium falciparum
FLNENISYFSLFSFGEKYAIIKYNNENI

SEQ ID NO: 3356771 - protein, 20 aa, Plasmodium falciparum
FLNERIVDIVLFPHNLKFGV

SEQ ID NO: 3356772 - protein, 21 aa, Plasmodium falciparum
FLNIKKFLYDLSINKITNIYK

SEQ ID NO: 3356773 - protein, 17 aa, Plasmodium falciparum
FLNLNKFNDALSCLSKL

SEQ ID NO: 3356774 - protein, 18 aa, Plasmodium falciparum
FLNNLKILYKKLDNKKKI

SEQ ID NO: 3356775 - protein, 25 aa, Plasmodium falciparum
FLNNYHCQCFKKFFNNTYINTSKII

SEQ ID NO: 3356776 - protein, 20 aa, Plasmodium falciparum
FLNRAKANYKRVQMKKKTSI

SEQ ID NO: 3356777 - protein, 18 aa, Plasmodium falciparum
FLNSELFFEWYLKKLNIS

SEQ ID NO: 3356778 - protein, 18 aa, Plasmodium falciparum
FLNSLELNDLINIEKKFI

SEQ ID NO: 3356779 - protein, 28 aa, Plasmodium falciparum
FLNSSKFFGVIFCRNIHIQLSLRKKKKK

SEQ ID NO: 3356780 - protein, 17 aa, Plasmodium falciparum
FLNTLFKYMNAKRNYIH

SEQ ID NO: 3356781 - protein, 19 aa, Plasmodium falciparum
FLPDVLLMIFAFCINSEIN

SEQ ID NO: 3356782 - protein, 19 aa, Plasmodium falciparum
FLPDYFKKTSHIYCKNYIH

SEQ ID NO: 3356783 - protein, 18 aa, Plasmodium falciparum
FLQFNQAYNTFNIPYAIY

SEQ ID NO: 3356784 - protein, 19 aa, Plasmodium falciparum
FLQKALIFIYIEYHTDHND

SEQ ID NO: 3356785 - protein, 18 aa, Plasmodium falciparum
FLQLHGKLKQTSRLNTYH

SEQ ID NO: 3356786 - protein, 23 aa, Plasmodium falciparum
FLQNMSYPFSYENLSPLIELDIN

SEQ ID NO: 3356787 - protein, 18 aa, Plasmodium falciparum
FLSCNVVLGYKEDAYIFS

SEQ ID NO: 3356788 - protein, 20 aa, Plasmodium falciparum
FLSDIYKLHIGGVTGMMICN

SEQ ID NO: 3356789 - protein, 18 aa, Plasmodium falciparum
FLSHFKKNFILQNNEEKY

SEQ ID NO: 3356790 - protein, 24 aa, Plasmodium falciparum
FLSRNEYRVLTAIEMGMRNHEYLS

SEQ ID NO: 3356791 - protein, 30 aa, Plasmodium falciparum
FLSYKFKPRVMKIIFTKWLLFEKSQGNMHS

SEQ ID NO: 3356792 - protein, 18 aa, Plasmodium falciparum
FLTCSYIAERIMNNNHSN

SEQ ID NO: 3356793 - protein, 25 aa, Plasmodium falciparum
FLTFSIKNINTFIGAEKCIKENMLL

SEQ ID NO: 3356794 - protein, 24 aa, Plasmodium falciparum
FLVEKLCPIHENINNNFLLKDKNK

SEQ ID NO: 3356795 - protein, 19 aa, Plasmodium falciparum
FLVHYGISCQSFITPFIPS

SEQ ID NO: 3356796 - protein, 24 aa, Plasmodium falciparum
FLVIKKYTAKYEVQIDPFNGFDIA

SEQ ID NO: 3356797 - protein, 21 aa, Plasmodium falciparum
FLYCNTFEFPKWIQPQYIRDI

SEQ ID NO: 3356798 - protein, 17 aa, Plasmodium falciparum
FLYDLSINKITNIYKIF

SEQ ID NO: 3356799 - protein, 17 aa, Plasmodium falciparum
FLYGLNCNFDCASIGEI

SEQ ID NO: 3356800 - protein, 21 aa, Plasmodium falciparum
FLYIKNLFYLQEEYNKETVEN

SEQ ID NO: 3356801 - protein, 20 aa, Plasmodium falciparum
FLYKEYKIVVRVNQKAYNGI

SEQ ID NO: 3356802 - protein, 25 aa, Plasmodium falciparum
FLYKLSISEVEAWGCGDEKALQEQK

SEQ ID NO: 3356803 - protein, 18 aa, Plasmodium falciparum
FLYNEFYFTPCGYSCNVS

SEQ ID NO: 3356804 - protein, 17 aa, Plasmodium falciparum
FLYNKNILLKWLNNFMI

SEQ ID NO: 3356805 - protein, 17 aa, Plasmodium falciparum
FLYNNMNILQNFKYDMK

SEQ ID NO: 3356806 - protein, 19 aa, Plasmodium falciparum
FLYNPKLFSFTLLPHRLDK

SEQ ID NO: 3356807 - protein, 26 aa, Plasmodium falciparum
FMAAKCLRPQLATVIIQYEENKKKQI

SEQ ID NO: 3356808 - protein, 22 aa, Plasmodium falciparum
FMDYYHLVMAYTYFKQNKHEDK

SEQ ID NO: 3356809 - protein, 27 aa, Plasmodium falciparum
FMELLKRKKKVPIICHEYIKSYSKYIL

SEQ ID NO: 3356810 - protein, 20 aa, Plasmodium falciparum
FMFSTICFNECIAHLTNEQK

SEQ ID NO: 3356811 - protein, 29 aa, Plasmodium falciparum
FMKELSLTFPHIFYEPRLDNSIEYLLNNS

SEQ ID NO: 3356812 - protein, 23 aa, Plasmodium falciparum
FMKGKKESIHFGDDEENDDKNGD

SEQ ID NO: 3356813 - protein, 23 aa, Plasmodium falciparum
FMKISDFDIHLSIKHLISQGDNK

SEQ ID NO: 3356814 - protein, 22 aa, Plasmodium falciparum
FMKQRRCDYFSLLNNFINLLIS

SEQ ID NO: 3356815 - protein, 40 aa, Plasmodium falciparum
FMKVNELYHYMYALGVFEYAVKISLEFGSNIRMSTISSKI

SEQ ID NO: 3356816 - protein, 24 aa, Plasmodium falciparum
FMLKKFDRRFLRVFANTSKLSEFL

SEQ ID NO: 3356817 - protein, 18 aa, Plasmodium falciparum
FMMPPNLGLGNRTQLKKD

SEQ ID NO: 3356818 - protein, 18 aa, Plasmodium falciparum
FMNLRFLIIDEVDKIVAY

SEQ ID NO: 3356819 - protein, 18 aa, Plasmodium falciparum
FMSDEEIVIFDLFINNEC

SEQ ID NO: 3356820 - protein, 24 aa, Plasmodium falciparum
FMSISTKDTCCFISKNDGESSGDE

SEQ ID NO: 3356821 - protein, 24 aa, Plasmodium falciparum
FMTKKECFNLILNCVKYAMHNDNS

SEQ ID NO: 3356822 - protein, 26 aa, Plasmodium falciparum
FMVLKKVGGKLLFFLSSVPNIGDLTV

SEQ ID NO: 3356823 - protein, 24 aa, Plasmodium falciparum
FMYKEYRYKCKIYYETIRNNDDLQ

SEQ ID NO: 3356824 - protein, 23 aa, Plasmodium falciparum
FNAFKLVYDCISYYINNYDNQNH

SEQ ID NO: 3356825 - protein, 23 aa, Plasmodium falciparum
FNCEVCKALFNIDIFRNFNIFEL

SEQ ID NO: 3356826 - protein, 25 aa, Plasmodium falciparum
FNCLRRHLCSLISSFLNFNNSSMRK

SEQ ID NO: 3356827 - protein, 17 aa, Plasmodium falciparum
FNDAVLCTKNKTYNILM

SEQ ID NO: 3356828 - protein, 17 aa, Plasmodium falciparum
FNDCAILKKCIKNGILK

SEQ ID NO: 3356829 - protein, 22 aa, Plasmodium falciparum
FNDCLKSYVFKGNKEISAQDLQ

SEQ ID NO: 3356830 - protein, 27 aa, Plasmodium falciparum
FNDFILLNDCNLCYRNFVTQKANKKNI

SEQ ID NO: 3356831 - protein, 19 aa, Plasmodium falciparum
FNDIRNGPMDGVSFDDDKY

SEQ ID NO: 3356832 - protein, 26 aa, Plasmodium falciparum
FNDKFYLRYIYKWPHMNIITKEIDDH

SEQ ID NO: 3356833 - protein, 25 aa, Plasmodium falciparum
FNDLLHYFHLFYSCFFSFDHFLQKK

SEQ ID NO: 3356834 - protein, 20 aa, Plasmodium falciparum
FNDSKCWELDTLRGHFNNVS

SEQ ID NO: 3356835 - protein, 21 aa, Plasmodium falciparum
FNDVYPIDFFDYFIHLDEKEE

SEQ ID NO: 3356836 - protein, 24 aa, Plasmodium falciparum
FNEETCTIWDLVMKNKKKKVKKKR

SEQ ID NO: 3356837 - protein, 27 aa, Plasmodium falciparum
FNEGSAVLIGSFSDHVHIHMDENEILR

SEQ ID NO: 3356838 - protein, 21 aa, Plasmodium falciparum
FNEKMEILNNIILKDLNVLED

SEQ ID NO: 3356839 - protein, 24 aa, Plasmodium falciparum
FNELKYDFEKNLHKNNIHQIYFMK

SEQ ID NO: 3356840 - protein, 18 aa, Plasmodium falciparum
FNESVVLYFYLKEKSKLT

SEQ ID NO: 3356841 - protein, 27 aa, Plasmodium falciparum
FNEVFEVEKIIMARYKLNCKRKKNRKD

SEQ ID NO: 3356842 - protein, 22 aa, Plasmodium falciparum
FNEYIGILVCHDYKKGNVVLHI

SEQ ID NO: 3356843 - protein, 24 aa, Plasmodium falciparum
FNFKNVIKYFGLLKLYNYHFYVNN

SEQ ID NO: 3356844 - protein, 20 aa, Plasmodium falciparum
FNFLFEIITGKNIYYQINDI

SEQ ID NO: 3356845 - protein, 20 aa, Plasmodium falciparum
FNFLTEFHFLYGSEYFICKH

SEQ ID NO: 3356846 - protein, 26 aa, Plasmodium falciparum
FNFPSSCRIVPCKTHILGFTQKAYCN

SEQ ID NO: 3356847 - protein, 19 aa, Plasmodium falciparum
FNFSCSFTKSSRWNICMNR

SEQ ID NO: 3356848 - protein, 18 aa, Plasmodium falciparum
FNFYELINVINYIYEHIQ

SEQ ID NO: 3356849 - protein, 25 aa, Plasmodium falciparum
FNGIFNWIVSKGMNKIPCREIENIN

SEQ ID NO: 3356850 - protein, 20 aa, Plasmodium falciparum
FNGIIPDHVQKIIERREYFK

SEQ ID NO: 3356851 - protein, 18 aa, Plasmodium falciparum
FNGINCLFWNPIYLNSHK

SEQ ID NO: 3356852 - protein, 24 aa, Plasmodium falciparum
FNGNKRISYELSNLESIKKINKND

SEQ ID NO: 3356853 - protein, 19 aa, Plasmodium falciparum
FNGTVNHGKMPPVQNGNAI

SEQ ID NO: 3356854 - protein, 18 aa, Plasmodium falciparum
FNHIYNMQNFNHFIPNIS

SEQ ID NO: 3356855 - protein, 17 aa, Plasmodium falciparum
FNHLAEKLSLCFVCKNA

SEQ ID NO: 3356856 - protein, 21 aa, Plasmodium falciparum
FNHLYNFLIGTYVFNHLNKKC

SEQ ID NO: 3356857 - protein, 34 aa, Plasmodium falciparum
FNHPYIPDFIKLICLREKNVLRRKEIIFWYDEDI

SEQ ID NO: 3356858 - protein, 17 aa, Plasmodium falciparum
FNHTCDIVSNPYNNNNN

SEQ ID NO: 3356859 - protein, 25 aa, Plasmodium falciparum
FNHVNFNPLITFSFNLYELKKEHDF

SEQ ID NO: 3356860 - protein, 17 aa, Plasmodium falciparum
FNHWELRGIPIRIEVGP

SEQ ID NO: 3356861 - protein, 30 aa, Plasmodium falciparum
FNIATCGADEFVHLWRIFIKDDISIKCLGR

SEQ ID NO: 3356862 - protein, 22 aa, Plasmodium falciparum
FNICILPYMFGEISVQSLNTIL

SEQ ID NO: 3356863 - protein, 17 aa, Plasmodium falciparum
FNIFKQVDNSNFLEILK

SEQ ID NO: 3356864 - protein, 29 aa, Plasmodium falciparum
FNIFLNKQICIFSSSFGLCHLISLLKIFT

SEQ ID NO: 3356865 - protein, 27 aa, Plasmodium falciparum
FNIGKSIHCKKLIYISGDKRYIRKRNN

SEQ ID NO: 3356866 - protein, 20 aa, Plasmodium falciparum
FNIHSCSELNQAKKIMLPLL

SEQ ID NO: 3356867 - protein, 26 aa, Plasmodium falciparum
FNIIELLSASGMRSIRYAKELEDTIN

SEQ ID NO: 3356868 - protein, 17 aa, Plasmodium falciparum
FNIKHVMTSKDCMYEKF

SEQ ID NO: 3356869 - protein, 17 aa, Plasmodium falciparum
FNIMGVYMDSVFQPNVL

SEQ ID NO: 3356870 - protein, 17 aa, Plasmodium falciparum
FNISELIINDQVKTKLN

SEQ ID NO: 3356871 - protein, 18 aa, Plasmodium falciparum
FNKAMKIIPEGSSCNVMN

SEQ ID NO: 3356872 - protein, 17 aa, Plasmodium falciparum
FNKCTEGLIVITWDKFV

SEQ ID NO: 3356873 - protein, 20 aa, Plasmodium falciparum
FNKEEEGFHYFNLLKKYDIR

SEQ ID NO: 3356874 - protein, 20 aa, Plasmodium falciparum
FNKILEGLREKELVNCERQI

SEQ ID NO: 3356875 - protein, 19 aa, Plasmodium falciparum
FNKKMHILDIFKYHDFPMN

SEQ ID NO: 3356876 - protein, 31 aa, Plasmodium falciparum
FNKLGGMVLRDLFTLECEFLVDWGDNLLIQA

SEQ ID NO: 3356877 - protein, 25 aa, Plasmodium falciparum
FNKMLSYPCFYFLGTGCSMPSTFRN

SEQ ID NO: 3356878 - protein, 25 aa, Plasmodium falciparum
FNKNKEIYNAIDIFSSVNDINLPSI

SEQ ID NO: 3356879 - protein, 26 aa, Plasmodium falciparum
FNKQICESVFHCIKLIEVLQLEELKD

SEQ ID NO: 3356880 - protein, 23 aa, Plasmodium falciparum
FNKRIILCNSISKKIQIAIFDIL

SEQ ID NO: 3356881 - protein, 22 aa, Plasmodium falciparum
FNKSICFFLRRDLYLKKKNCTK

SEQ ID NO: 3356882 - protein, 25 aa, Plasmodium falciparum
FNKYDLYEFVSLCLNIHKDKISTQL

SEQ ID NO: 3356883 - protein, 17 aa, Plasmodium falciparum
FNKYKQQELCVNKNEEN

SEQ ID NO: 3356884 - protein, 25 aa, Plasmodium falciparum
FNKYWKRYLFFCTNIPGNKSAWTKE

SEQ ID NO: 3356885 - protein, 23 aa, Plasmodium falciparum
FNLEKSGFVKNEMSLLDMKNNKG

SEQ ID NO: 3356886 - protein, 22 aa, Plasmodium falciparum
FNLESFKMYLINIIENEALECA

SEQ ID NO: 3356887 - protein, 23 aa, Plasmodium falciparum
FNLKEYLRMQTVRFKKKETNESL

SEQ ID NO: 3356888 - protein, 23 aa, Plasmodium falciparum
FNLKNFRIGLVSVEKLRNFKINK

SEQ ID NO: 3356889 - protein, 19 aa, Plasmodium falciparum
FNLLLKKRIKQMNKQTENT

SEQ ID NO: 3356890 - protein, 17 aa, Plasmodium falciparum
FNLPLLVERRDKYIQRL

SEQ ID NO: 3356891 - protein, 26 aa, Plasmodium falciparum
FNLRLMECYSTWIFYDMNFQKNQFFS

SEQ ID NO: 3356892 - protein, 22 aa, Plasmodium falciparum
FNLSDSIYFIYLISTRAGGLGI

SEQ ID NO: 3356893 - protein, 22 aa, Plasmodium falciparum
FNLSKLRIKYLRIIENYKTSNT

SEQ ID NO: 3356894 - protein, 19 aa, Plasmodium falciparum
FNMEILFLYNFLKNKFSEK

SEQ ID NO: 3356895 - protein, 35 aa, Plasmodium falciparum
FNMERCLDDFIFICFFCGNDFLPHLPSISIAGGSI

SEQ ID NO: 3356896 - protein, 17 aa, Plasmodium falciparum
FNNAFSLFGNKTETKNN

SEQ ID NO: 3356897 - protein, 26 aa, Plasmodium falciparum
FNNDKIRGAFFFKVKLENSLKGQIKT

SEQ ID NO: 3356898 - protein, 17 aa, Plasmodium falciparum
FNNEEFIYLKVIESSIY

SEQ ID NO: 3356899 - protein, 26 aa, Plasmodium falciparum
FNNGVKTFKYMKGIFEDSGGAENEII

SEQ ID NO: 3356900 - protein, 21 aa, Plasmodium falciparum
FNNHLRIKVSVKNPNEESTIR

SEQ ID NO: 3356901 - protein, 22 aa, Plasmodium falciparum
FNNIELLYSYYLIVQNEALDND

SEQ ID NO: 3356902 - protein, 18 aa, Plasmodium falciparum
FNNIESISNYLNNYKNNF

SEQ ID NO: 3356903 - protein, 23 aa, Plasmodium falciparum
FNNISCILYNFLVNRNSVKKYKD

SEQ ID NO: 3356904 - protein, 19 aa, Plasmodium falciparum
FNNITKYCCNRNICDSFFI

SEQ ID NO: 3356905 - protein, 17 aa, Plasmodium falciparum
FNNLTSYVRRNSKHKTS

SEQ ID NO: 3356906 - protein, 25 aa, Plasmodium falciparum
FNNMSDFYYIPSFYNRYDYNTNYIH

SEQ ID NO: 3356907 - protein, 23 aa, Plasmodium falciparum
FNNNNFVDGWWFRRNQEIDQIPK

SEQ ID NO: 3356908 - protein, 25 aa, Plasmodium falciparum
FNNPPEWRDILSFFRGNELQIFFTK

SEQ ID NO: 3356909 - protein, 17 aa, Plasmodium falciparum
FNNRGQNGISITKNYEP

SEQ ID NO: 3356910 - protein, 20 aa, Plasmodium falciparum
FNNRKEFTIRDYMPSNLHDR

SEQ ID NO: 3356911 - protein, 17 aa, Plasmodium falciparum
FNNRTMYRVDFMNNKNE

SEQ ID NO: 3356912 - protein, 28 aa, Plasmodium falciparum
FNNRWKCPICSFYLRPKNLVIDTFITYI

SEQ ID NO: 3356913 - protein, 21 aa, Plasmodium falciparum
FNNSAGLLLDFDLCKRKVLEI

SEQ ID NO: 3356914 - protein, 24 aa, Plasmodium falciparum
FNNSKLRPGMFIQNSNVVFNEQYK

SEQ ID NO: 3356915 - protein, 17 aa, Plasmodium falciparum
FNNSVLISNNKYILSDL

SEQ ID NO: 3356916 - protein, 22 aa, Plasmodium falciparum
FNNTRWLPGHKVRLQQTFNDIT

SEQ ID NO: 3356917 - protein, 17 aa, Plasmodium falciparum
FNNVWIYIHLKNELIDI

SEQ ID NO: 3356918 - protein, 25 aa, Plasmodium falciparum
FNNVYRLLYIWMKLIEIKDTTNEAT

SEQ ID NO: 3356919 - protein, 26 aa, Plasmodium falciparum
FNNYELRLHFILPNFAFAIPMSLYLK

SEQ ID NO: 3356920 - protein, 18 aa, Plasmodium falciparum
FNNYISSFILNINKNLND

SEQ ID NO: 3356921 - protein, 17 aa, Plasmodium falciparum
FNPKISQKSLTSSTLIM

SEQ ID NO: 3356922 - protein, 18 aa, Plasmodium falciparum
FNPKKQQWLAAWNDNTRE

SEQ ID NO: 3356923 - protein, 17 aa, Plasmodium falciparum
FNPNMLGMENNVSQEPA

SEQ ID NO: 3356924 - protein, 23 aa, Plasmodium falciparum
FNPRIPQSLMRISLTFMFEPPVG

SEQ ID NO: 3356925 - protein, 19 aa, Plasmodium falciparum
FNPSGLLAQEKIYKNGIEM

SEQ ID NO: 3356926 - protein, 17 aa, Plasmodium falciparum
FNQMKSINLCINICTNY

SEQ ID NO: 3356927 - protein, 21 aa, Plasmodium falciparum
FNQNNLISWRHQQAAQQQAVH

SEQ ID NO: 3356928 - protein, 24 aa, Plasmodium falciparum
FNRDSCLYTNNFINMLIQNERHGN

SEQ ID NO: 3356929 - protein, 22 aa, Plasmodium falciparum
FNRPKISPFRGRGMKSALGVRG

SEQ ID NO: 3356930 - protein, 23 aa, Plasmodium falciparum
FNSDLWFSYFQYLLLNKKFVYAI

SEQ ID NO: 3356931 - protein, 30 aa, Plasmodium falciparum
FNSIADKGLHIFVIPVLRHILEERGYEEMI

SEQ ID NO: 3356932 - protein, 25 aa, Plasmodium falciparum
FNSKISDWLEQLFVFNKNLINNGLQ

SEQ ID NO: 3356933 - protein, 17 aa, Plasmodium falciparum
FNSKSRYLVDERKNEYT

SEQ ID NO: 3356934 - protein, 23 aa, Plasmodium falciparum
FNSNSIYKCVRKNMNEDNLFLYN

SEQ ID NO: 3356935 - protein, 24 aa, Plasmodium falciparum
FNSPCKISSLFLIGGEEGTYPRKI

SEQ ID NO: 3356936 - protein, 21 aa, Plasmodium falciparum
FNSSCSDNLCPTKKDSKAKII

SEQ ID NO: 3356937 - protein, 23 aa, Plasmodium falciparum
FNSSLLYRENYIFKKEHELNYCY

SEQ ID NO: 3356938 - protein, 19 aa, Plasmodium falciparum
FNSSSRFNNITHFNNGISH

SEQ ID NO: 3356939 - protein, 17 aa, Plasmodium falciparum
FNSVTSRGFHKVGQDNT

SEQ ID NO: 3356940 - protein, 26 aa, Plasmodium falciparum
FNTCEIGIILKCFLKINIHDIEIINT

SEQ ID NO: 3356941 - protein, 17 aa, Plasmodium falciparum
FNTTLGYVQNVKLLNKM

SEQ ID NO: 3356942 - protein, 19 aa, Plasmodium falciparum
FNTVGHVSSIRVCRDSVTR

SEQ ID NO: 3356943 - protein, 23 aa, Plasmodium falciparum
FNVKEYVDGIIVVEEKEVKAMKG

SEQ ID NO: 3356944 - protein, 40 aa, Plasmodium falciparum
FNVNMVHDMPARLNLRKIIYKYLILELFTNAQSCNFLTCI

SEQ ID NO: 3356945 - protein, 17 aa, Plasmodium falciparum
FNVNTFDGVSYCAIPTM

SEQ ID NO: 3356946 - protein, 18 aa, Plasmodium falciparum
FNVPLLYSQIKCLIDTRW

SEQ ID NO: 3356947 - protein, 20 aa, Plasmodium falciparum
FNWKAAYYICKEIYDKQQIN

SEQ ID NO: 3356948 - protein, 39 aa, Plasmodium falciparum
FNYDECLRALTEMNGYIFKGCKIKVSKSNGIKMNPSNIN

SEQ ID NO: 3356949 - protein, 19 aa, Plasmodium falciparum
FNYDFLYKEYKIVVRVNQK

SEQ ID NO: 3356950 - protein, 19 aa, Plasmodium falciparum
FPADIWSLGIILYELISLK

SEQ ID NO: 3356951 - protein, 21 aa, Plasmodium falciparum
FPDAYLNNYHVGIINNMNNMN

SEQ ID NO: 3356952 - protein, 21 aa, Plasmodium falciparum
FPDFLVEKLTKLSFLCLNPNI

SEQ ID NO: 3356953 - protein, 25 aa, Plasmodium falciparum
FPDIGCCYFFRKYFGRNIGLHLGLT

SEQ ID NO: 3356954 - protein, 20 aa, Plasmodium falciparum
FPEDITLCIGDFKISLIHGH

SEQ ID NO: 3356955 - protein, 17 aa, Plasmodium falciparum
FPEFFVAIESYFKKYYA

SEQ ID NO: 3356956 - protein, 21 aa, Plasmodium falciparum
FPEHSNIDILRFQHLDNNLNY

SEQ ID NO: 3356957 - protein, 25 aa, Plasmodium falciparum
FPFNYYYYNMNNLYFNNSNYNNGPN

SEQ ID NO: 3356958 - protein, 20 aa, Plasmodium falciparum
FPFSIPYSIEKCLKKINKSF

SEQ ID NO: 3356959 - protein, 17 aa, Plasmodium falciparum
FPFTIQIIDPSGLSSLE

SEQ ID NO: 3356960 - protein, 30 aa, Plasmodium falciparum
FPGIGLKVANCICLFGLNKYDCIPIDTHIY

SEQ ID NO: 3356961 - protein, 27 aa, Plasmodium falciparum
FPGKHLFESDFLRKCFHILMEKRLNNN

SEQ ID NO: 3356962 - protein, 19 aa, Plasmodium falciparum
FPGSISNWELYEYTHDEIF

SEQ ID NO: 3356963 - protein, 20 aa, Plasmodium falciparum
FPIILECSFSDKSKKNHKLK

SEQ ID NO: 3356964 - protein, 29 aa, Plasmodium falciparum
FPKESFNRIVEMFTKEIINLSICQCPGVI

SEQ ID NO: 3356965 - protein, 21 aa, Plasmodium falciparum
FPKKASPALKRIKEENYKNKK

SEQ ID NO: 3356966 - protein, 17 aa, Plasmodium falciparum
FPKKVCIESISCGKDHT

SEQ ID NO: 3356967 - protein, 19 aa, Plasmodium falciparum
FPKNMSLSFLQKIDFSNSY

SEQ ID NO: 3356968 - protein, 20 aa, Plasmodium falciparum
FPKNPRAFTNLVEYSFSNEQ

SEQ ID NO: 3356969 - protein, 20 aa, Plasmodium falciparum
FPKQMLCIIEGLDRIKEVYE

SEQ ID NO: 3356970 - protein, 18 aa, Plasmodium falciparum
FPKSSYKILLQAIGKNIK

SEQ ID NO: 3356971 - protein, 24 aa, Plasmodium falciparum
FPLFKRTKSSILLKRNNNEQEKIK

SEQ ID NO: 3356972 - protein, 18 aa, Plasmodium falciparum
FPLFTVLHKISFENEDPS

SEQ ID NO: 3356973 - protein, 19 aa, Plasmodium falciparum
FPLKGVINGLDFKPPNDKV

SEQ ID NO: 3356974 - protein, 19 aa, Plasmodium falciparum
FPLKKAIEYVKKYKPITLN

SEQ ID NO: 3356975 - protein, 27 aa, Plasmodium falciparum
FPLSLINKLIHKFSLKINKKVPKYKLE

SEQ ID NO: 3356976 - protein, 20 aa, Plasmodium falciparum
FPNASYCFIDDKNICLLAMR

SEQ ID NO: 3356977 - protein, 26 aa, Plasmodium falciparum
FPNCLNEEIFEAVIVFKDYKNKQIST

SEQ ID NO: 3356978 - protein, 17 aa, Plasmodium falciparum
FPNEKKKYMSIKKKRSE

SEQ ID NO: 3356979 - protein, 25 aa, Plasmodium falciparum
FPNFVLCNPSFIFSNPSFYHKDNSL

SEQ ID NO: 3356980 - protein, 23 aa, Plasmodium falciparum
FPNIRSHKSCNVNAYYKDHNDYR

SEQ ID NO: 3356981 - protein, 23 aa, Plasmodium falciparum
FPNVKFTAYRAGHVIGACMFLVE

SEQ ID NO: 3356982 - protein, 22 aa, Plasmodium falciparum
FPNYIDSHFLFLKRELLKIDLD

SEQ ID NO: 3356983 - protein, 21 aa, Plasmodium falciparum
FPPCEEFINSINLNYAKRFFP

SEQ ID NO: 3356984 - protein, 29 aa, Plasmodium falciparum
FPQAKEMTCKFLLRCIYDDVLYPAFLSDI

SEQ ID NO: 3356985 - protein, 17 aa, Plasmodium falciparum
FPRNTCHARRNLRRNIM

SEQ ID NO: 3356986 - protein, 17 aa, Plasmodium falciparum
FPSDIKIMSSYFQNISH

SEQ ID NO: 3356987 - protein, 18 aa, Plasmodium falciparum
FPSIRIAKTPQMFQRNLY

SEQ ID NO: 3356988 - protein, 18 aa, Plasmodium falciparum
FPSLIYFNKLFKKNYPYK

SEQ ID NO: 3356989 - protein, 17 aa, Plasmodium falciparum
FPSLLYTNINNFFIEPN

SEQ ID NO: 3356990 - protein, 21 aa, Plasmodium falciparum
FPSNFTFEIKNNIYLQNGNKM

SEQ ID NO: 3356991 - protein, 32 aa, Plasmodium falciparum
FPSWIPKRSINNFFIKRIIEIDKDLIGIQKKT

SEQ ID NO: 3356992 - protein, 24 aa, Plasmodium falciparum
FPTCLCVEFFFHLFKNIFNTKKIN

SEQ ID NO: 3356993 - protein, 19 aa, Plasmodium falciparum
FPVIRHVLHQEPLRNNDGP

SEQ ID NO: 3356994 - protein, 35 aa, Plasmodium falciparum
FPVIYRHLHRSVRRRLCLDFTLCTLIKDITVANIL

SEQ ID NO: 3356995 - protein, 18 aa, Plasmodium falciparum
FPVQSMVIPIFLSGRDHI

SEQ ID NO: 3356996 - protein, 20 aa, Plasmodium falciparum
FPWHTFCIHKSGSFLEKNRL

SEQ ID NO: 3356997 - protein, 21 aa, Plasmodium falciparum
FPYERHLIDLISYEDVLYPSN

SEQ ID NO: 3356998 - protein, 19 aa, Plasmodium falciparum
FPYKDLKDRCISKCYKNLP

SEQ ID NO: 3356999 - protein, 27 aa, Plasmodium falciparum
FPYKEYNADILITWNVPKDNFNIHPEL

SEQ ID NO: 3357000 - protein, 18 aa, Plasmodium falciparum
FPYMCTPPPMYNQYYMYN

SEQ ID NO: 3357001 - protein, 17 aa, Plasmodium falciparum
FQAAYLYLIPSSIKASM

SEQ ID NO: 3357002 - protein, 25 aa, Plasmodium falciparum
FQDCDKLLFLWLHECERVYSDKLNK

SEQ ID NO: 3357003 - protein, 17 aa, Plasmodium falciparum
FQDECIDQFLNYYDDMK

SEQ ID NO: 3357004 - protein, 19 aa, Plasmodium falciparum
FQDKQFIHVRCCDIKSYNN

SEQ ID NO: 3357005 - protein, 21 aa, Plasmodium falciparum
FQFTPDLCSRVTFVNFTLTPS

SEQ ID NO: 3357006 - protein, 23 aa, Plasmodium falciparum
FQGINCSILAYGQTNSGKTYTML

SEQ ID NO: 3357007 - protein, 19 aa, Plasmodium falciparum
FQGQHRFECRFKIQEELKK

SEQ ID NO: 3357008 - protein, 17 aa, Plasmodium falciparum
FQHKAALLKEEMVEEYG

SEQ ID NO: 3357009 - protein, 20 aa, Plasmodium falciparum
FQHMIPYHISTFIISNLAHI

SEQ ID NO: 3357010 - protein, 17 aa, Plasmodium falciparum
FQIDLNIVREAEKELEQ

SEQ ID NO: 3357011 - protein, 22 aa, Plasmodium falciparum
FQKCYKWLKPTGTLLITDYCAT

SEQ ID NO: 3357012 - protein, 17 aa, Plasmodium falciparum
FQKEMLYAPSFDARIVV

SEQ ID NO: 3357013 - protein, 24 aa, Plasmodium falciparum
FQKGCALLPIGGKCKVKTEGLKYN

SEQ ID NO: 3357014 - protein, 25 aa, Plasmodium falciparum
FQKVIKILYCIKSKPEIICANAEVL

SEQ ID NO: 3357015 - protein, 29 aa, Plasmodium falciparum
FQNCDMSENIWLNKKFDEHNVFEKNEIYE

SEQ ID NO: 3357016 - protein, 23 aa, Plasmodium falciparum
FQNPEYWCYYFSSKAKDHLYSFG

SEQ ID NO: 3357017 - protein, 17 aa, Plasmodium falciparum
FQNSRFMDHTGACDTIK

SEQ ID NO: 3357018 - protein, 30 aa, Plasmodium falciparum
FQNYKCNFINADLSPFLNVNKAWEEINRTT

SEQ ID NO: 3357019 - protein, 19 aa, Plasmodium falciparum
FQPEFLAHMPGNFYKQNII

SEQ ID NO: 3357020 - protein, 32 aa, Plasmodium falciparum
FQPFEDICSLGLKHSIKTLLVPGAGIANIDTF

SEQ ID NO: 3357021 - protein, 25 aa, Plasmodium falciparum
FQPNGSLIAHHNFYVNHHPYILNNH

SEQ ID NO: 3357022 - protein, 26 aa, Plasmodium falciparum
FQQGHIWYLICTDILSRGIDIKGIET

SEQ ID NO: 3357023 - protein, 19 aa, Plasmodium falciparum
FQQKIKYHLANFKSMSHSF

SEQ ID NO: 3357024 - protein, 19 aa, Plasmodium falciparum
FQQTVCGFDILRTTMGPFV

SEQ ID NO: 3357025 - protein, 21 aa, Plasmodium falciparum
FQQWSDRFILSKDEEYYYDIQ

SEQ ID NO: 3357026 - protein, 21 aa, Plasmodium falciparum
FQRNNIKVISSLHENKCQKIA

SEQ ID NO: 3357027 - protein, 21 aa, Plasmodium falciparum
FQRVEHIVHIFTQASDYAYST

SEQ ID NO: 3357028 - protein, 18 aa, Plasmodium falciparum
FQSFIDFYISKHVQKILN

SEQ ID NO: 3357029 - protein, 24 aa, Plasmodium falciparum
FQSKCKANKGFMANIHEKKQNHEY

SEQ ID NO: 3357030 - protein, 19 aa, Plasmodium falciparum
FQSNLLNRRSNINTFNDLS

SEQ ID NO: 3357031 - protein, 24 aa, Plasmodium falciparum
FQTDVPPAFGIFDGVGSWSLEGID

SEQ ID NO: 3357032 - protein, 18 aa, Plasmodium falciparum
FQTILPIQIKKEIPYEKE

SEQ ID NO: 3357033 - protein, 25 aa, Plasmodium falciparum
FQVLERLSAFLFRKLIMTEQEKFNV

SEQ ID NO: 3357034 - protein, 20 aa, Plasmodium falciparum
FRCPEALFNPTLIGRECPGL

SEQ ID NO: 3357035 - protein, 18 aa, Plasmodium falciparum
FRDRRYVYKKGLKECEHE

SEQ ID NO: 3357036 - protein, 27 aa, Plasmodium falciparum
FRDTHIICTKPVFTFSMCAVECLQKQE

SEQ ID NO: 3357037 - protein, 20 aa, Plasmodium falciparum
FREAFILFSSCSDHIEMYKF

SEQ ID NO: 3357038 - protein, 17 aa, Plasmodium falciparum
FREIALKVITHLNIIGE

SEQ ID NO: 3357039 - protein, 18 aa, Plasmodium falciparum
FRERRKRLLNDYSSCSSD

SEQ ID NO: 3357040 - protein, 19 aa, Plasmodium falciparum
FRFFTPTSNNVFVRTRSLT

SEQ ID NO: 3357041 - protein, 22 aa, Plasmodium falciparum
FRFLLYELQQLILPHLKKSVDQ

SEQ ID NO: 3357042 - protein, 23 aa, Plasmodium falciparum
FRGADLLALPNCHSGQNFSIIVD

SEQ ID NO: 3357043 - protein, 25 aa, Plasmodium falciparum
FRGGTFFLQKYEKIWNRAKGYHTYN

SEQ ID NO: 3357044 - protein, 19 aa, Plasmodium falciparum
FRGNEKMKYEMKIQNNNNF

SEQ ID NO: 3357045 - protein, 25 aa, Plasmodium falciparum
FRHGKIYEAHCCLMEICSQNKHKEL

SEQ ID NO: 3357046 - protein, 17 aa, Plasmodium falciparum
FRIFLRLVLLDKECGIE

SEQ ID NO: 3357047 - protein, 21 aa, Plasmodium falciparum
FRIIKIEDIYVKSFLSEDIRK

SEQ ID NO: 3357048 - protein, 27 aa, Plasmodium falciparum
FRINKIPLPFQIYNNFNIVVQIDLIQK

SEQ ID NO: 3357049 - protein, 17 aa, Plasmodium falciparum
FRIRLGKFATKIPSSPE

SEQ ID NO: 3357050 - protein, 19 aa, Plasmodium falciparum
FRISSFLILNNEFFGYPLQ

SEQ ID NO: 3357051 - protein, 21 aa, Plasmodium falciparum
FRKITNLSIAICKNILNKNDY

SEQ ID NO: 3357052 - protein, 21 aa, Plasmodium falciparum
FRKLLFSLFWFHSILNNRKKF

SEQ ID NO: 3357053 - protein, 27 aa, Plasmodium falciparum
FRKSKEFLTILLLEFLKSMLTVLNKYN

SEQ ID NO: 3357054 - protein, 31 aa, Plasmodium falciparum
FRKVYQISAFPGIFRDAMGIAYDLRDKDSCP

SEQ ID NO: 3357055 - protein, 23 aa, Plasmodium falciparum
FRKYKIDMVVGLHCCGGLTDYTI

SEQ ID NO: 3357056 - protein, 19 aa, Plasmodium falciparum
FRLCQYRLMVEKLSTLQVS

SEQ ID NO: 3357057 - protein, 24 aa, Plasmodium falciparum
FRLFSKKTFKGHHNIGYSINVSCS

SEQ ID NO: 3357058 - protein, 20 aa, Plasmodium falciparum
FRLLCRKYNCDLTFTPMLHS

SEQ ID NO: 3357059 - protein, 20 aa, Plasmodium falciparum
FRLRLALSLISGKAITIKNI

SEQ ID NO: 3357060 - protein, 20 aa, Plasmodium falciparum
FRLSFWTCFCTYSCWQLNNI

SEQ ID NO: 3357061 - protein, 23 aa, Plasmodium falciparum
FRLSNLNCIINIFGTSGTGKTTL

SEQ ID NO: 3357062 - protein, 30 aa, Plasmodium falciparum
FRLYNYKFNWLNICRKHFLKNYRFNDNASK

SEQ ID NO: 3357063 - protein, 18 aa, Plasmodium falciparum
FRNEEYISLIWVLEKLFG

SEQ ID NO: 3357064 - protein, 27 aa, Plasmodium falciparum
FRNFKICSFSRKLLVNALLNLNYEVSY

SEQ ID NO: 3357065 - protein, 19 aa, Plasmodium falciparum
FRNGGILKYVLRSLVNEAN

SEQ ID NO: 3357066 - protein, 23 aa, Plasmodium falciparum
FRNITKYDLSTPFNVIREKKGRN

SEQ ID NO: 3357067 - protein, 23 aa, Plasmodium falciparum
FRNKCNVGYAFINFIHPYYAELF

SEQ ID NO: 3357068 - protein, 18 aa, Plasmodium falciparum
FRNKQIVVNSILKKKKTM

SEQ ID NO: 3357069 - protein, 22 aa, Plasmodium falciparum
FRNLLYCLTLKYKLYDFQIDVL

SEQ ID NO: 3357070 - protein, 17 aa, Plasmodium falciparum
FRNRLILELAINVNGLI

SEQ ID NO: 3357071 - protein, 19 aa, Plasmodium falciparum
FRNSGGFDMIKSSDIQIIN

SEQ ID NO: 3357072 - protein, 27 aa, Plasmodium falciparum
FRNSILCKLRIAEELSRNTNHSSKENI

SEQ ID NO: 3357073 - protein, 22 aa, Plasmodium falciparum
FRNTFNKEYLKSVLTNDNNNDG

SEQ ID NO: 3357074 - protein, 20 aa, Plasmodium falciparum
FRPDILHQCLIHLLESPLNK

SEQ ID NO: 3357075 - protein, 21 aa, Plasmodium falciparum
FRPEKVCKIAERYGLDGEAVL

SEQ ID NO: 3357076 - protein, 21 aa, Plasmodium falciparum
FRPTLKCIIKLNMNFFYYTVF

SEQ ID NO: 3357077 - protein, 19 aa, Plasmodium falciparum
FRQETFCITEYVDDSDDES

SEQ ID NO: 3357078 - protein, 20 aa, Plasmodium falciparum
FRQLLQIIRYFVLLFKQHYG

SEQ ID NO: 3357079 - protein, 18 aa, Plasmodium falciparum
FRQSFSLNNIHSNHMNNY

SEQ ID NO: 3357080 - protein, 18 aa, Plasmodium falciparum
FRRATLLIYLNDVDKDGE

SEQ ID NO: 3357081 - protein, 20 aa, Plasmodium falciparum
FRRAYKRNDKILCFNTVKFI

SEQ ID NO: 3357082 - protein, 17 aa, Plasmodium falciparum
FRRSFVKNEMMSVNHTS

SEQ ID NO: 3357083 - protein, 20 aa, Plasmodium falciparum
FRSLIPSYIRDSAAAIVVYD

SEQ ID NO: 3357084 - protein, 20 aa, Plasmodium falciparum
FRSYTHPHFDSLKMYSNEFI

SEQ ID NO: 3357085 - protein, 21 aa, Plasmodium falciparum
FRTYMKICISMDNQAKDVPFN

SEQ ID NO: 3357086 - protein, 21 aa, Plasmodium falciparum
FRVKDPHAFMRKSHETRIRKF

SEQ ID NO: 3357087 - protein, 27 aa, Plasmodium falciparum
FRVRINCLKHTFSVYIQKLDEYNLNFN

SEQ ID NO: 3357088 - protein, 22 aa, Plasmodium falciparum
FRYIEKLKCVNDIWNVNKIYVI

SEQ ID NO: 3357089 - protein, 25 aa, Plasmodium falciparum
FRYIKSEIIYEFIVKLIELISINDE

SEQ ID NO: 3357090 - protein, 17 aa, Plasmodium falciparum
FRYNTQLFIDADYREIE

SEQ ID NO: 3357091 - protein, 18 aa, Plasmodium falciparum
FSATASLCGIIKEKINSI

SEQ ID NO: 3357092 - protein, 18 aa, Plasmodium falciparum
FSDEVLLQMMRSIHNIVD

SEQ ID NO: 3357093 - protein, 18 aa, Plasmodium falciparum
FSDFSGSFNANFFRNAYK

SEQ ID NO: 3357094 - protein, 24 aa, Plasmodium falciparum
FSDIYEVYLCMNILDNIKLGDKHL

SEQ ID NO: 3357095 - protein, 17 aa, Plasmodium falciparum
FSDKHEILIPLEGYDKK

SEQ ID NO: 3357096 - protein, 23 aa, Plasmodium falciparum
FSESTDLNRFIGIFEKSFDDGEI

SEQ ID NO: 3357097 - protein, 26 aa, Plasmodium falciparum
FSFFKYELVHLYSLKNYSVILFHTTC

SEQ ID NO: 3357098 - protein, 17 aa, Plasmodium falciparum
FSFNLPLLVERRDKYIQ

SEQ ID NO: 3357099 - protein, 25 aa, Plasmodium falciparum
FSFNRKDILLNIVNNFKFDNILIEK

SEQ ID NO: 3357100 - protein, 17 aa, Plasmodium falciparum
FSFSKGFQKDALEADDK

SEQ ID NO: 3357101 - protein, 25 aa, Plasmodium falciparum
FSFYGNAKLVFLFGGNKKGYNAALG

SEQ ID NO: 3357102 - protein, 20 aa, Plasmodium falciparum
FSFYNPLKINIRMMNLIGRG

SEQ ID NO: 3357103 - protein, 24 aa, Plasmodium falciparum
FSGCSKGNQCTKCHHDYHKNHEDP

SEQ ID NO: 3357104 - protein, 17 aa, Plasmodium falciparum
FSGHIYVFNSSYKKPIC

SEQ ID NO: 3357105 - protein, 25 aa, Plasmodium falciparum
FSGHTSGICKLKFNENGNYLCSCSK

SEQ ID NO: 3357106 - protein, 21 aa, Plasmodium falciparum
FSGKGNALSAYQNKILNIKSN

SEQ ID NO: 3357107 - protein, 17 aa, Plasmodium falciparum
FSGKINTNSFIVENNNG

SEQ ID NO: 3357108 - protein, 19 aa, Plasmodium falciparum
FSGRDCSLILKGLQNIPCN

SEQ ID NO: 3357109 - protein, 17 aa, Plasmodium falciparum
FSGYDFYITKYFSKYMN

SEQ ID NO: 3357110 - protein, 17 aa, Plasmodium falciparum
FSGYDIQATYQFPSTSG

SEQ ID NO: 3357111 - protein, 25 aa, Plasmodium falciparum
FSHEIKKGYFIRTYCFMKTFDKEKI

SEQ ID NO: 3357112 - protein, 17 aa, Plasmodium falciparum
FSHHYYRNNSYKYKNSH

SEQ ID NO: 3357113 - protein, 28 aa, Plasmodium falciparum
FSHIYSLRIKIMKTLLMRTIEDIVKKEE

SEQ ID NO: 3357114 - protein, 20 aa, Plasmodium falciparum
FSHKQYYAALNMYNEIMEKC

SEQ ID NO: 3357115 - protein, 17 aa, Plasmodium falciparum
FSHNIRNKNILYNEDKD

SEQ ID NO: 3357116 - protein, 24 aa, Plasmodium falciparum
FSHSTCLINHNFFMLVGGINIHRT

SEQ ID NO: 3357117 - protein, 22 aa, Plasmodium falciparum
FSIELRHSYYSSVLILVNDNSE

SEQ ID NO: 3357118 - protein, 23 aa, Plasmodium falciparum
FSIFKNAWLSKDNHIIDKGDNYI

SEQ ID NO: 3357119 - protein, 20 aa, Plasmodium falciparum
FSIICEINYIVQNIIRILYA

SEQ ID NO: 3357120 - protein, 17 aa, Plasmodium falciparum
FSIKGEVPSSTLNHKVT

SEQ ID NO: 3357121 - protein, 18 aa, Plasmodium falciparum
FSINRITLGKVYFELFND

SEQ ID NO: 3357122 - protein, 21 aa, Plasmodium falciparum
FSIQLPNMLPALLSKEEEEQN

SEQ ID NO: 3357123 - protein, 17 aa, Plasmodium falciparum
FSKDDIHGPKHIYHDLL

SEQ ID NO: 3357124 - protein, 19 aa, Plasmodium falciparum
FSKDFYSKGLFQYLNADFI

SEQ ID NO: 3357125 - protein, 17 aa, Plasmodium falciparum
FSKFLYIIKDIKNIFQT

SEQ ID NO: 3357126 - protein, 19 aa, Plasmodium falciparum
FSKHVKFFLKESGLKISHN

SEQ ID NO: 3357127 - protein, 24 aa, Plasmodium falciparum
FSKISRGGVRIVISNNVNSYMHNS

SEQ ID NO: 3357128 - protein, 20 aa, Plasmodium falciparum
FSKKAGWSWIKNRRGRKKIL

SEQ ID NO: 3357129 - protein, 17 aa, Plasmodium falciparum
FSKKFLRDQNIFNNVVN

SEQ ID NO: 3357130 - protein, 26 aa, Plasmodium falciparum
FSKKSIQRLIVISAYQKNNEINADLG

SEQ ID NO: 3357131 - protein, 19 aa, Plasmodium falciparum
FSKLLEICELLNISDLQDF

SEQ ID NO: 3357132 - protein, 17 aa, Plasmodium falciparum
FSKLLLLKKKKYACAKV

SEQ ID NO: 3357133 - protein, 17 aa, Plasmodium falciparum
FSKNVIDIFYELKDLVK

SEQ ID NO: 3357134 - protein, 18 aa, Plasmodium falciparum
FSKYLKNVRCEVVYGGIS

SEQ ID NO: 3357135 - protein, 25 aa, Plasmodium falciparum
FSLAKSVWAAGDFKGQIIEGIKRPV

SEQ ID NO: 3357136 - protein, 25 aa, Plasmodium falciparum
FSLCDCPGLIFPSLVFNKNDLIING

SEQ ID NO: 3357137 - protein, 18 aa, Plasmodium falciparum
FSLFSGSILGEFTEITKP

SEQ ID NO: 3357138 - protein, 19 aa, Plasmodium falciparum
FSLLLKMKEYEIWKKLYIL

SEQ ID NO: 3357139 - protein, 19 aa, Plasmodium falciparum
FSLLLKYGVDILIKDDFDM

SEQ ID NO: 3357140 - protein, 17 aa, Plasmodium falciparum
FSLNPLSIRSARITIVR

SEQ ID NO: 3357141 - protein, 21 aa, Plasmodium falciparum
FSLQNLGAMDIIKSSSRSNNN

SEQ ID NO: 3357142 - protein, 19 aa, Plasmodium falciparum
FSLSAAMCCSSICSEFEHL

SEQ ID NO: 3357143 - protein, 20 aa, Plasmodium falciparum
FSLYIQKYFYCANIQKKTIP

SEQ ID NO: 3357144 - protein, 18 aa, Plasmodium falciparum
FSMIRFNPHYDEIKFEKL

SEQ ID NO: 3357145 - protein, 19 aa, Plasmodium falciparum
FSMLRSHSYENHFKHISYD

SEQ ID NO: 3357146 - protein, 18 aa, Plasmodium falciparum
FSNFAFKLLGQSLEYLIS

SEQ ID NO: 3357147 - protein, 24 aa, Plasmodium falciparum
FSNFPCIQKDISFYIKQYFNETSF

SEQ ID NO: 3357148 - protein, 23 aa, Plasmodium falciparum
FSNIKISKNFFLKMNDDEDEEDE

SEQ ID NO: 3357149 - protein, 26 aa, Plasmodium falciparum
FSNILKCSYLFLLVLINYSKNVRVLS

SEQ ID NO: 3357150 - protein, 32 aa, Plasmodium falciparum
FSNLVIQKFNSVVFFCDASGFSNLAEQLDKRI

SEQ ID NO: 3357151 - protein, 19 aa, Plasmodium falciparum
FSNNFCMNEINSLKNITND

SEQ ID NO: 3357152 - protein, 46 aa, Plasmodium falciparum
FSNRSKRWTICPSYICCNSALCRFKLTCNFKFLQFNQAYNTFNIPY

SEQ ID NO: 3357153 - protein, 25 aa, Plasmodium falciparum
FSNSWCGFKKRWFVLRNNKLYYYKN

SEQ ID NO: 3357154 - protein, 22 aa, Plasmodium falciparum
FSNVCKVVNAWINYDHTDRSNG

SEQ ID NO: 3357155 - protein, 27 aa, Plasmodium falciparum
FSPCDYWLCAATDRFIRIWNLESKLII

SEQ ID NO: 3357156 - protein, 23 aa, Plasmodium falciparum
FSPCNQKKALLIGINYYGTKYEL

SEQ ID NO: 3357157 - protein, 39 aa, Plasmodium falciparum
FSPEITSGTGYDWRSDIWSLGVLLYEMLVGDVPFDGTKT

SEQ ID NO: 3357158 - protein, 27 aa, Plasmodium falciparum
FSPPESLICSLSFEEVRKKSKQENKFI

SEQ ID NO: 3357159 - protein, 27 aa, Plasmodium falciparum
FSRCYETISIPFLVNYVRKYGTFSRAF

SEQ ID NO: 3357160 - protein, 22 aa, Plasmodium falciparum
FSRIKKEYLRKIKFSEKNEEII

SEQ ID NO: 3357161 - protein, 21 aa, Plasmodium falciparum
FSRKKSFKMKNKRKMNENTSS

SEQ ID NO: 3357162 - protein, 27 aa, Plasmodium falciparum
FSRNLLDFENFCSYKFKRNINNNLVNN

SEQ ID NO: 3357163 - protein, 25 aa, Plasmodium falciparum
FSSDEIRTSLLLILKQIFTINNGLQ

SEQ ID NO: 3357164 - protein, 24 aa, Plasmodium falciparum
FSSDNMKSNIYVAKKNYSSESFNN

SEQ ID NO: 3357165 - protein, 17 aa, Plasmodium falciparum
FSSEVSTCIRICDGALI

SEQ ID NO: 3357166 - protein, 17 aa, Plasmodium falciparum
FSSGRFGIYSTPDMISL

SEQ ID NO: 3357167 - protein, 18 aa, Plasmodium falciparum
FSSIDFYGGCSDYNIAVL

SEQ ID NO: 3357168 - protein, 23 aa, Plasmodium falciparum
FSSIPKFMIGFIGFPNVGKSSII

SEQ ID NO: 3357169 - protein, 17 aa, Plasmodium falciparum
FSSIYIQKMFTGVSKNV

SEQ ID NO: 3357170 - protein, 17 aa, Plasmodium falciparum
FSSKMLVDNNMQAPINN

SEQ ID NO: 3357171 - protein, 18 aa, Plasmodium falciparum
FSSKNKYIYCITNANTKS

SEQ ID NO: 3357172 - protein, 20 aa, Plasmodium falciparum
FSSLHILLKYSIRSFFKNYS

SEQ ID NO: 3357173 - protein, 24 aa, Plasmodium falciparum
FSSLPLKCDFQYKYKIEKYSREYE

SEQ ID NO: 3357174 - protein, 19 aa, Plasmodium falciparum
FSSLSYKLAGKVIEYKESK

SEQ ID NO: 3357175 - protein, 20 aa, Plasmodium falciparum
FSSNFSSTCNSAFYLQPEFE

SEQ ID NO: 3357176 - protein, 23 aa, Plasmodium falciparum
FSSNVVEKCLIIGNNKCRKLIIN

SEQ ID NO: 3357177 - protein, 22 aa, Plasmodium falciparum
FSSSVVWEVVDKIIILENTIEE

SEQ ID NO: 3357178 - protein, 22 aa, Plasmodium falciparum
FSSTLFPLSKRIRYKSNINSLS

SEQ ID NO: 3357179 - protein, 25 aa, Plasmodium falciparum
FSSYFYKNFLKNIVIFDFNINYLLC

SEQ ID NO: 3357180 - protein, 17 aa, Plasmodium falciparum
FSTHLSLLNYNFKDNNN

SEQ ID NO: 3357181 - protein, 23 aa, Plasmodium falciparum
FSTKKKPSRFIIGRLYNNKILDY

SEQ ID NO: 3357182 - protein, 17 aa, Plasmodium falciparum
FSTLKLKNCDVSIEDNK

SEQ ID NO: 3357183 - protein, 44 aa, Plasmodium falciparum
FSTYEVAKYCFEKLNGKWIPGKAHRFKLNWAKYNMSDNITTNEK

SEQ ID NO: 3357184 - protein, 24 aa, Plasmodium falciparum
FSVKKYGFEKARELAIKCREENVN

SEQ ID NO: 3357185 - protein, 17 aa, Plasmodium falciparum
FSVNEYKSVQLARQKAI

SEQ ID NO: 3357186 - protein, 20 aa, Plasmodium falciparum
FSWYDKWFTIKNMQTCEYTI

SEQ ID NO: 3357187 - protein, 19 aa, Plasmodium falciparum
FSYDMIKSILIPHFTNNQD

SEQ ID NO: 3357188 - protein, 35 aa, Plasmodium falciparum
FSYFMPKNDLNFIFEHFDIGLIVLTKIHNIRKKYE

SEQ ID NO: 3357189 - protein, 20 aa, Plasmodium falciparum
FSYHIRYEYHSSCIMVAKNI

SEQ ID NO: 3357190 - protein, 23 aa, Plasmodium falciparum
FSYILKCLIKYLNEDGISKLFMY

SEQ ID NO: 3357191 - protein, 18 aa, Plasmodium falciparum
FSYNRVIGDIAFFDSKPN

SEQ ID NO: 3357192 - protein, 19 aa, Plasmodium falciparum
FSYYMLNKKMSTLLKKINN

SEQ ID NO: 3357193 - protein, 21 aa, Plasmodium falciparum
FTAQSNGGWVLLKNIHISTKW

SEQ ID NO: 3357194 - protein, 17 aa, Plasmodium falciparum
FTASELMNRMSNNEETS

SEQ ID NO: 3357195 - protein, 17 aa, Plasmodium falciparum
FTCKKWLSNTVDLNTQK

SEQ ID NO: 3357196 - protein, 24 aa, Plasmodium falciparum
FTDCLKLTKWPGIKIPEDDTENNF

SEQ ID NO: 3357197 - protein, 17 aa, Plasmodium falciparum
FTDMKYQKIYIYGGYSQ

SEQ ID NO: 3357198 - protein, 32 aa, Plasmodium falciparum
FTDSFKYRYFYLPATWLLATLFPTYRQKTGSV

SEQ ID NO: 3357199 - protein, 25 aa, Plasmodium falciparum
FTEILKYRGIILMSYPTKALSPILL

SEQ ID NO: 3357200 - protein, 34 aa, Plasmodium falciparum
FTEKELKSIVDFFFCINYFLKFAAHINSVYYLVI

SEQ ID NO: 3357201 - protein, 25 aa, Plasmodium falciparum
FTEKGMCALFESFSLNSSLNIVDAS

SEQ ID NO: 3357202 - protein, 24 aa, Plasmodium falciparum
FTFGCNKRAQLGLPNHYNKKVSYT

SEQ ID NO: 3357203 - protein, 17 aa, Plasmodium falciparum
FTFKKIFILYATFELRQ

SEQ ID NO: 3357204 - protein, 22 aa, Plasmodium falciparum
FTFPSKIKKITCGDNHTAILLE

SEQ ID NO: 3357205 - protein, 17 aa, Plasmodium falciparum
FTFYKNSGLCFIPCDNK

SEQ ID NO: 3357206 - protein, 25 aa, Plasmodium falciparum
FTINPRLIRHFFILNINFPENNTVN

SEQ ID NO: 3357207 - protein, 17 aa, Plasmodium falciparum
FTKCNEKTFSFSNLKTF

SEQ ID NO: 3357208 - protein, 17 aa, Plasmodium falciparum
FTKETNTGIILNNASQD

SEQ ID NO: 3357209 - protein, 19 aa, Plasmodium falciparum
FTKHITSLCDILFSICMKD

SEQ ID NO: 3357210 - protein, 21 aa, Plasmodium falciparum
FTKKWLLQLLYNINNDDENLT

SEQ ID NO: 3357211 - protein, 21 aa, Plasmodium falciparum
FTKNCGVTLFGLLLSEVKNKN

SEQ ID NO: 3357212 - protein, 24 aa, Plasmodium falciparum
FTKTCNVLIQRGYLSILKDTNNDF

SEQ ID NO: 3357213 - protein, 19 aa, Plasmodium falciparum
FTLDNEYLFKVIINKQNIF

SEQ ID NO: 3357214 - protein, 20 aa, Plasmodium falciparum
FTLHIIKIFEECFKGRILYE

SEQ ID NO: 3357215 - protein, 17 aa, Plasmodium falciparum
FTLIFKIYQGFHKIIRK

SEQ ID NO: 3357216 - protein, 27 aa, Plasmodium falciparum
FTLKCNKCKTFTYVGTKFNSRVEKLKD

SEQ ID NO: 3357217 - protein, 20 aa, Plasmodium falciparum
FTLMYKSRIDTNVVELKVVP

SEQ ID NO: 3357218 - protein, 36 aa, Plasmodium falciparum
FTMDSYGNMYLRICLKVLKKNVDYFLSPMNLNNEKL

SEQ ID NO: 3357219 - protein, 32 aa, Plasmodium falciparum
FTNAQSCNFLTCIEKGTTFLISHINKDMEKEI

SEQ ID NO: 3357220 - protein, 22 aa, Plasmodium falciparum
FTNCCWLNDGILLLINKNNYII

SEQ ID NO: 3357221 - protein, 45 aa, Plasmodium falciparum
FTNIDDICVRNYLEKHFPFIKGYRNKYEITDDLFMQGNDDNHLSK

SEQ ID NO: 3357222 - protein, 17 aa, Plasmodium falciparum
FTNRNIVDCKMYKQNNI

SEQ ID NO: 3357223 - protein, 18 aa, Plasmodium falciparum
FTNSELRELFSLKDTKVI

SEQ ID NO: 3357224 - protein, 25 aa, Plasmodium falciparum
FTNSRSTFPKSLSFNSDVTNAKDEI

SEQ ID NO: 3357225 - protein, 20 aa, Plasmodium falciparum
FTPLLPSYYFKVLKNKIDDI

SEQ ID NO: 3357226 - protein, 18 aa, Plasmodium falciparum
FTPYTWKTPIQKFVESQK

SEQ ID NO: 3357227 - protein, 24 aa, Plasmodium falciparum
FTQELIKQLAWIAPNLIQLNKVTI

SEQ ID NO: 3357228 - protein, 18 aa, Plasmodium falciparum
FTQKVESLEHAFKQSYNQ

SEQ ID NO: 3357229 - protein, 24 aa, Plasmodium falciparum
FTQVEIFKLFYLYSQNINASDKLL

SEQ ID NO: 3357230 - protein, 20 aa, Plasmodium falciparum
FTREKIRWWLYDEKCREQFI

SEQ ID NO: 3357231 - protein, 19 aa, Plasmodium falciparum
FTSAAIFVENCVKIFSQKI

SEQ ID NO: 3357232 - protein, 26 aa, Plasmodium falciparum
FTSDVVYCYLKLLKLKNICTPNGINN

SEQ ID NO: 3357233 - protein, 25 aa, Plasmodium falciparum
FTSECFEYLEISPPAFIDPQNNNIQ

SEQ ID NO: 3357234 - protein, 24 aa, Plasmodium falciparum
FTSISKVYYCEVVNKKREKILSND

SEQ ID NO: 3357235 - protein, 20 aa, Plasmodium falciparum
FTSKIKNLFLKKNKNKNKIK

SEQ ID NO: 3357236 - protein, 20 aa, Plasmodium falciparum
FTSLCPLTKKSGLCKNEKCS

SEQ ID NO: 3357237 - protein, 26 aa, Plasmodium falciparum
FTSNGKYIIKTVCRNIHNLSKKLLPK

SEQ ID NO: 3357238 - protein, 17 aa, Plasmodium falciparum
FTSYFNNFIPSIFTSEN

SEQ ID NO: 3357239 - protein, 17 aa, Plasmodium falciparum
FTTDIACRGLDFSSIDW

SEQ ID NO: 3357240 - protein, 19 aa, Plasmodium falciparum
FTVEFIWKSTAYDRMQLAL

SEQ ID NO: 3357241 - protein, 18 aa, Plasmodium falciparum
FTVIERKPLSSLENNESL

SEQ ID NO: 3357242 - protein, 17 aa, Plasmodium falciparum
FTVVPKPQPVLQWEEEL

SEQ ID NO: 3357243 - protein, 20 aa, Plasmodium falciparum
FTVYEPLPWESFLKGLDESG

SEQ ID NO: 3357244 - protein, 23 aa, Plasmodium falciparum
FTWSRIRLFDHLAVILIYEELLK

SEQ ID NO: 3357245 - protein, 17 aa, Plasmodium falciparum
FTYFHFFLKYIKNTEHE

SEQ ID NO: 3357246 - protein, 22 aa, Plasmodium falciparum
FTYFNLYSSFYFEKQMSYIMMN

SEQ ID NO: 3357247 - protein, 33 aa, Plasmodium falciparum
FTYHKVKNCVWNDAYKLAKEFDKLIKQGNDVKN

SEQ ID NO: 3357248 - protein, 22 aa, Plasmodium falciparum
FTYTYFRHIEWIRISPNVYDYD

SEQ ID NO: 3357249 - protein, 23 aa, Plasmodium falciparum
FVCDKCKCIIKVEFMDGKFEPPK

SEQ ID NO: 3357250 - protein, 18 aa, Plasmodium falciparum
FVCMCSRCTHPVDNCRGF

SEQ ID NO: 3357251 - protein, 26 aa, Plasmodium falciparum
FVDVAKIKKILCDIVKPNEEQKSNTN

SEQ ID NO: 3357252 - protein, 23 aa, Plasmodium falciparum
FVEAFKNIVALIIDSDYTFPLME

SEQ ID NO: 3357253 - protein, 23 aa, Plasmodium falciparum
FVENIKKPLLYEIYKKENDTNTN

SEQ ID NO: 3357254 - protein, 29 aa, Plasmodium falciparum
FVEQKQKKRLLGIVKLIGELFQRQIVSIS

SEQ ID NO: 3357255 - protein, 23 aa, Plasmodium falciparum
FVESFLQKWFHYEYMNEKKVGNI

SEQ ID NO: 3357256 - protein, 21 aa, Plasmodium falciparum
FVETIPKWQCIVLDEAHRIKN

SEQ ID NO: 3357257 - protein, 17 aa, Plasmodium falciparum
FVFEIGRRYKILNPDRM

SEQ ID NO: 3357258 - protein, 20 aa, Plasmodium falciparum
FVHGCARNFLHVCLNVQILL

SEQ ID NO: 3357259 - protein, 24 aa, Plasmodium falciparum
FVIENFKLILFISNIFSDRYEQLD

SEQ ID NO: 3357260 - protein, 21 aa, Plasmodium falciparum
FVILKEFPFTIQIIDPSGLSS

SEQ ID NO: 3357261 - protein, 23 aa, Plasmodium falciparum
FVIPNIIRRVLTIIRVEHFKQLY

SEQ ID NO: 3357262 - protein, 22 aa, Plasmodium falciparum
FVIYRDIDIFFSLEHKTKNLSY

SEQ ID NO: 3357263 - protein, 18 aa, Plasmodium falciparum
FVKEAIKKIKDARHNNAH

SEQ ID NO: 3357264 - protein, 24 aa, Plasmodium falciparum
FVKEINYSSILIAIFSFFNNHHED

SEQ ID NO: 3357265 - protein, 19 aa, Plasmodium falciparum
FVKEIVFHFTYPRLDINVS

SEQ ID NO: 3357266 - protein, 27 aa, Plasmodium falciparum
FVKISLFLFFFVHKNFIYSYKINGGFL

SEQ ID NO: 3357267 - protein, 20 aa, Plasmodium falciparum
FVLCFSEKYGKLIFSAYKID

SEQ ID NO: 3357268 - protein, 25 aa, Plasmodium falciparum
FVLEKECLHFGSPEIKEVIERMKTI

SEQ ID NO: 3357269 - protein, 19 aa, Plasmodium falciparum
FVLENLCYFDLSYKYYLQK

SEQ ID NO: 3357270 - protein, 20 aa, Plasmodium falciparum
FVLPMLSYVKQLPPLTYETS

SEQ ID NO: 3357271 - protein, 18 aa, Plasmodium falciparum
FVLRNVIQQFRLLKELVI

SEQ ID NO: 3357272 - protein, 20 aa, Plasmodium falciparum
FVNIYLNLFFQARKNAILSD

SEQ ID NO: 3357273 - protein, 18 aa, Plasmodium falciparum
FVNNHILQYLPILMSLNE

SEQ ID NO: 3357274 - protein, 17 aa, Plasmodium falciparum
FVNRRLKCVVEHIRDGA

SEQ ID NO: 3357275 - protein, 23 aa, Plasmodium falciparum
FVNYIKPFIFRFQNVDKNDIPNN

SEQ ID NO: 3357276 - protein, 22 aa, Plasmodium falciparum
FVPPFRGGILADEMGLGKTIQS

SEQ ID NO: 3357277 - protein, 24 aa, Plasmodium falciparum
FVQKGKRIPRRGEVGLSAEAIENF

SEQ ID NO: 3357278 - protein, 17 aa, Plasmodium falciparum
FVQYTLFYLLTNHYIEL

SEQ ID NO: 3357279 - protein, 19 aa, Plasmodium falciparum
FVRPVSCFDNEGHIFIASY

SEQ ID NO: 3357280 - protein, 25 aa, Plasmodium falciparum
FVSIKGPELLTMWFGESEANVREVF

SEQ ID NO: 3357281 - protein, 26 aa, Plasmodium falciparum
FVSKIGGKPFWLDRINLPDEKEFNCS

SEQ ID NO: 3357282 - protein, 22 aa, Plasmodium falciparum
FVSTEMSLWWAGKEMNENLYLK

SEQ ID NO: 3357283 - protein, 26 aa, Plasmodium falciparum
FVTCFPVYFFDVFTIRCTAEYKIGSE

SEQ ID NO: 3357284 - protein, 20 aa, Plasmodium falciparum
FVTCPDFYANNIKSIYLDPN

SEQ ID NO: 3357285 - protein, 18 aa, Plasmodium falciparum
FVTSLSNFFCLEKNEEDV

SEQ ID NO: 3357286 - protein, 18 aa, Plasmodium falciparum
FVVDLLIYHMDNVGIIEK

SEQ ID NO: 3357287 - protein, 20 aa, Plasmodium falciparum
FVWKRKMYKWLKGIFNKSQG

SEQ ID NO: 3357288 - protein, 32 aa, Plasmodium falciparum
FVYESELFHGLAWLKYCFHILNFKRNMTEKEK

SEQ ID NO: 3357289 - protein, 25 aa, Plasmodium falciparum
FVYFFSQKKWYLLKGKLCNDEYLYN

SEQ ID NO: 3357290 - protein, 17 aa, Plasmodium falciparum
FWCEDRCEFTDPKQMLV

SEQ ID NO: 3357291 - protein, 17 aa, Plasmodium falciparum
FWNEEDEHTSIFDICKE

SEQ ID NO: 3357292 - protein, 20 aa, Plasmodium falciparum
FWSIKDGKLLNVIRSQARHV

SEQ ID NO: 3357293 - protein, 17 aa, Plasmodium falciparum
FWSSSNVTSTTNKNNNN

SEQ ID NO: 3357294 - protein, 19 aa, Plasmodium falciparum
FWVARMVMVSLHLMKKLPF

SEQ ID NO: 3357295 - protein, 18 aa, Plasmodium falciparum
FWYLSKKIFFGKYKNCAV

SEQ ID NO: 3357296 - protein, 22 aa, Plasmodium falciparum
FYDFIFKKIIMFIHQFDEKELS

SEQ ID NO: 3357297 - protein, 18 aa, Plasmodium falciparum
FYDIEYIKDISYDNVKNN

SEQ ID NO: 3357298 - protein, 21 aa, Plasmodium falciparum
FYDVQMLKRLLIKKLNLPGGV

SEQ ID NO: 3357299 - protein, 19 aa, Plasmodium falciparum
FYEFCVAINIMLKGNKKDK

SEQ ID NO: 3357300 - protein, 19 aa, Plasmodium falciparum
FYEFYYYNQMDNFKIDLDF

SEQ ID NO: 3357301 - protein, 19 aa, Plasmodium falciparum
FYEMFLFVLCFSKIEFMPH

SEQ ID NO: 3357302 - protein, 21 aa, Plasmodium falciparum
FYENICYLYDLIRNEKIYPSE

SEQ ID NO: 3357303 - protein, 19 aa, Plasmodium falciparum
FYEQKCLFELEQKKVENEK

SEQ ID NO: 3357304 - protein, 19 aa, Plasmodium falciparum
FYESFSLLLKYGVDILIKD

SEQ ID NO: 3357305 - protein, 17 aa, Plasmodium falciparum
FYEYGCTIHHAGMSRSD

SEQ ID NO: 3357306 - protein, 18 aa, Plasmodium falciparum
FYEYIKKSYFVSNRKNYD

SEQ ID NO: 3357307 - protein, 17 aa, Plasmodium falciparum
FYFDSLHVYEPVAKMII

SEQ ID NO: 3357308 - protein, 18 aa, Plasmodium falciparum
FYFFDYLLFYTKAYKQNL

SEQ ID NO: 3357309 - protein, 17 aa, Plasmodium falciparum
FYFICSKMENTKRKEND

SEQ ID NO: 3357310 - protein, 19 aa, Plasmodium falciparum
FYFKNARWSPPSKYNIKCS

SEQ ID NO: 3357311 - protein, 17 aa, Plasmodium falciparum
FYFYNRGSLLVMGGKAV

SEQ ID NO: 3357312 - protein, 23 aa, Plasmodium falciparum
FYFYYDQHFLKYPCIHIFQYKKI

SEQ ID NO: 3357313 - protein, 22 aa, Plasmodium falciparum
FYGDKDVLCFSIHRFDKKVEEK

SEQ ID NO: 3357314 - protein, 19 aa, Plasmodium falciparum
FYHGMCLYEKCKFKVHPYW

SEQ ID NO: 3357315 - protein, 22 aa, Plasmodium falciparum
FYHPYFCKVICREVCLDIYKIK

SEQ ID NO: 3357316 - protein, 25 aa, Plasmodium falciparum
FYIEDCKSKFGTLIQIRKPVFFNIR

SEQ ID NO: 3357317 - protein, 24 aa, Plasmodium falciparum
FYIFNYWTKRDFSLYFTHDELNEI

SEQ ID NO: 3357318 - protein, 18 aa, Plasmodium falciparum
FYIIEFLEIGGIQTYSYI

SEQ ID NO: 3357319 - protein, 17 aa, Plasmodium falciparum
FYILYLYIYKRNLVQNE

SEQ ID NO: 3357320 - protein, 22 aa, Plasmodium falciparum
FYIMNAELLKFENINLKNTISN

SEQ ID NO: 3357321 - protein, 33 aa, Plasmodium falciparum
FYINIIKGFNFKLCSYYDYFKLFRQKIMENDSK

SEQ ID NO: 3357322 - protein, 22 aa, Plasmodium falciparum
FYIRNKCIGALELKGIYDNINY

SEQ ID NO: 3357323 - protein, 25 aa, Plasmodium falciparum
FYIYFNIYVKYLFTCYINYCNEETG

SEQ ID NO: 3357324 - protein, 24 aa, Plasmodium falciparum
FYKDCDACNSPTFNSAVICPHSND

SEQ ID NO: 3357325 - protein, 31 aa, Plasmodium falciparum
FYKDDWPFIVVCPSSIRFQWKDQALRWLSHL

SEQ ID NO: 3357326 - protein, 18 aa, Plasmodium falciparum
FYKELDLSKYCNKSGSQY

SEQ ID NO: 3357327 - protein, 21 aa, Plasmodium falciparum
FYKNEFIEFHFSDSHKYPLCI

SEQ ID NO: 3357328 - protein, 19 aa, Plasmodium falciparum
FYKNELMLDKSISDYEENV

SEQ ID NO: 3357329 - protein, 22 aa, Plasmodium falciparum
FYKNELNIFFNLIYILNEKYRT

SEQ ID NO: 3357330 - protein, 17 aa, Plasmodium falciparum
FYKNEVFYFKQNIHLLE

SEQ ID NO: 3357331 - protein, 31 aa, Plasmodium falciparum
FYLDTSFSTLRFALKCKTIKKKIEVNYLSAE

SEQ ID NO: 3357332 - protein, 17 aa, Plasmodium falciparum
FYLFRFSNINSFNLLNL

SEQ ID NO: 3357333 - protein, 21 aa, Plasmodium falciparum
FYLLYAQNVLYDFKHINVEVQ

SEQ ID NO: 3357334 - protein, 24 aa, Plasmodium falciparum
FYLNALYQKLCNYFLINNISFEQF

SEQ ID NO: 3357335 - protein, 31 aa, Plasmodium falciparum
FYLNEKKLRAYQLTGLNWIVSRMKRNLSVLL

SEQ ID NO: 3357336 - protein, 32 aa, Plasmodium falciparum
FYLNLETYEIFCVFEKILHYYAPYLYLQNNYI

SEQ ID NO: 3357337 - protein, 20 aa, Plasmodium falciparum
FYLRNLDLFDSSGLSAPSDL

SEQ ID NO: 3357338 - protein, 20 aa, Plasmodium falciparum
FYLYPAEELVEFEYAQEIFD

SEQ ID NO: 3357339 - protein, 29 aa, Plasmodium falciparum
FYMINNCRIPHIFTKHGLIILKKFTTDNM

SEQ ID NO: 3357340 - protein, 23 aa, Plasmodium falciparum
FYMNEHEKCCVSVDKNNIKEQNK

SEQ ID NO: 3357341 - protein, 20 aa, Plasmodium falciparum
FYNAILICMNEIIKYLKICD

SEQ ID NO: 3357342 - protein, 30 aa, Plasmodium falciparum
FYNDIQRWKNTIKVPIWLKKPKDRESLDEF

SEQ ID NO: 3357343 - protein, 20 aa, Plasmodium falciparum
FYNHPNFHIGLHDKVNSMSD

SEQ ID NO: 3357344 - protein, 25 aa, Plasmodium falciparum
FYNIRRCTKVLLGIDAIIHNSVYGH

SEQ ID NO: 3357345 - protein, 20 aa, Plasmodium falciparum
FYNKACVQVHLFKRKLLQKY

SEQ ID NO: 3357346 - protein, 18 aa, Plasmodium falciparum
FYNKLKCLKKELYTLDDM

SEQ ID NO: 3357347 - protein, 25 aa, Plasmodium falciparum
FYNMYKDKVKFLLLEECNYLKELRN

SEQ ID NO: 3357348 - protein, 19 aa, Plasmodium falciparum
FYNNLRFKILQALFNKSKQ

SEQ ID NO: 3357349 - protein, 20 aa, Plasmodium falciparum
FYNNMNININRCLYKQTITN

SEQ ID NO: 3357350 - protein, 19 aa, Plasmodium falciparum
FYNPKSCVPYYDKTNNNIK

SEQ ID NO: 3357351 - protein, 19 aa, Plasmodium falciparum
FYNSLNMKLINYGNFGYNN

SEQ ID NO: 3357352 - protein, 22 aa, Plasmodium falciparum
FYNYDFGNLILFPNVDKNENTK

SEQ ID NO: 3357353 - protein, 21 aa, Plasmodium falciparum
FYNYLKGIEITKMFDDNIVND

SEQ ID NO: 3357354 - protein, 23 aa, Plasmodium falciparum
FYQCGLPSKILQILEKKNFKKMY

SEQ ID NO: 3357355 - protein, 29 aa, Plasmodium falciparum
FYQFDFLKKFKIDGIISFLFDDTYLEQIC

SEQ ID NO: 3357356 - protein, 18 aa, Plasmodium falciparum
FYQKYGYKPCIGNIRYQL

SEQ ID NO: 3357357 - protein, 21 aa, Plasmodium falciparum
FYQLLKWKPLNLNTVDFGIET

SEQ ID NO: 3357358 - protein, 19 aa, Plasmodium falciparum
FYQSLNIPYRIVSIVSGAL

SEQ ID NO: 3357359 - protein, 28 aa, Plasmodium falciparum
FYRCANLKPLDRMNCPIVLKTLEQNKNF

SEQ ID NO: 3357360 - protein, 24 aa, Plasmodium falciparum
FYRHFKIWCDLYFRIKHRNINRGI

SEQ ID NO: 3357361 - protein, 23 aa, Plasmodium falciparum
FYRRIKKNPNYYGLKGISNEHIS

SEQ ID NO: 3357362 - protein, 18 aa, Plasmodium falciparum
FYSSEIILALEYLHDLNI

SEQ ID NO: 3357363 - protein, 18 aa, Plasmodium falciparum
FYTFICESKYQLLFLRKG

SEQ ID NO: 3357364 - protein, 33 aa, Plasmodium falciparum
FYTNKSIYCINSFKKWIYFGSINNKCYLYNNFD

SEQ ID NO: 3357365 - protein, 29 aa, Plasmodium falciparum
FYTQIKHFYKRKVIYIDLDNSFYIDRYKN

SEQ ID NO: 3357366 - protein, 18 aa, Plasmodium falciparum
FYTSRSKLCLNEKIRTGK

SEQ ID NO: 3357367 - protein, 24 aa, Plasmodium falciparum
FYVCKGEIPAEIVLHDKNGNVSHS

SEQ ID NO: 3357368 - protein, 28 aa, Plasmodium falciparum
FYVDYILKRKPCILKSEYVIKNKLNIDL

SEQ ID NO: 3357369 - protein, 17 aa, Plasmodium falciparum
FYVEYSINIVLTIINIY

SEQ ID NO: 3357370 - protein, 19 aa, Plasmodium falciparum
FYVRYGLPVECHVNHDDIP

SEQ ID NO: 3357371 - protein, 18 aa, Plasmodium falciparum
FYYDLDYFFLCIYNSLCN

SEQ ID NO: 3357372 - protein, 25 aa, Plasmodium falciparum
FYYEQLALVFLDFLKIYQLYSKFIN

SEQ ID NO: 3357373 - protein, 17 aa, Plasmodium falciparum
FYYKWFDKKKIFVMQIH

SEQ ID NO: 3357374 - protein, 17 aa, Plasmodium falciparum
FYYLKKFSYNFLKTLIN

SEQ ID NO: 3357375 - protein, 22 aa, Plasmodium falciparum
FYYQSFFQKYFIFINSNIKKIN

SEQ ID NO: 3357376 - protein, 17 aa, Plasmodium falciparum
FYYVLCSKINNDIQKIS

SEQ ID NO: 3357377 - protein, 18 aa, Plasmodium falciparum
GAADCLYWEKYLGKIIKI

SEQ ID NO: 3357378 - protein, 18 aa, Plasmodium falciparum
GACDGGLNIPHGNNRFPG

SEQ ID NO: 3357379 - protein, 25 aa, Plasmodium falciparum
GAFVPCTYCELTVVDKIFTRLGSSD

SEQ ID NO: 3357380 - protein, 18 aa, Plasmodium falciparum
GAICSAALDLSLQHNIGF

SEQ ID NO: 3357381 - protein, 23 aa, Plasmodium falciparum
GAIKKLKNNPVLLRDSCNENINT

SEQ ID NO: 3357382 - protein, 30 aa, Plasmodium falciparum
GAILLKKNQVIILFKGCIVSGNDTEDNEIE

SEQ ID NO: 3357383 - protein, 26 aa, Plasmodium falciparum
GAISCSFDSFLCNWLKDEEKKILNKF

SEQ ID NO: 3357384 - protein, 17 aa, Plasmodium falciparum
GANDFVLDEMQRSIHDA

SEQ ID NO: 3357385 - protein, 23 aa, Plasmodium falciparum
GANGFRFTSIYSEYSLFDTYVEN

SEQ ID NO: 3357386 - protein, 17 aa, Plasmodium falciparum
GANKLPPSNNIIHEEKK

SEQ ID NO: 3357387 - protein, 24 aa, Plasmodium falciparum
GANTFLYDYTWKGILFNLCGTVAS

SEQ ID NO: 3357388 - protein, 25 aa, Plasmodium falciparum
GAPQKRGICLKVRVQTPKKPNSGLK

SEQ ID NO: 3357389 - protein, 18 aa, Plasmodium falciparum
GAQLGRYVLVFNCDESFD

SEQ ID NO: 3357390 - protein, 24 aa, Plasmodium falciparum
GARIHYIFNDWYIKSLNDFSPLEM

SEQ ID NO: 3357391 - protein, 19 aa, Plasmodium falciparum
GATKNILCEFNKKGKKGIV

SEQ ID NO: 3357392 - protein, 22 aa, Plasmodium falciparum
GATKVYGYRVEAIYDQTYNFLT

SEQ ID NO: 3357393 - protein, 22 aa, Plasmodium falciparum
GCDNMTCLIVQYNPEYKIHTEK

SEQ ID NO: 3357394 - protein, 26 aa, Plasmodium falciparum
GCFVPCTYAKIPIFTQIMCRVGSSDI

SEQ ID NO: 3357395 - protein, 19 aa, Plasmodium falciparum
GCHFSLILVDNIKEIADYF

SEQ ID NO: 3357396 - protein, 22 aa, Plasmodium falciparum
GCIIFELINLCPLFPGKFKKDE

SEQ ID NO: 3357397 - protein, 19 aa, Plasmodium falciparum
GCISLRVHVYNELFLFETS

SEQ ID NO: 3357398 - protein, 18 aa, Plasmodium falciparum
GCLFGCAQNIFSEPVEKF

SEQ ID NO: 3357399 - protein, 17 aa, Plasmodium falciparum
GCLVVNSDDTMECVCCM

SEQ ID NO: 3357400 - protein, 25 aa, Plasmodium falciparum
GCNYSRIVAYVKLHLSVFIILNDTR

SEQ ID NO: 3357401 - protein, 29 aa, Plasmodium falciparum
GCSGCGKSTLSCLLAMFLNIRRIISTDII

SEQ ID NO: 3357402 - protein, 25 aa, Plasmodium falciparum
GCSPGYRIPVGLLLSGKEGLENELE

SEQ ID NO: 3357403 - protein, 17 aa, Plasmodium falciparum
GCVPKKLMHYAGHMGSI

SEQ ID NO: 3357404 - protein, 20 aa, Plasmodium falciparum
GDAPPVFYLNGINFTYLKSN

SEQ ID NO: 3357405 - protein, 19 aa, Plasmodium falciparum
GDARICLIGFPSVGKSTLL

SEQ ID NO: 3357406 - protein, 17 aa, Plasmodium falciparum
GDATFGYSALDMSLDEK

SEQ ID NO: 3357407 - protein, 22 aa, Plasmodium falciparum
GDAWPCVLLRKKSFEDLHKLYY

SEQ ID NO: 3357408 - protein, 26 aa, Plasmodium falciparum
GDCLIAAAFCAYIGFFEHYERQRLKR

SEQ ID NO: 3357409 - protein, 17 aa, Plasmodium falciparum
GDECSFCHHPDHVLISA

SEQ ID NO: 3357410 - protein, 17 aa, Plasmodium falciparum
GDENNLSDTLIMLKTTI

SEQ ID NO: 3357411 - protein, 25 aa, Plasmodium falciparum
GDICGDFYVPVCLPGRYKYNVEDIE

SEQ ID NO: 3357412 - protein, 27 aa, Plasmodium falciparum
GDIKIYNFECSFIESFYDYKMKKNKEQ

SEQ ID NO: 3357413 - protein, 24 aa, Plasmodium falciparum
GDIKNMEIFWFNKLTKNRQKSIIE

SEQ ID NO: 3357414 - protein, 17 aa, Plasmodium falciparum
GDILFFLFSGHGSQEKD

SEQ ID NO: 3357415 - protein, 18 aa, Plasmodium falciparum
GDILRYNFVIDDIKQNTN

SEQ ID NO: 3357416 - protein, 21 aa, Plasmodium falciparum
GDILYLPCGWFHEVKSFSSEE

SEQ ID NO: 3357417 - protein, 18 aa, Plasmodium falciparum
GDIQIGLREQNGINNMNE

SEQ ID NO: 3357418 - protein, 20 aa, Plasmodium falciparum
GDISNCKELILKNRNIEECE

SEQ ID NO: 3357419 - protein, 18 aa, Plasmodium falciparum
GDISRMFLEYFKKKNYFD

SEQ ID NO: 3357420 - protein, 19 aa, Plasmodium falciparum
GDKDFKFNNVISATPDVIC

SEQ ID NO: 3357421 - protein, 17 aa, Plasmodium falciparum
GDKFISLCFKEEETCNT

SEQ ID NO: 3357422 - protein, 17 aa, Plasmodium falciparum
GDKHLKVNCSDNLKKMF

SEQ ID NO: 3357423 - protein, 22 aa, Plasmodium falciparum
GDKKLSDRKNGNFFSHRNNIKG

SEQ ID NO: 3357424 - protein, 17 aa, Plasmodium falciparum
GDKWTKFLNTFGKYLKI

SEQ ID NO: 3357425 - protein, 20 aa, Plasmodium falciparum
GDLIIKFSLKIPEKLTPRQV

SEQ ID NO: 3357426 - protein, 23 aa, Plasmodium falciparum
GDLIPCEYNYLGYEVEYKNEKVV

SEQ ID NO: 3357427 - protein, 18 aa, Plasmodium falciparum
GDLNSLYIGKYVIIGCGT

SEQ ID NO: 3357428 - protein, 24 aa, Plasmodium falciparum
GDLRITFINWLKKTQMNFIREKDK

SEQ ID NO: 3357429 - protein, 21 aa, Plasmodium falciparum
GDLYMNVELGLTRTSAMGINI

SEQ ID NO: 3357430 - protein, 19 aa, Plasmodium falciparum
GDMPRHLQLNVTRYLCEKM

SEQ ID NO: 3357431 - protein, 23 aa, Plasmodium falciparum
GDNNNVFSFYNFKANKLTNLTNH

SEQ ID NO: 3357432 - protein, 26 aa, Plasmodium falciparum
GDNQRNCEIENAFMILKDKIKTTNVE

SEQ ID NO: 3357433 - protein, 23 aa, Plasmodium falciparum
GDNTLSTPFVWKLKNKYEKIKNH

SEQ ID NO: 3357434 - protein, 20 aa, Plasmodium falciparum
GDNYIPVIHIRGLCEYIKQL

SEQ ID NO: 3357435 - protein, 21 aa, Plasmodium falciparum
GDPNKIIALEWSKQNDLLIVT

SEQ ID NO: 3357436 - protein, 21 aa, Plasmodium falciparum
GDPSFLNGLQVWYKMVRDDGW

SEQ ID NO: 3357437 - protein, 21 aa, Plasmodium falciparum
GDTFKVKWLMDKYGIQINKTS

SEQ ID NO: 3357438 - protein, 20 aa, Plasmodium falciparum
GDVKYHLGVEIDYYDEDSQR

SEQ ID NO: 3357439 - protein, 17 aa, Plasmodium falciparum
GDWGTQFGMIINYIKTH

SEQ ID NO: 3357440 - protein, 18 aa, Plasmodium falciparum
GDYDYYVHWEKFDRRLDC

SEQ ID NO: 3357441 - protein, 17 aa, Plasmodium falciparum
GDYELAIFHYTRSINYV

SEQ ID NO: 3357442 - protein, 23 aa, Plasmodium falciparum
GDYLSKHGFMYGGYNKKKYGIYT

SEQ ID NO: 3357443 - protein, 25 aa, Plasmodium falciparum
GDYSVLLLRHVFRSMRKIVSDAHVQ

SEQ ID NO: 3357444 - protein, 29 aa, Plasmodium falciparum
GEAEIARTLDGWYIKSFDLIQYNHYVTPC

SEQ ID NO: 3357445 - protein, 22 aa, Plasmodium falciparum
GEAKIATLRYLKIIEVLNKNSS

SEQ ID NO: 3357446 - protein, 20 aa, Plasmodium falciparum
GEALNSLCMLSNVNITTKNE

SEQ ID NO: 3357447 - protein, 24 aa, Plasmodium falciparum
GEAPCPRWKHGAVIFDKNMWISGG

SEQ ID NO: 3357448 - protein, 20 aa, Plasmodium falciparum
GEAYVIYKIIEKMIKIDNIN

SEQ ID NO: 3357449 - protein, 21 aa, Plasmodium falciparum
GECRYSWRLPLTNLLSDYNMN

SEQ ID NO: 3357450 - protein, 19 aa, Plasmodium falciparum
GEDSKICSLDDIKAEDTIK

SEQ ID NO: 3357451 - protein, 26 aa, Plasmodium falciparum
GEEITYNYSYNFLFNNFECLCKSPNC

SEQ ID NO: 3357452 - protein, 27 aa, Plasmodium falciparum
GEENKFYFNKELNRWVIKGEEDKIENE

SEQ ID NO: 3357453 - protein, 24 aa, Plasmodium falciparum
GEERELYSFDDCILQNDPLKYVNY

SEQ ID NO: 3357454 - protein, 25 aa, Plasmodium falciparum
GEFFNEKINECLNLLDKIAQGNKEQ

SEQ ID NO: 3357455 - protein, 21 aa, Plasmodium falciparum
GEGNMNNGFIVERANPYDRKN

SEQ ID NO: 3357456 - protein, 24 aa, Plasmodium falciparum
GEHNYKIGSVMSEIYNRNTDVDKS

SEQ ID NO: 3357457 - protein, 19 aa, Plasmodium falciparum
GEIFFEYFDTLNLNLSVSG

SEQ ID NO: 3357458 - protein, 20 aa, Plasmodium falciparum
GEIILRAGVFPFGSESYKNS

SEQ ID NO: 3357459 - protein, 17 aa, Plasmodium falciparum
GEIKCPIFSIKEDVLQY

SEQ ID NO: 3357460 - protein, 20 aa, Plasmodium falciparum
GEIKDLISFYSLPSKVLGNN

SEQ ID NO: 3357461 - protein, 32 aa, Plasmodium falciparum
GEIKDLIVMKSFWRKGQAWVVYDDKECATKAL

SEQ ID NO: 3357462 - protein, 23 aa, Plasmodium falciparum
GEISLTDCLACSGCVTNEETTFL

SEQ ID NO: 3357463 - protein, 20 aa, Plasmodium falciparum
GEIYKVNILIYQENGCILEI

SEQ ID NO: 3357464 - protein, 21 aa, Plasmodium falciparum
GEKKLFLNKCIKNGNVKYIEK

SEQ ID NO: 3357465 - protein, 20 aa, Plasmodium falciparum
GEKKTTWGLIYKCSNTRTLT

SEQ ID NO: 3357466 - protein, 22 aa, Plasmodium falciparum
GEKLKCSFFTPFNYNENTPCVI

SEQ ID NO: 3357467 - protein, 17 aa, Plasmodium falciparum
GEKLRIKEEKHKKKTEA

SEQ ID NO: 3357468 - protein, 20 aa, Plasmodium falciparum
GEKLVKCATYINNEKVYECS

SEQ ID NO: 3357469 - protein, 22 aa, Plasmodium falciparum
GEKNEFGIFVWNNECMYMGNIK

SEQ ID NO: 3357470 - protein, 25 aa, Plasmodium falciparum
GEKTLSSLALVFALHYFKPNPIYFM

SEQ ID NO: 3357471 - protein, 21 aa, Plasmodium falciparum
GELTPILVAMVIRNSKAHSLL

SEQ ID NO: 3357472 - protein, 19 aa, Plasmodium falciparum
GELVDGFVFSVNIASAKSL

SEQ ID NO: 3357473 - protein, 19 aa, Plasmodium falciparum
GELVFGVAHIFASFNDTFI

SEQ ID NO: 3357474 - protein, 20 aa, Plasmodium falciparum
GEMGMSPSMQKYMKQQATAQ

SEQ ID NO: 3357475 - protein, 26 aa, Plasmodium falciparum
GENHIAFLSKEGELFTYGDNTYAQLG

SEQ ID NO: 3357476 - protein, 18 aa, Plasmodium falciparum
GENHKPKELIKRTKKKSK

SEQ ID NO: 3357477 - protein, 21 aa, Plasmodium falciparum
GENHMNGWSAEDMFKLNEQKF

SEQ ID NO: 3357478 - protein, 24 aa, Plasmodium falciparum
GEQIYKKCSLERYNNLHNTECIDQ

SEQ ID NO: 3357479 - protein, 25 aa, Plasmodium falciparum
GERKRKSVRGCIVGQDLSALNLTLV

SEQ ID NO: 3357480 - protein, 21 aa, Plasmodium falciparum
GERSIVAICLFLCLNKIDNFS

SEQ ID NO: 3357481 - protein, 18 aa, Plasmodium falciparum
GESYEQIDSLNWEYSYDS

SEQ ID NO: 3357482 - protein, 20 aa, Plasmodium falciparum
GETIFPCHNLSIKPIQGSGV

SEQ ID NO: 3357483 - protein, 26 aa, Plasmodium falciparum
GETVDLNIWSDHIFAHKLDSKTTREN

SEQ ID NO: 3357484 - protein, 18 aa, Plasmodium falciparum
GETYRYILTMKKHITPYL

SEQ ID NO: 3357485 - protein, 17 aa, Plasmodium falciparum
GEVHFFMRNIKKINPFD

SEQ ID NO: 3357486 - protein, 22 aa, Plasmodium falciparum
GEVIKGWDICVSSMRKNEKCLV

SEQ ID NO: 3357487 - protein, 20 aa, Plasmodium falciparum
GEVLNSCHFFSPDTNEWQLG

SEQ ID NO: 3357488 - protein, 19 aa, Plasmodium falciparum
GEVSLIFNTLRTCDAIVES

SEQ ID NO: 3357489 - protein, 22 aa, Plasmodium falciparum
GEWWRTQFNSVFLPYLPAHISR

SEQ ID NO: 3357490 - protein, 25 aa, Plasmodium falciparum
GEYEVDILTEYVWHMAGNAKSSNEF

SEQ ID NO: 3357491 - protein, 24 aa, Plasmodium falciparum
GEYILKFCGEIHMQKCLSDFVNIY

SEQ ID NO: 3357492 - protein, 23 aa, Plasmodium falciparum
GEYKGQEANAFISNIKNKSEKNK

SEQ ID NO: 3357493 - protein, 25 aa, Plasmodium falciparum
GFAEVWEVFDSINLEMYAAKIHKIE

SEQ ID NO: 3357494 - protein, 18 aa, Plasmodium falciparum
GFDILRTTMGPFVCDVNG

SEQ ID NO: 3357495 - protein, 17 aa, Plasmodium falciparum
GFEYLKKYINNEENNLI

SEQ ID NO: 3357496 - protein, 17 aa, Plasmodium falciparum
GFFKNDFFSYLYEKSDM

SEQ ID NO: 3357497 - protein, 31 aa, Plasmodium falciparum
GFGIVTKMRFLTFPQYYAIKKISKDHIIKSQ

SEQ ID NO: 3357498 - protein, 27 aa, Plasmodium falciparum
GFGRIGRLVFRAAFGRKDIEVVAINDP

SEQ ID NO: 3357499 - protein, 25 aa, Plasmodium falciparum
GFHRCPRIIKSIPFEGESNYRSEFG

SEQ ID NO: 3357500 - protein, 20 aa, Plasmodium falciparum
GFICAEVYKYTDLVEYKSEG

SEQ ID NO: 3357501 - protein, 19 aa, Plasmodium falciparum
GFIKDICYFNKSKKQMNNN

SEQ ID NO: 3357502 - protein, 17 aa, Plasmodium falciparum
GFKKCKKVYIFPESKPS

SEQ ID NO: 3357503 - protein, 18 aa, Plasmodium falciparum
GFLISAFVIYPLKKHYGE

SEQ ID NO: 3357504 - protein, 17 aa, Plasmodium falciparum
GFNSGLIKKLCAGINYF

SEQ ID NO: 3357505 - protein, 21 aa, Plasmodium falciparum
GFNTFCKVFKGKLSKNTKLLN

SEQ ID NO: 3357506 - protein, 19 aa, Plasmodium falciparum
GFQIPIFVKWMKLYDKKDM

SEQ ID NO: 3357507 - protein, 22 aa, Plasmodium falciparum
GFRDYCGVLGLPSFGEKNELLT

SEQ ID NO: 3357508 - protein, 17 aa, Plasmodium falciparum
GFSECKNLQDLSPHIIG

SEQ ID NO: 3357509 - protein, 25 aa, Plasmodium falciparum
GFTREELSKILKFGAQKLWEKNSSK

SEQ ID NO: 3357510 - protein, 17 aa, Plasmodium falciparum
GFTSIIMIGTNNMNYII

SEQ ID NO: 3357511 - protein, 22 aa, Plasmodium falciparum
GFWKYPEKIWEVIRDISSDYEI

SEQ ID NO: 3357512 - protein, 18 aa, Plasmodium falciparum
GGAGLRSALELSKNKYKV

SEQ ID NO: 3357513 - protein, 20 aa, Plasmodium falciparum
GGCIALKMFEYIHKLNKEWK

SEQ ID NO: 3357514 - protein, 25 aa, Plasmodium falciparum
GGDKIGNVYIWSAISGFLINTFQAH

SEQ ID NO: 3357515 - protein, 20 aa, Plasmodium falciparum
GGELQRFALLMSIIGQSTNV

SEQ ID NO: 3357516 - protein, 26 aa, Plasmodium falciparum
GGFAYECALEYNCILGEVSLRIYRSS

SEQ ID NO: 3357517 - protein, 20 aa, Plasmodium falciparum
GGFGNLAGDINFYYKEVDNS

SEQ ID NO: 3357518 - protein, 26 aa, Plasmodium falciparum
GGFKDFFLKPELLRAISESGFEHPSE

SEQ ID NO: 3357519 - protein, 17 aa, Plasmodium falciparum
GGGCDLSPCYIFPDLFT

SEQ ID NO: 3357520 - protein, 21 aa, Plasmodium falciparum
GGGKRKGSFAVYIEPWHSDIF

SEQ ID NO: 3357521 - protein, 17 aa, Plasmodium falciparum
GGHTIRGDINVLLLGDP

SEQ ID NO: 3357522 - protein, 19 aa, Plasmodium falciparum
GGIATCIIQNPPIGIGEPI

SEQ ID NO: 3357523 - protein, 23 aa, Plasmodium falciparum
GGIKSSFFSSLRAHQLLNCKKYI

SEQ ID NO: 3357524 - protein, 19 aa, Plasmodium falciparum
GGILNNIYKSGSFHNNNYS

SEQ ID NO: 3357525 - protein, 32 aa, Plasmodium falciparum
GGIVKYLNIFSKLPFFYLFYPSSYKKKKRKKK

SEQ ID NO: 3357526 - protein, 20 aa, Plasmodium falciparum
GGKGTFRYLEKKIPSIEDSQ

SEQ ID NO: 3357527 - protein, 24 aa, Plasmodium falciparum
GGKKWNCNMCYNINDTPQFYFVPL

SEQ ID NO: 3357528 - protein, 20 aa, Plasmodium falciparum
GGKMKTDLFSPGNNYDKDIN

SEQ ID NO: 3357529 - protein, 24 aa, Plasmodium falciparum
GGLKAAAVNTCILALIDAGIAIKY

SEQ ID NO: 3357530 - protein, 25 aa, Plasmodium falciparum
GGLLNLCDVILCDKKDKFKYIDFKK

SEQ ID NO: 3357531 - protein, 20 aa, Plasmodium falciparum
GGNGCIFKALDRYNIIDHMI

SEQ ID NO: 3357532 - protein, 17 aa, Plasmodium falciparum
GGPDDFNSLHICPELDY

SEQ ID NO: 3357533 - protein, 18 aa, Plasmodium falciparum
GGPICPNTKYKVRSWETY

SEQ ID NO: 3357534 - protein, 19 aa, Plasmodium falciparum
GGRDYSNILFFKKYDEKDE

SEQ ID NO: 3357535 - protein, 18 aa, Plasmodium falciparum
GGRFLCLEFSKVQCHIFN

SEQ ID NO: 3357536 - protein, 19 aa, Plasmodium falciparum
GGSGDSLKIKEMVKEFSKN

SEQ ID NO: 3357537 - protein, 24 aa, Plasmodium falciparum
GGSHTFCKKSISSQLVASKIKETN

SEQ ID NO: 3357538 - protein, 25 aa, Plasmodium falciparum
GGSIHLAQLGNIVIVGERHNLRNNE

SEQ ID NO: 3357539 - protein, 24 aa, Plasmodium falciparum
GGTGICALCVLIVKDNIERKLQQR

SEQ ID NO: 3357540 - protein, 29 aa, Plasmodium falciparum
GGTTGERGSGFKGRIKALDNMMSQHYANN

SEQ ID NO: 3357541 - protein, 27 aa, Plasmodium falciparum
GGVGGSGGPCYRNMSSLNDVYSKGRYK

SEQ ID NO: 3357542 - protein, 23 aa, Plasmodium falciparum
GGVKGCSYCGGLGHRITQCSKLE

SEQ ID NO: 3357543 - protein, 29 aa, Plasmodium falciparum
GGVLKGEIKDLLLLDVIPLSLGIETLGGV

SEQ ID NO: 3357544 - protein, 17 aa, Plasmodium falciparum
GGYLLEDFEEIYPNEYY

SEQ ID NO: 3357545 - protein, 22 aa, Plasmodium falciparum
GHAKAHIVGIDIFTGRKYEDIC

SEQ ID NO: 3357546 - protein, 17 aa, Plasmodium falciparum
GHARCVEHVRSYNIPLL

SEQ ID NO: 3357547 - protein, 27 aa, Plasmodium falciparum
GHDMSTLKFSTKYSHKDIHIKSKNDIK

SEQ ID NO: 3357548 - protein, 25 aa, Plasmodium falciparum
GHIASMYYIKCETVYFFYTSIQAGK

SEQ ID NO: 3357549 - protein, 23 aa, Plasmodium falciparum
GHIKSLPLKKFHTDYENCRMNCS

SEQ ID NO: 3357550 - protein, 17 aa, Plasmodium falciparum
GHLAYTFLLEKTPKQIS

SEQ ID NO: 3357551 - protein, 17 aa, Plasmodium falciparum
GHLEPLRVHTVLISTQH

SEQ ID NO: 3357552 - protein, 20 aa, Plasmodium falciparum
GHLRLRKVIFASYTNSSALD

SEQ ID NO: 3357553 - protein, 18 aa, Plasmodium falciparum
GHMKYNCYNHDMLYNEHE

SEQ ID NO: 3357554 - protein, 23 aa, Plasmodium falciparum
GHRTFRLQGWHILQEQIMLRYIE

SEQ ID NO: 3357555 - protein, 19 aa, Plasmodium falciparum
GHVQKCFNNVWIYIHLKNE

SEQ ID NO: 3357556 - protein, 18 aa, Plasmodium falciparum
GIAKRVNVGLSERALSKI

SEQ ID NO: 3357557 - protein, 35 aa, Plasmodium falciparum
GIASLKIDKFYPIFQILKKNICKFNCIEGEHSILN

SEQ ID NO: 3357558 - protein, 17 aa, Plasmodium falciparum
GICLFVNVYSIMFLECI

SEQ ID NO: 3357559 - protein, 21 aa, Plasmodium falciparum
GICLKGEYHDESILKWTCEQI

SEQ ID NO: 3357560 - protein, 18 aa, Plasmodium falciparum
GICSMSYGTLHKSNPLLW

SEQ ID NO: 3357561 - protein, 18 aa, Plasmodium falciparum
GICSSRFVNNNVQNGLFK

SEQ ID NO: 3357562 - protein, 18 aa, Plasmodium falciparum
GICYLKRKDGFLFDEKKK

SEQ ID NO: 3357563 - protein, 18 aa, Plasmodium falciparum
GIDIKNIILVINYQCPDH

SEQ ID NO: 3357564 - protein, 20 aa, Plasmodium falciparum
GIDMWTLPISLAISKKNRYL

SEQ ID NO: 3357565 - protein, 17 aa, Plasmodium falciparum
GIDRESFEYLLDYFHNM

SEQ ID NO: 3357566 - protein, 19 aa, Plasmodium falciparum
GIEIAKSFLNITCSDEKFI

SEQ ID NO: 3357567 - protein, 22 aa, Plasmodium falciparum
GIELNISPSINVIVKEEGGSLI

SEQ ID NO: 3357568 - protein, 18 aa, Plasmodium falciparum
GIENCIELFYSHLHHYVI

SEQ ID NO: 3357569 - protein, 23 aa, Plasmodium falciparum
GIESCKKKIFGYVENMPGEKNWL

SEQ ID NO: 3357570 - protein, 22 aa, Plasmodium falciparum
GIEYDYYITYYFNQENFFPTKK

SEQ ID NO: 3357571 - protein, 25 aa, Plasmodium falciparum
GIFLRAHIERGIFYFDHSFRPVQIE

SEQ ID NO: 3357572 - protein, 19 aa, Plasmodium falciparum
GIFRIVDALMIFRDNIQPM

SEQ ID NO: 3357573 - protein, 18 aa, Plasmodium falciparum
GIGLKTILLYSLKTAYGF

SEQ ID NO: 3357574 - protein, 30 aa, Plasmodium falciparum
GIIGQKYYLCFINQLIKHWKILNKKYSEMD

SEQ ID NO: 3357575 - protein, 19 aa, Plasmodium falciparum
GIIGSGPSALYCCKHFLKN

SEQ ID NO: 3357576 - protein, 18 aa, Plasmodium falciparum
GIKDCFSSSCGKTKTKGN

SEQ ID NO: 3357577 - protein, 22 aa, Plasmodium falciparum
GIKKEEIFTHFINVYHDNEKET

SEQ ID NO: 3357578 - protein, 22 aa, Plasmodium falciparum
GIKYPEYYTVLFALSRSIGVMS

SEQ ID NO: 3357579 - protein, 18 aa, Plasmodium falciparum
GILNEYKLVKNVRSNSNS

SEQ ID NO: 3357580 - protein, 19 aa, Plasmodium falciparum
GINHFPCNDINNISYPEQK

SEQ ID NO: 3357581 - protein, 19 aa, Plasmodium falciparum
GINIDEIFMTHFLENDNFM

SEQ ID NO: 3357582 - protein, 19 aa, Plasmodium falciparum
GINIELCKNLILNGINITI

SEQ ID NO: 3357583 - protein, 23 aa, Plasmodium falciparum
GINLKPFVRYKSLSILEKEKNKN

SEQ ID NO: 3357584 - protein, 19 aa, Plasmodium falciparum
GINSCYGYVGLKSKELDIQ

SEQ ID NO: 3357585 - protein, 24 aa, Plasmodium falciparum
GIPIDIIDNILIKICNFEEIKIKL

SEQ ID NO: 3357586 - protein, 18 aa, Plasmodium falciparum
GIQKTIRLLNLFSNSEKK

SEQ ID NO: 3357587 - protein, 22 aa, Plasmodium falciparum
GIQSSLRFAMLLLEPSRILATL

SEQ ID NO: 3357588 - protein, 19 aa, Plasmodium falciparum
GISKRCAFVNYAYKEQGIF

SEQ ID NO: 3357589 - protein, 18 aa, Plasmodium falciparum
GISSVCNIASYRNSTSFE

SEQ ID NO: 3357590 - protein, 23 aa, Plasmodium falciparum
GITNKCWYGGEIMNSSTKNRKLE

SEQ ID NO: 3357591 - protein, 36 aa, Plasmodium falciparum
GIVFKKWKFKNFGLYFWYHIKCIENERDLNFYIKIF

SEQ ID NO: 3357592 - protein, 19 aa, Plasmodium falciparum
GIYGTCPSIYCENAKLLPT

SEQ ID NO: 3357593 - protein, 20 aa, Plasmodium falciparum
GIYIKNIILQGAKWDFISQS

SEQ ID NO: 3357594 - protein, 27 aa, Plasmodium falciparum
GIYMSNECKREMKNFHVSDNMSDHHVD

SEQ ID NO: 3357595 - protein, 29 aa, Plasmodium falciparum
GIYYKDIHILDFFPQIHFSKTTHLVHYPS

SEQ ID NO: 3357596 - protein, 20 aa, Plasmodium falciparum
GKARDFWSLGCTIYQLVTCT

SEQ ID NO: 3357597 - protein, 25 aa, Plasmodium falciparum
GKCINKSRQSIICIIDNDSYIKECN

SEQ ID NO: 3357598 - protein, 23 aa, Plasmodium falciparum
GKDACIIEWDIIKGEKVHIYKGN

SEQ ID NO: 3357599 - protein, 26 aa, Plasmodium falciparum
GKDGFIKIYHLITGNIIMCIRAHNYP

SEQ ID NO: 3357600 - protein, 20 aa, Plasmodium falciparum
GKDHKGVVEDEYKVESVQQN

SEQ ID NO: 3357601 - protein, 20 aa, Plasmodium falciparum
GKDKVMIYFLNPGFQKRLLE

SEQ ID NO: 3357602 - protein, 20 aa, Plasmodium falciparum
GKDLLKNKITIILNKPKHYL

SEQ ID NO: 3357603 - protein, 17 aa, Plasmodium falciparum
GKDLSRIGMPIYLNEPS

SEQ ID NO: 3357604 - protein, 17 aa, Plasmodium falciparum
GKDNIKCEDNIKCEDNI

SEQ ID NO: 3357605 - protein, 30 aa, Plasmodium falciparum
GKDYGLNGCKIMNKDFFNGKMKREIRKTKY

SEQ ID NO: 3357606 - protein, 21 aa, Plasmodium falciparum
GKEGKFIPNNLYVTVEMNVET

SEQ ID NO: 3357607 - protein, 23 aa, Plasmodium falciparum
GKEIFKIPVENVVDESLPPMNFT

SEQ ID NO: 3357608 - protein, 17 aa, Plasmodium falciparum
GKEKCKEKDKYKDKEFD

SEQ ID NO: 3357609 - protein, 22 aa, Plasmodium falciparum
GKELKSHKNIKEEKGGIEKTDT

SEQ ID NO: 3357610 - protein, 20 aa, Plasmodium falciparum
GKEVSPCVVRFVLDVETTAW

SEQ ID NO: 3357611 - protein, 20 aa, Plasmodium falciparum
GKFCDLKYILSESLINTLEK

SEQ ID NO: 3357612 - protein, 19 aa, Plasmodium falciparum
GKFKFELFQNIVPRTSENF

SEQ ID NO: 3357613 - protein, 17 aa, Plasmodium falciparum
GKFKKYYTTPPIPDNNN

SEQ ID NO: 3357614 - protein, 23 aa, Plasmodium falciparum
GKFYIRAQCKDYDTFFESFVDFL

SEQ ID NO: 3357615 - protein, 24 aa, Plasmodium falciparum
GKFYPFLFFPRFGVGRDRSGLGYG

SEQ ID NO: 3357616 - protein, 24 aa, Plasmodium falciparum
GKGDLGIYISLAFPNVLVIILDIN

SEQ ID NO: 3357617 - protein, 37 aa, Plasmodium falciparum
GKGEMPNVSTWQFNFKFDLDSDMYAQNSIDFLKLSGI

SEQ ID NO: 3357618 - protein, 18 aa, Plasmodium falciparum
GKGIPHILEHSVLSGSKN

SEQ ID NO: 3357619 - protein, 18 aa, Plasmodium falciparum
GKGKGIRRNLRGRKGKNK

SEQ ID NO: 3357620 - protein, 37 aa, Plasmodium falciparum
GKGSSLFSYLFSIRYKMQFFFSHVIRYLQEDIINYEY

SEQ ID NO: 3357621 - protein, 17 aa, Plasmodium falciparum
GKGYILKGVNKEFIDDR

SEQ ID NO: 3357622 - protein, 27 aa, Plasmodium falciparum
GKHLHQFKARYYILFDNLLYYYDKKRN

SEQ ID NO: 3357623 - protein, 25 aa, Plasmodium falciparum
GKHPSYHFNKDFSLLNNVTLTNFDP

SEQ ID NO: 3357624 - protein, 20 aa, Plasmodium falciparum
GKIGEVLSCDKFRNMVKVKG

SEQ ID NO: 3357625 - protein, 18 aa, Plasmodium falciparum
GKIIKNIYQGSVNYYNKI

SEQ ID NO: 3357626 - protein, 18 aa, Plasmodium falciparum
GKILEVVDFMSLLHHLTE

SEQ ID NO: 3357627 - protein, 18 aa, Plasmodium falciparum
GKINCCSVKKNEISKIEN

SEQ ID NO: 3357628 - protein, 17 aa, Plasmodium falciparum
GKINLFYSKFFQDYITN

SEQ ID NO: 3357629 - protein, 17 aa, Plasmodium falciparum
GKIPYFVNPDKYLTEQD

SEQ ID NO: 3357630 - protein, 19 aa, Plasmodium falciparum
GKITINIDVVQKLNKIMDK

SEQ ID NO: 3357631 - protein, 17 aa, Plasmodium falciparum
GKIYAIGGSTGVKNLSS

SEQ ID NO: 3357632 - protein, 18 aa, Plasmodium falciparum
GKIYAYIGAVVGHDILHD

SEQ ID NO: 3357633 - protein, 19 aa, Plasmodium falciparum
GKKDAMWKEYVLLKNKKSK

SEQ ID NO: 3357634 - protein, 23 aa, Plasmodium falciparum
GKKDLKNKFSHASNLASGHAHFN

SEQ ID NO: 3357635 - protein, 19 aa, Plasmodium falciparum
GKKDLLIMLINDLTHGKIK

SEQ ID NO: 3357636 - protein, 23 aa, Plasmodium falciparum
GKKELLFGHPKCMEYVNTAYAKK

SEQ ID NO: 3357637 - protein, 23 aa, Plasmodium falciparum
GKKEMKFSIDNLFSNIQKEVEEQ

SEQ ID NO: 3357638 - protein, 18 aa, Plasmodium falciparum
GKKFKGYMLKVEYSIEKK

SEQ ID NO: 3357639 - protein, 23 aa, Plasmodium falciparum
GKKLKCCTKEGLDIDDSEEAKKD

SEQ ID NO: 3357640 - protein, 20 aa, Plasmodium falciparum
GKKMDAYTFFIGTNRANALD

SEQ ID NO: 3357641 - protein, 19 aa, Plasmodium falciparum
GKKMKECQIIGNGTIIKDI

SEQ ID NO: 3357642 - protein, 20 aa, Plasmodium falciparum
GKKQILFRGHFNKISNVIKS

SEQ ID NO: 3357643 - protein, 27 aa, Plasmodium falciparum
GKKRTGFYDLEIDGVISSFEARKGVYY

SEQ ID NO: 3357644 - protein, 24 aa, Plasmodium falciparum
GKKSSYWLLRNSWGSHWGDKGNFK

SEQ ID NO: 3357645 - protein, 20 aa, Plasmodium falciparum
GKKSYGLKKKYTMNRRLHKA

SEQ ID NO: 3357646 - protein, 28 aa, Plasmodium falciparum
GKKYFPIKLYRRIIIELLNMEHISVNTI

SEQ ID NO: 3357647 - protein, 21 aa, Plasmodium falciparum
GKKYICESICPNLYNCKLSKL

SEQ ID NO: 3357648 - protein, 20 aa, Plasmodium falciparum
GKLELFFNVSNGFIKDGNIF

SEQ ID NO: 3357649 - protein, 32 aa, Plasmodium falciparum
GKLISKIFIDLEIPYISNVVYCYCNKFDDWII

SEQ ID NO: 3357650 - protein, 30 aa, Plasmodium falciparum
GKLKGLELSYRLLVHDILFYAFFSYLSDLP

SEQ ID NO: 3357651 - protein, 20 aa, Plasmodium falciparum
GKLKKFSLLLKMKEYEIWKK

SEQ ID NO: 3357652 - protein, 17 aa, Plasmodium falciparum
GKLKLKKDIFKKDDKKG

SEQ ID NO: 3357653 - protein, 20 aa, Plasmodium falciparum
GKLLTVICKSGTLKVNTYFI

SEQ ID NO: 3357654 - protein, 20 aa, Plasmodium falciparum
GKLLYNFLPDYFKKTSHIYC

SEQ ID NO: 3357655 - protein, 24 aa, Plasmodium falciparum
GKLNSLKKILCDIINEQVKEEKKR

SEQ ID NO: 3357656 - protein, 20 aa, Plasmodium falciparum
GKLYILEKRLLWINENANKK

SEQ ID NO: 3357657 - protein, 19 aa, Plasmodium falciparum
GKLYPEGYNENNFDVRYNY

SEQ ID NO: 3357658 - protein, 32 aa, Plasmodium falciparum
GKMDSSYFVSRKELIEWVNRYLKLNITKVEQC

SEQ ID NO: 3357659 - protein, 22 aa, Plasmodium falciparum
GKMERVCLFLNLANDPTIERIL

SEQ ID NO: 3357660 - protein, 28 aa, Plasmodium falciparum
GKMKFHFLNKFEFLFSVLKEYENKYVYK

SEQ ID NO: 3357661 - protein, 19 aa, Plasmodium falciparum
GKNFKIRYSSKCKSNKTWK

SEQ ID NO: 3357662 - protein, 19 aa, Plasmodium falciparum
GKNIKFVLTNCNYKTNVLK

SEQ ID NO: 3357663 - protein, 24 aa, Plasmodium falciparum
GKNLCSFKLSLQIEKYAKKNNIPI

SEQ ID NO: 3357664 - protein, 25 aa, Plasmodium falciparum
GKNNACLFISMKYHRLRSNYLKARI

SEQ ID NO: 3357665 - protein, 19 aa, Plasmodium falciparum
GKNSLKGNMMNSNVCINNN

SEQ ID NO: 3357666 - protein, 20 aa, Plasmodium falciparum
GKNVIINGIVLRRWKRLYKD

SEQ ID NO: 3357667 - protein, 17 aa, Plasmodium falciparum
GKPGRKKKIKLEIENVS

SEQ ID NO: 3357668 - protein, 19 aa, Plasmodium falciparum
GKQHPKWVVKDKEKYNIFT

SEQ ID NO: 3357669 - protein, 41 aa, Plasmodium falciparum
GKQIKRRFKIKYYGWDEAKSLAIKARFAFENKTKNLKGKKG

SEQ ID NO: 3357670 - protein, 21 aa, Plasmodium falciparum
GKQKGCVDYIFYSYKNLKQVS

SEQ ID NO: 3357671 - protein, 18 aa, Plasmodium falciparum
GKRKIKFFSLLKKYYYSN

SEQ ID NO: 3357672 - protein, 17 aa, Plasmodium falciparum
GKRRKINILNIFDNNIK

SEQ ID NO: 3357673 - protein, 21 aa, Plasmodium falciparum
GKRSYSLWGNYFIIENKLDPV

SEQ ID NO: 3357674 - protein, 22 aa, Plasmodium falciparum
GKSENKSILEIKKEGQIKNVIY

SEQ ID NO: 3357675 - protein, 18 aa, Plasmodium falciparum
GKSGHLFVTINIEPHKIF

SEQ ID NO: 3357676 - protein, 17 aa, Plasmodium falciparum
GKSGSLFYFTSNGKYII

SEQ ID NO: 3357677 - protein, 18 aa, Plasmodium falciparum
GKSIRILIRSNKWNTSDI

SEQ ID NO: 3357678 - protein, 20 aa, Plasmodium falciparum
GKSLFYDKKIENINVKNPPL

SEQ ID NO: 3357679 - protein, 23 aa, Plasmodium falciparum
GKSRSIKSRSHFSGDNEYIQDQL

SEQ ID NO: 3357680 - protein, 21 aa, Plasmodium falciparum
GKSSIINCLIGKKKVSVSRQP

SEQ ID NO: 3357681 - protein, 38 aa, Plasmodium falciparum
GKSTYPLEKCILPFAEDYCFKYVCLLLNNGGKREVRIL

SEQ ID NO: 3357682 - protein, 19 aa, Plasmodium falciparum
GKTACFIIPILQDLKVNKQ

SEQ ID NO: 3357683 - protein, 23 aa, Plasmodium falciparum
GKTCSFLIPLLIKLNNIYLEKHE

SEQ ID NO: 3357684 - protein, 24 aa, Plasmodium falciparum
GKTKRFFWEALFENDIPGTLFEDK

SEQ ID NO: 3357685 - protein, 24 aa, Plasmodium falciparum
GKTLCLLCASISYVVDILEKKGHF

SEQ ID NO: 3357686 - protein, 21 aa, Plasmodium falciparum
GKTNIALLCILNVINSYRLTS

SEQ ID NO: 3357687 - protein, 25 aa, Plasmodium falciparum
GKTNIFRNFFKNLFFFNDKNKKKKP

SEQ ID NO: 3357688 - protein, 23 aa, Plasmodium falciparum
GKTSLCKCLSQVLSTCALDKHKE

SEQ ID NO: 3357689 - protein, 18 aa, Plasmodium falciparum
GKTSSNIYDYFLDKKEHD

SEQ ID NO: 3357690 - protein, 21 aa, Plasmodium falciparum
GKTTLLDRLRHSNIADNEIGG

SEQ ID NO: 3357691 - protein, 22 aa, Plasmodium falciparum
GKVELKSAVKTVPENKTSNEQK

SEQ ID NO: 3357692 - protein, 17 aa, Plasmodium falciparum
GKVFYKDRVDELKGGAR

SEQ ID NO: 3357693 - protein, 18 aa, Plasmodium falciparum
GKVIEQFLPFSANDPNVT

SEQ ID NO: 3357694 - protein, 19 aa, Plasmodium falciparum
GKVLCVNKLLNLLNDKYSY

SEQ ID NO: 3357695 - protein, 28 aa, Plasmodium falciparum
GKVNLKVRIPKTVWHYWEAVAEESLKIN

SEQ ID NO: 3357696 - protein, 21 aa, Plasmodium falciparum
GKVTLKCHLSGMPLCELSTNN

SEQ ID NO: 3357697 - protein, 23 aa, Plasmodium falciparum
GKVVPLNLCALTFHPNIPPIYLM

SEQ ID NO: 3357698 - protein, 28 aa, Plasmodium falciparum
GKVYNRFINRCFKRKLYHHEHEKNEPFD

SEQ ID NO: 3357699 - protein, 17 aa, Plasmodium falciparum
GKYCSMCAYKLGKCHIC

SEQ ID NO: 3357700 - protein, 18 aa, Plasmodium falciparum
GKYIFKIYECDDIDELFL

SEQ ID NO: 3357701 - protein, 20 aa, Plasmodium falciparum
GKYKKIYEKIQEGMFPPCEE

SEQ ID NO: 3357702 - protein, 20 aa, Plasmodium falciparum
GKYLSSKYCRLHNIPYLGIC

SEQ ID NO: 3357703 - protein, 17 aa, Plasmodium falciparum
GKYMFMINYVFCEESNN

SEQ ID NO: 3357704 - protein, 33 aa, Plasmodium falciparum
GKYVFSNKCVRTFPLIHSCRGIFISKMSIGPEV

SEQ ID NO: 3357705 - protein, 19 aa, Plasmodium falciparum
GLCHLISLLKIFTHQNLIS

SEQ ID NO: 3357706 - protein, 25 aa, Plasmodium falciparum
GLDVLEKKNTFGFLDNNYQNYGSNN

SEQ ID NO: 3357707 - protein, 25 aa, Plasmodium falciparum
GLEGKNREKNICRNWKDEKSQHEFY

SEQ ID NO: 3357708 - protein, 17 aa, Plasmodium falciparum
GLENMNSEMCEFKNSEK

SEQ ID NO: 3357709 - protein, 19 aa, Plasmodium falciparum
GLIGLRSFIIFCKNEEKMK

SEQ ID NO: 3357710 - protein, 19 aa, Plasmodium falciparum
GLIHFSFQVIYTLLYLKHF

SEQ ID NO: 3357711 - protein, 18 aa, Plasmodium falciparum
GLIIPQELLGVFVDPYKE

SEQ ID NO: 3357712 - protein, 23 aa, Plasmodium falciparum
GLIKKESLEFINILICCNYIEKI

SEQ ID NO: 3357713 - protein, 24 aa, Plasmodium falciparum
GLIKKLCAGINYFSHSDSVINKTF

SEQ ID NO: 3357714 - protein, 20 aa, Plasmodium falciparum
GLIKVESFGSASSSSREVYT

SEQ ID NO: 3357715 - protein, 18 aa, Plasmodium falciparum
GLIYHYPNYDKIKTNAPK

SEQ ID NO: 3357716 - protein, 18 aa, Plasmodium falciparum
GLKFYPFCNNLKKNINFV

SEQ ID NO: 3357717 - protein, 25 aa, Plasmodium falciparum
GLKINRKYLPLAYILGLDNVKISFS

SEQ ID NO: 3357718 - protein, 19 aa, Plasmodium falciparum
GLLCIKNILHNIAEKKIIK

SEQ ID NO: 3357719 - protein, 22 aa, Plasmodium falciparum
GLLHIGHAFTLSKLDFIVRYKN

SEQ ID NO: 3357720 - protein, 21 aa, Plasmodium falciparum
GLLKLKFTNTFLLSLMNRHFI

SEQ ID NO: 3357721 - protein, 20 aa, Plasmodium falciparum
GLLNIKKIYLFKETEKDIFY

SEQ ID NO: 3357722 - protein, 17 aa, Plasmodium falciparum
GLLRGIYAYGFEKPSAI

SEQ ID NO: 3357723 - protein, 18 aa, Plasmodium falciparum
GLLYGNGENVFFSIFKNA

SEQ ID NO: 3357724 - protein, 23 aa, Plasmodium falciparum
GLMDEGRLNFIHTAGKHVDKNNM

SEQ ID NO: 3357725 - protein, 18 aa, Plasmodium falciparum
GLNNIGFVIVNNTCEEMN

SEQ ID NO: 3357726 - protein, 26 aa, Plasmodium falciparum
GLNNWSRVASLLVRKSAKQCKARWYE

SEQ ID NO: 3357727 - protein, 24 aa, Plasmodium falciparum
GLNYICATPERFYAVSTVLANMVN

SEQ ID NO: 3357728 - protein, 22 aa, Plasmodium falciparum
GLPLWLRPYEILVTGSNSGIIE

SEQ ID NO: 3357729 - protein, 25 aa, Plasmodium falciparum
GLPVAICAYDYLLFIITCPYIYENV

SEQ ID NO: 3357730 - protein, 23 aa, Plasmodium falciparum
GLQDFRGPTGIWTNEHLNELKNK

SEQ ID NO: 3357731 - protein, 25 aa, Plasmodium falciparum
GLQKLKWYCQMCEKQCRDENGFKCH

SEQ ID NO: 3357732 - protein, 30 aa, Plasmodium falciparum
GLSKEYKCEICGNYSYFGRATFEKHFYEWR

SEQ ID NO: 3357733 - protein, 18 aa, Plasmodium falciparum
GLSSPVSNVEQFVIDDMM

SEQ ID NO: 3357734 - protein, 18 aa, Plasmodium falciparum
GLTLSNCTFLRNIHNSYK

SEQ ID NO: 3357735 - protein, 31 aa, Plasmodium falciparum
GLVYFSVDPNDLWKNYFLSWIDKHDNFNSNI

SEQ ID NO: 3357736 - protein, 19 aa, Plasmodium falciparum
GMCLYYILRGKVNVNVLKK

SEQ ID NO: 3357737 - protein, 25 aa, Plasmodium falciparum
GMEQECWRSNKKFDDMNNRNNSLNN

SEQ ID NO: 3357738 - protein, 20 aa, Plasmodium falciparum
GMGLAWKAQNFVTAGSFAKR

SEQ ID NO: 3357739 - protein, 18 aa, Plasmodium falciparum
GMIWFSRDILSPIILFKH

SEQ ID NO: 3357740 - protein, 22 aa, Plasmodium falciparum
GMKNNLIKREEVEVHYLTINKY

SEQ ID NO: 3357741 - protein, 24 aa, Plasmodium falciparum
GMLLKSSFSNFILESIGWTYENIS

SEQ ID NO: 3357742 - protein, 19 aa, Plasmodium falciparum
GMLPRSLAEFFNGIENPSS

SEQ ID NO: 3357743 - protein, 24 aa, Plasmodium falciparum
GMMRKLRRNKKFKIKKNILSLHDV

SEQ ID NO: 3357744 - protein, 21 aa, Plasmodium falciparum
GMPGDCLSMVYKARSEASEFL

SEQ ID NO: 3357745 - protein, 17 aa, Plasmodium falciparum
GMVKTWSPLLIGKQIDG

SEQ ID NO: 3357746 - protein, 23 aa, Plasmodium falciparum
GNAAWPMGVTMVGIHERAGRSKI

SEQ ID NO: 3357747 - protein, 21 aa, Plasmodium falciparum
GNAILYECVKTITYISTDPGL

SEQ ID NO: 3357748 - protein, 17 aa, Plasmodium falciparum
GNAKVLSRHHFISREKI

SEQ ID NO: 3357749 - protein, 25 aa, Plasmodium falciparum
GNAYNISYMFIYQYYYVLHTKKEMM

SEQ ID NO: 3357750 - protein, 30 aa, Plasmodium falciparum
GNCIFDIIVCIPYGVLIFFSSYSSMTETVN

SEQ ID NO: 3357751 - protein, 24 aa, Plasmodium falciparum
GNCLCDPLKCTNKFPEGLHYPIKV

SEQ ID NO: 3357752 - protein, 17 aa, Plasmodium falciparum
GNCNGKCNGNGNGNGNG

SEQ ID NO: 3357753 - protein, 19 aa, Plasmodium falciparum
GNCRASVIVAVHPSHFYLD

SEQ ID NO: 3357754 - protein, 20 aa, Plasmodium falciparum
GNCRKGSFLFKKKKKKKKGK

SEQ ID NO: 3357755 - protein, 23 aa, Plasmodium falciparum
GNDEFLYRTQLPSFTSLSNRIKI

SEQ ID NO: 3357756 - protein, 34 aa, Plasmodium falciparum
GNDKAKLRAKELIEKLKSGITFEQLYPDKGPPIV

SEQ ID NO: 3357757 - protein, 17 aa, Plasmodium falciparum
GNDRLYSIIPDNISESD

SEQ ID NO: 3357758 - protein, 18 aa, Plasmodium falciparum
GNEIDISILQEFVSKNKE

SEQ ID NO: 3357759 - protein, 22 aa, Plasmodium falciparum
GNELIHFLIYFFRWNKNDKNLI

SEQ ID NO: 3357760 - protein, 26 aa, Plasmodium falciparum
GNENMLFKKGGSIMNFGDVDNNTTCA

SEQ ID NO: 3357761 - protein, 26 aa, Plasmodium falciparum
GNEPHAASVFCCIATLFLIQKLYLIN

SEQ ID NO: 3357762 - protein, 29 aa, Plasmodium falciparum
GNESIKLWLCKFSLNSISECSCVYIEFEQ

SEQ ID NO: 3357763 - protein, 23 aa, Plasmodium falciparum
GNFDFLNNLFHLCKDYNTCHNNE

SEQ ID NO: 3357764 - protein, 22 aa, Plasmodium falciparum
GNFNFPNANMNLDFNTTNVTDN

SEQ ID NO: 3357765 - protein, 26 aa, Plasmodium falciparum
GNFTLCKGFAFTFLFIESYKNLDEFT

SEQ ID NO: 3357766 - protein, 19 aa, Plasmodium falciparum
GNFYKNVRRAYKIENKQPF

SEQ ID NO: 3357767 - protein, 24 aa, Plasmodium falciparum
GNGGDGICCFTVFSQKKNKKYASG

SEQ ID NO: 3357768 - protein, 21 aa, Plasmodium falciparum
GNGHCGLGVKCAKEVATAIRG

SEQ ID NO: 3357769 - protein, 25 aa, Plasmodium falciparum
GNGIYKTKDGFIFDGSFKENKRHGK

SEQ ID NO: 3357770 - protein, 27 aa, Plasmodium falciparum
GNGNILRISLPCSYNTIKKKIMELTNI

SEQ ID NO: 3357771 - protein, 24 aa, Plasmodium falciparum
GNHIDMIKCISFNKDYSMLLSAGN

SEQ ID NO: 3357772 - protein, 19 aa, Plasmodium falciparum
GNHMGEFISLKSFQNKKYS

SEQ ID NO: 3357773 - protein, 25 aa, Plasmodium falciparum
GNHPLAVQMFEKWGTVGRYVGIEFS

SEQ ID NO: 3357774 - protein, 24 aa, Plasmodium falciparum
GNIIPRLYLLIIVGRNYIKNKDIK

SEQ ID NO: 3357775 - protein, 17 aa, Plasmodium falciparum
GNILIKDFIQFLNVTFD

SEQ ID NO: 3357776 - protein, 17 aa, Plasmodium falciparum
GNINQHRFFSLIIKHKR

SEQ ID NO: 3357777 - protein, 24 aa, Plasmodium falciparum
GNINRKDFKIVYISPMKALVNEQV

SEQ ID NO: 3357778 - protein, 20 aa, Plasmodium falciparum
GNIRGFGGSDFGSFRMSNEF

SEQ ID NO: 3357779 - protein, 19 aa, Plasmodium falciparum
GNIRRFNKNITFYEKKTNI

SEQ ID NO: 3357780 - protein, 18 aa, Plasmodium falciparum
GNISNIYTHNVIPDQHIN

SEQ ID NO: 3357781 - protein, 25 aa, Plasmodium falciparum
GNIYQLPTRAPSICPSMVPNTSNYF

SEQ ID NO: 3357782 - protein, 22 aa, Plasmodium falciparum
GNKCIKETPIIIEIHKNDVLDL

SEQ ID NO: 3357783 - protein, 25 aa, Plasmodium falciparum
GNKFMSSYKKFYCFVTATDVKHKPY

SEQ ID NO: 3357784 - protein, 23 aa, Plasmodium falciparum
GNKLNVCNACLFCNNNNSQNHMN

SEQ ID NO: 3357785 - protein, 24 aa, Plasmodium falciparum
GNKMTAALVTFLFVLKNNIRENVN

SEQ ID NO: 3357786 - protein, 26 aa, Plasmodium falciparum
GNKRRIMNITNIFKIYNLKNNNENNK

SEQ ID NO: 3357787 - protein, 24 aa, Plasmodium falciparum
GNKYEKYSNLSFFKKTDKDNKINK

SEQ ID NO: 3357788 - protein, 25 aa, Plasmodium falciparum
GNKYKGNLINIFFIYSDIQQLIFTY

SEQ ID NO: 3357789 - protein, 19 aa, Plasmodium falciparum
GNLCDLFLLNGNNYKEFLR

SEQ ID NO: 3357790 - protein, 25 aa, Plasmodium falciparum
GNLFDLLDFFNLYNWPMHNNKNLLL

SEQ ID NO: 3357791 - protein, 18 aa, Plasmodium falciparum
GNLHFPLTNQNEINLCEE

SEQ ID NO: 3357792 - protein, 25 aa, Plasmodium falciparum
GNLKHSYNTFEFLKNCDKQKEINNN

SEQ ID NO: 3357793 - protein, 29 aa, Plasmodium falciparum
GNLKIMIAACDTFRAGAVEQLRIHANCLN

SEQ ID NO: 3357794 - protein, 34 aa, Plasmodium falciparum
GNLNCSEITLFPARTFPIQRFFFVNEYVELEITD

SEQ ID NO: 3357795 - protein, 18 aa, Plasmodium falciparum
GNLNGSVEIYELKREFEE

SEQ ID NO: 3357796 - protein, 20 aa, Plasmodium falciparum
GNLYKSRLALLKKNKVRISK

SEQ ID NO: 3357797 - protein, 31 aa, Plasmodium falciparum
GNMKSVFLNNIFCSFPFLYKNDHMFMIDISN

SEQ ID NO: 3357798 - protein, 24 aa, Plasmodium falciparum
GNMNLRDPILYRIMYKIHPKTKNK

SEQ ID NO: 3357799 - protein, 19 aa, Plasmodium falciparum
GNMTHKWTCLVRCPESTDI

SEQ ID NO: 3357800 - protein, 26 aa, Plasmodium falciparum
GNNDDCFRLGIKILEGDKKIHLYSPF

SEQ ID NO: 3357801 - protein, 19 aa, Plasmodium falciparum
GNNFLYKDLNIFKEKYVHN

SEQ ID NO: 3357802 - protein, 18 aa, Plasmodium falciparum
GNNFPSCQPNLLEKKSTY

SEQ ID NO: 3357803 - protein, 19 aa, Plasmodium falciparum
GNNIHKGYINNYIIPEDNP

SEQ ID NO: 3357804 - protein, 18 aa, Plasmodium falciparum
GNNKFGWDNIFQPESLSK

SEQ ID NO: 3357805 - protein, 26 aa, Plasmodium falciparum
GNNLIKKLKESFNISDPSTSQNDTSN

SEQ ID NO: 3357806 - protein, 28 aa, Plasmodium falciparum
GNNLRIGRPKTFPIEYHSLIPQATIPAI

SEQ ID NO: 3357807 - protein, 19 aa, Plasmodium falciparum
GNNNFGINSCDEYYGHTNN

SEQ ID NO: 3357808 - protein, 18 aa, Plasmodium falciparum
GNNNIFMYYDLIKYDISK

SEQ ID NO: 3357809 - protein, 25 aa, Plasmodium falciparum
GNNNLCAPTSLLLHNNEKGNTIKND

SEQ ID NO: 3357810 - protein, 26 aa, Plasmodium falciparum
GNNNSPRMKYGLCGSHTSIDNMKNNE

SEQ ID NO: 3357811 - protein, 18 aa, Plasmodium falciparum
GNNPYIFFENNKGCYVYN

SEQ ID NO: 3357812 - protein, 29 aa, Plasmodium falciparum
GNNSLKYRNKEYFDFLKSIYYNDKNNIHN

SEQ ID NO: 3357813 - protein, 18 aa, Plasmodium falciparum
GNNTFSIFSNENIKKEDS

SEQ ID NO: 3357814 - protein, 19 aa, Plasmodium falciparum
GNNYLSVWDTKTLKQVRKI

SEQ ID NO: 3357815 - protein, 27 aa, Plasmodium falciparum
GNPNMYKKGLSYKVPPCNTNYRELNKN

SEQ ID NO: 3357816 - protein, 20 aa, Plasmodium falciparum
GNPWEKLKLLKKGNNKKNDG

SEQ ID NO: 3357817 - protein, 34 aa, Plasmodium falciparum
GNQGEDFVNKRLVKRFLKRKEKIQPEMYDGHEES

SEQ ID NO: 3357818 - protein, 25 aa, Plasmodium falciparum
GNQSYKLGYFESAIDYYTKAIQYDN

SEQ ID NO: 3357819 - protein, 22 aa, Plasmodium falciparum
GNSFNYILICLNLNTYKIDDFI

SEQ ID NO: 3357820 - protein, 22 aa, Plasmodium falciparum
GNSFVLRYLLSFLTNKISSLRK

SEQ ID NO: 3357821 - protein, 19 aa, Plasmodium falciparum
GNSKIISFYPSTNIKNSDQ

SEQ ID NO: 3357822 - protein, 19 aa, Plasmodium falciparum
GNTIYSFLDIDLLPTPLLF

SEQ ID NO: 3357823 - protein, 19 aa, Plasmodium falciparum
GNTLWKVFVFKKFAEDFKK

SEQ ID NO: 3357824 - protein, 17 aa, Plasmodium falciparum
GNVANLVSFQYKGSLPK

SEQ ID NO: 3357825 - protein, 22 aa, Plasmodium falciparum
GNVCACSSSDGYVSFYHFNNNE

SEQ ID NO: 3357826 - protein, 18 aa, Plasmodium falciparum
GNVGFIKDICYFNKSKKQ

SEQ ID NO: 3357827 - protein, 21 aa, Plasmodium falciparum
GNVKGLVPLKKFMGSKRFPPT

SEQ ID NO: 3357828 - protein, 19 aa, Plasmodium falciparum
GNVKSYPLDKLHKHVKSII

SEQ ID NO: 3357829 - protein, 24 aa, Plasmodium falciparum
GNVLFPRFLSWEMKNNVNRLNLMR

SEQ ID NO: 3357830 - protein, 17 aa, Plasmodium falciparum
GNVLIYKIDKFECILKL

SEQ ID NO: 3357831 - protein, 21 aa, Plasmodium falciparum
GNVNYSMNFCHYNLNDKNYLI

SEQ ID NO: 3357832 - protein, 23 aa, Plasmodium falciparum
GNVSDYKCGLGILNNNHQRSYEE

SEQ ID NO: 3357833 - protein, 18 aa, Plasmodium falciparum
GNYAMCFTSNYGRYIKGS

SEQ ID NO: 3357834 - protein, 18 aa, Plasmodium falciparum
GNYAPYISIEGAYIEDEL

SEQ ID NO: 3357835 - protein, 18 aa, Plasmodium falciparum
GNYQFRGADLLALPNCHS

SEQ ID NO: 3357836 - protein, 18 aa, Plasmodium falciparum
GPFGQLFRPDNFVFGQTG

SEQ ID NO: 3357837 - protein, 21 aa, Plasmodium falciparum
GPFPSSKLSVFLNENGNNEQV

SEQ ID NO: 3357838 - protein, 18 aa, Plasmodium falciparum
GPIFLKCFHLTDRTVRYV

SEQ ID NO: 3357839 - protein, 27 aa, Plasmodium falciparum
GPINEFYFSVKLKEGIRAKSFSSDTHF

SEQ ID NO: 3357840 - protein, 20 aa, Plasmodium falciparum
GPKYCNPNMHEFYKSNNNQL

SEQ ID NO: 3357841 - protein, 23 aa, Plasmodium falciparum
GPLHLLKKFIPKFYGVTEILVES

SEQ ID NO: 3357842 - protein, 24 aa, Plasmodium falciparum
GPLKISILGSGNWASAISKVVGTN

SEQ ID NO: 3357843 - protein, 23 aa, Plasmodium falciparum
GPLRIPLLEGYKDNGIIAIGKIE

SEQ ID NO: 3357844 - protein, 19 aa, Plasmodium falciparum
GPMYPLKIIAGYSEIKYSI

SEQ ID NO: 3357845 - protein, 22 aa, Plasmodium falciparum
GPNIEYYPNVPIFPESQNQMFP

SEQ ID NO: 3357846 - protein, 32 aa, Plasmodium falciparum
GPNVSKWISYNFRRIFIRCLKEANEEMIKKNM

SEQ ID NO: 3357847 - protein, 22 aa, Plasmodium falciparum
GPPGCGKTLLAKAVASECSANF

SEQ ID NO: 3357848 - protein, 22 aa, Plasmodium falciparum
GPPGCGKTMLAKAISNEMKANF

SEQ ID NO: 3357849 - protein, 18 aa, Plasmodium falciparum
GPRGRHIKIIPKIENIEG

SEQ ID NO: 3357850 - protein, 18 aa, Plasmodium falciparum
GPSIKKGTGLHRISFIIS

SEQ ID NO: 3357851 - protein, 26 aa, Plasmodium falciparum
GPSLYFEILDYIPLHSLLFSGNCLLY

SEQ ID NO: 3357852 - protein, 19 aa, Plasmodium falciparum
GPTTLSVLHDKILKETIDQ

SEQ ID NO: 3357853 - protein, 27 aa, Plasmodium falciparum
GQAYKKCKRIERIFSVNKYGFEGARKL

SEQ ID NO: 3357854 - protein, 17 aa, Plasmodium falciparum
GQCIKIFNSTNIIKHIG

SEQ ID NO: 3357855 - protein, 20 aa, Plasmodium falciparum
GQDFCKNCGSVAHKEKDCLE

SEQ ID NO: 3357856 - protein, 22 aa, Plasmodium falciparum
GQFGVGFYSAYLVADHVVVISK

SEQ ID NO: 3357857 - protein, 27 aa, Plasmodium falciparum
GQHEKNIDCINLFLKHEKENYEMNNLY

SEQ ID NO: 3357858 - protein, 24 aa, Plasmodium falciparum
GQIECLKLIASNKFSFKRIGYLGL

SEQ ID NO: 3357859 - protein, 33 aa, Plasmodium falciparum
GQISFNSILYIPGSLPWELSKNMFDEESRGIRL

SEQ ID NO: 3357860 - protein, 18 aa, Plasmodium falciparum
GQKNCIRAKINMQSKNKC

SEQ ID NO: 3357861 - protein, 26 aa, Plasmodium falciparum
GQKYYLFRRKVLLIFQSDLKDIQKSQ

SEQ ID NO: 3357862 - protein, 18 aa, Plasmodium falciparum
GQLDRNELIIGYKELLKL

SEQ ID NO: 3357863 - protein, 19 aa, Plasmodium falciparum
GQLIILIHFHLKRYIMVGK

SEQ ID NO: 3357864 - protein, 18 aa, Plasmodium falciparum
GQLISCPEYEGLIKLIVE

SEQ ID NO: 3357865 - protein, 22 aa, Plasmodium falciparum
GQMPRWVEVIVEDDLCDIVKCG

SEQ ID NO: 3357866 - protein, 17 aa, Plasmodium falciparum
GQNGISITKNYEPNLTF

SEQ ID NO: 3357867 - protein, 19 aa, Plasmodium falciparum
GQNILAPLLKVGNLRHHGV

SEQ ID NO: 3357868 - protein, 25 aa, Plasmodium falciparum
GQNSCKPNVILNQQIFHKVDEHGNF

SEQ ID NO: 3357869 - protein, 19 aa, Plasmodium falciparum
GQPARLMWSHRDPSLRKSG

SEQ ID NO: 3357870 - protein, 21 aa, Plasmodium falciparum
GQPTKSKRGAKSWMSFGKGKK

SEQ ID NO: 3357871 - protein, 18 aa, Plasmodium falciparum
GQSEGWKGLRTHIRQFDD

SEQ ID NO: 3357872 - protein, 18 aa, Plasmodium falciparum
GQSTLPILSGTTNNIRYK

SEQ ID NO: 3357873 - protein, 18 aa, Plasmodium falciparum
GQVERLKNEMININIDNR

SEQ ID NO: 3357874 - protein, 25 aa, Plasmodium falciparum
GQVPEGWVDPQITGFIAPMMNDVLH

SEQ ID NO: 3357875 - protein, 20 aa, Plasmodium falciparum
GQVTIAWRGCPWEDVQTKLA

SEQ ID NO: 3357876 - protein, 24 aa, Plasmodium falciparum
GQVTLWKLIEDVIFEMQTNMKICN

SEQ ID NO: 3357877 - protein, 20 aa, Plasmodium falciparum
GRAGVPMEVMGLMLGEIVDE

SEQ ID NO: 3357878 - protein, 18 aa, Plasmodium falciparum
GRAYRVHQGFGPWKLLFK

SEQ ID NO: 3357879 - protein, 17 aa, Plasmodium falciparum
GRCAQKFAKVKDILHIL

SEQ ID NO: 3357880 - protein, 24 aa, Plasmodium falciparum
GRDEFKNKILFLLNEKKKKDQTSV

SEQ ID NO: 3357881 - protein, 20 aa, Plasmodium falciparum
GRDKMNFKYKNFNNNYMENK

SEQ ID NO: 3357882 - protein, 20 aa, Plasmodium falciparum
GRDYISNFVIKSENFKNKEI

SEQ ID NO: 3357883 - protein, 22 aa, Plasmodium falciparum
GRFFHIDFGYIFGEDPKPFSPP

SEQ ID NO: 3357884 - protein, 20 aa, Plasmodium falciparum
GRFGRKGVAINFVKNDDIKI

SEQ ID NO: 3357885 - protein, 18 aa, Plasmodium falciparum
GRFGRKGVAINFVTNDDK

SEQ ID NO: 3357886 - protein, 29 aa, Plasmodium falciparum
GRFPYEINNYMPIHLKKKILMENKPKFEP

SEQ ID NO: 3357887 - protein, 24 aa, Plasmodium falciparum
GRFYELLQKLILFENLRLEKYNNN

SEQ ID NO: 3357888 - protein, 17 aa, Plasmodium falciparum
GRGGALVREKLVASSSS

SEQ ID NO: 3357889 - protein, 23 aa, Plasmodium falciparum
GRGGCYKHTFYGINSYQCMEATP

SEQ ID NO: 3357890 - protein, 22 aa, Plasmodium falciparum
GRGKEKGICLTMYHKYEYRNVD

SEQ ID NO: 3357891 - protein, 17 aa, Plasmodium falciparum
GRGRRTRTGTRTSTRTS

SEQ ID NO: 3357892 - protein, 18 aa, Plasmodium falciparum
GRHTIYNKNIDGIQIKEN

SEQ ID NO: 3357893 - protein, 20 aa, Plasmodium falciparum
GRIDDLRSGKKCVYSEKPGE

SEQ ID NO: 3357894 - protein, 18 aa, Plasmodium falciparum
GRIFNFFFKTYRKVTYCY

SEQ ID NO: 3357895 - protein, 17 aa, Plasmodium falciparum
GRIKEYLNHSSTAKYFP

SEQ ID NO: 3357896 - protein, 26 aa, Plasmodium falciparum
GRILIPKTQKTGSIVMDGINKILDGL

SEQ ID NO: 3357897 - protein, 25 aa, Plasmodium falciparum
GRIPLMLKSMFCWTKGLPENEIADM

SEQ ID NO: 3357898 - protein, 22 aa, Plasmodium falciparum
GRKGEKYIYCYENIKILEDIKD

SEQ ID NO: 3357899 - protein, 21 aa, Plasmodium falciparum
GRKKRSCTINDNINLSEKKQL

SEQ ID NO: 3357900 - protein, 17 aa, Plasmodium falciparum
GRKKVRIIILIHDCEYF

SEQ ID NO: 3357901 - protein, 19 aa, Plasmodium falciparum
GRKLAPLNEDWYFIRASSI

SEQ ID NO: 3357902 - protein, 24 aa, Plasmodium falciparum
GRKRDGKCFRLFTKKSFIDLSDNS

SEQ ID NO: 3357903 - protein, 35 aa, Plasmodium falciparum
GRKYHCFESLYNFECIGLCYKKLKNMKMKINNNTI

SEQ ID NO: 3357904 - protein, 25 aa, Plasmodium falciparum
GRKYLSEGFSAYVHVALCENTIISK

SEQ ID NO: 3357905 - protein, 21 aa, Plasmodium falciparum
GRLQDCLEKAYTVLNQCNYVI

SEQ ID NO: 3357906 - protein, 19 aa, Plasmodium falciparum
GRLQLCSDLSSSDITSSSE

SEQ ID NO: 3357907 - protein, 19 aa, Plasmodium falciparum
GRNFIVFYFLSKYLCKPVF

SEQ ID NO: 3357908 - protein, 20 aa, Plasmodium falciparum
GRNGFGAKLTNIFSKEFIVQ

SEQ ID NO: 3357909 - protein, 18 aa, Plasmodium falciparum
GRNPSIIRKIIWKTTDQK

SEQ ID NO: 3357910 - protein, 18 aa, Plasmodium falciparum
GRNSYLLKNILKLYHNEL

SEQ ID NO: 3357911 - protein, 19 aa, Plasmodium falciparum
GRPKTIFLFNNEKKYDKGV

SEQ ID NO: 3357912 - protein, 25 aa, Plasmodium falciparum
GRPPPLPLRNSYNVFGIDYELQRNI

SEQ ID NO: 3357913 - protein, 29 aa, Plasmodium falciparum
GRSKLPESLKILFRPITVIIPDFNKICEN

SEQ ID NO: 3357914 - protein, 19 aa, Plasmodium falciparum
GRTFAGRKVQASFATEEEY

SEQ ID NO: 3357915 - protein, 19 aa, Plasmodium falciparum
GRTGPAWLFSKVINVCEGQ

SEQ ID NO: 3357916 - protein, 18 aa, Plasmodium falciparum
GRTGSFGSRVFDNRKGSF

SEQ ID NO: 3357917 - protein, 24 aa, Plasmodium falciparum
GRTIKNWIPRRLGGGKGPARGSEE

SEQ ID NO: 3357918 - protein, 18 aa, Plasmodium falciparum
GRTLLTYRSIEINKNILV

SEQ ID NO: 3357919 - protein, 28 aa, Plasmodium falciparum
GRTPLYRRLPKWPEAWLSRQKKNYDCLN

SEQ ID NO: 3357920 - protein, 17 aa, Plasmodium falciparum
GRVGRDGKNSLCIVLSA

SEQ ID NO: 3357921 - protein, 18 aa, Plasmodium falciparum
GRVIDAPLFHSAPDNDIN

SEQ ID NO: 3357922 - protein, 20 aa, Plasmodium falciparum
GRWISDVLCEAYFVPQLAYN

SEQ ID NO: 3357923 - protein, 20 aa, Plasmodium falciparum
GRYAFAAKLKEEIKHFHSKR

SEQ ID NO: 3357924 - protein, 17 aa, Plasmodium falciparum
GRYMSHTLFSRVEKGSD

SEQ ID NO: 3357925 - protein, 22 aa, Plasmodium falciparum
GSACTFSQEIGCFIKENSEFIF

SEQ ID NO: 3357926 - protein, 23 aa, Plasmodium falciparum
GSALSEINFWIGYENALYQLESQ

SEQ ID NO: 3357927 - protein, 24 aa, Plasmodium falciparum
GSATLRKILLILIKVVKKLKYKTF

SEQ ID NO: 3357928 - protein, 24 aa, Plasmodium falciparum
GSCCSDIVEIILLYGNKLSIYELI

SEQ ID NO: 3357929 - protein, 30 aa, Plasmodium falciparum
GSDSLVTCKTFFKLMEMYFDNKIDDKKYSG

SEQ ID NO: 3357930 - protein, 21 aa, Plasmodium falciparum
GSFKGNLYFIDICNNNNIKII

SEQ ID NO: 3357931 - protein, 18 aa, Plasmodium falciparum
GSFLKCLDDVHNMVRINA

SEQ ID NO: 3357932 - protein, 21 aa, Plasmodium falciparum
GSFRMSNEFLGWKNKKTNNVY

SEQ ID NO: 3357933 - protein, 24 aa, Plasmodium falciparum
GSGKSNILLAIEFILSDVCEYKQI

SEQ ID NO: 3357934 - protein, 22 aa, Plasmodium falciparum
GSGKSTLICNIILYLDKILTHE

SEQ ID NO: 3357935 - protein, 20 aa, Plasmodium falciparum
GSGLSKFNLGFSNIQNNNNN

SEQ ID NO: 3357936 - protein, 24 aa, Plasmodium falciparum
GSGYLTVCMAIKMNVLENKNSYVI

SEQ ID NO: 3357937 - protein, 22 aa, Plasmodium falciparum
GSHLPFEYHLKGVANFNNLNLV

SEQ ID NO: 3357938 - protein, 24 aa, Plasmodium falciparum
GSHSAVKLCRWTKSQVRGRGGCYK

SEQ ID NO: 3357939 - protein, 25 aa, Plasmodium falciparum
GSIHMKDKKICLYDSLNGSNKKFFE

SEQ ID NO: 3357940 - protein, 17 aa, Plasmodium falciparum
GSIIKYITEQSGSQIQV

SEQ ID NO: 3357941 - protein, 17 aa, Plasmodium falciparum
GSILRIYPNKGIVKKEE

SEQ ID NO: 3357942 - protein, 24 aa, Plasmodium falciparum
GSIPPYYMDQSFFMEAMNFLRNTT

SEQ ID NO: 3357943 - protein, 23 aa, Plasmodium falciparum
GSKNVYVGPFIKKSERATNDTKF

SEQ ID NO: 3357944 - protein, 24 aa, Plasmodium falciparum
GSKTYIYIFLFRGEEIGKKKITDI

SEQ ID NO: 3357945 - protein, 19 aa, Plasmodium falciparum
GSLGLMSSVLLCPDGVTCV

SEQ ID NO: 3357946 - protein, 30 aa, Plasmodium falciparum
GSLKVLCANCGDSGAFICHNKKPIKLSLRH

SEQ ID NO: 3357947 - protein, 19 aa, Plasmodium falciparum
GSLLWSISHAEIKAEKYFS

SEQ ID NO: 3357948 - protein, 24 aa, Plasmodium falciparum
GSLVCPKCNISFPIKDGIPNMLTG

SEQ ID NO: 3357949 - protein, 19 aa, Plasmodium falciparum
GSMNVSPCNHMYNENNDII

SEQ ID NO: 3357950 - protein, 29 aa, Plasmodium falciparum
GSMRLKTISCKHFGYSNSKKISILFLLRW

SEQ ID NO: 3357951 - protein, 18 aa, Plasmodium falciparum
GSMYKTNVQNMVNNNNGA

SEQ ID NO: 3357952 - protein, 20 aa, Plasmodium falciparum
GSNAKGRRRKRKKNMNECND

SEQ ID NO: 3357953 - protein, 17 aa, Plasmodium falciparum
GSPFRIIFKNDNNMYYI

SEQ ID NO: 3357954 - protein, 22 aa, Plasmodium falciparum
GSRAVLKFAQYTGAQAIAGRWT

SEQ ID NO: 3357955 - protein, 24 aa, Plasmodium falciparum
GSSCLFLKSCLSLISQELDQKKSL

SEQ ID NO: 3357956 - protein, 19 aa, Plasmodium falciparum
GSSKTVFICTISSSMKNAR

SEQ ID NO: 3357957 - protein, 25 aa, Plasmodium falciparum
GSSSIKYGENGTMIDDCFNNNKNNE

SEQ ID NO: 3357958 - protein, 17 aa, Plasmodium falciparum
GSSTPRFVAKYKCNPTK

SEQ ID NO: 3357959 - protein, 36 aa, Plasmodium falciparum
GSTPAGVYMIRINGVVQAWRAEWRSPSGCKRTKNFG

SEQ ID NO: 3357960 - protein, 17 aa, Plasmodium falciparum
GSTYCLKEMDALTGTKN

SEQ ID NO: 3357961 - protein, 25 aa, Plasmodium falciparum
GSVPIIKFTCDFCDVQANEQNGEII

SEQ ID NO: 3357962 - protein, 18 aa, Plasmodium falciparum
GSVVLCAITSCTNTSNSS

SEQ ID NO: 3357963 - protein, 26 aa, Plasmodium falciparum
GSWGSKCFLESIGLDIYVKGYSVALK

SEQ ID NO: 3357964 - protein, 17 aa, Plasmodium falciparum
GSYFFSSCSVDYLNNES

SEQ ID NO: 3357965 - protein, 19 aa, Plasmodium falciparum
GSYLYELIYPQTIHSFPVI

SEQ ID NO: 3357966 - protein, 20 aa, Plasmodium falciparum
GTACGKLFRISCLVITDVGD

SEQ ID NO: 3357967 - protein, 21 aa, Plasmodium falciparum
GTAEDDLTCILSEITQLNNTI

SEQ ID NO: 3357968 - protein, 19 aa, Plasmodium falciparum
GTAKLRDGVNFEIINEYKT

SEQ ID NO: 3357969 - protein, 22 aa, Plasmodium falciparum
GTCNSMGIRVCKELNDEEKKKY

SEQ ID NO: 3357970 - protein, 17 aa, Plasmodium falciparum
GTDIVICTVKTLIHFVN

SEQ ID NO: 3357971 - protein, 26 aa, Plasmodium falciparum
GTDQFLRWLIEWAMQACKEKKRVRDS

SEQ ID NO: 3357972 - protein, 23 aa, Plasmodium falciparum
GTDSLKTVFPYIGAYEVDYMSDN

SEQ ID NO: 3357973 - protein, 25 aa, Plasmodium falciparum
GTEQRKKLILKKRSVPLDQKSYVVN

SEQ ID NO: 3357974 - protein, 17 aa, Plasmodium falciparum
GTFDYKDLREVYFMNDN

SEQ ID NO: 3357975 - protein, 21 aa, Plasmodium falciparum
GTFNREIFGSIMLSFDTTTEI

SEQ ID NO: 3357976 - protein, 18 aa, Plasmodium falciparum
GTGNDFAKAFGWKKIDRM

SEQ ID NO: 3357977 - protein, 19 aa, Plasmodium falciparum
GTGSTAWAYNINKIDKKKM

SEQ ID NO: 3357978 - protein, 33 aa, Plasmodium falciparum
GTGTSRCIPFWSFCFRQNIKIKIIDTCEVRVLK

SEQ ID NO: 3357979 - protein, 18 aa, Plasmodium falciparum
GTIEWWNKEIVDYVNKNK

SEQ ID NO: 3357980 - protein, 19 aa, Plasmodium falciparum
GTIFLRFVVNNKKEIFEKI

SEQ ID NO: 3357981 - protein, 18 aa, Plasmodium falciparum
GTIHSFCRYILYKYKGTF

SEQ ID NO: 3357982 - protein, 24 aa, Plasmodium falciparum
GTIKLLLLNILCRIYQRNKIIEEN

SEQ ID NO: 3357983 - protein, 18 aa, Plasmodium falciparum
GTILAFLADNGIIKIYLI

SEQ ID NO: 3357984 - protein, 25 aa, Plasmodium falciparum
GTISIKRLRFILQYLGEPLTNVEFD

SEQ ID NO: 3357985 - protein, 24 aa, Plasmodium falciparum
GTKKYPLDFFLWLLNKIYRHSNKM

SEQ ID NO: 3357986 - protein, 33 aa, Plasmodium falciparum
GTLEHAKSCLFLLDPLRKFFGNRVFSRKDCLNS

SEQ ID NO: 3357987 - protein, 18 aa, Plasmodium falciparum
GTLYVGFRTVMGLFLLIT

SEQ ID NO: 3357988 - protein, 17 aa, Plasmodium falciparum
GTMNKEDSLICDKDKEE

SEQ ID NO: 3357989 - protein, 19 aa, Plasmodium falciparum
GTNFHSGNISTSYNDRYLN

SEQ ID NO: 3357990 - protein, 21 aa, Plasmodium falciparum
GTNSRPVYFSTLLRTTIDNIK

SEQ ID NO: 3357991 - protein, 26 aa, Plasmodium falciparum
GTNWASRQGITEWIRNIVMERKKNRK

SEQ ID NO: 3357992 - protein, 17 aa, Plasmodium falciparum
GTQMTLKTFHFAGVASM

SEQ ID NO: 3357993 - protein, 19 aa, Plasmodium falciparum
GTRVIGRVCVGNRKGLLVS

SEQ ID NO: 3357994 - protein, 19 aa, Plasmodium falciparum
GTSAFLCTITSFYSTSKNL

SEQ ID NO: 3357995 - protein, 20 aa, Plasmodium falciparum
GTSAKFGLGIKLLSRKIREL

SEQ ID NO: 3357996 - protein, 20 aa, Plasmodium falciparum
GTSFFSAPCISNYIKSIDIY

SEQ ID NO: 3357997 - protein, 19 aa, Plasmodium falciparum
GTSLLFVFDSDPSKKENED

SEQ ID NO: 3357998 - protein, 20 aa, Plasmodium falciparum
GTSRPSRRKKNSFINKLFLA

SEQ ID NO: 3357999 - protein, 21 aa, Plasmodium falciparum
GTTDGRCLIYYGDNSKKGVLD

SEQ ID NO: 3358000 - protein, 21 aa, Plasmodium falciparum
GTTGICSELFDAFKNASIPYV

SEQ ID NO: 3358001 - protein, 23 aa, Plasmodium falciparum
GTTYIKVLCKIIYLSFSAHADSN

SEQ ID NO: 3358002 - protein, 17 aa, Plasmodium falciparum
GTVKIPLKRGRKKKSEK

SEQ ID NO: 3358003 - protein, 17 aa, Plasmodium falciparum
GTVSVVDLVCRLQKPAK

SEQ ID NO: 3358004 - protein, 21 aa, Plasmodium falciparum
GTVTSAFWLKYPNNIQKHIQN

SEQ ID NO: 3358005 - protein, 26 aa, Plasmodium falciparum
GTYDYHPSNMMYKKFGKNNDNDNDNN

SEQ ID NO: 3358006 - protein, 18 aa, Plasmodium falciparum
GVDLKFQLLMSKKVKNII

SEQ ID NO: 3358007 - protein, 27 aa, Plasmodium falciparum
GVDPRDIEICRFLRKYILLKHPQGKYI

SEQ ID NO: 3358008 - protein, 28 aa, Plasmodium falciparum
GVEMCGNIIRIGWSKAIPKFGYNTKNEI

SEQ ID NO: 3358009 - protein, 24 aa, Plasmodium falciparum
GVEWLLKSFLTGGAILADEMGLGK

SEQ ID NO: 3358010 - protein, 17 aa, Plasmodium falciparum
GVFRCSLDLLKKYGNMR

SEQ ID NO: 3358011 - protein, 18 aa, Plasmodium falciparum
GVFSRLTNSYALVALGGS

SEQ ID NO: 3358012 - protein, 20 aa, Plasmodium falciparum
GVGCNLFLQNMMKKMAKQKN

SEQ ID NO: 3358013 - protein, 19 aa, Plasmodium falciparum
GVGKSCLLLQFTDKRFRAD

SEQ ID NO: 3358014 - protein, 19 aa, Plasmodium falciparum
GVGKSFFSVNFSYYLKKKG

SEQ ID NO: 3358015 - protein, 28 aa, Plasmodium falciparum
GVGKSICFYEDFIKLREKILLKEKEILE

SEQ ID NO: 3358016 - protein, 25 aa, Plasmodium falciparum
GVGKTEIARRISMFVDAPFIKVEAT

SEQ ID NO: 3358017 - protein, 26 aa, Plasmodium falciparum
GVGLKYKELCCNITRTLLLNARTQHK

SEQ ID NO: 3358018 - protein, 20 aa, Plasmodium falciparum
GVGVLSKFGYIMKFDLSQYF

SEQ ID NO: 3358019 - protein, 21 aa, Plasmodium falciparum
GVHESYRLIEEKFKKDSIQNE

SEQ ID NO: 3358020 - protein, 19 aa, Plasmodium falciparum
GVHFKRGGTLVIAPLALIY

SEQ ID NO: 3358021 - protein, 23 aa, Plasmodium falciparum
GVIFKGVKSLGVIPKGVVSSNKG

SEQ ID NO: 3358022 - protein, 23 aa, Plasmodium falciparum
GVKEMSKFLKYYFESLKRDHENF

SEQ ID NO: 3358023 - protein, 25 aa, Plasmodium falciparum
GVKRFFIPYIRIFPLKGVINGLDFK

SEQ ID NO: 3358024 - protein, 18 aa, Plasmodium falciparum
GVLIKYFLLFDFDDIQNE

SEQ ID NO: 3358025 - protein, 24 aa, Plasmodium falciparum
GVLKNCINVAIKVLKKNENNGFEN

SEQ ID NO: 3358026 - protein, 22 aa, Plasmodium falciparum
GVLNRFKRGKLYKLVSHSCVNT

SEQ ID NO: 3358027 - protein, 19 aa, Plasmodium falciparum
GVLPDFANDIYIHDNNYHN

SEQ ID NO: 3358028 - protein, 19 aa, Plasmodium falciparum
GVNNHNQFIINMRMKNNKQ

SEQ ID NO: 3358029 - protein, 25 aa, Plasmodium falciparum
GVPKSVAMTLTFCETVTPLNYDNLK

SEQ ID NO: 3358030 - protein, 17 aa, Plasmodium falciparum
GVPPNFASFSIRINGES

SEQ ID NO: 3358031 - protein, 23 aa, Plasmodium falciparum
GVPWNSPDSITFMLMQCIIGTYK

SEQ ID NO: 3358032 - protein, 26 aa, Plasmodium falciparum
GVQKIRFFPKYGNYLLSASLDNTLKL

SEQ ID NO: 3358033 - protein, 23 aa, Plasmodium falciparum
GVREPIQLEARGFFINGRSNNVN

SEQ ID NO: 3358034 - protein, 20 aa, Plasmodium falciparum
GVRFKEMIGDFIRVLNKNVL

SEQ ID NO: 3358035 - protein, 25 aa, Plasmodium falciparum
GVRSMCWKLALKHLSLDSNKWNTEL

SEQ ID NO: 3358036 - protein, 20 aa, Plasmodium falciparum
GVSWNFKARKPKGFGVRLLT

SEQ ID NO: 3358037 - protein, 24 aa, Plasmodium falciparum
GVSYKYSENFLKKESGSYFMRTVE

SEQ ID NO: 3358038 - protein, 18 aa, Plasmodium falciparum
GVTLKYIIHQGYKKPKKI

SEQ ID NO: 3358039 - protein, 20 aa, Plasmodium falciparum
GVYYKHGFEKHTHHLRKIER

SEQ ID NO: 3358040 - protein, 18 aa, Plasmodium falciparum
GWIIFVIQNCEIIIHSKG

SEQ ID NO: 3358041 - protein, 40 aa, Plasmodium falciparum
GWLNYKWTDPDGFLELSIRQKRKFDSWKRLSELYENPIVM

SEQ ID NO: 3358042 - protein, 36 aa, Plasmodium falciparum
GWLTKRRIKKYFDFCVIKLCKPTLIKGIDIDTNNFL

SEQ ID NO: 3358043 - protein, 26 aa, Plasmodium falciparum
GWRAEARGGHDFQFFNVEKLDELEKI

SEQ ID NO: 3358044 - protein, 23 aa, Plasmodium falciparum
GWYHSHPGFGCWLSGTDVNTQKS

SEQ ID NO: 3358045 - protein, 23 aa, Plasmodium falciparum
GYALRSRNVYTLKNLVHKKDADI

SEQ ID NO: 3358046 - protein, 24 aa, Plasmodium falciparum
GYCKLYKIKNINMFKSNNFNFHIK

SEQ ID NO: 3358047 - protein, 17 aa, Plasmodium falciparum
GYEKERRNRTTYEEEND

SEQ ID NO: 3358048 - protein, 30 aa, Plasmodium falciparum
GYEQQLLYGRINWKLAEKKKITKHSITTMK

SEQ ID NO: 3358049 - protein, 25 aa, Plasmodium falciparum
GYESHSDISCKIGYTDSESEGVASI

SEQ ID NO: 3358050 - protein, 17 aa, Plasmodium falciparum
GYFDFKYDIKLLKGKIK

SEQ ID NO: 3358051 - protein, 32 aa, Plasmodium falciparum
GYFFKHKMDELFLLNNINLCLSYNEKWKNKMI

SEQ ID NO: 3358052 - protein, 19 aa, Plasmodium falciparum
GYGKFLINFSYFLSQTEKR

SEQ ID NO: 3358053 - protein, 42 aa, Plasmodium falciparum
GYGQSDFSGCLAISFPEIDLSITILLSDVFKGADVIENENNS

SEQ ID NO: 3358054 - protein, 26 aa, Plasmodium falciparum
GYHLNNLKQGLGIYKWDDGRIYFGNW

SEQ ID NO: 3358055 - protein, 17 aa, Plasmodium falciparum
GYIAVPWQVEGGGMIGV

SEQ ID NO: 3358056 - protein, 18 aa, Plasmodium falciparum
GYISNIGYGNLFNIKYND

SEQ ID NO: 3358057 - protein, 20 aa, Plasmodium falciparum
GYIYSYKISYSFNPCYMDYL

SEQ ID NO: 3358058 - protein, 27 aa, Plasmodium falciparum
GYKELKRRPTNNMNMTFICGSKMNHND

SEQ ID NO: 3358059 - protein, 33 aa, Plasmodium falciparum
GYKINSIKLWGYFCTSCYFFMRTNNLLFCSKCG

SEQ ID NO: 3358060 - protein, 46 aa, Plasmodium falciparum
GYKNCLKVFDLFTGTYLWKSKGLGVSLLHLNCETLIKSLNFLNDIN

SEQ ID NO: 3358061 - protein, 17 aa, Plasmodium falciparum
GYKPCIGNIRYQLSASF

SEQ ID NO: 3358062 - protein, 19 aa, Plasmodium falciparum
GYKQFNFGTSIEFIKQSPL

SEQ ID NO: 3358063 - protein, 29 aa, Plasmodium falciparum
GYLKDKKFRFVIKFKESYPITPPKIICLS

SEQ ID NO: 3358064 - protein, 18 aa, Plasmodium falciparum
GYLSKKFSNSWCGFKKRW

SEQ ID NO: 3358065 - protein, 27 aa, Plasmodium falciparum
GYLSNCYFCSLVSKNIHIKRINEQVAQ

SEQ ID NO: 3358066 - protein, 28 aa, Plasmodium falciparum
GYLSYGKWTLPNGIYFVGRFRQNKPTGE

SEQ ID NO: 3358067 - protein, 32 aa, Plasmodium falciparum
GYNEARKLSILKRTEWEKEYKHHTDLKNSDGK

SEQ ID NO: 3358068 - protein, 33 aa, Plasmodium falciparum
GYNKRICSYCRIKHGVVITCSNTDCDVSFHISC

SEQ ID NO: 3358069 - protein, 23 aa, Plasmodium falciparum
GYNNRFGYKYKYLYDKKKTSYYV

SEQ ID NO: 3358070 - protein, 18 aa, Plasmodium falciparum
GYPCRVLYDDIWIRYSGI

SEQ ID NO: 3358071 - protein, 22 aa, Plasmodium falciparum
GYPHKIQGLSLMKTVEYTLSIG

SEQ ID NO: 3358072 - protein, 36 aa, Plasmodium falciparum
GYRKYEIIGNILIFHYKYFECIMKLYKVYEGKLKKY

SEQ ID NO: 3358073 - protein, 21 aa, Plasmodium falciparum
GYRNEKILKNENFCDNNMNTY

SEQ ID NO: 3358074 - protein, 18 aa, Plasmodium falciparum
GYSGADLYGVLRESAFIA

SEQ ID NO: 3358075 - protein, 18 aa, Plasmodium falciparum
GYSKFKFIGKHQIKKKNK

SEQ ID NO: 3358076 - protein, 26 aa, Plasmodium falciparum
GYSNFIKKKCVPYDKKKYIFCNKNRL

SEQ ID NO: 3358077 - protein, 18 aa, Plasmodium falciparum
GYSNRFVGENSMNEKISE

SEQ ID NO: 3358078 - protein, 18 aa, Plasmodium falciparum
GYTSYPRDIDYKGFREIC

SEQ ID NO: 3358079 - protein, 35 aa, Plasmodium falciparum
GYVSREHCLIYYDGSKDAGERWLLRDTSTLGTFLK

SEQ ID NO: 3358080 - protein, 18 aa, Plasmodium falciparum
GYYENYKKEFLYDLIKPG

SEQ ID NO: 3358081 - protein, 23 aa, Plasmodium falciparum
GYYIKSDCAIIMFDVSSRITYKN

SEQ ID NO: 3358082 - protein, 24 aa, Plasmodium falciparum
HAAFLKYKPIIFAISIYNMSFNDT

SEQ ID NO: 3358083 - protein, 19 aa, Plasmodium falciparum
HACIKELEMNLERYNNEKI

SEQ ID NO: 3358084 - protein, 22 aa, Plasmodium falciparum
HAGLKRLDRKLVEDLFSDRHIQ

SEQ ID NO: 3358085 - protein, 17 aa, Plasmodium falciparum
HAHGESELQPKNLPLHL

SEQ ID NO: 3358086 - protein, 22 aa, Plasmodium falciparum
HAIKNLEIMKSIFMYNNIIIKW

SEQ ID NO: 3358087 - protein, 30 aa, Plasmodium falciparum
HANIFTINICKSLWILLSITIQSVRKKNNL

SEQ ID NO: 3358088 - protein, 19 aa, Plasmodium falciparum
HANSLIKPIPCKKTNFKNS

SEQ ID NO: 3358089 - protein, 18 aa, Plasmodium falciparum
HAPSSILNNVPWSSTFTS

SEQ ID NO: 3358090 - protein, 31 aa, Plasmodium falciparum
HASDIFFKIIYCMNKGLSLLINHINEELEDI

SEQ ID NO: 3358091 - protein, 24 aa, Plasmodium falciparum
HASTIRLSLRKGKGDQRVCKVYDA

SEQ ID NO: 3358092 - protein, 23 aa, Plasmodium falciparum
HASTWRSSWTAQFFVDNDHVLLS

SEQ ID NO: 3358093 - protein, 21 aa, Plasmodium falciparum
HAYKKIGACKIFVGNISSSAR

SEQ ID NO: 3358094 - protein, 23 aa, Plasmodium falciparum
HCDKEIKGKPFLNQVPLMSTSKK

SEQ ID NO: 3358095 - protein, 21 aa, Plasmodium falciparum
HCDNSTFMKIHYNDQFNNHYP

SEQ ID NO: 3358096 - protein, 20 aa, Plasmodium falciparum
HCFFQPLRRCFSTKKDYDVI

SEQ ID NO: 3358097 - protein, 17 aa, Plasmodium falciparum
HCLNVTFQYQCNKIKSI

SEQ ID NO: 3358098 - protein, 21 aa, Plasmodium falciparum
HCRACGNVFCSNCSDNKIKIS

SEQ ID NO: 3358099 - protein, 21 aa, Plasmodium falciparum
HCYNKLLIESCCHIDKDVKKS

SEQ ID NO: 3358100 - protein, 19 aa, Plasmodium falciparum
HDAFLKQSIIFPLNKDISL

SEQ ID NO: 3358101 - protein, 27 aa, Plasmodium falciparum
HDAIKLASECVFNFLLNYNKSNLHDLS

SEQ ID NO: 3358102 - protein, 20 aa, Plasmodium falciparum
HDAYKIKIFLTYLNVSSSIL

SEQ ID NO: 3358103 - protein, 19 aa, Plasmodium falciparum
HDEKEKGSCILNKDNKNHN

SEQ ID NO: 3358104 - protein, 23 aa, Plasmodium falciparum
HDEKKEVEEFFLIADKKKEENED

SEQ ID NO: 3358105 - protein, 23 aa, Plasmodium falciparum
HDEKRIKKRIAYILYKNNNIYNS

SEQ ID NO: 3358106 - protein, 19 aa, Plasmodium falciparum
HDISRSREEMIGIIGREGH

SEQ ID NO: 3358107 - protein, 17 aa, Plasmodium falciparum
HDKCVENFIRYVPGINL

SEQ ID NO: 3358108 - protein, 23 aa, Plasmodium falciparum
HDKRLKRNIPFIYSNEIQNLEEL

SEQ ID NO: 3358109 - protein, 19 aa, Plasmodium falciparum
HDLAIKFPGLNIVLEHISS

SEQ ID NO: 3358110 - protein, 17 aa, Plasmodium falciparum
HDLFRKKKIQPMLFYQH

SEQ ID NO: 3358111 - protein, 24 aa, Plasmodium falciparum
HDLNGKYIFHPNINNINNNNINNN

SEQ ID NO: 3358112 - protein, 23 aa, Plasmodium falciparum
HDLYEFSQKYILNKDIIEGTSTS

SEQ ID NO: 3358113 - protein, 17 aa, Plasmodium falciparum
HDMDCKELALIIYSMGK

SEQ ID NO: 3358114 - protein, 19 aa, Plasmodium falciparum
HDMENASISKVFNFDENFH

SEQ ID NO: 3358115 - protein, 19 aa, Plasmodium falciparum
HDNRYICALTEEKIYIKSN

SEQ ID NO: 3358116 - protein, 27 aa, Plasmodium falciparum
HDSHILELVKILKKIIKIVYNTYYCLN

SEQ ID NO: 3358117 - protein, 22 aa, Plasmodium falciparum
HDTCEGSVIVIVDIISNNNIEI

SEQ ID NO: 3358118 - protein, 19 aa, Plasmodium falciparum
HDTCKLYKIVLVEKFSEIL

SEQ ID NO: 3358119 - protein, 17 aa, Plasmodium falciparum
HDTCVSSLEKDKDEYIS

SEQ ID NO: 3358120 - protein, 25 aa, Plasmodium falciparum
HDVIKKKMFLGVSFFIKTNNVIRYM

SEQ ID NO: 3358121 - protein, 19 aa, Plasmodium falciparum
HDVRQIFFNAFTYHKVKNC

SEQ ID NO: 3358122 - protein, 18 aa, Plasmodium falciparum
HDYLEQIILDSYNEKENV

SEQ ID NO: 3358123 - protein, 18 aa, Plasmodium falciparum
HEAAEGLAAIGSESNIPV

SEQ ID NO: 3358124 - protein, 24 aa, Plasmodium falciparum
HEEACKKLKGILKECKKYDKELQE

SEQ ID NO: 3358125 - protein, 17 aa, Plasmodium falciparum
HEELCSVIIVMRHGDRK

SEQ ID NO: 3358126 - protein, 17 aa, Plasmodium falciparum
HEFYKSNNNQLVYIKPP

SEQ ID NO: 3358127 - protein, 31 aa, Plasmodium falciparum
HEGGKWGFFTHLFKWGHIIIPKELEIKLPSP

SEQ ID NO: 3358128 - protein, 18 aa, Plasmodium falciparum
HEGIRLSLHEKIRKNRNE

SEQ ID NO: 3358129 - protein, 19 aa, Plasmodium falciparum
HEHKDEVSLYVKKKKIKKK

SEQ ID NO: 3358130 - protein, 23 aa, Plasmodium falciparum
HEHNLKKILVPRHCIPPQDYQNE

SEQ ID NO: 3358131 - protein, 18 aa, Plasmodium falciparum
HEIIFSGICTNCLLNQEE

SEQ ID NO: 3358132 - protein, 19 aa, Plasmodium falciparum
HEIINCNHILLFIKNKLLL

SEQ ID NO: 3358133 - protein, 25 aa, Plasmodium falciparum
HEIQVRWKSLTKMWYKKNKNKYDTS

SEQ ID NO: 3358134 - protein, 24 aa, Plasmodium falciparum
HEKFLKDEIQIIVATVAFGMGIDK

SEQ ID NO: 3358135 - protein, 26 aa, Plasmodium falciparum
HEKKSKRGRRTGGASKNYKKELGEQK

SEQ ID NO: 3358136 - protein, 24 aa, Plasmodium falciparum
HEKNCGSYNFLTPAQVFFENNKEK

SEQ ID NO: 3358137 - protein, 29 aa, Plasmodium falciparum
HEKNICVNYLLGFCSLGYGCRKIHKTKSR

SEQ ID NO: 3358138 - protein, 17 aa, Plasmodium falciparum
HEKRIDKSLPFSSISSN

SEQ ID NO: 3358139 - protein, 17 aa, Plasmodium falciparum
HEKRKLNHIGYINDISN

SEQ ID NO: 3358140 - protein, 17 aa, Plasmodium falciparum
HEKYIHWDKDKKIMNDN

SEQ ID NO: 3358141 - protein, 23 aa, Plasmodium falciparum
HELFKCPYIYNAIDVELGKYWKT

SEQ ID NO: 3358142 - protein, 18 aa, Plasmodium falciparum
HELLCDLLCLLLNENNEK

SEQ ID NO: 3358143 - protein, 19 aa, Plasmodium falciparum
HELNCLKNNRAVYLKRGNM

SEQ ID NO: 3358144 - protein, 29 aa, Plasmodium falciparum
HELPLCSNKFKFPELEKNIRNFDEDNDQQ

SEQ ID NO: 3358145 - protein, 22 aa, Plasmodium falciparum
HEMIPEKMNILINNNNSNIIND

SEQ ID NO: 3358146 - protein, 25 aa, Plasmodium falciparum
HEMKELRKELILKKKNYEELRLKLN

SEQ ID NO: 3358147 - protein, 62 aa, Plasmodium falciparum
HEMMRIPKMKGVHFDARQKRWCAYGYKKKECFSVYRYGFLIARELAIRSRLKVQKRKNNLRI

SEQ ID NO: 3358148 - protein, 19 aa, Plasmodium falciparum
HENKCQKIAVLQKEKDSSS

SEQ ID NO: 3358149 - protein, 23 aa, Plasmodium falciparum
HENLKKCIDRKIPKNTNENEEES

SEQ ID NO: 3358150 - protein, 26 aa, Plasmodium falciparum
HEQDCCSDKSFDECARKKELELNNNK

SEQ ID NO: 3358151 - protein, 23 aa, Plasmodium falciparum
HEQKCLKPGWYEHDPIEIMTNLY

SEQ ID NO: 3358152 - protein, 27 aa, Plasmodium falciparum
HEQNAACLYGLIHSRFILTSKGLALMR

SEQ ID NO: 3358153 - protein, 22 aa, Plasmodium falciparum
HEQRICKPCAHVYNGSTCMNGD

SEQ ID NO: 3358154 - protein, 21 aa, Plasmodium falciparum
HERIKKCSKTIFQEKIVEVPQ

SEQ ID NO: 3358155 - protein, 24 aa, Plasmodium falciparum
HERWKENMVYNFLANYDKKEKKYI

SEQ ID NO: 3358156 - protein, 33 aa, Plasmodium falciparum
HFCNVCFSFLYYKKYCFYELLRIYKNYSCLNEE

SEQ ID NO: 3358157 - protein, 24 aa, Plasmodium falciparum
HFDEALNYNKTCEYLPNLLTSEEV

SEQ ID NO: 3358158 - protein, 25 aa, Plasmodium falciparum
HFDSHVLKKRANDINPNDANYFNEK

SEQ ID NO: 3358159 - protein, 17 aa, Plasmodium falciparum
HFFSFVFEIGRRYKILN

SEQ ID NO: 3358160 - protein, 22 aa, Plasmodium falciparum
HFGDGWATFLAFEIDQQNEINQ

SEQ ID NO: 3358161 - protein, 20 aa, Plasmodium falciparum
HFGTKYGTCDSWYTNIVLLK

SEQ ID NO: 3358162 - protein, 23 aa, Plasmodium falciparum
HFHKKFIIHRDIKPANTLIKNIQ

SEQ ID NO: 3358163 - protein, 18 aa, Plasmodium falciparum
HFHLKVSRNYSPPNFSNE

SEQ ID NO: 3358164 - protein, 18 aa, Plasmodium falciparum
HFHVESVGSIPPEQIVQM

SEQ ID NO: 3358165 - protein, 24 aa, Plasmodium falciparum
HFIEPPEPLFEVMVNVFVDKKVSI

SEQ ID NO: 3358166 - protein, 40 aa, Plasmodium falciparum
HFIKSYVRKISHSYFSILSKRLLNYYINDMNRYYKQYEQV

SEQ ID NO: 3358167 - protein, 20 aa, Plasmodium falciparum
HFINVKWAKTSVESLLHDVY

SEQ ID NO: 3358168 - protein, 27 aa, Plasmodium falciparum
HFIVFKYITLYSINEWNVLLFKDIDAY

SEQ ID NO: 3358169 - protein, 18 aa, Plasmodium falciparum
HFIYNCVDCNYNTNDNGI

SEQ ID NO: 3358170 - protein, 22 aa, Plasmodium falciparum
HFKDTLHILGAINIIKNMENIQ

SEQ ID NO: 3358171 - protein, 22 aa, Plasmodium falciparum
HFKEKKKFIDNKKFTKKFSTYS

SEQ ID NO: 3358172 - protein, 17 aa, Plasmodium falciparum
HFKKSYRQYSLKHLLLL

SEQ ID NO: 3358173 - protein, 17 aa, Plasmodium falciparum
HFKSAKDAEDFISKYNN

SEQ ID NO: 3358174 - protein, 21 aa, Plasmodium falciparum
HFLQSIKLCLHDDIHTPNIFI

SEQ ID NO: 3358175 - protein, 26 aa, Plasmodium falciparum
HFMKNHFFEYINFFKKKELYHIEKTK

SEQ ID NO: 3358176 - protein, 26 aa, Plasmodium falciparum
HFMKSIPNYIFKKDIEEEIERKNINF

SEQ ID NO: 3358177 - protein, 23 aa, Plasmodium falciparum
HFNKFEFEKGIIRNAIVSTPSNK

SEQ ID NO: 3358178 - protein, 25 aa, Plasmodium falciparum
HFNLCQIYFSLGYHFYKSSFPIIII

SEQ ID NO: 3358179 - protein, 19 aa, Plasmodium falciparum
HFNLKRNTIEYIPRNKRKN

SEQ ID NO: 3358180 - protein, 29 aa, Plasmodium falciparum
HFNMDKEKARLAAVEFMKTVENNGRKKSG

SEQ ID NO: 3358181 - protein, 24 aa, Plasmodium falciparum
HFNMKGKYNFSYFYTKSNNLNADV

SEQ ID NO: 3358182 - protein, 17 aa, Plasmodium falciparum
HFQKNFYYNKLRFLELL

SEQ ID NO: 3358183 - protein, 30 aa, Plasmodium falciparum
HFVQMYVQLCKKLNVHFHNMKLEDDTTVQF

SEQ ID NO: 3358184 - protein, 23 aa, Plasmodium falciparum
HFYDELLQYLMLNNKMDILKEFK

SEQ ID NO: 3358185 - protein, 24 aa, Plasmodium falciparum
HFYVDGKLIYKCHIQYVDNFTLIF

SEQ ID NO: 3358186 - protein, 26 aa, Plasmodium falciparum
HFYVYYCTFCQTSSCKDMLIDDNDLY

SEQ ID NO: 3358187 - protein, 23 aa, Plasmodium falciparum
HGDCNNKHICYYNIHDCNNNILK

SEQ ID NO: 3358188 - protein, 23 aa, Plasmodium falciparum
HGDPHPGNILVMMEEKKKRKRKK

SEQ ID NO: 3358189 - protein, 19 aa, Plasmodium falciparum
HGFQSMGIRNIPELHSKLY

SEQ ID NO: 3358190 - protein, 26 aa, Plasmodium falciparum
HGFYGYKLTSSILFCDTLIACKMFGF

SEQ ID NO: 3358191 - protein, 17 aa, Plasmodium falciparum
HGIGRSGNLDDVQPKSA

SEQ ID NO: 3358192 - protein, 27 aa, Plasmodium falciparum
HGKFMYYDHMCLIFEPLGPSLYEIITR

SEQ ID NO: 3358193 - protein, 19 aa, Plasmodium falciparum
HGKNYICIGYIIGNTNKLV

SEQ ID NO: 3358194 - protein, 19 aa, Plasmodium falciparum
HGLFNLLFDIYGFNKDIFK

SEQ ID NO: 3358195 - protein, 21 aa, Plasmodium falciparum
HGLRITQQFLHNIIIKKKEYL

SEQ ID NO: 3358196 - protein, 17 aa, Plasmodium falciparum
HGLSEGWENLKANINNF

SEQ ID NO: 3358197 - protein, 22 aa, Plasmodium falciparum
HGNAEDRNPCLFSDKNRFSNES

SEQ ID NO: 3358198 - protein, 33 aa, Plasmodium falciparum
HGNIFTERCDFCGRRYLRDYLISTISFKPTGSL

SEQ ID NO: 3358199 - protein, 26 aa, Plasmodium falciparum
HGPPGCGKTYIALLIKEELSLLKKKF

SEQ ID NO: 3358200 - protein, 20 aa, Plasmodium falciparum
HGQIKPCSLKKCYNKDDIKV

SEQ ID NO: 3358201 - protein, 18 aa, Plasmodium falciparum
HGVSEIFNEVKLDEGLFG

SEQ ID NO: 3358202 - protein, 19 aa, Plasmodium falciparum
HGYNYFPDINFFEDIKRAP

SEQ ID NO: 3358203 - protein, 26 aa, Plasmodium falciparum
HHCSRSHPSGFCIFNNISVACKYIFK

SEQ ID NO: 3358204 - protein, 30 aa, Plasmodium falciparum
HHDGSVIPNNFCNNFSMYANMMNIQNVNGG

SEQ ID NO: 3358205 - protein, 24 aa, Plasmodium falciparum
HHFVISKPCGRRNVGSNWKIKLKG

SEQ ID NO: 3358206 - protein, 22 aa, Plasmodium falciparum
HHGLRNFDMIFVFKDYTKPVKR

SEQ ID NO: 3358207 - protein, 26 aa, Plasmodium falciparum
HHHHHLLKYIPQWLMDKISVHSNLYI

SEQ ID NO: 3358208 - protein, 18 aa, Plasmodium falciparum
HHIKRISINSNINMYQKE

SEQ ID NO: 3358209 - protein, 23 aa, Plasmodium falciparum
HHLFFTFYSLCKIMVFEDKISKE

SEQ ID NO: 3358210 - protein, 17 aa, Plasmodium falciparum
HHNLSCDKFNIKKKKQT

SEQ ID NO: 3358211 - protein, 25 aa, Plasmodium falciparum
HHRNKLCPNDEKFIKRNDLFNKKNV

SEQ ID NO: 3358212 - protein, 18 aa, Plasmodium falciparum
HHSYIYGIIFLFNIGKHY

SEQ ID NO: 3358213 - protein, 17 aa, Plasmodium falciparum
HHTKRSTSEFLQNPNSK

SEQ ID NO: 3358214 - protein, 38 aa, Plasmodium falciparum
HHVEKHPGARACHLSFFYKDKLFIHGGTNLKAEKDDFF

SEQ ID NO: 3358215 - protein, 24 aa, Plasmodium falciparum
HIAKRINLILNDTIEFFQKHTYLH

SEQ ID NO: 3358216 - protein, 19 aa, Plasmodium falciparum
HIASLFVRDPIVVFEGSYS

SEQ ID NO: 3358217 - protein, 25 aa, Plasmodium falciparum
HICSLTLKQVIKFFIKHADTKKLLE

SEQ ID NO: 3358218 - protein, 18 aa, Plasmodium falciparum
HIDYCSIPQYFILTPQII

SEQ ID NO: 3358219 - protein, 22 aa, Plasmodium falciparum
HIDYWFLHKFYNIYNLQNKLKT

SEQ ID NO: 3358220 - protein, 20 aa, Plasmodium falciparum
HIEFVLPLFNPLFYKELQEL

SEQ ID NO: 3358221 - protein, 23 aa, Plasmodium falciparum
HIEKCLLSYIIQFTIVCKYLECG

SEQ ID NO: 3358222 - protein, 27 aa, Plasmodium falciparum
HIFPSVYNIRFHIVTKFCLITQKHILK

SEQ ID NO: 3358223 - protein, 22 aa, Plasmodium falciparum
HIFRSNEVSIHFNDDIKKIEHV

SEQ ID NO: 3358224 - protein, 19 aa, Plasmodium falciparum
HIFTERFSYHASDEHNEKS

SEQ ID NO: 3358225 - protein, 17 aa, Plasmodium falciparum
HIGHIEFVLPLFNPLFY

SEQ ID NO: 3358226 - protein, 21 aa, Plasmodium falciparum
HIGNLPLDLSNIYESNNNQKD

SEQ ID NO: 3358227 - protein, 18 aa, Plasmodium falciparum
HIHNFFCTYDYLKNFHGI

SEQ ID NO: 3358228 - protein, 25 aa, Plasmodium falciparum
HIIIPPRRLAILLHQSLKYQVDNCL

SEQ ID NO: 3358229 - protein, 25 aa, Plasmodium falciparum
HIINHIKDILLKRDVINRSCPHEMI

SEQ ID NO: 3358230 - protein, 18 aa, Plasmodium falciparum
HIIPESLYIPNLLTNSLK

SEQ ID NO: 3358231 - protein, 18 aa, Plasmodium falciparum
HIKCFSYEYYNIIKKGFN

SEQ ID NO: 3358232 - protein, 23 aa, Plasmodium falciparum
HIKDDYFYYIAFQKIKQIIDVMD

SEQ ID NO: 3358233 - protein, 25 aa, Plasmodium falciparum
HIKDMCMYELIGPKSFDLLINILKV

SEQ ID NO: 3358234 - protein, 39 aa, Plasmodium falciparum
HIKEKRSLYHYNIKQFIKWKVYLLNNINICLYGIGSKFH

SEQ ID NO: 3358235 - protein, 18 aa, Plasmodium falciparum
HIKGIILKNVIKSNNNNY

SEQ ID NO: 3358236 - protein, 18 aa, Plasmodium falciparum
HIKGSPFRIIFKNDNNMY

SEQ ID NO: 3358237 - protein, 24 aa, Plasmodium falciparum
HIKIMKYKKSYYKVIEQLNKTWIN

SEQ ID NO: 3358238 - protein, 25 aa, Plasmodium falciparum
HIKKAAKLPRCEGIGYDELSQSWVS

SEQ ID NO: 3358239 - protein, 20 aa, Plasmodium falciparum
HIKKYSSLYGKNEKKNDIIN

SEQ ID NO: 3358240 - protein, 24 aa, Plasmodium falciparum
HIKNKPNNSLRFSSNDRKSYNDMF

SEQ ID NO: 3358241 - protein, 17 aa, Plasmodium falciparum
HILILFQARPMLEFYKP

SEQ ID NO: 3358242 - protein, 19 aa, Plasmodium falciparum
HILKFSCQVNNSSKMLSDT

SEQ ID NO: 3358243 - protein, 22 aa, Plasmodium falciparum
HILKRVYFGKCIALRRNQYMNN

SEQ ID NO: 3358244 - protein, 25 aa, Plasmodium falciparum
HILLCSFKNIILIYSLKKKYIHYPF

SEQ ID NO: 3358245 - protein, 21 aa, Plasmodium falciparum
HILNEICFHFGKTEIMPDKIY

SEQ ID NO: 3358246 - protein, 20 aa, Plasmodium falciparum
HILNPKSSTVSFSRDVSQPL

SEQ ID NO: 3358247 - protein, 28 aa, Plasmodium falciparum
HILPFTDFYMNIEISYQIKCKRKDSLHS

SEQ ID NO: 3358248 - protein, 28 aa, Plasmodium falciparum
HILYCICKYCSSLLLSKEKIDFYCNLKK

SEQ ID NO: 3358249 - protein, 19 aa, Plasmodium falciparum
HIMCKKCADDYFHLTQIAD

SEQ ID NO: 3358250 - protein, 17 aa, Plasmodium falciparum
HIMSEFLEEFKIIREYH

SEQ ID NO: 3358251 - protein, 19 aa, Plasmodium falciparum
HINFFLKLMNMFDSEYIDN

SEQ ID NO: 3358252 - protein, 26 aa, Plasmodium falciparum
HINKYYMKEEMNYFKKAIKEMKRLKK

SEQ ID NO: 3358253 - protein, 22 aa, Plasmodium falciparum
HINLFKIPNFFMTTSNELSEVS

SEQ ID NO: 3358254 - protein, 29 aa, Plasmodium falciparum
HINRYEGYWFRGMKHGYAILYEGDHIYYA

SEQ ID NO: 3358255 - protein, 25 aa, Plasmodium falciparum
HINYFNKLLFVWSYIDLLEIILKEC

SEQ ID NO: 3358256 - protein, 17 aa, Plasmodium falciparum
HIPNEWIQTDLLSAFSP

SEQ ID NO: 3358257 - protein, 27 aa, Plasmodium falciparum
HIPYQEWNQCFTFKKKVLYAIEVLKNI

SEQ ID NO: 3358258 - protein, 25 aa, Plasmodium falciparum
HIQNIQWVQLLPLSYIKGNHINFFS

SEQ ID NO: 3358259 - protein, 18 aa, Plasmodium falciparum
HIRRYIVNTVKEKKIDLY

SEQ ID NO: 3358260 - protein, 24 aa, Plasmodium falciparum
HISSNFAFNYLIKFHFIDNHFLLK

SEQ ID NO: 3358261 - protein, 17 aa, Plasmodium falciparum
HITCNICMHNVNTDGNN

SEQ ID NO: 3358262 - protein, 26 aa, Plasmodium falciparum
HITFKHIIKTPLYLYKSKEDKNKNNS

SEQ ID NO: 3358263 - protein, 25 aa, Plasmodium falciparum
HITNFKEYVEKRIKDINNIMDMNRK

SEQ ID NO: 3358264 - protein, 18 aa, Plasmodium falciparum
HIYCNNCIFNNLKTRNRK

SEQ ID NO: 3358265 - protein, 24 aa, Plasmodium falciparum
HIYDYKGNCIASRPFHQCDYGGII

SEQ ID NO: 3358266 - protein, 17 aa, Plasmodium falciparum
HIYFHARLVCGRTQKGT

SEQ ID NO: 3358267 - protein, 19 aa, Plasmodium falciparum
HIYISFNYINIVQPFYEHI

SEQ ID NO: 3358268 - protein, 19 aa, Plasmodium falciparum
HKAISIMKSSEFSFRKIMD

SEQ ID NO: 3358269 - protein, 27 aa, Plasmodium falciparum
HKAKGLEWKVVFIINVTEGEIPQAVDS

SEQ ID NO: 3358270 - protein, 25 aa, Plasmodium falciparum
HKASEAIEALTVMNGMEVAGREIKV

SEQ ID NO: 3358271 - protein, 17 aa, Plasmodium falciparum
HKCHYFKMMNKINYITE

SEQ ID NO: 3358272 - protein, 18 aa, Plasmodium falciparum
HKDFKNGRISFRCLSSTI

SEQ ID NO: 3358273 - protein, 19 aa, Plasmodium falciparum
HKDILLKIKSLPLIQKLCL

SEQ ID NO: 3358274 - protein, 19 aa, Plasmodium falciparum
HKDKEKVLMMSNDKKKSGL

SEQ ID NO: 3358275 - protein, 19 aa, Plasmodium falciparum
HKDKIFCLQSYEDENKNNN

SEQ ID NO: 3358276 - protein, 25 aa, Plasmodium falciparum
HKDVLKSKKYRKIITKLSEIANGNL

SEQ ID NO: 3358277 - protein, 21 aa, Plasmodium falciparum
HKEIINIPSVRNIKSGEKKEK

SEQ ID NO: 3358278 - protein, 24 aa, Plasmodium falciparum
HKEKMLLCNNEFLHKYKIYGKYGN

SEQ ID NO: 3358279 - protein, 26 aa, Plasmodium falciparum
HKEMEGYIMDTIMGIILNELKGKNNV

SEQ ID NO: 3358280 - protein, 38 aa, Plasmodium falciparum
HKENNCKVINIYSCYAIWLCMNEIYPSWFDISIHPAQF

SEQ ID NO: 3358281 - protein, 29 aa, Plasmodium falciparum
HKETVNFFIERICIIINPIIPHVTEHIWT

SEQ ID NO: 3358282 - protein, 19 aa, Plasmodium falciparum
HKFVPKWDIHEVPRPVVKY

SEQ ID NO: 3358283 - protein, 22 aa, Plasmodium falciparum
HKFYYRHIHSNIKDNEEGSKNI

SEQ ID NO: 3358284 - protein, 33 aa, Plasmodium falciparum
HKGRCSPCKYEWTRGCHLGSRCRFCHDQSHVPE

SEQ ID NO: 3358285 - protein, 17 aa, Plasmodium falciparum
HKHFIKFINKIKKILKN

SEQ ID NO: 3358286 - protein, 23 aa, Plasmodium falciparum
HKIGCSFINIHFILYTNYKEYVQ

SEQ ID NO: 3358287 - protein, 24 aa, Plasmodium falciparum
HKIGKKMCKNVCSKKNLCNIQKNV

SEQ ID NO: 3358288 - protein, 21 aa, Plasmodium falciparum
HKIIKPGRHSFFNANKLLNSI

SEQ ID NO: 3358289 - protein, 20 aa, Plasmodium falciparum
HKIKHYKCPYENCSYTYSTI

SEQ ID NO: 3358290 - protein, 17 aa, Plasmodium falciparum
HKILSALFNNISKETLK

SEQ ID NO: 3358291 - protein, 24 aa, Plasmodium falciparum
HKINYCSDCSSSSLSWHNQEYDDL

SEQ ID NO: 3358292 - protein, 21 aa, Plasmodium falciparum
HKIYRRHMNSLNSFIDILSFR

SEQ ID NO: 3358293 - protein, 20 aa, Plasmodium falciparum
HKKKESSSRMCAPYDTTYLG

SEQ ID NO: 3358294 - protein, 21 aa, Plasmodium falciparum
HKKKIKKYFLKISKELDKCVS

SEQ ID NO: 3358295 - protein, 19 aa, Plasmodium falciparum
HKKKILDLCHQMNQINEEL

SEQ ID NO: 3358296 - protein, 20 aa, Plasmodium falciparum
HKKKILYIILQNGNNKSEEK

SEQ ID NO: 3358297 - protein, 20 aa, Plasmodium falciparum
HKKLCLSIHHNKGPISGRRH

SEQ ID NO: 3358298 - protein, 20 aa, Plasmodium falciparum
HKKLNLVVGVVKSYLTRVGC

SEQ ID NO: 3358299 - protein, 31 aa, Plasmodium falciparum
HKKMCFKKKYVCLECNKIYLHLNGYNKHINK

SEQ ID NO: 3358300 - protein, 23 aa, Plasmodium falciparum
HKKNVFFPYAIILTNTREAACEL

SEQ ID NO: 3358301 - protein, 22 aa, Plasmodium falciparum
HKLDDLEWLACETNDKGWLAIS

SEQ ID NO: 3358302 - protein, 21 aa, Plasmodium falciparum
HKLDLFIKKMDELYHIFMEKT

SEQ ID NO: 3358303 - protein, 19 aa, Plasmodium falciparum
HKLKKKKKKNISMENINKN

SEQ ID NO: 3358304 - protein, 21 aa, Plasmodium falciparum
HKLKTMFCPMYKNEWRINKND

SEQ ID NO: 3358305 - protein, 17 aa, Plasmodium falciparum
HKLMHKKVMSIRNYSAP

SEQ ID NO: 3358306 - protein, 19 aa, Plasmodium falciparum
HKLMKLKLTNITSESINNS

SEQ ID NO: 3358307 - protein, 23 aa, Plasmodium falciparum
HKLNLNCGVQFSKIFYIYNPLSI

SEQ ID NO: 3358308 - protein, 17 aa, Plasmodium falciparum
HKLNMSNSMMKTNTFGN

SEQ ID NO: 3358309 - protein, 21 aa, Plasmodium falciparum
HKLRMDDLFEVFKLSKTDEDY

SEQ ID NO: 3358310 - protein, 17 aa, Plasmodium falciparum
HKLYGPKGIGALYIKRK

SEQ ID NO: 3358311 - protein, 17 aa, Plasmodium falciparum
HKNECNRYYQYRENDYN

SEQ ID NO: 3358312 - protein, 18 aa, Plasmodium falciparum
HKNFIPIFYENCNKEKDN

SEQ ID NO: 3358313 - protein, 17 aa, Plasmodium falciparum
HKNGRFYSVQFHPEGNN

SEQ ID NO: 3358314 - protein, 26 aa, Plasmodium falciparum
HKNIEIFKIASLYIIAAFNADIKISS

SEQ ID NO: 3358315 - protein, 27 aa, Plasmodium falciparum
HKNILEELLEILGLYISNVPCLIISKH

SEQ ID NO: 3358316 - protein, 21 aa, Plasmodium falciparum
HKNIQDFNLFFNINIEKAEDI

SEQ ID NO: 3358317 - protein, 38 aa, Plasmodium falciparum
HKNISYVICKNYLKKGKNYYERRMLKNMNLKYNILKIN

SEQ ID NO: 3358318 - protein, 23 aa, Plasmodium falciparum
HKNNFKEVISFIEKNVIKNIPAV

SEQ ID NO: 3358319 - protein, 21 aa, Plasmodium falciparum
HKNNIHQIYFMKKRKIFINNM

SEQ ID NO: 3358320 - protein, 21 aa, Plasmodium falciparum
HKNVLLQYFHFMKWDKENFIV

SEQ ID NO: 3358321 - protein, 23 aa, Plasmodium falciparum
HKPTKIRYALKCVSKRSIINLNQ

SEQ ID NO: 3358322 - protein, 20 aa, Plasmodium falciparum
HKQGRFIVHSTFGGKNEDYV

SEQ ID NO: 3358323 - protein, 24 aa, Plasmodium falciparum
HKRDTCIHPLLLLNEDLFLLKDFN

SEQ ID NO: 3358324 - protein, 18 aa, Plasmodium falciparum
HKRHSSFNILKSKEKFFK

SEQ ID NO: 3358325 - protein, 26 aa, Plasmodium falciparum
HKRLEAESGAQISIRGKGTLKEGKKT

SEQ ID NO: 3358326 - protein, 21 aa, Plasmodium falciparum
HKRMNAIRMRKENQVYSAEEQ

SEQ ID NO: 3358327 - protein, 21 aa, Plasmodium falciparum
HKRNSRNYHMVGKLKGTTSNY

SEQ ID NO: 3358328 - protein, 45 aa, Plasmodium falciparum
HKSHHYGFVLSQAFPCYLDPYPVSKYGIYGAVPIYVIKKTLLEYR

SEQ ID NO: 3358329 - protein, 22 aa, Plasmodium falciparum
HKSTNWWSSFMKVVRNDKFIKE

SEQ ID NO: 3358330 - protein, 23 aa, Plasmodium falciparum
HKTLKHRVNLFLFYVITEYDEYG

SEQ ID NO: 3358331 - protein, 17 aa, Plasmodium falciparum
HKTQLSSILGYQGIDKI

SEQ ID NO: 3358332 - protein, 20 aa, Plasmodium falciparum
HKTTHFLSPMNIIVTSLDTD

SEQ ID NO: 3358333 - protein, 20 aa, Plasmodium falciparum
HKVYILKCLIRKENKKNISN

SEQ ID NO: 3358334 - protein, 27 aa, Plasmodium falciparum
HKWDQILICLCKACFFNIAKSTSNTNV

SEQ ID NO: 3358335 - protein, 20 aa, Plasmodium falciparum
HKYFHHNFFYLKNLNNSENI

SEQ ID NO: 3358336 - protein, 17 aa, Plasmodium falciparum
HKYFYNSIHLFHELIYS

SEQ ID NO: 3358337 - protein, 42 aa, Plasmodium falciparum
HKYIIAVDMRMRIHKTRHVIQIQDILFSFAIIMHQLNNFKMA

SEQ ID NO: 3358338 - protein, 29 aa, Plasmodium falciparum
HKYLSLLIWCLFKYNILHNYINKLIPIIQ

SEQ ID NO: 3358339 - protein, 20 aa, Plasmodium falciparum
HKYNVYQYYVDVDFVHYYNA

SEQ ID NO: 3358340 - protein, 24 aa, Plasmodium falciparum
HKYPYKGLLDFLAYKCLSEGTNAW

SEQ ID NO: 3358341 - protein, 21 aa, Plasmodium falciparum
HKYSIRYEGYIFVPHNGTYTF

SEQ ID NO: 3358342 - protein, 26 aa, Plasmodium falciparum
HKYTHYEIYKSMFAYGKIAQMRNNLE

SEQ ID NO: 3358343 - protein, 19 aa, Plasmodium falciparum
HKYYIIDMIKSCLKKVNIK

SEQ ID NO: 3358344 - protein, 20 aa, Plasmodium falciparum
HLAHINDLCYIHSEKNEYTK

SEQ ID NO: 3358345 - protein, 25 aa, Plasmodium falciparum
HLAKEPNEALIFYNKIIDEFKKQYN

SEQ ID NO: 3358346 - protein, 27 aa, Plasmodium falciparum
HLAKLFPTQWRTIAPIVGRTAQQCLEH

SEQ ID NO: 3358347 - protein, 35 aa, Plasmodium falciparum
HLATYKSTICSFWGKGKCFNGNKCRFAHGNEDIKM

SEQ ID NO: 3358348 - protein, 21 aa, Plasmodium falciparum
HLDDALSCIIAYSQLPSNHKY

SEQ ID NO: 3358349 - protein, 25 aa, Plasmodium falciparum
HLDVCFSVDFFLNVIRKYNIQPNMS

SEQ ID NO: 3358350 - protein, 24 aa, Plasmodium falciparum
HLEGYKKIGNNSCEQNFDYTKYKA

SEQ ID NO: 3358351 - protein, 26 aa, Plasmodium falciparum
HLESPLDILVCAGLISSKKLIEAQAI

SEQ ID NO: 3358352 - protein, 20 aa, Plasmodium falciparum
HLFKKYGLKCYNSMSKGLLS

SEQ ID NO: 3358353 - protein, 19 aa, Plasmodium falciparum
HLFLLGLYFNIFFLYNNKE

SEQ ID NO: 3358354 - protein, 26 aa, Plasmodium falciparum
HLFNKFKTCIQIGGSDQWGNIQSGIE

SEQ ID NO: 3358355 - protein, 20 aa, Plasmodium falciparum
HLHEHLHKSILIKKKYNIDN

SEQ ID NO: 3358356 - protein, 31 aa, Plasmodium falciparum
HLHFLFCRSYEKYALLLRLILIFKKKKLGKT

SEQ ID NO: 3358357 - protein, 25 aa, Plasmodium falciparum
HLHYEKKCFPCFINKNDISEKNIII

SEQ ID NO: 3358358 - protein, 17 aa, Plasmodium falciparum
HLIHIDYGFMLTNSPGN

SEQ ID NO: 3358359 - protein, 21 aa, Plasmodium falciparum
HLIKSEAKDKIILKKKISQLT

SEQ ID NO: 3358360 - protein, 22 aa, Plasmodium falciparum
HLKNILPPYCFFLLTEKNQSFK

SEQ ID NO: 3358361 - protein, 23 aa, Plasmodium falciparum
HLKNNEILNNFLFTSSDITRGTI

SEQ ID NO: 3358362 - protein, 19 aa, Plasmodium falciparum
HLKSSYKMQKEMSMEKENV

SEQ ID NO: 3358363 - protein, 25 aa, Plasmodium falciparum
HLKTTLIGIPINFIARNKIDEQNNL

SEQ ID NO: 3358364 - protein, 17 aa, Plasmodium falciparum
HLLDFPNIIIKGTELNL

SEQ ID NO: 3358365 - protein, 23 aa, Plasmodium falciparum
HLLEENKFRCMKIIYENENIKSS

SEQ ID NO: 3358366 - protein, 20 aa, Plasmodium falciparum
HLLLFRFLCLDKETGDITIP

SEQ ID NO: 3358367 - protein, 24 aa, Plasmodium falciparum
HLLLKYDDVYSRWGVSSNPKKKKN

SEQ ID NO: 3358368 - protein, 18 aa, Plasmodium falciparum
HLLPAKLKNIYNTNKNKA

SEQ ID NO: 3358369 - protein, 23 aa, Plasmodium falciparum
HLLSKAKGVFLIMDNCNNIERTY

SEQ ID NO: 3358370 - protein, 19 aa, Plasmodium falciparum
HLMTKWLKEFEEILDKIFL

SEQ ID NO: 3358371 - protein, 25 aa, Plasmodium falciparum
HLNKWMFPIMDFKKNYSIRQNLQYL

SEQ ID NO: 3358372 - protein, 21 aa, Plasmodium falciparum
HLNNHSIYNFVYPENKNIYDA

SEQ ID NO: 3358373 - protein, 23 aa, Plasmodium falciparum
HLNNIYLEFSLLNNFLKELKENI

SEQ ID NO: 3358374 - protein, 18 aa, Plasmodium falciparum
HLNVRRKRIVQSSDESDE

SEQ ID NO: 3358375 - protein, 19 aa, Plasmodium falciparum
HLRKNIYLLSSNVKSSHIK

SEQ ID NO: 3358376 - protein, 20 aa, Plasmodium falciparum
HLRKRVRLNLPEPILNENEI

SEQ ID NO: 3358377 - protein, 19 aa, Plasmodium falciparum
HLSLCLKLNMTNPIICLYC

SEQ ID NO: 3358378 - protein, 28 aa, Plasmodium falciparum
HLSMLFKQNIGINYEYYYEQFLFILNKI

SEQ ID NO: 3358379 - protein, 17 aa, Plasmodium falciparum
HLTCQKIVHEKATKERY

SEQ ID NO: 3358380 - protein, 17 aa, Plasmodium falciparum
HLTMYIDVIEKLKNEIE

SEQ ID NO: 3358381 - protein, 18 aa, Plasmodium falciparum
HLTTRPSKEWFDYWKRHM

SEQ ID NO: 3358382 - protein, 26 aa, Plasmodium falciparum
HLVFKRKRWKYIILDEAHNIKNFNTK

SEQ ID NO: 3358383 - protein, 18 aa, Plasmodium falciparum
HLVNALPYIDSYDNELEQ

SEQ ID NO: 3358384 - protein, 19 aa, Plasmodium falciparum
HLYFLPNIIFLDVSYNMLK

SEQ ID NO: 3358385 - protein, 19 aa, Plasmodium falciparum
HLYLSVPFYVIINDENINE

SEQ ID NO: 3358386 - protein, 18 aa, Plasmodium falciparum
HLYMRKKKLLFFYFYQDL

SEQ ID NO: 3358387 - protein, 25 aa, Plasmodium falciparum
HMDDQRLNAVLIFTDGSLRDNNGNN

SEQ ID NO: 3358388 - protein, 19 aa, Plasmodium falciparum
HMDELKKNYTIIDIAPVGK

SEQ ID NO: 3358389 - protein, 18 aa, Plasmodium falciparum
HMENCAFSKYQEDLYKNV

SEQ ID NO: 3358390 - protein, 28 aa, Plasmodium falciparum
HMENFKSCYRINPPFFPQNINIDMMLYK

SEQ ID NO: 3358391 - protein, 18 aa, Plasmodium falciparum
HMENMLINLGFKGVDINN

SEQ ID NO: 3358392 - protein, 19 aa, Plasmodium falciparum
HMFDRFFTFDTDLLSIEKQ

SEQ ID NO: 3358393 - protein, 34 aa, Plasmodium falciparum
HMKDILFLRYRYMCILNILIKYNLKYGDSKNSVF

SEQ ID NO: 3358394 - protein, 21 aa, Plasmodium falciparum
HMNEIYKPYIYGFMDNNMSIK

SEQ ID NO: 3358395 - protein, 25 aa, Plasmodium falciparum
HMNFISVKGPEIFSKYVGESEKSIR

SEQ ID NO: 3358396 - protein, 20 aa, Plasmodium falciparum
HMRECCANYLLNNAINSHIP

SEQ ID NO: 3358397 - protein, 24 aa, Plasmodium falciparum
HMTKLINAFIHFMKYRDQLYNENG

SEQ ID NO: 3358398 - protein, 29 aa, Plasmodium falciparum
HMVKFDKSFSLDMCLLKLRRKNLRQNFIP

SEQ ID NO: 3358399 - protein, 25 aa, Plasmodium falciparum
HMYKNNFKYDYKNNKGYNLKMGKGY

SEQ ID NO: 3358400 - protein, 26 aa, Plasmodium falciparum
HNDDLSLCLFDEYKLSTCTDPEEKKI

SEQ ID NO: 3358401 - protein, 21 aa, Plasmodium falciparum
HNDGKKIVCEEPFSFFRRHDC

SEQ ID NO: 3358402 - protein, 21 aa, Plasmodium falciparum
HNEAAFFELLNDFFPSLYDIK

SEQ ID NO: 3358403 - protein, 26 aa, Plasmodium falciparum
HNELDLSAVALLEYYSKKNNIPKDLS

SEQ ID NO: 3358404 - protein, 21 aa, Plasmodium falciparum
HNFHKSCLKQYIESFEMENAD

SEQ ID NO: 3358405 - protein, 25 aa, Plasmodium falciparum
HNFKAEFKKGLRFKQKCVDIYSRDP

SEQ ID NO: 3358406 - protein, 19 aa, Plasmodium falciparum
HNFSNEIDKAITISSLTGY

SEQ ID NO: 3358407 - protein, 23 aa, Plasmodium falciparum
HNFSYPQFNGSFMKNNNFKKNSY

SEQ ID NO: 3358408 - protein, 24 aa, Plasmodium falciparum
HNFTRFIYIPRYCKYRNEEYKSYV

SEQ ID NO: 3358409 - protein, 28 aa, Plasmodium falciparum
HNFVPLYFNNGLFKYVYNFSQVEDNTNI

SEQ ID NO: 3358410 - protein, 22 aa, Plasmodium falciparum
HNGKRNTFHLFNSKNLINKRTL

SEQ ID NO: 3358411 - protein, 17 aa, Plasmodium falciparum
HNICATITSTTAESKSR

SEQ ID NO: 3358412 - protein, 19 aa, Plasmodium falciparum
HNIDFRGRMYPLSPHLHHM

SEQ ID NO: 3358413 - protein, 17 aa, Plasmodium falciparum
HNIICGVFDCLKKKNKK

SEQ ID NO: 3358414 - protein, 17 aa, Plasmodium falciparum
HNIKEFFFNSHNKLKEE

SEQ ID NO: 3358415 - protein, 42 aa, Plasmodium falciparum
HNIKLLYNHLYLIKQREAHILRVRNYKVGYLNKGNHISRKQQ

SEQ ID NO: 3358416 - protein, 23 aa, Plasmodium falciparum
HNIKRNVMNIIFKSINDVCTMPD

SEQ ID NO: 3358417 - protein, 19 aa, Plasmodium falciparum
HNITESFFSPNKIFTIRKG

SEQ ID NO: 3358418 - protein, 23 aa, Plasmodium falciparum
HNKEISVNFMYNNIILDNNNNIN

SEQ ID NO: 3358419 - protein, 26 aa, Plasmodium falciparum
HNKGSCNPCANYFFHFSGCSKGNQCT

SEQ ID NO: 3358420 - protein, 18 aa, Plasmodium falciparum
HNKISFKKYHGIIRRKYK

SEQ ID NO: 3358421 - protein, 24 aa, Plasmodium falciparum
HNKKNEKKSGCNIKTKEQNNNKNT

SEQ ID NO: 3358422 - protein, 33 aa, Plasmodium falciparum
HNKKYLLNTLMKYNKIDLINIFVDICNHLKTDN

SEQ ID NO: 3358423 - protein, 17 aa, Plasmodium falciparum
HNKNIPANMQFDKINKN

SEQ ID NO: 3358424 - protein, 23 aa, Plasmodium falciparum
HNKRFCVFVNTFCKFTYVEDNKD

SEQ ID NO: 3358425 - protein, 19 aa, Plasmodium falciparum
HNKYVRFLNSCYEKKMNSV

SEQ ID NO: 3358426 - protein, 20 aa, Plasmodium falciparum
HNLFSYALTFKHFYDIHNVL

SEQ ID NO: 3358427 - protein, 25 aa, Plasmodium falciparum
HNLKCLKYAITACIYSHIKISGKSI

SEQ ID NO: 3358428 - protein, 24 aa, Plasmodium falciparum
HNLKKLLKELVLLNTRKVQLKLKQ

SEQ ID NO: 3358429 - protein, 22 aa, Plasmodium falciparum
HNLKYVGVTGLALIVKINPLYA

SEQ ID NO: 3358430 - protein, 22 aa, Plasmodium falciparum
HNLLYRLFLKISNNINKKKEKT

SEQ ID NO: 3358431 - protein, 22 aa, Plasmodium falciparum
HNLPSYIQKSIETIFEKNNKEN

SEQ ID NO: 3358432 - protein, 23 aa, Plasmodium falciparum
HNLRKIRKPRSYDFEYVDDKTKK

SEQ ID NO: 3358433 - protein, 20 aa, Plasmodium falciparum
HNNHRVNIHMNYRNKNNCMN

SEQ ID NO: 3358434 - protein, 33 aa, Plasmodium falciparum
HNNIEGSLSHSNRLRESIKFEDKKKNNNSNNYS

SEQ ID NO: 3358435 - protein, 25 aa, Plasmodium falciparum
HNNKNKYTSCNFVLPGETNDEKNKE

SEQ ID NO: 3358436 - protein, 25 aa, Plasmodium falciparum
HNNLKELWSLLNFLMPKIFDNSEEF

SEQ ID NO: 3358437 - protein, 25 aa, Plasmodium falciparum
HNNNLICYRNMDCHNYIINQHSNSI

SEQ ID NO: 3358438 - protein, 20 aa, Plasmodium falciparum
HNNNRPWNIYNRNNIIKDED

SEQ ID NO: 3358439 - protein, 28 aa, Plasmodium falciparum
HNPRIEQVFKPKIVKNIEVQKHVPISVD

SEQ ID NO: 3358440 - protein, 17 aa, Plasmodium falciparum
HNQFKDSYYNLLSNEDV

SEQ ID NO: 3358441 - protein, 18 aa, Plasmodium falciparum
HNRAYYFFSPDDILDNII

SEQ ID NO: 3358442 - protein, 29 aa, Plasmodium falciparum
HNRTALWYSCRNGSLKMARLILKKGSNIN

SEQ ID NO: 3358443 - protein, 19 aa, Plasmodium falciparum
HNSECGVCKGACTAYQGKL

SEQ ID NO: 3358444 - protein, 24 aa, Plasmodium falciparum
HNSLICIVDELFILHNLQGEEIFA

SEQ ID NO: 3358445 - protein, 19 aa, Plasmodium falciparum
HNSMKLIGNNYPMNFENNE

SEQ ID NO: 3358446 - protein, 17 aa, Plasmodium falciparum
HNTKYICYESSEYIKKD

SEQ ID NO: 3358447 - protein, 29 aa, Plasmodium falciparum
HNVIFGKLWVELHGNIIIRNHNNGDFSIV

SEQ ID NO: 3358448 - protein, 24 aa, Plasmodium falciparum
HNVKGEGILCFVVKKKGDIKNYSK

SEQ ID NO: 3358449 - protein, 20 aa, Plasmodium falciparum
HNYHQPYNCNIYSDDYEISN

SEQ ID NO: 3358450 - protein, 31 aa, Plasmodium falciparum
HNYIRINLFDACNCLYYLNPSFIKKVSKKFT

SEQ ID NO: 3358451 - protein, 19 aa, Plasmodium falciparum
HNYSYSWCTKNFIQYKALN

SEQ ID NO: 3358452 - protein, 17 aa, Plasmodium falciparum
HNYYNYFPLYYNDDYMI

SEQ ID NO: 3358453 - protein, 23 aa, Plasmodium falciparum
HPCHAQWFLFWVFASYLNEKFSD

SEQ ID NO: 3358454 - protein, 17 aa, Plasmodium falciparum
HPDKFLTNFKKSGDAKD

SEQ ID NO: 3358455 - protein, 24 aa, Plasmodium falciparum
HPEFKGSRISPGYVSFHEKTDSFT

SEQ ID NO: 3358456 - protein, 19 aa, Plasmodium falciparum
HPENAIFFDYFINLKKKAI

SEQ ID NO: 3358457 - protein, 19 aa, Plasmodium falciparum
HPFGFFFFYFYNRGSLLVM

SEQ ID NO: 3358458 - protein, 20 aa, Plasmodium falciparum
HPGECVGALAAQSIGEPATQ

SEQ ID NO: 3358459 - protein, 25 aa, Plasmodium falciparum
HPHYPDVRSVGMCLYYILRGKVNVN

SEQ ID NO: 3358460 - protein, 17 aa, Plasmodium falciparum
HPIRLYCRYVDKIWILF

SEQ ID NO: 3358461 - protein, 21 aa, Plasmodium falciparum
HPKCKKRKSFEQVQKELSQEM

SEQ ID NO: 3358462 - protein, 25 aa, Plasmodium falciparum
HPLTSNPLWNRAVILITNKEKNNIV

SEQ ID NO: 3358463 - protein, 18 aa, Plasmodium falciparum
HPLYEDLFAISFKNNDFK

SEQ ID NO: 3358464 - protein, 17 aa, Plasmodium falciparum
HPMIQFHALTLLCSIKN

SEQ ID NO: 3358465 - protein, 21 aa, Plasmodium falciparum
HPNFYTNYYQSFIKNDNIPYI

SEQ ID NO: 3358466 - protein, 27 aa, Plasmodium falciparum
HPNKEWTATSGYSFVRFSTNIEARKTL

SEQ ID NO: 3358467 - protein, 26 aa, Plasmodium falciparum
HPNLWIPHECSFKMLDSCIANIPTGQ

SEQ ID NO: 3358468 - protein, 24 aa, Plasmodium falciparum
HPSENKIFYGIEWDNEISGKNLGK

SEQ ID NO: 3358469 - protein, 23 aa, Plasmodium falciparum
HPSFYFKHEPIGPVGEYIKLKEP

SEQ ID NO: 3358470 - protein, 27 aa, Plasmodium falciparum
HPTQFLNTCCELCIGFINNYMNSPNSE

SEQ ID NO: 3358471 - protein, 44 aa, Plasmodium falciparum
HPVENCRNWPYCAFGSECIYIHPNVPCKFGIYCTNYYCNYSHDH

SEQ ID NO: 3358472 - protein, 23 aa, Plasmodium falciparum
HPWVTEMLNNFSLQNSKFLWHEK

SEQ ID NO: 3358473 - protein, 17 aa, Plasmodium falciparum
HPYEIPEVIAVPIEYGS

SEQ ID NO: 3358474 - protein, 18 aa, Plasmodium falciparum
HPYLKEMESLYVSEMLFY

SEQ ID NO: 3358475 - protein, 26 aa, Plasmodium falciparum
HQFKEYKFNIADFVLGYVQLVSAPLE

SEQ ID NO: 3358476 - protein, 25 aa, Plasmodium falciparum
HQFNYYKWYLYHINYPNHLDFKKAY

SEQ ID NO: 3358477 - protein, 18 aa, Plasmodium falciparum
HQGISFISSFLLLFLEPK

SEQ ID NO: 3358478 - protein, 17 aa, Plasmodium falciparum
HQKFKLPNLKHHHKDLN

SEQ ID NO: 3358479 - protein, 20 aa, Plasmodium falciparum
HQMVEFCAFIPFETAERALD

SEQ ID NO: 3358480 - protein, 23 aa, Plasmodium falciparum
HQRDKRKNCFEEYLDNNNYFIDS

SEQ ID NO: 3358481 - protein, 17 aa, Plasmodium falciparum
HQSLKYQVDNCLFHNHF

SEQ ID NO: 3358482 - protein, 30 aa, Plasmodium falciparum
HRDNLKVYLAYYGWKMIKFIETGRQNECRL

SEQ ID NO: 3358483 - protein, 37 aa, Plasmodium falciparum
HRIDSHVFDSSVLPNRLPWDGGRHAKSLIHMPHSSVS

SEQ ID NO: 3358484 - protein, 19 aa, Plasmodium falciparum
HRIGRACRSDRKEGKAITF

SEQ ID NO: 3358485 - protein, 23 aa, Plasmodium falciparum
HRLKKMCHIFFEIVDKCNSDGSL

SEQ ID NO: 3358486 - protein, 18 aa, Plasmodium falciparum
HRLLKIFKDFCGQITEEL

SEQ ID NO: 3358487 - protein, 17 aa, Plasmodium falciparum
HRLPLYTGVTIKSCENT

SEQ ID NO: 3358488 - protein, 18 aa, Plasmodium falciparum
HRMHKDFFSKNYILNSFS

SEQ ID NO: 3358489 - protein, 26 aa, Plasmodium falciparum
HRNFKCVKRFKCIIDNTLMDNKLKWK

SEQ ID NO: 3358490 - protein, 21 aa, Plasmodium falciparum
HRNIKEKELISQINFIDLAGS

SEQ ID NO: 3358491 - protein, 18 aa, Plasmodium falciparum
HRNISRFLNIVGIRHRSE

SEQ ID NO: 3358492 - protein, 18 aa, Plasmodium falciparum
HRVIKDFMIQGGDFVNYN

SEQ ID NO: 3358493 - protein, 22 aa, Plasmodium falciparum
HSAKLFQRRQFSLFNNKDKNDE

SEQ ID NO: 3358494 - protein, 18 aa, Plasmodium falciparum
HSCFPNASYCFIDDKNIC

SEQ ID NO: 3358495 - protein, 27 aa, Plasmodium falciparum
HSDDRPYKCDICFKSYKRSDHLRNHLS

SEQ ID NO: 3358496 - protein, 25 aa, Plasmodium falciparum
HSDERPFECKICHKSYKRGDHLKIH

SEQ ID NO: 3358497 - protein, 24 aa, Plasmodium falciparum
HSDFSRKNNDGFYRNNDNNYNNET

SEQ ID NO: 3358498 - protein, 19 aa, Plasmodium falciparum
HSDIMPSHKGKKCTDNNYV

SEQ ID NO: 3358499 - protein, 20 aa, Plasmodium falciparum
HSDRLKRKIPKHYSSKNKDN

SEQ ID NO: 3358500 - protein, 17 aa, Plasmodium falciparum
HSFSNSKLKGVKHNTSV

SEQ ID NO: 3358501 - protein, 21 aa, Plasmodium falciparum
HSGKWRTELNLEDEEAILKPS

SEQ ID NO: 3358502 - protein, 24 aa, Plasmodium falciparum
HSGYILKPELLRFNEKQDYNTLLL

SEQ ID NO: 3358503 - protein, 18 aa, Plasmodium falciparum
HSHIRGLGLNDCLDARYC

SEQ ID NO: 3358504 - protein, 19 aa, Plasmodium falciparum
HSIKLRKAGFYAIYVENNN

SEQ ID NO: 3358505 - protein, 24 aa, Plasmodium falciparum
HSIKYDDEYIPYISDKVKRYKKHK

SEQ ID NO: 3358506 - protein, 54 aa, Plasmodium falciparum
HSISPNSSLFCPVCNIPFTYKIRINPCYHIICKTCYKLSLQDQKCLMCNNDIND

SEQ ID NO: 3358507 - protein, 29 aa, Plasmodium falciparum
HSKEIIKSNCKKDDKKKQCSFNGNNKKEK

SEQ ID NO: 3358508 - protein, 25 aa, Plasmodium falciparum
HSKHLKSKILKPIRQEKVVKVPVTQ

SEQ ID NO: 3358509 - protein, 27 aa, Plasmodium falciparum
HSKIVKSACKLFFILFEATVKIRGVDE

SEQ ID NO: 3358510 - protein, 22 aa, Plasmodium falciparum
HSKRFKMISIYGYKLALKNYSK

SEQ ID NO: 3358511 - protein, 23 aa, Plasmodium falciparum
HSKSHKILSCKTVFARNPSMILN

SEQ ID NO: 3358512 - protein, 24 aa, Plasmodium falciparum
HSKVMKLLNYRSCMEQKNTINKNN

SEQ ID NO: 3358513 - protein, 20 aa, Plasmodium falciparum
HSLNKYKNLINFKDDIYQDL

SEQ ID NO: 3358514 - protein, 20 aa, Plasmodium falciparum
HSLYAVYIIYKHYILRDLIR

SEQ ID NO: 3358515 - protein, 23 aa, Plasmodium falciparum
HSNCSYYDFHSSLEISEEEKIER

SEQ ID NO: 3358516 - protein, 24 aa, Plasmodium falciparum
HSNIYKRNSLNIVNNAHIISNNMN

SEQ ID NO: 3358517 - protein, 17 aa, Plasmodium falciparum
HSNRIKNILNYNYIHPQ

SEQ ID NO: 3358518 - protein, 25 aa, Plasmodium falciparum
HSNYSVNCIYCYNYFLYSGASDCLI

SEQ ID NO: 3358519 - protein, 30 aa, Plasmodium falciparum
HSPNTSILEFCCSRYFSSNFPFEKTMIQNE

SEQ ID NO: 3358520 - protein, 23 aa, Plasmodium falciparum
HSPRMKKNVAKMLLKGNLNTANF

SEQ ID NO: 3358521 - protein, 26 aa, Plasmodium falciparum
HSQLRETKKLLSYEIRKNKMIEKKYE

SEQ ID NO: 3358522 - protein, 20 aa, Plasmodium falciparum
HSRLKYLIDDVGIFFTKLPI

SEQ ID NO: 3358523 - protein, 17 aa, Plasmodium falciparum
HSSIIINDINHKFQKDQ

SEQ ID NO: 3358524 - protein, 21 aa, Plasmodium falciparum
HSSLKLEKVCHNIKAYNQQII

SEQ ID NO: 3358525 - protein, 25 aa, Plasmodium falciparum
HSSSILKNSEDLILNKSSNNSNNEN

SEQ ID NO: 3358526 - protein, 18 aa, Plasmodium falciparum
HSTYEPKDFIVLHDSIYV

SEQ ID NO: 3358527 - protein, 27 aa, Plasmodium falciparum
HSVDELRIPRIPDILLEKKDNNQTDGG

SEQ ID NO: 3358528 - protein, 24 aa, Plasmodium falciparum
HSYAPSELGGLFNSSIKCYSIDES

SEQ ID NO: 3358529 - protein, 19 aa, Plasmodium falciparum
HSYELKNTFPFNDIPLDDD

SEQ ID NO: 3358530 - protein, 25 aa, Plasmodium falciparum
HSYFCIKNILSLLIFYIVTTLKYDI

SEQ ID NO: 3358531 - protein, 19 aa, Plasmodium falciparum
HTASARANRNYKYKFMKNK

SEQ ID NO: 3358532 - protein, 26 aa, Plasmodium falciparum
HTEYPNLISLKNFKLIFKNYKNIFSS

SEQ ID NO: 3358533 - protein, 26 aa, Plasmodium falciparum
HTFLKSHKGIMQYILKNGNTSSNKNN

SEQ ID NO: 3358534 - protein, 25 aa, Plasmodium falciparum
HTGDFRYSNIQSFLIKKLLSYSGDI

SEQ ID NO: 3358535 - protein, 27 aa, Plasmodium falciparum
HTGIFLKNKLYIYGGFEKYENYNILKN

SEQ ID NO: 3358536 - protein, 25 aa, Plasmodium falciparum
HTGLLILHLNKFFQRVYICKPQSSR

SEQ ID NO: 3358537 - protein, 23 aa, Plasmodium falciparum
HTHGDYGSFGWNYKWKLEESKKN

SEQ ID NO: 3358538 - protein, 27 aa, Plasmodium falciparum
HTIIGYKNEPGIMMMILKDLFERIKML

SEQ ID NO: 3358539 - protein, 22 aa, Plasmodium falciparum
HTKEGFVTCYIYYGTSKDISSE

SEQ ID NO: 3358540 - protein, 19 aa, Plasmodium falciparum
HTKYAWANIDFRFLNVDLF

SEQ ID NO: 3358541 - protein, 23 aa, Plasmodium falciparum
HTLFKGTFFPTWEGLFWEKASGF

SEQ ID NO: 3358542 - protein, 19 aa, Plasmodium falciparum
HTNIELRATENLYKTALCE

SEQ ID NO: 3358543 - protein, 24 aa, Plasmodium falciparum
HTNKVIKCIFFLVTNNTFLNTSIR

SEQ ID NO: 3358544 - protein, 27 aa, Plasmodium falciparum
HTNRIPLLIYESYHFWHLQFLFEKFKI

SEQ ID NO: 3358545 - protein, 25 aa, Plasmodium falciparum
HTPKVSLIKKWFGIYNLMSNGSTPD

SEQ ID NO: 3358546 - protein, 19 aa, Plasmodium falciparum
HTPLPMIYYKVHKDKNRAF

SEQ ID NO: 3358547 - protein, 24 aa, Plasmodium falciparum
HTQILQCKYCFREINILNYSHFSF

SEQ ID NO: 3358548 - protein, 22 aa, Plasmodium falciparum
HTRQINCCRFHPLNEQVFISGS

SEQ ID NO: 3358549 - protein, 22 aa, Plasmodium falciparum
HTTEAGIIFGYVFYERKNDNHK

SEQ ID NO: 3358550 - protein, 23 aa, Plasmodium falciparum
HTTRQICKNNIISNNNSYYETYG

SEQ ID NO: 3358551 - protein, 25 aa, Plasmodium falciparum
HTYFCNPMHLLHMINLLAEKIRINK

SEQ ID NO: 3358552 - protein, 32 aa, Plasmodium falciparum
HTYIYGLLIFKHYKYILPYKHIIKDKLKNMKH

SEQ ID NO: 3358553 - protein, 27 aa, Plasmodium falciparum
HTYMYIRMLKCPSLYGVIINSNDKIKG

SEQ ID NO: 3358554 - protein, 25 aa, Plasmodium falciparum
HVCLKYKMYLDNLLEEILLNYSKGV

SEQ ID NO: 3358555 - protein, 17 aa, Plasmodium falciparum
HVDKEVINKLVLHNKNM

SEQ ID NO: 3358556 - protein, 23 aa, Plasmodium falciparum
HVDNDMLYYCGMKDDIENLKELI

SEQ ID NO: 3358557 - protein, 21 aa, Plasmodium falciparum
HVEIACSIFKASMKKISNEKE

SEQ ID NO: 3358558 - protein, 24 aa, Plasmodium falciparum
HVEVLKFLLENEVNINLTNKYHQN

SEQ ID NO: 3358559 - protein, 26 aa, Plasmodium falciparum
HVFINEMFFSFVLRIQQKYFNKGDSL

SEQ ID NO: 3358560 - protein, 19 aa, Plasmodium falciparum
HVFLSEFKSKYRILLTGTP

SEQ ID NO: 3358561 - protein, 21 aa, Plasmodium falciparum
HVGGNHWTLGSIHMKDKKICL

SEQ ID NO: 3358562 - protein, 23 aa, Plasmodium falciparum
HVGGQAFLDLCNFNEFNKDDEPF

SEQ ID NO: 3358563 - protein, 21 aa, Plasmodium falciparum
HVHDIKIFFIPKIYKENEEDN

SEQ ID NO: 3358564 - protein, 24 aa, Plasmodium falciparum
HVHETCKSLELLKTEQEKLIKYKK

SEQ ID NO: 3358565 - protein, 25 aa, Plasmodium falciparum
HVIIKKYFGVISLHIVKENINLKKF

SEQ ID NO: 3358566 - protein, 22 aa, Plasmodium falciparum
HVKHNISYFACKHVNMNDLYNS

SEQ ID NO: 3358567 - protein, 24 aa, Plasmodium falciparum
HVKKCLPLYKIIKHELFCDFLYSI

SEQ ID NO: 3358568 - protein, 26 aa, Plasmodium falciparum
HVKSYKLGKESDGWIIQKKAKRKKKK

SEQ ID NO: 3358569 - protein, 21 aa, Plasmodium falciparum
HVLCQQIKPPISPFQIVDIKP

SEQ ID NO: 3358570 - protein, 19 aa, Plasmodium falciparum
HVLFYILDVRNPLFFYCPG

SEQ ID NO: 3358571 - protein, 23 aa, Plasmodium falciparum
HVLGELRPLPNLMNTKLCKSYKK

SEQ ID NO: 3358572 - protein, 18 aa, Plasmodium falciparum
HVLLNICYGFYFEQTEEL

SEQ ID NO: 3358573 - protein, 27 aa, Plasmodium falciparum
HVNAKMYFERDINCVINHFFKKYKIKI

SEQ ID NO: 3358574 - protein, 17 aa, Plasmodium falciparum
HVNCMKMKNINFEDSLR

SEQ ID NO: 3358575 - protein, 20 aa, Plasmodium falciparum
HVNCVQVHPQGTCLATSGLE

SEQ ID NO: 3358576 - protein, 20 aa, Plasmodium falciparum
HVNEKLKLLLNNNSKKNKKK

SEQ ID NO: 3358577 - protein, 20 aa, Plasmodium falciparum
HVNIPLPYDIPQFYYTPDNR

SEQ ID NO: 3358578 - protein, 20 aa, Plasmodium falciparum
HVQYRLGNIDAYQLADGIQY

SEQ ID NO: 3358579 - protein, 28 aa, Plasmodium falciparum
HVSIERYKRLIFRRIKWNEDVYDDEENQ

SEQ ID NO: 3358580 - protein, 23 aa, Plasmodium falciparum
HVSIPIECLIELYNLENYINQNT

SEQ ID NO: 3358581 - protein, 35 aa, Plasmodium falciparum
HVSSHSFWLYLYINLEEAFTFSSLLHGIVEIKIES

SEQ ID NO: 3358582 - protein, 25 aa, Plasmodium falciparum
HVSSKEIIKVISMTKGFAVFDNYFI

SEQ ID NO: 3358583 - protein, 17 aa, Plasmodium falciparum
HVSYKINENYYLQMNNQ

SEQ ID NO: 3358584 - protein, 24 aa, Plasmodium falciparum
HVTKKLKINRHLGLTLREDQVIYL

SEQ ID NO: 3358585 - protein, 17 aa, Plasmodium falciparum
HVTRKHSLFFLKYFLLI

SEQ ID NO: 3358586 - protein, 30 aa, Plasmodium falciparum
HVVKCYNLPEFMYEGFFEFLIKKYNNEDLY

SEQ ID NO: 3358587 - protein, 18 aa, Plasmodium falciparum
HVYDEYPLFIGYSRKRFI

SEQ ID NO: 3358588 - protein, 23 aa, Plasmodium falciparum
HVYNMTFHIPIYIIDTIQHEGYE

SEQ ID NO: 3358589 - protein, 26 aa, Plasmodium falciparum
HWEKFDRRLDCWLAYENLRLLDKEPD

SEQ ID NO: 3358590 - protein, 28 aa, Plasmodium falciparum
HYDRKQFRWKATWYTSHGRRCAKYYPVK

SEQ ID NO: 3358591 - protein, 27 aa, Plasmodium falciparum
HYDYKGIPLNLVRKIATHVLIGMQYLH

SEQ ID NO: 3358592 - protein, 17 aa, Plasmodium falciparum
HYGKCTYFYILEKFQKR

SEQ ID NO: 3358593 - protein, 24 aa, Plasmodium falciparum
HYGQGNSYILPTCQRNDLLKDDRN

SEQ ID NO: 3358594 - protein, 32 aa, Plasmodium falciparum
HYGYNFKEYFLKSNILEKSISLILERRDIRLS

SEQ ID NO: 3358595 - protein, 27 aa, Plasmodium falciparum
HYHEELKAGIALECLFGTYSCMKSKIL

SEQ ID NO: 3358596 - protein, 18 aa, Plasmodium falciparum
HYIAWKKMKKFFSSNSNI

SEQ ID NO: 3358597 - protein, 29 aa, Plasmodium falciparum
HYILFPYEIIKWTSFLLEYLTEIIPTNIF

SEQ ID NO: 3358598 - protein, 23 aa, Plasmodium falciparum
HYIMFKYIEACVKINNIQELDRI

SEQ ID NO: 3358599 - protein, 23 aa, Plasmodium falciparum
HYINAFSRFSGNYVGKVTGPANS

SEQ ID NO: 3358600 - protein, 26 aa, Plasmodium falciparum
HYIYLLRLLPKFSLPLYDSGILQYVC

SEQ ID NO: 3358601 - protein, 28 aa, Plasmodium falciparum
HYKNKCSPCKDYIEGSCKKFSHQCIYCH

SEQ ID NO: 3358602 - protein, 21 aa, Plasmodium falciparum
HYKYKSSKTLKSFDLLYELIQ

SEQ ID NO: 3358603 - protein, 19 aa, Plasmodium falciparum
HYLNKPLIMFNSGAKGALI

SEQ ID NO: 3358604 - protein, 17 aa, Plasmodium falciparum
HYMKNVCMVSDNVKAKN

SEQ ID NO: 3358605 - protein, 24 aa, Plasmodium falciparum
HYNKNVCTNINYPSSILYNNHPYS

SEQ ID NO: 3358606 - protein, 17 aa, Plasmodium falciparum
HYNMTKGVVSFIDSFEH

SEQ ID NO: 3358607 - protein, 22 aa, Plasmodium falciparum
HYNNLFLSKSIKKLRNKYLESL

SEQ ID NO: 3358608 - protein, 24 aa, Plasmodium falciparum
HYQPEIQSACSLINFTVTPDDLEE

SEQ ID NO: 3358609 - protein, 17 aa, Plasmodium falciparum
HYSCGGRNSCLYYKTYA

SEQ ID NO: 3358610 - protein, 19 aa, Plasmodium falciparum
HYTKGCKKTNIQVTPSPFP

SEQ ID NO: 3358611 - protein, 25 aa, Plasmodium falciparum
HYTNFVKHYVTKVGIYNNMEKNKLN

SEQ ID NO: 3358612 - protein, 25 aa, Plasmodium falciparum
HYVKIFKEEYIHIFLNNKNIIDKGI

SEQ ID NO: 3358613 - protein, 25 aa, Plasmodium falciparum
HYYDNVKFDLSYEIEEDKKQRKKKI

SEQ ID NO: 3358614 - protein, 22 aa, Plasmodium falciparum
HYYLCNNCFKLLQDKNIVDVGL

SEQ ID NO: 3358615 - protein, 45 aa, Plasmodium falciparum
HYYVTQNSYMLFGDVFKIYNLKGEIKKIHAFFPGDENNLSDTLIM

SEQ ID NO: 3358616 - protein, 18 aa, Plasmodium falciparum
IAAGEVIIRPCNALKELV

SEQ ID NO: 3358617 - protein, 18 aa, Plasmodium falciparum
IAAYRCRKGLGFAEPSIK

SEQ ID NO: 3358618 - protein, 22 aa, Plasmodium falciparum
IACCIKGRARGEEEGEEEGRGR

SEQ ID NO: 3358619 - protein, 17 aa, Plasmodium falciparum
IACDLRLGANTFTTVST

SEQ ID NO: 3358620 - protein, 17 aa, Plasmodium falciparum
IACSAGYIAVPWQVEGG

SEQ ID NO: 3358621 - protein, 25 aa, Plasmodium falciparum
IAEFIKEHFLYCFFTHMNYRNKTKD

SEQ ID NO: 3358622 - protein, 27 aa, Plasmodium falciparum
IAEKFCKRENISISHIKSIVDFINQNC

SEQ ID NO: 3358623 - protein, 25 aa, Plasmodium falciparum
IAEKTKRSRLSICDIDEGRLQELLA

SEQ ID NO: 3358624 - protein, 25 aa, Plasmodium falciparum
IAGCNNGSVCLTNITKKVDGDLTFS

SEQ ID NO: 3358625 - protein, 17 aa, Plasmodium falciparum
IAHKRNELIIPYHEKCI

SEQ ID NO: 3358626 - protein, 17 aa, Plasmodium falciparum
IAHTRWATHGCKTDENA

SEQ ID NO: 3358627 - protein, 23 aa, Plasmodium falciparum
IAIKYKHGIMIAADRKASYGSYA

SEQ ID NO: 3358628 - protein, 24 aa, Plasmodium falciparum
IAKESCLIFQILLKIKEDDIKEKT

SEQ ID NO: 3358629 - protein, 23 aa, Plasmodium falciparum
IAKRVSEEFGCILGQEVGYSIRF

SEQ ID NO: 3358630 - protein, 19 aa, Plasmodium falciparum
IAKVFFFFYLNKFEDCLLL

SEQ ID NO: 3358631 - protein, 26 aa, Plasmodium falciparum
IALQLPEGLLVWGLYLSEIFYFFCES

SEQ ID NO: 3358632 - protein, 20 aa, Plasmodium falciparum
IANCLPQFIENYSRDVERLN

SEQ ID NO: 3358633 - protein, 24 aa, Plasmodium falciparum
IANNKRLFTSFSVSKYGYNEARKL

SEQ ID NO: 3358634 - protein, 22 aa, Plasmodium falciparum
IAPKRPGDKLSVEDAFGTVNRN

SEQ ID NO: 3358635 - protein, 26 aa, Plasmodium falciparum
IAPSNEVYDFIIFRGKDIKDVTVSET

SEQ ID NO: 3358636 - protein, 27 aa, Plasmodium falciparum
IAQYNKNLEVLKRMIDVEQEKFLRMSN

SEQ ID NO: 3358637 - protein, 18 aa, Plasmodium falciparum
IARIDVIGGGGFIPSIKI

SEQ ID NO: 3358638 - protein, 18 aa, Plasmodium falciparum
IASLFPNIFYNIYMNNYQ

SEQ ID NO: 3358639 - protein, 18 aa, Plasmodium falciparum
IATHLPISISDSLPPLKP

SEQ ID NO: 3358640 - protein, 19 aa, Plasmodium falciparum
IATHVLIGMQYLHDVCKII

SEQ ID NO: 3358641 - protein, 32 aa, Plasmodium falciparum
IATKELKKEFLLMYGRLMFSRKKLQEKEVIEH

SEQ ID NO: 3358642 - protein, 32 aa, Plasmodium falciparum
IATYCIKDGVLPLRLIDKLLFIYNYVEMARVT

SEQ ID NO: 3358643 - protein, 24 aa, Plasmodium falciparum
IAVKRSNVISSIFSLIGDCLNMHR

SEQ ID NO: 3358644 - protein, 17 aa, Plasmodium falciparum
IAVSLKYVEERIANVYC

SEQ ID NO: 3358645 - protein, 21 aa, Plasmodium falciparum
IAWELLRIFPEDMLKKIKTDI

SEQ ID NO: 3358646 - protein, 22 aa, Plasmodium falciparum
IAWPEATSYVGGKYMGTTNEIE

SEQ ID NO: 3358647 - protein, 22 aa, Plasmodium falciparum
ICADAHLNLSHMKNIKCDKIKM

SEQ ID NO: 3358648 - protein, 18 aa, Plasmodium falciparum
ICDCINKKISLFLELFLK

SEQ ID NO: 3358649 - protein, 23 aa, Plasmodium falciparum
ICDHKKKIKIPMLYLSNVCNNIY

SEQ ID NO: 3358650 - protein, 24 aa, Plasmodium falciparum
ICDLKYDKFHIVAPCPHESICPLA

SEQ ID NO: 3358651 - protein, 17 aa, Plasmodium falciparum
ICDSFIWKNLLKRCTDI

SEQ ID NO: 3358652 - protein, 18 aa, Plasmodium falciparum
ICEEENYSSSSTNVATYI

SEQ ID NO: 3358653 - protein, 21 aa, Plasmodium falciparum
ICEIKKNIYLLILKNNLNCSE

SEQ ID NO: 3358654 - protein, 25 aa, Plasmodium falciparum
ICEIKNLDFYVGVQFHPEFTSRPFK

SEQ ID NO: 3358655 - protein, 26 aa, Plasmodium falciparum
ICEYRKCTSNAQNSICYNDQHKLNYV

SEQ ID NO: 3358656 - protein, 17 aa, Plasmodium falciparum
ICFNCSFQNLMEEKEIS

SEQ ID NO: 3358657 - protein, 17 aa, Plasmodium falciparum
ICFYSLKDLHVYEEQAL

SEQ ID NO: 3358658 - protein, 17 aa, Plasmodium falciparum
ICGCFYTGGKILFSNDG

SEQ ID NO: 3358659 - protein, 19 aa, Plasmodium falciparum
ICGEPHVTYGKHFDSTQKI

SEQ ID NO: 3358660 - protein, 19 aa, Plasmodium falciparum
ICGQLDYATSGLLIVAKDK

SEQ ID NO: 3358661 - protein, 25 aa, Plasmodium falciparum
ICHKRLTSVELIRKHVYNISPICPN

SEQ ID NO: 3358662 - protein, 23 aa, Plasmodium falciparum
ICHNKKPIKLSLRHKPDLQEERI

SEQ ID NO: 3358663 - protein, 24 aa, Plasmodium falciparum
ICIDKNIRCGLWYKVKREEDELYT

SEQ ID NO: 3358664 - protein, 30 aa, Plasmodium falciparum
ICIHTRECMIHFLKCYLYHIQNDVIKSEYN

SEQ ID NO: 3358665 - protein, 17 aa, Plasmodium falciparum
ICIPSSKTKYFFKNKKF

SEQ ID NO: 3358666 - protein, 17 aa, Plasmodium falciparum
ICIYGVHFLNKDNEINE

SEQ ID NO: 3358667 - protein, 24 aa, Plasmodium falciparum
ICKCILKNRDGYLYKGNKNHRFIC

SEQ ID NO: 3358668 - protein, 18 aa, Plasmodium falciparum
ICKDCYGNFMMQKLLTTC

SEQ ID NO: 3358669 - protein, 20 aa, Plasmodium falciparum
ICKKINSLVATWCDDSNIYI

SEQ ID NO: 3358670 - protein, 20 aa, Plasmodium falciparum
ICKNPYYMSHGDKLPSGALV

SEQ ID NO: 3358671 - protein, 19 aa, Plasmodium falciparum
ICKNYKLINKNRFINNEYY

SEQ ID NO: 3358672 - protein, 18 aa, Plasmodium falciparum
ICKNYKLYHSDFYDEFDK

SEQ ID NO: 3358673 - protein, 22 aa, Plasmodium falciparum
ICKRYFGVSGSYGYSIFSKEGN

SEQ ID NO: 3358674 - protein, 26 aa, Plasmodium falciparum
ICLHKISRLISFFDMKQIIIPLCNEI

SEQ ID NO: 3358675 - protein, 21 aa, Plasmodium falciparum
ICLKFRDSHVRKFVLNNQLDN

SEQ ID NO: 3358676 - protein, 21 aa, Plasmodium falciparum
ICLQVMWTNDIEKCIYKYHSE

SEQ ID NO: 3358677 - protein, 18 aa, Plasmodium falciparum
ICLSSLNNIFIFDIRYIN

SEQ ID NO: 3358678 - protein, 23 aa, Plasmodium falciparum
ICNHLRYGKKSANSINGMIKTST

SEQ ID NO: 3358679 - protein, 20 aa, Plasmodium falciparum
ICNHPLLHKYYYTVEDIKKI

SEQ ID NO: 3358680 - protein, 20 aa, Plasmodium falciparum
ICNICGKSRENVNIDTYTDN

SEQ ID NO: 3358681 - protein, 27 aa, Plasmodium falciparum
ICNKAWKILYKYFPFVINNELNNAQIP

SEQ ID NO: 3358682 - protein, 26 aa, Plasmodium falciparum
ICNSCSESKLILHFVKIITSKQKTYN

SEQ ID NO: 3358683 - protein, 17 aa, Plasmodium falciparum
ICNVINVHLSILLFPLC

SEQ ID NO: 3358684 - protein, 23 aa, Plasmodium falciparum
ICNYKLQYLFERVMIDVVNKIGC

SEQ ID NO: 3358685 - protein, 22 aa, Plasmodium falciparum
ICPHSNDIVCIHCYDEHACNCK

SEQ ID NO: 3358686 - protein, 25 aa, Plasmodium falciparum
ICPKPNVCEHFSYFLNNKNEQEEHK

SEQ ID NO: 3358687 - protein, 17 aa, Plasmodium falciparum
ICQLKNIKTLILAYNEI

SEQ ID NO: 3358688 - protein, 18 aa, Plasmodium falciparum
ICRLSLKNNLCVEKNCGN

SEQ ID NO: 3358689 - protein, 24 aa, Plasmodium falciparum
ICRREKSPIMLIDFSDILQTPVKP

SEQ ID NO: 3358690 - protein, 25 aa, Plasmodium falciparum
ICRREKSPIMLIDFSDILQTPVKPL

SEQ ID NO: 3358691 - protein, 17 aa, Plasmodium falciparum
ICSCCYTKYKDLRKHIF

SEQ ID NO: 3358692 - protein, 21 aa, Plasmodium falciparum
ICSENCKRNLITQNEYQRKDK

SEQ ID NO: 3358693 - protein, 21 aa, Plasmodium falciparum
ICSNLGIGLGRAYVGKFSDGE

SEQ ID NO: 3358694 - protein, 18 aa, Plasmodium falciparum
ICSTEIYGDAFLSKTYDN

SEQ ID NO: 3358695 - protein, 17 aa, Plasmodium falciparum
ICSYIYTYIIRKRFLHK

SEQ ID NO: 3358696 - protein, 19 aa, Plasmodium falciparum
ICSYLKSLEELWLNNNNID

SEQ ID NO: 3358697 - protein, 19 aa, Plasmodium falciparum
ICTFFSQKLLPIIYYNNLN

SEQ ID NO: 3358698 - protein, 24 aa, Plasmodium falciparum
ICTQCGLRDLFLTSMKIYNNNDKK

SEQ ID NO: 3358699 - protein, 23 aa, Plasmodium falciparum
ICTQPRRIACIAIANRVAEEMNV

SEQ ID NO: 3358700 - protein, 18 aa, Plasmodium falciparum
ICTVKTLIHFVNKKYFSL

SEQ ID NO: 3358701 - protein, 18 aa, Plasmodium falciparum
ICVEIPGRIKKGSSGLSA

SEQ ID NO: 3358702 - protein, 26 aa, Plasmodium falciparum
ICYMTYRLILMMKKCINYIKKRKKGN

SEQ ID NO: 3358703 - protein, 24 aa, Plasmodium falciparum
ICYTKRKHSNGVNVWYKFDDSTVT

SEQ ID NO: 3358704 - protein, 17 aa, Plasmodium falciparum
IDALKIQKHLTFQFDKI

SEQ ID NO: 3358705 - protein, 27 aa, Plasmodium falciparum
IDALKSLKLNGSIGISTGKIWCGIIGN

SEQ ID NO: 3358706 - protein, 24 aa, Plasmodium falciparum
IDALYFLRICSDLKDILSDVSGCI

SEQ ID NO: 3358707 - protein, 24 aa, Plasmodium falciparum
IDANKKLWMWGWNEYGQIDDTYIN

SEQ ID NO: 3358708 - protein, 19 aa, Plasmodium falciparum
IDAVIKGYNSTVFAYGATG

SEQ ID NO: 3358709 - protein, 23 aa, Plasmodium falciparum
IDCLNYKVGDMIERGIFETFNSK

SEQ ID NO: 3358710 - protein, 21 aa, Plasmodium falciparum
IDCNGLILLMIWSYKKYICST

SEQ ID NO: 3358711 - protein, 18 aa, Plasmodium falciparum
IDDEYLFLQRKFKKQKTD

SEQ ID NO: 3358712 - protein, 27 aa, Plasmodium falciparum
IDDIMLRELFEPFGTITSAKVMRDEKE

SEQ ID NO: 3358713 - protein, 24 aa, Plasmodium falciparum
IDDKKLKYSWSILKENIQPQNEQL

SEQ ID NO: 3358714 - protein, 29 aa, Plasmodium falciparum
IDDLSNLFFFCFEFFLKYLCIPGKIENYI

SEQ ID NO: 3358715 - protein, 17 aa, Plasmodium falciparum
IDDNCSLDDYKIKESCD

SEQ ID NO: 3358716 - protein, 23 aa, Plasmodium falciparum
IDDREVYEISSCYNENDDTNKSH

SEQ ID NO: 3358717 - protein, 19 aa, Plasmodium falciparum
IDDSYSLSLILIIIDEKYL

SEQ ID NO: 3358718 - protein, 25 aa, Plasmodium falciparum
IDDTIRSSGGYKFFNYNLGGVDAQY

SEQ ID NO: 3358719 - protein, 34 aa, Plasmodium falciparum
IDDVNAFKIIRRLCCPRKKKDIDLLFKSTTNEYN

SEQ ID NO: 3358720 - protein, 23 aa, Plasmodium falciparum
IDEADRLLDMGFEKQLRKIMTQV

SEQ ID NO: 3358721 - protein, 31 aa, Plasmodium falciparum
IDEDKVLYSFPFKYFHLLVYAFKNYYFNIYL

SEQ ID NO: 3358722 - protein, 19 aa, Plasmodium falciparum
IDEGFKTYIIHDDINKYKN

SEQ ID NO: 3358723 - protein, 26 aa, Plasmodium falciparum
IDEGLKYLKKYSSVIVSNQDMHEHIK

SEQ ID NO: 3358724 - protein, 22 aa, Plasmodium falciparum
IDEIATIVALLNCDSIFLNYNF

SEQ ID NO: 3358725 - protein, 24 aa, Plasmodium falciparum
IDEKCAINAVNFLNQKKFFDNSPN

SEQ ID NO: 3358726 - protein, 18 aa, Plasmodium falciparum
IDEKLNIYLCYINMECLY

SEQ ID NO: 3358727 - protein, 25 aa, Plasmodium falciparum
IDELKVHIHNSCNIYVYINERTSDD

SEQ ID NO: 3358728 - protein, 20 aa, Plasmodium falciparum
IDENKVEMCLCFDNRGSTNK

SEQ ID NO: 3358729 - protein, 25 aa, Plasmodium falciparum
IDEPRYKVDMTKYIERHEFIVDKVF

SEQ ID NO: 3358730 - protein, 20 aa, Plasmodium falciparum
IDERKRLPIYSYRYDILKAI

SEQ ID NO: 3358731 - protein, 17 aa, Plasmodium falciparum
IDESRYAEIQTRQYRAP

SEQ ID NO: 3358732 - protein, 28 aa, Plasmodium falciparum
IDETEAPCPLKFMYKLLKRYLDERSKKK

SEQ ID NO: 3358733 - protein, 18 aa, Plasmodium falciparum
IDEVDICHSGEYIKGSPY

SEQ ID NO: 3358734 - protein, 25 aa, Plasmodium falciparum
IDEYCNMCNIPIDDACSYNTQKNKK

SEQ ID NO: 3358735 - protein, 25 aa, Plasmodium falciparum
IDFEEFIIGIAICCRGTKSDKINVL

SEQ ID NO: 3358736 - protein, 17 aa, Plasmodium falciparum
IDFFKFVKKMILKCNKN

SEQ ID NO: 3358737 - protein, 17 aa, Plasmodium falciparum
IDFKFMICKVDKDVSYT

SEQ ID NO: 3358738 - protein, 17 aa, Plasmodium falciparum
IDFNNLVKKKKKLLQDL

SEQ ID NO: 3358739 - protein, 24 aa, Plasmodium falciparum
IDFTRGINCIVGFNGSGKSNILLA

SEQ ID NO: 3358740 - protein, 18 aa, Plasmodium falciparum
IDGEYSFYNFVSEKGIHR

SEQ ID NO: 3358741 - protein, 28 aa, Plasmodium falciparum
IDGFYIIPTLRFQYEINMKAYINQLMNM

SEQ ID NO: 3358742 - protein, 19 aa, Plasmodium falciparum
IDGKTYFKRNKYFYEPILI

SEQ ID NO: 3358743 - protein, 20 aa, Plasmodium falciparum
IDGTLAICLQSFVSKYYRNN

SEQ ID NO: 3358744 - protein, 17 aa, Plasmodium falciparum
IDHLNFFQSKCKANKGF

SEQ ID NO: 3358745 - protein, 18 aa, Plasmodium falciparum
IDIEKLLTFDVIINNQIQ

SEQ ID NO: 3358746 - protein, 18 aa, Plasmodium falciparum
IDIHKGILLHGPPGCGKT

SEQ ID NO: 3358747 - protein, 18 aa, Plasmodium falciparum
IDIICNFSINYKMCPLSI

SEQ ID NO: 3358748 - protein, 27 aa, Plasmodium falciparum
IDIKQKFRLLYSFGPQIRYLHSDEYLV

SEQ ID NO: 3358749 - protein, 32 aa, Plasmodium falciparum
IDINPDYFISFYSSKCKYVFTSDDEEKLEKKQ

SEQ ID NO: 3358750 - protein, 17 aa, Plasmodium falciparum
IDIPNYINNNIFSNDSV

SEQ ID NO: 3358751 - protein, 21 aa, Plasmodium falciparum
IDIPPCCQIIYDNVDDATNEQ

SEQ ID NO: 3358752 - protein, 24 aa, Plasmodium falciparum
IDIPSDLFCFCNYFFFKEKYITFF

SEQ ID NO: 3358753 - protein, 23 aa, Plasmodium falciparum
IDIQNLRYLIIMTLSDNINTFFH

SEQ ID NO: 3358754 - protein, 18 aa, Plasmodium falciparum
IDIYFRILYEYNGINKLC

SEQ ID NO: 3358755 - protein, 20 aa, Plasmodium falciparum
IDIYKNDTFWQYAISNDNIF

SEQ ID NO: 3358756 - protein, 26 aa, Plasmodium falciparum
IDKCKRKYKKAFYTLVVRDGIVDEYL

SEQ ID NO: 3358757 - protein, 18 aa, Plasmodium falciparum
IDKDGYFENFMLCNNEEE

SEQ ID NO: 3358758 - protein, 24 aa, Plasmodium falciparum
IDKDKNRLLVCIKQNDDNFFVIPN

SEQ ID NO: 3358759 - protein, 17 aa, Plasmodium falciparum
IDKEGKMHLTGKEHYNA

SEQ ID NO: 3358760 - protein, 23 aa, Plasmodium falciparum
IDKFGYGCVINLLKDQIISRILF

SEQ ID NO: 3358761 - protein, 32 aa, Plasmodium falciparum
IDKFKSAIMPIALLWARGHSFVEILSDSQIYE

SEQ ID NO: 3358762 - protein, 20 aa, Plasmodium falciparum
IDKIKLLRKGCFINNQHIYP

SEQ ID NO: 3358763 - protein, 20 aa, Plasmodium falciparum
IDKKRLIKHIEIKDYARKYY

SEQ ID NO: 3358764 - protein, 18 aa, Plasmodium falciparum
IDKKRWYNKYGYDGIKQV

SEQ ID NO: 3358765 - protein, 20 aa, Plasmodium falciparum
IDKNVENFVFLDFIPVTEEY

SEQ ID NO: 3358766 - protein, 23 aa, Plasmodium falciparum
IDKPHVCYNNWKGFNIKNKNYFI

SEQ ID NO: 3358767 - protein, 19 aa, Plasmodium falciparum
IDKRSEIYYSNKAYDPQYL

SEQ ID NO: 3358768 - protein, 17 aa, Plasmodium falciparum
IDKVIGLQINETFELGD

SEQ ID NO: 3358769 - protein, 25 aa, Plasmodium falciparum
IDKYSFPFSIIYNIVNYKHYLENKK

SEQ ID NO: 3358770 - protein, 23 aa, Plasmodium falciparum
IDLAFKVLTYLCAHFYSTKMNLH

SEQ ID NO: 3358771 - protein, 22 aa, Plasmodium falciparum
IDLDIFTIINFIFKYNNDKDSI

SEQ ID NO: 3358772 - protein, 25 aa, Plasmodium falciparum
IDLKHLKYIWLMIKYWYTTFDFIKN

SEQ ID NO: 3358773 - protein, 24 aa, Plasmodium falciparum
IDLKTKRKLIYDALDEINQQTQQK

SEQ ID NO: 3358774 - protein, 43 aa, Plasmodium falciparum
IDLNELRQNLFLCAINFHLNYWAEKVILFYPHNEKINKYCTKL

SEQ ID NO: 3358775 - protein, 18 aa, Plasmodium falciparum
IDLNICYVRCIIKNKLFQ

SEQ ID NO: 3358776 - protein, 17 aa, Plasmodium falciparum
IDLPPFYFDLIINPIPS

SEQ ID NO: 3358777 - protein, 25 aa, Plasmodium falciparum
IDLREIKKFLNLVSEDFIKNNKTKC

SEQ ID NO: 3358778 - protein, 23 aa, Plasmodium falciparum
IDLSDKFIHVIFIATSKNEDIDN

SEQ ID NO: 3358779 - protein, 18 aa, Plasmodium falciparum
IDLSRMVKKLLDIEDNVS

SEQ ID NO: 3358780 - protein, 23 aa, Plasmodium falciparum
IDLTCKYLHLGNLVPLITLDILR

SEQ ID NO: 3358781 - protein, 24 aa, Plasmodium falciparum
IDLTLKLKYLRHLEYLKRKKKKDK

SEQ ID NO: 3358782 - protein, 18 aa, Plasmodium falciparum
IDMLLKLANYRLAIEKAI

SEQ ID NO: 3358783 - protein, 18 aa, Plasmodium falciparum
IDMLYCVDINKKACECIK

SEQ ID NO: 3358784 - protein, 19 aa, Plasmodium falciparum
IDMLYQYIINEIKFLKKKK

SEQ ID NO: 3358785 - protein, 20 aa, Plasmodium falciparum
IDMNCLWSDLYISRPFLKVL

SEQ ID NO: 3358786 - protein, 17 aa, Plasmodium falciparum
IDNELIQILTYLKFLGP

SEQ ID NO: 3358787 - protein, 21 aa, Plasmodium falciparum
IDNKICLSVILGVSTPSFFFN

SEQ ID NO: 3358788 - protein, 19 aa, Plasmodium falciparum
IDNTFLLNWDNYKKTNNQY

SEQ ID NO: 3358789 - protein, 23 aa, Plasmodium falciparum
IDNVKLKLCYNDILIKQISTYFK

SEQ ID NO: 3358790 - protein, 20 aa, Plasmodium falciparum
IDNWKIKLENEMKIYDIQTE

SEQ ID NO: 3358791 - protein, 32 aa, Plasmodium falciparum
IDPNLQRLPLRFPVIEKRKAKSTILKNAKNET

SEQ ID NO: 3358792 - protein, 20 aa, Plasmodium falciparum
IDPTHAWNCNSQVDPMSFGD

SEQ ID NO: 3358793 - protein, 21 aa, Plasmodium falciparum
IDQLFKILCLLGLPDKESYPE

SEQ ID NO: 3358794 - protein, 23 aa, Plasmodium falciparum
IDQLKEKINIIIIPNKGVINNFE

SEQ ID NO: 3358795 - protein, 21 aa, Plasmodium falciparum
IDRLKLLYDYMHDNISIKTYI

SEQ ID NO: 3358796 - protein, 23 aa, Plasmodium falciparum
IDRVLRLPLGHLLLVGASGAGKT

SEQ ID NO: 3358797 - protein, 17 aa, Plasmodium falciparum
IDSCLSTKFVNRYNKIV

SEQ ID NO: 3358798 - protein, 22 aa, Plasmodium falciparum
IDSEFLMGMVIAREANGIIKKK

SEQ ID NO: 3358799 - protein, 27 aa, Plasmodium falciparum
IDSIHKWIFKIKNLFLSNITINYITKR

SEQ ID NO: 3358800 - protein, 17 aa, Plasmodium falciparum
IDSKFLYSNNITSDNNK

SEQ ID NO: 3358801 - protein, 25 aa, Plasmodium falciparum
IDSLKYKYLFLPIIKMLSYVCPTYR

SEQ ID NO: 3358802 - protein, 28 aa, Plasmodium falciparum
IDSNILIIFELFKFGFLTTEALLPPDGK

SEQ ID NO: 3358803 - protein, 20 aa, Plasmodium falciparum
IDSNMCAVSSNLQHNNYNED

SEQ ID NO: 3358804 - protein, 20 aa, Plasmodium falciparum
IDSQGFRKVYQISAFPGIFR

SEQ ID NO: 3358805 - protein, 18 aa, Plasmodium falciparum
IDSSRAWPVDKAQWKYYY

SEQ ID NO: 3358806 - protein, 25 aa, Plasmodium falciparum
IDTKNEYFVSCFIKNKNVNILCVRR

SEQ ID NO: 3358807 - protein, 17 aa, Plasmodium falciparum
IDTPPEKKKVATKKISQ

SEQ ID NO: 3358808 - protein, 25 aa, Plasmodium falciparum
IDTWSIGCVMGELLLGKPLFLGECA

SEQ ID NO: 3358809 - protein, 21 aa, Plasmodium falciparum
IDVIGGGGFIPSIKINNNTNN

SEQ ID NO: 3358810 - protein, 25 aa, Plasmodium falciparum
IDVIPRANYVLAWLYEELGEIHANS

SEQ ID NO: 3358811 - protein, 24 aa, Plasmodium falciparum
IDVIRKYNEVFNFMLEDVCLNIEK

SEQ ID NO: 3358812 - protein, 18 aa, Plasmodium falciparum
IDVSRILLTHALTTRDIY

SEQ ID NO: 3358813 - protein, 17 aa, Plasmodium falciparum
IDWRNGGRFLLCVGMRR

SEQ ID NO: 3358814 - protein, 19 aa, Plasmodium falciparum
IDYEPCICKDYKETGYCGF

SEQ ID NO: 3358815 - protein, 18 aa, Plasmodium falciparum
IDYFIDMDFYCFNNKNNT

SEQ ID NO: 3358816 - protein, 19 aa, Plasmodium falciparum
IDYFVPLCYIYKKKKEESD

SEQ ID NO: 3358817 - protein, 32 aa, Plasmodium falciparum
IDYGDMINCFRCPKTYHKLCEGIKDENVKKTW

SEQ ID NO: 3358818 - protein, 17 aa, Plasmodium falciparum
IDYKENVALIFSPSLNT

SEQ ID NO: 3358819 - protein, 21 aa, Plasmodium falciparum
IDYPLKFYKTIYFNFFSSFIE

SEQ ID NO: 3358820 - protein, 24 aa, Plasmodium falciparum
IDYRKELLRNIYLTGGSSIIRGFR

SEQ ID NO: 3358821 - protein, 36 aa, Plasmodium falciparum
IDYRTLCGTCNMNVKYCPGHFGHIELAKPMYHYGFM

SEQ ID NO: 3358822 - protein, 23 aa, Plasmodium falciparum
IDYTRIGPRFSNSILQAIMVLIK

SEQ ID NO: 3358823 - protein, 24 aa, Plasmodium falciparum
IDYTVGGLFLFGGFKIDIEENNGI

SEQ ID NO: 3358824 - protein, 18 aa, Plasmodium falciparum
IEAEGGVSTALDDDNYMN

SEQ ID NO: 3358825 - protein, 17 aa, Plasmodium falciparum
IEAVRRALLKELRTVIS

SEQ ID NO: 3358826 - protein, 21 aa, Plasmodium falciparum
IECHTKMKITYLLDNITTLLC

SEQ ID NO: 3358827 - protein, 19 aa, Plasmodium falciparum
IECLIKLNIFLYLKKKKTY

SEQ ID NO: 3358828 - protein, 25 aa, Plasmodium falciparum
IECNLRASRTFPFISKALNLNFIDL

SEQ ID NO: 3358829 - protein, 17 aa, Plasmodium falciparum
IECSKKILYSCLYIEEN

SEQ ID NO: 3358830 - protein, 18 aa, Plasmodium falciparum
IEDELPRIFYFLRKHIKK

SEQ ID NO: 3358831 - protein, 23 aa, Plasmodium falciparum
IEDHDIQKYKDCYNNNDQDNKNS

SEQ ID NO: 3358832 - protein, 19 aa, Plasmodium falciparum
IEDIHKLKQALKVKQHNDI

SEQ ID NO: 3358833 - protein, 19 aa, Plasmodium falciparum
IEDIQWCKKGNGLGNVFAM

SEQ ID NO: 3358834 - protein, 23 aa, Plasmodium falciparum
IEDKKICTIQCIGGTGAIFVLLE

SEQ ID NO: 3358835 - protein, 29 aa, Plasmodium falciparum
IEDMNRSLELNGKMIYSGNNSFEHGTISV

SEQ ID NO: 3358836 - protein, 29 aa, Plasmodium falciparum
IEEICIKKKIIKMYEEMLLKLEKMSEERK

SEQ ID NO: 3358837 - protein, 21 aa, Plasmodium falciparum
IEEIFLYKDKIDYMLNLEKSI

SEQ ID NO: 3358838 - protein, 18 aa, Plasmodium falciparum
IEEKICFDEKIEVEEVFT

SEQ ID NO: 3358839 - protein, 19 aa, Plasmodium falciparum
IEELKHFLIKDYNFNELRV

SEQ ID NO: 3358840 - protein, 18 aa, Plasmodium falciparum
IEELKVGYEIILEHPTSL

SEQ ID NO: 3358841 - protein, 25 aa, Plasmodium falciparum
IEELLKRMYGFKSGEDYINFMENED

SEQ ID NO: 3358842 - protein, 26 aa, Plasmodium falciparum
IEERIPKNFLKNSFYCVCENDEECTE

SEQ ID NO: 3358843 - protein, 21 aa, Plasmodium falciparum
IEEYMFPSFINNKVFVLRNVI

SEQ ID NO: 3358844 - protein, 28 aa, Plasmodium falciparum
IEFEFKCLRVDISIPVCEYCYSTKAITY

SEQ ID NO: 3358845 - protein, 18 aa, Plasmodium falciparum
IEFPSHLNEEEKFEFEQM

SEQ ID NO: 3358846 - protein, 20 aa, Plasmodium falciparum
IEGFIGCFGSFVFDNLDMKP

SEQ ID NO: 3358847 - protein, 17 aa, Plasmodium falciparum
IEGKKYICESICPNLYN

SEQ ID NO: 3358848 - protein, 19 aa, Plasmodium falciparum
IEGKWLLEIAPNYYNLEDL

SEQ ID NO: 3358849 - protein, 17 aa, Plasmodium falciparum
IEGLLLISNYEEKKKRK

SEQ ID NO: 3358850 - protein, 23 aa, Plasmodium falciparum
IEGYKGVRTRGINKVKREKLDIL

SEQ ID NO: 3358851 - protein, 26 aa, Plasmodium falciparum
IEHIKCIKEGKILIDIEKQKENPKDH

SEQ ID NO: 3358852 - protein, 21 aa, Plasmodium falciparum
IEHIKLLSILINTCSYINSNI

SEQ ID NO: 3358853 - protein, 18 aa, Plasmodium falciparum
IEHLEICRQEICSNNTRL

SEQ ID NO: 3358854 - protein, 24 aa, Plasmodium falciparum
IEHPIIFITCGSYNSAVIDANKKL

SEQ ID NO: 3358855 - protein, 17 aa, Plasmodium falciparum
IEHQEILMNSSIFFLGS

SEQ ID NO: 3358856 - protein, 23 aa, Plasmodium falciparum
IEIAKKRILTILKILEDTLEEDK

SEQ ID NO: 3358857 - protein, 21 aa, Plasmodium falciparum
IEIFERKIIYLSFINEEILEK

SEQ ID NO: 3358858 - protein, 22 aa, Plasmodium falciparum
IEIFKTNISKIIKRINDNITDY

SEQ ID NO: 3358859 - protein, 18 aa, Plasmodium falciparum
IEIKDCYDHVTKKLKINR

SEQ ID NO: 3358860 - protein, 18 aa, Plasmodium falciparum
IEIKEFIDISTYNEPKHS

SEQ ID NO: 3358861 - protein, 18 aa, Plasmodium falciparum
IEILGCGKIKNEVLAMSL

SEQ ID NO: 3358862 - protein, 18 aa, Plasmodium falciparum
IEILSLGRNCIKKIQYLE

SEQ ID NO: 3358863 - protein, 17 aa, Plasmodium falciparum
IEIMKRDILSLPENPLH

SEQ ID NO: 3358864 - protein, 17 aa, Plasmodium falciparum
IEINYNFEKQKKNIIHS

SEQ ID NO: 3358865 - protein, 23 aa, Plasmodium falciparum
IEIPLFKKCCFLHQGTCEHRIVF

SEQ ID NO: 3358866 - protein, 17 aa, Plasmodium falciparum
IEITKMFDDNIVNDLKY

SEQ ID NO: 3358867 - protein, 25 aa, Plasmodium falciparum
IEKACGAVIKCQKEFDVSVYPPPSE

SEQ ID NO: 3358868 - protein, 18 aa, Plasmodium falciparum
IEKDELIMQNKLLKEKIL

SEQ ID NO: 3358869 - protein, 20 aa, Plasmodium falciparum
IEKDIKCVNNLFNNKKEKHF

SEQ ID NO: 3358870 - protein, 19 aa, Plasmodium falciparum
IEKDRKRCYTLLKELLKNK

SEQ ID NO: 3358871 - protein, 23 aa, Plasmodium falciparum
IEKEFNKFMNIFENINRNKPNES

SEQ ID NO: 3358872 - protein, 23 aa, Plasmodium falciparum
IEKEKNVDCIIVNKIQENVKGDE

SEQ ID NO: 3358873 - protein, 18 aa, Plasmodium falciparum
IEKHGGFVILMFQSIKLC

SEQ ID NO: 3358874 - protein, 28 aa, Plasmodium falciparum
IEKHLGDIFYSWLVSCYEDKNFLNKMDI

SEQ ID NO: 3358875 - protein, 28 aa, Plasmodium falciparum
IEKIKLNEFFFRIKVYMTSHMDELKKNY

SEQ ID NO: 3358876 - protein, 18 aa, Plasmodium falciparum
IEKIPYRLPPYIQDTKIS

SEQ ID NO: 3358877 - protein, 27 aa, Plasmodium falciparum
IEKKELLELWAPKYLYFDALKYISMIK

SEQ ID NO: 3358878 - protein, 24 aa, Plasmodium falciparum
IEKKFFPEMENLRLKEDMYKSNLL

SEQ ID NO: 3358879 - protein, 17 aa, Plasmodium falciparum
IEKKGFFSNRKKKKHKI

SEQ ID NO: 3358880 - protein, 17 aa, Plasmodium falciparum
IEKKILSKVTMNFSPCD

SEQ ID NO: 3358881 - protein, 25 aa, Plasmodium falciparum
IEKKKKIYEKWKYENYLKTIYHAKG

SEQ ID NO: 3358882 - protein, 25 aa, Plasmodium falciparum
IEKKLKRHFCQFTIYECNISNLVRF

SEQ ID NO: 3358883 - protein, 25 aa, Plasmodium falciparum
IEKKLPMKPNMFLTLINDLKIEFIL

SEQ ID NO: 3358884 - protein, 23 aa, Plasmodium falciparum
IEKLGHVNECFLFKLYSINSKSI

SEQ ID NO: 3358885 - protein, 20 aa, Plasmodium falciparum
IEKLKIKMAENIQSVEGELL

SEQ ID NO: 3358886 - protein, 21 aa, Plasmodium falciparum
IEKLNGMEWWNTVIKGDAEID

SEQ ID NO: 3358887 - protein, 17 aa, Plasmodium falciparum
IEKNCVYDETFIENEKF

SEQ ID NO: 3358888 - protein, 22 aa, Plasmodium falciparum
IEKNEDSCNIIINDKNKMKKKK

SEQ ID NO: 3358889 - protein, 28 aa, Plasmodium falciparum
IEKNIMWKKLLIDMICFNNNLNVPYNES

SEQ ID NO: 3358890 - protein, 18 aa, Plasmodium falciparum
IEKNISLLCNQPHVDNYD

SEQ ID NO: 3358891 - protein, 18 aa, Plasmodium falciparum
IEKNNLNDLLSLEYDDVD

SEQ ID NO: 3358892 - protein, 27 aa, Plasmodium falciparum
IEKQKRIFLYINHMGRINLEHYKSSLI

SEQ ID NO: 3358893 - protein, 25 aa, Plasmodium falciparum
IEKRAYLELKERFIAENKMVPEETT

SEQ ID NO: 3358894 - protein, 17 aa, Plasmodium falciparum
IEKRNYVNMMINEQGTA

SEQ ID NO: 3358895 - protein, 18 aa, Plasmodium falciparum
IEKSCFHLKKLVKAPKKF

SEQ ID NO: 3358896 - protein, 18 aa, Plasmodium falciparum
IEKSIFLDNLFKHIDNIS

SEQ ID NO: 3358897 - protein, 27 aa, Plasmodium falciparum
IEKVIKKKAFLEAKNTVFPSLKKYNTV

SEQ ID NO: 3358898 - protein, 18 aa, Plasmodium falciparum
IEKWKILINKDCNKKFIL

SEQ ID NO: 3358899 - protein, 24 aa, Plasmodium falciparum
IEKYIQCTELLLKEESIHSKYMNQ

SEQ ID NO: 3358900 - protein, 22 aa, Plasmodium falciparum
IEKYPKMASDIFFLTQKSSLPV

SEQ ID NO: 3358901 - protein, 24 aa, Plasmodium falciparum
IELAKPMYHYGFMNVVLNVLRCVC

SEQ ID NO: 3358902 - protein, 24 aa, Plasmodium falciparum
IELARLYAEKCIRKKNEKVNYLNL

SEQ ID NO: 3358903 - protein, 27 aa, Plasmodium falciparum
IELEENYKNIFEFIKKVNKNITYIRLH

SEQ ID NO: 3358904 - protein, 19 aa, Plasmodium falciparum
IELIECVNNICAMLLEVPN

SEQ ID NO: 3358905 - protein, 27 aa, Plasmodium falciparum
IELKRFCPCFKILSYYGNQNERYKKRV

SEQ ID NO: 3358906 - protein, 17 aa, Plasmodium falciparum
IELLIRKSFDNLDTLTC

SEQ ID NO: 3358907 - protein, 20 aa, Plasmodium falciparum
IELLLNKIFHSFNLKNDPVS

SEQ ID NO: 3358908 - protein, 25 aa, Plasmodium falciparum
IELNKDVLNNFFLRNNNSATTTSTT

SEQ ID NO: 3358909 - protein, 24 aa, Plasmodium falciparum
IELPNLIDYCYLYYLYSMTIANSN

SEQ ID NO: 3358910 - protein, 17 aa, Plasmodium falciparum
IELSTPYLVKAYINVPC

SEQ ID NO: 3358911 - protein, 24 aa, Plasmodium falciparum
IELVYKIIHIYLFQDLTDMQNIQK

SEQ ID NO: 3358912 - protein, 22 aa, Plasmodium falciparum
IELYSYREKYIFDKNKKDYWKN

SEQ ID NO: 3358913 - protein, 17 aa, Plasmodium falciparum
IEMIKKKLRIVCKSNNP

SEQ ID NO: 3358914 - protein, 19 aa, Plasmodium falciparum
IEMLHVLRCDGGMTKNKPF

SEQ ID NO: 3358915 - protein, 24 aa, Plasmodium falciparum
IEMRKKLCVFGRYKPLHWGVKEMS

SEQ ID NO: 3358916 - protein, 25 aa, Plasmodium falciparum
IEMTLYNWMVFSGPITLRANKGINL

SEQ ID NO: 3358917 - protein, 23 aa, Plasmodium falciparum
IENFEAYNKCFGKSIDYDNSKDS

SEQ ID NO: 3358918 - protein, 18 aa, Plasmodium falciparum
IENFKNVLCNDINQYFKD

SEQ ID NO: 3358919 - protein, 41 aa, Plasmodium falciparum
IENFLNIFIQFNFILNDFFLFKGEECFRQYFNNILDIYIKY

SEQ ID NO: 3358920 - protein, 18 aa, Plasmodium falciparum
IENIKMFFDGDLCDKNMS

SEQ ID NO: 3358921 - protein, 23 aa, Plasmodium falciparum
IENIKRQLFHLEYSKIHSRLFKS

SEQ ID NO: 3358922 - protein, 35 aa, Plasmodium falciparum
IENIYRGFNKKIWKILKELIDFKYCDVYTYLNDTD

SEQ ID NO: 3358923 - protein, 20 aa, Plasmodium falciparum
IENKAVKLNQAFKYPSIFYE

SEQ ID NO: 3358924 - protein, 17 aa, Plasmodium falciparum
IENKGCAVYEEVETLTN

SEQ ID NO: 3358925 - protein, 22 aa, Plasmodium falciparum
IENLKIRTFLGTGEYTNDAVIF

SEQ ID NO: 3358926 - protein, 29 aa, Plasmodium falciparum
IENNLCTKLNSIINFEWINNDLKMNLNGN

SEQ ID NO: 3358927 - protein, 18 aa, Plasmodium falciparum
IENYKYNSNYCVNDNEDN

SEQ ID NO: 3358928 - protein, 18 aa, Plasmodium falciparum
IENYLIQCDVLYPYIDEI

SEQ ID NO: 3358929 - protein, 26 aa, Plasmodium falciparum
IENYSTALTIKWAFEIKNQPHNLIQY

SEQ ID NO: 3358930 - protein, 18 aa, Plasmodium falciparum
IEPEIAFADLYDNMELAE

SEQ ID NO: 3358931 - protein, 17 aa, Plasmodium falciparum
IEPKKLLYMAIDGVAPK

SEQ ID NO: 3358932 - protein, 17 aa, Plasmodium falciparum
IEPLTEYLNKWKQLKEL

SEQ ID NO: 3358933 - protein, 34 aa, Plasmodium falciparum
IEPNPFYKDIILFGCFRKYIYLLNVEKKKIIKKF

SEQ ID NO: 3358934 - protein, 18 aa, Plasmodium falciparum
IEPSIKWFNNTRTISQNK

SEQ ID NO: 3358935 - protein, 25 aa, Plasmodium falciparum
IEQDFKNFICKYILNNKINDIQNNM

SEQ ID NO: 3358936 - protein, 18 aa, Plasmodium falciparum
IEQKLCLIWKYGKSLITF

SEQ ID NO: 3358937 - protein, 28 aa, Plasmodium falciparum
IEQLEKYSLLKFNYIMHSSYNMQEEYNK

SEQ ID NO: 3358938 - protein, 18 aa, Plasmodium falciparum
IEQLEVLLNYELQQIDSA

SEQ ID NO: 3358939 - protein, 22 aa, Plasmodium falciparum
IEQMAGIQLCEAFESNFIKINN

SEQ ID NO: 3358940 - protein, 17 aa, Plasmodium falciparum
IERHEFIVDKVFDDTVD

SEQ ID NO: 3358941 - protein, 18 aa, Plasmodium falciparum
IERIFLLKEMNTSTNVLY

SEQ ID NO: 3358942 - protein, 17 aa, Plasmodium falciparum
IERIITIAEEFIRTKNL

SEQ ID NO: 3358943 - protein, 21 aa, Plasmodium falciparum
IERIKKLVKIYREKYITDHRL

SEQ ID NO: 3358944 - protein, 26 aa, Plasmodium falciparum
IERKEILDLSMNRYSHFQSEISNNYN

SEQ ID NO: 3358945 - protein, 18 aa, Plasmodium falciparum
IERNKFHISLLILHIKKN

SEQ ID NO: 3358946 - protein, 17 aa, Plasmodium falciparum
IERRMWSTMTPLRQFGL

SEQ ID NO: 3358947 - protein, 20 aa, Plasmodium falciparum
IERRRLYRDYSYIIKNKKKH

SEQ ID NO: 3358948 - protein, 21 aa, Plasmodium falciparum
IESHAAYSLISYLLQVKDRHN

SEQ ID NO: 3358949 - protein, 18 aa, Plasmodium falciparum
IESIDMIKNIMLNIEDSD

SEQ ID NO: 3358950 - protein, 23 aa, Plasmodium falciparum
IESIGSIALKIPKCISRVVELSL

SEQ ID NO: 3358951 - protein, 24 aa, Plasmodium falciparum
IESIKRKIMSAADNTFPDAYLNNY

SEQ ID NO: 3358952 - protein, 19 aa, Plasmodium falciparum
IESKKVLKQNIIKNNFNFE

SEQ ID NO: 3358953 - protein, 24 aa, Plasmodium falciparum
IESKRLPLKYAGFSSCFRKEAGAH

SEQ ID NO: 3358954 - protein, 17 aa, Plasmodium falciparum
IESKTWGSFSLNVNSKF

SEQ ID NO: 3358955 - protein, 21 aa, Plasmodium falciparum
IESNLLIKFDFGTTKEEITPK

SEQ ID NO: 3358956 - protein, 32 aa, Plasmodium falciparum
IETADFRIKWIRECLEQLDIHHPDFLKTNASV

SEQ ID NO: 3358957 - protein, 22 aa, Plasmodium falciparum
IETDISYNITIHAYNTVVPSLW

SEQ ID NO: 3358958 - protein, 20 aa, Plasmodium falciparum
IEVPSYCLNYTYTFPTEQTE

SEQ ID NO: 3358959 - protein, 36 aa, Plasmodium falciparum
IEVRVKGEIGCVIYLNEEPEWFQGFVDSHNLNDTFS

SEQ ID NO: 3358960 - protein, 21 aa, Plasmodium falciparum
IEVSLYIGGKGISSFVHNSNS

SEQ ID NO: 3358961 - protein, 17 aa, Plasmodium falciparum
IEVSRLFEEKVKSILDN

SEQ ID NO: 3358962 - protein, 21 aa, Plasmodium falciparum
IEVYFPYELYDCQYNYMLSVL

SEQ ID NO: 3358963 - protein, 25 aa, Plasmodium falciparum
IEWFVCIKCLFLVDKNIILNYLIGK

SEQ ID NO: 3358964 - protein, 24 aa, Plasmodium falciparum
IEYDDKWRKCIFELEELKKNINMI

SEQ ID NO: 3358965 - protein, 18 aa, Plasmodium falciparum
IEYKSQEVFFLIDKLILF

SEQ ID NO: 3358966 - protein, 18 aa, Plasmodium falciparum
IEYLKYETAGKMNLSELE

SEQ ID NO: 3358967 - protein, 24 aa, Plasmodium falciparum
IEYLREFLHLPPSIFPATLSKKTV

SEQ ID NO: 3358968 - protein, 21 aa, Plasmodium falciparum
IFCAYCVKSIDFMKDEKEKYI

SEQ ID NO: 3358969 - protein, 22 aa, Plasmodium falciparum
IFCCNYSINILLHYDDEEYNNK

SEQ ID NO: 3358970 - protein, 18 aa, Plasmodium falciparum
IFCEPFEKCMCCSERVIL

SEQ ID NO: 3358971 - protein, 31 aa, Plasmodium falciparum
IFCRRLKKLVDLFLCIKQFQILKSIKFDCVQ

SEQ ID NO: 3358972 - protein, 20 aa, Plasmodium falciparum
IFDDINMNIQFNANINNNFG

SEQ ID NO: 3358973 - protein, 27 aa, Plasmodium falciparum
IFDEKLKNFFLNYKINPNIEESNDTKI

SEQ ID NO: 3358974 - protein, 22 aa, Plasmodium falciparum
IFDKHLDKLYAIQDMIIPKKGE

SEQ ID NO: 3358975 - protein, 22 aa, Plasmodium falciparum
IFEKAWKLFFHDDTKGKKLLLH

SEQ ID NO: 3358976 - protein, 20 aa, Plasmodium falciparum
IFEKELETIFSPKNIFCKKI

SEQ ID NO: 3358977 - protein, 24 aa, Plasmodium falciparum
IFEKGKFLRYIFMNNVNNIIVNEH

SEQ ID NO: 3358978 - protein, 26 aa, Plasmodium falciparum
IFEKILKLFTHICENVHFKLTRNKLE

SEQ ID NO: 3358979 - protein, 21 aa, Plasmodium falciparum
IFELKKLNLFAERKKKGDKEI

SEQ ID NO: 3358980 - protein, 18 aa, Plasmodium falciparum
IFELRNLKCMNIDMNNFH

SEQ ID NO: 3358981 - protein, 20 aa, Plasmodium falciparum
IFEVLLGFIYFNRPRNIIEF

SEQ ID NO: 3358982 - protein, 18 aa, Plasmodium falciparum
IFFDIKYFLIFKDIINDP

SEQ ID NO: 3358983 - protein, 17 aa, Plasmodium falciparum
IFFDYFINLKKKAIAQG

SEQ ID NO: 3358984 - protein, 23 aa, Plasmodium falciparum
IFFELDGPWHGMFLPASEKSDDL

SEQ ID NO: 3358985 - protein, 21 aa, Plasmodium falciparum
IFFFLKTIFILISLDDHKENK

SEQ ID NO: 3358986 - protein, 28 aa, Plasmodium falciparum
IFFKEGNSPWLYAHKSLQRELFIFPEDI

SEQ ID NO: 3358987 - protein, 19 aa, Plasmodium falciparum
IFFLIKCYKDIYNIQQEKK

SEQ ID NO: 3358988 - protein, 23 aa, Plasmodium falciparum
IFFLRNSIRIFDRFYSILENYVC

SEQ ID NO: 3358989 - protein, 17 aa, Plasmodium falciparum
IFFMMLFSSEELSDYTG

SEQ ID NO: 3358990 - protein, 19 aa, Plasmodium falciparum
IFFNKGVKEIHWPYYYFYI

SEQ ID NO: 3358991 - protein, 25 aa, Plasmodium falciparum
IFFSEDFITYDFQWVETDGVVSSYA

SEQ ID NO: 3358992 - protein, 26 aa, Plasmodium falciparum
IFFSKKRAPYLLMFEVADLDEDISHI

SEQ ID NO: 3358993 - protein, 18 aa, Plasmodium falciparum
IFHLRKNYILTPIFRSNK

SEQ ID NO: 3358994 - protein, 18 aa, Plasmodium falciparum
IFHYDLISSNNWDNHLRD

SEQ ID NO: 3358995 - protein, 20 aa, Plasmodium falciparum
IFIEDIFYYVGMIMKEMMEG

SEQ ID NO: 3358996 - protein, 23 aa, Plasmodium falciparum
IFIEDIFYYVGMIMKEMMEGQNI

SEQ ID NO: 3358997 - protein, 20 aa, Plasmodium falciparum
IFIESIKFIIVNNCHMKEQK

SEQ ID NO: 3358998 - protein, 18 aa, Plasmodium falciparum
IFIIYCLNKKNIVYLNFF

SEQ ID NO: 3358999 - protein, 22 aa, Plasmodium falciparum
IFIKNIKTGVTMEQFRNSLQEF

SEQ ID NO: 3359000 - protein, 18 aa, Plasmodium falciparum
IFILKLKQFQNIYEINDI

SEQ ID NO: 3359001 - protein, 17 aa, Plasmodium falciparum
IFILLFIFKLSCNDSVI

SEQ ID NO: 3359002 - protein, 24 aa, Plasmodium falciparum
IFININMMYFFSLSLDEQIINLFR

SEQ ID NO: 3359003 - protein, 21 aa, Plasmodium falciparum
IFINYNHRLFFYKYNGINMPL

SEQ ID NO: 3359004 - protein, 19 aa, Plasmodium falciparum
IFIRDEEKTELSIIMEKLP

SEQ ID NO: 3359005 - protein, 17 aa, Plasmodium falciparum
IFISVILYFSLNSGALN

SEQ ID NO: 3359006 - protein, 23 aa, Plasmodium falciparum
IFIWSLRNYYCLYILKDNLYPIN

SEQ ID NO: 3359007 - protein, 19 aa, Plasmodium falciparum
IFKDVKVYASYMQLYNDRI

SEQ ID NO: 3359008 - protein, 17 aa, Plasmodium falciparum
IFKEIYFNRSFKQLINY

SEQ ID NO: 3359009 - protein, 19 aa, Plasmodium falciparum
IFKELKCDNSEELTTNEKN

SEQ ID NO: 3359010 - protein, 19 aa, Plasmodium falciparum
IFKINKLKKLLHSEVDDNI

SEQ ID NO: 3359011 - protein, 20 aa, Plasmodium falciparum
IFKKEIHKIQLYKEKLSKKN

SEQ ID NO: 3359012 - protein, 22 aa, Plasmodium falciparum
IFKKEINVEALLSYLNSYGSLL

SEQ ID NO: 3359013 - protein, 21 aa, Plasmodium falciparum
IFKLSCLYNQIPECYCGPFSE

SEQ ID NO: 3359014 - protein, 24 aa, Plasmodium falciparum
IFKMKRKAFVKCLSNLYHFINVKW

SEQ ID NO: 3359015 - protein, 21 aa, Plasmodium falciparum
IFKNLYNVMSSFFKILSTYII

SEQ ID NO: 3359016 - protein, 18 aa, Plasmodium falciparum
IFKSTKFFQCTEMDWVEV

SEQ ID NO: 3359017 - protein, 17 aa, Plasmodium falciparum
IFKTEKYEYLYVNLLAM

SEQ ID NO: 3359018 - protein, 25 aa, Plasmodium falciparum
IFLCCNTEYLYLCDLRCNLLNTISK

SEQ ID NO: 3359019 - protein, 18 aa, Plasmodium falciparum
IFLDNLFKHIDNISLDVK

SEQ ID NO: 3359020 - protein, 19 aa, Plasmodium falciparum
IFLDTSFQNKKLMVHPKNG

SEQ ID NO: 3359021 - protein, 19 aa, Plasmodium falciparum
IFLFYKCTQYLNSFIFTYL

SEQ ID NO: 3359022 - protein, 22 aa, Plasmodium falciparum
IFLKAHGKKIMKSKEKKLKNTT

SEQ ID NO: 3359023 - protein, 20 aa, Plasmodium falciparum
IFLKDFVKNKMRLHIRLYGL

SEQ ID NO: 3359024 - protein, 17 aa, Plasmodium falciparum
IFLLLKFDNIPLHTMNN

SEQ ID NO: 3359025 - protein, 26 aa, Plasmodium falciparum
IFLLSTRAGGIGINLTTADIVILFDS

SEQ ID NO: 3359026 - protein, 28 aa, Plasmodium falciparum
IFLPNSVWLSALFNPISFLTAIKQKFAQ

SEQ ID NO: 3359027 - protein, 17 aa, Plasmodium falciparum
IFLQNIHLMTKWLKEFE

SEQ ID NO: 3359028 - protein, 17 aa, Plasmodium falciparum
IFLSNIYDINSFNLLLS

SEQ ID NO: 3359029 - protein, 17 aa, Plasmodium falciparum
IFMDCFNRIYDMNASML

SEQ ID NO: 3359030 - protein, 33 aa, Plasmodium falciparum
IFMIPLKHIYQFKPCYDNIFLDRILDDSTKGEN

SEQ ID NO: 3359031 - protein, 20 aa, Plasmodium falciparum
IFMYILRSHFFKHIPQSSYV

SEQ ID NO: 3359032 - protein, 18 aa, Plasmodium falciparum
IFNDLWIDFSENISSEIK

SEQ ID NO: 3359033 - protein, 26 aa, Plasmodium falciparum
IFNDTFFFKYIQKIQIEMLPFIQALE

SEQ ID NO: 3359034 - protein, 19 aa, Plasmodium falciparum
IFNEVKLDEGLFGALEYLK

SEQ ID NO: 3359035 - protein, 32 aa, Plasmodium falciparum
IFNFLFKVYFLYPFTKYVCNYLRQIKHFSEQE

SEQ ID NO: 3359036 - protein, 18 aa, Plasmodium falciparum
IFNIGDIVSIEIYDKLYP

SEQ ID NO: 3359037 - protein, 19 aa, Plasmodium falciparum
IFNKKRLDFKIHPKFFHIP

SEQ ID NO: 3359038 - protein, 18 aa, Plasmodium falciparum
IFNSNLFHGNNMGYHEGN

SEQ ID NO: 3359039 - protein, 26 aa, Plasmodium falciparum
IFNSVENLDCLKLINFQNELLTKLNY

SEQ ID NO: 3359040 - protein, 17 aa, Plasmodium falciparum
IFNYFKPLLTFRNINII

SEQ ID NO: 3359041 - protein, 23 aa, Plasmodium falciparum
IFPDMLRYAPIFKINKSKAKTNF

SEQ ID NO: 3359042 - protein, 22 aa, Plasmodium falciparum
IFPDRVKPYYSFIKKALAACEH

SEQ ID NO: 3359043 - protein, 25 aa, Plasmodium falciparum
IFPIIWEYINQLPFDKESWIENFDN

SEQ ID NO: 3359044 - protein, 26 aa, Plasmodium falciparum
IFPSKDIKSLCIFKQRNKKVRSSNNS

SEQ ID NO: 3359045 - protein, 21 aa, Plasmodium falciparum
IFQKKDFKEPIEINVSDIIEN

SEQ ID NO: 3359046 - protein, 18 aa, Plasmodium falciparum
IFQQPGVQNMHIYNMFAQ

SEQ ID NO: 3359047 - protein, 19 aa, Plasmodium falciparum
IFRCGEKTFNDLIFENEIN

SEQ ID NO: 3359048 - protein, 20 aa, Plasmodium falciparum
IFREDNEIYIKGGVVPPPIR

SEQ ID NO: 3359049 - protein, 25 aa, Plasmodium falciparum
IFRITCLQYISKLIIYFPLEYIQHN

SEQ ID NO: 3359050 - protein, 17 aa, Plasmodium falciparum
IFRKWTRTLYYYWKDKY

SEQ ID NO: 3359051 - protein, 23 aa, Plasmodium falciparum
IFRYIKENLPIYFFLNKMDINHI

SEQ ID NO: 3359052 - protein, 26 aa, Plasmodium falciparum
IFSANCLKGLKFLNLSSCNINNDGIS

SEQ ID NO: 3359053 - protein, 26 aa, Plasmodium falciparum
IFSCGYSDGLISVWDMRYNKESLLKL

SEQ ID NO: 3359054 - protein, 20 aa, Plasmodium falciparum
IFSDDIWKINKCSFDKTNPI

SEQ ID NO: 3359055 - protein, 23 aa, Plasmodium falciparum
IFSHRFETIRAYLHYKNNMNEIN

SEQ ID NO: 3359056 - protein, 31 aa, Plasmodium falciparum
IFSSGKNLFGIPIARTTNNLFLQKIESNIIN

SEQ ID NO: 3359057 - protein, 17 aa, Plasmodium falciparum
IFSTGSCGWHIMDKIYL

SEQ ID NO: 3359058 - protein, 21 aa, Plasmodium falciparum
IFSVLLKNHFNNFKQDVSDLI

SEQ ID NO: 3359059 - protein, 18 aa, Plasmodium falciparum
IFSYCQYISYLITHIQTY

SEQ ID NO: 3359060 - protein, 19 aa, Plasmodium falciparum
IFTCQKYFMRPSNVLHNIQ

SEQ ID NO: 3359061 - protein, 29 aa, Plasmodium falciparum
IFTEIYINYECAFIRLANIYIKNKNFLKA

SEQ ID NO: 3359062 - protein, 32 aa, Plasmodium falciparum
IFTEKNCDLFAFPLKCKMHLLNNSFNNLINTM

SEQ ID NO: 3359063 - protein, 30 aa, Plasmodium falciparum
IFTEWSIEPTPLWTVECEIMFNELPKKIIK

SEQ ID NO: 3359064 - protein, 25 aa, Plasmodium falciparum
IFTGKRIAIDVSIWLYELTYANNVK

SEQ ID NO: 3359065 - protein, 19 aa, Plasmodium falciparum
IFTNECTHIVKLLESNVYF

SEQ ID NO: 3359066 - protein, 20 aa, Plasmodium falciparum
IFTNIIVCLYRIANNINGKV

SEQ ID NO: 3359067 - protein, 20 aa, Plasmodium falciparum
IFTSHMFSYLNNVLCEINNA

SEQ ID NO: 3359068 - protein, 26 aa, Plasmodium falciparum
IFVEEKCLMVPPSCAPMILTQEEKKE

SEQ ID NO: 3359069 - protein, 18 aa, Plasmodium falciparum
IFYHKLKTVCLSKKEKEL

SEQ ID NO: 3359070 - protein, 19 aa, Plasmodium falciparum
IFYIIIIFYNIEKVNNYKS

SEQ ID NO: 3359071 - protein, 20 aa, Plasmodium falciparum
IFYKSLCHPGECVGALAAQS

SEQ ID NO: 3359072 - protein, 38 aa, Plasmodium falciparum
IFYLEHNKMYCCCCNRKLSYACPVFFIKPFYNSTDLWN

SEQ ID NO: 3359073 - protein, 17 aa, Plasmodium falciparum
IFYLPSLNERTYDFEEI

SEQ ID NO: 3359074 - protein, 22 aa, Plasmodium falciparum
IFYLRFSKCISKNNNYGYINFG

SEQ ID NO: 3359075 - protein, 19 aa, Plasmodium falciparum
IFYMLAEEIYKNIINNNNT

SEQ ID NO: 3359076 - protein, 17 aa, Plasmodium falciparum
IFYYVGMIMKEMMEGQN

SEQ ID NO: 3359077 - protein, 24 aa, Plasmodium falciparum
IGCSLKHYDLITGIRLVDKLSTTR

SEQ ID NO: 3359078 - protein, 18 aa, Plasmodium falciparum
IGDIRWFDIEKLLEYKDS

SEQ ID NO: 3359079 - protein, 18 aa, Plasmodium falciparum
IGDVVLCVVSNKSIDQKI

SEQ ID NO: 3359080 - protein, 23 aa, Plasmodium falciparum
IGELCILRNLLRCEGQKSVYICP

SEQ ID NO: 3359081 - protein, 24 aa, Plasmodium falciparum
IGEVIKGRISAINYNLNNKFETNF

SEQ ID NO: 3359082 - protein, 24 aa, Plasmodium falciparum
IGFSSTECYGYFFKKIKNKYETNE

SEQ ID NO: 3359083 - protein, 19 aa, Plasmodium falciparum
IGGGDMFYDINDPFLDDEE

SEQ ID NO: 3359084 - protein, 17 aa, Plasmodium falciparum
IGGTCVNVGCVPKKLMH

SEQ ID NO: 3359085 - protein, 17 aa, Plasmodium falciparum
IGIDSRIGRGFERHRQK

SEQ ID NO: 3359086 - protein, 24 aa, Plasmodium falciparum
IGISLSEFILIINFILKVKKNRIF

SEQ ID NO: 3359087 - protein, 18 aa, Plasmodium falciparum
IGISRSYNLFYSKDKNKK

SEQ ID NO: 3359088 - protein, 20 aa, Plasmodium falciparum
IGITEMEWKKYIKRKKKNEN

SEQ ID NO: 3359089 - protein, 22 aa, Plasmodium falciparum
IGKETALYCARNIADFIGNCTT

SEQ ID NO: 3359090 - protein, 19 aa, Plasmodium falciparum
IGKIGGRSKSLLTHSKKVS

SEQ ID NO: 3359091 - protein, 22 aa, Plasmodium falciparum
IGKKCGSSTFSNYIINDNEINK

SEQ ID NO: 3359092 - protein, 20 aa, Plasmodium falciparum
IGKKNKRRSYDYSSNYDESD

SEQ ID NO: 3359093 - protein, 24 aa, Plasmodium falciparum
IGKKRLRNSMSLSYERKKRIRPES

SEQ ID NO: 3359094 - protein, 24 aa, Plasmodium falciparum
IGKNFKDTFSYYIEFDKYNSDDHK

SEQ ID NO: 3359095 - protein, 17 aa, Plasmodium falciparum
IGLCIKNILDSTLEKNI

SEQ ID NO: 3359096 - protein, 22 aa, Plasmodium falciparum
IGLPLECYLALKNDKYRKPRIG

SEQ ID NO: 3359097 - protein, 23 aa, Plasmodium falciparum
IGLSELYMYYMIPKREERENLGL

SEQ ID NO: 3359098 - protein, 20 aa, Plasmodium falciparum
IGMPIEFAKVLTIDEYITQN

SEQ ID NO: 3359099 - protein, 21 aa, Plasmodium falciparum
IGNDIMKWRAVIFGPADTPWE

SEQ ID NO: 3359100 - protein, 23 aa, Plasmodium falciparum
IGNGKLVNMDNMFNINEHNNIYR

SEQ ID NO: 3359101 - protein, 22 aa, Plasmodium falciparum
IGNKICGGYTCMLHKEVSDFLN

SEQ ID NO: 3359102 - protein, 28 aa, Plasmodium falciparum
IGNKICPRARYKHASFSFNDFLYIHGGL

SEQ ID NO: 3359103 - protein, 17 aa, Plasmodium falciparum
IGNKKCLYIILDDLNNI

SEQ ID NO: 3359104 - protein, 18 aa, Plasmodium falciparum
IGNMVQFNRSIVPISNDE

SEQ ID NO: 3359105 - protein, 20 aa, Plasmodium falciparum
IGNPLCKGGPEKEKRFSSIS

SEQ ID NO: 3359106 - protein, 21 aa, Plasmodium falciparum
IGNQNLKSCTMIYKDDKEENK

SEQ ID NO: 3359107 - protein, 18 aa, Plasmodium falciparum
IGNSLVLQLIDIEDPSSI

SEQ ID NO: 3359108 - protein, 18 aa, Plasmodium falciparum
IGNYYSGKLYPEGYNENN

SEQ ID NO: 3359109 - protein, 25 aa, Plasmodium falciparum
IGPKTFPLICSHCSGAVIYGEKNFD

SEQ ID NO: 3359110 - protein, 23 aa, Plasmodium falciparum
IGPNIEYYPNVPIFPESQNQMFP

SEQ ID NO: 3359111 - protein, 24 aa, Plasmodium falciparum
IGQFGVGFYSSFLVSNRVEVYTKK

SEQ ID NO: 3359112 - protein, 23 aa, Plasmodium falciparum
IGQFGVGFYSSFVVSNKVEVFTR

SEQ ID NO: 3359113 - protein, 23 aa, Plasmodium falciparum
IGQRTPYKYILKVAGLIQDIRQK

SEQ ID NO: 3359114 - protein, 17 aa, Plasmodium falciparum
IGRPLFKGVTEFDLIIR

SEQ ID NO: 3359115 - protein, 26 aa, Plasmodium falciparum
IGSCIYCSKINFRIYKPSSQNDYSNE

SEQ ID NO: 3359116 - protein, 17 aa, Plasmodium falciparum
IGSCTPSAMLFYSYEKY

SEQ ID NO: 3359117 - protein, 18 aa, Plasmodium falciparum
IGSEFLKNIITIGCKNID

SEQ ID NO: 3359118 - protein, 18 aa, Plasmodium falciparum
IGSGKGYYDKTLTKTRKK

SEQ ID NO: 3359119 - protein, 22 aa, Plasmodium falciparum
IGSKADFSSLCSDNNGYEMFEN

SEQ ID NO: 3359120 - protein, 21 aa, Plasmodium falciparum
IGSTLLDFFLPLPTKNTNTYE

SEQ ID NO: 3359121 - protein, 22 aa, Plasmodium falciparum
IGTGPLSLLSINAILNGAKHVD

SEQ ID NO: 3359122 - protein, 25 aa, Plasmodium falciparum
IGTPNLPEFWLRALRNNNTVSHVIE

SEQ ID NO: 3359123 - protein, 29 aa, Plasmodium falciparum
IGVYNWYVHCLKYYIGIKTFREIEQKKKN

SEQ ID NO: 3359124 - protein, 24 aa, Plasmodium falciparum
IGWGEFYLQVKIHFVDLTLSPISI

SEQ ID NO: 3359125 - protein, 25 aa, Plasmodium falciparum
IGYANTCVCVARFFSNKCEILCDIA

SEQ ID NO: 3359126 - protein, 28 aa, Plasmodium falciparum
IGYHCKKFSSLRGSHVVNYIDIKYCLKL

SEQ ID NO: 3359127 - protein, 18 aa, Plasmodium falciparum
IGYTDAYVIKDCKVAYVY

SEQ ID NO: 3359128 - protein, 34 aa, Plasmodium falciparum
IHCDDVCFSQICNLCIIKRKNLYLKYKKFKKHNL

SEQ ID NO: 3359129 - protein, 17 aa, Plasmodium falciparum
IHEKNVKLSNCIINDNF

SEQ ID NO: 3359130 - protein, 22 aa, Plasmodium falciparum
IHEKQHRWEIVVSKSDGSQFQQ

SEQ ID NO: 3359131 - protein, 19 aa, Plasmodium falciparum
IHERKCIEEIINFHDSKLK

SEQ ID NO: 3359132 - protein, 20 aa, Plasmodium falciparum
IHESENWILASLYSGKLVIF

SEQ ID NO: 3359133 - protein, 24 aa, Plasmodium falciparum
IHEYDNLLEIIKSIRVVQRNLVFV

SEQ ID NO: 3359134 - protein, 22 aa, Plasmodium falciparum
IHFDIIDYSFIFSKNLKKFVNY

SEQ ID NO: 3359135 - protein, 23 aa, Plasmodium falciparum
IHFFSIDIIHRIAFNYDIKNMNN

SEQ ID NO: 3359136 - protein, 19 aa, Plasmodium falciparum
IHFHLKRYIMVGKKKTLDV

SEQ ID NO: 3359137 - protein, 23 aa, Plasmodium falciparum
IHFINSCNYIHGLINPLSIFVNS

SEQ ID NO: 3359138 - protein, 24 aa, Plasmodium falciparum
IHFKHDLACKIIELIERYTPDDIW

SEQ ID NO: 3359139 - protein, 18 aa, Plasmodium falciparum
IHFLSRNNSKGWTNKINE

SEQ ID NO: 3359140 - protein, 23 aa, Plasmodium falciparum
IHFNCSIKNFVEFLENNINNKII

SEQ ID NO: 3359141 - protein, 24 aa, Plasmodium falciparum
IHFNEENYEYFGRGRNYKNCNNNG

SEQ ID NO: 3359142 - protein, 18 aa, Plasmodium falciparum
IHFTSYFNISCDFNEYEN

SEQ ID NO: 3359143 - protein, 31 aa, Plasmodium falciparum
IHFYKIGKPCLMCLVDLPGYGYAECKEELRL

SEQ ID NO: 3359144 - protein, 18 aa, Plasmodium falciparum
IHHILFQLWMCEVDLGNI

SEQ ID NO: 3359145 - protein, 26 aa, Plasmodium falciparum
IHHKRARYFFNFFQVYGILSEESSDY

SEQ ID NO: 3359146 - protein, 26 aa, Plasmodium falciparum
IHHMEHCYICSYPIQNNEQKFILHKG

SEQ ID NO: 3359147 - protein, 19 aa, Plasmodium falciparum
IHIGDRLEVTVSIDKNTAG

SEQ ID NO: 3359148 - protein, 19 aa, Plasmodium falciparum
IHIKKHVKHNISYFACKHV

SEQ ID NO: 3359149 - protein, 23 aa, Plasmodium falciparum
IHIKKYKPLIIYFFNNLAQNLKK

SEQ ID NO: 3359150 - protein, 27 aa, Plasmodium falciparum
IHILGMKLIHVKHCSDFSLYFLKSNYA

SEQ ID NO: 3359151 - protein, 18 aa, Plasmodium falciparum
IHIMNCINIQYSELECIY

SEQ ID NO: 3359152 - protein, 17 aa, Plasmodium falciparum
IHIPKIKDFYILQDNQF

SEQ ID NO: 3359153 - protein, 25 aa, Plasmodium falciparum
IHIYSLCKHHLLPFEGTCDIEYIPN

SEQ ID NO: 3359154 - protein, 18 aa, Plasmodium falciparum
IHKIAILDIRVMNLDRND

SEQ ID NO: 3359155 - protein, 17 aa, Plasmodium falciparum
IHKKCYKKVNEHICTSS

SEQ ID NO: 3359156 - protein, 26 aa, Plasmodium falciparum
IHKKNCIIFLLLKYIYMWKNMNLNAH

SEQ ID NO: 3359157 - protein, 18 aa, Plasmodium falciparum
IHKKYIIYQLLRALKYIH

SEQ ID NO: 3359158 - protein, 24 aa, Plasmodium falciparum
IHKLADLCQSFTCSDINSLINISM

SEQ ID NO: 3359159 - protein, 23 aa, Plasmodium falciparum
IHKNEIKKGTILISHPLTSNPLW

SEQ ID NO: 3359160 - protein, 33 aa, Plasmodium falciparum
IHKNVWKRMYIPEEIKFFILKYITLLNNLRDYI

SEQ ID NO: 3359161 - protein, 19 aa, Plasmodium falciparum
IHKRKKKGKGKDKGKDKTE

SEQ ID NO: 3359162 - protein, 30 aa, Plasmodium falciparum
IHKYLKRIKIFWSFCFFKNLEYCLRQAKEF

SEQ ID NO: 3359163 - protein, 19 aa, Plasmodium falciparum
IHLKRFIDEAFLMYFNQKH

SEQ ID NO: 3359164 - protein, 19 aa, Plasmodium falciparum
IHLTNEWFKLYKCELRPLM

SEQ ID NO: 3359165 - protein, 36 aa, Plasmodium falciparum
IHLVQLAIHKGIFVYSQRILLPVSACEKSADDLYPK

SEQ ID NO: 3359166 - protein, 25 aa, Plasmodium falciparum
IHMIDIKIGNYFYAVSLTIIEDYDI

SEQ ID NO: 3359167 - protein, 21 aa, Plasmodium falciparum
IHNELPRLVVFGQQSMGKTTL

SEQ ID NO: 3359168 - protein, 26 aa, Plasmodium falciparum
IHNISGLHYYEYIYKYIVKPLNLTEE

SEQ ID NO: 3359169 - protein, 40 aa, Plasmodium falciparum
IHNLFPCCICSIRLHFSFISFDILEIMLTGHLIKVKNNNA

SEQ ID NO: 3359170 - protein, 24 aa, Plasmodium falciparum
IHNLKSIINRDFLDKSLVSNDDEI

SEQ ID NO: 3359171 - protein, 18 aa, Plasmodium falciparum
IHNSDMKKEYSLYDKNVC

SEQ ID NO: 3359172 - protein, 23 aa, Plasmodium falciparum
IHPDGTFYKGFWLNDKQNKNGIE

SEQ ID NO: 3359173 - protein, 27 aa, Plasmodium falciparum
IHPNILRTGIFFNKCSITTHNHRNVDL

SEQ ID NO: 3359174 - protein, 17 aa, Plasmodium falciparum
IHPVWTVYMNRFSLFKQ

SEQ ID NO: 3359175 - protein, 38 aa, Plasmodium falciparum
IHPYYAELFIKFFNNYKLNAFKSNKVCSVTWGRVQGLK

SEQ ID NO: 3359176 - protein, 17 aa, Plasmodium falciparum
IHRMIKLGLSIDEEENN

SEQ ID NO: 3359177 - protein, 17 aa, Plasmodium falciparum
IHRYYPLDMKMHSNIYL

SEQ ID NO: 3359178 - protein, 19 aa, Plasmodium falciparum
IHSAEFFYFNSINQKTLNV

SEQ ID NO: 3359179 - protein, 24 aa, Plasmodium falciparum
IHSDNKYETCSLPEKKNIYEPNSQ

SEQ ID NO: 3359180 - protein, 20 aa, Plasmodium falciparum
IHSESCLKKYYNNIILKALS

SEQ ID NO: 3359181 - protein, 18 aa, Plasmodium falciparum
IHSINVYNQLLLKRKMIN

SEQ ID NO: 3359182 - protein, 23 aa, Plasmodium falciparum
IHSRRKGKANSNELCDDDDEEER

SEQ ID NO: 3359183 - protein, 23 aa, Plasmodium falciparum
IHSSINYRSFLKLFIKNDDKSIL

SEQ ID NO: 3359184 - protein, 19 aa, Plasmodium falciparum
IHSYDFKLIHKFCIDNYKE

SEQ ID NO: 3359185 - protein, 18 aa, Plasmodium falciparum
IHVDFCQSLSKYKNEYLK

SEQ ID NO: 3359186 - protein, 17 aa, Plasmodium falciparum
IHVHRIANRLNWVNSKN

SEQ ID NO: 3359187 - protein, 23 aa, Plasmodium falciparum
IHVKCTTFLSALKLLKIAQYAGL

SEQ ID NO: 3359188 - protein, 23 aa, Plasmodium falciparum
IHYFDRCKIVLLKNQNNKNKDNN

SEQ ID NO: 3359189 - protein, 28 aa, Plasmodium falciparum
IHYKPQNVFISFKYSKDNIFPTNEKLTY

SEQ ID NO: 3359190 - protein, 34 aa, Plasmodium falciparum
IIACACFPVKCLREGLRFVPLCDKYLKDIKGSGI

SEQ ID NO: 3359191 - protein, 28 aa, Plasmodium falciparum
IIAKEFCEFRNLKNLKVLIIGQPGVGKT

SEQ ID NO: 3359192 - protein, 28 aa, Plasmodium falciparum
IIALMECMSCITSAYGKEFLKYAKDVIR

SEQ ID NO: 3359193 - protein, 26 aa, Plasmodium falciparum
IICDGFRMALASAREALLDSCFCHDV

SEQ ID NO: 3359194 - protein, 23 aa, Plasmodium falciparum
IICKKCNKYIYKGERFKSERRKI

SEQ ID NO: 3359195 - protein, 19 aa, Plasmodium falciparum
IICTFPLIEMMNFHKQNKA

SEQ ID NO: 3359196 - protein, 18 aa, Plasmodium falciparum
IIDACKMKDLKLVEKTVQ

SEQ ID NO: 3359197 - protein, 19 aa, Plasmodium falciparum
IIDELRCIEKSIKTDKQTI

SEQ ID NO: 3359198 - protein, 21 aa, Plasmodium falciparum
IIDEPTCRHIITIPINDNTKY

SEQ ID NO: 3359199 - protein, 19 aa, Plasmodium falciparum
IIDFNSCIYESDKLEMYIQ

SEQ ID NO: 3359200 - protein, 28 aa, Plasmodium falciparum
IIDIDNLCIDDCILQESFYEKRKNRKDS

SEQ ID NO: 3359201 - protein, 19 aa, Plasmodium falciparum
IIDIVNYIITIGIWEMYTY

SEQ ID NO: 3359202 - protein, 18 aa, Plasmodium falciparum
IIDKACLDSICSEDSLKN

SEQ ID NO: 3359203 - protein, 25 aa, Plasmodium falciparum
IIDKALLRSGRFDQLIYISLPKYQG

SEQ ID NO: 3359204 - protein, 24 aa, Plasmodium falciparum
IIDKEIIELFYIIIMNKNVYPHFI

SEQ ID NO: 3359205 - protein, 26 aa, Plasmodium falciparum
IIDKKDCKIDHICYNSTNESEGKNND

SEQ ID NO: 3359206 - protein, 18 aa, Plasmodium falciparum
IIDLKLGYNTIIDNDLSF

SEQ ID NO: 3359207 - protein, 21 aa, Plasmodium falciparum
IIDMNLLYNKDIDTLNSNGSA

SEQ ID NO: 3359208 - protein, 18 aa, Plasmodium falciparum
IIDPNVCNNFINCNKNNK

SEQ ID NO: 3359209 - protein, 25 aa, Plasmodium falciparum
IIDSCISSSVYFCLEDNNTISVFSL

SEQ ID NO: 3359210 - protein, 26 aa, Plasmodium falciparum
IIDSDWNIHLCDFGDAEECEDGIVTN

SEQ ID NO: 3359211 - protein, 24 aa, Plasmodium falciparum
IIEIPMNVNLCIIACPGSGKTSTL

SEQ ID NO: 3359212 - protein, 24 aa, Plasmodium falciparum
IIEKSGYQALPWVRYITQNGDYQV

SEQ ID NO: 3359213 - protein, 19 aa, Plasmodium falciparum
IIEKTPYYKLINFEKKLAT

SEQ ID NO: 3359214 - protein, 17 aa, Plasmodium falciparum
IIELQYCVINLSDSMEI

SEQ ID NO: 3359215 - protein, 18 aa, Plasmodium falciparum
IIELSNNIFLEFFSCDVE

SEQ ID NO: 3359216 - protein, 23 aa, Plasmodium falciparum
IIENKLDPVFIFLKREGLQHDYI

SEQ ID NO: 3359217 - protein, 26 aa, Plasmodium falciparum
IIEPKKKKLLFFKKKINNKINTITNN

SEQ ID NO: 3359218 - protein, 26 aa, Plasmodium falciparum
IIEPLKRKIYQNMSIYIENLISDVKS

SEQ ID NO: 3359219 - protein, 24 aa, Plasmodium falciparum
IIERECLILFNLYHDGLMLRSLSK

SEQ ID NO: 3359220 - protein, 18 aa, Plasmodium falciparum
IIEYLPPICESFLRYVLD

SEQ ID NO: 3359221 - protein, 17 aa, Plasmodium falciparum
IIFELLLALSYFHSNNY

SEQ ID NO: 3359222 - protein, 26 aa, Plasmodium falciparum
IIFERIYRYICDDIKKEIIEHSYSKE

SEQ ID NO: 3359223 - protein, 19 aa, Plasmodium falciparum
IIFGICLGNQLLGISLGCD

SEQ ID NO: 3359224 - protein, 17 aa, Plasmodium falciparum
IIFPDVLFLIGSLSVVK

SEQ ID NO: 3359225 - protein, 19 aa, Plasmodium falciparum
IIFYNEFIKDDNYYNNICL

SEQ ID NO: 3359226 - protein, 31 aa, Plasmodium falciparum
IIGFREGQVELARRKEFIFTDDGKIKKIVEE

SEQ ID NO: 3359227 - protein, 27 aa, Plasmodium falciparum
IIGKPRSRRKTKRWNIEEEDKLYEDEV

SEQ ID NO: 3359228 - protein, 21 aa, Plasmodium falciparum
IIGNIKLWIQLNVPRIEDGNN

SEQ ID NO: 3359229 - protein, 26 aa, Plasmodium falciparum
IIHEFLRMYWCKKILNWSGNSKTALK

SEQ ID NO: 3359230 - protein, 30 aa, Plasmodium falciparum
IIHEGWLNKWTNIIGSYRPRYFILENGLLR

SEQ ID NO: 3359231 - protein, 34 aa, Plasmodium falciparum
IIHEKIKKGCILQNIKMKEGIIINKTNTFQDYRT

SEQ ID NO: 3359232 - protein, 25 aa, Plasmodium falciparum
IIHIRALDMTQAFSLDIGNAYIGLY

SEQ ID NO: 3359233 - protein, 19 aa, Plasmodium falciparum
IIHKYCLSIFKKINISTFF

SEQ ID NO: 3359234 - protein, 18 aa, Plasmodium falciparum
IIHNDGLHSLSREKKKNK

SEQ ID NO: 3359235 - protein, 24 aa, Plasmodium falciparum
IIHNKKTRCISQFSYERKYKKNIN

SEQ ID NO: 3359236 - protein, 23 aa, Plasmodium falciparum
IIHTYNIPSFFLLDKDVRNHFLS

SEQ ID NO: 3359237 - protein, 18 aa, Plasmodium falciparum
IIIFDEIDMLFQNNAYRN

SEQ ID NO: 3359238 - protein, 19 aa, Plasmodium falciparum
IIIGVPCRNCSGNGQIINN

SEQ ID NO: 3359239 - protein, 24 aa, Plasmodium falciparum
IIIIYKRFNYISSNGKLNYDNFEK

SEQ ID NO: 3359240 - protein, 20 aa, Plasmodium falciparum
IIILDILSSVLIQKIKQCTI

SEQ ID NO: 3359241 - protein, 21 aa, Plasmodium falciparum
IIINKKIGLIFKHIHSNTYFI

SEQ ID NO: 3359242 - protein, 18 aa, Plasmodium falciparum
IIIPKGSYLYELIYPQTI

SEQ ID NO: 3359243 - protein, 20 aa, Plasmodium falciparum
IIISIIYKQNFWYNNILNKS

SEQ ID NO: 3359244 - protein, 20 aa, Plasmodium falciparum
IIKCSYACIRSCDNILSKIC

SEQ ID NO: 3359245 - protein, 19 aa, Plasmodium falciparum
IIKEDGLLDDCIKDDIINN

SEQ ID NO: 3359246 - protein, 23 aa, Plasmodium falciparum
IIKEIKTVFQIGIYMHKNTNSIF

SEQ ID NO: 3359247 - protein, 17 aa, Plasmodium falciparum
IIKGINILKNMTMNDKF

SEQ ID NO: 3359248 - protein, 17 aa, Plasmodium falciparum
IIKGTELNLPFQALLKL

SEQ ID NO: 3359249 - protein, 22 aa, Plasmodium falciparum
IIKHELFCDFLYSILQIDPTLR

SEQ ID NO: 3359250 - protein, 24 aa, Plasmodium falciparum
IIKIKKYGEHGLGYNEHEENNNGM

SEQ ID NO: 3359251 - protein, 18 aa, Plasmodium falciparum
IIKKCLLNLFTRVKEEYP

SEQ ID NO: 3359252 - protein, 18 aa, Plasmodium falciparum
IIKKKWRDTRTNQNLNSN

SEQ ID NO: 3359253 - protein, 25 aa, Plasmodium falciparum
IIKKNFKLPCWIKIKNLRKNDLSNL

SEQ ID NO: 3359254 - protein, 18 aa, Plasmodium falciparum
IIKKNSFLDMKIFFEPSN

SEQ ID NO: 3359255 - protein, 32 aa, Plasmodium falciparum
IIKLCSESEAFFYAWLYLSCLKKINISRTKNN

SEQ ID NO: 3359256 - protein, 27 aa, Plasmodium falciparum
IIKLDFKYNKADSFFKLINIAKNNQNN

SEQ ID NO: 3359257 - protein, 20 aa, Plasmodium falciparum
IIKLRCEYYAVIFSQASKLL

SEQ ID NO: 3359258 - protein, 28 aa, Plasmodium falciparum
IIKLTKKLCKYKKKRKFNDTQKKGTYKD

SEQ ID NO: 3359259 - protein, 18 aa, Plasmodium falciparum
IIKLYLLIYNECGKVLIY

SEQ ID NO: 3359260 - protein, 24 aa, Plasmodium falciparum
IIKNGECIYKYIVEGANVFISDDA

SEQ ID NO: 3359261 - protein, 29 aa, Plasmodium falciparum
IIKNKVYCPIELKNVYTLLEDSDKILRKK

SEQ ID NO: 3359262 - protein, 28 aa, Plasmodium falciparum
IIKNLCVKYGYPGCDYISAYKKCINDMD

SEQ ID NO: 3359263 - protein, 17 aa, Plasmodium falciparum
IIKNLKNTFGHDQVFDE

SEQ ID NO: 3359264 - protein, 22 aa, Plasmodium falciparum
IIKNVLTLVLWDIESTVRQATE

SEQ ID NO: 3359265 - protein, 18 aa, Plasmodium falciparum
IIKNWKLNFPDINTENLF

SEQ ID NO: 3359266 - protein, 17 aa, Plasmodium falciparum
IIKSVLNSFSYIHNEKN

SEQ ID NO: 3359267 - protein, 22 aa, Plasmodium falciparum
IILCPPCNVGNIKKNNIQYKNK

SEQ ID NO: 3359268 - protein, 19 aa, Plasmodium falciparum
IILDCSGGQTILDPAGTEN

SEQ ID NO: 3359269 - protein, 17 aa, Plasmodium falciparum
IILDILSSVLIQKIKQC

SEQ ID NO: 3359270 - protein, 19 aa, Plasmodium falciparum
IILDKLIYEKRFLKNKNKQ

SEQ ID NO: 3359271 - protein, 25 aa, Plasmodium falciparum
IILICTDLYKPYNIMSDINSWIDTL

SEQ ID NO: 3359272 - protein, 21 aa, Plasmodium falciparum
IILILLDYCNLHLDYWSCIYI

SEQ ID NO: 3359273 - protein, 17 aa, Plasmodium falciparum
IILKELEVEISIPGGIY

SEQ ID NO: 3359274 - protein, 17 aa, Plasmodium falciparum
IILKFISEENFRRYEKY

SEQ ID NO: 3359275 - protein, 17 aa, Plasmodium falciparum
IILKKSKSENMFLKNKN

SEQ ID NO: 3359276 - protein, 17 aa, Plasmodium falciparum
IILKNFLIRINDINHNV

SEQ ID NO: 3359277 - protein, 20 aa, Plasmodium falciparum
IILKSDFVKLFNCLILFLKE

SEQ ID NO: 3359278 - protein, 40 aa, Plasmodium falciparum
IILLKNIRPFPTIYWLINKNICGYISHLEKINIIKNIENF

SEQ ID NO: 3359279 - protein, 22 aa, Plasmodium falciparum
IILLKRIVILITAISKLKKKAI

SEQ ID NO: 3359280 - protein, 24 aa, Plasmodium falciparum
IILLLFRIFFNYIITLNENNDKEL

SEQ ID NO: 3359281 - protein, 17 aa, Plasmodium falciparum
IILPNIKNKYRISMNTP

SEQ ID NO: 3359282 - protein, 17 aa, Plasmodium falciparum
IILPYNLVHKVLIKTKK

SEQ ID NO: 3359283 - protein, 27 aa, Plasmodium falciparum
IILRNFDLRPGFIIQELKLTEPVFSKT

SEQ ID NO: 3359284 - protein, 29 aa, Plasmodium falciparum
IILRNIDKALFLFKFLNTMVNDNETVIVF

SEQ ID NO: 3359285 - protein, 18 aa, Plasmodium falciparum
IILSCANSAYSDVYLNYY

SEQ ID NO: 3359286 - protein, 18 aa, Plasmodium falciparum
IILTMIWNINNISLLTGS

SEQ ID NO: 3359287 - protein, 23 aa, Plasmodium falciparum
IIMDDVSGVILFYEDVINEMKGS

SEQ ID NO: 3359288 - protein, 19 aa, Plasmodium falciparum
IINALKKSHISTSYLFNNL

SEQ ID NO: 3359289 - protein, 18 aa, Plasmodium falciparum
IINCKECNIFFFCSIEYL

SEQ ID NO: 3359290 - protein, 24 aa, Plasmodium falciparum
IINDKHCFELYGFDILIDNNLKPW

SEQ ID NO: 3359291 - protein, 17 aa, Plasmodium falciparum
IINDLLQMVHVWKKLLI

SEQ ID NO: 3359292 - protein, 36 aa, Plasmodium falciparum
IINDREQCMALLREKICINNQIAYMIKHDYEKLKKQ

SEQ ID NO: 3359293 - protein, 24 aa, Plasmodium falciparum
IINELKIILTYYIWEDDKIFNNFT

SEQ ID NO: 3359294 - protein, 19 aa, Plasmodium falciparum
IINGKPLYVGLAEKREQRL

SEQ ID NO: 3359295 - protein, 26 aa, Plasmodium falciparum
IINHFKKFCIPNFLKSVGKDILNFLH

SEQ ID NO: 3359296 - protein, 22 aa, Plasmodium falciparum
IINIKLLSVYNILGLIRNINGK

SEQ ID NO: 3359297 - protein, 17 aa, Plasmodium falciparum
IINKIKKLYKCYRSMEE

SEQ ID NO: 3359298 - protein, 18 aa, Plasmodium falciparum
IINKWKKVDSNILINIVQ

SEQ ID NO: 3359299 - protein, 19 aa, Plasmodium falciparum
IINLKYDISNNMNEKMKHI

SEQ ID NO: 3359300 - protein, 18 aa, Plasmodium falciparum
IINLLTVHNIFFITGKLE

SEQ ID NO: 3359301 - protein, 22 aa, Plasmodium falciparum
IINMKPLIYYGKEKILHKGKFK

SEQ ID NO: 3359302 - protein, 22 aa, Plasmodium falciparum
IINMSEKLLILSNKYDILVKES

SEQ ID NO: 3359303 - protein, 24 aa, Plasmodium falciparum
IINNFFFKKWIYKIPYDKSELIFS

SEQ ID NO: 3359304 - protein, 18 aa, Plasmodium falciparum
IINNINLFKNFMKNEKAQ

SEQ ID NO: 3359305 - protein, 22 aa, Plasmodium falciparum
IINNRLDICLSVNADGVHLGKS

SEQ ID NO: 3359306 - protein, 17 aa, Plasmodium falciparum
IINPQNVKAIYWKNMSY

SEQ ID NO: 3359307 - protein, 22 aa, Plasmodium falciparum
IINSLHELWVLGAINNEGNLTD

SEQ ID NO: 3359308 - protein, 26 aa, Plasmodium falciparum
IINSRFVVVCACGHSLMIAQKMNYGL

SEQ ID NO: 3359309 - protein, 23 aa, Plasmodium falciparum
IINVCLWGISPFTYGKIEKDFAL

SEQ ID NO: 3359310 - protein, 26 aa, Plasmodium falciparum
IINVLKREGLRKISTHNGKFESFSNM

SEQ ID NO: 3359311 - protein, 26 aa, Plasmodium falciparum
IINYIKLILRYIYKVLKLAFQKLKSD

SEQ ID NO: 3359312 - protein, 18 aa, Plasmodium falciparum
IIPKITWTDKIYQVDCLI

SEQ ID NO: 3359313 - protein, 18 aa, Plasmodium falciparum
IIPSFGIKKNTNILKIRI

SEQ ID NO: 3359314 - protein, 17 aa, Plasmodium falciparum
IIPSFQVDDEFYPTSLL

SEQ ID NO: 3359315 - protein, 25 aa, Plasmodium falciparum
IIQEDLRWGWCICIEGQLIEHKKAN

SEQ ID NO: 3359316 - protein, 18 aa, Plasmodium falciparum
IIQGFSWATKEGPLIEES

SEQ ID NO: 3359317 - protein, 18 aa, Plasmodium falciparum
IIQIILSRYKHIFMKKSY

SEQ ID NO: 3359318 - protein, 21 aa, Plasmodium falciparum
IIQILICTSTLAWGINLPAYL

SEQ ID NO: 3359319 - protein, 19 aa, Plasmodium falciparum
IIQILPFLKLLIIQKYSIL

SEQ ID NO: 3359320 - protein, 21 aa, Plasmodium falciparum
IIQKIPGFWANTLRKHPALSD

SEQ ID NO: 3359321 - protein, 26 aa, Plasmodium falciparum
IIQKRKKMNVLRKNLYEYMPFQKNEK

SEQ ID NO: 3359322 - protein, 17 aa, Plasmodium falciparum
IIQLICSIIPLRNTLLL

SEQ ID NO: 3359323 - protein, 25 aa, Plasmodium falciparum
IIQNDRIQPIIVRQPQTVIIHSQPK

SEQ ID NO: 3359324 - protein, 28 aa, Plasmodium falciparum
IIQRKYNCLNSFPCLHAPSKIKDSTMNM

SEQ ID NO: 3359325 - protein, 24 aa, Plasmodium falciparum
IIREAKIFLSFEFELPEEIKNMIS

SEQ ID NO: 3359326 - protein, 17 aa, Plasmodium falciparum
IIREVLRKFKIKKEKYL

SEQ ID NO: 3359327 - protein, 18 aa, Plasmodium falciparum
IIRFKKNKLETFNYIKNI

SEQ ID NO: 3359328 - protein, 17 aa, Plasmodium falciparum
IIRISYVLYAFYYFLNE

SEQ ID NO: 3359329 - protein, 18 aa, Plasmodium falciparum
IIRKCSRNYISTRNNIYI

SEQ ID NO: 3359330 - protein, 18 aa, Plasmodium falciparum
IIRKEADNLFGKKKINDY

SEQ ID NO: 3359331 - protein, 21 aa, Plasmodium falciparum
IIRKNRVTKVFLMNNKMCNNH

SEQ ID NO: 3359332 - protein, 24 aa, Plasmodium falciparum
IIRLKGEINKISLLYSNELNEKNS

SEQ ID NO: 3359333 - protein, 22 aa, Plasmodium falciparum
IIRNCLMSSLPSFTLNDEITNL

SEQ ID NO: 3359334 - protein, 24 aa, Plasmodium falciparum
IIRPDLKTMFVYKPFENYEFVETE

SEQ ID NO: 3359335 - protein, 19 aa, Plasmodium falciparum
IIRSLKLGKSFITKDEITQ

SEQ ID NO: 3359336 - protein, 19 aa, Plasmodium falciparum
IIRVKRRIDDTSIPSIYVK

SEQ ID NO: 3359337 - protein, 26 aa, Plasmodium falciparum
IIRWNLPRPYFLDKINLFNNYMHNEY

SEQ ID NO: 3359338 - protein, 19 aa, Plasmodium falciparum
IIRYIDNVLFEYNLPPVKL

SEQ ID NO: 3359339 - protein, 25 aa, Plasmodium falciparum
IIRYIKLKADWWVNATYYNRERIKR

SEQ ID NO: 3359340 - protein, 31 aa, Plasmodium falciparum
IISDIDIFCSFGFICCSSISTYVRPEIEENG

SEQ ID NO: 3359341 - protein, 17 aa, Plasmodium falciparum
IISIIVLPFNYLGLSAL

SEQ ID NO: 3359342 - protein, 24 aa, Plasmodium falciparum
IISKCFPKNEWFVCIKDGQEVCKV

SEQ ID NO: 3359343 - protein, 26 aa, Plasmodium falciparum
IISKCNVCLCEITESAAYEYIEYENS

SEQ ID NO: 3359344 - protein, 21 aa, Plasmodium falciparum
IISKFKLSMDIKRGSKEIKNL

SEQ ID NO: 3359345 - protein, 18 aa, Plasmodium falciparum
IISKHPYISPLINNNTNI

SEQ ID NO: 3359346 - protein, 24 aa, Plasmodium falciparum
IISLKGYVYEGTYSFLKNCKQGLG

SEQ ID NO: 3359347 - protein, 19 aa, Plasmodium falciparum
IISNCLFKLNTFCKNSDKL

SEQ ID NO: 3359348 - protein, 19 aa, Plasmodium falciparum
IISNIDFDNNIFKSYIKEN

SEQ ID NO: 3359349 - protein, 19 aa, Plasmodium falciparum
IISSCDIYHHFVVKKYTHN

SEQ ID NO: 3359350 - protein, 26 aa, Plasmodium falciparum
IISSEVVCLKSKIQSYDTQSIPINNK

SEQ ID NO: 3359351 - protein, 26 aa, Plasmodium falciparum
IISSIKLLIEKRVRPIILNDGGDIKF

SEQ ID NO: 3359352 - protein, 23 aa, Plasmodium falciparum
IISVCFYHPIRGIKIAEYEILSN

SEQ ID NO: 3359353 - protein, 18 aa, Plasmodium falciparum
IISVKSFSNDNVNNMCNV

SEQ ID NO: 3359354 - protein, 20 aa, Plasmodium falciparum
IITCNSYGRTGCVSIIQSGL

SEQ ID NO: 3359355 - protein, 23 aa, Plasmodium falciparum
IITECRLYILSRITYFIHLYTFD

SEQ ID NO: 3359356 - protein, 22 aa, Plasmodium falciparum
IITEKMCQIMESRLNTDEIQTV

SEQ ID NO: 3359357 - protein, 20 aa, Plasmodium falciparum
IITILSIKYSLNLPSDLSQK

SEQ ID NO: 3359358 - protein, 18 aa, Plasmodium falciparum
IITLVAFLHFLNKKVDYA

SEQ ID NO: 3359359 - protein, 24 aa, Plasmodium falciparum
IITNIYRDICKNINDQSYNISSNI

SEQ ID NO: 3359360 - protein, 30 aa, Plasmodium falciparum
IITSILNIMKWKSLFFTFSNITIYKNEENI

SEQ ID NO: 3359361 - protein, 18 aa, Plasmodium falciparum
IIVKSLESCENYLEDNYN

SEQ ID NO: 3359362 - protein, 22 aa, Plasmodium falciparum
IIVLPLFKLIYVPLYDPLKQNE

SEQ ID NO: 3359363 - protein, 20 aa, Plasmodium falciparum
IIVSCGWDKLVKVWNLKNCD

SEQ ID NO: 3359364 - protein, 26 aa, Plasmodium falciparum
IIYCLRYDNFVRIRFHIISMERNKIN

SEQ ID NO: 3359365 - protein, 32 aa, Plasmodium falciparum
IIYGPLCKYIKCIKPQYDYILEYFLKKYFNSF

SEQ ID NO: 3359366 - protein, 23 aa, Plasmodium falciparum
IIYHNIKFVIYNIVTSKGCTKNM

SEQ ID NO: 3359367 - protein, 18 aa, Plasmodium falciparum
IIYILSIKNQIVFYEEVG

SEQ ID NO: 3359368 - protein, 32 aa, Plasmodium falciparum
IIYIYNTTLEWFLKCIALIQHNIRKWLVKRKI

SEQ ID NO: 3359369 - protein, 30 aa, Plasmodium falciparum
IIYKENITFLTYFYSCINIIKENKIIIPKG

SEQ ID NO: 3359370 - protein, 17 aa, Plasmodium falciparum
IIYKHYILRDLIRILRV

SEQ ID NO: 3359371 - protein, 23 aa, Plasmodium falciparum
IIYLHIYKKLYLVDSDYTLNDKT

SEQ ID NO: 3359372 - protein, 19 aa, Plasmodium falciparum
IIYNHFKSAISFDTQILSV

SEQ ID NO: 3359373 - protein, 21 aa, Plasmodium falciparum
IIYQKNILSNFIAQIPSRIQV

SEQ ID NO: 3359374 - protein, 19 aa, Plasmodium falciparum
IIYSLKFGQLSLDRPFYDE

SEQ ID NO: 3359375 - protein, 37 aa, Plasmodium falciparum
IIYSLSYLHCVLCERKKFGPLGWCVPYEFSITDLFAS

SEQ ID NO: 3359376 - protein, 18 aa, Plasmodium falciparum
IIYTHLFLPTRLREKINK

SEQ ID NO: 3359377 - protein, 24 aa, Plasmodium falciparum
IIYVIELPLSVSQKYLHKKLSIKV

SEQ ID NO: 3359378 - protein, 33 aa, Plasmodium falciparum
IKAEKYFSLLARRLRIVMYTKLIADGKIVNEDT

SEQ ID NO: 3359379 - protein, 17 aa, Plasmodium falciparum
IKAGISVIKTDHCGSKT

SEQ ID NO: 3359380 - protein, 17 aa, Plasmodium falciparum
IKALDNMMSQHYANNNI

SEQ ID NO: 3359381 - protein, 26 aa, Plasmodium falciparum
IKALQILNIPIDFFHLGINSHKYIHK

SEQ ID NO: 3359382 - protein, 21 aa, Plasmodium falciparum
IKAMPISLLFSNRIYENIPNN

SEQ ID NO: 3359383 - protein, 26 aa, Plasmodium falciparum
IKAMQLNLWYKCFDILSTENEYIKSA

SEQ ID NO: 3359384 - protein, 18 aa, Plasmodium falciparum
IKARDYFSICSVHEDCYS

SEQ ID NO: 3359385 - protein, 21 aa, Plasmodium falciparum
IKASYQNYCEFLEKVNTINLL

SEQ ID NO: 3359386 - protein, 20 aa, Plasmodium falciparum
IKATFKDGVLKIDIPKKDIP

SEQ ID NO: 3359387 - protein, 19 aa, Plasmodium falciparum
IKCFCLFATHFHEMSNLED

SEQ ID NO: 3359388 - protein, 30 aa, Plasmodium falciparum
IKCINNSICFLKRFMPTNLYYFTKYNEENE

SEQ ID NO: 3359389 - protein, 27 aa, Plasmodium falciparum
IKCKPSYEYIIPILIVLKAIGTPILQA

SEQ ID NO: 3359390 - protein, 28 aa, Plasmodium falciparum
IKCNVPDCYKYYHISCATSSPKYLIELN

SEQ ID NO: 3359391 - protein, 18 aa, Plasmodium falciparum
IKCRCIFSTHYHLLVEEV

SEQ ID NO: 3359392 - protein, 23 aa, Plasmodium falciparum
IKCRCNHYFCSLHRYADAHNCTF

SEQ ID NO: 3359393 - protein, 18 aa, Plasmodium falciparum
IKCRGLKIQSIKELFHSE

SEQ ID NO: 3359394 - protein, 26 aa, Plasmodium falciparum
IKCRKILKWSYTYAYFSNWKSDNQKH

SEQ ID NO: 3359395 - protein, 19 aa, Plasmodium falciparum
IKCRKRFATGHFQGDSYTI

SEQ ID NO: 3359396 - protein, 22 aa, Plasmodium falciparum
IKCSPQLIIKCVNETYKSKSFN

SEQ ID NO: 3359397 - protein, 19 aa, Plasmodium falciparum
IKCSRRLYHKHMINKEKII

SEQ ID NO: 3359398 - protein, 17 aa, Plasmodium falciparum
IKDALLYKCKQINEQNY

SEQ ID NO: 3359399 - protein, 19 aa, Plasmodium falciparum
IKDDGALLIKQLVYIQKIP

SEQ ID NO: 3359400 - protein, 20 aa, Plasmodium falciparum
IKDELFVKENLEFLKNNSYF

SEQ ID NO: 3359401 - protein, 24 aa, Plasmodium falciparum
IKDFSKLLLIRVLRKDRFLIALKN

SEQ ID NO: 3359402 - protein, 17 aa, Plasmodium falciparum
IKDGIMYDGNDLDMNGT

SEQ ID NO: 3359403 - protein, 25 aa, Plasmodium falciparum
IKDGSSLFLQFSFPSFLDELFIQKS

SEQ ID NO: 3359404 - protein, 21 aa, Plasmodium falciparum
IKDGYKYLFFFQDTNALALKV

SEQ ID NO: 3359405 - protein, 23 aa, Plasmodium falciparum
IKDHIFCSYGYKINIPNNIHSTY

SEQ ID NO: 3359406 - protein, 18 aa, Plasmodium falciparum
IKDILKCSNDFLCTPYVS

SEQ ID NO: 3359407 - protein, 24 aa, Plasmodium falciparum
IKDIRKKKEKVLIFSQFTTFLDII

SEQ ID NO: 3359408 - protein, 21 aa, Plasmodium falciparum
IKDIYDILLCYNNMRNLNKED

SEQ ID NO: 3359409 - protein, 18 aa, Plasmodium falciparum
IKDKIVNVILRPDLFTGL

SEQ ID NO: 3359410 - protein, 22 aa, Plasmodium falciparum
IKDKLDMRAEILMKELEEEEAQ

SEQ ID NO: 3359411 - protein, 24 aa, Plasmodium falciparum
IKDKLEKVAFVLRKLLARKLQLGY

SEQ ID NO: 3359412 - protein, 26 aa, Plasmodium falciparum
IKDKLYEGNDFFSLVSSIAKESCLIF

SEQ ID NO: 3359413 - protein, 24 aa, Plasmodium falciparum
IKDKSALYDIDWFFLVIDEAHRIK

SEQ ID NO: 3359414 - protein, 29 aa, Plasmodium falciparum
IKDLKLKKKLRHLLRSWKLEKKDEYYKKP

SEQ ID NO: 3359415 - protein, 26 aa, Plasmodium falciparum
IKDLKSFYVLINFCMHSSDIIKSKNE

SEQ ID NO: 3359416 - protein, 22 aa, Plasmodium falciparum
IKDLKVDILLDRQRGTRLEGKF

SEQ ID NO: 3359417 - protein, 25 aa, Plasmodium falciparum
IKDLLEQFGDLKAFNIIKDLNTGLN

SEQ ID NO: 3359418 - protein, 39 aa, Plasmodium falciparum
IKDLRRCINEFYNFQWDIKIILNMHAWIVTYYTNLYIYE

SEQ ID NO: 3359419 - protein, 20 aa, Plasmodium falciparum
IKDMIPMSFINFIIHYNSLY

SEQ ID NO: 3359420 - protein, 23 aa, Plasmodium falciparum
IKDRKGCRYEEKGLFKGGNKDLI

SEQ ID NO: 3359421 - protein, 25 aa, Plasmodium falciparum
IKDRSWKSAQKMMINPEKFISLLKD

SEQ ID NO: 3359422 - protein, 17 aa, Plasmodium falciparum
IKDRWPSKNTHIYYNTY

SEQ ID NO: 3359423 - protein, 17 aa, Plasmodium falciparum
IKDSEKIGGKIEVDNKM

SEQ ID NO: 3359424 - protein, 25 aa, Plasmodium falciparum
IKDSKRIKCSWLCQRKYLKNVKDLL

SEQ ID NO: 3359425 - protein, 25 aa, Plasmodium falciparum
IKDVVKFNQSYYCYFKNVQKNDVYP

SEQ ID NO: 3359426 - protein, 22 aa, Plasmodium falciparum
IKDYYNKRVNVHYNDRYKYPVT

SEQ ID NO: 3359427 - protein, 28 aa, Plasmodium falciparum
IKEAEMNGKICLRKEYLEKLKEDIKSET

SEQ ID NO: 3359428 - protein, 19 aa, Plasmodium falciparum
IKECFKILNEMKVKKIHPT

SEQ ID NO: 3359429 - protein, 20 aa, Plasmodium falciparum
IKEDVKWLGYDWKEHLYFAS

SEQ ID NO: 3359430 - protein, 19 aa, Plasmodium falciparum
IKEELRVMLSKAVDKEIME

SEQ ID NO: 3359431 - protein, 17 aa, Plasmodium falciparum
IKEEVKIVVDNNNNNIY

SEQ ID NO: 3359432 - protein, 24 aa, Plasmodium falciparum
IKEIDFLSCKSVILPEQHLNAKDN

SEQ ID NO: 3359433 - protein, 17 aa, Plasmodium falciparum
IKEIKFNNDAFLYLNNM

SEQ ID NO: 3359434 - protein, 20 aa, Plasmodium falciparum
IKEIKYNKTYMENIKTNNKK

SEQ ID NO: 3359435 - protein, 20 aa, Plasmodium falciparum
IKEISKWVRTHFRIYRDVEQ

SEQ ID NO: 3359436 - protein, 26 aa, Plasmodium falciparum
IKEITKAYRILALKYHPDKFLTNFKK

SEQ ID NO: 3359437 - protein, 30 aa, Plasmodium falciparum
IKEKAKSYMLSLLNKKICNHLYEENKIKQS

SEQ ID NO: 3359438 - protein, 28 aa, Plasmodium falciparum
IKEKCEGFSCITAINILYSFANLNYEQL

SEQ ID NO: 3359439 - protein, 23 aa, Plasmodium falciparum
IKEKEIIESLSILYYNNNNNNNN

SEQ ID NO: 3359440 - protein, 24 aa, Plasmodium falciparum
IKEKEKYTLGGRERGSRRSKESDS

SEQ ID NO: 3359441 - protein, 18 aa, Plasmodium falciparum
IKEKFFFSYDNYNIGKND

SEQ ID NO: 3359442 - protein, 19 aa, Plasmodium falciparum
IKEKIHIHKIALYQKRKMD

SEQ ID NO: 3359443 - protein, 23 aa, Plasmodium falciparum
IKEKKNALIERCVQSYDNDEISD

SEQ ID NO: 3359444 - protein, 20 aa, Plasmodium falciparum
IKEKKSNLIQKKKINKQDNY

SEQ ID NO: 3359445 - protein, 18 aa, Plasmodium falciparum
IKEKPYLKIQDVIKPIPC

SEQ ID NO: 3359446 - protein, 20 aa, Plasmodium falciparum
IKELGWKKPTEIQREILPHA

SEQ ID NO: 3359447 - protein, 17 aa, Plasmodium falciparum
IKELNIILLQNKDEIDN

SEQ ID NO: 3359448 - protein, 18 aa, Plasmodium falciparum
IKELNMFYNYFYNAYPFF

SEQ ID NO: 3359449 - protein, 21 aa, Plasmodium falciparum
IKELSNFQWKPLGKNVPKISL

SEQ ID NO: 3359450 - protein, 19 aa, Plasmodium falciparum
IKENLTISNFFKYYNINLY

SEQ ID NO: 3359451 - protein, 22 aa, Plasmodium falciparum
IKENRGISNYAHITKNNGNNNN

SEQ ID NO: 3359452 - protein, 18 aa, Plasmodium falciparum
IKENVEYDIYHKFINNYF

SEQ ID NO: 3359453 - protein, 22 aa, Plasmodium falciparum
IKERLCITPLTDRCYLTCAQAL

SEQ ID NO: 3359454 - protein, 27 aa, Plasmodium falciparum
IKESHFYRMKNYFQYICMNDEKSTMQD

SEQ ID NO: 3359455 - protein, 17 aa, Plasmodium falciparum
IKESIIINENIIKTNTN

SEQ ID NO: 3359456 - protein, 17 aa, Plasmodium falciparum
IKETICFCSLNPSEDQL

SEQ ID NO: 3359457 - protein, 20 aa, Plasmodium falciparum
IKETIFSKHVKFFLKESGLK

SEQ ID NO: 3359458 - protein, 18 aa, Plasmodium falciparum
IKETLKYNYTYCSNGNKY

SEQ ID NO: 3359459 - protein, 17 aa, Plasmodium falciparum
IKFASEIQKLWKEKKKD

SEQ ID NO: 3359460 - protein, 21 aa, Plasmodium falciparum
IKFLKKKKINFLMSLKRAVLS

SEQ ID NO: 3359461 - protein, 28 aa, Plasmodium falciparum
IKFLPFPLVFCIGGFDGVEYLNSMELLD

SEQ ID NO: 3359462 - protein, 17 aa, Plasmodium falciparum
IKFLYGLNCNFDCASIG

SEQ ID NO: 3359463 - protein, 25 aa, Plasmodium falciparum
IKFNEEFKKAISWIYKTISNSRDKD

SEQ ID NO: 3359464 - protein, 20 aa, Plasmodium falciparum
IKFNNDAFLYLNNMCKNAKE

SEQ ID NO: 3359465 - protein, 21 aa, Plasmodium falciparum
IKFNYLEKQDYILGSSTNIDD

SEQ ID NO: 3359466 - protein, 20 aa, Plasmodium falciparum
IKGDALVTYVYTQSVDMAIK

SEQ ID NO: 3359467 - protein, 21 aa, Plasmodium falciparum
IKGEMLKVYEFIRNEEKLSNY

SEQ ID NO: 3359468 - protein, 17 aa, Plasmodium falciparum
IKGGQLFDSVDNNMYNN

SEQ ID NO: 3359469 - protein, 21 aa, Plasmodium falciparum
IKGIPNFPLNIEFIKQNGRYK

SEQ ID NO: 3359470 - protein, 18 aa, Plasmodium falciparum
IKGISCEKNIYSIHNKIR

SEQ ID NO: 3359471 - protein, 26 aa, Plasmodium falciparum
IKGKIKLYLKNAIVYNHLLKKIQSEE

SEQ ID NO: 3359472 - protein, 17 aa, Plasmodium falciparum
IKGKKRHSTICIILNDN

SEQ ID NO: 3359473 - protein, 20 aa, Plasmodium falciparum
IKGKNGCLVTRYDKNKLLFY

SEQ ID NO: 3359474 - protein, 35 aa, Plasmodium falciparum
IKGLLINMIHKFWPSLLKHKGFLSEFVTPIVKVQK

SEQ ID NO: 3359475 - protein, 23 aa, Plasmodium falciparum
IKGNCLLQYDLLIVLTKLSIIFL

SEQ ID NO: 3359476 - protein, 19 aa, Plasmodium falciparum
IKGNFKNLSLIVLGQIENV

SEQ ID NO: 3359477 - protein, 20 aa, Plasmodium falciparum
IKGNIPFRNRNFLNFFTSED

SEQ ID NO: 3359478 - protein, 24 aa, Plasmodium falciparum
IKGNYNFGIDIEMVYVNEQNKIVV

SEQ ID NO: 3359479 - protein, 18 aa, Plasmodium falciparum
IKGRLIVDIYLLCKDSIK

SEQ ID NO: 3359480 - protein, 22 aa, Plasmodium falciparum
IKHDLQLCGSKTMSNFYKEGNT

SEQ ID NO: 3359481 - protein, 17 aa, Plasmodium falciparum
IKHEIDLKMLDNIIEIK

SEQ ID NO: 3359482 - protein, 19 aa, Plasmodium falciparum
IKHFNMFQLLLIIKGLYES

SEQ ID NO: 3359483 - protein, 18 aa, Plasmodium falciparum
IKHIHLIKNIIHFNQQFI

SEQ ID NO: 3359484 - protein, 24 aa, Plasmodium falciparum
IKHIVRIKSNLALHGGLYSNYFEK

SEQ ID NO: 3359485 - protein, 22 aa, Plasmodium falciparum
IKHLRYPKRYVFHLERKTKGNE

SEQ ID NO: 3359486 - protein, 23 aa, Plasmodium falciparum
IKHLYEQFICLCTNEKGNILCID

SEQ ID NO: 3359487 - protein, 18 aa, Plasmodium falciparum
IKHRAWLLHFQQKRNNYK

SEQ ID NO: 3359488 - protein, 17 aa, Plasmodium falciparum
IKHSIDIKKLIKANFYK

SEQ ID NO: 3359489 - protein, 21 aa, Plasmodium falciparum
IKHVCKAYDIYLAKNEEGKLN

SEQ ID NO: 3359490 - protein, 17 aa, Plasmodium falciparum
IKHVINFDLPSNIDDYI

SEQ ID NO: 3359491 - protein, 24 aa, Plasmodium falciparum
IKIAQLKLLYYAFRKLSNNLCYNY

SEQ ID NO: 3359492 - protein, 20 aa, Plasmodium falciparum
IKIDINASIISKCFPKNEWF

SEQ ID NO: 3359493 - protein, 21 aa, Plasmodium falciparum
IKIEGRETVQIPIKCQTTNAT

SEQ ID NO: 3359494 - protein, 25 aa, Plasmodium falciparum
IKIEIKDTFELLNYPCVYQNSKKKF

SEQ ID NO: 3359495 - protein, 27 aa, Plasmodium falciparum
IKIELFCYEVPKTCKNFLALCASGYYD

SEQ ID NO: 3359496 - protein, 18 aa, Plasmodium falciparum
IKIFAISKYHFFVNIYMA

SEQ ID NO: 3359497 - protein, 26 aa, Plasmodium falciparum
IKIFEEMLHIFLLVGFEDTGDFYVIK

SEQ ID NO: 3359498 - protein, 18 aa, Plasmodium falciparum
IKIFKSLVKKGANIFMKT

SEQ ID NO: 3359499 - protein, 19 aa, Plasmodium falciparum
IKIGEEINNELNFQLLEKK

SEQ ID NO: 3359500 - protein, 18 aa, Plasmodium falciparum
IKIHNGGISFLFLHKRGK

SEQ ID NO: 3359501 - protein, 19 aa, Plasmodium falciparum
IKIIEEVKNLCFIYPNKCN

SEQ ID NO: 3359502 - protein, 21 aa, Plasmodium falciparum
IKIIKFNLIYIYKHPLTQNKV

SEQ ID NO: 3359503 - protein, 28 aa, Plasmodium falciparum
IKIINEIVELGYYFYIINIFFLLVKKNT

SEQ ID NO: 3359504 - protein, 24 aa, Plasmodium falciparum
IKIKAQRIIQRILFRLDILDKLFI

SEQ ID NO: 3359505 - protein, 17 aa, Plasmodium falciparum
IKIKKKFDELFGDDHFS

SEQ ID NO: 3359506 - protein, 22 aa, Plasmodium falciparum
IKIKKNYINLLFLINKKYGSTF

SEQ ID NO: 3359507 - protein, 36 aa, Plasmodium falciparum
IKIKNIYKYDFFLNKTFKYIYIKYVENVHAKLYMEQ

SEQ ID NO: 3359508 - protein, 17 aa, Plasmodium falciparum
IKIKRMKKYNMNHMDDS

SEQ ID NO: 3359509 - protein, 18 aa, Plasmodium falciparum
IKIKTNMKKLCNLKKKIK

SEQ ID NO: 3359510 - protein, 18 aa, Plasmodium falciparum
IKILECRALTNNVINNYN

SEQ ID NO: 3359511 - protein, 17 aa, Plasmodium falciparum
IKILKYKIFNLEKLLKI

SEQ ID NO: 3359512 - protein, 17 aa, Plasmodium falciparum
IKINCYIYDQEKNINLN

SEQ ID NO: 3359513 - protein, 18 aa, Plasmodium falciparum
IKINEIFNINKYKQIYII

SEQ ID NO: 3359514 - protein, 19 aa, Plasmodium falciparum
IKIPIKMTFDNYDKEKKNI

SEQ ID NO: 3359515 - protein, 21 aa, Plasmodium falciparum
IKIQLCQDPKVLFAAYRQPHP

SEQ ID NO: 3359516 - protein, 23 aa, Plasmodium falciparum
IKIRCYKCKEITNIKNYEKHIIN

SEQ ID NO: 3359517 - protein, 19 aa, Plasmodium falciparum
IKIREKCSVHTKEYIKYVC

SEQ ID NO: 3359518 - protein, 25 aa, Plasmodium falciparum
IKIRQCDEVIRINLFTTKLTKKVHI

SEQ ID NO: 3359519 - protein, 20 aa, Plasmodium falciparum
IKISALIILESYYKDVAEKL

SEQ ID NO: 3359520 - protein, 20 aa, Plasmodium falciparum
IKISNILIYLNIISTDIMFI

SEQ ID NO: 3359521 - protein, 21 aa, Plasmodium falciparum
IKISSKMLIKIVTSYSNVKIK

SEQ ID NO: 3359522 - protein, 26 aa, Plasmodium falciparum
IKITDGSFVREIKLINLLLNGNVPDE

SEQ ID NO: 3359523 - protein, 22 aa, Plasmodium falciparum
IKITNFCRSLCISNLNLSIGID

SEQ ID NO: 3359524 - protein, 24 aa, Plasmodium falciparum
IKIWDLASCKLKLTLTGHINSIRD

SEQ ID NO: 3359525 - protein, 24 aa, Plasmodium falciparum
IKIWEVSTGFLLKVFSDSSATLSV

SEQ ID NO: 3359526 - protein, 18 aa, Plasmodium falciparum
IKIWRFNDSKCWELDTLR

SEQ ID NO: 3359527 - protein, 23 aa, Plasmodium falciparum
IKKAKARWIYSCLDEMLISNRKS

SEQ ID NO: 3359528 - protein, 18 aa, Plasmodium falciparum
IKKDELIIKQVKKLNKNC

SEQ ID NO: 3359529 - protein, 21 aa, Plasmodium falciparum
IKKDIIYYFLFYKNSYEYNIY

SEQ ID NO: 3359530 - protein, 29 aa, Plasmodium falciparum
IKKDILIKIFLRRASSFLCLQEFNKCNED

SEQ ID NO: 3359531 - protein, 20 aa, Plasmodium falciparum
IKKDISIACIEQELCLENVT

SEQ ID NO: 3359532 - protein, 23 aa, Plasmodium falciparum
IKKDKAKECMYRCNISCGRTFHK

SEQ ID NO: 3359533 - protein, 18 aa, Plasmodium falciparum
IKKDSRIANDIHYNNLFL

SEQ ID NO: 3359534 - protein, 22 aa, Plasmodium falciparum
IKKEEIEKVFSFSQNYFFNYYL

SEQ ID NO: 3359535 - protein, 18 aa, Plasmodium falciparum
IKKEFKYLVPGERVKFSV

SEQ ID NO: 3359536 - protein, 22 aa, Plasmodium falciparum
IKKEHKNNILLEHDKEIRHIKL

SEQ ID NO: 3359537 - protein, 31 aa, Plasmodium falciparum
IKKEKLRKIVLDLKIGPTIFKDLNKEDDEDY

SEQ ID NO: 3359538 - protein, 17 aa, Plasmodium falciparum
IKKEMIKLKETYNKDIY

SEQ ID NO: 3359539 - protein, 35 aa, Plasmodium falciparum
IKKESLDIECFLFKIKYYFYKSVLFLYQEGIKSYL

SEQ ID NO: 3359540 - protein, 19 aa, Plasmodium falciparum
IKKEYGVKLNYVYYPYNKC

SEQ ID NO: 3359541 - protein, 21 aa, Plasmodium falciparum
IKKFERLGSLHLQEYNTTLED

SEQ ID NO: 3359542 - protein, 18 aa, Plasmodium falciparum
IKKGALLMMTGGVQKITS

SEQ ID NO: 3359543 - protein, 17 aa, Plasmodium falciparum
IKKGVIIEEDFEKYFTY

SEQ ID NO: 3359544 - protein, 25 aa, Plasmodium falciparum
IKKHELFKKKLNDIYNFLKKKSNYN

SEQ ID NO: 3359545 - protein, 21 aa, Plasmodium falciparum
IKKIKDARHNNAHELFENKYV

SEQ ID NO: 3359546 - protein, 19 aa, Plasmodium falciparum
IKKINNFICTNTVINNTCF

SEQ ID NO: 3359547 - protein, 26 aa, Plasmodium falciparum
IKKIYKRRYQMIFNKKLFYLFQKCEE

SEQ ID NO: 3359548 - protein, 25 aa, Plasmodium falciparum
IKKKAFKEAAFFVARTIPSRIEYNT

SEQ ID NO: 3359549 - protein, 22 aa, Plasmodium falciparum
IKKKEVVDSLYLDMNFLCKYVQ

SEQ ID NO: 3359550 - protein, 29 aa, Plasmodium falciparum
IKKKIAPGMLFNFKIEFYPKSHANYEYDL

SEQ ID NO: 3359551 - protein, 18 aa, Plasmodium falciparum
IKKKIILKEHVLEEQDNS

SEQ ID NO: 3359552 - protein, 17 aa, Plasmodium falciparum
IKKKIKRRHIYRKRRRR

SEQ ID NO: 3359553 - protein, 22 aa, Plasmodium falciparum
IKKKKFIRFTLIKSQKNIKYLY

SEQ ID NO: 3359554 - protein, 24 aa, Plasmodium falciparum
IKKKKGRKPKVSLIQEERNVNLKN

SEQ ID NO: 3359555 - protein, 18 aa, Plasmodium falciparum
IKKKKLKYSARWINELSR

SEQ ID NO: 3359556 - protein, 19 aa, Plasmodium falciparum
IKKKKYESFFDDINNDVDI

SEQ ID NO: 3359557 - protein, 22 aa, Plasmodium falciparum
IKKKLKTQEEIISQKDRQIETL

SEQ ID NO: 3359558 - protein, 21 aa, Plasmodium falciparum
IKKKLLEKYARIKHKKRRKLK

SEQ ID NO: 3359559 - protein, 20 aa, Plasmodium falciparum
IKKKLRIVCKSNNPTLSSAI

SEQ ID NO: 3359560 - protein, 23 aa, Plasmodium falciparum
IKKKNLNNLLEFFKRYEKQIDQE

SEQ ID NO: 3359561 - protein, 25 aa, Plasmodium falciparum
IKKKNQCYEYLKRRHLRITCNEDFQ

SEQ ID NO: 3359562 - protein, 18 aa, Plasmodium falciparum
IKKKRIVEENIKNLQLAQ

SEQ ID NO: 3359563 - protein, 21 aa, Plasmodium falciparum
IKKKRKHDGLISKNKDQDSDN

SEQ ID NO: 3359564 - protein, 28 aa, Plasmodium falciparum
IKKKRKSFVCKKVIKKGIIKSNQIYNFK

SEQ ID NO: 3359565 - protein, 23 aa, Plasmodium falciparum
IKKLDILKRINIQTLNDVPYNDY

SEQ ID NO: 3359566 - protein, 22 aa, Plasmodium falciparum
IKKLIFKYLYLINNNFKHDGVG

SEQ ID NO: 3359567 - protein, 21 aa, Plasmodium falciparum
IKKLILIFNCINQKVKPNTNS

SEQ ID NO: 3359568 - protein, 49 aa, Plasmodium falciparum
IKKLKNIFISRNIIYYRYFKNITYTNICKYKYYISNYVISFYYNYLHND

SEQ ID NO: 3359569 - protein, 20 aa, Plasmodium falciparum
IKKLKTCRFDADDIRNLLEK

SEQ ID NO: 3359570 - protein, 18 aa, Plasmodium falciparum
IKKLLSYSGDISICTYKK

SEQ ID NO: 3359571 - protein, 22 aa, Plasmodium falciparum
IKKLMLKNNLLFEHLQKNGKFN

SEQ ID NO: 3359572 - protein, 30 aa, Plasmodium falciparum
IKKLSACECVLLELLLKNDILNVLRKYKIF

SEQ ID NO: 3359573 - protein, 23 aa, Plasmodium falciparum
IKKMCPRIKLYEFILNDIRKTVI

SEQ ID NO: 3359574 - protein, 20 aa, Plasmodium falciparum
IKKMDELYHIFMEKTNVHIS

SEQ ID NO: 3359575 - protein, 21 aa, Plasmodium falciparum
IKKMECIYPKYISRCELKKII

SEQ ID NO: 3359576 - protein, 26 aa, Plasmodium falciparum
IKKMGCVLLPVDIDSIFIDLLFHINA

SEQ ID NO: 3359577 - protein, 20 aa, Plasmodium falciparum
IKKMKCLDEIINCQNENREK

SEQ ID NO: 3359578 - protein, 24 aa, Plasmodium falciparum
IKKNDIKIVNEWNYDGKFHNDMHR

SEQ ID NO: 3359579 - protein, 22 aa, Plasmodium falciparum
IKKNEFHDRCVIKVKAGNGGDG

SEQ ID NO: 3359580 - protein, 31 aa, Plasmodium falciparum
IKKNEKYDWSGYLPVKIQIMKNTENKKFRIL

SEQ ID NO: 3359581 - protein, 21 aa, Plasmodium falciparum
IKKNLAKHIVHLNEENEKYRN

SEQ ID NO: 3359582 - protein, 24 aa, Plasmodium falciparum
IKKNLPDIIFIQFLNRILYKLDKT

SEQ ID NO: 3359583 - protein, 20 aa, Plasmodium falciparum
IKKNSAYFIYSYGSCFTSPL

SEQ ID NO: 3359584 - protein, 27 aa, Plasmodium falciparum
IKKNVCIIIPDIYRPIGKYKIKTYVKI

SEQ ID NO: 3359585 - protein, 19 aa, Plasmodium falciparum
IKKPKVGTFHFGRFYCITF

SEQ ID NO: 3359586 - protein, 21 aa, Plasmodium falciparum
IKKPMYINKIIFRCKKKKYNS

SEQ ID NO: 3359587 - protein, 17 aa, Plasmodium falciparum
IKKRIAYNNNNNNNDNK

SEQ ID NO: 3359588 - protein, 25 aa, Plasmodium falciparum
IKKRKCPFNTFFVGELNLDNLLNMS

SEQ ID NO: 3359589 - protein, 18 aa, Plasmodium falciparum
IKKRKKEECNLIENVEGN

SEQ ID NO: 3359590 - protein, 18 aa, Plasmodium falciparum
IKKSILFLNDDIKNKIRS

SEQ ID NO: 3359591 - protein, 27 aa, Plasmodium falciparum
IKKSISILFKEHWALEENKNVQSNKFR

SEQ ID NO: 3359592 - protein, 37 aa, Plasmodium falciparum
IKKSKLINYLNFFMRVCCSKSSYIKFVNHYFNIIYSN

SEQ ID NO: 3359593 - protein, 30 aa, Plasmodium falciparum
IKKVSWKNISYNCIDIIYYLIHENNKKNNK

SEQ ID NO: 3359594 - protein, 22 aa, Plasmodium falciparum
IKKYCIRLCNIFNENASLYEIL

SEQ ID NO: 3359595 - protein, 18 aa, Plasmodium falciparum
IKKYCPFVKNIQFLYNTN

SEQ ID NO: 3359596 - protein, 19 aa, Plasmodium falciparum
IKKYGDVINKIMFIHTQKK

SEQ ID NO: 3359597 - protein, 23 aa, Plasmodium falciparum
IKKYKGILWLSYFGNYDLGIPCL

SEQ ID NO: 3359598 - protein, 31 aa, Plasmodium falciparum
IKKYNNIPIFYFRKLFKYIIEQNNNNNNNNR

SEQ ID NO: 3359599 - protein, 33 aa, Plasmodium falciparum
IKKYREACTVLCDWSYDGTLFMTASTYPRMKVE

SEQ ID NO: 3359600 - protein, 17 aa, Plasmodium falciparum
IKLAFLKTDEQFLKVSK

SEQ ID NO: 3359601 - protein, 22 aa, Plasmodium falciparum
IKLDSYDICVNKYSSNNYSDKE

SEQ ID NO: 3359602 - protein, 17 aa, Plasmodium falciparum
IKLEKTLMIRDNSNNNN

SEQ ID NO: 3359603 - protein, 17 aa, Plasmodium falciparum
IKLELYLSKLITINVRT

SEQ ID NO: 3359604 - protein, 18 aa, Plasmodium falciparum
IKLENEMKIYDIQTERLK

SEQ ID NO: 3359605 - protein, 26 aa, Plasmodium falciparum
IKLFIEIIYNIKFPSLLYTNINNFFI

SEQ ID NO: 3359606 - protein, 20 aa, Plasmodium falciparum
IKLGDRRGILKFVGNIKNNQ

SEQ ID NO: 3359607 - protein, 17 aa, Plasmodium falciparum
IKLGGKISMVKKKKRTD

SEQ ID NO: 3359608 - protein, 25 aa, Plasmodium falciparum
IKLHDILGALFILRRCALYPELSKY

SEQ ID NO: 3359609 - protein, 24 aa, Plasmodium falciparum
IKLIDCFDMVCGTSAGGLISLALL

SEQ ID NO: 3359610 - protein, 22 aa, Plasmodium falciparum
IKLISKEGIVYKGLIMGKSVSP

SEQ ID NO: 3359611 - protein, 20 aa, Plasmodium falciparum
IKLKEEIMMNQIFNKQEKRN

SEQ ID NO: 3359612 - protein, 31 aa, Plasmodium falciparum
IKLKENYKYFSYVCSRYYRAPELLFGSNYYS

SEQ ID NO: 3359613 - protein, 22 aa, Plasmodium falciparum
IKLKKNREGIIHSIQRIKHLEG

SEQ ID NO: 3359614 - protein, 17 aa, Plasmodium falciparum
IKLKLIYNNNNNNNNNN

SEQ ID NO: 3359615 - protein, 19 aa, Plasmodium falciparum
IKLKQEIDVIKEDNIINTN

SEQ ID NO: 3359616 - protein, 26 aa, Plasmodium falciparum
IKLLDDIKGLWFIKTNFSCILEVELW

SEQ ID NO: 3359617 - protein, 44 aa, Plasmodium falciparum
IKLLDFLLDALFRNKYFMNRFYLWIRNICKQHKDVLKSKKYRKI

SEQ ID NO: 3359618 - protein, 20 aa, Plasmodium falciparum
IKLLLCCYILLNIFVQYNWT

SEQ ID NO: 3359619 - protein, 21 aa, Plasmodium falciparum
IKLLLIPFILGNLCYETLNIN

SEQ ID NO: 3359620 - protein, 17 aa, Plasmodium falciparum
IKLMMEYKGKFSHKMIK

SEQ ID NO: 3359621 - protein, 27 aa, Plasmodium falciparum
IKLNEIRIPLIIGRQYLFYSLNFAHSV

SEQ ID NO: 3359622 - protein, 30 aa, Plasmodium falciparum
IKLNETLCLLKLAMINRIYIFLKQTHDYIQ

SEQ ID NO: 3359623 - protein, 28 aa, Plasmodium falciparum
IKLPFHAICSKPLVLCEPLFLNLEHIII

SEQ ID NO: 3359624 - protein, 24 aa, Plasmodium falciparum
IKLPHTRAFKGGRPMMKRGKSGKW

SEQ ID NO: 3359625 - protein, 17 aa, Plasmodium falciparum
IKLPIKHSSTEEIGQYI

SEQ ID NO: 3359626 - protein, 19 aa, Plasmodium falciparum
IKLPNKRKELNSGDNHEIV

SEQ ID NO: 3359627 - protein, 20 aa, Plasmodium falciparum
IKLPNYRIISTYIDNNNNRN

SEQ ID NO: 3359628 - protein, 24 aa, Plasmodium falciparum
IKLRNGYKICFVLKISQIPLDIYV

SEQ ID NO: 3359629 - protein, 19 aa, Plasmodium falciparum
IKLSESVKVGKSMNENIGK

SEQ ID NO: 3359630 - protein, 19 aa, Plasmodium falciparum
IKLVPYLVSILKQICENKL

SEQ ID NO: 3359631 - protein, 19 aa, Plasmodium falciparum
IKLYLFQLVQSLRTFNYQH

SEQ ID NO: 3359632 - protein, 19 aa, Plasmodium falciparum
IKLYYESQINKNFISIPKD

SEQ ID NO: 3359633 - protein, 19 aa, Plasmodium falciparum
IKMKINLYQPLTIYDVLAF

SEQ ID NO: 3359634 - protein, 20 aa, Plasmodium falciparum
IKMKSPKNISKVCQNKSTIN

SEQ ID NO: 3359635 - protein, 18 aa, Plasmodium falciparum
IKMLISVPLATKIYAHFL

SEQ ID NO: 3359636 - protein, 21 aa, Plasmodium falciparum
IKMYAKAFFELYFMEKYKRNE

SEQ ID NO: 3359637 - protein, 19 aa, Plasmodium falciparum
IKNDCSYNIINAHNITNRN

SEQ ID NO: 3359638 - protein, 17 aa, Plasmodium falciparum
IKNDHMVVGEDIMGDTN

SEQ ID NO: 3359639 - protein, 19 aa, Plasmodium falciparum
IKNDLSVHNNEYYSMVENI

SEQ ID NO: 3359640 - protein, 17 aa, Plasmodium falciparum
IKNDVKIIVTWNMNSIT

SEQ ID NO: 3359641 - protein, 24 aa, Plasmodium falciparum
IKNEERIEGSILREYYMNTTNISV

SEQ ID NO: 3359642 - protein, 27 aa, Plasmodium falciparum
IKNEFVVYMQLPFKPFYIYNTSDIFRK

SEQ ID NO: 3359643 - protein, 22 aa, Plasmodium falciparum
IKNEKNKKEFFFFDDDKDKVLL

SEQ ID NO: 3359644 - protein, 20 aa, Plasmodium falciparum
IKNEYCLTCEGIITNYDEVY

SEQ ID NO: 3359645 - protein, 29 aa, Plasmodium falciparum
IKNFKNEYYWSIKMKYVYNNDEINPMDDE

SEQ ID NO: 3359646 - protein, 26 aa, Plasmodium falciparum
IKNFLPHGYGFLSYDDSAIFEGYFIE

SEQ ID NO: 3359647 - protein, 26 aa, Plasmodium falciparum
IKNFLRNHFCLIDEDIESLKNKNKKL

SEQ ID NO: 3359648 - protein, 18 aa, Plasmodium falciparum
IKNFQCIERLITSQEIPF

SEQ ID NO: 3359649 - protein, 25 aa, Plasmodium falciparum
IKNHIWFTTHPMKIMLSNNISTTCN

SEQ ID NO: 3359650 - protein, 17 aa, Plasmodium falciparum
IKNIALIRLKCFLNNQE

SEQ ID NO: 3359651 - protein, 18 aa, Plasmodium falciparum
IKNIEFFIPLLAEYYINK

SEQ ID NO: 3359652 - protein, 19 aa, Plasmodium falciparum
IKNIFCLDKNIFSFGANGK

SEQ ID NO: 3359653 - protein, 18 aa, Plasmodium falciparum
IKNIFINKYNMSFPEERI

SEQ ID NO: 3359654 - protein, 26 aa, Plasmodium falciparum
IKNIFSYDCAYHIFNECEKKRNIQQN

SEQ ID NO: 3359655 - protein, 20 aa, Plasmodium falciparum
IKNIGSGIFKFRNKKEKENY

SEQ ID NO: 3359656 - protein, 33 aa, Plasmodium falciparum
IKNIIFKAYYLRGIARYKLRIYKLSLKDFKESK

SEQ ID NO: 3359657 - protein, 25 aa, Plasmodium falciparum
IKNIPEMWKKIFLHSQGNNNSTSMN

SEQ ID NO: 3359658 - protein, 23 aa, Plasmodium falciparum
IKNITCSCNRCLQIIDEERNILC

SEQ ID NO: 3359659 - protein, 30 aa, Plasmodium falciparum
IKNIYPIVPYISVWENKYIQGIMDIESDTE

SEQ ID NO: 3359660 - protein, 23 aa, Plasmodium falciparum
IKNKGTINYSFKYPPKSNLKNNM

SEQ ID NO: 3359661 - protein, 17 aa, Plasmodium falciparum
IKNKICTSKNYIVQKDM

SEQ ID NO: 3359662 - protein, 19 aa, Plasmodium falciparum
IKNKIKLHFIHFYNVILYQ

SEQ ID NO: 3359663 - protein, 26 aa, Plasmodium falciparum
IKNKIKYIYDKYCYKKEAKTVQFNIK

SEQ ID NO: 3359664 - protein, 26 aa, Plasmodium falciparum
IKNKVRGLLTYCLGKAIELLKNDFSY

SEQ ID NO: 3359665 - protein, 19 aa, Plasmodium falciparum
IKNKYKLLPGEDCINIMLI

SEQ ID NO: 3359666 - protein, 22 aa, Plasmodium falciparum
IKNLIMPPVVPFNDMFKKFNKE

SEQ ID NO: 3359667 - protein, 27 aa, Plasmodium falciparum
IKNLIPLYRYIPLILQKLNTEYLVSVM

SEQ ID NO: 3359668 - protein, 20 aa, Plasmodium falciparum
IKNLKEFLINKINKINKINN

SEQ ID NO: 3359669 - protein, 18 aa, Plasmodium falciparum
IKNLKHLIKSEAKDKIIL

SEQ ID NO: 3359670 - protein, 26 aa, Plasmodium falciparum
IKNLKHLKVIFLLRPTYTNILRLMSE

SEQ ID NO: 3359671 - protein, 18 aa, Plasmodium falciparum
IKNLKIYPYFSIEKNTNN

SEQ ID NO: 3359672 - protein, 23 aa, Plasmodium falciparum
IKNLSRASAIITQLYEYPIIGKK

SEQ ID NO: 3359673 - protein, 18 aa, Plasmodium falciparum
IKNLWPAIDKYKFLQTRQ

SEQ ID NO: 3359674 - protein, 24 aa, Plasmodium falciparum
IKNNLKFNYLFILDEIHYINNQKR

SEQ ID NO: 3359675 - protein, 22 aa, Plasmodium falciparum
IKNNLRETFLFSSYNTTVHIQM

SEQ ID NO: 3359676 - protein, 21 aa, Plasmodium falciparum
IKNNYFFNRGIYFFNKYKIYI

SEQ ID NO: 3359677 - protein, 18 aa, Plasmodium falciparum
IKNQVICIDKKINEKKEH

SEQ ID NO: 3359678 - protein, 22 aa, Plasmodium falciparum
IKNRKECICKNNLYDNEKKNNS

SEQ ID NO: 3359679 - protein, 25 aa, Plasmodium falciparum
IKNSLKMKYPFIINFNIKKNKYQNV

SEQ ID NO: 3359680 - protein, 18 aa, Plasmodium falciparum
IKNSSSCDEKELIEKINL

SEQ ID NO: 3359681 - protein, 31 aa, Plasmodium falciparum
IKNVDHIINFHFPLDVITYIHRLGKINRLHN

SEQ ID NO: 3359682 - protein, 26 aa, Plasmodium falciparum
IKNYIFKNKRSLLNYKYYNSKDYSVK

SEQ ID NO: 3359683 - protein, 17 aa, Plasmodium falciparum
IKNYKCGIIYNNNNNNN

SEQ ID NO: 3359684 - protein, 23 aa, Plasmodium falciparum
IKNYRDCLNLIYAALYVDKENKS

SEQ ID NO: 3359685 - protein, 24 aa, Plasmodium falciparum
IKNYTHYLNEHWMNRKILGGYIIF

SEQ ID NO: 3359686 - protein, 19 aa, Plasmodium falciparum
IKPDIIICTVGRLLDHFES

SEQ ID NO: 3359687 - protein, 18 aa, Plasmodium falciparum
IKPFISIKTNELYSNVRW

SEQ ID NO: 3359688 - protein, 25 aa, Plasmodium falciparum
IKPLMNNICIQCLIIKYIEDPPDHI

SEQ ID NO: 3359689 - protein, 25 aa, Plasmodium falciparum
IKPNLKGKIYFIGSCENNIWIKNSD

SEQ ID NO: 3359690 - protein, 27 aa, Plasmodium falciparum
IKPNLKKGENIWEARTHLLVEQKENAV

SEQ ID NO: 3359691 - protein, 19 aa, Plasmodium falciparum
IKPPSFVFFCNSEKSVYAN

SEQ ID NO: 3359692 - protein, 24 aa, Plasmodium falciparum
IKPRNIIKMWKIRKGDEVKVISGK

SEQ ID NO: 3359693 - protein, 17 aa, Plasmodium falciparum
IKPTNCHKYNKYHEYHK

SEQ ID NO: 3359694 - protein, 24 aa, Plasmodium falciparum
IKQCLHPLPTCRPTAKYLSHHFEH

SEQ ID NO: 3359695 - protein, 20 aa, Plasmodium falciparum
IKQECKNIYKYTKSNYPQMI

SEQ ID NO: 3359696 - protein, 25 aa, Plasmodium falciparum
IKQFIPVNLNPCFYPNEPNILLKLP

SEQ ID NO: 3359697 - protein, 23 aa, Plasmodium falciparum
IKQIKEILDRDINLLNEDPRIIN

SEQ ID NO: 3359698 - protein, 19 aa, Plasmodium falciparum
IKQKYCKSYKHIKIDRPIN

SEQ ID NO: 3359699 - protein, 25 aa, Plasmodium falciparum
IKQRLKNYSAYMLVYVKKSLIPKLI

SEQ ID NO: 3359700 - protein, 24 aa, Plasmodium falciparum
IKQRRMMEKKGMDIFKTLSEEQSV

SEQ ID NO: 3359701 - protein, 17 aa, Plasmodium falciparum
IKQSPLICYLQHFPNDE

SEQ ID NO: 3359702 - protein, 28 aa, Plasmodium falciparum
IKQTLHCLSNFFKWIPLTYIFDKYKFND

SEQ ID NO: 3359703 - protein, 24 aa, Plasmodium falciparum
IKRALKWSKCEGTIIGEGRISSDH

SEQ ID NO: 3359704 - protein, 21 aa, Plasmodium falciparum
IKRAPYFLTKFFTFAQSYLNF

SEQ ID NO: 3359705 - protein, 22 aa, Plasmodium falciparum
IKRLRKNKRISKKDKNLKENQK

SEQ ID NO: 3359706 - protein, 21 aa, Plasmodium falciparum
IKRNKIQHIFANIPYNNNFKK

SEQ ID NO: 3359707 - protein, 21 aa, Plasmodium falciparum
IKRNTSSFICLNDIICLLTSL

SEQ ID NO: 3359708 - protein, 21 aa, Plasmodium falciparum
IKRNYTFSNIRYKNHTKNTLS

SEQ ID NO: 3359709 - protein, 17 aa, Plasmodium falciparum
IKRRKKLPSPRTEIKIS

SEQ ID NO: 3359710 - protein, 23 aa, Plasmodium falciparum
IKRRMYNILYSCFLILEKYDLIK

SEQ ID NO: 3359711 - protein, 25 aa, Plasmodium falciparum
IKRTPFCIYSLNDICNHLRYGKKSA

SEQ ID NO: 3359712 - protein, 19 aa, Plasmodium falciparum
IKRVCGYDTPFPHVYEPFY

SEQ ID NO: 3359713 - protein, 22 aa, Plasmodium falciparum
IKRVYYKNSFELPKSNEQDMYQ

SEQ ID NO: 3359714 - protein, 20 aa, Plasmodium falciparum
IKSDCSLQYIKCKTSTKIDD

SEQ ID NO: 3359715 - protein, 22 aa, Plasmodium falciparum
IKSDIITTCLDNDYSNMNYSSD

SEQ ID NO: 3359716 - protein, 20 aa, Plasmodium falciparum
IKSEIILKSDKFILNSYDNI

SEQ ID NO: 3359717 - protein, 22 aa, Plasmodium falciparum
IKSEVNVCNSLTVLHKNYNINM

SEQ ID NO: 3359718 - protein, 24 aa, Plasmodium falciparum
IKSHCCSCGGGDVSNILENINKNF

SEQ ID NO: 3359719 - protein, 19 aa, Plasmodium falciparum
IKSIEVCVKKENEIHHKNM

SEQ ID NO: 3359720 - protein, 17 aa, Plasmodium falciparum
IKSILGIEKLRYLEKLN

SEQ ID NO: 3359721 - protein, 17 aa, Plasmodium falciparum
IKSILVIKDTMRKYQRF

SEQ ID NO: 3359722 - protein, 22 aa, Plasmodium falciparum
IKSIMKRKVDEINMKSNSNIIN

SEQ ID NO: 3359723 - protein, 19 aa, Plasmodium falciparum
IKSIRVVQRNLVFVIGITA

SEQ ID NO: 3359724 - protein, 17 aa, Plasmodium falciparum
IKSKHGYLHAYQPQKIQ

SEQ ID NO: 3359725 - protein, 19 aa, Plasmodium falciparum
IKSKHIVDIINLYKDSAGN

SEQ ID NO: 3359726 - protein, 25 aa, Plasmodium falciparum
IKSKKLSIYFYWFLLSEAKDKIKGK

SEQ ID NO: 3359727 - protein, 22 aa, Plasmodium falciparum
IKSKLPSAVLHKIWNLADITED

SEQ ID NO: 3359728 - protein, 19 aa, Plasmodium falciparum
IKSKMLYNNKSYSKSEKVL

SEQ ID NO: 3359729 - protein, 33 aa, Plasmodium falciparum
IKSKRDNKLLCYNKCIRRHKKIKPYERSNKENC

SEQ ID NO: 3359730 - protein, 21 aa, Plasmodium falciparum
IKSKRMSSALDHIKRRKSSKK

SEQ ID NO: 3359731 - protein, 20 aa, Plasmodium falciparum
IKSLCERYGPIVDVKVFKKN

SEQ ID NO: 3359732 - protein, 17 aa, Plasmodium falciparum
IKSLPFIRGSMLRNIDI

SEQ ID NO: 3359733 - protein, 23 aa, Plasmodium falciparum
IKSMEKAKEKECEAEYNKIINNN

SEQ ID NO: 3359734 - protein, 23 aa, Plasmodium falciparum
IKSNKRSSSVILANELIEKRNIK

SEQ ID NO: 3359735 - protein, 19 aa, Plasmodium falciparum
IKSPHLCKMKNTPTENLAN

SEQ ID NO: 3359736 - protein, 24 aa, Plasmodium falciparum
IKSSKKRSRELANLEEHNLKKLLK

SEQ ID NO: 3359737 - protein, 19 aa, Plasmodium falciparum
IKSSLKVDENMMRFLCADE

SEQ ID NO: 3359738 - protein, 20 aa, Plasmodium falciparum
IKSTCTNYAIWKLGPTPSQT

SEQ ID NO: 3359739 - protein, 20 aa, Plasmodium falciparum
IKTDMKNFMQRRDYEQDNIM

SEQ ID NO: 3359740 - protein, 18 aa, Plasmodium falciparum
IKTHCKKDTIGIFYKDKK

SEQ ID NO: 3359741 - protein, 18 aa, Plasmodium falciparum
IKTHVVVSGLLYGNGENV

SEQ ID NO: 3359742 - protein, 23 aa, Plasmodium falciparum
IKTIKEIVEIGDIFDYLHKLILL

SEQ ID NO: 3359743 - protein, 18 aa, Plasmodium falciparum
IKTKFYLLKEKFYKYKIF

SEQ ID NO: 3359744 - protein, 20 aa, Plasmodium falciparum
IKTLCKMTGKKYVCHFAPHY

SEQ ID NO: 3359745 - protein, 22 aa, Plasmodium falciparum
IKTLLLPNVSLIFDWKIADCAD

SEQ ID NO: 3359746 - protein, 17 aa, Plasmodium falciparum
IKTLNRYKNEQLKKEIL

SEQ ID NO: 3359747 - protein, 22 aa, Plasmodium falciparum
IKTLYNLCELFLNYMKNINDFA

SEQ ID NO: 3359748 - protein, 24 aa, Plasmodium falciparum
IKTMRRLSNKFLIKYDSKFKKLFC

SEQ ID NO: 3359749 - protein, 22 aa, Plasmodium falciparum
IKTNANSLFKFVDKNESNEEGI

SEQ ID NO: 3359750 - protein, 29 aa, Plasmodium falciparum
IKTNELYSNVRWLYDSLIIGSTYSGYFSL

SEQ ID NO: 3359751 - protein, 17 aa, Plasmodium falciparum
IKTPVNMFYKRKKKLKI

SEQ ID NO: 3359752 - protein, 47 aa, Plasmodium falciparum
IKTSNSLNDIDICRMWFEQVFSYNTRVYIEYEKEFIARIKTSKIFEK

SEQ ID NO: 3359753 - protein, 21 aa, Plasmodium falciparum
IKTSYYKLALKYHPDKNANDP

SEQ ID NO: 3359754 - protein, 25 aa, Plasmodium falciparum
IKTVRLESFHKVYIKLLDDIKGLWF

SEQ ID NO: 3359755 - protein, 17 aa, Plasmodium falciparum
IKTYLLKNDEQCCNEEK

SEQ ID NO: 3359756 - protein, 17 aa, Plasmodium falciparum
IKVCPDDQLHFEIDTNE

SEQ ID NO: 3359757 - protein, 23 aa, Plasmodium falciparum
IKVDLLICCGDFQSVRYNVDNEC

SEQ ID NO: 3359758 - protein, 17 aa, Plasmodium falciparum
IKVGHDINKKKLDNTYK

SEQ ID NO: 3359759 - protein, 27 aa, Plasmodium falciparum
IKVKNYETTNIWLLHNKMLIKLLKKRK

SEQ ID NO: 3359760 - protein, 27 aa, Plasmodium falciparum
IKVKRRRGRPKASEVAAINIMNNKLKQ

SEQ ID NO: 3359761 - protein, 20 aa, Plasmodium falciparum
IKVNCYFVKDMLKGDDYYEL

SEQ ID NO: 3359762 - protein, 25 aa, Plasmodium falciparum
IKVNIPLSCLNSFNKIFMSSKNTEE

SEQ ID NO: 3359763 - protein, 18 aa, Plasmodium falciparum
IKVPKGLTPRFANLKNNK

SEQ ID NO: 3359764 - protein, 22 aa, Plasmodium falciparum
IKWEYETFPFFTYKSNYLMNEE

SEQ ID NO: 3359765 - protein, 19 aa, Plasmodium falciparum
IKWSEDFFSQLVYHLFGTY

SEQ ID NO: 3359766 - protein, 17 aa, Plasmodium falciparum
IKYDKAHTFFNNIRNLH

SEQ ID NO: 3359767 - protein, 32 aa, Plasmodium falciparum
IKYDSKFKKLFCKKCNSVLIPSETCDVSVNPL

SEQ ID NO: 3359768 - protein, 26 aa, Plasmodium falciparum
IKYEKCPKGKYIILEGDYCEYFYFIK

SEQ ID NO: 3359769 - protein, 25 aa, Plasmodium falciparum
IKYEKYINNIFCKWINKPTTKSSTF

SEQ ID NO: 3359770 - protein, 20 aa, Plasmodium falciparum
IKYEREVIKITNKYRNALEK

SEQ ID NO: 3359771 - protein, 25 aa, Plasmodium falciparum
IKYFDNFLFRQNCIIHVEKAQFNNK

SEQ ID NO: 3359772 - protein, 17 aa, Plasmodium falciparum
IKYGDEYEEEIYNTKNV

SEQ ID NO: 3359773 - protein, 31 aa, Plasmodium falciparum
IKYGKDDFWFPNNIIYEYIKTHLLNRFVIHN

SEQ ID NO: 3359774 - protein, 31 aa, Plasmodium falciparum
IKYHEACENFSILFKIFYDSLIYIVKKNEEA

SEQ ID NO: 3359775 - protein, 18 aa, Plasmodium falciparum
IKYIKLGGKISMVKKKKR

SEQ ID NO: 3359776 - protein, 20 aa, Plasmodium falciparum
IKYKYFYLPVMKIFSRYFPT

SEQ ID NO: 3359777 - protein, 18 aa, Plasmodium falciparum
IKYLFNYNYKFKLQNIDV

SEQ ID NO: 3359778 - protein, 23 aa, Plasmodium falciparum
IKYLIHLKKIILMGIEQNKKSYY

SEQ ID NO: 3359779 - protein, 18 aa, Plasmodium falciparum
IKYLQVFIFLSDIKINKI

SEQ ID NO: 3359780 - protein, 17 aa, Plasmodium falciparum
IKYLRLQNRFISNLRGN

SEQ ID NO: 3359781 - protein, 18 aa, Plasmodium falciparum
IKYLSRIYRILSIKYFHI

SEQ ID NO: 3359782 - protein, 24 aa, Plasmodium falciparum
IKYMIKNNMFRYYVNLKKMKNDFI

SEQ ID NO: 3359783 - protein, 33 aa, Plasmodium falciparum
IKYQYKEYLLHKTVYPRNICRNEHMNQKDNCTK

SEQ ID NO: 3359784 - protein, 19 aa, Plasmodium falciparum
IKYSVSAYFNSYDDIIEKY

SEQ ID NO: 3359785 - protein, 19 aa, Plasmodium falciparum
IKYTDLYKLLNIKMNDKDK

SEQ ID NO: 3359786 - protein, 18 aa, Plasmodium falciparum
IKYVENVHAKLYMEQQQS

SEQ ID NO: 3359787 - protein, 21 aa, Plasmodium falciparum
IKYVNDKNCFFLQYKNVESAI

SEQ ID NO: 3359788 - protein, 26 aa, Plasmodium falciparum
IKYVYPNCYHYTYFGFENKFENIYCG

SEQ ID NO: 3359789 - protein, 26 aa, Plasmodium falciparum
ILAADTRLSLSYSIYTRFCPKISKLT

SEQ ID NO: 3359790 - protein, 22 aa, Plasmodium falciparum
ILACADNGYILIFDFRIKSNEP

SEQ ID NO: 3359791 - protein, 18 aa, Plasmodium falciparum
ILAIEYIGFGLCYLEGST

SEQ ID NO: 3359792 - protein, 19 aa, Plasmodium falciparum
ILANLCYNQMKAIDQKRKI

SEQ ID NO: 3359793 - protein, 23 aa, Plasmodium falciparum
ILASKEVKPFLGSSEKTKNEPIE

SEQ ID NO: 3359794 - protein, 24 aa, Plasmodium falciparum
ILCGHFGSGWGWLALNNNNKLVIL

SEQ ID NO: 3359795 - protein, 17 aa, Plasmodium falciparum
ILCGYPPFRGNNVKEIF

SEQ ID NO: 3359796 - protein, 23 aa, Plasmodium falciparum
ILCILPGKFAWSVDINVMVLNAG

SEQ ID NO: 3359797 - protein, 22 aa, Plasmodium falciparum
ILCKYLDFRDTHIICTKPVFTF

SEQ ID NO: 3359798 - protein, 20 aa, Plasmodium falciparum
ILCLIKKYIIQSNIHNYENK

SEQ ID NO: 3359799 - protein, 23 aa, Plasmodium falciparum
ILCSIKDITICFIKNIQDDIRTF

SEQ ID NO: 3359800 - protein, 19 aa, Plasmodium falciparum
ILDALEFNQVIIFVKSVTR

SEQ ID NO: 3359801 - protein, 18 aa, Plasmodium falciparum
ILDCSAVLDMKELWKDKS

SEQ ID NO: 3359802 - protein, 29 aa, Plasmodium falciparum
ILDGPKIICLFFLCIIKMLSHIKLEELKE

SEQ ID NO: 3359803 - protein, 24 aa, Plasmodium falciparum
ILDILKRRVDNNEQVNINEYDEDE

SEQ ID NO: 3359804 - protein, 17 aa, Plasmodium falciparum
ILDKLNLGLKNKGNDKN

SEQ ID NO: 3359805 - protein, 25 aa, Plasmodium falciparum
ILDNENREGLYLCDVMKNSNELKRI

SEQ ID NO: 3359806 - protein, 39 aa, Plasmodium falciparum
ILDNINHLLIKFSYPSKKALFYRCFAVSSCIIKNLRKKT

SEQ ID NO: 3359807 - protein, 19 aa, Plasmodium falciparum
ILDNISWTILLKKYIFIIL

SEQ ID NO: 3359808 - protein, 18 aa, Plasmodium falciparum
ILDTFKGINGCILAYGQT

SEQ ID NO: 3359809 - protein, 26 aa, Plasmodium falciparum
ILDYLKEYCRSKCIQFNDENYFYHFT

SEQ ID NO: 3359810 - protein, 18 aa, Plasmodium falciparum
ILEGHEKGVNCCTFHHNL

SEQ ID NO: 3359811 - protein, 26 aa, Plasmodium falciparum
ILEHMYYKPEMLFKQIWTYLMNGKEM

SEQ ID NO: 3359812 - protein, 22 aa, Plasmodium falciparum
ILEKKYKINLLNHFCAKTEKLK

SEQ ID NO: 3359813 - protein, 20 aa, Plasmodium falciparum
ILELLKYHARVMYIDIDVHH

SEQ ID NO: 3359814 - protein, 18 aa, Plasmodium falciparum
ILEMCYKVIPGILSATGK

SEQ ID NO: 3359815 - protein, 19 aa, Plasmodium falciparum
ILENILLKTDINYVNEQNI

SEQ ID NO: 3359816 - protein, 17 aa, Plasmodium falciparum
ILERCVKNTLLSEKSRS

SEQ ID NO: 3359817 - protein, 17 aa, Plasmodium falciparum
ILESINIMDVLKRRESI

SEQ ID NO: 3359818 - protein, 17 aa, Plasmodium falciparum
ILETLSHGKMEKHKKNK

SEQ ID NO: 3359819 - protein, 17 aa, Plasmodium falciparum
ILFDGIFTYGKKTQNII

SEQ ID NO: 3359820 - protein, 19 aa, Plasmodium falciparum
ILFDSFIEFAHSFEKSSEP

SEQ ID NO: 3359821 - protein, 22 aa, Plasmodium falciparum
ILFEKYDFFSRRSTYLSSNTLS

SEQ ID NO: 3359822 - protein, 21 aa, Plasmodium falciparum
ILFFDEIDSLLGTRKKDEDDT

SEQ ID NO: 3359823 - protein, 32 aa, Plasmodium falciparum
ILFKDVMLNICKFSRIFLFENEHFISIGDSSQ

SEQ ID NO: 3359824 - protein, 24 aa, Plasmodium falciparum
ILFLCSNMKMNIMEEIFDDLKRDI

SEQ ID NO: 3359825 - protein, 18 aa, Plasmodium falciparum
ILFNCLQTDFNLHLMQYV

SEQ ID NO: 3359826 - protein, 27 aa, Plasmodium falciparum
ILFYLKYEYRLPLKCEYLYLYSENFIA

SEQ ID NO: 3359827 - protein, 17 aa, Plasmodium falciparum
ILGNLCYETLNINIRYE

SEQ ID NO: 3359828 - protein, 25 aa, Plasmodium falciparum
ILGTGELYLDCILHDLRKLYGDLEI

SEQ ID NO: 3359829 - protein, 25 aa, Plasmodium falciparum
ILHFRKEINNLLSVTYERQIDRKIY

SEQ ID NO: 3359830 - protein, 18 aa, Plasmodium falciparum
ILHILLLCECSIFSYDCS

SEQ ID NO: 3359831 - protein, 25 aa, Plasmodium falciparum
ILHTFLKKYFIKRNIHINENKINDI

SEQ ID NO: 3359832 - protein, 18 aa, Plasmodium falciparum
ILHTRSSIYGKLSNGVLI

SEQ ID NO: 3359833 - protein, 19 aa, Plasmodium falciparum
ILICSFTYCIYIYKLNISG

SEQ ID NO: 3359834 - protein, 22 aa, Plasmodium falciparum
ILIDKYLRQEKIIYKLKKHNEE

SEQ ID NO: 3359835 - protein, 19 aa, Plasmodium falciparum
ILIHIKRNFYEKILNIETN

SEQ ID NO: 3359836 - protein, 18 aa, Plasmodium falciparum
ILIHRQVKKKNNVTDVIT

SEQ ID NO: 3359837 - protein, 17 aa, Plasmodium falciparum
ILIIDALFYKRKHYSHF

SEQ ID NO: 3359838 - protein, 19 aa, Plasmodium falciparum
ILIKKKIVICYSGDEKILK

SEQ ID NO: 3359839 - protein, 32 aa, Plasmodium falciparum
ILILANQIKWKVCDNKVFYEYIKKSYFVSNRK

SEQ ID NO: 3359840 - protein, 24 aa, Plasmodium falciparum
ILINECLRILYFRDATSSNFIQIV

SEQ ID NO: 3359841 - protein, 19 aa, Plasmodium falciparum
ILINPQFASFFKIELFLFI

SEQ ID NO: 3359842 - protein, 27 aa, Plasmodium falciparum
ILISCVEGFMGLPILCKYLDFRDTHII

SEQ ID NO: 3359843 - protein, 18 aa, Plasmodium falciparum
ILISSFVFEAVVPNYVKL

SEQ ID NO: 3359844 - protein, 29 aa, Plasmodium falciparum
ILIYKYLCKNGIMYRKYNFFSFEKENQEI

SEQ ID NO: 3359845 - protein, 20 aa, Plasmodium falciparum
ILIYSCKGGVGKSFFSVNFS

SEQ ID NO: 3359846 - protein, 17 aa, Plasmodium falciparum
ILKCASYGTKVDIFSLG

SEQ ID NO: 3359847 - protein, 17 aa, Plasmodium falciparum
ILKCCNFLTYPKDFPDT

SEQ ID NO: 3359848 - protein, 28 aa, Plasmodium falciparum
ILKCNLYDFLLYFSFNFIIQNIQSVIPP

SEQ ID NO: 3359849 - protein, 25 aa, Plasmodium falciparum
ILKDQLKICIQILCDDIYLLEMKQK

SEQ ID NO: 3359850 - protein, 20 aa, Plasmodium falciparum
ILKDRLCLEKKVTQSILFKR

SEQ ID NO: 3359851 - protein, 19 aa, Plasmodium falciparum
ILKEEIKKMDSLKLENTQL

SEQ ID NO: 3359852 - protein, 25 aa, Plasmodium falciparum
ILKEIVEILFSKGLIKVLFATETFA

SEQ ID NO: 3359853 - protein, 20 aa, Plasmodium falciparum
ILKERASIIQNIFDEEKLMK

SEQ ID NO: 3359854 - protein, 21 aa, Plasmodium falciparum
ILKFRDHFKIIPIRKKIIPVI

SEQ ID NO: 3359855 - protein, 22 aa, Plasmodium falciparum
ILKGDLHKNCLIKRKSDSQYFT

SEQ ID NO: 3359856 - protein, 19 aa, Plasmodium falciparum
ILKIDRLNNDLVLKLNKSS

SEQ ID NO: 3359857 - protein, 18 aa, Plasmodium falciparum
ILKIRKKKMTTFLNKIMS

SEQ ID NO: 3359858 - protein, 19 aa, Plasmodium falciparum
ILKIYTIEFEQFYKSYNIP

SEQ ID NO: 3359859 - protein, 22 aa, Plasmodium falciparum
ILKKDIFYNIFFLKLLGIQNIC

SEQ ID NO: 3359860 - protein, 18 aa, Plasmodium falciparum
ILKKGGGKIDATVDYSFH

SEQ ID NO: 3359861 - protein, 24 aa, Plasmodium falciparum
ILKKIKKKILYTGKASCACKMKCY

SEQ ID NO: 3359862 - protein, 21 aa, Plasmodium falciparum
ILKKKPCYNKLNIQTNDDLDI

SEQ ID NO: 3359863 - protein, 21 aa, Plasmodium falciparum
ILKKNLKFFKIHNLIEYDKKE

SEQ ID NO: 3359864 - protein, 23 aa, Plasmodium falciparum
ILKNFFPLYKFKVLGRTLKYPWV

SEQ ID NO: 3359865 - protein, 17 aa, Plasmodium falciparum
ILKNILNLIKLCNVKDF

SEQ ID NO: 3359866 - protein, 34 aa, Plasmodium falciparum
ILKNILRKKFYIMYNYLFPKRKTFYFCSYNFHDT

SEQ ID NO: 3359867 - protein, 19 aa, Plasmodium falciparum
ILKNINLILKKQIDLNHSN

SEQ ID NO: 3359868 - protein, 25 aa, Plasmodium falciparum
ILKPFMLRRLKVEVEQSLPPKREIY

SEQ ID NO: 3359869 - protein, 18 aa, Plasmodium falciparum
ILKPFPRNFTCNTNVSSN

SEQ ID NO: 3359870 - protein, 23 aa, Plasmodium falciparum
ILKPHLWNLPWRKYYENKINKIY

SEQ ID NO: 3359871 - protein, 22 aa, Plasmodium falciparum
ILKQETILFILIYIMQNKETPT

SEQ ID NO: 3359872 - protein, 20 aa, Plasmodium falciparum
ILKQLDLLFNLQKSYENRNI

SEQ ID NO: 3359873 - protein, 19 aa, Plasmodium falciparum
ILKRPKLDISKLMELHTDP

SEQ ID NO: 3359874 - protein, 25 aa, Plasmodium falciparum
ILKRSRKLILQKQVKMMPIKKKTER

SEQ ID NO: 3359875 - protein, 22 aa, Plasmodium falciparum
ILKSCEIDNFMEIINKELPITF

SEQ ID NO: 3359876 - protein, 20 aa, Plasmodium falciparum
ILKSCVMSGYTHGAEYDIYG

SEQ ID NO: 3359877 - protein, 18 aa, Plasmodium falciparum
ILKSIKFDCVQNITKTFN

SEQ ID NO: 3359878 - protein, 19 aa, Plasmodium falciparum
ILLARRFLSALACHPNNFR

SEQ ID NO: 3359879 - protein, 20 aa, Plasmodium falciparum
ILLCCGNNNIFMYYDLIKYD

SEQ ID NO: 3359880 - protein, 17 aa, Plasmodium falciparum
ILLCGGIGKRTELIGPK

SEQ ID NO: 3359881 - protein, 21 aa, Plasmodium falciparum
ILLCGYPPFFGESDHEILSMV

SEQ ID NO: 3359882 - protein, 18 aa, Plasmodium falciparum
ILLDLFFFYVELKYYKGI

SEQ ID NO: 3359883 - protein, 26 aa, Plasmodium falciparum
ILLEKKSALCTFNIHNFFYVETLFNL

SEQ ID NO: 3359884 - protein, 21 aa, Plasmodium falciparum
ILLFYVCKLLLDMCSKVNMNQ

SEQ ID NO: 3359885 - protein, 20 aa, Plasmodium falciparum
ILLIDCGRANMYLLTQQLYK

SEQ ID NO: 3359886 - protein, 24 aa, Plasmodium falciparum
ILLKENIFLFLFDFIKKNNDISNY

SEQ ID NO: 3359887 - protein, 17 aa, Plasmodium falciparum
ILLNGMCSKCCHIEHVL

SEQ ID NO: 3359888 - protein, 19 aa, Plasmodium falciparum
ILLNYVCNFLPSPKEINNY

SEQ ID NO: 3359889 - protein, 17 aa, Plasmodium falciparum
ILLQELTNNLGLQAFYH

SEQ ID NO: 3359890 - protein, 24 aa, Plasmodium falciparum
ILLRNRLKYALTFDEVKMILIQKI

SEQ ID NO: 3359891 - protein, 20 aa, Plasmodium falciparum
ILLSLCKDSNLFLFFKNEKN

SEQ ID NO: 3359892 - protein, 18 aa, Plasmodium falciparum
ILLTHALTTRDIYTLQNT

SEQ ID NO: 3359893 - protein, 27 aa, Plasmodium falciparum
ILMNEKRKLTGIVSIEYEKNESASDAV

SEQ ID NO: 3359894 - protein, 25 aa, Plasmodium falciparum
ILNCKSYDLYDSIFLLNESFYEQNK

SEQ ID NO: 3359895 - protein, 17 aa, Plasmodium falciparum
ILNCVNLKFDINMELLF

SEQ ID NO: 3359896 - protein, 18 aa, Plasmodium falciparum
ILNDDAYYKKLFESEGKY

SEQ ID NO: 3359897 - protein, 23 aa, Plasmodium falciparum
ILNECIKVCQLFLLSSKIVDKFS

SEQ ID NO: 3359898 - protein, 19 aa, Plasmodium falciparum
ILNEIKLSFKKNIAPKLTM

SEQ ID NO: 3359899 - protein, 18 aa, Plasmodium falciparum
ILNFFSTNVMDILTNIKQ

SEQ ID NO: 3359900 - protein, 28 aa, Plasmodium falciparum
ILNIFSEQNIRLVIVFLIDISFISSNTK

SEQ ID NO: 3359901 - protein, 19 aa, Plasmodium falciparum
ILNIYKWSVNFTNLNKELL

SEQ ID NO: 3359902 - protein, 19 aa, Plasmodium falciparum
ILNKIVLHFGDLSYLKGDA

SEQ ID NO: 3359903 - protein, 20 aa, Plasmodium falciparum
ILNKNYLKMNEFLLKTLNAS

SEQ ID NO: 3359904 - protein, 28 aa, Plasmodium falciparum
ILNKQYRCHPSISEICSHLFYNNRIKNA

SEQ ID NO: 3359905 - protein, 19 aa, Plasmodium falciparum
ILNNVPWSSTFTSNMLYEK

SEQ ID NO: 3359906 - protein, 18 aa, Plasmodium falciparum
ILNRLKSDYIIRLHDLII

SEQ ID NO: 3359907 - protein, 18 aa, Plasmodium falciparum
ILNYCLSIVKPFYDKIQK

SEQ ID NO: 3359908 - protein, 20 aa, Plasmodium falciparum
ILNYFPFKVIALRCLKSPLG

SEQ ID NO: 3359909 - protein, 24 aa, Plasmodium falciparum
ILNYPLEVCCVAGTQANKRELNQI

SEQ ID NO: 3359910 - protein, 25 aa, Plasmodium falciparum
ILNYVFPDYEFKYLNNSNYKYIKNI

SEQ ID NO: 3359911 - protein, 23 aa, Plasmodium falciparum
ILPPNRITFLFSATMTKNVAKLK

SEQ ID NO: 3359912 - protein, 23 aa, Plasmodium falciparum
ILPPRANEAIGVMHMKIYIGDNI

SEQ ID NO: 3359913 - protein, 22 aa, Plasmodium falciparum
ILPQKKWNVYRKDAQYKVHYDE

SEQ ID NO: 3359914 - protein, 27 aa, Plasmodium falciparum
ILQCKKYLIRYALYYKKILKYIKDKNK

SEQ ID NO: 3359915 - protein, 20 aa, Plasmodium falciparum
ILQHNFDNFLLLYKNKKKKK

SEQ ID NO: 3359916 - protein, 29 aa, Plasmodium falciparum
ILQIRKLFKYKRINILLVTGRLIYYERCT

SEQ ID NO: 3359917 - protein, 17 aa, Plasmodium falciparum
ILQLLCNEELYDIVKNV

SEQ ID NO: 3359918 - protein, 25 aa, Plasmodium falciparum
ILQNEKFPFIFYDSNLRNLVIYYKD

SEQ ID NO: 3359919 - protein, 33 aa, Plasmodium falciparum
ILQRFYMLRIKNISEIISFLSYIKEHSLKNKWN

SEQ ID NO: 3359920 - protein, 18 aa, Plasmodium falciparum
ILQVLKLRCKFERIKIDS

SEQ ID NO: 3359921 - protein, 24 aa, Plasmodium falciparum
ILRDKEIVEHSAIYDTKKCCIKSN

SEQ ID NO: 3359922 - protein, 18 aa, Plasmodium falciparum
ILRGPRSALIFFNKKRNP

SEQ ID NO: 3359923 - protein, 18 aa, Plasmodium falciparum
ILRKCLKDPYSDIALERS

SEQ ID NO: 3359924 - protein, 24 aa, Plasmodium falciparum
ILRNILKIILCDVETTVRRSAQKV

SEQ ID NO: 3359925 - protein, 20 aa, Plasmodium falciparum
ILRRCALYPELSKYIIHLNF

SEQ ID NO: 3359926 - protein, 19 aa, Plasmodium falciparum
ILSCISICTILKSITPSYK

SEQ ID NO: 3359927 - protein, 24 aa, Plasmodium falciparum
ILSDQNCKLEEEMKRIKEDHTKES

SEQ ID NO: 3359928 - protein, 18 aa, Plasmodium falciparum
ILSEIKIKKENFIDIDYL

SEQ ID NO: 3359929 - protein, 22 aa, Plasmodium falciparum
ILSKKRKTVSFSNMNIDTNNQI

SEQ ID NO: 3359930 - protein, 25 aa, Plasmodium falciparum
ILSKKRSIELGNILHNLIYGYIYKG

SEQ ID NO: 3359931 - protein, 23 aa, Plasmodium falciparum
ILSLKTKYDYIFVEVSGVYDNIQ

SEQ ID NO: 3359932 - protein, 24 aa, Plasmodium falciparum
ILSMYRDALDFFIEDELKNDEIPL

SEQ ID NO: 3359933 - protein, 18 aa, Plasmodium falciparum
ILSNLFKDLSLNYTVKIL

SEQ ID NO: 3359934 - protein, 26 aa, Plasmodium falciparum
ILSNLPCYYWYKREEDKLNFFISSKE

SEQ ID NO: 3359935 - protein, 27 aa, Plasmodium falciparum
ILSPKCIFHLPPGFTLKAIPLFDLNNC

SEQ ID NO: 3359936 - protein, 23 aa, Plasmodium falciparum
ILSPMKIPFCKINNTNVQNTTNV

SEQ ID NO: 3359937 - protein, 26 aa, Plasmodium falciparum
ILSSDSLKNAYSFYSLSEKNNSNNIG

SEQ ID NO: 3359938 - protein, 23 aa, Plasmodium falciparum
ILTKLPSNFALKTIRKKKKLTNG

SEQ ID NO: 3359939 - protein, 23 aa, Plasmodium falciparum
ILTKNLLEGLAYIHSKNLIHCDL

SEQ ID NO: 3359940 - protein, 17 aa, Plasmodium falciparum
ILTKPYPYIVASCITGG

SEQ ID NO: 3359941 - protein, 19 aa, Plasmodium falciparum
ILTLHDFNVNMVHDMPARL

SEQ ID NO: 3359942 - protein, 17 aa, Plasmodium falciparum
ILTMKKHITPYLSLGRL

SEQ ID NO: 3359943 - protein, 17 aa, Plasmodium falciparum
ILTNVNVVWSVFNNDLL

SEQ ID NO: 3359944 - protein, 23 aa, Plasmodium falciparum
ILVSKSSFLAGVPKVFNRIYNNV

SEQ ID NO: 3359945 - protein, 18 aa, Plasmodium falciparum
ILVVAKWGGELTRMGRRQ

SEQ ID NO: 3359946 - protein, 17 aa, Plasmodium falciparum
ILWCYCVNKFFDSKFWK

SEQ ID NO: 3359947 - protein, 17 aa, Plasmodium falciparum
ILYAMLFGLLPYDSEDK

SEQ ID NO: 3359948 - protein, 18 aa, Plasmodium falciparum
ILYDLGWNIRRVVWIDWI

SEQ ID NO: 3359949 - protein, 19 aa, Plasmodium falciparum
ILYEEIINNINLFKNFMKN

SEQ ID NO: 3359950 - protein, 17 aa, Plasmodium falciparum
ILYEFNVFNVKRDGHVF

SEQ ID NO: 3359951 - protein, 27 aa, Plasmodium falciparum
ILYFMEYIGRILLDIKLCCKQNSNMLV

SEQ ID NO: 3359952 - protein, 18 aa, Plasmodium falciparum
ILYHPLFYKTKRCEDYKK

SEQ ID NO: 3359953 - protein, 25 aa, Plasmodium falciparum
ILYIIEKCMCSNTPCYFIKKKWITT

SEQ ID NO: 3359954 - protein, 22 aa, Plasmodium falciparum
ILYQLLFEYIILCVNDSLNDSD

SEQ ID NO: 3359955 - protein, 18 aa, Plasmodium falciparum
ILYVKRYFYISEIKREFY

SEQ ID NO: 3359956 - protein, 36 aa, Plasmodium falciparum
ILYVLCVKGNISILDRRIKYYVSYILTYVNEYMREL

SEQ ID NO: 3359957 - protein, 17 aa, Plasmodium falciparum
IMCLSMKGIQPFIITSV

SEQ ID NO: 3359958 - protein, 24 aa, Plasmodium falciparum
IMCNSERICIISTCSNNCKIIYEN

SEQ ID NO: 3359959 - protein, 23 aa, Plasmodium falciparum
IMCVSSLIRIYIKTIRIETSMES

SEQ ID NO: 3359960 - protein, 24 aa, Plasmodium falciparum
IMDIKWSPTHPALFSTCSSNGKIK

SEQ ID NO: 3359961 - protein, 22 aa, Plasmodium falciparum
IMDIYNKFYRHFIIHYLPQIRS

SEQ ID NO: 3359962 - protein, 18 aa, Plasmodium falciparum
IMDLRLPPNDAYHKINYT

SEQ ID NO: 3359963 - protein, 25 aa, Plasmodium falciparum
IMDTLKYIVINGMKIEIFKNLYELK

SEQ ID NO: 3359964 - protein, 29 aa, Plasmodium falciparum
IMEKYEFVPNFILKTEFLYPLLYKNPEVL

SEQ ID NO: 3359965 - protein, 24 aa, Plasmodium falciparum
IMENICIHICSLMNIKINTSPIFN

SEQ ID NO: 3359966 - protein, 22 aa, Plasmodium falciparum
IMFENFPKYIEILFDVQPNLKQ

SEQ ID NO: 3359967 - protein, 19 aa, Plasmodium falciparum
IMFTYKYNLANDERNSQNL

SEQ ID NO: 3359968 - protein, 18 aa, Plasmodium falciparum
IMGGYRILRISENSPCSN

SEQ ID NO: 3359969 - protein, 20 aa, Plasmodium falciparum
IMHFSRSNFCGICTDNNDLF

SEQ ID NO: 3359970 - protein, 26 aa, Plasmodium falciparum
IMHKRKLTNEIAMFKNRIKELEENLE

SEQ ID NO: 3359971 - protein, 25 aa, Plasmodium falciparum
IMHMQWKKRFAFIEYYKASHALNAL

SEQ ID NO: 3359972 - protein, 24 aa, Plasmodium falciparum
IMISKSDFSYGFYDQVKKKYYLLN

SEQ ID NO: 3359973 - protein, 24 aa, Plasmodium falciparum
IMKFSLYLCNIFLGKRIKTENENA

SEQ ID NO: 3359974 - protein, 24 aa, Plasmodium falciparum
IMKHEFKLKTSRRTLMENKNKEEA

SEQ ID NO: 3359975 - protein, 18 aa, Plasmodium falciparum
IMKLFYTNQIKTFREAFL

SEQ ID NO: 3359976 - protein, 18 aa, Plasmodium falciparum
IMKSGGNFPYLSRHEEVN

SEQ ID NO: 3359977 - protein, 22 aa, Plasmodium falciparum
IMKSIFMYNNIIIKWIRDKHVV

SEQ ID NO: 3359978 - protein, 27 aa, Plasmodium falciparum
IMKSLNYDQCFLKLLLGTFKLYMHNID

SEQ ID NO: 3359979 - protein, 28 aa, Plasmodium falciparum
IMLDVRLRKALLYLFKYQHPTIIQKMSI

SEQ ID NO: 3359980 - protein, 17 aa, Plasmodium falciparum
IMLKKKYIYEMFKNVKS

SEQ ID NO: 3359981 - protein, 25 aa, Plasmodium falciparum
IMLNIGDCFFKFDLDYIEEHLEDRK

SEQ ID NO: 3359982 - protein, 25 aa, Plasmodium falciparum
IMMILYEFIKTIPPSYTYYSSFSYK

SEQ ID NO: 3359983 - protein, 19 aa, Plasmodium falciparum
IMNGELFIEEAYIAYNLKK

SEQ ID NO: 3359984 - protein, 21 aa, Plasmodium falciparum
IMNIRLIYRTVEIYLFSMRQF

SEQ ID NO: 3359985 - protein, 18 aa, Plasmodium falciparum
IMNKKKNNLHLARHSVGS

SEQ ID NO: 3359986 - protein, 17 aa, Plasmodium falciparum
IMNKNFIYEDIKTTNKK

SEQ ID NO: 3359987 - protein, 18 aa, Plasmodium falciparum
IMNKSCIDFQYILQNLYA

SEQ ID NO: 3359988 - protein, 26 aa, Plasmodium falciparum
IMPEKDELWELYIYMNLKKKKRKIEY

SEQ ID NO: 3359989 - protein, 18 aa, Plasmodium falciparum
IMQAKKLIYLRDEQNKQL

SEQ ID NO: 3359990 - protein, 19 aa, Plasmodium falciparum
IMQKNMCSSDIILDDTNSK

SEQ ID NO: 3359991 - protein, 23 aa, Plasmodium falciparum
IMRRTIPNIYSFINLLSKLCESD

SEQ ID NO: 3359992 - protein, 21 aa, Plasmodium falciparum
IMSDKKFLGINNFTHVNLSNN

SEQ ID NO: 3359993 - protein, 18 aa, Plasmodium falciparum
IMYDEDWNPFIDLQAIDR

SEQ ID NO: 3359994 - protein, 23 aa, Plasmodium falciparum
INAKVYFYYSWIHELGGKLSQVR

SEQ ID NO: 3359995 - protein, 17 aa, Plasmodium falciparum
INARHRIFTEWSIEPTP

SEQ ID NO: 3359996 - protein, 21 aa, Plasmodium falciparum
INCEIYKNLLYNFKDKTNIEN

SEQ ID NO: 3359997 - protein, 31 aa, Plasmodium falciparum
INCFSYYLLIQLCLFKSCLNSKVYEKDESPS

SEQ ID NO: 3359998 - protein, 33 aa, Plasmodium falciparum
INCNKLLNENCIKSSCDKSNFLNTPNIVVPKYS

SEQ ID NO: 3359999 - protein, 17 aa, Plasmodium falciparum
INDEEFILFGGEYNDNN

SEQ ID NO: 3360000 - protein, 26 aa, Plasmodium falciparum
INDFNCFNINLKLMIRNNLLSKIKCN

SEQ ID NO: 3360001 - protein, 26 aa, Plasmodium falciparum
INDHICNYWDGFICNNKKNITIKDIL

SEQ ID NO: 3360002 - protein, 23 aa, Plasmodium falciparum
INDIKPLYSLPEKVMSYCMNVNV

SEQ ID NO: 3360003 - protein, 22 aa, Plasmodium falciparum
INDIYSYGCVGVIKEILYDEDN

SEQ ID NO: 3360004 - protein, 25 aa, Plasmodium falciparum
INDKCAVPSRGTCDDDIINIDDDDN

SEQ ID NO: 3360005 - protein, 25 aa, Plasmodium falciparum
INDKELMFHPSFYIILHTQLSNPHY

SEQ ID NO: 3360006 - protein, 24 aa, Plasmodium falciparum
INDKLIYLLCDYYINKKEIDKLIE

SEQ ID NO: 3360007 - protein, 17 aa, Plasmodium falciparum
INDLFIINSENIRNKEN

SEQ ID NO: 3360008 - protein, 18 aa, Plasmodium falciparum
INDLSAYKQLIAPQYSNK

SEQ ID NO: 3360009 - protein, 32 aa, Plasmodium falciparum
INDNINVYCLPRCSMKATILNMISSSSANDPN

SEQ ID NO: 3360010 - protein, 21 aa, Plasmodium falciparum
INDNLLCLIKKGHDNAFNKEE

SEQ ID NO: 3360011 - protein, 18 aa, Plasmodium falciparum
INDSLSFYNYNNKVLYNV

SEQ ID NO: 3360012 - protein, 17 aa, Plasmodium falciparum
INEDINGVNMCKYDGNY

SEQ ID NO: 3360013 - protein, 17 aa, Plasmodium falciparum
INEEINVLIYLDHPNII

SEQ ID NO: 3360014 - protein, 26 aa, Plasmodium falciparum
INEELKEILPFGFGIHHAGLKRLDRK

SEQ ID NO: 3360015 - protein, 18 aa, Plasmodium falciparum
INEELKQIIFYKEIKISY

SEQ ID NO: 3360016 - protein, 23 aa, Plasmodium falciparum
INEELKRKMELVSDNINNKINDN

SEQ ID NO: 3360017 - protein, 23 aa, Plasmodium falciparum
INEFLCFFYSIVLHDLLPYQMLN

SEQ ID NO: 3360018 - protein, 17 aa, Plasmodium falciparum
INEHISFEKIQDHEKEE

SEQ ID NO: 3360019 - protein, 28 aa, Plasmodium falciparum
INEHMKIKWPDFLKLNNLIYYNHILNIY

SEQ ID NO: 3360020 - protein, 23 aa, Plasmodium falciparum
INEIHRLCKLRHFTPEEKWITKI

SEQ ID NO: 3360021 - protein, 27 aa, Plasmodium falciparum
INEKKLDIFKKITLSVGTSLDDMINIM

SEQ ID NO: 3360022 - protein, 25 aa, Plasmodium falciparum
INEKSCLRLISLVLHKSLDNIINKT

SEQ ID NO: 3360023 - protein, 24 aa, Plasmodium falciparum
INELKLPPIMPPILPNLNNSQNII

SEQ ID NO: 3360024 - protein, 28 aa, Plasmodium falciparum
INELKYLLHKSMENFRLWEPDDNIKRKI

SEQ ID NO: 3360025 - protein, 21 aa, Plasmodium falciparum
INELPEWTHEVFSCVNITKLN

SEQ ID NO: 3360026 - protein, 20 aa, Plasmodium falciparum
INELSALSVIFAMKKLNIDL

SEQ ID NO: 3360027 - protein, 29 aa, Plasmodium falciparum
INEMGLCVTESYLTPAYIKQGVIELLFEY

SEQ ID NO: 3360028 - protein, 31 aa, Plasmodium falciparum
INEMLKWKRRGFPGCNPVSLTNHNIKNLFTK

SEQ ID NO: 3360029 - protein, 18 aa, Plasmodium falciparum
INEMYLYHIQSLYNDSVP

SEQ ID NO: 3360030 - protein, 19 aa, Plasmodium falciparum
INERLKCIYNNIENKRKSI

SEQ ID NO: 3360031 - protein, 21 aa, Plasmodium falciparum
INESLKFLKHDVDNSILNFQY

SEQ ID NO: 3360032 - protein, 20 aa, Plasmodium falciparum
INESYPFFLQNNIKDNKKNS

SEQ ID NO: 3360033 - protein, 27 aa, Plasmodium falciparum
INETQCFWLEYNISLSYVNNHPNIHLI

SEQ ID NO: 3360034 - protein, 17 aa, Plasmodium falciparum
INEWNKISFCIVPNEKK

SEQ ID NO: 3360035 - protein, 21 aa, Plasmodium falciparum
INFCRKEIFIQLQKAYIFSKM

SEQ ID NO: 3360036 - protein, 17 aa, Plasmodium falciparum
INFENICARHATSKIKD

SEQ ID NO: 3360037 - protein, 31 aa, Plasmodium falciparum
INFIKKYETIPSLIICGDFNSTPSSAVYQLI

SEQ ID NO: 3360038 - protein, 25 aa, Plasmodium falciparum
INFKAEGLSTISLKEKLNFILETLN

SEQ ID NO: 3360039 - protein, 23 aa, Plasmodium falciparum
INFKRRIILDGINFSQNFSYSNF

SEQ ID NO: 3360040 - protein, 17 aa, Plasmodium falciparum
INFLILNFLNKLKKKKK

SEQ ID NO: 3360041 - protein, 19 aa, Plasmodium falciparum
INFRCLKQEINIPLYYNLP

SEQ ID NO: 3360042 - protein, 19 aa, Plasmodium falciparum
INFRRKRNVSSSSKDDKIN

SEQ ID NO: 3360043 - protein, 20 aa, Plasmodium falciparum
INFVEELFFLITQLLIHFKH

SEQ ID NO: 3360044 - protein, 17 aa, Plasmodium falciparum
INFVLLREIKIMKEIKH

SEQ ID NO: 3360045 - protein, 21 aa, Plasmodium falciparum
INFYDLCSTFFDYIKKKNIIH

SEQ ID NO: 3360046 - protein, 17 aa, Plasmodium falciparum
INGKENIFAVEKVGINE

SEQ ID NO: 3360047 - protein, 26 aa, Plasmodium falciparum
INGKYKIVLYGGGLLDYDFTKNYASE

SEQ ID NO: 3360048 - protein, 36 aa, Plasmodium falciparum
INGNHVVQKCLITLTSHQCDFIYEAILNNCVEVSTH

SEQ ID NO: 3360049 - protein, 19 aa, Plasmodium falciparum
INGTELLGNCLNKFFNILI

SEQ ID NO: 3360050 - protein, 33 aa, Plasmodium falciparum
INHALLPIRNCYSRFGGGWVMSGSEDGNIYICS

SEQ ID NO: 3360051 - protein, 18 aa, Plasmodium falciparum
INHDEIFKPIAYEKNGIN

SEQ ID NO: 3360052 - protein, 25 aa, Plasmodium falciparum
INHEYYKKLTPLKVKNENDEDEDIK

SEQ ID NO: 3360053 - protein, 17 aa, Plasmodium falciparum
INHLKLSNLEFKDKIIK

SEQ ID NO: 3360054 - protein, 30 aa, Plasmodium falciparum
INHNFRLSPNIKKKLNIMDIYNLYDGRDVE

SEQ ID NO: 3360055 - protein, 18 aa, Plasmodium falciparum
INHSCSPNSVSQKWIVRG

SEQ ID NO: 3360056 - protein, 25 aa, Plasmodium falciparum
INHYSGDINICLGNNVKGEDHTFVN

SEQ ID NO: 3360057 - protein, 18 aa, Plasmodium falciparum
INIFYKWLDLSVMHLHKK

SEQ ID NO: 3360058 - protein, 21 aa, Plasmodium falciparum
INIHDEWKQTIIIPKKIEQKL

SEQ ID NO: 3360059 - protein, 21 aa, Plasmodium falciparum
INIIDLKGLVTIEVKLLNGIS

SEQ ID NO: 3360060 - protein, 23 aa, Plasmodium falciparum
INIKDLRLIYFYKHNIKMKKEKN

SEQ ID NO: 3360061 - protein, 24 aa, Plasmodium falciparum
INIKEARIIISICENMIDNDINPD

SEQ ID NO: 3360062 - protein, 17 aa, Plasmodium falciparum
INIKNCDSISRDILNNE

SEQ ID NO: 3360063 - protein, 18 aa, Plasmodium falciparum
INIKNIIPYMKKNNYEFD

SEQ ID NO: 3360064 - protein, 19 aa, Plasmodium falciparum
INILFSFHNACLSNYNKLD

SEQ ID NO: 3360065 - protein, 18 aa, Plasmodium falciparum
INILLQLQHDNILSIKEV

SEQ ID NO: 3360066 - protein, 18 aa, Plasmodium falciparum
ININCNMIYNMIYNNNNN

SEQ ID NO: 3360067 - protein, 21 aa, Plasmodium falciparum
INIPQKNNFTLNSNKNDVVMN

SEQ ID NO: 3360068 - protein, 22 aa, Plasmodium falciparum
INIQLFFKYIFSLLSNIIQMKE

SEQ ID NO: 3360069 - protein, 24 aa, Plasmodium falciparum
INIRLPLSLQYKILKFRSLLSNKC

SEQ ID NO: 3360070 - protein, 25 aa, Plasmodium falciparum
INISFPYRFDLLYNVIINVYEETHM

SEQ ID NO: 3360071 - protein, 33 aa, Plasmodium falciparum
INITIPPGLSLPDINRALLHSAYLDNITVVKKC

SEQ ID NO: 3360072 - protein, 20 aa, Plasmodium falciparum
INIWKRVRRNVSYGYYNINI

SEQ ID NO: 3360073 - protein, 27 aa, Plasmodium falciparum
INIYKFHLIKYKWHSHSVYNLEIDGRK

SEQ ID NO: 3360074 - protein, 23 aa, Plasmodium falciparum
INIYRLKYIYLLITSDNYLFNNF

SEQ ID NO: 3360075 - protein, 18 aa, Plasmodium falciparum
INKDDFIILISLSIFNEI

SEQ ID NO: 3360076 - protein, 23 aa, Plasmodium falciparum
INKEEVYDIINIYITDEEYDLNG

SEQ ID NO: 3360077 - protein, 22 aa, Plasmodium falciparum
INKEFCAYIKFHRGDPNFSGSK

SEQ ID NO: 3360078 - protein, 33 aa, Plasmodium falciparum
INKEKEDWSRLKIKLVKDFQHKAALLKEEMVEE

SEQ ID NO: 3360079 - protein, 17 aa, Plasmodium falciparum
INKELPITFRVLNNNKY

SEQ ID NO: 3360080 - protein, 22 aa, Plasmodium falciparum
INKEPLIPMVPWYKDFKGRIES

SEQ ID NO: 3360081 - protein, 18 aa, Plasmodium falciparum
INKFNYYFVKLFINNKWY

SEQ ID NO: 3360082 - protein, 22 aa, Plasmodium falciparum
INKFYYYFKEFLLKEKYNTKDD

SEQ ID NO: 3360083 - protein, 18 aa, Plasmodium falciparum
INKGILFMELLLYDIKFY

SEQ ID NO: 3360084 - protein, 17 aa, Plasmodium falciparum
INKIFFLEKNKVLLYKI

SEQ ID NO: 3360085 - protein, 24 aa, Plasmodium falciparum
INKIIKHFNKAVIPQKLIKDRNQS

SEQ ID NO: 3360086 - protein, 31 aa, Plasmodium falciparum
INKILCLSKYKILLIGFQFINYINIVKEKRR

SEQ ID NO: 3360087 - protein, 19 aa, Plasmodium falciparum
INKIPELFFDISEISEYSS

SEQ ID NO: 3360088 - protein, 25 aa, Plasmodium falciparum
INKIVRKGAHGVVFSAWRSENVDFF

SEQ ID NO: 3360089 - protein, 27 aa, Plasmodium falciparum
INKIYKYPIKYCELNSKAFVFFIIKNV

SEQ ID NO: 3360090 - protein, 20 aa, Plasmodium falciparum
INKKISYPINMNYSNSEDKT

SEQ ID NO: 3360091 - protein, 21 aa, Plasmodium falciparum
INKKKRFIFLLSSVGKELLLD

SEQ ID NO: 3360092 - protein, 19 aa, Plasmodium falciparum
INKKLKYCKKCCNNDISKC

SEQ ID NO: 3360093 - protein, 25 aa, Plasmodium falciparum
INKKMAWKQKLFVYLKKIPTQEKQQ

SEQ ID NO: 3360094 - protein, 26 aa, Plasmodium falciparum
INKKMPIEILHFFDYYINRKNELDKT

SEQ ID NO: 3360095 - protein, 17 aa, Plasmodium falciparum
INKKYGSTFTFINNKWV

SEQ ID NO: 3360096 - protein, 26 aa, Plasmodium falciparum
INKLCKKKSFSGLKLQNIEKMDILEK

SEQ ID NO: 3360097 - protein, 22 aa, Plasmodium falciparum
INKLNGDIWQYKDPSGNVQGPF

SEQ ID NO: 3360098 - protein, 29 aa, Plasmodium falciparum
INKLPRVLTIQIKRFFMNSNFDIVKNHKN

SEQ ID NO: 3360099 - protein, 17 aa, Plasmodium falciparum
INKMIIRIKARIHHIII

SEQ ID NO: 3360100 - protein, 20 aa, Plasmodium falciparum
INKMIKRNVTYLNIKENDKN

SEQ ID NO: 3360101 - protein, 17 aa, Plasmodium falciparum
INKNGDILNSFNGNALP

SEQ ID NO: 3360102 - protein, 25 aa, Plasmodium falciparum
INKNLCSFTLPLNVLQLIERKYAFN

SEQ ID NO: 3360103 - protein, 26 aa, Plasmodium falciparum
INKNLCSIYAFTPMIIKKFAEKINSY

SEQ ID NO: 3360104 - protein, 23 aa, Plasmodium falciparum
INKQQRLGTEFIKSNNREKLNGN

SEQ ID NO: 3360105 - protein, 25 aa, Plasmodium falciparum
INKRNSISKGTSRRHNHNNNNNNNN

SEQ ID NO: 3360106 - protein, 19 aa, Plasmodium falciparum
INKSVLFLPSLAIHLQNRT

SEQ ID NO: 3360107 - protein, 18 aa, Plasmodium falciparum
INKYKKKMIIPSYEENDE

SEQ ID NO: 3360108 - protein, 25 aa, Plasmodium falciparum
INLEEINKYISLFIAYNIGFPIDLS

SEQ ID NO: 3360109 - protein, 25 aa, Plasmodium falciparum
INLFNRIPKNGVFNLSSENYENKEE

SEQ ID NO: 3360110 - protein, 23 aa, Plasmodium falciparum
INLFRIKNVQSFQEIKKILKSNI

SEQ ID NO: 3360111 - protein, 17 aa, Plasmodium falciparum
INLFYSKFFQDYITNPV

SEQ ID NO: 3360112 - protein, 25 aa, Plasmodium falciparum
INLHYPVDIELIYYLFSKCGTVEKI

SEQ ID NO: 3360113 - protein, 18 aa, Plasmodium falciparum
INLIFDKWTILRLAVTNN

SEQ ID NO: 3360114 - protein, 18 aa, Plasmodium falciparum
INLINCIFYTIKEERNKF

SEQ ID NO: 3360115 - protein, 18 aa, Plasmodium falciparum
INLKENIHLYKMFQGQKP

SEQ ID NO: 3360116 - protein, 24 aa, Plasmodium falciparum
INLKLMETRFSKNVASSRTTKRKR

SEQ ID NO: 3360117 - protein, 19 aa, Plasmodium falciparum
INLKSFTKYISFIAEVERE

SEQ ID NO: 3360118 - protein, 18 aa, Plasmodium falciparum
INLLKCIYVVIDEADRLL

SEQ ID NO: 3360119 - protein, 20 aa, Plasmodium falciparum
INLLNSLYMLHPYFKNHKTK

SEQ ID NO: 3360120 - protein, 24 aa, Plasmodium falciparum
INLMKRLLCRLPQGRIGCSINGFK

SEQ ID NO: 3360121 - protein, 17 aa, Plasmodium falciparum
INLMLNKSMTLYLNYFN

SEQ ID NO: 3360122 - protein, 18 aa, Plasmodium falciparum
INLMNEFLEKVQIIKNTN

SEQ ID NO: 3360123 - protein, 17 aa, Plasmodium falciparum
INLNENIFIGSRDMNSS

SEQ ID NO: 3360124 - protein, 17 aa, Plasmodium falciparum
INLNFLWVCDPVMGDNG

SEQ ID NO: 3360125 - protein, 31 aa, Plasmodium falciparum
INLPDEKEFNCSVCNNMMIFLLQIYAPLDEL

SEQ ID NO: 3360126 - protein, 17 aa, Plasmodium falciparum
INLPIEVFVCKNYSIFE

SEQ ID NO: 3360127 - protein, 23 aa, Plasmodium falciparum
INLPPSLFSRFDLIYLVIDQANE

SEQ ID NO: 3360128 - protein, 21 aa, Plasmodium falciparum
INLYFIIPFVYLKVVLIKNRK

SEQ ID NO: 3360129 - protein, 45 aa, Plasmodium falciparum
INLYSCPNCKGPFLMCPNCHCRYPRFCVNDNKIAMECEYCDCEHC

SEQ ID NO: 3360130 - protein, 19 aa, Plasmodium falciparum
INMCRCIFADLFKKDRLYK

SEQ ID NO: 3360131 - protein, 19 aa, Plasmodium falciparum
INMFFCKYNEPAYVKMEKL

SEQ ID NO: 3360132 - protein, 21 aa, Plasmodium falciparum
INMLNQIPFIFSYKKKKIKNL

SEQ ID NO: 3360133 - protein, 26 aa, Plasmodium falciparum
INMNYCFKYLYYYFTIHQQIVISNNF

SEQ ID NO: 3360134 - protein, 17 aa, Plasmodium falciparum
INMRVGNVNYMMKYGPS

SEQ ID NO: 3360135 - protein, 17 aa, Plasmodium falciparum
INMYIKKHELFKKKLND

SEQ ID NO: 3360136 - protein, 18 aa, Plasmodium falciparum
INNACKYNKCVENRKEMY

SEQ ID NO: 3360137 - protein, 22 aa, Plasmodium falciparum
INNCFLHNKMECNIENIKEDKN

SEQ ID NO: 3360138 - protein, 28 aa, Plasmodium falciparum
INNCYEDHFPFFLLPKEDSMILENMELY

SEQ ID NO: 3360139 - protein, 17 aa, Plasmodium falciparum
INNDILRDINMKKNNNK

SEQ ID NO: 3360140 - protein, 19 aa, Plasmodium falciparum
INNEWYNKQFVNISNKNIP

SEQ ID NO: 3360141 - protein, 18 aa, Plasmodium falciparum
INNFLLNQHFNFNKNDNI

SEQ ID NO: 3360142 - protein, 31 aa, Plasmodium falciparum
INNFNEVFFFLKLWLSSFNIGKSIHCKKLIY

SEQ ID NO: 3360143 - protein, 25 aa, Plasmodium falciparum
INNFRICSLSGIYKKYSFFKKYYES

SEQ ID NO: 3360144 - protein, 18 aa, Plasmodium falciparum
INNFSIICEINYIVQNII

SEQ ID NO: 3360145 - protein, 24 aa, Plasmodium falciparum
INNFYPFHFYPSCYISQQQKRKSQ

SEQ ID NO: 3360146 - protein, 26 aa, Plasmodium falciparum
INNGIYCIGHIILLQGRMKLLNKTFY

SEQ ID NO: 3360147 - protein, 20 aa, Plasmodium falciparum
INNHVASVMFIDWSSSGYIL

SEQ ID NO: 3360148 - protein, 25 aa, Plasmodium falciparum
INNIFSTIISFHIHNIEDKYKKVYE

SEQ ID NO: 3360149 - protein, 23 aa, Plasmodium falciparum
INNKCFFEKNIPLVFASHEDKQV

SEQ ID NO: 3360150 - protein, 18 aa, Plasmodium falciparum
INNKDIRGTNLYNTKLCN

SEQ ID NO: 3360151 - protein, 17 aa, Plasmodium falciparum
INNKGKVLLPVFALGRA

SEQ ID NO: 3360152 - protein, 19 aa, Plasmodium falciparum
INNKMNWQKKGFMLEQNRE

SEQ ID NO: 3360153 - protein, 24 aa, Plasmodium falciparum
INNKRISIYYPFYIINDDKNNKPQ

SEQ ID NO: 3360154 - protein, 23 aa, Plasmodium falciparum
INNKSPCCNVSINREMNNNNNNN

SEQ ID NO: 3360155 - protein, 19 aa, Plasmodium falciparum
INNLMEHFFSFLLRKTDFI

SEQ ID NO: 3360156 - protein, 18 aa, Plasmodium falciparum
INNMFKMAAQQSVQNGLS

SEQ ID NO: 3360157 - protein, 26 aa, Plasmodium falciparum
INNNFELCGGISKKLNHFIFQNHTKL

SEQ ID NO: 3360158 - protein, 17 aa, Plasmodium falciparum
INNNILDFNKYVYKDKM

SEQ ID NO: 3360159 - protein, 24 aa, Plasmodium falciparum
INNNKSCDNTYCYSDHTNNSNKHY

SEQ ID NO: 3360160 - protein, 39 aa, Plasmodium falciparum
INNNLDIFNIFFIMNIFKYSLKYKKLAIILATHDFFLVS

SEQ ID NO: 3360161 - protein, 17 aa, Plasmodium falciparum
INNNLPFNKRDDEDIIL

SEQ ID NO: 3360162 - protein, 17 aa, Plasmodium falciparum
INNVDIKNCFKNYYLKL

SEQ ID NO: 3360163 - protein, 23 aa, Plasmodium falciparum
INNYDIFSILSIPNMNNNDNNND

SEQ ID NO: 3360164 - protein, 18 aa, Plasmodium falciparum
INPFKPNHKYSIMSDDYK

SEQ ID NO: 3360165 - protein, 27 aa, Plasmodium falciparum
INPGEEIFADFGFEWFEKVNDICLNEF

SEQ ID NO: 3360166 - protein, 33 aa, Plasmodium falciparum
INPKRKNYIFLFKYNKFFYKMLENHREERNLIR

SEQ ID NO: 3360167 - protein, 18 aa, Plasmodium falciparum
INPLYVCGDKIIALDARF

SEQ ID NO: 3360168 - protein, 24 aa, Plasmodium falciparum
INPSEYKNVVLIKRRGRSNRMWVD

SEQ ID NO: 3360169 - protein, 32 aa, Plasmodium falciparum
INPYYAKAYYRKGCSYLLLSDLKRASECFQKV

SEQ ID NO: 3360170 - protein, 18 aa, Plasmodium falciparum
INQGMMPGITNLRSSHFM

SEQ ID NO: 3360171 - protein, 18 aa, Plasmodium falciparum
INQKPEFTIHPGANATNN

SEQ ID NO: 3360172 - protein, 23 aa, Plasmodium falciparum
INQLCGGQSFTVCLLNNNDLYIW

SEQ ID NO: 3360173 - protein, 17 aa, Plasmodium falciparum
INQRLMLYMIMACSNKG

SEQ ID NO: 3360174 - protein, 25 aa, Plasmodium falciparum
INQWKLRLRDSAPLAYIEFIDRPGE

SEQ ID NO: 3360175 - protein, 28 aa, Plasmodium falciparum
INRDHFKKYFFLLLYRYHISRHTYPNYV

SEQ ID NO: 3360176 - protein, 26 aa, Plasmodium falciparum
INREELKSGFDYDQIHVINLTNSEKI

SEQ ID NO: 3360177 - protein, 27 aa, Plasmodium falciparum
INREVSKCKFVDGLIYDEANKCFRIKI

SEQ ID NO: 3360178 - protein, 20 aa, Plasmodium falciparum
INRHNFYLTILEGMNKNFPR

SEQ ID NO: 3360179 - protein, 23 aa, Plasmodium falciparum
INRIKFGMISSGIFASCSDDGTA

SEQ ID NO: 3360180 - protein, 25 aa, Plasmodium falciparum
INRIKSLYADSWRNTLIPSTYILPF

SEQ ID NO: 3360181 - protein, 18 aa, Plasmodium falciparum
INRIPKYVINGFLKNYRQ

SEQ ID NO: 3360182 - protein, 21 aa, Plasmodium falciparum
INRLYQIIVITLEFNEKSCID

SEQ ID NO: 3360183 - protein, 17 aa, Plasmodium falciparum
INRMKRCLKIMGRSEGE

SEQ ID NO: 3360184 - protein, 17 aa, Plasmodium falciparum
INRNLKVLISINQDTSN

SEQ ID NO: 3360185 - protein, 17 aa, Plasmodium falciparum
INRNSLSVKSNIELNKD

SEQ ID NO: 3360186 - protein, 20 aa, Plasmodium falciparum
INRPLRYVENLSLNNISSIF

SEQ ID NO: 3360187 - protein, 28 aa, Plasmodium falciparum
INSASKYKYVCYFLEEFFFHKQKISQKV

SEQ ID NO: 3360188 - protein, 19 aa, Plasmodium falciparum
INSCCRIFYDKPIEFLHII

SEQ ID NO: 3360189 - protein, 17 aa, Plasmodium falciparum
INSCYSTNEPNEYCDRN

SEQ ID NO: 3360190 - protein, 24 aa, Plasmodium falciparum
INSEIDLLSGILFIYEKDYKSAYI

SEQ ID NO: 3360191 - protein, 17 aa, Plasmodium falciparum
INSEILFFKNTYLMIKR

SEQ ID NO: 3360192 - protein, 24 aa, Plasmodium falciparum
INSEIRRVSDHIVVDYSKNNHKNK

SEQ ID NO: 3360193 - protein, 22 aa, Plasmodium falciparum
INSEMFFNIFLNIHIDQNIFII

SEQ ID NO: 3360194 - protein, 23 aa, Plasmodium falciparum
INSFFFKKYFCKEEKKKKKKYIS

SEQ ID NO: 3360195 - protein, 25 aa, Plasmodium falciparum
INSFGNNGELCFATWEINQAKMYTN

SEQ ID NO: 3360196 - protein, 27 aa, Plasmodium falciparum
INSFIKSIREWRRWFNYLQVENLVFPD

SEQ ID NO: 3360197 - protein, 23 aa, Plasmodium falciparum
INSFKRFNMVKINLMRDSSTSSK

SEQ ID NO: 3360198 - protein, 25 aa, Plasmodium falciparum
INSILFYYKRYYSLKKPLNEENIYN

SEQ ID NO: 3360199 - protein, 17 aa, Plasmodium falciparum
INSIPNFFKANLLFCVS

SEQ ID NO: 3360200 - protein, 22 aa, Plasmodium falciparum
INSIRTFFLINCFGTVGCILHN

SEQ ID NO: 3360201 - protein, 21 aa, Plasmodium falciparum
INSKFSYPHCVNNIDSCYIYI

SEQ ID NO: 3360202 - protein, 23 aa, Plasmodium falciparum
INSKSYRSYSCISDRSYYRNKKE

SEQ ID NO: 3360203 - protein, 18 aa, Plasmodium falciparum
INSLKNLLFIKGTIGGYK

SEQ ID NO: 3360204 - protein, 26 aa, Plasmodium falciparum
INSLPPYLIVHFLRFESKKIVESNNS

SEQ ID NO: 3360205 - protein, 21 aa, Plasmodium falciparum
INSNFDSFILKKLKIINDPDC

SEQ ID NO: 3360206 - protein, 24 aa, Plasmodium falciparum
INSNHLYYPFPFHNNVNSPKMVGM

SEQ ID NO: 3360207 - protein, 26 aa, Plasmodium falciparum
INSNLNIKGCISLAGMISVRMVGSID

SEQ ID NO: 3360208 - protein, 26 aa, Plasmodium falciparum
INSNMYNMFFGLYGMQFVEFTIPVFY

SEQ ID NO: 3360209 - protein, 20 aa, Plasmodium falciparum
INSPIGIKFKDIFGKFQDIN

SEQ ID NO: 3360210 - protein, 23 aa, Plasmodium falciparum
INSRKRKSSILLYNKDEKNTHKN

SEQ ID NO: 3360211 - protein, 24 aa, Plasmodium falciparum
INSSSFNIPPGFNMSQDKEQNNNY

SEQ ID NO: 3360212 - protein, 24 aa, Plasmodium falciparum
INSYEFLLDILIFFNNNNIMQGEI

SEQ ID NO: 3360213 - protein, 19 aa, Plasmodium falciparum
INTDCFNYTNSIDEMDDIN

SEQ ID NO: 3360214 - protein, 18 aa, Plasmodium falciparum
INTFNYSKPLGCLPPNIS

SEQ ID NO: 3360215 - protein, 19 aa, Plasmodium falciparum
INTLSERTLSEYLLNKNTS

SEQ ID NO: 3360216 - protein, 24 aa, Plasmodium falciparum
INTMKAPAYFSALPMGMEKDKVNI

SEQ ID NO: 3360217 - protein, 23 aa, Plasmodium falciparum
INTQMMPIHFRKNVTSTKKQGKS

SEQ ID NO: 3360218 - protein, 23 aa, Plasmodium falciparum
INTTYFIHFMKPFLSSHNNEDDL

SEQ ID NO: 3360219 - protein, 18 aa, Plasmodium falciparum
INVDVMNPLYKRYLVEKR

SEQ ID NO: 3360220 - protein, 20 aa, Plasmodium falciparum
INVGNYRKAYLRSKYNDHLL

SEQ ID NO: 3360221 - protein, 18 aa, Plasmodium falciparum
INVIKEFRNVAGSITPHH

SEQ ID NO: 3360222 - protein, 21 aa, Plasmodium falciparum
INVKDAYDFYSRNIPPTENIN

SEQ ID NO: 3360223 - protein, 17 aa, Plasmodium falciparum
INVKLLDDISHLYMIAN

SEQ ID NO: 3360224 - protein, 26 aa, Plasmodium falciparum
INVLKYSNFIYFHIFMICVTYANQTK

SEQ ID NO: 3360225 - protein, 22 aa, Plasmodium falciparum
INVPCSIIGLIGCPAYINGYHV

SEQ ID NO: 3360226 - protein, 25 aa, Plasmodium falciparum
INVPNIDPSLFLERFAHKLNLKNDI

SEQ ID NO: 3360227 - protein, 27 aa, Plasmodium falciparum
INVPSTSRCYFALSLQSYRHDNPENST

SEQ ID NO: 3360228 - protein, 18 aa, Plasmodium falciparum
INVPVKYNPEVVINNELH

SEQ ID NO: 3360229 - protein, 25 aa, Plasmodium falciparum
INVSAQCKGILLSTVSPRKMSSGIK

SEQ ID NO: 3360230 - protein, 27 aa, Plasmodium falciparum
INVVMQCLSVFFKLIYTLHNYVTVKYK

SEQ ID NO: 3360231 - protein, 17 aa, Plasmodium falciparum
INYDEGAWFNNNQMNGT

SEQ ID NO: 3360232 - protein, 18 aa, Plasmodium falciparum
INYDICKLIADIGKGLII

SEQ ID NO: 3360233 - protein, 22 aa, Plasmodium falciparum
INYEAAVCIRKLVKNNNFQNNI

SEQ ID NO: 3360234 - protein, 23 aa, Plasmodium falciparum
INYKDIFNFISISIIEGGNNLLP

SEQ ID NO: 3360235 - protein, 18 aa, Plasmodium falciparum
INYKGYKFKQNYHTNAYV

SEQ ID NO: 3360236 - protein, 41 aa, Plasmodium falciparum
INYLCDDIPMGRFGMNLVWSDTNTICLFGGEYCEISKTHKE

SEQ ID NO: 3360237 - protein, 24 aa, Plasmodium falciparum
INYLKKLYITISFNNIILLEIVGY

SEQ ID NO: 3360238 - protein, 24 aa, Plasmodium falciparum
INYLKNIFWTLSINYKINHIIKIF

SEQ ID NO: 3360239 - protein, 17 aa, Plasmodium falciparum
INYLKPPVMNLIRNNIY

SEQ ID NO: 3360240 - protein, 25 aa, Plasmodium falciparum
INYMKVKGKGECCHKNQQIMYEHYD

SEQ ID NO: 3360241 - protein, 24 aa, Plasmodium falciparum
INYNNKIDICFSVYKEGDDFEDDG

SEQ ID NO: 3360242 - protein, 29 aa, Plasmodium falciparum
INYPLGNKLFFRLKISNIYYKCNEYDILD

SEQ ID NO: 3360243 - protein, 23 aa, Plasmodium falciparum
INYTCKGYNSLTFQIFSNNHDVW

SEQ ID NO: 3360244 - protein, 25 aa, Plasmodium falciparum
INYTCKLNNLKIVIVDELDFIATRN

SEQ ID NO: 3360245 - protein, 17 aa, Plasmodium falciparum
INYVIFLFSKRLHKENQ

SEQ ID NO: 3360246 - protein, 28 aa, Plasmodium falciparum
INYYNSIKSDFFFLNYISISKYILLILS

SEQ ID NO: 3360247 - protein, 22 aa, Plasmodium falciparum
IPAAIPFLRIMHVIKDNTGNEF

SEQ ID NO: 3360248 - protein, 17 aa, Plasmodium falciparum
IPAENYPFCTIDPHEAK

SEQ ID NO: 3360249 - protein, 23 aa, Plasmodium falciparum
IPALMCGRDVIAIAETGSGKTLS

SEQ ID NO: 3360250 - protein, 24 aa, Plasmodium falciparum
IPAVKGIEFGSGFNGTYMFGSMHN

SEQ ID NO: 3360251 - protein, 23 aa, Plasmodium falciparum
IPCDERMMYRYNTMEGVGPCHNI

SEQ ID NO: 3360252 - protein, 20 aa, Plasmodium falciparum
IPCSTLFEYVNELMKGNDYK

SEQ ID NO: 3360253 - protein, 29 aa, Plasmodium falciparum
IPDADMKPPENILFVCKLNPVTEEEDLKI

SEQ ID NO: 3360254 - protein, 24 aa, Plasmodium falciparum
IPDNLKILYDYYLKIQSTVGVTEC

SEQ ID NO: 3360255 - protein, 19 aa, Plasmodium falciparum
IPDVLLDRVEIIHIHAYTN

SEQ ID NO: 3360256 - protein, 20 aa, Plasmodium falciparum
IPDYRPLKSGDIINIDISVF

SEQ ID NO: 3360257 - protein, 22 aa, Plasmodium falciparum
IPEEFLLYFKDIIKLNKLYEHS

SEQ ID NO: 3360258 - protein, 19 aa, Plasmodium falciparum
IPEGGKLCVSILYDQYLPL

SEQ ID NO: 3360259 - protein, 22 aa, Plasmodium falciparum
IPERKYRTKAADHYRKILRSIV

SEQ ID NO: 3360260 - protein, 19 aa, Plasmodium falciparum
IPFEIYLKDFYPIEKICEL

SEQ ID NO: 3360261 - protein, 25 aa, Plasmodium falciparum
IPFGDEHFDALSFDEYRKRINSKKS

SEQ ID NO: 3360262 - protein, 20 aa, Plasmodium falciparum
IPGIDIIHLCYYIPNLKQYY

SEQ ID NO: 3360263 - protein, 18 aa, Plasmodium falciparum
IPGLLSIFQTEWDSIISE

SEQ ID NO: 3360264 - protein, 18 aa, Plasmodium falciparum
IPGVLRFDNNIDVNTEIV

SEQ ID NO: 3360265 - protein, 17 aa, Plasmodium falciparum
IPGVPILYAKNFKYKIE

SEQ ID NO: 3360266 - protein, 23 aa, Plasmodium falciparum
IPIALEMRDLIGIAETGSGKTAA

SEQ ID NO: 3360267 - protein, 17 aa, Plasmodium falciparum
IPIMKGDLDKYLNMSNF

SEQ ID NO: 3360268 - protein, 17 aa, Plasmodium falciparum
IPINGRFTAKALCKLFA

SEQ ID NO: 3360269 - protein, 26 aa, Plasmodium falciparum
IPINLFNFIGTVAFDSIRFIQNKLSK

SEQ ID NO: 3360270 - protein, 21 aa, Plasmodium falciparum
IPINLPVPYIVPKPKIIDVDV

SEQ ID NO: 3360271 - protein, 24 aa, Plasmodium falciparum
IPIPQYKPILFQNGITVSWPESDG

SEQ ID NO: 3360272 - protein, 21 aa, Plasmodium falciparum
IPKDIPILFVHSVDDCACYYN

SEQ ID NO: 3360273 - protein, 17 aa, Plasmodium falciparum
IPKEHLENGLFYKNVEF

SEQ ID NO: 3360274 - protein, 27 aa, Plasmodium falciparum
IPKILCPGSGLGRLPYEIAKKGYRSQG

SEQ ID NO: 3360275 - protein, 25 aa, Plasmodium falciparum
IPKKEEIENFVSLFYKSKDKNKSKK

SEQ ID NO: 3360276 - protein, 25 aa, Plasmodium falciparum
IPKKGECDRLYKFVTSLSNFFCLEK

SEQ ID NO: 3360277 - protein, 21 aa, Plasmodium falciparum
IPKLYEYNNMISICNNEKDII

SEQ ID NO: 3360278 - protein, 27 aa, Plasmodium falciparum
IPKNESNLFLSIYVLNFISNIQHKILD

SEQ ID NO: 3360279 - protein, 19 aa, Plasmodium falciparum
IPKNIPILFIHSKTDNICT

SEQ ID NO: 3360280 - protein, 40 aa, Plasmodium falciparum
IPKREERENLGLLKRNGWRDLICSTFLEDVHENISSILKI

SEQ ID NO: 3360281 - protein, 17 aa, Plasmodium falciparum
IPLANLFDHVISIDYSI

SEQ ID NO: 3360282 - protein, 22 aa, Plasmodium falciparum
IPLEYLRRVLCFHIMNYEIDIK

SEQ ID NO: 3360283 - protein, 17 aa, Plasmodium falciparum
IPLFKEINKEIFEKLPL

SEQ ID NO: 3360284 - protein, 18 aa, Plasmodium falciparum
IPLFNFYEMFLFVLCFSK

SEQ ID NO: 3360285 - protein, 32 aa, Plasmodium falciparum
IPLKENKIVTSLCFYFDCLFDKSTYYIKNNTH

SEQ ID NO: 3360286 - protein, 17 aa, Plasmodium falciparum
IPLLERWLSNLLARQFE

SEQ ID NO: 3360287 - protein, 22 aa, Plasmodium falciparum
IPLPPKKNHRVWFHVILSRDIP

SEQ ID NO: 3360288 - protein, 18 aa, Plasmodium falciparum
IPLSCVIKNRKTRRSRKN

SEQ ID NO: 3360289 - protein, 21 aa, Plasmodium falciparum
IPLTPPLPILPNFLNIPFIDN

SEQ ID NO: 3360290 - protein, 25 aa, Plasmodium falciparum
IPMFTSSGMYIRYLKVFEKSNYKII

SEQ ID NO: 3360291 - protein, 18 aa, Plasmodium falciparum
IPMKVQLFHYIKYINNDN

SEQ ID NO: 3360292 - protein, 17 aa, Plasmodium falciparum
IPMLYLSNVCNNIYYFL

SEQ ID NO: 3360293 - protein, 29 aa, Plasmodium falciparum
IPMNARGSTSFMIPPKINNRIGNILPSNI

SEQ ID NO: 3360294 - protein, 17 aa, Plasmodium falciparum
IPMNINVNFSLNNIYDD

SEQ ID NO: 3360295 - protein, 17 aa, Plasmodium falciparum
IPMNYYLNICTNDDEEK

SEQ ID NO: 3360296 - protein, 23 aa, Plasmodium falciparum
IPNCSLATLIGLMISIKLQYSLC

SEQ ID NO: 3360297 - protein, 17 aa, Plasmodium falciparum
IPNEMSFTTDKSSSKYI

SEQ ID NO: 3360298 - protein, 20 aa, Plasmodium falciparum
IPNERLRFYCICKKKNYDFK

SEQ ID NO: 3360299 - protein, 18 aa, Plasmodium falciparum
IPNFLLKCFKNYTKFSEP

SEQ ID NO: 3360300 - protein, 22 aa, Plasmodium falciparum
IPNHFLPMYNMFNYPNAQYQNM

SEQ ID NO: 3360301 - protein, 18 aa, Plasmodium falciparum
IPNIIGSKIPHFNLYTLD

SEQ ID NO: 3360302 - protein, 21 aa, Plasmodium falciparum
IPNIYPIKVNVIYKLLNIIKK

SEQ ID NO: 3360303 - protein, 21 aa, Plasmodium falciparum
IPNKSDIPFNEDIHYNIKKNS

SEQ ID NO: 3360304 - protein, 17 aa, Plasmodium falciparum
IPNNLYVTVEMNVETEH

SEQ ID NO: 3360305 - protein, 17 aa, Plasmodium falciparum
IPNYKYEQDDVYVEIIE

SEQ ID NO: 3360306 - protein, 18 aa, Plasmodium falciparum
IPPDQQRLIFAGKQLEDG

SEQ ID NO: 3360307 - protein, 25 aa, Plasmodium falciparum
IPPHKICGMAGVLHSARLRHNLAEK

SEQ ID NO: 3360308 - protein, 21 aa, Plasmodium falciparum
IPPKTKLNCFIAAKHEEDKIF

SEQ ID NO: 3360309 - protein, 29 aa, Plasmodium falciparum
IPPNFFLCYYKNCRVYLKGFTHKKEKYIY

SEQ ID NO: 3360310 - protein, 17 aa, Plasmodium falciparum
IPQNVPILFIHSRHDSV

SEQ ID NO: 3360311 - protein, 17 aa, Plasmodium falciparum
IPQPFYADIHRPNHFLQ

SEQ ID NO: 3360312 - protein, 22 aa, Plasmodium falciparum
IPRKMCPYQQMQLCENKYNYIK

SEQ ID NO: 3360313 - protein, 19 aa, Plasmodium falciparum
IPRLKEIFLTSKLTSKPMI

SEQ ID NO: 3360314 - protein, 17 aa, Plasmodium falciparum
IPSHPNLHTYGVPCSPF

SEQ ID NO: 3360315 - protein, 36 aa, Plasmodium falciparum
IPSIYVKKSNKRICNGDFYKHIDTIIPEEGQHEKNI

SEQ ID NO: 3360316 - protein, 17 aa, Plasmodium falciparum
IPSKVDKDIKRRKKKEH

SEQ ID NO: 3360317 - protein, 22 aa, Plasmodium falciparum
IPSNIKFNFLNEINIIPTNLSV

SEQ ID NO: 3360318 - protein, 21 aa, Plasmodium falciparum
IPSNIPLTMLILQHMEEKTKN

SEQ ID NO: 3360319 - protein, 24 aa, Plasmodium falciparum
IPSNKHFYGSLALNLFFQNKSIND

SEQ ID NO: 3360320 - protein, 21 aa, Plasmodium falciparum
IPSSKTKYFFKNKKFQDHNMS

SEQ ID NO: 3360321 - protein, 29 aa, Plasmodium falciparum
IPTFQDIFITKSCPTIATVAFKNEEERNY

SEQ ID NO: 3360322 - protein, 17 aa, Plasmodium falciparum
IPTIGLWISSGSKYENK

SEQ ID NO: 3360323 - protein, 26 aa, Plasmodium falciparum
IPTKIKYHMNLCALIKKIKNYINEKL

SEQ ID NO: 3360324 - protein, 19 aa, Plasmodium falciparum
IPTSVKLWLEAYKKEKNVD

SEQ ID NO: 3360325 - protein, 25 aa, Plasmodium falciparum
IPVDIWLKQFEMMELYNGEYLVNAE

SEQ ID NO: 3360326 - protein, 21 aa, Plasmodium falciparum
IPVDLLDRIIIVKTMLYNKEE

SEQ ID NO: 3360327 - protein, 26 aa, Plasmodium falciparum
IPVILKKINLLACSQTGSGKTFSFLC

SEQ ID NO: 3360328 - protein, 25 aa, Plasmodium falciparum
IPVKSEWLNPVYVRSSYFYSKKYSS

SEQ ID NO: 3360329 - protein, 20 aa, Plasmodium falciparum
IPVLKDFEKVFFYKHIIELI

SEQ ID NO: 3360330 - protein, 20 aa, Plasmodium falciparum
IPVSVAEKWIKILSKDYPTI

SEQ ID NO: 3360331 - protein, 25 aa, Plasmodium falciparum
IPVVLKRGKGVFVYDIEDRRYYDFL

SEQ ID NO: 3360332 - protein, 25 aa, Plasmodium falciparum
IPVVMRINPFQSFRLFNHNEFSNPF

SEQ ID NO: 3360333 - protein, 17 aa, Plasmodium falciparum
IPYICKDLLNKLHSINC

SEQ ID NO: 3360334 - protein, 21 aa, Plasmodium falciparum
IPYIKKYMCNSYHIGYQEDVH

SEQ ID NO: 3360335 - protein, 23 aa, Plasmodium falciparum
IPYLGICLGMQIAVIDVAREYLN

SEQ ID NO: 3360336 - protein, 23 aa, Plasmodium falciparum
IPYNNYCLRIGRPHDYIPPPEGD

SEQ ID NO: 3360337 - protein, 18 aa, Plasmodium falciparum
IPYTNIFISGSYDGYVHF

SEQ ID NO: 3360338 - protein, 20 aa, Plasmodium falciparum
IPYWNHVIPTPAIIKPRALW

SEQ ID NO: 3360339 - protein, 28 aa, Plasmodium falciparum
IQADCIKKAGGFKRLADMEGHETTNVFW

SEQ ID NO: 3360340 - protein, 17 aa, Plasmodium falciparum
IQAIKIIPRSVTKEQIK

SEQ ID NO: 3360341 - protein, 22 aa, Plasmodium falciparum
IQAKCIPHFLSGKDILGAAKTG

SEQ ID NO: 3360342 - protein, 22 aa, Plasmodium falciparum
IQALHFRYNYFPDLDLSIEDYQ

SEQ ID NO: 3360343 - protein, 24 aa, Plasmodium falciparum
IQASWEYVSKFVIIIMDGTNNKSS

SEQ ID NO: 3360344 - protein, 27 aa, Plasmodium falciparum
IQDIIFPGKAQMIFINFKQLENNFTNM

SEQ ID NO: 3360345 - protein, 20 aa, Plasmodium falciparum
IQEAFYKFKSLQSLNYHIVS

SEQ ID NO: 3360346 - protein, 29 aa, Plasmodium falciparum
IQEFNCCICKIYLSYQPILFPCCFVSSCS

SEQ ID NO: 3360347 - protein, 24 aa, Plasmodium falciparum
IQEFYLLCNKLNIYFDILKDKSSN

SEQ ID NO: 3360348 - protein, 23 aa, Plasmodium falciparum
IQELKPTLFISVPRLYNRIHERI

SEQ ID NO: 3360349 - protein, 21 aa, Plasmodium falciparum
IQELTSIFTMCHSKINIPKVN

SEQ ID NO: 3360350 - protein, 26 aa, Plasmodium falciparum
IQEYPKRSDLWFTYLDIHINSLTKNE

SEQ ID NO: 3360351 - protein, 18 aa, Plasmodium falciparum
IQFEHEIINDPHINNIIK

SEQ ID NO: 3360352 - protein, 26 aa, Plasmodium falciparum
IQFKSVIHKYDFFLYIFFNCLHEDIW

SEQ ID NO: 3360353 - protein, 23 aa, Plasmodium falciparum
IQFLTSEASDRCTREKRKTINGE

SEQ ID NO: 3360354 - protein, 25 aa, Plasmodium falciparum
IQFQAGCIYLLFLLYFSQHVEENHY

SEQ ID NO: 3360355 - protein, 23 aa, Plasmodium falciparum
IQFTNRVNAEFAKIAMSDQPIEN

SEQ ID NO: 3360356 - protein, 18 aa, Plasmodium falciparum
IQFTQNVCDYCLKSHNIE

SEQ ID NO: 3360357 - protein, 25 aa, Plasmodium falciparum
IQGIYSLCIKYILNKDIQNIRIEEY

SEQ ID NO: 3360358 - protein, 23 aa, Plasmodium falciparum
IQGKNKLIFKYLSYDSIQKEWVV

SEQ ID NO: 3360359 - protein, 23 aa, Plasmodium falciparum
IQGNLYYISGVVIHYTDVEIKDI

SEQ ID NO: 3360360 - protein, 20 aa, Plasmodium falciparum
IQHLKQLYLYINYISQMKKN

SEQ ID NO: 3360361 - protein, 18 aa, Plasmodium falciparum
IQHNISSNMGCTMKIINK

SEQ ID NO: 3360362 - protein, 24 aa, Plasmodium falciparum
IQIDYCLTLWGNFEPFLEDHLLDY

SEQ ID NO: 3360363 - protein, 24 aa, Plasmodium falciparum
IQIEIEGRVGLVIDKNKNRIKLPI

SEQ ID NO: 3360364 - protein, 25 aa, Plasmodium falciparum
IQIGCPRLSIDWGNYNLKPLLNTYE

SEQ ID NO: 3360365 - protein, 18 aa, Plasmodium falciparum
IQIKKLHNIFSINGKGND

SEQ ID NO: 3360366 - protein, 24 aa, Plasmodium falciparum
IQILKQRNCPFVIALNKIDRLYMW

SEQ ID NO: 3360367 - protein, 19 aa, Plasmodium falciparum
IQIPFHILAIYNPILEYSK

SEQ ID NO: 3360368 - protein, 33 aa, Plasmodium falciparum
IQKAYEILKNPVLRENYDFYGLDKDLDEFQTYY

SEQ ID NO: 3360369 - protein, 17 aa, Plasmodium falciparum
IQKKCLYLPNCQFGDKC

SEQ ID NO: 3360370 - protein, 20 aa, Plasmodium falciparum
IQKKKCCHIGDQFLHSGNDF

SEQ ID NO: 3360371 - protein, 24 aa, Plasmodium falciparum
IQKLPFKRSRIIHTSDAIKEIVQP

SEQ ID NO: 3360372 - protein, 19 aa, Plasmodium falciparum
IQKMLKKTGMSIDIIIQNW

SEQ ID NO: 3360373 - protein, 21 aa, Plasmodium falciparum
IQKMSICKILNGHDVIISSKT

SEQ ID NO: 3360374 - protein, 23 aa, Plasmodium falciparum
IQKRKEKDKILGVQTQTGNYIDM

SEQ ID NO: 3360375 - protein, 29 aa, Plasmodium falciparum
IQKSSRLLEKEWFIKQSELIDIQNENNKM

SEQ ID NO: 3360376 - protein, 18 aa, Plasmodium falciparum
IQKYILMKNEYEKMFKRI

SEQ ID NO: 3360377 - protein, 17 aa, Plasmodium falciparum
IQKYKIFITDYFAEQFI

SEQ ID NO: 3360378 - protein, 26 aa, Plasmodium falciparum
IQLCFNLGLHIGMAFQLYDDYLDYKI

SEQ ID NO: 3360379 - protein, 25 aa, Plasmodium falciparum
IQLDEYTCKEIAFTYRDVLDEKVIA

SEQ ID NO: 3360380 - protein, 37 aa, Plasmodium falciparum
IQLESMKCIILFCSLYKIKYFQGMHDMIISLFYLNLE

SEQ ID NO: 3360381 - protein, 17 aa, Plasmodium falciparum
IQLGDTFQKLFSPPESL

SEQ ID NO: 3360382 - protein, 24 aa, Plasmodium falciparum
IQLKIILGNTIINHFKKFCIPNFL

SEQ ID NO: 3360383 - protein, 24 aa, Plasmodium falciparum
IQLLCLKYNLELIKTSKNFISMAI

SEQ ID NO: 3360384 - protein, 21 aa, Plasmodium falciparum
IQLLFKFNYIFEIDNYHDFRL

SEQ ID NO: 3360385 - protein, 20 aa, Plasmodium falciparum
IQLLFNKIIEKICKEYFSQV

SEQ ID NO: 3360386 - protein, 18 aa, Plasmodium falciparum
IQLLKDIEKLWIYLQNMY

SEQ ID NO: 3360387 - protein, 20 aa, Plasmodium falciparum
IQLNEYRNIILLYLESKMFY

SEQ ID NO: 3360388 - protein, 17 aa, Plasmodium falciparum
IQLSNIYSNFVCIHVLI

SEQ ID NO: 3360389 - protein, 24 aa, Plasmodium falciparum
IQLWDYRIGILIDKFEEHEGPVRG

SEQ ID NO: 3360390 - protein, 17 aa, Plasmodium falciparum
IQMNYEFLSNHEEGQEL

SEQ ID NO: 3360391 - protein, 17 aa, Plasmodium falciparum
IQNLISIDSSNENDEND

SEQ ID NO: 3360392 - protein, 22 aa, Plasmodium falciparum
IQNNFYKYIKFYEDNQNSSKHN

SEQ ID NO: 3360393 - protein, 25 aa, Plasmodium falciparum
IQPACLPSFDIVRHKSFSDISNMEG

SEQ ID NO: 3360394 - protein, 26 aa, Plasmodium falciparum
IQPFDKSNCKKGWNVIKESIDSNDQK

SEQ ID NO: 3360395 - protein, 23 aa, Plasmodium falciparum
IQPFYVCSHIVWGLWALLQGLHS

SEQ ID NO: 3360396 - protein, 18 aa, Plasmodium falciparum
IQPKKGFKKFFSSDDKKK

SEQ ID NO: 3360397 - protein, 18 aa, Plasmodium falciparum
IQPWVFDYISDVIVKDKP

SEQ ID NO: 3360398 - protein, 25 aa, Plasmodium falciparum
IQQKRKLYELKIRKDFEEKIRLRRE

SEQ ID NO: 3360399 - protein, 23 aa, Plasmodium falciparum
IQQKRPSTKWDVPEPSEGDPSIL

SEQ ID NO: 3360400 - protein, 17 aa, Plasmodium falciparum
IQQLPITIKSLRGSQLG

SEQ ID NO: 3360401 - protein, 23 aa, Plasmodium falciparum
IQQNSLVRYIWIGDTGDMDRQAG

SEQ ID NO: 3360402 - protein, 22 aa, Plasmodium falciparum
IQRIREACILGRKTLDYAHTLV

SEQ ID NO: 3360403 - protein, 19 aa, Plasmodium falciparum
IQSHLPVSESFGFTSALRA

SEQ ID NO: 3360404 - protein, 24 aa, Plasmodium falciparum
IQTIFRYIFDKTFKLHDLDFKLLV

SEQ ID NO: 3360405 - protein, 24 aa, Plasmodium falciparum
IQTILKRKENLLLDNKNINNVNIT

SEQ ID NO: 3360406 - protein, 19 aa, Plasmodium falciparum
IQTIPKKAIVTAVKTNNVS

SEQ ID NO: 3360407 - protein, 24 aa, Plasmodium falciparum
IQTKLRYNIFVTRFLESNGLSTSN

SEQ ID NO: 3360408 - protein, 17 aa, Plasmodium falciparum
IQVIGAYIFKRTFINND

SEQ ID NO: 3360409 - protein, 26 aa, Plasmodium falciparum
IQYIKSICNIFHIFLNESFMLLEKKC

SEQ ID NO: 3360410 - protein, 28 aa, Plasmodium falciparum
IQYKDLLKEYIFLELLVIEYEKNNVALH

SEQ ID NO: 3360411 - protein, 18 aa, Plasmodium falciparum
IQYRMHPEISAFPKKCYY

SEQ ID NO: 3360412 - protein, 26 aa, Plasmodium falciparum
IRAASICYLCACNFSETVEIWNNMPS

SEQ ID NO: 3360413 - protein, 18 aa, Plasmodium falciparum
IRAKSFSSDTHFFIDKSQ

SEQ ID NO: 3360414 - protein, 18 aa, Plasmodium falciparum
IRALIKMSVHPFIVRYKE

SEQ ID NO: 3360415 - protein, 19 aa, Plasmodium falciparum
IRALLTCFRLIDALKSLKL

SEQ ID NO: 3360416 - protein, 18 aa, Plasmodium falciparum
IRATSCYGNFFILKRYKS

SEQ ID NO: 3360417 - protein, 28 aa, Plasmodium falciparum
IRCPTKQILKHVCYKLNIDPTHILIYSF

SEQ ID NO: 3360418 - protein, 19 aa, Plasmodium falciparum
IRDDNCKYVEKFYTNCQIQ

SEQ ID NO: 3360419 - protein, 25 aa, Plasmodium falciparum
IRDECNRTALDLAIVLFMKKFHECI

SEQ ID NO: 3360420 - protein, 23 aa, Plasmodium falciparum
IRDIPLVAGSIIWAKQIERKLED

SEQ ID NO: 3360421 - protein, 39 aa, Plasmodium falciparum
IRDIVEKHPYVAIDTEFPGIVARPTGNVLDYNYQTIKCN

SEQ ID NO: 3360422 - protein, 30 aa, Plasmodium falciparum
IRDKVHDLFKLWRYHSKKLLKDFAKSFDPM

SEQ ID NO: 3360423 - protein, 27 aa, Plasmodium falciparum
IRDLFICSWKYFSFELPYYSADIHPLI

SEQ ID NO: 3360424 - protein, 20 aa, Plasmodium falciparum
IRDLTSKDVKSWTRTDDENL

SEQ ID NO: 3360425 - protein, 18 aa, Plasmodium falciparum
IREITKFVESVKVVDVPI

SEQ ID NO: 3360426 - protein, 27 aa, Plasmodium falciparum
IRERVKLVIEKRGRKGLDKHEHINILS

SEQ ID NO: 3360427 - protein, 28 aa, Plasmodium falciparum
IREVELALLLRKRLQPYVDGDVEWEEQM

SEQ ID NO: 3360428 - protein, 23 aa, Plasmodium falciparum
IREVLTFYNCIKYYGSTFNNKVI

SEQ ID NO: 3360429 - protein, 17 aa, Plasmodium falciparum
IREVPYLSRYVILEKLK

SEQ ID NO: 3360430 - protein, 21 aa, Plasmodium falciparum
IREYWWALNRKEVWKALTCSG

SEQ ID NO: 3360431 - protein, 21 aa, Plasmodium falciparum
IRFCAFDVLESLMVDLKKELL

SEQ ID NO: 3360432 - protein, 19 aa, Plasmodium falciparum
IRFFHGRGGSVSRGGGPQH

SEQ ID NO: 3360433 - protein, 18 aa, Plasmodium falciparum
IRFSGGKQHPKWVVKDKE

SEQ ID NO: 3360434 - protein, 17 aa, Plasmodium falciparum
IRGPPKKDIHKLLIDDI

SEQ ID NO: 3360435 - protein, 18 aa, Plasmodium falciparum
IRGTNLYNTKLCNNKLYN

SEQ ID NO: 3360436 - protein, 19 aa, Plasmodium falciparum
IRGVLKVFLENVIKDSIMY

SEQ ID NO: 3360437 - protein, 19 aa, Plasmodium falciparum
IRHGMDLPLTYIIVPYYYN

SEQ ID NO: 3360438 - protein, 33 aa, Plasmodium falciparum
IRHKEMIVAASFIIPYPPGFPVLVPGQIISEEI

SEQ ID NO: 3360439 - protein, 17 aa, Plasmodium falciparum
IRHLINILLHTNKSITT

SEQ ID NO: 3360440 - protein, 17 aa, Plasmodium falciparum
IRHNKPLFIKDHCNDLA

SEQ ID NO: 3360441 - protein, 26 aa, Plasmodium falciparum
IRILKELYIKNEVFLIHIMNCINIQY

SEQ ID NO: 3360442 - protein, 25 aa, Plasmodium falciparum
IRINQCLKIFFYLTANKKELDEQSK

SEQ ID NO: 3360443 - protein, 20 aa, Plasmodium falciparum
IRITGTVVKLGIKNLNEINN

SEQ ID NO: 3360444 - protein, 19 aa, Plasmodium falciparum
IRIWNWQSRVCIAILTGHN

SEQ ID NO: 3360445 - protein, 22 aa, Plasmodium falciparum
IRKHVYNISPICPNTFLEKIVS

SEQ ID NO: 3360446 - protein, 19 aa, Plasmodium falciparum
IRKIMTYDKFEAVYNKDDL

SEQ ID NO: 3360447 - protein, 20 aa, Plasmodium falciparum
IRKKMCKSDYIYLNCVKDIS

SEQ ID NO: 3360448 - protein, 21 aa, Plasmodium falciparum
IRKKNIFHISDSCQSICEYFC

SEQ ID NO: 3360449 - protein, 20 aa, Plasmodium falciparum
IRKMTLPYLDKFQRKNVQNF

SEQ ID NO: 3360450 - protein, 19 aa, Plasmodium falciparum
IRKNNMMSYAFKVQNIDYE

SEQ ID NO: 3360451 - protein, 18 aa, Plasmodium falciparum
IRKRYRKDNLSAMYLSDS

SEQ ID NO: 3360452 - protein, 22 aa, Plasmodium falciparum
IRKYILKSFKKDQIINGRLENS

SEQ ID NO: 3360453 - protein, 21 aa, Plasmodium falciparum
IRLAESFAKMELSQFATDKHV

SEQ ID NO: 3360454 - protein, 17 aa, Plasmodium falciparum
IRLEVYRSYCAYENNFI

SEQ ID NO: 3360455 - protein, 19 aa, Plasmodium falciparum
IRLGLALNYSVFFYEILNQ

SEQ ID NO: 3360456 - protein, 24 aa, Plasmodium falciparum
IRLIFKGPLMLVAGMIPLPSHLKI

SEQ ID NO: 3360457 - protein, 37 aa, Plasmodium falciparum
IRLKCILNLLCCFRNSYELTKFISIFFELQKNEPLTN

SEQ ID NO: 3360458 - protein, 17 aa, Plasmodium falciparum
IRLKRARGMKKLGILMQ

SEQ ID NO: 3360459 - protein, 16 aa, Plasmodium falciparum
IRLLIVFPNNHIVILT

SEQ ID NO: 3360460 - protein, 17 aa, Plasmodium falciparum
IRLLKNWPQLEKTYQTN

SEQ ID NO: 3360461 - protein, 18 aa, Plasmodium falciparum
IRLLYKKRRVYNKKNNEM

SEQ ID NO: 3360462 - protein, 19 aa, Plasmodium falciparum
IRLNNLPVYTFQSNEKSKI

SEQ ID NO: 3360463 - protein, 21 aa, Plasmodium falciparum
IRLPNGIRIQNNFGLSNTLQD

SEQ ID NO: 3360464 - protein, 17 aa, Plasmodium falciparum
IRLRYIKNPIYAFNDKN

SEQ ID NO: 3360465 - protein, 19 aa, Plasmodium falciparum
IRMEKKLSHNFIHTLNLCN

SEQ ID NO: 3360466 - protein, 20 aa, Plasmodium falciparum
IRMLLKSSFSNFILESILKY

SEQ ID NO: 3360467 - protein, 17 aa, Plasmodium falciparum
IRNAIKMNTSDYEKEKL

SEQ ID NO: 3360468 - protein, 21 aa, Plasmodium falciparum
IRNDLRLFAVNSYHDKKYSDC

SEQ ID NO: 3360469 - protein, 24 aa, Plasmodium falciparum
IRNDTKIDFSKIIKSMKEEHNIKI

SEQ ID NO: 3360470 - protein, 29 aa, Plasmodium falciparum
IRNFAEKYKNVIFHGFKKGTVKTINKKNR

SEQ ID NO: 3360471 - protein, 19 aa, Plasmodium falciparum
IRNFIKILILLKKLLKKKI

SEQ ID NO: 3360472 - protein, 17 aa, Plasmodium falciparum
IRNGWLTLGKHIDTTLF

SEQ ID NO: 3360473 - protein, 27 aa, Plasmodium falciparum
IRNIKTFGFRGEALASISHVSYLTITS

SEQ ID NO: 3360474 - protein, 19 aa, Plasmodium falciparum
IRNILKLHFACMIKEQPYN

SEQ ID NO: 3360475 - protein, 33 aa, Plasmodium falciparum
IRNLNYDICETLEEVLEIISLLVDHKTNGLVLA

SEQ ID NO: 3360476 - protein, 28 aa, Plasmodium falciparum
IRNSIILRQCKSCFISIIKSYYPFIKQA

SEQ ID NO: 3360477 - protein, 19 aa, Plasmodium falciparum
IRNSIKYIVHNNIYSQIFF

SEQ ID NO: 3360478 - protein, 22 aa, Plasmodium falciparum
IRRKSLKKYIVYSINNDKEFIP

SEQ ID NO: 3360479 - protein, 17 aa, Plasmodium falciparum
IRSFLKDYLDTDYSEDT

SEQ ID NO: 3360480 - protein, 20 aa, Plasmodium falciparum
IRSLKHYKLKKEKRIKDERM

SEQ ID NO: 3360481 - protein, 22 aa, Plasmodium falciparum
IRTKPYPLMEYLFKENDDKYNE

SEQ ID NO: 3360482 - protein, 19 aa, Plasmodium falciparum
IRTKVEIKRETNIKNDNKN

SEQ ID NO: 3360483 - protein, 21 aa, Plasmodium falciparum
IRTMRVCTRLLQIGAKMHLTL

SEQ ID NO: 3360484 - protein, 18 aa, Plasmodium falciparum
IRTSLIVNLLKFVSANKH

SEQ ID NO: 3360485 - protein, 17 aa, Plasmodium falciparum
IRYFKLLKNYICKLEGI

SEQ ID NO: 3360486 - protein, 22 aa, Plasmodium falciparum
IRYGSVVAFLLEKSRIITQDDN

SEQ ID NO: 3360487 - protein, 24 aa, Plasmodium falciparum
IRYKTGESTLPILSGTTNNTRYKT

SEQ ID NO: 3360488 - protein, 20 aa, Plasmodium falciparum
IRYPRFDMNAAPRVNRRSDF

SEQ ID NO: 3360489 - protein, 19 aa, Plasmodium falciparum
IRYQLVALMAFFGTTSAIT

SEQ ID NO: 3360490 - protein, 27 aa, Plasmodium falciparum
IRYYDLFKYCILLIFLLNNQLICVLEN

SEQ ID NO: 3360491 - protein, 42 aa, Plasmodium falciparum
ISAFPEITCVTLTPEDEFLFLACDGIWDCKDGQDVVGFVKTR

SEQ ID NO: 3360492 - protein, 25 aa, Plasmodium falciparum
ISAIYTSICLWKSNGTNIMLDNENN

SEQ ID NO: 3360493 - protein, 18 aa, Plasmodium falciparum
ISAKLSNFYSRVRQKASA

SEQ ID NO: 3360494 - protein, 21 aa, Plasmodium falciparum
ISAKYGTNCNYLIQIIEHLIN

SEQ ID NO: 3360495 - protein, 17 aa, Plasmodium falciparum
ISASIFLKNSIRNNYDV

SEQ ID NO: 3360496 - protein, 18 aa, Plasmodium falciparum
ISATFPNYIQNMAKKLLY

SEQ ID NO: 3360497 - protein, 23 aa, Plasmodium falciparum
ISATKFLKYFFPLLKVNVKESNA

SEQ ID NO: 3360498 - protein, 20 aa, Plasmodium falciparum
ISCGEKYYKISPCTQNHESF

SEQ ID NO: 3360499 - protein, 17 aa, Plasmodium falciparum
ISCGIEKCNICENNKKK

SEQ ID NO: 3360500 - protein, 18 aa, Plasmodium falciparum
ISCLLKKMNIAIVTAASY

SEQ ID NO: 3360501 - protein, 17 aa, Plasmodium falciparum
ISCQSFITPFIPSIYIF

SEQ ID NO: 3360502 - protein, 21 aa, Plasmodium falciparum
ISCWCVTRFSSWICHPDNCEK

SEQ ID NO: 3360503 - protein, 24 aa, Plasmodium falciparum
ISDAIHLMPIYLKKNKMLPCNNDI

SEQ ID NO: 3360504 - protein, 17 aa, Plasmodium falciparum
ISDFLDYICLHIYSKFK

SEQ ID NO: 3360505 - protein, 22 aa, Plasmodium falciparum
ISDHFFFVFFMKRQCLKRSGGF

SEQ ID NO: 3360506 - protein, 19 aa, Plasmodium falciparum
ISDLFPFHNFFDNNSYSST

SEQ ID NO: 3360507 - protein, 19 aa, Plasmodium falciparum
ISDSCQSICEYFCHRPHVD

SEQ ID NO: 3360508 - protein, 19 aa, Plasmodium falciparum
ISDVIKCRCIFSTHYHLLV

SEQ ID NO: 3360509 - protein, 18 aa, Plasmodium falciparum
ISECTNTDSIPCAFFFSN

SEQ ID NO: 3360510 - protein, 24 aa, Plasmodium falciparum
ISEFKKKFLHKIIKVLEEAKYNEN

SEQ ID NO: 3360511 - protein, 21 aa, Plasmodium falciparum
ISEIFKRAMIIKKWFNNLSKV

SEQ ID NO: 3360512 - protein, 18 aa, Plasmodium falciparum
ISEKKKPIIKKIENEEYI

SEQ ID NO: 3360513 - protein, 18 aa, Plasmodium falciparum
ISELFFSNFFSKYNYDYI

SEQ ID NO: 3360514 - protein, 25 aa, Plasmodium falciparum
ISELKCLLKQLLSGINYLHRNWVMH

SEQ ID NO: 3360515 - protein, 25 aa, Plasmodium falciparum
ISELLCISVSILLGKKECLIEHVVL

SEQ ID NO: 3360516 - protein, 20 aa, Plasmodium falciparum
ISENKIACLAVREDEDPLYI

SEQ ID NO: 3360517 - protein, 22 aa, Plasmodium falciparum
ISEPTPAASIISYISVMSPTNE

SEQ ID NO: 3360518 - protein, 20 aa, Plasmodium falciparum
ISEQLIRLFSILNEKRILRT

SEQ ID NO: 3360519 - protein, 23 aa, Plasmodium falciparum
ISESPYQFGKCPYHINELIESVC

SEQ ID NO: 3360520 - protein, 23 aa, Plasmodium falciparum
ISETIGLRTVHEYKKIKDEIYSN

SEQ ID NO: 3360521 - protein, 18 aa, Plasmodium falciparum
ISEYDFYLCLNKLNISIT

SEQ ID NO: 3360522 - protein, 26 aa, Plasmodium falciparum
ISEYGIARAKNLAIISRLIRSSSIPD

SEQ ID NO: 3360523 - protein, 19 aa, Plasmodium falciparum
ISFDYNVEPVYNYINEGHN

SEQ ID NO: 3360524 - protein, 19 aa, Plasmodium falciparum
ISFEKEYIESIINDQKVKF

SEQ ID NO: 3360525 - protein, 23 aa, Plasmodium falciparum
ISFICLVCNALPNKKILEAGTGT

SEQ ID NO: 3360526 - protein, 25 aa, Plasmodium falciparum
ISGDSKGGLMLWDIRTGKNVEQIKM

SEQ ID NO: 3360527 - protein, 27 aa, Plasmodium falciparum
ISGDSNGGLFIWNWKKMVNFKNIKAHK

SEQ ID NO: 3360528 - protein, 18 aa, Plasmodium falciparum
ISGSFMGPKGIHVKTIKS

SEQ ID NO: 3360529 - protein, 21 aa, Plasmodium falciparum
ISHKHRIICCANHMDDYKKEH

SEQ ID NO: 3360530 - protein, 24 aa, Plasmodium falciparum
ISHNGKFASWVYSYNVILPMSVDQ

SEQ ID NO: 3360531 - protein, 19 aa, Plasmodium falciparum
ISHVPKYKTLIEVVLEPSK

SEQ ID NO: 3360532 - protein, 22 aa, Plasmodium falciparum
ISIGLKITKYISMHGLSLNFNL

SEQ ID NO: 3360533 - protein, 24 aa, Plasmodium falciparum
ISIIDHIKYLSAYKKMNLKYMLSY

SEQ ID NO: 3360534 - protein, 18 aa, Plasmodium falciparum
ISIIESFSKNNICRKYIS

SEQ ID NO: 3360535 - protein, 19 aa, Plasmodium falciparum
ISIKEKISDFLLKHTILVR

SEQ ID NO: 3360536 - protein, 24 aa, Plasmodium falciparum
ISIKKGNIKSVHFLLNNKLSIVLS

SEQ ID NO: 3360537 - protein, 23 aa, Plasmodium falciparum
ISILGEKHWLYASFNYIIADICF

SEQ ID NO: 3360538 - protein, 17 aa, Plasmodium falciparum
ISIMPKLKILNHSSINK

SEQ ID NO: 3360539 - protein, 23 aa, Plasmodium falciparum
ISIRRKKIRLVGLSATLPNYEDV

SEQ ID NO: 3360540 - protein, 26 aa, Plasmodium falciparum
ISISEIYKNSCLRNLNKIREVTDEIN

SEQ ID NO: 3360541 - protein, 17 aa, Plasmodium falciparum
ISIYFFVNTILYKNDNL

SEQ ID NO: 3360542 - protein, 23 aa, Plasmodium falciparum
ISIYKGVGFEVNYHSFKYYNYFK

SEQ ID NO: 3360543 - protein, 29 aa, Plasmodium falciparum
ISKDDCGIIKKFTLGVCAMESKVESAPME

SEQ ID NO: 3360544 - protein, 49 aa, Plasmodium falciparum
ISKDDGCFWIPWKDVIKYFSHIYICWNSVIFPYQFEIHTKWENNSLLNS

SEQ ID NO: 3360545 - protein, 19 aa, Plasmodium falciparum
ISKDITINVTNRISNDKSN

SEQ ID NO: 3360546 - protein, 24 aa, Plasmodium falciparum
ISKEFLSPIKLEFEKVYCPYLLLN

SEQ ID NO: 3360547 - protein, 19 aa, Plasmodium falciparum
ISKEILKEKTLQMIKKKEQ

SEQ ID NO: 3360548 - protein, 29 aa, Plasmodium falciparum
ISKELFSNWCPLKIINKGLGTFHSTDLKY

SEQ ID NO: 3360549 - protein, 27 aa, Plasmodium falciparum
ISKENCLDMFYVLASYYDIIKNIRENL

SEQ ID NO: 3360550 - protein, 17 aa, Plasmodium falciparum
ISKEVYDFILLHKDRLN

SEQ ID NO: 3360551 - protein, 20 aa, Plasmodium falciparum
ISKEYKINWRERERLQKTEY

SEQ ID NO: 3360552 - protein, 46 aa, Plasmodium falciparum
ISKGNSVRRSRWIQSLLDFYGVNLFKAESSATCGGLDSLLDPHGSL

SEQ ID NO: 3360553 - protein, 21 aa, Plasmodium falciparum
ISKHPFLKSGFTFSNNTYSIY

SEQ ID NO: 3360554 - protein, 18 aa, Plasmodium falciparum
ISKILKYLTVEDIYKNSS

SEQ ID NO: 3360555 - protein, 23 aa, Plasmodium falciparum
ISKKISFKRKIKYVQEYKDNLYI

SEQ ID NO: 3360556 - protein, 18 aa, Plasmodium falciparum
ISKLKRNKNIFVDKHVVL

SEQ ID NO: 3360557 - protein, 25 aa, Plasmodium falciparum
ISKLNIKGCISLSGMVSITKVGSIK

SEQ ID NO: 3360558 - protein, 23 aa, Plasmodium falciparum
ISKLPKYLIFTIERFSKNNFFIE

SEQ ID NO: 3360559 - protein, 18 aa, Plasmodium falciparum
ISKNFYYSPFHNVLSLDI

SEQ ID NO: 3360560 - protein, 18 aa, Plasmodium falciparum
ISKNIYASFIHDIHNLKY

SEQ ID NO: 3360561 - protein, 23 aa, Plasmodium falciparum
ISKPRKLLFIIEMDGINIYIKDV

SEQ ID NO: 3360562 - protein, 23 aa, Plasmodium falciparum
ISKQIKYKCPHPISSNNMNNQSV

SEQ ID NO: 3360563 - protein, 24 aa, Plasmodium falciparum
ISKSCSSSTIARRNISDENIFYSC

SEQ ID NO: 3360564 - protein, 17 aa, Plasmodium falciparum
ISKSGTILAFLADNGII

SEQ ID NO: 3360565 - protein, 25 aa, Plasmodium falciparum
ISKSNRLYLFNKFFTSLFYEDNTRT

SEQ ID NO: 3360566 - protein, 28 aa, Plasmodium falciparum
ISKYAIWFCLEKTYCFEINDCIREYMEV

SEQ ID NO: 3360567 - protein, 19 aa, Plasmodium falciparum
ISKYIEHRIRKNAEENTMK

SEQ ID NO: 3360568 - protein, 25 aa, Plasmodium falciparum
ISLFFFCKYTSYNLYLHPLNKNEHI

SEQ ID NO: 3360569 - protein, 17 aa, Plasmodium falciparum
ISLLNTNKCCIESILSN

SEQ ID NO: 3360570 - protein, 17 aa, Plasmodium falciparum
ISLPRRVATITVAERVS

SEQ ID NO: 3360571 - protein, 19 aa, Plasmodium falciparum
ISLRINVKRNIYFMRECLS

SEQ ID NO: 3360572 - protein, 26 aa, Plasmodium falciparum
ISLYKIKISVLPLIQIGKLLNKIINK

SEQ ID NO: 3360573 - protein, 26 aa, Plasmodium falciparum
ISLYKLRYRNVNFLKLLEKYIFMNKE

SEQ ID NO: 3360574 - protein, 23 aa, Plasmodium falciparum
ISMKADGKRVFKIMLDSKERQRD

SEQ ID NO: 3360575 - protein, 30 aa, Plasmodium falciparum
ISMKKSIRFYIEFIALSLLSPKFQYNRNYY

SEQ ID NO: 3360576 - protein, 17 aa, Plasmodium falciparum
ISNCINLFIHDYIYLLL

SEQ ID NO: 3360577 - protein, 25 aa, Plasmodium falciparum
ISNDIKRNCCFFDFNKIKNDDKYEA

SEQ ID NO: 3360578 - protein, 18 aa, Plasmodium falciparum
ISNFYISSDLIFSICLKL

SEQ ID NO: 3360579 - protein, 17 aa, Plasmodium falciparum
ISNIDLLSCAHVCHALN

SEQ ID NO: 3360580 - protein, 20 aa, Plasmodium falciparum
ISNIEAIPGGFNTLRRMYHN

SEQ ID NO: 3360581 - protein, 20 aa, Plasmodium falciparum
ISNKCYVSAILAVTHKYELW

SEQ ID NO: 3360582 - protein, 26 aa, Plasmodium falciparum
ISNKIHFLGFRFIEIPCVKTKNEKRN

SEQ ID NO: 3360583 - protein, 20 aa, Plasmodium falciparum
ISNKVYIFGLCLNLKNPDEM

SEQ ID NO: 3360584 - protein, 21 aa, Plasmodium falciparum
ISNKYICIMDMIKCRDKTIYK

SEQ ID NO: 3360585 - protein, 17 aa, Plasmodium falciparum
ISNLPLYIPKVQETKKC

SEQ ID NO: 3360586 - protein, 24 aa, Plasmodium falciparum
ISNLRGHSINKYIIHGGKCVPIVR

SEQ ID NO: 3360587 - protein, 25 aa, Plasmodium falciparum
ISNNLLYKKNYELFENSLKMFILND

SEQ ID NO: 3360588 - protein, 25 aa, Plasmodium falciparum
ISNRNGDIRSCFDAILRVFSEKIID

SEQ ID NO: 3360589 - protein, 17 aa, Plasmodium falciparum
ISNSFNMKEIGRILYAY

SEQ ID NO: 3360590 - protein, 19 aa, Plasmodium falciparum
ISNYIKYNVDNSFIKNEKN

SEQ ID NO: 3360591 - protein, 22 aa, Plasmodium falciparum
ISNYKGKEFLNMYLKDNMNDID

SEQ ID NO: 3360592 - protein, 20 aa, Plasmodium falciparum
ISPEEFKILIRVLGQTINEK

SEQ ID NO: 3360593 - protein, 17 aa, Plasmodium falciparum
ISPGDILIFNFLSNMNL

SEQ ID NO: 3360594 - protein, 17 aa, Plasmodium falciparum
ISPICPNTFLEKIVSGI

SEQ ID NO: 3360595 - protein, 32 aa, Plasmodium falciparum
ISPRITKCRHIFCFFCILKYFIDEEKKIWKKC

SEQ ID NO: 3360596 - protein, 17 aa, Plasmodium falciparum
ISPRRESINLFSSKINR

SEQ ID NO: 3360597 - protein, 23 aa, Plasmodium falciparum
ISPSKFYRLSFYGMEEKNKNEVE

SEQ ID NO: 3360598 - protein, 18 aa, Plasmodium falciparum
ISPYASVIGRTYKPFNPL

SEQ ID NO: 3360599 - protein, 17 aa, Plasmodium falciparum
ISQCNYDKMRVRYNECK

SEQ ID NO: 3360600 - protein, 18 aa, Plasmodium falciparum
ISQHLIYGIPIFIYTTIH

SEQ ID NO: 3360601 - protein, 18 aa, Plasmodium falciparum
ISQIPYYNFISWKFLTVM

SEQ ID NO: 3360602 - protein, 33 aa, Plasmodium falciparum
ISQLYLTDLSDVFANFNYSCNFNNDQYIINNEE

SEQ ID NO: 3360603 - protein, 25 aa, Plasmodium falciparum
ISREINRKMPFVFLSGSEVYSNEIK

SEQ ID NO: 3360604 - protein, 20 aa, Plasmodium falciparum
ISRLEVLINQSIKIEEQMDI

SEQ ID NO: 3360605 - protein, 17 aa, Plasmodium falciparum
ISRRRKINEQNDICSVN

SEQ ID NO: 3360606 - protein, 24 aa, Plasmodium falciparum
ISSCLKESLIIKAIRPDKLENCFN

SEQ ID NO: 3360607 - protein, 17 aa, Plasmodium falciparum
ISSDIFYKDKILSDIYK

SEQ ID NO: 3360608 - protein, 19 aa, Plasmodium falciparum
ISSIFLNNNYCIIKLSYIT

SEQ ID NO: 3360609 - protein, 34 aa, Plasmodium falciparum
ISSINFFYIKCHTWLDYRHEILRQWNKFLPEWVF

SEQ ID NO: 3360610 - protein, 19 aa, Plasmodium falciparum
ISSKEALKHPCFQDIEQVK

SEQ ID NO: 3360611 - protein, 25 aa, Plasmodium falciparum
ISSKLKEMYQMIAIGGDAELEIIDS

SEQ ID NO: 3360612 - protein, 20 aa, Plasmodium falciparum
ISSLNKVQCNMSNSKGVYIS

SEQ ID NO: 3360613 - protein, 20 aa, Plasmodium falciparum
ISSLSERSSCEINVHKDDVP

SEQ ID NO: 3360614 - protein, 20 aa, Plasmodium falciparum
ISSLVIHIGICLKGEYHDES

SEQ ID NO: 3360615 - protein, 26 aa, Plasmodium falciparum
ISSPLKIKNMKHLIANKMHILNNDCN

SEQ ID NO: 3360616 - protein, 19 aa, Plasmodium falciparum
ISSSLFMIMDFKKDSFCYD

SEQ ID NO: 3360617 - protein, 18 aa, Plasmodium falciparum
ISSSVKFLSSKERYNNNQ

SEQ ID NO: 3360618 - protein, 20 aa, Plasmodium falciparum
ISSTKWLFKNEKLYKNIISL

SEQ ID NO: 3360619 - protein, 17 aa, Plasmodium falciparum
ISSYVRKILIRSTLLKN

SEQ ID NO: 3360620 - protein, 17 aa, Plasmodium falciparum
ISTCSNNCKIIYENYIS

SEQ ID NO: 3360621 - protein, 17 aa, Plasmodium falciparum
ISTFFKWLYNCLKRGAR

SEQ ID NO: 3360622 - protein, 17 aa, Plasmodium falciparum
ISTFLSIKKYIFYKFIY

SEQ ID NO: 3360623 - protein, 22 aa, Plasmodium falciparum
ISTFLWCCAYINIIYKPLFDSA

SEQ ID NO: 3360624 - protein, 24 aa, Plasmodium falciparum
ISTGKIWCGIIGNKIRKEYTALGD

SEQ ID NO: 3360625 - protein, 19 aa, Plasmodium falciparum
ISTIFNIVFSDYIFEAKKN

SEQ ID NO: 3360626 - protein, 25 aa, Plasmodium falciparum
ISTKLKPWIYKKITEYIGADEKDII

SEQ ID NO: 3360627 - protein, 20 aa, Plasmodium falciparum
ISTLCNILYYYTKLNISNDD

SEQ ID NO: 3360628 - protein, 31 aa, Plasmodium falciparum
ISTLRLFNCLFNFRNSCILNEIVEVNTNDDE

SEQ ID NO: 3360629 - protein, 43 aa, Plasmodium falciparum
ISTYCLKSCFSKICFYFADGPWRRTYCKYGYDPRKDPTSYIYQ

SEQ ID NO: 3360630 - protein, 18 aa, Plasmodium falciparum
ISTYDYTKIYSFYIPNFY

SEQ ID NO: 3360631 - protein, 30 aa, Plasmodium falciparum
ISVHIRAKLPYEVNRILSILNETELSVNWA

SEQ ID NO: 3360632 - protein, 21 aa, Plasmodium falciparum
ISVNYGVRFNKINDFYYLIYF

SEQ ID NO: 3360633 - protein, 20 aa, Plasmodium falciparum
ISVVFSKVFTRVLFRIWDIW

SEQ ID NO: 3360634 - protein, 21 aa, Plasmodium falciparum
ISWNFKDTYVLLASSLDNSIS

SEQ ID NO: 3360635 - protein, 17 aa, Plasmodium falciparum
ISYDRKGFHLSYDNKQD

SEQ ID NO: 3360636 - protein, 28 aa, Plasmodium falciparum
ISYEHFKNSLSLCIDKKYIFPIFSGSAL

SEQ ID NO: 3360637 - protein, 20 aa, Plasmodium falciparum
ISYELRKLIESINIYQRAVN

SEQ ID NO: 3360638 - protein, 27 aa, Plasmodium falciparum
ISYKIPRKIVQCKPFISVYTIDFDLDS

SEQ ID NO: 3360639 - protein, 17 aa, Plasmodium falciparum
ISYKKGDFDHIIINLNV

SEQ ID NO: 3360640 - protein, 22 aa, Plasmodium falciparum
ISYKSIKLFCNFFKENKFLFYL

SEQ ID NO: 3360641 - protein, 20 aa, Plasmodium falciparum
ITALLHRQLEVLLIDFYSMY

SEQ ID NO: 3360642 - protein, 25 aa, Plasmodium falciparum
ITAMSTNVLIHFSFYNYDFGNLILF

SEQ ID NO: 3360643 - protein, 20 aa, Plasmodium falciparum
ITCDKGGNFIGLLKYQNKDF

SEQ ID NO: 3360644 - protein, 24 aa, Plasmodium falciparum
ITDCLKNRLKDIIKIEEDDLNEQI

SEQ ID NO: 3360645 - protein, 19 aa, Plasmodium falciparum
ITDKEINYMNSFKNRLGEL

SEQ ID NO: 3360646 - protein, 26 aa, Plasmodium falciparum
ITDLNLKYDECYKLYKQTQYKNLIYK

SEQ ID NO: 3360647 - protein, 19 aa, Plasmodium falciparum
ITDRYIKFISLSSSTFSLN

SEQ ID NO: 3360648 - protein, 23 aa, Plasmodium falciparum
ITEGWKPSPRGAGVLFSEEKTES

SEQ ID NO: 3360649 - protein, 19 aa, Plasmodium falciparum
ITEHMFPCIKNDKKREDDD

SEQ ID NO: 3360650 - protein, 26 aa, Plasmodium falciparum
ITEIGKLPFLKKFFVEKILSLKRSNM

SEQ ID NO: 3360651 - protein, 22 aa, Plasmodium falciparum
ITEIQGLCKIYLNWISELEKRI

SEQ ID NO: 3360652 - protein, 17 aa, Plasmodium falciparum
ITFNKLGGMVLRDLFTL

SEQ ID NO: 3360653 - protein, 27 aa, Plasmodium falciparum
ITGKLEFDEVIKLIFILYEKKIHTLNE

SEQ ID NO: 3360654 - protein, 24 aa, Plasmodium falciparum
ITIAEPICRPELIHEFQLTIFSLY

SEQ ID NO: 3360655 - protein, 28 aa, Plasmodium falciparum
ITIEKIRSIIAYKLWKYIVKDINLIKIF

SEQ ID NO: 3360656 - protein, 27 aa, Plasmodium falciparum
ITIKDILTLKCFIKKPFHDKITLSKFI

SEQ ID NO: 3360657 - protein, 24 aa, Plasmodium falciparum
ITIKSAYSCFEWNKIKVNLIDTPG

SEQ ID NO: 3360658 - protein, 20 aa, Plasmodium falciparum
ITIKSLRGSQLGKILTYLHS

SEQ ID NO: 3360659 - protein, 22 aa, Plasmodium falciparum
ITIRKCKRFSFGPYKYTDINTQ

SEQ ID NO: 3360660 - protein, 24 aa, Plasmodium falciparum
ITKDELFKILSFSAVQVSFSKEII

SEQ ID NO: 3360661 - protein, 19 aa, Plasmodium falciparum
ITKKNSFENIEKWLKELRD

SEQ ID NO: 3360662 - protein, 22 aa, Plasmodium falciparum
ITKMKYKAVALHGGKAQEIREQ

SEQ ID NO: 3360663 - protein, 25 aa, Plasmodium falciparum
ITKQFRYPCVCFIHDSSLRFFESSL

SEQ ID NO: 3360664 - protein, 17 aa, Plasmodium falciparum
ITLACGFCDGLNLPTNS

SEQ ID NO: 3360665 - protein, 18 aa, Plasmodium falciparum
ITLIEIINCLSRREDYFY

SEQ ID NO: 3360666 - protein, 17 aa, Plasmodium falciparum
ITMKYLIDYENKVIDNV

SEQ ID NO: 3360667 - protein, 22 aa, Plasmodium falciparum
ITNDMKMLWDEISLPSLDNILK

SEQ ID NO: 3360668 - protein, 19 aa, Plasmodium falciparum
ITNELNFHINIIIYILNNL

SEQ ID NO: 3360669 - protein, 26 aa, Plasmodium falciparum
ITNIPFNSPGRFNFHDLIDNMFANTF

SEQ ID NO: 3360670 - protein, 19 aa, Plasmodium falciparum
ITNLKFYKNFIISSDVTKN

SEQ ID NO: 3360671 - protein, 18 aa, Plasmodium falciparum
ITNSCCYFLLLNDNYDDP

SEQ ID NO: 3360672 - protein, 25 aa, Plasmodium falciparum
ITNTLCRFNNFIKLCINAKKKVDFD

SEQ ID NO: 3360673 - protein, 20 aa, Plasmodium falciparum
ITPEYGRGRRTKVVNQNYVK

SEQ ID NO: 3360674 - protein, 22 aa, Plasmodium falciparum
ITPLFNCINLTILFLQINKIKS

SEQ ID NO: 3360675 - protein, 19 aa, Plasmodium falciparum
ITPRVKFKTIRKINDQKYM

SEQ ID NO: 3360676 - protein, 26 aa, Plasmodium falciparum
ITPTFKIKRFHVFRDYAFFIDDIKKL

SEQ ID NO: 3360677 - protein, 24 aa, Plasmodium falciparum
ITPTKYECPGWLTKRRIKKYFDFC

SEQ ID NO: 3360678 - protein, 26 aa, Plasmodium falciparum
ITPVESCELHPVVIIKDQYGHLYDDD

SEQ ID NO: 3360679 - protein, 27 aa, Plasmodium falciparum
ITQGFDIAKGILLEFLDSMKIPVNIEE

SEQ ID NO: 3360680 - protein, 22 aa, Plasmodium falciparum
ITQRLGRTIIPLNPELLAQSTF

SEQ ID NO: 3360681 - protein, 20 aa, Plasmodium falciparum
ITRNHTSAHRMISPRRESIN

SEQ ID NO: 3360682 - protein, 25 aa, Plasmodium falciparum
ITSDMLIKRMKIFNISLIARRNVNN

SEQ ID NO: 3360683 - protein, 22 aa, Plasmodium falciparum
ITSEGPLSFLYKFEKDTKLDTS

SEQ ID NO: 3360684 - protein, 25 aa, Plasmodium falciparum
ITSFDILSCIQREGIKYKFLEDCIY

SEQ ID NO: 3360685 - protein, 20 aa, Plasmodium falciparum
ITSFLRKYMQTLSYEQDTEE

SEQ ID NO: 3360686 - protein, 18 aa, Plasmodium falciparum
ITSICWSKDDSIIVSSAF

SEQ ID NO: 3360687 - protein, 18 aa, Plasmodium falciparum
ITSKNIYDSIYIPQINIK

SEQ ID NO: 3360688 - protein, 18 aa, Plasmodium falciparum
ITSSCIYKSLALYEDVKY

SEQ ID NO: 3360689 - protein, 27 aa, Plasmodium falciparum
ITSSNQKGKCNFNIFKINKHINKKKNK

SEQ ID NO: 3360690 - protein, 25 aa, Plasmodium falciparum
ITSVHSYGAFLDCNVYIKNQDNRYK

SEQ ID NO: 3360691 - protein, 18 aa, Plasmodium falciparum
ITTGFTVEFIWKSTAYDR

SEQ ID NO: 3360692 - protein, 18 aa, Plasmodium falciparum
ITTILEWLEKNQLAGKDE

SEQ ID NO: 3360693 - protein, 17 aa, Plasmodium falciparum
ITTNSFQSNDFVNSYTS

SEQ ID NO: 3360694 - protein, 25 aa, Plasmodium falciparum
ITTVPCPWLDFKHTVFGKVTQGSKI

SEQ ID NO: 3360695 - protein, 25 aa, Plasmodium falciparum
ITVHELRIMLNINYETCFKAANVYK

SEQ ID NO: 3360696 - protein, 22 aa, Plasmodium falciparum
ITVHPKFRLFLSTLPGKEIPIS

SEQ ID NO: 3360697 - protein, 43 aa, Plasmodium falciparum
ITVSEMLTNLFNFRYKRNITIAYDYVESLIGFYQDKYKIDISY

SEQ ID NO: 3360698 - protein, 23 aa, Plasmodium falciparum
ITYDHIYSFMSFKKFSGKNISID

SEQ ID NO: 3360699 - protein, 23 aa, Plasmodium falciparum
ITYEKCLDCGNDFLHFINIQTRS

SEQ ID NO: 3360700 - protein, 24 aa, Plasmodium falciparum
ITYKYFPFLKHCIFKLEDQDNVLI

SEQ ID NO: 3360701 - protein, 25 aa, Plasmodium falciparum
ITYLKEFYNFYVIDHMKWLREKREK

SEQ ID NO: 3360702 - protein, 17 aa, Plasmodium falciparum
ITYLYDKVNFFLIQNKA

SEQ ID NO: 3360703 - protein, 17 aa, Plasmodium falciparum
ITYRKVQNWDLSLKCDE

SEQ ID NO: 3360704 - protein, 19 aa, Plasmodium falciparum
ITYSECKFLDKNIYEDNKI

SEQ ID NO: 3360705 - protein, 25 aa, Plasmodium falciparum
IVAKEQMLYILRVMGYDEIDNIYFH

SEQ ID NO: 3360706 - protein, 19 aa, Plasmodium falciparum
IVAVIEFNRVMKLKKTANK

SEQ ID NO: 3360707 - protein, 17 aa, Plasmodium falciparum
IVCLYRIANNINGKVCY

SEQ ID NO: 3360708 - protein, 24 aa, Plasmodium falciparum
IVCNLKTRCTIIAASNPKEGKYNY

SEQ ID NO: 3360709 - protein, 19 aa, Plasmodium falciparum
IVDEFILKIKSSRMSYDKN

SEQ ID NO: 3360710 - protein, 17 aa, Plasmodium falciparum
IVDELDFIATRNVRLEL

SEQ ID NO: 3360711 - protein, 25 aa, Plasmodium falciparum
IVDILNEVKLEWLCLDLDFVENLLY

SEQ ID NO: 3360712 - protein, 19 aa, Plasmodium falciparum
IVDLCAAPGSWSQVLKNIC

SEQ ID NO: 3360713 - protein, 22 aa, Plasmodium falciparum
IVDPPRTCYFVVGSEGVGKKFI

SEQ ID NO: 3360714 - protein, 22 aa, Plasmodium falciparum
IVDPSGSIDFMKKMVRLYNKKE

SEQ ID NO: 3360715 - protein, 17 aa, Plasmodium falciparum
IVEFVSYDDMLYAIEKF

SEQ ID NO: 3360716 - protein, 22 aa, Plasmodium falciparum
IVEKFPCYFISHANGIALSCDA

SEQ ID NO: 3360717 - protein, 30 aa, Plasmodium falciparum
IVELLLYKRMKEIYLWKKIICSQERYKELY

SEQ ID NO: 3360718 - protein, 30 aa, Plasmodium falciparum
IVELVYRCISLLPKHIQKYFVSQIYISGGS

SEQ ID NO: 3360719 - protein, 18 aa, Plasmodium falciparum
IVEPRGNNKFGWDNIFQP

SEQ ID NO: 3360720 - protein, 21 aa, Plasmodium falciparum
IVERFKTFLIEFDNEILNNTD

SEQ ID NO: 3360721 - protein, 18 aa, Plasmodium falciparum
IVETVRFRSLPLEEKYAD

SEQ ID NO: 3360722 - protein, 24 aa, Plasmodium falciparum
IVEVPELQEVIKIIEKPEIKERII

SEQ ID NO: 3360723 - protein, 23 aa, Plasmodium falciparum
IVGCANCSVSLYIYDTNLYLLIK

SEQ ID NO: 3360724 - protein, 26 aa, Plasmodium falciparum
IVHEGFDTIKIPKYREVEIVEKIVEV

SEQ ID NO: 3360725 - protein, 29 aa, Plasmodium falciparum
IVHVCNIYERLYCGSRFFELIILTNEKKC

SEQ ID NO: 3360726 - protein, 24 aa, Plasmodium falciparum
IVHVTEIMCGISIIRDYDKTRKFN

SEQ ID NO: 3360727 - protein, 18 aa, Plasmodium falciparum
IVHYVDWINQIFKKNSLQ

SEQ ID NO: 3360728 - protein, 33 aa, Plasmodium falciparum
IVIDKLYYIMCKWKNILENYAMDLLRALNFPSR

SEQ ID NO: 3360729 - protein, 17 aa, Plasmodium falciparum
IVIITSVNYNFDKDHLF

SEQ ID NO: 3360730 - protein, 18 aa, Plasmodium falciparum
IVILNFLKTLYVNNTNLI

SEQ ID NO: 3360731 - protein, 39 aa, Plasmodium falciparum
IVIPERVEKLFLSNILRWAFKIHNFLSISFIYNALAATY

SEQ ID NO: 3360732 - protein, 22 aa, Plasmodium falciparum
IVKDICNFRENIRVVISSATLD

SEQ ID NO: 3360733 - protein, 27 aa, Plasmodium falciparum
IVKEKRRSFFLSSEFRTITYIESINMN

SEQ ID NO: 3360734 - protein, 19 aa, Plasmodium falciparum
IVKIPKMCINKLARKKGYM

SEQ ID NO: 3360735 - protein, 20 aa, Plasmodium falciparum
IVKMYKRKLSFGKDNKKENK

SEQ ID NO: 3360736 - protein, 23 aa, Plasmodium falciparum
IVKNHLKNSLAHNEYVAKRMSSL

SEQ ID NO: 3360737 - protein, 18 aa, Plasmodium falciparum
IVKPRPITASSIPGLLSI

SEQ ID NO: 3360738 - protein, 18 aa, Plasmodium falciparum
IVKQEFVHFVTYYSDVWY

SEQ ID NO: 3360739 - protein, 24 aa, Plasmodium falciparum
IVKRSIKPYYRLIITNKKNEKHLL

SEQ ID NO: 3360740 - protein, 25 aa, Plasmodium falciparum
IVLCLKRIYEVLSNMYSKNMIIKEE

SEQ ID NO: 3360741 - protein, 25 aa, Plasmodium falciparum
IVLKEIGPRFSFVVYKINKETLDSL

SEQ ID NO: 3360742 - protein, 27 aa, Plasmodium falciparum
IVMDSCLGGALGLCYVENMIYLCGCYT

SEQ ID NO: 3360743 - protein, 19 aa, Plasmodium falciparum
IVNDIRRREWGLLVFDEVQ

SEQ ID NO: 3360744 - protein, 30 aa, Plasmodium falciparum
IVNEIPEWLKTCKYYCFKMTELDNNKNKTL

SEQ ID NO: 3360745 - protein, 25 aa, Plasmodium falciparum
IVNHLLPFRRSRNFYDTESSDNDNE

SEQ ID NO: 3360746 - protein, 25 aa, Plasmodium falciparum
IVNKLRLGLKICAVKAPGFGEHRKA

SEQ ID NO: 3360747 - protein, 18 aa, Plasmodium falciparum
IVNNFKFDNILIEKKKNC

SEQ ID NO: 3360748 - protein, 25 aa, Plasmodium falciparum
IVNRIWSRISMKLGGPNQKYMCLND

SEQ ID NO: 3360749 - protein, 18 aa, Plasmodium falciparum
IVNSFYCLHGNLNCSEIT

SEQ ID NO: 3360750 - protein, 19 aa, Plasmodium falciparum
IVNSKLIYVRKIQEVLSKM

SEQ ID NO: 3360751 - protein, 18 aa, Plasmodium falciparum
IVNVPYWLKPSISKQEFI

SEQ ID NO: 3360752 - protein, 18 aa, Plasmodium falciparum
IVNYYKPEMSFFVYISDV

SEQ ID NO: 3360753 - protein, 22 aa, Plasmodium falciparum
IVPGGGSALLFASKELDSVQTD

SEQ ID NO: 3360754 - protein, 17 aa, Plasmodium falciparum
IVPGVLFIDEVHMLDIE

SEQ ID NO: 3360755 - protein, 19 aa, Plasmodium falciparum
IVPPPNYLGNYNVYKYNLD

SEQ ID NO: 3360756 - protein, 18 aa, Plasmodium falciparum
IVQSRLKYNINLKNYLEN

SEQ ID NO: 3360757 - protein, 25 aa, Plasmodium falciparum
IVRLIPRITYEHFMNAKKSKYYNQK

SEQ ID NO: 3360758 - protein, 25 aa, Plasmodium falciparum
IVRYKNMVCDNVLLPFSFHCTGTPI

SEQ ID NO: 3360759 - protein, 25 aa, Plasmodium falciparum
IVSAACNKQRLCLVNNDGHVFYEHM

SEQ ID NO: 3360760 - protein, 24 aa, Plasmodium falciparum
IVSNYYDCYGKDYYNHGDISTYNE

SEQ ID NO: 3360761 - protein, 18 aa, Plasmodium falciparum
IVSTDEVFVYFFSQKKWY

SEQ ID NO: 3360762 - protein, 17 aa, Plasmodium falciparum
IVSTSLLFGKRPIQRIR

SEQ ID NO: 3360763 - protein, 22 aa, Plasmodium falciparum
IVSVFLCWASKIIKQGIELKDI

SEQ ID NO: 3360764 - protein, 18 aa, Plasmodium falciparum
IVTKCSYVYVFDEGTLSL

SEQ ID NO: 3360765 - protein, 21 aa, Plasmodium falciparum
IVTKIEADWLLKYVSAKFQVA

SEQ ID NO: 3360766 - protein, 18 aa, Plasmodium falciparum
IVTNIPVEWSKYDVVWFF

SEQ ID NO: 3360767 - protein, 25 aa, Plasmodium falciparum
IVVDCLKFELNNMISVECIKKMINV

SEQ ID NO: 3360768 - protein, 22 aa, Plasmodium falciparum
IVVKQRIQNMLFDDVEKKTIED

SEQ ID NO: 3360769 - protein, 28 aa, Plasmodium falciparum
IVWGLCGLLEYKDRLKVHNFLLKNVPVL

SEQ ID NO: 3360770 - protein, 23 aa, Plasmodium falciparum
IVYSLCYSKYIGIKELQKICDEH

SEQ ID NO: 3360771 - protein, 28 aa, Plasmodium falciparum
IWEETIILLPLMVRFIFLSATIPNGIQF

SEQ ID NO: 3360772 - protein, 17 aa, Plasmodium falciparum
IWEMYTYEWVFNRKTFL

SEQ ID NO: 3360773 - protein, 25 aa, Plasmodium falciparum
IWGHKDIKTSIAYALFGGVQKGGDK

SEQ ID NO: 3360774 - protein, 17 aa, Plasmodium falciparum
IWILFKFTNEESKDLIQ

SEQ ID NO: 3360775 - protein, 20 aa, Plasmodium falciparum
IWKINKCSFDKTNPIQQSGK

SEQ ID NO: 3360776 - protein, 31 aa, Plasmodium falciparum
IWKNCEDEVLKAAVMKYGLNNWSRVASLLVR

SEQ ID NO: 3360777 - protein, 18 aa, Plasmodium falciparum
IWNIHEFLSFFVDDFKLS

SEQ ID NO: 3360778 - protein, 23 aa, Plasmodium falciparum
IWNNEMKRYMSLKESQSVYQFNG

SEQ ID NO: 3360779 - protein, 30 aa, Plasmodium falciparum
IWQIYLSKKIKCINDQWLLICINQELKKII

SEQ ID NO: 3360780 - protein, 26 aa, Plasmodium falciparum
IWSAACIICELIIGRPLFKGVTEFDL

SEQ ID NO: 3360781 - protein, 20 aa, Plasmodium falciparum
IWSAGCIFAEMILKKPLFVG

SEQ ID NO: 3360782 - protein, 25 aa, Plasmodium falciparum
IWSLGCILYEMLFCERPFQFNYLEK

SEQ ID NO: 3360783 - protein, 18 aa, Plasmodium falciparum
IWSLGCLFMELIQGRPLF

SEQ ID NO: 3360784 - protein, 18 aa, Plasmodium falciparum
IYAAKLLQPNQFPKESFN

SEQ ID NO: 3360785 - protein, 28 aa, Plasmodium falciparum
IYACKSKREILCITRFIINALKRNNNII

SEQ ID NO: 3360786 - protein, 19 aa, Plasmodium falciparum
IYAICACCKVESKNEGKKN

SEQ ID NO: 3360787 - protein, 44 aa, Plasmodium falciparum
IYANCLYCGKIYCTKIKYKNCIFCENQLYKSHIINNLFFQSPQN

SEQ ID NO: 3360788 - protein, 17 aa, Plasmodium falciparum
IYAVEGFKKVSFKKNTP

SEQ ID NO: 3360789 - protein, 19 aa, Plasmodium falciparum
IYCAYPRRLEIGQDKNISI

SEQ ID NO: 3360790 - protein, 23 aa, Plasmodium falciparum
IYCKEGIKIYGIIENYIIHIYTY

SEQ ID NO: 3360791 - protein, 17 aa, Plasmodium falciparum
IYCYQDFIENILFYIYR

SEQ ID NO: 3360792 - protein, 19 aa, Plasmodium falciparum
IYDDISFTLFDKGYIHNHT

SEQ ID NO: 3360793 - protein, 18 aa, Plasmodium falciparum
IYDDYVVDCVEMVTENIK

SEQ ID NO: 3360794 - protein, 27 aa, Plasmodium falciparum
IYDEFEKRNLLRFSFVKNAEENKRNDE

SEQ ID NO: 3360795 - protein, 22 aa, Plasmodium falciparum
IYDHKLVPSIIFLLNTTLQTNG

SEQ ID NO: 3360796 - protein, 25 aa, Plasmodium falciparum
IYDIIKRERIITCEDHMGGIIDLLF

SEQ ID NO: 3360797 - protein, 19 aa, Plasmodium falciparum
IYDIKEIIQESSIKTSIFT

SEQ ID NO: 3360798 - protein, 22 aa, Plasmodium falciparum
IYDKKKRNVIVSWNNQVKGYNF

SEQ ID NO: 3360799 - protein, 26 aa, Plasmodium falciparum
IYDKNLKPRGYAFIEFEHTKSMNDAY

SEQ ID NO: 3360800 - protein, 18 aa, Plasmodium falciparum
IYDKYNFNNLGYKTNDKG

SEQ ID NO: 3360801 - protein, 23 aa, Plasmodium falciparum
IYDLKAIQLYTNILINCLIQNTT

SEQ ID NO: 3360802 - protein, 24 aa, Plasmodium falciparum
IYDMYIKGNFRIIKIEDIYVKSFL

SEQ ID NO: 3360803 - protein, 19 aa, Plasmodium falciparum
IYDPHCILITLPQQSFDII

SEQ ID NO: 3360804 - protein, 25 aa, Plasmodium falciparum
IYDYRKSDFGMAKFSSLNLASIKDC

SEQ ID NO: 3360805 - protein, 25 aa, Plasmodium falciparum
IYEFLFLRFVFINIFTHSNIIQENI

SEQ ID NO: 3360806 - protein, 24 aa, Plasmodium falciparum
IYEKYKINNILSLLVDNNKFQNES

SEQ ID NO: 3360807 - protein, 24 aa, Plasmodium falciparum
IYELSEVILHYEFNNILYNLYCNV

SEQ ID NO: 3360808 - protein, 22 aa, Plasmodium falciparum
IYEPKVNNIIKDVCEKHWSQKS

SEQ ID NO: 3360809 - protein, 25 aa, Plasmodium falciparum
IYEQELQPLLPRFSSFNSCENYLDF

SEQ ID NO: 3360810 - protein, 25 aa, Plasmodium falciparum
IYERINIYLCFVLTVEIHIWSKNLK

SEQ ID NO: 3360811 - protein, 23 aa, Plasmodium falciparum
IYESRSRLNGIYKNFVMDDERDR

SEQ ID NO: 3360812 - protein, 20 aa, Plasmodium falciparum
IYEYCELINSFSLSIIFLGL

SEQ ID NO: 3360813 - protein, 20 aa, Plasmodium falciparum
IYEYEIPNIIGSKIPHFNLY

SEQ ID NO: 3360814 - protein, 18 aa, Plasmodium falciparum
IYEYYKYNCDVFNLLSLM

SEQ ID NO: 3360815 - protein, 21 aa, Plasmodium falciparum
IYFDEYFYKSLILYNTNINDL

SEQ ID NO: 3360816 - protein, 29 aa, Plasmodium falciparum
IYFDYYECIWECYNEIKSILYNISEPYFT

SEQ ID NO: 3360817 - protein, 28 aa, Plasmodium falciparum
IYFENECLRYLYSAQFDFSKAMELIKSN

SEQ ID NO: 3360818 - protein, 21 aa, Plasmodium falciparum
IYFILQHLCNINFLYQYDLNF

SEQ ID NO: 3360819 - protein, 28 aa, Plasmodium falciparum
IYFIPKRIVLTTVAICIYGVHFLNKDNE

SEQ ID NO: 3360820 - protein, 23 aa, Plasmodium falciparum
IYFLPYEITTCFYSENYNMKEIK

SEQ ID NO: 3360821 - protein, 20 aa, Plasmodium falciparum
IYFLVVMKRKIHCFENEKCI

SEQ ID NO: 3360822 - protein, 17 aa, Plasmodium falciparum
IYFLYRNIMYIKINEDY

SEQ ID NO: 3360823 - protein, 27 aa, Plasmodium falciparum
IYFMDEIDAALDFKNVSIISHYIQTKT

SEQ ID NO: 3360824 - protein, 20 aa, Plasmodium falciparum
IYFNRSFKQLINYTSFILND

SEQ ID NO: 3360825 - protein, 18 aa, Plasmodium falciparum
IYFVKSLLLHSHRNTSTL

SEQ ID NO: 3360826 - protein, 19 aa, Plasmodium falciparum
IYFYQCIDGQCIFLDPFIL

SEQ ID NO: 3360827 - protein, 17 aa, Plasmodium falciparum
IYGAVTTWSMGKMVIIP

SEQ ID NO: 3360828 - protein, 18 aa, Plasmodium falciparum
IYGICIFNNDIININEEL

SEQ ID NO: 3360829 - protein, 21 aa, Plasmodium falciparum
IYGKGGFQFVFMRKQSNSNKY

SEQ ID NO: 3360830 - protein, 24 aa, Plasmodium falciparum
IYGSGKKCSVSIIRKIQINTDRHI

SEQ ID NO: 3360831 - protein, 18 aa, Plasmodium falciparum
IYHCGVLKLEGMFYEEVD

SEQ ID NO: 3360832 - protein, 22 aa, Plasmodium falciparum
IYHKDFFNEFILNHIKKYDEQN

SEQ ID NO: 3360833 - protein, 18 aa, Plasmodium falciparum
IYHKINFITSESYEEFKN

SEQ ID NO: 3360834 - protein, 27 aa, Plasmodium falciparum
IYHKNLFLKYNIPFFTIFSQTSHFLVA

SEQ ID NO: 3360835 - protein, 18 aa, Plasmodium falciparum
IYHNLKLYIYKEYYEKYK

SEQ ID NO: 3360836 - protein, 18 aa, Plasmodium falciparum
IYHVLRVNKKYNFLNSSN

SEQ ID NO: 3360837 - protein, 17 aa, Plasmodium falciparum
IYIAQLFIYYFDYKDIL

SEQ ID NO: 3360838 - protein, 21 aa, Plasmodium falciparum
IYIDEEFFHDFLLEEEDNNYE

SEQ ID NO: 3360839 - protein, 19 aa, Plasmodium falciparum
IYIENNIKENIFFRDKLIN

SEQ ID NO: 3360840 - protein, 17 aa, Plasmodium falciparum
IYIFDYQNIFTFYNVQD

SEQ ID NO: 3360841 - protein, 23 aa, Plasmodium falciparum
IYIFSIKFFFLYYYIKIPVYEKV

SEQ ID NO: 3360842 - protein, 18 aa, Plasmodium falciparum
IYIFTNINIRNWNDMKNG

SEQ ID NO: 3360843 - protein, 29 aa, Plasmodium falciparum
IYIIKNYHRPECGMIDLFGRVMCGTIKKG

SEQ ID NO: 3360844 - protein, 18 aa, Plasmodium falciparum
IYIIRISAYLYRDDLQCI

SEQ ID NO: 3360845 - protein, 24 aa, Plasmodium falciparum
IYIKDVLMNIVLDFYNIFEEELPK

SEQ ID NO: 3360846 - protein, 17 aa, Plasmodium falciparum
IYINSYIYDCFENKYTN

SEQ ID NO: 3360847 - protein, 30 aa, Plasmodium falciparum
IYISEFPQTFSVILQHCIKINNEKAYIKIK

SEQ ID NO: 3360848 - protein, 19 aa, Plasmodium falciparum
IYIWYKKNKKLLFNTDDNK

SEQ ID NO: 3360849 - protein, 19 aa, Plasmodium falciparum
IYIYRLIINYLYKIEDKLN

SEQ ID NO: 3360850 - protein, 21 aa, Plasmodium falciparum
IYKDTRYTDILGHQGSSPRIL

SEQ ID NO: 3360851 - protein, 33 aa, Plasmodium falciparum
IYKEMHRSPVMPLRIEAFHSLEDQRLIYGKPDW

SEQ ID NO: 3360852 - protein, 34 aa, Plasmodium falciparum
IYKEPIDFYHDMKLIYKNCIDFNPDIEENKYIIE

SEQ ID NO: 3360853 - protein, 19 aa, Plasmodium falciparum
IYKIKNLKQITSFINFLMH

SEQ ID NO: 3360854 - protein, 19 aa, Plasmodium falciparum
IYKILCVSKNYSIVVPTIL

SEQ ID NO: 3360855 - protein, 29 aa, Plasmodium falciparum
IYKINEYKLDLILCLNFPPYEKKNPNYNI

SEQ ID NO: 3360856 - protein, 25 aa, Plasmodium falciparum
IYKKASDIFFNFPKFSFVIFKNRQK

SEQ ID NO: 3360857 - protein, 18 aa, Plasmodium falciparum
IYKMKAIKNEIYEQYKNK

SEQ ID NO: 3360858 - protein, 17 aa, Plasmodium falciparum
IYKMYALYAKDMKEQNF

SEQ ID NO: 3360859 - protein, 28 aa, Plasmodium falciparum
IYKQVEPMLYKFIYDTRHQIINKKNNNI

SEQ ID NO: 3360860 - protein, 17 aa, Plasmodium falciparum
IYKSLALYEDVKYKYRL

SEQ ID NO: 3360861 - protein, 26 aa, Plasmodium falciparum
IYKVKDLSCKLSELYNNTTDLTYNLN

SEQ ID NO: 3360862 - protein, 19 aa, Plasmodium falciparum
IYKYCKERNILFINEEVES

SEQ ID NO: 3360863 - protein, 27 aa, Plasmodium falciparum
IYLKINTCKIINIKKKICLIDILGNTF

SEQ ID NO: 3360864 - protein, 18 aa, Plasmodium falciparum
IYLNYYLNHVYVLLQKID

SEQ ID NO: 3360865 - protein, 18 aa, Plasmodium falciparum
IYLPLSVLGFVHIEVKSN

SEQ ID NO: 3360866 - protein, 17 aa, Plasmodium falciparum
IYLQIIKDLFIPNKNTF

SEQ ID NO: 3360867 - protein, 25 aa, Plasmodium falciparum
IYLQKYCLQNDILFIQKYDRKINGH

SEQ ID NO: 3360868 - protein, 18 aa, Plasmodium falciparum
IYLRFVKNKYQNIIKKNS

SEQ ID NO: 3360869 - protein, 25 aa, Plasmodium falciparum
IYLRRIKPLFCYSNMIDRYDGVMSH

SEQ ID NO: 3360870 - protein, 20 aa, Plasmodium falciparum
IYLYKKCRNAYVIKLYVYFF

SEQ ID NO: 3360871 - protein, 39 aa, Plasmodium falciparum
IYMKCKYDPTKVDIFCVGYILYFCLTKHELFKCSLDKDI

SEQ ID NO: 3360872 - protein, 19 aa, Plasmodium falciparum
IYMKSRINIMRENADKNNQ

SEQ ID NO: 3360873 - protein, 17 aa, Plasmodium falciparum
IYMNICINHFVNKLINV

SEQ ID NO: 3360874 - protein, 19 aa, Plasmodium falciparum
IYMRYFKKGIKDKIENMGN

SEQ ID NO: 3360875 - protein, 34 aa, Plasmodium falciparum
IYNEALDHIIELMVDPFGNYLCQKLMEVCTSEQI

SEQ ID NO: 3360876 - protein, 22 aa, Plasmodium falciparum
IYNELHKKYQWVSILEDERMNP

SEQ ID NO: 3360877 - protein, 32 aa, Plasmodium falciparum
IYNEMKTRVMEIFKRENIMSDDYLLYYMYNNI

SEQ ID NO: 3360878 - protein, 25 aa, Plasmodium falciparum
IYNHNIKVVFVFDGEELPEKKKENM

SEQ ID NO: 3360879 - protein, 21 aa, Plasmodium falciparum
IYNINSYLNVVGYNDNKKNDT

SEQ ID NO: 3360880 - protein, 18 aa, Plasmodium falciparum
IYNKIIIKLFLKNRKYYE

SEQ ID NO: 3360881 - protein, 23 aa, Plasmodium falciparum
IYNKKGREGNSFTCEIKNNDCQN

SEQ ID NO: 3360882 - protein, 18 aa, Plasmodium falciparum
IYNLIKLLFDILNFNTDY

SEQ ID NO: 3360883 - protein, 27 aa, Plasmodium falciparum
IYNLRRKSLKIYKSIEIVNTVDEMWWN

SEQ ID NO: 3360884 - protein, 23 aa, Plasmodium falciparum
IYNNSLWVYRYFILNKLSYFHDL

SEQ ID NO: 3360885 - protein, 18 aa, Plasmodium falciparum
IYNTEFFTELYVEDEYYD

SEQ ID NO: 3360886 - protein, 33 aa, Plasmodium falciparum
IYNYRDIFNKNKWDFLKNDDMLLNNNMTSLNNM

SEQ ID NO: 3360887 - protein, 21 aa, Plasmodium falciparum
IYPLKRLKVYNEPNSIEVTLN

SEQ ID NO: 3360888 - protein, 23 aa, Plasmodium falciparum
IYPLMIEAFFILKIDLSNNSISE

SEQ ID NO: 3360889 - protein, 23 aa, Plasmodium falciparum
IYPNVDPKYVIAFDDRKDVWIDI

SEQ ID NO: 3360890 - protein, 22 aa, Plasmodium falciparum
IYPPYHLFDFFSSILRIGQTNL

SEQ ID NO: 3360891 - protein, 18 aa, Plasmodium falciparum
IYPSNNFSNRHMSMYSNR

SEQ ID NO: 3360892 - protein, 20 aa, Plasmodium falciparum
IYPYKMKWLPTYATPNNTQA

SEQ ID NO: 3360893 - protein, 23 aa, Plasmodium falciparum
IYQKIVKFQSFFKHKHFSKLSKV

SEQ ID NO: 3360894 - protein, 26 aa, Plasmodium falciparum
IYRCNSCYQKSYLNYYIAHFGAVNRI

SEQ ID NO: 3360895 - protein, 26 aa, Plasmodium falciparum
IYRDNRLVAWCPHLKTALSDIEVNLE

SEQ ID NO: 3360896 - protein, 25 aa, Plasmodium falciparum
IYRKVHLKKKLINIINEIYKIKNYN

SEQ ID NO: 3360897 - protein, 17 aa, Plasmodium falciparum
IYRSSDIISALREAIKI

SEQ ID NO: 3360898 - protein, 18 aa, Plasmodium falciparum
IYSIFYHMHLMRVQYMDL

SEQ ID NO: 3360899 - protein, 24 aa, Plasmodium falciparum
IYSKCKSIELTGVCVENNYLSTFL

SEQ ID NO: 3360900 - protein, 26 aa, Plasmodium falciparum
IYSLPKKNKPRCLVISDYKNNLLRYF

SEQ ID NO: 3360901 - protein, 18 aa, Plasmodium falciparum
IYSLPNFLIIDNLSNYNP

SEQ ID NO: 3360902 - protein, 27 aa, Plasmodium falciparum
IYSNGYINNCINRYANNYSNESSNNFT

SEQ ID NO: 3360903 - protein, 21 aa, Plasmodium falciparum
IYSQIFFDQVFSIFHLPLSTH

SEQ ID NO: 3360904 - protein, 29 aa, Plasmodium falciparum
IYSQYKNTIKWGPFGNMIALGGFGNLAGD

SEQ ID NO: 3360905 - protein, 26 aa, Plasmodium falciparum
IYSTEKKEDCLFLYGGKRGSYITNDT

SEQ ID NO: 3360906 - protein, 23 aa, Plasmodium falciparum
IYSYSCSLLSQYIKALNISTQQF

SEQ ID NO: 3360907 - protein, 22 aa, Plasmodium falciparum
IYTCMPDNICSREKNKNPESKP

SEQ ID NO: 3360908 - protein, 19 aa, Plasmodium falciparum
IYTDCNVDNIVILNFLKTL

SEQ ID NO: 3360909 - protein, 23 aa, Plasmodium falciparum
IYTDLYNWFGFKNCRNIDTESLN

SEQ ID NO: 3360910 - protein, 18 aa, Plasmodium falciparum
IYTELVESISVIKNLESQ

SEQ ID NO: 3360911 - protein, 24 aa, Plasmodium falciparum
IYTENICFLYGVLRTDVAILLNLR

SEQ ID NO: 3360912 - protein, 29 aa, Plasmodium falciparum
IYTFFKWLLENPFIYKLFFNFPSDIKIMS

SEQ ID NO: 3360913 - protein, 17 aa, Plasmodium falciparum
IYTKIKKGFIFFYGSGH

SEQ ID NO: 3360914 - protein, 24 aa, Plasmodium falciparum
IYTKRASVLLSLKRPKACIRDCTE

SEQ ID NO: 3360915 - protein, 20 aa, Plasmodium falciparum
IYTPKPKLFVYSLKNNLNTN

SEQ ID NO: 3360916 - protein, 19 aa, Plasmodium falciparum
IYTRFCPKISKLTDKCIIG

SEQ ID NO: 3360917 - protein, 33 aa, Plasmodium falciparum
IYTVCVKLDDLCCRLSGTFPHSMNIWEREGKIN

SEQ ID NO: 3360918 - protein, 18 aa, Plasmodium falciparum
IYTYEGTLVNSYNFNELY

SEQ ID NO: 3360919 - protein, 18 aa, Plasmodium falciparum
IYTYIGYILLSVNPYENF

SEQ ID NO: 3360920 - protein, 23 aa, Plasmodium falciparum
IYTYIKLVLLWKRDINIKCIIDN

SEQ ID NO: 3360921 - protein, 20 aa, Plasmodium falciparum
IYVKNIFKFIHTNLLTVASQ

SEQ ID NO: 3360922 - protein, 17 aa, Plasmodium falciparum
IYVNYGFSGTNCIKYPN

SEQ ID NO: 3360923 - protein, 17 aa, Plasmodium falciparum
IYVQVILNFYFLSFNKN

SEQ ID NO: 3360924 - protein, 19 aa, Plasmodium falciparum
IYVSILIHLSYIYKNISID

SEQ ID NO: 3360925 - protein, 18 aa, Plasmodium falciparum
IYWMLNHINNMFNEIKNI

SEQ ID NO: 3360926 - protein, 17 aa, Plasmodium falciparum
IYYCTNPIIFLMQRNDS

SEQ ID NO: 3360927 - protein, 20 aa, Plasmodium falciparum
IYYIPLCNSFIYHKEKDACS

SEQ ID NO: 3360928 - protein, 17 aa, Plasmodium falciparum
IYYKSEKVITWLHVCSS

SEQ ID NO: 3360929 - protein, 19 aa, Plasmodium falciparum
IYYNIKLLYKILDYKNERL

SEQ ID NO: 3360930 - protein, 18 aa, Plasmodium falciparum
IYYNYYFFYEYLNKSSNE

SEQ ID NO: 3360931 - protein, 20 aa, Plasmodium falciparum
IYYPEQNFSQTIGKENQHIY

SEQ ID NO: 3360932 - protein, 17 aa, Plasmodium falciparum
IYYPNGGQVERLKNEMI

SEQ ID NO: 3360933 - protein, 31 aa, Plasmodium falciparum
IYYPYKLPIYMSGLVICCKDFSIYKTFVKMI

SEQ ID NO: 3360934 - protein, 18 aa, Plasmodium falciparum
IYYSINLYTLKEFIQFVN

SEQ ID NO: 3360935 - protein, 25 aa, Plasmodium falciparum
IYYSLIHALFFFGILNVEITPLDNE

SEQ ID NO: 3360936 - protein, 18 aa, Plasmodium falciparum
IYYSMPLIYVYCISNEQD

SEQ ID NO: 3360937 - protein, 39 aa, Plasmodium falciparum
IYYYIMKFSSFHISLKICKLWCISNGIYCYQDFIENILF

SEQ ID NO: 3360938 - protein, 17 aa, Plasmodium falciparum
KAAGIVLRMIKEGRISG

SEQ ID NO: 3360939 - protein, 21 aa, Plasmodium falciparum
KAAICPHAGYDYALETNSHVY

SEQ ID NO: 3360940 - protein, 19 aa, Plasmodium falciparum
KAAVKAIAWCPYKNHILSS

SEQ ID NO: 3360941 - protein, 19 aa, Plasmodium falciparum
KACIRDCTEALNLNIDSAN

SEQ ID NO: 3360942 - protein, 21 aa, Plasmodium falciparum
KACIYQFSFLLLLKKVYDIKQ

SEQ ID NO: 3360943 - protein, 22 aa, Plasmodium falciparum
KADHYKPIWLDEMYNQEKMKEL

SEQ ID NO: 3360944 - protein, 18 aa, Plasmodium falciparum
KAEDVVHKVMNNKCIQNE

SEQ ID NO: 3360945 - protein, 23 aa, Plasmodium falciparum
KAGNLMQWDKLWSINKQIIDPII

SEQ ID NO: 3360946 - protein, 20 aa, Plasmodium falciparum
KAHEYHVWSCTFNGNENVIT

SEQ ID NO: 3360947 - protein, 18 aa, Plasmodium falciparum
KAIECIPNSVKLWKEAIS

SEQ ID NO: 3360948 - protein, 17 aa, Plasmodium falciparum
KAIESIGSIALKIPKCI

SEQ ID NO: 3360949 - protein, 21 aa, Plasmodium falciparum
KAIGSLGGFICANKYYIDVIR

SEQ ID NO: 3360950 - protein, 18 aa, Plasmodium falciparum
KAILSRAAEQVLPIMKKR

SEQ ID NO: 3360951 - protein, 18 aa, Plasmodium falciparum
KAINSRDVNICKPSLSEI

SEQ ID NO: 3360952 - protein, 20 aa, Plasmodium falciparum
KAIRKQGGGRFCFVNLNDGS

SEQ ID NO: 3360953 - protein, 18 aa, Plasmodium falciparum
KAKEIIMKGCVVCSKNED

SEQ ID NO: 3360954 - protein, 22 aa, Plasmodium falciparum
KAKHFKCLHCNRKLDMANGLVV

SEQ ID NO: 3360955 - protein, 23 aa, Plasmodium falciparum
KAKILPYSTFRLNLSVTSPYNAD

SEQ ID NO: 3360956 - protein, 24 aa, Plasmodium falciparum
KAKKELKNDIDFVNSLKKTDILHI

SEQ ID NO: 3360957 - protein, 26 aa, Plasmodium falciparum
KAKKKKAHLFACTYLNRKEPFPKRHI

SEQ ID NO: 3360958 - protein, 23 aa, Plasmodium falciparum
KAKKVPWIYLCRKLKMIEDYHVN

SEQ ID NO: 3360959 - protein, 19 aa, Plasmodium falciparum
KAKLKYIFDKSFDDLEEVC

SEQ ID NO: 3360960 - protein, 17 aa, Plasmodium falciparum
KAKLLFTPKEFFNTLND

SEQ ID NO: 3360961 - protein, 24 aa, Plasmodium falciparum
KAKNELKPIILMGTSMGGCIAVKM

SEQ ID NO: 3360962 - protein, 22 aa, Plasmodium falciparum
KAKNLFNLSRLTGITSTTIPGA

SEQ ID NO: 3360963 - protein, 31 aa, Plasmodium falciparum
KAKNRSCLSHGFHLTSLIGWSKKKKEPFFIS

SEQ ID NO: 3360964 - protein, 25 aa, Plasmodium falciparum
KAKTFGGTVKKGGTIINLEAESQRI

SEQ ID NO: 3360965 - protein, 25 aa, Plasmodium falciparum
KAKTSPDLWSFDPLKENEVIIKNSE

SEQ ID NO: 3360966 - protein, 19 aa, Plasmodium falciparum
KAKVWLEHFNDIISEDIKN

SEQ ID NO: 3360967 - protein, 18 aa, Plasmodium falciparum
KALDIILKNYKKWPEYTD

SEQ ID NO: 3360968 - protein, 26 aa, Plasmodium falciparum
KALLKLRACLSCRMLKSESEFYQNGC

SEQ ID NO: 3360969 - protein, 18 aa, Plasmodium falciparum
KALLSGFYQQVAYKTTKG

SEQ ID NO: 3360970 - protein, 22 aa, Plasmodium falciparum
KALNALQGYVLFGKIMQINFSH

SEQ ID NO: 3360971 - protein, 22 aa, Plasmodium falciparum
KALSKYYFLIGIYYHILQNMKK

SEQ ID NO: 3360972 - protein, 25 aa, Plasmodium falciparum
KAMIKELKGIYGIIMERFEKAMNIK

SEQ ID NO: 3360973 - protein, 34 aa, Plasmodium falciparum
KANFISAGKICICITSDEDIYIWGDNYGNKPNLI

SEQ ID NO: 3360974 - protein, 20 aa, Plasmodium falciparum
KANHVERIKITHIDTFTSNN

SEQ ID NO: 3360975 - protein, 19 aa, Plasmodium falciparum
KANNLFFYLYLTISIHGYN

SEQ ID NO: 3360976 - protein, 25 aa, Plasmodium falciparum
KANPNWCYHNKFTPILLAYNLNKAW

SEQ ID NO: 3360977 - protein, 24 aa, Plasmodium falciparum
KAQGKTGPLFSFDAVENLSGITDI

SEQ ID NO: 3360978 - protein, 18 aa, Plasmodium falciparum
KAREEIQIRNSVMKQKKL

SEQ ID NO: 3360979 - protein, 25 aa, Plasmodium falciparum
KARHCPRLLYAMCCLDYRCYFLLPT

SEQ ID NO: 3360980 - protein, 18 aa, Plasmodium falciparum
KARLNENGLHKCSSSESS

SEQ ID NO: 3360981 - protein, 28 aa, Plasmodium falciparum
KASDDLLWHKMSEQFDRNNKSILELSEK

SEQ ID NO: 3360982 - protein, 17 aa, Plasmodium falciparum
KASPLVCKLNNEKILSM

SEQ ID NO: 3360983 - protein, 25 aa, Plasmodium falciparum
KASRAAGPLAKWVESVITFLNILET

SEQ ID NO: 3360984 - protein, 20 aa, Plasmodium falciparum
KASSFNTIFTNSRSTFPKSL

SEQ ID NO: 3360985 - protein, 18 aa, Plasmodium falciparum
KASVYFSNNQKFLYFAVP

SEQ ID NO: 3360986 - protein, 30 aa, Plasmodium falciparum
KASYEFISHLGFPCYYIYLNKEKNLIICNS

SEQ ID NO: 3360987 - protein, 28 aa, Plasmodium falciparum
KATYTCLLCKRKKKINLQHLSKHKNIYP

SEQ ID NO: 3360988 - protein, 19 aa, Plasmodium falciparum
KAVKHGFQSMGIRNIPELH

SEQ ID NO: 3360989 - protein, 19 aa, Plasmodium falciparum
KAYENVFPNNFVKELVNRI

SEQ ID NO: 3360990 - protein, 26 aa, Plasmodium falciparum
KAYKENIAFSCFSFYNIIDQRINTLQ

SEQ ID NO: 3360991 - protein, 18 aa, Plasmodium falciparum
KAYMKDKILQVALSNNMF

SEQ ID NO: 3360992 - protein, 19 aa, Plasmodium falciparum
KAYSCFYIYHKNLFLKYNI

SEQ ID NO: 3360993 - protein, 19 aa, Plasmodium falciparum
KAYSRKGNLHFFMKDYYKA

SEQ ID NO: 3360994 - protein, 17 aa, Plasmodium falciparum
KCASCGYPSAKKRRFNW

SEQ ID NO: 3360995 - protein, 34 aa, Plasmodium falciparum
KCAYASDKFTLFLTIEGILYGVGLINEHLLKGDM

SEQ ID NO: 3360996 - protein, 23 aa, Plasmodium falciparum
KCDCDDCPFSNGYKNLITVDDPY

SEQ ID NO: 3360997 - protein, 19 aa, Plasmodium falciparum
KCDGSLYFIDGILYPDLRS

SEQ ID NO: 3360998 - protein, 24 aa, Plasmodium falciparum
KCDIWSCGVILYILLSGCPPFNGS

SEQ ID NO: 3360999 - protein, 29 aa, Plasmodium falciparum
KCDKIKMRCVRILRMIEEVYNNKGNEQSG

SEQ ID NO: 3361000 - protein, 30 aa, Plasmodium falciparum
KCDVAGVYWDKRSWIASWYDNGKRYYKSFS

SEQ ID NO: 3361001 - protein, 17 aa, Plasmodium falciparum
KCESESYLPNKLKNKKK

SEQ ID NO: 3361002 - protein, 18 aa, Plasmodium falciparum
KCETNKCDIYITKDNLEE

SEQ ID NO: 3361003 - protein, 22 aa, Plasmodium falciparum
KCFKICRQLNLNGLVIIGDVSG

SEQ ID NO: 3361004 - protein, 18 aa, Plasmodium falciparum
KCGDLKCELINKTCLTFV

SEQ ID NO: 3361005 - protein, 21 aa, Plasmodium falciparum
KCGIKEIILAIAYKPTNITNF

SEQ ID NO: 3361006 - protein, 17 aa, Plasmodium falciparum
KCGKLTRIMIKYRDSYE

SEQ ID NO: 3361007 - protein, 18 aa, Plasmodium falciparum
KCHACVGGTVVREDIDKL

SEQ ID NO: 3361008 - protein, 25 aa, Plasmodium falciparum
KCICCPNCKYVVYCSDMCLERAWKS

SEQ ID NO: 3361009 - protein, 21 aa, Plasmodium falciparum
KCIDGYICFSTFYMKIKNYRD

SEQ ID NO: 3361010 - protein, 18 aa, Plasmodium falciparum
KCILARELIIIYMSTYKK

SEQ ID NO: 3361011 - protein, 26 aa, Plasmodium falciparum
KCINFLIDMMTPYYFKNHQVLLNVFK

SEQ ID NO: 3361012 - protein, 30 aa, Plasmodium falciparum
KCINNKIKELWCGRMKGLMNLKLCNMERKI

SEQ ID NO: 3361013 - protein, 23 aa, Plasmodium falciparum
KCINNQIGCFNHHIGCPNNHGDC

SEQ ID NO: 3361014 - protein, 17 aa, Plasmodium falciparum
KCKELNYVIPSTYMKVN

SEQ ID NO: 3361015 - protein, 19 aa, Plasmodium falciparum
KCKIIRTYVIYNYIGLIKI

SEQ ID NO: 3361016 - protein, 22 aa, Plasmodium falciparum
KCKQIKEKYAFYISENNIDLIL

SEQ ID NO: 3361017 - protein, 29 aa, Plasmodium falciparum
KCKYACEIIYYKRLEQIKSSSHNLLFTMY

SEQ ID NO: 3361018 - protein, 28 aa, Plasmodium falciparum
KCLHFLKLETILKCELLNKMSCDIINNR

SEQ ID NO: 3361019 - protein, 18 aa, Plasmodium falciparum
KCLKESIHYLFVKYQDNY

SEQ ID NO: 3361020 - protein, 18 aa, Plasmodium falciparum
KCLRYCDYSTIDLKNNYI

SEQ ID NO: 3361021 - protein, 23 aa, Plasmodium falciparum
KCLSDECYKRFMRGYGEEDESEK

SEQ ID NO: 3361022 - protein, 22 aa, Plasmodium falciparum
KCMKTVKSVLDWLEKNQTAETE

SEQ ID NO: 3361023 - protein, 18 aa, Plasmodium falciparum
KCNMYYKQYIELESNVKN

SEQ ID NO: 3361024 - protein, 19 aa, Plasmodium falciparum
KCNTLPFFIGYSPCTYEKR

SEQ ID NO: 3361025 - protein, 19 aa, Plasmodium falciparum
KCNYNRLSKLSSEGKNHRF

SEQ ID NO: 3361026 - protein, 21 aa, Plasmodium falciparum
KCNYVNYDFFSYLLKQGNLFM

SEQ ID NO: 3361027 - protein, 27 aa, Plasmodium falciparum
KCPTLLRISILFNRLQDVISLINEKYY

SEQ ID NO: 3361028 - protein, 19 aa, Plasmodium falciparum
KCRKTCCEMLEDRGYIMTP

SEQ ID NO: 3361029 - protein, 18 aa, Plasmodium falciparum
KCRNKLYNGNVFSDDIIK

SEQ ID NO: 3361030 - protein, 18 aa, Plasmodium falciparum
KCRRIRRVHNKSGGDEKS

SEQ ID NO: 3361031 - protein, 17 aa, Plasmodium falciparum
KCSFKKKVDTEIFCLNE

SEQ ID NO: 3361032 - protein, 24 aa, Plasmodium falciparum
KCSGGLKNTYIINIFNKYDFIHIH

SEQ ID NO: 3361033 - protein, 37 aa, Plasmodium falciparum
KCSGKFEVLDRMLPKLLKFKHKVLIFSQMTKLMNILC

SEQ ID NO: 3361034 - protein, 24 aa, Plasmodium falciparum
KCSKKEYYEKAIIILNEKIENRVL

SEQ ID NO: 3361035 - protein, 19 aa, Plasmodium falciparum
KCSKNLYEEFLIKEKHKYY

SEQ ID NO: 3361036 - protein, 21 aa, Plasmodium falciparum
KCSTSLIYMLSLKCRYIESIW

SEQ ID NO: 3361037 - protein, 18 aa, Plasmodium falciparum
KCSVFCVLSGKSSKDENA

SEQ ID NO: 3361038 - protein, 26 aa, Plasmodium falciparum
KCTIRLFSFQVIDILKKIFENNNKDI

SEQ ID NO: 3361039 - protein, 17 aa, Plasmodium falciparum
KCVFNLVGHLDYIRKVQ

SEQ ID NO: 3361040 - protein, 19 aa, Plasmodium falciparum
KCVHKNFFMKNEQQLKKKI

SEQ ID NO: 3361041 - protein, 25 aa, Plasmodium falciparum
KCVKSVINGFPWLYSKDIKNAEELY

SEQ ID NO: 3361042 - protein, 17 aa, Plasmodium falciparum
KCVKVKNGVKLFNINDY

SEQ ID NO: 3361043 - protein, 17 aa, Plasmodium falciparum
KCVNDIWNVNKIYVIFK

SEQ ID NO: 3361044 - protein, 22 aa, Plasmodium falciparum
KDAEVFSLLSTVFKKIENVTCP

SEQ ID NO: 3361045 - protein, 22 aa, Plasmodium falciparum
KDAKASALTLEILGDIPDADMK

SEQ ID NO: 3361046 - protein, 19 aa, Plasmodium falciparum
KDAKDIICDNNITLKNKIP

SEQ ID NO: 3361047 - protein, 17 aa, Plasmodium falciparum
KDAYFKLIEKFDRMYSI

SEQ ID NO: 3361048 - protein, 17 aa, Plasmodium falciparum
KDCHLKMDNQDNIKINK

SEQ ID NO: 3361049 - protein, 18 aa, Plasmodium falciparum
KDCKCLLLNYEMRDNKYC

SEQ ID NO: 3361050 - protein, 25 aa, Plasmodium falciparum
KDCYMYDFMEDMWSKYTFKLDSSPG

SEQ ID NO: 3361051 - protein, 21 aa, Plasmodium falciparum
KDDIKSMKGSLAYDNINNKIK

SEQ ID NO: 3361052 - protein, 17 aa, Plasmodium falciparum
KDDKYEHKVEDINEHKV

SEQ ID NO: 3361053 - protein, 18 aa, Plasmodium falciparum
KDDVLIEYYDCQENYNKN

SEQ ID NO: 3361054 - protein, 22 aa, Plasmodium falciparum
KDDVLKRYSMYLKDPKENNTKK

SEQ ID NO: 3361055 - protein, 36 aa, Plasmodium falciparum
KDEAYIVQIIKYIEKLKEQDKIFGINKNEEKQENKN

SEQ ID NO: 3361056 - protein, 25 aa, Plasmodium falciparum
KDEEFFNHINVLKVRDNDISHSNNN

SEQ ID NO: 3361057 - protein, 22 aa, Plasmodium falciparum
KDEEKCRYVKKESCEHNNDGSK

SEQ ID NO: 3361058 - protein, 26 aa, Plasmodium falciparum
KDEFKMKLKFFSTRFSNSILLDKLII

SEQ ID NO: 3361059 - protein, 20 aa, Plasmodium falciparum
KDEICSWCFDTLYYELKNEK

SEQ ID NO: 3361060 - protein, 25 aa, Plasmodium falciparum
KDEKICMNGWIQISFIFYEKNYYKL

SEQ ID NO: 3361061 - protein, 24 aa, Plasmodium falciparum
KDEKKYGIHYSIKKNTKIYREDMK

SEQ ID NO: 3361062 - protein, 21 aa, Plasmodium falciparum
KDELKLAWPENASSINSIKHV

SEQ ID NO: 3361063 - protein, 22 aa, Plasmodium falciparum
KDEVVICPFCQSVAKKEFTSTI

SEQ ID NO: 3361064 - protein, 25 aa, Plasmodium falciparum
KDFAKSFDPMFIIIRKRYRKDNLSA

SEQ ID NO: 3361065 - protein, 18 aa, Plasmodium falciparum
KDFFCLFEKDIFYILKYY

SEQ ID NO: 3361066 - protein, 19 aa, Plasmodium falciparum
KDFIKYFIKNFPKEETRVS

SEQ ID NO: 3361067 - protein, 21 aa, Plasmodium falciparum
KDFMPHLYQQIVIWANSKNYL

SEQ ID NO: 3361068 - protein, 18 aa, Plasmodium falciparum
KDFSEHSTFFGKRNNSHM

SEQ ID NO: 3361069 - protein, 18 aa, Plasmodium falciparum
KDFSHRVPQSGAIRRERG

SEQ ID NO: 3361070 - protein, 19 aa, Plasmodium falciparum
KDFYELYLTIYPSHIYKPN

SEQ ID NO: 3361071 - protein, 37 aa, Plasmodium falciparum
KDGDIYLQLFEYIWPKVMKKYKGRIIMYPSSDNERKE

SEQ ID NO: 3361072 - protein, 35 aa, Plasmodium falciparum
KDGFYKAQEFWSLGFGNPFPCSGIHGNGLSEILDE

SEQ ID NO: 3361073 - protein, 22 aa, Plasmodium falciparum
KDGGRLTSAWELFKAQEKLVHI

SEQ ID NO: 3361074 - protein, 21 aa, Plasmodium falciparum
KDGIKNIIFFFKCSNGEEEQK

SEQ ID NO: 3361075 - protein, 52 aa, Plasmodium falciparum
KDGPPGANLFLYGIPLKWTELNLIQLVNKYGHVVGLRIPYISKENDKKQGNR

SEQ ID NO: 3361076 - protein, 25 aa, Plasmodium falciparum
KDGQDVVGFVKTRLEKFEEIPDDPN

SEQ ID NO: 3361077 - protein, 18 aa, Plasmodium falciparum
KDHICLITDHYFNNKVSN

SEQ ID NO: 3361078 - protein, 28 aa, Plasmodium falciparum
KDHIRKRSLNNLCFQSNLLNRRSNINTF

SEQ ID NO: 3361079 - protein, 17 aa, Plasmodium falciparum
KDHKRKSSKYVYKHIVR

SEQ ID NO: 3361080 - protein, 25 aa, Plasmodium falciparum
KDHLKFFYKCIIICPTEELCLQIYD

SEQ ID NO: 3361081 - protein, 23 aa, Plasmodium falciparum
KDICLTVKHFKNKLAEIEQYVNS

SEQ ID NO: 3361082 - protein, 31 aa, Plasmodium falciparum
KDIDEIAKYNIKFNDIIYAIKVHKKKNGNDV

SEQ ID NO: 3361083 - protein, 19 aa, Plasmodium falciparum
KDIDYIIKLAMKYDAILCT

SEQ ID NO: 3361084 - protein, 20 aa, Plasmodium falciparum
KDIFFKKKIETQEQENVTQI

SEQ ID NO: 3361085 - protein, 24 aa, Plasmodium falciparum
KDIFKEPLILAYILSKKLHKQLYR

SEQ ID NO: 3361086 - protein, 19 aa, Plasmodium falciparum
KDIHLKGFLVCSNCMHNVK

SEQ ID NO: 3361087 - protein, 25 aa, Plasmodium falciparum
KDIHSCSYFISLLIRNIAYTNKIYK

SEQ ID NO: 3361088 - protein, 19 aa, Plasmodium falciparum
KDIHYSKEFNRFPSDNYHN

SEQ ID NO: 3361089 - protein, 31 aa, Plasmodium falciparum
KDIITKGLGIYPLLAKPLLHRLIKENIIKEK

SEQ ID NO: 3361090 - protein, 23 aa, Plasmodium falciparum
KDIKDAHNFWNFNTFSKNKINFY

SEQ ID NO: 3361091 - protein, 21 aa, Plasmodium falciparum
KDIKIPCAHHESLCNNSTNTN

SEQ ID NO: 3361092 - protein, 35 aa, Plasmodium falciparum
KDIKIRKSNIIELNKLLKENLRIEQNLQKQKKDKI

SEQ ID NO: 3361093 - protein, 21 aa, Plasmodium falciparum
KDIKSDVNISTLFKDLQNKNN

SEQ ID NO: 3361094 - protein, 24 aa, Plasmodium falciparum
KDILCARYILFYQHICKRGYKEAA

SEQ ID NO: 3361095 - protein, 20 aa, Plasmodium falciparum
KDILEKVFFYTQSKKSYELL

SEQ ID NO: 3361096 - protein, 19 aa, Plasmodium falciparum
KDILKRYILQNDYVEVRCY

SEQ ID NO: 3361097 - protein, 19 aa, Plasmodium falciparum
KDILRYHRIFEIQNNIINI

SEQ ID NO: 3361098 - protein, 28 aa, Plasmodium falciparum
KDINKFPIYCDMFNHLIHPEALRLHELY

SEQ ID NO: 3361099 - protein, 26 aa, Plasmodium falciparum
KDINLFCGVLDIFGFESFPVNSFEQL

SEQ ID NO: 3361100 - protein, 20 aa, Plasmodium falciparum
KDINTMDLLNSSRKYNSMKN

SEQ ID NO: 3361101 - protein, 17 aa, Plasmodium falciparum
KDINVKWMLLKSNHKKI

SEQ ID NO: 3361102 - protein, 19 aa, Plasmodium falciparum
KDIQSLCNIQEYRNNKEEC

SEQ ID NO: 3361103 - protein, 19 aa, Plasmodium falciparum
KDIRCYTCYDAMSNNSKNK

SEQ ID NO: 3361104 - protein, 19 aa, Plasmodium falciparum
KDIREIMKNNKTRIENLYD

SEQ ID NO: 3361105 - protein, 21 aa, Plasmodium falciparum
KDITYNMNVVIRCRPMSISEK

SEQ ID NO: 3361106 - protein, 23 aa, Plasmodium falciparum
KDIWIHVLEFYKNNFLTKHTNIK

SEQ ID NO: 3361107 - protein, 17 aa, Plasmodium falciparum
KDIWTHFINQLNIKNKS

SEQ ID NO: 3361108 - protein, 17 aa, Plasmodium falciparum
KDIYGYKSICSEDNSKN

SEQ ID NO: 3361109 - protein, 22 aa, Plasmodium falciparum
KDIYSSNLWKQFEEYLEEISKS

SEQ ID NO: 3361110 - protein, 20 aa, Plasmodium falciparum
KDKDLCLFGRELRKRNIFKR

SEQ ID NO: 3361111 - protein, 30 aa, Plasmodium falciparum
KDKFRLYRSLLKFGNPSLRLDDIQEDAKLT

SEQ ID NO: 3361112 - protein, 19 aa, Plasmodium falciparum
KDKGNYGFVEFATVEETER

SEQ ID NO: 3361113 - protein, 18 aa, Plasmodium falciparum
KDKHLYVIKSIPLKGKQL

SEQ ID NO: 3361114 - protein, 18 aa, Plasmodium falciparum
KDKHSLPYNDYLSKDSAY

SEQ ID NO: 3361115 - protein, 20 aa, Plasmodium falciparum
KDKIIVHLNLQIKKLANQNE

SEQ ID NO: 3361116 - protein, 18 aa, Plasmodium falciparum
KDKIKIFINKFGKQKFRI

SEQ ID NO: 3361117 - protein, 20 aa, Plasmodium falciparum
KDKIMGMLKMNSLFLKDTCR

SEQ ID NO: 3361118 - protein, 20 aa, Plasmodium falciparum
KDKINALLEIGMYKENDMET

SEQ ID NO: 3361119 - protein, 18 aa, Plasmodium falciparum
KDKKDKKASLGSVKETYE

SEQ ID NO: 3361120 - protein, 23 aa, Plasmodium falciparum
KDKKENLNSMILLNDNNSNNGSS

SEQ ID NO: 3361121 - protein, 21 aa, Plasmodium falciparum
KDKKIKICMNVKSKKSVSKHV

SEQ ID NO: 3361122 - protein, 40 aa, Plasmodium falciparum
KDKKKLGFQCIYCRDRQLFKKKSSVLYHMVTFNHGLKNSV

SEQ ID NO: 3361123 - protein, 29 aa, Plasmodium falciparum
KDKKQRINMCKVIKSLVKKACALQIDVSN

SEQ ID NO: 3361124 - protein, 21 aa, Plasmodium falciparum
KDKKWCFCFNSYGKIINQEEK

SEQ ID NO: 3361125 - protein, 21 aa, Plasmodium falciparum
KDKLKLSYRIVNAGFNSNEDA

SEQ ID NO: 3361126 - protein, 17 aa, Plasmodium falciparum
KDKMGNVYCKDRERRVF

SEQ ID NO: 3361127 - protein, 20 aa, Plasmodium falciparum
KDKNVGLLQHEERSLEKDGT

SEQ ID NO: 3361128 - protein, 25 aa, Plasmodium falciparum
KDKNVLDLFSYVGSFGITLAYYGAK

SEQ ID NO: 3361129 - protein, 18 aa, Plasmodium falciparum
KDKQSVLNNEKKELRNEE

SEQ ID NO: 3361130 - protein, 23 aa, Plasmodium falciparum
KDKRGKNKKDTCENINDNIYENR

SEQ ID NO: 3361131 - protein, 24 aa, Plasmodium falciparum
KDKSFKNLLSFYIHPMYNNINYND

SEQ ID NO: 3361132 - protein, 25 aa, Plasmodium falciparum
KDKTYELLRSLVLLTQTLEPLPERT

SEQ ID NO: 3361133 - protein, 29 aa, Plasmodium falciparum
KDKVGFITCKLCNIKNKLSLESIEILTKV

SEQ ID NO: 3361134 - protein, 25 aa, Plasmodium falciparum
KDKVWKRFNIKNNIKTIIHNEEMKR

SEQ ID NO: 3361135 - protein, 20 aa, Plasmodium falciparum
KDKYESWTVTNVIIKREKKR

SEQ ID NO: 3361136 - protein, 22 aa, Plasmodium falciparum
KDKYMLNHIVSIDICNDKENKD

SEQ ID NO: 3361137 - protein, 20 aa, Plasmodium falciparum
KDKYNICSNPFLQKEDIKPF

SEQ ID NO: 3361138 - protein, 20 aa, Plasmodium falciparum
KDLELLLSYFSLMNSVSLKL

SEQ ID NO: 3361139 - protein, 22 aa, Plasmodium falciparum
KDLENRGLHSFVKILEKVDIDG

SEQ ID NO: 3361140 - protein, 19 aa, Plasmodium falciparum
KDLFIGLNVQSILPLFYIK

SEQ ID NO: 3361141 - protein, 20 aa, Plasmodium falciparum
KDLFMKSGGNYLYKNKNIAN

SEQ ID NO: 3361142 - protein, 18 aa, Plasmodium falciparum
KDLIEEIKQFYIIHNNNI

SEQ ID NO: 3361143 - protein, 25 aa, Plasmodium falciparum
KDLIEMLFYLSLHIEFKKQLLEEKN

SEQ ID NO: 3361144 - protein, 17 aa, Plasmodium falciparum
KDLKAALPYLHEAEEAI

SEQ ID NO: 3361145 - protein, 21 aa, Plasmodium falciparum
KDLKDYLIRYNKFEELYNYCY

SEQ ID NO: 3361146 - protein, 19 aa, Plasmodium falciparum
KDLKFYSKDFVIYKNLELI

SEQ ID NO: 3361147 - protein, 26 aa, Plasmodium falciparum
KDLKKSILRKNIKIINYDYEKNLCYI

SEQ ID NO: 3361148 - protein, 22 aa, Plasmodium falciparum
KDLKNDILYLLHEAFIECGQKK

SEQ ID NO: 3361149 - protein, 23 aa, Plasmodium falciparum
KDLKRVLVCSVLLNGHYGHKGVF

SEQ ID NO: 3361150 - protein, 19 aa, Plasmodium falciparum
KDLLEKVSLLSYKQSNECI

SEQ ID NO: 3361151 - protein, 26 aa, Plasmodium falciparum
KDLLITRILIHPEWRNNNHNYNFTYK

SEQ ID NO: 3361152 - protein, 22 aa, Plasmodium falciparum
KDLMLCSVCLSKASYSDKNKEE

SEQ ID NO: 3361153 - protein, 23 aa, Plasmodium falciparum
KDLNIKLGYCDKIEEIIIGEDKL

SEQ ID NO: 3361154 - protein, 26 aa, Plasmodium falciparum
KDLNNLEHFICIIGFSSTECYGYFFK

SEQ ID NO: 3361155 - protein, 19 aa, Plasmodium falciparum
KDLPKGRALDILHTRPLNR

SEQ ID NO: 3361156 - protein, 22 aa, Plasmodium falciparum
KDLPNIIKMSDFLNELKKKQYL

SEQ ID NO: 3361157 - protein, 25 aa, Plasmodium falciparum
KDLRSRIISLVLEYLLIIDNGYVTN

SEQ ID NO: 3361158 - protein, 29 aa, Plasmodium falciparum
KDLTAYYIKKLKDIFKLETEAAKNYYYYV

SEQ ID NO: 3361159 - protein, 27 aa, Plasmodium falciparum
KDLTKNFDIFLCLFMKYEKNESQLLAL

SEQ ID NO: 3361160 - protein, 18 aa, Plasmodium falciparum
KDMCPKSVSLIVKKENHI

SEQ ID NO: 3361161 - protein, 20 aa, Plasmodium falciparum
KDMCRKGYNCYYIKEKENDK

SEQ ID NO: 3361162 - protein, 17 aa, Plasmodium falciparum
KDMEFIADMLLKAILLT

SEQ ID NO: 3361163 - protein, 26 aa, Plasmodium falciparum
KDMFDFLYLYSIKFFKAKRVEGNTND

SEQ ID NO: 3361164 - protein, 19 aa, Plasmodium falciparum
KDMHKYFTFEKYKMITIKP

SEQ ID NO: 3361165 - protein, 26 aa, Plasmodium falciparum
KDMIKDFKFALVWGRSTKHNPQRVDL

SEQ ID NO: 3361166 - protein, 20 aa, Plasmodium falciparum
KDMTNVKCKIGISNYGTHKL

SEQ ID NO: 3361167 - protein, 22 aa, Plasmodium falciparum
KDMTYLWIKVFDNVYICEDNIY

SEQ ID NO: 3361168 - protein, 20 aa, Plasmodium falciparum
KDMYAEAVVHTLIYKNMENN

SEQ ID NO: 3361169 - protein, 20 aa, Plasmodium falciparum
KDNDTVIVMVTRRIINKNNQ

SEQ ID NO: 3361170 - protein, 23 aa, Plasmodium falciparum
KDNEDWPNVVFLGCDKLYDWDVF

SEQ ID NO: 3361171 - protein, 30 aa, Plasmodium falciparum
KDNEKRIFLMENYWEYSILTLHDFNVNMVH

SEQ ID NO: 3361172 - protein, 19 aa, Plasmodium falciparum
KDNIPLILLQQIKEKQNSL

SEQ ID NO: 3361173 - protein, 18 aa, Plasmodium falciparum
KDNKCFKGVLDISYNNLN

SEQ ID NO: 3361174 - protein, 26 aa, Plasmodium falciparum
KDNKDLYEHINFNNIESISNYLNNYK

SEQ ID NO: 3361175 - protein, 26 aa, Plasmodium falciparum
KDNLEYCLSEGKTLLIENVEEYIDPI

SEQ ID NO: 3361176 - protein, 25 aa, Plasmodium falciparum
KDNLIHDEGMCEFKSQDENFLHAEV

SEQ ID NO: 3361177 - protein, 22 aa, Plasmodium falciparum
KDNLRNHLFVDFNLNLIKNDYR

SEQ ID NO: 3361178 - protein, 18 aa, Plasmodium falciparum
KDNNCNIFLNPSNIKDTL

SEQ ID NO: 3361179 - protein, 22 aa, Plasmodium falciparum
KDNRAWDFLDTVEFLIDIESEF

SEQ ID NO: 3361180 - protein, 17 aa, Plasmodium falciparum
KDNRLIFFALQNNTLLI

SEQ ID NO: 3361181 - protein, 19 aa, Plasmodium falciparum
KDNSLFQRIFKSIEEEKMK

SEQ ID NO: 3361182 - protein, 17 aa, Plasmodium falciparum
KDNTAECLNTLKLTIEA

SEQ ID NO: 3361183 - protein, 23 aa, Plasmodium falciparum
KDNYGEVVLSFYKDIGYPYTISK

SEQ ID NO: 3361184 - protein, 20 aa, Plasmodium falciparum
KDNYTIIFLFSVNESGGFQG

SEQ ID NO: 3361185 - protein, 20 aa, Plasmodium falciparum
KDPFNPLLLAYEKKEKKKYR

SEQ ID NO: 3361186 - protein, 18 aa, Plasmodium falciparum
KDPKGIDKDGYFENFMLC

SEQ ID NO: 3361187 - protein, 35 aa, Plasmodium falciparum
KDQAVKHFLYQNILKKNFILFNIFKGGKNSNNEED

SEQ ID NO: 3361188 - protein, 17 aa, Plasmodium falciparum
KDQKISALFYFYYLKKF

SEQ ID NO: 3361189 - protein, 24 aa, Plasmodium falciparum
KDRLGGDFNKIYGFHNTNNNYTNT

SEQ ID NO: 3361190 - protein, 18 aa, Plasmodium falciparum
KDRVLFRNNILLNVNNIN

SEQ ID NO: 3361191 - protein, 22 aa, Plasmodium falciparum
KDSDGIYNLCHINENNINNSSF

SEQ ID NO: 3361192 - protein, 24 aa, Plasmodium falciparum
KDSDMFRLRDKYRRLGKSHSQSFS

SEQ ID NO: 3361193 - protein, 20 aa, Plasmodium falciparum
KDSFFIIFEKAWKLFFHDDT

SEQ ID NO: 3361194 - protein, 18 aa, Plasmodium falciparum
KDSFPLNSYYNFVKNNNH

SEQ ID NO: 3361195 - protein, 23 aa, Plasmodium falciparum
KDSGITWGLTFSFYYPHAKSSVL

SEQ ID NO: 3361196 - protein, 24 aa, Plasmodium falciparum
KDSIDLRRVESISHGSKENNNIDK

SEQ ID NO: 3361197 - protein, 29 aa, Plasmodium falciparum
KDSKAKIICYYAFIPLCNIKDQIINKKLI

SEQ ID NO: 3361198 - protein, 25 aa, Plasmodium falciparum
KDSKGRFLTLLSWTGRKKNLYSLNN

SEQ ID NO: 3361199 - protein, 21 aa, Plasmodium falciparum
KDSKMIIANFINRIKDSKQEQ

SEQ ID NO: 3361200 - protein, 24 aa, Plasmodium falciparum
KDSLGGNCKTVMIANISPSHLSYE

SEQ ID NO: 3361201 - protein, 17 aa, Plasmodium falciparum
KDSLVMCSLDHKIENES

SEQ ID NO: 3361202 - protein, 23 aa, Plasmodium falciparum
KDSYKVGHTMVFLKKEAVHKIRD

SEQ ID NO: 3361203 - protein, 20 aa, Plasmodium falciparum
KDTAILPCRHMCLCNVCANV

SEQ ID NO: 3361204 - protein, 19 aa, Plasmodium falciparum
KDTYKEFFIHENKHITPYY

SEQ ID NO: 3361205 - protein, 29 aa, Plasmodium falciparum
KDTYNDLLFKWIYDTGSKILFIYMKEDVN

SEQ ID NO: 3361206 - protein, 21 aa, Plasmodium falciparum
KDVADFLNVEESYFSENKEKK

SEQ ID NO: 3361207 - protein, 17 aa, Plasmodium falciparum
KDVFSGNFLSYIYNQFE

SEQ ID NO: 3361208 - protein, 24 aa, Plasmodium falciparum
KDVGKSCLVKALQEICINNDEQED

SEQ ID NO: 3361209 - protein, 17 aa, Plasmodium falciparum
KDVHLFISPGTLEYLRE

SEQ ID NO: 3361210 - protein, 24 aa, Plasmodium falciparum
KDVHVFRFVCEYTVEENIWKKQLQ

SEQ ID NO: 3361211 - protein, 17 aa, Plasmodium falciparum
KDVKKSKKEKDKIKAAY

SEQ ID NO: 3361212 - protein, 28 aa, Plasmodium falciparum
KDVKSKLSKFLIVPIIHPGVATDPRLHF

SEQ ID NO: 3361213 - protein, 19 aa, Plasmodium falciparum
KDVKVNRKRIIIEKLVLEN

SEQ ID NO: 3361214 - protein, 18 aa, Plasmodium falciparum
KDVLLRYDRSLLVGDTRR

SEQ ID NO: 3361215 - protein, 24 aa, Plasmodium falciparum
KDVLNKLFLMLLFEITKRIDKMNT

SEQ ID NO: 3361216 - protein, 19 aa, Plasmodium falciparum
KDVPLLLERNGTVYEGYVL

SEQ ID NO: 3361217 - protein, 18 aa, Plasmodium falciparum
KDVRFDLIKIEGKTGGLL

SEQ ID NO: 3361218 - protein, 17 aa, Plasmodium falciparum
KDVRFLWVASPMIKEDQ

SEQ ID NO: 3361219 - protein, 17 aa, Plasmodium falciparum
KDWLKRILLNNNTNDLR

SEQ ID NO: 3361220 - protein, 26 aa, Plasmodium falciparum
KDYELLKKIRIIYKMIDIPSDLFCFC

SEQ ID NO: 3361221 - protein, 18 aa, Plasmodium falciparum
KDYFKKEKFSTFNQKKER

SEQ ID NO: 3361222 - protein, 21 aa, Plasmodium falciparum
KDYFLKHAKSILCNMSENINL

SEQ ID NO: 3361223 - protein, 19 aa, Plasmodium falciparum
KDYGHVEISIGFTKVICKI

SEQ ID NO: 3361224 - protein, 25 aa, Plasmodium falciparum
KDYIKNVIYFLSKIFHYNFLDYTYI

SEQ ID NO: 3361225 - protein, 21 aa, Plasmodium falciparum
KDYLHALVIWFDISFSACHTE

SEQ ID NO: 3361226 - protein, 23 aa, Plasmodium falciparum
KEAKAKHPLIKFTYNMQADLERK

SEQ ID NO: 3361227 - protein, 23 aa, Plasmodium falciparum
KEAKKKASVIIMKNERLQKVYKG

SEQ ID NO: 3361228 - protein, 29 aa, Plasmodium falciparum
KEALASFNFKVCIYINVLFSNNFITNPSV

SEQ ID NO: 3361229 - protein, 20 aa, Plasmodium falciparum
KEASCCILKNALLHKKNNET

SEQ ID NO: 3361230 - protein, 20 aa, Plasmodium falciparum
KECDKIIILSCNIYLWENKI

SEQ ID NO: 3361231 - protein, 24 aa, Plasmodium falciparum
KECILSGLLSHYGKKILVLDRNPY

SEQ ID NO: 3361232 - protein, 17 aa, Plasmodium falciparum
KECNTLFKLHKEYLKRK

SEQ ID NO: 3361233 - protein, 17 aa, Plasmodium falciparum
KEDEALLRNLLKNNPDI

SEQ ID NO: 3361234 - protein, 26 aa, Plasmodium falciparum
KEDIIRTYLKTHAAYFLSQNKKNSNL

SEQ ID NO: 3361235 - protein, 33 aa, Plasmodium falciparum
KEDKNKRIIYIILCKKQIIYILEELYKNVYKNK

SEQ ID NO: 3361236 - protein, 21 aa, Plasmodium falciparum
KEDLLRPILFNSYMKNYYTEI

SEQ ID NO: 3361237 - protein, 25 aa, Plasmodium falciparum
KEDLNRINLLFGFNILSISEQKNVI

SEQ ID NO: 3361238 - protein, 25 aa, Plasmodium falciparum
KEDLYSCIPILLSRKNLGDNMKKMN

SEQ ID NO: 3361239 - protein, 23 aa, Plasmodium falciparum
KEDNCAKLIVKIVEKNNGKMNIM

SEQ ID NO: 3361240 - protein, 18 aa, Plasmodium falciparum
KEDNEYLISLRTASDQCF

SEQ ID NO: 3361241 - protein, 21 aa, Plasmodium falciparum
KEDPFSVSHIIGDRLLQGWTL

SEQ ID NO: 3361242 - protein, 27 aa, Plasmodium falciparum
KEDRNMFRKDMHMMHQELLYFILKFLL

SEQ ID NO: 3361243 - protein, 25 aa, Plasmodium falciparum
KEDRYCARCDLFIKIRETSHEKEEK

SEQ ID NO: 3361244 - protein, 25 aa, Plasmodium falciparum
KEDSMILENMELYLSSKYNKESSHK

SEQ ID NO: 3361245 - protein, 21 aa, Plasmodium falciparum
KEDTIKCIIPGNNMYEHNNSN

SEQ ID NO: 3361246 - protein, 26 aa, Plasmodium falciparum
KEDVCDDLIKDMCILNGKEFPNPPSL

SEQ ID NO: 3361247 - protein, 20 aa, Plasmodium falciparum
KEDYLLSLYFKGELKKDQII

SEQ ID NO: 3361248 - protein, 18 aa, Plasmodium falciparum
KEDYNFFMFGKHMDTEKM

SEQ ID NO: 3361249 - protein, 18 aa, Plasmodium falciparum
KEEEEKKRNYNISNNNNN

SEQ ID NO: 3361250 - protein, 24 aa, Plasmodium falciparum
KEEEISAQIVEPVKKRGRKKGSKF

SEQ ID NO: 3361251 - protein, 17 aa, Plasmodium falciparum
KEEEKKDNINIFINNNI

SEQ ID NO: 3361252 - protein, 18 aa, Plasmodium falciparum
KEEEKLLQYSRRQEQIRK

SEQ ID NO: 3361253 - protein, 18 aa, Plasmodium falciparum
KEEGRPYYHNEITGETQW

SEQ ID NO: 3361254 - protein, 17 aa, Plasmodium falciparum
KEEHEGYNNNYIDNDYN

SEQ ID NO: 3361255 - protein, 24 aa, Plasmodium falciparum
KEEIFKRKYLLPIDVTHENLKSRL

SEQ ID NO: 3361256 - protein, 28 aa, Plasmodium falciparum
KEEIKLKINNCLKMIFVRHNIKIKCRLI

SEQ ID NO: 3361257 - protein, 18 aa, Plasmodium falciparum
KEEILKEYLKITVDKVVL

SEQ ID NO: 3361258 - protein, 24 aa, Plasmodium falciparum
KEEILKRKLLFEENKKKEYYEEME

SEQ ID NO: 3361259 - protein, 23 aa, Plasmodium falciparum
KEEINEIILVGGMTRMPKVTDTV

SEQ ID NO: 3361260 - protein, 25 aa, Plasmodium falciparum
KEEINFLEGKFCSKEEGEFHISKKS

SEQ ID NO: 3361261 - protein, 24 aa, Plasmodium falciparum
KEEIYEVFKKAGIIKIDTERNEPQ

SEQ ID NO: 3361262 - protein, 22 aa, Plasmodium falciparum
KEEKKGGKRRGRKKQTDDKKND

SEQ ID NO: 3361263 - protein, 23 aa, Plasmodium falciparum
KEEKYFLKFFIEPEKLSEHNNEK

SEQ ID NO: 3361264 - protein, 20 aa, Plasmodium falciparum
KEELEWSKKCDLLKQSEVLL

SEQ ID NO: 3361265 - protein, 21 aa, Plasmodium falciparum
KEELFELAIELPKLYRKNNHE

SEQ ID NO: 3361266 - protein, 24 aa, Plasmodium falciparum
KEELKIARDIIMKRKDKETSLSPQ

SEQ ID NO: 3361267 - protein, 18 aa, Plasmodium falciparum
KEELKITPERIIESNIVD

SEQ ID NO: 3361268 - protein, 20 aa, Plasmodium falciparum
KEELLKVVYEYILKNLKTYD

SEQ ID NO: 3361269 - protein, 18 aa, Plasmodium falciparum
KEELRKEKYTCSICKHKL

SEQ ID NO: 3361270 - protein, 19 aa, Plasmodium falciparum
KEELRVWIEDTLKRKDFSF

SEQ ID NO: 3361271 - protein, 28 aa, Plasmodium falciparum
KEELSPEVIKGSELYTNDKQKKKDETNK

SEQ ID NO: 3361272 - protein, 18 aa, Plasmodium falciparum
KEERCCEEIYYYCANVER

SEQ ID NO: 3361273 - protein, 28 aa, Plasmodium falciparum
KEERLNYITSIYHSFDYYNKRIKKKDQE

SEQ ID NO: 3361274 - protein, 23 aa, Plasmodium falciparum
KEETGWMKKVYLDFEKTKNDTYT

SEQ ID NO: 3361275 - protein, 24 aa, Plasmodium falciparum
KEETTAFFMKKFFPTNENDTSNNN

SEQ ID NO: 3361276 - protein, 18 aa, Plasmodium falciparum
KEEVYKKCLCTKDEFYQH

SEQ ID NO: 3361277 - protein, 32 aa, Plasmodium falciparum
KEEYHKYNFISMHLKNLIYIYITENFHNLNEF

SEQ ID NO: 3361278 - protein, 17 aa, Plasmodium falciparum
KEEYYKLFISHYNINSS

SEQ ID NO: 3361279 - protein, 20 aa, Plasmodium falciparum
KEFCRKKNIDYIISPYEADA

SEQ ID NO: 3361280 - protein, 20 aa, Plasmodium falciparum
KEFCYQRLKAYENRKSYLIS

SEQ ID NO: 3361281 - protein, 24 aa, Plasmodium falciparum
KEFERKFPELALWPRNVSQSNVEV

SEQ ID NO: 3361282 - protein, 18 aa, Plasmodium falciparum
KEFESFLITLKIFPKKII

SEQ ID NO: 3361283 - protein, 20 aa, Plasmodium falciparum
KEFIARIKTSKIFEKNNKQH

SEQ ID NO: 3361284 - protein, 22 aa, Plasmodium falciparum
KEFIYKNLICLIIDEADRLLQI

SEQ ID NO: 3361285 - protein, 20 aa, Plasmodium falciparum
KEFKFKLKKFYNLQDEADHK

SEQ ID NO: 3361286 - protein, 21 aa, Plasmodium falciparum
KEFLAKICPKFPQFTPSMTTN

SEQ ID NO: 3361287 - protein, 17 aa, Plasmodium falciparum
KEFLKKYNECILFLQNV

SEQ ID NO: 3361288 - protein, 20 aa, Plasmodium falciparum
KEFLYHVNWGILDYLIIDMP

SEQ ID NO: 3361289 - protein, 20 aa, Plasmodium falciparum
KEFSDELMYGMYKKYSTTFN

SEQ ID NO: 3361290 - protein, 21 aa, Plasmodium falciparum
KEFSNEFNINYGSHSKVQQDI

SEQ ID NO: 3361291 - protein, 19 aa, Plasmodium falciparum
KEGDVIHIGDRLEVTVSID

SEQ ID NO: 3361292 - protein, 20 aa, Plasmodium falciparum
KEGEKVLRAKINMKSGNMNL

SEQ ID NO: 3361293 - protein, 18 aa, Plasmodium falciparum
KEGFFFFFSSFKRSCNNN

SEQ ID NO: 3361294 - protein, 21 aa, Plasmodium falciparum
KEGFKPIFICHDTFLKCKEEQ

SEQ ID NO: 3361295 - protein, 17 aa, Plasmodium falciparum
KEGGGGNIFSRSFNLKK

SEQ ID NO: 3361296 - protein, 21 aa, Plasmodium falciparum
KEGILRKNIMGKRVNNCARTV

SEQ ID NO: 3361297 - protein, 17 aa, Plasmodium falciparum
KEGKPSENSVYVNTYND

SEQ ID NO: 3361298 - protein, 17 aa, Plasmodium falciparum
KEGKVFNIELCDEDGEI

SEQ ID NO: 3361299 - protein, 24 aa, Plasmodium falciparum
KEGRSKGYGFVTFKYVESVQKCLK

SEQ ID NO: 3361300 - protein, 18 aa, Plasmodium falciparum
KEGYKFNINVPLEKGYNN

SEQ ID NO: 3361301 - protein, 21 aa, Plasmodium falciparum
KEHFAELAVNAILRIKDNLNL

SEQ ID NO: 3361302 - protein, 24 aa, Plasmodium falciparum
KEHHSSFISIEYIKKNIFQYMYKL

SEQ ID NO: 3361303 - protein, 17 aa, Plasmodium falciparum
KEHIKKYSSLYGKNEKK

SEQ ID NO: 3361304 - protein, 21 aa, Plasmodium falciparum
KEHLENGLFYKNVEFYQKHNL

SEQ ID NO: 3361305 - protein, 20 aa, Plasmodium falciparum
KEHSHSISYISSLENSPDKL

SEQ ID NO: 3361306 - protein, 19 aa, Plasmodium falciparum
KEIDCYHLSDKVSCAMYSP

SEQ ID NO: 3361307 - protein, 17 aa, Plasmodium falciparum
KEIEFLKNIAKEHSLKK

SEQ ID NO: 3361308 - protein, 17 aa, Plasmodium falciparum
KEIEKLTMLLVRLKHEK

SEQ ID NO: 3361309 - protein, 20 aa, Plasmodium falciparum
KEIEMYKSLLKSRDSEINTL

SEQ ID NO: 3361310 - protein, 21 aa, Plasmodium falciparum
KEIFPKLASDNMLYFYQLNNF

SEQ ID NO: 3361311 - protein, 21 aa, Plasmodium falciparum
KEIGIDDFIFVFKQLHINIKK

SEQ ID NO: 3361312 - protein, 20 aa, Plasmodium falciparum
KEIHRKGSITYVNNNFDNNI

SEQ ID NO: 3361313 - protein, 20 aa, Plasmodium falciparum
KEIHRVLKPGGRFLCLEFSK

SEQ ID NO: 3361314 - protein, 26 aa, Plasmodium falciparum
KEIHWPYYYFYICDIIYGSKMDDYFD

SEQ ID NO: 3361315 - protein, 20 aa, Plasmodium falciparum
KEIICNSNIYEEFNYDTYMR

SEQ ID NO: 3361316 - protein, 19 aa, Plasmodium falciparum
KEIIEIMFQESLLKVLFST

SEQ ID NO: 3361317 - protein, 25 aa, Plasmodium falciparum
KEIITRNELYLGNHIDMIKCISFNK

SEQ ID NO: 3361318 - protein, 18 aa, Plasmodium falciparum
KEIKCAMQSLGLDAKNPM

SEQ ID NO: 3361319 - protein, 20 aa, Plasmodium falciparum
KEIKCILIPPQIGNYQSVTL

SEQ ID NO: 3361320 - protein, 22 aa, Plasmodium falciparum
KEIKEDFLIHRVLLIDRTAHNR

SEQ ID NO: 3361321 - protein, 18 aa, Plasmodium falciparum
KEIKEFYHDIEIETFSSI

SEQ ID NO: 3361322 - protein, 24 aa, Plasmodium falciparum
KEIKEIANLCLEQNLSVNSENILI

SEQ ID NO: 3361323 - protein, 31 aa, Plasmodium falciparum
KEIKKKAAQDLKKWYEEIAIVIEEKKKLSNQ

SEQ ID NO: 3361324 - protein, 20 aa, Plasmodium falciparum
KEIKNILNVLNNLRNYKFHD

SEQ ID NO: 3361325 - protein, 18 aa, Plasmodium falciparum
KEIKTCRYYIEQNMKGYQ

SEQ ID NO: 3361326 - protein, 21 aa, Plasmodium falciparum
KEIKTLCSILSGLVIANNYEN

SEQ ID NO: 3361327 - protein, 22 aa, Plasmodium falciparum
KEILFHRKPLKGFYDVKDEQNI

SEQ ID NO: 3361328 - protein, 33 aa, Plasmodium falciparum
KEILNCLRMISRIKKIFFDECSKMINNQISVLE

SEQ ID NO: 3361329 - protein, 21 aa, Plasmodium falciparum
KEILQSDEFIDLLWNKLTANQ

SEQ ID NO: 3361330 - protein, 21 aa, Plasmodium falciparum
KEINALYSLLERLSNYKYKQY

SEQ ID NO: 3361331 - protein, 22 aa, Plasmodium falciparum
KEINCINGICYLLANFYSKITL

SEQ ID NO: 3361332 - protein, 24 aa, Plasmodium falciparum
KEINKLCKLNDTLSGKLENALENN

SEQ ID NO: 3361333 - protein, 17 aa, Plasmodium falciparum
KEINNVVQVKREKSSEE

SEQ ID NO: 3361334 - protein, 21 aa, Plasmodium falciparum
KEIPQDGAICDLLWSDPAGPE

SEQ ID NO: 3361335 - protein, 33 aa, Plasmodium falciparum
KEIQKNPSLVKRLLKDNVALVILLECIQQYSKI

SEQ ID NO: 3361336 - protein, 17 aa, Plasmodium falciparum
KEIQLALELEQTSNINK

SEQ ID NO: 3361337 - protein, 17 aa, Plasmodium falciparum
KEIQMLKNQILSLEESI

SEQ ID NO: 3361338 - protein, 23 aa, Plasmodium falciparum
KEIRKNHLFEISKIKDYNLITHY

SEQ ID NO: 3361339 - protein, 26 aa, Plasmodium falciparum
KEIRLRFNRVKFWLAANCNFSDHMKY

SEQ ID NO: 3361340 - protein, 17 aa, Plasmodium falciparum
KEISTFLSIKKYIFYKF

SEQ ID NO: 3361341 - protein, 22 aa, Plasmodium falciparum
KEIVIKLFFNFMNRTGKEASSQ

SEQ ID NO: 3361342 - protein, 27 aa, Plasmodium falciparum
KEIWCSMPCSFYKYYLKSNSFIKRRLY

SEQ ID NO: 3361343 - protein, 18 aa, Plasmodium falciparum
KEIYFCFTYANQFYDNQA

SEQ ID NO: 3361344 - protein, 24 aa, Plasmodium falciparum
KEKALHCLRELMLNYKENKSHISR

SEQ ID NO: 3361345 - protein, 20 aa, Plasmodium falciparum
KEKCWKEYVSSFFLKNKKYE

SEQ ID NO: 3361346 - protein, 30 aa, Plasmodium falciparum
KEKEHIYKCPYCEICTCSLVCSKNHKKMFK

SEQ ID NO: 3361347 - protein, 19 aa, Plasmodium falciparum
KEKEILKNELDIIKKEYDE

SEQ ID NO: 3361348 - protein, 19 aa, Plasmodium falciparum
KEKEILKNELDIIKKEYNE

SEQ ID NO: 3361349 - protein, 27 aa, Plasmodium falciparum
KEKEKKDIFSYIKGMYLSPTSLPPQKK

SEQ ID NO: 3361350 - protein, 21 aa, Plasmodium falciparum
KEKELEIIKQQYLGLNKTKKK

SEQ ID NO: 3361351 - protein, 28 aa, Plasmodium falciparum
KEKELFIKGKETLLLEGMNDGKLDDDIE

SEQ ID NO: 3361352 - protein, 26 aa, Plasmodium falciparum
KEKENIMLIELNLKIELDKLKSTFSK

SEQ ID NO: 3361353 - protein, 20 aa, Plasmodium falciparum
KEKFLQFMCRSRKECNIYES

SEQ ID NO: 3361354 - protein, 18 aa, Plasmodium falciparum
KEKHPCSNLSNMTLNPSS

SEQ ID NO: 3361355 - protein, 19 aa, Plasmodium falciparum
KEKHYLRALISIISSSTHI

SEQ ID NO: 3361356 - protein, 18 aa, Plasmodium falciparum
KEKIKWLKHYNLKLLSLN

SEQ ID NO: 3361357 - protein, 17 aa, Plasmodium falciparum
KEKILVHYEYFIFHVFH

SEQ ID NO: 3361358 - protein, 19 aa, Plasmodium falciparum
KEKKDHIVIKYKYQPSNSP

SEQ ID NO: 3361359 - protein, 35 aa, Plasmodium falciparum
KEKKDRHIETYKTVFLCYPCVYRSIEDFTKSHKKN

SEQ ID NO: 3361360 - protein, 30 aa, Plasmodium falciparum
KEKKELLKTILKEKILILYNEQQNEEKKKK

SEQ ID NO: 3361361 - protein, 17 aa, Plasmodium falciparum
KEKKIKEKKRKKKIKRS

SEQ ID NO: 3361362 - protein, 28 aa, Plasmodium falciparum
KEKKKNNWAMYGRPIVKRQNNRNINIKN

SEQ ID NO: 3361363 - protein, 21 aa, Plasmodium falciparum
KEKKKSFILENEEFINEESSF

SEQ ID NO: 3361364 - protein, 23 aa, Plasmodium falciparum
KEKKNIFVGLFFHKEKTIETHLE

SEQ ID NO: 3361365 - protein, 21 aa, Plasmodium falciparum
KEKKNSLDISNNIIINNFMNN

SEQ ID NO: 3361366 - protein, 23 aa, Plasmodium falciparum
KEKKRKILIFIIGGITYPEIKQI

SEQ ID NO: 3361367 - protein, 20 aa, Plasmodium falciparum
KEKKSIISIINLNDFINKDT

SEQ ID NO: 3361368 - protein, 21 aa, Plasmodium falciparum
KEKKVLISAVKIQYQKILQLQ

SEQ ID NO: 3361369 - protein, 21 aa, Plasmodium falciparum
KEKLCKECFIESFEEDVHDTI

SEQ ID NO: 3361370 - protein, 17 aa, Plasmodium falciparum
KEKLFKKLFNTMHDDQY

SEQ ID NO: 3361371 - protein, 18 aa, Plasmodium falciparum
KEKLKELNYVNSRSNSNT

SEQ ID NO: 3361372 - protein, 18 aa, Plasmodium falciparum
KEKLKLLFTTVGSKMSVD

SEQ ID NO: 3361373 - protein, 18 aa, Plasmodium falciparum
KEKLKLLQTSHDTLIIQH

SEQ ID NO: 3361374 - protein, 18 aa, Plasmodium falciparum
KEKLKMWKSSVSKQNDSM

SEQ ID NO: 3361375 - protein, 20 aa, Plasmodium falciparum
KEKLNDLIENIHLKNNKIEN

SEQ ID NO: 3361376 - protein, 27 aa, Plasmodium falciparum
KEKLNEWKNLKWFDGIQKMKELKNEIL

SEQ ID NO: 3361377 - protein, 17 aa, Plasmodium falciparum
KEKMAAALFNGLISNNS

SEQ ID NO: 3361378 - protein, 20 aa, Plasmodium falciparum
KEKMEAYNFLCGSTKKYENH

SEQ ID NO: 3361379 - protein, 19 aa, Plasmodium falciparum
KEKMLSLCNKKTMDIYEKE

SEQ ID NO: 3361380 - protein, 23 aa, Plasmodium falciparum
KEKNIKIGIYFEETCDIKQSNDK

SEQ ID NO: 3361381 - protein, 25 aa, Plasmodium falciparum
KEKNKWGFKCCTNIDKNSKCTNNTN

SEQ ID NO: 3361382 - protein, 17 aa, Plasmodium falciparum
KEKNSFNSLHYINNEKR

SEQ ID NO: 3361383 - protein, 21 aa, Plasmodium falciparum
KEKRIQYKKGKKDRRDFEEDD

SEQ ID NO: 3361384 - protein, 25 aa, Plasmodium falciparum
KEKRKIKKRKKCITKNYQPNTYYTC

SEQ ID NO: 3361385 - protein, 24 aa, Plasmodium falciparum
KEKSFLMKISWNYIVVDEGHRMKN

SEQ ID NO: 3361386 - protein, 27 aa, Plasmodium falciparum
KEKSSNTFFCKYCNVNIEEGKLSDHNK

SEQ ID NO: 3361387 - protein, 22 aa, Plasmodium falciparum
KEKVKITRDMGIFVLVLSPTRE

SEQ ID NO: 3361388 - protein, 19 aa, Plasmodium falciparum
KEKVLCPDKKIEPFIDDVE

SEQ ID NO: 3361389 - protein, 20 aa, Plasmodium falciparum
KEKWGHENLYEMKKNNSIQE

SEQ ID NO: 3361390 - protein, 23 aa, Plasmodium falciparum
KEKWWRRHSSYCCGNFVKIEETE

SEQ ID NO: 3361391 - protein, 21 aa, Plasmodium falciparum
KEKYCNIHNFIDRNYINKNML

SEQ ID NO: 3361392 - protein, 30 aa, Plasmodium falciparum
KEKYFLCHKEEKIVILFFYLISHSSNIKTV

SEQ ID NO: 3361393 - protein, 20 aa, Plasmodium falciparum
KEKYIREIYECIVFPSNNKD

SEQ ID NO: 3361394 - protein, 23 aa, Plasmodium falciparum
KEKYKYRYEEHISKKDYTKKKEK

SEQ ID NO: 3361395 - protein, 17 aa, Plasmodium falciparum
KEKYNMCTYKYNSNNNN

SEQ ID NO: 3361396 - protein, 22 aa, Plasmodium falciparum
KEKYPTYFTYKNFEKIIEETYN

SEQ ID NO: 3361397 - protein, 22 aa, Plasmodium falciparum
KEKYQDVPVCKYVPKIDVELDC

SEQ ID NO: 3361398 - protein, 20 aa, Plasmodium falciparum
KELASAIIFEICDYTGNIEA

SEQ ID NO: 3361399 - protein, 20 aa, Plasmodium falciparum
KELCNSLKKQVIMKKKKLLL

SEQ ID NO: 3361400 - protein, 17 aa, Plasmodium falciparum
KELCVPVTIKLLINKMM

SEQ ID NO: 3361401 - protein, 28 aa, Plasmodium falciparum
KELDENWLIKLLIYMNSLLQLERLRLED

SEQ ID NO: 3361402 - protein, 21 aa, Plasmodium falciparum
KELDKCVSMKNFFFYESPICF

SEQ ID NO: 3361403 - protein, 24 aa, Plasmodium falciparum
KELDKYKFFLNKLANCEKSDDTES

SEQ ID NO: 3361404 - protein, 19 aa, Plasmodium falciparum
KELDMSLEYIYEEQNKYNN

SEQ ID NO: 3361405 - protein, 25 aa, Plasmodium falciparum
KELDVYLKIEGFLLSSSAKSSISLP

SEQ ID NO: 3361406 - protein, 20 aa, Plasmodium falciparum
KELEKSLDFIFSLCEDIGSK

SEQ ID NO: 3361407 - protein, 21 aa, Plasmodium falciparum
KELEMEKMKLLDDVQEERIKF

SEQ ID NO: 3361408 - protein, 25 aa, Plasmodium falciparum
KELERQKEMLYKFDFQTQVLTKKIN

SEQ ID NO: 3361409 - protein, 19 aa, Plasmodium falciparum
KELEYGYKVERHMTDEDYI

SEQ ID NO: 3361410 - protein, 21 aa, Plasmodium falciparum
KELFCPVAYSHEFIGHMLVQY

SEQ ID NO: 3361411 - protein, 17 aa, Plasmodium falciparum
KELFESEILMAENINLR

SEQ ID NO: 3361412 - protein, 17 aa, Plasmodium falciparum
KELFKNHIFYIHNDMPF

SEQ ID NO: 3361413 - protein, 21 aa, Plasmodium falciparum
KELFKYGNICHHIITVDFLKH

SEQ ID NO: 3361414 - protein, 17 aa, Plasmodium falciparum
KELFTYDPTLFVDDDNA

SEQ ID NO: 3361415 - protein, 18 aa, Plasmodium falciparum
KELGNCDFYPTNVSFHPS

SEQ ID NO: 3361416 - protein, 19 aa, Plasmodium falciparum
KELIKKKKMNILMKQKKKK

SEQ ID NO: 3361417 - protein, 33 aa, Plasmodium falciparum
KELILAEKLKCGWGFPTGCSLNHCAAHYTPNYG

SEQ ID NO: 3361418 - protein, 20 aa, Plasmodium falciparum
KELILRCLYESKQIFKKEIH

SEQ ID NO: 3361419 - protein, 26 aa, Plasmodium falciparum
KELINKWKLIRDQALNNNNNNNNNEN

SEQ ID NO: 3361420 - protein, 18 aa, Plasmodium falciparum
KELISSNGKRYFMEIRKI

SEQ ID NO: 3361421 - protein, 23 aa, Plasmodium falciparum
KELKDLFRKHGRVVRADLKNEDN

SEQ ID NO: 3361422 - protein, 22 aa, Plasmodium falciparum
KELKFLTVQEIFDFIKKIKLLQ

SEQ ID NO: 3361423 - protein, 19 aa, Plasmodium falciparum
KELKLLRKKEETLNSLKNR

SEQ ID NO: 3361424 - protein, 20 aa, Plasmodium falciparum
KELLDQKIYLGSSLTEQTSA

SEQ ID NO: 3361425 - protein, 25 aa, Plasmodium falciparum
KELLGNYINFLDTFNLYDNIYSKEK

SEQ ID NO: 3361426 - protein, 18 aa, Plasmodium falciparum
KELLNFRSDTDMKIQKSG

SEQ ID NO: 3361427 - protein, 17 aa, Plasmodium falciparum
KELLSNKYLYDKNLYNY

SEQ ID NO: 3361428 - protein, 18 aa, Plasmodium falciparum
KELLYNVCKTCIRTKLPI

SEQ ID NO: 3361429 - protein, 17 aa, Plasmodium falciparum
KELMTHYSIIDNRDNIL

SEQ ID NO: 3361430 - protein, 27 aa, Plasmodium falciparum
KELNFHFPKSVSLLAQELILKLCSRTA

SEQ ID NO: 3361431 - protein, 21 aa, Plasmodium falciparum
KELNGYYIYCQDFKNEYNNYF

SEQ ID NO: 3361432 - protein, 19 aa, Plasmodium falciparum
KELNNFHFYLIVKINNLNI

SEQ ID NO: 3361433 - protein, 20 aa, Plasmodium falciparum
KELPITFRVLNNNKYSNFIH

SEQ ID NO: 3361434 - protein, 22 aa, Plasmodium falciparum
KELPVTLLNACVELCKEINRSI

SEQ ID NO: 3361435 - protein, 29 aa, Plasmodium falciparum
KELQIETEFPCWTPWEIFCKTKYDELCYI

SEQ ID NO: 3361436 - protein, 24 aa, Plasmodium falciparum
KELVRHNFEIRKIIICKYNNKIIK

SEQ ID NO: 3361437 - protein, 19 aa, Plasmodium falciparum
KELYELLLEKNILKIIEAY

SEQ ID NO: 3361438 - protein, 18 aa, Plasmodium falciparum
KELYEWQDECLRELRKVN

SEQ ID NO: 3361439 - protein, 21 aa, Plasmodium falciparum
KELYHKKCGHYDWVSEVFFTK

SEQ ID NO: 3361440 - protein, 17 aa, Plasmodium falciparum
KEMCYISVGVTDKGEEF

SEQ ID NO: 3361441 - protein, 21 aa, Plasmodium falciparum
KEMFLKFFKTNMINGNIIQNK

SEQ ID NO: 3361442 - protein, 23 aa, Plasmodium falciparum
KEMIKRNELKVIHVFNQTPSKEI

SEQ ID NO: 3361443 - protein, 20 aa, Plasmodium falciparum
KEMNCKENILNLIKNKNLSV

SEQ ID NO: 3361444 - protein, 33 aa, Plasmodium falciparum
KEMNNKLFLNIKEFIFKMHLNLENIKEMIKNKN

SEQ ID NO: 3361445 - protein, 23 aa, Plasmodium falciparum
KENAEGIWEEMCNLTEENNNIQD

SEQ ID NO: 3361446 - protein, 25 aa, Plasmodium falciparum
KENCLYSLKLKDFFVSVLKQCGKNE

SEQ ID NO: 3361447 - protein, 22 aa, Plasmodium falciparum
KENCSLHKILFVRNEQNIFVKH

SEQ ID NO: 3361448 - protein, 20 aa, Plasmodium falciparum
KENDNCKEYALNISSKTNKE

SEQ ID NO: 3361449 - protein, 19 aa, Plasmodium falciparum
KENDQCVGKIISLDTFNTI

SEQ ID NO: 3361450 - protein, 26 aa, Plasmodium falciparum
KENELLEIFQPFGLIESIKLKVNKNV

SEQ ID NO: 3361451 - protein, 29 aa, Plasmodium falciparum
KENFFINCLLFRGAVKISEDIKIIENEIL

SEQ ID NO: 3361452 - protein, 22 aa, Plasmodium falciparum
KENFYKIIFQDLFSLLNEFIMV

SEQ ID NO: 3361453 - protein, 19 aa, Plasmodium falciparum
KENFYNVYILTYIKHIVRI

SEQ ID NO: 3361454 - protein, 18 aa, Plasmodium falciparum
KENGKKCHPLIYNNNNNN

SEQ ID NO: 3361455 - protein, 22 aa, Plasmodium falciparum
KENHGIHTIYFLLSSNDLIEID

SEQ ID NO: 3361456 - protein, 25 aa, Plasmodium falciparum
KENIHLKNHLDFIYNTEFFTELYVE

SEQ ID NO: 3361457 - protein, 23 aa, Plasmodium falciparum
KENIPAIRWVGGVEMELIAIATG

SEQ ID NO: 3361458 - protein, 24 aa, Plasmodium falciparum
KENIRKRRCTVAHMYEKNINSKNT

SEQ ID NO: 3361459 - protein, 18 aa, Plasmodium falciparum
KENISFENFELFENVAII

SEQ ID NO: 3361460 - protein, 25 aa, Plasmodium falciparum
KENISSIFLSFFLFLNICLNENTYK

SEQ ID NO: 3361461 - protein, 20 aa, Plasmodium falciparum
KENKGEVSLTKEEQEMQNEN

SEQ ID NO: 3361462 - protein, 25 aa, Plasmodium falciparum
KENLKIFKYNCSKIKNIVSNVPEIY

SEQ ID NO: 3361463 - protein, 26 aa, Plasmodium falciparum
KENMKRILYEWAKFLIKENDNTNITY

SEQ ID NO: 3361464 - protein, 26 aa, Plasmodium falciparum
KENMLLDYSLLFGIHYRELSKDVVNW

SEQ ID NO: 3361465 - protein, 20 aa, Plasmodium falciparum
KENPFHFYVTDDLYVNENKF

SEQ ID NO: 3361466 - protein, 23 aa, Plasmodium falciparum
KENQRLKMCDTHEGPMNNNESGA

SEQ ID NO: 3361467 - protein, 18 aa, Plasmodium falciparum
KEPCWKRLTKEKEKQHFL

SEQ ID NO: 3361468 - protein, 25 aa, Plasmodium falciparum
KEPKNNLKYPMNIYNKLFNKDRQNI

SEQ ID NO: 3361469 - protein, 28 aa, Plasmodium falciparum
KEPKRKGRKRKIWIQPLDNYNKVEDNKL

SEQ ID NO: 3361470 - protein, 21 aa, Plasmodium falciparum
KEPRGFGFVEFYDAKDAEQAL

SEQ ID NO: 3361471 - protein, 21 aa, Plasmodium falciparum
KEPYPKYICKDENKYTHRTNN

SEQ ID NO: 3361472 - protein, 22 aa, Plasmodium falciparum
KEQDSSCPIMPNYVKDKIDDTF

SEQ ID NO: 3361473 - protein, 23 aa, Plasmodium falciparum
KEQFSDGVGYNWIDGLKQYAEKK

SEQ ID NO: 3361474 - protein, 22 aa, Plasmodium falciparum
KEQFYSFPFCECIEKIHYSETY

SEQ ID NO: 3361475 - protein, 26 aa, Plasmodium falciparum
KEQGNSRLKKWLCKINAREKEKEKKL

SEQ ID NO: 3361476 - protein, 20 aa, Plasmodium falciparum
KEQIKAPIINTYDDINNNSN

SEQ ID NO: 3361477 - protein, 21 aa, Plasmodium falciparum
KEQKCSYIRVDGLTPMEKREI

SEQ ID NO: 3361478 - protein, 18 aa, Plasmodium falciparum
KEQLEAAKQIFANSSSSL

SEQ ID NO: 3361479 - protein, 25 aa, Plasmodium falciparum
KEQNHIFFFSFNISELIINDQVKTK

SEQ ID NO: 3361480 - protein, 19 aa, Plasmodium falciparum
KEQSSLYKLSQYCIEKQVI

SEQ ID NO: 3361481 - protein, 18 aa, Plasmodium falciparum
KERACYVSLDYLKELEKE

SEQ ID NO: 3361482 - protein, 18 aa, Plasmodium falciparum
KERFRYRSSYDRKMSSYR

SEQ ID NO: 3361483 - protein, 18 aa, Plasmodium falciparum
KERHWKLILQKLNIKIYY

SEQ ID NO: 3361484 - protein, 37 aa, Plasmodium falciparum
KERINYMFVCPFIPNLIKWINVLKLSIKGKVSKKNTY

SEQ ID NO: 3361485 - protein, 23 aa, Plasmodium falciparum
KERKDICLELLKTCDALKNIGNK

SEQ ID NO: 3361486 - protein, 18 aa, Plasmodium falciparum
KERLRYVHRRKDENLFFN

SEQ ID NO: 3361487 - protein, 25 aa, Plasmodium falciparum
KERNIPKKDIEIIPLKNKESLNSNK

SEQ ID NO: 3361488 - protein, 20 aa, Plasmodium falciparum
KERRSINEYNNKCSSTAAYS

SEQ ID NO: 3361489 - protein, 17 aa, Plasmodium falciparum
KERYIAFLLDRNSDGII

SEQ ID NO: 3361490 - protein, 26 aa, Plasmodium falciparum
KERYPMKYPEFDGTTNETMMVREKAE

SEQ ID NO: 3361491 - protein, 27 aa, Plasmodium falciparum
KESAMRLGWDYSFRHAKVQGSIDTSGK

SEQ ID NO: 3361492 - protein, 22 aa, Plasmodium falciparum
KESEIFYKTYLKKIYNKSNEND

SEQ ID NO: 3361493 - protein, 19 aa, Plasmodium falciparum
KESFLLADRNFDGHISSNE

SEQ ID NO: 3361494 - protein, 20 aa, Plasmodium falciparum
KESFVPKIYISSAVIPQNLA

SEQ ID NO: 3361495 - protein, 20 aa, Plasmodium falciparum
KESKKSLVENDNFCLNNYRN

SEQ ID NO: 3361496 - protein, 18 aa, Plasmodium falciparum
KESKWIKKHMYPKLIYEN

SEQ ID NO: 3361497 - protein, 24 aa, Plasmodium falciparum
KESLLKDEWRIYNDYIYINTKKPQ

SEQ ID NO: 3361498 - protein, 31 aa, Plasmodium falciparum
KESLMYCLGANSLEELGCIILCCKAPPEFNK

SEQ ID NO: 3361499 - protein, 24 aa, Plasmodium falciparum
KESNELIKYVSLFLWIQKKISKNE

SEQ ID NO: 3361500 - protein, 19 aa, Plasmodium falciparum
KESRGNYKKEYKKDKNETN

SEQ ID NO: 3361501 - protein, 19 aa, Plasmodium falciparum
KESSALLCASDLIDEMMNL

SEQ ID NO: 3361502 - protein, 20 aa, Plasmodium falciparum
KESTHKLNIYNLFNKSNKNK

SEQ ID NO: 3361503 - protein, 25 aa, Plasmodium falciparum
KESTSRLAFVTAFTISPYASVIGRT

SEQ ID NO: 3361504 - protein, 19 aa, Plasmodium falciparum
KETEPHFIRCIKPNAQNVP

SEQ ID NO: 3361505 - protein, 18 aa, Plasmodium falciparum
KETIKIIPSEGLVKSCYR

SEQ ID NO: 3361506 - protein, 19 aa, Plasmodium falciparum
KETLLANSLEQAHVIAYSH

SEQ ID NO: 3361507 - protein, 19 aa, Plasmodium falciparum
KETLLHCLVYGLLRMHTIY

SEQ ID NO: 3361508 - protein, 22 aa, Plasmodium falciparum
KETNRFFKMYNLHLKIEKLPIN

SEQ ID NO: 3361509 - protein, 31 aa, Plasmodium falciparum
KETPIKAMIRYKNDLKVCKNYLNQYESKIDK

SEQ ID NO: 3361510 - protein, 25 aa, Plasmodium falciparum
KETQSWKGLKICVKLTIQNRQAKVE

SEQ ID NO: 3361511 - protein, 33 aa, Plasmodium falciparum
KETTEFGRNFLLKLFFFLGRYFNSKSIFMYKYI

SEQ ID NO: 3361512 - protein, 19 aa, Plasmodium falciparum
KETYCSSLDFSLEDLKENY

SEQ ID NO: 3361513 - protein, 19 aa, Plasmodium falciparum
KETYIKKNIHMIHKSNNNV

SEQ ID NO: 3361514 - protein, 20 aa, Plasmodium falciparum
KEVDNSVSIIKKYREACTVL

SEQ ID NO: 3361515 - protein, 20 aa, Plasmodium falciparum
KEVHKSQIIISEREDFIKEL

SEQ ID NO: 3361516 - protein, 20 aa, Plasmodium falciparum
KEVILKLEFFLDNKKIISKN

SEQ ID NO: 3361517 - protein, 20 aa, Plasmodium falciparum
KEVKDICKLDEPIHNNNNNN

SEQ ID NO: 3361518 - protein, 20 aa, Plasmodium falciparum
KEVKKNPQFVVNKTMIPLKE

SEQ ID NO: 3361519 - protein, 24 aa, Plasmodium falciparum
KEVKKSDIVSCIAFLSRGKKKKSL

SEQ ID NO: 3361520 - protein, 21 aa, Plasmodium falciparum
KEVKRLIKYKTPRALNPKHSK

SEQ ID NO: 3361521 - protein, 23 aa, Plasmodium falciparum
KEVLERRLEFLLSNESVYQQLYN

SEQ ID NO: 3361522 - protein, 22 aa, Plasmodium falciparum
KEVLKNNLKIFFKNENIPFSFL

SEQ ID NO: 3361523 - protein, 19 aa, Plasmodium falciparum
KEVLLCMDVLQYEEDKVNR

SEQ ID NO: 3361524 - protein, 33 aa, Plasmodium falciparum
KEVTCSLPTNFDCAYSYILGFSCVEMLQHKYNG

SEQ ID NO: 3361525 - protein, 19 aa, Plasmodium falciparum
KEVTNEYDFLKKVGEVCKK

SEQ ID NO: 3361526 - protein, 19 aa, Plasmodium falciparum
KEVTTLCFEPLHLLKEEDI

SEQ ID NO: 3361527 - protein, 30 aa, Plasmodium falciparum
KEVVKIITGLHKYYLPGYFKAMPKAYVRDS

SEQ ID NO: 3361528 - protein, 19 aa, Plasmodium falciparum
KEVYDFILLHKDRLNKEID

SEQ ID NO: 3361529 - protein, 19 aa, Plasmodium falciparum
KEWKIKYMYCNDEELKNCL

SEQ ID NO: 3361530 - protein, 24 aa, Plasmodium falciparum
KEWKLYEFICKHFLAVCSNDAIGY

SEQ ID NO: 3361531 - protein, 19 aa, Plasmodium falciparum
KEWYWTYEGIKFFYTKDEL

SEQ ID NO: 3361532 - protein, 21 aa, Plasmodium falciparum
KEYDFSLNLEKYVLKHRINDI

SEQ ID NO: 3361533 - protein, 22 aa, Plasmodium falciparum
KEYERRILKNNSTRKYKNAKFI

SEQ ID NO: 3361534 - protein, 17 aa, Plasmodium falciparum
KEYHSIFHFVNDYRNVV

SEQ ID NO: 3361535 - protein, 25 aa, Plasmodium falciparum
KEYKEKNIDMGLTLAQQNSHVSKLW

SEQ ID NO: 3361536 - protein, 24 aa, Plasmodium falciparum
KEYKKKIIEIFVYKNLIKDLQNFH

SEQ ID NO: 3361537 - protein, 23 aa, Plasmodium falciparum
KEYKKRKFFKIHFFLNRKNKNND

SEQ ID NO: 3361538 - protein, 22 aa, Plasmodium falciparum
KEYLFICKLFFDKVEIYLNKQT

SEQ ID NO: 3361539 - protein, 24 aa, Plasmodium falciparum
KEYLKNCIYINLSHNLISHMNNIF

SEQ ID NO: 3361540 - protein, 24 aa, Plasmodium falciparum
KEYMKWKTFFFKNIPLEKFYNFCS

SEQ ID NO: 3361541 - protein, 21 aa, Plasmodium falciparum
KEYVSLCYILDAYRKLAKKKK

SEQ ID NO: 3361542 - protein, 26 aa, Plasmodium falciparum
KEYVYKPLISSFIYYYIMKFSSFHIS

SEQ ID NO: 3361543 - protein, 25 aa, Plasmodium falciparum
KFADYETFKLYVLKKYDKIYKTCNY

SEQ ID NO: 3361544 - protein, 31 aa, Plasmodium falciparum
KFAPEFSDVISAKFGLYGWGKYQKKKDKKNK

SEQ ID NO: 3361545 - protein, 24 aa, Plasmodium falciparum
KFCSEKKGIPFLLLLEKTNKYIKE

SEQ ID NO: 3361546 - protein, 18 aa, Plasmodium falciparum
KFCTINCNNIIYNKNIFI

SEQ ID NO: 3361547 - protein, 17 aa, Plasmodium falciparum
KFDELYIVLEIADSDLK

SEQ ID NO: 3361548 - protein, 26 aa, Plasmodium falciparum
KFDNFPVIRYYLYDVHFSIEEIKMII

SEQ ID NO: 3361549 - protein, 19 aa, Plasmodium falciparum
KFDNLILGGMCYIYDNKIV

SEQ ID NO: 3361550 - protein, 19 aa, Plasmodium falciparum
KFDRMYSIINDFKSNIKPY

SEQ ID NO: 3361551 - protein, 26 aa, Plasmodium falciparum
KFDVNLECPPPLIVPYPVQRIKQISP

SEQ ID NO: 3361552 - protein, 20 aa, Plasmodium falciparum
KFEIDLIEGYMCVKTTKKTF

SEQ ID NO: 3361553 - protein, 25 aa, Plasmodium falciparum
KFEILKNIIKKCILIKKKIVICYSG

SEQ ID NO: 3361554 - protein, 20 aa, Plasmodium falciparum
KFELSLSIGNLQLCVDIINE

SEQ ID NO: 3361555 - protein, 21 aa, Plasmodium falciparum
KFFDLKKCDSYVSFIEPNPFY

SEQ ID NO: 3361556 - protein, 19 aa, Plasmodium falciparum
KFFGCELGTMVKFEENEEK

SEQ ID NO: 3361557 - protein, 17 aa, Plasmodium falciparum
KFFNFKQLHKYVIQQNS

SEQ ID NO: 3361558 - protein, 23 aa, Plasmodium falciparum
KFFQYLMIYISRFFMSDEEIVIF

SEQ ID NO: 3361559 - protein, 19 aa, Plasmodium falciparum
KFGADSISTIFNIVFSDYI

SEQ ID NO: 3361560 - protein, 18 aa, Plasmodium falciparum
KFGIDTYVKESAKITNRL

SEQ ID NO: 3361561 - protein, 22 aa, Plasmodium falciparum
KFGKEIKYLLSKNDEHNKILVD

SEQ ID NO: 3361562 - protein, 18 aa, Plasmodium falciparum
KFGTLVALRKAREIFPKD

SEQ ID NO: 3361563 - protein, 19 aa, Plasmodium falciparum
KFHLLNLFTNICLNDGNKC

SEQ ID NO: 3361564 - protein, 19 aa, Plasmodium falciparum
KFHLQECPLKKVQFHKSYN

SEQ ID NO: 3361565 - protein, 18 aa, Plasmodium falciparum
KFHNFDFVNNYDLSMSSI

SEQ ID NO: 3361566 - protein, 23 aa, Plasmodium falciparum
KFHPFKNILFSGGDDCTIQIIDV

SEQ ID NO: 3361567 - protein, 17 aa, Plasmodium falciparum
KFHQCVRLSKFENDRTI

SEQ ID NO: 3361568 - protein, 19 aa, Plasmodium falciparum
KFIEIVENINLYKNISTSQ

SEQ ID NO: 3361569 - protein, 31 aa, Plasmodium falciparum
KFIELLKDIKILKGQAIIFVELRHSINNVFN

SEQ ID NO: 3361570 - protein, 20 aa, Plasmodium falciparum
KFIESVFLSVYYPNGRKIER

SEQ ID NO: 3361571 - protein, 19 aa, Plasmodium falciparum
KFIGWKILGNNNMNVQNFF

SEQ ID NO: 3361572 - protein, 18 aa, Plasmodium falciparum
KFIHTWANKYATGLRKGK

SEQ ID NO: 3361573 - protein, 21 aa, Plasmodium falciparum
KFIIGSSYRKCDLVIKGNIEN

SEQ ID NO: 3361574 - protein, 18 aa, Plasmodium falciparum
KFIKNKGYESNIYIPMQN

SEQ ID NO: 3361575 - protein, 24 aa, Plasmodium falciparum
KFIKSELYKNSFLEYNLKTDIYLK

SEQ ID NO: 3361576 - protein, 25 aa, Plasmodium falciparum
KFILPVKYSNIYKHLGINKSMGILL

SEQ ID NO: 3361577 - protein, 17 aa, Plasmodium falciparum
KFIRKKKNKIIKNLNSL

SEQ ID NO: 3361578 - protein, 36 aa, Plasmodium falciparum
KFKEDMILNHDIDCWPIVDCLIAFYSTGFPLKKAIE

SEQ ID NO: 3361579 - protein, 23 aa, Plasmodium falciparum
KFKEINLDLLFCKNNEYKQNVNN

SEQ ID NO: 3361580 - protein, 22 aa, Plasmodium falciparum
KFKLLGLYGSNSINWLVADLGA

SEQ ID NO: 3361581 - protein, 24 aa, Plasmodium falciparum
KFKRDIFISSSYDWTIRIWTQSRK

SEQ ID NO: 3361582 - protein, 24 aa, Plasmodium falciparum
KFKRKECLMKYFYTLKGPQINTER

SEQ ID NO: 3361583 - protein, 27 aa, Plasmodium falciparum
KFKSPEELEDLFLRNNVILNDIEKEFK

SEQ ID NO: 3361584 - protein, 17 aa, Plasmodium falciparum
KFLDFWNYIYIGSKDLV

SEQ ID NO: 3361585 - protein, 28 aa, Plasmodium falciparum
KFLKDCNCLLFKLNNNFRSTREIVRVSQ

SEQ ID NO: 3361586 - protein, 24 aa, Plasmodium falciparum
KFLKGEPVLAYINGEWEKGEIGGI

SEQ ID NO: 3361587 - protein, 23 aa, Plasmodium falciparum
KFLKHCDEWDKIIEHYKMNNKII

SEQ ID NO: 3361588 - protein, 25 aa, Plasmodium falciparum
KFLKLKFILHLLSIMENICIHICSL

SEQ ID NO: 3361589 - protein, 21 aa, Plasmodium falciparum
KFLKWGMNSFKNMLILPPGSG

SEQ ID NO: 3361590 - protein, 25 aa, Plasmodium falciparum
KFLNIHLIDKFECIHINNKEEYEYY

SEQ ID NO: 3361591 - protein, 17 aa, Plasmodium falciparum
KFLQHSSDIIIEGGGKK

SEQ ID NO: 3361592 - protein, 17 aa, Plasmodium falciparum
KFLRAVCSKCGTVQLGK

SEQ ID NO: 3361593 - protein, 18 aa, Plasmodium falciparum
KFLYSYSYYHFDNFQDIH

SEQ ID NO: 3361594 - protein, 18 aa, Plasmodium falciparum
KFLYVDWKHLIYSKAPKS

SEQ ID NO: 3361595 - protein, 18 aa, Plasmodium falciparum
KFNALKVCDLGSASDISE

SEQ ID NO: 3361596 - protein, 17 aa, Plasmodium falciparum
KFNCYTSAISVLLDKIL

SEQ ID NO: 3361597 - protein, 19 aa, Plasmodium falciparum
KFNDALSCLSKLQNLKGKK

SEQ ID NO: 3361598 - protein, 20 aa, Plasmodium falciparum
KFNDNRWKRVINLFKKVYSD

SEQ ID NO: 3361599 - protein, 23 aa, Plasmodium falciparum
KFNEKRKCTNRSYNNRYYNDYLK

SEQ ID NO: 3361600 - protein, 18 aa, Plasmodium falciparum
KFNFEKLKKNIYVIEHID

SEQ ID NO: 3361601 - protein, 24 aa, Plasmodium falciparum
KFNIPNKRYIYLNGDDSNYKKKKQ

SEQ ID NO: 3361602 - protein, 17 aa, Plasmodium falciparum
KFNKIAFMKKLKKNNPL

SEQ ID NO: 3361603 - protein, 20 aa, Plasmodium falciparum
KFNNYCTSFNNSAMSLNSTK

SEQ ID NO: 3361604 - protein, 24 aa, Plasmodium falciparum
KFNVDLYNYFDFYRIYFILFVSCV

SEQ ID NO: 3361605 - protein, 18 aa, Plasmodium falciparum
KFNYSYLFIEKKKKNYNS

SEQ ID NO: 3361606 - protein, 26 aa, Plasmodium falciparum
KFPNHGCTIISLIIFRNKMFVANLGD

SEQ ID NO: 3361607 - protein, 18 aa, Plasmodium falciparum
KFQICTYNDILLLCDEVA

SEQ ID NO: 3361608 - protein, 22 aa, Plasmodium falciparum
KFRKPDISDVHILHNEKIYLEK

SEQ ID NO: 3361609 - protein, 18 aa, Plasmodium falciparum
KFRNEVFLKINISEEDLW

SEQ ID NO: 3361610 - protein, 17 aa, Plasmodium falciparum
KFSEKTCSFSIIDTTQF

SEQ ID NO: 3361611 - protein, 18 aa, Plasmodium falciparum
KFSHLTYHTHIYLCTVSD

SEQ ID NO: 3361612 - protein, 19 aa, Plasmodium falciparum
KFSIGLSLACQREAEKLSK

SEQ ID NO: 3361613 - protein, 24 aa, Plasmodium falciparum
KFSNKLIPQKCEENNQIRCRSLSY

SEQ ID NO: 3361614 - protein, 30 aa, Plasmodium falciparum
KFSTQRFGYDVAISLSIDFYKNLGGLKGEE

SEQ ID NO: 3361615 - protein, 19 aa, Plasmodium falciparum
KFSVLKLLKIIDGANGFRF

SEQ ID NO: 3361616 - protein, 36 aa, Plasmodium falciparum
KFTAKQLIRICLGGNMKASEYLKRSKDSIIDYSSHV

SEQ ID NO: 3361617 - protein, 18 aa, Plasmodium falciparum
KFTSGNILDIDISIYDHI

SEQ ID NO: 3361618 - protein, 18 aa, Plasmodium falciparum
KFTVCFLNDLIIEDLNYE

SEQ ID NO: 3361619 - protein, 23 aa, Plasmodium falciparum
KFTYASLYKHIWKNLLKNYENIE

SEQ ID NO: 3361620 - protein, 18 aa, Plasmodium falciparum
KFVNSLLSNCEKKKKWQN

SEQ ID NO: 3361621 - protein, 18 aa, Plasmodium falciparum
KFVQGIMHVVGFNNLLTV

SEQ ID NO: 3361622 - protein, 23 aa, Plasmodium falciparum
KFWDIRSKWAVHIIKHDFPLLSV

SEQ ID NO: 3361623 - protein, 20 aa, Plasmodium falciparum
KFYFNFPNFVLCNPSFIFSN

SEQ ID NO: 3361624 - protein, 19 aa, Plasmodium falciparum
KFYIFKHKINIPLCKENIF

SEQ ID NO: 3361625 - protein, 23 aa, Plasmodium falciparum
KFYKISSKCFSRVLNEDDVSLPN

SEQ ID NO: 3361626 - protein, 21 aa, Plasmodium falciparum
KFYYDYLKNKSIENIYNSNSN

SEQ ID NO: 3361627 - protein, 17 aa, Plasmodium falciparum
KGAEPKTIERLMILCSG

SEQ ID NO: 3361628 - protein, 18 aa, Plasmodium falciparum
KGALTIIRLPAENKKQNM

SEQ ID NO: 3361629 - protein, 18 aa, Plasmodium falciparum
KGALTIIRLPAENKKQVK

SEQ ID NO: 3361630 - protein, 20 aa, Plasmodium falciparum
KGCGKVFRRWIRGLCCKHII

SEQ ID NO: 3361631 - protein, 26 aa, Plasmodium falciparum
KGDEECCLILLKLLYVNIILNNYNYL

SEQ ID NO: 3361632 - protein, 18 aa, Plasmodium falciparum
KGDEMVGSIKKPGRANTL

SEQ ID NO: 3361633 - protein, 27 aa, Plasmodium falciparum
KGDFFYIPRFSNFQIINDSRYIKNKYK

SEQ ID NO: 3361634 - protein, 17 aa, Plasmodium falciparum
KGDINILPYNNYIPLYK

SEQ ID NO: 3361635 - protein, 18 aa, Plasmodium falciparum
KGDNVSCYYDRYRECESV

SEQ ID NO: 3361636 - protein, 24 aa, Plasmodium falciparum
KGDQRVCKVYDAPNLPEVECIFQL

SEQ ID NO: 3361637 - protein, 18 aa, Plasmodium falciparum
KGDSFLITYIGYNNSEYV

SEQ ID NO: 3361638 - protein, 20 aa, Plasmodium falciparum
KGEEITPRFVYISDGLFEEK

SEQ ID NO: 3361639 - protein, 20 aa, Plasmodium falciparum
KGEIKLKVKNFVKVHQVGQG

SEQ ID NO: 3361640 - protein, 21 aa, Plasmodium falciparum
KGEIKTLLGDVEMDENKNKNN

SEQ ID NO: 3361641 - protein, 17 aa, Plasmodium falciparum
KGEKIYMESDHGYDNKK

SEQ ID NO: 3361642 - protein, 20 aa, Plasmodium falciparum
KGEKYFVEFDLNLTTPACPV

SEQ ID NO: 3361643 - protein, 23 aa, Plasmodium falciparum
KGEVRFLICTDVAARGIDIQNLR

SEQ ID NO: 3361644 - protein, 19 aa, Plasmodium falciparum
KGFHKLICFSFDKKGELWA

SEQ ID NO: 3361645 - protein, 20 aa, Plasmodium falciparum
KGFIKRQPFSSVLYEQKRKE

SEQ ID NO: 3361646 - protein, 22 aa, Plasmodium falciparum
KGFKRKCNILRSNANFLNIRKK

SEQ ID NO: 3361647 - protein, 17 aa, Plasmodium falciparum
KGFLFPRVEKYETPFGF

SEQ ID NO: 3361648 - protein, 31 aa, Plasmodium falciparum
KGFLTLRKEKGICLNVKRVYSLYDLYHKLIN

SEQ ID NO: 3361649 - protein, 17 aa, Plasmodium falciparum
KGFMKGIQQNNKIPNDI

SEQ ID NO: 3361650 - protein, 35 aa, Plasmodium falciparum
KGFYDKNTFLSICRIYSGMLYENMILYICGKSTKT

SEQ ID NO: 3361651 - protein, 19 aa, Plasmodium falciparum
KGGGKDQAVKHFLYQNILK

SEQ ID NO: 3361652 - protein, 27 aa, Plasmodium falciparum
KGGGMNGNLRMSRMQNYAGAGISGQSV

SEQ ID NO: 3361653 - protein, 19 aa, Plasmodium falciparum
KGGKDWRAGRCALSNIIPA

SEQ ID NO: 3361654 - protein, 20 aa, Plasmodium falciparum
KGGLLLWSYNFYEIDDTTIR

SEQ ID NO: 3361655 - protein, 20 aa, Plasmodium falciparum
KGGNILKIGIILSGGPAPGG

SEQ ID NO: 3361656 - protein, 19 aa, Plasmodium falciparum
KGGSNIVCILNCFNIKEEK

SEQ ID NO: 3361657 - protein, 27 aa, Plasmodium falciparum
KGHKKLIKRFIGKATWDMNQLVDELNN

SEQ ID NO: 3361658 - protein, 22 aa, Plasmodium falciparum
KGIHQCSDFHLILFVAKVLDIE

SEQ ID NO: 3361659 - protein, 26 aa, Plasmodium falciparum
KGIHVKTIKSSLHISVYKSAKDVWFP

SEQ ID NO: 3361660 - protein, 24 aa, Plasmodium falciparum
KGIIKRKKYLSVFILLSKLSPSII

SEQ ID NO: 3361661 - protein, 27 aa, Plasmodium falciparum
KGIIPDGITRKEWCKLVKEQNREKRKH

SEQ ID NO: 3361662 - protein, 26 aa, Plasmodium falciparum
KGIIPQIYYKIYFLADMENFDKKNYY

SEQ ID NO: 3361663 - protein, 28 aa, Plasmodium falciparum
KGIKRFFCSKCNISFGYRSSFRRHNVNM

SEQ ID NO: 3361664 - protein, 25 aa, Plasmodium falciparum
KGIWDELKIIYSNICDMKKMLWSNV

SEQ ID NO: 3361665 - protein, 19 aa, Plasmodium falciparum
KGKDVIGIFTLNSKIHKDN

SEQ ID NO: 3361666 - protein, 22 aa, Plasmodium falciparum
KGKDVLYNFVMEKRGHIENCKK

SEQ ID NO: 3361667 - protein, 22 aa, Plasmodium falciparum
KGKDYYCVNGYNTPNYKNLQEQ

SEQ ID NO: 3361668 - protein, 21 aa, Plasmodium falciparum
KGKEINPNFNNFPSGTINDNN

SEQ ID NO: 3361669 - protein, 20 aa, Plasmodium falciparum
KGKEKKILFHDMEINNNENN

SEQ ID NO: 3361670 - protein, 19 aa, Plasmodium falciparum
KGKHPSYAEEDRNYKRRNY

SEQ ID NO: 3361671 - protein, 21 aa, Plasmodium falciparum
KGKISIEWIKNYFSTLSDSVC

SEQ ID NO: 3361672 - protein, 22 aa, Plasmodium falciparum
KGKKRTIKIILDISDTTTNKPT

SEQ ID NO: 3361673 - protein, 25 aa, Plasmodium falciparum
KGKKYLDFKLGNGLDGEEEGGGDYD

SEQ ID NO: 3361674 - protein, 22 aa, Plasmodium falciparum
KGKLRYYHNSIYWNYGALPQTY

SEQ ID NO: 3361675 - protein, 25 aa, Plasmodium falciparum
KGKMFDEHFIMLKKDEKIYKNKNKS

SEQ ID NO: 3361676 - protein, 20 aa, Plasmodium falciparum
KGKNKFIGCQTIKEEVVKVL

SEQ ID NO: 3361677 - protein, 28 aa, Plasmodium falciparum
KGKSTRIENTIIRFDPFVDKKKKNKNKN

SEQ ID NO: 3361678 - protein, 19 aa, Plasmodium falciparum
KGKTLYDFIYKKGYNKNEI

SEQ ID NO: 3361679 - protein, 20 aa, Plasmodium falciparum
KGKTNILICTNILSRGVKFD

SEQ ID NO: 3361680 - protein, 27 aa, Plasmodium falciparum
KGKVVIDCFRLINPHILMLGQEPRQTT

SEQ ID NO: 3361681 - protein, 21 aa, Plasmodium falciparum
KGKYTLEDLFGWEERKNFERK

SEQ ID NO: 3361682 - protein, 17 aa, Plasmodium falciparum
KGLDTLIMFDKKEKKKN

SEQ ID NO: 3361683 - protein, 25 aa, Plasmodium falciparum
KGLFWLKIHLANTFGKDKLSFQKRI

SEQ ID NO: 3361684 - protein, 28 aa, Plasmodium falciparum
KGLIKIWRIKTGICLKIINAHNDSLISI

SEQ ID NO: 3361685 - protein, 23 aa, Plasmodium falciparum
KGLKLSQYKQMLWKQFKKSAENP

SEQ ID NO: 3361686 - protein, 43 aa, Plasmodium falciparum
KGLLTNKLFLEWDDLSVISKLRIIRMLLNLVLCESNNLKKMLG

SEQ ID NO: 3361687 - protein, 32 aa, Plasmodium falciparum
KGLPPLPFLKCKDMKPYMRLFNIVLKVIESND

SEQ ID NO: 3361688 - protein, 17 aa, Plasmodium falciparum
KGLSVFKNLKVLDLRSN

SEQ ID NO: 3361689 - protein, 18 aa, Plasmodium falciparum
KGLYEFLSDYILFCKDSG

SEQ ID NO: 3361690 - protein, 24 aa, Plasmodium falciparum
KGMDFFFLRICKRYESRVKAHRYT

SEQ ID NO: 3361691 - protein, 20 aa, Plasmodium falciparum
KGMIPRACEEIMNRLTSIKL

SEQ ID NO: 3361692 - protein, 24 aa, Plasmodium falciparum
KGMSKGSMLYCPIKYHNNNNNNNN

SEQ ID NO: 3361693 - protein, 19 aa, Plasmodium falciparum
KGNCEYSFNQDKEKKKNTQ

SEQ ID NO: 3361694 - protein, 19 aa, Plasmodium falciparum
KGNEYFLRNKKLFNYSCLE

SEQ ID NO: 3361695 - protein, 18 aa, Plasmodium falciparum
KGNFKYAENFSGSNNNHY

SEQ ID NO: 3361696 - protein, 20 aa, Plasmodium falciparum
KGNFSYFYFEYNIKVLCNSE

SEQ ID NO: 3361697 - protein, 26 aa, Plasmodium falciparum
KGNHYSRRSGERMKFTHLLVDKNSAS

SEQ ID NO: 3361698 - protein, 28 aa, Plasmodium falciparum
KGNILCIDLNYKPGYLMCNRHFNRMDDN

SEQ ID NO: 3361699 - protein, 21 aa, Plasmodium falciparum
KGNKCTYIFEEMYVTKKGTKL

SEQ ID NO: 3361700 - protein, 19 aa, Plasmodium falciparum
KGNNVGTHTTLLRKGKKNF

SEQ ID NO: 3361701 - protein, 26 aa, Plasmodium falciparum
KGNPMDKYRAFLCLYLAKKKNINIQT

SEQ ID NO: 3361702 - protein, 26 aa, Plasmodium falciparum
KGNREISCTTFAFPEGDINTLYGGTE

SEQ ID NO: 3361703 - protein, 26 aa, Plasmodium falciparum
KGNVLLCSSIHCWCIDMDIFCYSFCK

SEQ ID NO: 3361704 - protein, 33 aa, Plasmodium falciparum
KGNVTFIIPCCLNKNILSCFLPQLERGLYHLFF

SEQ ID NO: 3361705 - protein, 32 aa, Plasmodium falciparum
KGPGCGLWAPLWRVWIFFLRGVIPLLERWLSN

SEQ ID NO: 3361706 - protein, 20 aa, Plasmodium falciparum
KGPGGKPYMRLELSDDKKEF

SEQ ID NO: 3361707 - protein, 17 aa, Plasmodium falciparum
KGPSFVFHDIKKKRMRE

SEQ ID NO: 3361708 - protein, 22 aa, Plasmodium falciparum
KGQLKQAKFRGGPSTSVDEQYY

SEQ ID NO: 3361709 - protein, 17 aa, Plasmodium falciparum
KGQRIQVEHDRDVHYNT

SEQ ID NO: 3361710 - protein, 26 aa, Plasmodium falciparum
KGQYKVKIKPVFFERKIKISENKIAC

SEQ ID NO: 3361711 - protein, 26 aa, Plasmodium falciparum
KGRKRRRIKSSKFYDNDEYIYSLDKT

SEQ ID NO: 3361712 - protein, 20 aa, Plasmodium falciparum
KGRNEFPLVNNVDIGVSDIN

SEQ ID NO: 3361713 - protein, 26 aa, Plasmodium falciparum
KGRVSRYDMNSSYNLNEHKNNKNSAL

SEQ ID NO: 3361714 - protein, 18 aa, Plasmodium falciparum
KGSISRFINHSCSPNSVS

SEQ ID NO: 3361715 - protein, 21 aa, Plasmodium falciparum
KGSKKFVYLYIDFDNYFLNAS

SEQ ID NO: 3361716 - protein, 27 aa, Plasmodium falciparum
KGSKSNRPSVEELRLKYLSMSKNMPKV

SEQ ID NO: 3361717 - protein, 22 aa, Plasmodium falciparum
KGSKTLRLAPKIHEQIAREKIK

SEQ ID NO: 3361718 - protein, 20 aa, Plasmodium falciparum
KGSRGTYEFMPPEFFSNESS

SEQ ID NO: 3361719 - protein, 21 aa, Plasmodium falciparum
KGSSYLSFYCCNEDIVENFII

SEQ ID NO: 3361720 - protein, 18 aa, Plasmodium falciparum
KGSVKRFVSKNEVEIYIF

SEQ ID NO: 3361721 - protein, 21 aa, Plasmodium falciparum
KGTELNLPFQALLKLNKIGDL

SEQ ID NO: 3361722 - protein, 20 aa, Plasmodium falciparum
KGTFGKVCLGIHIYTHEIVA

SEQ ID NO: 3361723 - protein, 23 aa, Plasmodium falciparum
KGTLKLLKLMYEFFISNDDECRL

SEQ ID NO: 3361724 - protein, 17 aa, Plasmodium falciparum
KGTVLLHNAEELINYTK

SEQ ID NO: 3361725 - protein, 35 aa, Plasmodium falciparum
KGTVTFLNELRYLFKSFRSQVVLKNRINKEFCAYI

SEQ ID NO: 3361726 - protein, 25 aa, Plasmodium falciparum
KGTYRFLYKYNNLFEKLVDNNNIVY

SEQ ID NO: 3361727 - protein, 21 aa, Plasmodium falciparum
KGVFSVICVNKLALVKFSDVD

SEQ ID NO: 3361728 - protein, 17 aa, Plasmodium falciparum
KGVKCYYEDINYTPILP

SEQ ID NO: 3361729 - protein, 23 aa, Plasmodium falciparum
KGVKRTNFPWIHSNRIKNILNYN

SEQ ID NO: 3361730 - protein, 17 aa, Plasmodium falciparum
KGVNISFLFSGNSDVFG

SEQ ID NO: 3361731 - protein, 18 aa, Plasmodium falciparum
KGVSIPVMLKNKLLNVRY

SEQ ID NO: 3361732 - protein, 19 aa, Plasmodium falciparum
KGVYGYGVGFGKNIKEARN

SEQ ID NO: 3361733 - protein, 19 aa, Plasmodium falciparum
KGYFDVCLVSSDISAQRQI

SEQ ID NO: 3361734 - protein, 24 aa, Plasmodium falciparum
KGYMYPNYNTALNIMNPNENGDNN

SEQ ID NO: 3361735 - protein, 17 aa, Plasmodium falciparum
KGYRIQNIVFKYMTYSL

SEQ ID NO: 3361736 - protein, 18 aa, Plasmodium falciparum
KGYTCDKMNSKKCTNDNN

SEQ ID NO: 3361737 - protein, 27 aa, Plasmodium falciparum
KGYYIWEDGLKCLLRVYLDNLGENVYE

SEQ ID NO: 3361738 - protein, 22 aa, Plasmodium falciparum
KHASHNYHYLASRTKLKNTQRN

SEQ ID NO: 3361739 - protein, 18 aa, Plasmodium falciparum
KHCIVRDSIEPIALDEEI

SEQ ID NO: 3361740 - protein, 17 aa, Plasmodium falciparum
KHDFIKMFKNFFLVLYY

SEQ ID NO: 3361741 - protein, 23 aa, Plasmodium falciparum
KHEEFLIKKGHYIYYDKNFNTQH

SEQ ID NO: 3361742 - protein, 25 aa, Plasmodium falciparum
KHEFPLMGTYHFRFKILHNNIPAWV

SEQ ID NO: 3361743 - protein, 22 aa, Plasmodium falciparum
KHEKYLCSLNMTYKSRTNIEKV

SEQ ID NO: 3361744 - protein, 17 aa, Plasmodium falciparum
KHERVSSNMIIKRNNNN

SEQ ID NO: 3361745 - protein, 30 aa, Plasmodium falciparum
KHFPVCKFGFHEARQLALEFRNLKINDKNK

SEQ ID NO: 3361746 - protein, 20 aa, Plasmodium falciparum
KHFSCIIHSINVYNQLLLKR

SEQ ID NO: 3361747 - protein, 38 aa, Plasmodium falciparum
KHGCEEAKRLAIEWKKARIRGEVWDRFINKKKKNTNNN

SEQ ID NO: 3361748 - protein, 22 aa, Plasmodium falciparum
KHICVSPNCRNVIINLNRIGDQ

SEQ ID NO: 3361749 - protein, 20 aa, Plasmodium falciparum
KHIEELKKLLKTITIKKNRI

SEQ ID NO: 3361750 - protein, 24 aa, Plasmodium falciparum
KHIFVFPCNVQIILGMNGYIWISS

SEQ ID NO: 3361751 - protein, 18 aa, Plasmodium falciparum
KHIHADLIDILSIQHDDV

SEQ ID NO: 3361752 - protein, 25 aa, Plasmodium falciparum
KHIIEKGKCTNGYYSYSQPLSPMVF

SEQ ID NO: 3361753 - protein, 23 aa, Plasmodium falciparum
KHILFSLNAADEFKKKKKKKKHT

SEQ ID NO: 3361754 - protein, 23 aa, Plasmodium falciparum
KHILKLFSKNSFHANKQDTTMEK

SEQ ID NO: 3361755 - protein, 18 aa, Plasmodium falciparum
KHIQALRNYKLELIQELN

SEQ ID NO: 3361756 - protein, 21 aa, Plasmodium falciparum
KHISNTRVNNMINQNDIYDDM

SEQ ID NO: 3361757 - protein, 18 aa, Plasmodium falciparum
KHIYFLKFARVVENQITE

SEQ ID NO: 3361758 - protein, 19 aa, Plasmodium falciparum
KHKHMLPYLINNNMINQKL

SEQ ID NO: 3361759 - protein, 17 aa, Plasmodium falciparum
KHKKCSKTITLDISKYR

SEQ ID NO: 3361760 - protein, 23 aa, Plasmodium falciparum
KHKNLPKVLGRILIPKTQKTGSI

SEQ ID NO: 3361761 - protein, 18 aa, Plasmodium falciparum
KHKRKCKSMNNICDVKNN

SEQ ID NO: 3361762 - protein, 19 aa, Plasmodium falciparum
KHLALKGWTVHSINFRDIY

SEQ ID NO: 3361763 - protein, 21 aa, Plasmodium falciparum
KHLKHWGRQQLWLFLKGAGMT

SEQ ID NO: 3361764 - protein, 27 aa, Plasmodium falciparum
KHLLIKMLKKEIKVESVVLKYKENIPH

SEQ ID NO: 3361765 - protein, 23 aa, Plasmodium falciparum
KHLLKNKFMLLKIIRKIKNNHLY

SEQ ID NO: 3361766 - protein, 27 aa, Plasmodium falciparum
KHLNEIIKLILCEDSKKKNLRNIISTY

SEQ ID NO: 3361767 - protein, 20 aa, Plasmodium falciparum
KHLNRLSIEHLLILCKKMQH

SEQ ID NO: 3361768 - protein, 17 aa, Plasmodium falciparum
KHLPYLSTCYWYKKDIE

SEQ ID NO: 3361769 - protein, 24 aa, Plasmodium falciparum
KHMDPSYFIYISFKKEEKYFLNIK

SEQ ID NO: 3361770 - protein, 17 aa, Plasmodium falciparum
KHMPWLYVDVADPLTDI

SEQ ID NO: 3361771 - protein, 25 aa, Plasmodium falciparum
KHNCNYRLIIVALHKGKTYNYENSS

SEQ ID NO: 3361772 - protein, 21 aa, Plasmodium falciparum
KHNGFKKEEHEGYNNNYIDND

SEQ ID NO: 3361773 - protein, 17 aa, Plasmodium falciparum
KHNHMGCMNNHIKCINN

SEQ ID NO: 3361774 - protein, 19 aa, Plasmodium falciparum
KHNLFLNEYLLNFNNSEWK

SEQ ID NO: 3361775 - protein, 21 aa, Plasmodium falciparum
KHNLYDLAVRFISKTSFPENL

SEQ ID NO: 3361776 - protein, 18 aa, Plasmodium falciparum
KHNPRKVKWTKIYRKERN

SEQ ID NO: 3361777 - protein, 23 aa, Plasmodium falciparum
KHPHIACMYTWFHTSSHVFFVME

SEQ ID NO: 3361778 - protein, 20 aa, Plasmodium falciparum
KHPKNCGVPLSSLHIYAQFI

SEQ ID NO: 3361779 - protein, 20 aa, Plasmodium falciparum
KHPNYNYLRRDAEPKCRMSN

SEQ ID NO: 3361780 - protein, 18 aa, Plasmodium falciparum
KHQINWLAKEAVEKEYEI

SEQ ID NO: 3361781 - protein, 23 aa, Plasmodium falciparum
KHQIPHINSPYFNDYMKRFSSIN

SEQ ID NO: 3361782 - protein, 19 aa, Plasmodium falciparum
KHQKVYRKYITVVIKKSNE

SEQ ID NO: 3361783 - protein, 18 aa, Plasmodium falciparum
KHQSFCTNSSYTKKYSKL

SEQ ID NO: 3361784 - protein, 20 aa, Plasmodium falciparum
KHRLYKELRQVFPSDWDINI

SEQ ID NO: 3361785 - protein, 18 aa, Plasmodium falciparum
KHRRKTLVDTNHEYLNKA

SEQ ID NO: 3361786 - protein, 21 aa, Plasmodium falciparum
KHSEEIILFVELMMPALKIPC

SEQ ID NO: 3361787 - protein, 20 aa, Plasmodium falciparum
KHSSPFEIFGIYENINMDLI

SEQ ID NO: 3361788 - protein, 23 aa, Plasmodium falciparum
KHTTESINLYAPMDKDTNHIYEN

SEQ ID NO: 3361789 - protein, 18 aa, Plasmodium falciparum
KHVFLCTVVCSRMLKKLC

SEQ ID NO: 3361790 - protein, 24 aa, Plasmodium falciparum
KHVKKSVLPTDAYRKQQKKKEKKK

SEQ ID NO: 3361791 - protein, 29 aa, Plasmodium falciparum
KHVRMNTCRICLFSGSIFKHPNASKLDVA

SEQ ID NO: 3361792 - protein, 21 aa, Plasmodium falciparum
KHYCETCNVWISGHKVNIKNH

SEQ ID NO: 3361793 - protein, 34 aa, Plasmodium falciparum
KHYKVLIHAPACWKGEKFNGTPFIFVYDKSINFY

SEQ ID NO: 3361794 - protein, 19 aa, Plasmodium falciparum
KHYNKIMIIACRKISIYII

SEQ ID NO: 3361795 - protein, 18 aa, Plasmodium falciparum
KIAETLNIDESVLNKLSD

SEQ ID NO: 3361796 - protein, 23 aa, Plasmodium falciparum
KIAEVPSFLFIWCGVTHLEDARV

SEQ ID NO: 3361797 - protein, 26 aa, Plasmodium falciparum
KIANLKRRARELAQRYKSKEYSNHDQ

SEQ ID NO: 3361798 - protein, 23 aa, Plasmodium falciparum
KIARYAWYIPNAKAHIFALHGIT

SEQ ID NO: 3361799 - protein, 22 aa, Plasmodium falciparum
KIASCTYFNLGLHTTQVENINL

SEQ ID NO: 3361800 - protein, 21 aa, Plasmodium falciparum
KIATKGWNWGEFKLENSNLCF

SEQ ID NO: 3361801 - protein, 18 aa, Plasmodium falciparum
KIAVSKYHSPMCVYIKLE

SEQ ID NO: 3361802 - protein, 20 aa, Plasmodium falciparum
KICEKSFNIVHDSILKLSKM

SEQ ID NO: 3361803 - protein, 19 aa, Plasmodium falciparum
KICELCNIIYPIFNKIFGN

SEQ ID NO: 3361804 - protein, 25 aa, Plasmodium falciparum
KICHDDITLNECLNSIDINEGEKKT

SEQ ID NO: 3361805 - protein, 19 aa, Plasmodium falciparum
KICKDYHYNNMIAKENILQ

SEQ ID NO: 3361806 - protein, 22 aa, Plasmodium falciparum
KICLLNLYFIKMEKPSIYFMNN

SEQ ID NO: 3361807 - protein, 18 aa, Plasmodium falciparum
KICLYNLNEYHILYSNNY

SEQ ID NO: 3361808 - protein, 18 aa, Plasmodium falciparum
KIDDKKYSGIIYGLGSTI

SEQ ID NO: 3361809 - protein, 19 aa, Plasmodium falciparum
KIDDLIKHISYNVSRNSSN

SEQ ID NO: 3361810 - protein, 23 aa, Plasmodium falciparum
KIDESSFLCYIYFEERCNEINKC

SEQ ID NO: 3361811 - protein, 23 aa, Plasmodium falciparum
KIDKELSFHINVLYGMGSKGINL

SEQ ID NO: 3361812 - protein, 18 aa, Plasmodium falciparum
KIDKEYYIRNQILSPINR

SEQ ID NO: 3361813 - protein, 19 aa, Plasmodium falciparum
KIDKPIKFDMADFTIENVL

SEQ ID NO: 3361814 - protein, 17 aa, Plasmodium falciparum
KIDLNYVKYNTCVYKDD

SEQ ID NO: 3361815 - protein, 18 aa, Plasmodium falciparum
KIDNIIFFSNLKLDNIYK

SEQ ID NO: 3361816 - protein, 26 aa, Plasmodium falciparum
KIEDIDEYFAAFTIMGTLKKYLNITH

SEQ ID NO: 3361817 - protein, 28 aa, Plasmodium falciparum
KIEEKLKDLWFMPGIIYKKVKKAIKYKK

SEQ ID NO: 3361818 - protein, 18 aa, Plasmodium falciparum
KIEFSRKPLNSFNEDVKT

SEQ ID NO: 3361819 - protein, 17 aa, Plasmodium falciparum
KIEGKIKKFSALKNSTE

SEQ ID NO: 3361820 - protein, 26 aa, Plasmodium falciparum
KIEGSLNMYEYIYKNFQFFRQETFCI

SEQ ID NO: 3361821 - protein, 27 aa, Plasmodium falciparum
KIEKCRIKLIRKFFCESSSENEYSPKS

SEQ ID NO: 3361822 - protein, 24 aa, Plasmodium falciparum
KIEKFGASIGPVFTDEENKKEENK

SEQ ID NO: 3361823 - protein, 18 aa, Plasmodium falciparum
KIEKQRALQNINNIKNKI

SEQ ID NO: 3361824 - protein, 18 aa, Plasmodium falciparum
KIELDKKLKGDINVNINT

SEQ ID NO: 3361825 - protein, 24 aa, Plasmodium falciparum
KIELKDCYVNHNFEVRDEEEVYYN

SEQ ID NO: 3361826 - protein, 18 aa, Plasmodium falciparum
KIELKKKELRELYYKLEN

SEQ ID NO: 3361827 - protein, 19 aa, Plasmodium falciparum
KIELLRLSPPLFNNNIWNM

SEQ ID NO: 3361828 - protein, 19 aa, Plasmodium falciparum
KIENVTCPILPTVLNYVLL

SEQ ID NO: 3361829 - protein, 30 aa, Plasmodium falciparum
KIEREIIKDINIFVTINFRNLIIDTLYLFK

SEQ ID NO: 3361830 - protein, 20 aa, Plasmodium falciparum
KIERRWQLYFTFKRDIKKSY

SEQ ID NO: 3361831 - protein, 22 aa, Plasmodium falciparum
KIEVIKNLLIFYHKLKTVCLSK

SEQ ID NO: 3361832 - protein, 20 aa, Plasmodium falciparum
KIEVPLGCLYTVLKRTDDSS

SEQ ID NO: 3361833 - protein, 20 aa, Plasmodium falciparum
KIFDEWLFNDIVQYLKCIKY

SEQ ID NO: 3361834 - protein, 22 aa, Plasmodium falciparum
KIFDRKILKIITVPNWAHLDPL

SEQ ID NO: 3361835 - protein, 25 aa, Plasmodium falciparum
KIFEECFKGRILYENEKYQNYVTPQ

SEQ ID NO: 3361836 - protein, 20 aa, Plasmodium falciparum
KIFEPDIFCIPCEEIKINEQ

SEQ ID NO: 3361837 - protein, 23 aa, Plasmodium falciparum
KIFHLKNSYLIDDDRNEISSLSI

SEQ ID NO: 3361838 - protein, 20 aa, Plasmodium falciparum
KIFIGDEGIYILGEILTICQ

SEQ ID NO: 3361839 - protein, 18 aa, Plasmodium falciparum
KIFILYATFELRQLNVNK

SEQ ID NO: 3361840 - protein, 19 aa, Plasmodium falciparum
KIFLGKFLYTHNIWNNIKF

SEQ ID NO: 3361841 - protein, 20 aa, Plasmodium falciparum
KIFLPNIINEISFHEERLKV

SEQ ID NO: 3361842 - protein, 17 aa, Plasmodium falciparum
KIFSVFFYYALWANQFD

SEQ ID NO: 3361843 - protein, 23 aa, Plasmodium falciparum
KIFVKHLKMVDSFKLDDKLYREY

SEQ ID NO: 3361844 - protein, 40 aa, Plasmodium falciparum
KIGDVQLMPVIKCEIFNSDSRFCFLEFRTVQITWLCLKLD

SEQ ID NO: 3361845 - protein, 20 aa, Plasmodium falciparum
KIGLKKCASNKMYKLNTSMN

SEQ ID NO: 3361846 - protein, 17 aa, Plasmodium falciparum
KIGLRWRTEEEIIKGKG

SEQ ID NO: 3361847 - protein, 30 aa, Plasmodium falciparum
KIGQDKRFMHSLCVKELKSTEEGELFDDEK

SEQ ID NO: 3361848 - protein, 25 aa, Plasmodium falciparum
KIGQVIRCICILSNPIPETNQTNSC

SEQ ID NO: 3361849 - protein, 19 aa, Plasmodium falciparum
KIGTSVFNYDYKKMISEIS

SEQ ID NO: 3361850 - protein, 17 aa, Plasmodium falciparum
KIGYLINSLCQIKMFKI

SEQ ID NO: 3361851 - protein, 22 aa, Plasmodium falciparum
KIHADMKFKEILYDKSSKHQSD

SEQ ID NO: 3361852 - protein, 19 aa, Plasmodium falciparum
KIHCLKNFTLCNICKKVLK

SEQ ID NO: 3361853 - protein, 25 aa, Plasmodium falciparum
KIHEHCVIFFDILFSLLDVIKTDFY

SEQ ID NO: 3361854 - protein, 24 aa, Plasmodium falciparum
KIHLKINTVFKCKIKDCNKQFCSD

SEQ ID NO: 3361855 - protein, 45 aa, Plasmodium falciparum
KIHNTNFFFPHFVSYELKNFCYELCSKKRHCFSELKNHPWFQKNL

SEQ ID NO: 3361856 - protein, 25 aa, Plasmodium falciparum
KIHNYDIFLCLKIAQACNNVQVTYE

SEQ ID NO: 3361857 - protein, 18 aa, Plasmodium falciparum
KIHSDEIINIFISEDEEH

SEQ ID NO: 3361858 - protein, 24 aa, Plasmodium falciparum
KIHSLKYLILESILKEKQLERSVN

SEQ ID NO: 3361859 - protein, 26 aa, Plasmodium falciparum
KIHSRLFKSLHEWETNKYIFLNQKKK

SEQ ID NO: 3361860 - protein, 18 aa, Plasmodium falciparum
KIHVKKNEALKCDKNVKD

SEQ ID NO: 3361861 - protein, 18 aa, Plasmodium falciparum
KIHYCTLSLQEIKKDIQK

SEQ ID NO: 3361862 - protein, 21 aa, Plasmodium falciparum
KIIEIPIHKPYLVTHDTVVNK

SEQ ID NO: 3361863 - protein, 21 aa, Plasmodium falciparum
KIIEKEGPIKMFSSSTSIISD

SEQ ID NO: 3361864 - protein, 18 aa, Plasmodium falciparum
KIIENILIDLKESMCQKQ

SEQ ID NO: 3361865 - protein, 25 aa, Plasmodium falciparum
KIIFFKMGRFYEIFYIDACLMHTIC

SEQ ID NO: 3361866 - protein, 20 aa, Plasmodium falciparum
KIIFKKEFLDNFKYQKTDER

SEQ ID NO: 3361867 - protein, 29 aa, Plasmodium falciparum
KIIGVTKLKLEICTNEYMELKENYDKEKK

SEQ ID NO: 3361868 - protein, 18 aa, Plasmodium falciparum
KIIICKYNNKIIKWMKKI

SEQ ID NO: 3361869 - protein, 30 aa, Plasmodium falciparum
KIIIRQQIRTEYKIAFPYLYNNRPRKIAVS

SEQ ID NO: 3361870 - protein, 17 aa, Plasmodium falciparum
KIIKCGKYHSGAVSENG

SEQ ID NO: 3361871 - protein, 17 aa, Plasmodium falciparum
KIIKRFSKDENIFVFLL

SEQ ID NO: 3361872 - protein, 23 aa, Plasmodium falciparum
KIIKSCKTLISFLAKLDDELLKA

SEQ ID NO: 3361873 - protein, 24 aa, Plasmodium falciparum
KIIKSIYVIDDFVLVKILSNESLH

SEQ ID NO: 3361874 - protein, 23 aa, Plasmodium falciparum
KIILNDKYLFLFVDALNSIEYNV

SEQ ID NO: 3361875 - protein, 21 aa, Plasmodium falciparum
KIILNIVWKKNYFEWIDILYL

SEQ ID NO: 3361876 - protein, 24 aa, Plasmodium falciparum
KIINEFKSTILFRSAEINVNDTIK

SEQ ID NO: 3361877 - protein, 19 aa, Plasmodium falciparum
KIINQCLLNSTKKTCSTYK

SEQ ID NO: 3361878 - protein, 22 aa, Plasmodium falciparum
KIINYYIYDMFSFVIKGEGIQC

SEQ ID NO: 3361879 - protein, 18 aa, Plasmodium falciparum
KIIPQYPIKYSRRCSDKY

SEQ ID NO: 3361880 - protein, 19 aa, Plasmodium falciparum
KIIPRPLGKGLKINRKYLP

SEQ ID NO: 3361881 - protein, 26 aa, Plasmodium falciparum
KIIPSEGLVKSCYRKNKYINNYINKL

SEQ ID NO: 3361882 - protein, 22 aa, Plasmodium falciparum
KIIQLEAACELAMWKEASNIAE

SEQ ID NO: 3361883 - protein, 17 aa, Plasmodium falciparum
KIIRFLNNFQQIIKKKN

SEQ ID NO: 3361884 - protein, 30 aa, Plasmodium falciparum
KIISNALRLGYSCMNLCTILNKLINKDKLY

SEQ ID NO: 3361885 - protein, 33 aa, Plasmodium falciparum
KIITNRIDGFWVYKVSPLLKVKGILNITNKYIY

SEQ ID NO: 3361886 - protein, 25 aa, Plasmodium falciparum
KIIYEKLDGLSFCYDNDSKNFNFPP

SEQ ID NO: 3361887 - protein, 21 aa, Plasmodium falciparum
KIIYENIIKFSKRNVNNEHEL

SEQ ID NO: 3361888 - protein, 19 aa, Plasmodium falciparum
KIKDCKLTNTLIYINENKT

SEQ ID NO: 3361889 - protein, 24 aa, Plasmodium falciparum
KIKEDIYYYILIPLIYKHIYDAYH

SEQ ID NO: 3361890 - protein, 25 aa, Plasmodium falciparum
KIKEEELMHFKVCYEKLKNSMNILK

SEQ ID NO: 3361891 - protein, 18 aa, Plasmodium falciparum
KIKEEKTNILSIIEAPTV

SEQ ID NO: 3361892 - protein, 19 aa, Plasmodium falciparum
KIKEFRKITNLSIAICKNI

SEQ ID NO: 3361893 - protein, 22 aa, Plasmodium falciparum
KIKEIELQFLIIQNVTHENKGI

SEQ ID NO: 3361894 - protein, 26 aa, Plasmodium falciparum
KIKEILKKKLSLFINEKDINVIVKSL

SEQ ID NO: 3361895 - protein, 22 aa, Plasmodium falciparum
KIKEIYKKIDSISLLNDLSLNK

SEQ ID NO: 3361896 - protein, 35 aa, Plasmodium falciparum
KIKELKILEPLKRREYFFYLYIAVSLKYVEERIAN

SEQ ID NO: 3361897 - protein, 20 aa, Plasmodium falciparum
KIKESIRIYERILNQYDNVK

SEQ ID NO: 3361898 - protein, 25 aa, Plasmodium falciparum
KIKEVPRYIAKYVEKVVEVPEVKFV

SEQ ID NO: 3361899 - protein, 35 aa, Plasmodium falciparum
KIKFIILYFFCVLFLKDYERSEAFNLARTTEKLNY

SEQ ID NO: 3361900 - protein, 23 aa, Plasmodium falciparum
KIKFPEYYDMAGALLSDATAACV

SEQ ID NO: 3361901 - protein, 29 aa, Plasmodium falciparum
KIKFTDILHAGAFGHFFHRNKNGLSRSFV

SEQ ID NO: 3361902 - protein, 19 aa, Plasmodium falciparum
KIKGEHFVGLETYTNISKI

SEQ ID NO: 3361903 - protein, 17 aa, Plasmodium falciparum
KIKHTKFFYAFSNLYPC

SEQ ID NO: 3361904 - protein, 23 aa, Plasmodium falciparum
KIKIKIKQDCIDIKENGNCDDNN

SEQ ID NO: 3361905 - protein, 24 aa, Plasmodium falciparum
KIKIPEPKFKAIEMKSDEKQSNMN

SEQ ID NO: 3361906 - protein, 28 aa, Plasmodium falciparum
KIKIPGLDDFLFFNIKAFCTCPYIKIIP

SEQ ID NO: 3361907 - protein, 35 aa, Plasmodium falciparum
KIKKEQKLVINFNLFPFKFIDLLEECILENDNCEH

SEQ ID NO: 3361908 - protein, 19 aa, Plasmodium falciparum
KIKKGFIFFYGSGHRNQWI

SEQ ID NO: 3361909 - protein, 19 aa, Plasmodium falciparum
KIKKRFTLLSTDKQSRQST

SEQ ID NO: 3361910 - protein, 18 aa, Plasmodium falciparum
KIKLQKVIIRVCKIVNII

SEQ ID NO: 3361911 - protein, 33 aa, Plasmodium falciparum
KIKNAFLNHQVYDFILRKNIPINESFKSSFVNK

SEQ ID NO: 3361912 - protein, 24 aa, Plasmodium falciparum
KIKNEETFYIFNMYILKNVNKLIC

SEQ ID NO: 3361913 - protein, 30 aa, Plasmodium falciparum
KIKNENITFFPAIEQFNFSIEHAVSSYQTG

SEQ ID NO: 3361914 - protein, 20 aa, Plasmodium falciparum
KIKNEYLKNAIIKTIPLLIE

SEQ ID NO: 3361915 - protein, 20 aa, Plasmodium falciparum
KIKNIEIYPNVILNDNKIND

SEQ ID NO: 3361916 - protein, 20 aa, Plasmodium falciparum
KIKQSFAIKYLNLFSKSNIL

SEQ ID NO: 3361917 - protein, 20 aa, Plasmodium falciparum
KIKRIFRVYQKCDDIMKDCK

SEQ ID NO: 3361918 - protein, 37 aa, Plasmodium falciparum
KIKRKYKKFRFCINKVFKKKSINDIIALNENIHKNKD

SEQ ID NO: 3361919 - protein, 21 aa, Plasmodium falciparum
KIKSCDIFSEILMINNIQIYE

SEQ ID NO: 3361920 - protein, 30 aa, Plasmodium falciparum
KIKSLPLIQKLCLYASCNVVNDTHLNDYED

SEQ ID NO: 3361921 - protein, 22 aa, Plasmodium falciparum
KIKSNSIPPIIKKIERKSNDND

SEQ ID NO: 3361922 - protein, 21 aa, Plasmodium falciparum
KIKSSRMSYDKNIEKYDDQTK

SEQ ID NO: 3361923 - protein, 20 aa, Plasmodium falciparum
KIKTKLKVINKIRLTKKGKD

SEQ ID NO: 3361924 - protein, 25 aa, Plasmodium falciparum
KIKYISMVHDIIYKKYMLLNNTIFP

SEQ ID NO: 3361925 - protein, 26 aa, Plasmodium falciparum
KIKYRSEYYLKQGLIVDFLILKNNKP

SEQ ID NO: 3361926 - protein, 19 aa, Plasmodium falciparum
KILEIDSRITSLNNIKDEN

SEQ ID NO: 3361927 - protein, 21 aa, Plasmodium falciparum
KILEPNTPFNFILMDSASEDE

SEQ ID NO: 3361928 - protein, 20 aa, Plasmodium falciparum
KILFKKRRAKLLMEEGLDLY

SEQ ID NO: 3361929 - protein, 18 aa, Plasmodium falciparum
KILFYLEHLLNFDNYNFK

SEQ ID NO: 3361930 - protein, 34 aa, Plasmodium falciparum
KILIDPHYHCPLCVNMYFYHYNMLTEHCSNFHKN

SEQ ID NO: 3361931 - protein, 18 aa, Plasmodium falciparum
KILKCPLVTKSYYLWGSL

SEQ ID NO: 3361932 - protein, 26 aa, Plasmodium falciparum
KILKFSNYFLNGSFWNHINYSNPVGQ

SEQ ID NO: 3361933 - protein, 22 aa, Plasmodium falciparum
KILKGELCNLIGTITAVNDNVL

SEQ ID NO: 3361934 - protein, 41 aa, Plasmodium falciparum
KILKKKEILRWVVILDYGKIFLKKICKLFVVSTNSDIYFFH

SEQ ID NO: 3361935 - protein, 23 aa, Plasmodium falciparum
KILKREISCSVNTVCSSKTNNKT

SEQ ID NO: 3361936 - protein, 20 aa, Plasmodium falciparum
KILLEPYTNIDLMNPQVQIG

SEQ ID NO: 3361937 - protein, 27 aa, Plasmodium falciparum
KILLKKIEECISFGYSIIVENADEYID

SEQ ID NO: 3361938 - protein, 20 aa, Plasmodium falciparum
KILNCPPSIIKNEKTITLPY

SEQ ID NO: 3361939 - protein, 18 aa, Plasmodium falciparum
KILNENYKLFYLKKKMCK

SEQ ID NO: 3361940 - protein, 30 aa, Plasmodium falciparum
KILNQLAITYICKWLKYNISKLEPEKEFSD

SEQ ID NO: 3361941 - protein, 21 aa, Plasmodium falciparum
KILNRTKCYIEWLPKMENNTF

SEQ ID NO: 3361942 - protein, 21 aa, Plasmodium falciparum
KILQTLICKNSKELQELLHSN

SEQ ID NO: 3361943 - protein, 19 aa, Plasmodium falciparum
KILRKIYKYIKIYKNKKNM

SEQ ID NO: 3361944 - protein, 35 aa, Plasmodium falciparum
KILTKPKWKPFFMKLNIYHVLALWLMPTSKNTLPN

SEQ ID NO: 3361945 - protein, 23 aa, Plasmodium falciparum
KILYECLKLLIKLHNVGIAHLDI

SEQ ID NO: 3361946 - protein, 26 aa, Plasmodium falciparum
KILYKLKEIRHILEYTNHLLKDHFIK

SEQ ID NO: 3361947 - protein, 30 aa, Plasmodium falciparum
KILYSTLKEWVWNETRGEKKFFNFKQLHKY

SEQ ID NO: 3361948 - protein, 18 aa, Plasmodium falciparum
KIMDCSFNYSYDYIGNYQ

SEQ ID NO: 3361949 - protein, 26 aa, Plasmodium falciparum
KIMDFKTFRFNECVCSPYNADFDGDE

SEQ ID NO: 3361950 - protein, 21 aa, Plasmodium falciparum
KIMIIACRKISIYIIKENNNF

SEQ ID NO: 3361951 - protein, 33 aa, Plasmodium falciparum
KIMNESPHAYLYGHSIVKFGNKLYMFGGSNGKN

SEQ ID NO: 3361952 - protein, 18 aa, Plasmodium falciparum
KIMYEYYNLLDIDNNILP

SEQ ID NO: 3361953 - protein, 17 aa, Plasmodium falciparum
KINCKFGSFNNFILDLE

SEQ ID NO: 3361954 - protein, 19 aa, Plasmodium falciparum
KINDLIQIFGICNTVSLNE

SEQ ID NO: 3361955 - protein, 25 aa, Plasmodium falciparum
KINDLKVKILEKIKGCYDNYNSNNN

SEQ ID NO: 3361956 - protein, 26 aa, Plasmodium falciparum
KINEKFCAQNFLSLIQTFKNNIRKEK

SEQ ID NO: 3361957 - protein, 24 aa, Plasmodium falciparum
KINEKRWLIATKHVKIERVNKNGV

SEQ ID NO: 3361958 - protein, 19 aa, Plasmodium falciparum
KINELFLRCHKRYQEENKC

SEQ ID NO: 3361959 - protein, 21 aa, Plasmodium falciparum
KINEYKYNKSLKHEKNKSKRD

SEQ ID NO: 3361960 - protein, 20 aa, Plasmodium falciparum
KINFLEFLQAFYVVNKSKYS

SEQ ID NO: 3361961 - protein, 25 aa, Plasmodium falciparum
KINFLNENIDVWPVHCVKNTYGCKV

SEQ ID NO: 3361962 - protein, 23 aa, Plasmodium falciparum
KINFYKKDFHSFLDDIVKSELFH

SEQ ID NO: 3361963 - protein, 26 aa, Plasmodium falciparum
KINHKEVRKGLTFEQMRRKSYEPILY

SEQ ID NO: 3361964 - protein, 18 aa, Plasmodium falciparum
KINIGKLYTSEQVLKYCY

SEQ ID NO: 3361965 - protein, 27 aa, Plasmodium falciparum
KINIKCIKVVYGMKHFFCSYDTQEISD

SEQ ID NO: 3361966 - protein, 17 aa, Plasmodium falciparum
KINIKRIFLFDRSVDKV

SEQ ID NO: 3361967 - protein, 23 aa, Plasmodium falciparum
KINKKHSLHFVKRKYTKRKLMAS

SEQ ID NO: 3361968 - protein, 22 aa, Plasmodium falciparum
KINKKLKHYIIHPEQKNVLKIN

SEQ ID NO: 3361969 - protein, 17 aa, Plasmodium falciparum
KINLAITSWNIFNEENK

SEQ ID NO: 3361970 - protein, 19 aa, Plasmodium falciparum
KINLNFCNNLFIYNIETNK

SEQ ID NO: 3361971 - protein, 22 aa, Plasmodium falciparum
KINMKQIYHLNEWDSNQNDLAK

SEQ ID NO: 3361972 - protein, 26 aa, Plasmodium falciparum
KINMLFKILYNHSLNISTCKIFFKYR

SEQ ID NO: 3361973 - protein, 18 aa, Plasmodium falciparum
KINNCIINSISNLKEEIS

SEQ ID NO: 3361974 - protein, 21 aa, Plasmodium falciparum
KINTGHHFLSIIVNSTTNNFI

SEQ ID NO: 3361975 - protein, 19 aa, Plasmodium falciparum
KINTSIIYIPALKIENEDM

SEQ ID NO: 3361976 - protein, 27 aa, Plasmodium falciparum
KINVHYCPLSWDLNEFHIKDIIMSNTK

SEQ ID NO: 3361977 - protein, 20 aa, Plasmodium falciparum
KIPIYIWVKQFNLMNEYDGE

SEQ ID NO: 3361978 - protein, 31 aa, Plasmodium falciparum
KIPYNNICILCYEFLASCAIEVVNRFENTYG

SEQ ID NO: 3361979 - protein, 22 aa, Plasmodium falciparum
KIQEFLNPFIINLRKKKAKEKV

SEQ ID NO: 3361980 - protein, 26 aa, Plasmodium falciparum
KIQEKKLRFVDKIIKMKKEKQNVDIT

SEQ ID NO: 3361981 - protein, 22 aa, Plasmodium falciparum
KIQGILPKKIFLIIKYSLDVDE

SEQ ID NO: 3361982 - protein, 20 aa, Plasmodium falciparum
KIQIEMLPFIQALEKNFDNR

SEQ ID NO: 3361983 - protein, 21 aa, Plasmodium falciparum
KIQKARKWFYRVINLNPHFGD

SEQ ID NO: 3361984 - protein, 19 aa, Plasmodium falciparum
KIQLELCNIMESKEGEDEG

SEQ ID NO: 3361985 - protein, 18 aa, Plasmodium falciparum
KIQLKWKSILARKQLRRL

SEQ ID NO: 3361986 - protein, 24 aa, Plasmodium falciparum
KIQLNELAYSYGLIEFSQDMINEL

SEQ ID NO: 3361987 - protein, 26 aa, Plasmodium falciparum
KIQNIFSAVCSIEFVPSEKRTTPYQK

SEQ ID NO: 3361988 - protein, 23 aa, Plasmodium falciparum
KIQYEYLDIVYLSVKSFFQLVEW

SEQ ID NO: 3361989 - protein, 22 aa, Plasmodium falciparum
KIRDLGKLFQLYHISTTTNDTI

SEQ ID NO: 3361990 - protein, 25 aa, Plasmodium falciparum
KIREALQCGPLMHFFLTKTNITENI

SEQ ID NO: 3361991 - protein, 17 aa, Plasmodium falciparum
KIRGCELFIPMIEILIR

SEQ ID NO: 3361992 - protein, 21 aa, Plasmodium falciparum
KIRKTCGWIIFVIQNCEIIIH

SEQ ID NO: 3361993 - protein, 18 aa, Plasmodium falciparum
KIRLDTYNSEILKMKSDI

SEQ ID NO: 3361994 - protein, 19 aa, Plasmodium falciparum
KIRLHRGLRHHWGLRVRGQ

SEQ ID NO: 3361995 - protein, 26 aa, Plasmodium falciparum
KIRNGLDFRNTFFLNPLNKCELFNPC

SEQ ID NO: 3361996 - protein, 19 aa, Plasmodium falciparum
KIRRKIILSTNICETSITI

SEQ ID NO: 3361997 - protein, 23 aa, Plasmodium falciparum
KIRTKLLNAAKWKGKKIAPSGCL

SEQ ID NO: 3361998 - protein, 19 aa, Plasmodium falciparum
KISDSWFKLDSSLNKPILL

SEQ ID NO: 3361999 - protein, 19 aa, Plasmodium falciparum
KISDYKCNLLYTSLDRIHK

SEQ ID NO: 3362000 - protein, 23 aa, Plasmodium falciparum
KISEKLIFLKYLFNEYGHTEYPN

SEQ ID NO: 3362001 - protein, 26 aa, Plasmodium falciparum
KISFMKRIETFKAWVRKPAHLSSLIL

SEQ ID NO: 3362002 - protein, 20 aa, Plasmodium falciparum
KISHIHLILYIYSYFNTINN

SEQ ID NO: 3362003 - protein, 22 aa, Plasmodium falciparum
KISHYIIECYYVSKNIFSICKG

SEQ ID NO: 3362004 - protein, 19 aa, Plasmodium falciparum
KISIFKIFEREGQNGVPFS

SEQ ID NO: 3362005 - protein, 31 aa, Plasmodium falciparum
KISIMSFDDLCEFIYDIYVILNFTVPKNNTD

SEQ ID NO: 3362006 - protein, 19 aa, Plasmodium falciparum
KISLCKRIYLHKHNHDNFF

SEQ ID NO: 3362007 - protein, 24 aa, Plasmodium falciparum
KISMKYLFNNFVSFVLIIDEKIYH

SEQ ID NO: 3362008 - protein, 22 aa, Plasmodium falciparum
KISNIFYMLLFYNSNHFIYNRM

SEQ ID NO: 3362009 - protein, 26 aa, Plasmodium falciparum
KISNKSCVLISGKVKEGCLPNDNNVI

SEQ ID NO: 3362010 - protein, 27 aa, Plasmodium falciparum
KISNLYKCLLCRKLYTEPVTLHCCAET

SEQ ID NO: 3362011 - protein, 20 aa, Plasmodium falciparum
KISSLRKCYANALYNSYLLQ

SEQ ID NO: 3362012 - protein, 19 aa, Plasmodium falciparum
KISSPLIFKLISHRPLFKC

SEQ ID NO: 3362013 - protein, 18 aa, Plasmodium falciparum
KITKEVYSSNSFSSNSDT

SEQ ID NO: 3362014 - protein, 17 aa, Plasmodium falciparum
KITKLNCDITNSNNKEF

SEQ ID NO: 3362015 - protein, 17 aa, Plasmodium falciparum
KITNEIYAAKLLQPNQF

SEQ ID NO: 3362016 - protein, 24 aa, Plasmodium falciparum
KITSFFKICIFNSKELKMKNDMIG

SEQ ID NO: 3362017 - protein, 21 aa, Plasmodium falciparum
KIVDLKPAFACTIIETDVEVE

SEQ ID NO: 3362018 - protein, 26 aa, Plasmodium falciparum
KIVINFDICSCKEYIHRVGRTARAGR

SEQ ID NO: 3362019 - protein, 22 aa, Plasmodium falciparum
KIVLKNKGEMLLQNSSTMDKNV

SEQ ID NO: 3362020 - protein, 22 aa, Plasmodium falciparum
KIWGNLEIKKGALLMMTGGVQK

SEQ ID NO: 3362021 - protein, 17 aa, Plasmodium falciparum
KIWKEWISKIINSVEEW

SEQ ID NO: 3362022 - protein, 17 aa, Plasmodium falciparum
KIWNILIHIEIFYGDIR

SEQ ID NO: 3362023 - protein, 25 aa, Plasmodium falciparum
KIYEHLNGFVFFDFINGIKEHIQKQ

SEQ ID NO: 3362024 - protein, 20 aa, Plasmodium falciparum
KIYHYSFMLNFFNGQENQEM

SEQ ID NO: 3362025 - protein, 25 aa, Plasmodium falciparum
KIYKKNRWIKYGILGEVKIRSLHFI

SEQ ID NO: 3362026 - protein, 25 aa, Plasmodium falciparum
KIYKSAIILPYFDDWIKSIKKNKSN

SEQ ID NO: 3362027 - protein, 20 aa, Plasmodium falciparum
KIYLSIYMNILYKCYNILQL

SEQ ID NO: 3362028 - protein, 21 aa, Plasmodium falciparum
KIYMFDFSKKFLRDQNIFNNV

SEQ ID NO: 3362029 - protein, 17 aa, Plasmodium falciparum
KIYRGMGSMEAMYNKGF

SEQ ID NO: 3362030 - protein, 17 aa, Plasmodium falciparum
KIYRILRKKREAFIELL

SEQ ID NO: 3362031 - protein, 31 aa, Plasmodium falciparum
KIYSDYEFKSFSSLLAQWNVNKCSIKKAKDK

SEQ ID NO: 3362032 - protein, 29 aa, Plasmodium falciparum
KIYTKIDLLEIYLGHNWGEDGDRFNFVLS

SEQ ID NO: 3362033 - protein, 27 aa, Plasmodium falciparum
KIYTLEYCLRYTLLKELNDDIIHNYIN

SEQ ID NO: 3362034 - protein, 34 aa, Plasmodium falciparum
KIYYLCFFNNFFSYRTLYEYKYIYIYNSKGKKEL

SEQ ID NO: 3362035 - protein, 20 aa, Plasmodium falciparum
KKADIIISELLGSFGDNELF

SEQ ID NO: 3362036 - protein, 21 aa, Plasmodium falciparum
KKADLPVKVFNYGKLLKRWRY

SEQ ID NO: 3362037 - protein, 30 aa, Plasmodium falciparum
KKAETFDVPPYCELAPLIVLTKNCQLSTFE

SEQ ID NO: 3362038 - protein, 18 aa, Plasmodium falciparum
KKAFFNFITPGSLIKQAC

SEQ ID NO: 3362039 - protein, 17 aa, Plasmodium falciparum
KKAHCYKIINNGKPSLF

SEQ ID NO: 3362040 - protein, 20 aa, Plasmodium falciparum
KKAIEEFGLKSLPYIKSSLS

SEQ ID NO: 3362041 - protein, 17 aa, Plasmodium falciparum
KKAIEYVDIITPNQYET

SEQ ID NO: 3362042 - protein, 21 aa, Plasmodium falciparum
KKAITCLVFSFSEDKIISSSI

SEQ ID NO: 3362043 - protein, 33 aa, Plasmodium falciparum
KKAKEFLDNLKIKNRRMQVIYGNYKKNSNMNNV

SEQ ID NO: 3362044 - protein, 17 aa, Plasmodium falciparum
KKAKILTIFVGGNHEAM

SEQ ID NO: 3362045 - protein, 27 aa, Plasmodium falciparum
KKALKCNEFLKLLGIHTKVADVFLQHE

SEQ ID NO: 3362046 - protein, 18 aa, Plasmodium falciparum
KKALPKSKALPILLKKNI

SEQ ID NO: 3362047 - protein, 18 aa, Plasmodium falciparum
KKANEIVEKVILTIKNET

SEQ ID NO: 3362048 - protein, 20 aa, Plasmodium falciparum
KKAQHKLSINDKVIQAGLFN

SEQ ID NO: 3362049 - protein, 17 aa, Plasmodium falciparum
KKAVLYFDEDIVFDECN

SEQ ID NO: 3362050 - protein, 20 aa, Plasmodium falciparum
KKAYELKKEDLELDVIIVDI

SEQ ID NO: 3362051 - protein, 19 aa, Plasmodium falciparum
KKAYPLAKYAIMKSGGNFP

SEQ ID NO: 3362052 - protein, 20 aa, Plasmodium falciparum
KKAYRKLAIIHHPDKGGDPE

SEQ ID NO: 3362053 - protein, 21 aa, Plasmodium falciparum
KKCCIKLKNNIILDENDCINE

SEQ ID NO: 3362054 - protein, 21 aa, Plasmodium falciparum
KKCHSSDIFLIRDNILNNLSN

SEQ ID NO: 3362055 - protein, 25 aa, Plasmodium falciparum
KKCIYGESILSSFFLVYTGLLNYED

SEQ ID NO: 3362056 - protein, 17 aa, Plasmodium falciparum
KKCKELFLKDIQSNNRP

SEQ ID NO: 3362057 - protein, 26 aa, Plasmodium falciparum
KKCKKIFYIYFVEGNVQEFIQDINEE

SEQ ID NO: 3362058 - protein, 23 aa, Plasmodium falciparum
KKCMKRKNIEVQEQVNLHEKNGK

SEQ ID NO: 3362059 - protein, 19 aa, Plasmodium falciparum
KKCMKRYVRIKEILKRSRK

SEQ ID NO: 3362060 - protein, 17 aa, Plasmodium falciparum
KKCRPILIINLLKVELL

SEQ ID NO: 3362061 - protein, 22 aa, Plasmodium falciparum
KKCRRLGIFSIDIKFRRIMRVE

SEQ ID NO: 3362062 - protein, 23 aa, Plasmodium falciparum
KKDAEYVFSQKFFQDIYSNIKSK

SEQ ID NO: 3362063 - protein, 20 aa, Plasmodium falciparum
KKDARFFINDEIGSNDYMYD

SEQ ID NO: 3362064 - protein, 22 aa, Plasmodium falciparum
KKDARMKSKMNYPPKHDMNNPM

SEQ ID NO: 3362065 - protein, 24 aa, Plasmodium falciparum
KKDCFKEIVELCTKLWENDISTEF

SEQ ID NO: 3362066 - protein, 19 aa, Plasmodium falciparum
KKDDCCSLDIGGTLIKVVY

SEQ ID NO: 3362067 - protein, 21 aa, Plasmodium falciparum
KKDEGKFIFCTRTVAEMEKSL

SEQ ID NO: 3362068 - protein, 25 aa, Plasmodium falciparum
KKDELYKYDMIENLSNKNMKYVNDI

SEQ ID NO: 3362069 - protein, 22 aa, Plasmodium falciparum
KKDEVYIISALVDRSVSKNLSF

SEQ ID NO: 3362070 - protein, 19 aa, Plasmodium falciparum
KKDGMDCDMLVRDSSKRVN

SEQ ID NO: 3362071 - protein, 18 aa, Plasmodium falciparum
KKDIFEKYEHYLRRKKKA

SEQ ID NO: 3362072 - protein, 26 aa, Plasmodium falciparum
KKDILYSIIYPYKFRLSNLNCIINIF

SEQ ID NO: 3362073 - protein, 18 aa, Plasmodium falciparum
KKDISFNKNIFYPEEGNY

SEQ ID NO: 3362074 - protein, 32 aa, Plasmodium falciparum
KKDKDILKQIILDPFGNYVIQRALSVASEPEL

SEQ ID NO: 3362075 - protein, 21 aa, Plasmodium falciparum
KKDLEECGFDCDLAAKLRNDI

SEQ ID NO: 3362076 - protein, 17 aa, Plasmodium falciparum
KKDLLLKGYEKVNNEII

SEQ ID NO: 3362077 - protein, 18 aa, Plasmodium falciparum
KKDLVGYWLLSQNNEKDM

SEQ ID NO: 3362078 - protein, 57 aa, Plasmodium falciparum
KKDNRKRRKPKYRFEKDKDGNICDFFMVCSSELKGIKKCRNVGLDLQMINVTDIQLT

SEQ ID NO: 3362079 - protein, 24 aa, Plasmodium falciparum
KKDSEIYMLKELIKEKEKTILYND

SEQ ID NO: 3362080 - protein, 32 aa, Plasmodium falciparum
KKDSFYFKGRFFKIIPNEGWSEIKELSKNYIK

SEQ ID NO: 3362081 - protein, 19 aa, Plasmodium falciparum
KKDSIKVVHRNSGKTINNN

SEQ ID NO: 3362082 - protein, 23 aa, Plasmodium falciparum
KKDTIKFNISYNLNGNKKNDHTY

SEQ ID NO: 3362083 - protein, 19 aa, Plasmodium falciparum
KKDVLSFISTYALIPSSKK

SEQ ID NO: 3362084 - protein, 25 aa, Plasmodium falciparum
KKDWPKGYIRKGCAEHGLRQLSNAE

SEQ ID NO: 3362085 - protein, 18 aa, Plasmodium falciparum
KKDYGIMIFSDIRYAKHD

SEQ ID NO: 3362086 - protein, 24 aa, Plasmodium falciparum
KKDYHDLFDTFGFNTNEEKDQKED

SEQ ID NO: 3362087 - protein, 18 aa, Plasmodium falciparum
KKEAAINIAIEISESEKK

SEQ ID NO: 3362088 - protein, 30 aa, Plasmodium falciparum
KKEARNKIIKSFCKKQEELLNFSIKKLKSN

SEQ ID NO: 3362089 - protein, 25 aa, Plasmodium falciparum
KKECESVYSFLKEKGLLVLMYHADL

SEQ ID NO: 3362090 - protein, 20 aa, Plasmodium falciparum
KKEDCLNAYFEMDNVVIDDR

SEQ ID NO: 3362091 - protein, 21 aa, Plasmodium falciparum
KKEDFSFLLFLSVLDSLKNIK

SEQ ID NO: 3362092 - protein, 18 aa, Plasmodium falciparum
KKEECIDDSYSLSLILII

SEQ ID NO: 3362093 - protein, 23 aa, Plasmodium falciparum
KKEEKAHICICSMLRNENIHKVL

SEQ ID NO: 3362094 - protein, 26 aa, Plasmodium falciparum
KKEEKKMPPLSHMFDSIVKIKKQVDS

SEQ ID NO: 3362095 - protein, 24 aa, Plasmodium falciparum
KKEENKVLIATSVMARGIDIKNII

SEQ ID NO: 3362096 - protein, 18 aa, Plasmodium falciparum
KKEFLYDLIKPGVYTIED

SEQ ID NO: 3362097 - protein, 34 aa, Plasmodium falciparum
KKEGIDIGYKYCIKIRTNSFIFYLSKELNKFPHI

SEQ ID NO: 3362098 - protein, 21 aa, Plasmodium falciparum
KKEGRKLHTNNLINNMGTINK

SEQ ID NO: 3362099 - protein, 20 aa, Plasmodium falciparum
KKEHDFAAAYIAQYKLKKKK

SEQ ID NO: 3362100 - protein, 19 aa, Plasmodium falciparum
KKEHLKRNISQQMKQMPYS

SEQ ID NO: 3362101 - protein, 19 aa, Plasmodium falciparum
KKEHSFPYVHNDMNIDQNY

SEQ ID NO: 3362102 - protein, 26 aa, Plasmodium falciparum
KKEIDLCKLYMYDMNALEILDKNLDI

SEQ ID NO: 3362103 - protein, 19 aa, Plasmodium falciparum
KKEIEIINSPIGIKFKDIF

SEQ ID NO: 3362104 - protein, 17 aa, Plasmodium falciparum
KKEIIICRVFLQFLQIL

SEQ ID NO: 3362105 - protein, 22 aa, Plasmodium falciparum
KKEIINSMRLYHEYKKNQIYFL

SEQ ID NO: 3362106 - protein, 24 aa, Plasmodium falciparum
KKEIKRIILCSGQVYYDLLNYRYT

SEQ ID NO: 3362107 - protein, 21 aa, Plasmodium falciparum
KKEILEILKMHGYIEKENNTD

SEQ ID NO: 3362108 - protein, 25 aa, Plasmodium falciparum
KKEINNFRLSDYVSKDKSIFGNRLK

SEQ ID NO: 3362109 - protein, 19 aa, Plasmodium falciparum
KKEIQHIIGKGGIKKIKLF

SEQ ID NO: 3362110 - protein, 22 aa, Plasmodium falciparum
KKEIYRRALLIVWAKLKSVVEV

SEQ ID NO: 3362111 - protein, 21 aa, Plasmodium falciparum
KKEKIKLEKQFSFDSKDSDDN

SEQ ID NO: 3362112 - protein, 20 aa, Plasmodium falciparum
KKEKINLLSKFKAYTLNNKK

SEQ ID NO: 3362113 - protein, 18 aa, Plasmodium falciparum
KKEKKKKQEVFKDIMCSD

SEQ ID NO: 3362114 - protein, 22 aa, Plasmodium falciparum
KKEKKLFLQNIFTLKKKSLNKN

SEQ ID NO: 3362115 - protein, 22 aa, Plasmodium falciparum
KKEKLKYVVDLEDIIKKNFQEI

SEQ ID NO: 3362116 - protein, 25 aa, Plasmodium falciparum
KKEKRDVVNLLSFRYIEKELEKKLF

SEQ ID NO: 3362117 - protein, 26 aa, Plasmodium falciparum
KKEKYIECIELITNIMIFRYIQYTYK

SEQ ID NO: 3362118 - protein, 28 aa, Plasmodium falciparum
KKEKYILRNICKIIPFDCICKPHISPFI

SEQ ID NO: 3362119 - protein, 20 aa, Plasmodium falciparum
KKEKYLKCFNNWYKNNFLKG

SEQ ID NO: 3362120 - protein, 26 aa, Plasmodium falciparum
KKEKYLRFSTYESWKLHDSEDDMNII

SEQ ID NO: 3362121 - protein, 33 aa, Plasmodium falciparum
KKELKNNLFRCIKCYKSVHRKCMNQLKNNDNND

SEQ ID NO: 3362122 - protein, 20 aa, Plasmodium falciparum
KKELKTEGKILYSEYDSKVA

SEQ ID NO: 3362123 - protein, 20 aa, Plasmodium falciparum
KKELLTTLCYTNPYKTGNLM

SEQ ID NO: 3362124 - protein, 17 aa, Plasmodium falciparum
KKELRELYYKLENEQKE

SEQ ID NO: 3362125 - protein, 19 aa, Plasmodium falciparum
KKELVSVNVLPFWHKYIFD

SEQ ID NO: 3362126 - protein, 22 aa, Plasmodium falciparum
KKEMRFKKFVKEAIKKIKDARH

SEQ ID NO: 3362127 - protein, 18 aa, Plasmodium falciparum
KKENEIFNNNFLSIKGED

SEQ ID NO: 3362128 - protein, 20 aa, Plasmodium falciparum
KKENGFLDKFFTGVTKNQAV

SEQ ID NO: 3362129 - protein, 22 aa, Plasmodium falciparum
KKENRFKKFGARRREKKNMQRE

SEQ ID NO: 3362130 - protein, 19 aa, Plasmodium falciparum
KKEPCLLFGAPQATEEAAD

SEQ ID NO: 3362131 - protein, 20 aa, Plasmodium falciparum
KKEPRLFIYELMKKYKVTHV

SEQ ID NO: 3362132 - protein, 24 aa, Plasmodium falciparum
KKEQVIFFKQCDNFSTDMNYNLLL

SEQ ID NO: 3362133 - protein, 18 aa, Plasmodium falciparum
KKERRKKLLNKIRLYITR

SEQ ID NO: 3362134 - protein, 17 aa, Plasmodium falciparum
KKERSFNYISFDFIYGD

SEQ ID NO: 3362135 - protein, 21 aa, Plasmodium falciparum
KKESIKDFVLNLFKQRNVKND

SEQ ID NO: 3362136 - protein, 22 aa, Plasmodium falciparum
KKEVEKFLNYFLLYKNNNPSNI

SEQ ID NO: 3362137 - protein, 22 aa, Plasmodium falciparum
KKEVPLPFDTKALIFNQNKKEL

SEQ ID NO: 3362138 - protein, 26 aa, Plasmodium falciparum
KKEYKEAYEIFRKCIDSNIYDLKLFL

SEQ ID NO: 3362139 - protein, 18 aa, Plasmodium falciparum
KKEYKNNILLTYIDDICI

SEQ ID NO: 3362140 - protein, 27 aa, Plasmodium falciparum
KKEYLVLMFTCNICEKKSAKKFSKQAY

SEQ ID NO: 3362141 - protein, 18 aa, Plasmodium falciparum
KKEYSLYDKNVCMNKNCD

SEQ ID NO: 3362142 - protein, 24 aa, Plasmodium falciparum
KKEYVESFKSISLINKDKKDKGIY

SEQ ID NO: 3362143 - protein, 23 aa, Plasmodium falciparum
KKFIKNSGAHIVSYIPEYDLFSN

SEQ ID NO: 3362144 - protein, 26 aa, Plasmodium falciparum
KKFLHLSEYYPYFYSLQNIKLSLFSL

SEQ ID NO: 3362145 - protein, 39 aa, Plasmodium falciparum
KKFNYKYTDYWKKKVHFKCCKLQRAYNIFIIIIFSIVKE

SEQ ID NO: 3362146 - protein, 18 aa, Plasmodium falciparum
KKFPEVDDLIMVKVNRIE

SEQ ID NO: 3362147 - protein, 17 aa, Plasmodium falciparum
KKFPLFVSDTMIKDIHY

SEQ ID NO: 3362148 - protein, 19 aa, Plasmodium falciparum
KKFSDEFVLHKNIGSEDKD

SEQ ID NO: 3362149 - protein, 17 aa, Plasmodium falciparum
KKFSDKHEILIPLEGYD

SEQ ID NO: 3362150 - protein, 33 aa, Plasmodium falciparum
KKFSIEELGFYEAREKAIYCRKTFEKVNVHDDY

SEQ ID NO: 3362151 - protein, 18 aa, Plasmodium falciparum
KKFSPLLFIFRRDEENEI

SEQ ID NO: 3362152 - protein, 42 aa, Plasmodium falciparum
KKFSYELNKRIFLNGSVIKISFAPNGFFCLILTSRTLYLCNF

SEQ ID NO: 3362153 - protein, 27 aa, Plasmodium falciparum
KKFTQNDWKCVIAVILNSKESIKYIFK

SEQ ID NO: 3362154 - protein, 17 aa, Plasmodium falciparum
KKFWNHLGFVIIPQETA

SEQ ID NO: 3362155 - protein, 22 aa, Plasmodium falciparum
KKFYDKRFIFYLNEKDNEKNKC

SEQ ID NO: 3362156 - protein, 26 aa, Plasmodium falciparum
KKFYETPHSFHFLFMMEKKYNYMFKN

SEQ ID NO: 3362157 - protein, 22 aa, Plasmodium falciparum
KKGEKSINFLVRPVSNVEKPIN

SEQ ID NO: 3362158 - protein, 23 aa, Plasmodium falciparum
KKGEVDITLFPKMARQLKQVYDI

SEQ ID NO: 3362159 - protein, 24 aa, Plasmodium falciparum
KKGEVKLADFGLCTKYGYDMYSDK

SEQ ID NO: 3362160 - protein, 22 aa, Plasmodium falciparum
KKGGEAIMSLLGLSKNVDTKLE

SEQ ID NO: 3362161 - protein, 24 aa, Plasmodium falciparum
KKGINSFMLINFIYILTLTNNKLE

SEQ ID NO: 3362162 - protein, 21 aa, Plasmodium falciparum
KKGIRCLSTIYSDLFEELKDR

SEQ ID NO: 3362163 - protein, 21 aa, Plasmodium falciparum
KKGISKVLICTDLLSRGIDVP

SEQ ID NO: 3362164 - protein, 31 aa, Plasmodium falciparum
KKGKETKNGHTYCYSYFLWEEVNYQYVNPFG

SEQ ID NO: 3362165 - protein, 18 aa, Plasmodium falciparum
KKGKNENFQNFVLEEIAT

SEQ ID NO: 3362166 - protein, 20 aa, Plasmodium falciparum
KKGKSILFFSYDYYMPQKLK

SEQ ID NO: 3362167 - protein, 23 aa, Plasmodium falciparum
KKGKWAKNVLIIWDDRQMREIAK

SEQ ID NO: 3362168 - protein, 25 aa, Plasmodium falciparum
KKGLLKFDLLGSLLRCSGYNLSLKE

SEQ ID NO: 3362169 - protein, 19 aa, Plasmodium falciparum
KKGPPAFMKGPPKNVKGAL

SEQ ID NO: 3362170 - protein, 25 aa, Plasmodium falciparum
KKGSCNTYYCPFIHGLAETRVPGTY

SEQ ID NO: 3362171 - protein, 18 aa, Plasmodium falciparum
KKGYLILKLKYTNENNII

SEQ ID NO: 3362172 - protein, 22 aa, Plasmodium falciparum
KKGYNFPFSMFGIGTGNKSATS

SEQ ID NO: 3362173 - protein, 24 aa, Plasmodium falciparum
KKHDDIFSNFCYKRDESETGVQGN

SEQ ID NO: 3362174 - protein, 19 aa, Plasmodium falciparum
KKHDNNICFNNTNNYPNNI

SEQ ID NO: 3362175 - protein, 20 aa, Plasmodium falciparum
KKHEPSTCFKNPKTYINIRL

SEQ ID NO: 3362176 - protein, 25 aa, Plasmodium falciparum
KKHESKILPFLLDLNSTNGTYINNE

SEQ ID NO: 3362177 - protein, 21 aa, Plasmodium falciparum
KKHFEFFLYYFIQKSNDTVKR

SEQ ID NO: 3362178 - protein, 24 aa, Plasmodium falciparum
KKHFGYKNLKDFQVEAVHATFHKK

SEQ ID NO: 3362179 - protein, 29 aa, Plasmodium falciparum
KKHFKVLSHSCLKYLSNREKMKIKKQEEE

SEQ ID NO: 3362180 - protein, 19 aa, Plasmodium falciparum
KKHHRFSKHILPLNNNPHY

SEQ ID NO: 3362181 - protein, 24 aa, Plasmodium falciparum
KKHIDIGSTLLLKNVTIFDTIDNF

SEQ ID NO: 3362182 - protein, 21 aa, Plasmodium falciparum
KKHIFSINIFDNYYVKNLIKV

SEQ ID NO: 3362183 - protein, 25 aa, Plasmodium falciparum
KKHIYKNYNNALVFLKKQIYKTNWL

SEQ ID NO: 3362184 - protein, 18 aa, Plasmodium falciparum
KKHNSTFDSLEKLDMLLK

SEQ ID NO: 3362185 - protein, 17 aa, Plasmodium falciparum
KKHPMNILLNLNNKEKK

SEQ ID NO: 3362186 - protein, 21 aa, Plasmodium falciparum
KKHVINKIWSILTGKQNLNTA

SEQ ID NO: 3362187 - protein, 17 aa, Plasmodium falciparum
KKHVNILSLVISNNNLC

SEQ ID NO: 3362188 - protein, 17 aa, Plasmodium falciparum
KKIAEYIYELKLIEAQN

SEQ ID NO: 3362189 - protein, 21 aa, Plasmodium falciparum
KKIDISDDIWLNEKKNNSPII

SEQ ID NO: 3362190 - protein, 19 aa, Plasmodium falciparum
KKIDLSNYVNYTFIDFLFD

SEQ ID NO: 3362191 - protein, 18 aa, Plasmodium falciparum
KKIEEKYIPMNRKSTSLK

SEQ ID NO: 3362192 - protein, 24 aa, Plasmodium falciparum
KKIEELNSLFLMWGTSENPNEPFP

SEQ ID NO: 3362193 - protein, 22 aa, Plasmodium falciparum
KKIEKANAFTLLKDNDYIYHKP

SEQ ID NO: 3362194 - protein, 18 aa, Plasmodium falciparum
KKIESFEILNQCFNDSNN

SEQ ID NO: 3362195 - protein, 30 aa, Plasmodium falciparum
KKIFFFGIIDIFTKWSIKKKFEHTFRTIQK

SEQ ID NO: 3362196 - protein, 26 aa, Plasmodium falciparum
KKIFKKLKYKNTVVISNIGKKCGSST

SEQ ID NO: 3362197 - protein, 18 aa, Plasmodium falciparum
KKIGIFKVSIIKPQLFIP

SEQ ID NO: 3362198 - protein, 18 aa, Plasmodium falciparum
KKIGPRILITGNNNSGKS

SEQ ID NO: 3362199 - protein, 18 aa, Plasmodium falciparum
KKIHEMICIIRTYLRYKK

SEQ ID NO: 3362200 - protein, 20 aa, Plasmodium falciparum
KKIHYASHIHKWCSKTYQIR

SEQ ID NO: 3362201 - protein, 25 aa, Plasmodium falciparum
KKIIKLPLERESCYYYGNYINGLKH

SEQ ID NO: 3362202 - protein, 22 aa, Plasmodium falciparum
KKIINLFSLSNMFTCVKLPKDD

SEQ ID NO: 3362203 - protein, 21 aa, Plasmodium falciparum
KKIIPNFERHTVSSFIKNLSA

SEQ ID NO: 3362204 - protein, 17 aa, Plasmodium falciparum
KKIIVPIEIKKSTNKFI

SEQ ID NO: 3362205 - protein, 21 aa, Plasmodium falciparum
KKIKDVFLHHGTILINLEKNI

SEQ ID NO: 3362206 - protein, 19 aa, Plasmodium falciparum
KKIKELDEGLALDIKENLN

SEQ ID NO: 3362207 - protein, 31 aa, Plasmodium falciparum
KKIKKEDICLARIFLKKGIREENELKKIFEK

SEQ ID NO: 3362208 - protein, 27 aa, Plasmodium falciparum
KKIKKKKKSAFLKDHYFKENVNVTNDD

SEQ ID NO: 3362209 - protein, 24 aa, Plasmodium falciparum
KKIKLEINGCIKIKRKGAHEEYYN

SEQ ID NO: 3362210 - protein, 27 aa, Plasmodium falciparum
KKIKLFFKPHMEQFYNFSLLCKIDSKE

SEQ ID NO: 3362211 - protein, 19 aa, Plasmodium falciparum
KKIKMIILDIERKLIQNKE

SEQ ID NO: 3362212 - protein, 22 aa, Plasmodium falciparum
KKIKNIPIFLSIELSKTKHLIR

SEQ ID NO: 3362213 - protein, 19 aa, Plasmodium falciparum
KKIKNKYIPNKNHMNKYNN

SEQ ID NO: 3362214 - protein, 19 aa, Plasmodium falciparum
KKIKRKKKKIFENKRSSKK

SEQ ID NO: 3362215 - protein, 17 aa, Plasmodium falciparum
KKIKRRHIYRKRRRRGP

SEQ ID NO: 3362216 - protein, 25 aa, Plasmodium falciparum
KKIKRWLLQIIMAIKFIHDKKLIHR

SEQ ID NO: 3362217 - protein, 22 aa, Plasmodium falciparum
KKIKSELECFITSFNNLKKLKM

SEQ ID NO: 3362218 - protein, 20 aa, Plasmodium falciparum
KKIKSIEINYNFEKQKKNII

SEQ ID NO: 3362219 - protein, 24 aa, Plasmodium falciparum
KKIKSNMSKICFNKSNKLNADFKD

SEQ ID NO: 3362220 - protein, 23 aa, Plasmodium falciparum
KKIKTPFFNALKAYAERPIGVFH

SEQ ID NO: 3362221 - protein, 35 aa, Plasmodium falciparum
KKIKYSFYKPFSITYFRYFFSHFHFIKHITKDEIK

SEQ ID NO: 3362222 - protein, 19 aa, Plasmodium falciparum
KKILEVYLIEITNFAKYQK

SEQ ID NO: 3362223 - protein, 24 aa, Plasmodium falciparum
KKILIKKYLNEIALKKKNHVMNSI

SEQ ID NO: 3362224 - protein, 22 aa, Plasmodium falciparum
KKILKKKIYTHLINNKKKNNLN

SEQ ID NO: 3362225 - protein, 35 aa, Plasmodium falciparum
KKILNNFLCVELLPLFKKNLENLLLSSAQNWLMVY

SEQ ID NO: 3362226 - protein, 17 aa, Plasmodium falciparum
KKILSLFESGKKLQMIK

SEQ ID NO: 3362227 - protein, 25 aa, Plasmodium falciparum
KKIMKNIFIALDFFHSNNIIHRDIK

SEQ ID NO: 3362228 - protein, 19 aa, Plasmodium falciparum
KKINFPISSTVGYPIYSNK

SEQ ID NO: 3362229 - protein, 20 aa, Plasmodium falciparum
KKINIFKINLNKFFSSSFIN

SEQ ID NO: 3362230 - protein, 19 aa, Plasmodium falciparum
KKINIKIGDLASHNSGNFD

SEQ ID NO: 3362231 - protein, 27 aa, Plasmodium falciparum
KKINIKTFIKRDINLYSKMEETKNLIF

SEQ ID NO: 3362232 - protein, 21 aa, Plasmodium falciparum
KKINKGNCNYVNYNNNLEPYK

SEQ ID NO: 3362233 - protein, 19 aa, Plasmodium falciparum
KKINMISGISTFEKKKENQ

SEQ ID NO: 3362234 - protein, 19 aa, Plasmodium falciparum
KKINTCYSLLYEFLSKDKQ

SEQ ID NO: 3362235 - protein, 17 aa, Plasmodium falciparum
KKIPFTHTLTFSLIYYN

SEQ ID NO: 3362236 - protein, 22 aa, Plasmodium falciparum
KKIPIDINMYINREELKSGFDY

SEQ ID NO: 3362237 - protein, 18 aa, Plasmodium falciparum
KKIPITFIEKTQVYFDDL

SEQ ID NO: 3362238 - protein, 17 aa, Plasmodium falciparum
KKIQYYENMFKRMEQQV

SEQ ID NO: 3362239 - protein, 23 aa, Plasmodium falciparum
KKIRKEEMSILGFNSDRCVPASL

SEQ ID NO: 3362240 - protein, 20 aa, Plasmodium falciparum
KKISEKDILYNEYIINELFN

SEQ ID NO: 3362241 - protein, 21 aa, Plasmodium falciparum
KKISFKSSLFKKDENKKTNYI

SEQ ID NO: 3362242 - protein, 18 aa, Plasmodium falciparum
KKISFLYEIKKGYADKSY

SEQ ID NO: 3362243 - protein, 26 aa, Plasmodium falciparum
KKISKIIDCIGIIYDLLEDVVENGIL

SEQ ID NO: 3362244 - protein, 17 aa, Plasmodium falciparum
KKISKLVSLKDFKKKNI

SEQ ID NO: 3362245 - protein, 25 aa, Plasmodium falciparum
KKISLFLELFLKYSKKLNLNIEIEP

SEQ ID NO: 3362246 - protein, 17 aa, Plasmodium falciparum
KKITHYCELEFESLWKE

SEQ ID NO: 3362247 - protein, 24 aa, Plasmodium falciparum
KKITHYKNVCNMYIKNNGKISTCI

SEQ ID NO: 3362248 - protein, 21 aa, Plasmodium falciparum
KKIVFNNLCFIVRKFYSSPVI

SEQ ID NO: 3362249 - protein, 21 aa, Plasmodium falciparum
KKIVFPKNRVNKFSTSVRSLL

SEQ ID NO: 3362250 - protein, 19 aa, Plasmodium falciparum
KKIVIKKKRKIRFHQNLSD

SEQ ID NO: 3362251 - protein, 19 aa, Plasmodium falciparum
KKIVNCYDVDIQISNKMLF

SEQ ID NO: 3362252 - protein, 25 aa, Plasmodium falciparum
KKIWKKCPICFEIINENDLRIVKFH

SEQ ID NO: 3362253 - protein, 23 aa, Plasmodium falciparum
KKIWKTPFGNKSIYKNARERVQS

SEQ ID NO: 3362254 - protein, 26 aa, Plasmodium falciparum
KKIYEMLKCLSVGLVPQTWKKLYASK

SEQ ID NO: 3362255 - protein, 46 aa, Plasmodium falciparum
KKIYRTKNPWKNYCFKILHKLKKKEIACWFLKPVNPELDGIPNYFN

SEQ ID NO: 3362256 - protein, 23 aa, Plasmodium falciparum
KKIYTCHTCNIQIYNYSFFRYHF

SEQ ID NO: 3362257 - protein, 19 aa, Plasmodium falciparum
KKKAMPWIQSEVSIYEACM

SEQ ID NO: 3362258 - protein, 20 aa, Plasmodium falciparum
KKKAYKYLINKFLNDKQNHL

SEQ ID NO: 3362259 - protein, 24 aa, Plasmodium falciparum
KKKCDEIYHLKTLLEKEEMNNKQL

SEQ ID NO: 3362260 - protein, 20 aa, Plasmodium falciparum
KKKCDSCYYCFSNECNLTYC

SEQ ID NO: 3362261 - protein, 33 aa, Plasmodium falciparum
KKKCFIVLGCGCYRIGSSVEFDWSAIHCVKTIR

SEQ ID NO: 3362262 - protein, 19 aa, Plasmodium falciparum
KKKCGMCNDIKNCLNYKHI

SEQ ID NO: 3362263 - protein, 18 aa, Plasmodium falciparum
KKKCIEMYIKTFLKLYKY

SEQ ID NO: 3362264 - protein, 23 aa, Plasmodium falciparum
KKKCKKDLFNIREITLDNLKDIN

SEQ ID NO: 3362265 - protein, 22 aa, Plasmodium falciparum
KKKCKKIVKSILYNRKRSHYYI

SEQ ID NO: 3362266 - protein, 27 aa, Plasmodium falciparum
KKKDTLLFLLRFNKWKGASYNYTTNLK

SEQ ID NO: 3362267 - protein, 18 aa, Plasmodium falciparum
KKKEEILNEFFFCPFKDL

SEQ ID NO: 3362268 - protein, 22 aa, Plasmodium falciparum
KKKEGIGVLVITCKKMEKVKMK

SEQ ID NO: 3362269 - protein, 26 aa, Plasmodium falciparum
KKKEIINIIHFSYFLITRIFLYEKKA

SEQ ID NO: 3362270 - protein, 18 aa, Plasmodium falciparum
KKKEKKCHYDHNDDNSLE

SEQ ID NO: 3362271 - protein, 19 aa, Plasmodium falciparum
KKKEKKCVILLGDNIIRIL

SEQ ID NO: 3362272 - protein, 17 aa, Plasmodium falciparum
KKKEKKSIISIINLNDF

SEQ ID NO: 3362273 - protein, 22 aa, Plasmodium falciparum
KKKEKLSVSSIYEGSNNEKNQN

SEQ ID NO: 3362274 - protein, 30 aa, Plasmodium falciparum
KKKELLKNKNFFINPCRIYIRNYPAVLEQN

SEQ ID NO: 3362275 - protein, 20 aa, Plasmodium falciparum
KKKEQIIKKKVIQRNNEIFK

SEQ ID NO: 3362276 - protein, 25 aa, Plasmodium falciparum
KKKERELKKALSLKRRKKYTNIIDI

SEQ ID NO: 3362277 - protein, 17 aa, Plasmodium falciparum
KKKERHIKDEQNKDKYG

SEQ ID NO: 3362278 - protein, 21 aa, Plasmodium falciparum
KKKESLNSFDVELKEYSSKLQ

SEQ ID NO: 3362279 - protein, 30 aa, Plasmodium falciparum
KKKETCNLCIKSKIKLFLDEINFINNSLDI

SEQ ID NO: 3362280 - protein, 23 aa, Plasmodium falciparum
KKKFCKELVTYAWKGYEEADLVL

SEQ ID NO: 3362281 - protein, 25 aa, Plasmodium falciparum
KKKFFKNFNFCLSRSARTDQGVHAL

SEQ ID NO: 3362282 - protein, 18 aa, Plasmodium falciparum
KKKFLFKKKQLMNDTDEN

SEQ ID NO: 3362283 - protein, 20 aa, Plasmodium falciparum
KKKFRVQEMFKTVITSKNDD

SEQ ID NO: 3362284 - protein, 19 aa, Plasmodium falciparum
KKKFVGRNYYLDKNMNDEE

SEQ ID NO: 3362285 - protein, 42 aa, Plasmodium falciparum
KKKGSKCDSETLLPIANISRIMKRILPGSAKVAKESKDIIRE

SEQ ID NO: 3362286 - protein, 21 aa, Plasmodium falciparum
KKKHERNQTNQMCPQLNVTTQ

SEQ ID NO: 3362287 - protein, 20 aa, Plasmodium falciparum
KKKHFIDIINHFVQTNRNTK

SEQ ID NO: 3362288 - protein, 19 aa, Plasmodium falciparum
KKKHPMFFNNIHTMNEYDN

SEQ ID NO: 3362289 - protein, 25 aa, Plasmodium falciparum
KKKIKEIITPAGYKLPENLIIKEGD

SEQ ID NO: 3362290 - protein, 18 aa, Plasmodium falciparum
KKKINIFYHDNKSLKNIS

SEQ ID NO: 3362291 - protein, 19 aa, Plasmodium falciparum
KKKIPEVINNNGKEKKSIL

SEQ ID NO: 3362292 - protein, 24 aa, Plasmodium falciparum
KKKISYDIFYHLVLTKQIQGTTNL

SEQ ID NO: 3362293 - protein, 19 aa, Plasmodium falciparum
KKKIVDIINDYKIVFKTLQ

SEQ ID NO: 3362294 - protein, 18 aa, Plasmodium falciparum
KKKIVFYIYVLNKFNNRW

SEQ ID NO: 3362295 - protein, 18 aa, Plasmodium falciparum
KKKIVVFRNVFSYEDAMK

SEQ ID NO: 3362296 - protein, 19 aa, Plasmodium falciparum
KKKIWKSENIVVSCFYYKD

SEQ ID NO: 3362297 - protein, 18 aa, Plasmodium falciparum
KKKKCLITNYIPLFHTHI

SEQ ID NO: 3362298 - protein, 24 aa, Plasmodium falciparum
KKKKDFLINIATNFRKNKPKKNSE

SEQ ID NO: 3362299 - protein, 22 aa, Plasmodium falciparum
KKKKELFLLKINDIANKNYKDT

SEQ ID NO: 3362300 - protein, 25 aa, Plasmodium falciparum
KKKKESFLKWTPHKNIKRSYNKKNY

SEQ ID NO: 3362301 - protein, 21 aa, Plasmodium falciparum
KKKKFNFIESFSYNNNQEDKK

SEQ ID NO: 3362302 - protein, 19 aa, Plasmodium falciparum
KKKKGLIQISKKKKKKKKE

SEQ ID NO: 3362303 - protein, 19 aa, Plasmodium falciparum
KKKKILIKYINQLFEKHVL

SEQ ID NO: 3362304 - protein, 20 aa, Plasmodium falciparum
KKKKIPAKFMDPKKEKVSSK

SEQ ID NO: 3362305 - protein, 27 aa, Plasmodium falciparum
KKKKIQKDCFLFWLIMVKNKKEARNKI

SEQ ID NO: 3362306 - protein, 20 aa, Plasmodium falciparum
KKKKIRFPIRRIPPNEYYPN

SEQ ID NO: 3362307 - protein, 19 aa, Plasmodium falciparum
KKKKIRINNDIYLKNLPTN

SEQ ID NO: 3362308 - protein, 22 aa, Plasmodium falciparum
KKKKIWLNIGCINYMDNFVGKG

SEQ ID NO: 3362309 - protein, 21 aa, Plasmodium falciparum
KKKKIYFIVMNNFFSSIVEIH

SEQ ID NO: 3362310 - protein, 22 aa, Plasmodium falciparum
KKKKIYRPSIHIYNKNLFFIFY

SEQ ID NO: 3362311 - protein, 17 aa, Plasmodium falciparum
KKKKKEMINLYSNKSNI

SEQ ID NO: 3362312 - protein, 26 aa, Plasmodium falciparum
KKKKKFVFEKCFIFNNVIRGSYTYDS

SEQ ID NO: 3362313 - protein, 25 aa, Plasmodium falciparum
KKKKKFYLCYDIEWLAIVKANHHLI

SEQ ID NO: 3362314 - protein, 30 aa, Plasmodium falciparum
KKKKKIKKRIKKIFEFAQIFKKMSQKKKEN

SEQ ID NO: 3362315 - protein, 20 aa, Plasmodium falciparum
KKKKKKAIKLLEKEKRDKII

SEQ ID NO: 3362316 - protein, 21 aa, Plasmodium falciparum
KKKKKKCIINNNYIKEYKGDE

SEQ ID NO: 3362317 - protein, 25 aa, Plasmodium falciparum
KKKKKKFFFCSTFLYDNIKSNMFPN

SEQ ID NO: 3362318 - protein, 17 aa, Plasmodium falciparum
KKKKKKGLIQISKKKKK

SEQ ID NO: 3362319 - protein, 20 aa, Plasmodium falciparum
KKKKKLILPGHIKIKKLSAC

SEQ ID NO: 3362320 - protein, 17 aa, Plasmodium falciparum
KKKKKLLIHPIHLLNYV

SEQ ID NO: 3362321 - protein, 17 aa, Plasmodium falciparum
KKKKKNYFVARSIFNIR

SEQ ID NO: 3362322 - protein, 20 aa, Plasmodium falciparum
KKKKKRKINHNISDNMNYYL

SEQ ID NO: 3362323 - protein, 24 aa, Plasmodium falciparum
KKKKKRLDLIVSDNWKKIAEPDEA

SEQ ID NO: 3362324 - protein, 21 aa, Plasmodium falciparum
KKKKKTFLNRNYVTFNVEVNN

SEQ ID NO: 3362325 - protein, 26 aa, Plasmodium falciparum
KKKKKWLHKMKKWYFENNMEKKKNNK

SEQ ID NO: 3362326 - protein, 26 aa, Plasmodium falciparum
KKKKLCAKGKWILKILQLYETSLVRH

SEQ ID NO: 3362327 - protein, 25 aa, Plasmodium falciparum
KKKKLGKTMIFFCTKYHILFFSNIL

SEQ ID NO: 3362328 - protein, 21 aa, Plasmodium falciparum
KKKKNCYEDMFHFKHHQNILN

SEQ ID NO: 3362329 - protein, 23 aa, Plasmodium falciparum
KKKKNGFIYLVKWKGYSDDENTW

SEQ ID NO: 3362330 - protein, 23 aa, Plasmodium falciparum
KKKKNIFFEYDFKEMNDIINFSM

SEQ ID NO: 3362331 - protein, 20 aa, Plasmodium falciparum
KKKKNLGVCYLNLNNLSCQF

SEQ ID NO: 3362332 - protein, 20 aa, Plasmodium falciparum
KKKKNVKCTNLLSNSQNEKK

SEQ ID NO: 3362333 - protein, 19 aa, Plasmodium falciparum
KKKKRSVSWESTRSSSHEG

SEQ ID NO: 3362334 - protein, 22 aa, Plasmodium falciparum
KKKKVSLKKCFFIVFDEVDKLF

SEQ ID NO: 3362335 - protein, 22 aa, Plasmodium falciparum
KKKKYKKVILPNGKEHKINLNI

SEQ ID NO: 3362336 - protein, 23 aa, Plasmodium falciparum
KKKKYTFFSVAFETGVIYNNKVL

SEQ ID NO: 3362337 - protein, 23 aa, Plasmodium falciparum
KKKLCKLKNIKNIFMPKKKNSCL

SEQ ID NO: 3362338 - protein, 24 aa, Plasmodium falciparum
KKKLEIHYAECFKNENLLYPIHTC

SEQ ID NO: 3362339 - protein, 23 aa, Plasmodium falciparum
KKKLFLKKRLFNIIHKKRANDIK

SEQ ID NO: 3362340 - protein, 19 aa, Plasmodium falciparum
KKKLFPITTTFWVYAIKSY

SEQ ID NO: 3362341 - protein, 24 aa, Plasmodium falciparum
KKKLKKKMMKEIMIGVLNSDVNKF

SEQ ID NO: 3362342 - protein, 18 aa, Plasmodium falciparum
KKKLLFFLYLFSKNYYHL

SEQ ID NO: 3362343 - protein, 18 aa, Plasmodium falciparum
KKKLLFFYFYQDLKNPNY

SEQ ID NO: 3362344 - protein, 24 aa, Plasmodium falciparum
KKKLLKKKIMKYIHKCKVKYGLKI

SEQ ID NO: 3362345 - protein, 25 aa, Plasmodium falciparum
KKKLMNIRMMYPFTLKCNKCKTFTY

SEQ ID NO: 3362346 - protein, 18 aa, Plasmodium falciparum
KKKLPAWSAKKNFLKLLK

SEQ ID NO: 3362347 - protein, 22 aa, Plasmodium falciparum
KKKMCKSYKTSIILLNTKEKNK

SEQ ID NO: 3362348 - protein, 17 aa, Plasmodium falciparum
KKKMHIFDCKNVLDFCD

SEQ ID NO: 3362349 - protein, 20 aa, Plasmodium falciparum
KKKMKISIRFKKPKTLIYAR

SEQ ID NO: 3362350 - protein, 19 aa, Plasmodium falciparum
KKKMRANINACLSGSNNNI

SEQ ID NO: 3362351 - protein, 20 aa, Plasmodium falciparum
KKKMVLAPWCEDIATEEEIK

SEQ ID NO: 3362352 - protein, 29 aa, Plasmodium falciparum
KKKNDFLKQLDICKMNWKSFENSYSNSEQ

SEQ ID NO: 3362353 - protein, 25 aa, Plasmodium falciparum
KKKNDLDMYGCNEILKGENEIGMDP

SEQ ID NO: 3362354 - protein, 25 aa, Plasmodium falciparum
KKKNEKYACEWVVFIKTSVEEIKNK

SEQ ID NO: 3362355 - protein, 20 aa, Plasmodium falciparum
KKKNFLISINKLHSIYLECI

SEQ ID NO: 3362356 - protein, 19 aa, Plasmodium falciparum
KKKNGIKEVTRKCLNLIDI

SEQ ID NO: 3362357 - protein, 23 aa, Plasmodium falciparum
KKKNGSIVQWIFDNHLYEQMKYQ

SEQ ID NO: 3362358 - protein, 25 aa, Plasmodium falciparum
KKKNHIYCRCLKISIISSQHNGKDT

SEQ ID NO: 3362359 - protein, 19 aa, Plasmodium falciparum
KKKNIDMVYKIKEYEIQIK

SEQ ID NO: 3362360 - protein, 20 aa, Plasmodium falciparum
KKKNINFLINKNFTSHISSS

SEQ ID NO: 3362361 - protein, 21 aa, Plasmodium falciparum
KKKNIYIPLTIASRKTVAYPI

SEQ ID NO: 3362362 - protein, 20 aa, Plasmodium falciparum
KKKNKIRFTFARTDRKNNFC

SEQ ID NO: 3362363 - protein, 20 aa, Plasmodium falciparum
KKKNLKDICYKASNESLDLL

SEQ ID NO: 3362364 - protein, 24 aa, Plasmodium falciparum
KKKNLKKLCIYISDSELSQPPNQI

SEQ ID NO: 3362365 - protein, 19 aa, Plasmodium falciparum
KKKNMKSLLSKKDDNYWTK

SEQ ID NO: 3362366 - protein, 23 aa, Plasmodium falciparum
KKKNMNDLFLGKHDNMLRTDEIP

SEQ ID NO: 3362367 - protein, 20 aa, Plasmodium falciparum
KKKNRIINLMNEFLEKVQII

SEQ ID NO: 3362368 - protein, 45 aa, Plasmodium falciparum
KKKNTQCFYILGCKEFKVIDFFTIYRLDMTTFQWEKINITYNRLL

SEQ ID NO: 3362369 - protein, 18 aa, Plasmodium falciparum
KKKNVLFFNPKIIKCGKY

SEQ ID NO: 3362370 - protein, 20 aa, Plasmodium falciparum
KKKNYFVARSIFNIRNVNGK

SEQ ID NO: 3362371 - protein, 19 aa, Plasmodium falciparum
KKKNYMKMIIKSIDETEAP

SEQ ID NO: 3362372 - protein, 20 aa, Plasmodium falciparum
KKKPSTYILKDDDMKIIHDT

SEQ ID NO: 3362373 - protein, 17 aa, Plasmodium falciparum
KKKQCSFNGNNKKEKLF

SEQ ID NO: 3362374 - protein, 24 aa, Plasmodium falciparum
KKKQEGNCSISYNNIQFVETNRLR

SEQ ID NO: 3362375 - protein, 18 aa, Plasmodium falciparum
KKKQVNCLAYVYEVELKK

SEQ ID NO: 3362376 - protein, 23 aa, Plasmodium falciparum
KKKQYREYLGYNIIYIKKKVLLL

SEQ ID NO: 3362377 - protein, 26 aa, Plasmodium falciparum
KKKRDFFFDVSFSFEGMKNNLIKREE

SEQ ID NO: 3362378 - protein, 26 aa, Plasmodium falciparum
KKKREFLKNIKLKFSTYKILKCIYEN

SEQ ID NO: 3362379 - protein, 22 aa, Plasmodium falciparum
KKKRGRKKKILSVDGIGEIANN

SEQ ID NO: 3362380 - protein, 20 aa, Plasmodium falciparum
KKKRIIKARDYFSICSVHED

SEQ ID NO: 3362381 - protein, 31 aa, Plasmodium falciparum
KKKRKENLMIYKKCFFFINAIDEYCNMCNIP

SEQ ID NO: 3362382 - protein, 19 aa, Plasmodium falciparum
KKKRKLCYEKNINETFDMG

SEQ ID NO: 3362383 - protein, 18 aa, Plasmodium falciparum
KKKRKLFARIDMAQKRQK

SEQ ID NO: 3362384 - protein, 20 aa, Plasmodium falciparum
KKKRVSISINDNFNSTNVKR

SEQ ID NO: 3362385 - protein, 17 aa, Plasmodium falciparum
KKKSFGIHMSLSPNNNH

SEQ ID NO: 3362386 - protein, 20 aa, Plasmodium falciparum
KKKSNKMSCIERKKNEEEKR

SEQ ID NO: 3362387 - protein, 17 aa, Plasmodium falciparum
KKKSVIFQLKNLFNDVS

SEQ ID NO: 3362388 - protein, 17 aa, Plasmodium falciparum
KKKSVLIKSIIHKHYSE

SEQ ID NO: 3362389 - protein, 18 aa, Plasmodium falciparum
KKKSYDFVGTMNYDNNDC

SEQ ID NO: 3362390 - protein, 20 aa, Plasmodium falciparum
KKKSYPEFFSTNTNNFGLIS

SEQ ID NO: 3362391 - protein, 18 aa, Plasmodium falciparum
KKKTEFSKTYVLKKNIIT

SEQ ID NO: 3362392 - protein, 18 aa, Plasmodium falciparum
KKKTFLVNQAVFFTPKKS

SEQ ID NO: 3362393 - protein, 21 aa, Plasmodium falciparum
KKKTFVQWLMDERKRRLKNNL

SEQ ID NO: 3362394 - protein, 20 aa, Plasmodium falciparum
KKKTITHFFSYNMENQKGKT

SEQ ID NO: 3362395 - protein, 24 aa, Plasmodium falciparum
KKKTVYINMEFFKKAKGKYGSNNN

SEQ ID NO: 3362396 - protein, 18 aa, Plasmodium falciparum
KKKVAVKIQYPGVYESID

SEQ ID NO: 3362397 - protein, 22 aa, Plasmodium falciparum
KKKVEIYEHGIGGITQNKNDNN

SEQ ID NO: 3362398 - protein, 25 aa, Plasmodium falciparum
KKKVEPKYVCLKVMKNGKQFLDQGL

SEQ ID NO: 3362399 - protein, 17 aa, Plasmodium falciparum
KKKVRFVKKNKMKNNFR

SEQ ID NO: 3362400 - protein, 18 aa, Plasmodium falciparum
KKKVVCISACIPGQTKYW

SEQ ID NO: 3362401 - protein, 19 aa, Plasmodium falciparum
KKKYANICTNIYNNYDQKG

SEQ ID NO: 3362402 - protein, 19 aa, Plasmodium falciparum
KKKYCYKQSFPEEKKRNNS

SEQ ID NO: 3362403 - protein, 18 aa, Plasmodium falciparum
KKKYEMFSKSGIFENYGF

SEQ ID NO: 3362404 - protein, 25 aa, Plasmodium falciparum
KKKYILKKIENALKIWENDYNMLKD

SEQ ID NO: 3362405 - protein, 22 aa, Plasmodium falciparum
KKKYIYEMFKNVKSIFENNIMK

SEQ ID NO: 3362406 - protein, 24 aa, Plasmodium falciparum
KKKYKKLLIYYLLYNNYLKLSASN

SEQ ID NO: 3362407 - protein, 19 aa, Plasmodium falciparum
KKKYLKCNQLNMIPLHKKK

SEQ ID NO: 3362408 - protein, 20 aa, Plasmodium falciparum
KKLAELKDDCDVRIREMNEK

SEQ ID NO: 3362409 - protein, 17 aa, Plasmodium falciparum
KKLCLFPLNPIYANILL

SEQ ID NO: 3362410 - protein, 30 aa, Plasmodium falciparum
KKLDLFRMPIILILHLKRFNNTNRWLRTKI

SEQ ID NO: 3362411 - protein, 32 aa, Plasmodium falciparum
KKLEEYKENVDIHWQLKWMNGVDNNVYGPYNY

SEQ ID NO: 3362412 - protein, 17 aa, Plasmodium falciparum
KKLEHELSHCYEENQKL

SEQ ID NO: 3362413 - protein, 21 aa, Plasmodium falciparum
KKLEKEIEVHVGKRRGRKRQT

SEQ ID NO: 3362414 - protein, 24 aa, Plasmodium falciparum
KKLETLYKLLGFEIILEDDKIVIE

SEQ ID NO: 3362415 - protein, 23 aa, Plasmodium falciparum
KKLFECKGDKYGYIGNINSIEVG

SEQ ID NO: 3362416 - protein, 17 aa, Plasmodium falciparum
KKLFLNADILKEILYGG

SEQ ID NO: 3362417 - protein, 17 aa, Plasmodium falciparum
KKLGEGVYGKVFKAESL

SEQ ID NO: 3362418 - protein, 19 aa, Plasmodium falciparum
KKLHIIRIMLEAIYFIAHY

SEQ ID NO: 3362419 - protein, 30 aa, Plasmodium falciparum
KKLIFYFPQFLKTWLKIMAHGTQENEKINS

SEQ ID NO: 3362420 - protein, 21 aa, Plasmodium falciparum
KKLIHVKREYIFKINKLKKLL

SEQ ID NO: 3362421 - protein, 26 aa, Plasmodium falciparum
KKLIKCVIIKNFIIFDVELWNIFLKK

SEQ ID NO: 3362422 - protein, 18 aa, Plasmodium falciparum
KKLIPYKHVVSAVRNGDI

SEQ ID NO: 3362423 - protein, 23 aa, Plasmodium falciparum
KKLKEEYEVLNYEELMNLKTKTF

SEQ ID NO: 3362424 - protein, 21 aa, Plasmodium falciparum
KKLKEFTIILEERYRNEKNVS

SEQ ID NO: 3362425 - protein, 23 aa, Plasmodium falciparum
KKLKMKNEEIISIYKTREKELIE

SEQ ID NO: 3362426 - protein, 26 aa, Plasmodium falciparum
KKLKPMVYVPYWWYNEIAFCENNLDE

SEQ ID NO: 3362427 - protein, 24 aa, Plasmodium falciparum
KKLKRSTDPLFLLTLEQKNKQLCI

SEQ ID NO: 3362428 - protein, 20 aa, Plasmodium falciparum
KKLLFNDLIYELGYILKNIN

SEQ ID NO: 3362429 - protein, 19 aa, Plasmodium falciparum
KKLLKEFQQQIELKNKQKE

SEQ ID NO: 3362430 - protein, 18 aa, Plasmodium falciparum
KKLMNILPLLKIEKPEEI

SEQ ID NO: 3362431 - protein, 20 aa, Plasmodium falciparum
KKLNLIKIVGLVLNIEEKKE

SEQ ID NO: 3362432 - protein, 20 aa, Plasmodium falciparum
KKLNNILNFSCKPNKINIHN

SEQ ID NO: 3362433 - protein, 21 aa, Plasmodium falciparum
KKLNRKYELFIKYLKEKGKIE

SEQ ID NO: 3362434 - protein, 21 aa, Plasmodium falciparum
KKLPFKTIYLHAMIRDSRGEK

SEQ ID NO: 3362435 - protein, 17 aa, Plasmodium falciparum
KKLPLFVTPKFIYDCIL

SEQ ID NO: 3362436 - protein, 29 aa, Plasmodium falciparum
KKLQKELKWYINECLRLDKISEYLKKEAD

SEQ ID NO: 3362437 - protein, 20 aa, Plasmodium falciparum
KKLQNLFINKTVYENQDQRD

SEQ ID NO: 3362438 - protein, 20 aa, Plasmodium falciparum
KKLRHSKILSVHKNSMTNLD

SEQ ID NO: 3362439 - protein, 17 aa, Plasmodium falciparum
KKLRKIINKDKRPDKYN

SEQ ID NO: 3362440 - protein, 21 aa, Plasmodium falciparum
KKLRRSSMSGSLKTYNSYNFK

SEQ ID NO: 3362441 - protein, 23 aa, Plasmodium falciparum
KKLSEKNKEFEIFKNEYKELKNK

SEQ ID NO: 3362442 - protein, 20 aa, Plasmodium falciparum
KKLSHNFIHTLNLCNENMFL

SEQ ID NO: 3362443 - protein, 26 aa, Plasmodium falciparum
KKLSMPKSDLVWCYYDINSKKENIVI

SEQ ID NO: 3362444 - protein, 19 aa, Plasmodium falciparum
KKLTCIKMNINMRELDEYS

SEQ ID NO: 3362445 - protein, 18 aa, Plasmodium falciparum
KKLTEEKIHLSTVENNNL

SEQ ID NO: 3362446 - protein, 18 aa, Plasmodium falciparum
KKLTIKNRIKIMCIITLD

SEQ ID NO: 3362447 - protein, 26 aa, Plasmodium falciparum
KKLTLSDLCSLFYSKLENNECKFRGF

SEQ ID NO: 3362448 - protein, 30 aa, Plasmodium falciparum
KKLTNNFILNFSINFYKFVISSLILCDEKK

SEQ ID NO: 3362449 - protein, 17 aa, Plasmodium falciparum
KKLTNVDTPECIEKLMS

SEQ ID NO: 3362450 - protein, 31 aa, Plasmodium falciparum
KKLVYVGPFNKFKGFNFCISSNKNNLEIVKG

SEQ ID NO: 3362451 - protein, 20 aa, Plasmodium falciparum
KKLWESPYVHRFQQKIKYHL

SEQ ID NO: 3362452 - protein, 17 aa, Plasmodium falciparum
KKLWKEKMTTLYNYDNT

SEQ ID NO: 3362453 - protein, 20 aa, Plasmodium falciparum
KKLYESIKRRFHFLYNIKLY

SEQ ID NO: 3362454 - protein, 17 aa, Plasmodium falciparum
KKLYSRKLLEQKNSYNL

SEQ ID NO: 3362455 - protein, 25 aa, Plasmodium falciparum
KKMCGKLFFEEICVFRINEKNEHGH

SEQ ID NO: 3362456 - protein, 26 aa, Plasmodium falciparum
KKMFIIEGGGDFLLFLNIYKQCEENN

SEQ ID NO: 3362457 - protein, 18 aa, Plasmodium falciparum
KKMIIPNFRLEKIRKQRN

SEQ ID NO: 3362458 - protein, 27 aa, Plasmodium falciparum
KKMKIHYPIYFGCGLTENANKYYKIYS

SEQ ID NO: 3362459 - protein, 19 aa, Plasmodium falciparum
KKMKYAFDVTSIDFENLYT

SEQ ID NO: 3362460 - protein, 20 aa, Plasmodium falciparum
KKMLNDIFCEIFKRENDMKP

SEQ ID NO: 3362461 - protein, 20 aa, Plasmodium falciparum
KKMNFKVLFLYKQLIPEKKE

SEQ ID NO: 3362462 - protein, 18 aa, Plasmodium falciparum
KKMQRYCENYKKDVLNKI

SEQ ID NO: 3362463 - protein, 18 aa, Plasmodium falciparum
KKMRKIRELNLLNNNVEY

SEQ ID NO: 3362464 - protein, 28 aa, Plasmodium falciparum
KKNADNIIPKWLYFVKGVIDCEDMPLNI

SEQ ID NO: 3362465 - protein, 21 aa, Plasmodium falciparum
KKNAGMYWSFYINKRKKIRKK

SEQ ID NO: 3362466 - protein, 21 aa, Plasmodium falciparum
KKNDDTFFFISHNEKDKNYLF

SEQ ID NO: 3362467 - protein, 25 aa, Plasmodium falciparum
KKNDFLLKRNIMLYRNFKNINNEIS

SEQ ID NO: 3362468 - protein, 17 aa, Plasmodium falciparum
KKNECDITNRENIYNSI

SEQ ID NO: 3362469 - protein, 22 aa, Plasmodium falciparum
KKNEHFGKYGKILNIIINKSQA

SEQ ID NO: 3362470 - protein, 18 aa, Plasmodium falciparum
KKNEILKAKRKCSYNNTF

SEQ ID NO: 3362471 - protein, 17 aa, Plasmodium falciparum
KKNFELFQHIKNGDSVD

SEQ ID NO: 3362472 - protein, 18 aa, Plasmodium falciparum
KKNFFNLENNNVPPIDHI

SEQ ID NO: 3362473 - protein, 29 aa, Plasmodium falciparum
KKNGKLYKFYPFYNELLLKYENDPNGKVE

SEQ ID NO: 3362474 - protein, 19 aa, Plasmodium falciparum
KKNHNVFDVISIVCEYVQY

SEQ ID NO: 3362475 - protein, 17 aa, Plasmodium falciparum
KKNHVGEHLNLLESEFQ

SEQ ID NO: 3362476 - protein, 21 aa, Plasmodium falciparum
KKNICPPCDDYVRAPDKHFSQ

SEQ ID NO: 3362477 - protein, 18 aa, Plasmodium falciparum
KKNIELIKSNKDDSTENS

SEQ ID NO: 3362478 - protein, 19 aa, Plasmodium falciparum
KKNIFNLFNTNALYTTLKK

SEQ ID NO: 3362479 - protein, 27 aa, Plasmodium falciparum
KKNIFSIKEMDEFKGLIKKFKTYNPEF

SEQ ID NO: 3362480 - protein, 20 aa, Plasmodium falciparum
KKNIFYFLLKNVDNVDLIKD

SEQ ID NO: 3362481 - protein, 24 aa, Plasmodium falciparum
KKNIKLLGTCILPDLKFDIDEINF

SEQ ID NO: 3362482 - protein, 19 aa, Plasmodium falciparum
KKNILRIFDKQRKQLLKEE

SEQ ID NO: 3362483 - protein, 29 aa, Plasmodium falciparum
KKNILWCINRKGQLLKWVKTKWDNIQYKG

SEQ ID NO: 3362484 - protein, 21 aa, Plasmodium falciparum
KKNILYDYAINYLVEKIQEKS

SEQ ID NO: 3362485 - protein, 34 aa, Plasmodium falciparum
KKNIYPKKSCPFGFICKYKHFFNKVKKHKMKRRT

SEQ ID NO: 3362486 - protein, 25 aa, Plasmodium falciparum
KKNKKEKRLCLSFLSSSSEEEALKS

SEQ ID NO: 3362487 - protein, 25 aa, Plasmodium falciparum
KKNKKFKNVQNCRSQYNNNNHCDKC

SEQ ID NO: 3362488 - protein, 32 aa, Plasmodium falciparum
KKNKKKIEELCCMKKSIDMLHVRSRSENFHCR

SEQ ID NO: 3362489 - protein, 20 aa, Plasmodium falciparum
KKNKLETFNYIKNIMQQLKH

SEQ ID NO: 3362490 - protein, 21 aa, Plasmodium falciparum
KKNKMLPCNNDIMSKNKSSHN

SEQ ID NO: 3362491 - protein, 20 aa, Plasmodium falciparum
KKNKNSVLFNCYHNEDEEEK

SEQ ID NO: 3362492 - protein, 28 aa, Plasmodium falciparum
KKNLFSLVVLDFLWKIYDITIINRDDEQ

SEQ ID NO: 3362493 - protein, 19 aa, Plasmodium falciparum
KKNLIGLLIENNFDEVFEP

SEQ ID NO: 3362494 - protein, 19 aa, Plasmodium falciparum
KKNLITFHCQDGFINNISI

SEQ ID NO: 3362495 - protein, 23 aa, Plasmodium falciparum
KKNLKRYIEILFHNKTIKNKRYE

SEQ ID NO: 3362496 - protein, 19 aa, Plasmodium falciparum
KKNLSFFMDTLKLEKIDML

SEQ ID NO: 3362497 - protein, 19 aa, Plasmodium falciparum
KKNLYEIVNILYTSNFDFS

SEQ ID NO: 3362498 - protein, 19 aa, Plasmodium falciparum
KKNMCNYITNFFFKDNKQE

SEQ ID NO: 3362499 - protein, 20 aa, Plasmodium falciparum
KKNMGAECMCRNDDNKNGDK

SEQ ID NO: 3362500 - protein, 20 aa, Plasmodium falciparum
KKNMKRSNSLDFKKLDSEKK

SEQ ID NO: 3362501 - protein, 23 aa, Plasmodium falciparum
KKNMVIKGFFKNVKFTKFYNFFN

SEQ ID NO: 3362502 - protein, 27 aa, Plasmodium falciparum
KKNMWTHKFHYIYPYVHFMGTKHKQNN

SEQ ID NO: 3362503 - protein, 28 aa, Plasmodium falciparum
KKNNGCGGGNYLKIRPPFVNETNASTRS

SEQ ID NO: 3362504 - protein, 20 aa, Plasmodium falciparum
KKNNIISMGFNIPKPIYSLL

SEQ ID NO: 3362505 - protein, 19 aa, Plasmodium falciparum
KKNNLDILMNLKILILDEA

SEQ ID NO: 3362506 - protein, 23 aa, Plasmodium falciparum
KKNNLFPYHSFYINHMNKNEIQY

SEQ ID NO: 3362507 - protein, 19 aa, Plasmodium falciparum
KKNNLHLARHSVGSKLTMF

SEQ ID NO: 3362508 - protein, 20 aa, Plasmodium falciparum
KKNNLKVILNVLLSNVYCFF

SEQ ID NO: 3362509 - protein, 19 aa, Plasmodium falciparum
KKNNYDIFTLGDIKKYAKN

SEQ ID NO: 3362510 - protein, 24 aa, Plasmodium falciparum
KKNPSLYICDIIKILDGSESLFFK

SEQ ID NO: 3362511 - protein, 23 aa, Plasmodium falciparum
KKNPYLLCWTYIYQEKPEFTVPL

SEQ ID NO: 3362512 - protein, 17 aa, Plasmodium falciparum
KKNRPLVGLNEFNEQFF

SEQ ID NO: 3362513 - protein, 32 aa, Plasmodium falciparum
KKNRYLFYLVLKGGAKIDIWDYLGKSPLYIAC

SEQ ID NO: 3362514 - protein, 18 aa, Plasmodium falciparum
KKNSCLLSNIITNNNTYI

SEQ ID NO: 3362515 - protein, 24 aa, Plasmodium falciparum
KKNSLWKSPCHELILKDIFCDHCS

SEQ ID NO: 3362516 - protein, 17 aa, Plasmodium falciparum
KKNSSKNAFLINKPLCS

SEQ ID NO: 3362517 - protein, 22 aa, Plasmodium falciparum
KKNSVFGDAWLLSLTGENPLRI

SEQ ID NO: 3362518 - protein, 20 aa, Plasmodium falciparum
KKNTLFLLPFCPKDVTNVKK

SEQ ID NO: 3362519 - protein, 19 aa, Plasmodium falciparum
KKNVEPFGEINVIKNTINY

SEQ ID NO: 3362520 - protein, 20 aa, Plasmodium falciparum
KKNVFLFVQCFLQVMSNKYD

SEQ ID NO: 3362521 - protein, 17 aa, Plasmodium falciparum
KKNVHDIVIVLNSVTKK

SEQ ID NO: 3362522 - protein, 29 aa, Plasmodium falciparum
KKNYEELRLKLNHLECVERDSVKINSEKE

SEQ ID NO: 3362523 - protein, 31 aa, Plasmodium falciparum
KKNYIIENICKCFHFHSLGLNGGLPEINVNK

SEQ ID NO: 3362524 - protein, 32 aa, Plasmodium falciparum
KKNYKNKISFLMSGKSLIPLNVRVPKGDSSEK

SEQ ID NO: 3362525 - protein, 20 aa, Plasmodium falciparum
KKNYLINRMNTLISGDGKKN

SEQ ID NO: 3362526 - protein, 18 aa, Plasmodium falciparum
KKNYNFEGTINCNFKNVL

SEQ ID NO: 3362527 - protein, 18 aa, Plasmodium falciparum
KKNYSYKITIDKEKKKII

SEQ ID NO: 3362528 - protein, 23 aa, Plasmodium falciparum
KKPEIKCNLCGDHGHITLDCKLA

SEQ ID NO: 3362529 - protein, 19 aa, Plasmodium falciparum
KKPFILCGPPGSGKTMTLT

SEQ ID NO: 3362530 - protein, 20 aa, Plasmodium falciparum
KKPFILCKKNIIAIHKDKYN

SEQ ID NO: 3362531 - protein, 24 aa, Plasmodium falciparum
KKPFPICLYNNIKSFENIKQCYRC

SEQ ID NO: 3362532 - protein, 19 aa, Plasmodium falciparum
KKPIIKKIENEEYITTSLV

SEQ ID NO: 3362533 - protein, 18 aa, Plasmodium falciparum
KKPIILSLHKFRTVDISI

SEQ ID NO: 3362534 - protein, 20 aa, Plasmodium falciparum
KKPIKFNIATCGADEFVHLW

SEQ ID NO: 3362535 - protein, 25 aa, Plasmodium falciparum
KKPNVNRSNVFVRMESIFYGQKAIK

SEQ ID NO: 3362536 - protein, 20 aa, Plasmodium falciparum
KKPVIPNMLNILNKEYGENK

SEQ ID NO: 3362537 - protein, 38 aa, Plasmodium falciparum
KKPYIFKIAALRDIRNLFPLNHNPFYAAFGNTESDHRA

SEQ ID NO: 3362538 - protein, 33 aa, Plasmodium falciparum
KKQEMIKEITLKIIRRCRIYSLKQLHTEKKNIN

SEQ ID NO: 3362539 - protein, 26 aa, Plasmodium falciparum
KKQESLDPLLKCINSLSDRINLQHLV

SEQ ID NO: 3362540 - protein, 22 aa, Plasmodium falciparum
KKQGYAIVSFASLYNAQKALQL

SEQ ID NO: 3362541 - protein, 18 aa, Plasmodium falciparum
KKQIEAFKSMVHNHDMNH

SEQ ID NO: 3362542 - protein, 19 aa, Plasmodium falciparum
KKQIIIILNKCDLLDNGII

SEQ ID NO: 3362543 - protein, 27 aa, Plasmodium falciparum
KKQIPHIKYKFKRYIDTPPEKKKVATK

SEQ ID NO: 3362544 - protein, 17 aa, Plasmodium falciparum
KKQIPQMLEINKNTKNE

SEQ ID NO: 3362545 - protein, 20 aa, Plasmodium falciparum
KKQISCYKLIENISDNMSSM

SEQ ID NO: 3362546 - protein, 20 aa, Plasmodium falciparum
KKQITFRPKVDIMYDADKCE

SEQ ID NO: 3362547 - protein, 17 aa, Plasmodium falciparum
KKQKKKFALSFLYEKDK

SEQ ID NO: 3362548 - protein, 17 aa, Plasmodium falciparum
KKQLLDNKIEYMKKNER

SEQ ID NO: 3362549 - protein, 25 aa, Plasmodium falciparum
KKQLLKLCSGPGCVTKSQDITRQDD

SEQ ID NO: 3362550 - protein, 19 aa, Plasmodium falciparum
KKQLLSATIKREVKENMEI

SEQ ID NO: 3362551 - protein, 19 aa, Plasmodium falciparum
KKQMDSLRHSNNYDEEENY

SEQ ID NO: 3362552 - protein, 21 aa, Plasmodium falciparum
KKQNMAICGDNLLKTRIKDTI

SEQ ID NO: 3362553 - protein, 20 aa, Plasmodium falciparum
KKQPSKFGWVAEIRSQMERS

SEQ ID NO: 3362554 - protein, 20 aa, Plasmodium falciparum
KKQQWLAAWNDNTREIRRYF

SEQ ID NO: 3362555 - protein, 18 aa, Plasmodium falciparum
KKQRKIFPVEPNEKDEAY

SEQ ID NO: 3362556 - protein, 17 aa, Plasmodium falciparum
KKQSVILNSLGNKNDDI

SEQ ID NO: 3362557 - protein, 19 aa, Plasmodium falciparum
KKREELLVIINIIKNFLNF

SEQ ID NO: 3362558 - protein, 18 aa, Plasmodium falciparum
KKREGLLKGEGKNIGINN

SEQ ID NO: 3362559 - protein, 25 aa, Plasmodium falciparum
KKRELRRKRFGVVNTDDALESRAKR

SEQ ID NO: 3362560 - protein, 22 aa, Plasmodium falciparum
KKRENWWPCVIKGDTEIDTKNI

SEQ ID NO: 3362561 - protein, 19 aa, Plasmodium falciparum
KKRFKELFIENQKLKEELN

SEQ ID NO: 3362562 - protein, 39 aa, Plasmodium falciparum
KKRGYKSNLIVCSALKSDKRCCPYKCLNASIRNTPIMHV

SEQ ID NO: 3362563 - protein, 25 aa, Plasmodium falciparum
KKRIFFEVYKKYYFIEMTEYHKSRE

SEQ ID NO: 3362564 - protein, 21 aa, Plasmodium falciparum
KKRINIIIINIFYKWLDLSVM

SEQ ID NO: 3362565 - protein, 24 aa, Plasmodium falciparum
KKRIPKIDFLVLININSDNYNNII

SEQ ID NO: 3362566 - protein, 22 aa, Plasmodium falciparum
KKRITSKILCCAITSGNYKIVN

SEQ ID NO: 3362567 - protein, 19 aa, Plasmodium falciparum
KKRIWCFRNNHEFMEEYMN

SEQ ID NO: 3362568 - protein, 18 aa, Plasmodium falciparum
KKRIYGDNIYPIVVKSEE

SEQ ID NO: 3362569 - protein, 20 aa, Plasmodium falciparum
KKRKGAILMGVCRGKISEGI

SEQ ID NO: 3362570 - protein, 17 aa, Plasmodium falciparum
KKRKGFNNFNNYEYLKE

SEQ ID NO: 3362571 - protein, 22 aa, Plasmodium falciparum
KKRKIRFFFKLYKRNDTHKKLR

SEQ ID NO: 3362572 - protein, 19 aa, Plasmodium falciparum
KKRKMLFMQKYYHKGGFYQ

SEQ ID NO: 3362573 - protein, 23 aa, Plasmodium falciparum
KKRKNKKKMVSFFDDINESMKRI

SEQ ID NO: 3362574 - protein, 24 aa, Plasmodium falciparum
KKRKRIDFIIKYFINAAKEINNIN

SEQ ID NO: 3362575 - protein, 26 aa, Plasmodium falciparum
KKRKRKRKFIHVRSIIEQKGGRRKCI

SEQ ID NO: 3362576 - protein, 24 aa, Plasmodium falciparum
KKRKRRKKHVILMERMKQKEREKR

SEQ ID NO: 3362577 - protein, 19 aa, Plasmodium falciparum
KKRKYTRKTGATATTNNTT

SEQ ID NO: 3362578 - protein, 26 aa, Plasmodium falciparum
KKRLLKMKNECTNILNVINNATLTKQ

SEQ ID NO: 3362579 - protein, 20 aa, Plasmodium falciparum
KKRLPKGSKRYVPTQEEVER

SEQ ID NO: 3362580 - protein, 18 aa, Plasmodium falciparum
KKRLPSYDRKHLKNKSKG

SEQ ID NO: 3362581 - protein, 19 aa, Plasmodium falciparum
KKRLTVFKSETSPLISYYK

SEQ ID NO: 3362582 - protein, 17 aa, Plasmodium falciparum
KKRMGLSTIPWIPTKEK

SEQ ID NO: 3362583 - protein, 31 aa, Plasmodium falciparum
KKRNLKPRGFMFLEGCYVELIAKNDNINKYG

SEQ ID NO: 3362584 - protein, 22 aa, Plasmodium falciparum
KKRNRVCPYLRTINRNLLDFDF

SEQ ID NO: 3362585 - protein, 17 aa, Plasmodium falciparum
KKRNSKYSIFKEKKKKE

SEQ ID NO: 3362586 - protein, 30 aa, Plasmodium falciparum
KKRNTNKLFTCKELFPKNKEYFILNKNESK

SEQ ID NO: 3362587 - protein, 19 aa, Plasmodium falciparum
KKRPYRREKELGNNIHQGD

SEQ ID NO: 3362588 - protein, 23 aa, Plasmodium falciparum
KKRRIKYEKAWETLKSVDGVLVP

SEQ ID NO: 3362589 - protein, 22 aa, Plasmodium falciparum
KKRSFPRFYFLSNKEILEILGM

SEQ ID NO: 3362590 - protein, 19 aa, Plasmodium falciparum
KKRSKDILCLEDIPYKDEI

SEQ ID NO: 3362591 - protein, 25 aa, Plasmodium falciparum
KKRSQYIEGEFRFRNAYTKNTNPRK

SEQ ID NO: 3362592 - protein, 18 aa, Plasmodium falciparum
KKRSVPLDQKSYVVNPNI

SEQ ID NO: 3362593 - protein, 25 aa, Plasmodium falciparum
KKRTHFSVIDFPGIIKDLDKKINNI

SEQ ID NO: 3362594 - protein, 27 aa, Plasmodium falciparum
KKRTPEFLDFLLFYILKKENIHFFEEE

SEQ ID NO: 3362595 - protein, 18 aa, Plasmodium falciparum
KKRVNGKINKEKFKKNII

SEQ ID NO: 3362596 - protein, 21 aa, Plasmodium falciparum
KKSEFCKWNVIIIGIDIRGCD

SEQ ID NO: 3362597 - protein, 18 aa, Plasmodium falciparum
KKSFFNISKRKGNKDHEH

SEQ ID NO: 3362598 - protein, 18 aa, Plasmodium falciparum
KKSFLYKSFYMRICECSN

SEQ ID NO: 3362599 - protein, 18 aa, Plasmodium falciparum
KKSHIILLKEDLHFLNDE

SEQ ID NO: 3362600 - protein, 20 aa, Plasmodium falciparum
KKSHISTSYLFNNLKSLGTF

SEQ ID NO: 3362601 - protein, 19 aa, Plasmodium falciparum
KKSHSNLQRGVRQKEYHDN

SEQ ID NO: 3362602 - protein, 27 aa, Plasmodium falciparum
KKSIEYLKFLLENTVIKSNEMLRINKN

SEQ ID NO: 3362603 - protein, 19 aa, Plasmodium falciparum
KKSIIICPRSTLDNWYEEI

SEQ ID NO: 3362604 - protein, 25 aa, Plasmodium falciparum
KKSILKRKELAISYINANDKSIEGI

SEQ ID NO: 3362605 - protein, 18 aa, Plasmodium falciparum
KKSILPSGYILKKYDAVH

SEQ ID NO: 3362606 - protein, 24 aa, Plasmodium falciparum
KKSINYKAYYKYSLYYDIQMNISS

SEQ ID NO: 3362607 - protein, 22 aa, Plasmodium falciparum
KKSIPLFFTYLLYINNIDMKNK

SEQ ID NO: 3362608 - protein, 19 aa, Plasmodium falciparum
KKSKEIFYLNEENMTKDEK

SEQ ID NO: 3362609 - protein, 20 aa, Plasmodium falciparum
KKSKLLFKVMKLQAENKDYP

SEQ ID NO: 3362610 - protein, 20 aa, Plasmodium falciparum
KKSKSIYIFYTYGGVNEKNE

SEQ ID NO: 3362611 - protein, 18 aa, Plasmodium falciparum
KKSLIPCWMGCMLSYIIF

SEQ ID NO: 3362612 - protein, 19 aa, Plasmodium falciparum
KKSLKDCVNTSYSSNIEQK

SEQ ID NO: 3362613 - protein, 20 aa, Plasmodium falciparum
KKSLKSFMWMSLEYKSILME

SEQ ID NO: 3362614 - protein, 23 aa, Plasmodium falciparum
KKSNHKINCIFMTQKNKKYIVKK

SEQ ID NO: 3362615 - protein, 17 aa, Plasmodium falciparum
KKSPFPIEGENTITNPS

SEQ ID NO: 3362616 - protein, 26 aa, Plasmodium falciparum
KKSRIFEIICLSNIFNDILKIHNYDI

SEQ ID NO: 3362617 - protein, 23 aa, Plasmodium falciparum
KKSSCDKFGEFIFILKEYKERID

SEQ ID NO: 3362618 - protein, 18 aa, Plasmodium falciparum
KKSSDILLNNSIINNVDN

SEQ ID NO: 3362619 - protein, 17 aa, Plasmodium falciparum
KKSSFLFNKNNFHMINK

SEQ ID NO: 3362620 - protein, 20 aa, Plasmodium falciparum
KKSSKVCCIYHKPKNFGESS

SEQ ID NO: 3362621 - protein, 21 aa, Plasmodium falciparum
KKSSSLFLYDIDNMKKILKNY

SEQ ID NO: 3362622 - protein, 17 aa, Plasmodium falciparum
KKSTFSFKKGLDNITSK

SEQ ID NO: 3362623 - protein, 20 aa, Plasmodium falciparum
KKSVEVYNDILLLLSDTIPI

SEQ ID NO: 3362624 - protein, 19 aa, Plasmodium falciparum
KKSVQFSHRSIAVFDDKEK

SEQ ID NO: 3362625 - protein, 17 aa, Plasmodium falciparum
KKSWKHIQNLSGGEKTL

SEQ ID NO: 3362626 - protein, 17 aa, Plasmodium falciparum
KKSWMIMIPPIKDRNNY

SEQ ID NO: 3362627 - protein, 30 aa, Plasmodium falciparum
KKSYELLRFLFDLYKNIYIKYLNGQDKEMV

SEQ ID NO: 3362628 - protein, 18 aa, Plasmodium falciparum
KKSYKFYTELKVDEESNL

SEQ ID NO: 3362629 - protein, 26 aa, Plasmodium falciparum
KKTCGKQKCKGECDCFQTRIEKKKTE

SEQ ID NO: 3362630 - protein, 27 aa, Plasmodium falciparum
KKTDVYWRLAFARRNINVLENVTQEDV

SEQ ID NO: 3362631 - protein, 35 aa, Plasmodium falciparum
KKTEKVKNAYDWDVDWRKKKSMGIMNSVMNTNNVM

SEQ ID NO: 3362632 - protein, 22 aa, Plasmodium falciparum
KKTESGIIYRDLIDGVYDTVEE

SEQ ID NO: 3362633 - protein, 19 aa, Plasmodium falciparum
KKTESLMDTILFNIHSCSE

SEQ ID NO: 3362634 - protein, 27 aa, Plasmodium falciparum
KKTEVNKSLLFVLEIFNKKRLDFKIHP

SEQ ID NO: 3362635 - protein, 26 aa, Plasmodium falciparum
KKTFMCLMYNIGIQIDYCLTLWGNFE

SEQ ID NO: 3362636 - protein, 22 aa, Plasmodium falciparum
KKTGNIKSILSLTNRINNDDNN

SEQ ID NO: 3362637 - protein, 18 aa, Plasmodium falciparum
KKTIFTEVLYLTSSSNIY

SEQ ID NO: 3362638 - protein, 21 aa, Plasmodium falciparum
KKTNHFFFNMYENISKENNGV

SEQ ID NO: 3362639 - protein, 20 aa, Plasmodium falciparum
KKTNIEIGLDFKKFKDVVLS

SEQ ID NO: 3362640 - protein, 19 aa, Plasmodium falciparum
KKTSGTYVVDEMENSERNI

SEQ ID NO: 3362641 - protein, 30 aa, Plasmodium falciparum
KKTTPCCTFGYYYFETFLFRNNKMIPKLKK

SEQ ID NO: 3362642 - protein, 29 aa, Plasmodium falciparum
KKTWTCSWHECCLCFRKSSQCGNLLIHCA

SEQ ID NO: 3362643 - protein, 20 aa, Plasmodium falciparum
KKTYIEWSSSKIFKNNESIQ

SEQ ID NO: 3362644 - protein, 27 aa, Plasmodium falciparum
KKTYIVHGMEIPEQIFNMYNTSKKKAK

SEQ ID NO: 3362645 - protein, 23 aa, Plasmodium falciparum
KKTYKLGNVLAQPEKFIRKKKNK

SEQ ID NO: 3362646 - protein, 25 aa, Plasmodium falciparum
KKTYRKLKKKLLQDEENFKNNETFV

SEQ ID NO: 3362647 - protein, 17 aa, Plasmodium falciparum
KKVESVLKFLQNYKNSY

SEQ ID NO: 3362648 - protein, 21 aa, Plasmodium falciparum
KKVEYSIFKKHLVDCKLNVNK

SEQ ID NO: 3362649 - protein, 22 aa, Plasmodium falciparum
KKVFVLIDCRVGLKTSDKELLH

SEQ ID NO: 3362650 - protein, 20 aa, Plasmodium falciparum
KKVILILWNELNCFNISDTL

SEQ ID NO: 3362651 - protein, 19 aa, Plasmodium falciparum
KKVIQRNNEIFKRNYNRPL

SEQ ID NO: 3362652 - protein, 21 aa, Plasmodium falciparum
KKVNFKFMNDRNMKRTGHENV

SEQ ID NO: 3362653 - protein, 33 aa, Plasmodium falciparum
KKVNFKFMNDRNMKRTGHENVINPLKEGYKNNE

SEQ ID NO: 3362654 - protein, 18 aa, Plasmodium falciparum
KKVPFVFFSALRELYHQN

SEQ ID NO: 3362655 - protein, 18 aa, Plasmodium falciparum
KKVPIFLENFQTAFHTTD

SEQ ID NO: 3362656 - protein, 20 aa, Plasmodium falciparum
KKVQHIFFQFVLKTLQRNNK

SEQ ID NO: 3362657 - protein, 20 aa, Plasmodium falciparum
KKVRIIILIHDCEYFNINIL

SEQ ID NO: 3362658 - protein, 21 aa, Plasmodium falciparum
KKVSMKIIHMLTHTFNENKQA

SEQ ID NO: 3362659 - protein, 19 aa, Plasmodium falciparum
KKVYQLVYDLCFSEKRENA

SEQ ID NO: 3362660 - protein, 23 aa, Plasmodium falciparum
KKWFDKLLEEILRKGAIEEDECI

SEQ ID NO: 3362661 - protein, 23 aa, Plasmodium falciparum
KKWHPDKLGIHISPDIKKRHNNH

SEQ ID NO: 3362662 - protein, 24 aa, Plasmodium falciparum
KKWITFKFGHQILRSITNLRKDIQ

SEQ ID NO: 3362663 - protein, 20 aa, Plasmodium falciparum
KKWKDIYLNNNIISLYFDLC

SEQ ID NO: 3362664 - protein, 18 aa, Plasmodium falciparum
KKWPEYTDVFWNTVCSEN

SEQ ID NO: 3362665 - protein, 27 aa, Plasmodium falciparum
KKYCMKLFYLIPCLKNNCPYYINDQVF

SEQ ID NO: 3362666 - protein, 20 aa, Plasmodium falciparum
KKYDELLKELNISREVNLRL

SEQ ID NO: 3362667 - protein, 19 aa, Plasmodium falciparum
KKYDLRKIIVSTNIAETSL

SEQ ID NO: 3362668 - protein, 19 aa, Plasmodium falciparum
KKYDQVMVSYNCKYDNKIY

SEQ ID NO: 3362669 - protein, 22 aa, Plasmodium falciparum
KKYEDKKLISIVYNRKKIKYDN

SEQ ID NO: 3362670 - protein, 21 aa, Plasmodium falciparum
KKYFNNINHFAYRNNSNITNN

SEQ ID NO: 3362671 - protein, 22 aa, Plasmodium falciparum
KKYGLLCTGTFKKFKINSDDNF

SEQ ID NO: 3362672 - protein, 26 aa, Plasmodium falciparum
KKYICMSDNGWGCMIRVIQMVLANIL

SEQ ID NO: 3362673 - protein, 19 aa, Plasmodium falciparum
KKYIIDIRIFIKKMYISSI

SEQ ID NO: 3362674 - protein, 28 aa, Plasmodium falciparum
KKYIIERFKQKECYLMNQVKRGKLILNN

SEQ ID NO: 3362675 - protein, 17 aa, Plasmodium falciparum
KKYIISNKILKHIDNID

SEQ ID NO: 3362676 - protein, 20 aa, Plasmodium falciparum
KKYIKLLTTYSCKNEDFTFI

SEQ ID NO: 3362677 - protein, 21 aa, Plasmodium falciparum
KKYILEYLALYILNKNIKSKI

SEQ ID NO: 3362678 - protein, 27 aa, Plasmodium falciparum
KKYIPMVWSFIMHKNIRIISARDTLIN

SEQ ID NO: 3362679 - protein, 26 aa, Plasmodium falciparum
KKYITCPLKSFILSFFLLSIMSRTNN

SEQ ID NO: 3362680 - protein, 22 aa, Plasmodium falciparum
KKYIYLKDICDLLNKSLLEGEN

SEQ ID NO: 3362681 - protein, 24 aa, Plasmodium falciparum
KKYKDMFINGAVVPYEYIWNQSIH

SEQ ID NO: 3362682 - protein, 19 aa, Plasmodium falciparum
KKYKELFVPTISVLDFKKK

SEQ ID NO: 3362683 - protein, 20 aa, Plasmodium falciparum
KKYKINLEVKKEKTKNHVIL

SEQ ID NO: 3362684 - protein, 22 aa, Plasmodium falciparum
KKYKKEFLKLGGITQLVNLLEL

SEQ ID NO: 3362685 - protein, 24 aa, Plasmodium falciparum
KKYKLILVNYFEWVNLSTVEEKKE

SEQ ID NO: 3362686 - protein, 17 aa, Plasmodium falciparum
KKYKLPFEPNFYSNRFF

SEQ ID NO: 3362687 - protein, 18 aa, Plasmodium falciparum
KKYKSCILQKNPYKFNEI

SEQ ID NO: 3362688 - protein, 25 aa, Plasmodium falciparum
KKYLKDVRLLYGFKGNHTCYFSITD

SEQ ID NO: 3362689 - protein, 22 aa, Plasmodium falciparum
KKYLKNVLKILDYVYYAKLNSS

SEQ ID NO: 3362690 - protein, 19 aa, Plasmodium falciparum
KKYLRNMKYVNLKRLKTIN

SEQ ID NO: 3362691 - protein, 25 aa, Plasmodium falciparum
KKYLSCGNFNFYVEYSINIVLTIIN

SEQ ID NO: 3362692 - protein, 18 aa, Plasmodium falciparum
KKYMNIAEIEFLKRRNFE

SEQ ID NO: 3362693 - protein, 17 aa, Plasmodium falciparum
KKYNCNMHILGNVNEIK

SEQ ID NO: 3362694 - protein, 20 aa, Plasmodium falciparum
KKYNFSYDIYKQVDLQNNLL

SEQ ID NO: 3362695 - protein, 19 aa, Plasmodium falciparum
KKYNIPRVDLDEYVINSFK

SEQ ID NO: 3362696 - protein, 24 aa, Plasmodium falciparum
KKYSCKLGFVSLFMYASTLALKKM

SEQ ID NO: 3362697 - protein, 17 aa, Plasmodium falciparum
KKYSLQCERQNTDNDHD

SEQ ID NO: 3362698 - protein, 18 aa, Plasmodium falciparum
KKYTCLHKEPYDEINKKN

SEQ ID NO: 3362699 - protein, 19 aa, Plasmodium falciparum
KKYTGELFIKMRKKSYQKN

SEQ ID NO: 3362700 - protein, 23 aa, Plasmodium falciparum
KKYTNMYYFRGLQKCDEDDMEYH

SEQ ID NO: 3362701 - protein, 22 aa, Plasmodium falciparum
KKYTYGLSHLWPVRDPRPVLEK

SEQ ID NO: 3362702 - protein, 18 aa, Plasmodium falciparum
KKYVQNVFIISSYLDCPD

SEQ ID NO: 3362703 - protein, 19 aa, Plasmodium falciparum
KKYWGCLISNVSLNNNKSI

SEQ ID NO: 3362704 - protein, 17 aa, Plasmodium falciparum
KKYYEKISRLWLKNFVK

SEQ ID NO: 3362705 - protein, 20 aa, Plasmodium falciparum
KLAGKCILLAGPSGSGKSAL

SEQ ID NO: 3362706 - protein, 42 aa, Plasmodium falciparum
KLAHEKNILCKRTGYLSCNLFLHKDHELMLLLINTIQKDLKS

SEQ ID NO: 3362707 - protein, 21 aa, Plasmodium falciparum
KLAKYYICVEKHPFKLPREYN

SEQ ID NO: 3362708 - protein, 27 aa, Plasmodium falciparum
KLAVHNGKELMCYLRKNKNITYALLHS

SEQ ID NO: 3362709 - protein, 17 aa, Plasmodium falciparum
KLCGAKILTYLLEKVRV

SEQ ID NO: 3362710 - protein, 17 aa, Plasmodium falciparum
KLCKTEEFCPYDLIIDD

SEQ ID NO: 3362711 - protein, 24 aa, Plasmodium falciparum
KLCKVKGQHLYEGKAGITNEIIIE

SEQ ID NO: 3362712 - protein, 22 aa, Plasmodium falciparum
KLCKVKKILLRKGRLSIAVTHD

SEQ ID NO: 3362713 - protein, 17 aa, Plasmodium falciparum
KLCSRNNIRDHVVAKKI

SEQ ID NO: 3362714 - protein, 29 aa, Plasmodium falciparum
KLDELKKKMEGGVKLPSSNELIKNKNTSE

SEQ ID NO: 3362715 - protein, 21 aa, Plasmodium falciparum
KLDILLTMIRICIFYNDVKNL

SEQ ID NO: 3362716 - protein, 23 aa, Plasmodium falciparum
KLDKWRQDMAIKRYKKKKEKENQ

SEQ ID NO: 3362717 - protein, 18 aa, Plasmodium falciparum
KLDLKKSCLTNEEKKEYF

SEQ ID NO: 3362718 - protein, 26 aa, Plasmodium falciparum
KLDLWKNFQYSLSMHKEKIISIYNNF

SEQ ID NO: 3362719 - protein, 18 aa, Plasmodium falciparum
KLDNICINMGNFNNSNTH

SEQ ID NO: 3362720 - protein, 25 aa, Plasmodium falciparum
KLDNWKVHFLYKIKSKLSVEPNVEL

SEQ ID NO: 3362721 - protein, 18 aa, Plasmodium falciparum
KLDPNYYKAVYRRIQANI

SEQ ID NO: 3362722 - protein, 20 aa, Plasmodium falciparum
KLDSEWKCYKNIKLYQEKKR

SEQ ID NO: 3362723 - protein, 28 aa, Plasmodium falciparum
KLDSLLLCSLRFYLNMFYLSTPRYFMFK

SEQ ID NO: 3362724 - protein, 20 aa, Plasmodium falciparum
KLDTLCDLYETLTITQSIIY

SEQ ID NO: 3362725 - protein, 19 aa, Plasmodium falciparum
KLEALKCSKYKQSFSPLEK

SEQ ID NO: 3362726 - protein, 23 aa, Plasmodium falciparum
KLEKLMEVYCNRLGQSMEAVRFL

SEQ ID NO: 3362727 - protein, 23 aa, Plasmodium falciparum
KLEKYKSTFTLEFNDLKNKYEKA

SEQ ID NO: 3362728 - protein, 19 aa, Plasmodium falciparum
KLENNGLCINKYILKSLNL

SEQ ID NO: 3362729 - protein, 24 aa, Plasmodium falciparum
KLERCFKFLRFLIKHKEKHLSLSE

SEQ ID NO: 3362730 - protein, 22 aa, Plasmodium falciparum
KLESLGFPKHVALEAFIACDKN

SEQ ID NO: 3362731 - protein, 19 aa, Plasmodium falciparum
KLEVFAWESYKRGENVHFN

SEQ ID NO: 3362732 - protein, 21 aa, Plasmodium falciparum
KLFCSTIKREPIRIEEEKRNK

SEQ ID NO: 3362733 - protein, 32 aa, Plasmodium falciparum
KLFDIRKFRELCIYKGNHTCPITKFLWLQNKI

SEQ ID NO: 3362734 - protein, 23 aa, Plasmodium falciparum
KLFKKHCKQCHSIAPDNSQTNSG

SEQ ID NO: 3362735 - protein, 19 aa, Plasmodium falciparum
KLFKRYMYKKNKRRPCQIN

SEQ ID NO: 3362736 - protein, 18 aa, Plasmodium falciparum
KLFNACKDFSELIQISSR

SEQ ID NO: 3362737 - protein, 20 aa, Plasmodium falciparum
KLFSICSNLMRKDNSELRKK

SEQ ID NO: 3362738 - protein, 26 aa, Plasmodium falciparum
KLFSQENIFLFGFYIKYRNILKLFSS

SEQ ID NO: 3362739 - protein, 20 aa, Plasmodium falciparum
KLFVSFPICLTYNINNYQFY

SEQ ID NO: 3362740 - protein, 23 aa, Plasmodium falciparum
KLFYDNRQIMCPYNKKKDIFNND

SEQ ID NO: 3362741 - protein, 19 aa, Plasmodium falciparum
KLFYSGICQFVKEAKDIKG

SEQ ID NO: 3362742 - protein, 23 aa, Plasmodium falciparum
KLGECPYDPGGYFIVKGTERVLL

SEQ ID NO: 3362743 - protein, 22 aa, Plasmodium falciparum
KLGKALSRKIYRVFSPNANPHH

SEQ ID NO: 3362744 - protein, 22 aa, Plasmodium falciparum
KLGRVKLKIKKIITNAQQEREY

SEQ ID NO: 3362745 - protein, 21 aa, Plasmodium falciparum
KLHAIEVHQFIPVPSLPKPRF

SEQ ID NO: 3362746 - protein, 25 aa, Plasmodium falciparum
KLHKVIGGKEGWILIQDFANDGTLW

SEQ ID NO: 3362747 - protein, 23 aa, Plasmodium falciparum
KLHLARIKNIFFTKITPESIGGL

SEQ ID NO: 3362748 - protein, 19 aa, Plasmodium falciparum
KLHLHCLNVTFQYQCNKIK

SEQ ID NO: 3362749 - protein, 23 aa, Plasmodium falciparum
KLHNLRKRFLYEINKYEYDSYNI

SEQ ID NO: 3362750 - protein, 22 aa, Plasmodium falciparum
KLHSVFKSFFNFSSLLFENIKP

SEQ ID NO: 3362751 - protein, 20 aa, Plasmodium falciparum
KLHYVETLTAYKFVLITHKN

SEQ ID NO: 3362752 - protein, 19 aa, Plasmodium falciparum
KLIDNIYMKYMNMKNELIK

SEQ ID NO: 3362753 - protein, 20 aa, Plasmodium falciparum
KLIEGYAIMSGRASQAMPTV

SEQ ID NO: 3362754 - protein, 24 aa, Plasmodium falciparum
KLIIKDLVGNFIIPYVDKKRGAEF

SEQ ID NO: 3362755 - protein, 18 aa, Plasmodium falciparum
KLIKEVKQDYIYKYYNND

SEQ ID NO: 3362756 - protein, 18 aa, Plasmodium falciparum
KLIKRLTLDISDNGSRIM

SEQ ID NO: 3362757 - protein, 17 aa, Plasmodium falciparum
KLIKYKKDVFKQLQTQK

SEQ ID NO: 3362758 - protein, 17 aa, Plasmodium falciparum
KLILAGLLDKYGKPNEK

SEQ ID NO: 3362759 - protein, 22 aa, Plasmodium falciparum
KLILQNCYLIFIPGKNDPCACK

SEQ ID NO: 3362760 - protein, 19 aa, Plasmodium falciparum
KLINCLKEPSLRCADQVYE

SEQ ID NO: 3362761 - protein, 21 aa, Plasmodium falciparum
KLINSQLFGGISLKKTYSIFR

SEQ ID NO: 3362762 - protein, 25 aa, Plasmodium falciparum
KLIRETSLWHINKFFDIFNFKKNFA

SEQ ID NO: 3362763 - protein, 19 aa, Plasmodium falciparum
KLIRKSLSHFKMTCKNNSF

SEQ ID NO: 3362764 - protein, 17 aa, Plasmodium falciparum
KLIRLNVICVKDKRDLF

SEQ ID NO: 3362765 - protein, 21 aa, Plasmodium falciparum
KLISELCLLYKKPFYVTCQAY

SEQ ID NO: 3362766 - protein, 20 aa, Plasmodium falciparum
KLIVKCLIMLHLEKLNDKIS

SEQ ID NO: 3362767 - protein, 26 aa, Plasmodium falciparum
KLIVKFFRRFCRLLKENISTNPIVFV

SEQ ID NO: 3362768 - protein, 18 aa, Plasmodium falciparum
KLIYLIMPHKDYLGDHKI

SEQ ID NO: 3362769 - protein, 18 aa, Plasmodium falciparum
KLIYVRKIQEVLSKMFHI

SEQ ID NO: 3362770 - protein, 19 aa, Plasmodium falciparum
KLKEIPIYQNLVQDFIEQD

SEQ ID NO: 3362771 - protein, 26 aa, Plasmodium falciparum
KLKELSYKYTVCFYIQNNKLLYSITS

SEQ ID NO: 3362772 - protein, 20 aa, Plasmodium falciparum
KLKEYMSYLCTLQCLQEEIS

SEQ ID NO: 3362773 - protein, 32 aa, Plasmodium falciparum
KLKILKFDIIISEWMGYFLFYECMINTILYAR

SEQ ID NO: 3362774 - protein, 22 aa, Plasmodium falciparum
KLKIQFKKTGQFLIPDNLSQSF

SEQ ID NO: 3362775 - protein, 24 aa, Plasmodium falciparum
KLKKGKKAYKHFIHSNSKDDMYSL

SEQ ID NO: 3362776 - protein, 20 aa, Plasmodium falciparum
KLKKNIYVIEHIDKIYYDTF

SEQ ID NO: 3362777 - protein, 22 aa, Plasmodium falciparum
KLKKRNYNSFDYEQHGKDGKYN

SEQ ID NO: 3362778 - protein, 38 aa, Plasmodium falciparum
KLKKSIFQPCKRTGFSTCIYKNSLILFGGVFDKKVENN

SEQ ID NO: 3362779 - protein, 26 aa, Plasmodium falciparum
KLKLIKLTLEKTFLKLDEEMLLSENQ

SEQ ID NO: 3362780 - protein, 26 aa, Plasmodium falciparum
KLKLKKCSIPLEIIRNKIILNKQNSE

SEQ ID NO: 3362781 - protein, 18 aa, Plasmodium falciparum
KLKLLKNNVDIVVTHDWP

SEQ ID NO: 3362782 - protein, 27 aa, Plasmodium falciparum
KLKMLIKNGCNKWPGANYIIKKSKKGI

SEQ ID NO: 3362783 - protein, 17 aa, Plasmodium falciparum
KLKNCYENILLTAKDNN

SEQ ID NO: 3362784 - protein, 18 aa, Plasmodium falciparum
KLKNEEHNLWLLDPDNLI

SEQ ID NO: 3362785 - protein, 18 aa, Plasmodium falciparum
KLKNEYKSDINIIDNKNN

SEQ ID NO: 3362786 - protein, 25 aa, Plasmodium falciparum
KLKNFRLDLIDGFLYDKQSLYEREM

SEQ ID NO: 3362787 - protein, 23 aa, Plasmodium falciparum
KLKNIQKFRCLILVPTRELALQI

SEQ ID NO: 3362788 - protein, 21 aa, Plasmodium falciparum
KLKNKRSLSTVELLKQDIKFL

SEQ ID NO: 3362789 - protein, 30 aa, Plasmodium falciparum
KLKNLHSFYFYSLEIFLKIFIKCLNDSSPN

SEQ ID NO: 3362790 - protein, 24 aa, Plasmodium falciparum
KLKRELYFLKKFVFFQYITNKYES

SEQ ID NO: 3362791 - protein, 18 aa, Plasmodium falciparum
KLKRKQKYLIKKKKNEEK

SEQ ID NO: 3362792 - protein, 24 aa, Plasmodium falciparum
KLKSCSDCAVIPNLFKIYKEKIPS

SEQ ID NO: 3362793 - protein, 25 aa, Plasmodium falciparum
KLKTPQCKKGFILDGYPRNVKQAED

SEQ ID NO: 3362794 - protein, 18 aa, Plasmodium falciparum
KLKYFFRKDSIIFDIPRK

SEQ ID NO: 3362795 - protein, 24 aa, Plasmodium falciparum
KLKYNHYYYAGKLAEKEWEENYDN

SEQ ID NO: 3362796 - protein, 26 aa, Plasmodium falciparum
KLKYSARWINELSRILTKMNVDHIRN

SEQ ID NO: 3362797 - protein, 18 aa, Plasmodium falciparum
KLKYTLNNDMLFEENEFQ

SEQ ID NO: 3362798 - protein, 19 aa, Plasmodium falciparum
KLLCLPTIYISSFVFYSDN

SEQ ID NO: 3362799 - protein, 17 aa, Plasmodium falciparum
KLLDNWINDIERLFKNI

SEQ ID NO: 3362800 - protein, 19 aa, Plasmodium falciparum
KLLDVCFDFGLEVDDIEYK

SEQ ID NO: 3362801 - protein, 19 aa, Plasmodium falciparum
KLLEHYEINVLMSLRASDL

SEQ ID NO: 3362802 - protein, 19 aa, Plasmodium falciparum
KLLGIQNICSFDFVTAPSL

SEQ ID NO: 3362803 - protein, 18 aa, Plasmodium falciparum
KLLIFKKILEVYLIEITN

SEQ ID NO: 3362804 - protein, 19 aa, Plasmodium falciparum
KLLIHPIHLLNYVYNYNRL

SEQ ID NO: 3362805 - protein, 18 aa, Plasmodium falciparum
KLLIKFSTVLFRNISKRK

SEQ ID NO: 3362806 - protein, 22 aa, Plasmodium falciparum
KLLIRLLFRYASYSYINPKYFK

SEQ ID NO: 3362807 - protein, 29 aa, Plasmodium falciparum
KLLKKKDQCIGVLKCSHLYWENKKYRNSN

SEQ ID NO: 3362808 - protein, 17 aa, Plasmodium falciparum
KLLKLIKKVILLSVENG

SEQ ID NO: 3362809 - protein, 17 aa, Plasmodium falciparum
KLLKLNIKKGYEIEICN

SEQ ID NO: 3362810 - protein, 30 aa, Plasmodium falciparum
KLLLHKKKGIIRFLLRQEKTLKVVANHYIY

SEQ ID NO: 3362811 - protein, 19 aa, Plasmodium falciparum
KLLLIKMPLIIKEVTYQSI

SEQ ID NO: 3362812 - protein, 19 aa, Plasmodium falciparum
KLLNILSIEYIFASINIFL

SEQ ID NO: 3362813 - protein, 26 aa, Plasmodium falciparum
KLLNILSLSFLTFVDNVIYDSHIYAQ

SEQ ID NO: 3362814 - protein, 19 aa, Plasmodium falciparum
KLLNLNLFSKREDISNYNY

SEQ ID NO: 3362815 - protein, 18 aa, Plasmodium falciparum
KLLQNLLYHRKKEYEKKK

SEQ ID NO: 3362816 - protein, 17 aa, Plasmodium falciparum
KLLQSKFSTGIQNVSKF

SEQ ID NO: 3362817 - protein, 22 aa, Plasmodium falciparum
KLLRRAYKYNDECKIIMKNKNP

SEQ ID NO: 3362818 - protein, 32 aa, Plasmodium falciparum
KLLSDIYSNCYFSCMFWFSYYLYNYEKSLEEV

SEQ ID NO: 3362819 - protein, 24 aa, Plasmodium falciparum
KLLYLKKSFDFYMYDSVIQEIREN

SEQ ID NO: 3362820 - protein, 18 aa, Plasmodium falciparum
KLLYMAIDGVAPKAKMNQ

SEQ ID NO: 3362821 - protein, 19 aa, Plasmodium falciparum
KLMASNIQNICNFITDKNK

SEQ ID NO: 3362822 - protein, 21 aa, Plasmodium falciparum
KLMCDRICNILLFENLLPFIL

SEQ ID NO: 3362823 - protein, 19 aa, Plasmodium falciparum
KLMENINCHYENFNSKNNA

SEQ ID NO: 3362824 - protein, 21 aa, Plasmodium falciparum
KLMHYAGHMGSIFKLDSKAYG

SEQ ID NO: 3362825 - protein, 31 aa, Plasmodium falciparum
KLMNKNGLIEPYWWFFYNLYENACIHEGSTI

SEQ ID NO: 3362826 - protein, 24 aa, Plasmodium falciparum
KLMPRLDSYFSLYIQKAQKVNEQN

SEQ ID NO: 3362827 - protein, 19 aa, Plasmodium falciparum
KLNCKLIGFSCNSKESHDQ

SEQ ID NO: 3362828 - protein, 25 aa, Plasmodium falciparum
KLNDIIYNIECELYKVYMEKRSSQK

SEQ ID NO: 3362829 - protein, 20 aa, Plasmodium falciparum
KLNDRFYQICCKSIADINTH

SEQ ID NO: 3362830 - protein, 19 aa, Plasmodium falciparum
KLNEPLALCDKTLGGLIKK

SEQ ID NO: 3362831 - protein, 17 aa, Plasmodium falciparum
KLNEPWDQFEHNRKLYG

SEQ ID NO: 3362832 - protein, 18 aa, Plasmodium falciparum
KLNFYHPYFCKVICREVC

SEQ ID NO: 3362833 - protein, 17 aa, Plasmodium falciparum
KLNHIGYINDISNEPNK

SEQ ID NO: 3362834 - protein, 24 aa, Plasmodium falciparum
KLNIEIKSLLSFNNNLSYALKEKD

SEQ ID NO: 3362835 - protein, 25 aa, Plasmodium falciparum
KLNINACLFKSCNIDINTEDENKLY

SEQ ID NO: 3362836 - protein, 43 aa, Plasmodium falciparum
KLNKKRKKKIPGRIYKVIVRGKECWRAEWLVHSKNDDLRTLHP

SEQ ID NO: 3362837 - protein, 29 aa, Plasmodium falciparum
KLNKVPLYLRFLPSYNIGSMTDIKNEIKK

SEQ ID NO: 3362838 - protein, 31 aa, Plasmodium falciparum
KLNLDLSEICIIDIISIYNCNDISKFLKDVF

SEQ ID NO: 3362839 - protein, 18 aa, Plasmodium falciparum
KLNLENVVLNNKLQISPY

SEQ ID NO: 3362840 - protein, 17 aa, Plasmodium falciparum
KLNLKINVRNYVKLIKD

SEQ ID NO: 3362841 - protein, 19 aa, Plasmodium falciparum
KLNNFPFSHNIRNKNILYN

SEQ ID NO: 3362842 - protein, 22 aa, Plasmodium falciparum
KLNNRFEFYKELDLSKYCNKSG

SEQ ID NO: 3362843 - protein, 25 aa, Plasmodium falciparum
KLNPFFYKRKVKFFDYGYYINNIMD

SEQ ID NO: 3362844 - protein, 21 aa, Plasmodium falciparum
KLNQGGVCIAEDINMGSVNNT

SEQ ID NO: 3362845 - protein, 32 aa, Plasmodium falciparum
KLNQHTNCFFVYFFKVIHTFDFLANNLSDLRG

SEQ ID NO: 3362846 - protein, 18 aa, Plasmodium falciparum
KLNQWKKYLSIIKNENIE

SEQ ID NO: 3362847 - protein, 22 aa, Plasmodium falciparum
KLNSKVCIFSSWAGGDRDGNPF

SEQ ID NO: 3362848 - protein, 26 aa, Plasmodium falciparum
KLNTLFKILFIPTQVKPHKYYFPSVE

SEQ ID NO: 3362849 - protein, 24 aa, Plasmodium falciparum
KLNYYKCFIIGGSVVYQEFLEKKL

SEQ ID NO: 3362850 - protein, 24 aa, Plasmodium falciparum
KLPAYLRVNFEIILIPSSRDLVRK

SEQ ID NO: 3362851 - protein, 26 aa, Plasmodium falciparum
KLPFEPNFYSNRFFFLDNDMNGSLHQ

SEQ ID NO: 3362852 - protein, 20 aa, Plasmodium falciparum
KLPHYSDGIIFTPLHSPYIT

SEQ ID NO: 3362853 - protein, 24 aa, Plasmodium falciparum
KLPINIPNDLKILMQKKKKIVDII

SEQ ID NO: 3362854 - protein, 17 aa, Plasmodium falciparum
KLPKGNISFTLEEKDHN

SEQ ID NO: 3362855 - protein, 20 aa, Plasmodium falciparum
KLPLLPEMSHPNVFSSHSPR

SEQ ID NO: 3362856 - protein, 31 aa, Plasmodium falciparum
KLPNFGGQEIPIWGGIEVPNWEEEYKPLGEK

SEQ ID NO: 3362857 - protein, 19 aa, Plasmodium falciparum
KLPPSGGFGLNLGIGDVLN

SEQ ID NO: 3362858 - protein, 23 aa, Plasmodium falciparum
KLPQEVKKIFGASFNLKSIQIRC

SEQ ID NO: 3362859 - protein, 21 aa, Plasmodium falciparum
KLPSFDFINFYWIYGKVDKLL

SEQ ID NO: 3362860 - protein, 18 aa, Plasmodium falciparum
KLPTGVYFYQGSYVANWW

SEQ ID NO: 3362861 - protein, 34 aa, Plasmodium falciparum
KLQKGHITCAYWLSNSYIYACIDLLRQMIYIKNK

SEQ ID NO: 3362862 - protein, 25 aa, Plasmodium falciparum
KLQKSFPLIEWWQGKEILHKIQKKN

SEQ ID NO: 3362863 - protein, 20 aa, Plasmodium falciparum
KLQPHLSYQYKLIDYNNVSK

SEQ ID NO: 3362864 - protein, 19 aa, Plasmodium falciparum
KLQTCNRFSFTLTSTGAVT

SEQ ID NO: 3362865 - protein, 21 aa, Plasmodium falciparum
KLREKLGLKKLEITKDNVKKN

SEQ ID NO: 3362866 - protein, 21 aa, Plasmodium falciparum
KLRGELLKYMRRNINDEQVYN

SEQ ID NO: 3362867 - protein, 21 aa, Plasmodium falciparum
KLRHHLIMYISSAFNNDMLIA

SEQ ID NO: 3362868 - protein, 19 aa, Plasmodium falciparum
KLRHQLIFRAYDLDRDGYL

SEQ ID NO: 3362869 - protein, 18 aa, Plasmodium falciparum
KLRIYGCQLLQEAGIILK

SEQ ID NO: 3362870 - protein, 17 aa, Plasmodium falciparum
KLRSCKKKKLEINKERE

SEQ ID NO: 3362871 - protein, 24 aa, Plasmodium falciparum
KLRWKHFDCRGMEDIELDENENLD

SEQ ID NO: 3362872 - protein, 23 aa, Plasmodium falciparum
KLSDPRPLIYVCDIHNYIEELAE

SEQ ID NO: 3362873 - protein, 27 aa, Plasmodium falciparum
KLSEGFSGRCLRRIPFQAYAYFCQATL

SEQ ID NO: 3362874 - protein, 24 aa, Plasmodium falciparum
KLSEVKIILAKAIKHIPTSVKLWL

SEQ ID NO: 3362875 - protein, 20 aa, Plasmodium falciparum
KLSHKWKEASCCILKNALLH

SEQ ID NO: 3362876 - protein, 18 aa, Plasmodium falciparum
KLSIFSIFVCSTKSNDQN

SEQ ID NO: 3362877 - protein, 18 aa, Plasmodium falciparum
KLSKLLLQNNFPIKSDNI

SEQ ID NO: 3362878 - protein, 18 aa, Plasmodium falciparum
KLSLADIFVYTSLKHSCI

SEQ ID NO: 3362879 - protein, 17 aa, Plasmodium falciparum
KLSNNLCNNNITINTNN

SEQ ID NO: 3362880 - protein, 24 aa, Plasmodium falciparum
KLSRIELIDIFGFPNEFDVMNKIL

SEQ ID NO: 3362881 - protein, 18 aa, Plasmodium falciparum
KLSSFKMWDTFDDIKNKE

SEQ ID NO: 3362882 - protein, 18 aa, Plasmodium falciparum
KLSSIMERYAGGKRNDKK

SEQ ID NO: 3362883 - protein, 21 aa, Plasmodium falciparum
KLSSVELRHSINYNINTNNKK

SEQ ID NO: 3362884 - protein, 18 aa, Plasmodium falciparum
KLSTNLIKHSRQVSSSVN

SEQ ID NO: 3362885 - protein, 24 aa, Plasmodium falciparum
KLSYNFKNRLLFAATNNDTIDSSL

SEQ ID NO: 3362886 - protein, 32 aa, Plasmodium falciparum
KLTELFLLIYKERLKRMLLYCSNVEEGRNDNN

SEQ ID NO: 3362887 - protein, 33 aa, Plasmodium falciparum
KLTHKKECYEHYRSYLLYKYKTTYSVCDEAFKN

SEQ ID NO: 3362888 - protein, 19 aa, Plasmodium falciparum
KLTHKVCYKRKAPRAIKEI

SEQ ID NO: 3362889 - protein, 18 aa, Plasmodium falciparum
KLTLEILSEIKIKKENFI

SEQ ID NO: 3362890 - protein, 19 aa, Plasmodium falciparum
KLTSIYVEREDQKVGPLNV

SEQ ID NO: 3362891 - protein, 18 aa, Plasmodium falciparum
KLTTFALRKKYIWKNNTH

SEQ ID NO: 3362892 - protein, 22 aa, Plasmodium falciparum
KLVPNWKKPIVIGRHAYADQYK

SEQ ID NO: 3362893 - protein, 18 aa, Plasmodium falciparum
KLVRTCRVTWKKLRTKMI

SEQ ID NO: 3362894 - protein, 18 aa, Plasmodium falciparum
KLVTSIIHIKTKFIENKI

SEQ ID NO: 3362895 - protein, 19 aa, Plasmodium falciparum
KLVVNTCVGITSTTDKRPI

SEQ ID NO: 3362896 - protein, 25 aa, Plasmodium falciparum
KLWKHHIKSLCLTKLSNLVNTEDIQ

SEQ ID NO: 3362897 - protein, 17 aa, Plasmodium falciparum
KLWNYRKNNFKDFPSVH

SEQ ID NO: 3362898 - protein, 24 aa, Plasmodium falciparum
KLYDPMECYRDYDCAQKIREDILQ

SEQ ID NO: 3362899 - protein, 24 aa, Plasmodium falciparum
KLYEFRKGDIMSVFYTIVHQLITM

SEQ ID NO: 3362900 - protein, 19 aa, Plasmodium falciparum
KLYEIYVQVILNFYFLSFN

SEQ ID NO: 3362901 - protein, 22 aa, Plasmodium falciparum
KLYFDPSQNCMDTIISMGDNHD

SEQ ID NO: 3362902 - protein, 20 aa, Plasmodium falciparum
KLYFKEERTYIYIHKVYILK

SEQ ID NO: 3362903 - protein, 19 aa, Plasmodium falciparum
KLYFSYNLIGYIKKKGFAN

SEQ ID NO: 3362904 - protein, 18 aa, Plasmodium falciparum
KLYGLIMNIIKKSLFVNY

SEQ ID NO: 3362905 - protein, 25 aa, Plasmodium falciparum
KLYIIIKIKYPYGIYIFNCDDVYDI

SEQ ID NO: 3362906 - protein, 19 aa, Plasmodium falciparum
KLYKDLICCYNNISEKELI

SEQ ID NO: 3362907 - protein, 17 aa, Plasmodium falciparum
KLYKNKIHNKIHNNNNN

SEQ ID NO: 3362908 - protein, 18 aa, Plasmodium falciparum
KLYKYGEKIIYSDKDKKE

SEQ ID NO: 3362909 - protein, 22 aa, Plasmodium falciparum
KLYLEREEEGSFIFICDDDDML

SEQ ID NO: 3362910 - protein, 24 aa, Plasmodium falciparum
KLYTYKLDPNFVFLKPHNIDSFFL

SEQ ID NO: 3362911 - protein, 24 aa, Plasmodium falciparum
KLYVIKPYICYGYIKKYNFYNLME

SEQ ID NO: 3362912 - protein, 19 aa, Plasmodium falciparum
KMAKFVLENLCYFDLSYKY

SEQ ID NO: 3362913 - protein, 21 aa, Plasmodium falciparum
KMARHSICSLILGSTQGKIFN

SEQ ID NO: 3362914 - protein, 19 aa, Plasmodium falciparum
KMDDPTCNWSESRYEEIQK

SEQ ID NO: 3362915 - protein, 25 aa, Plasmodium falciparum
KMDFLKCHVDDRLSMGSDTMNNAPH

SEQ ID NO: 3362916 - protein, 19 aa, Plasmodium falciparum
KMDLQLFFTLLKRKILYSI

SEQ ID NO: 3362917 - protein, 18 aa, Plasmodium falciparum
KMDMKREKMEMLKNKNYR

SEQ ID NO: 3362918 - protein, 19 aa, Plasmodium falciparum
KMDNIDCIDNMNNIEKQSR

SEQ ID NO: 3362919 - protein, 26 aa, Plasmodium falciparum
KMDTYIHGFLCYFKSQLYDDVYISIE

SEQ ID NO: 3362920 - protein, 17 aa, Plasmodium falciparum
KMEILKQKFQEYATDNK

SEQ ID NO: 3362921 - protein, 25 aa, Plasmodium falciparum
KMEKLKESQDRLFIATERHIEKLHN

SEQ ID NO: 3362922 - protein, 22 aa, Plasmodium falciparum
KMFCQPCEIMIQYLKSFYDPND

SEQ ID NO: 3362923 - protein, 29 aa, Plasmodium falciparum
KMFYKTLCPNIKDNILLYIAQQKMNEQNN

SEQ ID NO: 3362924 - protein, 17 aa, Plasmodium falciparum
KMGRKYLSEGFSAYVHV

SEQ ID NO: 3362925 - protein, 22 aa, Plasmodium falciparum
KMIGSECFNLKTGTNVSKNTKK

SEQ ID NO: 3362926 - protein, 24 aa, Plasmodium falciparum
KMINASIFILRRICNHPLLHKYYY

SEQ ID NO: 3362927 - protein, 22 aa, Plasmodium falciparum
KMIPIYYILSFLKKLLRIGCLT

SEQ ID NO: 3362928 - protein, 17 aa, Plasmodium falciparum
KMISCAKTGDNNMTYVN

SEQ ID NO: 3362929 - protein, 25 aa, Plasmodium falciparum
KMKDLKKKFLFSINNIFKNVNMYFF

SEQ ID NO: 3362930 - protein, 28 aa, Plasmodium falciparum
KMKEDPCYVPKESGYFLHDNRFENNEKK

SEQ ID NO: 3362931 - protein, 22 aa, Plasmodium falciparum
KMKEEKIIIPLHTFDEKKTNNM

SEQ ID NO: 3362932 - protein, 24 aa, Plasmodium falciparum
KMKENKNMSTLICRSNMNNTDNID

SEQ ID NO: 3362933 - protein, 26 aa, Plasmodium falciparum
KMKEYEIWKKLYILKIETQYYALKWI

SEQ ID NO: 3362934 - protein, 22 aa, Plasmodium falciparum
KMKIKMWNETILQKEKQIEILE

SEQ ID NO: 3362935 - protein, 23 aa, Plasmodium falciparum
KMKIPEEHICCIKKVNDNVIYII

SEQ ID NO: 3362936 - protein, 20 aa, Plasmodium falciparum
KMKKSFCNIENNLIDFNKLN

SEQ ID NO: 3362937 - protein, 19 aa, Plasmodium falciparum
KMKLCERDWFLNKKNKNEK

SEQ ID NO: 3362938 - protein, 23 aa, Plasmodium falciparum
KMKNDDFELVFGPNDIKTFYLSY

SEQ ID NO: 3362939 - protein, 26 aa, Plasmodium falciparum
KMKNDICNIIKFNLTSLKCNRKENDE

SEQ ID NO: 3362940 - protein, 20 aa, Plasmodium falciparum
KMKSGGIKENVEYDIYHKFI

SEQ ID NO: 3362941 - protein, 29 aa, Plasmodium falciparum
KMLNNIYELRGWWVKVGQFLSTQENIMPV

SEQ ID NO: 3362942 - protein, 21 aa, Plasmodium falciparum
KMNEHFSYFVISEFLNLMRLC

SEQ ID NO: 3362943 - protein, 22 aa, Plasmodium falciparum
KMNEKISEPCIHNNTSNIYEYI

SEQ ID NO: 3362944 - protein, 25 aa, Plasmodium falciparum
KMNLLKSKMLHISEDLLKNEKEKKR

SEQ ID NO: 3362945 - protein, 22 aa, Plasmodium falciparum
KMNLTLHRLEIILKSAYQNLLQ

SEQ ID NO: 3362946 - protein, 30 aa, Plasmodium falciparum
KMNRNKILYLKGLKSKELLLQKKIDYQNEE

SEQ ID NO: 3362947 - protein, 25 aa, Plasmodium falciparum
KMNVCDEGKKNEVLSYISMNNENSE

SEQ ID NO: 3362948 - protein, 19 aa, Plasmodium falciparum
KMPPVQNGNAIKHMDEKEI

SEQ ID NO: 3362949 - protein, 24 aa, Plasmodium falciparum
KMQIDEKIFKKRDPPNINDTRAFP

SEQ ID NO: 3362950 - protein, 18 aa, Plasmodium falciparum
KMSPTRANKVSSRSHAIL

SEQ ID NO: 3362951 - protein, 23 aa, Plasmodium falciparum
KMTGKKYVCHFAPHYYTSHWPDY

SEQ ID NO: 3362952 - protein, 19 aa, Plasmodium falciparum
KMVLHGWRAEARGGHDFQF

SEQ ID NO: 3362953 - protein, 17 aa, Plasmodium falciparum
KMYEHIQNLFSEYKNKI

SEQ ID NO: 3362954 - protein, 18 aa, Plasmodium falciparum
KMYNFLYDDLNTIDKMNE

SEQ ID NO: 3362955 - protein, 17 aa, Plasmodium falciparum
KMYQKKSSFLFNKNNFH

SEQ ID NO: 3362956 - protein, 27 aa, Plasmodium falciparum
KNAKYNFVPVIIDWGLIKQLDSVMKFA

SEQ ID NO: 3362957 - protein, 20 aa, Plasmodium falciparum
KNAMSKWGLKTSTKVEKKKT

SEQ ID NO: 3362958 - protein, 17 aa, Plasmodium falciparum
KNAQGNFTLSLDDEAIL

SEQ ID NO: 3362959 - protein, 29 aa, Plasmodium falciparum
KNAQLSLFEAFIIYHFWYQKNSVDIKKNF

SEQ ID NO: 3362960 - protein, 37 aa, Plasmodium falciparum
KNASKKIKIVYVIEFLNIKIAKMFFTLINKTVFQNFL

SEQ ID NO: 3362961 - protein, 23 aa, Plasmodium falciparum
KNAVKGNMNLIGKHSNYDLMKNG

SEQ ID NO: 3362962 - protein, 19 aa, Plasmodium falciparum
KNCAVFITMNPDYLGRSKL

SEQ ID NO: 3362963 - protein, 22 aa, Plasmodium falciparum
KNCEKKCNIPCNHINENTLFTD

SEQ ID NO: 3362964 - protein, 17 aa, Plasmodium falciparum
KNCHSVLFLSLKLLMEK

SEQ ID NO: 3362965 - protein, 17 aa, Plasmodium falciparum
KNCICMFESGALPYLIS

SEQ ID NO: 3362966 - protein, 23 aa, Plasmodium falciparum
KNCKWKIFLNQLIVMETFLYDKK

SEQ ID NO: 3362967 - protein, 25 aa, Plasmodium falciparum
KNCNYKNLHLNSTINFNRNNNNNNI

SEQ ID NO: 3362968 - protein, 21 aa, Plasmodium falciparum
KNCRHAHGYKELKRRPTNNMN

SEQ ID NO: 3362969 - protein, 30 aa, Plasmodium falciparum
KNCRSGKIIGEPFPLDVVSRNKYCVEKGIY

SEQ ID NO: 3362970 - protein, 21 aa, Plasmodium falciparum
KNCTHGKMIRDTRKDEENNVP

SEQ ID NO: 3362971 - protein, 18 aa, Plasmodium falciparum
KNCTIKMKDNNFINNNKY

SEQ ID NO: 3362972 - protein, 17 aa, Plasmodium falciparum
KNCYENILLTAKDNNFK

SEQ ID NO: 3362973 - protein, 19 aa, Plasmodium falciparum
KNDCFSFFRNIKIVNNDKS

SEQ ID NO: 3362974 - protein, 17 aa, Plasmodium falciparum
KNDEILNFYEQMEELLY

SEQ ID NO: 3362975 - protein, 19 aa, Plasmodium falciparum
KNDELDINYIISILNCKSY

SEQ ID NO: 3362976 - protein, 20 aa, Plasmodium falciparum
KNDHSFKSHIQCNMNNSYNY

SEQ ID NO: 3362977 - protein, 25 aa, Plasmodium falciparum
KNDIECDMLHIFKNVINILTCKYPE

SEQ ID NO: 3362978 - protein, 17 aa, Plasmodium falciparum
KNDIIVFEKENLYIYTN

SEQ ID NO: 3362979 - protein, 24 aa, Plasmodium falciparum
KNDIKILVYKSIYDRYYKIITTFL

SEQ ID NO: 3362980 - protein, 24 aa, Plasmodium falciparum
KNDIKSYNFLLVYYKDVFSKKKVF

SEQ ID NO: 3362981 - protein, 27 aa, Plasmodium falciparum
KNDKYKICFYYIIKETLLANSLEQAHV

SEQ ID NO: 3362982 - protein, 23 aa, Plasmodium falciparum
KNDLKCRNSFEMLINEENEKINS

SEQ ID NO: 3362983 - protein, 18 aa, Plasmodium falciparum
KNDLLSIIEEKKYELENN

SEQ ID NO: 3362984 - protein, 20 aa, Plasmodium falciparum
KNDLQNILPINGHKIGLSLK

SEQ ID NO: 3362985 - protein, 20 aa, Plasmodium falciparum
KNDLSSSCSKNINEEYDKEE

SEQ ID NO: 3362986 - protein, 17 aa, Plasmodium falciparum
KNDNAFNKKWYNNQQND

SEQ ID NO: 3362987 - protein, 18 aa, Plasmodium falciparum
KNDNFGWYANKLCEEHKY

SEQ ID NO: 3362988 - protein, 17 aa, Plasmodium falciparum
KNDNHFCIVPFNSTNNF

SEQ ID NO: 3362989 - protein, 26 aa, Plasmodium falciparum
KNDPALGRVRDWVCKQCGNNEAVFLQ

SEQ ID NO: 3362990 - protein, 18 aa, Plasmodium falciparum
KNDPSCVEKIKIELLIRK

SEQ ID NO: 3362991 - protein, 17 aa, Plasmodium falciparum
KNDSCSDDAYMNNFISN

SEQ ID NO: 3362992 - protein, 22 aa, Plasmodium falciparum
KNDSLEFYDIFELVVQAKEFDD

SEQ ID NO: 3362993 - protein, 19 aa, Plasmodium falciparum
KNDSLLFMNCNFYIDDFVS

SEQ ID NO: 3362994 - protein, 19 aa, Plasmodium falciparum
KNDYCFNSYEIMNSYMQHK

SEQ ID NO: 3362995 - protein, 21 aa, Plasmodium falciparum
KNDYLLVLISIHFVDSYDQFI

SEQ ID NO: 3362996 - protein, 22 aa, Plasmodium falciparum
KNEDLCLLIKLEILRNKNNMDV

SEQ ID NO: 3362997 - protein, 26 aa, Plasmodium falciparum
KNEESSSFKLYWKSSRIHQQIIQSHY

SEQ ID NO: 3362998 - protein, 17 aa, Plasmodium falciparum
KNEETGKNKSSRSSSNS

SEQ ID NO: 3362999 - protein, 24 aa, Plasmodium falciparum
KNEIIIKTCEVIRIKTIIHNKKTR

SEQ ID NO: 3363000 - protein, 20 aa, Plasmodium falciparum
KNEKYDIFVSPNIGTIEGGR

SEQ ID NO: 3363001 - protein, 17 aa, Plasmodium falciparum
KNELCSLLHIKKASDIL

SEQ ID NO: 3363002 - protein, 19 aa, Plasmodium falciparum
KNELINERCILLNFLCDIE

SEQ ID NO: 3363003 - protein, 18 aa, Plasmodium falciparum
KNELWKNRQRVLIVRSPL

SEQ ID NO: 3363004 - protein, 17 aa, Plasmodium falciparum
KNEMNVWTLKEKKNEMN

SEQ ID NO: 3363005 - protein, 19 aa, Plasmodium falciparum
KNENKNEMMINDIKKEEEI

SEQ ID NO: 3363006 - protein, 19 aa, Plasmodium falciparum
KNEQLKKEILKSIQSNKEE

SEQ ID NO: 3363007 - protein, 17 aa, Plasmodium falciparum
KNESFLITLRVKPNAKK

SEQ ID NO: 3363008 - protein, 31 aa, Plasmodium falciparum
KNEVVGVDIMCWIHRGLISCAYDIVTDQYND

SEQ ID NO: 3363009 - protein, 21 aa, Plasmodium falciparum
KNEYKGPLGEEEFFEDTEEEK

SEQ ID NO: 3363010 - protein, 17 aa, Plasmodium falciparum
KNFDIQWIRVVDVPFQE

SEQ ID NO: 3363011 - protein, 22 aa, Plasmodium falciparum
KNFEFLYFFCFNCNTYYDINII

SEQ ID NO: 3363012 - protein, 18 aa, Plasmodium falciparum
KNFEKFSFSKGFQKDALE

SEQ ID NO: 3363013 - protein, 23 aa, Plasmodium falciparum
KNFGVQIDCCMDVVNYNKINRNG

SEQ ID NO: 3363014 - protein, 25 aa, Plasmodium falciparum
KNFKEIVKIYLMYEYLFQNNIKHYS

SEQ ID NO: 3363015 - protein, 38 aa, Plasmodium falciparum
KNFKKRRIPDELAYKYFCHVVNGLYYLNQMGIFHRDIK

SEQ ID NO: 3363016 - protein, 23 aa, Plasmodium falciparum
KNFKNNCKLIFLNKINEINMDNV

SEQ ID NO: 3363017 - protein, 20 aa, Plasmodium falciparum
KNFLLDFYFGTGLKPKSIVS

SEQ ID NO: 3363018 - protein, 21 aa, Plasmodium falciparum
KNFMQRLGMRKEDLYIEDENY

SEQ ID NO: 3363019 - protein, 17 aa, Plasmodium falciparum
KNFMQWIGPVIKVEKIP

SEQ ID NO: 3363020 - protein, 18 aa, Plasmodium falciparum
KNFQFFRQETFCITEYVD

SEQ ID NO: 3363021 - protein, 23 aa, Plasmodium falciparum
KNFQHKHFLSHKHSYNEHKEEDG

SEQ ID NO: 3363022 - protein, 25 aa, Plasmodium falciparum
KNFSKLYLYDCNYKKVIFYELLKSC

SEQ ID NO: 3363023 - protein, 18 aa, Plasmodium falciparum
KNFSSLFQRYNINNLSSK

SEQ ID NO: 3363024 - protein, 17 aa, Plasmodium falciparum
KNFTCYEHNGAHINNDK

SEQ ID NO: 3363025 - protein, 18 aa, Plasmodium falciparum
KNFVCLFTTDIACRGLDF

SEQ ID NO: 3363026 - protein, 24 aa, Plasmodium falciparum
KNFVLKRDRYALLGKIKNNKEIEV

SEQ ID NO: 3363027 - protein, 39 aa, Plasmodium falciparum
KNFYKIKNVCIIECIYHYLQLFKYEGIDFKTVIDNQEKL

SEQ ID NO: 3363028 - protein, 21 aa, Plasmodium falciparum
KNFYLRMIHTYFRSKDVKEID

SEQ ID NO: 3363029 - protein, 21 aa, Plasmodium falciparum
KNFYTTYIFDIYGKKIDILYQ

SEQ ID NO: 3363030 - protein, 22 aa, Plasmodium falciparum
KNGESVLSYSFYKNIKDKVMVQ

SEQ ID NO: 3363031 - protein, 24 aa, Plasmodium falciparum
KNGIKSLFYKACNKKNYREKIYFY

SEQ ID NO: 3363032 - protein, 18 aa, Plasmodium falciparum
KNGKFILYFNDFEDQHVV

SEQ ID NO: 3363033 - protein, 20 aa, Plasmodium falciparum
KNGKKIFMRGDEELKDNEEE

SEQ ID NO: 3363034 - protein, 19 aa, Plasmodium falciparum
KNGLICFLGIHKNDTWEDA

SEQ ID NO: 3363035 - protein, 26 aa, Plasmodium falciparum
KNGLYCSPLRLLAWEVYSKLTRMNKK

SEQ ID NO: 3363036 - protein, 20 aa, Plasmodium falciparum
KNGNFFSHRNNIKGTDKKDE

SEQ ID NO: 3363037 - protein, 17 aa, Plasmodium falciparum
KNGPCLWYTEPSGTNTR

SEQ ID NO: 3363038 - protein, 20 aa, Plasmodium falciparum
KNGRKCILATNIAETSITID

SEQ ID NO: 3363039 - protein, 21 aa, Plasmodium falciparum
KNGYHILYLTARAIGQADSTR

SEQ ID NO: 3363040 - protein, 17 aa, Plasmodium falciparum
KNHCIALCGKKNIRYLT

SEQ ID NO: 3363041 - protein, 25 aa, Plasmodium falciparum
KNHDKCIRMFYALQYAGFIKTDMKN

SEQ ID NO: 3363042 - protein, 27 aa, Plasmodium falciparum
KNHENMFRMSKSQLLSLESDIKYLQSL

SEQ ID NO: 3363043 - protein, 24 aa, Plasmodium falciparum
KNHFLKKFINNFNVGNIIIFTCEQ

SEQ ID NO: 3363044 - protein, 27 aa, Plasmodium falciparum
KNHGATCYMNALLQLLYHINIFRKAVC

SEQ ID NO: 3363045 - protein, 19 aa, Plasmodium falciparum
KNHINCSNNSYANNSKTYK

SEQ ID NO: 3363046 - protein, 19 aa, Plasmodium falciparum
KNHIYRKKLEINYDQPVDD

SEQ ID NO: 3363047 - protein, 21 aa, Plasmodium falciparum
KNHKIMFLWTGDRDGDSIDMA

SEQ ID NO: 3363048 - protein, 23 aa, Plasmodium falciparum
KNHKTCYPFFEGDNIVLLDIKEK

SEQ ID NO: 3363049 - protein, 21 aa, Plasmodium falciparum
KNHMMNIPSATSHEINKEYKM

SEQ ID NO: 3363050 - protein, 20 aa, Plasmodium falciparum
KNHQLKFIFSFNKLNLTHLC

SEQ ID NO: 3363051 - protein, 20 aa, Plasmodium falciparum
KNHRFICAYDTDLFLDINVE

SEQ ID NO: 3363052 - protein, 21 aa, Plasmodium falciparum
KNHSRKCDFCKGNFMNTTYVN

SEQ ID NO: 3363053 - protein, 19 aa, Plasmodium falciparum
KNHVIKILLNMLSKNVSYS

SEQ ID NO: 3363054 - protein, 17 aa, Plasmodium falciparum
KNIAHFGSSPKYDESQL

SEQ ID NO: 3363055 - protein, 17 aa, Plasmodium falciparum
KNICCIKLIRNGSNLII

SEQ ID NO: 3363056 - protein, 21 aa, Plasmodium falciparum
KNICGGLAIASYSYYKKVDLI

SEQ ID NO: 3363057 - protein, 17 aa, Plasmodium falciparum
KNICHIFHGRNICTNVI

SEQ ID NO: 3363058 - protein, 22 aa, Plasmodium falciparum
KNICLKRNDLKLIVTSATIDAK

SEQ ID NO: 3363059 - protein, 19 aa, Plasmodium falciparum
KNIDKICEWIFELITIGNK

SEQ ID NO: 3363060 - protein, 20 aa, Plasmodium falciparum
KNIDKICKYNNMIKELNDIK

SEQ ID NO: 3363061 - protein, 18 aa, Plasmodium falciparum
KNIEHIYLNTQHNYINTN

SEQ ID NO: 3363062 - protein, 23 aa, Plasmodium falciparum
KNIEKFKELLINATRDNLNEYIK

SEQ ID NO: 3363063 - protein, 21 aa, Plasmodium falciparum
KNIELKYTYKAHANKIINLSK

SEQ ID NO: 3363064 - protein, 17 aa, Plasmodium falciparum
KNIFFKKYNSLHIDHTD

SEQ ID NO: 3363065 - protein, 18 aa, Plasmodium falciparum
KNIFKHKYINSLNYISTG

SEQ ID NO: 3363066 - protein, 21 aa, Plasmodium falciparum
KNIFNLLSIYFLQNIDLINNH

SEQ ID NO: 3363067 - protein, 19 aa, Plasmodium falciparum
KNIFRNFLMKFNYIKYDSD

SEQ ID NO: 3363068 - protein, 18 aa, Plasmodium falciparum
KNIFSYFKNICKRKKYKI

SEQ ID NO: 3363069 - protein, 25 aa, Plasmodium falciparum
KNIGRRYLNCISNQILYIDDLSRHD

SEQ ID NO: 3363070 - protein, 31 aa, Plasmodium falciparum
KNIHFSPVTWILKLNIGWDINFFPYPIDFLN

SEQ ID NO: 3363071 - protein, 24 aa, Plasmodium falciparum
KNIIFLKKKIKLMKYIELYNIKIE

SEQ ID NO: 3363072 - protein, 25 aa, Plasmodium falciparum
KNIIKGNVYDIVYKKYINPYCIYEI

SEQ ID NO: 3363073 - protein, 23 aa, Plasmodium falciparum
KNIIKNKLVLIGFSKGCSVLFSL

SEQ ID NO: 3363074 - protein, 24 aa, Plasmodium falciparum
KNIIKPDGYVYLLFPEENQLNESV

SEQ ID NO: 3363075 - protein, 25 aa, Plasmodium falciparum
KNIILKRNSFLYIYEYYKYNCDVFN

SEQ ID NO: 3363076 - protein, 19 aa, Plasmodium falciparum
KNIIPPIILIGGINTNNIQ

SEQ ID NO: 3363077 - protein, 18 aa, Plasmodium falciparum
KNIIPYFLTNVFDMEQKK

SEQ ID NO: 3363078 - protein, 25 aa, Plasmodium falciparum
KNIIRFRFLFQSSTYFTYPVQEIEN

SEQ ID NO: 3363079 - protein, 19 aa, Plasmodium falciparum
KNIIRKNNIMNFNTNNNNN

SEQ ID NO: 3363080 - protein, 18 aa, Plasmodium falciparum
KNIKELFVNNNFETDIKH

SEQ ID NO: 3363081 - protein, 25 aa, Plasmodium falciparum
KNIKKRRYYSNFLYDEKMQMQMKRN

SEQ ID NO: 3363082 - protein, 22 aa, Plasmodium falciparum
KNIKLEWEKCLLDTCDHKYIVN

SEQ ID NO: 3363083 - protein, 24 aa, Plasmodium falciparum
KNIKMNKIRIKVMKENKMKNKKLM

SEQ ID NO: 3363084 - protein, 24 aa, Plasmodium falciparum
KNIKNSNMCKLEYKDEINGDKKKE

SEQ ID NO: 3363085 - protein, 17 aa, Plasmodium falciparum
KNIKSKVDECIHVNVSS

SEQ ID NO: 3363086 - protein, 18 aa, Plasmodium falciparum
KNIKSRNILKRVIYKADQ

SEQ ID NO: 3363087 - protein, 18 aa, Plasmodium falciparum
KNIKYEVIDISKNEVGIK

SEQ ID NO: 3363088 - protein, 23 aa, Plasmodium falciparum
KNILCVEELYISYNKINHIIDTF

SEQ ID NO: 3363089 - protein, 20 aa, Plasmodium falciparum
KNILEDIVHLFSSNNNVIYG

SEQ ID NO: 3363090 - protein, 20 aa, Plasmodium falciparum
KNILFKGGIGKEVLKLYLKI

SEQ ID NO: 3363091 - protein, 28 aa, Plasmodium falciparum
KNILIKFLRFILNFDWLNNPLIIEYDEC

SEQ ID NO: 3363092 - protein, 22 aa, Plasmodium falciparum
KNILKLFFITKGCNGLTHSFNF

SEQ ID NO: 3363093 - protein, 19 aa, Plasmodium falciparum
KNILLKYGKWKNGKLKKWL

SEQ ID NO: 3363094 - protein, 19 aa, Plasmodium falciparum
KNILMKKLRDAYNVYNNKK

SEQ ID NO: 3363095 - protein, 19 aa, Plasmodium falciparum
KNILRELHVKKRLTEYRIN

SEQ ID NO: 3363096 - protein, 25 aa, Plasmodium falciparum
KNIMFQILCAIAYMHSNNIAHKDLK

SEQ ID NO: 3363097 - protein, 20 aa, Plasmodium falciparum
KNIMNTWKIRFINNDKYKGR

SEQ ID NO: 3363098 - protein, 19 aa, Plasmodium falciparum
KNINLCFLNKYYFESEKEI

SEQ ID NO: 3363099 - protein, 41 aa, Plasmodium falciparum
KNINLFSMRVIEWYSWHFPELKKIVTDVCMYCKLVNLIQIK

SEQ ID NO: 3363100 - protein, 28 aa, Plasmodium falciparum
KNINMSLYMKCITHFSIKDLSKTLISIG

SEQ ID NO: 3363101 - protein, 25 aa, Plasmodium falciparum
KNINYPFVHIILYFYFKLNYINETF

SEQ ID NO: 3363102 - protein, 17 aa, Plasmodium falciparum
KNIPCDERMMYRYNTME

SEQ ID NO: 3363103 - protein, 18 aa, Plasmodium falciparum
KNIPCHCSPCFDVKEGDI

SEQ ID NO: 3363104 - protein, 25 aa, Plasmodium falciparum
KNIPIIKLDISDNIIKYTKVVKKLK

SEQ ID NO: 3363105 - protein, 17 aa, Plasmodium falciparum
KNIPMNINVNFSLNNIY

SEQ ID NO: 3363106 - protein, 29 aa, Plasmodium falciparum
KNIPPELKIFWEQYFLQLSICITSFLKNY

SEQ ID NO: 3363107 - protein, 22 aa, Plasmodium falciparum
KNIPQKKSLLFMKKATTGIKKV

SEQ ID NO: 3363108 - protein, 19 aa, Plasmodium falciparum
KNIPYDIKSNSLIDNNLDD

SEQ ID NO: 3363109 - protein, 23 aa, Plasmodium falciparum
KNIQRPLLILADRQIDLSVMIQH

SEQ ID NO: 3363110 - protein, 28 aa, Plasmodium falciparum
KNIRGLNKCLFLYKGVRNIRNRYNLCSY

SEQ ID NO: 3363111 - protein, 23 aa, Plasmodium falciparum
KNIRNGDKIAILFASKNYYYNTI

SEQ ID NO: 3363112 - protein, 25 aa, Plasmodium falciparum
KNIRNKHFFFIIGMGPPENLQLKAS

SEQ ID NO: 3363113 - protein, 28 aa, Plasmodium falciparum
KNISQLRRYISLFHKFIIYHTLPHNISL

SEQ ID NO: 3363114 - protein, 17 aa, Plasmodium falciparum
KNISTIMNYEPYSYHSK

SEQ ID NO: 3363115 - protein, 25 aa, Plasmodium falciparum
KNITYIRLHLEKFALKNKETIDKIE

SEQ ID NO: 3363116 - protein, 25 aa, Plasmodium falciparum
KNIWKDKFDNCYNICNDMFFGNNDI

SEQ ID NO: 3363117 - protein, 20 aa, Plasmodium falciparum
KNIWNLLSVHIHNNICNVDI

SEQ ID NO: 3363118 - protein, 20 aa, Plasmodium falciparum
KNIYLYPYLKFIKNELLEPY

SEQ ID NO: 3363119 - protein, 24 aa, Plasmodium falciparum
KNKAVLKPNPRFVGDNPNPFMQPP

SEQ ID NO: 3363120 - protein, 23 aa, Plasmodium falciparum
KNKDFCFYRNIKMKKKINKNKEF

SEQ ID NO: 3363121 - protein, 23 aa, Plasmodium falciparum
KNKDIKAKYILKDMTELCKGVQH

SEQ ID NO: 3363122 - protein, 28 aa, Plasmodium falciparum
KNKDTYHFNDFLKWYKINIGKLYTSEQV

SEQ ID NO: 3363123 - protein, 19 aa, Plasmodium falciparum
KNKDVLYFNYMILQKYGNF

SEQ ID NO: 3363124 - protein, 17 aa, Plasmodium falciparum
KNKEELLNYDKELKNRE

SEQ ID NO: 3363125 - protein, 25 aa, Plasmodium falciparum
KNKEGGLLYEWYNKYIYNGDGKEKL

SEQ ID NO: 3363126 - protein, 37 aa, Plasmodium falciparum
KNKEICTNCYIHYDNFKSSYILTFINRKQKKQRKIFP

SEQ ID NO: 3363127 - protein, 27 aa, Plasmodium falciparum
KNKEKTVVRRYFPGKKPHYAKKGEDDD

SEQ ID NO: 3363128 - protein, 18 aa, Plasmodium falciparum
KNKERHIDFVISSLAFNI

SEQ ID NO: 3363129 - protein, 36 aa, Plasmodium falciparum
KNKERISVISPVILLLIFKNMNIINLYKIFISCLKC

SEQ ID NO: 3363130 - protein, 20 aa, Plasmodium falciparum
KNKFDSMHINNNFLIGISPQ

SEQ ID NO: 3363131 - protein, 19 aa, Plasmodium falciparum
KNKFKCFTYYSCKNYNVCK

SEQ ID NO: 3363132 - protein, 19 aa, Plasmodium falciparum
KNKFLNVVEYIHYVCTNLY

SEQ ID NO: 3363133 - protein, 38 aa, Plasmodium falciparum
KNKGCVLIPVDLHFLYFIELIELIGVIISKHLPKEEQV

SEQ ID NO: 3363134 - protein, 23 aa, Plasmodium falciparum
KNKGFCGAMKKWNFSGKNKSHGT

SEQ ID NO: 3363135 - protein, 55 aa, Plasmodium falciparum
KNKGVWYNARTKCWLACVKGSGRHLRVFSVKKYGYKKAKMLAIECKNSVFYNEQN

SEQ ID NO: 3363136 - protein, 19 aa, Plasmodium falciparum
KNKIDNVFINRCSNNSYVR

SEQ ID NO: 3363137 - protein, 18 aa, Plasmodium falciparum
KNKIGKCIIEKMKQNVWK

SEQ ID NO: 3363138 - protein, 19 aa, Plasmodium falciparum
KNKIIRRVATLESKRNRNR

SEQ ID NO: 3363139 - protein, 29 aa, Plasmodium falciparum
KNKILCLIQLCSSDLCFVFNIHKLNGHIP

SEQ ID NO: 3363140 - protein, 18 aa, Plasmodium falciparum
KNKILKYIIHIFISDILK

SEQ ID NO: 3363141 - protein, 19 aa, Plasmodium falciparum
KNKILYELYVGNYIHNLYE

SEQ ID NO: 3363142 - protein, 24 aa, Plasmodium falciparum
KNKINIADICIKKLVDLLTALNEH

SEQ ID NO: 3363143 - protein, 23 aa, Plasmodium falciparum
KNKIPKKKIHVFKLNDNNTSRAT

SEQ ID NO: 3363144 - protein, 24 aa, Plasmodium falciparum
KNKKDIKKIVSYIRIKHVKNHNII

SEQ ID NO: 3363145 - protein, 37 aa, Plasmodium falciparum
KNKKFKDNYILVSHGVFTYCLIEAIIEFKEKELKYNI

SEQ ID NO: 3363146 - protein, 23 aa, Plasmodium falciparum
KNKKFPIIHYKINDFKYYIKNNI

SEQ ID NO: 3363147 - protein, 22 aa, Plasmodium falciparum
KNKKKNCIAEFLNLNEYDDNYE

SEQ ID NO: 3363148 - protein, 20 aa, Plasmodium falciparum
KNKKNVIIHRDIKPENLIID

SEQ ID NO: 3363149 - protein, 26 aa, Plasmodium falciparum
KNKKRNIYHLFLEYNQNVLLVQKYLK

SEQ ID NO: 3363150 - protein, 23 aa, Plasmodium falciparum
KNKKSARKSLHLKETPKDENEEE

SEQ ID NO: 3363151 - protein, 17 aa, Plasmodium falciparum
KNKKVVYVDGSFDIFHI

SEQ ID NO: 3363152 - protein, 33 aa, Plasmodium falciparum
KNKKYASKFFGCLVSLSKLLAWESRDVHKELQI

SEQ ID NO: 3363153 - protein, 24 aa, Plasmodium falciparum
KNKLLQSVTLDWSNLTLNSDGKED

SEQ ID NO: 3363154 - protein, 24 aa, Plasmodium falciparum
KNKLNCKTCIIYSYDNEGKNKKKI

SEQ ID NO: 3363155 - protein, 20 aa, Plasmodium falciparum
KNKMENIKEQNKIIIKENDS

SEQ ID NO: 3363156 - protein, 20 aa, Plasmodium falciparum
KNKMKYLIIKEQEELENYKK

SEQ ID NO: 3363157 - protein, 36 aa, Plasmodium falciparum
KNKNIWYRLNMKIFLYCWWYVEEVCFSDCTMNTLEY

SEQ ID NO: 3363158 - protein, 24 aa, Plasmodium falciparum
KNKNKQVICKNVIKKENDDHVDVN

SEQ ID NO: 3363159 - protein, 19 aa, Plasmodium falciparum
KNKNLKNGPSFSFFYEYAH

SEQ ID NO: 3363160 - protein, 23 aa, Plasmodium falciparum
KNKNRFVLEYDIAINERKHMKEI

SEQ ID NO: 3363161 - protein, 19 aa, Plasmodium falciparum
KNKNSSCWVNELNDINNMT

SEQ ID NO: 3363162 - protein, 23 aa, Plasmodium falciparum
KNKNVPFYLCNNSVEQNNNLIQV

SEQ ID NO: 3363163 - protein, 29 aa, Plasmodium falciparum
KNKNWRLRYSMYYCLKFFDHYFFFQNKEN

SEQ ID NO: 3363164 - protein, 30 aa, Plasmodium falciparum
KNKPFGGLILIKPKFLNIISNISVINNENY

SEQ ID NO: 3363165 - protein, 20 aa, Plasmodium falciparum
KNKQICIIKASLKNCSLKKS

SEQ ID NO: 3363166 - protein, 18 aa, Plasmodium falciparum
KNKQMNELYILKKEKEDI

SEQ ID NO: 3363167 - protein, 26 aa, Plasmodium falciparum
KNKRGHILRKTCSLNVIGGFLKSKEK

SEQ ID NO: 3363168 - protein, 23 aa, Plasmodium falciparum
KNKSELYKVHKLYNKSNQQYIKE

SEQ ID NO: 3363169 - protein, 19 aa, Plasmodium falciparum
KNKSEYFMKPDMKDKRYAN

SEQ ID NO: 3363170 - protein, 23 aa, Plasmodium falciparum
KNKSFRLNRYIFIKPIKSVKLNY

SEQ ID NO: 3363171 - protein, 26 aa, Plasmodium falciparum
KNKSIPCECTKCLEEKNTNKFMDTAN

SEQ ID NO: 3363172 - protein, 20 aa, Plasmodium falciparum
KNKTCIIMKYNIRNDFINSY

SEQ ID NO: 3363173 - protein, 17 aa, Plasmodium falciparum
KNKTIGLFHSKEVGSFK

SEQ ID NO: 3363174 - protein, 18 aa, Plasmodium falciparum
KNKTLSLCDDVDNLSEDM

SEQ ID NO: 3363175 - protein, 18 aa, Plasmodium falciparum
KNKTVFSIYSSIKNKSRN

SEQ ID NO: 3363176 - protein, 19 aa, Plasmodium falciparum
KNKVAGFVTHLMKRIQKGP

SEQ ID NO: 3363177 - protein, 24 aa, Plasmodium falciparum
KNKVRFLFFYLDRFVYSPILQILL

SEQ ID NO: 3363178 - protein, 23 aa, Plasmodium falciparum
KNKYIECSLGFDTTIFSYCQYIS

SEQ ID NO: 3363179 - protein, 24 aa, Plasmodium falciparum
KNKYKVACISKLFPTRSHTVAAQG

SEQ ID NO: 3363180 - protein, 27 aa, Plasmodium falciparum
KNKYLAEIIRCELIWGPTKNKEPITPV

SEQ ID NO: 3363181 - protein, 25 aa, Plasmodium falciparum
KNKYYGNKVHLCYYTNSVKDNYDMM

SEQ ID NO: 3363182 - protein, 17 aa, Plasmodium falciparum
KNLALKIWAFGPETIGP

SEQ ID NO: 3363183 - protein, 27 aa, Plasmodium falciparum
KNLCFIYPNKCNIILNFLSNNLRDDES

SEQ ID NO: 3363184 - protein, 21 aa, Plasmodium falciparum
KNLDIPLLIKKQLNLRDLRRK

SEQ ID NO: 3363185 - protein, 25 aa, Plasmodium falciparum
KNLDVRRMRKGFVLDNMNGEHVNSS

SEQ ID NO: 3363186 - protein, 24 aa, Plasmodium falciparum
KNLFETCHTLPFNGINCLFWNPIY

SEQ ID NO: 3363187 - protein, 17 aa, Plasmodium falciparum
KNLFGFPNLMKNSVSAE

SEQ ID NO: 3363188 - protein, 17 aa, Plasmodium falciparum
KNLFYSEFLFDYNPWND

SEQ ID NO: 3363189 - protein, 23 aa, Plasmodium falciparum
KNLIFLKRIQQYFYQKYINIKFS

SEQ ID NO: 3363190 - protein, 18 aa, Plasmodium falciparum
KNLIHIFNNINLKLININ

SEQ ID NO: 3363191 - protein, 20 aa, Plasmodium falciparum
KNLIKKCLDMFSELAENKEN

SEQ ID NO: 3363192 - protein, 17 aa, Plasmodium falciparum
KNLIRRNILNVVDTSNM

SEQ ID NO: 3363193 - protein, 24 aa, Plasmodium falciparum
KNLIYELIFIKGLIYKRNGNYLGA

SEQ ID NO: 3363194 - protein, 30 aa, Plasmodium falciparum
KNLIYKWQKKLFICEIELLKNNNQILTNQI

SEQ ID NO: 3363195 - protein, 18 aa, Plasmodium falciparum
KNLKQAHTTPCPKLPPCY

SEQ ID NO: 3363196 - protein, 18 aa, Plasmodium falciparum
KNLKRMRSIIKNKKKYLE

SEQ ID NO: 3363197 - protein, 30 aa, Plasmodium falciparum
KNLLAKGKKYIVCYNYLGKIQVKVFPADVY

SEQ ID NO: 3363198 - protein, 20 aa, Plasmodium falciparum
KNLLLLIKSFAYKGIKLENI

SEQ ID NO: 3363199 - protein, 18 aa, Plasmodium falciparum
KNLLLSNRLNDYDMDNIK

SEQ ID NO: 3363200 - protein, 25 aa, Plasmodium falciparum
KNLLSEMKRKLILLYNKGICCNYIK

SEQ ID NO: 3363201 - protein, 19 aa, Plasmodium falciparum
KNLLTKGELEQIFIKESKG

SEQ ID NO: 3363202 - protein, 17 aa, Plasmodium falciparum
KNLNCAFLSTTEYIDDN

SEQ ID NO: 3363203 - protein, 25 aa, Plasmodium falciparum
KNLNPSLCLEKLFLQSIIYIFSNIL

SEQ ID NO: 3363204 - protein, 17 aa, Plasmodium falciparum
KNLPLKDRLATVRNVQN

SEQ ID NO: 3363205 - protein, 27 aa, Plasmodium falciparum
KNLQKKIKCFESFYEICPTKYNEVLTC

SEQ ID NO: 3363206 - protein, 26 aa, Plasmodium falciparum
KNLRECFESICICMFDYMCNLNSVEL

SEQ ID NO: 3363207 - protein, 26 aa, Plasmodium falciparum
KNLSQLVHFYKCFKQFKEHEHTYQFV

SEQ ID NO: 3363208 - protein, 24 aa, Plasmodium falciparum
KNLSRLNLNLLLPTKKKVKKSKNS

SEQ ID NO: 3363209 - protein, 24 aa, Plasmodium falciparum
KNLTFKRKIFLDKFNKHDKEVLIK

SEQ ID NO: 3363210 - protein, 19 aa, Plasmodium falciparum
KNLTNEDKLRMAVHMQKNH

SEQ ID NO: 3363211 - protein, 20 aa, Plasmodium falciparum
KNLVDCYYLLLKKFKTKSSY

SEQ ID NO: 3363212 - protein, 18 aa, Plasmodium falciparum
KNLVEMILRNNKPSIDKN

SEQ ID NO: 3363213 - protein, 19 aa, Plasmodium falciparum
KNLWLKYIEVELINKNINS

SEQ ID NO: 3363214 - protein, 22 aa, Plasmodium falciparum
KNLWRRVYNSADIDYIYIKSDI

SEQ ID NO: 3363215 - protein, 18 aa, Plasmodium falciparum
KNLYLMRKVEFIKILSMK

SEQ ID NO: 3363216 - protein, 21 aa, Plasmodium falciparum
KNLYSTNNFVYVIFKRQVYKI

SEQ ID NO: 3363217 - protein, 24 aa, Plasmodium falciparum
KNLYTKKIEYVGCKHTEELHLFLT

SEQ ID NO: 3363218 - protein, 17 aa, Plasmodium falciparum
KNLYYCSKCGLSKYCNC

SEQ ID NO: 3363219 - protein, 19 aa, Plasmodium falciparum
KNMAFAFGVSEEFIENEIS

SEQ ID NO: 3363220 - protein, 28 aa, Plasmodium falciparum
KNMFYFKCPYCLWSSINTVCKPKLEDLI

SEQ ID NO: 3363221 - protein, 21 aa, Plasmodium falciparum
KNMHLKKKQSVILNSLGNKND

SEQ ID NO: 3363222 - protein, 19 aa, Plasmodium falciparum
KNMHVPLNLTRINGNNSGQ

SEQ ID NO: 3363223 - protein, 18 aa, Plasmodium falciparum
KNMLNGNGILLLEDNINN

SEQ ID NO: 3363224 - protein, 17 aa, Plasmodium falciparum
KNMNCFNNNNSNSLEIL

SEQ ID NO: 3363225 - protein, 18 aa, Plasmodium falciparum
KNMNLKYNILKINKYILS

SEQ ID NO: 3363226 - protein, 37 aa, Plasmodium falciparum
KNMNNWKFSHLKGGNFKSAKFLKWIDDDNMLHNDDDN

SEQ ID NO: 3363227 - protein, 22 aa, Plasmodium falciparum
KNMNYPFCKAPCNIENLRNTIF

SEQ ID NO: 3363228 - protein, 17 aa, Plasmodium falciparum
KNMPSNESCLFNKINNA

SEQ ID NO: 3363229 - protein, 19 aa, Plasmodium falciparum
KNMRLFCDFVEKNNDKQYF

SEQ ID NO: 3363230 - protein, 17 aa, Plasmodium falciparum
KNMTCIENIASVQTTAT

SEQ ID NO: 3363231 - protein, 25 aa, Plasmodium falciparum
KNMTLRILIEVYLRRLQINNFSIIC

SEQ ID NO: 3363232 - protein, 33 aa, Plasmodium falciparum
KNMVKLKYLNKFLGKRSGPSIKNNMNDMMVKMN

SEQ ID NO: 3363233 - protein, 23 aa, Plasmodium falciparum
KNMYDFNIKISYLEIYNEELCDL

SEQ ID NO: 3363234 - protein, 20 aa, Plasmodium falciparum
KNNCTVCGVFRRQSFEKGAL

SEQ ID NO: 3363235 - protein, 27 aa, Plasmodium falciparum
KNNDFKINMGILCCFTFKNTKNPEHFL

SEQ ID NO: 3363236 - protein, 24 aa, Plasmodium falciparum
KNNEIKKKIYIYGYDIYNVRNNIV

SEQ ID NO: 3363237 - protein, 21 aa, Plasmodium falciparum
KNNELIYILYIYKYHNYLNPF

SEQ ID NO: 3363238 - protein, 20 aa, Plasmodium falciparum
KNNELLSGIICKRTVGSSSG

SEQ ID NO: 3363239 - protein, 30 aa, Plasmodium falciparum
KNNELVLCRFCQKYDYKIQWIKENHGSKMK

SEQ ID NO: 3363240 - protein, 28 aa, Plasmodium falciparum
KNNENYIPLDIALNFVMDNEKLKKNLQK

SEQ ID NO: 3363241 - protein, 25 aa, Plasmodium falciparum
KNNEYKSTSFIGGKKFKKSSTISNF

SEQ ID NO: 3363242 - protein, 25 aa, Plasmodium falciparum
KNNEYSNECLIHLKELNLFNFTAVI

SEQ ID NO: 3363243 - protein, 43 aa, Plasmodium falciparum
KNNFDFISSIYLSFALCLIYKLDACIQFSSYVLIRIIHFQNFL

SEQ ID NO: 3363244 - protein, 18 aa, Plasmodium falciparum
KNNFFVMMDEHLLDIITH

SEQ ID NO: 3363245 - protein, 22 aa, Plasmodium falciparum
KNNFGNDGCSLFVNKKKFTLIE

SEQ ID NO: 3363246 - protein, 18 aa, Plasmodium falciparum
KNNFLENLIEEFMDLFIV

SEQ ID NO: 3363247 - protein, 17 aa, Plasmodium falciparum
KNNFLIEEVYDFKNLKN

SEQ ID NO: 3363248 - protein, 17 aa, Plasmodium falciparum
KNNFNNLGFSKNKEMNI

SEQ ID NO: 3363249 - protein, 17 aa, Plasmodium falciparum
KNNFNWVLWDELITTNH

SEQ ID NO: 3363250 - protein, 20 aa, Plasmodium falciparum
KNNHIMNIGKNMTIPIIKKK

SEQ ID NO: 3363251 - protein, 17 aa, Plasmodium falciparum
KNNICTYLDHESTNING

SEQ ID NO: 3363252 - protein, 29 aa, Plasmodium falciparum
KNNIFLKYFFSFSGGRFIKTFIDYNKNKA

SEQ ID NO: 3363253 - protein, 19 aa, Plasmodium falciparum
KNNIINIYFCIVKEEEEKH

SEQ ID NO: 3363254 - protein, 24 aa, Plasmodium falciparum
KNNIMIKKCNSLVLPTLNNKNEIC

SEQ ID NO: 3363255 - protein, 20 aa, Plasmodium falciparum
KNNINCVKNNEVIIMDDKNN

SEQ ID NO: 3363256 - protein, 24 aa, Plasmodium falciparum
KNNIPYFNFFVNYFEAVVHMNIHC

SEQ ID NO: 3363257 - protein, 21 aa, Plasmodium falciparum
KNNKCISHWLTKPCDISDVLK

SEQ ID NO: 3363258 - protein, 32 aa, Plasmodium falciparum
KNNKDAIILFECIKCIFELAIYDQEGKNTTTV

SEQ ID NO: 3363259 - protein, 38 aa, Plasmodium falciparum
KNNKDKICMQRFYYSNDYLRPVICEYKSFNKHIYNSKI

SEQ ID NO: 3363260 - protein, 32 aa, Plasmodium falciparum
KNNKIELLMCKLLHCVLNNFISIFTLLHGHIR

SEQ ID NO: 3363261 - protein, 20 aa, Plasmodium falciparum
KNNKKLKCSKKEQNMEENNS

SEQ ID NO: 3363262 - protein, 24 aa, Plasmodium falciparum
KNNKLCKYILAKIKEIKYNKTYME

SEQ ID NO: 3363263 - protein, 26 aa, Plasmodium falciparum
KNNKLKFLICQMKKLKLYDEQNENVQ

SEQ ID NO: 3363264 - protein, 24 aa, Plasmodium falciparum
KNNKVITCFDGLYVDKEYQKYFVL

SEQ ID NO: 3363265 - protein, 18 aa, Plasmodium falciparum
KNNLIDILDKELKKNCNN

SEQ ID NO: 3363266 - protein, 23 aa, Plasmodium falciparum
KNNLIWYKLFTKVFLGNFKKGNI

SEQ ID NO: 3363267 - protein, 26 aa, Plasmodium falciparum
KNNLIYFPYISNFVLDGLVNIHISHN

SEQ ID NO: 3363268 - protein, 19 aa, Plasmodium falciparum
KNNLKAVVCFGESLEQREQ

SEQ ID NO: 3363269 - protein, 19 aa, Plasmodium falciparum
KNNLKKVVPKRRKQENKSN

SEQ ID NO: 3363270 - protein, 23 aa, Plasmodium falciparum
KNNLRITFSSVHFDNEGNKISDN

SEQ ID NO: 3363271 - protein, 18 aa, Plasmodium falciparum
KNNLRNVFLIKKMEDDSN

SEQ ID NO: 3363272 - protein, 20 aa, Plasmodium falciparum
KNNMCKPTYEKNERTKIILT

SEQ ID NO: 3363273 - protein, 25 aa, Plasmodium falciparum
KNNMKCKYHLIPILKNYTLKNNSNC

SEQ ID NO: 3363274 - protein, 18 aa, Plasmodium falciparum
KNNNGNKCTYEKGEEKNK

SEQ ID NO: 3363275 - protein, 25 aa, Plasmodium falciparum
KNNNLREAIKIYSNWPYIPNLYVNN

SEQ ID NO: 3363276 - protein, 19 aa, Plasmodium falciparum
KNNNWYGVIHMRECCANYL

SEQ ID NO: 3363277 - protein, 23 aa, Plasmodium falciparum
KNNSDIIIREPFFKTSKYGKQNE

SEQ ID NO: 3363278 - protein, 19 aa, Plasmodium falciparum
KNNSFPIMYKKINEDISRG

SEQ ID NO: 3363279 - protein, 17 aa, Plasmodium falciparum
KNNSIHLNQMFTKNTIT

SEQ ID NO: 3363280 - protein, 18 aa, Plasmodium falciparum
KNNSILCFHNLKDNIIWN

SEQ ID NO: 3363281 - protein, 24 aa, Plasmodium falciparum
KNNSYYSNFFFKNDSDNLFDDLAV

SEQ ID NO: 3363282 - protein, 40 aa, Plasmodium falciparum
KNNTICSNCLYAYKIQICKRVEMFNFFGGKNDGLDKDALK

SEQ ID NO: 3363283 - protein, 18 aa, Plasmodium falciparum
KNNVERNLAIGIYHKFMK

SEQ ID NO: 3363284 - protein, 18 aa, Plasmodium falciparum
KNNVFRLEFENILDEFMK

SEQ ID NO: 3363285 - protein, 19 aa, Plasmodium falciparum
KNNVIPKIPVGIEKRERYK

SEQ ID NO: 3363286 - protein, 17 aa, Plasmodium falciparum
KNNVLHCYTNLSKIPYI

SEQ ID NO: 3363287 - protein, 25 aa, Plasmodium falciparum
KNNVLKAFMCWRCDKVKQTNVKVHW

SEQ ID NO: 3363288 - protein, 19 aa, Plasmodium falciparum
KNNVQRFMDELSKENKLQC

SEQ ID NO: 3363289 - protein, 28 aa, Plasmodium falciparum
KNNVTYCIWDSKKLKVQDLLSMNEDLTS

SEQ ID NO: 3363290 - protein, 23 aa, Plasmodium falciparum
KNNYEPMNFKSFDDITMSEMDQD

SEQ ID NO: 3363291 - protein, 22 aa, Plasmodium falciparum
KNPDFPFIIAAVNASFNVIELW

SEQ ID NO: 3363292 - protein, 20 aa, Plasmodium falciparum
KNPEVILTLHILKNAKRYFA

SEQ ID NO: 3363293 - protein, 25 aa, Plasmodium falciparum
KNPKAARIPSFYPKINMNNSMFNYH

SEQ ID NO: 3363294 - protein, 35 aa, Plasmodium falciparum
KNPKGKEIIDTLNIHKRTPLIYQLMKNDIYTYEKK

SEQ ID NO: 3363295 - protein, 17 aa, Plasmodium falciparum
KNPLCKITNVYESETRK

SEQ ID NO: 3363296 - protein, 24 aa, Plasmodium falciparum
KNPLICIMNNFLYFLLLSEYLNFN

SEQ ID NO: 3363297 - protein, 21 aa, Plasmodium falciparum
KNPLKEEIRHLKLKSKNSIVK

SEQ ID NO: 3363298 - protein, 21 aa, Plasmodium falciparum
KNPLYFYSIFDGHRGIKACEY

SEQ ID NO: 3363299 - protein, 25 aa, Plasmodium falciparum
KNPTKKRMYKLKKIVEILEYTIYNE

SEQ ID NO: 3363300 - protein, 27 aa, Plasmodium falciparum
KNPYISMYVHPCGDFLYASNRNENILK

SEQ ID NO: 3363301 - protein, 17 aa, Plasmodium falciparum
KNQECYNKMKISHHNNI

SEQ ID NO: 3363302 - protein, 20 aa, Plasmodium falciparum
KNQEGCKMLEEYENAKYVEE

SEQ ID NO: 3363303 - protein, 18 aa, Plasmodium falciparum
KNQNLCSRLFLLQYNGYI

SEQ ID NO: 3363304 - protein, 23 aa, Plasmodium falciparum
KNQRLAVKVSSLFKNIKNMMLSI

SEQ ID NO: 3363305 - protein, 21 aa, Plasmodium falciparum
KNRCAVVVNGYFEWMGNEGSS

SEQ ID NO: 3363306 - protein, 17 aa, Plasmodium falciparum
KNRDQKMNFIINKINKK

SEQ ID NO: 3363307 - protein, 18 aa, Plasmodium falciparum
KNRFNIWDEYLLTTEEFY

SEQ ID NO: 3363308 - protein, 17 aa, Plasmodium falciparum
KNRGFAFVEYVEVDDAK

SEQ ID NO: 3363309 - protein, 39 aa, Plasmodium falciparum
KNRKCLNEHKITYICKGLFYYYWLCYSMEEQKKCSLKIC

SEQ ID NO: 3363310 - protein, 21 aa, Plasmodium falciparum
KNRLNISLKIILDRKKQEKEY

SEQ ID NO: 3363311 - protein, 21 aa, Plasmodium falciparum
KNRRRGSTYLGAIGAYNNSNN

SEQ ID NO: 3363312 - protein, 18 aa, Plasmodium falciparum
KNRSFSHRIASIFRHKKF

SEQ ID NO: 3363313 - protein, 18 aa, Plasmodium falciparum
KNRSSCDNIMNKKKNNLH

SEQ ID NO: 3363314 - protein, 17 aa, Plasmodium falciparum
KNRSSCYGKTYDYINHI

SEQ ID NO: 3363315 - protein, 24 aa, Plasmodium falciparum
KNRYKDKRMFLLFTQIIKEKCEGF

SEQ ID NO: 3363316 - protein, 17 aa, Plasmodium falciparum
KNSEIIIKMQELIQDFR

SEQ ID NO: 3363317 - protein, 18 aa, Plasmodium falciparum
KNSEIVGTLITDSNITDS

SEQ ID NO: 3363318 - protein, 25 aa, Plasmodium falciparum
KNSELKNNYDFVKYSSNLKDGDHSN

SEQ ID NO: 3363319 - protein, 31 aa, Plasmodium falciparum
KNSFCVYDPHKLRKAFLSEYFLEDIKNLYST

SEQ ID NO: 3363320 - protein, 24 aa, Plasmodium falciparum
KNSFDHINPSTLYDFILSTNNANN

SEQ ID NO: 3363321 - protein, 18 aa, Plasmodium falciparum
KNSFFITYSYWKYMSKKE

SEQ ID NO: 3363322 - protein, 19 aa, Plasmodium falciparum
KNSFIIRPFNVVENHRIYC

SEQ ID NO: 3363323 - protein, 19 aa, Plasmodium falciparum
KNSFLNVIIFYSPQKKNLV

SEQ ID NO: 3363324 - protein, 18 aa, Plasmodium falciparum
KNSFVLCFSEKYGKLIFS

SEQ ID NO: 3363325 - protein, 25 aa, Plasmodium falciparum
KNSFWKYKKRFFSKKLVNIGILAHI

SEQ ID NO: 3363326 - protein, 18 aa, Plasmodium falciparum
KNSGLCFIPCDNKKVFIY

SEQ ID NO: 3363327 - protein, 18 aa, Plasmodium falciparum
KNSIDIVNTHISMVSDEV

SEQ ID NO: 3363328 - protein, 20 aa, Plasmodium falciparum
KNSIPFNFFHMVNNIYVTNK

SEQ ID NO: 3363329 - protein, 19 aa, Plasmodium falciparum
KNSKLIFNICNVYNKVMAL

SEQ ID NO: 3363330 - protein, 23 aa, Plasmodium falciparum
KNSLDYYKKVIIKLKNNINNMEE

SEQ ID NO: 3363331 - protein, 24 aa, Plasmodium falciparum
KNSLEGNCLVVMIANINPSRTSFQ

SEQ ID NO: 3363332 - protein, 26 aa, Plasmodium falciparum
KNSLENYRHLFFCTTCYTPIGYLENN

SEQ ID NO: 3363333 - protein, 21 aa, Plasmodium falciparum
KNSLISMGICLGKFTKTNNFF

SEQ ID NO: 3363334 - protein, 18 aa, Plasmodium falciparum
KNSLQWRYKLMTNHENQE

SEQ ID NO: 3363335 - protein, 19 aa, Plasmodium falciparum
KNSMFGESNMNSMNNMNSM

SEQ ID NO: 3363336 - protein, 19 aa, Plasmodium falciparum
KNSMNVINGMNIINGLNNM

SEQ ID NO: 3363337 - protein, 25 aa, Plasmodium falciparum
KNSNLWYHPSLVFRFDKKDPYYPSR

SEQ ID NO: 3363338 - protein, 25 aa, Plasmodium falciparum
KNSNRAVVMPLKNKIIYINDANITN

SEQ ID NO: 3363339 - protein, 38 aa, Plasmodium falciparum
KNSQRWFGEHKINGVKCAQSFAVKKHGCEEAKRLAIEW

SEQ ID NO: 3363340 - protein, 22 aa, Plasmodium falciparum
KNSRIKINIHKQFLHVTDFLYH

SEQ ID NO: 3363341 - protein, 18 aa, Plasmodium falciparum
KNSSINIINQNIDNSVVH

SEQ ID NO: 3363342 - protein, 24 aa, Plasmodium falciparum
KNSTNPRSSVILKNGEHNVLSTYN

SEQ ID NO: 3363343 - protein, 18 aa, Plasmodium falciparum
KNSVCSIVEKSKDILISG

SEQ ID NO: 3363344 - protein, 25 aa, Plasmodium falciparum
KNTAGMPYKGYVWNKNANKVLDRHE

SEQ ID NO: 3363345 - protein, 22 aa, Plasmodium falciparum
KNTFDFFKDLIISNNQDTIHTP

SEQ ID NO: 3363346 - protein, 18 aa, Plasmodium falciparum
KNTFFAFLKKQKYKSVRN

SEQ ID NO: 3363347 - protein, 22 aa, Plasmodium falciparum
KNTGGGCKKLFRKIKDRSSEYC

SEQ ID NO: 3363348 - protein, 29 aa, Plasmodium falciparum
KNTGNRFKWEYLDVCGNIQEGKDRATAMG

SEQ ID NO: 3363349 - protein, 20 aa, Plasmodium falciparum
KNTINYFGVPIKLKRSKQRI

SEQ ID NO: 3363350 - protein, 24 aa, Plasmodium falciparum
KNTKFKNVICIGIGGSYLGTEFVY

SEQ ID NO: 3363351 - protein, 20 aa, Plasmodium falciparum
KNTKKGFLIDEDNIINKIKE

SEQ ID NO: 3363352 - protein, 18 aa, Plasmodium falciparum
KNTLDIVHNVINKKISYD

SEQ ID NO: 3363353 - protein, 53 aa, Plasmodium falciparum
KNTPDKWKEDMFRFFNIPLRSSISVRDLRIERAVPRSSAAEFKKMKKLNKNYQ

SEQ ID NO: 3363354 - protein, 25 aa, Plasmodium falciparum
KNTQGGGNISNIWVNFDNTVQNKEL

SEQ ID NO: 3363355 - protein, 24 aa, Plasmodium falciparum
KNTTSLFKRFKIFGKTKNAPKGEV

SEQ ID NO: 3363356 - protein, 26 aa, Plasmodium falciparum
KNTYIKELYKRSGDYDNFSIHTDDTS

SEQ ID NO: 3363357 - protein, 24 aa, Plasmodium falciparum
KNTYKKLTSYNECPVDLYRDNNKT

SEQ ID NO: 3363358 - protein, 19 aa, Plasmodium falciparum
KNTYLKVNFFNNKNKDNNY

SEQ ID NO: 3363359 - protein, 24 aa, Plasmodium falciparum
KNVEFKRAHFLLTYNKLKEMRKDI

SEQ ID NO: 3363360 - protein, 30 aa, Plasmodium falciparum
KNVERSLPYFNWLVSIVLDNKIDMESFKHC

SEQ ID NO: 3363361 - protein, 18 aa, Plasmodium falciparum
KNVFFYGFMFTKYYNKYK

SEQ ID NO: 3363362 - protein, 19 aa, Plasmodium falciparum
KNVFKKYSRTIFRNTNISF

SEQ ID NO: 3363363 - protein, 20 aa, Plasmodium falciparum
KNVFQFFGLNVEKLKNFELK

SEQ ID NO: 3363364 - protein, 20 aa, Plasmodium falciparum
KNVHHKRSSSSNVNIRKLET

SEQ ID NO: 3363365 - protein, 17 aa, Plasmodium falciparum
KNVHLFEKYPNIPIKKE

SEQ ID NO: 3363366 - protein, 22 aa, Plasmodium falciparum
KNVIKNIPAVKCSDKNTKEINK

SEQ ID NO: 3363367 - protein, 19 aa, Plasmodium falciparum
KNVIKNVQFDKIIEQQNDA

SEQ ID NO: 3363368 - protein, 23 aa, Plasmodium falciparum
KNVILKEYFKAILKKIYENFQKN

SEQ ID NO: 3363369 - protein, 25 aa, Plasmodium falciparum
KNVKCVRFSPIISHLKIGSHIIDNS

SEQ ID NO: 3363370 - protein, 17 aa, Plasmodium falciparum
KNVKDKAVLVFSYHLTK

SEQ ID NO: 3363371 - protein, 19 aa, Plasmodium falciparum
KNVKETKEEFSFYDESTTY

SEQ ID NO: 3363372 - protein, 23 aa, Plasmodium falciparum
KNVKRKINFVRYKSSGGMYYYTQ

SEQ ID NO: 3363373 - protein, 24 aa, Plasmodium falciparum
KNVKSFCLAFYYALNKKHAEAHVL

SEQ ID NO: 3363374 - protein, 31 aa, Plasmodium falciparum
KNVLKFINKPLLRWGSANINRIPKYVINGFL

SEQ ID NO: 3363375 - protein, 33 aa, Plasmodium falciparum
KNVLKSGIPKKASWLPKSDKYFLTGHNNCIYIW

SEQ ID NO: 3363376 - protein, 27 aa, Plasmodium falciparum
KNVNCNYELINKNLLKVAANNINNLNN

SEQ ID NO: 3363377 - protein, 20 aa, Plasmodium falciparum
KNVNFFKNALSLLIVDDNKG

SEQ ID NO: 3363378 - protein, 31 aa, Plasmodium falciparum
KNVNKYFHIYKHGIIKVFNFDFANMDANEKD

SEQ ID NO: 3363379 - protein, 36 aa, Plasmodium falciparum
KNVPINTFNNTNCHFVKNRNKEVITTTYNDNINIYD

SEQ ID NO: 3363380 - protein, 23 aa, Plasmodium falciparum
KNVPQNFFSYAFYISKNAKVNSI

SEQ ID NO: 3363381 - protein, 24 aa, Plasmodium falciparum
KNVRKRYGISFTNLMSIIYENMHE

SEQ ID NO: 3363382 - protein, 17 aa, Plasmodium falciparum
KNVRLVGKVLKKDGNEL

SEQ ID NO: 3363383 - protein, 18 aa, Plasmodium falciparum
KNVSVQGGEECNENIESM

SEQ ID NO: 3363384 - protein, 25 aa, Plasmodium falciparum
KNVSVWRLVKFRSKCRNDDLILTKW

SEQ ID NO: 3363385 - protein, 29 aa, Plasmodium falciparum
KNVTKNKMKTIFSKKICSNENGKDHKGVV

SEQ ID NO: 3363386 - protein, 23 aa, Plasmodium falciparum
KNVWKEFNFKYMENIYGCQYISW

SEQ ID NO: 3363387 - protein, 18 aa, Plasmodium falciparum
KNVYKIYIMKSEGNYTRH

SEQ ID NO: 3363388 - protein, 21 aa, Plasmodium falciparum
KNVYRKYLKNLLVCDKKCSIE

SEQ ID NO: 3363389 - protein, 25 aa, Plasmodium falciparum
KNWFLKRRLNMEINYSLKKLFDSYN

SEQ ID NO: 3363390 - protein, 18 aa, Plasmodium falciparum
KNWLKPLVGKSMQNYYFP

SEQ ID NO: 3363391 - protein, 21 aa, Plasmodium falciparum
KNYFVKSYKNSHYKRKKGNSH

SEQ ID NO: 3363392 - protein, 19 aa, Plasmodium falciparum
KNYINMILLFSNCQTLYDF

SEQ ID NO: 3363393 - protein, 23 aa, Plasmodium falciparum
KNYKFLLHRYIQLYNVNEEHYEE

SEQ ID NO: 3363394 - protein, 17 aa, Plasmodium falciparum
KNYKIKKYQLINENLQD

SEQ ID NO: 3363395 - protein, 17 aa, Plasmodium falciparum
KNYKLNWIFPNNFPDRE

SEQ ID NO: 3363396 - protein, 17 aa, Plasmodium falciparum
KNYKVVPHSISYSDDGN

SEQ ID NO: 3363397 - protein, 18 aa, Plasmodium falciparum
KNYLNSMYNLLSTELSEP

SEQ ID NO: 3363398 - protein, 39 aa, Plasmodium falciparum
KNYMCCKKCDKKRCIFHYVNGFKLYGWLNYKWTDPDGFL

SEQ ID NO: 3363399 - protein, 31 aa, Plasmodium falciparum
KNYMIFSLNLKRCIFLNGEIKDHVHIQNDRR

SEQ ID NO: 3363400 - protein, 18 aa, Plasmodium falciparum
KNYNFVFIRYVEYKIILC

SEQ ID NO: 3363401 - protein, 30 aa, Plasmodium falciparum
KNYNIKLGWWNFGKPLKIFSNIEKYKQNIK

SEQ ID NO: 3363402 - protein, 25 aa, Plasmodium falciparum
KNYNLKKACTFHGYSRNHQKNMYTE

SEQ ID NO: 3363403 - protein, 17 aa, Plasmodium falciparum
KNYPYGNLPNIYYPDGY

SEQ ID NO: 3363404 - protein, 17 aa, Plasmodium falciparum
KNYQLKTNLGRSFINEL

SEQ ID NO: 3363405 - protein, 26 aa, Plasmodium falciparum
KNYSKEELIHIIALLKKENQRLKMCD

SEQ ID NO: 3363406 - protein, 17 aa, Plasmodium falciparum
KNYSLFIRKEIFDHAII

SEQ ID NO: 3363407 - protein, 20 aa, Plasmodium falciparum
KNYYYYVKCQKTFSDKKRLV

SEQ ID NO: 3363408 - protein, 22 aa, Plasmodium falciparum
KPAKAPTILRWIDLLRSMKLKQ

SEQ ID NO: 3363409 - protein, 36 aa, Plasmodium falciparum
KPARIKLYLCDHLRTCAKHVFNRPSIYISNNNGMEN

SEQ ID NO: 3363410 - protein, 19 aa, Plasmodium falciparum
KPCEFKKILICCGPGNNGG

SEQ ID NO: 3363411 - protein, 19 aa, Plasmodium falciparum
KPDEKVCSSNTDSQKKSDG

SEQ ID NO: 3363412 - protein, 20 aa, Plasmodium falciparum
KPDIRRIIHYGFARSLEAYV

SEQ ID NO: 3363413 - protein, 21 aa, Plasmodium falciparum
KPDMRIEGIILGFDEYMNMVL

SEQ ID NO: 3363414 - protein, 21 aa, Plasmodium falciparum
KPEHFILLINLYCRVNIFPRV

SEQ ID NO: 3363415 - protein, 17 aa, Plasmodium falciparum
KPELLKIDNFKIIHKNI

SEQ ID NO: 3363416 - protein, 17 aa, Plasmodium falciparum
KPEMSFFVYISDVELIM

SEQ ID NO: 3363417 - protein, 18 aa, Plasmodium falciparum
KPFLKPIYLSIFRLFEIR

SEQ ID NO: 3363418 - protein, 39 aa, Plasmodium falciparum
KPFSNPIPLPIGSIFKAGQCKIEVCSHDSAQFIQYPERS

SEQ ID NO: 3363419 - protein, 19 aa, Plasmodium falciparum
KPGEEIGALCTLNNNEKSM

SEQ ID NO: 3363420 - protein, 19 aa, Plasmodium falciparum
KPGILFMSLKCYKRKKMYY

SEQ ID NO: 3363421 - protein, 20 aa, Plasmodium falciparum
KPGKCFRLYTEKCFEETLPE

SEQ ID NO: 3363422 - protein, 20 aa, Plasmodium falciparum
KPGQRKVLYGCFKRNLRNEC

SEQ ID NO: 3363423 - protein, 22 aa, Plasmodium falciparum
KPHEKLNIGILFTGQQTPGGHN

SEQ ID NO: 3363424 - protein, 25 aa, Plasmodium falciparum
KPHKSSIKDVAWKPNLDNSANIIAS

SEQ ID NO: 3363425 - protein, 18 aa, Plasmodium falciparum
KPHLRKYTKEYIKNKLKY

SEQ ID NO: 3363426 - protein, 18 aa, Plasmodium falciparum
KPINEAPVVERMHLSITS

SEQ ID NO: 3363427 - protein, 18 aa, Plasmodium falciparum
KPINVLNAFEIFDEKGNG

SEQ ID NO: 3363428 - protein, 19 aa, Plasmodium falciparum
KPIYVFDGAPPELKGSELE

SEQ ID NO: 3363429 - protein, 21 aa, Plasmodium falciparum
KPKFEPFIWKQHTDLLDLCLR

SEQ ID NO: 3363430 - protein, 18 aa, Plasmodium falciparum
KPKIAWWTSYALNKRPIL

SEQ ID NO: 3363431 - protein, 21 aa, Plasmodium falciparum
KPKKCHLECKKNCPIVKTGKF

SEQ ID NO: 3363432 - protein, 20 aa, Plasmodium falciparum
KPKLLELFQMEGFQKQLDRL

SEQ ID NO: 3363433 - protein, 22 aa, Plasmodium falciparum
KPKMYSLWWDVMKNEKKKYNLT

SEQ ID NO: 3363434 - protein, 29 aa, Plasmodium falciparum
KPKRRRTKHCIKRQRILQKKIKVNLFKKK

SEQ ID NO: 3363435 - protein, 22 aa, Plasmodium falciparum
KPKTLVINLEYALRYMKNSNSG

SEQ ID NO: 3363436 - protein, 26 aa, Plasmodium falciparum
KPKWHFPYKLYRVILGHSGWVNCVDV

SEQ ID NO: 3363437 - protein, 19 aa, Plasmodium falciparum
KPLLDLTCGKIASMMKDKT

SEQ ID NO: 3363438 - protein, 21 aa, Plasmodium falciparum
KPLLIHLFEQIAICKKFNEKL

SEQ ID NO: 3363439 - protein, 19 aa, Plasmodium falciparum
KPLLTFRNINIILFLLHKY

SEQ ID NO: 3363440 - protein, 19 aa, Plasmodium falciparum
KPLLYNSGHSYQMIKINNL

SEQ ID NO: 3363441 - protein, 18 aa, Plasmodium falciparum
KPLLYYSLHTCIVGDNEY

SEQ ID NO: 3363442 - protein, 24 aa, Plasmodium falciparum
KPLMADIRFLNLLFDFSKNEKDNI

SEQ ID NO: 3363443 - protein, 17 aa, Plasmodium falciparum
KPLNEVLYNVSYNDSCK

SEQ ID NO: 3363444 - protein, 24 aa, Plasmodium falciparum
KPLSNRINVILSRTLKKEDFDEDV

SEQ ID NO: 3363445 - protein, 28 aa, Plasmodium falciparum
KPLVPLRRIPKNRGTVVRNVTEINPLSE

SEQ ID NO: 3363446 - protein, 21 aa, Plasmodium falciparum
KPLWICSDGFIYLEMFNSCSK

SEQ ID NO: 3363447 - protein, 21 aa, Plasmodium falciparum
KPLYIKVSIVAKHLCINMRGV

SEQ ID NO: 3363448 - protein, 24 aa, Plasmodium falciparum
KPMPDLRNTKLCDFVKKKIPCRDI

SEQ ID NO: 3363449 - protein, 19 aa, Plasmodium falciparum
KPNNVIHFMVDFLCKHYPE

SEQ ID NO: 3363450 - protein, 18 aa, Plasmodium falciparum
KPPHFTAFMGYKAGMTHI

SEQ ID NO: 3363451 - protein, 17 aa, Plasmodium falciparum
KPPLCGREHIFFRSYYH

SEQ ID NO: 3363452 - protein, 18 aa, Plasmodium falciparum
KPRGIDCRVRRRYKGTNL

SEQ ID NO: 3363453 - protein, 23 aa, Plasmodium falciparum
KPRYENLDNFPMQYINTHDNDDS

SEQ ID NO: 3363454 - protein, 19 aa, Plasmodium falciparum
KPSEAYAANCVIYKNDITN

SEQ ID NO: 3363455 - protein, 24 aa, Plasmodium falciparum
KPSEKFRNIFNFEWDQSEDTSRND

SEQ ID NO: 3363456 - protein, 21 aa, Plasmodium falciparum
KPSKRGIGFSFGTDITENFLK

SEQ ID NO: 3363457 - protein, 19 aa, Plasmodium falciparum
KPSPNRYVPYESDRYKGKR

SEQ ID NO: 3363458 - protein, 18 aa, Plasmodium falciparum
KPSVCSLNADGNENTEKI

SEQ ID NO: 3363459 - protein, 19 aa, Plasmodium falciparum
KPSYGRISRYGIIPYNEET

SEQ ID NO: 3363460 - protein, 30 aa, Plasmodium falciparum
KPTCNYSYDKKNACIYDFLELKTTKSIDKY

SEQ ID NO: 3363461 - protein, 31 aa, Plasmodium falciparum
KPTGSLCFLCSFPPIGVCTDVLLDWNNSYEE

SEQ ID NO: 3363462 - protein, 37 aa, Plasmodium falciparum
KPTNIKRISYGVVDKCIWCSVCYNSSNYPNVLNSSNF

SEQ ID NO: 3363463 - protein, 37 aa, Plasmodium falciparum
KPTRWRRIYKGLKLCEYVMKNGCEYFISDVKDKEELI

SEQ ID NO: 3363464 - protein, 18 aa, Plasmodium falciparum
KPTVRYISTSGSPFALNE

SEQ ID NO: 3363465 - protein, 17 aa, Plasmodium falciparum
KPVAWPSNLCNNKKVLN

SEQ ID NO: 3363466 - protein, 24 aa, Plasmodium falciparum
KPVFYPYKNVEIINNSFQNYIKNI

SEQ ID NO: 3363467 - protein, 18 aa, Plasmodium falciparum
KPVKRIDVIPTEYIDTIK

SEQ ID NO: 3363468 - protein, 26 aa, Plasmodium falciparum
KPVLPRRCPHCQSATFSVDRIKTAYT

SEQ ID NO: 3363469 - protein, 25 aa, Plasmodium falciparum
KPWNIRELISIFSYLKIYDEKLIDE

SEQ ID NO: 3363470 - protein, 20 aa, Plasmodium falciparum
KPYICSDSFELFNHYQNRQL

SEQ ID NO: 3363471 - protein, 26 aa, Plasmodium falciparum
KPYKLSCLESLAFCLYVCNYNKQCND

SEQ ID NO: 3363472 - protein, 18 aa, Plasmodium falciparum
KPYKYWYSIEDKMINFYI

SEQ ID NO: 3363473 - protein, 25 aa, Plasmodium falciparum
KPYNVSAEFWKVLVSAFSDGEKNII

SEQ ID NO: 3363474 - protein, 23 aa, Plasmodium falciparum
KPYRAKYSYMRRLKKSVQKMNFL

SEQ ID NO: 3363475 - protein, 17 aa, Plasmodium falciparum
KPYTFFVAGKFNLFSNF

SEQ ID NO: 3363476 - protein, 18 aa, Plasmodium falciparum
KQAELFKEKHEEFVNNKY

SEQ ID NO: 3363477 - protein, 21 aa, Plasmodium falciparum
KQAFFKIITNIVCNNKKVITS

SEQ ID NO: 3363478 - protein, 17 aa, Plasmodium falciparum
KQALLIIENVEKFCLQN

SEQ ID NO: 3363479 - protein, 30 aa, Plasmodium falciparum
KQCEYFKKWDIKIIFIFDGITPKGHKLFSA

SEQ ID NO: 3363480 - protein, 19 aa, Plasmodium falciparum
KQCVDISKYYQILINSLND

SEQ ID NO: 3363481 - protein, 21 aa, Plasmodium falciparum
KQCYCVSCAIHSRFVRVRSRE

SEQ ID NO: 3363482 - protein, 24 aa, Plasmodium falciparum
KQDFFDYDFSLGILKNKKSILNKF

SEQ ID NO: 3363483 - protein, 19 aa, Plasmodium falciparum
KQEFANIEECFKIHTSSIN

SEQ ID NO: 3363484 - protein, 33 aa, Plasmodium falciparum
KQEHMRKRKRKILRNRTCIIHQILNRNKENQKE

SEQ ID NO: 3363485 - protein, 18 aa, Plasmodium falciparum
KQEIRTFLEKYILYPKNF

SEQ ID NO: 3363486 - protein, 33 aa, Plasmodium falciparum
KQEKRYFSINKFGEEKARNLAIAARKKFENVYK

SEQ ID NO: 3363487 - protein, 17 aa, Plasmodium falciparum
KQEVFKDIMCSDIKYEK

SEQ ID NO: 3363488 - protein, 17 aa, Plasmodium falciparum
KQEYLRFNLSRNGENMK

SEQ ID NO: 3363489 - protein, 19 aa, Plasmodium falciparum
KQFILKCSRKINLRNAWII

SEQ ID NO: 3363490 - protein, 22 aa, Plasmodium falciparum
KQFKFLPSDVTKYFIEGDNVTV

SEQ ID NO: 3363491 - protein, 23 aa, Plasmodium falciparum
KQFNCPFCSYKKSVDIKLHRSKG

SEQ ID NO: 3363492 - protein, 17 aa, Plasmodium falciparum
KQFQILKSIKFDCVQNI

SEQ ID NO: 3363493 - protein, 18 aa, Plasmodium falciparum
KQGFAKWNKAEFNKLMSG

SEQ ID NO: 3363494 - protein, 23 aa, Plasmodium falciparum
KQGIKAPLILKKVDKRSGVIVQA

SEQ ID NO: 3363495 - protein, 24 aa, Plasmodium falciparum
KQGLNFKEYLIWKEIKIKESKELI

SEQ ID NO: 3363496 - protein, 17 aa, Plasmodium falciparum
KQHIVTMNLLDKKIDII

SEQ ID NO: 3363497 - protein, 19 aa, Plasmodium falciparum
KQIECARLLKEIEEKKKES

SEQ ID NO: 3363498 - protein, 18 aa, Plasmodium falciparum
KQIEMDAIQAERIVMHKI

SEQ ID NO: 3363499 - protein, 20 aa, Plasmodium falciparum
KQIERTFCLHKFKYSITCVK

SEQ ID NO: 3363500 - protein, 21 aa, Plasmodium falciparum
KQIMKSFGYYLSHKIYIKAHI

SEQ ID NO: 3363501 - protein, 21 aa, Plasmodium falciparum
KQIWEYIRLFYNIICYIDPID

SEQ ID NO: 3363502 - protein, 24 aa, Plasmodium falciparum
KQKDIITHVVNWFKYGGPEKNEKN

SEQ ID NO: 3363503 - protein, 22 aa, Plasmodium falciparum
KQKELVEFMLIIWQHSPFIKYY

SEQ ID NO: 3363504 - protein, 18 aa, Plasmodium falciparum
KQKFRIEDILYLLSSMYK

SEQ ID NO: 3363505 - protein, 18 aa, Plasmodium falciparum
KQKHSSCFDKTLDDLSKI

SEQ ID NO: 3363506 - protein, 18 aa, Plasmodium falciparum
KQKIKGHTDCITSLNSSK

SEQ ID NO: 3363507 - protein, 19 aa, Plasmodium falciparum
KQKILFYKTYVNDMRDKLK

SEQ ID NO: 3363508 - protein, 20 aa, Plasmodium falciparum
KQKKCNPHPILIDSNKNNYV

SEQ ID NO: 3363509 - protein, 24 aa, Plasmodium falciparum
KQKKGKHSIICIHYIKNMCMKNLF

SEQ ID NO: 3363510 - protein, 23 aa, Plasmodium falciparum
KQKKLERLYREKIYTKIDLLEIY

SEQ ID NO: 3363511 - protein, 22 aa, Plasmodium falciparum
KQKKRKAYSLFYSNEIGPNNEE

SEQ ID NO: 3363512 - protein, 22 aa, Plasmodium falciparum
KQKKRSLDIINMDKDKINALLE

SEQ ID NO: 3363513 - protein, 24 aa, Plasmodium falciparum
KQKKYNIFYNKYIKSINRDHFKKY

SEQ ID NO: 3363514 - protein, 26 aa, Plasmodium falciparum
KQKLNRPPTDPFKEKKEDQVSQQQKQ

SEQ ID NO: 3363515 - protein, 21 aa, Plasmodium falciparum
KQKLYRFALTITLTSIGIYTT

SEQ ID NO: 3363516 - protein, 23 aa, Plasmodium falciparum
KQKMPIADFINSFYLNIHNINIG

SEQ ID NO: 3363517 - protein, 27 aa, Plasmodium falciparum
KQKNRRRYEYMKKLDMRKRQNNLDIMR

SEQ ID NO: 3363518 - protein, 18 aa, Plasmodium falciparum
KQKSIIFSSYKKKLYTND

SEQ ID NO: 3363519 - protein, 25 aa, Plasmodium falciparum
KQKTHKSFFCNSSAKNVINNENNVK

SEQ ID NO: 3363520 - protein, 23 aa, Plasmodium falciparum
KQKYAYSYTNINIWKYFNNTCYN

SEQ ID NO: 3363521 - protein, 26 aa, Plasmodium falciparum
KQLELRLIQKILKAMEKGYITKYNYD

SEQ ID NO: 3363522 - protein, 18 aa, Plasmodium falciparum
KQLFKSKGNPLLINKKHV

SEQ ID NO: 3363523 - protein, 23 aa, Plasmodium falciparum
KQLHNIFFILGLVIQNILVDNNF

SEQ ID NO: 3363524 - protein, 19 aa, Plasmodium falciparum
KQLLRKKKLLLNCSIGNVK

SEQ ID NO: 3363525 - protein, 23 aa, Plasmodium falciparum
KQLNNYLPEWAKTDINILKEKKN

SEQ ID NO: 3363526 - protein, 30 aa, Plasmodium falciparum
KQLSRTFSLQKISEILSVKRIGRQHQAGSD

SEQ ID NO: 3363527 - protein, 17 aa, Plasmodium falciparum
KQLYHFTPYINIDVQKE

SEQ ID NO: 3363528 - protein, 18 aa, Plasmodium falciparum
KQLYIQLFEIMKILIHNN

SEQ ID NO: 3363529 - protein, 23 aa, Plasmodium falciparum
KQLYRDFKILMNIDISQIQNKLN

SEQ ID NO: 3363530 - protein, 17 aa, Plasmodium falciparum
KQMKFDMTKNIYDNPNL

SEQ ID NO: 3363531 - protein, 23 aa, Plasmodium falciparum
KQMNHASNMNFIYDYNYHNNYSS

SEQ ID NO: 3363532 - protein, 20 aa, Plasmodium falciparum
KQNIYLPICYTKNNKNIKKN

SEQ ID NO: 3363533 - protein, 24 aa, Plasmodium falciparum
KQNKEKYMHISLKKKIVAQDEGEN

SEQ ID NO: 3363534 - protein, 17 aa, Plasmodium falciparum
KQNLCYNNFSSHSPSIN

SEQ ID NO: 3363535 - protein, 23 aa, Plasmodium falciparum
KQNLSPRFKAFVQLKEFLMNEHK

SEQ ID NO: 3363536 - protein, 20 aa, Plasmodium falciparum
KQNPPCFLFLGNRYESTRVV

SEQ ID NO: 3363537 - protein, 17 aa, Plasmodium falciparum
KQNSFHIPIHMNEINSN

SEQ ID NO: 3363538 - protein, 19 aa, Plasmodium falciparum
KQPSILIGGELMKYQLEGL

SEQ ID NO: 3363539 - protein, 20 aa, Plasmodium falciparum
KQQCSIEDIQWCKKGNGLGN

SEQ ID NO: 3363540 - protein, 24 aa, Plasmodium falciparum
KQQEPNCSYLIFNPLTKFILHPYH

SEQ ID NO: 3363541 - protein, 25 aa, Plasmodium falciparum
KQQLVEIGPQFTLHIIKIFEECFKG

SEQ ID NO: 3363542 - protein, 18 aa, Plasmodium falciparum
KQRDEKKLLLLQLNAILF

SEQ ID NO: 3363543 - protein, 20 aa, Plasmodium falciparum
KQRHLCQKKMIWKRKLEISP

SEQ ID NO: 3363544 - protein, 17 aa, Plasmodium falciparum
KQSTYVFDSVFDVNATQ

SEQ ID NO: 3363545 - protein, 24 aa, Plasmodium falciparum
KQSYCKTCGYIYNYDDYMYLFMKY

SEQ ID NO: 3363546 - protein, 18 aa, Plasmodium falciparum
KQTIEVINSININYKKYY

SEQ ID NO: 3363547 - protein, 25 aa, Plasmodium falciparum
KQTKDRKKCYIKKICQLCNTLSNIL

SEQ ID NO: 3363548 - protein, 27 aa, Plasmodium falciparum
KQVRFMYEVFKKIKVGVMKFLQLHGKL

SEQ ID NO: 3363549 - protein, 18 aa, Plasmodium falciparum
KQYDKLYTEMEMNGEVLP

SEQ ID NO: 3363550 - protein, 23 aa, Plasmodium falciparum
KQYFFNCIQMAKLDISKSSATVV

SEQ ID NO: 3363551 - protein, 17 aa, Plasmodium falciparum
KQYILRLNKIINDHIQS

SEQ ID NO: 3363552 - protein, 24 aa, Plasmodium falciparum
KQYKSVFCVWLLTFKDYFIKQLYK

SEQ ID NO: 3363553 - protein, 27 aa, Plasmodium falciparum
KQYSSWKGGSILASFKNFNSFFVTRKE

SEQ ID NO: 3363554 - protein, 21 aa, Plasmodium falciparum
KRAAESRMKENELYKSKKDST

SEQ ID NO: 3363555 - protein, 17 aa, Plasmodium falciparum
KRAAVLLSLQEIVQKQK

SEQ ID NO: 3363556 - protein, 22 aa, Plasmodium falciparum
KRAFEKRWRYKRIYYCNQEKNE

SEQ ID NO: 3363557 - protein, 31 aa, Plasmodium falciparum
KRAGHSCVYYKSNLYFFGGIDFYSFNSNKIN

SEQ ID NO: 3363558 - protein, 19 aa, Plasmodium falciparum
KRAILEKRLDHFNFQENSE

SEQ ID NO: 3363559 - protein, 19 aa, Plasmodium falciparum
KRALSAYMFYVKDKRLEII

SEQ ID NO: 3363560 - protein, 17 aa, Plasmodium falciparum
KRARGMKKLGILMQKVA

SEQ ID NO: 3363561 - protein, 29 aa, Plasmodium falciparum
KRAVLSELLIIEWMEAFFFHTKLSLNISN

SEQ ID NO: 3363562 - protein, 17 aa, Plasmodium falciparum
KRCFLKYDVKFYSSKKK

SEQ ID NO: 3363563 - protein, 18 aa, Plasmodium falciparum
KRCINECLIYPKKYKNIY

SEQ ID NO: 3363564 - protein, 24 aa, Plasmodium falciparum
KRDAELMYLLKMLGRYNNENKKND

SEQ ID NO: 3363565 - protein, 24 aa, Plasmodium falciparum
KRDDFSITLSNNYIYLYGGVIQTG

SEQ ID NO: 3363566 - protein, 17 aa, Plasmodium falciparum
KRDLFILKNIIKKNYQK

SEQ ID NO: 3363567 - protein, 20 aa, Plasmodium falciparum
KRDNVELLYGIKYIYDENNN

SEQ ID NO: 3363568 - protein, 18 aa, Plasmodium falciparum
KREALKEKLKNMVKENEQ

SEQ ID NO: 3363569 - protein, 23 aa, Plasmodium falciparum
KRECEIKRKMEIMNEEINYPLGN

SEQ ID NO: 3363570 - protein, 39 aa, Plasmodium falciparum
KREEIKREYFISTLFKKSEPIKCLNHFYNTFFKNNNKEN

SEQ ID NO: 3363571 - protein, 20 aa, Plasmodium falciparum
KREELYKKQLEKITKKNEEH

SEQ ID NO: 3363572 - protein, 19 aa, Plasmodium falciparum
KREESCKNGHIGDNERSGD

SEQ ID NO: 3363573 - protein, 25 aa, Plasmodium falciparum
KREGNKCLLFTQFIKMLDILEIFLN

SEQ ID NO: 3363574 - protein, 21 aa, Plasmodium falciparum
KREIADFQLVINKYLNNKKKR

SEQ ID NO: 3363575 - protein, 19 aa, Plasmodium falciparum
KREILDCLDNEFVNHNKLD

SEQ ID NO: 3363576 - protein, 21 aa, Plasmodium falciparum
KREISNPINVCVPDNSSTFLK

SEQ ID NO: 3363577 - protein, 23 aa, Plasmodium falciparum
KREKELKKRLAARKAAEKAYKAN

SEQ ID NO: 3363578 - protein, 20 aa, Plasmodium falciparum
KRELLKIDLDIDIRCPTKQI

SEQ ID NO: 3363579 - protein, 19 aa, Plasmodium falciparum
KRELLMGIFEKGYEKPSPI

SEQ ID NO: 3363580 - protein, 17 aa, Plasmodium falciparum
KRENKKQMIGFNNTEKK

SEQ ID NO: 3363581 - protein, 32 aa, Plasmodium falciparum
KRERYKNSLRLCLKSARNTQHMNELEPYLELF

SEQ ID NO: 3363582 - protein, 24 aa, Plasmodium falciparum
KREYEAKFGIEYKIGNEKKKLQDL

SEQ ID NO: 3363583 - protein, 18 aa, Plasmodium falciparum
KRFCDFLWVTTKSGKGGN

SEQ ID NO: 3363584 - protein, 23 aa, Plasmodium falciparum
KRFDRKGNYLLINKLCYDDTQKE

SEQ ID NO: 3363585 - protein, 18 aa, Plasmodium falciparum
KRFEYRMNSNLVLQREGP

SEQ ID NO: 3363586 - protein, 22 aa, Plasmodium falciparum
KRFLRRSFNRSYYYKKNEKEKI

SEQ ID NO: 3363587 - protein, 17 aa, Plasmodium falciparum
KRFNEINIDIDLVNMKI

SEQ ID NO: 3363588 - protein, 17 aa, Plasmodium falciparum
KRFQVFKNEEIRILKKE

SEQ ID NO: 3363589 - protein, 20 aa, Plasmodium falciparum
KRFRKALCPIVERLVNSMMM

SEQ ID NO: 3363590 - protein, 19 aa, Plasmodium falciparum
KRFSEEKYNFLKNLIRNNK

SEQ ID NO: 3363591 - protein, 23 aa, Plasmodium falciparum
KRFSKYFFSEPFIFNFENLENLK

SEQ ID NO: 3363592 - protein, 19 aa, Plasmodium falciparum
KRGAYQWKNFGEVKELIMK

SEQ ID NO: 3363593 - protein, 18 aa, Plasmodium falciparum
KRGNPLWHLDESKYMDKD

SEQ ID NO: 3363594 - protein, 19 aa, Plasmodium falciparum
KRGPELPIKGKSKELNLLI

SEQ ID NO: 3363595 - protein, 23 aa, Plasmodium falciparum
KRHIVTFKGIYSFLNYMADILQK

SEQ ID NO: 3363596 - protein, 19 aa, Plasmodium falciparum
KRHNLNYINIFTLDGHINE

SEQ ID NO: 3363597 - protein, 17 aa, Plasmodium falciparum
KRHSTICIILNDNDLDE

SEQ ID NO: 3363598 - protein, 18 aa, Plasmodium falciparum
KRIAQGYIKRDFAKNNEQ

SEQ ID NO: 3363599 - protein, 19 aa, Plasmodium falciparum
KRIDKSLPFSSISSNDIKK

SEQ ID NO: 3363600 - protein, 21 aa, Plasmodium falciparum
KRIGFEHIIRILKSLTNVKYN

SEQ ID NO: 3363601 - protein, 31 aa, Plasmodium falciparum
KRIKDERMKYIYKSYRSCPLKETEKTGIWIM

SEQ ID NO: 3363602 - protein, 19 aa, Plasmodium falciparum
KRIKEYIFYKMENYKDFHF

SEQ ID NO: 3363603 - protein, 18 aa, Plasmodium falciparum
KRILEYTARAFIFENYMA

SEQ ID NO: 3363604 - protein, 18 aa, Plasmodium falciparum
KRILKPIQSFGYRGEGLS

SEQ ID NO: 3363605 - protein, 39 aa, Plasmodium falciparum
KRILNSYIQNLFIRPDIRCCAIFLNFLLFYDKINLSIDI

SEQ ID NO: 3363606 - protein, 29 aa, Plasmodium falciparum
KRIMQEVMNIFRLFCGFKVSANCLPNKII

SEQ ID NO: 3363607 - protein, 21 aa, Plasmodium falciparum
KRIQSVPLIIGQFLDIIDNNY

SEQ ID NO: 3363608 - protein, 26 aa, Plasmodium falciparum
KRITNIKALIAHNMYVRSLKKEKTQE

SEQ ID NO: 3363609 - protein, 20 aa, Plasmodium falciparum
KRIYAENYGLIKIIRNAENL

SEQ ID NO: 3363610 - protein, 17 aa, Plasmodium falciparum
KRIYDIILKNNNESNTY

SEQ ID NO: 3363611 - protein, 20 aa, Plasmodium falciparum
KRKAIKLDLAYTYDPNDEVE

SEQ ID NO: 3363612 - protein, 24 aa, Plasmodium falciparum
KRKEEKIRHFKGKKNIFDEKDNEH

SEQ ID NO: 3363613 - protein, 23 aa, Plasmodium falciparum
KRKEHIPDRGIEIKKYDRSSKYD

SEQ ID NO: 3363614 - protein, 24 aa, Plasmodium falciparum
KRKEKETQEKEFLEKELRRLDDIE

SEQ ID NO: 3363615 - protein, 21 aa, Plasmodium falciparum
KRKGSRYTSSLPFLKKEKNNG

SEQ ID NO: 3363616 - protein, 18 aa, Plasmodium falciparum
KRKKEGKINIKVKNISQM

SEQ ID NO: 3363617 - protein, 22 aa, Plasmodium falciparum
KRKKIKIILMSATFDINIFNQF

SEQ ID NO: 3363618 - protein, 31 aa, Plasmodium falciparum
KRKKKEMRQKYMLKKKFLMNNYKGKTNENYE

SEQ ID NO: 3363619 - protein, 29 aa, Plasmodium falciparum
KRKKKTFCFYCLFEQFACNIISKKSVIKN

SEQ ID NO: 3363620 - protein, 23 aa, Plasmodium falciparum
KRKKLKPIQVRRSIKDIIISHNP

SEQ ID NO: 3363621 - protein, 20 aa, Plasmodium falciparum
KRKKNLLLMNDRNYNNIDLN

SEQ ID NO: 3363622 - protein, 20 aa, Plasmodium falciparum
KRKLDSFLMDQENELDLHEN

SEQ ID NO: 3363623 - protein, 28 aa, Plasmodium falciparum
KRKLEKKKLKKWSCIYKINKIVRKGAHG

SEQ ID NO: 3363624 - protein, 21 aa, Plasmodium falciparum
KRKLKEMYIYDIGERKIKEKN

SEQ ID NO: 3363625 - protein, 20 aa, Plasmodium falciparum
KRKLNEFDDLKGYDEERKKK

SEQ ID NO: 3363626 - protein, 29 aa, Plasmodium falciparum
KRKNFKEHINYFFNDCFKNFKNLNDKIKH

SEQ ID NO: 3363627 - protein, 32 aa, Plasmodium falciparum
KRKNILREHFWHIKYIKNMTWNDLISSVLFRN

SEQ ID NO: 3363628 - protein, 18 aa, Plasmodium falciparum
KRKNMADIYYFTKELQIV

SEQ ID NO: 3363629 - protein, 29 aa, Plasmodium falciparum
KRKNMQGFECKDCKSFYNEIYSDDDEGKC

SEQ ID NO: 3363630 - protein, 26 aa, Plasmodium falciparum
KRKNTFLIILHFRKCMSTRIVDGKKY

SEQ ID NO: 3363631 - protein, 26 aa, Plasmodium falciparum
KRKNWIFLPICLKLSKTKDEDVSTLD

SEQ ID NO: 3363632 - protein, 25 aa, Plasmodium falciparum
KRKRKEIYEKLSIEIKKLDEVKKVQ

SEQ ID NO: 3363633 - protein, 26 aa, Plasmodium falciparum
KRKRLKDYLQAYLMHYERVHQKKEDW

SEQ ID NO: 3363634 - protein, 24 aa, Plasmodium falciparum
KRKRRKKKRLNVCKNEKHYCKYLS

SEQ ID NO: 3363635 - protein, 21 aa, Plasmodium falciparum
KRKSSKYVYKHIVRMFFEKHT

SEQ ID NO: 3363636 - protein, 20 aa, Plasmodium falciparum
KRKTTSYSMQKEEDPKILRN

SEQ ID NO: 3363637 - protein, 20 aa, Plasmodium falciparum
KRKVLRKAIECIPNSVKLWK

SEQ ID NO: 3363638 - protein, 20 aa, Plasmodium falciparum
KRKVNLSNNFILNNFSNILK

SEQ ID NO: 3363639 - protein, 22 aa, Plasmodium falciparum
KRKYSLTSINDVGCIKKKKNMN

SEQ ID NO: 3363640 - protein, 22 aa, Plasmodium falciparum
KRLDFKIHPKFFHIPNKSILPL

SEQ ID NO: 3363641 - protein, 19 aa, Plasmodium falciparum
KRLDIAGPLMASSFSTYFR

SEQ ID NO: 3363642 - protein, 27 aa, Plasmodium falciparum
KRLENLWSYSSSYGIDWNTLDELFLNY

SEQ ID NO: 3363643 - protein, 19 aa, Plasmodium falciparum
KRLEVSFYGYRNIYLKDIH

SEQ ID NO: 3363644 - protein, 19 aa, Plasmodium falciparum
KRLIDKISFVGNDFTRKNP

SEQ ID NO: 3363645 - protein, 17 aa, Plasmodium falciparum
KRLIEIINYDKIIKEIE

SEQ ID NO: 3363646 - protein, 17 aa, Plasmodium falciparum
KRLKSILYSLESMDHKR

SEQ ID NO: 3363647 - protein, 21 aa, Plasmodium falciparum
KRLLIKKLNLPGGVKVNDIII

SEQ ID NO: 3363648 - protein, 26 aa, Plasmodium falciparum
KRLLYDNCIYENKMVIMHFHTKIFEY

SEQ ID NO: 3363649 - protein, 26 aa, Plasmodium falciparum
KRLQNIKEFYLYNFLNSKKEEKDIND

SEQ ID NO: 3363650 - protein, 19 aa, Plasmodium falciparum
KRLRKAHKSLYIIIINFTR

SEQ ID NO: 3363651 - protein, 20 aa, Plasmodium falciparum
KRLSKRYFHFYLLKQDEKEE

SEQ ID NO: 3363652 - protein, 25 aa, Plasmodium falciparum
KRLTKNMWSTMNIKDCTTKKKMCPL

SEQ ID NO: 3363653 - protein, 20 aa, Plasmodium falciparum
KRLTLDISDNGSRIMNICFS

SEQ ID NO: 3363654 - protein, 23 aa, Plasmodium falciparum
KRLTQTNLFKFNGKYENRIIHDD

SEQ ID NO: 3363655 - protein, 20 aa, Plasmodium falciparum
KRLYELITPASFYYDDTHFL

SEQ ID NO: 3363656 - protein, 20 aa, Plasmodium falciparum
KRLYKELLEKVNIEELIKNM

SEQ ID NO: 3363657 - protein, 17 aa, Plasmodium falciparum
KRMERINKIKLLDVQKL

SEQ ID NO: 3363658 - protein, 17 aa, Plasmodium falciparum
KRMKDNYSRKINMQRDK

SEQ ID NO: 3363659 - protein, 18 aa, Plasmodium falciparum
KRMKKIYINKKENIYHNQ

SEQ ID NO: 3363660 - protein, 23 aa, Plasmodium falciparum
KRMPIEYWGSFRAIDFNVNHYPI

SEQ ID NO: 3363661 - protein, 19 aa, Plasmodium falciparum
KRMRKRKLTYLQESSTLAK

SEQ ID NO: 3363662 - protein, 25 aa, Plasmodium falciparum
KRMYDDLKYILLFQNEIVDIIIEDI

SEQ ID NO: 3363663 - protein, 18 aa, Plasmodium falciparum
KRNDAFGKKYSMGKDYFK

SEQ ID NO: 3363664 - protein, 19 aa, Plasmodium falciparum
KRNGFGYYLYVNIKTIYQG

SEQ ID NO: 3363665 - protein, 18 aa, Plasmodium falciparum
KRNGKKFEIILVDSEPYK

SEQ ID NO: 3363666 - protein, 18 aa, Plasmodium falciparum
KRNIACLCAKKYYYSNID

SEQ ID NO: 3363667 - protein, 17 aa, Plasmodium falciparum
KRNIKKRDIVTITEEAK

SEQ ID NO: 3363668 - protein, 19 aa, Plasmodium falciparum
KRNILKKSASANMMDNQNV

SEQ ID NO: 3363669 - protein, 20 aa, Plasmodium falciparum
KRNISRCLKRKASQSNSTKQ

SEQ ID NO: 3363670 - protein, 25 aa, Plasmodium falciparum
KRNITYPYFMFYQINNFLINPNPFH

SEQ ID NO: 3363671 - protein, 20 aa, Plasmodium falciparum
KRNIVIPRFKICEDSEEEKN

SEQ ID NO: 3363672 - protein, 18 aa, Plasmodium falciparum
KRNIWLQNIDFQKNINRK

SEQ ID NO: 3363673 - protein, 19 aa, Plasmodium falciparum
KRNKTCFDVSNSNHHNRSM

SEQ ID NO: 3363674 - protein, 21 aa, Plasmodium falciparum
KRNLLRNGLCSDFFFFFFKSN

SEQ ID NO: 3363675 - protein, 25 aa, Plasmodium falciparum
KRNLPFFQGLFLGQLCHIVHISTNK

SEQ ID NO: 3363676 - protein, 19 aa, Plasmodium falciparum
KRNLYLLLNHDNIVKDINK

SEQ ID NO: 3363677 - protein, 21 aa, Plasmodium falciparum
KRNNDKYKYCYNDKDKDISSY

SEQ ID NO: 3363678 - protein, 21 aa, Plasmodium falciparum
KRNNFNVLFYIYNMYHNNFSY

SEQ ID NO: 3363679 - protein, 18 aa, Plasmodium falciparum
KRNSPFCYTCNYKDGKPT

SEQ ID NO: 3363680 - protein, 21 aa, Plasmodium falciparum
KRNTFQLIPSFLLKNNLRSCL

SEQ ID NO: 3363681 - protein, 25 aa, Plasmodium falciparum
KRNTNLFIKKIFHIIKNIFQKKDFK

SEQ ID NO: 3363682 - protein, 18 aa, Plasmodium falciparum
KRNYFKKVIMEKSKNHQH

SEQ ID NO: 3363683 - protein, 19 aa, Plasmodium falciparum
KRPIMKELISYAIQDVIYL

SEQ ID NO: 3363684 - protein, 21 aa, Plasmodium falciparum
KRPNNILTQEQWEYIEKIKNY

SEQ ID NO: 3363685 - protein, 25 aa, Plasmodium falciparum
KRPRRCGWLDIPMLLYVKCINSIDM

SEQ ID NO: 3363686 - protein, 19 aa, Plasmodium falciparum
KRQRFLINQGYAYNVLSDN

SEQ ID NO: 3363687 - protein, 19 aa, Plasmodium falciparum
KRQSKNFVEEEFINGNRKM

SEQ ID NO: 3363688 - protein, 42 aa, Plasmodium falciparum
KRQYFPVKKFGQAQAKYLAIYARIQAVNCLQRKPHKPRMSKR

SEQ ID NO: 3363689 - protein, 18 aa, Plasmodium falciparum
KRRAKLLMEEGLDLYNQY

SEQ ID NO: 3363690 - protein, 18 aa, Plasmodium falciparum
KRRFHFLYNIKLYEYIYS

SEQ ID NO: 3363691 - protein, 18 aa, Plasmodium falciparum
KRRFSMPLHNRNNRKSSN

SEQ ID NO: 3363692 - protein, 18 aa, Plasmodium falciparum
KRRNTCSFFDEKKYIKKG

SEQ ID NO: 3363693 - protein, 22 aa, Plasmodium falciparum
KRRRRNIHELDNIIGNKNYNNI

SEQ ID NO: 3363694 - protein, 20 aa, Plasmodium falciparum
KRRRSRSISIERRIKEKHRN

SEQ ID NO: 3363695 - protein, 17 aa, Plasmodium falciparum
KRSALAMLTDIDPLTTL

SEQ ID NO: 3363696 - protein, 23 aa, Plasmodium falciparum
KRSCAYVYIKRGSGIIKINDKED

SEQ ID NO: 3363697 - protein, 18 aa, Plasmodium falciparum
KRSFKYNYDFHLKGGEIY

SEQ ID NO: 3363698 - protein, 20 aa, Plasmodium falciparum
KRSKVKAFIKCINVNHILPT

SEQ ID NO: 3363699 - protein, 19 aa, Plasmodium falciparum
KRSLELLNKIKWRNEQNED

SEQ ID NO: 3363700 - protein, 20 aa, Plasmodium falciparum
KRSLNILYNKINEFDKYKND

SEQ ID NO: 3363701 - protein, 21 aa, Plasmodium falciparum
KRSLTKLSVFISEQVLFQLNI

SEQ ID NO: 3363702 - protein, 24 aa, Plasmodium falciparum
KRSYLSNIFFKLSYDTIENLMNAR

SEQ ID NO: 3363703 - protein, 23 aa, Plasmodium falciparum
KRSYWLIRNSWSYYWGDEGNFRV

SEQ ID NO: 3363704 - protein, 21 aa, Plasmodium falciparum
KRTIAENNVLVWYKIIKENKQ

SEQ ID NO: 3363705 - protein, 25 aa, Plasmodium falciparum
KRTNRRYAETFLYLTNGYNLDIEQI

SEQ ID NO: 3363706 - protein, 27 aa, Plasmodium falciparum
KRTSEYFYKYDCNLIIIDLNSDVHKNI

SEQ ID NO: 3363707 - protein, 21 aa, Plasmodium falciparum
KRTSTPFSKEFIITSDVDSNE

SEQ ID NO: 3363708 - protein, 19 aa, Plasmodium falciparum
KRVATDISYKHIQKENKEE

SEQ ID NO: 3363709 - protein, 21 aa, Plasmodium falciparum
KRVHCKFQMWNFRNIHNSHLN

SEQ ID NO: 3363710 - protein, 18 aa, Plasmodium falciparum
KRVHKAIYFENIEKDKND

SEQ ID NO: 3363711 - protein, 21 aa, Plasmodium falciparum
KRVKEVKCVVLLNKPLFPGLT

SEQ ID NO: 3363712 - protein, 27 aa, Plasmodium falciparum
KRVQLKLKLYCIRNNMNYVKLWKNAIK

SEQ ID NO: 3363713 - protein, 18 aa, Plasmodium falciparum
KRYFELAVKEIDISRKGN

SEQ ID NO: 3363714 - protein, 19 aa, Plasmodium falciparum
KRYGYNLNDLHSYIYKINL

SEQ ID NO: 3363715 - protein, 20 aa, Plasmodium falciparum
KRYIEESSFNELFKYDLICD

SEQ ID NO: 3363716 - protein, 18 aa, Plasmodium falciparum
KRYMSCKYIYGKQNCGLS

SEQ ID NO: 3363717 - protein, 23 aa, Plasmodium falciparum
KRYNEEFKMTYTVYQHKKAKTQV

SEQ ID NO: 3363718 - protein, 17 aa, Plasmodium falciparum
KRYRIFTILNKYRINYP

SEQ ID NO: 3363719 - protein, 22 aa, Plasmodium falciparum
KSAVCNKFIYAVEGFKKVSFKK

SEQ ID NO: 3363720 - protein, 18 aa, Plasmodium falciparum
KSAYIYLYECYETLYTYI

SEQ ID NO: 3363721 - protein, 19 aa, Plasmodium falciparum
KSCEGCFAELGCISLRVHV

SEQ ID NO: 3363722 - protein, 21 aa, Plasmodium falciparum
KSCNLYTAKSNTVMFPNGNYE

SEQ ID NO: 3363723 - protein, 17 aa, Plasmodium falciparum
KSCRNYDLLYSEFLMNN

SEQ ID NO: 3363724 - protein, 22 aa, Plasmodium falciparum
KSDEELLIFKTLMAITNILTID

SEQ ID NO: 3363725 - protein, 18 aa, Plasmodium falciparum
KSDELLSLLSQLYFSIQY

SEQ ID NO: 3363726 - protein, 32 aa, Plasmodium falciparum
KSDFHELLFICSHMWPLFIKPILDGVLEPIVE

SEQ ID NO: 3363727 - protein, 22 aa, Plasmodium falciparum
KSDFIYPASIFQDSEIKKNDII

SEQ ID NO: 3363728 - protein, 29 aa, Plasmodium falciparum
KSDISPSLTQFFFNFIIKKNQYNFFLNKS

SEQ ID NO: 3363729 - protein, 19 aa, Plasmodium falciparum
KSDKHKARMLKRINKNNIH

SEQ ID NO: 3363730 - protein, 22 aa, Plasmodium falciparum
KSDLYVKYALLYLAYTPLNDLN

SEQ ID NO: 3363731 - protein, 22 aa, Plasmodium falciparum
KSDNILSCEKNFITLKNNNHNN

SEQ ID NO: 3363732 - protein, 24 aa, Plasmodium falciparum
KSDNYLEIWAALSCVCKLLNNEMI

SEQ ID NO: 3363733 - protein, 27 aa, Plasmodium falciparum
KSDVFPSESFLSYFKRQPSSDNANNSM

SEQ ID NO: 3363734 - protein, 19 aa, Plasmodium falciparum
KSEDRCWVLLASKSPRRIE

SEQ ID NO: 3363735 - protein, 17 aa, Plasmodium falciparum
KSEECVHSSNSFVNNLY

SEQ ID NO: 3363736 - protein, 23 aa, Plasmodium falciparum
KSEEFFYFFNHFCFYIINETNKY

SEQ ID NO: 3363737 - protein, 18 aa, Plasmodium falciparum
KSEHLLKFMEQYQKEREA

SEQ ID NO: 3363738 - protein, 18 aa, Plasmodium falciparum
KSEISRLIQTGIYNEDDE

SEQ ID NO: 3363739 - protein, 26 aa, Plasmodium falciparum
KSEKMKRRGRKKGSMQEFIEQKKKLK

SEQ ID NO: 3363740 - protein, 26 aa, Plasmodium falciparum
KSEKVITWLHVCSSFIHEMYKDKKVS

SEQ ID NO: 3363741 - protein, 22 aa, Plasmodium falciparum
KSENNICYNHQIKIYNKETNEK

SEQ ID NO: 3363742 - protein, 18 aa, Plasmodium falciparum
KSEQELLEEKKYYETFLK

SEQ ID NO: 3363743 - protein, 26 aa, Plasmodium falciparum
KSESVKEIILWMCCKNPDDRCTALQA

SEQ ID NO: 3363744 - protein, 20 aa, Plasmodium falciparum
KSFDNMSIFNDLWIDFSENI

SEQ ID NO: 3363745 - protein, 17 aa, Plasmodium falciparum
KSFDVSTKISRDVSNKM

SEQ ID NO: 3363746 - protein, 22 aa, Plasmodium falciparum
KSFFRYERFLNVKVPVKITSPF

SEQ ID NO: 3363747 - protein, 17 aa, Plasmodium falciparum
KSFHIKNDILMRKGNKK

SEQ ID NO: 3363748 - protein, 28 aa, Plasmodium falciparum
KSFKTTSHSLGFRLCGCQHYNKVSDTLF

SEQ ID NO: 3363749 - protein, 18 aa, Plasmodium falciparum
KSFMCCVNCFDTYNTDFE

SEQ ID NO: 3363750 - protein, 25 aa, Plasmodium falciparum
KSFNKYKFLLNLSKTLLSKKYLSIN

SEQ ID NO: 3363751 - protein, 25 aa, Plasmodium falciparum
KSFQIKPSFDIRYLLDGADLLMCNL

SEQ ID NO: 3363752 - protein, 24 aa, Plasmodium falciparum
KSGKKNCLLSNIFISHDENNNLKK

SEQ ID NO: 3363753 - protein, 28 aa, Plasmodium falciparum
KSGKNIVKNLFCNKKSYSNNSAYVNRGI

SEQ ID NO: 3363754 - protein, 21 aa, Plasmodium falciparum
KSGKYVKWSSNYYMKLNSTNG

SEQ ID NO: 3363755 - protein, 20 aa, Plasmodium falciparum
KSGNPFYSLYMKGDASQDVN

SEQ ID NO: 3363756 - protein, 29 aa, Plasmodium falciparum
KSGPCPLLCITNILLLRNQLHIDRKVKKI

SEQ ID NO: 3363757 - protein, 20 aa, Plasmodium falciparum
KSGRVIPGYGHAVLRVPDPR

SEQ ID NO: 3363758 - protein, 19 aa, Plasmodium falciparum
KSGTLKVNTYFIIGHIYGK

SEQ ID NO: 3363759 - protein, 23 aa, Plasmodium falciparum
KSGVKLYEFKKLENLYESNIIFE

SEQ ID NO: 3363760 - protein, 17 aa, Plasmodium falciparum
KSHECFKYVSSEMKKKM

SEQ ID NO: 3363761 - protein, 19 aa, Plasmodium falciparum
KSHIHIRYKYDVFNYCLKN

SEQ ID NO: 3363762 - protein, 17 aa, Plasmodium falciparum
KSHNYYNYFPLYYNDDY

SEQ ID NO: 3363763 - protein, 21 aa, Plasmodium falciparum
KSHRENYKYISKRKYSRDNHV

SEQ ID NO: 3363764 - protein, 17 aa, Plasmodium falciparum
KSHSQSFSPSRVIYVEN

SEQ ID NO: 3363765 - protein, 29 aa, Plasmodium falciparum
KSHTKKKKSSWLKFGRGDKNDKKSKNEKK

SEQ ID NO: 3363766 - protein, 29 aa, Plasmodium falciparum
KSHTKKKKSSWLKFGRGNKNDKKNKKEKK

SEQ ID NO: 3363767 - protein, 29 aa, Plasmodium falciparum
KSHTKKKKSSWLKFGRGNKNDKKSKNEKQ

SEQ ID NO: 3363768 - protein, 20 aa, Plasmodium falciparum
KSICIARRMALYPYDKKPEK

SEQ ID NO: 3363769 - protein, 24 aa, Plasmodium falciparum
KSICIKNKSTICTSSNLVNLLKNN

SEQ ID NO: 3363770 - protein, 19 aa, Plasmodium falciparum
KSIFFFLKHLTTMKYISHI

SEQ ID NO: 3363771 - protein, 23 aa, Plasmodium falciparum
KSIHTEIKCLKRKNEKKKITKLN

SEQ ID NO: 3363772 - protein, 20 aa, Plasmodium falciparum
KSIIDDICKYFHDIDNVKLK

SEQ ID NO: 3363773 - protein, 27 aa, Plasmodium falciparum
KSIIKEKLFGKIIFKEYLVISDDVEYF

SEQ ID NO: 3363774 - protein, 24 aa, Plasmodium falciparum
KSIIKKSYNLFKPCCHNKKEHIKN

SEQ ID NO: 3363775 - protein, 25 aa, Plasmodium falciparum
KSIIMGSEITDIIILVIDINKGIQK

SEQ ID NO: 3363776 - protein, 17 aa, Plasmodium falciparum
KSILCIFTSKISGYLTS

SEQ ID NO: 3363777 - protein, 19 aa, Plasmodium falciparum
KSILTNIINILNYVFPDYE

SEQ ID NO: 3363778 - protein, 19 aa, Plasmodium falciparum
KSISALALIFSIQKYINNS

SEQ ID NO: 3363779 - protein, 30 aa, Plasmodium falciparum
KSISLILERRDIRLSLVGPIENEDVENPRI

SEQ ID NO: 3363780 - protein, 27 aa, Plasmodium falciparum
KSIYSRKKKFCDFKELNNFGTKNLYSD

SEQ ID NO: 3363781 - protein, 18 aa, Plasmodium falciparum
KSKCYNCNLKEKHYQLIC

SEQ ID NO: 3363782 - protein, 24 aa, Plasmodium falciparum
KSKDKKKSGSLVHIKNENTNKLDN

SEQ ID NO: 3363783 - protein, 19 aa, Plasmodium falciparum
KSKDLRKVFPKGTPDEAIN

SEQ ID NO: 3363784 - protein, 24 aa, Plasmodium falciparum
KSKELIRYGIPVGLKNYAAAYATG

SEQ ID NO: 3363785 - protein, 22 aa, Plasmodium falciparum
KSKEQKYAFTYGDERLINECKL

SEQ ID NO: 3363786 - protein, 18 aa, Plasmodium falciparum
KSKHCWYDEKSSYICLLS

SEQ ID NO: 3363787 - protein, 26 aa, Plasmodium falciparum
KSKHTNVYYYFIQNIHLHKYNVYQYY

SEQ ID NO: 3363788 - protein, 20 aa, Plasmodium falciparum
KSKICLCFSDDIFINSCYEL

SEQ ID NO: 3363789 - protein, 18 aa, Plasmodium falciparum
KSKIIKDLLLKKLDIEKK

SEQ ID NO: 3363790 - protein, 22 aa, Plasmodium falciparum
KSKKCMKDTMVKKKKKKMKNQN

SEQ ID NO: 3363791 - protein, 19 aa, Plasmodium falciparum
KSKKWGNNMHLFKNEHNDM

SEQ ID NO: 3363792 - protein, 20 aa, Plasmodium falciparum
KSKKYKASLCNFINKCCGNM

SEQ ID NO: 3363793 - protein, 22 aa, Plasmodium falciparum
KSKLDYLLALIFSPKNSTDTYE

SEQ ID NO: 3363794 - protein, 19 aa, Plasmodium falciparum
KSKLNFCCWPSPQVSTAVV

SEQ ID NO: 3363795 - protein, 19 aa, Plasmodium falciparum
KSKLSKPFMNNKYSDHSCN

SEQ ID NO: 3363796 - protein, 25 aa, Plasmodium falciparum
KSKNEKKPSLEGVKQNAEEQKEQPA

SEQ ID NO: 3363797 - protein, 25 aa, Plasmodium falciparum
KSKQHCVFTYGCKYIKHFKYNPYKI

SEQ ID NO: 3363798 - protein, 21 aa, Plasmodium falciparum
KSKQKEIFSFYVKNIDELIGK

SEQ ID NO: 3363799 - protein, 18 aa, Plasmodium falciparum
KSKRKSIFPSDKKDSPTK

SEQ ID NO: 3363800 - protein, 20 aa, Plasmodium falciparum
KSKSKNRRSSTRKHIEVVTD

SEQ ID NO: 3363801 - protein, 20 aa, Plasmodium falciparum
KSKYIFKEFSVFSFNILANS

SEQ ID NO: 3363802 - protein, 17 aa, Plasmodium falciparum
KSLDKMASRRSYNRRRK

SEQ ID NO: 3363803 - protein, 22 aa, Plasmodium falciparum
KSLESFLVCLNFSLPRSNIISM

SEQ ID NO: 3363804 - protein, 18 aa, Plasmodium falciparum
KSLHRIRIGNIHLNDLPI

SEQ ID NO: 3363805 - protein, 17 aa, Plasmodium falciparum
KSLHVQNLFEFDFIDVP

SEQ ID NO: 3363806 - protein, 24 aa, Plasmodium falciparum
KSLIVFSSYLLRVNYEYFNINEIF

SEQ ID NO: 3363807 - protein, 18 aa, Plasmodium falciparum
KSLKFFMHPYSKIKNEKS

SEQ ID NO: 3363808 - protein, 28 aa, Plasmodium falciparum
KSLKIPECIFKKNILENIKNLSLNKKKK

SEQ ID NO: 3363809 - protein, 27 aa, Plasmodium falciparum
KSLKKCFELFYILKLMDINGNIIDKKK

SEQ ID NO: 3363810 - protein, 19 aa, Plasmodium falciparum
KSLKNYLYKNIFFKKNYNI

SEQ ID NO: 3363811 - protein, 28 aa, Plasmodium falciparum
KSLKYLFKVGDILNIYGAVTTWSMGKMV

SEQ ID NO: 3363812 - protein, 25 aa, Plasmodium falciparum
KSLKYRLYYLPGINFLSSICSTCRT

SEQ ID NO: 3363813 - protein, 23 aa, Plasmodium falciparum
KSLLNPSCKIIVIMNKFDKPSNM

SEQ ID NO: 3363814 - protein, 25 aa, Plasmodium falciparum
KSLMLHNIPHIWINYSYPSKKKLMP

SEQ ID NO: 3363815 - protein, 18 aa, Plasmodium falciparum
KSLMRYSIEIKKKNKNNN

SEQ ID NO: 3363816 - protein, 26 aa, Plasmodium falciparum
KSLNTHCAYELSPIGNQNLKSCTMIY

SEQ ID NO: 3363817 - protein, 21 aa, Plasmodium falciparum
KSLPHAESALYTNNFNDNNNL

SEQ ID NO: 3363818 - protein, 19 aa, Plasmodium falciparum
KSLQGYYCGTMQFIINRLG

SEQ ID NO: 3363819 - protein, 23 aa, Plasmodium falciparum
KSLRGFFNFDYVLCLNVGEYIPK

SEQ ID NO: 3363820 - protein, 24 aa, Plasmodium falciparum
KSLTRPKLVKIFQQVAEGMYNIHT

SEQ ID NO: 3363821 - protein, 18 aa, Plasmodium falciparum
KSLYFGILSCNNMEMYHD

SEQ ID NO: 3363822 - protein, 21 aa, Plasmodium falciparum
KSLYFIKFFLGIIPYKTTYIH

SEQ ID NO: 3363823 - protein, 20 aa, Plasmodium falciparum
KSLYFYIHILGMKLIHVKHC

SEQ ID NO: 3363824 - protein, 25 aa, Plasmodium falciparum
KSMDKKKINDCIIDRLKKYNDGHAV

SEQ ID NO: 3363825 - protein, 20 aa, Plasmodium falciparum
KSNCIKKIPIDINMYINREE

SEQ ID NO: 3363826 - protein, 18 aa, Plasmodium falciparum
KSNDKYAKVIFKLINDTF

SEQ ID NO: 3363827 - protein, 42 aa, Plasmodium falciparum
KSNDWKCDDCGNINWAKREKCNICSKSRYTKILNEHKNNKEI

SEQ ID NO: 3363828 - protein, 17 aa, Plasmodium falciparum
KSNEIIYEQNLKKIEKL

SEQ ID NO: 3363829 - protein, 20 aa, Plasmodium falciparum
KSNGPRNCCIMVVANKKDLP

SEQ ID NO: 3363830 - protein, 20 aa, Plasmodium falciparum
KSNHSNGIMNIVKKGDNSGE

SEQ ID NO: 3363831 - protein, 32 aa, Plasmodium falciparum
KSNIFRCGYDMYSRPILYVKIQEKLDMSEDDL

SEQ ID NO: 3363832 - protein, 24 aa, Plasmodium falciparum
KSNIFRKDEKFFLVTKDNSHISKK

SEQ ID NO: 3363833 - protein, 19 aa, Plasmodium falciparum
KSNIPYSITVVLLENLAGK

SEQ ID NO: 3363834 - protein, 18 aa, Plasmodium falciparum
KSNLRKGLSTNNSENGIK

SEQ ID NO: 3363835 - protein, 24 aa, Plasmodium falciparum
KSNLSKLGKLWSIIEPDMIGEIKV

SEQ ID NO: 3363836 - protein, 22 aa, Plasmodium falciparum
KSNTNYRFSNNIQVKNENINNN

SEQ ID NO: 3363837 - protein, 24 aa, Plasmodium falciparum
KSNVKEIRYLQGLKQMGDVKSDKD

SEQ ID NO: 3363838 - protein, 24 aa, Plasmodium falciparum
KSNVLDAICFVMGINNLNLIRVNR

SEQ ID NO: 3363839 - protein, 33 aa, Plasmodium falciparum
KSNVNYSSYFFIPPLEFIVSHLNKLHKKNTYAY

SEQ ID NO: 3363840 - protein, 19 aa, Plasmodium falciparum
KSNYCKMMKEFMKIKKRNC

SEQ ID NO: 3363841 - protein, 23 aa, Plasmodium falciparum
KSNYQTICICKKCYIKDMQEKLR

SEQ ID NO: 3363842 - protein, 18 aa, Plasmodium falciparum
KSPCNKINNFHSTSNNIN

SEQ ID NO: 3363843 - protein, 27 aa, Plasmodium falciparum
KSPHFLRKNLLYRKPRNKKEYLDFKKK

SEQ ID NO: 3363844 - protein, 23 aa, Plasmodium falciparum
KSPMFGQGILNKGDNVSVPVFGN

SEQ ID NO: 3363845 - protein, 23 aa, Plasmodium falciparum
KSPTLCLMKNIISLKEMTTDVLK

SEQ ID NO: 3363846 - protein, 19 aa, Plasmodium falciparum
KSQHEFYQLQSFEKNENRE

SEQ ID NO: 3363847 - protein, 19 aa, Plasmodium falciparum
KSQHVSCYIPNTFINKDLS

SEQ ID NO: 3363848 - protein, 31 aa, Plasmodium falciparum
KSQIKTCIRIKPSDKAECEFGKAITQIGTNK

SEQ ID NO: 3363849 - protein, 47 aa, Plasmodium falciparum
KSQNRWLSGICINGRCINRYFPVYKFGFEEARRLAIQHRKNFETANV

SEQ ID NO: 3363850 - protein, 21 aa, Plasmodium falciparum
KSQSSYFCSPAPSNSILRNNT

SEQ ID NO: 3363851 - protein, 17 aa, Plasmodium falciparum
KSRDFLIDFFNDGDTNE

SEQ ID NO: 3363852 - protein, 20 aa, Plasmodium falciparum
KSRDITCDVVQKCSVDKNRN

SEQ ID NO: 3363853 - protein, 21 aa, Plasmodium falciparum
KSRKISIANFFGENLEITVNI

SEQ ID NO: 3363854 - protein, 19 aa, Plasmodium falciparum
KSRKYINLMKKVQIYHLNM

SEQ ID NO: 3363855 - protein, 20 aa, Plasmodium falciparum
KSRLIQICICENNKLKFDNF

SEQ ID NO: 3363856 - protein, 17 aa, Plasmodium falciparum
KSSCEYVTCVCFDNNSN

SEQ ID NO: 3363857 - protein, 25 aa, Plasmodium falciparum
KSSCVNIKVIVRCRPLNEKEKNDIN

SEQ ID NO: 3363858 - protein, 20 aa, Plasmodium falciparum
KSSDFPLPRLYKTNRSICNL

SEQ ID NO: 3363859 - protein, 31 aa, Plasmodium falciparum
KSSDLSMSLCYLLKYYVRFNYNILYNSYCLF

SEQ ID NO: 3363860 - protein, 24 aa, Plasmodium falciparum
KSSFEHRLDILIYILKKYHERTIM

SEQ ID NO: 3363861 - protein, 20 aa, Plasmodium falciparum
KSSFSNFILESIGWTYENVS

SEQ ID NO: 3363862 - protein, 20 aa, Plasmodium falciparum
KSSHHINGYYINDHDNIKSD

SEQ ID NO: 3363863 - protein, 24 aa, Plasmodium falciparum
KSSKCCFCKFQRNISAKVSQRRDT

SEQ ID NO: 3363864 - protein, 20 aa, Plasmodium falciparum
KSSKLYKLEALKCSKYKQSF

SEQ ID NO: 3363865 - protein, 36 aa, Plasmodium falciparum
KSSKRTGIPLNERKYYRILAKQMKKIQGLTFDHNQI

SEQ ID NO: 3363866 - protein, 18 aa, Plasmodium falciparum
KSSLPPGCNFVNENKNYN

SEQ ID NO: 3363867 - protein, 17 aa, Plasmodium falciparum
KSSLPTVDGLQILPNEG

SEQ ID NO: 3363868 - protein, 23 aa, Plasmodium falciparum
KSSLSRHSLVILSIIYVLFHQNV

SEQ ID NO: 3363869 - protein, 24 aa, Plasmodium falciparum
KSSRKEHHSRYGSSSTTREKAVSS

SEQ ID NO: 3363870 - protein, 19 aa, Plasmodium falciparum
KSSSCIYVGNLPGNVIEEE

SEQ ID NO: 3363871 - protein, 18 aa, Plasmodium falciparum
KSSTVSFSRDVSQPLQKD

SEQ ID NO: 3363872 - protein, 24 aa, Plasmodium falciparum
KSSVSLLLLNYALKSGFKPLYIET

SEQ ID NO: 3363873 - protein, 21 aa, Plasmodium falciparum
KSSYFGCGWSSNKKEWTPFIH

SEQ ID NO: 3363874 - protein, 20 aa, Plasmodium falciparum
KSSYIPNAEKLLMFERKNKR

SEQ ID NO: 3363875 - protein, 35 aa, Plasmodium falciparum
KSSYSPRTEKLIEIISPILDYYGYNREDVYNFISL

SEQ ID NO: 3363876 - protein, 17 aa, Plasmodium falciparum
KSTENIKEMMQPHNEAN

SEQ ID NO: 3363877 - protein, 22 aa, Plasmodium falciparum
KSTKCIWIDGFGGEDKCILTTG

SEQ ID NO: 3363878 - protein, 20 aa, Plasmodium falciparum
KSTNGLFGFEKNNFNSIFGN

SEQ ID NO: 3363879 - protein, 26 aa, Plasmodium falciparum
KSTNIIWKRFCFYKLLSDKLNDLHIS

SEQ ID NO: 3363880 - protein, 25 aa, Plasmodium falciparum
KSVDGENRMNNTINMNGMNKTESIN

SEQ ID NO: 3363881 - protein, 20 aa, Plasmodium falciparum
KSVDGVLVPGGFGTRGIEGK

SEQ ID NO: 3363882 - protein, 28 aa, Plasmodium falciparum
KSVERAHLPSALWSRVLLSLNKKEAFNV

SEQ ID NO: 3363883 - protein, 26 aa, Plasmodium falciparum
KSVHYDMDEILSLKCKVYDELDTCLK

SEQ ID NO: 3363884 - protein, 20 aa, Plasmodium falciparum
KSVIYGSYISTFIIENKDIC

SEQ ID NO: 3363885 - protein, 25 aa, Plasmodium falciparum
KSVKNCNRKHIIGYDVQKDDNTIDM

SEQ ID NO: 3363886 - protein, 21 aa, Plasmodium falciparum
KSVLHKAKWNAKMEYECIINY

SEQ ID NO: 3363887 - protein, 19 aa, Plasmodium falciparum
KSVLNSMNLECKRKENPNI

SEQ ID NO: 3363888 - protein, 21 aa, Plasmodium falciparum
KSVNLWDFFMNPLLLNINHAD

SEQ ID NO: 3363889 - protein, 24 aa, Plasmodium falciparum
KSVRVKMLAIMLGLHNVPFVKIKD

SEQ ID NO: 3363890 - protein, 28 aa, Plasmodium falciparum
KSYFRKDKKWNIHLSKITLKFNNINHNI

SEQ ID NO: 3363891 - protein, 20 aa, Plasmodium falciparum
KSYIERISLDGTWGGQLELQ

SEQ ID NO: 3363892 - protein, 26 aa, Plasmodium falciparum
KSYKRTCPHISDFEPFSSMYYYTGLH

SEQ ID NO: 3363893 - protein, 20 aa, Plasmodium falciparum
KSYNKTDIINIFSKNKSNDE

SEQ ID NO: 3363894 - protein, 22 aa, Plasmodium falciparum
KSYNMLSRWRDFFIHIYENPQL

SEQ ID NO: 3363895 - protein, 30 aa, Plasmodium falciparum
KSYRQYSLKHLLLLLQFCVLHKCDKYVYRI

SEQ ID NO: 3363896 - protein, 33 aa, Plasmodium falciparum
KSYSNKNWPFFKWSDSESICTCLINNQVYIYKD

SEQ ID NO: 3363897 - protein, 36 aa, Plasmodium falciparum
KSYTSKQYFCIYFARGCCAYGHNCLYKHRIPNENDE

SEQ ID NO: 3363898 - protein, 20 aa, Plasmodium falciparum
KSYVSKKCNLDTDVFFVLIE

SEQ ID NO: 3363899 - protein, 17 aa, Plasmodium falciparum
KSYYLKSLIRKGIPDKL

SEQ ID NO: 3363900 - protein, 20 aa, Plasmodium falciparum
KTAAEALCQLAYKKKSLDNL

SEQ ID NO: 3363901 - protein, 19 aa, Plasmodium falciparum
KTAAFVLPMLSYVKQLPPL

SEQ ID NO: 3363902 - protein, 19 aa, Plasmodium falciparum
KTACSYSYASSKTIHERKC

SEQ ID NO: 3363903 - protein, 20 aa, Plasmodium falciparum
KTAQNYFKEFIILYKNNNFN

SEQ ID NO: 3363904 - protein, 24 aa, Plasmodium falciparum
KTCLKCGLIKDAKKMASIFTNPLD

SEQ ID NO: 3363905 - protein, 23 aa, Plasmodium falciparum
KTCPVIKIRLCNEGNNLRTIGKT

SEQ ID NO: 3363906 - protein, 23 aa, Plasmodium falciparum
KTDEFLKFIKLIKRISINALAQT

SEQ ID NO: 3363907 - protein, 20 aa, Plasmodium falciparum
KTDIFCLFEGEKIYEICSIL

SEQ ID NO: 3363908 - protein, 23 aa, Plasmodium falciparum
KTDIRSCFYFSYDNILEPVNIIN

SEQ ID NO: 3363909 - protein, 19 aa, Plasmodium falciparum
KTDKYVWTQSINTLDMYID

SEQ ID NO: 3363910 - protein, 30 aa, Plasmodium falciparum
KTDQVCARKAEAFVHWLINEYSMENTNGDG

SEQ ID NO: 3363911 - protein, 19 aa, Plasmodium falciparum
KTDRTWFYRRKVLKRNIPE

SEQ ID NO: 3363912 - protein, 24 aa, Plasmodium falciparum
KTDTQVFLPYCHKYMKDDSEITHD

SEQ ID NO: 3363913 - protein, 19 aa, Plasmodium falciparum
KTDVIRRIKPTPIDEAISL

SEQ ID NO: 3363914 - protein, 20 aa, Plasmodium falciparum
KTEEFCPYDLIIDDIASNSY

SEQ ID NO: 3363915 - protein, 17 aa, Plasmodium falciparum
KTENLRIIKLVDLAYNN

SEQ ID NO: 3363916 - protein, 23 aa, Plasmodium falciparum
KTFCLSILPFHYKYTSRLYPIER

SEQ ID NO: 3363917 - protein, 21 aa, Plasmodium falciparum
KTFDYKNYWLDIHGYLLNDMS

SEQ ID NO: 3363918 - protein, 25 aa, Plasmodium falciparum
KTFEDFKEEIFLFLFSNTSANFITV

SEQ ID NO: 3363919 - protein, 34 aa, Plasmodium falciparum
KTFFHNPSIKSFEWYKFMDELILIYDNIEEEKDI

SEQ ID NO: 3363920 - protein, 25 aa, Plasmodium falciparum
KTFGDLALKLGHTFKLSDDKIENIK

SEQ ID NO: 3363921 - protein, 19 aa, Plasmodium falciparum
KTFHRILAVYFGHERWDLV

SEQ ID NO: 3363922 - protein, 28 aa, Plasmodium falciparum
KTFIAKKICDHYNLIMCSINMLIDEYKK

SEQ ID NO: 3363923 - protein, 24 aa, Plasmodium falciparum
KTFIDCFNCLPVAAIIDEKIFCMH

SEQ ID NO: 3363924 - protein, 19 aa, Plasmodium falciparum
KTFIYKYNNMFKVINNDTQ

SEQ ID NO: 3363925 - protein, 30 aa, Plasmodium falciparum
KTFKKVLMICAQKGFSKPPHNINFTDNKKI

SEQ ID NO: 3363926 - protein, 19 aa, Plasmodium falciparum
KTFLKKIPFHRTVEKIAYH

SEQ ID NO: 3363927 - protein, 17 aa, Plasmodium falciparum
KTFLNPIKEKMKYMMQN

SEQ ID NO: 3363928 - protein, 18 aa, Plasmodium falciparum
KTFLQFFFEQIIFLQEYC

SEQ ID NO: 3363929 - protein, 34 aa, Plasmodium falciparum
KTFNILKCLFFLAQWYKRNCRYLFNELIKNFHLN

SEQ ID NO: 3363930 - protein, 26 aa, Plasmodium falciparum
KTFPPYLFIHLKRFYADENWSAKKIN

SEQ ID NO: 3363931 - protein, 22 aa, Plasmodium falciparum
KTFPQCKFSNAVIFMLNSMKIK

SEQ ID NO: 3363932 - protein, 17 aa, Plasmodium falciparum
KTFRIYSPNFAYRLKTN

SEQ ID NO: 3363933 - protein, 17 aa, Plasmodium falciparum
KTGMSIDIIIQNWCNTL

SEQ ID NO: 3363934 - protein, 20 aa, Plasmodium falciparum
KTGRRVWISYILIKNLNDSK

SEQ ID NO: 3363935 - protein, 21 aa, Plasmodium falciparum
KTHMKKVFIDLTLKLKYLRHL

SEQ ID NO: 3363936 - protein, 26 aa, Plasmodium falciparum
KTHTKIKEFFILFNMNNQKDVQNKNC

SEQ ID NO: 3363937 - protein, 27 aa, Plasmodium falciparum
KTIHERKCSKLGFIEKCTKIFKMKNDE

SEQ ID NO: 3363938 - protein, 36 aa, Plasmodium falciparum
KTIIKKIFICMGGDLIPIRYAYAGNIVALYLSIMYD

SEQ ID NO: 3363939 - protein, 25 aa, Plasmodium falciparum
KTIIPEFSNAYSFKNDIRINNLFKN

SEQ ID NO: 3363940 - protein, 17 aa, Plasmodium falciparum
KTIKIAMRVKRDRYLGR

SEQ ID NO: 3363941 - protein, 23 aa, Plasmodium falciparum
KTIKLANLVSFNKWMVTLKLASF

SEQ ID NO: 3363942 - protein, 24 aa, Plasmodium falciparum
KTILLRLSKILSLSSVTSRNKAQE

SEQ ID NO: 3363943 - protein, 19 aa, Plasmodium falciparum
KTILSRFVSWINGLSVFQI

SEQ ID NO: 3363944 - protein, 23 aa, Plasmodium falciparum
KTINWWYDHPFKDLIYLYENGRV

SEQ ID NO: 3363945 - protein, 24 aa, Plasmodium falciparum
KTIPLNEVKNLIMSSNMNNNDIPY

SEQ ID NO: 3363946 - protein, 19 aa, Plasmodium falciparum
KTIQPRTRINQNLNTNINL

SEQ ID NO: 3363947 - protein, 27 aa, Plasmodium falciparum
KTIRKKRKGRCKDIKNSIKKSIIKEKI

SEQ ID NO: 3363948 - protein, 20 aa, Plasmodium falciparum
KTIRSHLVLKNDFTVSYVKK

SEQ ID NO: 3363949 - protein, 25 aa, Plasmodium falciparum
KTITLPYIYKLIPLKYFGYKHKIKN

SEQ ID NO: 3363950 - protein, 31 aa, Plasmodium falciparum
KTKCGHIFCRECIEKVLLKFDYCPLCRNFIK

SEQ ID NO: 3363951 - protein, 21 aa, Plasmodium falciparum
KTKHGSTICGIFLNNNAHLTI

SEQ ID NO: 3363952 - protein, 24 aa, Plasmodium falciparum
KTKIKNKFPSVSQYEIDKILDELL

SEQ ID NO: 3363953 - protein, 30 aa, Plasmodium falciparum
KTKILIDAWFKYSFYTKWMNKFLRYLDRYY

SEQ ID NO: 3363954 - protein, 25 aa, Plasmodium falciparum
KTKKCKRKTLIDILNTLSLSVNNKN

SEQ ID NO: 3363955 - protein, 22 aa, Plasmodium falciparum
KTKKLLKRPSVMKLKEFAPKPE

SEQ ID NO: 3363956 - protein, 25 aa, Plasmodium falciparum
KTKLFDMLKYLSSIKYKSNNNILCP

SEQ ID NO: 3363957 - protein, 18 aa, Plasmodium falciparum
KTKLICLLKEQRENKIEN

SEQ ID NO: 3363958 - protein, 18 aa, Plasmodium falciparum
KTKLLIAYLKDKKKNKTQ

SEQ ID NO: 3363959 - protein, 18 aa, Plasmodium falciparum
KTKMLYKNIAVYLYQHLN

SEQ ID NO: 3363960 - protein, 31 aa, Plasmodium falciparum
KTKNEKFRHNCFYKNFDILNGNKRSDKNFSY

SEQ ID NO: 3363961 - protein, 19 aa, Plasmodium falciparum
KTKNKSVCRYISNEGNNNM

SEQ ID NO: 3363962 - protein, 17 aa, Plasmodium falciparum
KTKNYMDTFTKITLTNE

SEQ ID NO: 3363963 - protein, 24 aa, Plasmodium falciparum
KTKQNCPLLEYIGSLKNVSSPILM

SEQ ID NO: 3363964 - protein, 23 aa, Plasmodium falciparum
KTKREKLMFEYNENVFLVRNILT

SEQ ID NO: 3363965 - protein, 21 aa, Plasmodium falciparum
KTKSSCAVICEFFNDGKHFLT

SEQ ID NO: 3363966 - protein, 20 aa, Plasmodium falciparum
KTKTCSYVLNNLHKKYNHHN

SEQ ID NO: 3363967 - protein, 25 aa, Plasmodium falciparum
KTKYKFSCEYIILSINILINKYIEC

SEQ ID NO: 3363968 - protein, 18 aa, Plasmodium falciparum
KTKYVYCNVPWFNINVKY

SEQ ID NO: 3363969 - protein, 22 aa, Plasmodium falciparum
KTLCFVIPILQYLIHHRNKLCP

SEQ ID NO: 3363970 - protein, 25 aa, Plasmodium falciparum
KTLDFLKRKFIDTKNIKLFVLDEAD

SEQ ID NO: 3363971 - protein, 22 aa, Plasmodium falciparum
KTLEEILGCTVANKVSDMEEKN

SEQ ID NO: 3363972 - protein, 23 aa, Plasmodium falciparum
KTLEKKLTMFLSCSSCMSNYNEN

SEQ ID NO: 3363973 - protein, 24 aa, Plasmodium falciparum
KTLGIGILCCSEIVQSVPDAYKKK

SEQ ID NO: 3363974 - protein, 25 aa, Plasmodium falciparum
KTLKGHLYQGWGLEWDDKNNYISSC

SEQ ID NO: 3363975 - protein, 24 aa, Plasmodium falciparum
KTLNFKRSFSISSNIGDYFYDISM

SEQ ID NO: 3363976 - protein, 17 aa, Plasmodium falciparum
KTLPDFFQIQLLEEICS

SEQ ID NO: 3363977 - protein, 19 aa, Plasmodium falciparum
KTLSYFLPILDNFYKSNER

SEQ ID NO: 3363978 - protein, 18 aa, Plasmodium falciparum
KTLTIYNHHLIKGNENND

SEQ ID NO: 3363979 - protein, 29 aa, Plasmodium falciparum
KTNAKGMFRLCQIEFNRCNFDVAKDKIQE

SEQ ID NO: 3363980 - protein, 26 aa, Plasmodium falciparum
KTNDYEYFGNLGLQKGLHENNIYNDK

SEQ ID NO: 3363981 - protein, 18 aa, Plasmodium falciparum
KTNIKTSYLFNTTDINVT

SEQ ID NO: 3363982 - protein, 19 aa, Plasmodium falciparum
KTNIRSGALNMLLENLKEN

SEQ ID NO: 3363983 - protein, 25 aa, Plasmodium falciparum
KTNKIEYISCLKFCPKQYNNIFKNS

SEQ ID NO: 3363984 - protein, 19 aa, Plasmodium falciparum
KTNKNYGSLAIKKETHNEL

SEQ ID NO: 3363985 - protein, 23 aa, Plasmodium falciparum
KTNLKGRMSLQMSHDISQEALNT

SEQ ID NO: 3363986 - protein, 22 aa, Plasmodium falciparum
KTNNLRSLLWLSSQDEGDSISH

SEQ ID NO: 3363987 - protein, 26 aa, Plasmodium falciparum
KTNPIVCFVHFRFTPDYYPYQKNIIC

SEQ ID NO: 3363988 - protein, 25 aa, Plasmodium falciparum
KTNPNFAGVEFPLSLIEKPKFEQPV

SEQ ID NO: 3363989 - protein, 19 aa, Plasmodium falciparum
KTPCNYDKCSNEIIQKDND

SEQ ID NO: 3363990 - protein, 28 aa, Plasmodium falciparum
KTPIVRFYFDKLFYKYLCLSSVMHIDHI

SEQ ID NO: 3363991 - protein, 27 aa, Plasmodium falciparum
KTPKFQNHIWKQFTFGKLELFFNVSNG

SEQ ID NO: 3363992 - protein, 24 aa, Plasmodium falciparum
KTPYDINMFFLPFELSTKLRFKDF

SEQ ID NO: 3363993 - protein, 18 aa, Plasmodium falciparum
KTQCNEFELLKNEKKNLE

SEQ ID NO: 3363994 - protein, 23 aa, Plasmodium falciparum
KTQFNCFYIFKYIKHLYEELKNM

SEQ ID NO: 3363995 - protein, 20 aa, Plasmodium falciparum
KTQREIFENALLYLKKNGKI

SEQ ID NO: 3363996 - protein, 33 aa, Plasmodium falciparum
KTRCFKNSYPKKVWKKLIEYFLNMTKSNMNNNL

SEQ ID NO: 3363997 - protein, 24 aa, Plasmodium falciparum
KTREKELIEAINVLEDRYEKKNCL

SEQ ID NO: 3363998 - protein, 19 aa, Plasmodium falciparum
KTRENSIDICVDLNDEEPW

SEQ ID NO: 3363999 - protein, 29 aa, Plasmodium falciparum
KTSAYFFDIPLQRIFDSFDMKHFVKGKNN

SEQ ID NO: 3364000 - protein, 29 aa, Plasmodium falciparum
KTSDGRNKERFGTTPLYNHGYNNKFVDNR

SEQ ID NO: 3364001 - protein, 17 aa, Plasmodium falciparum
KTSEAVLKYNLKTSHFT

SEQ ID NO: 3364002 - protein, 19 aa, Plasmodium falciparum
KTSEIKSSGEINPKGKKIT

SEQ ID NO: 3364003 - protein, 18 aa, Plasmodium falciparum
KTSINIGGFPLLGVHIQY

SEQ ID NO: 3364004 - protein, 23 aa, Plasmodium falciparum
KTSLCSSLSKYLGNINSNTFTTT

SEQ ID NO: 3364005 - protein, 17 aa, Plasmodium falciparum
KTSLGCSIFHNKVDEKR

SEQ ID NO: 3364006 - protein, 24 aa, Plasmodium falciparum
KTSNEPVWWLPIINEYRATLNSKY

SEQ ID NO: 3364007 - protein, 20 aa, Plasmodium falciparum
KTSNLYFKKAFSMNYENINI

SEQ ID NO: 3364008 - protein, 18 aa, Plasmodium falciparum
KTSPFSIIGHISSKKDVD

SEQ ID NO: 3364009 - protein, 18 aa, Plasmodium falciparum
KTSQTFMKKSLSYETEKV

SEQ ID NO: 3364010 - protein, 29 aa, Plasmodium falciparum
KTSTKKKTSSWLSFGRKDKKDKKASLGSV

SEQ ID NO: 3364011 - protein, 18 aa, Plasmodium falciparum
KTSYYVYFNFNVLKCYNP

SEQ ID NO: 3364012 - protein, 19 aa, Plasmodium falciparum
KTTEIMSKISDCLKTGYFD

SEQ ID NO: 3364013 - protein, 24 aa, Plasmodium falciparum
KTTILSRFDIIFLLRNKQDVEKDT

SEQ ID NO: 3364014 - protein, 17 aa, Plasmodium falciparum
KTTMYNFNYKNMSLDNI

SEQ ID NO: 3364015 - protein, 24 aa, Plasmodium falciparum
KTTYDCLKHNNLNISTGKRRDLYK

SEQ ID NO: 3364016 - protein, 19 aa, Plasmodium falciparum
KTVHNLRHSKPPSRFRENL

SEQ ID NO: 3364017 - protein, 25 aa, Plasmodium falciparum
KTVSYRVSYHPADAVWEKISGVKFG

SEQ ID NO: 3364018 - protein, 27 aa, Plasmodium falciparum
KTVWLENFGSIYFFGSSIIRLTKKDFQ

SEQ ID NO: 3364019 - protein, 26 aa, Plasmodium falciparum
KTWRLTLFYRPYFYLKTKNIHNYEQV

SEQ ID NO: 3364020 - protein, 22 aa, Plasmodium falciparum
KTWTRDSHDLFDYEAQQVNKKS

SEQ ID NO: 3364021 - protein, 24 aa, Plasmodium falciparum
KTYATSLLFLSEWKGLSTEGKCDY

SEQ ID NO: 3364022 - protein, 19 aa, Plasmodium falciparum
KTYHFIFYILNFVHETKFP

SEQ ID NO: 3364023 - protein, 22 aa, Plasmodium falciparum
KTYKLPFEYSSFISNKLGSTII

SEQ ID NO: 3364024 - protein, 33 aa, Plasmodium falciparum
KTYNFIFNNCEYVNVLLYRAFSIKREDEYNRLR

SEQ ID NO: 3364025 - protein, 28 aa, Plasmodium falciparum
KTYNLICLKCLIAVIIKFEDNIIKFKEI

SEQ ID NO: 3364026 - protein, 17 aa, Plasmodium falciparum
KTYRHLLYMTGHLFSSR

SEQ ID NO: 3364027 - protein, 31 aa, Plasmodium falciparum
KTYSYEKFLLKNFFSKISKFISSNNVEDDKY

SEQ ID NO: 3364028 - protein, 42 aa, Plasmodium falciparum
KTYVKINFFLKKYILQYEEFKNSNILFCFGESSEEEVLSERC

SEQ ID NO: 3364029 - protein, 17 aa, Plasmodium falciparum
KVANKGKEEYNKKKKDI

SEQ ID NO: 3364030 - protein, 23 aa, Plasmodium falciparum
KVARKNLRVCLGDVVYVKSCPEI

SEQ ID NO: 3364031 - protein, 22 aa, Plasmodium falciparum
KVAYMHKCKARNIYNDTCPYLL

SEQ ID NO: 3364032 - protein, 20 aa, Plasmodium falciparum
KVCEICGAMQAVGDMVQRFE

SEQ ID NO: 3364033 - protein, 17 aa, Plasmodium falciparum
KVCGYSLGKLEEDNEYK

SEQ ID NO: 3364034 - protein, 22 aa, Plasmodium falciparum
KVCKLCWKFLTVAIVLLDTALR

SEQ ID NO: 3364035 - protein, 18 aa, Plasmodium falciparum
KVDDFFCANIKAQYTCSF

SEQ ID NO: 3364036 - protein, 17 aa, Plasmodium falciparum
KVDEINMKSNSNIINSE

SEQ ID NO: 3364037 - protein, 17 aa, Plasmodium falciparum
KVDEKRGSFSKSQDGIE

SEQ ID NO: 3364038 - protein, 31 aa, Plasmodium falciparum
KVDEYKSCLPFRSFGFLPKRMCDVYKCEIGR

SEQ ID NO: 3364039 - protein, 18 aa, Plasmodium falciparum
KVDKRSGVIVQAPVILKN

SEQ ID NO: 3364040 - protein, 18 aa, Plasmodium falciparum
KVDPKGLRTIGVITKIDL

SEQ ID NO: 3364041 - protein, 24 aa, Plasmodium falciparum
KVEIKGVKRGRGRPPKRKLSEESQ

SEQ ID NO: 3364042 - protein, 21 aa, Plasmodium falciparum
KVEKKRKRNYLNINDYNFDYD

SEQ ID NO: 3364043 - protein, 24 aa, Plasmodium falciparum
KVFDKELKCYAWFENDQIGSIKSI

SEQ ID NO: 3364044 - protein, 25 aa, Plasmodium falciparum
KVFMKKGIPKLMMKFNAFSTKKMGI

SEQ ID NO: 3364045 - protein, 21 aa, Plasmodium falciparum
KVFQHICSIIKSYFECPKNDS

SEQ ID NO: 3364046 - protein, 24 aa, Plasmodium falciparum
KVGDWDLMFFKGCRTSKSNTILLR

SEQ ID NO: 3364047 - protein, 19 aa, Plasmodium falciparum
KVGLQNVFWVLKTEESSIL

SEQ ID NO: 3364048 - protein, 18 aa, Plasmodium falciparum
KVGLWSYKIVDKKIKGNM

SEQ ID NO: 3364049 - protein, 21 aa, Plasmodium falciparum
KVGSYFIEVWKSCGMNMENVQ

SEQ ID NO: 3364050 - protein, 22 aa, Plasmodium falciparum
KVGSYISTIILGFVIKEKDEFI

SEQ ID NO: 3364051 - protein, 19 aa, Plasmodium falciparum
KVGVMKFLQLHGKLKQTSR

SEQ ID NO: 3364052 - protein, 18 aa, Plasmodium falciparum
KVGYAQDSKYLLACDNTQ

SEQ ID NO: 3364053 - protein, 18 aa, Plasmodium falciparum
KVHIKDKIILDGKIYNIK

SEQ ID NO: 3364054 - protein, 35 aa, Plasmodium falciparum
KVHKLPYLCVLCKRTGRQLKVWNIRNFQDPICAQS

SEQ ID NO: 3364055 - protein, 19 aa, Plasmodium falciparum
KVHKQIKEPCWKRLTKEKE

SEQ ID NO: 3364056 - protein, 21 aa, Plasmodium falciparum
KVHKVEWFLSIDINEDTIYEI

SEQ ID NO: 3364057 - protein, 26 aa, Plasmodium falciparum
KVIDMFVDRVFDRVVHRVVHRVDAKF

SEQ ID NO: 3364058 - protein, 17 aa, Plasmodium falciparum
KVIEIIDIIPQREFSNI

SEQ ID NO: 3364059 - protein, 26 aa, Plasmodium falciparum
KVIGPFYKKFSCIVGPNGSGKSNIID

SEQ ID NO: 3364060 - protein, 22 aa, Plasmodium falciparum
KVIGQIKVKRNAFFTDIKHEID

SEQ ID NO: 3364061 - protein, 17 aa, Plasmodium falciparum
KVIIKKSQKMVFAVSNV

SEQ ID NO: 3364062 - protein, 17 aa, Plasmodium falciparum
KVIKDCSQKVFKKTKVS

SEQ ID NO: 3364063 - protein, 17 aa, Plasmodium falciparum
KVIRNARRRPTYSPTAR

SEQ ID NO: 3364064 - protein, 18 aa, Plasmodium falciparum
KVISIKCRSYSSLKSIYE

SEQ ID NO: 3364065 - protein, 28 aa, Plasmodium falciparum
KVKCPHNGCLWIGYQYQYLNHFISCKYN

SEQ ID NO: 3364066 - protein, 19 aa, Plasmodium falciparum
KVKDIKSNSHIWILQHPSY

SEQ ID NO: 3364067 - protein, 33 aa, Plasmodium falciparum
KVKGVYFSKSPRGVGKWNAYFQIANNKRLFTSF

SEQ ID NO: 3364068 - protein, 19 aa, Plasmodium falciparum
KVKKCDVAKNRVKRLELVI

SEQ ID NO: 3364069 - protein, 20 aa, Plasmodium falciparum
KVKKGESWNSVFKGHKNLNP

SEQ ID NO: 3364070 - protein, 23 aa, Plasmodium falciparum
KVKKIHPTLVRFNEKLVLSYYEL

SEQ ID NO: 3364071 - protein, 20 aa, Plasmodium falciparum
KVKKLLLQECLFLIDETNIK

SEQ ID NO: 3364072 - protein, 52 aa, Plasmodium falciparum
KVKMKCECGWKTLIKEGNTWVRSEWSKKLLCLRLVKNPELLQKKYNIHSRRK

SEQ ID NO: 3364073 - protein, 18 aa, Plasmodium falciparum
KVKQLVCLPKSNLIFPVY

SEQ ID NO: 3364074 - protein, 37 aa, Plasmodium falciparum
KVKREKLDILSKMIKLEREYSCFMARENVDKKDLEEC

SEQ ID NO: 3364075 - protein, 30 aa, Plasmodium falciparum
KVLGIDISLKMCRQLAEVINFLHTPIKNKK

SEQ ID NO: 3364076 - protein, 18 aa, Plasmodium falciparum
KVLKILLSLCKDSNLFLF

SEQ ID NO: 3364077 - protein, 17 aa, Plasmodium falciparum
KVMDICFNKCVSKIGPK

SEQ ID NO: 3364078 - protein, 19 aa, Plasmodium falciparum
KVMSCKDEKYVILKKQITN

SEQ ID NO: 3364079 - protein, 17 aa, Plasmodium falciparum
KVNIKSPCVYLDQEKGK

SEQ ID NO: 3364080 - protein, 18 aa, Plasmodium falciparum
KVNKCYICGNPQGVIKKI

SEQ ID NO: 3364081 - protein, 28 aa, Plasmodium falciparum
KVNLEIANKLLPNIEELAVQKFSSNVVE

SEQ ID NO: 3364082 - protein, 27 aa, Plasmodium falciparum
KVNPYIRVGFACRYMRYDYPIGTDKYS

SEQ ID NO: 3364083 - protein, 21 aa, Plasmodium falciparum
KVNQLICLRGSVLRVSPIQLL

SEQ ID NO: 3364084 - protein, 19 aa, Plasmodium falciparum
KVNTKNCNITNSKAKKTDN

SEQ ID NO: 3364085 - protein, 19 aa, Plasmodium falciparum
KVNTYFIIGHIYGKIKRIY

SEQ ID NO: 3364086 - protein, 17 aa, Plasmodium falciparum
KVNVSLSNCKLSEGENE

SEQ ID NO: 3364087 - protein, 31 aa, Plasmodium falciparum
KVPCIPLCVLPGLSFLCARAFEEYKNGYRTD

SEQ ID NO: 3364088 - protein, 27 aa, Plasmodium falciparum
KVQDVGFFLPFYRKLLKKYETINNVVI

SEQ ID NO: 3364089 - protein, 25 aa, Plasmodium falciparum
KVQLEALEFWPIFIKDRSYVAYASY

SEQ ID NO: 3364090 - protein, 19 aa, Plasmodium falciparum
KVQSLKVLQWCKSNNNIPY

SEQ ID NO: 3364091 - protein, 19 aa, Plasmodium falciparum
KVRDFRIFHKYVSYKKIHT

SEQ ID NO: 3364092 - protein, 25 aa, Plasmodium falciparum
KVRVSYQKLLKCWVLNHLHSKRPKS

SEQ ID NO: 3364093 - protein, 24 aa, Plasmodium falciparum
KVRYRDIRIIYKLIEHIKNKEISN

SEQ ID NO: 3364094 - protein, 18 aa, Plasmodium falciparum
KVSGVWYDTNRRLWRVMY

SEQ ID NO: 3364095 - protein, 20 aa, Plasmodium falciparum
KVSIIKPQLFIPIKEIKLHV

SEQ ID NO: 3364096 - protein, 24 aa, Plasmodium falciparum
KVSKELRNNWSILIEEYLNRAKNL

SEQ ID NO: 3364097 - protein, 26 aa, Plasmodium falciparum
KVSKKFTNFFLEKFILIFENQANTLD

SEQ ID NO: 3364098 - protein, 18 aa, Plasmodium falciparum
KVSLGLLAYFAYHRLGII

SEQ ID NO: 3364099 - protein, 27 aa, Plasmodium falciparum
KVSSATGTLCMWVHALKMYAEVYREVA

SEQ ID NO: 3364100 - protein, 19 aa, Plasmodium falciparum
KVTGGSCLDTQLIYGVAFK

SEQ ID NO: 3364101 - protein, 29 aa, Plasmodium falciparum
KVTHNLKKFVFKNEFKYVDATNALKNIFL

SEQ ID NO: 3364102 - protein, 18 aa, Plasmodium falciparum
KVTYCYKNNFQISSILLK

SEQ ID NO: 3364103 - protein, 19 aa, Plasmodium falciparum
KVVECTRIKWKEGKNPIAA

SEQ ID NO: 3364104 - protein, 27 aa, Plasmodium falciparum
KVVKKLKRNILCIINKFIQTNNGKKKN

SEQ ID NO: 3364105 - protein, 26 aa, Plasmodium falciparum
KVVNPFAGKSVEEWNEITKLIKEDKD

SEQ ID NO: 3364106 - protein, 21 aa, Plasmodium falciparum
KVWHIPLFYIFEMSKLTLFLG

SEQ ID NO: 3364107 - protein, 24 aa, Plasmodium falciparum
KVYAKDCYDEDDFIDEDEKKDLEI

SEQ ID NO: 3364108 - protein, 22 aa, Plasmodium falciparum
KVYELFEKLDCGAFNEQINDSL

SEQ ID NO: 3364109 - protein, 17 aa, Plasmodium falciparum
KVYERYFNLFNFNFSNV

SEQ ID NO: 3364110 - protein, 20 aa, Plasmodium falciparum
KVYKKCCSLKQNRMIQKHSS

SEQ ID NO: 3364111 - protein, 25 aa, Plasmodium falciparum
KVYQCFTCGLRFMTSMDKLNHLENH

SEQ ID NO: 3364112 - protein, 27 aa, Plasmodium falciparum
KVYSDSVLYFYGAPWWLNKIRRGQKIG

SEQ ID NO: 3364113 - protein, 20 aa, Plasmodium falciparum
KWFTIKEIKWIDNYYTTNFD

SEQ ID NO: 3364114 - protein, 18 aa, Plasmodium falciparum
KWFVHIPADIKKRVNQIF

SEQ ID NO: 3364115 - protein, 18 aa, Plasmodium falciparum
KWFYRVINLNPHFGDGWA

SEQ ID NO: 3364116 - protein, 22 aa, Plasmodium falciparum
KWGDMYYYFYIFYKNQCIYSID

SEQ ID NO: 3364117 - protein, 22 aa, Plasmodium falciparum
KWGKKKFHQIHGIKEMKKKKKN

SEQ ID NO: 3364118 - protein, 18 aa, Plasmodium falciparum
KWIDENYLAQVFILCNTI

SEQ ID NO: 3364119 - protein, 21 aa, Plasmodium falciparum
KWITKICQIYQIMKLQHGVML

SEQ ID NO: 3364120 - protein, 17 aa, Plasmodium falciparum
KWKNMFDDFSLKYPQVS

SEQ ID NO: 3364121 - protein, 35 aa, Plasmodium falciparum
KWKSNCVDGKCEIIWKDNRQFFGYHLNNLKQGLGI

SEQ ID NO: 3364122 - protein, 29 aa, Plasmodium falciparum
KWLCVKRNNRSWILYRHIWENSSDDLKYI

SEQ ID NO: 3364123 - protein, 19 aa, Plasmodium falciparum
KWLSFQLLNGLAYLHNNKM

SEQ ID NO: 3364124 - protein, 25 aa, Plasmodium falciparum
KWMVTLKLASFIPAAIDYEDNISFP

SEQ ID NO: 3364125 - protein, 18 aa, Plasmodium falciparum
KWNEIYSRLTLRRLTWDN

SEQ ID NO: 3364126 - protein, 19 aa, Plasmodium falciparum
KWNNVKFSFSINNCDKDKF

SEQ ID NO: 3364127 - protein, 26 aa, Plasmodium falciparum
KWNTSDILKLFPIIKILSKAFDESSK

SEQ ID NO: 3364128 - protein, 26 aa, Plasmodium falciparum
KWSDFLKNIVTFGGFGPTVVHDVSDT

SEQ ID NO: 3364129 - protein, 19 aa, Plasmodium falciparum
KWSSIPIYKRQFYLHQMRN

SEQ ID NO: 3364130 - protein, 18 aa, Plasmodium falciparum
KWTILRLAVTNNWGGINS

SEQ ID NO: 3364131 - protein, 19 aa, Plasmodium falciparum
KWTNKYAYKIYVKGKNEEK

SEQ ID NO: 3364132 - protein, 23 aa, Plasmodium falciparum
KWYICNDNKIGLCEGNLGKDSAY

SEQ ID NO: 3364133 - protein, 18 aa, Plasmodium falciparum
KYAHLEEILNNYVNARNI

SEQ ID NO: 3364134 - protein, 17 aa, Plasmodium falciparum
KYAIIKYNNENIAKIVF

SEQ ID NO: 3364135 - protein, 18 aa, Plasmodium falciparum
KYANPFAISKELKSYMLK

SEQ ID NO: 3364136 - protein, 21 aa, Plasmodium falciparum
KYAQSGRKDYMRNSGKVEEQI

SEQ ID NO: 3364137 - protein, 17 aa, Plasmodium falciparum
KYCCNVKGVRWHASGAW

SEQ ID NO: 3364138 - protein, 21 aa, Plasmodium falciparum
KYCFDSLELKPGFNNYNIYLK

SEQ ID NO: 3364139 - protein, 19 aa, Plasmodium falciparum
KYCKIERIKKGKCIKSGYL

SEQ ID NO: 3364140 - protein, 18 aa, Plasmodium falciparum
KYCKSIIDIVNYIITIGI

SEQ ID NO: 3364141 - protein, 36 aa, Plasmodium falciparum
KYCNDIIKRQTIMFSATFRKEIQVLAKEYLCKYTFL

SEQ ID NO: 3364142 - protein, 21 aa, Plasmodium falciparum
KYDDIRILDNISWTILLKKYI

SEQ ID NO: 3364143 - protein, 20 aa, Plasmodium falciparum
KYDEGDSFYEFIKNMLEMEI

SEQ ID NO: 3364144 - protein, 20 aa, Plasmodium falciparum
KYDEIKCLKESVDIGLKKLN

SEQ ID NO: 3364145 - protein, 25 aa, Plasmodium falciparum
KYDIGLNIKYGFPILQTEIEANNIE

SEQ ID NO: 3364146 - protein, 20 aa, Plasmodium falciparum
KYDIHISVTGYFGCDNINVF

SEQ ID NO: 3364147 - protein, 27 aa, Plasmodium falciparum
KYDINFKKFDMVLFFKDIEFINYDDKN

SEQ ID NO: 3364148 - protein, 18 aa, Plasmodium falciparum
KYDKHICDIDSRKHKDYN

SEQ ID NO: 3364149 - protein, 25 aa, Plasmodium falciparum
KYDKIKKKIIKRIRNRISSDEFNDE

SEQ ID NO: 3364150 - protein, 19 aa, Plasmodium falciparum
KYDKRCDIWSSGVIMYILL

SEQ ID NO: 3364151 - protein, 19 aa, Plasmodium falciparum
KYDLSSCRILGSVGEPINP

SEQ ID NO: 3364152 - protein, 20 aa, Plasmodium falciparum
KYDNPAVCFFDNRIFNSIEE

SEQ ID NO: 3364153 - protein, 21 aa, Plasmodium falciparum
KYDSDVIIMYDHFFQLPQNFL

SEQ ID NO: 3364154 - protein, 20 aa, Plasmodium falciparum
KYDSTLLFSNFHKGSHDKTY

SEQ ID NO: 3364155 - protein, 19 aa, Plasmodium falciparum
KYEDILWKKRCNKKKEILE

SEQ ID NO: 3364156 - protein, 35 aa, Plasmodium falciparum
KYEDMLKRDKDLFTIINNICELEFNSTNNYLMKII

SEQ ID NO: 3364157 - protein, 22 aa, Plasmodium falciparum
KYEEKSFILFRFFNNNKAYETT

SEQ ID NO: 3364158 - protein, 21 aa, Plasmodium falciparum
KYEKARIIGTRALQISMNAPL

SEQ ID NO: 3364159 - protein, 19 aa, Plasmodium falciparum
KYEKFTLNLNNQMDDNNNN

SEQ ID NO: 3364160 - protein, 27 aa, Plasmodium falciparum
KYEKFWNALLFFCKYYLDKIELKGKEN

SEQ ID NO: 3364161 - protein, 30 aa, Plasmodium falciparum
KYEKIKHNMTIILISSIMTWSKTKRKFIKK

SEQ ID NO: 3364162 - protein, 18 aa, Plasmodium falciparum
KYEKQVFQKAYGLSLDDD

SEQ ID NO: 3364163 - protein, 29 aa, Plasmodium falciparum
KYENLRMLLSRMKLYRVKKSLLLIEHKKK

SEQ ID NO: 3364164 - protein, 18 aa, Plasmodium falciparum
KYENRKMTTDNIRYSNIC

SEQ ID NO: 3364165 - protein, 17 aa, Plasmodium falciparum
KYENVFIHKNIGPDKGE

SEQ ID NO: 3364166 - protein, 28 aa, Plasmodium falciparum
KYEPKWFYKHKDPIFNDRDIYLFNNKYW

SEQ ID NO: 3364167 - protein, 20 aa, Plasmodium falciparum
KYEQISGLNIKEYDINEKGN

SEQ ID NO: 3364168 - protein, 22 aa, Plasmodium falciparum
KYERQLIKFVQTFKNTKQDHIS

SEQ ID NO: 3364169 - protein, 20 aa, Plasmodium falciparum
KYEYEIKIQNVLNRKQEENQ

SEQ ID NO: 3364170 - protein, 19 aa, Plasmodium falciparum
KYEYKQCLNKYERQLIKFV

SEQ ID NO: 3364171 - protein, 20 aa, Plasmodium falciparum
KYFDRALCNDYEEWQDKIRE

SEQ ID NO: 3364172 - protein, 18 aa, Plasmodium falciparum
KYFGPIVIDYRILQSKVS

SEQ ID NO: 3364173 - protein, 24 aa, Plasmodium falciparum
KYFGRNIGLHLGLTSLRLNEVDLI

SEQ ID NO: 3364174 - protein, 25 aa, Plasmodium falciparum
KYFIPRIPFKYNKLVDLEYDLIEAM

SEQ ID NO: 3364175 - protein, 20 aa, Plasmodium falciparum
KYFKCNKCLTYLSIEQIRNY

SEQ ID NO: 3364176 - protein, 19 aa, Plasmodium falciparum
KYFKENNYIISLRYYTEAI

SEQ ID NO: 3364177 - protein, 21 aa, Plasmodium falciparum
KYFKNIYTLDVFFDIYNMYPP

SEQ ID NO: 3364178 - protein, 23 aa, Plasmodium falciparum
KYFPRSFFCNGHVLVNKEKMSKS

SEQ ID NO: 3364179 - protein, 26 aa, Plasmodium falciparum
KYGKWKNGKLKKWLYASDDSISVVNR

SEQ ID NO: 3364180 - protein, 17 aa, Plasmodium falciparum
KYHDFPMNMFGKKKNKS

SEQ ID NO: 3364181 - protein, 22 aa, Plasmodium falciparum
KYHGYFMLFWVFVFDISNESIL

SEQ ID NO: 3364182 - protein, 17 aa, Plasmodium falciparum
KYICSTGSMNDEYMFYE

SEQ ID NO: 3364183 - protein, 17 aa, Plasmodium falciparum
KYIHHIFNNENISFFSL

SEQ ID NO: 3364184 - protein, 29 aa, Plasmodium falciparum
KYIHKCKVKYGLKILKNFYDVINSSSSKK

SEQ ID NO: 3364185 - protein, 28 aa, Plasmodium falciparum
KYIIKNKYCCFATFISRNKYIFVEKKNN

SEQ ID NO: 3364186 - protein, 26 aa, Plasmodium falciparum
KYIKAACRPTKCLFISNLNENVNEDC

SEQ ID NO: 3364187 - protein, 19 aa, Plasmodium falciparum
KYIKLCDFNTSIKLKENYK

SEQ ID NO: 3364188 - protein, 30 aa, Plasmodium falciparum
KYIKLNIFKNIILVISIVRYFLHTITISQK

SEQ ID NO: 3364189 - protein, 19 aa, Plasmodium falciparum
KYILEDAISLISQIQVIGA

SEQ ID NO: 3364190 - protein, 18 aa, Plasmodium falciparum
KYILHIIYKTFQIKLQNE

SEQ ID NO: 3364191 - protein, 21 aa, Plasmodium falciparum
KYIMHICPIYLYEVKNNNGYN

SEQ ID NO: 3364192 - protein, 18 aa, Plasmodium falciparum
KYINICYDSLEVNERIKY

SEQ ID NO: 3364193 - protein, 17 aa, Plasmodium falciparum
KYINPYCIYEICSRILL

SEQ ID NO: 3364194 - protein, 20 aa, Plasmodium falciparum
KYIPIKKFNYSYLFIEKKKK

SEQ ID NO: 3364195 - protein, 19 aa, Plasmodium falciparum
KYIPVDFSLVISYESVDNP

SEQ ID NO: 3364196 - protein, 19 aa, Plasmodium falciparum
KYIQRRWNIKSNYIHEAYF

SEQ ID NO: 3364197 - protein, 27 aa, Plasmodium falciparum
KYIRTKYRLCVIDRRYKLFSSGIPLVF

SEQ ID NO: 3364198 - protein, 17 aa, Plasmodium falciparum
KYISDVKNYLLIKPSLN

SEQ ID NO: 3364199 - protein, 18 aa, Plasmodium falciparum
KYISYLLDNLCEKYVSKT

SEQ ID NO: 3364200 - protein, 25 aa, Plasmodium falciparum
KYIVKKAVVVGCNYVSEERSRLYGS

SEQ ID NO: 3364201 - protein, 17 aa, Plasmodium falciparum
KYIYIYCFHNIYKQKLE

SEQ ID NO: 3364202 - protein, 18 aa, Plasmodium falciparum
KYIYNISFSHVFKNLQLL

SEQ ID NO: 3364203 - protein, 34 aa, Plasmodium falciparum
KYKAKKIRCIQDFGSTCFFIDVIMISKSDFSYGF

SEQ ID NO: 3364204 - protein, 23 aa, Plasmodium falciparum
KYKDILCYIFRLSKSLKVGYIEY

SEQ ID NO: 3364205 - protein, 19 aa, Plasmodium falciparum
KYKFDEIKYIFMLQKRCFL

SEQ ID NO: 3364206 - protein, 29 aa, Plasmodium falciparum
KYKHKRGNIISTMFFPRSPYFMVAFENNI

SEQ ID NO: 3364207 - protein, 23 aa, Plasmodium falciparum
KYKICDPSKVYPYYYVTKNEEAT

SEQ ID NO: 3364208 - protein, 31 aa, Plasmodium falciparum
KYKIKFSQTCLSCFSTFIGCTFISCNKQCSK

SEQ ID NO: 3364209 - protein, 27 aa, Plasmodium falciparum
KYKIQVSLCIDRFPINYVQEKFEEDFQ

SEQ ID NO: 3364210 - protein, 17 aa, Plasmodium falciparum
KYKKCKLTLEDFTRSKN

SEQ ID NO: 3364211 - protein, 21 aa, Plasmodium falciparum
KYKKLANGLLDNGETLSKNLN

SEQ ID NO: 3364212 - protein, 30 aa, Plasmodium falciparum
KYKLKKFLHFYAELHKKCNYEEGRGYDIDE

SEQ ID NO: 3364213 - protein, 22 aa, Plasmodium falciparum
KYKNDVGKCILKNIYNGSEYFK

SEQ ID NO: 3364214 - protein, 18 aa, Plasmodium falciparum
KYKNFKCSLFSSDHMFYL

SEQ ID NO: 3364215 - protein, 22 aa, Plasmodium falciparum
KYKNKLKELERKSVTLKNYTMD

SEQ ID NO: 3364216 - protein, 23 aa, Plasmodium falciparum
KYKNVLDTWFGRLKELQRKKMYS

SEQ ID NO: 3364217 - protein, 19 aa, Plasmodium falciparum
KYKPACYEKSIDELKNELL

SEQ ID NO: 3364218 - protein, 18 aa, Plasmodium falciparum
KYKSILISVIDFMDKLKI

SEQ ID NO: 3364219 - protein, 21 aa, Plasmodium falciparum
KYKTPDNCRIFQKENIHLKNH

SEQ ID NO: 3364220 - protein, 22 aa, Plasmodium falciparum
KYLEEIKQNFDILEKKMFHNFL

SEQ ID NO: 3364221 - protein, 17 aa, Plasmodium falciparum
KYLELIYQFYGTHQANN

SEQ ID NO: 3364222 - protein, 24 aa, Plasmodium falciparum
KYLFIYRKLILSLIYDMEKKQKTK

SEQ ID NO: 3364223 - protein, 18 aa, Plasmodium falciparum
KYLFVGYDNVIACYNYHY

SEQ ID NO: 3364224 - protein, 29 aa, Plasmodium falciparum
KYLGLFFGASWCKYCVTFIDSLNIFKKNF

SEQ ID NO: 3364225 - protein, 19 aa, Plasmodium falciparum
KYLHLDFNLKEYLRMQTVR

SEQ ID NO: 3364226 - protein, 23 aa, Plasmodium falciparum
KYLKLGRGHESDVRIPDVSISRY

SEQ ID NO: 3364227 - protein, 18 aa, Plasmodium falciparum
KYLLHNGSIHNITLDTHA

SEQ ID NO: 3364228 - protein, 20 aa, Plasmodium falciparum
KYLNGKDYAYTRSCYNENNI

SEQ ID NO: 3364229 - protein, 20 aa, Plasmodium falciparum
KYLNSCLLILYNKENENENI

SEQ ID NO: 3364230 - protein, 17 aa, Plasmodium falciparum
KYLSINSSTRFEKKNVK

SEQ ID NO: 3364231 - protein, 21 aa, Plasmodium falciparum
KYLTDVFDYLPLTAIINDEIF

SEQ ID NO: 3364232 - protein, 25 aa, Plasmodium falciparum
KYLVEEIEYSFLILNNILFQYKYLL

SEQ ID NO: 3364233 - protein, 18 aa, Plasmodium falciparum
KYMCTKKNSLNSFKSEEY

SEQ ID NO: 3364234 - protein, 24 aa, Plasmodium falciparum
KYMKECYYSLFNMYKNKFNIQIKQ

SEQ ID NO: 3364235 - protein, 18 aa, Plasmodium falciparum
KYMKQRYDSKCDGSSKYG

SEQ ID NO: 3364236 - protein, 21 aa, Plasmodium falciparum
KYMNELWGFSSSENEEEKKYE

SEQ ID NO: 3364237 - protein, 17 aa, Plasmodium falciparum
KYMSIFLQNGFEVQILE

SEQ ID NO: 3364238 - protein, 19 aa, Plasmodium falciparum
KYMYAGKIFTIKKKIDKTS

SEQ ID NO: 3364239 - protein, 19 aa, Plasmodium falciparum
KYNACVDVTFFDDVKNNNQ

SEQ ID NO: 3364240 - protein, 17 aa, Plasmodium falciparum
KYNCDYAAHGTDLAYDK

SEQ ID NO: 3364241 - protein, 20 aa, Plasmodium falciparum
KYNDMMIMLMSGLNIKDNYN

SEQ ID NO: 3364242 - protein, 23 aa, Plasmodium falciparum
KYNFKKSHSSLFNVNLKLGNLTY

SEQ ID NO: 3364243 - protein, 21 aa, Plasmodium falciparum
KYNGKRYKIYFNESNITNSPV

SEQ ID NO: 3364244 - protein, 18 aa, Plasmodium falciparum
KYNHKKKILYIILQNGNN

SEQ ID NO: 3364245 - protein, 23 aa, Plasmodium falciparum
KYNKMEKECYSLKNEIERKNNEK

SEQ ID NO: 3364246 - protein, 17 aa, Plasmodium falciparum
KYNLKIILWEELIKQGE

SEQ ID NO: 3364247 - protein, 18 aa, Plasmodium falciparum
KYNLKLIVNISKCLMFAS

SEQ ID NO: 3364248 - protein, 17 aa, Plasmodium falciparum
KYNMLLCSLNEEKVIEG

SEQ ID NO: 3364249 - protein, 30 aa, Plasmodium falciparum
KYNNGLKPSEGYLLIYPHISHNSIAPKIKK

SEQ ID NO: 3364250 - protein, 25 aa, Plasmodium falciparum
KYNNIYKHDVNIIKNFYNEIKDKII

SEQ ID NO: 3364251 - protein, 18 aa, Plasmodium falciparum
KYNNLSIINQKQNITMDI

SEQ ID NO: 3364252 - protein, 18 aa, Plasmodium falciparum
KYNPEVVINNELHKSMKY

SEQ ID NO: 3364253 - protein, 18 aa, Plasmodium falciparum
KYNSLDIVDKNKTEGVYN

SEQ ID NO: 3364254 - protein, 19 aa, Plasmodium falciparum
KYNTIKIYIENNIKENIFF

SEQ ID NO: 3364255 - protein, 23 aa, Plasmodium falciparum
KYNTMMIKNCLKKRNKFITVHPK

SEQ ID NO: 3364256 - protein, 25 aa, Plasmodium falciparum
KYNWDILSIRSLWAFGPENNSPNIL

SEQ ID NO: 3364257 - protein, 23 aa, Plasmodium falciparum
KYNWLYHRTALFEPMDISYAERR

SEQ ID NO: 3364258 - protein, 26 aa, Plasmodium falciparum
KYNYAYKKSKLCKWTDEETDKFYQAI

SEQ ID NO: 3364259 - protein, 18 aa, Plasmodium falciparum
KYNYLKELCNSLKKQVIM

SEQ ID NO: 3364260 - protein, 20 aa, Plasmodium falciparum
KYNYSSLFLAKLYNSQILTG

SEQ ID NO: 3364261 - protein, 17 aa, Plasmodium falciparum
KYPAFPYEIKFEDKIEE

SEQ ID NO: 3364262 - protein, 22 aa, Plasmodium falciparum
KYPEIESTVSILSNHIKNVTFN

SEQ ID NO: 3364263 - protein, 18 aa, Plasmodium falciparum
KYPFDGCTKDLKIYTNVY

SEQ ID NO: 3364264 - protein, 18 aa, Plasmodium falciparum
KYPFSWPEFTKIIVNENG

SEQ ID NO: 3364265 - protein, 24 aa, Plasmodium falciparum
KYPHECAFPITLIYGNKDTIIHVD

SEQ ID NO: 3364266 - protein, 27 aa, Plasmodium falciparum
KYPIGNGRTGLVFKAIIKKEENKKVAL

SEQ ID NO: 3364267 - protein, 19 aa, Plasmodium falciparum
KYPLIRCICEEEGIVVSFM

SEQ ID NO: 3364268 - protein, 17 aa, Plasmodium falciparum
KYPLNLYNRNENIRIKP

SEQ ID NO: 3364269 - protein, 24 aa, Plasmodium falciparum
KYPQCSIKIKCLIIQDDGGCLSAT

SEQ ID NO: 3364270 - protein, 20 aa, Plasmodium falciparum
KYPTSIPIKERLKLVSHELK

SEQ ID NO: 3364271 - protein, 31 aa, Plasmodium falciparum
KYQDNFEFLQWFKSFFERIVDYNNEQVINYD

SEQ ID NO: 3364272 - protein, 21 aa, Plasmodium falciparum
KYQIIKGICLFVNVYSIMFLE

SEQ ID NO: 3364273 - protein, 23 aa, Plasmodium falciparum
KYQIKNLPSFMLITPNNNILVKD

SEQ ID NO: 3364274 - protein, 22 aa, Plasmodium falciparum
KYQKLPVEISVHFINAGFDTVD

SEQ ID NO: 3364275 - protein, 27 aa, Plasmodium falciparum
KYQNWLLHSCMLWFKCKGETFRFKTVD

SEQ ID NO: 3364276 - protein, 17 aa, Plasmodium falciparum
KYQSVLLDTLWYYQMLG

SEQ ID NO: 3364277 - protein, 20 aa, Plasmodium falciparum
KYQVDNCLFHNHFSQKTLKS

SEQ ID NO: 3364278 - protein, 25 aa, Plasmodium falciparum
KYRDIPIEKIRYVPKIETVELVKKI

SEQ ID NO: 3364279 - protein, 24 aa, Plasmodium falciparum
KYRIWYKSMHDIGVALLSTVMVHN

SEQ ID NO: 3364280 - protein, 35 aa, Plasmodium falciparum
KYRNILKLFSSPRCTHIYFSFNIIYQKIVKFQSFF

SEQ ID NO: 3364281 - protein, 20 aa, Plasmodium falciparum
KYRNVIVETCNYIYNIHNLF

SEQ ID NO: 3364282 - protein, 18 aa, Plasmodium falciparum
KYSFFKKYYESYPYTDIT

SEQ ID NO: 3364283 - protein, 18 aa, Plasmodium falciparum
KYSGIIYGLGSTIKNYNP

SEQ ID NO: 3364284 - protein, 24 aa, Plasmodium falciparum
KYSHSLYMKYNIKKMIYFIPKRIV

SEQ ID NO: 3364285 - protein, 28 aa, Plasmodium falciparum
KYSKENIQKICATPYTGSNISNTVESVY

SEQ ID NO: 3364286 - protein, 22 aa, Plasmodium falciparum
KYSKRIISILLMTLNKNPQKRI

SEQ ID NO: 3364287 - protein, 21 aa, Plasmodium falciparum
KYSKVCFPPIITLQEEKNNNQ

SEQ ID NO: 3364288 - protein, 18 aa, Plasmodium falciparum
KYSLFVKKDTCIISSACT

SEQ ID NO: 3364289 - protein, 22 aa, Plasmodium falciparum
KYSNLCGTKLYTNHFYETKRNN

SEQ ID NO: 3364290 - protein, 21 aa, Plasmodium falciparum
KYSTILIKNYFQLHGPDSVVH

SEQ ID NO: 3364291 - protein, 19 aa, Plasmodium falciparum
KYSTILVGGYSKKVVEKDN

SEQ ID NO: 3364292 - protein, 18 aa, Plasmodium falciparum
KYSWPSDVWATGCLIYEL

SEQ ID NO: 3364293 - protein, 24 aa, Plasmodium falciparum
KYTDEQLRFFSLIGNTQMNINTSY

SEQ ID NO: 3364294 - protein, 25 aa, Plasmodium falciparum
KYTFLKLYLPKYLCNSLIQIDLNIC

SEQ ID NO: 3364295 - protein, 26 aa, Plasmodium falciparum
KYTNLKEFFFIINVINQLYKKQISCY

SEQ ID NO: 3364296 - protein, 26 aa, Plasmodium falciparum
KYTRLHTCKPHYVLFSRCIKYRDKKL

SEQ ID NO: 3364297 - protein, 19 aa, Plasmodium falciparum
KYTSYKIDGTRYVYLKDEP

SEQ ID NO: 3364298 - protein, 18 aa, Plasmodium falciparum
KYTYTFDILNKWRELETK

SEQ ID NO: 3364299 - protein, 29 aa, Plasmodium falciparum
KYVCKTCKYTLLCADCLLNDPVHVQNKME

SEQ ID NO: 3364300 - protein, 24 aa, Plasmodium falciparum
KYVDEVKYVWKPIEKIVYVQKLIP

SEQ ID NO: 3364301 - protein, 23 aa, Plasmodium falciparum
KYVDGDIKRECVYSTDDINYVYV

SEQ ID NO: 3364302 - protein, 33 aa, Plasmodium falciparum
KYVDTFHKLKCYQKCGVLWLYVLYKQNKNGILA

SEQ ID NO: 3364303 - protein, 18 aa, Plasmodium falciparum
KYVICKKEKIQKFKKSNY

SEQ ID NO: 3364304 - protein, 19 aa, Plasmodium falciparum
KYVKACIAYAVKFNESNIF

SEQ ID NO: 3364305 - protein, 22 aa, Plasmodium falciparum
KYVKGDFLFNMYLKSDNLNFFQ

SEQ ID NO: 3364306 - protein, 30 aa, Plasmodium falciparum
KYVKTHKVFYCCQKPFPSLKYLYIHLKRKN

SEQ ID NO: 3364307 - protein, 18 aa, Plasmodium falciparum
KYVMKFLACAGSDIKKRS

SEQ ID NO: 3364308 - protein, 23 aa, Plasmodium falciparum
KYVPELLRAIDIYKNKHTEEQKN

SEQ ID NO: 3364309 - protein, 18 aa, Plasmodium falciparum
KYVQEYKDNLYILSYDNF

SEQ ID NO: 3364310 - protein, 28 aa, Plasmodium falciparum
KYVYKKTMISFSFIKVFNTISVENMHDE

SEQ ID NO: 3364311 - protein, 18 aa, Plasmodium falciparum
KYYACPINPHTCPYIFCS

SEQ ID NO: 3364312 - protein, 19 aa, Plasmodium falciparum
KYYDKGSCKINYKKDHNEY

SEQ ID NO: 3364313 - protein, 27 aa, Plasmodium falciparum
KYYECYSCKTQNLFANVQCYKCKKLRK

SEQ ID NO: 3364314 - protein, 19 aa, Plasmodium falciparum
KYYEGSFVKSIKFSTSNYG

SEQ ID NO: 3364315 - protein, 17 aa, Plasmodium falciparum
KYYELRETDIIRFGSSN

SEQ ID NO: 3364316 - protein, 23 aa, Plasmodium falciparum
KYYEQIKRIALGYISKIEDIEFC

SEQ ID NO: 3364317 - protein, 24 aa, Plasmodium falciparum
KYYKGDETFVCYNINKKEKNKMNI

SEQ ID NO: 3364318 - protein, 33 aa, Plasmodium falciparum
KYYKKKGKIERRIKEHNCYSGIIGENERNKIID

SEQ ID NO: 3364319 - protein, 18 aa, Plasmodium falciparum
KYYLCLWAGSSLVATMPT

SEQ ID NO: 3364320 - protein, 20 aa, Plasmodium falciparum
KYYLIDFCPHDLFPNTKSDI

SEQ ID NO: 3364321 - protein, 27 aa, Plasmodium falciparum
KYYLNEKRILKTCTKYFMDNFLSLIDK

SEQ ID NO: 3364322 - protein, 25 aa, Plasmodium falciparum
KYYNVCMNNLYILRNERIPIFGKNF

SEQ ID NO: 3364323 - protein, 17 aa, Plasmodium falciparum
KYYSNDCKVCSKKYNKV

SEQ ID NO: 3364324 - protein, 24 aa, Plasmodium falciparum
LAAEAKPLLLSVLTARIPQVPITE

SEQ ID NO: 3364325 - protein, 18 aa, Plasmodium falciparum
LAALSNHHILCIATHDSV

SEQ ID NO: 3364326 - protein, 42 aa, Plasmodium falciparum
LACANKCVFCWRHHKNPVGVKWRWNMDKAEIIVEEIIKKHKA

SEQ ID NO: 3364327 - protein, 35 aa, Plasmodium falciparum
LACISSLEKEVCRIHTYLNEWRSMHSYEDEEKKSS

SEQ ID NO: 3364328 - protein, 24 aa, Plasmodium falciparum
LADEEPYVFFLYKSSNIFMPLGYL

SEQ ID NO: 3364329 - protein, 23 aa, Plasmodium falciparum
LADMWCFSKNSWTPIKQIDRIPE

SEQ ID NO: 3364330 - protein, 22 aa, Plasmodium falciparum
LAEKELKLAKKLERENLKNEAA

SEQ ID NO: 3364331 - protein, 20 aa, Plasmodium falciparum
LAEKICKYIERIIKTKTFSL

SEQ ID NO: 3364332 - protein, 27 aa, Plasmodium falciparum
LAEQIYYEYFQRGLIKNDHNFHLNNSK

SEQ ID NO: 3364333 - protein, 17 aa, Plasmodium falciparum
LAFFFKELSCSLETNLD

SEQ ID NO: 3364334 - protein, 25 aa, Plasmodium falciparum
LAGTEYCLTFPYLNLSHFNNGYKQF

SEQ ID NO: 3364335 - protein, 29 aa, Plasmodium falciparum
LAHLCKLKRSITCLFILKPDIHILTFEQT

SEQ ID NO: 3364336 - protein, 19 aa, Plasmodium falciparum
LAHSGFCFEKIITPVNELN

SEQ ID NO: 3364337 - protein, 18 aa, Plasmodium falciparum
LAIEKVKRASRFKENNNI

SEQ ID NO: 3364338 - protein, 25 aa, Plasmodium falciparum
LAILGRDSLSLSLPEEVKGENDQVI

SEQ ID NO: 3364339 - protein, 21 aa, Plasmodium falciparum
LAISMAVCRAGAAANKVSLYK

SEQ ID NO: 3364340 - protein, 17 aa, Plasmodium falciparum
LAKEFINNFSLYLDKAG

SEQ ID NO: 3364341 - protein, 25 aa, Plasmodium falciparum
LAKEYLCKYTFLLVGKVGSTNEYIK

SEQ ID NO: 3364342 - protein, 29 aa, Plasmodium falciparum
LAKGNYPWIYLSLRLKYDIVDINVHPTKK

SEQ ID NO: 3364343 - protein, 20 aa, Plasmodium falciparum
LAKHLEIKKIPSAYNEEEQK

SEQ ID NO: 3364344 - protein, 17 aa, Plasmodium falciparum
LAKKAIEEFGLKSLPYI

SEQ ID NO: 3364345 - protein, 26 aa, Plasmodium falciparum
LALAESFSIKCGILALDEPTTNLDKA

SEQ ID NO: 3364346 - protein, 19 aa, Plasmodium falciparum
LALDKKCLDISNDLKRRRF

SEQ ID NO: 3364347 - protein, 20 aa, Plasmodium falciparum
LALIKKCLGLKMVEEEKNEN

SEQ ID NO: 3364348 - protein, 20 aa, Plasmodium falciparum
LALILKRMFENINENEKWLI

SEQ ID NO: 3364349 - protein, 25 aa, Plasmodium falciparum
LALKNRYEALFLLRDMETDTSLNAL

SEQ ID NO: 3364350 - protein, 18 aa, Plasmodium falciparum
LALLKTFPQFIIKELLQV

SEQ ID NO: 3364351 - protein, 23 aa, Plasmodium falciparum
LALLKVRTVPMYILDEIDAALDL

SEQ ID NO: 3364352 - protein, 21 aa, Plasmodium falciparum
LANCHVIFENGHIVLSMNEYS

SEQ ID NO: 3364353 - protein, 18 aa, Plasmodium falciparum
LANEICSNLGIGLGRAYV

SEQ ID NO: 3364354 - protein, 24 aa, Plasmodium falciparum
LANKSCVPKGCLELDNKKDVFNKM

SEQ ID NO: 3364355 - protein, 25 aa, Plasmodium falciparum
LANLEKPKFRSVQESMDENLNLEFL

SEQ ID NO: 3364356 - protein, 27 aa, Plasmodium falciparum
LANSGRLKAAMTFLCLIQHDQSIESLI

SEQ ID NO: 3364357 - protein, 21 aa, Plasmodium falciparum
LANTKCVRMGRGHDSDVRVND

SEQ ID NO: 3364358 - protein, 22 aa, Plasmodium falciparum
LAPGEKKVTCTISDKGDCNIFV

SEQ ID NO: 3364359 - protein, 17 aa, Plasmodium falciparum
LAPIAVDVILKITDINK

SEQ ID NO: 3364360 - protein, 20 aa, Plasmodium falciparum
LAQFREIVAFSQFGSDLDVS

SEQ ID NO: 3364361 - protein, 22 aa, Plasmodium falciparum
LAQLKQQFILQFKKELNSLHFG

SEQ ID NO: 3364362 - protein, 23 aa, Plasmodium falciparum
LARFDFLFELGFEKDEDIINEIL

SEQ ID NO: 3364363 - protein, 17 aa, Plasmodium falciparum
LARHIASLFVRDPIVVF

SEQ ID NO: 3364364 - protein, 29 aa, Plasmodium falciparum
LASDGIKIWDIYNCYAIKTLKYGENVINF

SEQ ID NO: 3364365 - protein, 19 aa, Plasmodium falciparum
LASHFSMNFFDSSETPIKF

SEQ ID NO: 3364366 - protein, 18 aa, Plasmodium falciparum
LASNPYKNDLTCSYNNNG

SEQ ID NO: 3364367 - protein, 17 aa, Plasmodium falciparum
LASQLIKQFKIIFENAG

SEQ ID NO: 3364368 - protein, 20 aa, Plasmodium falciparum
LATITVKWTIQYTFNPLKKK

SEQ ID NO: 3364369 - protein, 23 aa, Plasmodium falciparum
LATVEFPFWFYIDNLKHIYKKEF

SEQ ID NO: 3364370 - protein, 31 aa, Plasmodium falciparum
LAVYRGHVGPVYKVAWSIDNNFFVSCSQDST

SEQ ID NO: 3364371 - protein, 18 aa, Plasmodium falciparum
LCCHKKRYFELAVKEIDI

SEQ ID NO: 3364372 - protein, 17 aa, Plasmodium falciparum
LCDGCPNSYHVSCLGLA

SEQ ID NO: 3364373 - protein, 18 aa, Plasmodium falciparum
LCDKENGKKCHPLIYNNN

SEQ ID NO: 3364374 - protein, 24 aa, Plasmodium falciparum
LCDSIDIPCRYIRYVKNKTVHYFN

SEQ ID NO: 3364375 - protein, 17 aa, Plasmodium falciparum
LCDVMKNSNELKRINDN

SEQ ID NO: 3364376 - protein, 23 aa, Plasmodium falciparum
LCDYLKGEIVDLQLLREHNERNL

SEQ ID NO: 3364377 - protein, 24 aa, Plasmodium falciparum
LCDYLRDEMSVLFNVDIEDHSDIE

SEQ ID NO: 3364378 - protein, 19 aa, Plasmodium falciparum
LCEKIMKGDLTFTSEQWDN

SEQ ID NO: 3364379 - protein, 18 aa, Plasmodium falciparum
LCENNCGFYGNPANNNLC

SEQ ID NO: 3364380 - protein, 27 aa, Plasmodium falciparum
LCEPKIARLRLYFIVSYLHAIILERRR

SEQ ID NO: 3364381 - protein, 25 aa, Plasmodium falciparum
LCEYITNCVCIFKYNEVTMKKEIFM

SEQ ID NO: 3364382 - protein, 19 aa, Plasmodium falciparum
LCFIVRKFYSSPVIHTNRI

SEQ ID NO: 3364383 - protein, 20 aa, Plasmodium falciparum
LCFMNRVIHLSGIVHVRSLL

SEQ ID NO: 3364384 - protein, 23 aa, Plasmodium falciparum
LCGIIKEKINSIIVTSGTLSPIE

SEQ ID NO: 3364385 - protein, 18 aa, Plasmodium falciparum
LCGINGPIVTVIRALLTP

SEQ ID NO: 3364386 - protein, 25 aa, Plasmodium falciparum
LCGLYRRLKLLKGVCIAFYGLYGLL

SEQ ID NO: 3364387 - protein, 24 aa, Plasmodium falciparum
LCGQRLRNYMYLKYIKGKKNKNGS

SEQ ID NO: 3364388 - protein, 21 aa, Plasmodium falciparum
LCGTPEYLAPEIIEQKGHGKA

SEQ ID NO: 3364389 - protein, 17 aa, Plasmodium falciparum
LCGTPGRILDLANKDVA

SEQ ID NO: 3364390 - protein, 23 aa, Plasmodium falciparum
LCHRYEYPHLLLLQHIESQKYYL

SEQ ID NO: 3364391 - protein, 27 aa, Plasmodium falciparum
LCIILNEIIKFLFLNDEYVLLFEKIHK

SEQ ID NO: 3364392 - protein, 18 aa, Plasmodium falciparum
LCILSIPCTVDIDTVITE

SEQ ID NO: 3364393 - protein, 20 aa, Plasmodium falciparum
LCINCSGVHRSLGVHISIVR

SEQ ID NO: 3364394 - protein, 27 aa, Plasmodium falciparum
LCITKELKKVFDAYGIQIDFRHLSFIS

SEQ ID NO: 3364395 - protein, 20 aa, Plasmodium falciparum
LCIYETFINLCGEFVKKVVN

SEQ ID NO: 3364396 - protein, 18 aa, Plasmodium falciparum
LCKTLALDLILSAYNDNF

SEQ ID NO: 3364397 - protein, 20 aa, Plasmodium falciparum
LCLECKDGIICCCINSNMDK

SEQ ID NO: 3364398 - protein, 18 aa, Plasmodium falciparum
LCLEEILKNINLILKKQI

SEQ ID NO: 3364399 - protein, 24 aa, Plasmodium falciparum
LCLHKNRMADALLLSSFGGEQLWH

SEQ ID NO: 3364400 - protein, 17 aa, Plasmodium falciparum
LCLIVTNIPVEWSKYDV

SEQ ID NO: 3364401 - protein, 20 aa, Plasmodium falciparum
LCNAFEYIYHSDIFEFNYFN

SEQ ID NO: 3364402 - protein, 20 aa, Plasmodium falciparum
LCNDEIMWTYADILITTPDI

SEQ ID NO: 3364403 - protein, 23 aa, Plasmodium falciparum
LCNDTRLSNSFLNLIKKEIKIQD

SEQ ID NO: 3364404 - protein, 23 aa, Plasmodium falciparum
LCNENIKKIDFYILKIILNELDE

SEQ ID NO: 3364405 - protein, 18 aa, Plasmodium falciparum
LCNIIYPIFNKIFGNGFV

SEQ ID NO: 3364406 - protein, 20 aa, Plasmodium falciparum
LCNLKNVIKVLVLIDQLFCS

SEQ ID NO: 3364407 - protein, 22 aa, Plasmodium falciparum
LCNLLNIKYCQGYGLTETGGAI

SEQ ID NO: 3364408 - protein, 18 aa, Plasmodium falciparum
LCNLLPINEWPSTNFYDI

SEQ ID NO: 3364409 - protein, 17 aa, Plasmodium falciparum
LCPINVFLSYQKENTLD

SEQ ID NO: 3364410 - protein, 28 aa, Plasmodium falciparum
LCQENQGLLDWFCIPLLQHSVFYDISFS

SEQ ID NO: 3364411 - protein, 18 aa, Plasmodium falciparum
LCSDKNCKHKMCSSNKYN

SEQ ID NO: 3364412 - protein, 20 aa, Plasmodium falciparum
LCSHIKDVQSLFNYKEVKSK

SEQ ID NO: 3364413 - protein, 20 aa, Plasmodium falciparum
LCSILLRIDNIILKCNLYDF

SEQ ID NO: 3364414 - protein, 25 aa, Plasmodium falciparum
LCSLKAGGVGLNLTVSSKVYLMDLW

SEQ ID NO: 3364415 - protein, 27 aa, Plasmodium falciparum
LCSNIKNGYSYCLICCSQKIRIGSIIN

SEQ ID NO: 3364416 - protein, 20 aa, Plasmodium falciparum
LCSYIPLKYENKIKKNSSTD

SEQ ID NO: 3364417 - protein, 24 aa, Plasmodium falciparum
LCTGETGLGYYLKPRWYKNSPIHR

SEQ ID NO: 3364418 - protein, 24 aa, Plasmodium falciparum
LCTISGKRKKCIVKNIKKVKKKKG

SEQ ID NO: 3364419 - protein, 20 aa, Plasmodium falciparum
LCTITSIAYHFNIINQNFLN

SEQ ID NO: 3364420 - protein, 20 aa, Plasmodium falciparum
LCTSPASLLSLYYLSEHILQ

SEQ ID NO: 3364421 - protein, 27 aa, Plasmodium falciparum
LCTVVCSRMLKKLCEKYGYKYDETLTG

SEQ ID NO: 3364422 - protein, 19 aa, Plasmodium falciparum
LCVITYCYANILYNNDNLF

SEQ ID NO: 3364423 - protein, 18 aa, Plasmodium falciparum
LCYIPISLSKKNVFLFGD

SEQ ID NO: 3364424 - protein, 17 aa, Plasmodium falciparum
LCYLKRKNVILEDKCTF

SEQ ID NO: 3364425 - protein, 20 aa, Plasmodium falciparum
LCYVGMCSIFLYYDNEEENE

SEQ ID NO: 3364426 - protein, 27 aa, Plasmodium falciparum
LDAEQLWYLIECLIKKKNLNNLLEFFK

SEQ ID NO: 3364427 - protein, 19 aa, Plasmodium falciparum
LDAFKERNVELIGCSVDSK

SEQ ID NO: 3364428 - protein, 26 aa, Plasmodium falciparum
LDASEFLKKFCTFRKFVSGGKGGQLN

SEQ ID NO: 3364429 - protein, 24 aa, Plasmodium falciparum
LDAYRRSFFRLVDLDIIVLSSYSL

SEQ ID NO: 3364430 - protein, 22 aa, Plasmodium falciparum
LDAYTGHFLYSYNFMYENNSYI

SEQ ID NO: 3364431 - protein, 18 aa, Plasmodium falciparum
LDCIKPLNDSRCLRIVKG

SEQ ID NO: 3364432 - protein, 20 aa, Plasmodium falciparum
LDCYMLLCTALYNLNVKNGF

SEQ ID NO: 3364433 - protein, 27 aa, Plasmodium falciparum
LDDALCLGMDWCVKEGYSWIEDKLNCE

SEQ ID NO: 3364434 - protein, 50 aa, Plasmodium falciparum
LDDALLDCYGRFIALLPEFLLKDHVHLYFQIQEAYWWYDDMWQDKYPDKL

SEQ ID NO: 3364435 - protein, 18 aa, Plasmodium falciparum
LDDEELEVVFSFDPDKDA

SEQ ID NO: 3364436 - protein, 21 aa, Plasmodium falciparum
LDDGIEFSGGLYFNEKKSTEE

SEQ ID NO: 3364437 - protein, 22 aa, Plasmodium falciparum
LDDIEGNLSLFVIKRPDLFGSI

SEQ ID NO: 3364438 - protein, 20 aa, Plasmodium falciparum
LDDIFSFFKKFENVQENYQI

SEQ ID NO: 3364439 - protein, 23 aa, Plasmodium falciparum
LDDKRKAVQFIIDRYNEYTWFDK

SEQ ID NO: 3364440 - protein, 25 aa, Plasmodium falciparum
LDDLCRKVKIAFLYLGNIDLAQKVE

SEQ ID NO: 3364441 - protein, 22 aa, Plasmodium falciparum
LDDMLEMLRNVIRMEEKQKKKT

SEQ ID NO: 3364442 - protein, 18 aa, Plasmodium falciparum
LDDYENWLYDNIEENKNM

SEQ ID NO: 3364443 - protein, 22 aa, Plasmodium falciparum
LDEALLRPGRLDQLIYIPLPDL

SEQ ID NO: 3364444 - protein, 17 aa, Plasmodium falciparum
LDEEAFAPFNPRGYEGK

SEQ ID NO: 3364445 - protein, 18 aa, Plasmodium falciparum
LDEGLSRTRHSVHDEKCN

SEQ ID NO: 3364446 - protein, 20 aa, Plasmodium falciparum
LDEHRISYVDAYREKQTKIE

SEQ ID NO: 3364447 - protein, 21 aa, Plasmodium falciparum
LDEIAYLLNLRGYDYQYSPLF

SEQ ID NO: 3364448 - protein, 22 aa, Plasmodium falciparum
LDEKSIKIGLYIIIKNKHFVKQ

SEQ ID NO: 3364449 - protein, 29 aa, Plasmodium falciparum
LDELRKVNEPHYVSFEFTQDCINNGETKY

SEQ ID NO: 3364450 - protein, 19 aa, Plasmodium falciparum
LDEMRVWSEMGYFEPMLPV

SEQ ID NO: 3364451 - protein, 22 aa, Plasmodium falciparum
LDERHKTILFYGYKNILKYIYL

SEQ ID NO: 3364452 - protein, 18 aa, Plasmodium falciparum
LDEVLKLVKNITMEGLTW

SEQ ID NO: 3364453 - protein, 21 aa, Plasmodium falciparum
LDFCDKLYLNKNVIHIILSSL

SEQ ID NO: 3364454 - protein, 25 aa, Plasmodium falciparum
LDFDLCKRKVLEILKNVQSSKKKNK

SEQ ID NO: 3364455 - protein, 21 aa, Plasmodium falciparum
LDFIIKCFNSIGVLPNEQEEI

SEQ ID NO: 3364456 - protein, 22 aa, Plasmodium falciparum
LDFIQSYWYWKIRSESNLLNYE

SEQ ID NO: 3364457 - protein, 18 aa, Plasmodium falciparum
LDFKNIVIGFRLYANSLE

SEQ ID NO: 3364458 - protein, 28 aa, Plasmodium falciparum
LDGCYFGTSFASFFALSFNIASDKKKVY

SEQ ID NO: 3364459 - protein, 17 aa, Plasmodium falciparum
LDGGINYIIKELDEIER

SEQ ID NO: 3364460 - protein, 18 aa, Plasmodium falciparum
LDGIPNYFNVIKNPMDFE

SEQ ID NO: 3364461 - protein, 24 aa, Plasmodium falciparum
LDGKLCLWNTIYCCKIQKINKMMN

SEQ ID NO: 3364462 - protein, 22 aa, Plasmodium falciparum
LDGSRPIPIDKITYELSQNIIL

SEQ ID NO: 3364463 - protein, 20 aa, Plasmodium falciparum
LDHISFLVVDDIYEIYKKKK

SEQ ID NO: 3364464 - protein, 26 aa, Plasmodium falciparum
LDHYTRKPRGFGFVEYFESKYAKEAI

SEQ ID NO: 3364465 - protein, 23 aa, Plasmodium falciparum
LDIDIYIGYNILNFDLEFLIHRC

SEQ ID NO: 3364466 - protein, 32 aa, Plasmodium falciparum
LDIDLLPTPLLFYLYDNFKILQTLICKNSKEL

SEQ ID NO: 3364467 - protein, 26 aa, Plasmodium falciparum
LDIFLCSNCTSLLRIVNLNSGQVYQK

SEQ ID NO: 3364468 - protein, 28 aa, Plasmodium falciparum
LDIHNRLPIHSACLGGVLENVKILVENK

SEQ ID NO: 3364469 - protein, 20 aa, Plasmodium falciparum
LDIISLWGMKVVNPIEKILA

SEQ ID NO: 3364470 - protein, 25 aa, Plasmodium falciparum
LDIKEKKFNIDIINVFSSNKNLEDN

SEQ ID NO: 3364471 - protein, 20 aa, Plasmodium falciparum
LDIKKYISIIYKRKKHMNII

SEQ ID NO: 3364472 - protein, 25 aa, Plasmodium falciparum
LDIKMKIILLTSIEWHNNLTQTIKN

SEQ ID NO: 3364473 - protein, 33 aa, Plasmodium falciparum
LDILDIGSACLKIGQVVPVKILGAFTLIDEGEL

SEQ ID NO: 3364474 - protein, 17 aa, Plasmodium falciparum
LDILSSVLIQKIKQCTI

SEQ ID NO: 3364475 - protein, 17 aa, Plasmodium falciparum
LDINGGCRFFIDMFRLG

SEQ ID NO: 3364476 - protein, 24 aa, Plasmodium falciparum
LDINKLFESFLFKVISELDQGEAK

SEQ ID NO: 3364477 - protein, 20 aa, Plasmodium falciparum
LDIPNKIYIHDNLKDIYNDD

SEQ ID NO: 3364478 - protein, 20 aa, Plasmodium falciparum
LDIQKDCSFLSAEEFDEDIL

SEQ ID NO: 3364479 - protein, 19 aa, Plasmodium falciparum
LDISMDLLDCVLRQRDEQK

SEQ ID NO: 3364480 - protein, 24 aa, Plasmodium falciparum
LDKDIKSAFHLYRKMIKENIEVDI

SEQ ID NO: 3364481 - protein, 19 aa, Plasmodium falciparum
LDKEFNFLEIVLITNALCK

SEQ ID NO: 3364482 - protein, 18 aa, Plasmodium falciparum
LDKEKKASVYFSNNQKFL

SEQ ID NO: 3364483 - protein, 40 aa, Plasmodium falciparum
LDKIGRSALHYACAGGYFDICELLIKNGAKVNVSDYKNWT

SEQ ID NO: 3364484 - protein, 47 aa, Plasmodium falciparum
LDKIYKMFVEIYYMKKIIRFIIFSFFKFHDIYSVFNVNTFDGVSYCA

SEQ ID NO: 3364485 - protein, 25 aa, Plasmodium falciparum
LDKKEHKINIGIERKEEVYLEKLYY

SEQ ID NO: 3364486 - protein, 17 aa, Plasmodium falciparum
LDKKFKFKTIVENYLNY

SEQ ID NO: 3364487 - protein, 25 aa, Plasmodium falciparum
LDKKFRLSNWLNYSLLQEQILYAAV

SEQ ID NO: 3364488 - protein, 21 aa, Plasmodium falciparum
LDKKKFLSFNLEKLHLKKKLE

SEQ ID NO: 3364489 - protein, 19 aa, Plasmodium falciparum
LDKLCRDYNLYNIKTEHVL

SEQ ID NO: 3364490 - protein, 30 aa, Plasmodium falciparum
LDKLSALTINEFIDIYSLVILAALVSDDKQ

SEQ ID NO: 3364491 - protein, 27 aa, Plasmodium falciparum
LDKNVKGTLALLYKYYSNIKVKCPHNG

SEQ ID NO: 3364492 - protein, 22 aa, Plasmodium falciparum
LDKNYKGQIIIDGKNEVDEFLL

SEQ ID NO: 3364493 - protein, 27 aa, Plasmodium falciparum
LDLAYPLLFKRKFILKKIKTNEKLNKI

SEQ ID NO: 3364494 - protein, 20 aa, Plasmodium falciparum
LDLCLRLLDPNPWTRIQNAR

SEQ ID NO: 3364495 - protein, 29 aa, Plasmodium falciparum
LDLDIYYPLLHVEQIKFRQSNQEQNIFAA

SEQ ID NO: 3364496 - protein, 18 aa, Plasmodium falciparum
LDLDLVECLMARRNELPH

SEQ ID NO: 3364497 - protein, 19 aa, Plasmodium falciparum
LDLEFCKNGNDFYSFKYMS

SEQ ID NO: 3364498 - protein, 23 aa, Plasmodium falciparum
LDLIKCLQDDSGIYFILDPSKAI

SEQ ID NO: 3364499 - protein, 22 aa, Plasmodium falciparum
LDLKKKVEVVLADMPSDKQKLI

SEQ ID NO: 3364500 - protein, 17 aa, Plasmodium falciparum
LDLLFNFHFLYYFFDNI

SEQ ID NO: 3364501 - protein, 19 aa, Plasmodium falciparum
LDLLKKGKIELAIHLQSQM

SEQ ID NO: 3364502 - protein, 20 aa, Plasmodium falciparum
LDLRNSLNINQYFKKIECDN

SEQ ID NO: 3364503 - protein, 21 aa, Plasmodium falciparum
LDLYRPIFFYYMLNYKRNEEF

SEQ ID NO: 3364504 - protein, 20 aa, Plasmodium falciparum
LDMHLSRKGSIYDSLIHLKP

SEQ ID NO: 3364505 - protein, 17 aa, Plasmodium falciparum
LDNDVLIKFPFLHVDHP

SEQ ID NO: 3364506 - protein, 23 aa, Plasmodium falciparum
LDNELKSILDLREILNNKEDNDS

SEQ ID NO: 3364507 - protein, 19 aa, Plasmodium falciparum
LDNFLDMILNYSYYLLNDS

SEQ ID NO: 3364508 - protein, 17 aa, Plasmodium falciparum
LDNGIISFLWMKRTLEF

SEQ ID NO: 3364509 - protein, 27 aa, Plasmodium falciparum
LDNHFKGPSSIGWRVEFRTPDIQITDF

SEQ ID NO: 3364510 - protein, 31 aa, Plasmodium falciparum
LDNKIDMESFKHCWKSFFLESDENSYEYTKE

SEQ ID NO: 3364511 - protein, 20 aa, Plasmodium falciparum
LDNKMYAFKNTVEYDKDMKK

SEQ ID NO: 3364512 - protein, 24 aa, Plasmodium falciparum
LDNLKNRRLVGGIGSGFHFNNPLQ

SEQ ID NO: 3364513 - protein, 24 aa, Plasmodium falciparum
LDNNAYKVVEFCFTDYENNKNKNN

SEQ ID NO: 3364514 - protein, 17 aa, Plasmodium falciparum
LDNTCGFMATISSKYNE

SEQ ID NO: 3364515 - protein, 27 aa, Plasmodium falciparum
LDNTRIHPSNCYDIIYDMLKNTVEKKN

SEQ ID NO: 3364516 - protein, 18 aa, Plasmodium falciparum
LDNWLQMDINDFEKYLLR

SEQ ID NO: 3364517 - protein, 18 aa, Plasmodium falciparum
LDPPFLFIVPSSQNFPTM

SEQ ID NO: 3364518 - protein, 21 aa, Plasmodium falciparum
LDPPSPIVIIKGLELLYSLGA

SEQ ID NO: 3364519 - protein, 17 aa, Plasmodium falciparum
LDQYALIQVGIWCIGEF

SEQ ID NO: 3364520 - protein, 24 aa, Plasmodium falciparum
LDQYEFVILPSLKYINISNTNIAL

SEQ ID NO: 3364521 - protein, 22 aa, Plasmodium falciparum
LDRDTFCLLCSYFSDASLYIEL

SEQ ID NO: 3364522 - protein, 22 aa, Plasmodium falciparum
LDRTLTPLAICDIKNKTSQKKN

SEQ ID NO: 3364523 - protein, 19 aa, Plasmodium falciparum
LDSISFCSELLPFYCKSEI

SEQ ID NO: 3364524 - protein, 17 aa, Plasmodium falciparum
LDSSIAMKTVINKYKSI

SEQ ID NO: 3364525 - protein, 18 aa, Plasmodium falciparum
LDSYNGLCYTNGKNNIFC

SEQ ID NO: 3364526 - protein, 22 aa, Plasmodium falciparum
LDSYNLKDFFIDNNNYNMKEEK

SEQ ID NO: 3364527 - protein, 20 aa, Plasmodium falciparum
LDTFWNAHSFFLFIKGKFQD

SEQ ID NO: 3364528 - protein, 18 aa, Plasmodium falciparum
LDTLKLMLNKIIYPLFIN

SEQ ID NO: 3364529 - protein, 34 aa, Plasmodium falciparum
LDTPGHKVFQIFRGRAAFLSDILIILISLEVGAE

SEQ ID NO: 3364530 - protein, 22 aa, Plasmodium falciparum
LDTSWRSVSIILEHSENVNTKF

SEQ ID NO: 3364531 - protein, 23 aa, Plasmodium falciparum
LDVCKFKKQILFFSATLTSDIKQ

SEQ ID NO: 3364532 - protein, 24 aa, Plasmodium falciparum
LDVDELRTYLGLMGDKINPDDFNI

SEQ ID NO: 3364533 - protein, 24 aa, Plasmodium falciparum
LDVKKSESLLAMYQQINEYFQAIF

SEQ ID NO: 3364534 - protein, 27 aa, Plasmodium falciparum
LDVKYYLRIPMSTGWNHFGYLKNQNNV

SEQ ID NO: 3364535 - protein, 28 aa, Plasmodium falciparum
LDVLKEYIFQKLEIIRVYTKVRKEKPDF

SEQ ID NO: 3364536 - protein, 23 aa, Plasmodium falciparum
LDVRLKLAIEYCTPEIKRMFFEN

SEQ ID NO: 3364537 - protein, 26 aa, Plasmodium falciparum
LDVRNPLFFYCPGLEYYIKKVDKRKK

SEQ ID NO: 3364538 - protein, 19 aa, Plasmodium falciparum
LDYAKKCAVNRKYDESLNI

SEQ ID NO: 3364539 - protein, 17 aa, Plasmodium falciparum
LDYIKRLTQNNNNNENL

SEQ ID NO: 3364540 - protein, 19 aa, Plasmodium falciparum
LDYILRYKNNLTFNNEKTS

SEQ ID NO: 3364541 - protein, 17 aa, Plasmodium falciparum
LDYKHILENILLKTDIN

SEQ ID NO: 3364542 - protein, 17 aa, Plasmodium falciparum
LDYLKRKFSNYRKNKEE

SEQ ID NO: 3364543 - protein, 19 aa, Plasmodium falciparum
LDYMISLNIEDLFGSLENL

SEQ ID NO: 3364544 - protein, 25 aa, Plasmodium falciparum
LDYNNMKSLCYNEELFDDDKNVPKI

SEQ ID NO: 3364545 - protein, 33 aa, Plasmodium falciparum
LDYYVFSLISYIPLKLFPLSKEILYDTKPIVLI

SEQ ID NO: 3364546 - protein, 19 aa, Plasmodium falciparum
LDYYVQKLESFKCLFFTKD

SEQ ID NO: 3364547 - protein, 23 aa, Plasmodium falciparum
LEADNRWSSLVILTKGEKKQLFC

SEQ ID NO: 3364548 - protein, 18 aa, Plasmodium falciparum
LEAFKNTLLIFDFNLSEF

SEQ ID NO: 3364549 - protein, 18 aa, Plasmodium falciparum
LEALYGLNDFSIFEKVYG

SEQ ID NO: 3364550 - protein, 21 aa, Plasmodium falciparum
LEATPFCTIQAIDYSSLERIK

SEQ ID NO: 3364551 - protein, 25 aa, Plasmodium falciparum
LEDIKEGFHSQGLIINAILINQKYV

SEQ ID NO: 3364552 - protein, 20 aa, Plasmodium falciparum
LEDILLLTIKKYNKFLFDKE

SEQ ID NO: 3364553 - protein, 26 aa, Plasmodium falciparum
LEDIYFRIRHSVLFFHKDIQGLKDNH

SEQ ID NO: 3364554 - protein, 17 aa, Plasmodium falciparum
LEDLKCLVNNSAFFSVN

SEQ ID NO: 3364555 - protein, 26 aa, Plasmodium falciparum
LEDNFLKIFFSFNFYFTNDIIPYISA

SEQ ID NO: 3364556 - protein, 21 aa, Plasmodium falciparum
LEDREHVFEYNISVANENTTN

SEQ ID NO: 3364557 - protein, 32 aa, Plasmodium falciparum
LEDRYEKKNCLFKKKERHYKELLIQKDNDLNM

SEQ ID NO: 3364558 - protein, 18 aa, Plasmodium falciparum
LEDVRHVSFENVYLKNKE

SEQ ID NO: 3364559 - protein, 24 aa, Plasmodium falciparum
LEDYIKIINCYSKVYEYKENDSHR

SEQ ID NO: 3364560 - protein, 30 aa, Plasmodium falciparum
LEEDSVCACREIYEEIGIDIFPYIDEQVYI

SEQ ID NO: 3364561 - protein, 20 aa, Plasmodium falciparum
LEEFELYLLDALEYAHENDK

SEQ ID NO: 3364562 - protein, 24 aa, Plasmodium falciparum
LEEGEGPIGLIICPSRELATQTHN

SEQ ID NO: 3364563 - protein, 20 aa, Plasmodium falciparum
LEEIPSPFLNISEIKYSVSA

SEQ ID NO: 3364564 - protein, 21 aa, Plasmodium falciparum
LEEKFKFLLGDSNINTHQYEN

SEQ ID NO: 3364565 - protein, 21 aa, Plasmodium falciparum
LEEKLKALNLLKEPFKNLDIN

SEQ ID NO: 3364566 - protein, 23 aa, Plasmodium falciparum
LEEKRINHVFKKFLNNEDLDIHI

SEQ ID NO: 3364567 - protein, 28 aa, Plasmodium falciparum
LEELFTCIKEAILKQNDLCYLMKEDMNS

SEQ ID NO: 3364568 - protein, 17 aa, Plasmodium falciparum
LEELKIHMPEGYKTKED

SEQ ID NO: 3364569 - protein, 24 aa, Plasmodium falciparum
LEELKKIMQVCMKDCDITLHDTED

SEQ ID NO: 3364570 - protein, 34 aa, Plasmodium falciparum
LEENLRNGISTTDCADCADSLVTSNSNIGEEFNE

SEQ ID NO: 3364571 - protein, 21 aa, Plasmodium falciparum
LEERLYFVLTSLYFSMNIQLT

SEQ ID NO: 3364572 - protein, 27 aa, Plasmodium falciparum
LEESISYFFNVIWFTTLVSKFKNVKLI

SEQ ID NO: 3364573 - protein, 18 aa, Plasmodium falciparum
LEESITCFNNHKKKENMK

SEQ ID NO: 3364574 - protein, 25 aa, Plasmodium falciparum
LEEYCKYRCWKYMRLDGSTNKLIRE

SEQ ID NO: 3364575 - protein, 20 aa, Plasmodium falciparum
LEFFLKRLIHTTSNDLMSNV

SEQ ID NO: 3364576 - protein, 26 aa, Plasmodium falciparum
LEFRQKCLLCNNYLSFSHLYLSKFVK

SEQ ID NO: 3364577 - protein, 21 aa, Plasmodium falciparum
LEGANINRSLLALGNVINALV

SEQ ID NO: 3364578 - protein, 21 aa, Plasmodium falciparum
LEGELKVGNMTVIKDISKLRK

SEQ ID NO: 3364579 - protein, 26 aa, Plasmodium falciparum
LEGHNRTGKGLFFRENYLLSNGDDKN

SEQ ID NO: 3364580 - protein, 18 aa, Plasmodium falciparum
LEGHSGIIQGISFDNNYE

SEQ ID NO: 3364581 - protein, 19 aa, Plasmodium falciparum
LEGKKLFFELYMKEKDSEI

SEQ ID NO: 3364582 - protein, 20 aa, Plasmodium falciparum
LEHCFKYNLFEEYNYPHIHT

SEQ ID NO: 3364583 - protein, 20 aa, Plasmodium falciparum
LEHCSIVELVYRCISLLPKH

SEQ ID NO: 3364584 - protein, 20 aa, Plasmodium falciparum
LEHELSHCYEENQKLNEEIK

SEQ ID NO: 3364585 - protein, 17 aa, Plasmodium falciparum
LEHKIHYNNNYTINKEF

SEQ ID NO: 3364586 - protein, 18 aa, Plasmodium falciparum
LEHLKNRYGQMLRDSQKK

SEQ ID NO: 3364587 - protein, 18 aa, Plasmodium falciparum
LEHMMSFHIGEIVTSMQK

SEQ ID NO: 3364588 - protein, 23 aa, Plasmodium falciparum
LEIDGRKIISWGEEAVILFYDID

SEQ ID NO: 3364589 - protein, 19 aa, Plasmodium falciparum
LEIKKKCHIYNENNNIVIY

SEQ ID NO: 3364590 - protein, 21 aa, Plasmodium falciparum
LEILCKKSLILKNTLPSLRNI

SEQ ID NO: 3364591 - protein, 19 aa, Plasmodium falciparum
LEIMKRHIIKEIYNTNQQE

SEQ ID NO: 3364592 - protein, 19 aa, Plasmodium falciparum
LEINISLLNEENMNILNQN

SEQ ID NO: 3364593 - protein, 17 aa, Plasmodium falciparum
LEIQLREKFNVIKQDKK

SEQ ID NO: 3364594 - protein, 22 aa, Plasmodium falciparum
LEISEIYSLVNVMHKINKFQSF

SEQ ID NO: 3364595 - protein, 18 aa, Plasmodium falciparum
LEKAFKLFDKDGSGKISA

SEQ ID NO: 3364596 - protein, 19 aa, Plasmodium falciparum
LEKALEWKKKMEDMKKKKE

SEQ ID NO: 3364597 - protein, 17 aa, Plasmodium falciparum
LEKAYTVLNQCNYVILD

SEQ ID NO: 3364598 - protein, 18 aa, Plasmodium falciparum
LEKCKRLSLSTNRIEKLI

SEQ ID NO: 3364599 - protein, 18 aa, Plasmodium falciparum
LEKCKSFERLSDREKWKS

SEQ ID NO: 3364600 - protein, 23 aa, Plasmodium falciparum
LEKEKKLVIEFFKSQKLTTEIAK

SEQ ID NO: 3364601 - protein, 17 aa, Plasmodium falciparum
LEKELRRLDDIEKKYLL

SEQ ID NO: 3364602 - protein, 22 aa, Plasmodium falciparum
LEKFMKMSMTILPKKEISLKNQ

SEQ ID NO: 3364603 - protein, 24 aa, Plasmodium falciparum
LEKKYNYKIICISKLLKEYKEEYN

SEQ ID NO: 3364604 - protein, 17 aa, Plasmodium falciparum
LEKLCIEKNKITKKYKN

SEQ ID NO: 3364605 - protein, 22 aa, Plasmodium falciparum
LEKLFPLLYFPKINNVHLKNIS

SEQ ID NO: 3364606 - protein, 23 aa, Plasmodium falciparum
LEKLHFKGLFLKKKKDTCKDGIC

SEQ ID NO: 3364607 - protein, 21 aa, Plasmodium falciparum
LEKLKTLYLNGNRKIKEHFII

SEQ ID NO: 3364608 - protein, 24 aa, Plasmodium falciparum
LEKMKEGEYVYKWNNNIFQKKTLK

SEQ ID NO: 3364609 - protein, 24 aa, Plasmodium falciparum
LEKMKKGFNSLVILIKSIAYIRSS

SEQ ID NO: 3364610 - protein, 20 aa, Plasmodium falciparum
LEKNRLALRVPINLTKFEIR

SEQ ID NO: 3364611 - protein, 18 aa, Plasmodium falciparum
LEKQFSFDSKDSDDNYVR

SEQ ID NO: 3364612 - protein, 22 aa, Plasmodium falciparum
LEKRECKIINDESYKIEETTDM

SEQ ID NO: 3364613 - protein, 17 aa, Plasmodium falciparum
LEKRKNNIINIYFCIVK

SEQ ID NO: 3364614 - protein, 22 aa, Plasmodium falciparum
LEKSLCPKENILLLNSKKKLIH

SEQ ID NO: 3364615 - protein, 24 aa, Plasmodium falciparum
LEKTCKVANLLKLIGVKKQDTVTI

SEQ ID NO: 3364616 - protein, 23 aa, Plasmodium falciparum
LEKWKKEKWFIVLKENWKNEEHK

SEQ ID NO: 3364617 - protein, 29 aa, Plasmodium falciparum
LEKWKNELTKAIILEIIIHNGYLLYHKFG

SEQ ID NO: 3364618 - protein, 21 aa, Plasmodium falciparum
LEKYFSKFGKIVDIYVSRNIS

SEQ ID NO: 3364619 - protein, 17 aa, Plasmodium falciparum
LELAEQIYYEYFQRGLI

SEQ ID NO: 3364620 - protein, 23 aa, Plasmodium falciparum
LELDLECIFSKLLLLKKKKYACA

SEQ ID NO: 3364621 - protein, 21 aa, Plasmodium falciparum
LELDPHCPSYVIRERIRENFI

SEQ ID NO: 3364622 - protein, 24 aa, Plasmodium falciparum
LELIPSKRPLVSYSTYDNQQKYFE

SEQ ID NO: 3364623 - protein, 17 aa, Plasmodium falciparum
LELIPYTLAENAGLSPL

SEQ ID NO: 3364624 - protein, 17 aa, Plasmodium falciparum
LELKNEVSFENNEMIVS

SEQ ID NO: 3364625 - protein, 21 aa, Plasmodium falciparum
LELKSSIKFQLKKVLCMGVPV

SEQ ID NO: 3364626 - protein, 19 aa, Plasmodium falciparum
LELLTACVKVLYRRPAEMK

SEQ ID NO: 3364627 - protein, 17 aa, Plasmodium falciparum
LELRAAVMHDIIDMIPE

SEQ ID NO: 3364628 - protein, 23 aa, Plasmodium falciparum
LELSELWTKKSLIVNFQNNICEI

SEQ ID NO: 3364629 - protein, 17 aa, Plasmodium falciparum
LELYLSKLITINVRTLQ

SEQ ID NO: 3364630 - protein, 19 aa, Plasmodium falciparum
LEMFICGKEVLNAYTELND

SEQ ID NO: 3364631 - protein, 41 aa, Plasmodium falciparum
LEMKFCHFTGFNILDALKLTSWVHFRYPKNLTYDKIKNYNS

SEQ ID NO: 3364632 - protein, 25 aa, Plasmodium falciparum
LEMNIKDFLLLLLIYYKNKVFLLPQ

SEQ ID NO: 3364633 - protein, 17 aa, Plasmodium falciparum
LEMSKKEKINIFLKYLK

SEQ ID NO: 3364634 - protein, 23 aa, Plasmodium falciparum
LENDCKFALYTKFEILKRIEHFE

SEQ ID NO: 3364635 - protein, 17 aa, Plasmodium falciparum
LENEKKDIANLILQLQE

SEQ ID NO: 3364636 - protein, 20 aa, Plasmodium falciparum
LENEKKFLLRFLENKKNIEL

SEQ ID NO: 3364637 - protein, 24 aa, Plasmodium falciparum
LENEKKKYVEIIKNIDLKKEKEID

SEQ ID NO: 3364638 - protein, 24 aa, Plasmodium falciparum
LENELKMKAEKCIDDEKGGIYDHN

SEQ ID NO: 3364639 - protein, 20 aa, Plasmodium falciparum
LENFIGILDIFGFEIFVKNS

SEQ ID NO: 3364640 - protein, 20 aa, Plasmodium falciparum
LENFPKLPIKNVELCEDIYN

SEQ ID NO: 3364641 - protein, 17 aa, Plasmodium falciparum
LENILIFLKALLLEKKI

SEQ ID NO: 3364642 - protein, 25 aa, Plasmodium falciparum
LENLVIRRYNFVLGNELQSPIRNSV

SEQ ID NO: 3364643 - protein, 25 aa, Plasmodium falciparum
LENNECKFRGFVLDFFPRNYEEAKY

SEQ ID NO: 3364644 - protein, 24 aa, Plasmodium falciparum
LENNGNVLKSDFVNLQTNENINNN

SEQ ID NO: 3364645 - protein, 18 aa, Plasmodium falciparum
LENRKVSTNLSRTSNARN

SEQ ID NO: 3364646 - protein, 26 aa, Plasmodium falciparum
LENSCLYLAFEYCDIDLFNLIKKHNL

SEQ ID NO: 3364647 - protein, 21 aa, Plasmodium falciparum
LENTCIKPCLYLDNKNNFNIN

SEQ ID NO: 3364648 - protein, 19 aa, Plasmodium falciparum
LENVIKCKVHKIFHDICYN

SEQ ID NO: 3364649 - protein, 24 aa, Plasmodium falciparum
LENWEEDWGAAGWDDDDDDDDKFI

SEQ ID NO: 3364650 - protein, 21 aa, Plasmodium falciparum
LEPFFKRKNKALLDIILLKKE

SEQ ID NO: 3364651 - protein, 18 aa, Plasmodium falciparum
LEPISCSALYHKVMENNI

SEQ ID NO: 3364652 - protein, 28 aa, Plasmodium falciparum
LEPLPERTYLSMKLLYYDEIVPYNYQPP

SEQ ID NO: 3364653 - protein, 22 aa, Plasmodium falciparum
LEQIKIPSWDRNNIPDENEQVI

SEQ ID NO: 3364654 - protein, 19 aa, Plasmodium falciparum
LEQMRLVLLRKDFIRCHVI

SEQ ID NO: 3364655 - protein, 37 aa, Plasmodium falciparum
LEQRLNFLVLNGIPRYRILFDIGLGFAKKHDQSIKLL

SEQ ID NO: 3364656 - protein, 22 aa, Plasmodium falciparum
LERAKVKMVLDTLVVQGLNKKQ

SEQ ID NO: 3364657 - protein, 24 aa, Plasmodium falciparum
LERLEDIAHLFLPKQKKHDNMFNL

SEQ ID NO: 3364658 - protein, 21 aa, Plasmodium falciparum
LERSSKLCTVENRIRNVRNIP

SEQ ID NO: 3364659 - protein, 17 aa, Plasmodium falciparum
LERYEMYAIDFSDEIYS

SEQ ID NO: 3364660 - protein, 19 aa, Plasmodium falciparum
LESALRFGSTLLVYDVEKI

SEQ ID NO: 3364661 - protein, 24 aa, Plasmodium falciparum
LESCLKYGRSNFFILITNTDMRIL

SEQ ID NO: 3364662 - protein, 19 aa, Plasmodium falciparum
LESHARTKIEINPDNIEKA

SEQ ID NO: 3364663 - protein, 19 aa, Plasmodium falciparum
LESIPRHLSHNAGYDSTDI

SEQ ID NO: 3364664 - protein, 21 aa, Plasmodium falciparum
LESIPWTSSFFHLKDKDLCLF

SEQ ID NO: 3364665 - protein, 22 aa, Plasmodium falciparum
LESKPYGVFCMLDEECYIPSGR

SEQ ID NO: 3364666 - protein, 22 aa, Plasmodium falciparum
LESMSPPPLIILPIYSSLPSEM

SEQ ID NO: 3364667 - protein, 28 aa, Plasmodium falciparum
LESPNSWKYKQVVLIAGCNNGSVCLTNI

SEQ ID NO: 3364668 - protein, 24 aa, Plasmodium falciparum
LESPRYYSPLKWYYGESIEKSYKN

SEQ ID NO: 3364669 - protein, 20 aa, Plasmodium falciparum
LETEAAKNYYYYVKCQKTFS

SEQ ID NO: 3364670 - protein, 27 aa, Plasmodium falciparum
LETHEFYKRKGIVLYKIKKEKAENEKK

SEQ ID NO: 3364671 - protein, 22 aa, Plasmodium falciparum
LETIKTYITKCIKNYRHQNEEK

SEQ ID NO: 3364672 - protein, 20 aa, Plasmodium falciparum
LETLKFPGVQNLSNLFMSNK

SEQ ID NO: 3364673 - protein, 19 aa, Plasmodium falciparum
LETLNNYYINNILRDDQPN

SEQ ID NO: 3364674 - protein, 19 aa, Plasmodium falciparum
LETREKFSMFVQSICSIPL

SEQ ID NO: 3364675 - protein, 23 aa, Plasmodium falciparum
LETSCPLTYFTLMYKSRIDTNVV

SEQ ID NO: 3364676 - protein, 19 aa, Plasmodium falciparum
LEVKFFCIHVIVEKISTLK

SEQ ID NO: 3364677 - protein, 17 aa, Plasmodium falciparum
LEVLDGCDILISDRIKA

SEQ ID NO: 3364678 - protein, 17 aa, Plasmodium falciparum
LEVLLNYELQQIDSADM

SEQ ID NO: 3364679 - protein, 22 aa, Plasmodium falciparum
LEVYLRNKMNINIDIKKMNDKT

SEQ ID NO: 3364680 - protein, 18 aa, Plasmodium falciparum
LEVYRSYCAYENNFINDM

SEQ ID NO: 3364681 - protein, 23 aa, Plasmodium falciparum
LEYCPGGELFFHLSKLREFSEET

SEQ ID NO: 3364682 - protein, 17 aa, Plasmodium falciparum
LEYKRMEIKIGKQKEHK

SEQ ID NO: 3364683 - protein, 24 aa, Plasmodium falciparum
LEYLEYRLDCFSVQNVLLILEPLY

SEQ ID NO: 3364684 - protein, 27 aa, Plasmodium falciparum
LEYRKSNKLHLVRLIILTNCTFDGIVY

SEQ ID NO: 3364685 - protein, 20 aa, Plasmodium falciparum
LFADDRPIAIEVDGPSHFYA

SEQ ID NO: 3364686 - protein, 18 aa, Plasmodium falciparum
LFCPKKIIYCTFCNIFTQ

SEQ ID NO: 3364687 - protein, 17 aa, Plasmodium falciparum
LFCTVYKKARFYVFSKK

SEQ ID NO: 3364688 - protein, 26 aa, Plasmodium falciparum
LFDAFKNASIPYVFINYNDLYNIADS

SEQ ID NO: 3364689 - protein, 19 aa, Plasmodium falciparum
LFDCPGCTNVHGVRGSLKF

SEQ ID NO: 3364690 - protein, 26 aa, Plasmodium falciparum
LFDDLAVGISNIFKWMDIDNKIIQTN

SEQ ID NO: 3364691 - protein, 25 aa, Plasmodium falciparum
LFDECPQCIINKKYIFKGIHTSSIG

SEQ ID NO: 3364692 - protein, 38 aa, Plasmodium falciparum
LFDHLKLLYFVKSKYLWKARIFFIWQRLFTSSNDYYYS

SEQ ID NO: 3364693 - protein, 18 aa, Plasmodium falciparum
LFDLLNLRCAELHGSMSQ

SEQ ID NO: 3364694 - protein, 17 aa, Plasmodium falciparum
LFDNEWMIIYGGITNGW

SEQ ID NO: 3364695 - protein, 20 aa, Plasmodium falciparum
LFDTPLSFEEVMRRKNEKKK

SEQ ID NO: 3364696 - protein, 25 aa, Plasmodium falciparum
LFDYIKIDIYFNYIFNTNKMHNSAE

SEQ ID NO: 3364697 - protein, 20 aa, Plasmodium falciparum
LFECDKCNVDYDIMNFTNNT

SEQ ID NO: 3364698 - protein, 29 aa, Plasmodium falciparum
LFECTKKYVGCLLPYEFVSIYKTLKIIKR

SEQ ID NO: 3364699 - protein, 24 aa, Plasmodium falciparum
LFEFKNICIICNYASSLYLPTNKM

SEQ ID NO: 3364700 - protein, 18 aa, Plasmodium falciparum
LFEKDIFYILKYYNISIL

SEQ ID NO: 3364701 - protein, 18 aa, Plasmodium falciparum
LFEKLHLDTLFFIFYYQP

SEQ ID NO: 3364702 - protein, 23 aa, Plasmodium falciparum
LFEKNGICILLFKNYCNVTDAFK

SEQ ID NO: 3364703 - protein, 17 aa, Plasmodium falciparum
LFELFYSMYKLRKFKKL

SEQ ID NO: 3364704 - protein, 19 aa, Plasmodium falciparum
LFENLKMLIIDEADQLLST

SEQ ID NO: 3364705 - protein, 22 aa, Plasmodium falciparum
LFEPDLRDKNVITDGFGTYQIF

SEQ ID NO: 3364706 - protein, 17 aa, Plasmodium falciparum
LFFAKQVIPNACATQAI

SEQ ID NO: 3364707 - protein, 23 aa, Plasmodium falciparum
LFFDCLKSKIINEIKTLDNNLKK

SEQ ID NO: 3364708 - protein, 17 aa, Plasmodium falciparum
LFFEIKLAILMVEDDSY

SEQ ID NO: 3364709 - protein, 17 aa, Plasmodium falciparum
LFFFKKEYKSYFHKLSN

SEQ ID NO: 3364710 - protein, 27 aa, Plasmodium falciparum
LFFLFTKFFHCYKISYVLKNAKLAPNH

SEQ ID NO: 3364711 - protein, 20 aa, Plasmodium falciparum
LFFLITQLLIHFKHNLYNSV

SEQ ID NO: 3364712 - protein, 27 aa, Plasmodium falciparum
LFFLSSRERCNYCNYGKSTFVDTFNYE

SEQ ID NO: 3364713 - protein, 18 aa, Plasmodium falciparum
LFFSNFFSKYNYDYICAF

SEQ ID NO: 3364714 - protein, 24 aa, Plasmodium falciparum
LFFYAKEILKQFLLTYDNDADGKN

SEQ ID NO: 3364715 - protein, 18 aa, Plasmodium falciparum
LFHMNSLNEDYSWVKNLR

SEQ ID NO: 3364716 - protein, 18 aa, Plasmodium falciparum
LFHYWKLTKHSWAYQFCV

SEQ ID NO: 3364717 - protein, 19 aa, Plasmodium falciparum
LFIFPRLFSYSQYYREKKI

SEQ ID NO: 3364718 - protein, 17 aa, Plasmodium falciparum
LFIHDYIYLLLLPPISY

SEQ ID NO: 3364719 - protein, 19 aa, Plasmodium falciparum
LFIKCNLIKSLTLVCDKKH

SEQ ID NO: 3364720 - protein, 19 aa, Plasmodium falciparum
LFIKNVNDIRSFERGILNL

SEQ ID NO: 3364721 - protein, 30 aa, Plasmodium falciparum
LFIKTCGKTRVLFFIPFVVDLLIYHMDNVG

SEQ ID NO: 3364722 - protein, 19 aa, Plasmodium falciparum
LFIRKEIFDHAIIYTTNRI

SEQ ID NO: 3364723 - protein, 26 aa, Plasmodium falciparum
LFITNDFRLKICYSNNFMDYTKIYNN

SEQ ID NO: 3364724 - protein, 27 aa, Plasmodium falciparum
LFKDFWDRYIKCIKILKNRKERKVFRF

SEQ ID NO: 3364725 - protein, 32 aa, Plasmodium falciparum
LFKEFKIYDCKHVLKKSIKVLNKYAKKNSKEF

SEQ ID NO: 3364726 - protein, 27 aa, Plasmodium falciparum
LFKFDPSGFCAGYRACVIGNKEQESIS

SEQ ID NO: 3364727 - protein, 19 aa, Plasmodium falciparum
LFKLNRYIESFSSNKIKGI

SEQ ID NO: 3364728 - protein, 25 aa, Plasmodium falciparum
LFKNLNRKIEYTFACEKENTYDDSV

SEQ ID NO: 3364729 - protein, 19 aa, Plasmodium falciparum
LFKSFVFSLNNPINFSPSS

SEQ ID NO: 3364730 - protein, 27 aa, Plasmodium falciparum
LFLDSNLYTRAVWLLKKGYNMNDIEVQ

SEQ ID NO: 3364731 - protein, 19 aa, Plasmodium falciparum
LFLELLLLDVEACRCRYLE

SEQ ID NO: 3364732 - protein, 33 aa, Plasmodium falciparum
LFLENMLYFLLRTGLNFRFFPEIYNWKWIAHIE

SEQ ID NO: 3364733 - protein, 18 aa, Plasmodium falciparum
LFLGLIEEKITCSQCEYV

SEQ ID NO: 3364734 - protein, 17 aa, Plasmodium falciparum
LFLHNPIYVSHEQKNES

SEQ ID NO: 3364735 - protein, 19 aa, Plasmodium falciparum
LFLPSLIKIGQLRRIQQYS

SEQ ID NO: 3364736 - protein, 20 aa, Plasmodium falciparum
LFLVRGGFMSVEFKVVEVDP

SEQ ID NO: 3364737 - protein, 23 aa, Plasmodium falciparum
LFMDFSGSIILRAFSDEGYNLLG

SEQ ID NO: 3364738 - protein, 25 aa, Plasmodium falciparum
LFMPHCDIHLYGDILYSIFVHEKLF

SEQ ID NO: 3364739 - protein, 23 aa, Plasmodium falciparum
LFNHEIYKLLFIFNKYLNNNSNI

SEQ ID NO: 3364740 - protein, 23 aa, Plasmodium falciparum
LFNKLKICGQFNKGFVISKIDLL

SEQ ID NO: 3364741 - protein, 20 aa, Plasmodium falciparum
LFNKNICPELKEKNVYPHPL

SEQ ID NO: 3364742 - protein, 26 aa, Plasmodium falciparum
LFNLKSKSCHNFSLPDDGFYNYHNNN

SEQ ID NO: 3364743 - protein, 39 aa, Plasmodium falciparum
LFNRINDVFEFFPLCVLLDKNILCIHGGIGDSVMTISDY

SEQ ID NO: 3364744 - protein, 26 aa, Plasmodium falciparum
LFNVLKEVRSLWSLYDLYRSPGPIQF

SEQ ID NO: 3364745 - protein, 30 aa, Plasmodium falciparum
LFNYEKLIYRKVCDIVKIELFVIKNYLNVF

SEQ ID NO: 3364746 - protein, 18 aa, Plasmodium falciparum
LFNYKYDETFLFNMEILF

SEQ ID NO: 3364747 - protein, 19 aa, Plasmodium falciparum
LFNYNIMLLFEYHKLVKSS

SEQ ID NO: 3364748 - protein, 18 aa, Plasmodium falciparum
LFPHEPHTFMFLYTDDNF

SEQ ID NO: 3364749 - protein, 29 aa, Plasmodium falciparum
LFRHKKRLIHLSMYIKYILPLDEFGIYHL

SEQ ID NO: 3364750 - protein, 22 aa, Plasmodium falciparum
LFRKKFANPILIGRDKDATEKE

SEQ ID NO: 3364751 - protein, 18 aa, Plasmodium falciparum
LFRKNLLSLRILYEHNSI

SEQ ID NO: 3364752 - protein, 20 aa, Plasmodium falciparum
LFRNEEMKKQYGINGAPAEL

SEQ ID NO: 3364753 - protein, 18 aa, Plasmodium falciparum
LFRNILYHMIFVETNESE

SEQ ID NO: 3364754 - protein, 18 aa, Plasmodium falciparum
LFRSLSFDNLDYHGDKCI

SEQ ID NO: 3364755 - protein, 19 aa, Plasmodium falciparum
LFSDSFKFLPLAYVLNKNI

SEQ ID NO: 3364756 - protein, 24 aa, Plasmodium falciparum
LFSGNCLLYSRPLLIFSKHFDELD

SEQ ID NO: 3364757 - protein, 18 aa, Plasmodium falciparum
LFSGRDICDEKKLNQYIV

SEQ ID NO: 3364758 - protein, 25 aa, Plasmodium falciparum
LFSHPKYKLPILIKGNIHFDSTENM

SEQ ID NO: 3364759 - protein, 17 aa, Plasmodium falciparum
LFSNPSYYIKEVQYVQF

SEQ ID NO: 3364760 - protein, 28 aa, Plasmodium falciparum
LFSSEEMLPSFFRRIDFSPNGEFLITPS

SEQ ID NO: 3364761 - protein, 22 aa, Plasmodium falciparum
LFSYITYHICTFFNDISNIIDT

SEQ ID NO: 3364762 - protein, 19 aa, Plasmodium falciparum
LFSYMKYTFLKKEEIKLKI

SEQ ID NO: 3364763 - protein, 19 aa, Plasmodium falciparum
LFTHIAIKIGEEINNELNF

SEQ ID NO: 3364764 - protein, 18 aa, Plasmodium falciparum
LFTIAKNIYIRKFLENNE

SEQ ID NO: 3364765 - protein, 17 aa, Plasmodium falciparum
LFTVFQMMFVIQISNDV

SEQ ID NO: 3364766 - protein, 25 aa, Plasmodium falciparum
LFVDPSEFFVFFNISYKLITNERKK

SEQ ID NO: 3364767 - protein, 18 aa, Plasmodium falciparum
LFVHSAKMLFKINAIDMN

SEQ ID NO: 3364768 - protein, 20 aa, Plasmodium falciparum
LFVIKNYLNVFILYKDYTLI

SEQ ID NO: 3364769 - protein, 22 aa, Plasmodium falciparum
LFVNQIMFILDFIKIINEKVYI

SEQ ID NO: 3364770 - protein, 17 aa, Plasmodium falciparum
LFVPTISVLDFKKKRLY

SEQ ID NO: 3364771 - protein, 22 aa, Plasmodium falciparum
LFYECMINTILYARDKYLKENG

SEQ ID NO: 3364772 - protein, 23 aa, Plasmodium falciparum
LFYFKCKEEINLKDGNIILDDKN

SEQ ID NO: 3364773 - protein, 23 aa, Plasmodium falciparum
LFYHEFIRISIIESFSKNNICRK

SEQ ID NO: 3364774 - protein, 22 aa, Plasmodium falciparum
LFYIFEMSKLTLFLGGTVSDTV

SEQ ID NO: 3364775 - protein, 19 aa, Plasmodium falciparum
LFYKNCNLYVGEYILPDDI

SEQ ID NO: 3364776 - protein, 26 aa, Plasmodium falciparum
LFYMDVKNINEWKIKYRYLTSSFRKL

SEQ ID NO: 3364777 - protein, 22 aa, Plasmodium falciparum
LFYNIICYIDPIDLVKSLTYQK

SEQ ID NO: 3364778 - protein, 20 aa, Plasmodium falciparum
LFYSEFLFDYNPWNDNDVNK

SEQ ID NO: 3364779 - protein, 18 aa, Plasmodium falciparum
LGALQHLGDEIGWNYDKT

SEQ ID NO: 3364780 - protein, 21 aa, Plasmodium falciparum
LGCIIAEMILGYPIFSGQSSV

SEQ ID NO: 3364781 - protein, 25 aa, Plasmodium falciparum
LGCIMGELLCGKPLFTGNSTMNQLE

SEQ ID NO: 3364782 - protein, 24 aa, Plasmodium falciparum
LGCMVARNCVSWGIQHYTFVDNSR

SEQ ID NO: 3364783 - protein, 20 aa, Plasmodium falciparum
LGDDVFRYIISSVKNKNLLL

SEQ ID NO: 3364784 - protein, 23 aa, Plasmodium falciparum
LGDLRTLLFNHYYYYNSKNKENP

SEQ ID NO: 3364785 - protein, 17 aa, Plasmodium falciparum
LGDSNLLCISQNNNGTS

SEQ ID NO: 3364786 - protein, 23 aa, Plasmodium falciparum
LGEDHPRCKFQYYRSQIACTAEQ

SEQ ID NO: 3364787 - protein, 25 aa, Plasmodium falciparum
LGESKQFSVLKCLKTKEGTRKDNIE

SEQ ID NO: 3364788 - protein, 17 aa, Plasmodium falciparum
LGFNDYIEPLTEYLNKW

SEQ ID NO: 3364789 - protein, 17 aa, Plasmodium falciparum
LGGICLENNKNNNMNKN

SEQ ID NO: 3364790 - protein, 17 aa, Plasmodium falciparum
LGGNCRASVIVAVHPSH

SEQ ID NO: 3364791 - protein, 25 aa, Plasmodium falciparum
LGIEEYKCLLTHSFHMNTNVSNQKC

SEQ ID NO: 3364792 - protein, 24 aa, Plasmodium falciparum
LGINSPCLTKEDFFNCAGNNNVVE

SEQ ID NO: 3364793 - protein, 21 aa, Plasmodium falciparum
LGLERIGWIFTHLPRQEYLTS

SEQ ID NO: 3364794 - protein, 24 aa, Plasmodium falciparum
LGLHILKFPDIFYYILKNMLVHKL

SEQ ID NO: 3364795 - protein, 21 aa, Plasmodium falciparum
LGLHLIWAFWSIIRGYQTKSY

SEQ ID NO: 3364796 - protein, 23 aa, Plasmodium falciparum
LGLKKYDVVFSYLPLAHVYERFI

SEQ ID NO: 3364797 - protein, 23 aa, Plasmodium falciparum
LGLKSICLHGKLTQNQRLSSLNS

SEQ ID NO: 3364798 - protein, 18 aa, Plasmodium falciparum
LGLNFSYYHLEPLIYNFI

SEQ ID NO: 3364799 - protein, 23 aa, Plasmodium falciparum
LGLPNIIPSGIIKHQNNGLRTNI

SEQ ID NO: 3364800 - protein, 19 aa, Plasmodium falciparum
LGNCLNKFFNILIKIIDYW

SEQ ID NO: 3364801 - protein, 23 aa, Plasmodium falciparum
LGNFLIKKEKILVVDDIMENNKV

SEQ ID NO: 3364802 - protein, 21 aa, Plasmodium falciparum
LGNFVSFYFCNILSEDLKDLK

SEQ ID NO: 3364803 - protein, 17 aa, Plasmodium falciparum
LGNIDAYQLADGIQYIF

SEQ ID NO: 3364804 - protein, 18 aa, Plasmodium falciparum
LGNRKSFRSSTVHGTVSS

SEQ ID NO: 3364805 - protein, 17 aa, Plasmodium falciparum
LGPTPSQTKKFTHICDH

SEQ ID NO: 3364806 - protein, 25 aa, Plasmodium falciparum
LGQSKLKFVDIYGFNNDLLDMIPQP

SEQ ID NO: 3364807 - protein, 24 aa, Plasmodium falciparum
LGSGKLCALEKLLSKCKREGNKCL

SEQ ID NO: 3364808 - protein, 28 aa, Plasmodium falciparum
LGSKDIEMFLRGEIEKIKDNNNMLNRYL

SEQ ID NO: 3364809 - protein, 39 aa, Plasmodium falciparum
LGSYCVSTVYYWHVFHHYKFFFVKYIYMKLFDVYSKNKD

SEQ ID NO: 3364810 - protein, 17 aa, Plasmodium falciparum
LGTGCSMPSTFRNVSGI

SEQ ID NO: 3364811 - protein, 25 aa, Plasmodium falciparum
LGTSRYVIGKDFYVDHLIMGDSKDS

SEQ ID NO: 3364812 - protein, 26 aa, Plasmodium falciparum
LGTYSGTRLLYWDFRDDMDFIIFSPL

SEQ ID NO: 3364813 - protein, 22 aa, Plasmodium falciparum
LGVDRLKLFILDEADEMLSRGF

SEQ ID NO: 3364814 - protein, 22 aa, Plasmodium falciparum
LGVDVSKLFPDIIMISSTNDII

SEQ ID NO: 3364815 - protein, 17 aa, Plasmodium falciparum
LGVKCAKEVATAIRGAI

SEQ ID NO: 3364816 - protein, 21 aa, Plasmodium falciparum
LGVKVRRTGWINLMKNSIPRR

SEQ ID NO: 3364817 - protein, 19 aa, Plasmodium falciparum
LGWEFGGGAPQNGAAEDKK

SEQ ID NO: 3364818 - protein, 24 aa, Plasmodium falciparum
LGYDWKEHLYFASNYFEQLYEWAK

SEQ ID NO: 3364819 - protein, 26 aa, Plasmodium falciparum
LGYHFYKSSFPIIIIKPDILNITPNC

SEQ ID NO: 3364820 - protein, 27 aa, Plasmodium falciparum
LHCNRKLDMANGLVVHMMQVHKTNLKS

SEQ ID NO: 3364821 - protein, 18 aa, Plasmodium falciparum
LHCSKAFVICVSNPLDIM

SEQ ID NO: 3364822 - protein, 19 aa, Plasmodium falciparum
LHDILKVLVEYVKLNDEYF

SEQ ID NO: 3364823 - protein, 29 aa, Plasmodium falciparum
LHDLETILELNIPMLSKNVNMYKLCIKHH

SEQ ID NO: 3364824 - protein, 37 aa, Plasmodium falciparum
LHDYIPTPFIQRIVCVLIKKFLCEHLSEEFVYLIINS

SEQ ID NO: 3364825 - protein, 17 aa, Plasmodium falciparum
LHEDIWGLQGNVLYGRD

SEQ ID NO: 3364826 - protein, 21 aa, Plasmodium falciparum
LHEFCFINYLLTIDIYNNSLW

SEQ ID NO: 3364827 - protein, 24 aa, Plasmodium falciparum
LHEGDSLPGFPSPDTFEFLILPHL

SEQ ID NO: 3364828 - protein, 18 aa, Plasmodium falciparum
LHESLLIKERIFYEDELK

SEQ ID NO: 3364829 - protein, 17 aa, Plasmodium falciparum
LHFMKLYYVICNNMHFI

SEQ ID NO: 3364830 - protein, 17 aa, Plasmodium falciparum
LHFPKKVCIESISCGKD

SEQ ID NO: 3364831 - protein, 18 aa, Plasmodium falciparum
LHFVGFHIRFSKISRGGV

SEQ ID NO: 3364832 - protein, 18 aa, Plasmodium falciparum
LHGMNKFNNVRNLKNNEI

SEQ ID NO: 3364833 - protein, 35 aa, Plasmodium falciparum
LHGNFPPTFYKLTCDHIFHLMCLYETVIRRECRKT

SEQ ID NO: 3364834 - protein, 23 aa, Plasmodium falciparum
LHGVCGTAGCYFYQLDNLSTLGF

SEQ ID NO: 3364835 - protein, 17 aa, Plasmodium falciparum
LHHIFNIVNYYKPEMSF

SEQ ID NO: 3364836 - protein, 17 aa, Plasmodium falciparum
LHHPWFQGYFDPIQISP

SEQ ID NO: 3364837 - protein, 46 aa, Plasmodium falciparum
LHIFRNCSFPLLKKFEVCYYPLHHDHWYWNFVFDFTQLGLQGLYKI

SEQ ID NO: 3364838 - protein, 17 aa, Plasmodium falciparum
LHIGIGLLNRKSNIVIN

SEQ ID NO: 3364839 - protein, 25 aa, Plasmodium falciparum
LHIKRIQAIRLIKYISLKVISIDEK

SEQ ID NO: 3364840 - protein, 19 aa, Plasmodium falciparum
LHKAMLTEQMVKRAKKFPM

SEQ ID NO: 3364841 - protein, 23 aa, Plasmodium falciparum
LHKASYEKYNFFLPFLNDYIKNQ

SEQ ID NO: 3364842 - protein, 19 aa, Plasmodium falciparum
LHKDEKSFNHSCSDIQFNQ

SEQ ID NO: 3364843 - protein, 18 aa, Plasmodium falciparum
LHKDILFIILTTDKLFDN

SEQ ID NO: 3364844 - protein, 18 aa, Plasmodium falciparum
LHKFSLKDSMGLNIDESN

SEQ ID NO: 3364845 - protein, 19 aa, Plasmodium falciparum
LHKGVKIVIITSVNYNFDK

SEQ ID NO: 3364846 - protein, 21 aa, Plasmodium falciparum
LHKHVKSIILENQVYKHNNES

SEQ ID NO: 3364847 - protein, 19 aa, Plasmodium falciparum
LHKIAVSALSYAANTHKKL

SEQ ID NO: 3364848 - protein, 17 aa, Plasmodium falciparum
LHKSILIKKKYNIDNYK

SEQ ID NO: 3364849 - protein, 20 aa, Plasmodium falciparum
LHKYPFLYERTIKDLKDTSY

SEQ ID NO: 3364850 - protein, 17 aa, Plasmodium falciparum
LHLEERLYFVLTSLYFS

SEQ ID NO: 3364851 - protein, 23 aa, Plasmodium falciparum
LHLHNCPWRNNLMDISIFDLDKK

SEQ ID NO: 3364852 - protein, 17 aa, Plasmodium falciparum
LHLNIYVKSIWLCMNLK

SEQ ID NO: 3364853 - protein, 20 aa, Plasmodium falciparum
LHLTNNYSKYFIPRIPFKYN

SEQ ID NO: 3364854 - protein, 17 aa, Plasmodium falciparum
LHNEFTSLGGRDVTKET

SEQ ID NO: 3364855 - protein, 18 aa, Plasmodium falciparum
LHNGLSVFLFGGSNENIY

SEQ ID NO: 3364856 - protein, 33 aa, Plasmodium falciparum
LHNKMLIKLLKKRKIILLKAPIFTKIHKENKTF

SEQ ID NO: 3364857 - protein, 18 aa, Plasmodium falciparum
LHNSSCVKTFLDNQVNEN

SEQ ID NO: 3364858 - protein, 18 aa, Plasmodium falciparum
LHPSLDLLMSGGRDAVVR

SEQ ID NO: 3364859 - protein, 20 aa, Plasmodium falciparum
LHSAHNFYFNGVKYSDWKFT

SEQ ID NO: 3364860 - protein, 27 aa, Plasmodium falciparum
LHSFPGIDEALCFAELMQSIKNMKYSV

SEQ ID NO: 3364861 - protein, 18 aa, Plasmodium falciparum
LHSLFTYVRTKLKKKNKD

SEQ ID NO: 3364862 - protein, 23 aa, Plasmodium falciparum
LHSSNRYKLLINLFKKYKLYYCK

SEQ ID NO: 3364863 - protein, 25 aa, Plasmodium falciparum
LHTGLSLKAFKAWAGNPQNLIVLPG

SEQ ID NO: 3364864 - protein, 30 aa, Plasmodium falciparum
LHTKKEMMYNFYSEKAILLVSFNDESKIIN

SEQ ID NO: 3364865 - protein, 21 aa, Plasmodium falciparum
LHTVIRPYILRRLKKNVEKEM

SEQ ID NO: 3364866 - protein, 27 aa, Plasmodium falciparum
LHTYHWKCVKNWFKFNLTCPCCRYKLN

SEQ ID NO: 3364867 - protein, 18 aa, Plasmodium falciparum
LHVLTQVPFCCLQLNYIN

SEQ ID NO: 3364868 - protein, 21 aa, Plasmodium falciparum
LHVYHKLKELIKYQYKEYLLH

SEQ ID NO: 3364869 - protein, 37 aa, Plasmodium falciparum
LIAYEEPKEYCIEAFLQLIYSTGFFIDKIEKYKNVLD

SEQ ID NO: 3364870 - protein, 26 aa, Plasmodium falciparum
LICCSQKIRIGSIINNTINLMNYKIL

SEQ ID NO: 3364871 - protein, 27 aa, Plasmodium falciparum
LICMNEIIKYLKICDFKNNLKSKIKSA

SEQ ID NO: 3364872 - protein, 19 aa, Plasmodium falciparum
LICNCIYPINIYKRIYFLV

SEQ ID NO: 3364873 - protein, 26 aa, Plasmodium falciparum
LICSYECFRINNEFLDKSSIDMIICD

SEQ ID NO: 3364874 - protein, 24 aa, Plasmodium falciparum
LIDHVKKYIEFYINYYKKYNDKEV

SEQ ID NO: 3364875 - protein, 17 aa, Plasmodium falciparum
LIDIILHPILPHETVPW

SEQ ID NO: 3364876 - protein, 18 aa, Plasmodium falciparum
LIDKQCVDISKYYQILIN

SEQ ID NO: 3364877 - protein, 23 aa, Plasmodium falciparum
LIDLREYRCRILGLVSIKLNPFF

SEQ ID NO: 3364878 - protein, 27 aa, Plasmodium falciparum
LIDMKQKFICLIYMLLDCIEKKKKPVV

SEQ ID NO: 3364879 - protein, 24 aa, Plasmodium falciparum
LIDNGGIISYIWIIGEYCEYIEEA

SEQ ID NO: 3364880 - protein, 29 aa, Plasmodium falciparum
LIDNWKNDKIKIFISWCPEIVEDKYKSKC

SEQ ID NO: 3364881 - protein, 20 aa, Plasmodium falciparum
LIDPSIFFMMLFSSEELSDY

SEQ ID NO: 3364882 - protein, 26 aa, Plasmodium falciparum
LIDTSFKFCYFFQCLVENELFTDILN

SEQ ID NO: 3364883 - protein, 17 aa, Plasmodium falciparum
LIEAMKWQEDNIKKKLI

SEQ ID NO: 3364884 - protein, 22 aa, Plasmodium falciparum
LIEAPMDKEHIMINNSEEESIG

SEQ ID NO: 3364885 - protein, 17 aa, Plasmodium falciparum
LIEDDIMECVKKKDIDS

SEQ ID NO: 3364886 - protein, 30 aa, Plasmodium falciparum
LIEGPNCIRRAHILCGPSFSLVDFEHMPNY

SEQ ID NO: 3364887 - protein, 19 aa, Plasmodium falciparum
LIEIFKIALYDNLKNNIFW

SEQ ID NO: 3364888 - protein, 20 aa, Plasmodium falciparum
LIEIQRSSIDVVRDMLQKSN

SEQ ID NO: 3364889 - protein, 21 aa, Plasmodium falciparum
LIEISKKCLSGYSDVASNNMN

SEQ ID NO: 3364890 - protein, 18 aa, Plasmodium falciparum
LIEKFRGNEKMKYEMKIQ

SEQ ID NO: 3364891 - protein, 19 aa, Plasmodium falciparum
LIEKINLKDNYVFFNNNNK

SEQ ID NO: 3364892 - protein, 19 aa, Plasmodium falciparum
LIEKTLCDHIERNKLDIYM

SEQ ID NO: 3364893 - protein, 29 aa, Plasmodium falciparum
LIENLRNTKLLLIKKRRSLNNMKKENNIV

SEQ ID NO: 3364894 - protein, 36 aa, Plasmodium falciparum
LIEQLLVKIYMDYDTWLFNHGKPYANLKPKTYEKFI

SEQ ID NO: 3364895 - protein, 19 aa, Plasmodium falciparum
LIERRTFSRIILTKDINFK

SEQ ID NO: 3364896 - protein, 20 aa, Plasmodium falciparum
LIEVKRFIYELANSRKHKNI

SEQ ID NO: 3364897 - protein, 24 aa, Plasmodium falciparum
LIEYLLKHVDGFVAPPTYKPIKKI

SEQ ID NO: 3364898 - protein, 20 aa, Plasmodium falciparum
LIFHYTFEQIIFKTSEAVLK

SEQ ID NO: 3364899 - protein, 17 aa, Plasmodium falciparum
LIFKKKKLGKTMIFFCT

SEQ ID NO: 3364900 - protein, 18 aa, Plasmodium falciparum
LIFKYSINNIKTFLHIFK

SEQ ID NO: 3364901 - protein, 17 aa, Plasmodium falciparum
LIFLKEELAFWSIVQLI

SEQ ID NO: 3364902 - protein, 26 aa, Plasmodium falciparum
LIFNNICDNWNFISSLFLLNNPFFNK

SEQ ID NO: 3364903 - protein, 36 aa, Plasmodium falciparum
LIFSRDAEKYIKFLSNVKIYFLKKLDDIDYFNTNCK

SEQ ID NO: 3364904 - protein, 22 aa, Plasmodium falciparum
LIGECWKVMGVIPEDTCCSYIF

SEQ ID NO: 3364905 - protein, 27 aa, Plasmodium falciparum
LIGELFQRQIVSISIVISIAHDLLIAY

SEQ ID NO: 3364906 - protein, 24 aa, Plasmodium falciparum
LIHFYEAYDSLPLLIEQLKSDEEL

SEQ ID NO: 3364907 - protein, 20 aa, Plasmodium falciparum
LIHILFGRKYHCFESLYNFE

SEQ ID NO: 3364908 - protein, 19 aa, Plasmodium falciparum
LIHNKRNHCETIKRSYDHD

SEQ ID NO: 3364909 - protein, 19 aa, Plasmodium falciparum
LIHPEALRLHELYMKNKKN

SEQ ID NO: 3364910 - protein, 17 aa, Plasmodium falciparum
LIHVDFLKNEAYVLLHS

SEQ ID NO: 3364911 - protein, 18 aa, Plasmodium falciparum
LIIEPYILRRSKKHVFID

SEQ ID NO: 3364912 - protein, 18 aa, Plasmodium falciparum
LIIFDEIHLLNEMRGNVL

SEQ ID NO: 3364913 - protein, 17 aa, Plasmodium falciparum
LIIKEVTYQSILNRLGK

SEQ ID NO: 3364914 - protein, 18 aa, Plasmodium falciparum
LIIKRLYTRSGGLRKPQK

SEQ ID NO: 3364915 - protein, 23 aa, Plasmodium falciparum
LIILEEMKIFFIEQNYFAFYGTS

SEQ ID NO: 3364916 - protein, 27 aa, Plasmodium falciparum
LIINRLHSVLLPFMLRRVKKDVLKSLP

SEQ ID NO: 3364917 - protein, 21 aa, Plasmodium falciparum
LIIPVLNAFSMKLFKHDEAQA

SEQ ID NO: 3364918 - protein, 25 aa, Plasmodium falciparum
LIIRQVLYKGFRVILTLPTLSLINE

SEQ ID NO: 3364919 - protein, 22 aa, Plasmodium falciparum
LIKCQGAINIIEEFFQDNIKEN

SEQ ID NO: 3364920 - protein, 19 aa, Plasmodium falciparum
LIKEIQLLNNISLRSATYL

SEQ ID NO: 3364921 - protein, 17 aa, Plasmodium falciparum
LIKEKVKNNEYVYNNNG

SEQ ID NO: 3364922 - protein, 18 aa, Plasmodium falciparum
LIKICNFEEIKIKLKSTN

SEQ ID NO: 3364923 - protein, 25 aa, Plasmodium falciparum
LIKKMKEKFKHLNLQNDEIINLKYD

SEQ ID NO: 3364924 - protein, 27 aa, Plasmodium falciparum
LIKKQFFKTKMCPFQKNKNYCLNESSC

SEQ ID NO: 3364925 - protein, 21 aa, Plasmodium falciparum
LIKLEIEFVSTMNLLTFEELK

SEQ ID NO: 3364926 - protein, 26 aa, Plasmodium falciparum
LIKNGMLPCSFLLKKKNKVQPKNNKE

SEQ ID NO: 3364927 - protein, 19 aa, Plasmodium falciparum
LIKNIKRTANVILDTEAIL

SEQ ID NO: 3364928 - protein, 25 aa, Plasmodium falciparum
LIKNKGCVCIYSFYKNNLINKICDY

SEQ ID NO: 3364929 - protein, 23 aa, Plasmodium falciparum
LIKNKKILVCAPSNAAIDEILRR

SEQ ID NO: 3364930 - protein, 26 aa, Plasmodium falciparum
LIKNRWKIYYCTLLGQAQTEEEKEEI

SEQ ID NO: 3364931 - protein, 22 aa, Plasmodium falciparum
LIKNVSFNFVRKEYINIFEDMI

SEQ ID NO: 3364932 - protein, 26 aa, Plasmodium falciparum
LIKQFKIIFENAGLPLWLRPYEILVT

SEQ ID NO: 3364933 - protein, 36 aa, Plasmodium falciparum
LIKQLDSVMKFAFCKLVYNISCMNVLNIIEAFEDMG

SEQ ID NO: 3364934 - protein, 19 aa, Plasmodium falciparum
LIKRKCEYFNTSNLAMLIS

SEQ ID NO: 3364935 - protein, 22 aa, Plasmodium falciparum
LIKSRYRKLSILIHPDKCKIDK

SEQ ID NO: 3364936 - protein, 18 aa, Plasmodium falciparum
LIKVPKFVSNKWLQYNNK

SEQ ID NO: 3364937 - protein, 18 aa, Plasmodium falciparum
LIKVWNIHLKKCVFNLVG

SEQ ID NO: 3364938 - protein, 30 aa, Plasmodium falciparum
LIKYNCVPDSLKEEATICIHNIKKNLLNSE

SEQ ID NO: 3364939 - protein, 23 aa, Plasmodium falciparum
LIKYYEWEELPSFYNLPYGLINK

SEQ ID NO: 3364940 - protein, 20 aa, Plasmodium falciparum
LILCCYISFNSSLQVKKNNQ

SEQ ID NO: 3364941 - protein, 18 aa, Plasmodium falciparum
LILELKLAQNEQITEKNL

SEQ ID NO: 3364942 - protein, 19 aa, Plasmodium falciparum
LILLYKIIYKLNIFDINKK

SEQ ID NO: 3364943 - protein, 28 aa, Plasmodium falciparum
LILNKKLVMFFLKYITFFVIENREIYLL

SEQ ID NO: 3364944 - protein, 25 aa, Plasmodium falciparum
LILNNIKAFFIAVAIIDTELYTLEA

SEQ ID NO: 3364945 - protein, 18 aa, Plasmodium falciparum
LILNNLHINKNCHMNKLK

SEQ ID NO: 3364946 - protein, 19 aa, Plasmodium falciparum
LILNRIEKLLSYEWFNDGQ

SEQ ID NO: 3364947 - protein, 33 aa, Plasmodium falciparum
LILQHLSEAWRCWKANIPWKVVGLPLPVENIII

SEQ ID NO: 3364948 - protein, 18 aa, Plasmodium falciparum
LILRDRIYNSANHVLCQQ

SEQ ID NO: 3364949 - protein, 18 aa, Plasmodium falciparum
LILYPGSLVEYNFYKYER

SEQ ID NO: 3364950 - protein, 23 aa, Plasmodium falciparum
LIMPKRYRPPLSLSKLQYHMANH

SEQ ID NO: 3364951 - protein, 24 aa, Plasmodium falciparum
LINEKLYLSKEMEILERKLKESNE

SEQ ID NO: 3364952 - protein, 25 aa, Plasmodium falciparum
LINIFNMWNCWAIYNSVFVNGLLCL

SEQ ID NO: 3364953 - protein, 30 aa, Plasmodium falciparum
LININFKDEIKRIIQNAEATFNINEQSEQI

SEQ ID NO: 3364954 - protein, 19 aa, Plasmodium falciparum
LINIWNFIFKHVDPLIEVN

SEQ ID NO: 3364955 - protein, 24 aa, Plasmodium falciparum
LINKFLFFLRFYISHTLNNNMDNN

SEQ ID NO: 3364956 - protein, 18 aa, Plasmodium falciparum
LINLSCNYLLIKKNEKNV

SEQ ID NO: 3364957 - protein, 18 aa, Plasmodium falciparum
LINNINFYNKACVQVHLF

SEQ ID NO: 3364958 - protein, 21 aa, Plasmodium falciparum
LINNLPFKFSDISLNSFEKKK

SEQ ID NO: 3364959 - protein, 24 aa, Plasmodium falciparum
LINPKHNFFKSLLINGDKNMLNIS

SEQ ID NO: 3364960 - protein, 17 aa, Plasmodium falciparum
LINPYMNIMNMKGNVNM

SEQ ID NO: 3364961 - protein, 25 aa, Plasmodium falciparum
LINQRKVVEWKHSFENHKVDIVNTS

SEQ ID NO: 3364962 - protein, 22 aa, Plasmodium falciparum
LINRIKLVINHISLYFNQNILY

SEQ ID NO: 3364963 - protein, 17 aa, Plasmodium falciparum
LINRPPIILRTLTNNCI

SEQ ID NO: 3364964 - protein, 17 aa, Plasmodium falciparum
LINSFSLSIIFLGLINN

SEQ ID NO: 3364965 - protein, 22 aa, Plasmodium falciparum
LINTYIYCWFNKDVPYKVKHHM

SEQ ID NO: 3364966 - protein, 17 aa, Plasmodium falciparum
LIPAIPHDILQAYISCL

SEQ ID NO: 3364967 - protein, 17 aa, Plasmodium falciparum
LIPDRLRQCTVSYMKRK

SEQ ID NO: 3364968 - protein, 24 aa, Plasmodium falciparum
LIPEVLSVCSIQFKSILDCKRNNN

SEQ ID NO: 3364969 - protein, 19 aa, Plasmodium falciparum
LIPLHVGGNHWTLGSIHMK

SEQ ID NO: 3364970 - protein, 19 aa, Plasmodium falciparum
LIQAYLFIFLKAHGKKIMK

SEQ ID NO: 3364971 - protein, 27 aa, Plasmodium falciparum
LIQDNACKELLLSFVQAKKDSTYVYPR

SEQ ID NO: 3364972 - protein, 20 aa, Plasmodium falciparum
LIQELLSYCECLKRNRKKSS

SEQ ID NO: 3364973 - protein, 19 aa, Plasmodium falciparum
LIQFACLDSSIAMKTVINK

SEQ ID NO: 3364974 - protein, 18 aa, Plasmodium falciparum
LIQFPGIGLKVANCICLF

SEQ ID NO: 3364975 - protein, 26 aa, Plasmodium falciparum
LIQGNYRAILLLKIIKHKINFNYINK

SEQ ID NO: 3364976 - protein, 44 aa, Plasmodium falciparum
LIQIRKPVFFNIRRNKFIALQIGRTVMYVYMKRKNWIFLPICLK

SEQ ID NO: 3364977 - protein, 20 aa, Plasmodium falciparum
LIQREMLLLIKNDMFNYPLR

SEQ ID NO: 3364978 - protein, 26 aa, Plasmodium falciparum
LIQVLQKCFKHFNLYNGNSSSTLTLY

SEQ ID NO: 3364979 - protein, 28 aa, Plasmodium falciparum
LIRCPKHGRRSEEIKKKEFIETKLKYLE

SEQ ID NO: 3364980 - protein, 23 aa, Plasmodium falciparum
LIRDRIEREWRVEWLENGVPMKA

SEQ ID NO: 3364981 - protein, 19 aa, Plasmodium falciparum
LIRKNICTDNTYILKNNNP

SEQ ID NO: 3364982 - protein, 20 aa, Plasmodium falciparum
LIRRRNRKKSINFNYNNLEI

SEQ ID NO: 3364983 - protein, 24 aa, Plasmodium falciparum
LIRSLCFQKSLTIFNYFKPLLTFR

SEQ ID NO: 3364984 - protein, 18 aa, Plasmodium falciparum
LISERYCTNNKYFNSTFL

SEQ ID NO: 3364985 - protein, 17 aa, Plasmodium falciparum
LISIGFHNKIIKNMNRN

SEQ ID NO: 3364986 - protein, 18 aa, Plasmodium falciparum
LISLCAITLSFEQVMYKY

SEQ ID NO: 3364987 - protein, 26 aa, Plasmodium falciparum
LISLECLQVNLLIPFYKKKTKRIDNH

SEQ ID NO: 3364988 - protein, 17 aa, Plasmodium falciparum
LISLLKIFTHQNLISNP

SEQ ID NO: 3364989 - protein, 17 aa, Plasmodium falciparum
LISLMSIPMKVQLFHYI

SEQ ID NO: 3364990 - protein, 19 aa, Plasmodium falciparum
LISLWGIEHQEILMNSSIF

SEQ ID NO: 3364991 - protein, 24 aa, Plasmodium falciparum
LISSFKITNLFLREEKSHGYALIS

SEQ ID NO: 3364992 - protein, 19 aa, Plasmodium falciparum
LISTYSIFMYILRSHFFKH

SEQ ID NO: 3364993 - protein, 18 aa, Plasmodium falciparum
LITASPCANSFYKSKGIS

SEQ ID NO: 3364994 - protein, 21 aa, Plasmodium falciparum
LITKYFTPIIMKKYNMKKKEA

SEQ ID NO: 3364995 - protein, 23 aa, Plasmodium falciparum
LITLKIFPKKIIKINYSKNNILK

SEQ ID NO: 3364996 - protein, 27 aa, Plasmodium falciparum
LITSQEIPFIFNMDIIFQTEHNILILS

SEQ ID NO: 3364997 - protein, 18 aa, Plasmodium falciparum
LITYCILSKCDFIKLDSL

SEQ ID NO: 3364998 - protein, 29 aa, Plasmodium falciparum
LIVLFLPKYRLLALINICKTSIKVNISTL

SEQ ID NO: 3364999 - protein, 25 aa, Plasmodium falciparum
LIWELIKQILKGISYIHDMKIMHRD

SEQ ID NO: 3365000 - protein, 19 aa, Plasmodium falciparum
LIWNLQFSKELLKNKITNL

SEQ ID NO: 3365001 - protein, 23 aa, Plasmodium falciparum
LIYDTCTKLLIKNHISVNTNFNV

SEQ ID NO: 3365002 - protein, 18 aa, Plasmodium falciparum
LIYGIPIFIYTTIHYETN

SEQ ID NO: 3365003 - protein, 29 aa, Plasmodium falciparum
LIYICKTKPKNPCLHIAQYLLENAHKYNI

SEQ ID NO: 3365004 - protein, 18 aa, Plasmodium falciparum
LIYKKRNVNGYEEYMSQD

SEQ ID NO: 3365005 - protein, 20 aa, Plasmodium falciparum
LIYLLHCISYLIYSKEDKEK

SEQ ID NO: 3365006 - protein, 46 aa, Plasmodium falciparum
LIYRPPELIDLYSNFEISWKIDIWMVGCILYLLLFKIHPFQNNNFL

SEQ ID NO: 3365007 - protein, 19 aa, Plasmodium falciparum
LIYYDVVSLIKILSKLNKL

SEQ ID NO: 3365008 - protein, 29 aa, Plasmodium falciparum
LIYYERCTFKGANHIIFFSPPKFVFMYSE

SEQ ID NO: 3365009 - protein, 19 aa, Plasmodium falciparum
LKAADNFLEKKISYIGLDK

SEQ ID NO: 3365010 - protein, 18 aa, Plasmodium falciparum
LKAALPYLHEAEEAIKSI

SEQ ID NO: 3365011 - protein, 18 aa, Plasmodium falciparum
LKADETYINDGQIKKKYN

SEQ ID NO: 3365012 - protein, 19 aa, Plasmodium falciparum
LKAKLLHVNFFIKAENENV

SEQ ID NO: 3365013 - protein, 19 aa, Plasmodium falciparum
LKAKRKCSYNNTFRSFSPL

SEQ ID NO: 3365014 - protein, 26 aa, Plasmodium falciparum
LKAQELRPNCLLGMLLDTKGPEIRTG

SEQ ID NO: 3365015 - protein, 20 aa, Plasmodium falciparum
LKAVKNRLKMNVDIYTLPDL

SEQ ID NO: 3365016 - protein, 17 aa, Plasmodium falciparum
LKAYAERPIGVFHALAI

SEQ ID NO: 3365017 - protein, 18 aa, Plasmodium falciparum
LKAYENRKSYLISKLEKE

SEQ ID NO: 3365018 - protein, 32 aa, Plasmodium falciparum
LKCDNYRWLRIIKKSLFIKFFDGTLFDTKIKI

SEQ ID NO: 3365019 - protein, 26 aa, Plasmodium falciparum
LKCKNIPNVCDIYAKTKCDNCFYNLK

SEQ ID NO: 3365020 - protein, 21 aa, Plasmodium falciparum
LKCNVGGNIVIVSEFFNEDIL

SEQ ID NO: 3365021 - protein, 20 aa, Plasmodium falciparum
LKCSYDVFKNNVHRYSFDQI

SEQ ID NO: 3365022 - protein, 17 aa, Plasmodium falciparum
LKDDCDVRIREMNEKNE

SEQ ID NO: 3365023 - protein, 21 aa, Plasmodium falciparum
LKDDLKNLINIDFINDIDMEY

SEQ ID NO: 3365024 - protein, 19 aa, Plasmodium falciparum
LKDEIWNDTLLWVLDLNIK

SEQ ID NO: 3365025 - protein, 19 aa, Plasmodium falciparum
LKDELKLIISHNDDVRNYD

SEQ ID NO: 3365026 - protein, 25 aa, Plasmodium falciparum
LKDETYLNIPIWKFYGKCQECKNEI

SEQ ID NO: 3365027 - protein, 19 aa, Plasmodium falciparum
LKDIGAYQCSIDRKSCEGC

SEQ ID NO: 3365028 - protein, 19 aa, Plasmodium falciparum
LKDIKELINPLNLHNDSRI

SEQ ID NO: 3365029 - protein, 19 aa, Plasmodium falciparum
LKDIKNYVCYQCINEDDDI

SEQ ID NO: 3365030 - protein, 18 aa, Plasmodium falciparum
LKDIRLYNHKEKKNVNEE

SEQ ID NO: 3365031 - protein, 18 aa, Plasmodium falciparum
LKDIVSNQFIIYVQSSEE

SEQ ID NO: 3365032 - protein, 21 aa, Plasmodium falciparum
LKDIYKTIFIDLIILNPVYKI

SEQ ID NO: 3365033 - protein, 25 aa, Plasmodium falciparum
LKDKIMKKINCLIDICVDNKINQKL

SEQ ID NO: 3365034 - protein, 22 aa, Plasmodium falciparum
LKDKKLKTKRFKNLKKKITSPK

SEQ ID NO: 3365035 - protein, 19 aa, Plasmodium falciparum
LKDKTFKIILNKNENKNCF

SEQ ID NO: 3365036 - protein, 18 aa, Plasmodium falciparum
LKDLHYILNIKIYPIRTL

SEQ ID NO: 3365037 - protein, 23 aa, Plasmodium falciparum
LKDLKYSYYDGVKLCVNTFLNSL

SEQ ID NO: 3365038 - protein, 26 aa, Plasmodium falciparum
LKDLQEMFLRIQFRSSTKHHMNKKVK

SEQ ID NO: 3365039 - protein, 21 aa, Plasmodium falciparum
LKDNKKCVFNFELQEKVDHEN

SEQ ID NO: 3365040 - protein, 17 aa, Plasmodium falciparum
LKDQVCNKENIIHNKMD

SEQ ID NO: 3365041 - protein, 29 aa, Plasmodium falciparum
LKDSAYYEELDYLYKLLIQKKKNILGNKY

SEQ ID NO: 3365042 - protein, 22 aa, Plasmodium falciparum
LKDYNIFLNDAFNNFKINQNNN

SEQ ID NO: 3365043 - protein, 23 aa, Plasmodium falciparum
LKEACIILLYLKRYDQFKDLRLD

SEQ ID NO: 3365044 - protein, 18 aa, Plasmodium falciparum
LKEELDMIKNYYSEEKLK

SEQ ID NO: 3365045 - protein, 22 aa, Plasmodium falciparum
LKEFAPKPELVEVWDTTSSDPY

SEQ ID NO: 3365046 - protein, 17 aa, Plasmodium falciparum
LKEGINHRDKHEHMQDS

SEQ ID NO: 3365047 - protein, 17 aa, Plasmodium falciparum
LKEGMLIQNELNDLLKK

SEQ ID NO: 3365048 - protein, 21 aa, Plasmodium falciparum
LKEHYCYDLFKKRKLENTYRN

SEQ ID NO: 3365049 - protein, 23 aa, Plasmodium falciparum
LKEIMPTLSAKVFRTYNASITLD

SEQ ID NO: 3365050 - protein, 27 aa, Plasmodium falciparum
LKEKEKIIWFNELKTYLLKNTLALLAA

SEQ ID NO: 3365051 - protein, 20 aa, Plasmodium falciparum
LKEKFEMFVQNVFNFDINEP

SEQ ID NO: 3365052 - protein, 21 aa, Plasmodium falciparum
LKEKKGLHLSKQVIDLIFNCL

SEQ ID NO: 3365053 - protein, 17 aa, Plasmodium falciparum
LKEKLQLVKRENEKKYP

SEQ ID NO: 3365054 - protein, 18 aa, Plasmodium falciparum
LKEKMLRHQSVFNNILDI

SEQ ID NO: 3365055 - protein, 27 aa, Plasmodium falciparum
LKEKNMRWVMCKSLKQARLGLATIVFK

SEQ ID NO: 3365056 - protein, 31 aa, Plasmodium falciparum
LKELDKCNSHFFFTYFHKGELIEYLHNQINM

SEQ ID NO: 3365057 - protein, 18 aa, Plasmodium falciparum
LKELIKYQYKEYLLHKTV

SEQ ID NO: 3365058 - protein, 25 aa, Plasmodium falciparum
LKELKNLVRLGVQFNPFADNPNYRK

SEQ ID NO: 3365059 - protein, 19 aa, Plasmodium falciparum
LKELLFHLDPLNKYEQDND

SEQ ID NO: 3365060 - protein, 18 aa, Plasmodium falciparum
LKELRRFNERKKRLETYL

SEQ ID NO: 3365061 - protein, 19 aa, Plasmodium falciparum
LKENIKSNCIKKIPIDINM

SEQ ID NO: 3365062 - protein, 30 aa, Plasmodium falciparum
LKENKFRWVMFPIKYKTFWSYYKEIESLFW

SEQ ID NO: 3365063 - protein, 27 aa, Plasmodium falciparum
LKENLKYSFNKFNSFNDMCINDISKNV

SEQ ID NO: 3365064 - protein, 25 aa, Plasmodium falciparum
LKENRIGIISSMIYYFTLHENMFII

SEQ ID NO: 3365065 - protein, 24 aa, Plasmodium falciparum
LKEPCGTLAYVAPEVITLQGYNHK

SEQ ID NO: 3365066 - protein, 19 aa, Plasmodium falciparum
LKEPIRLFGETDLQRYNRL

SEQ ID NO: 3365067 - protein, 25 aa, Plasmodium falciparum
LKESGLKISHNIVHIYPIVKLTNYK

SEQ ID NO: 3365068 - protein, 23 aa, Plasmodium falciparum
LKESIDNICAMGFEKEQVKKAMI

SEQ ID NO: 3365069 - protein, 19 aa, Plasmodium falciparum
LKESYERRLDLLKQEIDEK

SEQ ID NO: 3365070 - protein, 29 aa, Plasmodium falciparum
LKEYRKKKLICIIWIKIYMMIIEEHKKEE

SEQ ID NO: 3365071 - protein, 21 aa, Plasmodium falciparum
LKFCRSFHLFPLPSGGYFIFN

SEQ ID NO: 3365072 - protein, 19 aa, Plasmodium falciparum
LKFDCHDWTYKGCSEYYPL

SEQ ID NO: 3365073 - protein, 19 aa, Plasmodium falciparum
LKFGGSLKTFVHVILYPDA

SEQ ID NO: 3365074 - protein, 19 aa, Plasmodium falciparum
LKFIDIFDEENELGISNDI

SEQ ID NO: 3365075 - protein, 19 aa, Plasmodium falciparum
LKFIYSFLEHFKLLKKELY

SEQ ID NO: 3365076 - protein, 19 aa, Plasmodium falciparum
LKFKIKKYNNIPIFYFRKL

SEQ ID NO: 3365077 - protein, 25 aa, Plasmodium falciparum
LKFLLYEFFCPYGNIIDINIKKSNK

SEQ ID NO: 3365078 - protein, 20 aa, Plasmodium falciparum
LKFNQCSLMDLLTADYSVNC

SEQ ID NO: 3365079 - protein, 17 aa, Plasmodium falciparum
LKFQLLMSKKVKNIIYN

SEQ ID NO: 3365080 - protein, 17 aa, Plasmodium falciparum
LKFYFKQFKHMHNFLPF

SEQ ID NO: 3365081 - protein, 19 aa, Plasmodium falciparum
LKGDLKNDIYLVNKMENVQ

SEQ ID NO: 3365082 - protein, 20 aa, Plasmodium falciparum
LKGDTSFLYIFIQTYVEMIN

SEQ ID NO: 3365083 - protein, 31 aa, Plasmodium falciparum
LKGEYFYKRISTCLIKSSLVKDYEKSQNKHF

SEQ ID NO: 3365084 - protein, 26 aa, Plasmodium falciparum
LKGHLFKFLYKYFQVHTDLRDLLNNC

SEQ ID NO: 3365085 - protein, 20 aa, Plasmodium falciparum
LKGHRNSIEGLHLLDDERFC

SEQ ID NO: 3365086 - protein, 26 aa, Plasmodium falciparum
LKGKEGRLRGNLMGKRVDFSARTVIT

SEQ ID NO: 3365087 - protein, 17 aa, Plasmodium falciparum
LKGKVIINRNYRGEVNV

SEQ ID NO: 3365088 - protein, 34 aa, Plasmodium falciparum
LKGLFTGEKKTCMKSYLVNCNKIEKFIQNNMIEG

SEQ ID NO: 3365089 - protein, 21 aa, Plasmodium falciparum
LKGNIPITYLCMGQDNINKNY

SEQ ID NO: 3365090 - protein, 24 aa, Plasmodium falciparum
LKGNIPKVPTCFINKVNKLSEFQK

SEQ ID NO: 3365091 - protein, 28 aa, Plasmodium falciparum
LKGNVIYPPKFPAVSNFSSNRPYLLKAP

SEQ ID NO: 3365092 - protein, 17 aa, Plasmodium falciparum
LKGQMELSKRKKTTSNI

SEQ ID NO: 3365093 - protein, 30 aa, Plasmodium falciparum
LKGRERDSLKGRERGSFRGKERDSFRGKER

SEQ ID NO: 3365094 - protein, 18 aa, Plasmodium falciparum
LKGSASHFKLPFSCNNLN

SEQ ID NO: 3365095 - protein, 17 aa, Plasmodium falciparum
LKGSLMGEERMKLWNEL

SEQ ID NO: 3365096 - protein, 22 aa, Plasmodium falciparum
LKGYIYIEADSLYMLKKFLLGF

SEQ ID NO: 3365097 - protein, 27 aa, Plasmodium falciparum
LKHFANIFCNGRIILVLEGGYNLNYLP

SEQ ID NO: 3365098 - protein, 21 aa, Plasmodium falciparum
LKHIFENSFELHLLIDYKKKL

SEQ ID NO: 3365099 - protein, 23 aa, Plasmodium falciparum
LKHINILELIAYFEDKTRLFLIL

SEQ ID NO: 3365100 - protein, 28 aa, Plasmodium falciparum
LKHIRWVDEIISPCPWVITPEFMEEHKI

SEQ ID NO: 3365101 - protein, 22 aa, Plasmodium falciparum
LKHIRWVDEIISPCPWVVTPEF

SEQ ID NO: 3365102 - protein, 25 aa, Plasmodium falciparum
LKHKGICPSGRVYSTIVWLDRTTKE

SEQ ID NO: 3365103 - protein, 18 aa, Plasmodium falciparum
LKHKINRGLNNIYNTSPN

SEQ ID NO: 3365104 - protein, 21 aa, Plasmodium falciparum
LKHLLDTALCISKVNIQDIHS

SEQ ID NO: 3365105 - protein, 18 aa, Plasmodium falciparum
LKHPCIIYGIELNFDNIA

SEQ ID NO: 3365106 - protein, 20 aa, Plasmodium falciparum
LKHTLKKYACNKNVERSLPY

SEQ ID NO: 3365107 - protein, 22 aa, Plasmodium falciparum
LKIAAQRDISGSFMGPKGIHVK

SEQ ID NO: 3365108 - protein, 50 aa, Plasmodium falciparum
LKICTTLNNKYICRYIGIHSGMTLYNIHRCICICLGVKKEDTDNYLHVFI

SEQ ID NO: 3365109 - protein, 20 aa, Plasmodium falciparum
LKIDELNMNLSINDEDMHVR

SEQ ID NO: 3365110 - protein, 20 aa, Plasmodium falciparum
LKIDNCLNIYPQLNDIPLSS

SEQ ID NO: 3365111 - protein, 21 aa, Plasmodium falciparum
LKIENEFKKDLLLDDSQIFGD

SEQ ID NO: 3365112 - protein, 17 aa, Plasmodium falciparum
LKIGTPLFVPEKNIKIG

SEQ ID NO: 3365113 - protein, 19 aa, Plasmodium falciparum
LKIHRECIKKRNASVKLKA

SEQ ID NO: 3365114 - protein, 18 aa, Plasmodium falciparum
LKIHRLGRISFRTIKNNR

SEQ ID NO: 3365115 - protein, 22 aa, Plasmodium falciparum
LKIIEAYSCIDLHYIGQKLNLD

SEQ ID NO: 3365116 - protein, 23 aa, Plasmodium falciparum
LKIIETRGIVLLQDINFEIVNDY

SEQ ID NO: 3365117 - protein, 22 aa, Plasmodium falciparum
LKIKENRNIVSIVNIERQHALY

SEQ ID NO: 3365118 - protein, 29 aa, Plasmodium falciparum
LKIKKEFFLKNCSCCKYSNGGNFMAVSKI

SEQ ID NO: 3365119 - protein, 24 aa, Plasmodium falciparum
LKIKTLDLLYEMTNPLNVQVIVEK

SEQ ID NO: 3365120 - protein, 17 aa, Plasmodium falciparum
LKILDYVYYAKLNSSQI

SEQ ID NO: 3365121 - protein, 20 aa, Plasmodium falciparum
LKILKFENLFSYTMDDVVKF

SEQ ID NO: 3365122 - protein, 20 aa, Plasmodium falciparum
LKILLCENGNKFTESEFKKF

SEQ ID NO: 3365123 - protein, 31 aa, Plasmodium falciparum
LKILLKNNYVREVFKQFTLSNDKIGYLSHYI

SEQ ID NO: 3365124 - protein, 19 aa, Plasmodium falciparum
LKIMNRLSKLTSRYFSNKG

SEQ ID NO: 3365125 - protein, 25 aa, Plasmodium falciparum
LKIMVKELLNYLLVADIEIKSDIVS

SEQ ID NO: 3365126 - protein, 17 aa, Plasmodium falciparum
LKINFIKKYETIPSLII

SEQ ID NO: 3365127 - protein, 21 aa, Plasmodium falciparum
LKINFPDRIWLIRGNHECRQM

SEQ ID NO: 3365128 - protein, 32 aa, Plasmodium falciparum
LKINRMRQFIRFIIEYNNWPFFLDDTINMENY

SEQ ID NO: 3365129 - protein, 19 aa, Plasmodium falciparum
LKIPCFANGTQFCIESLKE

SEQ ID NO: 3365130 - protein, 17 aa, Plasmodium falciparum
LKIPKCISRVVELSLSN

SEQ ID NO: 3365131 - protein, 20 aa, Plasmodium falciparum
LKIPSSILIINIQEFNCCIC

SEQ ID NO: 3365132 - protein, 33 aa, Plasmodium falciparum
LKIQKSFHMYDFFNLSLLFPIKVFKKTDKTLIQ

SEQ ID NO: 3365133 - protein, 18 aa, Plasmodium falciparum
LKISKELDKCVSMKNFFF

SEQ ID NO: 3365134 - protein, 27 aa, Plasmodium falciparum
LKISLIQIFRAHLWQKIHESLVMDICQ

SEQ ID NO: 3365135 - protein, 19 aa, Plasmodium falciparum
LKISLNIEFFEHLKQFEYT

SEQ ID NO: 3365136 - protein, 21 aa, Plasmodium falciparum
LKISYTYPDGSVWCCEGHISR

SEQ ID NO: 3365137 - protein, 18 aa, Plasmodium falciparum
LKITPERIIESNIVDSYK

SEQ ID NO: 3365138 - protein, 17 aa, Plasmodium falciparum
LKIVDLIMAEKSIKREN

SEQ ID NO: 3365139 - protein, 18 aa, Plasmodium falciparum
LKIVEPYVTYGYPTLSTV

SEQ ID NO: 3365140 - protein, 23 aa, Plasmodium falciparum
LKIWIHTFCNIIRNYNIFYEFIQ

SEQ ID NO: 3365141 - protein, 18 aa, Plasmodium falciparum
LKIWKPKKNYKFKDNNKH

SEQ ID NO: 3365142 - protein, 18 aa, Plasmodium falciparum
LKIYFNNIINSIRTFFLI

SEQ ID NO: 3365143 - protein, 23 aa, Plasmodium falciparum
LKKACLKNPVKVEVSNKYSTVST

SEQ ID NO: 3365144 - protein, 23 aa, Plasmodium falciparum
LKKAEKENFIFLHKLKKRNYTKM

SEQ ID NO: 3365145 - protein, 21 aa, Plasmodium falciparum
LKKAGANFVICQWGFDDEANY

SEQ ID NO: 3365146 - protein, 17 aa, Plasmodium falciparum
LKKAILILKYIMHICPI

SEQ ID NO: 3365147 - protein, 21 aa, Plasmodium falciparum
LKKDKQCIIFVCSRNETNKTI

SEQ ID NO: 3365148 - protein, 32 aa, Plasmodium falciparum
LKKDKYFNCLRCKYICLSVVKMIKHIELYNHG

SEQ ID NO: 3365149 - protein, 20 aa, Plasmodium falciparum
LKKECIKYNSIVIYSTHIFD

SEQ ID NO: 3365150 - protein, 19 aa, Plasmodium falciparum
LKKECLHDIIDNMKNMKDF

SEQ ID NO: 3365151 - protein, 26 aa, Plasmodium falciparum
LKKFICPLHICYVCKEFDINNTESSK

SEQ ID NO: 3365152 - protein, 21 aa, Plasmodium falciparum
LKKFLPNNEINIMSYYYNHIL

SEQ ID NO: 3365153 - protein, 20 aa, Plasmodium falciparum
LKKGATLIIAEVVSRFTNYK

SEQ ID NO: 3365154 - protein, 25 aa, Plasmodium falciparum
LKKGKPELSEFFFDYNSQYYYHPLY

SEQ ID NO: 3365155 - protein, 21 aa, Plasmodium falciparum
LKKGVSGKIGDDFIMDNNGDL

SEQ ID NO: 3365156 - protein, 21 aa, Plasmodium falciparum
LKKHMNRTYSRSISMYEDINI

SEQ ID NO: 3365157 - protein, 21 aa, Plasmodium falciparum
LKKICVNEPILSARYVGNHFI

SEQ ID NO: 3365158 - protein, 24 aa, Plasmodium falciparum
LKKIKYVYEKSLYTFKERLKKNEL

SEQ ID NO: 3365159 - protein, 18 aa, Plasmodium falciparum
LKKKEEQINEYINEIENY

SEQ ID NO: 3365160 - protein, 18 aa, Plasmodium falciparum
LKKKGCKSFIDNLKLLLP

SEQ ID NO: 3365161 - protein, 23 aa, Plasmodium falciparum
LKKKKCFYVLLSSNDIHRYYPLD

SEQ ID NO: 3365162 - protein, 20 aa, Plasmodium falciparum
LKKKKICIEVNGFTHYYNFN

SEQ ID NO: 3365163 - protein, 30 aa, Plasmodium falciparum
LKKKKKKRIVLSFDIDRIFYFYDKKYKEEY

SEQ ID NO: 3365164 - protein, 27 aa, Plasmodium falciparum
LKKKKSPCLLCLYGLIEKQRALNYYID

SEQ ID NO: 3365165 - protein, 21 aa, Plasmodium falciparum
LKKKLDISICNEKDLNNKLYD

SEQ ID NO: 3365166 - protein, 25 aa, Plasmodium falciparum
LKKKMLKEKIELEKKYKEQYEKETQ

SEQ ID NO: 3365167 - protein, 17 aa, Plasmodium falciparum
LKKKSTFSFKKGLDNIT

SEQ ID NO: 3365168 - protein, 21 aa, Plasmodium falciparum
LKKKWKMSASNNFYAYPKIPD

SEQ ID NO: 3365169 - protein, 19 aa, Plasmodium falciparum
LKKLKIINDPDCNNFSNQN

SEQ ID NO: 3365170 - protein, 24 aa, Plasmodium falciparum
LKKLKKILLNLDVLIDVSKIVIQK

SEQ ID NO: 3365171 - protein, 26 aa, Plasmodium falciparum
LKKMIKLHSNFYFSVMYQDIVGKLSK

SEQ ID NO: 3365172 - protein, 20 aa, Plasmodium falciparum
LKKMKEILLSKENIINYSLN

SEQ ID NO: 3365173 - protein, 17 aa, Plasmodium falciparum
LKKMLNYLWNIPNEIIN

SEQ ID NO: 3365174 - protein, 18 aa, Plasmodium falciparum
LKKNIFLERDILTKENNK

SEQ ID NO: 3365175 - protein, 18 aa, Plasmodium falciparum
LKKNLKKNYSYKITIDKE

SEQ ID NO: 3365176 - protein, 26 aa, Plasmodium falciparum
LKKNRGVVYANDINKLRCKAIEAHAS

SEQ ID NO: 3365177 - protein, 20 aa, Plasmodium falciparum
LKKNRYINDFNFFCSPNKSL

SEQ ID NO: 3365178 - protein, 17 aa, Plasmodium falciparum
LKKRGAIFILTPIILLN

SEQ ID NO: 3365179 - protein, 24 aa, Plasmodium falciparum
LKKRIKKLPFFRYGHFLCLTKNGC

SEQ ID NO: 3365180 - protein, 17 aa, Plasmodium falciparum
LKKRKLLEIKKNSYSHV

SEQ ID NO: 3365181 - protein, 21 aa, Plasmodium falciparum
LKKRLTSFFLYWKINVQLITE

SEQ ID NO: 3365182 - protein, 21 aa, Plasmodium falciparum
LKKRNGKNIFINSSRNNNGKN

SEQ ID NO: 3365183 - protein, 19 aa, Plasmodium falciparum
LKKSIWFSSIGLELNDFLN

SEQ ID NO: 3365184 - protein, 25 aa, Plasmodium falciparum
LKKSKIKGIHGMLIDLGYIEKKYEK

SEQ ID NO: 3365185 - protein, 18 aa, Plasmodium falciparum
LKKTLPKVNHFCKYLELI

SEQ ID NO: 3365186 - protein, 22 aa, Plasmodium falciparum
LKKVEKGEFVFDSNYWARVSDD

SEQ ID NO: 3365187 - protein, 20 aa, Plasmodium falciparum
LKKVIQYRINVMKQRKVEKL

SEQ ID NO: 3365188 - protein, 18 aa, Plasmodium falciparum
LKKYFILNNKYLIENANK

SEQ ID NO: 3365189 - protein, 20 aa, Plasmodium falciparum
LKKYIKVVMWFGVPDSLACI

SEQ ID NO: 3365190 - protein, 17 aa, Plasmodium falciparum
LKKYKIINENIQYINLD

SEQ ID NO: 3365191 - protein, 21 aa, Plasmodium falciparum
LKKYNECILFLQNVGRNKIKA

SEQ ID NO: 3365192 - protein, 22 aa, Plasmodium falciparum
LKLANYRLAIEKAILSKDIELV

SEQ ID NO: 3365193 - protein, 18 aa, Plasmodium falciparum
LKLDLNIYEQLKRKMIGK

SEQ ID NO: 3365194 - protein, 17 aa, Plasmodium falciparum
LKLDSLIIQKGKLNLNS

SEQ ID NO: 3365195 - protein, 21 aa, Plasmodium falciparum
LKLFDIRVGKKNIYLNNINNF

SEQ ID NO: 3365196 - protein, 17 aa, Plasmodium falciparum
LKLIIRGHECVQEGYKY

SEQ ID NO: 3365197 - protein, 18 aa, Plasmodium falciparum
LKLISFVLEQEICVFDFY

SEQ ID NO: 3365198 - protein, 17 aa, Plasmodium falciparum
LKLKKDIFKKDDKKGKK

SEQ ID NO: 3365199 - protein, 19 aa, Plasmodium falciparum
LKLKKELLKVTPKLLINKT

SEQ ID NO: 3365200 - protein, 24 aa, Plasmodium falciparum
LKLKNADYIRSFYFYDNSWTRPFM

SEQ ID NO: 3365201 - protein, 22 aa, Plasmodium falciparum
LKLKNNQIILCRNCNSNIINYS

SEQ ID NO: 3365202 - protein, 21 aa, Plasmodium falciparum
LKLKSEDNSLVLSPSSCSNDK

SEQ ID NO: 3365203 - protein, 20 aa, Plasmodium falciparum
LKLLCIQNNFIINQDFLNYL

SEQ ID NO: 3365204 - protein, 20 aa, Plasmodium falciparum
LKLLEKYIFMNKEYFKISHI

SEQ ID NO: 3365205 - protein, 17 aa, Plasmodium falciparum
LKLLNYINKEMATKKME

SEQ ID NO: 3365206 - protein, 21 aa, Plasmodium falciparum
LKLLSCSYCSEEIAKHYLELA

SEQ ID NO: 3365207 - protein, 21 aa, Plasmodium falciparum
LKLNDVIEIIGIYRKHQIKDF

SEQ ID NO: 3365208 - protein, 21 aa, Plasmodium falciparum
LKLNEDFLYINILKRSTKPEC

SEQ ID NO: 3365209 - protein, 29 aa, Plasmodium falciparum
LKLNIWDKLSELGIIEFLSVPKDFKENKK

SEQ ID NO: 3365210 - protein, 19 aa, Plasmodium falciparum
LKLNNVMSLQNLYKNVLNI

SEQ ID NO: 3365211 - protein, 23 aa, Plasmodium falciparum
LKLTHKKKSIVLLFDTQNDIQYY

SEQ ID NO: 3365212 - protein, 18 aa, Plasmodium falciparum
LKLWKVSHLFQQNEITQS

SEQ ID NO: 3365213 - protein, 20 aa, Plasmodium falciparum
LKLYHLRIVEMQQNVYKNNK

SEQ ID NO: 3365214 - protein, 27 aa, Plasmodium falciparum
LKLYKDMFSVFSLKMKYKFNNNIMDDD

SEQ ID NO: 3365215 - protein, 17 aa, Plasmodium falciparum
LKLYKIIMRQTRLPELG

SEQ ID NO: 3365216 - protein, 17 aa, Plasmodium falciparum
LKLYPLINNNAYVNIKR

SEQ ID NO: 3365217 - protein, 17 aa, Plasmodium falciparum
LKMCGVFYFLCSCKILS

SEQ ID NO: 3365218 - protein, 20 aa, Plasmodium falciparum
LKMHFLDIFENFLITIKMRN

SEQ ID NO: 3365219 - protein, 18 aa, Plasmodium falciparum
LKMICKINKKKSQNYYEQ

SEQ ID NO: 3365220 - protein, 23 aa, Plasmodium falciparum
LKMKKRKDDPMNIYLEAKEENQE

SEQ ID NO: 3365221 - protein, 19 aa, Plasmodium falciparum
LKMKLKEDRNMFRKDMHMM

SEQ ID NO: 3365222 - protein, 25 aa, Plasmodium falciparum
LKMKRIIHLKYYVPGLLKKLFNVDG

SEQ ID NO: 3365223 - protein, 18 aa, Plasmodium falciparum
LKMKYKFNNNIMDDDTDI

SEQ ID NO: 3365224 - protein, 21 aa, Plasmodium falciparum
LKMMITCDFFRHGFDGSGGDN

SEQ ID NO: 3365225 - protein, 21 aa, Plasmodium falciparum
LKMTLYRVLALSTDDGFIEFV

SEQ ID NO: 3365226 - protein, 20 aa, Plasmodium falciparum
LKMVCKKLDQIVLNYESIID

SEQ ID NO: 3365227 - protein, 17 aa, Plasmodium falciparum
LKMYHLAGKKEKDNNMN

SEQ ID NO: 3365228 - protein, 24 aa, Plasmodium falciparum
LKNAKRYFATMSFDSDIQLKQSKE

SEQ ID NO: 3365229 - protein, 18 aa, Plasmodium falciparum
LKNCKQGLGKFVSNIYDI

SEQ ID NO: 3365230 - protein, 20 aa, Plasmodium falciparum
LKNDFSYHDLFVAASQILID

SEQ ID NO: 3365231 - protein, 27 aa, Plasmodium falciparum
LKNDGCVSLLSVHALKNIVLKLYHLRI

SEQ ID NO: 3365232 - protein, 18 aa, Plasmodium falciparum
LKNDHRIEEEELQLKGKT

SEQ ID NO: 3365233 - protein, 19 aa, Plasmodium falciparum
LKNDIYLVNKMENVQNFND

SEQ ID NO: 3365234 - protein, 23 aa, Plasmodium falciparum
LKNEKKDPVDIILNSYKNIYVSK

SEQ ID NO: 3365235 - protein, 19 aa, Plasmodium falciparum
LKNELTMFLEATPFCTIQA

SEQ ID NO: 3365236 - protein, 22 aa, Plasmodium falciparum
LKNEVLDKILLRRTKGERKSDI

SEQ ID NO: 3365237 - protein, 18 aa, Plasmodium falciparum
LKNEVSFENNEMIVSGIQ

SEQ ID NO: 3365238 - protein, 38 aa, Plasmodium falciparum
LKNFFDISIRSSVLYHLKYKKDYNVAISDIFSIMDNVN

SEQ ID NO: 3365239 - protein, 18 aa, Plasmodium falciparum
LKNFLRVYISHFTHTLIL

SEQ ID NO: 3365240 - protein, 24 aa, Plasmodium falciparum
LKNFPSCRMCTIFDGHIGKETALY

SEQ ID NO: 3365241 - protein, 26 aa, Plasmodium falciparum
LKNFSAEWNKNGYFFIVSHNFGYFSI

SEQ ID NO: 3365242 - protein, 18 aa, Plasmodium falciparum
LKNFSFLFYHHIKNKKKE

SEQ ID NO: 3365243 - protein, 20 aa, Plasmodium falciparum
LKNGKFRLINQNGINTTRVK

SEQ ID NO: 3365244 - protein, 23 aa, Plasmodium falciparum
LKNGNVMQCCICLEDATYPLISK

SEQ ID NO: 3365245 - protein, 20 aa, Plasmodium falciparum
LKNGPSFSFFYEYAHDRSIL

SEQ ID NO: 3365246 - protein, 24 aa, Plasmodium falciparum
LKNGRTLFRNHILESFDHLKFLSI

SEQ ID NO: 3365247 - protein, 25 aa, Plasmodium falciparum
LKNIKRNITILSHYLPHKKEYDYIT

SEQ ID NO: 3365248 - protein, 26 aa, Plasmodium falciparum
LKNILREVNFLKMCEHPNVVKYFESF

SEQ ID NO: 3365249 - protein, 33 aa, Plasmodium falciparum
LKNIRTIYDLIFSVSFFKFSNCMTDVYNNDSGE

SEQ ID NO: 3365250 - protein, 20 aa, Plasmodium falciparum
LKNIVKLGISLVTYLRNLFE

SEQ ID NO: 3365251 - protein, 17 aa, Plasmodium falciparum
LKNIWKTNNTMLKKEIQ

SEQ ID NO: 3365252 - protein, 21 aa, Plasmodium falciparum
LKNIYSLLPYEYKNFLQRIRT

SEQ ID NO: 3365253 - protein, 25 aa, Plasmodium falciparum
LKNKEIILLQLIIEPYILRRSKKHV

SEQ ID NO: 3365254 - protein, 19 aa, Plasmodium falciparum
LKNKIILLRDLMYYKKLKN

SEQ ID NO: 3365255 - protein, 26 aa, Plasmodium falciparum
LKNKKNLYRLLGINFTKDIKNKIKCL

SEQ ID NO: 3365256 - protein, 21 aa, Plasmodium falciparum
LKNKKPFIMKKYKNVTSKVAK

SEQ ID NO: 3365257 - protein, 17 aa, Plasmodium falciparum
LKNKLLFAISNDLKLFD

SEQ ID NO: 3365258 - protein, 17 aa, Plasmodium falciparum
LKNKNLIDDKVGDDDDD

SEQ ID NO: 3365259 - protein, 28 aa, Plasmodium falciparum
LKNKSIYKRCYLNIRNLYLVKKNDKIKF

SEQ ID NO: 3365260 - protein, 17 aa, Plasmodium falciparum
LKNLKISIIKTEIPINC

SEQ ID NO: 3365261 - protein, 18 aa, Plasmodium falciparum
LKNLRRVSRELGENLSDD

SEQ ID NO: 3365262 - protein, 17 aa, Plasmodium falciparum
LKNMKYNKMLPLKPDYN

SEQ ID NO: 3365263 - protein, 22 aa, Plasmodium falciparum
LKNNFHTLCLLDIKVKERTVEN

SEQ ID NO: 3365264 - protein, 23 aa, Plasmodium falciparum
LKNNMNLFFSMCVQYITNYIDKE

SEQ ID NO: 3365265 - protein, 19 aa, Plasmodium falciparum
LKNNMYNNLNVFKNLKDDY

SEQ ID NO: 3365266 - protein, 21 aa, Plasmodium falciparum
LKNNREIFPSKDIKSLCIFKQ

SEQ ID NO: 3365267 - protein, 17 aa, Plasmodium falciparum
LKNNYSYIYKVRNSEQI

SEQ ID NO: 3365268 - protein, 20 aa, Plasmodium falciparum
LKNQHILLFNSLSNQSLLLD

SEQ ID NO: 3365269 - protein, 19 aa, Plasmodium falciparum
LKNQITFSSVKYISWFTSE

SEQ ID NO: 3365270 - protein, 18 aa, Plasmodium falciparum
LKNRFNKQICESVFHCIK

SEQ ID NO: 3365271 - protein, 18 aa, Plasmodium falciparum
LKNRKCIKCNSFIIFMNE

SEQ ID NO: 3365272 - protein, 24 aa, Plasmodium falciparum
LKNSMNILKEKKSHIILLKEDLHF

SEQ ID NO: 3365273 - protein, 19 aa, Plasmodium falciparum
LKNSNFLFDDMDKYKNDQY

SEQ ID NO: 3365274 - protein, 17 aa, Plasmodium falciparum
LKNVCDMNLQSQILIKE

SEQ ID NO: 3365275 - protein, 29 aa, Plasmodium falciparum
LKNVKTYLSKFGCRLWHIVFKKSKSHLRL

SEQ ID NO: 3365276 - protein, 20 aa, Plasmodium falciparum
LKNVLKDVLKMNTPGSTMTN

SEQ ID NO: 3365277 - protein, 20 aa, Plasmodium falciparum
LKNVLSGISYQMKNAMNVFG

SEQ ID NO: 3365278 - protein, 19 aa, Plasmodium falciparum
LKNVNKLICENIYSNMVLC

SEQ ID NO: 3365279 - protein, 25 aa, Plasmodium falciparum
LKNYFYENIKKFLLNINYNEINNII

SEQ ID NO: 3365280 - protein, 17 aa, Plasmodium falciparum
LKNYILILRDYENLCND

SEQ ID NO: 3365281 - protein, 19 aa, Plasmodium falciparum
LKNYKKYKVHKVNTQNNIV

SEQ ID NO: 3365282 - protein, 20 aa, Plasmodium falciparum
LKNYPPFSFKVSLAGLKIPT

SEQ ID NO: 3365283 - protein, 17 aa, Plasmodium falciparum
LKNYRFNDNASKKKNNN

SEQ ID NO: 3365284 - protein, 17 aa, Plasmodium falciparum
LKPEIFVNNAFILPFKE

SEQ ID NO: 3365285 - protein, 22 aa, Plasmodium falciparum
LKPELLLERKNCMVKIDKNNFS

SEQ ID NO: 3365286 - protein, 21 aa, Plasmodium falciparum
LKPENTAIIGIRDIDAYEKII

SEQ ID NO: 3365287 - protein, 18 aa, Plasmodium falciparum
LKPFCYYCDREFDDEKIL

SEQ ID NO: 3365288 - protein, 21 aa, Plasmodium falciparum
LKPGGIPLACSHIMESIEIAK

SEQ ID NO: 3365289 - protein, 17 aa, Plasmodium falciparum
LKPGKKFEHYGIKLELI

SEQ ID NO: 3365290 - protein, 24 aa, Plasmodium falciparum
LKPHNIDSFFLLDLKNIYGGKQIR

SEQ ID NO: 3365291 - protein, 33 aa, Plasmodium falciparum
LKPIPNLYKTAMCRNFIKNMCFKSKKECNFAHH

SEQ ID NO: 3365292 - protein, 20 aa, Plasmodium falciparum
LKPKELWTGKQLISVLIKPN

SEQ ID NO: 3365293 - protein, 21 aa, Plasmodium falciparum
LKPNEDLIRISGIKDNNNNNN

SEQ ID NO: 3365294 - protein, 18 aa, Plasmodium falciparum
LKPPRKGFKAKRHAFNEP

SEQ ID NO: 3365295 - protein, 19 aa, Plasmodium falciparum
LKPSMSYNKVISIMKNTSK

SEQ ID NO: 3365296 - protein, 21 aa, Plasmodium falciparum
LKPWLLEVNHSPSFSVSSKVD

SEQ ID NO: 3365297 - protein, 29 aa, Plasmodium falciparum
LKPYIPNILDFIELILIKEINHFNAQNFQ

SEQ ID NO: 3365298 - protein, 22 aa, Plasmodium falciparum
LKPYYECYIEFMKMKKTYNGVL

SEQ ID NO: 3365299 - protein, 27 aa, Plasmodium falciparum
LKQARLGLATIVFKGKIYAIGGSTGVK

SEQ ID NO: 3365300 - protein, 17 aa, Plasmodium falciparum
LKQEWKNDMTLEEGLLL

SEQ ID NO: 3365301 - protein, 18 aa, Plasmodium falciparum
LKQGVHMVVGTPGRVYDM

SEQ ID NO: 3365302 - protein, 26 aa, Plasmodium falciparum
LKQHIVFYKNELRVLKELNADIDEDN

SEQ ID NO: 3365303 - protein, 18 aa, Plasmodium falciparum
LKQIEVIDSNLFFNYNEN

SEQ ID NO: 3365304 - protein, 19 aa, Plasmodium falciparum
LKQKYIDVKGFKNENIFNF

SEQ ID NO: 3365305 - protein, 17 aa, Plasmodium falciparum
LKQSTSHYVDNYNSSKD

SEQ ID NO: 3365306 - protein, 18 aa, Plasmodium falciparum
LKQTYIIKEIDMVKKTDT

SEQ ID NO: 3365307 - protein, 24 aa, Plasmodium falciparum
LKQYKGHNGFIFYVCVNEKDKIMI

SEQ ID NO: 3365308 - protein, 19 aa, Plasmodium falciparum
LKRDCLNITNFFKKKIGTI

SEQ ID NO: 3365309 - protein, 17 aa, Plasmodium falciparum
LKREFNINVNLKNPKIN

SEQ ID NO: 3365310 - protein, 17 aa, Plasmodium falciparum
LKREKCYEKDKNVDDEE

SEQ ID NO: 3365311 - protein, 18 aa, Plasmodium falciparum
LKRGFKNGNICGSNSVGK

SEQ ID NO: 3365312 - protein, 20 aa, Plasmodium falciparum
LKRISSTHFDEYKSVETLML

SEQ ID NO: 3365313 - protein, 19 aa, Plasmodium falciparum
LKRKDGFLFDEKKKRFIKI

SEQ ID NO: 3365314 - protein, 21 aa, Plasmodium falciparum
LKRKEFDLIHIKENFEKKKNI

SEQ ID NO: 3365315 - protein, 22 aa, Plasmodium falciparum
LKRKKKKVVFFSFLKKGKSIYH

SEQ ID NO: 3365316 - protein, 24 aa, Plasmodium falciparum
LKRKRELLENINLIDIGEKISNTG

SEQ ID NO: 3365317 - protein, 18 aa, Plasmodium falciparum
LKRLKSECFFIEENKDFV

SEQ ID NO: 3365318 - protein, 24 aa, Plasmodium falciparum
LKRMLRCVQIAGLCHDLGHGPFSH

SEQ ID NO: 3365319 - protein, 23 aa, Plasmodium falciparum
LKRNKAIYLFLYFFVNIKKETEH

SEQ ID NO: 3365320 - protein, 21 aa, Plasmodium falciparum
LKRQLIVPQFSDIILHDLKVK

SEQ ID NO: 3365321 - protein, 25 aa, Plasmodium falciparum
LKRSDEIIVNILLIFIKKYYYKQWM

SEQ ID NO: 3365322 - protein, 21 aa, Plasmodium falciparum
LKRVKVSTVDSFQGIEKEIIL

SEQ ID NO: 3365323 - protein, 18 aa, Plasmodium falciparum
LKRWNKYEWIKVKKAYGI

SEQ ID NO: 3365324 - protein, 23 aa, Plasmodium falciparum
LKSEKSYEELLFISMNECNKKIY

SEQ ID NO: 3365325 - protein, 17 aa, Plasmodium falciparum
LKSESYYGKEYLNSYSK

SEQ ID NO: 3365326 - protein, 27 aa, Plasmodium falciparum
LKSFPWPNAKCPMFFYNSTGLEEMSAS

SEQ ID NO: 3365327 - protein, 19 aa, Plasmodium falciparum
LKSGNIFNVECINKYEKTC

SEQ ID NO: 3365328 - protein, 18 aa, Plasmodium falciparum
LKSIFKYNNNNNINEKDD

SEQ ID NO: 3365329 - protein, 21 aa, Plasmodium falciparum
LKSIIFTDVSFELSFNAKNVR

SEQ ID NO: 3365330 - protein, 21 aa, Plasmodium falciparum
LKSIKKYSCTNTKNYINEYNC

SEQ ID NO: 3365331 - protein, 18 aa, Plasmodium falciparum
LKSINRFNTVSLGLKGNH

SEQ ID NO: 3365332 - protein, 17 aa, Plasmodium falciparum
LKSIQISFSKKEYNIEA

SEQ ID NO: 3365333 - protein, 25 aa, Plasmodium falciparum
LKSIRCLLDKIMLRRLKEQAITLPK

SEQ ID NO: 3365334 - protein, 19 aa, Plasmodium falciparum
LKSKEKFFKNSIEDKSHEL

SEQ ID NO: 3365335 - protein, 17 aa, Plasmodium falciparum
LKSKELDIQEYVKNKKL

SEQ ID NO: 3365336 - protein, 26 aa, Plasmodium falciparum
LKSLKTSLCTLEYLDISCCQDLSNNT

SEQ ID NO: 3365337 - protein, 17 aa, Plasmodium falciparum
LKSPYFKNSKYCNYEYC

SEQ ID NO: 3365338 - protein, 20 aa, Plasmodium falciparum
LKSSGWYLVDINQILNENLP

SEQ ID NO: 3365339 - protein, 18 aa, Plasmodium falciparum
LKSSTLIIQKNYRTYILR

SEQ ID NO: 3365340 - protein, 18 aa, Plasmodium falciparum
LKSTFSLDIISVKVNPQS

SEQ ID NO: 3365341 - protein, 18 aa, Plasmodium falciparum
LKSYKRVNLKKILKDGDK

SEQ ID NO: 3365342 - protein, 26 aa, Plasmodium falciparum
LKTAFLEEGIFNFHLDKDMYVDILDA

SEQ ID NO: 3365343 - protein, 18 aa, Plasmodium falciparum
LKTAKGCKDFTGEDMQLR

SEQ ID NO: 3365344 - protein, 30 aa, Plasmodium falciparum
LKTCVHNSCGNNICMLIPLIYEFHTYMDCE

SEQ ID NO: 3365345 - protein, 25 aa, Plasmodium falciparum
LKTFCMSHSILGYVDFFNCMNNNIF

SEQ ID NO: 3365346 - protein, 27 aa, Plasmodium falciparum
LKTILLYSLKTAYGFLHIKVKVEENKI

SEQ ID NO: 3365347 - protein, 32 aa, Plasmodium falciparum
LKTINEKNCKLYVKGCTHFLNLNKFNDALSCL

SEQ ID NO: 3365348 - protein, 20 aa, Plasmodium falciparum
LKTKISYDMMKCMKGDETDN

SEQ ID NO: 3365349 - protein, 21 aa, Plasmodium falciparum
LKTNASVFIQNMFNNISNFLY

SEQ ID NO: 3365350 - protein, 20 aa, Plasmodium falciparum
LKTNCGNSIKYNNEYLDNYY

SEQ ID NO: 3365351 - protein, 21 aa, Plasmodium falciparum
LKTNYPLAIQTIFRYIFDKTF

SEQ ID NO: 3365352 - protein, 19 aa, Plasmodium falciparum
LKTSEIWKNSVGYDPYASY

SEQ ID NO: 3365353 - protein, 17 aa, Plasmodium falciparum
LKTVCLSKKEKELKDEF

SEQ ID NO: 3365354 - protein, 29 aa, Plasmodium falciparum
LKTYKSLPIILGNILPYWTKDKNIKKIKK

SEQ ID NO: 3365355 - protein, 17 aa, Plasmodium falciparum
LKVKSLRINDGNLKREH

SEQ ID NO: 3365356 - protein, 18 aa, Plasmodium falciparum
LKVLLWEKIWDYYRGLII

SEQ ID NO: 3365357 - protein, 23 aa, Plasmodium falciparum
LKVLSGLCTKLGFHNQFIITDNI

SEQ ID NO: 3365358 - protein, 18 aa, Plasmodium falciparum
LKVNKNVGPYAIYAHVLF

SEQ ID NO: 3365359 - protein, 17 aa, Plasmodium falciparum
LKVRVLTSFFYIPDKLR

SEQ ID NO: 3365360 - protein, 17 aa, Plasmodium falciparum
LKVSKFPNHGCTIISLI

SEQ ID NO: 3365361 - protein, 19 aa, Plasmodium falciparum
LKVTNKIIFHDKIDKLTVI

SEQ ID NO: 3365362 - protein, 19 aa, Plasmodium falciparum
LKYCKKCCNNDISKCVIKT

SEQ ID NO: 3365363 - protein, 25 aa, Plasmodium falciparum
LKYGPKAPSSWKCVTPTTNNDDKGS

SEQ ID NO: 3365364 - protein, 20 aa, Plasmodium falciparum
LKYIICDIFGSCCSDIVEII

SEQ ID NO: 3365365 - protein, 20 aa, Plasmodium falciparum
LKYIIHIFISDILKEKPNDV

SEQ ID NO: 3365366 - protein, 27 aa, Plasmodium falciparum
LKYINFCGISRKCSKKGTMYNYNKTLC

SEQ ID NO: 3365367 - protein, 22 aa, Plasmodium falciparum
LKYIPTFFYKFQLDNKIKQIAM

SEQ ID NO: 3365368 - protein, 19 aa, Plasmodium falciparum
LKYIYMWKNMNLNAHMFII

SEQ ID NO: 3365369 - protein, 24 aa, Plasmodium falciparum
LKYKEKYKYITLFNSIVVNKIEGS

SEQ ID NO: 3365370 - protein, 23 aa, Plasmodium falciparum
LKYKGYECIYAPYLAISQLAYFL

SEQ ID NO: 3365371 - protein, 19 aa, Plasmodium falciparum
LKYKSPRQIKNIHHNNNES

SEQ ID NO: 3365372 - protein, 27 aa, Plasmodium falciparum
LKYLCSRLYSIPLPKMRLFYTDENNPL

SEQ ID NO: 3365373 - protein, 20 aa, Plasmodium falciparum
LKYLSFNKSAGEAMYNINKQ

SEQ ID NO: 3365374 - protein, 17 aa, Plasmodium falciparum
LKYLSQYNMNVFDFFDF

SEQ ID NO: 3365375 - protein, 28 aa, Plasmodium falciparum
LKYMQEKFLESILCISYPNDLWTESTFE

SEQ ID NO: 3365376 - protein, 22 aa, Plasmodium falciparum
LKYNEIQNIFIFLEMTTDYKPN

SEQ ID NO: 3365377 - protein, 17 aa, Plasmodium falciparum
LKYQILLELSRHDYRLH

SEQ ID NO: 3365378 - protein, 19 aa, Plasmodium falciparum
LKYRGLFHILQHMKKNEIS

SEQ ID NO: 3365379 - protein, 18 aa, Plasmodium falciparum
LKYTNDMLLYKLLNNKKN

SEQ ID NO: 3365380 - protein, 23 aa, Plasmodium falciparum
LKYYSAKDKLHFNKKYENMMRHL

SEQ ID NO: 3365381 - protein, 21 aa, Plasmodium falciparum
LLACLINPQILSVVIVDNLNI

SEQ ID NO: 3365382 - protein, 17 aa, Plasmodium falciparum
LLAIKFLHSKKMALRDI

SEQ ID NO: 3365383 - protein, 19 aa, Plasmodium falciparum
LLAKLCSFFNNTFNIKKME

SEQ ID NO: 3365384 - protein, 24 aa, Plasmodium falciparum
LLALGCCMDIHKLLNKFPTPIENK

SEQ ID NO: 3365385 - protein, 24 aa, Plasmodium falciparum
LLASKCSLAARIDYFKKYKEGQYG

SEQ ID NO: 3365386 - protein, 18 aa, Plasmodium falciparum
LLAYFAYHRLGIISMTAS

SEQ ID NO: 3365387 - protein, 18 aa, Plasmodium falciparum
LLCDLMYQCCLILTQHDI

SEQ ID NO: 3365388 - protein, 19 aa, Plasmodium falciparum
LLCNEYKLNHILNKSNNKV

SEQ ID NO: 3365389 - protein, 17 aa, Plasmodium falciparum
LLCNLKDDFVIGSMENK

SEQ ID NO: 3365390 - protein, 18 aa, Plasmodium falciparum
LLCPPKMKGNSENLSTNN

SEQ ID NO: 3365391 - protein, 17 aa, Plasmodium falciparum
LLCSIIYSLIKGNCLLQ

SEQ ID NO: 3365392 - protein, 17 aa, Plasmodium falciparum
LLCSYFSDASLYIELPI

SEQ ID NO: 3365393 - protein, 23 aa, Plasmodium falciparum
LLDALAVKIYCEYESKDQAQNAL

SEQ ID NO: 3365394 - protein, 18 aa, Plasmodium falciparum
LLDDCIKDDIINNDEIKM

SEQ ID NO: 3365395 - protein, 17 aa, Plasmodium falciparum
LLDDYWKKMKIHYPIYF

SEQ ID NO: 3365396 - protein, 47 aa, Plasmodium falciparum
LLDEILRVQNACRKGKKKEIKLILLNAENKMTLCFDEKDKINYMNDI

SEQ ID NO: 3365397 - protein, 18 aa, Plasmodium falciparum
LLDEKSKMPLLCNYTNVS

SEQ ID NO: 3365398 - protein, 25 aa, Plasmodium falciparum
LLDGREAVQFLCAIRDYIENPNLML

SEQ ID NO: 3365399 - protein, 19 aa, Plasmodium falciparum
LLDKHFKFITSVKNISQLR

SEQ ID NO: 3365400 - protein, 18 aa, Plasmodium falciparum
LLDPNPWTRIQNAREALI

SEQ ID NO: 3365401 - protein, 19 aa, Plasmodium falciparum
LLDTLWYYQMLGLLYLYQD

SEQ ID NO: 3365402 - protein, 17 aa, Plasmodium falciparum
LLDVEACRCRYLEIKTD

SEQ ID NO: 3365403 - protein, 17 aa, Plasmodium falciparum
LLEEIHKKYIIYQLLRA

SEQ ID NO: 3365404 - protein, 19 aa, Plasmodium falciparum
LLEEPNICLNLFYIDVHNY

SEQ ID NO: 3365405 - protein, 23 aa, Plasmodium falciparum
LLEGCVNDTVDMCDHLMQRFGFN

SEQ ID NO: 3365406 - protein, 17 aa, Plasmodium falciparum
LLEKGCKKKLCNNIVYN

SEQ ID NO: 3365407 - protein, 23 aa, Plasmodium falciparum
LLEKIKNRKECHTLVASKKTPLT

SEQ ID NO: 3365408 - protein, 19 aa, Plasmodium falciparum
LLENDMCDLYNLKMHDLHN

SEQ ID NO: 3365409 - protein, 25 aa, Plasmodium falciparum
LLEQFKFLQKMVVKMGKLGLRENNI

SEQ ID NO: 3365410 - protein, 25 aa, Plasmodium falciparum
LLEQFKQGRVLACISSRPGQCGKAD

SEQ ID NO: 3365411 - protein, 17 aa, Plasmodium falciparum
LLERNGTVYEGYVLRVN

SEQ ID NO: 3365412 - protein, 23 aa, Plasmodium falciparum
LLEVIKCLKGLCEKIMKGDLTFT

SEQ ID NO: 3365413 - protein, 33 aa, Plasmodium falciparum
LLEYYFKKNEIMLLKNILKYIIQLMSEIKHQYS

SEQ ID NO: 3365414 - protein, 29 aa, Plasmodium falciparum
LLFDNICCHYCNLIYIPFYNCKITHSPNQ

SEQ ID NO: 3365415 - protein, 18 aa, Plasmodium falciparum
LLFEHSVSSNICENENCI

SEQ ID NO: 3365416 - protein, 17 aa, Plasmodium falciparum
LLFFPYTIKGMDISFSG

SEQ ID NO: 3365417 - protein, 27 aa, Plasmodium falciparum
LLFGGLCGPNILAKDCYMYDFMEDMWS

SEQ ID NO: 3365418 - protein, 19 aa, Plasmodium falciparum
LLFHACTKLNIKNDQLFSY

SEQ ID NO: 3365419 - protein, 24 aa, Plasmodium falciparum
LLFLSKPSSYTWMKLHELSTQITN

SEQ ID NO: 3365420 - protein, 17 aa, Plasmodium falciparum
LLFMSYLNVNTQNKNYS

SEQ ID NO: 3365421 - protein, 27 aa, Plasmodium falciparum
LLFSCYDCSVEIYKWFHQSYKSAIEIP

SEQ ID NO: 3365422 - protein, 25 aa, Plasmodium falciparum
LLFTIYCFCKFFKKYHYFDIKENKL

SEQ ID NO: 3365423 - protein, 19 aa, Plasmodium falciparum
LLGDIYKYRNVIVETCNYI

SEQ ID NO: 3365424 - protein, 20 aa, Plasmodium falciparum
LLGGILYIGIILRRSQKLSS

SEQ ID NO: 3365425 - protein, 18 aa, Plasmodium falciparum
LLGNEKVYETKKNSNYNV

SEQ ID NO: 3365426 - protein, 18 aa, Plasmodium falciparum
LLHALAYCHNLKDGPNGE

SEQ ID NO: 3365427 - protein, 17 aa, Plasmodium falciparum
LLHELNILRNDMSKLDK

SEQ ID NO: 3365428 - protein, 19 aa, Plasmodium falciparum
LLHEYYDPFHFKFKELSRI

SEQ ID NO: 3365429 - protein, 25 aa, Plasmodium falciparum
LLHIPRPSSAIYYDINFFQNKVKKN

SEQ ID NO: 3365430 - protein, 18 aa, Plasmodium falciparum
LLHKRFVKYRNKKLKKIM

SEQ ID NO: 3365431 - protein, 18 aa, Plasmodium falciparum
LLHKYYYTVEDIKKISKY

SEQ ID NO: 3365432 - protein, 18 aa, Plasmodium falciparum
LLHLIDFILNKLFENNLN

SEQ ID NO: 3365433 - protein, 19 aa, Plasmodium falciparum
LLHLIPFFLNLRKLKDIRS

SEQ ID NO: 3365434 - protein, 24 aa, Plasmodium falciparum
LLHNENFILWAWKRRALKYDKEQF

SEQ ID NO: 3365435 - protein, 21 aa, Plasmodium falciparum
LLHSRIKCVIFDKENKNNGAL

SEQ ID NO: 3365436 - protein, 19 aa, Plasmodium falciparum
LLICTDLPLYYSHIKNIFI

SEQ ID NO: 3365437 - protein, 21 aa, Plasmodium falciparum
LLIHFKHNLYNSVLLSIIKTL

SEQ ID NO: 3365438 - protein, 17 aa, Plasmodium falciparum
LLIKAGISVIKTDHCGS

SEQ ID NO: 3365439 - protein, 25 aa, Plasmodium falciparum
LLIKGDCIFHGYFVHKDITDNSFTE

SEQ ID NO: 3365440 - protein, 17 aa, Plasmodium falciparum
LLIKKKEIEIINSPIGI

SEQ ID NO: 3365441 - protein, 22 aa, Plasmodium falciparum
LLIRDLHWIIGPKLYEANWVEL

SEQ ID NO: 3365442 - protein, 25 aa, Plasmodium falciparum
LLIRRKRKYHNLSFDDKYSLQYLKN

SEQ ID NO: 3365443 - protein, 19 aa, Plasmodium falciparum
LLISLKILLYDNIISNKDI

SEQ ID NO: 3365444 - protein, 17 aa, Plasmodium falciparum
LLKAMWSKMCERRMYVL

SEQ ID NO: 3365445 - protein, 18 aa, Plasmodium falciparum
LLKCKKYLNDLLKRKEFD

SEQ ID NO: 3365446 - protein, 20 aa, Plasmodium falciparum
LLKCRKKKLEVILWVKIYMS

SEQ ID NO: 3365447 - protein, 20 aa, Plasmodium falciparum
LLKDCIGKDLSRIGMPIYLN

SEQ ID NO: 3365448 - protein, 26 aa, Plasmodium falciparum
LLKEMISAGFEALVEKQYKFFMKLPY

SEQ ID NO: 3365449 - protein, 26 aa, Plasmodium falciparum
LLKFDYCPLCRNFIKDKKLENVENST

SEQ ID NO: 3365450 - protein, 20 aa, Plasmodium falciparum
LLKFKDCLQELDVNDVADLF

SEQ ID NO: 3365451 - protein, 17 aa, Plasmodium falciparum
LLKGNLNTANFILDDDT

SEQ ID NO: 3365452 - protein, 23 aa, Plasmodium falciparum
LLKGSELFYNITCFDKLINIICD

SEQ ID NO: 3365453 - protein, 18 aa, Plasmodium falciparum
LLKGYKYINTKGNIQISN

SEQ ID NO: 3365454 - protein, 20 aa, Plasmodium falciparum
LLKICPDLNITAKVMDIPMP

SEQ ID NO: 3365455 - protein, 19 aa, Plasmodium falciparum
LLKIGDLGLCRELKNDGDM

SEQ ID NO: 3365456 - protein, 19 aa, Plasmodium falciparum
LLKIIPLYFFNENKFSLYV

SEQ ID NO: 3365457 - protein, 20 aa, Plasmodium falciparum
LLKIKSDHLFTQYYNNKNIT

SEQ ID NO: 3365458 - protein, 20 aa, Plasmodium falciparum
LLKKCFRINNEKSYSLKDNI

SEQ ID NO: 3365459 - protein, 21 aa, Plasmodium falciparum
LLKKCPIIFDGFVNYIMYLFK

SEQ ID NO: 3365460 - protein, 20 aa, Plasmodium falciparum
LLKKKGKGLTQVLSDVDNDK

SEQ ID NO: 3365461 - protein, 34 aa, Plasmodium falciparum
LLKKKKRYFLGLKECYKHICIDEPKIVFIAPNIE

SEQ ID NO: 3365462 - protein, 21 aa, Plasmodium falciparum
LLKKKMEWIQLPPFKITTNQK

SEQ ID NO: 3365463 - protein, 23 aa, Plasmodium falciparum
LLKKKSDALFIHFRDVLKDIVKT

SEQ ID NO: 3365464 - protein, 21 aa, Plasmodium falciparum
LLKKLLKKKIHFDDEEYKIIH

SEQ ID NO: 3365465 - protein, 18 aa, Plasmodium falciparum
LLKKMPWQLMVVDEAHQL

SEQ ID NO: 3365466 - protein, 24 aa, Plasmodium falciparum
LLKKRKCTQVDINEKVIALLLSSK

SEQ ID NO: 3365467 - protein, 19 aa, Plasmodium falciparum
LLKKRKIINDILLNIKKKM

SEQ ID NO: 3365468 - protein, 21 aa, Plasmodium falciparum
LLKKRRKGKTYKNSNIQTDIT

SEQ ID NO: 3365469 - protein, 26 aa, Plasmodium falciparum
LLKNSKFKYFLNYENIHKMFDTLPKY

SEQ ID NO: 3365470 - protein, 20 aa, Plasmodium falciparum
LLKNYICKLEGIFEILFFNT

SEQ ID NO: 3365471 - protein, 18 aa, Plasmodium falciparum
LLKPERNFISGIDNTMYS

SEQ ID NO: 3365472 - protein, 21 aa, Plasmodium falciparum
LLKQRLESHYYALSFKENYEN

SEQ ID NO: 3365473 - protein, 26 aa, Plasmodium falciparum
LLKRFLEHIRLLKIHIFVTYNGDFFD

SEQ ID NO: 3365474 - protein, 17 aa, Plasmodium falciparum
LLKRYLDERSKKKSILQ

SEQ ID NO: 3365475 - protein, 24 aa, Plasmodium falciparum
LLKSFLKYKYFHISLLKLLMYICN

SEQ ID NO: 3365476 - protein, 24 aa, Plasmodium falciparum
LLKSGKYMPSIFVFENIFDLLSKN

SEQ ID NO: 3365477 - protein, 17 aa, Plasmodium falciparum
LLKSLHVQNLFEFDFID

SEQ ID NO: 3365478 - protein, 26 aa, Plasmodium falciparum
LLKSNHKKIKYCVAIKHEGEIKDISW

SEQ ID NO: 3365479 - protein, 17 aa, Plasmodium falciparum
LLKVLKADADFLKENML

SEQ ID NO: 3365480 - protein, 18 aa, Plasmodium falciparum
LLKWSTKYADGTIDTNKR

SEQ ID NO: 3365481 - protein, 17 aa, Plasmodium falciparum
LLLCIKRALKWSKCEGT

SEQ ID NO: 3365482 - protein, 25 aa, Plasmodium falciparum
LLLEDIKRQCIRYHNKNKKKFIKKY

SEQ ID NO: 3365483 - protein, 18 aa, Plasmodium falciparum
LLLFEPLKKKKHFTLTND

SEQ ID NO: 3365484 - protein, 17 aa, Plasmodium falciparum
LLLGKPLFLGECASDQL

SEQ ID NO: 3365485 - protein, 20 aa, Plasmodium falciparum
LLLHSIEGLLLISNYEEKKK

SEQ ID NO: 3365486 - protein, 19 aa, Plasmodium falciparum
LLLIDPFFKIICMTDQKYV

SEQ ID NO: 3365487 - protein, 21 aa, Plasmodium falciparum
LLLKNELENLVPYFNGRIFLE

SEQ ID NO: 3365488 - protein, 26 aa, Plasmodium falciparum
LLLLEYPRLRFDGVYISCVTYIRSLK

SEQ ID NO: 3365489 - protein, 19 aa, Plasmodium falciparum
LLLLTCSKFQYFIENNSND

SEQ ID NO: 3365490 - protein, 18 aa, Plasmodium falciparum
LLLNFLLKLHYLKYQEQF

SEQ ID NO: 3365491 - protein, 19 aa, Plasmodium falciparum
LLLQFTDKRFRADHDLTIG

SEQ ID NO: 3365492 - protein, 17 aa, Plasmodium falciparum
LLMRTLRDMNLSKLIHD

SEQ ID NO: 3365493 - protein, 17 aa, Plasmodium falciparum
LLNAINECVEWGQVFIL

SEQ ID NO: 3365494 - protein, 21 aa, Plasmodium falciparum
LLNALYCCKIISYTQGLFLLK

SEQ ID NO: 3365495 - protein, 25 aa, Plasmodium falciparum
LLNATCHMCNITPLIKQKNKEDRYC

SEQ ID NO: 3365496 - protein, 36 aa, Plasmodium falciparum
LLNCVKKYCINILGLWVIKSKYLYKFLRGKQDKKEN

SEQ ID NO: 3365497 - protein, 22 aa, Plasmodium falciparum
LLNDICKTILFILDDTKNYLVQ

SEQ ID NO: 3365498 - protein, 25 aa, Plasmodium falciparum
LLNDIKRIVDSGANDSILNDNSNLS

SEQ ID NO: 3365499 - protein, 36 aa, Plasmodium falciparum
LLNDKWGSFKLFEKWIKDSSKWQWIDLKLQKEYINS

SEQ ID NO: 3365500 - protein, 23 aa, Plasmodium falciparum
LLNEFPNYFYFSVSCTTRKKREK

SEQ ID NO: 3365501 - protein, 26 aa, Plasmodium falciparum
LLNFKKRKNSFLLMKNEILYKSKINE

SEQ ID NO: 3365502 - protein, 17 aa, Plasmodium falciparum
LLNGIAYCHDRRVLHRD

SEQ ID NO: 3365503 - protein, 21 aa, Plasmodium falciparum
LLNHLYICFNENYSKNVEEIK

SEQ ID NO: 3365504 - protein, 41 aa, Plasmodium falciparum
LLNICFKTRFIFPFDSFCNIKRIKLIPCFVFFIHGTDDKIV

SEQ ID NO: 3365505 - protein, 21 aa, Plasmodium falciparum
LLNKDMNCINYTYKNLNEQKQ

SEQ ID NO: 3365506 - protein, 17 aa, Plasmodium falciparum
LLNKFPSNFTFEIKNNI

SEQ ID NO: 3365507 - protein, 26 aa, Plasmodium falciparum
LLNKLKPYFWFASHLHVKYSALYIHN

SEQ ID NO: 3365508 - protein, 19 aa, Plasmodium falciparum
LLNKMKLFLLHNQKHNHYH

SEQ ID NO: 3365509 - protein, 23 aa, Plasmodium falciparum
LLNLENNLNCPSRYFHNYHSSEI

SEQ ID NO: 3365510 - protein, 29 aa, Plasmodium falciparum
LLNLKERKSFRIPKFFHFIDNITNTESFL

SEQ ID NO: 3365511 - protein, 32 aa, Plasmodium falciparum
LLNLKIWLEQQCSYSFCSTSLLIIYDKNKPSS

SEQ ID NO: 3365512 - protein, 26 aa, Plasmodium falciparum
LLNLKKRNVLEEFPFNFVKQKDDSAK

SEQ ID NO: 3365513 - protein, 18 aa, Plasmodium falciparum
LLNMRYTNNYVFNSKNIQ

SEQ ID NO: 3365514 - protein, 24 aa, Plasmodium falciparum
LLNNKIKDCHRLYKDNNIHHMEHC

SEQ ID NO: 3365515 - protein, 17 aa, Plasmodium falciparum
LLNNLTLYFNKNKYEEE

SEQ ID NO: 3365516 - protein, 20 aa, Plasmodium falciparum
LLNQHFNFNKNDNIRDINSK

SEQ ID NO: 3365517 - protein, 23 aa, Plasmodium falciparum
LLNRCKCLQSFYPRVDSEEGLVK

SEQ ID NO: 3365518 - protein, 31 aa, Plasmodium falciparum
LLNSCKVSLSFIKYLIFDEADEMISLGLKKQ

SEQ ID NO: 3365519 - protein, 21 aa, Plasmodium falciparum
LLNSKILKFGKYLNYNNIITK

SEQ ID NO: 3365520 - protein, 23 aa, Plasmodium falciparum
LLNTKRTLYWVYIDDDNKEQGPF

SEQ ID NO: 3365521 - protein, 29 aa, Plasmodium falciparum
LLNVLKKKLTYIFWQLLGDIYKYRNVIVE

SEQ ID NO: 3365522 - protein, 23 aa, Plasmodium falciparum
LLNYSTIFSCISNFYTMKQKLID

SEQ ID NO: 3365523 - protein, 21 aa, Plasmodium falciparum
LLPDGGINKLRVYGEIKNNEK

SEQ ID NO: 3365524 - protein, 20 aa, Plasmodium falciparum
LLPIRCMNDQIILNVQDEVI

SEQ ID NO: 3365525 - protein, 23 aa, Plasmodium falciparum
LLPNVYRLIDLIKFKNDKYKICF

SEQ ID NO: 3365526 - protein, 31 aa, Plasmodium falciparum
LLPSDYFIKSVPIFFFRTYIGAATKAHAYNL

SEQ ID NO: 3365527 - protein, 26 aa, Plasmodium falciparum
LLQATSFAKFNMELPLENFVDDNGEA

SEQ ID NO: 3365528 - protein, 23 aa, Plasmodium falciparum
LLQEDRYVFGLQLCYVKSIINPN

SEQ ID NO: 3365529 - protein, 24 aa, Plasmodium falciparum
LLQMVHVWKKLLINDMQETKELLN

SEQ ID NO: 3365530 - protein, 23 aa, Plasmodium falciparum
LLQNICITFGRLTSTYPKKLIFY

SEQ ID NO: 3365531 - protein, 19 aa, Plasmodium falciparum
LLQNIKGGQLFDSVDNNMY

SEQ ID NO: 3365532 - protein, 27 aa, Plasmodium falciparum
LLQQSCLDCLFCFLNDFKNNVHEKMLV

SEQ ID NO: 3365533 - protein, 19 aa, Plasmodium falciparum
LLRENRWNDNILKEYVDGK

SEQ ID NO: 3365534 - protein, 17 aa, Plasmodium falciparum
LLRKEQNIHNNILNNEQ

SEQ ID NO: 3365535 - protein, 17 aa, Plasmodium falciparum
LLRKGRLSIAVTHDGRS

SEQ ID NO: 3365536 - protein, 19 aa, Plasmodium falciparum
LLRPGRLDRKIEFPLPDRK

SEQ ID NO: 3365537 - protein, 25 aa, Plasmodium falciparum
LLRVVSRYFMKLTLSNYGSHVIQSL

SEQ ID NO: 3365538 - protein, 25 aa, Plasmodium falciparum
LLRYKHLLKALKYVKPSGMKELYID

SEQ ID NO: 3365539 - protein, 17 aa, Plasmodium falciparum
LLSCDLIEVEKLKKKTI

SEQ ID NO: 3365540 - protein, 24 aa, Plasmodium falciparum
LLSDIIHNLGLKYKQLQTYNLSLR

SEQ ID NO: 3365541 - protein, 20 aa, Plasmodium falciparum
LLSHYILRIAFSKDKEKQQW

SEQ ID NO: 3365542 - protein, 23 aa, Plasmodium falciparum
LLSKKLLCVLAMGEWIDYSHPII

SEQ ID NO: 3365543 - protein, 25 aa, Plasmodium falciparum
LLSLKNLRNSSIFNLSLTDENLKRS

SEQ ID NO: 3365544 - protein, 18 aa, Plasmodium falciparum
LLSLLSFICNNISPYVGA

SEQ ID NO: 3365545 - protein, 25 aa, Plasmodium falciparum
LLSMYKKKMAIYFRSFVYNNIKVSK

SEQ ID NO: 3365546 - protein, 29 aa, Plasmodium falciparum
LLSNELSKFLPINFILKMPSTNNEHKKAL

SEQ ID NO: 3365547 - protein, 24 aa, Plasmodium falciparum
LLSSEKKGGYGINNMMINSEGMDF

SEQ ID NO: 3365548 - protein, 18 aa, Plasmodium falciparum
LLSSIHWGNNISYVSTNS

SEQ ID NO: 3365549 - protein, 25 aa, Plasmodium falciparum
LLSSKSGGCGINLISSNRLILLDPD

SEQ ID NO: 3365550 - protein, 18 aa, Plasmodium falciparum
LLSSLSYISSITDKVVES

SEQ ID NO: 3365551 - protein, 18 aa, Plasmodium falciparum
LLSSWKTDVIRRIKPTPI

SEQ ID NO: 3365552 - protein, 22 aa, Plasmodium falciparum
LLSTKAGGLGINLTSADTVIIY

SEQ ID NO: 3365553 - protein, 25 aa, Plasmodium falciparum
LLSTKAGGVGLNLIAANHVILMDQD

SEQ ID NO: 3365554 - protein, 17 aa, Plasmodium falciparum
LLSYIFKEEYNNIVNTK

SEQ ID NO: 3365555 - protein, 20 aa, Plasmodium falciparum
LLTDICFKGIEKVEEEYDED

SEQ ID NO: 3365556 - protein, 32 aa, Plasmodium falciparum
LLTDLKLGHNLNLKSAYAISKLLSQKLNPEEY

SEQ ID NO: 3365557 - protein, 23 aa, Plasmodium falciparum
LLTECNFPSIAIHGGLEQQERIE

SEQ ID NO: 3365558 - protein, 17 aa, Plasmodium falciparum
LLTEITFGDKKNLFNPK

SEQ ID NO: 3365559 - protein, 32 aa, Plasmodium falciparum
LLTFEELKELFLFFFPEQVMSIDENIIKENII

SEQ ID NO: 3365560 - protein, 28 aa, Plasmodium falciparum
LLTLQKCLSLIKANRNIIEVMFYILENN

SEQ ID NO: 3365561 - protein, 31 aa, Plasmodium falciparum
LLTQRYDYVYIFKKQFEYVLLKKSNSEQIEN

SEQ ID NO: 3365562 - protein, 26 aa, Plasmodium falciparum
LLTRDFRINDNWSLIYAYEKAKKKKA

SEQ ID NO: 3365563 - protein, 27 aa, Plasmodium falciparum
LLTRNNLKIKWILLNLNLKNDDEALIK

SEQ ID NO: 3365564 - protein, 19 aa, Plasmodium falciparum
LLTTYSCKNEDFTFIKTKT

SEQ ID NO: 3365565 - protein, 23 aa, Plasmodium falciparum
LLTYSTKEIIIWNDNNDRNDFTQ

SEQ ID NO: 3365566 - protein, 18 aa, Plasmodium falciparum
LLVGAGGIGSEFLKNIIT

SEQ ID NO: 3365567 - protein, 17 aa, Plasmodium falciparum
LLVYGYEIFPIIVEYLN

SEQ ID NO: 3365568 - protein, 17 aa, Plasmodium falciparum
LLYIYNLFYNYDRDVIN

SEQ ID NO: 3365569 - protein, 21 aa, Plasmodium falciparum
LLYKIIYQLFNIMVHMDFEVG

SEQ ID NO: 3365570 - protein, 17 aa, Plasmodium falciparum
LLYKKPFYVTCQAYKFL

SEQ ID NO: 3365571 - protein, 19 aa, Plasmodium falciparum
LLYKMKWKNIYDEKNINDE

SEQ ID NO: 3365572 - protein, 17 aa, Plasmodium falciparum
LLYNLLKINNFHFENIH

SEQ ID NO: 3365573 - protein, 21 aa, Plasmodium falciparum
LLYPGADFCYSYINTLNNLEE

SEQ ID NO: 3365574 - protein, 24 aa, Plasmodium falciparum
LMAKNAKNRYSLFNNNTNNKLSLY

SEQ ID NO: 3365575 - protein, 19 aa, Plasmodium falciparum
LMCSSCCLFKDNPYNSNPE

SEQ ID NO: 3365576 - protein, 19 aa, Plasmodium falciparum
LMDTILFNIHSCSELNQAK

SEQ ID NO: 3365577 - protein, 33 aa, Plasmodium falciparum
LMEGKLLYGGGCTEIRVGQYLIKEAAKFNDSRK

SEQ ID NO: 3365578 - protein, 23 aa, Plasmodium falciparum
LMEIFQRLNLFFIKNPNYIEYAL

SEQ ID NO: 3365579 - protein, 19 aa, Plasmodium falciparum
LMEILDFFNSFNIDNQLQK

SEQ ID NO: 3365580 - protein, 17 aa, Plasmodium falciparum
LMELIDTSFKFCYFFQC

SEQ ID NO: 3365581 - protein, 17 aa, Plasmodium falciparum
LMEQCLSTLKLRGIENI

SEQ ID NO: 3365582 - protein, 19 aa, Plasmodium falciparum
LMGDVPFGILLSGGLDSSI

SEQ ID NO: 3365583 - protein, 18 aa, Plasmodium falciparum
LMIFAFCINSEINLKIHF

SEQ ID NO: 3365584 - protein, 18 aa, Plasmodium falciparum
LMIKEKYFLCHKEEKIVI

SEQ ID NO: 3365585 - protein, 19 aa, Plasmodium falciparum
LMKEFLFKVYNFKNEKDVD

SEQ ID NO: 3365586 - protein, 17 aa, Plasmodium falciparum
LMLNKSMTLYLNYFNNR

SEQ ID NO: 3365587 - protein, 17 aa, Plasmodium falciparum
LMLYMIMACSNKGNIKR

SEQ ID NO: 3365588 - protein, 17 aa, Plasmodium falciparum
LMMEYKGKFSHKMIKGG

SEQ ID NO: 3365589 - protein, 18 aa, Plasmodium falciparum
LMNETCCLFENIKSDITT

SEQ ID NO: 3365590 - protein, 26 aa, Plasmodium falciparum
LMNGVQWSGYCGSALLNTTTNFSSLT

SEQ ID NO: 3365591 - protein, 30 aa, Plasmodium falciparum
LMNILCDYLEFRGYKYHRLDGNIGLQERKK

SEQ ID NO: 3365592 - protein, 24 aa, Plasmodium falciparum
LMNKEKNTNFGFCNNRKGDMISPY

SEQ ID NO: 3365593 - protein, 17 aa, Plasmodium falciparum
LMNLFNVLNNFNENNKI

SEQ ID NO: 3365594 - protein, 33 aa, Plasmodium falciparum
LMNLKLCNMERKILKRFSKYHINQDIYDVVLDF

SEQ ID NO: 3365595 - protein, 20 aa, Plasmodium falciparum
LMWSATWPKEVQALAKDLCK

SEQ ID NO: 3365596 - protein, 18 aa, Plasmodium falciparum
LMYKKTVEDLFYIYKSFG

SEQ ID NO: 3365597 - protein, 17 aa, Plasmodium falciparum
LMYKYIKLCDFNTSIKL

SEQ ID NO: 3365598 - protein, 23 aa, Plasmodium falciparum
LNADGFIQKSEMVAMLSNIPYIH

SEQ ID NO: 3365599 - protein, 31 aa, Plasmodium falciparum
LNARCTVLAAANPLYGCWNDALDMGQQLQFE

SEQ ID NO: 3365600 - protein, 17 aa, Plasmodium falciparum
LNASLKFNSLKDILSKL

SEQ ID NO: 3365601 - protein, 25 aa, Plasmodium falciparum
LNCEWPYNITVDIIFSNVYKSKQEN

SEQ ID NO: 3365602 - protein, 21 aa, Plasmodium falciparum
LNCVSNILKHFNVFKYKLYFH

SEQ ID NO: 3365603 - protein, 25 aa, Plasmodium falciparum
LNDEINLRLGYTGVVNRSTADIKKG

SEQ ID NO: 3365604 - protein, 18 aa, Plasmodium falciparum
LNDFNWKAAYYICKEIYD

SEQ ID NO: 3365605 - protein, 19 aa, Plasmodium falciparum
LNDILCNKLGLINMTTENR

SEQ ID NO: 3365606 - protein, 17 aa, Plasmodium falciparum
LNDIPLFIYSFNLFIKC

SEQ ID NO: 3365607 - protein, 25 aa, Plasmodium falciparum
LNDKRIRALLYIFKYIKNLEKKKEH

SEQ ID NO: 3365608 - protein, 18 aa, Plasmodium falciparum
LNDKRVATDISYKHIQKE

SEQ ID NO: 3365609 - protein, 18 aa, Plasmodium falciparum
LNDMFKNQINYVDNNLLK

SEQ ID NO: 3365610 - protein, 24 aa, Plasmodium falciparum
LNDMYNCNLFFKKIGERNHNEDII

SEQ ID NO: 3365611 - protein, 22 aa, Plasmodium falciparum
LNDNFFKLVSWYDNEWGYSNRV

SEQ ID NO: 3365612 - protein, 34 aa, Plasmodium falciparum
LNDPRRLNVALTRAKYGLIICGNAKVLSRHHFIS

SEQ ID NO: 3365613 - protein, 19 aa, Plasmodium falciparum
LNDSIRFLFYTIHDEIDGI

SEQ ID NO: 3365614 - protein, 18 aa, Plasmodium falciparum
LNDSMYWRGIVGGCLKNG

SEQ ID NO: 3365615 - protein, 18 aa, Plasmodium falciparum
LNDSRCLRIVKGSGTRLQ

SEQ ID NO: 3365616 - protein, 32 aa, Plasmodium falciparum
LNDSYVCFYKSELICGSLGKKVLGSSKYGLFY

SEQ ID NO: 3365617 - protein, 30 aa, Plasmodium falciparum
LNDTYIFNTFFYKKLELYDDVLKAYLNTTG

SEQ ID NO: 3365618 - protein, 17 aa, Plasmodium falciparum
LNDYGFRILEEKLVSMR

SEQ ID NO: 3365619 - protein, 21 aa, Plasmodium falciparum
LNEARKAGKVEALKDEEGNDI

SEQ ID NO: 3365620 - protein, 24 aa, Plasmodium falciparum
LNEARSFLKNILYFYFTDIDIKKK

SEQ ID NO: 3365621 - protein, 18 aa, Plasmodium falciparum
LNECIKNKMYLININMVS

SEQ ID NO: 3365622 - protein, 23 aa, Plasmodium falciparum
LNECISSCIYLMFLNNINNESTD

SEQ ID NO: 3365623 - protein, 19 aa, Plasmodium falciparum
LNEDPRIINALKKSHISTS

SEQ ID NO: 3365624 - protein, 19 aa, Plasmodium falciparum
LNEDYSWVKNLRNYDHTGE

SEQ ID NO: 3365625 - protein, 28 aa, Plasmodium falciparum
LNEEEFRKLCIFKGIYPKDFKEIPLKYR

SEQ ID NO: 3365626 - protein, 22 aa, Plasmodium falciparum
LNEFFFCPFKDLDVEDFDIQIK

SEQ ID NO: 3365627 - protein, 26 aa, Plasmodium falciparum
LNEFIKNNYFYRLYKLNTSREILFNG

SEQ ID NO: 3365628 - protein, 22 aa, Plasmodium falciparum
LNEFKSWLPQANVVCYHGNAVS

SEQ ID NO: 3365629 - protein, 34 aa, Plasmodium falciparum
LNEFYKKKLEHIQVWKTKLEIMKKNKCNEVIHNE

SEQ ID NO: 3365630 - protein, 20 aa, Plasmodium falciparum
LNEINILLNRASEILEKYSL

SEQ ID NO: 3365631 - protein, 23 aa, Plasmodium falciparum
LNEKCIWNSSTLNFKNIRKNYNT

SEQ ID NO: 3365632 - protein, 23 aa, Plasmodium falciparum
LNEKLIRLEAELIMEKKNTDQIE

SEQ ID NO: 3365633 - protein, 23 aa, Plasmodium falciparum
LNEKRGNILGSLISKNHDAKRAT

SEQ ID NO: 3365634 - protein, 27 aa, Plasmodium falciparum
LNELFDLPSPYFFEICYMFLDQKIFSK

SEQ ID NO: 3365635 - protein, 19 aa, Plasmodium falciparum
LNELSILVCHLISTHKEKS

SEQ ID NO: 3365636 - protein, 26 aa, Plasmodium falciparum
LNEMNYCSIMHNCTMYHKKINKKIKT

SEQ ID NO: 3365637 - protein, 19 aa, Plasmodium falciparum
LNEPFWFLIDFEKCNMSSY

SEQ ID NO: 3365638 - protein, 23 aa, Plasmodium falciparum
LNEPNKEKWEIINNERNYIPCQK

SEQ ID NO: 3365639 - protein, 24 aa, Plasmodium falciparum
LNEQKKLFVQIDILKSQVDQKQNI

SEQ ID NO: 3365640 - protein, 24 aa, Plasmodium falciparum
LNEYHPGITPKLYKILYEPDNKYF

SEQ ID NO: 3365641 - protein, 17 aa, Plasmodium falciparum
LNEYVRKSIKRCYLMSL

SEQ ID NO: 3365642 - protein, 37 aa, Plasmodium falciparum
LNFDILKWKELYIECICILRFLFFNCKLVHADFSEYN

SEQ ID NO: 3365643 - protein, 23 aa, Plasmodium falciparum
LNFFKLKDLREVYELFHKIDKTI

SEQ ID NO: 3365644 - protein, 18 aa, Plasmodium falciparum
LNFHINIIIYILNNLKKL

SEQ ID NO: 3365645 - protein, 19 aa, Plasmodium falciparum
LNFISCPDILNGITSYLVK

SEQ ID NO: 3365646 - protein, 26 aa, Plasmodium falciparum
LNFNELFKLMPLCKSSYNIFNHTFCI

SEQ ID NO: 3365647 - protein, 17 aa, Plasmodium falciparum
LNFPDINTENLFFHLYF

SEQ ID NO: 3365648 - protein, 23 aa, Plasmodium falciparum
LNFSCKPNKINIHNKIYTANDKE

SEQ ID NO: 3365649 - protein, 18 aa, Plasmodium falciparum
LNFSLPRSNIISMNNHNA

SEQ ID NO: 3365650 - protein, 25 aa, Plasmodium falciparum
LNGDLKCLLAIFLYILNDAMSENTK

SEQ ID NO: 3365651 - protein, 32 aa, Plasmodium falciparum
LNGKEFPNPPSLYNCRICLCEYENVNNPLVSP

SEQ ID NO: 3365652 - protein, 17 aa, Plasmodium falciparum
LNGMCSKCCHIEHVLNM

SEQ ID NO: 3365653 - protein, 19 aa, Plasmodium falciparum
LNGPHNYPENTIIYYLYTR

SEQ ID NO: 3365654 - protein, 21 aa, Plasmodium falciparum
LNHQLPCYNILNNIKRINKIK

SEQ ID NO: 3365655 - protein, 17 aa, Plasmodium falciparum
LNIAEHIIENLIDKDDV

SEQ ID NO: 3365656 - protein, 17 aa, Plasmodium falciparum
LNIDIRDSIKYHEIMKE

SEQ ID NO: 3365657 - protein, 25 aa, Plasmodium falciparum
LNIDSYWWYRQLRQYGSHPHAGFGL

SEQ ID NO: 3365658 - protein, 17 aa, Plasmodium falciparum
LNIEDIIKMKSINNNDN

SEQ ID NO: 3365659 - protein, 23 aa, Plasmodium falciparum
LNIEEFDKYFVFSFINANMKKIN

SEQ ID NO: 3365660 - protein, 19 aa, Plasmodium falciparum
LNIHLLITLCNGGFVLVNK

SEQ ID NO: 3365661 - protein, 23 aa, Plasmodium falciparum
LNIKEGDLLFVRKKISADIMNDN

SEQ ID NO: 3365662 - protein, 18 aa, Plasmodium falciparum
LNIKESFKYLDHNEKMLL

SEQ ID NO: 3365663 - protein, 18 aa, Plasmodium falciparum
LNIKPLCWDEILGNILEI

SEQ ID NO: 3365664 - protein, 21 aa, Plasmodium falciparum
LNIKYFPIKKLNEIKKDITND

SEQ ID NO: 3365665 - protein, 18 aa, Plasmodium falciparum
LNILFNFLNECLNIKKII

SEQ ID NO: 3365666 - protein, 19 aa, Plasmodium falciparum
LNILSEYLTLRGFKHQRLD

SEQ ID NO: 3365667 - protein, 17 aa, Plasmodium falciparum
LNILSINKSVCYNQLSI

SEQ ID NO: 3365668 - protein, 19 aa, Plasmodium falciparum
LNINCNVNFTFLNNHLQKY

SEQ ID NO: 3365669 - protein, 20 aa, Plasmodium falciparum
LNINSFKNFFTQNISSNNEK

SEQ ID NO: 3365670 - protein, 23 aa, Plasmodium falciparum
LNIPDIYFRNILKEFCIQKNGKY

SEQ ID NO: 3365671 - protein, 17 aa, Plasmodium falciparum
LNIPIRKEHTLYICSYL

SEQ ID NO: 3365672 - protein, 21 aa, Plasmodium falciparum
LNIPKEFSDLIIPTKKANMKR

SEQ ID NO: 3365673 - protein, 25 aa, Plasmodium falciparum
LNIPKEILNITALLSSPILTTYNIK

SEQ ID NO: 3365674 - protein, 18 aa, Plasmodium falciparum
LNIPSSIINKFNKSNNTN

SEQ ID NO: 3365675 - protein, 24 aa, Plasmodium falciparum
LNIRSDINNTIFITLKNEKKTESL

SEQ ID NO: 3365676 - protein, 17 aa, Plasmodium falciparum
LNISKECIIAYGRSLGS

SEQ ID NO: 3365677 - protein, 17 aa, Plasmodium falciparum
LNIYYYQSVGDLYEINH

SEQ ID NO: 3365678 - protein, 27 aa, Plasmodium falciparum
LNKEWKSYVKCLILVSPMISLGKQKNK

SEQ ID NO: 3365679 - protein, 20 aa, Plasmodium falciparum
LNKEYDCAIVDEIQMINNES

SEQ ID NO: 3365680 - protein, 31 aa, Plasmodium falciparum
LNKIISCIDNFLSRFSTFLPELRHYNMKKDE

SEQ ID NO: 3365681 - protein, 20 aa, Plasmodium falciparum
LNKKCSIYLMKPIKIEEQSF

SEQ ID NO: 3365682 - protein, 24 aa, Plasmodium falciparum
LNKKCVCAIVLDVIKLLKELPTLV

SEQ ID NO: 3365683 - protein, 25 aa, Plasmodium falciparum
LNKKFLNNYFHACYFECSDNPMLSN

SEQ ID NO: 3365684 - protein, 24 aa, Plasmodium falciparum
LNKKRVSICRAMIFCTRHSDYSLD

SEQ ID NO: 3365685 - protein, 25 aa, Plasmodium falciparum
LNKMMKTKEIILDMLTIIKNRKLNI

SEQ ID NO: 3365686 - protein, 19 aa, Plasmodium falciparum
LNKNCIKEGEYLSNIIKKC

SEQ ID NO: 3365687 - protein, 17 aa, Plasmodium falciparum
LNKNCINNNISMDDNVY

SEQ ID NO: 3365688 - protein, 20 aa, Plasmodium falciparum
LNKNCKSYPVSDFHKVNLRP

SEQ ID NO: 3365689 - protein, 19 aa, Plasmodium falciparum
LNKNCLLKNIQNVGNIKSY

SEQ ID NO: 3365690 - protein, 24 aa, Plasmodium falciparum
LNKNESKHLVGYNISNDDNKIKVN

SEQ ID NO: 3365691 - protein, 20 aa, Plasmodium falciparum
LNKNGAISICENEVLMNNKY

SEQ ID NO: 3365692 - protein, 24 aa, Plasmodium falciparum
LNKNIKSKILLLVGSPGTGKTSIC

SEQ ID NO: 3365693 - protein, 20 aa, Plasmodium falciparum
LNKNNLLSYIFKEEYNNIVN

SEQ ID NO: 3365694 - protein, 21 aa, Plasmodium falciparum
LNKQYCPLCKVSVTKKNVSLF

SEQ ID NO: 3365695 - protein, 17 aa, Plasmodium falciparum
LNKRLTQTNLFKFNGKY

SEQ ID NO: 3365696 - protein, 18 aa, Plasmodium falciparum
LNKSCNINAIIFNINSDD

SEQ ID NO: 3365697 - protein, 25 aa, Plasmodium falciparum
LNKSFKKKEGELFKNEKITESKDLK

SEQ ID NO: 3365698 - protein, 22 aa, Plasmodium falciparum
LNKSKLEWNKVLSIKDSKGRFL

SEQ ID NO: 3365699 - protein, 20 aa, Plasmodium falciparum
LNKSYVYVCALNEYDIKSHK

SEQ ID NO: 3365700 - protein, 24 aa, Plasmodium falciparum
LNKTCFGIPKFVQYTLFYLLTNHY

SEQ ID NO: 3365701 - protein, 27 aa, Plasmodium falciparum
LNKTRMCYRNVPSFNYINNIDLLNDFS

SEQ ID NO: 3365702 - protein, 25 aa, Plasmodium falciparum
LNKYHKLNICCAIGGKNEEKEKSIF

SEQ ID NO: 3365703 - protein, 35 aa, Plasmodium falciparum
LNKYKGSSFALIIHEISDLLSLITTVDKSKNKNKI

SEQ ID NO: 3365704 - protein, 20 aa, Plasmodium falciparum
LNKYKLVFLGEQAVGKTSII

SEQ ID NO: 3365705 - protein, 19 aa, Plasmodium falciparum
LNKYMTCNDKNIGAIENEL

SEQ ID NO: 3365706 - protein, 22 aa, Plasmodium falciparum
LNLDNILSYIFKPVGSHMTKLI

SEQ ID NO: 3365707 - protein, 28 aa, Plasmodium falciparum
LNLEEYRRLTVLNQIAWKALSNQIQYSC

SEQ ID NO: 3365708 - protein, 23 aa, Plasmodium falciparum
LNLEHLNMISSYERRNKVQNRIN

SEQ ID NO: 3365709 - protein, 22 aa, Plasmodium falciparum
LNLHNLKVLYLHSNKIQNIVQV

SEQ ID NO: 3365710 - protein, 23 aa, Plasmodium falciparum
LNLKCSICKKDLTFLFQLSTSYD

SEQ ID NO: 3365711 - protein, 44 aa, Plasmodium falciparum
LNLKDIPLKINFCSYKNLFYLCTRKRLYFLKLFYVKENKTLKVK

SEQ ID NO: 3365712 - protein, 30 aa, Plasmodium falciparum
LNLKKIMNSFLLFLHMGRNKFQSDINSILF

SEQ ID NO: 3365713 - protein, 23 aa, Plasmodium falciparum
LNLKNKRIKKFFYNKEKHHELLS

SEQ ID NO: 3365714 - protein, 41 aa, Plasmodium falciparum
LNLKNPDEMKIFLILCKSKILFTYRSNFLIRINDNNLYRSN

SEQ ID NO: 3365715 - protein, 19 aa, Plasmodium falciparum
LNLLIKNLLNLSAKERPSA

SEQ ID NO: 3365716 - protein, 18 aa, Plasmodium falciparum
LNLLKVFSNINIKEKKAN

SEQ ID NO: 3365717 - protein, 25 aa, Plasmodium falciparum
LNLNGNSYVDYKFNGNIPNEELYNL

SEQ ID NO: 3365718 - protein, 20 aa, Plasmodium falciparum
LNLRKTCSYDGEFFNDNFSH

SEQ ID NO: 3365719 - protein, 17 aa, Plasmodium falciparum
LNLTYACIYIYEVMEKE

SEQ ID NO: 3365720 - protein, 25 aa, Plasmodium falciparum
LNLYLNKLFDKYCIIVHKIRTHRRK

SEQ ID NO: 3365721 - protein, 32 aa, Plasmodium falciparum
LNLYPEDMYSIYFPIVNFVQILSLKNVKNKQK

SEQ ID NO: 3365722 - protein, 24 aa, Plasmodium falciparum
LNMDRLKNIIKRSYLQHLRDLETS

SEQ ID NO: 3365723 - protein, 28 aa, Plasmodium falciparum
LNMGELFLNIYLCERVATQKIVPLIVTV

SEQ ID NO: 3365724 - protein, 23 aa, Plasmodium falciparum
LNMKKNSLHISIPNNNIKMNEND

SEQ ID NO: 3365725 - protein, 18 aa, Plasmodium falciparum
LNMNLSINDEDMHVRGLD

SEQ ID NO: 3365726 - protein, 26 aa, Plasmodium falciparum
LNMPLYFKRYHFLLLDFIIETNNEKN

SEQ ID NO: 3365727 - protein, 18 aa, Plasmodium falciparum
LNMQEVQKGMNEVGKKRA

SEQ ID NO: 3365728 - protein, 21 aa, Plasmodium falciparum
LNMRYLFSLYEYIRLYLSKCN

SEQ ID NO: 3365729 - protein, 18 aa, Plasmodium falciparum
LNMSNSMMKTNTFGNYPN

SEQ ID NO: 3365730 - protein, 20 aa, Plasmodium falciparum
LNMYYVCIDYIKLQDDKIKE

SEQ ID NO: 3365731 - protein, 18 aa, Plasmodium falciparum
LNNDIDMLSNNCKKLKES

SEQ ID NO: 3365732 - protein, 19 aa, Plasmodium falciparum
LNNFCKILLYNDIYSYINQ

SEQ ID NO: 3365733 - protein, 26 aa, Plasmodium falciparum
LNNFKMALQLYKEVYSFYKSYYGPND

SEQ ID NO: 3365734 - protein, 22 aa, Plasmodium falciparum
LNNFPGPYIKWMQKALGSKGIA

SEQ ID NO: 3365735 - protein, 18 aa, Plasmodium falciparum
LNNGELLVKILANELKTQ

SEQ ID NO: 3365736 - protein, 25 aa, Plasmodium falciparum
LNNIAININNMWFLKIKNNSDFNKC

SEQ ID NO: 3365737 - protein, 19 aa, Plasmodium falciparum
LNNICILPLNPNIQQHSFN

SEQ ID NO: 3365738 - protein, 19 aa, Plasmodium falciparum
LNNICKITKLALILISISN

SEQ ID NO: 3365739 - protein, 21 aa, Plasmodium falciparum
LNNICLGFKLASKYGPIAQEP

SEQ ID NO: 3365740 - protein, 17 aa, Plasmodium falciparum
LNNIFIFDIRYINNNLP

SEQ ID NO: 3365741 - protein, 17 aa, Plasmodium falciparum
LNNIIGYYHYINLNRLT

SEQ ID NO: 3365742 - protein, 19 aa, Plasmodium falciparum
LNNILKYSFIMDNNIITCI

SEQ ID NO: 3365743 - protein, 17 aa, Plasmodium falciparum
LNNKASSFNTIFTNSRS

SEQ ID NO: 3365744 - protein, 17 aa, Plasmodium falciparum
LNNKIILSGAHKPLEVR

SEQ ID NO: 3365745 - protein, 29 aa, Plasmodium falciparum
LNNKMDILKEFKKYMNLIIQDGYTCAYYK

SEQ ID NO: 3365746 - protein, 26 aa, Plasmodium falciparum
LNNKMGEFFFPFQKRHSTLHSRSSIK

SEQ ID NO: 3365747 - protein, 24 aa, Plasmodium falciparum
LNNKNVHNNIPFIGTKINLNNSLV

SEQ ID NO: 3365748 - protein, 17 aa, Plasmodium falciparum
LNNKYVEEWLKGHIKRV

SEQ ID NO: 3365749 - protein, 17 aa, Plasmodium falciparum
LNNLKFDLIIYNIKSNI

SEQ ID NO: 3365750 - protein, 31 aa, Plasmodium falciparum
LNNLKRFLLYFKEISRRLTITNNNYKNIYDV

SEQ ID NO: 3365751 - protein, 21 aa, Plasmodium falciparum
LNNLLIIPGINFEYRLHNFDT

SEQ ID NO: 3365752 - protein, 18 aa, Plasmodium falciparum
LNNMKSGNNPYIFFENNK

SEQ ID NO: 3365753 - protein, 25 aa, Plasmodium falciparum
LNNNKCSFVLSPSCNDKIRHVDELE

SEQ ID NO: 3365754 - protein, 17 aa, Plasmodium falciparum
LNNNRFLILQGEVEQIA

SEQ ID NO: 3365755 - protein, 24 aa, Plasmodium falciparum
LNNNYCIIKLSYITNIKYIEINTI

SEQ ID NO: 3365756 - protein, 24 aa, Plasmodium falciparum
LNNREFLYYIGYCSKNKLLNLNKI

SEQ ID NO: 3365757 - protein, 20 aa, Plasmodium falciparum
LNNTGINFYIDKKIEEINDI

SEQ ID NO: 3365758 - protein, 25 aa, Plasmodium falciparum
LNNTIPLNCINVFNHINDNLRNNLI

SEQ ID NO: 3365759 - protein, 27 aa, Plasmodium falciparum
LNNVKSRFYIKRICLKNNKTMENNNIY

SEQ ID NO: 3365760 - protein, 30 aa, Plasmodium falciparum
LNNVLCEINNALEIFNKFNANSSIKNNSDN

SEQ ID NO: 3365761 - protein, 28 aa, Plasmodium falciparum
LNNVLKELKFKSANNIKYGRDNNFDDIT

SEQ ID NO: 3365762 - protein, 19 aa, Plasmodium falciparum
LNPLYKIFGYVCSEEKEFL

SEQ ID NO: 3365763 - protein, 19 aa, Plasmodium falciparum
LNPNQLVAFFRNNHFNTLF

SEQ ID NO: 3365764 - protein, 17 aa, Plasmodium falciparum
LNPSNFFLIEFPNNFTY

SEQ ID NO: 3365765 - protein, 30 aa, Plasmodium falciparum
LNQDIAFKIFTMFYKVCYGKKKHTYTSFFE

SEQ ID NO: 3365766 - protein, 21 aa, Plasmodium falciparum
LNQDKIDLINDMSRTNENIKN

SEQ ID NO: 3365767 - protein, 27 aa, Plasmodium falciparum
LNQEVQKWLNLFPYDEYALYVIDILHE

SEQ ID NO: 3365768 - protein, 19 aa, Plasmodium falciparum
LNQFLELYIKNNSINNEAF

SEQ ID NO: 3365769 - protein, 36 aa, Plasmodium falciparum
LNQFTYKIIVFFPTARATSFYAQFFINQLKISVYEI

SEQ ID NO: 3365770 - protein, 27 aa, Plasmodium falciparum
LNQGKCGNCWVFASSVVIAAYRCRKGL

SEQ ID NO: 3365771 - protein, 24 aa, Plasmodium falciparum
LNQGVTVPEILDFVKEKYEKYYEN

SEQ ID NO: 3365772 - protein, 23 aa, Plasmodium falciparum
LNQISQKFLRSHQNVVNNNISTS

SEQ ID NO: 3365773 - protein, 17 aa, Plasmodium falciparum
LNQKSAYDRNMYNDNIS

SEQ ID NO: 3365774 - protein, 24 aa, Plasmodium falciparum
LNQLKASFFLYERKNIKNSNMCKL

SEQ ID NO: 3365775 - protein, 19 aa, Plasmodium falciparum
LNQLKCLYDNLTTLDNEMD

SEQ ID NO: 3365776 - protein, 19 aa, Plasmodium falciparum
LNQYFTIVANSIKLLKNNL

SEQ ID NO: 3365777 - protein, 17 aa, Plasmodium falciparum
LNRERYIILNKIPRYRE

SEQ ID NO: 3365778 - protein, 19 aa, Plasmodium falciparum
LNRLLRLIVDHNIADYITA

SEQ ID NO: 3365779 - protein, 17 aa, Plasmodium falciparum
LNRTLDISVVFSKVFTR

SEQ ID NO: 3365780 - protein, 24 aa, Plasmodium falciparum
LNRYDLPKDISYYVEEYQKRKEQA

SEQ ID NO: 3365781 - protein, 23 aa, Plasmodium falciparum
LNSAEIEGIISLRNDISEDLLKL

SEQ ID NO: 3365782 - protein, 23 aa, Plasmodium falciparum
LNSECKTSTITKCSSNINTPSIY

SEQ ID NO: 3365783 - protein, 23 aa, Plasmodium falciparum
LNSFKLPQIPLILKTCDEGSLEG

SEQ ID NO: 3365784 - protein, 24 aa, Plasmodium falciparum
LNSFLKKKMYSTGSMYDIKVPIKK

SEQ ID NO: 3365785 - protein, 32 aa, Plasmodium falciparum
LNSFSFNLMNCYFLKFISNYLKYVNMPNGSNS

SEQ ID NO: 3365786 - protein, 18 aa, Plasmodium falciparum
LNSICTLCNIKLDHRSIC

SEQ ID NO: 3365787 - protein, 18 aa, Plasmodium falciparum
LNSIKMIYLVARFYNTPN

SEQ ID NO: 3365788 - protein, 19 aa, Plasmodium falciparum
LNSKAFVFFIIKNVGVHKI

SEQ ID NO: 3365789 - protein, 25 aa, Plasmodium falciparum
LNSKMPSRFPPVVFYTPKELGGLGM

SEQ ID NO: 3365790 - protein, 21 aa, Plasmodium falciparum
LNSLCGGSIHLIVELNTNEEK

SEQ ID NO: 3365791 - protein, 18 aa, Plasmodium falciparum
LNSLFKIPIDDITSVEFC

SEQ ID NO: 3365792 - protein, 31 aa, Plasmodium falciparum
LNSLFQEFVDFCLENNFVLPENLSFKRHEYM

SEQ ID NO: 3365793 - protein, 26 aa, Plasmodium falciparum
LNSLLLGSFCNLLWNDNIYTHEYLIS

SEQ ID NO: 3365794 - protein, 25 aa, Plasmodium falciparum
LNSNWKVGLKCRIQKPLCATNYNAY

SEQ ID NO: 3365795 - protein, 23 aa, Plasmodium falciparum
LNSPRTSNILNMCSQNHNNKNYN

SEQ ID NO: 3365796 - protein, 19 aa, Plasmodium falciparum
LNSQICTFFSQKLLPIIYY

SEQ ID NO: 3365797 - protein, 32 aa, Plasmodium falciparum
LNSRSNSCYTRNCVNCNILINNHIDVSNVDNI

SEQ ID NO: 3365798 - protein, 24 aa, Plasmodium falciparum
LNSVDVIMCTSCLTKIEKSNYKLH

SEQ ID NO: 3365799 - protein, 21 aa, Plasmodium falciparum
LNSYMPCIFLSNTFKMNCTKN

SEQ ID NO: 3365800 - protein, 25 aa, Plasmodium falciparum
LNTCELFIYFILRNMQVPSFPSSLY

SEQ ID NO: 3365801 - protein, 19 aa, Plasmodium falciparum
LNTLCKSILLNFGASAVCI

SEQ ID NO: 3365802 - protein, 17 aa, Plasmodium falciparum
LNTLKLTIEALDGNEKS

SEQ ID NO: 3365803 - protein, 20 aa, Plasmodium falciparum
LNTLRYSSRVKNFKNKSTCI

SEQ ID NO: 3365804 - protein, 22 aa, Plasmodium falciparum
LNTNKCCIESILSNLINLNNIE

SEQ ID NO: 3365805 - protein, 18 aa, Plasmodium falciparum
LNTTLLYIKCILKDTNIN

SEQ ID NO: 3365806 - protein, 26 aa, Plasmodium falciparum
LNTYKMPITLSFKIPMFTSSGMYIRY

SEQ ID NO: 3365807 - protein, 22 aa, Plasmodium falciparum
LNVDRYKYFLPYVTDSKITEKN

SEQ ID NO: 3365808 - protein, 20 aa, Plasmodium falciparum
LNVINKRMINFTKDNNSNNI

SEQ ID NO: 3365809 - protein, 31 aa, Plasmodium falciparum
LNVLCNSHLPFSIKLKNNFLHILNVKNAEDE

SEQ ID NO: 3365810 - protein, 17 aa, Plasmodium falciparum
LNVLVGYVEQVEIHPDA

SEQ ID NO: 3365811 - protein, 17 aa, Plasmodium falciparum
LNWIFPNNFPDREVYKC

SEQ ID NO: 3365812 - protein, 24 aa, Plasmodium falciparum
LNWYYKYRRKLPWRGDEPPFTTSV

SEQ ID NO: 3365813 - protein, 23 aa, Plasmodium falciparum
LNYFFHLKLGFFVCYKNHNDKYS

SEQ ID NO: 3365814 - protein, 23 aa, Plasmodium falciparum
LNYHKYYYTYSINNMSEKKKKNC

SEQ ID NO: 3365815 - protein, 17 aa, Plasmodium falciparum
LNYHSSKSYISDSEENI

SEQ ID NO: 3365816 - protein, 21 aa, Plasmodium falciparum
LNYKYKLLFVYNILNINNVKC

SEQ ID NO: 3365817 - protein, 17 aa, Plasmodium falciparum
LNYLDKRGKVIYDDQYE

SEQ ID NO: 3365818 - protein, 18 aa, Plasmodium falciparum
LNYLSGIIKPLIDHPNSL

SEQ ID NO: 3365819 - protein, 28 aa, Plasmodium falciparum
LNYNEIIDLIHIWNFLCKENNTYEMLNE

SEQ ID NO: 3365820 - protein, 17 aa, Plasmodium falciparum
LNYRLPKKYLKDADKNE

SEQ ID NO: 3365821 - protein, 28 aa, Plasmodium falciparum
LNYVCIAFEEGNVWLCYQDDEYKLFNYE

SEQ ID NO: 3365822 - protein, 27 aa, Plasmodium falciparum
LNYYLNNKFNYFLGHTNFMKKIFKKKK

SEQ ID NO: 3365823 - protein, 25 aa, Plasmodium falciparum
LPCEISIQIPDEFIGAVIGKNGSRL

SEQ ID NO: 3365824 - protein, 19 aa, Plasmodium falciparum
LPCKVFGDVHGNLFDLLDF

SEQ ID NO: 3365825 - protein, 29 aa, Plasmodium falciparum
LPDCFAEIEISYYLLRRLLGVKSQDGEKN

SEQ ID NO: 3365826 - protein, 19 aa, Plasmodium falciparum
LPDGFQWQYPDGVSNNPLC

SEQ ID NO: 3365827 - protein, 23 aa, Plasmodium falciparum
LPDHAYPKWLWKLEKPLKSYGEL

SEQ ID NO: 3365828 - protein, 19 aa, Plasmodium falciparum
LPDKEIIIGYDILQNDFIL

SEQ ID NO: 3365829 - protein, 24 aa, Plasmodium falciparum
LPDNYSSLYFKGMWTNKSAGGCSN

SEQ ID NO: 3365830 - protein, 31 aa, Plasmodium falciparum
LPEHWDKTPCVFKMMDRWRLAVSNYKNLDKV

SEQ ID NO: 3365831 - protein, 20 aa, Plasmodium falciparum
LPELIWKNYIDMEINLQEYD

SEQ ID NO: 3365832 - protein, 20 aa, Plasmodium falciparum
LPENLSFKRHEYMYNSDGST

SEQ ID NO: 3365833 - protein, 17 aa, Plasmodium falciparum
LPFTNGIDIPNIPNVII

SEQ ID NO: 3365834 - protein, 20 aa, Plasmodium falciparum
LPGKDLNLVTLKSVRKDVAD

SEQ ID NO: 3365835 - protein, 28 aa, Plasmodium falciparum
LPGNLGEFLPKFLIDNNINSGNNVVSFG

SEQ ID NO: 3365836 - protein, 18 aa, Plasmodium falciparum
LPHHPCLNYDHFNFITCY

SEQ ID NO: 3365837 - protein, 24 aa, Plasmodium falciparum
LPHRIDVKKAMAILNDRSLLKKMK

SEQ ID NO: 3365838 - protein, 26 aa, Plasmodium falciparum
LPIEPKKLARFCNIIREESKDYKLNL

SEQ ID NO: 3365839 - protein, 17 aa, Plasmodium falciparum
LPIEVFVCKNYSIFEDF

SEQ ID NO: 3365840 - protein, 18 aa, Plasmodium falciparum
LPILYKMFDINSICVSLK

SEQ ID NO: 3365841 - protein, 23 aa, Plasmodium falciparum
LPIMKKRRFRVELLSEFLPKNPN

SEQ ID NO: 3365842 - protein, 20 aa, Plasmodium falciparum
LPINYDRNEYASSYSEKNTN

SEQ ID NO: 3365843 - protein, 17 aa, Plasmodium falciparum
LPITCMDISKDNKILAS

SEQ ID NO: 3365844 - protein, 17 aa, Plasmodium falciparum
LPITLDLPPQNIILKNE

SEQ ID NO: 3365845 - protein, 17 aa, Plasmodium falciparum
LPIVGDYMYRVVTKNEK

SEQ ID NO: 3365846 - protein, 22 aa, Plasmodium falciparum
LPIYSYRYDILKAIKNNKILIL

SEQ ID NO: 3365847 - protein, 21 aa, Plasmodium falciparum
LPKIIEEFEFLLLKQRKEIKC

SEQ ID NO: 3365848 - protein, 25 aa, Plasmodium falciparum
LPKKNCPVIPIIIRTNYVGIFDIFL

SEQ ID NO: 3365849 - protein, 26 aa, Plasmodium falciparum
LPKNLKFKLFEPFKYLFKDDVKTLSR

SEQ ID NO: 3365850 - protein, 21 aa, Plasmodium falciparum
LPKTRSGKIVRRILRCIANGI

SEQ ID NO: 3365851 - protein, 17 aa, Plasmodium falciparum
LPLDEFGIYHLLPIKCQ

SEQ ID NO: 3365852 - protein, 21 aa, Plasmodium falciparum
LPLKDLKIYLCEVADNEKKIY

SEQ ID NO: 3365853 - protein, 19 aa, Plasmodium falciparum
LPLKKSRDGTELPLNVASI

SEQ ID NO: 3365854 - protein, 26 aa, Plasmodium falciparum
LPLKNTEVCLSFYYIQYLRNQLLYGN

SEQ ID NO: 3365855 - protein, 25 aa, Plasmodium falciparum
LPLLNLRFKEIITIAYQTFYNFVLT

SEQ ID NO: 3365856 - protein, 17 aa, Plasmodium falciparum
LPLNCKAKNLIVDIKED

SEQ ID NO: 3365857 - protein, 18 aa, Plasmodium falciparum
LPLNKLIYLDVSYNNIKK

SEQ ID NO: 3365858 - protein, 19 aa, Plasmodium falciparum
LPLNVGREILQKSKMLSII

SEQ ID NO: 3365859 - protein, 18 aa, Plasmodium falciparum
LPLSELFHQSNINELKLP

SEQ ID NO: 3365860 - protein, 17 aa, Plasmodium falciparum
LPLSGFATVGNRRKYNL

SEQ ID NO: 3365861 - protein, 20 aa, Plasmodium falciparum
LPLYLLELFSIPIEQKEKND

SEQ ID NO: 3365862 - protein, 17 aa, Plasmodium falciparum
LPNAPVFKSTTESNIIP

SEQ ID NO: 3365863 - protein, 20 aa, Plasmodium falciparum
LPNELFLEVTRNENFVQECK

SEQ ID NO: 3365864 - protein, 19 aa, Plasmodium falciparum
LPNFTIRTNLLKVIQQLPI

SEQ ID NO: 3365865 - protein, 21 aa, Plasmodium falciparum
LPNKFLIDYGDVFNNYGSFAY

SEQ ID NO: 3365866 - protein, 24 aa, Plasmodium falciparum
LPNNICFNYSLSILKPKTLLGDII

SEQ ID NO: 3365867 - protein, 17 aa, Plasmodium falciparum
LPNSWTNLWGDTKLLFN

SEQ ID NO: 3365868 - protein, 17 aa, Plasmodium falciparum
LPNWISEFNRWCPSLNV

SEQ ID NO: 3365869 - protein, 26 aa, Plasmodium falciparum
LPPECPCGGIFKPNIILFGEVVSSDL

SEQ ID NO: 3365870 - protein, 17 aa, Plasmodium falciparum
LPPLPFKTNNKYNGSQN

SEQ ID NO: 3365871 - protein, 18 aa, Plasmodium falciparum
LPPNDAYHKINYTIEEIN

SEQ ID NO: 3365872 - protein, 17 aa, Plasmodium falciparum
LPPSFPYLKIPGLNVSS

SEQ ID NO: 3365873 - protein, 19 aa, Plasmodium falciparum
LPPYNLLPLCSGCAPHNYN

SEQ ID NO: 3365874 - protein, 26 aa, Plasmodium falciparum
LPQFKCKRIVLDIITRLFSRYVNTNY

SEQ ID NO: 3365875 - protein, 18 aa, Plasmodium falciparum
LPQLERGLYHLFFFFNKE

SEQ ID NO: 3365876 - protein, 17 aa, Plasmodium falciparum
LPQNINMENLPKVWYCK

SEQ ID NO: 3365877 - protein, 19 aa, Plasmodium falciparum
LPRIFLYKEMINKFQNGYS

SEQ ID NO: 3365878 - protein, 21 aa, Plasmodium falciparum
LPRNETLNFLKQEYVSSKEQE

SEQ ID NO: 3365879 - protein, 19 aa, Plasmodium falciparum
LPRNIKVFNLYEFIMTEKY

SEQ ID NO: 3365880 - protein, 18 aa, Plasmodium falciparum
LPRNYSYDNMNRTWNCNN

SEQ ID NO: 3365881 - protein, 22 aa, Plasmodium falciparum
LPSCVITKSFLNNYYKRLITYY

SEQ ID NO: 3365882 - protein, 19 aa, Plasmodium falciparum
LPSEEKITSYNFLKKHNST

SEQ ID NO: 3365883 - protein, 17 aa, Plasmodium falciparum
LPSEKKMAFLIYTHLKN

SEQ ID NO: 3365884 - protein, 21 aa, Plasmodium falciparum
LPSFYEFYQKYGYKPCIGNIR

SEQ ID NO: 3365885 - protein, 24 aa, Plasmodium falciparum
LPSGYILKKYDAVHIKGNNNEISI

SEQ ID NO: 3365886 - protein, 19 aa, Plasmodium falciparum
LPSNLRYDFMEKREVLNIT

SEQ ID NO: 3365887 - protein, 19 aa, Plasmodium falciparum
LPSSFNYMIGKKIEYDIKI

SEQ ID NO: 3365888 - protein, 21 aa, Plasmodium falciparum
LPSTHPIRLGLALNYSVFFYE

SEQ ID NO: 3365889 - protein, 25 aa, Plasmodium falciparum
LPTDLPYAELYVLIDSLIHNEILPS

SEQ ID NO: 3365890 - protein, 18 aa, Plasmodium falciparum
LPTLLPFDYEYVKFKVVN

SEQ ID NO: 3365891 - protein, 25 aa, Plasmodium falciparum
LPTSYLNIWRWCNKRQFKSLFHYYD

SEQ ID NO: 3365892 - protein, 27 aa, Plasmodium falciparum
LPVAPKAYCLCAATWEQISIEGLFPII

SEQ ID NO: 3365893 - protein, 25 aa, Plasmodium falciparum
LPVEKNMEGYNCLILCKGLPFHVDN

SEQ ID NO: 3365894 - protein, 25 aa, Plasmodium falciparum
LPVKHPEIFESLGISQPKGVLLYGP

SEQ ID NO: 3365895 - protein, 18 aa, Plasmodium falciparum
LPVPCLNVINGGSHAGNK

SEQ ID NO: 3365896 - protein, 20 aa, Plasmodium falciparum
LPVSESFGFTSALRAATSGQ

SEQ ID NO: 3365897 - protein, 20 aa, Plasmodium falciparum
LPYIQSMVLDFDRKVQNNIK

SEQ ID NO: 3365898 - protein, 24 aa, Plasmodium falciparum
LPYKCSTSNNYNCPNNNNSQNDYN

SEQ ID NO: 3365899 - protein, 22 aa, Plasmodium falciparum
LPYKIIHAWYTGPAHIYFNHPY

SEQ ID NO: 3365900 - protein, 22 aa, Plasmodium falciparum
LPYLSTCYWYKKDIEKIEYILL

SEQ ID NO: 3365901 - protein, 17 aa, Plasmodium falciparum
LPYSENCVLLIVSSQEQ

SEQ ID NO: 3365902 - protein, 18 aa, Plasmodium falciparum
LQAAKVIYYYPHEINENI

SEQ ID NO: 3365903 - protein, 25 aa, Plasmodium falciparum
LQAYSCLKYLPSHVFVLYADEEYIY

SEQ ID NO: 3365904 - protein, 34 aa, Plasmodium falciparum
LQCPLSSIHRVKLRLKFTLPYDLFCNIDKVHLIK

SEQ ID NO: 3365905 - protein, 19 aa, Plasmodium falciparum
LQCYRRLGIHRKKYFNFSN

SEQ ID NO: 3365906 - protein, 18 aa, Plasmodium falciparum
LQDAIKRGSKVSLQAHLQ

SEQ ID NO: 3365907 - protein, 23 aa, Plasmodium falciparum
LQDLCSLLQFHITTLFDNDIPGM

SEQ ID NO: 3365908 - protein, 20 aa, Plasmodium falciparum
LQEELCDKESEILKIKGEKN

SEQ ID NO: 3365909 - protein, 21 aa, Plasmodium falciparum
LQEIEKIFYKSLCHPGECVGA

SEQ ID NO: 3365910 - protein, 26 aa, Plasmodium falciparum
LQEILEMYEPPIIVFVNQKKVADIIS

SEQ ID NO: 3365911 - protein, 18 aa, Plasmodium falciparum
LQEKLRMKQIKKLLDEKQ

SEQ ID NO: 3365912 - protein, 17 aa, Plasmodium falciparum
LQEKSVNLWDFFMNPLL

SEQ ID NO: 3365913 - protein, 25 aa, Plasmodium falciparum
LQEVEEIKDALNLTVKAREQSDDDI

SEQ ID NO: 3365914 - protein, 17 aa, Plasmodium falciparum
LQFLFTDKNFKVIKLPH

SEQ ID NO: 3365915 - protein, 35 aa, Plasmodium falciparum
LQHGVLSLCSFYPCINSYLLCLCSKDGNIVIIDIR

SEQ ID NO: 3365916 - protein, 21 aa, Plasmodium falciparum
LQHKYNGYMCVIKKLKNLLLN

SEQ ID NO: 3365917 - protein, 17 aa, Plasmodium falciparum
LQHPSYINSLIKNIKNF

SEQ ID NO: 3365918 - protein, 29 aa, Plasmodium falciparum
LQHTHLYGRHLIIDFADDFMFDKNVDEYD

SEQ ID NO: 3365919 - protein, 17 aa, Plasmodium falciparum
LQILKYNLNIHIQNITL

SEQ ID NO: 3365920 - protein, 29 aa, Plasmodium falciparum
LQIMFRPLKLHPFSTINIHKIHYNLYKDI

SEQ ID NO: 3365921 - protein, 25 aa, Plasmodium falciparum
LQIRKKRLYLSFPYHSHSEKKNDIL

SEQ ID NO: 3365922 - protein, 20 aa, Plasmodium falciparum
LQIYIKYNLSKIYMKHLYIL

SEQ ID NO: 3365923 - protein, 17 aa, Plasmodium falciparum
LQIYRGKGVFVAFNDDI

SEQ ID NO: 3365924 - protein, 24 aa, Plasmodium falciparum
LQIYWLGGFCNPKSILKYILHEYS

SEQ ID NO: 3365925 - protein, 20 aa, Plasmodium falciparum
LQKACAMLIELKRYSKSYIS

SEQ ID NO: 3365926 - protein, 25 aa, Plasmodium falciparum
LQKDFSIYFVNIFDIAICSNYLNFK

SEQ ID NO: 3365927 - protein, 26 aa, Plasmodium falciparum
LQKEKKFLCIDLEFLDDMNKKNVNGE

SEQ ID NO: 3365928 - protein, 17 aa, Plasmodium falciparum
LQKELYKAYATLDKNKL

SEQ ID NO: 3365929 - protein, 18 aa, Plasmodium falciparum
LQKGLKLKVHKQIKEPCW

SEQ ID NO: 3365930 - protein, 26 aa, Plasmodium falciparum
LQKKNDYRFSLPFDENKIFRKSSSLS

SEQ ID NO: 3365931 - protein, 27 aa, Plasmodium falciparum
LQKKRSYKFLHCFNYIKNIIDNVYNNL

SEQ ID NO: 3365932 - protein, 23 aa, Plasmodium falciparum
LQKRIDETLGLIVEENKRKQYEE

SEQ ID NO: 3365933 - protein, 25 aa, Plasmodium falciparum
LQKSKEVWDFLPPIIRDQLLMDRES

SEQ ID NO: 3365934 - protein, 23 aa, Plasmodium falciparum
LQKYENRGYFSFANIPKNHINNN

SEQ ID NO: 3365935 - protein, 17 aa, Plasmodium falciparum
LQLERDYVIEAADQNKD

SEQ ID NO: 3365936 - protein, 18 aa, Plasmodium falciparum
LQLKFPSKNNILSKKKEQ

SEQ ID NO: 3365937 - protein, 19 aa, Plasmodium falciparum
LQLSNYIFNIECKQMEYFK

SEQ ID NO: 3365938 - protein, 23 aa, Plasmodium falciparum
LQLSRVYSYISIDYFIENICPDH

SEQ ID NO: 3365939 - protein, 19 aa, Plasmodium falciparum
LQMTKLVSIYFKISSKECM

SEQ ID NO: 3365940 - protein, 33 aa, Plasmodium falciparum
LQNEKKYTFTCCYEYYCSLECFKKHDQQKCRNQ

SEQ ID NO: 3365941 - protein, 24 aa, Plasmodium falciparum
LQNGCDYKDRCIIENNVEDENLKL

SEQ ID NO: 3365942 - protein, 20 aa, Plasmodium falciparum
LQNKCLHKQNLINTQKDKNI

SEQ ID NO: 3365943 - protein, 32 aa, Plasmodium falciparum
LQNKIVMLKKLCLRILFINEYQIYNIKKLQEN

SEQ ID NO: 3365944 - protein, 20 aa, Plasmodium falciparum
LQNLELLGWIHTQTTNCSNT

SEQ ID NO: 3365945 - protein, 18 aa, Plasmodium falciparum
LQNLLMAEPFNKYYKLYI

SEQ ID NO: 3365946 - protein, 26 aa, Plasmodium falciparum
LQNPEFHSYVVFKIFFSIKENLDQYA

SEQ ID NO: 3365947 - protein, 20 aa, Plasmodium falciparum
LQNSKFLWHEKVKSRWIYLL

SEQ ID NO: 3365948 - protein, 19 aa, Plasmodium falciparum
LQQPFLLSSTMCTPASFSS

SEQ ID NO: 3365949 - protein, 17 aa, Plasmodium falciparum
LQRIFKDNDRIIVFVET

SEQ ID NO: 3365950 - protein, 36 aa, Plasmodium falciparum
LQRKPHKPRMSKRLSEKKKLLLNMEGKEKNELGNNE

SEQ ID NO: 3365951 - protein, 24 aa, Plasmodium falciparum
LQRLEKRLSGLHFSIELQKNEKID

SEQ ID NO: 3365952 - protein, 24 aa, Plasmodium falciparum
LQSECARLLSLYILGMLKSIAFRD

SEQ ID NO: 3365953 - protein, 17 aa, Plasmodium falciparum
LQSLKCLLANKNFLTML

SEQ ID NO: 3365954 - protein, 21 aa, Plasmodium falciparum
LQSPELLQAFQQVMSSNRNLG

SEQ ID NO: 3365955 - protein, 27 aa, Plasmodium falciparum
LQTIDSPKMWLIKLFKNNVERNLAIGI

SEQ ID NO: 3365956 - protein, 20 aa, Plasmodium falciparum
LQVKKCLKDIVSNQFIIYVQ

SEQ ID NO: 3365957 - protein, 18 aa, Plasmodium falciparum
LQVSCVIVDDLVNTDELI

SEQ ID NO: 3365958 - protein, 19 aa, Plasmodium falciparum
LQYIKCKTSTKIDDILKRR

SEQ ID NO: 3365959 - protein, 17 aa, Plasmodium falciparum
LQYQILQDIKEEWYTDN

SEQ ID NO: 3365960 - protein, 19 aa, Plasmodium falciparum
LRAINFAKNAGLEFEAKLG

SEQ ID NO: 3365961 - protein, 18 aa, Plasmodium falciparum
LRAKSYRKDQEIKKLQET

SEQ ID NO: 3365962 - protein, 25 aa, Plasmodium falciparum
LRALARSGLKIGRIEDVTPIPTDST

SEQ ID NO: 3365963 - protein, 17 aa, Plasmodium falciparum
LRALKYIHSGGLLHRDI

SEQ ID NO: 3365964 - protein, 18 aa, Plasmodium falciparum
LRALWGIVLVNLSRYGNK

SEQ ID NO: 3365965 - protein, 21 aa, Plasmodium falciparum
LRARCAVIAAANPIYGRYDPS

SEQ ID NO: 3365966 - protein, 43 aa, Plasmodium falciparum
LRATENLYKTALCESFIKGKCFSGQFCRYAHGHNELRENPMEI

SEQ ID NO: 3365967 - protein, 25 aa, Plasmodium falciparum
LRAVCSKCGTVQLGKLAHFRKHCDK

SEQ ID NO: 3365968 - protein, 24 aa, Plasmodium falciparum
LRCEIYICVLGDLLMTHPNLNNDE

SEQ ID NO: 3365969 - protein, 20 aa, Plasmodium falciparum
LRCILLQKEGVEFAGYTVPH

SEQ ID NO: 3365970 - protein, 19 aa, Plasmodium falciparum
LRCKAIEAHASRMGINNLI

SEQ ID NO: 3365971 - protein, 18 aa, Plasmodium falciparum
LRDGVNFEIINEYKTDRP

SEQ ID NO: 3365972 - protein, 24 aa, Plasmodium falciparum
LRDKDSCPCYNNLIKKTDQELLQL

SEQ ID NO: 3365973 - protein, 26 aa, Plasmodium falciparum
LRDTGENCFIYLKSLSKELDVIINKL

SEQ ID NO: 3365974 - protein, 24 aa, Plasmodium falciparum
LRDTLKYASNMLCELRTSHLSPKY

SEQ ID NO: 3365975 - protein, 17 aa, Plasmodium falciparum
LRDVVKCVEKETLLARS

SEQ ID NO: 3365976 - protein, 23 aa, Plasmodium falciparum
LREAIKILKYYCNNEMKENELSI

SEQ ID NO: 3365977 - protein, 17 aa, Plasmodium falciparum
LREHIKNSINNVVEEIL

SEQ ID NO: 3365978 - protein, 21 aa, Plasmodium falciparum
LREHMLIEYTAMFVNIEGDIA

SEQ ID NO: 3365979 - protein, 41 aa, Plasmodium falciparum
LREVGKPAICQLHREGRCIKGNQCRFAHSINDINTKLVKFY

SEQ ID NO: 3365980 - protein, 19 aa, Plasmodium falciparum
LRFECELEFLQSLCNIDYI

SEQ ID NO: 3365981 - protein, 25 aa, Plasmodium falciparum
LRFEGPPPHFLIIKFDKVNRKAYIV

SEQ ID NO: 3365982 - protein, 19 aa, Plasmodium falciparum
LRFWGIIKGTHNDYYILEG

SEQ ID NO: 3365983 - protein, 18 aa, Plasmodium falciparum
LRFYNYIPVNKELKKSCI

SEQ ID NO: 3365984 - protein, 18 aa, Plasmodium falciparum
LRGCKGNVPSTRYGHISF

SEQ ID NO: 3365985 - protein, 23 aa, Plasmodium falciparum
LRGDYKPHVIFLLEGNEIKNVNY

SEQ ID NO: 3365986 - protein, 20 aa, Plasmodium falciparum
LRGIYAYGFEKPSAIQQRGI

SEQ ID NO: 3365987 - protein, 17 aa, Plasmodium falciparum
LRGLFIIDKNGCVRHQT

SEQ ID NO: 3365988 - protein, 25 aa, Plasmodium falciparum
LRGLFLRYFLIQMCKDRIPDTGSEY

SEQ ID NO: 3365989 - protein, 20 aa, Plasmodium falciparum
LRGTIFKRNYFWEKVNRESG

SEQ ID NO: 3365990 - protein, 24 aa, Plasmodium falciparum
LRHIEFSKDGSFFVVASFDSKCSI

SEQ ID NO: 3365991 - protein, 28 aa, Plasmodium falciparum
LRHIKDMNRLYLFESCEPTIAKGAYMPP

SEQ ID NO: 3365992 - protein, 24 aa, Plasmodium falciparum
LRHKEELHEQILFINSKKYNDEII

SEQ ID NO: 3365993 - protein, 19 aa, Plasmodium falciparum
LRHKIYEITKKCNIAEEKL

SEQ ID NO: 3365994 - protein, 19 aa, Plasmodium falciparum
LRHLKCKYIKQLVIDEADE

SEQ ID NO: 3365995 - protein, 24 aa, Plasmodium falciparum
LRHPNILQCIGNIFVDDKEDCGIV

SEQ ID NO: 3365996 - protein, 29 aa, Plasmodium falciparum
LRHSKNEKNCVFKYFLDVKETSHKNGNID

SEQ ID NO: 3365997 - protein, 27 aa, Plasmodium falciparum
LRHSYLYFKGACYFCNDMHCPSDSLSY

SEQ ID NO: 3365998 - protein, 18 aa, Plasmodium falciparum
LRIFRSFFEISLKKNSYN

SEQ ID NO: 3365999 - protein, 19 aa, Plasmodium falciparum
LRIKPDMRKTKLCKSYILG

SEQ ID NO: 3366000 - protein, 17 aa, Plasmodium falciparum
LRIKSFCFNLSTLCGKY

SEQ ID NO: 3366001 - protein, 19 aa, Plasmodium falciparum
LRIYDIKTIICDFNPLNET

SEQ ID NO: 3366002 - protein, 22 aa, Plasmodium falciparum
LRKCCNHPYLFDGIEEPPYIEG

SEQ ID NO: 3366003 - protein, 20 aa, Plasmodium falciparum
LRKECMKDKFMLIIDPIAVG

SEQ ID NO: 3366004 - protein, 25 aa, Plasmodium falciparum
LRKENFYFFYTFYFELFINSYLYNR

SEQ ID NO: 3366005 - protein, 20 aa, Plasmodium falciparum
LRKEVLPHMGTHPGVESKKS

SEQ ID NO: 3366006 - protein, 23 aa, Plasmodium falciparum
LRKGSRIQLFNVFVQKSNHNNNK

SEQ ID NO: 3366007 - protein, 19 aa, Plasmodium falciparum
LRKHLFPITNFLKNSGIMN

SEQ ID NO: 3366008 - protein, 20 aa, Plasmodium falciparum
LRKKIRRTLYHIYKDKIYSY

SEQ ID NO: 3366009 - protein, 19 aa, Plasmodium falciparum
LRKKSRIFNLWKRIINDNK

SEQ ID NO: 3366010 - protein, 24 aa, Plasmodium falciparum
LRKLLEEIPNLIIAGYGRIMQVFT

SEQ ID NO: 3366011 - protein, 30 aa, Plasmodium falciparum
LRKMKNKKIKVENMWYKRYDSNDMNNNNNN

SEQ ID NO: 3366012 - protein, 20 aa, Plasmodium falciparum
LRKNECVYFNIQNHYNSFVN

SEQ ID NO: 3366013 - protein, 23 aa, Plasmodium falciparum
LRKNRICSLNTFSFLSTKINKTL

SEQ ID NO: 3366014 - protein, 19 aa, Plasmodium falciparum
LRKNYNYNYNYEDIDMDIE

SEQ ID NO: 3366015 - protein, 17 aa, Plasmodium falciparum
LRKPALYKDDDLRKHLV

SEQ ID NO: 3366016 - protein, 18 aa, Plasmodium falciparum
LRKSEAFYSYPELKIPPF

SEQ ID NO: 3366017 - protein, 20 aa, Plasmodium falciparum
LRKSFRKRYRIVRNNLMKLI

SEQ ID NO: 3366018 - protein, 20 aa, Plasmodium falciparum
LRKTLEYEYNSKIKLHDILK

SEQ ID NO: 3366019 - protein, 21 aa, Plasmodium falciparum
LRKVCNHCDLFTNKYIQTPYY

SEQ ID NO: 3366020 - protein, 20 aa, Plasmodium falciparum
LRKVMKATMKNSDFNDNTNN

SEQ ID NO: 3366021 - protein, 29 aa, Plasmodium falciparum
LRLELKRRWLRILFILECFLCKSKSHCSF

SEQ ID NO: 3366022 - protein, 18 aa, Plasmodium falciparum
LRLKCMNIKVSELTGDVN

SEQ ID NO: 3366023 - protein, 18 aa, Plasmodium falciparum
LRLLHPISPFITEELYQK

SEQ ID NO: 3366024 - protein, 19 aa, Plasmodium falciparum
LRLLSKIKYLKILDPLMET

SEQ ID NO: 3366025 - protein, 27 aa, Plasmodium falciparum
LRLRQCCSHPLLLFSKPFFEEWNKDDM

SEQ ID NO: 3366026 - protein, 20 aa, Plasmodium falciparum
LRLTDIYIDYTVVEDLAKHA

SEQ ID NO: 3366027 - protein, 19 aa, Plasmodium falciparum
LRLVCQRVKEILVEENNVQ

SEQ ID NO: 3366028 - protein, 22 aa, Plasmodium falciparum
LRNECKVAQLVGYIAEHSAYHH

SEQ ID NO: 3366029 - protein, 21 aa, Plasmodium falciparum
LRNELLRRFIYSLNSWMNMRR

SEQ ID NO: 3366030 - protein, 17 aa, Plasmodium falciparum
LRNLDIRKRSIYKGSTF

SEQ ID NO: 3366031 - protein, 23 aa, Plasmodium falciparum
LRNNIKTAYSLYPEKYIIKPNES

SEQ ID NO: 3366032 - protein, 18 aa, Plasmodium falciparum
LRNNLLLEEKNLLLKQSH

SEQ ID NO: 3366033 - protein, 17 aa, Plasmodium falciparum
LRNPFRIEHPYLKEMES

SEQ ID NO: 3366034 - protein, 19 aa, Plasmodium falciparum
LRNQIPLDIDMNMPNVKTY

SEQ ID NO: 3366035 - protein, 17 aa, Plasmodium falciparum
LRNQLHIDRKVKKISQK

SEQ ID NO: 3366036 - protein, 17 aa, Plasmodium falciparum
LRNSLAIKKKTLAEKDL

SEQ ID NO: 3366037 - protein, 20 aa, Plasmodium falciparum
LRNSNYPIKEIIGHSKGINN

SEQ ID NO: 3366038 - protein, 20 aa, Plasmodium falciparum
LRNTFECLFFGMVEQYNIIL

SEQ ID NO: 3366039 - protein, 20 aa, Plasmodium falciparum
LRNTNIFSLFALTIKEQNKK

SEQ ID NO: 3366040 - protein, 17 aa, Plasmodium falciparum
LRNVFLIKKMEDDSNIK

SEQ ID NO: 3366041 - protein, 21 aa, Plasmodium falciparum
LRPLQPGKWLIIFADEINLPT

SEQ ID NO: 3366042 - protein, 20 aa, Plasmodium falciparum
LRPLSELYVENNINEIIRNN

SEQ ID NO: 3366043 - protein, 17 aa, Plasmodium falciparum
LRPSGVLDLDIINMNLY

SEQ ID NO: 3366044 - protein, 22 aa, Plasmodium falciparum
LRPTGDLYKTAPCTKFLRGKCN

SEQ ID NO: 3366045 - protein, 19 aa, Plasmodium falciparum
LRPYGVSFLIGGYDTKDGY

SEQ ID NO: 3366046 - protein, 22 aa, Plasmodium falciparum
LRQELLFALTTETAWESVMRIR

SEQ ID NO: 3366047 - protein, 19 aa, Plasmodium falciparum
LRQIAGLLIKNAFTSKDNY

SEQ ID NO: 3366048 - protein, 23 aa, Plasmodium falciparum
LRQLIEFQGFYFLDKDKRGNFKK

SEQ ID NO: 3366049 - protein, 18 aa, Plasmodium falciparum
LRQLKEPIRLFGETDLQR

SEQ ID NO: 3366050 - protein, 17 aa, Plasmodium falciparum
LRQPSFRPFYRGRGAYK

SEQ ID NO: 3366051 - protein, 21 aa, Plasmodium falciparum
LRRQELIDVLYWFNECSPNSD

SEQ ID NO: 3366052 - protein, 30 aa, Plasmodium falciparum
LRRSYMFLKRGGRDFFTRTVHNMNNMNNID

SEQ ID NO: 3366053 - protein, 22 aa, Plasmodium falciparum
LRSDILNSMFGFHIINETHPMK

SEQ ID NO: 3366054 - protein, 18 aa, Plasmodium falciparum
LRSFSIFPNDNEQINSDI

SEQ ID NO: 3366055 - protein, 18 aa, Plasmodium falciparum
LRSGKKCVYSEKPGEDKN

SEQ ID NO: 3366056 - protein, 24 aa, Plasmodium falciparum
LRSGTLPTHLIVGFGEAAKVCSLE

SEQ ID NO: 3366057 - protein, 28 aa, Plasmodium falciparum
LRSLSKCKQIYCFLYMDSNCFSSYNIFE

SEQ ID NO: 3366058 - protein, 26 aa, Plasmodium falciparum
LRSMKCPRCIIGYIYPIKTEALIEAL

SEQ ID NO: 3366059 - protein, 18 aa, Plasmodium falciparum
LRSVSNNMSCSRHTDICN

SEQ ID NO: 3366060 - protein, 18 aa, Plasmodium falciparum
LRSYKYYIDYIIENIYRT

SEQ ID NO: 3366061 - protein, 17 aa, Plasmodium falciparum
LRTIKSLEKIGATVSCN

SEQ ID NO: 3366062 - protein, 21 aa, Plasmodium falciparum
LRTKEKYFFKPIIQTDIITDL

SEQ ID NO: 3366063 - protein, 18 aa, Plasmodium falciparum
LRTNISMDIPFDEQNNNL

SEQ ID NO: 3366064 - protein, 19 aa, Plasmodium falciparum
LRTRKTGFSKFSYQANNRG

SEQ ID NO: 3366065 - protein, 23 aa, Plasmodium falciparum
LRVFCESVLRFGVPPNFASFSIR

SEQ ID NO: 3366066 - protein, 20 aa, Plasmodium falciparum
LRVFCKIKYRNDMLDQFFYN

SEQ ID NO: 3366067 - protein, 22 aa, Plasmodium falciparum
LRVWNIYTSDLIYVYNIKNEYT

SEQ ID NO: 3366068 - protein, 18 aa, Plasmodium falciparum
LRYIPVACPYFIKNKNET

SEQ ID NO: 3366069 - protein, 17 aa, Plasmodium falciparum
LRYKDERILFLQDEQKT

SEQ ID NO: 3366070 - protein, 20 aa, Plasmodium falciparum
LRYKKPFFYNYLPKNVKRKL

SEQ ID NO: 3366071 - protein, 17 aa, Plasmodium falciparum
LRYKRKNTFLIILHFRK

SEQ ID NO: 3366072 - protein, 22 aa, Plasmodium falciparum
LRYSYNGKFLYMFKSTKTNIKQ

SEQ ID NO: 3366073 - protein, 31 aa, Plasmodium falciparum
LSAELQKNEVISFMLNNIFLKEKDISDVLLK

SEQ ID NO: 3366074 - protein, 20 aa, Plasmodium falciparum
LSALRLKEVGLRSFDDQYIE

SEQ ID NO: 3366075 - protein, 18 aa, Plasmodium falciparum
LSAPELMDDFYLNLLDWS

SEQ ID NO: 3366076 - protein, 41 aa, Plasmodium falciparum
LSAVVGIVVKKHFKCVILKKSYFLQWDISDFMGNVVSVYVN

SEQ ID NO: 3366077 - protein, 20 aa, Plasmodium falciparum
LSCDEKLKLLNETSKEITIN

SEQ ID NO: 3366078 - protein, 20 aa, Plasmodium falciparum
LSCSNCIYTRMLNHHHNVIY

SEQ ID NO: 3366079 - protein, 25 aa, Plasmodium falciparum
LSCYGCARTSGLVLHVEKNCTNLCG

SEQ ID NO: 3366080 - protein, 19 aa, Plasmodium falciparum
LSDCEPVDFIYFKKHLIFI

SEQ ID NO: 3366081 - protein, 20 aa, Plasmodium falciparum
LSDEDKFIFDSYLNEENIKK

SEQ ID NO: 3366082 - protein, 19 aa, Plasmodium falciparum
LSDIFKLQVDYLIGTSERG

SEQ ID NO: 3366083 - protein, 22 aa, Plasmodium falciparum
LSDKGICCIDEFDKMDDSARAI

SEQ ID NO: 3366084 - protein, 24 aa, Plasmodium falciparum
LSDLPFWAKPPIEILRIYNYESLY

SEQ ID NO: 3366085 - protein, 27 aa, Plasmodium falciparum
LSDTLRFLGFTIKWGIHENGYWLTNIN

SEQ ID NO: 3366086 - protein, 24 aa, Plasmodium falciparum
LSDTYKVLINFCINEISRNKDQDG

SEQ ID NO: 3366087 - protein, 21 aa, Plasmodium falciparum
LSEEGNVFVTFLFLWNDNLID

SEQ ID NO: 3366088 - protein, 32 aa, Plasmodium falciparum
LSEEIKDGYFLYCIDAYLPLFNSFKLAEELRS

SEQ ID NO: 3366089 - protein, 24 aa, Plasmodium falciparum
LSEGSRNQRCFVEDFEHFISDAIQ

SEQ ID NO: 3366090 - protein, 19 aa, Plasmodium falciparum
LSEHKACITKIIFSDDENY

SEQ ID NO: 3366091 - protein, 25 aa, Plasmodium falciparum
LSEHLKIRIDNEIFMSQELNDYINK

SEQ ID NO: 3366092 - protein, 18 aa, Plasmodium falciparum
LSEIIRCIYAYSLENDLI

SEQ ID NO: 3366093 - protein, 20 aa, Plasmodium falciparum
LSEKCKIPLFSIAMGSEEGY

SEQ ID NO: 3366094 - protein, 22 aa, Plasmodium falciparum
LSELCIWNGSYFNFEDMKRIPI

SEQ ID NO: 3366095 - protein, 40 aa, Plasmodium falciparum
LSENARALEALKYCLPEPLRHVHKTFLPCLKEDPFTKKWL

SEQ ID NO: 3366096 - protein, 31 aa, Plasmodium falciparum
LSENYITCIGLKTLLKYILNYNENIGVNILK

SEQ ID NO: 3366097 - protein, 22 aa, Plasmodium falciparum
LSEQGLNCQLYWENMNPRKYVS

SEQ ID NO: 3366098 - protein, 19 aa, Plasmodium falciparum
LSERKSRRSNIVNHLLPFR

SEQ ID NO: 3366099 - protein, 25 aa, Plasmodium falciparum
LSFDIPYTASITYGFNRGQIFDIMN

SEQ ID NO: 3366100 - protein, 19 aa, Plasmodium falciparum
LSFFIYKMKAIKNEIYEQY

SEQ ID NO: 3366101 - protein, 20 aa, Plasmodium falciparum
LSFLYFFSGHIEKLKKMLSI

SEQ ID NO: 3366102 - protein, 25 aa, Plasmodium falciparum
LSFNLLKDVKFCKIGYEKDDSMGTL

SEQ ID NO: 3366103 - protein, 17 aa, Plasmodium falciparum
LSFNSSREYDYMNLHNN

SEQ ID NO: 3366104 - protein, 17 aa, Plasmodium falciparum
LSFSHLYLSKFVKKVKQ

SEQ ID NO: 3366105 - protein, 23 aa, Plasmodium falciparum
LSFWNFCKYDKINFFSDNNYVKR

SEQ ID NO: 3366106 - protein, 22 aa, Plasmodium falciparum
LSFWQIYSIRVKKNLHLLDASD

SEQ ID NO: 3366107 - protein, 24 aa, Plasmodium falciparum
LSFYQREIDDFLNVIRNLQNIVLI

SEQ ID NO: 3366108 - protein, 18 aa, Plasmodium falciparum
LSGCFFFHSSFTCPISRD

SEQ ID NO: 3366109 - protein, 26 aa, Plasmodium falciparum
LSGGMKMRLCLSRILFSNNDIILLDE

SEQ ID NO: 3366110 - protein, 18 aa, Plasmodium falciparum
LSGLCKFSSCCIDNLRNI

SEQ ID NO: 3366111 - protein, 32 aa, Plasmodium falciparum
LSGNNVCGLLCIKSPWPGMLRTVYGNHQRLIK

SEQ ID NO: 3366112 - protein, 23 aa, Plasmodium falciparum
LSGNRSGVDFSEFSSHFFEEYLN

SEQ ID NO: 3366113 - protein, 32 aa, Plasmodium falciparum
LSHEKHIFIYSLKCSLLIINLLAKLGGTTYII

SEQ ID NO: 3366114 - protein, 17 aa, Plasmodium falciparum
LSHLIREEHICVVKNGK

SEQ ID NO: 3366115 - protein, 25 aa, Plasmodium falciparum
LSHLRRLNTPLGREGKMAKPRQLHN

SEQ ID NO: 3366116 - protein, 24 aa, Plasmodium falciparum
LSHREIYTVLASVGIKKWDINRIL

SEQ ID NO: 3366117 - protein, 19 aa, Plasmodium falciparum
LSIAKSSAYYSIFNNQETV

SEQ ID NO: 3366118 - protein, 17 aa, Plasmodium falciparum
LSIEHLLILCKKMQHKL

SEQ ID NO: 3366119 - protein, 17 aa, Plasmodium falciparum
LSIKGGSNIVCILNCFN

SEQ ID NO: 3366120 - protein, 20 aa, Plasmodium falciparum
LSIKHVKGMILYGPPGTGKT

SEQ ID NO: 3366121 - protein, 26 aa, Plasmodium falciparum
LSIKSCFVRGSVVRYVFLPSNEIDVQ

SEQ ID NO: 3366122 - protein, 23 aa, Plasmodium falciparum
LSILCDVMTQKGYLMSITRHGIN

SEQ ID NO: 3366123 - protein, 19 aa, Plasmodium falciparum
LSINFSVFFTLNLKNELLF

SEQ ID NO: 3366124 - protein, 20 aa, Plasmodium falciparum
LSINIFDALYSLSCLLIDEK

SEQ ID NO: 3366125 - protein, 20 aa, Plasmodium falciparum
LSINKSVCYNQLSIFYKKKI

SEQ ID NO: 3366126 - protein, 18 aa, Plasmodium falciparum
LSINRKEKITGYINEKDN

SEQ ID NO: 3366127 - protein, 21 aa, Plasmodium falciparum
LSINSSTRFEKKNVKNKDFKN

SEQ ID NO: 3366128 - protein, 19 aa, Plasmodium falciparum
LSIPFSVHLNSWTRRNAII

SEQ ID NO: 3366129 - protein, 18 aa, Plasmodium falciparum
LSIRSARITIVRCPINTL

SEQ ID NO: 3366130 - protein, 24 aa, Plasmodium falciparum
LSISHLFKITGYAKVKAIKEYISY

SEQ ID NO: 3366131 - protein, 25 aa, Plasmodium falciparum
LSITSLRKSKVNWDYNNDGRKSDDE

SEQ ID NO: 3366132 - protein, 23 aa, Plasmodium falciparum
LSIVQDCSRCLAIIVDYVNIEEI

SEQ ID NO: 3366133 - protein, 24 aa, Plasmodium falciparum
LSIWIKDLCIFNFILTNNNFKFLA

SEQ ID NO: 3366134 - protein, 23 aa, Plasmodium falciparum
LSIYELINLSSYEFNVVRNVLLC

SEQ ID NO: 3366135 - protein, 22 aa, Plasmodium falciparum
LSKCMKIKISKRKSWVKRNKKW

SEQ ID NO: 3366136 - protein, 24 aa, Plasmodium falciparum
LSKCNREKVQFCILQQKFKYNRKH

SEQ ID NO: 3366137 - protein, 23 aa, Plasmodium falciparum
LSKEFNCIAGLSSLHMDKKFHVW

SEQ ID NO: 3366138 - protein, 17 aa, Plasmodium falciparum
LSKEFNTALQIFKEQLQ

SEQ ID NO: 3366139 - protein, 18 aa, Plasmodium falciparum
LSKESFYFMYGIVKHAKA

SEQ ID NO: 3366140 - protein, 31 aa, Plasmodium falciparum
LSKKLAIEMRARMTGECLISDDGTVFDYSTK

SEQ ID NO: 3366141 - protein, 20 aa, Plasmodium falciparum
LSKKYTFLKIFLHKNEKSTN

SEQ ID NO: 3366142 - protein, 17 aa, Plasmodium falciparum
LSKLRYFIEKGRLDTRF

SEQ ID NO: 3366143 - protein, 25 aa, Plasmodium falciparum
LSKPFYDHCYNFFYVNDLIYFRHYQ

SEQ ID NO: 3366144 - protein, 21 aa, Plasmodium falciparum
LSKYFWPGPLSIIAKAKKEAP

SEQ ID NO: 3366145 - protein, 19 aa, Plasmodium falciparum
LSKYVPWIDINYVVNDKIL

SEQ ID NO: 3366146 - protein, 18 aa, Plasmodium falciparum
LSLCDNYILLIGNKYDIN

SEQ ID NO: 3366147 - protein, 19 aa, Plasmodium falciparum
LSLCTRVDALGNFVEPSIA

SEQ ID NO: 3366148 - protein, 19 aa, Plasmodium falciparum
LSLEKCVDIIYKANLPLTQ

SEQ ID NO: 3366149 - protein, 20 aa, Plasmodium falciparum
LSLFFYSFNYMKRWYMNKGI

SEQ ID NO: 3366150 - protein, 18 aa, Plasmodium falciparum
LSLFSLQRNVVYNNLNNI

SEQ ID NO: 3366151 - protein, 18 aa, Plasmodium falciparum
LSLFSRKKSFKMKNKRKM

SEQ ID NO: 3366152 - protein, 17 aa, Plasmodium falciparum
LSLHEKIRKNRNEDNKE

SEQ ID NO: 3366153 - protein, 17 aa, Plasmodium falciparum
LSLIKHYDYKGIPLNLV

SEQ ID NO: 3366154 - protein, 39 aa, Plasmodium falciparum
LSLLCKEIYLNESFSCYQYEKLFLKKLVYYSFNNLGNNL

SEQ ID NO: 3366155 - protein, 17 aa, Plasmodium falciparum
LSLLPHDFNKENFYLNI

SEQ ID NO: 3366156 - protein, 33 aa, Plasmodium falciparum
LSLNNIQNKECIKKYSLPIIMGGSHVATNSYMN

SEQ ID NO: 3366157 - protein, 19 aa, Plasmodium falciparum
LSLQLSTLFQFLYFSPNHS

SEQ ID NO: 3366158 - protein, 21 aa, Plasmodium falciparum
LSLRLLKQLFHAFINSLDKST

SEQ ID NO: 3366159 - protein, 17 aa, Plasmodium falciparum
LSLRSNENGVIDTVMLS

SEQ ID NO: 3366160 - protein, 17 aa, Plasmodium falciparum
LSLRYDLTVPLYRFINT

SEQ ID NO: 3366161 - protein, 18 aa, Plasmodium falciparum
LSLVKRSCIIKWAKQLKI

SEQ ID NO: 3366162 - protein, 25 aa, Plasmodium falciparum
LSLYYLSEHILQFQKGTIKYILQDL

SEQ ID NO: 3366163 - protein, 21 aa, Plasmodium falciparum
LSMGGCIALRTLETINRLNKE

SEQ ID NO: 3366164 - protein, 19 aa, Plasmodium falciparum
LSNCAKYCLADDVDELNLI

SEQ ID NO: 3366165 - protein, 26 aa, Plasmodium falciparum
LSNDHLEMLLKIFGTIEKIYMDDNEG

SEQ ID NO: 3366166 - protein, 25 aa, Plasmodium falciparum
LSNFFKYIFDILYDMIKKGQIRLSD

SEQ ID NO: 3366167 - protein, 25 aa, Plasmodium falciparum
LSNFLKKNNELFFKDLDKYMNEHIF

SEQ ID NO: 3366168 - protein, 17 aa, Plasmodium falciparum
LSNIKIKSLHRIRIGNI

SEQ ID NO: 3366169 - protein, 20 aa, Plasmodium falciparum
LSNIKLGHFLTNKNKSQNNK

SEQ ID NO: 3366170 - protein, 24 aa, Plasmodium falciparum
LSNIQCSKSRCNLPEKIQDRKCFN

SEQ ID NO: 3366171 - protein, 25 aa, Plasmodium falciparum
LSNKEFKNIIARNVSLSHEFPLIHT

SEQ ID NO: 3366172 - protein, 22 aa, Plasmodium falciparum
LSNKNAGLALDYYVQKLESFKC

SEQ ID NO: 3366173 - protein, 21 aa, Plasmodium falciparum
LSNLCRGKPAPKFEIVSKALP

SEQ ID NO: 3366174 - protein, 19 aa, Plasmodium falciparum
LSNMFTCVKLPKDDTLTSV

SEQ ID NO: 3366175 - protein, 26 aa, Plasmodium falciparum
LSNNCKKLKESIMMMEKYKIIMNNNI

SEQ ID NO: 3366176 - protein, 28 aa, Plasmodium falciparum
LSNNLSFFKYSCMYRKRQLLHEKMLGNW

SEQ ID NO: 3366177 - protein, 23 aa, Plasmodium falciparum
LSNNSGMMNYNMINDMKDENNMN

SEQ ID NO: 3366178 - protein, 27 aa, Plasmodium falciparum
LSNPQRLPELLQMIGRTDPSFLEYIRQ

SEQ ID NO: 3366179 - protein, 21 aa, Plasmodium falciparum
LSNQLPLLSFVTFNNNITHKD

SEQ ID NO: 3366180 - protein, 21 aa, Plasmodium falciparum
LSNYEFLKMICKINKKKSQNY

SEQ ID NO: 3366181 - protein, 22 aa, Plasmodium falciparum
LSPCAIALLLNSFKKLEIKKYD

SEQ ID NO: 3366182 - protein, 24 aa, Plasmodium falciparum
LSPFKRFIINTVMSLRKSNKNGWL

SEQ ID NO: 3366183 - protein, 23 aa, Plasmodium falciparum
LSPHQKVSLKDCYSSDQTPQKIY

SEQ ID NO: 3366184 - protein, 22 aa, Plasmodium falciparum
LSPKKKFFFFFRTIKGRRRKEK

SEQ ID NO: 3366185 - protein, 17 aa, Plasmodium falciparum
LSPLKINVLFKYNECKI

SEQ ID NO: 3366186 - protein, 17 aa, Plasmodium falciparum
LSPRGDTIINRDFRGDI

SEQ ID NO: 3366187 - protein, 18 aa, Plasmodium falciparum
LSQEIYKYINENIDLTSE

SEQ ID NO: 3366188 - protein, 18 aa, Plasmodium falciparum
LSQLAKWKTAEEVASLIR

SEQ ID NO: 3366189 - protein, 19 aa, Plasmodium falciparum
LSRKIAYEYCKSIMKKGGQ

SEQ ID NO: 3366190 - protein, 23 aa, Plasmodium falciparum
LSRLSFIACIGMMTRLNSQFEKG

SEQ ID NO: 3366191 - protein, 20 aa, Plasmodium falciparum
LSSDLLRFITSIYLLQNKEL

SEQ ID NO: 3366192 - protein, 19 aa, Plasmodium falciparum
LSSELEAGKTWKNFITIKK

SEQ ID NO: 3366193 - protein, 19 aa, Plasmodium falciparum
LSSELIELLEKIVLHNSEF

SEQ ID NO: 3366194 - protein, 17 aa, Plasmodium falciparum
LSSFFGKNCYVFNCSDQ

SEQ ID NO: 3366195 - protein, 24 aa, Plasmodium falciparum
LSSGKDVTKCWYLDNNNFDIFNEI

SEQ ID NO: 3366196 - protein, 23 aa, Plasmodium falciparum
LSSHISEFFNYYHISLPILIQQY

SEQ ID NO: 3366197 - protein, 18 aa, Plasmodium falciparum
LSSIKYNIEINRNRNNNR

SEQ ID NO: 3366198 - protein, 21 aa, Plasmodium falciparum
LSSKIERRLKMEKVNDQSNIS

SEQ ID NO: 3366199 - protein, 22 aa, Plasmodium falciparum
LSSKRVLKWKTIIEIHLEVLHD

SEQ ID NO: 3366200 - protein, 21 aa, Plasmodium falciparum
LSSLLKSPYFSSISSYRPCKG

SEQ ID NO: 3366201 - protein, 23 aa, Plasmodium falciparum
LSSLQAVCICPTRELSQQNYDVV

SEQ ID NO: 3366202 - protein, 22 aa, Plasmodium falciparum
LSSNEIHNFYSLYDLYVQLKEK

SEQ ID NO: 3366203 - protein, 18 aa, Plasmodium falciparum
LSSNRKGNHYSRRSGERM

SEQ ID NO: 3366204 - protein, 20 aa, Plasmodium falciparum
LSSRIKGNTIYSFLDIDLLP

SEQ ID NO: 3366205 - protein, 18 aa, Plasmodium falciparum
LSSSSRSYMASYPSSGIK

SEQ ID NO: 3366206 - protein, 18 aa, Plasmodium falciparum
LSSTMCTPASFSSSSSSS

SEQ ID NO: 3366207 - protein, 25 aa, Plasmodium falciparum
LSTEVKSNESPFLFNNNNNNNNNNN

SEQ ID NO: 3366208 - protein, 19 aa, Plasmodium falciparum
LSTKFVNRYNKIVSKLALE

SEQ ID NO: 3366209 - protein, 18 aa, Plasmodium falciparum
LSTKSEIHYNSLKSQKKK

SEQ ID NO: 3366210 - protein, 18 aa, Plasmodium falciparum
LSTLKLRGIENITKVYMR

SEQ ID NO: 3366211 - protein, 25 aa, Plasmodium falciparum
LSTLPYVYCCDIQLIKYFEFLKLKE

SEQ ID NO: 3366212 - protein, 18 aa, Plasmodium falciparum
LSTNTFRNKQIVVNSILK

SEQ ID NO: 3366213 - protein, 18 aa, Plasmodium falciparum
LSTSRSFGDISYKIPRKI

SEQ ID NO: 3366214 - protein, 26 aa, Plasmodium falciparum
LSTTFPFIWKTGIAQLSFAKTGGSLA

SEQ ID NO: 3366215 - protein, 32 aa, Plasmodium falciparum
LSTVLTFLSCIKHSYKLYSERYIRNEKSTDVI

SEQ ID NO: 3366216 - protein, 26 aa, Plasmodium falciparum
LSVELRALYDSCIKGFDMTDKNYIEL

SEQ ID NO: 3366217 - protein, 20 aa, Plasmodium falciparum
LSVFQIRAGRNYTTESFEAD

SEQ ID NO: 3366218 - protein, 18 aa, Plasmodium falciparum
LSVILGVSTPSFFFNRIT

SEQ ID NO: 3366219 - protein, 20 aa, Plasmodium falciparum
LSVLCYNFLNIKKFLYDLSI

SEQ ID NO: 3366220 - protein, 17 aa, Plasmodium falciparum
LSYGLLIWASGLAQTTL

SEQ ID NO: 3366221 - protein, 19 aa, Plasmodium falciparum
LSYIIKNRFRLNVQNFFVY

SEQ ID NO: 3366222 - protein, 25 aa, Plasmodium falciparum
LSYIKGCKQKGIWPITNPTNKVHKA

SEQ ID NO: 3366223 - protein, 22 aa, Plasmodium falciparum
LSYIKGNHINFFSINKILNKTS

SEQ ID NO: 3366224 - protein, 20 aa, Plasmodium falciparum
LSYLICINILIYKSNCCSKG

SEQ ID NO: 3366225 - protein, 18 aa, Plasmodium falciparum
LSYYLGLEEFDEFDDDFD

SEQ ID NO: 3366226 - protein, 18 aa, Plasmodium falciparum
LTACRSIKQEIYLLEEHE

SEQ ID NO: 3366227 - protein, 19 aa, Plasmodium falciparum
LTACYLKLKEYALAIEAAK

SEQ ID NO: 3366228 - protein, 19 aa, Plasmodium falciparum
LTASELMKSLSNGIHLNQK

SEQ ID NO: 3366229 - protein, 18 aa, Plasmodium falciparum
LTAYCMSLIDSLNQEEQL

SEQ ID NO: 3366230 - protein, 24 aa, Plasmodium falciparum
LTCKSFCEYHYWITTIRALMFRSR

SEQ ID NO: 3366231 - protein, 19 aa, Plasmodium falciparum
LTCPICLEDNIISPRITKC

SEQ ID NO: 3366232 - protein, 18 aa, Plasmodium falciparum
LTCRCVFFISPDKKVKAT

SEQ ID NO: 3366233 - protein, 26 aa, Plasmodium falciparum
LTDHQKIWYEWCINEPITTSIHNYNA

SEQ ID NO: 3366234 - protein, 18 aa, Plasmodium falciparum
LTDRSIILNNHMEENDSP

SEQ ID NO: 3366235 - protein, 19 aa, Plasmodium falciparum
LTDVWSLGIILFLLLNHRL

SEQ ID NO: 3366236 - protein, 21 aa, Plasmodium falciparum
LTEEEAFLFNSNYRGQIKAKT

SEQ ID NO: 3366237 - protein, 17 aa, Plasmodium falciparum
LTEELENPINIHRWRNL

SEQ ID NO: 3366238 - protein, 18 aa, Plasmodium falciparum
LTEKCFYSCLISLDNFYV

SEQ ID NO: 3366239 - protein, 20 aa, Plasmodium falciparum
LTEKLNCLKLEKTNEILEFN

SEQ ID NO: 3366240 - protein, 26 aa, Plasmodium falciparum
LTERLEEIIKTWTCEFVNWPNNGKRF

SEQ ID NO: 3366241 - protein, 17 aa, Plasmodium falciparum
LTESSSFHIFDELDVYM

SEQ ID NO: 3366242 - protein, 20 aa, Plasmodium falciparum
LTEYKSFLLCSSSLSHSSSF

SEQ ID NO: 3366243 - protein, 19 aa, Plasmodium falciparum
LTFFQSFIHLYKEGGILYL

SEQ ID NO: 3366244 - protein, 25 aa, Plasmodium falciparum
LTFTPRKIVPLPFPSLFYDHDSSLE

SEQ ID NO: 3366245 - protein, 26 aa, Plasmodium falciparum
LTFVIAMLCKINRTLSSLQAVCICPT

SEQ ID NO: 3366246 - protein, 18 aa, Plasmodium falciparum
LTHCKIKVCPDDQLHFEI

SEQ ID NO: 3366247 - protein, 17 aa, Plasmodium falciparum
LTHICSLTLKQVIKFFI

SEQ ID NO: 3366248 - protein, 27 aa, Plasmodium falciparum
LTHLSRRPKLISVFKKKINSITSRILN

SEQ ID NO: 3366249 - protein, 24 aa, Plasmodium falciparum
LTHNLYQWMTFQLKHFANIFCNGR

SEQ ID NO: 3366250 - protein, 23 aa, Plasmodium falciparum
LTHRKFRFISEQVVHHPPITAYH

SEQ ID NO: 3366251 - protein, 17 aa, Plasmodium falciparum
LTHSFNFISKKDIHKED

SEQ ID NO: 3366252 - protein, 18 aa, Plasmodium falciparum
LTHYLSSFYYKIMNHQID

SEQ ID NO: 3366253 - protein, 19 aa, Plasmodium falciparum
LTICSRAFFSDSLGVCERY

SEQ ID NO: 3366254 - protein, 23 aa, Plasmodium falciparum
LTIKQCLLGGLVTVPTLNGDMDL

SEQ ID NO: 3366255 - protein, 23 aa, Plasmodium falciparum
LTKEIKDKIHIINNLNIKNELLN

SEQ ID NO: 3366256 - protein, 24 aa, Plasmodium falciparum
LTKELKIYILYSLSILLKNYELKK

SEQ ID NO: 3366257 - protein, 31 aa, Plasmodium falciparum
LTKGELKLLSKVLHHKFLLNEISAIGNYEQK

SEQ ID NO: 3366258 - protein, 25 aa, Plasmodium falciparum
LTKHKSEICGLEWNADGTYLASGSN

SEQ ID NO: 3366259 - protein, 26 aa, Plasmodium falciparum
LTKKEKRNNLEFLKERPGKLDATPIK

SEQ ID NO: 3366260 - protein, 36 aa, Plasmodium falciparum
LTKKSGLCKNEKCSYAHSVCELRPTGDLYKTAPCTK

SEQ ID NO: 3366261 - protein, 20 aa, Plasmodium falciparum
LTKLSFLCLNPNIKNRPSSK

SEQ ID NO: 3366262 - protein, 23 aa, Plasmodium falciparum
LTKLSIIFLEEFKYSELANICVA

SEQ ID NO: 3366263 - protein, 22 aa, Plasmodium falciparum
LTKLWIFSLNIYQLVVTDIKFH

SEQ ID NO: 3366264 - protein, 18 aa, Plasmodium falciparum
LTKRCIENYLIQCDVLYP

SEQ ID NO: 3366265 - protein, 19 aa, Plasmodium falciparum
LTKTLDFLAKEEHINPNGN

SEQ ID NO: 3366266 - protein, 17 aa, Plasmodium falciparum
LTLADALVYAEKLGVDY

SEQ ID NO: 3366267 - protein, 17 aa, Plasmodium falciparum
LTLEDAIVFKSFEKDFM

SEQ ID NO: 3366268 - protein, 27 aa, Plasmodium falciparum
LTLINDLKIEFILTFEKFAIGNIKIKK

SEQ ID NO: 3366269 - protein, 30 aa, Plasmodium falciparum
LTLREDQVIYLLSIFFKKIVHLILPQLLNL

SEQ ID NO: 3366270 - protein, 23 aa, Plasmodium falciparum
LTLYFKSIIEFFFGKKNINKDLE

SEQ ID NO: 3366271 - protein, 23 aa, Plasmodium falciparum
LTMKRILTVLSRRAIHDQCLRAK

SEQ ID NO: 3366272 - protein, 18 aa, Plasmodium falciparum
LTMLEIYKHFNLCQLTID

SEQ ID NO: 3366273 - protein, 22 aa, Plasmodium falciparum
LTNCPIKNEVTTLIQKINKFYY

SEQ ID NO: 3366274 - protein, 18 aa, Plasmodium falciparum
LTNLLLFLMPHIFTETNI

SEQ ID NO: 3366275 - protein, 17 aa, Plasmodium falciparum
LTNLNCEKLIVLQNQYN

SEQ ID NO: 3366276 - protein, 24 aa, Plasmodium falciparum
LTNMKRVKEPYAHSNTFVNSKVNH

SEQ ID NO: 3366277 - protein, 18 aa, Plasmodium falciparum
LTNNLGLQAFYHKINHPA

SEQ ID NO: 3366278 - protein, 31 aa, Plasmodium falciparum
LTPDQISALNAHLPNEINIETITSTLTTNNE

SEQ ID NO: 3366279 - protein, 26 aa, Plasmodium falciparum
LTPTFKVKRFHVFKDYAFFINDVKKI

SEQ ID NO: 3366280 - protein, 27 aa, Plasmodium falciparum
LTPTFKVKRFYVFKDYAFFISQVKEIY

SEQ ID NO: 3366281 - protein, 18 aa, Plasmodium falciparum
LTPWSLALLKTFPQFIIK

SEQ ID NO: 3366282 - protein, 23 aa, Plasmodium falciparum
LTPYEVHEALIISEFLETHKTQL

SEQ ID NO: 3366283 - protein, 28 aa, Plasmodium falciparum
LTQVIKCIRKGYSGIVLIAIDVFPINII

SEQ ID NO: 3366284 - protein, 25 aa, Plasmodium falciparum
LTQYRKQVLKGFTFNISLLSDDIKR

SEQ ID NO: 3366285 - protein, 18 aa, Plasmodium falciparum
LTRDKRATINSVLDNRTL

SEQ ID NO: 3366286 - protein, 17 aa, Plasmodium falciparum
LTSAEFKTLPISKRTLR

SEQ ID NO: 3366287 - protein, 23 aa, Plasmodium falciparum
LTSENFYIVRIERISYEYNNTYP

SEQ ID NO: 3366288 - protein, 33 aa, Plasmodium falciparum
LTSESLRFFLPMNGLCLIDYQLHFFKQNNVKKI

SEQ ID NO: 3366289 - protein, 17 aa, Plasmodium falciparum
LTSLDWDHYNTFVSVYS

SEQ ID NO: 3366290 - protein, 20 aa, Plasmodium falciparum
LTSNAWKYTEEGKRRTLQRQ

SEQ ID NO: 3366291 - protein, 19 aa, Plasmodium falciparum
LTSNCLKDNLQNVKNNDDE

SEQ ID NO: 3366292 - protein, 23 aa, Plasmodium falciparum
LTSNGCTFIFWIADWFAHLNNKM

SEQ ID NO: 3366293 - protein, 25 aa, Plasmodium falciparum
LTSNNCPHVLNVSSLNVKNMENQMA

SEQ ID NO: 3366294 - protein, 19 aa, Plasmodium falciparum
LTTEEELFDTPLSFEEVMR

SEQ ID NO: 3366295 - protein, 19 aa, Plasmodium falciparum
LTVPFFKKYLHYVKNIFYH

SEQ ID NO: 3366296 - protein, 17 aa, Plasmodium falciparum
LTYDMIYSLSRFNKIKT

SEQ ID NO: 3366297 - protein, 18 aa, Plasmodium falciparum
LTYNGVMVKCELSDGKMD

SEQ ID NO: 3366298 - protein, 18 aa, Plasmodium falciparum
LVANDWSAFCGMDTTAIE

SEQ ID NO: 3366299 - protein, 18 aa, Plasmodium falciparum
LVASRWFSDLSLQNFFSN

SEQ ID NO: 3366300 - protein, 20 aa, Plasmodium falciparum
LVAVILKGYLIVANAGDSRA

SEQ ID NO: 3366301 - protein, 17 aa, Plasmodium falciparum
LVAVSIRNAEYNPSKIN

SEQ ID NO: 3366302 - protein, 21 aa, Plasmodium falciparum
LVCADTFRAGAFDQLKQNAAK

SEQ ID NO: 3366303 - protein, 20 aa, Plasmodium falciparum
LVCDHLFEIIFDRCGTHVLR

SEQ ID NO: 3366304 - protein, 19 aa, Plasmodium falciparum
LVCHDYKKGNVVLHIPYLT

SEQ ID NO: 3366305 - protein, 20 aa, Plasmodium falciparum
LVCSIIIRYVKTRISYDEII

SEQ ID NO: 3366306 - protein, 18 aa, Plasmodium falciparum
LVCTCGKGNIYVNTIEDN

SEQ ID NO: 3366307 - protein, 19 aa, Plasmodium falciparum
LVDCKYCIDSNSFEKLNKL

SEQ ID NO: 3366308 - protein, 20 aa, Plasmodium falciparum
LVDLCRILYSYMRIKKNYNH

SEQ ID NO: 3366309 - protein, 19 aa, Plasmodium falciparum
LVDNYSIFPSCLNIYNDYL

SEQ ID NO: 3366310 - protein, 22 aa, Plasmodium falciparum
LVEEKNNLLAIIASLTSENMYL

SEQ ID NO: 3366311 - protein, 17 aa, Plasmodium falciparum
LVEICLIHVDFLKNEAY

SEQ ID NO: 3366312 - protein, 24 aa, Plasmodium falciparum
LVESFKTDLLYSIEKNKNDIYAHN

SEQ ID NO: 3366313 - protein, 18 aa, Plasmodium falciparum
LVFDEADKLLSQDFESSI

SEQ ID NO: 3366314 - protein, 27 aa, Plasmodium falciparum
LVFHKNCCISVFNFKYYVGEFCDNLSE

SEQ ID NO: 3366315 - protein, 24 aa, Plasmodium falciparum
LVGAKRRTKRVIATRKKKNARGKY

SEQ ID NO: 3366316 - protein, 23 aa, Plasmodium falciparum
LVGIRTSLILPYTLFNEELILFI

SEQ ID NO: 3366317 - protein, 35 aa, Plasmodium falciparum
LVGITKLDEIIGLMKLVFEKAVTQHHFVQMYVQLC

SEQ ID NO: 3366318 - protein, 17 aa, Plasmodium falciparum
LVGLNEFNEQFFSNSNA

SEQ ID NO: 3366319 - protein, 19 aa, Plasmodium falciparum
LVHECVHKGGKVLIPVFAI

SEQ ID NO: 3366320 - protein, 19 aa, Plasmodium falciparum
LVHHFPKLELNAYIQPINH

SEQ ID NO: 3366321 - protein, 21 aa, Plasmodium falciparum
LVHKLFKGVSLNIHVRQISNR

SEQ ID NO: 3366322 - protein, 17 aa, Plasmodium falciparum
LVIPKQLFVSRLKVDDK

SEQ ID NO: 3366323 - protein, 18 aa, Plasmodium falciparum
LVISCCREKAILRKEIIR

SEQ ID NO: 3366324 - protein, 18 aa, Plasmodium falciparum
LVKDCAATGLFAHIRGIE

SEQ ID NO: 3366325 - protein, 26 aa, Plasmodium falciparum
LVKGGELYDFLLAETRLSEIHANKII

SEQ ID NO: 3366326 - protein, 25 aa, Plasmodium falciparum
LVKNYCLLKELNLLSTIKNEYKEIV

SEQ ID NO: 3366327 - protein, 27 aa, Plasmodium falciparum
LVKVLDLRLALNIYLRCSSHNKILSTY

SEQ ID NO: 3366328 - protein, 25 aa, Plasmodium falciparum
LVLDPLCGYYDTFVLYLDFNSLYPS

SEQ ID NO: 3366329 - protein, 27 aa, Plasmodium falciparum
LVLEIGCGVGNSLIPLLMEYEDCNFIG

SEQ ID NO: 3366330 - protein, 26 aa, Plasmodium falciparum
LVLELSLQCGFSIPPIYDETDMLENL

SEQ ID NO: 3366331 - protein, 18 aa, Plasmodium falciparum
LVLKNMYRNYLVKLLNSS

SEQ ID NO: 3366332 - protein, 18 aa, Plasmodium falciparum
LVLLKCILINPSNFRAHL

SEQ ID NO: 3366333 - protein, 22 aa, Plasmodium falciparum
LVNDIINIFGFLKMEKKKFLFF

SEQ ID NO: 3366334 - protein, 24 aa, Plasmodium falciparum
LVNEKYLRRFITLFQNQYNNIAKH

SEQ ID NO: 3366335 - protein, 17 aa, Plasmodium falciparum
LVNICKKIFLLKYYSAK

SEQ ID NO: 3366336 - protein, 22 aa, Plasmodium falciparum
LVPEELKYIGVLLREKLKKSME

SEQ ID NO: 3366337 - protein, 20 aa, Plasmodium falciparum
LVPEHLRKPALYKDDDLRKH

SEQ ID NO: 3366338 - protein, 19 aa, Plasmodium falciparum
LVPIKFDIGAIYNFPVSQK

SEQ ID NO: 3366339 - protein, 28 aa, Plasmodium falciparum
LVQIICNIIPFKLCNNYKIDTNIIHQYL

SEQ ID NO: 3366340 - protein, 19 aa, Plasmodium falciparum
LVQKYLALPSNENIMATDY

SEQ ID NO: 3366341 - protein, 19 aa, Plasmodium falciparum
LVQNLSLFLKYLKYYNNEE

SEQ ID NO: 3366342 - protein, 19 aa, Plasmodium falciparum
LVSGFSILGSQHMNHTLFL

SEQ ID NO: 3366343 - protein, 24 aa, Plasmodium falciparum
LVSRKLLLEFLKKECIKYNSIVIY

SEQ ID NO: 3366344 - protein, 28 aa, Plasmodium falciparum
LVTKKILWRYNVNFNISIKVAYPKEDDI

SEQ ID NO: 3366345 - protein, 19 aa, Plasmodium falciparum
LVVSILWGIGGSLNLETRE

SEQ ID NO: 3366346 - protein, 18 aa, Plasmodium falciparum
LVWFEWPQIKIPLDDEEL

SEQ ID NO: 3366347 - protein, 24 aa, Plasmodium falciparum
LVYAFKNYYFNIYLKKVHNNNDNN

SEQ ID NO: 3366348 - protein, 27 aa, Plasmodium falciparum
LVYGFKRPCVLDIKMGKRQRKIGASIE

SEQ ID NO: 3366349 - protein, 21 aa, Plasmodium falciparum
LWAKFISYCNFNYSHLGLALE

SEQ ID NO: 3366350 - protein, 17 aa, Plasmodium falciparum
LWHEKVKSRWIYLLSNN

SEQ ID NO: 3366351 - protein, 17 aa, Plasmodium falciparum
LWIQLNVPRIEDGNNFG

SEQ ID NO: 3366352 - protein, 21 aa, Plasmodium falciparum
LWKYIVKDINLIKIFDLFKDI

SEQ ID NO: 3366353 - protein, 18 aa, Plasmodium falciparum
LWLLPYLLTICSFLNNIS

SEQ ID NO: 3366354 - protein, 22 aa, Plasmodium falciparum
LWNDFKDFMLNFIYTIDESSDP

SEQ ID NO: 3366355 - protein, 27 aa, Plasmodium falciparum
LWNNRTIEVTFVWLFITKEFNENRKKY

SEQ ID NO: 3366356 - protein, 26 aa, Plasmodium falciparum
LWREIGEHMFFLWTCAENDMLDLKNP

SEQ ID NO: 3366357 - protein, 19 aa, Plasmodium falciparum
LWVKNLLKDTMKWENEIKD

SEQ ID NO: 3366358 - protein, 34 aa, Plasmodium falciparum
LWVPKGTCKRFLGHSNTAWEMKELAFWNDDVILA

SEQ ID NO: 3366359 - protein, 17 aa, Plasmodium falciparum
LYALRFLGVESDYSLME

SEQ ID NO: 3366360 - protein, 24 aa, Plasmodium falciparum
LYASEIFVLLILRINQFSQNVYDD

SEQ ID NO: 3366361 - protein, 22 aa, Plasmodium falciparum
LYCGIGGLHYSLLQAFNNFVHA

SEQ ID NO: 3366362 - protein, 18 aa, Plasmodium falciparum
LYCNRAIIHYKKKRYIKC

SEQ ID NO: 3366363 - protein, 21 aa, Plasmodium falciparum
LYDCKFYPYFEWNDSNSCFFS

SEQ ID NO: 3366364 - protein, 18 aa, Plasmodium falciparum
LYDEKLSIFSIFVCSTKS

SEQ ID NO: 3366365 - protein, 19 aa, Plasmodium falciparum
LYDKLFYSHFKFIPNKIYK

SEQ ID NO: 3366366 - protein, 26 aa, Plasmodium falciparum
LYDNLKNNIFWNIAISHVERVKSYAP

SEQ ID NO: 3366367 - protein, 19 aa, Plasmodium falciparum
LYDVIKFVITLLKNSYSLE

SEQ ID NO: 3366368 - protein, 24 aa, Plasmodium falciparum
LYDVKWKNVLPGFFKQPPKPQPNL

SEQ ID NO: 3366369 - protein, 18 aa, Plasmodium falciparum
LYECKYHMYGNIICTQPR

SEQ ID NO: 3366370 - protein, 19 aa, Plasmodium falciparum
LYEDGILALILKRMFENIN

SEQ ID NO: 3366371 - protein, 19 aa, Plasmodium falciparum
LYEDHYRVLTGIQYEHNFC

SEQ ID NO: 3366372 - protein, 19 aa, Plasmodium falciparum
LYEDIGIKPPKGVILYGPP

SEQ ID NO: 3366373 - protein, 20 aa, Plasmodium falciparum
LYEFKLWKEKEEDVMRSMFK

SEQ ID NO: 3366374 - protein, 18 aa, Plasmodium falciparum
LYEKKRRVKKMKKHNDKI

SEQ ID NO: 3366375 - protein, 23 aa, Plasmodium falciparum
LYEKLAKLLIKKKIRQRDDLHFD

SEQ ID NO: 3366376 - protein, 18 aa, Plasmodium falciparum
LYEKLNVARNFGIRTLII

SEQ ID NO: 3366377 - protein, 26 aa, Plasmodium falciparum
LYELCKYKTYALCISLSLDGEYMAIL

SEQ ID NO: 3366378 - protein, 33 aa, Plasmodium falciparum
LYELMKRKIIIIQRWFRNRLNIIRKEKLKRQEA

SEQ ID NO: 3366379 - protein, 22 aa, Plasmodium falciparum
LYENVCLNVKPIIISKQRLESG

SEQ ID NO: 3366380 - protein, 26 aa, Plasmodium falciparum
LYEQDINFILPLCVTVNQINKYIQDE

SEQ ID NO: 3366381 - protein, 22 aa, Plasmodium falciparum
LYERRIKSFIFSKLKFNYDNVS

SEQ ID NO: 3366382 - protein, 18 aa, Plasmodium falciparum
LYESFKISLEAIKTADVI

SEQ ID NO: 3366383 - protein, 19 aa, Plasmodium falciparum
LYESLTITQAVVFCNTQMK

SEQ ID NO: 3366384 - protein, 18 aa, Plasmodium falciparum
LYEWFQEKLHIFKTRQIE

SEQ ID NO: 3366385 - protein, 21 aa, Plasmodium falciparum
LYEYDFLSSIEILLIDQIDII

SEQ ID NO: 3366386 - protein, 19 aa, Plasmodium falciparum
LYFDFPYNKNQIIFKPVFY

SEQ ID NO: 3366387 - protein, 19 aa, Plasmodium falciparum
LYFLHDYLEQIILDSYNEK

SEQ ID NO: 3366388 - protein, 23 aa, Plasmodium falciparum
LYFNILFENTWFYEFFYYNHKDD

SEQ ID NO: 3366389 - protein, 19 aa, Plasmodium falciparum
LYFSEGENIILPKEEDMGV

SEQ ID NO: 3366390 - protein, 17 aa, Plasmodium falciparum
LYFYKKKKKEIMKANKS

SEQ ID NO: 3366391 - protein, 18 aa, Plasmodium falciparum
LYHDLCNYVVKKIFVLNV

SEQ ID NO: 3366392 - protein, 18 aa, Plasmodium falciparum
LYHFYKKKKVKLYLCLNK

SEQ ID NO: 3366393 - protein, 19 aa, Plasmodium falciparum
LYHKLIFPYYFKFIRAPYE

SEQ ID NO: 3366394 - protein, 19 aa, Plasmodium falciparum
LYHLFFFFNKERMFIKLLR

SEQ ID NO: 3366395 - protein, 20 aa, Plasmodium falciparum
LYHLKAYHELRIVTLEKSTK

SEQ ID NO: 3366396 - protein, 18 aa, Plasmodium falciparum
LYICNLGDSRAMLIKKDG

SEQ ID NO: 3366397 - protein, 27 aa, Plasmodium falciparum
LYIEGYEPWWLKCVIKKMKIPEEHICC

SEQ ID NO: 3366398 - protein, 17 aa, Plasmodium falciparum
LYIGKYVIIGCGTLICP

SEQ ID NO: 3366399 - protein, 25 aa, Plasmodium falciparum
LYIIFKKYMNWAYEKKRNFLRCRIE

SEQ ID NO: 3366400 - protein, 19 aa, Plasmodium falciparum
LYIIRKCLNLRLWNNDNKT

SEQ ID NO: 3366401 - protein, 19 aa, Plasmodium falciparum
LYIKLKRYDLNNFVINNSQ

SEQ ID NO: 3366402 - protein, 17 aa, Plasmodium falciparum
LYILKKEKEDIYKEYEE

SEQ ID NO: 3366403 - protein, 19 aa, Plasmodium falciparum
LYINCEYYEYAINMLKYFS

SEQ ID NO: 3366404 - protein, 17 aa, Plasmodium falciparum
LYIRELVNIVSNLLTGN

SEQ ID NO: 3366405 - protein, 24 aa, Plasmodium falciparum
LYISEKKLEYVWNEREAFKRAHSN

SEQ ID NO: 3366406 - protein, 23 aa, Plasmodium falciparum
LYISLNEFIYFFSANEKMTKYNF

SEQ ID NO: 3366407 - protein, 18 aa, Plasmodium falciparum
LYITRYIKRKNNNEENDD

SEQ ID NO: 3366408 - protein, 17 aa, Plasmodium falciparum
LYIYNAYFGNMEYNIQN

SEQ ID NO: 3366409 - protein, 21 aa, Plasmodium falciparum
LYKDIGIKIAIFPLSLHEEKN

SEQ ID NO: 3366410 - protein, 19 aa, Plasmodium falciparum
LYKDIKIPLPSYAIPQTNN

SEQ ID NO: 3366411 - protein, 17 aa, Plasmodium falciparum
LYKDIKYKKENIKAIKN

SEQ ID NO: 3366412 - protein, 28 aa, Plasmodium falciparum
LYKDISLRISKDIDMLYYYFKVNRENDQ

SEQ ID NO: 3366413 - protein, 20 aa, Plasmodium falciparum
LYKEYLFYFETFKRKKLLKD

SEQ ID NO: 3366414 - protein, 27 aa, Plasmodium falciparum
LYKGKYIPVGRRIFREKLIKGRKQKSP

SEQ ID NO: 3366415 - protein, 17 aa, Plasmodium falciparum
LYKGVNISFLFSGNSDV

SEQ ID NO: 3366416 - protein, 18 aa, Plasmodium falciparum
LYKKCNFSGYKIYSDGLV

SEQ ID NO: 3366417 - protein, 30 aa, Plasmodium falciparum
LYKKKLLKENVFNLLLKLSKSYEVKYSEVI

SEQ ID NO: 3366418 - protein, 25 aa, Plasmodium falciparum
LYKKLKKNPECIEYTSNDINFCSTI

SEQ ID NO: 3366419 - protein, 26 aa, Plasmodium falciparum
LYKLSDLKDYICNSPSHLMKEKKSSC

SEQ ID NO: 3366420 - protein, 24 aa, Plasmodium falciparum
LYKNICLKGYCNMTTIQKYSIPVI

SEQ ID NO: 3366421 - protein, 23 aa, Plasmodium falciparum
LYKNYKERFDILINELNDSNIKS

SEQ ID NO: 3366422 - protein, 17 aa, Plasmodium falciparum
LYKPIILLKSGKTAKAA

SEQ ID NO: 3366423 - protein, 25 aa, Plasmodium falciparum
LYKRGCIPLIIKNAFLECCKDNSIL

SEQ ID NO: 3366424 - protein, 18 aa, Plasmodium falciparum
LYKRMYKNNSIIKVTGIH

SEQ ID NO: 3366425 - protein, 17 aa, Plasmodium falciparum
LYKTIIFIFKLSNEKNG

SEQ ID NO: 3366426 - protein, 28 aa, Plasmodium falciparum
LYLEMYPEEVAKLFVKVKQWKKEEKKKK

SEQ ID NO: 3366427 - protein, 25 aa, Plasmodium falciparum
LYLESIKTYHIMLLKNITNINNKMN

SEQ ID NO: 3366428 - protein, 17 aa, Plasmodium falciparum
LYLFKYIFNNKEFSLSM

SEQ ID NO: 3366429 - protein, 20 aa, Plasmodium falciparum
LYLGSVCVNGFYLSDLKEET

SEQ ID NO: 3366430 - protein, 19 aa, Plasmodium falciparum
LYLIHIFPNLLILNNSCVE

SEQ ID NO: 3366431 - protein, 24 aa, Plasmodium falciparum
LYLLLSGKLPFPINKNTEMNIQKN

SEQ ID NO: 3366432 - protein, 17 aa, Plasmodium falciparum
LYLLNKRSSLNNNYSPN

SEQ ID NO: 3366433 - protein, 24 aa, Plasmodium falciparum
LYLNKLMEFITFFVVNHRCAYISN

SEQ ID NO: 3366434 - protein, 17 aa, Plasmodium falciparum
LYLSCKLEEDFCRIYKI

SEQ ID NO: 3366435 - protein, 17 aa, Plasmodium falciparum
LYLSILYGVWATGKNNT

SEQ ID NO: 3366436 - protein, 17 aa, Plasmodium falciparum
LYLSKLITINVRTLQSC

SEQ ID NO: 3366437 - protein, 21 aa, Plasmodium falciparum
LYLVLRRGMGLAWKAQNFVTA

SEQ ID NO: 3366438 - protein, 25 aa, Plasmodium falciparum
LYMKLTYLNFEIFKYLKVLDLSNNG

SEQ ID NO: 3366439 - protein, 22 aa, Plasmodium falciparum
LYNCKDYKKTNHFFFNMYENIS

SEQ ID NO: 3366440 - protein, 18 aa, Plasmodium falciparum
LYNHLNKYCSIEQDNKNI

SEQ ID NO: 3366441 - protein, 19 aa, Plasmodium falciparum
LYNIEIIKFINSVKRNKPI

SEQ ID NO: 3366442 - protein, 27 aa, Plasmodium falciparum
LYNLKMHDLHNLKSYDFGLSKDLLKKD

SEQ ID NO: 3366443 - protein, 25 aa, Plasmodium falciparum
LYNNKLHMILSLIILSFYNAKKNMG

SEQ ID NO: 3366444 - protein, 27 aa, Plasmodium falciparum
LYNRNLIQLGLCAFRHGKIYEAHCCLM

SEQ ID NO: 3366445 - protein, 23 aa, Plasmodium falciparum
LYNSKDFAEWIGCKKNDYYNFLS

SEQ ID NO: 3366446 - protein, 18 aa, Plasmodium falciparum
LYNSRLYILGNWNYISKE

SEQ ID NO: 3366447 - protein, 17 aa, Plasmodium falciparum
LYNWCLNTNKLIDKLVD

SEQ ID NO: 3366448 - protein, 25 aa, Plasmodium falciparum
LYNYKKTYNIFSFSNNHIGEHNEIK

SEQ ID NO: 3366449 - protein, 28 aa, Plasmodium falciparum
LYPDEYVNLLTCFANLKIANKDLIKTLC

SEQ ID NO: 3366450 - protein, 18 aa, Plasmodium falciparum
LYPECQLKLQSGKFDTIS

SEQ ID NO: 3366451 - protein, 18 aa, Plasmodium falciparum
LYPNKLEIQAQMNNIHKD

SEQ ID NO: 3366452 - protein, 22 aa, Plasmodium falciparum
LYPNSIPYIYVISTNNNRYRLD

SEQ ID NO: 3366453 - protein, 19 aa, Plasmodium falciparum
LYPSIIIEYNVCFSTLKLK

SEQ ID NO: 3366454 - protein, 24 aa, Plasmodium falciparum
LYPSKVESLILCNSYRKTDNFASI

SEQ ID NO: 3366455 - protein, 30 aa, Plasmodium falciparum
LYQIQRSRYYFALVECYNKEIVEFLYEELN

SEQ ID NO: 3366456 - protein, 24 aa, Plasmodium falciparum
LYQKLKRELANAVNNYKNKIKEFY

SEQ ID NO: 3366457 - protein, 18 aa, Plasmodium falciparum
LYQKRKLDVFRICGQLDY

SEQ ID NO: 3366458 - protein, 23 aa, Plasmodium falciparum
LYQLYRFKINGILADEMGLGKTL

SEQ ID NO: 3366459 - protein, 28 aa, Plasmodium falciparum
LYQRLILFDKLKAIEIIKNAIIYLNENY

SEQ ID NO: 3366460 - protein, 18 aa, Plasmodium falciparum
LYRCHGIMNCTMCCPKGL

SEQ ID NO: 3366461 - protein, 26 aa, Plasmodium falciparum
LYRDNKYVYRHIILSDNVRQYAENKV

SEQ ID NO: 3366462 - protein, 18 aa, Plasmodium falciparum
LYRKCKELNYVIPSTYMK

SEQ ID NO: 3366463 - protein, 17 aa, Plasmodium falciparum
LYRKKIVNSNECNNKNV

SEQ ID NO: 3366464 - protein, 25 aa, Plasmodium falciparum
LYRKRLEYEYLLLMKRWKEIEVENA

SEQ ID NO: 3366465 - protein, 18 aa, Plasmodium falciparum
LYRMFRKRMERINKIKLL

SEQ ID NO: 3366466 - protein, 18 aa, Plasmodium falciparum
LYSGPKYVIDSTASEKSF

SEQ ID NO: 3366467 - protein, 18 aa, Plasmodium falciparum
LYSISLSSYEDFKRRKHK

SEQ ID NO: 3366468 - protein, 18 aa, Plasmodium falciparum
LYSLIRFIEFYPYAYYFC

SEQ ID NO: 3366469 - protein, 33 aa, Plasmodium falciparum
LYSNSYECVRIWSLNNFECLKSIQSLDFNITRV

SEQ ID NO: 3366470 - protein, 19 aa, Plasmodium falciparum
LYSQGNSWNKRKGKGSSIN

SEQ ID NO: 3366471 - protein, 33 aa, Plasmodium falciparum
LYSQIKCLIDTRWLNDEVINFYLSMLQEYNEQH

SEQ ID NO: 3366472 - protein, 24 aa, Plasmodium falciparum
LYSRRFFPYYAFNILAGVDENNKG

SEQ ID NO: 3366473 - protein, 18 aa, Plasmodium falciparum
LYTEKCFEETLPEQTYPE

SEQ ID NO: 3366474 - protein, 19 aa, Plasmodium falciparum
LYTEMEMNGEVLPHMFNSS

SEQ ID NO: 3366475 - protein, 20 aa, Plasmodium falciparum
LYTHLNFTLADFMKMNLWAV

SEQ ID NO: 3366476 - protein, 17 aa, Plasmodium falciparum
LYTICRREKSPIMLIDF

SEQ ID NO: 3366477 - protein, 23 aa, Plasmodium falciparum
LYTLKEFIQFVNLLNKFPSNFTF

SEQ ID NO: 3366478 - protein, 23 aa, Plasmodium falciparum
LYVDKKGIFSFDHMKNKSEVKDQ

SEQ ID NO: 3366479 - protein, 24 aa, Plasmodium falciparum
LYVFQIADALSYLHNFNIIHRDLK

SEQ ID NO: 3366480 - protein, 17 aa, Plasmodium falciparum
LYVRQVIGPIATPDLIC

SEQ ID NO: 3366481 - protein, 21 aa, Plasmodium falciparum
LYVSFRIIQKPGYVFVSSCNR

SEQ ID NO: 3366482 - protein, 25 aa, Plasmodium falciparum
LYWIIVYHIEIPKKINIAYPYFNNI

SEQ ID NO: 3366483 - protein, 17 aa, Plasmodium falciparum
LYYELAIYTNATREYAD

SEQ ID NO: 3366484 - protein, 20 aa, Plasmodium falciparum
LYYIGFTIIHLNYLYELQKE

SEQ ID NO: 3366485 - protein, 20 aa, Plasmodium falciparum
LYYLLYMRKYLFPSLDDPLI

SEQ ID NO: 3366486 - protein, 27 aa, Plasmodium falciparum
LYYNRARTLMHLNKWMDVIENCNNCLK

SEQ ID NO: 3366487 - protein, 17 aa, Plasmodium falciparum
LYYNYIDTFIKEFLGNE

SEQ ID NO: 3366488 - protein, 22 aa, Plasmodium falciparum
LYYRLRNIFPHMEVIGTSAKFG

SEQ ID NO: 3366489 - protein, 22 aa, Plasmodium falciparum
MAADKFDSVFILRVPEEAKQDE

SEQ ID NO: 3366490 - protein, 19 aa, Plasmodium falciparum
MAEPFNKYYKLYIPNNNLH

SEQ ID NO: 3366491 - protein, 25 aa, Plasmodium falciparum
MAEVDPRPHLNIIFIGHVDAGKSTA

SEQ ID NO: 3366492 - protein, 25 aa, Plasmodium falciparum
MAKKLLYKPIEIIVGEKGKTNNNIY

SEQ ID NO: 3366493 - protein, 17 aa, Plasmodium falciparum
MALKWQAHHNIIKNKKD

SEQ ID NO: 3366494 - protein, 37 aa, Plasmodium falciparum
MAPEVFKKKFTIKCDIWSAGVIMFFLFTKSLPFGGNT

SEQ ID NO: 3366495 - protein, 22 aa, Plasmodium falciparum
MASCTFLPEQNNITLTNQKGKE

SEQ ID NO: 3366496 - protein, 17 aa, Plasmodium falciparum
MCAEFHPNLDYIISCSL

SEQ ID NO: 3366497 - protein, 27 aa, Plasmodium falciparum
MCAKKNPFCYSKEVYRKYGESLSMYTI

SEQ ID NO: 3366498 - protein, 22 aa, Plasmodium falciparum
MCCLDYRCYFLLPTILEITEMN

SEQ ID NO: 3366499 - protein, 25 aa, Plasmodium falciparum
MCDLSRSLLSMAIFTTVYLSYIHCN

SEQ ID NO: 3366500 - protein, 19 aa, Plasmodium falciparum
MCDYGSLCSAYILEKKVDP

SEQ ID NO: 3366501 - protein, 19 aa, Plasmodium falciparum
MCGTIKKGQSVRILGEGYT

SEQ ID NO: 3366502 - protein, 18 aa, Plasmodium falciparum
MCILTGDIQIDMKLLQTH

SEQ ID NO: 3366503 - protein, 32 aa, Plasmodium falciparum
MCKKHSVSMGEVIRWFKNMISEHIGKNVLEET

SEQ ID NO: 3366504 - protein, 20 aa, Plasmodium falciparum
MCKNIMPLYIEKLNEFLLSE

SEQ ID NO: 3366505 - protein, 20 aa, Plasmodium falciparum
MCKTEFQAAYLYLIPSSIKA

SEQ ID NO: 3366506 - protein, 21 aa, Plasmodium falciparum
MCLNNLIARCILIDMEPKVIE

SEQ ID NO: 3366507 - protein, 20 aa, Plasmodium falciparum
MCNDIKNCLNYKHIINKIKN

SEQ ID NO: 3366508 - protein, 18 aa, Plasmodium falciparum
MCNKRYILKNILNLIKLC

SEQ ID NO: 3366509 - protein, 27 aa, Plasmodium falciparum
MCPHPGRRSIYNHFSHAHISNSNNMND

SEQ ID NO: 3366510 - protein, 17 aa, Plasmodium falciparum
MCPQYLHLLEIIPLYFS

SEQ ID NO: 3366511 - protein, 21 aa, Plasmodium falciparum
MCPSLGQQCHFDFIKHNINYI

SEQ ID NO: 3366512 - protein, 17 aa, Plasmodium falciparum
MCSDCSTTDEKTSFLYH

SEQ ID NO: 3366513 - protein, 17 aa, Plasmodium falciparum
MCSEYKGKCVVNNELNN

SEQ ID NO: 3366514 - protein, 19 aa, Plasmodium falciparum
MCSNLYKLYHKGMGISPEY

SEQ ID NO: 3366515 - protein, 19 aa, Plasmodium falciparum
MCTPPPMYNQYYMYNGNNM

SEQ ID NO: 3366516 - protein, 23 aa, Plasmodium falciparum
MDDFYKNMVMDPKFFHANMNMNN

SEQ ID NO: 3366517 - protein, 17 aa, Plasmodium falciparum
MDDILNLLEEIKENQLS

SEQ ID NO: 3366518 - protein, 23 aa, Plasmodium falciparum
MDEHLLDIITHYIIKLNKVPLYL

SEQ ID NO: 3366519 - protein, 21 aa, Plasmodium falciparum
MDELGQYLLVPGGDTQNYEHE

SEQ ID NO: 3366520 - protein, 28 aa, Plasmodium falciparum
MDEREMFKYLDTLRHLPSKKGGSQYKLH

SEQ ID NO: 3366521 - protein, 21 aa, Plasmodium falciparum
MDESQFYLKQLESCESNSCVA

SEQ ID NO: 3366522 - protein, 17 aa, Plasmodium falciparum
MDGWKPGQRKVLYGCFK

SEQ ID NO: 3366523 - protein, 17 aa, Plasmodium falciparum
MDIKDNYLFLIGLNAGS

SEQ ID NO: 3366524 - protein, 22 aa, Plasmodium falciparum
MDIKENMLNKMIYRSEKDTLYK

SEQ ID NO: 3366525 - protein, 17 aa, Plasmodium falciparum
MDIKKFLNSLDILENQK

SEQ ID NO: 3366526 - protein, 19 aa, Plasmodium falciparum
MDIYPKIIEDILMEAKQSK

SEQ ID NO: 3366527 - protein, 18 aa, Plasmodium falciparum
MDKGYLTFVFNDGTTTVY

SEQ ID NO: 3366528 - protein, 33 aa, Plasmodium falciparum
MDKQMRPKCIFNWKIAKKSLMKMLHSAHNFYFN

SEQ ID NO: 3366529 - protein, 17 aa, Plasmodium falciparum
MDKYLINPIEAIMKYKS

SEQ ID NO: 3366530 - protein, 21 aa, Plasmodium falciparum
MDLAIKCIECIFFMEKNFKNI

SEQ ID NO: 3366531 - protein, 25 aa, Plasmodium falciparum
MDLKNYKAVQMYKVLPNYKNVQVNK

SEQ ID NO: 3366532 - protein, 17 aa, Plasmodium falciparum
MDLLRALNFPSRDIKVK

SEQ ID NO: 3366533 - protein, 17 aa, Plasmodium falciparum
MDLYYYIERGMQKKINV

SEQ ID NO: 3366534 - protein, 23 aa, Plasmodium falciparum
MDNEQFFKPIIILANKSDDGTSF

SEQ ID NO: 3366535 - protein, 23 aa, Plasmodium falciparum
MDNETSVSFLKIFHDKNTDKEDI

SEQ ID NO: 3366536 - protein, 23 aa, Plasmodium falciparum
MDNFNRYSMNMNFNMQNNNNNQR

SEQ ID NO: 3366537 - protein, 30 aa, Plasmodium falciparum
MDNVYHLTGYLHRLLFLMKELDKKEHKINI

SEQ ID NO: 3366538 - protein, 20 aa, Plasmodium falciparum
MDQLQAIVCLQKLEEIPSPF

SEQ ID NO: 3366539 - protein, 24 aa, Plasmodium falciparum
MDQMEFKRIFQIFTKKDESFDEND

SEQ ID NO: 3366540 - protein, 26 aa, Plasmodium falciparum
MDSIKFSDLVEYQWRNNLNPVNDIKK

SEQ ID NO: 3366541 - protein, 25 aa, Plasmodium falciparum
MDSLKKINILSVRVKSLEKISKKYD

SEQ ID NO: 3366542 - protein, 20 aa, Plasmodium falciparum
MDSRIAICGVNGSGKTTLIK

SEQ ID NO: 3366543 - protein, 19 aa, Plasmodium falciparum
MDTLNIFDILPLLNIYFNF

SEQ ID NO: 3366544 - protein, 25 aa, Plasmodium falciparum
MEAIKKCKPGMFYKNIGTLIDAYVS

SEQ ID NO: 3366545 - protein, 18 aa, Plasmodium falciparum
MEALKHPWLQPNLYKDGL

SEQ ID NO: 3366546 - protein, 19 aa, Plasmodium falciparum
MEALKSSYEKGEFFQKREN

SEQ ID NO: 3366547 - protein, 22 aa, Plasmodium falciparum
MEDIKAYLTVFFRKYDQIKGGV

SEQ ID NO: 3366548 - protein, 19 aa, Plasmodium falciparum
MEEGIRWDPLDFPDNKDCI

SEQ ID NO: 3366549 - protein, 18 aa, Plasmodium falciparum
MEEKRPGDVAPHANNHIL

SEQ ID NO: 3366550 - protein, 24 aa, Plasmodium falciparum
MEENIKNLKTCEAFINQIIDKKII

SEQ ID NO: 3366551 - protein, 29 aa, Plasmodium falciparum
MEEQKKCSLKICRLIHKFNSKNNKKKKNV

SEQ ID NO: 3366552 - protein, 17 aa, Plasmodium falciparum
MEGLTWGKAHKKTPFAF

SEQ ID NO: 3366553 - protein, 22 aa, Plasmodium falciparum
MEHFFSFLLRKTDFITNSHNVD

SEQ ID NO: 3366554 - protein, 17 aa, Plasmodium falciparum
MEHIKYDYIIGENNHYL

SEQ ID NO: 3366555 - protein, 17 aa, Plasmodium falciparum
MEKEIKKETSMELSNDK

SEQ ID NO: 3366556 - protein, 25 aa, Plasmodium falciparum
MEKHSLKFSPKVMPLLMKEKNVKHK

SEQ ID NO: 3366557 - protein, 20 aa, Plasmodium falciparum
MEKLIMFNPVICFEEKEISK

SEQ ID NO: 3366558 - protein, 26 aa, Plasmodium falciparum
MEKLKKLKLAELWKYNSGVEKNETVL

SEQ ID NO: 3366559 - protein, 24 aa, Plasmodium falciparum
MELKLLFERIDEAIKINDIIYKNV

SEQ ID NO: 3366560 - protein, 17 aa, Plasmodium falciparum
MELNVYLLSLPVFNGKI

SEQ ID NO: 3366561 - protein, 21 aa, Plasmodium falciparum
MELRNICLNVGNIIINEKKEY

SEQ ID NO: 3366562 - protein, 19 aa, Plasmodium falciparum
MENGLKPIYVFDGAPPELK

SEQ ID NO: 3366563 - protein, 28 aa, Plasmodium falciparum
MENKRIIKGFGETGCSNLLLDNLVNCEI

SEQ ID NO: 3366564 - protein, 23 aa, Plasmodium falciparum
MEQFLKRHEKMIHNFTLINNPSV

SEQ ID NO: 3366565 - protein, 17 aa, Plasmodium falciparum
MERDCLIAYGVSNLLLE

SEQ ID NO: 3366566 - protein, 19 aa, Plasmodium falciparum
MESGFPLYGTDIIKNTSPI

SEQ ID NO: 3366567 - protein, 17 aa, Plasmodium falciparum
MESLKKGLLDLLIYGDK

SEQ ID NO: 3366568 - protein, 19 aa, Plasmodium falciparum
METELKLNVLHKNVKYNEN

SEQ ID NO: 3366569 - protein, 18 aa, Plasmodium falciparum
METFKCVGNVLGADIMLT

SEQ ID NO: 3366570 - protein, 21 aa, Plasmodium falciparum
METRLRKNIIIQPKKKKDLTY

SEQ ID NO: 3366571 - protein, 27 aa, Plasmodium falciparum
MEYECIINYKLIQSVFNKLGIKKYMDV

SEQ ID NO: 3366572 - protein, 17 aa, Plasmodium falciparum
MEYKKDFLITARKPNIT

SEQ ID NO: 3366573 - protein, 19 aa, Plasmodium falciparum
MFDKKKKKKGFYQKNDLSM

SEQ ID NO: 3366574 - protein, 18 aa, Plasmodium falciparum
MFEKYCSNIKNTLIRDDM

SEQ ID NO: 3366575 - protein, 17 aa, Plasmodium falciparum
MFERIVDVMYEKREEIK

SEQ ID NO: 3366576 - protein, 27 aa, Plasmodium falciparum
MFFNMNDIFYPFTIKNFNLCKNKNEKN

SEQ ID NO: 3366577 - protein, 24 aa, Plasmodium falciparum
MFHDVDNFTSLLLHINNYNEKDFM

SEQ ID NO: 3366578 - protein, 25 aa, Plasmodium falciparum
MFKELKIIPLRLAKNIDEETLETYN

SEQ ID NO: 3366579 - protein, 24 aa, Plasmodium falciparum
MFLEQIYKSFPYSSLPKIISVKQP

SEQ ID NO: 3366580 - protein, 25 aa, Plasmodium falciparum
MFLNLKDFTTFIGHKSQVLKCYVDD

SEQ ID NO: 3366581 - protein, 21 aa, Plasmodium falciparum
MFLNTNIFLLLKFDNIPLHTM

SEQ ID NO: 3366582 - protein, 23 aa, Plasmodium falciparum
MFMKKGNMYNMRYNRYTENSSEK

SEQ ID NO: 3366583 - protein, 19 aa, Plasmodium falciparum
MFNDKFELNDEAKTMDPKE

SEQ ID NO: 3366584 - protein, 19 aa, Plasmodium falciparum
MFNKNAHRIKEDRGKTYYH

SEQ ID NO: 3366585 - protein, 23 aa, Plasmodium falciparum
MFQLPIILYNVLFEKTINSFNDY

SEQ ID NO: 3366586 - protein, 20 aa, Plasmodium falciparum
MFRLLGLYGSNSANWITADI

SEQ ID NO: 3366587 - protein, 29 aa, Plasmodium falciparum
MFRSRKLKISRSILFSHLNDSFLLVTQDD

SEQ ID NO: 3366588 - protein, 25 aa, Plasmodium falciparum
MFSSISGFCKYNFMNESCYLNILWD

SEQ ID NO: 3366589 - protein, 19 aa, Plasmodium falciparum
MGMHADFLGSMDSPRNTKN

SEQ ID NO: 3366590 - protein, 25 aa, Plasmodium falciparum
MGMLDIFGFEVFKNNSLEQLFINIT

SEQ ID NO: 3366591 - protein, 24 aa, Plasmodium falciparum
MGNFYKDEYEILKKKYIHLKENMD

SEQ ID NO: 3366592 - protein, 23 aa, Plasmodium falciparum
MGNNKFSIINKMNNVIHDKQVYN

SEQ ID NO: 3366593 - protein, 17 aa, Plasmodium falciparum
MGPKGINIDEIFMTHFL

SEQ ID NO: 3366594 - protein, 24 aa, Plasmodium falciparum
MGTCVSDKIILCYSNDNDTKMILN

SEQ ID NO: 3366595 - protein, 24 aa, Plasmodium falciparum
MGTLCRSLRVNEHYIHRIYNDVEK

SEQ ID NO: 3366596 - protein, 17 aa, Plasmodium falciparum
MGTMRISDDMLNNSNDI

SEQ ID NO: 3366597 - protein, 24 aa, Plasmodium falciparum
MHDLNWYTFLFLFRMTTYKDIPNY

SEQ ID NO: 3366598 - protein, 23 aa, Plasmodium falciparum
MHIFTSRFLFIGKNINMEDIKNK

SEQ ID NO: 3366599 - protein, 26 aa, Plasmodium falciparum
MHKENVCTHIGNNISHDYILNDHISS

SEQ ID NO: 3366600 - protein, 29 aa, Plasmodium falciparum
MHKVKFLPWEYLNSSLSLIFVVQSKDDYF

SEQ ID NO: 3366601 - protein, 25 aa, Plasmodium falciparum
MHNEGFAMTSLREINILLQLQHDNI

SEQ ID NO: 3366602 - protein, 19 aa, Plasmodium falciparum
MHNLCPIHYYFNGRDYNSD

SEQ ID NO: 3366603 - protein, 24 aa, Plasmodium falciparum
MHQELLYFILKFLLKNKKKKIQKD

SEQ ID NO: 3366604 - protein, 25 aa, Plasmodium falciparum
MHQTNLKTGFPIVITIFSAPNYCDV

SEQ ID NO: 3366605 - protein, 19 aa, Plasmodium falciparum
MHSKFILNEIVDILNEVKL

SEQ ID NO: 3366606 - protein, 17 aa, Plasmodium falciparum
MHYHIKKIIKYKQEKDK

SEQ ID NO: 3366607 - protein, 19 aa, Plasmodium falciparum
MIADVLKIIDKNSEENYKE

SEQ ID NO: 3366608 - protein, 23 aa, Plasmodium falciparum
MICKSHTKLHTNFMVYIQKYYDF

SEQ ID NO: 3366609 - protein, 29 aa, Plasmodium falciparum
MICPDYSSDLNLFFSLYDNIHIERKKYIK

SEQ ID NO: 3366610 - protein, 17 aa, Plasmodium falciparum
MIECVHDYIFLYFNKKA

SEQ ID NO: 3366611 - protein, 35 aa, Plasmodium falciparum
MIEKFPKEEINELFLKECINSFRLQNNKSRKPKEV

SEQ ID NO: 3366612 - protein, 22 aa, Plasmodium falciparum
MIEKKGCVDFIKPLKDDIKALD

SEQ ID NO: 3366613 - protein, 22 aa, Plasmodium falciparum
MIGHSLGGILNRSVLLNLNRKK

SEQ ID NO: 3366614 - protein, 17 aa, Plasmodium falciparum
MIGKYCEDLDPHLAYTA

SEQ ID NO: 3366615 - protein, 24 aa, Plasmodium falciparum
MIHIKEFIQTFCFAKNVEIIMDES

SEQ ID NO: 3366616 - protein, 26 aa, Plasmodium falciparum
MIHIKEFIQTFCFAKNVEIIMDESNL

SEQ ID NO: 3366617 - protein, 18 aa, Plasmodium falciparum
MIINELKDNIDFNELHSR

SEQ ID NO: 3366618 - protein, 18 aa, Plasmodium falciparum
MIINIKTVRLESFHKVYI

SEQ ID NO: 3366619 - protein, 23 aa, Plasmodium falciparum
MIITHLPFHLNIYNILYLLLNAS

SEQ ID NO: 3366620 - protein, 18 aa, Plasmodium falciparum
MIKEAAHMQELLIENFKK

SEQ ID NO: 3366621 - protein, 26 aa, Plasmodium falciparum
MIKILKFLHCFYNFINTYIKKEKDVY

SEQ ID NO: 3366622 - protein, 30 aa, Plasmodium falciparum
MIKKNSLKEGILYKIGKHLHQFKARYYILF

SEQ ID NO: 3366623 - protein, 24 aa, Plasmodium falciparum
MIKYWYTTFDFIKNVNIFYLYDIL

SEQ ID NO: 3366624 - protein, 17 aa, Plasmodium falciparum
MILCAAASDFYIPFDDL

SEQ ID NO: 3366625 - protein, 23 aa, Plasmodium falciparum
MINFKCYSNDYIINMNKKRNKIK

SEQ ID NO: 3366626 - protein, 25 aa, Plasmodium falciparum
MIPKRKKVIIYAWSIKEGFIKSRIS

SEQ ID NO: 3366627 - protein, 27 aa, Plasmodium falciparum
MIQLKSFHLYKLISFPDYNIYQIKTKF

SEQ ID NO: 3366628 - protein, 17 aa, Plasmodium falciparum
MIRYSFDSFNEEFENPI

SEQ ID NO: 3366629 - protein, 19 aa, Plasmodium falciparum
MISELLAITKDHEWTKQID

SEQ ID NO: 3366630 - protein, 23 aa, Plasmodium falciparum
MISSKSCDAEMFFEQLKRENFDF

SEQ ID NO: 3366631 - protein, 18 aa, Plasmodium falciparum
MIVFESIYSMSGHISNIE

SEQ ID NO: 3366632 - protein, 38 aa, Plasmodium falciparum
MIYKTLYDMAIKYGNCLPVEKLELMRMNLQVFGQTGEA

SEQ ID NO: 3366633 - protein, 27 aa, Plasmodium falciparum
MIYTCEWPSLFIEWLPKVYKNDEEYAY

SEQ ID NO: 3366634 - protein, 17 aa, Plasmodium falciparum
MIYYFTLHENMFIIFNY

SEQ ID NO: 3366635 - protein, 22 aa, Plasmodium falciparum
MKAACAQTCRNIFVLDKKYKKE

SEQ ID NO: 3366636 - protein, 18 aa, Plasmodium falciparum
MKAGLALNDNFFKLVSWY

SEQ ID NO: 3366637 - protein, 21 aa, Plasmodium falciparum
MKALIKRAAQLDVDSVLMSMS

SEQ ID NO: 3366638 - protein, 18 aa, Plasmodium falciparum
MKANFIAIKGPEILNKYV

SEQ ID NO: 3366639 - protein, 21 aa, Plasmodium falciparum
MKASFRNVYSPVLYNPYVKPF

SEQ ID NO: 3366640 - protein, 26 aa, Plasmodium falciparum
MKCKGEKPFLLCINKNVLKKNILLEE

SEQ ID NO: 3366641 - protein, 32 aa, Plasmodium falciparum
MKDDELKWKRADIEGFLYIVKRSIKPYYRLII

SEQ ID NO: 3366642 - protein, 24 aa, Plasmodium falciparum
MKDKERICRDFKMLSNMKCKGEKP

SEQ ID NO: 3366643 - protein, 22 aa, Plasmodium falciparum
MKDKFMKWNLRFFKVNHSKYEH

SEQ ID NO: 3366644 - protein, 18 aa, Plasmodium falciparum
MKDLLKNPALCLKNPNQW

SEQ ID NO: 3366645 - protein, 17 aa, Plasmodium falciparum
MKDNYSRKINMQRDKMD

SEQ ID NO: 3366646 - protein, 17 aa, Plasmodium falciparum
MKDTQSWINNKYFNEEK

SEQ ID NO: 3366647 - protein, 25 aa, Plasmodium falciparum
MKEDELLKEHHLYLKKGSEVVPNNQ

SEQ ID NO: 3366648 - protein, 28 aa, Plasmodium falciparum
MKEEILKYKQLIMSSGINEKFEKNFNSS

SEQ ID NO: 3366649 - protein, 25 aa, Plasmodium falciparum
MKEELRKERILMIEEVEKMKVIMLE

SEQ ID NO: 3366650 - protein, 18 aa, Plasmodium falciparum
MKEFKEDNGSLLVFVNIG

SEQ ID NO: 3366651 - protein, 31 aa, Plasmodium falciparum
MKEKKKTLLLSGWSFTFKCETQHLTNVCFQL

SEQ ID NO: 3366652 - protein, 17 aa, Plasmodium falciparum
MKELAFWNDDVILAASD

SEQ ID NO: 3366653 - protein, 18 aa, Plasmodium falciparum
MKELKVIEKIKLKEEKKI

SEQ ID NO: 3366654 - protein, 21 aa, Plasmodium falciparum
MKELYHILCAIKKKNPKAARI

SEQ ID NO: 3366655 - protein, 17 aa, Plasmodium falciparum
MKENCCYVSFNMNKEKN

SEQ ID NO: 3366656 - protein, 21 aa, Plasmodium falciparum
MKENKIRLQETINLQKKMIEK

SEQ ID NO: 3366657 - protein, 17 aa, Plasmodium falciparum
MKESVQVFNNKNVDFLN

SEQ ID NO: 3366658 - protein, 20 aa, Plasmodium falciparum
MKEVHNLPKRILHNDSHASH

SEQ ID NO: 3366659 - protein, 21 aa, Plasmodium falciparum
MKEYMSVPIFKELKSINQLIN

SEQ ID NO: 3366660 - protein, 17 aa, Plasmodium falciparum
MKFFTTKPLILDYFNSE

SEQ ID NO: 3366661 - protein, 17 aa, Plasmodium falciparum
MKFLQLHGKLKQTSRLN

SEQ ID NO: 3366662 - protein, 20 aa, Plasmodium falciparum
MKFVKQYINFLIAQKEKERI

SEQ ID NO: 3366663 - protein, 24 aa, Plasmodium falciparum
MKGFKKGEYMDGISSVPFLSDGKS

SEQ ID NO: 3366664 - protein, 17 aa, Plasmodium falciparum
MKGKYFPVVSLLERTLN

SEQ ID NO: 3366665 - protein, 17 aa, Plasmodium falciparum
MKGSLAYDNINNKIKKK

SEQ ID NO: 3366666 - protein, 18 aa, Plasmodium falciparum
MKHHKTVDHNARKKSKSS

SEQ ID NO: 3366667 - protein, 18 aa, Plasmodium falciparum
MKHIPLSVNNKGYNKSSI

SEQ ID NO: 3366668 - protein, 21 aa, Plasmodium falciparum
MKIFPNLKILISHIKNISNII

SEQ ID NO: 3366669 - protein, 18 aa, Plasmodium falciparum
MKIHIDFKNIYFVKYKYI

SEQ ID NO: 3366670 - protein, 17 aa, Plasmodium falciparum
MKIKEGLMKNGKMGNNI

SEQ ID NO: 3366671 - protein, 22 aa, Plasmodium falciparum
MKIKIQNLLKLIGLLKAQINQK

SEQ ID NO: 3366672 - protein, 20 aa, Plasmodium falciparum
MKIKNLFNLKLDEYEQKMKL

SEQ ID NO: 3366673 - protein, 17 aa, Plasmodium falciparum
MKILHERGYGFSTSAEK

SEQ ID NO: 3366674 - protein, 17 aa, Plasmodium falciparum
MKILLRTRMLEARKQNI

SEQ ID NO: 3366675 - protein, 23 aa, Plasmodium falciparum
MKIPGVKLGRNYIQDMDICSDWL

SEQ ID NO: 3366676 - protein, 19 aa, Plasmodium falciparum
MKIQNKGFKKYSEESNQVN

SEQ ID NO: 3366677 - protein, 21 aa, Plasmodium falciparum
MKISLLNVYQYINFVQTNYGN

SEQ ID NO: 3366678 - protein, 21 aa, Plasmodium falciparum
MKISYPSLALIVFELKAYDTV

SEQ ID NO: 3366679 - protein, 37 aa, Plasmodium falciparum
MKIYIEEIKKWLFIKAINIYKYFSFKKSIELIKKKDY

SEQ ID NO: 3366680 - protein, 21 aa, Plasmodium falciparum
MKKDNGYSFLHLNIYKNNNTY

SEQ ID NO: 3366681 - protein, 23 aa, Plasmodium falciparum
MKKDTCKYLFSIEENHKFLEHEN

SEQ ID NO: 3366682 - protein, 30 aa, Plasmodium falciparum
MKKEERNLCFPLLDLYFLNKNFKWQNLKES

SEQ ID NO: 3366683 - protein, 17 aa, Plasmodium falciparum
MKKEGKNNYSYVKPIMN

SEQ ID NO: 3366684 - protein, 23 aa, Plasmodium falciparum
MKKINWNAYIPFSSVLKEPEISI

SEQ ID NO: 3366685 - protein, 19 aa, Plasmodium falciparum
MKKKEAFKKASQIIKKIKI

SEQ ID NO: 3366686 - protein, 20 aa, Plasmodium falciparum
MKKKFVSFYKFEVEKKNLIL

SEQ ID NO: 3366687 - protein, 23 aa, Plasmodium falciparum
MKKKKKSDLCINHDNHLNNEGDE

SEQ ID NO: 3366688 - protein, 21 aa, Plasmodium falciparum
MKKNLLCIWNGYVMGGGLGIS

SEQ ID NO: 3366689 - protein, 26 aa, Plasmodium falciparum
MKKQFTCCYFRYKEITQYLVHKEKLF

SEQ ID NO: 3366690 - protein, 22 aa, Plasmodium falciparum
MKKRGVEYFLYELFDSPEVVKN

SEQ ID NO: 3366691 - protein, 19 aa, Plasmodium falciparum
MKKVLCTQSLMNMDYEEFD

SEQ ID NO: 3366692 - protein, 23 aa, Plasmodium falciparum
MKKVLKERGVFVIFLPCIEQVYK

SEQ ID NO: 3366693 - protein, 19 aa, Plasmodium falciparum
MKKYIKCIIHNKEKEEFYS

SEQ ID NO: 3366694 - protein, 17 aa, Plasmodium falciparum
MKLENILIFLKALLLEK

SEQ ID NO: 3366695 - protein, 19 aa, Plasmodium falciparum
MKLNMNSNMYMNNNTQNQI

SEQ ID NO: 3366696 - protein, 20 aa, Plasmodium falciparum
MKLPAILCIGFISSFSETLS

SEQ ID NO: 3366697 - protein, 29 aa, Plasmodium falciparum
MKLSECKDFQNAILFKRKILPIVNIPLME

SEQ ID NO: 3366698 - protein, 20 aa, Plasmodium falciparum
MKMDELLFKVVEDIKNFCVI

SEQ ID NO: 3366699 - protein, 19 aa, Plasmodium falciparum
MKMKRIGTINFPTKNSNNI

SEQ ID NO: 3366700 - protein, 23 aa, Plasmodium falciparum
MKMKRKEIDIDFSDTLDCKERIK

SEQ ID NO: 3366701 - protein, 25 aa, Plasmodium falciparum
MKMPKYNFSTPINIYNDYINRYVNT

SEQ ID NO: 3366702 - protein, 23 aa, Plasmodium falciparum
MKNDDIFFCTSLYNKYKMRKSSK

SEQ ID NO: 3366703 - protein, 23 aa, Plasmodium falciparum
MKNDIYLWLLKNVKTYLSKFGCR

SEQ ID NO: 3366704 - protein, 20 aa, Plasmodium falciparum
MKNECSRILQTLQELSNKEI

SEQ ID NO: 3366705 - protein, 19 aa, Plasmodium falciparum
MKNEIGISLSEFILIINFI

SEQ ID NO: 3366706 - protein, 26 aa, Plasmodium falciparum
MKNEKYDECWFLFQHYFERSSDVRKE

SEQ ID NO: 3366707 - protein, 17 aa, Plasmodium falciparum
MKNELIKNINLLNNKIN

SEQ ID NO: 3366708 - protein, 21 aa, Plasmodium falciparum
MKNFIACYTITLSTEGTTVGV

SEQ ID NO: 3366709 - protein, 23 aa, Plasmodium falciparum
MKNFIVPNMNGMVLQNTSVPANV

SEQ ID NO: 3366710 - protein, 19 aa, Plasmodium falciparum
MKNHNPQALPYKNAPKKKK

SEQ ID NO: 3366711 - protein, 22 aa, Plasmodium falciparum
MKNKDLYELVNYLIDKKRLIKH

SEQ ID NO: 3366712 - protein, 22 aa, Plasmodium falciparum
MKNKIKTCCTKYTYKNVLKNRH

SEQ ID NO: 3366713 - protein, 21 aa, Plasmodium falciparum
MKNKMKEIFNFMNNIYNNKQI

SEQ ID NO: 3366714 - protein, 18 aa, Plasmodium falciparum
MKNKTKASNNYLYNKTYH

SEQ ID NO: 3366715 - protein, 21 aa, Plasmodium falciparum
MKNLFCNYLHQLIYSRIPTCK

SEQ ID NO: 3366716 - protein, 21 aa, Plasmodium falciparum
MKNNFKGKINCCSVKKNEISK

SEQ ID NO: 3366717 - protein, 22 aa, Plasmodium falciparum
MKNNILCKETYLNCSGKKDTYK

SEQ ID NO: 3366718 - protein, 21 aa, Plasmodium falciparum
MKNNLSLYDVIKFVITLLKNS

SEQ ID NO: 3366719 - protein, 21 aa, Plasmodium falciparum
MKNNRIEGFGNTVFDNKNNQN

SEQ ID NO: 3366720 - protein, 28 aa, Plasmodium falciparum
MKNSEWLRDSSISSFSCFNVEDDSTRYY

SEQ ID NO: 3366721 - protein, 17 aa, Plasmodium falciparum
MKNVCMVSDNVKAKNTS

SEQ ID NO: 3366722 - protein, 21 aa, Plasmodium falciparum
MKPKHFVLLPTYNSYYSFHLE

SEQ ID NO: 3366723 - protein, 28 aa, Plasmodium falciparum
MKQAHILDGLALLQFFHWCEQKRKTKEL

SEQ ID NO: 3366724 - protein, 24 aa, Plasmodium falciparum
MKQHKPFRSNSCNLINYNNNKIYI

SEQ ID NO: 3366725 - protein, 21 aa, Plasmodium falciparum
MKQLQLLKEKMMKNAKAQKSE

SEQ ID NO: 3366726 - protein, 20 aa, Plasmodium falciparum
MKQNLLIYKSRNDNISPVYE

SEQ ID NO: 3366727 - protein, 17 aa, Plasmodium falciparum
MKQNLYFKPMVTNKKSV

SEQ ID NO: 3366728 - protein, 26 aa, Plasmodium falciparum
MKRCKCDSCICKIRRVEYFVIIKNIY

SEQ ID NO: 3366729 - protein, 27 aa, Plasmodium falciparum
MKRKIHCFENEKCIFLKNDEHTNCRIC

SEQ ID NO: 3366730 - protein, 22 aa, Plasmodium falciparum
MKRKKEGLTDFNIKAYISTLLT

SEQ ID NO: 3366731 - protein, 19 aa, Plasmodium falciparum
MKRRTVKKHIKYDHDNDYD

SEQ ID NO: 3366732 - protein, 27 aa, Plasmodium falciparum
MKRYLTPKMFCKIVLMFLEINSNEYTF

SEQ ID NO: 3366733 - protein, 21 aa, Plasmodium falciparum
MKSALGVRGRLRQPSFRPFYR

SEQ ID NO: 3366734 - protein, 17 aa, Plasmodium falciparum
MKSIPQMEAIYYFEIEN

SEQ ID NO: 3366735 - protein, 18 aa, Plasmodium falciparum
MKSNFDVTSFIFVGTCNS

SEQ ID NO: 3366736 - protein, 20 aa, Plasmodium falciparum
MKSSEFSFRKIMDPPTRKYQ

SEQ ID NO: 3366737 - protein, 21 aa, Plasmodium falciparum
MKSSKKGRCLLTEKEEDFMLL

SEQ ID NO: 3366738 - protein, 19 aa, Plasmodium falciparum
MKSTIYIPSDMSLFNKNKY

SEQ ID NO: 3366739 - protein, 24 aa, Plasmodium falciparum
MKTFHKRIAFCLQLYSDAIKAMQY

SEQ ID NO: 3366740 - protein, 19 aa, Plasmodium falciparum
MKTPSLVDFCKYDNSSPLS

SEQ ID NO: 3366741 - protein, 17 aa, Plasmodium falciparum
MKTQWIFFVSKIYKDTR

SEQ ID NO: 3366742 - protein, 21 aa, Plasmodium falciparum
MKTYICKECSLLKNKNENNNL

SEQ ID NO: 3366743 - protein, 21 aa, Plasmodium falciparum
MKTYQCLEGSKINEILRANET

SEQ ID NO: 3366744 - protein, 24 aa, Plasmodium falciparum
MKVLCIKEGYKINTRESDTFFLSL

SEQ ID NO: 3366745 - protein, 21 aa, Plasmodium falciparum
MKVNNFEWLGYIYFSGTSRSS

SEQ ID NO: 3366746 - protein, 25 aa, Plasmodium falciparum
MKYDLKKKNIKIIALESQIDNNLNM

SEQ ID NO: 3366747 - protein, 23 aa, Plasmodium falciparum
MKYIHMVYRLGMFALHSKIVKSA

SEQ ID NO: 3366748 - protein, 18 aa, Plasmodium falciparum
MKYKDHLNLLKSQVNKGK

SEQ ID NO: 3366749 - protein, 27 aa, Plasmodium falciparum
MKYKDIQIYLCEEINSFSFDRRPLVVK

SEQ ID NO: 3366750 - protein, 20 aa, Plasmodium falciparum
MKYMMQNGIVKWYISITEFL

SEQ ID NO: 3366751 - protein, 25 aa, Plasmodium falciparum
MKYNKMLPLKPDYNVGNDKEHILEL

SEQ ID NO: 3366752 - protein, 18 aa, Plasmodium falciparum
MKYREKLGLFPHIKVIDT

SEQ ID NO: 3366753 - protein, 36 aa, Plasmodium falciparum
MKYTQKDDFLFKEKMSYKFIELQTINSMEQSNKYMT

SEQ ID NO: 3366754 - protein, 17 aa, Plasmodium falciparum
MKYYGVILFSSNLIYYI

SEQ ID NO: 3366755 - protein, 25 aa, Plasmodium falciparum
MLAHSCISTACWHYGENDSFVLRAR

SEQ ID NO: 3366756 - protein, 23 aa, Plasmodium falciparum
MLATFLPYIDYKKINIFKINLNK

SEQ ID NO: 3366757 - protein, 25 aa, Plasmodium falciparum
MLCDGFRLADDIFKWSESLNDLDSF

SEQ ID NO: 3366758 - protein, 23 aa, Plasmodium falciparum
MLCEGKMNKYGFCEYDQNFNDRY

SEQ ID NO: 3366759 - protein, 24 aa, Plasmodium falciparum
MLDELCIIKKCYQQAVEENAMKIK

SEQ ID NO: 3366760 - protein, 22 aa, Plasmodium falciparum
MLDGRFHKMSHIINNIDEKCYD

SEQ ID NO: 3366761 - protein, 21 aa, Plasmodium falciparum
MLDTPLHWREAHKLFVGEANR

SEQ ID NO: 3366762 - protein, 19 aa, Plasmodium falciparum
MLDVDTFGIAAAHYRTNMH

SEQ ID NO: 3366763 - protein, 22 aa, Plasmodium falciparum
MLEIGPRVSYKIFKITDQDKGK

SEQ ID NO: 3366764 - protein, 19 aa, Plasmodium falciparum
MLENANLLEDREHVFEYNI

SEQ ID NO: 3366765 - protein, 18 aa, Plasmodium falciparum
MLFEIIWAIRTCHDKRIA

SEQ ID NO: 3366766 - protein, 26 aa, Plasmodium falciparum
MLFKIPEAIGGYTFINYIENVPNNYI

SEQ ID NO: 3366767 - protein, 18 aa, Plasmodium falciparum
MLFLTEIHMRSKIEKSIF

SEQ ID NO: 3366768 - protein, 25 aa, Plasmodium falciparum
MLFMQKYYHKGGFYQDLFEEGKEEI

SEQ ID NO: 3366769 - protein, 24 aa, Plasmodium falciparum
MLFPKSKIEESLRVLNTLQVDIER

SEQ ID NO: 3366770 - protein, 17 aa, Plasmodium falciparum
MLFTYFHFFLKYIKNTE

SEQ ID NO: 3366771 - protein, 20 aa, Plasmodium falciparum
MLGQLCKIGTGSFDIIIDNQ

SEQ ID NO: 3366772 - protein, 17 aa, Plasmodium falciparum
MLGSMLFYRNVTGHRVI

SEQ ID NO: 3366773 - protein, 34 aa, Plasmodium falciparum
MLHIHDIYFLSSWKIKTAILKTIIAFVSNAYVMN

SEQ ID NO: 3366774 - protein, 22 aa, Plasmodium falciparum
MLHKKRYIDVLQNFLKNFKYVW

SEQ ID NO: 3366775 - protein, 18 aa, Plasmodium falciparum
MLHNYPLKGRNCIIKNVD

SEQ ID NO: 3366776 - protein, 18 aa, Plasmodium falciparum
MLINITIILDRIIEQLII

SEQ ID NO: 3366777 - protein, 23 aa, Plasmodium falciparum
MLKFKRHIGNKIIWGRTNNFFYK

SEQ ID NO: 3366778 - protein, 23 aa, Plasmodium falciparum
MLKFRQCKFRVLISTDIWGRGLD

SEQ ID NO: 3366779 - protein, 24 aa, Plasmodium falciparum
MLKSSKKKCLLIFIKDIKFYTYKN

SEQ ID NO: 3366780 - protein, 18 aa, Plasmodium falciparum
MLKYLTCEIYLNVKNFMK

SEQ ID NO: 3366781 - protein, 18 aa, Plasmodium falciparum
MLMFGLRSLSDFCNPTSK

SEQ ID NO: 3366782 - protein, 24 aa, Plasmodium falciparum
MLNARSIKKWLSLKIKDDENLSKH

SEQ ID NO: 3366783 - protein, 28 aa, Plasmodium falciparum
MLNEFLKKLYIYQIYILKKIVFNKSDIL

SEQ ID NO: 3366784 - protein, 19 aa, Plasmodium falciparum
MLNEFRYNTQLFIDADYRE

SEQ ID NO: 3366785 - protein, 24 aa, Plasmodium falciparum
MLNEKRINSMTLIFKNGDNNWKYL

SEQ ID NO: 3366786 - protein, 26 aa, Plasmodium falciparum
MLNELQGRLPVHVTLSSLTIKDFIDI

SEQ ID NO: 3366787 - protein, 19 aa, Plasmodium falciparum
MLNHSFLFDVLKKIVDQTF

SEQ ID NO: 3366788 - protein, 23 aa, Plasmodium falciparum
MLNKRSYFSIYNFFISLRKGGES

SEQ ID NO: 3366789 - protein, 21 aa, Plasmodium falciparum
MLQVIYEFIFLCIRIYDDDII

SEQ ID NO: 3366790 - protein, 19 aa, Plasmodium falciparum
MLSNFKYSFAVANATDSAK

SEQ ID NO: 3366791 - protein, 25 aa, Plasmodium falciparum
MLSSDLRLPYYLVRTKGIDHIFSSF

SEQ ID NO: 3366792 - protein, 17 aa, Plasmodium falciparum
MLTNYIIQTYSESMTYS

SEQ ID NO: 3366793 - protein, 19 aa, Plasmodium falciparum
MLYAPSFDARIVVYPNEKE

SEQ ID NO: 3366794 - protein, 18 aa, Plasmodium falciparum
MLYSLMVKILEYNYNAHM

SEQ ID NO: 3366795 - protein, 24 aa, Plasmodium falciparum
MLYSRIGKLFGKFRNVALCGYINS

SEQ ID NO: 3366796 - protein, 19 aa, Plasmodium falciparum
MMADARFALLIVDSATALY

SEQ ID NO: 3366797 - protein, 30 aa, Plasmodium falciparum
MMEKASCDCLFCIQHKKILNKDELYLILFK

SEQ ID NO: 3366798 - protein, 17 aa, Plasmodium falciparum
MMIGIRISSIKKFSIND

SEQ ID NO: 3366799 - protein, 30 aa, Plasmodium falciparum
MMKPEHILCYSFYINIEFFLPSAQLIIPSY

SEQ ID NO: 3366800 - protein, 40 aa, Plasmodium falciparum
MMMILKDLFERIKMLQIMNEYKVKCSFIEIYNENICDLLN

SEQ ID NO: 3366801 - protein, 20 aa, Plasmodium falciparum
MMMKNIMHPNVIKNMDENNM

SEQ ID NO: 3366802 - protein, 24 aa, Plasmodium falciparum
MMPGEGQAIAQFVQKGKRIPRRGE

SEQ ID NO: 3366803 - protein, 17 aa, Plasmodium falciparum
MMQYRKGDKKSEDMKED

SEQ ID NO: 3366804 - protein, 24 aa, Plasmodium falciparum
MNCCKQKSVDLCVSSTEKSPSKEN

SEQ ID NO: 3366805 - protein, 24 aa, Plasmodium falciparum
MNCNFYIDDFVSFFSICNTLDNSN

SEQ ID NO: 3366806 - protein, 23 aa, Plasmodium falciparum
MNCNYKPNYNYFINKDLLNNNMT

SEQ ID NO: 3366807 - protein, 18 aa, Plasmodium falciparum
MNDAFKYLINLIMLNNDI

SEQ ID NO: 3366808 - protein, 30 aa, Plasmodium falciparum
MNDECKKHISILCTFRQDFINYVIFLFSKR

SEQ ID NO: 3366809 - protein, 20 aa, Plasmodium falciparum
MNDIKIIYNYLVSYSGVVNN

SEQ ID NO: 3366810 - protein, 18 aa, Plasmodium falciparum
MNDIRLTIYVRFNSEGIN

SEQ ID NO: 3366811 - protein, 21 aa, Plasmodium falciparum
MNDLEKCKTCMEGEKEINDVI

SEQ ID NO: 3366812 - protein, 25 aa, Plasmodium falciparum
MNDMMSLLVHRFWKDQFVKELDILL

SEQ ID NO: 3366813 - protein, 23 aa, Plasmodium falciparum
MNDNICYINDFFLLLDSNLVYNE

SEQ ID NO: 3366814 - protein, 26 aa, Plasmodium falciparum
MNDRNMKRTGHENVINPLKEGYKNNE

SEQ ID NO: 3366815 - protein, 17 aa, Plasmodium falciparum
MNEAVFISGYNVHNNDM

SEQ ID NO: 3366816 - protein, 35 aa, Plasmodium falciparum
MNEIPRNFYCLPQIDNLLIWDVFIMLYSTVYKNAK

SEQ ID NO: 3366817 - protein, 21 aa, Plasmodium falciparum
MNEKRLCYMNPYIDITNMNAL

SEQ ID NO: 3366818 - protein, 18 aa, Plasmodium falciparum
MNENLYLKNIIGVNEKTK

SEQ ID NO: 3366819 - protein, 28 aa, Plasmodium falciparum
MNEYEKNCIWRFRFQLLNRKETLGKFLK

SEQ ID NO: 3366820 - protein, 23 aa, Plasmodium falciparum
MNEYTSFMGMKSYPVAPPPNINH

SEQ ID NO: 3366821 - protein, 17 aa, Plasmodium falciparum
MNFIAAITLIFLKEELA

SEQ ID NO: 3366822 - protein, 20 aa, Plasmodium falciparum
MNFLERLNYYFSKLYYQNNN

SEQ ID NO: 3366823 - protein, 22 aa, Plasmodium falciparum
MNFNNSKGFIINPFNENYKKNN

SEQ ID NO: 3366824 - protein, 17 aa, Plasmodium falciparum
MNGLLHIGHAFTLSKLD

SEQ ID NO: 3366825 - protein, 24 aa, Plasmodium falciparum
MNGNIFKTWELFKREKKYFMSTLA

SEQ ID NO: 3366826 - protein, 21 aa, Plasmodium falciparum
MNHTLFLLCEIHQEIIKHIKL

SEQ ID NO: 3366827 - protein, 27 aa, Plasmodium falciparum
MNICNFSIFELCRFINIIINNNIKHTN

SEQ ID NO: 3366828 - protein, 24 aa, Plasmodium falciparum
MNIGSPLFKCKYNSYSHKPVQIYI

SEQ ID NO: 3366829 - protein, 17 aa, Plasmodium falciparum
MNIKGVILSGGPYSVTE

SEQ ID NO: 3366830 - protein, 23 aa, Plasmodium falciparum
MNILKRSNFLYIYNSINTINEEN

SEQ ID NO: 3366831 - protein, 24 aa, Plasmodium falciparum
MNINTCPIKSPELLKDNKENDMNN

SEQ ID NO: 3366832 - protein, 17 aa, Plasmodium falciparum
MNINVNFSLNNIYDDHY

SEQ ID NO: 3366833 - protein, 18 aa, Plasmodium falciparum
MNISTGIVPCVSSDSTDD

SEQ ID NO: 3366834 - protein, 18 aa, Plasmodium falciparum
MNIYYKKKFTYHNDMNNY

SEQ ID NO: 3366835 - protein, 24 aa, Plasmodium falciparum
MNKDNYLFCLSKYVYVQKKILFYL

SEQ ID NO: 3366836 - protein, 17 aa, Plasmodium falciparum
MNKIPCREIENINDVDF

SEQ ID NO: 3366837 - protein, 18 aa, Plasmodium falciparum
MNKKRSFNKNDNKNVDGV

SEQ ID NO: 3366838 - protein, 24 aa, Plasmodium falciparum
MNKLLKYYKGGFNISTLKKKLKNR

SEQ ID NO: 3366839 - protein, 21 aa, Plasmodium falciparum
MNKNFPRQWNKNNITLSKNQG

SEQ ID NO: 3366840 - protein, 20 aa, Plasmodium falciparum
MNKQLCGPVYYSSDLTYEDF

SEQ ID NO: 3366841 - protein, 23 aa, Plasmodium falciparum
MNKSGPFYSYMHFIVNSNLKQKK

SEQ ID NO: 3366842 - protein, 28 aa, Plasmodium falciparum
MNKSMFKRYPNFMGGYPYNNMNPYNNFN

SEQ ID NO: 3366843 - protein, 19 aa, Plasmodium falciparum
MNLGLSQPSNLCLNNNEKS

SEQ ID NO: 3366844 - protein, 17 aa, Plasmodium falciparum
MNLPAALLTRFDLQFLL

SEQ ID NO: 3366845 - protein, 24 aa, Plasmodium falciparum
MNLPRSNMVAFIWENHLVVYGGIN

SEQ ID NO: 3366846 - protein, 27 aa, Plasmodium falciparum
MNLQGFLNFLSNFIIYFKINLSNMSIG

SEQ ID NO: 3366847 - protein, 19 aa, Plasmodium falciparum
MNMEMSILYNDRIVNNNNK

SEQ ID NO: 3366848 - protein, 17 aa, Plasmodium falciparum
MNMSGSFSNLKKKKSSD

SEQ ID NO: 3366849 - protein, 18 aa, Plasmodium falciparum
MNNEIFCVCHSLKKEDSY

SEQ ID NO: 3366850 - protein, 24 aa, Plasmodium falciparum
MNNFLKNACKYAMDNMFGDENRED

SEQ ID NO: 3366851 - protein, 32 aa, Plasmodium falciparum
MNNIKNILISSVFGRIKWLKIMNESPHAYLYG

SEQ ID NO: 3366852 - protein, 17 aa, Plasmodium falciparum
MNNKLFNDKNIVPSKEN

SEQ ID NO: 3366853 - protein, 26 aa, Plasmodium falciparum
MNNMKDINCKNLNSSNGNAYNISYMF

SEQ ID NO: 3366854 - protein, 18 aa, Plasmodium falciparum
MNNPSFVNNCIEFVENPR

SEQ ID NO: 3366855 - protein, 20 aa, Plasmodium falciparum
MNNSEFYYMFDGFSSNYSTD

SEQ ID NO: 3366856 - protein, 19 aa, Plasmodium falciparum
MNNVGFKLSNKINLDDFFY

SEQ ID NO: 3366857 - protein, 22 aa, Plasmodium falciparum
MNPEVVPPILQLPASTNLIKNV

SEQ ID NO: 3366858 - protein, 17 aa, Plasmodium falciparum
MNPGLNNFNSFNNANYA

SEQ ID NO: 3366859 - protein, 21 aa, Plasmodium falciparum
MNPPKKFPLLLKNKGKSPPFI

SEQ ID NO: 3366860 - protein, 23 aa, Plasmodium falciparum
MNPSFSDLCIIDMDMIEIVSKTK

SEQ ID NO: 3366861 - protein, 18 aa, Plasmodium falciparum
MNRTCKSGIHNGNKNNNN

SEQ ID NO: 3366862 - protein, 42 aa, Plasmodium falciparum
MNSLNMLILPKIKGVRFDKSGRRWVASWSQNGNQKRQYFPVK

SEQ ID NO: 3366863 - protein, 22 aa, Plasmodium falciparum
MNSNCLPHTTSIVKLNRCDESL

SEQ ID NO: 3366864 - protein, 23 aa, Plasmodium falciparum
MNSSTCNLFNPMASCDTYNNAYN

SEQ ID NO: 3366865 - protein, 18 aa, Plasmodium falciparum
MNTDWPKIIFESVRCLKK

SEQ ID NO: 3366866 - protein, 26 aa, Plasmodium falciparum
MNTISYKAKLCFVDLAGSERASATSN

SEQ ID NO: 3366867 - protein, 23 aa, Plasmodium falciparum
MNTLELFLYASILLKSKDINISY

SEQ ID NO: 3366868 - protein, 19 aa, Plasmodium falciparum
MNTLKSAFYKYEDMKLNLN

SEQ ID NO: 3366869 - protein, 27 aa, Plasmodium falciparum
MNVKCICGYSFCWLCLDNWKNHKGGFY

SEQ ID NO: 3366870 - protein, 17 aa, Plasmodium falciparum
MNVKLFYKDIHSENENE

SEQ ID NO: 3366871 - protein, 17 aa, Plasmodium falciparum
MNVVIRCRPMSISEKND

SEQ ID NO: 3366872 - protein, 22 aa, Plasmodium falciparum
MNWKLNLGEIARIWRGGCIIRA

SEQ ID NO: 3366873 - protein, 28 aa, Plasmodium falciparum
MNYIHKCKKKRVLCLDTKHGKNEIKQNE

SEQ ID NO: 3366874 - protein, 24 aa, Plasmodium falciparum
MNYLCSCSKYANVLLRQRNYYKNE

SEQ ID NO: 3366875 - protein, 26 aa, Plasmodium falciparum
MNYRIIYRGRSLKDIDEIAKYNIKFN

SEQ ID NO: 3366876 - protein, 18 aa, Plasmodium falciparum
MNYWKWINNDTIAIVCEK

SEQ ID NO: 3366877 - protein, 19 aa, Plasmodium falciparum
MPADNRLPVSASLKTSEIW

SEQ ID NO: 3366878 - protein, 18 aa, Plasmodium falciparum
MPAIIGVYNTNGLKKEKQ

SEQ ID NO: 3366879 - protein, 19 aa, Plasmodium falciparum
MPERCQAWVDLPETRNMIN

SEQ ID NO: 3366880 - protein, 25 aa, Plasmodium falciparum
MPGITNLRSSHFMSNSSANFMNNSE

SEQ ID NO: 3366881 - protein, 20 aa, Plasmodium falciparum
MPGVVTHRVIRDGNQDTIVI

SEQ ID NO: 3366882 - protein, 17 aa, Plasmodium falciparum
MPIIIYLIKRIFKENYP

SEQ ID NO: 3366883 - protein, 21 aa, Plasmodium falciparum
MPILTFKLFLYSAIVVNNYNS

SEQ ID NO: 3366884 - protein, 20 aa, Plasmodium falciparum
MPINDLIDWNVINKIKNPLS

SEQ ID NO: 3366885 - protein, 19 aa, Plasmodium falciparum
MPKAHSNLSNIIDKIDKLV

SEQ ID NO: 3366886 - protein, 17 aa, Plasmodium falciparum
MPMLLIYVLEYMKSLLS

SEQ ID NO: 3366887 - protein, 21 aa, Plasmodium falciparum
MPNIGRGRRGTYTKRNTKPSV

SEQ ID NO: 3366888 - protein, 20 aa, Plasmodium falciparum
MPNPFEKKGVYGMKENSFYK

SEQ ID NO: 3366889 - protein, 24 aa, Plasmodium falciparum
MPPMKRYFEISELSGGEKSISALA

SEQ ID NO: 3366890 - protein, 21 aa, Plasmodium falciparum
MPSNESCLFNKINNAKTKTPA

SEQ ID NO: 3366891 - protein, 18 aa, Plasmodium falciparum
MPTISGMRRRGYSPDAIK

SEQ ID NO: 3366892 - protein, 20 aa, Plasmodium falciparum
MPYNSSVPFNNSMFSLQRNQ

SEQ ID NO: 3366893 - protein, 29 aa, Plasmodium falciparum
MQDEEYIYHVLEFCSKGSIYSISKNFKKR

SEQ ID NO: 3366894 - protein, 25 aa, Plasmodium falciparum
MQFNDDLFCTCGYDNAFRLINLNDK

SEQ ID NO: 3366895 - protein, 26 aa, Plasmodium falciparum
MQGIKSFPSKNMNPFNTSKLIEHNGS

SEQ ID NO: 3366896 - protein, 17 aa, Plasmodium falciparum
MQICEISNMNALEKDQI

SEQ ID NO: 3366897 - protein, 24 aa, Plasmodium falciparum
MQKAVSLKSKFKVTYNMILKLLIN

SEQ ID NO: 3366898 - protein, 18 aa, Plasmodium falciparum
MQMDPRMQMDPKVQMDSM

SEQ ID NO: 3366899 - protein, 33 aa, Plasmodium falciparum
MQMQKFLVKHMNCVYTLIGRKRIILPNIKNKYR

SEQ ID NO: 3366900 - protein, 32 aa, Plasmodium falciparum
MQQKYFANLFSLHILAVGWNVNKGDGMENNNI

SEQ ID NO: 3366901 - protein, 26 aa, Plasmodium falciparum
MQYIPRARYFLTFCKNEKCNTMLKKY

SEQ ID NO: 3366902 - protein, 19 aa, Plasmodium falciparum
MRICECSNIYLPHQNVLVQ

SEQ ID NO: 3366903 - protein, 20 aa, Plasmodium falciparum
MRIICGHPKGIVSRPSQMEK

SEQ ID NO: 3366904 - protein, 20 aa, Plasmodium falciparum
MRIICHFYAQCLRTLQEYDS

SEQ ID NO: 3366905 - protein, 22 aa, Plasmodium falciparum
MRIKVKYYKWSILIDDTENIFN

SEQ ID NO: 3366906 - protein, 28 aa, Plasmodium falciparum
MRILHAHGWKIIPINAGEWLQLNFDQKK

SEQ ID NO: 3366907 - protein, 23 aa, Plasmodium falciparum
MRKLKSEILHKVTGNISKIKDKK

SEQ ID NO: 3366908 - protein, 28 aa, Plasmodium falciparum
MRKQKWSIYCKEMFSLFFEFNSSFDEHF

SEQ ID NO: 3366909 - protein, 26 aa, Plasmodium falciparum
MRKTKLCKSYILGKCTDNNCIYAHSV

SEQ ID NO: 3366910 - protein, 22 aa, Plasmodium falciparum
MRKTKQPLLYIIYKLKKLNYNN

SEQ ID NO: 3366911 - protein, 25 aa, Plasmodium falciparum
MRLMKTKYCRARILANTVYTNMISD

SEQ ID NO: 3366912 - protein, 20 aa, Plasmodium falciparum
MRLYYFIKMKIDEIYYLDMS

SEQ ID NO: 3366913 - protein, 25 aa, Plasmodium falciparum
MRMEKELPYTYALVDWIREKISSNK

SEQ ID NO: 3366914 - protein, 19 aa, Plasmodium falciparum
MRMTKKVFTKFERLKKKWK

SEQ ID NO: 3366915 - protein, 18 aa, Plasmodium falciparum
MRNKKLDNIIAINDDDNN

SEQ ID NO: 3366916 - protein, 17 aa, Plasmodium falciparum
MRPGNGCPPAFGKCGHH

SEQ ID NO: 3366917 - protein, 18 aa, Plasmodium falciparum
MRPTFEEISRLLFNEIIR

SEQ ID NO: 3366918 - protein, 19 aa, Plasmodium falciparum
MRSMFKKKEEQLIKKFSKK

SEQ ID NO: 3366919 - protein, 19 aa, Plasmodium falciparum
MRSRCDIFNVAHSQDNIKN

SEQ ID NO: 3366920 - protein, 19 aa, Plasmodium falciparum
MRTKSLNFVSRESYGEHKS

SEQ ID NO: 3366921 - protein, 21 aa, Plasmodium falciparum
MRVKPAWRKPRGIDCRVRRRY

SEQ ID NO: 3366922 - protein, 21 aa, Plasmodium falciparum
MRVYGSLMWSLGIVINTPEVN

SEQ ID NO: 3366923 - protein, 17 aa, Plasmodium falciparum
MSASNNFYAYPKIPDIH

SEQ ID NO: 3366924 - protein, 23 aa, Plasmodium falciparum
MSDGLDNMKNCLSISHEYISCDQ

SEQ ID NO: 3366925 - protein, 26 aa, Plasmodium falciparum
MSEASLYEYFNFAALNNNNGSNILGQ

SEQ ID NO: 3366926 - protein, 19 aa, Plasmodium falciparum
MSENCRGSKVYTPVNFDQK

SEQ ID NO: 3366927 - protein, 25 aa, Plasmodium falciparum
MSFNEYSLNPGLSMDDFYKNMVMDP

SEQ ID NO: 3366928 - protein, 31 aa, Plasmodium falciparum
MSFPEERIILSYVKYYYVYRLVNMKKNCDYN

SEQ ID NO: 3366929 - protein, 18 aa, Plasmodium falciparum
MSGHKLYGPKGIGALYIK

SEQ ID NO: 3366930 - protein, 22 aa, Plasmodium falciparum
MSGVTCSLRFPGQLNSDLRKLA

SEQ ID NO: 3366931 - protein, 31 aa, Plasmodium falciparum
MSICKIEIPFCKTEIPIWKFEIPIRKHEQRI

SEQ ID NO: 3366932 - protein, 24 aa, Plasmodium falciparum
MSILCKYSLLYCGKYNHIPRDPYT

SEQ ID NO: 3366933 - protein, 27 aa, Plasmodium falciparum
MSKDCYRLKSFRSVHSVFDKEHTYQEP

SEQ ID NO: 3366934 - protein, 18 aa, Plasmodium falciparum
MSKFYFYIHVKLFTCNVD

SEQ ID NO: 3366935 - protein, 19 aa, Plasmodium falciparum
MSKKEKINIFLKYLKMIDV

SEQ ID NO: 3366936 - protein, 23 aa, Plasmodium falciparum
MSKNDVLILLSFNNNYLAEEKVK

SEQ ID NO: 3366937 - protein, 17 aa, Plasmodium falciparum
MSKNLKKKIEIINNIYR

SEQ ID NO: 3366938 - protein, 36 aa, Plasmodium falciparum
MSKNMPKVRGVWFNSTPQRMGWVGQAYKKCKRIERI

SEQ ID NO: 3366939 - protein, 28 aa, Plasmodium falciparum
MSLKCYKRKKMYYPCIYDWYFDNLNNVK

SEQ ID NO: 3366940 - protein, 21 aa, Plasmodium falciparum
MSMLNDLNKYYGNNNQKFPLN

SEQ ID NO: 3366941 - protein, 23 aa, Plasmodium falciparum
MSNSLCQYKRTHMHNYIYNEDDQ

SEQ ID NO: 3366942 - protein, 22 aa, Plasmodium falciparum
MSNTDLPAWLGFGQQAEGLLTT

SEQ ID NO: 3366943 - protein, 22 aa, Plasmodium falciparum
MSPEYIFNFSLHMNNLHKYCTN

SEQ ID NO: 3366944 - protein, 19 aa, Plasmodium falciparum
MSPLHICVKYGHINIAKFL

SEQ ID NO: 3366945 - protein, 17 aa, Plasmodium falciparum
MSPSRGVLFYGPPGCGK

SEQ ID NO: 3366946 - protein, 24 aa, Plasmodium falciparum
MSRLKNEMNRRIILEKNYKKLKEF

SEQ ID NO: 3366947 - protein, 20 aa, Plasmodium falciparum
MSSGIKEFINFLKLNFPEEN

SEQ ID NO: 3366948 - protein, 29 aa, Plasmodium falciparum
MSSIFSEKIYKYALIFSPILKNDGCVSLL

SEQ ID NO: 3366949 - protein, 22 aa, Plasmodium falciparum
MSYCAYHLGKLSGRNIFDGLSN

SEQ ID NO: 3366950 - protein, 29 aa, Plasmodium falciparum
MSYEDFKGLFKHNACLISEYEYNNDKSST

SEQ ID NO: 3366951 - protein, 24 aa, Plasmodium falciparum
MSYPDRYEELGSHLKDIEWDNVKY

SEQ ID NO: 3366952 - protein, 18 aa, Plasmodium falciparum
MTEMLNARVAKKGNKIEL

SEQ ID NO: 3366953 - protein, 19 aa, Plasmodium falciparum
MTGAVPIEILTFGYEKIIE

SEQ ID NO: 3366954 - protein, 31 aa, Plasmodium falciparum
MTGHLFSSRFYRRFGKSLIRILIDMYDFKIT

SEQ ID NO: 3366955 - protein, 25 aa, Plasmodium falciparum
MTGLEALRIWKYLLTNSEEKINDEL

SEQ ID NO: 3366956 - protein, 18 aa, Plasmodium falciparum
MTINKCIENLNNDDYAEV

SEQ ID NO: 3366957 - protein, 18 aa, Plasmodium falciparum
MTIREARQKLLQLEIDSS

SEQ ID NO: 3366958 - protein, 17 aa, Plasmodium falciparum
MTKQLYLRLKIKNLKAK

SEQ ID NO: 3366959 - protein, 22 aa, Plasmodium falciparum
MTMKYKCVEINLHFYDENGELM

SEQ ID NO: 3366960 - protein, 34 aa, Plasmodium falciparum
MTNPMLFFEKYNYMGLKYGALKVIPPSFFSPQFN

SEQ ID NO: 3366961 - protein, 19 aa, Plasmodium falciparum
MTSIKSVDGENRMNNTINM

SEQ ID NO: 3366962 - protein, 28 aa, Plasmodium falciparum
MTSKDCMYEKFMLYNLFSYNITCLKSSL

SEQ ID NO: 3366963 - protein, 27 aa, Plasmodium falciparum
MTSNTSVKCNINWFFPGKHLFESDFLR

SEQ ID NO: 3366964 - protein, 24 aa, Plasmodium falciparum
MTTRLRSGARLRIRERTASVSSNG

SEQ ID NO: 3366965 - protein, 17 aa, Plasmodium falciparum
MTTYGITLLNFFNQVSL

SEQ ID NO: 3366966 - protein, 24 aa, Plasmodium falciparum
MTYDKIFLYEHVKHNGSFDPVSRE

SEQ ID NO: 3366967 - protein, 40 aa, Plasmodium falciparum
MVDGLKQNAFCPLRKSINKDIPFFINYDILLKNCKQDKNY

SEQ ID NO: 3366968 - protein, 18 aa, Plasmodium falciparum
MVEAKCDAISKRIINYIK

SEQ ID NO: 3366969 - protein, 18 aa, Plasmodium falciparum
MVIEEMDDILNLLEEIKE

SEQ ID NO: 3366970 - protein, 18 aa, Plasmodium falciparum
MVILDEADKIIYLGTQDK

SEQ ID NO: 3366971 - protein, 27 aa, Plasmodium falciparum
MVKMLEIFGNVIKWQRQRNPSTNELMA

SEQ ID NO: 3366972 - protein, 25 aa, Plasmodium falciparum
MVKVKGCNMRKLFVDNKFVYIEKKI

SEQ ID NO: 3366973 - protein, 17 aa, Plasmodium falciparum
MVLDTLVVQGLNKKQND

SEQ ID NO: 3366974 - protein, 23 aa, Plasmodium falciparum
MVLEIPIPQFVGSMCNVGTSEGE

SEQ ID NO: 3366975 - protein, 19 aa, Plasmodium falciparum
MVLPTCFVSSISDPDQATQ

SEQ ID NO: 3366976 - protein, 17 aa, Plasmodium falciparum
MVLPVPCLNVINGGSHA

SEQ ID NO: 3366977 - protein, 23 aa, Plasmodium falciparum
MVPLPRYCCVNGIPLSDFTKKGA

SEQ ID NO: 3366978 - protein, 24 aa, Plasmodium falciparum
MVPLRSCVFLLQNIMKNINIKLNE

SEQ ID NO: 3366979 - protein, 17 aa, Plasmodium falciparum
MVQERIIPVPKKIVKEK

SEQ ID NO: 3366980 - protein, 17 aa, Plasmodium falciparum
MVQIKCREALYDEIREC

SEQ ID NO: 3366981 - protein, 18 aa, Plasmodium falciparum
MVRKCHRIILGLLPHSQP

SEQ ID NO: 3366982 - protein, 27 aa, Plasmodium falciparum
MVRKYCVRHLLGYVVAKSRENIKIKFN

SEQ ID NO: 3366983 - protein, 21 aa, Plasmodium falciparum
MVSGPKFSYTEKVYKNDNNHN

SEQ ID NO: 3366984 - protein, 19 aa, Plasmodium falciparum
MVSIELLKNMGIQENNVQS

SEQ ID NO: 3366985 - protein, 18 aa, Plasmodium falciparum
MVSYNCKYDNKIYINNNI

SEQ ID NO: 3366986 - protein, 20 aa, Plasmodium falciparum
MVTKCMNEAVFISGYNVHNN

SEQ ID NO: 3366987 - protein, 18 aa, Plasmodium falciparum
MWCPYLRNHKIIYYGSQS

SEQ ID NO: 3366988 - protein, 17 aa, Plasmodium falciparum
MWIALARLCTYTEAQKV

SEQ ID NO: 3366989 - protein, 21 aa, Plasmodium falciparum
MWSFGCIFAELLLQKALFPGE

SEQ ID NO: 3366990 - protein, 17 aa, Plasmodium falciparum
MWSHKHITLPRVYEKKN

SEQ ID NO: 3366991 - protein, 17 aa, Plasmodium falciparum
MWSKMCERRMYVLSVSH

SEQ ID NO: 3366992 - protein, 52 aa, Plasmodium falciparum
MYAQNSIDFLKLSGINFEKHQSLGIELLHFGEVIMSSGLVMNEDVKWISFHG

SEQ ID NO: 3366993 - protein, 17 aa, Plasmodium falciparum
MYDGFYFFLSNNKSPHF

SEQ ID NO: 3366994 - protein, 24 aa, Plasmodium falciparum
MYDIKVPIKKYFQGLKKINNLLSK

SEQ ID NO: 3366995 - protein, 29 aa, Plasmodium falciparum
MYDKIYLYNKFHLCYICSSYNINIVSFNY

SEQ ID NO: 3366996 - protein, 27 aa, Plasmodium falciparum
MYDMKCPKINVSNMVRFNVENELRKIQ

SEQ ID NO: 3366997 - protein, 25 aa, Plasmodium falciparum
MYDNVKIGLNQGVDIFRTPMRNYNV

SEQ ID NO: 3366998 - protein, 17 aa, Plasmodium falciparum
MYEGCMVNGDECKNEQV

SEQ ID NO: 3366999 - protein, 18 aa, Plasmodium falciparum
MYEMKRYNNDKCDDNNKC

SEQ ID NO: 3367000 - protein, 22 aa, Plasmodium falciparum
MYGNKKKKDFIKMIENSSFGPA

SEQ ID NO: 3367001 - protein, 17 aa, Plasmodium falciparum
MYGSYYINFLSYVSQEN

SEQ ID NO: 3367002 - protein, 22 aa, Plasmodium falciparum
MYHFKILHNLFFQTIKYIYPKK

SEQ ID NO: 3367003 - protein, 28 aa, Plasmodium falciparum
MYHRIYNCYTRLYINDDFLLINNKTKEI

SEQ ID NO: 3367004 - protein, 20 aa, Plasmodium falciparum
MYIAILALDLRRKIGNLKEN

SEQ ID NO: 3367005 - protein, 17 aa, Plasmodium falciparum
MYIDCLSIFPLSSKKYL

SEQ ID NO: 3367006 - protein, 30 aa, Plasmodium falciparum
MYIFKKVCGKIFNFFQSFFFMDYLINKYID

SEQ ID NO: 3367007 - protein, 19 aa, Plasmodium falciparum
MYIHFTVFLIYYEFNIIET

SEQ ID NO: 3367008 - protein, 21 aa, Plasmodium falciparum
MYIKTFLKLYKYLNINKKEEE

SEQ ID NO: 3367009 - protein, 20 aa, Plasmodium falciparum
MYILDEIDAALDLNHTQNIG

SEQ ID NO: 3367010 - protein, 22 aa, Plasmodium falciparum
MYINIRMLNEFMISRNMRPMAF

SEQ ID NO: 3367011 - protein, 19 aa, Plasmodium falciparum
MYIQNCLKKNNILYIYTYQ

SEQ ID NO: 3367012 - protein, 25 aa, Plasmodium falciparum
MYISEWKILVCLSSESCEVVVYTHN

SEQ ID NO: 3367013 - protein, 32 aa, Plasmodium falciparum
MYKDLKYYFLNCSWDLVMFECDENVFPQTNKQ

SEQ ID NO: 3367014 - protein, 21 aa, Plasmodium falciparum
MYKFFELMNSFGIILTNDEKA

SEQ ID NO: 3367015 - protein, 38 aa, Plasmodium falciparum
MYKLSILKKAFKLRKLFEVYNEHGFNYILRSMNKIQLI

SEQ ID NO: 3367016 - protein, 21 aa, Plasmodium falciparum
MYKNCFVNITWSFIVANYHKT

SEQ ID NO: 3367017 - protein, 20 aa, Plasmodium falciparum
MYKNECGRLRELLVKENYDK

SEQ ID NO: 3367018 - protein, 22 aa, Plasmodium falciparum
MYKTLLVSLLYEKKCFKNLDNN

SEQ ID NO: 3367019 - protein, 19 aa, Plasmodium falciparum
MYLCKSHFYVSLKHNISFI

SEQ ID NO: 3367020 - protein, 17 aa, Plasmodium falciparum
MYLIKSYHKTASLFSHL

SEQ ID NO: 3367021 - protein, 21 aa, Plasmodium falciparum
MYLQKYSCSWDEWNNESKKSK

SEQ ID NO: 3367022 - protein, 19 aa, Plasmodium falciparum
MYLSKELEENILLDEDPCE

SEQ ID NO: 3367023 - protein, 25 aa, Plasmodium falciparum
MYMTDGMFLRLLLYNPTLEDISVLI

SEQ ID NO: 3367024 - protein, 21 aa, Plasmodium falciparum
MYNMVPWTKSLVEYKNYNNVD

SEQ ID NO: 3367025 - protein, 23 aa, Plasmodium falciparum
MYNYEWIKNLSYEKCIDYITKNS

SEQ ID NO: 3367026 - protein, 25 aa, Plasmodium falciparum
MYPQHLNFQRENYILNGYTHNIDNH

SEQ ID NO: 3367027 - protein, 23 aa, Plasmodium falciparum
MYQIKNRAFDIYLNESTKNRIET

SEQ ID NO: 3367028 - protein, 23 aa, Plasmodium falciparum
MYSVFPKWIRSYRDLPLKLNQWN

SEQ ID NO: 3367029 - protein, 26 aa, Plasmodium falciparum
MYTCSYNSVMAWQFYDKKAIYLKNID

SEQ ID NO: 3367030 - protein, 24 aa, Plasmodium falciparum
MYYFSFSLCGIIVDMFKKEMVDNE

SEQ ID NO: 3367031 - protein, 17 aa, Plasmodium falciparum
MYYKHNELLNEYNTIDD

SEQ ID NO: 3367032 - protein, 26 aa, Plasmodium falciparum
MYYNEFNSSILFSIPPDDMYVARQNV

SEQ ID NO: 3367033 - protein, 18 aa, Plasmodium falciparum
NADFKDDHIEIILDNKNI

SEQ ID NO: 3367034 - protein, 21 aa, Plasmodium falciparum
NADQCSFVYTGIVKDEYFKND

SEQ ID NO: 3367035 - protein, 19 aa, Plasmodium falciparum
NAEFYIWLDDQIKRYMKGK

SEQ ID NO: 3367036 - protein, 17 aa, Plasmodium falciparum
NAELLKCDEKKTEGNLS

SEQ ID NO: 3367037 - protein, 32 aa, Plasmodium falciparum
NAESKNRPFEYLRLTSLGVIGALVKVDNPEVI

SEQ ID NO: 3367038 - protein, 17 aa, Plasmodium falciparum
NAESMLLTGDKLKESID

SEQ ID NO: 3367039 - protein, 24 aa, Plasmodium falciparum
NAEWSLDKNKGFRNIFDRGILQLY

SEQ ID NO: 3367040 - protein, 21 aa, Plasmodium falciparum
NAFIDICLLFHNYNYIKKLIL

SEQ ID NO: 3367041 - protein, 18 aa, Plasmodium falciparum
NAFSLPVNIYINKLSFFS

SEQ ID NO: 3367042 - protein, 22 aa, Plasmodium falciparum
NAGDSRAIVCFNGNSLGMSTDH

SEQ ID NO: 3367043 - protein, 17 aa, Plasmodium falciparum
NAGKCIYDGKMVKPDKR

SEQ ID NO: 3367044 - protein, 17 aa, Plasmodium falciparum
NAGLEFEAKLGDKKLNK

SEQ ID NO: 3367045 - protein, 21 aa, Plasmodium falciparum
NAHVHDGLKIGIREVIKSIES

SEQ ID NO: 3367046 - protein, 19 aa, Plasmodium falciparum
NAIFKHLFLHNNLESSIPK

SEQ ID NO: 3367047 - protein, 27 aa, Plasmodium falciparum
NAIKKERLSRLFLYIEDIHKLKQALKV

SEQ ID NO: 3367048 - protein, 18 aa, Plasmodium falciparum
NAITCIHTIIKHHGVDII

SEQ ID NO: 3367049 - protein, 23 aa, Plasmodium falciparum
NAKAKIGLVFSYWKKVANNDFSK

SEQ ID NO: 3367050 - protein, 22 aa, Plasmodium falciparum
NAKASLIWIIGEYVERIDNADE

SEQ ID NO: 3367051 - protein, 25 aa, Plasmodium falciparum
NAKELLGVCSCSFINEKTLIKNSIW

SEQ ID NO: 3367052 - protein, 17 aa, Plasmodium falciparum
NAKFFTKHITSLCDILF

SEQ ID NO: 3367053 - protein, 24 aa, Plasmodium falciparum
NAKHKECIRHRFIHNIFDYIKDIF

SEQ ID NO: 3367054 - protein, 23 aa, Plasmodium falciparum
NAKKNMGCYFLLDVLMKTINYYK

SEQ ID NO: 3367055 - protein, 25 aa, Plasmodium falciparum
NAKSEMKNGLFLKKNVEVNKNDEIG

SEQ ID NO: 3367056 - protein, 19 aa, Plasmodium falciparum
NAKSFFGLDPQKKFHISDE

SEQ ID NO: 3367057 - protein, 17 aa, Plasmodium falciparum
NALEMMIDQNSIDNDDS

SEQ ID NO: 3367058 - protein, 23 aa, Plasmodium falciparum
NALHISYMNPFYFKKTDELQKKD

SEQ ID NO: 3367059 - protein, 18 aa, Plasmodium falciparum
NALINYVYLNKGNVYKNV

SEQ ID NO: 3367060 - protein, 18 aa, Plasmodium falciparum
NALKAAFMVLKKVGGKLL

SEQ ID NO: 3367061 - protein, 28 aa, Plasmodium falciparum
NALRKIRTPCYMKLLVVKQGDPLEYKFF

SEQ ID NO: 3367062 - protein, 26 aa, Plasmodium falciparum
NALRQRWRRIQVSDDMKKDIIPKNIL

SEQ ID NO: 3367063 - protein, 18 aa, Plasmodium falciparum
NALYPGYIFYHILNTPFY

SEQ ID NO: 3367064 - protein, 20 aa, Plasmodium falciparum
NANATFWSIFGYEDKPNENI

SEQ ID NO: 3367065 - protein, 27 aa, Plasmodium falciparum
NANILIDLCAAPGGWLQVAYKNMSKQS

SEQ ID NO: 3367066 - protein, 24 aa, Plasmodium falciparum
NANKTCKDYRTLRHKEELHEQILF

SEQ ID NO: 3367067 - protein, 26 aa, Plasmodium falciparum
NANTKSLFLCYDWLKEKLMFSKIFPF

SEQ ID NO: 3367068 - protein, 23 aa, Plasmodium falciparum
NANVYNIYPTVPYNKNYEKNLKN

SEQ ID NO: 3367069 - protein, 23 aa, Plasmodium falciparum
NAPHPYKNSVLMNPSRKTRNSKN

SEQ ID NO: 3367070 - protein, 23 aa, Plasmodium falciparum
NARILEAIKMRWIKIYEQKLRNK

SEQ ID NO: 3367071 - protein, 20 aa, Plasmodium falciparum
NARNRMYIDYDKIIREIYER

SEQ ID NO: 3367072 - protein, 20 aa, Plasmodium falciparum
NARSRLSYEQFNQFLSNIKK

SEQ ID NO: 3367073 - protein, 17 aa, Plasmodium falciparum
NASIRNKICMYEKKKSM

SEQ ID NO: 3367074 - protein, 17 aa, Plasmodium falciparum
NASYNFVDVMLLTLDSL

SEQ ID NO: 3367075 - protein, 21 aa, Plasmodium falciparum
NAVCEFCGGSGDSLKIKEMVK

SEQ ID NO: 3367076 - protein, 24 aa, Plasmodium falciparum
NAVENRGSIKYNLIKERQEFMYEP

SEQ ID NO: 3367077 - protein, 25 aa, Plasmodium falciparum
NAVLEGLMDLFGLKSNRLSRKIIVN

SEQ ID NO: 3367078 - protein, 21 aa, Plasmodium falciparum
NAYIYKYRSDHNIKLTFDVFS

SEQ ID NO: 3367079 - protein, 22 aa, Plasmodium falciparum
NCAIFLDLLKALILNHKDDNYI

SEQ ID NO: 3367080 - protein, 27 aa, Plasmodium falciparum
NCDHVKPLCCSYILRFEGPPPHFLIIK

SEQ ID NO: 3367081 - protein, 26 aa, Plasmodium falciparum
NCEFKPGEGVMDSMNNLFMYNNNGNY

SEQ ID NO: 3367082 - protein, 21 aa, Plasmodium falciparum
NCEKIKCGNVEYNSCDDKKNQ

SEQ ID NO: 3367083 - protein, 24 aa, Plasmodium falciparum
NCELKNNLHFSKFLNDMRSYCVNL

SEQ ID NO: 3367084 - protein, 22 aa, Plasmodium falciparum
NCFEELKNFLMKAAIVSKDNPV

SEQ ID NO: 3367085 - protein, 46 aa, Plasmodium falciparum
NCFLKCFNNKYSYRKFLKIFIQLFLDKILCIRKYIIKRKKNKNDSN

SEQ ID NO: 3367086 - protein, 26 aa, Plasmodium falciparum
NCGHTRYSFEFCIDLGLEFHEENMKS

SEQ ID NO: 3367087 - protein, 34 aa, Plasmodium falciparum
NCGLTESECKFLFFQIASGISFIQTCYQSNIVRL

SEQ ID NO: 3367088 - protein, 26 aa, Plasmodium falciparum
NCIDGVRIGPIDFPDFNIKRKNDKII

SEQ ID NO: 3367089 - protein, 26 aa, Plasmodium falciparum
NCIEIKNNISYIFPLFKLKNKGKNVE

SEQ ID NO: 3367090 - protein, 18 aa, Plasmodium falciparum
NCISVIFYFSLKFATAEQ

SEQ ID NO: 3367091 - protein, 25 aa, Plasmodium falciparum
NCIYEVCVIISMLINEPLFLYNHKN

SEQ ID NO: 3367092 - protein, 22 aa, Plasmodium falciparum
NCKGTRDKKIVRKKSTSEIASD

SEQ ID NO: 3367093 - protein, 21 aa, Plasmodium falciparum
NCKLSKLSILLVLIGGNKINN

SEQ ID NO: 3367094 - protein, 26 aa, Plasmodium falciparum
NCKTKKRKTNNCLFKKYNSDGDLYEK

SEQ ID NO: 3367095 - protein, 18 aa, Plasmodium falciparum
NCLLFKKETTEEVLKKFL

SEQ ID NO: 3367096 - protein, 24 aa, Plasmodium falciparum
NCLPELEVFFYLLILLYLLDEKCY

SEQ ID NO: 3367097 - protein, 22 aa, Plasmodium falciparum
NCLSTNCVSHCLANHCLGNHCV

SEQ ID NO: 3367098 - protein, 27 aa, Plasmodium falciparum
NCMDKKFKAKGYIFLRNILRYLNVEEE

SEQ ID NO: 3367099 - protein, 30 aa, Plasmodium falciparum
NCNAIKSFHRRPICKCGQIFTPRLEINNWM

SEQ ID NO: 3367100 - protein, 17 aa, Plasmodium falciparum
NCSITYINSNGVISTRD

SEQ ID NO: 3367101 - protein, 24 aa, Plasmodium falciparum
NCSNEFFSSWSYRKHIEDELPRIF

SEQ ID NO: 3367102 - protein, 17 aa, Plasmodium falciparum
NCSNKILNNNVKIVTSN

SEQ ID NO: 3367103 - protein, 18 aa, Plasmodium falciparum
NCSYIYLYDIRNVKDYIQ

SEQ ID NO: 3367104 - protein, 26 aa, Plasmodium falciparum
NCTHILPVLRNVPILRYLSEEELVQI

SEQ ID NO: 3367105 - protein, 35 aa, Plasmodium falciparum
NCVDYYIDILFSYTGFCDIIFSVTCGIYRKKYTCY

SEQ ID NO: 3367106 - protein, 20 aa, Plasmodium falciparum
NCVIMFLHVCIFKDNDTNKD

SEQ ID NO: 3367107 - protein, 29 aa, Plasmodium falciparum
NCVNLKFDINMELLFSCSKDGSIYIFSIE

SEQ ID NO: 3367108 - protein, 32 aa, Plasmodium falciparum
NCYEIAVKCLHIYKGFPLIKVSYRMQDMFKKT

SEQ ID NO: 3367109 - protein, 21 aa, Plasmodium falciparum
NCYKYLKKGGYVLLRDYGLYD

SEQ ID NO: 3367110 - protein, 19 aa, Plasmodium falciparum
NCYSLCFHPEKNWLLCGTN

SEQ ID NO: 3367111 - protein, 17 aa, Plasmodium falciparum
NDANIVLKKVLNKKNTN

SEQ ID NO: 3367112 - protein, 17 aa, Plasmodium falciparum
NDCTYMSDMSTIYSENN

SEQ ID NO: 3367113 - protein, 18 aa, Plasmodium falciparum
NDDIKFSLLNVEDASVDF

SEQ ID NO: 3367114 - protein, 23 aa, Plasmodium falciparum
NDDKIKYIIPFFSNHNKINIFKK

SEQ ID NO: 3367115 - protein, 27 aa, Plasmodium falciparum
NDDKKKFWRFPFGKKKETKDANEEGID

SEQ ID NO: 3367116 - protein, 19 aa, Plasmodium falciparum
NDDMSYNFADHIKDIECYI

SEQ ID NO: 3367117 - protein, 20 aa, Plasmodium falciparum
NDDNEVLMTYELYKQNKEKY

SEQ ID NO: 3367118 - protein, 23 aa, Plasmodium falciparum
NDEDCKFVWNKLCESSKKEFDKL

SEQ ID NO: 3367119 - protein, 20 aa, Plasmodium falciparum
NDEEYFKIALRYDPENNEDN

SEQ ID NO: 3367120 - protein, 18 aa, Plasmodium falciparum
NDEFKDIDIVDAQNDDTD

SEQ ID NO: 3367121 - protein, 23 aa, Plasmodium falciparum
NDEFYERLYKFNNFVLNNCKDDK

SEQ ID NO: 3367122 - protein, 17 aa, Plasmodium falciparum
NDEIKEFDPQGLDKDLF

SEQ ID NO: 3367123 - protein, 24 aa, Plasmodium falciparum
NDEIKSIVCDGMYPDDNNKSYFRK

SEQ ID NO: 3367124 - protein, 21 aa, Plasmodium falciparum
NDEIWKLGPQNVPHNSFKNKL

SEQ ID NO: 3367125 - protein, 19 aa, Plasmodium falciparum
NDEKIELGTGYNNVKENDD

SEQ ID NO: 3367126 - protein, 23 aa, Plasmodium falciparum
NDEKKKFLDIETYKHKNIKMNNN

SEQ ID NO: 3367127 - protein, 23 aa, Plasmodium falciparum
NDEKVNIGPRFDISTRPDNSYGR

SEQ ID NO: 3367128 - protein, 18 aa, Plasmodium falciparum
NDEKWKNVVVIFSDSNVC

SEQ ID NO: 3367129 - protein, 24 aa, Plasmodium falciparum
NDELHELSNFFLIDKTKREKLMFE

SEQ ID NO: 3367130 - protein, 18 aa, Plasmodium falciparum
NDENIIGLCIKNILDSTL

SEQ ID NO: 3367131 - protein, 24 aa, Plasmodium falciparum
NDEPVMRKSFHIVFPNKDKYIGKI

SEQ ID NO: 3367132 - protein, 19 aa, Plasmodium falciparum
NDEQSKCAYNNSVVDEKEN

SEQ ID NO: 3367133 - protein, 20 aa, Plasmodium falciparum
NDFEFSIKNKVRGLLTYCLG

SEQ ID NO: 3367134 - protein, 24 aa, Plasmodium falciparum
NDFIPLKENILFDNINVQSKYDNV

SEQ ID NO: 3367135 - protein, 30 aa, Plasmodium falciparum
NDFLEIDIKLLRWLTTIMIKTSNSLNDIDI

SEQ ID NO: 3367136 - protein, 19 aa, Plasmodium falciparum
NDFPTRFCSLTLWVSNPQE

SEQ ID NO: 3367137 - protein, 27 aa, Plasmodium falciparum
NDGICEYEIPFLLDYVDDSNKEDSEKN

SEQ ID NO: 3367138 - protein, 17 aa, Plasmodium falciparum
NDGILCASSEGSISVLI

SEQ ID NO: 3367139 - protein, 24 aa, Plasmodium falciparum
NDGYKLNTPFSFSYPQYSHIKYTL

SEQ ID NO: 3367140 - protein, 22 aa, Plasmodium falciparum
NDHKSWVLVVLFSPDNKFLATA

SEQ ID NO: 3367141 - protein, 24 aa, Plasmodium falciparum
NDHPFIIRLVRTFKDSKYFYFLTE

SEQ ID NO: 3367142 - protein, 17 aa, Plasmodium falciparum
NDHTLKLICNITENNKA

SEQ ID NO: 3367143 - protein, 20 aa, Plasmodium falciparum
NDIDLKICIFSWKKTEKSKK

SEQ ID NO: 3367144 - protein, 21 aa, Plasmodium falciparum
NDIEKCIPKPVLYTHNKYDVP

SEQ ID NO: 3367145 - protein, 29 aa, Plasmodium falciparum
NDIERQVCIPMHLPISYSINIEENEDINN

SEQ ID NO: 3367146 - protein, 18 aa, Plasmodium falciparum
NDIFGCVADIGWVTGHTY

SEQ ID NO: 3367147 - protein, 18 aa, Plasmodium falciparum
NDIFVLRINFLVPGNQGV

SEQ ID NO: 3367148 - protein, 18 aa, Plasmodium falciparum
NDIHVVKNDVSLFNHTCD

SEQ ID NO: 3367149 - protein, 17 aa, Plasmodium falciparum
NDIICLLTSLSKLKYKD

SEQ ID NO: 3367150 - protein, 25 aa, Plasmodium falciparum
NDIIIRKHCEKFGKVKRVLILEDNV

SEQ ID NO: 3367151 - protein, 18 aa, Plasmodium falciparum
NDIIPFLIAHITHPSTPV

SEQ ID NO: 3367152 - protein, 23 aa, Plasmodium falciparum
NDIKISFYDIFEKMLNGEYKKEF

SEQ ID NO: 3367153 - protein, 17 aa, Plasmodium falciparum
NDIKSKMLYNNKSYSKS

SEQ ID NO: 3367154 - protein, 27 aa, Plasmodium falciparum
NDILAVCTLSCKIMFWDISIQEVVGTI

SEQ ID NO: 3367155 - protein, 24 aa, Plasmodium falciparum
NDILKDSLCPNSLRDFAKIRQEIN

SEQ ID NO: 3367156 - protein, 17 aa, Plasmodium falciparum
NDIPLNYIYTWNQPNVL

SEQ ID NO: 3367157 - protein, 23 aa, Plasmodium falciparum
NDIPYQIMKRILKDTFDINHVKN

SEQ ID NO: 3367158 - protein, 29 aa, Plasmodium falciparum
NDISKCVIKTRHWRNVIYKTNEEKNEIFY

SEQ ID NO: 3367159 - protein, 19 aa, Plasmodium falciparum
NDISKFLKDVFYDFTKYIK

SEQ ID NO: 3367160 - protein, 18 aa, Plasmodium falciparum
NDISRVSSCPEYQNSNEQ

SEQ ID NO: 3367161 - protein, 24 aa, Plasmodium falciparum
NDIVEIFEVLGIEAVRRALLKELR

SEQ ID NO: 3367162 - protein, 20 aa, Plasmodium falciparum
NDIYFQYIIIFDINSIDHPI

SEQ ID NO: 3367163 - protein, 24 aa, Plasmodium falciparum
NDIYLIILPFNFIKINFKNIASYI

SEQ ID NO: 3367164 - protein, 31 aa, Plasmodium falciparum
NDKITNIIIYKRMYQSFILLKKEYRDLIDEH

SEQ ID NO: 3367165 - protein, 30 aa, Plasmodium falciparum
NDKKKDKSCKCCIKKKIINDEKILLRMNIF

SEQ ID NO: 3367166 - protein, 23 aa, Plasmodium falciparum
NDKKQGNRGFGFVSYDNKKSAIE

SEQ ID NO: 3367167 - protein, 36 aa, Plasmodium falciparum
NDKNINCLNDIIFLDVYRAYNVLTYMQEKVSVIIFT

SEQ ID NO: 3367168 - protein, 24 aa, Plasmodium falciparum
NDKTIISLSIKWCIDNTSNNFIWS

SEQ ID NO: 3367169 - protein, 27 aa, Plasmodium falciparum
NDKVTCIKHNINLKELINLNLFEETKL

SEQ ID NO: 3367170 - protein, 24 aa, Plasmodium falciparum
NDKVVKRKCRFEQISFSAHSDFNQ

SEQ ID NO: 3367171 - protein, 17 aa, Plasmodium falciparum
NDKYAPCIFSKEQNNKT

SEQ ID NO: 3367172 - protein, 17 aa, Plasmodium falciparum
NDKYKILSGGRCNKRLD

SEQ ID NO: 3367173 - protein, 19 aa, Plasmodium falciparum
NDKYSYLFEYNEQQDCHEF

SEQ ID NO: 3367174 - protein, 17 aa, Plasmodium falciparum
NDLEMFNDKFELNDEAK

SEQ ID NO: 3367175 - protein, 17 aa, Plasmodium falciparum
NDLFPTIDVLYLPYNKR

SEQ ID NO: 3367176 - protein, 23 aa, Plasmodium falciparum
NDLKEKNSDHFIDVEEGIREYNY

SEQ ID NO: 3367177 - protein, 17 aa, Plasmodium falciparum
NDLKLVIYNINEKMNTI

SEQ ID NO: 3367178 - protein, 23 aa, Plasmodium falciparum
NDLKYLALIPKLEYINGAVKLLN

SEQ ID NO: 3367179 - protein, 17 aa, Plasmodium falciparum
NDLLCSQLNFLSFTCHY

SEQ ID NO: 3367180 - protein, 18 aa, Plasmodium falciparum
NDLLERYEMYAIDFSDEI

SEQ ID NO: 3367181 - protein, 28 aa, Plasmodium falciparum
NDLLKKCLNLHLYRCINKSLFEYQNDVI

SEQ ID NO: 3367182 - protein, 25 aa, Plasmodium falciparum
NDLNFRLHENSAWINQLRQSHNNLC

SEQ ID NO: 3367183 - protein, 23 aa, Plasmodium falciparum
NDLPIIIECFYYIMNMNIPESTS

SEQ ID NO: 3367184 - protein, 23 aa, Plasmodium falciparum
NDLPTMWAKNDFDQFHINLIKKI

SEQ ID NO: 3367185 - protein, 21 aa, Plasmodium falciparum
NDLRAQAIIKVMINRYPSLNY

SEQ ID NO: 3367186 - protein, 19 aa, Plasmodium falciparum
NDLSAFNFFEYITKLQSES

SEQ ID NO: 3367187 - protein, 18 aa, Plasmodium falciparum
NDLTGINIWESCLVASRW

SEQ ID NO: 3367188 - protein, 22 aa, Plasmodium falciparum
NDLYIKGFEKLSVLLISKFKLI

SEQ ID NO: 3367189 - protein, 17 aa, Plasmodium falciparum
NDLYNFKYNNFYEESVK

SEQ ID NO: 3367190 - protein, 25 aa, Plasmodium falciparum
NDMDFKKASKIICLMKNTKIFEEHS

SEQ ID NO: 3367191 - protein, 17 aa, Plasmodium falciparum
NDMKFVKQYINFLIAQK

SEQ ID NO: 3367192 - protein, 25 aa, Plasmodium falciparum
NDMKLKEIFNFLILIEEFNPFDYSN

SEQ ID NO: 3367193 - protein, 22 aa, Plasmodium falciparum
NDMKVFRFQTLISCMLSSRTKD

SEQ ID NO: 3367194 - protein, 23 aa, Plasmodium falciparum
NDMKVIWPNKLSWKEISNEIKKK

SEQ ID NO: 3367195 - protein, 33 aa, Plasmodium falciparum
NDMLIAHYFFFYLCGSYIKESKLKLGKISLNIF

SEQ ID NO: 3367196 - protein, 24 aa, Plasmodium falciparum
NDMLVNPMLYRNYIYSTNAEADNM

SEQ ID NO: 3367197 - protein, 23 aa, Plasmodium falciparum
NDMPFDVLSIIILSCGGKISWNS

SEQ ID NO: 3367198 - protein, 17 aa, Plasmodium falciparum
NDMTLEEGLLLALKTLA

SEQ ID NO: 3367199 - protein, 18 aa, Plasmodium falciparum
NDNCKYGNDFSLDKYNSD

SEQ ID NO: 3367200 - protein, 17 aa, Plasmodium falciparum
NDNDIYLIFDFMETDLH

SEQ ID NO: 3367201 - protein, 23 aa, Plasmodium falciparum
NDNFTYRPTLFNLLEVLANHNIT

SEQ ID NO: 3367202 - protein, 20 aa, Plasmodium falciparum
NDNICFKKGGDNTFVSLLND

SEQ ID NO: 3367203 - protein, 17 aa, Plasmodium falciparum
NDNIHMINDVATKLNQH

SEQ ID NO: 3367204 - protein, 18 aa, Plasmodium falciparum
NDNILKEYVDGKVLENEE

SEQ ID NO: 3367205 - protein, 23 aa, Plasmodium falciparum
NDNKRLGSFFKINDKCESINENV

SEQ ID NO: 3367206 - protein, 22 aa, Plasmodium falciparum
NDNLICKRNMKPLELSKNNVND

SEQ ID NO: 3367207 - protein, 20 aa, Plasmodium falciparum
NDNLNVKGCISLAGMISIDE

SEQ ID NO: 3367208 - protein, 17 aa, Plasmodium falciparum
NDNLNVLGFLEETTSGE

SEQ ID NO: 3367209 - protein, 23 aa, Plasmodium falciparum
NDNNAFYFKTPVLEDININDNIK

SEQ ID NO: 3367210 - protein, 25 aa, Plasmodium falciparum
NDNTREIRRYFSVKQYGFEQARILA

SEQ ID NO: 3367211 - protein, 31 aa, Plasmodium falciparum
NDNTVYYCSMCGSVCNYCNCGERTLSYKNSW

SEQ ID NO: 3367212 - protein, 20 aa, Plasmodium falciparum
NDNVECFHNLNLPKRSHTTI

SEQ ID NO: 3367213 - protein, 23 aa, Plasmodium falciparum
NDNYIKHSLILNNVEDNVVKPAK

SEQ ID NO: 3367214 - protein, 25 aa, Plasmodium falciparum
NDNYYKLPWVHRGISKYLLIKNKNF

SEQ ID NO: 3367215 - protein, 18 aa, Plasmodium falciparum
NDPFKQKECFKLQQKDRE

SEQ ID NO: 3367216 - protein, 17 aa, Plasmodium falciparum
NDPKKALKLSFSQSSSK

SEQ ID NO: 3367217 - protein, 20 aa, Plasmodium falciparum
NDPLSMLVVIKYIEELMKRE

SEQ ID NO: 3367218 - protein, 24 aa, Plasmodium falciparum
NDQIKLILRKDIINNVINNFTKDK

SEQ ID NO: 3367219 - protein, 24 aa, Plasmodium falciparum
NDQNEYAGDDKKDEDGDAKKGSDD

SEQ ID NO: 3367220 - protein, 18 aa, Plasmodium falciparum
NDQTSACLEDCIEGKIGT

SEQ ID NO: 3367221 - protein, 24 aa, Plasmodium falciparum
NDRIICPLFPIKQGIYSNGECTFI

SEQ ID NO: 3367222 - protein, 23 aa, Plasmodium falciparum
NDRSFRLAARNAQKGSVDDLEAW

SEQ ID NO: 3367223 - protein, 24 aa, Plasmodium falciparum
NDSEYLDYYSFFFKDISKYIKFHI

SEQ ID NO: 3367224 - protein, 28 aa, Plasmodium falciparum
NDSFLLKKCILTLHMLIKYNNEIPYIVF

SEQ ID NO: 3367225 - protein, 22 aa, Plasmodium falciparum
NDSIIYKNEMMINKNENVINEN

SEQ ID NO: 3367226 - protein, 41 aa, Plasmodium falciparum
NDSKLKSVMSFNTFCKDMKDENFFNQFLREHIKNSINNVVE

SEQ ID NO: 3367227 - protein, 19 aa, Plasmodium falciparum
NDSKRSITYSNININEKSN

SEQ ID NO: 3367228 - protein, 23 aa, Plasmodium falciparum
NDSLCYYPGLEIFYNRLVSDNKE

SEQ ID NO: 3367229 - protein, 23 aa, Plasmodium falciparum
NDSLFGNNAFKLSTEVKSNESPF

SEQ ID NO: 3367230 - protein, 19 aa, Plasmodium falciparum
NDSLILLFYVCKLLLDMCS

SEQ ID NO: 3367231 - protein, 25 aa, Plasmodium falciparum
NDSLKFKNNFIMSNNLCGSTNMNNI

SEQ ID NO: 3367232 - protein, 27 aa, Plasmodium falciparum
NDSLLPCYYPLCSVSMHTKCVEKLLLF

SEQ ID NO: 3367233 - protein, 18 aa, Plasmodium falciparum
NDSNCIFADINFNNDINL

SEQ ID NO: 3367234 - protein, 18 aa, Plasmodium falciparum
NDSRVIYTNLCYNKSKDE

SEQ ID NO: 3367235 - protein, 21 aa, Plasmodium falciparum
NDSSFSYKGQKNYNSKNKSNT

SEQ ID NO: 3367236 - protein, 28 aa, Plasmodium falciparum
NDSVDIIWEKMVLLAIGEEFSLIDLCGL

SEQ ID NO: 3367237 - protein, 26 aa, Plasmodium falciparum
NDSVKYRLGLKTNSILCNININEAIG

SEQ ID NO: 3367238 - protein, 18 aa, Plasmodium falciparum
NDSWGGKGLLGCNVATGY

SEQ ID NO: 3367239 - protein, 19 aa, Plasmodium falciparum
NDTHILYISNFVNFINLEN

SEQ ID NO: 3367240 - protein, 24 aa, Plasmodium falciparum
NDTIKFKKFVKVFSEKKKIDINQS

SEQ ID NO: 3367241 - protein, 27 aa, Plasmodium falciparum
NDTIKMDYLLNRKIEYEKLDEDQSESN

SEQ ID NO: 3367242 - protein, 23 aa, Plasmodium falciparum
NDTIRYPIYIIKKVYNDEETCND

SEQ ID NO: 3367243 - protein, 24 aa, Plasmodium falciparum
NDTKKSKCQLIPIKNNKTEKLWVS

SEQ ID NO: 3367244 - protein, 19 aa, Plasmodium falciparum
NDTLCIICLQNEKKYTFTC

SEQ ID NO: 3367245 - protein, 26 aa, Plasmodium falciparum
NDTNLYKKIKFNFSINRKIYDEKKKI

SEQ ID NO: 3367246 - protein, 17 aa, Plasmodium falciparum
NDTRVLYELKINKNDDI

SEQ ID NO: 3367247 - protein, 29 aa, Plasmodium falciparum
NDVDKVCIIRFPFSVSKDIKKYLLNKNLD

SEQ ID NO: 3367248 - protein, 24 aa, Plasmodium falciparum
NDVEMYKNDFTMINEHIVQNANYD

SEQ ID NO: 3367249 - protein, 33 aa, Plasmodium falciparum
NDVIVKIIWSFAFLKIRDIHLFVDFSISIQLIL

SEQ ID NO: 3367250 - protein, 35 aa, Plasmodium falciparum
NDVKRLFREKYFLQDLCEKRKVMIQKSKIENTKLN

SEQ ID NO: 3367251 - protein, 18 aa, Plasmodium falciparum
NDVLCFFTLQCFTHSLRT

SEQ ID NO: 3367252 - protein, 17 aa, Plasmodium falciparum
NDVLIKFPFLHVDHPLH

SEQ ID NO: 3367253 - protein, 19 aa, Plasmodium falciparum
NDVSCIYLFNDIKGSSKKK

SEQ ID NO: 3367254 - protein, 25 aa, Plasmodium falciparum
NDVYKVIKSFLFKYMENDKKRGVNK

SEQ ID NO: 3367255 - protein, 26 aa, Plasmodium falciparum
NDWSYLRSGANTSFRNSIKNNENLIF

SEQ ID NO: 3367256 - protein, 19 aa, Plasmodium falciparum
NDYEFKKLITSTINTCYPK

SEQ ID NO: 3367257 - protein, 29 aa, Plasmodium falciparum
NDYFVYRLYRLPIYYLLTNEHRNQFLLER

SEQ ID NO: 3367258 - protein, 24 aa, Plasmodium falciparum
NDYIENWDLFLVIEKCDCSLNDIL

SEQ ID NO: 3367259 - protein, 27 aa, Plasmodium falciparum
NDYKETCLFLSFEYIEKCVISKLKRNK

SEQ ID NO: 3367260 - protein, 27 aa, Plasmodium falciparum
NDYKGKRIFSRLEILNINIVKLNYLDK

SEQ ID NO: 3367261 - protein, 17 aa, Plasmodium falciparum
NDYSEGINNFDQNNNQK

SEQ ID NO: 3367262 - protein, 23 aa, Plasmodium falciparum
NDYYYIIHLEWFNKLKKFINNES

SEQ ID NO: 3367263 - protein, 31 aa, Plasmodium falciparum
NEAIIKSYLVFVKRFCKYIIKSVIHIEHYYK

SEQ ID NO: 3367264 - protein, 19 aa, Plasmodium falciparum
NEAKCKLNNFINNNQTQQD

SEQ ID NO: 3367265 - protein, 24 aa, Plasmodium falciparum
NEALCCLQGDMLPIFKQSDNFTIA

SEQ ID NO: 3367266 - protein, 18 aa, Plasmodium falciparum
NEALKIHRECIKKRNASV

SEQ ID NO: 3367267 - protein, 18 aa, Plasmodium falciparum
NEAQKELFIRNISNNALD

SEQ ID NO: 3367268 - protein, 27 aa, Plasmodium falciparum
NEATVSWIEWFCQLKQNLFLVEVDEDF

SEQ ID NO: 3367269 - protein, 18 aa, Plasmodium falciparum
NECGKVLIYFIDYLNEKY

SEQ ID NO: 3367270 - protein, 17 aa, Plasmodium falciparum
NECMYMGNIKNNYFFNR

SEQ ID NO: 3367271 - protein, 28 aa, Plasmodium falciparum
NECNYCPKKSYYLCPPIPILKIDDTLNT

SEQ ID NO: 3367272 - protein, 23 aa, Plasmodium falciparum
NEDAKILLNEWYIKEPFVDSQGK

SEQ ID NO: 3367273 - protein, 19 aa, Plasmodium falciparum
NEDFLTGTIYEFKRRINHS

SEQ ID NO: 3367274 - protein, 26 aa, Plasmodium falciparum
NEDKLKYINSLLCDEKDKYDIVVKDI

SEQ ID NO: 3367275 - protein, 21 aa, Plasmodium falciparum
NEDLPKWSGYFEKLLKKNHTN

SEQ ID NO: 3367276 - protein, 23 aa, Plasmodium falciparum
NEDNSCNYMCYNINKMNQNDHTS

SEQ ID NO: 3367277 - protein, 19 aa, Plasmodium falciparum
NEECYPREHLEKLEKELIM

SEQ ID NO: 3367278 - protein, 18 aa, Plasmodium falciparum
NEEDLNLLSSRERENRMN

SEQ ID NO: 3367279 - protein, 22 aa, Plasmodium falciparum
NEEELEYFLDFDKRYFGEQYFS

SEQ ID NO: 3367280 - protein, 23 aa, Plasmodium falciparum
NEEFLGPIFMHFYDKNYYRKDLI

SEQ ID NO: 3367281 - protein, 23 aa, Plasmodium falciparum
NEEGKRSIIVRKFTQKNNMNNEE

SEQ ID NO: 3367282 - protein, 25 aa, Plasmodium falciparum
NEEICKCKDLCLIFDQKKIELEENY

SEQ ID NO: 3367283 - protein, 32 aa, Plasmodium falciparum
NEEKDFLYSRGLDFYDVKCVVNFDMPSDSETF

SEQ ID NO: 3367284 - protein, 23 aa, Plasmodium falciparum
NEEKKEYFIICIYSFIIQLYDYI

SEQ ID NO: 3367285 - protein, 26 aa, Plasmodium falciparum
NEEKLAENCGFVFLSNEHTKGDKSFD

SEQ ID NO: 3367286 - protein, 28 aa, Plasmodium falciparum
NEELKSFSILYAWSFSTRIQNFVFTNND

SEQ ID NO: 3367287 - protein, 18 aa, Plasmodium falciparum
NEELSWRINKFVNQLRIS

SEQ ID NO: 3367288 - protein, 19 aa, Plasmodium falciparum
NEENGCIEDKCVDDDKEVK

SEQ ID NO: 3367289 - protein, 25 aa, Plasmodium falciparum
NEENWNIFWEWLYENDDINISTFKK

SEQ ID NO: 3367290 - protein, 21 aa, Plasmodium falciparum
NEEYGNLKICKEKNEQNIQHL

SEQ ID NO: 3367291 - protein, 21 aa, Plasmodium falciparum
NEEYMEIILTNFINTIINNLE

SEQ ID NO: 3367292 - protein, 22 aa, Plasmodium falciparum
NEFCLPSKTARSILNDEENNKP

SEQ ID NO: 3367293 - protein, 31 aa, Plasmodium falciparum
NEFGKVMTPKESFRYISWIFHGKKQGKNKLE

SEQ ID NO: 3367294 - protein, 25 aa, Plasmodium falciparum
NEFIKYKFQNMLRKNISLERSNVEL

SEQ ID NO: 3367295 - protein, 17 aa, Plasmodium falciparum
NEFKKVLLCSWKNDPLS

SEQ ID NO: 3367296 - protein, 17 aa, Plasmodium falciparum
NEFKSKENVKMLFELLD

SEQ ID NO: 3367297 - protein, 17 aa, Plasmodium falciparum
NEFKVNNKLILKSKEFK

SEQ ID NO: 3367298 - protein, 24 aa, Plasmodium falciparum
NEFLSDMFNFLYRDKVLILQKNRN

SEQ ID NO: 3367299 - protein, 25 aa, Plasmodium falciparum
NEFMRKKMWMEKYLHNQINCYDVLL

SEQ ID NO: 3367300 - protein, 27 aa, Plasmodium falciparum
NEFNSLCSFNSSSKCVKDEMITQFVGN

SEQ ID NO: 3367301 - protein, 24 aa, Plasmodium falciparum
NEFPELRLKILQLLYNSFNVNFSF

SEQ ID NO: 3367302 - protein, 23 aa, Plasmodium falciparum
NEFPTHTNSRFRIFKTNDENVQY

SEQ ID NO: 3367303 - protein, 26 aa, Plasmodium falciparum
NEFSKGYRLMCLYSAQELNEQINYNK

SEQ ID NO: 3367304 - protein, 17 aa, Plasmodium falciparum
NEFSYFMLLGSNFILNY

SEQ ID NO: 3367305 - protein, 21 aa, Plasmodium falciparum
NEFVKNNGFHTYNLLPEKEKG

SEQ ID NO: 3367306 - protein, 20 aa, Plasmodium falciparum
NEFYADMIFCGVQDIHYKFN

SEQ ID NO: 3367307 - protein, 25 aa, Plasmodium falciparum
NEGDLRKAFYLAYEEDYVEYILLNN

SEQ ID NO: 3367308 - protein, 18 aa, Plasmodium falciparum
NEGEKEFGSANTIDEANK

SEQ ID NO: 3367309 - protein, 22 aa, Plasmodium falciparum
NEGIYLDAFEQIYVKKKKNEDE

SEQ ID NO: 3367310 - protein, 22 aa, Plasmodium falciparum
NEGKATTFLLSFLEQNLPNNKN

SEQ ID NO: 3367311 - protein, 23 aa, Plasmodium falciparum
NEGNLKMCVLDIEKIKSNEIFID

SEQ ID NO: 3367312 - protein, 23 aa, Plasmodium falciparum
NEHCELICRCIEKNINRTNDKNR

SEQ ID NO: 3367313 - protein, 32 aa, Plasmodium falciparum
NEHKICLNTCTIPEWWNLELYFGDSENKICHD

SEQ ID NO: 3367314 - protein, 22 aa, Plasmodium falciparum
NEHKRTYLHFARTLPEDYELPL

SEQ ID NO: 3367315 - protein, 24 aa, Plasmodium falciparum
NEHLKEILKYGIGIHHAGLNENDK

SEQ ID NO: 3367316 - protein, 24 aa, Plasmodium falciparum
NEHMLKDNMDVFLKKYVLKNDKHN

SEQ ID NO: 3367317 - protein, 21 aa, Plasmodium falciparum
NEHPGDILVFLTGQDEINTAC

SEQ ID NO: 3367318 - protein, 23 aa, Plasmodium falciparum
NEHVSSVNYIEWSPHEYGLHLGC

SEQ ID NO: 3367319 - protein, 17 aa, Plasmodium falciparum
NEICNKSSLPFNTDEIR

SEQ ID NO: 3367320 - protein, 17 aa, Plasmodium falciparum
NEICSLTTEVMELNNKK

SEQ ID NO: 3367321 - protein, 23 aa, Plasmodium falciparum
NEICSSYFDMCNNMDESYNIMNN

SEQ ID NO: 3367322 - protein, 26 aa, Plasmodium falciparum
NEIDIKVCTLINCPTHNPQNYVKSNG

SEQ ID NO: 3367323 - protein, 18 aa, Plasmodium falciparum
NEIEIFKNNIEKMKNEEI

SEQ ID NO: 3367324 - protein, 19 aa, Plasmodium falciparum
NEIELTIDGKTYFKRNKYF

SEQ ID NO: 3367325 - protein, 19 aa, Plasmodium falciparum
NEIFYKYHHAPIFLLVNVH

SEQ ID NO: 3367326 - protein, 25 aa, Plasmodium falciparum
NEIIKLFACSVRPKISCDIKNLFEE

SEQ ID NO: 3367327 - protein, 24 aa, Plasmodium falciparum
NEIIPRLGFEEMRNEMNKYGVEIN

SEQ ID NO: 3367328 - protein, 20 aa, Plasmodium falciparum
NEIIYKKKFQTIKKNKNIIY

SEQ ID NO: 3367329 - protein, 23 aa, Plasmodium falciparum
NEIKEIYLNNIISQIKDKKDNTK

SEQ ID NO: 3367330 - protein, 23 aa, Plasmodium falciparum
NEIKKDIVRCICEKKNYNFINEK

SEQ ID NO: 3367331 - protein, 43 aa, Plasmodium falciparum
NEIKKLQFLNEFYKIYFEKYNKWKVVIINNRIHIFDKEKNKNK

SEQ ID NO: 3367332 - protein, 22 aa, Plasmodium falciparum
NEIKKSCNYFTHFENIHKNIKR

SEQ ID NO: 3367333 - protein, 26 aa, Plasmodium falciparum
NEIKRIYYFKLWNAMVEHNFTLFENI

SEQ ID NO: 3367334 - protein, 22 aa, Plasmodium falciparum
NEIKTLKIVKEFKQNNKDDNNN

SEQ ID NO: 3367335 - protein, 22 aa, Plasmodium falciparum
NEIKTYVNLCLNYYNNLDTCVI

SEQ ID NO: 3367336 - protein, 25 aa, Plasmodium falciparum
NEIKVHCVAAFQWASKEGVLCEENM

SEQ ID NO: 3367337 - protein, 18 aa, Plasmodium falciparum
NEILKTNKKFVVNNISFN

SEQ ID NO: 3367338 - protein, 22 aa, Plasmodium falciparum
NEILYMGVSIFFKNKFFEEYKM

SEQ ID NO: 3367339 - protein, 37 aa, Plasmodium falciparum
NEIPYIVFHKSYLIFPPFNINMLWDIYELDQSWYKTF

SEQ ID NO: 3367340 - protein, 21 aa, Plasmodium falciparum
NEIRIKKDLELLFNIGDKDLK

SEQ ID NO: 3367341 - protein, 24 aa, Plasmodium falciparum
NEISNGRFSYDIFNPHKNNKDKIC

SEQ ID NO: 3367342 - protein, 20 aa, Plasmodium falciparum
NEISNGSILYTLRNNNNNNN

SEQ ID NO: 3367343 - protein, 23 aa, Plasmodium falciparum
NEISRFNMLLIRACYLNDEDAKY

SEQ ID NO: 3367344 - protein, 27 aa, Plasmodium falciparum
NEIYIKGGVVPPPIRKWEESNLSNDLL

SEQ ID NO: 3367345 - protein, 23 aa, Plasmodium falciparum
NEKDILPVHTFESLSNSNDNIFR

SEQ ID NO: 3367346 - protein, 17 aa, Plasmodium falciparum
NEKEFSNEFNINYGSHS

SEQ ID NO: 3367347 - protein, 24 aa, Plasmodium falciparum
NEKEIKDYFSWRQVDCHINTQYNE

SEQ ID NO: 3367348 - protein, 29 aa, Plasmodium falciparum
NEKEIKKKLSVPFLPPYYFFTYHVTYICL

SEQ ID NO: 3367349 - protein, 22 aa, Plasmodium falciparum
NEKEKPIFLKNCKDKTSDNKFN

SEQ ID NO: 3367350 - protein, 23 aa, Plasmodium falciparum
NEKEKYVKLEFLYDEIKQKYDLL

SEQ ID NO: 3367351 - protein, 17 aa, Plasmodium falciparum
NEKEVIQINHLITNMNK

SEQ ID NO: 3367352 - protein, 25 aa, Plasmodium falciparum
NEKFKSICTCSMLLHDILNILNQNI

SEQ ID NO: 3367353 - protein, 21 aa, Plasmodium falciparum
NEKGEYILTMLNISRDTTDVD

SEQ ID NO: 3367354 - protein, 20 aa, Plasmodium falciparum
NEKHLNIGSFSFYKNEYDDM

SEQ ID NO: 3367355 - protein, 23 aa, Plasmodium falciparum
NEKIKLSLEIGKLENRINKIAHD

SEQ ID NO: 3367356 - protein, 20 aa, Plasmodium falciparum
NEKILLHKIKLIIFDEIHLL

SEQ ID NO: 3367357 - protein, 19 aa, Plasmodium falciparum
NEKIYNMDVIKNFKYLDTK

SEQ ID NO: 3367358 - protein, 25 aa, Plasmodium falciparum
NEKKCRNIKVLMSFLEVYNETIRDL

SEQ ID NO: 3367359 - protein, 33 aa, Plasmodium falciparum
NEKKDFSTFSFDINKYTSWADIVDEYDEFFYEV

SEQ ID NO: 3367360 - protein, 21 aa, Plasmodium falciparum
NEKKDILSFATFLVKDNVTLN

SEQ ID NO: 3367361 - protein, 21 aa, Plasmodium falciparum
NEKKHDISIENVLKKMKKKKK

SEQ ID NO: 3367362 - protein, 19 aa, Plasmodium falciparum
NEKKLKFIDIFDEENELGI

SEQ ID NO: 3367363 - protein, 21 aa, Plasmodium falciparum
NEKKLYDKKVKNYKNQYTEEK

SEQ ID NO: 3367364 - protein, 24 aa, Plasmodium falciparum
NEKKPCAYFSVHNNIKIYNKSSSI

SEQ ID NO: 3367365 - protein, 17 aa, Plasmodium falciparum
NEKMCKNEYLDIDLENL

SEQ ID NO: 3367366 - protein, 26 aa, Plasmodium falciparum
NEKNCNVGMLNLTFPFNNSCKDEKIL

SEQ ID NO: 3367367 - protein, 18 aa, Plasmodium falciparum
NEKNEIILNDAKEIEKWI

SEQ ID NO: 3367368 - protein, 26 aa, Plasmodium falciparum
NEKPWGVPCTLAFPCATQNEINLEDA

SEQ ID NO: 3367369 - protein, 23 aa, Plasmodium falciparum
NEKQGDIIICTAGRLLDLLNSCK

SEQ ID NO: 3367370 - protein, 24 aa, Plasmodium falciparum
NEKRKLHKERDNFEEQKKIYEEEF

SEQ ID NO: 3367371 - protein, 19 aa, Plasmodium falciparum
NEKRNLLIHMYENNYNFDD

SEQ ID NO: 3367372 - protein, 19 aa, Plasmodium falciparum
NEKSEDVFQLLLNALLDEK

SEQ ID NO: 3367373 - protein, 19 aa, Plasmodium falciparum
NEKVCCNYLNNNVYNNYCY

SEQ ID NO: 3367374 - protein, 22 aa, Plasmodium falciparum
NEKYKYIQNIILFLDSNLYTRA

SEQ ID NO: 3367375 - protein, 38 aa, Plasmodium falciparum
NEKYRGKYHKYPLDIEASYRCKNLYLKINVDTNNEQIL

SEQ ID NO: 3367376 - protein, 25 aa, Plasmodium falciparum
NELEEKINILNFMKNDFEIVLQKEN

SEQ ID NO: 3367377 - protein, 19 aa, Plasmodium falciparum
NELEMLKKELESLEKEKKQ

SEQ ID NO: 3367378 - protein, 23 aa, Plasmodium falciparum
NELETYSSIILDKINHFKAQEEK

SEQ ID NO: 3367379 - protein, 24 aa, Plasmodium falciparum
NELFCNYHKIQIKKLNYLSLNNIN

SEQ ID NO: 3367380 - protein, 24 aa, Plasmodium falciparum
NELFKYDLICDVYNKKCSYYKEKK

SEQ ID NO: 3367381 - protein, 23 aa, Plasmodium falciparum
NELFLRIAKKLPLHKKEQERCPA

SEQ ID NO: 3367382 - protein, 27 aa, Plasmodium falciparum
NELIRKKVCMLLHKMYIIEPSLIKDID

SEQ ID NO: 3367383 - protein, 25 aa, Plasmodium falciparum
NELKERELYYLGMIEELRNEIKTKE

SEQ ID NO: 3367384 - protein, 25 aa, Plasmodium falciparum
NELKKDGLLKIGYRKIHSTIFTMNH

SEQ ID NO: 3367385 - protein, 17 aa, Plasmodium falciparum
NELKRINDNFFKLHSNL

SEQ ID NO: 3367386 - protein, 19 aa, Plasmodium falciparum
NELLFYYTYYYEYSKEMIK

SEQ ID NO: 3367387 - protein, 24 aa, Plasmodium falciparum
NELLKLNSVIVELDLDISSKDKEI

SEQ ID NO: 3367388 - protein, 23 aa, Plasmodium falciparum
NELPGKPKYIWTIKKDNLSEYDG

SEQ ID NO: 3367389 - protein, 21 aa, Plasmodium falciparum
NELPHLKNLIILDTVAKQGII

SEQ ID NO: 3367390 - protein, 17 aa, Plasmodium falciparum
NELQIFFTKLLEEKLSP

SEQ ID NO: 3367391 - protein, 24 aa, Plasmodium falciparum
NELRRRLICSVCMENFRNYIIIKC

SEQ ID NO: 3367392 - protein, 29 aa, Plasmodium falciparum
NELTLLRFFMKYPIKKFIFIGDVKQLGFV

SEQ ID NO: 3367393 - protein, 27 aa, Plasmodium falciparum
NELVGFFKRLLINFIPIINTVNIEGQF

SEQ ID NO: 3367394 - protein, 21 aa, Plasmodium falciparum
NELVIIFCFNKLINKAPYECH

SEQ ID NO: 3367395 - protein, 23 aa, Plasmodium falciparum
NEMFYRNILSSSWASHNNNGLLQ

SEQ ID NO: 3367396 - protein, 23 aa, Plasmodium falciparum
NEMKKFICSFIKYYDKLKNDLLN

SEQ ID NO: 3367397 - protein, 25 aa, Plasmodium falciparum
NEMNIKYGDICVKYEEMSLTYKETS

SEQ ID NO: 3367398 - protein, 25 aa, Plasmodium falciparum
NEMNKLKMDMELVQEQNELFKIDFN

SEQ ID NO: 3367399 - protein, 17 aa, Plasmodium falciparum
NEMRSSILEVKRMMSMT

SEQ ID NO: 3367400 - protein, 17 aa, Plasmodium falciparum
NEMVHSFICFNNSELMH

SEQ ID NO: 3367401 - protein, 19 aa, Plasmodium falciparum
NENELLCEVIDVKCNHEII

SEQ ID NO: 3367402 - protein, 26 aa, Plasmodium falciparum
NENFKNKGFLKYKNDNLIISDANYVS

SEQ ID NO: 3367403 - protein, 29 aa, Plasmodium falciparum
NENICLKACIRGDTHYAFVEFRNIQDTSN

SEQ ID NO: 3367404 - protein, 17 aa, Plasmodium falciparum
NENIKLFNNIFEQNLNK

SEQ ID NO: 3367405 - protein, 25 aa, Plasmodium falciparum
NENINICLLSLIYRDLSFLNNYEIK

SEQ ID NO: 3367406 - protein, 24 aa, Plasmodium falciparum
NENIPFILMQIICWVIGEYSHLCD

SEQ ID NO: 3367407 - protein, 24 aa, Plasmodium falciparum
NENIPFSFLYHKVLTILKSHYNNH

SEQ ID NO: 3367408 - protein, 17 aa, Plasmodium falciparum
NENKDDMSFIYNQINIK

SEQ ID NO: 3367409 - protein, 26 aa, Plasmodium falciparum
NENKEKIEFADLMYSNNNFFGQGLQK

SEQ ID NO: 3367410 - protein, 20 aa, Plasmodium falciparum
NENKKFFFLNNINNYHSKDI

SEQ ID NO: 3367411 - protein, 21 aa, Plasmodium falciparum
NENKKVIAIVPWQIDLTSFAL

SEQ ID NO: 3367412 - protein, 21 aa, Plasmodium falciparum
NENKLLWTIKKFKGEHEYSIR

SEQ ID NO: 3367413 - protein, 26 aa, Plasmodium falciparum
NENKTPFHFHWFKDDYIYFYKNKETE

SEQ ID NO: 3367414 - protein, 18 aa, Plasmodium falciparum
NENMKTKFEDIVLQAQKQ

SEQ ID NO: 3367415 - protein, 35 aa, Plasmodium falciparum
NENNFDVRYNYNMMNDFYNYFPFNYYYYNMNNLYF

SEQ ID NO: 3367416 - protein, 31 aa, Plasmodium falciparum
NENNYKLIHCLKWTRVYIRRKDDNTMRLVEY

SEQ ID NO: 3367417 - protein, 26 aa, Plasmodium falciparum
NENTKETMKIFLFLDQKIPFFELSPE

SEQ ID NO: 3367418 - protein, 20 aa, Plasmodium falciparum
NENYKFLGLDTNVICDCINK

SEQ ID NO: 3367419 - protein, 18 aa, Plasmodium falciparum
NEPFKIEAIENVLEEKEN

SEQ ID NO: 3367420 - protein, 17 aa, Plasmodium falciparum
NEPKKKFLIGAKPILPT

SEQ ID NO: 3367421 - protein, 22 aa, Plasmodium falciparum
NEPQKILHIHDKSYYLIGKEQL

SEQ ID NO: 3367422 - protein, 17 aa, Plasmodium falciparum
NEQEKYNNLSIINQKQN

SEQ ID NO: 3367423 - protein, 19 aa, Plasmodium falciparum
NEQLLCLKHKMNILKKYNS

SEQ ID NO: 3367424 - protein, 28 aa, Plasmodium falciparum
NEQTEIYSFGALILEMLVSKSPAIHVGK

SEQ ID NO: 3367425 - protein, 26 aa, Plasmodium falciparum
NEREAFKRAHSNIKNFQVNQNKMREL

SEQ ID NO: 3367426 - protein, 23 aa, Plasmodium falciparum
NERIAISAIEFWNTVCEEETFID

SEQ ID NO: 3367427 - protein, 17 aa, Plasmodium falciparum
NERIEYIVENYVKHRKC

SEQ ID NO: 3367428 - protein, 24 aa, Plasmodium falciparum
NERIMKYLLNFYHFLNKYNYKKCK

SEQ ID NO: 3367429 - protein, 18 aa, Plasmodium falciparum
NERIPIFGKNFLDLIKKE

SEQ ID NO: 3367430 - protein, 22 aa, Plasmodium falciparum
NERKGVKSFNVINEKTNVEIFS

SEQ ID NO: 3367431 - protein, 26 aa, Plasmodium falciparum
NERKKCLQESLLACQSDWDVKNILLK

SEQ ID NO: 3367432 - protein, 20 aa, Plasmodium falciparum
NERLHTFSGVYSLNLNDEIK

SEQ ID NO: 3367433 - protein, 18 aa, Plasmodium falciparum
NERLIKSTHLLNEQNNIS

SEQ ID NO: 3367434 - protein, 22 aa, Plasmodium falciparum
NERLRRMIYLLIKNLPVSEKEI

SEQ ID NO: 3367435 - protein, 24 aa, Plasmodium falciparum
NERMINCFLELELIFCEPSKSLWI

SEQ ID NO: 3367436 - protein, 24 aa, Plasmodium falciparum
NERMPRFSEYQIYKNSNVMYLNKS

SEQ ID NO: 3367437 - protein, 23 aa, Plasmodium falciparum
NERVYRLNIKELRSITYGIYGFV

SEQ ID NO: 3367438 - protein, 23 aa, Plasmodium falciparum
NESIKKPWFFTIKKNMKPSDITE

SEQ ID NO: 3367439 - protein, 18 aa, Plasmodium falciparum
NESIKNEIGTDMCNHTND

SEQ ID NO: 3367440 - protein, 22 aa, Plasmodium falciparum
NESKKLYDVYDMINDYYEKNKN

SEQ ID NO: 3367441 - protein, 23 aa, Plasmodium falciparum
NESLDISNVFLISCNKNKNDDDK

SEQ ID NO: 3367442 - protein, 19 aa, Plasmodium falciparum
NESLFFYLIYNNMKYIHAL

SEQ ID NO: 3367443 - protein, 18 aa, Plasmodium falciparum
NESLKYINKSIIGRSSIC

SEQ ID NO: 3367444 - protein, 21 aa, Plasmodium falciparum
NESTCFKVILELSNLKDKLNE

SEQ ID NO: 3367445 - protein, 18 aa, Plasmodium falciparum
NESYLHMSKNSNVHYNNY

SEQ ID NO: 3367446 - protein, 25 aa, Plasmodium falciparum
NETCIKELFILLIPYIRYLIQNKNY

SEQ ID NO: 3367447 - protein, 21 aa, Plasmodium falciparum
NETHIKCMISFFDKVINKIID

SEQ ID NO: 3367448 - protein, 18 aa, Plasmodium falciparum
NETKEIKSLKVVWNPNKD

SEQ ID NO: 3367449 - protein, 21 aa, Plasmodium falciparum
NETKISFTIDFKIYPPILMKN

SEQ ID NO: 3367450 - protein, 17 aa, Plasmodium falciparum
NETKLEWLCLDLDLVEC

SEQ ID NO: 3367451 - protein, 25 aa, Plasmodium falciparum
NETLFKKELDQEMILDIIDNLSSFV

SEQ ID NO: 3367452 - protein, 21 aa, Plasmodium falciparum
NETNGLFFLCYKYVDELFKEG

SEQ ID NO: 3367453 - protein, 21 aa, Plasmodium falciparum
NETPRDDFTFNHFQKNKNNNI

SEQ ID NO: 3367454 - protein, 23 aa, Plasmodium falciparum
NETQFSLSTCLTESSFMDKKMKE

SEQ ID NO: 3367455 - protein, 26 aa, Plasmodium falciparum
NEVAERRGIKHWGIDCENKILYSTLK

SEQ ID NO: 3367456 - protein, 27 aa, Plasmodium falciparum
NEVEFLIKWIDKSHIHNFFCTYDYLKN

SEQ ID NO: 3367457 - protein, 17 aa, Plasmodium falciparum
NEVEFPYTFSIKNVQNN

SEQ ID NO: 3367458 - protein, 24 aa, Plasmodium falciparum
NEVGKKRAPRRRAKTINLKSINRF

SEQ ID NO: 3367459 - protein, 23 aa, Plasmodium falciparum
NEVKSMAGEDYCDIDKRSIDNLG

SEQ ID NO: 3367460 - protein, 20 aa, Plasmodium falciparum
NEVLENIWQMYDAVNYLIFV

SEQ ID NO: 3367461 - protein, 18 aa, Plasmodium falciparum
NEVLWKNAQWKNVYMADL

SEQ ID NO: 3367462 - protein, 17 aa, Plasmodium falciparum
NEVRKENDQCVGKIISL

SEQ ID NO: 3367463 - protein, 18 aa, Plasmodium falciparum
NEVTSFDTVYIYNEKKVD

SEQ ID NO: 3367464 - protein, 17 aa, Plasmodium falciparum
NEVYNFFNLHFPLNENI

SEQ ID NO: 3367465 - protein, 20 aa, Plasmodium falciparum
NEYAYKFNIDDIINTEQLNN

SEQ ID NO: 3367466 - protein, 17 aa, Plasmodium falciparum
NEYCKYKYGALKILECL

SEQ ID NO: 3367467 - protein, 17 aa, Plasmodium falciparum
NEYDKAILCIDDIDIIF

SEQ ID NO: 3367468 - protein, 23 aa, Plasmodium falciparum
NEYEILSVFWIYNETIRKQDENM

SEQ ID NO: 3367469 - protein, 41 aa, Plasmodium falciparum
NEYFSDMMVYISWVPKSARCQYPRELPKSAAERNKLSEYIV

SEQ ID NO: 3367470 - protein, 22 aa, Plasmodium falciparum
NEYFYYSFLIDIEYSNLLHMKK

SEQ ID NO: 3367471 - protein, 27 aa, Plasmodium falciparum
NEYIHHKYIKACIGVKISANNLEEVLC

SEQ ID NO: 3367472 - protein, 22 aa, Plasmodium falciparum
NEYINNYILECIFNDKKVDNNY

SEQ ID NO: 3367473 - protein, 18 aa, Plasmodium falciparum
NEYIPINVNNFFATNKKV

SEQ ID NO: 3367474 - protein, 17 aa, Plasmodium falciparum
NEYIWKGILSMKNKENL

SEQ ID NO: 3367475 - protein, 17 aa, Plasmodium falciparum
NEYKNVYFLTKREFEAL

SEQ ID NO: 3367476 - protein, 19 aa, Plasmodium falciparum
NEYLPLILITAGTNVADHE

SEQ ID NO: 3367477 - protein, 24 aa, Plasmodium falciparum
NEYNKLYMHRYYHINNHTTNNDNI

SEQ ID NO: 3367478 - protein, 28 aa, Plasmodium falciparum
NEYNSRLKFLYTGCLSFANLNIDKPSNG

SEQ ID NO: 3367479 - protein, 25 aa, Plasmodium falciparum
NEYYFYRYLCCAYDFEKTNYDFFQY

SEQ ID NO: 3367480 - protein, 25 aa, Plasmodium falciparum
NFAFAIPMSLYLKMNTHLNLDDIKL

SEQ ID NO: 3367481 - protein, 22 aa, Plasmodium falciparum
NFAKELKLIIPNSEKINRGSYF

SEQ ID NO: 3367482 - protein, 17 aa, Plasmodium falciparum
NFAKMFKIEFEDENEVK

SEQ ID NO: 3367483 - protein, 23 aa, Plasmodium falciparum
NFATLKSAYEFLLNENLRKKYNL

SEQ ID NO: 3367484 - protein, 32 aa, Plasmodium falciparum
NFCEINIPGFKKCLILSFVCPNCNFKTSEIKS

SEQ ID NO: 3367485 - protein, 19 aa, Plasmodium falciparum
NFCENPCKFIDHFMNSKFS

SEQ ID NO: 3367486 - protein, 20 aa, Plasmodium falciparum
NFCSSSYFTNEWKFNKSNFI

SEQ ID NO: 3367487 - protein, 19 aa, Plasmodium falciparum
NFDICLYLLQKHGGDLNNE

SEQ ID NO: 3367488 - protein, 24 aa, Plasmodium falciparum
NFDNPNDFNICWNDESSTGVNRNI

SEQ ID NO: 3367489 - protein, 28 aa, Plasmodium falciparum
NFEHLHFFECLKKKSLKLMNTFDAQDFY

SEQ ID NO: 3367490 - protein, 24 aa, Plasmodium falciparum
NFFDEFLCSLNICECCCLVVDVVD

SEQ ID NO: 3367491 - protein, 21 aa, Plasmodium falciparum
NFFDLLKSSVIEWIDVNEQNN

SEQ ID NO: 3367492 - protein, 17 aa, Plasmodium falciparum
NFFKCPCWLNDNKNIKL

SEQ ID NO: 3367493 - protein, 26 aa, Plasmodium falciparum
NFFQFFPNVYRFMQMQKFLVKHMNCV

SEQ ID NO: 3367494 - protein, 20 aa, Plasmodium falciparum
NFFSCIGISNFYRATDLSKN

SEQ ID NO: 3367495 - protein, 27 aa, Plasmodium falciparum
NFFVIPNCIFDEKFPGLQKKTESMIIQ

SEQ ID NO: 3367496 - protein, 19 aa, Plasmodium falciparum
NFGRGGYRSGGGMGGGFRG

SEQ ID NO: 3367497 - protein, 26 aa, Plasmodium falciparum
NFHYSLKVFLNICIKDLRRCINEFYN

SEQ ID NO: 3367498 - protein, 22 aa, Plasmodium falciparum
NFIDKMDTTRCQGGNIRNNKYS

SEQ ID NO: 3367499 - protein, 28 aa, Plasmodium falciparum
NFIKKEIKLLECFNINHLLDTPFMKTLE

SEQ ID NO: 3367500 - protein, 21 aa, Plasmodium falciparum
NFINCKINNLYVITTDTNKIP

SEQ ID NO: 3367501 - protein, 24 aa, Plasmodium falciparum
NFINHPVQLFYILDNKNWLKKYQK

SEQ ID NO: 3367502 - protein, 19 aa, Plasmodium falciparum
NFIPFSIYFNIFLNKQICI

SEQ ID NO: 3367503 - protein, 17 aa, Plasmodium falciparum
NFIPSNIKFNFLNEINI

SEQ ID NO: 3367504 - protein, 26 aa, Plasmodium falciparum
NFIVNLRLGKYIFKNELFDIKNNDCL

SEQ ID NO: 3367505 - protein, 21 aa, Plasmodium falciparum
NFKDIKLDLGDKINTTDNLCS

SEQ ID NO: 3367506 - protein, 21 aa, Plasmodium falciparum
NFKEFDIFLFYKINNYHKYKE

SEQ ID NO: 3367507 - protein, 25 aa, Plasmodium falciparum
NFKEVILRLRFEGIKNSIYEKDKKL

SEQ ID NO: 3367508 - protein, 29 aa, Plasmodium falciparum
NFKNIFLKDYELMFILFYLKYEYRLPLKC

SEQ ID NO: 3367509 - protein, 19 aa, Plasmodium falciparum
NFKRPKTHMKKVFIDLTLK

SEQ ID NO: 3367510 - protein, 22 aa, Plasmodium falciparum
NFKSAVFKKRMIGSPYTNINTY

SEQ ID NO: 3367511 - protein, 17 aa, Plasmodium falciparum
NFLCPNFDYTYNDDYNY

SEQ ID NO: 3367512 - protein, 17 aa, Plasmodium falciparum
NFLEDKYVEKIDRIHDS

SEQ ID NO: 3367513 - protein, 22 aa, Plasmodium falciparum
NFLEPCGQFGSRKEGGKDASAA

SEQ ID NO: 3367514 - protein, 26 aa, Plasmodium falciparum
NFLFVELMINYKCVTKSISIAFMKRN

SEQ ID NO: 3367515 - protein, 25 aa, Plasmodium falciparum
NFLKNNFDSVFGFPSIVRFSWSTAD

SEQ ID NO: 3367516 - protein, 20 aa, Plasmodium falciparum
NFLWACANIASVKRENVEGV

SEQ ID NO: 3367517 - protein, 25 aa, Plasmodium falciparum
NFLYTNKIYPCYVNYYMNMYKNYKS

SEQ ID NO: 3367518 - protein, 28 aa, Plasmodium falciparum
NFMQHIFLIYKKWWLYDRHNCKHLLDDF

SEQ ID NO: 3367519 - protein, 17 aa, Plasmodium falciparum
NFNCSYESINYGMDTYN

SEQ ID NO: 3367520 - protein, 24 aa, Plasmodium falciparum
NFNELRVTNYINRLLKARKVTTQR

SEQ ID NO: 3367521 - protein, 18 aa, Plasmodium falciparum
NFNFACFCLFDGHNGKNT

SEQ ID NO: 3367522 - protein, 24 aa, Plasmodium falciparum
NFNFKWFPTPIINYKFKKYVLLSF

SEQ ID NO: 3367523 - protein, 17 aa, Plasmodium falciparum
NFNGYKLLERPLVVDHI

SEQ ID NO: 3367524 - protein, 21 aa, Plasmodium falciparum
NFNKLKPLLILKNFNNTSNTE

SEQ ID NO: 3367525 - protein, 23 aa, Plasmodium falciparum
NFNKNNFKYVIGQNLHRDDNNIL

SEQ ID NO: 3367526 - protein, 41 aa, Plasmodium falciparum
NFNLWPTRVNILKAVNWLVRDSIPFGSYVFYFAGKSVQVDN

SEQ ID NO: 3367527 - protein, 22 aa, Plasmodium falciparum
NFNLYPLFNFVAYASLKINGVS

SEQ ID NO: 3367528 - protein, 18 aa, Plasmodium falciparum
NFNNLGFSKNKEMNIDIN

SEQ ID NO: 3367529 - protein, 22 aa, Plasmodium falciparum
NFNRMNFNKGLGNNNFNNNSNN

SEQ ID NO: 3367530 - protein, 31 aa, Plasmodium falciparum
NFNTKRWNIILSLKRDNCLLITGTPLQNSLE

SEQ ID NO: 3367531 - protein, 18 aa, Plasmodium falciparum
NFNYKKYLLHNGSIHNIT

SEQ ID NO: 3367532 - protein, 17 aa, Plasmodium falciparum
NFQDCFIKSDKNKKTNK

SEQ ID NO: 3367533 - protein, 25 aa, Plasmodium falciparum
NFRNAKELKLIYPIDSSFDNFKNNY

SEQ ID NO: 3367534 - protein, 29 aa, Plasmodium falciparum
NFRNKCFYFKNSLYFYGGSGYNPNIKESI

SEQ ID NO: 3367535 - protein, 29 aa, Plasmodium falciparum
NFSCILEVELWYHSFILLKLDFNKSDPFI

SEQ ID NO: 3367536 - protein, 26 aa, Plasmodium falciparum
NFSDHMKYVLSLCKIIPQYPIKYSRR

SEQ ID NO: 3367537 - protein, 26 aa, Plasmodium falciparum
NFSEVAKIIPQWKYSFEALNTRAHED

SEQ ID NO: 3367538 - protein, 18 aa, Plasmodium falciparum
NFSGYKIYSDGLVHSEFS

SEQ ID NO: 3367539 - protein, 25 aa, Plasmodium falciparum
NFSKGLCVQENFTITNLLKLLNVSE

SEQ ID NO: 3367540 - protein, 25 aa, Plasmodium falciparum
NFSNFSAWFLKYSLKKSIIDTNNEL

SEQ ID NO: 3367541 - protein, 23 aa, Plasmodium falciparum
NFSNRHMSMYSNRGMNTTQGNNN

SEQ ID NO: 3367542 - protein, 18 aa, Plasmodium falciparum
NFSNYEFRNNKEITDKEI

SEQ ID NO: 3367543 - protein, 45 aa, Plasmodium falciparum
NFSQCTNVTYNVRRMWHPLFNRPLGDIGRKLILKEIREHHHRDAE

SEQ ID NO: 3367544 - protein, 22 aa, Plasmodium falciparum
NFTFELPKDYPLGSISIINVTV

SEQ ID NO: 3367545 - protein, 31 aa, Plasmodium falciparum
NFTFIRWLCLTDCLLVCFFDEQLILNSLICQ

SEQ ID NO: 3367546 - protein, 20 aa, Plasmodium falciparum
NFTFKLLLFEPLKKKKHFTL

SEQ ID NO: 3367547 - protein, 25 aa, Plasmodium falciparum
NFTNSCLYKKININQNIPNYYNYPN

SEQ ID NO: 3367548 - protein, 21 aa, Plasmodium falciparum
NFVSLDLVKIFYNFEKHKNSH

SEQ ID NO: 3367549 - protein, 21 aa, Plasmodium falciparum
NFVTYCFTKYYALKLSKNLCI

SEQ ID NO: 3367550 - protein, 23 aa, Plasmodium falciparum
NFYKDPINFLFICNQTEKRIKEI

SEQ ID NO: 3367551 - protein, 23 aa, Plasmodium falciparum
NFYRKRKISPSIINRDDTNMDKN

SEQ ID NO: 3367552 - protein, 21 aa, Plasmodium falciparum
NFYRNHIWRCTGVCRKYPPHF

SEQ ID NO: 3367553 - protein, 18 aa, Plasmodium falciparum
NFYRNVVYFVIMRRNKFH

SEQ ID NO: 3367554 - protein, 21 aa, Plasmodium falciparum
NFYYNKLRFLELLCNQTNDSY

SEQ ID NO: 3367555 - protein, 24 aa, Plasmodium falciparum
NGCTLIYYHCDHIYKGHPKYIIDS

SEQ ID NO: 3367556 - protein, 26 aa, Plasmodium falciparum
NGDICIYGGMLHDKCVENFIRYVPGI

SEQ ID NO: 3367557 - protein, 28 aa, Plasmodium falciparum
NGDILFFYFCGYSIKLIDSKFTENYNFA

SEQ ID NO: 3367558 - protein, 26 aa, Plasmodium falciparum
NGEFSKRILYNRSKSTENIKEMMQPH

SEQ ID NO: 3367559 - protein, 23 aa, Plasmodium falciparum
NGETYSGFLVFCDRFMNLHMKNI

SEQ ID NO: 3367560 - protein, 18 aa, Plasmodium falciparum
NGFFKIKSLLGVNDKSVQ

SEQ ID NO: 3367561 - protein, 25 aa, Plasmodium falciparum
NGFVVLECQNCSLVGNPAEKKKIIT

SEQ ID NO: 3367562 - protein, 28 aa, Plasmodium falciparum
NGGIYINKFKLSLDMPINKLAVSSNLGP

SEQ ID NO: 3367563 - protein, 19 aa, Plasmodium falciparum
NGGRFLLCVGMRRIENRII

SEQ ID NO: 3367564 - protein, 21 aa, Plasmodium falciparum
NGGTIKGHISTTFKTNLDHID

SEQ ID NO: 3367565 - protein, 20 aa, Plasmodium falciparum
NGIKKRKCVEKKIEKVFKKT

SEQ ID NO: 3367566 - protein, 17 aa, Plasmodium falciparum
NGISYKINIYDNNHPID

SEQ ID NO: 3367567 - protein, 25 aa, Plasmodium falciparum
NGITCVKWYQEFFILSGSRNCSYIY

SEQ ID NO: 3367568 - protein, 18 aa, Plasmodium falciparum
NGIVKCIECKKSQHVSCY

SEQ ID NO: 3367569 - protein, 23 aa, Plasmodium falciparum
NGIVLRRWKRLYKDIRCDSELFI

SEQ ID NO: 3367570 - protein, 23 aa, Plasmodium falciparum
NGKCMKSSSSFEVKHLYKKINDI

SEQ ID NO: 3367571 - protein, 33 aa, Plasmodium falciparum
NGKERLLNRYNIMRPQRSADMLIRNYLYNDLPY

SEQ ID NO: 3367572 - protein, 28 aa, Plasmodium falciparum
NGKFCLGMKHGYGIYVYDHINRYEGYWF

SEQ ID NO: 3367573 - protein, 23 aa, Plasmodium falciparum
NGKFKTKGFSLIHYSTLEEARKQ

SEQ ID NO: 3367574 - protein, 23 aa, Plasmodium falciparum
NGKIKGSAGFLSFLANNSASFNH

SEQ ID NO: 3367575 - protein, 26 aa, Plasmodium falciparum
NGKILCVGCKCGFVHLINSLTFEIFF

SEQ ID NO: 3367576 - protein, 34 aa, Plasmodium falciparum
NGKKISPFFPVWPNIPDFFGYKMFKNIKKDFKRM

SEQ ID NO: 3367577 - protein, 21 aa, Plasmodium falciparum
NGKKQIFFLFPLKSLINEKMT

SEQ ID NO: 3367578 - protein, 20 aa, Plasmodium falciparum
NGKMKREIRKTKYYTNKYSN

SEQ ID NO: 3367579 - protein, 24 aa, Plasmodium falciparum
NGKNKFANCNLPYDNPKEYHNVIN

SEQ ID NO: 3367580 - protein, 20 aa, Plasmodium falciparum
NGKPSLFIHTILKELINNDN

SEQ ID NO: 3367581 - protein, 28 aa, Plasmodium falciparum
NGKRLIIFDFKKAIDMYRIRKLKKKILD

SEQ ID NO: 3367582 - protein, 20 aa, Plasmodium falciparum
NGKSRGYGFINFENQQSAIN

SEQ ID NO: 3367583 - protein, 21 aa, Plasmodium falciparum
NGKSRGYGFINFENQQSAINA

SEQ ID NO: 3367584 - protein, 20 aa, Plasmodium falciparum
NGKWGSDIINMMQTTNMNNL

SEQ ID NO: 3367585 - protein, 17 aa, Plasmodium falciparum
NGLFKLQARYLISRQSI

SEQ ID NO: 3367586 - protein, 19 aa, Plasmodium falciparum
NGLFLYKLYEKGFMNLYGF

SEQ ID NO: 3367587 - protein, 19 aa, Plasmodium falciparum
NGLITKEHIVSSISPTDEL

SEQ ID NO: 3367588 - protein, 27 aa, Plasmodium falciparum
NGLKIIYSLQLIRYSLYEFMKNTQMLI

SEQ ID NO: 3367589 - protein, 26 aa, Plasmodium falciparum
NGLKYLFCLFMLRDIKKQNHMSVFEF

SEQ ID NO: 3367590 - protein, 24 aa, Plasmodium falciparum
NGLKYLYKLKHLFTTPMDVETLSE

SEQ ID NO: 3367591 - protein, 20 aa, Plasmodium falciparum
NGLLCLLCNMKINYIDVNKS

SEQ ID NO: 3367592 - protein, 19 aa, Plasmodium falciparum
NGLTAMSMNLFDDSSDNDS

SEQ ID NO: 3367593 - protein, 22 aa, Plasmodium falciparum
NGMDKFKRTTLRKYSKNHKRNA

SEQ ID NO: 3367594 - protein, 26 aa, Plasmodium falciparum
NGMIYCKRIKFYLKNEREHDYTDFLI

SEQ ID NO: 3367595 - protein, 18 aa, Plasmodium falciparum
NGMKKCNLRNLLKRLEET

SEQ ID NO: 3367596 - protein, 22 aa, Plasmodium falciparum
NGMYILPQYVTRECINSPYDSS

SEQ ID NO: 3367597 - protein, 24 aa, Plasmodium falciparum
NGNGEGRYLFSLLDRLNNFKKLKL

SEQ ID NO: 3367598 - protein, 24 aa, Plasmodium falciparum
NGNKRSDKNFSYNTKSNIYNIQDN

SEQ ID NO: 3367599 - protein, 20 aa, Plasmodium falciparum
NGNLWKCSDPLQDEDFFYFV

SEQ ID NO: 3367600 - protein, 27 aa, Plasmodium falciparum
NGNYNYLGSYGCNYPYNNNYYVDENEK

SEQ ID NO: 3367601 - protein, 18 aa, Plasmodium falciparum
NGPFDYLNYYFLCEIVFD

SEQ ID NO: 3367602 - protein, 17 aa, Plasmodium falciparum
NGPSFSAYITYSNEKEA

SEQ ID NO: 3367603 - protein, 29 aa, Plasmodium falciparum
NGPYIPYNYKPIYHVEPFSSDVNNNMNSN

SEQ ID NO: 3367604 - protein, 20 aa, Plasmodium falciparum
NGQEKVKCIQIVSKYKNDIL

SEQ ID NO: 3367605 - protein, 18 aa, Plasmodium falciparum
NGQKFLKNDLHEINEYNN

SEQ ID NO: 3367606 - protein, 24 aa, Plasmodium falciparum
NGRIEEFKDGYALSREDIKNKDFQ

SEQ ID NO: 3367607 - protein, 19 aa, Plasmodium falciparum
NGSCMLVGVGGSGKRSLTK

SEQ ID NO: 3367608 - protein, 23 aa, Plasmodium falciparum
NGSEAMLHASEFNQGINKENFQG

SEQ ID NO: 3367609 - protein, 20 aa, Plasmodium falciparum
NGSLLYEELIPLLLEKLHSF

SEQ ID NO: 3367610 - protein, 23 aa, Plasmodium falciparum
NGSNFCRFLKYNIVDKMRTLVNT

SEQ ID NO: 3367611 - protein, 17 aa, Plasmodium falciparum
NGTCCYEEVRKFNKLKI

SEQ ID NO: 3367612 - protein, 17 aa, Plasmodium falciparum
NGTFGIQTILKRKENLL

SEQ ID NO: 3367613 - protein, 27 aa, Plasmodium falciparum
NGTIDFPEFLTLMARKLKDTDTEEELI

SEQ ID NO: 3367614 - protein, 17 aa, Plasmodium falciparum
NGTTLRDSHHYVTTTTN

SEQ ID NO: 3367615 - protein, 17 aa, Plasmodium falciparum
NGTYIYKYISMLLYTTN

SEQ ID NO: 3367616 - protein, 18 aa, Plasmodium falciparum
NGVHFLKYLNKSEFLLSG

SEQ ID NO: 3367617 - protein, 21 aa, Plasmodium falciparum
NGVKYKALVSYAPNQTLIKKN

SEQ ID NO: 3367618 - protein, 20 aa, Plasmodium falciparum
NGVYKICDFCSHSISNSFFP

SEQ ID NO: 3367619 - protein, 21 aa, Plasmodium falciparum
NGYAAIKMVGPFISQEYYTYV

SEQ ID NO: 3367620 - protein, 23 aa, Plasmodium falciparum
NGYDEMHRSFFIPEERESINMSK

SEQ ID NO: 3367621 - protein, 19 aa, Plasmodium falciparum
NHAMKTLANYCLTNNTMWI

SEQ ID NO: 3367622 - protein, 25 aa, Plasmodium falciparum
NHCPGSVIIYFEFKNGTKIIHTGDF

SEQ ID NO: 3367623 - protein, 30 aa, Plasmodium falciparum
NHDLRKCLLVKGWSTDSWSFPRGKVDELEE

SEQ ID NO: 3367624 - protein, 29 aa, Plasmodium falciparum
NHEEHCPYSPHSVEGMFLNNKKNKNQIIS

SEQ ID NO: 3367625 - protein, 18 aa, Plasmodium falciparum
NHEIVMCNKINYKKFYKN

SEQ ID NO: 3367626 - protein, 17 aa, Plasmodium falciparum
NHFRNSFNNPLYDFYES

SEQ ID NO: 3367627 - protein, 24 aa, Plasmodium falciparum
NHFYDISDNLYLQECSDNFFHNNK

SEQ ID NO: 3367628 - protein, 37 aa, Plasmodium falciparum
NHGDKSMWFNYNFDEHTFKEWVQKHIDRKLEKQQNYQ

SEQ ID NO: 3367629 - protein, 25 aa, Plasmodium falciparum
NHGSKMKTCIEIRSKAFYKLNRDIM

SEQ ID NO: 3367630 - protein, 18 aa, Plasmodium falciparum
NHGYCLKKKSILKRKELA

SEQ ID NO: 3367631 - protein, 33 aa, Plasmodium falciparum
NHILESFDHLKFLSIPWFFFLQTQWIKNLDLLL

SEQ ID NO: 3367632 - protein, 17 aa, Plasmodium falciparum
NHIPKNNPLNCNDNNQK

SEQ ID NO: 3367633 - protein, 36 aa, Plasmodium falciparum
NHITKDIIFFCFSLCIFSYICGFKSTGKVKYLDFFI

SEQ ID NO: 3367634 - protein, 17 aa, Plasmodium falciparum
NHKGRVTSMEWLGDLLF

SEQ ID NO: 3367635 - protein, 25 aa, Plasmodium falciparum
NHKKRKLLISNFFPYPLNNMELFIS

SEQ ID NO: 3367636 - protein, 24 aa, Plasmodium falciparum
NHKLPEMRRIAALLYKKNKKYKEA

SEQ ID NO: 3367637 - protein, 20 aa, Plasmodium falciparum
NHKRSVSSFNNVDKVINTFK

SEQ ID NO: 3367638 - protein, 22 aa, Plasmodium falciparum
NHLFFANNIFFDFDKETNQLNS

SEQ ID NO: 3367639 - protein, 24 aa, Plasmodium falciparum
NHLFNYNNHMYKKFVSNQYLENVP

SEQ ID NO: 3367640 - protein, 25 aa, Plasmodium falciparum
NHLHNGDYAFTDFLLNNKIINSHNK

SEQ ID NO: 3367641 - protein, 17 aa, Plasmodium falciparum
NHLKEFEEMNGYRYIGS

SEQ ID NO: 3367642 - protein, 21 aa, Plasmodium falciparum
NHLKNYLKKCIGEMCLNICPY

SEQ ID NO: 3367643 - protein, 17 aa, Plasmodium falciparum
NHLKVLLWEKIWDYYRG

SEQ ID NO: 3367644 - protein, 21 aa, Plasmodium falciparum
NHLNCFCFKLHVKFSSKRTGN

SEQ ID NO: 3367645 - protein, 19 aa, Plasmodium falciparum
NHLQAIGNLRFLRHCEKIN

SEQ ID NO: 3367646 - protein, 19 aa, Plasmodium falciparum
NHLYYEMIKKANIQIVNPL

SEQ ID NO: 3367647 - protein, 25 aa, Plasmodium falciparum
NHMNLVFEFSDLMFATPATISRAGL

SEQ ID NO: 3367648 - protein, 31 aa, Plasmodium falciparum
NHMNPSYIYNNICTPTNFIQDLIKTNKINNN

SEQ ID NO: 3367649 - protein, 19 aa, Plasmodium falciparum
NHNGVSKCDINNLEVSVET

SEQ ID NO: 3367650 - protein, 17 aa, Plasmodium falciparum
NHNKACGYMLEKRNEVY

SEQ ID NO: 3367651 - protein, 19 aa, Plasmodium falciparum
NHNNLKCDVLIKDKDQSYN

SEQ ID NO: 3367652 - protein, 20 aa, Plasmodium falciparum
NHPFLCAEPLDKDEYKERLV

SEQ ID NO: 3367653 - protein, 24 aa, Plasmodium falciparum
NHPIMNIKDAFILSNQRKSLSDIS

SEQ ID NO: 3367654 - protein, 21 aa, Plasmodium falciparum
NHPKDNFYSYLYDSLQGKNHI

SEQ ID NO: 3367655 - protein, 18 aa, Plasmodium falciparum
NHPLKLPLLPEMSHPNVF

SEQ ID NO: 3367656 - protein, 28 aa, Plasmodium falciparum
NHPNPLPGPQPIFAPPLPYTNTLTSTGN

SEQ ID NO: 3367657 - protein, 17 aa, Plasmodium falciparum
NHRKGVISVSKYKSELT

SEQ ID NO: 3367658 - protein, 21 aa, Plasmodium falciparum
NHSLVSFLCILFVVEKLNDYV

SEQ ID NO: 3367659 - protein, 29 aa, Plasmodium falciparum
NHTNIPCVLDFLKHRYLKNQIYTTAVPLI

SEQ ID NO: 3367660 - protein, 23 aa, Plasmodium falciparum
NHTVNRFAPMGQYANSKNNNMNN

SEQ ID NO: 3367661 - protein, 23 aa, Plasmodium falciparum
NHYELPTICSIVKSKHPIYSKPN

SEQ ID NO: 3367662 - protein, 45 aa, Plasmodium falciparum
NHYKTCSVFNNFDFRINSEWQLVYLDGWPHIILTSIPGVEINPGE

SEQ ID NO: 3367663 - protein, 18 aa, Plasmodium falciparum
NHYLFKYIYNISFSHVFK

SEQ ID NO: 3367664 - protein, 18 aa, Plasmodium falciparum
NIALKVIEDIALTVDIEE

SEQ ID NO: 3367665 - protein, 25 aa, Plasmodium falciparum
NIALNSKFAYLAIYTCENNCDIFDI

SEQ ID NO: 3367666 - protein, 17 aa, Plasmodium falciparum
NIANFFFNRNMYINVTN

SEQ ID NO: 3367667 - protein, 23 aa, Plasmodium falciparum
NIAPEIFFTPSLLQNSNKLNHHL

SEQ ID NO: 3367668 - protein, 17 aa, Plasmodium falciparum
NICCSSMNDKSFKINNN

SEQ ID NO: 3367669 - protein, 18 aa, Plasmodium falciparum
NICILKYTTFSSFYEKYK

SEQ ID NO: 3367670 - protein, 21 aa, Plasmodium falciparum
NICKKGRKTNNIKKRKILVND

SEQ ID NO: 3367671 - protein, 19 aa, Plasmodium falciparum
NICSFDFVTAPSLKSLKKC

SEQ ID NO: 3367672 - protein, 24 aa, Plasmodium falciparum
NICVKKNREGYELNHKNKNIVDNK

SEQ ID NO: 3367673 - protein, 21 aa, Plasmodium falciparum
NICYVRCIIKNKLFQIKLNDP

SEQ ID NO: 3367674 - protein, 24 aa, Plasmodium falciparum
NIDDIKLSNICFNNKKENDIYNVI

SEQ ID NO: 3367675 - protein, 19 aa, Plasmodium falciparum
NIDEFITYIYLYKGKRFRV

SEQ ID NO: 3367676 - protein, 27 aa, Plasmodium falciparum
NIDETWPTFFFVNLNFSKFNNVYRLLY

SEQ ID NO: 3367677 - protein, 25 aa, Plasmodium falciparum
NIDKCLKPYLPLLSYLMFETDIVVN

SEQ ID NO: 3367678 - protein, 18 aa, Plasmodium falciparum
NIDLKKKFELLDTYEKEL

SEQ ID NO: 3367679 - protein, 26 aa, Plasmodium falciparum
NIDMYNCKHIACSEIRAYNLSNQCNY

SEQ ID NO: 3367680 - protein, 24 aa, Plasmodium falciparum
NIEECFKIHTSSINYMKVKGKGEC

SEQ ID NO: 3367681 - protein, 50 aa, Plasmodium falciparum
NIEGCHKSDNMIKLESRNMIYEYYKNLDVNECTVHIISIEVVNLHDEIYI

SEQ ID NO: 3367682 - protein, 27 aa, Plasmodium falciparum
NIEIKGKGPLCINFNDFIDEKKKNTGN

SEQ ID NO: 3367683 - protein, 24 aa, Plasmodium falciparum
NIEKAYILKNWWIHNKKMICNSIN

SEQ ID NO: 3367684 - protein, 24 aa, Plasmodium falciparum
NIEKELKTKEILYLKNKKNDLYQD

SEQ ID NO: 3367685 - protein, 17 aa, Plasmodium falciparum
NIEKLRIVQKMKEKIRV

SEQ ID NO: 3367686 - protein, 17 aa, Plasmodium falciparum
NIEKYKFANEEKNSEQI

SEQ ID NO: 3367687 - protein, 24 aa, Plasmodium falciparum
NIELFCNNYSNGFLLNEEYTKGME

SEQ ID NO: 3367688 - protein, 23 aa, Plasmodium falciparum
NIELKKLVYLYVINYAKVQPELA

SEQ ID NO: 3367689 - protein, 32 aa, Plasmodium falciparum
NIELNWACDPLLYEELEWYLSTNNEYLNMTDK

SEQ ID NO: 3367690 - protein, 22 aa, Plasmodium falciparum
NIERGKGIVEFVSYDDMLYAIE

SEQ ID NO: 3367691 - protein, 18 aa, Plasmodium falciparum
NIFCKKIISKKEKRAQMG

SEQ ID NO: 3367692 - protein, 27 aa, Plasmodium falciparum
NIFDFKNEMLFCFKRDYENIYMNITNM

SEQ ID NO: 3367693 - protein, 42 aa, Plasmodium falciparum
NIFDILPLLNIYFNFFYIYGINVKALYKWKTYNIEHRILTKY

SEQ ID NO: 3367694 - protein, 31 aa, Plasmodium falciparum
NIFEFKLFIKACRLTWRKSIKNLHAEYTELL

SEQ ID NO: 3367695 - protein, 18 aa, Plasmodium falciparum
NIFENLGFKGHIRINNKV

SEQ ID NO: 3367696 - protein, 17 aa, Plasmodium falciparum
NIFESLNSFIYNFKNNN

SEQ ID NO: 3367697 - protein, 23 aa, Plasmodium falciparum
NIFFGDLVLLKFIPKETAKNDTQ

SEQ ID NO: 3367698 - protein, 24 aa, Plasmodium falciparum
NIFFQHFLCLYIKQQFYIFNILSY

SEQ ID NO: 3367699 - protein, 18 aa, Plasmodium falciparum
NIFIPKPVISVAVEILKK

SEQ ID NO: 3367700 - protein, 28 aa, Plasmodium falciparum
NIFKGIGSTGCWCCFDEFNRLIPEVLSV

SEQ ID NO: 3367701 - protein, 23 aa, Plasmodium falciparum
NIFKRFLVYHYKQGIQVFRSFSC

SEQ ID NO: 3367702 - protein, 23 aa, Plasmodium falciparum
NIFLKIKNCLNIEKESGEIKNKN

SEQ ID NO: 3367703 - protein, 18 aa, Plasmodium falciparum
NIFLKNLLEFNISYNTIN

SEQ ID NO: 3367704 - protein, 19 aa, Plasmodium falciparum
NIFPKCGDKSISLFFPLSN

SEQ ID NO: 3367705 - protein, 25 aa, Plasmodium falciparum
NIFRKIQEAYECLTNEVQRKWYDRN

SEQ ID NO: 3367706 - protein, 18 aa, Plasmodium falciparum
NIFSYKKINHILATLLWN

SEQ ID NO: 3367707 - protein, 23 aa, Plasmodium falciparum
NIFYEKVDGILLVYDSSNNKSYH

SEQ ID NO: 3367708 - protein, 24 aa, Plasmodium falciparum
NIFYKFYLNNVIPIIGKVVANDMK

SEQ ID NO: 3367709 - protein, 21 aa, Plasmodium falciparum
NIFYKTKWRNIHNSSIVRSKE

SEQ ID NO: 3367710 - protein, 18 aa, Plasmodium falciparum
NIGCIEFVKHFKIHSDEI

SEQ ID NO: 3367711 - protein, 17 aa, Plasmodium falciparum
NIGLGHSYSRSKLKLDP

SEQ ID NO: 3367712 - protein, 40 aa, Plasmodium falciparum
NIGSFSFYKNEYDDMKYKLLKCEEKNKILLNKNQELHQTI

SEQ ID NO: 3367713 - protein, 21 aa, Plasmodium falciparum
NIHFYKKYSSYLLYLSNEKQI

SEQ ID NO: 3367714 - protein, 21 aa, Plasmodium falciparum
NIHIEKGEMNLIRSDINNNEN

SEQ ID NO: 3367715 - protein, 18 aa, Plasmodium falciparum
NIHIKRINEQVAQDVKWS

SEQ ID NO: 3367716 - protein, 19 aa, Plasmodium falciparum
NIHLKKCVFNLVGHLDYIR

SEQ ID NO: 3367717 - protein, 23 aa, Plasmodium falciparum
NIHVLNSWAPYIFISLNPKIIKN

SEQ ID NO: 3367718 - protein, 18 aa, Plasmodium falciparum
NIHYSFLYLFGGDLTNKG

SEQ ID NO: 3367719 - protein, 30 aa, Plasmodium falciparum
NIIEAFEDMGFCFKEDFTYDPEIYIENLKT

SEQ ID NO: 3367720 - protein, 17 aa, Plasmodium falciparum
NIIEKILLKKEYKYKKK

SEQ ID NO: 3367721 - protein, 26 aa, Plasmodium falciparum
NIIEKKVPLIVERVVPVLKVNRVEKE

SEQ ID NO: 3367722 - protein, 22 aa, Plasmodium falciparum
NIIEQYILYGLIDIDKIKNVIT

SEQ ID NO: 3367723 - protein, 18 aa, Plasmodium falciparum
NIIFFGIINKCLFLNNKR

SEQ ID NO: 3367724 - protein, 24 aa, Plasmodium falciparum
NIIKACSRLNYEINDIQILLDNFK

SEQ ID NO: 3367725 - protein, 23 aa, Plasmodium falciparum
NIIKCCLKMYPKIIESNPITSGT

SEQ ID NO: 3367726 - protein, 18 aa, Plasmodium falciparum
NIIKDVCEKHWSQKSREE

SEQ ID NO: 3367727 - protein, 18 aa, Plasmodium falciparum
NIIKFIIDQIYVFLFTKT

SEQ ID NO: 3367728 - protein, 24 aa, Plasmodium falciparum
NIIKKKRSISSFSLNQQDNSNDNS

SEQ ID NO: 3367729 - protein, 18 aa, Plasmodium falciparum
NIIKQYIQQFDWPEELFK

SEQ ID NO: 3367730 - protein, 18 aa, Plasmodium falciparum
NIIKSCRNYDLLYSEFLM

SEQ ID NO: 3367731 - protein, 32 aa, Plasmodium falciparum
NIILKINYCHRIKEIYNYILFNEEIYKTLEHA

SEQ ID NO: 3367732 - protein, 17 aa, Plasmodium falciparum
NIILKQTLEYMFTYNNK

SEQ ID NO: 3367733 - protein, 17 aa, Plasmodium falciparum
NIILNFLNKLNIEEENE

SEQ ID NO: 3367734 - protein, 18 aa, Plasmodium falciparum
NIILPYKYNNDILRIEIK

SEQ ID NO: 3367735 - protein, 17 aa, Plasmodium falciparum
NIILQGAKWDFISQSLI

SEQ ID NO: 3367736 - protein, 19 aa, Plasmodium falciparum
NIILRLNKLNCRLTSVHIV

SEQ ID NO: 3367737 - protein, 19 aa, Plasmodium falciparum
NIINFDLPYILNRGTALNL

SEQ ID NO: 3367738 - protein, 26 aa, Plasmodium falciparum
NIINFESLCIIPGKKVWCICINIMVI

SEQ ID NO: 3367739 - protein, 27 aa, Plasmodium falciparum
NIIPKCLEFFKSFILPFYGNKFGVYFE

SEQ ID NO: 3367740 - protein, 29 aa, Plasmodium falciparum
NIIPNRILQTFIFDLCIFFKQDNFLRQLL

SEQ ID NO: 3367741 - protein, 20 aa, Plasmodium falciparum
NIIPSIIIFDEIDMLFQNNA

SEQ ID NO: 3367742 - protein, 17 aa, Plasmodium falciparum
NIISRKMNIPFIGMNND

SEQ ID NO: 3367743 - protein, 20 aa, Plasmodium falciparum
NIIVSINIFKYININILCTK

SEQ ID NO: 3367744 - protein, 22 aa, Plasmodium falciparum
NIIWRQALKECIKYSMRGIPTN

SEQ ID NO: 3367745 - protein, 25 aa, Plasmodium falciparum
NIIYASKCIMEYMELKKQNELKIKE

SEQ ID NO: 3367746 - protein, 20 aa, Plasmodium falciparum
NIIYKRYIKTMGENNTNDDY

SEQ ID NO: 3367747 - protein, 19 aa, Plasmodium falciparum
NIIYNLKFDCHDWTYKGCS

SEQ ID NO: 3367748 - protein, 22 aa, Plasmodium falciparum
NIKDDIKNIIPYNDYNEDDIIS

SEQ ID NO: 3367749 - protein, 22 aa, Plasmodium falciparum
NIKEIKNKELLNDTISSIEDTN

SEQ ID NO: 3367750 - protein, 24 aa, Plasmodium falciparum
NIKFCSFDDLLKCADDLQKYDSYA

SEQ ID NO: 3367751 - protein, 24 aa, Plasmodium falciparum
NIKFDEYINVIKKWKSFYTSGQKY

SEQ ID NO: 3367752 - protein, 28 aa, Plasmodium falciparum
NIKFLLVLDRIRYAYNLGKILNVAYSFN

SEQ ID NO: 3367753 - protein, 18 aa, Plasmodium falciparum
NIKHMRTKSLNFVSRESY

SEQ ID NO: 3367754 - protein, 25 aa, Plasmodium falciparum
NIKIKFNFLDNFFLKIWENNNEVIN

SEQ ID NO: 3367755 - protein, 27 aa, Plasmodium falciparum
NIKIPVFLKNSPLYVLYPELNSYIKDT

SEQ ID NO: 3367756 - protein, 24 aa, Plasmodium falciparum
NIKKDLFFFKVCEQILDEQKKDSF

SEQ ID NO: 3367757 - protein, 22 aa, Plasmodium falciparum
NIKKESINNHIIYDLKQTPNTH

SEQ ID NO: 3367758 - protein, 22 aa, Plasmodium falciparum
NIKKFTLLMSYFLIVQDKEITP

SEQ ID NO: 3367759 - protein, 22 aa, Plasmodium falciparum
NIKKKLMFFKAFNNKIPYIMIK

SEQ ID NO: 3367760 - protein, 27 aa, Plasmodium falciparum
NIKKKYAAECLDLFITSSCFTTNGVFN

SEQ ID NO: 3367761 - protein, 22 aa, Plasmodium falciparum
NIKKLLYQYFLFFKNIFDNTCL

SEQ ID NO: 3367762 - protein, 20 aa, Plasmodium falciparum
NIKKYSEYILANTKVGQNIM

SEQ ID NO: 3367763 - protein, 18 aa, Plasmodium falciparum
NIKNCSNILFGMNNNNNY

SEQ ID NO: 3367764 - protein, 24 aa, Plasmodium falciparum
NIKNDIFGNLVFLDGSYKNMTNKM

SEQ ID NO: 3367765 - protein, 20 aa, Plasmodium falciparum
NIKNPNMFNMLFKKKSNNNL

SEQ ID NO: 3367766 - protein, 25 aa, Plasmodium falciparum
NIKPICQVKFNYGYNNTKQGLYNYC

SEQ ID NO: 3367767 - protein, 22 aa, Plasmodium falciparum
NIKRKPNDFLYLLVKYKHLNKW

SEQ ID NO: 3367768 - protein, 19 aa, Plasmodium falciparum
NIKRNKSVCFLKRRNTCSF

SEQ ID NO: 3367769 - protein, 18 aa, Plasmodium falciparum
NIKRQVCRSQYVENDINI

SEQ ID NO: 3367770 - protein, 23 aa, Plasmodium falciparum
NIKTCASDHIIIYPYQHKFIDIC

SEQ ID NO: 3367771 - protein, 21 aa, Plasmodium falciparum
NIKVLPSLCLFIDGVLIQTCV

SEQ ID NO: 3367772 - protein, 21 aa, Plasmodium falciparum
NIKVSNCLNKSLKVKNLNNLQ

SEQ ID NO: 3367773 - protein, 25 aa, Plasmodium falciparum
NIKYAWRIIYDLLKGSSHMKKKEKE

SEQ ID NO: 3367774 - protein, 25 aa, Plasmodium falciparum
NILARRLCYSHHILSLVKRSCIIKW

SEQ ID NO: 3367775 - protein, 25 aa, Plasmodium falciparum
NILCAACKYSYVSKKINQNYMPTIM

SEQ ID NO: 3367776 - protein, 28 aa, Plasmodium falciparum
NILCEFNKKGKKGIVNKFNRDMLQKIEK

SEQ ID NO: 3367777 - protein, 24 aa, Plasmodium falciparum
NILCIGEANLSFSLLLQKNLNLCK

SEQ ID NO: 3367778 - protein, 22 aa, Plasmodium falciparum
NILELSYHKDFMDNKIEKNIKE

SEQ ID NO: 3367779 - protein, 18 aa, Plasmodium falciparum
NILENLRRINITKDEDIS

SEQ ID NO: 3367780 - protein, 19 aa, Plasmodium falciparum
NILHSYGDFIILGLSDGSV

SEQ ID NO: 3367781 - protein, 17 aa, Plasmodium falciparum
NILIDFFSKCLFSNTLS

SEQ ID NO: 3367782 - protein, 25 aa, Plasmodium falciparum
NILIKIPIHHFIKSVNFHTSLGNIN

SEQ ID NO: 3367783 - protein, 24 aa, Plasmodium falciparum
NILKHFKIHHSILYGNSDTSFRFE

SEQ ID NO: 3367784 - protein, 20 aa, Plasmodium falciparum
NILKQNYHVEKFKKQNENIE

SEQ ID NO: 3367785 - protein, 22 aa, Plasmodium falciparum
NILKRHWIEIINILKEKKKKDI

SEQ ID NO: 3367786 - protein, 26 aa, Plasmodium falciparum
NILKSKRFLNVALFYDLIYNFLYKNN

SEQ ID NO: 3367787 - protein, 23 aa, Plasmodium falciparum
NILKSLLILLHYSLIRKKNASDI

SEQ ID NO: 3367788 - protein, 21 aa, Plasmodium falciparum
NILKSRKFLLKKLNKEKQGNE

SEQ ID NO: 3367789 - protein, 18 aa, Plasmodium falciparum
NILNEVLISLPFSYAYKL

SEQ ID NO: 3367790 - protein, 24 aa, Plasmodium falciparum
NILNGKSFYGRSVDVIRYNDSDLS

SEQ ID NO: 3367791 - protein, 23 aa, Plasmodium falciparum
NILNIKIQIEWNRKLAELSTYTD

SEQ ID NO: 3367792 - protein, 24 aa, Plasmodium falciparum
NILNKRVRCLTSFENIKDGLANVR

SEQ ID NO: 3367793 - protein, 18 aa, Plasmodium falciparum
NILNLRYEQIMNYIYNGK

SEQ ID NO: 3367794 - protein, 19 aa, Plasmodium falciparum
NILNNLFAYNIVKNCSAEL

SEQ ID NO: 3367795 - protein, 18 aa, Plasmodium falciparum
NILPELLTLYIVKLNERD

SEQ ID NO: 3367796 - protein, 25 aa, Plasmodium falciparum
NILQYYDFFLILRKKKLYLWNLERT

SEQ ID NO: 3367797 - protein, 21 aa, Plasmodium falciparum
NILRIRREMINEYKTNKLNDS

SEQ ID NO: 3367798 - protein, 25 aa, Plasmodium falciparum
NILRLLKEPICLFGEDSYDKRKRLK

SEQ ID NO: 3367799 - protein, 19 aa, Plasmodium falciparum
NILRLMDKRFTGIAKGVGT

SEQ ID NO: 3367800 - protein, 17 aa, Plasmodium falciparum
NILRVFCKIKYRNDMLD

SEQ ID NO: 3367801 - protein, 22 aa, Plasmodium falciparum
NILSKCLKYLPHLRCLNLSNNL

SEQ ID NO: 3367802 - protein, 19 aa, Plasmodium falciparum
NILSRECEYLFRNLSHINI

SEQ ID NO: 3367803 - protein, 24 aa, Plasmodium falciparum
NILTKERIEKIIIDMKAREEKKKK

SEQ ID NO: 3367804 - protein, 17 aa, Plasmodium falciparum
NILYGISGNRYYSIVLD

SEQ ID NO: 3367805 - protein, 22 aa, Plasmodium falciparum
NIMDCICFALGINNKYLRVKNL

SEQ ID NO: 3367806 - protein, 22 aa, Plasmodium falciparum
NIMDKLKESYNINVKNEEYMEI

SEQ ID NO: 3367807 - protein, 23 aa, Plasmodium falciparum
NIMKEPFVPPSNRLIIQLLNELT

SEQ ID NO: 3367808 - protein, 19 aa, Plasmodium falciparum
NIMKMVYNKNIWASKEEEF

SEQ ID NO: 3367809 - protein, 18 aa, Plasmodium falciparum
NIMKTFLISYNYDIILIK

SEQ ID NO: 3367810 - protein, 22 aa, Plasmodium falciparum
NIMNNMGGIFSMNYGNNNNNNN

SEQ ID NO: 3367811 - protein, 42 aa, Plasmodium falciparum
NIMYPYNYISCLSCFTRKHMKCGYPPYIFAKNTYCYRKDYSF

SEQ ID NO: 3367812 - protein, 17 aa, Plasmodium falciparum
NINCPKHILPKIIPHPK

SEQ ID NO: 3367813 - protein, 23 aa, Plasmodium falciparum
NINCSRNTLEFFLTKKYLKSSEL

SEQ ID NO: 3367814 - protein, 26 aa, Plasmodium falciparum
NINCSYKDTFPYYLSMNDKKNRAYTE

SEQ ID NO: 3367815 - protein, 18 aa, Plasmodium falciparum
NINEKWKNKSFNNSNMKN

SEQ ID NO: 3367816 - protein, 21 aa, Plasmodium falciparum
NINGNIFYPVFKKSNIKNKKD

SEQ ID NO: 3367817 - protein, 53 aa, Plasmodium falciparum
NINHTAPCIGEFRTCMNCFLNISTLFCKTCNIFLCAICNVKLHNNKSNHIINV

SEQ ID NO: 3367818 - protein, 20 aa, Plasmodium falciparum
NINIKRIIFYSLKKYDGDIL

SEQ ID NO: 3367819 - protein, 21 aa, Plasmodium falciparum
NININRCLYKQTITNKNNKDD

SEQ ID NO: 3367820 - protein, 24 aa, Plasmodium falciparum
NINITCGRDFFCYMHGNNYSNNIP

SEQ ID NO: 3367821 - protein, 28 aa, Plasmodium falciparum
NINKFITLSFYFSNIVILHISKENCLDM

SEQ ID NO: 3367822 - protein, 25 aa, Plasmodium falciparum
NINKIKIVPIIKCSNYKIKNNPISH

SEQ ID NO: 3367823 - protein, 23 aa, Plasmodium falciparum
NINKYDGLNSMTINIKDILDTKN

SEQ ID NO: 3367824 - protein, 21 aa, Plasmodium falciparum
NINKYGFSICHKGTKQVQKRN

SEQ ID NO: 3367825 - protein, 23 aa, Plasmodium falciparum
NINKYIIMPEFVIILKSTEELCK

SEQ ID NO: 3367826 - protein, 18 aa, Plasmodium falciparum
NINLKVLINQMIKMEIEK

SEQ ID NO: 3367827 - protein, 24 aa, Plasmodium falciparum
NINNKNRFCFFIYIKDFSASYSTI

SEQ ID NO: 3367828 - protein, 17 aa, Plasmodium falciparum
NINQSLLTLGRVINSLI

SEQ ID NO: 3367829 - protein, 18 aa, Plasmodium falciparum
NINSLFSCFVKLYCNKIK

SEQ ID NO: 3367830 - protein, 19 aa, Plasmodium falciparum
NINSWIDLIFGYKQNGHNA

SEQ ID NO: 3367831 - protein, 19 aa, Plasmodium falciparum
NINSYLLMNNFRNFLNIPS

SEQ ID NO: 3367832 - protein, 23 aa, Plasmodium falciparum
NINTLKFTNAFEHITKKFNNNET

SEQ ID NO: 3367833 - protein, 20 aa, Plasmodium falciparum
NINTYYWYKKEIDINNMKII

SEQ ID NO: 3367834 - protein, 19 aa, Plasmodium falciparum
NINVGPMCSSNHKNTKIEI

SEQ ID NO: 3367835 - protein, 17 aa, Plasmodium falciparum
NINVLTLTGGIKRRDDQ

SEQ ID NO: 3367836 - protein, 29 aa, Plasmodium falciparum
NINYEIIESCCTLNNRIFIAGTFSGHIYV

SEQ ID NO: 3367837 - protein, 24 aa, Plasmodium falciparum
NINYERFDMYQVDFEKIGLNVSNL

SEQ ID NO: 3367838 - protein, 22 aa, Plasmodium falciparum
NIPIYKRPFVPKNNNPTNMMTY

SEQ ID NO: 3367839 - protein, 21 aa, Plasmodium falciparum
NIPKNVFRGFSEVYQDESSSE

SEQ ID NO: 3367840 - protein, 22 aa, Plasmodium falciparum
NIPLEKCEEAKKISCNVLENKM

SEQ ID NO: 3367841 - protein, 21 aa, Plasmodium falciparum
NIPLLVPRGRYDIEMYSSTFK

SEQ ID NO: 3367842 - protein, 29 aa, Plasmodium falciparum
NIPQEFLCKLCNYLLLESYIIVCNNNCGY

SEQ ID NO: 3367843 - protein, 24 aa, Plasmodium falciparum
NIPQPSLLFPYVLTMSNNVLNDNI

SEQ ID NO: 3367844 - protein, 22 aa, Plasmodium falciparum
NIPTLLVLLLYRILIEKPENII

SEQ ID NO: 3367845 - protein, 25 aa, Plasmodium falciparum
NIPVIINKECTIFIVPIKEEYLKDL

SEQ ID NO: 3367846 - protein, 27 aa, Plasmodium falciparum
NIQEGKDRATAMGYKYLNSSVTGKRYV

SEQ ID NO: 3367847 - protein, 24 aa, Plasmodium falciparum
NIQKCYKMFGKIEEHAIIDITRQL

SEQ ID NO: 3367848 - protein, 28 aa, Plasmodium falciparum
NIQNWVYCKFSFLPNGHIFYPKSGNLKK

SEQ ID NO: 3367849 - protein, 17 aa, Plasmodium falciparum
NIRAQVFDVDRVNPECF

SEQ ID NO: 3367850 - protein, 24 aa, Plasmodium falciparum
NIRIGKFYIEENILQEYCKLFEKY

SEQ ID NO: 3367851 - protein, 25 aa, Plasmodium falciparum
NIRKILYCNLAMVLIQRKARNDGYL

SEQ ID NO: 3367852 - protein, 20 aa, Plasmodium falciparum
NIRNFFKNYFVKSYKNSHYK

SEQ ID NO: 3367853 - protein, 21 aa, Plasmodium falciparum
NIRNGDFLLQFHKKDPQICKK

SEQ ID NO: 3367854 - protein, 20 aa, Plasmodium falciparum
NIRSIKNLSSIHVHNKDYKL

SEQ ID NO: 3367855 - protein, 38 aa, Plasmodium falciparum
NIRYERLKDAILYYNEFLRLINMFKIIVIDDYLYEEEG

SEQ ID NO: 3367856 - protein, 18 aa, Plasmodium falciparum
NIRYVGICIYDIYSNEFS

SEQ ID NO: 3367857 - protein, 19 aa, Plasmodium falciparum
NISECLYSDIDIMTDDHKV

SEQ ID NO: 3367858 - protein, 19 aa, Plasmodium falciparum
NISEIKYSVSAYFNSYDDI

SEQ ID NO: 3367859 - protein, 18 aa, Plasmodium falciparum
NISFFSLYNLEEEKNKIC

SEQ ID NO: 3367860 - protein, 22 aa, Plasmodium falciparum
NISKELKYAYEINNDDIALLKI

SEQ ID NO: 3367861 - protein, 20 aa, Plasmodium falciparum
NISKFFLLKYFLYIFREDSS

SEQ ID NO: 3367862 - protein, 25 aa, Plasmodium falciparum
NISLKKIEDIFLFKRNIFNKETIYY

SEQ ID NO: 3367863 - protein, 18 aa, Plasmodium falciparum
NISLLCFSATASLCGIIK

SEQ ID NO: 3367864 - protein, 18 aa, Plasmodium falciparum
NISLRSATYLLKIEIEKI

SEQ ID NO: 3367865 - protein, 23 aa, Plasmodium falciparum
NISLYAHSIISYKNLKNDQSMMD

SEQ ID NO: 3367866 - protein, 33 aa, Plasmodium falciparum
NISLYKAVLLKLQLICNRCCNTFDVTSTSKEAC

SEQ ID NO: 3367867 - protein, 19 aa, Plasmodium falciparum
NISNIIINEWCLRNNNEKY

SEQ ID NO: 3367868 - protein, 18 aa, Plasmodium falciparum
NISSWSLYKNLLACVFNN

SEQ ID NO: 3367869 - protein, 25 aa, Plasmodium falciparum
NISTEQRIPFCIGKQKEMFLKFFKT

SEQ ID NO: 3367870 - protein, 17 aa, Plasmodium falciparum
NISVPNIHGEFMSEKTN

SEQ ID NO: 3367871 - protein, 18 aa, Plasmodium falciparum
NISYFSMFICKVKQVEFY

SEQ ID NO: 3367872 - protein, 33 aa, Plasmodium falciparum
NISYIAVDMAIYWNKFLYMNPCFTKKKKTKTKK

SEQ ID NO: 3367873 - protein, 49 aa, Plasmodium falciparum
NITEERLKNVLEIFGYIIHIEYKWSIDKWSYAFVYFIDEKCAINAVNFL

SEQ ID NO: 3367874 - protein, 24 aa, Plasmodium falciparum
NITIFKYTLIFRVLNYCKYIEHKL

SEQ ID NO: 3367875 - protein, 19 aa, Plasmodium falciparum
NITLRKFHFIQTISNNNFN

SEQ ID NO: 3367876 - protein, 24 aa, Plasmodium falciparum
NITNFFKKKIGTIVQQTQPTNLYT

SEQ ID NO: 3367877 - protein, 34 aa, Plasmodium falciparum
NITNIECIYIRCYLCNSLNYSKYSPFNINSTNIN

SEQ ID NO: 3367878 - protein, 17 aa, Plasmodium falciparum
NITRKNSSINIINQNID

SEQ ID NO: 3367879 - protein, 29 aa, Plasmodium falciparum
NITVVKKCLEKKADINYLDKIGRSALHYA

SEQ ID NO: 3367880 - protein, 25 aa, Plasmodium falciparum
NITYLKKSHINQMSSFKEKEKEKEK

SEQ ID NO: 3367881 - protein, 22 aa, Plasmodium falciparum
NITYRYNVIKSKNGIMYNRLKD

SEQ ID NO: 3367882 - protein, 24 aa, Plasmodium falciparum
NIVEENILFCFSIDKDKNRLLVCI

SEQ ID NO: 3367883 - protein, 24 aa, Plasmodium falciparum
NIVHKKYTCDFSIIEHAEKRRIEL

SEQ ID NO: 3367884 - protein, 26 aa, Plasmodium falciparum
NIVKYILKCKLVIYDLHNTDLEEIEY

SEQ ID NO: 3367885 - protein, 17 aa, Plasmodium falciparum
NIVLKLYHLRIVEMQQN

SEQ ID NO: 3367886 - protein, 22 aa, Plasmodium falciparum
NIVLPNPFLPYVKDQNKKEAHT

SEQ ID NO: 3367887 - protein, 22 aa, Plasmodium falciparum
NIVLPPKVHVHVSKLSSLENNI

SEQ ID NO: 3367888 - protein, 19 aa, Plasmodium falciparum
NIVPTKNFYLFNSQDKSNH

SEQ ID NO: 3367889 - protein, 18 aa, Plasmodium falciparum
NIVVPKYSNIRPITQKDS

SEQ ID NO: 3367890 - protein, 19 aa, Plasmodium falciparum
NIVVYHGFYGYKLTSSILF

SEQ ID NO: 3367891 - protein, 28 aa, Plasmodium falciparum
NIWKIREMFEFSDAIKIPSLPYQLVGSK

SEQ ID NO: 3367892 - protein, 25 aa, Plasmodium falciparum
NIYDGCVEYIYSLHNKYTAWNYNTE

SEQ ID NO: 3367893 - protein, 27 aa, Plasmodium falciparum
NIYDINHVYLLYCFDKKLEACRIHEEQ

SEQ ID NO: 3367894 - protein, 24 aa, Plasmodium falciparum
NIYDLKLFLSFLYFTYHTSSIHEY

SEQ ID NO: 3367895 - protein, 19 aa, Plasmodium falciparum
NIYEAIPMENLKNNLDDSI

SEQ ID NO: 3367896 - protein, 25 aa, Plasmodium falciparum
NIYENKYDYYSCCYSDQFDESDSDY

SEQ ID NO: 3367897 - protein, 21 aa, Plasmodium falciparum
NIYFKLCKVQNHLQNIHEQNS

SEQ ID NO: 3367898 - protein, 20 aa, Plasmodium falciparum
NIYGCQYISWGVDNNPFKYM

SEQ ID NO: 3367899 - protein, 23 aa, Plasmodium falciparum
NIYHHKKCYDLVLDELLKVTRKK

SEQ ID NO: 3367900 - protein, 18 aa, Plasmodium falciparum
NIYLKFKLLNKVQLLLEQ

SEQ ID NO: 3367901 - protein, 24 aa, Plasmodium falciparum
NIYLNMQILYHYFSIYKNKAVINY

SEQ ID NO: 3367902 - protein, 17 aa, Plasmodium falciparum
NIYLNYANNINFNEKDE

SEQ ID NO: 3367903 - protein, 24 aa, Plasmodium falciparum
NIYLWKKNAKIVISDVDGTITRST

SEQ ID NO: 3367904 - protein, 17 aa, Plasmodium falciparum
NIYNNFKSFHNKNIPAN

SEQ ID NO: 3367905 - protein, 19 aa, Plasmodium falciparum
NIYNSCSYVYVNYEKLPLL

SEQ ID NO: 3367906 - protein, 27 aa, Plasmodium falciparum
NIYNTIDFKICPPICSHMERIKKDYNM

SEQ ID NO: 3367907 - protein, 28 aa, Plasmodium falciparum
NIYNYIFFFKKICKLFSTCYVNNDMLTL

SEQ ID NO: 3367908 - protein, 26 aa, Plasmodium falciparum
NIYQWERHHILILLYLFKLNRYIESF

SEQ ID NO: 3367909 - protein, 29 aa, Plasmodium falciparum
NIYRKIFLSTDFLKKVISIKCRSYSSLKS

SEQ ID NO: 3367910 - protein, 17 aa, Plasmodium falciparum
NIYSEYHNALNVSNKSI

SEQ ID NO: 3367911 - protein, 19 aa, Plasmodium falciparum
NIYSKWSPYIPDLFASSTN

SEQ ID NO: 3367912 - protein, 19 aa, Plasmodium falciparum
NIYTSYGFEENKICEIIKI

SEQ ID NO: 3367913 - protein, 33 aa, Plasmodium falciparum
NIYVKSIWLCMNLKCTFSIHDLILIARSFKNTE

SEQ ID NO: 3367914 - protein, 18 aa, Plasmodium falciparum
NKADFLHICIDEFSNQEK

SEQ ID NO: 3367915 - protein, 24 aa, Plasmodium falciparum
NKADKCLTCNCNLHDIQDFTQIYL

SEQ ID NO: 3367916 - protein, 17 aa, Plasmodium falciparum
NKALGVIIKNVLTLVLW

SEQ ID NO: 3367917 - protein, 20 aa, Plasmodium falciparum
NKASIKWNNNIKDISELDTP

SEQ ID NO: 3367918 - protein, 22 aa, Plasmodium falciparum
NKCKEKNPLFYSVDFSNQKKND

SEQ ID NO: 3367919 - protein, 33 aa, Plasmodium falciparum
NKCKESYEKLLFRDVLKYGFYDMLLKRDTYRMM

SEQ ID NO: 3367920 - protein, 20 aa, Plasmodium falciparum
NKCREIFERLIVSIPKLECF

SEQ ID NO: 3367921 - protein, 18 aa, Plasmodium falciparum
NKCTIIFIDEIEILCKKR

SEQ ID NO: 3367922 - protein, 20 aa, Plasmodium falciparum
NKCYEKIYNFSFLSFDMNEQ

SEQ ID NO: 3367923 - protein, 20 aa, Plasmodium falciparum
NKDALTLCVCVEDDRKKYVT

SEQ ID NO: 3367924 - protein, 19 aa, Plasmodium falciparum
NKDDMSFIYNQINIKNDKQ

SEQ ID NO: 3367925 - protein, 27 aa, Plasmodium falciparum
NKDEKNIKCTYKIDDILCSYNNGNNIK

SEQ ID NO: 3367926 - protein, 18 aa, Plasmodium falciparum
NKDFFKLYICNLGDSRAM

SEQ ID NO: 3367927 - protein, 23 aa, Plasmodium falciparum
NKDGLRRSSLFNLKSKSCHNFSL

SEQ ID NO: 3367928 - protein, 20 aa, Plasmodium falciparum
NKDILKKKNINFLINKNFTS

SEQ ID NO: 3367929 - protein, 22 aa, Plasmodium falciparum
NKDILKYAYKILKRNKEGKNKK

SEQ ID NO: 3367930 - protein, 21 aa, Plasmodium falciparum
NKDKFEISRNFLTTLMLINAD

SEQ ID NO: 3367931 - protein, 26 aa, Plasmodium falciparum
NKDKFFCIFRQNFAIGIFERKKPHMN

SEQ ID NO: 3367932 - protein, 17 aa, Plasmodium falciparum
NKDKFFKNNKFKKEDNK

SEQ ID NO: 3367933 - protein, 22 aa, Plasmodium falciparum
NKDLERMNSCTLSKNVNNKNKK

SEQ ID NO: 3367934 - protein, 21 aa, Plasmodium falciparum
NKDLIRKIIELQYCVINLSDS

SEQ ID NO: 3367935 - protein, 18 aa, Plasmodium falciparum
NKDLQILLNVEKKNQQQN

SEQ ID NO: 3367936 - protein, 18 aa, Plasmodium falciparum
NKDNIKLNILFNFLNECL

SEQ ID NO: 3367937 - protein, 18 aa, Plasmodium falciparum
NKDTCKDIVIGIPNNTNQ

SEQ ID NO: 3367938 - protein, 18 aa, Plasmodium falciparum
NKDVHVIYKAASQLKKRK

SEQ ID NO: 3367939 - protein, 27 aa, Plasmodium falciparum
NKEDIKWNLKNSYYVYEKHKIEQELST

SEQ ID NO: 3367940 - protein, 17 aa, Plasmodium falciparum
NKEEAFVYKNEIGNNYN

SEQ ID NO: 3367941 - protein, 29 aa, Plasmodium falciparum
NKEEITMLDSWYFANKMKIIPYLFDDKPI

SEQ ID NO: 3367942 - protein, 20 aa, Plasmodium falciparum
NKEFCVVPPVMPYHINSIEN

SEQ ID NO: 3367943 - protein, 25 aa, Plasmodium falciparum
NKEFPLKYLCPYFLSKLKYHKEQDI

SEQ ID NO: 3367944 - protein, 25 aa, Plasmodium falciparum
NKEFSKCLRNFISKIYTLKRKKIIR

SEQ ID NO: 3367945 - protein, 25 aa, Plasmodium falciparum
NKEGFKMKLCYNYNDYYDNGKYCYS

SEQ ID NO: 3367946 - protein, 23 aa, Plasmodium falciparum
NKEGGKNLYTWYIDNKIDEKKKK

SEQ ID NO: 3367947 - protein, 44 aa, Plasmodium falciparum
NKEIFKTLICYYSKLLASHPCIKYIFRFFFLKYASITTVSTNLG

SEQ ID NO: 3367948 - protein, 22 aa, Plasmodium falciparum
NKEIHIPVLIFVDSIIKANMIY

SEQ ID NO: 3367949 - protein, 18 aa, Plasmodium falciparum
NKEIILLNIYLELSNDHL

SEQ ID NO: 3367950 - protein, 18 aa, Plasmodium falciparum
NKEIKGWEKYTYDLDFYC

SEQ ID NO: 3367951 - protein, 24 aa, Plasmodium falciparum
NKEITKLLLQYGAKIDDTDLSNRS

SEQ ID NO: 3367952 - protein, 19 aa, Plasmodium falciparum
NKEKCNLSFNTIHNNNFHV

SEQ ID NO: 3367953 - protein, 33 aa, Plasmodium falciparum
NKEKEIQAAILIQKCFRGFVVRKKYLIFKYYIK

SEQ ID NO: 3367954 - protein, 21 aa, Plasmodium falciparum
NKEKKEGFILSFYFATNPFFS

SEQ ID NO: 3367955 - protein, 33 aa, Plasmodium falciparum
NKEKKLSINFIWLGGLFYPRAFITATRQLSAFK

SEQ ID NO: 3367956 - protein, 27 aa, Plasmodium falciparum
NKEKKSCIWMVFEYVPFDLSGYSELLR

SEQ ID NO: 3367957 - protein, 37 aa, Plasmodium falciparum
NKEKLVAQLLIRWWYVLPDWPPPDYDYKDELYNRKLK

SEQ ID NO: 3367958 - protein, 19 aa, Plasmodium falciparum
NKEMHGLGKYCMNYNKTYF

SEQ ID NO: 3367959 - protein, 28 aa, Plasmodium falciparum
NKENDLCRIFCIIFKRDNAFEDYKCSNL

SEQ ID NO: 3367960 - protein, 22 aa, Plasmodium falciparum
NKENLMRCLHRKNLMEDEKSYQ

SEQ ID NO: 3367961 - protein, 17 aa, Plasmodium falciparum
NKENSPCNIIDVNNDDK

SEQ ID NO: 3367962 - protein, 22 aa, Plasmodium falciparum
NKEQIFYFLLFYPFELKQTVIH

SEQ ID NO: 3367963 - protein, 24 aa, Plasmodium falciparum
NKERFLFKIVYVFKKKEQKTEKNV

SEQ ID NO: 3367964 - protein, 25 aa, Plasmodium falciparum
NKETLCSIYNVFELFSKKNIKKEYM

SEQ ID NO: 3367965 - protein, 25 aa, Plasmodium falciparum
NKFASYCSCRTVAVVGGRNAEAQAF

SEQ ID NO: 3367966 - protein, 18 aa, Plasmodium falciparum
NKFCRRVLVQASYSIGIA

SEQ ID NO: 3367967 - protein, 17 aa, Plasmodium falciparum
NKFELMKKIGLKLQTIK

SEQ ID NO: 3367968 - protein, 37 aa, Plasmodium falciparum
NKFGVLKICCGFSFSCILLKNKKCFLIGTYSNKHTIK

SEQ ID NO: 3367969 - protein, 18 aa, Plasmodium falciparum
NKFIKMSILLLQNIFHIN

SEQ ID NO: 3367970 - protein, 29 aa, Plasmodium falciparum
NKFKHAYPQEQIIGFSLDAYRRSFFRLVD

SEQ ID NO: 3367971 - protein, 25 aa, Plasmodium falciparum
NKFKNIYVYFCLNKYININSLDSKN

SEQ ID NO: 3367972 - protein, 26 aa, Plasmodium falciparum
NKFKSLQIEKCVKCNVVLNNLISSIE

SEQ ID NO: 3367973 - protein, 19 aa, Plasmodium falciparum
NKFLLSLCYNYIPIHKNCH

SEQ ID NO: 3367974 - protein, 22 aa, Plasmodium falciparum
NKFNMPSSLLIYGTDGVGKTTL

SEQ ID NO: 3367975 - protein, 22 aa, Plasmodium falciparum
NKFSDVCFHESILNYLNNKFSE

SEQ ID NO: 3367976 - protein, 17 aa, Plasmodium falciparum
NKGCIPYNPNHPNNTNT

SEQ ID NO: 3367977 - protein, 19 aa, Plasmodium falciparum
NKGELCVKGSSLMVGYFRD

SEQ ID NO: 3367978 - protein, 18 aa, Plasmodium falciparum
NKGFIKTHYFRKIDTEKI

SEQ ID NO: 3367979 - protein, 22 aa, Plasmodium falciparum
NKGILKICDFGMARKFGHVTNH

SEQ ID NO: 3367980 - protein, 25 aa, Plasmodium falciparum
NKGNICDGSAILNLVEINQFKELTH

SEQ ID NO: 3367981 - protein, 17 aa, Plasmodium falciparum
NKGVCNLEIIKMYEHIQ

SEQ ID NO: 3367982 - protein, 24 aa, Plasmodium falciparum
NKHFEPYVPISYIYIEPTINAAFV

SEQ ID NO: 3367983 - protein, 24 aa, Plasmodium falciparum
NKHFHKHLFVHPTQKNLSSGKNNN

SEQ ID NO: 3367984 - protein, 20 aa, Plasmodium falciparum
NKHIDIICELHFKNFKRPKT

SEQ ID NO: 3367985 - protein, 19 aa, Plasmodium falciparum
NKHIFFFAFDKIINTFNEK

SEQ ID NO: 3367986 - protein, 23 aa, Plasmodium falciparum
NKHINRRNMCIFHNKINKKEKNI

SEQ ID NO: 3367987 - protein, 17 aa, Plasmodium falciparum
NKHKIVFNGEADEKPNV

SEQ ID NO: 3367988 - protein, 24 aa, Plasmodium falciparum
NKHLYNFKFLKYFIIEESESLCNV

SEQ ID NO: 3367989 - protein, 20 aa, Plasmodium falciparum
NKHRCNLVYTCPGCSQTFVI

SEQ ID NO: 3367990 - protein, 17 aa, Plasmodium falciparum
NKIALIWEQDCPDQYKK

SEQ ID NO: 3367991 - protein, 21 aa, Plasmodium falciparum
NKICNRKGSSIYIEILNKTYN

SEQ ID NO: 3367992 - protein, 27 aa, Plasmodium falciparum
NKIECNDNFLWMCQIKYILTEDEIKEN

SEQ ID NO: 3367993 - protein, 20 aa, Plasmodium falciparum
NKIELPVFIHSYVWKNNNWY

SEQ ID NO: 3367994 - protein, 20 aa, Plasmodium falciparum
NKIENIILIYSCKGGVGKSF

SEQ ID NO: 3367995 - protein, 17 aa, Plasmodium falciparum
NKIFHISKNRSYYDEHD

SEQ ID NO: 3367996 - protein, 24 aa, Plasmodium falciparum
NKIHTFDSIELFKDNKDKSFYKEE

SEQ ID NO: 3367997 - protein, 21 aa, Plasmodium falciparum
NKIHTSFLWESYIDKVDKRML

SEQ ID NO: 3367998 - protein, 23 aa, Plasmodium falciparum
NKIIKKKCVHGKASEKNTEDIDN

SEQ ID NO: 3367999 - protein, 33 aa, Plasmodium falciparum
NKIITKGLCSKGFIYKRLCFRNFNSIIKSEKKV

SEQ ID NO: 3368000 - protein, 21 aa, Plasmodium falciparum
NKIITRIGSFVTNKSVYQYEK

SEQ ID NO: 3368001 - protein, 28 aa, Plasmodium falciparum
NKIKISDEMYCYIVRTFANNCKDKRVSL

SEQ ID NO: 3368002 - protein, 23 aa, Plasmodium falciparum
NKIKKCRHIYKRGDVVLLVSPVN

SEQ ID NO: 3368003 - protein, 17 aa, Plasmodium falciparum
NKIKKEKCFTRNDINIY

SEQ ID NO: 3368004 - protein, 26 aa, Plasmodium falciparum
NKIKKLYKCYRSMEEKYLKKTKKQNI

SEQ ID NO: 3368005 - protein, 23 aa, Plasmodium falciparum
NKIKKPIKMVINKHINYLKDKLY

SEQ ID NO: 3368006 - protein, 35 aa, Plasmodium falciparum
NKIKLGFKYKLLNRYLIEFAHPFIHVRTIEINKKS

SEQ ID NO: 3368007 - protein, 33 aa, Plasmodium falciparum
NKIKLQKHIALLELIKYVILYSNTNIKKENTEI

SEQ ID NO: 3368008 - protein, 26 aa, Plasmodium falciparum
NKIKSYIFKCVMDKIIFIHKNKKVNK

SEQ ID NO: 3368009 - protein, 20 aa, Plasmodium falciparum
NKILNCNRFIVSPLAGTTVD

SEQ ID NO: 3368010 - protein, 19 aa, Plasmodium falciparum
NKINALFCVDFVCSKYIKH

SEQ ID NO: 3368011 - protein, 25 aa, Plasmodium falciparum
NKINGFKGENHYSYNNVGKNISTDI

SEQ ID NO: 3368012 - protein, 31 aa, Plasmodium falciparum
NKINLFINSACPYELLLFSSLIKCNILCNVS

SEQ ID NO: 3368013 - protein, 37 aa, Plasmodium falciparum
NKIRAYKIQEAYLLDCLQKCMIDLNLNSVMSTENINC

SEQ ID NO: 3368014 - protein, 24 aa, Plasmodium falciparum
NKIRKIQIVNNILKDEVKTYSIKV

SEQ ID NO: 3368015 - protein, 17 aa, Plasmodium falciparum
NKIRTHISIPLKKNTNH

SEQ ID NO: 3368016 - protein, 22 aa, Plasmodium falciparum
NKISFKSIKNMNIVKKYLKKDD

SEQ ID NO: 3368017 - protein, 19 aa, Plasmodium falciparum
NKISRKSSSKMYNKENKEY

SEQ ID NO: 3368018 - protein, 17 aa, Plasmodium falciparum
NKITFGLSNNNLLANQE

SEQ ID NO: 3368019 - protein, 27 aa, Plasmodium falciparum
NKIYFSKLRMGLNMLLKHEKKSKRGRR

SEQ ID NO: 3368020 - protein, 23 aa, Plasmodium falciparum
NKIYKEILRPIYTYYQNLKSNMV

SEQ ID NO: 3368021 - protein, 19 aa, Plasmodium falciparum
NKIYNKCGNKNIFLDHSVF

SEQ ID NO: 3368022 - protein, 27 aa, Plasmodium falciparum
NKIYRPQEKDIPITQDNSFVFQNKNNG

SEQ ID NO: 3368023 - protein, 17 aa, Plasmodium falciparum
NKKACIYQFSFLLLLKK

SEQ ID NO: 3368024 - protein, 19 aa, Plasmodium falciparum
NKKAKVIFENKLLPHFITN

SEQ ID NO: 3368025 - protein, 22 aa, Plasmodium falciparum
NKKCLICIQNNFNIQYIMKKKY

SEQ ID NO: 3368026 - protein, 20 aa, Plasmodium falciparum
NKKDYLLKMKTFIQNDIPHI

SEQ ID NO: 3368027 - protein, 18 aa, Plasmodium falciparum
NKKECFNEYIKEKNTSLI

SEQ ID NO: 3368028 - protein, 17 aa, Plasmodium falciparum
NKKECGNSNNFLPTDKH

SEQ ID NO: 3368029 - protein, 21 aa, Plasmodium falciparum
NKKEIGFCSCVIKVKEKKEIE

SEQ ID NO: 3368030 - protein, 23 aa, Plasmodium falciparum
NKKEIYKKCFAKFHENVDHIDNE

SEQ ID NO: 3368031 - protein, 23 aa, Plasmodium falciparum
NKKETLFNFSLNFREIEKNKRDK

SEQ ID NO: 3368032 - protein, 24 aa, Plasmodium falciparum
NKKEWCNYNTLLELEKNKMIKEKE

SEQ ID NO: 3368033 - protein, 17 aa, Plasmodium falciparum
NKKFLCDTDTLFYENNV

SEQ ID NO: 3368034 - protein, 17 aa, Plasmodium falciparum
NKKFLKKCGSQKIKSHK

SEQ ID NO: 3368035 - protein, 20 aa, Plasmodium falciparum
NKKFNSVMEWINYIEELMSH

SEQ ID NO: 3368036 - protein, 18 aa, Plasmodium falciparum
NKKFPPLVNSLNVKSENK

SEQ ID NO: 3368037 - protein, 17 aa, Plasmodium falciparum
NKKFPVLPFHVKHLEDQ

SEQ ID NO: 3368038 - protein, 19 aa, Plasmodium falciparum
NKKFQIIYMKEFFNLLKEH

SEQ ID NO: 3368039 - protein, 18 aa, Plasmodium falciparum
NKKFYNVFVKKVRDKYFK

SEQ ID NO: 3368040 - protein, 22 aa, Plasmodium falciparum
NKKGKTAAAYVEFDNIEDMNRS

SEQ ID NO: 3368041 - protein, 24 aa, Plasmodium falciparum
NKKGRFVYRFFVIVGENENYIDII

SEQ ID NO: 3368042 - protein, 20 aa, Plasmodium falciparum
NKKIEEIRVYLKGDKNIHSI

SEQ ID NO: 3368043 - protein, 24 aa, Plasmodium falciparum
NKKIKKRDMEMYILLEENKKQKEK

SEQ ID NO: 3368044 - protein, 18 aa, Plasmodium falciparum
NKKIKLFIQKEILYQSLK

SEQ ID NO: 3368045 - protein, 18 aa, Plasmodium falciparum
NKKILKGKVFNATSKTGY

SEQ ID NO: 3368046 - protein, 22 aa, Plasmodium falciparum
NKKIYTTLIQWLLNHSPENQKQ

SEQ ID NO: 3368047 - protein, 26 aa, Plasmodium falciparum
NKKKCLDELYILASYDNFLKKKYETY

SEQ ID NO: 3368048 - protein, 28 aa, Plasmodium falciparum
NKKKDECLLLTFSFKLFQLSKMHNKGKV

SEQ ID NO: 3368049 - protein, 27 aa, Plasmodium falciparum
NKKKFKILCAKCVVTIKEIIGNDSNLL

SEQ ID NO: 3368050 - protein, 23 aa, Plasmodium falciparum
NKKKGKKRLSFIEEQKFNTTLGY

SEQ ID NO: 3368051 - protein, 17 aa, Plasmodium falciparum
NKKKGLINYKSTLYNDN

SEQ ID NO: 3368052 - protein, 23 aa, Plasmodium falciparum
NKKKICLLVGIGINVNLEDQHNI

SEQ ID NO: 3368053 - protein, 19 aa, Plasmodium falciparum
NKKKISSILIKKNIFEKEI

SEQ ID NO: 3368054 - protein, 33 aa, Plasmodium falciparum
NKKKLKFVETYALEFSKLIKEASVLTLPKEIQK

SEQ ID NO: 3368055 - protein, 21 aa, Plasmodium falciparum
NKKKLNWSGKNNIYVNKYNVR

SEQ ID NO: 3368056 - protein, 23 aa, Plasmodium falciparum
NKKKRDAENYMFNETYNALKNTN

SEQ ID NO: 3368057 - protein, 18 aa, Plasmodium falciparum
NKKKRYIEKLKKKKIKIL

SEQ ID NO: 3368058 - protein, 21 aa, Plasmodium falciparum
NKKKYICNYISQHKKRIKEKK

SEQ ID NO: 3368059 - protein, 25 aa, Plasmodium falciparum
NKKKYNSVCSFYFMTNESLYLILNS

SEQ ID NO: 3368060 - protein, 17 aa, Plasmodium falciparum
NKKLFKNINCYKSSVKI

SEQ ID NO: 3368061 - protein, 20 aa, Plasmodium falciparum
NKKLMVHPKNGRNIFQTSKN

SEQ ID NO: 3368062 - protein, 18 aa, Plasmodium falciparum
NKKMECFLGDNFYIYLNI

SEQ ID NO: 3368063 - protein, 29 aa, Plasmodium falciparum
NKKNRSMVTVETFASLKSFEREMNLLKSH

SEQ ID NO: 3368064 - protein, 23 aa, Plasmodium falciparum
NKKNYKDICIWFKDNEIEKILQL

SEQ ID NO: 3368065 - protein, 24 aa, Plasmodium falciparum
NKKPHLRKAAGIVWKDPTLDEWPE

SEQ ID NO: 3368066 - protein, 21 aa, Plasmodium falciparum
NKKRFSIFDHYVKIFKEEYIH

SEQ ID NO: 3368067 - protein, 25 aa, Plasmodium falciparum
NKKSEHPIEKVIIRVKRRIDDTSIP

SEQ ID NO: 3368068 - protein, 23 aa, Plasmodium falciparum
NKKSPYTRFTEIFTDKLKNFTLG

SEQ ID NO: 3368069 - protein, 24 aa, Plasmodium falciparum
NKKSQFYENEWLNMKSLEYSLINS

SEQ ID NO: 3368070 - protein, 25 aa, Plasmodium falciparum
NKKSSRSHSIFTITLIIKDINNVGE

SEQ ID NO: 3368071 - protein, 23 aa, Plasmodium falciparum
NKKTARILYIYNMTNEYKDENFI

SEQ ID NO: 3368072 - protein, 35 aa, Plasmodium falciparum
NKKTRIKINMCENPCDIWYGLKKRNGKNIFINSSR

SEQ ID NO: 3368073 - protein, 22 aa, Plasmodium falciparum
NKKTRLNKVIKILSMYRDALDF

SEQ ID NO: 3368074 - protein, 18 aa, Plasmodium falciparum
NKKVETFKKIDDIKNIII

SEQ ID NO: 3368075 - protein, 19 aa, Plasmodium falciparum
NKKVIKWRSQKKGLFNKVC

SEQ ID NO: 3368076 - protein, 25 aa, Plasmodium falciparum
NKKWKIENSILYIKWMKIINFEKTN

SEQ ID NO: 3368077 - protein, 23 aa, Plasmodium falciparum
NKKWQEGFCEIIDNYGMTKISLL

SEQ ID NO: 3368078 - protein, 19 aa, Plasmodium falciparum
NKKYKCNVISIADEEQEDT

SEQ ID NO: 3368079 - protein, 23 aa, Plasmodium falciparum
NKKYSKIDILNIIFNNLQNDNDE

SEQ ID NO: 3368080 - protein, 21 aa, Plasmodium falciparum
NKLAYEVIKSVYILKKYINDI

SEQ ID NO: 3368081 - protein, 17 aa, Plasmodium falciparum
NKLESGFSFDASSIKLC

SEQ ID NO: 3368082 - protein, 31 aa, Plasmodium falciparum
NKLFEHYKIDILKKLSFCIVYNNEKKKIILT

SEQ ID NO: 3368083 - protein, 23 aa, Plasmodium falciparum
NKLFNIRGSLLFHNIFLDEQFSS

SEQ ID NO: 3368084 - protein, 19 aa, Plasmodium falciparum
NKLFPPPLKPFTVVPKPQP

SEQ ID NO: 3368085 - protein, 23 aa, Plasmodium falciparum
NKLIHIYMIKKLISEQFKNLQQP

SEQ ID NO: 3368086 - protein, 18 aa, Plasmodium falciparum
NKLIKYIINNEIKKKSKN

SEQ ID NO: 3368087 - protein, 25 aa, Plasmodium falciparum
NKLISRTRITPDFISVDKKYMNSSN

SEQ ID NO: 3368088 - protein, 24 aa, Plasmodium falciparum
NKLKEKILSILVYFLQSIFDCKIL

SEQ ID NO: 3368089 - protein, 18 aa, Plasmodium falciparum
NKLKEYENLWNLIKEKVK

SEQ ID NO: 3368090 - protein, 18 aa, Plasmodium falciparum
NKLKEYNEELSLINDLKN

SEQ ID NO: 3368091 - protein, 28 aa, Plasmodium falciparum
NKLKINIKFFSKYECVQNIIKTKIEECK

SEQ ID NO: 3368092 - protein, 28 aa, Plasmodium falciparum
NKLKKHILSSRVIIYSKGASLVYNVDEI

SEQ ID NO: 3368093 - protein, 23 aa, Plasmodium falciparum
NKLKKISFYILFEYTEKYPDEAP

SEQ ID NO: 3368094 - protein, 22 aa, Plasmodium falciparum
NKLKKYPYEINKFDRRETSEYF

SEQ ID NO: 3368095 - protein, 17 aa, Plasmodium falciparum
NKLKNFFDISIRSSVLY

SEQ ID NO: 3368096 - protein, 18 aa, Plasmodium falciparum
NKLLDLWKRVMKNEESKL

SEQ ID NO: 3368097 - protein, 17 aa, Plasmodium falciparum
NKLLFAISNDLKLFDIR

SEQ ID NO: 3368098 - protein, 25 aa, Plasmodium falciparum
NKLLKKLSFLYSFKNGVIAEITHKF

SEQ ID NO: 3368099 - protein, 19 aa, Plasmodium falciparum
NKLLLNIAKEYLLKNNVNE

SEQ ID NO: 3368100 - protein, 18 aa, Plasmodium falciparum
NKLNCRLTSVHIVDSTLC

SEQ ID NO: 3368101 - protein, 25 aa, Plasmodium falciparum
NKLNIRGCIPLAGMISIDELATKPS

SEQ ID NO: 3368102 - protein, 23 aa, Plasmodium falciparum
NKLNKRKIMINQINHEIKKKNNN

SEQ ID NO: 3368103 - protein, 19 aa, Plasmodium falciparum
NKLNLFFNLSVKYGLNDKK

SEQ ID NO: 3368104 - protein, 17 aa, Plasmodium falciparum
NKLNLIFKNFVQQMQDI

SEQ ID NO: 3368105 - protein, 19 aa, Plasmodium falciparum
NKLPPWIIKCMDISNINLT

SEQ ID NO: 3368106 - protein, 19 aa, Plasmodium falciparum
NKLSLDNCVKKEGTKIEQL

SEQ ID NO: 3368107 - protein, 19 aa, Plasmodium falciparum
NKLSLMSMNGMYNMNNMNN

SEQ ID NO: 3368108 - protein, 18 aa, Plasmodium falciparum
NKLSTFTFSEEDESKKKY

SEQ ID NO: 3368109 - protein, 18 aa, Plasmodium falciparum
NKLTSPITFICKDEDTDN

SEQ ID NO: 3368110 - protein, 24 aa, Plasmodium falciparum
NKLYDKWIMRMFAILKNDKKNQRL

SEQ ID NO: 3368111 - protein, 25 aa, Plasmodium falciparum
NKLYKRAEQFFNYIVNYKNVVPDEI

SEQ ID NO: 3368112 - protein, 22 aa, Plasmodium falciparum
NKMDYYFSFCQNIDEAFMEQFW

SEQ ID NO: 3368113 - protein, 21 aa, Plasmodium falciparum
NKMEKCMDIFEKFQIKNKDKY

SEQ ID NO: 3368114 - protein, 20 aa, Plasmodium falciparum
NKMFPKECTYGSRIGECHKK

SEQ ID NO: 3368115 - protein, 18 aa, Plasmodium falciparum
NKMIELLALLKGKHNEDL

SEQ ID NO: 3368116 - protein, 17 aa, Plasmodium falciparum
NKMIKRSTVNPKLTQKS

SEQ ID NO: 3368117 - protein, 27 aa, Plasmodium falciparum
NKMIPKLKKKDCIIFNRITKKEDFLFL

SEQ ID NO: 3368118 - protein, 17 aa, Plasmodium falciparum
NKMKEMVHHDNVDYDNE

SEQ ID NO: 3368119 - protein, 19 aa, Plasmodium falciparum
NKMLKKRKLSTLKKKTGYM

SEQ ID NO: 3368120 - protein, 19 aa, Plasmodium falciparum
NKMNLGFSSFRGPILNELI

SEQ ID NO: 3368121 - protein, 18 aa, Plasmodium falciparum
NKMNLIHFYDELLQYLML

SEQ ID NO: 3368122 - protein, 27 aa, Plasmodium falciparum
NKNAKLFRLLFQFFFPHISYYFDTNID

SEQ ID NO: 3368123 - protein, 25 aa, Plasmodium falciparum
NKNALFLYCKYVLLFYGKELLNENN

SEQ ID NO: 3368124 - protein, 18 aa, Plasmodium falciparum
NKNCGGGLHNSYQKSLLS

SEQ ID NO: 3368125 - protein, 17 aa, Plasmodium falciparum
NKNCKLTKIEIQENEME

SEQ ID NO: 3368126 - protein, 20 aa, Plasmodium falciparum
NKNCNLESSIKLKNNNIESF

SEQ ID NO: 3368127 - protein, 18 aa, Plasmodium falciparum
NKNDGMKSFAHMNQNQNN

SEQ ID NO: 3368128 - protein, 26 aa, Plasmodium falciparum
NKNEFFRVIPRFLIQTGDHTNTGLHN

SEQ ID NO: 3368129 - protein, 25 aa, Plasmodium falciparum
NKNEFLIKRNDVILENDVIYDIWCR

SEQ ID NO: 3368130 - protein, 19 aa, Plasmodium falciparum
NKNEPKISGSHNINMDDIK

SEQ ID NO: 3368131 - protein, 18 aa, Plasmodium falciparum
NKNEVNWIIDNDIYMNST

SEQ ID NO: 3368132 - protein, 22 aa, Plasmodium falciparum
NKNHKWNIFINIYVYEYTPYIY

SEQ ID NO: 3368133 - protein, 17 aa, Plasmodium falciparum
NKNICFDIFLFKQDFFD

SEQ ID NO: 3368134 - protein, 18 aa, Plasmodium falciparum
NKNIGKHFNFNFEKDSRD

SEQ ID NO: 3368135 - protein, 18 aa, Plasmodium falciparum
NKNIIIFNQILKYQHNCN

SEQ ID NO: 3368136 - protein, 24 aa, Plasmodium falciparum
NKNIKIIYDDGGAKRIVVKKKRKN

SEQ ID NO: 3368137 - protein, 19 aa, Plasmodium falciparum
NKNIKLIKVPKFVSNKWLQ

SEQ ID NO: 3368138 - protein, 23 aa, Plasmodium falciparum
NKNIKSTNFFPVHITYPSSIQMV

SEQ ID NO: 3368139 - protein, 25 aa, Plasmodium falciparum
NKNILLKWLNNFMIYYLENTKDNVS

SEQ ID NO: 3368140 - protein, 22 aa, Plasmodium falciparum
NKNINLSIVFFLTNPREKIERS

SEQ ID NO: 3368141 - protein, 22 aa, Plasmodium falciparum
NKNIPWMLIVHFKGEEEYPLSI

SEQ ID NO: 3368142 - protein, 21 aa, Plasmodium falciparum
NKNIRLGRRNDQSRCDQGNTI

SEQ ID NO: 3368143 - protein, 20 aa, Plasmodium falciparum
NKNKCNFGFVVSDIATSYIA

SEQ ID NO: 3368144 - protein, 24 aa, Plasmodium falciparum
NKNKFNIIITNAFVHVNREKLLQN

SEQ ID NO: 3368145 - protein, 17 aa, Plasmodium falciparum
NKNKIIQINSCLQKEKE

SEQ ID NO: 3368146 - protein, 20 aa, Plasmodium falciparum
NKNKIIYKHIINDHINQKDN

SEQ ID NO: 3368147 - protein, 17 aa, Plasmodium falciparum
NKNKMGFIEIKPNDIDD

SEQ ID NO: 3368148 - protein, 19 aa, Plasmodium falciparum
NKNKNCFIFNLNRNDSRNS

SEQ ID NO: 3368149 - protein, 20 aa, Plasmodium falciparum
NKNLHHFISYIIRKKKKNNE

SEQ ID NO: 3368150 - protein, 37 aa, Plasmodium falciparum
NKNLLLLNKRCCELIRSLRIKLIYDESLKSSISPDSI

SEQ ID NO: 3368151 - protein, 22 aa, Plasmodium falciparum
NKNLSYKILHIIGNGVYGVVYK

SEQ ID NO: 3368152 - protein, 24 aa, Plasmodium falciparum
NKNMKDVINLYTYVVNKKNEKNIY

SEQ ID NO: 3368153 - protein, 23 aa, Plasmodium falciparum
NKNMKKLSLNLMKNKNNLQQSKM

SEQ ID NO: 3368154 - protein, 24 aa, Plasmodium falciparum
NKNNKRFHNIISYKNKDNKKNVQK

SEQ ID NO: 3368155 - protein, 17 aa, Plasmodium falciparum
NKNNYFEKNCSRNNKVI

SEQ ID NO: 3368156 - protein, 25 aa, Plasmodium falciparum
NKNRGGGNKGFFGKKFSSNSNNYNN

SEQ ID NO: 3368157 - protein, 22 aa, Plasmodium falciparum
NKNRKFCFINYADAESAKNAMD

SEQ ID NO: 3368158 - protein, 23 aa, Plasmodium falciparum
NKNRNVNMYKNDFICSNVNNDNV

SEQ ID NO: 3368159 - protein, 24 aa, Plasmodium falciparum
NKNSCDNKGLLNCNMAHNNSNINY

SEQ ID NO: 3368160 - protein, 32 aa, Plasmodium falciparum
NKNSIQSVAVWKLRGERNWCLTGTPIQNSIFD

SEQ ID NO: 3368161 - protein, 21 aa, Plasmodium falciparum
NKNWLAKELFTLEKSIYEKCE

SEQ ID NO: 3368162 - protein, 17 aa, Plasmodium falciparum
NKNYKHHGSHSKINNYN

SEQ ID NO: 3368163 - protein, 26 aa, Plasmodium falciparum
NKNYLRFLFLQLLKKRFIKKCKYFNE

SEQ ID NO: 3368164 - protein, 23 aa, Plasmodium falciparum
NKNYYSNVFFKLFKNIINEKRTK

SEQ ID NO: 3368165 - protein, 25 aa, Plasmodium falciparum
NKPAEWNHYDLQNFLVSQFHNKNYI

SEQ ID NO: 3368166 - protein, 21 aa, Plasmodium falciparum
NKPEVIERDNIINIKNDTNNI

SEQ ID NO: 3368167 - protein, 21 aa, Plasmodium falciparum
NKPKGKMFFLTKKEKSISQAK

SEQ ID NO: 3368168 - protein, 22 aa, Plasmodium falciparum
NKPKIMSFLSLRKFISFLNNIY

SEQ ID NO: 3368169 - protein, 20 aa, Plasmodium falciparum
NKPSLKWRLINKESNFFDKA

SEQ ID NO: 3368170 - protein, 33 aa, Plasmodium falciparum
NKPSPRSGHRMILWKNYIVMFGGFFDNGKSIEY

SEQ ID NO: 3368171 - protein, 32 aa, Plasmodium falciparum
NKPTSYLDFCEAWSKFKFRNLASHANDQINKD

SEQ ID NO: 3368172 - protein, 19 aa, Plasmodium falciparum
NKQCSINFSCERKPSPFRS

SEQ ID NO: 3368173 - protein, 20 aa, Plasmodium falciparum
NKQHGSGIFIIIKNFKEYEH

SEQ ID NO: 3368174 - protein, 18 aa, Plasmodium falciparum
NKQLCNFNNTSYNFPEQT

SEQ ID NO: 3368175 - protein, 24 aa, Plasmodium falciparum
NKQLPLLVCLPNFHISPKAFLINL

SEQ ID NO: 3368176 - protein, 18 aa, Plasmodium falciparum
NKQQFLFSTLSKQYNTNV

SEQ ID NO: 3368177 - protein, 23 aa, Plasmodium falciparum
NKQSKWIMEDKILQIKKSATHDN

SEQ ID NO: 3368178 - protein, 33 aa, Plasmodium falciparum
NKRDEIISMIIELIKYISYMQKALIKASEGNFL

SEQ ID NO: 3368179 - protein, 23 aa, Plasmodium falciparum
NKREASYGFGCLNEKKMDSINNN

SEQ ID NO: 3368180 - protein, 21 aa, Plasmodium falciparum
NKREECGYDRINEITQEKNKT

SEQ ID NO: 3368181 - protein, 21 aa, Plasmodium falciparum
NKRFIKYPKLKQLLELKNDII

SEQ ID NO: 3368182 - protein, 19 aa, Plasmodium falciparum
NKRGEYIYEPKVNNIIKDV

SEQ ID NO: 3368183 - protein, 20 aa, Plasmodium falciparum
NKRHIIRLLSSIKYKNHLCL

SEQ ID NO: 3368184 - protein, 17 aa, Plasmodium falciparum
NKRIFVFLNGINNIYHS

SEQ ID NO: 3368185 - protein, 23 aa, Plasmodium falciparum
NKRIKHKDIQPIDIFRTAIQIMK

SEQ ID NO: 3368186 - protein, 23 aa, Plasmodium falciparum
NKRPMASVLLHHPWFQGYFDPIQ

SEQ ID NO: 3368187 - protein, 21 aa, Plasmodium falciparum
NKRVIAGTCRSIHLFEKMNTI

SEQ ID NO: 3368188 - protein, 22 aa, Plasmodium falciparum
NKRVQNNMCISIDNKINMKNKS

SEQ ID NO: 3368189 - protein, 19 aa, Plasmodium falciparum
NKRVYAMKVVLKECNEIFV

SEQ ID NO: 3368190 - protein, 22 aa, Plasmodium falciparum
NKSARNCLCDVVITYEGTNHIS

SEQ ID NO: 3368191 - protein, 25 aa, Plasmodium falciparum
NKSDLFFSFFHLRKNRICSLNTFSF

SEQ ID NO: 3368192 - protein, 20 aa, Plasmodium falciparum
NKSEKKCGIQIEGQNGNPSE

SEQ ID NO: 3368193 - protein, 17 aa, Plasmodium falciparum
NKSELLYKNFLQFQKKY

SEQ ID NO: 3368194 - protein, 18 aa, Plasmodium falciparum
NKSFLKVLCSKRGVLPII

SEQ ID NO: 3368195 - protein, 21 aa, Plasmodium falciparum
NKSFNGPFLQFLLSDENNEYS

SEQ ID NO: 3368196 - protein, 29 aa, Plasmodium falciparum
NKSHISRLSTFICIGVDNAFFKNMFSSVH

SEQ ID NO: 3368197 - protein, 24 aa, Plasmodium falciparum
NKSIKRINCNYEYILKHKEAQNIS

SEQ ID NO: 3368198 - protein, 17 aa, Plasmodium falciparum
NKSISINSFTKMNSSNN

SEQ ID NO: 3368199 - protein, 21 aa, Plasmodium falciparum
NKSKYKILNYFNNFKYNFSIK

SEQ ID NO: 3368200 - protein, 32 aa, Plasmodium falciparum
NKSLENYFKITFYCLCGYLQYIKDDSDWKQII

SEQ ID NO: 3368201 - protein, 24 aa, Plasmodium falciparum
NKSMIKDFLFFGVIDKKGQNYLGR

SEQ ID NO: 3368202 - protein, 22 aa, Plasmodium falciparum
NKSRSKKFLKFNIKGKDKKNNI

SEQ ID NO: 3368203 - protein, 18 aa, Plasmodium falciparum
NKSSLPFNTDEIRGYEDN

SEQ ID NO: 3368204 - protein, 30 aa, Plasmodium falciparum
NKSSNRWADMCEDCDAPLVDTYNDNNDMKG

SEQ ID NO: 3368205 - protein, 32 aa, Plasmodium falciparum
NKSTCKASKNDNKWLRFFRFNKKTNPNEEKIL

SEQ ID NO: 3368206 - protein, 21 aa, Plasmodium falciparum
NKSTESFKNMNRHEVQSINNK

SEQ ID NO: 3368207 - protein, 21 aa, Plasmodium falciparum
NKSVCFLKRRNTCSFFDEKKY

SEQ ID NO: 3368208 - protein, 24 aa, Plasmodium falciparum
NKSYDIEGVWLFRGTDIPFEMKDH

SEQ ID NO: 3368209 - protein, 22 aa, Plasmodium falciparum
NKSYICYYNYKNIFLKDQLFIS

SEQ ID NO: 3368210 - protein, 44 aa, Plasmodium falciparum
NKTDTWFNYNFPRPQKVWRILASKACRNAIMVGKALNIYEMIKI

SEQ ID NO: 3368211 - protein, 29 aa, Plasmodium falciparum
NKTEFNRWKTALCFGGFLKGGEHMNNTYM

SEQ ID NO: 3368212 - protein, 24 aa, Plasmodium falciparum
NKTFIYNHILFWTIKITFVNLNIR

SEQ ID NO: 3368213 - protein, 18 aa, Plasmodium falciparum
NKTINYTLDFCVNETTSC

SEQ ID NO: 3368214 - protein, 27 aa, Plasmodium falciparum
NKTKKTSNCLITYDFKNLQQIYKEKCI

SEQ ID NO: 3368215 - protein, 21 aa, Plasmodium falciparum
NKTKLASCGNYSSFKEKITSI

SEQ ID NO: 3368216 - protein, 39 aa, Plasmodium falciparum
NKTKLHIKGVLKLDNISFKLKRIHNIPRNNLHNYNISET

SEQ ID NO: 3368217 - protein, 17 aa, Plasmodium falciparum
NKTLSLCDDVDNLSEDM

SEQ ID NO: 3368218 - protein, 36 aa, Plasmodium falciparum
NKTNSHDLLWVPRCCNGSYGTFLKYNYSNMNEINKY

SEQ ID NO: 3368219 - protein, 19 aa, Plasmodium falciparum
NKTPLSYLFRNYKTTLLNQ

SEQ ID NO: 3368220 - protein, 27 aa, Plasmodium falciparum
NKTSLHYKNNIGILMMAGDKIKVKVSL

SEQ ID NO: 3368221 - protein, 25 aa, Plasmodium falciparum
NKTVVNSICATNCTLNSIDVNPHNK

SEQ ID NO: 3368222 - protein, 18 aa, Plasmodium falciparum
NKTWLKVSQYLDMEKGEY

SEQ ID NO: 3368223 - protein, 25 aa, Plasmodium falciparum
NKTYMIKKKWKVHYILNKTKKKIKK

SEQ ID NO: 3368224 - protein, 19 aa, Plasmodium falciparum
NKVCRERRNRSRMLKQQKK

SEQ ID NO: 3368225 - protein, 21 aa, Plasmodium falciparum
NKVERILRVELSPIQIEYYKN

SEQ ID NO: 3368226 - protein, 18 aa, Plasmodium falciparum
NKVFLDWINGDSINNDEF

SEQ ID NO: 3368227 - protein, 28 aa, Plasmodium falciparum
NKVKEIYYFHVFYHYIKLGFPEKEAAIE

SEQ ID NO: 3368228 - protein, 17 aa, Plasmodium falciparum
NKVLKEKLHIICGKEIV

SEQ ID NO: 3368229 - protein, 23 aa, Plasmodium falciparum
NKVLKPKYLFMSVYNVLKNINVK

SEQ ID NO: 3368230 - protein, 20 aa, Plasmodium falciparum
NKVLLKFVININMNDQKEGN

SEQ ID NO: 3368231 - protein, 23 aa, Plasmodium falciparum
NKVPYDLVYSFLLDGELYLGYDI

SEQ ID NO: 3368232 - protein, 40 aa, Plasmodium falciparum
NKVSDWYCSACNFLNFSRRTACHFCKAPKTSDAKLVDKET

SEQ ID NO: 3368233 - protein, 26 aa, Plasmodium falciparum
NKWKAFKRGTKIEVLLCSDDEEYEQN

SEQ ID NO: 3368234 - protein, 26 aa, Plasmodium falciparum
NKYALTFKMNFAFYIPYGSVGIDVLK

SEQ ID NO: 3368235 - protein, 31 aa, Plasmodium falciparum
NKYDDWLVHKLCKWLYNINDKLYFNIDKQEI

SEQ ID NO: 3368236 - protein, 20 aa, Plasmodium falciparum
NKYEHIIKCKLTRRQQILYD

SEQ ID NO: 3368237 - protein, 25 aa, Plasmodium falciparum
NKYEKTCFFPARKQPIYTIINTKRQ

SEQ ID NO: 3368238 - protein, 29 aa, Plasmodium falciparum
NKYEWIKVKKAYGIFKLKSLAFDRKNRLW

SEQ ID NO: 3368239 - protein, 17 aa, Plasmodium falciparum
NKYFLRKVKEEKINEEK

SEQ ID NO: 3368240 - protein, 21 aa, Plasmodium falciparum
NKYGNNFLSYNGNYGSNKMYS

SEQ ID NO: 3368241 - protein, 18 aa, Plasmodium falciparum
NKYIKKEHNSFINYKNNE

SEQ ID NO: 3368242 - protein, 17 aa, Plasmodium falciparum
NKYINICDINNIHHLNN

SEQ ID NO: 3368243 - protein, 24 aa, Plasmodium falciparum
NKYKGNLINIFFIYSDIQQLIFTY

SEQ ID NO: 3368244 - protein, 20 aa, Plasmodium falciparum
NKYKKSIYKRGIDDTNMNSK

SEQ ID NO: 3368245 - protein, 22 aa, Plasmodium falciparum
NKYKNEYAYKHVVKCYNLPEFM

SEQ ID NO: 3368246 - protein, 25 aa, Plasmodium falciparum
NKYKRFSLPYFRFTSIGRNGTIQKP

SEQ ID NO: 3368247 - protein, 27 aa, Plasmodium falciparum
NKYNFKGNFEKYKYDFIIYSSDGDLDS

SEQ ID NO: 3368248 - protein, 28 aa, Plasmodium falciparum
NKYNLEIPMKFLLYISKYYSFVFKGKSF

SEQ ID NO: 3368249 - protein, 17 aa, Plasmodium falciparum
NKYNLFKHLDIKEERLN

SEQ ID NO: 3368250 - protein, 24 aa, Plasmodium falciparum
NKYNPCCSSCNGNVLSSSKTFNMC

SEQ ID NO: 3368251 - protein, 19 aa, Plasmodium falciparum
NKYNVRFAPIKNCKNNYFD

SEQ ID NO: 3368252 - protein, 19 aa, Plasmodium falciparum
NKYPFICKSILNVYKNKNK

SEQ ID NO: 3368253 - protein, 28 aa, Plasmodium falciparum
NKYQCPICKTSCKSSRELIICQKSHSEG

SEQ ID NO: 3368254 - protein, 19 aa, Plasmodium falciparum
NKYSIKCHIYLREWSNNKN

SEQ ID NO: 3368255 - protein, 17 aa, Plasmodium falciparum
NKYSRILIETELLSSNE

SEQ ID NO: 3368256 - protein, 28 aa, Plasmodium falciparum
NKYVEEWLKGHIKRVLYNQKYKNKTLYK

SEQ ID NO: 3368257 - protein, 18 aa, Plasmodium falciparum
NKYYYLADIFGYINRIYV

SEQ ID NO: 3368258 - protein, 24 aa, Plasmodium falciparum
NLACLQCPRLFMKSQNTEKVEEPL

SEQ ID NO: 3368259 - protein, 19 aa, Plasmodium falciparum
NLALLCSHLYNIPINLSDK

SEQ ID NO: 3368260 - protein, 24 aa, Plasmodium falciparum
NLARIRAPHCFFICLDEIIIIDIV

SEQ ID NO: 3368261 - protein, 30 aa, Plasmodium falciparum
NLCEEKRSNFVNPYIKNIINKDYKQNFIND

SEQ ID NO: 3368262 - protein, 17 aa, Plasmodium falciparum
NLCIPYDTLDILHRIKK

SEQ ID NO: 3368263 - protein, 21 aa, Plasmodium falciparum
NLCLHITLADLLFIHNHQKKN

SEQ ID NO: 3368264 - protein, 19 aa, Plasmodium falciparum
NLCNIKFDIWDTAGQERYA

SEQ ID NO: 3368265 - protein, 17 aa, Plasmodium falciparum
NLCNYLIEKGCNPNDQD

SEQ ID NO: 3368266 - protein, 19 aa, Plasmodium falciparum
NLCTTSIKENLECSTNIIK

SEQ ID NO: 3368267 - protein, 21 aa, Plasmodium falciparum
NLCYEEVMKLYQYLKNYGSQL

SEQ ID NO: 3368268 - protein, 21 aa, Plasmodium falciparum
NLDDFFYVFFFEKNQEVDISS

SEQ ID NO: 3368269 - protein, 17 aa, Plasmodium falciparum
NLDEKWSSIPIYKRQFY

SEQ ID NO: 3368270 - protein, 22 aa, Plasmodium falciparum
NLDHIKMSIKYQDQESSTYGNV

SEQ ID NO: 3368271 - protein, 21 aa, Plasmodium falciparum
NLDYHIIHFFNQYVLSLKTLK

SEQ ID NO: 3368272 - protein, 24 aa, Plasmodium falciparum
NLEDFDCIYFLSSNIQSVDIMIND

SEQ ID NO: 3368273 - protein, 20 aa, Plasmodium falciparum
NLEEERKKLLKYNEKENYKS

SEQ ID NO: 3368274 - protein, 26 aa, Plasmodium falciparum
NLEEIKCLYFFFLINILRFKNNLDLN

SEQ ID NO: 3368275 - protein, 25 aa, Plasmodium falciparum
NLEIFYHISNFIIHRYWYSQEYSTY

SEQ ID NO: 3368276 - protein, 17 aa, Plasmodium falciparum
NLEIMKCRISIEQIENE

SEQ ID NO: 3368277 - protein, 21 aa, Plasmodium falciparum
NLEKERFSWFFYNKKNDRKDK

SEQ ID NO: 3368278 - protein, 25 aa, Plasmodium falciparum
NLELYKKEFSKFGKIYNIYHDNEKK

SEQ ID NO: 3368279 - protein, 23 aa, Plasmodium falciparum
NLERCTKKNFCMNKEKDHVERGD

SEQ ID NO: 3368280 - protein, 18 aa, Plasmodium falciparum
NLERRKKKKNWPFCYFKK

SEQ ID NO: 3368281 - protein, 17 aa, Plasmodium falciparum
NLESLSFLESLSVSYKP

SEQ ID NO: 3368282 - protein, 25 aa, Plasmodium falciparum
NLEYKSVYLCKGRVNKIPLSITLKH

SEQ ID NO: 3368283 - protein, 18 aa, Plasmodium falciparum
NLEYYKALLNISSDNELF

SEQ ID NO: 3368284 - protein, 25 aa, Plasmodium falciparum
NLFCNIYNSICFVKMIKNTQKSPHK

SEQ ID NO: 3368285 - protein, 24 aa, Plasmodium falciparum
NLFFLFEYYYNYLVNMIKNVKLNK

SEQ ID NO: 3368286 - protein, 22 aa, Plasmodium falciparum
NLFHQNFRSFIPINSIKSQGNH

SEQ ID NO: 3368287 - protein, 22 aa, Plasmodium falciparum
NLFKCFFKYYYRIQNHEYDTKI

SEQ ID NO: 3368288 - protein, 17 aa, Plasmodium falciparum
NLFKYKNTWYELFFYNN

SEQ ID NO: 3368289 - protein, 26 aa, Plasmodium falciparum
NLFKYNDKICEFINICEHYKIHMNSQ

SEQ ID NO: 3368290 - protein, 18 aa, Plasmodium falciparum
NLFLMKREFLHLIETTIE

SEQ ID NO: 3368291 - protein, 22 aa, Plasmodium falciparum
NLFRFFLETLFYEYMTDERFKS

SEQ ID NO: 3368292 - protein, 20 aa, Plasmodium falciparum
NLFRFVKYINNFLHKASYEK

SEQ ID NO: 3368293 - protein, 29 aa, Plasmodium falciparum
NLGMNAKQAGSAWKKKETENVEEEGEEKE

SEQ ID NO: 3368294 - protein, 20 aa, Plasmodium falciparum
NLGNSCVYNNDLIYIIHNNK

SEQ ID NO: 3368295 - protein, 21 aa, Plasmodium falciparum
NLGNTCYFNAVLQFLTSFDDL

SEQ ID NO: 3368296 - protein, 18 aa, Plasmodium falciparum
NLGTIYEWDGYQMNKIKH

SEQ ID NO: 3368297 - protein, 18 aa, Plasmodium falciparum
NLGYHIITSLIIYGNKDE

SEQ ID NO: 3368298 - protein, 23 aa, Plasmodium falciparum
NLHEMKLCMSNYFSIGIDSRIGR

SEQ ID NO: 3368299 - protein, 23 aa, Plasmodium falciparum
NLHKYKIAKEMLLLSDSNSSSTC

SEQ ID NO: 3368300 - protein, 25 aa, Plasmodium falciparum
NLHSFSCTQTGILITTDLISRGINI

SEQ ID NO: 3368301 - protein, 18 aa, Plasmodium falciparum
NLIEDYKKEEFIENVEEI

SEQ ID NO: 3368302 - protein, 19 aa, Plasmodium falciparum
NLIKIFDLFKDIYLLNNGD

SEQ ID NO: 3368303 - protein, 21 aa, Plasmodium falciparum
NLIKIKFHLTNDITFKKEDIK

SEQ ID NO: 3368304 - protein, 25 aa, Plasmodium falciparum
NLIKIKIIPYKSIIFTTTIHDAYKI

SEQ ID NO: 3368305 - protein, 20 aa, Plasmodium falciparum
NLIKKQCFINSSFNASLNFD

SEQ ID NO: 3368306 - protein, 23 aa, Plasmodium falciparum
NLINLRFYILRLNGGKVSQKKIT

SEQ ID NO: 3368307 - protein, 23 aa, Plasmodium falciparum
NLIPFPRLHFFMIGFAPLTSRGS

SEQ ID NO: 3368308 - protein, 19 aa, Plasmodium falciparum
NLITPEAFVSKWFIGLNVH

SEQ ID NO: 3368309 - protein, 18 aa, Plasmodium falciparum
NLIYKKPIGPIMSSKDIL

SEQ ID NO: 3368310 - protein, 17 aa, Plasmodium falciparum
NLIYPLFYLEGLENTCI

SEQ ID NO: 3368311 - protein, 19 aa, Plasmodium falciparum
NLIYYGSRVTIFSRYNNQA

SEQ ID NO: 3368312 - protein, 26 aa, Plasmodium falciparum
NLKCYRNLCCITSALIMKIKKKRIVE

SEQ ID NO: 3368313 - protein, 22 aa, Plasmodium falciparum
NLKDDFFNLFAIVHNKVSDTCD

SEQ ID NO: 3368314 - protein, 17 aa, Plasmodium falciparum
NLKEHKIDIIANKMNDI

SEQ ID NO: 3368315 - protein, 23 aa, Plasmodium falciparum
NLKGKVCSDFSLSNTPSNDRMNI

SEQ ID NO: 3368316 - protein, 24 aa, Plasmodium falciparum
NLKHSKCTYQIMLQRIKKEKKLLY

SEQ ID NO: 3368317 - protein, 26 aa, Plasmodium falciparum
NLKINKIYYLFNFKVAFIDANHCPGS

SEQ ID NO: 3368318 - protein, 22 aa, Plasmodium falciparum
NLKIVKCVCYALLGKYDNKELV

SEQ ID NO: 3368319 - protein, 17 aa, Plasmodium falciparum
NLKKCGHYYLSIFHNKK

SEQ ID NO: 3368320 - protein, 22 aa, Plasmodium falciparum
NLKKKYLLDDSINYNDKNNDYL

SEQ ID NO: 3368321 - protein, 25 aa, Plasmodium falciparum
NLKKTFRFLFFYTKLSIEDKFMEYT

SEQ ID NO: 3368322 - protein, 29 aa, Plasmodium falciparum
NLKNANIKFALSIKDPFFVQSDIIELKGK

SEQ ID NO: 3368323 - protein, 23 aa, Plasmodium falciparum
NLKNVEPEDDFGSLNSNIMKNNN

SEQ ID NO: 3368324 - protein, 18 aa, Plasmodium falciparum
NLKPYVCYETNKLIEAFM

SEQ ID NO: 3368325 - protein, 18 aa, Plasmodium falciparum
NLKRALCLIESTESFSTY

SEQ ID NO: 3368326 - protein, 19 aa, Plasmodium falciparum
NLKRSRKVININLMQEEKL

SEQ ID NO: 3368327 - protein, 25 aa, Plasmodium falciparum
NLKSDGFQGFSVIKTFFINQEIFFN

SEQ ID NO: 3368328 - protein, 18 aa, Plasmodium falciparum
NLKSEICIKQNFDDLNVP

SEQ ID NO: 3368329 - protein, 21 aa, Plasmodium falciparum
NLKYKKCEPNQQFNDNVKNYK

SEQ ID NO: 3368330 - protein, 29 aa, Plasmodium falciparum
NLKYKYEYLKHFFHFALLNDDEFMNNIKS

SEQ ID NO: 3368331 - protein, 20 aa, Plasmodium falciparum
NLKYTCIRNKMNVDSIKLND

SEQ ID NO: 3368332 - protein, 20 aa, Plasmodium falciparum
NLLDFDFEKLCSISLSNLHV

SEQ ID NO: 3368333 - protein, 21 aa, Plasmodium falciparum
NLLFDCLIELLKNRKILNSTN

SEQ ID NO: 3368334 - protein, 17 aa, Plasmodium falciparum
NLLFTFNKLNVMKKKFV

SEQ ID NO: 3368335 - protein, 36 aa, Plasmodium falciparum
NLLIHCATCPTSFCYNCFPPDYVRYYVGEEYYHNLR

SEQ ID NO: 3368336 - protein, 24 aa, Plasmodium falciparum
NLLKRNILTTLSWILQNFKILSHE

SEQ ID NO: 3368337 - protein, 22 aa, Plasmodium falciparum
NLLLGEGLKELGLGRGGTPGVS

SEQ ID NO: 3368338 - protein, 19 aa, Plasmodium falciparum
NLLLKQSHLNLLLNNQLKL

SEQ ID NO: 3368339 - protein, 17 aa, Plasmodium falciparum
NLLLYTFELDRLIEKNN

SEQ ID NO: 3368340 - protein, 17 aa, Plasmodium falciparum
NLLNLSAKERPSALQCL

SEQ ID NO: 3368341 - protein, 19 aa, Plasmodium falciparum
NLLNVWLLYIQNILSKHSI

SEQ ID NO: 3368342 - protein, 23 aa, Plasmodium falciparum
NLLRLKDPITIVGDIHGQYYDLL

SEQ ID NO: 3368343 - protein, 18 aa, Plasmodium falciparum
NLLSPGGDKNIPFTDINY

SEQ ID NO: 3368344 - protein, 21 aa, Plasmodium falciparum
NLLTTKCVKNQILMNNKMSLN

SEQ ID NO: 3368345 - protein, 22 aa, Plasmodium falciparum
NLLYNHESYILSPYDYYNYYCS

SEQ ID NO: 3368346 - protein, 23 aa, Plasmodium falciparum
NLMDICNIFDLLIYNNDIFNNNN

SEQ ID NO: 3368347 - protein, 20 aa, Plasmodium falciparum
NLMGRDSLQDKIMYNPMNDY

SEQ ID NO: 3368348 - protein, 25 aa, Plasmodium falciparum
NLMKEIFYFKEITPIVDELEKKNIL

SEQ ID NO: 3368349 - protein, 25 aa, Plasmodium falciparum
NLMKSKLKNPFSLLTTLGTKNKEDT

SEQ ID NO: 3368350 - protein, 17 aa, Plasmodium falciparum
NLMLPGNLGEFLPKFLI

SEQ ID NO: 3368351 - protein, 18 aa, Plasmodium falciparum
NLNEYIKCLQNINNKKLK

SEQ ID NO: 3368352 - protein, 24 aa, Plasmodium falciparum
NLNHPYKYEIENIIKEYRNDNNNV

SEQ ID NO: 3368353 - protein, 23 aa, Plasmodium falciparum
NLNIDLLNNIGFREEYLYYDNYL

SEQ ID NO: 3368354 - protein, 24 aa, Plasmodium falciparum
NLNIKRNMKNESFISDLSTNKNEL

SEQ ID NO: 3368355 - protein, 28 aa, Plasmodium falciparum
NLNKGGRYFKVDKYFYSKKYKVRTHFGD

SEQ ID NO: 3368356 - protein, 18 aa, Plasmodium falciparum
NLNKQISNCFSKDNNNNN

SEQ ID NO: 3368357 - protein, 21 aa, Plasmodium falciparum
NLNLIKGRGGALVREKLVASS

SEQ ID NO: 3368358 - protein, 23 aa, Plasmodium falciparum
NLNNNIPPVFKYDDIINNNNNNN

SEQ ID NO: 3368359 - protein, 24 aa, Plasmodium falciparum
NLNNRRNVIIIRDINSHYINTIKS

SEQ ID NO: 3368360 - protein, 21 aa, Plasmodium falciparum
NLNSICVWKAHKRPHNSEQYY

SEQ ID NO: 3368361 - protein, 27 aa, Plasmodium falciparum
NLPEFKKKELLCGYIPDIILPANVRKV

SEQ ID NO: 3368362 - protein, 23 aa, Plasmodium falciparum
NLPLKPRYVNYILEEKKKTNSKK

SEQ ID NO: 3368363 - protein, 19 aa, Plasmodium falciparum
NLQAFDLLDNFHMDDYGNN

SEQ ID NO: 3368364 - protein, 18 aa, Plasmodium falciparum
NLQHLVGDPTTYFKIGGG

SEQ ID NO: 3368365 - protein, 18 aa, Plasmodium falciparum
NLQHNICKNYKLYHSDFY

SEQ ID NO: 3368366 - protein, 24 aa, Plasmodium falciparum
NLQKMEIMNLFKKIMHACDSLSND

SEQ ID NO: 3368367 - protein, 23 aa, Plasmodium falciparum
NLQLKLNSIIICNQKNKDQKDIC

SEQ ID NO: 3368368 - protein, 36 aa, Plasmodium falciparum
NLQSCIKALEQDGCLLKDKYIQVTLALNNSMQDNNK

SEQ ID NO: 3368369 - protein, 25 aa, Plasmodium falciparum
NLQVKFKELFKIWKNASNKLITDFT

SEQ ID NO: 3368370 - protein, 24 aa, Plasmodium falciparum
NLRFLRHCEKINKILNLDNILSYI

SEQ ID NO: 3368371 - protein, 26 aa, Plasmodium falciparum
NLRLTEVYGSSILAFKNIVFLNVEDA

SEQ ID NO: 3368372 - protein, 17 aa, Plasmodium falciparum
NLRNENFNKSIFMYDEY

SEQ ID NO: 3368373 - protein, 19 aa, Plasmodium falciparum
NLRNLCNMFQIFDNESSGI

SEQ ID NO: 3368374 - protein, 21 aa, Plasmodium falciparum
NLRQRRKVHNYAQMEDNYFET

SEQ ID NO: 3368375 - protein, 24 aa, Plasmodium falciparum
NLRTNLKLLKDSNWMNYKKNVNSD

SEQ ID NO: 3368376 - protein, 18 aa, Plasmodium falciparum
NLRYIFISIMPKLKILNH

SEQ ID NO: 3368377 - protein, 27 aa, Plasmodium falciparum
NLSFKDIKRNYASIFAQVKTPRRNASN

SEQ ID NO: 3368378 - protein, 26 aa, Plasmodium falciparum
NLSICQCPGVIKLHKVIGGKEGWILI

SEQ ID NO: 3368379 - protein, 23 aa, Plasmodium falciparum
NLSLFCTGTFQGRVLSKFGEKKC

SEQ ID NO: 3368380 - protein, 24 aa, Plasmodium falciparum
NLSNCQFEYKRMQNTKEKKNSNHS

SEQ ID NO: 3368381 - protein, 26 aa, Plasmodium falciparum
NLSNVKLKYINIITYYMDLLSPFNKC

SEQ ID NO: 3368382 - protein, 35 aa, Plasmodium falciparum
NLSQTCKFFYKRKFKVAYNRLIFKSYLGYNPKILY

SEQ ID NO: 3368383 - protein, 18 aa, Plasmodium falciparum
NLSSLCRDFHNIFRINKY

SEQ ID NO: 3368384 - protein, 23 aa, Plasmodium falciparum
NLSSLKTSFRYKINNKSGKSRSI

SEQ ID NO: 3368385 - protein, 24 aa, Plasmodium falciparum
NLSSLRRTYILFSYFPEALTGLKK

SEQ ID NO: 3368386 - protein, 23 aa, Plasmodium falciparum
NLSTFRRLFNLKRKKKDKEEKPK

SEQ ID NO: 3368387 - protein, 25 aa, Plasmodium falciparum
NLSYDKECVEKKSLIIKDKEEKNIY

SEQ ID NO: 3368388 - protein, 20 aa, Plasmodium falciparum
NLSYLFRIDYGINKDDTQKG

SEQ ID NO: 3368389 - protein, 24 aa, Plasmodium falciparum
NLTHLCYAFSLIKIPKFKEKSKIK

SEQ ID NO: 3368390 - protein, 25 aa, Plasmodium falciparum
NLTIGCNLLKGLVPVQNLLNIKLSS

SEQ ID NO: 3368391 - protein, 24 aa, Plasmodium falciparum
NLTKDYRKSLTYNDIPNFLDYNIN

SEQ ID NO: 3368392 - protein, 24 aa, Plasmodium falciparum
NLTQSCKLLYNIYCVLNKDNEQKK

SEQ ID NO: 3368393 - protein, 18 aa, Plasmodium falciparum
NLTRTGRKMAEFPTDVKS

SEQ ID NO: 3368394 - protein, 17 aa, Plasmodium falciparum
NLVNSFFYVGRRNKIPI

SEQ ID NO: 3368395 - protein, 25 aa, Plasmodium falciparum
NLVPYPRIHFMLSSYAPIISAEKAY

SEQ ID NO: 3368396 - protein, 25 aa, Plasmodium falciparum
NLVPYPRIHFMLSSYAPVVSAEKAY

SEQ ID NO: 3368397 - protein, 17 aa, Plasmodium falciparum
NLVRIYNLRRKSLKIYK

SEQ ID NO: 3368398 - protein, 20 aa, Plasmodium falciparum
NLVSFQYKGSLPKENINNLK

SEQ ID NO: 3368399 - protein, 18 aa, Plasmodium falciparum
NLYDQGFAYLKCNVPQKP

SEQ ID NO: 3368400 - protein, 21 aa, Plasmodium falciparum
NLYINSIHIINNFFSPNENNN

SEQ ID NO: 3368401 - protein, 25 aa, Plasmodium falciparum
NLYINYEMFKFIFLNIDMNIEQNGQ

SEQ ID NO: 3368402 - protein, 19 aa, Plasmodium falciparum
NLYIPNSRSINIDINDTDN

SEQ ID NO: 3368403 - protein, 35 aa, Plasmodium falciparum
NLYKKYQMCFYCDSNKGLIFCFLTSFSHLQLYNIE

SEQ ID NO: 3368404 - protein, 18 aa, Plasmodium falciparum
NLYLKYKKFKKHNLRIRE

SEQ ID NO: 3368405 - protein, 25 aa, Plasmodium falciparum
NMAPPPNRRKSIIGGVRENMDMYDN

SEQ ID NO: 3368406 - protein, 25 aa, Plasmodium falciparum
NMARVCSFWRKNSCNRGDECPYLHK

SEQ ID NO: 3368407 - protein, 26 aa, Plasmodium falciparum
NMAYESIMGLLFPNIRSHKSCNVNAY

SEQ ID NO: 3368408 - protein, 26 aa, Plasmodium falciparum
NMCNKKINRIRLMGVPESVNENMDIK

SEQ ID NO: 3368409 - protein, 23 aa, Plasmodium falciparum
NMCNTYAAICYEGINNNQGIILG

SEQ ID NO: 3368410 - protein, 20 aa, Plasmodium falciparum
NMCSIKHIYDNGSSNDDILN

SEQ ID NO: 3368411 - protein, 17 aa, Plasmodium falciparum
NMCYVCKEKEHIYKCPY

SEQ ID NO: 3368412 - protein, 30 aa, Plasmodium falciparum
NMDDWKMKKYKKFSNNNMNSMNNVNNVNNV

SEQ ID NO: 3368413 - protein, 22 aa, Plasmodium falciparum
NMDLPCCDKDNYIINKKLKKNH

SEQ ID NO: 3368414 - protein, 21 aa, Plasmodium falciparum
NMEGSLKWKLSSREKENYQRI

SEQ ID NO: 3368415 - protein, 23 aa, Plasmodium falciparum
NMEKEVYHTCSIQSPERSAVHNN

SEQ ID NO: 3368416 - protein, 20 aa, Plasmodium falciparum
NMENLLCDLENISINNNELF

SEQ ID NO: 3368417 - protein, 23 aa, Plasmodium falciparum
NMENLPKVWYCKLNNDVRYNSCD

SEQ ID NO: 3368418 - protein, 21 aa, Plasmodium falciparum
NMFCKEGEAYNMINKEKESKK

SEQ ID NO: 3368419 - protein, 27 aa, Plasmodium falciparum
NMFCTICHIPICNLCISSHVHTDLTTN

SEQ ID NO: 3368420 - protein, 24 aa, Plasmodium falciparum
NMFKIIIFSCNHFKPFEVSSIFKS

SEQ ID NO: 3368421 - protein, 26 aa, Plasmodium falciparum
NMFLNKKKRSCFFMLNEKEKCTLKRK

SEQ ID NO: 3368422 - protein, 19 aa, Plasmodium falciparum
NMFLYSYMKPGDFLSIPII

SEQ ID NO: 3368423 - protein, 25 aa, Plasmodium falciparum
NMFNGFSLYLFYPLIYVGYFINNSM

SEQ ID NO: 3368424 - protein, 19 aa, Plasmodium falciparum
NMFNYPNAQYQNMQNVQNM

SEQ ID NO: 3368425 - protein, 18 aa, Plasmodium falciparum
NMFPSKINMDNCNINNNY

SEQ ID NO: 3368426 - protein, 17 aa, Plasmodium falciparum
NMGKGKKQTPNRMNNTK

SEQ ID NO: 3368427 - protein, 24 aa, Plasmodium falciparum
NMICSHCKHKLVFELQLFSTFIYQ

SEQ ID NO: 3368428 - protein, 17 aa, Plasmodium falciparum
NMIKKDKAKECMYRCNI

SEQ ID NO: 3368429 - protein, 21 aa, Plasmodium falciparum
NMKDLLILRLEFFNKYNQKFV

SEQ ID NO: 3368430 - protein, 21 aa, Plasmodium falciparum
NMKECINPNINDYVDRNKNHN

SEQ ID NO: 3368431 - protein, 50 aa, Plasmodium falciparum
NMKECIVNMCNYNFNSCKIISLLFYNRILKCVIFKNKMNLIHFYDELLQY

SEQ ID NO: 3368432 - protein, 23 aa, Plasmodium falciparum
NMKGKTFTLKKLIGIKKNLGPKK

SEQ ID NO: 3368433 - protein, 27 aa, Plasmodium falciparum
NMKKNIRINKNYFPKGITSPRNNGNTN

SEQ ID NO: 3368434 - protein, 18 aa, Plasmodium falciparum
NMKKRTFGEFIEKGKDTK

SEQ ID NO: 3368435 - protein, 25 aa, Plasmodium falciparum
NMKLLKQRNCNLITLSQFMKERKKK

SEQ ID NO: 3368436 - protein, 22 aa, Plasmodium falciparum
NMKLTELYLDFIDLSNVCGEYI

SEQ ID NO: 3368437 - protein, 24 aa, Plasmodium falciparum
NMKNSLRVWIEFEKWTSYKNTVNK

SEQ ID NO: 3368438 - protein, 25 aa, Plasmodium falciparum
NMKRSMSLCNLKDTQVDDIKYDDLI

SEQ ID NO: 3368439 - protein, 21 aa, Plasmodium falciparum
NMKTPVVVFPTGFYNNEIKIV

SEQ ID NO: 3368440 - protein, 21 aa, Plasmodium falciparum
NMLEMEIKKYVPVHKVYPIPK

SEQ ID NO: 3368441 - protein, 25 aa, Plasmodium falciparum
NMLEQRIGWMYGYYREDNHYNLGIR

SEQ ID NO: 3368442 - protein, 17 aa, Plasmodium falciparum
NMLKLKNNQIILCRNCN

SEQ ID NO: 3368443 - protein, 26 aa, Plasmodium falciparum
NMLPEEELVEFIFLLLKERNEYNNLE

SEQ ID NO: 3368444 - protein, 24 aa, Plasmodium falciparum
NMLRKKLRCKFKSVGMLELDTLIN

SEQ ID NO: 3368445 - protein, 23 aa, Plasmodium falciparum
NMLSHILCLLYFTSDSRAHATFD

SEQ ID NO: 3368446 - protein, 24 aa, Plasmodium falciparum
NMMGSSGFPNRSTNTSNLFGLTTT

SEQ ID NO: 3368447 - protein, 17 aa, Plasmodium falciparum
NMMRGMVERALSSSLYF

SEQ ID NO: 3368448 - protein, 17 aa, Plasmodium falciparum
NMMSYAFKVQNIDYEKI

SEQ ID NO: 3368449 - protein, 29 aa, Plasmodium falciparum
NMNEAFLYFIQLLQGMWYIQEMNIVHRDL

SEQ ID NO: 3368450 - protein, 18 aa, Plasmodium falciparum
NMNELKVSYDSGISDSDD

SEQ ID NO: 3368451 - protein, 17 aa, Plasmodium falciparum
NMNHFKSVIPSDMTTNN

SEQ ID NO: 3368452 - protein, 19 aa, Plasmodium falciparum
NMNLLREILKLMTDNIDTL

SEQ ID NO: 3368453 - protein, 18 aa, Plasmodium falciparum
NMPISLYKYPPIFGYCSL

SEQ ID NO: 3368454 - protein, 25 aa, Plasmodium falciparum
NMQVPSFPSSLYILQNYFVKLIILN

SEQ ID NO: 3368455 - protein, 25 aa, Plasmodium falciparum
NMRSSRSHAIIQFFVNISDCTLHNG

SEQ ID NO: 3368456 - protein, 24 aa, Plasmodium falciparum
NMSEKKKKNCRMKKNDKEKENIIL

SEQ ID NO: 3368457 - protein, 20 aa, Plasmodium falciparum
NMTIKVSSLNDLPYFFDEEK

SEQ ID NO: 3368458 - protein, 17 aa, Plasmodium falciparum
NMVSQHHKVFIGNGHEN

SEQ ID NO: 3368459 - protein, 25 aa, Plasmodium falciparum
NMYKKNSFDNFHFIKSLSSNELKNN

SEQ ID NO: 3368460 - protein, 26 aa, Plasmodium falciparum
NNADYFKRTHLYKFNNILSNNNINNT

SEQ ID NO: 3368461 - protein, 17 aa, Plasmodium falciparum
NNALLINEYNNFSKSGM

SEQ ID NO: 3368462 - protein, 19 aa, Plasmodium falciparum
NNCFEKFNIASIDEIVDNM

SEQ ID NO: 3368463 - protein, 19 aa, Plasmodium falciparum
NNCHLQYNISLSKNINCKY

SEQ ID NO: 3368464 - protein, 21 aa, Plasmodium falciparum
NNCILFKNDLSIIISQGPFND

SEQ ID NO: 3368465 - protein, 19 aa, Plasmodium falciparum
NNCIYIWNLSLLTNTIIMN

SEQ ID NO: 3368466 - protein, 19 aa, Plasmodium falciparum
NNCKNKFLVKYKHFENNDS

SEQ ID NO: 3368467 - protein, 25 aa, Plasmodium falciparum
NNCKSLNVHKSICLDKSNMNIDEEY

SEQ ID NO: 3368468 - protein, 30 aa, Plasmodium falciparum
NNCKVINIYSCYAIWLCMNEIYPSWFDISI

SEQ ID NO: 3368469 - protein, 17 aa, Plasmodium falciparum
NNCRGVIEDDKPPKEII

SEQ ID NO: 3368470 - protein, 17 aa, Plasmodium falciparum
NNCTRCVKKETMGKKNE

SEQ ID NO: 3368471 - protein, 24 aa, Plasmodium falciparum
NNDDMYKNLSMDEFFLNPNNIEAN

SEQ ID NO: 3368472 - protein, 23 aa, Plasmodium falciparum
NNDDVCLCHLSYVPIIGNLREQK

SEQ ID NO: 3368473 - protein, 31 aa, Plasmodium falciparum
NNDESLKSFQFLNGRYFGGSLINAYFISNDV

SEQ ID NO: 3368474 - protein, 23 aa, Plasmodium falciparum
NNDFKITQYFLFHKNSFERGVTE

SEQ ID NO: 3368475 - protein, 18 aa, Plasmodium falciparum
NNDILKDIILQVIDIIRN

SEQ ID NO: 3368476 - protein, 18 aa, Plasmodium falciparum
NNDILWAFGACKKGGINC

SEQ ID NO: 3368477 - protein, 23 aa, Plasmodium falciparum
NNDIRLRLSLLYVSEQYELFKSY

SEQ ID NO: 3368478 - protein, 17 aa, Plasmodium falciparum
NNDIVICNNHNNSSHVQ

SEQ ID NO: 3368479 - protein, 19 aa, Plasmodium falciparum
NNDKMISEHMGIYGEQINL

SEQ ID NO: 3368480 - protein, 20 aa, Plasmodium falciparum
NNDLMVCKIKNNFKDKNTCP

SEQ ID NO: 3368481 - protein, 22 aa, Plasmodium falciparum
NNDLYIWGNREILGMEYDDDAY

SEQ ID NO: 3368482 - protein, 18 aa, Plasmodium falciparum
NNDMSIRISNQYNNENIK

SEQ ID NO: 3368483 - protein, 26 aa, Plasmodium falciparum
NNDNYICFFCLYDINFCTLCKEVLTN

SEQ ID NO: 3368484 - protein, 28 aa, Plasmodium falciparum
NNECSKDNIYACCHIELSTPYLVKAYIN

SEQ ID NO: 3368485 - protein, 18 aa, Plasmodium falciparum
NNECVKLKKKIENEKYDI

SEQ ID NO: 3368486 - protein, 29 aa, Plasmodium falciparum
NNEDPVHFALCEYLNCFKKNNLSIKINKL

SEQ ID NO: 3368487 - protein, 24 aa, Plasmodium falciparum
NNEDTCGFIQVLLKSIYTRISDDQ

SEQ ID NO: 3368488 - protein, 24 aa, Plasmodium falciparum
NNEELKIYILIFRSLCNENIKKID

SEQ ID NO: 3368489 - protein, 32 aa, Plasmodium falciparum
NNEEVYSEWKICPNFIFRILFIAKSRANNFIY

SEQ ID NO: 3368490 - protein, 19 aa, Plasmodium falciparum
NNEFVVAQLYELNNYNENN

SEQ ID NO: 3368491 - protein, 23 aa, Plasmodium falciparum
NNEGCPFSYMNIKSLSTHNDNRN

SEQ ID NO: 3368492 - protein, 24 aa, Plasmodium falciparum
NNEHILKICDFIKEDEKEERKNII

SEQ ID NO: 3368493 - protein, 18 aa, Plasmodium falciparum
NNEIFKRNYNRPLMPLLV

SEQ ID NO: 3368494 - protein, 18 aa, Plasmodium falciparum
NNEIFYKVFEQYPYSFFS

SEQ ID NO: 3368495 - protein, 22 aa, Plasmodium falciparum
NNEIKFKIYYTLPKHTNLKYIV

SEQ ID NO: 3368496 - protein, 31 aa, Plasmodium falciparum
NNEKSFILYQCLKLLIRLHDAGLSHLDLTPE

SEQ ID NO: 3368497 - protein, 25 aa, Plasmodium falciparum
NNEKYLQWFDTIYTVCVKLDDLCCR

SEQ ID NO: 3368498 - protein, 29 aa, Plasmodium falciparum
NNEKYSYIKFKKERQGTVKYLKEYFQKMQ

SEQ ID NO: 3368499 - protein, 24 aa, Plasmodium falciparum
NNELCKLDHILKPLLLSTNNKNMH

SEQ ID NO: 3368500 - protein, 28 aa, Plasmodium falciparum
NNELPDQYPFHLCNEFKNDMQSKNKLTY

SEQ ID NO: 3368501 - protein, 19 aa, Plasmodium falciparum
NNEMPFDHIEESFNYPENK

SEQ ID NO: 3368502 - protein, 17 aa, Plasmodium falciparum
NNENGFWISNIDKQRLV

SEQ ID NO: 3368503 - protein, 19 aa, Plasmodium falciparum
NNENIFLKNFFLSSKKYDN

SEQ ID NO: 3368504 - protein, 23 aa, Plasmodium falciparum
NNENVPMCLISKSSYSEVNDEFN

SEQ ID NO: 3368505 - protein, 26 aa, Plasmodium falciparum
NNESITFRVRCLIKDVIDNRNEKWNK

SEQ ID NO: 3368506 - protein, 32 aa, Plasmodium falciparum
NNEWSEVDFSYSFNISKVFCRSVLVESIDRNI

SEQ ID NO: 3368507 - protein, 24 aa, Plasmodium falciparum
NNEYEFFIIPIIFNKHNEILYMGV

SEQ ID NO: 3368508 - protein, 23 aa, Plasmodium falciparum
NNEYKYRFYYIFLNNYLTIQTMF

SEQ ID NO: 3368509 - protein, 23 aa, Plasmodium falciparum
NNFDKINMCPLIISYNRSIPTPK

SEQ ID NO: 3368510 - protein, 28 aa, Plasmodium falciparum
NNFEELHVSFSFSEFLLFQKAANLLLPQ

SEQ ID NO: 3368511 - protein, 20 aa, Plasmodium falciparum
NNFFIPKIDNLIYILNKMLQ

SEQ ID NO: 3368512 - protein, 18 aa, Plasmodium falciparum
NNFFYKKEYIFSSFRNNI

SEQ ID NO: 3368513 - protein, 19 aa, Plasmodium falciparum
NNFHHIKGYTCDKMNSKKC

SEQ ID NO: 3368514 - protein, 18 aa, Plasmodium falciparum
NNFIFKCEEKLYMEEGIR

SEQ ID NO: 3368515 - protein, 28 aa, Plasmodium falciparum
NNFILCSGCNHVYHLKCVHKFNTEVNEN

SEQ ID NO: 3368516 - protein, 26 aa, Plasmodium falciparum
NNFIPLYLCAFLKREINYIKQNKNIY

SEQ ID NO: 3368517 - protein, 40 aa, Plasmodium falciparum
NNFKPCYESLIILYFLYSLVRYHECDFILAHPIDQKLTDF

SEQ ID NO: 3368518 - protein, 24 aa, Plasmodium falciparum
NNFLKELFPFIKIKNEKNKQNDSS

SEQ ID NO: 3368519 - protein, 37 aa, Plasmodium falciparum
NNFNGNYCPMQDMNMMYDVNGIMYGYSYVKNDDKNMN

SEQ ID NO: 3368520 - protein, 17 aa, Plasmodium falciparum
NNFPLEFFIERGRQKLP

SEQ ID NO: 3368521 - protein, 20 aa, Plasmodium falciparum
NNFSCSVLIELIKKNIFVNK

SEQ ID NO: 3368522 - protein, 18 aa, Plasmodium falciparum
NNFSRGYFSNTYEKGNTY

SEQ ID NO: 3368523 - protein, 24 aa, Plasmodium falciparum
NNFSYKLYLLSLMQDKNKNLQTEQ

SEQ ID NO: 3368524 - protein, 26 aa, Plasmodium falciparum
NNFYEESVKLLGTHLTEDISLNNPDV

SEQ ID NO: 3368525 - protein, 23 aa, Plasmodium falciparum
NNFYKKKAEEWINDYPFDDYIIS

SEQ ID NO: 3368526 - protein, 22 aa, Plasmodium falciparum
NNGCGKTTLLNLIYENSDNKLK

SEQ ID NO: 3368527 - protein, 28 aa, Plasmodium falciparum
NNGEKKVRIKICLEDFFNKNKEIYNAID

SEQ ID NO: 3368528 - protein, 24 aa, Plasmodium falciparum
NNGITKFFLKDLIKESSLKNNEDV

SEQ ID NO: 3368529 - protein, 18 aa, Plasmodium falciparum
NNGNKCYQKGDDMKDGKF

SEQ ID NO: 3368530 - protein, 24 aa, Plasmodium falciparum
NNGSYKITFIFGEKAKEFMEPLTL

SEQ ID NO: 3368531 - protein, 17 aa, Plasmodium falciparum
NNGTYYLSNNVGYIKTN

SEQ ID NO: 3368532 - protein, 29 aa, Plasmodium falciparum
NNHIKLNNIYNLYCYLIKNTFFKISDKNV

SEQ ID NO: 3368533 - protein, 31 aa, Plasmodium falciparum
NNHIRLLCCLSLKLIYNLQVAYVYNYSIYND

SEQ ID NO: 3368534 - protein, 19 aa, Plasmodium falciparum
NNHSLDFSIHCEDNMNISN

SEQ ID NO: 3368535 - protein, 19 aa, Plasmodium falciparum
NNHSLYINEIVNIKKDEHN

SEQ ID NO: 3368536 - protein, 17 aa, Plasmodium falciparum
NNHVFYYLICSFQDKQF

SEQ ID NO: 3368537 - protein, 19 aa, Plasmodium falciparum
NNICTKDLVGDLLEYKNYI

SEQ ID NO: 3368538 - protein, 19 aa, Plasmodium falciparum
NNIDCINMNKKNYMYNINN

SEQ ID NO: 3368539 - protein, 21 aa, Plasmodium falciparum
NNIDSLVIWRIKKFLSSSEHN

SEQ ID NO: 3368540 - protein, 36 aa, Plasmodium falciparum
NNIFDVKYGVGFKMSFARISSSCAIMSRTFNTIGIG

SEQ ID NO: 3368541 - protein, 18 aa, Plasmodium falciparum
NNIFFSFFTSFKLMKNEE

SEQ ID NO: 3368542 - protein, 25 aa, Plasmodium falciparum
NNIFLIKYVLKYKHIFSNNLYLYIL

SEQ ID NO: 3368543 - protein, 23 aa, Plasmodium falciparum
NNIFPVKEYNNFVNYSEAFNNKK

SEQ ID NO: 3368544 - protein, 18 aa, Plasmodium falciparum
NNIICGGNPCEKNRFPHY

SEQ ID NO: 3368545 - protein, 17 aa, Plasmodium falciparum
NNIIFYNEFIKDDNYYN

SEQ ID NO: 3368546 - protein, 18 aa, Plasmodium falciparum
NNIIIKWIRDKHVVNQTK

SEQ ID NO: 3368547 - protein, 25 aa, Plasmodium falciparum
NNIILKPSNFYNFPMDTSSSNTSDN

SEQ ID NO: 3368548 - protein, 22 aa, Plasmodium falciparum
NNIKFCSFNFLKLNNVIENCII

SEQ ID NO: 3368549 - protein, 24 aa, Plasmodium falciparum
NNIKKGVTCIPLNYQSKGGAMAII

SEQ ID NO: 3368550 - protein, 23 aa, Plasmodium falciparum
NNIKNELKGIIGNSSNFLENTFK

SEQ ID NO: 3368551 - protein, 23 aa, Plasmodium falciparum
NNIKNGKMNKAFYNNDVNIDNMG

SEQ ID NO: 3368552 - protein, 25 aa, Plasmodium falciparum
NNIKNKYMLDDKFGSTSLYNNNNNN

SEQ ID NO: 3368553 - protein, 24 aa, Plasmodium falciparum
NNIKNNILYIKWVYNRLAFVTTSN

SEQ ID NO: 3368554 - protein, 22 aa, Plasmodium falciparum
NNIKNSMLLLNDIKRIVDSGAN

SEQ ID NO: 3368555 - protein, 24 aa, Plasmodium falciparum
NNIKNSYYIPSEQYEMFCSANNIV

SEQ ID NO: 3368556 - protein, 25 aa, Plasmodium falciparum
NNIKSIKGLRAFENLRVLNISHNEV

SEQ ID NO: 3368557 - protein, 23 aa, Plasmodium falciparum
NNILFCLCCTTTLSVGINMNIHT

SEQ ID NO: 3368558 - protein, 23 aa, Plasmodium falciparum
NNILHPDMIVFLYFLLICNSLSN

SEQ ID NO: 3368559 - protein, 19 aa, Plasmodium falciparum
NNIMRKNLIQFLKENRNKV

SEQ ID NO: 3368560 - protein, 19 aa, Plasmodium falciparum
NNINDIKKDIGIDQSNNIK

SEQ ID NO: 3368561 - protein, 20 aa, Plasmodium falciparum
NNINITWKNNHNVKDMKFYQ

SEQ ID NO: 3368562 - protein, 21 aa, Plasmodium falciparum
NNINSHMGIMITQNVQENNTG

SEQ ID NO: 3368563 - protein, 25 aa, Plasmodium falciparum
NNINYKNNFLLSSNVSKCSNRYVSS

SEQ ID NO: 3368564 - protein, 32 aa, Plasmodium falciparum
NNIPIFKKIIKFGAMWIFYIYKNIQNEKDAFF

SEQ ID NO: 3368565 - protein, 21 aa, Plasmodium falciparum
NNIPQPFSFDKGQYKVKIKPV

SEQ ID NO: 3368566 - protein, 31 aa, Plasmodium falciparum
NNIQFDKSLLINCIDVLLNFMNYNNLKDTIT

SEQ ID NO: 3368567 - protein, 24 aa, Plasmodium falciparum
NNIRREQRISYKKYGNDKAKLRAK

SEQ ID NO: 3368568 - protein, 21 aa, Plasmodium falciparum
NNIRRGLYLASKILKDIHEEK

SEQ ID NO: 3368569 - protein, 25 aa, Plasmodium falciparum
NNIRRKNFTYSFPIIKRNYYIKRHL

SEQ ID NO: 3368570 - protein, 17 aa, Plasmodium falciparum
NNISCGFNENIEFFSYL

SEQ ID NO: 3368571 - protein, 24 aa, Plasmodium falciparum
NNISIGESIIYPSNEINKLYVIIK

SEQ ID NO: 3368572 - protein, 18 aa, Plasmodium falciparum
NNISLMFRNKIMNFAKKQ

SEQ ID NO: 3368573 - protein, 24 aa, Plasmodium falciparum
NNISRRRNHILYKCRNKLYNGNVF

SEQ ID NO: 3368574 - protein, 18 aa, Plasmodium falciparum
NNISSMHFLYLLIYSKCK

SEQ ID NO: 3368575 - protein, 20 aa, Plasmodium falciparum
NNIVSWPMLIDYFNELYNIN

SEQ ID NO: 3368576 - protein, 17 aa, Plasmodium falciparum
NNIVWKYLTDVFDYLPL

SEQ ID NO: 3368577 - protein, 23 aa, Plasmodium falciparum
NNIYEFLTEWGLESLDEVPPELM

SEQ ID NO: 3368578 - protein, 19 aa, Plasmodium falciparum
NNIYFKHFISNKIINKYIH

SEQ ID NO: 3368579 - protein, 29 aa, Plasmodium falciparum
NNIYKCTYFNEHRCFICKSLYEDTSKQLE

SEQ ID NO: 3368580 - protein, 24 aa, Plasmodium falciparum
NNIYKESKHEFDIYEENVLQVDTE

SEQ ID NO: 3368581 - protein, 22 aa, Plasmodium falciparum
NNIYRNSFSNFATFNYNDSNLS

SEQ ID NO: 3368582 - protein, 19 aa, Plasmodium falciparum
NNKCSSTAAYSEMKQYVDV

SEQ ID NO: 3368583 - protein, 25 aa, Plasmodium falciparum
NNKDIYALLKSWRQYVTALKSTQRY

SEQ ID NO: 3368584 - protein, 29 aa, Plasmodium falciparum
NNKDMRINLCRDAILFILHDLETILELNI

SEQ ID NO: 3368585 - protein, 22 aa, Plasmodium falciparum
NNKDVLNTYGIDYLSEENNNKN

SEQ ID NO: 3368586 - protein, 21 aa, Plasmodium falciparum
NNKEFCYSLLYISDSLNRFNI

SEQ ID NO: 3368587 - protein, 30 aa, Plasmodium falciparum
NNKEFSLSMVDDLYRNVIIFNDVINSTWKD

SEQ ID NO: 3368588 - protein, 18 aa, Plasmodium falciparum
NNKFDVFSKIVYMENIPE

SEQ ID NO: 3368589 - protein, 22 aa, Plasmodium falciparum
NNKFFKDDVIIIRNTKSEEQEE

SEQ ID NO: 3368590 - protein, 25 aa, Plasmodium falciparum
NNKGMNLDLFLYITKQYKILKNLLT

SEQ ID NO: 3368591 - protein, 26 aa, Plasmodium falciparum
NNKGYNLKMGKGYKVQTITNNNNSNN

SEQ ID NO: 3368592 - protein, 18 aa, Plasmodium falciparum
NNKICKTRVISFNEKDIY

SEQ ID NO: 3368593 - protein, 18 aa, Plasmodium falciparum
NNKIFFYNVHLINDDDLF

SEQ ID NO: 3368594 - protein, 31 aa, Plasmodium falciparum
NNKIIKWMKKIHNLYIMHVYKSYKNDQNGYI

SEQ ID NO: 3368595 - protein, 21 aa, Plasmodium falciparum
NNKIKGFRNINIRIIKKEDEQ

SEQ ID NO: 3368596 - protein, 17 aa, Plasmodium falciparum
NNKIKGRVIDAPLFHSA

SEQ ID NO: 3368597 - protein, 24 aa, Plasmodium falciparum
NNKIKRLSITPSILPLKNKKKYNF

SEQ ID NO: 3368598 - protein, 26 aa, Plasmodium falciparum
NNKIYKYGVIKLADFGFSCQLKNKRQ

SEQ ID NO: 3368599 - protein, 21 aa, Plasmodium falciparum
NNKKIMMDFAKNRNNDLNFNE

SEQ ID NO: 3368600 - protein, 23 aa, Plasmodium falciparum
NNKKKLHSFFIRNKLIYNNNNNS

SEQ ID NO: 3368601 - protein, 21 aa, Plasmodium falciparum
NNKKLLSSRLLKLNTKSNTSA

SEQ ID NO: 3368602 - protein, 18 aa, Plasmodium falciparum
NNKKRKTTSYSMQKEEDP

SEQ ID NO: 3368603 - protein, 26 aa, Plasmodium falciparum
NNKLKIELKKFWDLKEKKKKYEQNKF

SEQ ID NO: 3368604 - protein, 24 aa, Plasmodium falciparum
NNKLTWPLIKAFELCSQPEKEDII

SEQ ID NO: 3368605 - protein, 21 aa, Plasmodium falciparum
NNKMIPAHHIHKDNMNNMNNM

SEQ ID NO: 3368606 - protein, 17 aa, Plasmodium falciparum
NNKNEVLENIWQMYDAV

SEQ ID NO: 3368607 - protein, 25 aa, Plasmodium falciparum
NNKNFYLKFEERFNMNNDRIITNKL

SEQ ID NO: 3368608 - protein, 25 aa, Plasmodium falciparum
NNKNLSVFVKLKYKQDADTFLKKIG

SEQ ID NO: 3368609 - protein, 19 aa, Plasmodium falciparum
NNKQYILWNNRTIEVTFVW

SEQ ID NO: 3368610 - protein, 22 aa, Plasmodium falciparum
NNKREDNSLCLYNDDIEKNSFY

SEQ ID NO: 3368611 - protein, 23 aa, Plasmodium falciparum
NNKREQELFCSDNLKNDSDDIVK

SEQ ID NO: 3368612 - protein, 25 aa, Plasmodium falciparum
NNKRLGTFFFKKAMKLNIFYEYSYI

SEQ ID NO: 3368613 - protein, 19 aa, Plasmodium falciparum
NNKSFGWKNTKKRGSKFDG

SEQ ID NO: 3368614 - protein, 21 aa, Plasmodium falciparum
NNKSRFHVFLSEFKSKYRILL

SEQ ID NO: 3368615 - protein, 20 aa, Plasmodium falciparum
NNKTNKCFTAKNVTLNIEDE

SEQ ID NO: 3368616 - protein, 25 aa, Plasmodium falciparum
NNKVIKNESEFEYLLELSDKEGPNL

SEQ ID NO: 3368617 - protein, 22 aa, Plasmodium falciparum
NNKYNKNGFVYDYNTYYTKKSS

SEQ ID NO: 3368618 - protein, 25 aa, Plasmodium falciparum
NNLALYLKDACLNLGKEKQYTNNLL

SEQ ID NO: 3368619 - protein, 17 aa, Plasmodium falciparum
NNLCGSTNMNNINILNN

SEQ ID NO: 3368620 - protein, 18 aa, Plasmodium falciparum
NNLCRDQNKMYLLNQYNM

SEQ ID NO: 3368621 - protein, 29 aa, Plasmodium falciparum
NNLDFPLRNESISSFCHIKELLTHNKDNK

SEQ ID NO: 3368622 - protein, 17 aa, Plasmodium falciparum
NNLDLSCINKINNNNQM

SEQ ID NO: 3368623 - protein, 23 aa, Plasmodium falciparum
NNLEELWTLLHFLNPQQYTYYET

SEQ ID NO: 3368624 - protein, 25 aa, Plasmodium falciparum
NNLEEVLCGTSLFVVNNIEEEEEYK

SEQ ID NO: 3368625 - protein, 22 aa, Plasmodium falciparum
NNLEPYKSISINNVKRKYKNKS

SEQ ID NO: 3368626 - protein, 17 aa, Plasmodium falciparum
NNLHGMNKFNNVRNLKN

SEQ ID NO: 3368627 - protein, 20 aa, Plasmodium falciparum
NNLIKLCRTIFFTNIIPPLV

SEQ ID NO: 3368628 - protein, 25 aa, Plasmodium falciparum
NNLKEKEYPFFGTIEKNDENVSNKK

SEQ ID NO: 3368629 - protein, 20 aa, Plasmodium falciparum
NNLKIKYPLQNNITLNDQNR

SEQ ID NO: 3368630 - protein, 25 aa, Plasmodium falciparum
NNLKKCFYMCNSCSKKFNYMRCLVK

SEQ ID NO: 3368631 - protein, 24 aa, Plasmodium falciparum
NNLKKKSKQFSVSVYGHENARLFA

SEQ ID NO: 3368632 - protein, 18 aa, Plasmodium falciparum
NNLKLVINKGENEEEEDS

SEQ ID NO: 3368633 - protein, 29 aa, Plasmodium falciparum
NNLKSLGTFRKGGLTWAIYYNNNNKGVNN

SEQ ID NO: 3368634 - protein, 22 aa, Plasmodium falciparum
NNLKVNIIMHFLNFFHLNDMYT

SEQ ID NO: 3368635 - protein, 18 aa, Plasmodium falciparum
NNLLFLYDSDDLIKKDSR

SEQ ID NO: 3368636 - protein, 20 aa, Plasmodium falciparum
NNLLIFCGKVNFGSKKQKEK

SEQ ID NO: 3368637 - protein, 24 aa, Plasmodium falciparum
NNLLKNRLDQLFNINQDLQKHLDT

SEQ ID NO: 3368638 - protein, 17 aa, Plasmodium falciparum
NNLLNIFLSCNSINENF

SEQ ID NO: 3368639 - protein, 18 aa, Plasmodium falciparum
NNLLRYFSNIVKVENYGS

SEQ ID NO: 3368640 - protein, 22 aa, Plasmodium falciparum
NNLMNMNKFKAGKYMKNKGSKN

SEQ ID NO: 3368641 - protein, 18 aa, Plasmodium falciparum
NNLNHFINMNASRNQAYK

SEQ ID NO: 3368642 - protein, 25 aa, Plasmodium falciparum
NNLNLKKYALCIGYIGSQYHGCQGQ

SEQ ID NO: 3368643 - protein, 26 aa, Plasmodium falciparum
NNLNYLIYKYFNTVLYYKNKILQNVL

SEQ ID NO: 3368644 - protein, 17 aa, Plasmodium falciparum
NNLRKKSHIHIRYKYDV

SEQ ID NO: 3368645 - protein, 18 aa, Plasmodium falciparum
NNLRSCLTALFTFKNSYY

SEQ ID NO: 3368646 - protein, 26 aa, Plasmodium falciparum
NNLSCICCARIYLIDKIIKVTSNKIK

SEQ ID NO: 3368647 - protein, 25 aa, Plasmodium falciparum
NNLSDEQKKEWAVKASKINEENFLL

SEQ ID NO: 3368648 - protein, 26 aa, Plasmodium falciparum
NNLSELWSLLNFLLPKIFSSCVDFEK

SEQ ID NO: 3368649 - protein, 27 aa, Plasmodium falciparum
NNLSKAPMFNFDFSKGLLNNNEKEKTL

SEQ ID NO: 3368650 - protein, 17 aa, Plasmodium falciparum
NNLSRAGSYMVRSISSN

SEQ ID NO: 3368651 - protein, 29 aa, Plasmodium falciparum
NNLSSSFCWYLYGCLYKIYKNYDEALKCF

SEQ ID NO: 3368652 - protein, 19 aa, Plasmodium falciparum
NNLYLCFLVTEPFLENEKK

SEQ ID NO: 3368653 - protein, 19 aa, Plasmodium falciparum
NNLYPWYNKICNMTLSSSI

SEQ ID NO: 3368654 - protein, 19 aa, Plasmodium falciparum
NNLYRHGKNSFSCKNIEEA

SEQ ID NO: 3368655 - protein, 25 aa, Plasmodium falciparum
NNMIDCGMNFDILDNNAYKVVEFCF

SEQ ID NO: 3368656 - protein, 33 aa, Plasmodium falciparum
NNMKKYLIQKCGKKNIKKRMDILNQENNNMGIH

SEQ ID NO: 3368657 - protein, 24 aa, Plasmodium falciparum
NNMLKRRKCNVVGEKEKYDEQIFM

SEQ ID NO: 3368658 - protein, 29 aa, Plasmodium falciparum
NNMNKSCIMKRFNKKDVKYNDMLLKADET

SEQ ID NO: 3368659 - protein, 21 aa, Plasmodium falciparum
NNMNLSIGKIDLSNIYMDILH

SEQ ID NO: 3368660 - protein, 23 aa, Plasmodium falciparum
NNMNRLNAVNNFGDINSFHDPLN

SEQ ID NO: 3368661 - protein, 17 aa, Plasmodium falciparum
NNMSCLSIDCCVNPFTI

SEQ ID NO: 3368662 - protein, 23 aa, Plasmodium falciparum
NNMSGTKKLLWRDSDKTGSMSTW

SEQ ID NO: 3368663 - protein, 17 aa, Plasmodium falciparum
NNMYSIGYLCFIGNINN

SEQ ID NO: 3368664 - protein, 17 aa, Plasmodium falciparum
NNNCGFKAHSREQLLIK

SEQ ID NO: 3368665 - protein, 26 aa, Plasmodium falciparum
NNNCVFRVILSYGFKSMHNVLRKIKE

SEQ ID NO: 3368666 - protein, 28 aa, Plasmodium falciparum
NNNDCFGRRPIHFFKHLNKHKVDVPSQT

SEQ ID NO: 3368667 - protein, 27 aa, Plasmodium falciparum
NNNDTFKVYKDIIITLNGPHNYPENTI

SEQ ID NO: 3368668 - protein, 29 aa, Plasmodium falciparum
NNNEIIFHNLLLNLKFFFPSLKNLNIKYT

SEQ ID NO: 3368669 - protein, 24 aa, Plasmodium falciparum
NNNEKRGNLCYIKNVKNMNNLHNN

SEQ ID NO: 3368670 - protein, 25 aa, Plasmodium falciparum
NNNFNSNWIRKLKSFGASSDNEDEN

SEQ ID NO: 3368671 - protein, 36 aa, Plasmodium falciparum
NNNHCDKCNNNIFTGMNMKNMNSVNYIKNRKNMHNN

SEQ ID NO: 3368672 - protein, 18 aa, Plasmodium falciparum
NNNICIMQNEYLGNDRYD

SEQ ID NO: 3368673 - protein, 27 aa, Plasmodium falciparum
NNNIILYKSFDDFKINYSYKTKNHLHE

SEQ ID NO: 3368674 - protein, 23 aa, Plasmodium falciparum
NNNILKDDHHVISNEVNKTKHHK

SEQ ID NO: 3368675 - protein, 24 aa, Plasmodium falciparum
NNNILKKKLEGINKREKKNIEQNK

SEQ ID NO: 3368676 - protein, 17 aa, Plasmodium falciparum
NNNIVHYVDWINQIFKK

SEQ ID NO: 3368677 - protein, 20 aa, Plasmodium falciparum
NNNKCLYKDINQNDHNNSII

SEQ ID NO: 3368678 - protein, 24 aa, Plasmodium falciparum
NNNKEIIHSLNLIENIRQGTFDYK

SEQ ID NO: 3368679 - protein, 24 aa, Plasmodium falciparum
NNNLAFLNSHCILTDKDFQIDSPD

SEQ ID NO: 3368680 - protein, 18 aa, Plasmodium falciparum
NNNLCYCLLKNQIIKKIG

SEQ ID NO: 3368681 - protein, 30 aa, Plasmodium falciparum
NNNLLNEYSCLKGYVFRNFYETRNYNEICS

SEQ ID NO: 3368682 - protein, 22 aa, Plasmodium falciparum
NNNLYVSMYIPFIKKFYDKRFI

SEQ ID NO: 3368683 - protein, 17 aa, Plasmodium falciparum
NNNNCYNYHGYNVMNTK

SEQ ID NO: 3368684 - protein, 24 aa, Plasmodium falciparum
NNNNCYYYYNYVLPYTLNLDKKYI

SEQ ID NO: 3368685 - protein, 22 aa, Plasmodium falciparum
NNNNECIFCSSSNKKLKSYMFN

SEQ ID NO: 3368686 - protein, 23 aa, Plasmodium falciparum
NNNNIYANYVFKQPNEISNGSIL

SEQ ID NO: 3368687 - protein, 26 aa, Plasmodium falciparum
NNNNSICRFISFDYCCNINNMSKKKK

SEQ ID NO: 3368688 - protein, 20 aa, Plasmodium falciparum
NNNNVPLCIPQLDNYNKTKN

SEQ ID NO: 3368689 - protein, 25 aa, Plasmodium falciparum
NNNNYFCIPCGYNTKEYKYNIYNTY

SEQ ID NO: 3368690 - protein, 19 aa, Plasmodium falciparum
NNNSGRHFISFNNISSDTI

SEQ ID NO: 3368691 - protein, 24 aa, Plasmodium falciparum
NNNSLKLICKIKYINNNYQLIPCI

SEQ ID NO: 3368692 - protein, 23 aa, Plasmodium falciparum
NNNTFCYKQGYVPDDTMKTHNET

SEQ ID NO: 3368693 - protein, 25 aa, Plasmodium falciparum
NNNVNMCLMQGPYINNHNMKNFYMG

SEQ ID NO: 3368694 - protein, 28 aa, Plasmodium falciparum
NNNYISCLYCDKYLFKLDNYHEDFFFVC

SEQ ID NO: 3368695 - protein, 24 aa, Plasmodium falciparum
NNPDEECSFIMSLLNEELKQMLME

SEQ ID NO: 3368696 - protein, 20 aa, Plasmodium falciparum
NNPFNLSFNSSREYDYMNLH

SEQ ID NO: 3368697 - protein, 17 aa, Plasmodium falciparum
NNPHYYWIPCFFENIIA

SEQ ID NO: 3368698 - protein, 24 aa, Plasmodium falciparum
NNPICNIPELQNCVIKNLINIKYF

SEQ ID NO: 3368699 - protein, 17 aa, Plasmodium falciparum
NNPINLSTHGSLQKNNV

SEQ ID NO: 3368700 - protein, 25 aa, Plasmodium falciparum
NNPMTRNKIETIFSMSDDEETINYE

SEQ ID NO: 3368701 - protein, 24 aa, Plasmodium falciparum
NNPNKKCNISFNDDFYDSLAQDNF

SEQ ID NO: 3368702 - protein, 29 aa, Plasmodium falciparum
NNPSHRIYKPPVFISKYIKDMNEDELNDI

SEQ ID NO: 3368703 - protein, 20 aa, Plasmodium falciparum
NNQALPMFLVKLYSYQLCRA

SEQ ID NO: 3368704 - protein, 20 aa, Plasmodium falciparum
NNQLFCNQFNPTISGNLQNY

SEQ ID NO: 3368705 - protein, 26 aa, Plasmodium falciparum
NNQLKIKYTKMYQAKVNHITRTSNLN

SEQ ID NO: 3368706 - protein, 19 aa, Plasmodium falciparum
NNQQLIPQMNFVSGANIDM

SEQ ID NO: 3368707 - protein, 28 aa, Plasmodium falciparum
NNQSDCLMKAQLLLKEELDKEIQKKDEI

SEQ ID NO: 3368708 - protein, 20 aa, Plasmodium falciparum
NNRFSEGYILKRDNKLARYN

SEQ ID NO: 3368709 - protein, 20 aa, Plasmodium falciparum
NNRIYNDSGCYVISDDCVIP

SEQ ID NO: 3368710 - protein, 24 aa, Plasmodium falciparum
NNRLKGTICSNLFMNIEEMNNGNL

SEQ ID NO: 3368711 - protein, 19 aa, Plasmodium falciparum
NNRSLSYFYSKKNYNEHFM

SEQ ID NO: 3368712 - protein, 21 aa, Plasmodium falciparum
NNRVNGLLSNRMMKQEIDDDM

SEQ ID NO: 3368713 - protein, 25 aa, Plasmodium falciparum
NNSAELFTLINFMFPDIFKNSEIIE

SEQ ID NO: 3368714 - protein, 44 aa, Plasmodium falciparum
NNSCSIIKYELRKTSICKYWIKGICANVECNFAHGEHELKYTFG

SEQ ID NO: 3368715 - protein, 25 aa, Plasmodium falciparum
NNSFKYPSRSHIFTERFSYHASDEH

SEQ ID NO: 3368716 - protein, 20 aa, Plasmodium falciparum
NNSFNMSSFFSKGANSNDSQ

SEQ ID NO: 3368717 - protein, 18 aa, Plasmodium falciparum
NNSHLFKIQYDNLNISQD

SEQ ID NO: 3368718 - protein, 23 aa, Plasmodium falciparum
NNSHLRIPLCVQESNRNNNVCNI

SEQ ID NO: 3368719 - protein, 23 aa, Plasmodium falciparum
NNSKFNLSCYISMKDYNFNSSIR

SEQ ID NO: 3368720 - protein, 23 aa, Plasmodium falciparum
NNSKLPFGWRVHILLPQDISAKM

SEQ ID NO: 3368721 - protein, 19 aa, Plasmodium falciparum
NNSLFLKNIIKNSSKCIKR

SEQ ID NO: 3368722 - protein, 21 aa, Plasmodium falciparum
NNSLISCSNFWNCTEDELSTS

SEQ ID NO: 3368723 - protein, 25 aa, Plasmodium falciparum
NNSMKLYAYNSHNLFQPDNNKNTSN

SEQ ID NO: 3368724 - protein, 17 aa, Plasmodium falciparum
NNSNCAIFLDLLKALIL

SEQ ID NO: 3368725 - protein, 28 aa, Plasmodium falciparum
NNSNRPVVRKVIKRVIRTRVKNKKDETN

SEQ ID NO: 3368726 - protein, 24 aa, Plasmodium falciparum
NNSPHCQKDLSLIESIQALTDITS

SEQ ID NO: 3368727 - protein, 28 aa, Plasmodium falciparum
NNSRGGGGGKCYGILKGEGDQFSIKYYS

SEQ ID NO: 3368728 - protein, 24 aa, Plasmodium falciparum
NNSSLPYANEWLFDKIKEILDPSI

SEQ ID NO: 3368729 - protein, 24 aa, Plasmodium falciparum
NNSSRICTISNLLNENSSMYNKNE

SEQ ID NO: 3368730 - protein, 30 aa, Plasmodium falciparum
NNSSVLYDEYRVHAEEYGLMKVHRNNDTSQ

SEQ ID NO: 3368731 - protein, 21 aa, Plasmodium falciparum
NNSVCSIGLYVKCGSRYEEIN

SEQ ID NO: 3368732 - protein, 23 aa, Plasmodium falciparum
NNSYCSRNLFNFNNLNIDLLNNI

SEQ ID NO: 3368733 - protein, 19 aa, Plasmodium falciparum
NNSYDCFILSLSLMNTDWP

SEQ ID NO: 3368734 - protein, 32 aa, Plasmodium falciparum
NNSYDCGIYIIQFILHLCLNKHLVERDLINPY

SEQ ID NO: 3368735 - protein, 24 aa, Plasmodium falciparum
NNTCKLKILDVIKKFSQLKEKIKK

SEQ ID NO: 3368736 - protein, 23 aa, Plasmodium falciparum
NNTIKRKIIFSNIYKNYLINKYK

SEQ ID NO: 3368737 - protein, 22 aa, Plasmodium falciparum
NNTLWKKQQRNMMNEKKTTMYN

SEQ ID NO: 3368738 - protein, 18 aa, Plasmodium falciparum
NNTNHLFNTNINLYEKKN

SEQ ID NO: 3368739 - protein, 17 aa, Plasmodium falciparum
NNTPFVFSLLLDNIEKG

SEQ ID NO: 3368740 - protein, 20 aa, Plasmodium falciparum
NNTPLFLSFNIRINILVQII

SEQ ID NO: 3368741 - protein, 26 aa, Plasmodium falciparum
NNTSMKKYFCRSRYSKLIEVESTSAM

SEQ ID NO: 3368742 - protein, 22 aa, Plasmodium falciparum
NNTSRNMNCIVRSENCLLGSDK

SEQ ID NO: 3368743 - protein, 18 aa, Plasmodium falciparum
NNTYFICSNLNMMDSLKE

SEQ ID NO: 3368744 - protein, 21 aa, Plasmodium falciparum
NNVFLKARYSCLIEQNQYDKI

SEQ ID NO: 3368745 - protein, 25 aa, Plasmodium falciparum
NNVGKLKFSLILVEILTNECIKYRH

SEQ ID NO: 3368746 - protein, 24 aa, Plasmodium falciparum
NNVGMFECKLCLTLHNNESSYLCH

SEQ ID NO: 3368747 - protein, 17 aa, Plasmodium falciparum
NNVKGNMYITNRFLIYI

SEQ ID NO: 3368748 - protein, 24 aa, Plasmodium falciparum
NNVKVSDRFNGFLTNNKKPVIPNM

SEQ ID NO: 3368749 - protein, 19 aa, Plasmodium falciparum
NNVNSLNHMNCLNHMNNNN

SEQ ID NO: 3368750 - protein, 36 aa, Plasmodium falciparum
NNVPKKKVEKMKWTILSERKIDKLVDIMKGEEKNIN

SEQ ID NO: 3368751 - protein, 18 aa, Plasmodium falciparum
NNVPYNYNVRNIEDSSSC

SEQ ID NO: 3368752 - protein, 26 aa, Plasmodium falciparum
NNVVLLKTSLNYKGIINADKKMEQAN

SEQ ID NO: 3368753 - protein, 25 aa, Plasmodium falciparum
NNVYDHICDIINFIVVEKPEKSYEN

SEQ ID NO: 3368754 - protein, 42 aa, Plasmodium falciparum
NNVYELKNEYIFVYRCNICLLLFTCVYTFAEHIISENHRVKQ

SEQ ID NO: 3368755 - protein, 17 aa, Plasmodium falciparum
NNVYIKHHIKNHMNNSS

SEQ ID NO: 3368756 - protein, 33 aa, Plasmodium falciparum
NNVYKLTYKHIFKYKRISSISTDEVDYVINEEI

SEQ ID NO: 3368757 - protein, 19 aa, Plasmodium falciparum
NNWQYKIDMNILKKIADIN

SEQ ID NO: 3368758 - protein, 25 aa, Plasmodium falciparum
NNYDVCGNDVGFAKSNIMNVNLENY

SEQ ID NO: 3368759 - protein, 18 aa, Plasmodium falciparum
NNYEGIPVVEVQDDEYYE

SEQ ID NO: 3368760 - protein, 18 aa, Plasmodium falciparum
NNYFPSQSILRCDKTKNT

SEQ ID NO: 3368761 - protein, 17 aa, Plasmodium falciparum
NNYIYSNEIFNIIKKLQ

SEQ ID NO: 3368762 - protein, 30 aa, Plasmodium falciparum
NNYKEFLRRYLLCFFCCTDLNNCVSLLNMP

SEQ ID NO: 3368763 - protein, 25 aa, Plasmodium falciparum
NNYKLKFCLEKEILDNTIQHNELKK

SEQ ID NO: 3368764 - protein, 23 aa, Plasmodium falciparum
NNYLCLYNQIKFMNIKKDLFFFK

SEQ ID NO: 3368765 - protein, 20 aa, Plasmodium falciparum
NNYLKENVCLENDKEYNKCY

SEQ ID NO: 3368766 - protein, 27 aa, Plasmodium falciparum
NNYLKLRNYIIPKNMYTISCDHKNDNI

SEQ ID NO: 3368767 - protein, 21 aa, Plasmodium falciparum
NNYRINKCIYKKKNCDNKINL

SEQ ID NO: 3368768 - protein, 21 aa, Plasmodium falciparum
NNYRKGIWVKYKNIHNLFYFM

SEQ ID NO: 3368769 - protein, 33 aa, Plasmodium falciparum
NNYSDNMLLRSSIKNGPKYSVHYPSSSNNQDTT

SEQ ID NO: 3368770 - protein, 31 aa, Plasmodium falciparum
NNYSIPLFFRIIFLSCYFEFLNNEENEKKNN

SEQ ID NO: 3368771 - protein, 22 aa, Plasmodium falciparum
NNYSLKEAINFIENENNVVKYN

SEQ ID NO: 3368772 - protein, 19 aa, Plasmodium falciparum
NNYTSLYVEHLFNDKKENI

SEQ ID NO: 3368773 - protein, 26 aa, Plasmodium falciparum
NNYYLKCCIYYIKRLFMSIENFDNDS

SEQ ID NO: 3368774 - protein, 24 aa, Plasmodium falciparum
NPAPSIPIKLFVSSIPKNLTEEDI

SEQ ID NO: 3368775 - protein, 22 aa, Plasmodium falciparum
NPCEKNRFPHYYTHNNNGANNF

SEQ ID NO: 3368776 - protein, 27 aa, Plasmodium falciparum
NPDRVKSCLITAIFKLCSRNNIRDHVV

SEQ ID NO: 3368777 - protein, 17 aa, Plasmodium falciparum
NPDWVSVNHGIFLCINC

SEQ ID NO: 3368778 - protein, 21 aa, Plasmodium falciparum
NPEAMDSCIYISLDYFKENLI

SEQ ID NO: 3368779 - protein, 24 aa, Plasmodium falciparum
NPEFPFKKLNIEKIEKIRKSVSLC

SEQ ID NO: 3368780 - protein, 21 aa, Plasmodium falciparum
NPEIPIKSVHLNNNQYVNNNH

SEQ ID NO: 3368781 - protein, 23 aa, Plasmodium falciparum
NPERKIKIKINRSSEFRKNDYCF

SEQ ID NO: 3368782 - protein, 22 aa, Plasmodium falciparum
NPFEVNCLIAGYDKKDGYQLYW

SEQ ID NO: 3368783 - protein, 17 aa, Plasmodium falciparum
NPFHHRGSYLTSYENQK

SEQ ID NO: 3368784 - protein, 19 aa, Plasmodium falciparum
NPFKRFFKIGLNVTLSTDD

SEQ ID NO: 3368785 - protein, 23 aa, Plasmodium falciparum
NPFLSVFNFNSLILANTITDIQK

SEQ ID NO: 3368786 - protein, 33 aa, Plasmodium falciparum
NPGFQKRLLEAYSNIFLHFDIFIDNKTYNFIFN

SEQ ID NO: 3368787 - protein, 21 aa, Plasmodium falciparum
NPHTCPYIFCSWQCLSNNIKI

SEQ ID NO: 3368788 - protein, 23 aa, Plasmodium falciparum
NPIICLYCACLYNYKEKYETALL

SEQ ID NO: 3368789 - protein, 18 aa, Plasmodium falciparum
NPILLRRINNKNEVLENI

SEQ ID NO: 3368790 - protein, 23 aa, Plasmodium falciparum
NPIPAECNLSIYVNVVNQYDSHY

SEQ ID NO: 3368791 - protein, 17 aa, Plasmodium falciparum
NPIPAISTGGTFNSNIF

SEQ ID NO: 3368792 - protein, 19 aa, Plasmodium falciparum
NPKDNLGLELKRDGTYLSD

SEQ ID NO: 3368793 - protein, 22 aa, Plasmodium falciparum
NPLFLCKVLITLGEGILVQHPY

SEQ ID NO: 3368794 - protein, 19 aa, Plasmodium falciparum
NPLIYDISELYNREKNEEQ

SEQ ID NO: 3368795 - protein, 19 aa, Plasmodium falciparum
NPLLECFGNAKTIKNDNSS

SEQ ID NO: 3368796 - protein, 19 aa, Plasmodium falciparum
NPMLQRQKIIWRKWIAKNL

SEQ ID NO: 3368797 - protein, 18 aa, Plasmodium falciparum
NPNAPPCVGNMNNLNNIN

SEQ ID NO: 3368798 - protein, 18 aa, Plasmodium falciparum
NPNIFDGYMEKVLYTGKE

SEQ ID NO: 3368799 - protein, 26 aa, Plasmodium falciparum
NPNLLREFMRPEILQAGLQIENALNM

SEQ ID NO: 3368800 - protein, 25 aa, Plasmodium falciparum
NPNVPTVHMNFRFFQIFIKTGKKKK

SEQ ID NO: 3368801 - protein, 25 aa, Plasmodium falciparum
NPNYRPTRRNILSALMWLTRDNKPG

SEQ ID NO: 3368802 - protein, 29 aa, Plasmodium falciparum
NPNYSPEIYARCCVIDFTVTVKGLEDQLL

SEQ ID NO: 3368803 - protein, 18 aa, Plasmodium falciparum
NPPEVLRNTGPMTEKIDN

SEQ ID NO: 3368804 - protein, 32 aa, Plasmodium falciparum
NPPLSISFLPYFNLSMLWQLAEDFGVYNEALK

SEQ ID NO: 3368805 - protein, 19 aa, Plasmodium falciparum
NPPRKGCGKVFRRWIRGLC

SEQ ID NO: 3368806 - protein, 18 aa, Plasmodium falciparum
NPQGPFSIDIMIKNNRLI

SEQ ID NO: 3368807 - protein, 26 aa, Plasmodium falciparum
NPRTNEMVLKKCIQAISVSKEIIDSV

SEQ ID NO: 3368808 - protein, 17 aa, Plasmodium falciparum
NPSCTNKSIGYITCVHL

SEQ ID NO: 3368809 - protein, 17 aa, Plasmodium falciparum
NPSISRFHCVLYMCEDF

SEQ ID NO: 3368810 - protein, 27 aa, Plasmodium falciparum
NPSSRLLKHIVRCYLRLSENARALEAL

SEQ ID NO: 3368811 - protein, 23 aa, Plasmodium falciparum
NPSYMCNNCFDLFLMDKNNQPID

SEQ ID NO: 3368812 - protein, 24 aa, Plasmodium falciparum
NPWGCIRWKGRYSHNDYETWTKEL

SEQ ID NO: 3368813 - protein, 27 aa, Plasmodium falciparum
NPYEFFIAYNYIEWDGKYVFDFFELLN

SEQ ID NO: 3368814 - protein, 21 aa, Plasmodium falciparum
NPYICFLLYIHDDFIFTNNSE

SEQ ID NO: 3368815 - protein, 48 aa, Plasmodium falciparum
NQASRLPKLQGMFFDKRRNYWTVSVCGFRKSFGVRTRGVYQAYKLAAE

SEQ ID NO: 3368816 - protein, 21 aa, Plasmodium falciparum
NQDDLYCPYNNVNAANNNNNN

SEQ ID NO: 3368817 - protein, 18 aa, Plasmodium falciparum
NQEMFIIKLIEDHKNLNK

SEQ ID NO: 3368818 - protein, 19 aa, Plasmodium falciparum
NQFLFDNKFRFLLYELQQL

SEQ ID NO: 3368819 - protein, 26 aa, Plasmodium falciparum
NQFLKLVYFMDNFIPFSIYFNIFLNK

SEQ ID NO: 3368820 - protein, 17 aa, Plasmodium falciparum
NQFLYNFYTNDDVIYIK

SEQ ID NO: 3368821 - protein, 17 aa, Plasmodium falciparum
NQFMIKTFIQGFLTISL

SEQ ID NO: 3368822 - protein, 18 aa, Plasmodium falciparum
NQFPLLICLDQFNYNLSV

SEQ ID NO: 3368823 - protein, 22 aa, Plasmodium falciparum
NQFSKHHIDYIITKENLMVMNK

SEQ ID NO: 3368824 - protein, 17 aa, Plasmodium falciparum
NQHKNCNDQFMKIEGDN

SEQ ID NO: 3368825 - protein, 19 aa, Plasmodium falciparum
NQHKYSFKINSYYSKEIVI

SEQ ID NO: 3368826 - protein, 17 aa, Plasmodium falciparum
NQHLENIVSVRKNFESK

SEQ ID NO: 3368827 - protein, 24 aa, Plasmodium falciparum
NQIIKRTLSCIPYILNNNRGAFYK

SEQ ID NO: 3368828 - protein, 24 aa, Plasmodium falciparum
NQIPNRRFTLWWSPTINRANVYVG

SEQ ID NO: 3368829 - protein, 24 aa, Plasmodium falciparum
NQIYKKQILHFIVKKIIQELTNIN

SEQ ID NO: 3368830 - protein, 17 aa, Plasmodium falciparum
NQIYNFKINNGITKNMN

SEQ ID NO: 3368831 - protein, 24 aa, Plasmodium falciparum
NQKENYYEWMLPTIYNKDDDIQSD

SEQ ID NO: 3368832 - protein, 27 aa, Plasmodium falciparum
NQKLNIIYFLCKFHFYNETIKKFYLQV

SEQ ID NO: 3368833 - protein, 18 aa, Plasmodium falciparum
NQKLTACYLKLKEYALAI

SEQ ID NO: 3368834 - protein, 23 aa, Plasmodium falciparum
NQKRLLTQITPYDYRVVLNSNFC

SEQ ID NO: 3368835 - protein, 17 aa, Plasmodium falciparum
NQKRLNQYFTIVANSIK

SEQ ID NO: 3368836 - protein, 19 aa, Plasmodium falciparum
NQLDFLLNLLILEKKNLNT

SEQ ID NO: 3368837 - protein, 17 aa, Plasmodium falciparum
NQLGILFELSFPNIKEN

SEQ ID NO: 3368838 - protein, 31 aa, Plasmodium falciparum
NQLHYDIIIIYNFLFYGAFTIYSNKEYFNFY

SEQ ID NO: 3368839 - protein, 23 aa, Plasmodium falciparum
NQLICVLENGYIYKINKKDQNVI

SEQ ID NO: 3368840 - protein, 49 aa, Plasmodium falciparum
NQLKADKYTCMMRKLRGILNKLTFEKFDLLYEQIILVGITKLDEIIGLM

SEQ ID NO: 3368841 - protein, 19 aa, Plasmodium falciparum
NQLKKANCILNKNNRALEI

SEQ ID NO: 3368842 - protein, 24 aa, Plasmodium falciparum
NQLLLKRKMINSFLKNGNDKLNIN

SEQ ID NO: 3368843 - protein, 25 aa, Plasmodium falciparum
NQLNKEYYFYGGFDLEEIYNIIYDS

SEQ ID NO: 3368844 - protein, 18 aa, Plasmodium falciparum
NQLTNLKGLSVFKNLKVL

SEQ ID NO: 3368845 - protein, 18 aa, Plasmodium falciparum
NQMDNFKIDLDFYQVHNS

SEQ ID NO: 3368846 - protein, 26 aa, Plasmodium falciparum
NQNGKYVHDKECFKNDEYIFKNSKNL

SEQ ID NO: 3368847 - protein, 24 aa, Plasmodium falciparum
NQNIKFKKDIDVLTEDKKNILIQN

SEQ ID NO: 3368848 - protein, 29 aa, Plasmodium falciparum
NQNKLIRKYRCLINNPFVFVKNEMDNSII

SEQ ID NO: 3368849 - protein, 19 aa, Plasmodium falciparum
NQNKQLDHCISKKHNSLLI

SEQ ID NO: 3368850 - protein, 25 aa, Plasmodium falciparum
NQNLEFQKKFILHKMNDYFKNINAT

SEQ ID NO: 3368851 - protein, 17 aa, Plasmodium falciparum
NQNNFYVRYGLPVECHV

SEQ ID NO: 3368852 - protein, 24 aa, Plasmodium falciparum
NQNNYYLHYGFISDLYNRTHSHDN

SEQ ID NO: 3368853 - protein, 25 aa, Plasmodium falciparum
NQPFPVKREDLFYTISIYVPSCNSN

SEQ ID NO: 3368854 - protein, 18 aa, Plasmodium falciparum
NQPLSMTMNQPFNHPALY

SEQ ID NO: 3368855 - protein, 20 aa, Plasmodium falciparum
NQPQCPLQSFGKVLKVKDLR

SEQ ID NO: 3368856 - protein, 25 aa, Plasmodium falciparum
NQQIPRWFLNLVMKHTASARANRNY

SEQ ID NO: 3368857 - protein, 19 aa, Plasmodium falciparum
NQRKIFFPLHVYVINTKQN

SEQ ID NO: 3368858 - protein, 23 aa, Plasmodium falciparum
NQSCLLLCQLHCTIVSRQHEIAD

SEQ ID NO: 3368859 - protein, 28 aa, Plasmodium falciparum
NQSHEMEARLLLIVCNKMNQPFDVKMHI

SEQ ID NO: 3368860 - protein, 21 aa, Plasmodium falciparum
NQTMEAWRCLYHLDKCFMNET

SEQ ID NO: 3368861 - protein, 22 aa, Plasmodium falciparum
NQTPLIKHQKFYYAENSNNNYL

SEQ ID NO: 3368862 - protein, 17 aa, Plasmodium falciparum
NQYAYINNFYHIYHNNS

SEQ ID NO: 3368863 - protein, 26 aa, Plasmodium falciparum
NQYSIKFVPRHLLYVMSQVASRSFFD

SEQ ID NO: 3368864 - protein, 25 aa, Plasmodium falciparum
NQYSSCIFKSLKFLSEPTCQKLIAE

SEQ ID NO: 3368865 - protein, 17 aa, Plasmodium falciparum
NRALANIMYKHKFIQNV

SEQ ID NO: 3368866 - protein, 27 aa, Plasmodium falciparum
NRAPSTLFCCLYKFFTMQLSEKQLKSL

SEQ ID NO: 3368867 - protein, 26 aa, Plasmodium falciparum
NRDEAVNAIKCLNNKIILSGAHKPLE

SEQ ID NO: 3368868 - protein, 22 aa, Plasmodium falciparum
NRDEKVISCNENFVHKENNIII

SEQ ID NO: 3368869 - protein, 19 aa, Plasmodium falciparum
NRDFNVLAEFHLNLRKTLE

SEQ ID NO: 3368870 - protein, 26 aa, Plasmodium falciparum
NREKTCPFLLRLFYKVDKEYNVDDMD

SEQ ID NO: 3368871 - protein, 17 aa, Plasmodium falciparum
NREKYFMTVNFTRNKPI

SEQ ID NO: 3368872 - protein, 19 aa, Plasmodium falciparum
NRELKRWVGDNDIVDETKL

SEQ ID NO: 3368873 - protein, 17 aa, Plasmodium falciparum
NRFIHTYNMLFINIFYN

SEQ ID NO: 3368874 - protein, 21 aa, Plasmodium falciparum
NRFLWLPILYTFVLPFRSGKV

SEQ ID NO: 3368875 - protein, 17 aa, Plasmodium falciparum
NRFRLNVQNFFVYMLEK

SEQ ID NO: 3368876 - protein, 20 aa, Plasmodium falciparum
NRGKNMKKLIGEDLEKDEQF

SEQ ID NO: 3368877 - protein, 17 aa, Plasmodium falciparum
NRGQNGISITKNYEPNL

SEQ ID NO: 3368878 - protein, 20 aa, Plasmodium falciparum
NRHFIKCIKITLKETKGVYG

SEQ ID NO: 3368879 - protein, 28 aa, Plasmodium falciparum
NRHWNVDLIPKFILVGGNLVKILKKTRV

SEQ ID NO: 3368880 - protein, 23 aa, Plasmodium falciparum
NRICQSRISPLGIKDSIKKDEKN

SEQ ID NO: 3368881 - protein, 20 aa, Plasmodium falciparum
NRIFIAGTFSGHIYVFNSSY

SEQ ID NO: 3368882 - protein, 24 aa, Plasmodium falciparum
NRIINCPIKLIPLLYENVYEDILW

SEQ ID NO: 3368883 - protein, 19 aa, Plasmodium falciparum
NRIIYKKKHPMFFNNIHTM

SEQ ID NO: 3368884 - protein, 22 aa, Plasmodium falciparum
NRIKDTCKYEYNIYNNKYIELK

SEQ ID NO: 3368885 - protein, 23 aa, Plasmodium falciparum
NRIKFSPNVFIFFEVENLKNCTP

SEQ ID NO: 3368886 - protein, 24 aa, Plasmodium falciparum
NRIKKLPKLFGIPIVIKDNIITKG

SEQ ID NO: 3368887 - protein, 18 aa, Plasmodium falciparum
NRILISIGNILKGFHPLL

SEQ ID NO: 3368888 - protein, 17 aa, Plasmodium falciparum
NRILRKFDESVINVLEN

SEQ ID NO: 3368889 - protein, 23 aa, Plasmodium falciparum
NRINDDQCCIIEFPSDEASGKLF

SEQ ID NO: 3368890 - protein, 26 aa, Plasmodium falciparum
NRINLFKIKNLICLKNYNDFKKYEDA

SEQ ID NO: 3368891 - protein, 20 aa, Plasmodium falciparum
NRINNIFPIDSLKFKDNLTD

SEQ ID NO: 3368892 - protein, 18 aa, Plasmodium falciparum
NRINNLCNYDEQLCNILN

SEQ ID NO: 3368893 - protein, 40 aa, Plasmodium falciparum
NRIYEKRYTPIYINKYEWCGLKLKDIRNMLNEDFNYDGND

SEQ ID NO: 3368894 - protein, 21 aa, Plasmodium falciparum
NRKFLWKGMKILLSAKFAQDQ

SEQ ID NO: 3368895 - protein, 22 aa, Plasmodium falciparum
NRKIQLKPVDFIIVNDKVIVTK

SEQ ID NO: 3368896 - protein, 24 aa, Plasmodium falciparum
NRKIYKSIFWYQFLNENEELLVAR

SEQ ID NO: 3368897 - protein, 18 aa, Plasmodium falciparum
NRKKGLRDMSTYADKVLE

SEQ ID NO: 3368898 - protein, 26 aa, Plasmodium falciparum
NRKPTRFLCLILKLLQIQPDKDIIYE

SEQ ID NO: 3368899 - protein, 20 aa, Plasmodium falciparum
NRLDRECCCFIEDEELFSSD

SEQ ID NO: 3368900 - protein, 22 aa, Plasmodium falciparum
NRLKKGISILTCTPGRLLDHLE

SEQ ID NO: 3368901 - protein, 26 aa, Plasmodium falciparum
NRLKLIWKETPFLYLIIQKFHLNKII

SEQ ID NO: 3368902 - protein, 20 aa, Plasmodium falciparum
NRLRNLMSIGNMTNEKVYSE

SEQ ID NO: 3368903 - protein, 19 aa, Plasmodium falciparum
NRLTLNLLKLEKKKLKRKR

SEQ ID NO: 3368904 - protein, 17 aa, Plasmodium falciparum
NRMKITILEDKLFKNEK

SEQ ID NO: 3368905 - protein, 17 aa, Plasmodium falciparum
NRMKYYGVILFSSNLIY

SEQ ID NO: 3368906 - protein, 21 aa, Plasmodium falciparum
NRMMKSNVLVVGLSGINIELC

SEQ ID NO: 3368907 - protein, 18 aa, Plasmodium falciparum
NRMSNSMNNMYDLKHKNY

SEQ ID NO: 3368908 - protein, 18 aa, Plasmodium falciparum
NRMYGMATSSNIKEHPVD

SEQ ID NO: 3368909 - protein, 21 aa, Plasmodium falciparum
NRNDFSYYLNIKDGNKIEDDN

SEQ ID NO: 3368910 - protein, 23 aa, Plasmodium falciparum
NRNKRLLQIGLFDHLRKAKDALE

SEQ ID NO: 3368911 - protein, 19 aa, Plasmodium falciparum
NRNLMKFIQTIPLKNDVTG

SEQ ID NO: 3368912 - protein, 24 aa, Plasmodium falciparum
NRNRRLTTCLPIEQKTFINSYHMN

SEQ ID NO: 3368913 - protein, 19 aa, Plasmodium falciparum
NRNSFLFPKDVIYKRIYNE

SEQ ID NO: 3368914 - protein, 19 aa, Plasmodium falciparum
NRNSIKIFKYDRNVKDEEN

SEQ ID NO: 3368915 - protein, 20 aa, Plasmodium falciparum
NRNTMDLAILSKVGAESGPT

SEQ ID NO: 3368916 - protein, 17 aa, Plasmodium falciparum
NRNVNSFLDIPKELWEE

SEQ ID NO: 3368917 - protein, 23 aa, Plasmodium falciparum
NRRKRGAGQKGVFSDEEGMKMDN

SEQ ID NO: 3368918 - protein, 28 aa, Plasmodium falciparum
NRRKSNAKLCIRYNMGNNGLNLLLNMFE

SEQ ID NO: 3368919 - protein, 30 aa, Plasmodium falciparum
NRRNMQRIDIFNMILMRDMLSNLDENNVSF

SEQ ID NO: 3368920 - protein, 18 aa, Plasmodium falciparum
NRSFEVQEIFGIEKSPET

SEQ ID NO: 3368921 - protein, 23 aa, Plasmodium falciparum
NRSIKRRLSQILDNMKKKKIYKM

SEQ ID NO: 3368922 - protein, 20 aa, Plasmodium falciparum
NRSLRLKFPWAMFATKNFTF

SEQ ID NO: 3368923 - protein, 26 aa, Plasmodium falciparum
NRSPGCLSLKSAGSCISSTSSCYKNV

SEQ ID NO: 3368924 - protein, 21 aa, Plasmodium falciparum
NRSQSIIIFTSFIEKMKRNNI

SEQ ID NO: 3368925 - protein, 25 aa, Plasmodium falciparum
NRSSFLWSTLWKYFNTLKEERQKKY

SEQ ID NO: 3368926 - protein, 26 aa, Plasmodium falciparum
NRSYDSYFFNRYCINADKFNYDIIKD

SEQ ID NO: 3368927 - protein, 17 aa, Plasmodium falciparum
NRSYPRVSMSVRNDTFN

SEQ ID NO: 3368928 - protein, 19 aa, Plasmodium falciparum
NRSYSYNFVHTLKKYIILR

SEQ ID NO: 3368929 - protein, 29 aa, Plasmodium falciparum
NRSYTSFLMNIGSSYLKKKKTAEIKTGEN

SEQ ID NO: 3368930 - protein, 22 aa, Plasmodium falciparum
NRTKRMRNLLTLNSENALEMMI

SEQ ID NO: 3368931 - protein, 19 aa, Plasmodium falciparum
NRTLWKMLTNYIIQTYSES

SEQ ID NO: 3368932 - protein, 24 aa, Plasmodium falciparum
NRTLYKKKLFCIILQNHTKYEHIF

SEQ ID NO: 3368933 - protein, 20 aa, Plasmodium falciparum
NRTWNCNNISSMNNMIISTN

SEQ ID NO: 3368934 - protein, 21 aa, Plasmodium falciparum
NRVKCWDLEYNKVIRDYHGHL

SEQ ID NO: 3368935 - protein, 22 aa, Plasmodium falciparum
NRYDKWITMRFAHQLIEATRNL

SEQ ID NO: 3368936 - protein, 17 aa, Plasmodium falciparum
NRYEIMKKIGRGKYSEV

SEQ ID NO: 3368937 - protein, 21 aa, Plasmodium falciparum
NRYKKILALLHKNKLTLNVGL

SEQ ID NO: 3368938 - protein, 24 aa, Plasmodium falciparum
NRYRLDKPLAQYFHIFTKVRQKFE

SEQ ID NO: 3368939 - protein, 33 aa, Plasmodium falciparum
NRYVKNILFDFFKHKNVDTFSKKSIQRLIVISA

SEQ ID NO: 3368940 - protein, 26 aa, Plasmodium falciparum
NRYVKSLQKSKCFELININYYKGDIK

SEQ ID NO: 3368941 - protein, 17 aa, Plasmodium falciparum
NSAEVLNTLALRYEKNY

SEQ ID NO: 3368942 - protein, 21 aa, Plasmodium falciparum
NSAKILLKRKKLYEQEIENIL

SEQ ID NO: 3368943 - protein, 17 aa, Plasmodium falciparum
NSAKKYIPMVWSFIMHK

SEQ ID NO: 3368944 - protein, 27 aa, Plasmodium falciparum
NSAYTCEKICKFFHIITNTKNIEEKYN

SEQ ID NO: 3368945 - protein, 20 aa, Plasmodium falciparum
NSCGVAGGSMDSHYNTANSL

SEQ ID NO: 3368946 - protein, 25 aa, Plasmodium falciparum
NSDFIQYVFKWGIGNKFRSDPENRY

SEQ ID NO: 3368947 - protein, 24 aa, Plasmodium falciparum
NSDMSFCKNTQLANNSNVYDKKCD

SEQ ID NO: 3368948 - protein, 26 aa, Plasmodium falciparum
NSDRCVPASLILTCIPIPPPCARPYV

SEQ ID NO: 3368949 - protein, 28 aa, Plasmodium falciparum
NSDVKRMSNFNIHRDGMYLKDEQNTVTQ

SEQ ID NO: 3368950 - protein, 26 aa, Plasmodium falciparum
NSELSLSDLYTFLFFIYENSNFMCLN

SEQ ID NO: 3368951 - protein, 18 aa, Plasmodium falciparum
NSFICNNIFHKRRPSNIL

SEQ ID NO: 3368952 - protein, 20 aa, Plasmodium falciparum
NSFIILWKINETSFLDPIKK

SEQ ID NO: 3368953 - protein, 33 aa, Plasmodium falciparum
NSFIKRRLYTCNPRKLMMCEYLIKYHEQNNDKI

SEQ ID NO: 3368954 - protein, 24 aa, Plasmodium falciparum
NSFKRPLSNTNICYKDKDDKIKNG

SEQ ID NO: 3368955 - protein, 17 aa, Plasmodium falciparum
NSFLKNSNFLFDDMDKY

SEQ ID NO: 3368956 - protein, 24 aa, Plasmodium falciparum
NSFLKSRNGLPLSEHSSNENNITN

SEQ ID NO: 3368957 - protein, 24 aa, Plasmodium falciparum
NSFLNEIGACFKWHMENKKKKKSE

SEQ ID NO: 3368958 - protein, 25 aa, Plasmodium falciparum
NSFLRFPKFHKILLDVPCSTDEHLI

SEQ ID NO: 3368959 - protein, 22 aa, Plasmodium falciparum
NSFLSNSLFPLLNKLQLPQTNK

SEQ ID NO: 3368960 - protein, 19 aa, Plasmodium falciparum
NSFNDSFSLFRSECNKRIS

SEQ ID NO: 3368961 - protein, 21 aa, Plasmodium falciparum
NSFNVPSNWLLDGNTTNLNLT

SEQ ID NO: 3368962 - protein, 19 aa, Plasmodium falciparum
NSFQYWKINSLSFYEKYMN

SEQ ID NO: 3368963 - protein, 25 aa, Plasmodium falciparum
NSFSKDCICLYSLIHARFITTPKGL

SEQ ID NO: 3368964 - protein, 27 aa, Plasmodium falciparum
NSFYQNRHIYFDAIFNSYFLKDILQNG

SEQ ID NO: 3368965 - protein, 17 aa, Plasmodium falciparum
NSGHIFNSNINRSNIFN

SEQ ID NO: 3368966 - protein, 19 aa, Plasmodium falciparum
NSGVIRAKFKTHIPPKAFG

SEQ ID NO: 3368967 - protein, 25 aa, Plasmodium falciparum
NSHCLKQYESIILPRDINIEQQKNT

SEQ ID NO: 3368968 - protein, 21 aa, Plasmodium falciparum
NSHINNYFCYGSINKRVDENL

SEQ ID NO: 3368969 - protein, 25 aa, Plasmodium falciparum
NSHMKLPYTNNMCPHPGRRSIYNHF

SEQ ID NO: 3368970 - protein, 33 aa, Plasmodium falciparum
NSIDLYKKKIDMLNLKFLKLKNEYTHANNENII

SEQ ID NO: 3368971 - protein, 25 aa, Plasmodium falciparum
NSIFDYNLKLCFNQNYLFGYCYGTG

SEQ ID NO: 3368972 - protein, 25 aa, Plasmodium falciparum
NSIFQFLFLLSRIHYNLKILCYHNR

SEQ ID NO: 3368973 - protein, 19 aa, Plasmodium falciparum
NSIFSKYPLIRCICEEEGI

SEQ ID NO: 3368974 - protein, 21 aa, Plasmodium falciparum
NSIHFTNLFYSFAKFKPDYVQ

SEQ ID NO: 3368975 - protein, 26 aa, Plasmodium falciparum
NSILLKKILKMKIESMKKEKEDIKEK

SEQ ID NO: 3368976 - protein, 24 aa, Plasmodium falciparum
NSINEMKNGCLINDNNIGTNNILN

SEQ ID NO: 3368977 - protein, 21 aa, Plasmodium falciparum
NSINFLLCLSSEMKNISRTHY

SEQ ID NO: 3368978 - protein, 17 aa, Plasmodium falciparum
NSINRINSVNSINSVNS

SEQ ID NO: 3368979 - protein, 19 aa, Plasmodium falciparum
NSIPNFNFHIDLFNKQTKN

SEQ ID NO: 3368980 - protein, 21 aa, Plasmodium falciparum
NSIPSHIYVCLYYVNDENSNL

SEQ ID NO: 3368981 - protein, 22 aa, Plasmodium falciparum
NSIRYILKRHISHIKRNKYKKR

SEQ ID NO: 3368982 - protein, 17 aa, Plasmodium falciparum
NSISSFTAFSRLILILR

SEQ ID NO: 3368983 - protein, 23 aa, Plasmodium falciparum
NSISYGRMAYFLVFDLTNPSTFE

SEQ ID NO: 3368984 - protein, 25 aa, Plasmodium falciparum
NSITLRNSFFLSFAEYIYESIDSYN

SEQ ID NO: 3368985 - protein, 24 aa, Plasmodium falciparum
NSIVLRQCKSCFIYIIKNYYPFIK

SEQ ID NO: 3368986 - protein, 23 aa, Plasmodium falciparum
NSIYNRYRINSITSINDNTSQHM

SEQ ID NO: 3368987 - protein, 23 aa, Plasmodium falciparum
NSKEFKIIYIAPMKSLVFEITNL

SEQ ID NO: 3368988 - protein, 27 aa, Plasmodium falciparum
NSKGQLICPAYFLWRSKLKENKKVKEP

SEQ ID NO: 3368989 - protein, 20 aa, Plasmodium falciparum
NSKGRWKLSNFDCIHEKNMS

SEQ ID NO: 3368990 - protein, 20 aa, Plasmodium falciparum
NSKIKLLLEKEFKVRKQLQI

SEQ ID NO: 3368991 - protein, 26 aa, Plasmodium falciparum
NSKIYEFLKNILFKTIIVKSLESCEN

SEQ ID NO: 3368992 - protein, 25 aa, Plasmodium falciparum
NSKKLIDLTEGFFSSEFFHKSYECN

SEQ ID NO: 3368993 - protein, 20 aa, Plasmodium falciparum
NSKMAIFYVYNHLIQELRNN

SEQ ID NO: 3368994 - protein, 23 aa, Plasmodium falciparum
NSKNEKSVIEDDWSLIRKKSSIT

SEQ ID NO: 3368995 - protein, 19 aa, Plasmodium falciparum
NSKSALLRNILPSNNNNNN

SEQ ID NO: 3368996 - protein, 23 aa, Plasmodium falciparum
NSKSIFMYKYISRIFEDKEESLS

SEQ ID NO: 3368997 - protein, 26 aa, Plasmodium falciparum
NSKSQLRITSFFKRIDKKTNENHNMH

SEQ ID NO: 3368998 - protein, 22 aa, Plasmodium falciparum
NSKYKMDLRVGDLKEDFGKDMS

SEQ ID NO: 3368999 - protein, 37 aa, Plasmodium falciparum
NSKYYRIKLCPFLKEGFCQKGDNCSYAHSPDKLRNYI

SEQ ID NO: 3369000 - protein, 17 aa, Plasmodium falciparum
NSLADKNYQNFLDTTQF

SEQ ID NO: 3369001 - protein, 20 aa, Plasmodium falciparum
NSLCQIKMFKIDEGTYESLR

SEQ ID NO: 3369002 - protein, 24 aa, Plasmodium falciparum
NSLEELWSLLHFLMPNIFTSHLDF

SEQ ID NO: 3369003 - protein, 32 aa, Plasmodium falciparum
NSLFYINAIEECRKAERFDVSDDVYHKIISLN

SEQ ID NO: 3369004 - protein, 25 aa, Plasmodium falciparum
NSLHIKKSICKHSCNNIKKGHMKYN

SEQ ID NO: 3369005 - protein, 27 aa, Plasmodium falciparum
NSLHPNFSQKIFKEYSKQGPSHESGDN

SEQ ID NO: 3369006 - protein, 17 aa, Plasmodium falciparum
NSLKLILQQKINKTQNT

SEQ ID NO: 3369007 - protein, 19 aa, Plasmodium falciparum
NSLLKLKKQISVLENDKIN

SEQ ID NO: 3369008 - protein, 17 aa, Plasmodium falciparum
NSLMYKYIKLCDFNTSI

SEQ ID NO: 3369009 - protein, 25 aa, Plasmodium falciparum
NSLNHKESFNFTGINNDGINICSSS

SEQ ID NO: 3369010 - protein, 20 aa, Plasmodium falciparum
NSLNNLLCDGIETTQLYYFY

SEQ ID NO: 3369011 - protein, 24 aa, Plasmodium falciparum
NSLRNILIDPCINLEIKELRHKIY

SEQ ID NO: 3369012 - protein, 27 aa, Plasmodium falciparum
NSLSKLKLCNNIEDIYCNEVKLQEPYR

SEQ ID NO: 3369013 - protein, 25 aa, Plasmodium falciparum
NSLSLFREGHNFSCVNYDREKSEHS

SEQ ID NO: 3369014 - protein, 24 aa, Plasmodium falciparum
NSLTHLYLFYSPLVYYKIYVCNIH

SEQ ID NO: 3369015 - protein, 22 aa, Plasmodium falciparum
NSLVKCLFFLPDEEYIDTEKKE

SEQ ID NO: 3369016 - protein, 25 aa, Plasmodium falciparum
NSLWQGRISFAEMAKRKPKVETKEI

SEQ ID NO: 3369017 - protein, 22 aa, Plasmodium falciparum
NSLWYDKMNIIDFLKYGEYFSI

SEQ ID NO: 3369018 - protein, 17 aa, Plasmodium falciparum
NSMIPSVMNTSLENYNK

SEQ ID NO: 3369019 - protein, 19 aa, Plasmodium falciparum
NSMKDSINSFGSFEANNMG

SEQ ID NO: 3369020 - protein, 18 aa, Plasmodium falciparum
NSMKETTNMLSIDNINKK

SEQ ID NO: 3369021 - protein, 19 aa, Plasmodium falciparum
NSMYHFYFRNEIYNTFKDT

SEQ ID NO: 3369022 - protein, 24 aa, Plasmodium falciparum
NSNDIKLDGFYVVNKKEEKKQNIT

SEQ ID NO: 3369023 - protein, 18 aa, Plasmodium falciparum
NSNEYLYYKFDEQYDKKN

SEQ ID NO: 3369024 - protein, 17 aa, Plasmodium falciparum
NSNFFFVKYVHLKDAIK

SEQ ID NO: 3369025 - protein, 23 aa, Plasmodium falciparum
NSNIKGSPYIKLYFNQLDVQKCN

SEQ ID NO: 3369026 - protein, 34 aa, Plasmodium falciparum
NSNIKRKVIIKVLRKHLNNVLALKLLTLSSKTKT

SEQ ID NO: 3369027 - protein, 18 aa, Plasmodium falciparum
NSNIKYTCMNNIYMNKIY

SEQ ID NO: 3369028 - protein, 18 aa, Plasmodium falciparum
NSNISFRINKIPLPFQIY

SEQ ID NO: 3369029 - protein, 24 aa, Plasmodium falciparum
NSNLSSNVYGCIDISSQNFIHSRY

SEQ ID NO: 3369030 - protein, 24 aa, Plasmodium falciparum
NSNNYKLSDYFKINDSSTASVATS

SEQ ID NO: 3369031 - protein, 34 aa, Plasmodium falciparum
NSNYNKKNDCMFLFKDNLSISGLGNVNLCNEKNM

SEQ ID NO: 3369032 - protein, 18 aa, Plasmodium falciparum
NSPFNFSSANIVYDILHN

SEQ ID NO: 3369033 - protein, 19 aa, Plasmodium falciparum
NSPFPYVRPVIVDHGENVI

SEQ ID NO: 3369034 - protein, 17 aa, Plasmodium falciparum
NSPINYFGIAFNNRKEF

SEQ ID NO: 3369035 - protein, 18 aa, Plasmodium falciparum
NSPKFNIKNTWEKLSGYI

SEQ ID NO: 3369036 - protein, 22 aa, Plasmodium falciparum
NSPKKHSFYILGINPKNITEEQ

SEQ ID NO: 3369037 - protein, 17 aa, Plasmodium falciparum
NSPLSTKEKIMYQNDDQ

SEQ ID NO: 3369038 - protein, 18 aa, Plasmodium falciparum
NSPLVSLSNNSGMMNYNM

SEQ ID NO: 3369039 - protein, 18 aa, Plasmodium falciparum
NSPVVLCHCDLLSSNIIK

SEQ ID NO: 3369040 - protein, 19 aa, Plasmodium falciparum
NSPYNKKDESFSMMPDNEE

SEQ ID NO: 3369041 - protein, 21 aa, Plasmodium falciparum
NSQILKSKFFKNFDLDSFMPS

SEQ ID NO: 3369042 - protein, 36 aa, Plasmodium falciparum
NSQISSFIKLCLIRCLREDRTILCANKFVDEVLNRN

SEQ ID NO: 3369043 - protein, 21 aa, Plasmodium falciparum
NSQKDTYNWYMQKTNNNKLLY

SEQ ID NO: 3369044 - protein, 18 aa, Plasmodium falciparum
NSQYKWYTKLNMKKEAEE

SEQ ID NO: 3369045 - protein, 22 aa, Plasmodium falciparum
NSRFSRKSITSIDSYESSKSSS

SEQ ID NO: 3369046 - protein, 27 aa, Plasmodium falciparum
NSRKFMWICILCMCNYDDLPSLVRDIY

SEQ ID NO: 3369047 - protein, 19 aa, Plasmodium falciparum
NSRNKIVFVQGEKNKFKNI

SEQ ID NO: 3369048 - protein, 23 aa, Plasmodium falciparum
NSRNVCYALKNGKFRLINQNGIN

SEQ ID NO: 3369049 - protein, 17 aa, Plasmodium falciparum
NSSCNYRKNIIECVEIL

SEQ ID NO: 3369050 - protein, 17 aa, Plasmodium falciparum
NSSESFLSISDDTSSYA

SEQ ID NO: 3369051 - protein, 22 aa, Plasmodium falciparum
NSSFFTKCFSKIVNFGNNTQEN

SEQ ID NO: 3369052 - protein, 25 aa, Plasmodium falciparum
NSSFPPYKFISYLRPKLTPKAYHLK

SEQ ID NO: 3369053 - protein, 17 aa, Plasmodium falciparum
NSSGFSGYFNKWSPGFN

SEQ ID NO: 3369054 - protein, 22 aa, Plasmodium falciparum
NSSGPRGALFVPESAFETLIKK

SEQ ID NO: 3369055 - protein, 21 aa, Plasmodium falciparum
NSSKRKFYALDKLKTNRHLDL

SEQ ID NO: 3369056 - protein, 22 aa, Plasmodium falciparum
NSSKYPSMHSVILRNTKDQKKK

SEQ ID NO: 3369057 - protein, 18 aa, Plasmodium falciparum
NSSMFLKNIDSFNNYSVS

SEQ ID NO: 3369058 - protein, 17 aa, Plasmodium falciparum
NSSMSINIPPPIIPDNK

SEQ ID NO: 3369059 - protein, 21 aa, Plasmodium falciparum
NSSNFSWNSTKNFNDTYEHKN

SEQ ID NO: 3369060 - protein, 19 aa, Plasmodium falciparum
NSSNNCALVNSSNTINNNL

SEQ ID NO: 3369061 - protein, 18 aa, Plasmodium falciparum
NSSSICYYTKYHTYELER

SEQ ID NO: 3369062 - protein, 21 aa, Plasmodium falciparum
NSSSLLRNINESFSNQYDNKK

SEQ ID NO: 3369063 - protein, 27 aa, Plasmodium falciparum
NSSSLNYSNIFPFNCLNTNKNAISLSN

SEQ ID NO: 3369064 - protein, 17 aa, Plasmodium falciparum
NSSSYCSYSNKINQNNV

SEQ ID NO: 3369065 - protein, 19 aa, Plasmodium falciparum
NSSVLCIFSNMLLKENVQN

SEQ ID NO: 3369066 - protein, 23 aa, Plasmodium falciparum
NSSVRLLQCLGLKKKKKKKKTCI

SEQ ID NO: 3369067 - protein, 29 aa, Plasmodium falciparum
NSSYFSQFMKFMYVYNFLRRSKKEKTNKN

SEQ ID NO: 3369068 - protein, 28 aa, Plasmodium falciparum
NSSYMYSSQMYKYMKSNKYDTCMNTNME

SEQ ID NO: 3369069 - protein, 20 aa, Plasmodium falciparum
NSTAHVFIKNGYYLEKQNIK

SEQ ID NO: 3369070 - protein, 30 aa, Plasmodium falciparum
NSTFYSFCIVCKNCLNEIVFETNPQNCSYD

SEQ ID NO: 3369071 - protein, 19 aa, Plasmodium falciparum
NSTHGGCLSKQVNNDIETL

SEQ ID NO: 3369072 - protein, 31 aa, Plasmodium falciparum
NSTMSKFNFVPKIKKIFSFKEKNKCDIKDQD

SEQ ID NO: 3369073 - protein, 17 aa, Plasmodium falciparum
NSTNIIPLWKNEAEKSG

SEQ ID NO: 3369074 - protein, 23 aa, Plasmodium falciparum
NSTRELRKLLSIEKGPPIQEVIN

SEQ ID NO: 3369075 - protein, 17 aa, Plasmodium falciparum
NSVKKSYSTKGYNTDRS

SEQ ID NO: 3369076 - protein, 20 aa, Plasmodium falciparum
NSVNFLLIIRLLKITDDTKI

SEQ ID NO: 3369077 - protein, 22 aa, Plasmodium falciparum
NSVNFLRKKIGNINHVDKMNNM

SEQ ID NO: 3369078 - protein, 22 aa, Plasmodium falciparum
NSVPCYEYNILQGLNKPIFNSN

SEQ ID NO: 3369079 - protein, 20 aa, Plasmodium falciparum
NSVQITRFLIMKSQNHIMGT

SEQ ID NO: 3369080 - protein, 17 aa, Plasmodium falciparum
NSVYLLSQHGIYGIKFI

SEQ ID NO: 3369081 - protein, 22 aa, Plasmodium falciparum
NSWSNNFCAFKYSNEKYSNNRY

SEQ ID NO: 3369082 - protein, 26 aa, Plasmodium falciparum
NSYEKGNLISICIFERNIKLLKKLFN

SEQ ID NO: 3369083 - protein, 25 aa, Plasmodium falciparum
NSYIAPCLPYSYYYIPPFNETNIRN

SEQ ID NO: 3369084 - protein, 29 aa, Plasmodium falciparum
NSYIRYKKLPLYLEWAPLNLFAKQKDIED

SEQ ID NO: 3369085 - protein, 20 aa, Plasmodium falciparum
NSYKLLYDIERMRKNKKDIM

SEQ ID NO: 3369086 - protein, 17 aa, Plasmodium falciparum
NSYKYSTNNITKIIDKR

SEQ ID NO: 3369087 - protein, 23 aa, Plasmodium falciparum
NSYLKKAFELRDKMLKNSINEEQ

SEQ ID NO: 3369088 - protein, 28 aa, Plasmodium falciparum
NSYLLRNRAFRLTWTSIIEKIKHEIDIE

SEQ ID NO: 3369089 - protein, 29 aa, Plasmodium falciparum
NSYNLIKLTLKFCKMIERRMWSTMTPLRQ

SEQ ID NO: 3369090 - protein, 17 aa, Plasmodium falciparum
NSYSIVFKRNDDLNLPN

SEQ ID NO: 3369091 - protein, 26 aa, Plasmodium falciparum
NSYTKLCYYHEPFYDFIFKKIIMFIH

SEQ ID NO: 3369092 - protein, 24 aa, Plasmodium falciparum
NTALKHKITISTFIKKAYTTNPSL

SEQ ID NO: 3369093 - protein, 18 aa, Plasmodium falciparum
NTAMCLRQGTNWASRQGI

SEQ ID NO: 3369094 - protein, 19 aa, Plasmodium falciparum
NTCAWFNKNVFEVLIDEHK

SEQ ID NO: 3369095 - protein, 26 aa, Plasmodium falciparum
NTCIPKNRINEICIKKNFNNNYKNIH

SEQ ID NO: 3369096 - protein, 18 aa, Plasmodium falciparum
NTCVELIHNISINKKMKD

SEQ ID NO: 3369097 - protein, 37 aa, Plasmodium falciparum
NTDCDVSFHISCGILLGCKMDNFFGRVDIYNPKKAYC

SEQ ID NO: 3369098 - protein, 24 aa, Plasmodium falciparum
NTDDELYNFISYHMQGRNPSFEKK

SEQ ID NO: 3369099 - protein, 27 aa, Plasmodium falciparum
NTDILYFFSEYFIEALYINYNLTNIEQ

SEQ ID NO: 3369100 - protein, 18 aa, Plasmodium falciparum
NTDITICDGSIIPNNKNY

SEQ ID NO: 3369101 - protein, 52 aa, Plasmodium falciparum
NTENKKFRILCFQKGSGRLFLNTDIFDGFKIIPSKNLSALFSGRDICDEKKL

SEQ ID NO: 3369102 - protein, 23 aa, Plasmodium falciparum
NTEPRGFGHIGFLVNDLENYCKE

SEQ ID NO: 3369103 - protein, 25 aa, Plasmodium falciparum
NTETLYLMRPFHAILNEIENAEKEG

SEQ ID NO: 3369104 - protein, 17 aa, Plasmodium falciparum
NTFDIIIFNFPFVLPTK

SEQ ID NO: 3369105 - protein, 20 aa, Plasmodium falciparum
NTFFDYYQNIIVFKTVVLPN

SEQ ID NO: 3369106 - protein, 17 aa, Plasmodium falciparum
NTFIKYESKNVEKKNET

SEQ ID NO: 3369107 - protein, 23 aa, Plasmodium falciparum
NTFIYFCRCGDFFIFNENLCYEY

SEQ ID NO: 3369108 - protein, 18 aa, Plasmodium falciparum
NTFLWGCYFIDIGETNDK

SEQ ID NO: 3369109 - protein, 18 aa, Plasmodium falciparum
NTGAMLIEKITRKGNDNN

SEQ ID NO: 3369110 - protein, 24 aa, Plasmodium falciparum
NTGKFTNTHLFNGDTFLENKNKNI

SEQ ID NO: 3369111 - protein, 19 aa, Plasmodium falciparum
NTHDNLMFLKNIRSKSNNN

SEQ ID NO: 3369112 - protein, 17 aa, Plasmodium falciparum
NTHLGFMGASKINNNIS

SEQ ID NO: 3369113 - protein, 17 aa, Plasmodium falciparum
NTIGQFINKCVDNLKNE

SEQ ID NO: 3369114 - protein, 33 aa, Plasmodium falciparum
NTIICISCFKCYFPFEFVNKCVICNSFDMINLK

SEQ ID NO: 3369115 - protein, 20 aa, Plasmodium falciparum
NTIKLKIPFEKRENDFTDRK

SEQ ID NO: 3369116 - protein, 24 aa, Plasmodium falciparum
NTIKSISCPILIFHSEHYSYKNSS

SEQ ID NO: 3369117 - protein, 18 aa, Plasmodium falciparum
NTIMTLKLIEELQKDVMN

SEQ ID NO: 3369118 - protein, 20 aa, Plasmodium falciparum
NTKAFKSKKLKLRKFQYKYV

SEQ ID NO: 3369119 - protein, 28 aa, Plasmodium falciparum
NTKDEKSLLCLLSIKSFFQCNPKIEIYS

SEQ ID NO: 3369120 - protein, 21 aa, Plasmodium falciparum
NTKHTRCNIKHIDDIELNDKI

SEQ ID NO: 3369121 - protein, 18 aa, Plasmodium falciparum
NTKKGCFMFYFKYDNKTY

SEQ ID NO: 3369122 - protein, 18 aa, Plasmodium falciparum
NTKKRGSKFDGTYRNDDE

SEQ ID NO: 3369123 - protein, 23 aa, Plasmodium falciparum
NTKLKETLIFDDIIHIHNTYLNN

SEQ ID NO: 3369124 - protein, 25 aa, Plasmodium falciparum
NTKMKIKLDQEFYKMKMLEKEKKSL

SEQ ID NO: 3369125 - protein, 46 aa, Plasmodium falciparum
NTKQGLYNYCYSYLIRIHEGFDIFPMEGFKFRSIVIDGANVCAKVI

SEQ ID NO: 3369126 - protein, 17 aa, Plasmodium falciparum
NTKRWKFNFSKGKNLFN

SEQ ID NO: 3369127 - protein, 18 aa, Plasmodium falciparum
NTLFKYENKLFILAADIS

SEQ ID NO: 3369128 - protein, 23 aa, Plasmodium falciparum
NTLICIITSLSLILQNSKYGSTI

SEQ ID NO: 3369129 - protein, 18 aa, Plasmodium falciparum
NTLNVLKEQKMPILDHND

SEQ ID NO: 3369130 - protein, 37 aa, Plasmodium falciparum
NTLRIKGIGGISNFLTLKCIHLYFASHLSYPNTVGYI

SEQ ID NO: 3369131 - protein, 24 aa, Plasmodium falciparum
NTLRYKEIVKLFFEISSCLYYIHK

SEQ ID NO: 3369132 - protein, 20 aa, Plasmodium falciparum
NTLSYGRPVITAFNQNNLIS

SEQ ID NO: 3369133 - protein, 30 aa, Plasmodium falciparum
NTLWYKHKRHFFIFTFSGKPVFTRYGNEEN

SEQ ID NO: 3369134 - protein, 22 aa, Plasmodium falciparum
NTLYPWKENKFKNVDMLNIYKI

SEQ ID NO: 3369135 - protein, 21 aa, Plasmodium falciparum
NTMHYSKENFSLLKDGPPGAN

SEQ ID NO: 3369136 - protein, 18 aa, Plasmodium falciparum
NTMLKKEIQHIIGKGGIK

SEQ ID NO: 3369137 - protein, 24 aa, Plasmodium falciparum
NTMVKEFLKKISVSHEKLLLLKKK

SEQ ID NO: 3369138 - protein, 32 aa, Plasmodium falciparum
NTNAFWILQLCYRYHSNLLSEDRLPISQPVLL

SEQ ID NO: 3369139 - protein, 20 aa, Plasmodium falciparum
NTNCVYAHGELELRAPPDFF

SEQ ID NO: 3369140 - protein, 20 aa, Plasmodium falciparum
NTNEVFEFFTRITNNQKDLN

SEQ ID NO: 3369141 - protein, 44 aa, Plasmodium falciparum
NTNFNKNLFYGFGYNKCEYIPIIYDYHICYNKKENLSLKNDMKK

SEQ ID NO: 3369142 - protein, 17 aa, Plasmodium falciparum
NTNIDFDGMYNYKNLRP

SEQ ID NO: 3369143 - protein, 25 aa, Plasmodium falciparum
NTNIYFPNCNIFNNFNKQENDIKNK

SEQ ID NO: 3369144 - protein, 24 aa, Plasmodium falciparum
NTNKEVYKWINVLLYEKKVRCIRT

SEQ ID NO: 3369145 - protein, 18 aa, Plasmodium falciparum
NTNKRHWIVFDGDVDPEW

SEQ ID NO: 3369146 - protein, 35 aa, Plasmodium falciparum
NTNKVPRCHICKRRKVFEFQVLSTIINFLKINKNI

SEQ ID NO: 3369147 - protein, 23 aa, Plasmodium falciparum
NTNLRFIFHNTFITSEEEIAISE

SEQ ID NO: 3369148 - protein, 27 aa, Plasmodium falciparum
NTPCYFIKKKWITTFHKQWIDDIELIN

SEQ ID NO: 3369149 - protein, 26 aa, Plasmodium falciparum
NTPPKYICGYKFNIFYTNLINKNHKP

SEQ ID NO: 3369150 - protein, 18 aa, Plasmodium falciparum
NTPSEYMLHKEHVINRVT

SEQ ID NO: 3369151 - protein, 20 aa, Plasmodium falciparum
NTPSIMIADVLKIIDKNSEE

SEQ ID NO: 3369152 - protein, 28 aa, Plasmodium falciparum
NTQKSPHKIYCFIHFFNYDECLRALTEM

SEQ ID NO: 3369153 - protein, 21 aa, Plasmodium falciparum
NTQNLLKWKLKYANNTYKTND

SEQ ID NO: 3369154 - protein, 17 aa, Plasmodium falciparum
NTQPRVSMCVSRLTQEL

SEQ ID NO: 3369155 - protein, 18 aa, Plasmodium falciparum
NTQTRPSIFGSKEEGNNN

SEQ ID NO: 3369156 - protein, 18 aa, Plasmodium falciparum
NTRCSVIAAANPSFGSYD

SEQ ID NO: 3369157 - protein, 18 aa, Plasmodium falciparum
NTREAACELFSLLKKFDI

SEQ ID NO: 3369158 - protein, 26 aa, Plasmodium falciparum
NTRKICSDRQILKFIISYCNNISSNH

SEQ ID NO: 3369159 - protein, 24 aa, Plasmodium falciparum
NTRYKTERFFKAKNSNQENINQNE

SEQ ID NO: 3369160 - protein, 24 aa, Plasmodium falciparum
NTRYLCNFSLRLVSLSINNDDIKR

SEQ ID NO: 3369161 - protein, 18 aa, Plasmodium falciparum
NTRYRKIIVIPFNDKDVK

SEQ ID NO: 3369162 - protein, 17 aa, Plasmodium falciparum
NTSCIYDNYDRRLHNSS

SEQ ID NO: 3369163 - protein, 24 aa, Plasmodium falciparum
NTSEFCKNISLPLDVLENEKKLKS

SEQ ID NO: 3369164 - protein, 45 aa, Plasmodium falciparum
NTSELNIKCIWAHPFLNTKSTYYILCAFLPRVILEAFLNSKGILH

SEQ ID NO: 3369165 - protein, 28 aa, Plasmodium falciparum
NTSILYKVFYKRIMKGNSNDSIFDNIEK

SEQ ID NO: 3369166 - protein, 25 aa, Plasmodium falciparum
NTSKWSVVCTLCPKEEQKLAAYNMW

SEQ ID NO: 3369167 - protein, 20 aa, Plasmodium falciparum
NTSLTFPSNRNKNIIHLQVT

SEQ ID NO: 3369168 - protein, 22 aa, Plasmodium falciparum
NTSNKIRCVIKIYDDDSQYNGK

SEQ ID NO: 3369169 - protein, 17 aa, Plasmodium falciparum
NTSPIFNDHLKSVEIKD

SEQ ID NO: 3369170 - protein, 17 aa, Plasmodium falciparum
NTSREILFNGMEDIVEK

SEQ ID NO: 3369171 - protein, 29 aa, Plasmodium falciparum
NTTCNKWYDSIYFRNGIRKNEINEKNVNT

SEQ ID NO: 3369172 - protein, 24 aa, Plasmodium falciparum
NTTGMPYNHVNMMNNPNMINRQSH

SEQ ID NO: 3369173 - protein, 23 aa, Plasmodium falciparum
NTTIGASFCTYVVNLNDINIKNN

SEQ ID NO: 3369174 - protein, 20 aa, Plasmodium falciparum
NTVAELLMKQISMIKERNKG

SEQ ID NO: 3369175 - protein, 30 aa, Plasmodium falciparum
NTVESVYFVNYRAVVVKTKHYYVTQNSYML

SEQ ID NO: 3369176 - protein, 17 aa, Plasmodium falciparum
NTVFNFNHEFLKFLRKV

SEQ ID NO: 3369177 - protein, 23 aa, Plasmodium falciparum
NTVKVNSFDSSWVELKEQQRERL

SEQ ID NO: 3369178 - protein, 18 aa, Plasmodium falciparum
NTVLKKKNFFNLENNNVP

SEQ ID NO: 3369179 - protein, 24 aa, Plasmodium falciparum
NTVMFPNGNYEMMHVEGRYNVVDV

SEQ ID NO: 3369180 - protein, 22 aa, Plasmodium falciparum
NTWTQIFTMDDFYYLKTELINK

SEQ ID NO: 3369181 - protein, 22 aa, Plasmodium falciparum
NTYKYIYCNTINNLILTKNDEK

SEQ ID NO: 3369182 - protein, 23 aa, Plasmodium falciparum
NTYNKYYCDVRMNIRNNLTNLNN

SEQ ID NO: 3369183 - protein, 18 aa, Plasmodium falciparum
NTYYCLNIDLSENYITCI

SEQ ID NO: 3369184 - protein, 23 aa, Plasmodium falciparum
NTYYKGTCCKFNDNKGKKKIDKD

SEQ ID NO: 3369185 - protein, 31 aa, Plasmodium falciparum
NVAKRECIHMNKGRFVRGGAYTKVCERNTER

SEQ ID NO: 3369186 - protein, 27 aa, Plasmodium falciparum
NVCDYKIYFKWFFEDNSLYKDFNEVFD

SEQ ID NO: 3369187 - protein, 23 aa, Plasmodium falciparum
NVCKKINLNKCVLLDIGSSLLKY

SEQ ID NO: 3369188 - protein, 22 aa, Plasmodium falciparum
NVCKRNNIVVKYMVHNKAQMNK

SEQ ID NO: 3369189 - protein, 28 aa, Plasmodium falciparum
NVCKTCIRTKLPICLADKLADDLVESIK

SEQ ID NO: 3369190 - protein, 19 aa, Plasmodium falciparum
NVCYFRKSKEFLTILLLEF

SEQ ID NO: 3369191 - protein, 25 aa, Plasmodium falciparum
NVDCCKKEDNLNCDVDRYDEKKENI

SEQ ID NO: 3369192 - protein, 25 aa, Plasmodium falciparum
NVDCTYIVMELCEGGELMSRIKNSE

SEQ ID NO: 3369193 - protein, 24 aa, Plasmodium falciparum
NVDIKNCFKNYYLKLYDEITNLIL

SEQ ID NO: 3369194 - protein, 18 aa, Plasmodium falciparum
NVDSKCSWIDDNHKVISL

SEQ ID NO: 3369195 - protein, 26 aa, Plasmodium falciparum
NVDTPECIEKLMSENVSLFRKHDDKF

SEQ ID NO: 3369196 - protein, 23 aa, Plasmodium falciparum
NVEELIKMFAHFDNNCTGYLTKS

SEQ ID NO: 3369197 - protein, 18 aa, Plasmodium falciparum
NVEFLQLQITRFINSDSP

SEQ ID NO: 3369198 - protein, 31 aa, Plasmodium falciparum
NVEGKRIPFGFNHRSLPHFIKFDYGPESRGF

SEQ ID NO: 3369199 - protein, 18 aa, Plasmodium falciparum
NVEIRKGCRYSTIYNNIE

SEQ ID NO: 3369200 - protein, 24 aa, Plasmodium falciparum
NVENARINNFFSCNYTLDDKTKIN

SEQ ID NO: 3369201 - protein, 24 aa, Plasmodium falciparum
NVEYLKLLNKIMEGLLEHENFYKS

SEQ ID NO: 3369202 - protein, 25 aa, Plasmodium falciparum
NVFDKCLHDYWPFMCPPEQDSKYKP

SEQ ID NO: 3369203 - protein, 18 aa, Plasmodium falciparum
NVFDQHCYVSNGNMEYIK

SEQ ID NO: 3369204 - protein, 17 aa, Plasmodium falciparum
NVFENFGNMSQWEDLHV

SEQ ID NO: 3369205 - protein, 17 aa, Plasmodium falciparum
NVFFPWHTFCIHKSGSF

SEQ ID NO: 3369206 - protein, 26 aa, Plasmodium falciparum
NVFKVLYKLLSNISFHPNEEKYKTIK

SEQ ID NO: 3369207 - protein, 26 aa, Plasmodium falciparum
NVFQPKLKWLNIFTRNFNKDQLGTKY

SEQ ID NO: 3369208 - protein, 18 aa, Plasmodium falciparum
NVFYILKPIGSITLKDIK

SEQ ID NO: 3369209 - protein, 20 aa, Plasmodium falciparum
NVFYNKYFIKNTFQNKNKLS

SEQ ID NO: 3369210 - protein, 17 aa, Plasmodium falciparum
NVGCIVRSCVAFNVHKI

SEQ ID NO: 3369211 - protein, 25 aa, Plasmodium falciparum
NVHHLGFNLFDLIKINDDVLLKNEY

SEQ ID NO: 3369212 - protein, 20 aa, Plasmodium falciparum
NVHIPKELSHYYLKSRNKTK

SEQ ID NO: 3369213 - protein, 19 aa, Plasmodium falciparum
NVIDVCVCTPMILLNMIHE

SEQ ID NO: 3369214 - protein, 22 aa, Plasmodium falciparum
NVIECEKHMQLLISPGDMYMFK

SEQ ID NO: 3369215 - protein, 17 aa, Plasmodium falciparum
NVIEIFEVLLGFIYFNR

SEQ ID NO: 3369216 - protein, 29 aa, Plasmodium falciparum
NVIIHIPLFLRYFIQTHVSSTKARTNRCV

SEQ ID NO: 3369217 - protein, 20 aa, Plasmodium falciparum
NVIKEIKCEYIVMTLDNLAY

SEQ ID NO: 3369218 - protein, 20 aa, Plasmodium falciparum
NVIKGGILFDILEKDKKLVW

SEQ ID NO: 3369219 - protein, 33 aa, Plasmodium falciparum
NVIKYKYLPTGVFYSRVSKSFIANWIDDKTKKQ

SEQ ID NO: 3369220 - protein, 23 aa, Plasmodium falciparum
NVILENCVHEWFPFLKDEHDDID

SEQ ID NO: 3369221 - protein, 20 aa, Plasmodium falciparum
NVIMRKSRHPLLELQYNLNN

SEQ ID NO: 3369222 - protein, 27 aa, Plasmodium falciparum
NVIQQFRLLKELVIKIINIITLIISIC

SEQ ID NO: 3369223 - protein, 23 aa, Plasmodium falciparum
NVIRVCEVIDLIIITNHSLNYIG

SEQ ID NO: 3369224 - protein, 24 aa, Plasmodium falciparum
NVISRSVLIKGVIELWSEGNSYNE

SEQ ID NO: 3369225 - protein, 25 aa, Plasmodium falciparum
NVIYKELKFTQNIKHIKKCMKRYVR

SEQ ID NO: 3369226 - protein, 19 aa, Plasmodium falciparum
NVKASGFLMKKELEYFSKA

SEQ ID NO: 3369227 - protein, 36 aa, Plasmodium falciparum
NVKDKNILCSFKIKKKSCSNWPVINFTNDDNYFFLQ

SEQ ID NO: 3369228 - protein, 28 aa, Plasmodium falciparum
NVKDYPLGCPVCYIPLTVDFNLLVDKEE

SEQ ID NO: 3369229 - protein, 17 aa, Plasmodium falciparum
NVKFFPYLQFSYSLNYN

SEQ ID NO: 3369230 - protein, 21 aa, Plasmodium falciparum
NVKGVRWHASGAWRVYFCKRN

SEQ ID NO: 3369231 - protein, 18 aa, Plasmodium falciparum
NVKGYLFRKDNIKEDLCV

SEQ ID NO: 3369232 - protein, 24 aa, Plasmodium falciparum
NVKIWKNDIEHLKIWKPKKNYKFK

SEQ ID NO: 3369233 - protein, 23 aa, Plasmodium falciparum
NVKKKWERMLPISKRKKLSTQIR

SEQ ID NO: 3369234 - protein, 28 aa, Plasmodium falciparum
NVKKSFTSMILNFFGFKYDNIEEDKKSE

SEQ ID NO: 3369235 - protein, 27 aa, Plasmodium falciparum
NVKLCHLSNGYIIRVYLLLLLLSKSKL

SEQ ID NO: 3369236 - protein, 19 aa, Plasmodium falciparum
NVKLSNCIINDNFNNNIKY

SEQ ID NO: 3369237 - protein, 18 aa, Plasmodium falciparum
NVKNCKNGDKLFLNIQKN

SEQ ID NO: 3369238 - protein, 23 aa, Plasmodium falciparum
NVKNNLFHFGNYLITEKYAPCKI

SEQ ID NO: 3369239 - protein, 21 aa, Plasmodium falciparum
NVKRLFCDDEYLWIFNIRDST

SEQ ID NO: 3369240 - protein, 28 aa, Plasmodium falciparum
NVKRMKIFFRYYMKNLFLGNFDKILDFH

SEQ ID NO: 3369241 - protein, 22 aa, Plasmodium falciparum
NVKRVGKCSLYQDMFDIETDTF

SEQ ID NO: 3369242 - protein, 24 aa, Plasmodium falciparum
NVKSEKGVNFDLYNSIPVEISGFN

SEQ ID NO: 3369243 - protein, 24 aa, Plasmodium falciparum
NVKSRIIIRILFLSFLRYSISNNN

SEQ ID NO: 3369244 - protein, 26 aa, Plasmodium falciparum
NVKVFLAVPLCERYNKSGGYQIYVGT

SEQ ID NO: 3369245 - protein, 24 aa, Plasmodium falciparum
NVKYIPQSKWNDRHYNKYYIHYNG

SEQ ID NO: 3369246 - protein, 18 aa, Plasmodium falciparum
NVLCITKEEFDDISKELS

SEQ ID NO: 3369247 - protein, 18 aa, Plasmodium falciparum
NVLKKLNLENVVLNNKLQ

SEQ ID NO: 3369248 - protein, 48 aa, Plasmodium falciparum
NVLLSNVYCFFEIKLTIILLNFFISNNCQWSFSLFPLSLINKLIHKFS

SEQ ID NO: 3369249 - protein, 21 aa, Plasmodium falciparum
NVLNCSFLLLVEEIHPYSNYG

SEQ ID NO: 3369250 - protein, 24 aa, Plasmodium falciparum
NVLNDLKCINLPKKESASDIDTIK

SEQ ID NO: 3369251 - protein, 21 aa, Plasmodium falciparum
NVLTHAYLPICLEKMKEGEYV

SEQ ID NO: 3369252 - protein, 23 aa, Plasmodium falciparum
NVMNAPHPFNKMNYNYHNMNPGL

SEQ ID NO: 3369253 - protein, 17 aa, Plasmodium falciparum
NVNGVAILDAEDMNISK

SEQ ID NO: 3369254 - protein, 18 aa, Plasmodium falciparum
NVNILDIHNRLPIHSACL

SEQ ID NO: 3369255 - protein, 19 aa, Plasmodium falciparum
NVNKIKWNNNGIYLLSCSK

SEQ ID NO: 3369256 - protein, 25 aa, Plasmodium falciparum
NVNKKSQHVICLNVQNKDHNNNNNL

SEQ ID NO: 3369257 - protein, 25 aa, Plasmodium falciparum
NVNLKNCIEQCLKNYYKSCTKSIYD

SEQ ID NO: 3369258 - protein, 18 aa, Plasmodium falciparum
NVPDEEIYFCITNFSLKK

SEQ ID NO: 3369259 - protein, 23 aa, Plasmodium falciparum
NVPEAYETLLLECFKGHKKKFIS

SEQ ID NO: 3369260 - protein, 25 aa, Plasmodium falciparum
NVPELRFISGYCLKDIFINTMKENI

SEQ ID NO: 3369261 - protein, 17 aa, Plasmodium falciparum
NVPFKKRGSDLYNNSKK

SEQ ID NO: 3369262 - protein, 24 aa, Plasmodium falciparum
NVPFLKNPVVFFLLQQNFKIVVEY

SEQ ID NO: 3369263 - protein, 23 aa, Plasmodium falciparum
NVPNIDPSLFLERFAHKLNLKND

SEQ ID NO: 3369264 - protein, 20 aa, Plasmodium falciparum
NVPVNVRDIIDWDYYKQKLE

SEQ ID NO: 3369265 - protein, 18 aa, Plasmodium falciparum
NVQGTICEDEQKKIHKLE

SEQ ID NO: 3369266 - protein, 24 aa, Plasmodium falciparum
NVQIKTITSSICTYKNGVDDEHEN

SEQ ID NO: 3369267 - protein, 17 aa, Plasmodium falciparum
NVRMFRIEHIIINNIVK

SEQ ID NO: 3369268 - protein, 40 aa, Plasmodium falciparum
NVRNDCSSCSFFWKQLNCELCKFPYPTYIYIQNKYLELYE

SEQ ID NO: 3369269 - protein, 21 aa, Plasmodium falciparum
NVRNIYSLWFYSTEEKEQIYK

SEQ ID NO: 3369270 - protein, 26 aa, Plasmodium falciparum
NVSEEIEFYLSCLNLHHNKGNDKKKQ

SEQ ID NO: 3369271 - protein, 19 aa, Plasmodium falciparum
NVSGMFCTTAGLTCAAIKE

SEQ ID NO: 3369272 - protein, 18 aa, Plasmodium falciparum
NVSKRYIEESSFNELFKY

SEQ ID NO: 3369273 - protein, 20 aa, Plasmodium falciparum
NVSLLSYFFSYLLKSDRNYD

SEQ ID NO: 3369274 - protein, 26 aa, Plasmodium falciparum
NVSMLYNYYLDICRDNKSQLEKKIQD

SEQ ID NO: 3369275 - protein, 30 aa, Plasmodium falciparum
NVSSNSYKGECLWEKILASLNNDYEQISKI

SEQ ID NO: 3369276 - protein, 17 aa, Plasmodium falciparum
NVSVRWDIGLNKKRYAH

SEQ ID NO: 3369277 - protein, 20 aa, Plasmodium falciparum
NVTCKVCYTVFMQTQSISQL

SEQ ID NO: 3369278 - protein, 24 aa, Plasmodium falciparum
NVTNMPILYSMNKEQYINISNHNN

SEQ ID NO: 3369279 - protein, 23 aa, Plasmodium falciparum
NVTPKKLFVPSAIKQQQQKEALK

SEQ ID NO: 3369280 - protein, 27 aa, Plasmodium falciparum
NVVDLFCGVGYFTLPLLKCIEAQNKIN

SEQ ID NO: 3369281 - protein, 33 aa, Plasmodium falciparum
NVVKYFESFFWPPCYLVIVCEYLSGGTLYDLYK

SEQ ID NO: 3369282 - protein, 17 aa, Plasmodium falciparum
NVVLFNFSINYLKNKKK

SEQ ID NO: 3369283 - protein, 19 aa, Plasmodium falciparum
NVVSKGVSIPVMLKNKLLN

SEQ ID NO: 3369284 - protein, 21 aa, Plasmodium falciparum
NVVSKSGSYKCDAENNNTNMK

SEQ ID NO: 3369285 - protein, 26 aa, Plasmodium falciparum
NVWKNGQIIKVKYNIHKISWSPNGTI

SEQ ID NO: 3369286 - protein, 26 aa, Plasmodium falciparum
NVYCKSLGICLVEFSYLDNTQNYSLY

SEQ ID NO: 3369287 - protein, 23 aa, Plasmodium falciparum
NVYDCNKKLIGHCQDLEKENSTL

SEQ ID NO: 3369288 - protein, 18 aa, Plasmodium falciparum
NVYKKQRGLFSFVPLLAK

SEQ ID NO: 3369289 - protein, 26 aa, Plasmodium falciparum
NVYWVSLNGIENWILLKSTTPKYIEI

SEQ ID NO: 3369290 - protein, 17 aa, Plasmodium falciparum
NWDALYEALEPFGKTKD

SEQ ID NO: 3369291 - protein, 25 aa, Plasmodium falciparum
NWFNYCLNNLFSLNIAELYMFRIYV

SEQ ID NO: 3369292 - protein, 18 aa, Plasmodium falciparum
NWILASLYSGKLVIFDYV

SEQ ID NO: 3369293 - protein, 25 aa, Plasmodium falciparum
NWINDKRNGLGFNIDIYKNIYYGYY

SEQ ID NO: 3369294 - protein, 29 aa, Plasmodium falciparum
NWKSPNHIEVLNLLFLMNGDNQIKKDKYI

SEQ ID NO: 3369295 - protein, 19 aa, Plasmodium falciparum
NWMYEDFYVNRLISQIMKK

SEQ ID NO: 3369296 - protein, 20 aa, Plasmodium falciparum
NWNWSVEISLILKINNKFIH

SEQ ID NO: 3369297 - protein, 20 aa, Plasmodium falciparum
NWQSRVCIAILTGHNHYVMC

SEQ ID NO: 3369298 - protein, 28 aa, Plasmodium falciparum
NWSGNSKTALKCAMKLNDDFSIDAKSPH

SEQ ID NO: 3369299 - protein, 25 aa, Plasmodium falciparum
NWWIHNKKMICNSINLSSNYINIET

SEQ ID NO: 3369300 - protein, 23 aa, Plasmodium falciparum
NYAEAGGIYNEMNSLKLIYNYIN

SEQ ID NO: 3369301 - protein, 20 aa, Plasmodium falciparum
NYASEFLMNVHGDMTKCDNN

SEQ ID NO: 3369302 - protein, 19 aa, Plasmodium falciparum
NYCMMKNLLNNVVDIVKLT

SEQ ID NO: 3369303 - protein, 17 aa, Plasmodium falciparum
NYCNSFYKHFKINEMYL

SEQ ID NO: 3369304 - protein, 25 aa, Plasmodium falciparum
NYDCIKDIPISIGMNRETEKNKLHN

SEQ ID NO: 3369305 - protein, 30 aa, Plasmodium falciparum
NYDDVPMFFNFVNCCSSVLGSEIIYVTDET

SEQ ID NO: 3369306 - protein, 27 aa, Plasmodium falciparum
NYDETIWRYYVGLILKEERCCEEIYYY

SEQ ID NO: 3369307 - protein, 17 aa, Plasmodium falciparum
NYDFHLKGGEIYNESSL

SEQ ID NO: 3369308 - protein, 24 aa, Plasmodium falciparum
NYDFKSALNVQFCKTKMCPYMNTK

SEQ ID NO: 3369309 - protein, 25 aa, Plasmodium falciparum
NYDICSLKKEITTFSDIYKKYNNKL

SEQ ID NO: 3369310 - protein, 23 aa, Plasmodium falciparum
NYDIIKDRFRIIDKNINNEIQND

SEQ ID NO: 3369311 - protein, 25 aa, Plasmodium falciparum
NYDKEKKRLIMLTNTCYENECMKYK

SEQ ID NO: 3369312 - protein, 26 aa, Plasmodium falciparum
NYDKKTMEFSSWVKIAKMNPNNNNNN

SEQ ID NO: 3369313 - protein, 24 aa, Plasmodium falciparum
NYDKYKVLPICSIDYEEVNLKLEK

SEQ ID NO: 3369314 - protein, 21 aa, Plasmodium falciparum
NYDLLWLKLIEIELCCNNKNL

SEQ ID NO: 3369315 - protein, 17 aa, Plasmodium falciparum
NYDVILIDTAGRMQDNE

SEQ ID NO: 3369316 - protein, 25 aa, Plasmodium falciparum
NYDVLRLSLLYSLKYADEQHINVIK

SEQ ID NO: 3369317 - protein, 19 aa, Plasmodium falciparum
NYDVSSCIEWYHRCSESTK

SEQ ID NO: 3369318 - protein, 22 aa, Plasmodium falciparum
NYDYKNNFLVSMNTIKNNGSNI

SEQ ID NO: 3369319 - protein, 19 aa, Plasmodium falciparum
NYEESIFCNEVIFYVICES

SEQ ID NO: 3369320 - protein, 19 aa, Plasmodium falciparum
NYEEYKYIVKYILPSIDDK

SEQ ID NO: 3369321 - protein, 23 aa, Plasmodium falciparum
NYEIKHLIGRGSYGYVYLAYDKN

SEQ ID NO: 3369322 - protein, 19 aa, Plasmodium falciparum
NYEIYTWLLTNCNMQTDEN

SEQ ID NO: 3369323 - protein, 25 aa, Plasmodium falciparum
NYEPELFAGLVYRYKPTSNLKSVIL

SEQ ID NO: 3369324 - protein, 25 aa, Plasmodium falciparum
NYEPNCKVYILAYLDNLRTRNINNN

SEQ ID NO: 3369325 - protein, 17 aa, Plasmodium falciparum
NYERGYCSDNVINYNNI

SEQ ID NO: 3369326 - protein, 21 aa, Plasmodium falciparum
NYFDIPKRESLFNKNSSFSKE

SEQ ID NO: 3369327 - protein, 17 aa, Plasmodium falciparum
NYFIKREIKTIMNATTN

SEQ ID NO: 3369328 - protein, 17 aa, Plasmodium falciparum
NYFKGFIIICEPYPEAT

SEQ ID NO: 3369329 - protein, 18 aa, Plasmodium falciparum
NYFKKQCKRSMPVCIYCH

SEQ ID NO: 3369330 - protein, 25 aa, Plasmodium falciparum
NYFKNELYEAMFISSSLFMIMDFKK

SEQ ID NO: 3369331 - protein, 24 aa, Plasmodium falciparum
NYFLNLKELQNIYASEKYGKSKKG

SEQ ID NO: 3369332 - protein, 19 aa, Plasmodium falciparum
NYFLRIYKFESMKLYRVYD

SEQ ID NO: 3369333 - protein, 31 aa, Plasmodium falciparum
NYFNNFKYNFSIKRYFKILVNVSLLNYLPLN

SEQ ID NO: 3369334 - protein, 18 aa, Plasmodium falciparum
NYFSIDIYDVSYKYKCHK

SEQ ID NO: 3369335 - protein, 22 aa, Plasmodium falciparum
NYFSKYGKIKCLNIVERKYLSN

SEQ ID NO: 3369336 - protein, 22 aa, Plasmodium falciparum
NYFTDLLNAFNFVNTPKEVGSF

SEQ ID NO: 3369337 - protein, 22 aa, Plasmodium falciparum
NYFYHFTQIISIEKTYFDLKTI

SEQ ID NO: 3369338 - protein, 18 aa, Plasmodium falciparum
NYFYLKRSDFDNLIDSLF

SEQ ID NO: 3369339 - protein, 25 aa, Plasmodium falciparum
NYFYYLHCFLYLIYHYNYFQNIIKY

SEQ ID NO: 3369340 - protein, 25 aa, Plasmodium falciparum
NYGLKKKITLLKRNDIKDEGYNNEN

SEQ ID NO: 3369341 - protein, 23 aa, Plasmodium falciparum
NYGNMEFKKDVLIQLKKNNFQTY

SEQ ID NO: 3369342 - protein, 23 aa, Plasmodium falciparum
NYGRISEDLLVYILDDVLNGLNY

SEQ ID NO: 3369343 - protein, 18 aa, Plasmodium falciparum
NYHFEKNNKNFIVPIQNN

SEQ ID NO: 3369344 - protein, 19 aa, Plasmodium falciparum
NYHLPCYYISLIEDDEECG

SEQ ID NO: 3369345 - protein, 24 aa, Plasmodium falciparum
NYICKKCRKSFCLPHRYSDVHNCI

SEQ ID NO: 3369346 - protein, 25 aa, Plasmodium falciparum
NYICQFGLSSLYKCKLKNENNSFLI

SEQ ID NO: 3369347 - protein, 23 aa, Plasmodium falciparum
NYIEEFPFYFSILFEDMFPFSLS

SEQ ID NO: 3369348 - protein, 26 aa, Plasmodium falciparum
NYIIKRLDAIPPYVVVNVFHNLIRSG

SEQ ID NO: 3369349 - protein, 23 aa, Plasmodium falciparum
NYIKCLKIILHISKDIPSDEFEK

SEQ ID NO: 3369350 - protein, 28 aa, Plasmodium falciparum
NYIKKIQRFPSQFIRYSYNGTALYSSCD

SEQ ID NO: 3369351 - protein, 23 aa, Plasmodium falciparum
NYIKNSICIIVVFDATNKESINP

SEQ ID NO: 3369352 - protein, 24 aa, Plasmodium falciparum
NYILKVLKFLKKVNIIQKLDNDTL

SEQ ID NO: 3369353 - protein, 26 aa, Plasmodium falciparum
NYILNRLSVFQVLKLLSSIVKMNIYD

SEQ ID NO: 3369354 - protein, 28 aa, Plasmodium falciparum
NYILYKLCLNLGKFNDAVLCTKNKTYNI

SEQ ID NO: 3369355 - protein, 25 aa, Plasmodium falciparum
NYINDFLIYIEKYIYSLNFYLPTQN

SEQ ID NO: 3369356 - protein, 29 aa, Plasmodium falciparum
NYIQKTCGVCLIFCFNPKISQKSLTSSTL

SEQ ID NO: 3369357 - protein, 24 aa, Plasmodium falciparum
NYIYKCDKINWGIKNLNINQKKAV

SEQ ID NO: 3369358 - protein, 20 aa, Plasmodium falciparum
NYIYRAIEVSRLFEEKVKSI

SEQ ID NO: 3369359 - protein, 19 aa, Plasmodium falciparum
NYIYRIGVHIADVSYFVKQ

SEQ ID NO: 3369360 - protein, 17 aa, Plasmodium falciparum
NYKCVFAATGALGMLSS

SEQ ID NO: 3369361 - protein, 25 aa, Plasmodium falciparum
NYKDSHICVLVKYISFGCSNFCTNK

SEQ ID NO: 3369362 - protein, 22 aa, Plasmodium falciparum
NYKEEIKTLILKEKEKKLNNHQ

SEQ ID NO: 3369363 - protein, 22 aa, Plasmodium falciparum
NYKFEFLGFVKYFYYFNNMSDF

SEQ ID NO: 3369364 - protein, 17 aa, Plasmodium falciparum
NYKFKLQNIDVMKKKKK

SEQ ID NO: 3369365 - protein, 20 aa, Plasmodium falciparum
NYKILFLCLQEIFNDKNIHD

SEQ ID NO: 3369366 - protein, 22 aa, Plasmodium falciparum
NYKKISGCLIHMYDHMENQKDH

SEQ ID NO: 3369367 - protein, 25 aa, Plasmodium falciparum
NYKKKKKSRYCDINDKLNFVKFNEK

SEQ ID NO: 3369368 - protein, 27 aa, Plasmodium falciparum
NYKKKSNMYGLFIINERLKCIYNNIEN

SEQ ID NO: 3369369 - protein, 27 aa, Plasmodium falciparum
NYKMKYKIFKKSVLYSNYYGPDIIHLF

SEQ ID NO: 3369370 - protein, 19 aa, Plasmodium falciparum
NYKNKCCISNEIELQQNNV

SEQ ID NO: 3369371 - protein, 23 aa, Plasmodium falciparum
NYKNLCKYYLSFINFDNNTSHIL

SEQ ID NO: 3369372 - protein, 23 aa, Plasmodium falciparum
NYKNQKLKCKIIPDNYNNLSYSQ

SEQ ID NO: 3369373 - protein, 21 aa, Plasmodium falciparum
NYKNTCRNIKNLIGKIGTDVK

SEQ ID NO: 3369374 - protein, 19 aa, Plasmodium falciparum
NYKNVILCKCYANNKYYDI

SEQ ID NO: 3369375 - protein, 21 aa, Plasmodium falciparum
NYKVCPRLEYKTISGVQGPLV

SEQ ID NO: 3369376 - protein, 21 aa, Plasmodium falciparum
NYKYELYHQLLAYNSFKKSGI

SEQ ID NO: 3369377 - protein, 26 aa, Plasmodium falciparum
NYLDRLTNLFKYLTLGVEKNNSTEKN

SEQ ID NO: 3369378 - protein, 22 aa, Plasmodium falciparum
NYLETFKDIYLVDFILLDNPKP

SEQ ID NO: 3369379 - protein, 23 aa, Plasmodium falciparum
NYLKKKKKKNFFNYHPINEANIY

SEQ ID NO: 3369380 - protein, 17 aa, Plasmodium falciparum
NYLPMICKPKRWENFEG

SEQ ID NO: 3369381 - protein, 20 aa, Plasmodium falciparum
NYLQNVWLFLFDNEVRKEND

SEQ ID NO: 3369382 - protein, 25 aa, Plasmodium falciparum
NYLSGRTRIPIKLDIRKRDLKNVGD

SEQ ID NO: 3369383 - protein, 23 aa, Plasmodium falciparum
NYLYKNIFFKKNYNINIDIIHQH

SEQ ID NO: 3369384 - protein, 24 aa, Plasmodium falciparum
NYMKDINNRLFVGTKIDNNTLNIN

SEQ ID NO: 3369385 - protein, 17 aa, Plasmodium falciparum
NYMKGKLIGNISPKIQR

SEQ ID NO: 3369386 - protein, 23 aa, Plasmodium falciparum
NYNCKKYAIHLAMEAVQTILKID

SEQ ID NO: 3369387 - protein, 20 aa, Plasmodium falciparum
NYNDAFVCLLEFSKYVNDED

SEQ ID NO: 3369388 - protein, 25 aa, Plasmodium falciparum
NYNEKGILCSASIETYLLAKSRVVD

SEQ ID NO: 3369389 - protein, 25 aa, Plasmodium falciparum
NYNFICSKIGIKREFNPMIDTQIVL

SEQ ID NO: 3369390 - protein, 32 aa, Plasmodium falciparum
NYNHKVKEYMCLQVEYEKCKEYLNRDKNKNVI

SEQ ID NO: 3369391 - protein, 33 aa, Plasmodium falciparum
NYNIPCEVESLSFFFHCCNINTYYWYKKEIDIN

SEQ ID NO: 3369392 - protein, 25 aa, Plasmodium falciparum
NYNKRIFKKDMENIMRKDNMYKNMG

SEQ ID NO: 3369393 - protein, 29 aa, Plasmodium falciparum
NYNLPFSPKLFIHRIGRACRTDISGYGIS

SEQ ID NO: 3369394 - protein, 27 aa, Plasmodium falciparum
NYNNCWKCTKGQYPIHNMTCTKIKKKK

SEQ ID NO: 3369395 - protein, 27 aa, Plasmodium falciparum
NYNNFFIKDCIVTFIFVDKDVYKGKLD

SEQ ID NO: 3369396 - protein, 24 aa, Plasmodium falciparum
NYNNGWCDKSSILSENRICNYNDI

SEQ ID NO: 3369397 - protein, 26 aa, Plasmodium falciparum
NYNNSVSSNLEWRKSDADKLKGFFDS

SEQ ID NO: 3369398 - protein, 27 aa, Plasmodium falciparum
NYNYYNIMKNYYFAFFLDLYKNNEDSK

SEQ ID NO: 3369399 - protein, 22 aa, Plasmodium falciparum
NYPENTIIYYLYTRENSSLNNN

SEQ ID NO: 3369400 - protein, 18 aa, Plasmodium falciparum
NYPFCTIDPHEAKVTVED

SEQ ID NO: 3369401 - protein, 18 aa, Plasmodium falciparum
NYPFNTHLYVCKKNKIIR

SEQ ID NO: 3369402 - protein, 24 aa, Plasmodium falciparum
NYQIIRLNFELMVSKIKDIVIIDK

SEQ ID NO: 3369403 - protein, 21 aa, Plasmodium falciparum
NYRIPDCSLTLLKNTFGYNEN

SEQ ID NO: 3369404 - protein, 32 aa, Plasmodium falciparum
NYRMRKEALETLGKCLSMFILYITDGAMEYCE

SEQ ID NO: 3369405 - protein, 24 aa, Plasmodium falciparum
NYRRNEGYVHNKIVYDIDVKFSSK

SEQ ID NO: 3369406 - protein, 19 aa, Plasmodium falciparum
NYSAITAPEKMNCPQMMAN

SEQ ID NO: 3369407 - protein, 23 aa, Plasmodium falciparum
NYSEYYKDILLKEGSQAFEKEEE

SEQ ID NO: 3369408 - protein, 26 aa, Plasmodium falciparum
NYSFFRYHFKSEWHKYNLKRKLLNLH

SEQ ID NO: 3369409 - protein, 39 aa, Plasmodium falciparum
NYSLSFCAHLFLIRALLQYPCFLKTFLNYNNFKATKIVK

SEQ ID NO: 3369410 - protein, 25 aa, Plasmodium falciparum
NYSRNFCYIKITFNKLGGMVLRDLF

SEQ ID NO: 3369411 - protein, 18 aa, Plasmodium falciparum
NYSRYFKNSCSLILSSGT

SEQ ID NO: 3369412 - protein, 24 aa, Plasmodium falciparum
NYSYFKIKTFLAMIKNNEDIDDTE

SEQ ID NO: 3369413 - protein, 17 aa, Plasmodium falciparum
NYTDIYGPVIYKKKKKN

SEQ ID NO: 3369414 - protein, 22 aa, Plasmodium falciparum
NYTKRFIFLTSLYNNIFNYSYN

SEQ ID NO: 3369415 - protein, 36 aa, Plasmodium falciparum
NYTSFTRKLPGGDEWNKRGYKLFVTKLNSATTIEKL

SEQ ID NO: 3369416 - protein, 23 aa, Plasmodium falciparum
NYVFELRDAILLTYSNIIYALID

SEQ ID NO: 3369417 - protein, 17 aa, Plasmodium falciparum
NYVKKCETNKCDIYITK

SEQ ID NO: 3369418 - protein, 27 aa, Plasmodium falciparum
NYVNRFQFRGGESFSEENHIGKAGDRY

SEQ ID NO: 3369419 - protein, 28 aa, Plasmodium falciparum
NYWNMILCKIPYYKSKYILKCFQEKLQK

SEQ ID NO: 3369420 - protein, 22 aa, Plasmodium falciparum
NYWYCPLCKRRGVTVDASLKRR

SEQ ID NO: 3369421 - protein, 24 aa, Plasmodium falciparum
NYYADFYLILFLHNEFTSLGGRDV

SEQ ID NO: 3369422 - protein, 25 aa, Plasmodium falciparum
NYYDCDKLTFTRIVNENTKETMKIF

SEQ ID NO: 3369423 - protein, 29 aa, Plasmodium falciparum
NYYFNRVCLPICLILAPTRELAVQIFYDA

SEQ ID NO: 3369424 - protein, 26 aa, Plasmodium falciparum
NYYFPEFNKSSLFYKNNNLYNISKKN

SEQ ID NO: 3369425 - protein, 29 aa, Plasmodium falciparum
NYYFYIPSDMKFELLLCGLNDKEKSVRES

SEQ ID NO: 3369426 - protein, 20 aa, Plasmodium falciparum
NYYLKMNMIYILIKKLKHTE

SEQ ID NO: 3369427 - protein, 31 aa, Plasmodium falciparum
NYYNFHILLNILRRKQLYHNSFNQLISKMTK

SEQ ID NO: 3369428 - protein, 21 aa, Plasmodium falciparum
NYYPKNIVKNNMLASQETNTK

SEQ ID NO: 3369429 - protein, 24 aa, Plasmodium falciparum
NYYPSFLFLSLIVEYKYIKDEETY

SEQ ID NO: 3369430 - protein, 22 aa, Plasmodium falciparum
NYYRLIKEIEFLERKENMKECI

SEQ ID NO: 3369431 - protein, 25 aa, Plasmodium falciparum
NYYSVKWINFINRKVPILLQNKSGP

SEQ ID NO: 3369432 - protein, 24 aa, Plasmodium falciparum
NYYYKGDTSIYYKMIGNQYNCGDN

SEQ ID NO: 3369433 - protein, 17 aa, Plasmodium falciparum
NYYYRKIALNIMNYDYE

SEQ ID NO: 3369434 - protein, 27 aa, Plasmodium falciparum
PADAVWEKISGVKFGPMILTAQSRTTN

SEQ ID NO: 3369435 - protein, 17 aa, Plasmodium falciparum
PAIRRLARRGGVKRISG

SEQ ID NO: 3369436 - protein, 19 aa, Plasmodium falciparum
PALCQQISYGGYRPKDKSK

SEQ ID NO: 3369437 - protein, 23 aa, Plasmodium falciparum
PALFNRCVIDWFGDWPYSALLQV

SEQ ID NO: 3369438 - protein, 17 aa, Plasmodium falciparum
PALLRPGRLDRKIEFPL

SEQ ID NO: 3369439 - protein, 22 aa, Plasmodium falciparum
PALSEFPSYVFYDGSLQNGITL

SEQ ID NO: 3369440 - protein, 20 aa, Plasmodium falciparum
PANVSYRIDHKVLIKHNLID

SEQ ID NO: 3369441 - protein, 21 aa, Plasmodium falciparum
PAPLLSRFDLFYTMLDCIDID

SEQ ID NO: 3369442 - protein, 20 aa, Plasmodium falciparum
PCHCSPCFDVKEGDIVTVGQ

SEQ ID NO: 3369443 - protein, 20 aa, Plasmodium falciparum
PCHTKGHILYYVYKTDEAKQ

SEQ ID NO: 3369444 - protein, 18 aa, Plasmodium falciparum
PCIYDWYFDNLNNVKKNK

SEQ ID NO: 3369445 - protein, 32 aa, Plasmodium falciparum
PCLHERTCKINEFITVCTICHDYINENMECKL

SEQ ID NO: 3369446 - protein, 22 aa, Plasmodium falciparum
PCLKEDPFTKKWLLQLLYNINN

SEQ ID NO: 3369447 - protein, 18 aa, Plasmodium falciparum
PCNLGIISSFYNLDYHII

SEQ ID NO: 3369448 - protein, 27 aa, Plasmodium falciparum
PCRIYEKFILSLLLKYKLIPQCFDLVK

SEQ ID NO: 3369449 - protein, 18 aa, Plasmodium falciparum
PCTIMVEACNPHFNNKSK

SEQ ID NO: 3369450 - protein, 18 aa, Plasmodium falciparum
PCVYVNKYINNIFQNNNP

SEQ ID NO: 3369451 - protein, 17 aa, Plasmodium falciparum
PDALVIWEAQFGDFANG

SEQ ID NO: 3369452 - protein, 20 aa, Plasmodium falciparum
PDCLPDICHTFFGLAALSLI

SEQ ID NO: 3369453 - protein, 21 aa, Plasmodium falciparum
PDCNDRNDFEFSIKNKVRGLL

SEQ ID NO: 3369454 - protein, 20 aa, Plasmodium falciparum
PDDEFPICILHGSIKISTSL

SEQ ID NO: 3369455 - protein, 33 aa, Plasmodium falciparum
PDDFLKYRMSLEKFIQFTIKEHIVYIMKDEKKK

SEQ ID NO: 3369456 - protein, 17 aa, Plasmodium falciparum
PDDLDLRNCYNIEMRKK

SEQ ID NO: 3369457 - protein, 20 aa, Plasmodium falciparum
PDDQFHFYAYSRLEKDIINL

SEQ ID NO: 3369458 - protein, 30 aa, Plasmodium falciparum
PDELRVKLLLKRKLICYDGFEPSGRMHIAQ

SEQ ID NO: 3369459 - protein, 25 aa, Plasmodium falciparum
PDFNIKRKNDKIIYAQMRRSQSDNL

SEQ ID NO: 3369460 - protein, 18 aa, Plasmodium falciparum
PDGYCFVLFMVDPDYPSR

SEQ ID NO: 3369461 - protein, 20 aa, Plasmodium falciparum
PDHCFNCSFYKQRHLCQKKM

SEQ ID NO: 3369462 - protein, 20 aa, Plasmodium falciparum
PDHVQKIIERREYFKNLNQS

SEQ ID NO: 3369463 - protein, 28 aa, Plasmodium falciparum
PDIFLYYKQLRFEGVELKTCCCKVNRLI

SEQ ID NO: 3369464 - protein, 17 aa, Plasmodium falciparum
PDIIHLFNQTKLNLSFY

SEQ ID NO: 3369465 - protein, 31 aa, Plasmodium falciparum
PDIKKYQFEPSMKFERIGKVCDFTMNSYQKN

SEQ ID NO: 3369466 - protein, 27 aa, Plasmodium falciparum
PDKCKIDKAAEAFHILTRAYEELQKDE

SEQ ID NO: 3369467 - protein, 35 aa, Plasmodium falciparum
PDKERLIKINLTFPIFFIICKSDGYEILNNRTYQG

SEQ ID NO: 3369468 - protein, 24 aa, Plasmodium falciparum
PDKKVFVITYSWKNLKDVNDKAMK

SEQ ID NO: 3369469 - protein, 20 aa, Plasmodium falciparum
PDKLPKLSLKTFGYLICDDC

SEQ ID NO: 3369470 - protein, 22 aa, Plasmodium falciparum
PDKNCNRSNSFTSNIDKESNDN

SEQ ID NO: 3369471 - protein, 24 aa, Plasmodium falciparum
PDLGARISILTAILRKCPVAENVP

SEQ ID NO: 3369472 - protein, 17 aa, Plasmodium falciparum
PDLPKTRSGKIVRRILR

SEQ ID NO: 3369473 - protein, 17 aa, Plasmodium falciparum
PDMGRKSLDKMASRRSY

SEQ ID NO: 3369474 - protein, 25 aa, Plasmodium falciparum
PDMKDKRYANNNMYDDFFTIENMEK

SEQ ID NO: 3369475 - protein, 20 aa, Plasmodium falciparum
PDNLKQLFRSFAMIEPNKQL

SEQ ID NO: 3369476 - protein, 17 aa, Plasmodium falciparum
PDNLLKNCISFCNEGIQ

SEQ ID NO: 3369477 - protein, 20 aa, Plasmodium falciparum
PDRIKCIIKALKEKKLINKM

SEQ ID NO: 3369478 - protein, 17 aa, Plasmodium falciparum
PDRLFPSFKREVIDKKP

SEQ ID NO: 3369479 - protein, 17 aa, Plasmodium falciparum
PDRLRQCTVSYMKRKHV

SEQ ID NO: 3369480 - protein, 18 aa, Plasmodium falciparum
PDVIRLILQYLKENNLIR

SEQ ID NO: 3369481 - protein, 17 aa, Plasmodium falciparum
PDVRNLYIFSRQELNSD

SEQ ID NO: 3369482 - protein, 26 aa, Plasmodium falciparum
PDYSSLDFPFPELLLQKREPKKNKTN

SEQ ID NO: 3369483 - protein, 21 aa, Plasmodium falciparum
PEAYLLNNYYLMFQQKLENQQ

SEQ ID NO: 3369484 - protein, 29 aa, Plasmodium falciparum
PEDLKIHNLPISRIKKIMKEDDEIKSNQM

SEQ ID NO: 3369485 - protein, 33 aa, Plasmodium falciparum
PEELYKIIEKFCLGRRKIELFGTNRNIRNGWLT

SEQ ID NO: 3369486 - protein, 17 aa, Plasmodium falciparum
PEFKDFLNLCLDKNPKK

SEQ ID NO: 3369487 - protein, 20 aa, Plasmodium falciparum
PEFMNEYKLYNEKVKHDNIN

SEQ ID NO: 3369488 - protein, 21 aa, Plasmodium falciparum
PEGFSRMCAINGGTFMLNKNV

SEQ ID NO: 3369489 - protein, 19 aa, Plasmodium falciparum
PEGSVCFAPSLAIVEIIEA

SEQ ID NO: 3369490 - protein, 21 aa, Plasmodium falciparum
PEIFIPLCVKYMAPRIIDQNN

SEQ ID NO: 3369491 - protein, 18 aa, Plasmodium falciparum
PEIFQRILIKYNINHMTT

SEQ ID NO: 3369492 - protein, 19 aa, Plasmodium falciparum
PEIFVNNAFILPFKEVNNS

SEQ ID NO: 3369493 - protein, 20 aa, Plasmodium falciparum
PEIIKKISVCEIVNVDIYKD

SEQ ID NO: 3369494 - protein, 18 aa, Plasmodium falciparum
PEIKKICRCHESNCSKSS

SEQ ID NO: 3369495 - protein, 22 aa, Plasmodium falciparum
PEILICTPGRLKYFLHLENPIK

SEQ ID NO: 3369496 - protein, 22 aa, Plasmodium falciparum
PEIPIQINSGLLKNYNGVKVTG

SEQ ID NO: 3369497 - protein, 19 aa, Plasmodium falciparum
PEKEFSDEVLLQMMRSIHN

SEQ ID NO: 3369498 - protein, 20 aa, Plasmodium falciparum
PEKLNLLLYEAIAHVISCFP

SEQ ID NO: 3369499 - protein, 24 aa, Plasmodium falciparum
PELGFFKKFIESFGGKVSKDKEFF

SEQ ID NO: 3369500 - protein, 20 aa, Plasmodium falciparum
PELISKVVVCIITAKINEQY

SEQ ID NO: 3369501 - protein, 22 aa, Plasmodium falciparum
PELLRNRFFSMYNKYQLRAINN

SEQ ID NO: 3369502 - protein, 19 aa, Plasmodium falciparum
PELLTLYIVKLNERDIVCK

SEQ ID NO: 3369503 - protein, 21 aa, Plasmodium falciparum
PELYIQKLGLNFSYYHLEPLI

SEQ ID NO: 3369504 - protein, 25 aa, Plasmodium falciparum
PENKEFIKDLLLNRQGEDIIQNLDN

SEQ ID NO: 3369505 - protein, 28 aa, Plasmodium falciparum
PENQKQLILKRSDITNMNFSNDSHKTID

SEQ ID NO: 3369506 - protein, 18 aa, Plasmodium falciparum
PEQILEVLHECLMVEAYR

SEQ ID NO: 3369507 - protein, 23 aa, Plasmodium falciparum
PEQPKRVLTEPGFYKHKNAIVHD

SEQ ID NO: 3369508 - protein, 22 aa, Plasmodium falciparum
PERAIQFRVCWLDDNGVQRKNR

SEQ ID NO: 3369509 - protein, 20 aa, Plasmodium falciparum
PERDCIKLPIKHSSTEEIGQ

SEQ ID NO: 3369510 - protein, 17 aa, Plasmodium falciparum
PERNFISGIDNTMYSDN

SEQ ID NO: 3369511 - protein, 24 aa, Plasmodium falciparum
PERRPKMALSVPHFVDKIIHLSML

SEQ ID NO: 3369512 - protein, 20 aa, Plasmodium falciparum
PESKPFCDLIVSGYKNQMMN

SEQ ID NO: 3369513 - protein, 20 aa, Plasmodium falciparum
PESLYIPNLLTNSLKYSKEL

SEQ ID NO: 3369514 - protein, 23 aa, Plasmodium falciparum
PESVFPFSVEAKSNMLAHKLNVL

SEQ ID NO: 3369515 - protein, 18 aa, Plasmodium falciparum
PETAESVDILVNWLNNIY

SEQ ID NO: 3369516 - protein, 24 aa, Plasmodium falciparum
PETFKKRDDSFLIYKESIKSFNNN

SEQ ID NO: 3369517 - protein, 18 aa, Plasmodium falciparum
PEYFKKYPIYYAGPAKTP

SEQ ID NO: 3369518 - protein, 20 aa, Plasmodium falciparum
PEYKIPNGYEILRINLEDIG

SEQ ID NO: 3369519 - protein, 20 aa, Plasmodium falciparum
PEYNCMRIHFDVLDSTQLFS

SEQ ID NO: 3369520 - protein, 25 aa, Plasmodium falciparum
PFDEILKLNFAYFFEKHALINQAHY

SEQ ID NO: 3369521 - protein, 27 aa, Plasmodium falciparum
PFDELKLDESIIFSLYIQKYFYCANIQ

SEQ ID NO: 3369522 - protein, 20 aa, Plasmodium falciparum
PFDIHICGFFVTNHFMGVLI

SEQ ID NO: 3369523 - protein, 25 aa, Plasmodium falciparum
PFDIRCDSWSLGIILADLAKCGVNS

SEQ ID NO: 3369524 - protein, 22 aa, Plasmodium falciparum
PFESLGKYIFCKAYRRIYKNNQ

SEQ ID NO: 3369525 - protein, 25 aa, Plasmodium falciparum
PFFIKGKVALIPKDINTFFDDEKKG

SEQ ID NO: 3369526 - protein, 21 aa, Plasmodium falciparum
PFFKIICMTDQKYVMDLINKK

SEQ ID NO: 3369527 - protein, 26 aa, Plasmodium falciparum
PFGKDWDFVINFDFDELFNQCENVIE

SEQ ID NO: 3369528 - protein, 32 aa, Plasmodium falciparum
PFHFKFKELSRIGGVLFVEGNENLGIFEFIKL

SEQ ID NO: 3369529 - protein, 18 aa, Plasmodium falciparum
PFHQCDYGGIISVDKKKI

SEQ ID NO: 3369530 - protein, 25 aa, Plasmodium falciparum
PFILNFKTVHAIKLLLHKNNQSISH

SEQ ID NO: 3369531 - protein, 25 aa, Plasmodium falciparum
PFIVRARCWKLALGYLPLNTDDTQK

SEQ ID NO: 3369532 - protein, 20 aa, Plasmodium falciparum
PFKRCIIKKIISLKKSNKKR

SEQ ID NO: 3369533 - protein, 20 aa, Plasmodium falciparum
PFLHELDVKYYLRIPMSTGW

SEQ ID NO: 3369534 - protein, 17 aa, Plasmodium falciparum
PFLLKNKIQNIFSAVCS

SEQ ID NO: 3369535 - protein, 19 aa, Plasmodium falciparum
PFLQEKRINNNYEENAKGD

SEQ ID NO: 3369536 - protein, 21 aa, Plasmodium falciparum
PFNSKAWISMINFELSLDEVE

SEQ ID NO: 3369537 - protein, 18 aa, Plasmodium falciparum
PFNSLRDVENLTYTNSEH

SEQ ID NO: 3369538 - protein, 18 aa, Plasmodium falciparum
PFPSPLTIRTYLSKRHHN

SEQ ID NO: 3369539 - protein, 19 aa, Plasmodium falciparum
PFSLFSNICEICINPHNSS

SEQ ID NO: 3369540 - protein, 18 aa, Plasmodium falciparum
PFYFISYSQDRFVTCLQF

SEQ ID NO: 3369541 - protein, 20 aa, Plasmodium falciparum
PFYFIYKPNKDMSMDHHHHN

SEQ ID NO: 3369542 - protein, 23 aa, Plasmodium falciparum
PFYINFDSIRIFDNVCKTFNITD

SEQ ID NO: 3369543 - protein, 21 aa, Plasmodium falciparum
PGCGKTFLCTNYFSTYIRINM

SEQ ID NO: 3369544 - protein, 19 aa, Plasmodium falciparum
PGDFRVLLKRARKEAIRYS

SEQ ID NO: 3369545 - protein, 17 aa, Plasmodium falciparum
PGDIILVDRACHKSHHY

SEQ ID NO: 3369546 - protein, 18 aa, Plasmodium falciparum
PGDVAPHANNHILKFSCQ

SEQ ID NO: 3369547 - protein, 18 aa, Plasmodium falciparum
PGERVKFSVIYDEKSNSS

SEQ ID NO: 3369548 - protein, 27 aa, Plasmodium falciparum
PGGSIGRLCIWSESAFKKLDVIYGKIH

SEQ ID NO: 3369549 - protein, 17 aa, Plasmodium falciparum
PGHIKIKKLSACECVLL

SEQ ID NO: 3369550 - protein, 23 aa, Plasmodium falciparum
PGIIKPGECKIGIMPSHIHKKGC

SEQ ID NO: 3369551 - protein, 19 aa, Plasmodium falciparum
PGKCYRLYTEEAYKNEMSE

SEQ ID NO: 3369552 - protein, 26 aa, Plasmodium falciparum
PGKNNFKSSIPMNVITQLKLWESERH

SEQ ID NO: 3369553 - protein, 18 aa, Plasmodium falciparum
PGLIERLHNSLKEKECFT

SEQ ID NO: 3369554 - protein, 17 aa, Plasmodium falciparum
PGLLLTHYSPFVSTYLL

SEQ ID NO: 3369555 - protein, 30 aa, Plasmodium falciparum
PGNDIWACGVILYVLMDGRFPYEINNYMPI

SEQ ID NO: 3369556 - protein, 26 aa, Plasmodium falciparum
PGNDNFICLMCSYVANELKMVCQKSE

SEQ ID NO: 3369557 - protein, 17 aa, Plasmodium falciparum
PGNFKKTHIYRESPHMK

SEQ ID NO: 3369558 - protein, 22 aa, Plasmodium falciparum
PGQIEVFNWSASGNIILETLSV

SEQ ID NO: 3369559 - protein, 24 aa, Plasmodium falciparum
PGRLFPVEIFYTLQAEKDYVKVVI

SEQ ID NO: 3369560 - protein, 23 aa, Plasmodium falciparum
PGSDLYYLTGWIPVTISLKSKIS

SEQ ID NO: 3369561 - protein, 21 aa, Plasmodium falciparum
PGSWKIKIGFAKDDFPNDEIP

SEQ ID NO: 3369562 - protein, 18 aa, Plasmodium falciparum
PGTNLTICKVCNGSGIQR

SEQ ID NO: 3369563 - protein, 20 aa, Plasmodium falciparum
PGYIPGKGRGVTGFSGGVSR

SEQ ID NO: 3369564 - protein, 19 aa, Plasmodium falciparum
PGYQAHSLLSNELSKFLPI

SEQ ID NO: 3369565 - protein, 25 aa, Plasmodium falciparum
PHANRYDKYYSLNMNIMNNMNNMNN

SEQ ID NO: 3369566 - protein, 20 aa, Plasmodium falciparum
PHASPLIIKHNTDHMINFKC

SEQ ID NO: 3369567 - protein, 27 aa, Plasmodium falciparum
PHDKLGRKVIIVICYQCNNRNITNIEC

SEQ ID NO: 3369568 - protein, 29 aa, Plasmodium falciparum
PHEREEIRLGKKLVVQNCGLYMDGNKNAG

SEQ ID NO: 3369569 - protein, 18 aa, Plasmodium falciparum
PHFYTHKHFIKFINKIKK

SEQ ID NO: 3369570 - protein, 21 aa, Plasmodium falciparum
PHGSSCLLPFTALGSGSLNAM

SEQ ID NO: 3369571 - protein, 17 aa, Plasmodium falciparum
PHIFSLRERIIVNDEPI

SEQ ID NO: 3369572 - protein, 23 aa, Plasmodium falciparum
PHIIGPIEYKKIYLKNLNSNEHE

SEQ ID NO: 3369573 - protein, 19 aa, Plasmodium falciparum
PHILLCAPLKNSPLLLNYT

SEQ ID NO: 3369574 - protein, 31 aa, Plasmodium falciparum
PHIRLYVPECTRFYIFLECSQEHSVNLRIFK

SEQ ID NO: 3369575 - protein, 29 aa, Plasmodium falciparum
PHKPNNCLWVGNILKNYFFNTANILKTMF

SEQ ID NO: 3369576 - protein, 21 aa, Plasmodium falciparum
PHLRFHKLWDSLYYEENIKRD

SEQ ID NO: 3369577 - protein, 22 aa, Plasmodium falciparum
PHLRFHKLWDSLYYEENIKRDL

SEQ ID NO: 3369578 - protein, 25 aa, Plasmodium falciparum
PHMPQYIIKAPWYLNQTKPGLKHQR

SEQ ID NO: 3369579 - protein, 18 aa, Plasmodium falciparum
PHNLKFGVLGIIHPKVLE

SEQ ID NO: 3369580 - protein, 19 aa, Plasmodium falciparum
PHNLYDFLFTTGIERENKT

SEQ ID NO: 3369581 - protein, 19 aa, Plasmodium falciparum
PHPPHLPHPPQLLNNTVNK

SEQ ID NO: 3369582 - protein, 23 aa, Plasmodium falciparum
PHPVLKPDGLLVGPNNKFFNPGK

SEQ ID NO: 3369583 - protein, 26 aa, Plasmodium falciparum
PHRLDKKLLELCKYSTLLYSELFDNM

SEQ ID NO: 3369584 - protein, 23 aa, Plasmodium falciparum
PHSQPAWKNAFFLLDNKYGGILH

SEQ ID NO: 3369585 - protein, 18 aa, Plasmodium falciparum
PHSRTKTSSLSWLSNQPT

SEQ ID NO: 3369586 - protein, 18 aa, Plasmodium falciparum
PHSSICYSSLTFDLSKDK

SEQ ID NO: 3369587 - protein, 21 aa, Plasmodium falciparum
PHSSVLWLMLAKQKWLNNEID

SEQ ID NO: 3369588 - protein, 21 aa, Plasmodium falciparum
PHSSVSLSHLLFVKAENNNIG

SEQ ID NO: 3369589 - protein, 22 aa, Plasmodium falciparum
PHTLEHLIFLGSHKYPYKGLLD

SEQ ID NO: 3369590 - protein, 25 aa, Plasmodium falciparum
PHTTIKCIIHPSVIFTILDAYLRRD

SEQ ID NO: 3369591 - protein, 34 aa, Plasmodium falciparum
PHYYWIPCFFENIIACFFKIWKSNYFIVNELLFT

SEQ ID NO: 3369592 - protein, 18 aa, Plasmodium falciparum
PIAPEFKPQNSLYIYQKI

SEQ ID NO: 3369593 - protein, 27 aa, Plasmodium falciparum
PIDANCLRYIGGIICSGNIKDVISKKN

SEQ ID NO: 3369594 - protein, 18 aa, Plasmodium falciparum
PIDDACSYNTQKNKKNKK

SEQ ID NO: 3369595 - protein, 18 aa, Plasmodium falciparum
PIDIFRTAIQIMKGEEDV

SEQ ID NO: 3369596 - protein, 18 aa, Plasmodium falciparum
PIDNCTKFIFTLLECASI

SEQ ID NO: 3369597 - protein, 26 aa, Plasmodium falciparum
PIDVLRWLDRKLIRLVSTFADYQKDD

SEQ ID NO: 3369598 - protein, 26 aa, Plasmodium falciparum
PIEKYVILQLCWKCCDIENNHFEYFN

SEQ ID NO: 3369599 - protein, 28 aa, Plasmodium falciparum
PIELVLFLPALCRLKEVPYCIVKDKATL

SEQ ID NO: 3369600 - protein, 23 aa, Plasmodium falciparum
PIEQVRIVPKLKVREVEKIRHVP

SEQ ID NO: 3369601 - protein, 25 aa, Plasmodium falciparum
PIFNPCGMYICRLHCNGIQRKIIID

SEQ ID NO: 3369602 - protein, 64 aa, Plasmodium falciparum
PIGKTVNIFYRWSRGPPRTVCFFHPQKIACLQCTVTFRCFCSYECFMKGFDHLHKYYKSNGSIN

SEQ ID NO: 3369603 - protein, 19 aa, Plasmodium falciparum
PIGSFPLNKITSIRTKVDN

SEQ ID NO: 3369604 - protein, 18 aa, Plasmodium falciparum
PIHKTIIFVNSIKDCIKI

SEQ ID NO: 3369605 - protein, 19 aa, Plasmodium falciparum
PIHSIKYDKAHTFFNNIRN

SEQ ID NO: 3369606 - protein, 17 aa, Plasmodium falciparum
PIIKYIIVTGGNMSGLG

SEQ ID NO: 3369607 - protein, 23 aa, Plasmodium falciparum
PIIRPNDKEGFLFNYEDDDYNNN

SEQ ID NO: 3369608 - protein, 25 aa, Plasmodium falciparum
PIKEKRILIWLTQILTALKFLHSNH

SEQ ID NO: 3369609 - protein, 23 aa, Plasmodium falciparum
PIKELKNSYLIFINTQKDTNNKY

SEQ ID NO: 3369610 - protein, 22 aa, Plasmodium falciparum
PIKITKGVCPSIHIYSVARMKG

SEQ ID NO: 3369611 - protein, 23 aa, Plasmodium falciparum
PIKKLCSKLHMSAEKIKKIENLT

SEQ ID NO: 3369612 - protein, 26 aa, Plasmodium falciparum
PILFPCCFVSSCSDCLANYIMNNINQ

SEQ ID NO: 3369613 - protein, 18 aa, Plasmodium falciparum
PIMLTWKPHLRYVNNSTQ

SEQ ID NO: 3369614 - protein, 20 aa, Plasmodium falciparum
PINLSLYVYADFYWFLIQLD

SEQ ID NO: 3369615 - protein, 18 aa, Plasmodium falciparum
PINYFGIAFNNRKEFTIR

SEQ ID NO: 3369616 - protein, 23 aa, Plasmodium falciparum
PIPKHPHGIVCVKFKGVEEAETV

SEQ ID NO: 3369617 - protein, 24 aa, Plasmodium falciparum
PIPPNRKFVNFPFDSSKKNNFLND

SEQ ID NO: 3369618 - protein, 24 aa, Plasmodium falciparum
PIPPPCARPYVQYGNQRSEDDLTL

SEQ ID NO: 3369619 - protein, 27 aa, Plasmodium falciparum
PIQLKGRMSRYLSCKSAMAARIDSFSD

SEQ ID NO: 3369620 - protein, 23 aa, Plasmodium falciparum
PISFEIRIGIVFLSRQAPGAMNV

SEQ ID NO: 3369621 - protein, 21 aa, Plasmodium falciparum
PISLKFCYGINNSLSSVHIVE

SEQ ID NO: 3369622 - protein, 19 aa, Plasmodium falciparum
PISNCLTLLLSISTLKEQS

SEQ ID NO: 3369623 - protein, 18 aa, Plasmodium falciparum
PIVSSRSYIPFPNMDGKN

SEQ ID NO: 3369624 - protein, 19 aa, Plasmodium falciparum
PIYKKRIAQGYIKRDFAKN

SEQ ID NO: 3369625 - protein, 18 aa, Plasmodium falciparum
PIYLSIFRLFEIRTDICE

SEQ ID NO: 3369626 - protein, 28 aa, Plasmodium falciparum
PIYMPNLSLLGNMNKKIFFGNINISGDN

SEQ ID NO: 3369627 - protein, 25 aa, Plasmodium falciparum
PKDDWVSDWGFSNVQYYIILINIAD

SEQ ID NO: 3369628 - protein, 18 aa, Plasmodium falciparum
PKDFIVLHDSIYVDHKSF

SEQ ID NO: 3369629 - protein, 20 aa, Plasmodium falciparum
PKDGLSLSMAFLVRGNINIS

SEQ ID NO: 3369630 - protein, 20 aa, Plasmodium falciparum
PKDIPILFVHSIHDCACYYG

SEQ ID NO: 3369631 - protein, 23 aa, Plasmodium falciparum
PKDKIPTAIYRISNLVNDLIFLL

SEQ ID NO: 3369632 - protein, 18 aa, Plasmodium falciparum
PKDLKWLCVKRNNRSWIL

SEQ ID NO: 3369633 - protein, 20 aa, Plasmodium falciparum
PKDLYFETFEEIDVFSYDKN

SEQ ID NO: 3369634 - protein, 18 aa, Plasmodium falciparum
PKDNYIKFIGYIQEWIVH

SEQ ID NO: 3369635 - protein, 23 aa, Plasmodium falciparum
PKEAFCIKTKILYSNQTSQKIFL

SEQ ID NO: 3369636 - protein, 21 aa, Plasmodium falciparum
PKEEILKAFRLFDDDETGKIS

SEQ ID NO: 3369637 - protein, 26 aa, Plasmodium falciparum
PKEGKELVETCYFSLMEAIKKCKPGM

SEQ ID NO: 3369638 - protein, 19 aa, Plasmodium falciparum
PKELEIMGNLEIYQYNIWL

SEQ ID NO: 3369639 - protein, 24 aa, Plasmodium falciparum
PKENEAFLKDMDYFFEKTDTLDLL

SEQ ID NO: 3369640 - protein, 19 aa, Plasmodium falciparum
PKETLKYESVIKIQSDYSK

SEQ ID NO: 3369641 - protein, 18 aa, Plasmodium falciparum
PKEVQALAKDLCKEQPIQ

SEQ ID NO: 3369642 - protein, 21 aa, Plasmodium falciparum
PKFKGNFLFSNNMKINVFFHQ

SEQ ID NO: 3369643 - protein, 25 aa, Plasmodium falciparum
PKFKIDRLKMLQIIFTDIYGRRILS

SEQ ID NO: 3369644 - protein, 17 aa, Plasmodium falciparum
PKFLRVGILSNQLIFKT

SEQ ID NO: 3369645 - protein, 19 aa, Plasmodium falciparum
PKFNEKLHAHILKHTLKKY

SEQ ID NO: 3369646 - protein, 20 aa, Plasmodium falciparum
PKFSSCIAGDKCIIPSIDTY

SEQ ID NO: 3369647 - protein, 19 aa, Plasmodium falciparum
PKFVPSNFKSPKCYNNSPV

SEQ ID NO: 3369648 - protein, 20 aa, Plasmodium falciparum
PKGAPNKHKIVFNGEADEKP

SEQ ID NO: 3369649 - protein, 17 aa, Plasmodium falciparum
PKGILLYGPPGCSKTLF

SEQ ID NO: 3369650 - protein, 23 aa, Plasmodium falciparum
PKGIPSQLAYFINCMKNAEIKED

SEQ ID NO: 3369651 - protein, 25 aa, Plasmodium falciparum
PKGIRLPCKLKWTVDNNSMVSSNQI

SEQ ID NO: 3369652 - protein, 17 aa, Plasmodium falciparum
PKGMPKPLYSFIKNKDL

SEQ ID NO: 3369653 - protein, 25 aa, Plasmodium falciparum
PKHSYEFYKNKILKIYDNGVQVEIQ

SEQ ID NO: 3369654 - protein, 18 aa, Plasmodium falciparum
PKIDININVDNNMCNNIA

SEQ ID NO: 3369655 - protein, 28 aa, Plasmodium falciparum
PKIDVELDCPPPLIVPYPAVHFHNTSEV

SEQ ID NO: 3369656 - protein, 26 aa, Plasmodium falciparum
PKILIEPEFSFTLTHLIKKIKGNITI

SEQ ID NO: 3369657 - protein, 17 aa, Plasmodium falciparum
PKINEWGDQSTLELLRQ

SEQ ID NO: 3369658 - protein, 19 aa, Plasmodium falciparum
PKIPVGIEKRERYKNSLRL

SEQ ID NO: 3369659 - protein, 24 aa, Plasmodium falciparum
PKIRLSKKYVELGCLGVWKLSSFK

SEQ ID NO: 3369660 - protein, 24 aa, Plasmodium falciparum
PKISEGVEKFFGFKFTGEGNDAEE

SEQ ID NO: 3369661 - protein, 18 aa, Plasmodium falciparum
PKISGSHNINMDDIKNSN

SEQ ID NO: 3369662 - protein, 17 aa, Plasmodium falciparum
PKIYGFFTLLTEAENDE

SEQ ID NO: 3369663 - protein, 21 aa, Plasmodium falciparum
PKIYNPLFITNDFRLKICYSN

SEQ ID NO: 3369664 - protein, 21 aa, Plasmodium falciparum
PKIYYHDNMHNLYPINNIPSN

SEQ ID NO: 3369665 - protein, 20 aa, Plasmodium falciparum
PKKALKLSFSQSSSKQSSEI

SEQ ID NO: 3369666 - protein, 21 aa, Plasmodium falciparum
PKKEAKYYMTLQKYTYKLHII

SEQ ID NO: 3369667 - protein, 35 aa, Plasmodium falciparum
PKKIFHDVWLPLGTLSAHWYKRLLDIRSMVEEKVS

SEQ ID NO: 3369668 - protein, 25 aa, Plasmodium falciparum
PKKIKRDDFLKFIGIKNKTNTIFFN

SEQ ID NO: 3369669 - protein, 20 aa, Plasmodium falciparum
PKKKFLIGAKPILPTCNEEL

SEQ ID NO: 3369670 - protein, 27 aa, Plasmodium falciparum
PKKKKSRRGWLCCGGGDIETVEPQQEE

SEQ ID NO: 3369671 - protein, 24 aa, Plasmodium falciparum
PKKKSWKKNVYFLRHNPDFMYSLY

SEQ ID NO: 3369672 - protein, 27 aa, Plasmodium falciparum
PKKSFLKGGVLLNRSDSFIKKGTKNVL

SEQ ID NO: 3369673 - protein, 22 aa, Plasmodium falciparum
PKKYRSNLYIKNKVNIYSIHSK

SEQ ID NO: 3369674 - protein, 17 aa, Plasmodium falciparum
PKLPITLDLPPQNIILK

SEQ ID NO: 3369675 - protein, 18 aa, Plasmodium falciparum
PKLTTFVEEIMKKNETQS

SEQ ID NO: 3369676 - protein, 25 aa, Plasmodium falciparum
PKLYNLYWGYSIEILKNLSDIFKLQ

SEQ ID NO: 3369677 - protein, 21 aa, Plasmodium falciparum
PKNFPEMYDVYILDKKELNKK

SEQ ID NO: 3369678 - protein, 19 aa, Plasmodium falciparum
PKNHMFPLLPSSPFFQPPN

SEQ ID NO: 3369679 - protein, 27 aa, Plasmodium falciparum
PKNIELLYKYIMHRLYNFPFNEKPILN

SEQ ID NO: 3369680 - protein, 18 aa, Plasmodium falciparum
PKNIPILFIHSINDCLCW

SEQ ID NO: 3369681 - protein, 18 aa, Plasmodium falciparum
PKPLYSFIKNKDLNRNPI

SEQ ID NO: 3369682 - protein, 19 aa, Plasmodium falciparum
PKQKMKFFTTKPLILDYFN

SEQ ID NO: 3369683 - protein, 22 aa, Plasmodium falciparum
PKQRYNELLNNLTLYFNKNKYE

SEQ ID NO: 3369684 - protein, 19 aa, Plasmodium falciparum
PKQSEWFDEEEIFDLPNNL

SEQ ID NO: 3369685 - protein, 19 aa, Plasmodium falciparum
PKQVFFIGMSCDIEHNITN

SEQ ID NO: 3369686 - protein, 24 aa, Plasmodium falciparum
PKRHYDLLCRILFIYAKIHPYVKY

SEQ ID NO: 3369687 - protein, 26 aa, Plasmodium falciparum
PKRNRIKTLRYWIGERELTERNPYTG

SEQ ID NO: 3369688 - protein, 22 aa, Plasmodium falciparum
PKRREIKITKLVETLLENKPSS

SEQ ID NO: 3369689 - protein, 17 aa, Plasmodium falciparum
PKSDEKNDEILNFYEQM

SEQ ID NO: 3369690 - protein, 20 aa, Plasmodium falciparum
PKSKALPILLKKNISIPKEK

SEQ ID NO: 3369691 - protein, 24 aa, Plasmodium falciparum
PKSMKKKYLFRIFKSTKFFQCTEM

SEQ ID NO: 3369692 - protein, 24 aa, Plasmodium falciparum
PKTKEGYLYRCIFSECFPEQCAQE

SEQ ID NO: 3369693 - protein, 24 aa, Plasmodium falciparum
PKVRSVFRLLRLLQVHNGVFVKVN

SEQ ID NO: 3369694 - protein, 19 aa, Plasmodium falciparum
PKWCSSPKEFLIFMKNALE

SEQ ID NO: 3369695 - protein, 20 aa, Plasmodium falciparum
PKWLSLTYAIFICLNCSGKH

SEQ ID NO: 3369696 - protein, 17 aa, Plasmodium falciparum
PKYKMFIEVVLEPSKRD

SEQ ID NO: 3369697 - protein, 19 aa, Plasmodium falciparum
PKYLCTTIRRNVYTELNKI

SEQ ID NO: 3369698 - protein, 21 aa, Plasmodium falciparum
PKYVKYNTIHREIMNPRQHFF

SEQ ID NO: 3369699 - protein, 21 aa, Plasmodium falciparum
PLCDYCSDAPAILYCESDEVK

SEQ ID NO: 3369700 - protein, 19 aa, Plasmodium falciparum
PLCEYKYTGYFFKHKMDEL

SEQ ID NO: 3369701 - protein, 17 aa, Plasmodium falciparum
PLCNPFFMHKHKPLIFL

SEQ ID NO: 3369702 - protein, 22 aa, Plasmodium falciparum
PLDEGKSLINYGRNENVNENNK

SEQ ID NO: 3369703 - protein, 47 aa, Plasmodium falciparum
PLDELGNCFHRCLYVFICIHCGDQAKCFRTQLPRNNPFYNYYLQDSN

SEQ ID NO: 3369704 - protein, 23 aa, Plasmodium falciparum
PLDMKMHSNIYLYDLFKKTNKES

SEQ ID NO: 3369705 - protein, 27 aa, Plasmodium falciparum
PLELIGVYIKYCRKYIFPKLSEDAKKY

SEQ ID NO: 3369706 - protein, 20 aa, Plasmodium falciparum
PLETYIFMGPIYYQKLKHMV

SEQ ID NO: 3369707 - protein, 20 aa, Plasmodium falciparum
PLEWCEPKILIQLHALSILE

SEQ ID NO: 3369708 - protein, 19 aa, Plasmodium falciparum
PLFDFIKNYIFYGKVKDTY

SEQ ID NO: 3369709 - protein, 24 aa, Plasmodium falciparum
PLFFRCREGFLYRCGECDQIFMHV

SEQ ID NO: 3369710 - protein, 19 aa, Plasmodium falciparum
PLFFRPKIRGAIQEYQNTL

SEQ ID NO: 3369711 - protein, 19 aa, Plasmodium falciparum
PLFQKRKLTTFALRKKYIW

SEQ ID NO: 3369712 - protein, 30 aa, Plasmodium falciparum
PLFYKELQELLNLICYHCYNFCCSEDVIFL

SEQ ID NO: 3369713 - protein, 38 aa, Plasmodium falciparum
PLICPCDCKGSIKYAHLMCLRKWINGRLNLNDQLFSGS

SEQ ID NO: 3369714 - protein, 18 aa, Plasmodium falciparum
PLIDRSLIGKFSVEKYKS

SEQ ID NO: 3369715 - protein, 24 aa, Plasmodium falciparum
PLKKKKIINYLCSYGNKKLNDPPD

SEQ ID NO: 3369716 - protein, 18 aa, Plasmodium falciparum
PLKNIKNNFILKNIHNNN

SEQ ID NO: 3369717 - protein, 18 aa, Plasmodium falciparum
PLLHRLIKENIIKEKFIK

SEQ ID NO: 3369718 - protein, 29 aa, Plasmodium falciparum
PLLPFEQLLCVLPANSSHCLPKMYKQLML

SEQ ID NO: 3369719 - protein, 17 aa, Plasmodium falciparum
PLLVYKMCQGINNLHNI

SEQ ID NO: 3369720 - protein, 20 aa, Plasmodium falciparum
PLNFKHTYKLLYINENNHTL

SEQ ID NO: 3369721 - protein, 20 aa, Plasmodium falciparum
PLNLPDPYINKQVYERILKL

SEQ ID NO: 3369722 - protein, 19 aa, Plasmodium falciparum
PLNNMELFISKNNVGTRNV

SEQ ID NO: 3369723 - protein, 27 aa, Plasmodium falciparum
PLNYQSKGGAMAIILIGTDTTYGPVKN

SEQ ID NO: 3369724 - protein, 19 aa, Plasmodium falciparum
PLPNYYMLHCYNIKNYQDF

SEQ ID NO: 3369725 - protein, 19 aa, Plasmodium falciparum
PLQDCCWNDNNVLSVSENG

SEQ ID NO: 3369726 - protein, 17 aa, Plasmodium falciparum
PLRKIRPIRQLRQLRKI

SEQ ID NO: 3369727 - protein, 26 aa, Plasmodium falciparum
PLSASTVRFVFESAKNFKPNLNCYHY

SEQ ID NO: 3369728 - protein, 22 aa, Plasmodium falciparum
PLSCSTCRVCIEKYPKKISFQK

SEQ ID NO: 3369729 - protein, 18 aa, Plasmodium falciparum
PLSKEKRNSVVVEKRIIP

SEQ ID NO: 3369730 - protein, 26 aa, Plasmodium falciparum
PLSKIKRRIIEIYGSVKKGIFINDQV

SEQ ID NO: 3369731 - protein, 21 aa, Plasmodium falciparum
PLTEYLNKWKQLKELNNSNNY

SEQ ID NO: 3369732 - protein, 20 aa, Plasmodium falciparum
PLTHPELYEDIGIKPPKGVI

SEQ ID NO: 3369733 - protein, 27 aa, Plasmodium falciparum
PLTVMLRKSNWPVFTNFICSFSNAWLE

SEQ ID NO: 3369734 - protein, 18 aa, Plasmodium falciparum
PLVPRLTAYCMSLIDSLN

SEQ ID NO: 3369735 - protein, 26 aa, Plasmodium falciparum
PLVYFRSANNFLLMFQINAMIILEER

SEQ ID NO: 3369736 - protein, 25 aa, Plasmodium falciparum
PLVYYKIYVCNIHKDFIFDYYFKGK

SEQ ID NO: 3369737 - protein, 19 aa, Plasmodium falciparum
PLYEFENFSFYFLNKNNKK

SEQ ID NO: 3369738 - protein, 25 aa, Plasmodium falciparum
PLYFNRIKTSFDWNKYNKTHYDYEN

SEQ ID NO: 3369739 - protein, 18 aa, Plasmodium falciparum
PLYIEVKGLLEVINAQDF

SEQ ID NO: 3369740 - protein, 19 aa, Plasmodium falciparum
PLYNITWRRIIIDEAHVIK

SEQ ID NO: 3369741 - protein, 18 aa, Plasmodium falciparum
PLYVCKRPYIDLFFSSLY

SEQ ID NO: 3369742 - protein, 17 aa, Plasmodium falciparum
PMEELHLSHNLIQDNAC

SEQ ID NO: 3369743 - protein, 19 aa, Plasmodium falciparum
PMEKMHYIFFYSSDDVHMT

SEQ ID NO: 3369744 - protein, 25 aa, Plasmodium falciparum
PMICKPKRWENFEGGMLLLKNSFIR

SEQ ID NO: 3369745 - protein, 18 aa, Plasmodium falciparum
PMIPELIYSMLACVRIGA

SEQ ID NO: 3369746 - protein, 26 aa, Plasmodium falciparum
PMNNSAVFWLCKWIKQREKEIKNDIK

SEQ ID NO: 3369747 - protein, 23 aa, Plasmodium falciparum
PMNPIGMPFMPGLLPNMNTCDYY

SEQ ID NO: 3369748 - protein, 27 aa, Plasmodium falciparum
PMYFTSHLKAFILLQAHIHRYSLPLNY

SEQ ID NO: 3369749 - protein, 23 aa, Plasmodium falciparum
PNAGSEKIYAWTVKDFAEEPKIE

SEQ ID NO: 3369750 - protein, 19 aa, Plasmodium falciparum
PNCAQTLVIRHMYDNPPIA

SEQ ID NO: 3369751 - protein, 23 aa, Plasmodium falciparum
PNCKSRITEMFFLSLENDIQIED

SEQ ID NO: 3369752 - protein, 26 aa, Plasmodium falciparum
PNDIKTFYLSYMYKYIQYVLKKREYP

SEQ ID NO: 3369753 - protein, 26 aa, Plasmodium falciparum
PNDIPLKLYIGGLLGPLSNITEQELK

SEQ ID NO: 3369754 - protein, 24 aa, Plasmodium falciparum
PNDIRGCSYFFGYNAATTFLEKNG

SEQ ID NO: 3369755 - protein, 19 aa, Plasmodium falciparum
PNEDLRNIWSHAVGVANEG

SEQ ID NO: 3369756 - protein, 19 aa, Plasmodium falciparum
PNELAKLFEYISGSDEYEQ

SEQ ID NO: 3369757 - protein, 20 aa, Plasmodium falciparum
PNELKDIIKQLLHVEQRKKL

SEQ ID NO: 3369758 - protein, 19 aa, Plasmodium falciparum
PNEQVMFMSPQEEKYIYMN

SEQ ID NO: 3369759 - protein, 18 aa, Plasmodium falciparum
PNEYYPNIHSIKFLNNNS

SEQ ID NO: 3369760 - protein, 18 aa, Plasmodium falciparum
PNFHLADLFYLLQLPNIS

SEQ ID NO: 3369761 - protein, 23 aa, Plasmodium falciparum
PNFKLWNYQEVYTYLKQNNISIG

SEQ ID NO: 3369762 - protein, 20 aa, Plasmodium falciparum
PNFNSLCEMLAKRLQNEKFD

SEQ ID NO: 3369763 - protein, 19 aa, Plasmodium falciparum
PNFYICGNGYIAPLDIKNL

SEQ ID NO: 3369764 - protein, 20 aa, Plasmodium falciparum
PNGACYKYSGIVIGKNKEMF

SEQ ID NO: 3369765 - protein, 17 aa, Plasmodium falciparum
PNGFIFFERSNKYSPED

SEQ ID NO: 3369766 - protein, 18 aa, Plasmodium falciparum
PNHWKEIYSQTGDSLSSP

SEQ ID NO: 3369767 - protein, 19 aa, Plasmodium falciparum
PNIDLKMLDEFLSSSNNNS

SEQ ID NO: 3369768 - protein, 18 aa, Plasmodium falciparum
PNIHGEFMSEKTNEEKIS

SEQ ID NO: 3369769 - protein, 18 aa, Plasmodium falciparum
PNIHSIKFLNNNSSNNNS

SEQ ID NO: 3369770 - protein, 17 aa, Plasmodium falciparum
PNINVGRNSFYGKTLDP

SEQ ID NO: 3369771 - protein, 21 aa, Plasmodium falciparum
PNIPNLPGIVPHNINNSHFMS

SEQ ID NO: 3369772 - protein, 39 aa, Plasmodium falciparum
PNIYHKIITGCCIPNITVFPNYNITCFKNYNHTNPQNQF

SEQ ID NO: 3369773 - protein, 19 aa, Plasmodium falciparum
PNKDIKLYFNISDTHYNSN

SEQ ID NO: 3369774 - protein, 27 aa, Plasmodium falciparum
PNKGYRYKFDVCITTPSILNSVSDVEL

SEQ ID NO: 3369775 - protein, 32 aa, Plasmodium falciparum
PNKLFSEQMSKLNIFGNINIDIEKLRKSLNKN

SEQ ID NO: 3369776 - protein, 24 aa, Plasmodium falciparum
PNKNVESINKFNHIYNMQNFNHFI

SEQ ID NO: 3369777 - protein, 22 aa, Plasmodium falciparum
PNKNYCIYDEEIILNDVLQNEK

SEQ ID NO: 3369778 - protein, 25 aa, Plasmodium falciparum
PNKYKSNIDDIFFFKEQSSLYKLSQ

SEQ ID NO: 3369779 - protein, 30 aa, Plasmodium falciparum
PNLFSAAKKEVFPGFSTGIIGNNTSNNSNI

SEQ ID NO: 3369780 - protein, 29 aa, Plasmodium falciparum
PNLHTYGVPCSPFDWDNYEKNIEFDEKHY

SEQ ID NO: 3369781 - protein, 20 aa, Plasmodium falciparum
PNLTEGVIIFGGKCLYNNSI

SEQ ID NO: 3369782 - protein, 24 aa, Plasmodium falciparum
PNNKQCYRIRGFLTEPKKVRCSLL

SEQ ID NO: 3369783 - protein, 23 aa, Plasmodium falciparum
PNNRLRQIFYRKLYVYPGALHPH

SEQ ID NO: 3369784 - protein, 19 aa, Plasmodium falciparum
PNPYISQSFVASDEEEEEE

SEQ ID NO: 3369785 - protein, 25 aa, Plasmodium falciparum
PNQKYMCLNDWIYFIMNYEDMTTNR

SEQ ID NO: 3369786 - protein, 19 aa, Plasmodium falciparum
PNRGKFVYKENPNIPNYTN

SEQ ID NO: 3369787 - protein, 17 aa, Plasmodium falciparum
PNRSRQYNNRSANNKGN

SEQ ID NO: 3369788 - protein, 23 aa, Plasmodium falciparum
PNSPNLPNCFTYVNNQTDILISN

SEQ ID NO: 3369789 - protein, 29 aa, Plasmodium falciparum
PNSQESLKWLNGEINLICFSQMNAGANQT

SEQ ID NO: 3369790 - protein, 22 aa, Plasmodium falciparum
PNTICNMTCNFFVSVNNCHILE

SEQ ID NO: 3369791 - protein, 18 aa, Plasmodium falciparum
PNTLIRCNSLDYILRYKN

SEQ ID NO: 3369792 - protein, 22 aa, Plasmodium falciparum
PNVKTYLLLLSRFYECTYETVD

SEQ ID NO: 3369793 - protein, 22 aa, Plasmodium falciparum
PNVLNSSNFVKVNIPYNLSNND

SEQ ID NO: 3369794 - protein, 25 aa, Plasmodium falciparum
PNVYLKRANDIIGFNNNNNNNNNNN

SEQ ID NO: 3369795 - protein, 19 aa, Plasmodium falciparum
PNYCLKKKYGTNQMKNAVH

SEQ ID NO: 3369796 - protein, 24 aa, Plasmodium falciparum
PNYCYRCGNCASLMLVDEFMEKDF

SEQ ID NO: 3369797 - protein, 18 aa, Plasmodium falciparum
PNYLCGNIHISSPTNYTR

SEQ ID NO: 3369798 - protein, 29 aa, Plasmodium falciparum
PNYRKELFEFLPNVKIIDCYNKEGMEVLS

SEQ ID NO: 3369799 - protein, 20 aa, Plasmodium falciparum
PNYVMVLLFLTVYKDVLKMN

SEQ ID NO: 3369800 - protein, 19 aa, Plasmodium falciparum
PPDAIKFIRDNMCSDEDLP

SEQ ID NO: 3369801 - protein, 17 aa, Plasmodium falciparum
PPDYPFKPPKIIFTTKI

SEQ ID NO: 3369802 - protein, 22 aa, Plasmodium falciparum
PPEGDPAFTTVFTDINMDVFEK

SEQ ID NO: 3369803 - protein, 30 aa, Plasmodium falciparum
PPEIFEKIEEFIIFIGKYIDKFCSICKDME

SEQ ID NO: 3369804 - protein, 19 aa, Plasmodium falciparum
PPFKAVDEKLHFSVLENDL

SEQ ID NO: 3369805 - protein, 28 aa, Plasmodium falciparum
PPICESFLRYVLDIIILNPLHDIILSYD

SEQ ID NO: 3369806 - protein, 23 aa, Plasmodium falciparum
PPKGLKMAVTFVGNSTAIQEMFK

SEQ ID NO: 3369807 - protein, 18 aa, Plasmodium falciparum
PPKIKVESFKERKEKKKK

SEQ ID NO: 3369808 - protein, 21 aa, Plasmodium falciparum
PPKNVKGALAVGKTKFSKLTK

SEQ ID NO: 3369809 - protein, 26 aa, Plasmodium falciparum
PPLHPKKDHWFFGPKEDFKKQEDNKD

SEQ ID NO: 3369810 - protein, 20 aa, Plasmodium falciparum
PPNMKCFWSGKPAKRWCLFG

SEQ ID NO: 3369811 - protein, 19 aa, Plasmodium falciparum
PPPDHKWAIEYKQAHYTPG

SEQ ID NO: 3369812 - protein, 25 aa, Plasmodium falciparum
PPPPKMKLSNLMRVMGDTALAQPSK

SEQ ID NO: 3369813 - protein, 22 aa, Plasmodium falciparum
PPPQLPHTGPLSMTSLDPHFMS

SEQ ID NO: 3369814 - protein, 19 aa, Plasmodium falciparum
PPPSEKILTIFGKKENKKK

SEQ ID NO: 3369815 - protein, 26 aa, Plasmodium falciparum
PPSRFRENLKAWDLFVKLTSSNPIER

SEQ ID NO: 3369816 - protein, 23 aa, Plasmodium falciparum
PPSRKRGTCINKQINNINKNIVS

SEQ ID NO: 3369817 - protein, 17 aa, Plasmodium falciparum
PPYCSSKIFGFNVYHNF

SEQ ID NO: 3369818 - protein, 19 aa, Plasmodium falciparum
PPYEQFSSFPYHNEEVELL

SEQ ID NO: 3369819 - protein, 34 aa, Plasmodium falciparum
PQDKVKIGVHIVGKLLRKLIHDVTYYRDEEERNK

SEQ ID NO: 3369820 - protein, 17 aa, Plasmodium falciparum
PQEVLVELLSLKKDITN

SEQ ID NO: 3369821 - protein, 17 aa, Plasmodium falciparum
PQIIEDININKNNNNNI

SEQ ID NO: 3369822 - protein, 26 aa, Plasmodium falciparum
PQIVTLLRFFFEKRLSMNDLENKSEH

SEQ ID NO: 3369823 - protein, 25 aa, Plasmodium falciparum
PQKFIKYNLLYIIKNQRKIFFPLHV

SEQ ID NO: 3369824 - protein, 23 aa, Plasmodium falciparum
PQKKYRATLVLKNGIYEVIETNP

SEQ ID NO: 3369825 - protein, 24 aa, Plasmodium falciparum
PQKLRWMAEWAEWYCKVQSQEYDK

SEQ ID NO: 3369826 - protein, 24 aa, Plasmodium falciparum
PQKNIWVKNIHNLSHGYYINNLKI

SEQ ID NO: 3369827 - protein, 23 aa, Plasmodium falciparum
PQKPLVCTKVMEYLRFRELPAGI

SEQ ID NO: 3369828 - protein, 19 aa, Plasmodium falciparum
PQKSVNLGNKIKVRSKTMN

SEQ ID NO: 3369829 - protein, 19 aa, Plasmodium falciparum
PQLMPLKPPYMLSLQKKRQ

SEQ ID NO: 3369830 - protein, 18 aa, Plasmodium falciparum
PQNINIDMMLYKFQNSVN

SEQ ID NO: 3369831 - protein, 23 aa, Plasmodium falciparum
PQNQFTIMTWNVLAEIYGTIEAF

SEQ ID NO: 3369832 - protein, 19 aa, Plasmodium falciparum
PQQRCNLISVFNKQKNHKN

SEQ ID NO: 3369833 - protein, 20 aa, Plasmodium falciparum
PQRFRWMTEWSEYYCKALKV

SEQ ID NO: 3369834 - protein, 26 aa, Plasmodium falciparum
PQSHILKAEHYNFFELSKYDIISHFK

SEQ ID NO: 3369835 - protein, 27 aa, Plasmodium falciparum
PQSSILKILWFGYVDICKCILKNRDGY

SEQ ID NO: 3369836 - protein, 40 aa, Plasmodium falciparum
PQVKIVKVSCGKRIIGFLSASGKIYCWHLNELNDFDKNVP

SEQ ID NO: 3369837 - protein, 24 aa, Plasmodium falciparum
PQVRSIIDFIAIKKAQSLQWGDHI

SEQ ID NO: 3369838 - protein, 19 aa, Plasmodium falciparum
PQVVKRCRLEEIINKKRYK

SEQ ID NO: 3369839 - protein, 18 aa, Plasmodium falciparum
PRDICSGLRNKKNAEDLL

SEQ ID NO: 3369840 - protein, 22 aa, Plasmodium falciparum
PRDWLIEGRIRIKLPNQNNDIL

SEQ ID NO: 3369841 - protein, 19 aa, Plasmodium falciparum
PREAFKVMQQPERIIDNRV

SEQ ID NO: 3369842 - protein, 17 aa, Plasmodium falciparum
PRFKQGKHHTVMYLQSY

SEQ ID NO: 3369843 - protein, 20 aa, Plasmodium falciparum
PRFYGDHLKRKCNYNKKKRY

SEQ ID NO: 3369844 - protein, 17 aa, Plasmodium falciparum
PRGDTIINRDFRGDIIK

SEQ ID NO: 3369845 - protein, 21 aa, Plasmodium falciparum
PRGDYGYISCWVHIECSKKIL

SEQ ID NO: 3369846 - protein, 27 aa, Plasmodium falciparum
PRHGRYLTACAMFRGRMSTKEVDEQML

SEQ ID NO: 3369847 - protein, 18 aa, Plasmodium falciparum
PRHGSLGFLPRKRCKRLR

SEQ ID NO: 3369848 - protein, 17 aa, Plasmodium falciparum
PRIFYFLRKHIKKVDSK

SEQ ID NO: 3369849 - protein, 18 aa, Plasmodium falciparum
PRILNPIVLCLQEIDELY

SEQ ID NO: 3369850 - protein, 17 aa, Plasmodium falciparum
PRLDGGINYIIKELDEI

SEQ ID NO: 3369851 - protein, 18 aa, Plasmodium falciparum
PRLKPRKLTIEIIPEEYT

SEQ ID NO: 3369852 - protein, 29 aa, Plasmodium falciparum
PRMRSGKTLPSFHRYDYGARSCGLITDCF

SEQ ID NO: 3369853 - protein, 22 aa, Plasmodium falciparum
PRPITASSIPGLLSIFQTEWDS

SEQ ID NO: 3369854 - protein, 21 aa, Plasmodium falciparum
PRPQMSSCFLLSMKADSIEGI

SEQ ID NO: 3369855 - protein, 19 aa, Plasmodium falciparum
PRRHDSSLEVLKKNIKDLL

SEQ ID NO: 3369856 - protein, 19 aa, Plasmodium falciparum
PRRKSVEVILVEKKLKKKK

SEQ ID NO: 3369857 - protein, 23 aa, Plasmodium falciparum
PRSNKIESCLGYNVEKKYVVMNE

SEQ ID NO: 3369858 - protein, 19 aa, Plasmodium falciparum
PRSSLRILQHGLSIEELAD

SEQ ID NO: 3369859 - protein, 19 aa, Plasmodium falciparum
PRYFAKLNLIYSTEKKEDC

SEQ ID NO: 3369860 - protein, 17 aa, Plasmodium falciparum
PSAYTMLQHPWLNMVSL

SEQ ID NO: 3369861 - protein, 18 aa, Plasmodium falciparum
PSDEFCYVHQSLYELNKL

SEQ ID NO: 3369862 - protein, 19 aa, Plasmodium falciparum
PSDIFIYIHRIGRCSSVNS

SEQ ID NO: 3369863 - protein, 21 aa, Plasmodium falciparum
PSDMSTCYPQMILKGHTNEGS

SEQ ID NO: 3369864 - protein, 24 aa, Plasmodium falciparum
PSDRRCYRMVGEVLVERTVGEIKP

SEQ ID NO: 3369865 - protein, 34 aa, Plasmodium falciparum
PSDYFYFACTTLRRLGWIFGEIEILSSLNHNQNN

SEQ ID NO: 3369866 - protein, 26 aa, Plasmodium falciparum
PSEILCMPGDLILLMSDGVSDNLFDE

SEQ ID NO: 3369867 - protein, 21 aa, Plasmodium falciparum
PSENVLNEFAIKCKTLDTKLI

SEQ ID NO: 3369868 - protein, 21 aa, Plasmodium falciparum
PSGCYFNWMATCVGKDYQNNM

SEQ ID NO: 3369869 - protein, 20 aa, Plasmodium falciparum
PSGRRRLRVTTISYRFAEPN

SEQ ID NO: 3369870 - protein, 17 aa, Plasmodium falciparum
PSHGYVPDGRFIQDDNR

SEQ ID NO: 3369871 - protein, 19 aa, Plasmodium falciparum
PSHIYKPNLLFDIKELNLE

SEQ ID NO: 3369872 - protein, 17 aa, Plasmodium falciparum
PSILLNDHMNEWSQNKS

SEQ ID NO: 3369873 - protein, 26 aa, Plasmodium falciparum
PSILQKLHDGIYCLKDNNKKKNNDGD

SEQ ID NO: 3369874 - protein, 21 aa, Plasmodium falciparum
PSIQSRSEFIIKRVQLKLKLY

SEQ ID NO: 3369875 - protein, 18 aa, Plasmodium falciparum
PSIYERMDYLISLINSYH

SEQ ID NO: 3369876 - protein, 18 aa, Plasmodium falciparum
PSKFEGIKKKLFLKKRLF

SEQ ID NO: 3369877 - protein, 24 aa, Plasmodium falciparum
PSKILWRCVRGMLPHKTYKGQLAL

SEQ ID NO: 3369878 - protein, 33 aa, Plasmodium falciparum
PSKKKLMPWFENFKLRIIFIKEWISKIRNNIFL

SEQ ID NO: 3369879 - protein, 19 aa, Plasmodium falciparum
PSKRHSHTGIFLKNKLYIY

SEQ ID NO: 3369880 - protein, 30 aa, Plasmodium falciparum
PSKRYGHSLDFLYPHLVLFGGNEEICDEDN

SEQ ID NO: 3369881 - protein, 18 aa, Plasmodium falciparum
PSKSILPAQLFKNVKHTQ

SEQ ID NO: 3369882 - protein, 26 aa, Plasmodium falciparum
PSKSLWINVCRFIWESSIKLNRERRR

SEQ ID NO: 3369883 - protein, 20 aa, Plasmodium falciparum
PSKTPVLICYNIPKEYTDVN

SEQ ID NO: 3369884 - protein, 17 aa, Plasmodium falciparum
PSLKTLSIKCVRNKYLT

SEQ ID NO: 3369885 - protein, 23 aa, Plasmodium falciparum
PSLLSRFDLIFLVRDSATEQDDE

SEQ ID NO: 3369886 - protein, 29 aa, Plasmodium falciparum
PSLNKKLRRDSCRLIFDPFGYNNTWKIKT

SEQ ID NO: 3369887 - protein, 17 aa, Plasmodium falciparum
PSLNVITYRGNKLERKH

SEQ ID NO: 3369888 - protein, 17 aa, Plasmodium falciparum
PSLPKPRFLDLVPSQQY

SEQ ID NO: 3369889 - protein, 23 aa, Plasmodium falciparum
PSLTFKNFFYKPYICSDSFELFN

SEQ ID NO: 3369890 - protein, 19 aa, Plasmodium falciparum
PSLYLPKIGDIVICKVQRV

SEQ ID NO: 3369891 - protein, 17 aa, Plasmodium falciparum
PSLYRANVTGNYQICVH

SEQ ID NO: 3369892 - protein, 25 aa, Plasmodium falciparum
PSMKGDLIVEFDIVFPKSLTSEKKK

SEQ ID NO: 3369893 - protein, 21 aa, Plasmodium falciparum
PSNCIKELGSCIVKINEKNDK

SEQ ID NO: 3369894 - protein, 24 aa, Plasmodium falciparum
PSNDCPYLILICYISIKEQTTENN

SEQ ID NO: 3369895 - protein, 21 aa, Plasmodium falciparum
PSNFFLIEFPNNFTYNTKKDR

SEQ ID NO: 3369896 - protein, 19 aa, Plasmodium falciparum
PSNIIVRKEFEEHINKRDH

SEQ ID NO: 3369897 - protein, 25 aa, Plasmodium falciparum
PSNMKRLPPIPGSFHEKKAVPMKYH

SEQ ID NO: 3369898 - protein, 25 aa, Plasmodium falciparum
PSPFPQFLRDIQIYNIPQKKIRLKR

SEQ ID NO: 3369899 - protein, 23 aa, Plasmodium falciparum
PSQIKRRHRKYMPANNYQLNENH

SEQ ID NO: 3369900 - protein, 22 aa, Plasmodium falciparum
PSSCGSNKLSERINSLINESYS

SEQ ID NO: 3369901 - protein, 29 aa, Plasmodium falciparum
PSSFLQRLAEDFQYIYLLKYASNEKESTS

SEQ ID NO: 3369902 - protein, 24 aa, Plasmodium falciparum
PSSIKASMELFYWSSQSNDILYYP

SEQ ID NO: 3369903 - protein, 21 aa, Plasmodium falciparum
PSSIYEIRDILKIYNGKGKTN

SEQ ID NO: 3369904 - protein, 18 aa, Plasmodium falciparum
PSSLCIDETLSTLDYVFR

SEQ ID NO: 3369905 - protein, 18 aa, Plasmodium falciparum
PSSSFKTPIERLFKIYQE

SEQ ID NO: 3369906 - protein, 20 aa, Plasmodium falciparum
PSTIYYKFAEDIETYYKKLN

SEQ ID NO: 3369907 - protein, 18 aa, Plasmodium falciparum
PSTLLLFDELNFYTCGLL

SEQ ID NO: 3369908 - protein, 25 aa, Plasmodium falciparum
PSTLNKDSFCSFTTVSSTPEYEINK

SEQ ID NO: 3369909 - protein, 17 aa, Plasmodium falciparum
PSTRRLMVRNIPFSTRD

SEQ ID NO: 3369910 - protein, 21 aa, Plasmodium falciparum
PSVNWSTSFSKYVRQLEQYFD

SEQ ID NO: 3369911 - protein, 24 aa, Plasmodium falciparum
PSYDHKENFCEYVAVEDPGIITPS

SEQ ID NO: 3369912 - protein, 23 aa, Plasmodium falciparum
PSYEETKLYPLKIICNKNLGNFL

SEQ ID NO: 3369913 - protein, 21 aa, Plasmodium falciparum
PSYIKEAYKDLKKSILRKNIK

SEQ ID NO: 3369914 - protein, 18 aa, Plasmodium falciparum
PSYYDIIETLKFDPVSVT

SEQ ID NO: 3369915 - protein, 20 aa, Plasmodium falciparum
PSYYSIGFGGVLSRNEDFLQ

SEQ ID NO: 3369916 - protein, 22 aa, Plasmodium falciparum
PTAIQKITWPIALSGKDLIGVA

SEQ ID NO: 3369917 - protein, 20 aa, Plasmodium falciparum
PTCISGNLFFYNRNIICICN

SEQ ID NO: 3369918 - protein, 24 aa, Plasmodium falciparum
PTDVKRNIFFDDLILISSSYNQHF

SEQ ID NO: 3369919 - protein, 18 aa, Plasmodium falciparum
PTEEEIKKEMKINNKEQK

SEQ ID NO: 3369920 - protein, 20 aa, Plasmodium falciparum
PTEEIIKAFKLFDDDDTGKI

SEQ ID NO: 3369921 - protein, 24 aa, Plasmodium falciparum
PTFCTCILYINSINWYGVPIIFKS

SEQ ID NO: 3369922 - protein, 17 aa, Plasmodium falciparum
PTGSGKTNIALLCILNV

SEQ ID NO: 3369923 - protein, 19 aa, Plasmodium falciparum
PTGYEILRNFYHGIHNDIQ

SEQ ID NO: 3369924 - protein, 35 aa, Plasmodium falciparum
PTGYVFSEKAISLFLKAEETFECPITNEKYRMDEF

SEQ ID NO: 3369925 - protein, 25 aa, Plasmodium falciparum
PTIVNRLKLIFKFSKYYKHSDKIND

SEQ ID NO: 3369926 - protein, 34 aa, Plasmodium falciparum
PTKDYKAHFPNSYMLFRFVNKGIYQVNIPNKCQL

SEQ ID NO: 3369927 - protein, 20 aa, Plasmodium falciparum
PTKIWRRWGRKVNLKEKRYA

SEQ ID NO: 3369928 - protein, 26 aa, Plasmodium falciparum
PTKNFKIKRNCIISRKKLGGYDYSSI

SEQ ID NO: 3369929 - protein, 32 aa, Plasmodium falciparum
PTKRTRAPRGRRMESLTARASALTPVEGVRFD

SEQ ID NO: 3369930 - protein, 17 aa, Plasmodium falciparum
PTKSVVFTSIYKHDHLR

SEQ ID NO: 3369931 - protein, 34 aa, Plasmodium falciparum
PTLSDICIFSPDLFWNICLYFKDNIMGVDPSLVK

SEQ ID NO: 3369932 - protein, 19 aa, Plasmodium falciparum
PTLYFSYHIRYEYHSSCIM

SEQ ID NO: 3369933 - protein, 20 aa, Plasmodium falciparum
PTMSKKIIFSKMGQQKRKNY

SEQ ID NO: 3369934 - protein, 24 aa, Plasmodium falciparum
PTNIKTCICNFCKYAKREKYNDFY

SEQ ID NO: 3369935 - protein, 17 aa, Plasmodium falciparum
PTQRKEIYYDYLHETGN

SEQ ID NO: 3369936 - protein, 26 aa, Plasmodium falciparum
PTRIYLFKKRCTYPYVKKNINQYINC

SEQ ID NO: 3369937 - protein, 23 aa, Plasmodium falciparum
PTSNLKSVILIFVSGKIIITGCK

SEQ ID NO: 3369938 - protein, 22 aa, Plasmodium falciparum
PTSQAFPNPWASKNTKNKNSIN

SEQ ID NO: 3369939 - protein, 27 aa, Plasmodium falciparum
PTSRRILLCAWNVKDLDQMALPPCHIL

SEQ ID NO: 3369940 - protein, 29 aa, Plasmodium falciparum
PTSSANKKSRSWMSFGKGDKSDKKNKSKS

SEQ ID NO: 3369941 - protein, 23 aa, Plasmodium falciparum
PTTGFFQKYLNIFSKKKNGNESE

SEQ ID NO: 3369942 - protein, 17 aa, Plasmodium falciparum
PTVAHLGEENKFYFNKE

SEQ ID NO: 3369943 - protein, 19 aa, Plasmodium falciparum
PTYRLRKKHSGFKRFPYIN

SEQ ID NO: 3369944 - protein, 17 aa, Plasmodium falciparum
PVAKMIINKTGYYSIKK

SEQ ID NO: 3369945 - protein, 19 aa, Plasmodium falciparum
PVDFIYFKKHLIFIENKKI

SEQ ID NO: 3369946 - protein, 20 aa, Plasmodium falciparum
PVDVYVKCLHFLKLETILKC

SEQ ID NO: 3369947 - protein, 17 aa, Plasmodium falciparum
PVEWSKYDVVWFFREYF

SEQ ID NO: 3369948 - protein, 18 aa, Plasmodium falciparum
PVFHKKFVEKIVEVPKVK

SEQ ID NO: 3369949 - protein, 24 aa, Plasmodium falciparum
PVGKLLIDNCRYLIKSIKNLTSKR

SEQ ID NO: 3369950 - protein, 18 aa, Plasmodium falciparum
PVISSIITPCSWNYLCIN

SEQ ID NO: 3369951 - protein, 32 aa, Plasmodium falciparum
PVIVEYCKVCGMPYEYCEYGNSFNECKEENKD

SEQ ID NO: 3369952 - protein, 23 aa, Plasmodium falciparum
PVKEGKRHLSIIVEMNTEDMATK

SEQ ID NO: 3369953 - protein, 20 aa, Plasmodium falciparum
PVKKCLLSKFFKQVKKNNKI

SEQ ID NO: 3369954 - protein, 29 aa, Plasmodium falciparum
PVKKRGRKKGSKFVHKNITNEHILSQLKE

SEQ ID NO: 3369955 - protein, 27 aa, Plasmodium falciparum
PVKTLLQYICEVIFEKSKETLSIIDEL

SEQ ID NO: 3369956 - protein, 23 aa, Plasmodium falciparum
PVLYKGSDIEFIYNKLNLGEGKL

SEQ ID NO: 3369957 - protein, 35 aa, Plasmodium falciparum
PVNLKSGAAVTHCILRVDVPLKRGSKNEERKSSSY

SEQ ID NO: 3369958 - protein, 25 aa, Plasmodium falciparum
PVPVRRKIIPKIKWISDVYQVDCIK

SEQ ID NO: 3369959 - protein, 19 aa, Plasmodium falciparum
PVQNFVNVKLNFCNSNQYH

SEQ ID NO: 3369960 - protein, 29 aa, Plasmodium falciparum
PVSREQFSIREVIPNYAIKEATEHFLKAN

SEQ ID NO: 3369961 - protein, 43 aa, Plasmodium falciparum
PVTMNCGHTFCRYCIGHNKLNGKNCPLCRQPLGNTACINTIIS

SEQ ID NO: 3369962 - protein, 17 aa, Plasmodium falciparum
PVVAMVWEGVDMVKQGR

SEQ ID NO: 3369963 - protein, 24 aa, Plasmodium falciparum
PVYPVHFRDFLKKRTFNNKQDVHL

SEQ ID NO: 3369964 - protein, 21 aa, Plasmodium falciparum
PWKNTKWSKGKFIYDHELNNI

SEQ ID NO: 3369965 - protein, 29 aa, Plasmodium falciparum
PYANLKPKTYEKFIPLFKFQQNSNQKQNV

SEQ ID NO: 3369966 - protein, 18 aa, Plasmodium falciparum
PYANNFNGNVCNTSTNVI

SEQ ID NO: 3369967 - protein, 24 aa, Plasmodium falciparum
PYDEAFSFLCGYIGKNINEYKKDD

SEQ ID NO: 3369968 - protein, 19 aa, Plasmodium falciparum
PYDSIIIKPIPNKSIVEQN

SEQ ID NO: 3369969 - protein, 22 aa, Plasmodium falciparum
PYENIPICISIGEINNKYIYDM

SEQ ID NO: 3369970 - protein, 19 aa, Plasmodium falciparum
PYFDPHEFPKILWKSKAGG

SEQ ID NO: 3369971 - protein, 22 aa, Plasmodium falciparum
PYGKQFFVFNAFKRDIKFDNEM

SEQ ID NO: 3369972 - protein, 19 aa, Plasmodium falciparum
PYICAVFLVHWSKHLQKMD

SEQ ID NO: 3369973 - protein, 17 aa, Plasmodium falciparum
PYIDLFFSSLYPFYEII

SEQ ID NO: 3369974 - protein, 22 aa, Plasmodium falciparum
PYIHKLKNIFFNKDNRKNIYRD

SEQ ID NO: 3369975 - protein, 26 aa, Plasmodium falciparum
PYIKKKAAMCAIRILKKTNDIEELFL

SEQ ID NO: 3369976 - protein, 18 aa, Plasmodium falciparum
PYKDYRYIYDKKKEEELF

SEQ ID NO: 3369977 - protein, 26 aa, Plasmodium falciparum
PYKISEYGIEKCMILAILSRNLRLSN

SEQ ID NO: 3369978 - protein, 24 aa, Plasmodium falciparum
PYKSPKYKTLIEMVLNPSSKTYDM

SEQ ID NO: 3369979 - protein, 20 aa, Plasmodium falciparum
PYLHRLPNDCLKKIDQDDSD

SEQ ID NO: 3369980 - protein, 18 aa, Plasmodium falciparum
PYLKLIELTIDFEEIEKQ

SEQ ID NO: 3369981 - protein, 29 aa, Plasmodium falciparum
PYLPKKLKDFLIYFFRKNIEVLLITNEDI

SEQ ID NO: 3369982 - protein, 18 aa, Plasmodium falciparum
PYLQTLWNYRREYFEYIK

SEQ ID NO: 3369983 - protein, 25 aa, Plasmodium falciparum
PYLYNNCIRQGFVADCSFLSSLTVL

SEQ ID NO: 3369984 - protein, 24 aa, Plasmodium falciparum
PYMIKKDVTKGMVYRKKEKDDDII

SEQ ID NO: 3369985 - protein, 28 aa, Plasmodium falciparum
PYNEKKYRLIGDFSRYMSVTINEKKGGL

SEQ ID NO: 3369986 - protein, 21 aa, Plasmodium falciparum
PYNLNLENIFWKQINLKNYKK

SEQ ID NO: 3369987 - protein, 19 aa, Plasmodium falciparum
PYNNVPYILKKGLEPKTHN

SEQ ID NO: 3369988 - protein, 20 aa, Plasmodium falciparum
PYNSEYTLDIILKYYQEKEK

SEQ ID NO: 3369989 - protein, 20 aa, Plasmodium falciparum
PYQLEGLNWLYQLYRFKING

SEQ ID NO: 3369990 - protein, 19 aa, Plasmodium falciparum
PYQLIAMYRNLLVVISRRN

SEQ ID NO: 3369991 - protein, 18 aa, Plasmodium falciparum
PYQQELFNFFIFDDSIFL

SEQ ID NO: 3369992 - protein, 21 aa, Plasmodium falciparum
PYSGIIKKLLVKEGQFVDLDK

SEQ ID NO: 3369993 - protein, 20 aa, Plasmodium falciparum
PYSTAAYVSKIFKYKPKLVQ

SEQ ID NO: 3369994 - protein, 18 aa, Plasmodium falciparum
PYSTYNCISNIIEEEKEI

SEQ ID NO: 3369995 - protein, 28 aa, Plasmodium falciparum
PYSVTTFYCPVKFPYTDNIIYKSDQYPE

SEQ ID NO: 3369996 - protein, 19 aa, Plasmodium falciparum
PYSYCLVAGIEKHPLKVNK

SEQ ID NO: 3369997 - protein, 19 aa, Plasmodium falciparum
PYTAVQICSYILKLKNKGD

SEQ ID NO: 3369998 - protein, 20 aa, Plasmodium falciparum
PYTKKRDALRISEDKEKRKI

SEQ ID NO: 3369999 - protein, 24 aa, Plasmodium falciparum
PYTKSKSKFHMFFYKNKYSSSKYN

SEQ ID NO: 3370000 - protein, 24 aa, Plasmodium falciparum
PYVNYCALLPFLTKEDFYLFRKLQ

SEQ ID NO: 3370001 - protein, 17 aa, Plasmodium falciparum
PYVVCFIHKNGSIHLHG

SEQ ID NO: 3370002 - protein, 18 aa, Plasmodium falciparum
PYYLQSIISLEHDIQMKK

SEQ ID NO: 3370003 - protein, 28 aa, Plasmodium falciparum
PYYNFISWKFLTVMESFLIDKEFKKLKN

SEQ ID NO: 3370004 - protein, 25 aa, Plasmodium falciparum
PYYWPEAYNFFKYATTPFENVEYRC

SEQ ID NO: 3370005 - protein, 27 aa, Plasmodium falciparum
PYYYMLSIRYFVPRFFILFEKNYYADF

SEQ ID NO: 3370006 - protein, 19 aa, Plasmodium falciparum
QADDFIFYKNELMLDKSIS

SEQ ID NO: 3370007 - protein, 21 aa, Plasmodium falciparum
QADSSFSFLLTDAHDTEKNRD

SEQ ID NO: 3370008 - protein, 17 aa, Plasmodium falciparum
QAEFLLREKEDYLFNEI

SEQ ID NO: 3370009 - protein, 32 aa, Plasmodium falciparum
QAGELMIKTFPQRIKAVFLHHVKGKDDNTLLP

SEQ ID NO: 3370010 - protein, 19 aa, Plasmodium falciparum
QAHMIINWLEKGVFEAIEK

SEQ ID NO: 3370011 - protein, 19 aa, Plasmodium falciparum
QAIIKQFVWKRKMYKWLKG

SEQ ID NO: 3370012 - protein, 20 aa, Plasmodium falciparum
QAIKVLPHMMFNASKLILSD

SEQ ID NO: 3370013 - protein, 20 aa, Plasmodium falciparum
QAIKVLPHMMFNASKLKVLS

SEQ ID NO: 3370014 - protein, 26 aa, Plasmodium falciparum
QAKCLRTKKKKNWESPERAGIFSQEE

SEQ ID NO: 3370015 - protein, 30 aa, Plasmodium falciparum
QAKMYTNFFLLRFIFEYESYMSENYPNNLK

SEQ ID NO: 3370016 - protein, 19 aa, Plasmodium falciparum
QALKISSHVRLDFQENGLL

SEQ ID NO: 3370017 - protein, 26 aa, Plasmodium falciparum
QANGYIPAIIWKYGIEERICIPHKLI

SEQ ID NO: 3370018 - protein, 19 aa, Plasmodium falciparum
QARKVALQLTEEIDNCNKN

SEQ ID NO: 3370019 - protein, 32 aa, Plasmodium falciparum
QATDLKQLTALCKLPLDDSLLNFLKNFKKADE

SEQ ID NO: 3370020 - protein, 17 aa, Plasmodium falciparum
QAYKYTRKMLMQRMVQI

SEQ ID NO: 3370021 - protein, 22 aa, Plasmodium falciparum
QCGQCGNQIGVEFWKQLCNEHN

SEQ ID NO: 3370022 - protein, 31 aa, Plasmodium falciparum
QCLKEERRNLEFLNLCLYKDIKYKKENIKAI

SEQ ID NO: 3370023 - protein, 22 aa, Plasmodium falciparum
QCNNIILGGTFYKHCENDLLLK

SEQ ID NO: 3370024 - protein, 31 aa, Plasmodium falciparum
QCSYVSKSLIRICHDYIKLLKFSSSLYKCKM

SEQ ID NO: 3370025 - protein, 26 aa, Plasmodium falciparum
QCTNIIDLVPYFFIFKNIIKQKTLPS

SEQ ID NO: 3370026 - protein, 24 aa, Plasmodium falciparum
QDAIDWLTWSFFYRRIKKNPNYYG

SEQ ID NO: 3370027 - protein, 22 aa, Plasmodium falciparum
QDALCKNSFFVNINIEDVHSYI

SEQ ID NO: 3370028 - protein, 34 aa, Plasmodium falciparum
QDELKSAQNLFAYKSSMCKFVANKRCLNGATCRF

SEQ ID NO: 3370029 - protein, 19 aa, Plasmodium falciparum
QDENMSFCDFVVVTNNSVE

SEQ ID NO: 3370030 - protein, 17 aa, Plasmodium falciparum
QDFCLKYSNTCKINDLN

SEQ ID NO: 3370031 - protein, 17 aa, Plasmodium falciparum
QDGTCNTFLQNSLNNQS

SEQ ID NO: 3370032 - protein, 17 aa, Plasmodium falciparum
QDIDRKRKVRVYISIQK

SEQ ID NO: 3370033 - protein, 17 aa, Plasmodium falciparum
QDIKEEWYTDNRIKAIK

SEQ ID NO: 3370034 - protein, 24 aa, Plasmodium falciparum
QDILWSKKWRNLIQQKAIKEEMNK

SEQ ID NO: 3370035 - protein, 18 aa, Plasmodium falciparum
QDISSGYSETSCKSTNSI

SEQ ID NO: 3370036 - protein, 25 aa, Plasmodium falciparum
QDIYFFSIFNWEWNFEGNTKHNYNI

SEQ ID NO: 3370037 - protein, 23 aa, Plasmodium falciparum
QDIYFIISNIFNFHVYNFPYINL

SEQ ID NO: 3370038 - protein, 25 aa, Plasmodium falciparum
QDKIKWKKAHSLRNRMKEYDLITRT

SEQ ID NO: 3370039 - protein, 32 aa, Plasmodium falciparum
QDKIMYNPMNDYNCIYPSNNPYGIQNNDKGYM

SEQ ID NO: 3370040 - protein, 22 aa, Plasmodium falciparum
QDKRKIIKINTINKIKRKYKKF

SEQ ID NO: 3370041 - protein, 27 aa, Plasmodium falciparum
QDLYQRKAESFVIIISSEFIYNTNTNL

SEQ ID NO: 3370042 - protein, 18 aa, Plasmodium falciparum
QDNIKNDHMVVGEDIMGD

SEQ ID NO: 3370043 - protein, 17 aa, Plasmodium falciparum
QDNISRENNISWKEEEY

SEQ ID NO: 3370044 - protein, 26 aa, Plasmodium falciparum
QDNKLPVVLFCFSRIKCETYAKCMPH

SEQ ID NO: 3370045 - protein, 24 aa, Plasmodium falciparum
QDNNAFYFYKMIPFEKLYTKDTMD

SEQ ID NO: 3370046 - protein, 38 aa, Plasmodium falciparum
QDNVKLRKWRESRDLKLKRYLDKSSFSFDKSKNESDND

SEQ ID NO: 3370047 - protein, 54 aa, Plasmodium falciparum
QDPYGLTKRSINEWKILAKCDHPNIIKLCGGIIHSYFDIWLVTKLVNGLDLHTI

SEQ ID NO: 3370048 - protein, 18 aa, Plasmodium falciparum
QDQKCLMCNNDINDIENI

SEQ ID NO: 3370049 - protein, 26 aa, Plasmodium falciparum
QDRKCFNRPFRKSFVKDLEIKKTEKT

SEQ ID NO: 3370050 - protein, 22 aa, Plasmodium falciparum
QDSYNLTSYCFNFLNENLTDSL

SEQ ID NO: 3370051 - protein, 24 aa, Plasmodium falciparum
QDTFLKKHTNIIEMNKILNKYNND

SEQ ID NO: 3370052 - protein, 23 aa, Plasmodium falciparum
QDTSNCMLLNGINFYGNNLRIGR

SEQ ID NO: 3370053 - protein, 21 aa, Plasmodium falciparum
QDVSDKCVLHMDCDDLYVSPN

SEQ ID NO: 3370054 - protein, 25 aa, Plasmodium falciparum
QDYDKCIKLTCLHTYHWKCVKNWFK

SEQ ID NO: 3370055 - protein, 17 aa, Plasmodium falciparum
QEAACSSFANLEEDALE

SEQ ID NO: 3370056 - protein, 33 aa, Plasmodium falciparum
QEAEKAGARCKPMFHVHGSRKAVDAAITNDLLR

SEQ ID NO: 3370057 - protein, 25 aa, Plasmodium falciparum
QEAELIRIFSIYSIYCGGIAEYVMN

SEQ ID NO: 3370058 - protein, 19 aa, Plasmodium falciparum
QEASKGPILYGTKTENVRF

SEQ ID NO: 3370059 - protein, 26 aa, Plasmodium falciparum
QECAKSWKSNIDEWVPFSPEYAYKLL

SEQ ID NO: 3370060 - protein, 21 aa, Plasmodium falciparum
QECSCNFILNIDAYKWVERDS

SEQ ID NO: 3370061 - protein, 17 aa, Plasmodium falciparum
QEDLYVDEIGRLLLLSF

SEQ ID NO: 3370062 - protein, 24 aa, Plasmodium falciparum
QEEKTRLLLLYFMNYININDNDKM

SEQ ID NO: 3370063 - protein, 17 aa, Plasmodium falciparum
QEFINHLKYIYSKNNVN

SEQ ID NO: 3370064 - protein, 19 aa, Plasmodium falciparum
QEGKLGGICLENNKNNNMN

SEQ ID NO: 3370065 - protein, 24 aa, Plasmodium falciparum
QEGYKRGFCQFIMEPILNLCQSIM

SEQ ID NO: 3370066 - protein, 18 aa, Plasmodium falciparum
QEHHKLLLDKNGNNNNDD

SEQ ID NO: 3370067 - protein, 24 aa, Plasmodium falciparum
QEICVFDFYAYVLKYMYAKEIMGE

SEQ ID NO: 3370068 - protein, 23 aa, Plasmodium falciparum
QEIIIKECHKKIEFVNKNSVNHL

SEQ ID NO: 3370069 - protein, 24 aa, Plasmodium falciparum
QEINGICTSSLIRIPKNVRKNISE

SEQ ID NO: 3370070 - protein, 18 aa, Plasmodium falciparum
QEIQGCWSNINFLFENII

SEQ ID NO: 3370071 - protein, 19 aa, Plasmodium falciparum
QEIQGKFNLHLTNANKKLN

SEQ ID NO: 3370072 - protein, 26 aa, Plasmodium falciparum
QEIRRRLDCYFNIVLRNVRDSVPKMI

SEQ ID NO: 3370073 - protein, 17 aa, Plasmodium falciparum
QEKEIICNSNIYEEFNY

SEQ ID NO: 3370074 - protein, 19 aa, Plasmodium falciparum
QEKEKCFFILQKRFKESTT

SEQ ID NO: 3370075 - protein, 23 aa, Plasmodium falciparum
QEKFKGIIEYVKFDKYTNKYVAI

SEQ ID NO: 3370076 - protein, 31 aa, Plasmodium falciparum
QEKIIFLYKFIKGVCPKSFGIHIAKLAGLPK

SEQ ID NO: 3370077 - protein, 19 aa, Plasmodium falciparum
QEKQSMGGIDRVLHHRKIL

SEQ ID NO: 3370078 - protein, 24 aa, Plasmodium falciparum
QEKYEYLMNYLIKLKSSIHNDGIS

SEQ ID NO: 3370079 - protein, 28 aa, Plasmodium falciparum
QEKYFYISIKKCIHGIHYYPNNINDEKD

SEQ ID NO: 3370080 - protein, 21 aa, Plasmodium falciparum
QELFYKNNIKLIAIDIDGTLA

SEQ ID NO: 3370081 - protein, 17 aa, Plasmodium falciparum
QELKKMLNYLWNIPNEI

SEQ ID NO: 3370082 - protein, 17 aa, Plasmodium falciparum
QELKSIIFTDVSFELSF

SEQ ID NO: 3370083 - protein, 36 aa, Plasmodium falciparum
QELVSMLPVLFLRLKENFFVLDICAAPGSKTAQILD

SEQ ID NO: 3370084 - protein, 34 aa, Plasmodium falciparum
QEMKEAVELPLTCPELYEKIGIEPPMGILIYGPP

SEQ ID NO: 3370085 - protein, 28 aa, Plasmodium falciparum
QENGYDCGVFTCMFAKCLSFNREFDFNQ

SEQ ID NO: 3370086 - protein, 17 aa, Plasmodium falciparum
QENLISFKSKLKSKKEK

SEQ ID NO: 3370087 - protein, 29 aa, Plasmodium falciparum
QENSLRFAKEIFKNGAFDKNGNFKLYANK

SEQ ID NO: 3370088 - protein, 24 aa, Plasmodium falciparum
QEPPRSGIFCDILWSDPIDEDKEE

SEQ ID NO: 3370089 - protein, 24 aa, Plasmodium falciparum
QEQIMLRYIEFCLYLEKLSLVKDG

SEQ ID NO: 3370090 - protein, 24 aa, Plasmodium falciparum
QETKKCNNSFHLLRNEHINNQDTK

SEQ ID NO: 3370091 - protein, 37 aa, Plasmodium falciparum
QETPEIFKDIHIKKAIILRLILMHFLQKGDFFMYYVL

SEQ ID NO: 3370092 - protein, 33 aa, Plasmodium falciparum
QEVHIMKSKIFLNYKINCPKFLINTISPSDIIT

SEQ ID NO: 3370093 - protein, 17 aa, Plasmodium falciparum
QEVKRNQFFISEKTKKG

SEQ ID NO: 3370094 - protein, 25 aa, Plasmodium falciparum
QEVLKLKIFFLNIIKNMKNKKRNIL

SEQ ID NO: 3370095 - protein, 23 aa, Plasmodium falciparum
QEYHFYYKYVINVLKQNKDSINH

SEQ ID NO: 3370096 - protein, 28 aa, Plasmodium falciparum
QEYYQCIYKVFKNLLLKKEEIDEKEKQE

SEQ ID NO: 3370097 - protein, 20 aa, Plasmodium falciparum
QFCNKLKTYLLHNKHKKKQK

SEQ ID NO: 3370098 - protein, 17 aa, Plasmodium falciparum
QFCTDIYKMEILKKDEN

SEQ ID NO: 3370099 - protein, 26 aa, Plasmodium falciparum
QFICNKKVHISYAFKKDSKGERHGTA

SEQ ID NO: 3370100 - protein, 22 aa, Plasmodium falciparum
QFIGDIRIDFYYRQSERTLCRA

SEQ ID NO: 3370101 - protein, 22 aa, Plasmodium falciparum
QFILDKFQMIFISATLNHAMKT

SEQ ID NO: 3370102 - protein, 19 aa, Plasmodium falciparum
QFIPMTLKNLINVIQQKMQ

SEQ ID NO: 3370103 - protein, 22 aa, Plasmodium falciparum
QFIRNIFERFLSYKFKPRVMKI

SEQ ID NO: 3370104 - protein, 20 aa, Plasmodium falciparum
QFKKGSNLIKKCIDQNIDVY

SEQ ID NO: 3370105 - protein, 22 aa, Plasmodium falciparum
QFKVPFKISEYGIARAKNLAII

SEQ ID NO: 3370106 - protein, 30 aa, Plasmodium falciparum
QFKYKCYPTYDFACPIIDSIEGVTHALRTN

SEQ ID NO: 3370107 - protein, 25 aa, Plasmodium falciparum
QFLGWNVIILYEYEWKALRNFDEKL

SEQ ID NO: 3370108 - protein, 27 aa, Plasmodium falciparum
QFLHVTDFLYHLILHIYTKFTEKNNKL

SEQ ID NO: 3370109 - protein, 37 aa, Plasmodium falciparum
QFLKALKIKVYYIIILFKLNDNFIFNKLIGIYRQIFE

SEQ ID NO: 3370110 - protein, 17 aa, Plasmodium falciparum
QFLRWFTEWAEEFCNER

SEQ ID NO: 3370111 - protein, 24 aa, Plasmodium falciparum
QFLSMNWCNLSFVHIFNTNNLFIN

SEQ ID NO: 3370112 - protein, 26 aa, Plasmodium falciparum
QFLYNGGPCIKRISNNIYNTFIPISS

SEQ ID NO: 3370113 - protein, 19 aa, Plasmodium falciparum
QFMKKGICYLHNNMTEIEK

SEQ ID NO: 3370114 - protein, 25 aa, Plasmodium falciparum
QFNAKLGDFGLSFVYMNNNNVFNLT

SEQ ID NO: 3370115 - protein, 30 aa, Plasmodium falciparum
QFQKGFGGFGGMLRYKIDLNLYDEDVESDV

SEQ ID NO: 3370116 - protein, 17 aa, Plasmodium falciparum
QFSRAKFLFPYNTPKTK

SEQ ID NO: 3370117 - protein, 21 aa, Plasmodium falciparum
QFSTTLKCLNLLYKKVKTDTQ

SEQ ID NO: 3370118 - protein, 22 aa, Plasmodium falciparum
QFTKSIFHICSYKENEYIPINV

SEQ ID NO: 3370119 - protein, 25 aa, Plasmodium falciparum
QFVLNSWICMSRILAFSDGHNEINR

SEQ ID NO: 3370120 - protein, 17 aa, Plasmodium falciparum
QGFLALFSGDTGEIKNE

SEQ ID NO: 3370121 - protein, 20 aa, Plasmodium falciparum
QGFLNCLDRNVLENIDKGLG

SEQ ID NO: 3370122 - protein, 25 aa, Plasmodium falciparum
QGGYYCKICDCVLKDSQTYLDHING

SEQ ID NO: 3370123 - protein, 24 aa, Plasmodium falciparum
QGIILKILHLHNSVLYTYPSLNKY

SEQ ID NO: 3370124 - protein, 18 aa, Plasmodium falciparum
QGITSIWVCLREYEIKNK

SEQ ID NO: 3370125 - protein, 18 aa, Plasmodium falciparum
QGKHHTVMYLQSYNVSII

SEQ ID NO: 3370126 - protein, 24 aa, Plasmodium falciparum
QGMKSFLEDPLCYLQKLKCEVDDI

SEQ ID NO: 3370127 - protein, 40 aa, Plasmodium falciparum
QGNELKGKGGMYPNKGMKYGRGGANNEHFNNLKYYSNNYG

SEQ ID NO: 3370128 - protein, 24 aa, Plasmodium falciparum
QGPFNSYTIFNWVSNEYFEDNTLI

SEQ ID NO: 3370129 - protein, 62 aa, Plasmodium falciparum
QGPFSSELMFYWWCLNYFPYDLPIRFNESMPWVRFNDMFPFGSFPFVLPLTSMKKNLKNVEP

SEQ ID NO: 3370130 - protein, 29 aa, Plasmodium falciparum
QGSYIINNMYFKFFFNHNKELVCNNQNHT

SEQ ID NO: 3370131 - protein, 28 aa, Plasmodium falciparum
QGYNHKVDAWSIGIILYLLLSGKLPFPI

SEQ ID NO: 3370132 - protein, 20 aa, Plasmodium falciparum
QHAGLHWLLYLYKNNINGIL

SEQ ID NO: 3370133 - protein, 24 aa, Plasmodium falciparum
QHFWKTKLCPLHMENRCNEGSNCD

SEQ ID NO: 3370134 - protein, 17 aa, Plasmodium falciparum
QHHLSFIHNIKEYNDMQ

SEQ ID NO: 3370135 - protein, 21 aa, Plasmodium falciparum
QHKELKNVLIFSEDREVKEGQ

SEQ ID NO: 3370136 - protein, 19 aa, Plasmodium falciparum
QHKNMKKKISFDNNPKESY

SEQ ID NO: 3370137 - protein, 18 aa, Plasmodium falciparum
QHLLKKECLHDIIDNMKN

SEQ ID NO: 3370138 - protein, 27 aa, Plasmodium falciparum
QHNIRKWLVKRKILRIHNIKKKNKIKN

SEQ ID NO: 3370139 - protein, 32 aa, Plasmodium falciparum
QHPFPISMMIEARFKDWFIQYLTGFFFINYDD

SEQ ID NO: 3370140 - protein, 27 aa, Plasmodium falciparum
QIADFHFCLGSSFYIVPASSYPSKKKY

SEQ ID NO: 3370141 - protein, 25 aa, Plasmodium falciparum
QICKTKRTSGGIFKKSIDSSTFLNC

SEQ ID NO: 3370142 - protein, 20 aa, Plasmodium falciparum
QIDCLIKFKRKECLMKYFYT

SEQ ID NO: 3370143 - protein, 17 aa, Plasmodium falciparum
QIDGVWHTAVLVYNMEY

SEQ ID NO: 3370144 - protein, 25 aa, Plasmodium falciparum
QIDIYEIIGLLLLNYDFNKFKKLSK

SEQ ID NO: 3370145 - protein, 18 aa, Plasmodium falciparum
QIDLVLGRGLALLRQRYV

SEQ ID NO: 3370146 - protein, 18 aa, Plasmodium falciparum
QIDLYRKHIKHLYNVNDD

SEQ ID NO: 3370147 - protein, 19 aa, Plasmodium falciparum
QIDSLNWEYSYDSNNLNNS

SEQ ID NO: 3370148 - protein, 19 aa, Plasmodium falciparum
QIEKCIVQNIYVYQQMIYK

SEQ ID NO: 3370149 - protein, 18 aa, Plasmodium falciparum
QIFEEIQKEYNLYEHDKT

SEQ ID NO: 3370150 - protein, 20 aa, Plasmodium falciparum
QIFFNAFTYHKVKNCVWNDA

SEQ ID NO: 3370151 - protein, 20 aa, Plasmodium falciparum
QIFKMYNLDIEHFNEQDHLS

SEQ ID NO: 3370152 - protein, 25 aa, Plasmodium falciparum
QIHYDKCKCMAKHFVSWLKDNDSDS

SEQ ID NO: 3370153 - protein, 27 aa, Plasmodium falciparum
QIIEFFKPYKIMEKYIIFMRDKKGHFF

SEQ ID NO: 3370154 - protein, 26 aa, Plasmodium falciparum
QIIFYKEIKISYFINILNIIDEAILN

SEQ ID NO: 3370155 - protein, 17 aa, Plasmodium falciparum
QIIKDLVEIAVKRQKTK

SEQ ID NO: 3370156 - protein, 18 aa, Plasmodium falciparum
QIIKEDIHFVKKHINDDV

SEQ ID NO: 3370157 - protein, 31 aa, Plasmodium falciparum
QIIKTSFILWLRYEYDQDAALFMNTYKVHKL

SEQ ID NO: 3370158 - protein, 21 aa, Plasmodium falciparum
QIILLCLQILWTTNIENELIN

SEQ ID NO: 3370159 - protein, 22 aa, Plasmodium falciparum
QIILRFTFILNDVLIDIEGNIQ

SEQ ID NO: 3370160 - protein, 30 aa, Plasmodium falciparum
QIIPYLNVFGDYIQRCILPTDLPYAELYVL

SEQ ID NO: 3370161 - protein, 18 aa, Plasmodium falciparum
QIIRCYKKFAPHRLNNII

SEQ ID NO: 3370162 - protein, 20 aa, Plasmodium falciparum
QIKAKTGAEVKIFNKTNHKE

SEQ ID NO: 3370163 - protein, 22 aa, Plasmodium falciparum
QIKLKFENIFSHSPQREKYNNL

SEQ ID NO: 3370164 - protein, 22 aa, Plasmodium falciparum
QIKNGGLFYEGYLIYSSLEMND

SEQ ID NO: 3370165 - protein, 23 aa, Plasmodium falciparum
QIKNLCILYSFLCRENITIELHN

SEQ ID NO: 3370166 - protein, 22 aa, Plasmodium falciparum
QIKPNYLLLYLAPKVIGKLMYD

SEQ ID NO: 3370167 - protein, 20 aa, Plasmodium falciparum
QIKTGAPCRSERNAKYNQLL

SEQ ID NO: 3370168 - protein, 22 aa, Plasmodium falciparum
QILFHRFYFKKSFTDFDVNIIA

SEQ ID NO: 3370169 - protein, 18 aa, Plasmodium falciparum
QILNLFKIFDNLPFEPKS

SEQ ID NO: 3370170 - protein, 20 aa, Plasmodium falciparum
QILPRYLIQFECDPNDDEHF

SEQ ID NO: 3370171 - protein, 21 aa, Plasmodium falciparum
QILYRKLFIHRYKNMITEKIN

SEQ ID NO: 3370172 - protein, 19 aa, Plasmodium falciparum
QIMAARAYSSKYCFFVTNG

SEQ ID NO: 3370173 - protein, 19 aa, Plasmodium falciparum
QINCYDVLLEIRKRVPRWG

SEQ ID NO: 3370174 - protein, 18 aa, Plasmodium falciparum
QINEKFGILKLFKPDIYN

SEQ ID NO: 3370175 - protein, 17 aa, Plasmodium falciparum
QINIELMNEINREIKNY

SEQ ID NO: 3370176 - protein, 21 aa, Plasmodium falciparum
QININYSFSFNNDNTINEGTK

SEQ ID NO: 3370177 - protein, 24 aa, Plasmodium falciparum
QINQFKKYFNLFYVNENIMEILQN

SEQ ID NO: 3370178 - protein, 17 aa, Plasmodium falciparum
QINTCCVEWLGYVNEAN

SEQ ID NO: 3370179 - protein, 25 aa, Plasmodium falciparum
QINYTNSFWSYIFGYFNNIYNNWSQ

SEQ ID NO: 3370180 - protein, 24 aa, Plasmodium falciparum
QIPEGRAFYGFQMCMENIHDEVYA

SEQ ID NO: 3370181 - protein, 18 aa, Plasmodium falciparum
QIQEACKIADEQNDNIFD

SEQ ID NO: 3370182 - protein, 17 aa, Plasmodium falciparum
QIQEDIYSLISPFITSL

SEQ ID NO: 3370183 - protein, 18 aa, Plasmodium falciparum
QIQFSKSVVPGMREAYNT

SEQ ID NO: 3370184 - protein, 22 aa, Plasmodium falciparum
QIREEIKLELTQEITNKLEKKY

SEQ ID NO: 3370185 - protein, 19 aa, Plasmodium falciparum
QISDYLKYFYILSHEYLEK

SEQ ID NO: 3370186 - protein, 23 aa, Plasmodium falciparum
QISEFKEAFSLFDKDGDGTITTK

SEQ ID NO: 3370187 - protein, 25 aa, Plasmodium falciparum
QISTIIRRFINICKHVNPQVLHKKF

SEQ ID NO: 3370188 - protein, 23 aa, Plasmodium falciparum
QISVTCFQRGLLLKQLFNYNIML

SEQ ID NO: 3370189 - protein, 20 aa, Plasmodium falciparum
QITNEFIHQVFLPHVESQII

SEQ ID NO: 3370190 - protein, 23 aa, Plasmodium falciparum
QIVDKRSALSFAGQNMDASNNYN

SEQ ID NO: 3370191 - protein, 35 aa, Plasmodium falciparum
QIVDLLKLRLLINHSSLLPNSWTEKALCNICNIGE

SEQ ID NO: 3370192 - protein, 26 aa, Plasmodium falciparum
QIYEELKKWRVPHANYVVVDHDTVKR

SEQ ID NO: 3370193 - protein, 24 aa, Plasmodium falciparum
QIYELPLHIIVPLEHENILKIWSF

SEQ ID NO: 3370194 - protein, 20 aa, Plasmodium falciparum
QIYISMDVFHNYPIIPCNMP

SEQ ID NO: 3370195 - protein, 19 aa, Plasmodium falciparum
QKACEELKCNVISNCVTYQ

SEQ ID NO: 3370196 - protein, 22 aa, Plasmodium falciparum
QKAKEAFQILKNVPKSETKIKQ

SEQ ID NO: 3370197 - protein, 25 aa, Plasmodium falciparum
QKALIKASEGNFLIENPDINVENVS

SEQ ID NO: 3370198 - protein, 18 aa, Plasmodium falciparum
QKCRGMYEHVRQDLKEGM

SEQ ID NO: 3370199 - protein, 26 aa, Plasmodium falciparum
QKDLLKWHLCNNIKKLSMKRSDYKFK

SEQ ID NO: 3370200 - protein, 31 aa, Plasmodium falciparum
QKDRHTLAYDKGWRIRQLFKQYQIIKSNPFW

SEQ ID NO: 3370201 - protein, 26 aa, Plasmodium falciparum
QKDRNDMFPCFGYLYPEGTDRIRKCW

SEQ ID NO: 3370202 - protein, 23 aa, Plasmodium falciparum
QKEGRNICFPSVFKENKKTNDVL

SEQ ID NO: 3370203 - protein, 19 aa, Plasmodium falciparum
QKELFCNIVELYKELDNES

SEQ ID NO: 3370204 - protein, 21 aa, Plasmodium falciparum
QKELHASNISHMLNEDNSNEI

SEQ ID NO: 3370205 - protein, 23 aa, Plasmodium falciparum
QKELKIKLSDNIYKQNIIMNSNP

SEQ ID NO: 3370206 - protein, 25 aa, Plasmodium falciparum
QKELLDKMNECITIENKCKSKLYEY

SEQ ID NO: 3370207 - protein, 28 aa, Plasmodium falciparum
QKESIVLRLKRLLILSGEQEAELIRIFS

SEQ ID NO: 3370208 - protein, 26 aa, Plasmodium falciparum
QKFNEYIPMNGFRSIYHNNNMNNGNG

SEQ ID NO: 3370209 - protein, 20 aa, Plasmodium falciparum
QKFYLHPSIDSMRQIWFSKL

SEQ ID NO: 3370210 - protein, 30 aa, Plasmodium falciparum
QKGAYIIYYKLRPGVIEFLRTMSEKYEIYL

SEQ ID NO: 3370211 - protein, 27 aa, Plasmodium falciparum
QKGGRRKCIHMFKKWIHEKNVKLSNCI

SEQ ID NO: 3370212 - protein, 23 aa, Plasmodium falciparum
QKGHGKAVDWWSLGIMLYEMLTG

SEQ ID NO: 3370213 - protein, 20 aa, Plasmodium falciparum
QKGLNDINCLVNFEAKQQAE

SEQ ID NO: 3370214 - protein, 27 aa, Plasmodium falciparum
QKGLYFFNKRVQIFSLLDFLYKIDNDN

SEQ ID NO: 3370215 - protein, 30 aa, Plasmodium falciparum
QKGNWKLCCEKIFSLSIWPKFPDKEKVQNI

SEQ ID NO: 3370216 - protein, 19 aa, Plasmodium falciparum
QKIFPRLIYFTLLIKSPIC

SEQ ID NO: 3370217 - protein, 18 aa, Plasmodium falciparum
QKIIKKKILISLKKRGAI

SEQ ID NO: 3370218 - protein, 19 aa, Plasmodium falciparum
QKIKEEKTVAVNIDEVLFE

SEQ ID NO: 3370219 - protein, 17 aa, Plasmodium falciparum
QKILDWIFNIYKKEDER

SEQ ID NO: 3370220 - protein, 20 aa, Plasmodium falciparum
QKISALFYFYYLKKFSYNFL

SEQ ID NO: 3370221 - protein, 24 aa, Plasmodium falciparum
QKISLPEYVIDDWVYNQNKISKNL

SEQ ID NO: 3370222 - protein, 19 aa, Plasmodium falciparum
QKISMSVIINKCVSSVLLN

SEQ ID NO: 3370223 - protein, 23 aa, Plasmodium falciparum
QKISRKGSFSIEGRTCNICKMVF

SEQ ID NO: 3370224 - protein, 19 aa, Plasmodium falciparum
QKKHISININRKCASYNNI

SEQ ID NO: 3370225 - protein, 27 aa, Plasmodium falciparum
QKKKEMSFCKNKEKYKKKKISLINEYE

SEQ ID NO: 3370226 - protein, 17 aa, Plasmodium falciparum
QKKKFALSFLYEKDKFR

SEQ ID NO: 3370227 - protein, 21 aa, Plasmodium falciparum
QKKKIILCTAGYEKCNEQKMI

SEQ ID NO: 3370228 - protein, 20 aa, Plasmodium falciparum
QKKKKKIIVRKINVSGKNKK

SEQ ID NO: 3370229 - protein, 26 aa, Plasmodium falciparum
QKKKKKRKFTAFSIFAREKRKEYKEK

SEQ ID NO: 3370230 - protein, 24 aa, Plasmodium falciparum
QKKKLNCFDFILGNEILYRKENYY

SEQ ID NO: 3370231 - protein, 29 aa, Plasmodium falciparum
QKKKNIFLMRCLKFLKSMKNILQLLCNEE

SEQ ID NO: 3370232 - protein, 17 aa, Plasmodium falciparum
QKKLRYLKMKDKKEEKK

SEQ ID NO: 3370233 - protein, 18 aa, Plasmodium falciparum
QKKLSILSDQNCKLEEEM

SEQ ID NO: 3370234 - protein, 18 aa, Plasmodium falciparum
QKKLTSFFPLTKRANSSN

SEQ ID NO: 3370235 - protein, 18 aa, Plasmodium falciparum
QKKMIWKRKLEISPIDYG

SEQ ID NO: 3370236 - protein, 26 aa, Plasmodium falciparum
QKKNLDVLKILKLSGKHYNYIFEKNN

SEQ ID NO: 3370237 - protein, 17 aa, Plasmodium falciparum
QKKNVELAAHFDEIQAL

SEQ ID NO: 3370238 - protein, 34 aa, Plasmodium falciparum
QKKQVPDYLCCKISMCLMNEPVITPSGMTYDKIF

SEQ ID NO: 3370239 - protein, 17 aa, Plasmodium falciparum
QKKRKVLQNKDNFEEDN

SEQ ID NO: 3370240 - protein, 26 aa, Plasmodium falciparum
QKKSKAAAGLAEWVLNITSFYKIIQN

SEQ ID NO: 3370241 - protein, 20 aa, Plasmodium falciparum
QKKSKIFVGSFFNVKDVEIE

SEQ ID NO: 3370242 - protein, 19 aa, Plasmodium falciparum
QKKTDIYIYDTLKLIQDHD

SEQ ID NO: 3370243 - protein, 24 aa, Plasmodium falciparum
QKKYKIKISEWKDDKSHTFHKKND

SEQ ID NO: 3370244 - protein, 26 aa, Plasmodium falciparum
QKKYLNKRCISLFSSIRYYYYCDNNV

SEQ ID NO: 3370245 - protein, 17 aa, Plasmodium falciparum
QKLKDHKNSAILFNDEQ

SEQ ID NO: 3370246 - protein, 20 aa, Plasmodium falciparum
QKLKFAKELIKLLNKTNQTV

SEQ ID NO: 3370247 - protein, 31 aa, Plasmodium falciparum
QKLKIARYSWKAENPKAYVFALHGITSHLRN

SEQ ID NO: 3370248 - protein, 17 aa, Plasmodium falciparum
QKLKLISFVLEQEICVF

SEQ ID NO: 3370249 - protein, 47 aa, Plasmodium falciparum
QKLKRKHVPEEVVISLEFLNFCVKNLGLFFARFIDESFMKKISKLLR

SEQ ID NO: 3370250 - protein, 17 aa, Plasmodium falciparum
QKLLKKKLIVIGLTQVI

SEQ ID NO: 3370251 - protein, 31 aa, Plasmodium falciparum
QKLLKQYIILKGYYKNVCKKYRQENELLKSF

SEQ ID NO: 3370252 - protein, 23 aa, Plasmodium falciparum
QKLQYKINIHIEKETEIKKTNDI

SEQ ID NO: 3370253 - protein, 25 aa, Plasmodium falciparum
QKLYILMEFCDAGDLSRNIQKCYKM

SEQ ID NO: 3370254 - protein, 23 aa, Plasmodium falciparum
QKLYRIITCMNREKTLMPPVVLA

SEQ ID NO: 3370255 - protein, 23 aa, Plasmodium falciparum
QKNEIKEAFDLFDTEKTGKIDYH

SEQ ID NO: 3370256 - protein, 23 aa, Plasmodium falciparum
QKNEKRKISSRIINSSKFNTNDC

SEQ ID NO: 3370257 - protein, 34 aa, Plasmodium falciparum
QKNIIKRSNHIFVYLKRFLKNRDQKMNFIINKIN

SEQ ID NO: 3370258 - protein, 20 aa, Plasmodium falciparum
QKNKCKRFLQKYAGEPDFSD

SEQ ID NO: 3370259 - protein, 17 aa, Plasmodium falciparum
QKNKEKYVHIVQSLTNQ

SEQ ID NO: 3370260 - protein, 26 aa, Plasmodium falciparum
QKNKKCFKCGLQLNGIMNTAQNIIDI

SEQ ID NO: 3370261 - protein, 24 aa, Plasmodium falciparum
QKNLNSCLSLKLKSIHIKLNNLFL

SEQ ID NO: 3370262 - protein, 18 aa, Plasmodium falciparum
QKNNFCNMNCLKKNSNDL

SEQ ID NO: 3370263 - protein, 26 aa, Plasmodium falciparum
QKNPYKFNEIFLLPIDIKNNVKDEKN

SEQ ID NO: 3370264 - protein, 20 aa, Plasmodium falciparum
QKNSYAFIEFSTYEVAKYCF

SEQ ID NO: 3370265 - protein, 17 aa, Plasmodium falciparum
QKPYLTYKYEFKYRDPI

SEQ ID NO: 3370266 - protein, 23 aa, Plasmodium falciparum
QKQEKQKICAITNLEGKYFDPLT

SEQ ID NO: 3370267 - protein, 18 aa, Plasmodium falciparum
QKQELMKQGFAKWNKAEF

SEQ ID NO: 3370268 - protein, 19 aa, Plasmodium falciparum
QKRIECAISDSYKDQNACE

SEQ ID NO: 3370269 - protein, 24 aa, Plasmodium falciparum
QKRIMEQFESLNLLLNGSNINNNN

SEQ ID NO: 3370270 - protein, 33 aa, Plasmodium falciparum
QKRKEASRKWKIIARNILHKEMQLLLETIHYDK

SEQ ID NO: 3370271 - protein, 20 aa, Plasmodium falciparum
QKRKESINMVSKKKKSKNND

SEQ ID NO: 3370272 - protein, 26 aa, Plasmodium falciparum
QKRKSKCGKWQLPIPKIQALNEAEML

SEQ ID NO: 3370273 - protein, 18 aa, Plasmodium falciparum
QKRKTCDISSLSKNQSLN

SEQ ID NO: 3370274 - protein, 20 aa, Plasmodium falciparum
QKRLSELARKSSLASQILTK

SEQ ID NO: 3370275 - protein, 21 aa, Plasmodium falciparum
QKRSTFCGTIDYMPPEIINQI

SEQ ID NO: 3370276 - protein, 33 aa, Plasmodium falciparum
QKRYLKIALCFNNFKIKIIDIILNIVNKEENKI

SEQ ID NO: 3370277 - protein, 20 aa, Plasmodium falciparum
QKSECLKEQTSLLKMGPPIN

SEQ ID NO: 3370278 - protein, 18 aa, Plasmodium falciparum
QKSLGVCFYNYLKYEFLM

SEQ ID NO: 3370279 - protein, 17 aa, Plasmodium falciparum
QKSLLKEMISAGFEALV

SEQ ID NO: 3370280 - protein, 24 aa, Plasmodium falciparum
QKSREIIFQTLLNWDKLNECTTYV

SEQ ID NO: 3370281 - protein, 22 aa, Plasmodium falciparum
QKSVYICPMKAIVNERYKSWKS

SEQ ID NO: 3370282 - protein, 31 aa, Plasmodium falciparum
QKTFKLDMNILCYFVTAGINPPVSFDEIDSC

SEQ ID NO: 3370283 - protein, 24 aa, Plasmodium falciparum
QKTFLKEKLETFINNKKKKVLKNI

SEQ ID NO: 3370284 - protein, 28 aa, Plasmodium falciparum
QKTKENIKRASAASIILENNFNSDHIDE

SEQ ID NO: 3370285 - protein, 19 aa, Plasmodium falciparum
QKTKREMHSDIFFSSYPSK

SEQ ID NO: 3370286 - protein, 24 aa, Plasmodium falciparum
QKTPHPYPHWTIKEIHEQSATLSK

SEQ ID NO: 3370287 - protein, 20 aa, Plasmodium falciparum
QKVKRICDHFSVNSPDILIV

SEQ ID NO: 3370288 - protein, 25 aa, Plasmodium falciparum
QKVWESIICKGLGYSKEEIRRDVER

SEQ ID NO: 3370289 - protein, 20 aa, Plasmodium falciparum
QKYFEYQNEFMVNKGKNENE

SEQ ID NO: 3370290 - protein, 17 aa, Plasmodium falciparum
QKYFVTPSFLPGQNELY

SEQ ID NO: 3370291 - protein, 19 aa, Plasmodium falciparum
QKYKCDFVATLYEGDPKLK

SEQ ID NO: 3370292 - protein, 22 aa, Plasmodium falciparum
QKYKENLFIVAFDTIFDYGYYL

SEQ ID NO: 3370293 - protein, 19 aa, Plasmodium falciparum
QKYYDVREIFSFIRENSQI

SEQ ID NO: 3370294 - protein, 27 aa, Plasmodium falciparum
QLAFEMFEFARKCFEKLLEEKKDVPKR

SEQ ID NO: 3370295 - protein, 24 aa, Plasmodium falciparum
QLAHKCILNSFYGYVKRRSSRWYS

SEQ ID NO: 3370296 - protein, 24 aa, Plasmodium falciparum
QLAIHALNGFVCGQNILNVKKATF

SEQ ID NO: 3370297 - protein, 24 aa, Plasmodium falciparum
QLALKKLKVCVGMPYPYDKKKKYV

SEQ ID NO: 3370298 - protein, 18 aa, Plasmodium falciparum
QLCACPVQNFVNVKLNFC

SEQ ID NO: 3370299 - protein, 20 aa, Plasmodium falciparum
QLCNTLSNILIEYIKNIKGI

SEQ ID NO: 3370300 - protein, 30 aa, Plasmodium falciparum
QLDNLDFFELLKCYHSLNIQQIQIKLYWIY

SEQ ID NO: 3370301 - protein, 22 aa, Plasmodium falciparum
QLDPSVKFTASELMNRMSNNEE

SEQ ID NO: 3370302 - protein, 21 aa, Plasmodium falciparum
QLEGTWSFCIIHKNHPDEMIL

SEQ ID NO: 3370303 - protein, 21 aa, Plasmodium falciparum
QLEKSILTFTHFCTNISNQTH

SEQ ID NO: 3370304 - protein, 17 aa, Plasmodium falciparum
QLFIPIKEIKLHVQEIF

SEQ ID NO: 3370305 - protein, 20 aa, Plasmodium falciparum
QLGTHISFVRSTGMDKFTAK

SEQ ID NO: 3370306 - protein, 19 aa, Plasmodium falciparum
QLHFYDWSSGYKYDTLSNK

SEQ ID NO: 3370307 - protein, 25 aa, Plasmodium falciparum
QLIIIKLKCKGDHTFHFITNNSNIP

SEQ ID NO: 3370308 - protein, 26 aa, Plasmodium falciparum
QLIQKGHNLWSLPFIQAAKLERLNIL

SEQ ID NO: 3370309 - protein, 19 aa, Plasmodium falciparum
QLISELKRGPELPIKGKSK

SEQ ID NO: 3370310 - protein, 18 aa, Plasmodium falciparum
QLKIYKAREKKWINLVKL

SEQ ID NO: 3370311 - protein, 25 aa, Plasmodium falciparum
QLLKRRLRFPALHLPTLQKEYRKKF

SEQ ID NO: 3370312 - protein, 17 aa, Plasmodium falciparum
QLLPFSYQIFRVKNIKV

SEQ ID NO: 3370313 - protein, 19 aa, Plasmodium falciparum
QLLRSCVELAKLWRTDRYL

SEQ ID NO: 3370314 - protein, 28 aa, Plasmodium falciparum
QLLYHINIFRKAVCMMIFNIENIIGKKT

SEQ ID NO: 3370315 - protein, 17 aa, Plasmodium falciparum
QLNDSWGGKGLLGCNVA

SEQ ID NO: 3370316 - protein, 23 aa, Plasmodium falciparum
QLNEEVRSLFYFCEDNIHRYRIS

SEQ ID NO: 3370317 - protein, 24 aa, Plasmodium falciparum
QLNEFKHTYIIVKGYENFIGKKIL

SEQ ID NO: 3370318 - protein, 24 aa, Plasmodium falciparum
QLNFNYPFFYLLNVIKRYHINIKK

SEQ ID NO: 3370319 - protein, 19 aa, Plasmodium falciparum
QLNIKDVNNLLIIMNNMHM

SEQ ID NO: 3370320 - protein, 25 aa, Plasmodium falciparum
QLNKCMWNQLVVSRKCIKKFVCNYS

SEQ ID NO: 3370321 - protein, 22 aa, Plasmodium falciparum
QLNKSTGMDVFLKKQSYTKNDD

SEQ ID NO: 3370322 - protein, 18 aa, Plasmodium falciparum
QLNYGYRGIEHDIDETDY

SEQ ID NO: 3370323 - protein, 23 aa, Plasmodium falciparum
QLPKGLFYFKWSYFIRYKNRKII

SEQ ID NO: 3370324 - protein, 18 aa, Plasmodium falciparum
QLQITRFINSDSPAVSQL

SEQ ID NO: 3370325 - protein, 28 aa, Plasmodium falciparum
QLQKKIENFECKMLYNVLIDNFLLHIRK

SEQ ID NO: 3370326 - protein, 19 aa, Plasmodium falciparum
QLRCDCTYRSKLAEQAERY

SEQ ID NO: 3370327 - protein, 21 aa, Plasmodium falciparum
QLRKRSRTTFKLKNIEKKYIY

SEQ ID NO: 3370328 - protein, 26 aa, Plasmodium falciparum
QLSIFYKKKIFFQYKGAKYLHNNYNM

SEQ ID NO: 3370329 - protein, 20 aa, Plasmodium falciparum
QLSKCKNGYVIKRSVRTSIF

SEQ ID NO: 3370330 - protein, 18 aa, Plasmodium falciparum
QLSSYNFYYVIKIQDENK

SEQ ID NO: 3370331 - protein, 35 aa, Plasmodium falciparum
QLTGMYRYKYRLMRQVRMCKDLKHLIYYRFNTGSV

SEQ ID NO: 3370332 - protein, 19 aa, Plasmodium falciparum
QLTKYIFKCCKYLHQSKYR

SEQ ID NO: 3370333 - protein, 19 aa, Plasmodium falciparum
QLVKLACTYKELNYFNYIY

SEQ ID NO: 3370334 - protein, 17 aa, Plasmodium falciparum
QLVNILLSYSYFFKKQP

SEQ ID NO: 3370335 - protein, 22 aa, Plasmodium falciparum
QLYDSFYYKEHLIIVTEYMQSD

SEQ ID NO: 3370336 - protein, 24 aa, Plasmodium falciparum
QLYLKGKFVPKYKINNEHDIKKKR

SEQ ID NO: 3370337 - protein, 21 aa, Plasmodium falciparum
QLYPLNKYFLFIVKPVILISF

SEQ ID NO: 3370338 - protein, 20 aa, Plasmodium falciparum
QMACVKFFMETHPGSVGDGV

SEQ ID NO: 3370339 - protein, 31 aa, Plasmodium falciparum
QMCLNHQKFNIAFICYFLLHKINKCIHILLS

SEQ ID NO: 3370340 - protein, 18 aa, Plasmodium falciparum
QMDLRIQMDPRMQMDPRM

SEQ ID NO: 3370341 - protein, 30 aa, Plasmodium falciparum
QMESLKEKLSLLMECFKNNIDNVIMKEVFN

SEQ ID NO: 3370342 - protein, 19 aa, Plasmodium falciparum
QMHPEMDFSKANINYGNSS

SEQ ID NO: 3370343 - protein, 20 aa, Plasmodium falciparum
QMIFSSPISEGWGMTEVGVG

SEQ ID NO: 3370344 - protein, 25 aa, Plasmodium falciparum
QMIKSHPFLNMFLLFETNGNISIWC

SEQ ID NO: 3370345 - protein, 20 aa, Plasmodium falciparum
QMKLINWAGYHVKNNLICYI

SEQ ID NO: 3370346 - protein, 25 aa, Plasmodium falciparum
QMKNIRYLVCDEIDKMIEISFMKDI

SEQ ID NO: 3370347 - protein, 24 aa, Plasmodium falciparum
QMLDSLNYWYGSSFSKENILKKNK

SEQ ID NO: 3370348 - protein, 19 aa, Plasmodium falciparum
QMLSCKFLLKKMKKAKSEE

SEQ ID NO: 3370349 - protein, 23 aa, Plasmodium falciparum
QMMIPNFLETFFLNNMNNTVLCY

SEQ ID NO: 3370350 - protein, 24 aa, Plasmodium falciparum
QMNGKILNGRALRIDYKRKKNPGD

SEQ ID NO: 3370351 - protein, 18 aa, Plasmodium falciparum
QMNKEYLKNIPMDKNKNK

SEQ ID NO: 3370352 - protein, 26 aa, Plasmodium falciparum
QMRTFKEIFFSLGFEEMETHNYVESS

SEQ ID NO: 3370353 - protein, 20 aa, Plasmodium falciparum
QMYQNLRVIWIDAHGDINIP

SEQ ID NO: 3370354 - protein, 18 aa, Plasmodium falciparum
QNANELILELKLAQNEQI

SEQ ID NO: 3370355 - protein, 18 aa, Plasmodium falciparum
QNAPIRNMHSLNVNKKSE

SEQ ID NO: 3370356 - protein, 25 aa, Plasmodium falciparum
QNDLGEFYALISLCNPDLFDDINLF

SEQ ID NO: 3370357 - protein, 19 aa, Plasmodium falciparum
QNDTFICMCHLQDDNTILF

SEQ ID NO: 3370358 - protein, 25 aa, Plasmodium falciparum
QNDYLLCTINEFLKQGLKNECIPLF

SEQ ID NO: 3370359 - protein, 26 aa, Plasmodium falciparum
QNEEAKKLLTLMGIPIIEAPCEAESQ

SEQ ID NO: 3370360 - protein, 21 aa, Plasmodium falciparum
QNEENLCLLKMDLHEEESPVK

SEQ ID NO: 3370361 - protein, 25 aa, Plasmodium falciparum
QNEIKYSNMNSMAEMFSFGVHNNSS

SEQ ID NO: 3370362 - protein, 20 aa, Plasmodium falciparum
QNELFKIDFNNLVKKKKKLL

SEQ ID NO: 3370363 - protein, 23 aa, Plasmodium falciparum
QNELKMKFDDDILKIYEQNINNV

SEQ ID NO: 3370364 - protein, 18 aa, Plasmodium falciparum
QNENRYYVTFNFENENLM

SEQ ID NO: 3370365 - protein, 21 aa, Plasmodium falciparum
QNEYGLTCTFIQSNDEKKKEE

SEQ ID NO: 3370366 - protein, 29 aa, Plasmodium falciparum
QNFELPLKWHYAALCSITMLNDFNYKACL

SEQ ID NO: 3370367 - protein, 17 aa, Plasmodium falciparum
QNFKYKSFQEFEKDVLL

SEQ ID NO: 3370368 - protein, 17 aa, Plasmodium falciparum
QNFLDNFLFKRDSNEIN

SEQ ID NO: 3370369 - protein, 24 aa, Plasmodium falciparum
QNFLKNFKYVWSLNNELFPEIFQR

SEQ ID NO: 3370370 - protein, 26 aa, Plasmodium falciparum
QNFQCTKEILIIVSMLSSPSIFLESK

SEQ ID NO: 3370371 - protein, 28 aa, Plasmodium falciparum
QNGKKYKYQWIILLPFVDKERIIKHARP

SEQ ID NO: 3370372 - protein, 22 aa, Plasmodium falciparum
QNGLFVFLSHMFLKNNVDMNNT

SEQ ID NO: 3370373 - protein, 24 aa, Plasmodium falciparum
QNHSKNSFSKGFGIQNNANVYNQH

SEQ ID NO: 3370374 - protein, 27 aa, Plasmodium falciparum
QNIDILYICEFCLSFFKEYSELKRHIE

SEQ ID NO: 3370375 - protein, 20 aa, Plasmodium falciparum
QNIEICKKLSQLLYIKSDNS

SEQ ID NO: 3370376 - protein, 26 aa, Plasmodium falciparum
QNIHSRFRCAISLKGKEENDTHDNNN

SEQ ID NO: 3370377 - protein, 23 aa, Plasmodium falciparum
QNIIRRTQLLHILDINTYKDHIN

SEQ ID NO: 3370378 - protein, 17 aa, Plasmodium falciparum
QNIKTRSSIFVDSNNFS

SEQ ID NO: 3370379 - protein, 17 aa, Plasmodium falciparum
QNINEFNNSVLISNNKY

SEQ ID NO: 3370380 - protein, 24 aa, Plasmodium falciparum
QNINSEWSWSWGRLPHLKTHDAVS

SEQ ID NO: 3370381 - protein, 21 aa, Plasmodium falciparum
QNIPKAMVLYIRNKLSNKLKN

SEQ ID NO: 3370382 - protein, 20 aa, Plasmodium falciparum
QNIRICISITKPRNLSVFHP

SEQ ID NO: 3370383 - protein, 24 aa, Plasmodium falciparum
QNITNCKYALLGILKVSKYTKKNT

SEQ ID NO: 3370384 - protein, 17 aa, Plasmodium falciparum
QNIYNFMNLCSTNNQSL

SEQ ID NO: 3370385 - protein, 17 aa, Plasmodium falciparum
QNKCAVESILRWNNNIF

SEQ ID NO: 3370386 - protein, 25 aa, Plasmodium falciparum
QNKCVQDIFWCYSLNNGKWTQIQNS

SEQ ID NO: 3370387 - protein, 23 aa, Plasmodium falciparum
QNKELRLKSFEKVLNKIDNIIFF

SEQ ID NO: 3370388 - protein, 24 aa, Plasmodium falciparum
QNKKCKDNNLFGSVEYKINMENKN

SEQ ID NO: 3370389 - protein, 22 aa, Plasmodium falciparum
QNKLRIFEPMLRLNLTCESTVL

SEQ ID NO: 3370390 - protein, 26 aa, Plasmodium falciparum
QNKQLSYTELQSFFIDKINLLNQIGY

SEQ ID NO: 3370391 - protein, 19 aa, Plasmodium falciparum
QNKTICSNAPFSNNEDHNI

SEQ ID NO: 3370392 - protein, 24 aa, Plasmodium falciparum
QNLFNIYVCSYLMKKNNYNISHIE

SEQ ID NO: 3370393 - protein, 20 aa, Plasmodium falciparum
QNLHGKKCSDNMCEETNKEE

SEQ ID NO: 3370394 - protein, 17 aa, Plasmodium falciparum
QNLILSWLTFKKNQTVN

SEQ ID NO: 3370395 - protein, 24 aa, Plasmodium falciparum
QNLKRCGRCKKVYYCSVECQKSDY

SEQ ID NO: 3370396 - protein, 17 aa, Plasmodium falciparum
QNNAFRLCQYRLMVEKL

SEQ ID NO: 3370397 - protein, 23 aa, Plasmodium falciparum
QNNEYYESFFIPKNLTEFNFKDN

SEQ ID NO: 3370398 - protein, 18 aa, Plasmodium falciparum
QNNKSRKPKEVLLDTQQL

SEQ ID NO: 3370399 - protein, 28 aa, Plasmodium falciparum
QNNLFKKRKLKNECLPNIYNKNNKYLEK

SEQ ID NO: 3370400 - protein, 18 aa, Plasmodium falciparum
QNNMSFNNLMWNNYYQDI

SEQ ID NO: 3370401 - protein, 31 aa, Plasmodium falciparum
QNQKVIIPYKFQLICSLTKWNVQRTSEQIKN

SEQ ID NO: 3370402 - protein, 26 aa, Plasmodium falciparum
QNRIECSLCGHLLLNQNIDNEQNDYN

SEQ ID NO: 3370403 - protein, 25 aa, Plasmodium falciparum
QNSADCWKYCMSKFLESNKLEVKFF

SEQ ID NO: 3370404 - protein, 19 aa, Plasmodium falciparum
QNSEFIKRQMNSYFKEINN

SEQ ID NO: 3370405 - protein, 17 aa, Plasmodium falciparum
QNSEGWIKENDKYLDLS

SEQ ID NO: 3370406 - protein, 19 aa, Plasmodium falciparum
QNVLYDFKHINVEVQDIMC

SEQ ID NO: 3370407 - protein, 17 aa, Plasmodium falciparum
QNVPILFIHSRHDSVCA

SEQ ID NO: 3370408 - protein, 17 aa, Plasmodium falciparum
QNVRGYESDNCMGLENN

SEQ ID NO: 3370409 - protein, 17 aa, Plasmodium falciparum
QNVRKGINFCLNTYNRE

SEQ ID NO: 3370410 - protein, 17 aa, Plasmodium falciparum
QNVSSFMNAGWQTPKKS

SEQ ID NO: 3370411 - protein, 25 aa, Plasmodium falciparum
QNVYDDFYYIISIFNPILKYISKYK

SEQ ID NO: 3370412 - protein, 24 aa, Plasmodium falciparum
QNWRPEYITDLYFFIKKNYHKMDS

SEQ ID NO: 3370413 - protein, 22 aa, Plasmodium falciparum
QNWVCFLCSKCKAVEEQKKRRK

SEQ ID NO: 3370414 - protein, 24 aa, Plasmodium falciparum
QNYDVVCNFTKYLNVKVFLAVPLC

SEQ ID NO: 3370415 - protein, 23 aa, Plasmodium falciparum
QNYIKELLIQKMYYQKEFYNNND

SEQ ID NO: 3370416 - protein, 33 aa, Plasmodium falciparum
QNYKNFMQYCSIPGFNSVLFSQRVIELYRKEEH

SEQ ID NO: 3370417 - protein, 37 aa, Plasmodium falciparum
QPASDRSKARWKVISFNIKCVYQLSAVVLSIDKPFDK

SEQ ID NO: 3370418 - protein, 20 aa, Plasmodium falciparum
QPGVGKTFIAKKICDHYNLI

SEQ ID NO: 3370419 - protein, 22 aa, Plasmodium falciparum
QPKVIICGYTSYPRDIDYKGFR

SEQ ID NO: 3370420 - protein, 17 aa, Plasmodium falciparum
QPNEISNGSILYTLRNN

SEQ ID NO: 3370421 - protein, 25 aa, Plasmodium falciparum
QPNFKCPNCNIILNDKIIKLDKNVK

SEQ ID NO: 3370422 - protein, 19 aa, Plasmodium falciparum
QPNIFRNITKYDLSTPFNV

SEQ ID NO: 3370423 - protein, 32 aa, Plasmodium falciparum
QPNLSALPNFNCTPNLFSPEKQNVSIFGSRSK

SEQ ID NO: 3370424 - protein, 25 aa, Plasmodium falciparum
QPNRLPDIFIYPSFTNEKSYIKEVH

SEQ ID NO: 3370425 - protein, 22 aa, Plasmodium falciparum
QPPKLQEIGPRFEFTLEENYKT

SEQ ID NO: 3370426 - protein, 20 aa, Plasmodium falciparum
QPRRVAAVSVAYRVSYEMNV

SEQ ID NO: 3370427 - protein, 26 aa, Plasmodium falciparum
QPVIEDRFFLEWLVNIPSNEEAERKG

SEQ ID NO: 3370428 - protein, 24 aa, Plasmodium falciparum
QPYDSLFRKNCVSFYEDFDTEAIF

SEQ ID NO: 3370429 - protein, 36 aa, Plasmodium falciparum
QQEKYLFLKNMKKNIIFEIIKIAMFALLKVNLNDNN

SEQ ID NO: 3370430 - protein, 26 aa, Plasmodium falciparum
QQETFKRKFNCINMYLEDMERGEQKQ

SEQ ID NO: 3370431 - protein, 21 aa, Plasmodium falciparum
QQHGRCFVRPSGTENLLRIYA

SEQ ID NO: 3370432 - protein, 28 aa, Plasmodium falciparum
QQIQIKLYWIYYKIQMFEQSNLLSCDNK

SEQ ID NO: 3370433 - protein, 18 aa, Plasmodium falciparum
QQLKCNTLPFFIGYSPCT

SEQ ID NO: 3370434 - protein, 23 aa, Plasmodium falciparum
QQLLRIMERLNLKILSIKPSNPE

SEQ ID NO: 3370435 - protein, 19 aa, Plasmodium falciparum
QQLNECLNLILSNKKSDMF

SEQ ID NO: 3370436 - protein, 26 aa, Plasmodium falciparum
QQPFPNIFFKKARNFNSFQCVTNPYL

SEQ ID NO: 3370437 - protein, 26 aa, Plasmodium falciparum
QQSNVFCKIFKHFNENKIIDQSIINK

SEQ ID NO: 3370438 - protein, 17 aa, Plasmodium falciparum
QQTFAIFQGYCVEIRKK

SEQ ID NO: 3370439 - protein, 18 aa, Plasmodium falciparum
QQYFKKKILSLFESGKKL

SEQ ID NO: 3370440 - protein, 17 aa, Plasmodium falciparum
QQYNVSFERDFDNRRLN

SEQ ID NO: 3370441 - protein, 35 aa, Plasmodium falciparum
QRADFGINVGYAIIYECVKTIATIYPSHHLLELAS

SEQ ID NO: 3370442 - protein, 18 aa, Plasmodium falciparum
QRCLIKCMESVILHYDGT

SEQ ID NO: 3370443 - protein, 22 aa, Plasmodium falciparum
QREGVQFVFECLMNIKDDKISG

SEQ ID NO: 3370444 - protein, 19 aa, Plasmodium falciparum
QREIIKKGKTQNINSNKKI

SEQ ID NO: 3370445 - protein, 25 aa, Plasmodium falciparum
QREIKNFQKSFSFYFEKPCNENTYK

SEQ ID NO: 3370446 - protein, 19 aa, Plasmodium falciparum
QRHVGCFFESKNVLGRANR

SEQ ID NO: 3370447 - protein, 25 aa, Plasmodium falciparum
QRILYLCLHELFVFKVMNTDPNLGN

SEQ ID NO: 3370448 - protein, 17 aa, Plasmodium falciparum
QRIQVEHDRDVHYNTTQ

SEQ ID NO: 3370449 - protein, 23 aa, Plasmodium falciparum
QRIRYLRRYGKIGQFVSIYDNFL

SEQ ID NO: 3370450 - protein, 33 aa, Plasmodium falciparum
QRISLELNIKLIKWKILKDLKFEHIKKLKILII

SEQ ID NO: 3370451 - protein, 20 aa, Plasmodium falciparum
QRKIFVGGLNYYWTKDTLES

SEQ ID NO: 3370452 - protein, 19 aa, Plasmodium falciparum
QRKLLNWIIHPIRDEKKIN

SEQ ID NO: 3370453 - protein, 22 aa, Plasmodium falciparum
QRKNEFIFLWPKTFHGGFNSGY

SEQ ID NO: 3370454 - protein, 20 aa, Plasmodium falciparum
QRKWRSDNIITTKGKEDKEY

SEQ ID NO: 3370455 - protein, 18 aa, Plasmodium falciparum
QRLEESVEKHKRRLLITR

SEQ ID NO: 3370456 - protein, 25 aa, Plasmodium falciparum
QRLKGKEGRFRCNLSGKRVDFSSRT

SEQ ID NO: 3370457 - protein, 19 aa, Plasmodium falciparum
QRLKKELLHILKEKNYSEN

SEQ ID NO: 3370458 - protein, 29 aa, Plasmodium falciparum
QRLSRLQQRFRMHPIRHHMNNPLNTPMQY

SEQ ID NO: 3370459 - protein, 20 aa, Plasmodium falciparum
QRNAQWVFKVFSYEKKKLTF

SEQ ID NO: 3370460 - protein, 19 aa, Plasmodium falciparum
QRNHCNKNYINFIKEDQQE

SEQ ID NO: 3370461 - protein, 18 aa, Plasmodium falciparum
QRNIKFAGLESEIKNDIN

SEQ ID NO: 3370462 - protein, 19 aa, Plasmodium falciparum
QRNLVFVIGITATYAKKTV

SEQ ID NO: 3370463 - protein, 23 aa, Plasmodium falciparum
QRNNIKAAHSFMTKNYKKRDLPK

SEQ ID NO: 3370464 - protein, 30 aa, Plasmodium falciparum
QRNPSTNELMAFGFCEFSDIYEVYLCMNIL

SEQ ID NO: 3370465 - protein, 18 aa, Plasmodium falciparum
QRQKIIWKKWIAKHPNKM

SEQ ID NO: 3370466 - protein, 18 aa, Plasmodium falciparum
QRSFKKAYQTNFNYKNTY

SEQ ID NO: 3370467 - protein, 17 aa, Plasmodium falciparum
QRSGSNFLACKNLKERL

SEQ ID NO: 3370468 - protein, 20 aa, Plasmodium falciparum
QRSLLALSLILALLKVRTVP

SEQ ID NO: 3370469 - protein, 29 aa, Plasmodium falciparum
QRYMLLFLCPYGENFIRLLFTSLTYMNVH

SEQ ID NO: 3370470 - protein, 18 aa, Plasmodium falciparum
QSCFYKYSPNYAKSNSNI

SEQ ID NO: 3370471 - protein, 25 aa, Plasmodium falciparum
QSEEFLKNDFSWKSEINNIKNMNKQ

SEQ ID NO: 3370472 - protein, 20 aa, Plasmodium falciparum
QSEQIIFNIFKQVDNSNFLE

SEQ ID NO: 3370473 - protein, 17 aa, Plasmodium falciparum
QSFDIIMNAARITLQNI

SEQ ID NO: 3370474 - protein, 18 aa, Plasmodium falciparum
QSFFMEAMNFLRNTTNND

SEQ ID NO: 3370475 - protein, 23 aa, Plasmodium falciparum
QSFSAPIPLLMGDVCGTEKDGDE

SEQ ID NO: 3370476 - protein, 18 aa, Plasmodium falciparum
QSGCDFIKQNGGDFIKPN

SEQ ID NO: 3370477 - protein, 22 aa, Plasmodium falciparum
QSHIRRYLMVRFYKTYRQNYYA

SEQ ID NO: 3370478 - protein, 17 aa, Plasmodium falciparum
QSHLCRFLRGLQRIADI

SEQ ID NO: 3370479 - protein, 27 aa, Plasmodium falciparum
QSILNRLGKIPPFEFDPPIPLYDLLLV

SEQ ID NO: 3370480 - protein, 25 aa, Plasmodium falciparum
QSKEKLRNWIAIFYEKMADILFVYE

SEQ ID NO: 3370481 - protein, 28 aa, Plasmodium falciparum
QSKIWDLRNFKSLFTFGNGLSCSSNKSI

SEQ ID NO: 3370482 - protein, 17 aa, Plasmodium falciparum
QSKKSYELLRFLFDLYK

SEQ ID NO: 3370483 - protein, 22 aa, Plasmodium falciparum
QSKNCTRNFCNVNEEDRKEEGM

SEQ ID NO: 3370484 - protein, 25 aa, Plasmodium falciparum
QSLDGMLKKNCFSNENYNILNEKNE

SEQ ID NO: 3370485 - protein, 19 aa, Plasmodium falciparum
QSLDIAWELLRIFPEDMLK

SEQ ID NO: 3370486 - protein, 22 aa, Plasmodium falciparum
QSLETICLLLAYKIKYPENFFL

SEQ ID NO: 3370487 - protein, 17 aa, Plasmodium falciparum
QSLKDSILFDNINEKEY

SEQ ID NO: 3370488 - protein, 25 aa, Plasmodium falciparum
QSLKFLKSYISYRLCEINRFGNFYI

SEQ ID NO: 3370489 - protein, 22 aa, Plasmodium falciparum
QSLLKSLLYIYNFYTNKKDNCF

SEQ ID NO: 3370490 - protein, 25 aa, Plasmodium falciparum
QSLNFEWNYLFFQSLNNLPQCCIDK

SEQ ID NO: 3370491 - protein, 24 aa, Plasmodium falciparum
QSNKKCVNHEAFLSTHEQSKFFNN

SEQ ID NO: 3370492 - protein, 26 aa, Plasmodium falciparum
QSNQFPRSYPEFFEANFGPIDELMDE

SEQ ID NO: 3370493 - protein, 20 aa, Plasmodium falciparum
QSPIRNSVQITRFLIMKSQN

SEQ ID NO: 3370494 - protein, 17 aa, Plasmodium falciparum
QSRCAIIRYFKLSDDQV

SEQ ID NO: 3370495 - protein, 17 aa, Plasmodium falciparum
QSREKRKNIGFVNCFIL

SEQ ID NO: 3370496 - protein, 27 aa, Plasmodium falciparum
QSTVKKYLFDKLNWLKSYDNKDKKKNE

SEQ ID NO: 3370497 - protein, 26 aa, Plasmodium falciparum
QSVDIKKCEGGVMYFPEKSLDYSRNS

SEQ ID NO: 3370498 - protein, 32 aa, Plasmodium falciparum
QSVFEPKMDFTLCINKSIKLFLKDINISKYDK

SEQ ID NO: 3370499 - protein, 25 aa, Plasmodium falciparum
QSVPLRFYLIKNILPILTDALIYIC

SEQ ID NO: 3370500 - protein, 26 aa, Plasmodium falciparum
QSWFHRRWLIEYIYKMNYRKKNNQRN

SEQ ID NO: 3370501 - protein, 24 aa, Plasmodium falciparum
QSYFIRSISSCLNLNKVDNFEEIE

SEQ ID NO: 3370502 - protein, 17 aa, Plasmodium falciparum
QSYILHYGLYYNDILQI

SEQ ID NO: 3370503 - protein, 24 aa, Plasmodium falciparum
QSYKYILSVSFDYNYLKIVPHVIN

SEQ ID NO: 3370504 - protein, 26 aa, Plasmodium falciparum
QSYLPSMLRYNCHQITEYFSLRKKDK

SEQ ID NO: 3370505 - protein, 17 aa, Plasmodium falciparum
QSYSSLFMRYMQSDDEK

SEQ ID NO: 3370506 - protein, 20 aa, Plasmodium falciparum
QTCEEFYQSLNIPYRIVSIV

SEQ ID NO: 3370507 - protein, 25 aa, Plasmodium falciparum
QTDIYFLCMNCIKNNIFNVTHHMEY

SEQ ID NO: 3370508 - protein, 19 aa, Plasmodium falciparum
QTEGIFKELLDSFQKKQVP

SEQ ID NO: 3370509 - protein, 28 aa, Plasmodium falciparum
QTEMFKLRLNLFCFSFLKSSKNIIKPDG

SEQ ID NO: 3370510 - protein, 33 aa, Plasmodium falciparum
QTEYHLQGIKYWWKNIHSFLGLNSFNNNEDIKT

SEQ ID NO: 3370511 - protein, 25 aa, Plasmodium falciparum
QTFDDYYYMKAHGYDDSEYSTRGKN

SEQ ID NO: 3370512 - protein, 17 aa, Plasmodium falciparum
QTGKCIDKLFGHNSPII

SEQ ID NO: 3370513 - protein, 17 aa, Plasmodium falciparum
QTGRPKTIFLFNNEKKY

SEQ ID NO: 3370514 - protein, 19 aa, Plasmodium falciparum
QTIDFGCCNIIEIIKYNKF

SEQ ID NO: 3370515 - protein, 21 aa, Plasmodium falciparum
QTIDFRYNLSREIKSKDIEEI

SEQ ID NO: 3370516 - protein, 24 aa, Plasmodium falciparum
QTIEELKNLVLFLNNENKRLHTMN

SEQ ID NO: 3370517 - protein, 17 aa, Plasmodium falciparum
QTIEGFIGCFGSFVFDN

SEQ ID NO: 3370518 - protein, 30 aa, Plasmodium falciparum
QTIKCNVDLLKVIQLGVTFSNGKGEMPNVS

SEQ ID NO: 3370519 - protein, 23 aa, Plasmodium falciparum
QTKKAREVWVFGIIRNYVLRGII

SEQ ID NO: 3370520 - protein, 28 aa, Plasmodium falciparum
QTKTPYECIYKFISMPLSNPYFDLNNLY

SEQ ID NO: 3370521 - protein, 18 aa, Plasmodium falciparum
QTKVFKLGLAKSVHHARV

SEQ ID NO: 3370522 - protein, 24 aa, Plasmodium falciparum
QTLIKHIKARIEVLNNNQCGNVYN

SEQ ID NO: 3370523 - protein, 17 aa, Plasmodium falciparum
QTLIKVISSVYDYTKME

SEQ ID NO: 3370524 - protein, 23 aa, Plasmodium falciparum
QTLNLTDCRGMKSVELNEGNWIE

SEQ ID NO: 3370525 - protein, 41 aa, Plasmodium falciparum
QTLYIYGEKNINTFLKWKRFRGMLKRYFFLLKNTNNNNYDN

SEQ ID NO: 3370526 - protein, 18 aa, Plasmodium falciparum
QTLYLVCKYLLYHNKEQL

SEQ ID NO: 3370527 - protein, 17 aa, Plasmodium falciparum
QTNLFIWLHYDIPDNFL

SEQ ID NO: 3370528 - protein, 19 aa, Plasmodium falciparum
QTNLLSIKGIDRVDIKQKK

SEQ ID NO: 3370529 - protein, 24 aa, Plasmodium falciparum
QTNNLRANISIDIHFDENNNNVEN

SEQ ID NO: 3370530 - protein, 18 aa, Plasmodium falciparum
QTNSLKYKCEEENDQNYD

SEQ ID NO: 3370531 - protein, 27 aa, Plasmodium falciparum
QTRDVHKFFKWKCDSMDKQSNGSTHNE

SEQ ID NO: 3370532 - protein, 20 aa, Plasmodium falciparum
QTRIKIGLNSKMPSRFPPVV

SEQ ID NO: 3370533 - protein, 28 aa, Plasmodium falciparum
QTTYGNFPFELCTVLARRFADIGDIIRG

SEQ ID NO: 3370534 - protein, 25 aa, Plasmodium falciparum
QTVPALIRRRAKLQDINMIYKTLYD

SEQ ID NO: 3370535 - protein, 17 aa, Plasmodium falciparum
QTYEIIKELKYCQDVYK

SEQ ID NO: 3370536 - protein, 27 aa, Plasmodium falciparum
QTYLKKEVCLIPFKFFDIDGNGKISVE

SEQ ID NO: 3370537 - protein, 19 aa, Plasmodium falciparum
QVAELRNSLAIKKKTLAEK

SEQ ID NO: 3370538 - protein, 25 aa, Plasmodium falciparum
QVDIERVCCYIKHFIEPPEPLFEVM

SEQ ID NO: 3370539 - protein, 30 aa, Plasmodium falciparum
QVETIKRFLPRSCQILLFSATYNDSVRKFA

SEQ ID NO: 3370540 - protein, 19 aa, Plasmodium falciparum
QVFCFKPPNFYLICQFSLT

SEQ ID NO: 3370541 - protein, 20 aa, Plasmodium falciparum
QVFENIRFNLLNNEHIYEIQ

SEQ ID NO: 3370542 - protein, 23 aa, Plasmodium falciparum
QVGIWCIGEFGDLLIQGKNVGPD

SEQ ID NO: 3370543 - protein, 25 aa, Plasmodium falciparum
QVIMKKKKLLLLIEKAKLQNFTYKN

SEQ ID NO: 3370544 - protein, 23 aa, Plasmodium falciparum
QVKNEAKIYCKAVNIEILAVYGG

SEQ ID NO: 3370545 - protein, 26 aa, Plasmodium falciparum
QVLDLFSYVGCFGIQCSKIGNAKYVI

SEQ ID NO: 3370546 - protein, 21 aa, Plasmodium falciparum
QVLGENLFPLVANYHPTLAGK

SEQ ID NO: 3370547 - protein, 22 aa, Plasmodium falciparum
QVLGSKCSDVKFSERLTTSPAV

SEQ ID NO: 3370548 - protein, 17 aa, Plasmodium falciparum
QVLKHRWFKKFKSNNLI

SEQ ID NO: 3370549 - protein, 25 aa, Plasmodium falciparum
QVLKSEGGFLWACKNYDGDIQSDAV

SEQ ID NO: 3370550 - protein, 18 aa, Plasmodium falciparum
QVMYKYNYIFNEEKNEVE

SEQ ID NO: 3370551 - protein, 26 aa, Plasmodium falciparum
QVNEPFAYDNRVIAFGKYPTDSSKEI

SEQ ID NO: 3370552 - protein, 27 aa, Plasmodium falciparum
QVQDFFKELWTFIQAVEFNRKTINEAL

SEQ ID NO: 3370553 - protein, 23 aa, Plasmodium falciparum
QVVCTMQPLILCLHKYNDDITKC

SEQ ID NO: 3370554 - protein, 25 aa, Plasmodium falciparum
QWCQKRKYLHGKRGIEKIPYRLPPY

SEQ ID NO: 3370555 - protein, 18 aa, Plasmodium falciparum
QWIICGGDDMTIRVYNYN

SEQ ID NO: 3370556 - protein, 24 aa, Plasmodium falciparum
QWNKFLPEWVFNKKCEEIDIKKNI

SEQ ID NO: 3370557 - protein, 22 aa, Plasmodium falciparum
QWPEALYNLLLLIERGNNDVVD

SEQ ID NO: 3370558 - protein, 17 aa, Plasmodium falciparum
QWYINYGNMEFKKDVLI

SEQ ID NO: 3370559 - protein, 17 aa, Plasmodium falciparum
QYAHLTFSLNYLEEEGD

SEQ ID NO: 3370560 - protein, 18 aa, Plasmodium falciparum
QYEDIVIFDLLWSDPQKK

SEQ ID NO: 3370561 - protein, 25 aa, Plasmodium falciparum
QYEELKKFISAYLIYLLQNGNIDDE

SEQ ID NO: 3370562 - protein, 26 aa, Plasmodium falciparum
QYFNIDMFLTMCVLSGCDYSNDFHIT

SEQ ID NO: 3370563 - protein, 17 aa, Plasmodium falciparum
QYFYMFEKYALKTNFFL

SEQ ID NO: 3370564 - protein, 20 aa, Plasmodium falciparum
QYIQQFDWPEELFKLQYFNI

SEQ ID NO: 3370565 - protein, 17 aa, Plasmodium falciparum
QYISWGVDNNPFKYMSD

SEQ ID NO: 3370566 - protein, 18 aa, Plasmodium falciparum
QYIYANLLFKEVNKHNII

SEQ ID NO: 3370567 - protein, 24 aa, Plasmodium falciparum
QYKCSDIDEGCWIKTSYNNNRLHL

SEQ ID NO: 3370568 - protein, 21 aa, Plasmodium falciparum
QYKDSCGYFYIKGKKKGKTKI

SEQ ID NO: 3370569 - protein, 22 aa, Plasmodium falciparum
QYKFFMKLPYITVSEMLTNLFN

SEQ ID NO: 3370570 - protein, 25 aa, Plasmodium falciparum
QYKGYGLCCGIILSGYDHTGFNMFY

SEQ ID NO: 3370571 - protein, 24 aa, Plasmodium falciparum
QYKPCDKPGALGHTSSIILKKKMY

SEQ ID NO: 3370572 - protein, 24 aa, Plasmodium falciparum
QYKTKVSICRLIYAVTSLFQKKLK

SEQ ID NO: 3370573 - protein, 18 aa, Plasmodium falciparum
QYLFYSLNFAHSVTVTNI

SEQ ID NO: 3370574 - protein, 24 aa, Plasmodium falciparum
QYLNEYPLFPVSSIDLYNTDNMNY

SEQ ID NO: 3370575 - protein, 17 aa, Plasmodium falciparum
QYMKYPIANVLNFNECM

SEQ ID NO: 3370576 - protein, 24 aa, Plasmodium falciparum
QYNIQSLLQLQAWEEEKKKYIENK

SEQ ID NO: 3370577 - protein, 24 aa, Plasmodium falciparum
QYNKSGNSPLMWSIQNKHIESTRE

SEQ ID NO: 3370578 - protein, 17 aa, Plasmodium falciparum
QYRSFKLNQLQAKQQKI

SEQ ID NO: 3370579 - protein, 24 aa, Plasmodium falciparum
QYWRYKHRYLLFIIEELRSKEIKS

SEQ ID NO: 3370580 - protein, 19 aa, Plasmodium falciparum
QYYALKWILLLLTQEFDMA

SEQ ID NO: 3370581 - protein, 19 aa, Plasmodium falciparum
RAANLCFLLYPMNNGKSTV

SEQ ID NO: 3370582 - protein, 25 aa, Plasmodium falciparum
RACITFPDFESASLAASQYDGGTLN

SEQ ID NO: 3370583 - protein, 19 aa, Plasmodium falciparum
RADESIYLYELNESELSQY

SEQ ID NO: 3370584 - protein, 22 aa, Plasmodium falciparum
RAERFGLNVVKMNDFEKKKKRA

SEQ ID NO: 3370585 - protein, 20 aa, Plasmodium falciparum
RAGMKGLAISFITEHDSHLF

SEQ ID NO: 3370586 - protein, 17 aa, Plasmodium falciparum
RAKEALEKIYIPINNSI

SEQ ID NO: 3370587 - protein, 17 aa, Plasmodium falciparum
RALDLGMIYLKPTDINF

SEQ ID NO: 3370588 - protein, 25 aa, Plasmodium falciparum
RALLKELRTVISFDSSYVNYRHLSI

SEQ ID NO: 3370589 - protein, 17 aa, Plasmodium falciparum
RALWTGKQIFSMLLQFD

SEQ ID NO: 3370590 - protein, 17 aa, Plasmodium falciparum
RANNFIYPVASSFIETI

SEQ ID NO: 3370591 - protein, 18 aa, Plasmodium falciparum
RANNLYFNYFSKLIDIYL

SEQ ID NO: 3370592 - protein, 27 aa, Plasmodium falciparum
RANRNPVPCVFIQGGFKKNSVFGDAWL

SEQ ID NO: 3370593 - protein, 26 aa, Plasmodium falciparum
RAPWYYEESEETWAKKVLQRNDELME

SEQ ID NO: 3370594 - protein, 21 aa, Plasmodium falciparum
RASFLEKFHKLGFTNVKREHI

SEQ ID NO: 3370595 - protein, 22 aa, Plasmodium falciparum
RASHGSKFVLQHNMDNMENIDN

SEQ ID NO: 3370596 - protein, 24 aa, Plasmodium falciparum
RASRCRVCGFSIEKDNLRIGYPTK

SEQ ID NO: 3370597 - protein, 26 aa, Plasmodium falciparum
RASYVKAWWNLVNWNFANENLKKAMQ

SEQ ID NO: 3370598 - protein, 20 aa, Plasmodium falciparum
RAVKTSSFMTANWYQIPYDI

SEQ ID NO: 3370599 - protein, 19 aa, Plasmodium falciparum
RCDIGLYRIEIENNKQLID

SEQ ID NO: 3370600 - protein, 18 aa, Plasmodium falciparum
RCDLLKLQGEYKVKIREL

SEQ ID NO: 3370601 - protein, 18 aa, Plasmodium falciparum
RCIGRICGSNGSTKYAIE

SEQ ID NO: 3370602 - protein, 18 aa, Plasmodium falciparum
RCIKHILQSLEFNKSNKQ

SEQ ID NO: 3370603 - protein, 29 aa, Plasmodium falciparum
RCKEYYKAGARFAKWRTVLVIDTAKGKPT

SEQ ID NO: 3370604 - protein, 40 aa, Plasmodium falciparum
RCRHVFHCSCIIPWLKERNSCPTCRFELPTDDQEYNCKRE

SEQ ID NO: 3370605 - protein, 25 aa, Plasmodium falciparum
RCRKYNKQIKKSYVHILNANKKQYL

SEQ ID NO: 3370606 - protein, 21 aa, Plasmodium falciparum
RCSLRKPHLLFPLLECHEEKK

SEQ ID NO: 3370607 - protein, 30 aa, Plasmodium falciparum
RCSSGQKVLSSIIIRLALAESFSIKCGILA

SEQ ID NO: 3370608 - protein, 26 aa, Plasmodium falciparum
RCTGVCRKYPPHFGFVKRSMNRPPGP

SEQ ID NO: 3370609 - protein, 35 aa, Plasmodium falciparum
RCTHPVDNCRGFRCSSCGIGTFFIKSEYHDDIPII

SEQ ID NO: 3370610 - protein, 26 aa, Plasmodium falciparum
RCTREKRKTINGEDILYSMEKLGFND

SEQ ID NO: 3370611 - protein, 18 aa, Plasmodium falciparum
RCTTCSGEDALNLMTKEE

SEQ ID NO: 3370612 - protein, 24 aa, Plasmodium falciparum
RCVCYHCGRLLCNVNSSKVKYIEK

SEQ ID NO: 3370613 - protein, 21 aa, Plasmodium falciparum
RCVLLIYFIKWNGYNFHMLKR

SEQ ID NO: 3370614 - protein, 24 aa, Plasmodium falciparum
RCWDFNKICLVFPCMNTYMYNHPI

SEQ ID NO: 3370615 - protein, 17 aa, Plasmodium falciparum
RCYDKIEAQNLIKYYLL

SEQ ID NO: 3370616 - protein, 27 aa, Plasmodium falciparum
RCYLKKRNFYNVCLIKRGIKNSKLNEK

SEQ ID NO: 3370617 - protein, 23 aa, Plasmodium falciparum
RDCYTDFCGLSITRDKLCSLIRK

SEQ ID NO: 3370618 - protein, 21 aa, Plasmodium falciparum
RDDICLSDHIDYCNNKDYSNN

SEQ ID NO: 3370619 - protein, 20 aa, Plasmodium falciparum
RDEFPPEFFETHHANESFYA

SEQ ID NO: 3370620 - protein, 19 aa, Plasmodium falciparum
RDENKLIYDHQFNDNNTPY

SEQ ID NO: 3370621 - protein, 18 aa, Plasmodium falciparum
RDFISTIPKEEWSSVKQD

SEQ ID NO: 3370622 - protein, 25 aa, Plasmodium falciparum
RDFNGKIPLLHKVLKPLPAKNRSNN

SEQ ID NO: 3370623 - protein, 20 aa, Plasmodium falciparum
RDIIKCFKSALSKMNNKKED

SEQ ID NO: 3370624 - protein, 23 aa, Plasmodium falciparum
RDIKEKLCYIAMDYDEELKRSEE

SEQ ID NO: 3370625 - protein, 29 aa, Plasmodium falciparum
RDIKYLRNLPCWNLLKLNPIHPNNIHHNI

SEQ ID NO: 3370626 - protein, 19 aa, Plasmodium falciparum
RDILNYTYVFIRLGDINLL

SEQ ID NO: 3370627 - protein, 24 aa, Plasmodium falciparum
RDIPIAIRFSCTFNGSQEVLKLKI

SEQ ID NO: 3370628 - protein, 22 aa, Plasmodium falciparum
RDIPSYLVYSYIVNMFNKNNMD

SEQ ID NO: 3370629 - protein, 24 aa, Plasmodium falciparum
RDKINGYHAGYGFVEYEYEYECEY

SEQ ID NO: 3370630 - protein, 17 aa, Plasmodium falciparum
RDKKCRPILIINLLKVE

SEQ ID NO: 3370631 - protein, 19 aa, Plasmodium falciparum
RDKNLLFLSFHNMTMKYKC

SEQ ID NO: 3370632 - protein, 18 aa, Plasmodium falciparum
RDLFNLPCEISIQIPDEF

SEQ ID NO: 3370633 - protein, 24 aa, Plasmodium falciparum
RDLIKIYFIRFLYFEKKEENISIL

SEQ ID NO: 3370634 - protein, 20 aa, Plasmodium falciparum
RDLLLVIIYKQVEPMLYKFI

SEQ ID NO: 3370635 - protein, 24 aa, Plasmodium falciparum
RDLMTRPNIFTGRKILGTLELHMN

SEQ ID NO: 3370636 - protein, 22 aa, Plasmodium falciparum
RDLTKLSGYIWMRSLLCYTSER

SEQ ID NO: 3370637 - protein, 19 aa, Plasmodium falciparum
RDNESSLNYHTSIMTKEQP

SEQ ID NO: 3370638 - protein, 18 aa, Plasmodium falciparum
RDNIKLKNRSSCDNIMNK

SEQ ID NO: 3370639 - protein, 20 aa, Plasmodium falciparum
RDNNFMNSNILNFNIKNNTN

SEQ ID NO: 3370640 - protein, 23 aa, Plasmodium falciparum
RDNRLVNLLCSIVLKKINELSPC

SEQ ID NO: 3370641 - protein, 22 aa, Plasmodium falciparum
RDPIGICPLYIGYAADGSIWFS

SEQ ID NO: 3370642 - protein, 20 aa, Plasmodium falciparum
RDPSLRKSGTGNIFVKNLDK

SEQ ID NO: 3370643 - protein, 17 aa, Plasmodium falciparum
RDRMRNFGYRNNGYRHD

SEQ ID NO: 3370644 - protein, 20 aa, Plasmodium falciparum
RDRYLGRHYRYFIRNTRVRA

SEQ ID NO: 3370645 - protein, 20 aa, Plasmodium falciparum
RDSPCLDNRVNLASNETIQN

SEQ ID NO: 3370646 - protein, 18 aa, Plasmodium falciparum
RDSVPKMIGYFLIRKLQE

SEQ ID NO: 3370647 - protein, 19 aa, Plasmodium falciparum
RDVESIKKISYISTGGNNN

SEQ ID NO: 3370648 - protein, 20 aa, Plasmodium falciparum
RDVFYEKQFCKIMNENFEVY

SEQ ID NO: 3370649 - protein, 29 aa, Plasmodium falciparum
RDVINRSCPHEMIEPDMSEGHINMANKNN

SEQ ID NO: 3370650 - protein, 23 aa, Plasmodium falciparum
RDYNKIFFLFFSIFIYNTQNGGD

SEQ ID NO: 3370651 - protein, 24 aa, Plasmodium falciparum
REAGLKPDFIFCRCEEPLTQEAIK

SEQ ID NO: 3370652 - protein, 19 aa, Plasmodium falciparum
RECRKTCCICHNELSENDK

SEQ ID NO: 3370653 - protein, 19 aa, Plasmodium falciparum
REDEKLLRKHLEQNILNNN

SEQ ID NO: 3370654 - protein, 23 aa, Plasmodium falciparum
REDVKLKLYLPDRTIKEDGMIFL

SEQ ID NO: 3370655 - protein, 19 aa, Plasmodium falciparum
REEESIIPNSYNRDMYEGC

SEQ ID NO: 3370656 - protein, 23 aa, Plasmodium falciparum
REERAYRDKFPFDRINRTRHTFF

SEQ ID NO: 3370657 - protein, 21 aa, Plasmodium falciparum
REFILKPRPLGLGLQPKQCIV

SEQ ID NO: 3370658 - protein, 29 aa, Plasmodium falciparum
REFIRKMIIGKNVSFCLEYTYNNRQFCSV

SEQ ID NO: 3370659 - protein, 19 aa, Plasmodium falciparum
REFLKRSQMNINEYYNYKI

SEQ ID NO: 3370660 - protein, 19 aa, Plasmodium falciparum
REGFTSTFGKYSSLNDIDK

SEQ ID NO: 3370661 - protein, 19 aa, Plasmodium falciparum
REGNFFLQCEFTNSDINCN

SEQ ID NO: 3370662 - protein, 25 aa, Plasmodium falciparum
REHAYNSSLGSCFLKNKNSEMQIPQ

SEQ ID NO: 3370663 - protein, 18 aa, Plasmodium falciparum
REHIFFRSYYHPVQNVVD

SEQ ID NO: 3370664 - protein, 26 aa, Plasmodium falciparum
REIDLRMGSIFTRFMTIRYIELVKHE

SEQ ID NO: 3370665 - protein, 21 aa, Plasmodium falciparum
REIFSYASVYKPCLIFFDEID

SEQ ID NO: 3370666 - protein, 23 aa, Plasmodium falciparum
REILKKMIHVYCVEEKEKKNNNK

SEQ ID NO: 3370667 - protein, 23 aa, Plasmodium falciparum
REILPHAFLKKDIIGLSETGSGK

SEQ ID NO: 3370668 - protein, 25 aa, Plasmodium falciparum
REILREWKPNIIKEEKKSQKYTIKT

SEQ ID NO: 3370669 - protein, 17 aa, Plasmodium falciparum
REISRTSTTVSVSLKAN

SEQ ID NO: 3370670 - protein, 24 aa, Plasmodium falciparum
REITHPSYHWFFKSMIHVIDDLDI

SEQ ID NO: 3370671 - protein, 25 aa, Plasmodium falciparum
REKAILRKEIIRMYSRIFQAPLNLK

SEQ ID NO: 3370672 - protein, 21 aa, Plasmodium falciparum
REKERLLSILYGSVFTGPKYL

SEQ ID NO: 3370673 - protein, 19 aa, Plasmodium falciparum
REKKECIESLNVEKMEINL

SEQ ID NO: 3370674 - protein, 20 aa, Plasmodium falciparum
REKKFVVEFVDTYNDDYVKK

SEQ ID NO: 3370675 - protein, 22 aa, Plasmodium falciparum
REKKKKKMHVLKFTKEEEEEEL

SEQ ID NO: 3370676 - protein, 20 aa, Plasmodium falciparum
REKKLNLLKNIIVNNPNKKC

SEQ ID NO: 3370677 - protein, 20 aa, Plasmodium falciparum
REKLTNWLFVCMCSRCTHPV

SEQ ID NO: 3370678 - protein, 18 aa, Plasmodium falciparum
REKMEMLKNKNYRDRLIR

SEQ ID NO: 3370679 - protein, 25 aa, Plasmodium falciparum
REKSIKKILCKYSYVADLYEGDILF

SEQ ID NO: 3370680 - protein, 17 aa, Plasmodium falciparum
REKWKGTKYKKVKLRNM

SEQ ID NO: 3370681 - protein, 18 aa, Plasmodium falciparum
RELEKLIEEQHCVLDMLD

SEQ ID NO: 3370682 - protein, 23 aa, Plasmodium falciparum
RELERINNIILKYSKNIETCNKN

SEQ ID NO: 3370683 - protein, 32 aa, Plasmodium falciparum
RELGFWRSKIIKYRNRFLLAHRKDLQPFVNPR

SEQ ID NO: 3370684 - protein, 23 aa, Plasmodium falciparum
RELKNCTFHPTLNNNRIKREGTI

SEQ ID NO: 3370685 - protein, 18 aa, Plasmodium falciparum
RELKRWVGDNDIVDETKL

SEQ ID NO: 3370686 - protein, 19 aa, Plasmodium falciparum
RELKYPSIIPSELIDLIEK

SEQ ID NO: 3370687 - protein, 26 aa, Plasmodium falciparum
RELNLKNVNIIKCLQQQINEQTKLYK

SEQ ID NO: 3370688 - protein, 19 aa, Plasmodium falciparum
REMHSDIFFSSYPSKSKDN

SEQ ID NO: 3370689 - protein, 20 aa, Plasmodium falciparum
REMYLYPSRIEKCRKDNLNH

SEQ ID NO: 3370690 - protein, 18 aa, Plasmodium falciparum
RENFPDGEIFLCEESYGK

SEQ ID NO: 3370691 - protein, 18 aa, Plasmodium falciparum
RENKNIIINQDFLTDEYF

SEQ ID NO: 3370692 - protein, 19 aa, Plasmodium falciparum
RENNISWKEEEYFDDKEEL

SEQ ID NO: 3370693 - protein, 25 aa, Plasmodium falciparum
RENSVCYYLKCCTHENGNIFTLHQK

SEQ ID NO: 3370694 - protein, 24 aa, Plasmodium falciparum
RENYFKDKLCKIGKYHSNRDPFES

SEQ ID NO: 3370695 - protein, 17 aa, Plasmodium falciparum
REQKRYNKMFVESRYNE

SEQ ID NO: 3370696 - protein, 18 aa, Plasmodium falciparum
RERCLKNRGYHKCVKNEI

SEQ ID NO: 3370697 - protein, 18 aa, Plasmodium falciparum
RERILINFRCLKQEINIP

SEQ ID NO: 3370698 - protein, 25 aa, Plasmodium falciparum
RERKKRTTVYTLEFNNFVNNENIYE

SEQ ID NO: 3370699 - protein, 17 aa, Plasmodium falciparum
RERRREKCFDLNRNKKN

SEQ ID NO: 3370700 - protein, 26 aa, Plasmodium falciparum
RESFEYLLDYFHNMTLKKRLSIRNND

SEQ ID NO: 3370701 - protein, 19 aa, Plasmodium falciparum
RESIKLSLGDILKSDISKK

SEQ ID NO: 3370702 - protein, 17 aa, Plasmodium falciparum
RESKIYGMKAMASVWNR

SEQ ID NO: 3370703 - protein, 25 aa, Plasmodium falciparum
RESYPKFAAESFLYYNVKGRNPSII

SEQ ID NO: 3370704 - protein, 28 aa, Plasmodium falciparum
RETCEESLFKCFEFLKNINYKLNENTNK

SEQ ID NO: 3370705 - protein, 25 aa, Plasmodium falciparum
RETLLHEMIHAFLFLTRSNRKHDGH

SEQ ID NO: 3370706 - protein, 21 aa, Plasmodium falciparum
REVELLKMLDHINIMKLYEFF

SEQ ID NO: 3370707 - protein, 24 aa, Plasmodium falciparum
REVNDLGPIYGFQWRHFGAEYTNM

SEQ ID NO: 3370708 - protein, 25 aa, Plasmodium falciparum
REVNVWKLMTEWTVEERMAFRREQK

SEQ ID NO: 3370709 - protein, 22 aa, Plasmodium falciparum
REVVELPILNPYLYKRVGIKTP

SEQ ID NO: 3370710 - protein, 37 aa, Plasmodium falciparum
REVYKCFKYPKVCTDIKKFEWHVPDIKSITKFLHKTT

SEQ ID NO: 3370711 - protein, 26 aa, Plasmodium falciparum
REWFRVDPNLNWKEKQQLIYNEIEKL

SEQ ID NO: 3370712 - protein, 23 aa, Plasmodium falciparum
REYNFKKKQIIGMWENFSNYEFR

SEQ ID NO: 3370713 - protein, 19 aa, Plasmodium falciparum
REYNMSIALSKFNNYTFKE

SEQ ID NO: 3370714 - protein, 21 aa, Plasmodium falciparum
REYNYKRLLSYQKIQTNESED

SEQ ID NO: 3370715 - protein, 23 aa, Plasmodium falciparum
REYWLPMNVCLTSNVELLDGQYL

SEQ ID NO: 3370716 - protein, 19 aa, Plasmodium falciparum
RFAIPIIGIIYALLWNGDA

SEQ ID NO: 3370717 - protein, 20 aa, Plasmodium falciparum
RFAPLRNIIKNFTFIKFNNA

SEQ ID NO: 3370718 - protein, 18 aa, Plasmodium falciparum
RFDDKALRNLCVKNIPKE

SEQ ID NO: 3370719 - protein, 19 aa, Plasmodium falciparum
RFDKTNCLDNYMNKKDNDD

SEQ ID NO: 3370720 - protein, 18 aa, Plasmodium falciparum
RFEYIRMCRYYSLRDRRN

SEQ ID NO: 3370721 - protein, 18 aa, Plasmodium falciparum
RFFDKCINTYLGHTNNIL

SEQ ID NO: 3370722 - protein, 26 aa, Plasmodium falciparum
RFFKNIKEFLSRAGKVLYIHKDNGLI

SEQ ID NO: 3370723 - protein, 24 aa, Plasmodium falciparum
RFFNISRKSLLLIPNDKQMKISNM

SEQ ID NO: 3370724 - protein, 20 aa, Plasmodium falciparum
RFGAIKDVYLPIDYYTKEPR

SEQ ID NO: 3370725 - protein, 25 aa, Plasmodium falciparum
RFGGSNEAYCFVRITSIGGINRSNN

SEQ ID NO: 3370726 - protein, 19 aa, Plasmodium falciparum
RFGIQKARQSTLMLASFEE

SEQ ID NO: 3370727 - protein, 24 aa, Plasmodium falciparum
RFGNIKSCKIIKDKVTNNSLQYGF

SEQ ID NO: 3370728 - protein, 18 aa, Plasmodium falciparum
RFIEIYYRIIKVRYYHEL

SEQ ID NO: 3370729 - protein, 19 aa, Plasmodium falciparum
RFIEYAVCFFGHKIGYFSG

SEQ ID NO: 3370730 - protein, 17 aa, Plasmodium falciparum
RFIYSLNSWMNMRRCIV

SEQ ID NO: 3370731 - protein, 18 aa, Plasmodium falciparum
RFKGRITNNLAREILVAL

SEQ ID NO: 3370732 - protein, 26 aa, Plasmodium falciparum
RFLDKYKTKIIMICECGSRNYDRINS

SEQ ID NO: 3370733 - protein, 19 aa, Plasmodium falciparum
RFLIMKSQNHIMGTCVSDK

SEQ ID NO: 3370734 - protein, 25 aa, Plasmodium falciparum
RFLKLHWRFLKTVMKKLFEFAENEK

SEQ ID NO: 3370735 - protein, 20 aa, Plasmodium falciparum
RFLRHTSVLYVDFPGYESLK

SEQ ID NO: 3370736 - protein, 33 aa, Plasmodium falciparum
RFMDELSKENKLQCKEYGKAKVYLINQKEFKSL

SEQ ID NO: 3370737 - protein, 23 aa, Plasmodium falciparum
RFMTNLTVDVCIQRINALIEASI

SEQ ID NO: 3370738 - protein, 19 aa, Plasmodium falciparum
RFNELLLLEYPRLRFDGVY

SEQ ID NO: 3370739 - protein, 20 aa, Plasmodium falciparum
RFNKLFKRKAHLHHYLEYLS

SEQ ID NO: 3370740 - protein, 26 aa, Plasmodium falciparum
RFNTVSLGLKGNHNMENMNNMDNMDN

SEQ ID NO: 3370741 - protein, 23 aa, Plasmodium falciparum
RFNYEKYGSFLFNNHEEISFSTS

SEQ ID NO: 3370742 - protein, 19 aa, Plasmodium falciparum
RFPFLKNVILVKSNFKCIN

SEQ ID NO: 3370743 - protein, 21 aa, Plasmodium falciparum
RFPSGKKSFIFVGKRDEDGKE

SEQ ID NO: 3370744 - protein, 19 aa, Plasmodium falciparum
RFQSLGVAFYRGADCCVLV

SEQ ID NO: 3370745 - protein, 22 aa, Plasmodium falciparum
RFRCPEALFQPSFLGKEAAGIH

SEQ ID NO: 3370746 - protein, 24 aa, Plasmodium falciparum
RFRIPLNEFASSLFLCDVNNSTKY

SEQ ID NO: 3370747 - protein, 19 aa, Plasmodium falciparum
RFRSVNKLIRVGRHEVVLV

SEQ ID NO: 3370748 - protein, 28 aa, Plasmodium falciparum
RFRTKQCLRLAKGLCEFGLDRCQYSHSA

SEQ ID NO: 3370749 - protein, 20 aa, Plasmodium falciparum
RFSNLSLLNDDFFLKSQNLD

SEQ ID NO: 3370750 - protein, 20 aa, Plasmodium falciparum
RFTFPHTFHYSIIWHGSSIV

SEQ ID NO: 3370751 - protein, 18 aa, Plasmodium falciparum
RFTNILQKYSDTFIFKQI

SEQ ID NO: 3370752 - protein, 17 aa, Plasmodium falciparum
RFYAFGRVFSGTVATGQ

SEQ ID NO: 3370753 - protein, 20 aa, Plasmodium falciparum
RFYFSLPCSRDLKNIVKLPL

SEQ ID NO: 3370754 - protein, 18 aa, Plasmodium falciparum
RFYHSNIHFDIILFLNNY

SEQ ID NO: 3370755 - protein, 25 aa, Plasmodium falciparum
RFYNPRANINWTLIRFRHRVSQLRK

SEQ ID NO: 3370756 - protein, 27 aa, Plasmodium falciparum
RFYYCIRYCSIFSFVLNKIIQKKVQHI

SEQ ID NO: 3370757 - protein, 17 aa, Plasmodium falciparum
RFYYPACMKCKKKLLSS

SEQ ID NO: 3370758 - protein, 21 aa, Plasmodium falciparum
RGCELFIPMIEILIRDLTLHH

SEQ ID NO: 3370759 - protein, 20 aa, Plasmodium falciparum
RGEGIVTRRPIEFRLIHIKE

SEQ ID NO: 3370760 - protein, 21 aa, Plasmodium falciparum
RGEQLVEECCIEEKEKKEKGY

SEQ ID NO: 3370761 - protein, 17 aa, Plasmodium falciparum
RGFEKNSSHQLILKNNF

SEQ ID NO: 3370762 - protein, 21 aa, Plasmodium falciparum
RGFLIYLIPFFNVFHNKLPLN

SEQ ID NO: 3370763 - protein, 19 aa, Plasmodium falciparum
RGFLKNWNINYLSTNFNNL

SEQ ID NO: 3370764 - protein, 20 aa, Plasmodium falciparum
RGGFRPRFYRGFRGGRGGFL

SEQ ID NO: 3370765 - protein, 19 aa, Plasmodium falciparum
RGGKGGISYSHFKKHDYRL

SEQ ID NO: 3370766 - protein, 27 aa, Plasmodium falciparum
RGGQSALRFARLRLEKRHNYVRKVAEV

SEQ ID NO: 3370767 - protein, 24 aa, Plasmodium falciparum
RGGSELKGLLSLATFSSEEMGDTN

SEQ ID NO: 3370768 - protein, 19 aa, Plasmodium falciparum
RGGTLVIAPLALIYQWKEE

SEQ ID NO: 3370769 - protein, 21 aa, Plasmodium falciparum
RGIKACEYCMSHIIKNIIYYF

SEQ ID NO: 3370770 - protein, 21 aa, Plasmodium falciparum
RGINMDIHWVINYDAANKNMT

SEQ ID NO: 3370771 - protein, 18 aa, Plasmodium falciparum
RGIYKNQFLYNFYTNDDV

SEQ ID NO: 3370772 - protein, 26 aa, Plasmodium falciparum
RGIYKSYNFFKSMNMMNSLSKCYHTK

SEQ ID NO: 3370773 - protein, 23 aa, Plasmodium falciparum
RGKEKYGYLYLIKYLSNVDEYFY

SEQ ID NO: 3370774 - protein, 19 aa, Plasmodium falciparum
RGKGKNCFSDFLKIYPIRA

SEQ ID NO: 3370775 - protein, 23 aa, Plasmodium falciparum
RGKGLFSRALIHAQLSSPAFTNV

SEQ ID NO: 3370776 - protein, 19 aa, Plasmodium falciparum
RGKGRNRGRISKLHTTKKL

SEQ ID NO: 3370777 - protein, 22 aa, Plasmodium falciparum
RGKKIYSFFTVIAIDIYDETDD

SEQ ID NO: 3370778 - protein, 21 aa, Plasmodium falciparum
RGKYFRKRRFSMPLHNRNNRK

SEQ ID NO: 3370779 - protein, 19 aa, Plasmodium falciparum
RGLDISNIKHVINFDLPSN

SEQ ID NO: 3370780 - protein, 23 aa, Plasmodium falciparum
RGLDYYTGIIFEFVLLSETNVGS

SEQ ID NO: 3370781 - protein, 25 aa, Plasmodium falciparum
RGMPRVFACGCVRCTDPTENNLHLR

SEQ ID NO: 3370782 - protein, 17 aa, Plasmodium falciparum
RGNHEILTLIDARNDIK

SEQ ID NO: 3370783 - protein, 26 aa, Plasmodium falciparum
RGNLRCFIKDIELINAQFILNIIHSA

SEQ ID NO: 3370784 - protein, 39 aa, Plasmodium falciparum
RGNYSLEVICLLFSLKILFPKHIYLLRGNHEDRLFNYIY

SEQ ID NO: 3370785 - protein, 20 aa, Plasmodium falciparum
RGRQKLPIINGVDLEREEKC

SEQ ID NO: 3370786 - protein, 17 aa, Plasmodium falciparum
RGRVIRISSKIKLNQHT

SEQ ID NO: 3370787 - protein, 17 aa, Plasmodium falciparum
RGSRGNGNILRISLPCS

SEQ ID NO: 3370788 - protein, 22 aa, Plasmodium falciparum
RGSSLTKEVKWVIFDEIHYMRD

SEQ ID NO: 3370789 - protein, 18 aa, Plasmodium falciparum
RGSSNLIENLLSHSGTKS

SEQ ID NO: 3370790 - protein, 19 aa, Plasmodium falciparum
RGSTLRLLSKIKYLKILDP

SEQ ID NO: 3370791 - protein, 19 aa, Plasmodium falciparum
RGVKTNEYYDYFVTDKTLL

SEQ ID NO: 3370792 - protein, 17 aa, Plasmodium falciparum
RGVSLIELINCERDNLE

SEQ ID NO: 3370793 - protein, 18 aa, Plasmodium falciparum
RGYIKRGTASGVSSSNVV

SEQ ID NO: 3370794 - protein, 19 aa, Plasmodium falciparum
RGYWKKMHYFIRKNNMMSY

SEQ ID NO: 3370795 - protein, 19 aa, Plasmodium falciparum
RHFMALKTLIDLNIVEPYP

SEQ ID NO: 3370796 - protein, 17 aa, Plasmodium falciparum
RHHNIYLPFYKKEDTNE

SEQ ID NO: 3370797 - protein, 21 aa, Plasmodium falciparum
RHKLYSLQCILDIKNNNNDKN

SEQ ID NO: 3370798 - protein, 30 aa, Plasmodium falciparum
RHLNEIKNLSCSLSNSIYDAGKRKSKKTFD

SEQ ID NO: 3370799 - protein, 21 aa, Plasmodium falciparum
RHLQLEKNDLLSIIEEKKYEL

SEQ ID NO: 3370800 - protein, 19 aa, Plasmodium falciparum
RHMCLCNVCANVVRMQNTK

SEQ ID NO: 3370801 - protein, 20 aa, Plasmodium falciparum
RHQYKSMIMLCSQYKEKCKK

SEQ ID NO: 3370802 - protein, 18 aa, Plasmodium falciparum
RHRGPDWNGIVVEENDDG

SEQ ID NO: 3370803 - protein, 22 aa, Plasmodium falciparum
RHYAFDRCFDDYVGNDEVYKHL

SEQ ID NO: 3370804 - protein, 18 aa, Plasmodium falciparum
RHYNKYYIHYNGKTKNEK

SEQ ID NO: 3370805 - protein, 33 aa, Plasmodium falciparum
RHYNYRNMNNFGYRTNIPRSRRNNHNNNNNNDD

SEQ ID NO: 3370806 - protein, 19 aa, Plasmodium falciparum
RIANDIHYNNLFLSKSIKK

SEQ ID NO: 3370807 - protein, 22 aa, Plasmodium falciparum
RICTELNCLFKIINDKINISMI

SEQ ID NO: 3370808 - protein, 21 aa, Plasmodium falciparum
RIDHKTCYKCISFCNLKYFVV

SEQ ID NO: 3370809 - protein, 21 aa, Plasmodium falciparum
RIDTPLNRKNISSINNNNNNN

SEQ ID NO: 3370810 - protein, 20 aa, Plasmodium falciparum
RIDYGTGHELNFLLFLFCLN

SEQ ID NO: 3370811 - protein, 18 aa, Plasmodium falciparum
RIDYKRSAMETIRNQKIH

SEQ ID NO: 3370812 - protein, 27 aa, Plasmodium falciparum
RIDYVELMACEKGCLFGCAQNIFSEPV

SEQ ID NO: 3370813 - protein, 23 aa, Plasmodium falciparum
RIEKIRMKNKIFHISKNRSYYDE

SEQ ID NO: 3370814 - protein, 19 aa, Plasmodium falciparum
RIEKRSYELINDFEVNEIA

SEQ ID NO: 3370815 - protein, 23 aa, Plasmodium falciparum
RIFACDIRESVLIFFYDPNQNTL

SEQ ID NO: 3370816 - protein, 24 aa, Plasmodium falciparum
RIFFKEKYFELSLDNKVRVIKFND

SEQ ID NO: 3370817 - protein, 18 aa, Plasmodium falciparum
RIFGKSFVKENKYIQKSK

SEQ ID NO: 3370818 - protein, 17 aa, Plasmodium falciparum
RIFKKLRGVQHITSMDV

SEQ ID NO: 3370819 - protein, 18 aa, Plasmodium falciparum
RIFLYPVNVQLVPDYLNV

SEQ ID NO: 3370820 - protein, 19 aa, Plasmodium falciparum
RIFNGTSCCFYRYMHSVKH

SEQ ID NO: 3370821 - protein, 24 aa, Plasmodium falciparum
RIFVGLCQVGAWGCFDEFNRLEER

SEQ ID NO: 3370822 - protein, 31 aa, Plasmodium falciparum
RIHKINHFICNGPYINSKVCHLSPPRVTNVG

SEQ ID NO: 3370823 - protein, 19 aa, Plasmodium falciparum
RIHLKSDIDPSIWKLRGTS

SEQ ID NO: 3370824 - protein, 17 aa, Plasmodium falciparum
RIHSEIDEEIILKDNVW

SEQ ID NO: 3370825 - protein, 25 aa, Plasmodium falciparum
RIHVGHVLTSCLFHSKILEESAHTK

SEQ ID NO: 3370826 - protein, 26 aa, Plasmodium falciparum
RIIDGLFSFLCCIRQVPDVIYNRHSK

SEQ ID NO: 3370827 - protein, 18 aa, Plasmodium falciparum
RIIFPIQLSNIYSNFVCI

SEQ ID NO: 3370828 - protein, 18 aa, Plasmodium falciparum
RIIFYSLKKYDGDILRYL

SEQ ID NO: 3370829 - protein, 25 aa, Plasmodium falciparum
RIIIKEWYIDYVLYPNSIPYIYVIS

SEQ ID NO: 3370830 - protein, 29 aa, Plasmodium falciparum
RIIKDNETDKVWLELSGMNHEEHCPYSPH

SEQ ID NO: 3370831 - protein, 17 aa, Plasmodium falciparum
RIIKPGINFEHLPSIDF

SEQ ID NO: 3370832 - protein, 23 aa, Plasmodium falciparum
RIKALKRCLNKIVSIKTLCKMTG

SEQ ID NO: 3370833 - protein, 19 aa, Plasmodium falciparum
RIKHAQFRNLFLMKREFLH

SEQ ID NO: 3370834 - protein, 18 aa, Plasmodium falciparum
RIKKAFISVKGYYLQAEI

SEQ ID NO: 3370835 - protein, 18 aa, Plasmodium falciparum
RIKKELLKNISDVYLCIY

SEQ ID NO: 3370836 - protein, 26 aa, Plasmodium falciparum
RIKKGKCIKSGYLRNKININDDKTYY

SEQ ID NO: 3370837 - protein, 19 aa, Plasmodium falciparum
RIKNFKDVYSYNIYNENME

SEQ ID NO: 3370838 - protein, 20 aa, Plasmodium falciparum
RIKPFNVLGACQLPSLCTPS

SEQ ID NO: 3370839 - protein, 18 aa, Plasmodium falciparum
RIKSCACINLHFFAYESR

SEQ ID NO: 3370840 - protein, 24 aa, Plasmodium falciparum
RILEKYNKRVFVIYGSLPPDSKKK

SEQ ID NO: 3370841 - protein, 20 aa, Plasmodium falciparum
RILFRLDILDKLFILKNNSV

SEQ ID NO: 3370842 - protein, 17 aa, Plasmodium falciparum
RILKKKSTFSFKKGLDN

SEQ ID NO: 3370843 - protein, 22 aa, Plasmodium falciparum
RILKLAPQKVVRWDENTIDNEN

SEQ ID NO: 3370844 - protein, 24 aa, Plasmodium falciparum
RILKRYSSFLFLYPLPNFICISDN

SEQ ID NO: 3370845 - protein, 18 aa, Plasmodium falciparum
RILKYLKCINDYTTFLFP

SEQ ID NO: 3370846 - protein, 17 aa, Plasmodium falciparum
RILLLDCTLEYKKAESQ

SEQ ID NO: 3370847 - protein, 18 aa, Plasmodium falciparum
RILLSLDDYENWLYDNIE

SEQ ID NO: 3370848 - protein, 35 aa, Plasmodium falciparum
RILNDFKKGCLKKMKKIFNKKCKKIEKDISQNLQS

SEQ ID NO: 3370849 - protein, 27 aa, Plasmodium falciparum
RILTTDKCSWLYDYYRITKTSDPCVKE

SEQ ID NO: 3370850 - protein, 18 aa, Plasmodium falciparum
RILYAKELLRKEVLPHMG

SEQ ID NO: 3370851 - protein, 23 aa, Plasmodium falciparum
RILYAYYDICLNILKNISNLIMN

SEQ ID NO: 3370852 - protein, 19 aa, Plasmodium falciparum
RILYFNKIITKGLCSKGFI

SEQ ID NO: 3370853 - protein, 20 aa, Plasmodium falciparum
RIMNIFKYLFPPVTMRTNKR

SEQ ID NO: 3370854 - protein, 24 aa, Plasmodium falciparum
RINCQTCLHYLKYLDIINKCENKK

SEQ ID NO: 3370855 - protein, 20 aa, Plasmodium falciparum
RINDNFFKLHSNLASNLLST

SEQ ID NO: 3370856 - protein, 26 aa, Plasmodium falciparum
RINEIKEIIMKYANNRGYGKDGDLTS

SEQ ID NO: 3370857 - protein, 18 aa, Plasmodium falciparum
RINEQVAQDVKWSNIRDE

SEQ ID NO: 3370858 - protein, 20 aa, Plasmodium falciparum
RINGPSIRENSLYPGSFEMA

SEQ ID NO: 3370859 - protein, 18 aa, Plasmodium falciparum
RINHKSYVSKKCNLDTDV

SEQ ID NO: 3370860 - protein, 17 aa, Plasmodium falciparum
RINHSSFFINLHKQNIL

SEQ ID NO: 3370861 - protein, 22 aa, Plasmodium falciparum
RIPAPWIQIKILSIFRILGYSN

SEQ ID NO: 3370862 - protein, 19 aa, Plasmodium falciparum
RIPMGRKLQIKNIFLKKRE

SEQ ID NO: 3370863 - protein, 27 aa, Plasmodium falciparum
RIQEWKWSSDIKGALKVKKHDPYKNFI

SEQ ID NO: 3370864 - protein, 18 aa, Plasmodium falciparum
RIRFKRGTFNETYDNIYH

SEQ ID NO: 3370865 - protein, 19 aa, Plasmodium falciparum
RIRHPYIITNEILIKKQIR

SEQ ID NO: 3370866 - protein, 26 aa, Plasmodium falciparum
RIRKCKAKSVALERFISIIITASESK

SEQ ID NO: 3370867 - protein, 19 aa, Plasmodium falciparum
RIRKVSPYGKLKTWDLKCV

SEQ ID NO: 3370868 - protein, 20 aa, Plasmodium falciparum
RIRNNCQGVINMIHDNDNMN

SEQ ID NO: 3370869 - protein, 20 aa, Plasmodium falciparum
RIRRRSETISTIIRRNGTIS

SEQ ID NO: 3370870 - protein, 23 aa, Plasmodium falciparum
RIRTYNRFVCFLIGGTFAYSFSN

SEQ ID NO: 3370871 - protein, 19 aa, Plasmodium falciparum
RISANEALEHIWVKNPTAV

SEQ ID NO: 3370872 - protein, 29 aa, Plasmodium falciparum
RISAYLYRDDLQCIKSILSQLHNYIYTDE

SEQ ID NO: 3370873 - protein, 17 aa, Plasmodium falciparum
RISDYIRDNLTSYRQIL

SEQ ID NO: 3370874 - protein, 23 aa, Plasmodium falciparum
RISEKTLLLNLYVDYSSMEDTSF

SEQ ID NO: 3370875 - protein, 19 aa, Plasmodium falciparum
RISMFKKKEMASSHNRKRK

SEQ ID NO: 3370876 - protein, 19 aa, Plasmodium falciparum
RISNIPLFNLFNVQNKNQK

SEQ ID NO: 3370877 - protein, 20 aa, Plasmodium falciparum
RISQALARLRDSDVIETADF

SEQ ID NO: 3370878 - protein, 19 aa, Plasmodium falciparum
RISQITTYVSKWIIKAKVV

SEQ ID NO: 3370879 - protein, 37 aa, Plasmodium falciparum
RISRPQRAGGLLNTFYESFIYGCGFFLSNRLLDQIFG

SEQ ID NO: 3370880 - protein, 22 aa, Plasmodium falciparum
RITKNIFLEILFLLSPHENINE

SEQ ID NO: 3370881 - protein, 18 aa, Plasmodium falciparum
RITLGKVYFELFNDEEIK

SEQ ID NO: 3370882 - protein, 32 aa, Plasmodium falciparum
RITLSACSHFKGVVEFIYLRKKIRRTLYHIYK

SEQ ID NO: 3370883 - protein, 19 aa, Plasmodium falciparum
RITNVCFKKNVLPLSHSLE

SEQ ID NO: 3370884 - protein, 24 aa, Plasmodium falciparum
RITYKKMIAKFERKFLMKNTNDTQ

SEQ ID NO: 3370885 - protein, 19 aa, Plasmodium falciparum
RIVLKSISMMKGLKETGGD

SEQ ID NO: 3370886 - protein, 21 aa, Plasmodium falciparum
RIVQDKIFFLEYITLNVTHME

SEQ ID NO: 3370887 - protein, 18 aa, Plasmodium falciparum
RIWRSNDDTINWSNKDYA

SEQ ID NO: 3370888 - protein, 24 aa, Plasmodium falciparum
RIYERRKTSIFSNKYEKPYYKKSV

SEQ ID NO: 3370889 - protein, 18 aa, Plasmodium falciparum
RIYHIIVKKNFIRKDENK

SEQ ID NO: 3370890 - protein, 30 aa, Plasmodium falciparum
RIYIDKELPCNMLNIYCPKIIILFIPQNIY

SEQ ID NO: 3370891 - protein, 29 aa, Plasmodium falciparum
RIYKNLKNCPEKWTKISAVVKTRTADDCL

SEQ ID NO: 3370892 - protein, 20 aa, Plasmodium falciparum
RKAARKCLLNICMNEILIVL

SEQ ID NO: 3370893 - protein, 17 aa, Plasmodium falciparum
RKAHLHHYLEYLSMDDI

SEQ ID NO: 3370894 - protein, 28 aa, Plasmodium falciparum
RKAKESGYRARSSFKLIQINEKFGILKL

SEQ ID NO: 3370895 - protein, 23 aa, Plasmodium falciparum
RKAPTEILRRYQILREKEYNKNK

SEQ ID NO: 3370896 - protein, 18 aa, Plasmodium falciparum
RKAREMNIQNDICSEAYK

SEQ ID NO: 3370897 - protein, 20 aa, Plasmodium falciparum
RKAYEKNGIMNRDEQKYFND

SEQ ID NO: 3370898 - protein, 19 aa, Plasmodium falciparum
RKCIYNVDGKIYIQNNPFN

SEQ ID NO: 3370899 - protein, 26 aa, Plasmodium falciparum
RKDIDSKIWICDRGSKNIEKAEGDEN

SEQ ID NO: 3370900 - protein, 24 aa, Plasmodium falciparum
RKDWWTANRETVWKAITRSDKLGH

SEQ ID NO: 3370901 - protein, 18 aa, Plasmodium falciparum
RKEEIYKYIRNIKNEIDK

SEQ ID NO: 3370902 - protein, 21 aa, Plasmodium falciparum
RKEEKVLNWSTHLSIEENHLD

SEQ ID NO: 3370903 - protein, 17 aa, Plasmodium falciparum
RKEETTIINVCSEKKPY

SEQ ID NO: 3370904 - protein, 25 aa, Plasmodium falciparum
RKEEYKLPSGYAWCVCDITKENDRS

SEQ ID NO: 3370905 - protein, 17 aa, Plasmodium falciparum
RKEIEPLQSLSYDEDNI

SEQ ID NO: 3370906 - protein, 21 aa, Plasmodium falciparum
RKEILPNREEYVILRNGTIKK

SEQ ID NO: 3370907 - protein, 25 aa, Plasmodium falciparum
RKEKKRYYIGIDIEWDSYKKKKNTV

SEQ ID NO: 3370908 - protein, 29 aa, Plasmodium falciparum
RKEKYTCSICKHKLRVLNKYKKDNVQKYI

SEQ ID NO: 3370909 - protein, 17 aa, Plasmodium falciparum
RKELRKLVCNYANQKQV

SEQ ID NO: 3370910 - protein, 22 aa, Plasmodium falciparum
RKENWKVINIVLKKVQLEEDFI

SEQ ID NO: 3370911 - protein, 21 aa, Plasmodium falciparum
RKFAFCIKKPKVGTFHFGRFY

SEQ ID NO: 3370912 - protein, 23 aa, Plasmodium falciparum
RKFCSFRFYEYLFPVYVLSEVQV

SEQ ID NO: 3370913 - protein, 17 aa, Plasmodium falciparum
RKFDHIHEYITLNNHDE

SEQ ID NO: 3370914 - protein, 20 aa, Plasmodium falciparum
RKFEQCWICLRTAENPVSSP

SEQ ID NO: 3370915 - protein, 19 aa, Plasmodium falciparum
RKFKIIHLLYNVWKEYKHK

SEQ ID NO: 3370916 - protein, 24 aa, Plasmodium falciparum
RKFYNLKCIILFNYIIENKIVFPD

SEQ ID NO: 3370917 - protein, 19 aa, Plasmodium falciparum
RKGKKKQIVLKTIDLLEKY

SEQ ID NO: 3370918 - protein, 20 aa, Plasmodium falciparum
RKGKSNIFYYKKSVSSRSME

SEQ ID NO: 3370919 - protein, 20 aa, Plasmodium falciparum
RKGNIIKINALDIYNNNMGE

SEQ ID NO: 3370920 - protein, 20 aa, Plasmodium falciparum
RKGNVLTCLNDRSIRKQNQN

SEQ ID NO: 3370921 - protein, 20 aa, Plasmodium falciparum
RKGRGRGGGGKHGRTPRRRS

SEQ ID NO: 3370922 - protein, 21 aa, Plasmodium falciparum
RKHDLAHIWCFLDDSVKVQHI

SEQ ID NO: 3370923 - protein, 26 aa, Plasmodium falciparum
RKHFPQCYNFFPMTWILPNEVSDFKS

SEQ ID NO: 3370924 - protein, 17 aa, Plasmodium falciparum
RKHIKHLYNVNDDLKKY

SEQ ID NO: 3370925 - protein, 18 aa, Plasmodium falciparum
RKIAVLVKYAERERRLKE

SEQ ID NO: 3370926 - protein, 18 aa, Plasmodium falciparum
RKICLLALGCCMDIHKLL

SEQ ID NO: 3370927 - protein, 27 aa, Plasmodium falciparum
RKIDIWSLGCILFEFLTKKILFDYQNI

SEQ ID NO: 3370928 - protein, 21 aa, Plasmodium falciparum
RKIDNVCSVEQWKDFKNTNEF

SEQ ID NO: 3370929 - protein, 19 aa, Plasmodium falciparum
RKIFYYRAHYIKQHTTWNV

SEQ ID NO: 3370930 - protein, 17 aa, Plasmodium falciparum
RKIIDRFVVPQSSGILT

SEQ ID NO: 3370931 - protein, 21 aa, Plasmodium falciparum
RKIKVILKKDIGTISISPFYI

SEQ ID NO: 3370932 - protein, 26 aa, Plasmodium falciparum
RKILNIKSPFIWRYTHLLHHFIGENG

SEQ ID NO: 3370933 - protein, 18 aa, Plasmodium falciparum
RKINEQNDICSVNDNKNI

SEQ ID NO: 3370934 - protein, 25 aa, Plasmodium falciparum
RKINYEKCFYYKNYIDIKKKISELQ

SEQ ID NO: 3370935 - protein, 22 aa, Plasmodium falciparum
RKIPKIKFKTIKQIYNYDFDAI

SEQ ID NO: 3370936 - protein, 18 aa, Plasmodium falciparum
RKIPNMPYRILSAPELMD

SEQ ID NO: 3370937 - protein, 20 aa, Plasmodium falciparum
RKIQICYSLQHHIFSMLIEI

SEQ ID NO: 3370938 - protein, 21 aa, Plasmodium falciparum
RKISRCIIELLNSPRSSVSKN

SEQ ID NO: 3370939 - protein, 18 aa, Plasmodium falciparum
RKIYLAKKYLKDMGIESS

SEQ ID NO: 3370940 - protein, 19 aa, Plasmodium falciparum
RKKEQIKLMEEMRKFEEQR

SEQ ID NO: 3370941 - protein, 30 aa, Plasmodium falciparum
RKKGETIKMLLDYIYPCRTLDPRLNSLYGM

SEQ ID NO: 3370942 - protein, 22 aa, Plasmodium falciparum
RKKGFWEWRRRIIHRYNEKRYI

SEQ ID NO: 3370943 - protein, 33 aa, Plasmodium falciparum
RKKGYMKMTCFIYRGKGEFVSYFLERGNKNFNF

SEQ ID NO: 3370944 - protein, 24 aa, Plasmodium falciparum
RKKHSGFKRFPYINDLMNFDKLRY

SEQ ID NO: 3370945 - protein, 23 aa, Plasmodium falciparum
RKKIIRSPFWLSNVMPTEEDVMG

SEQ ID NO: 3370946 - protein, 20 aa, Plasmodium falciparum
RKKIKEILLEYNSLNLSLSS

SEQ ID NO: 3370947 - protein, 30 aa, Plasmodium falciparum
RKKKIGCLFPPCYSQLLINFCVLTNNYDYI

SEQ ID NO: 3370948 - protein, 20 aa, Plasmodium falciparum
RKKKKFVCGEIPLPNKNIGI

SEQ ID NO: 3370949 - protein, 25 aa, Plasmodium falciparum
RKKKKISLSKFLIKKHIIKLRKMEK

SEQ ID NO: 3370950 - protein, 24 aa, Plasmodium falciparum
RKKKKNWPFCYFKKDTIKENDEMY

SEQ ID NO: 3370951 - protein, 20 aa, Plasmodium falciparum
RKKKLKFLLLTTKKIYDDHD

SEQ ID NO: 3370952 - protein, 19 aa, Plasmodium falciparum
RKKKMTTFLNKIMSTPIHT

SEQ ID NO: 3370953 - protein, 20 aa, Plasmodium falciparum
RKKKVIELHLALPSKTHIMI

SEQ ID NO: 3370954 - protein, 20 aa, Plasmodium falciparum
RKKLAITLKSTFHIEKEEDI

SEQ ID NO: 3370955 - protein, 25 aa, Plasmodium falciparum
RKKLEKEILKIMGICCLTVASRMQQ

SEQ ID NO: 3370956 - protein, 24 aa, Plasmodium falciparum
RKKLHKMVEFHYLFTPSDYEYGSF

SEQ ID NO: 3370957 - protein, 20 aa, Plasmodium falciparum
RKKNLIKLKEEIMMNQIFNK

SEQ ID NO: 3370958 - protein, 37 aa, Plasmodium falciparum
RKKQFYKTKMCPWFFSGRCDRGMECLFAHSQGELNPI

SEQ ID NO: 3370959 - protein, 25 aa, Plasmodium falciparum
RKKRDRKVFMGKYFFSDIINTIIYP

SEQ ID NO: 3370960 - protein, 24 aa, Plasmodium falciparum
RKKSLQHISNFIIQLENIYDLINN

SEQ ID NO: 3370961 - protein, 27 aa, Plasmodium falciparum
RKKTFKILFEICKLKNLSYSIESIYNK

SEQ ID NO: 3370962 - protein, 21 aa, Plasmodium falciparum
RKKWLWKTIIEIHMLILEEQR

SEQ ID NO: 3370963 - protein, 18 aa, Plasmodium falciparum
RKLAIAFRNSQKPANEDS

SEQ ID NO: 3370964 - protein, 21 aa, Plasmodium falciparum
RKLDVFRICGQLDYATSGLLI

SEQ ID NO: 3370965 - protein, 21 aa, Plasmodium falciparum
RKLEISPIDYGHVLSLKQDLK

SEQ ID NO: 3370966 - protein, 25 aa, Plasmodium falciparum
RKLFEYDFIFNYAFNKESINNNKKK

SEQ ID NO: 3370967 - protein, 17 aa, Plasmodium falciparum
RKLFRRMYKKYPEYKKR

SEQ ID NO: 3370968 - protein, 21 aa, Plasmodium falciparum
RKLIRLCNLRDTYIKKFQDID

SEQ ID NO: 3370969 - protein, 23 aa, Plasmodium falciparum
RKLKDIRSLCSFRLISQKDVSKL

SEQ ID NO: 3370970 - protein, 18 aa, Plasmodium falciparum
RKLKRKNLSYNFKDNSLD

SEQ ID NO: 3370971 - protein, 18 aa, Plasmodium falciparum
RKLLEERKENLLLEKNLG

SEQ ID NO: 3370972 - protein, 20 aa, Plasmodium falciparum
RKLLYFKWKARKSYKKRVLN

SEQ ID NO: 3370973 - protein, 17 aa, Plasmodium falciparum
RKLRKLCVNKFNEVILI

SEQ ID NO: 3370974 - protein, 20 aa, Plasmodium falciparum
RKLWLQNFILGSYVDHKEKD

SEQ ID NO: 3370975 - protein, 26 aa, Plasmodium falciparum
RKLYAATCLILSFKFYQHDDIQILEK

SEQ ID NO: 3370976 - protein, 17 aa, Plasmodium falciparum
RKLYHHEHEKNEPFDNM

SEQ ID NO: 3370977 - protein, 18 aa, Plasmodium falciparum
RKMFIYNRIKGIRETETN

SEQ ID NO: 3370978 - protein, 25 aa, Plasmodium falciparum
RKMGDGTFGRVLLCQHIDNKKYYAV

SEQ ID NO: 3370979 - protein, 18 aa, Plasmodium falciparum
RKMIDIYVLTFIDDKIME

SEQ ID NO: 3370980 - protein, 45 aa, Plasmodium falciparum
RKMVKQWAEKEFRNLRRILICGLRCPYPLVLRSNVIVMSMIGYID

SEQ ID NO: 3370981 - protein, 18 aa, Plasmodium falciparum
RKNEEIKVGSNLSTNNDV

SEQ ID NO: 3370982 - protein, 19 aa, Plasmodium falciparum
RKNEISISFDGNVFGHENR

SEQ ID NO: 3370983 - protein, 20 aa, Plasmodium falciparum
RKNEKIILLKSIKKNNSRKG

SEQ ID NO: 3370984 - protein, 19 aa, Plasmodium falciparum
RKNIDIRIIPPLRTQQVLN

SEQ ID NO: 3370985 - protein, 18 aa, Plasmodium falciparum
RKNIDIVCAKDLFFYTIL

SEQ ID NO: 3370986 - protein, 28 aa, Plasmodium falciparum
RKNIIECVEILPQLKYGLDVNCKFTNIC

SEQ ID NO: 3370987 - protein, 25 aa, Plasmodium falciparum
RKNIQLRGNILLYFSCDKNLSILCE

SEQ ID NO: 3370988 - protein, 18 aa, Plasmodium falciparum
RKNIRKYILKSFKKDQII

SEQ ID NO: 3370989 - protein, 19 aa, Plasmodium falciparum
RKNIYCINFKKYYKSLQRK

SEQ ID NO: 3370990 - protein, 25 aa, Plasmodium falciparum
RKNKLMYKLIDNMKRYGDKNEPSHI

SEQ ID NO: 3370991 - protein, 27 aa, Plasmodium falciparum
RKNKYFKFSHLYTMYIQNNFDYLYKKN

SEQ ID NO: 3370992 - protein, 30 aa, Plasmodium falciparum
RKNSFKNLEISMMKPHMQHFEQSINMEGFR

SEQ ID NO: 3370993 - protein, 18 aa, Plasmodium falciparum
RKNSGLLYPYFKNKSFRL

SEQ ID NO: 3370994 - protein, 24 aa, Plasmodium falciparum
RKNSKNGLKKFLINNNKLDILLKK

SEQ ID NO: 3370995 - protein, 19 aa, Plasmodium falciparum
RKNSRPFLGYRSNYSTYNL

SEQ ID NO: 3370996 - protein, 19 aa, Plasmodium falciparum
RKNYALEASSMGLSNNDNN

SEQ ID NO: 3370997 - protein, 19 aa, Plasmodium falciparum
RKNYEYIYYNCIIRKCSRN

SEQ ID NO: 3370998 - protein, 30 aa, Plasmodium falciparum
RKNYWKSKKIKNRRSLSCGNYNSDSSNTQI

SEQ ID NO: 3370999 - protein, 17 aa, Plasmodium falciparum
RKPHRYRPGVLALKEIR

SEQ ID NO: 3371000 - protein, 19 aa, Plasmodium falciparum
RKPIELDYNKPVKRIIEEC

SEQ ID NO: 3371001 - protein, 22 aa, Plasmodium falciparum
RKPKGTHVLLHLYSENVISCKV

SEQ ID NO: 3371002 - protein, 23 aa, Plasmodium falciparum
RKQLNNDLIYFFPKYKLIIHPTL

SEQ ID NO: 3371003 - protein, 17 aa, Plasmodium falciparum
RKQMEALGKTILASDDI

SEQ ID NO: 3371004 - protein, 30 aa, Plasmodium falciparum
RKQMKKMLLYMKDVINWKSPNHIEVLNLLF

SEQ ID NO: 3371005 - protein, 20 aa, Plasmodium falciparum
RKQYDSSIPFDERIPTLTQL

SEQ ID NO: 3371006 - protein, 25 aa, Plasmodium falciparum
RKQYIEWSTYWPLYFRKPDKDILIL

SEQ ID NO: 3371007 - protein, 20 aa, Plasmodium falciparum
RKRDFLFFINALRRNDILSY

SEQ ID NO: 3371008 - protein, 21 aa, Plasmodium falciparum
RKREKCLKLDLNIYEQLKRKM

SEQ ID NO: 3371009 - protein, 22 aa, Plasmodium falciparum
RKRFDRETDLCINKFVNKQDYK

SEQ ID NO: 3371010 - protein, 26 aa, Plasmodium falciparum
RKRFKDEINEDFNFEDNFRIVGEPDF

SEQ ID NO: 3371011 - protein, 27 aa, Plasmodium falciparum
RKRFLHKRNCCILIQSHIRRYLMVRFY

SEQ ID NO: 3371012 - protein, 22 aa, Plasmodium falciparum
RKRKKLKQKRIYEIYNSEITNK

SEQ ID NO: 3371013 - protein, 20 aa, Plasmodium falciparum
RKRNIFKRCFQRIHKNRRRR

SEQ ID NO: 3371014 - protein, 19 aa, Plasmodium falciparum
RKRRICPTMTLVLDLDETL

SEQ ID NO: 3371015 - protein, 20 aa, Plasmodium falciparum
RKRYEENLFYPRTGAKNELG

SEQ ID NO: 3371016 - protein, 17 aa, Plasmodium falciparum
RKSDFLLALDTYPFGMG

SEQ ID NO: 3371017 - protein, 26 aa, Plasmodium falciparum
RKSIKRCYLMSLPIILRNKYNLEIPM

SEQ ID NO: 3371018 - protein, 17 aa, Plasmodium falciparum
RKSKSYKSSYHEKSDNQ

SEQ ID NO: 3371019 - protein, 17 aa, Plasmodium falciparum
RKSRCNEDFLLRKIKNA

SEQ ID NO: 3371020 - protein, 17 aa, Plasmodium falciparum
RKSSSYKSYPKFNKGKR

SEQ ID NO: 3371021 - protein, 20 aa, Plasmodium falciparum
RKSYCKSSLESEKKEESDNS

SEQ ID NO: 3371022 - protein, 19 aa, Plasmodium falciparum
RKTEEVIPVDCFTKHEEGM

SEQ ID NO: 3371023 - protein, 31 aa, Plasmodium falciparum
RKTETCSHLKWYRNSCISFGQDKGSIINLFQ

SEQ ID NO: 3371024 - protein, 21 aa, Plasmodium falciparum
RKTEYMEKVFEMRKIKKENRF

SEQ ID NO: 3371025 - protein, 17 aa, Plasmodium falciparum
RKTFYFCSYNFHDTKNE

SEQ ID NO: 3371026 - protein, 27 aa, Plasmodium falciparum
RKTHRGLRKVACIGAWHPARVQFQIPR

SEQ ID NO: 3371027 - protein, 19 aa, Plasmodium falciparum
RKTKMKEQFLEDKPIDYLN

SEQ ID NO: 3371028 - protein, 24 aa, Plasmodium falciparum
RKTKQKFYLDDHVELAKNKIKNKE

SEQ ID NO: 3371029 - protein, 19 aa, Plasmodium falciparum
RKTLLETFHKIRLEKKNDE

SEQ ID NO: 3371030 - protein, 17 aa, Plasmodium falciparum
RKTTRIFKTNYLSRKKK

SEQ ID NO: 3371031 - protein, 22 aa, Plasmodium falciparum
RKVCSEHFLFERSFFTQSIKGK

SEQ ID NO: 3371032 - protein, 26 aa, Plasmodium falciparum
RKVGDIEFHACSDYIYLLMTLSKDPE

SEQ ID NO: 3371033 - protein, 21 aa, Plasmodium falciparum
RKVHKEFTYPKGTSLNKINIL

SEQ ID NO: 3371034 - protein, 19 aa, Plasmodium falciparum
RKVIKRIHVGHVLTSCLFH

SEQ ID NO: 3371035 - protein, 17 aa, Plasmodium falciparum
RKVKHPKNCGVPLSSLH

SEQ ID NO: 3371036 - protein, 17 aa, Plasmodium falciparum
RKVSLHCPFSLDRILIP

SEQ ID NO: 3371037 - protein, 23 aa, Plasmodium falciparum
RKWKEKRYGHDYEKKKTITRQEK

SEQ ID NO: 3371038 - protein, 19 aa, Plasmodium falciparum
RKWLSDNYVSIILQLCSCK

SEQ ID NO: 3371039 - protein, 19 aa, Plasmodium falciparum
RKWQDLSFFLTNDIDTSHW

SEQ ID NO: 3371040 - protein, 18 aa, Plasmodium falciparum
RKYCSSPEKNERPKKDTN

SEQ ID NO: 3371041 - protein, 24 aa, Plasmodium falciparum
RKYEGKFIKMDKCDQHTFDTYVKP

SEQ ID NO: 3371042 - protein, 17 aa, Plasmodium falciparum
RKYGESLSMYTIDKIKP

SEQ ID NO: 3371043 - protein, 24 aa, Plasmodium falciparum
RKYIEGNKGYQLFYLNSSTSKEYG

SEQ ID NO: 3371044 - protein, 19 aa, Plasmodium falciparum
RKYIKGLALISPMISIEKQ

SEQ ID NO: 3371045 - protein, 24 aa, Plasmodium falciparum
RKYINRHKFNFIKMDEIPNELIEL

SEQ ID NO: 3371046 - protein, 18 aa, Plasmodium falciparum
RKYLKKIKERSKCIREKE

SEQ ID NO: 3371047 - protein, 20 aa, Plasmodium falciparum
RKYMKSLHFYNNYLNTTRGT

SEQ ID NO: 3371048 - protein, 17 aa, Plasmodium falciparum
RKYMQTLSYEQDTEEKN

SEQ ID NO: 3371049 - protein, 20 aa, Plasmodium falciparum
RKYNIYKMIYSYSKNVENQN

SEQ ID NO: 3371050 - protein, 19 aa, Plasmodium falciparum
RKYVIGRAITKNGKTKFIK

SEQ ID NO: 3371051 - protein, 19 aa, Plasmodium falciparum
RKYYKYNFDKNIRKLFNNV

SEQ ID NO: 3371052 - protein, 18 aa, Plasmodium falciparum
RLADMEGHETTNVFWDGF

SEQ ID NO: 3371053 - protein, 18 aa, Plasmodium falciparum
RLAKSGDFHIIKFKEDMI

SEQ ID NO: 3371054 - protein, 19 aa, Plasmodium falciparum
RLANYLFSLIQKVVVYLKV

SEQ ID NO: 3371055 - protein, 19 aa, Plasmodium falciparum
RLDEIYVEHHLPRNNKSLH

SEQ ID NO: 3371056 - protein, 41 aa, Plasmodium falciparum
RLEKDIINLIMLRQIWCESENLRLLYQFLVVEYQNKSANSV

SEQ ID NO: 3371057 - protein, 18 aa, Plasmodium falciparum
RLELGVLDPEIIKKISVC

SEQ ID NO: 3371058 - protein, 19 aa, Plasmodium falciparum
RLENDNCNNKILTQNMEKN

SEQ ID NO: 3371059 - protein, 26 aa, Plasmodium falciparum
RLETLHIKKSFSVLINKNRCAVVVNG

SEQ ID NO: 3371060 - protein, 21 aa, Plasmodium falciparum
RLETWLKKYFSQHMNPTLLCS

SEQ ID NO: 3371061 - protein, 18 aa, Plasmodium falciparum
RLGFNGGCEEILEHLYFQ

SEQ ID NO: 3371062 - protein, 17 aa, Plasmodium falciparum
RLGKGFTFEELKGAGLT

SEQ ID NO: 3371063 - protein, 18 aa, Plasmodium falciparum
RLGKTIHMIGLLKKGYNY

SEQ ID NO: 3371064 - protein, 19 aa, Plasmodium falciparum
RLHGSDCILGVEMKSTGEV

SEQ ID NO: 3371065 - protein, 17 aa, Plasmodium falciparum
RLHKKINRKTFFKNEIF

SEQ ID NO: 3371066 - protein, 24 aa, Plasmodium falciparum
RLHYYRAAMRWTGHNDVSCESSSN

SEQ ID NO: 3371067 - protein, 24 aa, Plasmodium falciparum
RLIAKYKPSCTILALSASDSTVKC

SEQ ID NO: 3371068 - protein, 19 aa, Plasmodium falciparum
RLIEEKFKKDSIQNEYPNN

SEQ ID NO: 3371069 - protein, 26 aa, Plasmodium falciparum
RLIEYSCYRNSIELEKEVNKYHKKIN

SEQ ID NO: 3371070 - protein, 19 aa, Plasmodium falciparum
RLIQLPGTMYVSPDYTLRL

SEQ ID NO: 3371071 - protein, 20 aa, Plasmodium falciparum
RLKELNFNGAHIIMDQIKNG

SEQ ID NO: 3371072 - protein, 43 aa, Plasmodium falciparum
RLKELQRKKMYSKRIKFVIQDVFDLRSSEWRKKTHKDTAKGLN

SEQ ID NO: 3371073 - protein, 18 aa, Plasmodium falciparum
RLKKDICNDEKGNTQNDI

SEQ ID NO: 3371074 - protein, 19 aa, Plasmodium falciparum
RLKKHLLPVPSRFHYLYTT

SEQ ID NO: 3371075 - protein, 25 aa, Plasmodium falciparum
RLKKKKKLEQAYLYLNRSTRDTTRR

SEQ ID NO: 3371076 - protein, 18 aa, Plasmodium falciparum
RLKKLFMKKLEKVFYKKE

SEQ ID NO: 3371077 - protein, 19 aa, Plasmodium falciparum
RLKSDYIIRLHDLIIPEDL

SEQ ID NO: 3371078 - protein, 31 aa, Plasmodium falciparum
RLLDIIDDYCRWKNYPYLRIDGSTPGDERQV

SEQ ID NO: 3371079 - protein, 17 aa, Plasmodium falciparum
RLLFKWKASQDLNTLEW

SEQ ID NO: 3371080 - protein, 18 aa, Plasmodium falciparum
RLLKGYKLSYLNPHMKHK

SEQ ID NO: 3371081 - protein, 17 aa, Plasmodium falciparum
RLLKRNIDIWIEKYRPE

SEQ ID NO: 3371082 - protein, 23 aa, Plasmodium falciparum
RLLLCSITKSLLKLCMELLGMKP

SEQ ID NO: 3371083 - protein, 17 aa, Plasmodium falciparum
RLNGEFKSGGSALSEIN

SEQ ID NO: 3371084 - protein, 25 aa, Plasmodium falciparum
RLNKPQCTALIFKNGRIMLTGTRTK

SEQ ID NO: 3371085 - protein, 21 aa, Plasmodium falciparum
RLNNFKKLKLKTSENDASLSK

SEQ ID NO: 3371086 - protein, 21 aa, Plasmodium falciparum
RLNSKFILKRSYKENFIKSML

SEQ ID NO: 3371087 - protein, 20 aa, Plasmodium falciparum
RLPNLYMIIYIKRFKWIYDQ

SEQ ID NO: 3371088 - protein, 25 aa, Plasmodium falciparum
RLRPDGKEYIHWVVSGIKTKELIKG

SEQ ID NO: 3371089 - protein, 19 aa, Plasmodium falciparum
RLRQCTVSYMKRKHVNNNN

SEQ ID NO: 3371090 - protein, 22 aa, Plasmodium falciparum
RLRRRIEKLYESRDRIKNEYIK

SEQ ID NO: 3371091 - protein, 17 aa, Plasmodium falciparum
RLRRRNQGFHFFENFTK

SEQ ID NO: 3371092 - protein, 22 aa, Plasmodium falciparum
RLRYIKELRVLCEIIGNERTKN

SEQ ID NO: 3371093 - protein, 20 aa, Plasmodium falciparum
RLSDFEIFTKDILVSLKKLN

SEQ ID NO: 3371094 - protein, 18 aa, Plasmodium falciparum
RLSGEYVRTGQMLVKQRK

SEQ ID NO: 3371095 - protein, 24 aa, Plasmodium falciparum
RLSLDEVMKHEWLAGTAKNRLEMS

SEQ ID NO: 3371096 - protein, 19 aa, Plasmodium falciparum
RLTQELFKYQGYKVCAIVL

SEQ ID NO: 3371097 - protein, 26 aa, Plasmodium falciparum
RLVELTCYACDLCPIYESKVQKYKNI

SEQ ID NO: 3371098 - protein, 17 aa, Plasmodium falciparum
RLVGSIYFRCLKNNFQL

SEQ ID NO: 3371099 - protein, 19 aa, Plasmodium falciparum
RLVYFLFMKTNYYGIENFL

SEQ ID NO: 3371100 - protein, 18 aa, Plasmodium falciparum
RLYDNMCGHNWGDIYHDN

SEQ ID NO: 3371101 - protein, 26 aa, Plasmodium falciparum
RLYQICPSPFTFGKCLFIGNHNSLYS

SEQ ID NO: 3371102 - protein, 25 aa, Plasmodium falciparum
RMEKPRYKPPMLRNQGNFNNNRNNF

SEQ ID NO: 3371103 - protein, 19 aa, Plasmodium falciparum
RMERGPIIIGVPCRNCSGN

SEQ ID NO: 3371104 - protein, 25 aa, Plasmodium falciparum
RMFENEVFLFYGIKKKSLKNIITYL

SEQ ID NO: 3371105 - protein, 20 aa, Plasmodium falciparum
RMHNNYDNFYDNSFKKKLSD

SEQ ID NO: 3371106 - protein, 19 aa, Plasmodium falciparum
RMICTSKTILSLKENNKIS

SEQ ID NO: 3371107 - protein, 19 aa, Plasmodium falciparum
RMKEELGIQTNITIRENEE

SEQ ID NO: 3371108 - protein, 20 aa, Plasmodium falciparum
RMLHVLREMFICDLKYDKFH

SEQ ID NO: 3371109 - protein, 21 aa, Plasmodium falciparum
RMMTPNLYTGFKRNINNINYK

SEQ ID NO: 3371110 - protein, 19 aa, Plasmodium falciparum
RMNIILKKFELILRDLIKI

SEQ ID NO: 3371111 - protein, 17 aa, Plasmodium falciparum
RMNKIKNSISIGNGSKI

SEQ ID NO: 3371112 - protein, 23 aa, Plasmodium falciparum
RMNPLHLNRWYKFLEMYEDEEEI

SEQ ID NO: 3371113 - protein, 31 aa, Plasmodium falciparum
RMQDMFKKTIELRLPIPITKYMKKMEISKDV

SEQ ID NO: 3371114 - protein, 34 aa, Plasmodium falciparum
RMTNDYYYNYLFCNIQGVIAYSRFHKLDFRTLIH

SEQ ID NO: 3371115 - protein, 20 aa, Plasmodium falciparum
RNALEKWRYKFVHKNKTTKR

SEQ ID NO: 3371116 - protein, 24 aa, Plasmodium falciparum
RNALKRIYEKLLYLQTEALKNKKY

SEQ ID NO: 3371117 - protein, 20 aa, Plasmodium falciparum
RNCEEVHTIISTLFDKFEYL

SEQ ID NO: 3371118 - protein, 25 aa, Plasmodium falciparum
RNDIFSEFDMLGSLFESLDELENKS

SEQ ID NO: 3371119 - protein, 26 aa, Plasmodium falciparum
RNDIRPEIICILNIRKKNMNNFLINN

SEQ ID NO: 3371120 - protein, 28 aa, Plasmodium falciparum
RNDKYLYEYGYYLNKHMIEINDNINRLS

SEQ ID NO: 3371121 - protein, 18 aa, Plasmodium falciparum
RNEHVLKKDSLIFRKEEN

SEQ ID NO: 3371122 - protein, 17 aa, Plasmodium falciparum
RNEIKRFSNYVLDVKNE

SEQ ID NO: 3371123 - protein, 20 aa, Plasmodium falciparum
RNEKMKSKFLINNLQSKLTN

SEQ ID NO: 3371124 - protein, 22 aa, Plasmodium falciparum
RNETYCIFPKKKEIYFNKVNAL

SEQ ID NO: 3371125 - protein, 24 aa, Plasmodium falciparum
RNEVKLFINQSCIINNGIYCIGHI

SEQ ID NO: 3371126 - protein, 23 aa, Plasmodium falciparum
RNEYLNYYGRPIWAHKKDEVHDN

SEQ ID NO: 3371127 - protein, 17 aa, Plasmodium falciparum
RNFHVSAFYALSKQSNQ

SEQ ID NO: 3371128 - protein, 37 aa, Plasmodium falciparum
RNFKKKNDFKNIVCVCQASKQMARLQVHMEENRQMLE

SEQ ID NO: 3371129 - protein, 19 aa, Plasmodium falciparum
RNFKMPKIHTGDLIEVKYE

SEQ ID NO: 3371130 - protein, 31 aa, Plasmodium falciparum
RNFNYYDTCKNIWNYQICKDDNNLLNNNEKT

SEQ ID NO: 3371131 - protein, 27 aa, Plasmodium falciparum
RNFRRKDIDLEINWRNTANPTQEENNN

SEQ ID NO: 3371132 - protein, 17 aa, Plasmodium falciparum
RNHLLCRDENLRSDNNM

SEQ ID NO: 3371133 - protein, 18 aa, Plasmodium falciparum
RNHMKSLIAMLEVNNQTC

SEQ ID NO: 3371134 - protein, 18 aa, Plasmodium falciparum
RNHSETFLYTNQMSTTQD

SEQ ID NO: 3371135 - protein, 20 aa, Plasmodium falciparum
RNHTEIFYFTLINKKDVSYD

SEQ ID NO: 3371136 - protein, 17 aa, Plasmodium falciparum
RNIDIWIEKYRPEFLDE

SEQ ID NO: 3371137 - protein, 24 aa, Plasmodium falciparum
RNIDKKNLRDVIFKIFAVINSKRF

SEQ ID NO: 3371138 - protein, 23 aa, Plasmodium falciparum
RNIKPFVRPPICSVSTATDSFRC

SEQ ID NO: 3371139 - protein, 17 aa, Plasmodium falciparum
RNIKYVNDKNCFFLQYK

SEQ ID NO: 3371140 - protein, 20 aa, Plasmodium falciparum
RNILNNVWLKTDMFIKESIY

SEQ ID NO: 3371141 - protein, 21 aa, Plasmodium falciparum
RNILYKEQFNIIVKNYKDCKD

SEQ ID NO: 3371142 - protein, 17 aa, Plasmodium falciparum
RNINIRLPLSLQYKILK

SEQ ID NO: 3371143 - protein, 19 aa, Plasmodium falciparum
RNINLFGYLNCKHEESDVH

SEQ ID NO: 3371144 - protein, 25 aa, Plasmodium falciparum
RNINLVFEKYFFPMIQLNNIMKIPT

SEQ ID NO: 3371145 - protein, 24 aa, Plasmodium falciparum
RNKCKHIFITILLYIYEHLFLLPN

SEQ ID NO: 3371146 - protein, 21 aa, Plasmodium falciparum
RNKCLSKNDDNCYVGNKNKVI

SEQ ID NO: 3371147 - protein, 18 aa, Plasmodium falciparum
RNKEKVLKEFITKKYDDI

SEQ ID NO: 3371148 - protein, 22 aa, Plasmodium falciparum
RNKKKFKLNFDVLNINKDDIKE

SEQ ID NO: 3371149 - protein, 18 aa, Plasmodium falciparum
RNKKRLENLWSYSSSYGI

SEQ ID NO: 3371150 - protein, 18 aa, Plasmodium falciparum
RNKNIFVDKHVVLQNLNA

SEQ ID NO: 3371151 - protein, 32 aa, Plasmodium falciparum
RNKNQIKRVVDALGVYISLSLLEKTILIQNYG

SEQ ID NO: 3371152 - protein, 19 aa, Plasmodium falciparum
RNKNVILFEENIFDNYLEN

SEQ ID NO: 3371153 - protein, 39 aa, Plasmodium falciparum
RNKPIAHPFFIYHCLSEKFVKNFVSFVLDPLSEQNYKNF

SEQ ID NO: 3371154 - protein, 24 aa, Plasmodium falciparum
RNKRRQKRGLSMRSVSSSSSTRKI

SEQ ID NO: 3371155 - protein, 20 aa, Plasmodium falciparum
RNLEKYTFINDLLIIEKGEN

SEQ ID NO: 3371156 - protein, 27 aa, Plasmodium falciparum
RNLFGPNCGWAQTILFASELKKFSHIF

SEQ ID NO: 3371157 - protein, 18 aa, Plasmodium falciparum
RNLFKKLCGGKVTYTKKE

SEQ ID NO: 3371158 - protein, 25 aa, Plasmodium falciparum
RNLIDKIIYCLDPSYVNNTLDEETK

SEQ ID NO: 3371159 - protein, 19 aa, Plasmodium falciparum
RNLIIDTLYLFKYIFNNKE

SEQ ID NO: 3371160 - protein, 19 aa, Plasmodium falciparum
RNLKGVNFSEVVSLNNNEM

SEQ ID NO: 3371161 - protein, 17 aa, Plasmodium falciparum
RNLKRRTFHNDSIEYSR

SEQ ID NO: 3371162 - protein, 19 aa, Plasmodium falciparum
RNLLGPRGRHIKIIPKIEN

SEQ ID NO: 3371163 - protein, 18 aa, Plasmodium falciparum
RNLLILWNDFKDFMLNFI

SEQ ID NO: 3371164 - protein, 19 aa, Plasmodium falciparum
RNLLNGLLVCNEEDNEEVI

SEQ ID NO: 3371165 - protein, 17 aa, Plasmodium falciparum
RNLLNILKIHFINELIV

SEQ ID NO: 3371166 - protein, 31 aa, Plasmodium falciparum
RNLRLTFLDIQRWKMWLFGLMYYQYKLVNKG

SEQ ID NO: 3371167 - protein, 17 aa, Plasmodium falciparum
RNLSVLLADEMGLGKTV

SEQ ID NO: 3371168 - protein, 25 aa, Plasmodium falciparum
RNMEFKLIITKFIDGFIKCTESKIY

SEQ ID NO: 3371169 - protein, 38 aa, Plasmodium falciparum
RNMFEQYGYVVEVFFPKTYPKVFVRFDNLQSCIKALEQ

SEQ ID NO: 3371170 - protein, 18 aa, Plasmodium falciparum
RNMKEMYLTYDASHSDIS

SEQ ID NO: 3371171 - protein, 23 aa, Plasmodium falciparum
RNNHIIDYIINYMVNNMVNNMVN

SEQ ID NO: 3371172 - protein, 24 aa, Plasmodium falciparum
RNNIKLYVRRVFIMDDCEEIIPEW

SEQ ID NO: 3371173 - protein, 19 aa, Plasmodium falciparum
RNNIRLIQLGLYFRMEHKP

SEQ ID NO: 3371174 - protein, 24 aa, Plasmodium falciparum
RNNKILPYYYFFDLNNFTQNMKQN

SEQ ID NO: 3371175 - protein, 18 aa, Plasmodium falciparum
RNNKIRWGKKEENNKKIN

SEQ ID NO: 3371176 - protein, 23 aa, Plasmodium falciparum
RNNLHIFLCFSPIHKEFALRYQQ

SEQ ID NO: 3371177 - protein, 18 aa, Plasmodium falciparum
RNNLKNDLIKFNSIADKG

SEQ ID NO: 3371178 - protein, 18 aa, Plasmodium falciparum
RNNLLKLNNYVNLLNEKT

SEQ ID NO: 3371179 - protein, 17 aa, Plasmodium falciparum
RNNNNVCIIGSDEIIVK

SEQ ID NO: 3371180 - protein, 23 aa, Plasmodium falciparum
RNNTKHIFIYLITHTNIVKHKNK

SEQ ID NO: 3371181 - protein, 20 aa, Plasmodium falciparum
RNNVKPNIVKKFNRAKEEED

SEQ ID NO: 3371182 - protein, 18 aa, Plasmodium falciparum
RNPNRYVRKKSYIENYLN

SEQ ID NO: 3371183 - protein, 25 aa, Plasmodium falciparum
RNQMKDDILDNLININFKDEIKRII

SEQ ID NO: 3371184 - protein, 22 aa, Plasmodium falciparum
RNQPTCIFPNKYKSNISMTKNT

SEQ ID NO: 3371185 - protein, 24 aa, Plasmodium falciparum
RNQYEPLFIFPLNISEFTYTYFRH

SEQ ID NO: 3371186 - protein, 25 aa, Plasmodium falciparum
RNQYKSCVYFEFVLTNINLDKYRRD

SEQ ID NO: 3371187 - protein, 18 aa, Plasmodium falciparum
RNSDIFLNLSKRSKNEDI

SEQ ID NO: 3371188 - protein, 24 aa, Plasmodium falciparum
RNSELMKSHMLFLERKLYKIYEKI

SEQ ID NO: 3371189 - protein, 18 aa, Plasmodium falciparum
RNSHDRLSYKDNYEKNNN

SEQ ID NO: 3371190 - protein, 26 aa, Plasmodium falciparum
RNSIVLRQCKSCFISIIKNYYPFIKK

SEQ ID NO: 3371191 - protein, 19 aa, Plasmodium falciparum
RNSLSLNNMNLMNDLNLNG

SEQ ID NO: 3371192 - protein, 19 aa, Plasmodium falciparum
RNSRSFSPRDRRTRGEGNM

SEQ ID NO: 3371193 - protein, 17 aa, Plasmodium falciparum
RNSRYSVSDKKNYDNKS

SEQ ID NO: 3371194 - protein, 17 aa, Plasmodium falciparum
RNTCAYGGVPKSGQIYA

SEQ ID NO: 3371195 - protein, 18 aa, Plasmodium falciparum
RNTIEYIPRNKRKNINSY

SEQ ID NO: 3371196 - protein, 19 aa, Plasmodium falciparum
RNTLIPSTYILPFLETKLV

SEQ ID NO: 3371197 - protein, 17 aa, Plasmodium falciparum
RNTPIMHVYMFIHQKEN

SEQ ID NO: 3371198 - protein, 22 aa, Plasmodium falciparum
RNTRNSKVIFCEEIQVREYDIE

SEQ ID NO: 3371199 - protein, 18 aa, Plasmodium falciparum
RNTVGGKINEMGLCVTES

SEQ ID NO: 3371200 - protein, 17 aa, Plasmodium falciparum
RNVAKLLFINMLGYPTH

SEQ ID NO: 3371201 - protein, 21 aa, Plasmodium falciparum
RNVCTEAGMFAIRAMRDYVIE

SEQ ID NO: 3371202 - protein, 22 aa, Plasmodium falciparum
RNVENFNSPSFVSVNKNGNIQN

SEQ ID NO: 3371203 - protein, 21 aa, Plasmodium falciparum
RNVFETLKNVFLEEQENNKRK

SEQ ID NO: 3371204 - protein, 24 aa, Plasmodium falciparum
RNVKIFGLHLMKLDIRQESEKHIS

SEQ ID NO: 3371205 - protein, 22 aa, Plasmodium falciparum
RNVRFFLRYLLPEYKEENKHLN

SEQ ID NO: 3371206 - protein, 19 aa, Plasmodium falciparum
RNVRIKYDVDKNMSKGFAF

SEQ ID NO: 3371207 - protein, 34 aa, Plasmodium falciparum
RNYEAKILYSLRECKHVIKLIGVCSLREGEESLI

SEQ ID NO: 3371208 - protein, 17 aa, Plasmodium falciparum
RNYFKKYIIRGILENMN

SEQ ID NO: 3371209 - protein, 23 aa, Plasmodium falciparum
RNYKMRELHLLSEIKYLKRKVTR

SEQ ID NO: 3371210 - protein, 20 aa, Plasmodium falciparum
RNYNRPLMPLLVKKKKKNFL

SEQ ID NO: 3371211 - protein, 18 aa, Plasmodium falciparum
RNYPYYPRASNLPYNNET

SEQ ID NO: 3371212 - protein, 27 aa, Plasmodium falciparum
RNYVRSWIIKLIVKYKIKDSKKIKEIL

SEQ ID NO: 3371213 - protein, 19 aa, Plasmodium falciparum
RPAKPVGYNKIKFIYEEMK

SEQ ID NO: 3371214 - protein, 21 aa, Plasmodium falciparum
RPHNSEQYYGFNYMTVELNEI

SEQ ID NO: 3371215 - protein, 21 aa, Plasmodium falciparum
RPIAIEVDGPSHFYANSNRYT

SEQ ID NO: 3371216 - protein, 20 aa, Plasmodium falciparum
RPITKHSLFNGYSLNKIILN

SEQ ID NO: 3371217 - protein, 19 aa, Plasmodium falciparum
RPLSELDLLILENEEKKKH

SEQ ID NO: 3371218 - protein, 28 aa, Plasmodium falciparum
RPLSKRGVMYFFILQKLKNLHSFYFYSL

SEQ ID NO: 3371219 - protein, 20 aa, Plasmodium falciparum
RPLSNISIIYALKNVKYLYK

SEQ ID NO: 3371220 - protein, 19 aa, Plasmodium falciparum
RPLYKSIVHNDIRLLRLMC

SEQ ID NO: 3371221 - protein, 19 aa, Plasmodium falciparum
RPNVGKSTIFNRLTRKYQD

SEQ ID NO: 3371222 - protein, 19 aa, Plasmodium falciparum
RPRSYFISSVIRIRNSLSI

SEQ ID NO: 3371223 - protein, 20 aa, Plasmodium falciparum
RPSQMEKLFAFFEEESEDIK

SEQ ID NO: 3371224 - protein, 20 aa, Plasmodium falciparum
RPVKKGDLFLVRGGFMSVEF

SEQ ID NO: 3371225 - protein, 17 aa, Plasmodium falciparum
RQDDNFILFTLKKNVSL

SEQ ID NO: 3371226 - protein, 17 aa, Plasmodium falciparum
RQEFSNVTLNYKGISKF

SEQ ID NO: 3371227 - protein, 17 aa, Plasmodium falciparum
RQELHDFNNENPPFTTN

SEQ ID NO: 3371228 - protein, 24 aa, Plasmodium falciparum
RQEPEIYKAIKFGAILENVVMDPV

SEQ ID NO: 3371229 - protein, 24 aa, Plasmodium falciparum
RQFNEIIWNESFLYYLQTILPPAD

SEQ ID NO: 3371230 - protein, 19 aa, Plasmodium falciparum
RQFNRKDFYSINKIHSNII

SEQ ID NO: 3371231 - protein, 19 aa, Plasmodium falciparum
RQGGKGWGLELGREEDSSN

SEQ ID NO: 3371232 - protein, 19 aa, Plasmodium falciparum
RQHEFRILFDEYFDEISNE

SEQ ID NO: 3371233 - protein, 26 aa, Plasmodium falciparum
RQIDLSVMIQHAWTYQALIHDVFDIK

SEQ ID NO: 3371234 - protein, 20 aa, Plasmodium falciparum
RQIEFARLNVTYMVMSKRKL

SEQ ID NO: 3371235 - protein, 21 aa, Plasmodium falciparum
RQKMINLKLNIWDKLSELGII

SEQ ID NO: 3371236 - protein, 18 aa, Plasmodium falciparum
RQKVHCLNTLFAKLQINQ

SEQ ID NO: 3371237 - protein, 27 aa, Plasmodium falciparum
RQLALMLKYKYIKRNHTIFKNLNDQEM

SEQ ID NO: 3371238 - protein, 28 aa, Plasmodium falciparum
RQLLPENLKIFFRFISMMVPDRQIIIKV

SEQ ID NO: 3371239 - protein, 17 aa, Plasmodium falciparum
RQLPNVESVTCFDLQLT

SEQ ID NO: 3371240 - protein, 19 aa, Plasmodium falciparum
RQLRLWGVKAQNRMMKSNV

SEQ ID NO: 3371241 - protein, 19 aa, Plasmodium falciparum
RQLYILFCSLEVRKKKNNV

SEQ ID NO: 3371242 - protein, 17 aa, Plasmodium falciparum
RQMNSYFKEINNLFFDI

SEQ ID NO: 3371243 - protein, 19 aa, Plasmodium falciparum
RQQLWLFLKGAGMTLDENI

SEQ ID NO: 3371244 - protein, 23 aa, Plasmodium falciparum
RQSKRFIELKQFMAESKLLLSGT

SEQ ID NO: 3371245 - protein, 19 aa, Plasmodium falciparum
RQTNCYSLSGSCMCNPRTM

SEQ ID NO: 3371246 - protein, 18 aa, Plasmodium falciparum
RQWIPIYIAISLSSYAYV

SEQ ID NO: 3371247 - protein, 25 aa, Plasmodium falciparum
RQYLFKCLFDKIANFKNNAILYYNK

SEQ ID NO: 3371248 - protein, 27 aa, Plasmodium falciparum
RQYNILRFTYFKLLKQVGEMKVYNNNI

SEQ ID NO: 3371249 - protein, 24 aa, Plasmodium falciparum
RQYRAPEVILKSGFNETADIWSFA

SEQ ID NO: 3371250 - protein, 26 aa, Plasmodium falciparum
RQYRAPEVILNLGWDVSSDMWSFGCV

SEQ ID NO: 3371251 - protein, 22 aa, Plasmodium falciparum
RRAKTINLKSINRFNTVSLGLK

SEQ ID NO: 3371252 - protein, 20 aa, Plasmodium falciparum
RRARKMLVKLGLKAIPNVHK

SEQ ID NO: 3371253 - protein, 18 aa, Plasmodium falciparum
RRCIVACCENIFAMTGLC

SEQ ID NO: 3371254 - protein, 18 aa, Plasmodium falciparum
RRDLYKNDLINILNEKEE

SEQ ID NO: 3371255 - protein, 26 aa, Plasmodium falciparum
RRDNQILYCYIEFPDDTFFMINNYFY

SEQ ID NO: 3371256 - protein, 18 aa, Plasmodium falciparum
RREIWHNPLSYYLGLEEF

SEQ ID NO: 3371257 - protein, 21 aa, Plasmodium falciparum
RRERNFKLFCSTIKREPIRIE

SEQ ID NO: 3371258 - protein, 19 aa, Plasmodium falciparum
RRESINILESINIMDVLKR

SEQ ID NO: 3371259 - protein, 17 aa, Plasmodium falciparum
RRESINLFSSKINRTSN

SEQ ID NO: 3371260 - protein, 20 aa, Plasmodium falciparum
RRFDSPADFIIQTTNRMKDI

SEQ ID NO: 3371261 - protein, 17 aa, Plasmodium falciparum
RRFKGLHQITRCGSTVI

SEQ ID NO: 3371262 - protein, 25 aa, Plasmodium falciparum
RRFNERKKRLETYLIMNKLYNQNKK

SEQ ID NO: 3371263 - protein, 21 aa, Plasmodium falciparum
RRFYKKCVDLSMIKGKYDNKV

SEQ ID NO: 3371264 - protein, 21 aa, Plasmodium falciparum
RRGIELSKLSFLRLISNESEQ

SEQ ID NO: 3371265 - protein, 18 aa, Plasmodium falciparum
RRGLDDRGIVIIMLDTPL

SEQ ID NO: 3371266 - protein, 24 aa, Plasmodium falciparum
RRGVKEAYKLSIESIEQIKRQTQT

SEQ ID NO: 3371267 - protein, 20 aa, Plasmodium falciparum
RRHRKGRSPSRSRSRERNKH

SEQ ID NO: 3371268 - protein, 19 aa, Plasmodium falciparum
RRIELMKLMGIKNLYICES

SEQ ID NO: 3371269 - protein, 25 aa, Plasmodium falciparum
RRIIYDPQHLWKCVTVKKDTQKFNK

SEQ ID NO: 3371270 - protein, 42 aa, Plasmodium falciparum
RRILFYKTKICPWYIKGKCERRKTCLYAHAQNELRELPNLCK

SEQ ID NO: 3371271 - protein, 19 aa, Plasmodium falciparum
RRIRTIWYCSSLYVEYKNA

SEQ ID NO: 3371272 - protein, 24 aa, Plasmodium falciparum
RRKEELRATYLVEGYKKDNIEYIC

SEQ ID NO: 3371273 - protein, 21 aa, Plasmodium falciparum
RRKESPSRKPGLCVDEICTCG

SEQ ID NO: 3371274 - protein, 20 aa, Plasmodium falciparum
RRKIKNILIEKFLKKNMQTL

SEQ ID NO: 3371275 - protein, 19 aa, Plasmodium falciparum
RRKKKEHFNNSFSKTNIFN

SEQ ID NO: 3371276 - protein, 20 aa, Plasmodium falciparum
RRKKLLNKIRLYITRYKILS

SEQ ID NO: 3371277 - protein, 32 aa, Plasmodium falciparum
RRKKLPSPRTEIKISMWSLLKDCIGKDLSRIG

SEQ ID NO: 3371278 - protein, 25 aa, Plasmodium falciparum
RRKKNSFINKLFLAEHVNTKKSTFR

SEQ ID NO: 3371279 - protein, 19 aa, Plasmodium falciparum
RRKSLKMNKYGYKIKEKKL

SEQ ID NO: 3371280 - protein, 19 aa, Plasmodium falciparum
RRKYAINCIMEKLRKDQNE

SEQ ID NO: 3371281 - protein, 17 aa, Plasmodium falciparum
RRLEKCSNFSTPLVDVF

SEQ ID NO: 3371282 - protein, 18 aa, Plasmodium falciparum
RRMCLAAFSDIFIAFIHI

SEQ ID NO: 3371283 - protein, 23 aa, Plasmodium falciparum
RRMLGKFSLNEKMTLRSCIPSDT

SEQ ID NO: 3371284 - protein, 20 aa, Plasmodium falciparum
RRMTKTVIYGILYGQTENGL

SEQ ID NO: 3371285 - protein, 23 aa, Plasmodium falciparum
RRNELPHLKNLIILDIVAKQGMI

SEQ ID NO: 3371286 - protein, 24 aa, Plasmodium falciparum
RRNEYSGDESIDFYNLHDIINVGK

SEQ ID NO: 3371287 - protein, 18 aa, Plasmodium falciparum
RRNFEEIDENYKEVVEEK

SEQ ID NO: 3371288 - protein, 18 aa, Plasmodium falciparum
RRNKKIWIEQAEHEKAEN

SEQ ID NO: 3371289 - protein, 17 aa, Plasmodium falciparum
RRNNCGVTSNGRIYCIG

SEQ ID NO: 3371290 - protein, 25 aa, Plasmodium falciparum
RRNPRKRGRRCSSLRNNRNTINSVT

SEQ ID NO: 3371291 - protein, 18 aa, Plasmodium falciparum
RRNSEKELEYGYKVERHM

SEQ ID NO: 3371292 - protein, 24 aa, Plasmodium falciparum
RRNSNLYKYVSFFLSKERMNKERM

SEQ ID NO: 3371293 - protein, 18 aa, Plasmodium falciparum
RRNTICSSISKYNYMYPQ

SEQ ID NO: 3371294 - protein, 20 aa, Plasmodium falciparum
RRPSNILNSCIFTELDEGLS

SEQ ID NO: 3371295 - protein, 19 aa, Plasmodium falciparum
RRQKLCVDFLKQLKDQTDE

SEQ ID NO: 3371296 - protein, 27 aa, Plasmodium falciparum
RRRHKITLPDMFKRKVLIKEENNDTYE

SEQ ID NO: 3371297 - protein, 20 aa, Plasmodium falciparum
RRRKTFFSFVNKFRNFVVNK

SEQ ID NO: 3371298 - protein, 25 aa, Plasmodium falciparum
RRRRKLRSKILFNVKKVGKYIFKIY

SEQ ID NO: 3371299 - protein, 17 aa, Plasmodium falciparum
RRSCSKISLLKYNEEIF

SEQ ID NO: 3371300 - protein, 24 aa, Plasmodium falciparum
RRSSTKKLGRKGLSAVKKEEVTNN

SEQ ID NO: 3371301 - protein, 19 aa, Plasmodium falciparum
RRSVSNMHMSHVNRNSFVE

SEQ ID NO: 3371302 - protein, 17 aa, Plasmodium falciparum
RRTFYMKNVKFFYNVTH

SEQ ID NO: 3371303 - protein, 18 aa, Plasmodium falciparum
RRTYSYEVNDQIELIHKN

SEQ ID NO: 3371304 - protein, 28 aa, Plasmodium falciparum
RRVNELLKRNFLQSKSGTFVGSPEMFFN

SEQ ID NO: 3371305 - protein, 25 aa, Plasmodium falciparum
RRWIRGLCCKHIIYVSCNVHSQFKD

SEQ ID NO: 3371306 - protein, 20 aa, Plasmodium falciparum
RRYKSFFLFFQNVRGYKNAD

SEQ ID NO: 3371307 - protein, 50 aa, Plasmodium falciparum
RSATYLLKIEIEKIQKLISCNNWKQVPSIYKKSAENILLKKNEYIKNLKT

SEQ ID NO: 3371308 - protein, 19 aa, Plasmodium falciparum
RSCLIKKLKNMYSDIFSSL

SEQ ID NO: 3371309 - protein, 19 aa, Plasmodium falciparum
RSDFMDNIVKFGGLINNQD

SEQ ID NO: 3371310 - protein, 17 aa, Plasmodium falciparum
RSDHNIKLTFDVFSHTF

SEQ ID NO: 3371311 - protein, 22 aa, Plasmodium falciparum
RSDKMNSLKCDRLNSLRSDKLN

SEQ ID NO: 3371312 - protein, 22 aa, Plasmodium falciparum
RSDKMNSLKCDRLNSLRSDKMN

SEQ ID NO: 3371313 - protein, 18 aa, Plasmodium falciparum
RSDSFIKKGTKNVLYNNK

SEQ ID NO: 3371314 - protein, 20 aa, Plasmodium falciparum
RSEKLININNLWSSFFEPNS

SEQ ID NO: 3371315 - protein, 18 aa, Plasmodium falciparum
RSENCLLGSDKKKIIDKI

SEQ ID NO: 3371316 - protein, 24 aa, Plasmodium falciparum
RSERLYLRRKRASSILSNNSTENS

SEQ ID NO: 3371317 - protein, 20 aa, Plasmodium falciparum
RSGGIYNNFINYNMNKKISN

SEQ ID NO: 3371318 - protein, 21 aa, Plasmodium falciparum
RSHRIIKKCGGVPHKEEPILP

SEQ ID NO: 3371319 - protein, 19 aa, Plasmodium falciparum
RSHYKEILHNSSYINIKEA

SEQ ID NO: 3371320 - protein, 21 aa, Plasmodium falciparum
RSIKHLNNFKHVFVAAHTSAG

SEQ ID NO: 3371321 - protein, 18 aa, Plasmodium falciparum
RSINPQWIYAVFGVQTID

SEQ ID NO: 3371322 - protein, 17 aa, Plasmodium falciparum
RSIRSGFTVTNNILNDK

SEQ ID NO: 3371323 - protein, 17 aa, Plasmodium falciparum
RSKEKNTFFAFLKKQKY

SEQ ID NO: 3371324 - protein, 17 aa, Plasmodium falciparum
RSKLPIYNLKNDLMKAI

SEQ ID NO: 3371325 - protein, 22 aa, Plasmodium falciparum
RSKLWWGHYHLRIGSRLQVRLN

SEQ ID NO: 3371326 - protein, 22 aa, Plasmodium falciparum
RSKYLPVIYKYSKPVLNFEDTE

SEQ ID NO: 3371327 - protein, 21 aa, Plasmodium falciparum
RSLCISNLNLSIGIDLINEIR

SEQ ID NO: 3371328 - protein, 17 aa, Plasmodium falciparum
RSLKLKMIDLIKRNTSS

SEQ ID NO: 3371329 - protein, 18 aa, Plasmodium falciparum
RSLSAYMFFAKEKRAEII

SEQ ID NO: 3371330 - protein, 20 aa, Plasmodium falciparum
RSLSFANVMKALYINDSKNR

SEQ ID NO: 3371331 - protein, 19 aa, Plasmodium falciparum
RSNCGKSTLINELCGRTNK

SEQ ID NO: 3371332 - protein, 22 aa, Plasmodium falciparum
RSNDLSCNLSHFLNEEESDIRK

SEQ ID NO: 3371333 - protein, 20 aa, Plasmodium falciparum
RSNISLNRITKCKSTNYNKF

SEQ ID NO: 3371334 - protein, 18 aa, Plasmodium falciparum
RSNSALYRRNDVDNQNII

SEQ ID NO: 3371335 - protein, 28 aa, Plasmodium falciparum
RSNSNICLIFNFIYKFIEILKYFFNNEL

SEQ ID NO: 3371336 - protein, 18 aa, Plasmodium falciparum
RSPELIVNCLKKKTQTLY

SEQ ID NO: 3371337 - protein, 18 aa, Plasmodium falciparum
RSPFAEKIISSFVDLKKK

SEQ ID NO: 3371338 - protein, 29 aa, Plasmodium falciparum
RSQSCNFTFDIFCCCLSNISAHILNHINR

SEQ ID NO: 3371339 - protein, 19 aa, Plasmodium falciparum
RSREKKYVFDYVFDENSSQ

SEQ ID NO: 3371340 - protein, 27 aa, Plasmodium falciparum
RSRLQCPKCKKVSITFDPFMYLSIPLP

SEQ ID NO: 3371341 - protein, 26 aa, Plasmodium falciparum
RSRMLKQQKKLLCADINLNDPLLGTK

SEQ ID NO: 3371342 - protein, 19 aa, Plasmodium falciparum
RSSDKYGYVYICCCDNIPD

SEQ ID NO: 3371343 - protein, 18 aa, Plasmodium falciparum
RSSEYCPEIHKVRTNGTY

SEQ ID NO: 3371344 - protein, 25 aa, Plasmodium falciparum
RSSGRSSSRSCGRSSSRRSNNNVSD

SEQ ID NO: 3371345 - protein, 26 aa, Plasmodium falciparum
RSSMFSFNSSDFFKDFGKLRKNFVGK

SEQ ID NO: 3371346 - protein, 26 aa, Plasmodium falciparum
RSSREISSEIYLVGLNFLGKKVDKKL

SEQ ID NO: 3371347 - protein, 17 aa, Plasmodium falciparum
RSSSRRSNNNVSDIHVD

SEQ ID NO: 3371348 - protein, 21 aa, Plasmodium falciparum
RSSVDIFCVCTSITLDSLQSV

SEQ ID NO: 3371349 - protein, 18 aa, Plasmodium falciparum
RSTGLVNLNGYLSSKLPD

SEQ ID NO: 3371350 - protein, 20 aa, Plasmodium falciparum
RSTIYDFPSSGPVNNSLFYI

SEQ ID NO: 3371351 - protein, 19 aa, Plasmodium falciparum
RSVCTEAGMFAIRARRKTI

SEQ ID NO: 3371352 - protein, 20 aa, Plasmodium falciparum
RSVKNINDIIIKRSHTPEIV

SEQ ID NO: 3371353 - protein, 17 aa, Plasmodium falciparum
RSVLYMDHGHYYNNTSS

SEQ ID NO: 3371354 - protein, 20 aa, Plasmodium falciparum
RSVSMPSYLNNNLEKCDTSS

SEQ ID NO: 3371355 - protein, 24 aa, Plasmodium falciparum
RSYEKHILLKWTERKNETLRRSYM

SEQ ID NO: 3371356 - protein, 23 aa, Plasmodium falciparum
RSYEKQNWISLFFMNKKNYDITL

SEQ ID NO: 3371357 - protein, 25 aa, Plasmodium falciparum
RSYIYLIKRINLFSENNNEVDIIYE

SEQ ID NO: 3371358 - protein, 25 aa, Plasmodium falciparum
RSYNLWKRITVDDIKNTHFTPTEKQ

SEQ ID NO: 3371359 - protein, 23 aa, Plasmodium falciparum
RSYSDPFPFHSPNTSILEFCCSR

SEQ ID NO: 3371360 - protein, 17 aa, Plasmodium falciparum
RTARNFKKGKCICFITE

SEQ ID NO: 3371361 - protein, 19 aa, Plasmodium falciparum
RTDACFICVIGSELVQKYV

SEQ ID NO: 3371362 - protein, 22 aa, Plasmodium falciparum
RTDFHILYIFWDILYNLRNVLG

SEQ ID NO: 3371363 - protein, 21 aa, Plasmodium falciparum
RTDGNCLFRAVSDQLYNHEEN

SEQ ID NO: 3371364 - protein, 22 aa, Plasmodium falciparum
RTESFSLYIFKVLKQVHPETGV

SEQ ID NO: 3371365 - protein, 21 aa, Plasmodium falciparum
RTFEEFLYQYKFVDIAAAEDS

SEQ ID NO: 3371366 - protein, 17 aa, Plasmodium falciparum
RTFKRALDLGMIYLKPT

SEQ ID NO: 3371367 - protein, 19 aa, Plasmodium falciparum
RTFREIIFLYELNGHDNII

SEQ ID NO: 3371368 - protein, 20 aa, Plasmodium falciparum
RTHRASLNIMQNINIPQKNN

SEQ ID NO: 3371369 - protein, 21 aa, Plasmodium falciparum
RTIAYSIIFLRGTVHIWSKNL

SEQ ID NO: 3371370 - protein, 17 aa, Plasmodium falciparum
RTIEPLKIINGKNKLIK

SEQ ID NO: 3371371 - protein, 18 aa, Plasmodium falciparum
RTIMKKNKIDVYILINSD

SEQ ID NO: 3371372 - protein, 26 aa, Plasmodium falciparum
RTIRKRCVQCSDLIVLVISLDDGIMS

SEQ ID NO: 3371373 - protein, 23 aa, Plasmodium falciparum
RTISTDILFCLLKDVVRKRADFK

SEQ ID NO: 3371374 - protein, 27 aa, Plasmodium falciparum
RTKKNVKLLFNFVYRNYYFNKILRKSI

SEQ ID NO: 3371375 - protein, 17 aa, Plasmodium falciparum
RTKKSMGAKGFVMNISE

SEQ ID NO: 3371376 - protein, 17 aa, Plasmodium falciparum
RTKNRYKNMKTMKFLTS

SEQ ID NO: 3371377 - protein, 21 aa, Plasmodium falciparum
RTKRNSYLWQRDTVTRKKNAK

SEQ ID NO: 3371378 - protein, 27 aa, Plasmodium falciparum
RTKTALFIFKYFDIYAEEKINDSSLIC

SEQ ID NO: 3371379 - protein, 18 aa, Plasmodium falciparum
RTKYEMLEDSTVKDDVNK

SEQ ID NO: 3371380 - protein, 20 aa, Plasmodium falciparum
RTLCEHIGLLLGVGAHMQEL

SEQ ID NO: 3371381 - protein, 17 aa, Plasmodium falciparum
RTLDISVVFSKVFTRVL

SEQ ID NO: 3371382 - protein, 19 aa, Plasmodium falciparum
RTLNLRKNNLIYFPYISNF

SEQ ID NO: 3371383 - protein, 19 aa, Plasmodium falciparum
RTLNVLAMKVVDDVVIGAP

SEQ ID NO: 3371384 - protein, 25 aa, Plasmodium falciparum
RTLRALLKLCLFEINKLKIINKLYI

SEQ ID NO: 3371385 - protein, 20 aa, Plasmodium falciparum
RTNDSCFKDYIVLSNLGKGT

SEQ ID NO: 3371386 - protein, 19 aa, Plasmodium falciparum
RTNIHNHHNLSCDKFNIKK

SEQ ID NO: 3371387 - protein, 19 aa, Plasmodium falciparum
RTNKKKMVLHGWRAEARGG

SEQ ID NO: 3371388 - protein, 19 aa, Plasmodium falciparum
RTNLFKSPCNKINNFHSTS

SEQ ID NO: 3371389 - protein, 18 aa, Plasmodium falciparum
RTNLFLVIDVSENSYEIF

SEQ ID NO: 3371390 - protein, 21 aa, Plasmodium falciparum
RTNSLNIKRVRSGPLDNSQNV

SEQ ID NO: 3371391 - protein, 25 aa, Plasmodium falciparum
RTPAALCGCIGFKPSYGRISRYGII

SEQ ID NO: 3371392 - protein, 24 aa, Plasmodium falciparum
RTQANVRSALPLNIIPHEKVQINE

SEQ ID NO: 3371393 - protein, 17 aa, Plasmodium falciparum
RTQIKWINDVLIDYKKI

SEQ ID NO: 3371394 - protein, 23 aa, Plasmodium falciparum
RTRRFLERTARELLAGGTRYIIL

SEQ ID NO: 3371395 - protein, 19 aa, Plasmodium falciparum
RTSDVEIIYNGEIKCKGCN

SEQ ID NO: 3371396 - protein, 22 aa, Plasmodium falciparum
RTSRVKLVQAWHISPVQVINKF

SEQ ID NO: 3371397 - protein, 23 aa, Plasmodium falciparum
RTTKRKRMIDIDKTVLHYYKEHI

SEQ ID NO: 3371398 - protein, 19 aa, Plasmodium falciparum
RTTTPNVINSISMESMNDG

SEQ ID NO: 3371399 - protein, 21 aa, Plasmodium falciparum
RTVPPALPGVVFLSGGQSEEE

SEQ ID NO: 3371400 - protein, 24 aa, Plasmodium falciparum
RTYFPNCYILSPGIGAQNGDLHKT

SEQ ID NO: 3371401 - protein, 19 aa, Plasmodium falciparum
RTYIPFFHFMIHKYTTKII

SEQ ID NO: 3371402 - protein, 17 aa, Plasmodium falciparum
RVAAMSIAKRVSEEFGC

SEQ ID NO: 3371403 - protein, 25 aa, Plasmodium falciparum
RVDRLPGFRRSYRSFKKVDEGNWNN

SEQ ID NO: 3371404 - protein, 26 aa, Plasmodium falciparum
RVEIKFRFLFSLSPITCIKFIPRHSV

SEQ ID NO: 3371405 - protein, 19 aa, Plasmodium falciparum
RVGGVCFDKNRQRWIAHWK

SEQ ID NO: 3371406 - protein, 21 aa, Plasmodium falciparum
RVIEKSHVLFYILDVRNPLFF

SEQ ID NO: 3371407 - protein, 17 aa, Plasmodium falciparum
RVIHLSGIVHVRSLLRY

SEQ ID NO: 3371408 - protein, 20 aa, Plasmodium falciparum
RVIIKLKWGMEYKGILKSFD

SEQ ID NO: 3371409 - protein, 23 aa, Plasmodium falciparum
RVILVEFSNFFLLSTYTPNNGFD

SEQ ID NO: 3371410 - protein, 31 aa, Plasmodium falciparum
RVINKIIYRCEVCRKNFKSLKQYASHEKSKK

SEQ ID NO: 3371411 - protein, 23 aa, Plasmodium falciparum
RVITHLWIYEGRYRIEVDEIPAG

SEQ ID NO: 3371412 - protein, 21 aa, Plasmodium falciparum
RVIYKNSLYLFGYSYLYTPLF

SEQ ID NO: 3371413 - protein, 22 aa, Plasmodium falciparum
RVKAANIIRKNWIMYITKYDYK

SEQ ID NO: 3371414 - protein, 23 aa, Plasmodium falciparum
RVKCIKSNELLMSRLKNEMNRRI

SEQ ID NO: 3371415 - protein, 26 aa, Plasmodium falciparum
RVKLIRLRNGHFRRIVDISNIDEKSI

SEQ ID NO: 3371416 - protein, 25 aa, Plasmodium falciparum
RVKRNCWPKVRGVAMNPVEHPHGGG

SEQ ID NO: 3371417 - protein, 18 aa, Plasmodium falciparum
RVLDKMLPYMTYIYGNAH

SEQ ID NO: 3371418 - protein, 19 aa, Plasmodium falciparum
RVLNTLQVDIERVCCYIKH

SEQ ID NO: 3371419 - protein, 19 aa, Plasmodium falciparum
RVMGYDEIDNIYFHPPKGS

SEQ ID NO: 3371420 - protein, 23 aa, Plasmodium falciparum
RVMINKLTKITCHENDDLHNEYE

SEQ ID NO: 3371421 - protein, 21 aa, Plasmodium falciparum
RVNRYKANFYYFYNNTYDAFA

SEQ ID NO: 3371422 - protein, 19 aa, Plasmodium falciparum
RVSFHMIYCYILSSHNIFT

SEQ ID NO: 3371423 - protein, 21 aa, Plasmodium falciparum
RVSKWNAFLEEKLEILKRQPK

SEQ ID NO: 3371424 - protein, 25 aa, Plasmodium falciparum
RVTSMEWLGDLLFSASWDQTIKCWN

SEQ ID NO: 3371425 - protein, 19 aa, Plasmodium falciparum
RVVHRVVHRVDAKFDDMII

SEQ ID NO: 3371426 - protein, 35 aa, Plasmodium falciparum
RVVLKRYTLLEMMKVLKLLIHYANKIRKSDEKEIN

SEQ ID NO: 3371427 - protein, 22 aa, Plasmodium falciparum
RVYKPSLLPTILKKWKEHLNKV

SEQ ID NO: 3371428 - protein, 18 aa, Plasmodium falciparum
RVYNPKVHVSGWYDIQND

SEQ ID NO: 3371429 - protein, 21 aa, Plasmodium falciparum
RVYSCFCEKIFVFSLDENIKN

SEQ ID NO: 3371430 - protein, 17 aa, Plasmodium falciparum
RVYSLYDLYHKLINDCD

SEQ ID NO: 3371431 - protein, 19 aa, Plasmodium falciparum
RWDPLDFPDNKDCIDILES

SEQ ID NO: 3371432 - protein, 19 aa, Plasmodium falciparum
RWNIKSNYIHEAYFCHKKE

SEQ ID NO: 3371433 - protein, 20 aa, Plasmodium falciparum
RWSSDLKGSFSVNEIKKYDQ

SEQ ID NO: 3371434 - protein, 19 aa, Plasmodium falciparum
RYALSTISFTIVRYVQLIN

SEQ ID NO: 3371435 - protein, 18 aa, Plasmodium falciparum
RYASLFFIACIDKGDNEL

SEQ ID NO: 3371436 - protein, 24 aa, Plasmodium falciparum
RYDILEKWDHVLFNLIEPTDVEKE

SEQ ID NO: 3371437 - protein, 25 aa, Plasmodium falciparum
RYDNKRIVIADFGWSEHIDSCNLHP

SEQ ID NO: 3371438 - protein, 18 aa, Plasmodium falciparum
RYDSKCDGSSKYGGSSKY

SEQ ID NO: 3371439 - protein, 21 aa, Plasmodium falciparum
RYDTVKCLLENGVNPSIKDAQ

SEQ ID NO: 3371440 - protein, 24 aa, Plasmodium falciparum
RYEEGSSPLILAKPVFNDRESEIS

SEQ ID NO: 3371441 - protein, 21 aa, Plasmodium falciparum
RYFKNSCSLILSSGTGGTEAC

SEQ ID NO: 3371442 - protein, 18 aa, Plasmodium falciparum
RYGNYVIQKCFEHSDDNI

SEQ ID NO: 3371443 - protein, 20 aa, Plasmodium falciparum
RYHPYHVYRETIPMGKTPLT

SEQ ID NO: 3371444 - protein, 19 aa, Plasmodium falciparum
RYIEHLEDVCEYDNGNKKK

SEQ ID NO: 3371445 - protein, 18 aa, Plasmodium falciparum
RYILYKYKGTFKILTDFI

SEQ ID NO: 3371446 - protein, 24 aa, Plasmodium falciparum
RYKESEIFRNFFFTNKVTIYLYNW

SEQ ID NO: 3371447 - protein, 27 aa, Plasmodium falciparum
RYKKKKNRFSLYKWLSINDKVEQYYMQ

SEQ ID NO: 3371448 - protein, 24 aa, Plasmodium falciparum
RYKLFSSGIPLVFMNYKDSHICVL

SEQ ID NO: 3371449 - protein, 20 aa, Plasmodium falciparum
RYKLLKGLAVRRACYGVLRH

SEQ ID NO: 3371450 - protein, 20 aa, Plasmodium falciparum
RYKLNCKRKKNRKDENLDDF

SEQ ID NO: 3371451 - protein, 24 aa, Plasmodium falciparum
RYKNMKYYFSTILKKKPCYNKLNI

SEQ ID NO: 3371452 - protein, 23 aa, Plasmodium falciparum
RYKTGESTLPILSGTTNNTRYKT

SEQ ID NO: 3371453 - protein, 19 aa, Plasmodium falciparum
RYKYDVFNYCLKNIKRNIT

SEQ ID NO: 3371454 - protein, 22 aa, Plasmodium falciparum
RYLENFYKHFNVILDINNSNTN

SEQ ID NO: 3371455 - protein, 19 aa, Plasmodium falciparum
RYLYILDMLPHEWKGMLHL

SEQ ID NO: 3371456 - protein, 20 aa, Plasmodium falciparum
RYNDSHAYLMSGENEIMAHN

SEQ ID NO: 3371457 - protein, 22 aa, Plasmodium falciparum
RYNFKAEFIQVAKLYNRLAISY

SEQ ID NO: 3371458 - protein, 26 aa, Plasmodium falciparum
RYNKESYRKLLLGDLLNDDDFNEEKS

SEQ ID NO: 3371459 - protein, 18 aa, Plasmodium falciparum
RYNRGIIKRNDYTDGNTT

SEQ ID NO: 3371460 - protein, 19 aa, Plasmodium falciparum
RYNSKRAALVQSRIKLLNK

SEQ ID NO: 3371461 - protein, 23 aa, Plasmodium falciparum
RYNTRRGSTLSSHEINKNERNNK

SEQ ID NO: 3371462 - protein, 34 aa, Plasmodium falciparum
RYQQFPCIYNCVTINWFLKWPLEALVNVSTAYLN

SEQ ID NO: 3371463 - protein, 19 aa, Plasmodium falciparum
RYREAFPSIMNNTSTDKIK

SEQ ID NO: 3371464 - protein, 18 aa, Plasmodium falciparum
RYRHSCVLINDYMFIIGG

SEQ ID NO: 3371465 - protein, 17 aa, Plasmodium falciparum
RYRNFKIYTPDVITDLN

SEQ ID NO: 3371466 - protein, 27 aa, Plasmodium falciparum
RYSIFSEFFCFGIKQDSCFTNIDNNPK

SEQ ID NO: 3371467 - protein, 19 aa, Plasmodium falciparum
RYSLYEFMKNTQMLILDKI

SEQ ID NO: 3371468 - protein, 19 aa, Plasmodium falciparum
RYSSKCKSNKTWKDNIRNR

SEQ ID NO: 3371469 - protein, 18 aa, Plasmodium falciparum
RYSTICKTGYNNADVYRD

SEQ ID NO: 3371470 - protein, 25 aa, Plasmodium falciparum
RYTLIPIDHGLILPHIMDVAEIDLV

SEQ ID NO: 3371471 - protein, 27 aa, Plasmodium falciparum
RYTPDDIWFLNKINTLFLSVGELLDES

SEQ ID NO: 3371472 - protein, 18 aa, Plasmodium falciparum
RYTVKRKTYIAAVENKYT

SEQ ID NO: 3371473 - protein, 19 aa, Plasmodium falciparum
RYVEREKRRIMERERRRAM

SEQ ID NO: 3371474 - protein, 28 aa, Plasmodium falciparum
RYVEYKIILCKLLYININNLTIQNFIEF

SEQ ID NO: 3371475 - protein, 17 aa, Plasmodium falciparum
RYVIKKIFYTFICESKY

SEQ ID NO: 3371476 - protein, 19 aa, Plasmodium falciparum
RYVQLKNKLLFAISNDLKL

SEQ ID NO: 3371477 - protein, 19 aa, Plasmodium falciparum
RYVSCEKAKLCSKEQTPVF

SEQ ID NO: 3371478 - protein, 18 aa, Plasmodium falciparum
RYYYFLLNKNKVYYENGE

SEQ ID NO: 3371479 - protein, 21 aa, Plasmodium falciparum
RYYYTICCIHLKKYNKAKSNL

SEQ ID NO: 3371480 - protein, 21 aa, Plasmodium falciparum
SAADNCLKYHILKYVEESDTD

SEQ ID NO: 3371481 - protein, 20 aa, Plasmodium falciparum
SAALDLSLQHNIGFSHFISV

SEQ ID NO: 3371482 - protein, 19 aa, Plasmodium falciparum
SADCYVHLWNIKKKEVVDS

SEQ ID NO: 3371483 - protein, 21 aa, Plasmodium falciparum
SADGISAYVVEYVGDENIMYN

SEQ ID NO: 3371484 - protein, 18 aa, Plasmodium falciparum
SAEPEFFIRIIPDKTNNT

SEQ ID NO: 3371485 - protein, 24 aa, Plasmodium falciparum
SAETKYLVCFYFDEIENMTNVNNN

SEQ ID NO: 3371486 - protein, 17 aa, Plasmodium falciparum
SAIHCVKTIRKLNHKAI

SEQ ID NO: 3371487 - protein, 19 aa, Plasmodium falciparum
SAIYEAWKRIELTDPVSLG

SEQ ID NO: 3371488 - protein, 23 aa, Plasmodium falciparum
SAKINALGLLSSRNDLNYIMNNN

SEQ ID NO: 3371489 - protein, 17 aa, Plasmodium falciparum
SALNLLDNYAFEGLTKN

SEQ ID NO: 3371490 - protein, 17 aa, Plasmodium falciparum
SALQWLCNWDKKDESPV

SEQ ID NO: 3371491 - protein, 25 aa, Plasmodium falciparum
SALREFPNELLLPALNFCCSVMPEW

SEQ ID NO: 3371492 - protein, 20 aa, Plasmodium falciparum
SANDCYRANAIRVLSKIIDF

SEQ ID NO: 3371493 - protein, 21 aa, Plasmodium falciparum
SAQKRLHSLKSMGYEDKSMEN

SEQ ID NO: 3371494 - protein, 22 aa, Plasmodium falciparum
SAQKYHFCNKWLSKRSNIKKSD

SEQ ID NO: 3371495 - protein, 25 aa, Plasmodium falciparum
SAQYFFRKIVEGLKYMHKNNIAHRD

SEQ ID NO: 3371496 - protein, 22 aa, Plasmodium falciparum
SARRCMCINDKVLLKHEREKID

SEQ ID NO: 3371497 - protein, 21 aa, Plasmodium falciparum
SASHFKLPFSCNNLNEINFKD

SEQ ID NO: 3371498 - protein, 24 aa, Plasmodium falciparum
SATSVFKSLGFFLSKKKVKSSESS

SEQ ID NO: 3371499 - protein, 24 aa, Plasmodium falciparum
SATTFKSKTFVNGSLKEKKNLKND

SEQ ID NO: 3371500 - protein, 21 aa, Plasmodium falciparum
SAVYYPLNISWKYVAKKRSVG

SEQ ID NO: 3371501 - protein, 18 aa, Plasmodium falciparum
SAWWDANRKDIWKAMTCK

SEQ ID NO: 3371502 - protein, 22 aa, Plasmodium falciparum
SAYKIDVDVIFEIKNQIKNSTF

SEQ ID NO: 3371503 - protein, 21 aa, Plasmodium falciparum
SCADDIITHVPSNYKKCDEEQ

SEQ ID NO: 3371504 - protein, 25 aa, Plasmodium falciparum
SCCPTFRLPQNFNFQKFPYVNDLIN

SEQ ID NO: 3371505 - protein, 17 aa, Plasmodium falciparum
SCDDVCGILIGKYLSSN

SEQ ID NO: 3371506 - protein, 38 aa, Plasmodium falciparum
SCDEKGIVKFWFLDKYMYKLLFTYRRTFYMKNVKFFYN

SEQ ID NO: 3371507 - protein, 18 aa, Plasmodium falciparum
SCDGELLLASNGNDSITL

SEQ ID NO: 3371508 - protein, 22 aa, Plasmodium falciparum
SCECLKEYLPIVTNLIIGNVLF

SEQ ID NO: 3371509 - protein, 18 aa, Plasmodium falciparum
SCEKAKIHLDNKIYRGKI

SEQ ID NO: 3371510 - protein, 20 aa, Plasmodium falciparum
SCEYFLSFDIPYTASITYGF

SEQ ID NO: 3371511 - protein, 27 aa, Plasmodium falciparum
SCFHSFCWKCLATAIQKYSIDNCPSCR

SEQ ID NO: 3371512 - protein, 34 aa, Plasmodium falciparum
SCFIKMKKIISSLCDIHQAIKILLLLLEKHVEYI

SEQ ID NO: 3371513 - protein, 22 aa, Plasmodium falciparum
SCFTSPLWFYHSLKDLKEGQQI

SEQ ID NO: 3371514 - protein, 33 aa, Plasmodium falciparum
SCGNCYLGDAFRCASCPYKGLPAFQPGENVKLN

SEQ ID NO: 3371515 - protein, 18 aa, Plasmodium falciparum
SCGWHIMDKIYLLVGDRN

SEQ ID NO: 3371516 - protein, 18 aa, Plasmodium falciparum
SCGYPSAKKRRFNWSVKA

SEQ ID NO: 3371517 - protein, 21 aa, Plasmodium falciparum
SCIDGRLTSAWNWCSKIEKKK

SEQ ID NO: 3371518 - protein, 18 aa, Plasmodium falciparum
SCIIKWAKQLKIGGYSKI

SEQ ID NO: 3371519 - protein, 24 aa, Plasmodium falciparum
SCIKDPQSFLAIFTIKQNGIAQLE

SEQ ID NO: 3371520 - protein, 19 aa, Plasmodium falciparum
SCIVVRFAKNEFYEYQEST

SEQ ID NO: 3371521 - protein, 18 aa, Plasmodium falciparum
SCLLNECPHFSDSSNLEY

SEQ ID NO: 3371522 - protein, 27 aa, Plasmodium falciparum
SCLNVREYLKLKKLLHISNEIQDINQN

SEQ ID NO: 3371523 - protein, 19 aa, Plasmodium falciparum
SCNCSDCPCPIQNEDSEKE

SEQ ID NO: 3371524 - protein, 17 aa, Plasmodium falciparum
SCNKMNYIHKCKKKRVL

SEQ ID NO: 3371525 - protein, 60 aa, Plasmodium falciparum
SCNNKDMKKKFCRIKTFYCLKRKFLYNVDIKFLIKEKHFLKYLYLCTLKKKIQAHYNKQK

SEQ ID NO: 3371526 - protein, 20 aa, Plasmodium falciparum
SCNSVVHSCYPYDKKNIENE

SEQ ID NO: 3371527 - protein, 18 aa, Plasmodium falciparum
SCPWLDKRHVVLGHLEYG

SEQ ID NO: 3371528 - protein, 22 aa, Plasmodium falciparum
SCSKISLLKYNEEIFKHQNDKC

SEQ ID NO: 3371529 - protein, 22 aa, Plasmodium falciparum
SCSKKFNYMRCLVKNSNVHYEY

SEQ ID NO: 3371530 - protein, 24 aa, Plasmodium falciparum
SCSNRRAFSTNIVRSSKMINNFCN

SEQ ID NO: 3371531 - protein, 37 aa, Plasmodium falciparum
SCSPNSVSQKWIVRGFYRIGIFALRDIPSGEEITYNY

SEQ ID NO: 3371532 - protein, 18 aa, Plasmodium falciparum
SCSQPISHLLPRTIMPLV

SEQ ID NO: 3371533 - protein, 38 aa, Plasmodium falciparum
SCSRLKWNDFNLIYALKNMTLCWSILRNNFLIKSANSI

SEQ ID NO: 3371534 - protein, 25 aa, Plasmodium falciparum
SCSSTCNRRKVILLNKLKHKINRGL

SEQ ID NO: 3371535 - protein, 21 aa, Plasmodium falciparum
SCSTFDYSDLEFQYFSNKENI

SEQ ID NO: 3371536 - protein, 24 aa, Plasmodium falciparum
SCSVDGSICLWDINKGTKSNDVPR

SEQ ID NO: 3371537 - protein, 18 aa, Plasmodium falciparum
SCTLLENYVIIFGGLNSE

SEQ ID NO: 3371538 - protein, 20 aa, Plasmodium falciparum
SCTNKSIGYITCVHLDDINI

SEQ ID NO: 3371539 - protein, 22 aa, Plasmodium falciparum
SCVQSKYSWHLLIKKKGNQIII

SEQ ID NO: 3371540 - protein, 18 aa, Plasmodium falciparum
SCVYDYDIYNAKKIGKIQ

SEQ ID NO: 3371541 - protein, 17 aa, Plasmodium falciparum
SCYGRKELSEIIYTACN

SEQ ID NO: 3371542 - protein, 17 aa, Plasmodium falciparum
SCYKEFSPYGVLPNSSV

SEQ ID NO: 3371543 - protein, 19 aa, Plasmodium falciparum
SCYYCFSNECNLTYCKYRH

SEQ ID NO: 3371544 - protein, 20 aa, Plasmodium falciparum
SDARTAMLTGCNKLADAVSV

SEQ ID NO: 3371545 - protein, 23 aa, Plasmodium falciparum
SDDCSFVIWDLRTTTISQQNKKS

SEQ ID NO: 3371546 - protein, 20 aa, Plasmodium falciparum
SDDIIPRWITCSEILDHHTI

SEQ ID NO: 3371547 - protein, 21 aa, Plasmodium falciparum
SDDLKFGMCILTVDYHPAMHI

SEQ ID NO: 3371548 - protein, 24 aa, Plasmodium falciparum
SDDLLKKRYVVFNNKYKISELKGF

SEQ ID NO: 3371549 - protein, 23 aa, Plasmodium falciparum
SDDNRSFCTFGQYTPKQYYESPF

SEQ ID NO: 3371550 - protein, 23 aa, Plasmodium falciparum
SDDSLRRMGRNMGNDFIRRNNNN

SEQ ID NO: 3371551 - protein, 19 aa, Plasmodium falciparum
SDDYLLYYMYNNIKLNIDI

SEQ ID NO: 3371552 - protein, 18 aa, Plasmodium falciparum
SDEMLKNLINLYTKNKSS

SEQ ID NO: 3371553 - protein, 25 aa, Plasmodium falciparum
SDEPKGRYAWLEEKCFTGKKKRKYG

SEQ ID NO: 3371554 - protein, 18 aa, Plasmodium falciparum
SDEWLPFREGVVLQKSSN

SEQ ID NO: 3371555 - protein, 18 aa, Plasmodium falciparum
SDEYCEGGYHPVKINEIY

SEQ ID NO: 3371556 - protein, 22 aa, Plasmodium falciparum
SDEYKIYITVHIPFSKRYIKYL

SEQ ID NO: 3371557 - protein, 25 aa, Plasmodium falciparum
SDFRDLKYNACMFLQGELMRQFLMD

SEQ ID NO: 3371558 - protein, 21 aa, Plasmodium falciparum
SDFSTTCKFYINKIEKDNKTI

SEQ ID NO: 3371559 - protein, 18 aa, Plasmodium falciparum
SDFYGNMCNLKVQGRHDS

SEQ ID NO: 3371560 - protein, 25 aa, Plasmodium falciparum
SDGKIFCLCHDKFFTIWDTVTLKTL

SEQ ID NO: 3371561 - protein, 20 aa, Plasmodium falciparum
SDHRAYISVGVPEAKVFIID

SEQ ID NO: 3371562 - protein, 17 aa, Plasmodium falciparum
SDIDCCIVVENCEDKNS

SEQ ID NO: 3371563 - protein, 35 aa, Plasmodium falciparum
SDIDIFPRQCYLILCSYKYMCLNMHYDTDNYSVHY

SEQ ID NO: 3371564 - protein, 27 aa, Plasmodium falciparum
SDIEALKCIIDFKINFIREKYKKEKYY

SEQ ID NO: 3371565 - protein, 19 aa, Plasmodium falciparum
SDIFIEELLELLINEEKKE

SEQ ID NO: 3371566 - protein, 23 aa, Plasmodium falciparum
SDIFLNYFINMNYCFKYLYYYFT

SEQ ID NO: 3371567 - protein, 17 aa, Plasmodium falciparum
SDIIIKGNYNFGIDIEM

SEQ ID NO: 3371568 - protein, 20 aa, Plasmodium falciparum
SDIIKAIIINTELCQNEGNE

SEQ ID NO: 3371569 - protein, 23 aa, Plasmodium falciparum
SDIIRIVFDGVLILLQGKLKEPK

SEQ ID NO: 3371570 - protein, 19 aa, Plasmodium falciparum
SDILKILFFNKSPSQSSIL

SEQ ID NO: 3371571 - protein, 20 aa, Plasmodium falciparum
SDINKLVSFHIYDNKNEKTF

SEQ ID NO: 3371572 - protein, 22 aa, Plasmodium falciparum
SDINMSCSFIKNLNNDDIYITQ

SEQ ID NO: 3371573 - protein, 25 aa, Plasmodium falciparum
SDISFLLFHYLKYKGYECIYAPYLA

SEQ ID NO: 3371574 - protein, 26 aa, Plasmodium falciparum
SDITLICYTKGPGIGSALYIGYNIAK

SEQ ID NO: 3371575 - protein, 17 aa, Plasmodium falciparum
SDIWFNAQLFKKEFDDL

SEQ ID NO: 3371576 - protein, 18 aa, Plasmodium falciparum
SDKGQGFIFCNSKKNVML

SEQ ID NO: 3371577 - protein, 22 aa, Plasmodium falciparum
SDKGVCCIDELDKISLNDQQSF

SEQ ID NO: 3371578 - protein, 27 aa, Plasmodium falciparum
SDKRQSVLCKVLFNYIQKTCGVCLIFC

SEQ ID NO: 3371579 - protein, 17 aa, Plasmodium falciparum
SDKSYHGNHHFNTGCHF

SEQ ID NO: 3371580 - protein, 23 aa, Plasmodium falciparum
SDKVKEILKTPARLQITQEELNK

SEQ ID NO: 3371581 - protein, 23 aa, Plasmodium falciparum
SDKYGDCMTLNFKEKLSDNVKAY

SEQ ID NO: 3371582 - protein, 38 aa, Plasmodium falciparum
SDKYILKYNIEYFKLAQFFSQDYHLFKNYIKHVDKKLS

SEQ ID NO: 3371583 - protein, 19 aa, Plasmodium falciparum
SDLDKLLLNIFNAEQKYFT

SEQ ID NO: 3371584 - protein, 21 aa, Plasmodium falciparum
SDLGYRPFIYSWLQKLKDINT

SEQ ID NO: 3371585 - protein, 23 aa, Plasmodium falciparum
SDLLNFLKCYSNLNINLNKVPYD

SEQ ID NO: 3371586 - protein, 27 aa, Plasmodium falciparum
SDLLVYGCPRVLYKLKNTGECNEISLM

SEQ ID NO: 3371587 - protein, 22 aa, Plasmodium falciparum
SDLRKDLVMCHICNNNPDDQFH

SEQ ID NO: 3371588 - protein, 25 aa, Plasmodium falciparum
SDLYNLIKWRYKIKKSVLNQTSKKN

SEQ ID NO: 3371589 - protein, 17 aa, Plasmodium falciparum
SDMSLIISEQLRKRSRT

SEQ ID NO: 3371590 - protein, 27 aa, Plasmodium falciparum
SDNIIKCPICQGILKYGILNKKMELTI

SEQ ID NO: 3371591 - protein, 24 aa, Plasmodium falciparum
SDNLYKRKNIAHLINKRNTMDNIV

SEQ ID NO: 3371592 - protein, 18 aa, Plasmodium falciparum
SDNPMLSNDISRVSSCPE

SEQ ID NO: 3371593 - protein, 26 aa, Plasmodium falciparum
SDNSKLSFSRNFKNSFNKGMNRNNSV

SEQ ID NO: 3371594 - protein, 20 aa, Plasmodium falciparum
SDPNFQFQIYNRKDNENTLP

SEQ ID NO: 3371595 - protein, 23 aa, Plasmodium falciparum
SDPRGSEGKLCLDYFIENNENDM

SEQ ID NO: 3371596 - protein, 23 aa, Plasmodium falciparum
SDPSRNGPPPASEEVIKNLKVET

SEQ ID NO: 3371597 - protein, 18 aa, Plasmodium falciparum
SDQLMDWACIIAKKRKYP

SEQ ID NO: 3371598 - protein, 17 aa, Plasmodium falciparum
SDRECVICLTDEKDTAI

SEQ ID NO: 3371599 - protein, 17 aa, Plasmodium falciparum
SDRKEGKAITFFTSENI

SEQ ID NO: 3371600 - protein, 19 aa, Plasmodium falciparum
SDSDLSCYLDSFKNTFQDK

SEQ ID NO: 3371601 - protein, 17 aa, Plasmodium falciparum
SDSDMSICRNKHNDKSD

SEQ ID NO: 3371602 - protein, 23 aa, Plasmodium falciparum
SDSICGIYRLNSSQLLNENLDNT

SEQ ID NO: 3371603 - protein, 24 aa, Plasmodium falciparum
SDSLCLDNVFSMYLFNNYVDRSKT

SEQ ID NO: 3371604 - protein, 21 aa, Plasmodium falciparum
SDSLSKLKTIINYDKDEKRSN

SEQ ID NO: 3371605 - protein, 19 aa, Plasmodium falciparum
SDSNIYLKDISKIKIENND

SEQ ID NO: 3371606 - protein, 20 aa, Plasmodium falciparum
SDSNLLCSHNFVHNENEMLR

SEQ ID NO: 3371607 - protein, 20 aa, Plasmodium falciparum
SDTFFLSLFMYSKYVDKIYR

SEQ ID NO: 3371608 - protein, 21 aa, Plasmodium falciparum
SDTKFLIKLNNEIKKEEEKKD

SEQ ID NO: 3371609 - protein, 17 aa, Plasmodium falciparum
SDTRYDLSLFYNVQDKC

SEQ ID NO: 3371610 - protein, 18 aa, Plasmodium falciparum
SDVFYYIDCQIVGTYYIQ

SEQ ID NO: 3371611 - protein, 17 aa, Plasmodium falciparum
SDVGRECITTSEKANYD

SEQ ID NO: 3371612 - protein, 20 aa, Plasmodium falciparum
SDVINCIHFLPNLKEIIDNE

SEQ ID NO: 3371613 - protein, 23 aa, Plasmodium falciparum
SDVRKEMVHFLLERKSQENLISF

SEQ ID NO: 3371614 - protein, 25 aa, Plasmodium falciparum
SDYDKQELLKHLSLNNTNVSDTLEN

SEQ ID NO: 3371615 - protein, 18 aa, Plasmodium falciparum
SDYIRFAPLRNIIKNFTF

SEQ ID NO: 3371616 - protein, 18 aa, Plasmodium falciparum
SDYLKKTSGTYVVDEMEN

SEQ ID NO: 3371617 - protein, 34 aa, Plasmodium falciparum
SDYNKWSVNMLYNFLKMIGLKKEAYLFKINKIRG

SEQ ID NO: 3371618 - protein, 17 aa, Plasmodium falciparum
SDYSYKYIKNIYEKFEN

SEQ ID NO: 3371619 - protein, 25 aa, Plasmodium falciparum
SDYVCCLWGKAGAYGVVTCPFSVRE

SEQ ID NO: 3371620 - protein, 26 aa, Plasmodium falciparum
SDYYQHKPCLCHRRGILNTSNSSENQ

SEQ ID NO: 3371621 - protein, 20 aa, Plasmodium falciparum
SEAHSKLILNKKVTSDDVIN

SEQ ID NO: 3371622 - protein, 23 aa, Plasmodium falciparum
SEAINRKLAYIFKQKLPLENKTS

SEQ ID NO: 3371623 - protein, 17 aa, Plasmodium falciparum
SEALYDYMDIFKIILNK

SEQ ID NO: 3371624 - protein, 18 aa, Plasmodium falciparum
SEANISYIHDKIKTSTTK

SEQ ID NO: 3371625 - protein, 19 aa, Plasmodium falciparum
SECIPVRLYLSGFDLTPTY

SEQ ID NO: 3371626 - protein, 34 aa, Plasmodium falciparum
SECTEFLWKFHKEFNDKDAILFEYVLSSVKIIMN

SEQ ID NO: 3371627 - protein, 29 aa, Plasmodium falciparum
SEDDVCFYELYKFICSNNIEGNNENIFDD

SEQ ID NO: 3371628 - protein, 19 aa, Plasmodium falciparum
SEDEIKEEVKIVVDNNNNN

SEQ ID NO: 3371629 - protein, 34 aa, Plasmodium falciparum
SEDILNKYCFIRERKYNKPGGNKYIPRDRSNNNN

SEQ ID NO: 3371630 - protein, 21 aa, Plasmodium falciparum
SEDIRKKHIIKTFNDNKKNRE

SEQ ID NO: 3371631 - protein, 23 aa, Plasmodium falciparum
SEDIYDWKYAYKISNKNNNNNNN

SEQ ID NO: 3371632 - protein, 20 aa, Plasmodium falciparum
SEDMLNDIFHIMDLNNNNKI

SEQ ID NO: 3371633 - protein, 20 aa, Plasmodium falciparum
SEDSFHFVSYISFQDKVYLL

SEQ ID NO: 3371634 - protein, 23 aa, Plasmodium falciparum
SEDTFCFKIIKELGNGYYSPGNG

SEQ ID NO: 3371635 - protein, 23 aa, Plasmodium falciparum
SEDYKPYLPLPFVDFPPGLTPAQ

SEQ ID NO: 3371636 - protein, 21 aa, Plasmodium falciparum
SEEGVVVIICRDPCLSSYISL

SEQ ID NO: 3371637 - protein, 25 aa, Plasmodium falciparum
SEEHFRLDKSFNIFNNKLTYDEMKK

SEQ ID NO: 3371638 - protein, 21 aa, Plasmodium falciparum
SEEKRLIIIYLNTVGMEEELS

SEQ ID NO: 3371639 - protein, 23 aa, Plasmodium falciparum
SEERKECNLFERNFRILQKKRSY

SEQ ID NO: 3371640 - protein, 21 aa, Plasmodium falciparum
SEERLRDAFNLFDTDKSGKIT

SEQ ID NO: 3371641 - protein, 21 aa, Plasmodium falciparum
SEESFLYKYNIHNILKNKHFS

SEQ ID NO: 3371642 - protein, 17 aa, Plasmodium falciparum
SEESVFYCSLLSNRSSC

SEQ ID NO: 3371643 - protein, 23 aa, Plasmodium falciparum
SEFEELNCELLHLGFSALPNLPK

SEQ ID NO: 3371644 - protein, 23 aa, Plasmodium falciparum
SEFIKFPIEIWSEKIDYERVPDD

SEQ ID NO: 3371645 - protein, 27 aa, Plasmodium falciparum
SEFKRLLHLHFDKFLNRAKANYKRVQM

SEQ ID NO: 3371646 - protein, 17 aa, Plasmodium falciparum
SEFMKNNKLGVGHTNNN

SEQ ID NO: 3371647 - protein, 19 aa, Plasmodium falciparum
SEFNRWCPSLNVITYRGNK

SEQ ID NO: 3371648 - protein, 44 aa, Plasmodium falciparum
SEFVPFEEKEIFSLYKKCSYELNEIRKNLNLFIIRQDNGLSLVG

SEQ ID NO: 3371649 - protein, 23 aa, Plasmodium falciparum
SEGFPRNDIDIYSIRVARNKIIC

SEQ ID NO: 3371650 - protein, 17 aa, Plasmodium falciparum
SEGKSGSLFYFTSNGKY

SEQ ID NO: 3371651 - protein, 23 aa, Plasmodium falciparum
SEGSISVLIPFSSFANFKKALCI

SEQ ID NO: 3371652 - protein, 22 aa, Plasmodium falciparum
SEGTQICNGCGMVVESKILSEE

SEQ ID NO: 3371653 - protein, 22 aa, Plasmodium falciparum
SEGWIKENDKYLDLSHRVDKDN

SEQ ID NO: 3371654 - protein, 20 aa, Plasmodium falciparum
SEGYHFKLVVYITHNVLNLK

SEQ ID NO: 3371655 - protein, 19 aa, Plasmodium falciparum
SEIHFLKYLELQYYLKKQK

SEQ ID NO: 3371656 - protein, 29 aa, Plasmodium falciparum
SEIIADCYCNLGLLYRLTGNVVESLHKYI

SEQ ID NO: 3371657 - protein, 20 aa, Plasmodium falciparum
SEIKKNDIIITFKYDSHDNI

SEQ ID NO: 3371658 - protein, 28 aa, Plasmodium falciparum
SEILFFKNTYLMIKRAVNRDLIKEKRKN

SEQ ID NO: 3371659 - protein, 24 aa, Plasmodium falciparum
SEILKMKSDIILRRNSTITNKIYK

SEQ ID NO: 3371660 - protein, 23 aa, Plasmodium falciparum
SEILSFYLEYLIKSNDQYITFYI

SEQ ID NO: 3371661 - protein, 24 aa, Plasmodium falciparum
SEIPFVRRATRTLTFKNQGGLTGC

SEQ ID NO: 3371662 - protein, 22 aa, Plasmodium falciparum
SEITCLLYISFHRINNFLNIYQ

SEQ ID NO: 3371663 - protein, 23 aa, Plasmodium falciparum
SEIYVKETLLLILSLSQCDISHP

SEQ ID NO: 3371664 - protein, 23 aa, Plasmodium falciparum
SEKEIKMDMSINCNNAKGTNKTN

SEQ ID NO: 3371665 - protein, 17 aa, Plasmodium falciparum
SEKETIEAFNLFFMNNF

SEQ ID NO: 3371666 - protein, 17 aa, Plasmodium falciparum
SEKFKLKKMIILLKGTN

SEQ ID NO: 3371667 - protein, 24 aa, Plasmodium falciparum
SEKIKRKWVEIKIKGKKPSKRYGH

SEQ ID NO: 3371668 - protein, 20 aa, Plasmodium falciparum
SEKILRCTMRLEKITNPHFY

SEQ ID NO: 3371669 - protein, 20 aa, Plasmodium falciparum
SEKKMAFLIYTHLKNKKRKI

SEQ ID NO: 3371670 - protein, 20 aa, Plasmodium falciparum
SEKNEEIIFEHALLEEELFE

SEQ ID NO: 3371671 - protein, 17 aa, Plasmodium falciparum
SEKNLKDKIILLENEKD

SEQ ID NO: 3371672 - protein, 18 aa, Plasmodium falciparum
SEKNRLKKGISILTCTPG

SEQ ID NO: 3371673 - protein, 21 aa, Plasmodium falciparum
SEKNVETILGWKENCKKKKEV

SEQ ID NO: 3371674 - protein, 21 aa, Plasmodium falciparum
SEKNVGFFLKPVIKNDKLLWD

SEQ ID NO: 3371675 - protein, 36 aa, Plasmodium falciparum
SEKRDSLLNHIVKMPLKYAYKNGLSPRNSTARSEDK

SEQ ID NO: 3371676 - protein, 20 aa, Plasmodium falciparum
SEKRENALLELSRKRETYHD

SEQ ID NO: 3371677 - protein, 24 aa, Plasmodium falciparum
SEKRIRKYRTKKMLLKEAMEKGIS

SEQ ID NO: 3371678 - protein, 17 aa, Plasmodium falciparum
SEKSLWRLLEIKKNDNY

SEQ ID NO: 3371679 - protein, 18 aa, Plasmodium falciparum
SEKTFLKNNVDWNKIKLL

SEQ ID NO: 3371680 - protein, 20 aa, Plasmodium falciparum
SEKWYCPICKPDDHKNLDVR

SEQ ID NO: 3371681 - protein, 20 aa, Plasmodium falciparum
SEKYIKCLFETAKEHSPAII

SEQ ID NO: 3371682 - protein, 21 aa, Plasmodium falciparum
SEKYMDIVLCDNNDSTTKNTT

SEQ ID NO: 3371683 - protein, 26 aa, Plasmodium falciparum
SELKFFFQKLHELFRQMLNKSGKKKK

SEQ ID NO: 3371684 - protein, 23 aa, Plasmodium falciparum
SELKFYISNNIPFFIFAQQRKIF

SEQ ID NO: 3371685 - protein, 24 aa, Plasmodium falciparum
SELLGVDLPYCYKKKYEKHMDKLY

SEQ ID NO: 3371686 - protein, 19 aa, Plasmodium falciparum
SELNSLLEIYGYGKEYDKK

SEQ ID NO: 3371687 - protein, 21 aa, Plasmodium falciparum
SELQSRLSLTNINPSILSSKT

SEQ ID NO: 3371688 - protein, 20 aa, Plasmodium falciparum
SELSKTVATFIVQKILIDEL

SEQ ID NO: 3371689 - protein, 18 aa, Plasmodium falciparum
SELTKEDEILLGNSNDDN

SEQ ID NO: 3371690 - protein, 25 aa, Plasmodium falciparum
SELYIRKWIYHIIYKKWFTPNNATS

SEQ ID NO: 3371691 - protein, 17 aa, Plasmodium falciparum
SELYYNYIDTFIKEFLG

SEQ ID NO: 3371692 - protein, 20 aa, Plasmodium falciparum
SEMRCRRLLGKKKKINKDQE

SEQ ID NO: 3371693 - protein, 27 aa, Plasmodium falciparum
SENHFNLFGNYNFFGNNCIHCKSYKNE

SEQ ID NO: 3371694 - protein, 23 aa, Plasmodium falciparum
SENLRFIYDSILKKEGKEKIKEC

SEQ ID NO: 3371695 - protein, 23 aa, Plasmodium falciparum
SENMMKCDLKIMNEQDVIHNIND

SEQ ID NO: 3371696 - protein, 21 aa, Plasmodium falciparum
SENVISCKVLNNILKELAQKH

SEQ ID NO: 3371697 - protein, 33 aa, Plasmodium falciparum
SENYTYKITSRGPVCYSALYRDNKYVYRHIILS

SEQ ID NO: 3371698 - protein, 23 aa, Plasmodium falciparum
SEPNIYKYNRFMGTQKDSYVNKI

SEQ ID NO: 3371699 - protein, 22 aa, Plasmodium falciparum
SEPWNVMVDMFLWRDPEQFELK

SEQ ID NO: 3371700 - protein, 21 aa, Plasmodium falciparum
SEPYVPVTLLKSFRDVYPKFK

SEQ ID NO: 3371701 - protein, 23 aa, Plasmodium falciparum
SEQILPLYLIEFEFKCLRVDISI

SEQ ID NO: 3371702 - protein, 19 aa, Plasmodium falciparum
SEQNNICSLIESLDNKKFQ

SEQ ID NO: 3371703 - protein, 24 aa, Plasmodium falciparum
SERIKKGDVGTTTWTKSTTEGHPE

SEQ ID NO: 3371704 - protein, 18 aa, Plasmodium falciparum
SERLDCLRNLDIRKRSIY

SEQ ID NO: 3371705 - protein, 23 aa, Plasmodium falciparum
SESEKKILVKEIMGRSKKCTMKN

SEQ ID NO: 3371706 - protein, 27 aa, Plasmodium falciparum
SESFEVQRIKLFYEKLIKQFQEKIKSK

SEQ ID NO: 3371707 - protein, 21 aa, Plasmodium falciparum
SESMGDNTIILGVYNNTKDIK

SEQ ID NO: 3371708 - protein, 23 aa, Plasmodium falciparum
SESNTGLLSSFDFRSHSSYNKYN

SEQ ID NO: 3371709 - protein, 17 aa, Plasmodium falciparum
SESRSSKVGLYNNISDS

SEQ ID NO: 3371710 - protein, 26 aa, Plasmodium falciparum
SESSVCTALFNKFHPHLIIGGTYTGN

SEQ ID NO: 3371711 - protein, 25 aa, Plasmodium falciparum
SETAYKLCRKWGYEVKKIPENSAKI

SEQ ID NO: 3371712 - protein, 23 aa, Plasmodium falciparum
SETNCSDFLYIVKNILKMKNTSD

SEQ ID NO: 3371713 - protein, 20 aa, Plasmodium falciparum
SEVDFSPSFNLFLTSRDAHF

SEQ ID NO: 3371714 - protein, 24 aa, Plasmodium falciparum
SEVKDKSWRNWFGVSSTEYDNTTN

SEQ ID NO: 3371715 - protein, 19 aa, Plasmodium falciparum
SEVKFYITLKISKLRNIDY

SEQ ID NO: 3371716 - protein, 24 aa, Plasmodium falciparum
SEWLLCLFCTTFPITTTLRIWDCL

SEQ ID NO: 3371717 - protein, 19 aa, Plasmodium falciparum
SEYEIIRTSLIVNLLKFVS

SEQ ID NO: 3371718 - protein, 19 aa, Plasmodium falciparum
SEYKGKCVVNNELNNIQNE

SEQ ID NO: 3371719 - protein, 19 aa, Plasmodium falciparum
SEYLFDSCNKYLNVENNYD

SEQ ID NO: 3371720 - protein, 19 aa, Plasmodium falciparum
SEYRVVVKHFPRFFKNIKE

SEQ ID NO: 3371721 - protein, 20 aa, Plasmodium falciparum
SEYYQARSILNKKLKNNIKK

SEQ ID NO: 3371722 - protein, 17 aa, Plasmodium falciparum
SFANFKKALCIEIAITD

SEQ ID NO: 3371723 - protein, 26 aa, Plasmodium falciparum
SFDKRIEIFLIYSYSSYKIFKPLIFL

SEQ ID NO: 3371724 - protein, 20 aa, Plasmodium falciparum
SFDMLDMINSNYTSKSGKKN

SEQ ID NO: 3371725 - protein, 30 aa, Plasmodium falciparum
SFDNLDTLTCLWSISGQYLIFLVNTNDTTN

SEQ ID NO: 3371726 - protein, 18 aa, Plasmodium falciparum
SFDSRTLIGIMTFDSTIH

SEQ ID NO: 3371727 - protein, 37 aa, Plasmodium falciparum
SFEHKGPNGTHICMVFEFMGPNLLSLIKHYDYKGIPL

SEQ ID NO: 3371728 - protein, 20 aa, Plasmodium falciparum
SFENFELFENVAIIKKELYD

SEQ ID NO: 3371729 - protein, 35 aa, Plasmodium falciparum
SFENIKQCYRCCCFFNTKCCHCIECKEKYHMKLKN

SEQ ID NO: 3371730 - protein, 20 aa, Plasmodium falciparum
SFFKELSCEALNISMNNSNE

SEQ ID NO: 3371731 - protein, 18 aa, Plasmodium falciparum
SFFKKLKLIMNILDDVHS

SEQ ID NO: 3371732 - protein, 21 aa, Plasmodium falciparum
SFFNKLCHTIYIFIITKYPFL

SEQ ID NO: 3371733 - protein, 17 aa, Plasmodium falciparum
SFFNYYINQKILKSCEI

SEQ ID NO: 3371734 - protein, 23 aa, Plasmodium falciparum
SFFPSLRLTPGLRFNMFPHMNDI

SEQ ID NO: 3371735 - protein, 18 aa, Plasmodium falciparum
SFFSVNFSYYLKKKGASV

SEQ ID NO: 3371736 - protein, 28 aa, Plasmodium falciparum
SFFYIYHKNYWKKCILKLQNNSYITCPL

SEQ ID NO: 3371737 - protein, 19 aa, Plasmodium falciparum
SFHFRCIIEKLKNRKYDNI

SEQ ID NO: 3371738 - protein, 19 aa, Plasmodium falciparum
SFHLEMLLHSSISTYDYTK

SEQ ID NO: 3371739 - protein, 17 aa, Plasmodium falciparum
SFHSFVCCTVWRKFDHI

SEQ ID NO: 3371740 - protein, 19 aa, Plasmodium falciparum
SFHSLNLICNCIYPINIYK

SEQ ID NO: 3371741 - protein, 17 aa, Plasmodium falciparum
SFICNNISPYVGAYAAK

SEQ ID NO: 3371742 - protein, 20 aa, Plasmodium falciparum
SFILHQHICTAIFAEYKSLK

SEQ ID NO: 3371743 - protein, 26 aa, Plasmodium falciparum
SFINLKQLYLFIFFNIYKYFKYISTP

SEQ ID NO: 3371744 - protein, 18 aa, Plasmodium falciparum
SFIPEHFATDKIVTKQSS

SEQ ID NO: 3371745 - protein, 22 aa, Plasmodium falciparum
SFKDCKKELYTNVKDKITLQHK

SEQ ID NO: 3371746 - protein, 30 aa, Plasmodium falciparum
SFKDTKLFVHQNISSLILYFNQRSMDDKWV

SEQ ID NO: 3371747 - protein, 20 aa, Plasmodium falciparum
SFKSPYHCYFFLRNQFENFK

SEQ ID NO: 3371748 - protein, 35 aa, Plasmodium falciparum
SFKYYNYFKSFTFDHLVALFCLFLHLSNIKGRNIY

SEQ ID NO: 3371749 - protein, 26 aa, Plasmodium falciparum
SFLCFKFSEKYLYIFGNEKKHVEIFI

SEQ ID NO: 3371750 - protein, 19 aa, Plasmodium falciparum
SFLCIPMNYYLNICTNDDE

SEQ ID NO: 3371751 - protein, 17 aa, Plasmodium falciparum
SFLCLVYFMFLENLDIF

SEQ ID NO: 3371752 - protein, 18 aa, Plasmodium falciparum
SFLEHVNNFFSYANKKND

SEQ ID NO: 3371753 - protein, 29 aa, Plasmodium falciparum
SFLFLHKRGKFLCSASYERFIIILNTETR

SEQ ID NO: 3371754 - protein, 20 aa, Plasmodium falciparum
SFLIFLTRHFLKVINKKSSI

SEQ ID NO: 3371755 - protein, 24 aa, Plasmodium falciparum
SFLKKLLRIGCLTSYNISINILSV

SEQ ID NO: 3371756 - protein, 18 aa, Plasmodium falciparum
SFLNVYVHLFDIFKKSVD

SEQ ID NO: 3371757 - protein, 19 aa, Plasmodium falciparum
SFLWMKRTLEFIITFLEKC

SEQ ID NO: 3371758 - protein, 26 aa, Plasmodium falciparum
SFMPSKRSSVCLFTDMKYQKIYIYGG

SEQ ID NO: 3371759 - protein, 20 aa, Plasmodium falciparum
SFNCAHFIAYNGFRETLHGH

SEQ ID NO: 3371760 - protein, 25 aa, Plasmodium falciparum
SFNIKEILTMLNFIKLYSNGKGHTE

SEQ ID NO: 3371761 - protein, 25 aa, Plasmodium falciparum
SFNKKICKIKNIYSENKNNQFFKNN

SEQ ID NO: 3371762 - protein, 23 aa, Plasmodium falciparum
SFNMTLILCWSNEECARVIEDFR

SEQ ID NO: 3371763 - protein, 19 aa, Plasmodium falciparum
SFNNLMWNNYYQDISGGTT

SEQ ID NO: 3371764 - protein, 25 aa, Plasmodium falciparum
SFPNREFCNFLNFIIQNKININEKQ

SEQ ID NO: 3371765 - protein, 26 aa, Plasmodium falciparum
SFPPYECTNCNILLKEITTRNYLNFS

SEQ ID NO: 3371766 - protein, 19 aa, Plasmodium falciparum
SFQKRKFMTADEIEQEKIY

SEQ ID NO: 3371767 - protein, 19 aa, Plasmodium falciparum
SFRKGSFVDDISWKKQESQ

SEQ ID NO: 3371768 - protein, 18 aa, Plasmodium falciparum
SFSIEVLLLLYALKINFP

SEQ ID NO: 3371769 - protein, 18 aa, Plasmodium falciparum
SFSMKYKHIHTNNNNRSE

SEQ ID NO: 3371770 - protein, 19 aa, Plasmodium falciparum
SFSNILLKIIKYKNDTNNT

SEQ ID NO: 3371771 - protein, 18 aa, Plasmodium falciparum
SFSNLKKKKSSDILLNNS

SEQ ID NO: 3371772 - protein, 24 aa, Plasmodium falciparum
SFSNMCIDKAYILTDDIMLSLMED

SEQ ID NO: 3371773 - protein, 22 aa, Plasmodium falciparum
SFSPYNNICIIQYENADNAKKA

SEQ ID NO: 3371774 - protein, 24 aa, Plasmodium falciparum
SFSSIKLPILVLIIKSMFVILNDE

SEQ ID NO: 3371775 - protein, 23 aa, Plasmodium falciparum
SFSSSILESIGWTYENVATSYIA

SEQ ID NO: 3371776 - protein, 18 aa, Plasmodium falciparum
SFTFGQDVVHNFLRKHEL

SEQ ID NO: 3371777 - protein, 26 aa, Plasmodium falciparum
SFTGNICKIAKDQTGCRILQRILEKK

SEQ ID NO: 3371778 - protein, 23 aa, Plasmodium falciparum
SFTKSSRWNICMNRHNSRFFSSN

SEQ ID NO: 3371779 - protein, 30 aa, Plasmodium falciparum
SFTNKILGSYSFKFILNINMYDFEENFYFN

SEQ ID NO: 3371780 - protein, 24 aa, Plasmodium falciparum
SFVKGARVGNLWLLNYNKNNLRKI

SEQ ID NO: 3371781 - protein, 17 aa, Plasmodium falciparum
SFWDIRMNKPIISLNSH

SEQ ID NO: 3371782 - protein, 51 aa, Plasmodium falciparum
SFYAKGICARGSKCSWAHGQSDVRPMPKFYKTRMCYTFLSGSYCEASKCTF

SEQ ID NO: 3371783 - protein, 17 aa, Plasmodium falciparum
SFYAMSHIVDILNNNNE

SEQ ID NO: 3371784 - protein, 23 aa, Plasmodium falciparum
SFYHYYKYLEFIKHEQVKEHIEL

SEQ ID NO: 3371785 - protein, 23 aa, Plasmodium falciparum
SFYLYKYDYFGELSIINEQLRTT

SEQ ID NO: 3371786 - protein, 22 aa, Plasmodium falciparum
SGADKFIFLWNMEYGNVNKRIH

SEQ ID NO: 3371787 - protein, 32 aa, Plasmodium falciparum
SGCYILRPAAYYIWECVQAFFNKEIKKLNVEN

SEQ ID NO: 3371788 - protein, 33 aa, Plasmodium falciparum
SGDKKYKLVVFIYKGILLMLLIKGSKIKDEDFD

SEQ ID NO: 3371789 - protein, 24 aa, Plasmodium falciparum
SGDKLHCRPFFPFVGKQKDPNHIY

SEQ ID NO: 3371790 - protein, 24 aa, Plasmodium falciparum
SGDLFSCLLLSFIVKQKGNILHII

SEQ ID NO: 3371791 - protein, 22 aa, Plasmodium falciparum
SGDLYFKMFNRYIKEYNDFIKS

SEQ ID NO: 3371792 - protein, 18 aa, Plasmodium falciparum
SGGQRSLLALSLILALLK

SEQ ID NO: 3371793 - protein, 25 aa, Plasmodium falciparum
SGILQSGFWCCFDEFSRIDESVIVI

SEQ ID NO: 3371794 - protein, 17 aa, Plasmodium falciparum
SGIQRMERGPIIIGVPC

SEQ ID NO: 3371795 - protein, 19 aa, Plasmodium falciparum
SGIYKRYFDKSTNNISQHK

SEQ ID NO: 3371796 - protein, 19 aa, Plasmodium falciparum
SGKEAYVFNAIKYINDEEL

SEQ ID NO: 3371797 - protein, 25 aa, Plasmodium falciparum
SGKRKESWDNLFYRNNIIKEEKEME

SEQ ID NO: 3371798 - protein, 17 aa, Plasmodium falciparum
SGKRLFHRFMLYSRIGK

SEQ ID NO: 3371799 - protein, 27 aa, Plasmodium falciparum
SGKRRGGKYTIDGCAIFYNKKKLKFVE

SEQ ID NO: 3371800 - protein, 27 aa, Plasmodium falciparum
SGKTLAFVLPCFMHILKHKEIIQNNNN

SEQ ID NO: 3371801 - protein, 17 aa, Plasmodium falciparum
SGLENIMPHVSYKINEN

SEQ ID NO: 3371802 - protein, 26 aa, Plasmodium falciparum
SGLGDFPECIKNIINNMSSTYKVNEN

SEQ ID NO: 3371803 - protein, 35 aa, Plasmodium falciparum
SGLNLWNNIEIHFKLTWPIALIINTNTIYTYNSIF

SEQ ID NO: 3371804 - protein, 30 aa, Plasmodium falciparum
SGNKSFILSWGIRESREISLQKGYVNIQKI

SEQ ID NO: 3371805 - protein, 20 aa, Plasmodium falciparum
SGNNWAYGFYVHGKNICEDF

SEQ ID NO: 3371806 - protein, 20 aa, Plasmodium falciparum
SGPITLRANKGINLIAAANA

SEQ ID NO: 3371807 - protein, 20 aa, Plasmodium falciparum
SGPSALYCCKHFLKNDNIKV

SEQ ID NO: 3371808 - protein, 26 aa, Plasmodium falciparum
SGQAFPQCVFDHWSVLYDDPFDSNKN

SEQ ID NO: 3371809 - protein, 27 aa, Plasmodium falciparum
SGREWCYVEVQLLGKGSRDWDYCRDSI

SEQ ID NO: 3371810 - protein, 27 aa, Plasmodium falciparum
SGSFKILCFRLSHHFLDVPNGVALEGK

SEQ ID NO: 3371811 - protein, 28 aa, Plasmodium falciparum
SGSFNANFFRNAYKFLYDSREQEKKIIE

SEQ ID NO: 3371812 - protein, 19 aa, Plasmodium falciparum
SGSIGINLTAANVVIFYDT

SEQ ID NO: 3371813 - protein, 27 aa, Plasmodium falciparum
SGSVFIKDICCELCKSKYPKSIKQNEE

SEQ ID NO: 3371814 - protein, 21 aa, Plasmodium falciparum
SGTEPKVKWYAEISRDTYEQA

SEQ ID NO: 3371815 - protein, 21 aa, Plasmodium falciparum
SGTLKQLWLSYNYIDKLDNLQ

SEQ ID NO: 3371816 - protein, 19 aa, Plasmodium falciparum
SGYGGNFGRGGYRSGGGMG

SEQ ID NO: 3371817 - protein, 27 aa, Plasmodium falciparum
SGYLNFPMNFLKLIRNIYINVMQKKNG

SEQ ID NO: 3371818 - protein, 26 aa, Plasmodium falciparum
SHADVLFKMRFIDGISTVNRHALDIR

SEQ ID NO: 3371819 - protein, 17 aa, Plasmodium falciparum
SHAILNIDLKDINKNTS

SEQ ID NO: 3371820 - protein, 19 aa, Plasmodium falciparum
SHCLLTVYQHRNIKEKELI

SEQ ID NO: 3371821 - protein, 20 aa, Plasmodium falciparum
SHCLPKMYKQLMLHKDSPII

SEQ ID NO: 3371822 - protein, 23 aa, Plasmodium falciparum
SHDAFDFIIPSSFNKEEDNGNEK

SEQ ID NO: 3371823 - protein, 18 aa, Plasmodium falciparum
SHDIKEKLIERVMINKLT

SEQ ID NO: 3371824 - protein, 20 aa, Plasmodium falciparum
SHEDIDLFSAPKEKTSNVHI

SEQ ID NO: 3371825 - protein, 19 aa, Plasmodium falciparum
SHEEINLFKDIYEELENSQ

SEQ ID NO: 3371826 - protein, 25 aa, Plasmodium falciparum
SHEGPFFWSYVDSIIFLDPGFNKNI

SEQ ID NO: 3371827 - protein, 25 aa, Plasmodium falciparum
SHEPCYMCAMALLHSRIKCVIFDKE

SEQ ID NO: 3371828 - protein, 18 aa, Plasmodium falciparum
SHERSHIYITPKLYLESI

SEQ ID NO: 3371829 - protein, 25 aa, Plasmodium falciparum
SHEVVSWIRKILRCEKTGHSGTLDP

SEQ ID NO: 3371830 - protein, 17 aa, Plasmodium falciparum
SHFPIKFDKEVVSNHDE

SEQ ID NO: 3371831 - protein, 23 aa, Plasmodium falciparum
SHFPLLKYCIFKLEDEEKILIDK

SEQ ID NO: 3371832 - protein, 19 aa, Plasmodium falciparum
SHFYVPWFQTPYIYDIKMK

SEQ ID NO: 3371833 - protein, 20 aa, Plasmodium falciparum
SHGDTYFYNYLRYSVNNNGR

SEQ ID NO: 3371834 - protein, 19 aa, Plasmodium falciparum
SHGRRCAKYYPVKQYGYLE

SEQ ID NO: 3371835 - protein, 22 aa, Plasmodium falciparum
SHHKDPIKFSSLIKNKQNNNNS

SEQ ID NO: 3371836 - protein, 24 aa, Plasmodium falciparum
SHIEKKKCKILFYMNKDVKKDIDN

SEQ ID NO: 3371837 - protein, 20 aa, Plasmodium falciparum
SHIHKKGCVGIVSRSGTLTY

SEQ ID NO: 3371838 - protein, 18 aa, Plasmodium falciparum
SHIMYSVNKIKEEKHNLE

SEQ ID NO: 3371839 - protein, 30 aa, Plasmodium falciparum
SHKILEMKSFRLSLNYTDLDVLVGIFPIIW

SEQ ID NO: 3371840 - protein, 19 aa, Plasmodium falciparum
SHKKRVVTINGELIENDGR

SEQ ID NO: 3371841 - protein, 20 aa, Plasmodium falciparum
SHKLLSERNIENMINKYILK

SEQ ID NO: 3371842 - protein, 20 aa, Plasmodium falciparum
SHKNDKCLIYKALNVGYNIV

SEQ ID NO: 3371843 - protein, 18 aa, Plasmodium falciparum
SHKRTLIRNAAWTLSNLC

SEQ ID NO: 3371844 - protein, 18 aa, Plasmodium falciparum
SHKSYVHENYVFGDNQIN

SEQ ID NO: 3371845 - protein, 18 aa, Plasmodium falciparum
SHKYACNIIEKILLKKEY

SEQ ID NO: 3371846 - protein, 23 aa, Plasmodium falciparum
SHLHVKYSALYIHNDQKQYTRFL

SEQ ID NO: 3371847 - protein, 21 aa, Plasmodium falciparum
SHLILNRYNHFKSRFNDHQYA

SEQ ID NO: 3371848 - protein, 18 aa, Plasmodium falciparum
SHLYHGCSNDFLFSAYPV

SEQ ID NO: 3371849 - protein, 19 aa, Plasmodium falciparum
SHMHDWRNTSSHHYYTHHH

SEQ ID NO: 3371850 - protein, 34 aa, Plasmodium falciparum
SHMNAYCLCKSMLKYPLVFLCTGQVNCFFFHSNK

SEQ ID NO: 3371851 - protein, 29 aa, Plasmodium falciparum
SHNEFWNRRCPFYLSDSSFIRYITVMCPD

SEQ ID NO: 3371852 - protein, 25 aa, Plasmodium falciparum
SHNKICTRNAFDIHIIEHLEDLINL

SEQ ID NO: 3371853 - protein, 18 aa, Plasmodium falciparum
SHNMLLYYTDIMKNGIKL

SEQ ID NO: 3371854 - protein, 30 aa, Plasmodium falciparum
SHPFYKHYIEEISFNLQIPYLIVYDKPDVL

SEQ ID NO: 3371855 - protein, 23 aa, Plasmodium falciparum
SHPHAGFGLGFERLIMLVTGVDN

SEQ ID NO: 3371856 - protein, 21 aa, Plasmodium falciparum
SHQILNFKLSKTFKKFSLERE

SEQ ID NO: 3371857 - protein, 18 aa, Plasmodium falciparum
SHQLFVGCMTHYNNQILL

SEQ ID NO: 3371858 - protein, 29 aa, Plasmodium falciparum
SHSEINMLINNFIYILKIMNKHKQMLENI

SEQ ID NO: 3371859 - protein, 18 aa, Plasmodium falciparum
SHSFLYEKSFHIINNSHL

SEQ ID NO: 3371860 - protein, 19 aa, Plasmodium falciparum
SHSIKKKVILILWNELNCF

SEQ ID NO: 3371861 - protein, 19 aa, Plasmodium falciparum
SHSSYPYSSYSSICSKEKN

SEQ ID NO: 3371862 - protein, 18 aa, Plasmodium falciparum
SHTFYIFLSYDYKKKLSI

SEQ ID NO: 3371863 - protein, 17 aa, Plasmodium falciparum
SHTPEIVTKVLKIEETI

SEQ ID NO: 3371864 - protein, 18 aa, Plasmodium falciparum
SHTSKFYLYGLKKNIYTS

SEQ ID NO: 3371865 - protein, 25 aa, Plasmodium falciparum
SHVIQSLLCLFPYFNKYEYIYIDKL

SEQ ID NO: 3371866 - protein, 23 aa, Plasmodium falciparum
SHVNIIKMYGCMQDEEYIYHVLE

SEQ ID NO: 3371867 - protein, 19 aa, Plasmodium falciparum
SHYPRGIVGVDSIYNENTV

SEQ ID NO: 3371868 - protein, 21 aa, Plasmodium falciparum
SHYYISNFLKTCMKIKNNKIQ

SEQ ID NO: 3371869 - protein, 25 aa, Plasmodium falciparum
SIAARGLDFPDLELVINYDLPSEFE

SEQ ID NO: 3371870 - protein, 18 aa, Plasmodium falciparum
SIAIWPLSYSKFPYMISA

SEQ ID NO: 3371871 - protein, 18 aa, Plasmodium falciparum
SIAKMLICKVHIGTKNLE

SEQ ID NO: 3371872 - protein, 25 aa, Plasmodium falciparum
SIALPDVHAGYGFSIGNVAAFDMDN

SEQ ID NO: 3371873 - protein, 19 aa, Plasmodium falciparum
SIANHLIKILLNGLGTPFN

SEQ ID NO: 3371874 - protein, 17 aa, Plasmodium falciparum
SICEYFCHRPHVDGLLL

SEQ ID NO: 3371875 - protein, 17 aa, Plasmodium falciparum
SICLSQYNNAMNAYNNF

SEQ ID NO: 3371876 - protein, 18 aa, Plasmodium falciparum
SICSGYFNHVCKRDTQQG

SEQ ID NO: 3371877 - protein, 20 aa, Plasmodium falciparum
SIDATFFYFLSVINSYERTC

SEQ ID NO: 3371878 - protein, 18 aa, Plasmodium falciparum
SIDDCLMNCLKHNASNLK

SEQ ID NO: 3371879 - protein, 30 aa, Plasmodium falciparum
SIDDKVFLMFILKYIKKYILHIIYKTFQIK

SEQ ID NO: 3371880 - protein, 17 aa, Plasmodium falciparum
SIDEYKINFTILKTNLI

SEQ ID NO: 3371881 - protein, 18 aa, Plasmodium falciparum
SIDFIKQYISTLLKKNIR

SEQ ID NO: 3371882 - protein, 24 aa, Plasmodium falciparum
SIDHFKGDVVTLVQIICNIIPFKL

SEQ ID NO: 3371883 - protein, 31 aa, Plasmodium falciparum
SIDIYITEIIMKSCFVTVYKMKDDELKWKRA

SEQ ID NO: 3371884 - protein, 29 aa, Plasmodium falciparum
SIDKIVQVRLYKGIFNYPQGVLLRDNIYK

SEQ ID NO: 3371885 - protein, 24 aa, Plasmodium falciparum
SIDKRKKHNLKMDMIEEYTKKGIP

SEQ ID NO: 3371886 - protein, 17 aa, Plasmodium falciparum
SIDSVFFKSLSKDSYDL

SEQ ID NO: 3371887 - protein, 18 aa, Plasmodium falciparum
SIDSYLIFEEIKDDNKKD

SEQ ID NO: 3371888 - protein, 17 aa, Plasmodium falciparum
SIENCLYKMNLKNYDTI

SEQ ID NO: 3371889 - protein, 23 aa, Plasmodium falciparum
SIENIKMLGTESFYEDENNDEDI

SEQ ID NO: 3371890 - protein, 18 aa, Plasmodium falciparum
SIEQKLEFLTEGKKKQKL

SEQ ID NO: 3371891 - protein, 18 aa, Plasmodium falciparum
SIEYNIVDEFILKIKSSR

SEQ ID NO: 3371892 - protein, 17 aa, Plasmodium falciparum
SIFNACIEIFPSPKNID

SEQ ID NO: 3371893 - protein, 24 aa, Plasmodium falciparum
SIFPRSCTFASISSASKENERKNS

SEQ ID NO: 3371894 - protein, 30 aa, Plasmodium falciparum
SIFSCNLKFPDFVNPLAIDLIKKTLVVDVN

SEQ ID NO: 3371895 - protein, 27 aa, Plasmodium falciparum
SIFSLELVPISLLLTKALTCPLIGTVT

SEQ ID NO: 3371896 - protein, 19 aa, Plasmodium falciparum
SIFSQRIGMKFTQNLNNEM

SEQ ID NO: 3371897 - protein, 23 aa, Plasmodium falciparum
SIFSYANIIVCTTGRLLYHLENN

SEQ ID NO: 3371898 - protein, 24 aa, Plasmodium falciparum
SIFVKKEFVEFLTYDANIKIVSNK

SEQ ID NO: 3371899 - protein, 24 aa, Plasmodium falciparum
SIFVKKNFDSILCDVPCSGDGTLR

SEQ ID NO: 3371900 - protein, 24 aa, Plasmodium falciparum
SIFYEHSEKLCVNLRFQCTNIYDD

SEQ ID NO: 3371901 - protein, 17 aa, Plasmodium falciparum
SIFYLLSSLEKFKDFTG

SEQ ID NO: 3371902 - protein, 23 aa, Plasmodium falciparum
SIGPKYKYHCESFNHNKNNDISN

SEQ ID NO: 3371903 - protein, 19 aa, Plasmodium falciparum
SIHPTIASTLFDINHENPR

SEQ ID NO: 3371904 - protein, 25 aa, Plasmodium falciparum
SIIAIKYCIEHGILSGTKHHEALYK

SEQ ID NO: 3371905 - protein, 19 aa, Plasmodium falciparum
SIIHIVDSYHFIKYYNKQE

SEQ ID NO: 3371906 - protein, 38 aa, Plasmodium falciparum
SIIKTEIPINCEMAKRPAHLFIPIKSKEAISAYIELKK

SEQ ID NO: 3371907 - protein, 22 aa, Plasmodium falciparum
SIILNHFCEPNMEPLKKNTVDL

SEQ ID NO: 3371908 - protein, 23 aa, Plasmodium falciparum
SIIMLPHHVQILLLSATVPNYLE

SEQ ID NO: 3371909 - protein, 23 aa, Plasmodium falciparum
SIINYRMILGLKKIDINNLSSLC

SEQ ID NO: 3371910 - protein, 21 aa, Plasmodium falciparum
SIIRNHIKKYITYLLKINTCS

SEQ ID NO: 3371911 - protein, 25 aa, Plasmodium falciparum
SIITYLYKYGHLYNEHALSKEEIIS

SEQ ID NO: 3371912 - protein, 22 aa, Plasmodium falciparum
SIKCPDLSLIDLPGITRVPLKN

SEQ ID NO: 3371913 - protein, 24 aa, Plasmodium falciparum
SIKEDRKHIQFSLDNKIIENNEMK

SEQ ID NO: 3371914 - protein, 24 aa, Plasmodium falciparum
SIKRIPINLKYFLSTDKWGFNIWS

SEQ ID NO: 3371915 - protein, 18 aa, Plasmodium falciparum
SIKSQACHIVYTDYRPTP

SEQ ID NO: 3371916 - protein, 25 aa, Plasmodium falciparum
SIKYKCPSSSYLSLNELLKFVDSIN

SEQ ID NO: 3371917 - protein, 25 aa, Plasmodium falciparum
SILDELVNIYSLKGEYFYKRISTCL

SEQ ID NO: 3371918 - protein, 17 aa, Plasmodium falciparum
SILEVKRMMSMTKGNGK

SEQ ID NO: 3371919 - protein, 19 aa, Plasmodium falciparum
SILKYIIGICYLKKKNFSL

SEQ ID NO: 3371920 - protein, 19 aa, Plasmodium falciparum
SILNCYDNDECIYTNKNNN

SEQ ID NO: 3371921 - protein, 29 aa, Plasmodium falciparum
SILNLKCCGYRWCLTGTPLQNRISELYSL

SEQ ID NO: 3371922 - protein, 17 aa, Plasmodium falciparum
SILPCVHIENNKNELHI

SEQ ID NO: 3371923 - protein, 29 aa, Plasmodium falciparum
SILSNRSKKKFSCLVKNDLESEKGRGRSS

SEQ ID NO: 3371924 - protein, 27 aa, Plasmodium falciparum
SIMVHLKINVQNRMNLFIPINKYNGKR

SEQ ID NO: 3371925 - protein, 22 aa, Plasmodium falciparum
SINEYKETINIVKNLTKKINYK

SEQ ID NO: 3371926 - protein, 26 aa, Plasmodium falciparum
SINGDQSVEMIINFIFKHFNKLKDLR

SEQ ID NO: 3371927 - protein, 23 aa, Plasmodium falciparum
SINHKRLFKIIASIQLENLDKGI

SEQ ID NO: 3371928 - protein, 26 aa, Plasmodium falciparum
SINLKKYKLMWLLNVNKTYLNYNEII

SEQ ID NO: 3371929 - protein, 23 aa, Plasmodium falciparum
SINLNCIKSYIEHPVPLNEDENY

SEQ ID NO: 3371930 - protein, 17 aa, Plasmodium falciparum
SINLWICAIDLQIEKKN

SEQ ID NO: 3371931 - protein, 27 aa, Plasmodium falciparum
SINNEIREWLLLFLLPNFIHKSIHKVT

SEQ ID NO: 3371932 - protein, 24 aa, Plasmodium falciparum
SIPHIEFITKFMLKVIDKIEKQLH

SEQ ID NO: 3371933 - protein, 20 aa, Plasmodium falciparum
SIPLHVIEITDFSHGLKKNK

SEQ ID NO: 3371934 - protein, 24 aa, Plasmodium falciparum
SIQAYRKNDRFFILQAPSQYKYFI

SEQ ID NO: 3371935 - protein, 23 aa, Plasmodium falciparum
SIRDAFELLKLIIKNTNMTIVER

SEQ ID NO: 3371936 - protein, 27 aa, Plasmodium falciparum
SIRDILCSYIHLYKSVLNFYLNNMNIL

SEQ ID NO: 3371937 - protein, 17 aa, Plasmodium falciparum
SIRKETYEDIQLDVQGC

SEQ ID NO: 3371938 - protein, 19 aa, Plasmodium falciparum
SIRNKICMYEKKKSMNNEI

SEQ ID NO: 3371939 - protein, 17 aa, Plasmodium falciparum
SISCADDIITHVPSNYK

SEQ ID NO: 3371940 - protein, 23 aa, Plasmodium falciparum
SISEVKKSILINCIKEKDIIESS

SEQ ID NO: 3371941 - protein, 25 aa, Plasmodium falciparum
SISHFKSVMDIYCNKYNSFFISVGS

SEQ ID NO: 3371942 - protein, 23 aa, Plasmodium falciparum
SISHLNIPIGFKICNEEKEKKKK

SEQ ID NO: 3371943 - protein, 19 aa, Plasmodium falciparum
SISMMKGLKETGGDKWTKF

SEQ ID NO: 3371944 - protein, 19 aa, Plasmodium falciparum
SISNKKSVVRNLMLNTQDQ

SEQ ID NO: 3371945 - protein, 22 aa, Plasmodium falciparum
SISSVPSCCTVKSLDKYIKHIT

SEQ ID NO: 3371946 - protein, 23 aa, Plasmodium falciparum
SISWSRCGRFLVSAVSNNPNAFN

SEQ ID NO: 3371947 - protein, 17 aa, Plasmodium falciparum
SITGPSLYFEILDYIPL

SEQ ID NO: 3371948 - protein, 17 aa, Plasmodium falciparum
SITYDFMDSNLIITDNK

SEQ ID NO: 3371949 - protein, 17 aa, Plasmodium falciparum
SIVKPFYDKIQKNEQYN

SEQ ID NO: 3371950 - protein, 31 aa, Plasmodium falciparum
SIVKYIRKGWFEKEIHNVRGVVCDRYKNIIF

SEQ ID NO: 3371951 - protein, 19 aa, Plasmodium falciparum
SIVRFSWSTADTMLENLGE

SEQ ID NO: 3371952 - protein, 24 aa, Plasmodium falciparum
SIVYSRNDFGLFIFLIQYTENDFF

SEQ ID NO: 3371953 - protein, 26 aa, Plasmodium falciparum
SIYDIYPDEWFRANKYDDWLVHKLCK

SEQ ID NO: 3371954 - protein, 25 aa, Plasmodium falciparum
SIYEKRKVLLTKLLLLFKKNVDTQI

SEQ ID NO: 3371955 - protein, 17 aa, Plasmodium falciparum
SIYFLNHIYNFIKKNKY

SEQ ID NO: 3371956 - protein, 20 aa, Plasmodium falciparum
SIYFRCLKNNFQLKKSEREH

SEQ ID NO: 3371957 - protein, 18 aa, Plasmodium falciparum
SIYGKRNIGNLIEFNIDG

SEQ ID NO: 3371958 - protein, 18 aa, Plasmodium falciparum
SIYLDPNLQNNNYFDNMQ

SEQ ID NO: 3371959 - protein, 24 aa, Plasmodium falciparum
SIYLECIGNNFALDNIFLSNPFLI

SEQ ID NO: 3371960 - protein, 18 aa, Plasmodium falciparum
SIYLSSKRVLKWKTIIEI

SEQ ID NO: 3371961 - protein, 27 aa, Plasmodium falciparum
SIYNFYKHFRLFKMFQIYNLSHIEKIK

SEQ ID NO: 3371962 - protein, 18 aa, Plasmodium falciparum
SIYNRKRHSGSDIYNKKY

SEQ ID NO: 3371963 - protein, 23 aa, Plasmodium falciparum
SIYPCLTGVLIGVDLAYNLYSAY

SEQ ID NO: 3371964 - protein, 19 aa, Plasmodium falciparum
SKAKHVWVKSIVNGNKIFS

SEQ ID NO: 3371965 - protein, 18 aa, Plasmodium falciparum
SKAMLLRSELNDIFQKKY

SEQ ID NO: 3371966 - protein, 21 aa, Plasmodium falciparum
SKAYIKHLKYNKVIPTDPTIP

SEQ ID NO: 3371967 - protein, 24 aa, Plasmodium falciparum
SKDFYNCIYNHKIVKHLRSTYSQH

SEQ ID NO: 3371968 - protein, 17 aa, Plasmodium falciparum
SKDIFRIDADISENKKG

SEQ ID NO: 3371969 - protein, 18 aa, Plasmodium falciparum
SKDIFRIDADISENKKGK

SEQ ID NO: 3371970 - protein, 27 aa, Plasmodium falciparum
SKDKSIFLWKGIYPFNKMREWNGHIDG

SEQ ID NO: 3371971 - protein, 36 aa, Plasmodium falciparum
SKDKYKASQIFPLWDHPKDSIDYCLSTYLYWLYLRR

SEQ ID NO: 3371972 - protein, 21 aa, Plasmodium falciparum
SKDLHRKYFKNMYQNNQDEKH

SEQ ID NO: 3371973 - protein, 22 aa, Plasmodium falciparum
SKDSAYIYFDFEKKKLDSQEKH

SEQ ID NO: 3371974 - protein, 24 aa, Plasmodium falciparum
SKDSTFPFPPLTFIRNNTNKKRIA

SEQ ID NO: 3371975 - protein, 19 aa, Plasmodium falciparum
SKDTSLWNTQIHLLNEKIK

SEQ ID NO: 3371976 - protein, 26 aa, Plasmodium falciparum
SKDYLKLKLPDSIFKHIRDLTSKDVK

SEQ ID NO: 3371977 - protein, 20 aa, Plasmodium falciparum
SKDYSKARVQTMTTNIGNHN

SEQ ID NO: 3371978 - protein, 17 aa, Plasmodium falciparum
SKEAISAYIELKKPYDN

SEQ ID NO: 3371979 - protein, 19 aa, Plasmodium falciparum
SKEDTCLRVWNIYTSDLIY

SEQ ID NO: 3371980 - protein, 28 aa, Plasmodium falciparum
SKEEAIRVCTRIRPLFEKEINNGHLKAW

SEQ ID NO: 3371981 - protein, 25 aa, Plasmodium falciparum
SKEEVQVPIFLWVIFGGKDMKSMDS

SEQ ID NO: 3371982 - protein, 27 aa, Plasmodium falciparum
SKEHIPWAIRNWFWNGSLLYEELIPLL

SEQ ID NO: 3371983 - protein, 22 aa, Plasmodium falciparum
SKEKYIIALPFFLNTSPKSSNT

SEQ ID NO: 3371984 - protein, 17 aa, Plasmodium falciparum
SKELKLWNYINYDKIYN

SEQ ID NO: 3371985 - protein, 33 aa, Plasmodium falciparum
SKEPKISKYLLKKWGFNKAHSLAVHTVKCAYKA

SEQ ID NO: 3371986 - protein, 22 aa, Plasmodium falciparum
SKERAVKKCFGLLIEQNVYTVD

SEQ ID NO: 3371987 - protein, 19 aa, Plasmodium falciparum
SKESDSFRGRERGSRRSKE

SEQ ID NO: 3371988 - protein, 23 aa, Plasmodium falciparum
SKESRYFPCLMIAEKQYNSLKEL

SEQ ID NO: 3371989 - protein, 18 aa, Plasmodium falciparum
SKETLSIIDELRCIEKSI

SEQ ID NO: 3371990 - protein, 17 aa, Plasmodium falciparum
SKFDFLSNFHFDMPYNS

SEQ ID NO: 3371991 - protein, 19 aa, Plasmodium falciparum
SKFEIFLKTIFRIYSSPGR

SEQ ID NO: 3371992 - protein, 18 aa, Plasmodium falciparum
SKFGKVFDFMYMNNKMNS

SEQ ID NO: 3371993 - protein, 25 aa, Plasmodium falciparum
SKFILKERLNLYIPMTLLEENLFRA

SEQ ID NO: 3371994 - protein, 22 aa, Plasmodium falciparum
SKFKKQNTIVLKKRKTMPRLHL

SEQ ID NO: 3371995 - protein, 17 aa, Plasmodium falciparum
SKFLESFNVNKGSKFHQ

SEQ ID NO: 3371996 - protein, 25 aa, Plasmodium falciparum
SKFLKKSVRCIGCNSSIKKPPLCNH

SEQ ID NO: 3371997 - protein, 20 aa, Plasmodium falciparum
SKFPPNTFDALYYVLPGLSF

SEQ ID NO: 3371998 - protein, 18 aa, Plasmodium falciparum
SKFYRTVSYRNMSLKKNK

SEQ ID NO: 3371999 - protein, 19 aa, Plasmodium falciparum
SKGASLVYNVDEINKNSIY

SEQ ID NO: 3372000 - protein, 17 aa, Plasmodium falciparum
SKGNPLLINKKHVPKMD

SEQ ID NO: 3372001 - protein, 19 aa, Plasmodium falciparum
SKGSIAFIILRHKLYSLQC

SEQ ID NO: 3372002 - protein, 23 aa, Plasmodium falciparum
SKHDYDAFCLFNPRFKQGKHHTV

SEQ ID NO: 3372003 - protein, 17 aa, Plasmodium falciparum
SKHGYLHAYQPQKIQSD

SEQ ID NO: 3372004 - protein, 22 aa, Plasmodium falciparum
SKHLKTLLLDPQWKEQKDKLYE

SEQ ID NO: 3372005 - protein, 18 aa, Plasmodium falciparum
SKHMLKNTMITKLNNNSN

SEQ ID NO: 3372006 - protein, 17 aa, Plasmodium falciparum
SKIDYGLKNEDYKKKSM

SEQ ID NO: 3372007 - protein, 23 aa, Plasmodium falciparum
SKIGVPWCTSLTWSANGQLLYCG

SEQ ID NO: 3372008 - protein, 17 aa, Plasmodium falciparum
SKIHVFLINNPKENDKK

SEQ ID NO: 3372009 - protein, 24 aa, Plasmodium falciparum
SKIKEKDFGLDIIKQADHLQLQDF

SEQ ID NO: 3372010 - protein, 31 aa, Plasmodium falciparum
SKIKELLEAFGEIKNFEFFYGDETSDTYISL

SEQ ID NO: 3372011 - protein, 25 aa, Plasmodium falciparum
SKIKRKKKRINIIMRRKKKRKRKKK

SEQ ID NO: 3372012 - protein, 23 aa, Plasmodium falciparum
SKIKSEFLSFLIEEMKYDILNSK

SEQ ID NO: 3372013 - protein, 17 aa, Plasmodium falciparum
SKIKWLKRICNARLSQK

SEQ ID NO: 3372014 - protein, 19 aa, Plasmodium falciparum
SKILHYSPFNDLRIFGFDI

SEQ ID NO: 3372015 - protein, 23 aa, Plasmodium falciparum
SKINEAQALLIFQKIKEKLKKNK

SEQ ID NO: 3372016 - protein, 24 aa, Plasmodium falciparum
SKINSWRSLPPLNCVRHSASAIFF

SEQ ID NO: 3372017 - protein, 19 aa, Plasmodium falciparum
SKIVDKFSIIRQINKLAHH

SEQ ID NO: 3372018 - protein, 21 aa, Plasmodium falciparum
SKIYGMKAMASVWNRGPLSVT

SEQ ID NO: 3372019 - protein, 17 aa, Plasmodium falciparum
SKIYIIRNIHNYYIVLE

SEQ ID NO: 3372020 - protein, 23 aa, Plasmodium falciparum
SKIYKNKYKIFSEIDNVEDDTLD

SEQ ID NO: 3372021 - protein, 17 aa, Plasmodium falciparum
SKIYRKKYDQGFPLNLP

SEQ ID NO: 3372022 - protein, 24 aa, Plasmodium falciparum
SKKCKKIILLFLPKNVQSYEERLF

SEQ ID NO: 3372023 - protein, 24 aa, Plasmodium falciparum
SKKFWKRYIYLWINYSIFEELYAQ

SEQ ID NO: 3372024 - protein, 25 aa, Plasmodium falciparum
SKKIKGHPSVLFWSDAINEIHIKDK

SEQ ID NO: 3372025 - protein, 34 aa, Plasmodium falciparum
SKKKKICLSSIVPWKKADVMISKIYRKKYDQGFP

SEQ ID NO: 3372026 - protein, 17 aa, Plasmodium falciparum
SKKKKIFLGKFLYTHNI

SEQ ID NO: 3372027 - protein, 38 aa, Plasmodium falciparum
SKKKNKPKCLIEELLFERYCSAIGKNLYHKNESEKSIF

SEQ ID NO: 3372028 - protein, 17 aa, Plasmodium falciparum
SKKKNLRNIISTYLNSQ

SEQ ID NO: 3372029 - protein, 23 aa, Plasmodium falciparum
SKKKQKCCSPLLKIKKKKKKKRI

SEQ ID NO: 3372030 - protein, 21 aa, Plasmodium falciparum
SKKKYFNELLNFGNKNKNVQI

SEQ ID NO: 3372031 - protein, 17 aa, Plasmodium falciparum
SKKKYSLQCERQNTDND

SEQ ID NO: 3372032 - protein, 18 aa, Plasmodium falciparum
SKKLLFMSYLNVNTQNKN

SEQ ID NO: 3372033 - protein, 18 aa, Plasmodium falciparum
SKKLPINYIKKINNNNNK

SEQ ID NO: 3372034 - protein, 17 aa, Plasmodium falciparum
SKKNNFNNLGFSKNKEM

SEQ ID NO: 3372035 - protein, 24 aa, Plasmodium falciparum
SKKRKKCGSLKTANIKGSQNKTTD

SEQ ID NO: 3372036 - protein, 20 aa, Plasmodium falciparum
SKKRKTCKRNNIGEMQTSTN

SEQ ID NO: 3372037 - protein, 22 aa, Plasmodium falciparum
SKKSSLYAKCSDILQKYDSNKF

SEQ ID NO: 3372038 - protein, 23 aa, Plasmodium falciparum
SKKTFLHTLFKSFIKPYNEKNTA

SEQ ID NO: 3372039 - protein, 32 aa, Plasmodium falciparum
SKKVFRLLKLLGEWIKYGLVLIFVNKQIEADL

SEQ ID NO: 3372040 - protein, 23 aa, Plasmodium falciparum
SKKYEQRNWKCIARELNTNRSPL

SEQ ID NO: 3372041 - protein, 20 aa, Plasmodium falciparum
SKKYPRRSSSLVYSNAKKSI

SEQ ID NO: 3372042 - protein, 26 aa, Plasmodium falciparum
SKKYRCMRCDYVIKKNAAPELYYNTE

SEQ ID NO: 3372043 - protein, 17 aa, Plasmodium falciparum
SKLIFIDKLLCQLHYEN

SEQ ID NO: 3372044 - protein, 21 aa, Plasmodium falciparum
SKLKDGKNFKAYNESIQYEMH

SEQ ID NO: 3372045 - protein, 18 aa, Plasmodium falciparum
SKLKLGKISLNIFNILYN

SEQ ID NO: 3372046 - protein, 17 aa, Plasmodium falciparum
SKLLGYMSMISRNNILY

SEQ ID NO: 3372047 - protein, 24 aa, Plasmodium falciparum
SKLNELLLLTARYAYHYEKKDIQE

SEQ ID NO: 3372048 - protein, 19 aa, Plasmodium falciparum
SKLNFCSWPSPQVSTAVVE

SEQ ID NO: 3372049 - protein, 19 aa, Plasmodium falciparum
SKLPHFAIEQRKKLIKETN

SEQ ID NO: 3372050 - protein, 17 aa, Plasmodium falciparum
SKLRGCENLEKLQNSKV

SEQ ID NO: 3372051 - protein, 17 aa, Plasmodium falciparum
SKLSFLRLISNESEQDR

SEQ ID NO: 3372052 - protein, 22 aa, Plasmodium falciparum
SKLSQTALHMLKLMLQKDYNKR

SEQ ID NO: 3372053 - protein, 21 aa, Plasmodium falciparum
SKLTLDMKSTIYIPSDMSLFN

SEQ ID NO: 3372054 - protein, 17 aa, Plasmodium falciparum
SKMLKHEFSTFNDNTEN

SEQ ID NO: 3372055 - protein, 25 aa, Plasmodium falciparum
SKMYNVNFCIKKYLRNMKYVNLKRL

SEQ ID NO: 3372056 - protein, 18 aa, Plasmodium falciparum
SKNAYRFIEDVNENDKKE

SEQ ID NO: 3372057 - protein, 19 aa, Plasmodium falciparum
SKNDWEGVYVLIRNKTFLN

SEQ ID NO: 3372058 - protein, 25 aa, Plasmodium falciparum
SKNESTSNCALGFNTTKIKFHKNCL

SEQ ID NO: 3372059 - protein, 24 aa, Plasmodium falciparum
SKNETFPRKSMVHINNLENINIKN

SEQ ID NO: 3372060 - protein, 18 aa, Plasmodium falciparum
SKNEWGWSKSKLGANAIL

SEQ ID NO: 3372061 - protein, 27 aa, Plasmodium falciparum
SKNFRINTIYPLLKWKINHINDSYIPL

SEQ ID NO: 3372062 - protein, 25 aa, Plasmodium falciparum
SKNIKKEHSNECFTHNDNEVYNTEE

SEQ ID NO: 3372063 - protein, 26 aa, Plasmodium falciparum
SKNIKLDSILARGFNKSILKEIETNT

SEQ ID NO: 3372064 - protein, 24 aa, Plasmodium falciparum
SKNIYNSKGVKREGYNSEDNDNTA

SEQ ID NO: 3372065 - protein, 24 aa, Plasmodium falciparum
SKNKEAFCACLIVCYDLLKPDYIL

SEQ ID NO: 3372066 - protein, 29 aa, Plasmodium falciparum
SKNKKFIKFPSCNLFNNKLNDFINNSFGD

SEQ ID NO: 3372067 - protein, 33 aa, Plasmodium falciparum
SKNKYEFVKKFFIKNLFYINSFGNNGELCFATW

SEQ ID NO: 3372068 - protein, 23 aa, Plasmodium falciparum
SKNKYNEFFLWSTKCVDLEPSIL

SEQ ID NO: 3372069 - protein, 23 aa, Plasmodium falciparum
SKNMCLNFFDIIHKITKLSSIKS

SEQ ID NO: 3372070 - protein, 20 aa, Plasmodium falciparum
SKNNICRKYISYLLDNLCEK

SEQ ID NO: 3372071 - protein, 20 aa, Plasmodium falciparum
SKNRSIKYGDEYEEEIYNTK

SEQ ID NO: 3372072 - protein, 19 aa, Plasmodium falciparum
SKNSEFIGINALNLEPALP

SEQ ID NO: 3372073 - protein, 19 aa, Plasmodium falciparum
SKNSFKNRNEHMMIDEQKN

SEQ ID NO: 3372074 - protein, 17 aa, Plasmodium falciparum
SKNSFNLIQHIPDSITN

SEQ ID NO: 3372075 - protein, 20 aa, Plasmodium falciparum
SKNSVFYFSLIVDMLKEKSN

SEQ ID NO: 3372076 - protein, 19 aa, Plasmodium falciparum
SKNTTCPLCKIDLRNSYKK

SEQ ID NO: 3372077 - protein, 26 aa, Plasmodium falciparum
SKNVKSGSPFFLPSFMDCSIHNDDDS

SEQ ID NO: 3372078 - protein, 17 aa, Plasmodium falciparum
SKNVNMYKLCIKHHLNY

SEQ ID NO: 3372079 - protein, 18 aa, Plasmodium falciparum
SKPCARWGHSSQLFDNEW

SEQ ID NO: 3372080 - protein, 18 aa, Plasmodium falciparum
SKPDSFRNIYLTDSNSKY

SEQ ID NO: 3372081 - protein, 23 aa, Plasmodium falciparum
SKPFKSKLLLLLNKLSDCSDIVE

SEQ ID NO: 3372082 - protein, 18 aa, Plasmodium falciparum
SKPLKFVAIKIQKGSETY

SEQ ID NO: 3372083 - protein, 22 aa, Plasmodium falciparum
SKQAYYNGVVIVRCPSCENLHL

SEQ ID NO: 3372084 - protein, 23 aa, Plasmodium falciparum
SKQEYYKDVLFLKWTKEEHKKNN

SEQ ID NO: 3372085 - protein, 17 aa, Plasmodium falciparum
SKQINISKYAIWFCLEK

SEQ ID NO: 3372086 - protein, 23 aa, Plasmodium falciparum
SKQNKELYCYKKHMNTISSPINV

SEQ ID NO: 3372087 - protein, 20 aa, Plasmodium falciparum
SKRAFGVGLMIAAYHNEPCI

SEQ ID NO: 3372088 - protein, 22 aa, Plasmodium falciparum
SKRKDSDFFKKNYRNSYKHHPY

SEQ ID NO: 3372089 - protein, 25 aa, Plasmodium falciparum
SKRKSFPRFFFISSTDLIDILSNGN

SEQ ID NO: 3372090 - protein, 23 aa, Plasmodium falciparum
SKRMNRRKISELVNYHDDYCFYI

SEQ ID NO: 3372091 - protein, 20 aa, Plasmodium falciparum
SKSFIARNLVKTSLKNKTSA

SEQ ID NO: 3372092 - protein, 25 aa, Plasmodium falciparum
SKSHLRLKMVNSLIMPNMNDLKNIS

SEQ ID NO: 3372093 - protein, 25 aa, Plasmodium falciparum
SKSINCTICKQIIYRNEYLLHLNTL

SEQ ID NO: 3372094 - protein, 25 aa, Plasmodium falciparum
SKSKKCSWGAPYAVFECDKKKIINL

SEQ ID NO: 3372095 - protein, 23 aa, Plasmodium falciparum
SKSLTIFINLCINYMNNDNKHIF

SEQ ID NO: 3372096 - protein, 27 aa, Plasmodium falciparum
SKSMHFALKLSWLYHSIVEDNSSKYKD

SEQ ID NO: 3372097 - protein, 17 aa, Plasmodium falciparum
SKTIFQEKIVEVPQIKV

SEQ ID NO: 3372098 - protein, 28 aa, Plasmodium falciparum
SKTIKPVYKYEGKKIIEIPIHKPYLVTH

SEQ ID NO: 3372099 - protein, 21 aa, Plasmodium falciparum
SKTKICKHYLEQKCLNTHNCN

SEQ ID NO: 3372100 - protein, 18 aa, Plasmodium falciparum
SKTKYEGKFVKYEDTINQ

SEQ ID NO: 3372101 - protein, 25 aa, Plasmodium falciparum
SKTLLPPLFLYVTFFQFKIKYLCET

SEQ ID NO: 3372102 - protein, 28 aa, Plasmodium falciparum
SKTNFFPRISLITTKYITFFNHFDDINN

SEQ ID NO: 3372103 - protein, 24 aa, Plasmodium falciparum
SKTPLRLANSIGLIDAGYRGEIIA

SEQ ID NO: 3372104 - protein, 19 aa, Plasmodium falciparum
SKTRISSFHKNHVKNLDTN

SEQ ID NO: 3372105 - protein, 24 aa, Plasmodium falciparum
SKTSTKCPTCIKELKNIINKLPNI

SEQ ID NO: 3372106 - protein, 24 aa, Plasmodium falciparum
SKVIRRRRIRSKKKSVDKDIKGSN

SEQ ID NO: 3372107 - protein, 19 aa, Plasmodium falciparum
SKVKKNICNNIYDIYNNHI

SEQ ID NO: 3372108 - protein, 18 aa, Plasmodium falciparum
SKVNEFEKNIVIITTKEK

SEQ ID NO: 3372109 - protein, 17 aa, Plasmodium falciparum
SKWKVMNTACGRTNKKK

SEQ ID NO: 3372110 - protein, 18 aa, Plasmodium falciparum
SKWLVVSILWGIGGSLNL

SEQ ID NO: 3372111 - protein, 20 aa, Plasmodium falciparum
SKYATVCDFVKKKVNKSRVS

SEQ ID NO: 3372112 - protein, 23 aa, Plasmodium falciparum
SKYEAGEIVNVYFYNKLHIGIGL

SEQ ID NO: 3372113 - protein, 17 aa, Plasmodium falciparum
SKYGKVVNIWLDTKNID

SEQ ID NO: 3372114 - protein, 17 aa, Plasmodium falciparum
SKYHFFVNIYMALKNQR

SEQ ID NO: 3372115 - protein, 20 aa, Plasmodium falciparum
SKYKLYKYCRNYINDFKNKY

SEQ ID NO: 3372116 - protein, 26 aa, Plasmodium falciparum
SKYKRCFKIASTCWDRENRRNFQPEL

SEQ ID NO: 3372117 - protein, 20 aa, Plasmodium falciparum
SKYLCKPVFIDIIEHTYMCK

SEQ ID NO: 3372118 - protein, 29 aa, Plasmodium falciparum
SKYLFTFAKDFCVIWNLFQGINKNVSYTI

SEQ ID NO: 3372119 - protein, 19 aa, Plasmodium falciparum
SKYLNKFSSLNKMNTLFYE

SEQ ID NO: 3372120 - protein, 24 aa, Plasmodium falciparum
SKYNEKKNVINFILNNRKNFEIKN

SEQ ID NO: 3372121 - protein, 17 aa, Plasmodium falciparum
SKYRKPYSYFKVKPQTI

SEQ ID NO: 3372122 - protein, 18 aa, Plasmodium falciparum
SKYSLNINNFIKLHNNYY

SEQ ID NO: 3372123 - protein, 34 aa, Plasmodium falciparum
SKYSYLNILIMYYIKRMETFLPFFNLQDYLQILQ

SEQ ID NO: 3372124 - protein, 24 aa, Plasmodium falciparum
SKYTCLTHFKDLYIKIKIMDCSFN

SEQ ID NO: 3372125 - protein, 18 aa, Plasmodium falciparum
SKYYKLVLIKKMTLKHLF

SEQ ID NO: 3372126 - protein, 17 aa, Plasmodium falciparum
SLACQREAEKLSKNLNG

SEQ ID NO: 3372127 - protein, 19 aa, Plasmodium falciparum
SLASYCFTSSIKIDNNKCA

SEQ ID NO: 3372128 - protein, 18 aa, Plasmodium falciparum
SLAYFKMGAFENSLKDAL

SEQ ID NO: 3372129 - protein, 19 aa, Plasmodium falciparum
SLCDILFSICMKDENELNY

SEQ ID NO: 3372130 - protein, 17 aa, Plasmodium falciparum
SLCLTQDKCVYVWGYLK

SEQ ID NO: 3372131 - protein, 37 aa, Plasmodium falciparum
SLCYIYGDIESVNFMKGKNLFIVKFVSTDSALNAYKN

SEQ ID NO: 3372132 - protein, 19 aa, Plasmodium falciparum
SLDDLGNMCDIMLNKFNEA

SEQ ID NO: 3372133 - protein, 20 aa, Plasmodium falciparum
SLDIYEIICIRIGDTGEDGY

SEQ ID NO: 3372134 - protein, 18 aa, Plasmodium falciparum
SLDQIGLYEMKVCCEKTN

SEQ ID NO: 3372135 - protein, 25 aa, Plasmodium falciparum
SLDSGFRRRFEKRIYIPLPNIYARA

SEQ ID NO: 3372136 - protein, 22 aa, Plasmodium falciparum
SLDSICLITYSFLKCGKNKELQ

SEQ ID NO: 3372137 - protein, 19 aa, Plasmodium falciparum
SLDVDHMYLCKSHFYVSLK

SEQ ID NO: 3372138 - protein, 18 aa, Plasmodium falciparum
SLEHAFKQSYNQLKDQNE

SEQ ID NO: 3372139 - protein, 20 aa, Plasmodium falciparum
SLELLIYFLEHFNKYKKECT

SEQ ID NO: 3372140 - protein, 25 aa, Plasmodium falciparum
SLESIEILTKVGLFSHNILNVHKFF

SEQ ID NO: 3372141 - protein, 18 aa, Plasmodium falciparum
SLEVCKIALITETCLADC

SEQ ID NO: 3372142 - protein, 24 aa, Plasmodium falciparum
SLEYIRKLFYSIIIYNVDQFFLFF

SEQ ID NO: 3372143 - protein, 19 aa, Plasmodium falciparum
SLEYKQLYLDYFLNEKKQD

SEQ ID NO: 3372144 - protein, 20 aa, Plasmodium falciparum
SLFAAPKFHPYFMMKNYTVH

SEQ ID NO: 3372145 - protein, 25 aa, Plasmodium falciparum
SLFISRIQMVLGLQMYIGDNSIHSE

SEQ ID NO: 3372146 - protein, 23 aa, Plasmodium falciparum
SLFKLKFKWPKDSIFPTYNIFLF

SEQ ID NO: 3372147 - protein, 19 aa, Plasmodium falciparum
SLFLKEFVQNTAWAHIDIA

SEQ ID NO: 3372148 - protein, 23 aa, Plasmodium falciparum
SLFSHLFACIAILSFKNDTIIQL

SEQ ID NO: 3372149 - protein, 37 aa, Plasmodium falciparum
SLFTEHCIFNLFKLVLLRVSLYIGVFNTKVITLDLDK

SEQ ID NO: 3372150 - protein, 25 aa, Plasmodium falciparum
SLFVIKRPDLFGSIYEEINQHSTIE

SEQ ID NO: 3372151 - protein, 32 aa, Plasmodium falciparum
SLFWSGRSKLYRWVEGEWKERGLGESKLLLHK

SEQ ID NO: 3372152 - protein, 18 aa, Plasmodium falciparum
SLGYRLLNSITLLGQLFQ

SEQ ID NO: 3372153 - protein, 20 aa, Plasmodium falciparum
SLHELIKYFQIFDNENKGYM

SEQ ID NO: 3372154 - protein, 22 aa, Plasmodium falciparum
SLHKIDALAAWEDFYEKYHNVE

SEQ ID NO: 3372155 - protein, 20 aa, Plasmodium falciparum
SLHKIFNCRHSVPSKFIEDE

SEQ ID NO: 3372156 - protein, 18 aa, Plasmodium falciparum
SLICYSYSKLLIKSEMLF

SEQ ID NO: 3372157 - protein, 19 aa, Plasmodium falciparum
SLIFNSVRLFTKYSNLDKN

SEQ ID NO: 3372158 - protein, 20 aa, Plasmodium falciparum
SLIFPDMRIKGNINIVTESS

SEQ ID NO: 3372159 - protein, 26 aa, Plasmodium falciparum
SLIKESLEYGELLLSNVKEEDENNRR

SEQ ID NO: 3372160 - protein, 21 aa, Plasmodium falciparum
SLIKNHWDIFIGKKENMFEGY

SEQ ID NO: 3372161 - protein, 24 aa, Plasmodium falciparum
SLINEECILYEGFIININEHDMKE

SEQ ID NO: 3372162 - protein, 19 aa, Plasmodium falciparum
SLIPRYPIDWRNGGRFLLC

SEQ ID NO: 3372163 - protein, 18 aa, Plasmodium falciparum
SLIQKLCHNLELPPVDKN

SEQ ID NO: 3372164 - protein, 27 aa, Plasmodium falciparum
SLIYKMFNKSIKFLFVEINHIKKFTQN

SEQ ID NO: 3372165 - protein, 27 aa, Plasmodium falciparum
SLKEEKDILCKFFVYIFPFIIKKLDIK

SEQ ID NO: 3372166 - protein, 18 aa, Plasmodium falciparum
SLKEKENEINLLSKLQDC

SEQ ID NO: 3372167 - protein, 24 aa, Plasmodium falciparum
SLKGIKLAMCKSMNESLQVPLFHL

SEQ ID NO: 3372168 - protein, 25 aa, Plasmodium falciparum
SLKGRERDSLKGKERDSFRGKERDS

SEQ ID NO: 3372169 - protein, 23 aa, Plasmodium falciparum
SLKIFKKINEEWELISNVDNAHM

SEQ ID NO: 3372170 - protein, 30 aa, Plasmodium falciparum
SLKINDWGLSILIPCILRSRKLTTLNLSNN

SEQ ID NO: 3372171 - protein, 32 aa, Plasmodium falciparum
SLKKAFFFFKRLKNILKRFGISMKPSGNIQNI

SEQ ID NO: 3372172 - protein, 25 aa, Plasmodium falciparum
SLKKKEYMKAFILSLALNNYENILE

SEQ ID NO: 3372173 - protein, 19 aa, Plasmodium falciparum
SLKKNELFNQKNDKINILS

SEQ ID NO: 3372174 - protein, 21 aa, Plasmodium falciparum
SLKLSMYNYKIFKKDTTFNST

SEQ ID NO: 3372175 - protein, 26 aa, Plasmodium falciparum
SLKLWSKIMNEWNCIQTLNEHTSVVW

SEQ ID NO: 3372176 - protein, 21 aa, Plasmodium falciparum
SLKNFVFKDDALILKEKDEII

SEQ ID NO: 3372177 - protein, 21 aa, Plasmodium falciparum
SLKNNKLLPVHNYNNISDQNS

SEQ ID NO: 3372178 - protein, 23 aa, Plasmodium falciparum
SLKPYPECAFVHYVSNVEEDEKT

SEQ ID NO: 3372179 - protein, 24 aa, Plasmodium falciparum
SLKRPPMYPTKFFGCELGTMVKFE

SEQ ID NO: 3372180 - protein, 21 aa, Plasmodium falciparum
SLKSLTCYYISSSSNSSFSSY

SEQ ID NO: 3372181 - protein, 28 aa, Plasmodium falciparum
SLKSTIIASAIFKLNLFKYINNSKQTYI

SEQ ID NO: 3372182 - protein, 19 aa, Plasmodium falciparum
SLKTINILYNKERMNNHQE

SEQ ID NO: 3372183 - protein, 23 aa, Plasmodium falciparum
SLLDAMCDAGLKDMKMSPELCVL

SEQ ID NO: 3372184 - protein, 20 aa, Plasmodium falciparum
SLLELFTIINEKKCRNIKVL

SEQ ID NO: 3372185 - protein, 22 aa, Plasmodium falciparum
SLLESLVGLSFMPKGEDIVTRT

SEQ ID NO: 3372186 - protein, 18 aa, Plasmodium falciparum
SLLFKVLCDSIDIPCRYI

SEQ ID NO: 3372187 - protein, 19 aa, Plasmodium falciparum
SLLIECISNIILLEKYPQC

SEQ ID NO: 3372188 - protein, 23 aa, Plasmodium falciparum
SLLKDKHCDWGLRSIKSVLTKAG

SEQ ID NO: 3372189 - protein, 20 aa, Plasmodium falciparum
SLLKELKKEGLISIEEAEGN

SEQ ID NO: 3372190 - protein, 23 aa, Plasmodium falciparum
SLLKYDYMCQLSFLQSSILQKLT

SEQ ID NO: 3372191 - protein, 21 aa, Plasmodium falciparum
SLLLKELAHRGTQFIITTFRK

SEQ ID NO: 3372192 - protein, 26 aa, Plasmodium falciparum
SLLNTCLFVNNFLKITILGVHSYITV

SEQ ID NO: 3372193 - protein, 22 aa, Plasmodium falciparum
SLLSCFLLKQFQGISSGNTNTS

SEQ ID NO: 3372194 - protein, 17 aa, Plasmodium falciparum
SLLSNKLLVIFKDMNEQ

SEQ ID NO: 3372195 - protein, 20 aa, Plasmodium falciparum
SLLSNRSSCFIKMKKIISSL

SEQ ID NO: 3372196 - protein, 17 aa, Plasmodium falciparum
SLLSRLDDMLEMLRNVI

SEQ ID NO: 3372197 - protein, 19 aa, Plasmodium falciparum
SLLSYLAYYFNIWGPHLVI

SEQ ID NO: 3372198 - protein, 21 aa, Plasmodium falciparum
SLLTKYPHVFVYVTYSNQGHT

SEQ ID NO: 3372199 - protein, 20 aa, Plasmodium falciparum
SLLTRLYGIHSIKYQNNLGR

SEQ ID NO: 3372200 - protein, 18 aa, Plasmodium falciparum
SLMNIKINTSPIFNDHLK

SEQ ID NO: 3372201 - protein, 18 aa, Plasmodium falciparum
SLNCKNNSNIVIENTMKG

SEQ ID NO: 3372202 - protein, 19 aa, Plasmodium falciparum
SLNHCAAHYTPNYGDETVL

SEQ ID NO: 3372203 - protein, 23 aa, Plasmodium falciparum
SLNIKQFVCVFKIQLRYFDIARI

SEQ ID NO: 3372204 - protein, 25 aa, Plasmodium falciparum
SLNISTCKIFFKYRFSKSEQEDHLF

SEQ ID NO: 3372205 - protein, 23 aa, Plasmodium falciparum
SLNLPDKLKVVIYTDNYVNKNDI

SEQ ID NO: 3372206 - protein, 25 aa, Plasmodium falciparum
SLNPLFKSKMKIEKKNPPILIKTNN

SEQ ID NO: 3372207 - protein, 18 aa, Plasmodium falciparum
SLNRETHQSFKRHDSFNH

SEQ ID NO: 3372208 - protein, 19 aa, Plasmodium falciparum
SLNRNGSILSNLNFLNTNN

SEQ ID NO: 3372209 - protein, 24 aa, Plasmodium falciparum
SLNSCIYAKVLRLSWLDNKTGKEI

SEQ ID NO: 3372210 - protein, 18 aa, Plasmodium falciparum
SLNYENKMVYGLIENVVI

SEQ ID NO: 3372211 - protein, 24 aa, Plasmodium falciparum
SLNYEYFSLILFGGYGGYDRSSYN

SEQ ID NO: 3372212 - protein, 18 aa, Plasmodium falciparum
SLNYEYWNELQILDLTIL

SEQ ID NO: 3372213 - protein, 18 aa, Plasmodium falciparum
SLNYTVKILPYFYNISYN

SEQ ID NO: 3372214 - protein, 27 aa, Plasmodium falciparum
SLPHLKKLIILDTFINPSICNRKGGKS

SEQ ID NO: 3372215 - protein, 20 aa, Plasmodium falciparum
SLPIPEEYIHHYSRKQKMNK

SEQ ID NO: 3372216 - protein, 17 aa, Plasmodium falciparum
SLPIYKSKHELLDAVYN

SEQ ID NO: 3372217 - protein, 34 aa, Plasmodium falciparum
SLPLNELKTIIKFCSDLNLLCLFSTKNFKENLII

SEQ ID NO: 3372218 - protein, 19 aa, Plasmodium falciparum
SLPPRKKIKNIKKEDNHID

SEQ ID NO: 3372219 - protein, 19 aa, Plasmodium falciparum
SLQGWKEIEYELLRDNKNN

SEQ ID NO: 3372220 - protein, 20 aa, Plasmodium falciparum
SLQHNIGFSHFISVGSMCDV

SEQ ID NO: 3372221 - protein, 20 aa, Plasmodium falciparum
SLQVGRSVVHFKMDEEIPFK

SEQ ID NO: 3372222 - protein, 28 aa, Plasmodium falciparum
SLRGKNIFSLKYAESFNFNSIHKNIDKH

SEQ ID NO: 3372223 - protein, 21 aa, Plasmodium falciparum
SLRKSIEYIYILKIQDMLNSI

SEQ ID NO: 3372224 - protein, 25 aa, Plasmodium falciparum
SLRLRKLAELCLGIRACDHSVEEEG

SEQ ID NO: 3372225 - protein, 23 aa, Plasmodium falciparum
SLRNICKYGKITCKNNKRSIRSG

SEQ ID NO: 3372226 - protein, 19 aa, Plasmodium falciparum
SLRYALHLITLANLVSKKR

SEQ ID NO: 3372227 - protein, 18 aa, Plasmodium falciparum
SLSIPVAGINSYYAPGVN

SEQ ID NO: 3372228 - protein, 20 aa, Plasmodium falciparum
SLSKEPVCVAELKDHSSAVW

SEQ ID NO: 3372229 - protein, 17 aa, Plasmodium falciparum
SLSKVMSMIPGFGNNLI

SEQ ID NO: 3372230 - protein, 18 aa, Plasmodium falciparum
SLSLFAWTHIYFDIKEII

SEQ ID NO: 3372231 - protein, 19 aa, Plasmodium falciparum
SLSLHINYDLSFIALQKYL

SEQ ID NO: 3372232 - protein, 27 aa, Plasmodium falciparum
SLSNFLYRDVIFLYKVNKIILINNYEF

SEQ ID NO: 3372233 - protein, 30 aa, Plasmodium falciparum
SLSPNRGKTTASMGIHFAAIKGNKEITKLL

SEQ ID NO: 3372234 - protein, 25 aa, Plasmodium falciparum
SLSQEYPLRIPIIGDDGNSKGFLIM

SEQ ID NO: 3372235 - protein, 17 aa, Plasmodium falciparum
SLSSFIIRVNKKKEEEK

SEQ ID NO: 3372236 - protein, 25 aa, Plasmodium falciparum
SLTFIPKIFTFSTFFFQSLNFNGSY

SEQ ID NO: 3372237 - protein, 18 aa, Plasmodium falciparum
SLTYEIQTILNLTQETQN

SEQ ID NO: 3372238 - protein, 20 aa, Plasmodium falciparum
SLVCSNYFKNIGFLKDYRRL

SEQ ID NO: 3372239 - protein, 28 aa, Plasmodium falciparum
SLVDMIEYFCNFLIKYFYNDINMDSINI

SEQ ID NO: 3372240 - protein, 26 aa, Plasmodium falciparum
SLVHACLECGFKLVIKYINSSHLSLK

SEQ ID NO: 3372241 - protein, 17 aa, Plasmodium falciparum
SLVKKGANIFMKTICNN

SEQ ID NO: 3372242 - protein, 19 aa, Plasmodium falciparum
SLVYLCTLIDILKEHNKYY

SEQ ID NO: 3372243 - protein, 22 aa, Plasmodium falciparum
SLWIGNIPFDITENELYEILCK

SEQ ID NO: 3372244 - protein, 20 aa, Plasmodium falciparum
SLWKLPWNSIKKDSFYFKGR

SEQ ID NO: 3372245 - protein, 23 aa, Plasmodium falciparum
SLYCLWSNDLFISFEMYEQIKKF

SEQ ID NO: 3372246 - protein, 21 aa, Plasmodium falciparum
SLYDIKYLLLNLNIKQLSRTF

SEQ ID NO: 3372247 - protein, 24 aa, Plasmodium falciparum
SLYEKKLYSHFAMINPKPDNLSKE

SEQ ID NO: 3372248 - protein, 24 aa, Plasmodium falciparum
SLYEYIRLYLSKCNREKVQFCILQ

SEQ ID NO: 3372249 - protein, 22 aa, Plasmodium falciparum
SLYFDLCEIWLIQGNYRAILLL

SEQ ID NO: 3372250 - protein, 24 aa, Plasmodium falciparum
SLYIKECLLIIDILYILNNTYGNL

SEQ ID NO: 3372251 - protein, 20 aa, Plasmodium falciparum
SLYILKNIFLKDLYKQQKIY

SEQ ID NO: 3372252 - protein, 23 aa, Plasmodium falciparum
SLYKCKMLKISALGRMCKLVKKL

SEQ ID NO: 3372253 - protein, 19 aa, Plasmodium falciparum
SLYLSSLFNILTLQINENH

SEQ ID NO: 3372254 - protein, 19 aa, Plasmodium falciparum
SLYNYDWSSNDSFFKKNNE

SEQ ID NO: 3372255 - protein, 17 aa, Plasmodium falciparum
SLYNYSIKIYRRGKYTK

SEQ ID NO: 3372256 - protein, 28 aa, Plasmodium falciparum
SMAGIPRGFLIRRLCNLVFDNISHFHHT

SEQ ID NO: 3372257 - protein, 19 aa, Plasmodium falciparum
SMAKNCKKKNVLFFNPKII

SEQ ID NO: 3372258 - protein, 18 aa, Plasmodium falciparum
SMCMRKDEKVILKLYQDR

SEQ ID NO: 3372259 - protein, 26 aa, Plasmodium falciparum
SMELLDISQQCWRMCTPMSTKKAYFG

SEQ ID NO: 3372260 - protein, 21 aa, Plasmodium falciparum
SMGHMNSFFTSSCILETLNNY

SEQ ID NO: 3372261 - protein, 19 aa, Plasmodium falciparum
SMHECPKKVQIIARPMHDQ

SEQ ID NO: 3372262 - protein, 20 aa, Plasmodium falciparum
SMHYLFPFILLDTYDKNDCV

SEQ ID NO: 3372263 - protein, 34 aa, Plasmodium falciparum
SMKDCGHLKKWYISKKRYKVLTELALKDEIKLEN

SEQ ID NO: 3372264 - protein, 23 aa, Plasmodium falciparum
SMKEEVYLAVSRAIGDKDFKFNN

SEQ ID NO: 3372265 - protein, 25 aa, Plasmodium falciparum
SMKPGCASLPFLGVQLEILDSKTLQ

SEQ ID NO: 3372266 - protein, 18 aa, Plasmodium falciparum
SMKPSGNIQNIFKAIIAS

SEQ ID NO: 3372267 - protein, 19 aa, Plasmodium falciparum
SMLLSDYKLYSWGKYNSSC

SEQ ID NO: 3372268 - protein, 19 aa, Plasmodium falciparum
SMMAPKLNQMFVKNKNEDD

SEQ ID NO: 3372269 - protein, 29 aa, Plasmodium falciparum
SMMKSQRNIWTFLFTKIFHSPLFNFTSKI

SEQ ID NO: 3372270 - protein, 25 aa, Plasmodium falciparum
SMMNRFRNLGGFNMLWSGRGKVKNK

SEQ ID NO: 3372271 - protein, 25 aa, Plasmodium falciparum
SMMSIPYEFARFMITQLDYSTLHEI

SEQ ID NO: 3372272 - protein, 24 aa, Plasmodium falciparum
SMNEYSNIFLLKYDSIKYVKKNIN

SEQ ID NO: 3372273 - protein, 24 aa, Plasmodium falciparum
SMNYENINILLLILYTERDYYMHC

SEQ ID NO: 3372274 - protein, 26 aa, Plasmodium falciparum
SMSGSLKTYNSYNFKNMTSINNRDNN

SEQ ID NO: 3372275 - protein, 19 aa, Plasmodium falciparum
SMTNIMLNKNINNFINNNR

SEQ ID NO: 3372276 - protein, 19 aa, Plasmodium falciparum
SMVDKIIRLRRSVKNEEEK

SEQ ID NO: 3372277 - protein, 22 aa, Plasmodium falciparum
SMYFKKKIGIYSIYKKNKKKCK

SEQ ID NO: 3372278 - protein, 17 aa, Plasmodium falciparum
SMYSEFKNILIEINNII

SEQ ID NO: 3372279 - protein, 30 aa, Plasmodium falciparum
SNADKFMLGVFFFWIWTNGNLWKCSDPLQD

SEQ ID NO: 3372280 - protein, 17 aa, Plasmodium falciparum
SNALDEACLELSEEVEN

SEQ ID NO: 3372281 - protein, 19 aa, Plasmodium falciparum
SNAPSNVYSECMLNKSDEE

SEQ ID NO: 3372282 - protein, 19 aa, Plasmodium falciparum
SNCLLDICNWDMEKKTNEY

SEQ ID NO: 3372283 - protein, 19 aa, Plasmodium falciparum
SNDCKVCSKKYNKVKEQKE

SEQ ID NO: 3372284 - protein, 19 aa, Plasmodium falciparum
SNDNIFRISDYIRDNLTSY

SEQ ID NO: 3372285 - protein, 18 aa, Plasmodium falciparum
SNEAMQLINIESFNKLYN

SEQ ID NO: 3372286 - protein, 19 aa, Plasmodium falciparum
SNECNLTYCKYRHHDEHDD

SEQ ID NO: 3372287 - protein, 29 aa, Plasmodium falciparum
SNEEKLEMLKRIIINWVNKKHNEFLENLN

SEQ ID NO: 3372288 - protein, 31 aa, Plasmodium falciparum
SNEKALFEKFLKSFISLFFQDECIDQFLNYY

SEQ ID NO: 3372289 - protein, 26 aa, Plasmodium falciparum
SNEKEAINAIYFIDGMTLDNKILKAS

SEQ ID NO: 3372290 - protein, 18 aa, Plasmodium falciparum
SNEKSCNLYTAKSNTVMF

SEQ ID NO: 3372291 - protein, 29 aa, Plasmodium falciparum
SNEKTILCRKNCKNFILNKRINLEHYNSK

SEQ ID NO: 3372292 - protein, 18 aa, Plasmodium falciparum
SNELKKRYNHVIDKKVEL

SEQ ID NO: 3372293 - protein, 19 aa, Plasmodium falciparum
SNENFCFYILNKTKLLYNE

SEQ ID NO: 3372294 - protein, 20 aa, Plasmodium falciparum
SNENYEGFDFCSEKKKFTIK

SEQ ID NO: 3372295 - protein, 30 aa, Plasmodium falciparum
SNEQLKRFVYRMYLNFTKEPINVFNGDNIY

SEQ ID NO: 3372296 - protein, 23 aa, Plasmodium falciparum
SNERFFFLFILPDFMAFEDLPDY

SEQ ID NO: 3372297 - protein, 25 aa, Plasmodium falciparum
SNETEVFYYAKLMFPYLKDEIKENI

SEQ ID NO: 3372298 - protein, 18 aa, Plasmodium falciparum
SNEYKNKKNRSMVTVETF

SEQ ID NO: 3372299 - protein, 29 aa, Plasmodium falciparum
SNEYKNPCILEKIMEIFQIDVYSSNYPLH

SEQ ID NO: 3372300 - protein, 21 aa, Plasmodium falciparum
SNFDFSEYIMCDWEIENKFDT

SEQ ID NO: 3372301 - protein, 24 aa, Plasmodium falciparum
SNFFFFSSMLLHYCKSSSIHKSTY

SEQ ID NO: 3372302 - protein, 39 aa, Plasmodium falciparum
SNFGRCDSLIILKDRRSKSRGSGFVTFYNRDEAVNAIKC

SEQ ID NO: 3372303 - protein, 22 aa, Plasmodium falciparum
SNFKVYLYTSSLLKINILSHLC

SEQ ID NO: 3372304 - protein, 22 aa, Plasmodium falciparum
SNFNVYCSDEFLKIHNIEKNDN

SEQ ID NO: 3372305 - protein, 31 aa, Plasmodium falciparum
SNFQKLLVHFRGRLFIGCHINYSYFKIKTFL

SEQ ID NO: 3372306 - protein, 23 aa, Plasmodium falciparum
SNFRAHLLLSVIFFNEGNINIAN

SEQ ID NO: 3372307 - protein, 19 aa, Plasmodium falciparum
SNGECTFIKLIIGGKDDLT

SEQ ID NO: 3372308 - protein, 22 aa, Plasmodium falciparum
SNGGLSSFARCNSLEEKNAYLM

SEQ ID NO: 3372309 - protein, 25 aa, Plasmodium falciparum
SNGIIYKLRFNEHIGGDMFKISSHS

SEQ ID NO: 3372310 - protein, 23 aa, Plasmodium falciparum
SNGKLKWSVLHTEKFWLENVMQF

SEQ ID NO: 3372311 - protein, 27 aa, Plasmodium falciparum
SNHINLKYKNLFYNNSQPCVKNDFTNS

SEQ ID NO: 3372312 - protein, 19 aa, Plasmodium falciparum
SNHNCILKTCSLHKNNVTE

SEQ ID NO: 3372313 - protein, 17 aa, Plasmodium falciparum
SNICLVLLMSGFITQEI

SEQ ID NO: 3372314 - protein, 32 aa, Plasmodium falciparum
SNICTSPCSEFFKYFRLDDEIFQDNKTKNNVD

SEQ ID NO: 3372315 - protein, 28 aa, Plasmodium falciparum
SNIEIAREILYLGIYIRKIQKFIEINKR

SEQ ID NO: 3372316 - protein, 20 aa, Plasmodium falciparum
SNIESINSMTSIKSVDGENR

SEQ ID NO: 3372317 - protein, 25 aa, Plasmodium falciparum
SNIFKELRFILNFMVDTNSIILCCN

SEQ ID NO: 3372318 - protein, 24 aa, Plasmodium falciparum
SNIFLRFIPDKCLVISQVSNSDSY

SEQ ID NO: 3372319 - protein, 24 aa, Plasmodium falciparum
SNIGDYFYDISMVHLKNNCESSPS

SEQ ID NO: 3372320 - protein, 25 aa, Plasmodium falciparum
SNIGRSISLTSSFDMCEKKYNNSKD

SEQ ID NO: 3372321 - protein, 20 aa, Plasmodium falciparum
SNIHHISKLIIYYPNETAKN

SEQ ID NO: 3372322 - protein, 24 aa, Plasmodium falciparum
SNIIDAMLFVFGRRAKKIRQNKLS

SEQ ID NO: 3372323 - protein, 19 aa, Plasmodium falciparum
SNIKCDISLNTKTEQNDEV

SEQ ID NO: 3372324 - protein, 21 aa, Plasmodium falciparum
SNIKCIVCQDMNIAAQKSVAM

SEQ ID NO: 3372325 - protein, 18 aa, Plasmodium falciparum
SNIKNTLIRDDMKKFRKP

SEQ ID NO: 3372326 - protein, 19 aa, Plasmodium falciparum
SNILFLRTILIMSLMEFLF

SEQ ID NO: 3372327 - protein, 28 aa, Plasmodium falciparum
SNILTLEICKGLILSGVRNLIIIDDGLV

SEQ ID NO: 3372328 - protein, 22 aa, Plasmodium falciparum
SNINCNFMRIVVSAIVDKYIGE

SEQ ID NO: 3372329 - protein, 19 aa, Plasmodium falciparum
SNINKCFLDSLNINELKYL

SEQ ID NO: 3372330 - protein, 22 aa, Plasmodium falciparum
SNINMYNKFFVNENNLYSVDEK

SEQ ID NO: 3372331 - protein, 18 aa, Plasmodium falciparum
SNINYFYFYILNQIDLCN

SEQ ID NO: 3372332 - protein, 19 aa, Plasmodium falciparum
SNIPSGCAMQNDEDNMVLL

SEQ ID NO: 3372333 - protein, 21 aa, Plasmodium falciparum
SNIQCRICLIEGNQENDPLIC

SEQ ID NO: 3372334 - protein, 24 aa, Plasmodium falciparum
SNIQLRDTINLHLDNGFVVNIDRQ

SEQ ID NO: 3372335 - protein, 28 aa, Plasmodium falciparum
SNIRPFKWRASRVLEPYPFLLYKKSGEP

SEQ ID NO: 3372336 - protein, 24 aa, Plasmodium falciparum
SNITLRKSKFVDILEKTKNQITLH

SEQ ID NO: 3372337 - protein, 25 aa, Plasmodium falciparum
SNKAECSKVILVSVINLHYPVDIEL

SEQ ID NO: 3372338 - protein, 20 aa, Plasmodium falciparum
SNKEILKIVDLIMAEKSIKR

SEQ ID NO: 3372339 - protein, 23 aa, Plasmodium falciparum
SNKHKRNTISYVRREKKYIYDKN

SEQ ID NO: 3372340 - protein, 24 aa, Plasmodium falciparum
SNKICKACLIIDGLNNYTDNSFLY

SEQ ID NO: 3372341 - protein, 23 aa, Plasmodium falciparum
SNKIIKRKKNKIIYYNTTHNNRA

SEQ ID NO: 3372342 - protein, 29 aa, Plasmodium falciparum
SNKIKPLCICCFDILLNLIGINTIICISC

SEQ ID NO: 3372343 - protein, 17 aa, Plasmodium falciparum
SNKKFSFNNIENICNTH

SEQ ID NO: 3372344 - protein, 21 aa, Plasmodium falciparum
SNKKLGIGFLNDPRRLNVALT

SEQ ID NO: 3372345 - protein, 20 aa, Plasmodium falciparum
SNKKNCHMYENIIPIESNQQ

SEQ ID NO: 3372346 - protein, 23 aa, Plasmodium falciparum
SNKKRWLVNFLENLFHISSKIKE

SEQ ID NO: 3372347 - protein, 17 aa, Plasmodium falciparum
SNKKVCTNMDICNENMD

SEQ ID NO: 3372348 - protein, 21 aa, Plasmodium falciparum
SNKLCKKHVNIFLSLLNDKDH

SEQ ID NO: 3372349 - protein, 17 aa, Plasmodium falciparum
SNKLFTILFTILNVGNT

SEQ ID NO: 3372350 - protein, 45 aa, Plasmodium falciparum
SNKMKLCAGICIFKKSGYCCIRLSLPLLKLRKIKEYRETLLHEMI

SEQ ID NO: 3372351 - protein, 17 aa, Plasmodium falciparum
SNKNCFHLDPVFYTLTT

SEQ ID NO: 3372352 - protein, 22 aa, Plasmodium falciparum
SNKNFYNFHLLFKKDEKLKKEF

SEQ ID NO: 3372353 - protein, 24 aa, Plasmodium falciparum
SNKSEKLLNEKIVPIKNNNEEKAI

SEQ ID NO: 3372354 - protein, 20 aa, Plasmodium falciparum
SNKVIECLQKSIKNAEIAIQ

SEQ ID NO: 3372355 - protein, 28 aa, Plasmodium falciparum
SNKYRRFYRFLLYDGKSFIYAYEQEYNE

SEQ ID NO: 3372356 - protein, 25 aa, Plasmodium falciparum
SNLASGHAHFNRYNNFNYHDKYFNK

SEQ ID NO: 3372357 - protein, 19 aa, Plasmodium falciparum
SNLCLLKNDSISTCCDNIN

SEQ ID NO: 3372358 - protein, 22 aa, Plasmodium falciparum
SNLCSGIEVINNMNIKMVVDKI

SEQ ID NO: 3372359 - protein, 25 aa, Plasmodium falciparum
SNLFGKVGNIVRMFLAKHKETQNSK

SEQ ID NO: 3372360 - protein, 20 aa, Plasmodium falciparum
SNLIKKCIDQNIDVYDVLGV

SEQ ID NO: 3372361 - protein, 27 aa, Plasmodium falciparum
SNLKRKNEGFLIRSFKRIKHKIKGDDD

SEQ ID NO: 3372362 - protein, 19 aa, Plasmodium falciparum
SNLKTFIDHLNFFQSKCKA

SEQ ID NO: 3372363 - protein, 24 aa, Plasmodium falciparum
SNLLHSYIVLGFDKIHFKSINRMI

SEQ ID NO: 3372364 - protein, 24 aa, Plasmodium falciparum
SNLMKKFEICANFNNEGYITSIDL

SEQ ID NO: 3372365 - protein, 24 aa, Plasmodium falciparum
SNLNFLKNKMMDLNVNEFNNRTMY

SEQ ID NO: 3372366 - protein, 23 aa, Plasmodium falciparum
SNLSYYKKCCYLKDSIDKLKTIY

SEQ ID NO: 3372367 - protein, 17 aa, Plasmodium falciparum
SNLTCRKKGIDFIPKSI

SEQ ID NO: 3372368 - protein, 28 aa, Plasmodium falciparum
SNLTPDHMITLWKTFSIYVEKYYHILKE

SEQ ID NO: 3372369 - protein, 23 aa, Plasmodium falciparum
SNLVFSFMYYFHMKKLHYDNIKS

SEQ ID NO: 3372370 - protein, 25 aa, Plasmodium falciparum
SNLYPCHICKLDLLHILKKYHLNCN

SEQ ID NO: 3372371 - protein, 22 aa, Plasmodium falciparum
SNLYYCSYCGLSDYCNCGERTL

SEQ ID NO: 3372372 - protein, 18 aa, Plasmodium falciparum
SNMGCTMKIINKGEKNDI

SEQ ID NO: 3372373 - protein, 19 aa, Plasmodium falciparum
SNMKKENKSKMYVDQNERI

SEQ ID NO: 3372374 - protein, 21 aa, Plasmodium falciparum
SNMKNDWCNSNHKPEEMNLND

SEQ ID NO: 3372375 - protein, 19 aa, Plasmodium falciparum
SNMLYACSVLYKSRLPFLA

SEQ ID NO: 3372376 - protein, 18 aa, Plasmodium falciparum
SNMMKLNKYMTCNDKNIG

SEQ ID NO: 3372377 - protein, 19 aa, Plasmodium falciparum
SNMNGKFSKFIEAITNISK

SEQ ID NO: 3372378 - protein, 24 aa, Plasmodium falciparum
SNMNVEIYKGLILSYKNMFPYNLI

SEQ ID NO: 3372379 - protein, 25 aa, Plasmodium falciparum
SNMTNRVITLWYRPPELLLGSENYM

SEQ ID NO: 3372380 - protein, 17 aa, Plasmodium falciparum
SNNEKNCNVGMLNLTFP

SEQ ID NO: 3372381 - protein, 18 aa, Plasmodium falciparum
SNNFIKANHVERIKITHI

SEQ ID NO: 3372382 - protein, 22 aa, Plasmodium falciparum
SNNFPVCRSFSAEYHGFETAKQ

SEQ ID NO: 3372383 - protein, 22 aa, Plasmodium falciparum
SNNGICFPNHYNMNVIKKNNIE

SEQ ID NO: 3372384 - protein, 19 aa, Plasmodium falciparum
SNNINRCISNYIKYNVDNS

SEQ ID NO: 3372385 - protein, 26 aa, Plasmodium falciparum
SNNKCFDCGISNPDWVSVNHGIFLCI

SEQ ID NO: 3372386 - protein, 22 aa, Plasmodium falciparum
SNNKKFIGKCVYRNCSSFIRII

SEQ ID NO: 3372387 - protein, 22 aa, Plasmodium falciparum
SNNLDYCINKYDIIIEDPDMNC

SEQ ID NO: 3372388 - protein, 21 aa, Plasmodium falciparum
SNNLKCILQLLKYELDKEKKA

SEQ ID NO: 3372389 - protein, 31 aa, Plasmodium falciparum
SNNLRNGFTSIWFPLIYLKPVEEENKRDAEL

SEQ ID NO: 3372390 - protein, 24 aa, Plasmodium falciparum
SNNNCPSKEYIKNKIYFSKLRMGL

SEQ ID NO: 3372391 - protein, 19 aa, Plasmodium falciparum
SNNNILCPLIKINTDKNEY

SEQ ID NO: 3372392 - protein, 21 aa, Plasmodium falciparum
SNNNMKSSVFISNKNNINNNN

SEQ ID NO: 3372393 - protein, 22 aa, Plasmodium falciparum
SNNQKFLYFAVPLMSQDKSCDY

SEQ ID NO: 3372394 - protein, 20 aa, Plasmodium falciparum
SNNTLKYAFRARNIKLCATV

SEQ ID NO: 3372395 - protein, 17 aa, Plasmodium falciparum
SNNTRLQSQVQFVESQV

SEQ ID NO: 3372396 - protein, 24 aa, Plasmodium falciparum
SNPLKFNNMSGIYRNDSLLYVNSN

SEQ ID NO: 3372397 - protein, 18 aa, Plasmodium falciparum
SNPLKSIKKYSCTNTKNY

SEQ ID NO: 3372398 - protein, 18 aa, Plasmodium falciparum
SNQCKIESSLPLLVNADA

SEQ ID NO: 3372399 - protein, 18 aa, Plasmodium falciparum
SNQRCKITYGTYEIIMII

SEQ ID NO: 3372400 - protein, 21 aa, Plasmodium falciparum
SNRGINKILIRSLRKKLKSNL

SEQ ID NO: 3372401 - protein, 25 aa, Plasmodium falciparum
SNRLSRKIIVNELIIIQDYLRQKHD

SEQ ID NO: 3372402 - protein, 17 aa, Plasmodium falciparum
SNSCFFSACSKNKPVSL

SEQ ID NO: 3372403 - protein, 23 aa, Plasmodium falciparum
SNSDIYGDMFLKYSSNVNKSNKD

SEQ ID NO: 3372404 - protein, 17 aa, Plasmodium falciparum
SNSEIRYEGILYTINTH

SEQ ID NO: 3372405 - protein, 21 aa, Plasmodium falciparum
SNSFFGSAFGKTNELNKGSNP

SEQ ID NO: 3372406 - protein, 18 aa, Plasmodium falciparum
SNSFKRKYNILLTEKTDD

SEQ ID NO: 3372407 - protein, 25 aa, Plasmodium falciparum
SNSGGFIWNYMKNIYSSVTSAVKNN

SEQ ID NO: 3372408 - protein, 28 aa, Plasmodium falciparum
SNSKGICYRQRTTECVKENNGITKFFLK

SEQ ID NO: 3372409 - protein, 19 aa, Plasmodium falciparum
SNSKLGELLKLYKNKKKNK

SEQ ID NO: 3372410 - protein, 32 aa, Plasmodium falciparum
SNSLIKFKDFLFYKYECYITEGVIKEIKDENS

SEQ ID NO: 3372411 - protein, 23 aa, Plasmodium falciparum
SNSLKRYLNKTCDNLNVTSRINM

SEQ ID NO: 3372412 - protein, 28 aa, Plasmodium falciparum
SNSLRIFRFYRLGEVFSQNILHLTFTPR

SEQ ID NO: 3372413 - protein, 17 aa, Plasmodium falciparum
SNSRLSNEINSYLYENS

SEQ ID NO: 3372414 - protein, 18 aa, Plasmodium falciparum
SNSWCGFKKRWFVLRNNK

SEQ ID NO: 3372415 - protein, 21 aa, Plasmodium falciparum
SNSYDCFKSNVIFIKAKQFKK

SEQ ID NO: 3372416 - protein, 31 aa, Plasmodium falciparum
SNTCLYDLFCGIGFYSIPLANLFDHVISIDY

SEQ ID NO: 3372417 - protein, 22 aa, Plasmodium falciparum
SNTFIPIFFLNKVGDKFKNSEN

SEQ ID NO: 3372418 - protein, 21 aa, Plasmodium falciparum
SNTIKLIFNKYIHILYIIEKC

SEQ ID NO: 3372419 - protein, 42 aa, Plasmodium falciparum
SNTKNLFDFCLAIKLCRDVFDMSSNMGFNFYIINLGGGYPEE

SEQ ID NO: 3372420 - protein, 24 aa, Plasmodium falciparum
SNTKSCPIKNIIENLSKNNPITYG

SEQ ID NO: 3372421 - protein, 53 aa, Plasmodium falciparum
SNTLDNYLCCFSNIKICAVKSIFLDSIMECIEELEIIKKFKMSKEKEDGIEDK

SEQ ID NO: 3372422 - protein, 21 aa, Plasmodium falciparum
SNTLLHFKEKYTYPTLSTNED

SEQ ID NO: 3372423 - protein, 28 aa, Plasmodium falciparum
SNVELSFDLLIRRFDKILRLTKKYEQLL

SEQ ID NO: 3372424 - protein, 24 aa, Plasmodium falciparum
SNVGLEIFFDYIIQIDDLKLLDSS

SEQ ID NO: 3372425 - protein, 17 aa, Plasmodium falciparum
SNVKEEENVLVLDKSNE

SEQ ID NO: 3372426 - protein, 19 aa, Plasmodium falciparum
SNVKGGILADEMGMGKTIQ

SEQ ID NO: 3372427 - protein, 18 aa, Plasmodium falciparum
SNVPQLNGLVLLCENNKE

SEQ ID NO: 3372428 - protein, 23 aa, Plasmodium falciparum
SNVQCNWKNHIFNVTQNNAHIND

SEQ ID NO: 3372429 - protein, 25 aa, Plasmodium falciparum
SNVRIDYLANILFHLNKDSNEKNDM

SEQ ID NO: 3372430 - protein, 23 aa, Plasmodium falciparum
SNWLEIFKIIKLAKKLSYLNVSD

SEQ ID NO: 3372431 - protein, 20 aa, Plasmodium falciparum
SNWTYLKYYIIFQVEQLEVL

SEQ ID NO: 3372432 - protein, 24 aa, Plasmodium falciparum
SNYEFRLSSILPIKEKDVIFYINK

SEQ ID NO: 3372433 - protein, 23 aa, Plasmodium falciparum
SNYILKMLLNYAHMENFKSNNII

SEQ ID NO: 3372434 - protein, 21 aa, Plasmodium falciparum
SNYKLHCRSDFHVYNVKRKYK

SEQ ID NO: 3372435 - protein, 24 aa, Plasmodium falciparum
SNYKNADSFILPFTDTCSTILHTI

SEQ ID NO: 3372436 - protein, 23 aa, Plasmodium falciparum
SNYSRYNDFFTMFRNNVYNNINN

SEQ ID NO: 3372437 - protein, 17 aa, Plasmodium falciparum
SNYYKYSSKGSFYKDTK

SEQ ID NO: 3372438 - protein, 37 aa, Plasmodium falciparum
SPADGLNWIGCDKCEKWYHWICCKYSVDNPPDIENDW

SEQ ID NO: 3372439 - protein, 18 aa, Plasmodium falciparum
SPAIHVGKNYNCIYSKNE

SEQ ID NO: 3372440 - protein, 33 aa, Plasmodium falciparum
SPDIKKRHNNHFKRLFKAKQMLLNEVDRIKEKK

SEQ ID NO: 3372441 - protein, 19 aa, Plasmodium falciparum
SPDMLCFEKQFKYIYDIYK

SEQ ID NO: 3372442 - protein, 17 aa, Plasmodium falciparum
SPDPSMCSKEFVLFREC

SEQ ID NO: 3372443 - protein, 19 aa, Plasmodium falciparum
SPDTNEWQLGPSLLVPRFG

SEQ ID NO: 3372444 - protein, 20 aa, Plasmodium falciparum
SPEAKILASVLVLQKLEEYE

SEQ ID NO: 3372445 - protein, 29 aa, Plasmodium falciparum
SPFELLRALEFLDAIILNIKFDYTEHKLI

SEQ ID NO: 3372446 - protein, 23 aa, Plasmodium falciparum
SPFFSLCKINFRDDPIIINTNND

SEQ ID NO: 3372447 - protein, 23 aa, Plasmodium falciparum
SPHIPISIKFNFKQQLTDLQDPS

SEQ ID NO: 3372448 - protein, 18 aa, Plasmodium falciparum
SPHITRLLEKIKNRKECH

SEQ ID NO: 3372449 - protein, 26 aa, Plasmodium falciparum
SPHPYHLPNFMNLFTWSLPFVSEKVT

SEQ ID NO: 3372450 - protein, 20 aa, Plasmodium falciparum
SPHYELEYSDGNYVNRKYDE

SEQ ID NO: 3372451 - protein, 23 aa, Plasmodium falciparum
SPIRRYADIMVHRILNHIYQIEE

SEQ ID NO: 3372452 - protein, 18 aa, Plasmodium falciparum
SPISEGWGMTEVGVGFLQ

SEQ ID NO: 3372453 - protein, 22 aa, Plasmodium falciparum
SPITCIKFIPRHSVKTSPAIIV

SEQ ID NO: 3372454 - protein, 19 aa, Plasmodium falciparum
SPLDIYMRLYFKSNNIKNK

SEQ ID NO: 3372455 - protein, 19 aa, Plasmodium falciparum
SPLKSRIGLRNSVDESIKK

SEQ ID NO: 3372456 - protein, 19 aa, Plasmodium falciparum
SPLLIGKQIDGVWHTAVLV

SEQ ID NO: 3372457 - protein, 18 aa, Plasmodium falciparum
SPLLLYFSVLLEYDKLNT

SEQ ID NO: 3372458 - protein, 18 aa, Plasmodium falciparum
SPLNKFGYLQIYIKTHDN

SEQ ID NO: 3372459 - protein, 17 aa, Plasmodium falciparum
SPLSLIKKHGRLINNIE

SEQ ID NO: 3372460 - protein, 17 aa, Plasmodium falciparum
SPLSLPSYIEYKNKNNN

SEQ ID NO: 3372461 - protein, 25 aa, Plasmodium falciparum
SPLSRASVFGKVFFDIAKNSSIEYI

SEQ ID NO: 3372462 - protein, 26 aa, Plasmodium falciparum
SPNIPYTYLFICDGSNYLCINDNSLN

SEQ ID NO: 3372463 - protein, 18 aa, Plasmodium falciparum
SPNQAIIVSCGWDKLVKV

SEQ ID NO: 3372464 - protein, 22 aa, Plasmodium falciparum
SPNVLECIKENDIINAKFKQKK

SEQ ID NO: 3372465 - protein, 23 aa, Plasmodium falciparum
SPNYINGVVFFFKKNEYINSEMF

SEQ ID NO: 3372466 - protein, 18 aa, Plasmodium falciparum
SPPKLRFLSKIYHPNIYS

SEQ ID NO: 3372467 - protein, 18 aa, Plasmodium falciparum
SPPPVFGHVSFKYKNIIF

SEQ ID NO: 3372468 - protein, 19 aa, Plasmodium falciparum
SPPTKKIKIEKRMMMKNIM

SEQ ID NO: 3372469 - protein, 21 aa, Plasmodium falciparum
SPQWSYFIGDIEIKMVKCKKN

SEQ ID NO: 3372470 - protein, 26 aa, Plasmodium falciparum
SPSDIKLILRTGGGFRKLSEHDQKHY

SEQ ID NO: 3372471 - protein, 32 aa, Plasmodium falciparum
SPSLSINPYNFLSCSLPTPPPQLPHTGPLSMT

SEQ ID NO: 3372472 - protein, 21 aa, Plasmodium falciparum
SPVCLINKKLHSFCKTMNTYI

SEQ ID NO: 3372473 - protein, 24 aa, Plasmodium falciparum
SPVTCFKKRSVGLYNEKLSNIYNS

SEQ ID NO: 3372474 - protein, 33 aa, Plasmodium falciparum
SPYFLYACISPNFKYVYCIAEDYNLYCFDYNTS

SEQ ID NO: 3372475 - protein, 26 aa, Plasmodium falciparum
SPYGHIFCKICIINNFLNQKKIYARK

SEQ ID NO: 3372476 - protein, 22 aa, Plasmodium falciparum
SQCPINKYCMIYLKSNKKKQHN

SEQ ID NO: 3372477 - protein, 25 aa, Plasmodium falciparum
SQEFATRYLVMFSRASSLSDEVLIS

SEQ ID NO: 3372478 - protein, 19 aa, Plasmodium falciparum
SQEIYYKFFSSINGLDEVQ

SEQ ID NO: 3372479 - protein, 18 aa, Plasmodium falciparum
SQEVFFLIDKLILFFFNI

SEQ ID NO: 3372480 - protein, 17 aa, Plasmodium falciparum
SQGKIDAIIQFLQKNEK

SEQ ID NO: 3372481 - protein, 25 aa, Plasmodium falciparum
SQGYISNYIYLDFLNCIGGRSRKDF

SEQ ID NO: 3372482 - protein, 23 aa, Plasmodium falciparum
SQIEDWCKSFFSREISNNKEIFK

SEQ ID NO: 3372483 - protein, 25 aa, Plasmodium falciparum
SQIGWKKYRRGVYTFGKTEVILSLV

SEQ ID NO: 3372484 - protein, 18 aa, Plasmodium falciparum
SQIKRGLVKYDNINETKD

SEQ ID NO: 3372485 - protein, 27 aa, Plasmodium falciparum
SQILYPCMQCADIFFLNVDICQLGIDQ

SEQ ID NO: 3372486 - protein, 24 aa, Plasmodium falciparum
SQIYLPYACKLLFQELMTMAIYPK

SEQ ID NO: 3372487 - protein, 18 aa, Plasmodium falciparum
SQKIANRVLNRFPKLSEQ

SEQ ID NO: 3372488 - protein, 24 aa, Plasmodium falciparum
SQKKRIESIMKFKKAEVDFLLTTE

SEQ ID NO: 3372489 - protein, 21 aa, Plasmodium falciparum
SQKYYPNKINIFHKDDEYEKL

SEQ ID NO: 3372490 - protein, 23 aa, Plasmodium falciparum
SQLKFREVQNWNDFTNYTKEDKK

SEQ ID NO: 3372491 - protein, 18 aa, Plasmodium falciparum
SQLNGGSLLEDKNISELY

SEQ ID NO: 3372492 - protein, 20 aa, Plasmodium falciparum
SQLPKNLKIIVIYKNLMKEI

SEQ ID NO: 3372493 - protein, 24 aa, Plasmodium falciparum
SQLSPFELKPVENYINISNSLDEN

SEQ ID NO: 3372494 - protein, 25 aa, Plasmodium falciparum
SQLYMYIKRHFLRILDIFEKKVQLL

SEQ ID NO: 3372495 - protein, 48 aa, Plasmodium falciparum
SQMLEAFIQGRLCLSCDSLDHPMPLCPNNSFVCPNCHNVSHRGNDCPM

SEQ ID NO: 3372496 - protein, 22 aa, Plasmodium falciparum
SQNCNHPGTYIFSPYEALFNVT

SEQ ID NO: 3372497 - protein, 18 aa, Plasmodium falciparum
SQNFLKYLFLQIYKTLIS

SEQ ID NO: 3372498 - protein, 18 aa, Plasmodium falciparum
SQNIIPPIMFPYNNSNDY

SEQ ID NO: 3372499 - protein, 30 aa, Plasmodium falciparum
SQNKICRNSLIGCISCMYEGTKMYCHCHNI

SEQ ID NO: 3372500 - protein, 20 aa, Plasmodium falciparum
SQNSLPHYSVFRPRVKEKMT

SEQ ID NO: 3372501 - protein, 20 aa, Plasmodium falciparum
SQRQKIIWRKWIAKHTIRVR

SEQ ID NO: 3372502 - protein, 20 aa, Plasmodium falciparum
SQSALKRCRSYTILLREKKE

SEQ ID NO: 3372503 - protein, 25 aa, Plasmodium falciparum
SQSDKSDCIRYYKSINKNNEKNFLS

SEQ ID NO: 3372504 - protein, 22 aa, Plasmodium falciparum
SQSKNFSCLSYNKENNSFPIIC

SEQ ID NO: 3372505 - protein, 22 aa, Plasmodium falciparum
SQSLAKMKLKRVVSPEEANEAV

SEQ ID NO: 3372506 - protein, 32 aa, Plasmodium falciparum
SQTLKQSFEMIKNPSLMKELMKNTDRAISNIE

SEQ ID NO: 3372507 - protein, 23 aa, Plasmodium falciparum
SQVRLQCAILIRNIFRVYIKSTH

SEQ ID NO: 3372508 - protein, 18 aa, Plasmodium falciparum
SQYLKSLAYKYISGEDYT

SEQ ID NO: 3372509 - protein, 23 aa, Plasmodium falciparum
SQYSSKWIIKARVQSKDNIRRYT

SEQ ID NO: 3372510 - protein, 17 aa, Plasmodium falciparum
SRAKFLFPYNTPKTKEG

SEQ ID NO: 3372511 - protein, 17 aa, Plasmodium falciparum
SRCNEDFLLRKIKNAEL

SEQ ID NO: 3372512 - protein, 18 aa, Plasmodium falciparum
SRDGATCVIVLIKDEYAY

SEQ ID NO: 3372513 - protein, 23 aa, Plasmodium falciparum
SRDIKRKEIDNIMRKKSYRTSKK

SEQ ID NO: 3372514 - protein, 22 aa, Plasmodium falciparum
SRDIKYKHWIDINKDNYMMIYQ

SEQ ID NO: 3372515 - protein, 24 aa, Plasmodium falciparum
SRDLKLDVCVAIPSTIINNKSDVI

SEQ ID NO: 3372516 - protein, 22 aa, Plasmodium falciparum
SRDNKLNCCNNISSGNDNENKQ

SEQ ID NO: 3372517 - protein, 32 aa, Plasmodium falciparum
SRDNPPYLLTCGHAICKNCVDKIHAQRSRQFK

SEQ ID NO: 3372518 - protein, 24 aa, Plasmodium falciparum
SRDNVFEFWDWVGGRFSVTSSVGI

SEQ ID NO: 3372519 - protein, 18 aa, Plasmodium falciparum
SRDRWGLDRRRSRYKDSR

SEQ ID NO: 3372520 - protein, 21 aa, Plasmodium falciparum
SREAFSWFLKDLRSRIISLVL

SEQ ID NO: 3372521 - protein, 22 aa, Plasmodium falciparum
SREDIQCVFKLCKDKIVKNMNL

SEQ ID NO: 3372522 - protein, 29 aa, Plasmodium falciparum
SRFDIPILESLRWIFKHVAKTHLKKSSKS

SEQ ID NO: 3372523 - protein, 17 aa, Plasmodium falciparum
SRFEHSLGVGFLSAKYF

SEQ ID NO: 3372524 - protein, 18 aa, Plasmodium falciparum
SRFGNAFHLCREILRLTK

SEQ ID NO: 3372525 - protein, 22 aa, Plasmodium falciparum
SRFGNRGFQHFCDAYYKEVDEY

SEQ ID NO: 3372526 - protein, 19 aa, Plasmodium falciparum
SRFVSWINGLSVFQIRAGR

SEQ ID NO: 3372527 - protein, 25 aa, Plasmodium falciparum
SRFYRAPEIILGFRYDAQIDVWSAA

SEQ ID NO: 3372528 - protein, 17 aa, Plasmodium falciparum
SRIKMKIAENLRHIEHA

SEQ ID NO: 3372529 - protein, 24 aa, Plasmodium falciparum
SRIKYNYRYKDLFNHLKNKIIKSL

SEQ ID NO: 3372530 - protein, 23 aa, Plasmodium falciparum
SRKINLRNAWIIRLKKKNSIIAR

SEQ ID NO: 3372531 - protein, 24 aa, Plasmodium falciparum
SRKIYDRKIHAHVHFVYQCTNIID

SEQ ID NO: 3372532 - protein, 26 aa, Plasmodium falciparum
SRKLLKTLDRNSCIYESVVFLSAENL

SEQ ID NO: 3372533 - protein, 27 aa, Plasmodium falciparum
SRKPSGRFFHSCSLCLANQGNDINVYI

SEQ ID NO: 3372534 - protein, 20 aa, Plasmodium falciparum
SRKSLKIFNYHIPEECLEDE

SEQ ID NO: 3372535 - protein, 19 aa, Plasmodium falciparum
SRKSMNIMNSFLVDTFEKI

SEQ ID NO: 3372536 - protein, 18 aa, Plasmodium falciparum
SRLFLLQYNGYIWSWSIL

SEQ ID NO: 3372537 - protein, 21 aa, Plasmodium falciparum
SRLHVGSNILIHFIPNIVSKI

SEQ ID NO: 3372538 - protein, 23 aa, Plasmodium falciparum
SRLIKSSCVKMVLSGEGSDEIFG

SEQ ID NO: 3372539 - protein, 20 aa, Plasmodium falciparum
SRLISTSVLCEYITNCVCIF

SEQ ID NO: 3372540 - protein, 23 aa, Plasmodium falciparum
SRLNFLCGASCYSSNINMDKIID

SEQ ID NO: 3372541 - protein, 23 aa, Plasmodium falciparum
SRLRKDNKIEYVDNIFLSKYMLN

SEQ ID NO: 3372542 - protein, 23 aa, Plasmodium falciparum
SRLTLKYDPRISGWKGDNKMKKD

SEQ ID NO: 3372543 - protein, 19 aa, Plasmodium falciparum
SRNNYIYIYIKREYIPEYL

SEQ ID NO: 3372544 - protein, 18 aa, Plasmodium falciparum
SRNSFKALSYPVFDSNKK

SEQ ID NO: 3372545 - protein, 19 aa, Plasmodium falciparum
SRNSKLIGLKQHIDIEIKE

SEQ ID NO: 3372546 - protein, 19 aa, Plasmodium falciparum
SRNSYKSMIERIEDDVEYK

SEQ ID NO: 3372547 - protein, 17 aa, Plasmodium falciparum
SRNSYKYSTNNITKIID

SEQ ID NO: 3372548 - protein, 72 aa, Plasmodium falciparum
SRNYDRINSYWIRRGNIKQRKAPQILCELCNSKMWVHTWLDDIGSKVKLLCKCGFKNFLKKNNNWVRSPRWK

SEQ ID NO: 3372549 - protein, 25 aa, Plasmodium falciparum
SRRIFRFSKRKSLIHDMSYVEIIQL

SEQ ID NO: 3372550 - protein, 18 aa, Plasmodium falciparum
SRRNYVLSNDVNEFMDTL

SEQ ID NO: 3372551 - protein, 22 aa, Plasmodium falciparum
SRSDLSLLWRQELNELNKLYEK

SEQ ID NO: 3372552 - protein, 25 aa, Plasmodium falciparum
SRSICNKEQIVLFSFAKALESIPRH

SEQ ID NO: 3372553 - protein, 19 aa, Plasmodium falciparum
SRSKNTPLFGNKTEVEKKK

SEQ ID NO: 3372554 - protein, 29 aa, Plasmodium falciparum
SRSKSEGIKHLRLSSSDSDLSCYLDSFKN

SEQ ID NO: 3372555 - protein, 21 aa, Plasmodium falciparum
SRTLKSVCKIKLKYNPTEVDP

SEQ ID NO: 3372556 - protein, 25 aa, Plasmodium falciparum
SRTLYLCNFFYFSIYEITNNCYNSQ

SEQ ID NO: 3372557 - protein, 23 aa, Plasmodium falciparum
SRTMGSDIFSNFGSSASYGTPRN

SEQ ID NO: 3372558 - protein, 20 aa, Plasmodium falciparum
SRTSRKFAYIDFENKTKALA

SEQ ID NO: 3372559 - protein, 25 aa, Plasmodium falciparum
SRTTRKRNICKTEKSMITKNGNKYM

SEQ ID NO: 3372560 - protein, 27 aa, Plasmodium falciparum
SRYFHPLKRIELSTSCINKYLFAKKKE

SEQ ID NO: 3372561 - protein, 20 aa, Plasmodium falciparum
SRYKHIFMKKSYTLKERDIN

SEQ ID NO: 3372562 - protein, 22 aa, Plasmodium falciparum
SRYTGNFPYPYMNGLLHIGHAF

SEQ ID NO: 3372563 - protein, 20 aa, Plasmodium falciparum
SRYTWCLSDELPKLISSVNI

SEQ ID NO: 3372564 - protein, 18 aa, Plasmodium falciparum
SSAFDKKIFCTKLNEELK

SEQ ID NO: 3372565 - protein, 19 aa, Plasmodium falciparum
SSAIAPPCDIMTDDHLNSA

SEQ ID NO: 3372566 - protein, 25 aa, Plasmodium falciparum
SSAIFRHELAFVLGQVLHLNSLKYL

SEQ ID NO: 3372567 - protein, 26 aa, Plasmodium falciparum
SSAQSIRFKAKISVDHIESARLSPIK

SEQ ID NO: 3372568 - protein, 32 aa, Plasmodium falciparum
SSASHKRKVFHYGIHKENLLKGENEFIGNKDR

SEQ ID NO: 3372569 - protein, 28 aa, Plasmodium falciparum
SSAVYQLIYKKTCSRTHEDFNSDKYSLL

SEQ ID NO: 3372570 - protein, 17 aa, Plasmodium falciparum
SSCDIKWIDFTYSLQQD

SEQ ID NO: 3372571 - protein, 17 aa, Plasmodium falciparum
SSCLSRQSVITAISKDN

SEQ ID NO: 3372572 - protein, 26 aa, Plasmodium falciparum
SSDEMKEYNFLKELYRIQNNEQENIS

SEQ ID NO: 3372573 - protein, 25 aa, Plasmodium falciparum
SSDIPCPRYFSSLDLYIIRKNNIEE

SEQ ID NO: 3372574 - protein, 21 aa, Plasmodium falciparum
SSDKIVLFIFNCLDRGKRYHI

SEQ ID NO: 3372575 - protein, 22 aa, Plasmodium falciparum
SSDKRKGNLYGNNKINMNNNNN

SEQ ID NO: 3372576 - protein, 23 aa, Plasmodium falciparum
SSDKSFCIWKPFYDEYDDTNDNI

SEQ ID NO: 3372577 - protein, 24 aa, Plasmodium falciparum
SSDMSQEEIVSFSSKYNIKQNKIN

SEQ ID NO: 3372578 - protein, 22 aa, Plasmodium falciparum
SSDNISGCFFVEKLNAYLFAML

SEQ ID NO: 3372579 - protein, 25 aa, Plasmodium falciparum
SSDSFYKSNESFFLHEKDEDSTNLD

SEQ ID NO: 3372580 - protein, 17 aa, Plasmodium falciparum
SSDYIFSIWEFELEYCI

SEQ ID NO: 3372581 - protein, 28 aa, Plasmodium falciparum
SSEEHIFNFPIEWNIPNFKNNISTKLKP

SEQ ID NO: 3372582 - protein, 18 aa, Plasmodium falciparum
SSEFMKSRFIKPLDEKGV

SEQ ID NO: 3372583 - protein, 27 aa, Plasmodium falciparum
SSEILPSCSPSGCASRNKVTHVQNVRR

SEQ ID NO: 3372584 - protein, 34 aa, Plasmodium falciparum
SSFEARKGVYYDKSRKLWRANWKENGKIQTKGFS

SEQ ID NO: 3372585 - protein, 18 aa, Plasmodium falciparum
SSFFKILSTYIISSTTTS

SEQ ID NO: 3372586 - protein, 24 aa, Plasmodium falciparum
SSFKINNVLLSFLIIDDKIIGLSL

SEQ ID NO: 3372587 - protein, 23 aa, Plasmodium falciparum
SSFKSIKNFNSFDISKKRCNGID

SEQ ID NO: 3372588 - protein, 17 aa, Plasmodium falciparum
SSFLLSGSFCYNNNYFT

SEQ ID NO: 3372589 - protein, 24 aa, Plasmodium falciparum
SSFVKDLIRNFGIKSCEDVYILPY

SEQ ID NO: 3372590 - protein, 33 aa, Plasmodium falciparum
SSFVKNKINFMNYCSNEIIDIYNKVAHYEKMYN

SEQ ID NO: 3372591 - protein, 23 aa, Plasmodium falciparum
SSFYEKFNDIFLFIEDTTKNNNC

SEQ ID NO: 3372592 - protein, 27 aa, Plasmodium falciparum
SSGKFPDVFCSKGAIYLKCDVMNKKVN

SEQ ID NO: 3372593 - protein, 26 aa, Plasmodium falciparum
SSGLRKGQELFHVFLSNGKKIQTTYS

SEQ ID NO: 3372594 - protein, 31 aa, Plasmodium falciparum
SSGNKSFILSWGIRESREISLQKGYVNIQKI

SEQ ID NO: 3372595 - protein, 35 aa, Plasmodium falciparum
SSGPYKAGCCYIECTLESGIYCLLPSLYRANVTGN

SEQ ID NO: 3372596 - protein, 24 aa, Plasmodium falciparum
SSGQIFCMPLNLNIKKIKEEHIKE

SEQ ID NO: 3372597 - protein, 17 aa, Plasmodium falciparum
SSGRSRCFGFVVFSNEN

SEQ ID NO: 3372598 - protein, 20 aa, Plasmodium falciparum
SSHEDICFTIKMDPAKLQKA

SEQ ID NO: 3372599 - protein, 24 aa, Plasmodium falciparum
SSHFTFELIDSVFLNENNLKNKID

SEQ ID NO: 3372600 - protein, 22 aa, Plasmodium falciparum
SSHLSEHLNIFIKNNQNVSLEK

SEQ ID NO: 3372601 - protein, 26 aa, Plasmodium falciparum
SSHLVPLTFCFYKIHNNLIINYDKTY

SEQ ID NO: 3372602 - protein, 26 aa, Plasmodium falciparum
SSHNKILSTYCLLNMFNNVLSYINNF

SEQ ID NO: 3372603 - protein, 19 aa, Plasmodium falciparum
SSIALYLCHGRFSEKHQVT

SEQ ID NO: 3372604 - protein, 21 aa, Plasmodium falciparum
SSIDMIICDEAHRLKNDKTKT

SEQ ID NO: 3372605 - protein, 17 aa, Plasmodium falciparum
SSIDVVRDMLQKSNDLF

SEQ ID NO: 3372606 - protein, 33 aa, Plasmodium falciparum
SSIITPCSWNYLCINKTWPIFNPCGMYICRLHC

SEQ ID NO: 3372607 - protein, 18 aa, Plasmodium falciparum
SSIKNTKKGFLIDEDNII

SEQ ID NO: 3372608 - protein, 23 aa, Plasmodium falciparum
SSILKRIINIFDEYDKSESKDYN

SEQ ID NO: 3372609 - protein, 30 aa, Plasmodium falciparum
SSILLSVCSCLKIFPSIRYQNSELCRSFSH

SEQ ID NO: 3372610 - protein, 18 aa, Plasmodium falciparum
SSINLFFLNNYTIKSEDC

SEQ ID NO: 3372611 - protein, 17 aa, Plasmodium falciparum
SSIRLLKNWPQLEKTYQ

SEQ ID NO: 3372612 - protein, 35 aa, Plasmodium falciparum
SSIRRNEKKRIPLKIKRNASATFIHSVNNYKKNDE

SEQ ID NO: 3372613 - protein, 20 aa, Plasmodium falciparum
SSIRVRWMIQVPRLYHIYKK

SEQ ID NO: 3372614 - protein, 22 aa, Plasmodium falciparum
SSISNRCMSHFDNDFTISYERE

SEQ ID NO: 3372615 - protein, 53 aa, Plasmodium falciparum
SSISNTLDTLTFYQLILIIISIVNFCRKKSQTYNKNFEEKFNLASVQSSNATQ

SEQ ID NO: 3372616 - protein, 24 aa, Plasmodium falciparum
SSIYFCAGALKIENIYMHKHINVI

SEQ ID NO: 3372617 - protein, 19 aa, Plasmodium falciparum
SSKAFEVIKLQELTKQKEY

SEQ ID NO: 3372618 - protein, 20 aa, Plasmodium falciparum
SSKCRQVHMAPFSSINNSSF

SEQ ID NO: 3372619 - protein, 23 aa, Plasmodium falciparum
SSKDNRCVHMNNYVKQIRNSRSL

SEQ ID NO: 3372620 - protein, 25 aa, Plasmodium falciparum
SSKGHLKSGALIKVDKGNNNNNSNT

SEQ ID NO: 3372621 - protein, 23 aa, Plasmodium falciparum
SSKGYFIKKFHGLLKKRKKNEYE

SEQ ID NO: 3372622 - protein, 18 aa, Plasmodium falciparum
SSKIGCIYFIGMSTNMYR

SEQ ID NO: 3372623 - protein, 18 aa, Plasmodium falciparum
SSKIICSDQHHVERINNK

SEQ ID NO: 3372624 - protein, 25 aa, Plasmodium falciparum
SSKINEILFTFPYANFLLSKYFSNF

SEQ ID NO: 3372625 - protein, 24 aa, Plasmodium falciparum
SSKKCLYPHEIVEYLNKYIIGQSE

SEQ ID NO: 3372626 - protein, 18 aa, Plasmodium falciparum
SSKKCYEANYINKNFSFS

SEQ ID NO: 3372627 - protein, 23 aa, Plasmodium falciparum
SSKKELQKIYAILNKKEIKNEKN

SEQ ID NO: 3372628 - protein, 24 aa, Plasmodium falciparum
SSKKSIKKEACWALSNITAGNISQ

SEQ ID NO: 3372629 - protein, 17 aa, Plasmodium falciparum
SSKKYWNFKKIKNEIIA

SEQ ID NO: 3372630 - protein, 24 aa, Plasmodium falciparum
SSKMSLKRNIWYNNRSNSVHSALN

SEQ ID NO: 3372631 - protein, 24 aa, Plasmodium falciparum
SSKSEFRINIHINKVINSADKFLK

SEQ ID NO: 3372632 - protein, 24 aa, Plasmodium falciparum
SSKYEVFCFFCKYYYNKDLLGERK

SEQ ID NO: 3372633 - protein, 20 aa, Plasmodium falciparum
SSKYMYKHIMRMFIEKHNLN

SEQ ID NO: 3372634 - protein, 24 aa, Plasmodium falciparum
SSLANCLLIKYASYLIYCTEVHSE

SEQ ID NO: 3372635 - protein, 24 aa, Plasmodium falciparum
SSLCKAMYEKLFLWIIRHLNSRIE

SEQ ID NO: 3372636 - protein, 17 aa, Plasmodium falciparum
SSLESVKQNADEQKEQP

SEQ ID NO: 3372637 - protein, 23 aa, Plasmodium falciparum
SSLFSDESTKVFVNKKTRIKINM

SEQ ID NO: 3372638 - protein, 20 aa, Plasmodium falciparum
SSLKDGKLILLLDLDNTLLQ

SEQ ID NO: 3372639 - protein, 17 aa, Plasmodium falciparum
SSLKFFYKTYMPDYEKI

SEQ ID NO: 3372640 - protein, 19 aa, Plasmodium falciparum
SSLLKRNEHKVNRKSDEHI

SEQ ID NO: 3372641 - protein, 27 aa, Plasmodium falciparum
SSLLVYCFLDRINLFFQERSRKVVNML

SEQ ID NO: 3372642 - protein, 21 aa, Plasmodium falciparum
SSLNSPLLNGVHMNNIHMNSI

SEQ ID NO: 3372643 - protein, 19 aa, Plasmodium falciparum
SSLNSSSVPCSTSLFNNTW

SEQ ID NO: 3372644 - protein, 19 aa, Plasmodium falciparum
SSLPHDFLLNNNMLGSMTN

SEQ ID NO: 3372645 - protein, 17 aa, Plasmodium falciparum
SSLRCVRRLIQSEELAY

SEQ ID NO: 3372646 - protein, 23 aa, Plasmodium falciparum
SSLRKGIFRHIIILFDMSSSMKE

SEQ ID NO: 3372647 - protein, 19 aa, Plasmodium falciparum
SSLYPIVIACLVRKKIKLY

SEQ ID NO: 3372648 - protein, 24 aa, Plasmodium falciparum
SSMFYKKLGNNPVHNYNKFNHNND

SEQ ID NO: 3372649 - protein, 18 aa, Plasmodium falciparum
SSMKGLGARVYITEIDPI

SEQ ID NO: 3372650 - protein, 20 aa, Plasmodium falciparum
SSMNFEYPFNISKMNTESNN

SEQ ID NO: 3372651 - protein, 27 aa, Plasmodium falciparum
SSMRHPCVMDIKMGIRLYGDDCNEESI

SEQ ID NO: 3372652 - protein, 25 aa, Plasmodium falciparum
SSMSKFKKDCIIRDINYKDRFYFEP

SEQ ID NO: 3372653 - protein, 40 aa, Plasmodium falciparum
SSNEFMCNELKDFLGDHTTVFVDWLMRLMGDIRKQKKSDT

SEQ ID NO: 3372654 - protein, 17 aa, Plasmodium falciparum
SSNEMKQKELVNIKKDD

SEQ ID NO: 3372655 - protein, 26 aa, Plasmodium falciparum
SSNFKIKYKFLYNEQNFFSIEKCEEI

SEQ ID NO: 3372656 - protein, 19 aa, Plasmodium falciparum
SSNGKLLIEQCFNKKRYKR

SEQ ID NO: 3372657 - protein, 19 aa, Plasmodium falciparum
SSNIKTVYYIWNQFFDNLR

SEQ ID NO: 3372658 - protein, 34 aa, Plasmodium falciparum
SSNIMLSFFIFFKFKESFIRDYLITFIQTKYDIL

SEQ ID NO: 3372659 - protein, 19 aa, Plasmodium falciparum
SSNKEGVGLSWSPSNMCPD

SEQ ID NO: 3372660 - protein, 18 aa, Plasmodium falciparum
SSNKIIGLYNYSRYYGLR

SEQ ID NO: 3372661 - protein, 24 aa, Plasmodium falciparum
SSNKIKGIHFFFILNSKVLKELGI

SEQ ID NO: 3372662 - protein, 27 aa, Plasmodium falciparum
SSNKLRALFEMCFLISPATYNCVQDFK

SEQ ID NO: 3372663 - protein, 26 aa, Plasmodium falciparum
SSNLFPQKSWKGILFGDKNKHHTHNN

SEQ ID NO: 3372664 - protein, 17 aa, Plasmodium falciparum
SSNLIYFYPYTINDIQK

SEQ ID NO: 3372665 - protein, 25 aa, Plasmodium falciparum
SSNRVCNSLALLQCVASHPETKQHF

SEQ ID NO: 3372666 - protein, 24 aa, Plasmodium falciparum
SSNSCVKYKLSDFSNKYKNNIFNE

SEQ ID NO: 3372667 - protein, 20 aa, Plasmodium falciparum
SSPIKINFNNFVYKSRRNIS

SEQ ID NO: 3372668 - protein, 19 aa, Plasmodium falciparum
SSQFKFSVLNNIKNNIHNT

SEQ ID NO: 3372669 - protein, 30 aa, Plasmodium falciparum
SSQVILCCLRCLYSDLNLLDIHSLSTDENV

SEQ ID NO: 3372670 - protein, 25 aa, Plasmodium falciparum
SSRDKMEFIKRFKKMIIPNFRLEKI

SEQ ID NO: 3372671 - protein, 21 aa, Plasmodium falciparum
SSSCVNLKNLININKNFNVLM

SEQ ID NO: 3372672 - protein, 24 aa, Plasmodium falciparum
SSSDGIKKSVSFSKYVYDLAKNNY

SEQ ID NO: 3372673 - protein, 23 aa, Plasmodium falciparum
SSSFCVKKNYLLNSRSVSMPSYL

SEQ ID NO: 3372674 - protein, 23 aa, Plasmodium falciparum
SSSFGACRMIRLTVHKIATKFWC

SEQ ID NO: 3372675 - protein, 27 aa, Plasmodium falciparum
SSSFKSRSSLGRKISFSSDESYFDSDI

SEQ ID NO: 3372676 - protein, 35 aa, Plasmodium falciparum
SSSHSSFSCIAYWKSKRLSDSIIHSKYFNGVKKNN

SEQ ID NO: 3372677 - protein, 17 aa, Plasmodium falciparum
SSSKLIFIDKLLCQLHY

SEQ ID NO: 3372678 - protein, 23 aa, Plasmodium falciparum
SSSLEVLAGLVLDDKQYIDYMCS

SEQ ID NO: 3372679 - protein, 19 aa, Plasmodium falciparum
SSSLYRFLLEKASKSMHFA

SEQ ID NO: 3372680 - protein, 23 aa, Plasmodium falciparum
SSSMKDSRILKSYIHDTNVNAGF

SEQ ID NO: 3372681 - protein, 23 aa, Plasmodium falciparum
SSSMKELICKNILSVSNRYIKHL

SEQ ID NO: 3372682 - protein, 20 aa, Plasmodium falciparum
SSSNASFMKNFNNYDIPEQF

SEQ ID NO: 3372683 - protein, 17 aa, Plasmodium falciparum
SSSNKCCNNCCSSSYDK

SEQ ID NO: 3372684 - protein, 29 aa, Plasmodium falciparum
SSSNKKLKSYMFNGGRYAFAAKLKEEIKH

SEQ ID NO: 3372685 - protein, 17 aa, Plasmodium falciparum
SSSSCCYNSSNKKDYLL

SEQ ID NO: 3372686 - protein, 17 aa, Plasmodium falciparum
SSSSLSCVSYLSEAQNS

SEQ ID NO: 3372687 - protein, 21 aa, Plasmodium falciparum
SSSSLYFYFTIDVKELVNFMD

SEQ ID NO: 3372688 - protein, 24 aa, Plasmodium falciparum
SSSSMKRETECLLNNKIKDCHRLY

SEQ ID NO: 3372689 - protein, 28 aa, Plasmodium falciparum
SSSYIKPHRNLTLPINMYMNNTYMYNSK

SEQ ID NO: 3372690 - protein, 17 aa, Plasmodium falciparum
SSSYKISNVESMKNDNP

SEQ ID NO: 3372691 - protein, 26 aa, Plasmodium falciparum
SSTFSLNIPYCFKILHETNDELIKDV

SEQ ID NO: 3372692 - protein, 28 aa, Plasmodium falciparum
SSTVFLACLKCFLNFSINDTNLQIQIFQ

SEQ ID NO: 3372693 - protein, 18 aa, Plasmodium falciparum
SSVLKIYVINVVDDNNKY

SEQ ID NO: 3372694 - protein, 19 aa, Plasmodium falciparum
SSVNDSCIVENHQHYHQNN

SEQ ID NO: 3372695 - protein, 22 aa, Plasmodium falciparum
SSVPCSTSLFNNTWNKSLSNSK

SEQ ID NO: 3372696 - protein, 19 aa, Plasmodium falciparum
SSVRTALSLSESFFKKRQI

SEQ ID NO: 3372697 - protein, 20 aa, Plasmodium falciparum
SSYASSFYRTESKHDRTYKT

SEQ ID NO: 3372698 - protein, 17 aa, Plasmodium falciparum
SSYFCINDPNADKNKEN

SEQ ID NO: 3372699 - protein, 17 aa, Plasmodium falciparum
SSYFKDKYLGLFFGASW

SEQ ID NO: 3372700 - protein, 19 aa, Plasmodium falciparum
SSYGNNMFDYNYLREYNLN

SEQ ID NO: 3372701 - protein, 20 aa, Plasmodium falciparum
SSYGSLKIRQQESCNINQSL

SEQ ID NO: 3372702 - protein, 21 aa, Plasmodium falciparum
SSYIPDCWCVETGNNYVEHNA

SEQ ID NO: 3372703 - protein, 24 aa, Plasmodium falciparum
SSYKKCIYLLFFREKFLKKYKQNI

SEQ ID NO: 3372704 - protein, 19 aa, Plasmodium falciparum
SSYKSLGCMSELQTSRLYN

SEQ ID NO: 3372705 - protein, 20 aa, Plasmodium falciparum
SSYLFSLSFQNSGKINVYDS

SEQ ID NO: 3372706 - protein, 17 aa, Plasmodium falciparum
SSYPSHSSYPYSSYSSI

SEQ ID NO: 3372707 - protein, 20 aa, Plasmodium falciparum
SSYYLLVFHKNCCISVFNFK

SEQ ID NO: 3372708 - protein, 31 aa, Plasmodium falciparum
SSYYNILENFYKRRLQRLQNARNRMYIDYDK

SEQ ID NO: 3372709 - protein, 20 aa, Plasmodium falciparum
SSYYSAWVYRRKCLKKLNLN

SEQ ID NO: 3372710 - protein, 20 aa, Plasmodium falciparum
STAAYSEMKQYVDVKDTNNH

SEQ ID NO: 3372711 - protein, 21 aa, Plasmodium falciparum
STACGNILYILGYVDDRTIEK

SEQ ID NO: 3372712 - protein, 19 aa, Plasmodium falciparum
STAIYTKYVRAHLNVIKLT

SEQ ID NO: 3372713 - protein, 21 aa, Plasmodium falciparum
STAMCLIKPIFPDYITNKNKV

SEQ ID NO: 3372714 - protein, 41 aa, Plasmodium falciparum
STCEKCKCKKMFKYSCVYKQPNILIIHLIRLQEDGSKIDKP

SEQ ID NO: 3372715 - protein, 20 aa, Plasmodium falciparum
STCMNGDECSFCHHPDHVLI

SEQ ID NO: 3372716 - protein, 31 aa, Plasmodium falciparum
STCYVCQRPGKLLGCDFCPNSFHPTCLPDLD

SEQ ID NO: 3372717 - protein, 27 aa, Plasmodium falciparum
STDEFYKTTLCKFFLNGYCKADKNCRH

SEQ ID NO: 3372718 - protein, 24 aa, Plasmodium falciparum
STDEMKNCIYAFIKYYDTLQNDLF

SEQ ID NO: 3372719 - protein, 18 aa, Plasmodium falciparum
STDIFPDIENKVGEEREL

SEQ ID NO: 3372720 - protein, 21 aa, Plasmodium falciparum
STEENCIYAYITRNQNKINYL

SEQ ID NO: 3372721 - protein, 26 aa, Plasmodium falciparum
STEFKKVFDVYAYWKLFYSLKDKYEN

SEQ ID NO: 3372722 - protein, 22 aa, Plasmodium falciparum
STEKWLIECSPNYYIFENSNIK

SEQ ID NO: 3372723 - protein, 17 aa, Plasmodium falciparum
STELDILKEFCYQRLKA

SEQ ID NO: 3372724 - protein, 24 aa, Plasmodium falciparum
STELILICKCFLLVQKIEEGKTYL

SEQ ID NO: 3372725 - protein, 22 aa, Plasmodium falciparum
STFEILEKMFSLYVNTYPDNEL

SEQ ID NO: 3372726 - protein, 20 aa, Plasmodium falciparum
STFGKPTVRGSVTNDNLSDD

SEQ ID NO: 3372727 - protein, 19 aa, Plasmodium falciparum
STFSFSKFVNKIINYEKII

SEQ ID NO: 3372728 - protein, 25 aa, Plasmodium falciparum
STFTQEIWTHILIKALYKCFHIFHF

SEQ ID NO: 3372729 - protein, 19 aa, Plasmodium falciparum
STFYKYSLDKLIFKIYIPF

SEQ ID NO: 3372730 - protein, 17 aa, Plasmodium falciparum
STGMCPLKNNDTKKENC

SEQ ID NO: 3372731 - protein, 18 aa, Plasmodium falciparum
STGNLIFELLSYLLNIPL

SEQ ID NO: 3372732 - protein, 17 aa, Plasmodium falciparum
STGRLSCDQPNLQNIHS

SEQ ID NO: 3372733 - protein, 18 aa, Plasmodium falciparum
STGSEMFSDFYGGDSNEE

SEQ ID NO: 3372734 - protein, 19 aa, Plasmodium falciparum
STHSIPIGFLNLGKEKLYD

SEQ ID NO: 3372735 - protein, 23 aa, Plasmodium falciparum
STKNCLPKELINKINYYKYQLDE

SEQ ID NO: 3372736 - protein, 22 aa, Plasmodium falciparum
STKTCAISEFLNNNIRSKYIQQ

SEQ ID NO: 3372737 - protein, 24 aa, Plasmodium falciparum
STLERERINIILKELIISCNEKKE

SEQ ID NO: 3372738 - protein, 19 aa, Plasmodium falciparum
STLIGALLYNLNYVSEQTI

SEQ ID NO: 3372739 - protein, 18 aa, Plasmodium falciparum
STLNHKVTRSYRRRKKKN

SEQ ID NO: 3372740 - protein, 25 aa, Plasmodium falciparum
STLNILYMWKSYRSAFMSFIQKQNY

SEQ ID NO: 3372741 - protein, 23 aa, Plasmodium falciparum
STLNYNMDRCWSLCAKKTKNDLC

SEQ ID NO: 3372742 - protein, 25 aa, Plasmodium falciparum
STLRNKESFSFKNKFLNHVDNLKLK

SEQ ID NO: 3372743 - protein, 18 aa, Plasmodium falciparum
STLRQFVRDWSMEGQEER

SEQ ID NO: 3372744 - protein, 19 aa, Plasmodium falciparum
STNEKLLFCSKNNAVNIYD

SEQ ID NO: 3372745 - protein, 25 aa, Plasmodium falciparum
STNKLAWSHDGKRLIAADTQGCLTL

SEQ ID NO: 3372746 - protein, 22 aa, Plasmodium falciparum
STNMYDHIAWEKKNEQNVLPIR

SEQ ID NO: 3372747 - protein, 17 aa, Plasmodium falciparum
STNNFLILDKINQMHYI

SEQ ID NO: 3372748 - protein, 26 aa, Plasmodium falciparum
STNSVVKADCDIKNLFDKNMKNENKK

SEQ ID NO: 3372749 - protein, 18 aa, Plasmodium falciparum
STNTYFFIIKFDDLNNDY

SEQ ID NO: 3372750 - protein, 27 aa, Plasmodium falciparum
STNTYPTIFWCPLKFNDKTRILQQNTE

SEQ ID NO: 3372751 - protein, 34 aa, Plasmodium falciparum
STPEYKRDILYVFKRLYVDKCFIPNMNPKILDKQ

SEQ ID NO: 3372752 - protein, 20 aa, Plasmodium falciparum
STPRYFMFKKYNFVLKQINQ

SEQ ID NO: 3372753 - protein, 26 aa, Plasmodium falciparum
STQIACKKFLFNIYMMKPEHILCYSF

SEQ ID NO: 3372754 - protein, 27 aa, Plasmodium falciparum
STQIGLKYDNMWGIFRFVIDNLADKPN

SEQ ID NO: 3372755 - protein, 20 aa, Plasmodium falciparum
STSALLCGLNLYNNTSSDIV

SEQ ID NO: 3372756 - protein, 25 aa, Plasmodium falciparum
STSAMKFTSFFSTIIVMRDTETIIY

SEQ ID NO: 3372757 - protein, 17 aa, Plasmodium falciparum
STSDVLTPIFFNNGDEK

SEQ ID NO: 3372758 - protein, 23 aa, Plasmodium falciparum
STSNLMWLERALYTWKSTNPKYY

SEQ ID NO: 3372759 - protein, 35 aa, Plasmodium falciparum
STSSSGYPGVSWNKRMCAWLAFFYDGASRRSRTFH

SEQ ID NO: 3372760 - protein, 26 aa, Plasmodium falciparum
STTAESKSRCAIVYKNNKLYLKHNSF

SEQ ID NO: 3372761 - protein, 20 aa, Plasmodium falciparum
STTLPRDMYEENQFYNNEEE

SEQ ID NO: 3372762 - protein, 17 aa, Plasmodium falciparum
STVFQMNPEWVVYHELL

SEQ ID NO: 3372763 - protein, 24 aa, Plasmodium falciparum
STYEYPLTHLLNFNKECAYALNYN

SEQ ID NO: 3372764 - protein, 28 aa, Plasmodium falciparum
STYKTSLCYFWKRKKCMNEEKCRFAHGI

SEQ ID NO: 3372765 - protein, 28 aa, Plasmodium falciparum
STYPRMKVENVFKIYTYEGTLVNSYNFN

SEQ ID NO: 3372766 - protein, 18 aa, Plasmodium falciparum
STYSLYIKECLLIIDILY

SEQ ID NO: 3372767 - protein, 19 aa, Plasmodium falciparum
SVCELMQIWNISDMDNDGY

SEQ ID NO: 3372768 - protein, 26 aa, Plasmodium falciparum
SVCKLEHYREYLIYNIPSLRYLDFEK

SEQ ID NO: 3372769 - protein, 19 aa, Plasmodium falciparum
SVCRRRRRVDRNKESNEKE

SEQ ID NO: 3372770 - protein, 25 aa, Plasmodium falciparum
SVDELPSFRFLYLMKTGDNNITNYN

SEQ ID NO: 3372771 - protein, 19 aa, Plasmodium falciparum
SVDIIKCDMCFFSHDGLFL

SEQ ID NO: 3372772 - protein, 21 aa, Plasmodium falciparum
SVDISLCYEFLLIFYKNKISN

SEQ ID NO: 3372773 - protein, 29 aa, Plasmodium falciparum
SVEGQLEFKALLFIPKRAPFDMFENRKKR

SEQ ID NO: 3372774 - protein, 21 aa, Plasmodium falciparum
SVEHNNCPNLKKKDRSYNLWK

SEQ ID NO: 3372775 - protein, 23 aa, Plasmodium falciparum
SVEIDILIPLSFACNKIILVGDP

SEQ ID NO: 3372776 - protein, 23 aa, Plasmodium falciparum
SVEIIRLSSFKSRNDLKKKKIGG

SEQ ID NO: 3372777 - protein, 18 aa, Plasmodium falciparum
SVEKIRHRDDIVLCDGKA

SEQ ID NO: 3372778 - protein, 19 aa, Plasmodium falciparum
SVEKYKSFLSKIEKSNEDI

SEQ ID NO: 3372779 - protein, 26 aa, Plasmodium falciparum
SVEVIKDYIAFVFKYNIVITTIDLQH

SEQ ID NO: 3372780 - protein, 17 aa, Plasmodium falciparum
SVFLKRLKSYVSDRISR

SEQ ID NO: 3372781 - protein, 17 aa, Plasmodium falciparum
SVFRTIRKRCVQCSDLI

SEQ ID NO: 3372782 - protein, 17 aa, Plasmodium falciparum
SVGKSSIVLRLTKDTFH

SEQ ID NO: 3372783 - protein, 27 aa, Plasmodium falciparum
SVGSAEIKCTARVALVVLDNIYPIKKL

SEQ ID NO: 3372784 - protein, 18 aa, Plasmodium falciparum
SVHDEPFLRFAYAYYGSM

SEQ ID NO: 3372785 - protein, 18 aa, Plasmodium falciparum
SVHLNSWTRRNAIIDYIC

SEQ ID NO: 3372786 - protein, 25 aa, Plasmodium falciparum
SVHTTTPFEIFKWSNILNTKNEKVI

SEQ ID NO: 3372787 - protein, 26 aa, Plasmodium falciparum
SVIEKLKCNYFIKKFKEAIFNCYKNE

SEQ ID NO: 3372788 - protein, 19 aa, Plasmodium falciparum
SVIEVLRRKNFLLDDPNNT

SEQ ID NO: 3372789 - protein, 28 aa, Plasmodium falciparum
SVIFPMEKYRNFTLPSEEKITSYNFLKK

SEQ ID NO: 3372790 - protein, 18 aa, Plasmodium falciparum
SVILLIYDMNNVLFGYFL

SEQ ID NO: 3372791 - protein, 24 aa, Plasmodium falciparum
SVKRILSTFLKKEENVILFTKEQT

SEQ ID NO: 3372792 - protein, 31 aa, Plasmodium falciparum
SVKRLCKMPPLGITVAISFDSFVVLRHSYLY

SEQ ID NO: 3372793 - protein, 22 aa, Plasmodium falciparum
SVLHKLVGLVLVKEEKSKCYDT

SEQ ID NO: 3372794 - protein, 22 aa, Plasmodium falciparum
SVLKIFSFFDLEEGYFLYDVKS

SEQ ID NO: 3372795 - protein, 34 aa, Plasmodium falciparum
SVLKKCTMCNVYICYFCCHRMNIDIMKNYLNNDI

SEQ ID NO: 3372796 - protein, 19 aa, Plasmodium falciparum
SVLLCNRISFPHNEKKNLL

SEQ ID NO: 3372797 - protein, 33 aa, Plasmodium falciparum
SVLSFKIQLMNSFKYPVMVKVIFHRNENNHDNI

SEQ ID NO: 3372798 - protein, 19 aa, Plasmodium falciparum
SVLYEGACCLLYMSTSALS

SEQ ID NO: 3372799 - protein, 18 aa, Plasmodium falciparum
SVMFIDWSSSGYILSTNS

SEQ ID NO: 3372800 - protein, 25 aa, Plasmodium falciparum
SVNFLKDPFCFRNVVIENAYYKNKL

SEQ ID NO: 3372801 - protein, 18 aa, Plasmodium falciparum
SVNFPDFLVEKLTKLSFL

SEQ ID NO: 3372802 - protein, 18 aa, Plasmodium falciparum
SVNIELHSLFTYVRTKLK

SEQ ID NO: 3372803 - protein, 25 aa, Plasmodium falciparum
SVNKYGFEGARKLAIAFRNSQKPAN

SEQ ID NO: 3372804 - protein, 20 aa, Plasmodium falciparum
SVNNCVRKNSMFGESNMNSM

SEQ ID NO: 3372805 - protein, 17 aa, Plasmodium falciparum
SVNNKGYNKSSINKKYE

SEQ ID NO: 3372806 - protein, 24 aa, Plasmodium falciparum
SVNVLPFWHKYIFDFEYFNYVQSK

SEQ ID NO: 3372807 - protein, 25 aa, Plasmodium falciparum
SVPIKSRSSSYIDIKNIVHERLRRS

SEQ ID NO: 3372808 - protein, 26 aa, Plasmodium falciparum
SVPMYHFFYEHFFYILNIKKGKENVI

SEQ ID NO: 3372809 - protein, 27 aa, Plasmodium falciparum
SVPTIPCLNMFISCMNYNYGKIHKKKS

SEQ ID NO: 3372810 - protein, 23 aa, Plasmodium falciparum
SVQDSYQYYALKDDMYKLSNENK

SEQ ID NO: 3372811 - protein, 23 aa, Plasmodium falciparum
SVQKCLKSSHTLDNKELQVRLVA

SEQ ID NO: 3372812 - protein, 18 aa, Plasmodium falciparum
SVQLARQKAIEWREKKEA

SEQ ID NO: 3372813 - protein, 27 aa, Plasmodium falciparum
SVQQVLRKSLCGKSFYEYPHFDIEILY

SEQ ID NO: 3372814 - protein, 19 aa, Plasmodium falciparum
SVRCLKKGATLIIAEVVSR

SEQ ID NO: 3372815 - protein, 24 aa, Plasmodium falciparum
SVRNDGWFVLKCRRIRRVHNKSGG

SEQ ID NO: 3372816 - protein, 26 aa, Plasmodium falciparum
SVSILKWLEIKDIFIYTHICEIVLKN

SEQ ID NO: 3372817 - protein, 26 aa, Plasmodium falciparum
SVSKNSLLCLSEFYSIGKKKMDNTLD

SEQ ID NO: 3372818 - protein, 31 aa, Plasmodium falciparum
SVSRKLSKHFSLSRSGATFSMSNKKEKKSNK

SEQ ID NO: 3372819 - protein, 19 aa, Plasmodium falciparum
SVTCYVCGETVDLNIWSDH

SEQ ID NO: 3372820 - protein, 28 aa, Plasmodium falciparum
SVTGKRYVRNFVCILNAQCNSRLRIIKD

SEQ ID NO: 3372821 - protein, 24 aa, Plasmodium falciparum
SVTPLKLSTMYQFIDIYDNNVMNF

SEQ ID NO: 3372822 - protein, 26 aa, Plasmodium falciparum
SVVHFKMDEEIPFKSGIIDIIENKEV

SEQ ID NO: 3372823 - protein, 17 aa, Plasmodium falciparum
SVVQGVFEFLEQVVNDE

SEQ ID NO: 3372824 - protein, 19 aa, Plasmodium falciparum
SVVSYKSYGNKSGISDKYF

SEQ ID NO: 3372825 - protein, 17 aa, Plasmodium falciparum
SVYKCEDEIPLGTILNI

SEQ ID NO: 3372826 - protein, 18 aa, Plasmodium falciparum
SVYKIKIFLISSDKSSII

SEQ ID NO: 3372827 - protein, 25 aa, Plasmodium falciparum
SVYLPGIKLLSAICQTASVSGYGND

SEQ ID NO: 3372828 - protein, 19 aa, Plasmodium falciparum
SVYNFCSLNRFSWYRQDVR

SEQ ID NO: 3372829 - protein, 20 aa, Plasmodium falciparum
SVYNKGSVILLIYDMNNVLF

SEQ ID NO: 3372830 - protein, 20 aa, Plasmodium falciparum
SWATKTWLIDKFNILQNEYI

SEQ ID NO: 3372831 - protein, 19 aa, Plasmodium falciparum
SWCTKNFIQYKALNKAKEV

SEQ ID NO: 3372832 - protein, 20 aa, Plasmodium falciparum
SWGCTTRSIGIMIMTHGDDK

SEQ ID NO: 3372833 - protein, 21 aa, Plasmodium falciparum
SWSYKANFILSSLYVTKEIQE

SEQ ID NO: 3372834 - protein, 29 aa, Plasmodium falciparum
SWTILLKKYIFIILYTMKHCIVFNDKEEK

SEQ ID NO: 3372835 - protein, 21 aa, Plasmodium falciparum
SWTRPFMSLLVHKVLDDNLNL

SEQ ID NO: 3372836 - protein, 26 aa, Plasmodium falciparum
SWVDPRFPTIKGILRRGLTKEALFQF

SEQ ID NO: 3372837 - protein, 23 aa, Plasmodium falciparum
SWYKRHFKGTLLINENSNIKNTT

SEQ ID NO: 3372838 - protein, 32 aa, Plasmodium falciparum
SYAAEMNVGLVFRKYIPILINLSCNYLLIKKN

SEQ ID NO: 3372839 - protein, 21 aa, Plasmodium falciparum
SYCDNPKFYFNFPNFVLCNPS

SEQ ID NO: 3372840 - protein, 21 aa, Plasmodium falciparum
SYDFPPWLSEMISFSDKSKST

SEQ ID NO: 3372841 - protein, 26 aa, Plasmodium falciparum
SYDIIKCIYCGSVLGDIEILFNQFNN

SEQ ID NO: 3372842 - protein, 21 aa, Plasmodium falciparum
SYDIYDIISVKSFSNDNVNNM

SEQ ID NO: 3372843 - protein, 19 aa, Plasmodium falciparum
SYDKLSFLYFFSGHIEKLK

SEQ ID NO: 3372844 - protein, 24 aa, Plasmodium falciparum
SYDMNKLYKGTRLSYKEKHQTTNE

SEQ ID NO: 3372845 - protein, 25 aa, Plasmodium falciparum
SYDNICFKKSNYNNGMFSNATYNNY

SEQ ID NO: 3372846 - protein, 18 aa, Plasmodium falciparum
SYDNICLERTFIILKPDV

SEQ ID NO: 3372847 - protein, 21 aa, Plasmodium falciparum
SYDRLRRGYDYLVHKRTENIF

SEQ ID NO: 3372848 - protein, 18 aa, Plasmodium falciparum
SYEHFKKQNICEQNRIKI

SEQ ID NO: 3372849 - protein, 19 aa, Plasmodium falciparum
SYEIKLLKHENNNLINEMN

SEQ ID NO: 3372850 - protein, 18 aa, Plasmodium falciparum
SYEKLDIDKEFNFNDDNI

SEQ ID NO: 3372851 - protein, 25 aa, Plasmodium falciparum
SYELKKYKSAFSIYNILLNITKINM

SEQ ID NO: 3372852 - protein, 18 aa, Plasmodium falciparum
SYERCPYVNDLISFDKVR

SEQ ID NO: 3372853 - protein, 27 aa, Plasmodium falciparum
SYESCYELFHILNIFILKLKQFQNIYE

SEQ ID NO: 3372854 - protein, 18 aa, Plasmodium falciparum
SYFIKNLYLSSLFSSDYI

SEQ ID NO: 3372855 - protein, 21 aa, Plasmodium falciparum
SYFKNICKRKKYKINSKQQLH

SEQ ID NO: 3372856 - protein, 24 aa, Plasmodium falciparum
SYFRPNYFICIPIKNDNICNELIN

SEQ ID NO: 3372857 - protein, 25 aa, Plasmodium falciparum
SYFSREISEDFFASNSRNKSRISSS

SEQ ID NO: 3372858 - protein, 18 aa, Plasmodium falciparum
SYGDFIILGLSDGSVKVF

SEQ ID NO: 3372859 - protein, 19 aa, Plasmodium falciparum
SYGIICLGISFDKKLLALG

SEQ ID NO: 3372860 - protein, 18 aa, Plasmodium falciparum
SYGLYIFKVLKQVHPDTG

SEQ ID NO: 3372861 - protein, 19 aa, Plasmodium falciparum
SYGNKSGISDKYFNKHNNE

SEQ ID NO: 3372862 - protein, 25 aa, Plasmodium falciparum
SYGPCQFPTLGFVVNRYLDIKNFKN

SEQ ID NO: 3372863 - protein, 17 aa, Plasmodium falciparum
SYIAFSCVVGIERPELE

SEQ ID NO: 3372864 - protein, 37 aa, Plasmodium falciparum
SYICNICSYNEAIIYCKDCVEYLCKECCDNIHEMDIL

SEQ ID NO: 3372865 - protein, 17 aa, Plasmodium falciparum
SYIDIIINIIEEYLPFL

SEQ ID NO: 3372866 - protein, 30 aa, Plasmodium falciparum
SYIGVEWKLQLEIIKYKMIEIINKKLQKYT

SEQ ID NO: 3372867 - protein, 19 aa, Plasmodium falciparum
SYIHFSCHNSLFNTLFFFI

SEQ ID NO: 3372868 - protein, 24 aa, Plasmodium falciparum
SYIKAGLLLSLLGGKTIYDDNNQI

SEQ ID NO: 3372869 - protein, 17 aa, Plasmodium falciparum
SYIKPTFIFYSDIVQTK

SEQ ID NO: 3372870 - protein, 24 aa, Plasmodium falciparum
SYIKRGMYSFGNFNISVLYFLMNK

SEQ ID NO: 3372871 - protein, 25 aa, Plasmodium falciparum
SYINIKYFFLFILDVSNDYIIYENF

SEQ ID NO: 3372872 - protein, 28 aa, Plasmodium falciparum
SYINYNRLKCIKERLFNKNKEKKIINNL

SEQ ID NO: 3372873 - protein, 19 aa, Plasmodium falciparum
SYIPLIFIHIIDRFRLQSN

SEQ ID NO: 3372874 - protein, 17 aa, Plasmodium falciparum
SYISITNLLNLGLEGGV

SEQ ID NO: 3372875 - protein, 24 aa, Plasmodium falciparum
SYIYLNKDNMIFDNINKYNVSSNP

SEQ ID NO: 3372876 - protein, 21 aa, Plasmodium falciparum
SYKKAAFSFDFMNEDFITSFN

SEQ ID NO: 3372877 - protein, 19 aa, Plasmodium falciparum
SYKMCRSNIKIDEISSFFG

SEQ ID NO: 3372878 - protein, 31 aa, Plasmodium falciparum
SYKNRRHHNTYIKCCHDSHLYSREINDQGHD

SEQ ID NO: 3372879 - protein, 19 aa, Plasmodium falciparum
SYKNSHYKRKKGNSHNKHN

SEQ ID NO: 3372880 - protein, 25 aa, Plasmodium falciparum
SYKTLRKKMICLRHYANANTNTNAN

SEQ ID NO: 3372881 - protein, 18 aa, Plasmodium falciparum
SYLDDGASTILSKPDELE

SEQ ID NO: 3372882 - protein, 18 aa, Plasmodium falciparum
SYLKDYSYNVIINKIVRY

SEQ ID NO: 3372883 - protein, 18 aa, Plasmodium falciparum
SYLKKNKYLCIGRTNMNN

SEQ ID NO: 3372884 - protein, 25 aa, Plasmodium falciparum
SYLNYWHVLPCIGYYNKSTINNIIN

SEQ ID NO: 3372885 - protein, 19 aa, Plasmodium falciparum
SYMKYSLEYFFGYYDIKED

SEQ ID NO: 3372886 - protein, 17 aa, Plasmodium falciparum
SYMTMPYSNKKDIKYYK

SEQ ID NO: 3372887 - protein, 56 aa, Plasmodium falciparum
SYNDRKGSWLAYWSIGKNFQMRRFPIKKLGFEKAKELAIQCRLEAEQAGATTTENR

SEQ ID NO: 3372888 - protein, 18 aa, Plasmodium falciparum
SYNFLKKHNSTFDSLEKL

SEQ ID NO: 3372889 - protein, 24 aa, Plasmodium falciparum
SYNHSECNIIYPVINKSLDMDVKK

SEQ ID NO: 3372890 - protein, 23 aa, Plasmodium falciparum
SYNIFNHTFCINVHINPYKQKIS

SEQ ID NO: 3372891 - protein, 38 aa, Plasmodium falciparum
SYNITCLKSSLKMMYAYCLFKNLKLFYQIQYKNMNMTE

SEQ ID NO: 3372892 - protein, 18 aa, Plasmodium falciparum
SYNKCFHKNIKNITNSIT

SEQ ID NO: 3372893 - protein, 25 aa, Plasmodium falciparum
SYNKGKRQLIEYSNSIHDDKYYDIN

SEQ ID NO: 3372894 - protein, 18 aa, Plasmodium falciparum
SYNMKKHRLSYINEKLQE

SEQ ID NO: 3372895 - protein, 24 aa, Plasmodium falciparum
SYNNYLFCIKNLYHNNNNNNNSFF

SEQ ID NO: 3372896 - protein, 20 aa, Plasmodium falciparum
SYNPKIEIYSTCDFAVLMMD

SEQ ID NO: 3372897 - protein, 20 aa, Plasmodium falciparum
SYNPMALIYVCTNKHCHYWE

SEQ ID NO: 3372898 - protein, 26 aa, Plasmodium falciparum
SYNSLKINLFFLFDDMYDKFFIENYQ

SEQ ID NO: 3372899 - protein, 18 aa, Plasmodium falciparum
SYNTIKKKIMELTNIHIE

SEQ ID NO: 3372900 - protein, 23 aa, Plasmodium falciparum
SYNTKTLWVGDLEKIKDEVVDEN

SEQ ID NO: 3372901 - protein, 17 aa, Plasmodium falciparum
SYNYKPKPKCIVNTNHV

SEQ ID NO: 3372902 - protein, 24 aa, Plasmodium falciparum
SYPHSGCGIGLERVLMLFLGLNNI

SEQ ID NO: 3372903 - protein, 25 aa, Plasmodium falciparum
SYPKHVKLLSSYKMMETFNNNKNYI

SEQ ID NO: 3372904 - protein, 19 aa, Plasmodium falciparum
SYPKKDLFIGLNVQSILPL

SEQ ID NO: 3372905 - protein, 20 aa, Plasmodium falciparum
SYPLDKLHKHVKSIILENQV

SEQ ID NO: 3372906 - protein, 20 aa, Plasmodium falciparum
SYPLLKKAMSIICINIPSYS

SEQ ID NO: 3372907 - protein, 18 aa, Plasmodium falciparum
SYQKYELYSNDKLNMSLS

SEQ ID NO: 3372908 - protein, 27 aa, Plasmodium falciparum
SYQYHIYFKHKFLKEKNEINRKGSNNS

SEQ ID NO: 3372909 - protein, 24 aa, Plasmodium falciparum
SYRKLNELRIILKEIPIMCLTATC

SEQ ID NO: 3372910 - protein, 24 aa, Plasmodium falciparum
SYRMIYFFIQECIINFRKSYLHIL

SEQ ID NO: 3372911 - protein, 24 aa, Plasmodium falciparum
SYSGNMTFKENISFDKNNKLYNKN

SEQ ID NO: 3372912 - protein, 29 aa, Plasmodium falciparum
SYSKEKSELLCISPQILSHFNIFNGEYVA

SEQ ID NO: 3372913 - protein, 24 aa, Plasmodium falciparum
SYSKMKRWMSPFIKSYNKEFKCHK

SEQ ID NO: 3372914 - protein, 21 aa, Plasmodium falciparum
SYSLDCFSYKLSTKDGTEKKD

SEQ ID NO: 3372915 - protein, 19 aa, Plasmodium falciparum
SYSLIGIYVVKDLYMRGDE

SEQ ID NO: 3372916 - protein, 22 aa, Plasmodium falciparum
SYSPGYKFNHWELRGIPIRIEV

SEQ ID NO: 3372917 - protein, 30 aa, Plasmodium falciparum
SYSSFRRIDSICNNFNFSMIKYSNKHNNNN

SEQ ID NO: 3372918 - protein, 17 aa, Plasmodium falciparum
SYSVLQKGLKLKVHKQI

SEQ ID NO: 3372919 - protein, 23 aa, Plasmodium falciparum
SYTIPSMDRYNFQQTYKNLKQIY

SEQ ID NO: 3372920 - protein, 19 aa, Plasmodium falciparum
SYTNYSISFGFNDDIKKKT

SEQ ID NO: 3372921 - protein, 26 aa, Plasmodium falciparum
SYTTNDFKNLLGWVPRNLKISECTNT

SEQ ID NO: 3372922 - protein, 19 aa, Plasmodium falciparum
SYVAASCLYTICRREKSPI

SEQ ID NO: 3372923 - protein, 20 aa, Plasmodium falciparum
SYVAASCLYTICRREKSPIM

SEQ ID NO: 3372924 - protein, 17 aa, Plasmodium falciparum
SYVFYKKDMCDENNNIS

SEQ ID NO: 3372925 - protein, 17 aa, Plasmodium falciparum
SYVHWDNMIVLKEFFKI

SEQ ID NO: 3372926 - protein, 20 aa, Plasmodium falciparum
SYVIPYYYNNRHNINSSTSL

SEQ ID NO: 3372927 - protein, 21 aa, Plasmodium falciparum
SYYFKRLFSNPSYYIKEVQYV

SEQ ID NO: 3372928 - protein, 19 aa, Plasmodium falciparum
SYYKEIFKYFKELRSNMSK

SEQ ID NO: 3372929 - protein, 21 aa, Plasmodium falciparum
SYYKYISKSLSYVFNLAQPLV

SEQ ID NO: 3372930 - protein, 17 aa, Plasmodium falciparum
SYYPGMKYKGAGAEEDD

SEQ ID NO: 3372931 - protein, 22 aa, Plasmodium falciparum
SYYYNHILYRLRMKNKYEDIIH

SEQ ID NO: 3372932 - protein, 21 aa, Plasmodium falciparum
TAAVIMARFAVLKAETDEPID

SEQ ID NO: 3372933 - protein, 21 aa, Plasmodium falciparum
TACASICRKLLNIVLGNLQVV

SEQ ID NO: 3372934 - protein, 20 aa, Plasmodium falciparum
TADIWSFACMVFELVTGDFL

SEQ ID NO: 3372935 - protein, 23 aa, Plasmodium falciparum
TADKSKLYLLFQNIHGSILKTYS

SEQ ID NO: 3372936 - protein, 18 aa, Plasmodium falciparum
TAGHIAGYKMDYKLLNKL

SEQ ID NO: 3372937 - protein, 33 aa, Plasmodium falciparum
TAKALCKLFAFVNNEFFFPSYIINKIRKKYTID

SEQ ID NO: 3372938 - protein, 17 aa, Plasmodium falciparum
TALRALMKYGDEWIQKY

SEQ ID NO: 3372939 - protein, 25 aa, Plasmodium falciparum
TALREDFSFEHILWVYSGRRGIHCW

SEQ ID NO: 3372940 - protein, 21 aa, Plasmodium falciparum
TAPEKMNCPQMMANHNFNNIP

SEQ ID NO: 3372941 - protein, 17 aa, Plasmodium falciparum
TAQTCVFLDYMYKTGTI

SEQ ID NO: 3372942 - protein, 25 aa, Plasmodium falciparum
TARFYLQCIEKLKFLQYGTKQYKYF

SEQ ID NO: 3372943 - protein, 21 aa, Plasmodium falciparum
TATPAPFGSAFGAQKNNDSLF

SEQ ID NO: 3372944 - protein, 19 aa, Plasmodium falciparum
TAYSIYFSVFLKRLKSYVS

SEQ ID NO: 3372945 - protein, 19 aa, Plasmodium falciparum
TCEMKENFMKDAINNNKSC

SEQ ID NO: 3372946 - protein, 23 aa, Plasmodium falciparum
TCEMLKDHFHYYVYKTNRIKKAF

SEQ ID NO: 3372947 - protein, 17 aa, Plasmodium falciparum
TCEVCFDCNELKSLIEI

SEQ ID NO: 3372948 - protein, 23 aa, Plasmodium falciparum
TCFLNSSLQCLSKILKFSNYFLN

SEQ ID NO: 3372949 - protein, 52 aa, Plasmodium falciparum
TCGIYRKKYTCYNISTIPWFGYKNWGVLKNCMKKDMVSIRIDIHDIKEKNEI

SEQ ID NO: 3372950 - protein, 18 aa, Plasmodium falciparum
TCHMKKGLKYLVDKYDIA

SEQ ID NO: 3372951 - protein, 17 aa, Plasmodium falciparum
TCISPKNNSVVLNNTNM

SEQ ID NO: 3372952 - protein, 26 aa, Plasmodium falciparum
TCKKFKVNHLYFIPKLKALVHVNHLK

SEQ ID NO: 3372953 - protein, 26 aa, Plasmodium falciparum
TCLSLCFCSECAINGIHTNNCNIENI

SEQ ID NO: 3372954 - protein, 25 aa, Plasmodium falciparum
TCNIKKKRESFFKKINILQKYKNYK

SEQ ID NO: 3372955 - protein, 24 aa, Plasmodium falciparum
TCNLIDCNTCWYKYIIYKKNNSYY

SEQ ID NO: 3372956 - protein, 32 aa, Plasmodium falciparum
TCNLKKKCFDDCLLYLKQLYTFIKNYENNNDK

SEQ ID NO: 3372957 - protein, 23 aa, Plasmodium falciparum
TCPDCKEKGIIICDTSEGTQICN

SEQ ID NO: 3372958 - protein, 19 aa, Plasmodium falciparum
TCPFAAAVCVKPEFVKFIN

SEQ ID NO: 3372959 - protein, 19 aa, Plasmodium falciparum
TCPILFKHKLLKKKSKLNE

SEQ ID NO: 3372960 - protein, 23 aa, Plasmodium falciparum
TCPILPTVLNYVLLPTIDMIKND

SEQ ID NO: 3372961 - protein, 23 aa, Plasmodium falciparum
TCPYLLYVPRQGYFCSHHIGSQS

SEQ ID NO: 3372962 - protein, 25 aa, Plasmodium falciparum
TCSNYSFPIVLILSAYTKHCNDSHM

SEQ ID NO: 3372963 - protein, 21 aa, Plasmodium falciparum
TCSTYKKDNMVNILHTNKVKN

SEQ ID NO: 3372964 - protein, 18 aa, Plasmodium falciparum
TCSYKYRYFIVPFSKLLS

SEQ ID NO: 3372965 - protein, 23 aa, Plasmodium falciparum
TCTHEKYEYCLKLEKNNFDVNIE

SEQ ID NO: 3372966 - protein, 24 aa, Plasmodium falciparum
TCTVPFDGSTEWFIYNKIKRRELK

SEQ ID NO: 3372967 - protein, 28 aa, Plasmodium falciparum
TCVTNTYAECLLNFIYALDYIKYNVPLY

SEQ ID NO: 3372968 - protein, 22 aa, Plasmodium falciparum
TCVYNYKHILKNILYLENVIEK

SEQ ID NO: 3372969 - protein, 21 aa, Plasmodium falciparum
TDARRLGIRSPWRMVRSRYYV

SEQ ID NO: 3372970 - protein, 20 aa, Plasmodium falciparum
TDCLIKCSLYEIWLDNQQKE

SEQ ID NO: 3372971 - protein, 23 aa, Plasmodium falciparum
TDCRMLPKNVLLYGIKNIKKILR

SEQ ID NO: 3372972 - protein, 17 aa, Plasmodium falciparum
TDDIFLFCIETKKNDNS

SEQ ID NO: 3372973 - protein, 26 aa, Plasmodium falciparum
TDDKKIREFFFFYEHMNNKNVGEQHH

SEQ ID NO: 3372974 - protein, 18 aa, Plasmodium falciparum
TDDYFSVSIENIKIEGRE

SEQ ID NO: 3372975 - protein, 17 aa, Plasmodium falciparum
TDEFYLRNLDLFDSSGL

SEQ ID NO: 3372976 - protein, 31 aa, Plasmodium falciparum
TDEINWFSEFFLPYKIGDYIENLIVQIWANS

SEQ ID NO: 3372977 - protein, 22 aa, Plasmodium falciparum
TDFFSRAVGYNNNYLNNNNNMN

SEQ ID NO: 3372978 - protein, 24 aa, Plasmodium falciparum
TDFSMCAGELIEVYYYDKEYFDGV

SEQ ID NO: 3372979 - protein, 20 aa, Plasmodium falciparum
TDGHIQILFCDGKRKEILPN

SEQ ID NO: 3372980 - protein, 23 aa, Plasmodium falciparum
TDGSNAFGRRYENISERTLYKDY

SEQ ID NO: 3372981 - protein, 22 aa, Plasmodium falciparum
TDIKFIKLCHVLAKKTKKYSGA

SEQ ID NO: 3372982 - protein, 23 aa, Plasmodium falciparum
TDIKLNTLCLMAKDCLKSQIAGE

SEQ ID NO: 3372983 - protein, 21 aa, Plasmodium falciparum
TDIMKNNSFFGSSINTQNDLN

SEQ ID NO: 3372984 - protein, 21 aa, Plasmodium falciparum
TDINCGFAAIRPPGHHCSRSH

SEQ ID NO: 3372985 - protein, 17 aa, Plasmodium falciparum
TDINSNINFINHINNNS

SEQ ID NO: 3372986 - protein, 22 aa, Plasmodium falciparum
TDIRKEICKIIEIYNETSSNFK

SEQ ID NO: 3372987 - protein, 19 aa, Plasmodium falciparum
TDISISVVEIYLEKIRDLG

SEQ ID NO: 3372988 - protein, 25 aa, Plasmodium falciparum
TDIVKNIDCVISPYKDPNIIMDRIN

SEQ ID NO: 3372989 - protein, 23 aa, Plasmodium falciparum
TDKADDISVCDTISVIEKKEDFE

SEQ ID NO: 3372990 - protein, 26 aa, Plasmodium falciparum
TDKDMKWCILCGISTQDQGKSIDGYM

SEQ ID NO: 3372991 - protein, 21 aa, Plasmodium falciparum
TDKLNSIFNMATNVLNNSFFY

SEQ ID NO: 3372992 - protein, 28 aa, Plasmodium falciparum
TDKVADIEVCYCPTLDPNSYYAWNDSRV

SEQ ID NO: 3372993 - protein, 32 aa, Plasmodium falciparum
TDLHYLSHLVFRVWERKHLKRDDSNRFRIEIL

SEQ ID NO: 3372994 - protein, 17 aa, Plasmodium falciparum
TDLKRQLIVPQFSDIIL

SEQ ID NO: 3372995 - protein, 17 aa, Plasmodium falciparum
TDLLSVMSNYSYKNNYS

SEQ ID NO: 3372996 - protein, 26 aa, Plasmodium falciparum
TDLNKKKEECVILKNNLETVTMEKHD

SEQ ID NO: 3372997 - protein, 26 aa, Plasmodium falciparum
TDLPLYYSHIKNIFIPKMLISEGSSF

SEQ ID NO: 3372998 - protein, 20 aa, Plasmodium falciparum
TDLPSPFFFEISSMFLENNC

SEQ ID NO: 3372999 - protein, 37 aa, Plasmodium falciparum
TDLSNRSALHYAVYRNNCDYVKFLIYEEKANVNILDI

SEQ ID NO: 3373000 - protein, 20 aa, Plasmodium falciparum
TDMFIKESIYYGANFSLQNN

SEQ ID NO: 3373001 - protein, 18 aa, Plasmodium falciparum
TDMPERFFNIYKKRQKKL

SEQ ID NO: 3373002 - protein, 18 aa, Plasmodium falciparum
TDMYNWYIIQINKDVYID

SEQ ID NO: 3373003 - protein, 23 aa, Plasmodium falciparum
TDNEIFIDKSLQGWKEIEYELLR

SEQ ID NO: 3373004 - protein, 23 aa, Plasmodium falciparum
TDNFKLFLIIKIFNNISNKFKDI

SEQ ID NO: 3373005 - protein, 19 aa, Plasmodium falciparum
TDNGFEYIENLYFQKINDY

SEQ ID NO: 3373006 - protein, 24 aa, Plasmodium falciparum
TDNIRYSNICALNNGQNSCKPNVI

SEQ ID NO: 3373007 - protein, 25 aa, Plasmodium falciparum
TDNPSCRLDCILIAKMNKECIGYNN

SEQ ID NO: 3373008 - protein, 24 aa, Plasmodium falciparum
TDNTYKLAISYCVNDYQKILHNSP

SEQ ID NO: 3373009 - protein, 36 aa, Plasmodium falciparum
TDPRLHFIKRKILFMMQLWHDSFILHQHICTAIFAE

SEQ ID NO: 3373010 - protein, 18 aa, Plasmodium falciparum
TDQNYIFYRIINEETNVR

SEQ ID NO: 3373011 - protein, 17 aa, Plasmodium falciparum
TDRCSRNLYGETLPVNP

SEQ ID NO: 3373012 - protein, 23 aa, Plasmodium falciparum
TDRKCTHDFFGLVKDGASIDEIK

SEQ ID NO: 3373013 - protein, 19 aa, Plasmodium falciparum
TDSHLKLFRQEQLILLAEN

SEQ ID NO: 3373014 - protein, 18 aa, Plasmodium falciparum
TDVIHSWSIPSLGIKADA

SEQ ID NO: 3373015 - protein, 20 aa, Plasmodium falciparum
TDVQKLYGFYNFEKELYEDG

SEQ ID NO: 3373016 - protein, 19 aa, Plasmodium falciparum
TDYFGELALIKNIKRTANV

SEQ ID NO: 3373017 - protein, 21 aa, Plasmodium falciparum
TDYYIGSILGYSDFMNKMKYQ

SEQ ID NO: 3373018 - protein, 26 aa, Plasmodium falciparum
TEALKRLKNYLPYLCKILIDNTVYTK

SEQ ID NO: 3373019 - protein, 25 aa, Plasmodium falciparum
TEALRRSSIKRSTVDYEKKNLKSES

SEQ ID NO: 3373020 - protein, 23 aa, Plasmodium falciparum
TEDIKFVSWCPLSENTFISLSYD

SEQ ID NO: 3373021 - protein, 24 aa, Plasmodium falciparum
TEDIYKYDQIYILKDGSYGILKDV

SEQ ID NO: 3373022 - protein, 32 aa, Plasmodium falciparum
TEEDRVNCPFFWKIGACRHGDQCSRSHYKPNC

SEQ ID NO: 3373023 - protein, 26 aa, Plasmodium falciparum
TEEEDLKIIFSRFGNIKSCKIIKDKV

SEQ ID NO: 3373024 - protein, 18 aa, Plasmodium falciparum
TEEFIKKKIDAIKSTNYQ

SEQ ID NO: 3373025 - protein, 24 aa, Plasmodium falciparum
TEEKKIGTKKMKPFVPLEYRESFR

SEQ ID NO: 3373026 - protein, 25 aa, Plasmodium falciparum
TEESSCIKRTYFVDQFYDSYNMRNE

SEQ ID NO: 3373027 - protein, 18 aa, Plasmodium falciparum
TEFKSFKTPTNINVPIAP

SEQ ID NO: 3373028 - protein, 37 aa, Plasmodium falciparum
TEFRRICLKWKAKKIKRRSRLKKREKGDEESEDDIKD

SEQ ID NO: 3373029 - protein, 26 aa, Plasmodium falciparum
TEFYERYIRIIPLCRMNDASIKFLGD

SEQ ID NO: 3373030 - protein, 19 aa, Plasmodium falciparum
TEGFSLDWNPVHAAQLLTG

SEQ ID NO: 3373031 - protein, 29 aa, Plasmodium falciparum
TEGKECDKVYEDIAWTFVKYIENNNINLM

SEQ ID NO: 3373032 - protein, 20 aa, Plasmodium falciparum
TEGLISFLVTLGVVPIIRVS

SEQ ID NO: 3373033 - protein, 22 aa, Plasmodium falciparum
TEIKMEITAGVGGFEAKMFSKE

SEQ ID NO: 3373034 - protein, 24 aa, Plasmodium falciparum
TEIKTKYFSAQRFGHATAKKIALN

SEQ ID NO: 3373035 - protein, 17 aa, Plasmodium falciparum
TEILRSMLYRGSSLTKE

SEQ ID NO: 3373036 - protein, 19 aa, Plasmodium falciparum
TEINFIPDIDPIDVTNVNI

SEQ ID NO: 3373037 - protein, 20 aa, Plasmodium falciparum
TEIRKLMLTLCITKIDFDCE

SEQ ID NO: 3373038 - protein, 26 aa, Plasmodium falciparum
TEKHIKNIWTFFNFKIFNNKLPSFDF

SEQ ID NO: 3373039 - protein, 22 aa, Plasmodium falciparum
TEKIILPFDDWMVLSETQLRYI

SEQ ID NO: 3373040 - protein, 18 aa, Plasmodium falciparum
TEKIKDSEKIGGKIEVDN

SEQ ID NO: 3373041 - protein, 24 aa, Plasmodium falciparum
TEKKKLLLCFGNNNFGQLGLEDNV

SEQ ID NO: 3373042 - protein, 21 aa, Plasmodium falciparum
TEKSRYVIMIVDLNSYKILSL

SEQ ID NO: 3373043 - protein, 24 aa, Plasmodium falciparum
TELADNVSRDMCRGEIIQDETTYQ

SEQ ID NO: 3373044 - protein, 20 aa, Plasmodium falciparum
TELYDKILYDYKLNQHKYPS

SEQ ID NO: 3373045 - protein, 32 aa, Plasmodium falciparum
TEMKDKILFELLSLKFASIFNDILQLDNNFDN

SEQ ID NO: 3373046 - protein, 24 aa, Plasmodium falciparum
TENEKYMYERTCLMNEKRQNDMAT

SEQ ID NO: 3373047 - protein, 44 aa, Plasmodium falciparum
TEQMVKRAKKFPMVQGVYFDRYQQRWSVNWIEDGKRVAKYFPIK

SEQ ID NO: 3373048 - protein, 20 aa, Plasmodium falciparum
TESKIYKSSNIILQNIETDI

SEQ ID NO: 3373049 - protein, 23 aa, Plasmodium falciparum
TEYLPSNLLNSISINNVSQSNQI

SEQ ID NO: 3373050 - protein, 22 aa, Plasmodium falciparum
TEYNLLLPRSIFRKWTRTLYYY

SEQ ID NO: 3373051 - protein, 21 aa, Plasmodium falciparum
TFCSFLKILKPPNVSALLNYN

SEQ ID NO: 3373052 - protein, 19 aa, Plasmodium falciparum
TFCSYKYSARCAKEKVEWK

SEQ ID NO: 3373053 - protein, 28 aa, Plasmodium falciparum
TFDKRKGIKNMECKKSIECVDDKNKLSI

SEQ ID NO: 3373054 - protein, 32 aa, Plasmodium falciparum
TFEEKKRICSHFLKSIHLLEILCGYSHDYLRD

SEQ ID NO: 3373055 - protein, 19 aa, Plasmodium falciparum
TFEGKRIVNRMCNKKYNYD

SEQ ID NO: 3373056 - protein, 18 aa, Plasmodium falciparum
TFEISFDFLRDCETNTTV

SEQ ID NO: 3373057 - protein, 24 aa, Plasmodium falciparum
TFEKYKYLICENINNDKFVIKNNQ

SEQ ID NO: 3373058 - protein, 18 aa, Plasmodium falciparum
TFEQIIFKTSEAVLKYNL

SEQ ID NO: 3373059 - protein, 19 aa, Plasmodium falciparum
TFFPHLKHISTIYSGIDVT

SEQ ID NO: 3373060 - protein, 24 aa, Plasmodium falciparum
TFGKTKIFFRFGVLSIINEILNKN

SEQ ID NO: 3373061 - protein, 25 aa, Plasmodium falciparum
TFIKRIKPDVIVVGIRDIPSYLVYS

SEQ ID NO: 3373062 - protein, 40 aa, Plasmodium falciparum
TFIQCVYKYWLHIRKRRLLNFVLFGCRFKILFKKRRAKLL

SEQ ID NO: 3373063 - protein, 18 aa, Plasmodium falciparum
TFIYDWKKALKRVEEGRN

SEQ ID NO: 3373064 - protein, 18 aa, Plasmodium falciparum
TFKGRTFAGRKVQASFAT

SEQ ID NO: 3373065 - protein, 27 aa, Plasmodium falciparum
TFKRTATYFYYEFNLRDIHSIVKGLLT

SEQ ID NO: 3373066 - protein, 25 aa, Plasmodium falciparum
TFLEFKKPKLCASLQSNTYIVTGKF

SEQ ID NO: 3373067 - protein, 29 aa, Plasmodium falciparum
TFLENELFKSFLFTYPVYYMNARQKNKSL

SEQ ID NO: 3373068 - protein, 17 aa, Plasmodium falciparum
TFLIEYVQLEMFDQIIK

SEQ ID NO: 3373069 - protein, 19 aa, Plasmodium falciparum
TFLKNWKIIVSILNEHVTL

SEQ ID NO: 3373070 - protein, 19 aa, Plasmodium falciparum
TFLPLALMDKCIGSKIWIM

SEQ ID NO: 3373071 - protein, 18 aa, Plasmodium falciparum
TFNFPLCILSILEKKFIN

SEQ ID NO: 3373072 - protein, 22 aa, Plasmodium falciparum
TFNIPRYTPLHIEEEKNTEEIE

SEQ ID NO: 3373073 - protein, 31 aa, Plasmodium falciparum
TFNKFLMNKIKVVKRNVHFFGKDMNNKKKNK

SEQ ID NO: 3373074 - protein, 23 aa, Plasmodium falciparum
TFNNDCRTLFIGSIFINNINQVP

SEQ ID NO: 3373075 - protein, 19 aa, Plasmodium falciparum
TFNTIGIGLLSLELMNHCE

SEQ ID NO: 3373076 - protein, 26 aa, Plasmodium falciparum
TFQYVCPSCEIVYCSVECYKLHNSSC

SEQ ID NO: 3373077 - protein, 17 aa, Plasmodium falciparum
TFRKNIRVKTDYMPQEE

SEQ ID NO: 3373078 - protein, 25 aa, Plasmodium falciparum
TFSNCGQRVNQLKCLNTYNNKLNEE

SEQ ID NO: 3373079 - protein, 20 aa, Plasmodium falciparum
TFSRFLFPKNPRAFTNLVEY

SEQ ID NO: 3373080 - protein, 18 aa, Plasmodium falciparum
TFSSPREAFKVMQQPERI

SEQ ID NO: 3373081 - protein, 19 aa, Plasmodium falciparum
TFVKFLMCNQFLKVKPTEG

SEQ ID NO: 3373082 - protein, 24 aa, Plasmodium falciparum
TFWYYELKEMKGFQDLVMYEVKKK

SEQ ID NO: 3373083 - protein, 25 aa, Plasmodium falciparum
TFYEKKTNISLCLKNQNLIKERENN

SEQ ID NO: 3373084 - protein, 25 aa, Plasmodium falciparum
TFYFEEFDFNFVLLGSVKKGSDRHK

SEQ ID NO: 3373085 - protein, 18 aa, Plasmodium falciparum
TFYFELFINSYLYNRYVC

SEQ ID NO: 3373086 - protein, 26 aa, Plasmodium falciparum
TGAGICYRLYTENTFLCDLYQNNIPE

SEQ ID NO: 3373087 - protein, 20 aa, Plasmodium falciparum
TGCDPLRIFLHEDGLVRFSI

SEQ ID NO: 3373088 - protein, 22 aa, Plasmodium falciparum
TGCIKAKLLLTYSLNSYNEKKD

SEQ ID NO: 3373089 - protein, 18 aa, Plasmodium falciparum
TGDVPSFMIDIHDVNAKE

SEQ ID NO: 3373090 - protein, 18 aa, Plasmodium falciparum
TGESLSYMNQIQKLPFKR

SEQ ID NO: 3373091 - protein, 17 aa, Plasmodium falciparum
TGGILIVDGCPFKWDEG

SEQ ID NO: 3373092 - protein, 22 aa, Plasmodium falciparum
TGHEAVTYNINWNIPENINRTT

SEQ ID NO: 3373093 - protein, 25 aa, Plasmodium falciparum
TGHTLRLLAFPDLLKKALGYLINIR

SEQ ID NO: 3373094 - protein, 33 aa, Plasmodium falciparum
TGILLYYKNRLIKRLDAPFIDTAYNLALAKYPP

SEQ ID NO: 3373095 - protein, 29 aa, Plasmodium falciparum
TGKASCACKMKCYFFYSQNKNLTNIEKCT

SEQ ID NO: 3373096 - protein, 25 aa, Plasmodium falciparum
TGKIIKLRIRNFLNHENLELTFNSY

SEQ ID NO: 3373097 - protein, 37 aa, Plasmodium falciparum
TGKLNLGTSLSNWDPSCHYMSLIFLYIKNLFYLQEEY

SEQ ID NO: 3373098 - protein, 19 aa, Plasmodium falciparum
TGKLSPRFYQYVNMKELKD

SEQ ID NO: 3373099 - protein, 17 aa, Plasmodium falciparum
TGLFAKRVIGMMEKNAE

SEQ ID NO: 3373100 - protein, 26 aa, Plasmodium falciparum
TGLGKGCSFVKFSYKEQALYAIKSLN

SEQ ID NO: 3373101 - protein, 23 aa, Plasmodium falciparum
TGMGIKTAYNLIFQHKNIENIFH

SEQ ID NO: 3373102 - protein, 21 aa, Plasmodium falciparum
TGNCTWRNNNIYYKKNEIYID

SEQ ID NO: 3373103 - protein, 27 aa, Plasmodium falciparum
TGNKLLQYIYRKKCAIEKITYEKKSDK

SEQ ID NO: 3373104 - protein, 18 aa, Plasmodium falciparum
TGNLMCSSCCLFKDNPYN

SEQ ID NO: 3373105 - protein, 18 aa, Plasmodium falciparum
TGRSKVGILSAFGEENLK

SEQ ID NO: 3373106 - protein, 24 aa, Plasmodium falciparum
TGSGFGCLMLERLSVDYGKKSKLN

SEQ ID NO: 3373107 - protein, 19 aa, Plasmodium falciparum
TGSLTGKVCLYKITIKENK

SEQ ID NO: 3373108 - protein, 17 aa, Plasmodium falciparum
TGSNLYITRYIKRKNNN

SEQ ID NO: 3373109 - protein, 23 aa, Plasmodium falciparum
TGTFCRTLLPLFIPLSIYQYIRQ

SEQ ID NO: 3373110 - protein, 20 aa, Plasmodium falciparum
TGTGCLTYALANSVLPNGVI

SEQ ID NO: 3373111 - protein, 17 aa, Plasmodium falciparum
TGVGKTQLCKKILNEEK

SEQ ID NO: 3373112 - protein, 17 aa, Plasmodium falciparum
TGVPCIVDLATMRDTAE

SEQ ID NO: 3373113 - protein, 17 aa, Plasmodium falciparum
TGYTHKFVPKWDIHEVP

SEQ ID NO: 3373114 - protein, 26 aa, Plasmodium falciparum
THACVLEFSSNEGIIFVSDNIKENLG

SEQ ID NO: 3373115 - protein, 22 aa, Plasmodium falciparum
THAKWSPVCTAVYKMYPHFSFN

SEQ ID NO: 3373116 - protein, 18 aa, Plasmodium falciparum
THAPLSPRIRKVGDIEFH

SEQ ID NO: 3373117 - protein, 22 aa, Plasmodium falciparum
THCEIHPSLILGVCASIIPFSD

SEQ ID NO: 3373118 - protein, 23 aa, Plasmodium falciparum
THDDRQKHCFLFIDDYLTSNENK

SEQ ID NO: 3373119 - protein, 19 aa, Plasmodium falciparum
THEKCKLLRNNFIIYKKEK

SEQ ID NO: 3373120 - protein, 18 aa, Plasmodium falciparum
THEKEHFAELAVNAILRI

SEQ ID NO: 3373121 - protein, 19 aa, Plasmodium falciparum
THELLKLLLDKVEEQMKGT

SEQ ID NO: 3373122 - protein, 21 aa, Plasmodium falciparum
THGKNGITISSHMILSNQKVN

SEQ ID NO: 3373123 - protein, 22 aa, Plasmodium falciparum
THKKLRPIRFVRHVDVKLDNLN

SEQ ID NO: 3373124 - protein, 25 aa, Plasmodium falciparum
THKTSRRFSIKIKRDKNNPREHVYI

SEQ ID NO: 3373125 - protein, 24 aa, Plasmodium falciparum
THKYKYRSNIIFTINKIKNLESII

SEQ ID NO: 3373126 - protein, 21 aa, Plasmodium falciparum
THLIVCLLPDGGINKLRVYGE

SEQ ID NO: 3373127 - protein, 19 aa, Plasmodium falciparum
THLMYLLFDLLNLRCAELH

SEQ ID NO: 3373128 - protein, 28 aa, Plasmodium falciparum
THLSALAWLCQLLIFEVECFNDINEEKD

SEQ ID NO: 3373129 - protein, 23 aa, Plasmodium falciparum
THLSRINPLLAKSKVRKPNEEKH

SEQ ID NO: 3373130 - protein, 23 aa, Plasmodium falciparum
THNIIKYFCEFLYKDNFPTLRSL

SEQ ID NO: 3373131 - protein, 25 aa, Plasmodium falciparum
THTTLLRKGKKNFKFIDETKNKNKY

SEQ ID NO: 3373132 - protein, 17 aa, Plasmodium falciparum
THVCAGTMQGYRATEED

SEQ ID NO: 3373133 - protein, 24 aa, Plasmodium falciparum
THYKKDRINVLSGKNINVEDINFR

SEQ ID NO: 3373134 - protein, 23 aa, Plasmodium falciparum
TIAHLRKEINYEKLSKDTLNRDY

SEQ ID NO: 3373135 - protein, 18 aa, Plasmodium falciparum
TIASTLFDINHENPREHI

SEQ ID NO: 3373136 - protein, 18 aa, Plasmodium falciparum
TICGLVCQNAVILGADTR

SEQ ID NO: 3373137 - protein, 21 aa, Plasmodium falciparum
TICKVCNGSGIQRMERGPIII

SEQ ID NO: 3373138 - protein, 19 aa, Plasmodium falciparum
TICMNCNNVSLKYEQYYEL

SEQ ID NO: 3373139 - protein, 32 aa, Plasmodium falciparum
TIDELFKILDIWKKTHHIIPNVLSRLYQLKKI

SEQ ID NO: 3373140 - protein, 24 aa, Plasmodium falciparum
TIDFKIYPPILMKNITQLNIYIEN

SEQ ID NO: 3373141 - protein, 22 aa, Plasmodium falciparum
TIDMIKNFLFCKNVTNKIYKDE

SEQ ID NO: 3373142 - protein, 18 aa, Plasmodium falciparum
TIEPCEKCIKDADVKKEE

SEQ ID NO: 3373143 - protein, 24 aa, Plasmodium falciparum
TIFPRNLHESEILYTLFPHEPHTF

SEQ ID NO: 3373144 - protein, 20 aa, Plasmodium falciparum
TIFRRTFGSVSFSYDINKNI

SEQ ID NO: 3373145 - protein, 19 aa, Plasmodium falciparum
TIFSPKNIFCKKIISKKEK

SEQ ID NO: 3373146 - protein, 20 aa, Plasmodium falciparum
TIIHRCIPKNISHNLHTNET

SEQ ID NO: 3373147 - protein, 23 aa, Plasmodium falciparum
TIILDRIIEQLIIYYKEKDIDID

SEQ ID NO: 3373148 - protein, 27 aa, Plasmodium falciparum
TIKDYYGVLTLVDLVGCEREEFNTNKN

SEQ ID NO: 3373149 - protein, 29 aa, Plasmodium falciparum
TIKERIIPYAVDYYLGIIIESESNSIVSD

SEQ ID NO: 3373150 - protein, 18 aa, Plasmodium falciparum
TIKISLNINTKFNESYLD

SEQ ID NO: 3373151 - protein, 22 aa, Plasmodium falciparum
TIKNRIKIMCIITLDTFYRDVL

SEQ ID NO: 3373152 - protein, 28 aa, Plasmodium falciparum
TIKNSIKNGKSFITRYKNLFAKERNIVE

SEQ ID NO: 3373153 - protein, 18 aa, Plasmodium falciparum
TILECYNCACRNVFLLGF

SEQ ID NO: 3373154 - protein, 26 aa, Plasmodium falciparum
TILETGQDILFFWVARMVMVSLHLMK

SEQ ID NO: 3373155 - protein, 17 aa, Plasmodium falciparum
TILFYTKKYDKIKKKII

SEQ ID NO: 3373156 - protein, 18 aa, Plasmodium falciparum
TILIMSLMEFLFDKPKSI

SEQ ID NO: 3373157 - protein, 20 aa, Plasmodium falciparum
TILLRGANDFVLDEMQRSIH

SEQ ID NO: 3373158 - protein, 25 aa, Plasmodium falciparum
TILLWKCNIFKTFSLSLFFYSFNYM

SEQ ID NO: 3373159 - protein, 19 aa, Plasmodium falciparum
TILMYPKLFNQMTYNQYIF

SEQ ID NO: 3373160 - protein, 24 aa, Plasmodium falciparum
TILNDYTYYFSVDMVNSITSESIT

SEQ ID NO: 3373161 - protein, 25 aa, Plasmodium falciparum
TILPPADFMNAWLKHCQFREQIEKN

SEQ ID NO: 3373162 - protein, 17 aa, Plasmodium falciparum
TILRRGARHRRRNPRKR

SEQ ID NO: 3373163 - protein, 34 aa, Plasmodium falciparum
TILYFKEFDCKVFGFLYACFLSLEYKQLYLDYFL

SEQ ID NO: 3373164 - protein, 25 aa, Plasmodium falciparum
TIMINKCKRLSFYDNYNKKFKKSTD

SEQ ID NO: 3373165 - protein, 17 aa, Plasmodium falciparum
TIMKCKLYNLKKNVYKN

SEQ ID NO: 3373166 - protein, 27 aa, Plasmodium falciparum
TINGHICKDEKMLFPYFIEATYDKNTD

SEQ ID NO: 3373167 - protein, 25 aa, Plasmodium falciparum
TINHLVEWPPFILSVEDIEIASLER

SEQ ID NO: 3373168 - protein, 25 aa, Plasmodium falciparum
TINNIPLRFSKYYLKEKKKKKKYLK

SEQ ID NO: 3373169 - protein, 24 aa, Plasmodium falciparum
TINNIRNGWGMLIYNDRVIFEGEY

SEQ ID NO: 3373170 - protein, 25 aa, Plasmodium falciparum
TINSRYPICQNYSAITAPEKMNCPQ

SEQ ID NO: 3373171 - protein, 36 aa, Plasmodium falciparum
TIPGACTVCNHIGHLPYQCRNFISLEKFDINNNMNN

SEQ ID NO: 3373172 - protein, 23 aa, Plasmodium falciparum
TIPNGIQFAEWVSSIKSQACHIV

SEQ ID NO: 3373173 - protein, 19 aa, Plasmodium falciparum
TIPYRAVNIISDYFEENEF

SEQ ID NO: 3373174 - protein, 30 aa, Plasmodium falciparum
TIQKKLCFFFKSLNFHYVYDSSLGELITLN

SEQ ID NO: 3373175 - protein, 19 aa, Plasmodium falciparum
TIRIDGMYALFYIALKCAE

SEQ ID NO: 3373176 - protein, 18 aa, Plasmodium falciparum
TIRNFIKIINKWKKVDSN

SEQ ID NO: 3373177 - protein, 23 aa, Plasmodium falciparum
TIRSLGCSALIELLNNNNNELYE

SEQ ID NO: 3373178 - protein, 19 aa, Plasmodium falciparum
TIRSRACEFSKHFKDLITD

SEQ ID NO: 3373179 - protein, 24 aa, Plasmodium falciparum
TISLRLLFRPHTQHLPYLHSTLGP

SEQ ID NO: 3373180 - protein, 23 aa, Plasmodium falciparum
TISSLKWNINGNFLATGLSNGVV

SEQ ID NO: 3373181 - protein, 17 aa, Plasmodium falciparum
TITEKDLLLAINKVIHG

SEQ ID NO: 3373182 - protein, 25 aa, Plasmodium falciparum
TITYEIKKSILIDNLCVKEKQKFLN

SEQ ID NO: 3373183 - protein, 18 aa, Plasmodium falciparum
TIVLCIILNEIIKFLFLN

SEQ ID NO: 3373184 - protein, 20 aa, Plasmodium falciparum
TIVMWIGRSINPQWIYAVFG

SEQ ID NO: 3373185 - protein, 25 aa, Plasmodium falciparum
TIWRGDNYPSVGIFASRDIQPNEPL

SEQ ID NO: 3373186 - protein, 22 aa, Plasmodium falciparum
TIYCIRMYNFICHLPEDNFVQA

SEQ ID NO: 3373187 - protein, 21 aa, Plasmodium falciparum
TIYCLIHTDGLIGFIKVTINQ

SEQ ID NO: 3373188 - protein, 20 aa, Plasmodium falciparum
TIYCRIPTGYEILRNFYHGI

SEQ ID NO: 3373189 - protein, 26 aa, Plasmodium falciparum
TIYEIVLCTLPWKRNQSFENYIKTII

SEQ ID NO: 3373190 - protein, 18 aa, Plasmodium falciparum
TIYHAKGNNSLKYRNKEY

SEQ ID NO: 3373191 - protein, 19 aa, Plasmodium falciparum
TIYLKKCFDNNITPEPGSP

SEQ ID NO: 3373192 - protein, 25 aa, Plasmodium falciparum
TIYMIDEFMEFLRIYDIKTIICDFN

SEQ ID NO: 3373193 - protein, 23 aa, Plasmodium falciparum
TKALRLDGMPALCIHGDKKQEER

SEQ ID NO: 3373194 - protein, 17 aa, Plasmodium falciparum
TKASRIGIRLGTLKNFE

SEQ ID NO: 3373195 - protein, 18 aa, Plasmodium falciparum
TKCCCKQSGMNVFNQNSN

SEQ ID NO: 3373196 - protein, 23 aa, Plasmodium falciparum
TKCPICRQEVQGLLQISIDKKDK

SEQ ID NO: 3373197 - protein, 24 aa, Plasmodium falciparum
TKCRLKLLKLERIKDYLLLEEEYI

SEQ ID NO: 3373198 - protein, 25 aa, Plasmodium falciparum
TKDGYKNCQNRSYININRNRNNLSN

SEQ ID NO: 3373199 - protein, 19 aa, Plasmodium falciparum
TKDKLFYDIEYIKDISYDN

SEQ ID NO: 3373200 - protein, 18 aa, Plasmodium falciparum
TKEEEEEMELLKLYNNNN

SEQ ID NO: 3373201 - protein, 28 aa, Plasmodium falciparum
TKEEIYNLFDGYRIKRINILNKKGKTAA

SEQ ID NO: 3373202 - protein, 22 aa, Plasmodium falciparum
TKEELANLFGLTSISEQMWNEV

SEQ ID NO: 3373203 - protein, 24 aa, Plasmodium falciparum
TKEEVMSLLIWIPYWNHVIPTPAI

SEQ ID NO: 3373204 - protein, 35 aa, Plasmodium falciparum
TKEGCNLLKLTVFNIPHLRYFFVSKDLNFIKWYSS

SEQ ID NO: 3373205 - protein, 17 aa, Plasmodium falciparum
TKEGLSILENMNMQDVV

SEQ ID NO: 3373206 - protein, 22 aa, Plasmodium falciparum
TKEIIRPNIASFKESPIGEKGK

SEQ ID NO: 3373207 - protein, 24 aa, Plasmodium falciparum
TKEKCKRFSNNMCPYAHDKSELKP

SEQ ID NO: 3373208 - protein, 24 aa, Plasmodium falciparum
TKEKLKGLICEPDLFHIKLTDDDE

SEQ ID NO: 3373209 - protein, 20 aa, Plasmodium falciparum
TKEKRFSIGEIENIDIEKYN

SEQ ID NO: 3373210 - protein, 19 aa, Plasmodium falciparum
TKELLNIFHYDNRTDENIK

SEQ ID NO: 3373211 - protein, 19 aa, Plasmodium falciparum
TKELNKWSIHVIKNNSDIQ

SEQ ID NO: 3373212 - protein, 23 aa, Plasmodium falciparum
TKENKVFMKYDYTHEKPWSNHGD

SEQ ID NO: 3373213 - protein, 23 aa, Plasmodium falciparum
TKETRIYVDGIFDLSHSGHFNAM

SEQ ID NO: 3373214 - protein, 22 aa, Plasmodium falciparum
TKEVLPSWKLVVLDEADMMTED

SEQ ID NO: 3373215 - protein, 17 aa, Plasmodium falciparum
TKFEDIVLQAQKQKREI

SEQ ID NO: 3373216 - protein, 19 aa, Plasmodium falciparum
TKFKRRKRENSRSTLYSMQ

SEQ ID NO: 3373217 - protein, 42 aa, Plasmodium falciparum
TKFLPSYNTCFKKQICNLRKNMKKKLIVNSMSNKFNISQVNA

SEQ ID NO: 3373218 - protein, 17 aa, Plasmodium falciparum
TKFSFNLPLLVERRDKY

SEQ ID NO: 3373219 - protein, 19 aa, Plasmodium falciparum
TKGFSVKKLGLAQAKIEAE

SEQ ID NO: 3373220 - protein, 19 aa, Plasmodium falciparum
TKGGEIFHFNDIMGTLLHE

SEQ ID NO: 3373221 - protein, 20 aa, Plasmodium falciparum
TKHNILFDVFKFPDCSKYNI

SEQ ID NO: 3373222 - protein, 18 aa, Plasmodium falciparum
TKHSWAYQFCVDMSLRLK

SEQ ID NO: 3373223 - protein, 24 aa, Plasmodium falciparum
TKIKFHKNCLKIYDLEGTEDNTIE

SEQ ID NO: 3373224 - protein, 21 aa, Plasmodium falciparum
TKIKIKRLCEKIEGFEKEIKN

SEQ ID NO: 3373225 - protein, 24 aa, Plasmodium falciparum
TKILHRRDVICISKTGSGKSLVYL

SEQ ID NO: 3373226 - protein, 18 aa, Plasmodium falciparum
TKILKCSYDVFKNNVHRY

SEQ ID NO: 3373227 - protein, 20 aa, Plasmodium falciparum
TKIRCIYVFVDIKLNSTHLV

SEQ ID NO: 3373228 - protein, 24 aa, Plasmodium falciparum
TKIRKLRVSNEIKFTKKLASLNID

SEQ ID NO: 3373229 - protein, 18 aa, Plasmodium falciparum
TKIRYVTDGILLRETLND

SEQ ID NO: 3373230 - protein, 20 aa, Plasmodium falciparum
TKKCCIKSNITNVTNIKLYH

SEQ ID NO: 3373231 - protein, 20 aa, Plasmodium falciparum
TKKEALLFTRFYKSMNPNMF

SEQ ID NO: 3373232 - protein, 17 aa, Plasmodium falciparum
TKKEPKIDININVDNNM

SEQ ID NO: 3373233 - protein, 24 aa, Plasmodium falciparum
TKKERRLGSLSVLKKCTMCNVYIC

SEQ ID NO: 3373234 - protein, 23 aa, Plasmodium falciparum
TKKHILRKLFLNEEEFRKLCIFK

SEQ ID NO: 3373235 - protein, 25 aa, Plasmodium falciparum
TKKIKEVIFHKLILQLSRVYSYISI

SEQ ID NO: 3373236 - protein, 25 aa, Plasmodium falciparum
TKKINYKIIIPFSKLAFYEGEIKYT

SEQ ID NO: 3373237 - protein, 22 aa, Plasmodium falciparum
TKKIVLCCFVIYGINNYIFDMT

SEQ ID NO: 3373238 - protein, 19 aa, Plasmodium falciparum
TKKKIHWLPYLPQQLITCT

SEQ ID NO: 3373239 - protein, 20 aa, Plasmodium falciparum
TKKKLLKKLWTKIEDMKNNM

SEQ ID NO: 3373240 - protein, 18 aa, Plasmodium falciparum
TKKKTFLSISKWLEEIRQ

SEQ ID NO: 3373241 - protein, 21 aa, Plasmodium falciparum
TKKLPPCIHSKIENSPFADII

SEQ ID NO: 3373242 - protein, 22 aa, Plasmodium falciparum
TKKNFNFFGSFYSKYAKRNKND

SEQ ID NO: 3373243 - protein, 24 aa, Plasmodium falciparum
TKKSHFFYTLFINQGIHFFNNITI

SEQ ID NO: 3373244 - protein, 20 aa, Plasmodium falciparum
TKKSLWLALANLELTHGKRE

SEQ ID NO: 3373245 - protein, 23 aa, Plasmodium falciparum
TKKVKKLFVRLGIGTKNIDITRV

SEQ ID NO: 3373246 - protein, 19 aa, Plasmodium falciparum
TKKYIAFNHNKYVRFLNSC

SEQ ID NO: 3373247 - protein, 26 aa, Plasmodium falciparum
TKLDTSFFKYCFDRLKSLLNNLQIVN

SEQ ID NO: 3373248 - protein, 18 aa, Plasmodium falciparum
TKLLKKSFTPNFEKKTGS

SEQ ID NO: 3373249 - protein, 22 aa, Plasmodium falciparum
TKLLRRKRLRRISHFKEDRYVI

SEQ ID NO: 3373250 - protein, 20 aa, Plasmodium falciparum
TKLMSKIRFLLGDNTGDIIN

SEQ ID NO: 3373251 - protein, 18 aa, Plasmodium falciparum
TKLNIKNDQLFSYFYELM

SEQ ID NO: 3373252 - protein, 18 aa, Plasmodium falciparum
TKLNMMALWIKSRIHYNN

SEQ ID NO: 3373253 - protein, 41 aa, Plasmodium falciparum
TKLRFKDFKKYFPFKGNIIFRFKIALCDMINVINEGIINNS

SEQ ID NO: 3373254 - protein, 18 aa, Plasmodium falciparum
TKLWNRRYDKILTNVVSY

SEQ ID NO: 3373255 - protein, 17 aa, Plasmodium falciparum
TKNAELLKCDEKKTEGN

SEQ ID NO: 3373256 - protein, 18 aa, Plasmodium falciparum
TKNDVCNNIQTIHLSNIE

SEQ ID NO: 3373257 - protein, 18 aa, Plasmodium falciparum
TKNEPIELMTPNKINENS

SEQ ID NO: 3373258 - protein, 27 aa, Plasmodium falciparum
TKNFFSLKKLLLVISESKLKRNKKCGS

SEQ ID NO: 3373259 - protein, 23 aa, Plasmodium falciparum
TKNFKENLIIYFGNIISYILEKN

SEQ ID NO: 3373260 - protein, 26 aa, Plasmodium falciparum
TKNFSLNLCSACLNIDDKIYIKQIKE

SEQ ID NO: 3373261 - protein, 18 aa, Plasmodium falciparum
TKNIFKITLFNELREDIK

SEQ ID NO: 3373262 - protein, 20 aa, Plasmodium falciparum
TKNIHILKQLDLLFNLQKSY

SEQ ID NO: 3373263 - protein, 20 aa, Plasmodium falciparum
TKNKFEVILCPKVEDVYKFS

SEQ ID NO: 3373264 - protein, 32 aa, Plasmodium falciparum
TKNKHRASVSAWPEWKGQVIQQAILTQHKTNV

SEQ ID NO: 3373265 - protein, 24 aa, Plasmodium falciparum
TKNLIFPMDIKKIYGSLYKVKKKK

SEQ ID NO: 3373266 - protein, 25 aa, Plasmodium falciparum
TKNLNSLICSGEFNHITENNHNNNN

SEQ ID NO: 3373267 - protein, 35 aa, Plasmodium falciparum
TKNLVLRKINILKEFDHKFLSPGMVNINIHDEDIK

SEQ ID NO: 3373268 - protein, 32 aa, Plasmodium falciparum
TKNVRSFSSFDVKERISPRVIRNGNINNNKNN

SEQ ID NO: 3373269 - protein, 28 aa, Plasmodium falciparum
TKNVYLKYSYCKSLENCNTYTKGNNKKS

SEQ ID NO: 3373270 - protein, 23 aa, Plasmodium falciparum
TKPEFSYNAFDYFNKHISENKIS

SEQ ID NO: 3373271 - protein, 22 aa, Plasmodium falciparum
TKPFLFILINFIKTLLINDTIK

SEQ ID NO: 3373272 - protein, 22 aa, Plasmodium falciparum
TKQIDYGVAMMPGEGQAIAQFV

SEQ ID NO: 3373273 - protein, 21 aa, Plasmodium falciparum
TKRGKLCVIDLAGSERASQTN

SEQ ID NO: 3373274 - protein, 28 aa, Plasmodium falciparum
TKRIDNHFFLFKRFNSFDKIHSLDKNCN

SEQ ID NO: 3373275 - protein, 22 aa, Plasmodium falciparum
TKRKGYNFYSGWPPVNRIKVTD

SEQ ID NO: 3373276 - protein, 21 aa, Plasmodium falciparum
TKRMQHVLCCKFSQDAKYVFT

SEQ ID NO: 3373277 - protein, 22 aa, Plasmodium falciparum
TKRSIRKLLHFFYKQVHPDLTS

SEQ ID NO: 3373278 - protein, 20 aa, Plasmodium falciparum
TKSFEFIEIQFSYNNNNNNN

SEQ ID NO: 3373279 - protein, 21 aa, Plasmodium falciparum
TKSGYSSYKYNNIINYKNNQK

SEQ ID NO: 3373280 - protein, 19 aa, Plasmodium falciparum
TKSIISLIFSHSYILEKEI

SEQ ID NO: 3373281 - protein, 21 aa, Plasmodium falciparum
TKSLKIPFVCQYGEKTKEKKI

SEQ ID NO: 3373282 - protein, 18 aa, Plasmodium falciparum
TKSPILFIKKENFKLNQK

SEQ ID NO: 3373283 - protein, 19 aa, Plasmodium falciparum
TKSSNCFVIGRVMLLNNIH

SEQ ID NO: 3373284 - protein, 17 aa, Plasmodium falciparum
TKTKRRVKKKTTDETEN

SEQ ID NO: 3373285 - protein, 28 aa, Plasmodium falciparum
TKVGLHEICIRDAYSLINDKDILKNNFS

SEQ ID NO: 3373286 - protein, 17 aa, Plasmodium falciparum
TKVNYIFNNLVKKEKEI

SEQ ID NO: 3373287 - protein, 24 aa, Plasmodium falciparum
TKVPHFKKLLKIILDEDDDDDDDD

SEQ ID NO: 3373288 - protein, 18 aa, Plasmodium falciparum
TKVTMLLERNFDKDSYKV

SEQ ID NO: 3373289 - protein, 38 aa, Plasmodium falciparum
TKWRRKEINLFKVCLYFHCIKKSLKLLEDKNDFFINLI

SEQ ID NO: 3373290 - protein, 23 aa, Plasmodium falciparum
TKYDMFFFLRMERDKDIMRKLSL

SEQ ID NO: 3373291 - protein, 17 aa, Plasmodium falciparum
TKYGYYSFEKISLAINM

SEQ ID NO: 3373292 - protein, 17 aa, Plasmodium falciparum
TKYICYESSEYIKKDDI

SEQ ID NO: 3373293 - protein, 19 aa, Plasmodium falciparum
TKYKAHVSILKAYKKNIEN

SEQ ID NO: 3373294 - protein, 23 aa, Plasmodium falciparum
TKYKCSLCLRTNTTGIIKCNVPD

SEQ ID NO: 3373295 - protein, 17 aa, Plasmodium falciparum
TKYLGFKENNYGEKEIY

SEQ ID NO: 3373296 - protein, 19 aa, Plasmodium falciparum
TKYLIKYKIYNLIKNQFYQ

SEQ ID NO: 3373297 - protein, 27 aa, Plasmodium falciparum
TKYNCLNFNKSDVMRDYVRYSKKEDSS

SEQ ID NO: 3373298 - protein, 24 aa, Plasmodium falciparum
TKYNEVLTCLFIQSVDILKAEDIS

SEQ ID NO: 3373299 - protein, 20 aa, Plasmodium falciparum
TKYPIDFFNKLLLKLYNIEN

SEQ ID NO: 3373300 - protein, 26 aa, Plasmodium falciparum
TKYSLHLYIKINFILNHIRNISIVDE

SEQ ID NO: 3373301 - protein, 19 aa, Plasmodium falciparum
TKYVRAHLNVIKLTTNERI

SEQ ID NO: 3373302 - protein, 17 aa, Plasmodium falciparum
TKYYALKLSKNLCIQFF

SEQ ID NO: 3373303 - protein, 19 aa, Plasmodium falciparum
TKYYNSLCNYFDNKKYILI

SEQ ID NO: 3373304 - protein, 19 aa, Plasmodium falciparum
TLASCFGCLKNILKEIKEN

SEQ ID NO: 3373305 - protein, 23 aa, Plasmodium falciparum
TLATVSRCGMIWFSRDILSPIIL

SEQ ID NO: 3373306 - protein, 26 aa, Plasmodium falciparum
TLCNIKLDHRSICLFSEKFNLIQTND

SEQ ID NO: 3373307 - protein, 24 aa, Plasmodium falciparum
TLDLRVIEPIIFFNTSFIHSNNLI

SEQ ID NO: 3373308 - protein, 17 aa, Plasmodium falciparum
TLECLRKKKKILIVVNH

SEQ ID NO: 3373309 - protein, 28 aa, Plasmodium falciparum
TLEEARKQCILYRCDVGNIPVKSEWLNP

SEQ ID NO: 3373310 - protein, 23 aa, Plasmodium falciparum
TLEELRMKMEITQKKHFGYKNLK

SEQ ID NO: 3373311 - protein, 22 aa, Plasmodium falciparum
TLEKCKEMFLQIQKAYEILKNP

SEQ ID NO: 3373312 - protein, 23 aa, Plasmodium falciparum
TLEKIKMKFVFNTSVIGGNIENN

SEQ ID NO: 3373313 - protein, 32 aa, Plasmodium falciparum
TLEKRIKSRFTFEMIHISPILNIEDISKLVYK

SEQ ID NO: 3373314 - protein, 19 aa, Plasmodium falciparum
TLEVPRIKPKYVEIPVPIY

SEQ ID NO: 3373315 - protein, 29 aa, Plasmodium falciparum
TLEVVLPVFSYRTYEYLKRVSKKTQAGNV

SEQ ID NO: 3373316 - protein, 18 aa, Plasmodium falciparum
TLEYLKRAAESRMKENEL

SEQ ID NO: 3373317 - protein, 18 aa, Plasmodium falciparum
TLFHPFKNPLPGFVSDKT

SEQ ID NO: 3373318 - protein, 23 aa, Plasmodium falciparum
TLGKNDKTTFCTSNIHSSNKKMR

SEQ ID NO: 3373319 - protein, 19 aa, Plasmodium falciparum
TLGPLGINMMTFFKEFNDR

SEQ ID NO: 3373320 - protein, 26 aa, Plasmodium falciparum
TLHCCAETYCKACLYKYNKKKMKDTS

SEQ ID NO: 3373321 - protein, 17 aa, Plasmodium falciparum
TLHKFIIFETFRNKNKH

SEQ ID NO: 3373322 - protein, 18 aa, Plasmodium falciparum
TLIEAADLCDLCQEKLEG

SEQ ID NO: 3373323 - protein, 20 aa, Plasmodium falciparum
TLIKYNIYDMILLKKIENNI

SEQ ID NO: 3373324 - protein, 26 aa, Plasmodium falciparum
TLINMLRKKLEIKIKDYNLIMDTLIL

SEQ ID NO: 3373325 - protein, 19 aa, Plasmodium falciparum
TLINRSLVYQRLSAHFESI

SEQ ID NO: 3373326 - protein, 18 aa, Plasmodium falciparum
TLIVYNLPPQVTWKELKD

SEQ ID NO: 3373327 - protein, 24 aa, Plasmodium falciparum
TLKDGICLGEDKFLIVDMKSLYHV

SEQ ID NO: 3373328 - protein, 22 aa, Plasmodium falciparum
TLKEIFKKGVNYILLPSLPRSN

SEQ ID NO: 3373329 - protein, 18 aa, Plasmodium falciparum
TLKEKKNEMNVWTLKEKK

SEQ ID NO: 3373330 - protein, 24 aa, Plasmodium falciparum
TLKKLNYDESIVWMNNKIVNYLKN

SEQ ID NO: 3373331 - protein, 17 aa, Plasmodium falciparum
TLKKSRIFEIICLSNIF

SEQ ID NO: 3373332 - protein, 23 aa, Plasmodium falciparum
TLKNEELCIITSSNELYILDIEK

SEQ ID NO: 3373333 - protein, 24 aa, Plasmodium falciparum
TLKYGENVINFYIPTFKNVSYLIE

SEQ ID NO: 3373334 - protein, 26 aa, Plasmodium falciparum
TLLARSSSCLFMFNNIKRNDVHDDYV

SEQ ID NO: 3373335 - protein, 25 aa, Plasmodium falciparum
TLLCINNLKLAFIIDTHITTCYSEI

SEQ ID NO: 3373336 - protein, 17 aa, Plasmodium falciparum
TLLKLLSYDFLNIQKDI

SEQ ID NO: 3373337 - protein, 27 aa, Plasmodium falciparum
TLLKLNETLFMGRIIKSIQAYRKNDRF

SEQ ID NO: 3373338 - protein, 17 aa, Plasmodium falciparum
TLLLKKLKISLKDIPYA

SEQ ID NO: 3373339 - protein, 26 aa, Plasmodium falciparum
TLLLPFLHNIFEQMKLINWAGYHVKN

SEQ ID NO: 3373340 - protein, 22 aa, Plasmodium falciparum
TLLLSYRGIISLIKQETPEIFK

SEQ ID NO: 3373341 - protein, 17 aa, Plasmodium falciparum
TLLPWKENVTIKKIEAK

SEQ ID NO: 3373342 - protein, 20 aa, Plasmodium falciparum
TLMLCLHFFIKYQIYDEPFI

SEQ ID NO: 3373343 - protein, 24 aa, Plasmodium falciparum
TLNEKWKLLPAYLKVKGLVKQHIE

SEQ ID NO: 3373344 - protein, 24 aa, Plasmodium falciparum
TLNFIKKIILIRIIKNGRMTINKC

SEQ ID NO: 3373345 - protein, 19 aa, Plasmodium falciparum
TLNIYDYINFLLILIFYQC

SEQ ID NO: 3373346 - protein, 17 aa, Plasmodium falciparum
TLNKCLIYTSGITNNII

SEQ ID NO: 3373347 - protein, 27 aa, Plasmodium falciparum
TLNKIIKFIVWRQMHIQDFNNKWDTLK

SEQ ID NO: 3373348 - protein, 17 aa, Plasmodium falciparum
TLNKLESGFSFDASSIK

SEQ ID NO: 3373349 - protein, 22 aa, Plasmodium falciparum
TLNKRKAVMIRLKVKKDDEKCI

SEQ ID NO: 3373350 - protein, 18 aa, Plasmodium falciparum
TLNLIYAKYFLRIFIEKQ

SEQ ID NO: 3373351 - protein, 31 aa, Plasmodium falciparum
TLNLRKVYIYEFSRLAFVKTVMSKRKLKWFV

SEQ ID NO: 3373352 - protein, 20 aa, Plasmodium falciparum
TLNPKLCYRLINAEGDNIPG

SEQ ID NO: 3373353 - protein, 28 aa, Plasmodium falciparum
TLNTFPNAKGRFSLINKMASMPNMSTTS

SEQ ID NO: 3373354 - protein, 17 aa, Plasmodium falciparum
TLPLSLLSSSFIRRTIY

SEQ ID NO: 3373355 - protein, 21 aa, Plasmodium falciparum
TLQAYSYCLSLLTKGNAEYTM

SEQ ID NO: 3373356 - protein, 25 aa, Plasmodium falciparum
TLQNFLFKIDVEFVEYKNFVLLITK

SEQ ID NO: 3373357 - protein, 25 aa, Plasmodium falciparum
TLQTISLLCYLRFNKNIKKKSIIIC

SEQ ID NO: 3373358 - protein, 20 aa, Plasmodium falciparum
TLREAIDCGFICRNEKLIWE

SEQ ID NO: 3373359 - protein, 20 aa, Plasmodium falciparum
TLRMIKSLGINISNMKVHNP

SEQ ID NO: 3373360 - protein, 34 aa, Plasmodium falciparum
TLSDFRIYFKFFKMLIERNVHPFLANAYHLLPEQ

SEQ ID NO: 3373361 - protein, 24 aa, Plasmodium falciparum
TLSDIFIYFQMYKYFHVSSTQYAK

SEQ ID NO: 3373362 - protein, 20 aa, Plasmodium falciparum
TLSEILIRKHFHTNNNHNNN

SEQ ID NO: 3373363 - protein, 30 aa, Plasmodium falciparum
TLSIKCVRNKYLTCAPLTVMLRKSNWPVFT

SEQ ID NO: 3373364 - protein, 35 aa, Plasmodium falciparum
TLSNAEFESVLSYLKKYEMKSSKGMNKNHLEDDNG

SEQ ID NO: 3373365 - protein, 18 aa, Plasmodium falciparum
TLSNVGVYFTGFRKNSKN

SEQ ID NO: 3373366 - protein, 24 aa, Plasmodium falciparum
TLSVSFPVVINYIIDTVRCERPIT

SEQ ID NO: 3373367 - protein, 33 aa, Plasmodium falciparum
TLSYAIAGECGCPFFYIKLPEYIKYISNDNKNN

SEQ ID NO: 3373368 - protein, 19 aa, Plasmodium falciparum
TLTAATCGLIKIRGSKVRA

SEQ ID NO: 3373369 - protein, 19 aa, Plasmodium falciparum
TLTCATLVYHLVKMNMGKV

SEQ ID NO: 3373370 - protein, 22 aa, Plasmodium falciparum
TLTCLNDLFCFISVDLNPVANQ

SEQ ID NO: 3373371 - protein, 22 aa, Plasmodium falciparum
TLTCVPGIFKYKGAKMQLLDLP

SEQ ID NO: 3373372 - protein, 21 aa, Plasmodium falciparum
TLTEIYFIHFFNDSKKDNYNN

SEQ ID NO: 3373373 - protein, 29 aa, Plasmodium falciparum
TLTFKKPYIYELIQLPDYVTHNELISSKN

SEQ ID NO: 3373374 - protein, 27 aa, Plasmodium falciparum
TLVALRKAREIFPKDTMSLQVGRSVVH

SEQ ID NO: 3373375 - protein, 19 aa, Plasmodium falciparum
TLYAIFNKLFIFYLDKIQI

SEQ ID NO: 3373376 - protein, 25 aa, Plasmodium falciparum
TLYFKRILNLIHFFFHKGGKRFYHS

SEQ ID NO: 3373377 - protein, 19 aa, Plasmodium falciparum
TLYHIFKTRYLNILNTHLD

SEQ ID NO: 3373378 - protein, 18 aa, Plasmodium falciparum
TLYIHLVQNLSLFLKYLK

SEQ ID NO: 3373379 - protein, 25 aa, Plasmodium falciparum
TLYQCLYISIQIKNRIIDHFTSEKK

SEQ ID NO: 3373380 - protein, 19 aa, Plasmodium falciparum
TMFNCDLASNPYKNDLTCS

SEQ ID NO: 3373381 - protein, 17 aa, Plasmodium falciparum
TMFREGREISHKEWYSY

SEQ ID NO: 3373382 - protein, 27 aa, Plasmodium falciparum
TMGPFVCDVNGWSFVKGNIKYYNDCAH

SEQ ID NO: 3373383 - protein, 26 aa, Plasmodium falciparum
TMIHDELYHSIEFDIDKDDKKEETEY

SEQ ID NO: 3373384 - protein, 18 aa, Plasmodium falciparum
TMIRICIFYNDVKNLKKY

SEQ ID NO: 3373385 - protein, 21 aa, Plasmodium falciparum
TMIYKYYLKYILKNKSRYLFS

SEQ ID NO: 3373386 - protein, 21 aa, Plasmodium falciparum
TMKIRKRTLSFLMENKKYIDN

SEQ ID NO: 3373387 - protein, 22 aa, Plasmodium falciparum
TMKKLGVLVVDNFEELFNMCKV

SEQ ID NO: 3373388 - protein, 21 aa, Plasmodium falciparum
TMLQHPWLNMVSLEEGDDMYI

SEQ ID NO: 3373389 - protein, 18 aa, Plasmodium falciparum
TMNELHFLINDVSTSKQN

SEQ ID NO: 3373390 - protein, 18 aa, Plasmodium falciparum
TMRLGVKQSKIIDKDSLT

SEQ ID NO: 3373391 - protein, 21 aa, Plasmodium falciparum
TMSSMIKLNISLKRYSNLVDL

SEQ ID NO: 3373392 - protein, 33 aa, Plasmodium falciparum
TMVMSKRYKKTFLLIEELFRLKIIKDNENQLEV

SEQ ID NO: 3373393 - protein, 18 aa, Plasmodium falciparum
TNAHFKPSSYVNGAGKNM

SEQ ID NO: 3373394 - protein, 19 aa, Plasmodium falciparum
TNAPKGILNEYKLVKNVRS

SEQ ID NO: 3373395 - protein, 18 aa, Plasmodium falciparum
TNARYHPYHVYRETIPMG

SEQ ID NO: 3373396 - protein, 27 aa, Plasmodium falciparum
TNCFNFTKEELLHFTIEERKILIPQHV

SEQ ID NO: 3373397 - protein, 17 aa, Plasmodium falciparum
TNDAVIFSPFEQINIKW

SEQ ID NO: 3373398 - protein, 24 aa, Plasmodium falciparum
TNDFIKNRTNSIHSHYLRDENKLI

SEQ ID NO: 3373399 - protein, 20 aa, Plasmodium falciparum
TNDIEKCIYKYHSEKNILKV

SEQ ID NO: 3373400 - protein, 23 aa, Plasmodium falciparum
TNDKIILVPSIFFFSPDCNDRND

SEQ ID NO: 3373401 - protein, 26 aa, Plasmodium falciparum
TNDLKLKYCLLIGQEFCFNEVEKNMY

SEQ ID NO: 3373402 - protein, 19 aa, Plasmodium falciparum
TNDPLILHPSTSYIRNIVI

SEQ ID NO: 3373403 - protein, 37 aa, Plasmodium falciparum
TNDQMCLSCSGLPCHCKVGEATLVYSPIMLERVRERC

SEQ ID NO: 3373404 - protein, 24 aa, Plasmodium falciparum
TNEEKKHICLICEQSFATAKELKH

SEQ ID NO: 3373405 - protein, 21 aa, Plasmodium falciparum
TNEISFNLDIFIKENKLNFIE

SEQ ID NO: 3373406 - protein, 34 aa, Plasmodium falciparum
TNEKCTFIYVELKGRLRLCSKSLIFEAYDVDEEV

SEQ ID NO: 3373407 - protein, 23 aa, Plasmodium falciparum
TNEKLKDKIIHIFDNSLKNNKLL

SEQ ID NO: 3373408 - protein, 25 aa, Plasmodium falciparum
TNFIDLTREALSLILQDLKNNVIPK

SEQ ID NO: 3373409 - protein, 26 aa, Plasmodium falciparum
TNFKENCTYASVGMAIQIAGIRKYGN

SEQ ID NO: 3373410 - protein, 18 aa, Plasmodium falciparum
TNFLCIGGPIAANTKYKV

SEQ ID NO: 3373411 - protein, 17 aa, Plasmodium falciparum
TNFLKYPIYNNVNNISD

SEQ ID NO: 3373412 - protein, 17 aa, Plasmodium falciparum
TNFMFPLNMNKNEIINK

SEQ ID NO: 3373413 - protein, 21 aa, Plasmodium falciparum
TNFNSPFSAFGKTNTSDIFKT

SEQ ID NO: 3373414 - protein, 20 aa, Plasmodium falciparum
TNFPSFFDYTPGIPPPYLVR

SEQ ID NO: 3373415 - protein, 25 aa, Plasmodium falciparum
TNFYESLKLWSRMNDKVLKVPNMIQ

SEQ ID NO: 3373416 - protein, 31 aa, Plasmodium falciparum
TNGKGSVCYKIYTCLKIKKFKVGLFSSPHIF

SEQ ID NO: 3373417 - protein, 17 aa, Plasmodium falciparum
TNGLVLAQLKQQFILQF

SEQ ID NO: 3373418 - protein, 20 aa, Plasmodium falciparum
TNGSIYMWNFKKYLSDLNKY

SEQ ID NO: 3373419 - protein, 19 aa, Plasmodium falciparum
TNGTFLYVCKKNRDGIQLL

SEQ ID NO: 3373420 - protein, 27 aa, Plasmodium falciparum
TNHEKEFLKEFQLFMPDVNIMADKNIL

SEQ ID NO: 3373421 - protein, 25 aa, Plasmodium falciparum
TNIFGKPCITNNIFNNTLGNNHINK

SEQ ID NO: 3373422 - protein, 24 aa, Plasmodium falciparum
TNIIKEHKLFFQVMETNEQEYVDE

SEQ ID NO: 3373423 - protein, 27 aa, Plasmodium falciparum
TNIIKIYCVFKGYQILINRQRENEKKE

SEQ ID NO: 3373424 - protein, 17 aa, Plasmodium falciparum
TNIIKTSKYKSGKQTCI

SEQ ID NO: 3373425 - protein, 18 aa, Plasmodium falciparum
TNIIPLWKNEAEKSGRED

SEQ ID NO: 3373426 - protein, 32 aa, Plasmodium falciparum
TNIKKENTEIIKKREINEINSYQNGNVTNKRY

SEQ ID NO: 3373427 - protein, 18 aa, Plasmodium falciparum
TNIKWEATHLIQVNITNL

SEQ ID NO: 3373428 - protein, 20 aa, Plasmodium falciparum
TNILKIRILNSTSKGSINME

SEQ ID NO: 3373429 - protein, 17 aa, Plasmodium falciparum
TNINIWKYFNNTCYNGF

SEQ ID NO: 3373430 - protein, 18 aa, Plasmodium falciparum
TNIPHLYEPLNLTLSKEN

SEQ ID NO: 3373431 - protein, 17 aa, Plasmodium falciparum
TNITCDLNFNKLNNFFV

SEQ ID NO: 3373432 - protein, 17 aa, Plasmodium falciparum
TNIYKRMYQKIKENNKN

SEQ ID NO: 3373433 - protein, 18 aa, Plasmodium falciparum
TNKFDWFYNTMNDIYKEQ

SEQ ID NO: 3373434 - protein, 19 aa, Plasmodium falciparum
TNKFICSIVNILLYEQYYK

SEQ ID NO: 3373435 - protein, 26 aa, Plasmodium falciparum
TNKHKRKSVHYKENDFLKMQNVADDL

SEQ ID NO: 3373436 - protein, 17 aa, Plasmodium falciparum
TNKITGLRILKTDPVES

SEQ ID NO: 3373437 - protein, 21 aa, Plasmodium falciparum
TNKLKISFDIIRNDDKKKKPI

SEQ ID NO: 3373438 - protein, 17 aa, Plasmodium falciparum
TNKRKWQDLSFFLTNDI

SEQ ID NO: 3373439 - protein, 23 aa, Plasmodium falciparum
TNKRSSEDFVILREKNIGSMSAN

SEQ ID NO: 3373440 - protein, 25 aa, Plasmodium falciparum
TNKRYKKGLHKNGIHENDLHENDLH

SEQ ID NO: 3373441 - protein, 18 aa, Plasmodium falciparum
TNKWNYLGTFTFQNMYVR

SEQ ID NO: 3373442 - protein, 23 aa, Plasmodium falciparum
TNKYFPCYFYKFDNTNKYQNVPR

SEQ ID NO: 3373443 - protein, 23 aa, Plasmodium falciparum
TNKYVVCVSSFIEGGEKSLIKIF

SEQ ID NO: 3373444 - protein, 22 aa, Plasmodium falciparum
TNLFYIYICCTDYNTKEEHVDQ

SEQ ID NO: 3373445 - protein, 27 aa, Plasmodium falciparum
TNLHNTSWFCMIFDFDGISKLLNVFNK

SEQ ID NO: 3373446 - protein, 17 aa, Plasmodium falciparum
TNLIKRLFMEENNYNHC

SEQ ID NO: 3373447 - protein, 26 aa, Plasmodium falciparum
TNLKIKEKKIDLILSNNLSFFKYSCM

SEQ ID NO: 3373448 - protein, 17 aa, Plasmodium falciparum
TNLKLTDEFGISRDNVF

SEQ ID NO: 3373449 - protein, 23 aa, Plasmodium falciparum
TNLLKKKFIKTSIYKERIDIKKL

SEQ ID NO: 3373450 - protein, 17 aa, Plasmodium falciparum
TNLMYRRNIKIKRAKDE

SEQ ID NO: 3373451 - protein, 20 aa, Plasmodium falciparum
TNLPDNCRWQHLKDIMRQCG

SEQ ID NO: 3373452 - protein, 24 aa, Plasmodium falciparum
TNLSKIPYIYSCRKYDDYYYNYYK

SEQ ID NO: 3373453 - protein, 25 aa, Plasmodium falciparum
TNLSLHKMFYFYKNYIVYMDPYYST

SEQ ID NO: 3373454 - protein, 30 aa, Plasmodium falciparum
TNLTGPCINWRRNCIFVNDIKKKKFLHLSE

SEQ ID NO: 3373455 - protein, 24 aa, Plasmodium falciparum
TNMILPLRSLLMSIYIGKEAFNDF

SEQ ID NO: 3373456 - protein, 36 aa, Plasmodium falciparum
TNMKKICIDTDCKLRLRGRGSGYLEGEEKKEANESL

SEQ ID NO: 3373457 - protein, 18 aa, Plasmodium falciparum
TNMLKLFYFYSNQENRSM

SEQ ID NO: 3373458 - protein, 31 aa, Plasmodium falciparum
TNNFSKPNFLDKFFYEKKVESIQPHHLNQYY

SEQ ID NO: 3373459 - protein, 23 aa, Plasmodium falciparum
TNNGCIYYPLYFDNFEQISVIKL

SEQ ID NO: 3373460 - protein, 17 aa, Plasmodium falciparum
TNNLRFVDENNLNNILN

SEQ ID NO: 3373461 - protein, 20 aa, Plasmodium falciparum
TNNNLIICIDFLPKTLNVTC

SEQ ID NO: 3373462 - protein, 25 aa, Plasmodium falciparum
TNNQQMKRRCYTRNNSTNVSEYISK

SEQ ID NO: 3373463 - protein, 17 aa, Plasmodium falciparum
TNNRINIKDELGTTETI

SEQ ID NO: 3373464 - protein, 19 aa, Plasmodium falciparum
TNNVILNCNKNIIDKNIIS

SEQ ID NO: 3373465 - protein, 18 aa, Plasmodium falciparum
TNNVLFLCYDETNDDCTT

SEQ ID NO: 3373466 - protein, 21 aa, Plasmodium falciparum
TNPKHGPGWIAAARIEELAQR

SEQ ID NO: 3373467 - protein, 43 aa, Plasmodium falciparum
TNPKLDCLSKSFSKIRKINLCNSAYYPHCTYSNPLKSIKKYSC

SEQ ID NO: 3373468 - protein, 24 aa, Plasmodium falciparum
TNPLKLTIPLVFKRIKYTYEQALI

SEQ ID NO: 3373469 - protein, 25 aa, Plasmodium falciparum
TNPLLPWKILCNDILNTWKLSHMRK

SEQ ID NO: 3373470 - protein, 19 aa, Plasmodium falciparum
TNPNCKYAHKVENLQPTTD

SEQ ID NO: 3373471 - protein, 19 aa, Plasmodium falciparum
TNPRSPYYMLNYINEKKLD

SEQ ID NO: 3373472 - protein, 17 aa, Plasmodium falciparum
TNPSCIVNDNMQSEKQS

SEQ ID NO: 3373473 - protein, 29 aa, Plasmodium falciparum
TNQIKTFREAFLYILGWDIKIEQNDEEIF

SEQ ID NO: 3373474 - protein, 17 aa, Plasmodium falciparum
TNQKDWELFHKHINNNG

SEQ ID NO: 3373475 - protein, 17 aa, Plasmodium falciparum
TNQLFKCLVSDKAHAVW

SEQ ID NO: 3373476 - protein, 37 aa, Plasmodium falciparum
TNRALCYKKQKLWKLANMDARQALNLEEESVKAHFIL

SEQ ID NO: 3373477 - protein, 24 aa, Plasmodium falciparum
TNRENLKIAKYCWKPKEEKTKAYI

SEQ ID NO: 3373478 - protein, 24 aa, Plasmodium falciparum
TNRFPLFPGSSCFPLSPDHNSKKV

SEQ ID NO: 3373479 - protein, 23 aa, Plasmodium falciparum
TNRPRGIAFVTFLDNESVKNILS

SEQ ID NO: 3373480 - protein, 18 aa, Plasmodium falciparum
TNRWKEITNSSGSKPCAR

SEQ ID NO: 3373481 - protein, 17 aa, Plasmodium falciparum
TNRWLRTKIDSYVYYPH

SEQ ID NO: 3373482 - protein, 23 aa, Plasmodium falciparum
TNSFEYGDQFLLNMNENMDKLNN

SEQ ID NO: 3373483 - protein, 17 aa, Plasmodium falciparum
TNSLNINSFKNFFTQNI

SEQ ID NO: 3373484 - protein, 28 aa, Plasmodium falciparum
TNSLRRRYYSCSRFDKGIYNNDHHIDEE

SEQ ID NO: 3373485 - protein, 18 aa, Plasmodium falciparum
TNSSMIIMQNVIGKNSNN

SEQ ID NO: 3373486 - protein, 20 aa, Plasmodium falciparum
TNTSFKHITCNQKFIENNKI

SEQ ID NO: 3373487 - protein, 20 aa, Plasmodium falciparum
TNVLCGNKIYNKCGNKNIFL

SEQ ID NO: 3373488 - protein, 17 aa, Plasmodium falciparum
TNVNVVWSVFNNDLLNL

SEQ ID NO: 3373489 - protein, 22 aa, Plasmodium falciparum
TNVQLRYFVRLNIIKGYSGNIQ

SEQ ID NO: 3373490 - protein, 22 aa, Plasmodium falciparum
TNYAIWKLGPTPSQTKKFTHIC

SEQ ID NO: 3373491 - protein, 25 aa, Plasmodium falciparum
TNYCYSYEALFWILSQRYLYDYILF

SEQ ID NO: 3373492 - protein, 29 aa, Plasmodium falciparum
TNYEIKMFLLNTIKAIGIVFKKWKFKNFG

SEQ ID NO: 3373493 - protein, 18 aa, Plasmodium falciparum
TNYERKIINHKNFVHNSN

SEQ ID NO: 3373494 - protein, 20 aa, Plasmodium falciparum
TNYIYPQIIEDININKNNNN

SEQ ID NO: 3373495 - protein, 25 aa, Plasmodium falciparum
TNYTSNFIGCLDYIFYNDENLNIIS

SEQ ID NO: 3373496 - protein, 32 aa, Plasmodium falciparum
TNYYKLKYILTHELIHAFDFARANIDMYNCKH

SEQ ID NO: 3373497 - protein, 18 aa, Plasmodium falciparum
TPCMHFLIYFLNYINEND

SEQ ID NO: 3373498 - protein, 19 aa, Plasmodium falciparum
TPDGLPIYSMDELNMGELF

SEQ ID NO: 3373499 - protein, 22 aa, Plasmodium falciparum
TPDYPFNVNTRFREHAYNSSLG

SEQ ID NO: 3373500 - protein, 25 aa, Plasmodium falciparum
TPEDVLHSFFLMKYIYNYKFIDIEE

SEQ ID NO: 3373501 - protein, 22 aa, Plasmodium falciparum
TPEGVLRNRIYFIFWSPDLAKS

SEQ ID NO: 3373502 - protein, 18 aa, Plasmodium falciparum
TPEYAFKILHHVDYNPKK

SEQ ID NO: 3373503 - protein, 17 aa, Plasmodium falciparum
TPEYKKDINPIIKTQED

SEQ ID NO: 3373504 - protein, 23 aa, Plasmodium falciparum
TPFMDKLNCSVLIKGTDPQTLKE

SEQ ID NO: 3373505 - protein, 18 aa, Plasmodium falciparum
TPFNIGDVIIEFESEDSV

SEQ ID NO: 3373506 - protein, 19 aa, Plasmodium falciparum
TPFSFSFLEPFYMSNVLIK

SEQ ID NO: 3373507 - protein, 27 aa, Plasmodium falciparum
TPGIFQYAAGDIFTFLNIYDKDNTKGI

SEQ ID NO: 3373508 - protein, 20 aa, Plasmodium falciparum
TPGMPVPWPIPTTTQQLGST

SEQ ID NO: 3373509 - protein, 18 aa, Plasmodium falciparum
TPHFETIVYLKLDCKKVH

SEQ ID NO: 3373510 - protein, 23 aa, Plasmodium falciparum
TPIKCIKLLYSYIVLDDENFLNF

SEQ ID NO: 3373511 - protein, 17 aa, Plasmodium falciparum
TPILKKIIEYMEYHINN

SEQ ID NO: 3373512 - protein, 19 aa, Plasmodium falciparum
TPILLAYNLNKAWVNHFID

SEQ ID NO: 3373513 - protein, 25 aa, Plasmodium falciparum
TPIRKCKIRHIIVSASFINKKNIKE

SEQ ID NO: 3373514 - protein, 19 aa, Plasmodium falciparum
TPISILINPQFASFFKIEL

SEQ ID NO: 3373515 - protein, 22 aa, Plasmodium falciparum
TPKELSCIINYFKQIKINDSKI

SEQ ID NO: 3373516 - protein, 26 aa, Plasmodium falciparum
TPKKFKRRKECVPHIILEDLVYGFKR

SEQ ID NO: 3373517 - protein, 26 aa, Plasmodium falciparum
TPKKYISFLKFYWIYFNKEDLKKQNV

SEQ ID NO: 3373518 - protein, 22 aa, Plasmodium falciparum
TPKLCNFVEWREYKLVFKRYAS

SEQ ID NO: 3373519 - protein, 26 aa, Plasmodium falciparum
TPKLHKSIIRKSDFPYIKEKNSFNSL

SEQ ID NO: 3373520 - protein, 18 aa, Plasmodium falciparum
TPLAHSIKITKNYDNINM

SEQ ID NO: 3373521 - protein, 22 aa, Plasmodium falciparum
TPLKNGCNQGFQDNNRHKNKQN

SEQ ID NO: 3373522 - protein, 17 aa, Plasmodium falciparum
TPLKYSGVKEFDWSPVD

SEQ ID NO: 3373523 - protein, 20 aa, Plasmodium falciparum
TPLLPCLCSGTLSVNVCTES

SEQ ID NO: 3373524 - protein, 19 aa, Plasmodium falciparum
TPLNMDWVKVMNLIYSSND

SEQ ID NO: 3373525 - protein, 24 aa, Plasmodium falciparum
TPLSLCLECEVLLKELENTEYAIY

SEQ ID NO: 3373526 - protein, 17 aa, Plasmodium falciparum
TPMKAFKYYGNKDQRKE

SEQ ID NO: 3373527 - protein, 25 aa, Plasmodium falciparum
TPNKTKHFYADWERLLAYNHGLYTL

SEQ ID NO: 3373528 - protein, 22 aa, Plasmodium falciparum
TPNLHSWFPLYIPINKIQFLKK

SEQ ID NO: 3373529 - protein, 18 aa, Plasmodium falciparum
TPNWLKVFETCIPQKKVM

SEQ ID NO: 3373530 - protein, 17 aa, Plasmodium falciparum
TPQALKLRGRIDVWCFG

SEQ ID NO: 3373531 - protein, 17 aa, Plasmodium falciparum
TPQSISIYAYDDLIDYT

SEQ ID NO: 3373532 - protein, 22 aa, Plasmodium falciparum
TPTEISRLMGFKMKTNNKNINQ

SEQ ID NO: 3373533 - protein, 17 aa, Plasmodium falciparum
TPTNINVPIAPHVSLMK

SEQ ID NO: 3373534 - protein, 19 aa, Plasmodium falciparum
TPVFSTRFAIPIIGIIYAL

SEQ ID NO: 3373535 - protein, 27 aa, Plasmodium falciparum
TPYDYRVVLNSNFCNKFFTPNWREQQS

SEQ ID NO: 3373536 - protein, 18 aa, Plasmodium falciparum
TQDFCLKGMALRSVEIYM

SEQ ID NO: 3373537 - protein, 27 aa, Plasmodium falciparum
TQEERGALIAGCKWVDEVIIGTKYNVD

SEQ ID NO: 3373538 - protein, 27 aa, Plasmodium falciparum
TQESNIPIHFKVRRKTTRIFKTNYLSR

SEQ ID NO: 3373539 - protein, 26 aa, Plasmodium falciparum
TQKHVSIPVFRHSFLNENISKPDSFR

SEQ ID NO: 3373540 - protein, 22 aa, Plasmodium falciparum
TQLFKPNGVNIFDSNLGMNNKI

SEQ ID NO: 3373541 - protein, 26 aa, Plasmodium falciparum
TQLLWSMITDYCEIFKNTLKGKYDKR

SEQ ID NO: 3373542 - protein, 19 aa, Plasmodium falciparum
TQLSSILGYQGIDKILLLG

SEQ ID NO: 3373543 - protein, 43 aa, Plasmodium falciparum
TQLSVEFFFLPSIFWKFSSNPIFLSWPPFPSFSPFKSQYAHLT

SEQ ID NO: 3373544 - protein, 41 aa, Plasmodium falciparum
TQMPLYYFRDTHSISLLYSFCTLQKWLFGAFANLVDNCVHA

SEQ ID NO: 3373545 - protein, 27 aa, Plasmodium falciparum
TQMTFCSKESLGLVGEYLLKKLQRTDL

SEQ ID NO: 3373546 - protein, 23 aa, Plasmodium falciparum
TQMYRTSYLLGHDQQRGERGSLI

SEQ ID NO: 3373547 - protein, 27 aa, Plasmodium falciparum
TQNDVWKSICFCVDSLFHFKNTTVFAH

SEQ ID NO: 3373548 - protein, 45 aa, Plasmodium falciparum
TQNELFSLKLPLEIKVSMALRISERLRAFVFDKDLTAYYIKKLKD

SEQ ID NO: 3373549 - protein, 25 aa, Plasmodium falciparum
TQSKNVMSTFSFWNIEKETFITKPL

SEQ ID NO: 3373550 - protein, 24 aa, Plasmodium falciparum
TQTLKKYSYVDIMDSCKKLTNVDT

SEQ ID NO: 3373551 - protein, 17 aa, Plasmodium falciparum
TQVPKRWLSRNPADIEY

SEQ ID NO: 3373552 - protein, 27 aa, Plasmodium falciparum
TQYFKNMKILFTFLNIYAKQNSLDIDD

SEQ ID NO: 3373553 - protein, 31 aa, Plasmodium falciparum
TQYLQKELTCPICLDYFYLPVTMNCGHTFCR

SEQ ID NO: 3373554 - protein, 17 aa, Plasmodium falciparum
TQYRMNNLILLWSNKIF

SEQ ID NO: 3373555 - protein, 21 aa, Plasmodium falciparum
TRAGTIPFLCDFIDISKDHMK

SEQ ID NO: 3373556 - protein, 19 aa, Plasmodium falciparum
TRCAYPLSYIENAKIPAYI

SEQ ID NO: 3373557 - protein, 19 aa, Plasmodium falciparum
TRCPHPYTAVQICSYILKL

SEQ ID NO: 3373558 - protein, 20 aa, Plasmodium falciparum
TRDYRYMWQYNFRGKYERPR

SEQ ID NO: 3373559 - protein, 24 aa, Plasmodium falciparum
TRELLEQEILILFSNMLKKETILC

SEQ ID NO: 3373560 - protein, 25 aa, Plasmodium falciparum
TRGFSPRIYGFNAARDLAVQLKYEM

SEQ ID NO: 3373561 - protein, 18 aa, Plasmodium falciparum
TRHLFIFNLLNYLSIVDL

SEQ ID NO: 3373562 - protein, 17 aa, Plasmodium falciparum
TRIEKKIILDMLKENDC

SEQ ID NO: 3373563 - protein, 18 aa, Plasmodium falciparum
TRIIKILKDILVYIENIS

SEQ ID NO: 3373564 - protein, 23 aa, Plasmodium falciparum
TRKHSLFFLKYFLLIPEEQVNIK

SEQ ID NO: 3373565 - protein, 22 aa, Plasmodium falciparum
TRKIICELMHTFQLECVYVGDF

SEQ ID NO: 3373566 - protein, 18 aa, Plasmodium falciparum
TRKIIEVYIPKGAPNKHK

SEQ ID NO: 3373567 - protein, 20 aa, Plasmodium falciparum
TRKILKLNLENSIIIIDEGH

SEQ ID NO: 3373568 - protein, 19 aa, Plasmodium falciparum
TRKKFTINFKMPKKEKTNL

SEQ ID NO: 3373569 - protein, 29 aa, Plasmodium falciparum
TRKLRRLYFGNLPLHLGLSENAFQEIVWN

SEQ ID NO: 3373570 - protein, 19 aa, Plasmodium falciparum
TRKRNVYMSNRFKNNNNNN

SEQ ID NO: 3373571 - protein, 18 aa, Plasmodium falciparum
TRKYSCTNMNNMNEDNYL

SEQ ID NO: 3373572 - protein, 31 aa, Plasmodium falciparum
TRLKRAEGMKFLGKLMQKWSKIKNDKCDTND

SEQ ID NO: 3373573 - protein, 21 aa, Plasmodium falciparum
TRLLYEYNKMNAFNLRLMECY

SEQ ID NO: 3373574 - protein, 23 aa, Plasmodium falciparum
TRLNKIQFLLKIFLSNIYDINSF

SEQ ID NO: 3373575 - protein, 21 aa, Plasmodium falciparum
TRNAIGFYFNDMWILNINLIN

SEQ ID NO: 3373576 - protein, 18 aa, Plasmodium falciparum
TRNILVELVKSYNEEKDE

SEQ ID NO: 3373577 - protein, 23 aa, Plasmodium falciparum
TRNPRIITRAIDITNIPFNSPGR

SEQ ID NO: 3373578 - protein, 24 aa, Plasmodium falciparum
TRPIDPPVLCLKISQNTSPLTGKD

SEQ ID NO: 3373579 - protein, 29 aa, Plasmodium falciparum
TRPSKEWFDYWKRHMPTFNDKKSEYNVYK

SEQ ID NO: 3373580 - protein, 20 aa, Plasmodium falciparum
TRPSSCLYLSHNEKIDEKRI

SEQ ID NO: 3373581 - protein, 17 aa, Plasmodium falciparum
TRQAIIKQFVWKRKMYK

SEQ ID NO: 3373582 - protein, 18 aa, Plasmodium falciparum
TRRIKTEFLINMSGLTNY

SEQ ID NO: 3373583 - protein, 18 aa, Plasmodium falciparum
TRRKKRKQKMEILKQKFQ

SEQ ID NO: 3373584 - protein, 21 aa, Plasmodium falciparum
TRSYSLPPWLKSMYGNNFNTN

SEQ ID NO: 3373585 - protein, 24 aa, Plasmodium falciparum
TRTAQELFDMGRLEFKENKNYDVA

SEQ ID NO: 3373586 - protein, 23 aa, Plasmodium falciparum
TRVKLLYDNEVLYVCFNKENGNY

SEQ ID NO: 3373587 - protein, 24 aa, Plasmodium falciparum
TRVLFRIWDIWQIRHYRNYPNVFP

SEQ ID NO: 3373588 - protein, 19 aa, Plasmodium falciparum
TRVPFIQNFLQQYFQKPLS

SEQ ID NO: 3373589 - protein, 17 aa, Plasmodium falciparum
TRYAKKEKKLFNKYNDP

SEQ ID NO: 3373590 - protein, 19 aa, Plasmodium falciparum
TRYDLSLFYNVQDKCNEPG

SEQ ID NO: 3373591 - protein, 25 aa, Plasmodium falciparum
TRYRGVKHISELFALCENIISTYNE

SEQ ID NO: 3373592 - protein, 23 aa, Plasmodium falciparum
TSACPPYHLAIVIGGLSAEMNLK

SEQ ID NO: 3373593 - protein, 36 aa, Plasmodium falciparum
TSAVMLDCFGRLFINFLQLRGTSLSLYDFILNKNAK

SEQ ID NO: 3373594 - protein, 27 aa, Plasmodium falciparum
TSAYTESAIGLGFRKNGYINDCDLVNN

SEQ ID NO: 3373595 - protein, 18 aa, Plasmodium falciparum
TSCHIPRNIEQHLYYNDD

SEQ ID NO: 3373596 - protein, 25 aa, Plasmodium falciparum
TSCIAIPNICNFLVYSGGGDGVLKI

SEQ ID NO: 3373597 - protein, 22 aa, Plasmodium falciparum
TSDSFISIYGYLIKNRRSKNIK

SEQ ID NO: 3373598 - protein, 25 aa, Plasmodium falciparum
TSEFGWSANMERIMKAQALRDNSMT

SEQ ID NO: 3373599 - protein, 31 aa, Plasmodium falciparum
TSEMCKNILYRLYNSMCFESLLTYNDKDLKI

SEQ ID NO: 3373600 - protein, 24 aa, Plasmodium falciparum
TSFLARIFTIFSISKIYIYDDYLE

SEQ ID NO: 3373601 - protein, 18 aa, Plasmodium falciparum
TSGCSMIKNDDSFGDSVI

SEQ ID NO: 3373602 - protein, 24 aa, Plasmodium falciparum
TSGNMKGKFNNFRNTHGNMDKKNV

SEQ ID NO: 3373603 - protein, 18 aa, Plasmodium falciparum
TSHAPVTPQESITVQEPV

SEQ ID NO: 3373604 - protein, 23 aa, Plasmodium falciparum
TSHILSLDFSFGARFYKSCFSSR

SEQ ID NO: 3373605 - protein, 21 aa, Plasmodium falciparum
TSHISGLMSRSIRLMENGLKP

SEQ ID NO: 3373606 - protein, 23 aa, Plasmodium falciparum
TSIKSRLYHTCMIKNIILNIIKR

SEQ ID NO: 3373607 - protein, 18 aa, Plasmodium falciparum
TSILINWEIELKRFCPCF

SEQ ID NO: 3373608 - protein, 18 aa, Plasmodium falciparum
TSIRIGFNRFTTFFEVQQ

SEQ ID NO: 3373609 - protein, 21 aa, Plasmodium falciparum
TSIYKRQFVCLELKENDEYAY

SEQ ID NO: 3373610 - protein, 23 aa, Plasmodium falciparum
TSKFKKKFSYLLLKLKSKDSNLL

SEQ ID NO: 3373611 - protein, 22 aa, Plasmodium falciparum
TSKFPNVGMFKRVEDDSDIRKD

SEQ ID NO: 3373612 - protein, 24 aa, Plasmodium falciparum
TSKISGYLTSVGFFNKCTEGLIVI

SEQ ID NO: 3373613 - protein, 35 aa, Plasmodium falciparum
TSKYIPTFYKKEAGICIGFGGKICTFDNSTNNMSN

SEQ ID NO: 3373614 - protein, 17 aa, Plasmodium falciparum
TSLCYRITYRSHNKNLT

SEQ ID NO: 3373615 - protein, 27 aa, Plasmodium falciparum
TSLMLNFFFKNVRNIHSFKQKYDTVLN

SEQ ID NO: 3373616 - protein, 18 aa, Plasmodium falciparum
TSLTFGYACSLLDSNNTD

SEQ ID NO: 3373617 - protein, 21 aa, Plasmodium falciparum
TSLVRHGFMLVGNTLTGKTEI

SEQ ID NO: 3373618 - protein, 38 aa, Plasmodium falciparum
TSMKSFKNAESWTPICLPIYNPNLFLYAYINYIKKKIC

SEQ ID NO: 3373619 - protein, 23 aa, Plasmodium falciparum
TSNFLNYYLKGFILQNFNVLGSY

SEQ ID NO: 3373620 - protein, 19 aa, Plasmodium falciparum
TSNGLLYNNMNIINNNNVD

SEQ ID NO: 3373621 - protein, 17 aa, Plasmodium falciparum
TSNHFYNSLNMKLINYG

SEQ ID NO: 3373622 - protein, 24 aa, Plasmodium falciparum
TSNICKEEKTYIISYINNKSNIIF

SEQ ID NO: 3373623 - protein, 25 aa, Plasmodium falciparum
TSNIIKLRICRALNDMNINVQRYHH

SEQ ID NO: 3373624 - protein, 19 aa, Plasmodium falciparum
TSNLTSLRNTICKSENDHN

SEQ ID NO: 3373625 - protein, 19 aa, Plasmodium falciparum
TSNNFLIGDSINFDNKIDN

SEQ ID NO: 3373626 - protein, 19 aa, Plasmodium falciparum
TSNVLPFQDIQRLILYINS

SEQ ID NO: 3373627 - protein, 17 aa, Plasmodium falciparum
TSPSINCSILIDWTKGF

SEQ ID NO: 3373628 - protein, 26 aa, Plasmodium falciparum
TSPSNCLKEDFELFRTNENDMYEKEN

SEQ ID NO: 3373629 - protein, 17 aa, Plasmodium falciparum
TSPYLTKYEKARIIGTR

SEQ ID NO: 3373630 - protein, 27 aa, Plasmodium falciparum
TSQIIYILSYFKKLAVHNGKELMCYLR

SEQ ID NO: 3373631 - protein, 22 aa, Plasmodium falciparum
TSRIIKEMFLNIVGVKSNNAYV

SEQ ID NO: 3373632 - protein, 28 aa, Plasmodium falciparum
TSRKALKFCKKRFMFFDFYHHFNIFIKK

SEQ ID NO: 3373633 - protein, 24 aa, Plasmodium falciparum
TSRLGGNFRIQWIKMAKIDFDNFK

SEQ ID NO: 3373634 - protein, 29 aa, Plasmodium falciparum
TSRLYPIERPKYFYYVIHLFNAHVQSVAA

SEQ ID NO: 3373635 - protein, 26 aa, Plasmodium falciparum
TSRPFKSNPLFLAFVLASKKKLKDRL

SEQ ID NO: 3373636 - protein, 17 aa, Plasmodium falciparum
TSSIIYNKGMVNINKNM

SEQ ID NO: 3373637 - protein, 24 aa, Plasmodium falciparum
TSSIKSLHKSSVLSSLNADAPEFV

SEQ ID NO: 3373638 - protein, 20 aa, Plasmodium falciparum
TSSKDFNCFSNNEKKKNFTT

SEQ ID NO: 3373639 - protein, 18 aa, Plasmodium falciparum
TSSYNFPNINNMDSNIYN

SEQ ID NO: 3373640 - protein, 24 aa, Plasmodium falciparum
TSSYPLRIAFSLIDLTHKLFAQKC

SEQ ID NO: 3373641 - protein, 25 aa, Plasmodium falciparum
TSTEMRIPYCLLLPNRAIGYVIGKS

SEQ ID NO: 3373642 - protein, 25 aa, Plasmodium falciparum
TSTICPNCLVAKLGIKALGFDFLNK

SEQ ID NO: 3373643 - protein, 17 aa, Plasmodium falciparum
TSTTVSVSLKANILKNN

SEQ ID NO: 3373644 - protein, 24 aa, Plasmodium falciparum
TSVCSLRIKLWEALLLYVNNLNVE

SEQ ID NO: 3373645 - protein, 23 aa, Plasmodium falciparum
TSVICAFGGFIVYLRSLLLDKKI

SEQ ID NO: 3373646 - protein, 25 aa, Plasmodium falciparum
TSVYVCGFIFEYCVKETALSFLNLG

SEQ ID NO: 3373647 - protein, 25 aa, Plasmodium falciparum
TSYFLPPGFLRRALFSALYKGVNIS

SEQ ID NO: 3373648 - protein, 21 aa, Plasmodium falciparum
TSYGRLKGRVSRYDMNSSYNL

SEQ ID NO: 3373649 - protein, 18 aa, Plasmodium falciparum
TSYYAALFAKYLMNYLNC

SEQ ID NO: 3373650 - protein, 40 aa, Plasmodium falciparum
TTARKKFVDMDMHLHYMIKFFLKLHKNFFENPLETDVGKL

SEQ ID NO: 3373651 - protein, 22 aa, Plasmodium falciparum
TTASGFCPNTLFRSNDISNKLM

SEQ ID NO: 3373652 - protein, 19 aa, Plasmodium falciparum
TTATFAMKAVQNYELQGSK

SEQ ID NO: 3373653 - protein, 26 aa, Plasmodium falciparum
TTCAPSRLLALIGMALKWQAHHNIIK

SEQ ID NO: 3373654 - protein, 22 aa, Plasmodium falciparum
TTCGKFSDIYSYENVKYDVYDR

SEQ ID NO: 3373655 - protein, 24 aa, Plasmodium falciparum
TTDNDKKCSSSICSKKKKNKIKKR

SEQ ID NO: 3373656 - protein, 17 aa, Plasmodium falciparum
TTEEIRAEFDIVNDFTR

SEQ ID NO: 3373657 - protein, 28 aa, Plasmodium falciparum
TTEGHPEYLPRIPGVRFNPKKQQWLAAW

SEQ ID NO: 3373658 - protein, 17 aa, Plasmodium falciparum
TTEILRNLLYLNDNIIN

SEQ ID NO: 3373659 - protein, 26 aa, Plasmodium falciparum
TTESLKLIFPYIFFRKKYNQNNINKL

SEQ ID NO: 3373660 - protein, 29 aa, Plasmodium falciparum
TTFETCLIKIYTIELMMRSLLFSSSLVLY

SEQ ID NO: 3373661 - protein, 18 aa, Plasmodium falciparum
TTFSNAFHIPKINNNIKS

SEQ ID NO: 3373662 - protein, 21 aa, Plasmodium falciparum
TTGMCFNEWSHLAAKKYLLMN

SEQ ID NO: 3373663 - protein, 24 aa, Plasmodium falciparum
TTHFLKPKTFKDMNGLYYDLNDEM

SEQ ID NO: 3373664 - protein, 17 aa, Plasmodium falciparum
TTHPDFSILAARITTDN

SEQ ID NO: 3373665 - protein, 31 aa, Plasmodium falciparum
TTHPRLRVDNNLKIFKYNGLIVSRINFEELY

SEQ ID NO: 3373666 - protein, 19 aa, Plasmodium falciparum
TTIKSALLFKKYIKNNYHK

SEQ ID NO: 3373667 - protein, 20 aa, Plasmodium falciparum
TTKIPRWDLNKFEFASNTMN

SEQ ID NO: 3373668 - protein, 26 aa, Plasmodium falciparum
TTKYCSSFLKNASCGNEECFYLHELG

SEQ ID NO: 3373669 - protein, 19 aa, Plasmodium falciparum
TTLAFKFKDGIIVAVDSRA

SEQ ID NO: 3373670 - protein, 25 aa, Plasmodium falciparum
TTLKQKAYVPLGFVIQPLAPIPDGY

SEQ ID NO: 3373671 - protein, 19 aa, Plasmodium falciparum
TTLKSLRGDNNIKDSSNKM

SEQ ID NO: 3373672 - protein, 19 aa, Plasmodium falciparum
TTLQLVIVVDCLKFELNNM

SEQ ID NO: 3373673 - protein, 38 aa, Plasmodium falciparum
TTLYNNFDIIKFIMKWIFVHVIKIFVKDTYMLYINNNQ

SEQ ID NO: 3373674 - protein, 25 aa, Plasmodium falciparum
TTNEILLLCRAWENYVHPRAKEYWK

SEQ ID NO: 3373675 - protein, 18 aa, Plasmodium falciparum
TTNKIIVDLSRNLWDGSN

SEQ ID NO: 3373676 - protein, 23 aa, Plasmodium falciparum
TTNKNFRLFLTMEFNPRIPQSLM

SEQ ID NO: 3373677 - protein, 26 aa, Plasmodium falciparum
TTNTMWRYMGSTAKFRLVEDQQEKYL

SEQ ID NO: 3373678 - protein, 31 aa, Plasmodium falciparum
TTQMLNAFVPFDLDPPPLYAENPETVSPLTP

SEQ ID NO: 3373679 - protein, 25 aa, Plasmodium falciparum
TTRRTWKCVCGLQKLYKNLKRAKNK

SEQ ID NO: 3373680 - protein, 17 aa, Plasmodium falciparum
TTSEIVLICIGRKANFD

SEQ ID NO: 3373681 - protein, 23 aa, Plasmodium falciparum
TTSGEKFGRCSSTSNLLTDINCT

SEQ ID NO: 3373682 - protein, 18 aa, Plasmodium falciparum
TTSILQQVFNSFLSGSND

SEQ ID NO: 3373683 - protein, 27 aa, Plasmodium falciparum
TTSKVLVMEYIKGFKITDTELLKKYNV

SEQ ID NO: 3373684 - protein, 19 aa, Plasmodium falciparum
TTTYRVVPQTVVYTFPNNI

SEQ ID NO: 3373685 - protein, 26 aa, Plasmodium falciparum
TTVNCYKSEFSCYKDNYKYKKHSTHI

SEQ ID NO: 3373686 - protein, 20 aa, Plasmodium falciparum
TTVRCFKSEVNIRNKDTNKY

SEQ ID NO: 3373687 - protein, 58 aa, Plasmodium falciparum
TVDEMWWNENFIKPQVSVSLFLRIFLHDMISPPIFFDDLTSCVIDFFTVNKLWSKAKW

SEQ ID NO: 3373688 - protein, 33 aa, Plasmodium falciparum
TVDIWALGICLYEFICGPLPFGNDEEDQLEIFR

SEQ ID NO: 3373689 - protein, 18 aa, Plasmodium falciparum
TVDRAAAQLNELHKECYD

SEQ ID NO: 3373690 - protein, 53 aa, Plasmodium falciparum
TVDSSENVEEVVDNLTSEKNKESLKKDKRKKKEKKNNDVDDINEEEDEEGNDE

SEQ ID NO: 3373691 - protein, 20 aa, Plasmodium falciparum
TVDYHPAMHISFAETHRLLY

SEQ ID NO: 3373692 - protein, 22 aa, Plasmodium falciparum
TVELCIRIRLDIPSQYTCTNVF

SEQ ID NO: 3373693 - protein, 22 aa, Plasmodium falciparum
TVGDAFLDFIAIELSLSILNIT

SEQ ID NO: 3373694 - protein, 17 aa, Plasmodium falciparum
TVGRSCVIVELENRKVM

SEQ ID NO: 3373695 - protein, 23 aa, Plasmodium falciparum
TVIAEYAIALGLRDKQRVIYTSP

SEQ ID NO: 3373696 - protein, 18 aa, Plasmodium falciparum
TVIKGKIKINCNVTILPL

SEQ ID NO: 3373697 - protein, 23 aa, Plasmodium falciparum
TVKLWDLRKAQSFQTITLNETPN

SEQ ID NO: 3373698 - protein, 25 aa, Plasmodium falciparum
TVLHYYKEHISEFFNDKNKIIKLTK

SEQ ID NO: 3373699 - protein, 24 aa, Plasmodium falciparum
TVLSRSIAELGIYPAVDPLDSTSR

SEQ ID NO: 3373700 - protein, 25 aa, Plasmodium falciparum
TVLYYLCKLFHHFSSIKNVNSNVKM

SEQ ID NO: 3373701 - protein, 19 aa, Plasmodium falciparum
TVPHFKKNKAVGIMKPGHV

SEQ ID NO: 3373702 - protein, 23 aa, Plasmodium falciparum
TVPNYLEFADWVGFTKQKEVISI

SEQ ID NO: 3373703 - protein, 18 aa, Plasmodium falciparum
TVQSLKCGIYRDDLKEFF

SEQ ID NO: 3373704 - protein, 21 aa, Plasmodium falciparum
TVRAFDLLRYRNFKIYTPDVI

SEQ ID NO: 3373705 - protein, 23 aa, Plasmodium falciparum
TVRKGAALCLDYLSNVYNDEILE

SEQ ID NO: 3373706 - protein, 23 aa, Plasmodium falciparum
TVRLRYAFCITCNEVIKDDQGKV

SEQ ID NO: 3373707 - protein, 29 aa, Plasmodium falciparum
TVSPLTPISEIIDFIYSIFNKSTEDTITR

SEQ ID NO: 3373708 - protein, 29 aa, Plasmodium falciparum
TVSSFCRRRLAVLLFRLKFVQTIKLAITY

SEQ ID NO: 3373709 - protein, 26 aa, Plasmodium falciparum
TVVRCKKCRTYINPFVRFEAGGKKWN

SEQ ID NO: 3373710 - protein, 24 aa, Plasmodium falciparum
TVYIPCPVLLNFVCTEQKAHEILQ

SEQ ID NO: 3373711 - protein, 18 aa, Plasmodium falciparum
TVYKKARFYVFSKKKLNE

SEQ ID NO: 3373712 - protein, 26 aa, Plasmodium falciparum
TVYLRCIFNLSYNCRILKNFKNSLDI

SEQ ID NO: 3373713 - protein, 32 aa, Plasmodium falciparum
TVYTLWKFPKMIPCFVIYPPASEFLLRGADLM

SEQ ID NO: 3373714 - protein, 19 aa, Plasmodium falciparum
TWGSFSLNVNSKFPISQKK

SEQ ID NO: 3373715 - protein, 18 aa, Plasmodium falciparum
TWLQYRVRVTISDTRYFV

SEQ ID NO: 3373716 - protein, 46 aa, Plasmodium falciparum
TWNVLAEIYGTIEAFPHCDPYMLAWSYRKTKIIQEILNNSPDIVCL

SEQ ID NO: 3373717 - protein, 21 aa, Plasmodium falciparum
TWYCSNCKLHVQAYKKLDLFR

SEQ ID NO: 3373718 - protein, 20 aa, Plasmodium falciparum
TYAIFICLNCSGKHRQLGTH

SEQ ID NO: 3373719 - protein, 22 aa, Plasmodium falciparum
TYAKCMPHLNFLDTNKKSKVHL

SEQ ID NO: 3373720 - protein, 18 aa, Plasmodium falciparum
TYDGYVFTFGCNKRAQLG

SEQ ID NO: 3373721 - protein, 23 aa, Plasmodium falciparum
TYDRIKDFICQNDTTVIKKNISN

SEQ ID NO: 3373722 - protein, 17 aa, Plasmodium falciparum
TYECITPTFIISKNKNK

SEQ ID NO: 3373723 - protein, 26 aa, Plasmodium falciparum
TYEKNCWRKTRLREEKVYHKKYKFLK

SEQ ID NO: 3373724 - protein, 19 aa, Plasmodium falciparum
TYFKYCEDIIKGVYGSEIE

SEQ ID NO: 3373725 - protein, 18 aa, Plasmodium falciparum
TYFLNLLFDRIKLNKLKM

SEQ ID NO: 3373726 - protein, 20 aa, Plasmodium falciparum
TYFSAFKILWLIQNNPEIKQ

SEQ ID NO: 3373727 - protein, 18 aa, Plasmodium falciparum
TYFVETGINYGDELPRRN

SEQ ID NO: 3373728 - protein, 17 aa, Plasmodium falciparum
TYGFEIYTLLWSRNNEY

SEQ ID NO: 3373729 - protein, 17 aa, Plasmodium falciparum
TYGLILLPTRELCLQVL

SEQ ID NO: 3373730 - protein, 26 aa, Plasmodium falciparum
TYGVDFFLDICNALSRSNYKPYLSEE

SEQ ID NO: 3373731 - protein, 22 aa, Plasmodium falciparum
TYHDIAPVLWNSFGTITTLLQE

SEQ ID NO: 3373732 - protein, 17 aa, Plasmodium falciparum
TYICNKAVLAVLSIPVI

SEQ ID NO: 3373733 - protein, 17 aa, Plasmodium falciparum
TYIDEKIRKDQHVGDLK

SEQ ID NO: 3373734 - protein, 25 aa, Plasmodium falciparum
TYIIDEFLYRATIGSKFLNYQFDVL

SEQ ID NO: 3373735 - protein, 22 aa, Plasmodium falciparum
TYIKELNEFILILEDIKKVKLR

SEQ ID NO: 3373736 - protein, 21 aa, Plasmodium falciparum
TYIKHSLSFSTDFYFTSNKVK

SEQ ID NO: 3373737 - protein, 24 aa, Plasmodium falciparum
TYIKLFCLAGNFIQDHIKDDFIYY

SEQ ID NO: 3373738 - protein, 26 aa, Plasmodium falciparum
TYISEIGCGFIPREISAHHKYYIIDM

SEQ ID NO: 3373739 - protein, 26 aa, Plasmodium falciparum
TYKGNILFFDLRCMLPIYQNNNLHSN

SEQ ID NO: 3373740 - protein, 19 aa, Plasmodium falciparum
TYKILKCIYENSVINNEVN

SEQ ID NO: 3373741 - protein, 26 aa, Plasmodium falciparum
TYKLRRYETYIGYLRIRTHNDRNELD

SEQ ID NO: 3373742 - protein, 22 aa, Plasmodium falciparum
TYKLWDIRKMEYIKSYKSHNII

SEQ ID NO: 3373743 - protein, 23 aa, Plasmodium falciparum
TYKMVYKIIDYFAYQIHNDGFFH

SEQ ID NO: 3373744 - protein, 25 aa, Plasmodium falciparum
TYLKRVYELYSDIILKNPFYDIDMP

SEQ ID NO: 3373745 - protein, 25 aa, Plasmodium falciparum
TYLLKEKLINFLIFKHIKIEEMKNQ

SEQ ID NO: 3373746 - protein, 27 aa, Plasmodium falciparum
TYLNLFRPYKIEVDSFTSFKDITINTY

SEQ ID NO: 3373747 - protein, 20 aa, Plasmodium falciparum
TYLPECYINDWLLYEYAGAY

SEQ ID NO: 3373748 - protein, 25 aa, Plasmodium falciparum
TYLQELKFLIDNTLLYTHRKGILDN

SEQ ID NO: 3373749 - protein, 17 aa, Plasmodium falciparum
TYLQLKMLMSEYANTCV

SEQ ID NO: 3373750 - protein, 22 aa, Plasmodium falciparum
TYLSENLIRLIILGNSLSNIDN

SEQ ID NO: 3373751 - protein, 17 aa, Plasmodium falciparum
TYMSFNIWNKVFKYVEL

SEQ ID NO: 3373752 - protein, 19 aa, Plasmodium falciparum
TYMSLGMSILCKYSLLYCG

SEQ ID NO: 3373753 - protein, 19 aa, Plasmodium falciparum
TYNAHKYSDIYNIGDEQNH

SEQ ID NO: 3373754 - protein, 30 aa, Plasmodium falciparum
TYNIFHHKWLLKKCNCRGIASYKNIEDSLY

SEQ ID NO: 3373755 - protein, 25 aa, Plasmodium falciparum
TYNQQSQCSLIWNGVVKKKNFKNWK

SEQ ID NO: 3373756 - protein, 17 aa, Plasmodium falciparum
TYNTFSRIKNCNYYSDT

SEQ ID NO: 3373757 - protein, 18 aa, Plasmodium falciparum
TYNTIPFVNFYKQTKNYI

SEQ ID NO: 3373758 - protein, 23 aa, Plasmodium falciparum
TYPFNYNEPFYFIYKPNKDMSMD

SEQ ID NO: 3373759 - protein, 19 aa, Plasmodium falciparum
TYQAEGVWWMYTRENPPEY

SEQ ID NO: 3373760 - protein, 21 aa, Plasmodium falciparum
TYQAFIKKWKTQYEVQREKFK

SEQ ID NO: 3373761 - protein, 25 aa, Plasmodium falciparum
TYRNVCILKSVGINNVIIVINKLDL

SEQ ID NO: 3373762 - protein, 21 aa, Plasmodium falciparum
TYRTSKLLIDRFMKSDNLSKF

SEQ ID NO: 3373763 - protein, 25 aa, Plasmodium falciparum
TYSKKKLCDRLEYYHIKNYIILEKI

SEQ ID NO: 3373764 - protein, 20 aa, Plasmodium falciparum
TYSPNSFRGNLRCFIKDIEL

SEQ ID NO: 3373765 - protein, 24 aa, Plasmodium falciparum
TYSSTDLVLYFARVECKLSEKLST

SEQ ID NO: 3373766 - protein, 18 aa, Plasmodium falciparum
TYSTFDENFFKSHCDVDE

SEQ ID NO: 3373767 - protein, 18 aa, Plasmodium falciparum
TYTGIKLIQAMTRDWIST

SEQ ID NO: 3373768 - protein, 47 aa, Plasmodium falciparum
TYTKLKHRILTKLGYNVIHISYIDWRKLRNKSEREEFILKKLKEKND

SEQ ID NO: 3373769 - protein, 17 aa, Plasmodium falciparum
TYTSILFVSKDVLEETY

SEQ ID NO: 3373770 - protein, 17 aa, Plasmodium falciparum
TYVHLINIAALIHVQGI

SEQ ID NO: 3373771 - protein, 24 aa, Plasmodium falciparum
TYVKYIKSEINNMNNSIGVPTKKN

SEQ ID NO: 3373772 - protein, 17 aa, Plasmodium falciparum
TYVNRLVYFLFMKTNYY

SEQ ID NO: 3373773 - protein, 19 aa, Plasmodium falciparum
TYVRMIKTDFEIEKLKIKM

SEQ ID NO: 3373774 - protein, 25 aa, Plasmodium falciparum
TYVRRPQRKAAKKCISLWSEELRKK

SEQ ID NO: 3373775 - protein, 25 aa, Plasmodium falciparum
TYYASPRGNQIYNLFQDINNNHHNN

SEQ ID NO: 3373776 - protein, 24 aa, Plasmodium falciparum
TYYIPFDILNTFYKYYLSNKLLSH

SEQ ID NO: 3373777 - protein, 28 aa, Plasmodium falciparum
TYYLEFLIMIVLFFKNPVNILLKGITDD

SEQ ID NO: 3373778 - protein, 18 aa, Plasmodium falciparum
TYYNYKYLFIYRKLILSL

SEQ ID NO: 3373779 - protein, 17 aa, Plasmodium falciparum
TYYRKHCTHNHCYNNIN

SEQ ID NO: 3373780 - protein, 20 aa, Plasmodium falciparum
TYYSSFSYKDYVILQEMKEI

SEQ ID NO: 3373781 - protein, 23 aa, Plasmodium falciparum
VAALRLYIELFFKSIDNKQSIQI

SEQ ID NO: 3373782 - protein, 20 aa, Plasmodium falciparum
VACEVCAKKNYIFIFGEITT

SEQ ID NO: 3373783 - protein, 18 aa, Plasmodium falciparum
VACFLIKKKEIFDKETNI

SEQ ID NO: 3373784 - protein, 20 aa, Plasmodium falciparum
VACNMAGGFLQRLENNFSKY

SEQ ID NO: 3373785 - protein, 19 aa, Plasmodium falciparum
VAEKIGITEMEWKKYIKRK

SEQ ID NO: 3373786 - protein, 24 aa, Plasmodium falciparum
VAEKPAKALYVFKKKENMSPIEYM

SEQ ID NO: 3373787 - protein, 18 aa, Plasmodium falciparum
VAELLKDRLDLYIDNEDE

SEQ ID NO: 3373788 - protein, 17 aa, Plasmodium falciparum
VAFKMFLGISGTVTCVN

SEQ ID NO: 3373789 - protein, 28 aa, Plasmodium falciparum
VAILRRLPINCGIFRHFCYKNEMLEKNK

SEQ ID NO: 3373790 - protein, 23 aa, Plasmodium falciparum
VAISYKCMHFYNNLRFKILQALF

SEQ ID NO: 3373791 - protein, 30 aa, Plasmodium falciparum
VAKESKDIIRECVTEFIQFLTSEASDRCTR

SEQ ID NO: 3373792 - protein, 25 aa, Plasmodium falciparum
VAKNIKPLWSLKGHRNSIEGLHLLD

SEQ ID NO: 3373793 - protein, 25 aa, Plasmodium falciparum
VAKNISIKLYRVFEKLNKLFYLPRC

SEQ ID NO: 3373794 - protein, 21 aa, Plasmodium falciparum
VAKRMSSLLLNPQNVIDKEPY

SEQ ID NO: 3373795 - protein, 28 aa, Plasmodium falciparum
VAKSMLSFLYKQLKYCIEDEIQCYYSEV

SEQ ID NO: 3373796 - protein, 18 aa, Plasmodium falciparum
VALNDLWVFNSLNKTFVE

SEQ ID NO: 3373797 - protein, 18 aa, Plasmodium falciparum
VALNMYKGGLIIISHDTY

SEQ ID NO: 3373798 - protein, 17 aa, Plasmodium falciparum
VALPCKKISVFNMLTNL

SEQ ID NO: 3373799 - protein, 18 aa, Plasmodium falciparum
VAMKEGHVLYITNLHNSN

SEQ ID NO: 3373800 - protein, 18 aa, Plasmodium falciparum
VANKRCLNGATCRFAHSV

SEQ ID NO: 3373801 - protein, 22 aa, Plasmodium falciparum
VANKYIPSSFVNKINRVSASLS

SEQ ID NO: 3373802 - protein, 29 aa, Plasmodium falciparum
VANNILFHKRLRHINILSYKGKTADKSKL

SEQ ID NO: 3373803 - protein, 22 aa, Plasmodium falciparum
VANPRGAGWLFGPNVTKKFNHI

SEQ ID NO: 3373804 - protein, 31 aa, Plasmodium falciparum
VANQMKIYINYNFWSAAEIAFILRQITSLCN

SEQ ID NO: 3373805 - protein, 28 aa, Plasmodium falciparum
VAPCPHESICPLALTGKDWCHFSQRVHR

SEQ ID NO: 3373806 - protein, 24 aa, Plasmodium falciparum
VAPKRLRLKLAEELLSKNRKELEL

SEQ ID NO: 3373807 - protein, 29 aa, Plasmodium falciparum
VAQFGASWCAPCKKMKPVIEKLGEDNDNI

SEQ ID NO: 3373808 - protein, 24 aa, Plasmodium falciparum
VAQSRIPILYKRLLYDNCIYENKM

SEQ ID NO: 3373809 - protein, 21 aa, Plasmodium falciparum
VAQTILKTVHNLRHSKPPSRF

SEQ ID NO: 3373810 - protein, 17 aa, Plasmodium falciparum
VASEFIFNLILPDNNFY

SEQ ID NO: 3373811 - protein, 25 aa, Plasmodium falciparum
VASVLCLENRKIIGCIINVNSNETE

SEQ ID NO: 3373812 - protein, 25 aa, Plasmodium falciparum
VATCAKLKGGLHLVKVPGGNILVVL

SEQ ID NO: 3373813 - protein, 23 aa, Plasmodium falciparum
VATGYLHKIPPCQIKDKEEKENI

SEQ ID NO: 3373814 - protein, 17 aa, Plasmodium falciparum
VAWKYLHDRDIAVAAIG

SEQ ID NO: 3373815 - protein, 22 aa, Plasmodium falciparum
VAYLHRCGIIHRDIKPENILLT

SEQ ID NO: 3373816 - protein, 18 aa, Plasmodium falciparum
VCDKLLFRKQFIFHQNLF

SEQ ID NO: 3373817 - protein, 17 aa, Plasmodium falciparum
VCDKVCFEDIIFFLCAY

SEQ ID NO: 3373818 - protein, 20 aa, Plasmodium falciparum
VCDNCTCGKKEKLLNSENKV

SEQ ID NO: 3373819 - protein, 24 aa, Plasmodium falciparum
VCDYSIDETCCLLITSERPDIKCI

SEQ ID NO: 3373820 - protein, 30 aa, Plasmodium falciparum
VCEEPFSFFRRHDCWNNEYNCLHQQERKKK

SEQ ID NO: 3373821 - protein, 18 aa, Plasmodium falciparum
VCEYKQIYLHEGIGNAVR

SEQ ID NO: 3373822 - protein, 19 aa, Plasmodium falciparum
VCFFGHKIGYFSGNIKELV

SEQ ID NO: 3373823 - protein, 19 aa, Plasmodium falciparum
VCHGIPDYRPLKSGDIINI

SEQ ID NO: 3373824 - protein, 18 aa, Plasmodium falciparum
VCHNEPKELYKDIVNLNK

SEQ ID NO: 3373825 - protein, 30 aa, Plasmodium falciparum
VCINELKLKRLLPINPQAHMIINWLEKGVF

SEQ ID NO: 3373826 - protein, 23 aa, Plasmodium falciparum
VCKDLCKYIPQTNGIIIGGMSRN

SEQ ID NO: 3373827 - protein, 21 aa, Plasmodium falciparum
VCKKVCLYKPIILLKSGKTAK

SEQ ID NO: 3373828 - protein, 20 aa, Plasmodium falciparum
VCKYVPKIDVELDCPPPLIV

SEQ ID NO: 3373829 - protein, 26 aa, Plasmodium falciparum
VCLPKSNLIFPVYNLNLYMLKYEDNS

SEQ ID NO: 3373830 - protein, 19 aa, Plasmodium falciparum
VCMYCKLVNLIQIKEKFDF

SEQ ID NO: 3373831 - protein, 20 aa, Plasmodium falciparum
VCNIASYRNSTSFEKTNSII

SEQ ID NO: 3373832 - protein, 18 aa, Plasmodium falciparum
VCNLEIIKMYEHIQNLFS

SEQ ID NO: 3373833 - protein, 20 aa, Plasmodium falciparum
VCNRLGTSCNVLNTISLSQK

SEQ ID NO: 3373834 - protein, 18 aa, Plasmodium falciparum
VCNTSNIKIMNWINPNDK

SEQ ID NO: 3373835 - protein, 18 aa, Plasmodium falciparum
VCRSCEYISLKPNENNNI

SEQ ID NO: 3373836 - protein, 17 aa, Plasmodium falciparum
VCSIDLKIDADDNKKFA

SEQ ID NO: 3373837 - protein, 17 aa, Plasmodium falciparum
VCSKLLGYMSMISRNNI

SEQ ID NO: 3373838 - protein, 21 aa, Plasmodium falciparum
VCSRDLPGHLKMKTRDLSDYV

SEQ ID NO: 3373839 - protein, 20 aa, Plasmodium falciparum
VCTEAGMFALRERRVHVTQE

SEQ ID NO: 3373840 - protein, 19 aa, Plasmodium falciparum
VCTIKLILQQISKDFLNDI

SEQ ID NO: 3373841 - protein, 20 aa, Plasmodium falciparum
VCTIYYRPLEVLLSKFELSN

SEQ ID NO: 3373842 - protein, 18 aa, Plasmodium falciparum
VCYEKLKNSMNILKEKKS

SEQ ID NO: 3373843 - protein, 18 aa, Plasmodium falciparum
VCYHIYNFTDFICKNKDM

SEQ ID NO: 3373844 - protein, 19 aa, Plasmodium falciparum
VDAELQLNEKCIWNSSTLN

SEQ ID NO: 3373845 - protein, 18 aa, Plasmodium falciparum
VDALMIFRDNIQPMWEDP

SEQ ID NO: 3373846 - protein, 31 aa, Plasmodium falciparum
VDASDFLINIILRWNYYTSLKSEKELNLKAV

SEQ ID NO: 3373847 - protein, 20 aa, Plasmodium falciparum
VDATHKLSMQNRINFVCDEL

SEQ ID NO: 3373848 - protein, 19 aa, Plasmodium falciparum
VDDLEAWKLNEGSLGIENQ

SEQ ID NO: 3373849 - protein, 21 aa, Plasmodium falciparum
VDDYYDCLMRTKLTEETPNSL

SEQ ID NO: 3373850 - protein, 22 aa, Plasmodium falciparum
VDEALDIFKLCFEELKKRFLLT

SEQ ID NO: 3373851 - protein, 26 aa, Plasmodium falciparum
VDEDFIRDEFNLIGLQTKVPHFKKLL

SEQ ID NO: 3373852 - protein, 24 aa, Plasmodium falciparum
VDEDKRFLLLFTFLKKNMSKKIMV

SEQ ID NO: 3373853 - protein, 17 aa, Plasmodium falciparum
VDEFLLVSRIAHVDLCN

SEQ ID NO: 3373854 - protein, 24 aa, Plasmodium falciparum
VDEKMLSVHGGVFNKNDFEYGGKI

SEQ ID NO: 3373855 - protein, 24 aa, Plasmodium falciparum
VDELKLRYAFWLKFLVKYIFKWLL

SEQ ID NO: 3373856 - protein, 25 aa, Plasmodium falciparum
VDEYTIRIVDVFAMPQSGNSVSVEA

SEQ ID NO: 3373857 - protein, 28 aa, Plasmodium falciparum
VDFFAEWCGPCKRIAPFYEECSKTYTKM

SEQ ID NO: 3373858 - protein, 19 aa, Plasmodium falciparum
VDFILKNYIRKVIFAKKKK

SEQ ID NO: 3373859 - protein, 19 aa, Plasmodium falciparum
VDFSSKFISHGKFLDDEKI

SEQ ID NO: 3373860 - protein, 33 aa, Plasmodium falciparum
VDFYKNNFLPFFYIPCNYLFIKNYCNDNERCLE

SEQ ID NO: 3373861 - protein, 17 aa, Plasmodium falciparum
VDHGKTTLLDRLRHSNI

SEQ ID NO: 3373862 - protein, 19 aa, Plasmodium falciparum
VDHNLHLFKYYDQQKNYYT

SEQ ID NO: 3373863 - protein, 18 aa, Plasmodium falciparum
VDIAIKRKVKGLILQSAI

SEQ ID NO: 3373864 - protein, 26 aa, Plasmodium falciparum
VDICVHNNCSFFFSVFSTKKKPSRFI

SEQ ID NO: 3373865 - protein, 21 aa, Plasmodium falciparum
VDIFNYLKINRMRQFIRFIIE

SEQ ID NO: 3373866 - protein, 19 aa, Plasmodium falciparum
VDIGSLVGYTIRFEDNTTK

SEQ ID NO: 3373867 - protein, 17 aa, Plasmodium falciparum
VDIKIRQCDEVIRINLF

SEQ ID NO: 3373868 - protein, 26 aa, Plasmodium falciparum
VDIQISNKMLFPLKMKFLNFEKTLSM

SEQ ID NO: 3373869 - protein, 26 aa, Plasmodium falciparum
VDKESISSFNYFFFAKKNKRILFISC

SEQ ID NO: 3373870 - protein, 23 aa, Plasmodium falciparum
VDKKHYRFCIKKLCDKIIPNKCS

SEQ ID NO: 3373871 - protein, 19 aa, Plasmodium falciparum
VDKKIFFKKIINSNDIIKK

SEQ ID NO: 3373872 - protein, 26 aa, Plasmodium falciparum
VDKKLIWGNVQPFLYIPSNDYMDDAE

SEQ ID NO: 3373873 - protein, 23 aa, Plasmodium falciparum
VDKNNILHLFTLPDHIYKSDFDM

SEQ ID NO: 3373874 - protein, 20 aa, Plasmodium falciparum
VDKVPRINFDNMKKNIISEQ

SEQ ID NO: 3373875 - protein, 17 aa, Plasmodium falciparum
VDLFFKNKYKTLISDIE

SEQ ID NO: 3373876 - protein, 26 aa, Plasmodium falciparum
VDMCDHLMQRFGFNDFILLNDCNLCY

SEQ ID NO: 3373877 - protein, 25 aa, Plasmodium falciparum
VDMCKCIPDGIVAYFPSYIYMEQVI

SEQ ID NO: 3373878 - protein, 25 aa, Plasmodium falciparum
VDMNSCIALTYACFNIHYEDDNILK

SEQ ID NO: 3373879 - protein, 19 aa, Plasmodium falciparum
VDMWLYISSNVLKLKVIQK

SEQ ID NO: 3373880 - protein, 23 aa, Plasmodium falciparum
VDMWSCGCVLAELLTSNPLFSAE

SEQ ID NO: 3373881 - protein, 25 aa, Plasmodium falciparum
VDNAFFKNMFSSVHAKVFNYFKRAF

SEQ ID NO: 3373882 - protein, 19 aa, Plasmodium falciparum
VDNILNIRNKIYIETRERN

SEQ ID NO: 3373883 - protein, 23 aa, Plasmodium falciparum
VDNLKFILNDLLSYVDHKDGKRN

SEQ ID NO: 3373884 - protein, 24 aa, Plasmodium falciparum
VDNYLKERPIIILRYKGFQKKDKK

SEQ ID NO: 3373885 - protein, 26 aa, Plasmodium falciparum
VDPYKGMKTFNCRKLAKQNIIRNLDG

SEQ ID NO: 3373886 - protein, 17 aa, Plasmodium falciparum
VDQKIGTVLIDIKCPVQ

SEQ ID NO: 3373887 - protein, 29 aa, Plasmodium falciparum
VDRVNPECFCKPSRAILENDIKQLEEVLH

SEQ ID NO: 3373888 - protein, 17 aa, Plasmodium falciparum
VDSFSYCGTNFHSGNIS

SEQ ID NO: 3373889 - protein, 19 aa, Plasmodium falciparum
VDSIKCASNVRLQNIHLIR

SEQ ID NO: 3373890 - protein, 24 aa, Plasmodium falciparum
VDSKQIKGTCLIQHNEKIIKKTNQ

SEQ ID NO: 3373891 - protein, 17 aa, Plasmodium falciparum
VDSNILINIVQYKNYPN

SEQ ID NO: 3373892 - protein, 27 aa, Plasmodium falciparum
VDSNILLCGFPIFLRKSYYNNKSDYFY

SEQ ID NO: 3373893 - protein, 21 aa, Plasmodium falciparum
VDSSLRILSILKISSIIKDGD

SEQ ID NO: 3373894 - protein, 17 aa, Plasmodium falciparum
VDSVILTNVHFDYISKQ

SEQ ID NO: 3373895 - protein, 17 aa, Plasmodium falciparum
VDVLLLLKANKKKRRKY

SEQ ID NO: 3373896 - protein, 18 aa, Plasmodium falciparum
VDVYKHMRANNKIETYNH

SEQ ID NO: 3373897 - protein, 21 aa, Plasmodium falciparum
VDWFLPTQVPKRWLSRNPADI

SEQ ID NO: 3373898 - protein, 17 aa, Plasmodium falciparum
VDYKKCYPDAFTSEKDN

SEQ ID NO: 3373899 - protein, 17 aa, Plasmodium falciparum
VEADFLVHYGISCQSFI

SEQ ID NO: 3373900 - protein, 20 aa, Plasmodium falciparum
VEAQRIIFKGKILKDKESLT

SEQ ID NO: 3373901 - protein, 22 aa, Plasmodium falciparum
VECKDPHACTILLRGSTKDVLN

SEQ ID NO: 3373902 - protein, 26 aa, Plasmodium falciparum
VECSVGRLWTILKCKDLMISMRKCLK

SEQ ID NO: 3373903 - protein, 25 aa, Plasmodium falciparum
VEDALCNYINFEIVCEKVGLSNANI

SEQ ID NO: 3373904 - protein, 25 aa, Plasmodium falciparum
VEDGNGCYNICCLQKNVCEDTPLDI

SEQ ID NO: 3373905 - protein, 26 aa, Plasmodium falciparum
VEDIKKMRLKICKIFNINHRNNLNNN

SEQ ID NO: 3373906 - protein, 32 aa, Plasmodium falciparum
VEDKSKCFFCSKRIGLVGIKCRCNHYFCSLHR

SEQ ID NO: 3373907 - protein, 19 aa, Plasmodium falciparum
VEEALKMYLIKSYHKTASL

SEQ ID NO: 3373908 - protein, 19 aa, Plasmodium falciparum
VEEFIRKLMENEDMANKFN

SEQ ID NO: 3373909 - protein, 31 aa, Plasmodium falciparum
VEEFKKMEIIKGFLIKNINKYGINFELLNFN

SEQ ID NO: 3373910 - protein, 23 aa, Plasmodium falciparum
VEEIYKYKNIYSVFISKIHDKNV

SEQ ID NO: 3373911 - protein, 22 aa, Plasmodium falciparum
VEEKKKFFSFLKTFYDNILENE

SEQ ID NO: 3373912 - protein, 30 aa, Plasmodium falciparum
VEEKKRINNFLQYRIPHMNNNGNIQNEKKN

SEQ ID NO: 3373913 - protein, 18 aa, Plasmodium falciparum
VEELRKTLEYEYNSKIKL

SEQ ID NO: 3373914 - protein, 26 aa, Plasmodium falciparum
VEEQGNCGLCWIFASKLHFETIRCMR

SEQ ID NO: 3373915 - protein, 19 aa, Plasmodium falciparum
VEEVFTLEILIKILSKIFL

SEQ ID NO: 3373916 - protein, 18 aa, Plasmodium falciparum
VEFTIPVFYCSKEKKKKI

SEQ ID NO: 3373917 - protein, 21 aa, Plasmodium falciparum
VEGNENLGIFEFIKLITNGLY

SEQ ID NO: 3373918 - protein, 18 aa, Plasmodium falciparum
VEHFKQLYLYNNNYMDNI

SEQ ID NO: 3373919 - protein, 25 aa, Plasmodium falciparum
VEHFKRRFRIHYGKEANEYDLNKNI

SEQ ID NO: 3373920 - protein, 17 aa, Plasmodium falciparum
VEHINCTDNPYDNYNNS

SEQ ID NO: 3373921 - protein, 18 aa, Plasmodium falciparum
VEIFFPYDYIYPEQYAYM

SEQ ID NO: 3373922 - protein, 27 aa, Plasmodium falciparum
VEIHRRYDIKGSLVGRTVPETKREDHT

SEQ ID NO: 3373923 - protein, 23 aa, Plasmodium falciparum
VEILEFATPITIIYGNNGSGKST

SEQ ID NO: 3373924 - protein, 23 aa, Plasmodium falciparum
VEKEFLIGPYVLDFALKKKKICI

SEQ ID NO: 3373925 - protein, 22 aa, Plasmodium falciparum
VEKELYTSFNFDLKNLNYEDIE

SEQ ID NO: 3373926 - protein, 19 aa, Plasmodium falciparum
VEKFSYCSCNNFDIFKKLD

SEQ ID NO: 3373927 - protein, 20 aa, Plasmodium falciparum
VEKKEYHSSCESMNDEERVS

SEQ ID NO: 3373928 - protein, 21 aa, Plasmodium falciparum
VEKKGKSSYFYENKEKISNSD

SEQ ID NO: 3373929 - protein, 19 aa, Plasmodium falciparum
VEKKIVIVQNFYKDINKGI

SEQ ID NO: 3373930 - protein, 24 aa, Plasmodium falciparum
VEKKKRFLLNIVYRNKDYENISNQ

SEQ ID NO: 3373931 - protein, 24 aa, Plasmodium falciparum
VEKMTILKMIIKYENFNSIMNQKI

SEQ ID NO: 3373932 - protein, 19 aa, Plasmodium falciparum
VEKWFDKDIDLFRKKYNIT

SEQ ID NO: 3373933 - protein, 17 aa, Plasmodium falciparum
VEKWKKEHTIDGKDATN

SEQ ID NO: 3373934 - protein, 21 aa, Plasmodium falciparum
VELKYYKGIFLFLKSLFVGIP

SEQ ID NO: 3373935 - protein, 24 aa, Plasmodium falciparum
VELNIIRNLPLISIIGRPNVGKST

SEQ ID NO: 3373936 - protein, 26 aa, Plasmodium falciparum
VELNRGPGVISCFKYDNMNNIVSMYP

SEQ ID NO: 3373937 - protein, 24 aa, Plasmodium falciparum
VELSHMNRWIALVFQEDTEILLQE

SEQ ID NO: 3373938 - protein, 18 aa, Plasmodium falciparum
VELSNLYSTFQLVQKTVS

SEQ ID NO: 3373939 - protein, 23 aa, Plasmodium falciparum
VEMLKKLNCVFINVTHLITDIIM

SEQ ID NO: 3373940 - protein, 18 aa, Plasmodium falciparum
VENAGFMFYIKYEVPLLL

SEQ ID NO: 3373941 - protein, 17 aa, Plasmodium falciparum
VENCSGKIQYSEYANVI

SEQ ID NO: 3373942 - protein, 18 aa, Plasmodium falciparum
VENCVKIFSQKIEHLHNL

SEQ ID NO: 3373943 - protein, 21 aa, Plasmodium falciparum
VENFHKPYDSIIIKPIPNKSI

SEQ ID NO: 3373944 - protein, 24 aa, Plasmodium falciparum
VENFTTRLKLCFYENIDKIHYEKK

SEQ ID NO: 3373945 - protein, 28 aa, Plasmodium falciparum
VENIYHCFKCLKSVLHICIDDEDSNNNN

SEQ ID NO: 3373946 - protein, 25 aa, Plasmodium falciparum
VENPRGYRVPYEYQSQRFYEYFEVP

SEQ ID NO: 3373947 - protein, 25 aa, Plasmodium falciparum
VENPRIVKFSIGWDSEEKDEFKEFD

SEQ ID NO: 3373948 - protein, 18 aa, Plasmodium falciparum
VEQAFAFYVKTLTHSGKG

SEQ ID NO: 3373949 - protein, 18 aa, Plasmodium falciparum
VEQMKNFLKNGITENGVR

SEQ ID NO: 3373950 - protein, 27 aa, Plasmodium falciparum
VEQSLPPKREIYIFVGMSKLQKKLYSD

SEQ ID NO: 3373951 - protein, 24 aa, Plasmodium falciparum
VERMMLHCWIILKNKELNNLKKSE

SEQ ID NO: 3373952 - protein, 23 aa, Plasmodium falciparum
VERNLAIGIYHKFMKLKDNDFNI

SEQ ID NO: 3373953 - protein, 26 aa, Plasmodium falciparum
VESENCWLSKVASYILPSAKKNNESI

SEQ ID NO: 3373954 - protein, 25 aa, Plasmodium falciparum
VESHFGYCCIYAFQVKVLPDSVKQA

SEQ ID NO: 3373955 - protein, 18 aa, Plasmodium falciparum
VESIWKLPKKYKLLKKSY

SEQ ID NO: 3373956 - protein, 31 aa, Plasmodium falciparum
VESKFGSYILQKFGWEKGKGLGKHENGDVKI

SEQ ID NO: 3373957 - protein, 25 aa, Plasmodium falciparum
VESKHWNNICLKDLYDKNDIKLNKT

SEQ ID NO: 3373958 - protein, 26 aa, Plasmodium falciparum
VESLRAIPWVFSWTQNRMHLSVWLGI

SEQ ID NO: 3373959 - protein, 36 aa, Plasmodium falciparum
VESVTCFDLQLTENVFLIWQFLKLYLSTSPQVRSII

SEQ ID NO: 3373960 - protein, 25 aa, Plasmodium falciparum
VEVSTHRHGCCVIQRCIDSANEAQK

SEQ ID NO: 3373961 - protein, 19 aa, Plasmodium falciparum
VEYIKRCFNYLLRQDDNFI

SEQ ID NO: 3373962 - protein, 22 aa, Plasmodium falciparum
VEYKINQFLSLYNKPSSGTKVL

SEQ ID NO: 3373963 - protein, 21 aa, Plasmodium falciparum
VEYPFAISNKIIFKKNNNNNN

SEQ ID NO: 3373964 - protein, 18 aa, Plasmodium falciparum
VFDAKRLIGRKFSETTVQ

SEQ ID NO: 3373965 - protein, 19 aa, Plasmodium falciparum
VFEKLRPSKPVNVKTSSDE

SEQ ID NO: 3373966 - protein, 18 aa, Plasmodium falciparum
VFGELALLYNSKRAATAT

SEQ ID NO: 3373967 - protein, 18 aa, Plasmodium falciparum
VFGKVQGVFFRKYTKLEA

SEQ ID NO: 3373968 - protein, 23 aa, Plasmodium falciparum
VFHPELLPHTAFQQYFYEKVKNY

SEQ ID NO: 3373969 - protein, 19 aa, Plasmodium falciparum
VFICSSFITYCGMFNTEFR

SEQ ID NO: 3373970 - protein, 32 aa, Plasmodium falciparum
VFIDYKSKCVLKLQELQPFLGSYYQDIFNYIT

SEQ ID NO: 3373971 - protein, 26 aa, Plasmodium falciparum
VFIENCLKNECKLFIHIYETLRILYF

SEQ ID NO: 3373972 - protein, 20 aa, Plasmodium falciparum
VFIKILLLNIITKFSQLPCE

SEQ ID NO: 3373973 - protein, 25 aa, Plasmodium falciparum
VFILLKNRILLIAIDEVHCMSEWGH

SEQ ID NO: 3373974 - protein, 17 aa, Plasmodium falciparum
VFIVGFARTPIGALGGC

SEQ ID NO: 3373975 - protein, 19 aa, Plasmodium falciparum
VFKGRCKKNKNIVAVKKIF

SEQ ID NO: 3373976 - protein, 19 aa, Plasmodium falciparum
VFKLLNLLNKILMVIKEND

SEQ ID NO: 3373977 - protein, 25 aa, Plasmodium falciparum
VFKNLKVLDLRSNFINHPVQLFYIL

SEQ ID NO: 3373978 - protein, 22 aa, Plasmodium falciparum
VFKNLQLLKIFNFYELINVINY

SEQ ID NO: 3373979 - protein, 19 aa, Plasmodium falciparum
VFLSVYYPNGRKIERRPLV

SEQ ID NO: 3373980 - protein, 19 aa, Plasmodium falciparum
VFPIYNFNRYENFLINHLT

SEQ ID NO: 3373981 - protein, 29 aa, Plasmodium falciparum
VFRAKYKTIHVACKIFLYKPKDLAEESYC

SEQ ID NO: 3373982 - protein, 27 aa, Plasmodium falciparum
VFSMRLKEWYGWHFPELGKVITDNKIY

SEQ ID NO: 3373983 - protein, 18 aa, Plasmodium falciparum
VFSNLSFYDYIIKEKKKN

SEQ ID NO: 3373984 - protein, 26 aa, Plasmodium falciparum
VFTCLLCIVNSKFPNIGLLTIQRIIL

SEQ ID NO: 3373985 - protein, 19 aa, Plasmodium falciparum
VFTKLYFSIHNIFLTDEDM

SEQ ID NO: 3373986 - protein, 31 aa, Plasmodium falciparum
VFTNFICSFSNAWLEPIFIISNFIINRANNQ

SEQ ID NO: 3373987 - protein, 23 aa, Plasmodium falciparum
VFTPELLQKLSFHFEQNDSLISL

SEQ ID NO: 3373988 - protein, 19 aa, Plasmodium falciparum
VFVDNCLILNNFLDVDFPT

SEQ ID NO: 3373989 - protein, 17 aa, Plasmodium falciparum
VFVMFQVLKKMIEETKD

SEQ ID NO: 3373990 - protein, 17 aa, Plasmodium falciparum
VFVTFLFLWNDNLIDKV

SEQ ID NO: 3373991 - protein, 17 aa, Plasmodium falciparum
VFYGIKKSKNILSSSYD

SEQ ID NO: 3373992 - protein, 24 aa, Plasmodium falciparum
VFYKMEYLIHNYFYLKRSDFDNLI

SEQ ID NO: 3373993 - protein, 22 aa, Plasmodium falciparum
VFYTFMCKFYFFNVKNKTIDTT

SEQ ID NO: 3373994 - protein, 26 aa, Plasmodium falciparum
VGAPSFKEALRYGAEVYHTLKSEIKK

SEQ ID NO: 3373995 - protein, 21 aa, Plasmodium falciparum
VGAYAAKKIVDYILEKQKEEN

SEQ ID NO: 3373996 - protein, 18 aa, Plasmodium falciparum
VGCAKNFLRSKNYYKHYH

SEQ ID NO: 3373997 - protein, 23 aa, Plasmodium falciparum
VGCPHCTCITHKNISMTRGKTYS

SEQ ID NO: 3373998 - protein, 20 aa, Plasmodium falciparum
VGDGILEFVIYQSGVDLGLE

SEQ ID NO: 3373999 - protein, 18 aa, Plasmodium falciparum
VGDYMYRVVTKNEKHIKR

SEQ ID NO: 3374000 - protein, 19 aa, Plasmodium falciparum
VGEIIRLEGNYAYIQVYED

SEQ ID NO: 3374001 - protein, 38 aa, Plasmodium falciparum
VGELVKSGIISIPIVFVCIKQLLEKRESYISIKNDTKE

SEQ ID NO: 3374002 - protein, 17 aa, Plasmodium falciparum
VGGNFISKIFRGEHTGL

SEQ ID NO: 3374003 - protein, 18 aa, Plasmodium falciparum
VGIKGAVRRSYDIHLIHA

SEQ ID NO: 3374004 - protein, 39 aa, Plasmodium falciparum
VGILRKKRSLNFCLFEWNKKKCIIRIFKYMDIYLYIYNN

SEQ ID NO: 3374005 - protein, 19 aa, Plasmodium falciparum
VGILTRRSVLNAYNSDITA

SEQ ID NO: 3374006 - protein, 21 aa, Plasmodium falciparum
VGITMCECLLGFVPVTSKFES

SEQ ID NO: 3374007 - protein, 25 aa, Plasmodium falciparum
VGITRAKFLLYLLCSIQNNNSEKNT

SEQ ID NO: 3374008 - protein, 20 aa, Plasmodium falciparum
VGKIFLHQLFSWILYGQLID

SEQ ID NO: 3374009 - protein, 20 aa, Plasmodium falciparum
VGKNLCFFKSDAYNILSTLR

SEQ ID NO: 3374010 - protein, 17 aa, Plasmodium falciparum
VGKSCLLLRFADDTYTD

SEQ ID NO: 3374011 - protein, 18 aa, Plasmodium falciparum
VGLFSSPHIFSLRERIIV

SEQ ID NO: 3374012 - protein, 18 aa, Plasmodium falciparum
VGLHCCGGLTDYTIKKCM

SEQ ID NO: 3374013 - protein, 28 aa, Plasmodium falciparum
VGNIKSYINRDICKALENVKRSNYQVNN

SEQ ID NO: 3374014 - protein, 18 aa, Plasmodium falciparum
VGNIYEIIFFVITNFITL

SEQ ID NO: 3374015 - protein, 17 aa, Plasmodium falciparum
VGNLEESITCFNNHKKK

SEQ ID NO: 3374016 - protein, 18 aa, Plasmodium falciparum
VGNSCFKNDNGYSSYNDP

SEQ ID NO: 3374017 - protein, 33 aa, Plasmodium falciparum
VGNTIPVNGKQFFNFNNLYFLPNALNTFDNNIY

SEQ ID NO: 3374018 - protein, 23 aa, Plasmodium falciparum
VGPGRKKNVNFKMEENADTNVNY

SEQ ID NO: 3374019 - protein, 29 aa, Plasmodium falciparum
VGPHQSRARRHAILKAKFDNLNVENKNKH

SEQ ID NO: 3374020 - protein, 21 aa, Plasmodium falciparum
VGPYAIYAHVLFSTPEEAKRC

SEQ ID NO: 3374021 - protein, 17 aa, Plasmodium falciparum
VGQFKAREASLFLVDLI

SEQ ID NO: 3374022 - protein, 26 aa, Plasmodium falciparum
VGQGEGNKMKECSDLKNTLSSIEDEE

SEQ ID NO: 3374023 - protein, 19 aa, Plasmodium falciparum
VGQLISEKYLADFINKDIF

SEQ ID NO: 3374024 - protein, 28 aa, Plasmodium falciparum
VGSPDSFKYKYFFSPVMNLMSSIGPTDR

SEQ ID NO: 3374025 - protein, 24 aa, Plasmodium falciparum
VGSPEMFFNNIVLDVLTDFNNIHV

SEQ ID NO: 3374026 - protein, 19 aa, Plasmodium falciparum
VGTTFLSDGSMRFEKDSPE

SEQ ID NO: 3374027 - protein, 18 aa, Plasmodium falciparum
VGVNIIKDACKAPIKQIA

SEQ ID NO: 3374028 - protein, 19 aa, Plasmodium falciparum
VGVQILLNYVCNFLPSPKE

SEQ ID NO: 3374029 - protein, 28 aa, Plasmodium falciparum
VGVSSLIPYLKLFSTEILNNVLPSAQSL

SEQ ID NO: 3374030 - protein, 20 aa, Plasmodium falciparum
VGYFKRIFKLPNNILDDTAK

SEQ ID NO: 3374031 - protein, 21 aa, Plasmodium falciparum
VGYMLRPFYFISYSQDRFVTC

SEQ ID NO: 3374032 - protein, 24 aa, Plasmodium falciparum
VGYNNKTCWPRDCRMRKMKHDVNL

SEQ ID NO: 3374033 - protein, 24 aa, Plasmodium falciparum
VGYPRRVMTALGPLPLPEEFKKNI

SEQ ID NO: 3374034 - protein, 25 aa, Plasmodium falciparum
VHDINRLKFDMEVRNIDIDNVKKKI

SEQ ID NO: 3374035 - protein, 26 aa, Plasmodium falciparum
VHDVFFLIKGVFAFYTYYNQVLSTCV

SEQ ID NO: 3374036 - protein, 26 aa, Plasmodium falciparum
VHEKNNLEFIACFTYLYTYINVSNAY

SEQ ID NO: 3374037 - protein, 25 aa, Plasmodium falciparum
VHFSWKKGMLLNNAFLVIRKMGDGT

SEQ ID NO: 3374038 - protein, 17 aa, Plasmodium falciparum
VHIIKHDFPLLSVCSDK

SEQ ID NO: 3374039 - protein, 23 aa, Plasmodium falciparum
VHIPLTSLVYIPGKIVNTDNFLV

SEQ ID NO: 3374040 - protein, 23 aa, Plasmodium falciparum
VHKKNVKYSYAIEEKVQNENVEN

SEQ ID NO: 3374041 - protein, 17 aa, Plasmodium falciparum
VHLENNVYDNIIYDDYK

SEQ ID NO: 3374042 - protein, 21 aa, Plasmodium falciparum
VHLNLKFIILKNIEKDDNCLC

SEQ ID NO: 3374043 - protein, 17 aa, Plasmodium falciparum
VHLRPHYDITDFDKTAK

SEQ ID NO: 3374044 - protein, 19 aa, Plasmodium falciparum
VHLRSLLGNVGFIKDICYF

SEQ ID NO: 3374045 - protein, 38 aa, Plasmodium falciparum
VHLSILLFPLCFYDFDSRWYRCIENFEELYKHLVCTNN

SEQ ID NO: 3374046 - protein, 23 aa, Plasmodium falciparum
VHNALSYTCLKFLHDCGNENEDV

SEQ ID NO: 3374047 - protein, 18 aa, Plasmodium falciparum
VHNIKQQKKIIGKLIGNI

SEQ ID NO: 3374048 - protein, 17 aa, Plasmodium falciparum
VHNLSNFLIHTLINKEN

SEQ ID NO: 3374049 - protein, 22 aa, Plasmodium falciparum
VHNMDWFFKNENLCNMNNVRDQ

SEQ ID NO: 3374050 - protein, 18 aa, Plasmodium falciparum
VHPKNGRNIFQTSKNTSF

SEQ ID NO: 3374051 - protein, 23 aa, Plasmodium falciparum
VHQKKEDWDYILFLYTSNNKMIY

SEQ ID NO: 3374052 - protein, 25 aa, Plasmodium falciparum
VHRIRRFRCAFGLLQAKLAAEQFRK

SEQ ID NO: 3374053 - protein, 22 aa, Plasmodium falciparum
VHRKKIDGGGLIKREIKKKEKD

SEQ ID NO: 3374054 - protein, 18 aa, Plasmodium falciparum
VHSIDWQVGYAISHGLSL

SEQ ID NO: 3374055 - protein, 23 aa, Plasmodium falciparum
VHSPANLWMWFEPYLLEEDEFSI

SEQ ID NO: 3374056 - protein, 24 aa, Plasmodium falciparum
VHSRLMELFLFISTLRRSSAKKVT

SEQ ID NO: 3374057 - protein, 17 aa, Plasmodium falciparum
VHTKEYIKYVCKTCKYT

SEQ ID NO: 3374058 - protein, 26 aa, Plasmodium falciparum
VHTLKRPEGLYNIAETQSTHFLKDNN

SEQ ID NO: 3374059 - protein, 17 aa, Plasmodium falciparum
VHTNYTFDEFFWNKKSH

SEQ ID NO: 3374060 - protein, 17 aa, Plasmodium falciparum
VHTSPLIDLQHSNKNKS

SEQ ID NO: 3374061 - protein, 25 aa, Plasmodium falciparum
VHTVKCAYKAVPFTDEELVNIFNVD

SEQ ID NO: 3374062 - protein, 24 aa, Plasmodium falciparum
VHTVLNFYLKWMNKWNNIFDLAKC

SEQ ID NO: 3374063 - protein, 20 aa, Plasmodium falciparum
VIALRCLKSPLGCGIDEKTV

SEQ ID NO: 3374064 - protein, 32 aa, Plasmodium falciparum
VIANRITPYFKGIIRTRRFLKLVDKTGHKYLY

SEQ ID NO: 3374065 - protein, 24 aa, Plasmodium falciparum
VIASCSWSKNVLIWDLYARQNKGS

SEQ ID NO: 3374066 - protein, 25 aa, Plasmodium falciparum
VICEYPKRGFAVLLITNELQKNINY

SEQ ID NO: 3374067 - protein, 24 aa, Plasmodium falciparum
VICKCGYHFCFECLHEFHRPLLCS

SEQ ID NO: 3374068 - protein, 19 aa, Plasmodium falciparum
VICSKEFRVCGAIGACSSN

SEQ ID NO: 3374069 - protein, 20 aa, Plasmodium falciparum
VICSKRLENDNCNNKILTQN

SEQ ID NO: 3374070 - protein, 19 aa, Plasmodium falciparum
VIDAYAGWDERCRIKVRVI

SEQ ID NO: 3374071 - protein, 27 aa, Plasmodium falciparum
VIDREINCFFPTHFDNSLAFSHGLLAG

SEQ ID NO: 3374072 - protein, 23 aa, Plasmodium falciparum
VIDSKSVRSSVCCNIKGNEKKYL

SEQ ID NO: 3374073 - protein, 18 aa, Plasmodium falciparum
VIDYFFYRCANLKPLDRM

SEQ ID NO: 3374074 - protein, 22 aa, Plasmodium falciparum
VIDYKKMCTTFKNLKHIKKKNI

SEQ ID NO: 3374075 - protein, 19 aa, Plasmodium falciparum
VIEAFRITYRKVQNWDLSL

SEQ ID NO: 3374076 - protein, 32 aa, Plasmodium falciparum
VIEKILYEEFLPFGNIEYVRYIPNKNIAFIQF

SEQ ID NO: 3374077 - protein, 19 aa, Plasmodium falciparum
VIESLLRKEFQEYRRSPKN

SEQ ID NO: 3374078 - protein, 17 aa, Plasmodium falciparum
VIEYTHKEIENIKESFC

SEQ ID NO: 3374079 - protein, 17 aa, Plasmodium falciparum
VIFGKRKKKVIELHLAL

SEQ ID NO: 3374080 - protein, 22 aa, Plasmodium falciparum
VIFRKFKFHKNLFVNMDSCNSW

SEQ ID NO: 3374081 - protein, 20 aa, Plasmodium falciparum
VIHFIEFLHYIFMSENMTQW

SEQ ID NO: 3374082 - protein, 18 aa, Plasmodium falciparum
VIHHFNKPLNDFLEIDIK

SEQ ID NO: 3374083 - protein, 19 aa, Plasmodium falciparum
VIHIRGLCEYIKQLYISES

SEQ ID NO: 3374084 - protein, 21 aa, Plasmodium falciparum
VIHKCLFTFDNMYIVSASKDE

SEQ ID NO: 3374085 - protein, 17 aa, Plasmodium falciparum
VIHKEYFSNSIFRKYTH

SEQ ID NO: 3374086 - protein, 20 aa, Plasmodium falciparum
VIHKYNWMYEDFYVNRLISQ

SEQ ID NO: 3374087 - protein, 17 aa, Plasmodium falciparum
VIHMRECCANYLLNNAI

SEQ ID NO: 3374088 - protein, 17 aa, Plasmodium falciparum
VIHPEGYINKVIITTNE

SEQ ID NO: 3374089 - protein, 17 aa, Plasmodium falciparum
VIHVCKKQNTLFLKYKA

SEQ ID NO: 3374090 - protein, 18 aa, Plasmodium falciparum
VIHYSCRSICAFTKNPKG

SEQ ID NO: 3374091 - protein, 25 aa, Plasmodium falciparum
VIIFGGKCLYNNSIVSLNDMWIFSF

SEQ ID NO: 3374092 - protein, 19 aa, Plasmodium falciparum
VIIIILCYFVEKNATIKIR

SEQ ID NO: 3374093 - protein, 22 aa, Plasmodium falciparum
VIIKGLELLYSLGALNDEGNLT

SEQ ID NO: 3374094 - protein, 25 aa, Plasmodium falciparum
VIIKNEKMMFYFLYNTKDVLNNIIY

SEQ ID NO: 3374095 - protein, 18 aa, Plasmodium falciparum
VIISALQLYSLIEKQTKD

SEQ ID NO: 3374096 - protein, 22 aa, Plasmodium falciparum
VIKAEGDSLILLQTRNVSYEIS

SEQ ID NO: 3374097 - protein, 24 aa, Plasmodium falciparum
VIKFIPDEKIIWSILKSDISPSLT

SEQ ID NO: 3374098 - protein, 17 aa, Plasmodium falciparum
VIKHDRMDNDLKNINNM

SEQ ID NO: 3374099 - protein, 18 aa, Plasmodium falciparum
VIKKSYRTLAMKWHPDKN

SEQ ID NO: 3374100 - protein, 26 aa, Plasmodium falciparum
VIKLESNKSLIIFPVNIHEYGNKYIA

SEQ ID NO: 3374101 - protein, 22 aa, Plasmodium falciparum
VIKNSVISSIFLKVLKNKNKNY

SEQ ID NO: 3374102 - protein, 17 aa, Plasmodium falciparum
VIKRLMGDVPFGILLSG

SEQ ID NO: 3374103 - protein, 18 aa, Plasmodium falciparum
VIKYIKLFPTRDGIDLSK

SEQ ID NO: 3374104 - protein, 17 aa, Plasmodium falciparum
VILICSLNNLPLKNNKI

SEQ ID NO: 3374105 - protein, 20 aa, Plasmodium falciparum
VIMFDKRKGYGFIKPNDGGP

SEQ ID NO: 3374106 - protein, 25 aa, Plasmodium falciparum
VINEKYKLLEIELCKEKNIRDQQNV

SEQ ID NO: 3374107 - protein, 27 aa, Plasmodium falciparum
VINFLLQTEIIPLCLRIMETGSELSKT

SEQ ID NO: 3374108 - protein, 17 aa, Plasmodium falciparum
VINNMCYGLMNSNDDLN

SEQ ID NO: 3374109 - protein, 18 aa, Plasmodium falciparum
VINSFKLVSGGYDNQVII

SEQ ID NO: 3374110 - protein, 24 aa, Plasmodium falciparum
VIPRCFLCIWQTLFMVTGIKILNK

SEQ ID NO: 3374111 - protein, 21 aa, Plasmodium falciparum
VIPYIYKKIYIVKSTYDQKNG

SEQ ID NO: 3374112 - protein, 35 aa, Plasmodium falciparum
VIQKRNHIFCVKKSGPFCGFLITIDVEIRKGEHFG

SEQ ID NO: 3374113 - protein, 27 aa, Plasmodium falciparum
VIQMVLANILIHFNISNRYVYFHNVND

SEQ ID NO: 3374114 - protein, 29 aa, Plasmodium falciparum
VIRLRHIHKRILIFFYNYFLNSEYFISQH

SEQ ID NO: 3374115 - protein, 37 aa, Plasmodium falciparum
VIRPLKKLFKCEYFEMECIKLIIHIFDKIISKMKKEI

SEQ ID NO: 3374116 - protein, 17 aa, Plasmodium falciparum
VISEKLRNALNIEPNEP

SEQ ID NO: 3374117 - protein, 26 aa, Plasmodium falciparum
VISKDKFKIINSYIDYKLNYHKNNKY

SEQ ID NO: 3374118 - protein, 17 aa, Plasmodium falciparum
VISKGSDAMKCAVGPEE

SEQ ID NO: 3374119 - protein, 17 aa, Plasmodium falciparum
VISSGKEAYVFNAIKYI

SEQ ID NO: 3374120 - protein, 25 aa, Plasmodium falciparum
VIVAALKNSYLWDTVRGLNGAYGVF

SEQ ID NO: 3374121 - protein, 19 aa, Plasmodium falciparum
VIVKYLKNKSSILHEDDVI

SEQ ID NO: 3374122 - protein, 17 aa, Plasmodium falciparum
VIVPTSILINWEIELKR

SEQ ID NO: 3374123 - protein, 17 aa, Plasmodium falciparum
VIWIDAHGDINIPETSP

SEQ ID NO: 3374124 - protein, 22 aa, Plasmodium falciparum
VIYDEKKRLGANNLINENNNNN

SEQ ID NO: 3374125 - protein, 22 aa, Plasmodium falciparum
VIYDIWCRYVDYIINVSYKDYK

SEQ ID NO: 3374126 - protein, 25 aa, Plasmodium falciparum
VIYLKPLILCILDKFIIKQKKKEEQ

SEQ ID NO: 3374127 - protein, 22 aa, Plasmodium falciparum
VKAEHFEYCRRIDNENSDKKES

SEQ ID NO: 3374128 - protein, 17 aa, Plasmodium falciparum
VKAFCNYFNHFSAYLYF

SEQ ID NO: 3374129 - protein, 18 aa, Plasmodium falciparum
VKAIKEYISYLIDADIKF

SEQ ID NO: 3374130 - protein, 17 aa, Plasmodium falciparum
VKAIYWKNMSYLSQNKY

SEQ ID NO: 3374131 - protein, 20 aa, Plasmodium falciparum
VKALSLGADFVMLGNLLAAT

SEQ ID NO: 3374132 - protein, 19 aa, Plasmodium falciparum
VKCASIHPSNKYIVTCGRD

SEQ ID NO: 3374133 - protein, 17 aa, Plasmodium falciparum
VKCFIYDYNEKLKLYIK

SEQ ID NO: 3374134 - protein, 23 aa, Plasmodium falciparum
VKCIAALCNQWYINYGNMEFKKD

SEQ ID NO: 3374135 - protein, 17 aa, Plasmodium falciparum
VKCKIGISNYGTHKLGE

SEQ ID NO: 3374136 - protein, 17 aa, Plasmodium falciparum
VKCQKTFSDKKRLVNNL

SEQ ID NO: 3374137 - protein, 29 aa, Plasmodium falciparum
VKCVIELMYPLALTYGLRFSLREGGKTVA

SEQ ID NO: 3374138 - protein, 17 aa, Plasmodium falciparum
VKDKAVLVFSYHLTKSY

SEQ ID NO: 3374139 - protein, 17 aa, Plasmodium falciparum
VKDKLLNNMNCTNIMND

SEQ ID NO: 3374140 - protein, 22 aa, Plasmodium falciparum
VKDLGRTLGIYVIVTNCSNQHK

SEQ ID NO: 3374141 - protein, 24 aa, Plasmodium falciparum
VKDLYKFNVSLGIQNEQLLKKDQD

SEQ ID NO: 3374142 - protein, 23 aa, Plasmodium falciparum
VKDYDYLLSMPIFSLTLEKVEDL

SEQ ID NO: 3374143 - protein, 19 aa, Plasmodium falciparum
VKEAVFILQNMENFNYSIG

SEQ ID NO: 3374144 - protein, 24 aa, Plasmodium falciparum
VKEEEKLKILQIIDNYLQKNEMFF

SEQ ID NO: 3374145 - protein, 25 aa, Plasmodium falciparum
VKEIFKKNMRCHISFNTKHWINKSE

SEQ ID NO: 3374146 - protein, 20 aa, Plasmodium falciparum
VKEKFKLLKINTINISDLIW

SEQ ID NO: 3374147 - protein, 20 aa, Plasmodium falciparum
VKEKFKMDNVVDDKKNFEEE

SEQ ID NO: 3374148 - protein, 28 aa, Plasmodium falciparum
VKEKKFHLEKKMKIDMNMDLRSYEKHIL

SEQ ID NO: 3374149 - protein, 18 aa, Plasmodium falciparum
VKENIKYNNENNIKDDIH

SEQ ID NO: 3374150 - protein, 25 aa, Plasmodium falciparum
VKERIEFSYIYRWYLHIQETLLANF

SEQ ID NO: 3374151 - protein, 21 aa, Plasmodium falciparum
VKETYFLAKDIFYSNADMEEK

SEQ ID NO: 3374152 - protein, 17 aa, Plasmodium falciparum
VKFKKNAPFLLLSISHQ

SEQ ID NO: 3374153 - protein, 18 aa, Plasmodium falciparum
VKFSKFVTSLSFMKKNTE

SEQ ID NO: 3374154 - protein, 17 aa, Plasmodium falciparum
VKGCISLAGMISIDENA

SEQ ID NO: 3374155 - protein, 22 aa, Plasmodium falciparum
VKGFHKKEIFAHIKENDDKNNN

SEQ ID NO: 3374156 - protein, 20 aa, Plasmodium falciparum
VKGKGRCMFTKKKLDPGSVI

SEQ ID NO: 3374157 - protein, 27 aa, Plasmodium falciparum
VKGKKGFKKRKLIDIQDVINVDYGLNS

SEQ ID NO: 3374158 - protein, 25 aa, Plasmodium falciparum
VKGKNNFLLRASVISSKDDPKKRNS

SEQ ID NO: 3374159 - protein, 21 aa, Plasmodium falciparum
VKGNLYFNTKDKLFYDIEYIK

SEQ ID NO: 3374160 - protein, 26 aa, Plasmodium falciparum
VKGNMYITNRFLIYISETTKKEKDED

SEQ ID NO: 3374161 - protein, 19 aa, Plasmodium falciparum
VKHFKCPKCNNNISTDTVS

SEQ ID NO: 3374162 - protein, 19 aa, Plasmodium falciparum
VKHFYEMGTPQIIGTYIQP

SEQ ID NO: 3374163 - protein, 18 aa, Plasmodium falciparum
VKHKILIPNKINDIQNLS

SEQ ID NO: 3374164 - protein, 31 aa, Plasmodium falciparum
VKHKRTQEFFCWKAISYRGLKEREKSQLVIE

SEQ ID NO: 3374165 - protein, 19 aa, Plasmodium falciparum
VKHPMTYIKGFEYASDSIN

SEQ ID NO: 3374166 - protein, 18 aa, Plasmodium falciparum
VKHTYMYINILISFFDKL

SEQ ID NO: 3374167 - protein, 24 aa, Plasmodium falciparum
VKIICPYLTKKVCQKHNKECNKVH

SEQ ID NO: 3374168 - protein, 19 aa, Plasmodium falciparum
VKIKRKIKKFIKLTKGELK

SEQ ID NO: 3374169 - protein, 17 aa, Plasmodium falciparum
VKILGAFTLIDEGELDW

SEQ ID NO: 3374170 - protein, 20 aa, Plasmodium falciparum
VKILKKKSMKHIKINEEINV

SEQ ID NO: 3374171 - protein, 18 aa, Plasmodium falciparum
VKILPYFYNISYNMIMNK

SEQ ID NO: 3374172 - protein, 19 aa, Plasmodium falciparum
VKINIPYFKNVLIHSFECE

SEQ ID NO: 3374173 - protein, 27 aa, Plasmodium falciparum
VKINNMFKCGFYSFKGNRTYNEDRVII

SEQ ID NO: 3374174 - protein, 19 aa, Plasmodium falciparum
VKIPLKRGRKKKSEKKKRG

SEQ ID NO: 3374175 - protein, 23 aa, Plasmodium falciparum
VKIPNLKTPLIVLDNIIGQTSKG

SEQ ID NO: 3374176 - protein, 23 aa, Plasmodium falciparum
VKISFSGSNKWMSRIKALKRCLN

SEQ ID NO: 3374177 - protein, 21 aa, Plasmodium falciparum
VKKCKDISEISYLIKEAIYLN

SEQ ID NO: 3374178 - protein, 17 aa, Plasmodium falciparum
VKKDKFKIIEKFDSKKV

SEQ ID NO: 3374179 - protein, 22 aa, Plasmodium falciparum
VKKEFFVLPTFVNSVSMSGILF

SEQ ID NO: 3374180 - protein, 22 aa, Plasmodium falciparum
VKKEIFLILCDILGIKNMIPGL

SEQ ID NO: 3374181 - protein, 17 aa, Plasmodium falciparum
VKKERFTIIETRNEENM

SEQ ID NO: 3374182 - protein, 17 aa, Plasmodium falciparum
VKKFSYNNLLEVDDLLN

SEQ ID NO: 3374183 - protein, 22 aa, Plasmodium falciparum
VKKGEFCFYENDWGSISSDAKN

SEQ ID NO: 3374184 - protein, 27 aa, Plasmodium falciparum
VKKGILICKCNACGNIGELNNSHKIAT

SEQ ID NO: 3374185 - protein, 22 aa, Plasmodium falciparum
VKKKKKIYFKLGHKKKNKKNNN

SEQ ID NO: 3374186 - protein, 31 aa, Plasmodium falciparum
VKKKLDILILYLRFVHNFCYYSAKKFNTYDE

SEQ ID NO: 3374187 - protein, 25 aa, Plasmodium falciparum
VKKKNFKNWKMIVAKTEMEVTDYLS

SEQ ID NO: 3374188 - protein, 26 aa, Plasmodium falciparum
VKKKYKKVRINSHISSKLNDKSIINY

SEQ ID NO: 3374189 - protein, 17 aa, Plasmodium falciparum
VKKMKKGLNKILNNNND

SEQ ID NO: 3374190 - protein, 20 aa, Plasmodium falciparum
VKKNEALKCDKNVKDRENIK

SEQ ID NO: 3374191 - protein, 20 aa, Plasmodium falciparum
VKKNNLSNMDYFKITNYERK

SEQ ID NO: 3374192 - protein, 23 aa, Plasmodium falciparum
VKKNPLKVCHKINSDSNIFVNFE

SEQ ID NO: 3374193 - protein, 26 aa, Plasmodium falciparum
VKKNRISLLPGIYMNGCVTFDEKGSR

SEQ ID NO: 3374194 - protein, 26 aa, Plasmodium falciparum
VKKPAIRGITSFTLFAREKRKELLDQ

SEQ ID NO: 3374195 - protein, 28 aa, Plasmodium falciparum
VKKPEGLKMKLGFFIKKHSNVFKFDTEG

SEQ ID NO: 3374196 - protein, 17 aa, Plasmodium falciparum
VKKRFCKSNIYYNNNNN

SEQ ID NO: 3374197 - protein, 21 aa, Plasmodium falciparum
VKKRINSFCVEKLKSIKKKRE

SEQ ID NO: 3374198 - protein, 24 aa, Plasmodium falciparum
VKKVKRFENGFIFDPYTFSPEHTV

SEQ ID NO: 3374199 - protein, 23 aa, Plasmodium falciparum
VKKYNKRFSLLDAQKLQQDMTQE

SEQ ID NO: 3374200 - protein, 21 aa, Plasmodium falciparum
VKLCKSEKPLNEYLDSKRKSF

SEQ ID NO: 3374201 - protein, 17 aa, Plasmodium falciparum
VKLCVIDFGLSFLSSSI

SEQ ID NO: 3374202 - protein, 20 aa, Plasmodium falciparum
VKLDEGLFGALEYLKTKGEL

SEQ ID NO: 3374203 - protein, 19 aa, Plasmodium falciparum
VKLFELICFYSLKDLHVYE

SEQ ID NO: 3374204 - protein, 20 aa, Plasmodium falciparum
VKLFIKKIPIYIWVKQFNLM

SEQ ID NO: 3374205 - protein, 17 aa, Plasmodium falciparum
VKLLAFLIMPYVWQGNS

SEQ ID NO: 3374206 - protein, 32 aa, Plasmodium falciparum
VKLNQAFKYPSIFYEHFEFLSSDEYNYVKNNY

SEQ ID NO: 3374207 - protein, 23 aa, Plasmodium falciparum
VKLNQSNDVLLQFEKKLNNSLND

SEQ ID NO: 3374208 - protein, 18 aa, Plasmodium falciparum
VKLNYVYYPYNKCQKIIP

SEQ ID NO: 3374209 - protein, 22 aa, Plasmodium falciparum
VKLQFWAIKMLISVPLATKIYA

SEQ ID NO: 3374210 - protein, 17 aa, Plasmodium falciparum
VKLWKREEDMWINVLED

SEQ ID NO: 3374211 - protein, 21 aa, Plasmodium falciparum
VKLYSYQLCRALSYIHSKFIC

SEQ ID NO: 3374212 - protein, 17 aa, Plasmodium falciparum
VKMFERIYDEKKEWRKY

SEQ ID NO: 3374213 - protein, 19 aa, Plasmodium falciparum
VKNDVSLFNHTCDIVSNPY

SEQ ID NO: 3374214 - protein, 32 aa, Plasmodium falciparum
VKNEKKKKISICCFYTSLYVEYMMESSAMHEH

SEQ ID NO: 3374215 - protein, 22 aa, Plasmodium falciparum
VKNIKQAVSHYVIENETFNHDI

SEQ ID NO: 3374216 - protein, 17 aa, Plasmodium falciparum
VKNITMEGLTWGKAHKK

SEQ ID NO: 3374217 - protein, 17 aa, Plasmodium falciparum
VKNIYFVIIKNEKMMFY

SEQ ID NO: 3374218 - protein, 24 aa, Plasmodium falciparum
VKNKKFNITYALKIIRLSNSKYNT

SEQ ID NO: 3374219 - protein, 18 aa, Plasmodium falciparum
VKNLFGIECDKVNVLNTL

SEQ ID NO: 3374220 - protein, 21 aa, Plasmodium falciparum
VKNNIGFVMFKTFEDFKEEIF

SEQ ID NO: 3374221 - protein, 23 aa, Plasmodium falciparum
VKNNMLYNDMNVLLKEHKEEIFL

SEQ ID NO: 3374222 - protein, 17 aa, Plasmodium falciparum
VKNQVLIDGEFFKQIKP

SEQ ID NO: 3374223 - protein, 23 aa, Plasmodium falciparum
VKNRHVESSNIFKNMSSNSNCKD

SEQ ID NO: 3374224 - protein, 23 aa, Plasmodium falciparum
VKNSYGFMTFLVLDCHTNNFFID

SEQ ID NO: 3374225 - protein, 24 aa, Plasmodium falciparum
VKNTYGCKVHNKLIRHINDIIIKK

SEQ ID NO: 3374226 - protein, 35 aa, Plasmodium falciparum
VKPHKYYFPSVEYFERFYIHLHYKTRADDVDVDTN

SEQ ID NO: 3374227 - protein, 25 aa, Plasmodium falciparum
VKPRSFKLSTDYILNTDDSTLNKVV

SEQ ID NO: 3374228 - protein, 27 aa, Plasmodium falciparum
VKQIRNSRSLSDISLNLTKYTLESEKI

SEQ ID NO: 3374229 - protein, 20 aa, Plasmodium falciparum
VKQKCGYCNEHFENIDILEN

SEQ ID NO: 3374230 - protein, 21 aa, Plasmodium falciparum
VKQNNKVQCIKNNYYFDNNGK

SEQ ID NO: 3374231 - protein, 25 aa, Plasmodium falciparum
VKQNRTRLLLGREVIKCNEIILCLN

SEQ ID NO: 3374232 - protein, 19 aa, Plasmodium falciparum
VKQTCKNIVKVDENYSNQI

SEQ ID NO: 3374233 - protein, 19 aa, Plasmodium falciparum
VKQTTGVHYDVQKKMNHMK

SEQ ID NO: 3374234 - protein, 24 aa, Plasmodium falciparum
VKQWKVVMDDIWFDTYEQYCSYLQ

SEQ ID NO: 3374235 - protein, 29 aa, Plasmodium falciparum
VKQYGFEQARILAVKARQEAEKAGARCKP

SEQ ID NO: 3374236 - protein, 20 aa, Plasmodium falciparum
VKQYLKSKIEKIKMQNDYNL

SEQ ID NO: 3374237 - protein, 17 aa, Plasmodium falciparum
VKRIIKPGINFEHLPSI

SEQ ID NO: 3374238 - protein, 27 aa, Plasmodium falciparum
VKRKLCTVCGFEGKYKCLKCFEHKPTS

SEQ ID NO: 3374239 - protein, 17 aa, Plasmodium falciparum
VKRKLFRRMYKKYPEYK

SEQ ID NO: 3374240 - protein, 18 aa, Plasmodium falciparum
VKRLYIVGWIKCRKRFAT

SEQ ID NO: 3374241 - protein, 23 aa, Plasmodium falciparum
VKRNLIKIVVDWWNKMVQENNQQ

SEQ ID NO: 3374242 - protein, 19 aa, Plasmodium falciparum
VKSCNECIHNFLYNNYILQ

SEQ ID NO: 3374243 - protein, 25 aa, Plasmodium falciparum
VKSICFKEPSFVSSLIILEELKNEK

SEQ ID NO: 3374244 - protein, 18 aa, Plasmodium falciparum
VKSISFVLEKESNNIMFD

SEQ ID NO: 3374245 - protein, 22 aa, Plasmodium falciparum
VKSKFFLKDSFLKNKLKANNLD

SEQ ID NO: 3374246 - protein, 23 aa, Plasmodium falciparum
VKSRWIYLLSNNWDFFKNISSIS

SEQ ID NO: 3374247 - protein, 44 aa, Plasmodium falciparum
VKSTFANFIHWIIAGNMKGYIFVWEVPSGNIIKILLPPLYFFNE

SEQ ID NO: 3374248 - protein, 27 aa, Plasmodium falciparum
VKTEFEDMNFMNSYFINIRNFFKNYFV

SEQ ID NO: 3374249 - protein, 20 aa, Plasmodium falciparum
VKTQLLSICEKIDIPITTCG

SEQ ID NO: 3374250 - protein, 22 aa, Plasmodium falciparum
VKTRISYDEIISFNNLNEKNVL

SEQ ID NO: 3374251 - protein, 32 aa, Plasmodium falciparum
VKTRTADDCLKRFLYCRAVVLKEKKKLKEVTE

SEQ ID NO: 3374252 - protein, 17 aa, Plasmodium falciparum
VKTSSGILNKEENNKKE

SEQ ID NO: 3374253 - protein, 24 aa, Plasmodium falciparum
VKVEPKAGEELEIYVENMLNELKT

SEQ ID NO: 3374254 - protein, 21 aa, Plasmodium falciparum
VKVIEYLKINFIKKYETIPSL

SEQ ID NO: 3374255 - protein, 25 aa, Plasmodium falciparum
VKVRACMDCAYKLHYRKINKYLKKK

SEQ ID NO: 3374256 - protein, 19 aa, Plasmodium falciparum
VKVSNERLIFKRKHDTDDL

SEQ ID NO: 3374257 - protein, 17 aa, Plasmodium falciparum
VKWTIQYTFNPLKKKYS

SEQ ID NO: 3374258 - protein, 23 aa, Plasmodium falciparum
VKYKEDFTLCEIKRHYKINDCWI

SEQ ID NO: 3374259 - protein, 17 aa, Plasmodium falciparum
VKYKINHKYIKTYTKKK

SEQ ID NO: 3374260 - protein, 22 aa, Plasmodium falciparum
VKYKYELPTIASLGKVKKLDYL

SEQ ID NO: 3374261 - protein, 26 aa, Plasmodium falciparum
VKYKYIKCLVMNNSGIIVHSFVFHKN

SEQ ID NO: 3374262 - protein, 17 aa, Plasmodium falciparum
VKYLDFFIESYKNKIDI

SEQ ID NO: 3374263 - protein, 21 aa, Plasmodium falciparum
VKYLYKTHVWIESYEPLFNKK

SEQ ID NO: 3374264 - protein, 26 aa, Plasmodium falciparum
VKYSDWKFTCIPTLGFSKSSNRVQQM

SEQ ID NO: 3374265 - protein, 19 aa, Plasmodium falciparum
VKYTDGFINNIITFLERFS

SEQ ID NO: 3374266 - protein, 18 aa, Plasmodium falciparum
VLAKLKIKPILKIKYIYF

SEQ ID NO: 3374267 - protein, 21 aa, Plasmodium falciparum
VLCKGYDLYGNKSVERLYNNK

SEQ ID NO: 3374268 - protein, 24 aa, Plasmodium falciparum
VLDPTRITLFTGYSGIDGDTFKVK

SEQ ID NO: 3374269 - protein, 19 aa, Plasmodium falciparum
VLDRHELNELIKMETNSNQ

SEQ ID NO: 3374270 - protein, 19 aa, Plasmodium falciparum
VLDTYTFFYICNEICTNTK

SEQ ID NO: 3374271 - protein, 48 aa, Plasmodium falciparum
VLEHDWSEMYADLCQTLKWRSPNFEMKKKTSFEIALLKKIQEQYENLP

SEQ ID NO: 3374272 - protein, 26 aa, Plasmodium falciparum
VLELGCGHGLVGIKVLLDNGNVVFQE

SEQ ID NO: 3374273 - protein, 22 aa, Plasmodium falciparum
VLENPKNIFLYNINENDYPTSY

SEQ ID NO: 3374274 - protein, 18 aa, Plasmodium falciparum
VLEQSYFVDWQKIRLQEI

SEQ ID NO: 3374275 - protein, 17 aa, Plasmodium falciparum
VLFLPSLAIHLQNRTRY

SEQ ID NO: 3374276 - protein, 18 aa, Plasmodium falciparum
VLFTQYFIKCEGNKVTVI

SEQ ID NO: 3374277 - protein, 19 aa, Plasmodium falciparum
VLFVCLGVSIQKQLHMNFL

SEQ ID NO: 3374278 - protein, 25 aa, Plasmodium falciparum
VLGYKSCSCVHNIIRNSSNNKNQNG

SEQ ID NO: 3374279 - protein, 17 aa, Plasmodium falciparum
VLICYNIPKEYTDVNKL

SEQ ID NO: 3374280 - protein, 26 aa, Plasmodium falciparum
VLIDIKCPVQLGVIKKVILYVHRPIY

SEQ ID NO: 3374281 - protein, 26 aa, Plasmodium falciparum
VLILSCKHLICLICSSIQLEENYKNF

SEQ ID NO: 3374282 - protein, 22 aa, Plasmodium falciparum
VLISLPFSYAYKLLDYIKTYLI

SEQ ID NO: 3374283 - protein, 33 aa, Plasmodium falciparum
VLIYKIDKFECILKLNTKECLKKYFNNNPTTRR

SEQ ID NO: 3374284 - protein, 20 aa, Plasmodium falciparum
VLKEFPILNSKFNFKTNTYT

SEQ ID NO: 3374285 - protein, 28 aa, Plasmodium falciparum
VLKEKLHIICGKEIVVDVASMRDDKYKH

SEQ ID NO: 3374286 - protein, 18 aa, Plasmodium falciparum
VLKFRDTFVPVPVRRKII

SEQ ID NO: 3374287 - protein, 20 aa, Plasmodium falciparum
VLKHRINDISWKKKYISQNS

SEQ ID NO: 3374288 - protein, 28 aa, Plasmodium falciparum
VLKKNEFIGNLLLNFLNDLRNNYRLKEN

SEQ ID NO: 3374289 - protein, 17 aa, Plasmodium falciparum
VLKKRLTVFKSETSPLI

SEQ ID NO: 3374290 - protein, 22 aa, Plasmodium falciparum
VLKNICLYNYYQILYMINKYNN

SEQ ID NO: 3374291 - protein, 28 aa, Plasmodium falciparum
VLKTYKMKCSFFLNIIKNYEENIHILEN

SEQ ID NO: 3374292 - protein, 28 aa, Plasmodium falciparum
VLKYCYNCIKYSHFINIDIYYIKEKYKE

SEQ ID NO: 3374293 - protein, 26 aa, Plasmodium falciparum
VLKYDDVCKLDFGVHVNGYIIDCAFT

SEQ ID NO: 3374294 - protein, 40 aa, Plasmodium falciparum
VLLEIRKRVPRWGDYKCNFFFHWKKIMELNNEELKIYILI

SEQ ID NO: 3374295 - protein, 18 aa, Plasmodium falciparum
VLLEPIMLVEIISNYEHQ

SEQ ID NO: 3374296 - protein, 24 aa, Plasmodium falciparum
VLLKEHKEEIFLLKENIKILQKDN

SEQ ID NO: 3374297 - protein, 20 aa, Plasmodium falciparum
VLLKHGWCEMLKGGVIMDVK

SEQ ID NO: 3374298 - protein, 19 aa, Plasmodium falciparum
VLLKRARKEAIRYSLQYGS

SEQ ID NO: 3374299 - protein, 24 aa, Plasmodium falciparum
VLLLLEEIDEFVLMNLQTYKDAKF

SEQ ID NO: 3374300 - protein, 27 aa, Plasmodium falciparum
VLLPFSFHCTGTPIVVCADKLKNELNK

SEQ ID NO: 3374301 - protein, 25 aa, Plasmodium falciparum
VLLRETPKWFLGWVKTRCFKNSYPK

SEQ ID NO: 3374302 - protein, 17 aa, Plasmodium falciparum
VLLYEKKVRCIRTNNSH

SEQ ID NO: 3374303 - protein, 17 aa, Plasmodium falciparum
VLNDRWFLLCGGYNLSW

SEQ ID NO: 3374304 - protein, 25 aa, Plasmodium falciparum
VLNIPNYIKFFSFKYFNPIQTQMFH

SEQ ID NO: 3374305 - protein, 21 aa, Plasmodium falciparum
VLNKNLYVYGGMYEYKNNEII

SEQ ID NO: 3374306 - protein, 21 aa, Plasmodium falciparum
VLNKRRGIVISEEQKLGTPLL

SEQ ID NO: 3374307 - protein, 25 aa, Plasmodium falciparum
VLNLFHMNSIFYLYVNFNQYNKQFF

SEQ ID NO: 3374308 - protein, 21 aa, Plasmodium falciparum
VLNLLKPIDFSNIIFISAKTS

SEQ ID NO: 3374309 - protein, 24 aa, Plasmodium falciparum
VLNSIKIAYIFLKKNGIFITKVFR

SEQ ID NO: 3374310 - protein, 17 aa, Plasmodium falciparum
VLPRLDGGINYIIKELD

SEQ ID NO: 3374311 - protein, 24 aa, Plasmodium falciparum
VLPRLPIKIKNVYGARLMIIDDHR

SEQ ID NO: 3374312 - protein, 25 aa, Plasmodium falciparum
VLPSEEYLYYINLFNLNDKFDNQYI

SEQ ID NO: 3374313 - protein, 21 aa, Plasmodium falciparum
VLPVKYLINIFIKLNPIQEAL

SEQ ID NO: 3374314 - protein, 22 aa, Plasmodium falciparum
VLQGFNCTLFCYGQTGTGKTYT

SEQ ID NO: 3374315 - protein, 19 aa, Plasmodium falciparum
VLQIFNKINTFAMSNNIIN

SEQ ID NO: 3374316 - protein, 18 aa, Plasmodium falciparum
VLQKYAIHYPNVSFTCKK

SEQ ID NO: 3374317 - protein, 17 aa, Plasmodium falciparum
VLRARINLNPGDEITIS

SEQ ID NO: 3374318 - protein, 17 aa, Plasmodium falciparum
VLRKFKIKKEKYLRFST

SEQ ID NO: 3374319 - protein, 26 aa, Plasmodium falciparum
VLRSEILGCLKMKSYLSGMPELKLGL

SEQ ID NO: 3374320 - protein, 43 aa, Plasmodium falciparum
VLRSLIRTVGRISQFFDEYDMWKCFLSNIYRYENEKCDKYNDF

SEQ ID NO: 3374321 - protein, 19 aa, Plasmodium falciparum
VLRVLSIRKSLKRIGYNIN

SEQ ID NO: 3374322 - protein, 21 aa, Plasmodium falciparum
VLSHKTCKKVLKKFLKLYRSQ

SEQ ID NO: 3374323 - protein, 21 aa, Plasmodium falciparum
VLSKYKSIWIKDGSPLCVNTH

SEQ ID NO: 3374324 - protein, 18 aa, Plasmodium falciparum
VLSLKDGVFYVMLILSNK

SEQ ID NO: 3374325 - protein, 21 aa, Plasmodium falciparum
VLSNICCTYNYLFVSTFNKVY

SEQ ID NO: 3374326 - protein, 23 aa, Plasmodium falciparum
VLSRRRGHVLKDFPKVGTPLYMV

SEQ ID NO: 3374327 - protein, 23 aa, Plasmodium falciparum
VLSSIKVILCLLDKINDKEFIKN

SEQ ID NO: 3374328 - protein, 18 aa, Plasmodium falciparum
VLTNCNYKTNVLKVKHSM

SEQ ID NO: 3374329 - protein, 23 aa, Plasmodium falciparum
VLTWPSEISLLFDDTEIIIPILH

SEQ ID NO: 3374330 - protein, 18 aa, Plasmodium falciparum
VLVPGGFGTRGIEGKYLS

SEQ ID NO: 3374331 - protein, 18 aa, Plasmodium falciparum
VLYKKFKLIQKIYNSCYI

SEQ ID NO: 3374332 - protein, 19 aa, Plasmodium falciparum
VLYLPFFRNYFQTYKLNLL

SEQ ID NO: 3374333 - protein, 27 aa, Plasmodium falciparum
VMDNIWKRYGLDLKMTLYRVLALSTDD

SEQ ID NO: 3374334 - protein, 51 aa, Plasmodium falciparum
VMEECLSIKPDLIFLFDEAWFAYACFHPILKFRTAMTVAEKMRSTEQKRIY

SEQ ID NO: 3374335 - protein, 30 aa, Plasmodium falciparum
VMEQIDLYSSCLIKGILFSYMKYTFLKKEE

SEQ ID NO: 3374336 - protein, 17 aa, Plasmodium falciparum
VMEYLRFRELPAGINAI

SEQ ID NO: 3374337 - protein, 24 aa, Plasmodium falciparum
VMHELKIKNVRGVVIITAGFKETG

SEQ ID NO: 3374338 - protein, 18 aa, Plasmodium falciparum
VMHMKIYIGDNILMLSGA

SEQ ID NO: 3374339 - protein, 18 aa, Plasmodium falciparum
VMHSGKFVDSPCNNKIYR

SEQ ID NO: 3374340 - protein, 22 aa, Plasmodium falciparum
VMKDICDKFCYSSENYIEKDIL

SEQ ID NO: 3374341 - protein, 21 aa, Plasmodium falciparum
VMKDKRASLVYEPDTINLQNE

SEQ ID NO: 3374342 - protein, 18 aa, Plasmodium falciparum
VMKFLELWNIFKKPQYLI

SEQ ID NO: 3374343 - protein, 42 aa, Plasmodium falciparum
VMNEDVKWISFHGCYDFAYLLKILTCSALPHNEAAFFELLND

SEQ ID NO: 3374344 - protein, 36 aa, Plasmodium falciparum
VMNHLKTNVIAKFRQSFLITCKKKFKEKGSKLNELS

SEQ ID NO: 3374345 - protein, 25 aa, Plasmodium falciparum
VMNKWYKGIYIVAIVKNIYKNNKIE

SEQ ID NO: 3374346 - protein, 19 aa, Plasmodium falciparum
VMNTACGRTNKKKMVLHGW

SEQ ID NO: 3374347 - protein, 21 aa, Plasmodium falciparum
VMRLNAECIMCCYSKKHFEFF

SEQ ID NO: 3374348 - protein, 25 aa, Plasmodium falciparum
VMSKRKLKWFVENNVVDSWVDPRFP

SEQ ID NO: 3374349 - protein, 18 aa, Plasmodium falciparum
VMSNIKIYGYDIRSNMNI

SEQ ID NO: 3374350 - protein, 26 aa, Plasmodium falciparum
VMVQGTCKKNFFLFVKMKEEIDMKKL

SEQ ID NO: 3374351 - protein, 19 aa, Plasmodium falciparum
VMVSLHLMKKLPFKTIYLH

SEQ ID NO: 3374352 - protein, 17 aa, Plasmodium falciparum
VNAAGLFSVYTSGYDCL

SEQ ID NO: 3374353 - protein, 21 aa, Plasmodium falciparum
VNALEIIKAFPNFEDLKILKD

SEQ ID NO: 3374354 - protein, 17 aa, Plasmodium falciparum
VNCKIIGDNLGKRKKEK

SEQ ID NO: 3374355 - protein, 17 aa, Plasmodium falciparum
VNCYTWINNSHGLFDYE

SEQ ID NO: 3374356 - protein, 17 aa, Plasmodium falciparum
VNDGCFNLHLNNMNNIF

SEQ ID NO: 3374357 - protein, 21 aa, Plasmodium falciparum
VNDKSGFFFIFNTIYFTHLKN

SEQ ID NO: 3374358 - protein, 20 aa, Plasmodium falciparum
VNDMELIFFCFNHNRNLLMT

SEQ ID NO: 3374359 - protein, 18 aa, Plasmodium falciparum
VNDNIPLTVQLANKGNEI

SEQ ID NO: 3374360 - protein, 18 aa, Plasmodium falciparum
VNDNVCLIMASNNLENIP

SEQ ID NO: 3374361 - protein, 19 aa, Plasmodium falciparum
VNDPEYDWKDLIRSNRNSN

SEQ ID NO: 3374362 - protein, 20 aa, Plasmodium falciparum
VNDTMKLYRCHGIMNCTMCC

SEQ ID NO: 3374363 - protein, 23 aa, Plasmodium falciparum
VNEEKRPNVIIETNMYNNNVNNM

SEQ ID NO: 3374364 - protein, 30 aa, Plasmodium falciparum
VNENYEWFCSSCLQFCFNIIKQKEFVDYIE

SEQ ID NO: 3374365 - protein, 30 aa, Plasmodium falciparum
VNFEKLKKRAYRKLNFLSIVDVQKSLSDLS

SEQ ID NO: 3374366 - protein, 18 aa, Plasmodium falciparum
VNFKKRFTMNKIKNHIWF

SEQ ID NO: 3374367 - protein, 17 aa, Plasmodium falciparum
VNFTAMKIFPLKPTDIT

SEQ ID NO: 3374368 - protein, 24 aa, Plasmodium falciparum
VNGSSKFCGYAIMQSKPGESKNNN

SEQ ID NO: 3374369 - protein, 23 aa, Plasmodium falciparum
VNGSSVFRPVDRVQTIQEKKSSY

SEQ ID NO: 3374370 - protein, 17 aa, Plasmodium falciparum
VNGVKRKRFFKIVVANQ

SEQ ID NO: 3374371 - protein, 26 aa, Plasmodium falciparum
VNICNFKIIRCKSSAYINYYYYYYYY

SEQ ID NO: 3374372 - protein, 25 aa, Plasmodium falciparum
VNIEKCFQCTLLVQKKDKSHECFKY

SEQ ID NO: 3374373 - protein, 18 aa, Plasmodium falciparum
VNIFPRVLFTEIFHGIIK

SEQ ID NO: 3374374 - protein, 18 aa, Plasmodium falciparum
VNIHMNYRNKNNCMNNYY

SEQ ID NO: 3374375 - protein, 23 aa, Plasmodium falciparum
VNIKCFLNVLYIYSKNYEQNVNK

SEQ ID NO: 3374376 - protein, 25 aa, Plasmodium falciparum
VNILKDIITGLCFLHNQEIPIIHRD

SEQ ID NO: 3374377 - protein, 45 aa, Plasmodium falciparum
VNILKKAFEKRLYLMWPLIEFSNKYRLDQYFHLLGKNKNHINSSF

SEQ ID NO: 3374378 - protein, 18 aa, Plasmodium falciparum
VNIMADKNILYVLRHSKN

SEQ ID NO: 3374379 - protein, 23 aa, Plasmodium falciparum
VNIMLKEKLKIIYKGNLLNKLMK

SEQ ID NO: 3374380 - protein, 20 aa, Plasmodium falciparum
VNINLEFIKRHLFYKGPSKD

SEQ ID NO: 3374381 - protein, 17 aa, Plasmodium falciparum
VNISFLFSGNSDVFGDV

SEQ ID NO: 3374382 - protein, 62 aa, Plasmodium falciparum
VNIYETNIRICIVNNDLFQFLQCINKLFELYQRLNITKSKVEFLCYKLIYMTLQNMHQEFLI

SEQ ID NO: 3374383 - protein, 17 aa, Plasmodium falciparum
VNIYKFVLEKTVEERIL

SEQ ID NO: 3374384 - protein, 27 aa, Plasmodium falciparum
VNIYNLLKYRYVVFTYKALKNIIYELK

SEQ ID NO: 3374385 - protein, 23 aa, Plasmodium falciparum
VNKECKNNELCKIELKDEFKKND

SEQ ID NO: 3374386 - protein, 25 aa, Plasmodium falciparum
VNKEELRKLFSAFGNVKSVRIPKNV

SEQ ID NO: 3374387 - protein, 34 aa, Plasmodium falciparum
VNKIKFPLIETWINKRLIEILGFEDDILYEYCIS

SEQ ID NO: 3374388 - protein, 17 aa, Plasmodium falciparum
VNKIVCSKLKNKMLKYN

SEQ ID NO: 3374389 - protein, 21 aa, Plasmodium falciparum
VNKKPLFSRRATKNSTLSTNT

SEQ ID NO: 3374390 - protein, 25 aa, Plasmodium falciparum
VNKKVAKDINFEWWNSKKVSKISKD

SEQ ID NO: 3374391 - protein, 19 aa, Plasmodium falciparum
VNKMKDCDILSDEINNNSK

SEQ ID NO: 3374392 - protein, 18 aa, Plasmodium falciparum
VNKNESFYSYGINNNNNN

SEQ ID NO: 3374393 - protein, 17 aa, Plasmodium falciparum
VNKNMQSINHFSSLMQS

SEQ ID NO: 3374394 - protein, 23 aa, Plasmodium falciparum
VNKNVYAHLTFRTIKNCTEAKKI

SEQ ID NO: 3374395 - protein, 18 aa, Plasmodium falciparum
VNLCFERGMRILVCGKNG

SEQ ID NO: 3374396 - protein, 25 aa, Plasmodium falciparum
VNLHDEIYIYIYGKIKKSKHTNVYY

SEQ ID NO: 3374397 - protein, 24 aa, Plasmodium falciparum
VNLLRKVHMKDIINLTLFYYYNYL

SEQ ID NO: 3374398 - protein, 26 aa, Plasmodium falciparum
VNLLVYRYLVENGFVHTSFSFFNEAN

SEQ ID NO: 3374399 - protein, 26 aa, Plasmodium falciparum
VNLREWTVKVQNRYEKKLKKKVQEKK

SEQ ID NO: 3374400 - protein, 24 aa, Plasmodium falciparum
VNLSDSLECLGLENFIKLTKKNLF

SEQ ID NO: 3374401 - protein, 25 aa, Plasmodium falciparum
VNLTKRLICYERYLKAIPKIERRND

SEQ ID NO: 3374402 - protein, 19 aa, Plasmodium falciparum
VNMKDTYYMKLFIYSSNEI

SEQ ID NO: 3374403 - protein, 23 aa, Plasmodium falciparum
VNMYKLCIKHHLNYLTLIKNEEQ

SEQ ID NO: 3374404 - protein, 22 aa, Plasmodium falciparum
VNNCARTVISPDTFIETNQIGM

SEQ ID NO: 3374405 - protein, 18 aa, Plasmodium falciparum
VNNCIEFVENPRGYRVPY

SEQ ID NO: 3374406 - protein, 24 aa, Plasmodium falciparum
VNNESRKHKKGHKRDSKSRNYNYY

SEQ ID NO: 3374407 - protein, 25 aa, Plasmodium falciparum
VNNKKEIFEKIGILKRKFTSGNILD

SEQ ID NO: 3374408 - protein, 23 aa, Plasmodium falciparum
VNNKLEPTWSLFVDNLKYMDLVP

SEQ ID NO: 3374409 - protein, 18 aa, Plasmodium falciparum
VNNNKCKKEKYNEKEKKI

SEQ ID NO: 3374410 - protein, 24 aa, Plasmodium falciparum
VNNPICDILDPFVFTIEFEALNKL

SEQ ID NO: 3374411 - protein, 18 aa, Plasmodium falciparum
VNNPNVFSNLSFYDYIIK

SEQ ID NO: 3374412 - protein, 26 aa, Plasmodium falciparum
VNNSFLKNINFIKAFDNLQKNNPKID

SEQ ID NO: 3374413 - protein, 20 aa, Plasmodium falciparum
VNNYRSCEINADKNNGSNEQ

SEQ ID NO: 3374414 - protein, 25 aa, Plasmodium falciparum
VNPFGRSFHSTAIWYDTKKKKNNLI

SEQ ID NO: 3374415 - protein, 29 aa, Plasmodium falciparum
VNPHIPNFHSGVMNRNSISPIYPTSIRSN

SEQ ID NO: 3374416 - protein, 18 aa, Plasmodium falciparum
VNPKMTWDSALKILEADN

SEQ ID NO: 3374417 - protein, 19 aa, Plasmodium falciparum
VNPQLNIMGIMKDINNNNI

SEQ ID NO: 3374418 - protein, 47 aa, Plasmodium falciparum
VNQKGKRSTGGVFFYLIKYMYKNDIISKFKYDYIIEEEKEKKKTYRK

SEQ ID NO: 3374419 - protein, 29 aa, Plasmodium falciparum
VNRIKQKNCCKKWSTSMYNKNILINYRND

SEQ ID NO: 3374420 - protein, 22 aa, Plasmodium falciparum
VNRKIKSKIYLTPDKKKKNEVK

SEQ ID NO: 3374421 - protein, 17 aa, Plasmodium falciparum
VNRKRIIIEKLVLENFK

SEQ ID NO: 3374422 - protein, 21 aa, Plasmodium falciparum
VNRPIDWESIHYMLAEVQYGG

SEQ ID NO: 3374423 - protein, 23 aa, Plasmodium falciparum
VNRRNDMNYEMYNSINSGHMSNI

SEQ ID NO: 3374424 - protein, 20 aa, Plasmodium falciparum
VNSFIWLQYMRYYWDSKKKE

SEQ ID NO: 3374425 - protein, 22 aa, Plasmodium falciparum
VNSIRRGGCNRVLVMPNTHPII

SEQ ID NO: 3374426 - protein, 23 aa, Plasmodium falciparum
VNSNNFLPINTFHYNNNLNHNIL

SEQ ID NO: 3374427 - protein, 17 aa, Plasmodium falciparum
VNSNRFCNPNDSSSHCI

SEQ ID NO: 3374428 - protein, 24 aa, Plasmodium falciparum
VNSPKMVGMCDVTLASGVNKKDDF

SEQ ID NO: 3374429 - protein, 18 aa, Plasmodium falciparum
VNSRLKEIAVGKSTKEYK

SEQ ID NO: 3374430 - protein, 20 aa, Plasmodium falciparum
VNSSCEFKLDFNEIKLPDDI

SEQ ID NO: 3374431 - protein, 22 aa, Plasmodium falciparum
VNTYSGSCFCKTFDEIKNEKTT

SEQ ID NO: 3374432 - protein, 17 aa, Plasmodium falciparum
VNVAYTYGDDIDDFDYF

SEQ ID NO: 3374433 - protein, 17 aa, Plasmodium falciparum
VNVHGFLGSNNAVMMNN

SEQ ID NO: 3374434 - protein, 25 aa, Plasmodium falciparum
VNVILRPDLFTGLNRAAKGILLFGP

SEQ ID NO: 3374435 - protein, 19 aa, Plasmodium falciparum
VNVLCCNKTSLHYKNNIGI

SEQ ID NO: 3374436 - protein, 23 aa, Plasmodium falciparum
VNVPICPYFCAKKIIEISKVIIL

SEQ ID NO: 3374437 - protein, 25 aa, Plasmodium falciparum
VNVSMTCPDFLISSCKKDYENKERE

SEQ ID NO: 3374438 - protein, 17 aa, Plasmodium falciparum
VNVYVFDICKHRNSIIL

SEQ ID NO: 3374439 - protein, 19 aa, Plasmodium falciparum
VNYFFPWKNSSYNIIAHET

SEQ ID NO: 3374440 - protein, 23 aa, Plasmodium falciparum
VNYFLLERRRMFNKYKQQELCVN

SEQ ID NO: 3374441 - protein, 29 aa, Plasmodium falciparum
VNYIDIKYCLKLAFYNIYNEIYILKDYSK

SEQ ID NO: 3374442 - protein, 22 aa, Plasmodium falciparum
VNYIKSINKIECDTNNHNNNNN

SEQ ID NO: 3374443 - protein, 25 aa, Plasmodium falciparum
VNYKMKHPLFYCSNEQLKRFVYRMY

SEQ ID NO: 3374444 - protein, 37 aa, Plasmodium falciparum
VNYKRLRAKEMKKRNDICYNHLFSYRSVKIHIDDSII

SEQ ID NO: 3374445 - protein, 17 aa, Plasmodium falciparum
VPCIVDLATMRDTAEKL

SEQ ID NO: 3374446 - protein, 22 aa, Plasmodium falciparum
VPCPWLDGKHVVFGKVIEGMNV

SEQ ID NO: 3374447 - protein, 21 aa, Plasmodium falciparum
VPCRVCKESFVPKIYISSAVI

SEQ ID NO: 3374448 - protein, 21 aa, Plasmodium falciparum
VPDIQYCLKYVPKVEIQENII

SEQ ID NO: 3374449 - protein, 26 aa, Plasmodium falciparum
VPDLQGKMSICVGRKSGSATVNINID

SEQ ID NO: 3374450 - protein, 19 aa, Plasmodium falciparum
VPDLSFLNNSSRTFSNTDF

SEQ ID NO: 3374451 - protein, 21 aa, Plasmodium falciparum
VPDPRFLALRSFALSHFPDDP

SEQ ID NO: 3374452 - protein, 17 aa, Plasmodium falciparum
VPFYPDAYFLVRDHKVV

SEQ ID NO: 3374453 - protein, 25 aa, Plasmodium falciparum
VPGKAASFLIGRKGSIIKYITEQSG

SEQ ID NO: 3374454 - protein, 24 aa, Plasmodium falciparum
VPGSPKYKTLIEVVLEPSKRDTPS

SEQ ID NO: 3374455 - protein, 21 aa, Plasmodium falciparum
VPGTYKLPFTNGIDIPNIPNV

SEQ ID NO: 3374456 - protein, 17 aa, Plasmodium falciparum
VPIIKFGGSKKYIKNDY

SEQ ID NO: 3374457 - protein, 20 aa, Plasmodium falciparum
VPIKLKRSKQRITFLENELF

SEQ ID NO: 3374458 - protein, 17 aa, Plasmodium falciparum
VPILTDYVATRWYRAPE

SEQ ID NO: 3374459 - protein, 26 aa, Plasmodium falciparum
VPINLRLKNKLNDVCETKINTIDQKN

SEQ ID NO: 3374460 - protein, 59 aa, Plasmodium falciparum
VPINNTVPVVVNWVQCELCKKWRKLDAHINISLLPEKWYCSLNFWNAYNNCDMEEEIYV

SEQ ID NO: 3374461 - protein, 20 aa, Plasmodium falciparum
VPIQARCIAVNPIFNNYIGV

SEQ ID NO: 3374462 - protein, 20 aa, Plasmodium falciparum
VPIRSFHDIIEYLKIINNER

SEQ ID NO: 3374463 - protein, 17 aa, Plasmodium falciparum
VPIRSYGNIHMKNEEDK

SEQ ID NO: 3374464 - protein, 20 aa, Plasmodium falciparum
VPKFVSNKWLQYNNKDIVGL

SEQ ID NO: 3374465 - protein, 21 aa, Plasmodium falciparum
VPLHEKYCLLHYYDKILLHPG

SEQ ID NO: 3374466 - protein, 21 aa, Plasmodium falciparum
VPLHMNNFYVPYNCNEPNMNT

SEQ ID NO: 3374467 - protein, 17 aa, Plasmodium falciparum
VPLWLAAWATASAPTYL

SEQ ID NO: 3374468 - protein, 31 aa, Plasmodium falciparum
VPMFLRSENKRIFFSFFSYFMPKNDLNFIFE

SEQ ID NO: 3374469 - protein, 26 aa, Plasmodium falciparum
VPNDICDYVPNDICDYVPNNTPNLIT

SEQ ID NO: 3374470 - protein, 24 aa, Plasmodium falciparum
VPNDYYCMDDYKSLISNEQSSENL

SEQ ID NO: 3374471 - protein, 25 aa, Plasmodium falciparum
VPPDLRIYHWYRLENIPVESVEANF

SEQ ID NO: 3374472 - protein, 18 aa, Plasmodium falciparum
VPPTCPPPPTPPAPPGQP

SEQ ID NO: 3374473 - protein, 28 aa, Plasmodium falciparum
VPQYDVLKELPMNIGGNVLDDGINEKPF

SEQ ID NO: 3374474 - protein, 20 aa, Plasmodium falciparum
VPRAREEKLRKQKKDNKKIY

SEQ ID NO: 3374475 - protein, 17 aa, Plasmodium falciparum
VPSERLLACEVLGHDFF

SEQ ID NO: 3374476 - protein, 20 aa, Plasmodium falciparum
VPSIYPKMFTNYSDKYDLNV

SEQ ID NO: 3374477 - protein, 17 aa, Plasmodium falciparum
VPTSILINWEIELKRFC

SEQ ID NO: 3374478 - protein, 19 aa, Plasmodium falciparum
VPVKITSPFHPFIIANIGS

SEQ ID NO: 3374479 - protein, 18 aa, Plasmodium falciparum
VPVPENYRHFNILINGPD

SEQ ID NO: 3374480 - protein, 19 aa, Plasmodium falciparum
VPVTIKLLINKMMNTEELK

SEQ ID NO: 3374481 - protein, 21 aa, Plasmodium falciparum
VPYILKKGLEPKTHNHVKEDQ

SEQ ID NO: 3374482 - protein, 20 aa, Plasmodium falciparum
VPYNHVNHVVVNRKDKNIQM

SEQ ID NO: 3374483 - protein, 17 aa, Plasmodium falciparum
VPYWLKPSISKQEFIHE

SEQ ID NO: 3374484 - protein, 30 aa, Plasmodium falciparum
VPYYMSEMQFWKSYFFNIDIIYNEIADDIF

SEQ ID NO: 3374485 - protein, 24 aa, Plasmodium falciparum
VQAFYRPQEDYAFANNIRAKQFIY

SEQ ID NO: 3374486 - protein, 24 aa, Plasmodium falciparum
VQAIKAKEVFGLVKPTTIEQLEVL

SEQ ID NO: 3374487 - protein, 26 aa, Plasmodium falciparum
VQCNNCKRWFCNGSYGTCGSHIVTHL

SEQ ID NO: 3374488 - protein, 20 aa, Plasmodium falciparum
VQDIMCDVFLIIKIRKKRKN

SEQ ID NO: 3374489 - protein, 18 aa, Plasmodium falciparum
VQDLSSRFCKYENPDNRF

SEQ ID NO: 3374490 - protein, 18 aa, Plasmodium falciparum
VQDSPSLYSKEKYFTQKQ

SEQ ID NO: 3374491 - protein, 20 aa, Plasmodium falciparum
VQEGESWNHVGITIKDVNTN

SEQ ID NO: 3374492 - protein, 19 aa, Plasmodium falciparum
VQEGYKYSYKRKLLTLFSA

SEQ ID NO: 3374493 - protein, 18 aa, Plasmodium falciparum
VQEIFDFIKKIKLLQYSW

SEQ ID NO: 3374494 - protein, 18 aa, Plasmodium falciparum
VQFDDKRAYPYYESSGSL

SEQ ID NO: 3374495 - protein, 23 aa, Plasmodium falciparum
VQFKKILINQCQDSFENNLKPIE

SEQ ID NO: 3374496 - protein, 22 aa, Plasmodium falciparum
VQGGTCAIPGAFGCGKTCVSQA

SEQ ID NO: 3374497 - protein, 24 aa, Plasmodium falciparum
VQGILRRDKIILIPQVEVTDVVIP

SEQ ID NO: 3374498 - protein, 23 aa, Plasmodium falciparum
VQHGDKILSLIKIKKVEKPTDQK

SEQ ID NO: 3374499 - protein, 17 aa, Plasmodium falciparum
VQHIYRNIVSPQYRHIP

SEQ ID NO: 3374500 - protein, 18 aa, Plasmodium falciparum
VQIKRKKNLLLMNDRNYN

SEQ ID NO: 3374501 - protein, 24 aa, Plasmodium falciparum
VQKDKRIGISYAQEAALYDYRFLL

SEQ ID NO: 3374502 - protein, 25 aa, Plasmodium falciparum
VQKELKRINTLKCYLNEIINFSDDD

SEQ ID NO: 3374503 - protein, 23 aa, Plasmodium falciparum
VQKFWKKIEHFILQKRDSNFYIP

SEQ ID NO: 3374504 - protein, 18 aa, Plasmodium falciparum
VQKIECDEKIHFCDKEKE

SEQ ID NO: 3374505 - protein, 25 aa, Plasmodium falciparum
VQKLESFKCLFFTKDNLIDIEKKLE

SEQ ID NO: 3374506 - protein, 22 aa, Plasmodium falciparum
VQLDDKFAFIFGGRQNPKNCTN

SEQ ID NO: 3374507 - protein, 21 aa, Plasmodium falciparum
VQLHIPPKFNEKLHAHILKHT

SEQ ID NO: 3374508 - protein, 24 aa, Plasmodium falciparum
VQNFRTFKNNVFQQPLSYSNGSEA

SEQ ID NO: 3374509 - protein, 18 aa, Plasmodium falciparum
VQNIYVYQQMIYKNIHLN

SEQ ID NO: 3374510 - protein, 19 aa, Plasmodium falciparum
VQNLSKFVILKEFPFTIQI

SEQ ID NO: 3374511 - protein, 26 aa, Plasmodium falciparum
VQNYPVVMPYKILFVENVVENVDTQA

SEQ ID NO: 3374512 - protein, 20 aa, Plasmodium falciparum
VQPKYSREGPNMYIQFLHSS

SEQ ID NO: 3374513 - protein, 22 aa, Plasmodium falciparum
VQQLKYALVWGKSVKHNPQKVG

SEQ ID NO: 3374514 - protein, 22 aa, Plasmodium falciparum
VQSEIKISYLINGIEKNYISVF

SEQ ID NO: 3374515 - protein, 19 aa, Plasmodium falciparum
VQSGLCLEGFVAQLKLIQV

SEQ ID NO: 3374516 - protein, 17 aa, Plasmodium falciparum
VQSILPLFYIKQKYNKH

SEQ ID NO: 3374517 - protein, 20 aa, Plasmodium falciparum
VQSITHLFILKKRQTINKES

SEQ ID NO: 3374518 - protein, 43 aa, Plasmodium falciparum
VQSKFIRRHYIKKVLRDLCTIEYMILCAFTRLYKKEILPKTLY

SEQ ID NO: 3374519 - protein, 23 aa, Plasmodium falciparum
VQTPCAYEKYSLRGKLIQHKSLY

SEQ ID NO: 3374520 - protein, 17 aa, Plasmodium falciparum
VQVTYEFLKLSINNENT

SEQ ID NO: 3374521 - protein, 20 aa, Plasmodium falciparum
VQWLGKRAGHSCVYYKSNLY

SEQ ID NO: 3374522 - protein, 20 aa, Plasmodium falciparum
VQYFVYKLRDVVKCVEKETL

SEQ ID NO: 3374523 - protein, 22 aa, Plasmodium falciparum
VQYLKCIKYNIYIEKKKMNQSN

SEQ ID NO: 3374524 - protein, 22 aa, Plasmodium falciparum
VQYNDIWKGIVLSFCTTVGTEV

SEQ ID NO: 3374525 - protein, 17 aa, Plasmodium falciparum
VQYNVNYMLNYKIIEHE

SEQ ID NO: 3374526 - protein, 18 aa, Plasmodium falciparum
VRAELAKNIYNIWKIIKN

SEQ ID NO: 3374527 - protein, 17 aa, Plasmodium falciparum
VRDIIDWDYYKQKLEVQ

SEQ ID NO: 3374528 - protein, 30 aa, Plasmodium falciparum
VRDYTNNYIKERKKYIFLYNNNENNYKEIL

SEQ ID NO: 3374529 - protein, 20 aa, Plasmodium falciparum
VREMCHPCEYYFTNYKTCFN

SEQ ID NO: 3374530 - protein, 25 aa, Plasmodium falciparum
VRESCYRMILHWVQHFDDKIENLLL

SEQ ID NO: 3374531 - protein, 17 aa, Plasmodium falciparum
VRFLRSENRLLITGTPL

SEQ ID NO: 3374532 - protein, 25 aa, Plasmodium falciparum
VRGKNCPRPVQYFYQCGLPSKILQI

SEQ ID NO: 3374533 - protein, 27 aa, Plasmodium falciparum
VRGVVCDRYKNIIFFIYGKWSQEIYIA

SEQ ID NO: 3374534 - protein, 17 aa, Plasmodium falciparum
VRIGAIHNVVFAGYSAA

SEQ ID NO: 3374535 - protein, 17 aa, Plasmodium falciparum
VRINYFSPIYDNLCPCY

SEQ ID NO: 3374536 - protein, 22 aa, Plasmodium falciparum
VRIVSFPSWTLFKKQPEDYQYS

SEQ ID NO: 3374537 - protein, 17 aa, Plasmodium falciparum
VRKEYCQKIALLDINKY

SEQ ID NO: 3374538 - protein, 25 aa, Plasmodium falciparum
VRKGEKGIKRKVSMKKRNEKLNEEN

SEQ ID NO: 3374539 - protein, 18 aa, Plasmodium falciparum
VRKGINFCLNTYNREFDN

SEQ ID NO: 3374540 - protein, 19 aa, Plasmodium falciparum
VRKKLKVCILGDAVHVEEA

SEQ ID NO: 3374541 - protein, 25 aa, Plasmodium falciparum
VRKKWKDKRSCDVKKKKKENSSYSN

SEQ ID NO: 3374542 - protein, 20 aa, Plasmodium falciparum
VRKNKKAKTEQVEETTNNAA

SEQ ID NO: 3374543 - protein, 23 aa, Plasmodium falciparum
VRKTNAYLTEQCIVNELQIDIGK

SEQ ID NO: 3374544 - protein, 23 aa, Plasmodium falciparum
VRLCICEGLRIFQDRLIYKKEKK

SEQ ID NO: 3374545 - protein, 19 aa, Plasmodium falciparum
VRLLFKKGMKCYRPRKKGE

SEQ ID NO: 3374546 - protein, 25 aa, Plasmodium falciparum
VRMRREFTYWYPFDVRISGKDLIFN

SEQ ID NO: 3374547 - protein, 17 aa, Plasmodium falciparum
VRNLYIFSRQELNSDTK

SEQ ID NO: 3374548 - protein, 18 aa, Plasmodium falciparum
VRQKFEITTRILKTLQVY

SEQ ID NO: 3374549 - protein, 26 aa, Plasmodium falciparum
VRRNSSRYSIDYGRRDSSRRGSVKQE

SEQ ID NO: 3374550 - protein, 22 aa, Plasmodium falciparum
VRSCISCFCCGWDADDEAMNEL

SEQ ID NO: 3374551 - protein, 19 aa, Plasmodium falciparum
VRVLSALLSHLIKMAEKYI

SEQ ID NO: 3374552 - protein, 17 aa, Plasmodium falciparum
VRVLTSFFYIPDKLRKE

SEQ ID NO: 3374553 - protein, 23 aa, Plasmodium falciparum
VRVNCRLAYALSYFYYEQLALVF

SEQ ID NO: 3374554 - protein, 19 aa, Plasmodium falciparum
VRVTLRIDYEPCICKDYKE

SEQ ID NO: 3374555 - protein, 21 aa, Plasmodium falciparum
VSAKHLIQFHCENLVQWIEFK

SEQ ID NO: 3374556 - protein, 17 aa, Plasmodium falciparum
VSASLKTSEIWKNSVGY

SEQ ID NO: 3374557 - protein, 23 aa, Plasmodium falciparum
VSDKFQFERRGYFILDKIDPHHH

SEQ ID NO: 3374558 - protein, 21 aa, Plasmodium falciparum
VSDNCLKYMIELLSHMMYLLT

SEQ ID NO: 3374559 - protein, 24 aa, Plasmodium falciparum
VSDYKNWTPLHIAITKMHKDITEL

SEQ ID NO: 3374560 - protein, 39 aa, Plasmodium falciparum
VSEEEIIFNPFAWKKFEKHIPCEFIELFEKMEKQLDMLP

SEQ ID NO: 3374561 - protein, 21 aa, Plasmodium falciparum
VSEEPLHFEVFVSLNNKKNIK

SEQ ID NO: 3374562 - protein, 17 aa, Plasmodium falciparum
VSEHSGDLNRMLNNNLN

SEQ ID NO: 3374563 - protein, 24 aa, Plasmodium falciparum
VSEILSLICKIYYYVNDSYLIKEV

SEQ ID NO: 3374564 - protein, 22 aa, Plasmodium falciparum
VSENYLSKMFDYLTNFKDEEIN

SEQ ID NO: 3374565 - protein, 38 aa, Plasmodium falciparum
VSESQGLCFYSGIFDGHGGSNCARYVMNHLKTNVIAKF

SEQ ID NO: 3374566 - protein, 17 aa, Plasmodium falciparum
VSFGSGLQGWAFTLETF

SEQ ID NO: 3374567 - protein, 21 aa, Plasmodium falciparum
VSFVPCYKMIHIISNLLHSYI

SEQ ID NO: 3374568 - protein, 27 aa, Plasmodium falciparum
VSHIIGDRLLQGWTLLNATCHMCNITP

SEQ ID NO: 3374569 - protein, 23 aa, Plasmodium falciparum
VSHLKRFHIGKVYRRDEPSMNRG

SEQ ID NO: 3374570 - protein, 44 aa, Plasmodium falciparum
VSHRGNDCPMKCRFCLKYHMGISIMDCLKKARIQTEKNNSNHDK

SEQ ID NO: 3374571 - protein, 25 aa, Plasmodium falciparum
VSIFFKNKFFEEYKMNNYNYIELFI

SEQ ID NO: 3374572 - protein, 17 aa, Plasmodium falciparum
VSIGRKVYDNNNNNGSN

SEQ ID NO: 3374573 - protein, 17 aa, Plasmodium falciparum
VSIKKNRYECLGDADES

SEQ ID NO: 3374574 - protein, 19 aa, Plasmodium falciparum
VSINCYYDDVIKCYMDYTM

SEQ ID NO: 3374575 - protein, 26 aa, Plasmodium falciparum
VSINHLKEIFMNFGTLKDVQYVTYVE

SEQ ID NO: 3374576 - protein, 24 aa, Plasmodium falciparum
VSIPKLECFYKFIKFEKKYKNIVR

SEQ ID NO: 3374577 - protein, 18 aa, Plasmodium falciparum
VSKACLRDQQSVFCGEEE

SEQ ID NO: 3374578 - protein, 24 aa, Plasmodium falciparum
VSKECLYKAISICRDGQLFSEIGR

SEQ ID NO: 3374579 - protein, 19 aa, Plasmodium falciparum
VSKIPGCTKEIHFYKIGKP

SEQ ID NO: 3374580 - protein, 20 aa, Plasmodium falciparum
VSKIREIFCKYGDVDKIHLN

SEQ ID NO: 3374581 - protein, 20 aa, Plasmodium falciparum
VSKNSEFIGINALNLEPALP

SEQ ID NO: 3374582 - protein, 19 aa, Plasmodium falciparum
VSKNYSIVVPTILYEHNNN

SEQ ID NO: 3374583 - protein, 27 aa, Plasmodium falciparum
VSKPRKSKVNSCFELDILLLDDNNIII

SEQ ID NO: 3374584 - protein, 23 aa, Plasmodium falciparum
VSKTSCFTCGTTTQDKHMYNNDK

SEQ ID NO: 3374585 - protein, 21 aa, Plasmodium falciparum
VSKYKVVIVPIFYKTTDENAI

SEQ ID NO: 3374586 - protein, 33 aa, Plasmodium falciparum
VSLGKHLLIGSSLKKGISVSVRGRTMNLGMNAK

SEQ ID NO: 3374587 - protein, 19 aa, Plasmodium falciparum
VSLIFDWKIADCADLASIV

SEQ ID NO: 3374588 - protein, 20 aa, Plasmodium falciparum
VSLIKIKKDELIIKQVKKLN

SEQ ID NO: 3374589 - protein, 19 aa, Plasmodium falciparum
VSLPNIYYIKGVSNDNINV

SEQ ID NO: 3374590 - protein, 27 aa, Plasmodium falciparum
VSMHTKCVEKLLLFNSHCLKQYESIIL

SEQ ID NO: 3374591 - protein, 27 aa, Plasmodium falciparum
VSMKNFFFYESPICFCLYNNDYNNKRQ

SEQ ID NO: 3374592 - protein, 25 aa, Plasmodium falciparum
VSNHKEFFGELVVNAVYKLGDNLDK

SEQ ID NO: 3374593 - protein, 26 aa, Plasmodium falciparum
VSNLEKEEKYILLLYISEKKLEYVWN

SEQ ID NO: 3374594 - protein, 26 aa, Plasmodium falciparum
VSNLPNFFLCRSELMYKNYDTQENTN

SEQ ID NO: 3374595 - protein, 23 aa, Plasmodium falciparum
VSNNLCKLGDVLELLRNLHNNKN

SEQ ID NO: 3374596 - protein, 20 aa, Plasmodium falciparum
VSNNMSCSRHTDICNNYKFH

SEQ ID NO: 3374597 - protein, 23 aa, Plasmodium falciparum
VSNQTCIHICFFSSKGDVYIMIL

SEQ ID NO: 3374598 - protein, 19 aa, Plasmodium falciparum
VSNSTFLSPFGESKNETFP

SEQ ID NO: 3374599 - protein, 37 aa, Plasmodium falciparum
VSPCKCKGSMKYVHLNCLRTWMRGRLNVRNDCSSCSF

SEQ ID NO: 3374600 - protein, 32 aa, Plasmodium falciparum
VSPDYICHMCGKKGHSIKNCTMSSFNNNNKKI

SEQ ID NO: 3374601 - protein, 17 aa, Plasmodium falciparum
VSPEFKTHTKIKEFFIL

SEQ ID NO: 3374602 - protein, 17 aa, Plasmodium falciparum
VSPHEFLQAVGIESNKN

SEQ ID NO: 3374603 - protein, 19 aa, Plasmodium falciparum
VSQYLDMEKGEYFKENSRM

SEQ ID NO: 3374604 - protein, 24 aa, Plasmodium falciparum
VSRDMRIAYMESMLQKCEKDLSKL

SEQ ID NO: 3374605 - protein, 21 aa, Plasmodium falciparum
VSRKCIKKFVCNYSTKISPIE

SEQ ID NO: 3374606 - protein, 32 aa, Plasmodium falciparum
VSRNKYCVEKGIYGPKFSKSFENTNISNDHII

SEQ ID NO: 3374607 - protein, 22 aa, Plasmodium falciparum
VSRPSYTFYGYILRPFNEYTNS

SEQ ID NO: 3374608 - protein, 24 aa, Plasmodium falciparum
VSSCKYLTCCFANLLEIFNLNYDI

SEQ ID NO: 3374609 - protein, 19 aa, Plasmodium falciparum
VSSDIKRKEHIPDRGIEIK

SEQ ID NO: 3374610 - protein, 17 aa, Plasmodium falciparum
VSSDLLNFLKCYSNLNI

SEQ ID NO: 3374611 - protein, 33 aa, Plasmodium falciparum
VSSDMWSFGCVLAELYTGSLLFRTHEHMEHLAM

SEQ ID NO: 3374612 - protein, 19 aa, Plasmodium falciparum
VSSIRVCRDSVTRKSLGYA

SEQ ID NO: 3374613 - protein, 21 aa, Plasmodium falciparum
VSSNNHLSVPLNKYNDEDKQL

SEQ ID NO: 3374614 - protein, 24 aa, Plasmodium falciparum
VSSRSHAILQIYVYNEILDDNMNT

SEQ ID NO: 3374615 - protein, 24 aa, Plasmodium falciparum
VSSTCSIGTLGNVGSIGSIGNIGT

SEQ ID NO: 3374616 - protein, 23 aa, Plasmodium falciparum
VSSTKARTNRCVYNNDENKKKLK

SEQ ID NO: 3374617 - protein, 19 aa, Plasmodium falciparum
VSSYFSGNFDDIINKEDSL

SEQ ID NO: 3374618 - protein, 23 aa, Plasmodium falciparum
VSSYKEDNCVKTKYYTLEERTNI

SEQ ID NO: 3374619 - protein, 19 aa, Plasmodium falciparum
VSTNLSRTSNARNRGVKVK

SEQ ID NO: 3374620 - protein, 20 aa, Plasmodium falciparum
VSVSCAIILQNFAVWANYEQ

SEQ ID NO: 3374621 - protein, 30 aa, Plasmodium falciparum
VSVYGHENARLFALFELIKYNCVPDSLKEE

SEQ ID NO: 3374622 - protein, 17 aa, Plasmodium falciparum
VSYCAIPTMSKDDEKKV

SEQ ID NO: 3374623 - protein, 25 aa, Plasmodium falciparum
VSYFTSCFLYKWKNYFQKEMLYAPS

SEQ ID NO: 3374624 - protein, 26 aa, Plasmodium falciparum
VSYKCKHCQHYTKLVYECHLNKCQNK

SEQ ID NO: 3374625 - protein, 23 aa, Plasmodium falciparum
VSYNGLCKRCCKLKDENDTISEK

SEQ ID NO: 3374626 - protein, 17 aa, Plasmodium falciparum
VTAKICRKVSFPDTFDM

SEQ ID NO: 3374627 - protein, 31 aa, Plasmodium falciparum
VTALKSTQRYLGFRICTLIQHINYSDLLNDD

SEQ ID NO: 3374628 - protein, 22 aa, Plasmodium falciparum
VTCDIIILDMCHFNIINQISIL

SEQ ID NO: 3374629 - protein, 24 aa, Plasmodium falciparum
VTCTKCKIKDIGNVHCKDNNFLDF

SEQ ID NO: 3374630 - protein, 23 aa, Plasmodium falciparum
VTDIQLTYHFVCKEHDTCEGSVI

SEQ ID NO: 3374631 - protein, 17 aa, Plasmodium falciparum
VTFCGGFTKKYRNKIMT

SEQ ID NO: 3374632 - protein, 17 aa, Plasmodium falciparum
VTGGKEFTVAIEPDITV

SEQ ID NO: 3374633 - protein, 20 aa, Plasmodium falciparum
VTGKCSVTYGHKENKDPSTN

SEQ ID NO: 3374634 - protein, 24 aa, Plasmodium falciparum
VTGLCTKANCPLSNSVYSTIILDK

SEQ ID NO: 3374635 - protein, 28 aa, Plasmodium falciparum
VTGVCIKRGYVLPKLRVMYLKCNSCDTT

SEQ ID NO: 3374636 - protein, 20 aa, Plasmodium falciparum
VTGYFGCDNINVFIQTLYHF

SEQ ID NO: 3374637 - protein, 26 aa, Plasmodium falciparum
VTHKYELWVAFGNGYIAVYDLYDFQL

SEQ ID NO: 3374638 - protein, 18 aa, Plasmodium falciparum
VTHSCPGTFSLNTTKNKN

SEQ ID NO: 3374639 - protein, 21 aa, Plasmodium falciparum
VTIELKNGTLITGIITAVDIK

SEQ ID NO: 3374640 - protein, 27 aa, Plasmodium falciparum
VTIRMKVFKLNIAKLFNILVNDSFHGR

SEQ ID NO: 3374641 - protein, 19 aa, Plasmodium falciparum
VTKDKVKFCNFKIENIIAS

SEQ ID NO: 3374642 - protein, 22 aa, Plasmodium falciparum
VTKELINLITAWHLSNSLEQTN

SEQ ID NO: 3374643 - protein, 21 aa, Plasmodium falciparum
VTKKRRYDWMSSDDEDITSDE

SEQ ID NO: 3374644 - protein, 18 aa, Plasmodium falciparum
VTLLRNGIITVEFDDKEK

SEQ ID NO: 3374645 - protein, 19 aa, Plasmodium falciparum
VTLNYKGISKFDINEDKNT

SEQ ID NO: 3374646 - protein, 18 aa, Plasmodium falciparum
VTNELYLQFQNEINIFIN

SEQ ID NO: 3374647 - protein, 24 aa, Plasmodium falciparum
VTNEPRPPLVINPPPANIIFKNKS

SEQ ID NO: 3374648 - protein, 17 aa, Plasmodium falciparum
VTNKILINKNAELTNQK

SEQ ID NO: 3374649 - protein, 18 aa, Plasmodium falciparum
VTQGMALALRLKVKKKDF

SEQ ID NO: 3374650 - protein, 35 aa, Plasmodium falciparum
VTQKKVQCMLKLLTRKNIFMLPSLYTNDNDYIINE

SEQ ID NO: 3374651 - protein, 18 aa, Plasmodium falciparum
VTQPRRVAAMSVAARVSE

SEQ ID NO: 3374652 - protein, 19 aa, Plasmodium falciparum
VTRCCRNNTCTCFINNNDS

SEQ ID NO: 3374653 - protein, 18 aa, Plasmodium falciparum
VTSCDLLNILSTKNDIND

SEQ ID NO: 3374654 - protein, 31 aa, Plasmodium falciparum
VTSKFESSVLFKILVFRGIPNENFDDLLKKE

SEQ ID NO: 3374655 - protein, 22 aa, Plasmodium falciparum
VTTEKHFPIYASKLPQNNGANL

SEQ ID NO: 3374656 - protein, 60 aa, Plasmodium falciparum
VTTLNIYCALNIFKLIRRGRYTICKYENFDIFKMKYFKKYYKFFYSLKGEEEILMNVKNY

SEQ ID NO: 3374657 - protein, 17 aa, Plasmodium falciparum
VTTRMHILVTLSYDLSS

SEQ ID NO: 3374658 - protein, 24 aa, Plasmodium falciparum
VTTWGKNKIDVIVNKSNIYTEETN

SEQ ID NO: 3374659 - protein, 24 aa, Plasmodium falciparum
VTVAIRGSMRLEHLLGDIHPTLQQ

SEQ ID NO: 3374660 - protein, 18 aa, Plasmodium falciparum
VTVLNPILLRRINNKNEV

SEQ ID NO: 3374661 - protein, 23 aa, Plasmodium falciparum
VTWNRFSSNISCYDDNKLYNKGL

SEQ ID NO: 3374662 - protein, 23 aa, Plasmodium falciparum
VTYWEYLINISFNISQEKNEKID

SEQ ID NO: 3374663 - protein, 20 aa, Plasmodium falciparum
VVAIKFLYHLIKSHDVGEKK

SEQ ID NO: 3374664 - protein, 28 aa, Plasmodium falciparum
VVDCSWKSIDLLKRIKFSNQRKLPYIIA

SEQ ID NO: 3374665 - protein, 21 aa, Plasmodium falciparum
VVDDFYSFRIYKEDKGKKTKT

SEQ ID NO: 3374666 - protein, 19 aa, Plasmodium falciparum
VVDFMSLLHHLTEHPVASY

SEQ ID NO: 3374667 - protein, 22 aa, Plasmodium falciparum
VVDGFKYGADFVLYKNNVDEEH

SEQ ID NO: 3374668 - protein, 17 aa, Plasmodium falciparum
VVDNFTSAAIFVENCVK

SEQ ID NO: 3374669 - protein, 19 aa, Plasmodium falciparum
VVDVGSCYTDFSLCNDGTI

SEQ ID NO: 3374670 - protein, 18 aa, Plasmodium falciparum
VVEKLELYHEMHCMHKNI

SEQ ID NO: 3374671 - protein, 18 aa, Plasmodium falciparum
VVGTCFKLIECIRKNSIK

SEQ ID NO: 3374672 - protein, 35 aa, Plasmodium falciparum
VVIGAPWVITESFIKRFHIDVVVRGTIVDYIYSNN

SEQ ID NO: 3374673 - protein, 27 aa, Plasmodium falciparum
VVIKFCPKYIKTYFYNIEFFIEEIKTY

SEQ ID NO: 3374674 - protein, 17 aa, Plasmodium falciparum
VVIKFLYGLNCNFDCAS

SEQ ID NO: 3374675 - protein, 24 aa, Plasmodium falciparum
VVINNELHKSMKYMNSIDNNSKSN

SEQ ID NO: 3374676 - protein, 22 aa, Plasmodium falciparum
VVIVRCPSCENLHLISDQLGWF

SEQ ID NO: 3374677 - protein, 24 aa, Plasmodium falciparum
VVKIWDIRTNKCFINIDAGPACAN

SEQ ID NO: 3374678 - protein, 23 aa, Plasmodium falciparum
VVKKLKYKTFWTYLKQQKDDKKE

SEQ ID NO: 3374679 - protein, 23 aa, Plasmodium falciparum
VVKSLKTLCLFNDSKFIQLSVKR

SEQ ID NO: 3374680 - protein, 26 aa, Plasmodium falciparum
VVKVFRFITLSGVEELVFKKAQHKLS

SEQ ID NO: 3374681 - protein, 18 aa, Plasmodium falciparum
VVLCEYCGIVLPDKKEDI

SEQ ID NO: 3374682 - protein, 19 aa, Plasmodium falciparum
VVLDEADRLLDLGFESQIY

SEQ ID NO: 3374683 - protein, 23 aa, Plasmodium falciparum
VVLMEFRYSPSFMSFKHNLDKDL

SEQ ID NO: 3374684 - protein, 17 aa, Plasmodium falciparum
VVMKRYNFHLNNMNYGK

SEQ ID NO: 3374685 - protein, 18 aa, Plasmodium falciparum
VVNKIGCDINFLRKQKKK

SEQ ID NO: 3374686 - protein, 23 aa, Plasmodium falciparum
VVNLGRNGVFLFVHGGKKKNNIL

SEQ ID NO: 3374687 - protein, 20 aa, Plasmodium falciparum
VVNRFKMFLTNYKKCHHVKS

SEQ ID NO: 3374688 - protein, 19 aa, Plasmodium falciparum
VVNRVCDNCTCGKKEKLLN

SEQ ID NO: 3374689 - protein, 18 aa, Plasmodium falciparum
VVPGMREAYNTGFQSIKE

SEQ ID NO: 3374690 - protein, 24 aa, Plasmodium falciparum
VVPHRFPGVYLLKGKSDILVTKNL

SEQ ID NO: 3374691 - protein, 19 aa, Plasmodium falciparum
VVPKRRKQENKSNESPNTV

SEQ ID NO: 3374692 - protein, 22 aa, Plasmodium falciparum
VVQGPFYLDEMRVWSEMGYFEP

SEQ ID NO: 3374693 - protein, 19 aa, Plasmodium falciparum
VVRDSENWTEASINCNDWD

SEQ ID NO: 3374694 - protein, 26 aa, Plasmodium falciparum
VVRNIDIGMKCIKYLKDNKLQRMDFI

SEQ ID NO: 3374695 - protein, 18 aa, Plasmodium falciparum
VVRWEFKQPTPFIRTREF

SEQ ID NO: 3374696 - protein, 42 aa, Plasmodium falciparum
VVSAACKKDTFDFLIDLIPLEDRMKFINLHMKMNSRKSQTNM

SEQ ID NO: 3374697 - protein, 21 aa, Plasmodium falciparum
VVSKRSKYILRHSNVSSNYDD

SEQ ID NO: 3374698 - protein, 24 aa, Plasmodium falciparum
VVSRFTNYKAFIKFMNNVGFKLSN

SEQ ID NO: 3374699 - protein, 28 aa, Plasmodium falciparum
VVTCEPCIMCVYALKLIGIKNIYFCCLN

SEQ ID NO: 3374700 - protein, 29 aa, Plasmodium falciparum
VVVLKGKYKGSCAVIKKVLPDEDLVVVNI

SEQ ID NO: 3374701 - protein, 26 aa, Plasmodium falciparum
VVVYLKVCKELFLFQKNNLDSMYNKM

SEQ ID NO: 3374702 - protein, 18 aa, Plasmodium falciparum
VVYLETYTSILFVSKDVL

SEQ ID NO: 3374703 - protein, 18 aa, Plasmodium falciparum
VWCEYALKRNECHNQNKK

SEQ ID NO: 3374704 - protein, 23 aa, Plasmodium falciparum
VWDRLRYPFYEFYFKYVKKDELF

SEQ ID NO: 3374705 - protein, 17 aa, Plasmodium falciparum
VWIYQYLLLETKKQNDS

SEQ ID NO: 3374706 - protein, 19 aa, Plasmodium falciparum
VYCKKLKNDLIKDNYSLDI

SEQ ID NO: 3374707 - protein, 21 aa, Plasmodium falciparum
VYEISNLLIAYDLSKKLLTKN

SEQ ID NO: 3374708 - protein, 17 aa, Plasmodium falciparum
VYELNRFNDLNSCDIKC

SEQ ID NO: 3374709 - protein, 27 aa, Plasmodium falciparum
VYFGHERWDLVMNMMIGIRISSIKKFS

SEQ ID NO: 3374710 - protein, 17 aa, Plasmodium falciparum
VYFKGNFIAGNQQRRVN

SEQ ID NO: 3374711 - protein, 24 aa, Plasmodium falciparum
VYFNKKLYIFGGELCTNTQFFHYN

SEQ ID NO: 3374712 - protein, 19 aa, Plasmodium falciparum
VYFRKCPFNGQFAILAGVY

SEQ ID NO: 3374713 - protein, 17 aa, Plasmodium falciparum
VYINDYCLFCIIEGILN

SEQ ID NO: 3374714 - protein, 29 aa, Plasmodium falciparum
VYKDVLKMNWNFKDIEEMFQNKETTEFGR

SEQ ID NO: 3374715 - protein, 24 aa, Plasmodium falciparum
VYKEELIKYIYLYNLIKIKIIPYK

SEQ ID NO: 3374716 - protein, 22 aa, Plasmodium falciparum
VYKGKLDLYFGRIEEENKNSFN

SEQ ID NO: 3374717 - protein, 33 aa, Plasmodium falciparum
VYKKIYFFPCIDIINFWYIIKRINIYSIKDLSS

SEQ ID NO: 3374718 - protein, 18 aa, Plasmodium falciparum
VYKLEKLYNLPLKILKFE

SEQ ID NO: 3374719 - protein, 41 aa, Plasmodium falciparum
VYKNAKLKLQIRLSHNYPNTCPEVFFITPIFHPLVNIQTGK

SEQ ID NO: 3374720 - protein, 17 aa, Plasmodium falciparum
VYKNIFENLGFKGHIRI

SEQ ID NO: 3374721 - protein, 19 aa, Plasmodium falciparum
VYKNIKFPDIKPITLEKVI

SEQ ID NO: 3374722 - protein, 86 aa, Plasmodium falciparum
VYKSAKDVWFPGFADSHVFLLKGNIFGILRACQLLYHYVKSKMSSSKCCIYLVAPFECVQKLLADGCKRMAIIKEECGADVRLGNL

SEQ ID NO: 3374723 - protein, 19 aa, Plasmodium falciparum
VYKYFKYKIIFSKKKKRYL

SEQ ID NO: 3374724 - protein, 21 aa, Plasmodium falciparum
VYLDSYPYEMVEHKNKYTSNM

SEQ ID NO: 3374725 - protein, 23 aa, Plasmodium falciparum
VYLMDLWWNPAIEDQAFERVHRI

SEQ ID NO: 3374726 - protein, 17 aa, Plasmodium falciparum
VYLSYNLLNINKCERKD

SEQ ID NO: 3374727 - protein, 18 aa, Plasmodium falciparum
VYMDVSVGIYDVCNENIS

SEQ ID NO: 3374728 - protein, 24 aa, Plasmodium falciparum
VYNFCNSDHRFSHDISNEKGENIN

SEQ ID NO: 3374729 - protein, 29 aa, Plasmodium falciparum
VYNHDFLLGIGRYHIKNILSLDAKLSKIL

SEQ ID NO: 3374730 - protein, 19 aa, Plasmodium falciparum
VYNHRLQPFILKKGKEQNV

SEQ ID NO: 3374731 - protein, 17 aa, Plasmodium falciparum
VYNLNLYMLKYEDNSLN

SEQ ID NO: 3374732 - protein, 22 aa, Plasmodium falciparum
VYNMEYFYGGGILCLEQQEFET

SEQ ID NO: 3374733 - protein, 18 aa, Plasmodium falciparum
VYSPVLYNPYVKPFNPTY

SEQ ID NO: 3374734 - protein, 20 aa, Plasmodium falciparum
VYSPYEYLKYLFSKHNKLNI

SEQ ID NO: 3374735 - protein, 23 aa, Plasmodium falciparum
VYTCPGCSQTFVIYKDYIEHKKM

SEQ ID NO: 3374736 - protein, 27 aa, Plasmodium falciparum
VYTKNEFLYAYKELILDKKGLGEDHEL

SEQ ID NO: 3374737 - protein, 24 aa, Plasmodium falciparum
VYVFDICKHRNSIILFGKTLTKFK

SEQ ID NO: 3374738 - protein, 25 aa, Plasmodium falciparum
VYYPNKRKAKMWIGNYKILNPEDIL

SEQ ID NO: 3374739 - protein, 20 aa, Plasmodium falciparum
VYYTPQICGFTINRNIRETL

SEQ ID NO: 3374740 - protein, 30 aa, Plasmodium falciparum
VYYVFKYLLLPILEKFRPEFIFISCGFDAS

SEQ ID NO: 3374741 - protein, 17 aa, Plasmodium falciparum
WADIVDEYDEFFYEVEK

SEQ ID NO: 3374742 - protein, 20 aa, Plasmodium falciparum
WAIHRKELWEALTCNAPKGA

SEQ ID NO: 3374743 - protein, 17 aa, Plasmodium falciparum
WAIPKTEVNEMLKKYNV

SEQ ID NO: 3374744 - protein, 22 aa, Plasmodium falciparum
WAQKKECLYLTIELQDIENVKI

SEQ ID NO: 3374745 - protein, 17 aa, Plasmodium falciparum
WASKIIKQGIELKDIIS

SEQ ID NO: 3374746 - protein, 30 aa, Plasmodium falciparum
WAYEKKRNFLRCRIEVKIIILYIIKQKYKT

SEQ ID NO: 3374747 - protein, 21 aa, Plasmodium falciparum
WAYQFCVDMSLRLKEYEMVIH

SEQ ID NO: 3374748 - protein, 17 aa, Plasmodium falciparum
WCEMLKGGVIMDVKSVE

SEQ ID NO: 3374749 - protein, 17 aa, Plasmodium falciparum
WCGFKKRWFVLRNNKLY

SEQ ID NO: 3374750 - protein, 20 aa, Plasmodium falciparum
WCGLTKRWISDESLELMEIS

SEQ ID NO: 3374751 - protein, 25 aa, Plasmodium falciparum
WCKKGNGLGNVFAMCSCDKSISILD

SEQ ID NO: 3374752 - protein, 26 aa, Plasmodium falciparum
WCPFEEYKNYLLCFNSHNLLYSNNNS

SEQ ID NO: 3374753 - protein, 21 aa, Plasmodium falciparum
WDEIQIIISKWFTIKEIKWID

SEQ ID NO: 3374754 - protein, 18 aa, Plasmodium falciparum
WDEISLPSLDNILKEYKL

SEQ ID NO: 3374755 - protein, 21 aa, Plasmodium falciparum
WDFRDDMDFIIFSPLNNNIYL

SEQ ID NO: 3374756 - protein, 18 aa, Plasmodium falciparum
WDIECYKDELKFPDKEKD

SEQ ID NO: 3374757 - protein, 19 aa, Plasmodium falciparum
WDIHEVPRPVVKYIGEQKI

SEQ ID NO: 3374758 - protein, 20 aa, Plasmodium falciparum
WDISKNVLYRISKYCFSIDF

SEQ ID NO: 3374759 - protein, 24 aa, Plasmodium falciparum
WDIVSCSFIKANSLIMHYVGEITT

SEQ ID NO: 3374760 - protein, 17 aa, Plasmodium falciparum
WDKKKRKFVLTEIDTFQ

SEQ ID NO: 3374761 - protein, 19 aa, Plasmodium falciparum
WDKLVKVWNLKNCDLNKNL

SEQ ID NO: 3374762 - protein, 17 aa, Plasmodium falciparum
WDMLKFFHKEGFDFNNK

SEQ ID NO: 3374763 - protein, 25 aa, Plasmodium falciparum
WDNEKKIICIFLQYIKYQSMYFKKK

SEQ ID NO: 3374764 - protein, 23 aa, Plasmodium falciparum
WDNHLRDYMLYSLSKNHYTFLRK

SEQ ID NO: 3374765 - protein, 18 aa, Plasmodium falciparum
WDPFCSTGNLIFELLSYL

SEQ ID NO: 3374766 - protein, 18 aa, Plasmodium falciparum
WDRRINKTYVKNILKEIY

SEQ ID NO: 3374767 - protein, 17 aa, Plasmodium falciparum
WEDALYIIRKCLNLRLW

SEQ ID NO: 3374768 - protein, 19 aa, Plasmodium falciparum
WEEALSILCTYAINNPNFN

SEQ ID NO: 3374769 - protein, 23 aa, Plasmodium falciparum
WEEKLKYIGCSIVSEISEDKNER

SEQ ID NO: 3374770 - protein, 17 aa, Plasmodium falciparum
WEGEGYDEAFLCSDPFN

SEQ ID NO: 3374771 - protein, 19 aa, Plasmodium falciparum
WEGLLKKDVLLLLIQAIKN

SEQ ID NO: 3374772 - protein, 18 aa, Plasmodium falciparum
WELTRKSNCFIKKNKAGK

SEQ ID NO: 3374773 - protein, 23 aa, Plasmodium falciparum
WENDIIHFFFDLVLRKKEHFKNN

SEQ ID NO: 3374774 - protein, 17 aa, Plasmodium falciparum
WENHLVVYGGINKHKGD

SEQ ID NO: 3374775 - protein, 21 aa, Plasmodium falciparum
WEPQNKWTLSVLFQNIKSIVV

SEQ ID NO: 3374776 - protein, 26 aa, Plasmodium falciparum
WEQISIEGLFPIIEFARVSQLKKPES

SEQ ID NO: 3374777 - protein, 33 aa, Plasmodium falciparum
WESVMRIRISRGWKITNWYGNYQFRGADLLALP

SEQ ID NO: 3374778 - protein, 19 aa, Plasmodium falciparum
WETEKQKEIEVLKNEIYSQ

SEQ ID NO: 3374779 - protein, 19 aa, Plasmodium falciparum
WFDEEEIFDLPNNLEDITS

SEQ ID NO: 3374780 - protein, 20 aa, Plasmodium falciparum
WFHTCPSRGINCYNRNLKEN

SEQ ID NO: 3374781 - protein, 19 aa, Plasmodium falciparum
WFKCKGETFRFKTVDRAAA

SEQ ID NO: 3374782 - protein, 33 aa, Plasmodium falciparum
WFKLYKCELRPLMKICHYPKIGQMICNMPNVYV

SEQ ID NO: 3374783 - protein, 20 aa, Plasmodium falciparum
WFLLCGGYNLSWYQKSNLLD

SEQ ID NO: 3374784 - protein, 22 aa, Plasmodium falciparum
WFQEKLHIFKTRQIEFARLNVT

SEQ ID NO: 3374785 - protein, 26 aa, Plasmodium falciparum
WFQEYRKNEVNFFFLFDRKRNIISGN

SEQ ID NO: 3374786 - protein, 17 aa, Plasmodium falciparum
WFSKNMKNDEFYERLYK

SEQ ID NO: 3374787 - protein, 18 aa, Plasmodium falciparum
WFSRDILSPIILFKHKLN

SEQ ID NO: 3374788 - protein, 24 aa, Plasmodium falciparum
WGDTKLLFNKKVHRYIGNKGFISH

SEQ ID NO: 3374789 - protein, 35 aa, Plasmodium falciparum
WGEEVKKLPVAFGLYKLHMSCIIYDDFVNTNELIE

SEQ ID NO: 3374790 - protein, 18 aa, Plasmodium falciparum
WGEFKLENSNLCFDIDNK

SEQ ID NO: 3374791 - protein, 20 aa, Plasmodium falciparum
WGGELTRMGRRQSENLGKRF

SEQ ID NO: 3374792 - protein, 17 aa, Plasmodium falciparum
WGGKGLLGCNVATGYLH

SEQ ID NO: 3374793 - protein, 17 aa, Plasmodium falciparum
WGIGNKFRSDPENRYHP

SEQ ID NO: 3374794 - protein, 28 aa, Plasmodium falciparum
WGKAHKKTPFAFGLFKLQVSCVIVDDLV

SEQ ID NO: 3374795 - protein, 20 aa, Plasmodium falciparum
WGQPKIWYVIPPHYSDKVED

SEQ ID NO: 3374796 - protein, 18 aa, Plasmodium falciparum
WGQVFILDALVLYEPKTS

SEQ ID NO: 3374797 - protein, 19 aa, Plasmodium falciparum
WGTPFLPQNRDIFATLGGD

SEQ ID NO: 3374798 - protein, 18 aa, Plasmodium falciparum
WGTQFGMIINYIKTHYPN

SEQ ID NO: 3374799 - protein, 19 aa, Plasmodium falciparum
WGTVGRYVGIEFSGEASKE

SEQ ID NO: 3374800 - protein, 17 aa, Plasmodium falciparum
WGVIKQRTYDDVVILQL

SEQ ID NO: 3374801 - protein, 21 aa, Plasmodium falciparum
WHASGAWRVYFCKRNYQHNFF

SEQ ID NO: 3374802 - protein, 25 aa, Plasmodium falciparum
WICNLKKRTWEHISCKEKENKTNQP

SEQ ID NO: 3374803 - protein, 24 aa, Plasmodium falciparum
WIDEMKCYIIFLILSPYDEQQNKL

SEQ ID NO: 3374804 - protein, 21 aa, Plasmodium falciparum
WIDIQLRWGDFDSHDIERYSR

SEQ ID NO: 3374805 - protein, 43 aa, Plasmodium falciparum
WIEDGKRVAKYFPIKLFGFDYARRLAIYCKIHQKIPEEALNFE

SEQ ID NO: 3374806 - protein, 24 aa, Plasmodium falciparum
WIKIKRFYYAMIIYDCYNDDVYQV

SEQ ID NO: 3374807 - protein, 18 aa, Plasmodium falciparum
WIKNEGIYLDAFEQIYVK

SEQ ID NO: 3374808 - protein, 18 aa, Plasmodium falciparum
WILLIIIEKGIALTNRSN

SEQ ID NO: 3374809 - protein, 24 aa, Plasmodium falciparum
WILSQRYLYDYILFIIPSDFSNYF

SEQ ID NO: 3374810 - protein, 21 aa, Plasmodium falciparum
WILVCLLKKFLQNFKSSKQLS

SEQ ID NO: 3374811 - protein, 20 aa, Plasmodium falciparum
WINLFNELFFDKKLKFVYLT

SEQ ID NO: 3374812 - protein, 19 aa, Plasmodium falciparum
WINRDRFILSNGHASALLY

SEQ ID NO: 3374813 - protein, 18 aa, Plasmodium falciparum
WINSNLLLFTSLNGNIYI

SEQ ID NO: 3374814 - protein, 19 aa, Plasmodium falciparum
WITCSEILDHHTIMAADKF

SEQ ID NO: 3374815 - protein, 21 aa, Plasmodium falciparum
WIVIKKSILINEYITRSQKND

SEQ ID NO: 3374816 - protein, 22 aa, Plasmodium falciparum
WIVKEVIAIIILVHGLGSSLRF

SEQ ID NO: 3374817 - protein, 21 aa, Plasmodium falciparum
WIVSRMKRNLSVLLADEMGLG

SEQ ID NO: 3374818 - protein, 25 aa, Plasmodium falciparum
WIYILYFIHFCNFKRIKYYKQNILY

SEQ ID NO: 3374819 - protein, 22 aa, Plasmodium falciparum
WKAQNFVTAGSFAKRLINGNYE

SEQ ID NO: 3374820 - protein, 24 aa, Plasmodium falciparum
WKCKKCKRKVCGGAWSLTTPAAVA

SEQ ID NO: 3374821 - protein, 28 aa, Plasmodium falciparum
WKENTNLLGWKIKYYKGLGTSTDREFKQ

SEQ ID NO: 3374822 - protein, 20 aa, Plasmodium falciparum
WKEYSCSDGRKYWYHEEKNI

SEQ ID NO: 3374823 - protein, 21 aa, Plasmodium falciparum
WKGLQMKKANIIMHEHLENNL

SEQ ID NO: 3374824 - protein, 17 aa, Plasmodium falciparum
WKHECERVLIDKLSRME

SEQ ID NO: 3374825 - protein, 19 aa, Plasmodium falciparum
WKIKYRYLTSSFRKLDKEI

SEQ ID NO: 3374826 - protein, 26 aa, Plasmodium falciparum
WKINIFKREKWELLDKGNLDDIYLEE

SEQ ID NO: 3374827 - protein, 19 aa, Plasmodium falciparum
WKINKEILHYIEYAYIHGI

SEQ ID NO: 3374828 - protein, 24 aa, Plasmodium falciparum
WKIRDDIYWNIPLPYWVMSKNLLE

SEQ ID NO: 3374829 - protein, 21 aa, Plasmodium falciparum
WKKEEKKKKLLAFQNNIVTQR

SEQ ID NO: 3374830 - protein, 21 aa, Plasmodium falciparum
WKKNQECIKLKSCDNNKREFV

SEQ ID NO: 3374831 - protein, 27 aa, Plasmodium falciparum
WKKNYFEWIDILYLLKMWNINKEQFID

SEQ ID NO: 3374832 - protein, 20 aa, Plasmodium falciparum
WKLINDLDLVILIVYQGIQN

SEQ ID NO: 3374833 - protein, 20 aa, Plasmodium falciparum
WKNIHRKPEQAAEEVVNEAT

SEQ ID NO: 3374834 - protein, 21 aa, Plasmodium falciparum
WKNKMIKIAKIIQMYKNSKII

SEQ ID NO: 3374835 - protein, 27 aa, Plasmodium falciparum
WKNKRKKLGRPLLRMFWNNSQNSLPHY

SEQ ID NO: 3374836 - protein, 18 aa, Plasmodium falciparum
WKNKSFNNSNMKNILEER

SEQ ID NO: 3374837 - protein, 24 aa, Plasmodium falciparum
WKNLMNYKYINVIHILKAQNKKYS

SEQ ID NO: 3374838 - protein, 23 aa, Plasmodium falciparum
WKNRDYACILVGSKVIEIQESLE

SEQ ID NO: 3374839 - protein, 17 aa, Plasmodium falciparum
WKQFGVAVQKKAIDLEL

SEQ ID NO: 3374840 - protein, 17 aa, Plasmodium falciparum
WKQLWRVIEKSHVLFYI

SEQ ID NO: 3374841 - protein, 18 aa, Plasmodium falciparum
WKQNIEWKNYLNKINTYP

SEQ ID NO: 3374842 - protein, 18 aa, Plasmodium falciparum
WKQTIIIPKKIEQKLCLI

SEQ ID NO: 3374843 - protein, 20 aa, Plasmodium falciparum
WKSENIVVSCFYYKDYDDDD

SEQ ID NO: 3374844 - protein, 22 aa, Plasmodium falciparum
WKSQIKSLVLISPMISVERQKS

SEQ ID NO: 3374845 - protein, 22 aa, Plasmodium falciparum
WKTNSGLLYDFVCRKELEWPSL

SEQ ID NO: 3374846 - protein, 31 aa, Plasmodium falciparum
WKVVYIQLLLSWKSRFHFFIDFIKTKWYGRP

SEQ ID NO: 3374847 - protein, 17 aa, Plasmodium falciparum
WKVYLSYNLLNINKCER

SEQ ID NO: 3374848 - protein, 20 aa, Plasmodium falciparum
WKYIIRDDIIFDMNSLNIKQ

SEQ ID NO: 3374849 - protein, 19 aa, Plasmodium falciparum
WKYLNLVNLIKKMELCQKD

SEQ ID NO: 3374850 - protein, 19 aa, Plasmodium falciparum
WKYSFEALNTRAHEDTRDM

SEQ ID NO: 3374851 - protein, 19 aa, Plasmodium falciparum
WLEYTYLFIRMKKNPYLYD

SEQ ID NO: 3374852 - protein, 26 aa, Plasmodium falciparum
WLFDEKRNYAKYVLKIIYEHMKLGNF

SEQ ID NO: 3374853 - protein, 17 aa, Plasmodium falciparum
WLFNDIVQYLKCIKYNI

SEQ ID NO: 3374854 - protein, 23 aa, Plasmodium falciparum
WLHYDIPDNFLIQIKGRKKILLI

SEQ ID NO: 3374855 - protein, 26 aa, Plasmodium falciparum
WLIRCFCQLANIFGFNSFWSVKDKEA

SEQ ID NO: 3374856 - protein, 21 aa, Plasmodium falciparum
WLKEFEEILDKIFLDAHVNFR

SEQ ID NO: 3374857 - protein, 25 aa, Plasmodium falciparum
WLKEKLMFSKIFPFSLFSNICEICI

SEQ ID NO: 3374858 - protein, 18 aa, Plasmodium falciparum
WLKISKWVLNNQLSSIRV

SEQ ID NO: 3374859 - protein, 19 aa, Plasmodium falciparum
WLLAQEVLYLKGVIPRSEP

SEQ ID NO: 3374860 - protein, 23 aa, Plasmodium falciparum
WLLYEYAGAYTFVSSSNFNGFKK

SEQ ID NO: 3374861 - protein, 19 aa, Plasmodium falciparum
WLLYLYKNNINGILADEMG

SEQ ID NO: 3374862 - protein, 19 aa, Plasmodium falciparum
WLQYMRYYWDSKKKENKIN

SEQ ID NO: 3374863 - protein, 24 aa, Plasmodium falciparum
WLREIHRFTPHLTCIKICGSKNER

SEQ ID NO: 3374864 - protein, 17 aa, Plasmodium falciparum
WLVTRYPKIAKAVYETR

SEQ ID NO: 3374865 - protein, 25 aa, Plasmodium falciparum
WMKKDYKIVVDFERLRYIVYEYMKE

SEQ ID NO: 3374866 - protein, 18 aa, Plasmodium falciparum
WMSGEHKPHLGFPEQSLH

SEQ ID NO: 3374867 - protein, 27 aa, Plasmodium falciparum
WMSTSWINFCSIIKSFRIIFISHAHAD

SEQ ID NO: 3374868 - protein, 19 aa, Plasmodium falciparum
WMTEWSEYYCKALKVELEK

SEQ ID NO: 3374869 - protein, 17 aa, Plasmodium falciparum
WMWGNLRIALKKYGNGH

SEQ ID NO: 3374870 - protein, 25 aa, Plasmodium falciparum
WNCPHGRPTIKYLINNVDIKNCFKN

SEQ ID NO: 3374871 - protein, 18 aa, Plasmodium falciparum
WNDLISSVLFRNISRKDK

SEQ ID NO: 3374872 - protein, 27 aa, Plasmodium falciparum
WNDVLDILKKHWNNFITLECNMILDPL

SEQ ID NO: 3374873 - protein, 19 aa, Plasmodium falciparum
WNELNCFNISDTLVYIKSY

SEQ ID NO: 3374874 - protein, 18 aa, Plasmodium falciparum
WNELQILDLTILREYLLK

SEQ ID NO: 3374875 - protein, 17 aa, Plasmodium falciparum
WNETCFQFSKWKNRDYA

SEQ ID NO: 3374876 - protein, 26 aa, Plasmodium falciparum
WNHLKEKYFDMMKPGVVDNIINIKEN

SEQ ID NO: 3374877 - protein, 25 aa, Plasmodium falciparum
WNIEKETFITKPLYAQNLRKKQFSL

SEQ ID NO: 3374878 - protein, 17 aa, Plasmodium falciparum
WNIRNFQDPICAQSQLY

SEQ ID NO: 3374879 - protein, 19 aa, Plasmodium falciparum
WNKISFCIVPNEKKDIDLY

SEQ ID NO: 3374880 - protein, 20 aa, Plasmodium falciparum
WNKKTGVSIYYNKNLNESNS

SEQ ID NO: 3374881 - protein, 17 aa, Plasmodium falciparum
WNKVLSIKDSKGRFLTL

SEQ ID NO: 3374882 - protein, 21 aa, Plasmodium falciparum
WNLNNLCTINNIYTKLYDEHI

SEQ ID NO: 3374883 - protein, 19 aa, Plasmodium falciparum
WNNLGNVCACSSSDGYVSF

SEQ ID NO: 3374884 - protein, 30 aa, Plasmodium falciparum
WNNNIDRYSYKNGRNGVYYNEYGKMEGGTY

SEQ ID NO: 3374885 - protein, 17 aa, Plasmodium falciparum
WNNNIFIVKQWIQNRTD

SEQ ID NO: 3374886 - protein, 21 aa, Plasmodium falciparum
WNNSYEEFFHLNSIKHSQIAD

SEQ ID NO: 3374887 - protein, 27 aa, Plasmodium falciparum
WNPLSLKQSFHLSRIINDFILYNDNIN

SEQ ID NO: 3374888 - protein, 18 aa, Plasmodium falciparum
WNRHKEINNSIIVDLFQG

SEQ ID NO: 3374889 - protein, 17 aa, Plasmodium falciparum
WNSTKNFNDTYEHKNYV

SEQ ID NO: 3374890 - protein, 19 aa, Plasmodium falciparum
WNVLLFKDIDAYNVCGINN

SEQ ID NO: 3374891 - protein, 22 aa, Plasmodium falciparum
WNYLEHRGLIFSPPYVQHHVPI

SEQ ID NO: 3374892 - protein, 21 aa, Plasmodium falciparum
WNYLGTFTFQNMYVRSKVVSE

SEQ ID NO: 3374893 - protein, 19 aa, Plasmodium falciparum
WNYRREYFEYIKPEYLKGK

SEQ ID NO: 3374894 - protein, 18 aa, Plasmodium falciparum
WPAKSCKFLLNILDNVQA

SEQ ID NO: 3374895 - protein, 19 aa, Plasmodium falciparum
WPEELFKLQYFNIDMFLTM

SEQ ID NO: 3374896 - protein, 21 aa, Plasmodium falciparum
WPFELDDMIIHIKKHVKHNIS

SEQ ID NO: 3374897 - protein, 20 aa, Plasmodium falciparum
WPHNPVSIIIKHLKKYFNKN

SEQ ID NO: 3374898 - protein, 21 aa, Plasmodium falciparum
WPKDSIFPTYNIFLFEKGLNK

SEQ ID NO: 3374899 - protein, 17 aa, Plasmodium falciparum
WPLEALVNVSTAYLNNF

SEQ ID NO: 3374900 - protein, 19 aa, Plasmodium falciparum
WPSDVWATGCLIYELATFR

SEQ ID NO: 3374901 - protein, 19 aa, Plasmodium falciparum
WPSNLCNNKKVLNNEKKLN

SEQ ID NO: 3374902 - protein, 18 aa, Plasmodium falciparum
WPVHCVKNTYGCKVHNKL

SEQ ID NO: 3374903 - protein, 18 aa, Plasmodium falciparum
WQVGYAISHGLSLSFFTF

SEQ ID NO: 3374904 - protein, 19 aa, Plasmodium falciparum
WRDFASFECRGIELIDFFP

SEQ ID NO: 3374905 - protein, 17 aa, Plasmodium falciparum
WRDRSRDRWGLDRRRSR

SEQ ID NO: 3374906 - protein, 30 aa, Plasmodium falciparum
WRDSDKTGSMSTWRLGKNSVSNHNSSMNHM

SEQ ID NO: 3374907 - protein, 19 aa, Plasmodium falciparum
WRNKELKNDITNENIYQFI

SEQ ID NO: 3374908 - protein, 23 aa, Plasmodium falciparum
WRSDARASIYGMTFNTERSHIVR

SEQ ID NO: 3374909 - protein, 17 aa, Plasmodium falciparum
WRSFRRIDISTFNLKNF

SEQ ID NO: 3374910 - protein, 26 aa, Plasmodium falciparum
WRSPSGCKRTKNFGINTYGTTLSKKL

SEQ ID NO: 3374911 - protein, 18 aa, Plasmodium falciparum
WRTVLVIDTAKGKPTDLS

SEQ ID NO: 3374912 - protein, 17 aa, Plasmodium falciparum
WRVITGKLLRSFITPEY

SEQ ID NO: 3374913 - protein, 19 aa, Plasmodium falciparum
WRVVQDIADVVCARADVGK

SEQ ID NO: 3374914 - protein, 18 aa, Plasmodium falciparum
WSCLNVYGMLLVTHHFYG

SEQ ID NO: 3374915 - protein, 26 aa, Plasmodium falciparum
WSDLYISRPFLKVLYEQKFSNPTYIQ

SEQ ID NO: 3374916 - protein, 27 aa, Plasmodium falciparum
WSEMGYFEPMLPVRCCDSDRFVALNKL

SEQ ID NO: 3374917 - protein, 24 aa, Plasmodium falciparum
WSGNLSLKEKINYFIKNNIATKTE

SEQ ID NO: 3374918 - protein, 25 aa, Plasmodium falciparum
WSIKEGFIKSRISCLSKSYEVQDDS

SEQ ID NO: 3374919 - protein, 21 aa, Plasmodium falciparum
WSLGICLYVMFYNVVPFSLKI

SEQ ID NO: 3374920 - protein, 17 aa, Plasmodium falciparum
WSNIRDEFLIIEGKSDN

SEQ ID NO: 3374921 - protein, 18 aa, Plasmodium falciparum
WSPALTIRTALLSIQALL

SEQ ID NO: 3374922 - protein, 22 aa, Plasmodium falciparum
WSPNNRFIVFFFSYEEEKHNRL

SEQ ID NO: 3374923 - protein, 19 aa, Plasmodium falciparum
WSPYIPDLFASSTNMDTIQ

SEQ ID NO: 3374924 - protein, 18 aa, Plasmodium falciparum
WSQEIYIAYVKDMKKLEY

SEQ ID NO: 3374925 - protein, 26 aa, Plasmodium falciparum
WSSDHIFPIIDLFRILVLNKNCDFLY

SEQ ID NO: 3374926 - protein, 17 aa, Plasmodium falciparum
WSSNKKEWTPFIHAPFF

SEQ ID NO: 3374927 - protein, 20 aa, Plasmodium falciparum
WSSSLYPGIYFINNKDDKGH

SEQ ID NO: 3374928 - protein, 20 aa, Plasmodium falciparum
WSTKCVDLEPSILLEISCMQ

SEQ ID NO: 3374929 - protein, 20 aa, Plasmodium falciparum
WSYNSSICYDIIQVSDEEEY

SEQ ID NO: 3374930 - protein, 22 aa, Plasmodium falciparum
WTEKALCNICNIGEDWEDNPIV

SEQ ID NO: 3374931 - protein, 23 aa, Plasmodium falciparum
WTEYPENIFTAIALKPYYKNTVR

SEQ ID NO: 3374932 - protein, 18 aa, Plasmodium falciparum
WTKDEVDKLLCLSKKYEQ

SEQ ID NO: 3374933 - protein, 18 aa, Plasmodium falciparum
WTKSLVEYKNYNNVDSSF

SEQ ID NO: 3374934 - protein, 26 aa, Plasmodium falciparum
WTLHRAETFSSCKIRGIASTSEHSCF

SEQ ID NO: 3374935 - protein, 23 aa, Plasmodium falciparum
WTLKEKKNEMNVWTLKEKKNETY

SEQ ID NO: 3374936 - protein, 17 aa, Plasmodium falciparum
WTLSVLFQNIKSIVVKN

SEQ ID NO: 3374937 - protein, 19 aa, Plasmodium falciparum
WTNEVKYLEKFFMKDYNKN

SEQ ID NO: 3374938 - protein, 18 aa, Plasmodium falciparum
WTQCIKLIDQGGENLEER

SEQ ID NO: 3374939 - protein, 37 aa, Plasmodium falciparum
WTRRSVKGKIPLPRDQHSSLVYPAKCEHVRGEKPNLT

SEQ ID NO: 3374940 - protein, 17 aa, Plasmodium falciparum
WTYEGIKFFYTKDELIR

SEQ ID NO: 3374941 - protein, 18 aa, Plasmodium falciparum
WTYKGCSEYYPLMKKKMK

SEQ ID NO: 3374942 - protein, 17 aa, Plasmodium falciparum
WVERDSYLPNGSRTLKS

SEQ ID NO: 3374943 - protein, 17 aa, Plasmodium falciparum
WVGDNDIVDETKLKLDD

SEQ ID NO: 3374944 - protein, 25 aa, Plasmodium falciparum
WVRKPAHLSSLILARNGYVCQDEFV

SEQ ID NO: 3374945 - protein, 37 aa, Plasmodium falciparum
WVRSPRWKKPVPLIICNSCQQKMYMSQWLNNDGTKVK

SEQ ID NO: 3374946 - protein, 18 aa, Plasmodium falciparum
WVRTHFRIYRDVEQIQSD

SEQ ID NO: 3374947 - protein, 18 aa, Plasmodium falciparum
WVSEVFFTKRNEVLSGGL

SEQ ID NO: 3374948 - protein, 19 aa, Plasmodium falciparum
WVSRVMKNNTTNIIPENNK

SEQ ID NO: 3374949 - protein, 24 aa, Plasmodium falciparum
WVVFFRTYFITIPFISFMNKSIQP

SEQ ID NO: 3374950 - protein, 24 aa, Plasmodium falciparum
WVYSGRRGIHCWVADESCRYYTTD

SEQ ID NO: 3374951 - protein, 21 aa, Plasmodium falciparum
WWPYLRRWNSSVTTCEADIFE

SEQ ID NO: 3374952 - protein, 17 aa, Plasmodium falciparum
WWSLGIMLYEMLTGELP

SEQ ID NO: 3374953 - protein, 19 aa, Plasmodium falciparum
WYDDYCHTRQKYLKDVKEK

SEQ ID NO: 3374954 - protein, 24 aa, Plasmodium falciparum
WYDTNRRLWRVMYMENDKRKTRGF

SEQ ID NO: 3374955 - protein, 17 aa, Plasmodium falciparum
WYHRNYIELLFGYIKDN

SEQ ID NO: 3374956 - protein, 17 aa, Plasmodium falciparum
WYKQFLVYNNLKNKYIN

SEQ ID NO: 3374957 - protein, 20 aa, Plasmodium falciparum
WYLENGCEIVPLKRACNRDY

SEQ ID NO: 3374958 - protein, 17 aa, Plasmodium falciparum
WYLILLWLYTHNQYKCD

SEQ ID NO: 3374959 - protein, 17 aa, Plasmodium falciparum
WYNKQFVNISNKNIPWM

SEQ ID NO: 3374960 - protein, 17 aa, Plasmodium falciparum
WYNKYGYDGIKQVNFMN

SEQ ID NO: 3374961 - protein, 23 aa, Plasmodium falciparum
WYPYICANSRYFFRQKLNYLNNI

SEQ ID NO: 3374962 - protein, 22 aa, Plasmodium falciparum
WYRAPELLCGSMFYTTEVDLWS

SEQ ID NO: 3374963 - protein, 19 aa, Plasmodium falciparum
WYRPPELLLGSENYMASVD

SEQ ID NO: 3374964 - protein, 18 aa, Plasmodium falciparum
WYYGESIEKSYKNVVQEI

SEQ ID NO: 3374965 - protein, 34 aa, Plasmodium falciparum
YAAPEVLKGEGFFKESDVWSFAVSLWEALTKKIA

SEQ ID NO: 3374966 - protein, 19 aa, Plasmodium falciparum
YACKLLFQELQTMNVFPKI

SEQ ID NO: 3374967 - protein, 19 aa, Plasmodium falciparum
YACNKNVERSLPYFNWLVS

SEQ ID NO: 3374968 - protein, 27 aa, Plasmodium falciparum
YACPSECMFIHDGLEIWKDKSKSGSTK

SEQ ID NO: 3374969 - protein, 18 aa, Plasmodium falciparum
YADDESIIFINNPNYVMV

SEQ ID NO: 3374970 - protein, 23 aa, Plasmodium falciparum
YADKFDIPVIFVLNKADIYGSNE

SEQ ID NO: 3374971 - protein, 17 aa, Plasmodium falciparum
YADKHWTPPKGLHENNE

SEQ ID NO: 3374972 - protein, 18 aa, Plasmodium falciparum
YADLKKWFVHIPADIKKR

SEQ ID NO: 3374973 - protein, 17 aa, Plasmodium falciparum
YAENFSGSNNNHYGSRV

SEQ ID NO: 3374974 - protein, 23 aa, Plasmodium falciparum
YAESKLEKIEQLFEEIKKQEDLY

SEQ ID NO: 3374975 - protein, 18 aa, Plasmodium falciparum
YAFHLKLDYFSTECTYSP

SEQ ID NO: 3374976 - protein, 17 aa, Plasmodium falciparum
YAFKEILFFLNKKHLKQ

SEQ ID NO: 3374977 - protein, 17 aa, Plasmodium falciparum
YAFKILHHVDYNPKKAI

SEQ ID NO: 3374978 - protein, 28 aa, Plasmodium falciparum
YAFLVFKKKLIGLIKHYLFICQDNVKLR

SEQ ID NO: 3374979 - protein, 19 aa, Plasmodium falciparum
YAGYNHMYARCLNNNNMNN

SEQ ID NO: 3374980 - protein, 36 aa, Plasmodium falciparum
YAHGELELRAPPDFFKTKLCKFFNTSGMCPLSDNCR

SEQ ID NO: 3374981 - protein, 17 aa, Plasmodium falciparum
YAHMMLSDKNIYVEFEN

SEQ ID NO: 3374982 - protein, 25 aa, Plasmodium falciparum
YAHNFLIKLDYNFYYTNKYKLSYQN

SEQ ID NO: 3374983 - protein, 18 aa, Plasmodium falciparum
YAIWNCVLGISKEEFDDM

SEQ ID NO: 3374984 - protein, 28 aa, Plasmodium falciparum
YAKDVIRTCIKFLVILYIDLEEEVKYFY

SEQ ID NO: 3374985 - protein, 17 aa, Plasmodium falciparum
YAKKNSKEFSLFENNQH

SEQ ID NO: 3374986 - protein, 19 aa, Plasmodium falciparum
YALEALKLDPNYYKAVYRR

SEQ ID NO: 3374987 - protein, 19 aa, Plasmodium falciparum
YANCFLPRNIKVFNLYEFI

SEQ ID NO: 3374988 - protein, 22 aa, Plasmodium falciparum
YANCPEENYLNMKLIDNQKKKN

SEQ ID NO: 3374989 - protein, 30 aa, Plasmodium falciparum
YANIYYKLGNICTLLLKSGYAYINEYTIKF

SEQ ID NO: 3374990 - protein, 18 aa, Plasmodium falciparum
YANNYSNESSNNFTNNYK

SEQ ID NO: 3374991 - protein, 20 aa, Plasmodium falciparum
YAPSNMRTGIEVDNENGNED

SEQ ID NO: 3374992 - protein, 26 aa, Plasmodium falciparum
YAQRNVCTKNIINLIPSLHNIYENKN

SEQ ID NO: 3374993 - protein, 30 aa, Plasmodium falciparum
YAQTNFWEPLKIGQVVKCKKEFLEEKIKNQ

SEQ ID NO: 3374994 - protein, 17 aa, Plasmodium falciparum
YAQVWKVKHKITNEIYA

SEQ ID NO: 3374995 - protein, 21 aa, Plasmodium falciparum
YARKCKKNISSLCSTKQNEEC

SEQ ID NO: 3374996 - protein, 23 aa, Plasmodium falciparum
YASAKNGWCTDNFHEAKQNNTQK

SEQ ID NO: 3374997 - protein, 22 aa, Plasmodium falciparum
YASRFMRVFGKFKRAQLREKPQ

SEQ ID NO: 3374998 - protein, 17 aa, Plasmodium falciparum
YASSKTIHERKCSKLGF

SEQ ID NO: 3374999 - protein, 32 aa, Plasmodium falciparum
YATEKFFLKKILKRFFISKGYSKNISNFIDVG

SEQ ID NO: 3375000 - protein, 22 aa, Plasmodium falciparum
YATGLLCARRFLKSLNLDTQFL

SEQ ID NO: 3375001 - protein, 23 aa, Plasmodium falciparum
YATGLRKGKKYGRKRDIRQLINV

SEQ ID NO: 3375002 - protein, 33 aa, Plasmodium falciparum
YAVILSEAEKIIAYRIVEAFQQTVCGFDILRTT

SEQ ID NO: 3375003 - protein, 17 aa, Plasmodium falciparum
YAVPCNMITYDGQETND

SEQ ID NO: 3375004 - protein, 29 aa, Plasmodium falciparum
YAYINYIKKKICCVYICSHASSRDFFHLS

SEQ ID NO: 3375005 - protein, 21 aa, Plasmodium falciparum
YAYTRSCYNENNIEYNENENN

SEQ ID NO: 3375006 - protein, 20 aa, Plasmodium falciparum
YCGFGDTCIYLHDRSDYKSG

SEQ ID NO: 3375007 - protein, 25 aa, Plasmodium falciparum
YCIEDIRMIHIKKIKEEKFLNHVKQ

SEQ ID NO: 3375008 - protein, 24 aa, Plasmodium falciparum
YCIYEICSRILLNIIKVNNKDDNF

SEQ ID NO: 3375009 - protein, 19 aa, Plasmodium falciparum
YCKNCHINVDLVHFNENKT

SEQ ID NO: 3375010 - protein, 19 aa, Plasmodium falciparum
YCLFCIIEGILNILNDDKM

SEQ ID NO: 3375011 - protein, 20 aa, Plasmodium falciparum
YCLLHYYDKILLHPGPSPLY

SEQ ID NO: 3375012 - protein, 28 aa, Plasmodium falciparum
YCLNRLPIQRYSIAIPIYSNAHVQIIAH

SEQ ID NO: 3375013 - protein, 23 aa, Plasmodium falciparum
YCLSIFKKINISTFFKDNEKRIF

SEQ ID NO: 3375014 - protein, 31 aa, Plasmodium falciparum
YCLSTYLYWLYLRRNTNIFLQNTLLIPTCMR

SEQ ID NO: 3375015 - protein, 21 aa, Plasmodium falciparum
YCLWICKSITGPSLYFEILDY

SEQ ID NO: 3375016 - protein, 20 aa, Plasmodium falciparum
YCMNDPRFLNSREKKFLDNI

SEQ ID NO: 3375017 - protein, 25 aa, Plasmodium falciparum
YCNDENINPVLYVWFAKDKGNYGFV

SEQ ID NO: 3375018 - protein, 25 aa, Plasmodium falciparum
YCNIYSSCWFYFITTHVHIYTMILQ

SEQ ID NO: 3375019 - protein, 27 aa, Plasmodium falciparum
YCNLHLDYWSCIYILVASENFFCELEV

SEQ ID NO: 3375020 - protein, 20 aa, Plasmodium falciparum
YCSILDKSIELMKKSDKVKE

SEQ ID NO: 3375021 - protein, 20 aa, Plasmodium falciparum
YCSIPQYFILTPQIIKNIVF

SEQ ID NO: 3375022 - protein, 27 aa, Plasmodium falciparum
YCTFAISPEEACEFGEPALYTPAQDIA

SEQ ID NO: 3375023 - protein, 20 aa, Plasmodium falciparum
YCTFCKKCDKNIVIQMPYAC

SEQ ID NO: 3375024 - protein, 17 aa, Plasmodium falciparum
YCTKNFIDRIISSVFKK

SEQ ID NO: 3375025 - protein, 20 aa, Plasmodium falciparum
YCTYRNNFSTHLSLLNYNFK

SEQ ID NO: 3375026 - protein, 17 aa, Plasmodium falciparum
YCVKLNMINNNHLKVLL

SEQ ID NO: 3375027 - protein, 24 aa, Plasmodium falciparum
YCYGTGMCTYGIYSDNKFLIKSNY

SEQ ID NO: 3375028 - protein, 17 aa, Plasmodium falciparum
YCYRHKINIKENIRSNN

SEQ ID NO: 3375029 - protein, 32 aa, Plasmodium falciparum
YDAMLKFLGDIQIKLSRSIRDEFPPEFFETHH

SEQ ID NO: 3375030 - protein, 18 aa, Plasmodium falciparum
YDASHLFLNNKEMLMNGD

SEQ ID NO: 3375031 - protein, 20 aa, Plasmodium falciparum
YDAYHIDIHKGILLHGPPGC

SEQ ID NO: 3375032 - protein, 17 aa, Plasmodium falciparum
YDCDEFIYDKNILSNDV

SEQ ID NO: 3375033 - protein, 20 aa, Plasmodium falciparum
YDCNVPFFLNSSICTKNVKF

SEQ ID NO: 3375034 - protein, 19 aa, Plasmodium falciparum
YDCSCIYMTFSNSKLEPVY

SEQ ID NO: 3375035 - protein, 18 aa, Plasmodium falciparum
YDCSGCGLSDGYYSTKGW

SEQ ID NO: 3375036 - protein, 19 aa, Plasmodium falciparum
YDDDLWKQFGVAVQKKAID

SEQ ID NO: 3375037 - protein, 22 aa, Plasmodium falciparum
YDDIICCLDNDIILIDTISDTY

SEQ ID NO: 3375038 - protein, 22 aa, Plasmodium falciparum
YDDIICMPGYIDFALSDIDLTN

SEQ ID NO: 3375039 - protein, 25 aa, Plasmodium falciparum
YDDPFLRKFINVHIENFFSFVASNF

SEQ ID NO: 3375040 - protein, 17 aa, Plasmodium falciparum
YDDSILCNNRGSINDEN

SEQ ID NO: 3375041 - protein, 22 aa, Plasmodium falciparum
YDDSYVKGRHRGNYLSSSLNNI

SEQ ID NO: 3375042 - protein, 25 aa, Plasmodium falciparum
YDEFDKFLFNYSVVLLNPFKKNDLL

SEQ ID NO: 3375043 - protein, 19 aa, Plasmodium falciparum
YDEKNVCALKNVTVENKEL

SEQ ID NO: 3375044 - protein, 29 aa, Plasmodium falciparum
YDENIGFRCFYNFILDYYETININDPYSM

SEQ ID NO: 3375045 - protein, 18 aa, Plasmodium falciparum
YDEPGIFQKSLKNIKIEK

SEQ ID NO: 3375046 - protein, 18 aa, Plasmodium falciparum
YDEQEWKPILLADLISRI

SEQ ID NO: 3375047 - protein, 19 aa, Plasmodium falciparum
YDETFLFNMEILFLYNFLK

SEQ ID NO: 3375048 - protein, 18 aa, Plasmodium falciparum
YDETMFHFHVESVGSIPP

SEQ ID NO: 3375049 - protein, 17 aa, Plasmodium falciparum
YDEVKVIENERLQNNEW

SEQ ID NO: 3375050 - protein, 22 aa, Plasmodium falciparum
YDFLALRTFLKRGILKSIGNQI

SEQ ID NO: 3375051 - protein, 19 aa, Plasmodium falciparum
YDFYLCLNKLNISITQELN

SEQ ID NO: 3375052 - protein, 26 aa, Plasmodium falciparum
YDGIKKGKCVVCLGTLELKDAAPSGL

SEQ ID NO: 3375053 - protein, 18 aa, Plasmodium falciparum
YDGLASSCFPNINNECTR

SEQ ID NO: 3375054 - protein, 20 aa, Plasmodium falciparum
YDGSGHRRKISVKQKNTIGQ

SEQ ID NO: 3375055 - protein, 17 aa, Plasmodium falciparum
YDGSRLGRPELLGRHLW

SEQ ID NO: 3375056 - protein, 20 aa, Plasmodium falciparum
YDHDISLNKINTLWLEEKEN

SEQ ID NO: 3375057 - protein, 28 aa, Plasmodium falciparum
YDHDLLCDEFRNKLMLIRTYISDEAYRI

SEQ ID NO: 3375058 - protein, 27 aa, Plasmodium falciparum
YDHMDVEGFHKLDIEQKIENNRNKTIK

SEQ ID NO: 3375059 - protein, 29 aa, Plasmodium falciparum
YDHPECIQIYLLDCIDILTLNLLEQKKIF

SEQ ID NO: 3375060 - protein, 25 aa, Plasmodium falciparum
YDIAKKIIDSACLLRNVEATSQNMR

SEQ ID NO: 3375061 - protein, 24 aa, Plasmodium falciparum
YDIDESKKVFLYAYEYQLKNEKIN

SEQ ID NO: 3375062 - protein, 31 aa, Plasmodium falciparum
YDIDFIFGLDLLKRHQCLIDFKQNALIIEDN

SEQ ID NO: 3375063 - protein, 18 aa, Plasmodium falciparum
YDIDILYYIYIKKYIEYC

SEQ ID NO: 3375064 - protein, 25 aa, Plasmodium falciparum
YDIILLRYSYEVIYFYKEKNTSIFS

SEQ ID NO: 3375065 - protein, 20 aa, Plasmodium falciparum
YDIKDYIKFDGIENIHNENL

SEQ ID NO: 3375066 - protein, 17 aa, Plasmodium falciparum
YDIKVFQHICSIIKSYF

SEQ ID NO: 3375067 - protein, 24 aa, Plasmodium falciparum
YDIKVSDIHLLYNCIREHQQQNNI

SEQ ID NO: 3375068 - protein, 20 aa, Plasmodium falciparum
YDILDIIKVYGRLAEHSKYE

SEQ ID NO: 3375069 - protein, 25 aa, Plasmodium falciparum
YDILRRKSIEKMNLRGANNPYPSSR

SEQ ID NO: 3375070 - protein, 21 aa, Plasmodium falciparum
YDINYCWSKPSTFQMKISYPS

SEQ ID NO: 3375071 - protein, 17 aa, Plasmodium falciparum
YDINYLQNKVCEVKILL

SEQ ID NO: 3375072 - protein, 22 aa, Plasmodium falciparum
YDIPEQFINYSSEFKDSYAEEH

SEQ ID NO: 3375073 - protein, 22 aa, Plasmodium falciparum
YDIQSTVLICSYECFRINNEFL

SEQ ID NO: 3375074 - protein, 17 aa, Plasmodium falciparum
YDIQYVISYIKKIVTNF

SEQ ID NO: 3375075 - protein, 18 aa, Plasmodium falciparum
YDIRKMSENCRGSKVYTP

SEQ ID NO: 3375076 - protein, 17 aa, Plasmodium falciparum
YDIRKRKLNAMSQRIEE

SEQ ID NO: 3375077 - protein, 29 aa, Plasmodium falciparum
YDIVTSKLYFFDILSVQWKEYNEDTFNDG

SEQ ID NO: 3375078 - protein, 20 aa, Plasmodium falciparum
YDIYSIYKPLTCYMPKAHSN

SEQ ID NO: 3375079 - protein, 17 aa, Plasmodium falciparum
YDKAHTFFNNIRNLHYF

SEQ ID NO: 3375080 - protein, 20 aa, Plasmodium falciparum
YDKAILCIDDIDIIFSSKDD

SEQ ID NO: 3375081 - protein, 19 aa, Plasmodium falciparum
YDKCYKYYKDDTHNIRNKD

SEQ ID NO: 3375082 - protein, 19 aa, Plasmodium falciparum
YDKDCAMSSEQFGYTYSSP

SEQ ID NO: 3375083 - protein, 23 aa, Plasmodium falciparum
YDKELKNREIHLMEKEKEYNKKL

SEQ ID NO: 3375084 - protein, 19 aa, Plasmodium falciparum
YDKGEKWINENVLKKVEGK

SEQ ID NO: 3375085 - protein, 20 aa, Plasmodium falciparum
YDKGRKFLSFNKCQYNKDSE

SEQ ID NO: 3375086 - protein, 18 aa, Plasmodium falciparum
YDKGSCLLTQSSEELNKN

SEQ ID NO: 3375087 - protein, 24 aa, Plasmodium falciparum
YDKHFKNFFLLLTEYVNNNIDEYA

SEQ ID NO: 3375088 - protein, 17 aa, Plasmodium falciparum
YDKHIYDKYNFNNLGYK

SEQ ID NO: 3375089 - protein, 20 aa, Plasmodium falciparum
YDKITQILICYMKANIRNKQ

SEQ ID NO: 3375090 - protein, 24 aa, Plasmodium falciparum
YDKKCDIWSSGVIMYTLLCGYPPF

SEQ ID NO: 3375091 - protein, 31 aa, Plasmodium falciparum
YDKKKYIIENIKKFNYNISEMEMNSILENLD

SEQ ID NO: 3375092 - protein, 23 aa, Plasmodium falciparum
YDKKNCYNLAAFSYYEHQVYIRK

SEQ ID NO: 3375093 - protein, 24 aa, Plasmodium falciparum
YDKLKKSCVMCMQKDNGKNCWKHN

SEQ ID NO: 3375094 - protein, 19 aa, Plasmodium falciparum
YDKNFLKYINICYDSLEVN

SEQ ID NO: 3375095 - protein, 25 aa, Plasmodium falciparum
YDKYFKKRLFDFVRYENNMGIRKIP

SEQ ID NO: 3375096 - protein, 32 aa, Plasmodium falciparum
YDLFCNIDKVHLIKCPILFIHGKKDKLLSYHG

SEQ ID NO: 3375097 - protein, 17 aa, Plasmodium falciparum
YDLFDYIKIDIYFNYIF

SEQ ID NO: 3375098 - protein, 19 aa, Plasmodium falciparum
YDLFKKRKLENTYRNTYKK

SEQ ID NO: 3375099 - protein, 24 aa, Plasmodium falciparum
YDLKGKCLKLVHIFNDEIWKLGPQ

SEQ ID NO: 3375100 - protein, 22 aa, Plasmodium falciparum
YDLKSAQSLVSFNKLLNKEYIS

SEQ ID NO: 3375101 - protein, 26 aa, Plasmodium falciparum
YDLLKKRKFRFSHFIERTNDNFKKQV

SEQ ID NO: 3375102 - protein, 23 aa, Plasmodium falciparum
YDLPKKGFSLIWSLKKSRRNSPL

SEQ ID NO: 3375103 - protein, 24 aa, Plasmodium falciparum
YDLTSIGCAFIHFENIESATKARK

SEQ ID NO: 3375104 - protein, 31 aa, Plasmodium falciparum
YDMLFSPLTPWPCLSFDYILEHPKHDALSEE

SEQ ID NO: 3375105 - protein, 37 aa, Plasmodium falciparum
YDMNNVLFGYFLNKLHCDNCYYGSGENFLFTFKNNKL

SEQ ID NO: 3375106 - protein, 17 aa, Plasmodium falciparum
YDMPWVSIYYDFFLNSI

SEQ ID NO: 3375107 - protein, 17 aa, Plasmodium falciparum
YDNFDKYQVLKDHTSNS

SEQ ID NO: 3375108 - protein, 18 aa, Plasmodium falciparum
YDNLPWCTVIGSSNYGYR

SEQ ID NO: 3375109 - protein, 32 aa, Plasmodium falciparum
YDNNMLNYFFYIKYIISYSPWNIFKDYVNTSN

SEQ ID NO: 3375110 - protein, 25 aa, Plasmodium falciparum
YDNTIECYKFSFSYNNKNGDEIDIS

SEQ ID NO: 3375111 - protein, 25 aa, Plasmodium falciparum
YDNVISAQHAIQFMNGYFVNNKYLK

SEQ ID NO: 3375112 - protein, 18 aa, Plasmodium falciparum
YDNYCNYFYESVESVNVS

SEQ ID NO: 3375113 - protein, 23 aa, Plasmodium falciparum
YDPIERRKLCLLGERGDYKQLNN

SEQ ID NO: 3375114 - protein, 22 aa, Plasmodium falciparum
YDPIKVLYPFKIYEKKINVHYC

SEQ ID NO: 3375115 - protein, 17 aa, Plasmodium falciparum
YDPRILIFTCIVLAIKI

SEQ ID NO: 3375116 - protein, 23 aa, Plasmodium falciparum
YDPRIYGTIWGFWKYPEKIWEVI

SEQ ID NO: 3375117 - protein, 23 aa, Plasmodium falciparum
YDPYKCKLLLLTRQNCNSNISSN

SEQ ID NO: 3375118 - protein, 18 aa, Plasmodium falciparum
YDQGFPLNLPDPYINKQV

SEQ ID NO: 3375119 - protein, 19 aa, Plasmodium falciparum
YDQRVGVNIIKDACKAPIK

SEQ ID NO: 3375120 - protein, 34 aa, Plasmodium falciparum
YDRKQKIWVSHWRANCKTIHKYFSVKKYGFEKAR

SEQ ID NO: 3375121 - protein, 21 aa, Plasmodium falciparum
YDSDEPILIRSNLKNKINIQT

SEQ ID NO: 3375122 - protein, 19 aa, Plasmodium falciparum
YDSDVIIMYDHFFQLPQNF

SEQ ID NO: 3375123 - protein, 20 aa, Plasmodium falciparum
YDSEKKCILPECEKIEKCEK

SEQ ID NO: 3375124 - protein, 20 aa, Plasmodium falciparum
YDSLKKSGMNINMLSCDEKL

SEQ ID NO: 3375125 - protein, 24 aa, Plasmodium falciparum
YDSPYWKEKCFALTSESIIDQAIN

SEQ ID NO: 3375126 - protein, 17 aa, Plasmodium falciparum
YDSSLKYVKNANNLNKT

SEQ ID NO: 3375127 - protein, 18 aa, Plasmodium falciparum
YDTFTFLGAQTVTKSVIK

SEQ ID NO: 3375128 - protein, 18 aa, Plasmodium falciparum
YDTVLNKKVIKWRSQKKG

SEQ ID NO: 3375129 - protein, 19 aa, Plasmodium falciparum
YDVDKNMSKGFAFCEYKDV

SEQ ID NO: 3375130 - protein, 20 aa, Plasmodium falciparum
YDVIHMFSFSLYYTETILNT

SEQ ID NO: 3375131 - protein, 25 aa, Plasmodium falciparum
YDVKWSPSLSTCFFVISSNGTGKLH

SEQ ID NO: 3375132 - protein, 21 aa, Plasmodium falciparum
YDVYISKLIFVMVNIYNEHSM

SEQ ID NO: 3375133 - protein, 25 aa, Plasmodium falciparum
YDVYYEGFIPFFRPILNLKSKKNQD

SEQ ID NO: 3375134 - protein, 22 aa, Plasmodium falciparum
YDWNNILICFENSDRIYLASSY

SEQ ID NO: 3375135 - protein, 21 aa, Plasmodium falciparum
YDWTHFSIVETINFEDDLKNL

SEQ ID NO: 3375136 - protein, 21 aa, Plasmodium falciparum
YDYICAFLSCFVYDESTSKEI

SEQ ID NO: 3375137 - protein, 18 aa, Plasmodium falciparum
YDYKKMISEISLFNNNIK

SEQ ID NO: 3375138 - protein, 17 aa, Plasmodium falciparum
YDYLGLMVCHISFPEFF

SEQ ID NO: 3375139 - protein, 21 aa, Plasmodium falciparum
YDYTKIYSFYIPNFYYTDNHN

SEQ ID NO: 3375140 - protein, 17 aa, Plasmodium falciparum
YDYYNYYCSGLIPTYPI

SEQ ID NO: 3375141 - protein, 25 aa, Plasmodium falciparum
YEADAQLSYLCRMGFISCAISEDSD

SEQ ID NO: 3375142 - protein, 18 aa, Plasmodium falciparum
YEALNYIMIRNFAEASKI

SEQ ID NO: 3375143 - protein, 20 aa, Plasmodium falciparum
YECEDYISGFKRPSKENSNS

SEQ ID NO: 3375144 - protein, 24 aa, Plasmodium falciparum
YECISRKHCLFLLEVLMKKINKPT

SEQ ID NO: 3375145 - protein, 17 aa, Plasmodium falciparum
YEDIQLDVQGCNNIYES

SEQ ID NO: 3375146 - protein, 23 aa, Plasmodium falciparum
YEDTDLYLLSIVKYVLLENEKKN

SEQ ID NO: 3375147 - protein, 23 aa, Plasmodium falciparum
YEDVLSLPSCHYLNWVNMSNFGV

SEQ ID NO: 3375148 - protein, 18 aa, Plasmodium falciparum
YEEALAVEKLFFLSSRER

SEQ ID NO: 3375149 - protein, 23 aa, Plasmodium falciparum
YEEDFLCFFKKNNATSIIYLKYI

SEQ ID NO: 3375150 - protein, 17 aa, Plasmodium falciparum
YEEEKKNLIGLLIENNF

SEQ ID NO: 3375151 - protein, 27 aa, Plasmodium falciparum
YEEKIKFLYSFGRHAANIFFINNKQES

SEQ ID NO: 3375152 - protein, 23 aa, Plasmodium falciparum
YEEKKKKSIRVIKNVENKSYELD

SEQ ID NO: 3375153 - protein, 17 aa, Plasmodium falciparum
YEEKYAFINNEKREKPL

SEQ ID NO: 3375154 - protein, 31 aa, Plasmodium falciparum
YEELIPLLLEKLHSFFNCIVELRHYRFWSSS

SEQ ID NO: 3375155 - protein, 21 aa, Plasmodium falciparum
YEELKLKYIMDMKYIQSNKNE

SEQ ID NO: 3375156 - protein, 18 aa, Plasmodium falciparum
YEELRKNYNYNYNYEDID

SEQ ID NO: 3375157 - protein, 26 aa, Plasmodium falciparum
YEEMINKFFRCIGIWNDRNVYSKIVC

SEQ ID NO: 3375158 - protein, 19 aa, Plasmodium falciparum
YEEMKYDILRIERNINSEV

SEQ ID NO: 3375159 - protein, 35 aa, Plasmodium falciparum
YEENICIYCFKYAKCVKSLQAHMICKSHTKLHTNF

SEQ ID NO: 3375160 - protein, 21 aa, Plasmodium falciparum
YEENRAYLFIEEIFNTLENQN

SEQ ID NO: 3375161 - protein, 22 aa, Plasmodium falciparum
YEEPYILPCVLNSADYVYPSTL

SEQ ID NO: 3375162 - protein, 24 aa, Plasmodium falciparum
YEERHFSCYFLYMVNKSILDELVN

SEQ ID NO: 3375163 - protein, 34 aa, Plasmodium falciparum
YEESKKSYKSCIVWYMNHYQRFGGSIRRYSNALG

SEQ ID NO: 3375164 - protein, 18 aa, Plasmodium falciparum
YEEVRKFNKLKIFERSYG

SEQ ID NO: 3375165 - protein, 18 aa, Plasmodium falciparum
YEEYKKKVTSLINETNYN

SEQ ID NO: 3375166 - protein, 19 aa, Plasmodium falciparum
YEEYLAVPIIKGIKSEGEK

SEQ ID NO: 3375167 - protein, 25 aa, Plasmodium falciparum
YEFISLKIRIETIIEQIKKNLQINY

SEQ ID NO: 3375168 - protein, 19 aa, Plasmodium falciparum
YEFLCDKCSYRSKHKKKIG

SEQ ID NO: 3375169 - protein, 24 aa, Plasmodium falciparum
YEFSCKSEGGLSNDIYNNEKDILD

SEQ ID NO: 3375170 - protein, 19 aa, Plasmodium falciparum
YEFTLNFLKPINVEESKYS

SEQ ID NO: 3375171 - protein, 18 aa, Plasmodium falciparum
YEGCKGNNSISCHKEYRN

SEQ ID NO: 3375172 - protein, 29 aa, Plasmodium falciparum
YEGDILFIPSLWLHYVYNMPPHTYMKRKY

SEQ ID NO: 3375173 - protein, 18 aa, Plasmodium falciparum
YEGIKFFYTKDELIRVRI

SEQ ID NO: 3375174 - protein, 26 aa, Plasmodium falciparum
YEGNLYKYALTVIVNVPYWLKPSISK

SEQ ID NO: 3375175 - protein, 18 aa, Plasmodium falciparum
YEGTKMYCHCHNINNKNL

SEQ ID NO: 3375176 - protein, 23 aa, Plasmodium falciparum
YEHFPWYKRLYYIMKDYIYNILK

SEQ ID NO: 3375177 - protein, 23 aa, Plasmodium falciparum
YEHIKRLCDYTEINLYIKNNNKK

SEQ ID NO: 3375178 - protein, 18 aa, Plasmodium falciparum
YEHIPIHIMEHLDKNATK

SEQ ID NO: 3375179 - protein, 24 aa, Plasmodium falciparum
YEHYIQYPILLLFKNTEKIKKNFL

SEQ ID NO: 3375180 - protein, 23 aa, Plasmodium falciparum
YEIDHLWAYIEWHYNFEDEIRLQ

SEQ ID NO: 3375181 - protein, 20 aa, Plasmodium falciparum
YEIEEIKKDISIACIEQELC

SEQ ID NO: 3375182 - protein, 24 aa, Plasmodium falciparum
YEIKGRKLKVFWANEEYKDKYGHP

SEQ ID NO: 3375183 - protein, 17 aa, Plasmodium falciparum
YEIKLKLIYNNNNNNNN

SEQ ID NO: 3375184 - protein, 22 aa, Plasmodium falciparum
YEILKLKGPNSVLYNTQIDKHI

SEQ ID NO: 3375185 - protein, 20 aa, Plasmodium falciparum
YEIPEVIAVPIEYGSKDYLD

SEQ ID NO: 3375186 - protein, 17 aa, Plasmodium falciparum
YEIVAVIEFNRVMKLKK

SEQ ID NO: 3375187 - protein, 17 aa, Plasmodium falciparum
YEKCKFKVHPYWVVDGK

SEQ ID NO: 3375188 - protein, 25 aa, Plasmodium falciparum
YEKDKLVCILKYFYVNKLTGAFSLT

SEQ ID NO: 3375189 - protein, 19 aa, Plasmodium falciparum
YEKDVECSLYLINKTNYNK

SEQ ID NO: 3375190 - protein, 20 aa, Plasmodium falciparum
YEKEHEPLWVINASNEEKKS

SEQ ID NO: 3375191 - protein, 22 aa, Plasmodium falciparum
YEKELKEKNEIIIKLKKNMSPD

SEQ ID NO: 3375192 - protein, 17 aa, Plasmodium falciparum
YEKFYCIKTNLYHLYLS

SEQ ID NO: 3375193 - protein, 21 aa, Plasmodium falciparum
YEKGKGICIHGCHDQNVCNND

SEQ ID NO: 3375194 - protein, 19 aa, Plasmodium falciparum
YEKIIKRLKEELEENQIDK

SEQ ID NO: 3375195 - protein, 27 aa, Plasmodium falciparum
YEKIKELKSNVFIKEYKNSEKFVKKKI

SEQ ID NO: 3375196 - protein, 20 aa, Plasmodium falciparum
YEKKSLYGMENISSKDNINN

SEQ ID NO: 3375197 - protein, 20 aa, Plasmodium falciparum
YEKKVRCIRTNNSHLRGKLK

SEQ ID NO: 3375198 - protein, 25 aa, Plasmodium falciparum
YEKKWKRNPCLLLIIATTNNINNID

SEQ ID NO: 3375199 - protein, 18 aa, Plasmodium falciparum
YEKLEFQQKDNLMVNRNI

SEQ ID NO: 3375200 - protein, 18 aa, Plasmodium falciparum
YEKLRKALLNAYPKKKIV

SEQ ID NO: 3375201 - protein, 21 aa, Plasmodium falciparum
YEKRFPFLIDSVVKNPEQTRD

SEQ ID NO: 3375202 - protein, 21 aa, Plasmodium falciparum
YEKRKYKLMEKKFFPNNQQNE

SEQ ID NO: 3375203 - protein, 17 aa, Plasmodium falciparum
YEKRLKNQITFSSVKYI

SEQ ID NO: 3375204 - protein, 27 aa, Plasmodium falciparum
YEKSCKLNNFIPLIGVELGKTKFQREF

SEQ ID NO: 3375205 - protein, 27 aa, Plasmodium falciparum
YELDFLCLAVLIYEMCTKYNSYYSNKF

SEQ ID NO: 3375206 - protein, 35 aa, Plasmodium falciparum
YELDQSWYKTFIKIRKLRCRLKRLSKANNIHMDIF

SEQ ID NO: 3375207 - protein, 17 aa, Plasmodium falciparum
YELFIQNELEYMELQTK

SEQ ID NO: 3375208 - protein, 18 aa, Plasmodium falciparum
YELISVITHKGRNEESGH

SEQ ID NO: 3375209 - protein, 26 aa, Plasmodium falciparum
YELKGGRFSSTFWKVVYIQLLLSWKS

SEQ ID NO: 3375210 - protein, 17 aa, Plasmodium falciparum
YELLCDVDKNLLKLLGL

SEQ ID NO: 3375211 - protein, 18 aa, Plasmodium falciparum
YELRPSIEEALSYPIFNY

SEQ ID NO: 3375212 - protein, 18 aa, Plasmodium falciparum
YELTPEHDGMLSIQDDGE

SEQ ID NO: 3375213 - protein, 21 aa, Plasmodium falciparum
YELYDPVSVMFFYRNKHMMID

SEQ ID NO: 3375214 - protein, 24 aa, Plasmodium falciparum
YEMPTTGIVYLQFVFSLDHLTVDE

SEQ ID NO: 3375215 - protein, 18 aa, Plasmodium falciparum
YENCSYTYSTISKMKYHL

SEQ ID NO: 3375216 - protein, 18 aa, Plasmodium falciparum
YENCYEPIYDLSFKNQYT

SEQ ID NO: 3375217 - protein, 26 aa, Plasmodium falciparum
YENFRCPICMLILFKPVKTKCGHIFC

SEQ ID NO: 3375218 - protein, 17 aa, Plasmodium falciparum
YENGEYIFNDYLYLSYG

SEQ ID NO: 3375219 - protein, 24 aa, Plasmodium falciparum
YENGSGCMNILIGKNEHSKENKEN

SEQ ID NO: 3375220 - protein, 18 aa, Plasmodium falciparum
YENIRIEPPFYFTKDTFN

SEQ ID NO: 3375221 - protein, 19 aa, Plasmodium falciparum
YENKEILEKWNIEKETKEK

SEQ ID NO: 3375222 - protein, 17 aa, Plasmodium falciparum
YENKYYMIVGFNNGESC

SEQ ID NO: 3375223 - protein, 17 aa, Plasmodium falciparum
YENLWNLIKEKVKNNEY

SEQ ID NO: 3375224 - protein, 35 aa, Plasmodium falciparum
YENNLKNGWGYYKWSRKGSTYEGNWIDNKMNGKGL

SEQ ID NO: 3375225 - protein, 26 aa, Plasmodium falciparum
YEPLVAFRGDVNYNYDLEEKFNDMID

SEQ ID NO: 3375226 - protein, 18 aa, Plasmodium falciparum
YEQDLMKEFLFKVYNFKN

SEQ ID NO: 3375227 - protein, 22 aa, Plasmodium falciparum
YEQEFYKMLISIRGTKSANKFM

SEQ ID NO: 3375228 - protein, 25 aa, Plasmodium falciparum
YEQIKIRLNNFWQLNIKDVNNLLII

SEQ ID NO: 3375229 - protein, 25 aa, Plasmodium falciparum
YEQLEALKFPGLVIYVNKDNIEKYQ

SEQ ID NO: 3375230 - protein, 18 aa, Plasmodium falciparum
YEQLKEKYLHSKKDLHDH

SEQ ID NO: 3375231 - protein, 17 aa, Plasmodium falciparum
YEQVLSYHTLDEDKKKN

SEQ ID NO: 3375232 - protein, 18 aa, Plasmodium falciparum
YERLLKLENKFHIKAWIN

SEQ ID NO: 3375233 - protein, 19 aa, Plasmodium falciparum
YERWIKFKIDESSFLCYIY

SEQ ID NO: 3375234 - protein, 34 aa, Plasmodium falciparum
YESENFYKKCFKIKCLYNYYYILKDDINVEIKNE

SEQ ID NO: 3375235 - protein, 18 aa, Plasmodium falciparum
YESFIKQHFFGLDNILEM

SEQ ID NO: 3375236 - protein, 22 aa, Plasmodium falciparum
YESGKKYPLVVKIGTITKDGEA

SEQ ID NO: 3375237 - protein, 17 aa, Plasmodium falciparum
YESKFEYELFLLRQKYH

SEQ ID NO: 3375238 - protein, 21 aa, Plasmodium falciparum
YESLKRKREILYIKLNNNLYE

SEQ ID NO: 3375239 - protein, 20 aa, Plasmodium falciparum
YESVCRLCDGFNGADLRNVC

SEQ ID NO: 3375240 - protein, 24 aa, Plasmodium falciparum
YESYNLLCPYNLFYNKFKNQGNTN

SEQ ID NO: 3375241 - protein, 17 aa, Plasmodium falciparum
YETAGKMNLSELETPLN

SEQ ID NO: 3375242 - protein, 17 aa, Plasmodium falciparum
YETALLCLEQAQKNNYK

SEQ ID NO: 3375243 - protein, 18 aa, Plasmodium falciparum
YETCFKAANVYKCGNVYR

SEQ ID NO: 3375244 - protein, 23 aa, Plasmodium falciparum
YETYCVNYLASVFFQKNTSTNSF

SEQ ID NO: 3375245 - protein, 26 aa, Plasmodium falciparum
YEVKGRGELQLGILIEKLRREGYEMT

SEQ ID NO: 3375246 - protein, 34 aa, Plasmodium falciparum
YEVQIDPFNGFDIAKRIIGLKGTNMKKICIDTDC

SEQ ID NO: 3375247 - protein, 29 aa, Plasmodium falciparum
YEYEIKLYYLFKLYHYFKKKEKFKEDLLL

SEQ ID NO: 3375248 - protein, 18 aa, Plasmodium falciparum
YEYGSFIMMGFLNDNNSP

SEQ ID NO: 3375249 - protein, 20 aa, Plasmodium falciparum
YEYLKSSPFVGPFGTIENPV

SEQ ID NO: 3375250 - protein, 36 aa, Plasmodium falciparum
YEYLLEYDNALLIYKNMCLKCNIKPDEKEEKLKAQI

SEQ ID NO: 3375251 - protein, 32 aa, Plasmodium falciparum
YEYTKEDYPLLPRLVTNFISAVELYDKNHMLY

SEQ ID NO: 3375252 - protein, 18 aa, Plasmodium falciparum
YEYYIKNLFFDILKIENI

SEQ ID NO: 3375253 - protein, 21 aa, Plasmodium falciparum
YEYYYEQFLFILNKIILNISS

SEQ ID NO: 3375254 - protein, 18 aa, Plasmodium falciparum
YFCHSCEDVKRTSDVEII

SEQ ID NO: 3375255 - protein, 19 aa, Plasmodium falciparum
YFDHSFRPVQIEQHYIGIK

SEQ ID NO: 3375256 - protein, 26 aa, Plasmodium falciparum
YFDLKRRKNIFLSFSYEERNFSSNDI

SEQ ID NO: 3375257 - protein, 23 aa, Plasmodium falciparum
YFECPKNDSIYEFLFNHNFHVHK

SEQ ID NO: 3375258 - protein, 22 aa, Plasmodium falciparum
YFEDKTRLFLILELANGGSVRN

SEQ ID NO: 3375259 - protein, 23 aa, Plasmodium falciparum
YFEHMKKKLAVESYFPHERFEEK

SEQ ID NO: 3375260 - protein, 24 aa, Plasmodium falciparum
YFEKLKRATCYYVTKFTNEKKKKL

SEQ ID NO: 3375261 - protein, 27 aa, Plasmodium falciparum
YFEKNCSRNNKVISCHNYNCTKNIKSK

SEQ ID NO: 3375262 - protein, 26 aa, Plasmodium falciparum
YFFKYTHGLKGISIYNANRLDKHSMN

SEQ ID NO: 3375263 - protein, 17 aa, Plasmodium falciparum
YFFNDITLIRFLDTYNY

SEQ ID NO: 3375264 - protein, 17 aa, Plasmodium falciparum
YFFNTANILKTMFSYFG

SEQ ID NO: 3375265 - protein, 22 aa, Plasmodium falciparum
YFFPKYKLIIHPTLLNVNEQNN

SEQ ID NO: 3375266 - protein, 25 aa, Plasmodium falciparum
YFFPTFRPSPNLNFEKFPYINDIIN

SEQ ID NO: 3375267 - protein, 17 aa, Plasmodium falciparum
YFFYDLINEYEIYINHA

SEQ ID NO: 3375268 - protein, 19 aa, Plasmodium falciparum
YFHFMKWDKENFIVQKDKR

SEQ ID NO: 3375269 - protein, 34 aa, Plasmodium falciparum
YFHHIKEKPPDITFNPDVINMCLNNLYNEQLVNK

SEQ ID NO: 3375270 - protein, 26 aa, Plasmodium falciparum
YFHTKWNFKNSLHLLSYKENVSFKQC

SEQ ID NO: 3375271 - protein, 19 aa, Plasmodium falciparum
YFICSNLNMMDSLKETHDK

SEQ ID NO: 3375272 - protein, 17 aa, Plasmodium falciparum
YFIIPFFTSYGKFLIII

SEQ ID NO: 3375273 - protein, 21 aa, Plasmodium falciparum
YFILENGLLRYSLDKYSPTKE

SEQ ID NO: 3375274 - protein, 25 aa, Plasmodium falciparum
YFIPIIGIAPEWCNFLDSITEELEE

SEQ ID NO: 3375275 - protein, 24 aa, Plasmodium falciparum
YFIYKGLISYKCIYTIPIFINNTS

SEQ ID NO: 3375276 - protein, 19 aa, Plasmodium falciparum
YFKELRSNMSKIYKTLIKF

SEQ ID NO: 3375277 - protein, 31 aa, Plasmodium falciparum
YFKKELKGPYIKKMYEPFEMNKPHIKTIFSP

SEQ ID NO: 3375278 - protein, 24 aa, Plasmodium falciparum
YFKNDLKFPLSYYVEAQNLNQLIL

SEQ ID NO: 3375279 - protein, 25 aa, Plasmodium falciparum
YFKNHKTKIIIYLRFVKNKYQNIIK

SEQ ID NO: 3375280 - protein, 18 aa, Plasmodium falciparum
YFKNIGFLKDYRRLNVAV

SEQ ID NO: 3375281 - protein, 26 aa, Plasmodium falciparum
YFKNVLIHSFECEFCNYKNNVIQDLN

SEQ ID NO: 3375282 - protein, 19 aa, Plasmodium falciparum
YFKSLKINTLYIIEDIGAR

SEQ ID NO: 3375283 - protein, 20 aa, Plasmodium falciparum
YFLCSCKILSHTIEKKEEFI

SEQ ID NO: 3375284 - protein, 18 aa, Plasmodium falciparum
YFLEKSWSLMHIPPNMKN

SEQ ID NO: 3375285 - protein, 19 aa, Plasmodium falciparum
YFLFIKWATIKNSFIYSSY

SEQ ID NO: 3375286 - protein, 17 aa, Plasmodium falciparum
YFLFNKKMECFLGDNFY

SEQ ID NO: 3375287 - protein, 18 aa, Plasmodium falciparum
YFLHMAFTLDNEYLFKVI

SEQ ID NO: 3375288 - protein, 18 aa, Plasmodium falciparum
YFLIPSLLLSLANLNIYD

SEQ ID NO: 3375289 - protein, 17 aa, Plasmodium falciparum
YFLKKGDNVSCYYDRYR

SEQ ID NO: 3375290 - protein, 19 aa, Plasmodium falciparum
YFLKLCSHFSYLSEASYDK

SEQ ID NO: 3375291 - protein, 22 aa, Plasmodium falciparum
YFLKPLYVDVDMYREEYKGETM

SEQ ID NO: 3375292 - protein, 28 aa, Plasmodium falciparum
YFLNIYVFTCFINFCIHYKNISICKADD

SEQ ID NO: 3375293 - protein, 19 aa, Plasmodium falciparum
YFLNYYTKHIFRFDLPNNI

SEQ ID NO: 3375294 - protein, 26 aa, Plasmodium falciparum
YFLSNKEILEILGMYKNPFLLKNKIQ

SEQ ID NO: 3375295 - protein, 18 aa, Plasmodium falciparum
YFMKKRKIFINNMKGLQF

SEQ ID NO: 3375296 - protein, 19 aa, Plasmodium falciparum
YFMRECLSLMNLDTDGYNH

SEQ ID NO: 3375297 - protein, 19 aa, Plasmodium falciparum
YFNECKYVKEIKNIDQDNT

SEQ ID NO: 3375298 - protein, 18 aa, Plasmodium falciparum
YFNEGVLFFHNSKKTNNY

SEQ ID NO: 3375299 - protein, 23 aa, Plasmodium falciparum
YFNEIKIGVSFEMFLYDIDFSET

SEQ ID NO: 3375300 - protein, 27 aa, Plasmodium falciparum
YFNFTLNNFNYFECFYNDIYGDHFNDQ

SEQ ID NO: 3375301 - protein, 20 aa, Plasmodium falciparum
YFNKKKFKLIQKYPIHKTII

SEQ ID NO: 3375302 - protein, 22 aa, Plasmodium falciparum
YFNNMYKYIFKKYIDLSTNYWG

SEQ ID NO: 3375303 - protein, 24 aa, Plasmodium falciparum
YFNNNIKPLFLLQQAKCLRTKKKK

SEQ ID NO: 3375304 - protein, 22 aa, Plasmodium falciparum
YFNRPRNIIEFIIDELKILETK

SEQ ID NO: 3375305 - protein, 25 aa, Plasmodium falciparum
YFPDLFHNVYFLCAHYTILNKEINE

SEQ ID NO: 3375306 - protein, 29 aa, Plasmodium falciparum
YFRIYCENLCFLSKLFLDHKTLKHRVNLF

SEQ ID NO: 3375307 - protein, 22 aa, Plasmodium falciparum
YFRKHSNCYIQVPPVLNLLRGD

SEQ ID NO: 3375308 - protein, 21 aa, Plasmodium falciparum
YFRQIKKYDYLIFDEAHFLKN

SEQ ID NO: 3375309 - protein, 17 aa, Plasmodium falciparum
YFRSTKKNFIFPSFSTI

SEQ ID NO: 3375310 - protein, 23 aa, Plasmodium falciparum
YFSEKKFLMKNFKNVKYNFKKSH

SEQ ID NO: 3375311 - protein, 19 aa, Plasmodium falciparum
YFSKDGFKISIEDHNVDIF

SEQ ID NO: 3375312 - protein, 20 aa, Plasmodium falciparum
YFTACDNIQLSILLIKKILI

SEQ ID NO: 3375313 - protein, 20 aa, Plasmodium falciparum
YFTNEWKFNKSNFICGLNGS

SEQ ID NO: 3375314 - protein, 19 aa, Plasmodium falciparum
YFVHFKKPGILFMSLKCYK

SEQ ID NO: 3375315 - protein, 26 aa, Plasmodium falciparum
YFVKCIGHIIGIEFIDKEYLIIESNH

SEQ ID NO: 3375316 - protein, 22 aa, Plasmodium falciparum
YFVNRYSPIISINKHPIYPLLL

SEQ ID NO: 3375317 - protein, 20 aa, Plasmodium falciparum
YFWGSRAWLEPKAITLNPLY

SEQ ID NO: 3375318 - protein, 21 aa, Plasmodium falciparum
YFYEEFSPFYLFHEQPKNSIE

SEQ ID NO: 3375319 - protein, 17 aa, Plasmodium falciparum
YFYEFIKYTKISLSSKH

SEQ ID NO: 3375320 - protein, 24 aa, Plasmodium falciparum
YFYFKLFLNNIGKFFYPELTERES

SEQ ID NO: 3375321 - protein, 24 aa, Plasmodium falciparum
YFYFPVYLKTFFFKCRNVKLHIQD

SEQ ID NO: 3375322 - protein, 27 aa, Plasmodium falciparum
YFYFYELKLKILLFFIHKNDNQKESKK

SEQ ID NO: 3375323 - protein, 18 aa, Plasmodium falciparum
YFYILREIIDLDPKSEEK

SEQ ID NO: 3375324 - protein, 18 aa, Plasmodium falciparum
YFYKDWNDEIESEFYSEE

SEQ ID NO: 3375325 - protein, 25 aa, Plasmodium falciparum
YFYLIRELKIVASMLNIAILIFDVA

SEQ ID NO: 3375326 - protein, 20 aa, Plasmodium falciparum
YGAKLTIPGVLRFDNNIDVN

SEQ ID NO: 3375327 - protein, 17 aa, Plasmodium falciparum
YGATVGFFPVDDITLEY

SEQ ID NO: 3375328 - protein, 19 aa, Plasmodium falciparum
YGCGSSRDWAAKGPNLLGV

SEQ ID NO: 3375329 - protein, 24 aa, Plasmodium falciparum
YGDAQRGNAFGFKLSTLSKLNDIR

SEQ ID NO: 3375330 - protein, 20 aa, Plasmodium falciparum
YGDIKRTCWLYRSKRITHIK

SEQ ID NO: 3375331 - protein, 19 aa, Plasmodium falciparum
YGDILKYIYLDNIYIDIIK

SEQ ID NO: 3375332 - protein, 17 aa, Plasmodium falciparum
YGDLFILSFLPKKKNKD

SEQ ID NO: 3375333 - protein, 17 aa, Plasmodium falciparum
YGDVGKGCASSMKGLGA

SEQ ID NO: 3375334 - protein, 22 aa, Plasmodium falciparum
YGECAWRLVHLIIERLENEEIL

SEQ ID NO: 3375335 - protein, 17 aa, Plasmodium falciparum
YGEVEWEGYKFELVDTG

SEQ ID NO: 3375336 - protein, 18 aa, Plasmodium falciparum
YGFMNGVGILRKKRSLNF

SEQ ID NO: 3375337 - protein, 18 aa, Plasmodium falciparum
YGGFLIFHLRKNYILTPI

SEQ ID NO: 3375338 - protein, 21 aa, Plasmodium falciparum
YGGGVGRRLCMPNYSGSSDSI

SEQ ID NO: 3375339 - protein, 29 aa, Plasmodium falciparum
YGHFLKKECKILRINYCLEQNIENNVSND

SEQ ID NO: 3375340 - protein, 17 aa, Plasmodium falciparum
YGIKFIHLTNEWFKLYK

SEQ ID NO: 3375341 - protein, 27 aa, Plasmodium falciparum
YGIPRDIEYEKCPKCKGKKKEHTIKYN

SEQ ID NO: 3375342 - protein, 17 aa, Plasmodium falciparum
YGIQREEESIIPNSYNR

SEQ ID NO: 3375343 - protein, 19 aa, Plasmodium falciparum
YGKCQECKNEIIFKTDPKN

SEQ ID NO: 3375344 - protein, 22 aa, Plasmodium falciparum
YGKEVLRKGFSITDEEKINVLY

SEQ ID NO: 3375345 - protein, 21 aa, Plasmodium falciparum
YGKGRISCNTFIYTEGCIKPT

SEQ ID NO: 3375346 - protein, 22 aa, Plasmodium falciparum
YGKIHKKKSLFKYELNNTHLST

SEQ ID NO: 3375347 - protein, 25 aa, Plasmodium falciparum
YGKIKKRLTCFNENLEIKYNFLNIY

SEQ ID NO: 3375348 - protein, 29 aa, Plasmodium falciparum
YGKLKTWDLKCVIIKGGDDLRQELLASQL

SEQ ID NO: 3375349 - protein, 43 aa, Plasmodium falciparum
YGKQKAKKGMRFLSFPNICIFLLKRFTFDLQRMETVKLNNRFE

SEQ ID NO: 3375350 - protein, 20 aa, Plasmodium falciparum
YGKTFPYEKDELIIENMPSG

SEQ ID NO: 3375351 - protein, 17 aa, Plasmodium falciparum
YGKVCLMQVYVEKKNMN

SEQ ID NO: 3375352 - protein, 20 aa, Plasmodium falciparum
YGLCLYNCIHNIIIPNIQNI

SEQ ID NO: 3375353 - protein, 17 aa, Plasmodium falciparum
YGLLLRQYIISHLIKLQ

SEQ ID NO: 3375354 - protein, 22 aa, Plasmodium falciparum
YGLNSRPVYWLIEKQNQKKLQK

SEQ ID NO: 3375355 - protein, 17 aa, Plasmodium falciparum
YGLPKCDGSLYFIDGIL

SEQ ID NO: 3375356 - protein, 30 aa, Plasmodium falciparum
YGNDIARLLGMKFKMPFFVSVNVDECDENL

SEQ ID NO: 3375357 - protein, 31 aa, Plasmodium falciparum
YGNDIKMKILPPYMHHFNKAMKIIPEGSSCN

SEQ ID NO: 3375358 - protein, 17 aa, Plasmodium falciparum
YGNMCNLKVQGRHDSCI

SEQ ID NO: 3375359 - protein, 17 aa, Plasmodium falciparum
YGNPLLYGNSMKKSKTK

SEQ ID NO: 3375360 - protein, 19 aa, Plasmodium falciparum
YGNYCTAIFDPDNNTKEIY

SEQ ID NO: 3375361 - protein, 24 aa, Plasmodium falciparum
YGNYLYYYAAPYGYGPVGLPEKVV

SEQ ID NO: 3375362 - protein, 17 aa, Plasmodium falciparum
YGPLLGQGIYFGKKNSN

SEQ ID NO: 3375363 - protein, 25 aa, Plasmodium falciparum
YGPPGCSKTLFAKAIASEIHMNFIS

SEQ ID NO: 3375364 - protein, 24 aa, Plasmodium falciparum
YGREDIKKGLLCQLFGGSKITDKY

SEQ ID NO: 3375365 - protein, 22 aa, Plasmodium falciparum
YGREKYNPIEIVPKMKKKIQNV

SEQ ID NO: 3375366 - protein, 17 aa, Plasmodium falciparum
YGRTGCVSIIQSGLKTN

SEQ ID NO: 3375367 - protein, 21 aa, Plasmodium falciparum
YGSGLWHTWFDRSLGLSGQVL

SEQ ID NO: 3375368 - protein, 35 aa, Plasmodium falciparum
YGSKDFRSKWYIHFYKICLYNEKIYGGVTGGNKKN

SEQ ID NO: 3375369 - protein, 26 aa, Plasmodium falciparum
YGSKDGSICFLDLIKKKNIYRYEEIG

SEQ ID NO: 3375370 - protein, 31 aa, Plasmodium falciparum
YGSSEFYIWSFSFYLEVRINYFSPIYDNLCP

SEQ ID NO: 3375371 - protein, 17 aa, Plasmodium falciparum
YGSTFTFINNKWVRSKK

SEQ ID NO: 3375372 - protein, 20 aa, Plasmodium falciparum
YGSVYSFEIITGNKLLQYIY

SEQ ID NO: 3375373 - protein, 27 aa, Plasmodium falciparum
YGTAINILPSFFYDERIISFINKDVPK

SEQ ID NO: 3375374 - protein, 20 aa, Plasmodium falciparum
YGTCDSWYTNIVLLKNEIML

SEQ ID NO: 3375375 - protein, 22 aa, Plasmodium falciparum
YGVAFKKTFSYAGFEQQPKKFI

SEQ ID NO: 3375376 - protein, 18 aa, Plasmodium falciparum
YGYAECKEELRLQWNEFT

SEQ ID NO: 3375377 - protein, 34 aa, Plasmodium falciparum
YGYNREDVYNFISLYKFDIEKIQLELCNIMESKE

SEQ ID NO: 3375378 - protein, 29 aa, Plasmodium falciparum
YGYNRPKNSILNLNFEIPKLNTFNNNNTL

SEQ ID NO: 3375379 - protein, 26 aa, Plasmodium falciparum
YGYRNIYLKDIHNFIVNLRLGKYIFK

SEQ ID NO: 3375380 - protein, 17 aa, Plasmodium falciparum
YGYVGLKSKELDIQEYV

SEQ ID NO: 3375381 - protein, 17 aa, Plasmodium falciparum
YHAKWKLINDLDLVILI

SEQ ID NO: 3375382 - protein, 20 aa, Plasmodium falciparum
YHATIKYEKGLFKLEDHNSK

SEQ ID NO: 3375383 - protein, 19 aa, Plasmodium falciparum
YHCYFFLRNQFENFKNVHT

SEQ ID NO: 3375384 - protein, 38 aa, Plasmodium falciparum
YHDESILKWTCEQIHREWMKIMLKLFYNILYDTTYNVI

SEQ ID NO: 3375385 - protein, 23 aa, Plasmodium falciparum
YHDKSFCSSSIFSPLKKNKNEIY

SEQ ID NO: 3375386 - protein, 17 aa, Plasmodium falciparum
YHDSIKYTYIIPSKYTV

SEQ ID NO: 3375387 - protein, 22 aa, Plasmodium falciparum
YHEKSCYKICDLGNSLWIDESR

SEQ ID NO: 3375388 - protein, 22 aa, Plasmodium falciparum
YHFAKSYLCHDDLLNIKKDTIM

SEQ ID NO: 3375389 - protein, 21 aa, Plasmodium falciparum
YHFNIFIPYDYIYYTTYKKMN

SEQ ID NO: 3375390 - protein, 17 aa, Plasmodium falciparum
YHFSVKNVNFFKNALSL

SEQ ID NO: 3375391 - protein, 33 aa, Plasmodium falciparum
YHGPINELLALCWIKQILLGLLYMKNLPTGKVH

SEQ ID NO: 3375392 - protein, 17 aa, Plasmodium falciparum
YHHAPIFLLVNVHTDQS

SEQ ID NO: 3375393 - protein, 25 aa, Plasmodium falciparum
YHKFKSDLGLIYARKKKVHKYNHVP

SEQ ID NO: 3375394 - protein, 22 aa, Plasmodium falciparum
YHKKKLKKGLLRVLHIRTLEEK

SEQ ID NO: 3375395 - protein, 25 aa, Plasmodium falciparum
YHKMKLKNSIDYSYNHMLSTTIDEE

SEQ ID NO: 3375396 - protein, 18 aa, Plasmodium falciparum
YHKYKYSVKIIKSVDLLL

SEQ ID NO: 3375397 - protein, 17 aa, Plasmodium falciparum
YHLALMCRRYKLFKNYQ

SEQ ID NO: 3375398 - protein, 23 aa, Plasmodium falciparum
YHLTEFYGTAFLYASKNNLFISS

SEQ ID NO: 3375399 - protein, 18 aa, Plasmodium falciparum
YHLYWFGLRPNLRDMFND

SEQ ID NO: 3375400 - protein, 17 aa, Plasmodium falciparum
YHMHIIEMLTGLKYIKS

SEQ ID NO: 3375401 - protein, 17 aa, Plasmodium falciparum
YHMNHCMNTGGSKKKNV

SEQ ID NO: 3375402 - protein, 19 aa, Plasmodium falciparum
YHNLAKWLYELYINTKPPS

SEQ ID NO: 3375403 - protein, 18 aa, Plasmodium falciparum
YHNNIRYTFKGEKSEERL

SEQ ID NO: 3375404 - protein, 17 aa, Plasmodium falciparum
YHNRRDGYGDVLNNNKD

SEQ ID NO: 3375405 - protein, 24 aa, Plasmodium falciparum
YHPISKKRFGYFKDKNFSYNKHVE

SEQ ID NO: 3375406 - protein, 21 aa, Plasmodium falciparum
YHPTLVPRVSVISPYTPGIIQ

SEQ ID NO: 3375407 - protein, 17 aa, Plasmodium falciparum
YHRNGIICCTQPRRVAA

SEQ ID NO: 3375408 - protein, 23 aa, Plasmodium falciparum
YHSKEKFGIIEFYNHENAKDAIN

SEQ ID NO: 3375409 - protein, 17 aa, Plasmodium falciparum
YHSPMCVYIKLEDIDLP

SEQ ID NO: 3375410 - protein, 18 aa, Plasmodium falciparum
YHSSCIMVAKNISIKLYR

SEQ ID NO: 3375411 - protein, 17 aa, Plasmodium falciparum
YHSVVERKSYLYKNNIP

SEQ ID NO: 3375412 - protein, 24 aa, Plasmodium falciparum
YHTCVDAILSICEYKHILCPNQNK

SEQ ID NO: 3375413 - protein, 18 aa, Plasmodium falciparum
YHTKQCIQVLSGHTQNIS

SEQ ID NO: 3375414 - protein, 24 aa, Plasmodium falciparum
YHYAEMPNEMSIELAWDEIQIIIS

SEQ ID NO: 3375415 - protein, 28 aa, Plasmodium falciparum
YHYFFHLKHIFKIIKGIFLSEAPIYEEK

SEQ ID NO: 3375416 - protein, 26 aa, Plasmodium falciparum
YHYHVADISGSIILCIPHIFIEEELE

SEQ ID NO: 3375417 - protein, 25 aa, Plasmodium falciparum
YHYIFKYKIFHNIHFFNTNLNITKL

SEQ ID NO: 3375418 - protein, 17 aa, Plasmodium falciparum
YHYPFKRHMSYNSLPCN

SEQ ID NO: 3375419 - protein, 25 aa, Plasmodium falciparum
YHYYMPNKLMMMGNFRNLIDINKNV

SEQ ID NO: 3375420 - protein, 18 aa, Plasmodium falciparum
YIAYNLKKSLLNQVVNFF

SEQ ID NO: 3375421 - protein, 23 aa, Plasmodium falciparum
YICDSDLFLTFVQLFLDLIKNKD

SEQ ID NO: 3375422 - protein, 25 aa, Plasmodium falciparum
YICEDCGMMGYDLYCTFCKKCDKNI

SEQ ID NO: 3375423 - protein, 18 aa, Plasmodium falciparum
YICEKWKHKEDMLNKLNE

SEQ ID NO: 3375424 - protein, 22 aa, Plasmodium falciparum
YICKPRYSGISLYISNELPLKR

SEQ ID NO: 3375425 - protein, 20 aa, Plasmodium falciparum
YICSRFYRAPELMLGSTNYT

SEQ ID NO: 3375426 - protein, 18 aa, Plasmodium falciparum
YICSRWYRAPELLCGSMF

SEQ ID NO: 3375427 - protein, 25 aa, Plasmodium falciparum
YIDDIPRNIPILFIHSRNDSLCYYP

SEQ ID NO: 3375428 - protein, 24 aa, Plasmodium falciparum
YIDECMRRKKGLIFDIYDYIMKMG

SEQ ID NO: 3375429 - protein, 30 aa, Plasmodium falciparum
YIDESKCYDDIFFLLKILAKHLEIKKIPSA

SEQ ID NO: 3375430 - protein, 26 aa, Plasmodium falciparum
YIDFKKSLRYNYDFYKNVNTNSIKRN

SEQ ID NO: 3375431 - protein, 27 aa, Plasmodium falciparum
YIDIPKTRFKDIGGYKFVKRCINECLI

SEQ ID NO: 3375432 - protein, 19 aa, Plasmodium falciparum
YIEEIKYFWNHYKKNKDPN

SEQ ID NO: 3375433 - protein, 18 aa, Plasmodium falciparum
YIEHYFLYCNTFEFPKWI

SEQ ID NO: 3375434 - protein, 20 aa, Plasmodium falciparum
YIEKGREFLKRSQMNINEYY

SEQ ID NO: 3375435 - protein, 17 aa, Plasmodium falciparum
YIEKLKKKKIKILNEKK

SEQ ID NO: 3375436 - protein, 21 aa, Plasmodium falciparum
YIELQYILSTFIYYEKENITT

SEQ ID NO: 3375437 - protein, 18 aa, Plasmodium falciparum
YIENCILEVYIKRKEEID

SEQ ID NO: 3375438 - protein, 18 aa, Plasmodium falciparum
YIENLYFQKINDYTTNGI

SEQ ID NO: 3375439 - protein, 19 aa, Plasmodium falciparum
YIESIKEDVKWLGYDWKEH

SEQ ID NO: 3375440 - protein, 20 aa, Plasmodium falciparum
YIFKCCKYLHQSKYRKPYSY

SEQ ID NO: 3375441 - protein, 21 aa, Plasmodium falciparum
YIFKLPTAFFDTLGIFNVSEK

SEQ ID NO: 3375442 - protein, 18 aa, Plasmodium falciparum
YIFLPLKYKYTYLSSLCF

SEQ ID NO: 3375443 - protein, 17 aa, Plasmodium falciparum
YIFMLQKRCFLYKELYY

SEQ ID NO: 3375444 - protein, 19 aa, Plasmodium falciparum
YIFNIECKQMEYFKNSNLL

SEQ ID NO: 3375445 - protein, 22 aa, Plasmodium falciparum
YIFSCPKNFFLFFYYKSKNNLF

SEQ ID NO: 3375446 - protein, 24 aa, Plasmodium falciparum
YIFTLDMLPSIKFETFYEKNTDHK

SEQ ID NO: 3375447 - protein, 20 aa, Plasmodium falciparum
YIGFGHGIGRSGNLDDVQPK

SEQ ID NO: 3375448 - protein, 24 aa, Plasmodium falciparum
YIGFNKFLITPAIVQKNIANTKKE

SEQ ID NO: 3375449 - protein, 28 aa, Plasmodium falciparum
YIGKKPIEVWILLSRHVRERKTDVSQKY

SEQ ID NO: 3375450 - protein, 24 aa, Plasmodium falciparum
YIGMCPKCYLLLHDNHNKSSENIY

SEQ ID NO: 3375451 - protein, 17 aa, Plasmodium falciparum
YIGMWKFGEKNGHGKYI

SEQ ID NO: 3375452 - protein, 22 aa, Plasmodium falciparum
YIGNIKLDYVVLYIYGICIFNN

SEQ ID NO: 3375453 - protein, 24 aa, Plasmodium falciparum
YIHALPFKIFWKYQNVEEFYKNKN

SEQ ID NO: 3375454 - protein, 18 aa, Plasmodium falciparum
YIHIPPFVLTKLCEYAFK

SEQ ID NO: 3375455 - protein, 25 aa, Plasmodium falciparum
YIHIVNLNTLFGIYFNETERNILKV

SEQ ID NO: 3375456 - protein, 25 aa, Plasmodium falciparum
YIICVKNTLISLDYAKKCAVNRKYD

SEQ ID NO: 3375457 - protein, 28 aa, Plasmodium falciparum
YIIEPIIENTWLKKVLLIIKKESLDIEC

SEQ ID NO: 3375458 - protein, 18 aa, Plasmodium falciparum
YIIHQGYKKPKKIQWHDT

SEQ ID NO: 3375459 - protein, 28 aa, Plasmodium falciparum
YIIKCRACKFINPNGFKIEDYYTCQNCG

SEQ ID NO: 3375460 - protein, 18 aa, Plasmodium falciparum
YIIKFEWLYSKKKEGKDY

SEQ ID NO: 3375461 - protein, 17 aa, Plasmodium falciparum
YIILSGLGDALPLCVQL

SEQ ID NO: 3375462 - protein, 17 aa, Plasmodium falciparum
YIISNKILKHIDNIDKL

SEQ ID NO: 3375463 - protein, 19 aa, Plasmodium falciparum
YIKCLDDCKNSFSFNNKKY

SEQ ID NO: 3375464 - protein, 23 aa, Plasmodium falciparum
YIKDIKLDILVSVASKNNVVLII

SEQ ID NO: 3375465 - protein, 17 aa, Plasmodium falciparum
YIKECNDIINLANSLKL

SEQ ID NO: 3375466 - protein, 18 aa, Plasmodium falciparum
YIKEEYIVHGCEEEVKGL

SEQ ID NO: 3375467 - protein, 21 aa, Plasmodium falciparum
YIKEIDILLRLDINKNTNTTT

SEQ ID NO: 3375468 - protein, 18 aa, Plasmodium falciparum
YIKHHIKNHMNNSSEDIF

SEQ ID NO: 3375469 - protein, 17 aa, Plasmodium falciparum
YIKIKIMDCSFNYSYDY

SEQ ID NO: 3375470 - protein, 25 aa, Plasmodium falciparum
YIKIREYQKALTLCEKILNIRKLYF

SEQ ID NO: 3375471 - protein, 23 aa, Plasmodium falciparum
YIKKKFISILFYFKGHGRKEKIQ

SEQ ID NO: 3375472 - protein, 24 aa, Plasmodium falciparum
YIKKNYVMSFSFFPHCKIKKNDKA

SEQ ID NO: 3375473 - protein, 18 aa, Plasmodium falciparum
YIKKRKNSNISIEEKKNE

SEQ ID NO: 3375474 - protein, 32 aa, Plasmodium falciparum
YIKLEKMAKIFSKFYACGSSVIKGANNNPDQI

SEQ ID NO: 3375475 - protein, 25 aa, Plasmodium falciparum
YIKLIKSICMIINIECCDDIENEDI

SEQ ID NO: 3375476 - protein, 20 aa, Plasmodium falciparum
YIKNLCNISSETVNDKKIKT

SEQ ID NO: 3375477 - protein, 22 aa, Plasmodium falciparum
YIKREYIPEYLLNIKKKIKLIL

SEQ ID NO: 3375478 - protein, 23 aa, Plasmodium falciparum
YIKRLVSRLKYIYFEGDIQVQNL

SEQ ID NO: 3375479 - protein, 24 aa, Plasmodium falciparum
YIKTRFRFSSCFSKRESFIDNDDG

SEQ ID NO: 3375480 - protein, 20 aa, Plasmodium falciparum
YIKTYLISFHFFQKIQDNYK

SEQ ID NO: 3375481 - protein, 22 aa, Plasmodium falciparum
YIKVEQPLILCISHIEEKGIFL

SEQ ID NO: 3375482 - protein, 18 aa, Plasmodium falciparum
YIKVRKNKYFKFSHLYTM

SEQ ID NO: 3375483 - protein, 20 aa, Plasmodium falciparum
YIKYHAMGHFGLVKSYRNIF

SEQ ID NO: 3375484 - protein, 20 aa, Plasmodium falciparum
YIKYLECIKNNWSSSQASKL

SEQ ID NO: 3375485 - protein, 19 aa, Plasmodium falciparum
YILCCKEAFFCSTEEYEDD

SEQ ID NO: 3375486 - protein, 24 aa, Plasmodium falciparum
YILEKEIFLTLNFNDKNIFEDIYN

SEQ ID NO: 3375487 - protein, 26 aa, Plasmodium falciparum
YILEYFLKKYFNSFLLIQKDNKELLE

SEQ ID NO: 3375488 - protein, 21 aa, Plasmodium falciparum
YILFFLIKVGHDINKKKLDNT

SEQ ID NO: 3375489 - protein, 19 aa, Plasmodium falciparum
YILFLKYIYNDLLSFIESN

SEQ ID NO: 3375490 - protein, 17 aa, Plasmodium falciparum
YILKEHINYNIYIKELN

SEQ ID NO: 3375491 - protein, 22 aa, Plasmodium falciparum
YILKKLGWNVIHIPYQEWNQCF

SEQ ID NO: 3375492 - protein, 24 aa, Plasmodium falciparum
YILKKQFNNFFFYDALNEKQKILY

SEQ ID NO: 3375493 - protein, 19 aa, Plasmodium falciparum
YILKLDFFQQNNLVFDIYT

SEQ ID NO: 3375494 - protein, 20 aa, Plasmodium falciparum
YILLCGYPPFGGQNDQDIIK

SEQ ID NO: 3375495 - protein, 23 aa, Plasmodium falciparum
YILLTCPENNLLELKEFSKKIIN

SEQ ID NO: 3375496 - protein, 19 aa, Plasmodium falciparum
YILPLFLLFIRIEETNLKS

SEQ ID NO: 3375497 - protein, 28 aa, Plasmodium falciparum
YIMDKCSEYKCSLSMEKKTNDNFDNHKP

SEQ ID NO: 3375498 - protein, 19 aa, Plasmodium falciparum
YIMKFDLSQYFPLLTTKKL

SEQ ID NO: 3375499 - protein, 19 aa, Plasmodium falciparum
YIMKPEEHLENFIKNNRIY

SEQ ID NO: 3375500 - protein, 21 aa, Plasmodium falciparum
YINAFICLPLNCKAKNLIVDI

SEQ ID NO: 3375501 - protein, 17 aa, Plasmodium falciparum
YINDIHIKPGMMNKNKK

SEQ ID NO: 3375502 - protein, 19 aa, Plasmodium falciparum
YINDIPQNVPILFIHSRHD

SEQ ID NO: 3375503 - protein, 25 aa, Plasmodium falciparum
YINFKHFYNFLIFFEHLYKKKSEET

SEQ ID NO: 3375504 - protein, 17 aa, Plasmodium falciparum
YINFLLILIFYQCNNKI

SEQ ID NO: 3375505 - protein, 19 aa, Plasmodium falciparum
YINGPTMYRNIMKCLEIKD

SEQ ID NO: 3375506 - protein, 22 aa, Plasmodium falciparum
YINGYCKGIRHKKTNRIYCDGN

SEQ ID NO: 3375507 - protein, 24 aa, Plasmodium falciparum
YINHAKCYIIFDIKSYYKNLDIMK

SEQ ID NO: 3375508 - protein, 18 aa, Plasmodium falciparum
YINICFSRLIPDFHLKTF

SEQ ID NO: 3375509 - protein, 18 aa, Plasmodium falciparum
YINICTDHLNLLKNYNLN

SEQ ID NO: 3375510 - protein, 17 aa, Plasmodium falciparum
YINIRKALLSGFYQQVA

SEQ ID NO: 3375511 - protein, 18 aa, Plasmodium falciparum
YINKCTPNIVNMLISKNK

SEQ ID NO: 3375512 - protein, 18 aa, Plasmodium falciparum
YINKCVHTSPLIDLQHSN

SEQ ID NO: 3375513 - protein, 20 aa, Plasmodium falciparum
YINKDIETMISIDMDSLSYV

SEQ ID NO: 3375514 - protein, 20 aa, Plasmodium falciparum
YINKHKKAYEERVKKEEEER

SEQ ID NO: 3375515 - protein, 19 aa, Plasmodium falciparum
YINKNWKIGKIEKIENMEK

SEQ ID NO: 3375516 - protein, 19 aa, Plasmodium falciparum
YINKSPCIYNNKEALLSDK

SEQ ID NO: 3375517 - protein, 21 aa, Plasmodium falciparum
YINLPRICVVGTQSSGKSSVL

SEQ ID NO: 3375518 - protein, 17 aa, Plasmodium falciparum
YINLSLLNTCLFVNNFL

SEQ ID NO: 3375519 - protein, 26 aa, Plasmodium falciparum
YINNFFFKTLINKICQHYHMYNEMNN

SEQ ID NO: 3375520 - protein, 18 aa, Plasmodium falciparum
YIPVYPPFFMKKNIMEEC

SEQ ID NO: 3375521 - protein, 17 aa, Plasmodium falciparum
YIQEILDIYYSIIRNNK

SEQ ID NO: 3375522 - protein, 19 aa, Plasmodium falciparum
YIQKCAFFLNSNETNVLTN

SEQ ID NO: 3375523 - protein, 24 aa, Plasmodium falciparum
YIQKNLFCSPKFLNEKAINMLGYD

SEQ ID NO: 3375524 - protein, 24 aa, Plasmodium falciparum
YIQMIKRLLSFCQRKYCTNPSEAV

SEQ ID NO: 3375525 - protein, 25 aa, Plasmodium falciparum
YIQRRVAPCNFLKKLDIYKSDATLL

SEQ ID NO: 3375526 - protein, 18 aa, Plasmodium falciparum
YIQSGILSNCTTYYKYEI

SEQ ID NO: 3375527 - protein, 26 aa, Plasmodium falciparum
YIQSICLRVICKLLLTEYLGNHVYNI

SEQ ID NO: 3375528 - protein, 19 aa, Plasmodium falciparum
YIREIENAYIYKYRSDHNI

SEQ ID NO: 3375529 - protein, 17 aa, Plasmodium falciparum
YIRKIYKDMKHIYNEYN

SEQ ID NO: 3375530 - protein, 23 aa, Plasmodium falciparum
YIRTEISVGILFRALGCTSDRDI

SEQ ID NO: 3375531 - protein, 19 aa, Plasmodium falciparum
YIRYWKKVGLGFATPKEAK

SEQ ID NO: 3375532 - protein, 22 aa, Plasmodium falciparum
YISEPIYQWEVSSSDKIFYDKI

SEQ ID NO: 3375533 - protein, 18 aa, Plasmodium falciparum
YISLPDRSPFGILYICKI

SEQ ID NO: 3375534 - protein, 19 aa, Plasmodium falciparum
YISNLNILSCISICTILKS

SEQ ID NO: 3375535 - protein, 19 aa, Plasmodium falciparum
YISPMRLYYFIKMKIDEIY

SEQ ID NO: 3375536 - protein, 25 aa, Plasmodium falciparum
YISQIATKCFLRIQDLTYPLMELID

SEQ ID NO: 3375537 - protein, 20 aa, Plasmodium falciparum
YISSDLIFSICLKLEEHLIE

SEQ ID NO: 3375538 - protein, 22 aa, Plasmodium falciparum
YISSYQKGYNWKVKTDDDGYDD

SEQ ID NO: 3375539 - protein, 25 aa, Plasmodium falciparum
YISTPRSSHRYIFPKINKNINGEDY

SEQ ID NO: 3375540 - protein, 34 aa, Plasmodium falciparum
YITCPLHLCLILSAFARLDIREGNILLSFSKVAK

SEQ ID NO: 3375541 - protein, 27 aa, Plasmodium falciparum
YITDLCKKGTMLSLKKNELFNQKNDKI

SEQ ID NO: 3375542 - protein, 22 aa, Plasmodium falciparum
YITEILIGHILWVFDEKQNKLY

SEQ ID NO: 3375543 - protein, 18 aa, Plasmodium falciparum
YITIPTFVHYLAKRKEYF

SEQ ID NO: 3375544 - protein, 19 aa, Plasmodium falciparum
YITNGNIAAPFFVNNNDMI

SEQ ID NO: 3375545 - protein, 32 aa, Plasmodium falciparum
YITSCRTLGQLSIWLPAFEIIDSSLESIANHL

SEQ ID NO: 3375546 - protein, 18 aa, Plasmodium falciparum
YITSCTWSPIYKKRIAQG

SEQ ID NO: 3375547 - protein, 18 aa, Plasmodium falciparum
YIVSSSFDTFIKIWDSVN

SEQ ID NO: 3375548 - protein, 17 aa, Plasmodium falciparum
YIWSWSILPVYVNTLNE

SEQ ID NO: 3375549 - protein, 26 aa, Plasmodium falciparum
YIYCRTKKYSFPRIVNVFSSVVRMCQ

SEQ ID NO: 3375550 - protein, 24 aa, Plasmodium falciparum
YIYDDLFLHYLIRCSHKNNISMGY

SEQ ID NO: 3375551 - protein, 23 aa, Plasmodium falciparum
YIYIYIFQIEKYPKMASDIFFLT

SEQ ID NO: 3375552 - protein, 25 aa, Plasmodium falciparum
YIYIYKRLLPYLANKIQKNKISFEE

SEQ ID NO: 3375553 - protein, 20 aa, Plasmodium falciparum
YIYKCFRTSLELKNDYFYYY

SEQ ID NO: 3375554 - protein, 18 aa, Plasmodium falciparum
YIYMKLFDVYSKNKDIFK

SEQ ID NO: 3375555 - protein, 17 aa, Plasmodium falciparum
YIYNCINYAYDLGSKSQ

SEQ ID NO: 3375556 - protein, 18 aa, Plasmodium falciparum
YIYQEIYNRIDVLDKNIH

SEQ ID NO: 3375557 - protein, 24 aa, Plasmodium falciparum
YIYQFFKWGYVYDVNIMKDANTLL

SEQ ID NO: 3375558 - protein, 25 aa, Plasmodium falciparum
YIYSPRELTRWKLALYETLESCDEL

SEQ ID NO: 3375559 - protein, 25 aa, Plasmodium falciparum
YIYVPYNFCFHDFFIFLQNNLDEAR

SEQ ID NO: 3375560 - protein, 20 aa, Plasmodium falciparum
YKAAKICINQAVKMNNNEWK

SEQ ID NO: 3375561 - protein, 21 aa, Plasmodium falciparum
YKAGIICFSSNYILNDIKNNM

SEQ ID NO: 3375562 - protein, 26 aa, Plasmodium falciparum
YKALKEIFLIYPIKFMCVKKIQRNKK

SEQ ID NO: 3375563 - protein, 17 aa, Plasmodium falciparum
YKANGVILSEYEMNKQL

SEQ ID NO: 3375564 - protein, 20 aa, Plasmodium falciparum
YKCDNVYLFINYIKDILECD

SEQ ID NO: 3375565 - protein, 21 aa, Plasmodium falciparum
YKCEDEIPLGTILNIQDLDIH

SEQ ID NO: 3375566 - protein, 17 aa, Plasmodium falciparum
YKCISCDKICENTYYIL

SEQ ID NO: 3375567 - protein, 20 aa, Plasmodium falciparum
YKCLSEGTNAWTAIDHTCYT

SEQ ID NO: 3375568 - protein, 17 aa, Plasmodium falciparum
YKCMNIRTLSRFYDHIK

SEQ ID NO: 3375569 - protein, 17 aa, Plasmodium falciparum
YKDERILFLQDEQKTYL

SEQ ID NO: 3375570 - protein, 18 aa, Plasmodium falciparum
YKDFLNVINKRMINFTKD

SEQ ID NO: 3375571 - protein, 22 aa, Plasmodium falciparum
YKDIKNSVNWLGNFFSNNDNQE

SEQ ID NO: 3375572 - protein, 18 aa, Plasmodium falciparum
YKDKIDYMLNLEKSINKN

SEQ ID NO: 3375573 - protein, 17 aa, Plasmodium falciparum
YKDLELILFSLGSYNIL

SEQ ID NO: 3375574 - protein, 34 aa, Plasmodium falciparum
YKDLLKLKSLLLKKRYYKNILFEYQKNFVQINNR

SEQ ID NO: 3375575 - protein, 30 aa, Plasmodium falciparum
YKDLQVCVPKYLCNTWLYKATPRDIASLIR

SEQ ID NO: 3375576 - protein, 19 aa, Plasmodium falciparum
YKDNLYILSYDNFLRNYNL

SEQ ID NO: 3375577 - protein, 28 aa, Plasmodium falciparum
YKDPEFLKPIICRSACSSNFLGASTLLF

SEQ ID NO: 3375578 - protein, 18 aa, Plasmodium falciparum
YKEAFHIIACKKKIVKNF

SEQ ID NO: 3375579 - protein, 18 aa, Plasmodium falciparum
YKEECIYSSIDNFNGPFD

SEQ ID NO: 3375580 - protein, 24 aa, Plasmodium falciparum
YKEECSYPHFIRKGLKRKNEKDMK

SEQ ID NO: 3375581 - protein, 19 aa, Plasmodium falciparum
YKEICKLCFTKEYEEITNK

SEQ ID NO: 3375582 - protein, 18 aa, Plasmodium falciparum
YKEIPVPVHVQRIIEHPI

SEQ ID NO: 3375583 - protein, 24 aa, Plasmodium falciparum
YKEKCKKIPILESKIDILESEIKE

SEQ ID NO: 3375584 - protein, 21 aa, Plasmodium falciparum
YKEKIKMLCMFSNYKDNYENA

SEQ ID NO: 3375585 - protein, 18 aa, Plasmodium falciparum
YKEKLLDIKNHWDTKNFC

SEQ ID NO: 3375586 - protein, 22 aa, Plasmodium falciparum
YKEKRYICQNCGSVECEKDPFM

SEQ ID NO: 3375587 - protein, 19 aa, Plasmodium falciparum
YKELNYFNYIYIYKRLLPY

SEQ ID NO: 3375588 - protein, 25 aa, Plasmodium falciparum
YKENDLCFIKYIIVSNFKSYEDENI

SEQ ID NO: 3375589 - protein, 22 aa, Plasmodium falciparum
YKENFIKSMLFNKINVQQKVDT

SEQ ID NO: 3375590 - protein, 24 aa, Plasmodium falciparum
YKEQAECLCKIFLNDDIENKIKNG

SEQ ID NO: 3375591 - protein, 18 aa, Plasmodium falciparum
YKEQKCIKKKDTFTKDIV

SEQ ID NO: 3375592 - protein, 21 aa, Plasmodium falciparum
YKESFKLAHLIKNSINKNYKK

SEQ ID NO: 3375593 - protein, 25 aa, Plasmodium falciparum
YKEVKEYLKDLTILKSGANWKTYKM

SEQ ID NO: 3375594 - protein, 23 aa, Plasmodium falciparum
YKFELVDTGGLVFEQEKFSKEIK

SEQ ID NO: 3375595 - protein, 17 aa, Plasmodium falciparum
YKFLISILYFHKKSFSL

SEQ ID NO: 3375596 - protein, 29 aa, Plasmodium falciparum
YKFLKKKKIEGYMILNFLNFNKELIYYNE

SEQ ID NO: 3375597 - protein, 29 aa, Plasmodium falciparum
YKFLKKNCAYHDLIKLFYFKGHKQREKCN

SEQ ID NO: 3375598 - protein, 23 aa, Plasmodium falciparum
YKFNYCKHSSMLSEIEKMLTASA

SEQ ID NO: 3375599 - protein, 18 aa, Plasmodium falciparum
YKFPKWKINYDIVKKNQN

SEQ ID NO: 3375600 - protein, 17 aa, Plasmodium falciparum
YKGISKFDINEDKNTTI

SEQ ID NO: 3375601 - protein, 19 aa, Plasmodium falciparum
YKGKDILNYDYKNVHHKRS

SEQ ID NO: 3375602 - protein, 19 aa, Plasmodium falciparum
YKGKFSHKMIKGGQFYSQH

SEQ ID NO: 3375603 - protein, 21 aa, Plasmodium falciparum
YKGNSNISLTLNSLLYINDQI

SEQ ID NO: 3375604 - protein, 24 aa, Plasmodium falciparum
YKGPELFILQGMIFLKMKRNVDAL

SEQ ID NO: 3375605 - protein, 18 aa, Plasmodium falciparum
YKGSLPKENINNLKKINK

SEQ ID NO: 3375606 - protein, 19 aa, Plasmodium falciparum
YKGSMKGDEMVGSIKKPGR

SEQ ID NO: 3375607 - protein, 28 aa, Plasmodium falciparum
YKHAQIPVWIRLEYNCIHNPKDILKEVE

SEQ ID NO: 3375608 - protein, 20 aa, Plasmodium falciparum
YKHLFHMPSENYLMKNEKKD

SEQ ID NO: 3375609 - protein, 17 aa, Plasmodium falciparum
YKHNELLNEYNTIDDPD

SEQ ID NO: 3375610 - protein, 18 aa, Plasmodium falciparum
YKIADYILSQDVEVKKGL

SEQ ID NO: 3375611 - protein, 21 aa, Plasmodium falciparum
YKIDTCFLCKENFSFEYSYEY

SEQ ID NO: 3375612 - protein, 21 aa, Plasmodium falciparum
YKIECVKCIQEIVMLKIDEKN

SEQ ID NO: 3375613 - protein, 17 aa, Plasmodium falciparum
YKIFSVEKYDMLKKEVG

SEQ ID NO: 3375614 - protein, 20 aa, Plasmodium falciparum
YKIFTCGWHKDISIKEFESF

SEQ ID NO: 3375615 - protein, 20 aa, Plasmodium falciparum
YKIGKRCRIKLGDRRGILKF

SEQ ID NO: 3375616 - protein, 17 aa, Plasmodium falciparum
YKIKKKKYESFFDDINN

SEQ ID NO: 3375617 - protein, 18 aa, Plasmodium falciparum
YKIKKYQLINENLQDCIA

SEQ ID NO: 3375618 - protein, 20 aa, Plasmodium falciparum
YKILRSRSAHKFTLAQVCAL

SEQ ID NO: 3375619 - protein, 21 aa, Plasmodium falciparum
YKILSGGRCNKRLDKDKITTC

SEQ ID NO: 3375620 - protein, 20 aa, Plasmodium falciparum
YKILSKYIHLERDIKNGNDN

SEQ ID NO: 3375621 - protein, 19 aa, Plasmodium falciparum
YKINHIIKIFLDENDNNNN

SEQ ID NO: 3375622 - protein, 23 aa, Plasmodium falciparum
YKIPVLSSVHFHIFKNYIKQNNR

SEQ ID NO: 3375623 - protein, 25 aa, Plasmodium falciparum
YKIQHKMAYLRKDISAFLKKVQLEN

SEQ ID NO: 3375624 - protein, 21 aa, Plasmodium falciparum
YKIQITKDILLFDRLYQICPS

SEQ ID NO: 3375625 - protein, 22 aa, Plasmodium falciparum
YKIRENKIFLVTGMLGCGKTTC

SEQ ID NO: 3375626 - protein, 20 aa, Plasmodium falciparum
YKISNKILIDSFSMNNINNN

SEQ ID NO: 3375627 - protein, 18 aa, Plasmodium falciparum
YKISYSFNPCYMDYLKGK

SEQ ID NO: 3375628 - protein, 21 aa, Plasmodium falciparum
YKKALKPTWFQEYRKNEVNFF

SEQ ID NO: 3375629 - protein, 19 aa, Plasmodium falciparum
YKKCHHVKSYKLGKESDGW

SEQ ID NO: 3375630 - protein, 18 aa, Plasmodium falciparum
YKKCKWEKIKNSNINEQK

SEQ ID NO: 3375631 - protein, 21 aa, Plasmodium falciparum
YKKDCSLSLRSNENGVIDTVM

SEQ ID NO: 3375632 - protein, 17 aa, Plasmodium falciparum
YKKDDKYEHKVEDINEH

SEQ ID NO: 3375633 - protein, 17 aa, Plasmodium falciparum
YKKDFLITARKPNITDI

SEQ ID NO: 3375634 - protein, 23 aa, Plasmodium falciparum
YKKECTPQGLAMLLNSFSQIMKP

SEQ ID NO: 3375635 - protein, 17 aa, Plasmodium falciparum
YKKEGKPSENSVYVNTY

SEQ ID NO: 3375636 - protein, 17 aa, Plasmodium falciparum
YKKFHLQECPLKKVQFH

SEQ ID NO: 3375637 - protein, 19 aa, Plasmodium falciparum
YKKHLFKRILNNCKKVNKC

SEQ ID NO: 3375638 - protein, 20 aa, Plasmodium falciparum
YKKIAGCLVNLQYLDDIHFT

SEQ ID NO: 3375639 - protein, 25 aa, Plasmodium falciparum
YKKINHILATLLWNSKLQIYRGKGV

SEQ ID NO: 3375640 - protein, 28 aa, Plasmodium falciparum
YKKKIFIKKLFDSINCSYDLSNIEYTKL

SEQ ID NO: 3375641 - protein, 25 aa, Plasmodium falciparum
YKKKKDILEKPVWKSLYDIEETVKD

SEQ ID NO: 3375642 - protein, 18 aa, Plasmodium falciparum
YKKKKKIEFMSIVDYYGG

SEQ ID NO: 3375643 - protein, 26 aa, Plasmodium falciparum
YKKKKVKLYLCLNKKNDEIFIYQVQC

SEQ ID NO: 3375644 - protein, 18 aa, Plasmodium falciparum
YKKKMIIPSYEENDEKYS

SEQ ID NO: 3375645 - protein, 24 aa, Plasmodium falciparum
YKKKNVKWIDGFIIEKENCFELYN

SEQ ID NO: 3375646 - protein, 20 aa, Plasmodium falciparum
YKKKRYIKCLDDCKNSFSFN

SEQ ID NO: 3375647 - protein, 17 aa, Plasmodium falciparum
YKKKSSYHHVHREKYPD

SEQ ID NO: 3375648 - protein, 20 aa, Plasmodium falciparum
YKKKVTSLINETNYNYKNIE

SEQ ID NO: 3375649 - protein, 29 aa, Plasmodium falciparum
YKKLKNFENILCLYPYFNDYQLRKLSELI

SEQ ID NO: 3375650 - protein, 20 aa, Plasmodium falciparum
YKKLPNIIIDSGKYPSLEHT

SEQ ID NO: 3375651 - protein, 17 aa, Plasmodium falciparum
YKKNKKLLFNTDDNKEV

SEQ ID NO: 3375652 - protein, 18 aa, Plasmodium falciparum
YKKNMSFVKNNMLRKNTM

SEQ ID NO: 3375653 - protein, 27 aa, Plasmodium falciparum
YKKQNVFFLKAFFKNVINIKKERKKNL

SEQ ID NO: 3375654 - protein, 23 aa, Plasmodium falciparum
YKKRISKNIIVCTCAIEPKEYKK

SEQ ID NO: 3375655 - protein, 21 aa, Plasmodium falciparum
YKKRKQKCIEHIKDINKVNDG

SEQ ID NO: 3375656 - protein, 22 aa, Plasmodium falciparum
YKKRRRSSYYIYCRTKKYSFPR

SEQ ID NO: 3375657 - protein, 19 aa, Plasmodium falciparum
YKKRVGWFNKDSFHICISS

SEQ ID NO: 3375658 - protein, 17 aa, Plasmodium falciparum
YKKSIKLKEELDGIDPS

SEQ ID NO: 3375659 - protein, 20 aa, Plasmodium falciparum
YKKVENIAILMGEYFQVHDD

SEQ ID NO: 3375660 - protein, 23 aa, Plasmodium falciparum
YKKYHLYEILSFLEENKLINCLS

SEQ ID NO: 3375661 - protein, 25 aa, Plasmodium falciparum
YKKYNIKGCISLAGMISIEKLASTC

SEQ ID NO: 3375662 - protein, 20 aa, Plasmodium falciparum
YKLCKKICKNYFHLNINIII

SEQ ID NO: 3375663 - protein, 24 aa, Plasmodium falciparum
YKLDIYYKYFQSFIYDLLNIHKHI

SEQ ID NO: 3375664 - protein, 20 aa, Plasmodium falciparum
YKLDLCTNLFLFPDHKYKGN

SEQ ID NO: 3375665 - protein, 20 aa, Plasmodium falciparum
YKLDLTKCMFSSGNGTEKER

SEQ ID NO: 3375666 - protein, 20 aa, Plasmodium falciparum
YKLHIGGVTGMMICNKTQQR

SEQ ID NO: 3375667 - protein, 23 aa, Plasmodium falciparum
YKLIPQCFDLVKVIKCTQNEKHK

SEQ ID NO: 3375668 - protein, 30 aa, Plasmodium falciparum
YKLKDEILEYVKIRVFDKYSYVHKSFHDLP

SEQ ID NO: 3375669 - protein, 20 aa, Plasmodium falciparum
YKLKISYKIHNTRITNLKFY

SEQ ID NO: 3375670 - protein, 17 aa, Plasmodium falciparum
YKLKYTNDMLLYKLLNN

SEQ ID NO: 3375671 - protein, 20 aa, Plasmodium falciparum
YKLLLFLNLRFDVYSNNQFF

SEQ ID NO: 3375672 - protein, 22 aa, Plasmodium falciparum
YKLNCIKEYGMLYVDFNNYIFD

SEQ ID NO: 3375673 - protein, 22 aa, Plasmodium falciparum
YKLNNFAIIIFGNFKNDVILDI

SEQ ID NO: 3375674 - protein, 17 aa, Plasmodium falciparum
YKLNWIFPNNFPDREVY

SEQ ID NO: 3375675 - protein, 20 aa, Plasmodium falciparum
YKLPENLIIKEGDSLKVKMA

SEQ ID NO: 3375676 - protein, 22 aa, Plasmodium falciparum
YKLPNNILSLLVFSEDKLIKGK

SEQ ID NO: 3375677 - protein, 25 aa, Plasmodium falciparum
YKLRGDKMNSLKCDRLNSLRSDKIN

SEQ ID NO: 3375678 - protein, 18 aa, Plasmodium falciparum
YKLRHIWLNKQTEKNNLQ

SEQ ID NO: 3375679 - protein, 23 aa, Plasmodium falciparum
YKLSKILFCNNIIKQINKYNFKK

SEQ ID NO: 3375680 - protein, 19 aa, Plasmodium falciparum
YKLSLCNNLFNSNMNLQGF

SEQ ID NO: 3375681 - protein, 20 aa, Plasmodium falciparum
YKLSLGQCSYVSKSLIRICH

SEQ ID NO: 3375682 - protein, 21 aa, Plasmodium falciparum
YKLYEKGFMNLYGFDFSSTAI

SEQ ID NO: 3375683 - protein, 20 aa, Plasmodium falciparum
YKMENSCSINLKDNSHQQND

SEQ ID NO: 3375684 - protein, 20 aa, Plasmodium falciparum
YKMNNAIGYFIKYNEYSTEI

SEQ ID NO: 3375685 - protein, 17 aa, Plasmodium falciparum
YKNAKFINTTNLNYHKY

SEQ ID NO: 3375686 - protein, 25 aa, Plasmodium falciparum
YKNARKLLWGDLWRFTKRVTRPDAR

SEQ ID NO: 3375687 - protein, 27 aa, Plasmodium falciparum
YKNCKRKEKKKLFNDMLDKIFDTPMDN

SEQ ID NO: 3375688 - protein, 21 aa, Plasmodium falciparum
YKNDHEYENFITFSEWNAYNL

SEQ ID NO: 3375689 - protein, 19 aa, Plasmodium falciparum
YKNDLTCSYNNNGTANSNY

SEQ ID NO: 3375690 - protein, 30 aa, Plasmodium falciparum
YKNDNKYILWKKCIEAVKKLDKEFNFLEIV

SEQ ID NO: 3375691 - protein, 18 aa, Plasmodium falciparum
YKNDNLIISDANYVSNNV

SEQ ID NO: 3375692 - protein, 21 aa, Plasmodium falciparum
YKNEDGSICSYNNYNNMKTYI

SEQ ID NO: 3375693 - protein, 20 aa, Plasmodium falciparum
YKNEKRCVLYYLDDKMNYDI

SEQ ID NO: 3375694 - protein, 18 aa, Plasmodium falciparum
YKNEWRINKNDEMRKEYH

SEQ ID NO: 3375695 - protein, 19 aa, Plasmodium falciparum
YKNGEKFIGTFINGYKRKG

SEQ ID NO: 3375696 - protein, 21 aa, Plasmodium falciparum
YKNHLCLVFEWMWGNLRIALK

SEQ ID NO: 3375697 - protein, 24 aa, Plasmodium falciparum
YKNIKYRILTFYDPVVIDYDEQAT

SEQ ID NO: 3375698 - protein, 22 aa, Plasmodium falciparum
YKNILRKYFHYVKKYKHHQKKK

SEQ ID NO: 3375699 - protein, 18 aa, Plasmodium falciparum
YKNIQAFHQILIKKIIEE

SEQ ID NO: 3375700 - protein, 27 aa, Plasmodium falciparum
YKNIRNAVKLLKLWCINKKLLYTLPTY

SEQ ID NO: 3375701 - protein, 19 aa, Plasmodium falciparum
YKNISSLSYNKNVCDASTN

SEQ ID NO: 3375702 - protein, 17 aa, Plasmodium falciparum
YKNKCNLSNEYDYDNEN

SEQ ID NO: 3375703 - protein, 18 aa, Plasmodium falciparum
YKNKGVLFEKCQNQENTD

SEQ ID NO: 3375704 - protein, 20 aa, Plasmodium falciparum
YKNKLFKHWLSYTKNMNSLN

SEQ ID NO: 3375705 - protein, 24 aa, Plasmodium falciparum
YKNKLKGCTGISVISEKRDEEKKN

SEQ ID NO: 3375706 - protein, 22 aa, Plasmodium falciparum
YKNKMYFSHLLKNNCIKKTSML

SEQ ID NO: 3375707 - protein, 17 aa, Plasmodium falciparum
YKNKRVIAGTCRSIHLF

SEQ ID NO: 3375708 - protein, 25 aa, Plasmodium falciparum
YKNLNIKGCISLSGMICLEELSSKA

SEQ ID NO: 3375709 - protein, 24 aa, Plasmodium falciparum
YKNLRYPQCCNNLPSKEKIRTKDN

SEQ ID NO: 3375710 - protein, 17 aa, Plasmodium falciparum
YKNMGSNYICSNKTNNI

SEQ ID NO: 3375711 - protein, 17 aa, Plasmodium falciparum
YKNMKKINTGIFNMPNL

SEQ ID NO: 3375712 - protein, 23 aa, Plasmodium falciparum
YKNMSVFKFKSLYSNYQDKADDI

SEQ ID NO: 3375713 - protein, 21 aa, Plasmodium falciparum
YKNNFQISSILLKFPPRNKRY

SEQ ID NO: 3375714 - protein, 18 aa, Plasmodium falciparum
YKNNILLTYIDDICIDTI

SEQ ID NO: 3375715 - protein, 18 aa, Plasmodium falciparum
YKNNRYVNNNKILEDKNS

SEQ ID NO: 3375716 - protein, 18 aa, Plasmodium falciparum
YKNPPAYKNYVPIKNIIL

SEQ ID NO: 3375717 - protein, 18 aa, Plasmodium falciparum
YKNQLYSDMDVIILKAYK

SEQ ID NO: 3375718 - protein, 17 aa, Plasmodium falciparum
YKNRLRNLMSIGNMTNE

SEQ ID NO: 3375719 - protein, 22 aa, Plasmodium falciparum
YKNSCSSIIPSFGIKKNTNILK

SEQ ID NO: 3375720 - protein, 33 aa, Plasmodium falciparum
YKNSEKFVKKKILKYICKNEIIENVSNVFNYVK

SEQ ID NO: 3375721 - protein, 24 aa, Plasmodium falciparum
YKNSHIPNSLLIKNQINNIKENKK

SEQ ID NO: 3375722 - protein, 17 aa, Plasmodium falciparum
YKNSICDGFQDIKNNSV

SEQ ID NO: 3375723 - protein, 19 aa, Plasmodium falciparum
YKNSIKDDGALLIKQLVYI

SEQ ID NO: 3375724 - protein, 20 aa, Plasmodium falciparum
YKNSRIENALKYNNDNIDND

SEQ ID NO: 3375725 - protein, 18 aa, Plasmodium falciparum
YKNSVYIDECMRRKKGLI

SEQ ID NO: 3375726 - protein, 21 aa, Plasmodium falciparum
YKNTFLPREEIDNCSIEKIND

SEQ ID NO: 3375727 - protein, 23 aa, Plasmodium falciparum
YKNTHISKLFTFLSKKRKNNNNN

SEQ ID NO: 3375728 - protein, 19 aa, Plasmodium falciparum
YKNTLYKCKRYMSCKYIYG

SEQ ID NO: 3375729 - protein, 30 aa, Plasmodium falciparum
YKNVYFLTKREFEALCKKLEEYKENVDIHW

SEQ ID NO: 3375730 - protein, 28 aa, Plasmodium falciparum
YKNYIKDRCGYNVAEWLNMQTVKTNQTN

SEQ ID NO: 3375731 - protein, 23 aa, Plasmodium falciparum
YKNYKERYYYDKGNRIKHNNSIT

SEQ ID NO: 3375732 - protein, 24 aa, Plasmodium falciparum
YKNYNPKKVKVFFFSKNNPTELLN

SEQ ID NO: 3375733 - protein, 17 aa, Plasmodium falciparum
YKNYWSNKNINVEMNHE

SEQ ID NO: 3375734 - protein, 18 aa, Plasmodium falciparum
YKPEEGLNEDYYDIMNKK

SEQ ID NO: 3375735 - protein, 31 aa, Plasmodium falciparum
YKPKENCQICLFSATICKFLNVILNTFHIKD

SEQ ID NO: 3375736 - protein, 20 aa, Plasmodium falciparum
YKPKPKCIVNTNHVSSIFGV

SEQ ID NO: 3375737 - protein, 17 aa, Plasmodium falciparum
YKPLKTYTTSYTDLFNK

SEQ ID NO: 3375738 - protein, 18 aa, Plasmodium falciparum
YKPLNLCIEYDYFHPIGQ

SEQ ID NO: 3375739 - protein, 19 aa, Plasmodium falciparum
YKPQLFVDNIFKMKKRYEN

SEQ ID NO: 3375740 - protein, 17 aa, Plasmodium falciparum
YKQGNMYMHIPKNADLM

SEQ ID NO: 3375741 - protein, 25 aa, Plasmodium falciparum
YKQKLESILHIKIKYYEDIKIPIKM

SEQ ID NO: 3375742 - protein, 27 aa, Plasmodium falciparum
YKQKTKEIFTSPSGKRRGGKYTIDGCA

SEQ ID NO: 3375743 - protein, 18 aa, Plasmodium falciparum
YKQLAIDMGMQIANSDNE

SEQ ID NO: 3375744 - protein, 18 aa, Plasmodium falciparum
YKQLIAPQYSNKVGNVIS

SEQ ID NO: 3375745 - protein, 25 aa, Plasmodium falciparum
YKQLKRKLDELAILKDRENQIKEAN

SEQ ID NO: 3375746 - protein, 20 aa, Plasmodium falciparum
YKQMELFVMAYLSFDEQLLK

SEQ ID NO: 3375747 - protein, 18 aa, Plasmodium falciparum
YKQNYLNLMKIYKIYNRF

SEQ ID NO: 3375748 - protein, 25 aa, Plasmodium falciparum
YKQSFPPCMRRIFVNYIKDKHLKHW

SEQ ID NO: 3375749 - protein, 29 aa, Plasmodium falciparum
YKQWMKILRTVWFVSALVKARRQKFILRK

SEQ ID NO: 3375750 - protein, 23 aa, Plasmodium falciparum
YKRDIFNICFIFQYMILTNEKKK

SEQ ID NO: 3375751 - protein, 19 aa, Plasmodium falciparum
YKRKIKLYSSKNEKQNETN

SEQ ID NO: 3375752 - protein, 19 aa, Plasmodium falciparum
YKRKMNFEDNIFKIKRENI

SEQ ID NO: 3375753 - protein, 20 aa, Plasmodium falciparum
YKRNIILSHMDFMKSYSSQI

SEQ ID NO: 3375754 - protein, 21 aa, Plasmodium falciparum
YKRTYRGFTSIIMIGTNNMNY

SEQ ID NO: 3375755 - protein, 18 aa, Plasmodium falciparum
YKRVHVLYLGRLLQIVEK

SEQ ID NO: 3375756 - protein, 18 aa, Plasmodium falciparum
YKSAVAIRVLCPHVWDNL

SEQ ID NO: 3375757 - protein, 23 aa, Plasmodium falciparum
YKSDDRNACDIYKSNKKNVPDNC

SEQ ID NO: 3375758 - protein, 18 aa, Plasmodium falciparum
YKSDKTSIIFNRKNKIQQ

SEQ ID NO: 3375759 - protein, 19 aa, Plasmodium falciparum
YKSFFKNKIYHLFKEKNSF

SEQ ID NO: 3375760 - protein, 17 aa, Plasmodium falciparum
YKSFFNFVTNIKNNTEK

SEQ ID NO: 3375761 - protein, 19 aa, Plasmodium falciparum
YKSFQEFEKDVLLIINNCY

SEQ ID NO: 3375762 - protein, 29 aa, Plasmodium falciparum
YKSIKQFLKKYYVYNDIYIDEEFFHDFLL

SEQ ID NO: 3375763 - protein, 17 aa, Plasmodium falciparum
YKSIYYLNLCKMIDTKI

SEQ ID NO: 3375764 - protein, 24 aa, Plasmodium falciparum
YKSKCFSIPTYITFHIVITNNDIK

SEQ ID NO: 3375765 - protein, 25 aa, Plasmodium falciparum
YKSLEFLEIMNLYRNVDFHKNMCRV

SEQ ID NO: 3375766 - protein, 30 aa, Plasmodium falciparum
YKSLKEKGITFPVINKAEKFFVKNADMSPS

SEQ ID NO: 3375767 - protein, 17 aa, Plasmodium falciparum
YKSLYNYSIKIYRRGKY

SEQ ID NO: 3375768 - protein, 19 aa, Plasmodium falciparum
YKSNFVRPVSCFDNEGHIF

SEQ ID NO: 3375769 - protein, 19 aa, Plasmodium falciparum
YKSQSILYFFKLRDIDRKR

SEQ ID NO: 3375770 - protein, 21 aa, Plasmodium falciparum
YKSSNIFMPLGYLKINEAHLK

SEQ ID NO: 3375771 - protein, 29 aa, Plasmodium falciparum
YKTAKVHFWKWRKCRSEKEQQNYLCDIIY

SEQ ID NO: 3375772 - protein, 17 aa, Plasmodium falciparum
YKTALSLIDRLLKEVKK

SEQ ID NO: 3375773 - protein, 28 aa, Plasmodium falciparum
YKTAPCTKFLRGKCNAEEHCRHAHFVEE

SEQ ID NO: 3375774 - protein, 24 aa, Plasmodium falciparum
YKTDAPLSIKSVFYIPEEAPSRLF

SEQ ID NO: 3375775 - protein, 24 aa, Plasmodium falciparum
YKTFKDFYTHKVLKKNSINNSYKN

SEQ ID NO: 3375776 - protein, 18 aa, Plasmodium falciparum
YKTKCAILENQKDCHILE

SEQ ID NO: 3375777 - protein, 20 aa, Plasmodium falciparum
YKTKHCITNNFVHVMINTIR

SEQ ID NO: 3375778 - protein, 18 aa, Plasmodium falciparum
YKTKKFNLEKSMNLFNTN

SEQ ID NO: 3375779 - protein, 17 aa, Plasmodium falciparum
YKTLIEVVLEPSKRDTQ

SEQ ID NO: 3375780 - protein, 33 aa, Plasmodium falciparum
YKTQACQMAKDGACDYFQKCAFYHDSNDKNEAH

SEQ ID NO: 3375781 - protein, 19 aa, Plasmodium falciparum
YKTTYSVCDEAFKNHIMND

SEQ ID NO: 3375782 - protein, 17 aa, Plasmodium falciparum
YKVALYAKRKSHVLYSS

SEQ ID NO: 3375783 - protein, 17 aa, Plasmodium falciparum
YKVIPGILSATGKVKNP

SEQ ID NO: 3375784 - protein, 26 aa, Plasmodium falciparum
YKVPIYLFHHIFKWAHITQHHSYLET

SEQ ID NO: 3375785 - protein, 24 aa, Plasmodium falciparum
YKWDDGRIYFGNWLNNKQHGSGIF

SEQ ID NO: 3375786 - protein, 20 aa, Plasmodium falciparum
YKYANLFSIGEIKNIFIQLL

SEQ ID NO: 3375787 - protein, 17 aa, Plasmodium falciparum
YKYDKFYQKFRELVNVR

SEQ ID NO: 3375788 - protein, 22 aa, Plasmodium falciparum
YKYEIEKCPKESIKINTKLIND

SEQ ID NO: 3375789 - protein, 19 aa, Plasmodium falciparum
YKYEPKKSSNHFMQSNENH

SEQ ID NO: 3375790 - protein, 24 aa, Plasmodium falciparum
YKYGKKPNTLSICNQFNLYNHLTM

SEQ ID NO: 3375791 - protein, 25 aa, Plasmodium falciparum
YKYHPKCSLILRINVDFKNYKSYMS

SEQ ID NO: 3375792 - protein, 28 aa, Plasmodium falciparum
YKYIHAVNLKHFINHKVVKNHQNDIPKN

SEQ ID NO: 3375793 - protein, 18 aa, Plasmodium falciparum
YKYKCHKIANAMNDHNVG

SEQ ID NO: 3375794 - protein, 19 aa, Plasmodium falciparum
YKYKGTFKILTDFINTNII

SEQ ID NO: 3375795 - protein, 19 aa, Plasmodium falciparum
YKYKYAEQKRCKNLPREKK

SEQ ID NO: 3375796 - protein, 24 aa, Plasmodium falciparum
YKYLEHLKYSKILVYMFDINNDNI

SEQ ID NO: 3375797 - protein, 21 aa, Plasmodium falciparum
YKYLIQENIHLVTSHKDDENT

SEQ ID NO: 3375798 - protein, 18 aa, Plasmodium falciparum
YKYLKEDLFLSDSHFYKL

SEQ ID NO: 3375799 - protein, 24 aa, Plasmodium falciparum
YKYLLKHFLHLSNTFFDYYQNIIV

SEQ ID NO: 3375800 - protein, 19 aa, Plasmodium falciparum
YKYMYDFYVQNKNILKKEM

SEQ ID NO: 3375801 - protein, 18 aa, Plasmodium falciparum
YKYNIYNTYNYPNNANHI

SEQ ID NO: 3375802 - protein, 17 aa, Plasmodium falciparum
YKYSARCAKEKVEWKNY

SEQ ID NO: 3375803 - protein, 19 aa, Plasmodium falciparum
YKYSEGILKTDYWKYILED

SEQ ID NO: 3375804 - protein, 20 aa, Plasmodium falciparum
YKYSNVHISSNFAFNYLIKF

SEQ ID NO: 3375805 - protein, 25 aa, Plasmodium falciparum
YKYSYKRKLLTLFSAKNYCNKYNNN

SEQ ID NO: 3375806 - protein, 21 aa, Plasmodium falciparum
YKYTRKMLMQRMVQISIITCD

SEQ ID NO: 3375807 - protein, 25 aa, Plasmodium falciparum
YKYYRNTCISIHFILFSNLLHFHEY

SEQ ID NO: 3375808 - protein, 21 aa, Plasmodium falciparum
YLAEMLYRCNILAITGNKNDK

SEQ ID NO: 3375809 - protein, 28 aa, Plasmodium falciparum
YLAKRKEYFLAYRICEYAGIKTDNILIE

SEQ ID NO: 3375810 - protein, 19 aa, Plasmodium falciparum
YLCIPGKIENYISIIDCSG

SEQ ID NO: 3375811 - protein, 18 aa, Plasmodium falciparum
YLCKKCFRKNHRGLLASD

SEQ ID NO: 3375812 - protein, 17 aa, Plasmodium falciparum
YLCPNEAQKEYPIYHKY

SEQ ID NO: 3375813 - protein, 22 aa, Plasmodium falciparum
YLDAENLFYLLLDTHDIQAMNE

SEQ ID NO: 3375814 - protein, 27 aa, Plasmodium falciparum
YLDCPDIVILFWCFSKIGYRDNRLVNL

SEQ ID NO: 3375815 - protein, 18 aa, Plasmodium falciparum
YLDIPKKADIIISELLGS

SEQ ID NO: 3375816 - protein, 24 aa, Plasmodium falciparum
YLDKFQRKNVQNFQIKTLGGKFDK

SEQ ID NO: 3375817 - protein, 18 aa, Plasmodium falciparum
YLDLRIIDDNCSLDDYKI

SEQ ID NO: 3375818 - protein, 20 aa, Plasmodium falciparum
YLDMSRKWLSDNYVSIILQL

SEQ ID NO: 3375819 - protein, 17 aa, Plasmodium falciparum
YLEAKKMAIECRKAYNL

SEQ ID NO: 3375820 - protein, 17 aa, Plasmodium falciparum
YLEAKYHSVLSHVNIIK

SEQ ID NO: 3375821 - protein, 29 aa, Plasmodium falciparum
YLEGKRSKFPRFYFVSNLVLLKILSQGSD

SEQ ID NO: 3375822 - protein, 22 aa, Plasmodium falciparum
YLEHLLCNFNLVEFIKKHMGIT

SEQ ID NO: 3375823 - protein, 18 aa, Plasmodium falciparum
YLEIFCSKFMKDHAAFLK

SEQ ID NO: 3375824 - protein, 18 aa, Plasmodium falciparum
YLEKCSKELLVNKMKNGL

SEQ ID NO: 3375825 - protein, 17 aa, Plasmodium falciparum
YLEKFFMKDYNKNYEKM

SEQ ID NO: 3375826 - protein, 17 aa, Plasmodium falciparum
YLEKNIKRWYEEDPFIP

SEQ ID NO: 3375827 - protein, 19 aa, Plasmodium falciparum
YLEKSECLFKELKELNINF

SEQ ID NO: 3375828 - protein, 25 aa, Plasmodium falciparum
YLENEQYLKCKIGEVKNKNEQGNTA

SEQ ID NO: 3375829 - protein, 41 aa, Plasmodium falciparum
YLENKKSCMLKCEKNVFITDCFYYKNIFRNLHEFIDDKSTE

SEQ ID NO: 3375830 - protein, 21 aa, Plasmodium falciparum
YLETFPLPKITYLSNDNSIIQ

SEQ ID NO: 3375831 - protein, 25 aa, Plasmodium falciparum
YLETICIITSLILFRYINAYISYDN

SEQ ID NO: 3375832 - protein, 18 aa, Plasmodium falciparum
YLFERNILDMNPGVRSMC

SEQ ID NO: 3375833 - protein, 17 aa, Plasmodium falciparum
YLFHNHVFFLIISTKPF

SEQ ID NO: 3375834 - protein, 27 aa, Plasmodium falciparum
YLFLYPKKGIIFSFNLVNIYIYIDTDY

SEQ ID NO: 3375835 - protein, 24 aa, Plasmodium falciparum
YLGKERRKDIFLLYNNRNKEYERR

SEQ ID NO: 3375836 - protein, 17 aa, Plasmodium falciparum
YLGLMVCHISFPEFFVA

SEQ ID NO: 3375837 - protein, 23 aa, Plasmodium falciparum
YLGTTCGYLVFIFISEHFYNLVN

SEQ ID NO: 3375838 - protein, 18 aa, Plasmodium falciparum
YLGYDFLALRTFLKRGIL

SEQ ID NO: 3375839 - protein, 20 aa, Plasmodium falciparum
YLINIAIGFCALHGFKTVWL

SEQ ID NO: 3375840 - protein, 19 aa, Plasmodium falciparum
YLINRVIFKECEYENLVNK

SEQ ID NO: 3375841 - protein, 20 aa, Plasmodium falciparum
YLIPHFNIRFICYKSNHQIN

SEQ ID NO: 3375842 - protein, 24 aa, Plasmodium falciparum
YLISQCTRINRALHSIYLDIFILC

SEQ ID NO: 3375843 - protein, 24 aa, Plasmodium falciparum
YLISTRAGGLGINLTAANHVIMYD

SEQ ID NO: 3375844 - protein, 34 aa, Plasmodium falciparum
YLITEKYAPCKIIMKMCAHINQFMYNLLGVAKYD

SEQ ID NO: 3375845 - protein, 20 aa, Plasmodium falciparum
YLIVTLRSLVRVIKPEQTDA

SEQ ID NO: 3375846 - protein, 24 aa, Plasmodium falciparum
YLKAMGSACNFAWINRSSMTFLAR

SEQ ID NO: 3375847 - protein, 20 aa, Plasmodium falciparum
YLKCLDKLKFLNIMNNPICN

SEQ ID NO: 3375848 - protein, 25 aa, Plasmodium falciparum
YLKDEIKENIDIYVDVKHSLYMNEG

SEQ ID NO: 3375849 - protein, 28 aa, Plasmodium falciparum
YLKDKLYLLNILLKFYIQKIKNIMEQNI

SEQ ID NO: 3375850 - protein, 22 aa, Plasmodium falciparum
YLKKKCEAALETVEHSTDEQEC

SEQ ID NO: 3375851 - protein, 24 aa, Plasmodium falciparum
YLKKRWSKETNIELNWACDPLLYE

SEQ ID NO: 3375852 - protein, 18 aa, Plasmodium falciparum
YLKNERKGLQEEKKNISN

SEQ ID NO: 3375853 - protein, 22 aa, Plasmodium falciparum
YLKRCLLCYEDWSISKKKDLLN

SEQ ID NO: 3375854 - protein, 22 aa, Plasmodium falciparum
YLKSKVEIMKLFYTNQIKTFRE

SEQ ID NO: 3375855 - protein, 25 aa, Plasmodium falciparum
YLKSPFKYKYALRHYVFEKYKYHFY

SEQ ID NO: 3375856 - protein, 29 aa, Plasmodium falciparum
YLLESRYIKNLFSLFNYIDHTKFIYNEPK

SEQ ID NO: 3375857 - protein, 17 aa, Plasmodium falciparum
YLLKCIIKIQRAFKKYM

SEQ ID NO: 3375858 - protein, 29 aa, Plasmodium falciparum
YLLKRNFPVVYPLNWFNKLSFENISFYYL

SEQ ID NO: 3375859 - protein, 18 aa, Plasmodium falciparum
YLLLLKLLFPKNITLLRG

SEQ ID NO: 3375860 - protein, 28 aa, Plasmodium falciparum
YLLNIKKKIKLILLFSSNNIDNNVHNKN

SEQ ID NO: 3375861 - protein, 19 aa, Plasmodium falciparum
YLLQIPIRIFRHHNLENKY

SEQ ID NO: 3375862 - protein, 25 aa, Plasmodium falciparum
YLLTHLRKKLPFFKKFLNKRKIVNS

SEQ ID NO: 3375863 - protein, 19 aa, Plasmodium falciparum
YLLTNEHRNQFLLERNEDK

SEQ ID NO: 3375864 - protein, 22 aa, Plasmodium falciparum
YLMRKVEFIKILSMKYYKDNYL

SEQ ID NO: 3375865 - protein, 19 aa, Plasmodium falciparum
YLNDTFPYFDIYKNTNDAF

SEQ ID NO: 3375866 - protein, 28 aa, Plasmodium falciparum
YLNELKVLPYVSCIHCVNIRKKKVENAG

SEQ ID NO: 3375867 - protein, 18 aa, Plasmodium falciparum
YLNGRSCMNDMNMRLLNN

SEQ ID NO: 3375868 - protein, 17 aa, Plasmodium falciparum
YLNICYINSYYFLKEKR

SEQ ID NO: 3375869 - protein, 17 aa, Plasmodium falciparum
YLNIKFNIRRQMINELK

SEQ ID NO: 3375870 - protein, 22 aa, Plasmodium falciparum
YLNIKKAHFFASDLGGYLIQLY

SEQ ID NO: 3375871 - protein, 23 aa, Plasmodium falciparum
YLNIKVDKYWAYSINDKNKNNNN

SEQ ID NO: 3375872 - protein, 26 aa, Plasmodium falciparum
YLNIYYKGKCIAYYLTHININSISYK

SEQ ID NO: 3375873 - protein, 17 aa, Plasmodium falciparum
YLNNNVYNNYCYDNNFM

SEQ ID NO: 3375874 - protein, 28 aa, Plasmodium falciparum
YLNNSVSLKRSFSMLHFNRNIKNHVNYY

SEQ ID NO: 3375875 - protein, 27 aa, Plasmodium falciparum
YLNTKFQIRLSLLLKLQTETLFYIFYN

SEQ ID NO: 3375876 - protein, 17 aa, Plasmodium falciparum
YLNYYLKNFNRYIKFSK

SEQ ID NO: 3375877 - protein, 18 aa, Plasmodium falciparum
YLQRYNEQRECILPVIYK

SEQ ID NO: 3375878 - protein, 27 aa, Plasmodium falciparum
YLQYNLYFKKIRCVYHKIYRRHMNSLN

SEQ ID NO: 3375879 - protein, 23 aa, Plasmodium falciparum
YLRLENNCAIFLIYLNDDKQEDV

SEQ ID NO: 3375880 - protein, 22 aa, Plasmodium falciparum
YLRPKLTPKAYHLKNNEILNNF

SEQ ID NO: 3375881 - protein, 21 aa, Plasmodium falciparum
YLSAYTARFNYIMKRLKEERN

SEQ ID NO: 3375882 - protein, 27 aa, Plasmodium falciparum
YLSDIGIKCSLRYAIQLLTPAKILSKK

SEQ ID NO: 3375883 - protein, 23 aa, Plasmodium falciparum
YLSEVEIIHIVYLALKNRKCHLL

SEQ ID NO: 3375884 - protein, 17 aa, Plasmodium falciparum
YLSKNKFELISLNEYIK

SEQ ID NO: 3375885 - protein, 22 aa, Plasmodium falciparum
YLSNEILKFMIKYNESSKNFKM

SEQ ID NO: 3375886 - protein, 17 aa, Plasmodium falciparum
YLSNKFIRLRYIKNPIY

SEQ ID NO: 3375887 - protein, 20 aa, Plasmodium falciparum
YLSPISFTGNICKIAKDQTG

SEQ ID NO: 3375888 - protein, 19 aa, Plasmodium falciparum
YLSQYNMNVFDFFDFDKIS

SEQ ID NO: 3375889 - protein, 17 aa, Plasmodium falciparum
YLSTLIIDEIDKLIDKS

SEQ ID NO: 3375890 - protein, 26 aa, Plasmodium falciparum
YLSVKSFFQLVEWKKNSIRDILCSYI

SEQ ID NO: 3375891 - protein, 17 aa, Plasmodium falciparum
YLTCAQALGLCYGGAPA

SEQ ID NO: 3375892 - protein, 20 aa, Plasmodium falciparum
YLTCSFPKNMSLSFLQKIDF

SEQ ID NO: 3375893 - protein, 28 aa, Plasmodium falciparum
YLTLLSLRYNYFSSVKELIKFVNNLISK

SEQ ID NO: 3375894 - protein, 19 aa, Plasmodium falciparum
YLTPEELYENLTLSNVQSL

SEQ ID NO: 3375895 - protein, 25 aa, Plasmodium falciparum
YLVRTHPDLFYALTRIHEYIKGPYN

SEQ ID NO: 3375896 - protein, 17 aa, Plasmodium falciparum
YLYECYETLYTYIYNSH

SEQ ID NO: 3375897 - protein, 32 aa, Plasmodium falciparum
YLYEGKYFAALRCLRNKLEKCCFDQDTYYRLH

SEQ ID NO: 3375898 - protein, 18 aa, Plasmodium falciparum
YLYFLKYFYCIYKDNNYI

SEQ ID NO: 3375899 - protein, 17 aa, Plasmodium falciparum
YLYGLKKNIYTSGTTTD

SEQ ID NO: 3375900 - protein, 28 aa, Plasmodium falciparum
YLYICGYVYEYDRIFLLDKNFNFYSFFL

SEQ ID NO: 3375901 - protein, 20 aa, Plasmodium falciparum
YLYISWNIGNVIYRNLYNSS

SEQ ID NO: 3375902 - protein, 17 aa, Plasmodium falciparum
YLYIYKRNLVQNENVNK

SEQ ID NO: 3375903 - protein, 26 aa, Plasmodium falciparum
YLYKGKRFRVILSILLKNILHHIDNV

SEQ ID NO: 3375904 - protein, 18 aa, Plasmodium falciparum
YLYMSGYNDMEYIKDNLL

SEQ ID NO: 3375905 - protein, 18 aa, Plasmodium falciparum
YLYYLLEDIIKYKINTQL

SEQ ID NO: 3375906 - protein, 27 aa, Plasmodium falciparum
YMAYHKMSCLNYVYPYNPYRNKNYPYG

SEQ ID NO: 3375907 - protein, 17 aa, Plasmodium falciparum
YMCTLAEKLCKFKKNNF

SEQ ID NO: 3375908 - protein, 23 aa, Plasmodium falciparum
YMDPRITVAFCKKFEIPIEKVFN

SEQ ID NO: 3375909 - protein, 24 aa, Plasmodium falciparum
YMIYNCLFERIEVKNIKVKNIEVK

SEQ ID NO: 3375910 - protein, 23 aa, Plasmodium falciparum
YMKKSNCLSESYPSSGNLNNNGN

SEQ ID NO: 3375911 - protein, 23 aa, Plasmodium falciparum
YMKNRKNKKFLYEKGKKKNFKNM

SEQ ID NO: 3375912 - protein, 23 aa, Plasmodium falciparum
YMKTSEGKYLIKKNRFLYDSKNT

SEQ ID NO: 3375913 - protein, 20 aa, Plasmodium falciparum
YMNACFRKTHPSIIKNNLSE

SEQ ID NO: 3375914 - protein, 24 aa, Plasmodium falciparum
YMNEKRPNFAPIFLDQLKPRMVLY

SEQ ID NO: 3375915 - protein, 31 aa, Plasmodium falciparum
YMNISYKPIICYKCLSFFECENNYNFIRCPK

SEQ ID NO: 3375916 - protein, 26 aa, Plasmodium falciparum
YMNNFCIKWLSLFFSTIINKCILMNN

SEQ ID NO: 3375917 - protein, 23 aa, Plasmodium falciparum
YMRKPNIINVHRKKCSVDIMNKG

SEQ ID NO: 3375918 - protein, 20 aa, Plasmodium falciparum
YMRLHACSGMIIGIDENNKP

SEQ ID NO: 3375919 - protein, 24 aa, Plasmodium falciparum
YMRQLPFQYYEFMEILTKEVINVR

SEQ ID NO: 3375920 - protein, 29 aa, Plasmodium falciparum
YMSHGDKLPSGALVSFLQKALIFIYIEYH

SEQ ID NO: 3375921 - protein, 19 aa, Plasmodium falciparum
YMSNFLKKQMDSLRHSNNY

SEQ ID NO: 3375922 - protein, 17 aa, Plasmodium falciparum
YMTCPYINSYENCTENN

SEQ ID NO: 3375923 - protein, 17 aa, Plasmodium falciparum
YMTFSNSKLEPVYPYIS

SEQ ID NO: 3375924 - protein, 30 aa, Plasmodium falciparum
YMYAKEIMGEWFLCFLCFKNNKDQEEINIE

SEQ ID NO: 3375925 - protein, 17 aa, Plasmodium falciparum
YMYKFFEGEENIAKSHA

SEQ ID NO: 3375926 - protein, 25 aa, Plasmodium falciparum
YMYNLKDAYCLKKVNTKSIGVQINV

SEQ ID NO: 3375927 - protein, 18 aa, Plasmodium falciparum
YMYSQLYTKHYIFIELIF

SEQ ID NO: 3375928 - protein, 19 aa, Plasmodium falciparum
YNCACRNVFLLGFLPTSEE

SEQ ID NO: 3375929 - protein, 23 aa, Plasmodium falciparum
YNCQKLICRKCYARLHPRATNCR

SEQ ID NO: 3375930 - protein, 32 aa, Plasmodium falciparum
YNCTKNATSMLPDFSCMNGVEIMKKHINIDNI

SEQ ID NO: 3375931 - protein, 23 aa, Plasmodium falciparum
YNDCIILIDILYHLTNFGKDNYI

SEQ ID NO: 3375932 - protein, 23 aa, Plasmodium falciparum
YNDDEMDQMFSLFDPNDTGKITL

SEQ ID NO: 3375933 - protein, 17 aa, Plasmodium falciparum
YNDEHLINDQMKIRTKP

SEQ ID NO: 3375934 - protein, 18 aa, Plasmodium falciparum
YNDEIIHVNEYMKNEEEI

SEQ ID NO: 3375935 - protein, 25 aa, Plasmodium falciparum
YNDEYMFLKKCERVHSLRKELENAT

SEQ ID NO: 3375936 - protein, 25 aa, Plasmodium falciparum
YNDFKEYPIHFTYRNEKKNSSKNAF

SEQ ID NO: 3375937 - protein, 24 aa, Plasmodium falciparum
YNDHLVIYFDFFVNDFYVCNINYK

SEQ ID NO: 3375938 - protein, 17 aa, Plasmodium falciparum
YNDICFHSLNVISIDIS

SEQ ID NO: 3375939 - protein, 19 aa, Plasmodium falciparum
YNDINEFVKNNGFHTYNLL

SEQ ID NO: 3375940 - protein, 18 aa, Plasmodium falciparum
YNDKEVVEKLELYHEMHC

SEQ ID NO: 3375941 - protein, 19 aa, Plasmodium falciparum
YNDMLYLIIIQFCDEHNVN

SEQ ID NO: 3375942 - protein, 19 aa, Plasmodium falciparum
YNDNCRKLIHLIENKQKKD

SEQ ID NO: 3375943 - protein, 32 aa, Plasmodium falciparum
YNDRYRIEGKLGWGHFSTVWVATDLKSKPLKF

SEQ ID NO: 3375944 - protein, 24 aa, Plasmodium falciparum
YNDSKFLLYFLLNEEEIYKKLFEK

SEQ ID NO: 3375945 - protein, 26 aa, Plasmodium falciparum
YNDVAFFPYIWGKYFHIKLHFENLKY

SEQ ID NO: 3375946 - protein, 23 aa, Plasmodium falciparum
YNEAYKKNLNFLLQKSSMNNNNM

SEQ ID NO: 3375947 - protein, 18 aa, Plasmodium falciparum
YNECTAVFHILEYYYYPP

SEQ ID NO: 3375948 - protein, 22 aa, Plasmodium falciparum
YNEEGLRIPISIGEEKKKQDRK

SEQ ID NO: 3375949 - protein, 17 aa, Plasmodium falciparum
YNEELSLINDLKNEDNH

SEQ ID NO: 3375950 - protein, 21 aa, Plasmodium falciparum
YNEHFKYIIKNYIKNKNKDNY

SEQ ID NO: 3375951 - protein, 22 aa, Plasmodium falciparum
YNEINNIIFLEYQRKYMYRQTP

SEQ ID NO: 3375952 - protein, 25 aa, Plasmodium falciparum
YNEKKKCIYWFINYVTDMNTQMYAH

SEQ ID NO: 3375953 - protein, 19 aa, Plasmodium falciparum
YNERLCGFLDADVSKVLQK

SEQ ID NO: 3375954 - protein, 19 aa, Plasmodium falciparum
YNFADHIKDIECYINQLNE

SEQ ID NO: 3375955 - protein, 18 aa, Plasmodium falciparum
YNFANCYKNKDFVGECKN

SEQ ID NO: 3375956 - protein, 27 aa, Plasmodium falciparum
YNFIISANRKLCFLIKNKDNFIYNGIN

SEQ ID NO: 3375957 - protein, 17 aa, Plasmodium falciparum
YNFKNIVITNIFLGNIP

SEQ ID NO: 3375958 - protein, 27 aa, Plasmodium falciparum
YNFLDACVRHCFDYLFTLDSEIFNTFI

SEQ ID NO: 3375959 - protein, 46 aa, Plasmodium falciparum
YNFLDHTKLSYKWDIWSMGCVFQEMMNLPSPFQHYIITFDESDQIY

SEQ ID NO: 3375960 - protein, 20 aa, Plasmodium falciparum
YNFLKMSYKYADYNYSLACA

SEQ ID NO: 3375961 - protein, 20 aa, Plasmodium falciparum
YNFLKSLRIFDEGLMNEIGL

SEQ ID NO: 3375962 - protein, 29 aa, Plasmodium falciparum
YNFLRPVFKRNAKWSAIKPVPDIGDENTD

SEQ ID NO: 3375963 - protein, 26 aa, Plasmodium falciparum
YNFNAKRTSSAWFLNPAYENYMLEEK

SEQ ID NO: 3375964 - protein, 27 aa, Plasmodium falciparum
YNFPKNDLFKLSYKVSMNNIRNLYIAN

SEQ ID NO: 3375965 - protein, 19 aa, Plasmodium falciparum
YNFVHTLKKYIILRDSPYL

SEQ ID NO: 3375966 - protein, 27 aa, Plasmodium falciparum
YNGEIKCKGCNNVGFVEKIDEDDPLSF

SEQ ID NO: 3375967 - protein, 17 aa, Plasmodium falciparum
YNGIITCDMSLFYNNNH

SEQ ID NO: 3375968 - protein, 26 aa, Plasmodium falciparum
YNGKLKSYWLPGFFNPQGFLTSMKQE

SEQ ID NO: 3375969 - protein, 29 aa, Plasmodium falciparum
YNGSSKILLCYKNNYNICFSYKPYNENIY

SEQ ID NO: 3375970 - protein, 17 aa, Plasmodium falciparum
YNHASLIKSKRDNKLLC

SEQ ID NO: 3375971 - protein, 19 aa, Plasmodium falciparum
YNHMVNGNVVSEFIKNDDM

SEQ ID NO: 3375972 - protein, 62 aa, Plasmodium falciparum
YNHNKNCSFVFKIPTCCICEFDAFYIGGGPIKRTKKKNEWCHIRCALISNCIINNKIEINNK

SEQ ID NO: 3375973 - protein, 25 aa, Plasmodium falciparum
YNHSLCLSHDNILYAWGHGNYNGLK

SEQ ID NO: 3375974 - protein, 17 aa, Plasmodium falciparum
YNHTTCNNFNKNINNNI

SEQ ID NO: 3375975 - protein, 36 aa, Plasmodium falciparum
YNIEAYLMECLKVLIPLNMRDIFLGSENIILDSMNT

SEQ ID NO: 3375976 - protein, 27 aa, Plasmodium falciparum
YNIGFTAIRHLGRIKNLLTNVSSNNNN

SEQ ID NO: 3375977 - protein, 22 aa, Plasmodium falciparum
YNIHTNQCFHRDLKLSNILLDE

SEQ ID NO: 3375978 - protein, 22 aa, Plasmodium falciparum
YNIKENFWIKARRTSTLVRKNK

SEQ ID NO: 3375979 - protein, 17 aa, Plasmodium falciparum
YNIKKLWIIVKDLPEKY

SEQ ID NO: 3375980 - protein, 18 aa, Plasmodium falciparum
YNILHECNKNGDVYNSHI

SEQ ID NO: 3375981 - protein, 22 aa, Plasmodium falciparum
YNINPYNCFTLYTKERTYDFFS

SEQ ID NO: 3375982 - protein, 20 aa, Plasmodium falciparum
YNISRFLQRYGTTTPNTQHN

SEQ ID NO: 3375983 - protein, 17 aa, Plasmodium falciparum
YNIVGGLFEDVYHEEDW

SEQ ID NO: 3375984 - protein, 17 aa, Plasmodium falciparum
YNIVKACVEGGCHYVDV

SEQ ID NO: 3375985 - protein, 36 aa, Plasmodium falciparum
YNIYEAIYHILSFEKKHRFQELLKFQNALKYGLNNN

SEQ ID NO: 3375986 - protein, 23 aa, Plasmodium falciparum
YNIYKKRAYMLIKGYNKKVDINL

SEQ ID NO: 3375987 - protein, 19 aa, Plasmodium falciparum
YNIYKRLALIKNDHNSSTN

SEQ ID NO: 3375988 - protein, 17 aa, Plasmodium falciparum
YNIYLFKQNFRPLFDEY

SEQ ID NO: 3375989 - protein, 17 aa, Plasmodium falciparum
YNIYVKNIFKFIHTNLL

SEQ ID NO: 3375990 - protein, 22 aa, Plasmodium falciparum
YNKGICCNYIKEISINSGGKIN

SEQ ID NO: 3375991 - protein, 25 aa, Plasmodium falciparum
YNKIPFLICTKKFIEQNKGFDITKF

SEQ ID NO: 3375992 - protein, 24 aa, Plasmodium falciparum
YNKKEKKIIKREHKKEEDFTIYNF

SEQ ID NO: 3375993 - protein, 24 aa, Plasmodium falciparum
YNKKLCFPQNNLLSDFRSEPIIIQ

SEQ ID NO: 3375994 - protein, 32 aa, Plasmodium falciparum
YNKKRNETLFSIFFYLHWDISKNVLYRISKYC

SEQ ID NO: 3375995 - protein, 18 aa, Plasmodium falciparum
YNKLKGYISNIGYGNLFN

SEQ ID NO: 3375996 - protein, 25 aa, Plasmodium falciparum
YNKLKTCLILFSPIIEMHKRHKQYV

SEQ ID NO: 3375997 - protein, 19 aa, Plasmodium falciparum
YNKNQIIFKPVFYPYKNVE

SEQ ID NO: 3375998 - protein, 21 aa, Plasmodium falciparum
YNKPLIRRGAILLKKNQVIIL

SEQ ID NO: 3375999 - protein, 17 aa, Plasmodium falciparum
YNKSIPFILRRYLPNGS

SEQ ID NO: 3376000 - protein, 25 aa, Plasmodium falciparum
YNKYDEWLDVCFEKFLNLLFQLLKN

SEQ ID NO: 3376001 - protein, 26 aa, Plasmodium falciparum
YNKYWFGLKLGQFESSGNWKIVIIIT

SEQ ID NO: 3376002 - protein, 17 aa, Plasmodium falciparum
YNLFQMQVNILKRSIEL

SEQ ID NO: 3376003 - protein, 19 aa, Plasmodium falciparum
YNLFYIIENIYRGFNKKIW

SEQ ID NO: 3376004 - protein, 23 aa, Plasmodium falciparum
YNLGKARQYLCPKVQEYGIPGQV

SEQ ID NO: 3376005 - protein, 29 aa, Plasmodium falciparum
YNLIDKKGLTRVLVQAVLDLEKSKVPADS

SEQ ID NO: 3376006 - protein, 25 aa, Plasmodium falciparum
YNLKILCYHNRNLYKYLYYGKGSSL

SEQ ID NO: 3376007 - protein, 17 aa, Plasmodium falciparum
YNLKKSFLKKLFKKQYL

SEQ ID NO: 3376008 - protein, 29 aa, Plasmodium falciparum
YNLKLKRASELSVPHRILGNTSISKNDSD

SEQ ID NO: 3376009 - protein, 25 aa, Plasmodium falciparum
YNLKVLLKRQEHFNPFTIFGTSVKE

SEQ ID NO: 3376010 - protein, 23 aa, Plasmodium falciparum
YNLKYVKFKLSFLNEYSPDDIKF

SEQ ID NO: 3376011 - protein, 27 aa, Plasmodium falciparum
YNLLLNGYYSIKWKQNIEWKNYLNKIN

SEQ ID NO: 3376012 - protein, 18 aa, Plasmodium falciparum
YNLNKAWVNHFIDAGAGE

SEQ ID NO: 3376013 - protein, 17 aa, Plasmodium falciparum
YNLNYDWNVYKKQRGLF

SEQ ID NO: 3376014 - protein, 27 aa, Plasmodium falciparum
YNLNYLPKCALACIKALIKKNKSTTTD

SEQ ID NO: 3376015 - protein, 29 aa, Plasmodium falciparum
YNLPEKEISPLCSFLLPMLSVDPQTRPSA

SEQ ID NO: 3376016 - protein, 17 aa, Plasmodium falciparum
YNLPFKVSRTISGNLPV

SEQ ID NO: 3376017 - protein, 24 aa, Plasmodium falciparum
YNLWRWGCPGDSLFSSIKVGEKNK

SEQ ID NO: 3376018 - protein, 24 aa, Plasmodium falciparum
YNLYNEAFMDMNISYNGLMNNNLN

SEQ ID NO: 3376019 - protein, 23 aa, Plasmodium falciparum
YNMAKYIKWILLIIIEKGIALTN

SEQ ID NO: 3376020 - protein, 26 aa, Plasmodium falciparum
YNMNNCTRKNSSFNYNVTDNICHGNE

SEQ ID NO: 3376021 - protein, 22 aa, Plasmodium falciparum
YNMYNYNYMNGMNNVNTLNTIN

SEQ ID NO: 3376022 - protein, 25 aa, Plasmodium falciparum
YNNAEAFKKLRLYYHQISYNNLNKD

SEQ ID NO: 3376023 - protein, 18 aa, Plasmodium falciparum
YNNFLFKIPTGMGKTLIY

SEQ ID NO: 3376024 - protein, 27 aa, Plasmodium falciparum
YNNFNNPCCSFSCNIYDYYDILKIEEL

SEQ ID NO: 3376025 - protein, 17 aa, Plasmodium falciparum
YNNIKFGNIKNEKSNKI

SEQ ID NO: 3376026 - protein, 17 aa, Plasmodium falciparum
YNNIKGSYLNNNQQVGG

SEQ ID NO: 3376027 - protein, 18 aa, Plasmodium falciparum
YNNIREMYLYPSRIEKCR

SEQ ID NO: 3376028 - protein, 19 aa, Plasmodium falciparum
YNNKGCMQSKCNQNKKDEE

SEQ ID NO: 3376029 - protein, 24 aa, Plasmodium falciparum
YNNKKKLYAYHTFNGSEQTRRKGY

SEQ ID NO: 3376030 - protein, 19 aa, Plasmodium falciparum
YNNKLCYDESGKIFIRGDK

SEQ ID NO: 3376031 - protein, 23 aa, Plasmodium falciparum
YNNKLKGCAPISVNSENKDEEKK

SEQ ID NO: 3376032 - protein, 23 aa, Plasmodium falciparum
YNNKYGRKSIDGIKKNKQPSYRY

SEQ ID NO: 3376033 - protein, 23 aa, Plasmodium falciparum
YNNLEKRAAGGLYNTKPGVETLP

SEQ ID NO: 3376034 - protein, 24 aa, Plasmodium falciparum
YNNLFINSKCEWIDILEIEMKNMY

SEQ ID NO: 3376035 - protein, 22 aa, Plasmodium falciparum
YNNLHITNCLLFKKETTEEVLK

SEQ ID NO: 3376036 - protein, 26 aa, Plasmodium falciparum
YNNLHKLRKAFFYSRVVINNFEIKNN

SEQ ID NO: 3376037 - protein, 26 aa, Plasmodium falciparum
YNNLIKKFYCNFTFEDIILILQSYAL

SEQ ID NO: 3376038 - protein, 17 aa, Plasmodium falciparum
YNNLILPDGSEAINRKL

SEQ ID NO: 3376039 - protein, 26 aa, Plasmodium falciparum
YNNLKDWMKNMCNILEYLNIKKAHFF

SEQ ID NO: 3376040 - protein, 24 aa, Plasmodium falciparum
YNNLPEIFRRGTIIIRNKTFQKKN

SEQ ID NO: 3376041 - protein, 18 aa, Plasmodium falciparum
YNNMNGRLLNNMNNVNLI

SEQ ID NO: 3376042 - protein, 25 aa, Plasmodium falciparum
YNNMSVENYMGYPYYYSQYYNVGPH

SEQ ID NO: 3376043 - protein, 24 aa, Plasmodium falciparum
YNNNIPLDIGIYICNKNAKLFRLL

SEQ ID NO: 3376044 - protein, 17 aa, Plasmodium falciparum
YNNNSIFLLSKKEINHH

SEQ ID NO: 3376045 - protein, 17 aa, Plasmodium falciparum
YNNQTMEAWRCLYHLDK

SEQ ID NO: 3376046 - protein, 26 aa, Plasmodium falciparum
YNNSCIPPPLKKMIPIDGVRNKSINK

SEQ ID NO: 3376047 - protein, 23 aa, Plasmodium falciparum
YNNSNCKIQEFIMPLDNNDSTLQ

SEQ ID NO: 3376048 - protein, 20 aa, Plasmodium falciparum
YNNYMSSYGYVNMPTNNNIN

SEQ ID NO: 3376049 - protein, 27 aa, Plasmodium falciparum
YNNYYKMNDMLGGIILPNNNQLNNMDN

SEQ ID NO: 3376050 - protein, 24 aa, Plasmodium falciparum
YNPKILYEYVFPVIYRHLHRSVRR

SEQ ID NO: 3376051 - protein, 29 aa, Plasmodium falciparum
YNPKKAYCFKHTFQYCKKSNFLNFINANK

SEQ ID NO: 3376052 - protein, 18 aa, Plasmodium falciparum
YNPLCFDEVLNINKFKNK

SEQ ID NO: 3376053 - protein, 31 aa, Plasmodium falciparum
YNPMKSYHSYSMRSSHPYRLNIHNNKYSRAG

SEQ ID NO: 3376054 - protein, 18 aa, Plasmodium falciparum
YNPMYYYNYNNIKGNNQT

SEQ ID NO: 3376055 - protein, 22 aa, Plasmodium falciparum
YNPYKINNFLSVDKNNILHLFT

SEQ ID NO: 3376056 - protein, 19 aa, Plasmodium falciparum
YNPYNYYNGCTTIDNELNE

SEQ ID NO: 3376057 - protein, 21 aa, Plasmodium falciparum
YNQHFFPNLNFLLNLHTLQIL

SEQ ID NO: 3376058 - protein, 18 aa, Plasmodium falciparum
YNQIRHMVAILFLVGKGL

SEQ ID NO: 3376059 - protein, 17 aa, Plasmodium falciparum
YNQKKSSSLFLYDIDNM

SEQ ID NO: 3376060 - protein, 25 aa, Plasmodium falciparum
YNQKTLECITSFYVYFNKSENLIFP

SEQ ID NO: 3376061 - protein, 31 aa, Plasmodium falciparum
YNQYLFKKKLECIEKILFFYFNVYKQRIFFL

SEQ ID NO: 3376062 - protein, 19 aa, Plasmodium falciparum
YNRCLCAWYCKYKYRHVYK

SEQ ID NO: 3376063 - protein, 20 aa, Plasmodium falciparum
YNRFYLKEIILEYDPRILIF

SEQ ID NO: 3376064 - protein, 24 aa, Plasmodium falciparum
YNRINEIYHSFSLTEIIVLFHAYC

SEQ ID NO: 3376065 - protein, 21 aa, Plasmodium falciparum
YNRLFCCHLVNLPLYKKRSHL

SEQ ID NO: 3376066 - protein, 18 aa, Plasmodium falciparum
YNRLLKFLIKSVKNNIKL

SEQ ID NO: 3376067 - protein, 18 aa, Plasmodium falciparum
YNRTYRKVPHENYTDNMN

SEQ ID NO: 3376068 - protein, 19 aa, Plasmodium falciparum
YNSDENLFFGNKGNKPNMN

SEQ ID NO: 3376069 - protein, 19 aa, Plasmodium falciparum
YNSECSFLINVPSSIPSIS

SEQ ID NO: 3376070 - protein, 26 aa, Plasmodium falciparum
YNSEKADIWSLGIILYAMLFGLLPYD

SEQ ID NO: 3376071 - protein, 19 aa, Plasmodium falciparum
YNSFFLNNFLDSIKSDIPS

SEQ ID NO: 3376072 - protein, 26 aa, Plasmodium falciparum
YNSFLAYSICSIFYSYLKLSGDVLTN

SEQ ID NO: 3376073 - protein, 29 aa, Plasmodium falciparum
YNSFNVNFSFRFPTFIAILQFCSQNNIFH

SEQ ID NO: 3376074 - protein, 19 aa, Plasmodium falciparum
YNSGMSICPNIYCNIYTDL

SEQ ID NO: 3376075 - protein, 17 aa, Plasmodium falciparum
YNSISNLNNAYNAAYNI

SEQ ID NO: 3376076 - protein, 29 aa, Plasmodium falciparum
YNSLCNPGESIGILVAQSFGEPATQMTLN

SEQ ID NO: 3376077 - protein, 17 aa, Plasmodium falciparum
YNSPLCVSIDSCNLKEI

SEQ ID NO: 3376078 - protein, 22 aa, Plasmodium falciparum
YNSPYLFWNFLRNVEDQKVQSY

SEQ ID NO: 3376079 - protein, 17 aa, Plasmodium falciparum
YNSYFLKTLLEGSLYEK

SEQ ID NO: 3376080 - protein, 18 aa, Plasmodium falciparum
YNSYREFFLKSGGNKSIS

SEQ ID NO: 3376081 - protein, 17 aa, Plasmodium falciparum
YNSYSHKPVQIYIKIVD

SEQ ID NO: 3376082 - protein, 21 aa, Plasmodium falciparum
YNTCGVPFLFNQRFQNLPDFY

SEQ ID NO: 3376083 - protein, 19 aa, Plasmodium falciparum
YNTFEYKRNIILSHMDFMK

SEQ ID NO: 3376084 - protein, 31 aa, Plasmodium falciparum
YNTFNIPYAIYNCYKNIMNNYHYFTSTLCPQ

SEQ ID NO: 3376085 - protein, 21 aa, Plasmodium falciparum
YNTKNDWTGLVKYNTSKGIVK

SEQ ID NO: 3376086 - protein, 19 aa, Plasmodium falciparum
YNTMEGVGPCHNIHPMINT

SEQ ID NO: 3376087 - protein, 25 aa, Plasmodium falciparum
YNTSEKKTKCALEKEVNDEEIKTRE

SEQ ID NO: 3376088 - protein, 17 aa, Plasmodium falciparum
YNTYRRYNSLSRTYHQN

SEQ ID NO: 3376089 - protein, 17 aa, Plasmodium falciparum
YNVDNSFIKNEKNKKEF

SEQ ID NO: 3376090 - protein, 25 aa, Plasmodium falciparum
YNVLLKRRCSILSEEIKDGYFLYCI

SEQ ID NO: 3376091 - protein, 25 aa, Plasmodium falciparum
YNVLLKVSVHISGLYNTFMDILNYN

SEQ ID NO: 3376092 - protein, 24 aa, Plasmodium falciparum
YNVRTDKYFIFRIHLKSDIDPSIW

SEQ ID NO: 3376093 - protein, 24 aa, Plasmodium falciparum
YNVYKTPRLDKIRKNHKYNSHPQI

SEQ ID NO: 3376094 - protein, 19 aa, Plasmodium falciparum
YNYDMINQGNLNYMYNPLN

SEQ ID NO: 3376095 - protein, 22 aa, Plasmodium falciparum
YNYKCDMWSSGVLFYILLCGYP

SEQ ID NO: 3376096 - protein, 17 aa, Plasmodium falciparum
YNYKEAFHIIACKKKIV

SEQ ID NO: 3376097 - protein, 19 aa, Plasmodium falciparum
YNYKFMIYTFFKWLLENPF

SEQ ID NO: 3376098 - protein, 21 aa, Plasmodium falciparum
YNYKYGDFVILCRTNKTLKET

SEQ ID NO: 3376099 - protein, 26 aa, Plasmodium falciparum
YNYLCNIKNLLLICKYLDIIEIYQVE

SEQ ID NO: 3376100 - protein, 20 aa, Plasmodium falciparum
YNYLDPYAIILNRTSFTIIT

SEQ ID NO: 3376101 - protein, 25 aa, Plasmodium falciparum
YNYLSFKKILGYGAFGEVHLVEDNI

SEQ ID NO: 3376102 - protein, 17 aa, Plasmodium falciparum
YNYMKGRNNNVFHQSIE

SEQ ID NO: 3376103 - protein, 36 aa, Plasmodium falciparum
YNYMTFKQLRIFYNFYHILKFIIFKVNNFSISDFTQ

SEQ ID NO: 3376104 - protein, 35 aa, Plasmodium falciparum
YNYYFDDYFYFFIKSCYDLDLYIKIQRKNIFLTDE

SEQ ID NO: 3376105 - protein, 21 aa, Plasmodium falciparum
YNYYVNYIFIYLQKSSISEYY

SEQ ID NO: 3376106 - protein, 27 aa, Plasmodium falciparum
YPDDWKIPCIDALFISNVARFLNHSCE

SEQ ID NO: 3376107 - protein, 19 aa, Plasmodium falciparum
YPDEFPFSIPYSIEKCLKK

SEQ ID NO: 3376108 - protein, 24 aa, Plasmodium falciparum
YPDGSVWCCEGHISRLHNTEEISL

SEQ ID NO: 3376109 - protein, 24 aa, Plasmodium falciparum
YPDKGPPIVRVFENVGVYNVSLIR

SEQ ID NO: 3376110 - protein, 18 aa, Plasmodium falciparum
YPDKSCDGDDIINSDFSY

SEQ ID NO: 3376111 - protein, 18 aa, Plasmodium falciparum
YPDLIKIQRFLQIYNSTM

SEQ ID NO: 3376112 - protein, 22 aa, Plasmodium falciparum
YPELKIPPFKSVFKEINGKEPE

SEQ ID NO: 3376113 - protein, 22 aa, Plasmodium falciparum
YPENKLPTILIYYNGTCIHQIC

SEQ ID NO: 3376114 - protein, 21 aa, Plasmodium falciparum
YPEYNFMGLIIGPRGCNHKRL

SEQ ID NO: 3376115 - protein, 17 aa, Plasmodium falciparum
YPFFCIESTKKLVKSLN

SEQ ID NO: 3376116 - protein, 18 aa, Plasmodium falciparum
YPFFITKYVNYIKEQILL

SEQ ID NO: 3376117 - protein, 18 aa, Plasmodium falciparum
YPFGMGIVVDISKNSSKG

SEQ ID NO: 3376118 - protein, 17 aa, Plasmodium falciparum
YPFKLRVQYNVNYMLNY

SEQ ID NO: 3376119 - protein, 18 aa, Plasmodium falciparum
YPHISHNSIAPKIKKKKM

SEQ ID NO: 3376120 - protein, 17 aa, Plasmodium falciparum
YPHLLSIKSCFVRGSVV

SEQ ID NO: 3376121 - protein, 17 aa, Plasmodium falciparum
YPHVANFNMMMNTTNPV

SEQ ID NO: 3376122 - protein, 17 aa, Plasmodium falciparum
YPIANVLNFNECMKDKL

SEQ ID NO: 3376123 - protein, 25 aa, Plasmodium falciparum
YPIDFNSICEILRKINTLRIKGIGG

SEQ ID NO: 3376124 - protein, 17 aa, Plasmodium falciparum
YPIDWRNGGRFLLCVGM

SEQ ID NO: 3376125 - protein, 19 aa, Plasmodium falciparum
YPIFIDYFNIFVLQIKNYK

SEQ ID NO: 3376126 - protein, 20 aa, Plasmodium falciparum
YPIKNLIVIYDLINRDQFIF

SEQ ID NO: 3376127 - protein, 17 aa, Plasmodium falciparum
YPIQRDSLVPLCSSHPI

SEQ ID NO: 3376128 - protein, 26 aa, Plasmodium falciparum
YPLEIIKMIYKFLISKSLYKLNINIL

SEQ ID NO: 3376129 - protein, 19 aa, Plasmodium falciparum
YPLFIGYSRKRFIAHCMND

SEQ ID NO: 3376130 - protein, 17 aa, Plasmodium falciparum
YPMSRTTTPNVINSISM

SEQ ID NO: 3376131 - protein, 23 aa, Plasmodium falciparum
YPNESYCKLVPNAGSEKIYAWTV

SEQ ID NO: 3376132 - protein, 23 aa, Plasmodium falciparum
YPNFNLKYPMNMDMFNNNNNNNN

SEQ ID NO: 3376133 - protein, 34 aa, Plasmodium falciparum
YPNHLDFKKAYFFIFKDDIYIYGARNNQYIIPDA

SEQ ID NO: 3376134 - protein, 19 aa, Plasmodium falciparum
YPNKIIYFLVYINDKETSI

SEQ ID NO: 3376135 - protein, 25 aa, Plasmodium falciparum
YPNMSYNRLISYLTLYNSIKKKMKL

SEQ ID NO: 3376136 - protein, 19 aa, Plasmodium falciparum
YPNVFPPFTCEKHMDALKK

SEQ ID NO: 3376137 - protein, 19 aa, Plasmodium falciparum
YPNYHFLNFINIEEIHLSK

SEQ ID NO: 3376138 - protein, 19 aa, Plasmodium falciparum
YPPLCDIKNSFTSQMEHTI

SEQ ID NO: 3376139 - protein, 21 aa, Plasmodium falciparum
YPRQVGPWKEYYSGEGRPYYY

SEQ ID NO: 3376140 - protein, 18 aa, Plasmodium falciparum
YPSHHLLELASLSISRFI

SEQ ID NO: 3376141 - protein, 17 aa, Plasmodium falciparum
YPSIYFTKHVYTAPEID

SEQ ID NO: 3376142 - protein, 21 aa, Plasmodium falciparum
YPSKFCLTCTGILIDSQYEKY

SEQ ID NO: 3376143 - protein, 28 aa, Plasmodium falciparum
YPSRVALPLLASWVVFNQPLSILAVEKL

SEQ ID NO: 3376144 - protein, 23 aa, Plasmodium falciparum
YPSSLKNFPLLKAHNEFISNLPN

SEQ ID NO: 3376145 - protein, 17 aa, Plasmodium falciparum
YPTSCSVSNSYSESNRS

SEQ ID NO: 3376146 - protein, 19 aa, Plasmodium falciparum
YPTYEGMIIGEHFLSNDIE

SEQ ID NO: 3376147 - protein, 18 aa, Plasmodium falciparum
YPVFHIGYYKYIIHILYC

SEQ ID NO: 3376148 - protein, 20 aa, Plasmodium falciparum
YPYCNNVLYNGGMDNHPFYF

SEQ ID NO: 3376149 - protein, 19 aa, Plasmodium falciparum
YPYDKNGYEKTLNININKE

SEQ ID NO: 3376150 - protein, 17 aa, Plasmodium falciparum
YPYGDISPVPVHKNEKK

SEQ ID NO: 3376151 - protein, 41 aa, Plasmodium falciparum
YPYGNLPNIYYPDGYYANYCYPNYYYPIYYYPNYYYPNNYY

SEQ ID NO: 3376152 - protein, 18 aa, Plasmodium falciparum
YPYKSVMQEYIKGNDLSN

SEQ ID NO: 3376153 - protein, 17 aa, Plasmodium falciparum
YPYNYYKGFEELKPLRK

SEQ ID NO: 3376154 - protein, 23 aa, Plasmodium falciparum
YPYRYESNRNIFLIINSENINLG

SEQ ID NO: 3376155 - protein, 23 aa, Plasmodium falciparum
YQAYKLAAEFRNRILENNKGKYY

SEQ ID NO: 3376156 - protein, 18 aa, Plasmodium falciparum
YQCIKKDFIYNILKQEIK

SEQ ID NO: 3376157 - protein, 33 aa, Plasmodium falciparum
YQDFKILFRNLLKCFSLFYALSYIEFDFIIDII

SEQ ID NO: 3376158 - protein, 29 aa, Plasmodium falciparum
YQDILYAYEICFFIGKKLKFFKKEKSVLD

SEQ ID NO: 3376159 - protein, 19 aa, Plasmodium falciparum
YQDLFLFKDNFNVCEEDMD

SEQ ID NO: 3376160 - protein, 19 aa, Plasmodium falciparum
YQDRTHRIDSHVFDSSVLP

SEQ ID NO: 3376161 - protein, 23 aa, Plasmodium falciparum
YQDSKKAFCANWYSNGKQEKRYF

SEQ ID NO: 3376162 - protein, 19 aa, Plasmodium falciparum
YQEGIKSYLGDVANQMKIY

SEQ ID NO: 3376163 - protein, 20 aa, Plasmodium falciparum
YQFCLEHFINFFTYSITKYK

SEQ ID NO: 3376164 - protein, 26 aa, Plasmodium falciparum
YQFFKTYDIISALKLSSYKDNLYGNH

SEQ ID NO: 3376165 - protein, 17 aa, Plasmodium falciparum
YQGWAFGIGLERLCMLL

SEQ ID NO: 3376166 - protein, 18 aa, Plasmodium falciparum
YQICCKSIADINTHNLNK

SEQ ID NO: 3376167 - protein, 25 aa, Plasmodium falciparum
YQIDVKFPLTDDIPCTVDESNLSDD

SEQ ID NO: 3376168 - protein, 17 aa, Plasmodium falciparum
YQIKCKRKDSLHSKWEK

SEQ ID NO: 3376169 - protein, 18 aa, Plasmodium falciparum
YQINSFYKLFEYLKLNDI

SEQ ID NO: 3376170 - protein, 19 aa, Plasmodium falciparum
YQISCTINFEIKKNDNLLL

SEQ ID NO: 3376171 - protein, 17 aa, Plasmodium falciparum
YQKEFYNNNDFIHKYND

SEQ ID NO: 3376172 - protein, 23 aa, Plasmodium falciparum
YQKILVITCLLFDFFQNKKHVNI

SEQ ID NO: 3376173 - protein, 24 aa, Plasmodium falciparum
YQKKDIYCCMFAEMFKSIIRNHIK

SEQ ID NO: 3376174 - protein, 17 aa, Plasmodium falciparum
YQKKSSFLFNKNNFHMI

SEQ ID NO: 3376175 - protein, 22 aa, Plasmodium falciparum
YQKMYRNHIKKIGVGHLSALRL

SEQ ID NO: 3376176 - protein, 23 aa, Plasmodium falciparum
YQKSTRIFKEIEIMKKLKHPNIV

SEQ ID NO: 3376177 - protein, 18 aa, Plasmodium falciparum
YQKTIPYNFTKCTFSSNS

SEQ ID NO: 3376178 - protein, 17 aa, Plasmodium falciparum
YQKWKYIIRDDIIFDMN

SEQ ID NO: 3376179 - protein, 24 aa, Plasmodium falciparum
YQLDNLSTLGFRVISLQYPCYNNL

SEQ ID NO: 3376180 - protein, 17 aa, Plasmodium falciparum
YQLFNIMVHMDFEVGIF

SEQ ID NO: 3376181 - protein, 18 aa, Plasmodium falciparum
YQLMYSIIICNKVEKADA

SEQ ID NO: 3376182 - protein, 20 aa, Plasmodium falciparum
YQMLCIKFLLKRGKTKKRKK

SEQ ID NO: 3376183 - protein, 25 aa, Plasmodium falciparum
YQNEYRIFGIRNCYNLMENRNNQQL

SEQ ID NO: 3376184 - protein, 24 aa, Plasmodium falciparum
YQNMKCVSRPTLNVSSLNMKDMNV

SEQ ID NO: 3376185 - protein, 25 aa, Plasmodium falciparum
YQNRLEPQLLFGRGYIAGIDVREQR

SEQ ID NO: 3376186 - protein, 19 aa, Plasmodium falciparum
YQQMIYKNIHLNYLRQVEN

SEQ ID NO: 3376187 - protein, 18 aa, Plasmodium falciparum
YQQNCEINICLNIINKII

SEQ ID NO: 3376188 - protein, 18 aa, Plasmodium falciparum
YQQTKRGKLCVIDLAGSE

SEQ ID NO: 3376189 - protein, 32 aa, Plasmodium falciparum
YQRGETYPGSFQFIFELAMNKLAAEAKPLLLS

SEQ ID NO: 3376190 - protein, 34 aa, Plasmodium falciparum
YQRNINCWKEVMWRLGIPELHYYNSVRNDFFDSR

SEQ ID NO: 3376191 - protein, 19 aa, Plasmodium falciparum
YQSLLKIEYHLETKIIQLE

SEQ ID NO: 3376192 - protein, 29 aa, Plasmodium falciparum
YQSPYNRFNIQAGYRWDGVIRGNGFEERR

SEQ ID NO: 3376193 - protein, 23 aa, Plasmodium falciparum
YQVDCLIEKPYLVYHNIIKMVPT

SEQ ID NO: 3376194 - protein, 24 aa, Plasmodium falciparum
YQVEKILKCCSTILLTGPLREVII

SEQ ID NO: 3376195 - protein, 18 aa, Plasmodium falciparum
YQVLEEFGYIKPELNEYN

SEQ ID NO: 3376196 - protein, 22 aa, Plasmodium falciparum
YQWKNVFDLIEIIKYLGKQIIK

SEQ ID NO: 3376197 - protein, 18 aa, Plasmodium falciparum
YQYDWGTVTSAFWLKYPN

SEQ ID NO: 3376198 - protein, 29 aa, Plasmodium falciparum
YQYENVNIFKLLALFGWSYKSPQDDEHTQ

SEQ ID NO: 3376199 - protein, 19 aa, Plasmodium falciparum
YRANAIRVLSKIIDFSLAT

SEQ ID NO: 3376200 - protein, 23 aa, Plasmodium falciparum
YRAPEVLFNPSILGLEYLGLSEL

SEQ ID NO: 3376201 - protein, 21 aa, Plasmodium falciparum
YRDEMKCILKNIYSHKETNNN

SEQ ID NO: 3376202 - protein, 18 aa, Plasmodium falciparum
YRDYSFLFLTDYDIFMKL

SEQ ID NO: 3376203 - protein, 32 aa, Plasmodium falciparum
YRFGTKSCDSSLCCCGCFIPVCYQSQRHEYYV

SEQ ID NO: 3376204 - protein, 22 aa, Plasmodium falciparum
YRFIDLKGFMLKKFDRRFLRVF

SEQ ID NO: 3376205 - protein, 17 aa, Plasmodium falciparum
YRFPTLCMISFCLSYLG

SEQ ID NO: 3376206 - protein, 23 aa, Plasmodium falciparum
YRGNVSPNIMDMVHRMNNNMKDG

SEQ ID NO: 3376207 - protein, 25 aa, Plasmodium falciparum
YRHFKEIQLKTNIEWNIKNITLNDI

SEQ ID NO: 3376208 - protein, 18 aa, Plasmodium falciparum
YRHLCEYVSLDIEMTYKF

SEQ ID NO: 3376209 - protein, 17 aa, Plasmodium falciparum
YRHLGKWECAHADIEQG

SEQ ID NO: 3376210 - protein, 21 aa, Plasmodium falciparum
YRHLLYMTGHLFSSRFYRRFG

SEQ ID NO: 3376211 - protein, 19 aa, Plasmodium falciparum
YRHNNILSLLGYATNKNNF

SEQ ID NO: 3376212 - protein, 20 aa, Plasmodium falciparum
YRHTYLKTIYIWYKKNKKLL

SEQ ID NO: 3376213 - protein, 17 aa, Plasmodium falciparum
YRIIKQMKQQIGKGNHM

SEQ ID NO: 3376214 - protein, 17 aa, Plasmodium falciparum
YRILNYLSDEEIKWLKC

SEQ ID NO: 3376215 - protein, 21 aa, Plasmodium falciparum
YRINYSGCLNFIPFFQDIDNF

SEQ ID NO: 3376216 - protein, 17 aa, Plasmodium falciparum
YRIWYKSMHDIGVTLSS

SEQ ID NO: 3376217 - protein, 20 aa, Plasmodium falciparum
YRKFSYKDLELILFSLGSYN

SEQ ID NO: 3376218 - protein, 17 aa, Plasmodium falciparum
YRKIIVIPFNDKDVKLE

SEQ ID NO: 3376219 - protein, 20 aa, Plasmodium falciparum
YRKLKEVITNLKIKEKKIDL

SEQ ID NO: 3376220 - protein, 27 aa, Plasmodium falciparum
YRKVLPTHKVARLKIANSKKRNIEKIT

SEQ ID NO: 3376221 - protein, 20 aa, Plasmodium falciparum
YRKVQNWDLSLKCDELIKHL

SEQ ID NO: 3376222 - protein, 25 aa, Plasmodium falciparum
YRLCEINRFGNFYINNSPLITNLLD

SEQ ID NO: 3376223 - protein, 18 aa, Plasmodium falciparum
YRLDEIHCSNNINNEKEV

SEQ ID NO: 3376224 - protein, 17 aa, Plasmodium falciparum
YRLGNRILVNTPLQSIS

SEQ ID NO: 3376225 - protein, 19 aa, Plasmodium falciparum
YRLHQCTTFFMIINNNNEN

SEQ ID NO: 3376226 - protein, 29 aa, Plasmodium falciparum
YRLKNIRNIKKYGLYKILKYKYNLPEKEI

SEQ ID NO: 3376227 - protein, 24 aa, Plasmodium falciparum
YRLLEERKKKIYLNNYYNMIKSVD

SEQ ID NO: 3376228 - protein, 23 aa, Plasmodium falciparum
YRLLRYLPDGSCVFEEIPNEEDK

SEQ ID NO: 3376229 - protein, 17 aa, Plasmodium falciparum
YRLPKKYLKDADKNEYK

SEQ ID NO: 3376230 - protein, 17 aa, Plasmodium falciparum
YRLRKKKIYVIGEKGIC

SEQ ID NO: 3376231 - protein, 21 aa, Plasmodium falciparum
YRLSTHVKPLFWLDINITKKS

SEQ ID NO: 3376232 - protein, 18 aa, Plasmodium falciparum
YRLVDPWSTTTKMKNMKK

SEQ ID NO: 3376233 - protein, 24 aa, Plasmodium falciparum
YRMKKFSEPISMYDNYGFSENDNN

SEQ ID NO: 3376234 - protein, 21 aa, Plasmodium falciparum
YRMNNLILLWSNKIFYEQKLV

SEQ ID NO: 3376235 - protein, 23 aa, Plasmodium falciparum
YRNEEKMYLCVDHKINEERVGKD

SEQ ID NO: 3376236 - protein, 20 aa, Plasmodium falciparum
YRNGPRYKKAIITLEHEVPD

SEQ ID NO: 3376237 - protein, 18 aa, Plasmodium falciparum
YRNIILLYLESKMFYLAP

SEQ ID NO: 3376238 - protein, 19 aa, Plasmodium falciparum
YRNIRKRKLGSISDLNYNM

SEQ ID NO: 3376239 - protein, 17 aa, Plasmodium falciparum
YRNNDIINHNINGRNGL

SEQ ID NO: 3376240 - protein, 19 aa, Plasmodium falciparum
YRNNMRKATPFEGKRYSIS

SEQ ID NO: 3376241 - protein, 19 aa, Plasmodium falciparum
YRNVRIICILIGIREILNR

SEQ ID NO: 3376242 - protein, 19 aa, Plasmodium falciparum
YRPCKGLSNNASFDLSSHK

SEQ ID NO: 3376243 - protein, 23 aa, Plasmodium falciparum
YRPPEILCNSTLYNYSVDIWSVG

SEQ ID NO: 3376244 - protein, 19 aa, Plasmodium falciparum
YRPRYFILENGLLRYSLDK

SEQ ID NO: 3376245 - protein, 33 aa, Plasmodium falciparum
YRQQILRGFKHGFDFSVNFNNFFDNQLYDQDIT

SEQ ID NO: 3376246 - protein, 19 aa, Plasmodium falciparum
YRRKCLKKLNLNLLNDLKF

SEQ ID NO: 3376247 - protein, 18 aa, Plasmodium falciparum
YRRLHICDRNLELIKPDQ

SEQ ID NO: 3376248 - protein, 17 aa, Plasmodium falciparum
YRSKCNVTFSMKYKDSS

SEQ ID NO: 3376249 - protein, 18 aa, Plasmodium falciparum
YRSLCPINDLYNWLNYKN

SEQ ID NO: 3376250 - protein, 18 aa, Plasmodium falciparum
YRSVKIHIDDSIIMDASK

SEQ ID NO: 3376251 - protein, 25 aa, Plasmodium falciparum
YRTLKKRYINSFCHLNMYTILIGTT

SEQ ID NO: 3376252 - protein, 17 aa, Plasmodium falciparum
YRVLTGIQYEHNFCIDY

SEQ ID NO: 3376253 - protein, 23 aa, Plasmodium falciparum
YRWRAEYGWVKSRLNFLCGASCY

SEQ ID NO: 3376254 - protein, 23 aa, Plasmodium falciparum
YRYKKTCILDFYDNLMFNKNTFF

SEQ ID NO: 3376255 - protein, 17 aa, Plasmodium falciparum
YRYKMPKLISKIEGRGN

SEQ ID NO: 3376256 - protein, 19 aa, Plasmodium falciparum
YRYRVESTLNKCTNKKIKL

SEQ ID NO: 3376257 - protein, 23 aa, Plasmodium falciparum
YSAMCIYDHLTVVMKRYNFHLNN

SEQ ID NO: 3376258 - protein, 22 aa, Plasmodium falciparum
YSCGSTALVAVILKGYLIVANA

SEQ ID NO: 3376259 - protein, 18 aa, Plasmodium falciparum
YSCMKSKILKYIDESDID

SEQ ID NO: 3376260 - protein, 17 aa, Plasmodium falciparum
YSDTFIFKQIENMDKDA

SEQ ID NO: 3376261 - protein, 21 aa, Plasmodium falciparum
YSFFKPYLLEYLKKIKNIPIF

SEQ ID NO: 3376262 - protein, 24 aa, Plasmodium falciparum
YSFHIRKNLKLFCKVVNSVHDSLP

SEQ ID NO: 3376263 - protein, 17 aa, Plasmodium falciparum
YSFKGSYTHMKKKNPKE

SEQ ID NO: 3376264 - protein, 18 aa, Plasmodium falciparum
YSFLEYKIALENIVSCCE

SEQ ID NO: 3376265 - protein, 18 aa, Plasmodium falciparum
YSFLPHVLLKKIILENYI

SEQ ID NO: 3376266 - protein, 26 aa, Plasmodium falciparum
YSFNYMKRWYMNKGIYDTLSYYCYFF

SEQ ID NO: 3376267 - protein, 24 aa, Plasmodium falciparum
YSFRGAHINVFYKFLKDCNCLLFK

SEQ ID NO: 3376268 - protein, 18 aa, Plasmodium falciparum
YSGTKILIHRQVKKKNNV

SEQ ID NO: 3376269 - protein, 18 aa, Plasmodium falciparum
YSHFKFIPNKIYKEILRP

SEQ ID NO: 3376270 - protein, 17 aa, Plasmodium falciparum
YSHLAWKNMPIEKGGIG

SEQ ID NO: 3376271 - protein, 18 aa, Plasmodium falciparum
YSIALCKTLEKEIINTSD

SEQ ID NO: 3376272 - protein, 26 aa, Plasmodium falciparum
YSIDTYLKLMVFDIFKCNNEKKEIGI

SEQ ID NO: 3376273 - protein, 18 aa, Plasmodium falciparum
YSIFDGHRGIKACEYCMS

SEQ ID NO: 3376274 - protein, 17 aa, Plasmodium falciparum
YSIFLNKPLQVFTLNVK

SEQ ID NO: 3376275 - protein, 17 aa, Plasmodium falciparum
YSIKLVPYLVSILKQIC

SEQ ID NO: 3376276 - protein, 18 aa, Plasmodium falciparum
YSILCIINNIYKCTYFNE

SEQ ID NO: 3376277 - protein, 25 aa, Plasmodium falciparum
YSINVNEIYESILLDQNDDNYTHML

SEQ ID NO: 3376278 - protein, 17 aa, Plasmodium falciparum
YSIPVILKKINLLACSQ

SEQ ID NO: 3376279 - protein, 17 aa, Plasmodium falciparum
YSKDFTYVHLINIAALI

SEQ ID NO: 3376280 - protein, 21 aa, Plasmodium falciparum
YSKEMIKYLYYIFDIKELYLF

SEQ ID NO: 3376281 - protein, 19 aa, Plasmodium falciparum
YSKFKSPYIKRSTFYSKNG

SEQ ID NO: 3376282 - protein, 21 aa, Plasmodium falciparum
YSKHLCYFVEKCLQKKPENRG

SEQ ID NO: 3376283 - protein, 19 aa, Plasmodium falciparum
YSKKIKCYIKEDVLMSTLY

SEQ ID NO: 3376284 - protein, 20 aa, Plasmodium falciparum
YSKKIWSCYLQILHNTFKDE

SEQ ID NO: 3376285 - protein, 22 aa, Plasmodium falciparum
YSKKSGVDVVRFLNNTNEVIIC

SEQ ID NO: 3376286 - protein, 18 aa, Plasmodium falciparum
YSKLCLEDKSLFYTNNET

SEQ ID NO: 3376287 - protein, 22 aa, Plasmodium falciparum
YSKLYLSILLFLYLNDEDIQII

SEQ ID NO: 3376288 - protein, 30 aa, Plasmodium falciparum
YSKNISSYMDVFWKKIEKLVWEEKKRELQQ

SEQ ID NO: 3376289 - protein, 21 aa, Plasmodium falciparum
YSKNKLISIIHNFENKNSNNK

SEQ ID NO: 3376290 - protein, 17 aa, Plasmodium falciparum
YSKNVVVNDLIYEGYNE

SEQ ID NO: 3376291 - protein, 25 aa, Plasmodium falciparum
YSKPLGCLPPNISNIKEYYLDGINI

SEQ ID NO: 3376292 - protein, 19 aa, Plasmodium falciparum
YSKYDVIRKPLDLNKGGKG

SEQ ID NO: 3376293 - protein, 18 aa, Plasmodium falciparum
YSKYSGCPSKFIKYLPDS

SEQ ID NO: 3376294 - protein, 24 aa, Plasmodium falciparum
YSLDKLIFKIYIPFDQINKHHNYL

SEQ ID NO: 3376295 - protein, 18 aa, Plasmodium falciparum
YSLECLLPHFIPPTYNGK

SEQ ID NO: 3376296 - protein, 19 aa, Plasmodium falciparum
YSLEYFFGYYDIKEDLNLY

SEQ ID NO: 3376297 - protein, 19 aa, Plasmodium falciparum
YSLKYKWLEENADQCSFVY

SEQ ID NO: 3376298 - protein, 22 aa, Plasmodium falciparum
YSLRYILLDEHRFFCENQSMYI

SEQ ID NO: 3376299 - protein, 24 aa, Plasmodium falciparum
YSLSCKGPVLISIDLAFKVLTYLC

SEQ ID NO: 3376300 - protein, 22 aa, Plasmodium falciparum
YSLSIHPYCLCTSNRRGRDDHL

SEQ ID NO: 3376301 - protein, 18 aa, Plasmodium falciparum
YSMEKLGFNDYIEPLTEY

SEQ ID NO: 3376302 - protein, 30 aa, Plasmodium falciparum
YSMYKLRKFKKLYGCLKYFIENENKYQDFI

SEQ ID NO: 3376303 - protein, 25 aa, Plasmodium falciparum
YSNFIKKKCVPYDKKKYIFCNKNRL

SEQ ID NO: 3376304 - protein, 24 aa, Plasmodium falciparum
YSNFILPMLIKRKMINDLYNDNIN

SEQ ID NO: 3376305 - protein, 28 aa, Plasmodium falciparum
YSNKEYFNFYIGNGIKSKHGYLHAYQPQ

SEQ ID NO: 3376306 - protein, 26 aa, Plasmodium falciparum
YSNKFLCNEYFYIPITNTNYFKNKSL

SEQ ID NO: 3376307 - protein, 39 aa, Plasmodium falciparum
YSNKLKYTVIEEGSFGVVYKGWYKGMHVAVKVPVDKMAR

SEQ ID NO: 3376308 - protein, 26 aa, Plasmodium falciparum
YSNMMKGIHHVKSCVSSLGVETNMKN

SEQ ID NO: 3376309 - protein, 29 aa, Plasmodium falciparum
YSNNINILFKYECILQKFGEYNEKNLTAQ

SEQ ID NO: 3376310 - protein, 20 aa, Plasmodium falciparum
YSNRTIIKALINKITNTPMI

SEQ ID NO: 3376311 - protein, 33 aa, Plasmodium falciparum
YSNSKKISILFLLRWILCGKQIAEKTKRSRLSI

SEQ ID NO: 3376312 - protein, 17 aa, Plasmodium falciparum
YSNSSCYELKYTMEEDN

SEQ ID NO: 3376313 - protein, 20 aa, Plasmodium falciparum
YSNYLNMRRELYNNNININS

SEQ ID NO: 3376314 - protein, 18 aa, Plasmodium falciparum
YSNYYGPDIIHLFNQTKL

SEQ ID NO: 3376315 - protein, 26 aa, Plasmodium falciparum
YSPFNDLRIFGFDIEDFDDFNNNIVY

SEQ ID NO: 3376316 - protein, 17 aa, Plasmodium falciparum
YSPLFICTDNINFVILL

SEQ ID NO: 3376317 - protein, 26 aa, Plasmodium falciparum
YSQDRFVTCLQFCKDKKYLFCACNDG

SEQ ID NO: 3376318 - protein, 26 aa, Plasmodium falciparum
YSQIKIRRFFCDGKNNYINNSYSNYI

SEQ ID NO: 3376319 - protein, 20 aa, Plasmodium falciparum
YSRICSIFRKSTINVEDISK

SEQ ID NO: 3376320 - protein, 19 aa, Plasmodium falciparum
YSRLFLNVLNSYNFIESCM

SEQ ID NO: 3376321 - protein, 26 aa, Plasmodium falciparum
YSRLRSNRPAPWFGQRDINIKRKQMK

SEQ ID NO: 3376322 - protein, 25 aa, Plasmodium falciparum
YSRSCLKNDYELLFYMMKNNFKGKI

SEQ ID NO: 3376323 - protein, 22 aa, Plasmodium falciparum
YSRTPKRVLFEINKEDHQNKKL

SEQ ID NO: 3376324 - protein, 17 aa, Plasmodium falciparum
YSSASKTYYCNQYLNEY

SEQ ID NO: 3376325 - protein, 25 aa, Plasmodium falciparum
YSSECLHIVDLLLIYVNHNEQDINY

SEQ ID NO: 3376326 - protein, 36 aa, Plasmodium falciparum
YSSKSESGFNDYAFYAERFFEVITGYNSEPDYLSDI

SEQ ID NO: 3376327 - protein, 20 aa, Plasmodium falciparum
YSSKYCFFVTNGTSSSNKIV

SEQ ID NO: 3376328 - protein, 18 aa, Plasmodium falciparum
YSTACRRKKIYEYFDEAP

SEQ ID NO: 3376329 - protein, 23 aa, Plasmodium falciparum
YSTEIGYRSPISVKSVIIMSDND

SEQ ID NO: 3376330 - protein, 18 aa, Plasmodium falciparum
YSTLLVNRPIDWESIHYM

SEQ ID NO: 3376331 - protein, 27 aa, Plasmodium falciparum
YSTNTIRCGKLCLVDLAGSERLKQTKA

SEQ ID NO: 3376332 - protein, 18 aa, Plasmodium falciparum
YSVPALVILFELLNDKNI

SEQ ID NO: 3376333 - protein, 17 aa, Plasmodium falciparum
YSVYGLDLQSHGKSDGW

SEQ ID NO: 3376334 - protein, 22 aa, Plasmodium falciparum
YSWEVREPLGIIILVHGLASHI

SEQ ID NO: 3376335 - protein, 36 aa, Plasmodium falciparum
YSYFLKRHKKIYFSSCLFLIKFLEHVENLKYLFFFY

SEQ ID NO: 3376336 - protein, 23 aa, Plasmodium falciparum
YSYICSATIKILVNILRKYEEYT

SEQ ID NO: 3376337 - protein, 22 aa, Plasmodium falciparum
YSYKLCGALFSKFSKDSEKEEG

SEQ ID NO: 3376338 - protein, 31 aa, Plasmodium falciparum
YSYKYICKLFLKSDMPILFIGKTGVGKTQLC

SEQ ID NO: 3376339 - protein, 31 aa, Plasmodium falciparum
YSYSKLLIKSEMLFYILSVQIFQNMNMFTKQ

SEQ ID NO: 3376340 - protein, 21 aa, Plasmodium falciparum
YTDAISWSIFKIIKLTEEDTT

SEQ ID NO: 3376341 - protein, 17 aa, Plasmodium falciparum
YTDILGHQGSSPRILFD

SEQ ID NO: 3376342 - protein, 17 aa, Plasmodium falciparum
YTDKEVFIRELISNSSD

SEQ ID NO: 3376343 - protein, 26 aa, Plasmodium falciparum
YTEEKRWKHDLFYDYKYDEYVKRDNK

SEQ ID NO: 3376344 - protein, 20 aa, Plasmodium falciparum
YTEGCIKPTFFDVISKESIN

SEQ ID NO: 3376345 - protein, 26 aa, Plasmodium falciparum
YTEGSEQYNIWFGKYVTDRYDKSVKG

SEQ ID NO: 3376346 - protein, 22 aa, Plasmodium falciparum
YTEGVGKIFLHYADEATARKAQ

SEQ ID NO: 3376347 - protein, 24 aa, Plasmodium falciparum
YTEKLKFYITTFLNFSKIEKAKLE

SEQ ID NO: 3376348 - protein, 26 aa, Plasmodium falciparum
YTERKRKEQSLKYHIEYTQNSVGVSS

SEQ ID NO: 3376349 - protein, 27 aa, Plasmodium falciparum
YTFFVAGKFNLFSNFVLIKKLKDVGYN

SEQ ID NO: 3376350 - protein, 25 aa, Plasmodium falciparum
YTGGKLKYEMPVGVNPNDDKVKGVY

SEQ ID NO: 3376351 - protein, 22 aa, Plasmodium falciparum
YTGKSKGFGFIQFHKASEAIEA

SEQ ID NO: 3376352 - protein, 19 aa, Plasmodium falciparum
YTGLGTCIFFRFHKNKKTQ

SEQ ID NO: 3376353 - protein, 25 aa, Plasmodium falciparum
YTGTLRIAFFVQLAFEGNMSIEDKK

SEQ ID NO: 3376354 - protein, 17 aa, Plasmodium falciparum
YTHKIEHLEICRQEICS

SEQ ID NO: 3376355 - protein, 25 aa, Plasmodium falciparum
YTHKIFKERFFGIFIDNGLLRKNEA

SEQ ID NO: 3376356 - protein, 17 aa, Plasmodium falciparum
YTIIHIFCKLKFTKYSL

SEQ ID NO: 3376357 - protein, 18 aa, Plasmodium falciparum
YTIIKFLDFYSMHRFLFL

SEQ ID NO: 3376358 - protein, 25 aa, Plasmodium falciparum
YTKDILCCCCEKYKNEDGSICSYNN

SEQ ID NO: 3376359 - protein, 29 aa, Plasmodium falciparum
YTKQFAHFLLCLLMDISIFQIDGNFTFLK

SEQ ID NO: 3376360 - protein, 21 aa, Plasmodium falciparum
YTLEASLFVEFLSPFMDMLNI

SEQ ID NO: 3376361 - protein, 18 aa, Plasmodium falciparum
YTLKDTKLINVLPNSICN

SEQ ID NO: 3376362 - protein, 23 aa, Plasmodium falciparum
YTLKEIVQILALRAQTEKINITE

SEQ ID NO: 3376363 - protein, 21 aa, Plasmodium falciparum
YTLKNAMLFKDDINRYIYMRE

SEQ ID NO: 3376364 - protein, 18 aa, Plasmodium falciparum
YTLLCGYPPFYGDTDNEV

SEQ ID NO: 3376365 - protein, 17 aa, Plasmodium falciparum
YTLLKCAKLSEGFSGRC

SEQ ID NO: 3376366 - protein, 17 aa, Plasmodium falciparum
YTLNNDMLFEENEFQYP

SEQ ID NO: 3376367 - protein, 24 aa, Plasmodium falciparum
YTLREHTRLIGIEFEDQEPYRCAI

SEQ ID NO: 3376368 - protein, 20 aa, Plasmodium falciparum
YTLSTLKEFIELISKEDDKK

SEQ ID NO: 3376369 - protein, 23 aa, Plasmodium falciparum
YTLTRVNSILVLYERRIKSFIFS

SEQ ID NO: 3376370 - protein, 19 aa, Plasmodium falciparum
YTLWIDYLISNNIDIQEFS

SEQ ID NO: 3376371 - protein, 22 aa, Plasmodium falciparum
YTLYNFLRKKLHKMVEFHYLFT

SEQ ID NO: 3376372 - protein, 19 aa, Plasmodium falciparum
YTMPFNKILEGLREKELVN

SEQ ID NO: 3376373 - protein, 20 aa, Plasmodium falciparum
YTNRNNNCFINKYYNSKYLN

SEQ ID NO: 3376374 - protein, 35 aa, Plasmodium falciparum
YTNRSRRSTRCSIVKRKSSLCIGKKNSKIIKKSTS

SEQ ID NO: 3376375 - protein, 26 aa, Plasmodium falciparum
YTPEELKEILIPISGVYYSSSDEKWI

SEQ ID NO: 3376376 - protein, 22 aa, Plasmodium falciparum
YTPFRNIHRIKFPNKTTEDKKN

SEQ ID NO: 3376377 - protein, 24 aa, Plasmodium falciparum
YTPKELGGLGMLSMGHILIPESDL

SEQ ID NO: 3376378 - protein, 23 aa, Plasmodium falciparum
YTREALMCLSLCHYVQNPLGVVI

SEQ ID NO: 3376379 - protein, 18 aa, Plasmodium falciparum
YTRNRARRTSQRTRNNRR

SEQ ID NO: 3376380 - protein, 23 aa, Plasmodium falciparum
YTSQKRKPLYVVNYLKNENNELI

SEQ ID NO: 3376381 - protein, 18 aa, Plasmodium falciparum
YTSRGVFLSVKFNEELIQ

SEQ ID NO: 3376382 - protein, 26 aa, Plasmodium falciparum
YTTNPSLIFYEYCKTKVQLKEANKNI

SEQ ID NO: 3376383 - protein, 20 aa, Plasmodium falciparum
YTYIKYKYMYDFYVQNKNIL

SEQ ID NO: 3376384 - protein, 20 aa, Plasmodium falciparum
YTYKNVLKNRHKIYNTNYDY

SEQ ID NO: 3376385 - protein, 17 aa, Plasmodium falciparum
YTYMCSNLYKLYHKGMG

SEQ ID NO: 3376386 - protein, 20 aa, Plasmodium falciparum
YTYMVPKPVVIPIEVPILKF

SEQ ID NO: 3376387 - protein, 23 aa, Plasmodium falciparum
YVACDALKVLLCNSKFLNVIIFK

SEQ ID NO: 3376388 - protein, 18 aa, Plasmodium falciparum
YVATRWYRAPEILLGSTH

SEQ ID NO: 3376389 - protein, 17 aa, Plasmodium falciparum
YVAYFFPTFRPSPNLNF

SEQ ID NO: 3376390 - protein, 17 aa, Plasmodium falciparum
YVCKKRLLYDEERSSSI

SEQ ID NO: 3376391 - protein, 18 aa, Plasmodium falciparum
YVDEWKELQISSECNEHI

SEQ ID NO: 3376392 - protein, 18 aa, Plasmodium falciparum
YVDKEYQKYFVLYENDIF

SEQ ID NO: 3376393 - protein, 25 aa, Plasmodium falciparum
YVDLKNIFFMKGLIHFSFQVIYTLL

SEQ ID NO: 3376394 - protein, 25 aa, Plasmodium falciparum
YVDRGYYSCECFCLVACFKIKYPSR

SEQ ID NO: 3376395 - protein, 23 aa, Plasmodium falciparum
YVDYKMRVRDLLLVIIYKQVEPM

SEQ ID NO: 3376396 - protein, 20 aa, Plasmodium falciparum
YVEFIKYIFLMNINLQQYDL

SEQ ID NO: 3376397 - protein, 26 aa, Plasmodium falciparum
YVELLESCGLCINNLYNIIKQGQIIK

SEQ ID NO: 3376398 - protein, 20 aa, Plasmodium falciparum
YVFNSSYKKPICIQQNAHNS

SEQ ID NO: 3376399 - protein, 26 aa, Plasmodium falciparum
YVGNLPWKVTWPILKNHMKKAGDVVR

SEQ ID NO: 3376400 - protein, 23 aa, Plasmodium falciparum
YVGSVAYRLYKIVKMNVYTMKGG

SEQ ID NO: 3376401 - protein, 30 aa, Plasmodium falciparum
YVGTFKSQEGFIWSYPKVVMKRGSINNPRN

SEQ ID NO: 3376402 - protein, 18 aa, Plasmodium falciparum
YVHFAFFACFYISHIKKE

SEQ ID NO: 3376403 - protein, 18 aa, Plasmodium falciparum
YVIDTGYCKLKVYNQTIG

SEQ ID NO: 3376404 - protein, 25 aa, Plasmodium falciparum
YVIIGCGTLICPCFTNKINIPNEIF

SEQ ID NO: 3376405 - protein, 17 aa, Plasmodium falciparum
YVIKDCKVAYVYSSCKL

SEQ ID NO: 3376406 - protein, 30 aa, Plasmodium falciparum
YVINVPSFFKKVWCLFNMFIDNHTLNKIIF

SEQ ID NO: 3376407 - protein, 26 aa, Plasmodium falciparum
YVIVDEFDLLFSKQFVHLVTSVLKNI

SEQ ID NO: 3376408 - protein, 28 aa, Plasmodium falciparum
YVKAHEYKRIDLLNTNYKRSIMNNINNN

SEQ ID NO: 3376409 - protein, 22 aa, Plasmodium falciparum
YVKEVKKFWLAIKDIFNNKDIF

SEQ ID NO: 3376410 - protein, 18 aa, Plasmodium falciparum
YVKSCPEIPYGKKIQVLP

SEQ ID NO: 3376411 - protein, 25 aa, Plasmodium falciparum
YVKTPRTSYFYNLFFPDLINNDSVY

SEQ ID NO: 3376412 - protein, 25 aa, Plasmodium falciparum
YVLCKENRNICGFFVGKNFNIDTGS

SEQ ID NO: 3376413 - protein, 17 aa, Plasmodium falciparum
YVLCLNVGEYIPKKKEE

SEQ ID NO: 3376414 - protein, 18 aa, Plasmodium falciparum
YVLIRIIHFQNFLNLLLE

SEQ ID NO: 3376415 - protein, 17 aa, Plasmodium falciparum
YVLPYIEYKLIEYAVLR

SEQ ID NO: 3376416 - protein, 21 aa, Plasmodium falciparum
YVLSFKDYIWKSISSSAKDLI

SEQ ID NO: 3376417 - protein, 23 aa, Plasmodium falciparum
YVMKKKRLDDKVKEGMDKNYMDN

SEQ ID NO: 3376418 - protein, 25 aa, Plasmodium falciparum
YVNCIHIRIGYKLYKIPFKSFDDNL

SEQ ID NO: 3376419 - protein, 25 aa, Plasmodium falciparum
YVNLNKVPLFLSERHSSFYGKLSDI

SEQ ID NO: 3376420 - protein, 17 aa, Plasmodium falciparum
YVNTICMTNQKSGNMNM

SEQ ID NO: 3376421 - protein, 17 aa, Plasmodium falciparum
YVPLSYYILQNEGGNTS

SEQ ID NO: 3376422 - protein, 21 aa, Plasmodium falciparum
YVQSILPFGILGNKGSNDSYS

SEQ ID NO: 3376423 - protein, 23 aa, Plasmodium falciparum
YVRKFVLSVFRFLTNSIDNADPL

SEQ ID NO: 3376424 - protein, 23 aa, Plasmodium falciparum
YVRKTAVICIAKLYDISPKLVEE

SEQ ID NO: 3376425 - protein, 24 aa, Plasmodium falciparum
YVRSKMALGRACGISRSVIATSIV

SEQ ID NO: 3376426 - protein, 24 aa, Plasmodium falciparum
YVSEERSRLYGSVNDAYVFCRALV

SEQ ID NO: 3376427 - protein, 20 aa, Plasmodium falciparum
YVSKIFKYKPKLVQVELYCE

SEQ ID NO: 3376428 - protein, 22 aa, Plasmodium falciparum
YVSLYCLKLIFKKLKIKKKENN

SEQ ID NO: 3376429 - protein, 18 aa, Plasmodium falciparum
YVSPDICIGKVVGGSDTL

SEQ ID NO: 3376430 - protein, 17 aa, Plasmodium falciparum
YVSSSIFDVFDKIKDSN

SEQ ID NO: 3376431 - protein, 18 aa, Plasmodium falciparum
YVSSSSLFHMDVFKIIKD

SEQ ID NO: 3376432 - protein, 19 aa, Plasmodium falciparum
YVTCFEWMNSNNFVDINNN

SEQ ID NO: 3376433 - protein, 21 aa, Plasmodium falciparum
YVVCGEAPFSICSKNDKKNIC

SEQ ID NO: 3376434 - protein, 21 aa, Plasmodium falciparum
YVVFLDFFLDYLLGQERNSDM

SEQ ID NO: 3376435 - protein, 26 aa, Plasmodium falciparum
YVWIKCLKNSIPVPQQWCQKRKYLHG

SEQ ID NO: 3376436 - protein, 21 aa, Plasmodium falciparum
YVYIDKICECFTYIMSITLTK

SEQ ID NO: 3376437 - protein, 17 aa, Plasmodium falciparum
YWCFEHKPVKRTIINLI

SEQ ID NO: 3376438 - protein, 20 aa, Plasmodium falciparum
YWNKYSMKAHLNGVACISWE

SEQ ID NO: 3376439 - protein, 17 aa, Plasmodium falciparum
YYAFNPINFENLKTNYI

SEQ ID NO: 3376440 - protein, 18 aa, Plasmodium falciparum
YYAPGVNVHGFLGSNNAV

SEQ ID NO: 3376441 - protein, 17 aa, Plasmodium falciparum
YYARQVVQMATQVNTPT

SEQ ID NO: 3376442 - protein, 22 aa, Plasmodium falciparum
YYCDNKYNLTYCKNGNNMFSCI

SEQ ID NO: 3376443 - protein, 25 aa, Plasmodium falciparum
YYCKCFKNDIKWCIELLSDILSNSI

SEQ ID NO: 3376444 - protein, 17 aa, Plasmodium falciparum
YYCKECCLCEKDRDGCP

SEQ ID NO: 3376445 - protein, 17 aa, Plasmodium falciparum
YYCKNEIKELAKITNNF

SEQ ID NO: 3376446 - protein, 21 aa, Plasmodium falciparum
YYCNLDYLSTLIIDEIDKLID

SEQ ID NO: 3376447 - protein, 20 aa, Plasmodium falciparum
YYCSKCGLSKYCNCGKRTMS

SEQ ID NO: 3376448 - protein, 25 aa, Plasmodium falciparum
YYDDVIKCYMDYTMHGMEDETNFYL

SEQ ID NO: 3376449 - protein, 23 aa, Plasmodium falciparum
YYDIIKEKFTFNRESKKVSFDEP

SEQ ID NO: 3376450 - protein, 36 aa, Plasmodium falciparum
YYDISYETLQMIQFSIVWSTYIFKISNKEIIIENNK

SEQ ID NO: 3376451 - protein, 25 aa, Plasmodium falciparum
YYDLDYIKMILSFNEYFTKDWIYNY

SEQ ID NO: 3376452 - protein, 17 aa, Plasmodium falciparum
YYDPFHFKFKELSRIGG

SEQ ID NO: 3376453 - protein, 18 aa, Plasmodium falciparum
YYDVCYPSDNLLKNNFQI

SEQ ID NO: 3376454 - protein, 19 aa, Plasmodium falciparum
YYEDIKIPIKMTFDNYDKE

SEQ ID NO: 3376455 - protein, 19 aa, Plasmodium falciparum
YYEFKNIFKDVGIITGDVK

SEQ ID NO: 3376456 - protein, 22 aa, Plasmodium falciparum
YYEKISRLWLKNFVKKNGKVHK

SEQ ID NO: 3376457 - protein, 20 aa, Plasmodium falciparum
YYEPLRYPAFKMSDKIKSET

SEQ ID NO: 3376458 - protein, 19 aa, Plasmodium falciparum
YYFCKIFQMPPAFSEGQNI

SEQ ID NO: 3376459 - protein, 20 aa, Plasmodium falciparum
YYFDKCDTISMVLKNIIKNE

SEQ ID NO: 3376460 - protein, 18 aa, Plasmodium falciparum
YYFFIKHLLHDYCKKKLH

SEQ ID NO: 3376461 - protein, 17 aa, Plasmodium falciparum
YYFFTYHVTYICLNDVN

SEQ ID NO: 3376462 - protein, 17 aa, Plasmodium falciparum
YYFNIWGPHLVIVPTSI

SEQ ID NO: 3376463 - protein, 21 aa, Plasmodium falciparum
YYGNMNISFLFVEGESLLMSL

SEQ ID NO: 3376464 - protein, 18 aa, Plasmodium falciparum
YYHDSDVIFYVIDSKYES

SEQ ID NO: 3376465 - protein, 17 aa, Plasmodium falciparum
YYHELAINKHIFRELCI

SEQ ID NO: 3376466 - protein, 17 aa, Plasmodium falciparum
YYHHVWINLVTEDMYLP

SEQ ID NO: 3376467 - protein, 18 aa, Plasmodium falciparum
YYICCDKPLINYLGNELK

SEQ ID NO: 3376468 - protein, 17 aa, Plasmodium falciparum
YYIDNCSTIKAVKKNFH

SEQ ID NO: 3376469 - protein, 25 aa, Plasmodium falciparum
YYIENCLPKILLYLSNINDCLIQQY

SEQ ID NO: 3376470 - protein, 27 aa, Plasmodium falciparum
YYIFDIKELYLFLEINNMPKEIHLRTN

SEQ ID NO: 3376471 - protein, 19 aa, Plasmodium falciparum
YYILFSFEIYPSMIEEISN

SEQ ID NO: 3376472 - protein, 29 aa, Plasmodium falciparum
YYINNLKINLCSSYDNLIIGVENLDINSK

SEQ ID NO: 3376473 - protein, 17 aa, Plasmodium falciparum
YYIRNQILSPINRLCQY

SEQ ID NO: 3376474 - protein, 29 aa, Plasmodium falciparum
YYITIFPNIYFKNIIDFLKSEKFKLKKMI

SEQ ID NO: 3376475 - protein, 17 aa, Plasmodium falciparum
YYIYSHLLKIIIKKNKF

SEQ ID NO: 3376476 - protein, 23 aa, Plasmodium falciparum
YYKAEYLYNNCLNLSRNKNIRKI

SEQ ID NO: 3376477 - protein, 25 aa, Plasmodium falciparum
YYKDLPTVIIVIGMAGSGKTTYVGS

SEQ ID NO: 3376478 - protein, 25 aa, Plasmodium falciparum
YYKHPYGIEEGRAYDKNYYHDNELN

SEQ ID NO: 3376479 - protein, 17 aa, Plasmodium falciparum
YYKIYKKYLNEENMRRY

SEQ ID NO: 3376480 - protein, 19 aa, Plasmodium falciparum
YYKNIKLYNRFMENNKTGK

SEQ ID NO: 3376481 - protein, 18 aa, Plasmodium falciparum
YYKNVLFMDVFIYHKKKF

SEQ ID NO: 3376482 - protein, 18 aa, Plasmodium falciparum
YYKRLIINDDEIMWNVCY

SEQ ID NO: 3376483 - protein, 18 aa, Plasmodium falciparum
YYKRLNVWMVQWVENGVH

SEQ ID NO: 3376484 - protein, 26 aa, Plasmodium falciparum
YYKYNCDVFNLLSLMPSHISENKKAS

SEQ ID NO: 3376485 - protein, 21 aa, Plasmodium falciparum
YYLCLIGNYFSLKNNKRLGTF

SEQ ID NO: 3376486 - protein, 21 aa, Plasmodium falciparum
YYLCSMNPCKIKTNKMEPLYF

SEQ ID NO: 3376487 - protein, 27 aa, Plasmodium falciparum
YYLDGINIFEVINYVNISERMYKFENI

SEQ ID NO: 3376488 - protein, 27 aa, Plasmodium falciparum
YYLGYKSCPYLICCLKKMIKLHSNFYF

SEQ ID NO: 3376489 - protein, 19 aa, Plasmodium falciparum
YYLICSFQDKQFIHVRCCD

SEQ ID NO: 3376490 - protein, 20 aa, Plasmodium falciparum
YYLKPRWYKNSPIHRIVTDF

SEQ ID NO: 3376491 - protein, 33 aa, Plasmodium falciparum
YYLPPTLSIKIWKLAFCSSIHGVSFKTLYRSVY

SEQ ID NO: 3376492 - protein, 24 aa, Plasmodium falciparum
YYMYNNIKLNIDIISKHPYISPLI

SEQ ID NO: 3376493 - protein, 27 aa, Plasmodium falciparum
YYNDCAHILRAMFLAKLEEKYNIIPRD

SEQ ID NO: 3376494 - protein, 18 aa, Plasmodium falciparum
YYNDKRFSCNKGNICDGS

SEQ ID NO: 3376495 - protein, 27 aa, Plasmodium falciparum
YYNEIIKMVVHFNNILLLMLNNNATEM

SEQ ID NO: 3376496 - protein, 25 aa, Plasmodium falciparum
YYNFSCKFLLLHFLLKNIKQNTNDK

SEQ ID NO: 3376497 - protein, 23 aa, Plasmodium falciparum
YYNNCIFHRVIKHFMVQTGDPSG

SEQ ID NO: 3376498 - protein, 17 aa, Plasmodium falciparum
YYNRGYHSYFNKNGDQD

SEQ ID NO: 3376499 - protein, 20 aa, Plasmodium falciparum
YYNTLCNYKKLGESKQFSVL

SEQ ID NO: 3376500 - protein, 28 aa, Plasmodium falciparum
YYNYYCSGLIPTYPIFNYRNVINSNNNN

SEQ ID NO: 3376501 - protein, 25 aa, Plasmodium falciparum
YYPHTLSLLLEWFRSYKMADTKKLN

SEQ ID NO: 3376502 - protein, 20 aa, Plasmodium falciparum
YYPKHLWNYIDEESDFRINY

SEQ ID NO: 3376503 - protein, 22 aa, Plasmodium falciparum
YYQKHNFSLLKLYINACNSQYI

SEQ ID NO: 3376504 - protein, 20 aa, Plasmodium falciparum
YYQSEKWGVIKQRTYDDVVI

SEQ ID NO: 3376505 - protein, 19 aa, Plasmodium falciparum
YYRAPELLFGSNYYSQAID

SEQ ID NO: 3376506 - protein, 18 aa, Plasmodium falciparum
YYRCRYCEIDSIDSVVQC

SEQ ID NO: 3376507 - protein, 24 aa, Plasmodium falciparum
YYRDIKHVISYYVVKHNYDKNKGF

SEQ ID NO: 3376508 - protein, 19 aa, Plasmodium falciparum
YYRIPNFFRNKSEYVLYFM

SEQ ID NO: 3376509 - protein, 19 aa, Plasmodium falciparum
YYRKKRKKKKFVCGEIPLP

SEQ ID NO: 3376510 - protein, 23 aa, Plasmodium falciparum
YYRQIFKNVIGFVSVFEYVESYK

SEQ ID NO: 3376511 - protein, 18 aa, Plasmodium falciparum
YYSGGVIKIIENRYSHLY

SEQ ID NO: 3376512 - protein, 18 aa, Plasmodium falciparum
YYSNMIHMSHRGSIIKNK

SEQ ID NO: 3376513 - protein, 19 aa, Plasmodium falciparum
YYSYSQPLSPMVFNNNNSG

SEQ ID NO: 3376514 - protein, 22 aa, Plasmodium falciparum
YYTCQNCGYNDFSVIRSTSPNN

SEQ ID NO: 3376515 - protein, 17 aa, Plasmodium falciparum
YYTDRCILDRSTKRVSI

SEQ ID NO: 3376516 - protein, 29 aa, Plasmodium falciparum
YYTGLHNYRTFYLLIKINEIFNINKYKQI

SEQ ID NO: 3376517 - protein, 17 aa, Plasmodium falciparum
YYTHSNYRIISFLCKKL

SEQ ID NO: 3376518 - protein, 30 aa, Plasmodium falciparum
YYTKHIFRFDLPNNIVIKFVDNILGLTYYD

SEQ ID NO: 3376519 - protein, 26 aa, Plasmodium falciparum
YYTSHWPDYWFKNILNEYKYRIQKIQ

SEQ ID NO: 3376520 - protein, 17 aa, Plasmodium falciparum
YYTSLYGYNTLECKIKR

SEQ ID NO: 3376521 - protein, 25 aa, Plasmodium falciparum
YYWDLQVCEYPHAFANEIINTLNQE

SEQ ID NO: 3376522 - protein, 18 aa, Plasmodium falciparum
YYYHYDLLRKIGGANFKK

SEQ ID NO: 3376523 - protein, 18 aa, Plasmodium falciparum
YYYHYHYGGKYSLEKKEI

SEQ ID NO: 3376524 - protein, 25 aa, Plasmodium falciparum
YYYLKLENVNNGWRNKELKNDITNE

SEQ ID NO: 3376525 - protein, 24 aa, Plasmodium falciparum
YYYLSELYCSMTISQCVIFVNSKK

SEQ ID NO: 3376526 - protein, 18 aa, Plasmodium falciparum
YYYNNRHNINSSTSLDTS

SEQ ID NO: 3376527 - protein, 20 aa, Plasmodium falciparum
YYYYPPIKILECRALTNNVI

SEQ ID NO: 3376528 - protein, 20 aa, Plasmodium falciparum
YYYYSRRGSLKSVNKEEENC

SEQ ID NO: 3376529 - protein, 17 aa, Plasmodium falciparum
YYYYYINNYNRSMQGQN

SEQ ID NO: 3376530 - protein, 25 aa, Plasmodium falciparum
HTKKKKSSWLKFGRGNKNDKKSKNE

SEQ ID NO: 3376531 - protein, 21 aa, Plasmodium falciparum
CGAKCPRWASINLGIIICIEC

SEQ ID NO: 3376532 - protein, 21 aa, Plasmodium falciparum
KIKPGCTIFVFYLPNDWSDKD

SEQ ID NO: 3376533 - protein, 19 aa, Plasmodium falciparum
KKMLLKLIVLLGNQINSEI

SEQ ID NO: 3376534 - protein, 17 aa, Plasmodium falciparum
PRHDLYLLFLLKFISGV

SEQ ID NO: 3376535 - protein, 18 aa, Plasmodium falciparum
QGDSSIIMQNWIKNKYEK

SEQ ID NO: 3376536 - protein, 17 aa, Plasmodium falciparum
RKMGLCIIDRIIKNANN

SEQ ID NO: 3376537 - protein, 21 aa, Plasmodium falciparum
RPTGLCGAALLISTRMHGICI

SEQ ID NO: 3376538 - protein, 19 aa, Plasmodium falciparum
THIYPKLCHNFLYLCEYKY

SEQ ID NO: 3376539 - protein, 23 aa, Plasmodium falciparum
YCKHCLKFLKFLIIHGNKYKGNL

SEQ ID NO: 3376540 - protein, 17 aa, Plasmodium falciparum
AACLYGLIHSRFILTSK

SEQ ID NO: 3376541 - protein, 18 aa, Plasmodium falciparum
AAGLAEWVLNITSFYKII

SEQ ID NO: 3376542 - protein, 18 aa, Plasmodium falciparum
AAGPLAKWVESVITFLNI

SEQ ID NO: 3376543 - protein, 23 aa, Plasmodium falciparum
AAKKEVFPGFSTGIIGNNTSNNS

SEQ ID NO: 3376544 - protein, 19 aa, Plasmodium falciparum
AASICYLCACNFSETVEIW

SEQ ID NO: 3376545 - protein, 18 aa, Plasmodium falciparum
AAYYIWECVQAFFNKEIK

SEQ ID NO: 3376546 - protein, 20 aa, Plasmodium falciparum
ACENFSILFKIFYDSLIYIV

SEQ ID NO: 3376547 - protein, 18 aa, Plasmodium falciparum
ACFFKIWKSNYFIVNELL

SEQ ID NO: 3376548 - protein, 17 aa, Plasmodium falciparum
ADAEVHFTAAVGSSNNS

SEQ ID NO: 3376549 - protein, 21 aa, Plasmodium falciparum
ADAQLSYLCRMGFISCAISED

SEQ ID NO: 3376550 - protein, 24 aa, Plasmodium falciparum
ADFRIKWIRECLEQLDIHHPDFLK

SEQ ID NO: 3376551 - protein, 20 aa, Plasmodium falciparum
ADVLFKMRFIDGISTVNRHA

SEQ ID NO: 3376552 - protein, 24 aa, Plasmodium falciparum
AEKAGARCKPMFHVHGSRKAVDAA

SEQ ID NO: 3376553 - protein, 26 aa, Plasmodium falciparum
AESLDDCYLHFAVKVLRYFWPNFKYK

SEQ ID NO: 3376554 - protein, 20 aa, Plasmodium falciparum
AFEDMGFCFKEDFTYDPEIY

SEQ ID NO: 3376555 - protein, 20 aa, Plasmodium falciparum
AGECGCPFFYIKLPEYIKYI

SEQ ID NO: 3376556 - protein, 23 aa, Plasmodium falciparum
AGIPRGFLIRRLCNLVFDNISHF

SEQ ID NO: 3376557 - protein, 19 aa, Plasmodium falciparum
AICSKPLVLCEPLFLNLEH

SEQ ID NO: 3376558 - protein, 23 aa, Plasmodium falciparum
AIKLASECVFNFLLNYNKSNLHD

SEQ ID NO: 3376559 - protein, 17 aa, Plasmodium falciparum
AKCDHPNIIKLCGGIIH

SEQ ID NO: 3376560 - protein, 18 aa, Plasmodium falciparum
AKCLRPQLATVIIQYEEN

SEQ ID NO: 3376561 - protein, 17 aa, Plasmodium falciparum
AKFLKWIDDDNMLHNDD

SEQ ID NO: 3376562 - protein, 17 aa, Plasmodium falciparum
AKGKWILKILQLYETSL

SEQ ID NO: 3376563 - protein, 24 aa, Plasmodium falciparum
AKRKEYFLAYRICEYAGIKTDNIL

SEQ ID NO: 3376564 - protein, 23 aa, Plasmodium falciparum
ALKCNEFLKLLGIHTKVADVFLQ

SEQ ID NO: 3376565 - protein, 19 aa, Plasmodium falciparum
ALKSDKRCCPYKCLNASIR

SEQ ID NO: 3376566 - protein, 18 aa, Plasmodium falciparum
ALTFKMNFAFYIPYGSVG

SEQ ID NO: 3376567 - protein, 19 aa, Plasmodium falciparum
APMFNFDFSKGLLNNNEKE

SEQ ID NO: 3376568 - protein, 24 aa, Plasmodium falciparum
AQEFWSLGFGNPFPCSGIHGNGLS

SEQ ID NO: 3376569 - protein, 18 aa, Plasmodium falciparum
ARAAAPCVLFFDELDSIG

SEQ ID NO: 3376570 - protein, 17 aa, Plasmodium falciparum
ARFAKWRTVLVIDTAKG

SEQ ID NO: 3376571 - protein, 17 aa, Plasmodium falciparum
ARIKLYLCDHLRTCAKH

SEQ ID NO: 3376572 - protein, 24 aa, Plasmodium falciparum
ARKLSILKRTEWEKEYKHHTDLKN

SEQ ID NO: 3376573 - protein, 17 aa, Plasmodium falciparum
ARLRLYFIVSYLHAIIL

SEQ ID NO: 3376574 - protein, 17 aa, Plasmodium falciparum
ARRLRIVMYTKLIADGK

SEQ ID NO: 3376575 - protein, 18 aa, Plasmodium falciparum
ARYFLTFCKNEKCNTMLK

SEQ ID NO: 3376576 - protein, 25 aa, Plasmodium falciparum
ASCACKMKCYFFYSQNKNLTNIEKC

SEQ ID NO: 3376577 - protein, 25 aa, Plasmodium falciparum
ASDFLINIILRWNYYTSLKSEKELN

SEQ ID NO: 3376578 - protein, 19 aa, Plasmodium falciparum
ASKCIMEYMELKKQNELKI

SEQ ID NO: 3376579 - protein, 22 aa, Plasmodium falciparum
ASRLPKLQGMFFDKRRNYWTVS

SEQ ID NO: 3376580 - protein, 17 aa, Plasmodium falciparum
AVHNGKELMCYLRKNKN

SEQ ID NO: 3376581 - protein, 20 aa, Plasmodium falciparum
AVSCKELIRSFGWDASDVFT

SEQ ID NO: 3376582 - protein, 17 aa, Plasmodium falciparum
AWKILYKYFPFVINNEL

SEQ ID NO: 3376583 - protein, 18 aa, Plasmodium falciparum
AWRCWKANIPWKVVGLPL

SEQ ID NO: 3376584 - protein, 17 aa, Plasmodium falciparum
AYKYLRYHSQLIISLLD

SEQ ID NO: 3376585 - protein, 22 aa, Plasmodium falciparum
AYMPPECWKIYWKYDTMKIKNP

SEQ ID NO: 3376586 - protein, 22 aa, Plasmodium falciparum
CAPSRLLALIGMALKWQAHHNI

SEQ ID NO: 3376587 - protein, 34 aa, Plasmodium falciparum
CAYGYKKKECFSVYRYGFLIARELAIRSRLKVQK

SEQ ID NO: 3376588 - protein, 18 aa, Plasmodium falciparum
CCHYCNLIYIPFYNCKIT

SEQ ID NO: 3376589 - protein, 20 aa, Plasmodium falciparum
CCTFGYYYFETFLFRNNKMI

SEQ ID NO: 3376590 - protein, 18 aa, Plasmodium falciparum
CDDCGNINWAKREKCNIC

SEQ ID NO: 3376591 - protein, 20 aa, Plasmodium falciparum
CDLCNNPISPLCYVYECNIC

SEQ ID NO: 3376592 - protein, 17 aa, Plasmodium falciparum
CDVIACKENMYINEKDS

SEQ ID NO: 3376593 - protein, 21 aa, Plasmodium falciparum
CDYKIYFKWFFEDNSLYKDFN

SEQ ID NO: 3376594 - protein, 19 aa, Plasmodium falciparum
CECGWKTLIKEGNTWVRSE

SEQ ID NO: 3376595 - protein, 18 aa, Plasmodium falciparum
CEIIYYKRLEQIKSSSHN

SEQ ID NO: 3376596 - protein, 20 aa, Plasmodium falciparum
CELCNSKMWVHTWLDDIGSK

SEQ ID NO: 3376597 - protein, 17 aa, Plasmodium falciparum
CENLCFLSKLFLDHKTL

SEQ ID NO: 3376598 - protein, 17 aa, Plasmodium falciparum
CEPCIMCVYALKLIGIK

SEQ ID NO: 3376599 - protein, 19 aa, Plasmodium falciparum
CEYEIPFLLDYVDDSNKED

SEQ ID NO: 3376600 - protein, 18 aa, Plasmodium falciparum
CFWLEYNISLSYVNNHPN

SEQ ID NO: 3376601 - protein, 18 aa, Plasmodium falciparum
CFYNLKGYLFFPLSYEHI

SEQ ID NO: 3376602 - protein, 17 aa, Plasmodium falciparum
CGFYSFKGNRTYNEDRV

SEQ ID NO: 3376603 - protein, 18 aa, Plasmodium falciparum
CGIIKKFTLGVCAMESKV

SEQ ID NO: 3376604 - protein, 20 aa, Plasmodium falciparum
CGKKNIKKRMDILNQENNNM

SEQ ID NO: 3376605 - protein, 19 aa, Plasmodium falciparum
CGKTRVLFFIPFVVDLLIY

SEQ ID NO: 3376606 - protein, 19 aa, Plasmodium falciparum
CGQFKCFACDIYFINNDAK

SEQ ID NO: 3376607 - protein, 20 aa, Plasmodium falciparum
CGVCLIFCFNPKISQKSLTS

SEQ ID NO: 3376608 - protein, 17 aa, Plasmodium falciparum
CHIRCALISNCIINNKI

SEQ ID NO: 3376609 - protein, 25 aa, Plasmodium falciparum
CIDTDCKLRLRGRGSGYLEGEEKKE

SEQ ID NO: 3376610 - protein, 18 aa, Plasmodium falciparum
CIEKVLLKFDYCPLCRNF

SEQ ID NO: 3376611 - protein, 17 aa, Plasmodium falciparum
CIFDEKFPGLQKKTESM

SEQ ID NO: 3376612 - protein, 18 aa, Plasmodium falciparum
CIHIRIGYKLYKIPFKSF

SEQ ID NO: 3376613 - protein, 17 aa, Plasmodium falciparum
CIIDFKINFIREKYKKE

SEQ ID NO: 3376614 - protein, 17 aa, Plasmodium falciparum
CIIHPSVIFTILDAYLR

SEQ ID NO: 3376615 - protein, 19 aa, Plasmodium falciparum
CIIRFPFSVSKDIKKYLLN

SEQ ID NO: 3376616 - protein, 23 aa, Plasmodium falciparum
CILQEIQKALCVRLDKERKLKVI

SEQ ID NO: 3376617 - protein, 20 aa, Plasmodium falciparum
CILSKMMINYEGDMLVDDQE

SEQ ID NO: 3376618 - protein, 28 aa, Plasmodium falciparum
CINGYMIGIRWVPNVFAYEYYVYKITED

SEQ ID NO: 3376619 - protein, 20 aa, Plasmodium falciparum
CINWRRNCIFVNDIKKKKFL

SEQ ID NO: 3376620 - protein, 24 aa, Plasmodium falciparum
CIQVRWCFFDKLILSAHENGEIVV

SEQ ID NO: 3376621 - protein, 20 aa, Plasmodium falciparum
CIRTKLPICLADKLADDLVE

SEQ ID NO: 3376622 - protein, 25 aa, Plasmodium falciparum
CKCKKMFKYSCVYKQPNILIIHLIR

SEQ ID NO: 3376623 - protein, 18 aa, Plasmodium falciparum
CKFFYKRKFKVAYNRLIF

SEQ ID NO: 3376624 - protein, 17 aa, Plasmodium falciparum
CKFTNICSFEYTKGLCI

SEQ ID NO: 3376625 - protein, 17 aa, Plasmodium falciparum
CKGCKASDTSSEFFSVA

SEQ ID NO: 3376626 - protein, 18 aa, Plasmodium falciparum
CKIIKRLLWGELFEEKKK

SEQ ID NO: 3376627 - protein, 18 aa, Plasmodium falciparum
CKILRINYCLEQNIENNV

SEQ ID NO: 3376628 - protein, 18 aa, Plasmodium falciparum
CKLLHSFYIYLSYYKNIL

SEQ ID NO: 3376629 - protein, 17 aa, Plasmodium falciparum
CKPSRAILENDIKQLEE

SEQ ID NO: 3376630 - protein, 17 aa, Plasmodium falciparum
CKYFNCLGFKFNMLNSD

SEQ ID NO: 3376631 - protein, 19 aa, Plasmodium falciparum
CKYKHCLPQGYVLKKQEPT

SEQ ID NO: 3376632 - protein, 19 aa, Plasmodium falciparum
CLECGFKLVIKYINSSHLS

SEQ ID NO: 3376633 - protein, 18 aa, Plasmodium falciparum
CLIRCLREDRTILCANKF

SEQ ID NO: 3376634 - protein, 24 aa, Plasmodium falciparum
CLIYKLDACIQFSSYVLIRIIHFQ

SEQ ID NO: 3376635 - protein, 18 aa, Plasmodium falciparum
CLKKERCDNISQKILEKE

SEQ ID NO: 3376636 - protein, 17 aa, Plasmodium falciparum
CLKVLKKNVDYFLSPMN

SEQ ID NO: 3376637 - protein, 17 aa, Plasmodium falciparum
CLLVKGWSTDSWSFPRG

SEQ ID NO: 3376638 - protein, 44 aa, Plasmodium falciparum
CLNYFPYDLPIRFNESMPWVRFNDMFPFGSFPFVLPLTSMKKNL

SEQ ID NO: 3376639 - protein, 19 aa, Plasmodium falciparum
CLSCSGLPCHCKVGEATLV

SEQ ID NO: 3376640 - protein, 19 aa, Plasmodium falciparum
CLVSDKAHAVWRSRGRIER

SEQ ID NO: 3376641 - protein, 17 aa, Plasmodium falciparum
CNGDFYKHIDTIIPEEG

SEQ ID NO: 3376642 - protein, 17 aa, Plasmodium falciparum
CNIFHIFLNESFMLLEK

SEQ ID NO: 3376643 - protein, 19 aa, Plasmodium falciparum
CNIYERLYCGSRFFELIIL

SEQ ID NO: 3376644 - protein, 17 aa, Plasmodium falciparum
CNKEQIVLFSFAKALES

SEQ ID NO: 3376645 - protein, 24 aa, Plasmodium falciparum
CNLKFPDFVNPLAIDLIKKTLVVD

SEQ ID NO: 3376646 - protein, 17 aa, Plasmodium falciparum
CNLKKRTWEHISCKEKE

SEQ ID NO: 3376647 - protein, 19 aa, Plasmodium falciparum
CNNCKRWFCNGSYGTCGSH

SEQ ID NO: 3376648 - protein, 17 aa, Plasmodium falciparum
CNNGSVCLTNITKKVDG

SEQ ID NO: 3376649 - protein, 17 aa, Plasmodium falciparum
CNRKHIIGYDVQKDDNT

SEQ ID NO: 3376650 - protein, 21 aa, Plasmodium falciparum
CNRKLSYACPVFFIKPFYNST

SEQ ID NO: 3376651 - protein, 17 aa, Plasmodium falciparum
CPLCYDIFLKYLRFSIL

SEQ ID NO: 3376652 - protein, 18 aa, Plasmodium falciparum
CPLLCITNILLLRNQLHI

SEQ ID NO: 3376653 - protein, 18 aa, Plasmodium falciparum
CPSECMFIHDGLEIWKDK

SEQ ID NO: 3376654 - protein, 19 aa, Plasmodium falciparum
CPTLLRISILFNRLQDVIS

SEQ ID NO: 3376655 - protein, 21 aa, Plasmodium falciparum
CPYSPHSVEGMFLNNKKNKNQ

SEQ ID NO: 3376656 - protein, 19 aa, Plasmodium falciparum
CQTLKWRSPNFEMKKKTSF

SEQ ID NO: 3376657 - protein, 17 aa, Plasmodium falciparum
CRACKFINPNGFKIEDY

SEQ ID NO: 3376658 - protein, 26 aa, Plasmodium falciparum
CRGFRCSSCGIGTFFIKSEYHDDIPI

SEQ ID NO: 3376659 - protein, 17 aa, Plasmodium falciparum
CRICLYGEIIEIIDNNC

SEQ ID NO: 3376660 - protein, 18 aa, Plasmodium falciparum
CRKAERFDVSDDVYHKII

SEQ ID NO: 3376661 - protein, 19 aa, Plasmodium falciparum
CRNSLIGCISCMYEGTKMY

SEQ ID NO: 3376662 - protein, 19 aa, Plasmodium falciparum
CSESEAFFYAWLYLSCLKK

SEQ ID NO: 3376663 - protein, 17 aa, Plasmodium falciparum
CSGNIYPGHGIFFIRND

SEQ ID NO: 3376664 - protein, 20 aa, Plasmodium falciparum
CSHFKGVVEFIYLRKKIRRT

SEQ ID NO: 3376665 - protein, 22 aa, Plasmodium falciparum
CSHLKWYRNSCISFGQDKGSII

SEQ ID NO: 3376666 - protein, 17 aa, Plasmodium falciparum
CSIYNVFELFSKKNIKK

SEQ ID NO: 3376667 - protein, 20 aa, Plasmodium falciparum
CSMCGSVCNYCNCGERTLSY

SEQ ID NO: 3376668 - protein, 19 aa, Plasmodium falciparum
CSVIRRMGYAAAFKWISQF

SEQ ID NO: 3376669 - protein, 18 aa, Plasmodium falciparum
CSYFISLLIRNIAYTNKI

SEQ ID NO: 3376670 - protein, 20 aa, Plasmodium falciparum
CTMCNVYICYFCCHRMNIDI

SEQ ID NO: 3376671 - protein, 21 aa, Plasmodium falciparum
CTTLRRLGWIFGEIEILSSLN

SEQ ID NO: 3376672 - protein, 18 aa, Plasmodium falciparum
CVLAELYTGSLLFRTHEH

SEQ ID NO: 3376673 - protein, 17 aa, Plasmodium falciparum
CVRHCFDYLFTLDSEIF

SEQ ID NO: 3376674 - protein, 20 aa, Plasmodium falciparum
CVYKDFRYEYIFKTKIAYML

SEQ ID NO: 3376675 - protein, 17 aa, Plasmodium falciparum
CWTPWEIFCKTKYDELC

SEQ ID NO: 3376676 - protein, 18 aa, Plasmodium falciparum
CYEHYRSYLLYKYKTTYS

SEQ ID NO: 3376677 - protein, 17 aa, Plasmodium falciparum
CYKHICIDEPKIVFIAP

SEQ ID NO: 3376678 - protein, 21 aa, Plasmodium falciparum
CYNCIKYSHFINIDIYYIKEK

SEQ ID NO: 3376679 - protein, 24 aa, Plasmodium falciparum
CYVCQRPGKLLGCDFCPNSFHPTC

SEQ ID NO: 3376680 - protein, 19 aa, Plasmodium falciparum
CYYKNCRVYLKGFTHKKEK

SEQ ID NO: 3376681 - protein, 19 aa, Plasmodium falciparum
DACDYLWNQIESFVDKDTF

SEQ ID NO: 3376682 - protein, 23 aa, Plasmodium falciparum
DANCLRYIGGIICSGNIKDVISK

SEQ ID NO: 3376683 - protein, 19 aa, Plasmodium falciparum
DCIKDIPISIGMNRETEKN

SEQ ID NO: 3376684 - protein, 21 aa, Plasmodium falciparum
DCWPIVDCLIAFYSTGFPLKK

SEQ ID NO: 3376685 - protein, 24 aa, Plasmodium falciparum
DDCLKRFLYCRAVVLKEKKKLKEV

SEQ ID NO: 3376686 - protein, 17 aa, Plasmodium falciparum
DDLAVGISNIFKWMDID

SEQ ID NO: 3376687 - protein, 22 aa, Plasmodium falciparum
DDRPYKCDICFKSYKRSDHLRN

SEQ ID NO: 3376688 - protein, 17 aa, Plasmodium falciparum
DDYCRWKNYPYLRIDGS

SEQ ID NO: 3376689 - protein, 22 aa, Plasmodium falciparum
DEEMKKKLQFLLIGGDEKKQME

SEQ ID NO: 3376690 - protein, 17 aa, Plasmodium falciparum
DEIGRLLLLSFDNLCTL

SEQ ID NO: 3376691 - protein, 19 aa, Plasmodium falciparum
DELKWKRADIEGFLYIVKR

SEQ ID NO: 3376692 - protein, 17 aa, Plasmodium falciparum
DELRIPRIPDILLEKKD

SEQ ID NO: 3376693 - protein, 20 aa, Plasmodium falciparum
DELYHSIEFDIDKDDKKEET

SEQ ID NO: 3376694 - protein, 19 aa, Plasmodium falciparum
DEMKIFLILCKSKILFTYR

SEQ ID NO: 3376695 - protein, 22 aa, Plasmodium falciparum
DEMWWNENFIKPQVSVSLFLRI

SEQ ID NO: 3376696 - protein, 20 aa, Plasmodium falciparum
DENWLIKLLIYMNSLLQLER

SEQ ID NO: 3376697 - protein, 18 aa, Plasmodium falciparum
DEQKKEWAVKASKINEEN

SEQ ID NO: 3376698 - protein, 19 aa, Plasmodium falciparum
DFFFCINYFLKFAAHINSV

SEQ ID NO: 3376699 - protein, 23 aa, Plasmodium falciparum
DFFYIPRFSNFQIINDSRYIKNK

SEQ ID NO: 3376700 - protein, 21 aa, Plasmodium falciparum
DFHFCLGSSFYIVPASSYPSK

SEQ ID NO: 3376701 - protein, 24 aa, Plasmodium falciparum
DFILLNDCNLCYRNFVTQKANKKN

SEQ ID NO: 3376702 - protein, 18 aa, Plasmodium falciparum
DFYVPVCLPGRYKYNVED

SEQ ID NO: 3376703 - protein, 22 aa, Plasmodium falciparum
DGIKIWDIYNCYAIKTLKYGEN

SEQ ID NO: 3376704 - protein, 23 aa, Plasmodium falciparum
DGPWRRTYCKYGYDPRKDPTSYI

SEQ ID NO: 3376705 - protein, 19 aa, Plasmodium falciparum
DGTFGRVLLCQHIDNKKYY

SEQ ID NO: 3376706 - protein, 17 aa, Plasmodium falciparum
DHFAFPCAMKIYSDKIT

SEQ ID NO: 3376707 - protein, 21 aa, Plasmodium falciparum
DHPNIIKLCGGIIHSYFDIWL

SEQ ID NO: 3376708 - protein, 23 aa, Plasmodium falciparum
DHVKPLCCSYILRFEGPPPHFLI

SEQ ID NO: 3376709 - protein, 19 aa, Plasmodium falciparum
DICPFLFCYLWLKSNDYKI

SEQ ID NO: 3376710 - protein, 22 aa, Plasmodium falciparum
DIFYNRMNLMYGDNHLGDYNYK

SEQ ID NO: 3376711 - protein, 17 aa, Plasmodium falciparum
DIIISEWMGYFLFYECM

SEQ ID NO: 3376712 - protein, 17 aa, Plasmodium falciparum
DIKELYLFLEINNMPKE

SEQ ID NO: 3376713 - protein, 25 aa, Plasmodium falciparum
DILFSYTGFCDIIFSVTCGIYRKKY

SEQ ID NO: 3376714 - protein, 22 aa, Plasmodium falciparum
DILLSLWWKNLIDLYSDIIITN

SEQ ID NO: 3376715 - protein, 17 aa, Plasmodium falciparum
DIVILFWCFSKIGYRDN

SEQ ID NO: 3376716 - protein, 17 aa, Plasmodium falciparum
DIWSLGCILFEFLTKKI

SEQ ID NO: 3376717 - protein, 19 aa, Plasmodium falciparum
DKCNLILNRIEKLLSYEWF

SEQ ID NO: 3376718 - protein, 18 aa, Plasmodium falciparum
DKCNNNIFTGMNMKNMNS

SEQ ID NO: 3376719 - protein, 17 aa, Plasmodium falciparum
DKDGNICDFFMVCSSEL

SEQ ID NO: 3376720 - protein, 23 aa, Plasmodium falciparum
DKDMKWCILCGISTQDQGKSIDG

SEQ ID NO: 3376721 - protein, 24 aa, Plasmodium falciparum
DKEKARLAAVEFMKTVENNGRKKS

SEQ ID NO: 3376722 - protein, 21 aa, Plasmodium falciparum
DKELMFHPSFYIILHTQLSNP

SEQ ID NO: 3376723 - protein, 21 aa, Plasmodium falciparum
DKFMLGVFFFWIWTNGNLWKC

SEQ ID NO: 3376724 - protein, 24 aa, Plasmodium falciparum
DKIKMRCVRILRMIEEVYNNKGNE

SEQ ID NO: 3376725 - protein, 17 aa, Plasmodium falciparum
DKIRGAFFFKVKLENSL

SEQ ID NO: 3376726 - protein, 21 aa, Plasmodium falciparum
DKKDCKIDHICYNSTNESEGK

SEQ ID NO: 3376727 - protein, 18 aa, Plasmodium falciparum
DKSLKYHAVFCINCNNHI

SEQ ID NO: 3376728 - protein, 19 aa, Plasmodium falciparum
DKTPCVFKMMDRWRLAVSN

SEQ ID NO: 3376729 - protein, 26 aa, Plasmodium falciparum
DKYFNCLRCKYICLSVVKMIKHIELY

SEQ ID NO: 3376730 - protein, 24 aa, Plasmodium falciparum
DKYILKYNIEYFKLAQFFSQDYHL

SEQ ID NO: 3376731 - protein, 19 aa, Plasmodium falciparum
DLFCTRYLLNIPRYVRLAS

SEQ ID NO: 3376732 - protein, 23 aa, Plasmodium falciparum
DLFICSWKYFSFELPYYSADIHP

SEQ ID NO: 3376733 - protein, 18 aa, Plasmodium falciparum
DLIKDMCILNGKEFPNPP

SEQ ID NO: 3376734 - protein, 22 aa, Plasmodium falciparum
DLKRRKNIFLSFSYEERNFSSN

SEQ ID NO: 3376735 - protein, 20 aa, Plasmodium falciparum
DLLYEQIILVGITKLDEIIG

SEQ ID NO: 3376736 - protein, 26 aa, Plasmodium falciparum
DLQLTENVFLIWQFLKLYLSTSPQVR

SEQ ID NO: 3376737 - protein, 17 aa, Plasmodium falciparum
DLSITILLSDVFKGADV

SEQ ID NO: 3376738 - protein, 25 aa, Plasmodium falciparum
DLSNRSALHYAVYRNNCDYVKFLIY

SEQ ID NO: 3376739 - protein, 22 aa, Plasmodium falciparum
DMKCPKINVSNMVRFNVENELR

SEQ ID NO: 3376740 - protein, 22 aa, Plasmodium falciparum
DMLNIPLYHGWVISSDDIIFYS

SEQ ID NO: 3376741 - protein, 17 aa, Plasmodium falciparum
DNFICLMCSYVANELKM

SEQ ID NO: 3376742 - protein, 24 aa, Plasmodium falciparum
DNISFKLKRIHNIPRNNLHNYNIS

SEQ ID NO: 3376743 - protein, 18 aa, Plasmodium falciparum
DNYICFFCLYDINFCTLC

SEQ ID NO: 3376744 - protein, 17 aa, Plasmodium falciparum
DNYPSVGIFASRDIQPN

SEQ ID NO: 3376745 - protein, 18 aa, Plasmodium falciparum
DPLLYEELEWYLSTNNEY

SEQ ID NO: 3376746 - protein, 18 aa, Plasmodium falciparum
DPNDLWKNYFLSWIDKHD

SEQ ID NO: 3376747 - protein, 21 aa, Plasmodium falciparum
DPSRYGLSCMQGWRKNMEDAH

SEQ ID NO: 3376748 - protein, 23 aa, Plasmodium falciparum
DRKQFRWKATWYTSHGRRCAKYY

SEQ ID NO: 3376749 - protein, 18 aa, Plasmodium falciparum
DRNMFRKDMHMMHQELLY

SEQ ID NO: 3376750 - protein, 21 aa, Plasmodium falciparum
DRVNCPFFWKIGACRHGDQCS

SEQ ID NO: 3376751 - protein, 25 aa, Plasmodium falciparum
DRYRIEGKLGWGHFSTVWVATDLKS

SEQ ID NO: 3376752 - protein, 24 aa, Plasmodium falciparum
DSFYFKGRFFKIIPNEGWSEIKEL

SEQ ID NO: 3376753 - protein, 20 aa, Plasmodium falciparum
DSKCRVFICLCSLFEDKISK

SEQ ID NO: 3376754 - protein, 24 aa, Plasmodium falciparum
DSVMKFAFCKLVYNISCMNVLNII

SEQ ID NO: 3376755 - protein, 19 aa, Plasmodium falciparum
DSVTRKSLGYAYVNYHNLA

SEQ ID NO: 3376756 - protein, 24 aa, Plasmodium falciparum
DSYGNMYLRICLKVLKKNVDYFLS

SEQ ID NO: 3376757 - protein, 17 aa, Plasmodium falciparum
DTFDFLIDLIPLEDRMK

SEQ ID NO: 3376758 - protein, 17 aa, Plasmodium falciparum
DTFFFKYIQKIQIEMLP

SEQ ID NO: 3376759 - protein, 17 aa, Plasmodium falciparum
DTLKYIVINGMKIEIFK

SEQ ID NO: 3376760 - protein, 19 aa, Plasmodium falciparum
DTNTICLFGGEYCEISKTH

SEQ ID NO: 3376761 - protein, 18 aa, Plasmodium falciparum
DTSFKFCYFFQCLVENEL

SEQ ID NO: 3376762 - protein, 18 aa, Plasmodium falciparum
DTYHFNDFLKWYKINIGK

SEQ ID NO: 3376763 - protein, 20 aa, Plasmodium falciparum
DVRLRKALLYLFKYQHPTII

SEQ ID NO: 3376764 - protein, 19 aa, Plasmodium falciparum
DVWFPGFADSHVFLLKGNI

SEQ ID NO: 3376765 - protein, 18 aa, Plasmodium falciparum
DWMKNMCNILEYLNIKKA

SEQ ID NO: 3376766 - protein, 23 aa, Plasmodium falciparum
DYAFYAERFFEVITGYNSEPDYL

SEQ ID NO: 3376767 - protein, 25 aa, Plasmodium falciparum
DYGKIFLKKICKLFVVSTNSDIYFF

SEQ ID NO: 3376768 - protein, 26 aa, Plasmodium falciparum
DYNKWSVNMLYNFLKMIGLKKEAYLF

SEQ ID NO: 3376769 - protein, 20 aa, Plasmodium falciparum
DYPLLPRLVTNFISAVELYD

SEQ ID NO: 3376770 - protein, 18 aa, Plasmodium falciparum
DYWLCAATDRFIRIWNLE

SEQ ID NO: 3376771 - protein, 20 aa, Plasmodium falciparum
EAHINWTIWEKKWDKWRNNI

SEQ ID NO: 3376772 - protein, 20 aa, Plasmodium falciparum
EAINAIYFIDGMTLDNKILK

SEQ ID NO: 3376773 - protein, 21 aa, Plasmodium falciparum
EAKSLAIKARFAFENKTKNLK

SEQ ID NO: 3376774 - protein, 22 aa, Plasmodium falciparum
EASLYEYFNFAALNNNNGSNIL

SEQ ID NO: 3376775 - protein, 17 aa, Plasmodium falciparum
EASRKWKIIARNILHKE

SEQ ID NO: 3376776 - protein, 19 aa, Plasmodium falciparum
ECIHMNKGRFVRGGAYTKV

SEQ ID NO: 3376777 - protein, 17 aa, Plasmodium falciparum
ECKDFQNAILFKRKILP

SEQ ID NO: 3376778 - protein, 29 aa, Plasmodium falciparum
ECLKYDMYELLLLRFLKYECDYDDSEDIL

SEQ ID NO: 3376779 - protein, 19 aa, Plasmodium falciparum
ECLSIKPDLIFLFDEAWFA

SEQ ID NO: 3376780 - protein, 17 aa, Plasmodium falciparum
ECYSCKTQNLFANVQCY

SEQ ID NO: 3376781 - protein, 24 aa, Plasmodium falciparum
EDDVLRLLSYNSLFNKKTNQDLTY

SEQ ID NO: 3376782 - protein, 22 aa, Plasmodium falciparum
EDEFLFLACDGIWDCKDGQDVV

SEQ ID NO: 3376783 - protein, 19 aa, Plasmodium falciparum
EDIDEYFAAFTIMGTLKKY

SEQ ID NO: 3376784 - protein, 18 aa, Plasmodium falciparum
EDIKEGFHSQGLIINAIL

SEQ ID NO: 3376785 - protein, 17 aa, Plasmodium falciparum
EDLMKWKFTYNENENLL

SEQ ID NO: 3376786 - protein, 22 aa, Plasmodium falciparum
EDLNRINLLFGFNILSISEQKN

SEQ ID NO: 3376787 - protein, 23 aa, Plasmodium falciparum
EDVYNFISLYKFDIEKIQLELCN

SEQ ID NO: 3376788 - protein, 27 aa, Plasmodium falciparum
EEGMKLLREKICFKMLKSIDIYITEII

SEQ ID NO: 3376789 - protein, 24 aa, Plasmodium falciparum
EEHIFNFPIEWNIPNFKNNISTKL

SEQ ID NO: 3376790 - protein, 22 aa, Plasmodium falciparum
EEIKCLYFFFLINILRFKNNLD

SEQ ID NO: 3376791 - protein, 18 aa, Plasmodium falciparum
EEIKKWLFIKAINIYKYF

SEQ ID NO: 3376792 - protein, 25 aa, Plasmodium falciparum
EEKLEMLKRIIINWVNKKHNEFLEN

SEQ ID NO: 3376793 - protein, 18 aa, Plasmodium falciparum
EELLKFYITNNRGINLEY

SEQ ID NO: 3376794 - protein, 23 aa, Plasmodium falciparum
EERGALIAGCKWVDEVIIGTKYN

SEQ ID NO: 3376795 - protein, 32 aa, Plasmodium falciparum
EERLKNVLEIFGYIIHIEYKWSIDKWSYAFVY

SEQ ID NO: 3376796 - protein, 22 aa, Plasmodium falciparum
EFEKRNLLRFSFVKNAEENKRN

SEQ ID NO: 3376797 - protein, 18 aa, Plasmodium falciparum
EFFCWKAISYRGLKEREK

SEQ ID NO: 3376798 - protein, 20 aa, Plasmodium falciparum
EFKNSNILFCFGESSEEEVL

SEQ ID NO: 3376799 - protein, 19 aa, Plasmodium falciparum
EFLNIKIAKMFFTLINKTV

SEQ ID NO: 3376800 - protein, 19 aa, Plasmodium falciparum
EFVDFCLENNFVLPENLSF

SEQ ID NO: 3376801 - protein, 17 aa, Plasmodium falciparum
EGFRCILSKMMINYEGD

SEQ ID NO: 3376802 - protein, 20 aa, Plasmodium falciparum
EGGLLYEWYNKYIYNGDGKE

SEQ ID NO: 3376803 - protein, 24 aa, Plasmodium falciparum
EGKRIPFGFNHRSLPHFIKFDYGP

SEQ ID NO: 3376804 - protein, 18 aa, Plasmodium falciparum
EGPPPHFLIIKFDKVNRK

SEQ ID NO: 3376805 - protein, 19 aa, Plasmodium falciparum
EHIQVWKTKLEIMKKNKCN

SEQ ID NO: 3376806 - protein, 18 aa, Plasmodium falciparum
EHTFKEWVQKHIDRKLEK

SEQ ID NO: 3376807 - protein, 18 aa, Plasmodium falciparum
EICIIDIISIYNCNDISK

SEQ ID NO: 3376808 - protein, 23 aa, Plasmodium falciparum
EIDIKLLRWLTTIMIKTSNSLND

SEQ ID NO: 3376809 - protein, 22 aa, Plasmodium falciparum
EIDLRMGSIFTRFMTIRYIELV

SEQ ID NO: 3376810 - protein, 19 aa, Plasmodium falciparum
EIFKIASLYIIAAFNADIK

SEQ ID NO: 3376811 - protein, 24 aa, Plasmodium falciparum
EIHFKLTWPIALIINTNTIYTYNS

SEQ ID NO: 3376812 - protein, 24 aa, Plasmodium falciparum
EIIGLMKLVFEKAVTQHHFVQMYV

SEQ ID NO: 3376813 - protein, 21 aa, Plasmodium falciparum
EIIKMVVHFNNILLLMLNNNA

SEQ ID NO: 3376814 - protein, 21 aa, Plasmodium falciparum
EIIKNIKMRLGFYSNEESDSH

SEQ ID NO: 3376815 - protein, 22 aa, Plasmodium falciparum
EILCMPGDLILLMSDGVSDNLF

SEQ ID NO: 3376816 - protein, 20 aa, Plasmodium falciparum
EIMLKYVYCTTFFDNYILSI

SEQ ID NO: 3376817 - protein, 19 aa, Plasmodium falciparum
EIYFNGFLKYSKKKQKKKP

SEQ ID NO: 3376818 - protein, 23 aa, Plasmodium falciparum
EKCRIKLIRKFFCESSSENEYSP

SEQ ID NO: 3376819 - protein, 18 aa, Plasmodium falciparum
EKDFLYSRGLDFYDVKCV

SEQ ID NO: 3376820 - protein, 23 aa, Plasmodium falciparum
EKFDRRLDCWLAYENLRLLDKEP

SEQ ID NO: 3376821 - protein, 17 aa, Plasmodium falciparum
EKFRNIFNFEWDQSEDT

SEQ ID NO: 3376822 - protein, 25 aa, Plasmodium falciparum
EKFVKKKILKYICKNEIIENVSNVF

SEQ ID NO: 3376823 - protein, 18 aa, Plasmodium falciparum
EKIIAYRIVEAFQQTVCG

SEQ ID NO: 3376824 - protein, 19 aa, Plasmodium falciparum
EKKFLCIDLEFLDDMNKKN

SEQ ID NO: 3376825 - protein, 23 aa, Plasmodium falciparum
EKKKLCVMWELDLSYNYFKEISI

SEQ ID NO: 3376826 - protein, 20 aa, Plasmodium falciparum
EKKRICSHFLKSIHLLEILC

SEQ ID NO: 3376827 - protein, 21 aa, Plasmodium falciparum
EKKVRIKICLEDFFNKNKEIY

SEQ ID NO: 3376828 - protein, 21 aa, Plasmodium falciparum
EKKYRLIGDFSRYMSVTINEK

SEQ ID NO: 3376829 - protein, 23 aa, Plasmodium falciparum
EKLAENCGFVFLSNEHTKGDKSF

SEQ ID NO: 3376830 - protein, 19 aa, Plasmodium falciparum
EKLDGLSFCYDNDSKNFNF

SEQ ID NO: 3376831 - protein, 18 aa, Plasmodium falciparum
EKLHIICGKEIVVDVASM

SEQ ID NO: 3376832 - protein, 22 aa, Plasmodium falciparum
EKLIYRKVCDIVKIELFVIKNY

SEQ ID NO: 3376833 - protein, 17 aa, Plasmodium falciparum
EKLKCLDKTISNNTNDQ

SEQ ID NO: 3376834 - protein, 23 aa, Plasmodium falciparum
EKLKDLWFMPGIIYKKVKKAIKY

SEQ ID NO: 3376835 - protein, 24 aa, Plasmodium falciparum
EKLVAQLLIRWWYVLPDWPPPDYD

SEQ ID NO: 3376836 - protein, 20 aa, Plasmodium falciparum
EKNCIWRFRFQLLNRKETLG

SEQ ID NO: 3376837 - protein, 19 aa, Plasmodium falciparum
EKNCVFKYFLDVKETSHKN

SEQ ID NO: 3376838 - protein, 22 aa, Plasmodium falciparum
EKNMRWVMCKSLKQARLGLATI

SEQ ID NO: 3376839 - protein, 19 aa, Plasmodium falciparum
EKPLTCLVKAGSVNLPKNV

SEQ ID NO: 3376840 - protein, 23 aa, Plasmodium falciparum
EKPWGVPCTLAFPCATQNEINLE

SEQ ID NO: 3376841 - protein, 19 aa, Plasmodium falciparum
EKRKLTGIVSIEYEKNESA

SEQ ID NO: 3376842 - protein, 18 aa, Plasmodium falciparum
EKRLCLSFLSSSSEEEAL

SEQ ID NO: 3376843 - protein, 23 aa, Plasmodium falciparum
EKRNRLKLLLPWLESRANEGYEN

SEQ ID NO: 3376844 - protein, 17 aa, Plasmodium falciparum
EKYLCCIYESKNEIIDK

SEQ ID NO: 3376845 - protein, 20 aa, Plasmodium falciparum
EKYLRFSTYESWKLHDSEDD

SEQ ID NO: 3376846 - protein, 23 aa, Plasmodium falciparum
ELFSNWCPLKIINKGLGTFHSTD

SEQ ID NO: 3376847 - protein, 25 aa, Plasmodium falciparum
ELKKEFLLMYGRLMFSRKKLQEKEV

SEQ ID NO: 3376848 - protein, 30 aa, Plasmodium falciparum
ELKPKAPHIFCIKCKEVLVTNRFLDKYKTK

SEQ ID NO: 3376849 - protein, 17 aa, Plasmodium falciparum
ELLEIFQPFGLIESIKL

SEQ ID NO: 3376850 - protein, 17 aa, Plasmodium falciparum
ELLFALTTETAWESVMR

SEQ ID NO: 3376851 - protein, 17 aa, Plasmodium falciparum
ELNEIRKNLNLFIIRQD

SEQ ID NO: 3376852 - protein, 32 aa, Plasmodium falciparum
ELQRKKMYSKRIKFVIQDVFDLRSSEWRKKTH

SEQ ID NO: 3376853 - protein, 17 aa, Plasmodium falciparum
ELWELYIYMNLKKKKRK

SEQ ID NO: 3376854 - protein, 18 aa, Plasmodium falciparum
ELYLGYDISVFILLVKAE

SEQ ID NO: 3376855 - protein, 18 aa, Plasmodium falciparum
EMNGKICLRKEYLEKLKE

SEQ ID NO: 3376856 - protein, 22 aa, Plasmodium falciparum
EMRQKYMLKKKFLMNNYKGKTN

SEQ ID NO: 3376857 - protein, 23 aa, Plasmodium falciparum
ENCRNWPYCAFGSECIYIHPNVP

SEQ ID NO: 3376858 - protein, 17 aa, Plasmodium falciparum
ENFKLKTPCHFTLAQNT

SEQ ID NO: 3376859 - protein, 24 aa, Plasmodium falciparum
ENFRCPICMLILFKPVKTKCGHIF

SEQ ID NO: 3376860 - protein, 24 aa, Plasmodium falciparum
ENIGFRCFYNFILDYYETININDP

SEQ ID NO: 3376861 - protein, 17 aa, Plasmodium falciparum
ENILFCFSIDKDKNRLL

SEQ ID NO: 3376862 - protein, 20 aa, Plasmodium falciparum
ENITFFPAIEQFNFSIEHAV

SEQ ID NO: 3376863 - protein, 24 aa, Plasmodium falciparum
ENKKFRILCFQKGSGRLFLNTDIF

SEQ ID NO: 3376864 - protein, 23 aa, Plasmodium falciparum
ENKKSCMLKCEKNVFITDCFYYK

SEQ ID NO: 3376865 - protein, 21 aa, Plasmodium falciparum
ENKYDYYSCCYSDQFDESDSD

SEQ ID NO: 3376866 - protein, 20 aa, Plasmodium falciparum
ENLMIYKKCFFFINAIDEYC

SEQ ID NO: 3376867 - protein, 18 aa, Plasmodium falciparum
ENLWSYSSSYGIDWNTLD

SEQ ID NO: 3376868 - protein, 23 aa, Plasmodium falciparum
ENMKRILYEWAKFLIKENDNTNI

SEQ ID NO: 3376869 - protein, 20 aa, Plasmodium falciparum
ENTIRFAIYFEECKNKTQKN

SEQ ID NO: 3376870 - protein, 25 aa, Plasmodium falciparum
ENYEWFCSSCLQFCFNIIKQKEFVD

SEQ ID NO: 3376871 - protein, 23 aa, Plasmodium falciparum
ENYIPLDIALNFVMDNEKLKKNL

SEQ ID NO: 3376872 - protein, 22 aa, Plasmodium falciparum
EPIKKYNLCGVIVHRGLNSNCG

SEQ ID NO: 3376873 - protein, 18 aa, Plasmodium falciparum
EPKIPICVGMVLAKIHNG

SEQ ID NO: 3376874 - protein, 21 aa, Plasmodium falciparum
EPNCKVYILAYLDNLRTRNIN

SEQ ID NO: 3376875 - protein, 19 aa, Plasmodium falciparum
EQCEYCLTNFSISGHLILT

SEQ ID NO: 3376876 - protein, 22 aa, Plasmodium falciparum
EQDFKNFICKYILNNKINDIQN

SEQ ID NO: 3376877 - protein, 18 aa, Plasmodium falciparum
EQECWRSNKKFDDMNNRN

SEQ ID NO: 3376878 - protein, 23 aa, Plasmodium falciparum
EQKQKKRLLGIVKLIGELFQRQI

SEQ ID NO: 3376879 - protein, 17 aa, Plasmodium falciparum
EQLWYLIECLIKKKNLN

SEQ ID NO: 3376880 - protein, 20 aa, Plasmodium falciparum
EQNIRLVIVFLIDISFISSN

SEQ ID NO: 3376881 - protein, 23 aa, Plasmodium falciparum
ERAHLPSALWSRVLLSLNKKEAF

SEQ ID NO: 3376882 - protein, 26 aa, Plasmodium falciparum
ERENLGLLKRNGWRDLICSTFLEDVH

SEQ ID NO: 3376883 - protein, 19 aa, Plasmodium falciparum
ERYKRLIFRRIKWNEDVYD

SEQ ID NO: 3376884 - protein, 17 aa, Plasmodium falciparum
ESCYRMILHWVQHFDDK

SEQ ID NO: 3376885 - protein, 19 aa, Plasmodium falciparum
ESFIKRFHIDVVVRGTIVD

SEQ ID NO: 3376886 - protein, 18 aa, Plasmodium falciparum
ESFLKWTPHKNIKRSYNK

SEQ ID NO: 3376887 - protein, 21 aa, Plasmodium falciparum
ESHVPFYVVISIFMLSLPQKL

SEQ ID NO: 3376888 - protein, 19 aa, Plasmodium falciparum
ESISSFNYFFFAKKNKRIL

SEQ ID NO: 3376889 - protein, 17 aa, Plasmodium falciparum
ESLFKCFEFLKNINYKL

SEQ ID NO: 3376890 - protein, 19 aa, Plasmodium falciparum
ESLICSLSFEEVRKKSKQE

SEQ ID NO: 3376891 - protein, 22 aa, Plasmodium falciparum
ESLKSFQFLNGRYFGGSLINAY

SEQ ID NO: 3376892 - protein, 18 aa, Plasmodium falciparum
ESTSRLAFVTAFTISPYA

SEQ ID NO: 3376893 - protein, 22 aa, Plasmodium falciparum
ETFKRKFNCINMYLEDMERGEQ

SEQ ID NO: 3376894 - protein, 17 aa, Plasmodium falciparum
ETIKRFLPRSCQILLFS

SEQ ID NO: 3376895 - protein, 17 aa, Plasmodium falciparum
ETLQMIQFSIVWSTYIF

SEQ ID NO: 3376896 - protein, 23 aa, Plasmodium falciparum
ETYPGSFQFIFELAMNKLAAEAK

SEQ ID NO: 3376897 - protein, 20 aa, Plasmodium falciparum
EVDFSYSFNISKVFCRSVLV

SEQ ID NO: 3376898 - protein, 21 aa, Plasmodium falciparum
EVESLSFFFHCCNINTYYWYK

SEQ ID NO: 3376899 - protein, 18 aa, Plasmodium falciparum
EVISFMLNNIFLKEKDIS

SEQ ID NO: 3376900 - protein, 23 aa, Plasmodium falciparum
EVKKLPVAFGLYKLHMSCIIYDD

SEQ ID NO: 3376901 - protein, 17 aa, Plasmodium falciparum
EYCRSKCIQFNDENYFY

SEQ ID NO: 3376902 - protein, 23 aa, Plasmodium falciparum
EYDMWKCFLSNIYRYENEKCDKY

SEQ ID NO: 3376903 - protein, 20 aa, Plasmodium falciparum
EYFMSISFFSYVIEKWKILI

SEQ ID NO: 3376904 - protein, 31 aa, Plasmodium falciparum
EYNRLRNIPSYELSKYLYLFYELGKMTEKLN

SEQ ID NO: 3376905 - protein, 18 aa, Plasmodium falciparum
EYPIHFTYRNEKKNSSKN

SEQ ID NO: 3376906 - protein, 19 aa, Plasmodium falciparum
EYPLRIPIIGDDGNSKGFL

SEQ ID NO: 3376907 - protein, 17 aa, Plasmodium falciparum
FATRYLVMFSRASSLSD

SEQ ID NO: 3376908 - protein, 17 aa, Plasmodium falciparum
FCILCGCDYCDTIKGIG

SEQ ID NO: 3376909 - protein, 17 aa, Plasmodium falciparum
FCIPCGYNTKEYKYNIY

SEQ ID NO: 3376910 - protein, 25 aa, Plasmodium falciparum
FCSLYKIKYFQGMHDMIISLFYLNL

SEQ ID NO: 3376911 - protein, 18 aa, Plasmodium falciparum
FCTLCPSCILIGTHSKCF

SEQ ID NO: 3376912 - protein, 18 aa, Plasmodium falciparum
FCTLQKWLFGAFANLVDN

SEQ ID NO: 3376913 - protein, 17 aa, Plasmodium falciparum
FDDLCEFIYDIYVILNF

SEQ ID NO: 3376914 - protein, 23 aa, Plasmodium falciparum
FDFKNEMLFCFKRDYENIYMNIT

SEQ ID NO: 3376915 - protein, 17 aa, Plasmodium falciparum
FDKSNCKKGWNVIKESI

SEQ ID NO: 3376916 - protein, 18 aa, Plasmodium falciparum
FDLPSPYFFEICYMFLDQ

SEQ ID NO: 3376917 - protein, 22 aa, Plasmodium falciparum
FDSRWYRCIENFEELYKHLVCT

SEQ ID NO: 3376918 - protein, 18 aa, Plasmodium falciparum
FDVPPYCELAPLIVLTKN

SEQ ID NO: 3376919 - protein, 20 aa, Plasmodium falciparum
FECKDCKSFYNEIYSDDDEG

SEQ ID NO: 3376920 - protein, 17 aa, Plasmodium falciparum
FEECFKGRILYENEKYQ

SEQ ID NO: 3376921 - protein, 18 aa, Plasmodium falciparum
FEHFKGPFLFDSDEGIYS

SEQ ID NO: 3376922 - protein, 17 aa, Plasmodium falciparum
FEMKKKTSFEIALLKKI

SEQ ID NO: 3376923 - protein, 23 aa, Plasmodium falciparum
FENECLRYLYSAQFDFSKAMELI

SEQ ID NO: 3376924 - protein, 17 aa, Plasmodium falciparum
FEQARILAVKARQEAEK

SEQ ID NO: 3376925 - protein, 25 aa, Plasmodium falciparum
FESFFWPPCYLVIVCEYLSGGTLYD

SEQ ID NO: 3376926 - protein, 18 aa, Plasmodium falciparum
FFFHCCNINTYYWYKKEI

SEQ ID NO: 3376927 - protein, 18 aa, Plasmodium falciparum
FFHCYKISYVLKNAKLAP

SEQ ID NO: 3376928 - protein, 19 aa, Plasmodium falciparum
FFIFFKFKESFIRDYLITF

SEQ ID NO: 3376929 - protein, 19 aa, Plasmodium falciparum
FFIKSCYDLDLYIKIQRKN

SEQ ID NO: 3376930 - protein, 22 aa, Plasmodium falciparum
FFINCLLFRGAVKISEDIKIIE

SEQ ID NO: 3376931 - protein, 19 aa, Plasmodium falciparum
FFIYHCLSEKFVKNFVSFV

SEQ ID NO: 3376932 - protein, 20 aa, Plasmodium falciparum
FFKKICKLFSTCYVNNDMLT

SEQ ID NO: 3376933 - protein, 17 aa, Plasmodium falciparum
FFKLMEMYFDNKIDDKK

SEQ ID NO: 3376934 - protein, 17 aa, Plasmodium falciparum
FFKYCFDRLKSLLNNLQ

SEQ ID NO: 3376935 - protein, 20 aa, Plasmodium falciparum
FFKYELVHLYSLKNYSVILF

SEQ ID NO: 3376936 - protein, 17 aa, Plasmodium falciparum
FFKYSCMYRKRQLLHEK

SEQ ID NO: 3376937 - protein, 17 aa, Plasmodium falciparum
FFLAQWYKRNCRYLFNE

SEQ ID NO: 3376938 - protein, 18 aa, Plasmodium falciparum
FFMCWKKCRFNNLTKVFL

SEQ ID NO: 3376939 - protein, 17 aa, Plasmodium falciparum
FFPYYAFNILAGVDENN

SEQ ID NO: 3376940 - protein, 22 aa, Plasmodium falciparum
FGGQEIPIWGGIEVPNWEEEYK

SEQ ID NO: 3376941 - protein, 29 aa, Plasmodium falciparum
FGSECIYIHPNVPCKFGIYCTNYYCNYSH

SEQ ID NO: 3376942 - protein, 17 aa, Plasmodium falciparum
FGVIFCRNIHIQLSLRK

SEQ ID NO: 3376943 - protein, 17 aa, Plasmodium falciparum
FHFPKSVSLLAQELILK

SEQ ID NO: 3376944 - protein, 17 aa, Plasmodium falciparum
FHHKLYALGKHYNSVID

SEQ ID NO: 3376945 - protein, 20 aa, Plasmodium falciparum
FHMWQKMELNFFFKKYYQNN

SEQ ID NO: 3376946 - protein, 21 aa, Plasmodium falciparum
FHPILKFRTAMTVAEKMRSTE

SEQ ID NO: 3376947 - protein, 17 aa, Plasmodium falciparum
FIAYKWTLGVSFAELLE

SEQ ID NO: 3376948 - protein, 18 aa, Plasmodium falciparum
FICMGGDLIPIRYAYAGN

SEQ ID NO: 3376949 - protein, 20 aa, Plasmodium falciparum
FICSHMWPLFIKPILDGVLE

SEQ ID NO: 3376950 - protein, 18 aa, Plasmodium falciparum
FIILYFFCVLFLKDYERS

SEQ ID NO: 3376951 - protein, 17 aa, Plasmodium falciparum
FILHLCLNKHLVERDLI

SEQ ID NO: 3376952 - protein, 19 aa, Plasmodium falciparum
FILNFSINFYKFVISSLIL

SEQ ID NO: 3376953 - protein, 18 aa, Plasmodium falciparum
FIQRIVCVLIKKFLCEHL

SEQ ID NO: 3376954 - protein, 25 aa, Plasmodium falciparum
FISFYSSKCKYVFTSDDEEKLEKKQ

SEQ ID NO: 3376955 - protein, 21 aa, Plasmodium falciparum
FISHLGFPCYYIYLNKEKNLI

SEQ ID NO: 3376956 - protein, 22 aa, Plasmodium falciparum
FISNNCQWSFSLFPLSLINKLI

SEQ ID NO: 3376957 - protein, 17 aa, Plasmodium falciparum
FISSIYLSFALCLIYKL

SEQ ID NO: 3376958 - protein, 17 aa, Plasmodium falciparum
FIWKFLFSHMNTEKSKE

SEQ ID NO: 3376959 - protein, 19 aa, Plasmodium falciparum
FKAGQCKIEVCSHDSAQFI

SEQ ID NO: 3376960 - protein, 21 aa, Plasmodium falciparum
FKAYYLRGIARYKLRIYKLSL

SEQ ID NO: 3376961 - protein, 19 aa, Plasmodium falciparum
FKCPYCLWSSINTVCKPKL

SEQ ID NO: 3376962 - protein, 20 aa, Plasmodium falciparum
FKELWTFIQAVEFNRKTINE

SEQ ID NO: 3376963 - protein, 24 aa, Plasmodium falciparum
FKESWFYKKIKPCIKKYMPKYTNE

SEQ ID NO: 3376964 - protein, 22 aa, Plasmodium falciparum
FKFKELSRIGGVLFVEGNENLG

SEQ ID NO: 3376965 - protein, 17 aa, Plasmodium falciparum
FKFSEKYLYIFGNEKKH

SEQ ID NO: 3376966 - protein, 20 aa, Plasmodium falciparum
FKGLFKHNACLISEYEYNND

SEQ ID NO: 3376967 - protein, 17 aa, Plasmodium falciparum
FKGPFLFDSDEGIYSST

SEQ ID NO: 3376968 - protein, 21 aa, Plasmodium falciparum
FKHIIKTPLYLYKSKEDKNKN

SEQ ID NO: 3376969 - protein, 21 aa, Plasmodium falciparum
FKIKRFHVFRDYAFFIDDIKK

SEQ ID NO: 3376970 - protein, 21 aa, Plasmodium falciparum
FKILFEICKLKNLSYSIESIY

SEQ ID NO: 3376971 - protein, 20 aa, Plasmodium falciparum
FKINKIRGYHILKLTDKELK

SEQ ID NO: 3376972 - protein, 19 aa, Plasmodium falciparum
FKINMGILCCFTFKNTKNP

SEQ ID NO: 3376973 - protein, 21 aa, Plasmodium falciparum
FKIYDCKHVLKKSIKVLNKYA

SEQ ID NO: 3376974 - protein, 17 aa, Plasmodium falciparum
FKKAYFFIFKDDIYIYG

SEQ ID NO: 3376975 - protein, 17 aa, Plasmodium falciparum
FKKECIFHPTIKDNVKI

SEQ ID NO: 3376976 - protein, 17 aa, Plasmodium falciparum
FKKERQGTVKYLKEYFQ

SEQ ID NO: 3376977 - protein, 23 aa, Plasmodium falciparum
FKKMEIIKGFLIKNINKYGINFE

SEQ ID NO: 3376978 - protein, 22 aa, Plasmodium falciparum
FKKRNSCLWNYFTYHKHRNQYT

SEQ ID NO: 3376979 - protein, 19 aa, Plasmodium falciparum
FKKSLRYNYDFYKNVNTNS

SEQ ID NO: 3376980 - protein, 20 aa, Plasmodium falciparum
FKKYFFLLLYRYHISRHTYP

SEQ ID NO: 3376981 - protein, 19 aa, Plasmodium falciparum
FKLIITKFIDGFIKCTESK

SEQ ID NO: 3376982 - protein, 17 aa, Plasmodium falciparum
FKMNFAFYIPYGSVGID

SEQ ID NO: 3376983 - protein, 20 aa, Plasmodium falciparum
FKNAESWTPICLPIYNPNLF

SEQ ID NO: 3376984 - protein, 24 aa, Plasmodium falciparum
FKNDLNCNFLWRHYEKILQDINHL

SEQ ID NO: 3376985 - protein, 25 aa, Plasmodium falciparum
FKNFGLYFWYHIKCIENERDLNFYI

SEQ ID NO: 3376986 - protein, 17 aa, Plasmodium falciparum
FKPGEGVMDSMNNLFMY

SEQ ID NO: 3376987 - protein, 26 aa, Plasmodium falciparum
FKRDFKKRCAYDFGMKIIGKPRSRRK

SEQ ID NO: 3376988 - protein, 20 aa, Plasmodium falciparum
FKRKRWKYIILDEAHNIKNF

SEQ ID NO: 3376989 - protein, 20 aa, Plasmodium falciparum
FKRLKNILKRFGISMKPSGN

SEQ ID NO: 3376990 - protein, 18 aa, Plasmodium falciparum
FKRNAKWSAIKPVPDIGD

SEQ ID NO: 3376991 - protein, 19 aa, Plasmodium falciparum
FKRPCVLDIKMGKRQRKIG

SEQ ID NO: 3376992 - protein, 20 aa, Plasmodium falciparum
FKRRKECVPHIILEDLVYGF

SEQ ID NO: 3376993 - protein, 23 aa, Plasmodium falciparum
FKTLICYYSKLLASHPCIKYIFR

SEQ ID NO: 3376994 - protein, 17 aa, Plasmodium falciparum
FKYCILLIFLLNNQLIC

SEQ ID NO: 3376995 - protein, 20 aa, Plasmodium falciparum
FKYGFPYFWINALVEKPYSL

SEQ ID NO: 3376996 - protein, 17 aa, Plasmodium falciparum
FKYVCLLLNNGGKREVR

SEQ ID NO: 3376997 - protein, 17 aa, Plasmodium falciparum
FLDAIILNIKFDYTEHK

SEQ ID NO: 3376998 - protein, 18 aa, Plasmodium falciparum
FLEIMNLYRNVDFHKNMC

SEQ ID NO: 3376999 - protein, 18 aa, Plasmodium falciparum
FLFDLYKNIYIKYLNGQD

SEQ ID NO: 3377000 - protein, 17 aa, Plasmodium falciparum
FLFFQIASGISFIQTCY

SEQ ID NO: 3377001 - protein, 17 aa, Plasmodium falciparum
FLFLQLLKKRFIKKCKY

SEQ ID NO: 3377002 - protein, 17 aa, Plasmodium falciparum
FLFLRLATQIDYSKEIN

SEQ ID NO: 3377003 - protein, 18 aa, Plasmodium falciparum
FLHFYAELHKKCNYEEGR

SEQ ID NO: 3377004 - protein, 17 aa, Plasmodium falciparum
FLLGKSCNKAMRIDHFI

SEQ ID NO: 3377005 - protein, 23 aa, Plasmodium falciparum
FLLKKCILTLHMLIKYNNEIPYI

SEQ ID NO: 3377006 - protein, 18 aa, Plasmodium falciparum
FLLYFLLNEEEIYKKLFE

SEQ ID NO: 3377007 - protein, 18 aa, Plasmodium falciparum
FLLYFSFNFIIQNIQSVI

SEQ ID NO: 3377008 - protein, 23 aa, Plasmodium falciparum
FLNKWLCPFFEDFIINLQNYDKN

SEQ ID NO: 3377009 - protein, 17 aa, Plasmodium falciparum
FLPNVKIIDCYNKEGME

SEQ ID NO: 3377010 - protein, 17 aa, Plasmodium falciparum
FLQCINKLFELYQRLNI

SEQ ID NO: 3377011 - protein, 22 aa, Plasmodium falciparum
FLQFFPLPGLWGERLFLKFNFK

SEQ ID NO: 3377012 - protein, 22 aa, Plasmodium falciparum
FLSFPNICIFLLKRFTFDLQRM

SEQ ID NO: 3377013 - protein, 26 aa, Plasmodium falciparum
FLSKFCMLKRKFVYNFFLVKKEIVKK

SEQ ID NO: 3377014 - protein, 19 aa, Plasmodium falciparum
FLTLKCIHLYFASHLSYPN

SEQ ID NO: 3377015 - protein, 17 aa, Plasmodium falciparum
FLYSRGLDFYDVKCVVN

SEQ ID NO: 3377016 - protein, 18 aa, Plasmodium falciparum
FMEPLTLVKHVTFDNNQE

SEQ ID NO: 3377017 - protein, 24 aa, Plasmodium falciparum
FNDICTYHFISLIFQCFYNHGNDD

SEQ ID NO: 3377018 - protein, 17 aa, Plasmodium falciparum
FNDNFLKFLKQITNHNI

SEQ ID NO: 3377019 - protein, 18 aa, Plasmodium falciparum
FNEHRCFICKSLYEDTSK

SEQ ID NO: 3377020 - protein, 23 aa, Plasmodium falciparum
FNFKLCSYYDYFKLFRQKIMEND

SEQ ID NO: 3377021 - protein, 25 aa, Plasmodium falciparum
FNFLFKVYFLYPFTKYVCNYLRQIK

SEQ ID NO: 3377022 - protein, 17 aa, Plasmodium falciparum
FNIPLRSSISVRDLRIE

SEQ ID NO: 3377023 - protein, 17 aa, Plasmodium falciparum
FNKFKGFNFCISSNKNN

SEQ ID NO: 3377024 - protein, 18 aa, Plasmodium falciparum
FNLKYEDIIVLSLFNNNN

SEQ ID NO: 3377025 - protein, 19 aa, Plasmodium falciparum
FNNCEYVNVLLYRAFSIKR

SEQ ID NO: 3377026 - protein, 24 aa, Plasmodium falciparum
FNRWKTALCFGGFLKGGEHMNNTY

SEQ ID NO: 3377027 - protein, 18 aa, Plasmodium falciparum
FNTFFYKKLELYDDVLKA

SEQ ID NO: 3377028 - protein, 30 aa, Plasmodium falciparum
FPCDCGYQICLWCLYYIRDHMNNTCPACRR

SEQ ID NO: 3377029 - protein, 22 aa, Plasmodium falciparum
FPKMIPCFVIYPPASEFLLRGA

SEQ ID NO: 3377030 - protein, 18 aa, Plasmodium falciparum
FPNIYFKNIIDFLKSEKF

SEQ ID NO: 3377031 - protein, 20 aa, Plasmodium falciparum
FPNPPSLYNCRICLCEYENV

SEQ ID NO: 3377032 - protein, 17 aa, Plasmodium falciparum
FPQKSWKGILFGDKNKH

SEQ ID NO: 3377033 - protein, 20 aa, Plasmodium falciparum
FPQTFSVILQHCIKINNEKA

SEQ ID NO: 3377034 - protein, 26 aa, Plasmodium falciparum
FPRQCYLILCSYKYMCLNMHYDTDNY

SEQ ID NO: 3377035 - protein, 17 aa, Plasmodium falciparum
FPSQFIRYSYNGTALYS

SEQ ID NO: 3377036 - protein, 18 aa, Plasmodium falciparum
FPWPNAKCPMFFYNSTGL

SEQ ID NO: 3377037 - protein, 20 aa, Plasmodium falciparum
FPYEIIKWTSFLLEYLTEII

SEQ ID NO: 3377038 - protein, 17 aa, Plasmodium falciparum
FQILCAIAYMHSNNIAH

SEQ ID NO: 3377039 - protein, 26 aa, Plasmodium falciparum
FQLCPWKKGIQWNLLKKMWTCKLWDN

SEQ ID NO: 3377040 - protein, 19 aa, Plasmodium falciparum
FQPKLKWLNIFTRNFNKDQ

SEQ ID NO: 3377041 - protein, 17 aa, Plasmodium falciparum
FRCAISLKGKEENDTHD

SEQ ID NO: 3377042 - protein, 19 aa, Plasmodium falciparum
FRCASCPYKGLPAFQPGEN

SEQ ID NO: 3377043 - protein, 20 aa, Plasmodium falciparum
FRDVLKYGFYDMLLKRDTYR

SEQ ID NO: 3377044 - protein, 17 aa, Plasmodium falciparum
FREEFKYFISLDTPFFN

SEQ ID NO: 3377045 - protein, 18 aa, Plasmodium falciparum
FRGGESFSEENHIGKAGD

SEQ ID NO: 3377046 - protein, 25 aa, Plasmodium falciparum
FRLSSKRKKNCNELLNGEKHVEKNK

SEQ ID NO: 3377047 - protein, 20 aa, Plasmodium falciparum
FRNLLKCFSLFYALSYIEFD

SEQ ID NO: 3377048 - protein, 19 aa, Plasmodium falciparum
FRNSYELTKFISIFFELQK

SEQ ID NO: 3377049 - protein, 19 aa, Plasmodium falciparum
FRQSFLITCKKKFKEKGSK

SEQ ID NO: 3377050 - protein, 17 aa, Plasmodium falciparum
FRTAMTVAEKMRSTEQK

SEQ ID NO: 3377051 - protein, 18 aa, Plasmodium falciparum
FRTKQCKRLLNGGCNFGL

SEQ ID NO: 3377052 - protein, 20 aa, Plasmodium falciparum
FRVILSYGFKSMHNVLRKIK

SEQ ID NO: 3377053 - protein, 18 aa, Plasmodium falciparum
FRYLNCVNSVFKVACEPI

SEQ ID NO: 3377054 - protein, 17 aa, Plasmodium falciparum
FSEKYLYIFGNEKKHVE

SEQ ID NO: 3377055 - protein, 19 aa, Plasmodium falciparum
FSGRCLRRIPFQAYAYFCQ

SEQ ID NO: 3377056 - protein, 18 aa, Plasmodium falciparum
FSHLYTMYIQNNFDYLYK

SEQ ID NO: 3377057 - protein, 24 aa, Plasmodium falciparum
FSIRYKMQFFFSHVIRYLQEDIIN

SEQ ID NO: 3377058 - protein, 18 aa, Plasmodium falciparum
FSKFCVYPDFLHACNKNR

SEQ ID NO: 3377059 - protein, 37 aa, Plasmodium falciparum
FSLKLPLEIKVSMALRISERLRAFVFDKDLTAYYIKK

SEQ ID NO: 3377060 - protein, 20 aa, Plasmodium falciparum
FSMRVIEWYSWHFPELKKIV

SEQ ID NO: 3377061 - protein, 20 aa, Plasmodium falciparum
FSQTCLSCFSTFIGCTFISC

SEQ ID NO: 3377062 - protein, 23 aa, Plasmodium falciparum
FSSELMFYWWCLNYFPYDLPIRF

SEQ ID NO: 3377063 - protein, 20 aa, Plasmodium falciparum
FSTFSFDINKYTSWADIVDE

SEQ ID NO: 3377064 - protein, 19 aa, Plasmodium falciparum
FSVLKCTYAYILYKYNMDK

SEQ ID NO: 3377065 - protein, 18 aa, Plasmodium falciparum
FTCCLIACYIYQIKIDVI

SEQ ID NO: 3377066 - protein, 22 aa, Plasmodium falciparum
FTCCYEYYCSLECFKKHDQQKC

SEQ ID NO: 3377067 - protein, 25 aa, Plasmodium falciparum
FTEHCIFNLFKLVLLRVSLYIGVFN

SEQ ID NO: 3377068 - protein, 18 aa, Plasmodium falciparum
FTNFFLEKFILIFENQAN

SEQ ID NO: 3377069 - protein, 20 aa, Plasmodium falciparum
FTNICSFEYTKGLCIFDMLN

SEQ ID NO: 3377070 - protein, 17 aa, Plasmodium falciparum
FTVPCYHIFLKRNQINS

SEQ ID NO: 3377071 - protein, 17 aa, Plasmodium falciparum
FVEELKCLLILTDDPYT

SEQ ID NO: 3377072 - protein, 18 aa, Plasmodium falciparum
FVIKRPDLFGSIYEEINQ

SEQ ID NO: 3377073 - protein, 23 aa, Plasmodium falciparum
FVPFEEKEIFSLYKKCSYELNEI

SEQ ID NO: 3377074 - protein, 17 aa, Plasmodium falciparum
FVYFFKVIHTFDFLANN

SEQ ID NO: 3377075 - protein, 24 aa, Plasmodium falciparum
FVYRLYRLPIYYLLTNEHRNQFLL

SEQ ID NO: 3377076 - protein, 20 aa, Plasmodium falciparum
FWNRRCPFYLSDSSFIRYIT

SEQ ID NO: 3377077 - protein, 18 aa, Plasmodium falciparum
FYDELSFILNNEEVQSTD

SEQ ID NO: 3377078 - protein, 18 aa, Plasmodium falciparum
FYDIKRFMCLGSTIRDND

SEQ ID NO: 3377079 - protein, 17 aa, Plasmodium falciparum
FYDLEIDGVISSFEARK

SEQ ID NO: 3377080 - protein, 24 aa, Plasmodium falciparum
FYETPWYMCVKMGDKEVCMMSYEM

SEQ ID NO: 3377081 - protein, 19 aa, Plasmodium falciparum
FYHILKFIIFKVNNFSISD

SEQ ID NO: 3377082 - protein, 18 aa, Plasmodium falciparum
FYIYGINVKALYKWKTYN

SEQ ID NO: 3377083 - protein, 26 aa, Plasmodium falciparum
FYKKCFKIKCLYNYYYILKDDINVEI

SEQ ID NO: 3377084 - protein, 21 aa, Plasmodium falciparum
FYKKKLEHIQVWKTKLEIMKK

SEQ ID NO: 3377085 - protein, 17 aa, Plasmodium falciparum
FYNYFPFNYYYYNMNNL

SEQ ID NO: 3377086 - protein, 17 aa, Plasmodium falciparum
FYYIPSFYNRYDYNTNY

SEQ ID NO: 3377087 - protein, 30 aa, Plasmodium falciparum
GANLFLYGIPLKWTELNLIQLVNKYGHVVG

SEQ ID NO: 3377088 - protein, 20 aa, Plasmodium falciparum
GCAPIAHILWSYVMNYYNED

SEQ ID NO: 3377089 - protein, 32 aa, Plasmodium falciparum
GCEEAKRLAIEWKKARIRGEVWDRFINKKKKN

SEQ ID NO: 3377090 - protein, 17 aa, Plasmodium falciparum
GCIYLLFLLYFSQHVEE

SEQ ID NO: 3377091 - protein, 29 aa, Plasmodium falciparum
GCTNTSCFFHKYRITGCNEKKCINANNNY

SEQ ID NO: 3377092 - protein, 17 aa, Plasmodium falciparum
GDINICLGNNVKGEDHT

SEQ ID NO: 3377093 - protein, 17 aa, Plasmodium falciparum
GDLIPIRYAYAGNIVAL

SEQ ID NO: 3377094 - protein, 20 aa, Plasmodium falciparum
GDLRKAFYLAYEEDYVEYIL

SEQ ID NO: 3377095 - protein, 27 aa, Plasmodium falciparum
GEEFKLLRYYLIYDHLKYIVIRLRHIH

SEQ ID NO: 3377096 - protein, 18 aa, Plasmodium falciparum
GEFFFPFQKRHSTLHSRS

SEQ ID NO: 3377097 - protein, 23 aa, Plasmodium falciparum
GEIKCKGCNNVGFVEKIDEDDPL

SEQ ID NO: 3377098 - protein, 18 aa, Plasmodium falciparum
GELELRAPPDFFKTKLCK

SEQ ID NO: 3377099 - protein, 21 aa, Plasmodium falciparum
GELFLNIYLCERVATQKIVPL

SEQ ID NO: 3377100 - protein, 20 aa, Plasmodium falciparum
GELYCIIKWEFFEEKNPYNE

SEQ ID NO: 3377101 - protein, 18 aa, Plasmodium falciparum
GEYFYKRISTCLIKSSLV

SEQ ID NO: 3377102 - protein, 18 aa, Plasmodium falciparum
GFMGLPILCKYLDFRDTH

SEQ ID NO: 3377103 - protein, 19 aa, Plasmodium falciparum
GFTSIWFPLIYLKPVEEEN

SEQ ID NO: 3377104 - protein, 20 aa, Plasmodium falciparum
GFYKSKFWAIKVRLSKVKGQ

SEQ ID NO: 3377105 - protein, 18 aa, Plasmodium falciparum
GGNFKSAKFLKWIDDDNM

SEQ ID NO: 3377106 - protein, 19 aa, Plasmodium falciparum
GHRMILWKNYIVMFGGFFD

SEQ ID NO: 3377107 - protein, 25 aa, Plasmodium falciparum
GIDISLKMCRQLAEVINFLHTPIKN

SEQ ID NO: 3377108 - protein, 17 aa, Plasmodium falciparum
GIILKCFLKINIHDIEI

SEQ ID NO: 3377109 - protein, 18 aa, Plasmodium falciparum
GIISIPIVFVCIKQLLEK

SEQ ID NO: 3377110 - protein, 18 aa, Plasmodium falciparum
GIIYKLRFNEHIGGDMFK

SEQ ID NO: 3377111 - protein, 23 aa, Plasmodium falciparum
GIPRYRILFDIGLGFAKKHDQSI

SEQ ID NO: 3377112 - protein, 21 aa, Plasmodium falciparum
GKCDNCVYCLNLIKKKNGIKT

SEQ ID NO: 3377113 - protein, 19 aa, Plasmodium falciparum
GKCGNCWVFASSVVIAAYR

SEQ ID NO: 3377114 - protein, 17 aa, Plasmodium falciparum
GKIKAIEFFNDRLKTID

SEQ ID NO: 3377115 - protein, 19 aa, Plasmodium falciparum
GKIQLEFELKCCKEKLNEE

SEQ ID NO: 3377116 - protein, 19 aa, Plasmodium falciparum
GKIVFCFSELIHIYGPKIF

SEQ ID NO: 3377117 - protein, 17 aa, Plasmodium falciparum
GKKNCLLSNIFISHDEN

SEQ ID NO: 3377118 - protein, 19 aa, Plasmodium falciparum
GKKYIVCYNYLGKIQVKVF

SEQ ID NO: 3377119 - protein, 17 aa, Plasmodium falciparum
GKLRELILRKNLTNEDK

SEQ ID NO: 3377120 - protein, 20 aa, Plasmodium falciparum
GKLWVELHGNIIIRNHNNGD

SEQ ID NO: 3377121 - protein, 22 aa, Plasmodium falciparum
GKPECFRLFLSDEFKDSYCTES

SEQ ID NO: 3377122 - protein, 19 aa, Plasmodium falciparum
GKQFFNFNNLYFLPNALNT

SEQ ID NO: 3377123 - protein, 20 aa, Plasmodium falciparum
GKQKCKGECDCFQTRIEKKK

SEQ ID NO: 3377124 - protein, 32 aa, Plasmodium falciparum
GKTVNIFYRWSRGPPRTVCFFHPQKIACLQCT

SEQ ID NO: 3377125 - protein, 18 aa, Plasmodium falciparum
GLFYYYWLCYSMEEQKKC

SEQ ID NO: 3377126 - protein, 20 aa, Plasmodium falciparum
GLHEICIRDAYSLINDKDIL

SEQ ID NO: 3377127 - protein, 18 aa, Plasmodium falciparum
GLYFFNKRVQIFSLLDFL

SEQ ID NO: 3377128 - protein, 20 aa, Plasmodium falciparum
GMKMRLCLSRILFSNNDIIL

SEQ ID NO: 3377129 - protein, 18 aa, Plasmodium falciparum
GNCGLCWIFASKLHFETI

SEQ ID NO: 3377130 - protein, 24 aa, Plasmodium falciparum
GNDEDTMKKFSVDTSENEDDKEDD

SEQ ID NO: 3377131 - protein, 21 aa, Plasmodium falciparum
GNFPFELCTVLARRFADIGDI

SEQ ID NO: 3377132 - protein, 21 aa, Plasmodium falciparum
GNGRTGLVFKAIIKKEENKKV

SEQ ID NO: 3377133 - protein, 17 aa, Plasmodium falciparum
GNIPMGSVDKVIKHDRM

SEQ ID NO: 3377134 - protein, 17 aa, Plasmodium falciparum
GNLISICIFERNIKLLK

SEQ ID NO: 3377135 - protein, 25 aa, Plasmodium falciparum
GPINELLALCWIKQILLGLLYMKNL

SEQ ID NO: 3377136 - protein, 19 aa, Plasmodium falciparum
GPNGTHICMVFEFMGPNLL

SEQ ID NO: 3377137 - protein, 21 aa, Plasmodium falciparum
GQLMKCPSCSKYINSDELIVN

SEQ ID NO: 3377138 - protein, 18 aa, Plasmodium falciparum
GRFVYRFFVIVGENENYI

SEQ ID NO: 3377139 - protein, 19 aa, Plasmodium falciparum
GRNFLLKLFFFLGRYFNSK

SEQ ID NO: 3377140 - protein, 21 aa, Plasmodium falciparum
GSEQYNIWFGKYVTDRYDKSV

SEQ ID NO: 3377141 - protein, 22 aa, Plasmodium falciparum
GSFGVVYKGWYKGMHVAVKVPV

SEQ ID NO: 3377142 - protein, 25 aa, Plasmodium falciparum
GSKCDSETLLPIANISRIMKRILPG

SEQ ID NO: 3377143 - protein, 22 aa, Plasmodium falciparum
GSKEIIELITFLRFLLNVDDNI

SEQ ID NO: 3377144 - protein, 26 aa, Plasmodium falciparum
GSLCFLCSFPPIGVCTDVLLDWNNSY

SEQ ID NO: 3377145 - protein, 21 aa, Plasmodium falciparum
GSSLKKGISVSVRGRTMNLGM

SEQ ID NO: 3377146 - protein, 18 aa, Plasmodium falciparum
GSWLAYWSIGKNFQMRRF

SEQ ID NO: 3377147 - protein, 18 aa, Plasmodium falciparum
GTFRKGGLTWAIYYNNNN

SEQ ID NO: 3377148 - protein, 23 aa, Plasmodium falciparum
GTKKNCLRYDRFHIYDDKIKNID

SEQ ID NO: 3377149 - protein, 17 aa, Plasmodium falciparum
GVKWRWNMDKAEIIVEE

SEQ ID NO: 3377150 - protein, 24 aa, Plasmodium falciparum
GVLKICCGFSFSCILLKNKKCFLI

SEQ ID NO: 3377151 - protein, 17 aa, Plasmodium falciparum
GVLPLRLIDKLLFIYNY

SEQ ID NO: 3377152 - protein, 17 aa, Plasmodium falciparum
GVNIPWLYIGTLFSTFC

SEQ ID NO: 3377153 - protein, 19 aa, Plasmodium falciparum
GVNLFKAESSATCGGLDSL

SEQ ID NO: 3377154 - protein, 17 aa, Plasmodium falciparum
GVVPPPIRKWEESNLSN

SEQ ID NO: 3377155 - protein, 23 aa, Plasmodium falciparum
GYDNKYYCCLLVLREFFSMTEGP

SEQ ID NO: 3377156 - protein, 28 aa, Plasmodium falciparum
GYPGVSWNKRMCAWLAFFYDGASRRSRT

SEQ ID NO: 3377157 - protein, 18 aa, Plasmodium falciparum
GYYCYPIDALFVFISIIY

SEQ ID NO: 3377158 - protein, 17 aa, Plasmodium falciparum
HAILKAKFDNLNVENKN

SEQ ID NO: 3377159 - protein, 20 aa, Plasmodium falciparum
HAQIPVWIRLEYNCIHNPKD

SEQ ID NO: 3377160 - protein, 25 aa, Plasmodium falciparum
HCATCPTSFCYNCFPPDYVRYYVGE

SEQ ID NO: 3377161 - protein, 22 aa, Plasmodium falciparum
HCCAETYCKACLYKYNKKKMKD

SEQ ID NO: 3377162 - protein, 24 aa, Plasmodium falciparum
HCYFYNCIYCNFDFQKCLDMIKKN

SEQ ID NO: 3377163 - protein, 18 aa, Plasmodium falciparum
HDHWYWNFVFDFTQLGLQ

SEQ ID NO: 3377164 - protein, 17 aa, Plasmodium falciparum
HDKCIRMFYALQYAGFI

SEQ ID NO: 3377165 - protein, 18 aa, Plasmodium falciparum
HDLRKCLLVKGWSTDSWS

SEQ ID NO: 3377166 - protein, 17 aa, Plasmodium falciparum
HEIKRKLIKLINTNFYI

SEQ ID NO: 3377167 - protein, 23 aa, Plasmodium falciparum
HEKEFLKEFQLFMPDVNIMADKN

SEQ ID NO: 3377168 - protein, 22 aa, Plasmodium falciparum
HEMEARLLLIVCNKMNQPFDVK

SEQ ID NO: 3377169 - protein, 17 aa, Plasmodium falciparum
HFGEVIMSSGLVMNEDV

SEQ ID NO: 3377170 - protein, 18 aa, Plasmodium falciparum
HFLGFRFIEIPCVKTKNE

SEQ ID NO: 3377171 - protein, 18 aa, Plasmodium falciparum
HGFDFSVNFNNFFDNQLY

SEQ ID NO: 3377172 - protein, 17 aa, Plasmodium falciparum
HGKYIYKKCKSILEGNW

SEQ ID NO: 3377173 - protein, 21 aa, Plasmodium falciparum
HIEVLNLLFLMNGDNQIKKDK

SEQ ID NO: 3377174 - protein, 21 aa, Plasmodium falciparum
HIFCRECIEKVLLKFDYCPLC

SEQ ID NO: 3377175 - protein, 20 aa, Plasmodium falciparum
HIIYLCLYNGLLLEENQKII

SEQ ID NO: 3377176 - protein, 23 aa, Plasmodium falciparum
HILCYSFYINIEFFLPSAQLIIP

SEQ ID NO: 3377177 - protein, 22 aa, Plasmodium falciparum
HIPLFLRYFIQTHVSSTKARTN

SEQ ID NO: 3377178 - protein, 17 aa, Plasmodium falciparum
HIYKHGIIKVFNFDFAN

SEQ ID NO: 3377179 - protein, 17 aa, Plasmodium falciparum
HKESFNFTGINNDGINI

SEQ ID NO: 3377180 - protein, 18 aa, Plasmodium falciparum
HKTKIIIYLRFVKNKYQN

SEQ ID NO: 3377181 - protein, 21 aa, Plasmodium falciparum
HKVKNCVWNDAYKLAKEFDKL

SEQ ID NO: 3377182 - protein, 19 aa, Plasmodium falciparum
HKYIKACIGVKISANNLEE

SEQ ID NO: 3377183 - protein, 20 aa, Plasmodium falciparum
HLEMLLKIFGTIEKIYMDDN

SEQ ID NO: 3377184 - protein, 18 aa, Plasmodium falciparum
HLMCLRKWINGRLNLNDQ

SEQ ID NO: 3377185 - protein, 17 aa, Plasmodium falciparum
HLNLKFIILKNIEKDDN

SEQ ID NO: 3377186 - protein, 20 aa, Plasmodium falciparum
HLSRRPKLISVFKKKINSIT

SEQ ID NO: 3377187 - protein, 21 aa, Plasmodium falciparum
HMEHCYICSYPIQNNEQKFIL

SEQ ID NO: 3377188 - protein, 27 aa, Plasmodium falciparum
HMRKRKRKILRNRTCIIHQILNRNKEN

SEQ ID NO: 3377189 - protein, 18 aa, Plasmodium falciparum
HNIPHIWINYSYPSKKKL

SEQ ID NO: 3377190 - protein, 19 aa, Plasmodium falciparum
HNKKFPALFLYYTKDVKTK

SEQ ID NO: 3377191 - protein, 21 aa, Plasmodium falciparum
HPEYLPRIPGVRFNPKKQQWL

SEQ ID NO: 3377192 - protein, 19 aa, Plasmodium falciparum
HPGARACHLSFFYKDKLFI

SEQ ID NO: 3377193 - protein, 18 aa, Plasmodium falciparum
HPSYHFNKDFSLLNNVTL

SEQ ID NO: 3377194 - protein, 34 aa, Plasmodium falciparum
HRGNDCPMKCRFCLKYHMGISIMDCLKKARIQTE

SEQ ID NO: 3377195 - protein, 22 aa, Plasmodium falciparum
HSFCWKCLATAIQKYSIDNCPS

SEQ ID NO: 3377196 - protein, 17 aa, Plasmodium falciparum
HSNRLRESIKFEDKKKN

SEQ ID NO: 3377197 - protein, 19 aa, Plasmodium falciparum
HSRLFKSLHEWETNKYIFL

SEQ ID NO: 3377198 - protein, 18 aa, Plasmodium falciparum
HSSFSCIAYWKSKRLSDS

SEQ ID NO: 3377199 - protein, 18 aa, Plasmodium falciparum
HSYEFYKNKILKIYDNGV

SEQ ID NO: 3377200 - protein, 21 aa, Plasmodium falciparum
HTKIKEFFILFNMNNQKDVQN

SEQ ID NO: 3377201 - protein, 25 aa, Plasmodium falciparum
HTKKKKSSWLKFGRGDKNDKKSKNE

SEQ ID NO: 3377202 - protein, 25 aa, Plasmodium falciparum
HTKKKKSSWLKFGRGNKNDKKNKKE

SEQ ID NO: 3377203 - protein, 19 aa, Plasmodium falciparum
HVKKSVLPTDAYRKQQKKK

SEQ ID NO: 3377204 - protein, 18 aa, Plasmodium falciparum
HVVGLRIPYISKENDKKQ

SEQ ID NO: 3377205 - protein, 24 aa, Plasmodium falciparum
HYDNFKSSYILTFINRKQKKQRKI

SEQ ID NO: 3377206 - protein, 19 aa, Plasmodium falciparum
HYRFWSSSLLWVFDGGLSD

SEQ ID NO: 3377207 - protein, 19 aa, Plasmodium falciparum
IAALRDIRNLFPLNHNPFY

SEQ ID NO: 3377208 - protein, 22 aa, Plasmodium falciparum
IADCYCNLGLLYRLTGNVVESL

SEQ ID NO: 3377209 - protein, 21 aa, Plasmodium falciparum
IAFKIFTMFYKVCYGKKKHTY

SEQ ID NO: 3377210 - protein, 20 aa, Plasmodium falciparum
IAININNMWFLKIKNNSDFN

SEQ ID NO: 3377211 - protein, 22 aa, Plasmodium falciparum
IAKIVFENCNMCNINVDFVQDD

SEQ ID NO: 3377212 - protein, 17 aa, Plasmodium falciparum
IAKKICDHYNLIMCSIN

SEQ ID NO: 3377213 - protein, 19 aa, Plasmodium falciparum
IATELPLKMLIVGGIDKVY

SEQ ID NO: 3377214 - protein, 17 aa, Plasmodium falciparum
IAVKCLHIYKGFPLIKV

SEQ ID NO: 3377215 - protein, 21 aa, Plasmodium falciparum
ICGPYICCIFILSKKENVNIE

SEQ ID NO: 3377216 - protein, 17 aa, Plasmodium falciparum
ICGYKFNIFYTNLINKN

SEQ ID NO: 3377217 - protein, 17 aa, Plasmodium falciparum
ICHIPICNLCISSHVHT

SEQ ID NO: 3377218 - protein, 25 aa, Plasmodium falciparum
ICISCFKCYFPFEFVNKCVICNSFD

SEQ ID NO: 3377219 - protein, 26 aa, Plasmodium falciparum
ICIYCFKYAKCVKSLQAHMICKSHTK

SEQ ID NO: 3377220 - protein, 18 aa, Plasmodium falciparum
ICKCNACGNIGELNNSHK

SEQ ID NO: 3377221 - protein, 18 aa, Plasmodium falciparum
ICKHKLRVLNKYKKDNVQ

SEQ ID NO: 3377222 - protein, 17 aa, Plasmodium falciparum
ICLFSATICKFLNVILN

SEQ ID NO: 3377223 - protein, 19 aa, Plasmodium falciparum
ICMVFEFMGPNLLSLIKHY

SEQ ID NO: 3377224 - protein, 23 aa, Plasmodium falciparum
ICNFSIFELCRFINIIINNNIKH

SEQ ID NO: 3377225 - protein, 20 aa, Plasmodium falciparum
ICNKKVHISYAFKKDSKGER

SEQ ID NO: 3377226 - protein, 24 aa, Plasmodium falciparum
ICSYCRIKHGVVITCSNTDCDVSF

SEQ ID NO: 3377227 - protein, 17 aa, Plasmodium falciparum
IDCNTCWYKYIIYKKNN

SEQ ID NO: 3377228 - protein, 17 aa, Plasmodium falciparum
IDFCILCGCDYCDTIKG

SEQ ID NO: 3377229 - protein, 20 aa, Plasmodium falciparum
IDFPEFLTLMARKLKDTDTE

SEQ ID NO: 3377230 - protein, 17 aa, Plasmodium falciparum
IDIKVCTLINCPTHNPQ

SEQ ID NO: 3377231 - protein, 17 aa, Plasmodium falciparum
IDLLEIYLGHNWGEDGD

SEQ ID NO: 3377232 - protein, 24 aa, Plasmodium falciparum
IDLLPTPLLFYLYDNFKILQTLIC

SEQ ID NO: 3377233 - protein, 19 aa, Plasmodium falciparum
IDSKIWICDRGSKNIEKAE

SEQ ID NO: 3377234 - protein, 17 aa, Plasmodium falciparum
IDVELDCPPPLIVPYPA

SEQ ID NO: 3377235 - protein, 19 aa, Plasmodium falciparum
IEAFLQLIYSTGFFIDKIE

SEQ ID NO: 3377236 - protein, 26 aa, Plasmodium falciparum
IECFLFKIKYYFYKSVLFLYQEGIKS

SEQ ID NO: 3377237 - protein, 19 aa, Plasmodium falciparum
IEELCCMKKSIDMLHVRSR

SEQ ID NO: 3377238 - protein, 24 aa, Plasmodium falciparum
IEKFCLGRRKIELFGTNRNIRNGW

SEQ ID NO: 3377239 - protein, 23 aa, Plasmodium falciparum
IEKLKEQDKIFGINKNEEKQENK

SEQ ID NO: 3377240 - protein, 19 aa, Plasmodium falciparum
IEPKFILPNCVGQIRKKNI

SEQ ID NO: 3377241 - protein, 25 aa, Plasmodium falciparum
IEQKKKLKGLVVMPHEMYNLYKGKG

SEQ ID NO: 3377242 - protein, 17 aa, Plasmodium falciparum
IERAVPRSSAAEFKKMK

SEQ ID NO: 3377243 - protein, 21 aa, Plasmodium falciparum
IETEFPCWTPWEIFCKTKYDE

SEQ ID NO: 3377244 - protein, 17 aa, Plasmodium falciparum
IETFKAWVRKPAHLSSL

SEQ ID NO: 3377245 - protein, 18 aa, Plasmodium falciparum
IEYLKFLLENTVIKSNEM

SEQ ID NO: 3377246 - protein, 17 aa, Plasmodium falciparum
IEYPSFCKYDYNSTSNQ

SEQ ID NO: 3377247 - protein, 18 aa, Plasmodium falciparum
IFDGFKIIPSKNLSALFS

SEQ ID NO: 3377248 - protein, 17 aa, Plasmodium falciparum
IFEKIGILKRKFTSGNI

SEQ ID NO: 3377249 - protein, 18 aa, Plasmodium falciparum
IFFYLHWDISKNVLYRIS

SEQ ID NO: 3377250 - protein, 19 aa, Plasmodium falciparum
IFHYVNGFKLYGWLNYKWT

SEQ ID NO: 3377251 - protein, 17 aa, Plasmodium falciparum
IFIEQALDDFIIKTERE

SEQ ID NO: 3377252 - protein, 24 aa, Plasmodium falciparum
IFIYSLKCSLLIINLLAKLGGTTY

SEQ ID NO: 3377253 - protein, 19 aa, Plasmodium falciparum
IFKELRFILNFMVDTNSII

SEQ ID NO: 3377254 - protein, 17 aa, Plasmodium falciparum
IFVLFSRYVHNIKQQKK

SEQ ID NO: 3377255 - protein, 18 aa, Plasmodium falciparum
IFYLRFSKCISKNNNYGY

SEQ ID NO: 3377256 - protein, 24 aa, Plasmodium falciparum
IFYSPRIWFIFKMYGFKNVQILNG

SEQ ID NO: 3377257 - protein, 17 aa, Plasmodium falciparum
IGCVIYLNEEPEWFQGF

SEQ ID NO: 3377258 - protein, 20 aa, Plasmodium falciparum
IGKMRVCYRLSINKDYVNNE

SEQ ID NO: 3377259 - protein, 20 aa, Plasmodium falciparum
IGKPCLMCLVDLPGYGYAEC

SEQ ID NO: 3377260 - protein, 24 aa, Plasmodium falciparum
IGKRAEYLWNLALSAVYINVKLSM

SEQ ID NO: 3377261 - protein, 17 aa, Plasmodium falciparum
IGRLLLLSFDNLCTLLV

SEQ ID NO: 3377262 - protein, 21 aa, Plasmodium falciparum
IGVEWKLQLEIIKYKMIEIIN

SEQ ID NO: 3377263 - protein, 25 aa, Plasmodium falciparum
IHAPACWKGEKFNGTPFIFVYDKSI

SEQ ID NO: 3377264 - protein, 19 aa, Plasmodium falciparum
IHERKCSKLGFIEKCTKIF

SEQ ID NO: 3377265 - protein, 22 aa, Plasmodium falciparum
IHIKEFIQTFCFAKNVEIIMDE

SEQ ID NO: 3377266 - protein, 21 aa, Plasmodium falciparum
IICKTCYKLSLQDQKCLMCNN

SEQ ID NO: 3377267 - protein, 31 aa, Plasmodium falciparum
IIIIKFNILKLFKLGSCYLYIINRNLKEIQM

SEQ ID NO: 3377268 - protein, 18 aa, Plasmodium falciparum
IIIYKRMYQSFILLKKEY

SEQ ID NO: 3377269 - protein, 20 aa, Plasmodium falciparum
IIKDINIFVTINFRNLIIDT

SEQ ID NO: 3377270 - protein, 17 aa, Plasmodium falciparum
IIKFISVLCEIKKPFIK

SEQ ID NO: 3377271 - protein, 18 aa, Plasmodium falciparum
IIKHKFIHDVSCGENHIA

SEQ ID NO: 3377272 - protein, 23 aa, Plasmodium falciparum
IIKNKYCCFATFISRNKYIFVEK

SEQ ID NO: 3377273 - protein, 18 aa, Plasmodium falciparum
IIRIKIQHMLQRTKMENM

SEQ ID NO: 3377274 - protein, 23 aa, Plasmodium falciparum
IITNRIDGFWVYKVSPLLKVKGI

SEQ ID NO: 3377275 - protein, 17 aa, Plasmodium falciparum
IKAIEFFNDRLKTIDMN

SEQ ID NO: 3377276 - protein, 17 aa, Plasmodium falciparum
IKALWNIRKIKIVKSYD

SEQ ID NO: 3377277 - protein, 19 aa, Plasmodium falciparum
IKANFFGKAVDKWFDFIEV

SEQ ID NO: 3377278 - protein, 18 aa, Plasmodium falciparum
IKCSLRYAIQLLTPAKIL

SEQ ID NO: 3377279 - protein, 21 aa, Plasmodium falciparum
IKDGYFLYCIDAYLPLFNSFK

SEQ ID NO: 3377280 - protein, 17 aa, Plasmodium falciparum
IKDLCIFNFILTNNNFK

SEQ ID NO: 3377281 - protein, 19 aa, Plasmodium falciparum
IKDLIVMKSFWRKGQAWVV

SEQ ID NO: 3377282 - protein, 22 aa, Plasmodium falciparum
IKEITLKIIRRCRIYSLKQLHT

SEQ ID NO: 3377283 - protein, 21 aa, Plasmodium falciparum
IKEKHFLKYLYLCTLKKKIQA

SEQ ID NO: 3377284 - protein, 18 aa, Plasmodium falciparum
IKEKLFGKIIFKEYLVIS

SEQ ID NO: 3377285 - protein, 17 aa, Plasmodium falciparum
IKFSQTCLSCFSTFIGC

SEQ ID NO: 3377286 - protein, 18 aa, Plasmodium falciparum
IKGDCIFHGYFVHKDITD

SEQ ID NO: 3377287 - protein, 20 aa, Plasmodium falciparum
IKGKGPLCINFNDFIDEKKK

SEQ ID NO: 3377288 - protein, 17 aa, Plasmodium falciparum
IKGLRAFENLRVLNISH

SEQ ID NO: 3377289 - protein, 19 aa, Plasmodium falciparum
IKGVRFDKSGRRWVASWSQ

SEQ ID NO: 3377290 - protein, 18 aa, Plasmodium falciparum
IKHSLGYDNTCYDNNKDD

SEQ ID NO: 3377291 - protein, 20 aa, Plasmodium falciparum
IKIIDYWGGDIIKFSGDAVL

SEQ ID NO: 3377292 - protein, 17 aa, Plasmodium falciparum
IKIIFIFDGITPKGHKL

SEQ ID NO: 3377293 - protein, 23 aa, Plasmodium falciparum
IKINGYRKAYSVIRRGVKEAYKL

SEQ ID NO: 3377294 - protein, 17 aa, Plasmodium falciparum
IKIVPIIKCSNYKIKNN

SEQ ID NO: 3377295 - protein, 20 aa, Plasmodium falciparum
IKKEHSNECFTHNDNEVYNT

SEQ ID NO: 3377296 - protein, 23 aa, Plasmodium falciparum
IKKEIKLLECFNINHLLDTPFMK

SEQ ID NO: 3377297 - protein, 17 aa, Plasmodium falciparum
IKKGCILQNIKMKEGII

SEQ ID NO: 3377298 - protein, 17 aa, Plasmodium falciparum
IKKIVSYIRIKHVKNHN

SEQ ID NO: 3377299 - protein, 21 aa, Plasmodium falciparum
IKKKIKLILLFSSNNIDNNVH

SEQ ID NO: 3377300 - protein, 18 aa, Plasmodium falciparum
IKKLVKKCIKKYKKLLKL

SEQ ID NO: 3377301 - protein, 20 aa, Plasmodium falciparum
IKKTRADKIFAFDTSGENNN

SEQ ID NO: 3377302 - protein, 23 aa, Plasmodium falciparum
IKLFFKPHMEQFYNFSLLCKIDS

SEQ ID NO: 3377303 - protein, 20 aa, Plasmodium falciparum
IKLIYYFMENFIFKKKKENR

SEQ ID NO: 3377304 - protein, 17 aa, Plasmodium falciparum
IKLTLKFCKMIERRMWS

SEQ ID NO: 3377305 - protein, 23 aa, Plasmodium falciparum
IKLYLCDHLRTCAKHVFNRPSIY

SEQ ID NO: 3377306 - protein, 21 aa, Plasmodium falciparum
IKLYYLFKLYHYFKKKEKFKE

SEQ ID NO: 3377307 - protein, 17 aa, Plasmodium falciparum
IKNESEFEYLLELSDKE

SEQ ID NO: 3377308 - protein, 24 aa, Plasmodium falciparum
IKNFCWFCSLHILDEILEKQIYKE

SEQ ID NO: 3377309 - protein, 20 aa, Plasmodium falciparum
IKNIWTFFNFKIFNNKLPSF

SEQ ID NO: 3377310 - protein, 18 aa, Plasmodium falciparum
IKNKGCVCIYSFYKNNLI

SEQ ID NO: 3377311 - protein, 22 aa, Plasmodium falciparum
IKNLKCQICQQIFDSRNKLFQH

SEQ ID NO: 3377312 - protein, 17 aa, Plasmodium falciparum
IKNRRMQVIYGNYKKNS

SEQ ID NO: 3377313 - protein, 25 aa, Plasmodium falciparum
IKQCYRCCCFFNTKCCHCIECKEKY

SEQ ID NO: 3377314 - protein, 17 aa, Plasmodium falciparum
IKQKFRLLYSFGPQIRY

SEQ ID NO: 3377315 - protein, 23 aa, Plasmodium falciparum
IKRFLPRSCQILLFSATYNDSVR

SEQ ID NO: 3377316 - protein, 28 aa, Plasmodium falciparum
IKRISYGVVDKCIWCSVCYNSSNYPNVL

SEQ ID NO: 3377317 - protein, 21 aa, Plasmodium falciparum
IKRIYYFKLWNAMVEHNFTLF

SEQ ID NO: 3377318 - protein, 23 aa, Plasmodium falciparum
IKRKRLKLLKVRRPAYLQQKKIK

SEQ ID NO: 3377319 - protein, 26 aa, Plasmodium falciparum
IKRKYKKFRFCINKVFKKKSINDIIA

SEQ ID NO: 3377320 - protein, 17 aa, Plasmodium falciparum
IKTAILKTIIAFVSNAY

SEQ ID NO: 3377321 - protein, 20 aa, Plasmodium falciparum
IKTFIKRDINLYSKMEETKN

SEQ ID NO: 3377322 - protein, 24 aa, Plasmodium falciparum
IKTFPQRIKAVFLHHVKGKDDNTL

SEQ ID NO: 3377323 - protein, 17 aa, Plasmodium falciparum
IKVCTLINCPTHNPQNY

SEQ ID NO: 3377324 - protein, 21 aa, Plasmodium falciparum
IKVLRKHLNNVLALKLLTLSS

SEQ ID NO: 3377325 - protein, 17 aa, Plasmodium falciparum
IKYFSHIYICWNSVIFP

SEQ ID NO: 3377326 - protein, 17 aa, Plasmodium falciparum
IKYPSGLPPYLPDDCSV

SEQ ID NO: 3377327 - protein, 18 aa, Plasmodium falciparum
ILASKACRNAIMVGKALN

SEQ ID NO: 3377328 - protein, 17 aa, Plasmodium falciparum
ILCAIAYMHSNNIAHKD

SEQ ID NO: 3377329 - protein, 18 aa, Plasmodium falciparum
ILCGCDYCDTIKGIGSKT

SEQ ID NO: 3377330 - protein, 19 aa, Plasmodium falciparum
ILCKLRIAEELSRNTNHSS

SEQ ID NO: 3377331 - protein, 18 aa, Plasmodium falciparum
ILCTINLFGRLKKHLLPV

SEQ ID NO: 3377332 - protein, 17 aa, Plasmodium falciparum
ILFKEHWALEENKNVQS

SEQ ID NO: 3377333 - protein, 21 aa, Plasmodium falciparum
ILIKIFLRRASSFLCLQEFNK

SEQ ID NO: 3377334 - protein, 18 aa, Plasmodium falciparum
ILKCGGIIANINGINRII

SEQ ID NO: 3377335 - protein, 18 aa, Plasmodium falciparum
ILKEFKKYMNLIIQDGYT

SEQ ID NO: 3377336 - protein, 17 aa, Plasmodium falciparum
ILKIWSFFNNFKDDIFH

SEQ ID NO: 3377337 - protein, 19 aa, Plasmodium falciparum
ILLFPLCFYDFDSRWYRCI

SEQ ID NO: 3377338 - protein, 18 aa, Plasmodium falciparum
ILLYSLKTAYGFLHIKVK

SEQ ID NO: 3377339 - protein, 22 aa, Plasmodium falciparum
ILNEIIKFLFLNDEYVLLFEKI

SEQ ID NO: 3377340 - protein, 23 aa, Plasmodium falciparum
ILNIMKWKSLFFTFSNITIYKNE

SEQ ID NO: 3377341 - protein, 20 aa, Plasmodium falciparum
ILPFSFPGLLYLYNNKLLKA

SEQ ID NO: 3377342 - protein, 22 aa, Plasmodium falciparum
ILQKLHDGIYCLKDNNKKKNND

SEQ ID NO: 3377343 - protein, 17 aa, Plasmodium falciparum
ILQTFIFDLCIFFKQDN

SEQ ID NO: 3377344 - protein, 19 aa, Plasmodium falciparum
ILREWKPNIIKEEKKSQKY

SEQ ID NO: 3377345 - protein, 17 aa, Plasmodium falciparum
ILRGFKHGFDFSVNFNN

SEQ ID NO: 3377346 - protein, 17 aa, Plasmodium falciparum
ILSWGIRESREISLQKG

SEQ ID NO: 3377347 - protein, 17 aa, Plasmodium falciparum
ILTCSALPHNEAAFFEL

SEQ ID NO: 3377348 - protein, 21 aa, Plasmodium falciparum
ILWLRYEYDQDAALFMNTYKV

SEQ ID NO: 3377349 - protein, 17 aa, Plasmodium falciparum
IMFQILCAIAYMHSNNI

SEQ ID NO: 3377350 - protein, 21 aa, Plasmodium falciparum
IMGEWFLCFLCFKNNKDQEEI

SEQ ID NO: 3377351 - protein, 17 aa, Plasmodium falciparum
IMKKKCDLFFKSNFNNI

SEQ ID NO: 3377352 - protein, 17 aa, Plasmodium falciparum
IMLSFFIFFKFKESFIR

SEQ ID NO: 3377353 - protein, 17 aa, Plasmodium falciparum
INCTVFAYGATGSGKTY

SEQ ID NO: 3377354 - protein, 18 aa, Plasmodium falciparum
INDCWIIANGYVYDVSTF

SEQ ID NO: 3377355 - protein, 22 aa, Plasmodium falciparum
INDLKIEFILTFEKFAIGNIKI

SEQ ID NO: 3377356 - protein, 21 aa, Plasmodium falciparum
INEIKCSYAFLKNKNNWIDQV

SEQ ID NO: 3377357 - protein, 22 aa, Plasmodium falciparum
INGECPLMICIRTRNENLALLI

SEQ ID NO: 3377358 - protein, 17 aa, Plasmodium falciparum
INGFPWLYSKDIKNAEE

SEQ ID NO: 3377359 - protein, 26 aa, Plasmodium falciparum
INGRCINRYFPVYKFGFEEARRLAIQ

SEQ ID NO: 3377360 - protein, 23 aa, Plasmodium falciparum
INHKEVRKGLTFEQMRRKSYEPI

SEQ ID NO: 3377361 - protein, 19 aa, Plasmodium falciparum
INKFFRCIGIWNDRNVYSK

SEQ ID NO: 3377362 - protein, 17 aa, Plasmodium falciparum
INLEEAFTFSSLLHGIV

SEQ ID NO: 3377363 - protein, 18 aa, Plasmodium falciparum
INLFKVCLYFHCIKKSLK

SEQ ID NO: 3377364 - protein, 19 aa, Plasmodium falciparum
INNMFKCGFYSFKGNRTYN

SEQ ID NO: 3377365 - protein, 17 aa, Plasmodium falciparum
INNRLFVGTKIDNNTLN

SEQ ID NO: 3377366 - protein, 24 aa, Plasmodium falciparum
INNTVPVVVNWVQCELCKKWRKLD

SEQ ID NO: 3377367 - protein, 19 aa, Plasmodium falciparum
INSEWQLVYLDGWPHIILT

SEQ ID NO: 3377368 - protein, 19 aa, Plasmodium falciparum
INSFKKWIYFGSINNKCYL

SEQ ID NO: 3377369 - protein, 18 aa, Plasmodium falciparum
INVNEIYESILLDQNDDN

SEQ ID NO: 3377370 - protein, 19 aa, Plasmodium falciparum
IPDELAYKYFCHVVNGLYY

SEQ ID NO: 3377371 - protein, 18 aa, Plasmodium falciparum
IPEEIKFFILKYITLLNN

SEQ ID NO: 3377372 - protein, 23 aa, Plasmodium falciparum
IPEPRYAHSLIFSFYGNAKLVFL

SEQ ID NO: 3377373 - protein, 17 aa, Plasmodium falciparum
IPFLLDYVDDSNKEDSE

SEQ ID NO: 3377374 - protein, 20 aa, Plasmodium falciparum
IPGFKKCLILSFVCPNCNFK

SEQ ID NO: 3377375 - protein, 19 aa, Plasmodium falciparum
IPGSLPWELSKNMFDEESR

SEQ ID NO: 3377376 - protein, 20 aa, Plasmodium falciparum
IPIIYDYHICYNKKENLSLK

SEQ ID NO: 3377377 - protein, 19 aa, Plasmodium falciparum
IPKKASWLPKSDKYFLTGH

SEQ ID NO: 3377378 - protein, 17 aa, Plasmodium falciparum
IPMGRFGMNLVWSDTNT

SEQ ID NO: 3377379 - protein, 17 aa, Plasmodium falciparum
IPNICNFLVYSGGGDGV

SEQ ID NO: 3377380 - protein, 17 aa, Plasmodium falciparum
IPNKRYIYLNGDDSNYK

SEQ ID NO: 3377381 - protein, 17 aa, Plasmodium falciparum
IPPPLKKMIPIDGVRNK

SEQ ID NO: 3377382 - protein, 18 aa, Plasmodium falciparum
IPQDGAICDLLWSDPAGP

SEQ ID NO: 3377383 - protein, 17 aa, Plasmodium falciparum
IPTLRFQYEINMKAYIN

SEQ ID NO: 3377384 - protein, 21 aa, Plasmodium falciparum
IQKDCFLFWLIMVKNKKEARN

SEQ ID NO: 3377385 - protein, 18 aa, Plasmodium falciparum
IQKLCLYASCNVVNDTHL

SEQ ID NO: 3377386 - protein, 24 aa, Plasmodium falciparum
IQNIFSAVCSIEFVPSEKRTTPYQ

SEQ ID NO: 3377387 - protein, 18 aa, Plasmodium falciparum
IQQFRLLKELVIKIINII

SEQ ID NO: 3377388 - protein, 17 aa, Plasmodium falciparum
IRCIQDFGSTCFFIDVI

SEQ ID NO: 3377389 - protein, 17 aa, Plasmodium falciparum
IREWRRWFNYLQVENLV

SEQ ID NO: 3377390 - protein, 17 aa, Plasmodium falciparum
IRFIIFSFFKFHDIYSV

SEQ ID NO: 3377391 - protein, 19 aa, Plasmodium falciparum
IRFYIEFIALSLLSPKFQY

SEQ ID NO: 3377392 - protein, 23 aa, Plasmodium falciparum
IRIHEGFDIFPMEGFKFRSIVID

SEQ ID NO: 3377393 - protein, 19 aa, Plasmodium falciparum
IRINPCYHIICKTCYKLSL

SEQ ID NO: 3377394 - protein, 20 aa, Plasmodium falciparum
IRISRGWKITNWYGNYQFRG

SEQ ID NO: 3377395 - protein, 18 aa, Plasmodium falciparum
IRKKRLYLSFPYHSHSEK

SEQ ID NO: 3377396 - protein, 19 aa, Plasmodium falciparum
IRLFSFQVIDILKKIFENN

SEQ ID NO: 3377397 - protein, 18 aa, Plasmodium falciparum
IRMNNCLHQNITKQEHIT

SEQ ID NO: 3377398 - protein, 19 aa, Plasmodium falciparum
IRNAVKLLKLWCINKKLLY

SEQ ID NO: 3377399 - protein, 24 aa, Plasmodium falciparum
IRNCYSRFGGGWVMSGSEDGNIYI

SEQ ID NO: 3377400 - protein, 20 aa, Plasmodium falciparum
IRNLFPLNHNPFYAAFGNTE

SEQ ID NO: 3377401 - protein, 18 aa, Plasmodium falciparum
IRQKRKFDSWKRLSELYE

SEQ ID NO: 3377402 - protein, 18 aa, Plasmodium falciparum
IRRLCCPRKKKDIDLLFK

SEQ ID NO: 3377403 - protein, 18 aa, Plasmodium falciparum
IRSLRIKLIYDESLKSSI

SEQ ID NO: 3377404 - protein, 18 aa, Plasmodium falciparum
IRTPCYMKLLVVKQGDPL

SEQ ID NO: 3377405 - protein, 18 aa, Plasmodium falciparum
ISCAWVFFERLVMKGYVH

SEQ ID NO: 3377406 - protein, 24 aa, Plasmodium falciparum
ISDIDIFCSFGFICCSSISTYVRP

SEQ ID NO: 3377407 - protein, 18 aa, Plasmodium falciparum
ISFAPNGFFCLILTSRTL

SEQ ID NO: 3377408 - protein, 17 aa, Plasmodium falciparum
ISFEFKRNLSIIEVKKY

SEQ ID NO: 3377409 - protein, 20 aa, Plasmodium falciparum
ISIMDCLKKARIQTEKNNSN

SEQ ID NO: 3377410 - protein, 17 aa, Plasmodium falciparum
ISLLPGIYMNGCVTFDE

SEQ ID NO: 3377411 - protein, 17 aa, Plasmodium falciparum
ISLLPKHIQKYFVSQIY

SEQ ID NO: 3377412 - protein, 22 aa, Plasmodium falciparum
ISMKLGKIFLCKSYLETFIYEK

SEQ ID NO: 3377413 - protein, 17 aa, Plasmodium falciparum
ISMKLGMKGCVEESNNI

SEQ ID NO: 3377414 - protein, 23 aa, Plasmodium falciparum
ISPKLYKGRICKVVLRDWPYSTQ

SEQ ID NO: 3377415 - protein, 18 aa, Plasmodium falciparum
ISPLCLILCPTRELVIQI

SEQ ID NO: 3377416 - protein, 17 aa, Plasmodium falciparum
ISQQCWRMCTPMSTKKA

SEQ ID NO: 3377417 - protein, 20 aa, Plasmodium falciparum
ISRLSTFICIGVDNAFFKNM

SEQ ID NO: 3377418 - protein, 22 aa, Plasmodium falciparum
ISRNIIYYRYFKNITYTNICKY

SEQ ID NO: 3377419 - protein, 20 aa, Plasmodium falciparum
ISTIPWFGYKNWGVLKNCMK

SEQ ID NO: 3377420 - protein, 28 aa, Plasmodium falciparum
ISTLFCKTCNIFLCAICNVKLHNNKSNH

SEQ ID NO: 3377421 - protein, 17 aa, Plasmodium falciparum
ISVCDYLKQQLNILRAA

SEQ ID NO: 3377422 - protein, 18 aa, Plasmodium falciparum
ITCAYWLSNSYIYACIDL

SEQ ID NO: 3377423 - protein, 25 aa, Plasmodium falciparum
ITLFPARTFPIQRFFFVNEYVELEI

SEQ ID NO: 3377424 - protein, 17 aa, Plasmodium falciparum
ITLRNSFFLSFAEYIYE

SEQ ID NO: 3377425 - protein, 19 aa, Plasmodium falciparum
ITYICKWLKYNISKLEPEK

SEQ ID NO: 3377426 - protein, 17 aa, Plasmodium falciparum
ITYTEFMAGCYRWKNIE

SEQ ID NO: 3377427 - protein, 17 aa, Plasmodium falciparum
IVCIPYGVLIFFSSYSS

SEQ ID NO: 3377428 - protein, 19 aa, Plasmodium falciparum
IVMKSFWRKGQAWVVYDDK

SEQ ID NO: 3377429 - protein, 17 aa, Plasmodium falciparum
IWEDKLKKWIVFFKDKN

SEQ ID NO: 3377430 - protein, 20 aa, Plasmodium falciparum
IWLEQQCSYSFCSTSLLIIY

SEQ ID NO: 3377431 - protein, 18 aa, Plasmodium falciparum
IYEEIGIDIFPYIDEQVY

SEQ ID NO: 3377432 - protein, 17 aa, Plasmodium falciparum
IYEKLSIEIKKLDEVKK

SEQ ID NO: 3377433 - protein, 20 aa, Plasmodium falciparum
IYFFPCIDIINFWYIIKRIN

SEQ ID NO: 3377434 - protein, 17 aa, Plasmodium falciparum
IYFKCLFSDLINDFEYI

SEQ ID NO: 3377435 - protein, 32 aa, Plasmodium falciparum
IYGEKNINTFLKWKRFRGMLKRYFFLLKNTNN

SEQ ID NO: 3377436 - protein, 20 aa, Plasmodium falciparum
IYKERLKRMLLYCSNVEEGR

SEQ ID NO: 3377437 - protein, 17 aa, Plasmodium falciparum
IYKPPVFISKYIKDMNE

SEQ ID NO: 3377438 - protein, 18 aa, Plasmodium falciparum
IYLLRLLPKFSLPLYDSG

SEQ ID NO: 3377439 - protein, 23 aa, Plasmodium falciparum
IYNCVTINWFLKWPLEALVNVST

SEQ ID NO: 3377440 - protein, 18 aa, Plasmodium falciparum
IYPVSSWQVFEPNLSSKT

SEQ ID NO: 3377441 - protein, 17 aa, Plasmodium falciparum
IYYCTLLGQAQTEEEKE

SEQ ID NO: 3377442 - protein, 19 aa, Plasmodium falciparum
IYYKLRPGVIEFLRTMSEK

SEQ ID NO: 3377443 - protein, 21 aa, Plasmodium falciparum
IYYLCFFNNFFSYRTLYEYKY

SEQ ID NO: 3377444 - protein, 18 aa, Plasmodium falciparum
IYYRSGDIFRCILEVRGP

SEQ ID NO: 3377445 - protein, 24 aa, Plasmodium falciparum
KAKIICYYAFIPLCNIKDQIINKK

SEQ ID NO: 3377446 - protein, 21 aa, Plasmodium falciparum
KAPQILCELCNSKMWVHTWLD

SEQ ID NO: 3377447 - protein, 23 aa, Plasmodium falciparum
KCEKWYHWICCKYSVDNPPDIEN

SEQ ID NO: 3377448 - protein, 23 aa, Plasmodium falciparum
KCFKYPKVCTDIKKFEWHVPDIK

SEQ ID NO: 3377449 - protein, 17 aa, Plasmodium falciparum
KCFSLFYALSYIEFDFI

SEQ ID NO: 3377450 - protein, 17 aa, Plasmodium falciparum
KCLNNFCFLCHKHISEN

SEQ ID NO: 3377451 - protein, 24 aa, Plasmodium falciparum
KCRHIFCFFCILKYFIDEEKKIWK

SEQ ID NO: 3377452 - protein, 23 aa, Plasmodium falciparum
KDDISIKCLGRFIGHSGEINCVR

SEQ ID NO: 3377453 - protein, 24 aa, Plasmodium falciparum
KDEKSLLCLLSIKSFFQCNPKIEI

SEQ ID NO: 3377454 - protein, 30 aa, Plasmodium falciparum
KDFKKYFPFKGNIIFRFKIALCDMINVINE

SEQ ID NO: 3377455 - protein, 27 aa, Plasmodium falciparum
KDFRSKWYIHFYKICLYNEKIYGGVTG

SEQ ID NO: 3377456 - protein, 18 aa, Plasmodium falciparum
KDINFEWWNSKKVSKISK

SEQ ID NO: 3377457 - protein, 19 aa, Plasmodium falciparum
KDKKWNIHLSKITLKFNNI

SEQ ID NO: 3377458 - protein, 24 aa, Plasmodium falciparum
KDKLYLLNILLKFYIQKIKNIMEQ

SEQ ID NO: 3377459 - protein, 24 aa, Plasmodium falciparum
KDKYKASQIFPLWDHPKDSIDYCL

SEQ ID NO: 3377460 - protein, 17 aa, Plasmodium falciparum
KDLSCKLSELYNNTTDL

SEQ ID NO: 3377461 - protein, 18 aa, Plasmodium falciparum
KDSEIYMLKELIKEKEKT

SEQ ID NO: 3377462 - protein, 19 aa, Plasmodium falciparum
KDSHICVLVKYISFGCSNF

SEQ ID NO: 3377463 - protein, 22 aa, Plasmodium falciparum
KEAGICIGFGGKICTFDNSTNN

SEQ ID NO: 3377464 - protein, 17 aa, Plasmodium falciparum
KEECIAIINFLRWKKVR

SEQ ID NO: 3377465 - protein, 18 aa, Plasmodium falciparum
KEEKIVILFFYLISHSSN

SEQ ID NO: 3377466 - protein, 20 aa, Plasmodium falciparum
KEFDCKVFGFLYACFLSLEY

SEQ ID NO: 3377467 - protein, 20 aa, Plasmodium falciparum
KEFNCSVCNNMMIFLLQIYA

SEQ ID NO: 3377468 - protein, 18 aa, Plasmodium falciparum
KEGRLRGNLMGKRVDFSA

SEQ ID NO: 3377469 - protein, 22 aa, Plasmodium falciparum
KEILKKKLSLFINEKDINVIVK

SEQ ID NO: 3377470 - protein, 17 aa, Plasmodium falciparum
KEIRILINYILRKNKKK

SEQ ID NO: 3377471 - protein, 17 aa, Plasmodium falciparum
KEISMKLGMKGCVEESN

SEQ ID NO: 3377472 - protein, 17 aa, Plasmodium falciparum
KEIYEKLSIEIKKLDEV

SEQ ID NO: 3377473 - protein, 19 aa, Plasmodium falciparum
KEKLSLLMECFKNNIDNVI

SEQ ID NO: 3377474 - protein, 17 aa, Plasmodium falciparum
KEKNMKSAIRFMKESNY

SEQ ID NO: 3377475 - protein, 20 aa, Plasmodium falciparum
KELFQYLILKAINEIEQIST

SEQ ID NO: 3377476 - protein, 17 aa, Plasmodium falciparum
KELPYTYALVDWIREKI

SEQ ID NO: 3377477 - protein, 22 aa, Plasmodium falciparum
KELSYKYTVCFYIQNNKLLYSI

SEQ ID NO: 3377478 - protein, 21 aa, Plasmodium falciparum
KELWKDKSILPFSFPGLLYLY

SEQ ID NO: 3377479 - protein, 19 aa, Plasmodium falciparum
KELYKRSGDYDNFSIHTDD

SEQ ID NO: 3377480 - protein, 17 aa, Plasmodium falciparum
KEMDEFKGLIKKFKTYN

SEQ ID NO: 3377481 - protein, 24 aa, Plasmodium falciparum
KENIKRASAASIILENNFNSDHID

SEQ ID NO: 3377482 - protein, 20 aa, Plasmodium falciparum
KENKLQCKEYGKAKVYLINQ

SEQ ID NO: 3377483 - protein, 18 aa, Plasmodium falciparum
KEQSLKYHIEYTQNSVGV

SEQ ID NO: 3377484 - protein, 19 aa, Plasmodium falciparum
KERLCDIISAYRSICLSQY

SEQ ID NO: 3377485 - protein, 25 aa, Plasmodium falciparum
KERLIKINLTFPIFFIICKSDGYEI

SEQ ID NO: 3377486 - protein, 19 aa, Plasmodium falciparum
KERLSRLFLYIEDIHKLKQ

SEQ ID NO: 3377487 - protein, 20 aa, Plasmodium falciparum
KESLEYGELLLSNVKEEDEN

SEQ ID NO: 3377488 - protein, 17 aa, Plasmodium falciparum
KETLNCSDISIKLKNNM

SEQ ID NO: 3377489 - protein, 19 aa, Plasmodium falciparum
KEVILRLRFEGIKNSIYEK

SEQ ID NO: 3377490 - protein, 17 aa, Plasmodium falciparum
KEVYKWINVLLYEKKVR

SEQ ID NO: 3377491 - protein, 20 aa, Plasmodium falciparum
KEYLRILILDINDIYDNTIE

SEQ ID NO: 3377492 - protein, 17 aa, Plasmodium falciparum
KEYNADILITWNVPKDN

SEQ ID NO: 3377493 - protein, 20 aa, Plasmodium falciparum
KFDYCPLCRNFIKDKKLENV

SEQ ID NO: 3377494 - protein, 20 aa, Plasmodium falciparum
KFFCIFRQNFAIGIFERKKP

SEQ ID NO: 3377495 - protein, 18 aa, Plasmodium falciparum
KFKKLYGCLKYFIENENK

SEQ ID NO: 3377496 - protein, 22 aa, Plasmodium falciparum
KFNYKVCLYLNVFKEKYLTSEL

SEQ ID NO: 3377497 - protein, 25 aa, Plasmodium falciparum
KFTIKCDIWSAGVIMFFLFTKSLPF

SEQ ID NO: 3377498 - protein, 20 aa, Plasmodium falciparum
KGESLILFLKNQIKMYKKEL

SEQ ID NO: 3377499 - protein, 18 aa, Plasmodium falciparum
KGHIKRVLYNQKYKNKTL

SEQ ID NO: 3377500 - protein, 21 aa, Plasmodium falciparum
KGHLKSGALIKVDKGNNNNNS

SEQ ID NO: 3377501 - protein, 17 aa, Plasmodium falciparum
KGINCTVFAYGATGSGK

SEQ ID NO: 3377502 - protein, 18 aa, Plasmodium falciparum
KGKGKNLPKQWEYEFEEF

SEQ ID NO: 3377503 - protein, 19 aa, Plasmodium falciparum
KGKRFRVILSILLKNILHH

SEQ ID NO: 3377504 - protein, 24 aa, Plasmodium falciparum
KGKRSTGGVFFYLIKYMYKNDIIS

SEQ ID NO: 3377505 - protein, 21 aa, Plasmodium falciparum
KGLEWKVVFIINVTEGEIPQA

SEQ ID NO: 3377506 - protein, 18 aa, Plasmodium falciparum
KGLHIFVIPVLRHILEER

SEQ ID NO: 3377507 - protein, 18 aa, Plasmodium falciparum
KGMFRLCQIEFNRCNFDV

SEQ ID NO: 3377508 - protein, 20 aa, Plasmodium falciparum
KGRKRKIWIQPLDNYNKVED

SEQ ID NO: 3377509 - protein, 27 aa, Plasmodium falciparum
KGSHIKIKFKSMICMNNFLKAYKNTPD

SEQ ID NO: 3377510 - protein, 25 aa, Plasmodium falciparum
KGSSKKKGFCFIEFYNINMAKKVMN

SEQ ID NO: 3377511 - protein, 24 aa, Plasmodium falciparum
KGYRYKFDVCITTPSILNSVSDVE

SEQ ID NO: 3377512 - protein, 17 aa, Plasmodium falciparum
KHFRLFKMFQIYNLSHI

SEQ ID NO: 3377513 - protein, 18 aa, Plasmodium falciparum
KHQSLGIELLHFGEVIMS

SEQ ID NO: 3377514 - protein, 17 aa, Plasmodium falciparum
KHSIICIHYIKNMCMKN

SEQ ID NO: 3377515 - protein, 18 aa, Plasmodium falciparum
KICKACLIIDGLNNYTDN

SEQ ID NO: 3377516 - protein, 22 aa, Plasmodium falciparum
KIDILKKLSFCIVYNNEKKKII

SEQ ID NO: 3377517 - protein, 19 aa, Plasmodium falciparum
KIENFECKMLYNVLIDNFL

SEQ ID NO: 3377518 - protein, 23 aa, Plasmodium falciparum
KIFKGLCRSGLWGCFDEFNRINL

SEQ ID NO: 3377519 - protein, 20 aa, Plasmodium falciparum
KIIFLYKFIKGVCPKSFGIH

SEQ ID NO: 3377520 - protein, 22 aa, Plasmodium falciparum
KIIKFGAMWIFYIYKNIQNEKD

SEQ ID NO: 3377521 - protein, 21 aa, Plasmodium falciparum
KIIKFIVWRQMHIQDFNNKWD

SEQ ID NO: 3377522 - protein, 22 aa, Plasmodium falciparum
KIKELKSNVFIKEYKNSEKFVK

SEQ ID NO: 3377523 - protein, 21 aa, Plasmodium falciparum
KIKKTRADKIFAFDTSGENNN

SEQ ID NO: 3377524 - protein, 24 aa, Plasmodium falciparum
KIKLNEFFFRIKVYMTSHMDELKK

SEQ ID NO: 3377525 - protein, 22 aa, Plasmodium falciparum
KIKYKNCIFCENQLYKSHIINN

SEQ ID NO: 3377526 - protein, 22 aa, Plasmodium falciparum
KILCVGCKCGFVHLINSLTFEI

SEQ ID NO: 3377527 - protein, 17 aa, Plasmodium falciparum
KILFTYRSNFLIRINDN

SEQ ID NO: 3377528 - protein, 19 aa, Plasmodium falciparum
KILLCYKNNYNICFSYKPY

SEQ ID NO: 3377529 - protein, 17 aa, Plasmodium falciparum
KILRTVWFVSALVKARR

SEQ ID NO: 3377530 - protein, 17 aa, Plasmodium falciparum
KIPEAIGGYTFINYIEN

SEQ ID NO: 3377531 - protein, 17 aa, Plasmodium falciparum
KIRKLRCRLKRLSKANN

SEQ ID NO: 3377532 - protein, 21 aa, Plasmodium falciparum
KISEFQLKWLVHFDNEIKNAI

SEQ ID NO: 3377533 - protein, 18 aa, Plasmodium falciparum
KISKYLLKKWGFNKAHSL

SEQ ID NO: 3377534 - protein, 24 aa, Plasmodium falciparum
KITSRGPVCYSALYRDNKYVYRHI

SEQ ID NO: 3377535 - protein, 19 aa, Plasmodium falciparum
KIVIEIFVLMGLQKKTNTQ

SEQ ID NO: 3377536 - protein, 20 aa, Plasmodium falciparum
KIVLDLKIGPTIFKDLNKED

SEQ ID NO: 3377537 - protein, 25 aa, Plasmodium falciparum
KIVLDWRLPIGVLFDIYCDLDKSQK

SEQ ID NO: 3377538 - protein, 20 aa, Plasmodium falciparum
KIVTSLCFYFDCLFDKSTYY

SEQ ID NO: 3377539 - protein, 27 aa, Plasmodium falciparum
KKAFEKRLYLMWPLIEFSNKYRLDQYF

SEQ ID NO: 3377540 - protein, 33 aa, Plasmodium falciparum
KKAHLYFFFLRICKLLYYNIRPIFIFDGNPPEL

SEQ ID NO: 3377541 - protein, 21 aa, Plasmodium falciparum
KKCLDELYILASYDNFLKKKY

SEQ ID NO: 3377542 - protein, 22 aa, Plasmodium falciparum
KKCSLKICRLIHKFNSKNNKKK

SEQ ID NO: 3377543 - protein, 19 aa, Plasmodium falciparum
KKDECLLLTFSFKLFQLSK

SEQ ID NO: 3377544 - protein, 19 aa, Plasmodium falciparum
KKEFTNFSSSSSFNMSNNN

SEQ ID NO: 3377545 - protein, 21 aa, Plasmodium falciparum
KKEIACWFLKPVNPELDGIPN

SEQ ID NO: 3377546 - protein, 20 aa, Plasmodium falciparum
KKEIKLILLNAENKMTLCFD

SEQ ID NO: 3377547 - protein, 23 aa, Plasmodium falciparum
KKFEKHIPCEFIELFEKMEKQLD

SEQ ID NO: 3377548 - protein, 23 aa, Plasmodium falciparum
KKFIKFPSCNLFNNKLNDFINNS

SEQ ID NO: 3377549 - protein, 17 aa, Plasmodium falciparum
KKFLFSINNIFKNVNMY

SEQ ID NO: 3377550 - protein, 17 aa, Plasmodium falciparum
KKFPMVQGVYFDRYQQR

SEQ ID NO: 3377551 - protein, 17 aa, Plasmodium falciparum
KKFRFVIKFKESYPITP

SEQ ID NO: 3377552 - protein, 19 aa, Plasmodium falciparum
KKGIIRFLLRQEKTLKVVA

SEQ ID NO: 3377553 - protein, 21 aa, Plasmodium falciparum
KKGKIERRIKEHNCYSGIIGE

SEQ ID NO: 3377554 - protein, 18 aa, Plasmodium falciparum
KKHILSSRVIIYSKGASL

SEQ ID NO: 3377555 - protein, 19 aa, Plasmodium falciparum
KKHISILCTFRQDFINYVI

SEQ ID NO: 3377556 - protein, 17 aa, Plasmodium falciparum
KKICLSSIVPWKKADVM

SEQ ID NO: 3377557 - protein, 17 aa, Plasmodium falciparum
KKIDMLNLKFLKLKNEY

SEQ ID NO: 3377558 - protein, 23 aa, Plasmodium falciparum
KKIFIKKLFDSINCSYDLSNIEY

SEQ ID NO: 3377559 - protein, 17 aa, Plasmodium falciparum
KKIKYKVFYGFKKSYEN

SEQ ID NO: 3377560 - protein, 17 aa, Plasmodium falciparum
KKILCKYSYVADLYEGD

SEQ ID NO: 3377561 - protein, 21 aa, Plasmodium falciparum
KKILWRYNVNFNISIKVAYPK

SEQ ID NO: 3377562 - protein, 23 aa, Plasmodium falciparum
KKIPCRDINCTFAHDIDTLKPSV

SEQ ID NO: 3377563 - protein, 19 aa, Plasmodium falciparum
KKKAHLFACTYLNRKEPFP

SEQ ID NO: 3377564 - protein, 22 aa, Plasmodium falciparum
KKKEILRWVVILDYGKIFLKKI

SEQ ID NO: 3377565 - protein, 18 aa, Plasmodium falciparum
KKKFCDFKELNNFGTKNL

SEQ ID NO: 3377566 - protein, 19 aa, Plasmodium falciparum
KKKFSCLVKNDLESEKGRG

SEQ ID NO: 3377567 - protein, 23 aa, Plasmodium falciparum
KKKFWRFPFGKKKETKDANEEGI

SEQ ID NO: 3377568 - protein, 22 aa, Plasmodium falciparum
KKKIPCTYKWTRVYYNKECELV

SEQ ID NO: 3377569 - protein, 21 aa, Plasmodium falciparum
KKKKFFFCSTFLYDNIKSNMF

SEQ ID NO: 3377570 - protein, 19 aa, Plasmodium falciparum
KKKKFRPGVISEKLRNALN

SEQ ID NO: 3377571 - protein, 18 aa, Plasmodium falciparum
KKKKIWSCFPDFEKSRRL

SEQ ID NO: 3377572 - protein, 23 aa, Plasmodium falciparum
KKKKRKFTAFSIFAREKRKEYKE

SEQ ID NO: 3377573 - protein, 20 aa, Plasmodium falciparum
KKKLECIEKILFFYFNVYKQ

SEQ ID NO: 3377574 - protein, 18 aa, Plasmodium falciparum
KKKLRLVERWNRVAQESK

SEQ ID NO: 3377575 - protein, 20 aa, Plasmodium falciparum
KKKRLDLIVSDNWKKIAEPD

SEQ ID NO: 3377576 - protein, 23 aa, Plasmodium falciparum
KKKSPCLLCLYGLIEKQRALNYY

SEQ ID NO: 3377577 - protein, 20 aa, Plasmodium falciparum
KKKTLLLSGWSFTFKCETQH

SEQ ID NO: 3377578 - protein, 19 aa, Plasmodium falciparum
KKKTSFEIALLKKIQEQYE

SEQ ID NO: 3377579 - protein, 22 aa, Plasmodium falciparum
KKKTSSWLSFGRKDKKDKKASL

SEQ ID NO: 3377580 - protein, 20 aa, Plasmodium falciparum
KKLFCKKCNSVLIPSETCDV

SEQ ID NO: 3377581 - protein, 17 aa, Plasmodium falciparum
KKLICIIWIKIYMMIIE

SEQ ID NO: 3377582 - protein, 19 aa, Plasmodium falciparum
KKLIKRFIGKATWDMNQLV

SEQ ID NO: 3377583 - protein, 19 aa, Plasmodium falciparum
KKLKESFNISDPSTSQNDT

SEQ ID NO: 3377584 - protein, 19 aa, Plasmodium falciparum
KKLKESIMMMEKYKIIMNN

SEQ ID NO: 3377585 - protein, 17 aa, Plasmodium falciparum
KKLKFLFYFNCINLDNK

SEQ ID NO: 3377586 - protein, 19 aa, Plasmodium falciparum
KKLLYKPIEIIVGEKGKTN

SEQ ID NO: 3377587 - protein, 20 aa, Plasmodium falciparum
KKLVMFFLKYITFFVIENRE

SEQ ID NO: 3377588 - protein, 17 aa, Plasmodium falciparum
KKMAIYFRSFVYNNIKV

SEQ ID NO: 3377589 - protein, 19 aa, Plasmodium falciparum
KKNDYRFSLPFDENKIFRK

SEQ ID NO: 3377590 - protein, 23 aa, Plasmodium falciparum
KKNEFIGNLLLNFLNDLRNNYRL

SEQ ID NO: 3377591 - protein, 33 aa, Plasmodium falciparum
KKNHGYLHFMWLKRKTLCIEIIKCIATLTEKDT

SEQ ID NO: 3377592 - protein, 21 aa, Plasmodium falciparum
KKNIPLLIILLNFLKNLNINL

SEQ ID NO: 3377593 - protein, 18 aa, Plasmodium falciparum
KKNNELFFKDLDKYMNEH

SEQ ID NO: 3377594 - protein, 22 aa, Plasmodium falciparum
KKQFFKTKMCPFQKNKNYCLNE

SEQ ID NO: 3377595 - protein, 18 aa, Plasmodium falciparum
KKQFNNFFFYDALNEKQK

SEQ ID NO: 3377596 - protein, 27 aa, Plasmodium falciparum
KKQFYKTKMCPWFFSGRCDRGMECLFA

SEQ ID NO: 3377597 - protein, 18 aa, Plasmodium falciparum
KKQIKCMKDNYHILNPKS

SEQ ID NO: 3377598 - protein, 18 aa, Plasmodium falciparum
KKQLDLIVILKKQINLLQ

SEQ ID NO: 3377599 - protein, 20 aa, Plasmodium falciparum
KKRIKKIFEFAQIFKKMSQK

SEQ ID NO: 3377600 - protein, 21 aa, Plasmodium falciparum
KKRKCPFNTFFVGELNLDNLL

SEQ ID NO: 3377601 - protein, 21 aa, Plasmodium falciparum
KKRLIHLSMYIKYILPLDEFG

SEQ ID NO: 3377602 - protein, 23 aa, Plasmodium falciparum
KKRSYKFLHCFNYIKNIIDNVYN

SEQ ID NO: 3377603 - protein, 18 aa, Plasmodium falciparum
KKSILRKNIKIINYDYEK

SEQ ID NO: 3377604 - protein, 20 aa, Plasmodium falciparum
KKSIQRLIVISAYQKNNEIN

SEQ ID NO: 3377605 - protein, 20 aa, Plasmodium falciparum
KKSISILFKEHWALEENKNV

SEQ ID NO: 3377606 - protein, 20 aa, Plasmodium falciparum
KKTIELRLPIPITKYMKKME

SEQ ID NO: 3377607 - protein, 21 aa, Plasmodium falciparum
KKTKICEMWLKNKCGNTNCVY

SEQ ID NO: 3377608 - protein, 19 aa, Plasmodium falciparum
KKTMISFSFIKVFNTISVE

SEQ ID NO: 3377609 - protein, 19 aa, Plasmodium falciparum
KKYAAECLDLFITSSCFTT

SEQ ID NO: 3377610 - protein, 19 aa, Plasmodium falciparum
KKYLIRYALYYKKILKYIK

SEQ ID NO: 3377611 - protein, 23 aa, Plasmodium falciparum
KKYRCMRCDYVIKKNAAPELYYN

SEQ ID NO: 3377612 - protein, 18 aa, Plasmodium falciparum
KKYVCLECNKIYLHLNGY

SEQ ID NO: 3377613 - protein, 19 aa, Plasmodium falciparum
KLAFCSSIHGVSFKTLYRS

SEQ ID NO: 3377614 - protein, 19 aa, Plasmodium falciparum
KLAQFFSQDYHLFKNYIKH

SEQ ID NO: 3377615 - protein, 18 aa, Plasmodium falciparum
KLDCPLCYDIFLKYLRFS

SEQ ID NO: 3377616 - protein, 18 aa, Plasmodium falciparum
KLDELAILKDRENQIKEA

SEQ ID NO: 3377617 - protein, 17 aa, Plasmodium falciparum
KLFFRLKISNIYYKCNE

SEQ ID NO: 3377618 - protein, 17 aa, Plasmodium falciparum
KLGELVYKIPKYVKPQK

SEQ ID NO: 3377619 - protein, 18 aa, Plasmodium falciparum
KLHCDNCYYGSGENFLFT

SEQ ID NO: 3377620 - protein, 19 aa, Plasmodium falciparum
KLIKLMLLVFKFTYDYKND

SEQ ID NO: 3377621 - protein, 18 aa, Plasmodium falciparum
KLKFDFNFYDFARVGNIY

SEQ ID NO: 3377622 - protein, 19 aa, Plasmodium falciparum
KLKKKDCIIFNRITKKEDF

SEQ ID NO: 3377623 - protein, 19 aa, Plasmodium falciparum
KLKLCNNIEDIYCNEVKLQ

SEQ ID NO: 3377624 - protein, 21 aa, Plasmodium falciparum
KLKRNILCIINKFIQTNNGKK

SEQ ID NO: 3377625 - protein, 20 aa, Plasmodium falciparum
KLKRSITCLFILKPDIHILT

SEQ ID NO: 3377626 - protein, 18 aa, Plasmodium falciparum
KLKVLCVDYLRILKRLTP

SEQ ID NO: 3377627 - protein, 24 aa, Plasmodium falciparum
KLLIKSEMLFYILSVQIFQNMNMF

SEQ ID NO: 3377628 - protein, 19 aa, Plasmodium falciparum
KLLKKRKIILLKAPIFTKI

SEQ ID NO: 3377629 - protein, 24 aa, Plasmodium falciparum
KLLNRYLIEFAHPFIHVRTIEINK

SEQ ID NO: 3377630 - protein, 17 aa, Plasmodium falciparum
KLMKIYAIIPVKFTHNY

SEQ ID NO: 3377631 - protein, 19 aa, Plasmodium falciparum
KLNGKWIPGKAHRFKLNWA

SEQ ID NO: 3377632 - protein, 17 aa, Plasmodium falciparum
KLPSVSLENFFKDCEIE

SEQ ID NO: 3377633 - protein, 17 aa, Plasmodium falciparum
KLRCKFKSVGMLELDTL

SEQ ID NO: 3377634 - protein, 17 aa, Plasmodium falciparum
KLRRYETYIGYLRIRTH

SEQ ID NO: 3377635 - protein, 19 aa, Plasmodium falciparum
KLSKFLIVPIIHPGVATDP

SEQ ID NO: 3377636 - protein, 17 aa, Plasmodium falciparum
KLVKDFQHKAALLKEEM

SEQ ID NO: 3377637 - protein, 21 aa, Plasmodium falciparum
KLVLLRVSLYIGVFNTKVITL

SEQ ID NO: 3377638 - protein, 19 aa, Plasmodium falciparum
KLYEGNDFFSLVSSIAKES

SEQ ID NO: 3377639 - protein, 19 aa, Plasmodium falciparum
KLYGLDSFHKPDLIKNKNV

SEQ ID NO: 3377640 - protein, 20 aa, Plasmodium falciparum
KMAIECRKAYNLYKKLKKNP

SEQ ID NO: 3377641 - protein, 19 aa, Plasmodium falciparum
KMFVEIYYMKKIIRFIIFS

SEQ ID NO: 3377642 - protein, 24 aa, Plasmodium falciparum
KMIKLEREYSCFMARENVDKKDLE

SEQ ID NO: 3377643 - protein, 18 aa, Plasmodium falciparum
KMKIIMFFINIIRDSNIC

SEQ ID NO: 3377644 - protein, 20 aa, Plasmodium falciparum
KMKILPPYMHHFNKAMKIIP

SEQ ID NO: 3377645 - protein, 18 aa, Plasmodium falciparum
KMNWNFKDIEEMFQNKET

SEQ ID NO: 3377646 - protein, 18 aa, Plasmodium falciparum
KMRLKICKIFNINHRNNL

SEQ ID NO: 3377647 - protein, 21 aa, Plasmodium falciparum
KNDKIKIFISWCPEIVEDKYK

SEQ ID NO: 3377648 - protein, 25 aa, Plasmodium falciparum
KNEKYDWSGYLPVKIQIMKNTENKK

SEQ ID NO: 3377649 - protein, 19 aa, Plasmodium falciparum
KNFKLPCWIKIKNLRKNDL

SEQ ID NO: 3377650 - protein, 17 aa, Plasmodium falciparum
KNFLEYFERSWLSEDEF

SEQ ID NO: 3377651 - protein, 19 aa, Plasmodium falciparum
KNIDCINLFLKHEKENYEM

SEQ ID NO: 3377652 - protein, 19 aa, Plasmodium falciparum
KNIFLKDYELMFILFYLKY

SEQ ID NO: 3377653 - protein, 24 aa, Plasmodium falciparum
KNIFTWGILPVRAFDHPNIFVPLP

SEQ ID NO: 3377654 - protein, 22 aa, Plasmodium falciparum
KNIMWKKLLIDMICFNNNLNVP

SEQ ID NO: 3377655 - protein, 18 aa, Plasmodium falciparum
KNIRINKNYFPKGITSPR

SEQ ID NO: 3377656 - protein, 24 aa, Plasmodium falciparum
KNIWYRLNMKIFLYCWWYVEEVCF

SEQ ID NO: 3377657 - protein, 23 aa, Plasmodium falciparum
KNKKCFKCGLQLNGIMNTAQNII

SEQ ID NO: 3377658 - protein, 17 aa, Plasmodium falciparum
KNKPRCLVISDYKNNLL

SEQ ID NO: 3377659 - protein, 20 aa, Plasmodium falciparum
KNKWGFKCCTNIDKNSKCTN

SEQ ID NO: 3377660 - protein, 24 aa, Plasmodium falciparum
KNLDLYCILKFIITNNIEIYNEES

SEQ ID NO: 3377661 - protein, 18 aa, Plasmodium falciparum
KNLEVLKRMIDVEQEKFL

SEQ ID NO: 3377662 - protein, 20 aa, Plasmodium falciparum
KNLNSLICSGEFNHITENNH

SEQ ID NO: 3377663 - protein, 17 aa, Plasmodium falciparum
KNLVCSIEIFLSNSGNN

SEQ ID NO: 3377664 - protein, 20 aa, Plasmodium falciparum
KNLYRLLGINFTKDIKNKIK

SEQ ID NO: 3377665 - protein, 19 aa, Plasmodium falciparum
KNPFDLANIFTLKRKNQKS

SEQ ID NO: 3377666 - protein, 18 aa, Plasmodium falciparum
KNRINEICIKKNFNNNYK

SEQ ID NO: 3377667 - protein, 20 aa, Plasmodium falciparum
KNSFKEYCMEVSRIFTSHII

SEQ ID NO: 3377668 - protein, 21 aa, Plasmodium falciparum
KNSLLCLSEFYSIGKKKMDNT

SEQ ID NO: 3377669 - protein, 18 aa, Plasmodium falciparum
KNTIKWGPFGNMIALGGF

SEQ ID NO: 3377670 - protein, 18 aa, Plasmodium falciparum
KNTYCYRKDYSFKSNRPY

SEQ ID NO: 3377671 - protein, 24 aa, Plasmodium falciparum
KPEGLKMKLGFFIKKHSNVFKFDT

SEQ ID NO: 3377672 - protein, 18 aa, Plasmodium falciparum
KPELPYIIIELMNDRNKG

SEQ ID NO: 3377673 - protein, 20 aa, Plasmodium falciparum
KPKTYEKFIPLFKFQQNSNQ

SEQ ID NO: 3377674 - protein, 17 aa, Plasmodium falciparum
KPLGCLPPNISNIKEYY

SEQ ID NO: 3377675 - protein, 19 aa, Plasmodium falciparum
KPLSVFYLPLCKLDLENDS

SEQ ID NO: 3377676 - protein, 20 aa, Plasmodium falciparum
KPNNCLWVGNILKNYFFNTA

SEQ ID NO: 3377677 - protein, 18 aa, Plasmodium falciparum
KPNVCEHFSYFLNNKNEQ

SEQ ID NO: 3377678 - protein, 23 aa, Plasmodium falciparum
KPRKSKVNSCFELDILLLDDNNI

SEQ ID NO: 3377679 - protein, 17 aa, Plasmodium falciparum
KQFIPVNLNPCFYPNEP

SEQ ID NO: 3377680 - protein, 26 aa, Plasmodium falciparum
KQMRPKCIFNWKIAKKSLMKMLHSAH

SEQ ID NO: 3377681 - protein, 18 aa, Plasmodium falciparum
KQRINMCKVIKSLVKKAC

SEQ ID NO: 3377682 - protein, 19 aa, Plasmodium falciparum
KQSFEMIKNPSLMKELMKN

SEQ ID NO: 3377683 - protein, 17 aa, Plasmodium falciparum
KQVLKGFTFNISLLSDD

SEQ ID NO: 3377684 - protein, 20 aa, Plasmodium falciparum
KRADIEGFLYIVKRSIKPYY

SEQ ID NO: 3377685 - protein, 19 aa, Plasmodium falciparum
KRFFCSKCNISFGYRSSFR

SEQ ID NO: 3377686 - protein, 17 aa, Plasmodium falciparum
KRFKCIIDNTLMDNKLK

SEQ ID NO: 3377687 - protein, 20 aa, Plasmodium falciparum
KRIQEDLVFIPWRDSKLTRI

SEQ ID NO: 3377688 - protein, 37 aa, Plasmodium falciparum
KRKKKIPGRIYKVIVRGKECWRAEWLVHSKNDDLRTL

SEQ ID NO: 3377689 - protein, 20 aa, Plasmodium falciparum
KRKSFVCKKVIKKGIIKSNQ

SEQ ID NO: 3377690 - protein, 23 aa, Plasmodium falciparum
KRLCKMPPLGITVAISFDSFVVL

SEQ ID NO: 3377691 - protein, 26 aa, Plasmodium falciparum
KRLLEAYSNIFLHFDIFIDNKTYNFI

SEQ ID NO: 3377692 - protein, 17 aa, Plasmodium falciparum
KRLTCFNENLEIKYNFL

SEQ ID NO: 3377693 - protein, 18 aa, Plasmodium falciparum
KRNCCILIQSHIRRYLMV

SEQ ID NO: 3377694 - protein, 19 aa, Plasmodium falciparum
KRQTIMFSATFRKEIQVLA

SEQ ID NO: 3377695 - protein, 20 aa, Plasmodium falciparum
KRRLLNFVLFGCRFKILFKK

SEQ ID NO: 3377696 - protein, 18 aa, Plasmodium falciparum
KRRSFFLSSEFRTITYIE

SEQ ID NO: 3377697 - protein, 17 aa, Plasmodium falciparum
KRSDLWFTYLDIHINSL

SEQ ID NO: 3377698 - protein, 18 aa, Plasmodium falciparum
KRSSVCLFTDMKYQKIYI

SEQ ID NO: 3377699 - protein, 25 aa, Plasmodium falciparum
KRTKLCYKLLKGEKCFNKKCNYAHN

SEQ ID NO: 3377700 - protein, 19 aa, Plasmodium falciparum
KRVHCKFQMWNFRNIHNSH

SEQ ID NO: 3377701 - protein, 19 aa, Plasmodium falciparum
KRWKHDLFYDYKYDEYVKR

SEQ ID NO: 3377702 - protein, 23 aa, Plasmodium falciparum
KSFILYQCLKLLIRLHDAGLSHL

SEQ ID NO: 3377703 - protein, 20 aa, Plasmodium falciparum
KSGNSPLMWSIQNKHIESTR

SEQ ID NO: 3377704 - protein, 20 aa, Plasmodium falciparum
KSGRRWVASWSQNGNQKRQY

SEQ ID NO: 3377705 - protein, 25 aa, Plasmodium falciparum
KSGYCCIRLSLPLLKLRKIKEYRET

SEQ ID NO: 3377706 - protein, 26 aa, Plasmodium falciparum
KSHRLFKFPCCNKIFPCPTCHDLNSN

SEQ ID NO: 3377707 - protein, 19 aa, Plasmodium falciparum
KSHSSLCGTLVYFSPEITS

SEQ ID NO: 3377708 - protein, 19 aa, Plasmodium falciparum
KSIHCKKLIYISGDKRYIR

SEQ ID NO: 3377709 - protein, 22 aa, Plasmodium falciparum
KSIPCECTKCLEEKNTNKFMDT

SEQ ID NO: 3377710 - protein, 20 aa, Plasmodium falciparum
KSIRCLLDKIMLRRLKEQAI

SEQ ID NO: 3377711 - protein, 19 aa, Plasmodium falciparum
KSKAAAGLAEWVLNITSFY

SEQ ID NO: 3377712 - protein, 19 aa, Plasmodium falciparum
KSKAMLQLIYWHKWLTEEE

SEQ ID NO: 3377713 - protein, 23 aa, Plasmodium falciparum
KSKEFLTILLLEFLKSMLTVLNK

SEQ ID NO: 3377714 - protein, 20 aa, Plasmodium falciparum
KSKREILCITRFIINALKRN

SEQ ID NO: 3377715 - protein, 19 aa, Plasmodium falciparum
KSLGICLVEFSYLDNTQNY

SEQ ID NO: 3377716 - protein, 17 aa, Plasmodium falciparum
KSLGYAYVNYHNLADAE

SEQ ID NO: 3377717 - protein, 20 aa, Plasmodium falciparum
KSLKSNSAYIFKYKNSHIPN

SEQ ID NO: 3377718 - protein, 23 aa, Plasmodium falciparum
KSLKTSLCTLEYLDISCCQDLSN

SEQ ID NO: 3377719 - protein, 23 aa, Plasmodium falciparum
KSMFKRYPNFMGGYPYNNMNPYN

SEQ ID NO: 3377720 - protein, 22 aa, Plasmodium falciparum
KSNCVDGKCEIIWKDNRQFFGY

SEQ ID NO: 3377721 - protein, 19 aa, Plasmodium falciparum
KSNKLHLVRLIILTNCTFD

SEQ ID NO: 3377722 - protein, 21 aa, Plasmodium falciparum
KSQLRITSFFKRIDKKTNENH

SEQ ID NO: 3377723 - protein, 17 aa, Plasmodium falciparum
KSSCDKSNFLNTPNIVV

SEQ ID NO: 3377724 - protein, 19 aa, Plasmodium falciparum
KSSMCKFVANKRCLNGATC

SEQ ID NO: 3377725 - protein, 18 aa, Plasmodium falciparum
KSVRCIGCNSSIKKPPLC

SEQ ID NO: 3377726 - protein, 17 aa, Plasmodium falciparum
KTALKCAMKLNDDFSID

SEQ ID NO: 3377727 - protein, 17 aa, Plasmodium falciparum
KTCGVCLIFCFNPKISQ

SEQ ID NO: 3377728 - protein, 18 aa, Plasmodium falciparum
KTCMKSYLVNCNKIEKFI

SEQ ID NO: 3377729 - protein, 19 aa, Plasmodium falciparum
KTCPFLLRLFYKVDKEYNV

SEQ ID NO: 3377730 - protein, 17 aa, Plasmodium falciparum
KTFRFLFFYTKLSIEDK

SEQ ID NO: 3377731 - protein, 17 aa, Plasmodium falciparum
KTGFPIVITIFSAPNYC

SEQ ID NO: 3377732 - protein, 18 aa, Plasmodium falciparum
KTKKLLFAIHKWENNQYL

SEQ ID NO: 3377733 - protein, 19 aa, Plasmodium falciparum
KTKLCKSYILGKCTDNNCI

SEQ ID NO: 3377734 - protein, 24 aa, Plasmodium falciparum
KTPYECIYKFISMPLSNPYFDLNN

SEQ ID NO: 3377735 - protein, 17 aa, Plasmodium falciparum
KTRHWRNVIYKTNEEKN

SEQ ID NO: 3377736 - protein, 20 aa, Plasmodium falciparum
KTRMCYRNVPSFNYINNIDL

SEQ ID NO: 3377737 - protein, 18 aa, Plasmodium falciparum
KTSNCLITYDFKNLQQIY

SEQ ID NO: 3377738 - protein, 18 aa, Plasmodium falciparum
KTSRRFSIKIKRDKNNPR

SEQ ID NO: 3377739 - protein, 22 aa, Plasmodium falciparum
KTWDLKCVIIKGGDDLRQELLA

SEQ ID NO: 3377740 - protein, 19 aa, Plasmodium falciparum
KTYELLRSLVLLTQTLEPL

SEQ ID NO: 3377741 - protein, 19 aa, Plasmodium falciparum
KVFHYGIHKENLLKGENEF

SEQ ID NO: 3377742 - protein, 25 aa, Plasmodium falciparum
KVFRLLKLLGEWIKYGLVLIFVNKQ

SEQ ID NO: 3377743 - protein, 19 aa, Plasmodium falciparum
KVHTLWLYHCRGTLEKRHS

SEQ ID NO: 3377744 - protein, 24 aa, Plasmodium falciparum
KVIFYELLKSCILHFNEYIKYESI

SEQ ID NO: 3377745 - protein, 21 aa, Plasmodium falciparum
KVKNAYDWDVDWRKKKSMGIM

SEQ ID NO: 3377746 - protein, 21 aa, Plasmodium falciparum
KVLYSFPFKYFHLLVYAFKNY

SEQ ID NO: 3377747 - protein, 17 aa, Plasmodium falciparum
KWGRNIFARRLRGATFP

SEQ ID NO: 3377748 - protein, 18 aa, Plasmodium falciparum
KWGSFKLFEKWIKDSSKW

SEQ ID NO: 3377749 - protein, 18 aa, Plasmodium falciparum
KYAWRIIYDLLKGSSHMK

SEQ ID NO: 3377750 - protein, 17 aa, Plasmodium falciparum
KYCRARILANTVYTNMI

SEQ ID NO: 3377751 - protein, 17 aa, Plasmodium falciparum
KYFKFGLTHIKNEFVVY

SEQ ID NO: 3377752 - protein, 17 aa, Plasmodium falciparum
KYFKFSHLYTMYIQNNF

SEQ ID NO: 3377753 - protein, 19 aa, Plasmodium falciparum
KYHMNLCALIKKIKNYINE

SEQ ID NO: 3377754 - protein, 19 aa, Plasmodium falciparum
KYILKCKLVIYDLHNTDLE

SEQ ID NO: 3377755 - protein, 20 aa, Plasmodium falciparum
KYILRNICKIIPFDCICKPH

SEQ ID NO: 3377756 - protein, 19 aa, Plasmodium falciparum
KYKKVRINSHISSKLNDKS

SEQ ID NO: 3377757 - protein, 18 aa, Plasmodium falciparum
KYKLLEIELCKEKNIRDQ

SEQ ID NO: 3377758 - protein, 19 aa, Plasmodium falciparum
KYKNFYLNHFININNIFST

SEQ ID NO: 3377759 - protein, 27 aa, Plasmodium falciparum
KYLKRIKIFWSFCFFKNLEYCLRQAKE

SEQ ID NO: 3377760 - protein, 18 aa, Plasmodium falciparum
KYLLLPILEKFRPEFIFI

SEQ ID NO: 3377761 - protein, 18 aa, Plasmodium falciparum
KYNCDVFNLLSLMPSHIS

SEQ ID NO: 3377762 - protein, 19 aa, Plasmodium falciparum
KYNFSIKRYFKILVNVSLL

SEQ ID NO: 3377763 - protein, 20 aa, Plasmodium falciparum
KYNFVPVIIDWGLIKQLDSV

SEQ ID NO: 3377764 - protein, 20 aa, Plasmodium falciparum
KYREACTVLCDWSYDGTLFM

SEQ ID NO: 3377765 - protein, 18 aa, Plasmodium falciparum
KYSLKYKKLAIILATHDF

SEQ ID NO: 3377766 - protein, 18 aa, Plasmodium falciparum
KYSLLKFNYIMHSSYNMQ

SEQ ID NO: 3377767 - protein, 17 aa, Plasmodium falciparum
KYTFGVYKTTICKHWKK

SEQ ID NO: 3377768 - protein, 17 aa, Plasmodium falciparum
KYTHGLKGISIYNANRL

SEQ ID NO: 3377769 - protein, 25 aa, Plasmodium falciparum
KYYFPSVEYFERFYIHLHYKTRADD

SEQ ID NO: 3377770 - protein, 17 aa, Plasmodium falciparum
LACAILLLIDRLNYPDI

SEQ ID NO: 3377771 - protein, 20 aa, Plasmodium falciparum
LACLKCFLNFSINDTNLQIQ

SEQ ID NO: 3377772 - protein, 22 aa, Plasmodium falciparum
LASFNFKVCIYINVLFSNNFIT

SEQ ID NO: 3377773 - protein, 23 aa, Plasmodium falciparum
LASHPCIKYIFRFFFLKYASITT

SEQ ID NO: 3377774 - protein, 18 aa, Plasmodium falciparum
LCEINRFGNFYINNSPLI

SEQ ID NO: 3377775 - protein, 17 aa, Plasmodium falciparum
LCFCSECAINGIHTNNC

SEQ ID NO: 3377776 - protein, 19 aa, Plasmodium falciparum
LCFYFDCLFDKSTYYIKNN

SEQ ID NO: 3377777 - protein, 17 aa, Plasmodium falciparum
LCGFPIFLRKSYYNNKS

SEQ ID NO: 3377778 - protein, 22 aa, Plasmodium falciparum
LCHRLGLIPFKFDADLINYKED

SEQ ID NO: 3377779 - protein, 17 aa, Plasmodium falciparum
LCMNLKCTFSIHDLILI

SEQ ID NO: 3377780 - protein, 17 aa, Plasmodium falciparum
LCNSLNYSKYSPFNINS

SEQ ID NO: 3377781 - protein, 19 aa, Plasmodium falciparum
LCQRLKLFEALHNFIKEQN

SEQ ID NO: 3377782 - protein, 21 aa, Plasmodium falciparum
LCRKVKIAFLYLGNIDLAQKV

SEQ ID NO: 3377783 - protein, 17 aa, Plasmodium falciparum
LCSGPGCVTKSQDITRQ

SEQ ID NO: 3377784 - protein, 18 aa, Plasmodium falciparum
LCSLRFYLNMFYLSTPRY

SEQ ID NO: 3377785 - protein, 23 aa, Plasmodium falciparum
LCTKLNSIINFEWINNDLKMNLN

SEQ ID NO: 3377786 - protein, 20 aa, Plasmodium falciparum
LCVTESYLTPAYIKQGVIEL

SEQ ID NO: 3377787 - protein, 17 aa, Plasmodium falciparum
LCYLLKYYVRFNYNILY

SEQ ID NO: 3377788 - protein, 20 aa, Plasmodium falciparum
LDFFKPSLGEFGYEGVYKQK

SEQ ID NO: 3377789 - protein, 19 aa, Plasmodium falciparum
LDFLYPHLVLFGGNEEICD

SEQ ID NO: 3377790 - protein, 21 aa, Plasmodium falciparum
LDHTKLSYKWDIWSMGCVFQE

SEQ ID NO: 3377791 - protein, 17 aa, Plasmodium falciparum
LDILVCAGLISSKKLIE

SEQ ID NO: 3377792 - protein, 19 aa, Plasmodium falciparum
LDKFFCLFSLLKIKNKIYI

SEQ ID NO: 3377793 - protein, 22 aa, Plasmodium falciparum
LDKYKNECNFVYYQNYNNTNNV

SEQ ID NO: 3377794 - protein, 32 aa, Plasmodium falciparum
LDNYLCCFSNIKICAVKSIFLDSIMECIEELE

SEQ ID NO: 3377795 - protein, 19 aa, Plasmodium falciparum
LDPLLKCINSLSDRINLQH

SEQ ID NO: 3377796 - protein, 17 aa, Plasmodium falciparum
LDRNSCIYESVVFLSAE

SEQ ID NO: 3377797 - protein, 23 aa, Plasmodium falciparum
LDTLTCLWSISGQYLIFLVNTND

SEQ ID NO: 3377798 - protein, 18 aa, Plasmodium falciparum
LDVYRAYNVLTYMQEKVS

SEQ ID NO: 3377799 - protein, 24 aa, Plasmodium falciparum
LDYKEWWNVVGSFRCSGVINSIIW

SEQ ID NO: 3377800 - protein, 17 aa, Plasmodium falciparum
LEFWPIFIKDRSYVAYA

SEQ ID NO: 3377801 - protein, 17 aa, Plasmodium falciparum
LEHISWYKQFLVYNNLK

SEQ ID NO: 3377802 - protein, 20 aa, Plasmodium falciparum
LEIFQPFGLIESIKLKVNKN

SEQ ID NO: 3377803 - protein, 18 aa, Plasmodium falciparum
LEKFKSFIIEDSNSSSSG

SEQ ID NO: 3377804 - protein, 22 aa, Plasmodium falciparum
LEKKSALCTFNIHNFFYVETLF

SEQ ID NO: 3377805 - protein, 20 aa, Plasmodium falciparum
LEMKSFRLSLNYTDLDVLVG

SEQ ID NO: 3377806 - protein, 22 aa, Plasmodium falciparum
LENGVPMKARWSCKKVGNDEAQ

SEQ ID NO: 3377807 - protein, 17 aa, Plasmodium falciparum
LEQDGCLLKDKYIQVTL

SEQ ID NO: 3377808 - protein, 18 aa, Plasmodium falciparum
LESFKCLFFTKDNLIDIE

SEQ ID NO: 3377809 - protein, 17 aa, Plasmodium falciparum
LETLGKCLSMFILYITD

SEQ ID NO: 3377810 - protein, 17 aa, Plasmodium falciparum
LEYCLRYTLLKELNDDI

SEQ ID NO: 3377811 - protein, 19 aa, Plasmodium falciparum
LEYFLKKYFNSFLLIQKDN

SEQ ID NO: 3377812 - protein, 19 aa, Plasmodium falciparum
LFEAFIIYHFWYQKNSVDI

SEQ ID NO: 3377813 - protein, 19 aa, Plasmodium falciparum
LFECIKCIFELAIYDQEGK

SEQ ID NO: 3377814 - protein, 20 aa, Plasmodium falciparum
LFERIKMLQIMNEYKVKCSF

SEQ ID NO: 3377815 - protein, 18 aa, Plasmodium falciparum
LFFFCKYTSYNLYLHPLN

SEQ ID NO: 3377816 - protein, 19 aa, Plasmodium falciparum
LFFYFCGYSIKLIDSKFTE

SEQ ID NO: 3377817 - protein, 22 aa, Plasmodium falciparum
LFGFDYARRLAIYCKIHQKIPE

SEQ ID NO: 3377818 - protein, 19 aa, Plasmodium falciparum
LFHHIFKWAHITQHHSYLE

SEQ ID NO: 3377819 - protein, 18 aa, Plasmodium falciparum
LFIPSLWLHYVYNMPPHT

SEQ ID NO: 3377820 - protein, 18 aa, Plasmodium falciparum
LFLCYDWLKEKLMFSKIF

SEQ ID NO: 3377821 - protein, 17 aa, Plasmodium falciparum
LFLFFFVHKNFIYSYKI

SEQ ID NO: 3377822 - protein, 17 aa, Plasmodium falciparum
LFLKYNIPFFTIFSQTS

SEQ ID NO: 3377823 - protein, 17 aa, Plasmodium falciparum
LFSLHILAVGWNVNKGD

SEQ ID NO: 3377824 - protein, 18 aa, Plasmodium falciparum
LFTLINFMFPDIFKNSEI

SEQ ID NO: 3377825 - protein, 19 aa, Plasmodium falciparum
LFYRLKKYNNIFSIEQILG

SEQ ID NO: 3377826 - protein, 20 aa, Plasmodium falciparum
LGCGCYRIGSSVEFDWSAIH

SEQ ID NO: 3377827 - protein, 22 aa, Plasmodium falciparum
LGCKEFKVIDFFTIYRLDMTTF

SEQ ID NO: 3377828 - protein, 20 aa, Plasmodium falciparum
LGDIFYSWLVSCYEDKNFLN

SEQ ID NO: 3377829 - protein, 21 aa, Plasmodium falciparum
LGEFLPKFLIDNNINSGNNVV

SEQ ID NO: 3377830 - protein, 25 aa, Plasmodium falciparum
LGEPNFPYWCLGKYLPFVLVLETLN

SEQ ID NO: 3377831 - protein, 17 aa, Plasmodium falciparum
LGMKHGYGIYVYDHINR

SEQ ID NO: 3377832 - protein, 18 aa, Plasmodium falciparum
LGWWNFGKPLKIFSNIEK

SEQ ID NO: 3377833 - protein, 26 aa, Plasmodium falciparum
LHERTCKINEFITVCTICHDYINENM

SEQ ID NO: 3377834 - protein, 19 aa, Plasmodium falciparum
LHLYIKINFILNHIRNISI

SEQ ID NO: 3377835 - protein, 19 aa, Plasmodium falciparum
LHVSFSFSEFLLFQKAANL

SEQ ID NO: 3377836 - protein, 17 aa, Plasmodium falciparum
LIEILGFEDDILYEYCI

SEQ ID NO: 3377837 - protein, 18 aa, Plasmodium falciparum
LIEPYWWFFYNLYENACI

SEQ ID NO: 3377838 - protein, 18 aa, Plasmodium falciparum
LIHCLKWTRVYIRRKDDN

SEQ ID NO: 3377839 - protein, 23 aa, Plasmodium falciparum
LIIHEISDLLSLITTVDKSKNKN

SEQ ID NO: 3377840 - protein, 17 aa, Plasmodium falciparum
LIILLNFLKNLNINLNH

SEQ ID NO: 3377841 - protein, 18 aa, Plasmodium falciparum
LIKEMFIHVFGVPNYHPL

SEQ ID NO: 3377842 - protein, 21 aa, Plasmodium falciparum
LIKKFYCNFTFEDIILILQSY

SEQ ID NO: 3377843 - protein, 18 aa, Plasmodium falciparum
LIKYISYMQKALIKASEG

SEQ ID NO: 3377844 - protein, 26 aa, Plasmodium falciparum
LILAEKLKCGWGFPTGCSLNHCAAHY

SEQ ID NO: 3377845 - protein, 17 aa, Plasmodium falciparum
LILCKSKILFTYRSNFL

SEQ ID NO: 3377846 - protein, 17 aa, Plasmodium falciparum
LILLKLLYVNIILNNYN

SEQ ID NO: 3377847 - protein, 23 aa, Plasmodium falciparum
LIMYYIKRMETFLPFFNLQDYLQ

SEQ ID NO: 3377848 - protein, 26 aa, Plasmodium falciparum
LINYLNFFMRVCCSKSSYIKFVNHYF

SEQ ID NO: 3377849 - protein, 17 aa, Plasmodium falciparum
LIPTYPIFNYRNVINSN

SEQ ID NO: 3377850 - protein, 18 aa, Plasmodium falciparum
LIQLCLFKSCLNSKVYEK

SEQ ID NO: 3377851 - protein, 23 aa, Plasmodium falciparum
LIRKYRCLINNPFVFVKNEMDNS

SEQ ID NO: 3377852 - protein, 25 aa, Plasmodium falciparum
LIRSCFLLKWQCIFNIDNLNRKRKN

SEQ ID NO: 3377853 - protein, 18 aa, Plasmodium falciparum
LIRSFGWDASDVFTQQDT

SEQ ID NO: 3377854 - protein, 17 aa, Plasmodium falciparum
LISLWGIEHQEILMNSS

SEQ ID NO: 3377855 - protein, 18 aa, Plasmodium falciparum
LIVCSALKSDKRCCPYKC

SEQ ID NO: 3377856 - protein, 19 aa, Plasmodium falciparum
LIYKNCIDFNPDIEENKYI

SEQ ID NO: 3377857 - protein, 26 aa, Plasmodium falciparum
LKDHSSAVWKVCWSHPKYGSLLASCS

SEQ ID NO: 3377858 - protein, 18 aa, Plasmodium falciparum
LKDYELMFILFYLKYEYR

SEQ ID NO: 3377859 - protein, 18 aa, Plasmodium falciparum
LKEILPFGFGIHHAGLKR

SEQ ID NO: 3377860 - protein, 18 aa, Plasmodium falciparum
LKELKFKSANNIKYGRDN

SEQ ID NO: 3377861 - protein, 23 aa, Plasmodium falciparum
LKERKSFRIPKFFHFIDNITNTE

SEQ ID NO: 3377862 - protein, 19 aa, Plasmodium falciparum
LKETFSFCGKIKAIEFFND

SEQ ID NO: 3377863 - protein, 18 aa, Plasmodium falciparum
LKEWYGWHFPELGKVITD

SEQ ID NO: 3377864 - protein, 18 aa, Plasmodium falciparum
LKFFFQKLHELFRQMLNK

SEQ ID NO: 3377865 - protein, 19 aa, Plasmodium falciparum
LKFLHCFYNFINTYIKKEK

SEQ ID NO: 3377866 - protein, 24 aa, Plasmodium falciparum
LKFVETYALEFSKLIKEASVLTLP

SEQ ID NO: 3377867 - protein, 19 aa, Plasmodium falciparum
LKGEIKDLLLLDVIPLSLG

SEQ ID NO: 3377868 - protein, 20 aa, Plasmodium falciparum
LKIELKKFWDLKEKKKKYEQ

SEQ ID NO: 3377869 - protein, 18 aa, Plasmodium falciparum
LKIIFSRFGNIKSCKIIK

SEQ ID NO: 3377870 - protein, 17 aa, Plasmodium falciparum
LKIKWILLNLNLKNDDE

SEQ ID NO: 3377871 - protein, 18 aa, Plasmodium falciparum
LKIYILIFRSLCNENIKK

SEQ ID NO: 3377872 - protein, 17 aa, Plasmodium falciparum
LKKALSLKRRKKYTNII

SEQ ID NO: 3377873 - protein, 17 aa, Plasmodium falciparum
LKKCTMCNVYICYFCCH

SEQ ID NO: 3377874 - protein, 21 aa, Plasmodium falciparum
LKKIEECISFGYSIIVENADE

SEQ ID NO: 3377875 - protein, 20 aa, Plasmodium falciparum
LKKLCLRILFINEYQIYNIK

SEQ ID NO: 3377876 - protein, 17 aa, Plasmodium falciparum
LKKNCAYHDLIKLFYFK

SEQ ID NO: 3377877 - protein, 20 aa, Plasmodium falciparum
LKKNQVIILFKGCIVSGNDT

SEQ ID NO: 3377878 - protein, 18 aa, Plasmodium falciparum
LKKWHVGLIIALRNIISK

SEQ ID NO: 3377879 - protein, 17 aa, Plasmodium falciparum
LKLCSGPGCVTKSQDIT

SEQ ID NO: 3377880 - protein, 19 aa, Plasmodium falciparum
LKLDVCVAIPSTIINNKSD

SEQ ID NO: 3377881 - protein, 18 aa, Plasmodium falciparum
LKLEICTNEYMELKENYD

SEQ ID NO: 3377882 - protein, 19 aa, Plasmodium falciparum
LKLKIFFLNIIKNMKNKKR

SEQ ID NO: 3377883 - protein, 18 aa, Plasmodium falciparum
LKLLLSIENRKNYYKKKI

SEQ ID NO: 3377884 - protein, 17 aa, Plasmodium falciparum
LKLTSWVHFRYPKNLTY

SEQ ID NO: 3377885 - protein, 19 aa, Plasmodium falciparum
LKLYIGGLLGPLSNITEQE

SEQ ID NO: 3377886 - protein, 17 aa, Plasmodium falciparum
LKMGKGYKVQTITNNNN

SEQ ID NO: 3377887 - protein, 20 aa, Plasmodium falciparum
LKNLVRLGVQFNPFADNPNY

SEQ ID NO: 3377888 - protein, 20 aa, Plasmodium falciparum
LKNMTLCWSILRNNFLIKSA

SEQ ID NO: 3377889 - protein, 18 aa, Plasmodium falciparum
LKNYLPYLCKILIDNTVY

SEQ ID NO: 3377890 - protein, 18 aa, Plasmodium falciparum
LKNYSAYMLVYVKKSLIP

SEQ ID NO: 3377891 - protein, 17 aa, Plasmodium falciparum
LKPYFWFASHLHVKYSA

SEQ ID NO: 3377892 - protein, 19 aa, Plasmodium falciparum
LKQRNCNLITLSQFMKERK

SEQ ID NO: 3377893 - protein, 20 aa, Plasmodium falciparum
LKRFVYRMYLNFTKEPINVF

SEQ ID NO: 3377894 - protein, 19 aa, Plasmodium falciparum
LKRNLLISLCEKYNINILY

SEQ ID NO: 3377895 - protein, 20 aa, Plasmodium falciparum
LKRVYELYSDIILKNPFYDI

SEQ ID NO: 3377896 - protein, 18 aa, Plasmodium falciparum
LKSFYVLINFCMHSSDII

SEQ ID NO: 3377897 - protein, 21 aa, Plasmodium falciparum
LKSHKGIMQYILKNGNTSSNK

SEQ ID NO: 3377898 - protein, 18 aa, Plasmodium falciparum
LKSLYLLNEYLNVEPTNN

SEQ ID NO: 3377899 - protein, 28 aa, Plasmodium falciparum
LKSSLKMMYAYCLFKNLKLFYQIQYKNM

SEQ ID NO: 3377900 - protein, 17 aa, Plasmodium falciparum
LKTPCHFTLAQNTDFLN

SEQ ID NO: 3377901 - protein, 18 aa, Plasmodium falciparum
LKYHAVFCINCNNHIAYF

SEQ ID NO: 3377902 - protein, 23 aa, Plasmodium falciparum
LKYKGICKWPNYSNLFVINYNLN

SEQ ID NO: 3377903 - protein, 17 aa, Plasmodium falciparum
LKYLKKYSSVIVSNQDM

SEQ ID NO: 3377904 - protein, 22 aa, Plasmodium falciparum
LKYLLHKSMENFRLWEPDDNIK

SEQ ID NO: 3377905 - protein, 17 aa, Plasmodium falciparum
LLCYLRFNKNIKKKSII

SEQ ID NO: 3377906 - protein, 22 aa, Plasmodium falciparum
LLDCYGRFIALLPEFLLKDHVH

SEQ ID NO: 3377907 - protein, 27 aa, Plasmodium falciparum
LLDSFTCEYFCFSVCVKNEFNTYLEFY

SEQ ID NO: 3377908 - protein, 20 aa, Plasmodium falciparum
LLEYPRLRFDGVYISCVTYI

SEQ ID NO: 3377909 - protein, 17 aa, Plasmodium falciparum
LLFICSHMWPLFIKPIL

SEQ ID NO: 3377910 - protein, 19 aa, Plasmodium falciparum
LLFLLRFNKWKGASYNYTT

SEQ ID NO: 3377911 - protein, 17 aa, Plasmodium falciparum
LLKKRYVVFNNKYKISE

SEQ ID NO: 3377912 - protein, 18 aa, Plasmodium falciparum
LLLFRIFFNYIITLNENN

SEQ ID NO: 3377913 - protein, 26 aa, Plasmodium falciparum
LLNHIVKMPLKYAYKNGLSPRNSTAR

SEQ ID NO: 3377914 - protein, 18 aa, Plasmodium falciparum
LLPKFSLPLYDSGILQYV

SEQ ID NO: 3377915 - protein, 26 aa, Plasmodium falciparum
LLQEFCLVESKFLHIHLCLKKERCDN

SEQ ID NO: 3377916 - protein, 21 aa, Plasmodium falciparum
LLREKICINNQIAYMIKHDYE

SEQ ID NO: 3377917 - protein, 18 aa, Plasmodium falciparum
LLSGWSFTFKCETQHLTN

SEQ ID NO: 3377918 - protein, 20 aa, Plasmodium falciparum
LLTRKNIFMLPSLYTNDNDY

SEQ ID NO: 3377919 - protein, 18 aa, Plasmodium falciparum
LLVYRYLVENGFVHTSFS

SEQ ID NO: 3377920 - protein, 18 aa, Plasmodium falciparum
LLYDNCIYENKMVIMHFH

SEQ ID NO: 3377921 - protein, 22 aa, Plasmodium falciparum
LLYKRMKEIYLWKKIICSQERY

SEQ ID NO: 3377922 - protein, 18 aa, Plasmodium falciparum
LLYSFCTLQKWLFGAFAN

SEQ ID NO: 3377923 - protein, 25 aa, Plasmodium falciparum
LMECLKVLIPLNMRDIFLGSENIIL

SEQ ID NO: 3377924 - protein, 17 aa, Plasmodium falciparum
LMTRPNIFTGRKILGTL

SEQ ID NO: 3377925 - protein, 20 aa, Plasmodium falciparum
LNCGQFIKKSLCLILIELLK

SEQ ID NO: 3377926 - protein, 17 aa, Plasmodium falciparum
LNDIIFLDVYRAYNVLT

SEQ ID NO: 3377927 - protein, 23 aa, Plasmodium falciparum
LNEIRIPLIIGRQYLFYSLNFAH

SEQ ID NO: 3377928 - protein, 18 aa, Plasmodium falciparum
LNETLFMGRIIKSIQAYR

SEQ ID NO: 3377929 - protein, 21 aa, Plasmodium falciparum
LNEWKNLKWFDGIQKMKELKN

SEQ ID NO: 3377930 - protein, 26 aa, Plasmodium falciparum
LNFCVKNLGLFFARFIDESFMKKISK

SEQ ID NO: 3377931 - protein, 17 aa, Plasmodium falciparum
LNFKLNIEKVFYESLSN

SEQ ID NO: 3377932 - protein, 18 aa, Plasmodium falciparum
LNGIENWILLKSTTPKYI

SEQ ID NO: 3377933 - protein, 20 aa, Plasmodium falciparum
LNIFSKLPFFYLFYPSSYKK

SEQ ID NO: 3377934 - protein, 20 aa, Plasmodium falciparum
LNIIYFLCKFHFYNETIKKF

SEQ ID NO: 3377935 - protein, 22 aa, Plasmodium falciparum
LNIYCALNIFKLIRRGRYTICK

SEQ ID NO: 3377936 - protein, 18 aa, Plasmodium falciparum
LNKLKPYFWFASHLHVKY

SEQ ID NO: 3377937 - protein, 17 aa, Plasmodium falciparum
LNLKFLKLKNEYTHANN

SEQ ID NO: 3377938 - protein, 17 aa, Plasmodium falciparum
LNLKNVNIIKCLQQQIN

SEQ ID NO: 3377939 - protein, 17 aa, Plasmodium falciparum
LNLKRCIFLNGEIKDHV

SEQ ID NO: 3377940 - protein, 18 aa, Plasmodium falciparum
LNNFIPLIGVELGKTKFQ

SEQ ID NO: 3377941 - protein, 18 aa, Plasmodium falciparum
LNSKFAYLAIYTCENNCD

SEQ ID NO: 3377942 - protein, 17 aa, Plasmodium falciparum
LNSLFLMWGTSENPNEP

SEQ ID NO: 3377943 - protein, 19 aa, Plasmodium falciparum
LNVALTRARFNLFIFGNCK

SEQ ID NO: 3377944 - protein, 19 aa, Plasmodium falciparum
LNYTDCYDFKNSLLNGLSR

SEQ ID NO: 3377945 - protein, 23 aa, Plasmodium falciparum
LNYWAEKVILFYPHNEKINKYCT

SEQ ID NO: 3377946 - protein, 17 aa, Plasmodium falciparum
LPELLQMIGRTDPSFLE

SEQ ID NO: 3377947 - protein, 19 aa, Plasmodium falciparum
LPEMRRIAALLYKKNKKYK

SEQ ID NO: 3377948 - protein, 17 aa, Plasmodium falciparum
LPFGWRVHILLPQDISA

SEQ ID NO: 3377949 - protein, 18 aa, Plasmodium falciparum
LPKLLKFKHKVLIFSQMT

SEQ ID NO: 3377950 - protein, 17 aa, Plasmodium falciparum
LPLKMLIVGGIDKVYEI

SEQ ID NO: 3377951 - protein, 20 aa, Plasmodium falciparum
LPNFNCTPNLFSPEKQNVSI

SEQ ID NO: 3377952 - protein, 29 aa, Plasmodium falciparum
LPNSYPFFLIYYVSFCYRNSINAWNGWPS

SEQ ID NO: 3377953 - protein, 24 aa, Plasmodium falciparum
LPQYNFFYYLKFRPYVRQFLQILS

SEQ ID NO: 3377954 - protein, 17 aa, Plasmodium falciparum
LPSCSPSGCASRNKVTH

SEQ ID NO: 3377955 - protein, 20 aa, Plasmodium falciparum
LPSTWNISVCDYLKQQLNIL

SEQ ID NO: 3377956 - protein, 20 aa, Plasmodium falciparum
LPWKVTWPILKNHMKKAGDV

SEQ ID NO: 3377957 - protein, 29 aa, Plasmodium falciparum
LPYLCVLCKRTGRQLKVWNIRNFQDPICA

SEQ ID NO: 3377958 - protein, 19 aa, Plasmodium falciparum
LQIGRTVMYVYMKRKNWIF

SEQ ID NO: 3377959 - protein, 23 aa, Plasmodium falciparum
LQKYKGIFCNYEYYFDLEVKYNR

SEQ ID NO: 3377960 - protein, 18 aa, Plasmodium falciparum
LQLEIIKYKMIEIINKKL

SEQ ID NO: 3377961 - protein, 17 aa, Plasmodium falciparum
LQLICNRCCNTFDVTST

SEQ ID NO: 3377962 - protein, 21 aa, Plasmodium falciparum
LQNRRLKCIIIESNCNKDFIC

SEQ ID NO: 3377963 - protein, 20 aa, Plasmodium falciparum
LRAIPWVFSWTQNRMHLSVW

SEQ ID NO: 3377964 - protein, 20 aa, Plasmodium falciparum
LRALFEMCFLISPATYNCVQ

SEQ ID NO: 3377965 - protein, 21 aa, Plasmodium falciparum
LRECKHVIKLIGVCSLREGEE

SEQ ID NO: 3377966 - protein, 21 aa, Plasmodium falciparum
LRELFEPFGTITSAKVMRDEK

SEQ ID NO: 3377967 - protein, 21 aa, Plasmodium falciparum
LRETPKWFLGWVKTRCFKNSY

SEQ ID NO: 3377968 - protein, 20 aa, Plasmodium falciparum
LRFAKEIFKNGAFDKNGNFK

SEQ ID NO: 3377969 - protein, 20 aa, Plasmodium falciparum
LRFFLPMNGLCLIDYQLHFF

SEQ ID NO: 3377970 - protein, 18 aa, Plasmodium falciparum
LRFLYVIRLLEFFHEKKE

SEQ ID NO: 3377971 - protein, 22 aa, Plasmodium falciparum
LRGKDIYKILGLHINDCNNENA

SEQ ID NO: 3377972 - protein, 19 aa, Plasmodium falciparum
LRIPRIPDILLEKKDNNQT

SEQ ID NO: 3377973 - protein, 21 aa, Plasmodium falciparum
LRKEKGICLNVKRVYSLYDLY

SEQ ID NO: 3377974 - protein, 30 aa, Plasmodium falciparum
LRKTSICKYWIKGICANVECNFAHGEHELK

SEQ ID NO: 3377975 - protein, 20 aa, Plasmodium falciparum
LRLKFTLPYDLFCNIDKVHL

SEQ ID NO: 3377976 - protein, 17 aa, Plasmodium falciparum
LRLLYQFLVVEYQNKSA

SEQ ID NO: 3377977 - protein, 18 aa, Plasmodium falciparum
LRLNLFCFSFLKSSKNII

SEQ ID NO: 3377978 - protein, 17 aa, Plasmodium falciparum
LRLPFPASFRGLKDEQL

SEQ ID NO: 3377979 - protein, 17 aa, Plasmodium falciparum
LRLVERWNRVAQESKLL

SEQ ID NO: 3377980 - protein, 18 aa, Plasmodium falciparum
LRNHFCLIDEDIESLKNK

SEQ ID NO: 3377981 - protein, 17 aa, Plasmodium falciparum
LRNSFFLSFAEYIYESI

SEQ ID NO: 3377982 - protein, 18 aa, Plasmodium falciparum
LRQCCSHPLLLFSKPFFE

SEQ ID NO: 3377983 - protein, 25 aa, Plasmodium falciparum
LRQNLFLCAINFHLNYWAEKVILFY

SEQ ID NO: 3377984 - protein, 17 aa, Plasmodium falciparum
LRRKRFGVVNTDDALES

SEQ ID NO: 3377985 - protein, 18 aa, Plasmodium falciparum
LRTYLGLMGDKINPDDFN

SEQ ID NO: 3377986 - protein, 20 aa, Plasmodium falciparum
LRWAFKIHNFLSISFIYNAL

SEQ ID NO: 3377987 - protein, 18 aa, Plasmodium falciparum
LRYLFKSFRSQVVLKNRI

SEQ ID NO: 3377988 - protein, 17 aa, Plasmodium falciparum
LSAVALLEYYSKKNNIP

SEQ ID NO: 3377989 - protein, 21 aa, Plasmodium falciparum
LSEKFVKNFVSFVLDPLSEQN

SEQ ID NO: 3377990 - protein, 20 aa, Plasmodium falciparum
LSEVWLNHMFVKNININEEC

SEQ ID NO: 3377991 - protein, 20 aa, Plasmodium falciparum
LSFYLKRKVSSFSDYNKESD

SEQ ID NO: 3377992 - protein, 19 aa, Plasmodium falciparum
LSHGFHLTSLIGWSKKKKE

SEQ ID NO: 3377993 - protein, 18 aa, Plasmodium falciparum
LSHSCLKYLSNREKMKIK

SEQ ID NO: 3377994 - protein, 20 aa, Plasmodium falciparum
LSKFLPINFILKMPSTNNEH

SEQ ID NO: 3377995 - protein, 20 aa, Plasmodium falciparum
LSLGCNIFFNEIRKVTIIFV

SEQ ID NO: 3377996 - protein, 24 aa, Plasmodium falciparum
LSLLIWCLFKYNILHNYINKLIPI

SEQ ID NO: 3377997 - protein, 17 aa, Plasmodium falciparum
LSLLLEWFRSYKMADTK

SEQ ID NO: 3377998 - protein, 22 aa, Plasmodium falciparum
LSNKEILEILGMYKNPFLLKNK

SEQ ID NO: 3377999 - protein, 22 aa, Plasmodium falciparum
LSNLFFFCFEFFLKYLCIPGKI

SEQ ID NO: 3378000 - protein, 29 aa, Plasmodium falciparum
LSNVYCFFEIKLTIILLNFFISNNCQWSF

SEQ ID NO: 3378001 - protein, 22 aa, Plasmodium falciparum
LSPLFPEIWFILGCSYMKIQNF

SEQ ID NO: 3378002 - protein, 25 aa, Plasmodium falciparum
LSSIVPWKKADVMISKIYRKKYDQG

SEQ ID NO: 3378003 - protein, 18 aa, Plasmodium falciparum
LSTRAGGIGINLTTADIV

SEQ ID NO: 3378004 - protein, 27 aa, Plasmodium falciparum
LSVEFFFLPSIFWKFSSNPIFLSWPPF

SEQ ID NO: 3378005 - protein, 18 aa, Plasmodium falciparum
LSVFQVLKLLSSIVKMNI

SEQ ID NO: 3378006 - protein, 26 aa, Plasmodium falciparum
LTFEELKELFLFFFPEQVMSIDENII

SEQ ID NO: 3378007 - protein, 17 aa, Plasmodium falciparum
LTFKRKIFLDKFNKHDK

SEQ ID NO: 3378008 - protein, 17 aa, Plasmodium falciparum
LTGFKWIINKAIEYNEQ

SEQ ID NO: 3378009 - protein, 17 aa, Plasmodium falciparum
LTKELKETFSFCGKIKA

SEQ ID NO: 3378010 - protein, 17 aa, Plasmodium falciparum
LTKREFEALCKKLEEYK

SEQ ID NO: 3378011 - protein, 20 aa, Plasmodium falciparum
LTLEICKGLILSGVRNLIII

SEQ ID NO: 3378012 - protein, 22 aa, Plasmodium falciparum
LTPISEIIDFIYSIFNKSTEDT

SEQ ID NO: 3378013 - protein, 21 aa, Plasmodium falciparum
LTYSCIFCFNKDFDIIDISVK

SEQ ID NO: 3378014 - protein, 17 aa, Plasmodium falciparum
LVCSIIIRYVKTRISYD

SEQ ID NO: 3378015 - protein, 18 aa, Plasmodium falciparum
LVEKRCCMIYKEKPNKNT

SEQ ID NO: 3378016 - protein, 22 aa, Plasmodium falciparum
LVYCFLDRINLFFQERSRKVVN

SEQ ID NO: 3378017 - protein, 18 aa, Plasmodium falciparum
LVYGCPRVLYKLKNTGEC

SEQ ID NO: 3378018 - protein, 18 aa, Plasmodium falciparum
LVYLDGWPHIILTSIPGV

SEQ ID NO: 3378019 - protein, 17 aa, Plasmodium falciparum
LWGERLFLKFNFKNTGF

SEQ ID NO: 3378020 - protein, 17 aa, Plasmodium falciparum
LWIKAEKYLCCIYESKN

SEQ ID NO: 3378021 - protein, 17 aa, Plasmodium falciparum
LWLSSFNIGKSIHCKKL

SEQ ID NO: 3378022 - protein, 29 aa, Plasmodium falciparum
LWSKAKWVFNIKDCRVFSELIGYDKDDKE

SEQ ID NO: 3378023 - protein, 19 aa, Plasmodium falciparum
LWSKKWRNLIQQKAIKEEM

SEQ ID NO: 3378024 - protein, 19 aa, Plasmodium falciparum
LWSLLNFLLPKIFSSCVDF

SEQ ID NO: 3378025 - protein, 18 aa, Plasmodium falciparum
LWSLLNFLMPKIFDNSEE

SEQ ID NO: 3378026 - protein, 18 aa, Plasmodium falciparum
LYDKWIMRMFAILKNDKK

SEQ ID NO: 3378027 - protein, 22 aa, Plasmodium falciparum
LYDMAIKYGNCLPVEKLELMRM

SEQ ID NO: 3378028 - protein, 18 aa, Plasmodium falciparum
LYICEFCLSFFKEYSELK

SEQ ID NO: 3378029 - protein, 23 aa, Plasmodium falciparum
LYIECICILRFLFFNCKLVHADF

SEQ ID NO: 3378030 - protein, 24 aa, Plasmodium falciparum
LYKIWKLIPLTLKFKAINSRDVNI

SEQ ID NO: 3378031 - protein, 17 aa, Plasmodium falciparum
LYLDCILHDLRKLYGDL

SEQ ID NO: 3378032 - protein, 23 aa, Plasmodium falciparum
LYSFGLYCDWRRSFITTNINPYY

SEQ ID NO: 3378033 - protein, 18 aa, Plasmodium falciparum
LYYQKLLLCLKYVGDHNS

SEQ ID NO: 3378034 - protein, 21 aa, Plasmodium falciparum
MCCKKCDKKRCIFHYVNGFKL

SEQ ID NO: 3378035 - protein, 17 aa, Plasmodium falciparum
MDELSKENKLQCKEYGK

SEQ ID NO: 3378036 - protein, 19 aa, Plasmodium falciparum
MDYLLNRKIEYEKLDEDQS

SEQ ID NO: 3378037 - protein, 22 aa, Plasmodium falciparum
MECMSCITSAYGKEFLKYAKDV

SEQ ID NO: 3378038 - protein, 17 aa, Plasmodium falciparum
MECYSTWIFYDMNFQKN

SEQ ID NO: 3378039 - protein, 24 aa, Plasmodium falciparum
MESFKHCWKSFFLESDENSYEYTK

SEQ ID NO: 3378040 - protein, 17 aa, Plasmodium falciparum
MFIHDGLEIWKDKSKSG

SEQ ID NO: 3378041 - protein, 17 aa, Plasmodium falciparum
MFLRIQFRSSTKHHMNK

SEQ ID NO: 3378042 - protein, 26 aa, Plasmodium falciparum
MFLRSENKRIFFSFFSYFMPKNDLNF

SEQ ID NO: 3378043 - protein, 22 aa, Plasmodium falciparum
MHFALKLSWLYHSIVEDNSSKY

SEQ ID NO: 3378044 - protein, 24 aa, Plasmodium falciparum
MHLHYMIKFFLKLHKNFFENPLET

SEQ ID NO: 3378045 - protein, 17 aa, Plasmodium falciparum
MHRSPVMPLRIEAFHSL

SEQ ID NO: 3378046 - protein, 23 aa, Plasmodium falciparum
MIKDFKFALVWGRSTKHNPQRVD

SEQ ID NO: 3378047 - protein, 18 aa, Plasmodium falciparum
MIKNPSLMKELMKNTDRA

SEQ ID NO: 3378048 - protein, 21 aa, Plasmodium falciparum
MINKLFSCFTFLIRKKYNDLI

SEQ ID NO: 3378049 - protein, 22 aa, Plasmodium falciparum
MIQFSIVWSTYIFKISNKEIII

SEQ ID NO: 3378050 - protein, 18 aa, Plasmodium falciparum
MIRINGVVQAWRAEWRSP

SEQ ID NO: 3378051 - protein, 22 aa, Plasmodium falciparum
MIYCKRIKFYLKNEREHDYTDF

SEQ ID NO: 3378052 - protein, 17 aa, Plasmodium falciparum
MKIILLTSIEWHNNLTQ

SEQ ID NO: 3378053 - protein, 20 aa, Plasmodium falciparum
MKKYFCRSRYSKLIEVESTS

SEQ ID NO: 3378054 - protein, 21 aa, Plasmodium falciparum
MKLHLRVTVNIYKILPLCDIN

SEQ ID NO: 3378055 - protein, 18 aa, Plasmodium falciparum
MKNGLFLKKNVEVNKNDE

SEQ ID NO: 3378056 - protein, 18 aa, Plasmodium falciparum
MKPPENILFVCKLNPVTE

SEQ ID NO: 3378057 - protein, 19 aa, Plasmodium falciparum
MKRKIIIIQRWFRNRLNII

SEQ ID NO: 3378058 - protein, 20 aa, Plasmodium falciparum
MKRLKKIMCNILKSQSNNYL

SEQ ID NO: 3378059 - protein, 17 aa, Plasmodium falciparum
MKSAIRFMKESNYEDPH

SEQ ID NO: 3378060 - protein, 20 aa, Plasmodium falciparum
MKSLIPLNCNGAIKKSSTNT

SEQ ID NO: 3378061 - protein, 18 aa, Plasmodium falciparum
MKVLKLLIHYANKIRKSD

SEQ ID NO: 3378062 - protein, 17 aa, Plasmodium falciparum
MKWTILSERKIDKLVDI

SEQ ID NO: 3378063 - protein, 17 aa, Plasmodium falciparum
MKYDICVKSKVFIFENM

SEQ ID NO: 3378064 - protein, 20 aa, Plasmodium falciparum
MLAWSYRKTKIIQEILNNSP

SEQ ID NO: 3378065 - protein, 27 aa, Plasmodium falciparum
MLEAFIQGRLCLSCDSLDHPMPLCPNN

SEQ ID NO: 3378066 - protein, 22 aa, Plasmodium falciparum
MLEQRIGWMYGYYREDNHYNLG

SEQ ID NO: 3378067 - protein, 17 aa, Plasmodium falciparum
MLFYLSLHIEFKKQLLE

SEQ ID NO: 3378068 - protein, 18 aa, Plasmodium falciparum
MLLVFKFTYDYKNDNNKY

SEQ ID NO: 3378069 - protein, 17 aa, Plasmodium falciparum
MLNICKFSRIFLFENEH

SEQ ID NO: 3378070 - protein, 17 aa, Plasmodium falciparum
MMNDFYNYFPFNYYYYN

SEQ ID NO: 3378071 - protein, 19 aa, Plasmodium falciparum
MMNLPSPFQHYIITFDESD

SEQ ID NO: 3378072 - protein, 18 aa, Plasmodium falciparum
MNCYFLKFISNYLKYVNM

SEQ ID NO: 3378073 - protein, 35 aa, Plasmodium falciparum
MNEDVKWISFHGCYDFAYLLKILTCSALPHNEAAF

SEQ ID NO: 3378074 - protein, 19 aa, Plasmodium falciparum
MNRSLELNGKMIYSGNNSF

SEQ ID NO: 3378075 - protein, 20 aa, Plasmodium falciparum
MNVGLVFRKYIPILINLSCN

SEQ ID NO: 3378076 - protein, 20 aa, Plasmodium falciparum
MPIEILHFFDYYINRKNELD

SEQ ID NO: 3378077 - protein, 18 aa, Plasmodium falciparum
MPIILILHLKRFNNTNRW

SEQ ID NO: 3378078 - protein, 24 aa, Plasmodium falciparum
MPKFYKTRMCYTFLSGSYCEASKC

SEQ ID NO: 3378079 - protein, 21 aa, Plasmodium falciparum
MQCLSVFFKLIYTLHNYVTVK

SEQ ID NO: 3378080 - protein, 17 aa, Plasmodium falciparum
MQEMWKLSFQKNLNTNQ

SEQ ID NO: 3378081 - protein, 26 aa, Plasmodium falciparum
MQYCSIPGFNSVLFSQRVIELYRKEE

SEQ ID NO: 3378082 - protein, 18 aa, Plasmodium falciparum
MRINLCRDAILFILHDLE

SEQ ID NO: 3378083 - protein, 17 aa, Plasmodium falciparum
MRLKEWYGWHFPELGKV

SEQ ID NO: 3378084 - protein, 22 aa, Plasmodium falciparum
MRREFTYWYPFDVRISGKDLIF

SEQ ID NO: 3378085 - protein, 24 aa, Plasmodium falciparum
MTPKESFRYISWIFHGKKQGKNKL

SEQ ID NO: 3378086 - protein, 19 aa, Plasmodium falciparum
MTQWYKRIGIITPYATEKF

SEQ ID NO: 3378087 - protein, 19 aa, Plasmodium falciparum
MVTVETFASLKSFEREMNL

SEQ ID NO: 3378088 - protein, 17 aa, Plasmodium falciparum
MWSEFEWENKINIHTSI

SEQ ID NO: 3378089 - protein, 18 aa, Plasmodium falciparum
MYEPPIIVFVNQKKVADI

SEQ ID NO: 3378090 - protein, 17 aa, Plasmodium falciparum
MYQMIAIGGDAELEIID

SEQ ID NO: 3378091 - protein, 17 aa, Plasmodium falciparum
MYWCKKILNWSGNSKTA

SEQ ID NO: 3378092 - protein, 22 aa, Plasmodium falciparum
NAKAGLWSSFAIREKTSFSSYN

SEQ ID NO: 3378093 - protein, 24 aa, Plasmodium falciparum
NAKLFRLLFQFFFPHISYYFDTNI

SEQ ID NO: 3378094 - protein, 20 aa, Plasmodium falciparum
NCFHRCLYVFICIHCGDQAK

SEQ ID NO: 3378095 - protein, 20 aa, Plasmodium falciparum
NCIYPLLGNNIYKWSFLGTD

SEQ ID NO: 3378096 - protein, 19 aa, Plasmodium falciparum
NCLKGLKFLNLSSCNINND

SEQ ID NO: 3378097 - protein, 30 aa, Plasmodium falciparum
NCLYAYKIQICKRVEMFNFFGGKNDGLDKD

SEQ ID NO: 3378098 - protein, 18 aa, Plasmodium falciparum
NCVFRVILSYGFKSMHNV

SEQ ID NO: 3378099 - protein, 22 aa, Plasmodium falciparum
NDCFGRRPIHFFKHLNKHKVDV

SEQ ID NO: 3378100 - protein, 18 aa, Plasmodium falciparum
NDICNIIKFNLTSLKCNR

SEQ ID NO: 3378101 - protein, 17 aa, Plasmodium falciparum
NDIKRIVDSGANDSILN

SEQ ID NO: 3378102 - protein, 20 aa, Plasmodium falciparum
NDIKRNCCFFDFNKIKNDDK

SEQ ID NO: 3378103 - protein, 19 aa, Plasmodium falciparum
NDWKIPPCVSNWKNNKGYN

SEQ ID NO: 3378104 - protein, 17 aa, Plasmodium falciparum
NDYEYFGNLGLQKGLHE

SEQ ID NO: 3378105 - protein, 22 aa, Plasmodium falciparum
NEATCDFILYLLSFFIYKMKAI

SEQ ID NO: 3378106 - protein, 18 aa, Plasmodium falciparum
NEIIKLILCEDSKKKNLR

SEQ ID NO: 3378107 - protein, 22 aa, Plasmodium falciparum
NEIIPRLGFEEMRNEMNKYGVE

SEQ ID NO: 3378108 - protein, 17 aa, Plasmodium falciparum
NEIREWLLLFLLPNFIH

SEQ ID NO: 3378109 - protein, 27 aa, Plasmodium falciparum
NEKFRHNCFYKNFDILNGNKRSDKNFS

SEQ ID NO: 3378110 - protein, 20 aa, Plasmodium falciparum
NELKLKRLLPINPQAHMIIN

SEQ ID NO: 3378111 - protein, 20 aa, Plasmodium falciparum
NELYHYMYALGVFEYAVKIS

SEQ ID NO: 3378112 - protein, 17 aa, Plasmodium falciparum
NESLHLCVSCQKYDHYI

SEQ ID NO: 3378113 - protein, 21 aa, Plasmodium falciparum
NETLFSIFFYLHWDISKNVLY

SEQ ID NO: 3378114 - protein, 22 aa, Plasmodium falciparum
NEVFFFLKLWLSSFNIGKSIHC

SEQ ID NO: 3378115 - protein, 18 aa, Plasmodium falciparum
NEVYDFIIFRGKDIKDVT

SEQ ID NO: 3378116 - protein, 30 aa, Plasmodium falciparum
NEYIFVYRCNICLLLFTCVYTFAEHIISEN

SEQ ID NO: 3378117 - protein, 23 aa, Plasmodium falciparum
NEYKLDLILCLNFPPYEKKNPNY

SEQ ID NO: 3378118 - protein, 20 aa, Plasmodium falciparum
NEYYWSIKMKYVYNNDEINP

SEQ ID NO: 3378119 - protein, 19 aa, Plasmodium falciparum
NFCYELCSKKRHCFSELKN

SEQ ID NO: 3378120 - protein, 20 aa, Plasmodium falciparum
NFFIKDCIVTFIFVDKDVYK

SEQ ID NO: 3378121 - protein, 20 aa, Plasmodium falciparum
NFFPRISLITTKYITFFNHF

SEQ ID NO: 3378122 - protein, 18 aa, Plasmodium falciparum
NFGSIYFFGSSIIRLTKK

SEQ ID NO: 3378123 - protein, 18 aa, Plasmodium falciparum
NFISAGKICICITSDEDI

SEQ ID NO: 3378124 - protein, 17 aa, Plasmodium falciparum
NFLTCIEKGTTFLISHI

SEQ ID NO: 3378125 - protein, 24 aa, Plasmodium falciparum
NFNKNLFYGFGYNKCEYIPIIYDY

SEQ ID NO: 3378126 - protein, 20 aa, Plasmodium falciparum
NFTKEELLHFTIEERKILIP

SEQ ID NO: 3378127 - protein, 27 aa, Plasmodium falciparum
NHIFCVKKSGPFCGFLITIDVEIRKGE

SEQ ID NO: 3378128 - protein, 20 aa, Plasmodium falciparum
NHNIKVVFVFDGEELPEKKK

SEQ ID NO: 3378129 - protein, 19 aa, Plasmodium falciparum
NICKYKYYISNYVISFYYN

SEQ ID NO: 3378130 - protein, 20 aa, Plasmodium falciparum
NIEKCFQCTLLVQKKDKSHE

SEQ ID NO: 3378131 - protein, 18 aa, Plasmodium falciparum
NIFFMKGLIHFSFQVIYT

SEQ ID NO: 3378132 - protein, 21 aa, Plasmodium falciparum
NIFHHKWLLKKCNCRGIASYK

SEQ ID NO: 3378133 - protein, 20 aa, Plasmodium falciparum
NIFLMRCLKFLKSMKNILQL

SEQ ID NO: 3378134 - protein, 17 aa, Plasmodium falciparum
NIFNMWNCWAIYNSVFV

SEQ ID NO: 3378135 - protein, 24 aa, Plasmodium falciparum
NIFRCGYDMYSRPILYVKIQEKLD

SEQ ID NO: 3378136 - protein, 17 aa, Plasmodium falciparum
NIFSYDCAYHIFNECEK

SEQ ID NO: 3378137 - protein, 18 aa, Plasmodium falciparum
NIHLCDFGDAEECEDGIV

SEQ ID NO: 3378138 - protein, 20 aa, Plasmodium falciparum
NIHRCICICLGVKKEDTDNY

SEQ ID NO: 3378139 - protein, 17 aa, Plasmodium falciparum
NIIFINFLRLCQLNNMN

SEQ ID NO: 3378140 - protein, 23 aa, Plasmodium falciparum
NIIKCPICQGILKYGILNKKMEL

SEQ ID NO: 3378141 - protein, 18 aa, Plasmodium falciparum
NIITCILKLISISHIFTR

SEQ ID NO: 3378142 - protein, 19 aa, Plasmodium falciparum
NILEELLEILGLYISNVPC

SEQ ID NO: 3378143 - protein, 19 aa, Plasmodium falciparum
NILISSVFGRIKWLKIMNE

SEQ ID NO: 3378144 - protein, 28 aa, Plasmodium falciparum
NINCWKEVMWRLGIPELHYYNSVRNDFF

SEQ ID NO: 3378145 - protein, 22 aa, Plasmodium falciparum
NIPEMWKKIFLHSQGNNNSTSM

SEQ ID NO: 3378146 - protein, 18 aa, Plasmodium falciparum
NIPLRFSKYYLKEKKKKK

SEQ ID NO: 3378147 - protein, 23 aa, Plasmodium falciparum
NITFRLDNQMIFKKIAETLNIDE

SEQ ID NO: 3378148 - protein, 18 aa, Plasmodium falciparum
NIYFNFFYIYGINVKALY

SEQ ID NO: 3378149 - protein, 21 aa, Plasmodium falciparum
NIYFPNCNIFNNFNKQENDIK

SEQ ID NO: 3378150 - protein, 25 aa, Plasmodium falciparum
NIYNPLKWHLCISDFGCSAMEYATY

SEQ ID NO: 3378151 - protein, 26 aa, Plasmodium falciparum
NIYPKKSCPFGFICKYKHFFNKVKKH

SEQ ID NO: 3378152 - protein, 20 aa, Plasmodium falciparum
NKCFYFKNSLYFYGGSGYNP

SEQ ID NO: 3378153 - protein, 21 aa, Plasmodium falciparum
NKEIYNAIDIFSSVNDINLPS

SEQ ID NO: 3378154 - protein, 29 aa, Plasmodium falciparum
NKEKELIFCFSFIKYYSWIKALQILNIPI

SEQ ID NO: 3378155 - protein, 22 aa, Plasmodium falciparum
NKELRNAHNLSIINYDNNNNNN

SEQ ID NO: 3378156 - protein, 19 aa, Plasmodium falciparum
NKFKTCIQIGGSDQWGNIQ

SEQ ID NO: 3378157 - protein, 18 aa, Plasmodium falciparum
NKGKRQLIEYSNSIHDDK

SEQ ID NO: 3378158 - protein, 18 aa, Plasmodium falciparum
NKICTRNAFDIHIIEHLE

SEQ ID NO: 3378159 - protein, 17 aa, Plasmodium falciparum
NKIKIVPIIKCSNYKIK

SEQ ID NO: 3378160 - protein, 17 aa, Plasmodium falciparum
NKIKYIYDKYCYKKEAK

SEQ ID NO: 3378161 - protein, 18 aa, Plasmodium falciparum
NKKICKIKNIYSENKNNQ

SEQ ID NO: 3378162 - protein, 21 aa, Plasmodium falciparum
NKKKRSCFFMLNEKEKCTLKR

SEQ ID NO: 3378163 - protein, 24 aa, Plasmodium falciparum
NKKLKSYMFNGGRYAFAAKLKEEI

SEQ ID NO: 3378164 - protein, 23 aa, Plasmodium falciparum
NKKLRRDSCRLIFDPFGYNNTWK

SEQ ID NO: 3378165 - protein, 18 aa, Plasmodium falciparum
NKLFLEWDDLSVISKLRI

SEQ ID NO: 3378166 - protein, 21 aa, Plasmodium falciparum
NKLPVVLFCFSRIKCETYAKC

SEQ ID NO: 3378167 - protein, 17 aa, Plasmodium falciparum
NKNRINVALSRAKSQII

SEQ ID NO: 3378168 - protein, 18 aa, Plasmodium falciparum
NKRIFKKDMENIMRKDNM

SEQ ID NO: 3378169 - protein, 25 aa, Plasmodium falciparum
NKSSFSMLYLFGKVKFYISIIDIIH

SEQ ID NO: 3378170 - protein, 21 aa, Plasmodium falciparum
NKYICRYIGIHSGMTLYNIHR

SEQ ID NO: 3378171 - protein, 18 aa, Plasmodium falciparum
NKYLFLFRVFQAEILMFF

SEQ ID NO: 3378172 - protein, 18 aa, Plasmodium falciparum
NLCVAKCKSIENNKNKEN

SEQ ID NO: 3378173 - protein, 19 aa, Plasmodium falciparum
NLFLHKDHELMLLLINTIQ

SEQ ID NO: 3378174 - protein, 23 aa, Plasmodium falciparum
NLFNFRYKRNITIAYDYVESLIG

SEQ ID NO: 3378175 - protein, 22 aa, Plasmodium falciparum
NLFPCCICSIRLHFSFISFDIL

SEQ ID NO: 3378176 - protein, 22 aa, Plasmodium falciparum
NLKINLCSSYDNLIIGVENLDI

SEQ ID NO: 3378177 - protein, 21 aa, Plasmodium falciparum
NLKKKCFDDCLLYLKQLYTFI

SEQ ID NO: 3378178 - protein, 24 aa, Plasmodium falciparum
NLKLCNMERKILKRFSKYHINQDI

SEQ ID NO: 3378179 - protein, 20 aa, Plasmodium falciparum
NLLCCFRNSYELTKFISIFF

SEQ ID NO: 3378180 - protein, 19 aa, Plasmodium falciparum
NLLREFMRPEILQAGLQIE

SEQ ID NO: 3378181 - protein, 19 aa, Plasmodium falciparum
NLPTEKYPGAVLETVDNNF

SEQ ID NO: 3378182 - protein, 21 aa, Plasmodium falciparum
NLRKILKFHHKLFFENHSKEL

SEQ ID NO: 3378183 - protein, 29 aa, Plasmodium falciparum
NLRRILICGLRCPYPLVLRSNVIVMSMIG

SEQ ID NO: 3378184 - protein, 18 aa, Plasmodium falciparum
NLSFFKYSCMYRKRQLLH

SEQ ID NO: 3378185 - protein, 19 aa, Plasmodium falciparum
NLYDFLLYFSFNFIIQNIQ

SEQ ID NO: 3378186 - protein, 20 aa, Plasmodium falciparum
NLYKCLLCRKLYTEPVTLHC

SEQ ID NO: 3378187 - protein, 23 aa, Plasmodium falciparum
NMILCKIPYYKSKYILKCFQEKL

SEQ ID NO: 3378188 - protein, 25 aa, Plasmodium falciparum
NMLLRSSIKNGPKYSVHYPSSSNNQ

SEQ ID NO: 3378189 - protein, 18 aa, Plasmodium falciparum
NMLPRLLLKINKILDDNN

SEQ ID NO: 3378190 - protein, 17 aa, Plasmodium falciparum
NMSDFYYIPSFYNRYDY

SEQ ID NO: 3378191 - protein, 17 aa, Plasmodium falciparum
NMSKICFNKSNKLNADF

SEQ ID NO: 3378192 - protein, 25 aa, Plasmodium falciparum
NNCGYSVCRSCLLFYILNCVIKENE

SEQ ID NO: 3378193 - protein, 30 aa, Plasmodium falciparum; identical to SEQ ID NO: 3368468

SEQ ID NO: 3378194 - protein, 22 aa, Plasmodium falciparum
NNCLKYIPKYVNAFDTQIQAYE

SEQ ID NO: 3378195 - protein, 20 aa, Plasmodium falciparum
NNCRIPHIFTKHGLIILKKF

SEQ ID NO: 3378196 - protein, 23 aa, Plasmodium falciparum
NNCWKCTKGQYPIHNMTCTKIKK

SEQ ID NO: 3378197 - protein, 23 aa, Plasmodium falciparum
NNDDCFRLGIKILEGDKKIHLYS

SEQ ID NO: 3378198 - protein, 17 aa, Plasmodium falciparum
NNIDRYSYKNGRNGVYY

SEQ ID NO: 3378199 - protein, 17 aa, Plasmodium falciparum
NNKRFHNIISYKNKDNK

SEQ ID NO: 3378200 - protein, 23 aa, Plasmodium falciparum
NNNLCAPTSLLLHNNEKGNTIKN

SEQ ID NO: 3378201 - protein, 24 aa, Plasmodium falciparum
NNRTIEVTFVWLFITKEFNENRKK

SEQ ID NO: 3378202 - protein, 21 aa, Plasmodium falciparum
NNSRPPLYEDLFLKKTKITNI

SEQ ID NO: 3378203 - protein, 23 aa, Plasmodium falciparum
NNYVREVFKQFTLSNDKIGYLSH

SEQ ID NO: 3378204 - protein, 17 aa, Plasmodium falciparum
NPCILEKIMEIFQIDVY

SEQ ID NO: 3378205 - protein, 17 aa, Plasmodium falciparum
NPFAWKKFEKHIPCEFI

SEQ ID NO: 3378206 - protein, 17 aa, Plasmodium falciparum
NPMDKYRAFLCLYLAKK

SEQ ID NO: 3378207 - protein, 26 aa, Plasmodium falciparum
NPRIIILDMFKLCFIGNEKLHKDILF

SEQ ID NO: 3378208 - protein, 23 aa, Plasmodium falciparum
NQIKRVVDALGVYISLSLLEKTI

SEQ ID NO: 3378209 - protein, 19 aa, Plasmodium falciparum
NQYKSCVYFEFVLTNINLD

SEQ ID NO: 3378210 - protein, 18 aa, Plasmodium falciparum
NREGLYLCDVMKNSNELK

SEQ ID NO: 3378211 - protein, 24 aa, Plasmodium falciparum
NRIECSLCGHLLLNQNIDNEQNDY

SEQ ID NO: 3378212 - protein, 17 aa, Plasmodium falciparum
NRISLLPGIYMNGCVTF

SEQ ID NO: 3378213 - protein, 17 aa, Plasmodium falciparum
NRLPDIFIYPSFTNEKS

SEQ ID NO: 3378214 - protein, 20 aa, Plasmodium falciparum
NRLRESIKFEDKKKNNNSNN

SEQ ID NO: 3378215 - protein, 25 aa, Plasmodium falciparum
NRNDMCYYLPGASRHSFSFRDNNLK

SEQ ID NO: 3378216 - protein, 23 aa, Plasmodium falciparum
NRPFEYLRLTSLGVIGALVKVDN

SEQ ID NO: 3378217 - protein, 23 aa, Plasmodium falciparum
NRSKRWTICPSYICCNSALCRFK

SEQ ID NO: 3378218 - protein, 24 aa, Plasmodium falciparum
NRWKCPICSFYLRPKNLVIDTFIT

SEQ ID NO: 3378219 - protein, 18 aa, Plasmodium falciparum
NSCLPRFVELHNYSKANS

SEQ ID NO: 3378220 - protein, 17 aa, Plasmodium falciparum
NSDHRFSHDISNEKGEN

SEQ ID NO: 3378221 - protein, 28 aa, Plasmodium falciparum
NSHDLLWVPRCCNGSYGTFLKYNYSNMN

SEQ ID NO: 3378222 - protein, 18 aa, Plasmodium falciparum
NSLCSFNSSSKCVKDEMI

SEQ ID NO: 3378223 - protein, 22 aa, Plasmodium falciparum
NSLKSACKWNLVFLNGQCSSFL

SEQ ID NO: 3378224 - protein, 18 aa, Plasmodium falciparum
NSSLFCPVCNIPFTYKIR

SEQ ID NO: 3378225 - protein, 17 aa, Plasmodium falciparum
NSVIFPYQFEIHTKWEN

SEQ ID NO: 3378226 - protein, 22 aa, Plasmodium falciparum
NSYECVRIWSLNNFECLKSIQS

SEQ ID NO: 3378227 - protein, 18 aa, Plasmodium falciparum
NSYFRFYLLNGLSISIHH

SEQ ID NO: 3378228 - protein, 25 aa, Plasmodium falciparum
NTCLYDLFCGIGFYSIPLANLFDHV

SEQ ID NO: 3378229 - protein, 21 aa, Plasmodium falciparum
NTCTIPEWWNLELYFGDSENK

SEQ ID NO: 3378230 - protein, 17 aa, Plasmodium falciparum
NTIYICPMKDYFKNKYK

SEQ ID NO: 3378231 - protein, 17 aa, Plasmodium falciparum
NTIYPLLKWKINHINDS

SEQ ID NO: 3378232 - protein, 17 aa, Plasmodium falciparum
NTKLLLIKKRRSLNNMK

SEQ ID NO: 3378233 - protein, 17 aa, Plasmodium falciparum
NTKRWNIILSLKRDNCL

SEQ ID NO: 3378234 - protein, 20 aa, Plasmodium falciparum
NTLFKILFIPTQVKPHKYYF

SEQ ID NO: 3378235 - protein, 20 aa, Plasmodium falciparum
NTNKLFTCKELFPKNKEYFI

SEQ ID NO: 3378236 - protein, 17 aa, Plasmodium falciparum
NTRIIKICERLMLHKSM

SEQ ID NO: 3378237 - protein, 25 aa, Plasmodium falciparum
NVCGLLCIKSPWPGMLRTVYGNHQR

SEQ ID NO: 3378238 - protein, 21 aa, Plasmodium falciparum
NVDIHWQLKWMNGVDNNVYGP

SEQ ID NO: 3378239 - protein, 25 aa, Plasmodium falciparum
NVEILPLKVLFDFIVSSSLPDDIVY

SEQ ID NO: 3378240 - protein, 17 aa, Plasmodium falciparum
NVFEFWDWVGGRFSVTS

SEQ ID NO: 3378241 - protein, 17 aa, Plasmodium falciparum
NVFGDYIQRCILPTDLP

SEQ ID NO: 3378242 - protein, 18 aa, Plasmodium falciparum
NVIAKFRQSFLITCKKKF

SEQ ID NO: 3378243 - protein, 17 aa, Plasmodium falciparum
NVKIYFLKKLDDIDYFN

SEQ ID NO: 3378244 - protein, 23 aa, Plasmodium falciparum
NVKNIFKYKGYIIHLIQQSNVFC

SEQ ID NO: 3378245 - protein, 18 aa, Plasmodium falciparum
NVLIHSFECEFCNYKNNV

SEQ ID NO: 3378246 - protein, 20 aa, Plasmodium falciparum
NVNFSFRFPTFIAILQFCSQ

SEQ ID NO: 3378247 - protein, 23 aa, Plasmodium falciparum
NVNIFKLLALFGWSYKSPQDDEH

SEQ ID NO: 3378248 - protein, 23 aa, Plasmodium falciparum
NVQKYGYFSWLWKYFQPKKTEVK

SEQ ID NO: 3378249 - protein, 20 aa, Plasmodium falciparum
NVSGATWIYAPPELLTCHPL

SEQ ID NO: 3378250 - protein, 23 aa, Plasmodium falciparum
NVYLKYSYCKSLENCNTYTKGNN

SEQ ID NO: 3378251 - protein, 17 aa, Plasmodium falciparum
NWEEDWGAAGWDDDDDD

SEQ ID NO: 3378252 - protein, 20 aa, Plasmodium falciparum
NWVYCKFSFLPNGHIFYPKS

SEQ ID NO: 3378253 - protein, 23 aa, Plasmodium falciparum
NYDRINSYWIRRGNIKQRKAPQI

SEQ ID NO: 3378254 - protein, 23 aa, Plasmodium falciparum
NYEIKMFLLNTIKAIGIVFKKWK

SEQ ID NO: 3378255 - protein, 17 aa, Plasmodium falciparum
NYFEWIDILYLLKMWNI

SEQ ID NO: 3378256 - protein, 24 aa, Plasmodium falciparum
NYFKITFYCLCGYLQYIKDDSDWK

SEQ ID NO: 3378257 - protein, 18 aa, Plasmodium falciparum
NYFNCIFYNVGFLDINVD

SEQ ID NO: 3378258 - protein, 17 aa, Plasmodium falciparum
NYHLFYSTDLCWSNNGK

SEQ ID NO: 3378259 - protein, 18 aa, Plasmodium falciparum
NYIFFFKKICKLFSTCYV

SEQ ID NO: 3378260 - protein, 20 aa, Plasmodium falciparum
NYIKERKKYIFLYNNNENNY

SEQ ID NO: 3378261 - protein, 31 aa, Plasmodium falciparum
NYILYCMFYEFAEDIIRIKLCKEKSNQKNSY

SEQ ID NO: 3378262 - protein, 24 aa, Plasmodium falciparum
NYISIKCPLDLIPLYILPPYQDLQ

SEQ ID NO: 3378263 - protein, 26 aa, Plasmodium falciparum
NYKEFLRRYLLCFFCCTDLNNCVSLL

SEQ ID NO: 3378264 - protein, 23 aa, Plasmodium falciparum
NYKIVIMLMEYCERGNLLNIFQK

SEQ ID NO: 3378265 - protein, 19 aa, Plasmodium falciparum
NYKYFSYVCSRYYRAPELL

SEQ ID NO: 3378266 - protein, 25 aa, Plasmodium falciparum
NYLEKHFPFIKGYRNKYEITDDLFM

SEQ ID NO: 3378267 - protein, 23 aa, Plasmodium falciparum
NYQSKGGAMAIILIGTDTTYGPV

SEQ ID NO: 3378268 - protein, 17 aa, Plasmodium falciparum
NYYKLPWVHRGISKYLL

SEQ ID NO: 3378269 - protein, 17 aa, Plasmodium falciparum
PASKWEIYKPLKTYTTS

SEQ ID NO: 3378270 - protein, 18 aa, Plasmodium falciparum
PCIMCVYALKLIGIKNIY

SEQ ID NO: 3378271 - protein, 19 aa, Plasmodium falciparum
PCPWLDFKHTVFGKVTQGS

SEQ ID NO: 3378272 - protein, 25 aa, Plasmodium falciparum
PCTHNFHKQCILKWISKNTTCPLCK

SEQ ID NO: 3378273 - protein, 18 aa, Plasmodium falciparum
PCVLDFLKHRYLKNQIYT

SEQ ID NO: 3378274 - protein, 24 aa, Plasmodium falciparum
PDKWKEDMFRFFNIPLRSSISVRD

SEQ ID NO: 3378275 - protein, 24 aa, Plasmodium falciparum
PDYSSDLNLFFSLYDNIHIERKKY

SEQ ID NO: 3378276 - protein, 19 aa, Plasmodium falciparum
PEAFGVVFMLYIPVEINKN

SEQ ID NO: 3378277 - protein, 21 aa, Plasmodium falciparum
PEEELVEFIFLLLKERNEYNN

SEQ ID NO: 3378278 - protein, 19 aa, Plasmodium falciparum
PEFLKPIICRSACSSNFLG

SEQ ID NO: 3378279 - protein, 19 aa, Plasmodium falciparum
PEIYARCCVIDFTVTVKGL

SEQ ID NO: 3378280 - protein, 17 aa, Plasmodium falciparum
PELFAGLVYRYKPTSNL

SEQ ID NO: 3378281 - protein, 20 aa, Plasmodium falciparum
PFIPNLIKWINVLKLSIKGK

SEQ ID NO: 3378282 - protein, 23 aa, Plasmodium falciparum
PFSFFRRHDCWNNEYNCLHQQER

SEQ ID NO: 3378283 - protein, 19 aa, Plasmodium falciparum
PFTYKIRINPCYHIICKTC

SEQ ID NO: 3378284 - protein, 17 aa, Plasmodium falciparum
PGCLSLKSAGSCISSTS

SEQ ID NO: 3378285 - protein, 23 aa, Plasmodium falciparum
PGEEIFADFGFEWFEKVNDICLN

SEQ ID NO: 3378286 - protein, 19 aa, Plasmodium falciparum
PGESIGILVAQSFGEPATQ

SEQ ID NO: 3378287 - protein, 19 aa, Plasmodium falciparum
PGQEFLPFLFLRLATQIDY

SEQ ID NO: 3378288 - protein, 20 aa, Plasmodium falciparum
PHNGCLWIGYQYQYLNHFIS

SEQ ID NO: 3378289 - protein, 21 aa, Plasmodium falciparum
PHYHCPLCVNMYFYHYNMLTE

SEQ ID NO: 3378290 - protein, 17 aa, Plasmodium falciparum
PIFLKLLKIDIYNTCYT

SEQ ID NO: 3378291 - protein, 18 aa, Plasmodium falciparum
PIICRSACSSNFLGASTL

SEQ ID NO: 3378292 - protein, 18 aa, Plasmodium falciparum
PIIWEYINQLPFDKESWI

SEQ ID NO: 3378293 - protein, 20 aa, Plasmodium falciparum
PKAYCLCAATWEQISIEGLF

SEQ ID NO: 3378294 - protein, 23 aa, Plasmodium falciparum
PKCLEFFKSFILPFYGNKFGVYF

SEQ ID NO: 3378295 - protein, 20 aa, Plasmodium falciparum
PKEYCIEAFLQLIYSTGFFI

SEQ ID NO: 3378296 - protein, 18 aa, Plasmodium falciparum
PKFLSPLLYCPRCCETYY

SEQ ID NO: 3378297 - protein, 24 aa, Plasmodium falciparum
PKGIRLPCKLKWTVDNNSMVSSNQ

SEQ ID NO: 3378298 - protein, 19 aa, Plasmodium falciparum
PKILILCPFRYNAKEYVDL

SEQ ID NO: 3378299 - protein, 17 aa, Plasmodium falciparum
PKKGIIFSFNLVNIYIY

SEQ ID NO: 3378300 - protein, 18 aa, Plasmodium falciparum
PKLCHNFLYLCEYKYYNK

SEQ ID NO: 3378301 - protein, 19 aa, Plasmodium falciparum
PLCICCFDILLNLIGINTI

SEQ ID NO: 3378302 - protein, 22 aa, Plasmodium falciparum
PLHLCLILSAFARLDIREGNIL

SEQ ID NO: 3378303 - protein, 18 aa, Plasmodium falciparum
PLILCILDKFIIKQKKKE

SEQ ID NO: 3378304 - protein, 22 aa, Plasmodium falciparum
PLKKLKFLWSYKNKEHEDNNKY

SEQ ID NO: 3378305 - protein, 21 aa, Plasmodium falciparum
PLKWHYAALCSITMLNDFNYK

SEQ ID NO: 3378306 - protein, 18 aa, Plasmodium falciparum
PLQFRNGAEWSKKNDQKK

SEQ ID NO: 3378307 - protein, 20 aa, Plasmodium falciparum
PLTPWPCLSFDYILEHPKHD

SEQ ID NO: 3378308 - protein, 20 aa, Plasmodium falciparum
PLVFCIGGFDGVEYLNSMEL

SEQ ID NO: 3378309 - protein, 20 aa, Plasmodium falciparum
PLYLRFLPSYNIGSMTDIKN

SEQ ID NO: 3378310 - protein, 21 aa, Plasmodium falciparum
PNAKGRFSLINKMASMPNMST

SEQ ID NO: 3378311 - protein, 18 aa, Plasmodium falciparum
PNCHCRYPRFCVNDNKIA

SEQ ID NO: 3378312 - protein, 17 aa, Plasmodium falciparum
PNCNIILNDKIIKLDKN

SEQ ID NO: 3378313 - protein, 20 aa, Plasmodium falciparum
PNFKCPNCNIILNDKIIKLD

SEQ ID NO: 3378314 - protein, 18 aa, Plasmodium falciparum
PNHGCTIISLIIFRNKMF

SEQ ID NO: 3378315 - protein, 17 aa, Plasmodium falciparum
PNLISLKNFKLIFKNYK

SEQ ID NO: 3378316 - protein, 18 aa, Plasmodium falciparum
PNLQRLPLRFPVIEKRKA

SEQ ID NO: 3378317 - protein, 19 aa, Plasmodium falciparum
PNREFCNFLNFIIQNKINI

SEQ ID NO: 3378318 - protein, 20 aa, Plasmodium falciparum
PPKREIYIFVGMSKLQKKLY

SEQ ID NO: 3378319 - protein, 20 aa, Plasmodium falciparum
PPYECTNCNILLKEITTRNY

SEQ ID NO: 3378320 - protein, 19 aa, Plasmodium falciparum
PPYMHHFNKAMKIIPEGSS

SEQ ID NO: 3378321 - protein, 17 aa, Plasmodium falciparum
PQFLKTWLKIMAHGTQE

SEQ ID NO: 3378322 - protein, 18 aa, Plasmodium falciparum
PQRAGGLLNTFYESFIYG

SEQ ID NO: 3378323 - protein, 17 aa, Plasmodium falciparum
PRARYFLTFCKNEKCNT

SEQ ID NO: 3378324 - protein, 19 aa, Plasmodium falciparum
PRFPTIKGILRRGLTKEAL

SEQ ID NO: 3378325 - protein, 20 aa, Plasmodium falciparum
PRLNSLYGMLYYQSIGLLKD

SEQ ID NO: 3378326 - protein, 19 aa, Plasmodium falciparum
PRMKYGLCGSHTSIDNMKN

SEQ ID NO: 3378327 - protein, 18 aa, Plasmodium falciparum
PRSFKLSTDYILNTDDST

SEQ ID NO: 3378328 - protein, 27 aa, Plasmodium falciparum
PRWGDYKCNFFFHWKKIMELNNEELKI

SEQ ID NO: 3378329 - protein, 18 aa, Plasmodium falciparum
PSEGYLLIYPHISHNSIA

SEQ ID NO: 3378330 - protein, 17 aa, Plasmodium falciparum
PSLPKGLPKEVIKLIEN

SEQ ID NO: 3378331 - protein, 18 aa, Plasmodium falciparum
PSNCLKEDFELFRTNEND

SEQ ID NO: 3378332 - protein, 20 aa, Plasmodium falciparum
PSPRSGHRMILWKNYIVMFG

SEQ ID NO: 3378333 - protein, 18 aa, Plasmodium falciparum
PSTSRCYFALSLQSYRHD

SEQ ID NO: 3378334 - protein, 17 aa, Plasmodium falciparum
PTFKIKRFHVFRDYAFF

SEQ ID NO: 3378335 - protein, 17 aa, Plasmodium falciparum
PTFRLPQNFNFQKFPYV

SEQ ID NO: 3378336 - protein, 20 aa, Plasmodium falciparum
PTIPCLNMFISCMNYNYGKI

SEQ ID NO: 3378337 - protein, 18 aa, Plasmodium falciparum
PTRVNILKAVNWLVRDSI

SEQ ID NO: 3378338 - protein, 25 aa, Plasmodium falciparum
PVKCLREGLRFVPLCDKYLKDIKGS

SEQ ID NO: 3378339 - protein, 17 aa, Plasmodium falciparum
PWFENFKLRIIFIKEWI

SEQ ID NO: 3378340 - protein, 17 aa, Plasmodium falciparum
PYAIYNCYKNIMNNYHY

SEQ ID NO: 3378341 - protein, 18 aa, Plasmodium falciparum
PYIYELIQLPDYVTHNEL

SEQ ID NO: 3378342 - protein, 20 aa, Plasmodium falciparum
PYNFLSCSLPTPPPQLPHTG

SEQ ID NO: 3378343 - protein, 24 aa, Plasmodium falciparum
PYNNICILCYEFLASCAIEVVNRF

SEQ ID NO: 3378344 - protein, 27 aa, Plasmodium falciparum
PYVAIDTEFPGIVARPTGNVLDYNYQT

SEQ ID NO: 3378345 - protein, 17 aa, Plasmodium falciparum
QAGCIYLLFLLYFSQHV

SEQ ID NO: 3378346 - protein, 24 aa, Plasmodium falciparum
QAQAKYLAIYARIQAVNCLQRKPH

SEQ ID NO: 3378347 - protein, 18 aa, Plasmodium falciparum
QCELCKKWRKLDAHINIS

SEQ ID NO: 3378348 - protein, 17 aa, Plasmodium falciparum
QCFKNYIEYNILPYYFL

SEQ ID NO: 3378349 - protein, 18 aa, Plasmodium falciparum
QCLRLAKGLCEFGLDRCQ

SEQ ID NO: 3378350 - protein, 18 aa, Plasmodium falciparum
QCTKEILIIVSMLSSPSI

SEQ ID NO: 3378351 - protein, 17 aa, Plasmodium falciparum
QDIFWCYSLNNGKWTQI

SEQ ID NO: 3378352 - protein, 17 aa, Plasmodium falciparum
QDILFFWVARMVMVSLH

SEQ ID NO: 3378353 - protein, 18 aa, Plasmodium falciparum
QDILWSKKWRNLIQQKAI

SEQ ID NO: 3378354 - protein, 24 aa, Plasmodium falciparum
QDKTYVCPMWNYFKDYKIEKIYKK

SEQ ID NO: 3378355 - protein, 27 aa, Plasmodium falciparum
QDNFEFLQWFKSFFERIVDYNNEQVIN

SEQ ID NO: 3378356 - protein, 24 aa, Plasmodium falciparum
QEFNCCICKIYLSYQPILFPCCFV

SEQ ID NO: 3378357 - protein, 20 aa, Plasmodium falciparum
QEIPFIFNMDIIFQTEHNIL

SEQ ID NO: 3378358 - protein, 21 aa, Plasmodium falciparum
QEKKLRFVDKIIKMKKEKQNV

SEQ ID NO: 3378359 - protein, 19 aa, Plasmodium falciparum
QELRPNCLLGMLLDTKGPE

SEQ ID NO: 3378360 - protein, 17 aa, Plasmodium falciparum
QEMFLRIQFRSSTKHHM

SEQ ID NO: 3378361 - protein, 17 aa, Plasmodium falciparum
QESLLACQSDWDVKNIL

SEQ ID NO: 3378362 - protein, 18 aa, Plasmodium falciparum
QFNFKFDLDSDMYAQNSI

SEQ ID NO: 3378363 - protein, 26 aa, Plasmodium falciparum
QGIKYWWKNIHSFLGLNSFNNNEDIK

SEQ ID NO: 3378364 - protein, 17 aa, Plasmodium falciparum
QHFWKTKLCPLHMENRC

SEQ ID NO: 3378365 - protein, 17 aa, Plasmodium falciparum
QICNLCIIKRKNLYLKY

SEQ ID NO: 3378366 - protein, 23 aa, Plasmodium falciparum
QIGLKYDNMWGIFRFVIDNLADK

SEQ ID NO: 3378367 - protein, 23 aa, Plasmodium falciparum
QIICNIIPFKLCNNYKIDTNIIH

SEQ ID NO: 3378368 - protein, 18 aa, Plasmodium falciparum
QIKWKVCDNKVFYEYIKK

SEQ ID NO: 3378369 - protein, 17 aa, Plasmodium falciparum
QIYYEYFQRGLIKNDHN

SEQ ID NO: 3378370 - protein, 18 aa, Plasmodium falciparum
QKCFKHFNLYNGNSSSTL

SEQ ID NO: 3378371 - protein, 22 aa, Plasmodium falciparum
QKELKWYINECLRLDKISEYLK

SEQ ID NO: 3378372 - protein, 26 aa, Plasmodium falciparum
QKGSGRLFLNTDIFDGFKIIPSKNLS

SEQ ID NO: 3378373 - protein, 26 aa, Plasmodium falciparum
QKHIALLELIKYVILYSNTNIKKENT

SEQ ID NO: 3378374 - protein, 25 aa, Plasmodium falciparum
QKIACLQCTVTFRCFCSYECFMKGF

SEQ ID NO: 3378375 - protein, 19 aa, Plasmodium falciparum
QKLLLCLKYVGDHNSAINN

SEQ ID NO: 3378376 - protein, 17 aa, Plasmodium falciparum
QKLWKLANMDARQALNL

SEQ ID NO: 3378377 - protein, 21 aa, Plasmodium falciparum
QLEALKFPGLVIYVNKDNIEK

SEQ ID NO: 3378378 - protein, 17 aa, Plasmodium falciparum
QLLKLCSGPGCVTKSQD

SEQ ID NO: 3378379 - protein, 20 aa, Plasmodium falciparum
QLLYGRINWKLAEKKKITKH

SEQ ID NO: 3378380 - protein, 18 aa, Plasmodium falciparum
QNLFAYKSSMCKFVANKR

SEQ ID NO: 3378381 - protein, 25 aa, Plasmodium falciparum
QNLFIRPDIRCCAIFLNFLLFYDKI

SEQ ID NO: 3378382 - protein, 22 aa, Plasmodium falciparum
QNRWLSGICINGRCINRYFPVY

SEQ ID NO: 3378383 - protein, 23 aa, Plasmodium falciparum
QQIPRWFLNLVMKHTASARANRN

SEQ ID NO: 3378384 - protein, 21 aa, Plasmodium falciparum
QQSQCSLIWNGVVKKKNFKNW

SEQ ID NO: 3378385 - protein, 17 aa, Plasmodium falciparum
QRIPFCIGKQKEMFLKF

SEQ ID NO: 3378386 - protein, 21 aa, Plasmodium falciparum
QRLAEDFQYIYLLKYASNEKE

SEQ ID NO: 3378387 - protein, 17 aa, Plasmodium falciparum
QRLPELLQMIGRTDPSF

SEQ ID NO: 3378388 - protein, 20 aa, Plasmodium falciparum
QRLPLRFPVIEKRKAKSTIL

SEQ ID NO: 3378389 - protein, 20 aa, Plasmodium falciparum
QSCPMWHWYYPYYYAPLSSD

SEQ ID NO: 3378390 - protein, 23 aa, Plasmodium falciparum
QSDCLMKAQLLLKEELDKEIQKK

SEQ ID NO: 3378391 - protein, 18 aa, Plasmodium falciparum
QSKGFGFVCFASQEEANK

SEQ ID NO: 3378392 - protein, 17 aa, Plasmodium falciparum
QSVLCKVLFNYIQKTCG

SEQ ID NO: 3378393 - protein, 17 aa, Plasmodium falciparum
QTISLLCYLRFNKNIKK

SEQ ID NO: 3378394 - protein, 17 aa, Plasmodium falciparum
QTKIVLRQSWKEMIKTI

SEQ ID NO: 3378395 - protein, 22 aa, Plasmodium falciparum
QVILCCLRCLYSDLNLLDIHSL

SEQ ID NO: 3378396 - protein, 24 aa, Plasmodium falciparum
QVPDYLCCKISMCLMNEPVITPSG

SEQ ID NO: 3378397 - protein, 21 aa, Plasmodium falciparum
QWICPLCSYLRSQIFFIDDVN

SEQ ID NO: 3378398 - protein, 29 aa, Plasmodium falciparum
QYGYVVEVFFPKTYPKVFVRFDNLQSCIK

SEQ ID NO: 3378399 - protein, 23 aa, Plasmodium falciparum
RAEARGGHDFQFFNVEKLDELEK

SEQ ID NO: 3378400 - protein, 20 aa, Plasmodium falciparum
RALEALKYCLPEPLRHVHKT

SEQ ID NO: 3378401 - protein, 19 aa, Plasmodium falciparum
RALEFLDAIILNIKFDYTE

SEQ ID NO: 3378402 - protein, 27 aa, Plasmodium falciparum
RALTEMNGYIFKGCKIKVSKSNGIKMN

SEQ ID NO: 3378403 - protein, 26 aa, Plasmodium falciparum
RAPPDFFKTKLCKFFNTSGMCPLSDN

SEQ ID NO: 3378404 - protein, 18 aa, Plasmodium falciparum
RASVSAWPEWKGQVIQQA

SEQ ID NO: 3378405 - protein, 18 aa, Plasmodium falciparum
RCCPYKCLNASIRNTPIM

SEQ ID NO: 3378406 - protein, 23 aa, Plasmodium falciparum
RCNKRLKIYIIFELFQNKNIMKY

SEQ ID NO: 3378407 - protein, 19 aa, Plasmodium falciparum
RCPKTYHKLCEGIKDENVK

SEQ ID NO: 3378408 - protein, 17 aa, Plasmodium falciparum
RCVLLIYFIKWNGYNFH

SEQ ID NO: 3378409 - protein, 17 aa, Plasmodium falciparum
RDEFNLIGLQTKVPHFK

SEQ ID NO: 3378410 - protein, 18 aa, Plasmodium falciparum
RDHFKKYFFLLLYRYHIS

SEQ ID NO: 3378411 - protein, 18 aa, Plasmodium falciparum
RDIEICRFLRKYILLKHP

SEQ ID NO: 3378412 - protein, 23 aa, Plasmodium falciparum
RDNKLLCYNKCIRRHKKIKPYER

SEQ ID NO: 3378413 - protein, 18 aa, Plasmodium falciparum
RDSLSLSLPEEVKGENDQ

SEQ ID NO: 3378414 - protein, 20 aa, Plasmodium falciparum
RECFESICICMFDYMCNLNS

SEQ ID NO: 3378415 - protein, 21 aa, Plasmodium falciparum
RECKEKLGLFEWIHDININIT

SEQ ID NO: 3378416 - protein, 18 aa, Plasmodium falciparum
REFEALCKKLEEYKENVD

SEQ ID NO: 3378417 - protein, 18 aa, Plasmodium falciparum
REFLKYCKDLTCIDFSNC

SEQ ID NO: 3378418 - protein, 20 aa, Plasmodium falciparum
REILYLGIYIRKIQKFIEIN

SEQ ID NO: 3378419 - protein, 20 aa, Plasmodium falciparum
REKCNICSKSRYTKILNEHK

SEQ ID NO: 3378420 - protein, 25 aa, Plasmodium falciparum
RELPNLCKTSLCPKLKINELCNDKK

SEQ ID NO: 3378421 - protein, 23 aa, Plasmodium falciparum
REMFKYLDTLRHLPSKKGGSQYK

SEQ ID NO: 3378422 - protein, 17 aa, Plasmodium falciparum
REQELFCSDNLKNDSDD

SEQ ID NO: 3378423 - protein, 21 aa, Plasmodium falciparum
REVNASLKLPATWDNLENFEL

SEQ ID NO: 3378424 - protein, 20 aa, Plasmodium falciparum
RFCPCFKILSYYGNQNERYK

SEQ ID NO: 3378425 - protein, 20 aa, Plasmodium falciparum
RFGYDVAISLSIDFYKNLGG

SEQ ID NO: 3378426 - protein, 18 aa, Plasmodium falciparum
RFMHSLCVKELKSTEEGE

SEQ ID NO: 3378427 - protein, 18 aa, Plasmodium falciparum
RGAFFFKVKLENSLKGQI

SEQ ID NO: 3378428 - protein, 20 aa, Plasmodium falciparum
RGELQLGILIEKLRREGYEM

SEQ ID NO: 3378429 - protein, 22 aa, Plasmodium falciparum
RGGGGGKCYGILKGEGDQFSIK

SEQ ID NO: 3378430 - protein, 17 aa, Plasmodium falciparum
RGIRLYVKRVFINDKFS

SEQ ID NO: 3378431 - protein, 23 aa, Plasmodium falciparum
RGKTTASMGIHFAAIKGNKEITK

SEQ ID NO: 3378432 - protein, 18 aa, Plasmodium falciparum
RGNIISTMFFPRSPYFMV

SEQ ID NO: 3378433 - protein, 25 aa, Plasmodium falciparum
RGSGKALRLCTKFFLDGYCNKSDKC

SEQ ID NO: 3378434 - protein, 18 aa, Plasmodium falciparum
RHANLLYEFERGITKNKK

SEQ ID NO: 3378435 - protein, 18 aa, Plasmodium falciparum
RHIETYKTVFLCYPCVYR

SEQ ID NO: 3378436 - protein, 35 aa, Plasmodium falciparum
RHVFHCSCIIPWLKERNSCPTCRFELPTDDQEYNC

SEQ ID NO: 3378437 - protein, 19 aa, Plasmodium falciparum
RIDIFNMILMRDMLSNLDE

SEQ ID NO: 3378438 - protein, 20 aa, Plasmodium falciparum
RIGICKIIPMIIEKSIKEGQ

SEQ ID NO: 3378439 - protein, 19 aa, Plasmodium falciparum
RIIGFLSASGKIYCWHLNE

SEQ ID NO: 3378440 - protein, 17 aa, Plasmodium falciparum
RIINIPLSVPMELLQSV

SEQ ID NO: 3378441 - protein, 25 aa, Plasmodium falciparum
RIKINMCENPCDIWYGLKKRNGKNI

SEQ ID NO: 3378442 - protein, 17 aa, Plasmodium falciparum
RIKKGDVGTTTWTKSTT

SEQ ID NO: 3378443 - protein, 39 aa, Plasmodium falciparum
RILFYKTKICPWYIKGKCERRKTCLYAHAQNELRELPNL

SEQ ID NO: 3378444 - protein, 17 aa, Plasmodium falciparum
RILPLLFNIKGRADEYE

SEQ ID NO: 3378445 - protein, 20 aa, Plasmodium falciparum
RINNFLQYRIPHMNNNGNIQ

SEQ ID NO: 3378446 - protein, 18 aa, Plasmodium falciparum
RIPKTVWHYWEAVAEESL

SEQ ID NO: 3378447 - protein, 17 aa, Plasmodium falciparum
RIVLDIITRLFSRYVNT

SEQ ID NO: 3378448 - protein, 18 aa, Plasmodium falciparum
RIVLSFDIDRIFYFYDKK

SEQ ID NO: 3378449 - protein, 20 aa, Plasmodium falciparum
RIYDLRMGKLMSYDMKSSIL

SEQ ID NO: 3378450 - protein, 19 aa, Plasmodium falciparum
RKAESFVIIISSEFIYNTN

SEQ ID NO: 3378451 - protein, 20 aa, Plasmodium falciparum
RKAYIVKRVPVNKNISFNLA

SEQ ID NO: 3378452 - protein, 18 aa, Plasmodium falciparum
RKDMHMMHQELLYFILKF

SEQ ID NO: 3378453 - protein, 17 aa, Plasmodium falciparum
RKFLKIFIQLFLDKILC

SEQ ID NO: 3378454 - protein, 21 aa, Plasmodium falciparum
RKHMKCGYPPYIFAKNTYCYR

SEQ ID NO: 3378455 - protein, 17 aa, Plasmodium falciparum
RKIFNYGGGCLNNEEGA

SEQ ID NO: 3378456 - protein, 21 aa, Plasmodium falciparum
RKINLCNSAYYPHCTYSNPLK

SEQ ID NO: 3378457 - protein, 19 aa, Plasmodium falciparum
RKIVPLPFPSLFYDHDSSL

SEQ ID NO: 3378458 - protein, 18 aa, Plasmodium falciparum
RKKGSKFVHKNITNEHIL

SEQ ID NO: 3378459 - protein, 17 aa, Plasmodium falciparum
RKKLILKKRSVPLDQKS

SEQ ID NO: 3378460 - protein, 17 aa, Plasmodium falciparum
RKKSQTYNKNFEEKFNL

SEQ ID NO: 3378461 - protein, 20 aa, Plasmodium falciparum
RKLFKYKRINILLVTGRLIY

SEQ ID NO: 3378462 - protein, 18 aa, Plasmodium falciparum
RKLIKLINTNFYIDKCIH

SEQ ID NO: 3378463 - protein, 17 aa, Plasmodium falciparum
RKLLKTLDRNSCIYESV

SEQ ID NO: 3378464 - protein, 19 aa, Plasmodium falciparum
RKNEGFLIRSFKRIKHKIK

SEQ ID NO: 3378465 - protein, 23 aa, Plasmodium falciparum
RKQLFIIEALEWSSFFSGAASEK

SEQ ID NO: 3378466 - protein, 17 aa, Plasmodium falciparum
RKRCVQCSDLIVLVISL

SEQ ID NO: 3378467 - protein, 20 aa, Plasmodium falciparum
RKRTHLKGKYVLQRQENDLD

SEQ ID NO: 3378468 - protein, 23 aa, Plasmodium falciparum
RKYCVRHLLGYVVAKSRENIKIK

SEQ ID NO: 3378469 - protein, 17 aa, Plasmodium falciparum
RKYNCLNSFPCLHAPSK

SEQ ID NO: 3378470 - protein, 20 aa, Plasmodium falciparum
RLKDAILYYNEFLRLINMFK

SEQ ID NO: 3378471 - protein, 18 aa, Plasmodium falciparum
RLRFDGVYISCVTYIRSL

SEQ ID NO: 3378472 - protein, 20 aa, Plasmodium falciparum
RLSEKKKLLLNMEGKEKNEL

SEQ ID NO: 3378473 - protein, 19 aa, Plasmodium falciparum
RLTNLFKYLTLGVEKNNST

SEQ ID NO: 3378474 - protein, 25 aa, Plasmodium falciparum
RLYASWKQGTSFSRFMSCLFHYPSP

SEQ ID NO: 3378475 - protein, 21 aa, Plasmodium falciparum
RMKIFFRYYMKNLFLGNFDKI

SEQ ID NO: 3378476 - protein, 32 aa, Plasmodium falciparum
RNDCSSCSFFWKQLNCELCKFPYPTYIYIQNK

SEQ ID NO: 3378477 - protein, 20 aa, Plasmodium falciparum
RNDMFPCFGYLYPEGTDRIR

SEQ ID NO: 3378478 - protein, 25 aa, Plasmodium falciparum
RNEKKRIPLKIKRNASATFIHSVNN

SEQ ID NO: 3378479 - protein, 19 aa, Plasmodium falciparum
RNFDLRPGFIIQELKLTEP

SEQ ID NO: 3378480 - protein, 18 aa, Plasmodium falciparum
RNLCFPLLDLYFLNKNFK

SEQ ID NO: 3378481 - protein, 17 aa, Plasmodium falciparum
RNSCISFGQDKGSIINL

SEQ ID NO: 3378482 - protein, 19 aa, Plasmodium falciparum
RNSSRYSIDYGRRDSSRRG

SEQ ID NO: 3378483 - protein, 17 aa, Plasmodium falciparum
RNVSSCSSFELKNNMIT

SEQ ID NO: 3378484 - protein, 22 aa, Plasmodium falciparum
RPEVKIAEGMCLRNMFKDKYST

SEQ ID NO: 3378485 - protein, 18 aa, Plasmodium falciparum
RPKMALSVPHFVDKIIHL

SEQ ID NO: 3378486 - protein, 18 aa, Plasmodium falciparum
RPPTDPFKEKKEDQVSQQ

SEQ ID NO: 3378487 - protein, 20 aa, Plasmodium falciparum
RPQKVWRILASKACRNAIMV

SEQ ID NO: 3378488 - protein, 18 aa, Plasmodium falciparum
RPSSAIYYDINFFQNKVK

SEQ ID NO: 3378489 - protein, 17 aa, Plasmodium falciparum
RQVCIPMHLPISYSINI

SEQ ID NO: 3378490 - protein, 21 aa, Plasmodium falciparum
RRHHNTYIKCCHDSHLYSREI

SEQ ID NO: 3378491 - protein, 19 aa, Plasmodium falciparum
RRIKEHNCYSGIIGENERN

SEQ ID NO: 3378492 - protein, 21 aa, Plasmodium falciparum
RRKDIDLEINWRNTANPTQEE

SEQ ID NO: 3378493 - protein, 19 aa, Plasmodium falciparum
RRLDCYFNIVLRNVRDSVP

SEQ ID NO: 3378494 - protein, 20 aa, Plasmodium falciparum
RRLKKLVDLFLCIKQFQILK

SEQ ID NO: 3378495 - protein, 20 aa, Plasmodium falciparum
RRYETYIGYLRIRTHNDRNE

SEQ ID NO: 3378496 - protein, 20 aa, Plasmodium falciparum
RSINEWKILAKCDHPNIIKL

SEQ ID NO: 3378497 - protein, 20 aa, Plasmodium falciparum
RSKIIKYRNRFLLAHRKDLQ

SEQ ID NO: 3378498 - protein, 22 aa, Plasmodium falciparum
RSKSRGSGFVTFYNRDEAVNAI

SEQ ID NO: 3378499 - protein, 22 aa, Plasmodium falciparum
RSLPYFNWLVSIVLDNKIDMES

SEQ ID NO: 3378500 - protein, 19 aa, Plasmodium falciparum
RSMCWKLALKHLSLDSNKW

SEQ ID NO: 3378501 - protein, 20 aa, Plasmodium falciparum
RSNHIFVYLKRFLKNRDQKM

SEQ ID NO: 3378502 - protein, 25 aa, Plasmodium falciparum
RSPRWKKPVPLIICNSCQQKMYMSQ

SEQ ID NO: 3378503 - protein, 19 aa, Plasmodium falciparum
RSSSCLFMFNNIKRNDVHD

SEQ ID NO: 3378504 - protein, 20 aa, Plasmodium falciparum
RSVRRRLCLDFTLCTLIKDI

SEQ ID NO: 3378505 - protein, 20 aa, Plasmodium falciparum
RTEIKISMWSLLKDCIGKDL

SEQ ID NO: 3378506 - protein, 22 aa, Plasmodium falciparum
RTFKEIFFSLGFEEMETHNYVE

SEQ ID NO: 3378507 - protein, 18 aa, Plasmodium falciparum
RTGFYDLEIDGVISSFEA

SEQ ID NO: 3378508 - protein, 17 aa, Plasmodium falciparum
RTIPLRGAILLNHDLRK

SEQ ID NO: 3378509 - protein, 25 aa, Plasmodium falciparum
RTKNPWKNYCFKILHKLKKKEIACW

SEQ ID NO: 3378510 - protein, 22 aa, Plasmodium falciparum
RVALPLLASWVVFNQPLSILAV

SEQ ID NO: 3378511 - protein, 18 aa, Plasmodium falciparum
RVDISIPVCEYCYSTKAI

SEQ ID NO: 3378512 - protein, 18 aa, Plasmodium falciparum
RVKLLLKRKLICYDGFEP

SEQ ID NO: 3378513 - protein, 25 aa, Plasmodium falciparum
RYEYIFKTKIAYMLIKKFYAADDIE

SEQ ID NO: 3378514 - protein, 17 aa, Plasmodium falciparum
RYFFNFFQVYGILSEES

SEQ ID NO: 3378515 - protein, 21 aa, Plasmodium falciparum
RYFLGLKECYKHICIDEPKIV

SEQ ID NO: 3378516 - protein, 24 aa, Plasmodium falciparum
RYKKTFLLIEELFRLKIIKDNENQ

SEQ ID NO: 3378517 - protein, 18 aa, Plasmodium falciparum
RYKNIIFFIYGKWSQEIY

SEQ ID NO: 3378518 - protein, 23 aa, Plasmodium falciparum
RYLKIALCFNNFKIKIIDIILNI

SEQ ID NO: 3378519 - protein, 17 aa, Plasmodium falciparum
RYSMYYCLKFFDHYFFF

SEQ ID NO: 3378520 - protein, 17 aa, Plasmodium falciparum
RYYFALVECYNKEIVEF

SEQ ID NO: 3378521 - protein, 17 aa, Plasmodium falciparum
SACLKIGQVVPVKILGA

SEQ ID NO: 3378522 - protein, 19 aa, Plasmodium falciparum
SACPYELLLFSSLIKCNIL

SEQ ID NO: 3378523 - protein, 19 aa, Plasmodium falciparum
SAIGLGFRKNGYINDCDLV

SEQ ID NO: 3378524 - protein, 17 aa, Plasmodium falciparum
SAKNWFAVENIKLRNKL

SEQ ID NO: 3378525 - protein, 19 aa, Plasmodium falciparum
SALNAHLPNEINIETITST

SEQ ID NO: 3378526 - protein, 17 aa, Plasmodium falciparum
SCIPPPLKKMIPIDGVR

SEQ ID NO: 3378527 - protein, 21 aa, Plasmodium falciparum
SCKIISLLFYNRILKCVIFKN

SEQ ID NO: 3378528 - protein, 19 aa, Plasmodium falciparum
SCSRTKFTWGIQVPNDPKH

SEQ ID NO: 3378529 - protein, 22 aa, Plasmodium falciparum
SCYTRNCVNCNILINNHIDVSN

SEQ ID NO: 3378530 - protein, 21 aa, Plasmodium falciparum
SDFLRIFGIFCYNKLIYVDKC

SEQ ID NO: 3378531 - protein, 23 aa, Plasmodium falciparum
SDFRIYFKFFKMLIERNVHPFLA

SEQ ID NO: 3378532 - protein, 19 aa, Plasmodium falciparum
SDIKLILRTGGGFRKLSEH

SEQ ID NO: 3378533 - protein, 18 aa, Plasmodium falciparum
SDKSDCIRYYKSINKNNE

SEQ ID NO: 3378534 - protein, 18 aa, Plasmodium falciparum
SDLFLILCHMCKSINEVN

SEQ ID NO: 3378535 - protein, 17 aa, Plasmodium falciparum
SDLRLPYYLVRTKGIDH

SEQ ID NO: 3378536 - protein, 18 aa, Plasmodium falciparum
SDMATVWILERSVYKENI

SEQ ID NO: 3378537 - protein, 19 aa, Plasmodium falciparum
SDMKFEFLWNKWKEKINNN

SEQ ID NO: 3378538 - protein, 33 aa, Plasmodium falciparum
SDWYCSACNFLNFSRRTACHFCKAPKTSDAKLV

SEQ ID NO: 3378539 - protein, 19 aa, Plasmodium falciparum
SEFFKYFRLDDEIFQDNKT

SEQ ID NO: 3378540 - protein, 19 aa, Plasmodium falciparum
SEFFLPYKIGDYIENLIVQ

SEQ ID NO: 3378541 - protein, 17 aa, Plasmodium falciparum
SEFFVFFNISYKLITNE

SEQ ID NO: 3378542 - protein, 22 aa, Plasmodium falciparum
SEHSNLKKCCICCENYQHNDNV

SEQ ID NO: 3378543 - protein, 19 aa, Plasmodium falciparum
SEKIYKYALIFSPILKNDG

SEQ ID NO: 3378544 - protein, 20 aa, Plasmodium falciparum
SEKKTKCALEKEVNDEEIKT

SEQ ID NO: 3378545 - protein, 32 aa, Plasmodium falciparum
SEKNKESLKKDKRKKKEKKNNDVDDINEEEDE

SEQ ID NO: 3378546 - protein, 20 aa, Plasmodium falciparum
SELLIIEWMEAFFFHTKLSL

SEQ ID NO: 3378547 - protein, 24 aa, Plasmodium falciparum
SELNIKCIWAHPFLNTKSTYYILC

SEQ ID NO: 3378548 - protein, 19 aa, Plasmodium falciparum
SEMQFWKSYFFNIDIIYNE

SEQ ID NO: 3378549 - protein, 18 aa, Plasmodium falciparum
SENLRLLYQFLVVEYQNK

SEQ ID NO: 3378550 - protein, 23 aa, Plasmodium falciparum
SEQMSKLNIFGNINIDIEKLRKS

SEQ ID NO: 3378551 - protein, 20 aa, Plasmodium falciparum
SESSIKISKFIKKNEKYDWS

SEQ ID NO: 3378552 - protein, 25 aa, Plasmodium falciparum
SEWSKKLLCLRLVKNPELLQKKYNI

SEQ ID NO: 3378553 - protein, 19 aa, Plasmodium falciparum
SEYFYKYDCNLIIIDLNSD

SEQ ID NO: 3378554 - protein, 18 aa, Plasmodium falciparum
SEYKCSLSMEKKTNDNFD

SEQ ID NO: 3378555 - protein, 17 aa, Plasmodium falciparum
SFDLLIRRFDKILRLTK

SEQ ID NO: 3378556 - protein, 25 aa, Plasmodium falciparum
SFIKGKCFSGQFCRYAHGHNELREN

SEQ ID NO: 3378557 - protein, 17 aa, Plasmodium falciparum
SFPLLKKFEVCYYPLHH

SEQ ID NO: 3378558 - protein, 19 aa, Plasmodium falciparum
SFTSMILNFFGFKYDNIEE

SEQ ID NO: 3378559 - protein, 20 aa, Plasmodium falciparum
SGCKKVLIKKLSCPICLKNK

SEQ ID NO: 3378560 - protein, 20 aa, Plasmodium falciparum
SGDIFRCILEVRGPEKYIGN

SEQ ID NO: 3378561 - protein, 24 aa, Plasmodium falciparum
SGKICLLEKLLIRLKERGNRVLIF

SEQ ID NO: 3378562 - protein, 23 aa, Plasmodium falciparum
SGKRIAWKLAKKHPLLNADINNQ

SEQ ID NO: 3378563 - protein, 23 aa, Plasmodium falciparum
SGRLKAAMTFLCLIQHDQSIESL

SEQ ID NO: 3378564 - protein, 18 aa, Plasmodium falciparum
SHFGYCCIYAFQVKVLPD

SEQ ID NO: 3378565 - protein, 23 aa, Plasmodium falciparum
SHSFWLYLYINLEEAFTFSSLLH

SEQ ID NO: 3378566 - protein, 17 aa, Plasmodium falciparum
SICFCVDSLFHFKNTTV

SEQ ID NO: 3378567 - protein, 23 aa, Plasmodium falciparum
SIDFLKLSGINFEKHQSLGIELL

SEQ ID NO: 3378568 - protein, 18 aa, Plasmodium falciparum
SIFYEHFEFLSSDEYNYV

SEQ ID NO: 3378569 - protein, 18 aa, Plasmodium falciparum
SIFYRFLKRLPCKEEENI

SEQ ID NO: 3378570 - protein, 17 aa, Plasmodium falciparum
SIIKLKWGVDTNENESI

SEQ ID NO: 3378571 - protein, 20 aa, Plasmodium falciparum
SIKFSDLVEYQWRNNLNPVN

SEQ ID NO: 3378572 - protein, 18 aa, Plasmodium falciparum
SIKRINCNYEYILKHKEA

SEQ ID NO: 3378573 - protein, 17 aa, Plasmodium falciparum
SILKILWFGYVDICKCI

SEQ ID NO: 3378574 - protein, 21 aa, Plasmodium falciparum
SKARWKVISFNIKCVYQLSAV

SEQ ID NO: 3378575 - protein, 23 aa, Plasmodium falciparum
SKDCMYEKFMLYNLFSYNITCLK

SEQ ID NO: 3378576 - protein, 20 aa, Plasmodium falciparum
SKDIKSLCIFKQRNKKVRSS

SEQ ID NO: 3378577 - protein, 22 aa, Plasmodium falciparum
SKENCLDMFYVLASYYDIIKNI

SEQ ID NO: 3378578 - protein, 18 aa, Plasmodium falciparum
SKESLGLVGEYLLKKLQR

SEQ ID NO: 3378579 - protein, 19 aa, Plasmodium falciparum
SKIMNEWNCIQTLNEHTSV

SEQ ID NO: 3378580 - protein, 24 aa, Plasmodium falciparum
SKKISILFLLRWILCGKQIAEKTK

SEQ ID NO: 3378581 - protein, 18 aa, Plasmodium falciparum
SKKLSIYFYWFLLSEAKD

SEQ ID NO: 3378582 - protein, 23 aa, Plasmodium falciparum
SKKSYKSCIVWYMNHYQRFGGSI

SEQ ID NO: 3378583 - protein, 20 aa, Plasmodium falciparum
SKLKEMYQMIAIGGDAELEI

SEQ ID NO: 3378584 - protein, 21 aa, Plasmodium falciparum
SKLKSVMSFNTFCKDMKDENF

SEQ ID NO: 3378585 - protein, 22 aa, Plasmodium falciparum
SKLRIIRMLLNLVLCESNNLKK

SEQ ID NO: 3378586 - protein, 22 aa, Plasmodium falciparum
SKLSDKVMRMFGQELVLINSQI

SEQ ID NO: 3378587 - protein, 18 aa, Plasmodium falciparum
SKNFKFLISFIGNVNNCN

SEQ ID NO: 3378588 - protein, 29 aa, Plasmodium falciparum
SKQYFCIYFARGCCAYGHNCLYKHRIPNE

SEQ ID NO: 3378589 - protein, 17 aa, Plasmodium falciparum
SKRFLNVALFYDLIYNF

SEQ ID NO: 3378590 - protein, 21 aa, Plasmodium falciparum
SKYKYVCYFLEEFFFHKQKIS

SEQ ID NO: 3378591 - protein, 23 aa, Plasmodium falciparum
SKYLWKARIFFIWQRLFTSSNDY

SEQ ID NO: 3378592 - protein, 31 aa, Plasmodium falciparum
SKYYRIKLCPFLKEGFCQKGDNCSYAHSPDK

SEQ ID NO: 3378593 - protein, 17 aa, Plasmodium falciparum
SLEFLEIMNLYRNVDFH

SEQ ID NO: 3378594 - protein, 23 aa, Plasmodium falciparum
SLKEIKRVVGLILIRGENIVSFT

SEQ ID NO: 3378595 - protein, 20 aa, Plasmodium falciparum
SLKLIFPYIFFRKKYNQNNI

SEQ ID NO: 3378596 - protein, 18 aa, Plasmodium falciparum
SLLINCIDVLLNFMNYNN

SEQ ID NO: 3378597 - protein, 25 aa, Plasmodium falciparum
SLLPEKWYCSLNFWNAYNNCDMEEE

SEQ ID NO: 3378598 - protein, 21 aa, Plasmodium falciparum
SLPIILGNILPYWTKDKNIKK

SEQ ID NO: 3378599 - protein, 21 aa, Plasmodium falciparum
SLPPYLIVHFLRFESKKIVES

SEQ ID NO: 3378600 - protein, 17 aa, Plasmodium falciparum
SLRLCLKSARNTQHMNE

SEQ ID NO: 3378601 - protein, 17 aa, Plasmodium falciparum
SLTQFFFNFIIKKNQYN

SEQ ID NO: 3378602 - protein, 18 aa, Plasmodium falciparum
SMIIELIKYISYMQKALI

SEQ ID NO: 3378603 - protein, 22 aa, Plasmodium falciparum
SMKCPRCIIGYIYPIKTEALIE

SEQ ID NO: 3378604 - protein, 21 aa, Plasmodium falciparum
SMWFNYNFDEHTFKEWVQKHI

SEQ ID NO: 3378605 - protein, 21 aa, Plasmodium falciparum
SNGGLFIWNWKKMVNFKNIKA

SEQ ID NO: 3378606 - protein, 23 aa, Plasmodium falciparum
SNIKNGYSYCLICCSQKIRIGSI

SEQ ID NO: 3378607 - protein, 25 aa, Plasmodium falciparum
SNPIPLPIGSIFKAGQCKIEVCSHD

SEQ ID NO: 3378608 - protein, 20 aa, Plasmodium falciparum
SNQKGKCNFNIFKINKHINK

SEQ ID NO: 3378609 - protein, 19 aa, Plasmodium falciparum
SNRPAPWFGQRDINIKRKQ

SEQ ID NO: 3378610 - protein, 24 aa, Plasmodium falciparum
SNSYKGECLWEKILASLNNDYEQI

SEQ ID NO: 3378611 - protein, 19 aa, Plasmodium falciparum
SNTFFCKYCNVNIEEGKLS

SEQ ID NO: 3378612 - protein, 18 aa, Plasmodium falciparum
SNYKRLNVALTRARFNLF

SEQ ID NO: 3378613 - protein, 18 aa, Plasmodium falciparum
SNYSFPIVLILSAYTKHC

SEQ ID NO: 3378614 - protein, 25 aa, Plasmodium falciparum
SPFADIIRLCLNYDPNLRPTASEIV

SEQ ID NO: 3378615 - protein, 19 aa, Plasmodium falciparum
SPHKIYCFIHFFNYDECLR

SEQ ID NO: 3378616 - protein, 17 aa, Plasmodium falciparum
SPLDILVCAGLISSKKL

SEQ ID NO: 3378617 - protein, 24 aa, Plasmodium falciparum
SPNSWKYKQVVLIAGCNNGSVCLT

SEQ ID NO: 3378618 - protein, 25 aa, Plasmodium falciparum
SPYNRFNIQAGYRWDGVIRGNGFEE

SEQ ID NO: 3378619 - protein, 17 aa, Plasmodium falciparum
SQCFDSKCRVFICLCSL

SEQ ID NO: 3378620 - protein, 18 aa, Plasmodium falciparum
SQHVICLNVQNKDHNNNN

SEQ ID NO: 3378621 - protein, 24 aa, Plasmodium falciparum
SRCIPFWSFCFRQNIKIKIIDTCE

SEQ ID NO: 3378622 - protein, 20 aa, Plasmodium falciparum
SRFTFEMIHISPILNIEDIS

SEQ ID NO: 3378623 - protein, 18 aa, Plasmodium falciparum
SRFYRRFGKSLIRILIDM

SEQ ID NO: 3378624 - protein, 21 aa, Plasmodium falciparum
SRGFKFFFFKVLRSIKTKTID

SEQ ID NO: 3378625 - protein, 17 aa, Plasmodium falciparum
SRIELIDIFGFPNEFDV

SEQ ID NO: 3378626 - protein, 19 aa, Plasmodium falciparum
SRIMKRILPGSAKVAKESK

SEQ ID NO: 3378627 - protein, 24 aa, Plasmodium falciparum
SSANKKSRSWMSFGKGDKSDKKNK

SEQ ID NO: 3378628 - protein, 19 aa, Plasmodium falciparum
SSDSLKNAYSFYSLSEKNN

SEQ ID NO: 3378629 - protein, 34 aa, Plasmodium falciparum
SSKCCIYLVAPFECVQKLLADGCKRMAIIKEECG

SEQ ID NO: 3378630 - protein, 17 aa, Plasmodium falciparum
SSNPIFLSWPPFPSFSP

SEQ ID NO: 3378631 - protein, 24 aa, Plasmodium falciparum
SSVLFKILVFRGIPNENFDDLLKK

SEQ ID NO: 3378632 - protein, 21 aa, Plasmodium falciparum
SSYFFIPPLEFIVSHLNKLHK

SEQ ID NO: 3378633 - protein, 20 aa, Plasmodium falciparum
STALTIKWAFEIKNQPHNLI

SEQ ID NO: 3378634 - protein, 17 aa, Plasmodium falciparum
STCKASKNDNKWLRFFR

SEQ ID NO: 3378635 - protein, 23 aa, Plasmodium falciparum
STFSLNIPYCFKILHETNDELIK

SEQ ID NO: 3378636 - protein, 17 aa, Plasmodium falciparum
STICSFWGKGKCFNGNK

SEQ ID NO: 3378637 - protein, 20 aa, Plasmodium falciparum
STLFCCLYKFFTMQLSEKQL

SEQ ID NO: 3378638 - protein, 23 aa, Plasmodium falciparum
STTDCADCADSLVTSNSNIGEEF

SEQ ID NO: 3378639 - protein, 22 aa, Plasmodium falciparum
STYYILCAFLPRVILEAFLNSK

SEQ ID NO: 3378640 - protein, 19 aa, Plasmodium falciparum
SVNTILPSWDIKYNFNSSK

SEQ ID NO: 3378641 - protein, 25 aa, Plasmodium falciparum
SVSLFLRIFLHDMISPPIFFDDLTS

SEQ ID NO: 3378642 - protein, 17 aa, Plasmodium falciparum
SVVHEFIGRVAIVELLE

SEQ ID NO: 3378643 - protein, 17 aa, Plasmodium falciparum
SYDSYFFNRYCINADKF

SEQ ID NO: 3378644 - protein, 21 aa, Plasmodium falciparum
SYELLRFLFDLYKNIYIKYLN

SEQ ID NO: 3378645 - protein, 22 aa, Plasmodium falciparum
SYKPIICYKCLSFFECENNYNF

SEQ ID NO: 3378646 - protein, 21 aa, Plasmodium falciparum
SYRKCSIINFFNAIKEENKNY

SEQ ID NO: 3378647 - protein, 22 aa, Plasmodium falciparum
TAESKSRCAIVYKNNKLYLKHN

SEQ ID NO: 3378648 - protein, 17 aa, Plasmodium falciparum
TAKKIALNFLRSLGVNA

SEQ ID NO: 3378649 - protein, 17 aa, Plasmodium falciparum
TALDLAIVLFMKKFHEC

SEQ ID NO: 3378650 - protein, 19 aa, Plasmodium falciparum
TARATSFYAQFFINQLKIS

SEQ ID NO: 3378651 - protein, 17 aa, Plasmodium falciparum
TATYFYYEFNLRDIHSI

SEQ ID NO: 3378652 - protein, 18 aa, Plasmodium falciparum
TCKFFFKKGKCIHNDKCT

SEQ ID NO: 3378653 - protein, 18 aa, Plasmodium falciparum
TCKYTLLCADCLLNDPVH

SEQ ID NO: 3378654 - protein, 23 aa, Plasmodium falciparum
TCNLCIKSKIKLFLDEINFINNS

SEQ ID NO: 3378655 - protein, 19 aa, Plasmodium falciparum
TCPACRRSYEEKNFIYNKE

SEQ ID NO: 3378656 - protein, 23 aa, Plasmodium falciparum
TCQKLKECESIFCDSNDEHGEKK

SEQ ID NO: 3378657 - protein, 17 aa, Plasmodium falciparum
TCRICLFSGSIFKHPNA

SEQ ID NO: 3378658 - protein, 18 aa, Plasmodium falciparum
TDCLKLTKWPGIKIPEDD

SEQ ID NO: 3378659 - protein, 18 aa, Plasmodium falciparum
TDHQKIWYEWCINEPITT

SEQ ID NO: 3378660 - protein, 17 aa, Plasmodium falciparum
TDPDGFLELSIRQKRKF

SEQ ID NO: 3378661 - protein, 24 aa, Plasmodium falciparum
TDQFLRWLIEWAMQACKEKKRVRD

SEQ ID NO: 3378662 - protein, 17 aa, Plasmodium falciparum
TDSIPCAFFFSNDNQTR

SEQ ID NO: 3378663 - protein, 17 aa, Plasmodium falciparum
TDVYWRLAFARRNINVL

SEQ ID NO: 3378664 - protein, 21 aa, Plasmodium falciparum
TEAPCPLKFMYKLLKRYLDER

SEQ ID NO: 3378665 - protein, 17 aa, Plasmodium falciparum
TEFLWKFHKEFNDKDAI

SEQ ID NO: 3378666 - protein, 21 aa, Plasmodium falciparum
TEKKEDCLFLYGGKRGSYITN

SEQ ID NO: 3378667 - protein, 21 aa, Plasmodium falciparum
TEKYAPCKIIMKMCAHINQFM

SEQ ID NO: 3378668 - protein, 17 aa, Plasmodium falciparum
TFCFYCLFEQFACNIIS

SEQ ID NO: 3378669 - protein, 22 aa, Plasmodium falciparum
TFREAFLYILGWDIKIEQNDEE

SEQ ID NO: 3378670 - protein, 25 aa, Plasmodium falciparum
TFYCLKRKFLYNVDIKFLIKEKHFL

SEQ ID NO: 3378671 - protein, 23 aa, Plasmodium falciparum
TGKRYVRNFVCILNAQCNSRLRI

SEQ ID NO: 3378672 - protein, 17 aa, Plasmodium falciparum
TGLSLKAFKAWAGNPQN

SEQ ID NO: 3378673 - protein, 25 aa, Plasmodium falciparum
TGNRFKWEYLDVCGNIQEGKDRATA

SEQ ID NO: 3378674 - protein, 23 aa, Plasmodium falciparum
THEFYKRKGIVLYKIKKEKAENE

SEQ ID NO: 3378675 - protein, 18 aa, Plasmodium falciparum
THKSFFCNSSAKNVINNE

SEQ ID NO: 3378676 - protein, 18 aa, Plasmodium falciparum
THRHGCCVIQRCIDSANE

SEQ ID NO: 3378677 - protein, 28 aa, Plasmodium falciparum
TICNLVKIPLCYLEPLAIVKYEKNNYFN

SEQ ID NO: 3378678 - protein, 17 aa, Plasmodium falciparum
TKFTWGIQVPNDPKHVM

SEQ ID NO: 3378679 - protein, 20 aa, Plasmodium falciparum
TKGLCSKGFIYKRLCFRNFN

SEQ ID NO: 3378680 - protein, 20 aa, Plasmodium falciparum
TKNATSMLPDFSCMNGVEIM

SEQ ID NO: 3378681 - protein, 22 aa, Plasmodium falciparum
TKNFDIFLCLFMKYEKNESQLL

SEQ ID NO: 3378682 - protein, 26 aa, Plasmodium falciparum
TKRRIKKYFDFCVIKLCKPTLIKGID

SEQ ID NO: 3378683 - protein, 18 aa, Plasmodium falciparum
TLDPRLNSLYGMLYYQSI

SEQ ID NO: 3378684 - protein, 36 aa, Plasmodium falciparum
TLDTLTFYQLILIIISIVNFCRKKSQTYNKNFEEKF

SEQ ID NO: 3378685 - protein, 21 aa, Plasmodium falciparum
TLKLKEIIKFISVLCEIKKPF

SEQ ID NO: 3378686 - protein, 17 aa, Plasmodium falciparum
TLLRKGKKNFKFIDETK

SEQ ID NO: 3378687 - protein, 19 aa, Plasmodium falciparum
TMLDSWYFANKMKIIPYLF

SEQ ID NO: 3378688 - protein, 24 aa, Plasmodium falciparum
TMNCGHTFCRYCIGHNKLNGKNCP

SEQ ID NO: 3378689 - protein, 21 aa, Plasmodium falciparum
TNFFFPHFVSYELKNFCYELC

SEQ ID NO: 3378690 - protein, 20 aa, Plasmodium falciparum
TNFFLLRFIFEYESYMSENY

SEQ ID NO: 3378691 - protein, 23 aa, Plasmodium falciparum
TNFYIDKCIHFKKFSKDELYKTF

SEQ ID NO: 3378692 - protein, 26 aa, Plasmodium falciparum
TNIECIYIRCYLCNSLNYSKYSPFNI

SEQ ID NO: 3378693 - protein, 18 aa, Plasmodium falciparum
TNIRICIVNNDLFQFLQC

SEQ ID NO: 3378694 - protein, 21 aa, Plasmodium falciparum
TPEFLDFLLFYILKKENIHFF

SEQ ID NO: 3378695 - protein, 20 aa, Plasmodium falciparum
TPVLLAKACELFIMELTSNA

SEQ ID NO: 3378696 - protein, 20 aa, Plasmodium falciparum
TQCFYILGCKEFKVIDFFTI

SEQ ID NO: 3378697 - protein, 21 aa, Plasmodium falciparum
TQNDWKCVIAVILNSKESIKY

SEQ ID NO: 3378698 - protein, 20 aa, Plasmodium falciparum
TQRYLGFRICTLIQHINYSD

SEQ ID NO: 3378699 - protein, 17 aa, Plasmodium falciparum
TQWRTIAPIVGRTAQQC

SEQ ID NO: 3378700 - protein, 24 aa, Plasmodium falciparum
TRWRRIYKGLKLCEYVMKNGCEYF

SEQ ID NO: 3378701 - protein, 36 aa, Plasmodium falciparum
TSEYFYLPVDCPRMKKCDDAYCPLAHTKLEKIFHPI

SEQ ID NO: 3378702 - protein, 18 aa, Plasmodium falciparum
TSGTGYDWRSDIWSLGVL

SEQ ID NO: 3378703 - protein, 17 aa, Plasmodium falciparum
TTLCKFFLNGYCKADKN

SEQ ID NO: 3378704 - protein, 20 aa, Plasmodium falciparum
TTLEWFLKCIALIQHNIRKW

SEQ ID NO: 3378705 - protein, 18 aa, Plasmodium falciparum
TTVFVDWLMRLMGDIRKQ

SEQ ID NO: 3378706 - protein, 23 aa, Plasmodium falciparum
TVVPSLWLYASISFYLTKFHLEN

SEQ ID NO: 3378707 - protein, 18 aa, Plasmodium falciparum
TWPTFFFVNLNFSKFNNV

SEQ ID NO: 3378708 - protein, 17 aa, Plasmodium falciparum
TYICKGLFYYYWLCYSM

SEQ ID NO: 3378709 - protein, 26 aa, Plasmodium falciparum
TYKHIFKYKRISSISTDEVDYVINEE

SEQ ID NO: 3378710 - protein, 23 aa, Plasmodium falciparum
TYKMKCSFFLNIIKNYEENIHIL

SEQ ID NO: 3378711 - protein, 26 aa, Plasmodium falciparum
TYNLICLKCLIAVIIKFEDNIIKFKE

SEQ ID NO: 3378712 - protein, 18 aa, Plasmodium falciparum
TYRFLYKYNNLFEKLVDN

SEQ ID NO: 3378713 - protein, 19 aa, Plasmodium falciparum
VACIAWCIEILQASFLVAD

SEQ ID NO: 3378714 - protein, 17 aa, Plasmodium falciparum
VAKYCFEKLNGKWIPGK

SEQ ID NO: 3378715 - protein, 17 aa, Plasmodium falciparum
VAMTLTFCETVTPLNYD

SEQ ID NO: 3378716 - protein, 19 aa, Plasmodium falciparum
VCACREIYEEIGIDIFPYI

SEQ ID NO: 3378717 - protein, 23 aa, Plasmodium falciparum
VCARKAEAFVHWLINEYSMENTN

SEQ ID NO: 3378718 - protein, 20 aa, Plasmodium falciparum
VCIPMHLPISYSINIEENED

SEQ ID NO: 3378719 - protein, 18 aa, Plasmodium falciparum
VCKGEIPAEIVLHDKNGN

SEQ ID NO: 3378720 - protein, 20 aa, Plasmodium falciparum
VCLYFHCIKKSLKLLEDKND

SEQ ID NO: 3378721 - protein, 19 aa, Plasmodium falciparum
VCNSLALLQCVASHPETKQ

SEQ ID NO: 3378722 - protein, 19 aa, Plasmodium falciparum
VCSCLKIFPSIRYQNSELC

SEQ ID NO: 3378723 - protein, 18 aa, Plasmodium falciparum
VCTLINCPTHNPQNYVKS

SEQ ID NO: 3378724 - protein, 19 aa, Plasmodium falciparum
VCVKNEFNTYLEFYKNIVR

SEQ ID NO: 3378725 - protein, 17 aa, Plasmodium falciparum
VDGENRMNNTINMNGMN

SEQ ID NO: 3378726 - protein, 22 aa, Plasmodium falciparum
VDIIWEKMVLLAIGEEFSLIDL

SEQ ID NO: 3378727 - protein, 21 aa, Plasmodium falciparum
VDIKKCEGGVMYFPEKSLDYS

SEQ ID NO: 3378728 - protein, 19 aa, Plasmodium falciparum
VDIMCWIHRGLISCAYDIV

SEQ ID NO: 3378729 - protein, 19 aa, Plasmodium falciparum
VDLISGYILDIAGKGAENY

SEQ ID NO: 3378730 - protein, 26 aa, Plasmodium falciparum
VDYLRILKRLTPLWGSTDRTFESHYV

SEQ ID NO: 3378731 - protein, 17 aa, Plasmodium falciparum
VEPKYVCLKVMKNGKQF

SEQ ID NO: 3378732 - protein, 18 aa, Plasmodium falciparum
VFEKCFIFNNVIRGSYTY

SEQ ID NO: 3378733 - protein, 24 aa, Plasmodium falciparum
VFEPKMDFTLCINKSIKLFLKDIN

SEQ ID NO: 3378734 - protein, 23 aa, Plasmodium falciparum
VFEYAVKISLEFGSNIRMSTISS

SEQ ID NO: 3378735 - protein, 18 aa, Plasmodium falciparum
VFFLKAFFKNVINIKKER

SEQ ID NO: 3378736 - protein, 17 aa, Plasmodium falciparum
VFFNIRRNKFIALQIGR

SEQ ID NO: 3378737 - protein, 17 aa, Plasmodium falciparum
VFGRIKWLKIMNESPHA

SEQ ID NO: 3378738 - protein, 24 aa, Plasmodium falciparum
VFKIPTCCICEFDAFYIGGGPIKR

SEQ ID NO: 3378739 - protein, 24 aa, Plasmodium falciparum
VFLLKGNIFGILRACQLLYHYVKS

SEQ ID NO: 3378740 - protein, 23 aa, Plasmodium falciparum
VFLNNIFCSFPFLYKNDHMFMID

SEQ ID NO: 3378741 - protein, 20 aa, Plasmodium falciparum
VFPSESFLSYFKRQPSSDNA

SEQ ID NO: 3378742 - protein, 18 aa, Plasmodium falciparum
VFSNKCVRTFPLIHSCRG

SEQ ID NO: 3378743 - protein, 18 aa, Plasmodium falciparum
VFYYAKLMFPYLKDEIKE

SEQ ID NO: 3378744 - protein, 17 aa, Plasmodium falciparum
VGANCIYPLLGNNIYKW

SEQ ID NO: 3378745 - protein, 18 aa, Plasmodium falciparum
VGIIPHCINYIFNYINYH

SEQ ID NO: 3378746 - protein, 18 aa, Plasmodium falciparum
VGISNIFKWMDIDNKIIQ

SEQ ID NO: 3378747 - protein, 26 aa, Plasmodium falciparum
VGKLPSCIEYDLKIGDFGACCINEKN

SEQ ID NO: 3378748 - protein, 19 aa, Plasmodium falciparum
VHCVAAFQWASKEGVLCEE

SEQ ID NO: 3378749 - protein, 18 aa, Plasmodium falciparum
VHIHNSCNIYVYINERTS

SEQ ID NO: 3378750 - protein, 18 aa, Plasmodium falciparum
VHKFFKWKCDSMDKQSNG

SEQ ID NO: 3378751 - protein, 23 aa, Plasmodium falciparum
VHLNCLRTWMRGRLNVRNDCSSC

SEQ ID NO: 3378752 - protein, 18 aa, Plasmodium falciparum
VINIYSCYAIWLCMNEIY

SEQ ID NO: 3378753 - protein, 17 aa, Plasmodium falciparum
VIPNCIFDEKFPGLQKK

SEQ ID NO: 3378754 - protein, 18 aa, Plasmodium falciparum
VIPNNFCNNFSMYANMMN

SEQ ID NO: 3378755 - protein, 23 aa, Plasmodium falciparum
VKCICGYSFCWLCLDNWKNHKGG

SEQ ID NO: 3378756 - protein, 20 aa, Plasmodium falciparum
VKCIGHIIGIEFIDKEYLII

SEQ ID NO: 3378757 - protein, 19 aa, Plasmodium falciparum
VKCLHIYKGFPLIKVSYRM

SEQ ID NO: 3378758 - protein, 18 aa, Plasmodium falciparum
VKESIEMFSNPYVLVDEN

SEQ ID NO: 3378759 - protein, 21 aa, Plasmodium falciparum
VKHMNCVYTLIGRKRIILPNI

SEQ ID NO: 3378760 - protein, 19 aa, Plasmodium falciparum
VKHPEIFESLGISQPKGVL

SEQ ID NO: 3378761 - protein, 17 aa, Plasmodium falciparum
VKILEKIKGCYDNYNSN

SEQ ID NO: 3378762 - protein, 17 aa, Plasmodium falciparum
VKKAVVVGCNYVSEERS

SEQ ID NO: 3378763 - protein, 17 aa, Plasmodium falciparum
VKLRLKFTLPYDLFCNI

SEQ ID NO: 3378764 - protein, 18 aa, Plasmodium falciparum
VKRFHVFKDYAFFINDVK

SEQ ID NO: 3378765 - protein, 20 aa, Plasmodium falciparum
VKSFCLAFYYALNKKHAEAH

SEQ ID NO: 3378766 - protein, 19 aa, Plasmodium falciparum
VKSGSPFFLPSFMDCSIHN

SEQ ID NO: 3378767 - protein, 17 aa, Plasmodium falciparum
VKVLRYFWPNFKYKFGS

SEQ ID NO: 3378768 - protein, 21 aa, Plasmodium falciparum
VKVSCGKRIIGFLSASGKIYC

SEQ ID NO: 3378769 - protein, 23 aa, Plasmodium falciparum
VLCANCGDSGAFICHNKKPIKLS

SEQ ID NO: 3378770 - protein, 17 aa, Plasmodium falciparum
VLCDWSYDGTLFMTAST

SEQ ID NO: 3378771 - protein, 19 aa, Plasmodium falciparum
VLDLRLALNIYLRCSSHNK

SEQ ID NO: 3378772 - protein, 17 aa, Plasmodium falciparum
VLFFIPFVVDLLIYHMD

SEQ ID NO: 3378773 - protein, 24 aa, Plasmodium falciparum
VLFLPKYRLLALINICKTSIKVNI

SEQ ID NO: 3378774 - protein, 20 aa, Plasmodium falciparum
VLKSGIPKKASWLPKSDKYF

SEQ ID NO: 3378775 - protein, 19 aa, Plasmodium falciparum
VLRLKRLLILSGEQEAELI

SEQ ID NO: 3378776 - protein, 18 aa, Plasmodium falciparum
VMIQHAWTYQALIHDVFD

SEQ ID NO: 3378777 - protein, 19 aa, Plasmodium falciparum
VNELLKRNFLQSKSGTFVG

SEQ ID NO: 3378778 - protein, 32 aa, Plasmodium falciparum
VNELQIDIGKGWKHFMIYDGKLRELILRKNLT

SEQ ID NO: 3378779 - protein, 17 aa, Plasmodium falciparum
VNEPHYVSFEFTQDCIN

SEQ ID NO: 3378780 - protein, 17 aa, Plasmodium falciparum
VNLKHFINHKVVKNHQN

SEQ ID NO: 3378781 - protein, 18 aa, Plasmodium falciparum
VNPFAGKSVEEWNEITKL

SEQ ID NO: 3378782 - protein, 18 aa, Plasmodium falciparum
VNRFQFRGGESFSEENHI

SEQ ID NO: 3378783 - protein, 19 aa, Plasmodium falciparum
VPECTRFYIFLECSQEHSV

SEQ ID NO: 3378784 - protein, 17 aa, Plasmodium falciparum
VPLRFYLIKNILPILTD

SEQ ID NO: 3378785 - protein, 18 aa, Plasmodium falciparum
VPMFFNFVNCCSSVLGSE

SEQ ID NO: 3378786 - protein, 24 aa, Plasmodium falciparum
VPSFFKKVWCLFNMFIDNHTLNKI

SEQ ID NO: 3378787 - protein, 18 aa, Plasmodium falciparum
VQLCKKLNVHFHNMKLED

SEQ ID NO: 3378788 - protein, 18 aa, Plasmodium falciparum
VQVPIFLWVIFGGKDMKS

SEQ ID NO: 3378789 - protein, 19 aa, Plasmodium falciparum
VRGFYRIGIFALRDIPSGE

SEQ ID NO: 3378790 - protein, 24 aa, Plasmodium falciparum
VRINCLKHTFSVYIQKLDEYNLNF

SEQ ID NO: 3378791 - protein, 21 aa, Plasmodium falciparum
VRLAYELYIIYNRRMKKKNNK

SEQ ID NO: 3378792 - protein, 18 aa, Plasmodium falciparum
VRSLWSLYDLYRSPGPIQ

SEQ ID NO: 3378793 - protein, 20 aa, Plasmodium falciparum
VSAWPEWKGQVIQQAILTQH

SEQ ID NO: 3378794 - protein, 23 aa, Plasmodium falciparum
VSHWRANCKTIHKYFSVKKYGFE

SEQ ID NO: 3378795 - protein, 20 aa, Plasmodium falciparum
VSLKRSFSMLHFNRNIKNHV

SEQ ID NO: 3378796 - protein, 18 aa, Plasmodium falciparum
VSLTLKLEQEWKIIKKNY

SEQ ID NO: 3378797 - protein, 17 aa, Plasmodium falciparum
VSLYIGVFNTKVITLDL

SEQ ID NO: 3378798 - protein, 17 aa, Plasmodium falciparum
VSTGFLLKVFSDSSATL

SEQ ID NO: 3378799 - protein, 20 aa, Plasmodium falciparum
VTCKTFFKLMEMYFDNKIDD

SEQ ID NO: 3378800 - protein, 17 aa, Plasmodium falciparum
VTLLRFFFEKRLSMNDL

SEQ ID NO: 3378801 - protein, 22 aa, Plasmodium falciparum
VTWILKLNIGWDINFFPYPIDF

SEQ ID NO: 3378802 - protein, 19 aa, Plasmodium falciparum
VVISLEFLNFCVKNLGLFF

SEQ ID NO: 3378803 - protein, 19 aa, Plasmodium falciparum
VVYCYLKLLKLKNICTPNG

SEQ ID NO: 3378804 - protein, 17 aa, Plasmodium falciparum
VYCLPRCSMKATILNMI

SEQ ID NO: 3378805 - protein, 25 aa, Plasmodium falciparum
VYGHENARLFALFELIKYNCVPDSL

SEQ ID NO: 3378806 - protein, 20 aa, Plasmodium falciparum
VYHLTGYLHRLLFLMKELDK

SEQ ID NO: 3378807 - protein, 19 aa, Plasmodium falciparum
VYLKRANDIIGFNNNNNNN

SEQ ID NO: 3378808 - protein, 17 aa, Plasmodium falciparum
VYNIRFHIVTKFCLITQ

SEQ ID NO: 3378809 - protein, 22 aa, Plasmodium falciparum
VYRNNCDYVKFLIYEEKANVNI

SEQ ID NO: 3378810 - protein, 25 aa, Plasmodium falciparum
VYSEWKICPNFIFRILFIAKSRANN

SEQ ID NO: 3378811 - protein, 19 aa, Plasmodium falciparum
VYWDKRSWIASWYDNGKRY

SEQ ID NO: 3378812 - protein, 21 aa, Plasmodium falciparum
VYWRLAFARRNINVLENVTQE

SEQ ID NO: 3378813 - protein, 17 aa, Plasmodium falciparum
WCGPCIFTFEMINKIYK

SEQ ID NO: 3378814 - protein, 17 aa, Plasmodium falciparum
WDIKIIFIFDGITPKGH

SEQ ID NO: 3378815 - protein, 22 aa, Plasmodium falciparum
WDIKIILNMHAWIVTYYTNLYI

SEQ ID NO: 3378816 - protein, 22 aa, Plasmodium falciparum
WDKLSELGIIEFLSVPKDFKEN

SEQ ID NO: 3378817 - protein, 19 aa, Plasmodium falciparum
WDPSCHYMSLIFLYIKNLF

SEQ ID NO: 3378818 - protein, 17 aa, Plasmodium falciparum
WDVDWRKKKSMGIMNSV

SEQ ID NO: 3378819 - protein, 17 aa, Plasmodium falciparum
WEFELEYCIYKFKSDYA

SEQ ID NO: 3378820 - protein, 17 aa, Plasmodium falciparum
WFAYACFHPILKFRTAM

SEQ ID NO: 3378821 - protein, 22 aa, Plasmodium falciparum
WFFREYFYRLAINKNIFFPLIE

SEQ ID NO: 3378822 - protein, 17 aa, Plasmodium falciparum
WHFPYKLYRVILGHSGW

SEQ ID NO: 3378823 - protein, 22 aa, Plasmodium falciparum
WHVFHHYKFFFVKYIYMKLFDV

SEQ ID NO: 3378824 - protein, 20 aa, Plasmodium falciparum
WILQLCYRYHSNLLSEDRLP

SEQ ID NO: 3378825 - protein, 17 aa, Plasmodium falciparum
WINKRLIEILGFEDDIL

SEQ ID NO: 3378826 - protein, 26 aa, Plasmodium falciparum
WIPGKAHRFKLNWAKYNMSDNITTNE

SEQ ID NO: 3378827 - protein, 18 aa, Plasmodium falciparum
WIYLSLRLKYDIVDINVH

SEQ ID NO: 3378828 - protein, 17 aa, Plasmodium falciparum
WKGLKICVKLTIQNRQA

SEQ ID NO: 3378829 - protein, 21 aa, Plasmodium falciparum
WKLANMDARQALNLEEESVKA

SEQ ID NO: 3378830 - protein, 18 aa, Plasmodium falciparum
WLCLTDCLLVCFFDEQLI

SEQ ID NO: 3378831 - protein, 17 aa, Plasmodium falciparum
WLFIKAINIYKYFSFKK

SEQ ID NO: 3378832 - protein, 17 aa, Plasmodium falciparum
WLLQIIMAIKFIHDKKL

SEQ ID NO: 3378833 - protein, 23 aa, Plasmodium falciparum
WMNRKILGGYIIFPCKLIHEKED

SEQ ID NO: 3378834 - protein, 19 aa, Plasmodium falciparum
WNIILSLKRDNCLLITGTP

SEQ ID NO: 3378835 - protein, 18 aa, Plasmodium falciparum
WPSLFIEWLPKVYKNDEE

SEQ ID NO: 3378836 - protein, 20 aa, Plasmodium falciparum
WQKKLFICEIELLKNNNQIL

SEQ ID NO: 3378837 - protein, 18 aa, Plasmodium falciparum
WSRLKIKLVKDFQHKAAL

SEQ ID NO: 3378838 - protein, 24 aa, Plasmodium falciparum
WTCSWHECCLCFRKSSQCGNLLIH

SEQ ID NO: 3378839 - protein, 17 aa, Plasmodium falciparum
WTDEYNIDEMFIKKNDI

SEQ ID NO: 3378840 - protein, 26 aa, Plasmodium falciparum
WTDLDLFQHFCCFGNIISSKIQRDST

SEQ ID NO: 3378841 - protein, 18 aa, Plasmodium falciparum
WTLPNGIYFVGRFRQNKP

SEQ ID NO: 3378842 - protein, 18 aa, Plasmodium falciparum
WVASWSQNGNQKRQYFPV

SEQ ID NO: 3378843 - protein, 17 aa, Plasmodium falciparum
WVGNILKNYFFNTANIL

SEQ ID NO: 3378844 - protein, 18 aa, Plasmodium falciparum
WWPYLRRWNSSVTTCEAD

SEQ ID NO: 3378845 - protein, 17 aa, Plasmodium falciparum
WYDSIYFRNGIRKNEIN

SEQ ID NO: 3378846 - protein, 17 aa, Plasmodium falciparum
WYEWCINEPITTSIHNY

SEQ ID NO: 3378847 - protein, 20 aa, Plasmodium falciparum
WYVHCLKYYIGIKTFREIEQ

SEQ ID NO: 3378848 - protein, 23 aa, Plasmodium falciparum
YACAGGYFDICELLIKNGAKVNV

SEQ ID NO: 3378849 - protein, 17 aa, Plasmodium falciparum
YAKEILKQFLLTYDNDA

SEQ ID NO: 3378850 - protein, 20 aa, Plasmodium falciparum
YANYCYPNYYYPIYYYPNYY

SEQ ID NO: 3378851 - protein, 17 aa, Plasmodium falciparum
YASPRGNQIYNLFQDIN

SEQ ID NO: 3378852 - protein, 18 aa, Plasmodium falciparum
YAYEICFFIGKKLKFFKK

SEQ ID NO: 3378853 - protein, 17 aa, Plasmodium falciparum
YCARCDLFIKIRETSHE

SEQ ID NO: 3378854 - protein, 17 aa, Plasmodium falciparum
YCIEILKALNYLRKMSL

SEQ ID NO: 3378855 - protein, 21 aa, Plasmodium falciparum
YCKDCVEYLCKECCDNIHEMD

SEQ ID NO: 3378856 - protein, 23 aa, Plasmodium falciparum
YCKVCGMPYEYCEYGNSFNECKE

SEQ ID NO: 3378857 - protein, 22 aa, Plasmodium falciparum
YCLCKSMLKYPLVFLCTGQVNC

SEQ ID NO: 3378858 - protein, 24 aa, Plasmodium falciparum
YCLKSCFSKICFYFADGPWRRTYC

SEQ ID NO: 3378859 - protein, 17 aa, Plasmodium falciparum
YCPIELKNVYTLLEDSD

SEQ ID NO: 3378860 - protein, 20 aa, Plasmodium falciparum
YDHLCFLERNFLLEKIEDMN

SEQ ID NO: 3378861 - protein, 22 aa, Plasmodium falciparum
YDINHVYLLYCFDKKLEACRIH

SEQ ID NO: 3378862 - protein, 17 aa, Plasmodium falciparum
YDKKNACIYDFLELKTT

SEQ ID NO: 3378863 - protein, 22 aa, Plasmodium falciparum
YDVLRLSLLYSLKYADEQHINV

SEQ ID NO: 3378864 - protein, 19 aa, Plasmodium falciparum
YECIWECYNEIKSILYNIS

SEQ ID NO: 3378865 - protein, 19 aa, Plasmodium falciparum
YEELDYLYKLLIQKKKNIL

SEQ ID NO: 3378866 - protein, 19 aa, Plasmodium falciparum
YEKLLFRDVLKYGFYDMLL

SEQ ID NO: 3378867 - protein, 20 aa, Plasmodium falciparum
YEKRYTPIYINKYEWCGLKL

SEQ ID NO: 3378868 - protein, 21 aa, Plasmodium falciparum
YELKLKILLFFIHKNDNQKES

SEQ ID NO: 3378869 - protein, 23 aa, Plasmodium falciparum
YESELFHGLAWLKYCFHILNFKR

SEQ ID NO: 3378870 - protein, 19 aa, Plasmodium falciparum
YETIPSLIICGDFNSTPSS

SEQ ID NO: 3378871 - protein, 22 aa, Plasmodium falciparum
YEWCGLKLKDIRNMLNEDFNYD

SEQ ID NO: 3378872 - protein, 22 aa, Plasmodium falciparum
YFDKCLYKIIKRRTRTCDNNLC

SEQ ID NO: 3378873 - protein, 17 aa, Plasmodium falciparum
YFFYLYIAVSLKYVEER

SEQ ID NO: 3378874 - protein, 18 aa, Plasmodium falciparum
YFGNLGLQKGLHENNIYN

SEQ ID NO: 3378875 - protein, 24 aa, Plasmodium falciparum
YFIKSVPIFFFRTYIGAATKAHAY

SEQ ID NO: 3378876 - protein, 22 aa, Plasmodium falciparum
YFKEAFKFLNFLTNYNRRKHNP

SEQ ID NO: 3378877 - protein, 19 aa, Plasmodium falciparum
YFLSSWKIKTAILKTIIAF

SEQ ID NO: 3378878 - protein, 19 aa, Plasmodium falciparum
YFNCLGFKFNMLNSDYNIL

SEQ ID NO: 3378879 - protein, 24 aa, Plasmodium falciparum
YFNRVCLPICLILAPTRELAVQIF

SEQ ID NO: 3378880 - protein, 17 aa, Plasmodium falciparum
YFPEFNKSSLFYKNNNL

SEQ ID NO: 3378881 - protein, 18 aa, Plasmodium falciparum
YFPNCYILSPGIGAQNGD

SEQ ID NO: 3378882 - protein, 19 aa, Plasmodium falciparum
YFSDMMVYISWVPKSARCQ

SEQ ID NO: 3378883 - protein, 22 aa, Plasmodium falciparum
YFSKLRMGLNMLLKHEKKSKRG

SEQ ID NO: 3378884 - protein, 24 aa, Plasmodium falciparum
YFSKSPRGVGKWNAYFQIANNKRL

SEQ ID NO: 3378885 - protein, 19 aa, Plasmodium falciparum
YFSSCLFLIKFLEHVENLK

SEQ ID NO: 3378886 - protein, 18 aa, Plasmodium falciparum
YFVNYRAVVVKTKHYYVT

SEQ ID NO: 3378887 - protein, 17 aa, Plasmodium falciparum
YFYSLEIFLKIFIKCLN

SEQ ID NO: 3378888 - protein, 17 aa, Plasmodium falciparum
YGCREVCKIYILNNNLL

SEQ ID NO: 3378889 - protein, 18 aa, Plasmodium falciparum
YGNCLPVEKLELMRMNLQ

SEQ ID NO: 3378890 - protein, 17 aa, Plasmodium falciparum
YGVGFKMSFARISSSCA

SEQ ID NO: 3378891 - protein, 21 aa, Plasmodium falciparum
YHCFKCLKSVLHICIDDEDSN

SEQ ID NO: 3378892 - protein, 19 aa, Plasmodium falciparum
YHKMSCLNYVYPYNPYRNK

SEQ ID NO: 3378893 - protein, 23 aa, Plasmodium falciparum
YIAVDMAIYWNKFLYMNPCFTKK

SEQ ID NO: 3378894 - protein, 31 aa, Plasmodium falciparum
YICCNSALCRFKLTCNFKFLQFNQAYNTFNI

SEQ ID NO: 3378895 - protein, 17 aa, Plasmodium falciparum
YIILKGYYKNVCKKYRQ

SEQ ID NO: 3378896 - protein, 24 aa, Plasmodium falciparum
YIKKKAAMCAIRILKKTNDIEELF

SEQ ID NO: 3378897 - protein, 28 aa, Plasmodium falciparum
YILPGFKGKHMVGFTCFLKRGTQNPVPP

SEQ ID NO: 3378898 - protein, 17 aa, Plasmodium falciparum
YIPRARYFLTFCKNEKC

SEQ ID NO: 3378899 - protein, 19 aa, Plasmodium falciparum
YIRACGFLYLRYVHSPANL

SEQ ID NO: 3378900 - protein, 26 aa, Plasmodium falciparum
YKAHFPNSYMLFRFVNKGIYQVNIPN

SEQ ID NO: 3378901 - protein, 19 aa, Plasmodium falciparum
YKAKLCFVDLAGSERASAT

SEQ ID NO: 3378902 - protein, 18 aa, Plasmodium falciparum
YKCEICGNYSYFGRATFE

SEQ ID NO: 3378903 - protein, 20 aa, Plasmodium falciparum
YKCELRPLMKICHYPKIGQM

SEQ ID NO: 3378904 - protein, 18 aa, Plasmodium falciparum
YKDTFPYYLSMNDKKNRA

SEQ ID NO: 3378905 - protein, 20 aa, Plasmodium falciparum
YKFGFEEARRLAIQHRKNFE

SEQ ID NO: 3378906 - protein, 17 aa, Plasmodium falciparum
YKFIKGVCPKSFGIHIA

SEQ ID NO: 3378907 - protein, 18 aa, Plasmodium falciparum
YKFKSDYAISYFDMSFFH

SEQ ID NO: 3378908 - protein, 18 aa, Plasmodium falciparum
YKGSCAVIKKVLPDEDLV

SEQ ID NO: 3378909 - protein, 21 aa, Plasmodium falciparum
YKGYGLCCGIILSGYDHTGFN

SEQ ID NO: 3378910 - protein, 30 aa, Plasmodium falciparum
YKIKNVCIIECIYHYLQLFKYEGIDFKTVI

SEQ ID NO: 3378911 - protein, 26 aa, Plasmodium falciparum
YKIQEAYLLDCLQKCMIDLNLNSVMS

SEQ ID NO: 3378912 - protein, 22 aa, Plasmodium falciparum
YKKCKETYLYLCANSNININNY

SEQ ID NO: 3378913 - protein, 22 aa, Plasmodium falciparum
YKKCKRIERIFSVNKYGFEGAR

SEQ ID NO: 3378914 - protein, 19 aa, Plasmodium falciparum
YKKSCLFQSSLNKKKENHS

SEQ ID NO: 3378915 - protein, 19 aa, Plasmodium falciparum
YKLKFCLEKEILDNTIQHN

SEQ ID NO: 3378916 - protein, 20 aa, Plasmodium falciparum
YKMNDMLGGIILPNNNQLNN

SEQ ID NO: 3378917 - protein, 20 aa, Plasmodium falciparum
YKNCKKRCIQFIEDDTICND

SEQ ID NO: 3378918 - protein, 18 aa, Plasmodium falciparum
YKRINILLVTGRLIYYER

SEQ ID NO: 3378919 - protein, 21 aa, Plasmodium falciparum
YKRISTCLIKSSLVKDYEKSQ

SEQ ID NO: 3378920 - protein, 22 aa, Plasmodium falciparum
YKSCLPFRSFGFLPKRMCDVYK

SEQ ID NO: 3378921 - protein, 17 aa, Plasmodium falciparum
YKSDCDMQSFPFNNKWF

SEQ ID NO: 3378922 - protein, 18 aa, Plasmodium falciparum
YKSFDDFKINYSYKTKNH

SEQ ID NO: 3378923 - protein, 17 aa, Plasmodium falciparum
YKSNLIVCSALKSDKRC

SEQ ID NO: 3378924 - protein, 22 aa, Plasmodium falciparum
YKTAMCRNFIKNMCFKSKKECN

SEQ ID NO: 3378925 - protein, 18 aa, Plasmodium falciparum
YKTVFLCYPCVYRSIEDF

SEQ ID NO: 3378926 - protein, 21 aa, Plasmodium falciparum
YKVKIKPVFFERKIKISENKI

SEQ ID NO: 3378927 - protein, 17 aa, Plasmodium falciparum
YKYQWIILLPFVDKERI

SEQ ID NO: 3378928 - protein, 17 aa, Plasmodium falciparum
YKYRSNIIFTINKIKNL

SEQ ID NO: 3378929 - protein, 25 aa, Plasmodium falciparum
YLDFCEAWSKFKFRNLASHANDQIN

SEQ ID NO: 3378930 - protein, 17 aa, Plasmodium falciparum
YLFKINKIRGYHILKLT

SEQ ID NO: 3378931 - protein, 19 aa, Plasmodium falciparum
YLGSYGCNYPYNNNYYVDE

SEQ ID NO: 3378932 - protein, 22 aa, Plasmodium falciparum
YLKKEVCLIPFKFFDIDGNGKI

SEQ ID NO: 3378933 - protein, 19 aa, Plasmodium falciparum
YLLGNPVNLFWLGGPLPGL

SEQ ID NO: 3378934 - protein, 24 aa, Plasmodium falciparum
YLLTCGHAICKNCVDKIHAQRSRQ

SEQ ID NO: 3378935 - protein, 28 aa, Plasmodium falciparum
YLQKELTCPICLDYFYLPVTMNCGHTFC

SEQ ID NO: 3378936 - protein, 20 aa, Plasmodium falciparum
YLRNLPCWNLLKLNPIHPNN

SEQ ID NO: 3378937 - protein, 25 aa, Plasmodium falciparum
YNEMKTRVMEIFKRENIMSDDYLLY

SEQ ID NO: 3378938 - protein, 23 aa, Plasmodium falciparum
YNFLKKHNWPVFSFHKNLSLNSR

SEQ ID NO: 3378939 - protein, 23 aa, Plasmodium falciparum
YNKKNDCMFLFKDNLSISGLGNV

SEQ ID NO: 3378940 - protein, 17 aa, Plasmodium falciparum
YNKSGNSPLMWSIQNKH

SEQ ID NO: 3378941 - protein, 20 aa, Plasmodium falciparum
YNLKGEIKKIHAFFPGDENN

SEQ ID NO: 3378942 - protein, 17 aa, Plasmodium falciparum
YNLKMGKGYKVQTITNN

SEQ ID NO: 3378943 - protein, 17 aa, Plasmodium falciparum
YNMMNDFYNYFPFNYYY

SEQ ID NO: 3378944 - protein, 32 aa, Plasmodium falciparum
YNNFDIIKFIMKWIFVHVIKIFVKDTYMLYIN

SEQ ID NO: 3378945 - protein, 26 aa, Plasmodium falciparum
YNNIPIFYFRKLFKYIIEQNNNNNNN

SEQ ID NO: 3378946 - protein, 17 aa, Plasmodium falciparum
YNQQSQCSLIWNGVVKK

SEQ ID NO: 3378947 - protein, 17 aa, Plasmodium falciparum
YNRILKCYEKLDFMITN

SEQ ID NO: 3378948 - protein, 17 aa, Plasmodium falciparum
YNRYRINSITSINDNTS

SEQ ID NO: 3378949 - protein, 23 aa, Plasmodium falciparum
YNSLKINLFFLFDDMYDKFFIEN

SEQ ID NO: 3378950 - protein, 17 aa, Plasmodium falciparum
YNTIDFKICPPICSHME

SEQ ID NO: 3378951 - protein, 17 aa, Plasmodium falciparum
YNYLGSYGCNYPYNNNY

SEQ ID NO: 3378952 - protein, 20 aa, Plasmodium falciparum
YPCHICKLDLLHILKKYHLN

SEQ ID NO: 3378953 - protein, 18 aa, Plasmodium falciparum
YPKKVWKKLIEYFLNMTK

SEQ ID NO: 3378954 - protein, 17 aa, Plasmodium falciparum
YPRFCVNDNKIAMECEY

SEQ ID NO: 3378955 - protein, 27 aa, Plasmodium falciparum
YQCLRCFQCPFCFSTLITCHELVDETK

SEQ ID NO: 3378956 - protein, 19 aa, Plasmodium falciparum
YQQRWSVNWIEDGKRVAKY

SEQ ID NO: 3378957 - protein, 17 aa, Plasmodium falciparum
YQSCYPLSYLNVYNNNN

SEQ ID NO: 3378958 - protein, 20 aa, Plasmodium falciparum
YRDIKHVISYYVVKHNYDKN

SEQ ID NO: 3378959 - protein, 18 aa, Plasmodium falciparum
YRFSLPFDENKIFRKSSS

SEQ ID NO: 3378960 - protein, 18 aa, Plasmodium falciparum
YRHASVFVRRYIKKSKSI

SEQ ID NO: 3378961 - protein, 18 aa, Plasmodium falciparum
YRLKSFRSVHSVFDKEHT

SEQ ID NO: 3378962 - protein, 19 aa, Plasmodium falciparum
YRMSLEKFIQFTIKEHIVY

SEQ ID NO: 3378963 - protein, 18 aa, Plasmodium falciparum
YRNSINAWNGWPSFNDLY

SEQ ID NO: 3378964 - protein, 21 aa, Plasmodium falciparum
YRRFYRFLLYDGKSFIYAYEQ

SEQ ID NO: 3378965 - protein, 20 aa, Plasmodium falciparum
YRSYLLYKYKTTYSVCDEAF

SEQ ID NO: 3378966 - protein, 24 aa, Plasmodium falciparum
YRWLRIIKKSLFIKFFDGTLFDTK

SEQ ID NO: 3378967 - protein, 25 aa, Plasmodium falciparum
YSGNITRWIICWSYYNPEQIDALKK

SEQ ID NO: 3378968 - protein, 22 aa, Plasmodium falciparum
YSKEELIHIIALLKKENQRLKM

SEQ ID NO: 3378969 - protein, 17 aa, Plasmodium falciparum
YSLLFGIHYRELSKDVV

SEQ ID NO: 3378970 - protein, 23 aa, Plasmodium falciparum
YSSWKGGSILASFKNFNSFFVTR

SEQ ID NO: 3378971 - protein, 17 aa, Plasmodium falciparum
YSYKNGRNGVYYNEYGK

SEQ ID NO: 3378972 - protein, 21 aa, Plasmodium falciparum
YTCEKICKFFHIITNTKNIEE

SEQ ID NO: 3378973 - protein, 17 aa, Plasmodium falciparum
YTCHTCNIQIYNYSFFR

SEQ ID NO: 3378974 - protein, 17 aa, Plasmodium falciparum
YTLLEMMKVLKLLIHYA

SEQ ID NO: 3378975 - protein, 21 aa, Plasmodium falciparum
YTWRCPFLLGKSCNKAMRIDH

SEQ ID NO: 3378976 - protein, 24 aa, Plasmodium falciparum
YVEYKIILCKLLYININNLTIQNF

SEQ ID NO: 3378977 - protein, 21 aa, Plasmodium falciparum
YVFTCFINFCIHYKNISICKA

SEQ ID NO: 3378978 - protein, 19 aa, Plasmodium falciparum
YVILQLCWKCCDIENNHFE

SEQ ID NO: 3378979 - protein, 18 aa, Plasmodium falciparum
YYDTKEILAYLLPYHTYY

SEQ ID NO: 3378980 - protein, 19 aa, Plasmodium falciparum
YYFLNCSWDLVMFECDENV

SEQ ID NO: 3378981 - protein, 18 aa, Plasmodium falciparum
YYPLCSVSMHTKCVEKLL

SEQ ID NO: 3378982 - protein, 18 aa, Plasmodium falciparum
YYRKGCSYLLLSDLKRAS

SEQ ID NO: 3378983 - protein, 22 aa, Plasmodium falciparum
YYSLKLPKFIDVCLDIKKKKNN

SEQ ID NO: 3378984 - protein, 26 aa, Plasmodium falciparum
YYWIPCFFENIIACFFKIWKSNYFIV

SEQ ID NO: 3378985 - protein, 25 aa, Plasmodium falciparum
NTKVPIFVKLFFGKSIFIEDIFYYV

SEQ ID NO: 3378986 - protein, 32 aa, Plasmodium falciparum
ETQEKSHTKKKKSSWLKFGRGNKNDKKSKNEK

SEQ ID NO: 3378987 - protein, 25 aa, Plasmodium falciparum
QKESTLHLVLRLRGGMQIFVKTLTG

SEQ ID NO: 3378988 - protein, 26 aa, Plasmodium falciparum
DEMKNYIYVFIKYYDTFKNDLFNEHK

SEQ ID NO: 3378989 - protein, 17 aa, Plasmodium falciparum
DFTIMVLDLLGPSLEDL

SEQ ID NO: 3378990 - protein, 24 aa, Plasmodium falciparum
EALGYVLMYFLRGSLPWQGLKAIS

SEQ ID NO: 3378991 - protein, 24 aa, Plasmodium falciparum
NTKVPIFVKLFFGKSIFIEDIFYY

SEQ ID NO: 3378992 - protein, 26 aa, Plasmodium falciparum
RFEDRPDYTYLRRLLKDLFIREGFTY

SEQ ID NO: 3378993 - protein, 25 aa, Plasmodium falciparum
SKHPQLLYESKLYKILGGGIGVPKV

SEQ ID NO: 3378994 - protein, 24 aa, Plasmodium falciparum
AASGFYWRKKLKKYKLRNKLNDEK

SEQ ID NO: 3378995 - protein, 34 aa, Plasmodium falciparum
CEKKHLFNISLFHVIHNLWCPHDFCLFQCKGSYS

SEQ ID NO: 3378996 - protein, 22 aa, Plasmodium falciparum
CYDKDIIKKILICVLYNINNVD

SEQ ID NO: 3378997 - protein, 26 aa, Plasmodium falciparum
DCGAKCPRWASINLGIIICIECSGIH

SEQ ID NO: 3378998 - protein, 25 aa, Plasmodium falciparum
DEENEDIYAWLKRAGKFKATQRTEG

SEQ ID NO: 3378999 - protein, 36 aa, Plasmodium falciparum
DILQTPVKPLGKTFLKLLRLLHINVPNIDPSLFLER

SEQ ID NO: 3379000 - protein, 23 aa, Plasmodium falciparum
DITRLFYIIQIILINIKNNIYTT

SEQ ID NO: 3379001 - protein, 26 aa, Plasmodium falciparum
DNKKTTLFVFYLPPHWNDQDLFDKFK

SEQ ID NO: 3379002 - protein, 25 aa, Plasmodium falciparum
ECSVGRLWTILKCKDLMISMRKCLK

SEQ ID NO: 3379003 - protein, 28 aa, Plasmodium falciparum
EIDNLMDSIGKIDIFGSLKILDENKVDD

SEQ ID NO: 3379004 - protein, 30 aa, Plasmodium falciparum
EKEPRHDLYLLFLLKFISGVIPTIEYDFTT

SEQ ID NO: 3379005 - protein, 25 aa, Plasmodium falciparum
EPPKRPYDKPLRIPLQGVYKIGGIG

SEQ ID NO: 3379006 - protein, 30 aa, Plasmodium falciparum
EVFNDKRKKMLLKLIVLLGNQINSEIKKKF

SEQ ID NO: 3379007 - protein, 18 aa, Plasmodium falciparum
FKSNMFRNILFNKKYRIE

SEQ ID NO: 3379008 - protein, 28 aa, Plasmodium falciparum
FNKKYRIEDLYYIKLKYDDLSNIEKKEE

SEQ ID NO: 3379009 - protein, 20 aa, Plasmodium falciparum
FRNILFNKKYRIEDLYYIKL

SEQ ID NO: 3379010 - protein, 25 aa, Plasmodium falciparum
GLLEKYDIPNPFEKYYKDSIDYSQL

SEQ ID NO: 3379011 - protein, 25 aa, Plasmodium falciparum
GYIENPIYYNPYMRNYFSPHNNNSS

SEQ ID NO: 3379012 - protein, 27 aa, Plasmodium falciparum
HIEAAQRIYLMALQRNFTMGRNNSYVA

SEQ ID NO: 3379013 - protein, 19 aa, Plasmodium falciparum
HISKVKSLTLDKIMPQWIN

SEQ ID NO: 3379014 - protein, 18 aa, Plasmodium falciparum
HMIPMDKNRFMDKGDVGV

SEQ ID NO: 3379015 - protein, 23 aa, Plasmodium falciparum
HRVGLLDYLNKVEINLNAFAKII

SEQ ID NO: 3379016 - protein, 18 aa, Plasmodium falciparum
IDKNLDDILNYKTKDFNN

SEQ ID NO: 3379017 - protein, 30 aa, Plasmodium falciparum
IGNDLSNAYYLYNLPKDAYIPKQGDSSIIM

SEQ ID NO: 3379018 - protein, 23 aa, Plasmodium falciparum
IKKMQELYNDKPNLKYILMNVCD

SEQ ID NO: 3379019 - protein, 20 aa, Plasmodium falciparum
IRLKVIFRLVIFQPFENEII

SEQ ID NO: 3379020 - protein, 24 aa, Plasmodium falciparum
KFDPSNMTILNLIEDIKWDMDLEY

SEQ ID NO: 3379021 - protein, 19 aa, Plasmodium falciparum
KFETPRYFFTVIDAPGHKD

SEQ ID NO: 3379022 - protein, 29 aa, Plasmodium falciparum
KYKGNLINIFFIYSDIQQLIFTYKCEKKH

SEQ ID NO: 3379023 - protein, 30 aa, Plasmodium falciparum
KYVNSQPVPMPFFPQVPYPNYYASSHGMSP

SEQ ID NO: 3379024 - protein, 30 aa, Plasmodium falciparum
LCNTYKEEYFLYVSNNYYKFIVKSMERAEI

SEQ ID NO: 3379025 - protein, 17 aa, Plasmodium falciparum
LFSLGNLYRYIDNNIAL

SEQ ID NO: 3379026 - protein, 22 aa, Plasmodium falciparum
LNKKIEEHILSDELKNLKIDRN

SEQ ID NO: 3379027 - protein, 25 aa, Plasmodium falciparum
MEKQKRLFLQAKVFCLFNSYGTLPV

SEQ ID NO: 3379028 - protein, 25 aa, Plasmodium falciparum
NIDPSLFLERFAHKLNLKNDIYKVT

SEQ ID NO: 3379029 - protein, 25 aa, Plasmodium falciparum
NMHMTNNMPYGIRKELIINDNNNNN

SEQ ID NO: 3379030 - protein, 27 aa, Plasmodium falciparum
PNIEYYPNVPIFPESQNQMFPYADPNF

SEQ ID NO: 3379031 - protein, 30 aa, Plasmodium falciparum
QNISNTLVNLPYIPMIPPNITTVTNHNNNM

SEQ ID NO: 3379032 - protein, 29 aa, Plasmodium falciparum
QNNNAKLFNLALTVIIYDSFNNTLCNTYK

SEQ ID NO: 3379033 - protein, 18 aa, Plasmodium falciparum
QSIKMKKNLIRWGEKVTD

SEQ ID NO: 3379034 - protein, 23 aa, Plasmodium falciparum
QTPRIWLFGYNENGDPLKSEEIF

SEQ ID NO: 3379035 - protein, 19 aa, Plasmodium falciparum
QYILIIEKETIFYKLLQSN

SEQ ID NO: 3379036 - protein, 20 aa, Plasmodium falciparum
RDLLEYVSALMLFSTKKVDC

SEQ ID NO: 3379037 - protein, 17 aa, Plasmodium falciparum
RDRMRNFGYRNNGYRHD

SEQ ID NO: 3379038 - protein, 27 aa, Plasmodium falciparum
RERGITIDIALWKFETPRYFFTVIDAP

SEQ ID NO: 3379039 - protein, 27 aa, Plasmodium falciparum
RKIKPGCTIFVFYLPNDWSDKDLKRHF

SEQ ID NO: 3379040 - protein, 24 aa, Plasmodium falciparum
RREKSPIMLIDFSDILQTPVKPLG

SEQ ID NO: 3379041 - protein, 17 aa, Plasmodium falciparum
SFILSWGIRESREISLQ

SEQ ID NO: 3379042 - protein, 25 aa, Plasmodium falciparum
SHAQPAYRLVYLQKEDYNWDITVKT

SEQ ID NO: 3379043 - protein, 26 aa, Plasmodium falciparum
SRMDQKFDLMYAKRAFVHWYVGEGME

SEQ ID NO: 3379044 - protein, 18 aa, Plasmodium falciparum
TLRQIFYTNPKLFINQRN

SEQ ID NO: 3379045 - protein, 26 aa, Plasmodium falciparum
VKSLTLDKIMPQWINCIKNIGNDLSN

SEQ ID NO: 3379046 - protein, 27 aa, Plasmodium falciparum
YYDNDVMLTLLRLFCLYPHCYDKDIIK

SEQ ID NO: 3379047 - protein, 27 aa, Plasmodium falciparum
AACLYGLIHSRFILTSKGLALMREKYK

SEQ ID NO: 3379048 - protein, 20 aa, Plasmodium falciparum
AAESFLYYNVKGRNPSIIRK

SEQ ID NO: 3379049 - protein, 23 aa, Plasmodium falciparum
AAGACIEQWLYKSYNCSIVSYVH

SEQ ID NO: 3379050 - protein, 26 aa, Plasmodium falciparum
AAIDTSNWPLLLKNYDKLNIRTSHFT

SEQ ID NO: 3379051 - protein, 25 aa, Plasmodium falciparum
AAINDAPLYIEVKGLLEVINAQDFA

SEQ ID NO: 3379052 - protein, 17 aa, Plasmodium falciparum
AAKEFMDGGQIDGKIIS

SEQ ID NO: 3379053 - protein, 19 aa, Plasmodium falciparum
AAMTFLCLIQHDQSIESLI

SEQ ID NO: 3379054 - protein, 25 aa, Plasmodium falciparum
AANTVVFGELFWVPGQIIQAEDRAH

SEQ ID NO: 3379055 - protein, 22 aa, Plasmodium falciparum
AANVVIFYDTDWNPSIDKQAMD

SEQ ID NO: 3379056 - protein, 17 aa, Plasmodium falciparum
AAQKWLFSLGITITLGR

SEQ ID NO: 3379057 - protein, 18 aa, Plasmodium falciparum
AAYLYLIPSSIKASMELF

SEQ ID NO: 3379058 - protein, 25 aa, Plasmodium falciparum
ACAPYRRLHICDRNLELIKPDQITS

SEQ ID NO: 3379059 - protein, 26 aa, Plasmodium falciparum
ACDIRESVLIFFYDPNQNTLRLISDD

SEQ ID NO: 3379060 - protein, 52 aa, Plasmodium falciparum
ACECVLLELLLKNDILNVLRKYKIFKTEKYEYLYVNLLAMLKHYNYFSTIES

SEQ ID NO: 3379061 - protein, 19 aa, Plasmodium falciparum
ACFIIPILQDLKVNKQSFY

SEQ ID NO: 3379062 - protein, 19 aa, Plasmodium falciparum
ACIDYKLLYQSLVNAIETP

SEQ ID NO: 3379063 - protein, 18 aa, Plasmodium falciparum
ACINLHFFAYESRIFYFH

SEQ ID NO: 3379064 - protein, 32 aa, Plasmodium falciparum
ACINTIISNLVRIYNLRRKSLKIYKSIEIVNT

SEQ ID NO: 3379065 - protein, 25 aa, Plasmodium falciparum
ACKEYLILFLVPMSAVRDVITTISS

SEQ ID NO: 3379066 - protein, 39 aa, Plasmodium falciparum
ACKKDTFDFLIDLIPLEDRMKFINLHMKMNSRKSQTNMN

SEQ ID NO: 3379067 - protein, 17 aa, Plasmodium falciparum
ACKKFLFNIYMMKPEHI

SEQ ID NO: 3379068 - protein, 35 aa, Plasmodium falciparum
ACKWNLVFLNGQCSSFLNIFFKVFEAAKKNRPLVG

SEQ ID NO: 3379069 - protein, 26 aa, Plasmodium falciparum
ACLECGFKLVIKYINSSHLSLKQKKQ

SEQ ID NO: 3379070 - protein, 19 aa, Plasmodium falciparum
ACMDCAYKLHYRKINKYLK

SEQ ID NO: 3379071 - protein, 37 aa, Plasmodium falciparum
ACNCKYRVVLKRYTLLEMMKVLKLLIHYANKIRKSDE

SEQ ID NO: 3379072 - protein, 18 aa, Plasmodium falciparum
ACNHLYYEMIKKANIQIV

SEQ ID NO: 3379073 - protein, 36 aa, Plasmodium falciparum
ACNKNVERSLPYFNWLVSIVLDNKIDMESFKHCWKS

SEQ ID NO: 3379074 - protein, 25 aa, Plasmodium falciparum
ACNSQYIKPLLYYSLHTCIVGDNEY

SEQ ID NO: 3379075 - protein, 20 aa, Plasmodium falciparum
ADAQYLHELLTRKNINNLSE

SEQ ID NO: 3379076 - protein, 39 aa, Plasmodium falciparum
ADDESIIFINNPNYVMVLLFLTVYKDVLKMNWNFKDIEE

SEQ ID NO: 3379077 - protein, 25 aa, Plasmodium falciparum
ADDVRLIRNLLGPRGRHIKIIPKIE

SEQ ID NO: 3379078 - protein, 28 aa, Plasmodium falciparum
ADEFVHLWRIFIKDDISIKCLGRFIGHS

SEQ ID NO: 3379079 - protein, 25 aa, Plasmodium falciparum
ADEILCHRLGLIPFKFDADLINYKE

SEQ ID NO: 3379080 - protein, 35 aa, Plasmodium falciparum
ADHHVGLYYLLYMRKYLFPSLDDPLILIPITLKKW

SEQ ID NO: 3379081 - protein, 23 aa, Plasmodium falciparum
ADHINFMEIFKKKKKKKYNHKNN

SEQ ID NO: 3379082 - protein, 48 aa, Plasmodium falciparum
ADIIRKDYAIPTDTYNILMKPYNFLNRIQTKYFVYVDNNKLSLTNNNN

SEQ ID NO: 3379083 - protein, 23 aa, Plasmodium falciparum
ADKHKRIYLFNNVNIYILHGNLS

SEQ ID NO: 3379084 - protein, 24 aa, Plasmodium falciparum
ADKIRIQKWYIIYKDHITLQDYEI

SEQ ID NO: 3379085 - protein, 26 aa, Plasmodium falciparum
ADLCQTLKWRSPNFEMKKKTSFEIAL

SEQ ID NO: 3379086 - protein, 23 aa, Plasmodium falciparum
ADNGYILIFDFRIKSNEPAQQTL

SEQ ID NO: 3379087 - protein, 23 aa, Plasmodium falciparum
ADNHNNWIYYPKNTGGGCKKLFR

SEQ ID NO: 3379088 - protein, 22 aa, Plasmodium falciparum
ADNKFNLYSYGTGNALYTLERI

SEQ ID NO: 3379089 - protein, 21 aa, Plasmodium falciparum
ADNMDYIIKIKRKKKKVLDDE

SEQ ID NO: 3379090 - protein, 17 aa, Plasmodium falciparum
ADPNFCKNGRMRPIYQN

SEQ ID NO: 3379091 - protein, 29 aa, Plasmodium falciparum
ADTASRVFVLKYAWKYIKDNNLQNPNMKR

SEQ ID NO: 3379092 - protein, 27 aa, Plasmodium falciparum
ADVILLEVIHLFKKLYIPHVFDDSYLL

SEQ ID NO: 3379093 - protein, 26 aa, Plasmodium falciparum
AEAKPLLLSVLTARIPQVPITEDSYL

SEQ ID NO: 3379094 - protein, 25 aa, Plasmodium falciparum
AEEEGYLLANILFDELKNNKKKKAH

SEQ ID NO: 3379095 - protein, 24 aa, Plasmodium falciparum
AEEENYWVLLPDNLKNIVKSELIS

SEQ ID NO: 3379096 - protein, 35 aa, Plasmodium falciparum
AEESLFPMLNVDDKYYELLKTSIIICLNDILMNCI

SEQ ID NO: 3379097 - protein, 25 aa, Plasmodium falciparum
AEETVENIILYSLLGNIKEEEKNIW

SEQ ID NO: 3379098 - protein, 19 aa, Plasmodium falciparum
AEFCIFNFFLKMYRYEERN

SEQ ID NO: 3379099 - protein, 23 aa, Plasmodium falciparum
AEFESVLSYLKKYEMKSSKGMNK

SEQ ID NO: 3379100 - protein, 18 aa, Plasmodium falciparum
AEFFYFNSINQKTLNVCI

SEQ ID NO: 3379101 - protein, 30 aa, Plasmodium falciparum
AEFYLKLDNDVLIKFPFLHVDHPLHRYYEF

SEQ ID NO: 3379102 - protein, 19 aa, Plasmodium falciparum
AEHILKVQKAILKSQGQKN

SEQ ID NO: 3379103 - protein, 32 aa, Plasmodium falciparum
AEIKEDYFIIQLNIITVFLSDSYMKRVNMKDT

SEQ ID NO: 3379104 - protein, 30 aa, Plasmodium falciparum
AEKELYNKSIPFILRRYLPNGSYEDWRLDE

SEQ ID NO: 3379105 - protein, 27 aa, Plasmodium falciparum
AEKFSTYFFNSPIFTIPGKIFPVEILH

SEQ ID NO: 3379106 - protein, 20 aa, Plasmodium falciparum
AEKIIAYRIVEAFQQTVCGF

SEQ ID NO: 3379107 - protein, 18 aa, Plasmodium falciparum
AEKKDFLLSPLKNNVLFS

SEQ ID NO: 3379108 - protein, 22 aa, Plasmodium falciparum
AEKPHLYNMKEKKKNNINVNKC

SEQ ID NO: 3379109 - protein, 26 aa, Plasmodium falciparum
AEKRRIELEVLLYEEKMRQEGSKNIE

SEQ ID NO: 3379110 - protein, 24 aa, Plasmodium falciparum
AELGMIKILKFLHCFYNFINTYIK

SEQ ID NO: 3379111 - protein, 25 aa, Plasmodium falciparum
AELIRIFSIYSIYCGGIAEYVMNKR

SEQ ID NO: 3379112 - protein, 33 aa, Plasmodium falciparum
AENINKKEKLPRFSNLSLLNDDFFLKSQNLDMN

SEQ ID NO: 3379113 - protein, 17 aa, Plasmodium falciparum
AENKVRKTNAYLTEQCI

SEQ ID NO: 3379114 - protein, 17 aa, Plasmodium falciparum
AENLYVLKNAQLSLFEA

SEQ ID NO: 3379115 - protein, 18 aa, Plasmodium falciparum
AENYYPYQRSGSTVFHNF

SEQ ID NO: 3379116 - protein, 17 aa, Plasmodium falciparum
AEQYALEALKLDPNYYK

SEQ ID NO: 3379117 - protein, 27 aa, Plasmodium falciparum
AEQYPLSFYLNYYKTKKLRKLLEEIPN

SEQ ID NO: 3379118 - protein, 18 aa, Plasmodium falciparum
AERLGLERIGWIFTHLPR

SEQ ID NO: 3379119 - protein, 21 aa, Plasmodium falciparum
AERPQFLRWITEWYDDYCHTR

SEQ ID NO: 3379120 - protein, 25 aa, Plasmodium falciparum
AESLIQHPFIFIHNKNRSCIKSYAT

SEQ ID NO: 3379121 - protein, 27 aa, Plasmodium falciparum
AETRVPGTYKLPFTNGIDIPNIPNVII

SEQ ID NO: 3379122 - protein, 19 aa, Plasmodium falciparum
AEWVLNITSFYKIIQNILP

SEQ ID NO: 3379123 - protein, 25 aa, Plasmodium falciparum
AFASYNFWLYDLCDIYLELIKPRLN

SEQ ID NO: 3379124 - protein, 35 aa, Plasmodium falciparum
AFCACLIVCYDLLKPDYILEIVWTSGFKDQAMLYF

SEQ ID NO: 3379125 - protein, 18 aa, Plasmodium falciparum
AFCIIKVIASLRLDSYKK

SEQ ID NO: 3379126 - protein, 26 aa, Plasmodium falciparum
AFDELISEFKKKFLHKIIKVLEEAKY

SEQ ID NO: 3379127 - protein, 36 aa, Plasmodium falciparum
AFGGFIVYLRSLLLDKKIFRFCKIEKYDLFKRETYM

SEQ ID NO: 3379128 - protein, 25 aa, Plasmodium falciparum
AFGKSPFIYPLYGLGGIPEGFSRMC

SEQ ID NO: 3379129 - protein, 35 aa, Plasmodium falciparum
AFISNSYIRYKKLPLYLEWAPLNLFAKQKDIEDDN

SEQ ID NO: 3379130 - protein, 23 aa, Plasmodium falciparum
AFKKLRLYYHQISYNNLNKDICL

SEQ ID NO: 3379131 - protein, 28 aa, Plasmodium falciparum
AFLASQVILPQIPKLLGPGLNKAGKFPS

SEQ ID NO: 3379132 - protein, 18 aa, Plasmodium falciparum
AFLEAKNTVFPSLKKYNT

SEQ ID NO: 3379133 - protein, 32 aa, Plasmodium falciparum
AFLNEYHPGITPKLYKILYEPDNKYFNEGLSQ

SEQ ID NO: 3379134 - protein, 33 aa, Plasmodium falciparum
AFLSYIEFYKNHQLKFIFSFNKLNLTHLCYAFS

SEQ ID NO: 3379135 - protein, 19 aa, Plasmodium falciparum
AFPLKCKMHLLNNSFNNLI

SEQ ID NO: 3379136 - protein, 18 aa, Plasmodium falciparum
AFQLIHVIEYFETLKNKN

SEQ ID NO: 3379137 - protein, 24 aa, Plasmodium falciparum
AFRQHEFRILFDEYFDEISNEKYR

SEQ ID NO: 3379138 - protein, 33 aa, Plasmodium falciparum
AFSSPFKNEYNSRLKFLYTGCLSFANLNIDKPS

SEQ ID NO: 3379139 - protein, 26 aa, Plasmodium falciparum
AFTHEHLYQLLAISAAKMCEEPFALL

SEQ ID NO: 3379140 - protein, 17 aa, Plasmodium falciparum
AFTLSKLDFIVRYKNMV

SEQ ID NO: 3379141 - protein, 17 aa, Plasmodium falciparum
AFVFFIIKNVGVHKITY

SEQ ID NO: 3379142 - protein, 18 aa, Plasmodium falciparum
AFVFKYNIVITTIDLQHL

SEQ ID NO: 3379143 - protein, 26 aa, Plasmodium falciparum
AFVLGQVLHLNSLKYLLSSLTNVSEH

SEQ ID NO: 3379144 - protein, 20 aa, Plasmodium falciparum
AFVLPCFMHILKHKEIIQNN

SEQ ID NO: 3379145 - protein, 23 aa, Plasmodium falciparum
AFYKHIGIHKLKFKPTFNPYTEP

SEQ ID NO: 3379146 - protein, 33 aa, Plasmodium falciparum
AGFEALVEKQYKFFMKLPYITVSEMLTNLFNFR

SEQ ID NO: 3379147 - protein, 27 aa, Plasmodium falciparum
AGIDRESFEYLLDYFHNMTLKKRLSIR

SEQ ID NO: 3379148 - protein, 20 aa, Plasmodium falciparum
AGLALDYYVQKLESFKCLFF

SEQ ID NO: 3379149 - protein, 27 aa, Plasmodium falciparum
AGLYENKIIQDILLTTGINKVPSENVL

SEQ ID NO: 3379150 - protein, 18 aa, Plasmodium falciparum
AGMDKYQQRCNVAYNNYD

SEQ ID NO: 3379151 - protein, 18 aa, Plasmodium falciparum
AGTVLYMAPEVFKKKFTI

SEQ ID NO: 3379152 - protein, 20 aa, Plasmodium falciparum
AHDRLFNKQYFYIFNMESIK

SEQ ID NO: 3379153 - protein, 20 aa, Plasmodium falciparum
AHERFYVAEALFNPQLCHRD

SEQ ID NO: 3379154 - protein, 17 aa, Plasmodium falciparum
AHFNRYNNFNYHDKYFN

SEQ ID NO: 3379155 - protein, 28 aa, Plasmodium falciparum
AHIFDLLSRLRQAADHPYLIIFGNSFLS

SEQ ID NO: 3379156 - protein, 25 aa, Plasmodium falciparum
AHKKTPFAFGLFKLQVSCVIVDDLV

SEQ ID NO: 3379157 - protein, 25 aa, Plasmodium falciparum
AHKLEGPTTLSVLHDKILKETIDQN

SEQ ID NO: 3379158 - protein, 25 aa, Plasmodium falciparum
AHLLSSLCYIFYKYNFEHLHFFECL

SEQ ID NO: 3379159 - protein, 34 aa, Plasmodium falciparum
AHLYNNKLHMILSLIILSFYNAKKNMGCYFLLDV

SEQ ID NO: 3379160 - protein, 27 aa, Plasmodium falciparum
AHNFLIKLDYNFYYTNKYKLSYQNPTS

SEQ ID NO: 3379161 - protein, 22 aa, Plasmodium falciparum
AHNPLIYDISELYNREKNEEQK

SEQ ID NO: 3379162 - protein, 32 aa, Plasmodium falciparum
AHSHMWEGLLKKDVLLLLIQAIKNMGYKKSAK

SEQ ID NO: 3379163 - protein, 17 aa, Plasmodium falciparum
AHTSIRIGFNRFTTFFE

SEQ ID NO: 3379164 - protein, 25 aa, Plasmodium falciparum
AIACLFIKRTPLWNGFKADFVGFSI

SEQ ID NO: 3379165 - protein, 20 aa, Plasmodium falciparum
AIAYGLHKKGKGEKNILIFD

SEQ ID NO: 3379166 - protein, 17 aa, Plasmodium falciparum
AICTAWNVLKTADLLHV

SEQ ID NO: 3379167 - protein, 19 aa, Plasmodium falciparum
AIDVSIWLYELTYANNVKD

SEQ ID NO: 3379168 - protein, 25 aa, Plasmodium falciparum
AIDWLTWSFFYRRIKKNPNYYGLKG

SEQ ID NO: 3379169 - protein, 18 aa, Plasmodium falciparum
AIEMLPTCNNGNPKVLLY

SEQ ID NO: 3379170 - protein, 26 aa, Plasmodium falciparum
AIENFESLGYVMSGSRHKRMNAIRMR

SEQ ID NO: 3379171 - protein, 33 aa, Plasmodium falciparum
AIESKKYIFITLSRYFLLVKNAILSSPESVKQI

SEQ ID NO: 3379172 - protein, 33 aa, Plasmodium falciparum
AIFTHDIIQILPFLKLLIIQKYSILIFLSKDNF

SEQ ID NO: 3379173 - protein, 17 aa, Plasmodium falciparum
AIGIFERKKPHMNIGTI

SEQ ID NO: 3379174 - protein, 23 aa, Plasmodium falciparum
AIGNLDSLLKNFNILNNYKGKDK

SEQ ID NO: 3379175 - protein, 31 aa, Plasmodium falciparum
AIIKSYLVFVKRFCKYIIKSVIHIEHYYKKI

SEQ ID NO: 3379176 - protein, 19 aa, Plasmodium falciparum
AIISLKHLENRKVSTNLSR

SEQ ID NO: 3379177 - protein, 26 aa, Plasmodium falciparum
AIISVDKYLLFLSLKDDNMLEMTGVN

SEQ ID NO: 3379178 - protein, 25 aa, Plasmodium falciparum
AIKEYISYLIDADIKFLLFCHHKLV

SEQ ID NO: 3379179 - protein, 25 aa, Plasmodium falciparum
AIKHICKLIRIVDNLKAHALLLGIG

SEQ ID NO: 3379180 - protein, 17 aa, Plasmodium falciparum
AILAISMAVCRAGAAAN

SEQ ID NO: 3379181 - protein, 32 aa, Plasmodium falciparum
AIMNSTRKLRRLYFGNLPLHLGLSENAFQEIV

SEQ ID NO: 3379182 - protein, 17 aa, Plasmodium falciparum
AIPNVHKVIIKKSQKMV

SEQ ID NO: 3379183 - protein, 22 aa, Plasmodium falciparum
AIREDIYSTPLFSFTNKLHNSV

SEQ ID NO: 3379184 - protein, 19 aa, Plasmodium falciparum
AIRRLARRGGVKRISGLIY

SEQ ID NO: 3379185 - protein, 24 aa, Plasmodium falciparum
AIRTNLDIFYFNVPYDIFVVFVEN

SEQ ID NO: 3379186 - protein, 24 aa, Plasmodium falciparum
AISIIPIISSKKFWKRYIYLWINY

SEQ ID NO: 3379187 - protein, 19 aa, Plasmodium falciparum
AIVCLQKLEEIPSPFLNIS

SEQ ID NO: 3379188 - protein, 20 aa, Plasmodium falciparum
AKAFVQCYVTFIQPDFQTVP

SEQ ID NO: 3379189 - protein, 29 aa, Plasmodium falciparum
AKDTLFEIFLKPYFNESYRPVKKGDLFLV

SEQ ID NO: 3379190 - protein, 22 aa, Plasmodium falciparum
AKELIKLMLTYDYNKRITAKEA

SEQ ID NO: 3379191 - protein, 26 aa, Plasmodium falciparum
AKIGTPNLPEFWLRALRNNNTVSHVI

SEQ ID NO: 3379192 - protein, 20 aa, Plasmodium falciparum
AKILLKRKKLYEQEIENILN

SEQ ID NO: 3379193 - protein, 20 aa, Plasmodium falciparum
AKILLNEWYIKEPFVDSQGK

SEQ ID NO: 3379194 - protein, 22 aa, Plasmodium falciparum
AKIQIEIFIYNSNFVKNIIIYL

SEQ ID NO: 3379195 - protein, 22 aa, Plasmodium falciparum
AKKECHIYYPNGGQVERLKNEM

SEQ ID NO: 3379196 - protein, 20 aa, Plasmodium falciparum
AKKLTICSRAFFSDSLGVCE

SEQ ID NO: 3379197 - protein, 27 aa, Plasmodium falciparum
AKKSIEYLKFLLENTVIKSNEMLRINK

SEQ ID NO: 3379198 - protein, 17 aa, Plasmodium falciparum
AKKYNPFINIKEKYYKE

SEQ ID NO: 3379199 - protein, 29 aa, Plasmodium falciparum
AKLKIRNISFFILLSSYIIKQKIQLSTQS

SEQ ID NO: 3379200 - protein, 25 aa, Plasmodium falciparum
AKLNRERYIILNKIPRYREAFPSIM

SEQ ID NO: 3379201 - protein, 22 aa, Plasmodium falciparum
AKLSSMHFYGWEKGLKTGAYYL

SEQ ID NO: 3379202 - protein, 25 aa, Plasmodium falciparum
AKMEYECIINYKLIQSVFNKLGIKK

SEQ ID NO: 3379203 - protein, 25 aa, Plasmodium falciparum
AKNEILFPYKFVMFSKLRKIVLNDN

SEQ ID NO: 3379204 - protein, 22 aa, Plasmodium falciparum
AKNFLYNNMNILQNFKYDMKDN

SEQ ID NO: 3379205 - protein, 17 aa, Plasmodium falciparum
AKNYFILFDVVGTLIDS

SEQ ID NO: 3379206 - protein, 26 aa, Plasmodium falciparum
AKQKKHEEFLIKKGHYIYYDKNFNTQ

SEQ ID NO: 3379207 - protein, 43 aa, Plasmodium falciparum
AKQKKLERLYREKIYTKIDLLEIYLGHNWGEDGDRFNFVLSQE

SEQ ID NO: 3379208 - protein, 26 aa, Plasmodium falciparum
AKQLKIGGYSKIGYPGIIVCEGPKDE

SEQ ID NO: 3379209 - protein, 24 aa, Plasmodium falciparum
AKREKYIIRFLCEGSSYNLSELVN

SEQ ID NO: 3379210 - protein, 25 aa, Plasmodium falciparum
AKSKELIRYGIPVGLKNYAAAYATG

SEQ ID NO: 3379211 - protein, 17 aa, Plasmodium falciparum
AKSLTRPKLVKIFQQVA

SEQ ID NO: 3379212 - protein, 28 aa, Plasmodium falciparum
AKSSDMKFEFLWNKWKEKINNNFCDLNN

SEQ ID NO: 3379213 - protein, 26 aa, Plasmodium falciparum
AKSVALERFISIIITASESKLEDKDL

SEQ ID NO: 3379214 - protein, 19 aa, Plasmodium falciparum
AKTWTIVQKSDRKVKVDKV

SEQ ID NO: 3379215 - protein, 22 aa, Plasmodium falciparum
AKVEQNLPLIFSKINKLQKEKE

SEQ ID NO: 3379216 - protein, 24 aa, Plasmodium falciparum
AKVHQYFYDINNPNKRIFSILSPD

SEQ ID NO: 3379217 - protein, 19 aa, Plasmodium falciparum
AKYHSVLSHVNIIKMYGCM

SEQ ID NO: 3379218 - protein, 31 aa, Plasmodium falciparum
AKYNNFILYFMEYIGRILLDIKLCCKQNSNM

SEQ ID NO: 3379219 - protein, 20 aa, Plasmodium falciparum
ALDTLNYTNIKGQPARLMWS

SEQ ID NO: 3379220 - protein, 19 aa, Plasmodium falciparum
ALEALKLDPNYYKAVYRRI

SEQ ID NO: 3379221 - protein, 20 aa, Plasmodium falciparum
ALEESLYKPLPPLNEKQKQT

SEQ ID NO: 3379222 - protein, 21 aa, Plasmodium falciparum
ALEKKLRLIQSEQTDILTLLN

SEQ ID NO: 3379223 - protein, 18 aa, Plasmodium falciparum
ALEKLRIDKKKKDKLIKL

SEQ ID NO: 3379224 - protein, 18 aa, Plasmodium falciparum
ALFMDYYHLVMAYTYFKQ

SEQ ID NO: 3379225 - protein, 24 aa, Plasmodium falciparum
ALGICLYEFICGPLPFGNDEEDQL

SEQ ID NO: 3379226 - protein, 18 aa, Plasmodium falciparum
ALGVIIKNVLTLVLWDIE

SEQ ID NO: 3379227 - protein, 19 aa, Plasmodium falciparum
ALHNILCLIKKYIIQSNIH

SEQ ID NO: 3379228 - protein, 26 aa, Plasmodium falciparum
ALIFPNALPVKQVLWGLDPLNKVWRY

SEQ ID NO: 3379229 - protein, 22 aa, Plasmodium falciparum
ALKEKLAMKLCAMYNPNMLLVN

SEQ ID NO: 3379230 - protein, 30 aa, Plasmodium falciparum
ALKHKITISTFIKKAYTTNPSLIFYEYCKT

SEQ ID NO: 3379231 - protein, 25 aa, Plasmodium falciparum
ALKNGRIFNFFFKTYRKVTYCYKNN

SEQ ID NO: 3379232 - protein, 25 aa, Plasmodium falciparum
ALKNMTLCWSILRNNFLIKSANSIS

SEQ ID NO: 3379233 - protein, 19 aa, Plasmodium falciparum
ALKRIYEKLLYLQTEALKN

SEQ ID NO: 3379234 - protein, 31 aa, Plasmodium falciparum
ALLHRQLEVLLIDFYSMYKKLLYSNLNINKN

SEQ ID NO: 3379235 - protein, 26 aa, Plasmodium falciparum
ALNDELFFILFNILNKIYVQDNKNKS

SEQ ID NO: 3379236 - protein, 41 aa, Plasmodium falciparum
ALNIEPNEPLPWLINMQKYGLPPSFPYLKIPGLNVSSPNDP

SEQ ID NO: 3379237 - protein, 27 aa, Plasmodium falciparum
ALNIYEMIKIKKKLSFLKNPWNCPHGR

SEQ ID NO: 3379238 - protein, 17 aa, Plasmodium falciparum
ALNTYKLSKFKIGENKI

SEQ ID NO: 3379239 - protein, 23 aa, Plasmodium falciparum
ALNYNKTCEYLPNLLTSEEVNDN

SEQ ID NO: 3379240 - protein, 18 aa, Plasmodium falciparum
ALQAERLCKLKKIYQENF

SEQ ID NO: 3379241 - protein, 25 aa, Plasmodium falciparum
ALQCGPLMHFFLTKTNITENIFEKF

SEQ ID NO: 3379242 - protein, 19 aa, Plasmodium falciparum
ALQLYKEVYSFYKSYYGPN

SEQ ID NO: 3379243 - protein, 17 aa, Plasmodium falciparum
ALQTILAFDLKASEIEV

SEQ ID NO: 3379244 - protein, 18 aa, Plasmodium falciparum
ALRDISLENILLFENEKN

SEQ ID NO: 3379245 - protein, 25 aa, Plasmodium falciparum
ALREFPNELLLPALNFCCSVMPEWD

SEQ ID NO: 3379246 - protein, 28 aa, Plasmodium falciparum
ALSKKKNLAFLFPTMSKKIIFSKMGQQK

SEQ ID NO: 3379247 - protein, 26 aa, Plasmodium falciparum
ALTKKKNFLISINKLHSIYLECIGNN

SEQ ID NO: 3379248 - protein, 26 aa, Plasmodium falciparum
ALTNIKWYAKIKDYFFIKFYKNQVEL

SEQ ID NO: 3379249 - protein, 34 aa, Plasmodium falciparum
ALTPVEGVRFDPYSYSWFAKYLENENSKEPKISK

SEQ ID NO: 3379250 - protein, 32 aa, Plasmodium falciparum
AMKVVDDVVIGAPWVITESFIKRFHIDVVVRG

SEQ ID NO: 3379251 - protein, 17 aa, Plasmodium falciparum
AMRLGWDYSFRHAKVQG

SEQ ID NO: 3379252 - protein, 18 aa, Plasmodium falciparum
AMVEFDYELAKKAQIAVD

SEQ ID NO: 3379253 - protein, 22 aa, Plasmodium falciparum
ANATFWSIFGYEDKPNENISIN

SEQ ID NO: 3379254 - protein, 27 aa, Plasmodium falciparum
ANDAFNKQWYLLANQLILSLSKYEGGH

SEQ ID NO: 3379255 - protein, 24 aa, Plasmodium falciparum
ANETGAFFFLINGPEVMSKMAGEA

SEQ ID NO: 3379256 - protein, 25 aa, Plasmodium falciparum
ANEVKFPVLVRPSYVLSGAAMRVVN

SEQ ID NO: 3379257 - protein, 23 aa, Plasmodium falciparum
ANGKKIILVINTLVEIINKIERE

SEQ ID NO: 3379258 - protein, 33 aa, Plasmodium falciparum
ANIEDLLFNFLTEFHFLYGSEYFICKHIEIIYF

SEQ ID NO: 3379259 - protein, 28 aa, Plasmodium falciparum
ANIIRKNWIMYITKYDYKYLLKCIIKIQ

SEQ ID NO: 3379260 - protein, 38 aa, Plasmodium falciparum
ANIWTPVFSTRFAIPIIGIIYALLWNGDATFGYSALDM

SEQ ID NO: 3379261 - protein, 24 aa, Plasmodium falciparum
ANKFIKMSILLLQNIFHINFHPNF

SEQ ID NO: 3379262 - protein, 23 aa, Plasmodium falciparum
ANKFNVFHIGINKIEALKALYRE

SEQ ID NO: 3379263 - protein, 24 aa, Plasmodium falciparum
ANKKGCNEFFFNDDLLSLNNLEDK

SEQ ID NO: 3379264 - protein, 18 aa, Plasmodium falciparum
ANKKIYNTALVTFNTHEE

SEQ ID NO: 3379265 - protein, 19 aa, Plasmodium falciparum
ANKLSVLQEKYKNSLFYEK

SEQ ID NO: 3379266 - protein, 23 aa, Plasmodium falciparum
ANKVYLFDVYTGEPLKIIEENGP

SEQ ID NO: 3379267 - protein, 18 aa, Plasmodium falciparum
ANLYYNYNKQFPNSEENF

SEQ ID NO: 3379268 - protein, 24 aa, Plasmodium falciparum
ANMYKDLKYYFLNCSWDLVMFECD

SEQ ID NO: 3379269 - protein, 26 aa, Plasmodium falciparum
ANNENLQKKILLASGLLSSTDIMNPT

SEQ ID NO: 3379270 - protein, 20 aa, Plasmodium falciparum
ANNFILNKMNSLDSKTRTVN

SEQ ID NO: 3379271 - protein, 28 aa, Plasmodium falciparum
ANNLSKAPMFNFDFSKGLLNNNEKEKTL

SEQ ID NO: 3379272 - protein, 22 aa, Plasmodium falciparum
ANPMNPIGMPFMPGLLPNMNTC

SEQ ID NO: 3379273 - protein, 31 aa, Plasmodium falciparum
ANPNWCYHNKFTPILLAYNLNKAWVNHFIDA

SEQ ID NO: 3379274 - protein, 27 aa, Plasmodium falciparum
ANQKRTFVEFILNPLYKIFGYVCSEEK

SEQ ID NO: 3379275 - protein, 36 aa, Plasmodium falciparum
ANQNILMKSPYYNIENFLQVFLKYINKKKKKVKVKV

SEQ ID NO: 3379276 - protein, 36 aa, Plasmodium falciparum
ANRITPYFKGIIRTRRFLKLVDKTGHKYLYSKNNIN

SEQ ID NO: 3379277 - protein, 27 aa, Plasmodium falciparum
ANRQSHLCRFLRGLQRIADIYGVAVII

SEQ ID NO: 3379278 - protein, 37 aa, Plasmodium falciparum
ANTKSLFLCYDWLKEKLMFSKIFPFSLFSNICEICIN

SEQ ID NO: 3379279 - protein, 35 aa, Plasmodium falciparum
APDFIYNPKYHGYFMLFWVFVFDISNESILHYDLF

SEQ ID NO: 3379280 - protein, 18 aa, Plasmodium falciparum
APHGIPLDLLDRTLIIPT

SEQ ID NO: 3379281 - protein, 25 aa, Plasmodium falciparum
APISENDYFKIFNYGICNNMDNKLY

SEQ ID NO: 3379282 - protein, 31 aa, Plasmodium falciparum
APKKYIKLQIPLYLNIYYKGKCIAYYLTHIN

SEQ ID NO: 3379283 - protein, 31 aa, Plasmodium falciparum
APLNEDWYFIRASSILRRLYLHPDIGVGFLR

SEQ ID NO: 3379284 - protein, 20 aa, Plasmodium falciparum
APMECILKRLAKSGDFHIIK

SEQ ID NO: 3379285 - protein, 24 aa, Plasmodium falciparum
APNHQFIEQPLIKWTWDEAYDEAY

SEQ ID NO: 3379286 - protein, 26 aa, Plasmodium falciparum
APNIEKLNNPYYYHDNHIAYTNYMYS

SEQ ID NO: 3379287 - protein, 31 aa, Plasmodium falciparum
APTGHTLRLLAFPDLLKKALGYLINIREKLK

SEQ ID NO: 3379288 - protein, 17 aa, Plasmodium falciparum
APTVSSCLNVREYLKLK

SEQ ID NO: 3379289 - protein, 23 aa, Plasmodium falciparum
APVQNYPVVMPYKILFVENVVEN

SEQ ID NO: 3379290 - protein, 55 aa, Plasmodium falciparum
AQEHETIFNVYWHLLNNEKYKYIQNIILFLDSNLYTRAVWLLKKGYNMNDIEVQK

SEQ ID NO: 3379291 - protein, 22 aa, Plasmodium falciparum
AQFIVISLRNQMFELCDRMIGI

SEQ ID NO: 3379292 - protein, 35 aa, Plasmodium falciparum
AQFQIIYPQKYEKYLFLYPKKGIIFSFNLVNIYIY

SEQ ID NO: 3379293 - protein, 24 aa, Plasmodium falciparum
AQFVQKGKRIPRRGEVGLSAEAIE

SEQ ID NO: 3379294 - protein, 17 aa, Plasmodium falciparum
AQIPMNYAEQLLVNAPA

SEQ ID NO: 3379295 - protein, 23 aa, Plasmodium falciparum
AQKELFIRNISNNALDLVQDAFG

SEQ ID NO: 3379296 - protein, 20 aa, Plasmodium falciparum
AQLGNIVIVGERHNLRNNES

SEQ ID NO: 3379297 - protein, 25 aa, Plasmodium falciparum
AQNYFKEFIILYKNNNFNDFSLEIN

SEQ ID NO: 3379298 - protein, 26 aa, Plasmodium falciparum
AQTDIFKNILLFHIRKHYFMIINELK

SEQ ID NO: 3379299 - protein, 18 aa, Plasmodium falciparum
ARCEYLIQLYANILNKII

SEQ ID NO: 3379300 - protein, 25 aa, Plasmodium falciparum
ARKAQYMFNGRLFEKRVVCAAFYSE

SEQ ID NO: 3379301 - protein, 20 aa, Plasmodium falciparum
ARLLGMKFKMPFFVSVNVDE

SEQ ID NO: 3379302 - protein, 25 aa, Plasmodium falciparum
ARTINTKMILMNPLINADNNKIAYK

SEQ ID NO: 3379303 - protein, 17 aa, Plasmodium falciparum
ARTLGINQLIVAINKMD

SEQ ID NO: 3379304 - protein, 25 aa, Plasmodium falciparum
ASAIFFQNMIFIIGGKDGIGEYGKV

SEQ ID NO: 3379305 - protein, 30 aa, Plasmodium falciparum
ASCSTSCPSYWWNPEYYLGPATLMQAYRWI

SEQ ID NO: 3379306 - protein, 52 aa, Plasmodium falciparum
ASDYNKWSVNMLYNFLKMIGLKKEAYLFKINKIRGYHILKLTDKELKKLNIN

SEQ ID NO: 3379307 - protein, 29 aa, Plasmodium falciparum
ASFMDHFYFVIKDFLLIIRKFLINYEQGN

SEQ ID NO: 3379308 - protein, 30 aa, Plasmodium falciparum
ASGKSQKIDILIKPNLKKGENIWEARTHLL

SEQ ID NO: 3379309 - protein, 30 aa, Plasmodium falciparum
ASGQLYPLNKYFLFIVKPVILISFDDIVTL

SEQ ID NO: 3379310 - protein, 18 aa, Plasmodium falciparum
ASIISYISVMSPTNEVLK

SEQ ID NO: 3379311 - protein, 32 aa, Plasmodium falciparum
ASIKYFNKKKFKLIQKYPIHKTIIFVNSIKDC

SEQ ID NO: 3379312 - protein, 17 aa, Plasmodium falciparum
ASKILFESSFIGKYIIL

SEQ ID NO: 3379313 - protein, 40 aa, Plasmodium falciparum
ASKIPFKFKYFFIPLSRYVAYFFPTFRPSPNLNFEKFPYI

SEQ ID NO: 3379314 - protein, 25 aa, Plasmodium falciparum
ASKSMHFALKLSWLYHSIVEDNSSK

SEQ ID NO: 3379315 - protein, 31 aa, Plasmodium falciparum
ASKTYYCNQYLNEYPLFPVSSIDLYNTDNMN

SEQ ID NO: 3379316 - protein, 22 aa, Plasmodium falciparum
ASLKNFPSCRMCTIFDGHIGKE

SEQ ID NO: 3379317 - protein, 19 aa, Plasmodium falciparum
ASLNVSVSCAIILQNFAVW

SEQ ID NO: 3379318 - protein, 17 aa, Plasmodium falciparum
ASMGIHFAAIKGNKEIT

SEQ ID NO: 3379319 - protein, 33 aa, Plasmodium falciparum
ASNDKNIFIWSLRNYYCLYILKDNLYPINAIDV

SEQ ID NO: 3379320 - protein, 25 aa, Plasmodium falciparum
ASNIKLYIYQIFFNNKIENRRKVKK

SEQ ID NO: 3379321 - protein, 25 aa, Plasmodium falciparum
ASNKNYFLYFDINPGGIMSKNQEKI

SEQ ID NO: 3379322 - protein, 34 aa, Plasmodium falciparum
ASNLIENFFQFFPNVYRFMQMQKFLVKHMNCVYT

SEQ ID NO: 3379323 - protein, 25 aa, Plasmodium falciparum
ASQDYTLSRSLGYNLNFSMIQSEND

SEQ ID NO: 3379324 - protein, 21 aa, Plasmodium falciparum
ASQIFPLWDHPKDSIDYCLST

SEQ ID NO: 3379325 - protein, 26 aa, Plasmodium falciparum
ASRVLEPYPFLLYKKSGEPSSYQYGF

SEQ ID NO: 3379326 - protein, 24 aa, Plasmodium falciparum
ASTGCNLLIIQKSILRDAVNDLAL

SEQ ID NO: 3379327 - protein, 22 aa, Plasmodium falciparum
ASTVEKFFSLFFTKFKNVIDVG

SEQ ID NO: 3379328 - protein, 23 aa, Plasmodium falciparum
ASYEKYNFFLPFLNDYIKNQKKN

SEQ ID NO: 3379329 - protein, 21 aa, Plasmodium falciparum
ATAMGYKYLNSSVTGKRYVRN

SEQ ID NO: 3379330 - protein, 17 aa, Plasmodium falciparum
ATDFLISGKIVVICGYG

SEQ ID NO: 3379331 - protein, 27 aa, Plasmodium falciparum
ATEHTLKFFLSLLTLLRKGPIDLNLKK

SEQ ID NO: 3379332 - protein, 23 aa, Plasmodium falciparum
ATEIISYEKIIFYVVILGIMTEE

SEQ ID NO: 3379333 - protein, 18 aa, Plasmodium falciparum
ATELLLALTQHPLYFFAP

SEQ ID NO: 3379334 - protein, 35 aa, Plasmodium falciparum
ATEMKDKILFELLSLKFASIFNDILQLDNNFDNLI

SEQ ID NO: 3379335 - protein, 24 aa, Plasmodium falciparum
ATGMKLPKKSILISIKNLNNKLAF

SEQ ID NO: 3379336 - protein, 19 aa, Plasmodium falciparum
ATHILIRQYIIKKSIELLK

SEQ ID NO: 3379337 - protein, 28 aa, Plasmodium falciparum
ATHLFFQSRGFLYIHTPLITTSDCEGGG

SEQ ID NO: 3379338 - protein, 26 aa, Plasmodium falciparum
ATIMKQIFSAIFYLHSLNIVHRDLKP

SEQ ID NO: 3379339 - protein, 24 aa, Plasmodium falciparum
ATINLYLKDLILPSQNFYSTQLLD

SEQ ID NO: 3379340 - protein, 23 aa, Plasmodium falciparum
ATKYSIPIPAFSASLAYFQMVTS

SEQ ID NO: 3379341 - protein, 22 aa, Plasmodium falciparum
ATLDLIILHKGNPSNFLDVGGG

SEQ ID NO: 3379342 - protein, 25 aa, Plasmodium falciparum
ATLLKDTLFVARKPLYFNRIKTSFD

SEQ ID NO: 3379343 - protein, 31 aa, Plasmodium falciparum
ATNAASTIPFDAYMSYYNYNMNSSTCNLFNP

SEQ ID NO: 3379344 - protein, 28 aa, Plasmodium falciparum
ATNVVSPILNIYTLIKKYKIKKKKYESF

SEQ ID NO: 3379345 - protein, 35 aa, Plasmodium falciparum
ATQEEVFFQTAKPLIPHVFKGINCTVFAYGATGSG

SEQ ID NO: 3379346 - protein, 23 aa, Plasmodium falciparum
ATQPQMLLFNLYDDWLNSISSFT

SEQ ID NO: 3379347 - protein, 24 aa, Plasmodium falciparum
ATRPYTKQFPYLYYSRVPSHMYLS

SEQ ID NO: 3379348 - protein, 35 aa, Plasmodium falciparum
ATSIIYLKYIVLNYKTYIMIIEKGVIYIGELNEKN

SEQ ID NO: 3379349 - protein, 24 aa, Plasmodium falciparum
ATSPALFNRCVIDWFGDWPYSALL

SEQ ID NO: 3379350 - protein, 27 aa, Plasmodium falciparum
ATWKAYKEHLFYKKLLKSTKKIQLKWK

SEQ ID NO: 3379351 - protein, 26 aa, Plasmodium falciparum
ATYVRRPQRKAAKKCISLWSEELRKK

SEQ ID NO: 3379352 - protein, 22 aa, Plasmodium falciparum
AVALYTTAIHWFESRKFTHIPF

SEQ ID NO: 3379353 - protein, 24 aa, Plasmodium falciparum
AVAQLIFHKQPISSISWNFKDTYV

SEQ ID NO: 3379354 - protein, 30 aa, Plasmodium falciparum
AVATFYLYDKFIHNFLFALSSIIPMNPDNV

SEQ ID NO: 3379355 - protein, 19 aa, Plasmodium falciparum
AVDLLTKLFEKNPKKRLGS

SEQ ID NO: 3379356 - protein, 21 aa, Plasmodium falciparum
AVECIPQSIEMWIALARLCTY

SEQ ID NO: 3379357 - protein, 21 aa, Plasmodium falciparum
AVFLQLAEKISYNPMALIYVC

SEQ ID NO: 3379358 - protein, 17 aa, Plasmodium falciparum
AVIFTPIYYFDGNSWTA

SEQ ID NO: 3379359 - protein, 25 aa, Plasmodium falciparum
AVISPDIRGFNLHPMFTHINKKLEE

SEQ ID NO: 3379360 - protein, 24 aa, Plasmodium falciparum
AVKMKNLLLPFNVPLIINNRLDIC

SEQ ID NO: 3379361 - protein, 26 aa, Plasmodium falciparum
AVLRVPDPRFLALRSFALSHFPDDPI

SEQ ID NO: 3379362 - protein, 22 aa, Plasmodium falciparum
AVQDLLLLDVCSLSLGLETAGG

SEQ ID NO: 3379363 - protein, 24 aa, Plasmodium falciparum
AVTEMHLKIINGKPLYVGLAEKRE

SEQ ID NO: 3379364 - protein, 43 aa, Plasmodium falciparum
AVTHKYELWVAFGNGYIAVYDLYDFQLLLYTCISKSPIMDLKY

SEQ ID NO: 3379365 - protein, 20 aa, Plasmodium falciparum
AWDEIQIIISKWFTIKEIKW

SEQ ID NO: 3379366 - protein, 32 aa, Plasmodium falciparum
AYALSYFYYEQLALVFLDFLKIYQLYSKFINL

SEQ ID NO: 3379367 - protein, 19 aa, Plasmodium falciparum
AYECLLKYLNEYHEKKYEK

SEQ ID NO: 3379368 - protein, 27 aa, Plasmodium falciparum
AYEDIEDFFIFDHALSYLNNDVETIFT

SEQ ID NO: 3379369 - protein, 26 aa, Plasmodium falciparum
AYEEDYVEYILLNNLKDRIRHKEMIV

SEQ ID NO: 3379370 - protein, 34 aa, Plasmodium falciparum
AYENSKPYFDPHEFPKILWKSKAGGVCVPQISDD

SEQ ID NO: 3379371 - protein, 25 aa, Plasmodium falciparum
AYEVIEYKEKIIRMLCAILEVQGIT

SEQ ID NO: 3379372 - protein, 20 aa, Plasmodium falciparum
AYFYDFIFDLSFSIGVFDNI

SEQ ID NO: 3379373 - protein, 30 aa, Plasmodium falciparum
AYGMEKALSIFPTLFNELKTWDNFKKIEKK

SEQ ID NO: 3379374 - protein, 17 aa, Plasmodium falciparum
AYGVSNLLLERLMLSSD

SEQ ID NO: 3379375 - protein, 26 aa, Plasmodium falciparum
AYIGLYTCPILFKHKLLKKKSKLNEW

SEQ ID NO: 3379376 - protein, 29 aa, Plasmodium falciparum
AYIKIIENYDLLWLKLIEIELCCNNKNLN

SEQ ID NO: 3379377 - protein, 36 aa, Plasmodium falciparum
AYINVKGNLYFNTKDKLFYDIEYIKDISYDNVKNNL

SEQ ID NO: 3379378 - protein, 21 aa, Plasmodium falciparum
AYKIMKQIFSALYYCHSKNIM

SEQ ID NO: 3379379 - protein, 29 aa, Plasmodium falciparum
AYKIQEAYLLDCLQKCMIDLNLNSVMSTE

SEQ ID NO: 3379380 - protein, 29 aa, Plasmodium falciparum
AYKNYGNTLYSWIVKKKNFNYPTSIKGKD

SEQ ID NO: 3379381 - protein, 22 aa, Plasmodium falciparum
AYLINHLPLGISLTEVVDINEE

SEQ ID NO: 3379382 - protein, 29 aa, Plasmodium falciparum
AYMPPECWKIYWKYDTMKIKNPLKDLKHI

SEQ ID NO: 3379383 - protein, 32 aa, Plasmodium falciparum
AYNLIFQHKNIENIFHFLISNDRWRNKIPENL

SEQ ID NO: 3379384 - protein, 38 aa, Plasmodium falciparum
AYNNPHYYWIPCFFENIIACFFKIWKSNYFIVNELLFT

SEQ ID NO: 3379385 - protein, 24 aa, Plasmodium falciparum
AYNNQPNLSALPNFNCTPNLFSPE

SEQ ID NO: 3379386 - protein, 20 aa, Plasmodium falciparum
AYQNTILKNSPLVSLSNNSG

SEQ ID NO: 3379387 - protein, 28 aa, Plasmodium falciparum
AYRICMETYKMILEILRATPKLEKAYHE

SEQ ID NO: 3379388 - protein, 30 aa, Plasmodium falciparum
AYRKNDRFFILQAPSQYKYFINLAVHEKNK

SEQ ID NO: 3379389 - protein, 25 aa, Plasmodium falciparum
AYRQLSLLLRRPPGREAYPGDIFYI

SEQ ID NO: 3379390 - protein, 21 aa, Plasmodium falciparum
AYSIYFSVFLKRLKSYVSDRI

SEQ ID NO: 3379391 - protein, 41 aa, Plasmodium falciparum
AYVDFIYGANKYKLYIPSQNLLINFILLGITVEKINLKDLN

SEQ ID NO: 3379392 - protein, 25 aa, Plasmodium falciparum
AYVRNNFIHIFGKKYIDLIETNYHL

SEQ ID NO: 3379393 - protein, 33 aa, Plasmodium falciparum
AYYMNGLSSVYLWPNPIEDGFVACFLIKKKEIF

SEQ ID NO: 3379394 - protein, 17 aa, Plasmodium falciparum
CAEILLEKPYFFSNKNI

SEQ ID NO: 3379395 - protein, 23 aa, Plasmodium falciparum
CAHNYHELLQFYNLKEQEKNIIL

SEQ ID NO: 3379396 - protein, 21 aa, Plasmodium falciparum
CAIVLDVIKLLKELPTLVYLN

SEQ ID NO: 3379397 - protein, 18 aa, Plasmodium falciparum
CAKKKRGYKSNLIVCSAL

SEQ ID NO: 3379398 - protein, 23 aa, Plasmodium falciparum
CAKVTRDFLLKKWKYEEPIINID

SEQ ID NO: 3379399 - protein, 17 aa, Plasmodium falciparum
CALPSPIRPSDHLPLIA

SEQ ID NO: 3379400 - protein, 17 aa, Plasmodium falciparum
CALVFGLGYNSNILSRN

SEQ ID NO: 3379401 - protein, 20 aa, Plasmodium falciparum
CANSYFYTNVFLNQRLEQMT

SEQ ID NO: 3379402 - protein, 22 aa, Plasmodium falciparum
CARLLSLYILGMLKSIAFRDSG

SEQ ID NO: 3379403 - protein, 22 aa, Plasmodium falciparum
CASICRKLLNIVLGNLQVVLFR

SEQ ID NO: 3379404 - protein, 19 aa, Plasmodium falciparum
CAVLMFQKEFAERMLANVG

SEQ ID NO: 3379405 - protein, 32 aa, Plasmodium falciparum
CAYSPNMEIYMNKLKYTRLRKKNKYDMDVMDD

SEQ ID NO: 3379406 - protein, 28 aa, Plasmodium falciparum
CCFSNIKICAVKSIFLDSIMECIEELEI

SEQ ID NO: 3379407 - protein, 17 aa, Plasmodium falciparum
CCHFYRNTTWRCQYMDK

SEQ ID NO: 3379408 - protein, 20 aa, Plasmodium falciparum
CCHIELSTPYLVKAYINVPC

SEQ ID NO: 3379409 - protein, 19 aa, Plasmodium falciparum
CCLAYKYLRYHSQLIISLL

SEQ ID NO: 3379410 - protein, 26 aa, Plasmodium falciparum
CCQCTEPLCYIPISLSKKNVFLFGDH

SEQ ID NO: 3379411 - protein, 29 aa, Plasmodium falciparum
CCYSKKHFEFFLYYFIQKSNDTVKRMKTL

SEQ ID NO: 3379412 - protein, 32 aa, Plasmodium falciparum
CDDAYCPLAHTKLEKIFHPIVYKTQACQMAKD

SEQ ID NO: 3379413 - protein, 24 aa, Plasmodium falciparum
CDEKNVLFYSLVFSFTNINNNYIE

SEQ ID NO: 3379414 - protein, 19 aa, Plasmodium falciparum
CDEKTASIKYFNKKKFKLI

SEQ ID NO: 3379415 - protein, 26 aa, Plasmodium falciparum
CDFAKRPLMFLNYLDFKILQENIHKI

SEQ ID NO: 3379416 - protein, 18 aa, Plasmodium falciparum
CDFFNYNKIVRCEESHDK

SEQ ID NO: 3379417 - protein, 23 aa, Plasmodium falciparum
CDGSLYFIDGILYPDLRSNNAVD

SEQ ID NO: 3379418 - protein, 22 aa, Plasmodium falciparum
CDHRYDRNIIIKLKKYKNKYQE

SEQ ID NO: 3379419 - protein, 40 aa, Plasmodium falciparum
CDHVKPLCCSYILRFEGPPPHFLIIKFDKVNRKAYIVKRV

SEQ ID NO: 3379420 - protein, 23 aa, Plasmodium falciparum
CDINSVNIFLTNNLLKDIHDQVD

SEQ ID NO: 3379421 - protein, 26 aa, Plasmodium falciparum
CDKGLNSFIILWKINETSFLDPIKKF

SEQ ID NO: 3379422 - protein, 24 aa, Plasmodium falciparum
CDKKKIINLYNFIKKEIKLLECFN

SEQ ID NO: 3379423 - protein, 24 aa, Plasmodium falciparum
CDKKYKILLSNVKDKLYKNKIKEE

SEQ ID NO: 3379424 - protein, 23 aa, Plasmodium falciparum
CDKRTLCHLLLVGDPGTGKSQLL

SEQ ID NO: 3379425 - protein, 23 aa, Plasmodium falciparum
CDMLHIFKNVINILTCKYPEHNI

SEQ ID NO: 3379426 - protein, 26 aa, Plasmodium falciparum
CDMQSFPFNNKWFDNDLLNRETDKLQ

SEQ ID NO: 3379427 - protein, 23 aa, Plasmodium falciparum
CDNKLSFFLGSKYKFSSLFENSK

SEQ ID NO: 3379428 - protein, 23 aa, Plasmodium falciparum
CDNSLKNFVFKDDALILKEKDEI

SEQ ID NO: 3379429 - protein, 26 aa, Plasmodium falciparum
CDQEYKIMFDYLIGEDTLIVNNIKDA

SEQ ID NO: 3379430 - protein, 25 aa, Plasmodium falciparum
CDRFLDFMHKQLNFYNGKYMFMINY

SEQ ID NO: 3379431 - protein, 29 aa, Plasmodium falciparum
CDTIYILEKLFPLLYFPKINNVHLKNISR

SEQ ID NO: 3379432 - protein, 27 aa, Plasmodium falciparum
CDVFLNKWLCPFFEDFIINLQNYDKNK

SEQ ID NO: 3379433 - protein, 21 aa, Plasmodium falciparum
CDVSFHISCGILLGCKMDNFF

SEQ ID NO: 3379434 - protein, 28 aa, Plasmodium falciparum
CDVWSCGVILYILLCGYPPFGGQNDQDI

SEQ ID NO: 3379435 - protein, 23 aa, Plasmodium falciparum
CEDIYNIFYIRDQYLIGNKNILI

SEQ ID NO: 3379436 - protein, 32 aa, Plasmodium falciparum
CEEHDKYFKNLFKNLNRKIEYTFACEKENTYD

SEQ ID NO: 3379437 - protein, 25 aa, Plasmodium falciparum
CEEIISIIVLPFNYLGLSALNARNM

SEQ ID NO: 3379438 - protein, 31 aa, Plasmodium falciparum
CEEKRSNFVNPYIKNIINKDYKQNFINDNSN

SEQ ID NO: 3379439 - protein, 28 aa, Plasmodium falciparum
CEEMNKLHFFHFLKKKYKNFYIHIVNLN

SEQ ID NO: 3379440 - protein, 22 aa, Plasmodium falciparum
CEESLFKCFEFLKNINYKLNEN

SEQ ID NO: 3379441 - protein, 32 aa, Plasmodium falciparum
CEIHNDMKFVKQYINFLIAQKEKERINKEKKI

SEQ ID NO: 3379442 - protein, 24 aa, Plasmodium falciparum
CEILRKINTLRIKGIGGISNFLTL

SEQ ID NO: 3379443 - protein, 21 aa, Plasmodium falciparum
CEINNALEIFNKFNANSSIKN

SEQ ID NO: 3379444 - protein, 23 aa, Plasmodium falciparum
CEIPTIGLWISSGSKYENKKNNG

SEQ ID NO: 3379445 - protein, 29 aa, Plasmodium falciparum
CEKKKDTLLFLLRFNKWKGASYNYTTNLK

SEQ ID NO: 3379446 - protein, 33 aa, Plasmodium falciparum
CEKLKNLYLMRKVEFIKILSMKYYKDNYLNGVV

SEQ ID NO: 3379447 - protein, 40 aa, Plasmodium falciparum
CEKMFESRYMLNEFLKKLYIYQIYILKKIVFNKSDILKND

SEQ ID NO: 3379448 - protein, 25 aa, Plasmodium falciparum
CEKNVFITDCFYYKNIFRNLHEFID

SEQ ID NO: 3379449 - protein, 18 aa, Plasmodium falciparum
CELYCIQKSIYSKDINNI

SEQ ID NO: 3379450 - protein, 31 aa, Plasmodium falciparum
CENEIKRIYYFKLWNAMVEHNFTLFENIIQQ

SEQ ID NO: 3379451 - protein, 18 aa, Plasmodium falciparum
CENILYDFLKDLTAIFKY

SEQ ID NO: 3379452 - protein, 25 aa, Plasmodium falciparum
CENNKNKVYWFDMNKYINKDIKKYN

SEQ ID NO: 3379453 - protein, 26 aa, Plasmodium falciparum
CEPCIMCVYALKLIGIKNIYFCCLNE

SEQ ID NO: 3379454 - protein, 23 aa, Plasmodium falciparum
CEPNVNVITIWRGDNYPSVGIFA

SEQ ID NO: 3379455 - protein, 22 aa, Plasmodium falciparum
CERPYDIFVDILQQIMKKDKKD

SEQ ID NO: 3379456 - protein, 22 aa, Plasmodium falciparum
CESYKNYDNDHLLYYKKHSHSK

SEQ ID NO: 3379457 - protein, 28 aa, Plasmodium falciparum
CEWLKRILENFFFIIKNNNIISYNTITN

SEQ ID NO: 3379458 - protein, 17 aa, Plasmodium falciparum
CEYIKQLYISESKKKYL

SEQ ID NO: 3379459 - protein, 24 aa, Plasmodium falciparum
CEYVNYIYQPVYNLSVNVFKKNPE

SEQ ID NO: 3379460 - protein, 34 aa, Plasmodium falciparum
CFDLQLTENVFLIWQFLKLYLSTSPQVRSIIDFI

SEQ ID NO: 3379461 - protein, 25 aa, Plasmodium falciparum
CFEILGFDILLDYKLKPWLLEVNHS

SEQ ID NO: 3379462 - protein, 19 aa, Plasmodium falciparum
CFFCSKRIGLVGIKCRCNH

SEQ ID NO: 3379463 - protein, 19 aa, Plasmodium falciparum
CFHPILKFRTAMTVAEKMR

SEQ ID NO: 3379464 - protein, 19 aa, Plasmodium falciparum
CFHVNSFFVLFKKIEESNK

SEQ ID NO: 3379465 - protein, 23 aa, Plasmodium falciparum
CFIDDKNICLLAMRTINMYDEIT

SEQ ID NO: 3379466 - protein, 21 aa, Plasmodium falciparum
CFKFDLLKRKVVKQTIMTICY

SEQ ID NO: 3379467 - protein, 42 aa, Plasmodium falciparum
CFQKSLTIFNYFKPLLTFRNINIILFLLHKYIDYYDKQKDIC

SEQ ID NO: 3379468 - protein, 18 aa, Plasmodium falciparum
CFSGIIFDEYNRCPIYVI

SEQ ID NO: 3379469 - protein, 18 aa, Plasmodium falciparum
CFSIPTYITFHIVITNND

SEQ ID NO: 3379470 - protein, 18 aa, Plasmodium falciparum
CFSIWEEAYKYDDMVKGK

SEQ ID NO: 3379471 - protein, 19 aa, Plasmodium falciparum
CFSVDFFLNVIRKYNIQPN

SEQ ID NO: 3379472 - protein, 25 aa, Plasmodium falciparum
CFSYSKYVEPLKNGVLLIILNVKVI

SEQ ID NO: 3379473 - protein, 17 aa, Plasmodium falciparum
CFTLYTKERTYDFFSDD

SEQ ID NO: 3379474 - protein, 24 aa, Plasmodium falciparum
CFVRNFFNWNIFSKYFKDNEFQEL

SEQ ID NO: 3379475 - protein, 17 aa, Plasmodium falciparum
CGDTFGYIYIYNITNNR

SEQ ID NO: 3379476 - protein, 19 aa, Plasmodium falciparum
CGIFVGLLFIKYNYDIIFN

SEQ ID NO: 3379477 - protein, 34 aa, Plasmodium falciparum
CGKIFNFFQSFFFMDYLINKYIDLFYKPKTMNEL

SEQ ID NO: 3379478 - protein, 25 aa, Plasmodium falciparum
CGKRKIKFFSLLKKYYYSNTFQSST

SEQ ID NO: 3379479 - protein, 23 aa, Plasmodium falciparum
CGKTFLCTNYFSTYIRINMEEYK

SEQ ID NO: 3379480 - protein, 17 aa, Plasmodium falciparum
CGMIQTCIVFKNKTKMK

SEQ ID NO: 3379481 - protein, 21 aa, Plasmodium falciparum
CGNLRVLNSYWVGQDAVYKYY

SEQ ID NO: 3379482 - protein, 23 aa, Plasmodium falciparum
CGNNICMLIPLIYEFHTYMDCEL

SEQ ID NO: 3379483 - protein, 30 aa, Plasmodium falciparum
CGNVKDWKLFAIPFISLMKILPKGQGSKYL

SEQ ID NO: 3379484 - protein, 23 aa, Plasmodium falciparum
CGQFKCFACDIYFINNDAKIQHE

SEQ ID NO: 3379485 - protein, 22 aa, Plasmodium falciparum
CGRRDIGMFLILCTGNTAKHNK

SEQ ID NO: 3379486 - protein, 26 aa, Plasmodium falciparum
CGSGDNYLYIYDYKQKILKYSLPGHT

SEQ ID NO: 3379487 - protein, 19 aa, Plasmodium falciparum
CGSYPCFSFSTLKNNVTYC

SEQ ID NO: 3379488 - protein, 17 aa, Plasmodium falciparum
CGTVSCNFLPNYPNFSK

SEQ ID NO: 3379489 - protein, 34 aa, Plasmodium falciparum
CHFAPHYYTSHWPDYWFKNILNEYKYRIQKIQKK

SEQ ID NO: 3379490 - protein, 26 aa, Plasmodium falciparum
CHGYTTNEFILKYLKKIILERNMELR

SEQ ID NO: 3379491 - protein, 24 aa, Plasmodium falciparum
CHIHWNPLYPDIKLYHAYLIIRDF

SEQ ID NO: 3379492 - protein, 17 aa, Plasmodium falciparum
CHKNSISSILYSSNHTF

SEQ ID NO: 3379493 - protein, 32 aa, Plasmodium falciparum
CHLSNGYIIRVYLLLLLLSKSKLLLIDEINNN

SEQ ID NO: 3379494 - protein, 26 aa, Plasmodium falciparum
CHNSLFNTLFFFITKNYLFIKNKKNN

SEQ ID NO: 3379495 - protein, 18 aa, Plasmodium falciparum
CHSHFLVYKSLKKAFFFF

SEQ ID NO: 3379496 - protein, 22 aa, Plasmodium falciparum
CHTKGHILYYVYKTDEAKQEDH

SEQ ID NO: 3379497 - protein, 27 aa, Plasmodium falciparum
CHVLRNIPTFYMSSFSGSLENINKMTN

SEQ ID NO: 3379498 - protein, 20 aa, Plasmodium falciparum
CIAIPNICNFLVYSGGGDGV

SEQ ID NO: 3379499 - protein, 24 aa, Plasmodium falciparum
CIATLFLIQKLYLINENKLAHWLS

SEQ ID NO: 3379500 - protein, 31 aa, Plasmodium falciparum
CIDGQCIFLDPFILNLLFYEYDQDMNRLPKF

SEQ ID NO: 3379501 - protein, 29 aa, Plasmodium falciparum
CIEIKNNISYIFPLFKLKNKGKNVEEKTG

SEQ ID NO: 3379502 - protein, 37 aa, Plasmodium falciparum
CIGEFRTCMNCFLNISTLFCKTCNIFLCAICNVKLHN

SEQ ID NO: 3379503 - protein, 34 aa, Plasmodium falciparum
CIGNNFALDNIFLSNPFLILKDKYESWTVTNVII

SEQ ID NO: 3379504 - protein, 19 aa, Plasmodium falciparum
CIIFIDEAEAFLRKGRNES

SEQ ID NO: 3379505 - protein, 18 aa, Plasmodium falciparum
CIIKKIISLKKSNKKRWL

SEQ ID NO: 3379506 - protein, 17 aa, Plasmodium falciparum
CIITPYSKQTNLLRNIF

SEQ ID NO: 3379507 - protein, 24 aa, Plasmodium falciparum
CIKHNINLKELINLNLFEETKLIN

SEQ ID NO: 3379508 - protein, 18 aa, Plasmodium falciparum
CIKKLEEILYSIEKVHIK

SEQ ID NO: 3379509 - protein, 34 aa, Plasmodium falciparum
CILNSVVLWAKLNKWFVIFIPDVKKYKFDINNIV

SEQ ID NO: 3379510 - protein, 24 aa, Plasmodium falciparum
CILTLHMLIKYNNEIPYIVFHKSY

SEQ ID NO: 3379511 - protein, 20 aa, Plasmodium falciparum
CIMSYIIYSFYKINTQGSNN

SEQ ID NO: 3379512 - protein, 28 aa, Plasmodium falciparum
CINELKLKRLLPINPQAHMIINWLEKGV

SEQ ID NO: 3379513 - protein, 17 aa, Plasmodium falciparum
CINILNKSKSQMMNKIK

SEQ ID NO: 3379514 - protein, 17 aa, Plasmodium falciparum
CINKSMDLKYSTNNIII

SEQ ID NO: 3379515 - protein, 25 aa, Plasmodium falciparum
CINWRRNCIFVNDIKKKKFLHLSEY

SEQ ID NO: 3379516 - protein, 20 aa, Plasmodium falciparum
CIPNFAIIYLDKLSKYVEKT

SEQ ID NO: 3379517 - protein, 19 aa, Plasmodium falciparum
CIPNITVFPNYNITCFKNY

SEQ ID NO: 3379518 - protein, 25 aa, Plasmodium falciparum
CIRNNMNYVKLWKNAIKKTQQQREV

SEQ ID NO: 3379519 - protein, 21 aa, Plasmodium falciparum
CISCYIFLCITLGYHENMFYN

SEQ ID NO: 3379520 - protein, 31 aa, Plasmodium falciparum
CISKKMSYFVYLFLKNLPQKELMNFRISDFA

SEQ ID NO: 3379521 - protein, 23 aa, Plasmodium falciparum
CITFLIHLNAFLQLDFFSYLNET

SEQ ID NO: 3379522 - protein, 17 aa, Plasmodium falciparum
CITNILLLRNQLHIDRK

SEQ ID NO: 3379523 - protein, 23 aa, Plasmodium falciparum
CIYPLLGNNIYKWSFLGTDINID

SEQ ID NO: 3379524 - protein, 19 aa, Plasmodium falciparum
CIYVFIKYYDTLPNDLFNE

SEQ ID NO: 3379525 - protein, 18 aa, Plasmodium falciparum
CIYVGNLPGNVIEEEVYD

SEQ ID NO: 3379526 - protein, 20 aa, Plasmodium falciparum
CKCILKNRDGYLYKGNKNHR

SEQ ID NO: 3379527 - protein, 38 aa, Plasmodium falciparum
CKCLYKRHRDLIAIILRYMHANLYIINDYIFNNINQNF

SEQ ID NO: 3379528 - protein, 34 aa, Plasmodium falciparum
CKDFQNAILFKRKILPIVNIPLMERGYVQLQNDQ

SEQ ID NO: 3379529 - protein, 18 aa, Plasmodium falciparum
CKDPHACTILLRGSTKDV

SEQ ID NO: 3379530 - protein, 26 aa, Plasmodium falciparum
CKEIAFTYRDVLDEKVIAFINNNKLK

SEQ ID NO: 3379531 - protein, 21 aa, Plasmodium falciparum
CKEIITDFRSSDKIKEVMKRN

SEQ ID NO: 3379532 - protein, 30 aa, Plasmodium falciparum
CKEKYHMKLKNPHYFIFQHGLTASVHDFQN

SEQ ID NO: 3379533 - protein, 28 aa, Plasmodium falciparum
CKELNNFHFYLIVKINNLNIVPYLNLYM

SEQ ID NO: 3379534 - protein, 23 aa, Plasmodium falciparum
CKEMKPKFKSFGLFAMLIGLPNV

SEQ ID NO: 3379535 - protein, 26 aa, Plasmodium falciparum
CKEYGKAKVYLINQKEFKSLNTNEMN

SEQ ID NO: 3379536 - protein, 22 aa, Plasmodium falciparum
CKFLLDFIHLKLIKTKKDMFDF

SEQ ID NO: 3379537 - protein, 19 aa, Plasmodium falciparum
CKHFISFQKLISIKVKGKN

SEQ ID NO: 3379538 - protein, 19 aa, Plasmodium falciparum
CKHRNSIILFGKTLTKFKK

SEQ ID NO: 3379539 - protein, 36 aa, Plasmodium falciparum
CKIRRVEYFVIIKNIYVLVRYPSILYYIHPTSIIKD

SEQ ID NO: 3379540 - protein, 20 aa, Plasmodium falciparum
CKKEKIKLEKQFSFDSKDSD

SEQ ID NO: 3379541 - protein, 30 aa, Plasmodium falciparum
CKKIHEHCVIFFDILFSLLDVIKTDFYKIV

SEQ ID NO: 3379542 - protein, 17 aa, Plasmodium falciparum
CKLDHILKPLLLSTNNK

SEQ ID NO: 3379543 - protein, 17 aa, Plasmodium falciparum
CKLKKHIIFQEHKIYIS

SEQ ID NO: 3379544 - protein, 24 aa, Plasmodium falciparum
CKLNNFIPLIGVELGKTKFQREFT

SEQ ID NO: 3379545 - protein, 21 aa, Plasmodium falciparum
CKNDLWILNIKKCKKGKETKN

SEQ ID NO: 3379546 - protein, 28 aa, Plasmodium falciparum
CKNIQKFFFRLTSLPERKNVRSFSVLKC

SEQ ID NO: 3379547 - protein, 25 aa, Plasmodium falciparum
CKNSVNFLLIIRLLKITDDTKILNE

SEQ ID NO: 3379548 - protein, 35 aa, Plasmodium falciparum
CKNTKQCVEFYYLTKNFFSLKKLLLVISESKLKRN

SEQ ID NO: 3379549 - protein, 32 aa, Plasmodium falciparum
CKPNVILNQQIFHKVDEHGNFIYNMRDHENIQ

SEQ ID NO: 3379550 - protein, 22 aa, Plasmodium falciparum
CKQEKFICPILFLECDIEDTYT

SEQ ID NO: 3379551 - protein, 23 aa, Plasmodium falciparum
CKQIYCFLYMDSNCFSSYNIFEK

SEQ ID NO: 3379552 - protein, 17 aa, Plasmodium falciparum
CKQKGIWPITNPTNKVH

SEQ ID NO: 3379553 - protein, 17 aa, Plasmodium falciparum
CKQKYLNNILNLNNCNC

SEQ ID NO: 3379554 - protein, 21 aa, Plasmodium falciparum
CKQMEYFKNSNLLSYVDDYTI

SEQ ID NO: 3379555 - protein, 18 aa, Plasmodium falciparum
CKRSYPFYPRIQRYRRKL

SEQ ID NO: 3379556 - protein, 18 aa, Plasmodium falciparum
CKRTGYLSCNLFLHKDHE

SEQ ID NO: 3379557 - protein, 34 aa, Plasmodium falciparum
CKSGDINLYVHKYQYLVLKKRKRKRKFIHVRSII

SEQ ID NO: 3379558 - protein, 63 aa, Plasmodium falciparum
CKSKFGTLIQIRKPVFFNIRRNKFIALQIGRTVMYVYMKRKNWIFLPICLKLSKTKDEDVSTL

SEQ ID NO: 3379559 - protein, 20 aa, Plasmodium falciparum
CKSMLKYPLVFLCTGQVNCF

SEQ ID NO: 3379560 - protein, 26 aa, Plasmodium falciparum
CKSYDLYDSIFLLNESFYEQNKNTKC

SEQ ID NO: 3379561 - protein, 35 aa, Plasmodium falciparum
CKYENFDIFKMKYFKKYYKFFYSLKGEEEILMNVK

SEQ ID NO: 3379562 - protein, 29 aa, Plasmodium falciparum
CKYENPDNRFWVHNLVPEHLRKPALYKDD

SEQ ID NO: 3379563 - protein, 26 aa, Plasmodium falciparum
CKYQIKLIKDYLPYIQSMVLDFDRKV

SEQ ID NO: 3379564 - protein, 24 aa, Plasmodium falciparum
CLDDFIFICFFCGNDFLPHLPSIS

SEQ ID NO: 3379565 - protein, 21 aa, Plasmodium falciparum
CLDDNHIIFKEIKIKKKKGRK

SEQ ID NO: 3379566 - protein, 18 aa, Plasmodium falciparum
CLDNVFSMYLFNNYVDRS

SEQ ID NO: 3379567 - protein, 26 aa, Plasmodium falciparum
CLDSEHIPMILINEYMKYEILNKIIK

SEQ ID NO: 3379568 - protein, 21 aa, Plasmodium falciparum
CLDYRCYFLLPTILEITEMNI

SEQ ID NO: 3379569 - protein, 25 aa, Plasmodium falciparum
CLEKLFLQSIIYIFSNILCPKSKEL

SEQ ID NO: 3379570 - protein, 19 aa, Plasmodium falciparum
CLELLYKTHALKLGLDNPK

SEQ ID NO: 3379571 - protein, 22 aa, Plasmodium falciparum
CLENNFVLPENLSFKRHEYMYN

SEQ ID NO: 3379572 - protein, 29 aa, Plasmodium falciparum
CLFDHHKIIFKLLISLKILLYDNIISNKD

SEQ ID NO: 3379573 - protein, 40 aa, Plasmodium falciparum
CLFSHIHSKLIDHLKIRHNKLLIFKKILEVYLIEITNFAK

SEQ ID NO: 3379574 - protein, 18 aa, Plasmodium falciparum
CLHELFVFKVMNTDPNLG

SEQ ID NO: 3379575 - protein, 19 aa, Plasmodium falciparum
CLIEHVVLGLFLYDKFVSS

SEQ ID NO: 3379576 - protein, 17 aa, Plasmodium falciparum
CLIFSQYCSMLDLIEYH

SEQ ID NO: 3379577 - protein, 26 aa, Plasmodium falciparum
CLINHNFFMLVGGINIHRTLNDVWLF

SEQ ID NO: 3379578 - protein, 29 aa, Plasmodium falciparum
CLINIVSYFYSYLDAYMYAIGPLTWVAIE

SEQ ID NO: 3379579 - protein, 19 aa, Plasmodium falciparum
CLIPIFWENNKIKIKTNLN

SEQ ID NO: 3379580 - protein, 29 aa, Plasmodium falciparum
CLKKNNILYIYTYQYLLIELLRCNKNVLT

SEQ ID NO: 3379581 - protein, 29 aa, Plasmodium falciparum
CLKNNRAVYLKRGNMFFISSKEEALEVLK

SEQ ID NO: 3379582 - protein, 30 aa, Plasmodium falciparum
CLKYMIELLSHMMYLLTNTYLNPLTEEVKS

SEQ ID NO: 3379583 - protein, 20 aa, Plasmodium falciparum
CLLIHNIVDVNIIYSKSIEC

SEQ ID NO: 3379584 - protein, 22 aa, Plasmodium falciparum
CLLLNDDGPLVVLEYIEKDPFI

SEQ ID NO: 3379585 - protein, 34 aa, Plasmodium falciparum
CLNCGQFIKKSLCLILIELLKPQVQNILSDVSFY

SEQ ID NO: 3379586 - protein, 18 aa, Plasmodium falciparum
CLNIYPQLNDIPLSSPQI

SEQ ID NO: 3379587 - protein, 21 aa, Plasmodium falciparum
CLNKYERQLIKFVQTFKNTKQ

SEQ ID NO: 3379588 - protein, 18 aa, Plasmodium falciparum
CLNVYGMLLVTHHFYGNI

SEQ ID NO: 3379589 - protein, 19 aa, Plasmodium falciparum
CLNVYRREIQEKNKYISII

SEQ ID NO: 3379590 - protein, 17 aa, Plasmodium falciparum
CLNYLEKLKMKYDQQAQ

SEQ ID NO: 3379591 - protein, 31 aa, Plasmodium falciparum
CLQCTVTFRCFCSYECFMKGFDHLHKYYKSN

SEQ ID NO: 3379592 - protein, 19 aa, Plasmodium falciparum
CLQNKQNLLYTLFDLLHKK

SEQ ID NO: 3379593 - protein, 25 aa, Plasmodium falciparum
CLRCKYICLSVVKMIKHIELYNHGH

SEQ ID NO: 3379594 - protein, 32 aa, Plasmodium falciparum
CLSRREDYFYKVFYFYHIYLSNEMKINQRLML

SEQ ID NO: 3379595 - protein, 21 aa, Plasmodium falciparum
CLVACFKIKYPSRVTLLRGNH

SEQ ID NO: 3379596 - protein, 17 aa, Plasmodium falciparum
CMDMEKLKKLKLAELWK

SEQ ID NO: 3379597 - protein, 19 aa, Plasmodium falciparum
CMIYYIIKNIIEQRLKYIT

SEQ ID NO: 3379598 - protein, 18 aa, Plasmodium falciparum
CMNDMNMRLLNNSKFLPG

SEQ ID NO: 3379599 - protein, 30 aa, Plasmodium falciparum
CMNGWIQISFIFYEKNYYKLFLDLIKEGDI

SEQ ID NO: 3379600 - protein, 17 aa, Plasmodium falciparum
CMNILIGKNEHSKENKE

SEQ ID NO: 3379601 - protein, 26 aa, Plasmodium falciparum
CMQDEEYIYHVLEFCSKGSIYSISKN

SEQ ID NO: 3379602 - protein, 26 aa, Plasmodium falciparum
CMYRKRQLLHEKMLGNWSYVENTINK

SEQ ID NO: 3379603 - protein, 18 aa, Plasmodium falciparum
CNCLYIYRNIYKNRYDVV

SEQ ID NO: 3379604 - protein, 25 aa, Plasmodium falciparum
CNDDIYYFNIYTNVWENVDLNVSQK

SEQ ID NO: 3379605 - protein, 25 aa, Plasmodium falciparum
CNDKNKIDFLLFGGILGNVPSDDRT

SEQ ID NO: 3379606 - protein, 17 aa, Plasmodium falciparum
CNEDNYIYLDDESILLL

SEQ ID NO: 3379607 - protein, 23 aa, Plasmodium falciparum
CNEKNILTLIDLYKNIYKDEEID

SEQ ID NO: 3379608 - protein, 18 aa, Plasmodium falciparum
CNEVKLQEPYRINILSRN

SEQ ID NO: 3379609 - protein, 25 aa, Plasmodium falciparum
CNFKKNIIALLIIPPKIHISIELHS

SEQ ID NO: 3379610 - protein, 19 aa, Plasmodium falciparum
CNFNKLKPLLILKNFNNTS

SEQ ID NO: 3379611 - protein, 17 aa, Plasmodium falciparum
CNGKEPYFSVFLTKKKY

SEQ ID NO: 3379612 - protein, 26 aa, Plasmodium falciparum
CNGKVLYNAFPLLLNMAHNPIDVPLP

SEQ ID NO: 3379613 - protein, 17 aa, Plasmodium falciparum
CNIFEKHLFKRTPIFYK

SEQ ID NO: 3379614 - protein, 17 aa, Plasmodium falciparum
CNIPLIFSFIDEHLMNK

SEQ ID NO: 3379615 - protein, 24 aa, Plasmodium falciparum
CNKEQIVLFSFAKALESIPRHLSH

SEQ ID NO: 3379616 - protein, 24 aa, Plasmodium falciparum
CNKERIFFLIETPLKLNIHKCIDS

SEQ ID NO: 3379617 - protein, 34 aa, Plasmodium falciparum
CNKFLYNNFESYLNYWHVLPCIGYYNKSTINNII

SEQ ID NO: 3379618 - protein, 28 aa, Plasmodium falciparum
CNKIDGPHLIVVPLSTVGNWLREIHRFT

SEQ ID NO: 3379619 - protein, 26 aa, Plasmodium falciparum
CNKIIKRILMVKYIKYFESKSLMILD

SEQ ID NO: 3379620 - protein, 28 aa, Plasmodium falciparum
CNKTSLHYKNNIGILMMAGDKIKVKVSL

SEQ ID NO: 3379621 - protein, 23 aa, Plasmodium falciparum
CNLRASRTFPFISKALNLNFIDL

SEQ ID NO: 3379622 - protein, 25 aa, Plasmodium falciparum
CNMINYNHLVLLYGPPGTGKTSLCK

SEQ ID NO: 3379623 - protein, 19 aa, Plasmodium falciparum
CNMRKLFVDNKFVYIEKKI

SEQ ID NO: 3379624 - protein, 19 aa, Plasmodium falciparum
CNMTFINNQLMMRHVNSVH

SEQ ID NO: 3379625 - protein, 22 aa, Plasmodium falciparum
CNNFPNYDQIIYNNNVLSNGPV

SEQ ID NO: 3379626 - protein, 27 aa, Plasmodium falciparum
CNNHIRLLCCLSLKLIYNLQVAYVYNY

SEQ ID NO: 3379627 - protein, 18 aa, Plasmodium falciparum
CNNIILGGTFYKHCENDL

SEQ ID NO: 3379628 - protein, 18 aa, Plasmodium falciparum
CNNKLYNSNPYNMIPYNI

SEQ ID NO: 3379629 - protein, 36 aa, Plasmodium falciparum
CNNKMKNHFYDISDNLYLQECSDNFFHNNKISSSSI

SEQ ID NO: 3379630 - protein, 25 aa, Plasmodium falciparum
CNNNKYDWFFNSFDYVGNLEESITC

SEQ ID NO: 3379631 - protein, 27 aa, Plasmodium falciparum
CNNSYDHNFIYNYNFSNDNKLPYKCST

SEQ ID NO: 3379632 - protein, 23 aa, Plasmodium falciparum
CNNYNMNNFNLILPNVSLNEDNY

SEQ ID NO: 3379633 - protein, 30 aa, Plasmodium falciparum
CNRKLSYACPVFFIKPFYNSTDLWNNNFYN

SEQ ID NO: 3379634 - protein, 27 aa, Plasmodium falciparum
CNSDISFLLFHYLKYKGYECIYAPYLA

SEQ ID NO: 3379635 - protein, 24 aa, Plasmodium falciparum
CNTCWYKYIIYKKNNSYYNDMIIN

SEQ ID NO: 3379636 - protein, 28 aa, Plasmodium falciparum
CNYCPKKSYYLCPPIPILKIDDTLNTSQ

SEQ ID NO: 3379637 - protein, 24 aa, Plasmodium falciparum
CNYICYLLLNFLIAYEKDIHLNAY

SEQ ID NO: 3379638 - protein, 17 aa, Plasmodium falciparum
CNYLLIKKNEKNVITCI

SEQ ID NO: 3379639 - protein, 35 aa, Plasmodium falciparum
CNYMESHVPFYVVISIFMLSLPQKLQNDDYFKRAS

SEQ ID NO: 3379640 - protein, 28 aa, Plasmodium falciparum
CPDYSSDLNLFFSLYDNIHIERKKYIKN

SEQ ID NO: 3379641 - protein, 26 aa, Plasmodium falciparum
CPIATYAFYKNIKLLEKLNVNTTRRT

SEQ ID NO: 3379642 - protein, 17 aa, Plasmodium falciparum
CPILFLECDIEDTYTLS

SEQ ID NO: 3379643 - protein, 22 aa, Plasmodium falciparum
CPKENILLLNSKKKLIHLHQSK

SEQ ID NO: 3379644 - protein, 17 aa, Plasmodium falciparum
CPLQKTVGMMRIICHFY

SEQ ID NO: 3379645 - protein, 26 aa, Plasmodium falciparum
CPLSENTFISLSYDNSLKLWSKIMNE

SEQ ID NO: 3379646 - protein, 28 aa, Plasmodium falciparum
CPMKCRFCLKYHMGISIMDCLKKARIQT

SEQ ID NO: 3379647 - protein, 26 aa, Plasmodium falciparum
CPMQDMNMMYDVNGIMYGYSYVKNDD

SEQ ID NO: 3379648 - protein, 17 aa, Plasmodium falciparum
CPNLLTCICRCWDFNKI

SEQ ID NO: 3379649 - protein, 34 aa, Plasmodium falciparum
CPQAIHTDLVPLVLKFFIICIYTGNYNTIYNLAT

SEQ ID NO: 3379650 - protein, 23 aa, Plasmodium falciparum
CPRIIMNSYIKAGLLLSLLGGKT

SEQ ID NO: 3379651 - protein, 36 aa, Plasmodium falciparum
CPSKEYIKNKIYFSKLRMGLNMLLKHEKKSKRGRRT

SEQ ID NO: 3379652 - protein, 17 aa, Plasmodium falciparum
CPTFRLPQNFNFQKFPY

SEQ ID NO: 3379653 - protein, 22 aa, Plasmodium falciparum
CPTSFCYNCFPPDYVRYYVGEE

SEQ ID NO: 3379654 - protein, 26 aa, Plasmodium falciparum
CQEKKISTILFIRYISKKKSEISSYI

SEQ ID NO: 3379655 - protein, 24 aa, Plasmodium falciparum
CQICQQIFDSRNKLFQHIQEKGHS

SEQ ID NO: 3379656 - protein, 21 aa, Plasmodium falciparum
CRGFRCSSCGIGTFFIKSEYH

SEQ ID NO: 3379657 - protein, 19 aa, Plasmodium falciparum
CRIDYFVPLCYIYKKKKEE

SEQ ID NO: 3379658 - protein, 17 aa, Plasmodium falciparum
CRKLIINEILKKDKDIL

SEQ ID NO: 3379659 - protein, 18 aa, Plasmodium falciparum
CRLHNIPYLGICLGMQIA

SEQ ID NO: 3379660 - protein, 22 aa, Plasmodium falciparum
CRNDIFCFTYICNNLFLFNHTN

SEQ ID NO: 3379661 - protein, 25 aa, Plasmodium falciparum
CRNEKLIWELIKQILKGISYIHDMK

SEQ ID NO: 3379662 - protein, 22 aa, Plasmodium falciparum
CRNLLNILKIHFINELIVIENI

SEQ ID NO: 3379663 - protein, 21 aa, Plasmodium falciparum
CSAYILEKKVDPSKGKLLTVI

SEQ ID NO: 3379664 - protein, 28 aa, Plasmodium falciparum
CSDIVEIILLYGNKLSIYELINLSSYEF

SEQ ID NO: 3379665 - protein, 22 aa, Plasmodium falciparum
CSELKDLLAKRGLPSHGKKNEL

SEQ ID NO: 3379666 - protein, 28 aa, Plasmodium falciparum
CSENNIIYFWGSRAWLEPKAITLNPLYQ

SEQ ID NO: 3379667 - protein, 19 aa, Plasmodium falciparum
CSFINIHFILYTNYKEYVQ

SEQ ID NO: 3379668 - protein, 21 aa, Plasmodium falciparum
CSFSNAWLEPIFIISNFIINR

SEQ ID NO: 3379669 - protein, 25 aa, Plasmodium falciparum
CSIPQYFILTPQIIKNIVFKDITVH

SEQ ID NO: 3379670 - protein, 26 aa, Plasmodium falciparum
CSLDKDIYWKMFKNKNYKQLLKEKKG

SEQ ID NO: 3379671 - protein, 24 aa, Plasmodium falciparum
CSLEELILHCLKALKCSLSSESEL

SEQ ID NO: 3379672 - protein, 25 aa, Plasmodium falciparum
CSNNKLFRINSLKNLLFIKGTIGGY

SEQ ID NO: 3379673 - protein, 26 aa, Plasmodium falciparum
CSNNLKCILQLLKYELDKEKKASVYF

SEQ ID NO: 3379674 - protein, 25 aa, Plasmodium falciparum
CSSCLQFCFNIIKQKEFVDYIEKEN

SEQ ID NO: 3379675 - protein, 25 aa, Plasmodium falciparum
CSSLISQIFLINKTKLYYIEKTKEK

SEQ ID NO: 3379676 - protein, 24 aa, Plasmodium falciparum
CSVFYEEQNLGILLLEKGYATLVS

SEQ ID NO: 3379677 - protein, 24 aa, Plasmodium falciparum
CSYIYTYIIRKRFLHKRNCCILIQ

SEQ ID NO: 3379678 - protein, 26 aa, Plasmodium falciparum
CTAVFHILEYYYYPPIKILECRALTN

SEQ ID NO: 3379679 - protein, 25 aa, Plasmodium falciparum
CTAYQGKLLPWEYQWNVISHKYETL

SEQ ID NO: 3379680 - protein, 18 aa, Plasmodium falciparum
CTCPYIKIIPNIIDFEKC

SEQ ID NO: 3379681 - protein, 25 aa, Plasmodium falciparum
CTDIFFSITKLFQSNNERLRRMIYL

SEQ ID NO: 3379682 - protein, 21 aa, Plasmodium falciparum
CTDIYNYKLITIILNNTLCSH

SEQ ID NO: 3379683 - protein, 27 aa, Plasmodium falciparum
CTDSKILILKICNIIFEKKKTKNIHIL

SEQ ID NO: 3379684 - protein, 17 aa, Plasmodium falciparum
CTGTFKKFKINSDDNFI

SEQ ID NO: 3379685 - protein, 24 aa, Plasmodium falciparum
CTHILPVLRNVPILRYLSEEELVQ

SEQ ID NO: 3379686 - protein, 25 aa, Plasmodium falciparum
CTKLNSIINFEWINNDLKMNLNGNK

SEQ ID NO: 3379687 - protein, 17 aa, Plasmodium falciparum
CTLLENYVIIFGGLNSE

SEQ ID NO: 3379688 - protein, 30 aa, Plasmodium falciparum
CTLNIYDYINFLLILIFYQCNNKIKECDEK

SEQ ID NO: 3379689 - protein, 17 aa, Plasmodium falciparum
CTMCNVYICYFCCHRMN

SEQ ID NO: 3379690 - protein, 25 aa, Plasmodium falciparum
CTTFLSALKLLKIAQYAGLKQSGIL

SEQ ID NO: 3379691 - protein, 40 aa, Plasmodium falciparum
CTTLNNKYICRYIGIHSGMTLYNIHRCICICLGVKKEDTD

SEQ ID NO: 3379692 - protein, 23 aa, Plasmodium falciparum
CTYNDILLLCDEVAKLFKMENSL

SEQ ID NO: 3379693 - protein, 17 aa, Plasmodium falciparum
CVCAIVLDVIKLLKELP

SEQ ID NO: 3379694 - protein, 18 aa, Plasmodium falciparum
CVCILKFNQCSLMDLLTA

SEQ ID NO: 3379695 - protein, 17 aa, Plasmodium falciparum
CVDKYPWHTHQKRWVDI

SEQ ID NO: 3379696 - protein, 18 aa, Plasmodium falciparum
CVEKGIYGPKFSKSFENT

SEQ ID NO: 3379697 - protein, 30 aa, Plasmodium falciparum
CVELFLICEIVNIKLFFSKTLYLFENVKIG

SEQ ID NO: 3379698 - protein, 24 aa, Plasmodium falciparum
CVENFIRYVPGINLFEKMRLNSND

SEQ ID NO: 3379699 - protein, 25 aa, Plasmodium falciparum
CVESFLKNFFFKNPVGHVGVVALKN

SEQ ID NO: 3379700 - protein, 20 aa, Plasmodium falciparum
CVILFGIPYQYTLSKILKSR

SEQ ID NO: 3379701 - protein, 30 aa, Plasmodium falciparum
CVITKSFLNNYYKRLITYYTKTHEYIKIED

SEQ ID NO: 3379702 - protein, 27 aa, Plasmodium falciparum
CVKNEFNTYLEFYKNIVRPDNNDDESG

SEQ ID NO: 3379703 - protein, 27 aa, Plasmodium falciparum
CVKRNNRSWILYRHIWENSSDDLKYIA

SEQ ID NO: 3379704 - protein, 29 aa, Plasmodium falciparum
CVKVLTKPFLFILINFIKTLLINDTIKHI

SEQ ID NO: 3379705 - protein, 18 aa, Plasmodium falciparum
CVLKLQELQPFLGSYYQD

SEQ ID NO: 3379706 - protein, 27 aa, Plasmodium falciparum
CVLKTRKIIEVYIPKGAPNKHKIVFNG

SEQ ID NO: 3379707 - protein, 27 aa, Plasmodium falciparum
CVLNNFISIFTLLHGHIRNFLKYKKYN

SEQ ID NO: 3379708 - protein, 34 aa, Plasmodium falciparum
CVMYIVSQYHRFLKLHWRFLKTVMKKLFEFAENE

SEQ ID NO: 3379709 - protein, 19 aa, Plasmodium falciparum
CVNFLTNFEKFAIICCACT

SEQ ID NO: 3379710 - protein, 31 aa, Plasmodium falciparum
CVPDYYTFNMLFNMLYYKMKDYGKVLCLYDY

SEQ ID NO: 3379711 - protein, 35 aa, Plasmodium falciparum
CVYKDFRYEYIFKTKIAYMLIKKFYAADDIENTIR

SEQ ID NO: 3379712 - protein, 17 aa, Plasmodium falciparum
CWAIYNSVFVNGLLCLL

SEQ ID NO: 3379713 - protein, 19 aa, Plasmodium falciparum
CWVAFYRSNNFPVCRSFSA

SEQ ID NO: 3379714 - protein, 19 aa, Plasmodium falciparum
CYACEQFLFSIKEEHIKCF

SEQ ID NO: 3379715 - protein, 25 aa, Plasmodium falciparum
CYAIWLCMNEIYPSWFDISIHPAQF

SEQ ID NO: 3379716 - protein, 19 aa, Plasmodium falciparum
CYCLLKNQIIKKIGLINIK

SEQ ID NO: 3379717 - protein, 19 aa, Plasmodium falciparum
CYDHNIKKYFFIEKNIIYI

SEQ ID NO: 3379718 - protein, 28 aa, Plasmodium falciparum
CYDLSNFFKYIFDILYDMIKKGQIRLSD

SEQ ID NO: 3379719 - protein, 17 aa, Plasmodium falciparum
CYELFECNLIRGKGLFS

SEQ ID NO: 3379720 - protein, 26 aa, Plasmodium falciparum
CYHNRNLYKYLYYGKGSSLFSYLFSI

SEQ ID NO: 3379721 - protein, 19 aa, Plasmodium falciparum
CYHYTYFGFENKFENIYCG

SEQ ID NO: 3379722 - protein, 24 aa, Plasmodium falciparum
CYIITCIYHICDDLFYVSTSNGKI

SEQ ID NO: 3379723 - protein, 22 aa, Plasmodium falciparum
CYINDWLLYEYAGAYTFVSSSN

SEQ ID NO: 3379724 - protein, 33 aa, Plasmodium falciparum
CYINVVMQCLSVFFKLIYTLHNYVTVKYKNVNM

SEQ ID NO: 3379725 - protein, 21 aa, Plasmodium falciparum
CYKCISFCNLKYFVVDMIYKN

SEQ ID NO: 3379726 - protein, 17 aa, Plasmodium falciparum
CYKLLKGEKCFNKKCNY

SEQ ID NO: 3379727 - protein, 32 aa, Plasmodium falciparum
CYKLNIDPTHILIYSFPPLTSPVNYSSYNIDS

SEQ ID NO: 3379728 - protein, 27 aa, Plasmodium falciparum
CYNLPEFMYEGFFEFLIKKYNNEDLYK

SEQ ID NO: 3379729 - protein, 19 aa, Plasmodium falciparum
CYNLPTNNLYIDKEGKMHL

SEQ ID NO: 3379730 - protein, 25 aa, Plasmodium falciparum
CYNSQYVNFLWLNNNSYVIFNDKGH

SEQ ID NO: 3379731 - protein, 22 aa, Plasmodium falciparum
CYSWWIFSTLIVLKKYNWINKN

SEQ ID NO: 3379732 - protein, 18 aa, Plasmodium falciparum
CYSYFLWEEVNYQYVNPF

SEQ ID NO: 3379733 - protein, 23 aa, Plasmodium falciparum
CYTTIPIETLLAQGSYSSKDIFN

SEQ ID NO: 3379734 - protein, 24 aa, Plasmodium falciparum
CYYETLYDLILDYSKKQYLTSNIK

SEQ ID NO: 3379735 - protein, 27 aa, Plasmodium falciparum
CYYHEPFYDFIFKKIIMFIHQFDEKEL

SEQ ID NO: 3379736 - protein, 33 aa, Plasmodium falciparum
CYYPLHHDHWYWNFVFDFTQLGLQGLYKILYTM

SEQ ID NO: 3379737 - protein, 23 aa, Plasmodium falciparum
DADLLIFIVPCQYLESVLASIKE

SEQ ID NO: 3379738 - protein, 20 aa, Plasmodium falciparum
DADLTVIKKSYRTLAMKWHP

SEQ ID NO: 3379739 - protein, 24 aa, Plasmodium falciparum
DADRCKFLIRQKLWKGKYRPRPIK

SEQ ID NO: 3379740 - protein, 24 aa, Plasmodium falciparum
DADRILYFFFPQKGEEIKKKIFND

SEQ ID NO: 3379741 - protein, 32 aa, Plasmodium falciparum
DAEEIIVQHGDKILSLIKIKKVEKPTDQKSEK

SEQ ID NO: 3379742 - protein, 25 aa, Plasmodium falciparum
DAEKTTKLLLKNGLDYGKVRFMKVN

SEQ ID NO: 3379743 - protein, 17 aa, Plasmodium falciparum
DAEYVFSQKFFQDIYSN

SEQ ID NO: 3379744 - protein, 20 aa, Plasmodium falciparum
DAGDLISYVRNKLYLDEVSA

SEQ ID NO: 3379745 - protein, 18 aa, Plasmodium falciparum
DAIDTMWQPHFHPHNQEF

SEQ ID NO: 3379746 - protein, 17 aa, Plasmodium falciparum
DAIEKLRFLLQSGNIKA

SEQ ID NO: 3379747 - protein, 26 aa, Plasmodium falciparum
DAIIIYRCILILKYIKLEDYKNCEAE

SEQ ID NO: 3379748 - protein, 18 aa, Plasmodium falciparum
DAINILNGKSFYGRSVDV

SEQ ID NO: 3379749 - protein, 36 aa, Plasmodium falciparum
DAISKRIINYIKLILRYIYKVLKLAFQKLKSDLNTK

SEQ ID NO: 3379750 - protein, 31 aa, Plasmodium falciparum
DAITEELYFKIRQLFIVQAPDYDCVNDDLCV

SEQ ID NO: 3379751 - protein, 17 aa, Plasmodium falciparum
DAKPTMLQPLSSFNLRQ

SEQ ID NO: 3379752 - protein, 17 aa, Plasmodium falciparum
DALLYKCKQINEQNYLP

SEQ ID NO: 3379753 - protein, 29 aa, Plasmodium falciparum
DALQVINTIYYYLYLSRFNEKLYYNRKNY

SEQ ID NO: 3379754 - protein, 19 aa, Plasmodium falciparum
DAMIFILSTRSGSLGLNLQ

SEQ ID NO: 3379755 - protein, 25 aa, Plasmodium falciparum
DAMNNPHLLPLYYQEDNNIEMSTNK

SEQ ID NO: 3379756 - protein, 27 aa, Plasmodium falciparum
DANIDPLWFKTQKILEKMKLRLKSVRL

SEQ ID NO: 3379757 - protein, 25 aa, Plasmodium falciparum
DANNNFYEHLIFDSIYKFVDTPNHL

SEQ ID NO: 3379758 - protein, 24 aa, Plasmodium falciparum
DANNNIIPPPPSTDNRFFNISRKS

SEQ ID NO: 3379759 - protein, 17 aa, Plasmodium falciparum
DAQILPLDSYDAHFLCY

SEQ ID NO: 3379760 - protein, 27 aa, Plasmodium falciparum
DARKDLELLLSYFSLMNSVSLKLKDPL

SEQ ID NO: 3379761 - protein, 21 aa, Plasmodium falciparum
DARNVIFCNYLKRIPELDKLN

SEQ ID NO: 3379762 - protein, 41 aa, Plasmodium falciparum
DARQKRWCAYGYKKKECFSVYRYGFLIARELAIRSRLKVQK

SEQ ID NO: 3379763 - protein, 29 aa, Plasmodium falciparum
DARRLGIRSPWRMVRSRYYVTSASHMISL

SEQ ID NO: 3379764 - protein, 24 aa, Plasmodium falciparum
DASPQWSYFIGDIEIKMVKCKKNI

SEQ ID NO: 3379765 - protein, 35 aa, Plasmodium falciparum
DAVIIIGMKIILNDKYLFLFVDALNSIEYNVKKWM

SEQ ID NO: 3379766 - protein, 25 aa, Plasmodium falciparum
DAVNDLALDFLAKAKIMVIKDIDRE

SEQ ID NO: 3379767 - protein, 24 aa, Plasmodium falciparum
DAYKTPLSLVILDNIERLIDYTRI

SEQ ID NO: 3379768 - protein, 22 aa, Plasmodium falciparum
DAYLDQYLWYEGDLRNLFPNWV

SEQ ID NO: 3379769 - protein, 24 aa, Plasmodium falciparum
DAYSPLELDFFKKNNYTVKNITCG

SEQ ID NO: 3379770 - protein, 20 aa, Plasmodium falciparum
DCCRAVIICGLPYGNVYDSK

SEQ ID NO: 3379771 - protein, 27 aa, Plasmodium falciparum
DCFGRLFINFLQLRGTSLSLYDFILNK

SEQ ID NO: 3379772 - protein, 28 aa, Plasmodium falciparum
DCFKNTYFDTVNKYNLFLSSKGKSKYKN

SEQ ID NO: 3379773 - protein, 19 aa, Plasmodium falciparum
DCFRLINPHILMLGQEPRQ

SEQ ID NO: 3379774 - protein, 17 aa, Plasmodium falciparum
DCFTNEKNPFLHELDVK

SEQ ID NO: 3379775 - protein, 31 aa, Plasmodium falciparum
DCICKPHISPFIKTLLPLLKENFSKGLCVQE

SEQ ID NO: 3379776 - protein, 26 aa, Plasmodium falciparum
DCIKIYNFLKKHNWPVFSFHKNLSLN

SEQ ID NO: 3379777 - protein, 22 aa, Plasmodium falciparum
DCINIMLIIKDLQKYENRGYFS

SEQ ID NO: 3379778 - protein, 17 aa, Plasmodium falciparum
DCIYFLSSNIQSVDIMI

SEQ ID NO: 3379779 - protein, 26 aa, Plasmodium falciparum
DCKNKKWYLNFQPLNNISIEQYWKYE

SEQ ID NO: 3379780 - protein, 18 aa, Plasmodium falciparum
DCNKSTSLILKYPEIQKK

SEQ ID NO: 3379781 - protein, 25 aa, Plasmodium falciparum
DCNTPLDLVYLYLSQGFNNIFDAAS

SEQ ID NO: 3379782 - protein, 26 aa, Plasmodium falciparum
DCNYKKVIFYELLKSCILHFNEYIKY

SEQ ID NO: 3379783 - protein, 24 aa, Plasmodium falciparum
DCPYKSIFYLWNEKNIYININKTG

SEQ ID NO: 3379784 - protein, 28 aa, Plasmodium falciparum
DCSIQLWDLYNIDMLEPLYYLGDNEMKK

SEQ ID NO: 3379785 - protein, 60 aa, Plasmodium falciparum
DCSSCSFFWKQLNCELCKFPYPTYIYIQNKYLELYEIPKPELPYIIIELMNDRNKGFYIV

SEQ ID NO: 3379786 - protein, 19 aa, Plasmodium falciparum
DCTQLELIYLLLGDKDKLT

SEQ ID NO: 3379787 - protein, 18 aa, Plasmodium falciparum
DCVKIKLINMQEYKTKKL

SEQ ID NO: 3379788 - protein, 20 aa, Plasmodium falciparum
DCVNMQCRLPEQSYLPSMLR

SEQ ID NO: 3379789 - protein, 17 aa, Plasmodium falciparum
DCYITLDFLGKDSIRYF

SEQ ID NO: 3379790 - protein, 27 aa, Plasmodium falciparum
DDAINLLYLCYKKWPYDISILNSLIII

SEQ ID NO: 3379791 - protein, 34 aa, Plasmodium falciparum
DDAKYVYDQLAVIAPLFLALTACTPYLGGFLTET

SEQ ID NO: 3379792 - protein, 27 aa, Plasmodium falciparum
DDCSSVILFYNYFLPNMKDNTTYNIKD

SEQ ID NO: 3379793 - protein, 23 aa, Plasmodium falciparum
DDDDKFILKVESELQKFKANMEA

SEQ ID NO: 3379794 - protein, 21 aa, Plasmodium falciparum
DDDENDQNEYAGDDKKDEDGD

SEQ ID NO: 3379795 - protein, 24 aa, Plasmodium falciparum
DDDKYLIHMFLTPQERKKLRKRKR

SEQ ID NO: 3379796 - protein, 24 aa, Plasmodium falciparum
DDDMIYFDEYFYKSLILYNTNIND

SEQ ID NO: 3379797 - protein, 22 aa, Plasmodium falciparum
DDDTKVIIIFHGGIPYLDIAFK

SEQ ID NO: 3379798 - protein, 23 aa, Plasmodium falciparum
DDEAILLYNIRRMYESNTKYTKN

SEQ ID NO: 3379799 - protein, 30 aa, Plasmodium falciparum
DDEDDWELHPLFLSKIPKKNDIDKNAALSA

SEQ ID NO: 3379800 - protein, 19 aa, Plasmodium falciparum
DDEDIILNRSYPRVSMSVR

SEQ ID NO: 3379801 - protein, 26 aa, Plasmodium falciparum
DDEGGCYFIYPEPLILRDANNKKLPN

SEQ ID NO: 3379802 - protein, 17 aa, Plasmodium falciparum
DDEKKICMLNNGNFLIL

SEQ ID NO: 3379803 - protein, 19 aa, Plasmodium falciparum
DDEKYFINLKDYPEKKDDI

SEQ ID NO: 3379804 - protein, 21 aa, Plasmodium falciparum
DDFEFYIKWKNYDSDENTWEP

SEQ ID NO: 3379805 - protein, 21 aa, Plasmodium falciparum
DDFFNKELQTCVSCYQYIKEK

SEQ ID NO: 3379806 - protein, 29 aa, Plasmodium falciparum
DDFHLIKKYYSVYFTYPDLIKIQRFLQIY

SEQ ID NO: 3379807 - protein, 22 aa, Plasmodium falciparum
DDFNPMYFNKMNYPNNFNVKLN

SEQ ID NO: 3379808 - protein, 24 aa, Plasmodium falciparum
DDFSDIYFSCNLANDKFINTQGAN

SEQ ID NO: 3379809 - protein, 32 aa, Plasmodium falciparum
DDGHVKLYYFNCDSPLILYKSNFVRPVSCFDN

SEQ ID NO: 3379810 - protein, 22 aa, Plasmodium falciparum
DDGRYFCISGMYPPQVGLYDTK

SEQ ID NO: 3379811 - protein, 24 aa, Plasmodium falciparum
DDHKNNMNITYLKKSHINQMSSFK

SEQ ID NO: 3379812 - protein, 32 aa, Plasmodium falciparum
DDICVRNYLEKHFPFIKGYRNKYEITDDLFMQ

SEQ ID NO: 3379813 - protein, 25 aa, Plasmodium falciparum
DDIIKNLIMPPVVPFNDMFKKFNKE

SEQ ID NO: 3379814 - protein, 17 aa, Plasmodium falciparum
DDIINIISLIKNHWDIF

SEQ ID NO: 3379815 - protein, 18 aa, Plasmodium falciparum
DDIKALDFLLFDMLKDNL

SEQ ID NO: 3379816 - protein, 27 aa, Plasmodium falciparum
DDIKKSYKKIVLLYHPDKNTHLCDEDK

SEQ ID NO: 3379817 - protein, 17 aa, Plasmodium falciparum
DDILNYKTKDFNNNDDI

SEQ ID NO: 3379818 - protein, 25 aa, Plasmodium falciparum
DDILQRFYMLRIKNISEIISFLSYI

SEQ ID NO: 3379819 - protein, 30 aa, Plasmodium falciparum
DDINKKVLLYLLKNITTPLFDFIKNYIFYG

SEQ ID NO: 3379820 - protein, 17 aa, Plasmodium falciparum
DDINKNETFFLIKENRE

SEQ ID NO: 3379821 - protein, 24 aa, Plasmodium falciparum
DDINKSTIFNMPKIRNDNNATNII

SEQ ID NO: 3379822 - protein, 21 aa, Plasmodium falciparum
DDINWFYNFLCNNSLNTDHNK

SEQ ID NO: 3379823 - protein, 21 aa, Plasmodium falciparum
DDIRNLLEKRLAYERDNTLIK

SEQ ID NO: 3379824 - protein, 20 aa, Plasmodium falciparum
DDISRIIDVLPSPVYPTIDM

SEQ ID NO: 3379825 - protein, 31 aa, Plasmodium falciparum
DDIYNYRDIFNKNKWDFLKNDDMLLNNNMTS

SEQ ID NO: 3379826 - protein, 22 aa, Plasmodium falciparum
DDKCRFFIVHTKNNFLGDVYIF

SEQ ID NO: 3379827 - protein, 23 aa, Plasmodium falciparum
DDKEIYSLWYFCDKKIHSAKLKG

SEQ ID NO: 3379828 - protein, 21 aa, Plasmodium falciparum
DDKIKINYLDSLNSLELKIKQ

SEQ ID NO: 3379829 - protein, 24 aa, Plasmodium falciparum
DDKIVYLYFELYSCYMYVYSPEER

SEQ ID NO: 3379830 - protein, 25 aa, Plasmodium falciparum
DDKKSILEFMPMAKNELLLNTLHHL

SEQ ID NO: 3379831 - protein, 23 aa, Plasmodium falciparum
DDKNMYDFNIKISYLEIYNEELC

SEQ ID NO: 3379832 - protein, 27 aa, Plasmodium falciparum
DDKSDMWALGCIIYELCSGKTPFHKAN

SEQ ID NO: 3379833 - protein, 26 aa, Plasmodium falciparum
DDLKRIPGVYYDKNSQRWFGEHKING

SEQ ID NO: 3379834 - protein, 24 aa, Plasmodium falciparum
DDLRVHMVKLFKTYGGQCRIGKVK

SEQ ID NO: 3379835 - protein, 20 aa, Plasmodium falciparum
DDLYSFYSNPIIVSQNTLEK

SEQ ID NO: 3379836 - protein, 23 aa, Plasmodium falciparum
DDMEKIWHHTFYNELRAAPEEHP

SEQ ID NO: 3379837 - protein, 23 aa, Plasmodium falciparum
DDMEKIWHHTFYNELRVSPEEHP

SEQ ID NO: 3379838 - protein, 31 aa, Plasmodium falciparum
DDMKIFDEKLKNFFLNYKINPNIEESNDTKI

SEQ ID NO: 3379839 - protein, 38 aa, Plasmodium falciparum
DDMKNDIYLWLLKNVKTYLSKFGCRLWHIVFKKSKSHL

SEQ ID NO: 3379840 - protein, 24 aa, Plasmodium falciparum
DDMKNIINDLKNKYYKSLMAKQTM

SEQ ID NO: 3379841 - protein, 24 aa, Plasmodium falciparum
DDMLYTIGYNFLRNSDTKFMGEAL

SEQ ID NO: 3379842 - protein, 17 aa, Plasmodium falciparum
DDMTILNIIYKNNIYKI

SEQ ID NO: 3379843 - protein, 29 aa, Plasmodium falciparum
DDMWQDKYPDKLPKLSLKTFGYLICDDCP

SEQ ID NO: 3379844 - protein, 52 aa, Plasmodium falciparum
DDNGEAELYKFYLPQYNFFYYLKFRPYVRQFLQILSLYYELAIYTNATREYA

SEQ ID NO: 3379845 - protein, 21 aa, Plasmodium falciparum
DDNIINLLLKTCLFGKNFMKT

SEQ ID NO: 3379846 - protein, 18 aa, Plasmodium falciparum
DDNMFLNKKKRSCFFMLN

SEQ ID NO: 3379847 - protein, 20 aa, Plasmodium falciparum
DDNMLKWQRVCRGRYVEFNL

SEQ ID NO: 3379848 - protein, 25 aa, Plasmodium falciparum
DDNNFPYNIYYNIKKINLNESNKTS

SEQ ID NO: 3379849 - protein, 31 aa, Plasmodium falciparum
DDNTFISSFNKFLSLLNNKDLMLCSVCLSKA

SEQ ID NO: 3379850 - protein, 22 aa, Plasmodium falciparum
DDNYYYCGYNNYINNIHDEETK

SEQ ID NO: 3379851 - protein, 26 aa, Plasmodium falciparum
DDPKCTDCLIKCSLYEIWLDNQQKEF

SEQ ID NO: 3379852 - protein, 21 aa, Plasmodium falciparum
DDPNSIPINYDEGAWFNNNQM

SEQ ID NO: 3379853 - protein, 26 aa, Plasmodium falciparum
DDPSKKKLHYLLYKTLEDLNILNEIY

SEQ ID NO: 3379854 - protein, 26 aa, Plasmodium falciparum
DDQYNSFQYWKINSLSFYEKYMNVSD

SEQ ID NO: 3379855 - protein, 22 aa, Plasmodium falciparum
DDRKYMKSLHFYNNYLNTTRGT

SEQ ID NO: 3379856 - protein, 22 aa, Plasmodium falciparum
DDRNPMLSISKQKIKNIWSKFK

SEQ ID NO: 3379857 - protein, 31 aa, Plasmodium falciparum
DDRSLPQVQFILPLLLRGIGIHHGGLLPIIK

SEQ ID NO: 3379858 - protein, 29 aa, Plasmodium falciparum
DDRSNERFFFLFILPDFMAFEDLPDYIIN

SEQ ID NO: 3379859 - protein, 17 aa, Plasmodium falciparum
DDSFNRYSYMEDESNLP

SEQ ID NO: 3379860 - protein, 26 aa, Plasmodium falciparum
DDSIERKIIYENIIKFSKRNVNNEHE

SEQ ID NO: 3379861 - protein, 25 aa, Plasmodium falciparum
DDSNRFRIEILFSSGAKDGFGQNYE

SEQ ID NO: 3379862 - protein, 19 aa, Plasmodium falciparum
DDTCFFNIIISFKKLKIYN

SEQ ID NO: 3379863 - protein, 24 aa, Plasmodium falciparum
DDTKEILNNILLSKYKAEKDNVIK

SEQ ID NO: 3379864 - protein, 26 aa, Plasmodium falciparum
DDTSKKLLFMSYLNVNTQNKNYSSIN

SEQ ID NO: 3379865 - protein, 24 aa, Plasmodium falciparum
DDVDKELFYKLLKKLNKEINKYCY

SEQ ID NO: 3379866 - protein, 28 aa, Plasmodium falciparum
DDVFYKMEYLIHNYFYLKRSDFDNLIDS

SEQ ID NO: 3379867 - protein, 18 aa, Plasmodium falciparum
DDVHILTHDFKNELLIEK

SEQ ID NO: 3379868 - protein, 30 aa, Plasmodium falciparum
DDVLFDDSLYIYFKNIILEKLQLQEINGKI

SEQ ID NO: 3379869 - protein, 46 aa, Plasmodium falciparum
DDVNKVILNHITFDLVKFKYINTKLKELILCVYDTKKFNGLVKRIV

SEQ ID NO: 3379870 - protein, 22 aa, Plasmodium falciparum
DDVPMFFNFVNCCSSVLGSEII

SEQ ID NO: 3379871 - protein, 17 aa, Plasmodium falciparum
DDYDGLIKLIVEKDTNR

SEQ ID NO: 3379872 - protein, 28 aa, Plasmodium falciparum
DDYEKQKIYSILFYNSPHSYVCNEYQVF

SEQ ID NO: 3379873 - protein, 21 aa, Plasmodium falciparum
DDYFNLIQNLKLIDSSLFEIY

SEQ ID NO: 3379874 - protein, 25 aa, Plasmodium falciparum
DDYGDLFILSFLPKKKNKDIFDEED

SEQ ID NO: 3379875 - protein, 29 aa, Plasmodium falciparum
DDYIDINPDYFISFYSSKCKYVFTSDDEE

SEQ ID NO: 3379876 - protein, 20 aa, Plasmodium falciparum
DDYILFLNDCELFYSINETN

SEQ ID NO: 3379877 - protein, 26 aa, Plasmodium falciparum
DDYYSILEELANLEKPKFRSVQESMD

SEQ ID NO: 3379878 - protein, 25 aa, Plasmodium falciparum
DEAKLKLHGLLQHYVKLQEKDKTRK

SEQ ID NO: 3379879 - protein, 25 aa, Plasmodium falciparum
DEANYLLLKENIPAIRWVGGVEMEL

SEQ ID NO: 3379880 - protein, 20 aa, Plasmodium falciparum
DECENVILKTLRKYYKKKDE

SEQ ID NO: 3379881 - protein, 21 aa, Plasmodium falciparum
DECGYLYLYELKNIELKYTYK

SEQ ID NO: 3379882 - protein, 41 aa, Plasmodium falciparum
DECTQINELTLLRFFMKYPIKKFIFIGDVKQLGFVLKSKND

SEQ ID NO: 3379883 - protein, 37 aa, Plasmodium falciparum
DEDHEGLLLTSKFKKKFSYLLLKLKSKDSNLLDKNND

SEQ ID NO: 3379884 - protein, 29 aa, Plasmodium falciparum
DEDKKNYFVNYIKPFIFRFQNVDKNDIPN

SEQ ID NO: 3379885 - protein, 25 aa, Plasmodium falciparum
DEDKRFLLLFTFLKKNMSKKIMVFF

SEQ ID NO: 3379886 - protein, 49 aa, Plasmodium falciparum
DEDNKNFLLNLNNRRNVIIIRDINSHYINTIKSFVLSSPGIQSNDVLNI

SEQ ID NO: 3379887 - protein, 18 aa, Plasmodium falciparum
DEDSVVGFLLAGIGFRDG

SEQ ID NO: 3379888 - protein, 28 aa, Plasmodium falciparum
DEEAKKLVYVGPFNKFKGFNFCISSNKN

SEQ ID NO: 3379889 - protein, 22 aa, Plasmodium falciparum
DEECSFIMSLLNEELKQMLMEK

SEQ ID NO: 3379890 - protein, 20 aa, Plasmodium falciparum
DEEDIFWNHLKDGNVKNKVE

SEQ ID NO: 3379891 - protein, 44 aa, Plasmodium falciparum
DEEDIIKLYLLIYNECGKVLIYFIDYLNEKYFKFGLTHIKNEFV

SEQ ID NO: 3379892 - protein, 27 aa, Plasmodium falciparum
DEEELKCLFLKRLNFGTAGLRGKMCVG

SEQ ID NO: 3379893 - protein, 27 aa, Plasmodium falciparum
DEEFKTIFRRTFASRIYPNYIIKQLSI

SEQ ID NO: 3379894 - protein, 28 aa, Plasmodium falciparum
DEEGNDEDTMKKFSVDTSENEDDKEDDD

SEQ ID NO: 3379895 - protein, 25 aa, Plasmodium falciparum
DEEKNNLLFLYDSDDLIKKDSRIAN

SEQ ID NO: 3379896 - protein, 20 aa, Plasmodium falciparum
DEELIFEIFSLGLKSRGVLS

SEQ ID NO: 3379897 - protein, 33 aa, Plasmodium falciparum
DEELYFIENIINLNFLWVCDPVMGDNGRLYVDE

SEQ ID NO: 3379898 - protein, 26 aa, Plasmodium falciparum
DEEMKKKLQFLLIGGDEKKQMEFMEN

SEQ ID NO: 3379899 - protein, 26 aa, Plasmodium falciparum
DEENQDVLLFIDNIYRFTQAGSEVSA

SEQ ID NO: 3379900 - protein, 24 aa, Plasmodium falciparum
DEEPYHYTNFVKHYVTKVGIYNNM

SEQ ID NO: 3379901 - protein, 25 aa, Plasmodium falciparum
DEESLRYIFYKFFENDIQQINMNEF

SEQ ID NO: 3379902 - protein, 25 aa, Plasmodium falciparum
DEESNLSILALNLKNKRIKKFFYNK

SEQ ID NO: 3379903 - protein, 42 aa, Plasmodium falciparum
DEETKWKQKLKYMQEKFLESILCISYPNDLWTESTFEAYLES

SEQ ID NO: 3379904 - protein, 23 aa, Plasmodium falciparum
DEEVLKFPFKKLENVKLGIFKNE

SEQ ID NO: 3379905 - protein, 18 aa, Plasmodium falciparum
DEFDKLKRIIKNKNKEYF

SEQ ID NO: 3379906 - protein, 26 aa, Plasmodium falciparum
DEFKMKLKFFSTRFSNSILLDKLIIL

SEQ ID NO: 3379907 - protein, 19 aa, Plasmodium falciparum
DEFKNKILFLLNEKKKKDQ

SEQ ID NO: 3379908 - protein, 19 aa, Plasmodium falciparum
DEFYEYWSNFTTVKKVDYS

SEQ ID NO: 3379909 - protein, 27 aa, Plasmodium falciparum
DEFYQHNLIYPLFYLEGLENTCIKPCL

SEQ ID NO: 3379910 - protein, 22 aa, Plasmodium falciparum
DEGFLLGIISLHRIMDKTIQRI

SEQ ID NO: 3379911 - protein, 29 aa, Plasmodium falciparum
DEGGIINKYLINPIYNLFLRANEEIQNSN

SEQ ID NO: 3379912 - protein, 22 aa, Plasmodium falciparum
DEGHFYDSVISDKLPNSSSKKY

SEQ ID NO: 3379913 - protein, 27 aa, Plasmodium falciparum
DEGKTKRFFWEALFENDIPGTLFEDKK

SEQ ID NO: 3379914 - protein, 26 aa, Plasmodium falciparum
DEGNNTPFITYFLAGKTESKTINEES

SEQ ID NO: 3379915 - protein, 23 aa, Plasmodium falciparum
DEGNVIKYKYLPTGVFYSRVSKS

SEQ ID NO: 3379916 - protein, 27 aa, Plasmodium falciparum
DEGRVILVEFSNFFLLSTYTPNNGFDH

SEQ ID NO: 3379917 - protein, 17 aa, Plasmodium falciparum
DEHIWDILVKYFSNYYL

SEQ ID NO: 3379918 - protein, 18 aa, Plasmodium falciparum
DEHLILAIKEIKDWMEKI

SEQ ID NO: 3379919 - protein, 25 aa, Plasmodium falciparum
DEHNNICCNLIKDIFLYGVNLNVDI

SEQ ID NO: 3379920 - protein, 26 aa, Plasmodium falciparum
DEIIQKIPGFWANTLRKHPALSDIVP

SEQ ID NO: 3379921 - protein, 26 aa, Plasmodium falciparum
DEIKKESEIFYKTYLKKIYNKSNEND

SEQ ID NO: 3379922 - protein, 27 aa, Plasmodium falciparum
DEILGPINEFYFSVKLKEGIRAKSFSS

SEQ ID NO: 3379923 - protein, 28 aa, Plasmodium falciparum
DEINKDIFIYEKMAMFVEYAYDIFVNHN

SEQ ID NO: 3379924 - protein, 23 aa, Plasmodium falciparum
DEIVHFSWKKGMLLNNAFLVIRK

SEQ ID NO: 3379925 - protein, 23 aa, Plasmodium falciparum
DEIWNDTLLWVLDLNIKKVEDEK

SEQ ID NO: 3379926 - protein, 27 aa, Plasmodium falciparum
DEKERIEELLKFYITNNRGINLEYNKV

SEQ ID NO: 3379927 - protein, 28 aa, Plasmodium falciparum
DEKILKLIKILLHLYGLNDFNAITYFTL

SEQ ID NO: 3379928 - protein, 23 aa, Plasmodium falciparum
DEKKFILYDIMLESESFFILKEL

SEQ ID NO: 3379929 - protein, 24 aa, Plasmodium falciparum
DEKKNILISFFSTNDIIYFMNKYV

SEQ ID NO: 3379930 - protein, 32 aa, Plasmodium falciparum
DEKSLLCLLSIKSFFQCNPKIEIYSFPGEVNY

SEQ ID NO: 3379931 - protein, 24 aa, Plasmodium falciparum
DEKSLYLEKLLNDKLELLKESNNK

SEQ ID NO: 3379932 - protein, 33 aa, Plasmodium falciparum
DEKTFFYKYNLKYKYEYLKHFFHFALLNDDEFM

SEQ ID NO: 3379933 - protein, 27 aa, Plasmodium falciparum
DEKTSFLYHLNRLRSAVTVVDLHNYIA

SEQ ID NO: 3379934 - protein, 36 aa, Plasmodium falciparum
DEKVTIVLCIILNEIIKFLFLNDEYVLLFEKIHKNV

SEQ ID NO: 3379935 - protein, 23 aa, Plasmodium falciparum
DEKYGYPIVSSRSYIPFPNMDGK

SEQ ID NO: 3379936 - protein, 17 aa, Plasmodium falciparum
DEKYKICDPSKVYPYYY

SEQ ID NO: 3379937 - protein, 24 aa, Plasmodium falciparum
DEKYNDMMIMLMSGLNIKDNYNNI

SEQ ID NO: 3379938 - protein, 24 aa, Plasmodium falciparum
DELKDNYMKWLKTERLMRPNERRL

SEQ ID NO: 3379939 - protein, 52 aa, Plasmodium falciparum
DELKPKAPHIFCIKCKEVLVTNRFLDKYKTKIIMICECGSRNYDRINSYWIR

SEQ ID NO: 3379940 - protein, 27 aa, Plasmodium falciparum
DELTIDYFLFLMIFEKKVEQNFSNYLI

SEQ ID NO: 3379941 - protein, 26 aa, Plasmodium falciparum
DEMNYIRTYFPNCYILSPGIGAQNGD

SEQ ID NO: 3379942 - protein, 19 aa, Plasmodium falciparum
DENALYRKNNLLDYIKDED

SEQ ID NO: 3379943 - protein, 27 aa, Plasmodium falciparum
DENDLKELFSYYKGAHDIRILADKAAA

SEQ ID NO: 3379944 - protein, 44 aa, Plasmodium falciparum
DENEKIRLYQIQRSRYYFALVECYNKEIVEFLYEELNDMDADFC

SEQ ID NO: 3379945 - protein, 31 aa, Plasmodium falciparum
DENFENRVLTIIFYDSLFACSTSSLLINNNK

SEQ ID NO: 3379946 - protein, 23 aa, Plasmodium falciparum
DENIFVFLLSTKAGGVGLNLIAA

SEQ ID NO: 3379947 - protein, 27 aa, Plasmodium falciparum
DENINPVLYVWFAKDKGNYGFVEFATV

SEQ ID NO: 3379948 - protein, 28 aa, Plasmodium falciparum
DENITFRLDNQMIFKKIAETLNIDESVL

SEQ ID NO: 3379949 - protein, 25 aa, Plasmodium falciparum
DENKYFSRIYPNVDPKYVIAFDDRK

SEQ ID NO: 3379950 - protein, 22 aa, Plasmodium falciparum
DENLIAPLISLSQSYMFCGKRK

SEQ ID NO: 3379951 - protein, 27 aa, Plasmodium falciparum
DENNKLIIKDLVGNFIIPYVDKKRGAE

SEQ ID NO: 3379952 - protein, 24 aa, Plasmodium falciparum
DENRKFFIKIILGTLSECTNYNAK

SEQ ID NO: 3379953 - protein, 21 aa, Plasmodium falciparum
DENRLFKIYPSLYNDEIYKHI

SEQ ID NO: 3379954 - protein, 17 aa, Plasmodium falciparum
DENTLPDFLIKYYEWEE

SEQ ID NO: 3379955 - protein, 22 aa, Plasmodium falciparum
DENYIDLNKSFNKNIRSDINEI

SEQ ID NO: 3379956 - protein, 22 aa, Plasmodium falciparum
DENYNILYFYNEKERILNMEKY

SEQ ID NO: 3379957 - protein, 25 aa, Plasmodium falciparum
DEPLLPFEQLLCVLPANSSHCLPKM

SEQ ID NO: 3379958 - protein, 19 aa, Plasmodium falciparum
DEPLYNAIFSQNLEEIKKI

SEQ ID NO: 3379959 - protein, 26 aa, Plasmodium falciparum
DEQEKIIFLYKFIKGVCPKSFGIHIA

SEQ ID NO: 3379960 - protein, 18 aa, Plasmodium falciparum
DEQISKFLFIHMNNNILK

SEQ ID NO: 3379961 - protein, 34 aa, Plasmodium falciparum
DEQKLLSDIIHNLGLKYKQLQTYNLSLRNEITGI

SEQ ID NO: 3379962 - protein, 18 aa, Plasmodium falciparum
DEQKPFNFVLKKDKVNLP

SEQ ID NO: 3379963 - protein, 25 aa, Plasmodium falciparum
DEQKTYLKKYFNISKGLNNIMDKLK

SEQ ID NO: 3379964 - protein, 23 aa, Plasmodium falciparum
DEQYEHFLSFRKGSFVDDISWKK

SEQ ID NO: 3379965 - protein, 23 aa, Plasmodium falciparum
DERDRILLSLDDYENWLYDNIEE

SEQ ID NO: 3379966 - protein, 25 aa, Plasmodium falciparum
DERKKFIYVFIKYYDTLKNDLFNKH

SEQ ID NO: 3379967 - protein, 24 aa, Plasmodium falciparum
DERKYPNFNLLIRGPDKINHCQKE

SEQ ID NO: 3379968 - protein, 25 aa, Plasmodium falciparum
DESGKFYIRAQCKDYDTFFESFVDF

SEQ ID NO: 3379969 - protein, 24 aa, Plasmodium falciparum
DESHLKSLLYFFGLSDEQIKSIMP

SEQ ID NO: 3379970 - protein, 24 aa, Plasmodium falciparum
DESILLLDQLTFYEKNILSTSTCK

SEQ ID NO: 3379971 - protein, 31 aa, Plasmodium falciparum
DESKCYDDIFFLLKILAKHLEIKKIPSAYNE

SEQ ID NO: 3379972 - protein, 32 aa, Plasmodium falciparum
DESKKVFLYAYEYQLKNEKINWKRAEELKITK

SEQ ID NO: 3379973 - protein, 23 aa, Plasmodium falciparum
DESKTWEYYIKGINPDYEPRKEM

SEQ ID NO: 3379974 - protein, 37 aa, Plasmodium falciparum
DESLPPMNFTYVNKTIFFSRLPPYNLLPLCSGCAPHN

SEQ ID NO: 3379975 - protein, 23 aa, Plasmodium falciparum
DESQFYLKQLESCESNSCVANSV

SEQ ID NO: 3379976 - protein, 31 aa, Plasmodium falciparum
DESYLRKIITPLEKLLINFPRIVIKDSAVNA

SEQ ID NO: 3379977 - protein, 25 aa, Plasmodium falciparum
DETDYYIGSILGYSDFMNKMKYQNT

SEQ ID NO: 3379978 - protein, 48 aa, Plasmodium falciparum
DETILLWKCNIFKTFSLSLFFYSFNYMKRWYMNKGIYDTLSYYCYFFS

SEQ ID NO: 3379979 - protein, 23 aa, Plasmodium falciparum
DETYQKIITLPPLATHLTFEILN

SEQ ID NO: 3379980 - protein, 25 aa, Plasmodium falciparum
DEVEDFINMLFYFQNKNYLIFIIYC

SEQ ID NO: 3379981 - protein, 21 aa, Plasmodium falciparum
DEVLNNFIDSLKGKSCHELIT

SEQ ID NO: 3379982 - protein, 18 aa, Plasmodium falciparum
DEWLPFREGVVLQKSSNG

SEQ ID NO: 3379983 - protein, 25 aa, Plasmodium falciparum
DEYCFVEYDLSLCKEFFTLEDFDFA

SEQ ID NO: 3379984 - protein, 21 aa, Plasmodium falciparum
DEYFMSISFFSYVIEKWKILI

SEQ ID NO: 3379985 - protein, 23 aa, Plasmodium falciparum
DEYKSCLPFRSFGFLPKRMCDVY

SEQ ID NO: 3379986 - protein, 18 aa, Plasmodium falciparum
DEYNHSNIGDCTSVFKNE

SEQ ID NO: 3379987 - protein, 75 aa, Plasmodium falciparum
DEYNRLRNIPSYELSKYLYLFYELGKMTEKLNTLFKILFIPTQVKPHKYYFPSVEYFERFYIHLHYKTRADDVDV

SEQ ID NO: 3379988 - protein, 50 aa, Plasmodium falciparum
DEYVLLFEKIHKNVWKRMYIPEEIKFFILKYITLLNNLRDYIISVHNNMK

SEQ ID NO: 3379989 - protein, 19 aa, Plasmodium falciparum
DEYYYEKTLNFLNKEFDSN

SEQ ID NO: 3379990 - protein, 25 aa, Plasmodium falciparum
DFDQFHINLIKKIKIHNGGISFLFL

SEQ ID NO: 3379991 - protein, 24 aa, Plasmodium falciparum
DFERNSMCYQDLYAKLLNIEVYSK

SEQ ID NO: 3379992 - protein, 30 aa, Plasmodium falciparum
DFESSINKLLLILPPNRITFLFSATMTKNV

SEQ ID NO: 3379993 - protein, 23 aa, Plasmodium falciparum
DFETKYFDYLDNNYLDVLKKIQS

SEQ ID NO: 3379994 - protein, 23 aa, Plasmodium falciparum
DFFDIPYLYRRCEINNLSVSREI

SEQ ID NO: 3379995 - protein, 21 aa, Plasmodium falciparum
DFFEDGIFIDLLSFESFSLKF

SEQ ID NO: 3379996 - protein, 17 aa, Plasmodium falciparum
DFFFGSISNNHPNNNTL

SEQ ID NO: 3379997 - protein, 21 aa, Plasmodium falciparum
DFIENFYNFILNSFNLCNAEL

SEQ ID NO: 3379998 - protein, 17 aa, Plasmodium falciparum
DFIENILFYIYRQEFKK

SEQ ID NO: 3379999 - protein, 45 aa, Plasmodium falciparum
DFIKMFKNFFLVLYYFIVLEDNFLKIFFSFNFYFTNDIIPYISAN

SEQ ID NO: 3380000 - protein, 18 aa, Plasmodium falciparum
DFILCTFGGQTALNCALM

SEQ ID NO: 3380001 - protein, 23 aa, Plasmodium falciparum
DFKEIPLKYRKKFYKHKVFYTRN

SEQ ID NO: 3380002 - protein, 33 aa, Plasmodium falciparum
DFKKYDISLSPYINLMIYKLFDRKNVLLQNSPV

SEQ ID NO: 3380003 - protein, 17 aa, Plasmodium falciparum
DFKTTILSRFDIIFLLR

SEQ ID NO: 3380004 - protein, 35 aa, Plasmodium falciparum
DFKVQNKEFPLKYLCPYFLSKLKYHKEQDILMKGY

SEQ ID NO: 3380005 - protein, 30 aa, Plasmodium falciparum
DFLGDHTTVFVDWLMRLMGDIRKQKKSDTS

SEQ ID NO: 3380006 - protein, 19 aa, Plasmodium falciparum
DFLLQFHKKDPQICKKYNS

SEQ ID NO: 3380007 - protein, 38 aa, Plasmodium falciparum
DFLRANNLYFNYFSKLIDIYLKCLLPSDDILDKIKKYA

SEQ ID NO: 3380008 - protein, 28 aa, Plasmodium falciparum
DFNITPNSLLYYFIVNRFINLKHINLKY

SEQ ID NO: 3380009 - protein, 33 aa, Plasmodium falciparum
DFNMKASFRNVYSPVLYNPYVKPFNPTYKNSTP

SEQ ID NO: 3380010 - protein, 23 aa, Plasmodium falciparum
DFNPLRFTLMVIPPINHQQHLYS

SEQ ID NO: 3380011 - protein, 19 aa, Plasmodium falciparum
DFPFLLDELKIYNLSIGTD

SEQ ID NO: 3380012 - protein, 27 aa, Plasmodium falciparum
DFQDDNYFYLFNLKSFYTAKALNMAIP

SEQ ID NO: 3380013 - protein, 18 aa, Plasmodium falciparum
DFQLVINKYLNNKKKRDN

SEQ ID NO: 3380014 - protein, 18 aa, Plasmodium falciparum
DFQRRQMMEKGGTYFFNN

SEQ ID NO: 3380015 - protein, 29 aa, Plasmodium falciparum
DFRDDMDFIIFSPLNNNIYLSSSPLSVDE

SEQ ID NO: 3380016 - protein, 17 aa, Plasmodium falciparum
DFRNFLKKKMDIIKECQ

SEQ ID NO: 3380017 - protein, 27 aa, Plasmodium falciparum
DFRRLYVSLYCLKLIFKKLKIKKKENN

SEQ ID NO: 3380018 - protein, 34 aa, Plasmodium falciparum
DFRSYDNFILLSNKLLKKLSFLYSFKNGVIAEIT

SEQ ID NO: 3380019 - protein, 25 aa, Plasmodium falciparum
DFSEYNLLYFCNHIYIIDVSQSMEH

SEQ ID NO: 3380020 - protein, 27 aa, Plasmodium falciparum
DFSGSFNANFFRNAYKFLYDSREQEKK

SEQ ID NO: 3380021 - protein, 18 aa, Plasmodium falciparum
DFSIFEKVYGKKVAPRFL

SEQ ID NO: 3380022 - protein, 19 aa, Plasmodium falciparum
DFSIVKYIRKGWFEKEIHN

SEQ ID NO: 3380023 - protein, 33 aa, Plasmodium falciparum
DFSKLLEPVFSLNESFLLSHQLFNVQYAAQLGP

SEQ ID NO: 3380024 - protein, 20 aa, Plasmodium falciparum
DFSPSFNLFLTSRDAHFQFT

SEQ ID NO: 3380025 - protein, 21 aa, Plasmodium falciparum
DFSYHDLFVAASQILIDIKKE

SEQ ID NO: 3380026 - protein, 19 aa, Plasmodium falciparum
DFYHDMKLIYKNCIDFNPD

SEQ ID NO: 3380027 - protein, 17 aa, Plasmodium falciparum
DFYKHIDTIIPEEGQHE

SEQ ID NO: 3380028 - protein, 18 aa, Plasmodium falciparum
DFYSIFMNSIRSSQSVLN

SEQ ID NO: 3380029 - protein, 26 aa, Plasmodium falciparum
DFYSKDMHILYKNTFLPREEIDNCSI

SEQ ID NO: 3380030 - protein, 23 aa, Plasmodium falciparum
DFYSMHRFLFLCKSISSLISLEN

SEQ ID NO: 3380031 - protein, 19 aa, Plasmodium falciparum
DGAFEGLTKRNISNSNIVS

SEQ ID NO: 3380032 - protein, 18 aa, Plasmodium falciparum
DGAICDLLWSDPAGPEDE

SEQ ID NO: 3380033 - protein, 26 aa, Plasmodium falciparum
DGALLIKQLVYIQKIPMEELHLSHNL

SEQ ID NO: 3380034 - protein, 24 aa, Plasmodium falciparum
DGCNTINIQYSFLKELVIKGNNSS

SEQ ID NO: 3380035 - protein, 25 aa, Plasmodium falciparum
DGDHLTLLHIFYLWQEADIKEKKHF

SEQ ID NO: 3380036 - protein, 17 aa, Plasmodium falciparum
DGFGLDFQPIKKYILTC

SEQ ID NO: 3380037 - protein, 17 aa, Plasmodium falciparum
DGFYKSLTPHEIKKNIY

SEQ ID NO: 3380038 - protein, 26 aa, Plasmodium falciparum
DGIGVYNWYVHCLKYYIGIKTFREIE

SEQ ID NO: 3380039 - protein, 28 aa, Plasmodium falciparum
DGIKWLEYTYLFIRMKKNPYLYDVDINN

SEQ ID NO: 3380040 - protein, 28 aa, Plasmodium falciparum
DGKESIVIIVPTRSIPIIIGQKGSKISS

SEQ ID NO: 3380041 - protein, 19 aa, Plasmodium falciparum
DGKFLAVYRGHVGPVYKVA

SEQ ID NO: 3380042 - protein, 22 aa, Plasmodium falciparum
DGKFLVFVDYLFFFHNRRELIN

SEQ ID NO: 3380043 - protein, 20 aa, Plasmodium falciparum
DGKLIYKCHIQYVDNFTLIF

SEQ ID NO: 3380044 - protein, 19 aa, Plasmodium falciparum
DGKLRTRKTGFSKFSYQAN

SEQ ID NO: 3380045 - protein, 29 aa, Plasmodium falciparum
DGKTYFKRNKYFYEPILIEAMDKSDHEYE

SEQ ID NO: 3380046 - protein, 26 aa, Plasmodium falciparum
DGKVETLFDDGLKLIEKNRNKKIMHP

SEQ ID NO: 3380047 - protein, 21 aa, Plasmodium falciparum
DGLLIRTYSWTVKKAIGIIVL

SEQ ID NO: 3380048 - protein, 18 aa, Plasmodium falciparum
DGLMLICPYFNAYNEKVC

SEQ ID NO: 3380049 - protein, 23 aa, Plasmodium falciparum
DGNDLFASYLATKKLRDICIQES

SEQ ID NO: 3380050 - protein, 30 aa, Plasmodium falciparum
DGNFNKYWKRYLFFCTNIPGNKSAWTKELY

SEQ ID NO: 3380051 - protein, 26 aa, Plasmodium falciparum
DGPKIICLFFLCIIKMLSHIKLEELK

SEQ ID NO: 3380052 - protein, 19 aa, Plasmodium falciparum
DGPLKISILGSGNWASAIS

SEQ ID NO: 3380053 - protein, 17 aa, Plasmodium falciparum
DGRAFFRNARSRLSYEQ

SEQ ID NO: 3380054 - protein, 26 aa, Plasmodium falciparum
DGRLCNWSLSMFTYPSNTIDLKKGNR

SEQ ID NO: 3380055 - protein, 23 aa, Plasmodium falciparum
DGSFDIFHIGHLRILENAKKLGD

SEQ ID NO: 3380056 - protein, 24 aa, Plasmodium falciparum
DGSIPPQYYAIVHLGIEENNSTIS

SEQ ID NO: 3380057 - protein, 22 aa, Plasmodium falciparum
DGSLYIYLIYEYDNPHFYSDHN

SEQ ID NO: 3380058 - protein, 23 aa, Plasmodium falciparum
DGTMDIIINKKKKIWLNIGCINY

SEQ ID NO: 3380059 - protein, 17 aa, Plasmodium falciparum
DGVFYVMLILSNKKYED

SEQ ID NO: 3380060 - protein, 19 aa, Plasmodium falciparum
DGVLNTKLHIQNIPPHITD

SEQ ID NO: 3380061 - protein, 30 aa, Plasmodium falciparum
DGVLPLRLIDKLLFIYNYVEMARVTGTPFV

SEQ ID NO: 3380062 - protein, 22 aa, Plasmodium falciparum
DGVRYFLFIASNTTFLIDRNYE

SEQ ID NO: 3380063 - protein, 22 aa, Plasmodium falciparum
DGYEGIAKRVNVGLSERALSKI

SEQ ID NO: 3380064 - protein, 20 aa, Plasmodium falciparum
DGYYHKDGYYPKEDYHYKNV

SEQ ID NO: 3380065 - protein, 24 aa, Plasmodium falciparum
DHDKLIFFNNMISKYIYAISDKHF

SEQ ID NO: 3380066 - protein, 37 aa, Plasmodium falciparum
DHEIKRKLIKLINTNFYIDKCIHFKKFSKDELYKTFI

SEQ ID NO: 3380067 - protein, 27 aa, Plasmodium falciparum
DHFRQLLQIIRYFVLLFKQHYGKKNYT

SEQ ID NO: 3380068 - protein, 34 aa, Plasmodium falciparum
DHHTGIYLQLIQNKRKWILKNKKVKKIIITNNSN

SEQ ID NO: 3380069 - protein, 32 aa, Plasmodium falciparum
DHHTTILSSAYHNKLIKTGLKGKLSQLKNGNQ

SEQ ID NO: 3380070 - protein, 17 aa, Plasmodium falciparum
DHIFAHKLDSKTTRENY

SEQ ID NO: 3380071 - protein, 27 aa, Plasmodium falciparum
DHIKDDFIYYLLQNPEFHSYVVFKIFF

SEQ ID NO: 3380072 - protein, 18 aa, Plasmodium falciparum
DHKMSIDVPLWRDKPQLP

SEQ ID NO: 3380073 - protein, 23 aa, Plasmodium falciparum
DHLVEVGVLYKFFYQIKDSEEKI

SEQ ID NO: 3380074 - protein, 25 aa, Plasmodium falciparum
DHNNDYYYNNILSFQNKPLCYNNQL

SEQ ID NO: 3380075 - protein, 32 aa, Plasmodium falciparum
DHNNNSVILYKPIDMSLIYKTYDKNGMIYCKR

SEQ ID NO: 3380076 - protein, 26 aa, Plasmodium falciparum
DHNSKFGTLVALRKAREIFPKDTMSL

SEQ ID NO: 3380077 - protein, 26 aa, Plasmodium falciparum
DHQLKLNILQTNNLIKDLPIKIKDEK

SEQ ID NO: 3380078 - protein, 23 aa, Plasmodium falciparum
DHSKEILFHRKPLKGFYDVKDEQ

SEQ ID NO: 3380079 - protein, 31 aa, Plasmodium falciparum
DHTHSSKLSKNPLFISFIDTKNKTAKLKTFD

SEQ ID NO: 3380080 - protein, 40 aa, Plasmodium falciparum
DHYGYNFKEYFLKSNILEKSISLILERRDIRLSLVGPIEN

SEQ ID NO: 3380081 - protein, 24 aa, Plasmodium falciparum
DIADYVIRHIIHVNLTIGCNLLKG

SEQ ID NO: 3380082 - protein, 19 aa, Plasmodium falciparum
DIAFLNYADSNDSLISKGM

SEQ ID NO: 3380083 - protein, 26 aa, Plasmodium falciparum
DIAKQIYNLLPKIIYNRLVPPRSEIY

SEQ ID NO: 3380084 - protein, 19 aa, Plasmodium falciparum
DICKSYIKNFDYLNKRIFH

SEQ ID NO: 3380085 - protein, 40 aa, Plasmodium falciparum
DICNHKKILKLLQEFCLVESKFLHIHLCLKKERCDNISQK

SEQ ID NO: 3380086 - protein, 31 aa, Plasmodium falciparum
DICNYCKHCLKFLKFLIIHGNKYKGNLINIF

SEQ ID NO: 3380087 - protein, 32 aa, Plasmodium falciparum
DICNYCKHCLKFLKFLIIHGNKYKGNLINIFF

SEQ ID NO: 3380088 - protein, 17 aa, Plasmodium falciparum
DICYNHLFSYRSVKIHI

SEQ ID NO: 3380089 - protein, 31 aa, Plasmodium falciparum
DIDEIAKYNIKFNDIIYAIKVHKKKNGNDVT

SEQ ID NO: 3380090 - protein, 19 aa, Plasmodium falciparum
DIDIYIGYNILNFDLEFLI

SEQ ID NO: 3380091 - protein, 18 aa, Plasmodium falciparum
DIDLLKAPLMNPMNPEVV

SEQ ID NO: 3380092 - protein, 22 aa, Plasmodium falciparum
DIDSIFIDLLFHINALLEVCSQ

SEQ ID NO: 3380093 - protein, 27 aa, Plasmodium falciparum
DIEDLFKKYHLQSISYFLLNSKNENNS

SEQ ID NO: 3380094 - protein, 25 aa, Plasmodium falciparum
DIEDNVSFEFLINKKILRTTIEEFI

SEQ ID NO: 3380095 - protein, 25 aa, Plasmodium falciparum
DIEDSMLYAVYNRLFDLNNKELEND

SEQ ID NO: 3380096 - protein, 25 aa, Plasmodium falciparum
DIEGNLSLFVIKRPDLFGSIYEEIN

SEQ ID NO: 3380097 - protein, 17 aa, Plasmodium falciparum
DIEHIITYIYFNNIHFN

SEQ ID NO: 3380098 - protein, 17 aa, Plasmodium falciparum
DIEIIPLKNKESLNSNK

SEQ ID NO: 3380099 - protein, 31 aa, Plasmodium falciparum
DIEKYYPHTLSLLLEWFRSYKMADTKKLNLI

SEQ ID NO: 3380100 - protein, 21 aa, Plasmodium falciparum
DIENIFIKDQIYICPHNDCKK

SEQ ID NO: 3380101 - protein, 19 aa, Plasmodium falciparum
DIERYRERNIERDRDRDRD

SEQ ID NO: 3380102 - protein, 21 aa, Plasmodium falciparum
DIESLLFKRVYDLAGTCSVRV

SEQ ID NO: 3380103 - protein, 17 aa, Plasmodium falciparum
DIFKDKNVGLLQHEERS

SEQ ID NO: 3380104 - protein, 18 aa, Plasmodium falciparum
DIFKYHDFPMNMFGKKKN

SEQ ID NO: 3380105 - protein, 19 aa, Plasmodium falciparum
DIFNLSLNLFFENYHRVEE

SEQ ID NO: 3380106 - protein, 37 aa, Plasmodium falciparum
DIFNYITSCRTLGQLSIWLPAFEIIDSSLESIANHLI

SEQ ID NO: 3380107 - protein, 17 aa, Plasmodium falciparum
DIFYIHSKLLERSSKLN

SEQ ID NO: 3380108 - protein, 29 aa, Plasmodium falciparum
DIGSQLYMYIKRHFLRILDIFEKKVQLLA

SEQ ID NO: 3380109 - protein, 19 aa, Plasmodium falciparum
DIGTIRCIILNEGKVIEQF

SEQ ID NO: 3380110 - protein, 34 aa, Plasmodium falciparum
DIGYKYCIKIRTNSFIFYLSKELNKFPHIPEISY

SEQ ID NO: 3380111 - protein, 33 aa, Plasmodium falciparum
DIHGPKHIYHDLLYLYFKKLPDKKNDGTYDSLS

SEQ ID NO: 3380112 - protein, 17 aa, Plasmodium falciparum
DIHILNDTYLYVTSDEE

SEQ ID NO: 3380113 - protein, 25 aa, Plasmodium falciparum
DIHYNNLFLSKSIKKLRNKYLESLL

SEQ ID NO: 3380114 - protein, 21 aa, Plasmodium falciparum
DIIDNIKRYINKEPLIPMVPW

SEQ ID NO: 3380115 - protein, 25 aa, Plasmodium falciparum
DIIENFHIFLLNTLNNDILYFQKFS

SEQ ID NO: 3380116 - protein, 44 aa, Plasmodium falciparum
DIIHDKLHVYHKLKELIKYQYKEYLLHKTVYPRNICRNEHMNQK

SEQ ID NO: 3380117 - protein, 17 aa, Plasmodium falciparum
DIIIDILLQKLNSSNYL

SEQ ID NO: 3380118 - protein, 30 aa, Plasmodium falciparum
DIIIQNWCNTLQAYSYCLSLLTKGNAEYTM

SEQ ID NO: 3380119 - protein, 27 aa, Plasmodium falciparum
DIIKEALLLRPPIPIKNKSLNIYYAFQ

SEQ ID NO: 3380120 - protein, 19 aa, Plasmodium falciparum
DIIKITKWNNDMELSKNFI

SEQ ID NO: 3380121 - protein, 20 aa, Plasmodium falciparum
DIIKKKFFISSVNSHYVMIN

SEQ ID NO: 3380122 - protein, 22 aa, Plasmodium falciparum
DIIKLGRFRLKVRQFIESVDTL

SEQ ID NO: 3380123 - protein, 19 aa, Plasmodium falciparum
DIIKNLFVSAITPSIKDID

SEQ ID NO: 3380124 - protein, 18 aa, Plasmodium falciparum
DIILCDYIEQLIKLHNHY

SEQ ID NO: 3380125 - protein, 26 aa, Plasmodium falciparum
DIILDTFKGINGCILAYGQTGSGKTH

SEQ ID NO: 3380126 - protein, 26 aa, Plasmodium falciparum
DIINGWNLWAKFISYCNFNYSHLGLA

SEQ ID NO: 3380127 - protein, 18 aa, Plasmodium falciparum
DIINLYQIYLKKLIDTAS

SEQ ID NO: 3380128 - protein, 20 aa, Plasmodium falciparum
DIIRIVFDGVLILLQGKLKE

SEQ ID NO: 3380129 - protein, 24 aa, Plasmodium falciparum
DIISKLMYELFYEIQKVHINIYLN

SEQ ID NO: 3380130 - protein, 21 aa, Plasmodium falciparum
DIIYCLRYDNFVRIRFHIISM

SEQ ID NO: 3380131 - protein, 18 aa, Plasmodium falciparum
DIIYFPHNIDFRGRMYPL

SEQ ID NO: 3380132 - protein, 18 aa, Plasmodium falciparum
DIIYIYRSMTIFHFLNIY

SEQ ID NO: 3380133 - protein, 17 aa, Plasmodium falciparum
DIKAICTEAGLLALRER

SEQ ID NO: 3380134 - protein, 19 aa, Plasmodium falciparum
DIKDIRLKMTYEISQGCLV

SEQ ID NO: 3380135 - protein, 29 aa, Plasmodium falciparum
DIKELLEQFKFLQKMVVKMGKLGLRENNI

SEQ ID NO: 3380136 - protein, 29 aa, Plasmodium falciparum
DIKEVKYFYDFWYNFNNWRDFSYQNEYDY

SEQ ID NO: 3380137 - protein, 17 aa, Plasmodium falciparum
DIKHAFYQPCDGQLIIL

SEQ ID NO: 3380138 - protein, 37 aa, Plasmodium falciparum
DIKIKNIYKYDFFLNKTFKYIYIKYVENVHAKLYMEQ

SEQ ID NO: 3380139 - protein, 22 aa, Plasmodium falciparum
DIKKFEWHVPDIKSITKFLHKT

SEQ ID NO: 3380140 - protein, 26 aa, Plasmodium falciparum
DIKKIDDEYLFLQRKFKKQKTDNAVL

SEQ ID NO: 3380141 - protein, 35 aa, Plasmodium falciparum
DIKKKKFLHLSEYYPYFYSLQNIKLSLFSLQRNVV

SEQ ID NO: 3380142 - protein, 36 aa, Plasmodium falciparum
DIKNVLFLSKLFTYLLKEKLINFLIFKHIKIEEMKN

SEQ ID NO: 3380143 - protein, 32 aa, Plasmodium falciparum
DIKNVLKSGIPKKASWLPKSDKYFLTGHNNCI

SEQ ID NO: 3380144 - protein, 27 aa, Plasmodium falciparum
DIKPENFLFYDMTPESLIKIIDFGLAS

SEQ ID NO: 3380145 - protein, 23 aa, Plasmodium falciparum
DIKQLIMIYYSLYNYINKIYHME

SEQ ID NO: 3380146 - protein, 31 aa, Plasmodium falciparum
DIKSNSHIWILQHPSYINSLIKNIKNFKNVE

SEQ ID NO: 3380147 - protein, 26 aa, Plasmodium falciparum
DIKYTRSYSLPPWLKSMYGNNFNTNM

SEQ ID NO: 3380148 - protein, 17 aa, Plasmodium falciparum
DILAHLGLSQKSARILF

SEQ ID NO: 3380149 - protein, 36 aa, Plasmodium falciparum
DILCSYIHLYKSVLNFYLNNMNILYQSILEEKIIDK

SEQ ID NO: 3380150 - protein, 33 aa, Plasmodium falciparum
DILDKNLFIEYILPLFLLFIRIEETNLKSDLFI

SEQ ID NO: 3380151 - protein, 32 aa, Plasmodium falciparum; identical to SEQ ID NO: 3353657

SEQ ID NO: 3380152 - protein, 26 aa, Plasmodium falciparum
DILKQIILDPFGNYVIQRALSVASEP

SEQ ID NO: 3380153 - protein, 21 aa, Plasmodium falciparum
DILNDKLIIKKFERLGSLHLQ

SEQ ID NO: 3380154 - protein, 19 aa, Plasmodium falciparum
DILNFDLLIVAIKRGVLSV

SEQ ID NO: 3380155 - protein, 25 aa, Plasmodium falciparum
DILTQTIIFWFLPSVNTRKYFSNTY

SEQ ID NO: 3380156 - protein, 19 aa, Plasmodium falciparum
DILVADTINFTFGADHRYI

SEQ ID NO: 3380157 - protein, 17 aa, Plasmodium falciparum
DILVFLPGQYEIELVQQ

SEQ ID NO: 3380158 - protein, 19 aa, Plasmodium falciparum
DILYLPCGWFHEVKSFSSE

SEQ ID NO: 3380159 - protein, 20 aa, Plasmodium falciparum
DILYYPYSFSSIKLPILVLI

SEQ ID NO: 3380160 - protein, 28 aa, Plasmodium falciparum
DIMINKLFSCFTFLIRKKYNDLIKQKNS

SEQ ID NO: 3380161 - protein, 18 aa, Plasmodium falciparum
DIMNESLNLYIYNELLRK

SEQ ID NO: 3380162 - protein, 39 aa, Plasmodium falciparum
DIMNNNIMYLLESRYIKNLFSLFNYIDHTKFIYNEPKGN

SEQ ID NO: 3380163 - protein, 24 aa, Plasmodium falciparum
DIMPTYGVLPYYTFHHEYIIYDNS

SEQ ID NO: 3380164 - protein, 18 aa, Plasmodium falciparum
DINDIRLFWSNDKRFINQ

SEQ ID NO: 3380165 - protein, 43 aa, Plasmodium falciparum
DINEHMKIKWPDFLKLNNLIYYNHILNIYEGIRNIFNKYEKEK

SEQ ID NO: 3380166 - protein, 32 aa, Plasmodium falciparum
DINEICTNLIPYPFFNFLLSSLSPCIESESIR

SEQ ID NO: 3380167 - protein, 25 aa, Plasmodium falciparum
DINEKVIALLLSSKAQKIKDIEKDT

SEQ ID NO: 3380168 - protein, 27 aa, Plasmodium falciparum
DINFKKFDMVLFFKDIEFINYDDKNDI

SEQ ID NO: 3380169 - protein, 18 aa, Plasmodium falciparum
DINFLNLASSYIYFLYFN

SEQ ID NO: 3380170 - protein, 22 aa, Plasmodium falciparum
DINIIEQYILYGLIDIDKIKNV

SEQ ID NO: 3380171 - protein, 26 aa, Plasmodium falciparum
DINIPKVYFYRELIYYRINGLDETFK

SEQ ID NO: 3380172 - protein, 18 aa, Plasmodium falciparum
DINKGIIQLINNLEVYLR

SEQ ID NO: 3380173 - protein, 20 aa, Plasmodium falciparum
DINKGMSKGSMLYCPIKYHN

SEQ ID NO: 3380174 - protein, 17 aa, Plasmodium falciparum
DINKHFILKAGHPSPLS

SEQ ID NO: 3380175 - protein, 28 aa, Plasmodium falciparum
DINKSVLSVLPFIHTILNTSPIRDKKIY

SEQ ID NO: 3380176 - protein, 17 aa, Plasmodium falciparum
DINLEHCSIVELVYRCI

SEQ ID NO: 3380177 - protein, 21 aa, Plasmodium falciparum
DINNLFKYNDKICEFINICEH

SEQ ID NO: 3380178 - protein, 29 aa, Plasmodium falciparum
DINNSYVNVLYFRKLKLNKKLFEKLKNKN

SEQ ID NO: 3380179 - protein, 33 aa, Plasmodium falciparum
DINRRLFLENMLYFLLRTGLNFRFFPEIYNWKW

SEQ ID NO: 3380180 - protein, 26 aa, Plasmodium falciparum
DIQGIYSLCIKYILNKDIQNIRIEEY

SEQ ID NO: 3380181 - protein, 50 aa, Plasmodium falciparum
DIQISSIQNYYFVGNFYYDNNMLNYFFYIKYIISYSPWNIFKDYVNTSNV

SEQ ID NO: 3380182 - protein, 26 aa, Plasmodium falciparum
DIQNLRYLIIMTLSDNINTFFHKIGR

SEQ ID NO: 3380183 - protein, 23 aa, Plasmodium falciparum
DIQNNELDYFWNNKDVSNILNKE

SEQ ID NO: 3380184 - protein, 24 aa, Plasmodium falciparum
DIQSFYHPSNFLHYKNKCSPCKDY

SEQ ID NO: 3380185 - protein, 37 aa, Plasmodium falciparum
DIRILDNISWTILLKKYIFIILYTMKHCIVFNDKEEK

SEQ ID NO: 3380186 - protein, 25 aa, Plasmodium falciparum
DIRKKEVLVTLLLCSLINKNSFVLC

SEQ ID NO: 3380187 - protein, 18 aa, Plasmodium falciparum
DIRMIDFANTIYLQDNPS

SEQ ID NO: 3380188 - protein, 26 aa, Plasmodium falciparum
DIRNKNLPFQLLKLEQNMLENISKCY

SEQ ID NO: 3380189 - protein, 24 aa, Plasmodium falciparum
DIRSKWAVHIIKHDFPLLSVCSDK

SEQ ID NO: 3380190 - protein, 35 aa, Plasmodium falciparum
DISLANNVSLGKHLLIGSSLKKGISVSVRGRTMNL

SEQ ID NO: 3380191 - protein, 17 aa, Plasmodium falciparum
DISLFNKIKLQIFMYMI

SEQ ID NO: 3380192 - protein, 17 aa, Plasmodium falciparum
DISLPFHKNSMNEINII

SEQ ID NO: 3380193 - protein, 26 aa, Plasmodium falciparum
DISLRISKDIDMLYYYFKVNRENDQF

SEQ ID NO: 3380194 - protein, 17 aa, Plasmodium falciparum
DISLWTYSKEGVSEKGI

SEQ ID NO: 3380195 - protein, 26 aa, Plasmodium falciparum
DISNFKFIDFMPIKDHLLKLREEKLN

SEQ ID NO: 3380196 - protein, 22 aa, Plasmodium falciparum
DISRMFLEYFKKKNYFDEWIKI

SEQ ID NO: 3380197 - protein, 27 aa, Plasmodium falciparum
DISTIPEEFLLYFKDIIKLNKLYEHSD

SEQ ID NO: 3380198 - protein, 33 aa, Plasmodium falciparum
DISYETLQMIQFSIVWSTYIFKISNKEIIIENN

SEQ ID NO: 3380199 - protein, 18 aa, Plasmodium falciparum
DITEDGFVSLLYDNGDTK

SEQ ID NO: 3380200 - protein, 21 aa, Plasmodium falciparum
DITFTFFNENLSYTLLRNNNY

SEQ ID NO: 3380201 - protein, 24 aa, Plasmodium falciparum
DITIINNERASHGSKFVLQHNMDN

SEQ ID NO: 3380202 - protein, 23 aa, Plasmodium falciparum
DITKEDLLRPILFNSYMKNYYTE

SEQ ID NO: 3380203 - protein, 25 aa, Plasmodium falciparum
DITNEQVFLVKWTSCAYDQCTEETK

SEQ ID NO: 3380204 - protein, 30 aa, Plasmodium falciparum
DITPLFNCINLTILFLQINKIKSILGIEKL

SEQ ID NO: 3380205 - protein, 20 aa, Plasmodium falciparum
DITVHYLFNGFGVVDKQFDN

SEQ ID NO: 3380206 - protein, 27 aa, Plasmodium falciparum
DIVKMYYSILDFKQIYFTLKPIQGKNK

SEQ ID NO: 3380207 - protein, 18 aa, Plasmodium falciparum
DIVQIKKFKDIKNYLTKC

SEQ ID NO: 3380208 - protein, 20 aa, Plasmodium falciparum
DIVYIILKYKYVSQNVNIFF

SEQ ID NO: 3380209 - protein, 26 aa, Plasmodium falciparum
DIWSCGVILYILLSGCPPFNGSNEYD

SEQ ID NO: 3380210 - protein, 25 aa, Plasmodium falciparum
DIWSLGCLFMELIQGRPLFPGKNDC

SEQ ID NO: 3380211 - protein, 27 aa, Plasmodium falciparum
DIWSSGVIMYILLCGYPPFNGKNNDEI

SEQ ID NO: 3380212 - protein, 25 aa, Plasmodium falciparum
DIWSVGITMCECLLGFVPVTSKFES

SEQ ID NO: 3380213 - protein, 46 aa, Plasmodium falciparum
DIYDHKFYYLLIQQAYQIKKLLYLENLTLILYALKNICYLNVHNFQ

SEQ ID NO: 3380214 - protein, 21 aa, Plasmodium falciparum
DIYDIFSNFNSLKMYENNIAN

SEQ ID NO: 3380215 - protein, 19 aa, Plasmodium falciparum
DIYEHIDSSYFYVSCSNCE

SEQ ID NO: 3380216 - protein, 28 aa, Plasmodium falciparum
DIYEKINYLYTFLFSKKNKKIIVFFSTC

SEQ ID NO: 3380217 - protein, 17 aa, Plasmodium falciparum
DIYFLVVMKRKIHCFEN

SEQ ID NO: 3380218 - protein, 19 aa, Plasmodium falciparum
DIYIREILKRNKSLQFLLE

SEQ ID NO: 3380219 - protein, 17 aa, Plasmodium falciparum
DIYIWGDNYGNKPNLIK

SEQ ID NO: 3380220 - protein, 20 aa, Plasmodium falciparum
DIYIYFLNKRYYNPPSKRKW

SEQ ID NO: 3380221 - protein, 19 aa, Plasmodium falciparum
DIYKLFYKYLKNNNIESTH

SEQ ID NO: 3380222 - protein, 26 aa, Plasmodium falciparum
DIYKTIFIDLIILNPVYKIGDEIKDK

SEQ ID NO: 3380223 - protein, 23 aa, Plasmodium falciparum
DIYKTLYHIFKTRYLNILNTHLD

SEQ ID NO: 3380224 - protein, 21 aa, Plasmodium falciparum
DIYMNNLYDINPLNNDYINYN

SEQ ID NO: 3380225 - protein, 17 aa, Plasmodium falciparum
DIYNCRYDKIKKVKVIP

SEQ ID NO: 3380226 - protein, 20 aa, Plasmodium falciparum
DIYNYLRNTYNKTPSKFYRT

SEQ ID NO: 3380227 - protein, 23 aa, Plasmodium falciparum
DIYSTFYHIFLVENLKLSNMFPT

SEQ ID NO: 3380228 - protein, 36 aa, Plasmodium falciparum
DKAKQFLFKAFVVGSSDNLLYFIEKKKLNDIIYNIE

SEQ ID NO: 3380229 - protein, 27 aa, Plasmodium falciparum
DKCVSMKNFFFYESPICFCLYNNDYNN

SEQ ID NO: 3380230 - protein, 24 aa, Plasmodium falciparum
DKDAILFEYVLSSVKIIMNSLNKD

SEQ ID NO: 3380231 - protein, 26 aa, Plasmodium falciparum
DKDGETIFPCHNLSIKPIQGSGVFWY

SEQ ID NO: 3380232 - protein, 26 aa, Plasmodium falciparum
DKDGNICDFFMVCSSELKGIKKCRNV

SEQ ID NO: 3380233 - protein, 24 aa, Plasmodium falciparum
DKDHLFLYVSFFNNKNKIVYFKYK

SEQ ID NO: 3380234 - protein, 18 aa, Plasmodium falciparum
DKDLFTIINNICELEFNS

SEQ ID NO: 3380235 - protein, 26 aa, Plasmodium falciparum
DKDREIILLGLLNLDSLYGENWFEEK

SEQ ID NO: 3380236 - protein, 23 aa, Plasmodium falciparum
DKDTSYHMYPVHNNNIPFIHNRK

SEQ ID NO: 3380237 - protein, 49 aa, Plasmodium falciparum
DKDTYLEMSKKEKINIFLKYLKMIDVNSLSHLFQYFVDREKDEEMKKKL

SEQ ID NO: 3380238 - protein, 25 aa, Plasmodium falciparum
DKEDLYIRWPYFYNRMDVLEPFYIT

SEQ ID NO: 3380239 - protein, 24 aa, Plasmodium falciparum
DKEEILFILLNNNTIYLFFPNLIN

SEQ ID NO: 3380240 - protein, 17 aa, Plasmodium falciparum
DKEFLFNNKINVLSNYI

SEQ ID NO: 3380241 - protein, 26 aa, Plasmodium falciparum
DKEIKNILNVLNNLRNYKFHDTDNLD

SEQ ID NO: 3380242 - protein, 27 aa, Plasmodium falciparum
DKEKKFFQYLMIYISRFFMSDEEIVIF

SEQ ID NO: 3380243 - protein, 23 aa, Plasmodium falciparum
DKELFVNQIMFILDFIKIINEKV

SEQ ID NO: 3380244 - protein, 21 aa, Plasmodium falciparum
DKELLHFFDRYNIKYQIVLSK

SEQ ID NO: 3380245 - protein, 21 aa, Plasmodium falciparum
DKETFLKNIKYEKCPKGKYII

SEQ ID NO: 3380246 - protein, 24 aa, Plasmodium falciparum
DKEWPQVHAYLKKRWSKETNIELN

SEQ ID NO: 3380247 - protein, 24 aa, Plasmodium falciparum
DKEYQKYFVLYENDIFNIYEMNKT

SEQ ID NO: 3380248 - protein, 49 aa, Plasmodium falciparum
DKFIPINGRFTAKALCKLFAFVNNEFFFPSYIINKIRKKYTIDKSVEAL

SEQ ID NO: 3380249 - protein, 26 aa, Plasmodium falciparum
DKFKSAIMPIALLWARGHSFVEILSD

SEQ ID NO: 3380250 - protein, 27 aa, Plasmodium falciparum
DKFSESIPRWLTFLRGIVDSENLPLNV

SEQ ID NO: 3380251 - protein, 23 aa, Plasmodium falciparum
DKFYPIFQILKKNICKFNCIEGE

SEQ ID NO: 3380252 - protein, 24 aa, Plasmodium falciparum
DKGGNFIGLLKYQNKDFSMHLLSL

SEQ ID NO: 3380253 - protein, 24 aa, Plasmodium falciparum
DKGIYLNNLLCDRKNPIGEDSSSF

SEQ ID NO: 3380254 - protein, 31 aa, Plasmodium falciparum
DKGLNNYQVNLLFKNFKRLAPNQRKAALEII

SEQ ID NO: 3380255 - protein, 30 aa, Plasmodium falciparum
DKGSNDIYLIILPFNFIKINFKNIASYIKY

SEQ ID NO: 3380256 - protein, 25 aa, Plasmodium falciparum
DKGSVLNLIPHLFKAVKHGFQSMGI

SEQ ID NO: 3380257 - protein, 35 aa, Plasmodium falciparum
DKHSLPYNDYLSKDSAYIYFDFEKKKLDSQEKHSY

SEQ ID NO: 3380258 - protein, 17 aa, Plasmodium falciparum
DKHYLNYKISNDNLVNN

SEQ ID NO: 3380259 - protein, 27 aa, Plasmodium falciparum
DKICENTYYILKPTNIKRISYGVVDKC

SEQ ID NO: 3380260 - protein, 20 aa, Plasmodium falciparum
DKICRHIFVENPRIVKFSIG

SEQ ID NO: 3380261 - protein, 30 aa, Plasmodium falciparum
DKIFTQHWIMFQLYTILFEGYRDTSQWEKA

SEQ ID NO: 3380262 - protein, 18 aa, Plasmodium falciparum
DKIGRSALHYACAGGYFD

SEQ ID NO: 3380263 - protein, 31 aa, Plasmodium falciparum
DKIHELTHIDYWFLHKFYNIYNLQNKLKTLK

SEQ ID NO: 3380264 - protein, 22 aa, Plasmodium falciparum
DKIKENCLYSLKLKDFFVSVLK

SEQ ID NO: 3380265 - protein, 17 aa, Plasmodium falciparum
DKIKLEINPYLKKRGID

SEQ ID NO: 3380266 - protein, 51 aa, Plasmodium falciparum
DKIKSSLLCFIKNIHFSPVTWILKLNIGWDINFFPYPIDFLNHIKSEINKE

SEQ ID NO: 3380267 - protein, 17 aa, Plasmodium falciparum
DKILVYKELLNNIRNKK

SEQ ID NO: 3380268 - protein, 24 aa, Plasmodium falciparum
DKINDFTHNLYLSSRQNNKESYGE

SEQ ID NO: 3380269 - protein, 17 aa, Plasmodium falciparum
DKINILNKNLKYMKLKK

SEQ ID NO: 3380270 - protein, 24 aa, Plasmodium falciparum
DKINNFYPFHFYPSCYISQQQKRK

SEQ ID NO: 3380271 - protein, 27 aa, Plasmodium falciparum
DKINNNFNSNWIRKLKSFGASSDNEDE

SEQ ID NO: 3380272 - protein, 20 aa, Plasmodium falciparum
DKIQILSFLKENCKFVMDIT

SEQ ID NO: 3380273 - protein, 21 aa, Plasmodium falciparum
DKIQNFITYNKNINLSIVFFL

SEQ ID NO: 3380274 - protein, 24 aa, Plasmodium falciparum
DKIRGAFFFKVKLENSLKGQIKTS

SEQ ID NO: 3380275 - protein, 22 aa, Plasmodium falciparum
DKITCYVINKPWHKLNSKLQKK

SEQ ID NO: 3380276 - protein, 20 aa, Plasmodium falciparum
DKIVIYLKRCLLCYEDWSIS

SEQ ID NO: 3380277 - protein, 26 aa, Plasmodium falciparum
DKIYKDVLSFYNMYKDKVKFLLLEEC

SEQ ID NO: 3380278 - protein, 25 aa, Plasmodium falciparum
DKIYKKIFSFDLDNTLILSRGFFKP

SEQ ID NO: 3380279 - protein, 29 aa, Plasmodium falciparum
DKKCRPILIINLLKVELLSIDDLSNLFFF

SEQ ID NO: 3380280 - protein, 27 aa, Plasmodium falciparum
DKKDYYKLISFFTLLLSTNWFNEDQNE

SEQ ID NO: 3380281 - protein, 27 aa, Plasmodium falciparum
DKKFKAKGYIFLRNILRYLNVEEEMKE

SEQ ID NO: 3380282 - protein, 25 aa, Plasmodium falciparum
DKKIIKYNYDCNVPFFLNSSICTKN

SEQ ID NO: 3380283 - protein, 24 aa, Plasmodium falciparum
DKKILYGILSPNILDTLKLMLNKI

SEQ ID NO: 3380284 - protein, 20 aa, Plasmodium falciparum
DKKKFLSFNLEKLHLKKKLE

SEQ ID NO: 3380285 - protein, 24 aa, Plasmodium falciparum
DKKKGLLICSLPLNFRYSIFLLNS

SEQ ID NO: 3380286 - protein, 19 aa, Plasmodium falciparum
DKKLEKFKSFIIEDSNSSS

SEQ ID NO: 3380287 - protein, 33 aa, Plasmodium falciparum
DKKLSSYINSSKRKFYALDKLKTNRHLDLETHE

SEQ ID NO: 3380288 - protein, 27 aa, Plasmodium falciparum
DKKQATILILFLTYLDKLQIKRKKNYK

SEQ ID NO: 3380289 - protein, 23 aa, Plasmodium falciparum
DKKRDIIFYIYVNRTFPIHRLIE

SEQ ID NO: 3380290 - protein, 18 aa, Plasmodium falciparum
DKKTMEFSSWVKIAKMNP

SEQ ID NO: 3380291 - protein, 21 aa, Plasmodium falciparum
DKKVIFYQEGYESDSWLTENK

SEQ ID NO: 3380292 - protein, 22 aa, Plasmodium falciparum
DKKYALHLLPCGVLYDNNISVL

SEQ ID NO: 3380293 - protein, 24 aa, Plasmodium falciparum
DKKYSGIIYGLGSTIKNYNPKLDD

SEQ ID NO: 3380294 - protein, 20 aa, Plasmodium falciparum
DKLIYLLCDYYINKKEIDKL

SEQ ID NO: 3380295 - protein, 34 aa, Plasmodium falciparum
DKLKIQYKDLLKEYIFLELLVIEYEKNNVALHET

SEQ ID NO: 3380296 - protein, 25 aa, Plasmodium falciparum
DKLKNYYFYIPSDMKFELLLCGLND

SEQ ID NO: 3380297 - protein, 30 aa, Plasmodium falciparum
DKLNNNILSINIFDALYSLSCLLIDEKETP

SEQ ID NO: 3380298 - protein, 35 aa, Plasmodium falciparum
DKLPSGALVSFLQKALIFIYIEYHTDHNDGKKIVC

SEQ ID NO: 3380299 - protein, 22 aa, Plasmodium falciparum
DKLYCNIYSSCWFYFITTHVHI

SEQ ID NO: 3380300 - protein, 20 aa, Plasmodium falciparum
DKLYEDVYMIRSLNADMDEE

SEQ ID NO: 3380301 - protein, 19 aa, Plasmodium falciparum
DKLYYNNKKLKKLFKEIKN

SEQ ID NO: 3380302 - protein, 22 aa, Plasmodium falciparum
DKMNTFFNDHHPMHNTLSHMNN

SEQ ID NO: 3380303 - protein, 25 aa, Plasmodium falciparum
DKNCNLKNNVLLYNNKRKTNQHKNS

SEQ ID NO: 3380304 - protein, 25 aa, Plasmodium falciparum
DKNDFNFISNLIKKQCFINSSFNAS

SEQ ID NO: 3380305 - protein, 26 aa, Plasmodium falciparum
DKNDILNFAIPMGCNFIAASFIQSAD

SEQ ID NO: 3380306 - protein, 25 aa, Plasmodium falciparum
DKNDLEYLFNMLQLKNNEKEKMKKE

SEQ ID NO: 3380307 - protein, 25 aa, Plasmodium falciparum
DKNERKMFIKQLKKKCYKKNYDLNL

SEQ ID NO: 3380308 - protein, 30 aa, Plasmodium falciparum
DKNINCLNDIIFLDVYRAYNVLTYMQEKVS

SEQ ID NO: 3380309 - protein, 21 aa, Plasmodium falciparum
DKNINPLIRTKNKLNKKDGRN

SEQ ID NO: 3380310 - protein, 22 aa, Plasmodium falciparum
DKNIRCGLWYKVKREEDELYTE

SEQ ID NO: 3380311 - protein, 33 aa, Plasmodium falciparum
DKNIYSARYYFQKLKIDISYFDKLDIYLKENNI

SEQ ID NO: 3380312 - protein, 23 aa, Plasmodium falciparum
DKNKNFMDYSFYNNTCTSYNDKD

SEQ ID NO: 3380313 - protein, 25 aa, Plasmodium falciparum
DKNLLYYINMQLKNISHLISYKEIE

SEQ ID NO: 3380314 - protein, 23 aa, Plasmodium falciparum
DKNNRFFYDILNVIQLNENTWKN

SEQ ID NO: 3380315 - protein, 24 aa, Plasmodium falciparum
DKNPFRVKRVGRPSKYRPPIEPPP

SEQ ID NO: 3380316 - protein, 22 aa, Plasmodium falciparum
DKNSTLLLRGPTKNYNLNTELK

SEQ ID NO: 3380317 - protein, 25 aa, Plasmodium falciparum
DKNSYLYILKVIKSAINLIYPSLTI

SEQ ID NO: 3380318 - protein, 27 aa, Plasmodium falciparum
DKNTYRYYNLFHQYLDINRKNYKRINA

SEQ ID NO: 3380319 - protein, 28 aa, Plasmodium falciparum
DKNVKGTLALLYKYYSNIKVKCPHNGCL

SEQ ID NO: 3380320 - protein, 18 aa, Plasmodium falciparum
DKNYLDKNYFDIDDYSNL

SEQ ID NO: 3380321 - protein, 28 aa, Plasmodium falciparum
DKPGRNFIVFYFLSKYLCKPVFIDIIEH

SEQ ID NO: 3380322 - protein, 20 aa, Plasmodium falciparum
DKPSNFFNYIYNIESNKEDI

SEQ ID NO: 3380323 - protein, 17 aa, Plasmodium falciparum
DKQCEYFKKWDIKIIFI

SEQ ID NO: 3380324 - protein, 22 aa, Plasmodium falciparum
DKQKEEIFLLLKSAIKPNLKGK

SEQ ID NO: 3380325 - protein, 27 aa, Plasmodium falciparum
DKQLGTAVYLIDFLALRVGGEKDIDEE

SEQ ID NO: 3380326 - protein, 17 aa, Plasmodium falciparum
DKQTQATPLFYVTARKS

SEQ ID NO: 3380327 - protein, 24 aa, Plasmodium falciparum
DKRDYYINVLENVLSALKENRTYN

SEQ ID NO: 3380328 - protein, 28 aa, Plasmodium falciparum
DKRENVFEKYWFFFENNKIEGKKYICES

SEQ ID NO: 3380329 - protein, 24 aa, Plasmodium falciparum
DKRNEGICYYIKKYDIYLCGKCDN

SEQ ID NO: 3380330 - protein, 26 aa, Plasmodium falciparum
DKSCLLKKWHVGLIIALRNIISKRID

SEQ ID NO: 3380331 - protein, 30 aa, Plasmodium falciparum
DKSEEINILKEKLKLLQTSHDTLIIQHQNE

SEQ ID NO: 3380332 - protein, 22 aa, Plasmodium falciparum
DKSKMAVLKLQDEPLYNAIFSQ

SEQ ID NO: 3380333 - protein, 23 aa, Plasmodium falciparum
DKSLFIKDTFNNKNLYSCKTREK

SEQ ID NO: 3380334 - protein, 20 aa, Plasmodium falciparum
DKSLLINCIDVLLNFMNYNN

SEQ ID NO: 3380335 - protein, 25 aa, Plasmodium falciparum
DKSSNYNLNLFLKNINAPSNYNRYN

SEQ ID NO: 3380336 - protein, 32 aa, Plasmodium falciparum
DKSVEALILTGAMSRTWGMGFQLFECEYNANI

SEQ ID NO: 3380337 - protein, 26 aa, Plasmodium falciparum
DKTVNSFYIYFHNYKIRKNVVKIFFQ

SEQ ID NO: 3380338 - protein, 25 aa, Plasmodium falciparum
DKVCFEDIIFFLCAYKKVERSHHFV

SEQ ID NO: 3380339 - protein, 17 aa, Plasmodium falciparum
DKVLLKRYSLIEKCKQV

SEQ ID NO: 3380340 - protein, 30 aa, Plasmodium falciparum
DKVLSGYIFTDVFIYKDWPEKFLGKNINSK

SEQ ID NO: 3380341 - protein, 17 aa, Plasmodium falciparum
DKWFNVIELKKVYIFSK

SEQ ID NO: 3380342 - protein, 20 aa, Plasmodium falciparum
DKYDIIFQKKIELTDILKNV

SEQ ID NO: 3380343 - protein, 21 aa, Plasmodium falciparum
DKYEHYLFYCKDKQICLYDII

SEQ ID NO: 3380344 - protein, 19 aa, Plasmodium falciparum
DKYFSLLKYKDEQIKKVCE

SEQ ID NO: 3380345 - protein, 22 aa, Plasmodium falciparum
DKYIIMNHILLSLKQWIIDSDR

SEQ ID NO: 3380346 - protein, 27 aa, Plasmodium falciparum
DKYKNLIVDLIVQSLFYMQEPHVIVRC

SEQ ID NO: 3380347 - protein, 18 aa, Plasmodium falciparum
DKYNAHVNLILIRSHYKE

SEQ ID NO: 3380348 - protein, 23 aa, Plasmodium falciparum
DKYNRINNIFPIDSLKFKDNLTD

SEQ ID NO: 3380349 - protein, 17 aa, Plasmodium falciparum
DKYSFFNELNDFDYNTY

SEQ ID NO: 3380350 - protein, 31 aa, Plasmodium falciparum
DKYVNTINNIPLRFSKYYLKEKKKKKKYLKC

SEQ ID NO: 3380351 - protein, 21 aa, Plasmodium falciparum
DKYWIKYLFKDNSIVTDLLGF

SEQ ID NO: 3380352 - protein, 18 aa, Plasmodium falciparum
DLAKIFYSMLLCPYESID

SEQ ID NO: 3380353 - protein, 26 aa, Plasmodium falciparum
DLAKKKIYPALFKLFCNNSLPKDLLI

SEQ ID NO: 3380354 - protein, 39 aa, Plasmodium falciparum
DLARIVQLIRWYQKKGHLYANINPLPLPKEPPYSSVCYE

SEQ ID NO: 3380355 - protein, 22 aa, Plasmodium falciparum
DLCKYKYDNFLSSYKKNVATQN

SEQ ID NO: 3380356 - protein, 18 aa, Plasmodium falciparum
DLCRKVKIAFLYLGNIDL

SEQ ID NO: 3380357 - protein, 17 aa, Plasmodium falciparum
DLDGELTPILVAMVIRN

SEQ ID NO: 3380358 - protein, 17 aa, Plasmodium falciparum
DLDIDIYIGYNILNFDL

SEQ ID NO: 3380359 - protein, 22 aa, Plasmodium falciparum
DLDITVCPYYLKSKLKKYDKTV

SEQ ID NO: 3380360 - protein, 24 aa, Plasmodium falciparum
DLDKSPIDKLLYKSNNRINNNNNN

SEQ ID NO: 3380361 - protein, 26 aa, Plasmodium falciparum
DLDLDLYLRIATELPLKMLIVGGIDK

SEQ ID NO: 3380362 - protein, 20 aa, Plasmodium falciparum
DLDNIKSIVINLKPFHKDYE

SEQ ID NO: 3380363 - protein, 32 aa, Plasmodium falciparum
DLDNNIVIKTLMNIFLIITNIYRDICKNINDQ

SEQ ID NO: 3380364 - protein, 31 aa, Plasmodium falciparum
DLDNNMSDLNILKYLYSQLNGGSLLEDKNIS

SEQ ID NO: 3380365 - protein, 24 aa, Plasmodium falciparum
DLDYIEHYNKEKEFYIAEYPKNKF

SEQ ID NO: 3380366 - protein, 25 aa, Plasmodium falciparum
DLEEQINLMFINLKKIGLDNWLQMD

SEQ ID NO: 3380367 - protein, 27 aa, Plasmodium falciparum
DLEHSPTLINFTFPSKIKKITCGDNHT

SEQ ID NO: 3380368 - protein, 25 aa, Plasmodium falciparum
DLEKEFMYYHFYKPLLTSGDFLSKP

SEQ ID NO: 3380369 - protein, 21 aa, Plasmodium falciparum
DLENWEEDWGAAGWDDDDDDD

SEQ ID NO: 3380370 - protein, 32 aa, Plasmodium falciparum
DLEVKYNREYFLRQLLLKQAFNDLYNFSQCTN

SEQ ID NO: 3380371 - protein, 25 aa, Plasmodium falciparum
DLFCTRYLLNIPRYVRLASWNKNIE

SEQ ID NO: 3380372 - protein, 19 aa, Plasmodium falciparum
DLFFSFFHLRKNRICSLNT

SEQ ID NO: 3380373 - protein, 19 aa, Plasmodium falciparum
DLFGRSHLFNIFNNEEEID

SEQ ID NO: 3380374 - protein, 22 aa, Plasmodium falciparum
DLFKRMQNTCWLKCIPDVHDSF

SEQ ID NO: 3380375 - protein, 19 aa, Plasmodium falciparum
DLFLDINVENTKKGLLSFK

SEQ ID NO: 3380376 - protein, 28 aa, Plasmodium falciparum
DLGKRIMNIFKYLFPPVTMRTNKRKMPK

SEQ ID NO: 3380377 - protein, 19 aa, Plasmodium falciparum
DLHFAVQTILPNFSKRFLS

SEQ ID NO: 3380378 - protein, 19 aa, Plasmodium falciparum
DLIKNILHTLLKKEYEQLS

SEQ ID NO: 3380379 - protein, 20 aa, Plasmodium falciparum
DLILQRYKHGINISLNFSDI

SEQ ID NO: 3380380 - protein, 27 aa, Plasmodium falciparum
DLILSLLKKIILKRNDLYLFLFSDYFS

SEQ ID NO: 3380381 - protein, 19 aa, Plasmodium falciparum
DLIMLSLASHEPYFYILRE

SEQ ID NO: 3380382 - protein, 17 aa, Plasmodium falciparum
DLIVTTPLKNILQINKE

SEQ ID NO: 3380383 - protein, 17 aa, Plasmodium falciparum
DLIYFYNNFYDDLRCKS

SEQ ID NO: 3380384 - protein, 28 aa, Plasmodium falciparum
DLIYNYYVNYIFIYLQKSSISEYYIQLI

SEQ ID NO: 3380385 - protein, 21 aa, Plasmodium falciparum
DLKFGMCILTVDYHPAMHISF

SEQ ID NO: 3380386 - protein, 22 aa, Plasmodium falciparum
DLKIRLRKIPGVPILYAKNFKY

SEQ ID NO: 3380387 - protein, 31 aa, Plasmodium falciparum
DLKKKLQEQILIQRGLLKIKEQQQVYLELLK

SEQ ID NO: 3380388 - protein, 28 aa, Plasmodium falciparum
DLKNYYCNINIPWIGKTCTNPSSSMSKN

SEQ ID NO: 3380389 - protein, 24 aa, Plasmodium falciparum
DLLFNFHFLYYFFDNIILGGYIYE

SEQ ID NO: 3380390 - protein, 26 aa, Plasmodium falciparum
DLLKKEFIGELPKFKIDRLKMLQIIF

SEQ ID NO: 3380391 - protein, 24 aa, Plasmodium falciparum
DLLKNKITIILNKPKHYLSISNDN

SEQ ID NO: 3380392 - protein, 18 aa, Plasmodium falciparum
DLLNIKMWMYMDKGLLER

SEQ ID NO: 3380393 - protein, 35 aa, Plasmodium falciparum
DLLNLKERKSFRIPKFFHFIDNITNTESFLNYLQK

SEQ ID NO: 3380394 - protein, 30 aa, Plasmodium falciparum
DLLNNKNVHNNIPFIGTKINLNNSLVQLNN

SEQ ID NO: 3380395 - protein, 22 aa, Plasmodium falciparum
DLLNNNFFLKSEKDNFVLSNHD

SEQ ID NO: 3380396 - protein, 24 aa, Plasmodium falciparum
DLLRFITSIYLLQNKELFINFIYD

SEQ ID NO: 3380397 - protein, 17 aa, Plasmodium falciparum
DLLSFESFSLKFLKCNY

SEQ ID NO: 3380398 - protein, 19 aa, Plasmodium falciparum
DLLVYILDDVLNGLNYLHN

SEQ ID NO: 3380399 - protein, 22 aa, Plasmodium falciparum
DLLYDNKYYRQIFKNVIGFVSV

SEQ ID NO: 3380400 - protein, 18 aa, Plasmodium falciparum
DLMVPLQRYTSVNGVPLS

SEQ ID NO: 3380401 - protein, 24 aa, Plasmodium falciparum
DLNFRLHENSAWINQLRQSHNNLC

SEQ ID NO: 3380402 - protein, 27 aa, Plasmodium falciparum
DLNKGGKGTFRYLEKKIPSIEDSQKIN

SEQ ID NO: 3380403 - protein, 26 aa, Plasmodium falciparum
DLNKKYEQLFSLIKKFGKEIKYLLSK

SEQ ID NO: 3380404 - protein, 28 aa, Plasmodium falciparum
DLNKNIYLKFKLLNKVQLLLEQKIKNFD

SEQ ID NO: 3380405 - protein, 17 aa, Plasmodium falciparum
DLNNGFYIVKYFSFLND

SEQ ID NO: 3380406 - protein, 25 aa, Plasmodium falciparum
DLNNKILFEFFQFPESTYVSEYINN

SEQ ID NO: 3380407 - protein, 26 aa, Plasmodium falciparum
DLNNLKRFLLYFKEISRRLTITNNNY

SEQ ID NO: 3380408 - protein, 18 aa, Plasmodium falciparum
DLNRSLMLFFEQEVHLDI

SEQ ID NO: 3380409 - protein, 17 aa, Plasmodium falciparum
DLNVKLKTLKIMKHLCD

SEQ ID NO: 3380410 - protein, 17 aa, Plasmodium falciparum
DLQNLHFVVSYKDNEKK

SEQ ID NO: 3380411 - protein, 19 aa, Plasmodium falciparum
DLRIERAVPRSSAAEFKKM

SEQ ID NO: 3380412 - protein, 27 aa, Plasmodium falciparum
DLSENYITCIGLKTLLKYILNYNENIG

SEQ ID NO: 3380413 - protein, 17 aa, Plasmodium falciparum
DLSFHECILTNVNVVWS

SEQ ID NO: 3380414 - protein, 19 aa, Plasmodium falciparum
DLSKTLISIGFHNKIIKNM

SEQ ID NO: 3380415 - protein, 20 aa, Plasmodium falciparum
DLSLFQVYYNLFKDMTMLKY

SEQ ID NO: 3380416 - protein, 25 aa, Plasmodium falciparum
DLSMSLCYLLKYYVRFNYNILYNSY

SEQ ID NO: 3380417 - protein, 23 aa, Plasmodium falciparum
DLSPHIIGPIEYKKIYLKNLNSN

SEQ ID NO: 3380418 - protein, 24 aa, Plasmodium falciparum
DLSQKFIQFYFERRKEELRATYLV

SEQ ID NO: 3380419 - protein, 27 aa, Plasmodium falciparum
DLSVMIQHAWTYQALIHDVFDIKLNKI

SEQ ID NO: 3380420 - protein, 27 aa, Plasmodium falciparum
DLTIIAKVFFFFYLNKFEDCLLLIEEW

SEQ ID NO: 3380421 - protein, 19 aa, Plasmodium falciparum
DLVLKLNKSSIFQNTNDEN

SEQ ID NO: 3380422 - protein, 20 aa, Plasmodium falciparum
DLVRLCICEGLRIFQDRLIY

SEQ ID NO: 3380423 - protein, 25 aa, Plasmodium falciparum
DLVSRKLLLEFLKKECIKYNSIVIY

SEQ ID NO: 3380424 - protein, 21 aa, Plasmodium falciparum
DLVWCYYDINSKKENIVIFLH

SEQ ID NO: 3380425 - protein, 19 aa, Plasmodium falciparum
DLYAKLLNIEVYSKKVDFI

SEQ ID NO: 3380426 - protein, 29 aa, Plasmodium falciparum
DLYDTSRGFKFFFFKVLRSIKTKTIDMEN

SEQ ID NO: 3380427 - protein, 20 aa, Plasmodium falciparum
DLYLFLFSDYFSEQVLHFFT

SEQ ID NO: 3380428 - protein, 17 aa, Plasmodium falciparum
DLYNINHLLLLTENIRK

SEQ ID NO: 3380429 - protein, 26 aa, Plasmodium falciparum
DLYNNNQIYIIDKIYNILKNVDKEIL

SEQ ID NO: 3380430 - protein, 26 aa, Plasmodium falciparum
DMAIKYFDNFLFRQNCIIHVEKAQFN

SEQ ID NO: 3380431 - protein, 22 aa, Plasmodium falciparum
DMCLLKLRRKNLRQNFIPNGRL

SEQ ID NO: 3380432 - protein, 36 aa, Plasmodium falciparum
DMDELTKLKFYFLREFIIFIKKIKKLKTLFIKNNPF

SEQ ID NO: 3380433 - protein, 23 aa, Plasmodium falciparum
DMDHLYNHIIPYKNIKITEEYKS

SEQ ID NO: 3380434 - protein, 27 aa, Plasmodium falciparum
DMDKKAIRLFAILKPLKVIITNYNDAP

SEQ ID NO: 3380435 - protein, 25 aa, Plasmodium falciparum
DMDSRTFVKILKDAKLLNKKFTTVD

SEQ ID NO: 3380436 - protein, 26 aa, Plasmodium falciparum
DMDVIILKAYKENIAFSCFSFYNIID

SEQ ID NO: 3380437 - protein, 21 aa, Plasmodium falciparum
DMEEYLIIEKKIKVKRKKKKG

SEQ ID NO: 3380438 - protein, 17 aa, Plasmodium falciparum
DMEILIENLKLFVNMKD

SEQ ID NO: 3380439 - protein, 26 aa, Plasmodium falciparum
DMEYIKDNLLIWDKPMYNKNLYELKP

SEQ ID NO: 3380440 - protein, 18 aa, Plasmodium falciparum
DMHLIIDPPSMTEMLNAR

SEQ ID NO: 3380441 - protein, 23 aa, Plasmodium falciparum
DMKELYHILCAIKKKNPKAARIP

SEQ ID NO: 3380442 - protein, 28 aa, Plasmodium falciparum
DMKENLNMNILIRQFLKKNLNEENWNIF

SEQ ID NO: 3380443 - protein, 25 aa, Plasmodium falciparum
DMKNSRMVYIKPPVTLYPNAQHMMH

SEQ ID NO: 3380444 - protein, 18 aa, Plasmodium falciparum
DMLNWTSEQVLRVLSIRK

SEQ ID NO: 3380445 - protein, 31 aa, Plasmodium falciparum
DMMILQCKKYLIRYALYYKKILKYIKDKNKN

SEQ ID NO: 3380446 - protein, 21 aa, Plasmodium falciparum
DMNFVLLKQYKGHNGFIFYVC

SEQ ID NO: 3380447 - protein, 27 aa, Plasmodium falciparum
DMNKNIPRYYFFIKHLLHDYCKKKLHI

SEQ ID NO: 3380448 - protein, 21 aa, Plasmodium falciparum
DMNMRLLNNSKFLPGNMGLSN

SEQ ID NO: 3380449 - protein, 37 aa, Plasmodium falciparum
DMNNDYIHVLAKLKIKPILKIKYIYFSMIDLNKKLNK

SEQ ID NO: 3380450 - protein, 24 aa, Plasmodium falciparum
DMNNLECTSLYFTKNDLQNKNKLF

SEQ ID NO: 3380451 - protein, 17 aa, Plasmodium falciparum
DMNNTFSYICCDMRKRR

SEQ ID NO: 3380452 - protein, 17 aa, Plasmodium falciparum
DMPKFTNPLLYDVIARH

SEQ ID NO: 3380453 - protein, 25 aa, Plasmodium falciparum
DMPKKHSLIIKLPLNNTQLNLYKDE

SEQ ID NO: 3380454 - protein, 25 aa, Plasmodium falciparum
DMPLKYFVEAGAIAVRRVNKDDLRR

SEQ ID NO: 3380455 - protein, 27 aa, Plasmodium falciparum
DMRNNYIMLYDLLYKNWEKVVKPKNED

SEQ ID NO: 3380456 - protein, 18 aa, Plasmodium falciparum
DMSLIISEQLRKRSRTTF

SEQ ID NO: 3380457 - protein, 28 aa, Plasmodium falciparum
DMSTELILICKCFLLVQKIEEGKTYLQE

SEQ ID NO: 3380458 - protein, 27 aa, Plasmodium falciparum
DMTKRTNMILPLRSLLMSIYIGKEAFN

SEQ ID NO: 3380459 - protein, 23 aa, Plasmodium falciparum
DMTTLNLIYAKYFLRIFIEKQEA

SEQ ID NO: 3380460 - protein, 18 aa, Plasmodium falciparum
DMVSGLLKLKFTNTFLLS

SEQ ID NO: 3380461 - protein, 41 aa, Plasmodium falciparum
DNAGIDMWTLPISLAISKKNRYLFYLVLKGGAKIDIWDYLG

SEQ ID NO: 3380462 - protein, 29 aa, Plasmodium falciparum
DNATLIRELPLSEILYTKSNLRLKVRRHP

SEQ ID NO: 3380463 - protein, 22 aa, Plasmodium falciparum
DNDKYIYACGENRLIEIFDIYE

SEQ ID NO: 3380464 - protein, 34 aa, Plasmodium falciparum
DNDMKFKQILLDNKTFNKLLVNELNIVEENILFC

SEQ ID NO: 3380465 - protein, 25 aa, Plasmodium falciparum
DNDNLIPFDVFNINEAHLSLDQTQQ

SEQ ID NO: 3380466 - protein, 33 aa, Plasmodium falciparum
DNDNMNYHPISKKRFGYFKDKNFSYNKHVEADN

SEQ ID NO: 3380467 - protein, 28 aa, Plasmodium falciparum
DNEENILDEDILWMYETKEEKEIKEQEE

SEQ ID NO: 3380468 - protein, 23 aa, Plasmodium falciparum
DNEIPKWSIFEWFTTDELQDKPD

SEQ ID NO: 3380469 - protein, 25 aa, Plasmodium falciparum
DNEKEFFNFLFIQLNKYNEYMLPII

SEQ ID NO: 3380470 - protein, 30 aa, Plasmodium falciparum
DNEKQQIIQMYEQKLLLQKDNIEQTLNIQN

SEQ ID NO: 3380471 - protein, 26 aa, Plasmodium falciparum
DNESDILKILFFNKSPSQSSILKRII

SEQ ID NO: 3380472 - protein, 26 aa, Plasmodium falciparum
DNEYSFISYIILSSEFRFYPIEETKK

SEQ ID NO: 3380473 - protein, 31 aa, Plasmodium falciparum
DNFDENNFSLPYFIFVLRDVNKEEFSKMNLQ

SEQ ID NO: 3380474 - protein, 22 aa, Plasmodium falciparum
DNFIMIKDVIQIPKLNLDNIKN

SEQ ID NO: 3380475 - protein, 25 aa, Plasmodium falciparum
DNFIRRDIFRLVFHKYILQNTRNKI

SEQ ID NO: 3380476 - protein, 23 aa, Plasmodium falciparum
DNFKIDLDFYQVHNSLICIVDEL

SEQ ID NO: 3380477 - protein, 30 aa, Plasmodium falciparum
DNFLSNDIMNTIPYSPPTKKIKIEKRMMMK

SEQ ID NO: 3380478 - protein, 20 aa, Plasmodium falciparum
DNFYLLYAQNVLYDFKHINV

SEQ ID NO: 3380479 - protein, 25 aa, Plasmodium falciparum
DNGIISFLWMKRTLEFIITFLEKCY

SEQ ID NO: 3380480 - protein, 22 aa, Plasmodium falciparum
DNGKYCYSLIYPYKHSYINNEK

SEQ ID NO: 3380481 - protein, 42 aa, Plasmodium falciparum
DNHDKKILQYFYMFEKYALKTNFFLTHKISLAVAFDGALLKD

SEQ ID NO: 3380482 - protein, 27 aa, Plasmodium falciparum
DNHKFLSLLFFIYKYKFDEIKYIFMLQ

SEQ ID NO: 3380483 - protein, 27 aa, Plasmodium falciparum
DNHSEGSVIFPMEKYRNFTLPSEEKIT

SEQ ID NO: 3380484 - protein, 30 aa, Plasmodium falciparum
DNICCHYCNLIYIPFYNCKITHSPNQGKAT

SEQ ID NO: 3380485 - protein, 31 aa, Plasmodium falciparum
DNICNKAWKILYKYFPFVINNELNNAQIPLN

SEQ ID NO: 3380486 - protein, 25 aa, Plasmodium falciparum
DNIDEINFLILNFLNKLKKKKKIQK

SEQ ID NO: 3380487 - protein, 28 aa, Plasmodium falciparum
DNIEKAYILKNWWIHNKKMICNSINLSS

SEQ ID NO: 3380488 - protein, 18 aa, Plasmodium falciparum
DNIFINYIQSYFFNTNVN

SEQ ID NO: 3380489 - protein, 22 aa, Plasmodium falciparum
DNIILHLKFMKSFSYILKCLIK

SEQ ID NO: 3380490 - protein, 30 aa, Plasmodium falciparum
DNIKGKIKLYLKNAIVYNHLLKKIQSEEFL

SEQ ID NO: 3380491 - protein, 17 aa, Plasmodium falciparum
DNIKLADLTYKLNDYNI

SEQ ID NO: 3380492 - protein, 18 aa, Plasmodium falciparum
DNIKYFIETYFNLHFSLY

SEQ ID NO: 3380493 - protein, 25 aa, Plasmodium falciparum
DNILQKYYIFDLLKTSVIKSAQKII

SEQ ID NO: 3380494 - protein, 35 aa, Plasmodium falciparum
DNILYIYNDIYLYHNNLLFLSKPSSYTWMKLHELS

SEQ ID NO: 3380495 - protein, 21 aa, Plasmodium falciparum
DNIMNASFFNTMLYVKDDYVD

SEQ ID NO: 3380496 - protein, 31 aa, Plasmodium falciparum
DNINISLFHNPLLGPILYNILPPRANEAIGV

SEQ ID NO: 3380497 - protein, 34 aa, Plasmodium falciparum
DNINLDSINLKKYKLMWLLNVNKTYLNYNEIIDL

SEQ ID NO: 3380498 - protein, 33 aa, Plasmodium falciparum
DNISIDYTYKKKKKIWSCFPDFEKSRRLKFIRK

SEQ ID NO: 3380499 - protein, 24 aa, Plasmodium falciparum
DNIVKYILKCKLVIYDLHNTDLEE

SEQ ID NO: 3380500 - protein, 30 aa, Plasmodium falciparum
DNIYDLKAIQLYTNILINCLIQNTTSSNLS

SEQ ID NO: 3380501 - protein, 23 aa, Plasmodium falciparum
DNIYGSVYNKRKGFRAQVSSAGN

SEQ ID NO: 3380502 - protein, 24 aa, Plasmodium falciparum
DNKATYLNILFNDNFLWKINKDNV

SEQ ID NO: 3380503 - protein, 25 aa, Plasmodium falciparum
DNKDCVKIENLKIRTFLGTGEYTND

SEQ ID NO: 3380504 - protein, 23 aa, Plasmodium falciparum
DNKEFCVVPPVMPYHINSIENSN

SEQ ID NO: 3380505 - protein, 26 aa, Plasmodium falciparum
DNKIKVNMYPYKDTKLNALHNYICVI

SEQ ID NO: 3380506 - protein, 18 aa, Plasmodium falciparum
DNKIRTDTYPSINKNKLI

SEQ ID NO: 3380507 - protein, 25 aa, Plasmodium falciparum
DNKIYRGKILIAKYSKEKKITNYEE

SEQ ID NO: 3380508 - protein, 22 aa, Plasmodium falciparum
DNKKFFSLYSSPSPQYDNDEKN

SEQ ID NO: 3380509 - protein, 25 aa, Plasmodium falciparum
DNKKNIFYNTFLNNDILYNDDYEKQ

SEQ ID NO: 3380510 - protein, 34 aa, Plasmodium falciparum
DNKKNYIIENICKCFHFHSLGLNGGLPEINVNKD

SEQ ID NO: 3380511 - protein, 27 aa, Plasmodium falciparum
DNKLKKISFYILFEYTEKYPDEAPLYK

SEQ ID NO: 3380512 - protein, 23 aa, Plasmodium falciparum
DNKLKLECSSASDINKFLQDYKL

SEQ ID NO: 3380513 - protein, 23 aa, Plasmodium falciparum
DNKNHNKLLLKDKKIYNVKKKWE

SEQ ID NO: 3380514 - protein, 17 aa, Plasmodium falciparum
DNKNIIIQLIYRNKECN

SEQ ID NO: 3380515 - protein, 23 aa, Plasmodium falciparum
DNKNIYYIPLCNSFIYHKEKDAC

SEQ ID NO: 3380516 - protein, 18 aa, Plasmodium falciparum
DNKNNIFHLLKNNNLSSL

SEQ ID NO: 3380517 - protein, 25 aa, Plasmodium falciparum
DNKNYIVDFFFTEPIQDLLETCTRI

SEQ ID NO: 3380518 - protein, 25 aa, Plasmodium falciparum
DNKSNFFFFSSMLLHYCKSSSIHKS

SEQ ID NO: 3380519 - protein, 26 aa, Plasmodium falciparum
DNLHNTYLFNGPVKNFEYLNVQNVHT

SEQ ID NO: 3380520 - protein, 29 aa, Plasmodium falciparum
DNLIKKNNYPWFINGIIDIIKLDFKYNKA

SEQ ID NO: 3380521 - protein, 18 aa, Plasmodium falciparum
DNLIKYKNKMYFSHLLKN

SEQ ID NO: 3380522 - protein, 25 aa, Plasmodium falciparum
DNLKNMDSFLLYMKERKIKKKKNIN

SEQ ID NO: 3380523 - protein, 17 aa, Plasmodium falciparum
DNLLNKVDNMEKYLDEL

SEQ ID NO: 3380524 - protein, 27 aa, Plasmodium falciparum
DNLLNTKRTLYWVYIDDDNKEQGPFNS

SEQ ID NO: 3380525 - protein, 29 aa, Plasmodium falciparum
DNLNAYKKAIDLIMKLLNSLFQEFVDFCL

SEQ ID NO: 3380526 - protein, 27 aa, Plasmodium falciparum
DNLNDMLFLIQYSLKYKGICKWPNYSN

SEQ ID NO: 3380527 - protein, 21 aa, Plasmodium falciparum
DNLNISLNSLILDNFDKNHHN

SEQ ID NO: 3380528 - protein, 29 aa, Plasmodium falciparum
DNLRIHNYYFFFLYFLKKLGDEEQRKIKL

SEQ ID NO: 3380529 - protein, 20 aa, Plasmodium falciparum
DNLRNHLFVDFNLNLIKNDY

SEQ ID NO: 3380530 - protein, 26 aa, Plasmodium falciparum
DNMKIARYAWYIPNAKAHIFALHGIT

SEQ ID NO: 3380531 - protein, 19 aa, Plasmodium falciparum
DNMVLLGNENMLFKKGGSI

SEQ ID NO: 3380532 - protein, 21 aa, Plasmodium falciparum
DNNAFYFKTPVLEDININDNI

SEQ ID NO: 3380533 - protein, 21 aa, Plasmodium falciparum
DNNFIFFNLTLDSSITEEKIN

SEQ ID NO: 3380534 - protein, 26 aa, Plasmodium falciparum
DNNGNIYLWLPNNSGKWNYELLNLKN

SEQ ID NO: 3380535 - protein, 43 aa, Plasmodium falciparum
DNNIFLHTCYIFLYEIKLLLCCYILLNIFVQYNWTGPPLNYDI

SEQ ID NO: 3380536 - protein, 27 aa, Plasmodium falciparum
DNNIILQYILMCLNKLTVRFPSHKSKI

SEQ ID NO: 3380537 - protein, 28 aa, Plasmodium falciparum
DNNIMNKFFLLNYYLKNIWKTNNTMLKK

SEQ ID NO: 3380538 - protein, 35 aa, Plasmodium falciparum
DNNKLPDGPLILSPDRLFPSFKREVIDKKPYIFKI

SEQ ID NO: 3380539 - protein, 24 aa, Plasmodium falciparum
DNNKSICVLAFTTLLKTGNETSID

SEQ ID NO: 3380540 - protein, 24 aa, Plasmodium falciparum
DNNKYKRFSLPYFRFTSIGRNGTI

SEQ ID NO: 3380541 - protein, 32 aa, Plasmodium falciparum
DNNLDTLQMLDSLNYWYGSSFSKENILKKNKN

SEQ ID NO: 3380542 - protein, 24 aa, Plasmodium falciparum
DNNLEKKYFYYNSDSKHCIDEKNE

SEQ ID NO: 3380543 - protein, 33 aa, Plasmodium falciparum
DNNLICLSSLNNIFIFDIRYINNNLPYKVLHDN

SEQ ID NO: 3380544 - protein, 17 aa, Plasmodium falciparum
DNNLPMVGFLFKIQEDN

SEQ ID NO: 3380545 - protein, 28 aa, Plasmodium falciparum
DNNMGFYNKSWFQLPAEYKERDFMIEEN

SEQ ID NO: 3380546 - protein, 31 aa, Plasmodium falciparum
DNNNNFFNYNNFSYALQTPPGLQNYYQNTQY

SEQ ID NO: 3380547 - protein, 27 aa, Plasmodium falciparum
DNNPYYPNIFITKRKKSVYYKKNNDDD

SEQ ID NO: 3380548 - protein, 31 aa, Plasmodium falciparum
DNNTNDHMIYPFYIFPIYSQLSSEQQSKIFK

SEQ ID NO: 3380549 - protein, 36 aa, Plasmodium falciparum
DNNTPLFLSFNIRINILVQIINVLCYLHTSSPIVYH

SEQ ID NO: 3380550 - protein, 22 aa, Plasmodium falciparum
DNNYRENYIFNYLNEKDKTDDH

SEQ ID NO: 3380551 - protein, 26 aa, Plasmodium falciparum
DNPEVINFLLQTEIIPLCLRIMETGS

SEQ ID NO: 3380552 - protein, 25 aa, Plasmodium falciparum
DNPLKKLKFLWSYKNKEHEDNNKYI

SEQ ID NO: 3380553 - protein, 27 aa, Plasmodium falciparum
DNPNYRKELFEFLPNVKIIDCYNKEGM

SEQ ID NO: 3380554 - protein, 29 aa, Plasmodium falciparum
DNQAIFNYFIHMVFLYIKLYQNASQIKQK

SEQ ID NO: 3380555 - protein, 22 aa, Plasmodium falciparum
DNQILYCYIEFPDDTFFMINNY

SEQ ID NO: 3380556 - protein, 31 aa, Plasmodium falciparum
DNRILKRYSSFLFLYPLPNFICISDNTCNSF

SEQ ID NO: 3380557 - protein, 26 aa, Plasmodium falciparum
DNRLQDFIIQLLKNNIKYITIFQESS

SEQ ID NO: 3380558 - protein, 20 aa, Plasmodium falciparum
DNRVIGFHYVGPNAGEVTQG

SEQ ID NO: 3380559 - protein, 24 aa, Plasmodium falciparum
DNRYKKILALLHKNKLTLNVGLSS

SEQ ID NO: 3380560 - protein, 23 aa, Plasmodium falciparum
DNRYNYFSYYVSDSIYGCFSGII

SEQ ID NO: 3380561 - protein, 29 aa, Plasmodium falciparum
DNSKFNEEQFLNDNLNVLGFLEETTSGEK

SEQ ID NO: 3380562 - protein, 17 aa, Plasmodium falciparum
DNSLFRRGIFVPSINCV

SEQ ID NO: 3380563 - protein, 23 aa, Plasmodium falciparum
DNSSYKRSKLKKSYKYDKHTQSK

SEQ ID NO: 3380564 - protein, 22 aa, Plasmodium falciparum
DNSYPLLYLLSKELNCKEEDIL

SEQ ID NO: 3380565 - protein, 23 aa, Plasmodium falciparum
DNTAGNYYLKNGNPIMNVANTNN

SEQ ID NO: 3380566 - protein, 27 aa, Plasmodium falciparum
DNTKLYPYYEYFSFLSQYENIYFVCSI

SEQ ID NO: 3380567 - protein, 26 aa, Plasmodium falciparum
DNTKPALNIKQNIKLPLGPKQNSKSA

SEQ ID NO: 3380568 - protein, 24 aa, Plasmodium falciparum
DNTKYSYYFIFDNKTDEYNQINDV

SEQ ID NO: 3380569 - protein, 19 aa, Plasmodium falciparum
DNTLILSRGFFKPAQNEKD

SEQ ID NO: 3380570 - protein, 22 aa, Plasmodium falciparum
DNTLSTPFVWKLKNKYEKIKNH

SEQ ID NO: 3380571 - protein, 28 aa, Plasmodium falciparum
DNVDLIQAYLFIFLKAHGKKIMKSKEKK

SEQ ID NO: 3380572 - protein, 17 aa, Plasmodium falciparum
DNVIYDSHIYAQTKTYL

SEQ ID NO: 3380573 - protein, 58 aa, Plasmodium falciparum
DNVKNNLFHFGNYLITEKYAPCKIIMKMCAHINQFMYNLLGVAKYDIYYKHKDNLVEI

SEQ ID NO: 3380574 - protein, 19 aa, Plasmodium falciparum
DNVQLIFIDSPGIIPSHKK

SEQ ID NO: 3380575 - protein, 21 aa, Plasmodium falciparum
DNWEDFYFNSFFNLNNYNNNN

SEQ ID NO: 3380576 - protein, 38 aa, Plasmodium falciparum
DNYIDEDLLVYTKNEFLYAYKELILDKKGLGEDHELPL

SEQ ID NO: 3380577 - protein, 19 aa, Plasmodium falciparum
DNYIKAWLKQTENPEFYKN

SEQ ID NO: 3380578 - protein, 27 aa, Plasmodium falciparum
DNYINPNVWIYQYLLLETKKQNDSYRN

SEQ ID NO: 3380579 - protein, 25 aa, Plasmodium falciparum
DNYMFEYFIVVKYYYSDNSFALLEK

SEQ ID NO: 3380580 - protein, 19 aa, Plasmodium falciparum
DNYVSIILQLCSCKKVKML

SEQ ID NO: 3380581 - protein, 22 aa, Plasmodium falciparum
DNYYYKGDTSIYYKMIGNQYNC

SEQ ID NO: 3380582 - protein, 30 aa, Plasmodium falciparum
DPEEKKFYFFDYLLFYTKAYKQNLNDDLIF

SEQ ID NO: 3380583 - protein, 27 aa, Plasmodium falciparum
DPEINNLYLCFLVTEPFLENEKKIVKI

SEQ ID NO: 3380584 - protein, 22 aa, Plasmodium falciparum
DPFFLNNYYYNKEENNPIIICS

SEQ ID NO: 3380585 - protein, 28 aa, Plasmodium falciparum
DPFNLFTNYFYFIKYYSVFNSDHIIYMH

SEQ ID NO: 3380586 - protein, 33 aa, Plasmodium falciparum
DPFSVSHIIGDRLLQGWTLLNATCHMCNITPLI

SEQ ID NO: 3380587 - protein, 18 aa, Plasmodium falciparum
DPIIPRYAAVDKNSSILL

SEQ ID NO: 3380588 - protein, 20 aa, Plasmodium falciparum
DPILYRIMYKIHPKTKNKWV

SEQ ID NO: 3380589 - protein, 24 aa, Plasmodium falciparum
DPINIKNLVMWPIASRTMNNQNEI

SEQ ID NO: 3380590 - protein, 29 aa, Plasmodium falciparum
DPKDKTLVEFLFNLYVQNGGKIGTIGTTG

SEQ ID NO: 3380591 - protein, 35 aa, Plasmodium falciparum
DPLILIPITLKKWINLFNELFFDKKLKFVYLTENL

SEQ ID NO: 3380592 - protein, 23 aa, Plasmodium falciparum
DPLKIQSLTRYLNSINSQVIVIS

SEQ ID NO: 3380593 - protein, 21 aa, Plasmodium falciparum
DPLTTLKYILSLNDQLYDTAD

SEQ ID NO: 3380594 - protein, 19 aa, Plasmodium falciparum
DPNFVFLKPHNIDSFFLLD

SEQ ID NO: 3380595 - protein, 19 aa, Plasmodium falciparum
DPNKMLCNFLESLENNTND

SEQ ID NO: 3380596 - protein, 21 aa, Plasmodium falciparum
DPPLINLSLKSICKYIIGTCN

SEQ ID NO: 3380597 - protein, 17 aa, Plasmodium falciparum
DPPWDIHMDLPYGTMTD

SEQ ID NO: 3380598 - protein, 28 aa, Plasmodium falciparum
DPRIYGTIWGFWKYPEKIWEVIRDISSD

SEQ ID NO: 3380599 - protein, 26 aa, Plasmodium falciparum
DPRLNSLYGMLYYQSIGLLKDESFVG

SEQ ID NO: 3380600 - protein, 18 aa, Plasmodium falciparum
DPRPHLNIIFIGHVDAGK

SEQ ID NO: 3380601 - protein, 29 aa, Plasmodium falciparum
DPRSLLSKLNELLLLTARYAYHYEKKDIQ

SEQ ID NO: 3380602 - protein, 31 aa, Plasmodium falciparum
DPRVVKLNRFLWLPILYTFVLPFRSGKVLSK

SEQ ID NO: 3380603 - protein, 35 aa, Plasmodium falciparum
DPSNVIIKIQKKCLYLPNCQFGDKCRYIHPVENCR

SEQ ID NO: 3380604 - protein, 32 aa, Plasmodium falciparum
DPYGLTKRSINEWKILAKCDHPNIIKLCGGII

SEQ ID NO: 3380605 - protein, 21 aa, Plasmodium falciparum
DPYLRQIAGLLIKNAFTSKDN

SEQ ID NO: 3380606 - protein, 22 aa, Plasmodium falciparum
DPYTPFKKPVSILSLDGGGILT

SEQ ID NO: 3380607 - protein, 36 aa, Plasmodium falciparum
DQAVKHFLYQNILKKNFILFNIFKGGKNSNNEEDIC

SEQ ID NO: 3380608 - protein, 26 aa, Plasmodium falciparum
DQEEKTRLLLLYFMNYININDNDKMK

SEQ ID NO: 3380609 - protein, 22 aa, Plasmodium falciparum
DQELLQLIYQAIKNQIQCLKNS

SEQ ID NO: 3380610 - protein, 24 aa, Plasmodium falciparum
DQFTAMFRRKAFLHWYTGEGMDEM

SEQ ID NO: 3380611 - protein, 27 aa, Plasmodium falciparum
DQHVIEFLNTLFKYMNAKRNYIHINNL

SEQ ID NO: 3380612 - protein, 19 aa, Plasmodium falciparum
DQHVQVNSIFYLPEKNNIK

SEQ ID NO: 3380613 - protein, 27 aa, Plasmodium falciparum
DQIFSKYKIEVSNLSKYFDFHKTGKKE

SEQ ID NO: 3380614 - protein, 20 aa, Plasmodium falciparum
DQIKLILRKDIINNVINNFT

SEQ ID NO: 3380615 - protein, 17 aa, Plasmodium falciparum
DQIVLNYESIIDQILKK

SEQ ID NO: 3380616 - protein, 30 aa, Plasmodium falciparum
DQIYINSLTHLYLFYSPLVYYKIYVCNIHK

SEQ ID NO: 3380617 - protein, 22 aa, Plasmodium falciparum
DQKDFFNPLKKNNNLQSTHIDA

SEQ ID NO: 3380618 - protein, 27 aa, Plasmodium falciparum
DQKISALFYFYYLKKFSYNFLKTLINN

SEQ ID NO: 3380619 - protein, 17 aa, Plasmodium falciparum
DQKYVMDLINKKVFLLI

SEQ ID NO: 3380620 - protein, 26 aa, Plasmodium falciparum
DQNDIYEFLFLRFVFINIFTHSNIIQ

SEQ ID NO: 3380621 - protein, 28 aa, Plasmodium falciparum
DQNKDDIYYPYKLPIYMSGLVICCKDFS

SEQ ID NO: 3380622 - protein, 27 aa, Plasmodium falciparum
DQNPDKKVFVITYSWKNLKDVNDKAMK

SEQ ID NO: 3380623 - protein, 24 aa, Plasmodium falciparum
DQNRAHILEISPLSLPSYIEYKNK

SEQ ID NO: 3380624 - protein, 31 aa, Plasmodium falciparum
DQQDILLKKKKKYILLELKINNLIKNNIKTS

SEQ ID NO: 3380625 - protein, 20 aa, Plasmodium falciparum
DQRLNAVLIFTDGSLRDNNG

SEQ ID NO: 3380626 - protein, 22 aa, Plasmodium falciparum
DQSLHSFFQNLLAKGRSKSPSA

SEQ ID NO: 3380627 - protein, 37 aa, Plasmodium falciparum
DQSLTLDYKYLNRDKNLLFLSFHNMTMKYKCVEINLH

SEQ ID NO: 3380628 - protein, 34 aa, Plasmodium falciparum
DQTDTINIIFMHKYIYLKNLKKRNYFKKVIMEKS

SEQ ID NO: 3380629 - protein, 23 aa, Plasmodium falciparum
DQTIRIWNWQSRVCIAILTGHNH

SEQ ID NO: 3380630 - protein, 22 aa, Plasmodium falciparum
DQTIYFRQYATNLKKISFKKIL

SEQ ID NO: 3380631 - protein, 21 aa, Plasmodium falciparum
DQWINFGLVCLDELICISFKK

SEQ ID NO: 3380632 - protein, 17 aa, Plasmodium falciparum
DQYILNPAIIEYKNINE

SEQ ID NO: 3380633 - protein, 26 aa, Plasmodium falciparum
DQYKNSLNIKYFPIKKLNEIKKDITN

SEQ ID NO: 3380634 - protein, 25 aa, Plasmodium falciparum
DRASHQILNFKLSKTFKKFSLEREK

SEQ ID NO: 3380635 - protein, 29 aa, Plasmodium falciparum
DRDHDLNSSFKSIKNFNSFDISKKRCNGI

SEQ ID NO: 3380636 - protein, 32 aa, Plasmodium falciparum
DRDSELFRIILNFLRNPLTIPIPKDLSESEAL

SEQ ID NO: 3380637 - protein, 35 aa, Plasmodium falciparum
DRENINNFNEVFFFLKLWLSSFNIGKSIHCKKLIY

SEQ ID NO: 3380638 - protein, 23 aa, Plasmodium falciparum
DRGKRYHITQTDFIIGMLACSPQ

SEQ ID NO: 3380639 - protein, 31 aa, Plasmodium falciparum
DRGKYSIETFLLLLALKIKYPLHLTLIRGNH

SEQ ID NO: 3380640 - protein, 21 aa, Plasmodium falciparum
DRGWHNFVPFEKLREPGFISE

SEQ ID NO: 3380641 - protein, 20 aa, Plasmodium falciparum
DRINRTRHTFFNRGRNIRGN

SEQ ID NO: 3380642 - protein, 22 aa, Plasmodium falciparum
DRIRVRYRKSLRPTSEQLQSLN

SEQ ID NO: 3380643 - protein, 66 aa, Plasmodium falciparum
DRKIDIWSLGCILFEFLTKKILFDYQNIYRFIYSIVSYIGPFPFYMINNCRIPHIFTKHGLIILKK

SEQ ID NO: 3380644 - protein, 26 aa, Plasmodium falciparum
DRKKCRDILLISKQAFFKIITNIVCN

SEQ ID NO: 3380645 - protein, 23 aa, Plasmodium falciparum
DRKNLLYKHFFYNKLDIICLQEV

SEQ ID NO: 3380646 - protein, 30 aa, Plasmodium falciparum
DRKPKQKMKFFTTKPLILDYFNSEENLYNV

SEQ ID NO: 3380647 - protein, 25 aa, Plasmodium falciparum
DRLKMLQIIFTDIYGRRILSDEGLD

SEQ ID NO: 3380648 - protein, 22 aa, Plasmodium falciparum
DRMIVLHNILKDCIIAKVKNDY

SEQ ID NO: 3380649 - protein, 23 aa, Plasmodium falciparum
DRNDMFPCFGYLYPEGTDRIRKC

SEQ ID NO: 3380650 - protein, 21 aa, Plasmodium falciparum
DRNIYNYHNYITYLKKNKHMN

SEQ ID NO: 3380651 - protein, 22 aa, Plasmodium falciparum
DRNNLWMKKYSSKKYWNFKKIK

SEQ ID NO: 3380652 - protein, 23 aa, Plasmodium falciparum
DRNNVFNNYLLTIEGRKREMKYK

SEQ ID NO: 3380653 - protein, 22 aa, Plasmodium falciparum
DRRILYHLFYHLKRKCINMHVQ

SEQ ID NO: 3380654 - protein, 29 aa, Plasmodium falciparum
DRRNILLNTFNYFFYNNFGNLSEVKLKNG

SEQ ID NO: 3380655 - protein, 30 aa, Plasmodium falciparum
DRSKTPIVRFYFDKLFYKYLCLSSVMHIDH

SEQ ID NO: 3380656 - protein, 31 aa, Plasmodium falciparum
DRSKTVIEAFYKILKIIKRIYARKSDKHKAR

SEQ ID NO: 3380657 - protein, 18 aa, Plasmodium falciparum
DRVFIPTLDMKYSSPINI

SEQ ID NO: 3380658 - protein, 36 aa, Plasmodium falciparum
DRVLTLNDHLFLLGLYFNIFFLYNNKEYTFLNFFKL

SEQ ID NO: 3380659 - protein, 24 aa, Plasmodium falciparum
DRYLGRHYRYFIRNTRVRAYKQFL

SEQ ID NO: 3380660 - protein, 42 aa, Plasmodium falciparum
DSCFTLDKFFCLFSLLKIKNKIYIFLKDIKNIILQIKKLINH

SEQ ID NO: 3380661 - protein, 42 aa, Plasmodium falciparum
DSCYIRACGFLYLRYVHSPANLWMWFEPYLLEEDEFSISCDK

SEQ ID NO: 3380662 - protein, 27 aa, Plasmodium falciparum
DSDALATLIVNKLRLGLKICAVKAPGF

SEQ ID NO: 3380663 - protein, 25 aa, Plasmodium falciparum
DSDECYMWYYFKEDFFEIYYLKDEY

SEQ ID NO: 3380664 - protein, 26 aa, Plasmodium falciparum
DSDENKRFIKYPKLKQLLELKNDIIK

SEQ ID NO: 3380665 - protein, 24 aa, Plasmodium falciparum
DSDEWLTLEYFLQVNARTSRVKLV

SEQ ID NO: 3380666 - protein, 22 aa, Plasmodium falciparum
DSDGHLIHIDYGFMLTNSPGNV

SEQ ID NO: 3380667 - protein, 17 aa, Plasmodium falciparum
DSDSNYINLINNGNILI

SEQ ID NO: 3380668 - protein, 24 aa, Plasmodium falciparum
DSDTLKIGFVKFFLAPKMDDDMDN

SEQ ID NO: 3380669 - protein, 30 aa, Plasmodium falciparum
DSEILDIPISIVKNIHLCPITDISWNNLGN

SEQ ID NO: 3380670 - protein, 38 aa, Plasmodium falciparum
DSEISNNLLYKKNYELFENSLKMFILNDEMFNNINNNN

SEQ ID NO: 3380671 - protein, 23 aa, Plasmodium falciparum
DSELLHQNLIQIVSFAGGSSHCA

SEQ ID NO: 3380672 - protein, 27 aa, Plasmodium falciparum
DSEYLDYYSFFFKDISKYIKFHIIEKI

SEQ ID NO: 3380673 - protein, 25 aa, Plasmodium falciparum
DSFLEYIFEHFFPHIIYIGVHNYMD

SEQ ID NO: 3380674 - protein, 18 aa, Plasmodium falciparum
DSFMIPAHYKKYLTKVLV

SEQ ID NO: 3380675 - protein, 20 aa, Plasmodium falciparum
DSGDFLVYKFKTWEWQEADK

SEQ ID NO: 3380676 - protein, 17 aa, Plasmodium falciparum
DSGFRRRFEKRIYIPLP

SEQ ID NO: 3380677 - protein, 23 aa, Plasmodium falciparum
DSHDNIPIYIKYNTPSNKNMINT

SEQ ID NO: 3380678 - protein, 17 aa, Plasmodium falciparum
DSHFNEYKYDYVKEKFK

SEQ ID NO: 3380679 - protein, 23 aa, Plasmodium falciparum
DSILYLYNTINDKNFFKCPCWLN

SEQ ID NO: 3380680 - protein, 18 aa, Plasmodium falciparum
DSINLKLMETRFSKNVAS

SEQ ID NO: 3380681 - protein, 23 aa, Plasmodium falciparum
DSINLMKRLLCRLPQGRIGCSIN

SEQ ID NO: 3380682 - protein, 27 aa, Plasmodium falciparum
DSKAKIICYYAFIPLCNIKDQIINKKL

SEQ ID NO: 3380683 - protein, 24 aa, Plasmodium falciparum
DSKFKKLFCKKCNSVLIPSETCDV

SEQ ID NO: 3380684 - protein, 20 aa, Plasmodium falciparum
DSKIKFFVKMLLFEKRYSSY

SEQ ID NO: 3380685 - protein, 37 aa, Plasmodium falciparum
DSKKNNINHVPLLNNVPYLNNDLLINNVILNQNNMNN

SEQ ID NO: 3380686 - protein, 33 aa, Plasmodium falciparum
DSKKYLLCCLFLRICMNVRKPPLDIFITAAELQ

SEQ ID NO: 3380687 - protein, 24 aa, Plasmodium falciparum
DSKLPHFAIEQRKKLIKETNRFFK

SEQ ID NO: 3380688 - protein, 19 aa, Plasmodium falciparum
DSKVVLYKLLKNQDLKKCS

SEQ ID NO: 3380689 - protein, 24 aa, Plasmodium falciparum
DSLDHPMPLCPNNSFVCPNCHNVS

SEQ ID NO: 3380690 - protein, 24 aa, Plasmodium falciparum
DSLDPALIRPGRIDRKIQLPNPDT

SEQ ID NO: 3380691 - protein, 19 aa, Plasmodium falciparum
DSLFQPYLCRVSSGTNNLI

SEQ ID NO: 3380692 - protein, 34 aa, Plasmodium falciparum
DSLKVVYKLEKLYNLPLKILKFENLFSYTMDDVV

SEQ ID NO: 3380693 - protein, 20 aa, Plasmodium falciparum
DSLKYQILLELSRHDYRLHC

SEQ ID NO: 3380694 - protein, 33 aa, Plasmodium falciparum
DSLPGFPSPDTFEFLILPHLKKINAPVFNCLDR

SEQ ID NO: 3380695 - protein, 25 aa, Plasmodium falciparum
DSLVIWQRVFDLPYFKINCVNETIE

SEQ ID NO: 3380696 - protein, 17 aa, Plasmodium falciparum
DSLYYEENIKRDLLEYV

SEQ ID NO: 3380697 - protein, 18 aa, Plasmodium falciparum
DSLYYEENIKRDLLEYVS

SEQ ID NO: 3380698 - protein, 23 aa, Plasmodium falciparum
DSMGTLPVVHLLNENKKVIAIVP

SEQ ID NO: 3380699 - protein, 29 aa, Plasmodium falciparum
DSMHINNNFLIGISPQKNIWVKNIHNLSH

SEQ ID NO: 3380700 - protein, 30 aa, Plasmodium falciparum
DSNDVMIKKLMLKNNLLFEHLQKNGKFNKD

SEQ ID NO: 3380701 - protein, 32 aa, Plasmodium falciparum
DSNDYKTLYFYKKNPLYFYSIFDGHRGIKACE

SEQ ID NO: 3380702 - protein, 30 aa, Plasmodium falciparum
DSNTRTISQLYLTDLSDVFANFNYSCNFNN

SEQ ID NO: 3380703 - protein, 25 aa, Plasmodium falciparum
DSNVPLYFIIHNLDNTKLYPYYEYF

SEQ ID NO: 3380704 - protein, 18 aa, Plasmodium falciparum
DSPDQTFDDYYYMKAHGY

SEQ ID NO: 3380705 - protein, 27 aa, Plasmodium falciparum
DSPSDIKLILRTGGGFRKLSEHDQKHY

SEQ ID NO: 3380706 - protein, 22 aa, Plasmodium falciparum
DSPTPIPVLLDAQSLKSNVILL

SEQ ID NO: 3380707 - protein, 17 aa, Plasmodium falciparum
DSPYYSPRDMLSHNSFE

SEQ ID NO: 3380708 - protein, 18 aa, Plasmodium falciparum
DSQIFGDSLLADIKEYNY

SEQ ID NO: 3380709 - protein, 23 aa, Plasmodium falciparum
DSQKIVYIYLKGSASHFKLPFSC

SEQ ID NO: 3380710 - protein, 39 aa, Plasmodium falciparum
DSRQRNAQWVFKVFSYEKKKLTFLSKVHSTIYNYKEDNK

SEQ ID NO: 3380711 - protein, 25 aa, Plasmodium falciparum
DSSATLSVLLFPTNLDIFLCSNCTS

SEQ ID NO: 3380712 - protein, 18 aa, Plasmodium falciparum
DSSIQLMPFCNRKDKEKI

SEQ ID NO: 3380713 - protein, 24 aa, Plasmodium falciparum
DSSLLIYDIRYFKLLKNYICKLEG

SEQ ID NO: 3380714 - protein, 20 aa, Plasmodium falciparum
DSSLRILSILKISSIIKDGD

SEQ ID NO: 3380715 - protein, 19 aa, Plasmodium falciparum
DSSRRRDRYSRRYERRSER

SEQ ID NO: 3380716 - protein, 34 aa, Plasmodium falciparum
DSTFGVYLKSIIDRNKISLLKKLEKQKELKSVEE

SEQ ID NO: 3380717 - protein, 20 aa, Plasmodium falciparum
DSTFSLYNNVNYGKSIVHDD

SEQ ID NO: 3380718 - protein, 19 aa, Plasmodium falciparum
DSTLSFRRSCREGICGSCA

SEQ ID NO: 3380719 - protein, 19 aa, Plasmodium falciparum
DSTSFYMTKLMNSRIHVEK

SEQ ID NO: 3380720 - protein, 25 aa, Plasmodium falciparum
DSVDIIWEKMVLLAIGEEFSLIDLC

SEQ ID NO: 3380721 - protein, 25 aa, Plasmodium falciparum
DSVIHALKYTLLNKPQNFTTLQNFL

SEQ ID NO: 3380722 - protein, 35 aa, Plasmodium falciparum
DSVISKSNRLYLFNKFFTSLFYEDNTRTHNFIMFN

SEQ ID NO: 3380723 - protein, 23 aa, Plasmodium falciparum
DSYDAHFLCYCNNKIELIENDDH

SEQ ID NO: 3380724 - protein, 23 aa, Plasmodium falciparum
DSYDQFIILGLCKNIHLTNKSMD

SEQ ID NO: 3380725 - protein, 24 aa, Plasmodium falciparum
DSYKNIFHIMKEQNKLRSLSLNRN

SEQ ID NO: 3380726 - protein, 25 aa, Plasmodium falciparum
DSYNIRNFFINNKKIYLLNESEYSH

SEQ ID NO: 3380727 - protein, 23 aa, Plasmodium falciparum
DSYTNWIPAAIPFLRIMHVIKDN

SEQ ID NO: 3380728 - protein, 47 aa, Plasmodium falciparum
DTAEDQLKWKEKLELPYELLCDVDKNLLKLLGLTNEEDKTIRSHLVL

SEQ ID NO: 3380729 - protein, 23 aa, Plasmodium falciparum
DTDLNLFLEALKATLTILEKVNE

SEQ ID NO: 3380730 - protein, 24 aa, Plasmodium falciparum
DTEAIFLLDKGSRPIYHKLKDKEW

SEQ ID NO: 3380731 - protein, 17 aa, Plasmodium falciparum
DTEFYERYIRIIPLCRM

SEQ ID NO: 3380732 - protein, 42 aa, Plasmodium falciparum
DTFKVYKDIIITLNGPHNYPENTIIYYLYTRENSSLNNNMRN

SEQ ID NO: 3380733 - protein, 19 aa, Plasmodium falciparum
DTFQLYINEKEYYICKCLY

SEQ ID NO: 3380734 - protein, 25 aa, Plasmodium falciparum
DTGLFISKLNNFPGPYIKWMQKALG

SEQ ID NO: 3380735 - protein, 24 aa, Plasmodium falciparum
DTHFELFRKFKNKAVWKTLEGGEI

SEQ ID NO: 3380736 - protein, 26 aa, Plasmodium falciparum
DTIHRDNLSLLLKELAHRGTQFIITT

SEQ ID NO: 3380737 - protein, 17 aa, Plasmodium falciparum
DTIIYLNEFLQIRYKIF

SEQ ID NO: 3380738 - protein, 27 aa, Plasmodium falciparum
DTIKHIHLHLFYLNSLFTTHFNVFLNN

SEQ ID NO: 3380739 - protein, 17 aa, Plasmodium falciparum
DTIKKWLTTIDIVYYEG

SEQ ID NO: 3380740 - protein, 19 aa, Plasmodium falciparum
DTIMFVKKHRELNYRNTNL

SEQ ID NO: 3380741 - protein, 25 aa, Plasmodium falciparum
DTIRALLTCFRLIDALKSLKLNGSI

SEQ ID NO: 3380742 - protein, 21 aa, Plasmodium falciparum
DTISSLLNNPLARSVLNELSN

SEQ ID NO: 3380743 - protein, 25 aa, Plasmodium falciparum
DTKKHNFNFLLFDKSDHYYNESTIN

SEQ ID NO: 3380744 - protein, 26 aa, Plasmodium falciparum
DTLDYLFNYDFLYKEYKIVVRVNQKA

SEQ ID NO: 3380745 - protein, 21 aa, Plasmodium falciparum
DTLIACKMFGFTTSPYPIILS

SEQ ID NO: 3380746 - protein, 25 aa, Plasmodium falciparum
DTLNRDYNLLLYKYQECVSKLKRVK

SEQ ID NO: 3380747 - protein, 30 aa, Plasmodium falciparum
DTLRTDFHILYIFWDILYNLRNVLGNFKCK

SEQ ID NO: 3380748 - protein, 25 aa, Plasmodium falciparum
DTNFFNQLGLSNWLPNYDMPIYNEY

SEQ ID NO: 3380749 - protein, 25 aa, Plasmodium falciparum
DTNKSEKPLYLRRLEEYRKKKKLES

SEQ ID NO: 3380750 - protein, 28 aa, Plasmodium falciparum
DTNLFSMHYLFPFILLDTYDKNDCVKVK

SEQ ID NO: 3380751 - protein, 29 aa, Plasmodium falciparum
DTNSFVISDNYICQFGLSSLYKCKLKNEN

SEQ ID NO: 3380752 - protein, 23 aa, Plasmodium falciparum
DTNSKDNLLNTPGIRTSEKDIIT

SEQ ID NO: 3380753 - protein, 27 aa, Plasmodium falciparum
DTNTNDKIILVPSIFFFSPDCNDRNDF

SEQ ID NO: 3380754 - protein, 24 aa, Plasmodium falciparum
DTNYQWLPLLYMALATDTSVSKIT

SEQ ID NO: 3380755 - protein, 22 aa, Plasmodium falciparum
DTPQFYFVPLDEKGKRKDLFQR

SEQ ID NO: 3380756 - protein, 29 aa, Plasmodium falciparum
DTRNQYEPLFIFPLNISEFTYTYFRHIEW

SEQ ID NO: 3380757 - protein, 24 aa, Plasmodium falciparum
DTRNTIIIFPNYLSFSYGIINKCN

SEQ ID NO: 3380758 - protein, 23 aa, Plasmodium falciparum
DTSFLFKNFLLDIFNKKKQYREY

SEQ ID NO: 3380759 - protein, 29 aa, Plasmodium falciparum
DTSIKFCEYIFSKLILYTNYQNDNLTTFF

SEQ ID NO: 3380760 - protein, 18 aa, Plasmodium falciparum
DTSSLYPNKLEIQAQMNN

SEQ ID NO: 3380761 - protein, 23 aa, Plasmodium falciparum
DTSSNYFQYFKNLLALNLSETNI

SEQ ID NO: 3380762 - protein, 18 aa, Plasmodium falciparum
DTTFFWINQKYQDVKYYE

SEQ ID NO: 3380763 - protein, 28 aa, Plasmodium falciparum
DTTSSDPYFYVWIKCLKNSIPVPQQWCQ

SEQ ID NO: 3380764 - protein, 25 aa, Plasmodium falciparum
DTVTIYLPMIPELIYSMLACVRIGA

SEQ ID NO: 3380765 - protein, 27 aa, Plasmodium falciparum
DTYDNYEICKNYKLINKNRFINNEYYK

SEQ ID NO: 3380766 - protein, 17 aa, Plasmodium falciparum
DTYIDIYKYCKERNILF

SEQ ID NO: 3380767 - protein, 23 aa, Plasmodium falciparum
DTYNTLIYYNLSKSKLYLPSKIY

SEQ ID NO: 3380768 - protein, 26 aa, Plasmodium falciparum
DTYSMYDGFYFFLSNNKSPHFLRKNL

SEQ ID NO: 3380769 - protein, 25 aa, Plasmodium falciparum
DTYSNTIPVFYGIKKSKNILSSSYD

SEQ ID NO: 3380770 - protein, 19 aa, Plasmodium falciparum
DVCFEKFLNLLFQLLKNDD

SEQ ID NO: 3380771 - protein, 25 aa, Plasmodium falciparum
DVCLKHPLIILCYDDNMIRILNYRK

SEQ ID NO: 3380772 - protein, 26 aa, Plasmodium falciparum
DVDIIDKIFLLTIQTNFLYERLEKRN

SEQ ID NO: 3380773 - protein, 26 aa, Plasmodium falciparum
DVDKKHLELKEKLKMWKSSVSKQNDS

SEQ ID NO: 3380774 - protein, 25 aa, Plasmodium falciparum
DVDTFPEDLYLWNKQNLKYKKEFST

SEQ ID NO: 3380775 - protein, 19 aa, Plasmodium falciparum
DVEQEKFLRMSNINNMNNM

SEQ ID NO: 3380776 - protein, 21 aa, Plasmodium falciparum
DVEVFKLLNLLNKILMVIKEN

SEQ ID NO: 3380777 - protein, 37 aa, Plasmodium falciparum
DVFKKYFLNHILTKGQILALKYNDILLKCIVKDLKTA

SEQ ID NO: 3380778 - protein, 23 aa, Plasmodium falciparum
DVFRYIISSVKNKNLLLLNKRCC

SEQ ID NO: 3380779 - protein, 22 aa, Plasmodium falciparum
DVFYTFMCKFYFFNVKNKTIDT

SEQ ID NO: 3380780 - protein, 20 aa, Plasmodium falciparum
DVGFLTVRTLRRTVPPALPG

SEQ ID NO: 3380781 - protein, 29 aa, Plasmodium falciparum
DVGFSHTYVLPYIEYKLIEYAVLRTKISG

SEQ ID NO: 3380782 - protein, 24 aa, Plasmodium falciparum
DVGIFFTKLPITKAFHTYNKKYRI

SEQ ID NO: 3380783 - protein, 24 aa, Plasmodium falciparum
DVGNQFFNLLLKQLFDKIFSVDIS

SEQ ID NO: 3380784 - protein, 27 aa, Plasmodium falciparum
DVGYPRRVMTALGPLPLPEEFKKNIPE

SEQ ID NO: 3380785 - protein, 26 aa, Plasmodium falciparum
DVHEYLRYFLNSLEKTSFFSSIYIQK

SEQ ID NO: 3380786 - protein, 17 aa, Plasmodium falciparum
DVHFYPKEQIKELYTHI

SEQ ID NO: 3380787 - protein, 30 aa, Plasmodium falciparum
DVHGQLHDVLWLFNRFGIPSSTNIYIFNGD

SEQ ID NO: 3380788 - protein, 22 aa, Plasmodium falciparum
DVHMNLYNISLTRAGRFFHFIN

SEQ ID NO: 3380789 - protein, 30 aa, Plasmodium falciparum
DVHSRLMELFLFISTLRRSSAKKVTAVIPY

SEQ ID NO: 3380790 - protein, 25 aa, Plasmodium falciparum
DVIEKDFHFLIKARYDNKGNIWCIN

SEQ ID NO: 3380791 - protein, 23 aa, Plasmodium falciparum
DVIFLLKHIFQLKSLNQIESTNK

SEQ ID NO: 3380792 - protein, 23 aa, Plasmodium falciparum
DVIIMYDHFFQLPQNFLSSKLSE

SEQ ID NO: 3380793 - protein, 17 aa, Plasmodium falciparum
DVISKVMSLIDKYIYDS

SEQ ID NO: 3380794 - protein, 30 aa, Plasmodium falciparum
DVKKKLDILILYLRFVHNFCYYSAKKFNTY

SEQ ID NO: 3380795 - protein, 28 aa, Plasmodium falciparum
DVKLYQICYMTYRLILMMKKCINYIKKR

SEQ ID NO: 3380796 - protein, 19 aa, Plasmodium falciparum
DVKRMSNFNIHRDGMYLKD

SEQ ID NO: 3380797 - protein, 18 aa, Plasmodium falciparum
DVLCEAYFVPQLAYNHYY

SEQ ID NO: 3380798 - protein, 24 aa, Plasmodium falciparum
DVLEKKNTFGFLDNNYQNYGSNNN

SEQ ID NO: 3380799 - protein, 18 aa, Plasmodium falciparum
DVLLIYITNLSNKKHIFK

SEQ ID NO: 3380800 - protein, 19 aa, Plasmodium falciparum
DVLLYLQDYYYFDVIKRVS

SEQ ID NO: 3380801 - protein, 31 aa, Plasmodium falciparum
DVLNDEIMFPIKFNFEKLKKNIYVIEHIDKI

SEQ ID NO: 3380802 - protein, 27 aa, Plasmodium falciparum
DVLNMLSHILCLLYFTSDSRAHATFDT

SEQ ID NO: 3380803 - protein, 31 aa, Plasmodium falciparum
DVMISKIYRKKYDQGFPLNLPDPYINKQVYE

SEQ ID NO: 3380804 - protein, 22 aa, Plasmodium falciparum
DVMKYREKLGLFPHIKVIDTLS

SEQ ID NO: 3380805 - protein, 27 aa, Plasmodium falciparum
DVNKLFNLFSIYGFVTRIKILREKPDA

SEQ ID NO: 3380806 - protein, 23 aa, Plasmodium falciparum
DVNKNIFSFCKSNLNLKKENNNI

SEQ ID NO: 3380807 - protein, 18 aa, Plasmodium falciparum
DVNNNSWNWVKIERITFA

SEQ ID NO: 3380808 - protein, 28 aa, Plasmodium falciparum
DVNQVDEDYLYALKLNEALNGSGANDIN

SEQ ID NO: 3380809 - protein, 24 aa, Plasmodium falciparum
DVNYLFLGDYVDRGYYSCECFCLV

SEQ ID NO: 3380810 - protein, 28 aa, Plasmodium falciparum
DVQKIFISTPLKKQVMFFSATMAKEMRD

SEQ ID NO: 3380811 - protein, 24 aa, Plasmodium falciparum
DVRKEMVHFLLERKSQENLISFKS

SEQ ID NO: 3380812 - protein, 23 aa, Plasmodium falciparum
DVRQKCLENIKSEFYNFINKFIN

SEQ ID NO: 3380813 - protein, 37 aa, Plasmodium falciparum
DVSEEEIIFNPFAWKKFEKHIPCEFIELFEKMEKQLD

SEQ ID NO: 3380814 - protein, 25 aa, Plasmodium falciparum
DVSRILLTHALTTRDIYTLQNTLST

SEQ ID NO: 3380815 - protein, 25 aa, Plasmodium falciparum
DVSTNKYVYPIKNKILTNQKENYYE

SEQ ID NO: 3380816 - protein, 21 aa, Plasmodium falciparum
DVTDKLISLCAITLSFEQVMY

SEQ ID NO: 3380817 - protein, 17 aa, Plasmodium falciparum
DVTRSFGDLSLKKYGLL

SEQ ID NO: 3380818 - protein, 22 aa, Plasmodium falciparum
DVVKFNQSYYCYFKNVQKNDVY

SEQ ID NO: 3380819 - protein, 30 aa, Plasmodium falciparum
DVYFNMNQFVQPWYLKNLNKSMDIKKFLNS

SEQ ID NO: 3380820 - protein, 25 aa, Plasmodium falciparum
DVYNDNLNFLLKKNKNELEKSYIDP

SEQ ID NO: 3380821 - protein, 21 aa, Plasmodium falciparum
DVYWTFKVYQLKISLRNLHNL

SEQ ID NO: 3380822 - protein, 26 aa, Plasmodium falciparum
DWYCSACNFLNFSRRTACHFCKAPKT

SEQ ID NO: 3380823 - protein, 24 aa, Plasmodium falciparum
DYDDNFLFPMEKKNFFFEIKKNKN

SEQ ID NO: 3380824 - protein, 26 aa, Plasmodium falciparum
DYDHILKVHTLWLYHCRGTLEKRHSS

SEQ ID NO: 3380825 - protein, 26 aa, Plasmodium falciparum
DYEKYLYTLLHIYIKKSKDLKKCPNK

SEQ ID NO: 3380826 - protein, 23 aa, Plasmodium falciparum
DYELAIFIKELAKNWKCQLGWHP

SEQ ID NO: 3380827 - protein, 20 aa, Plasmodium falciparum
DYENVIVSKDVGFFNLYILD

SEQ ID NO: 3380828 - protein, 20 aa, Plasmodium falciparum
DYETFKLYVLKKYDKIYKTC

SEQ ID NO: 3380829 - protein, 18 aa, Plasmodium falciparum
DYFKKILNIFSEQNIRLV

SEQ ID NO: 3380830 - protein, 26 aa, Plasmodium falciparum
DYHELKVAIRALGFDIKKADVLDLMR

SEQ ID NO: 3380831 - protein, 18 aa, Plasmodium falciparum
DYHNVEAIYLSLSNLKDS

SEQ ID NO: 3380832 - protein, 20 aa, Plasmodium falciparum
DYICAFLSCFVYDESTSKEI

SEQ ID NO: 3380833 - protein, 19 aa, Plasmodium falciparum
DYIENLIVQIWANSYILKT

SEQ ID NO: 3380834 - protein, 17 aa, Plasmodium falciparum
DYIIYHKDFFNEFILNH

SEQ ID NO: 3380835 - protein, 24 aa, Plasmodium falciparum
DYIKAYLLGFTLEDSLALLRIEDL

SEQ ID NO: 3380836 - protein, 20 aa, Plasmodium falciparum
DYIKTYLISFHFFQKIQDNY

SEQ ID NO: 3380837 - protein, 17 aa, Plasmodium falciparum
DYILYKNYINKLTTCTN

SEQ ID NO: 3380838 - protein, 22 aa, Plasmodium falciparum
DYINITKILLYMMKNNKVITCF

SEQ ID NO: 3380839 - protein, 24 aa, Plasmodium falciparum
DYINMCRCIFADLFKKDRLYKYFK

SEQ ID NO: 3380840 - protein, 22 aa, Plasmodium falciparum
DYIYQNYYLRVGDSIVFYLIKG

SEQ ID NO: 3380841 - protein, 23 aa, Plasmodium falciparum
DYKIRLYEFKSCTCLYIGVAHNN

SEQ ID NO: 3380842 - protein, 23 aa, Plasmodium falciparum
DYKKLIDNWKNDKIKIFISWCPE

SEQ ID NO: 3380843 - protein, 20 aa, Plasmodium falciparum
DYKNIFFLEKGYISTHVRGD

SEQ ID NO: 3380844 - protein, 23 aa, Plasmodium falciparum
DYKNNKGYNLKMGKGYKVQTITN

SEQ ID NO: 3380845 - protein, 35 aa, Plasmodium falciparum
DYKTHTYFCNPMHLLHMINLLAEKIRINKNDPNFN

SEQ ID NO: 3380846 - protein, 27 aa, Plasmodium falciparum
DYLCCKISMCLMNEPVITPSGMTYDKI

SEQ ID NO: 3380847 - protein, 18 aa, Plasmodium falciparum
DYLFKIVLIGDSGVGKSN

SEQ ID NO: 3380848 - protein, 20 aa, Plasmodium falciparum
DYLGLMVCHISFPEFFVAIE

SEQ ID NO: 3380849 - protein, 20 aa, Plasmodium falciparum
DYLINYLKKCEETGLASFNQ

SEQ ID NO: 3380850 - protein, 21 aa, Plasmodium falciparum
DYLLNCFTAYFRLSDYITTVE

SEQ ID NO: 3380851 - protein, 18 aa, Plasmodium falciparum
DYLLNSKRNDLYEKQTFS

SEQ ID NO: 3380852 - protein, 35 aa, Plasmodium falciparum
DYLSDIGIKCSLRYAIQLLTPAKILSKKKGKKKID

SEQ ID NO: 3380853 - protein, 19 aa, Plasmodium falciparum
DYLSNIKCDISLNTKTEQN

SEQ ID NO: 3380854 - protein, 22 aa, Plasmodium falciparum
DYLSTLEHLIEKKFFPEMENLR

SEQ ID NO: 3380855 - protein, 17 aa, Plasmodium falciparum
DYMALKLNNIFNGTINK

SEQ ID NO: 3380856 - protein, 17 aa, Plasmodium falciparum
DYMYTNYLNMEHIKMNN

SEQ ID NO: 3380857 - protein, 17 aa, Plasmodium falciparum
DYNIVDDFIYLNKENRN

SEQ ID NO: 3380858 - protein, 51 aa, Plasmodium falciparum
DYNKEKELIFCFSFIKYYSWIKALQILNIPIDFFHLGINSHKYIHKNKSEE

SEQ ID NO: 3380859 - protein, 22 aa, Plasmodium falciparum
DYNLIMDTLILTKEECSKKEEQ

SEQ ID NO: 3380860 - protein, 26 aa, Plasmodium falciparum
DYNLYNEAFMDMNISYNGLMNNNLNN

SEQ ID NO: 3380861 - protein, 23 aa, Plasmodium falciparum
DYNMLNFINYFNNSYIKKVQQVC

SEQ ID NO: 3380862 - protein, 22 aa, Plasmodium falciparum
DYNNFDLMMLNNDLNNYLKDTN

SEQ ID NO: 3380863 - protein, 26 aa, Plasmodium falciparum
DYNNKIFNILLLVYNLEKIINVKNEN

SEQ ID NO: 3380864 - protein, 21 aa, Plasmodium falciparum
DYNYNNFLNIRFFTIEKSDNK

SEQ ID NO: 3380865 - protein, 30 aa, Plasmodium falciparum
DYNYQTIKCNVDLLKVIQLGVTFSNGKGEM

SEQ ID NO: 3380866 - protein, 25 aa, Plasmodium falciparum
DYQNDKIFNFQPKQSEWFDEEEIFD

SEQ ID NO: 3380867 - protein, 23 aa, Plasmodium falciparum
DYQTLHDAFFKYATKPKLVKFAE

SEQ ID NO: 3380868 - protein, 18 aa, Plasmodium falciparum
DYRIGILIDKFEEHEGPV

SEQ ID NO: 3380869 - protein, 18 aa, Plasmodium falciparum
DYSNTSLLSLFSRKKSFK

SEQ ID NO: 3380870 - protein, 26 aa, Plasmodium falciparum
DYSSIYNYLSFKKILGYGAFGEVHLV

SEQ ID NO: 3380871 - protein, 30 aa, Plasmodium falciparum
DYTDQNIQKLFFFHILIPLNNYNEEESELN

SEQ ID NO: 3380872 - protein, 25 aa, Plasmodium falciparum
DYTGTLRIAFFVQLAFEGNMSIEDK

SEQ ID NO: 3380873 - protein, 24 aa, Plasmodium falciparum
DYVEATTHFLKPKTFKDMNGLYYD

SEQ ID NO: 3380874 - protein, 31 aa, Plasmodium falciparum
DYYENIYIIRISYVLYAFYYFLNENINLKVV

SEQ ID NO: 3380875 - protein, 20 aa, Plasmodium falciparum
DYYMTLIKKDKNVFDKSVEY

SEQ ID NO: 3380876 - protein, 20 aa, Plasmodium falciparum
EAALYDYRFLLKNHPSVSIF

SEQ ID NO: 3380877 - protein, 19 aa, Plasmodium falciparum
EAEKLRRLIAPLSKEQLID

SEQ ID NO: 3380878 - protein, 27 aa, Plasmodium falciparum
EAENKILQIMFRPLKLHPFSTINIHKI

SEQ ID NO: 3380879 - protein, 18 aa, Plasmodium falciparum
EAFIPTFNGSVIVKVLFV

SEQ ID NO: 3380880 - protein, 18 aa, Plasmodium falciparum
EAFSWFLKDLRSRIISLV

SEQ ID NO: 3380881 - protein, 21 aa, Plasmodium falciparum
EAGKLLYHLYGESNKIKPNIL

SEQ ID NO: 3380882 - protein, 25 aa, Plasmodium falciparum
EAGKTWKNFITIKKNDKLKIPDNLF

SEQ ID NO: 3380883 - protein, 27 aa, Plasmodium falciparum
EAHLKECFYFSYFNSFYILGDNNYFFK

SEQ ID NO: 3380884 - protein, 27 aa, Plasmodium falciparum
EAIEKEYLRILILDINDIYDNTIECYK

SEQ ID NO: 3380885 - protein, 46 aa, Plasmodium falciparum
EAIGKRAEYLWNLALSAVYINVKLSMKYITLIKKITKNNLLFDNIC

SEQ ID NO: 3380886 - protein, 28 aa, Plasmodium falciparum
EAIINMSEKLLILSNKYDILVKESKLQE

SEQ ID NO: 3380887 - protein, 24 aa, Plasmodium falciparum
EAIKIYSNWPYIPNLYVNNNFIGG

SEQ ID NO: 3380888 - protein, 25 aa, Plasmodium falciparum
EAINLITQFLKYEPLKRLNPIEALA

SEQ ID NO: 3380889 - protein, 17 aa, Plasmodium falciparum
EAKFKIERLLKSSYKKC

SEQ ID NO: 3380890 - protein, 19 aa, Plasmodium falciparum
EAKILASVLVLQKLEEYEN

SEQ ID NO: 3380891 - protein, 28 aa, Plasmodium falciparum
EAKKFINTLHYKYITPTKYECPGWLTKR

SEQ ID NO: 3380892 - protein, 24 aa, Plasmodium falciparum
EAKKVVANALRQRWRRIQVSDDMK

SEQ ID NO: 3380893 - protein, 26 aa, Plasmodium falciparum
EAKMHKVLIFTQFQLVLDELEEYCKY

SEQ ID NO: 3380894 - protein, 30 aa, Plasmodium falciparum
EAKNCLFFMNKLNIKVLPSLCLFIDGVLIQ

SEQ ID NO: 3380895 - protein, 25 aa, Plasmodium falciparum
EAKRDDLTVLVLNLDLKADERDIYE

SEQ ID NO: 3380896 - protein, 18 aa, Plasmodium falciparum
EAKSFVSRLLGLGDISGL

SEQ ID NO: 3380897 - protein, 22 aa, Plasmodium falciparum
EAKYYMTLQKYTYKLHIIINKK

SEQ ID NO: 3380898 - protein, 31 aa, Plasmodium falciparum
EALKRLKNYLPYLCKILIDNTVYTKWDYLAM

SEQ ID NO: 3380899 - protein, 25 aa, Plasmodium falciparum
EALRRAKYKFPGRQKVFVSNKWGFT

SEQ ID NO: 3380900 - protein, 20 aa, Plasmodium falciparum
EALRRSSIKRSTVDYEKKNL

SEQ ID NO: 3380901 - protein, 25 aa, Plasmodium falciparum
EAMNKLSLISLYPNNNHIINNVNNV

SEQ ID NO: 3380902 - protein, 24 aa, Plasmodium falciparum
EAMRTYIFRYISIYESFSIDQLCV

SEQ ID NO: 3380903 - protein, 27 aa, Plasmodium falciparum
EANICKNPYYMSHGDKLPSGALVSFLQ

SEQ ID NO: 3380904 - protein, 23 aa, Plasmodium falciparum
EAQDLFDFIWKTHPDCTWNNKDI

SEQ ID NO: 3380905 - protein, 24 aa, Plasmodium falciparum
EAQMYQLSDCALPSPIRPSDHLPL

SEQ ID NO: 3380906 - protein, 25 aa, Plasmodium falciparum
EARFKDWFIQYLTGFFFINYDDANT

SEQ ID NO: 3380907 - protein, 24 aa, Plasmodium falciparum
EASKRIMDIFRTLNSNGLVSQESL

SEQ ID NO: 3380908 - protein, 17 aa, Plasmodium falciparum
EASLFLVDLIKQKKLAG

SEQ ID NO: 3380909 - protein, 29 aa, Plasmodium falciparum
EASSKIYKFTPLLPSYYFKVLKNKIDDIN

SEQ ID NO: 3380910 - protein, 26 aa, Plasmodium falciparum
EATVSWIEWFCQLKQNLFLVEVDEDF

SEQ ID NO: 3380911 - protein, 18 aa, Plasmodium falciparum
EAWRKEFYKDIFLQMKKN

SEQ ID NO: 3380912 - protein, 29 aa, Plasmodium falciparum
ECDKVYEDIAWTFVKYIENNNINLMEDFV

SEQ ID NO: 3380913 - protein, 23 aa, Plasmodium falciparum
ECDRLYKFVTSLSNFFCLEKNEE

SEQ ID NO: 3380914 - protein, 17 aa, Plasmodium falciparum
ECFNLPSFFSNISSDIK

SEQ ID NO: 3380915 - protein, 19 aa, Plasmodium falciparum
ECFVKNYRIYKADKMRNIL

SEQ ID NO: 3380916 - protein, 22 aa, Plasmodium falciparum
ECGTIFLRFVVNNKKEIFEKIG

SEQ ID NO: 3380917 - protein, 18 aa, Plasmodium falciparum
ECIIFLIGGGNYIEVSAL

SEQ ID NO: 3380918 - protein, 18 aa, Plasmodium falciparum
ECIKNKMYLININMVSPL

SEQ ID NO: 3380919 - protein, 23 aa, Plasmodium falciparum
ECINFVTYWEYLINISFNISQEK

SEQ ID NO: 3380920 - protein, 30 aa, Plasmodium falciparum
ECISRKHCLFLLEVLMKKINKPTSYDNKVK

SEQ ID NO: 3380921 - protein, 17 aa, Plasmodium falciparum
ECISSCIYLMFLNNINN

SEQ ID NO: 3380922 - protein, 31 aa, Plasmodium falciparum
ECKEELRLQWNEFTLFYLKNRKNLKKVFVLI

SEQ ID NO: 3380923 - protein, 25 aa, Plasmodium falciparum
ECKFRGFVLDFFPRNYEEAKYFFDN

SEQ ID NO: 3380924 - protein, 30 aa, Plasmodium falciparum
ECKKYDNDYTWLLEAKNNLKKCFYMCNSCS

SEQ ID NO: 3380925 - protein, 21 aa, Plasmodium falciparum
ECKNIYKYTKSNYPQMIIPQK

SEQ ID NO: 3380926 - protein, 17 aa, Plasmodium falciparum
ECKTKLICLLKEQRENK

SEQ ID NO: 3380927 - protein, 21 aa, Plasmodium falciparum
ECLRILYFRDATSSNFIQIVK

SEQ ID NO: 3380928 - protein, 24 aa, Plasmodium falciparum
ECMKDKFMLIIDPIAVGATTYRTN

SEQ ID NO: 3380929 - protein, 26 aa, Plasmodium falciparum
ECMNNIYNILFDNLFKKILNKEIKHR

SEQ ID NO: 3380930 - protein, 21 aa, Plasmodium falciparum
ECNICDNFALCKKCYKKNKHE

SEQ ID NO: 3380931 - protein, 40 aa, Plasmodium falciparum
ECPQCIINKKYIFKGIHTSSIGTNLFFKEPENHKNLTNDT

SEQ ID NO: 3380932 - protein, 17 aa, Plasmodium falciparum
ECPYCIKAISILKGYNL

SEQ ID NO: 3380933 - protein, 17 aa, Plasmodium falciparum
ECTKKYVGCLLPYEFVS

SEQ ID NO: 3380934 - protein, 25 aa, Plasmodium falciparum
ECTLESGIYCLLPSLYRANVTGNYQ

SEQ ID NO: 3380935 - protein, 28 aa, Plasmodium falciparum
ECTPRNKLLLEKLNKNIAYINALELSSN

SEQ ID NO: 3380936 - protein, 25 aa, Plasmodium falciparum
ECTTKEIFFLCNDLKVLGKSDLYNL

SEQ ID NO: 3380937 - protein, 21 aa, Plasmodium falciparum
ECVKTITYISTDPGLLVLAVN

SEQ ID NO: 3380938 - protein, 26 aa, Plasmodium falciparum
ECYEHYRSYLLYKYKTTYSVCDEAFK

SEQ ID NO: 3380939 - protein, 27 aa, Plasmodium falciparum
ECYNCACRNVFLLGFLPTSEEGVVVII

SEQ ID NO: 3380940 - protein, 17 aa, Plasmodium falciparum
EDAKLFRKGRMDGFESI

SEQ ID NO: 3380941 - protein, 32 aa, Plasmodium falciparum
EDCEYHALLLKVIRFLLMHIPKTKNPSKYIRY

SEQ ID NO: 3380942 - protein, 27 aa, Plasmodium falciparum
EDCIRSMKWDILIADKKKIIKKEKEKE

SEQ ID NO: 3380943 - protein, 32 aa, Plasmodium falciparum
EDDDNVFRFNYSSEFLLWALSSPNYVKNWHIG

SEQ ID NO: 3380944 - protein, 24 aa, Plasmodium falciparum
EDDKKVYFYSSSIDLEHGEIYKID

SEQ ID NO: 3380945 - protein, 25 aa, Plasmodium falciparum
EDDNKFLHLLSKAKGVFLIMDNCNN

SEQ ID NO: 3380946 - protein, 17 aa, Plasmodium falciparum
EDEAKTWTIVQKSDRKV

SEQ ID NO: 3380947 - protein, 22 aa, Plasmodium falciparum
EDEEFFKTFVSFNLYHNNNEKN

SEQ ID NO: 3380948 - protein, 34 aa, Plasmodium falciparum
EDEEIKQFIPVNLNPCFYPNEPNILLKLPHEEKK

SEQ ID NO: 3380949 - protein, 20 aa, Plasmodium falciparum
EDEFNYEWLIDSYLKSNKSN

SEQ ID NO: 3380950 - protein, 24 aa, Plasmodium falciparum
EDENDLYMLYLKNNYKNKKDQQKL

SEQ ID NO: 3380951 - protein, 24 aa, Plasmodium falciparum
EDFITSFNWFFSQEANFQNKDKSF

SEQ ID NO: 3380952 - protein, 20 aa, Plasmodium falciparum
EDFYFLYDHSFNIKGKGTIF

SEQ ID NO: 3380953 - protein, 28 aa, Plasmodium falciparum
EDGDVEWITPSFLFQEILKQSTNNTTYP

SEQ ID NO: 3380954 - protein, 25 aa, Plasmodium falciparum
EDGEYCIRPYDPSVYYHEKSCYKIC

SEQ ID NO: 3380955 - protein, 18 aa, Plasmodium falciparum
EDGFDVAYIFKSFNNYFV

SEQ ID NO: 3380956 - protein, 22 aa, Plasmodium falciparum
EDGFVSLLYDNGDTKDDLSLPK

SEQ ID NO: 3380957 - protein, 24 aa, Plasmodium falciparum
EDGINLYLNYYKKNFLKFQENNLY

SEQ ID NO: 3380958 - protein, 23 aa, Plasmodium falciparum
EDGNIYICSLLPQSNYKLIFLKH

SEQ ID NO: 3380959 - protein, 23 aa, Plasmodium falciparum
EDGNLLLNIFRKMKKKKFSSILN

SEQ ID NO: 3380960 - protein, 27 aa, Plasmodium falciparum
EDGVEWLLKSFLTGGAILADEMGLGKT

SEQ ID NO: 3380961 - protein, 27 aa, Plasmodium falciparum
EDGVLSYILAPLLLRPGDKIIASKYAN

SEQ ID NO: 3380962 - protein, 22 aa, Plasmodium falciparum
EDGYQIDVKFPLTDDIPCTVDE

SEQ ID NO: 3380963 - protein, 24 aa, Plasmodium falciparum
EDHKYKPILFTGDTLFIAGCGRFF

SEQ ID NO: 3380964 - protein, 18 aa, Plasmodium falciparum
EDHTLKILLKNNYVREVF

SEQ ID NO: 3380965 - protein, 17 aa, Plasmodium falciparum
EDICLLPRDILNDERYK

SEQ ID NO: 3380966 - protein, 28 aa, Plasmodium falciparum
EDIFYSPRIWFIFKMYGFKNVQILNGGL

SEQ ID NO: 3380967 - protein, 17 aa, Plasmodium falciparum
EDIIKLYHKDDNIIIDN

SEQ ID NO: 3380968 - protein, 23 aa, Plasmodium falciparum
EDIISFMRPFLRNKNPEIIFDGQ

SEQ ID NO: 3380969 - protein, 24 aa, Plasmodium falciparum
EDIISRLLCLVHNKNVKHKVLKIN

SEQ ID NO: 3380970 - protein, 25 aa, Plasmodium falciparum
EDIKAYLTVFFRKYDQIKGGVRLFD

SEQ ID NO: 3380971 - protein, 21 aa, Plasmodium falciparum
EDIKFVSWCPLSENTFISLSY

SEQ ID NO: 3380972 - protein, 31 aa, Plasmodium falciparum
EDIKILQSESEKLYLEKIKILTKNLDEKKNK

SEQ ID NO: 3380973 - protein, 22 aa, Plasmodium falciparum
EDIKLERYMILEKIKTTRDKNE

SEQ ID NO: 3380974 - protein, 23 aa, Plasmodium falciparum
EDIKNIWIEIISTKKEIINHNNI

SEQ ID NO: 3380975 - protein, 27 aa, Plasmodium falciparum
EDILKKLDYIYKYIKDTIYIINKAKKE

SEQ ID NO: 3380976 - protein, 17 aa, Plasmodium falciparum
EDILLLHKNKLLANIAN

SEQ ID NO: 3380977 - protein, 24 aa, Plasmodium falciparum
EDILNKYCFIRERKYNKPGGNKYI

SEQ ID NO: 3380978 - protein, 29 aa, Plasmodium falciparum
EDILQNEKFPFIFYDSNLRNLVIYYKDNY

SEQ ID NO: 3380979 - protein, 21 aa, Plasmodium falciparum
EDIMEIISSIKLLIEKRVRPI

SEQ ID NO: 3380980 - protein, 27 aa, Plasmodium falciparum
EDINEVEFLIKWIDKSHIHNFFCTYDY

SEQ ID NO: 3380981 - protein, 22 aa, Plasmodium falciparum
EDISKLVYKILYVNLDDFHLIK

SEQ ID NO: 3380982 - protein, 27 aa, Plasmodium falciparum
EDISLYKIKISVLPLIQIGKLLNKIIN

SEQ ID NO: 3380983 - protein, 23 aa, Plasmodium falciparum
EDITEDMILTLKDQNILNSDQED

SEQ ID NO: 3380984 - protein, 26 aa, Plasmodium falciparum
EDIYSVSMILLYEYLKGLQNVLNDGI

SEQ ID NO: 3380985 - protein, 22 aa, Plasmodium falciparum
EDKKMEYLSKIIPLFKDELNKE

SEQ ID NO: 3380986 - protein, 45 aa, Plasmodium falciparum
EDKLNISKMFDAYLLQSYLKVCDFKLFNLLSLSSLSVFDKFVHFN

SEQ ID NO: 3380987 - protein, 19 aa, Plasmodium falciparum
EDKLQIFREDELLIGGRKQ

SEQ ID NO: 3380988 - protein, 38 aa, Plasmodium falciparum
EDKNKRIIYIILCKKQIIYILEELYKNVYKNKIKDEKY

SEQ ID NO: 3380989 - protein, 26 aa, Plasmodium falciparum
EDKTKFFQFLLMLSNIKNLRGKYIKE

SEQ ID NO: 3380990 - protein, 24 aa, Plasmodium falciparum
EDKVGDWDLMFFKGCRTSKSNTIL

SEQ ID NO: 3380991 - protein, 26 aa, Plasmodium falciparum
EDKYKKLSIYILKYGCHTLPGEPDSK

SEQ ID NO: 3380992 - protein, 23 aa, Plasmodium falciparum
EDKYNRLLKFLIKSVKNNIKLKN

SEQ ID NO: 3380993 - protein, 20 aa, Plasmodium falciparum
EDLELLTELFYIDADEENYL

SEQ ID NO: 3380994 - protein, 26 aa, Plasmodium falciparum
EDLNSLYVLKLFKNINPYHVKLLNIE

SEQ ID NO: 3380995 - protein, 43 aa, Plasmodium falciparum
EDMTMWKKIFFFGQKKRTPEFLDFLLFYILKKENIHFFEEETR

SEQ ID NO: 3380996 - protein, 17 aa, Plasmodium falciparum
EDNIIEDILIPPKNDYY

SEQ ID NO: 3380997 - protein, 22 aa, Plasmodium falciparum
EDNIPVIMLLFNDNTKNAMINT

SEQ ID NO: 3380998 - protein, 27 aa, Plasmodium falciparum
EDNKKKKINPFLLLEQNVVQNKKKGLS

SEQ ID NO: 3380999 - protein, 31 aa, Plasmodium falciparum
EDNKKLWSWTNDGKLKLLCSQPIIPVSVVQG

SEQ ID NO: 3381000 - protein, 26 aa, Plasmodium falciparum
EDNKSYLYNMLYKTDAPLSIKSVFYI

SEQ ID NO: 3381001 - protein, 18 aa, Plasmodium falciparum
EDNKWDIIYQDLPNKTTN

SEQ ID NO: 3381002 - protein, 21 aa, Plasmodium falciparum
EDNMIIAGGHLKPLQFRNGAE

SEQ ID NO: 3381003 - protein, 26 aa, Plasmodium falciparum
EDNSRGIPWIINNKKKKLNKSNFIFL

SEQ ID NO: 3381004 - protein, 27 aa, Plasmodium falciparum
EDNTRTHNFIMFNIYNIEQKRQTHKVS

SEQ ID NO: 3381005 - protein, 22 aa, Plasmodium falciparum
EDNYFSFFNAKENNYSLKEAIN

SEQ ID NO: 3381006 - protein, 24 aa, Plasmodium falciparum
EDPCYVPKESGYFLHDNRFENNEK

SEQ ID NO: 3381007 - protein, 23 aa, Plasmodium falciparum
EDPLLWVDAPLIKIKEFERKFPE

SEQ ID NO: 3381008 - protein, 22 aa, Plasmodium falciparum
EDPLSEYYYRDSMSGHSNILSC

SEQ ID NO: 3381009 - protein, 43 aa, Plasmodium falciparum
EDQQEKYLFLKNMKKNIIFEIIKIAMFALLKVNLNDNNIYTLN

SEQ ID NO: 3381010 - protein, 22 aa, Plasmodium falciparum
EDRIICNEIILLKSRFSDPNTS

SEQ ID NO: 3381011 - protein, 44 aa, Plasmodium falciparum
EDRKDNFLYAPYNLLNVLKKKLTYIFWQLLGDIYKYRNVIVETC

SEQ ID NO: 3381012 - protein, 27 aa, Plasmodium falciparum
EDSEKNDMFLWLKNKDIENVLCEKRAT

SEQ ID NO: 3381013 - protein, 24 aa, Plasmodium falciparum
EDSNLYSFDMRYLKTAYLVHKGFV

SEQ ID NO: 3381014 - protein, 23 aa, Plasmodium falciparum
EDSSFIFKPTFNYLGKNNNNNNN

SEQ ID NO: 3381015 - protein, 45 aa, Plasmodium falciparum
EDSSLFLLNYIIPNYNYFYYLHCFLYLIYHYNYFQNIIKYNDNYS

SEQ ID NO: 3381016 - protein, 25 aa, Plasmodium falciparum
EDTAKYLYNLSLNSAFYDPKSRSMR

SEQ ID NO: 3381017 - protein, 24 aa, Plasmodium falciparum
EDTCGFIQVLLKSIYTRISDDQTH

SEQ ID NO: 3381018 - protein, 27 aa, Plasmodium falciparum
EDTDNFKLFLIIKIFNNISNKFKDIQK

SEQ ID NO: 3381019 - protein, 27 aa, Plasmodium falciparum
EDTDNYLHVFILNNGNIYGSGKKCSVS

SEQ ID NO: 3381020 - protein, 26 aa, Plasmodium falciparum
EDTGLPLIQLIYVSSTLPSVGPTTAG

SEQ ID NO: 3381021 - protein, 27 aa, Plasmodium falciparum
EDTSNVLSSLLSLNLLSPGGDKNIPFT

SEQ ID NO: 3381022 - protein, 33 aa, Plasmodium falciparum
EDVENPRIIILDMFKLCFIGNEKLHKDILFIIL

SEQ ID NO: 3381023 - protein, 21 aa, Plasmodium falciparum
EDVFQLLLNALLDEKSKMPLL

SEQ ID NO: 3381024 - protein, 26 aa, Plasmodium falciparum
EDVGIFKIMVPYNKYWFGLKLGQFES

SEQ ID NO: 3381025 - protein, 24 aa, Plasmodium falciparum
EDVKLKLYLPDRTIKEDGMIFLTS

SEQ ID NO: 3381026 - protein, 18 aa, Plasmodium falciparum
EDVNIPICGSSKSPLNIQ

SEQ ID NO: 3381027 - protein, 18 aa, Plasmodium falciparum
EDVQFLMDKIKKIDYDYI

SEQ ID NO: 3381028 - protein, 26 aa, Plasmodium falciparum
EDYCFKYVCLLLNNGGKREVRILRFN

SEQ ID NO: 3381029 - protein, 22 aa, Plasmodium falciparum
EDYFLILDILKSKYFYHDQNKV

SEQ ID NO: 3381030 - protein, 21 aa, Plasmodium falciparum
EDYFMSINNLKDIYSSNLWKQ

SEQ ID NO: 3381031 - protein, 17 aa, Plasmodium falciparum
EDYLLNSRLLVTVNSTG

SEQ ID NO: 3381032 - protein, 17 aa, Plasmodium falciparum
EDYWDKIYFKKKEYKNN

SEQ ID NO: 3381033 - protein, 33 aa, Plasmodium falciparum
EEAIHHLFTYMYIEQLYLLCPSNMLFKLSNVNQ

SEQ ID NO: 3381034 - protein, 20 aa, Plasmodium falciparum
EEAISYCPIATYAFYKNIKL

SEQ ID NO: 3381035 - protein, 24 aa, Plasmodium falciparum
EEAKKLLTLMGIPIIEAPCEAESQ

SEQ ID NO: 3381036 - protein, 25 aa, Plasmodium falciparum
EEAQLKCNILSMYEKNNLVVPSNII

SEQ ID NO: 3381037 - protein, 32 aa, Plasmodium falciparum
EEAYNQMMYDKNAYYKYYYDKNPYKNYKMDVS

SEQ ID NO: 3381038 - protein, 28 aa, Plasmodium falciparum
EECNQQIPRWFLNLVMKHTASARANRNY

SEQ ID NO: 3381039 - protein, 32 aa, Plasmodium falciparum
EEDESLFWSGRSKLYRWVEGEWKERGLGESKL

SEQ ID NO: 3381040 - protein, 24 aa, Plasmodium falciparum
EEDFLKSEYFKLILKLYMHEKENI

SEQ ID NO: 3381041 - protein, 22 aa, Plasmodium falciparum
EEDGHLSLLFSARLFRVHIHGK

SEQ ID NO: 3381042 - protein, 24 aa, Plasmodium falciparum
EEDHRYICKLSYTDKYKYLCNLKM

SEQ ID NO: 3381043 - protein, 28 aa, Plasmodium falciparum
EEDIFININMMYFFSLSLDEQIINLFRI

SEQ ID NO: 3381044 - protein, 35 aa, Plasmodium falciparum
EEDIKKLKRELYFLKKFVFFQYITNKYESKKRLQN

SEQ ID NO: 3381045 - protein, 17 aa, Plasmodium falciparum
EEDIWKLYKKDNYMKHC

SEQ ID NO: 3381046 - protein, 27 aa, Plasmodium falciparum
EEDLNCEWPYNITVDIIFSNVYKSKQE

SEQ ID NO: 3381047 - protein, 29 aa, Plasmodium falciparum
EEDMLINITIILDRIIEQLIIYYKEKDID

SEQ ID NO: 3381048 - protein, 24 aa, Plasmodium falciparum
EEDRVNCPFFWKIGACRHGDQCSR

SEQ ID NO: 3381049 - protein, 19 aa, Plasmodium falciparum
EEEDNNYEIQYKKKTLRDT

SEQ ID NO: 3381050 - protein, 32 aa, Plasmodium falciparum
EEEEKLLHLAKLFPTQWRTIAPIVGRTAQQCL

SEQ ID NO: 3381051 - protein, 20 aa, Plasmodium falciparum
EEEFERIRDIVEKHPYVAID

SEQ ID NO: 3381052 - protein, 26 aa, Plasmodium falciparum
EEEGFHYFNLLKKYDIRINIETYNSL

SEQ ID NO: 3381053 - protein, 24 aa, Plasmodium falciparum
EEEGSFIFICDDDDMLYTIGYNFL

SEQ ID NO: 3381054 - protein, 25 aa, Plasmodium falciparum
EEEHRHFFHFLNKNKSYNEDNKSYL

SEQ ID NO: 3381055 - protein, 24 aa, Plasmodium falciparum
EEEKFAYNILLNNQSDCLMKAQLL

SEQ ID NO: 3381056 - protein, 27 aa, Plasmodium falciparum
EEEKKNVPLPIKPLNIINVKANEEVNT

SEQ ID NO: 3381057 - protein, 24 aa, Plasmodium falciparum
EEEKNIWRKYLKDGSLDDKVISID

SEQ ID NO: 3381058 - protein, 26 aa, Plasmodium falciparum
EEEKRKIKIFVWNKLTLEILSEIKIK

SEQ ID NO: 3381059 - protein, 17 aa, Plasmodium falciparum
EEELCFEAMKYSYADYS

SEQ ID NO: 3381060 - protein, 23 aa, Plasmodium falciparum
EEELFLCFHHKLYALGKHYNSVI

SEQ ID NO: 3381061 - protein, 24 aa, Plasmodium falciparum
EEELQKKLLLLNKDDTYKKEEKKY

SEQ ID NO: 3381062 - protein, 17 aa, Plasmodium falciparum
EEENRTHFLENDPNKRD

SEQ ID NO: 3381063 - protein, 36 aa, Plasmodium falciparum
EEENYKYKYKVLSIIKHLLFFRTNEEKETLIETLEV

SEQ ID NO: 3381064 - protein, 23 aa, Plasmodium falciparum
EEENYYYCTPPNETIKNNTRGQR

SEQ ID NO: 3381065 - protein, 32 aa, Plasmodium falciparum
EEEVYDLFGKYGRIKYIDIKPSRSSSSSYAFV

SEQ ID NO: 3381066 - protein, 24 aa, Plasmodium falciparum
EEEVYYNLEGKKLFFELYMKEKDS

SEQ ID NO: 3381067 - protein, 19 aa, Plasmodium falciparum
EEEYKNMSVFKFKSLYSNY

SEQ ID NO: 3381068 - protein, 24 aa, Plasmodium falciparum
EEFHDDVFVMFQVLKKMIEETKDK

SEQ ID NO: 3381069 - protein, 18 aa, Plasmodium falciparum
EEFKILIRVLGQTINEKD

SEQ ID NO: 3381070 - protein, 27 aa, Plasmodium falciparum
EEFKLRKDFLNMYCDCLSIEITNHEKE

SEQ ID NO: 3381071 - protein, 17 aa, Plasmodium falciparum
EEFLKIFMNIYTQPISL

SEQ ID NO: 3381072 - protein, 19 aa, Plasmodium falciparum
EEFMSIVNKIPILKNFPNM

SEQ ID NO: 3381073 - protein, 22 aa, Plasmodium falciparum
EEFYSFMKYICDSDLFLTFVQL

SEQ ID NO: 3381074 - protein, 24 aa, Plasmodium falciparum
EEGISRLLVGRTFAYFPKYVDGKN

SEQ ID NO: 3381075 - protein, 26 aa, Plasmodium falciparum
EEGLQIAHDLLIDMPLYGTKEVLIMY

SEQ ID NO: 3381076 - protein, 29 aa, Plasmodium falciparum
EEGLTYFYFKLFLNNIGKFFYPELTERES

SEQ ID NO: 3381077 - protein, 27 aa, Plasmodium falciparum
EEGRFYELLQKLILFENLRLEKYNNNN

SEQ ID NO: 3381078 - protein, 22 aa, Plasmodium falciparum
EEHIKEWIPINKLYITNTYVNE

SEQ ID NO: 3381079 - protein, 23 aa, Plasmodium falciparum
EEHLSFIIEVLGNIPKHMIDAGY

SEQ ID NO: 3381080 - protein, 30 aa, Plasmodium falciparum
EEHNLKKLLKELVLLNTRKVQLKLKQHEYL

SEQ ID NO: 3381081 - protein, 30 aa, Plasmodium falciparum
EEHSDICPFLFCYLWLKSNDYKIDKWISSK

SEQ ID NO: 3381082 - protein, 26 aa, Plasmodium falciparum
EEIFADFGFEWFEKVNDICLNEFIKN

SEQ ID NO: 3381083 - protein, 22 aa, Plasmodium falciparum
EEIFKRKYLLPIDVTHENLKSR

SEQ ID NO: 3381084 - protein, 21 aa, Plasmodium falciparum
EEIIDYYLFSKPGKSLDEFVE

SEQ ID NO: 3381085 - protein, 34 aa, Plasmodium falciparum
EEIIHKYCLSIFKKINISTFFKDNEKRIFLMENY

SEQ ID NO: 3381086 - protein, 18 aa, Plasmodium falciparum
EEIIKAFKLFDDDDTGKI

SEQ ID NO: 3381087 - protein, 37 aa, Plasmodium falciparum
EEIIYLQHGVLSLCSFYPCINSYLLCLCSKDGNIVII

SEQ ID NO: 3381088 - protein, 18 aa, Plasmodium falciparum
EEIKLYLFQLVQSLRTFN

SEQ ID NO: 3381089 - protein, 24 aa, Plasmodium falciparum
EEILKNINLILKKQIDLNHSNEIE

SEQ ID NO: 3381090 - protein, 25 aa, Plasmodium falciparum
EEINKNIIFCPSKNAYRFIEDVNEN

SEQ ID NO: 3381091 - protein, 34 aa, Plasmodium falciparum
EEINYPLGNKLFFRLKISNIYYKCNEYDILDFFK

SEQ ID NO: 3381092 - protein, 26 aa, Plasmodium falciparum
EEITYNYSYNFLFNNFECLCKSPNCM

SEQ ID NO: 3381093 - protein, 22 aa, Plasmodium falciparum
EEIYIKTMYISEWKILVCLSSE

SEQ ID NO: 3381094 - protein, 26 aa, Plasmodium falciparum
EEIYKTLICILLLGNINFVESANDQE

SEQ ID NO: 3381095 - protein, 23 aa, Plasmodium falciparum
EEIYPNEYYFKPMLKTYQAEGVW

SEQ ID NO: 3381096 - protein, 34 aa, Plasmodium falciparum
EEKDFSLLYITYLLNMIYNKYKSIQPVYIYFICS

SEQ ID NO: 3381097 - protein, 17 aa, Plasmodium falciparum
EEKDIYFNIFGKEGKNW

SEQ ID NO: 3381098 - protein, 23 aa, Plasmodium falciparum
EEKEDLMYFYEKFHGDLNNILEF

SEQ ID NO: 3381099 - protein, 25 aa, Plasmodium falciparum
EEKEFLIPFLQSFNISLKKSDYLYN

SEQ ID NO: 3381100 - protein, 19 aa, Plasmodium falciparum
EEKEKLHKAFRQHEFRILF

SEQ ID NO: 3381101 - protein, 25 aa, Plasmodium falciparum
EEKINILNFMKNDFEIVLQKENEKH

SEQ ID NO: 3381102 - protein, 29 aa, Plasmodium falciparum
EEKKEKLKLIKLITEKLASPLKATSDNKN

SEQ ID NO: 3381103 - protein, 28 aa, Plasmodium falciparum
EEKKENIFSKFFSYIKKKSICNEKKDHN

SEQ ID NO: 3381104 - protein, 25 aa, Plasmodium falciparum
EEKKEYFIICIYSFIIQLYDYINCT

SEQ ID NO: 3381105 - protein, 33 aa, Plasmodium falciparum
EEKKIIKKDLLNSKILKFGKYLNYNNIITKDDS

SEQ ID NO: 3381106 - protein, 24 aa, Plasmodium falciparum
EEKKKKNIFMTKISHMNHYDIFYQ

SEQ ID NO: 3381107 - protein, 18 aa, Plasmodium falciparum
EEKKLIERIKLKKNILRK

SEQ ID NO: 3381108 - protein, 24 aa, Plasmodium falciparum
EEKKNNFIDYLYDDKFDNKEHFLK

SEQ ID NO: 3381109 - protein, 23 aa, Plasmodium falciparum
EEKLDYVLGLTLPKLLERRLQTK

SEQ ID NO: 3381110 - protein, 20 aa, Plasmodium falciparum
EEKLHEWLEYELTNQTNIIS

SEQ ID NO: 3381111 - protein, 24 aa, Plasmodium falciparum
EEKLITVYFTPTIPNCSLATLIGL

SEQ ID NO: 3381112 - protein, 26 aa, Plasmodium falciparum
EEKLKDLWFMPGIIYKKVKKAIKYKK

SEQ ID NO: 3381113 - protein, 32 aa, Plasmodium falciparum
EEKLPTGVYFYQGSYVANWWETNQKKQFKVPF

SEQ ID NO: 3381114 - protein, 20 aa, Plasmodium falciparum
EEKNFLKRTGLIYGSQEVYK

SEQ ID NO: 3381115 - protein, 26 aa, Plasmodium falciparum
EEKNNLFIWSVGKNLCFFKSDAYNIL

SEQ ID NO: 3381116 - protein, 23 aa, Plasmodium falciparum
EEKQKLNRPPTDPFKEKKEDQVS

SEQ ID NO: 3381117 - protein, 42 aa, Plasmodium falciparum
EEKRINVLYFINRFLYSNKTPLSYLFRNYKTTLLNQQINVNQ

SEQ ID NO: 3381118 - protein, 26 aa, Plasmodium falciparum
EEKSEEFFYFFNHFCFYIINETNKYA

SEQ ID NO: 3381119 - protein, 22 aa, Plasmodium falciparum
EEKTYIISYINNKSNIIFNSNI

SEQ ID NO: 3381120 - protein, 25 aa, Plasmodium falciparum
EEKVLYKFIENKILLKEFCDNYVSI

SEQ ID NO: 3381121 - protein, 21 aa, Plasmodium falciparum
EEKYILAFNTYMYDVQKEIGV

SEQ ID NO: 3381122 - protein, 23 aa, Plasmodium falciparum
EEKYNFLKNLIRNNKNMVKLKYL

SEQ ID NO: 3381123 - protein, 22 aa, Plasmodium falciparum
EEKYNIIPRDLADNWYNIENEE

SEQ ID NO: 3381124 - protein, 24 aa, Plasmodium falciparum
EELEDILLLTIKKYNKFLFDKENR

SEQ ID NO: 3381125 - protein, 23 aa, Plasmodium falciparum
EELEYFLDFDKRYFGEQYFSLLN

SEQ ID NO: 3381126 - protein, 26 aa, Plasmodium falciparum
EELKKLKKILLNLDVLIDVSKIVIQK

SEQ ID NO: 3381127 - protein, 27 aa, Plasmodium falciparum
EELKSFSILYAWSFSTRIQNFVFTNND

SEQ ID NO: 3381128 - protein, 24 aa, Plasmodium falciparum
EELKYNFFMIYAIGTNIIKENILD

SEQ ID NO: 3381129 - protein, 17 aa, Plasmodium falciparum
EELKYYLDNLNKKNKDT

SEQ ID NO: 3381130 - protein, 24 aa, Plasmodium falciparum
EELLKEPFFCCRLGYLYNKEHAFQ

SEQ ID NO: 3381131 - protein, 17 aa, Plasmodium falciparum
EELSDHLDKMKTYFDEK

SEQ ID NO: 3381132 - protein, 24 aa, Plasmodium falciparum
EELSKILKFGAQKLWEKNSSKYSP

SEQ ID NO: 3381133 - protein, 23 aa, Plasmodium falciparum
EELSMFLQKLICDIGYSMTTTKS

SEQ ID NO: 3381134 - protein, 40 aa, Plasmodium falciparum
EELTEKLVQLHIPPKFNEKLHAHILKHTLKKYACNKNVER

SEQ ID NO: 3381135 - protein, 18 aa, Plasmodium falciparum
EEMFVPIPSELLKNQKYE

SEQ ID NO: 3381136 - protein, 25 aa, Plasmodium falciparum
EEMINKFFRCIGIWNDRNVYSKIVC

SEQ ID NO: 3381137 - protein, 17 aa, Plasmodium falciparum
EENDIQEKLIYLTDKEL

SEQ ID NO: 3381138 - protein, 27 aa, Plasmodium falciparum
EENDNNIWIFKNIIVKIIDKTHKYYNH

SEQ ID NO: 3381139 - protein, 25 aa, Plasmodium falciparum
EENEETFIYIIRISAYLYRDDLQCI

SEQ ID NO: 3381140 - protein, 22 aa, Plasmodium falciparum
EENENIYFYVGNKKKIVFDIKK

SEQ ID NO: 3381141 - protein, 18 aa, Plasmodium falciparum
EENIFPSANLYKKEMNVK

SEQ ID NO: 3381142 - protein, 24 aa, Plasmodium falciparum
EENKEIFIFLHQIVGWDSVDDESI

SEQ ID NO: 3381143 - protein, 26 aa, Plasmodium falciparum
EENKYLRLENNCAIFLIYLNDDKQED

SEQ ID NO: 3381144 - protein, 24 aa, Plasmodium falciparum
EENLKEKLINLNIQKQYSGFHMKE

SEQ ID NO: 3381145 - protein, 22 aa, Plasmodium falciparum
EENLSFFEKLYKSQSIVKYEEQ

SEQ ID NO: 3381146 - protein, 42 aa, Plasmodium falciparum
EENMKKILNIPFYLLTIYMIDEFMEFLRIYDIKTIICDFNPL

SEQ ID NO: 3381147 - protein, 28 aa, Plasmodium falciparum
EENQNYGLIYYSLKYLFDLQNISKDTDI

SEQ ID NO: 3381148 - protein, 23 aa, Plasmodium falciparum
EENRLYIQNLPHDLKDEQIKDLL

SEQ ID NO: 3381149 - protein, 23 aa, Plasmodium falciparum
EENRSLIYLRMKNNILFPKYKQT

SEQ ID NO: 3381150 - protein, 35 aa, Plasmodium falciparum
EENVFQEFNEFMRKKMWMEKYLHNQINCYDVLLEI

SEQ ID NO: 3381151 - protein, 30 aa, Plasmodium falciparum
EEPKIITDLILKEPFCMLVSLIDHQEGIGV

SEQ ID NO: 3381152 - protein, 24 aa, Plasmodium falciparum
EEQHLLEQALIKYPTSIPIKERLK

SEQ ID NO: 3381153 - protein, 22 aa, Plasmodium falciparum
EEQIILRFTFILNDVLIDIEGN

SEQ ID NO: 3381154 - protein, 23 aa, Plasmodium falciparum
EEQKYFVTPSFLPGQNELYINTD

SEQ ID NO: 3381155 - protein, 29 aa, Plasmodium falciparum
EEQMLEPELPFFYVKKYNKRFSLLDAQKL

SEQ ID NO: 3381156 - protein, 24 aa, Plasmodium falciparum
EEQRIKYVYPNCYHYTYFGFENKF

SEQ ID NO: 3381157 - protein, 37 aa, Plasmodium falciparum
EEQWICPLCSYLRSQIFFIDDVNAFKIIRRLCCPRKK

SEQ ID NO: 3381158 - protein, 25 aa, Plasmodium falciparum
EERDKAYIPLINSLDKYLPIHDNYI

SEQ ID NO: 3381159 - protein, 24 aa, Plasmodium falciparum
EERKIIFQKFQQGHIWYLICTDIL

SEQ ID NO: 3381160 - protein, 21 aa, Plasmodium falciparum
EERKILLNCYFIVRIDGCDFK

SEQ ID NO: 3381161 - protein, 19 aa, Plasmodium falciparum
EERKIYLAKKYLKDMGIES

SEQ ID NO: 3381162 - protein, 24 aa, Plasmodium falciparum
EERNKFFYTYLNANQYKIISDMTE

SEQ ID NO: 3381163 - protein, 27 aa, Plasmodium falciparum
EERNLCFPLLDLYFLNKNFKWQNLKES

SEQ ID NO: 3381164 - protein, 22 aa, Plasmodium falciparum
EERNYFLDHQKFKLPNLKHHHK

SEQ ID NO: 3381165 - protein, 27 aa, Plasmodium falciparum
EESISYFFNVIWFTTLVSKFKNVKLIK

SEQ ID NO: 3381166 - protein, 24 aa, Plasmodium falciparum
EESKKAIYYLNKKNYFYLFITNND

SEQ ID NO: 3381167 - protein, 27 aa, Plasmodium falciparum
EESLNLKSLFFNDLYLFDMNKEHWSYL

SEQ ID NO: 3381168 - protein, 27 aa, Plasmodium falciparum
EESQYNLFNFYNPALHIFPIDLTNMNY

SEQ ID NO: 3381169 - protein, 24 aa, Plasmodium falciparum
EESSPWFIFTFHTQQINCLKNKND

SEQ ID NO: 3381170 - protein, 24 aa, Plasmodium falciparum
EETFYIFNMYILKNVNKLICENIY

SEQ ID NO: 3381171 - protein, 31 aa, Plasmodium falciparum
EETLHENLINLRFYILRLNGGKVSQKKITEY

SEQ ID NO: 3381172 - protein, 23 aa, Plasmodium falciparum
EETLKILSNIKKYYNEKKKESSD

SEQ ID NO: 3381173 - protein, 30 aa, Plasmodium falciparum
EETNVRNIYSLWFYSTEEKEQIYKVLKNIV

SEQ ID NO: 3381174 - protein, 28 aa, Plasmodium falciparum
EEVKLQFWAIKMLISVPLATKIYAHFLN

SEQ ID NO: 3381175 - protein, 25 aa, Plasmodium falciparum
EEVQVPIFLWVIFGGKDMKSMDSLN

SEQ ID NO: 3381176 - protein, 31 aa, Plasmodium falciparum
EEVSNILFLRTILIMSLMEFLFDKPKSILAK

SEQ ID NO: 3381177 - protein, 35 aa, Plasmodium falciparum
EEVYSEWKICPNFIFRILFIAKSRANNFIYPVASS

SEQ ID NO: 3381178 - protein, 18 aa, Plasmodium falciparum
EEWESIPTVLQYSSKQKQ

SEQ ID NO: 3381179 - protein, 20 aa, Plasmodium falciparum
EEYGKICQLYQEKKQKKEKK

SEQ ID NO: 3381180 - protein, 17 aa, Plasmodium falciparum
EEYIIQLEELRDTGENC

SEQ ID NO: 3381181 - protein, 30 aa, Plasmodium falciparum
EEYLYPKKKLSKISFSSTLFPLSKRIRYKS

SEQ ID NO: 3381182 - protein, 51 aa, Plasmodium falciparum
EEYNRLNIFARFSLKNYYLFDINKNLCSIYAFTPMIIKKFAEKINSYNLTK

SEQ ID NO: 3381183 - protein, 24 aa, Plasmodium falciparum
EEYTKKKIYIGLKTRSKIIKGTKK

SEQ ID NO: 3381184 - protein, 24 aa, Plasmodium falciparum
EFAESLLVIPKILALNASYDSIDL

SEQ ID NO: 3381185 - protein, 21 aa, Plasmodium falciparum
EFALRYQQFPCIYNCVTINWF

SEQ ID NO: 3381186 - protein, 27 aa, Plasmodium falciparum
EFDEVIKLIFILYEKKIHTLNEKSKIC

SEQ ID NO: 3381187 - protein, 72 aa, Plasmodium falciparum
EFDKNKERISVISPVILLLIFKNMNIINLYKIFISCLKCDNYRWLRIIKKSLFIKFFDGTLFDTKIKITDGS

SEQ ID NO: 3381188 - protein, 23 aa, Plasmodium falciparum
EFDKYFVFSFINANMKKINVHKL

SEQ ID NO: 3381189 - protein, 24 aa, Plasmodium falciparum
EFDRELYFLLKQLDTDGNGLIDYT

SEQ ID NO: 3381190 - protein, 34 aa, Plasmodium falciparum
EFEDMNFMNSYFINIRNFFKNYFVKSYKNSHYKR

SEQ ID NO: 3381191 - protein, 24 aa, Plasmodium falciparum
EFEELNCELLHLGFSALPNLPKKK

SEQ ID NO: 3381192 - protein, 19 aa, Plasmodium falciparum
EFEKHVFNILKNKKLMGKK

SEQ ID NO: 3381193 - protein, 22 aa, Plasmodium falciparum
EFEQYMHRIGRTGRIGKGGMAI

SEQ ID NO: 3381194 - protein, 22 aa, Plasmodium falciparum
EFESFLITLKIFPKKIIKINYS

SEQ ID NO: 3381195 - protein, 23 aa, Plasmodium falciparum
EFFFSVINYTFLFKNNFHCSINN

SEQ ID NO: 3381196 - protein, 20 aa, Plasmodium falciparum
EFFNESVVLYFYLKEKSKLT

SEQ ID NO: 3381197 - protein, 21 aa, Plasmodium falciparum
EFFNYYHISLPILIQQYKLNK

SEQ ID NO: 3381198 - protein, 22 aa, Plasmodium falciparum
EFHRPLLCSYIKKWYELENNDD

SEQ ID NO: 3381199 - protein, 17 aa, Plasmodium falciparum
EFIELFEKMEKQLDMLP

SEQ ID NO: 3381200 - protein, 32 aa, Plasmodium falciparum
EFIHENNYAFLVFKKKLIGLIKHYLFICQDNV

SEQ ID NO: 3381201 - protein, 26 aa, Plasmodium falciparum
EFIKFNEEFKKAISWIYKTISNSRDK

SEQ ID NO: 3381202 - protein, 17 aa, Plasmodium falciparum
EFIKMKGNMEDLIKLNY

SEQ ID NO: 3381203 - protein, 24 aa, Plasmodium falciparum
EFIKRFKKMIIPNFRLEKIRKQRN

SEQ ID NO: 3381204 - protein, 20 aa, Plasmodium falciparum
EFKEQLYFYLNKKDENKMIK

SEQ ID NO: 3381205 - protein, 24 aa, Plasmodium falciparum
EFKIYDCKHVLKKSIKVLNKYAKK

SEQ ID NO: 3381206 - protein, 18 aa, Plasmodium falciparum
EFKKLENLYESNIIFEYD

SEQ ID NO: 3381207 - protein, 25 aa, Plasmodium falciparum
EFKNEYKYYLFLHKTAKNNAEDLYE

SEQ ID NO: 3381208 - protein, 26 aa, Plasmodium falciparum
EFKNLDIFMNIHLPFEHLSLPLCDEK

SEQ ID NO: 3381209 - protein, 23 aa, Plasmodium falciparum
EFKSFYMIFNYYTTSKNVQTLMQ

SEQ ID NO: 3381210 - protein, 29 aa, Plasmodium falciparum
EFKTHTKIKEFFILFNMNNQKDVQNKNCV

SEQ ID NO: 3381211 - protein, 19 aa, Plasmodium falciparum
EFLLLSDIFMIKQNNLFLL

SEQ ID NO: 3381212 - protein, 30 aa, Plasmodium falciparum
EFLSDMFNFLYRDKVLILQKNRNSIKIFKY

SEQ ID NO: 3381213 - protein, 17 aa, Plasmodium falciparum
EFNFLEIVLITNALCKE

SEQ ID NO: 3381214 - protein, 17 aa, Plasmodium falciparum
EFNLNYSIPIIKKKIIP

SEQ ID NO: 3381215 - protein, 25 aa, Plasmodium falciparum
EFQVELYWYHSPKTCLNFYTLCTMG

SEQ ID NO: 3381216 - protein, 32 aa, Plasmodium falciparum
EFRNLRRILICGLRCPYPLVLRSNVIVMSMIG

SEQ ID NO: 3381217 - protein, 25 aa, Plasmodium falciparum
EFSRNLIPYFYHSTLYTINILLDYW

SEQ ID NO: 3381218 - protein, 45 aa, Plasmodium falciparum
EFTNLISYKKYKFLKTNHFVFKNLPLTVRGIPPMLIPLYDSEDNT

SEQ ID NO: 3381219 - protein, 24 aa, Plasmodium falciparum
EFVKKFFIKNLFYINSFGNNGELC

SEQ ID NO: 3381220 - protein, 25 aa, Plasmodium falciparum
EFVKRPQFLRWFTEWAEEFCNERKE

SEQ ID NO: 3381221 - protein, 27 aa, Plasmodium falciparum
EFVSPDFITLFYTDIGIFPPSNISYEL

SEQ ID NO: 3381222 - protein, 27 aa, Plasmodium falciparum
EFYTDVLFRIYVINVPSFFKKVWCLFN

SEQ ID NO: 3381223 - protein, 18 aa, Plasmodium falciparum
EFYYKNYNPKKVKVFFFS

SEQ ID NO: 3381224 - protein, 18 aa, Plasmodium falciparum
EGAYSFVYMAKDLNTNRA

SEQ ID NO: 3381225 - protein, 20 aa, Plasmodium falciparum
EGCIDYIFYKELIPISTETI

SEQ ID NO: 3381226 - protein, 25 aa, Plasmodium falciparum
EGDILFIPSLWLHYVYNMPPHTYMK

SEQ ID NO: 3381227 - protein, 26 aa, Plasmodium falciparum
EGEEGNLHLYPMYSDSEVGFENISHI

SEQ ID NO: 3381228 - protein, 20 aa, Plasmodium falciparum
EGEIFLFKYSIALCKTLEKE

SEQ ID NO: 3381229 - protein, 18 aa, Plasmodium falciparum
EGFILYKGGYWQVDSFYL

SEQ ID NO: 3381230 - protein, 24 aa, Plasmodium falciparum
EGFKWIPFLIKEWKIKYMYCNDEE

SEQ ID NO: 3381231 - protein, 26 aa, Plasmodium falciparum
EGGKWGFFTHLFKWGHIIIPKELEIK

SEQ ID NO: 3381232 - protein, 24 aa, Plasmodium falciparum
EGGYTIWECTWDMLKFFHKEGFDF

SEQ ID NO: 3381233 - protein, 26 aa, Plasmodium falciparum
EGIADLIMVLVKLTQTFMLKNIQYHD

SEQ ID NO: 3381234 - protein, 28 aa, Plasmodium falciparum
EGIMKKNYFNCIFYNVGFLDINVDVMNP

SEQ ID NO: 3381235 - protein, 25 aa, Plasmodium falciparum
EGIYILGEILTICQIVEFVDSEDIE

SEQ ID NO: 3381236 - protein, 34 aa, Plasmodium falciparum
EGIYMKTHKLLIRLLFRYASYSYINPKYFKVFSL

SEQ ID NO: 3381237 - protein, 34 aa, Plasmodium falciparum
EGKEKNDIPIYMPNLSLLGNMNKKIFFGNINISG

SEQ ID NO: 3381238 - protein, 23 aa, Plasmodium falciparum
EGKKSLIKFLFSKKASLSSISKK

SEQ ID NO: 3381239 - protein, 22 aa, Plasmodium falciparum
EGKNLIQGLFNKYIKKVMNAKK

SEQ ID NO: 3381240 - protein, 31 aa, Plasmodium falciparum
EGKNNYFLFNNNKDGLRRSSLFNLKSKSCHN

SEQ ID NO: 3381241 - protein, 33 aa, Plasmodium falciparum
EGKQIKRRFKIKYYGWDEAKSLAIKARFAFENK

SEQ ID NO: 3381242 - protein, 29 aa, Plasmodium falciparum
EGKRSKFPRFYFVSNLVLLKILSQGSDIN

SEQ ID NO: 3381243 - protein, 28 aa, Plasmodium falciparum
EGKTYLQELKFLIDNTLLYTHRKGILDN

SEQ ID NO: 3381244 - protein, 19 aa, Plasmodium falciparum
EGKYFLLPIRCMNDQIILN

SEQ ID NO: 3381245 - protein, 28 aa, Plasmodium falciparum
EGLATVEFPFWFYIDNLKHIYKKEFDDI

SEQ ID NO: 3381246 - protein, 18 aa, Plasmodium falciparum
EGLFGALEYLKTKGELNM

SEQ ID NO: 3381247 - protein, 23 aa, Plasmodium falciparum
EGLIMKIIESLEEKFKFLLGDSN

SEQ ID NO: 3381248 - protein, 29 aa, Plasmodium falciparum
EGLNKIVKINIPYFKNVLIHSFECEFCNY

SEQ ID NO: 3381249 - protein, 24 aa, Plasmodium falciparum
EGLSIKMEILHKRNYTYKKKYKSR

SEQ ID NO: 3381250 - protein, 19 aa, Plasmodium falciparum
EGLVKFYRYVIAKIEVMAL

SEQ ID NO: 3381251 - protein, 23 aa, Plasmodium falciparum
EGMPTYKDPFKKGNLYITFEVEY

SEQ ID NO: 3381252 - protein, 28 aa, Plasmodium falciparum
EGNLHLEALCMFLNTVGEILDTHEKANQ

SEQ ID NO: 3381253 - protein, 24 aa, Plasmodium falciparum
EGNNFIRCYVSCIYVTESDGTRNM

SEQ ID NO: 3381254 - protein, 24 aa, Plasmodium falciparum
EGQKKICYIYRLFCTGTIDEKVYQ

SEQ ID NO: 3381255 - protein, 26 aa, Plasmodium falciparum
EGQNGVPFSFFTKSFNIPANHIKGIL

SEQ ID NO: 3381256 - protein, 26 aa, Plasmodium falciparum
EGQTPIFYAIIYKHYDIVKLLIENGA

SEQ ID NO: 3381257 - protein, 20 aa, Plasmodium falciparum
EGRLFQVEYALGAIKLGSTA

SEQ ID NO: 3381258 - protein, 23 aa, Plasmodium falciparum
EGSIIRTLRRLDELIRQMICAFR

SEQ ID NO: 3381259 - protein, 17 aa, Plasmodium falciparum
EGSLSHSNRLRESIKFE

SEQ ID NO: 3381260 - protein, 23 aa, Plasmodium falciparum
EGSNLFLHLLNERVYRLNIKELR

SEQ ID NO: 3381261 - protein, 17 aa, Plasmodium falciparum
EGSYINQSLLALANCIN

SEQ ID NO: 3381262 - protein, 23 aa, Plasmodium falciparum
EGTEYQFLRWFAEWGEDFCKHKE

SEQ ID NO: 3381263 - protein, 29 aa, Plasmodium falciparum
EGTKRNFNLYLYKLKTKNDKLRYYEINNC

SEQ ID NO: 3381264 - protein, 27 aa, Plasmodium falciparum
EGVLRNRIYFIFWSPDLAKSKEKMLYA

SEQ ID NO: 3381265 - protein, 18 aa, Plasmodium falciparum
EGYAPDGVWLGGTKYQFI

SEQ ID NO: 3381266 - protein, 31 aa, Plasmodium falciparum
EGYLAGKEYIKTLLEKKQKKTFFFLNEIFKS

SEQ ID NO: 3381267 - protein, 18 aa, Plasmodium falciparum
EGYMILNFLNFNKELIYY

SEQ ID NO: 3381268 - protein, 30 aa, Plasmodium falciparum
EHCYFYNCIYCNFDFQKCLDMIKKNSLKEG

SEQ ID NO: 3381269 - protein, 24 aa, Plasmodium falciparum
EHDMDIYMLYIHKNEIKIIDHNNM

SEQ ID NO: 3381270 - protein, 17 aa, Plasmodium falciparum
EHDPFYPIYMSCQYFHI

SEQ ID NO: 3381271 - protein, 22 aa, Plasmodium falciparum
EHELKYTFGVYKTTICKHWKKN

SEQ ID NO: 3381272 - protein, 29 aa, Plasmodium falciparum
EHFILLINLYCRVNIFPRVLFTEIFHGII

SEQ ID NO: 3381273 - protein, 19 aa, Plasmodium falciparum
EHFKILFIDKYGDIYIYKP

SEQ ID NO: 3381274 - protein, 27 aa, Plasmodium falciparum
EHHNKHMNMLLQIKKILNINEDEDVIK

SEQ ID NO: 3381275 - protein, 21 aa, Plasmodium falciparum
EHIFFLMNIINTFNSIHNMYL

SEQ ID NO: 3381276 - protein, 25 aa, Plasmodium falciparum
EHIKHFPFILAYDKNHFLIEHLENL

SEQ ID NO: 3381277 - protein, 26 aa, Plasmodium falciparum
EHILSQLKEPKRKGRKRKIWIQPLDN

SEQ ID NO: 3381278 - protein, 24 aa, Plasmodium falciparum
EHINKKQRLKKNKILLICNTNLGV

SEQ ID NO: 3381279 - protein, 24 aa, Plasmodium falciparum
EHKDLYLFSLLFKETKFSLILTKS

SEQ ID NO: 3381280 - protein, 32 aa, Plasmodium falciparum
EHLINSKVFCYEYFIFDIFKYARNILSLEVNR

SEQ ID NO: 3381281 - protein, 33 aa, Plasmodium falciparum
EHLNYIQINLLNTFIRPTPIRGLLAATQERFVV

SEQ ID NO: 3381282 - protein, 17 aa, Plasmodium falciparum
EHLSEEFVYLIINSIIE

SEQ ID NO: 3381283 - protein, 19 aa, Plasmodium falciparum
EHNILILSKKKSMYSHYVD

SEQ ID NO: 3381284 - protein, 17 aa, Plasmodium falciparum
EHNILLKSLLDKNTNKK

SEQ ID NO: 3381285 - protein, 18 aa, Plasmodium falciparum
EHNLWLLDPDNLIEKFNL

SEQ ID NO: 3381286 - protein, 19 aa, Plasmodium falciparum
EHQSIFSNDYERVFVDSKS

SEQ ID NO: 3381287 - protein, 19 aa, Plasmodium falciparum
EHSHSISYISSLENSPDKL

SEQ ID NO: 3381288 - protein, 24 aa, Plasmodium falciparum
EHSNHTVNRFAPMGQYANSKNNNM

SEQ ID NO: 3381289 - protein, 25 aa, Plasmodium falciparum
EHTKIYKQIYTLWKEDIDISEKENE

SEQ ID NO: 3381290 - protein, 19 aa, Plasmodium falciparum
EHTLLARTLGINQLIVAIN

SEQ ID NO: 3381291 - protein, 21 aa, Plasmodium falciparum
EHTYMYIRMLKCPSLYGVIIN

SEQ ID NO: 3381292 - protein, 48 aa, Plasmodium falciparum
EHVGRTNFLYFLNHIGKMVFPIFKNLYNVMSSFFKILSTYIISSTTTS

SEQ ID NO: 3381293 - protein, 23 aa, Plasmodium falciparum
EHVYIIYRKVHLKKKLINIINEI

SEQ ID NO: 3381294 - protein, 31 aa, Plasmodium falciparum
EHYKKKDILLSLWWKNLIDLYSDIIITNLCN

SEQ ID NO: 3381295 - protein, 18 aa, Plasmodium falciparum
EHYNFFELSKYDIISHFK

SEQ ID NO: 3381296 - protein, 30 aa, Plasmodium falciparum
EHYNNKYNWLYHRTALFEPMDISYAERRHV

SEQ ID NO: 3381297 - protein, 18 aa, Plasmodium falciparum
EIAFAVFFCPLISKLHHS

SEQ ID NO: 3381298 - protein, 28 aa, Plasmodium falciparum
EIAKDSHYVLLLFSILQNSYSRNKVLIV

SEQ ID NO: 3381299 - protein, 26 aa, Plasmodium falciparum
EIAREILYLGIYIRKIQKFIEINKRS

SEQ ID NO: 3381300 - protein, 27 aa, Plasmodium falciparum
EIAVKCLHIYKGFPLIKVSYRMQDMFK

SEQ ID NO: 3381301 - protein, 26 aa, Plasmodium falciparum
EIAYIVLLHTNLLLHEANKLNYKIFD

SEQ ID NO: 3381302 - protein, 22 aa, Plasmodium falciparum
EICSQELLLYEKEITYLKEEIE

SEQ ID NO: 3381303 - protein, 27 aa, Plasmodium falciparum
EICVFDFYAYVLKYMYAKEIMGEWFLC

SEQ ID NO: 3381304 - protein, 24 aa, Plasmodium falciparum
EIDDKGTYSIYVGSLPINTTKEEI

SEQ ID NO: 3381305 - protein, 17 aa, Plasmodium falciparum
EIDLEGVLLVIFANKQD

SEQ ID NO: 3381306 - protein, 48 aa, Plasmodium falciparum
EIDLKHLKYIWLMIKYWYTTFDFIKNVNIFYLYDILNELIIMINEYKK

SEQ ID NO: 3381307 - protein, 22 aa, Plasmodium falciparum
EIDLWDMRFTNKSLHRIISQKE

SEQ ID NO: 3381308 - protein, 27 aa, Plasmodium falciparum
EIDPNLQRLPLRFPVIEKRKAKSTILK

SEQ ID NO: 3381309 - protein, 22 aa, Plasmodium falciparum
EIDPRKDWLKRILLNNNTNDLR

SEQ ID NO: 3381310 - protein, 26 aa, Plasmodium falciparum
EIDQLFKILCLLGLPDKESYPEFYEY

SEQ ID NO: 3381311 - protein, 21 aa, Plasmodium falciparum
EIEFYLSCLNLHHNKGNDKKK

SEQ ID NO: 3381312 - protein, 24 aa, Plasmodium falciparum
EIEKATQRLFLKLKNEKIKEDILR

SEQ ID NO: 3381313 - protein, 30 aa, Plasmodium falciparum
EIEKIAEVPSFLFIWCGVTHLEDARVLLNK

SEQ ID NO: 3381314 - protein, 19 aa, Plasmodium falciparum
EIEKWISERKKNYPTRNKI

SEQ ID NO: 3381315 - protein, 24 aa, Plasmodium falciparum
EIELNQKIYPIKAISNLRGHSINK

SEQ ID NO: 3381316 - protein, 19 aa, Plasmodium falciparum
EIEMYKSLLKSRDSEINTL

SEQ ID NO: 3381317 - protein, 27 aa, Plasmodium falciparum
EIENLFCNIYNSICFVKMIKNTQKSPH

SEQ ID NO: 3381318 - protein, 23 aa, Plasmodium falciparum
EIFDFIKKIKLLQYSWKLYEQDL

SEQ ID NO: 3381319 - protein, 18 aa, Plasmodium falciparum
EIFGKYYTSYKNFFKLIK

SEQ ID NO: 3381320 - protein, 46 aa, Plasmodium falciparum
EIFKDIHIKKAIILRLILMHFLQKGDFFMYYVLNKEILKNKKKKKK

SEQ ID NO: 3381321 - protein, 18 aa, Plasmodium falciparum
EIFKDSVLLIPPLNFSYT

SEQ ID NO: 3381322 - protein, 31 aa, Plasmodium falciparum
EIFKRNYNRPLMPLLVKKKKKNFLSHKNRKD

SEQ ID NO: 3381323 - protein, 24 aa, Plasmodium falciparum
EIFNTFIQSLLWAIKHEHPSVADH

SEQ ID NO: 3381324 - protein, 19 aa, Plasmodium falciparum
EIFRNFFFTNKVTIYLYNW

SEQ ID NO: 3381325 - protein, 17 aa, Plasmodium falciparum
EIFVLLILRINQFSQNV

SEQ ID NO: 3381326 - protein, 29 aa, Plasmodium falciparum
EIGISLSEFILIINFILKVKKNRIFCSNI

SEQ ID NO: 3381327 - protein, 18 aa, Plasmodium falciparum
EIGQDKNISIICWTMHRI

SEQ ID NO: 3381328 - protein, 27 aa, Plasmodium falciparum
EIHEKGIYAIVRLIPRITYEHFMNAKK

SEQ ID NO: 3381329 - protein, 20 aa, Plasmodium falciparum
EIHFLKYLELQYYLKKQKKE

SEQ ID NO: 3381330 - protein, 23 aa, Plasmodium falciparum
EIIEIMFQESLLKVLFSTETFSM

SEQ ID NO: 3381331 - protein, 25 aa, Plasmodium falciparum
EIIIQFENLYHFCNINKHLTISFIL

SEQ ID NO: 3381332 - protein, 18 aa, Plasmodium falciparum
EIILDKLIYEKRFLKNKN

SEQ ID NO: 3381333 - protein, 27 aa, Plasmodium falciparum
EIILSDYWKINIFKREKWELLDKGNLD

SEQ ID NO: 3381334 - protein, 27 aa, Plasmodium falciparum
EIINIIHFSYFLITRIFLYEKKAIENQ

SEQ ID NO: 3381335 - protein, 32 aa, Plasmodium falciparum
EIINVKLLDDISHLYMIANNLKILNFKGCPID

SEQ ID NO: 3381336 - protein, 18 aa, Plasmodium falciparum
EIINYPKFLYVLHSINYD

SEQ ID NO: 3381337 - protein, 22 aa, Plasmodium falciparum
EIIQYAIIFLVEKKYEVKSFPL

SEQ ID NO: 3381338 - protein, 18 aa, Plasmodium falciparum
EIITLLEEFLLTLTGKNL

SEQ ID NO: 3381339 - protein, 28 aa, Plasmodium falciparum
EIITQLHTILKPFMLRRLKVEVEQSLPP

SEQ ID NO: 3381340 - protein, 26 aa, Plasmodium falciparum
EIITTQLIPIVKYLNFNSLKNNILLE

SEQ ID NO: 3381341 - protein, 25 aa, Plasmodium falciparum
EIKDKIIQNYYFNQDDCISLCSILK

SEQ ID NO: 3381342 - protein, 18 aa, Plasmodium falciparum
EIKELRHKIYEITKKCNI

SEQ ID NO: 3381343 - protein, 23 aa, Plasmodium falciparum
EIKEQEEYLLGKKIDMQKLMQDD

SEQ ID NO: 3381344 - protein, 23 aa, Plasmodium falciparum
EIKISMWSLLKDCIGKDLSRIGM

SEQ ID NO: 3381345 - protein, 25 aa, Plasmodium falciparum
EIKKKDIPHIIKDKNKKRTLKNNND

SEQ ID NO: 3381346 - protein, 31 aa, Plasmodium falciparum
EIKKKLSVPFLPPYYFFTYHVTYICLNDVNK

SEQ ID NO: 3381347 - protein, 22 aa, Plasmodium falciparum
EIKLFIVVLYNNEGDITCVTYD

SEQ ID NO: 3381348 - protein, 20 aa, Plasmodium falciparum
EIKLKINNCLKMIFVRHNIK

SEQ ID NO: 3381349 - protein, 24 aa, Plasmodium falciparum
EIKNKNYLLNQISIEDLYEIYEDT

SEQ ID NO: 3381350 - protein, 37 aa, Plasmodium falciparum
EIKNLTLQIKLMKEEILKYKQLIMSSGINEKFEKNFN

SEQ ID NO: 3381351 - protein, 21 aa, Plasmodium falciparum
EIKNLWPAIDKYKFLQTRQKM

SEQ ID NO: 3381352 - protein, 25 aa, Plasmodium falciparum
EIKNYIYVFIKYYDTLRNDLFNEHR

SEQ ID NO: 3381353 - protein, 26 aa, Plasmodium falciparum
EIKQLKKIVIEIFVLMGLQKKTNTQE

SEQ ID NO: 3381354 - protein, 18 aa, Plasmodium falciparum
EIKRVVGLILIRGENIVS

SEQ ID NO: 3381355 - protein, 24 aa, Plasmodium falciparum
EIKSLLLKGIWVVCDRYAYSGVAY

SEQ ID NO: 3381356 - protein, 46 aa, Plasmodium falciparum
EIKTDNIKKAHLYFFFLRICKLLYYNIRPIFIFDGNPPELKRKTIF

SEQ ID NO: 3381357 - protein, 23 aa, Plasmodium falciparum
EIKYKSVYPSYIDKIIFTENSEG

SEQ ID NO: 3381358 - protein, 18 aa, Plasmodium falciparum
EILFNQYPGFYEVRYIPG

SEQ ID NO: 3381359 - protein, 29 aa, Plasmodium falciparum
EILKKDIFYNIFFLKLLGIQNICSFDFVT

SEQ ID NO: 3381360 - protein, 20 aa, Plasmodium falciparum
EILKRNKSLQFLLEHTEFLE

SEQ ID NO: 3381361 - protein, 30 aa, Plasmodium falciparum
EILLESLYEDRILPLLFNIKGRADEYEYRE

SEQ ID NO: 3381362 - protein, 29 aa, Plasmodium falciparum
EILLKNYFYENIKKFLLNINYNEINNIIF

SEQ ID NO: 3381363 - protein, 20 aa, Plasmodium falciparum
EILNKGRFLKKIILNYNCNI

SEQ ID NO: 3381364 - protein, 29 aa, Plasmodium falciparum
EILNPNNVFLPLHIFMKTAMQNKFSEYQV

SEQ ID NO: 3381365 - protein, 30 aa, Plasmodium falciparum
EILRDFNGKIPLLHKVLKPLPAKNRSNNFD

SEQ ID NO: 3381366 - protein, 24 aa, Plasmodium falciparum
EIMAHNKIYRPQEKDIPITQDNSF

SEQ ID NO: 3381367 - protein, 25 aa, Plasmodium falciparum
EIMGEWFLCFLCFKNNKDQEEINIE

SEQ ID NO: 3381368 - protein, 24 aa, Plasmodium falciparum
EIMSDKKFLGINNFTHVNLSNNAN

SEQ ID NO: 3381369 - protein, 18 aa, Plasmodium falciparum
EIMWTYADILITTPDIFL

SEQ ID NO: 3381370 - protein, 24 aa, Plasmodium falciparum
EIMYFLCMHVWIYCVKLNMINNNH

SEQ ID NO: 3381371 - protein, 19 aa, Plasmodium falciparum
EINEILQFLKKSNTISLME

SEQ ID NO: 3381372 - protein, 22 aa, Plasmodium falciparum
EINHLFFQKNNQLQIRRSIQID

SEQ ID NO: 3381373 - protein, 36 aa, Plasmodium falciparum
EINIKKKRILNNDEILILLNLLRDININRFNIKHVM

SEQ ID NO: 3381374 - protein, 23 aa, Plasmodium falciparum
EINKELINEKLYLSKEMEILERK

SEQ ID NO: 3381375 - protein, 21 aa, Plasmodium falciparum
EINKINVRIKKKSLGNPTFQE

SEQ ID NO: 3381376 - protein, 17 aa, Plasmodium falciparum
EINLMNNQILLRSYNES

SEQ ID NO: 3381377 - protein, 17 aa, Plasmodium falciparum
EINLPFITANQTGPKHL

SEQ ID NO: 3381378 - protein, 20 aa, Plasmodium falciparum
EINNYMPIHLKKKILMENKP

SEQ ID NO: 3381379 - protein, 24 aa, Plasmodium falciparum
EINPWIHKSLTLSKLRNLKIDLFN

SEQ ID NO: 3381380 - protein, 33 aa, Plasmodium falciparum
EINRLKLIWKETPFLYLIIQKFHLNKIITDCSQ

SEQ ID NO: 3381381 - protein, 23 aa, Plasmodium falciparum
EINVLIYLDHPNIIKIFDVYENV

SEQ ID NO: 3381382 - protein, 19 aa, Plasmodium falciparum
EIPIKFRKTYKEVTFFDYT

SEQ ID NO: 3381383 - protein, 20 aa, Plasmodium falciparum
EIPIWGGIEVPNWEEEYKPL

SEQ ID NO: 3381384 - protein, 20 aa, Plasmodium falciparum
EIPIWKFEIPIRKHEQRIYD

SEQ ID NO: 3381385 - protein, 18 aa, Plasmodium falciparum
EIPLFKKCCFLHQGTCEH

SEQ ID NO: 3381386 - protein, 21 aa, Plasmodium falciparum
EIPLNLTQINNIMKSLKAIKN

SEQ ID NO: 3381387 - protein, 18 aa, Plasmodium falciparum
EIPLWVKQKYLLSPIDTS

SEQ ID NO: 3381388 - protein, 17 aa, Plasmodium falciparum
EIPPLLPDNYSSLYFKG

SEQ ID NO: 3381389 - protein, 24 aa, Plasmodium falciparum
EIQCNFRIFFKEKYFELSLDNKVR

SEQ ID NO: 3381390 - protein, 20 aa, Plasmodium falciparum
EIQDEFLINLLLACIDDNPF

SEQ ID NO: 3381391 - protein, 32 aa, Plasmodium falciparum
EIQKKDEILIKLQKLISTLKEKNLIINEKNYK

SEQ ID NO: 3381392 - protein, 24 aa, Plasmodium falciparum
EIQKKITHYCELEFESLWKETRRT

SEQ ID NO: 3381393 - protein, 28 aa, Plasmodium falciparum
EIQKMLTMYFNKYVYPLKKYNITIDSSI

SEQ ID NO: 3381394 - protein, 38 aa, Plasmodium falciparum
EIQNKNVLFELFYSMYKLRKFKKLYGCLKYFIENENKY

SEQ ID NO: 3381395 - protein, 21 aa, Plasmodium falciparum
EIQQYLKTYSLLLDLKSESLK

SEQ ID NO: 3381396 - protein, 34 aa, Plasmodium falciparum
EIRILNEELVKYKTILYNLKKDPLLQNQDLLSKI

SEQ ID NO: 3381397 - protein, 25 aa, Plasmodium falciparum
EIRKTKYYTNKYSNKLKYTVIEEGS

SEQ ID NO: 3381398 - protein, 31 aa, Plasmodium falciparum
EISIKKKKLLHLNFLLHDIPEIIKKEKEKYE

SEQ ID NO: 3381399 - protein, 28 aa, Plasmodium falciparum
EISKQLLDNIILLNSLSKYMNKDDINKQ

SEQ ID NO: 3381400 - protein, 23 aa, Plasmodium falciparum
EISKVIKLLPNLSRDRIIFANTI

SEQ ID NO: 3381401 - protein, 23 aa, Plasmodium falciparum
EISLKYFDALTNADFLLITKQII

SEQ ID NO: 3381402 - protein, 24 aa, Plasmodium falciparum
EISNLTFPFFYNNTIHTLFKIYPF

SEQ ID NO: 3381403 - protein, 26 aa, Plasmodium falciparum
EISPKKNNLFPYHSFYINHMNKNEIQ

SEQ ID NO: 3381404 - protein, 18 aa, Plasmodium falciparum
EITEIFSKYGPLLGQGIY

SEQ ID NO: 3381405 - protein, 28 aa, Plasmodium falciparum
EITHPSYHWFFKSMIHVIDDLDIPFFKT

SEQ ID NO: 3381406 - protein, 26 aa, Plasmodium falciparum
EITKAYRILALKYHPDKFLTNFKKSG

SEQ ID NO: 3381407 - protein, 18 aa, Plasmodium falciparum
EITNLFRKKLKIFNLNVC

SEQ ID NO: 3381408 - protein, 34 aa, Plasmodium falciparum
EITSYLVSRFYRAPEIILGFRYDAQIDVWSAAAT

SEQ ID NO: 3381409 - protein, 18 aa, Plasmodium falciparum
EIVEKYLHIIQSKKIWAS

SEQ ID NO: 3381410 - protein, 23 aa, Plasmodium falciparum
EIVKFCIFLMQNDKLLNLENENS

SEQ ID NO: 3381411 - protein, 26 aa, Plasmodium falciparum
EIVKIYLMYEYLFQNNIKHYSSFFTN

SEQ ID NO: 3381412 - protein, 24 aa, Plasmodium falciparum
EIVNVYFYNKLHIGIGLLNRKSNI

SEQ ID NO: 3381413 - protein, 25 aa, Plasmodium falciparum
EIVRPQNKLFFNNASHFLELVNNKI

SEQ ID NO: 3381414 - protein, 21 aa, Plasmodium falciparum
EIVVNFLKIGRYMSHTLFSRV

SEQ ID NO: 3381415 - protein, 24 aa, Plasmodium falciparum
EIYEKYFMKLISDKILYKSIHKYI

SEQ ID NO: 3381416 - protein, 27 aa, Plasmodium falciparum
EIYEQFLLIFPRCVYYWNKYAELKIKK

SEQ ID NO: 3381417 - protein, 31 aa, Plasmodium falciparum
EIYERYRRTGEFIYRPTNTNGNYYRDRANAN

SEQ ID NO: 3381418 - protein, 21 aa, Plasmodium falciparum
EIYFNGFLKYSKKKQKKKPLG

SEQ ID NO: 3381419 - protein, 34 aa, Plasmodium falciparum
EIYGTIEAFPHCDPYMLAWSYRKTKIIQEILNNS

SEQ ID NO: 3381420 - protein, 26 aa, Plasmodium falciparum
EIYHIKLSHILSIEKGLLSLQEINID

SEQ ID NO: 3381421 - protein, 25 aa, Plasmodium falciparum
EIYKEGVFFVILNGILLGVHKRPQK

SEQ ID NO: 3381422 - protein, 24 aa, Plasmodium falciparum
EIYKHFNLCQLTIDFLGHAVALYL

SEQ ID NO: 3381423 - protein, 20 aa, Plasmodium falciparum
EIYNSDENLFFGNKGNKPNM

SEQ ID NO: 3381424 - protein, 37 aa, Plasmodium falciparum
EKAILRKEIIRMYSRIFQAPLNLKTYPLSRNKKYAHE

SEQ ID NO: 3381425 - protein, 28 aa, Plasmodium falciparum
EKAKAKNVQIFLPVDFKIADNFDNNANT

SEQ ID NO: 3381426 - protein, 25 aa, Plasmodium falciparum
EKAKDMRILFLETGNNLKTIYNEKQ

SEQ ID NO: 3381427 - protein, 26 aa, Plasmodium falciparum
EKAKNVYFAYINKKFKKYNILDHFNM

SEQ ID NO: 3381428 - protein, 19 aa, Plasmodium falciparum
EKARNLAIAARKKFENVYK

SEQ ID NO: 3381429 - protein, 17 aa, Plasmodium falciparum
EKCIKENMLLLKSLLEM

SEQ ID NO: 3381430 - protein, 25 aa, Plasmodium falciparum
EKCYDIGNYYSGKLYPEGYNENNFD

SEQ ID NO: 3381431 - protein, 22 aa, Plasmodium falciparum
EKCYKQMRIFAEKFSSFKNKFD

SEQ ID NO: 3381432 - protein, 27 aa, Plasmodium falciparum
EKCYNYKNYTPYINKLIILNKQYRCHP

SEQ ID NO: 3381433 - protein, 26 aa, Plasmodium falciparum
EKDELWELYIYMNLKKKKRKIEYNEK

SEQ ID NO: 3381434 - protein, 22 aa, Plasmodium falciparum
EKDIDFLFNDEEMNKYLNEIIN

SEQ ID NO: 3381435 - protein, 25 aa, Plasmodium falciparum
EKDIKGLPLTCRCVFFISPDKKVKA

SEQ ID NO: 3381436 - protein, 25 aa, Plasmodium falciparum
EKDILEKVFFYTQSKKSYELLRFLF

SEQ ID NO: 3381437 - protein, 27 aa, Plasmodium falciparum
EKDIYKYSILIFLSSKNGNFIEFPFNG

SEQ ID NO: 3381438 - protein, 23 aa, Plasmodium falciparum
EKDLTINLPYPCDEKDYSCVLHI

SEQ ID NO: 3381439 - protein, 36 aa, Plasmodium falciparum
EKDNPIFHFLFESSDLFYYYKWRVFSFAQGDSYKNW

SEQ ID NO: 3381440 - protein, 17 aa, Plasmodium falciparum
EKDSLFTLNLEKNDTQY

SEQ ID NO: 3381441 - protein, 34 aa, Plasmodium falciparum
EKECTFKPQTLWNQSFKKTISFVDEFFVKLKPYI

SEQ ID NO: 3381442 - protein, 29 aa, Plasmodium falciparum
EKEDTPFSFSFLEPFYMSNVLIKLKNVSF

SEQ ID NO: 3381443 - protein, 23 aa, Plasmodium falciparum
EKEDYIINFLKQQKIKSILYIND

SEQ ID NO: 3381444 - protein, 28 aa, Plasmodium falciparum
EKEESDISIVLFLIIPKKKEHINEPIYY

SEQ ID NO: 3381445 - protein, 25 aa, Plasmodium falciparum
EKEFDSFYYIIPTGWVKKFSFYERN

SEQ ID NO: 3381446 - protein, 24 aa, Plasmodium falciparum
EKEFNKFMNIFENINRNKPNESNE

SEQ ID NO: 3381447 - protein, 23 aa, Plasmodium falciparum
EKEIILNSLLIDTMSLCPDIYGS

SEQ ID NO: 3381448 - protein, 26 aa, Plasmodium falciparum
EKEIRRSFEQFFNIPIQYNDLKNTEE

SEQ ID NO: 3381449 - protein, 24 aa, Plasmodium falciparum
EKEKGNYYFLPKCLKKKKISKLKK

SEQ ID NO: 3381450 - protein, 31 aa, Plasmodium falciparum
EKEKKDIFSYIKGMYLSPTSLPPQKKKKKEK

SEQ ID NO: 3381451 - protein, 23 aa, Plasmodium falciparum
EKEKKKTYRKLKKKLLQDEENFK

SEQ ID NO: 3381452 - protein, 27 aa, Plasmodium falciparum
EKEKLDSIIYIPLYTDIFQYVENFIKN

SEQ ID NO: 3381453 - protein, 20 aa, Plasmodium falciparum
EKEKLLPETLYLIQSKDITS

SEQ ID NO: 3381454 - protein, 18 aa, Plasmodium falciparum
EKEKQYFFNCIQMAKLDI

SEQ ID NO: 3381455 - protein, 25 aa, Plasmodium falciparum
EKELNLFYNYHLKLRDRIVDVISFM

SEQ ID NO: 3381456 - protein, 25 aa, Plasmodium falciparum
EKENVLLKRSLLLSKNMYLGNDILT

SEQ ID NO: 3381457 - protein, 23 aa, Plasmodium falciparum
EKERLISKLKKINLKFNELKYDF

SEQ ID NO: 3381458 - protein, 36 aa, Plasmodium falciparum
EKERLLSILYGSVFTGPKYLLYSKKWRGKTLNEIIN

SEQ ID NO: 3381459 - protein, 25 aa, Plasmodium falciparum
EKESAKNWFAVENIKLRNKLKKLKY

SEQ ID NO: 3381460 - protein, 26 aa, Plasmodium falciparum
EKEYNKIRARIFSNFNKKQKNVQKTE

SEQ ID NO: 3381461 - protein, 22 aa, Plasmodium falciparum
EKEYPFFGTIEKNDENVSNKKK

SEQ ID NO: 3381462 - protein, 19 aa, Plasmodium falciparum
EKFDFLMLNIAKECGDINN

SEQ ID NO: 3381463 - protein, 19 aa, Plasmodium falciparum
EKFLLNINSLSENYSRIIE

SEQ ID NO: 3381464 - protein, 43 aa, Plasmodium falciparum
EKFYRKKSYMLCYDKKNNKYIFGYFILILANQIKWKVCDNKVF

SEQ ID NO: 3381465 - protein, 18 aa, Plasmodium falciparum
EKGILLNNLTIKGITKYD

SEQ ID NO: 3381466 - protein, 28 aa, Plasmodium falciparum
EKGKELNNLLYIINIKNKKIKSELECFI

SEQ ID NO: 3381467 - protein, 27 aa, Plasmodium falciparum
EKGNLKSKWYIKLRNRSYDSYFFNRYC

SEQ ID NO: 3381468 - protein, 18 aa, Plasmodium falciparum
EKGTSKKSIIKYSKKRKS

SEQ ID NO: 3381469 - protein, 22 aa, Plasmodium falciparum
EKGWHIIIGSKFGFFCTHEIYH

SEQ ID NO: 3381470 - protein, 32 aa, Plasmodium falciparum
EKHEDYKYYLAKYQQMFMKTLERIIDVADMKI

SEQ ID NO: 3381471 - protein, 30 aa, Plasmodium falciparum
EKHIKNIWTFFNFKIFNNKLPSFDFINFYW

SEQ ID NO: 3381472 - protein, 18 aa, Plasmodium falciparum
EKHLFKRTPIFYKDILYS

SEQ ID NO: 3381473 - protein, 21 aa, Plasmodium falciparum
EKHMLLDHLLIYYSLNENHTK

SEQ ID NO: 3381474 - protein, 21 aa, Plasmodium falciparum
EKHQAKIPDLVTDENEKTNVE

SEQ ID NO: 3381475 - protein, 24 aa, Plasmodium falciparum
EKHSLKFSPKVMPLLMKEKNVKHK

SEQ ID NO: 3381476 - protein, 20 aa, Plasmodium falciparum
EKICNHPLLLNVNDIKEIGQ

SEQ ID NO: 3381477 - protein, 21 aa, Plasmodium falciparum
EKIEFADLMYSNNNFFGQGLQ

SEQ ID NO: 3381478 - protein, 19 aa, Plasmodium falciparum
EKIEILNLLPRLKDIYVQN

SEQ ID NO: 3381479 - protein, 24 aa, Plasmodium falciparum
EKIFKKPVIVYNYPKDLKAFYMKL

SEQ ID NO: 3381480 - protein, 19 aa, Plasmodium falciparum
EKIFPCKDIKEIMLKYVYC

SEQ ID NO: 3381481 - protein, 25 aa, Plasmodium falciparum
EKIHDKLLTFIPNNSRKIINSGTKS

SEQ ID NO: 3381482 - protein, 21 aa, Plasmodium falciparum
EKIHGKYVPIIKFGGSKKYIK

SEQ ID NO: 3381483 - protein, 21 aa, Plasmodium falciparum
EKIIDHFLYLLTDDSYNQMKK

SEQ ID NO: 3381484 - protein, 23 aa, Plasmodium falciparum
EKIIKNSLFLINIDKVIYNYLKE

SEQ ID NO: 3381485 - protein, 27 aa, Plasmodium falciparum
EKIKELDKYKFFLNKLANCEKSDDTES

SEQ ID NO: 3381486 - protein, 38 aa, Plasmodium falciparum
EKIKHHYFFFFLQISDYLKYFYILSHEYLEKLYHYKKN

SEQ ID NO: 3381487 - protein, 28 aa, Plasmodium falciparum
EKIKNIYPIVPYISVWENKYIQGIMDIE

SEQ ID NO: 3381488 - protein, 28 aa, Plasmodium falciparum
EKIKRRMYNILYSCFLILEKYDLIKYNK

SEQ ID NO: 3381489 - protein, 24 aa, Plasmodium falciparum
EKILKCCSTILLTGPLREVIIKGM

SEQ ID NO: 3381490 - protein, 17 aa, Plasmodium falciparum
EKILKRNISNILYECIS

SEQ ID NO: 3381491 - protein, 49 aa, Plasmodium falciparum
EKINKAFIDLYNIFIFYIFIHNLFPCCICSIRLHFSFISFDILEIMLTG

SEQ ID NO: 3381492 - protein, 22 aa, Plasmodium falciparum
EKIQDPLWVPKGTCKRFLGHSN

SEQ ID NO: 3381493 - protein, 21 aa, Plasmodium falciparum
EKIRDLGKLFQLYHISTTTND

SEQ ID NO: 3381494 - protein, 23 aa, Plasmodium falciparum
EKIRKRYAILSHLPLGVNVLFVS

SEQ ID NO: 3381495 - protein, 18 aa, Plasmodium falciparum
EKIRWWLYDEKCREQFIV

SEQ ID NO: 3381496 - protein, 22 aa, Plasmodium falciparum
EKISGVKFGPMILTAQSRTTNV

SEQ ID NO: 3381497 - protein, 18 aa, Plasmodium falciparum
EKISKMDDILYPCDKNKS

SEQ ID NO: 3381498 - protein, 25 aa, Plasmodium falciparum
EKISNFFWYYSDVINQLLREEIIKK

SEQ ID NO: 3381499 - protein, 41 aa, Plasmodium falciparum
EKITKQILDKLSALTINEFIDIYSLVILAALVSDDKQKHIN

SEQ ID NO: 3381500 - protein, 24 aa, Plasmodium falciparum
EKITSYNFLKKHNSTFDSLEKLDM

SEQ ID NO: 3381501 - protein, 20 aa, Plasmodium falciparum
EKIWTMLENYFLAQKLYVDI

SEQ ID NO: 3381502 - protein, 19 aa, Plasmodium falciparum
EKIYIQKENNYFLLITNKN

SEQ ID NO: 3381503 - protein, 17 aa, Plasmodium falciparum
EKIYNVNPLSNYIKNDK

SEQ ID NO: 3381504 - protein, 30 aa, Plasmodium falciparum
EKKETFYFIFTFFMEPHFIWEELNIPIFHE

SEQ ID NO: 3381505 - protein, 38 aa, Plasmodium falciparum
EKKFINNFYVLDTRDLLLLIYLFTYLKLYVSHHEAYVC

SEQ ID NO: 3381506 - protein, 19 aa, Plasmodium falciparum
EKKFNSNNFFLHNDTKLRN

SEQ ID NO: 3381507 - protein, 25 aa, Plasmodium falciparum
EKKGIPFLLLLEKTNKYIKEYISCN

SEQ ID NO: 3381508 - protein, 25 aa, Plasmodium falciparum
EKKHLNLLVNLFDEHKEMEDVIFHM

SEQ ID NO: 3381509 - protein, 20 aa, Plasmodium falciparum
EKKICMLNNGNFLILNANKK

SEQ ID NO: 3381510 - protein, 23 aa, Plasmodium falciparum
EKKIIINNNFRSYKNGVIHKYSF

SEQ ID NO: 3381511 - protein, 32 aa, Plasmodium falciparum
EKKIIKKNIPLLIILLNFLKNLNINLNHLKTT

SEQ ID NO: 3381512 - protein, 17 aa, Plasmodium falciparum
EKKIQIENIIQTDIKDI

SEQ ID NO: 3381513 - protein, 22 aa, Plasmodium falciparum
EKKKFIDNKKFTKKFSTYSNNN

SEQ ID NO: 3381514 - protein, 22 aa, Plasmodium falciparum
EKKKIFLFNLSDNQKKQIENLK

SEQ ID NO: 3381515 - protein, 17 aa, Plasmodium falciparum
EKKKIIHNINWTALINK

SEQ ID NO: 3381516 - protein, 26 aa, Plasmodium falciparum
EKKKKELFLLKINDIANKNYKDTYKE

SEQ ID NO: 3381517 - protein, 25 aa, Plasmodium falciparum
EKKKKKFYLCYDIEWLAIVKANHHL

SEQ ID NO: 3381518 - protein, 25 aa, Plasmodium falciparum
EKKKKKVFYIIPPKINNNEENTFNG

SEQ ID NO: 3381519 - protein, 33 aa, Plasmodium falciparum
EKKKKRKMLFMQKYYHKGGFYQDLFEEGKEEIY

SEQ ID NO: 3381520 - protein, 26 aa, Plasmodium falciparum
EKKKLLNYKIFLLTSNGHLCCVNVSM

SEQ ID NO: 3381521 - protein, 19 aa, Plasmodium falciparum
EKKKNNWAMYGRPIVKRQN

SEQ ID NO: 3381522 - protein, 33 aa, Plasmodium falciparum
EKKKTKNIHILKQLDLLFNLQKSYENRNIFYEK

SEQ ID NO: 3381523 - protein, 24 aa, Plasmodium falciparum
EKKKVFVYLINFPFCNIYKDNIFN

SEQ ID NO: 3381524 - protein, 21 aa, Plasmodium falciparum
EKKLKFIDIFDEENELGISND

SEQ ID NO: 3381525 - protein, 17 aa, Plasmodium falciparum
EKKLKKIKYVYEKSLYT

SEQ ID NO: 3381526 - protein, 30 aa, Plasmodium falciparum
EKKLNIDSYWWYRQLRQYGSHPHAGFGLGF

SEQ ID NO: 3381527 - protein, 22 aa, Plasmodium falciparum
EKKNLFDILYKKYSLVFLFSDI

SEQ ID NO: 3381528 - protein, 20 aa, Plasmodium falciparum
EKKNLSLLNYNYPLDNDYNY

SEQ ID NO: 3381529 - protein, 26 aa, Plasmodium falciparum
EKKNPYLLCWTYIYQEKPEFTVPLKG

SEQ ID NO: 3381530 - protein, 32 aa, Plasmodium falciparum
EKKRDELKKIAQLKLLLSIENRKNYYKKKIKS

SEQ ID NO: 3381531 - protein, 24 aa, Plasmodium falciparum
EKKRKILIFIIGGITYPEIKQIYE

SEQ ID NO: 3381532 - protein, 28 aa, Plasmodium falciparum
EKKSALCTFNIHNFFYVETLFNLENSSY

SEQ ID NO: 3381533 - protein, 26 aa, Plasmodium falciparum
EKKSCIWMVFEYVPFDLSGYSELLRE

SEQ ID NO: 3381534 - protein, 24 aa, Plasmodium falciparum
EKKSFDVHIPLTSLVYIPGKIVNT

SEQ ID NO: 3381535 - protein, 22 aa, Plasmodium falciparum
EKKTVLLSNDILYDAKKEIEQS

SEQ ID NO: 3381536 - protein, 26 aa, Plasmodium falciparum
EKLKDKIIHIFDNSLKNNKLLPVHNY

SEQ ID NO: 3381537 - protein, 20 aa, Plasmodium falciparum
EKLKELINLLNKKKIKEEHT

SEQ ID NO: 3381538 - protein, 24 aa, Plasmodium falciparum
EKLKIKFTDILHAGAFGHFFHRNK

SEQ ID NO: 3381539 - protein, 26 aa, Plasmodium falciparum
EKLKKLKLAELWKYNSGVEKNETVLN

SEQ ID NO: 3381540 - protein, 26 aa, Plasmodium falciparum
EKLNKVKLYVFPFKKKNKDQEIKEKN

SEQ ID NO: 3381541 - protein, 20 aa, Plasmodium falciparum
EKLNQIISVLKIEKQRALQN

SEQ ID NO: 3381542 - protein, 22 aa, Plasmodium falciparum
EKLNRHGFENLLLSVEWAKPSN

SEQ ID NO: 3381543 - protein, 26 aa, Plasmodium falciparum
EKLQDRLLDYESKLLIYENNNEIKIL

SEQ ID NO: 3381544 - protein, 25 aa, Plasmodium falciparum
EKLQTKIFIYLQNVKSIYVSLNNEQ

SEQ ID NO: 3381545 - protein, 24 aa, Plasmodium falciparum
EKLRKIVLDLKIGPTIFKDLNKED

SEQ ID NO: 3381546 - protein, 21 aa, Plasmodium falciparum
EKLRMLDVDTFGIAAAHYRTN

SEQ ID NO: 3381547 - protein, 26 aa, Plasmodium falciparum
EKLSKEFDLLPWYEYNYLIEADKKIK

SEQ ID NO: 3381548 - protein, 21 aa, Plasmodium falciparum
EKLYMEEGIRWDPLDFPDNKD

SEQ ID NO: 3381549 - protein, 20 aa, Plasmodium falciparum
EKLYTRDSLKKKVKKIVIPE

SEQ ID NO: 3381550 - protein, 18 aa, Plasmodium falciparum
EKMGWKKGEGLGKDKQGI

SEQ ID NO: 3381551 - protein, 26 aa, Plasmodium falciparum
EKMLNVRLFIFYFKNKKDDNISYIKE

SEQ ID NO: 3381552 - protein, 35 aa, Plasmodium falciparum
EKNDEILNFYEQMEELLYFDEDLLDILNSDEEKEN

SEQ ID NO: 3381553 - protein, 30 aa, Plasmodium falciparum
EKNDVPTYIQYILPHLRFHKLWDSLYYEEN

SEQ ID NO: 3381554 - protein, 31 aa, Plasmodium falciparum
EKNDVPTYIQYILPHLRFHKLWDSLYYEENI

SEQ ID NO: 3381555 - protein, 17 aa, Plasmodium falciparum
EKNILIFDLGGGTFDVS

SEQ ID NO: 3381556 - protein, 17 aa, Plasmodium falciparum
EKNILNKYLTPDKIKYI

SEQ ID NO: 3381557 - protein, 24 aa, Plasmodium falciparum
EKNKEHFFILYTKRFDYNDFYIEW

SEQ ID NO: 3381558 - protein, 22 aa, Plasmodium falciparum
EKNKLLLNIAKEYLLKNNVNEK

SEQ ID NO: 3381559 - protein, 24 aa, Plasmodium falciparum
EKNLIILKNMIDYLKKQKQRALKL

SEQ ID NO: 3381560 - protein, 24 aa, Plasmodium falciparum
EKNMHLFEMLINKKQFDKNDLEYL

SEQ ID NO: 3381561 - protein, 33 aa, Plasmodium falciparum
EKNMYTNKNLPLNKLIYLDVSYNNIKKLTTFEK

SEQ ID NO: 3381562 - protein, 25 aa, Plasmodium falciparum
EKNNIVCGLILNKHPLYNDYMKMSN

SEQ ID NO: 3381563 - protein, 24 aa, Plasmodium falciparum
EKNNKNFIVPIQNNQHFTNPEIPI

SEQ ID NO: 3381564 - protein, 38 aa, Plasmodium falciparum
EKNNKQYILWNNRTIEVTFVWLFITKEFNENRKKYTAF

SEQ ID NO: 3381565 - protein, 18 aa, Plasmodium falciparum
EKNNTIYNFIHSATMFQH

SEQ ID NO: 3381566 - protein, 24 aa, Plasmodium falciparum
EKNNYILFFLIKVGHDINKKKLDN

SEQ ID NO: 3381567 - protein, 29 aa, Plasmodium falciparum
EKNTDILYFFSEYFIEALYINYNLTNIEQ

SEQ ID NO: 3381568 - protein, 43 aa, Plasmodium falciparum
EKNVYPHPLIFILYSNDNHLLYLYLTYSLYYYSKSKELFDINK

SEQ ID NO: 3381569 - protein, 18 aa, Plasmodium falciparum
EKNYKNIIPSKESNLLIA

SEQ ID NO: 3381570 - protein, 24 aa, Plasmodium falciparum
EKPAKALYVFKKKENMSPIEYMER

SEQ ID NO: 3381571 - protein, 26 aa, Plasmodium falciparum
EKPDKKWRLYMFKDSNNNEPQKILHI

SEQ ID NO: 3381572 - protein, 29 aa, Plasmodium falciparum
EKPEEIDINFIRYFSKLTGDLNSLSSVDI

SEQ ID NO: 3381573 - protein, 21 aa, Plasmodium falciparum
EKPEERWRPIWSVEGILVSVI

SEQ ID NO: 3381574 - protein, 29 aa, Plasmodium falciparum
EKPKFEQPVFGLNYLSGIIKPLIDHPNSL

SEQ ID NO: 3381575 - protein, 31 aa, Plasmodium falciparum
EKQHPVFRREGIDLFMNYKISLYESLTGFVA

SEQ ID NO: 3381576 - protein, 18 aa, Plasmodium falciparum
EKQINASKLIKTVINKDS

SEQ ID NO: 3381577 - protein, 25 aa, Plasmodium falciparum
EKQKKLPFKVTLKKLIKLNISNQNR

SEQ ID NO: 3381578 - protein, 23 aa, Plasmodium falciparum
EKQKKYTMFLKKDDISKNIDQKE

SEQ ID NO: 3381579 - protein, 23 aa, Plasmodium falciparum
EKQKLMYKGLLKDDVDLSLLNIK

SEQ ID NO: 3381580 - protein, 27 aa, Plasmodium falciparum
EKQNKKKIRQLFLKKLSMLSNMKSNKK

SEQ ID NO: 3381581 - protein, 22 aa, Plasmodium falciparum
EKQNVLLISTKEKSRIIKVNEK

SEQ ID NO: 3381582 - protein, 24 aa, Plasmodium falciparum
EKQRGIILLNKIFQQIDDHVKNKH

SEQ ID NO: 3381583 - protein, 23 aa, Plasmodium falciparum
EKQRKQMELLSQKINKDIIKLIS

SEQ ID NO: 3381584 - protein, 24 aa, Plasmodium falciparum
EKQRYTFPTNWLYIDNIIGKLETV

SEQ ID NO: 3381585 - protein, 23 aa, Plasmodium falciparum
EKRIHQFIKTLYEKKKILGCQVA

SEQ ID NO: 3381586 - protein, 30 aa, Plasmodium falciparum
EKRKKIFFVKFMLYYIYKKEYVHANVAHYN

SEQ ID NO: 3381587 - protein, 23 aa, Plasmodium falciparum
EKRKNKRLMKKNKIKELRINKKG

SEQ ID NO: 3381588 - protein, 25 aa, Plasmodium falciparum
EKRNFNYYDTCKNIWNYQICKDDNN

SEQ ID NO: 3381589 - protein, 18 aa, Plasmodium falciparum
EKRNNFIFFHAFSSLRKY

SEQ ID NO: 3381590 - protein, 17 aa, Plasmodium falciparum
EKSFFWPRVVMPTIKAA

SEQ ID NO: 3381591 - protein, 24 aa, Plasmodium falciparum
EKSLWRLLEIKKNDNYIFVSELKS

SEQ ID NO: 3381592 - protein, 31 aa, Plasmodium falciparum
EKSLYFEYVKGCTINFILKNLKEYEPKIPIC

SEQ ID NO: 3381593 - protein, 27 aa, Plasmodium falciparum
EKSVNLWDFFMNPLLLNINHADDKVKQ

SEQ ID NO: 3381594 - protein, 18 aa, Plasmodium falciparum
EKSYLSLYEIFKHLDNDK

SEQ ID NO: 3381595 - protein, 24 aa, Plasmodium falciparum
EKTHFFIIPSIYDSINIYPLPQPP

SEQ ID NO: 3381596 - protein, 25 aa, Plasmodium falciparum
EKTIPNKIYNFYLSGLCKFSSCCID

SEQ ID NO: 3381597 - protein, 23 aa, Plasmodium falciparum
EKTKDLMYVLKNQVSKKNMTDDK

SEQ ID NO: 3381598 - protein, 22 aa, Plasmodium falciparum
EKTNFWVSQILDTTLKELSKLN

SEQ ID NO: 3381599 - protein, 26 aa, Plasmodium falciparum
EKTNNRTIMLLKHKRKYDPDYNTSDE

SEQ ID NO: 3381600 - protein, 42 aa, Plasmodium falciparum
EKTSNDNFLLKIYFNNIINSIRTFFLINCFGTVGCILHNNKI

SEQ ID NO: 3381601 - protein, 20 aa, Plasmodium falciparum
EKTTLFHPFKNPLPGFVSDK

SEQ ID NO: 3381602 - protein, 21 aa, Plasmodium falciparum
EKTVVRRYFPGKKPHYAKKGE

SEQ ID NO: 3381603 - protein, 28 aa, Plasmodium falciparum
EKVHIKDKIILDGKIYNIKIIIKEINEC

SEQ ID NO: 3381604 - protein, 41 aa, Plasmodium falciparum
EKVHLHFLFCRSYEKYALLLRLILIFKKKKLGKTMIFFCTK

SEQ ID NO: 3381605 - protein, 17 aa, Plasmodium falciparum
EKVKKFQNFILKSEFHV

SEQ ID NO: 3381606 - protein, 25 aa, Plasmodium falciparum
EKVKMKHLLIKMLKKEIKVESVVLK

SEQ ID NO: 3381607 - protein, 23 aa, Plasmodium falciparum
EKVKRRRKNPFSRSVVGMSPASN

SEQ ID NO: 3381608 - protein, 26 aa, Plasmodium falciparum
EKVQRKDIFLNIDKIGFYELVLKQLL

SEQ ID NO: 3381609 - protein, 25 aa, Plasmodium falciparum
EKVRRKLRIHIYTIYKDGQREVSFP

SEQ ID NO: 3381610 - protein, 32 aa, Plasmodium falciparum
EKVSGVWYDTNRRLWRVMYMENDKRKTRGFSP

SEQ ID NO: 3381611 - protein, 21 aa, Plasmodium falciparum
EKWKKLAIENKLRKIRKIMTY

SEQ ID NO: 3381612 - protein, 22 aa, Plasmodium falciparum
EKYACEWVVFIKTSVEEIKNKV

SEQ ID NO: 3381613 - protein, 20 aa, Plasmodium falciparum
EKYDEDFTLNYILQKYDDDD

SEQ ID NO: 3381614 - protein, 17 aa, Plasmodium falciparum
EKYFISVKVSLYNYYKL

SEQ ID NO: 3381615 - protein, 32 aa, Plasmodium falciparum
EKYIDYFVQSIILNIKNFLRNHFCLIDEDIES

SEQ ID NO: 3381616 - protein, 25 aa, Plasmodium falciparum
EKYILRNICKIIPFDCICKPHISPF

SEQ ID NO: 3381617 - protein, 31 aa, Plasmodium falciparum
EKYINKLYNMNKFMYILNKANNNSFNNNIVE

SEQ ID NO: 3381618 - protein, 25 aa, Plasmodium falciparum
EKYKHIHMYILYNNYQKDFTFSCVK

SEQ ID NO: 3381619 - protein, 24 aa, Plasmodium falciparum
EKYKNVIFHGFKKGTVKTINKKNR

SEQ ID NO: 3381620 - protein, 20 aa, Plasmodium falciparum
EKYLHIIQSKKIWASKRLNI

SEQ ID NO: 3381621 - protein, 24 aa, Plasmodium falciparum
EKYLKCFNNWYKNNFLKGDLTQAC

SEQ ID NO: 3381622 - protein, 20 aa, Plasmodium falciparum
EKYLKFYKNYNYNLKEGVLE

SEQ ID NO: 3381623 - protein, 20 aa, Plasmodium falciparum
EKYLRRFITLFQNQYNNIAK

SEQ ID NO: 3381624 - protein, 23 aa, Plasmodium falciparum
EKYMSTPYVYLNIKQKRETKNRI

SEQ ID NO: 3381625 - protein, 38 aa, Plasmodium falciparum
EKYNNYFADIFLYEQEYYQCIYKVFKNLLLKKEEIDEK

SEQ ID NO: 3381626 - protein, 23 aa, Plasmodium falciparum
EKYPFIEDILSYDKYRYKGHITN

SEQ ID NO: 3381627 - protein, 22 aa, Plasmodium falciparum
EKYVHFAFFACFYISHIKKEKC

SEQ ID NO: 3381628 - protein, 25 aa, Plasmodium falciparum
EKYYSRFLLLFKIPNNIEEKKFINK

SEQ ID NO: 3381629 - protein, 18 aa, Plasmodium falciparum
ELAGRFLIRNVKGPVREG

SEQ ID NO: 3381630 - protein, 30 aa, Plasmodium falciparum
ELAKNWKCQLGWHPFTPEYAFKILHHVDYN

SEQ ID NO: 3381631 - protein, 26 aa, Plasmodium falciparum
ELAKPMYHYGFMNVVLNVLRCVCYHC

SEQ ID NO: 3381632 - protein, 18 aa, Plasmodium falciparum
ELALLYNSKRAATATALT

SEQ ID NO: 3381633 - protein, 25 aa, Plasmodium falciparum
ELAQKHKYIKFTKGIYNRIIENYPE

SEQ ID NO: 3381634 - protein, 25 aa, Plasmodium falciparum
ELCTNSLIFINNKKNSILIPSENEK

SEQ ID NO: 3381635 - protein, 24 aa, Plasmodium falciparum
ELDKKYLDIIYLNKQVALLNDKYR

SEQ ID NO: 3381636 - protein, 21 aa, Plasmodium falciparum
ELDKYFLKKKLLKVKNDFFDK

SEQ ID NO: 3381637 - protein, 25 aa, Plasmodium falciparum
ELEFFQKHPVYKKLPPALYGTNSLT

SEQ ID NO: 3381638 - protein, 18 aa, Plasmodium falciparum
ELEFFSNSRFYPLKEDFF

SEQ ID NO: 3381639 - protein, 20 aa, Plasmodium falciparum
ELEIALYLNLSICYSNVEKY

SEQ ID NO: 3381640 - protein, 19 aa, Plasmodium falciparum
ELEKSYIDPFSSKIEDLIS

SEQ ID NO: 3381641 - protein, 20 aa, Plasmodium falciparum
ELEQIIISRLLFIQQVVSER

SEQ ID NO: 3381642 - protein, 31 aa, Plasmodium falciparum
ELERERRKYLDKERTKRYIRSNSSSIYNDRE

SEQ ID NO: 3381643 - protein, 28 aa, Plasmodium falciparum
ELFCNYHKIQIKKLNYLSLNNINMKTVR

SEQ ID NO: 3381644 - protein, 19 aa, Plasmodium falciparum
ELFCYDIVSDLIIIKGDNK

SEQ ID NO: 3381645 - protein, 17 aa, Plasmodium falciparum
ELFCYINRYNINEIIEN

SEQ ID NO: 3381646 - protein, 20 aa, Plasmodium falciparum
ELFECNLIRGKGLFSRALIH

SEQ ID NO: 3381647 - protein, 21 aa, Plasmodium falciparum
ELFIPMIEILIRDLTLHHCTQ

SEQ ID NO: 3381648 - protein, 45 aa, Plasmodium falciparum
ELFLSFNDFYVYPSKFFLLSKKCKKIILLFLPKNVQSYEERLFLY

SEQ ID NO: 3381649 - protein, 17 aa, Plasmodium falciparum
ELFPKNKEYFILNKNES

SEQ ID NO: 3381650 - protein, 19 aa, Plasmodium falciparum
ELFVKENLEFLKNNSYFNI

SEQ ID NO: 3381651 - protein, 17 aa, Plasmodium falciparum
ELGYLFPPYKNYNIIEE

SEQ ID NO: 3381652 - protein, 25 aa, Plasmodium falciparum
ELHKKYQWVSILEDERMNPGFKNYN

SEQ ID NO: 3381653 - protein, 25 aa, Plasmodium falciparum
ELHLQYVIHLIFDNKYLEAIEYIKK

SEQ ID NO: 3381654 - protein, 18 aa, Plasmodium falciparum
ELHNFNYMNNMDLNNVDM

SEQ ID NO: 3381655 - protein, 27 aa, Plasmodium falciparum
ELHNKKFPALFLYYTKDVKTKHTIMYF

SEQ ID NO: 3381656 - protein, 47 aa, Plasmodium falciparum
ELIDLYSNFEISWKIDIWMVGCILYLLLFKIHPFQNNNFLSIINASF

SEQ ID NO: 3381657 - protein, 28 aa, Plasmodium falciparum
ELIDQKNIFLKLSKILNLIHLSYEQYDE

SEQ ID NO: 3381658 - protein, 25 aa, Plasmodium falciparum
ELIHEFQLTIFSLYAAISVGITLDE

SEQ ID NO: 3381659 - protein, 17 aa, Plasmodium falciparum
ELIKKYFIFERYNDKIT

SEQ ID NO: 3381660 - protein, 18 aa, Plasmodium falciparum
ELILDLLPYINECDINPL

SEQ ID NO: 3381661 - protein, 24 aa, Plasmodium falciparum
ELINIIDGLLKWNPNERLNIDAVL

SEQ ID NO: 3381662 - protein, 23 aa, Plasmodium falciparum
ELINNLKKPRKVILLIKAGPAVD

SEQ ID NO: 3381663 - protein, 21 aa, Plasmodium falciparum
ELINRLYQIIVITLEFNEKSC

SEQ ID NO: 3381664 - protein, 17 aa, Plasmodium falciparum
ELINSFSLSIIFLGLIN

SEQ ID NO: 3381665 - protein, 19 aa, Plasmodium falciparum
ELIQIELKIIRFLNNFQQI

SEQ ID NO: 3381666 - protein, 21 aa, Plasmodium falciparum
ELIQIFLNLSLSKIRDLFICS

SEQ ID NO: 3381667 - protein, 24 aa, Plasmodium falciparum
ELIRKHVYNISPICPNTFLEKIVS

SEQ ID NO: 3381668 - protein, 18 aa, Plasmodium falciparum
ELISYLCGNSKIISFYPS

SEQ ID NO: 3381669 - protein, 27 aa, Plasmodium falciparum
ELKEENKLFYLVPRYNELLQQLDETEE

SEQ ID NO: 3381670 - protein, 19 aa, Plasmodium falciparum
ELKIFWEQYFLQLSICITS

SEQ ID NO: 3381671 - protein, 27 aa, Plasmodium falciparum
ELKKANNLFFYLYLTISIHGYNENKYY

SEQ ID NO: 3381672 - protein, 27 aa, Plasmodium falciparum
ELKKDLLNWYYKYRRKLPWRGDEPPFT

SEQ ID NO: 3381673 - protein, 17 aa, Plasmodium falciparum
ELKKKELRELYYKLENE

SEQ ID NO: 3381674 - protein, 25 aa, Plasmodium falciparum
ELKKSICSLFSDKFLQRTKVEPNEY

SEQ ID NO: 3381675 - protein, 17 aa, Plasmodium falciparum
ELKLIYPIDSSFDNFKN

SEQ ID NO: 3381676 - protein, 17 aa, Plasmodium falciparum
ELKLKYIMDMKYIQSNK

SEQ ID NO: 3381677 - protein, 22 aa, Plasmodium falciparum
ELKLLINIILNNNYKNVAIQLP

SEQ ID NO: 3381678 - protein, 24 aa, Plasmodium falciparum
ELKNYEQEFYKMLISIRGTKSANK

SEQ ID NO: 3381679 - protein, 24 aa, Plasmodium falciparum
ELKQIKNIVLPPKVHVHVSKLSSL

SEQ ID NO: 3381680 - protein, 19 aa, Plasmodium falciparum
ELKRNKTLQFLLTNKDDEI

SEQ ID NO: 3381681 - protein, 33 aa, Plasmodium falciparum
ELKVDKKLIWGNVQPFLYIPSNDYMDDAEDMVN

SEQ ID NO: 3381682 - protein, 43 aa, Plasmodium falciparum
ELKWKRADIEGFLYIVKRSIKPYYRLIITNKKNEKHLLQDIDT

SEQ ID NO: 3381683 - protein, 40 aa, Plasmodium falciparum
ELLASQLIKQFKIIFENAGLPLWLRPYEILVTGSNSGIIE

SEQ ID NO: 3381684 - protein, 30 aa, Plasmodium falciparum
ELLFICSHMWPLFIKPILDGVLEPIVENMN

SEQ ID NO: 3381685 - protein, 17 aa, Plasmodium falciparum
ELLNRLNTGIYGSLYKF

SEQ ID NO: 3381686 - protein, 28 aa, Plasmodium falciparum
ELLRSEISILRLLRHPNVIYLKEIINTK

SEQ ID NO: 3381687 - protein, 36 aa, Plasmodium falciparum
ELLSIDDLSNLFFFCFEFFLKYLCIPGKIENYISII

SEQ ID NO: 3381688 - protein, 18 aa, Plasmodium falciparum
ELMAYFTCCSLQNSHLYL

SEQ ID NO: 3381689 - protein, 37 aa, Plasmodium falciparum
ELMCYLRKNKNITYALLHSLFILNIINDYNHMNSLEV

SEQ ID NO: 3381690 - protein, 24 aa, Plasmodium falciparum
ELMILFDMLLGTLNYDKGRKFLSF

SEQ ID NO: 3381691 - protein, 25 aa, Plasmodium falciparum
ELMVDPFGNYLCQKLMEVCTSEQIE

SEQ ID NO: 3381692 - protein, 21 aa, Plasmodium falciparum
ELNCLFKIINDKINISMIGHS

SEQ ID NO: 3381693 - protein, 40 aa, Plasmodium falciparum
ELNDFDKNVPYLLVDNIIKHKFIHDVSCGENHIAFLSKEG

SEQ ID NO: 3381694 - protein, 27 aa, Plasmodium falciparum
ELNEIRKNLNLFIIRQDNGLSLVGKKD

SEQ ID NO: 3381695 - protein, 24 aa, Plasmodium falciparum
ELNELHEIFVRYNFNSDSEEKPCL

SEQ ID NO: 3381696 - protein, 21 aa, Plasmodium falciparum
ELNFHINIIIYILNNLKKLNY

SEQ ID NO: 3381697 - protein, 25 aa, Plasmodium falciparum
ELNFLLFLFCLNKINFFIPSDYKHL

SEQ ID NO: 3381698 - protein, 18 aa, Plasmodium falciparum
ELNGRFYAGKPLQIEYTP

SEQ ID NO: 3381699 - protein, 18 aa, Plasmodium falciparum
ELNIIKKDDKVNIKNIIM

SEQ ID NO: 3381700 - protein, 26 aa, Plasmodium falciparum
ELNKKYSKIDILNIIFNNLQNDNDEM

SEQ ID NO: 3381701 - protein, 19 aa, Plasmodium falciparum
ELNKLTSPITFICKDEDTD

SEQ ID NO: 3381702 - protein, 28 aa, Plasmodium falciparum
ELNKTKILIDAWFKYSFYTKWMNKFLRY

SEQ ID NO: 3381703 - protein, 28 aa, Plasmodium falciparum
ELNMFYNYFYNAYPFFITKYVNYIKEQI

SEQ ID NO: 3381704 - protein, 24 aa, Plasmodium falciparum
ELNSLAEHIFCQNKKLLLIDNNLN

SEQ ID NO: 3381705 - protein, 21 aa, Plasmodium falciparum
ELNSLFLMWGTSENPNEPFPL

SEQ ID NO: 3381706 - protein, 23 aa, Plasmodium falciparum
ELNTFFDIFNNYVGYHNFHCFTK

SEQ ID NO: 3381707 - protein, 35 aa, Plasmodium falciparum
ELNYPVFHIGYYKYIIHILYCICKYCSSLLLSKEK

SEQ ID NO: 3381708 - protein, 34 aa, Plasmodium falciparum
ELPINANHNFYINNFLLNQHFNFNKNDNIRDINS

SEQ ID NO: 3381709 - protein, 17 aa, Plasmodium falciparum
ELPKLLKKHISIQKPIV

SEQ ID NO: 3381710 - protein, 19 aa, Plasmodium falciparum
ELPNYIIQFVDIHNYVEND

SEQ ID NO: 3381711 - protein, 22 aa, Plasmodium falciparum
ELQEMLRHFNPLDFGIKEKLSE

SEQ ID NO: 3381712 - protein, 27 aa, Plasmodium falciparum
ELQFIRNIFERFLSYKFKPRVMKIIFT

SEQ ID NO: 3381713 - protein, 23 aa, Plasmodium falciparum
ELQGRLPVHVTLSSLTIKDFIDI

SEQ ID NO: 3381714 - protein, 27 aa, Plasmodium falciparum
ELQIETEFPCWTPWEIFCKTKYDELCY

SEQ ID NO: 3381715 - protein, 22 aa, Plasmodium falciparum
ELQIFFTKLLEEKLSPIIKPQN

SEQ ID NO: 3381716 - protein, 47 aa, Plasmodium falciparum
ELQKNEVISFMLNNIFLKEKDISDVLLKSLIYRYDEYKYLKEDLFLS

SEQ ID NO: 3381717 - protein, 22 aa, Plasmodium falciparum
ELQNIINSLKFKNKQLEKELND

SEQ ID NO: 3381718 - protein, 17 aa, Plasmodium falciparum
ELRDIINKKKKAFDESR

SEQ ID NO: 3381719 - protein, 24 aa, Plasmodium falciparum
ELRKERILMIEEVEKMKVIMLEDI

SEQ ID NO: 3381720 - protein, 31 aa, Plasmodium falciparum
ELRNYKMRELHLLSEIKYLKRKVTRLNDLIE

SEQ ID NO: 3381721 - protein, 20 aa, Plasmodium falciparum
ELRPNCLLGMLLDTKGPEIR

SEQ ID NO: 3381722 - protein, 17 aa, Plasmodium falciparum
ELRQVFPSDWDINIYSH

SEQ ID NO: 3381723 - protein, 29 aa, Plasmodium falciparum
ELSEDPIISKYFRILNADDLIPDRLRQCT

SEQ ID NO: 3381724 - protein, 24 aa, Plasmodium falciparum
ELSILLDDYWKKMKIHYPIYFGCG

SEQ ID NO: 3381725 - protein, 23 aa, Plasmodium falciparum
ELSIYDNIILLKNNVRYLINITE

SEQ ID NO: 3381726 - protein, 27 aa, Plasmodium falciparum
ELSIYIDVLLLLLNISEIRFMFTNYID

SEQ ID NO: 3381727 - protein, 18 aa, Plasmodium falciparum
ELSKYIIHLNFNTNILYY

SEQ ID NO: 3381728 - protein, 24 aa, Plasmodium falciparum
ELSNFQWKPLGKNVPKISLINLSH

SEQ ID NO: 3381729 - protein, 31 aa, Plasmodium falciparum
ELTDVWSLGIILFLLLNHRLPFNNSDMNKLF

SEQ ID NO: 3381730 - protein, 24 aa, Plasmodium falciparum
ELVEFMLIIWQHSPFIKYYSPSSI

SEQ ID NO: 3381731 - protein, 19 aa, Plasmodium falciparum
ELWAINLKKELAIWNKKNK

SEQ ID NO: 3381732 - protein, 19 aa, Plasmodium falciparum
ELWLGKNKIEQINLPYLPK

SEQ ID NO: 3381733 - protein, 17 aa, Plasmodium falciparum
ELYDKILYDYKLNQHKY

SEQ ID NO: 3381734 - protein, 32 aa, Plasmodium falciparum
ELYDVKWKNVLPGFFKQPPKPQPNLLDSSNKK

SEQ ID NO: 3381735 - protein, 24 aa, Plasmodium falciparum
ELYKHTCDLLKIKCILFAIPDSRD

SEQ ID NO: 3381736 - protein, 18 aa, Plasmodium falciparum
ELYLFRENAKIELKDCYV

SEQ ID NO: 3381737 - protein, 17 aa, Plasmodium falciparum
ELYLQFQNEINIFINCI

SEQ ID NO: 3381738 - protein, 27 aa, Plasmodium falciparum
ELYNRVKLLFEIRPIWCKDVLLEHVEN

SEQ ID NO: 3381739 - protein, 18 aa, Plasmodium falciparum
ELYNSEIIHYVYPNQNVQ

SEQ ID NO: 3381740 - protein, 18 aa, Plasmodium falciparum
ELYSWGWGGNLFKGANGL

SEQ ID NO: 3381741 - protein, 23 aa, Plasmodium falciparum
EMCGNIIRIGWSKAIPKFGYNTK

SEQ ID NO: 3381742 - protein, 23 aa, Plasmodium falciparum
EMCHPCEYYFTNYKTCFNKYNCN

SEQ ID NO: 3381743 - protein, 30 aa, Plasmodium falciparum
EMDYVTYLHNFTRFIYIPRYCKYRNEEYKS

SEQ ID NO: 3381744 - protein, 26 aa, Plasmodium falciparum
EMEARLLLIVCNKMNQPFDVKMHIKD

SEQ ID NO: 3381745 - protein, 23 aa, Plasmodium falciparum
EMEKITEIQNMLSKKIRLGNVND

SEQ ID NO: 3381746 - protein, 28 aa, Plasmodium falciparum
EMEKLEEDLFYKKFTYQGKQFNDELTNK

SEQ ID NO: 3381747 - protein, 20 aa, Plasmodium falciparum
EMFIHVFGVPNYHPLSKPFY

SEQ ID NO: 3381748 - protein, 21 aa, Plasmodium falciparum
EMHTQLLWVWNKEKNRMVQKN

SEQ ID NO: 3381749 - protein, 26 aa, Plasmodium falciparum
EMIKKFIEDSYAFCTYSINFQSYKIL

SEQ ID NO: 3381750 - protein, 19 aa, Plasmodium falciparum
EMIKNLMLIELSYINTSHP

SEQ ID NO: 3381751 - protein, 20 aa, Plasmodium falciparum
EMINFNQMSYINKNIKEENM

SEQ ID NO: 3381752 - protein, 17 aa, Plasmodium falciparum
EMKFIHRSISMVTIQDE

SEQ ID NO: 3381753 - protein, 33 aa, Plasmodium falciparum
EMKIKKIYKMDLQLFFTLLKRKILYSINNSNNN

SEQ ID NO: 3381754 - protein, 23 aa, Plasmodium falciparum
EMKPIILMGLSMGGCIALRTLET

SEQ ID NO: 3381755 - protein, 22 aa, Plasmodium falciparum
EMKTLFLYFNEPSNIYMNQFSH

SEQ ID NO: 3381756 - protein, 22 aa, Plasmodium falciparum
EMLKNLINLYTKNKSSIFTSHM

SEQ ID NO: 3381757 - protein, 29 aa, Plasmodium falciparum
EMLMELNVYLLSLPVFNGKILEVVDFMSL

SEQ ID NO: 3381758 - protein, 31 aa, Plasmodium falciparum
EMLNNEYLHDNILDYIRANVLYEGYMNKDDI

SEQ ID NO: 3381759 - protein, 26 aa, Plasmodium falciparum
EMLPSFFRRIDFSPNGEFLITPSGIQ

SEQ ID NO: 3381760 - protein, 28 aa, Plasmodium falciparum
EMNDDIKLLLNFFGIPYIQSPCEAEAQC

SEQ ID NO: 3381761 - protein, 25 aa, Plasmodium falciparum
EMNDIPIKPSYFYDNSKLHNSSYTS

SEQ ID NO: 3381762 - protein, 25 aa, Plasmodium falciparum
EMNIKLLPEIDYQFLKSLHINNIQA

SEQ ID NO: 3381763 - protein, 18 aa, Plasmodium falciparum
EMNRNRESLRDIDRHRDI

SEQ ID NO: 3381764 - protein, 22 aa, Plasmodium falciparum
EMRQKYMLKKKFLMNNYKGKTN

SEQ ID NO: 3381765 - protein, 17 aa, Plasmodium falciparum
EMRYIVNFKYKNDKRYK

SEQ ID NO: 3381766 - protein, 18 aa, Plasmodium falciparum
EMTELVVSSLRCVRRLIQ

SEQ ID NO: 3381767 - protein, 27 aa, Plasmodium falciparum
EMTMHNYFIRISKLTSLISTLRLFNCL

SEQ ID NO: 3381768 - protein, 29 aa, Plasmodium falciparum
EMVAMLSNIPYIHKLKNIFFNKDNRKNIY

SEQ ID NO: 3381769 - protein, 24 aa, Plasmodium falciparum
ENAEINLFNRIPKNGVFNLSSENY

SEQ ID NO: 3381770 - protein, 25 aa, Plasmodium falciparum
ENALINDLKEILRKQNESILSNEKN

SEQ ID NO: 3381771 - protein, 22 aa, Plasmodium falciparum
ENAMQYFYTCPFYTSRSKLCLN

SEQ ID NO: 3381772 - protein, 23 aa, Plasmodium falciparum
ENANIYVELFKKKKKNYFVARSI

SEQ ID NO: 3381773 - protein, 26 aa, Plasmodium falciparum
ENARINNFFSCNYTLDDKTKINNRNT

SEQ ID NO: 3381774 - protein, 28 aa, Plasmodium falciparum
ENATEIFILLFIFKLSCNDSVIINRGNH

SEQ ID NO: 3381775 - protein, 31 aa, Plasmodium falciparum
ENAYDMLFSPLTPWPCLSFDYILEHPKHDAL

SEQ ID NO: 3381776 - protein, 20 aa, Plasmodium falciparum
ENAYIWWSTLFKNEHPIKIE

SEQ ID NO: 3381777 - protein, 25 aa, Plasmodium falciparum
ENDEKIIVLKKFICPLHICYVCKEF

SEQ ID NO: 3381778 - protein, 22 aa, Plasmodium falciparum
ENDHAYLLKFDKLGRLYHEEPI

SEQ ID NO: 3381779 - protein, 30 aa, Plasmodium falciparum
ENDKKVWHIPLFYIFEMSKLTLFLGGTVSD

SEQ ID NO: 3381780 - protein, 30 aa, Plasmodium falciparum
ENDKRKTRGFSPRIYGFNAARDLAVQLKYE

SEQ ID NO: 3381781 - protein, 22 aa, Plasmodium falciparum
ENDPLICPCDCKGSIKYAHLMC

SEQ ID NO: 3381782 - protein, 26 aa, Plasmodium falciparum
ENDREMLYSLMVKILEYNYNAHMIPN

SEQ ID NO: 3381783 - protein, 24 aa, Plasmodium falciparum
ENDRTRFHFLSNNINYYGTLIKKK

SEQ ID NO: 3381784 - protein, 22 aa, Plasmodium falciparum
ENDSVKYRLGLKTNSILCNINI

SEQ ID NO: 3381785 - protein, 25 aa, Plasmodium falciparum
ENDTIRYPIYIIKKVYNDEETCNDF

SEQ ID NO: 3381786 - protein, 21 aa, Plasmodium falciparum
ENEHILLKVDNLEKNKKEMKN

SEQ ID NO: 3381787 - protein, 17 aa, Plasmodium falciparum
ENEIFNNNFLSIKGEDK

SEQ ID NO: 3381788 - protein, 24 aa, Plasmodium falciparum
ENEIKNYFLPDHELSHCTLHSTHC

SEQ ID NO: 3381789 - protein, 27 aa, Plasmodium falciparum
ENEILGNIEKYIRIINKRTINKNMDED

SEQ ID NO: 3381790 - protein, 36 aa, Plasmodium falciparum
ENEILRPHFPGSYACISPLCLILCPTRELVIQIQNE

SEQ ID NO: 3381791 - protein, 28 aa, Plasmodium falciparum
ENEKKDFSTFSFDINKYTSWADIVDEYD

SEQ ID NO: 3381792 - protein, 23 aa, Plasmodium falciparum
ENEKKFLLRFLENKKNIELEYKK

SEQ ID NO: 3381793 - protein, 24 aa, Plasmodium falciparum
ENEKQIHFILPQWSNQINEYIIFL

SEQ ID NO: 3381794 - protein, 23 aa, Plasmodium falciparum
ENEKYHYFYVHNIEYDNSKYDIV

SEQ ID NO: 3381795 - protein, 25 aa, Plasmodium falciparum
ENELSFIYQTFLVQFKKFDTSDSGY

SEQ ID NO: 3381796 - protein, 24 aa, Plasmodium falciparum
ENELYEILCKVGVVRNVRIKYDVD

SEQ ID NO: 3381797 - protein, 26 aa, Plasmodium falciparum
ENENLAIFRSFFPKILLNIYSKCENP

SEQ ID NO: 3381798 - protein, 49 aa, Plasmodium falciparum
ENEVNPLVPSSISNTLDTLTFYQLILIIISIVNFCRKKSQTYNKNFEEK

SEQ ID NO: 3381799 - protein, 28 aa, Plasmodium falciparum
ENFDLLLKTFIPDIVYRKLSLGCNIFFN

SEQ ID NO: 3381800 - protein, 24 aa, Plasmodium falciparum
ENFDNVWFIKQYIPNSCGTIALLH

SEQ ID NO: 3381801 - protein, 19 aa, Plasmodium falciparum
ENFFLYYENVLLHLKNKNT

SEQ ID NO: 3381802 - protein, 28 aa, Plasmodium falciparum
ENFILSPSMLYLLINKQLKKYDLETIFK

SEQ ID NO: 3381803 - protein, 23 aa, Plasmodium falciparum
ENFKEIYVLYNKLLNLNKDETLT

SEQ ID NO: 3381804 - protein, 17 aa, Plasmodium falciparum
ENFKIDRVTPAFSRALQ

SEQ ID NO: 3381805 - protein, 26 aa, Plasmodium falciparum
ENFKSCYRINPPFFPQNINIDMMLYK

SEQ ID NO: 3381806 - protein, 20 aa, Plasmodium falciparum
ENFLFTFKNNKLNNNNNYTN

SEQ ID NO: 3381807 - protein, 26 aa, Plasmodium falciparum
ENFRCPICMLILFKPVKTKCGHIFCR

SEQ ID NO: 3381808 - protein, 18 aa, Plasmodium falciparum
ENFYLKDDVLYITEILIG

SEQ ID NO: 3381809 - protein, 20 aa, Plasmodium falciparum
ENFYTTFIYTPSQIALYCFT

SEQ ID NO: 3381810 - protein, 34 aa, Plasmodium falciparum
ENGIPKINILKNNENYIPLDIALNFVMDNEKLKK

SEQ ID NO: 3381811 - protein, 26 aa, Plasmodium falciparum
ENGKMKFHFLNKFEFLFSVLKEYENK

SEQ ID NO: 3381812 - protein, 30 aa, Plasmodium falciparum
ENGLRQFYNILYNIYKKRAYMLIKGYNKKV

SEQ ID NO: 3381813 - protein, 17 aa, Plasmodium falciparum
ENGLVCLWGLNSYGQLG

SEQ ID NO: 3381814 - protein, 22 aa, Plasmodium falciparum
ENGTINFFDLLKSSVIEWIDVN

SEQ ID NO: 3381815 - protein, 28 aa, Plasmodium falciparum
ENGTYHCYPIHLLKLNRSFLKNNSMFTL

SEQ ID NO: 3381816 - protein, 30 aa, Plasmodium falciparum
ENHEDYILNDTLKFCDQLKYPHLSEETSLI

SEQ ID NO: 3381817 - protein, 17 aa, Plasmodium falciparum
ENIFFRDKLINEELMNI

SEQ ID NO: 3381818 - protein, 25 aa, Plasmodium falciparum
ENIGNPWEKLKLLKKGNNKKNDGHT

SEQ ID NO: 3381819 - protein, 18 aa, Plasmodium falciparum
ENIINYEDLLYNNDLKEK

SEQ ID NO: 3381820 - protein, 19 aa, Plasmodium falciparum
ENIKECIIFLIGGGNYIEV

SEQ ID NO: 3381821 - protein, 35 aa, Plasmodium falciparum
ENIKLIKHVQWSPNNRFIVFFFSYEEEKHNRLGNL

SEQ ID NO: 3381822 - protein, 25 aa, Plasmodium falciparum
ENIKNTLLKELLIANKNGSIDPHEI

SEQ ID NO: 3381823 - protein, 19 aa, Plasmodium falciparum
ENIKRPSQYMNNMSYLGNV

SEQ ID NO: 3381824 - protein, 26 aa, Plasmodium falciparum
ENILDTLPLHPGHPLEFIHLQNKWIN

SEQ ID NO: 3381825 - protein, 23 aa, Plasmodium falciparum
ENILIEWFVCIKCLFLVDKNIIL

SEQ ID NO: 3381826 - protein, 17 aa, Plasmodium falciparum
ENILIKLKDREEDASLS

SEQ ID NO: 3381827 - protein, 25 aa, Plasmodium falciparum
ENIMLIELNLKIELDKLKSTFSKHV

SEQ ID NO: 3381828 - protein, 27 aa, Plasmodium falciparum
ENIMPIHAKLKNKFYIKSLTKEDKVHP

SEQ ID NO: 3381829 - protein, 24 aa, Plasmodium falciparum
ENINDQWCMFWNDIGHITKKKEGS

SEQ ID NO: 3381830 - protein, 25 aa, Plasmodium falciparum
ENINKEIFVLFSRYVHNIKQQKKII

SEQ ID NO: 3381831 - protein, 36 aa, Plasmodium falciparum
ENINMDLIKSRYRKLSILIHPDKCKIDKAAEAFHIL

SEQ ID NO: 3381832 - protein, 17 aa, Plasmodium falciparum
ENINNVDFLYLNVLIHN

SEQ ID NO: 3381833 - protein, 24 aa, Plasmodium falciparum
ENINSVLNILLFLYDTFNKNKNLN

SEQ ID NO: 3381834 - protein, 32 aa, Plasmodium falciparum
ENIRSLVNHIKKYDIRYINRIVELIEEKRKKV

SEQ ID NO: 3381835 - protein, 17 aa, Plasmodium falciparum
ENISKKQFFSFYEKAFT

SEQ ID NO: 3381836 - protein, 23 aa, Plasmodium falciparum
ENKDDMSFIYNQINIKNDKQEYV

SEQ ID NO: 3381837 - protein, 26 aa, Plasmodium falciparum
ENKEDTYIFYIRDIGTYKKWMNILKR

SEQ ID NO: 3381838 - protein, 32 aa, Plasmodium falciparum
ENKELLIKNYFFFFKYFNFYNSMINFGLSICQ

SEQ ID NO: 3381839 - protein, 20 aa, Plasmodium falciparum
ENKFMYLKRNRALANIMYKH

SEQ ID NO: 3381840 - protein, 17 aa, Plasmodium falciparum
ENKFYVIRKDRFLLKYP

SEQ ID NO: 3381841 - protein, 26 aa, Plasmodium falciparum
ENKGYLTLEDFFICCRLVAHAQNGNV

SEQ ID NO: 3381842 - protein, 20 aa, Plasmodium falciparum
ENKILNCNTIIPYTGTNNNN

SEQ ID NO: 3381843 - protein, 22 aa, Plasmodium falciparum
ENKIYMFGGFSKGVRNNKLKIY

SEQ ID NO: 3381844 - protein, 22 aa, Plasmodium falciparum
ENKKFIWEGMIYGLTYHLKDEN

SEQ ID NO: 3381845 - protein, 26 aa, Plasmodium falciparum
ENKKKQIDMLLKLANYRLAIEKAILS

SEQ ID NO: 3381846 - protein, 18 aa, Plasmodium falciparum
ENKKLKYILDIPSMVLYS

SEQ ID NO: 3381847 - protein, 28 aa, Plasmodium falciparum
ENKKVIAIVPWQIDLTSFALAKSSIDEE

SEQ ID NO: 3381848 - protein, 26 aa, Plasmodium falciparum
ENKLIDIILHPILPHETVPWKSEEYN

SEQ ID NO: 3381849 - protein, 22 aa, Plasmodium falciparum
ENKLIDLWKNYNVQYELTENIK

SEQ ID NO: 3381850 - protein, 17 aa, Plasmodium falciparum
ENKLKFLDYIDPNIMKK

SEQ ID NO: 3381851 - protein, 19 aa, Plasmodium falciparum
ENKLLERNYNKIKTKYRNV

SEQ ID NO: 3381852 - protein, 24 aa, Plasmodium falciparum
ENKNIYVSILIHLSYIYKNISIDQ

SEQ ID NO: 3381853 - protein, 34 aa, Plasmodium falciparum
ENKQSYLLDLAYPLLFKRKFILKKIKTNEKLNKI

SEQ ID NO: 3381854 - protein, 36 aa, Plasmodium falciparum
ENKRLPIWIDKNYNSPYLFWNFLRNVEDQKVQSYID

SEQ ID NO: 3381855 - protein, 25 aa, Plasmodium falciparum
ENKSCIICCNKWDLIYNKNDIFNDT

SEQ ID NO: 3381856 - protein, 36 aa, Plasmodium falciparum
ENKSLENYFKITFYCLCGYLQYIKDDSDWKQIINCY

SEQ ID NO: 3381857 - protein, 27 aa, Plasmodium falciparum
ENLFTTFSNAFHIPKINNNIKSTHNDI

SEQ ID NO: 3381858 - protein, 20 aa, Plasmodium falciparum
ENLHLISDQLGWFQDGKTNI

SEQ ID NO: 3381859 - protein, 30 aa, Plasmodium falciparum
ENLHNIIQYNKFPLFKRTKSSILLKRNNNE

SEQ ID NO: 3381860 - protein, 20 aa, Plasmodium falciparum
ENLIQQELFPLVIQKNKNKM

SEQ ID NO: 3381861 - protein, 28 aa, Plasmodium falciparum
ENLKFYFKQFKHMHNFLPFISEMLNKSS

SEQ ID NO: 3381862 - protein, 20 aa, Plasmodium falciparum
ENLKIFFRFISMMVPDRQII

SEQ ID NO: 3381863 - protein, 24 aa, Plasmodium falciparum
ENLKKLNDLYNFKYNNFYEESVKL

SEQ ID NO: 3381864 - protein, 35 aa, Plasmodium falciparum
ENLSSNMNEAFLYFIQLLQGMWYIQEMNIVHRDLK

SEQ ID NO: 3381865 - protein, 21 aa, Plasmodium falciparum
ENLTFLQIIQYLCSKIEKLQT

SEQ ID NO: 3381866 - protein, 17 aa, Plasmodium falciparum
ENLVIRRYNFVLGNELQ

SEQ ID NO: 3381867 - protein, 24 aa, Plasmodium falciparum
ENMINKYILKCYENFLNNLTKNEI

SEQ ID NO: 3381868 - protein, 26 aa, Plasmodium falciparum
ENMKKEKINLLSKFKAYTLNNKKELE

SEQ ID NO: 3381869 - protein, 27 aa, Plasmodium falciparum
ENMKLLKEHFYVDGKLIYKCHIQYVDN

SEQ ID NO: 3381870 - protein, 18 aa, Plasmodium falciparum
ENMLAYLKKLQEEFKLEE

SEQ ID NO: 3381871 - protein, 23 aa, Plasmodium falciparum
ENMLDTVLYCRDKWLKEGGLIFP

SEQ ID NO: 3381872 - protein, 23 aa, Plasmodium falciparum
ENMLLDYSLLFGIHYRELSKDVV

SEQ ID NO: 3381873 - protein, 31 aa, Plasmodium falciparum
ENMNMQDVVILIIKIQELVRMDPQTAIKMLN

SEQ ID NO: 3381874 - protein, 18 aa, Plasmodium falciparum
ENNFYNSNELFLNIINDC

SEQ ID NO: 3381875 - protein, 26 aa, Plasmodium falciparum
ENNINITLYMLIMKHDVSIDEGILKY

SEQ ID NO: 3381876 - protein, 36 aa, Plasmodium falciparum
ENNKILLWSEKYPNQIILLCLQILWTTNIENELINF

SEQ ID NO: 3381877 - protein, 26 aa, Plasmodium falciparum
ENNKLLDKNILINNFLNSEKLIKEIQ

SEQ ID NO: 3381878 - protein, 25 aa, Plasmodium falciparum
ENNKLMLPSFYEFYQKYGYKPCIGN

SEQ ID NO: 3381879 - protein, 24 aa, Plasmodium falciparum
ENNKNNIFSLQNLGAMDIIKSSSR

SEQ ID NO: 3381880 - protein, 33 aa, Plasmodium falciparum
ENNKQIQKHFPVCKFGFHEARQLALEFRNLKIN

SEQ ID NO: 3381881 - protein, 23 aa, Plasmodium falciparum
ENNKYFYNKDKLLFDHENGTIPR

SEQ ID NO: 3381882 - protein, 25 aa, Plasmodium falciparum
ENNLDTFINIFPNIYNILNNTESKI

SEQ ID NO: 3381883 - protein, 26 aa, Plasmodium falciparum
ENNLSDTLIMLKTTIVAVTTSKGEAL

SEQ ID NO: 3381884 - protein, 24 aa, Plasmodium falciparum
ENNNIICYPNIEHTTRQICKNNII

SEQ ID NO: 3381885 - protein, 17 aa, Plasmodium falciparum
ENNNYYIKIKKNKYKKL

SEQ ID NO: 3381886 - protein, 22 aa, Plasmodium falciparum
ENNQFQALYKKDGQWYDCIISK

SEQ ID NO: 3381887 - protein, 28 aa, Plasmodium falciparum
ENNRKIYKSIFWYQFLNENEELLVARGG

SEQ ID NO: 3381888 - protein, 25 aa, Plasmodium falciparum
ENNTYILTYIMSRFLNLSRSIFNAC

SEQ ID NO: 3381889 - protein, 21 aa, Plasmodium falciparum
ENNYFLLITNKNILKVLDSEK

SEQ ID NO: 3381890 - protein, 25 aa, Plasmodium falciparum
ENNYKLIHCLKWTRVYIRRKDDNTM

SEQ ID NO: 3381891 - protein, 47 aa, Plasmodium falciparum
ENNYNHCKYYLNEKRILKTCTKYFMDNFLSLIDKKINIKNIIPYMKK

SEQ ID NO: 3381892 - protein, 20 aa, Plasmodium falciparum
ENPTFLEIQFKKSLLENENI

SEQ ID NO: 3381893 - protein, 17 aa, Plasmodium falciparum
ENQERFILIDTLKKKKL

SEQ ID NO: 3381894 - protein, 18 aa, Plasmodium falciparum
ENQFFGEVSLIFNTLRTC

SEQ ID NO: 3381895 - protein, 23 aa, Plasmodium falciparum
ENQIKFVNAYIYLCYEKKNFKEI

SEQ ID NO: 3381896 - protein, 29 aa, Plasmodium falciparum
ENQIKIYLYQLIRATLYLHSLCITHRDIK

SEQ ID NO: 3381897 - protein, 35 aa, Plasmodium falciparum
ENQIKQFINVRKNIRKYILKSFKKDQIINGRLENS

SEQ ID NO: 3381898 - protein, 18 aa, Plasmodium falciparum
ENQNIFNLIKRIKNYNFK

SEQ ID NO: 3381899 - protein, 23 aa, Plasmodium falciparum
ENRNCIYTYIGYILLSVNPYENF

SEQ ID NO: 3381900 - protein, 20 aa, Plasmodium falciparum
ENRQIRLIDWGLAEFYHPGQ

SEQ ID NO: 3381901 - protein, 31 aa, Plasmodium falciparum
ENRYMKKYLNKIMNMSILRRHFNNVNSSVYI

SEQ ID NO: 3381902 - protein, 26 aa, Plasmodium falciparum
ENSDYIRFAPLRNIIKNFTFIKFNNA

SEQ ID NO: 3381903 - protein, 17 aa, Plasmodium falciparum
ENSFFKDNALSQKSIEN

SEQ ID NO: 3381904 - protein, 28 aa, Plasmodium falciparum
ENSKKKLMNILPLLKIEKPEEIDINFIR

SEQ ID NO: 3381905 - protein, 24 aa, Plasmodium falciparum
ENSKNFMNVYKTLLNQWKYEFKNQ

SEQ ID NO: 3381906 - protein, 26 aa, Plasmodium falciparum
ENSKYIYKLIPFFKNGEAQFYVRVNE

SEQ ID NO: 3381907 - protein, 21 aa, Plasmodium falciparum
ENSLLHIIILDEIDAICRQRG

SEQ ID NO: 3381908 - protein, 28 aa, Plasmodium falciparum
ENSLYNLAYQGIIPLLKNKNIKNVQIPK

SEQ ID NO: 3381909 - protein, 23 aa, Plasmodium falciparum
ENSNISYFSMFICKVKQVEFYKK

SEQ ID NO: 3381910 - protein, 25 aa, Plasmodium falciparum
ENSNSLITLFENMKPIFDNKNNQNY

SEQ ID NO: 3381911 - protein, 25 aa, Plasmodium falciparum
ENSSYIPYRDSKLTRLLQDSLGGKT

SEQ ID NO: 3381912 - protein, 22 aa, Plasmodium falciparum
ENSYFNFTLNNFNYFECFYNDI

SEQ ID NO: 3381913 - protein, 35 aa, Plasmodium falciparum
ENTKETMKIFLFLDQKIPFFELSPELKDFMKSSEE

SEQ ID NO: 3381914 - protein, 30 aa, Plasmodium falciparum
ENTKLNIEIKSLLSFNNNLSYALKEKDAEI

SEQ ID NO: 3381915 - protein, 24 aa, Plasmodium falciparum
ENTKSIYDYLNTVNYKLVNEKHVQ

SEQ ID NO: 3381916 - protein, 17 aa, Plasmodium falciparum
ENTLFNDIIPQYDYKRI

SEQ ID NO: 3381917 - protein, 25 aa, Plasmodium falciparum
ENTLKLFFNQIFALLQYSTDRRVVY

SEQ ID NO: 3381918 - protein, 25 aa, Plasmodium falciparum
ENTPPKYICGYKFNIFYTNLINKNH

SEQ ID NO: 3381919 - protein, 27 aa, Plasmodium falciparum
ENTSFLNVYVHLFDIFKKSVDKMLNII

SEQ ID NO: 3381920 - protein, 29 aa, Plasmodium falciparum
ENVCKYYLIDFCPHDLFPNTKSDIGRCKN

SEQ ID NO: 3381921 - protein, 23 aa, Plasmodium falciparum
ENVDFFNHSFFENLNLENKKKGY

SEQ ID NO: 3381922 - protein, 26 aa, Plasmodium falciparum
ENVEILPLKVLFDFIVSSSLPDDIVY

SEQ ID NO: 3381923 - protein, 20 aa, Plasmodium falciparum
ENVFLVRNILTQVLGIRNKT

SEQ ID NO: 3381924 - protein, 24 aa, Plasmodium falciparum
ENVPNNYIFPINKNLYEGIHVYKK

SEQ ID NO: 3381925 - protein, 23 aa, Plasmodium falciparum
ENVQSYIKMIYKNRKKSLQHISN

SEQ ID NO: 3381926 - protein, 25 aa, Plasmodium falciparum
ENVSNIYFQYLKTSSIIIYEKKLKD

SEQ ID NO: 3381927 - protein, 26 aa, Plasmodium falciparum
ENVSNIYFQYLKTSSIIIYEKKLKDL

SEQ ID NO: 3381928 - protein, 22 aa, Plasmodium falciparum
ENVYGPQWIRCDLRNFDLSIFN

SEQ ID NO: 3381929 - protein, 22 aa, Plasmodium falciparum
ENYDLDFQYIKSILNSCNIILN

SEQ ID NO: 3381930 - protein, 20 aa, Plasmodium falciparum
ENYEHIMNSLNLDNTLIQNK

SEQ ID NO: 3381931 - protein, 25 aa, Plasmodium falciparum
ENYHNFCPVLLEPIMLVEIISNYEH

SEQ ID NO: 3381932 - protein, 28 aa, Plasmodium falciparum
ENYKEQTFILICPMIINIKTVRLESFHK

SEQ ID NO: 3381933 - protein, 28 aa, Plasmodium falciparum
ENYKNLVDCYYLLLKKFKTKSSYVIDEF

SEQ ID NO: 3381934 - protein, 17 aa, Plasmodium falciparum
ENYLIQCDVLYPYIDEI

SEQ ID NO: 3381935 - protein, 24 aa, Plasmodium falciparum
ENYNLNVLFFFISTSSHGSFPNNS

SEQ ID NO: 3381936 - protein, 22 aa, Plasmodium falciparum
ENYNPLLIYHNEWNHFLKDQKE

SEQ ID NO: 3381937 - protein, 23 aa, Plasmodium falciparum
ENYRNEFLFPKDEKNRYYSSYMK

SEQ ID NO: 3381938 - protein, 25 aa, Plasmodium falciparum
ENYSRNMILQLLYIYYMCNICECFN

SEQ ID NO: 3381939 - protein, 17 aa, Plasmodium falciparum
ENYSRYFKNSCSLILSS

SEQ ID NO: 3381940 - protein, 26 aa, Plasmodium falciparum
EPAKTPEFTFWYYELKEMKGFQDLVM

SEQ ID NO: 3381941 - protein, 32 aa, Plasmodium falciparum
EPEMDYIFKDIYQFYFTSILYNSIIQNLASEQ

SEQ ID NO: 3381942 - protein, 17 aa, Plasmodium falciparum
EPFFISKEDAHSIKNDD

SEQ ID NO: 3381943 - protein, 18 aa, Plasmodium falciparum
EPIQQVNDFLLYNNNILE

SEQ ID NO: 3381944 - protein, 20 aa, Plasmodium falciparum
EPKGRYAWLEEKCFTGKKKR

SEQ ID NO: 3381945 - protein, 20 aa, Plasmodium falciparum
EPLDSSLDDIFSFFKKFENV

SEQ ID NO: 3381946 - protein, 25 aa, Plasmodium falciparum
EPLFDYNYIFVQKPIILEKRKNNII

SEQ ID NO: 3381947 - protein, 18 aa, Plasmodium falciparum
EPLHNYYEEPNAWRLSRR

SEQ ID NO: 3381948 - protein, 27 aa, Plasmodium falciparum
EPLKKKNIFNLFNTNALYTTLKKTNEE

SEQ ID NO: 3381949 - protein, 21 aa, Plasmodium falciparum
EPNCKVYILAYLDNLRTRNIN

SEQ ID NO: 3381950 - protein, 31 aa, Plasmodium falciparum
EPNCSYLIFNPLTKFILHPYHKIDICLSETI

SEQ ID NO: 3381951 - protein, 17 aa, Plasmodium falciparum
EPNILLKLPHEEKKIAE

SEQ ID NO: 3381952 - protein, 19 aa, Plasmodium falciparum
EPNMNFKYSRINRIGGNYI

SEQ ID NO: 3381953 - protein, 29 aa, Plasmodium falciparum
EPNNSRDIIFYFIPGIPIDIIDNILIKIC

SEQ ID NO: 3381954 - protein, 21 aa, Plasmodium falciparum
EPPDGYCFVLFMVDPDYPSRL

SEQ ID NO: 3381955 - protein, 21 aa, Plasmodium falciparum
EPPKLLLGRPKNTLKMGLVGL

SEQ ID NO: 3381956 - protein, 17 aa, Plasmodium falciparum
EPRLFIYELMKKYKVTH

SEQ ID NO: 3381957 - protein, 35 aa, Plasmodium falciparum
EPRYAHSLIFSFYGNAKLVFLFGGNKKGYNAALGD

SEQ ID NO: 3381958 - protein, 24 aa, Plasmodium falciparum
EQCCYYIYVNNISYGPYLVDQVIQ

SEQ ID NO: 3381959 - protein, 30 aa, Plasmodium falciparum
EQCMALLREKICINNQIAYMIKHDYEKLKK

SEQ ID NO: 3381960 - protein, 17 aa, Plasmodium falciparum
EQCSYQMNSPYNPAPSI

SEQ ID NO: 3381961 - protein, 26 aa, Plasmodium falciparum
EQDFKNFICKYILNNKINDIQNNMHI

SEQ ID NO: 3381962 - protein, 23 aa, Plasmodium falciparum
EQDHLSVIYIYEILYNTNDNNNN

SEQ ID NO: 3381963 - protein, 26 aa, Plasmodium falciparum
EQEDYPFYCNKNRVLPLDYACLKVKN

SEQ ID NO: 3381964 - protein, 23 aa, Plasmodium falciparum
EQELKQLFNPFGDILDVEIHRDP

SEQ ID NO: 3381965 - protein, 19 aa, Plasmodium falciparum
EQEPYITQEPYITQEPVTT

SEQ ID NO: 3381966 - protein, 25 aa, Plasmodium falciparum
EQFILDKFQMIFISATLNHAMKTLA

SEQ ID NO: 3381967 - protein, 46 aa, Plasmodium falciparum
EQFSLNWRRYCRTIPLRGAILLNHDLRKCLLVKGWSTDSWSFPRGK

SEQ ID NO: 3381968 - protein, 24 aa, Plasmodium falciparum
EQIAKICIRLPNGIRIQNNFGLSN

SEQ ID NO: 3381969 - protein, 33 aa, Plasmodium falciparum
EQIHREWMKIMLKLFYNILYDTTYNVIGKLFKE

SEQ ID NO: 3381970 - protein, 23 aa, Plasmodium falciparum
EQIKEFYIQLIDYKKSKIININS

SEQ ID NO: 3381971 - protein, 18 aa, Plasmodium falciparum
EQILYRKLFIHRYKNMIT

SEQ ID NO: 3381972 - protein, 24 aa, Plasmodium falciparum
EQKKKYFCNILLKITQKKEHQPFQ

SEQ ID NO: 3381973 - protein, 23 aa, Plasmodium falciparum
EQKKLFVQIDILKSQVDQKQNII

SEQ ID NO: 3381974 - protein, 24 aa, Plasmodium falciparum
EQKMKYFSSLSYKLAGKVIEYKES

SEQ ID NO: 3381975 - protein, 38 aa, Plasmodium falciparum
EQKNIFTWGILPVRAFDHPNIFVPLPCGFKHNNKNLAY

SEQ ID NO: 3381976 - protein, 22 aa, Plasmodium falciparum
EQKPIFGKCRFTIRSFGVRRNE

SEQ ID NO: 3381977 - protein, 20 aa, Plasmodium falciparum
EQLFSILYYMYKTGYSKPKI

SEQ ID NO: 3381978 - protein, 48 aa, Plasmodium falciparum
EQMHKNKVRGNMLFVGELVKSGIISIPIVFVCIKQLLEKRESYISIKN

SEQ ID NO: 3381979 - protein, 21 aa, Plasmodium falciparum
EQMISPFIKDDIIKHKQYCIN

SEQ ID NO: 3381980 - protein, 21 aa, Plasmodium falciparum
EQMKLLQNNILLYDLSNKINY

SEQ ID NO: 3381981 - protein, 26 aa, Plasmodium falciparum
EQMSKLNIFGNINIDIEKLRKSLNKN

SEQ ID NO: 3381982 - protein, 26 aa, Plasmodium falciparum
EQNDEEIFFILTSLFSTHDGKFVFIK

SEQ ID NO: 3381983 - protein, 25 aa, Plasmodium falciparum
EQNKFSYYMLNKKMSTLLKKINNHI

SEQ ID NO: 3381984 - protein, 24 aa, Plasmodium falciparum
EQNSFKLFNLIRQNKKRNTPTLYA

SEQ ID NO: 3381985 - protein, 19 aa, Plasmodium falciparum
EQNVLPIRNNLCETSHMNL

SEQ ID NO: 3381986 - protein, 23 aa, Plasmodium falciparum
EQNYFDKIYNNLQSRDFRFTGVG

SEQ ID NO: 3381987 - protein, 25 aa, Plasmodium falciparum
EQNYKNFMQYCSIPGFNSVLFSQRV

SEQ ID NO: 3381988 - protein, 21 aa, Plasmodium falciparum
EQQFHNILKSINDIKYILNEE

SEQ ID NO: 3381989 - protein, 25 aa, Plasmodium falciparum
EQQRERLFHYNMTKGVVSFIDSFEH

SEQ ID NO: 3381990 - protein, 30 aa, Plasmodium falciparum
EQRYKNMKYYFSTILKKKPCYNKLNIQTND

SEQ ID NO: 3381991 - protein, 26 aa, Plasmodium falciparum
EQSCYNPFTIFGSAPSLLDFDEVFDK

SEQ ID NO: 3381992 - protein, 27 aa, Plasmodium falciparum
EQSNDLLSLLPHDFNKENFYLNIKNME

SEQ ID NO: 3381993 - protein, 20 aa, Plasmodium falciparum
EQVKKAMILAYNNPNRAIDY

SEQ ID NO: 3381994 - protein, 18 aa, Plasmodium falciparum
EQVKKLMKLILNVKKEDS

SEQ ID NO: 3381995 - protein, 24 aa, Plasmodium falciparum
EQVKKNSLFYFKCKEEINLKDGNI

SEQ ID NO: 3381996 - protein, 27 aa, Plasmodium falciparum
ERANMIIHNVIFGKLWVELHGNIIIRN

SEQ ID NO: 3381997 - protein, 23 aa, Plasmodium falciparum
ERCFKFLRFLIKHKEKHLSLSEL

SEQ ID NO: 3381998 - protein, 17 aa, Plasmodium falciparum
ERCLFDHHKIIFKLLIS

SEQ ID NO: 3381999 - protein, 21 aa, Plasmodium falciparum
ERDIYEFFSEVAGKVRDIQCI

SEQ ID NO: 3382000 - protein, 24 aa, Plasmodium falciparum
EREEQIYEFILATKPSIFEIINDK

SEQ ID NO: 3382001 - protein, 28 aa, Plasmodium falciparum
ERETLYILNSILFYSYKLKNRLNILINK

SEQ ID NO: 3382002 - protein, 25 aa, Plasmodium falciparum
ERFIEYAVCFFGHKIGYFSGNIKEL

SEQ ID NO: 3382003 - protein, 21 aa, Plasmodium falciparum
ERFWVNSYIYNFINYCLLTYY

SEQ ID NO: 3382004 - protein, 26 aa, Plasmodium falciparum
ERGKGIVEFVSYDDMLYAIEKFDGAE

SEQ ID NO: 3382005 - protein, 31 aa, Plasmodium falciparum
ERHKTILFYGYKNILKYIYLDYDNFLNLNNV

SEQ ID NO: 3382006 - protein, 39 aa, Plasmodium falciparum
ERIFDQIKELNFHFPKSVSLLAQELILKLCSRTAEERIS

SEQ ID NO: 3382007 - protein, 19 aa, Plasmodium falciparum
ERIGWIFTHLPRQEYLTSD

SEQ ID NO: 3382008 - protein, 25 aa, Plasmodium falciparum
ERIHKINHFICNGPYINSKVCHLSP

SEQ ID NO: 3382009 - protein, 19 aa, Plasmodium falciparum
ERINIYLCFVLTVEIHIWS

SEQ ID NO: 3382010 - protein, 30 aa, Plasmodium falciparum
ERIVLPSEEYLYYINLFNLNDKFDNQYIDN

SEQ ID NO: 3382011 - protein, 23 aa, Plasmodium falciparum
ERKCSKLGFIEKCTKIFKMKNDE

SEQ ID NO: 3382012 - protein, 26 aa, Plasmodium falciparum
ERKKPQILYTPEYWGRKQEVKQIKHE

SEQ ID NO: 3382013 - protein, 19 aa, Plasmodium falciparum
ERKKRINSYDWNKQIRLYE

SEQ ID NO: 3382014 - protein, 26 aa, Plasmodium falciparum
ERKNKLMYKLIDNMKRYGDKNEPSHI

SEQ ID NO: 3382015 - protein, 24 aa, Plasmodium falciparum
ERKNLRYIFISIMPKLKILNHSSI

SEQ ID NO: 3382016 - protein, 24 aa, Plasmodium falciparum
ERLHAWVERYITQNPSMCMRKDEK

SEQ ID NO: 3382017 - protein, 48 aa, Plasmodium falciparum
ERLKNVLEIFGYIIHIEYKWSIDKWSYAFVYFIDEKCAINAVNFLNQK

SEQ ID NO: 3382018 - protein, 21 aa, Plasmodium falciparum
ERLTLIRKKIQIIQNTQGLSD

SEQ ID NO: 3382019 - protein, 26 aa, Plasmodium falciparum
ERMANNFIYVFKKKQPSKFGWVAEIR

SEQ ID NO: 3382020 - protein, 18 aa, Plasmodium falciparum
ERNDFYCRNNLNDSFDSL

SEQ ID NO: 3382021 - protein, 23 aa, Plasmodium falciparum
ERNFKLFCSTIKREPIRIEEEKR

SEQ ID NO: 3382022 - protein, 25 aa, Plasmodium falciparum
ERNHSENMSIYMKNVMHANDKLSNS

SEQ ID NO: 3382023 - protein, 24 aa, Plasmodium falciparum
ERNIFEISVLYFRALYTPNHFNEN

SEQ ID NO: 3382024 - protein, 18 aa, Plasmodium falciparum
ERNKLYYKFVLTGFSNII

SEQ ID NO: 3382025 - protein, 18 aa, Plasmodium falciparum
ERNVDILHDLNNISYEYF

SEQ ID NO: 3382026 - protein, 19 aa, Plasmodium falciparum
ERPIGVFHALAISKGNSVR

SEQ ID NO: 3382027 - protein, 23 aa, Plasmodium falciparum
ERQTFQLLQLARQISHIKTEQDI

SEQ ID NO: 3382028 - protein, 26 aa, Plasmodium falciparum
ERQVKSLLNKLTVENFPIITEKMCQI

SEQ ID NO: 3382029 - protein, 26 aa, Plasmodium falciparum
ERQYYLHGIQLLRDPALKSSKKYKIL

SEQ ID NO: 3382030 - protein, 24 aa, Plasmodium falciparum
ERRLKKLILFAEHEILIEADVICC

SEQ ID NO: 3382031 - protein, 27 aa, Plasmodium falciparum
ERSFPFPVDVYVKCLHFLKLETILKCE

SEQ ID NO: 3382032 - protein, 39 aa, Plasmodium falciparum
ERSIVAICLFLCLNKIDNFSFFFFDEIDAALDTIHRDNL

SEQ ID NO: 3382033 - protein, 20 aa, Plasmodium falciparum
ERTCKINEFITVCTICHDYI

SEQ ID NO: 3382034 - protein, 22 aa, Plasmodium falciparum
ERTILLLMKSLLDIYYKNKESE

SEQ ID NO: 3382035 - protein, 22 aa, Plasmodium falciparum
ERTKEFWIRMNKHSMNAGFTTL

SEQ ID NO: 3382036 - protein, 24 aa, Plasmodium falciparum
ERYASIVPLYYRGATCAIVVFDIS

SEQ ID NO: 3382037 - protein, 23 aa, Plasmodium falciparum
ERYKNSLRLCLKSARNTQHMNEL

SEQ ID NO: 3382038 - protein, 21 aa, Plasmodium falciparum
ERYRAITSAYYRGAVGALLVY

SEQ ID NO: 3382039 - protein, 17 aa, Plasmodium falciparum
ESAIPYPYYLIVDENIN

SEQ ID NO: 3382040 - protein, 20 aa, Plasmodium falciparum
ESAQFFSYLKNIVGDQYKLS

SEQ ID NO: 3382041 - protein, 17 aa, Plasmodium falciparum
ESDFFSNSDYPKLDEKN

SEQ ID NO: 3382042 - protein, 25 aa, Plasmodium falciparum
ESDFRINYHLFYSTDLCWSNNGKYL

SEQ ID NO: 3382043 - protein, 26 aa, Plasmodium falciparum
ESDVDIYILFDGHLLKYEFSFDIRLN

SEQ ID NO: 3382044 - protein, 25 aa, Plasmodium falciparum
ESDVWSFAVSLWEALTKKIAYDGIS

SEQ ID NO: 3382045 - protein, 33 aa, Plasmodium falciparum
ESEKILCDIINDNFNMTIKVSSLNDLPYFFDEE

SEQ ID NO: 3382046 - protein, 23 aa, Plasmodium falciparum
ESENWILASLYSGKLVIFDYVNQ

SEQ ID NO: 3382047 - protein, 24 aa, Plasmodium falciparum
ESEVVIHFIEFLHYIFMSENMTQW

SEQ ID NO: 3382048 - protein, 32 aa, Plasmodium falciparum
ESFDHLKFLSIPWFFFLQTQWIKNLDLLLNKN

SEQ ID NO: 3382049 - protein, 19 aa, Plasmodium falciparum
ESFFILKELESLAPKKGIR

SEQ ID NO: 3382050 - protein, 17 aa, Plasmodium falciparum
ESFFLNKTYDELVKYEY

SEQ ID NO: 3382051 - protein, 19 aa, Plasmodium falciparum
ESFFSPNKIFTIRKGKKNK

SEQ ID NO: 3382052 - protein, 17 aa, Plasmodium falciparum
ESFLLADRNFDGHISSN

SEQ ID NO: 3382053 - protein, 29 aa, Plasmodium falciparum
ESGIWIYDSFLYISKNLRLYIYTKKFIDI

SEQ ID NO: 3382054 - protein, 22 aa, Plasmodium falciparum
ESHEGPFFWSYVDSIIFLDPGF

SEQ ID NO: 3382055 - protein, 17 aa, Plasmodium falciparum
ESIFSSSKKIKYRQAFI

SEQ ID NO: 3382056 - protein, 21 aa, Plasmodium falciparum
ESIKLWLCKFSLNSISECSCV

SEQ ID NO: 3382057 - protein, 19 aa, Plasmodium falciparum
ESIKTFFYPCPCGDIFEVT

SEQ ID NO: 3382058 - protein, 17 aa, Plasmodium falciparum
ESIKTYHIMLLKNITNI

SEQ ID NO: 3382059 - protein, 25 aa, Plasmodium falciparum
ESINYIMNILNYIYSQIISLLTKSI

SEQ ID NO: 3382060 - protein, 23 aa, Plasmodium falciparum
ESISKFVQLLKSIDIKMVVFDFD

SEQ ID NO: 3382061 - protein, 32 aa, Plasmodium falciparum
ESISSFNYFFFAKKNKRILFISCITKPKYKNQ

SEQ ID NO: 3382062 - protein, 21 aa, Plasmodium falciparum
ESIVLRLKRLLILSGEQEAEL

SEQ ID NO: 3382063 - protein, 19 aa, Plasmodium falciparum
ESIWKLPKKYKLLKKSYVE

SEQ ID NO: 3382064 - protein, 17 aa, Plasmodium falciparum
ESKKYIYNCINYAYDLG

SEQ ID NO: 3382065 - protein, 20 aa, Plasmodium falciparum
ESKLYLLKRNLYQQHLKLRN

SEQ ID NO: 3382066 - protein, 28 aa, Plasmodium falciparum
ESKNMTLRILIEVYLRRLQINNFSIICE

SEQ ID NO: 3382067 - protein, 25 aa, Plasmodium falciparum
ESKNRPFEYLRLTSLGVIGALVKVD

SEQ ID NO: 3382068 - protein, 23 aa, Plasmodium falciparum
ESKQYFKYIRDYKSPPFTINEND

SEQ ID NO: 3382069 - protein, 24 aa, Plasmodium falciparum
ESKRGIIYLSYVPIGLSVSKIREI

SEQ ID NO: 3382070 - protein, 24 aa, Plasmodium falciparum
ESKYYKLVLIKKMTLKHLFNNQTD

SEQ ID NO: 3382071 - protein, 25 aa, Plasmodium falciparum
ESLDGELMFYNFAYNICKCKKQFDP

SEQ ID NO: 3382072 - protein, 24 aa, Plasmodium falciparum
ESLDLLEKLLQFNPSKRISAENAL

SEQ ID NO: 3382073 - protein, 22 aa, Plasmodium falciparum
ESLIGFYQDKYKIDISYERGKN

SEQ ID NO: 3382074 - protein, 17 aa, Plasmodium falciparum
ESLPIYKSKHELLDAVY

SEQ ID NO: 3382075 - protein, 18 aa, Plasmodium falciparum
ESLRFFLPMNGLCLIDYQ

SEQ ID NO: 3382076 - protein, 22 aa, Plasmodium falciparum
ESMNYPILYASAKNGWCTDNFH

SEQ ID NO: 3382077 - protein, 26 aa, Plasmodium falciparum
ESMSPPPLIILPIYSSLPSEMQSVIF

SEQ ID NO: 3382078 - protein, 28 aa, Plasmodium falciparum
ESNFLLNKYIKRLVSRLKYIYFEGDIQV

SEQ ID NO: 3382079 - protein, 20 aa, Plasmodium falciparum
ESNIPIHFKVRRKTTRIFKT

SEQ ID NO: 3382080 - protein, 22 aa, Plasmodium falciparum
ESNNTLKYAFRARNIKLCATVQ

SEQ ID NO: 3382081 - protein, 28 aa, Plasmodium falciparum
ESNRNDMCYYLPGASRHSFSFRDNNLKS

SEQ ID NO: 3382082 - protein, 17 aa, Plasmodium falciparum
ESNSGGFIWNYMKNIYS

SEQ ID NO: 3382083 - protein, 23 aa, Plasmodium falciparum
ESNTACCYYISKEYFLSLLNKDI

SEQ ID NO: 3382084 - protein, 22 aa, Plasmodium falciparum
ESNTLKFIILDKYKKNNSYDNN

SEQ ID NO: 3382085 - protein, 24 aa, Plasmodium falciparum
ESQKKEIIVLHPILKRSKNNSNKL

SEQ ID NO: 3382086 - protein, 29 aa, Plasmodium falciparum
ESQYNTYILFFSFDTIFIYSLEQFHLIYQ

SEQ ID NO: 3382087 - protein, 17 aa, Plasmodium falciparum
ESRCIQVRWCFFDKLIL

SEQ ID NO: 3382088 - protein, 27 aa, Plasmodium falciparum
ESRKRKFFTNILPYKNKKKKLPYTINL

SEQ ID NO: 3382089 - protein, 21 aa, Plasmodium falciparum
ESSILVIINLKEFYTEVRLAY

SEQ ID NO: 3382090 - protein, 22 aa, Plasmodium falciparum
ESSKDMFFIYNSLKEYIEQLKH

SEQ ID NO: 3382091 - protein, 27 aa, Plasmodium falciparum
ESSNNNFFLNLMKSKLKNPFSLLTTLG

SEQ ID NO: 3382092 - protein, 18 aa, Plasmodium falciparum
ESSWLFNEYYFYRYLCCA

SEQ ID NO: 3382093 - protein, 26 aa, Plasmodium falciparum
ESSYYLLVFHKNCCISVFNFKYYVGE

SEQ ID NO: 3382094 - protein, 32 aa, Plasmodium falciparum
ESTNNFPLEFFIERGRQKLPIINGVDLEREEK

SEQ ID NO: 3382095 - protein, 23 aa, Plasmodium falciparum
ESTRKILKLNLENSIIIIDEGHN

SEQ ID NO: 3382096 - protein, 22 aa, Plasmodium falciparum
ESTYMEHDFLKNLPYTMNNNSN

SEQ ID NO: 3382097 - protein, 45 aa, Plasmodium falciparum
ESWNNYTNWLQKKNDYRFSLPFDENKIFRKSSSLSPTTWENFVSL

SEQ ID NO: 3382098 - protein, 34 aa, Plasmodium falciparum
ESYEKLLFRDVLKYGFYDMLLKRDTYRMMCDKIH

SEQ ID NO: 3382099 - protein, 27 aa, Plasmodium falciparum
ESYERIIGLSELYMYYMIPKREERENL

SEQ ID NO: 3382100 - protein, 20 aa, Plasmodium falciparum
ESYGQWLKRKEFLLKMLNYH

SEQ ID NO: 3382101 - protein, 40 aa, Plasmodium falciparum
ESYILSPYDYYNYYCSGLIPTYPIFNYRNVINSNNNNNNI

SEQ ID NO: 3382102 - protein, 38 aa, Plasmodium falciparum
ESYKQHYILFPYEIIKWTSFLLEYLTEIIPTNIFLHTK

SEQ ID NO: 3382103 - protein, 19 aa, Plasmodium falciparum
ESYNFWDSLKNNLRNVFLI

SEQ ID NO: 3382104 - protein, 22 aa, Plasmodium falciparum
ESYPEFYEYSFISKNKELFKKK

SEQ ID NO: 3382105 - protein, 24 aa, Plasmodium falciparum
ETADFRIKWIRECLEQLDIHHPDF

SEQ ID NO: 3382106 - protein, 29 aa, Plasmodium falciparum
ETADIWSFACMVFELVTGDFLFNPQKGDR

SEQ ID NO: 3382107 - protein, 41 aa, Plasmodium falciparum
ETAKLRNCSKFFAHLLYTDAISWSIFKIIKLTEEDTTSSTR

SEQ ID NO: 3382108 - protein, 24 aa, Plasmodium falciparum
ETAVELCLHKNRMADALLLSSFGG

SEQ ID NO: 3382109 - protein, 24 aa, Plasmodium falciparum
ETAYIVERLGKYNKTLLAGIHFLI

SEQ ID NO: 3382110 - protein, 19 aa, Plasmodium falciparum
ETDEFYLRNLDLFDSSGLS

SEQ ID NO: 3382111 - protein, 37 aa, Plasmodium falciparum
ETDKFYQAIEMFGIDLMMVRALIPKFNDKQIRDKYKK

SEQ ID NO: 3382112 - protein, 17 aa, Plasmodium falciparum
ETDKIIDDIFKYSFPDI

SEQ ID NO: 3382113 - protein, 28 aa, Plasmodium falciparum
ETDNINLYFIIPFVYLKVVLIKNRKNDN

SEQ ID NO: 3382114 - protein, 26 aa, Plasmodium falciparum
ETEAPCPLKFMYKLLKRYLDERSKKK

SEQ ID NO: 3382115 - protein, 32 aa, Plasmodium falciparum
ETEEKSHTKKKKSSWLKFGRGDKNDKKSKNEK

SEQ ID NO: 3382116 - protein, 55 aa, Plasmodium falciparum
ETEEYYICDINILYELFILTLKEMNLFDIYDFNWFYKKYKLISISLNRTYRKNLK

SEQ ID NO: 3382117 - protein, 17 aa, Plasmodium falciparum
ETEFYMKDSLLDSLEKL

SEQ ID NO: 3382118 - protein, 28 aa, Plasmodium falciparum
ETFEELCSNFFLTKLKHLLDTALCISKV

SEQ ID NO: 3382119 - protein, 17 aa, Plasmodium falciparum
ETFLTFLENKTDYFHVM

SEQ ID NO: 3382120 - protein, 24 aa, Plasmodium falciparum
ETFNNIMNILYNNIYFTNENTNLC

SEQ ID NO: 3382121 - protein, 21 aa, Plasmodium falciparum
ETHEFYKRKGIVLYKIKKEKA

SEQ ID NO: 3382122 - protein, 34 aa, Plasmodium falciparum
ETIDELFKILDIWKKTHHIIPNVLSRLYQLKKIH

SEQ ID NO: 3382123 - protein, 27 aa, Plasmodium falciparum
ETIKMLLDYIYPCRTLDPRLNSLYGML

SEQ ID NO: 3382124 - protein, 25 aa, Plasmodium falciparum
ETIKNFIYVFPKLKTNIRSGALNML

SEQ ID NO: 3382125 - protein, 36 aa, Plasmodium falciparum
ETISTFEFIYAYPHILRPYIALVLPSFHEVLRKKNR

SEQ ID NO: 3382126 - protein, 18 aa, Plasmodium falciparum
ETKEIKSLKVVWNPNKDA

SEQ ID NO: 3382127 - protein, 23 aa, Plasmodium falciparum
ETKGKKYLDFKLGNGLDGEEEGG

SEQ ID NO: 3382128 - protein, 18 aa, Plasmodium falciparum
ETKKNLPKIIQIKKNTKK

SEQ ID NO: 3382129 - protein, 26 aa, Plasmodium falciparum
ETKLIYPYALTLQKTFRTYMKICISM

SEQ ID NO: 3382130 - protein, 29 aa, Plasmodium falciparum
ETKNYFEFLVSPFELLRALEFLDAIILNI

SEQ ID NO: 3382131 - protein, 22 aa, Plasmodium falciparum
ETKRNNFLRPLSELYVENNINE

SEQ ID NO: 3382132 - protein, 38 aa, Plasmodium falciparum
ETKVTHNLKKFVFKNEFKYVDATNALKNIFLKDKKNEE

SEQ ID NO: 3382133 - protein, 18 aa, Plasmodium falciparum
ETLHIKKSFSVLINKNRC

SEQ ID NO: 3382134 - protein, 21 aa, Plasmodium falciparum
ETLIYCGHEYTLNNLRFALSI

SEQ ID NO: 3382135 - protein, 20 aa, Plasmodium falciparum
ETLKELKNLVRLGVQFNPFA

SEQ ID NO: 3382136 - protein, 23 aa, Plasmodium falciparum
ETNDILIMCIYLNLQNVYEKLEK

SEQ ID NO: 3382137 - protein, 26 aa, Plasmodium falciparum
ETNQHYFTKEQLFPLKSDHLNQAHEI

SEQ ID NO: 3382138 - protein, 32 aa, Plasmodium falciparum
ETQEKSHTKKKKSSWLKFGRGNKNDKKNKKEK

SEQ ID NO: 3382139 - protein, 23 aa, Plasmodium falciparum
ETQKDLYFQSSLFNKLKICGQFN

SEQ ID NO: 3382140 - protein, 26 aa, Plasmodium falciparum
ETQKEPLFSKLLNKAFGKKYTHEKNY

SEQ ID NO: 3382141 - protein, 19 aa, Plasmodium falciparum
ETQNSKGFAFITYSKREEA

SEQ ID NO: 3382142 - protein, 27 aa, Plasmodium falciparum
ETQYYALKWILLLLTQEFDMADTIILY

SEQ ID NO: 3382143 - protein, 20 aa, Plasmodium falciparum
ETRIKKILYKSKHDPNLLPS

SEQ ID NO: 3382144 - protein, 25 aa, Plasmodium falciparum
ETRLRKNIIIQPKKKKDLTYVNTIN

SEQ ID NO: 3382145 - protein, 18 aa, Plasmodium falciparum
ETSFLQTVYLLFKKIQGT

SEQ ID NO: 3382146 - protein, 28 aa, Plasmodium falciparum
ETSPHYLLNEILIKYFIYGSNICDLEKC

SEQ ID NO: 3382147 - protein, 22 aa, Plasmodium falciparum
ETTAWIIGKAGCHIKEIRSVTG

SEQ ID NO: 3382148 - protein, 21 aa, Plasmodium falciparum
ETVEYVIKYIPKDASKKTKKE

SEQ ID NO: 3382149 - protein, 18 aa, Plasmodium falciparum
ETVIIWDRITGKPLYNAI

SEQ ID NO: 3382150 - protein, 24 aa, Plasmodium falciparum
ETVKLNNRFEFYKELDLSKYCNKS

SEQ ID NO: 3382151 - protein, 18 aa, Plasmodium falciparum
ETVRFRSLPLEEKYADKK

SEQ ID NO: 3382152 - protein, 19 aa, Plasmodium falciparum
ETYCKACLYKYNKKKMKDT

SEQ ID NO: 3382153 - protein, 27 aa, Plasmodium falciparum
ETYIKNIMFQILCAIAYMHSNNIAHKD

SEQ ID NO: 3382154 - protein, 20 aa, Plasmodium falciparum
ETYKHFAHEDYWINIDATRK

SEQ ID NO: 3382155 - protein, 26 aa, Plasmodium falciparum
ETYPDDWKIPCIDALFISNVARFLNH

SEQ ID NO: 3382156 - protein, 41 aa, Plasmodium falciparum
ETYRYILTMKKHITPYLSLGRLLYIIQEDLRWGWCICIEGQ

SEQ ID NO: 3382157 - protein, 28 aa, Plasmodium falciparum
ETYSGFLVFCDRFMNLHMKNIICTSKDG

SEQ ID NO: 3382158 - protein, 22 aa, Plasmodium falciparum
EVAKLFVKVKQWKKEEKKKKLL

SEQ ID NO: 3382159 - protein, 17 aa, Plasmodium falciparum
EVAKQIRNLFDNGKSVL

SEQ ID NO: 3382160 - protein, 30 aa, Plasmodium falciparum
EVCKALFNIDIFRNFNIFELFNIEVNYDID

SEQ ID NO: 3382161 - protein, 19 aa, Plasmodium falciparum
EVDLWSLGCIIFELINLCP

SEQ ID NO: 3382162 - protein, 36 aa, Plasmodium falciparum
EVDNKMISPINRHNFYLTILEGMNKNFPRQWNKNNI

SEQ ID NO: 3382163 - protein, 28 aa, Plasmodium falciparum
EVEEKNFFYYIKNDYMSLTLWINDDEIY

SEQ ID NO: 3382164 - protein, 23 aa, Plasmodium falciparum
EVEEQVFLSSWIPSYLNEIKDIR

SEQ ID NO: 3382165 - protein, 25 aa, Plasmodium falciparum
EVEKNMYIGLLNIKKIYLFKETEKD

SEQ ID NO: 3382166 - protein, 20 aa, Plasmodium falciparum
EVFEYFLEKKIPIFGICYGM

SEQ ID NO: 3382167 - protein, 18 aa, Plasmodium falciparum
EVFPGFSTGIIGNNTSNN

SEQ ID NO: 3382168 - protein, 18 aa, Plasmodium falciparum
EVFTLEILIKILSKIFLK

SEQ ID NO: 3382169 - protein, 27 aa, Plasmodium falciparum
EVGKKRAPRRRAKTINLKSINRFNTVS

SEQ ID NO: 3382170 - protein, 19 aa, Plasmodium falciparum
EVGQILFIEHELLETAILF

SEQ ID NO: 3382171 - protein, 35 aa, Plasmodium falciparum
EVHIMKSKIFLNYKINCPKFLINTISPSDIITTKD

SEQ ID NO: 3382172 - protein, 38 aa, Plasmodium falciparum
EVIHPVSTYFFFYKPNEYYFNILKNMNYLNGYFISFNM

SEQ ID NO: 3382173 - protein, 25 aa, Plasmodium falciparum
EVIKEYPRIFATRLPFEASKKDLEK

SEQ ID NO: 3382174 - protein, 23 aa, Plasmodium falciparum
EVIKMPIYRILDTNGHLLDGHEA

SEQ ID NO: 3382175 - protein, 23 aa, Plasmodium falciparum
EVIKNLLIFYHKLKTVCLSKKEK

SEQ ID NO: 3382176 - protein, 23 aa, Plasmodium falciparum
EVINKEVLLLKENNINDIMKKDV

SEQ ID NO: 3382177 - protein, 24 aa, Plasmodium falciparum
EVINKFDKNYLDKNYLDKNYFDID

SEQ ID NO: 3382178 - protein, 29 aa, Plasmodium falciparum
EVKCVVLLNKPLFPGLTYVLNSDKNVVKY

SEQ ID NO: 3382179 - protein, 23 aa, Plasmodium falciparum
EVKFILHMTLLTLYKDQIKPSYG

SEQ ID NO: 3382180 - protein, 27 aa, Plasmodium falciparum
EVKKLPVAFGLYKLHMSCIIYDDFVNT

SEQ ID NO: 3382181 - protein, 17 aa, Plasmodium falciparum
EVKLLNGISYKMCRSNI

SEQ ID NO: 3382182 - protein, 19 aa, Plasmodium falciparum
EVKRLIKYKTPRALNPKHS

SEQ ID NO: 3382183 - protein, 33 aa, Plasmodium falciparum
EVLDRMLPKLLKFKHKVLIFSQMTKLMNILCDY

SEQ ID NO: 3382184 - protein, 26 aa, Plasmodium falciparum
EVLENIWQMYDAVNYLIFVTNDNIKK

SEQ ID NO: 3382185 - protein, 18 aa, Plasmodium falciparum
EVLKIMRNKLKNFGHLGK

SEQ ID NO: 3382186 - protein, 17 aa, Plasmodium falciparum
EVLKKLFIRHLSAKISD

SEQ ID NO: 3382187 - protein, 28 aa, Plasmodium falciparum
EVLTNDSLLPCYYPLCSVSMHTKCVEKL

SEQ ID NO: 3382188 - protein, 36 aa, Plasmodium falciparum
EVLTNLLNKLIAFDKKRIFLYPVNVQLVPDYLNVIK

SEQ ID NO: 3382189 - protein, 23 aa, Plasmodium falciparum
EVNHEIHKFIDYCLKNYGNRNIM

SEQ ID NO: 3382190 - protein, 24 aa, Plasmodium falciparum
EVNKPLYTYNFKSIWQGAWIFNTS

SEQ ID NO: 3382191 - protein, 30 aa, Plasmodium falciparum
EVNLLVYRYLVENGFVHTSFSFFNEANICK

SEQ ID NO: 3382192 - protein, 27 aa, Plasmodium falciparum
EVQALGLHLIWAFWSIIRGYQTKSYNE

SEQ ID NO: 3382193 - protein, 19 aa, Plasmodium falciparum
EVQDLLRLYFLLHSDHEGG

SEQ ID NO: 3382194 - protein, 32 aa, Plasmodium falciparum
EVQKAEKKLIKLMLLVFKFTYDYKNDNNKYEY

SEQ ID NO: 3382195 - protein, 23 aa, Plasmodium falciparum
EVRLAYELYIIYNRRMKKKNNKT

SEQ ID NO: 3382196 - protein, 25 aa, Plasmodium falciparum
EVRSLWSLYDLYRSPGPIQFNGHLG

SEQ ID NO: 3382197 - protein, 21 aa, Plasmodium falciparum
EVSRCIFYVLLNNVKFYYSQE

SEQ ID NO: 3382198 - protein, 24 aa, Plasmodium falciparum
EVSTCIRICDGALILVDCIEGLCS

SEQ ID NO: 3382199 - protein, 23 aa, Plasmodium falciparum
EVSVLTLIALWFFQHKKNNQSSN

SEQ ID NO: 3382200 - protein, 26 aa, Plasmodium falciparum
EVTHYLKYHPGGKRILLGKSGKDITK

SEQ ID NO: 3382201 - protein, 33 aa, Plasmodium falciparum
EVTMKKEIFMIPLKHIYQFKPCYDNIFLDRILD

SEQ ID NO: 3382202 - protein, 30 aa, Plasmodium falciparum
EVVDENYILYCMFYEFAEDIIRIKLCKEKS

SEQ ID NO: 3382203 - protein, 26 aa, Plasmodium falciparum
EVVELPILNPYLYKRVGIKTPKGVLL

SEQ ID NO: 3382204 - protein, 26 aa, Plasmodium falciparum
EVVGVDIMCWIHRGLISCAYDIVTDQ

SEQ ID NO: 3382205 - protein, 47 aa, Plasmodium falciparum
EVVNLHDEIYIYIYGKIKKSKHTNVYYYFIQNIHLHKYNVYQYYVDV

SEQ ID NO: 3382206 - protein, 23 aa, Plasmodium falciparum
EVVPDFTPYTWKTPIQKFVESQK

SEQ ID NO: 3382207 - protein, 24 aa, Plasmodium falciparum
EVVSLYYRKILYTLSFKNDEIKTN

SEQ ID NO: 3382208 - protein, 19 aa, Plasmodium falciparum
EVYNFFNLHFPLNENIEIW

SEQ ID NO: 3382209 - protein, 23 aa, Plasmodium falciparum
EVYSQLIDIIKTLNIKNVSCDNK

SEQ ID NO: 3382210 - protein, 17 aa, Plasmodium falciparum
EWCGPCKRIAPFYEECS

SEQ ID NO: 3382211 - protein, 22 aa, Plasmodium falciparum
EWGLKYLFYQSIISNYILKMLL

SEQ ID NO: 3382212 - protein, 21 aa, Plasmodium falciparum
EWIRMDKYINYKLSKILFCNN

SEQ ID NO: 3382213 - protein, 24 aa, Plasmodium falciparum
EWRIYNDYIYINTKKPQKFIKYNL

SEQ ID NO: 3382214 - protein, 20 aa, Plasmodium falciparum
EWVMSLQKKVTWVKSNINIA

SEQ ID NO: 3382215 - protein, 27 aa, Plasmodium falciparum
EWYDLKAPKMFLVRNFGKTLVTKTIGK

SEQ ID NO: 3382216 - protein, 17 aa, Plasmodium falciparum
EWYPYICANSRYFFRQK

SEQ ID NO: 3382217 - protein, 18 aa, Plasmodium falciparum
EWYWTYEGIKFFYTKDEL

SEQ ID NO: 3382218 - protein, 21 aa, Plasmodium falciparum
EYCERGNLLNIFQKNKDKIKE

SEQ ID NO: 3382219 - protein, 22 aa, Plasmodium falciparum
EYCKLFEKYLNKKDKIYTVIIK

SEQ ID NO: 3382220 - protein, 20 aa, Plasmodium falciparum
EYCTLKYLLYEKMFDLHIEK

SEQ ID NO: 3382221 - protein, 24 aa, Plasmodium falciparum
EYDDIIQRAFMRIQIIYDDIIKDE

SEQ ID NO: 3382222 - protein, 24 aa, Plasmodium falciparum
EYDDLFYYSNLLKEDKHLKKQINI

SEQ ID NO: 3382223 - protein, 36 aa, Plasmodium falciparum
EYDTLLGKYTNLKEFFFIINVINQLYKKQISCYKLI

SEQ ID NO: 3382224 - protein, 22 aa, Plasmodium falciparum
EYEEFIDMWINLSYTSVDNINI

SEQ ID NO: 3382225 - protein, 23 aa, Plasmodium falciparum
EYEENDIFICLLIDEVESLSADR

SEQ ID NO: 3382226 - protein, 24 aa, Plasmodium falciparum
EYEIWKKLYILKIETQYYALKWIL

SEQ ID NO: 3382227 - protein, 36 aa, Plasmodium falciparum
EYENFITFSEWNAYNLMISKIYKALDMKKFEYYQRR

SEQ ID NO: 3382228 - protein, 20 aa, Plasmodium falciparum
EYFAAFTIMGTLKKYLNITH

SEQ ID NO: 3382229 - protein, 38 aa, Plasmodium falciparum
EYFDGVLTCFFLDTAKNLFMYIRTFASILKPNSLWSNI

SEQ ID NO: 3382230 - protein, 28 aa, Plasmodium falciparum
EYFEKKKVPFVFFSALRELYHQNKITIE

SEQ ID NO: 3382231 - protein, 20 aa, Plasmodium falciparum
EYFKSQLYIYNAYFGNMEYN

SEQ ID NO: 3382232 - protein, 29 aa, Plasmodium falciparum
EYFPGQEFLPFLFLRLATQIDYSKEINCI

SEQ ID NO: 3382233 - protein, 21 aa, Plasmodium falciparum
EYFSKYIYLPSFISIKKGNIK

SEQ ID NO: 3382234 - protein, 18 aa, Plasmodium falciparum
EYFSRVIEVLYGDVIIID

SEQ ID NO: 3382235 - protein, 17 aa, Plasmodium falciparum
EYFVILISILQLEFKSV

SEQ ID NO: 3382236 - protein, 26 aa, Plasmodium falciparum
EYGIEKCMILAILSRNLRLSNLSNVL

SEQ ID NO: 3382237 - protein, 39 aa, Plasmodium falciparum
EYIHIPPFVLTKLCEYAFKEILFFLNKKHLKQLQHILQD

SEQ ID NO: 3382238 - protein, 17 aa, Plasmodium falciparum
EYIIAKWYNKESSLLFT

SEQ ID NO: 3382239 - protein, 18 aa, Plasmodium falciparum
EYIKYILLTMKKQKNKVN

SEQ ID NO: 3382240 - protein, 28 aa, Plasmodium falciparum
EYINTALAVHLILGGKLTYLLVQNKEHS

SEQ ID NO: 3382241 - protein, 35 aa, Plasmodium falciparum
EYIRKLFYSIIIYNVDQFFLFFNNINKTNVILMFL

SEQ ID NO: 3382242 - protein, 25 aa, Plasmodium falciparum
EYIRLKNELTMFLEATPFCTIQAID

SEQ ID NO: 3382243 - protein, 28 aa, Plasmodium falciparum
EYKDVETCLLAFKYINGYEIKGRKLKVF

SEQ ID NO: 3382244 - protein, 22 aa, Plasmodium falciparum
EYKEWLYTLQKTISEYKKNISS

SEQ ID NO: 3382245 - protein, 24 aa, Plasmodium falciparum
EYKFYDYYELINKIKKLKGFKNVI

SEQ ID NO: 3382246 - protein, 23 aa, Plasmodium falciparum
EYKIYITVHIPFSKRYIKYLAKK

SEQ ID NO: 3382247 - protein, 24 aa, Plasmodium falciparum
EYKKKIIEIFVYKNLIKDLQNFHF

SEQ ID NO: 3382248 - protein, 25 aa, Plasmodium falciparum
EYKKKKKKYIISNKILKHIDNIDKL

SEQ ID NO: 3382249 - protein, 26 aa, Plasmodium falciparum
EYKKRKFFKIHFFLNRKNKNNDKRED

SEQ ID NO: 3382250 - protein, 28 aa, Plasmodium falciparum
EYKKSKIIKDLLLKKLDIEKKKKIYEKW

SEQ ID NO: 3382251 - protein, 29 aa, Plasmodium falciparum
EYKLPAYLRVNFEIILIPSSRDLVRKMRI

SEQ ID NO: 3382252 - protein, 18 aa, Plasmodium falciparum
EYKNNILLTYIDDICIDT

SEQ ID NO: 3382253 - protein, 17 aa, Plasmodium falciparum
EYKNSLHLFYRSNDILN

SEQ ID NO: 3382254 - protein, 37 aa, Plasmodium falciparum
EYKTNFIDLTREALSLILQDLKNNVIPKIPVGIEKRE

SEQ ID NO: 3382255 - protein, 20 aa, Plasmodium falciparum
EYKYDIVVYYAFMESFDTIP

SEQ ID NO: 3382256 - protein, 19 aa, Plasmodium falciparum
EYLNIKKAHFFASDLGGYL

SEQ ID NO: 3382257 - protein, 20 aa, Plasmodium falciparum
EYLRFRELPAGINAIVAIMC

SEQ ID NO: 3382258 - protein, 18 aa, Plasmodium falciparum
EYLVLMFTCNICEKKSAK

SEQ ID NO: 3382259 - protein, 18 aa, Plasmodium falciparum
EYLYLHNQMKLLKTDIAE

SEQ ID NO: 3382260 - protein, 17 aa, Plasmodium falciparum
EYLYLNVDKNILKNVFD

SEQ ID NO: 3382261 - protein, 27 aa, Plasmodium falciparum
EYMKWKTFFFKNIPLEKFYNFCSYNDK

SEQ ID NO: 3382262 - protein, 21 aa, Plasmodium falciparum
EYNEKEKPIFLKNCKDKTSDN

SEQ ID NO: 3382263 - protein, 50 aa, Plasmodium falciparum
EYNIELEKYFDILSDISLDILNYIKMYTKQKSLLKEMISAGFEALVEKQY

SEQ ID NO: 3382264 - protein, 33 aa, Plasmodium falciparum
EYNINVLKKNEFIGNLLLNFLNDLRNNYRLKEN

SEQ ID NO: 3382265 - protein, 25 aa, Plasmodium falciparum
EYNKKKFITPLIKKRTKKIETNQMK

SEQ ID NO: 3382266 - protein, 24 aa, Plasmodium falciparum
EYNKLNLQMLNITDLDILEKRTDI

SEQ ID NO: 3382267 - protein, 21 aa, Plasmodium falciparum
EYNKLYMHRYYHINNHTTNND

SEQ ID NO: 3382268 - protein, 42 aa, Plasmodium falciparum
EYNKNSLKPLISKKYIYLILEYFLFLLKDNLKKIPSNLVEKN

SEQ ID NO: 3382269 - protein, 18 aa, Plasmodium falciparum
EYNKYINICDINNIHHLN

SEQ ID NO: 3382270 - protein, 21 aa, Plasmodium falciparum
EYNYQKYPYVYNNQILSINHG

SEQ ID NO: 3382271 - protein, 21 aa, Plasmodium falciparum
EYQEIDLFKSEIKKEIQVKEN

SEQ ID NO: 3382272 - protein, 27 aa, Plasmodium falciparum
EYQIDIYEIIGLLLLNYDFNKFKKLSK

SEQ ID NO: 3382273 - protein, 25 aa, Plasmodium falciparum
EYQINLIPLTLLKEKSRNIIYEENI

SEQ ID NO: 3382274 - protein, 22 aa, Plasmodium falciparum
EYREILRNNIKTAYSLYPEKYI

SEQ ID NO: 3382275 - protein, 28 aa, Plasmodium falciparum
EYRKKKLICIIWIKIYMMIIEEHKKEEY

SEQ ID NO: 3382276 - protein, 24 aa, Plasmodium falciparum
EYRSKYLPVIYKYSKPVLNFEDTE

SEQ ID NO: 3382277 - protein, 24 aa, Plasmodium falciparum
EYSDIFIQLLKKIKKRIWCFRNNH

SEQ ID NO: 3382278 - protein, 18 aa, Plasmodium falciparum
EYTVFLKKFIYNQHLVLE

SEQ ID NO: 3382279 - protein, 26 aa, Plasmodium falciparum
EYVILDIILSIFHIISTNLSPIIEKI

SEQ ID NO: 3382280 - protein, 24 aa, Plasmodium falciparum
EYVKKYVIFFPGDYSYFFSNSVYT

SEQ ID NO: 3382281 - protein, 32 aa, Plasmodium falciparum
EYVMGWQTRRSINRPLRYVENLSLNNISSIFL

SEQ ID NO: 3382282 - protein, 31 aa, Plasmodium falciparum
EYVYKPLISSFIYYYIMKFSSFHISLKICKL

SEQ ID NO: 3382283 - protein, 21 aa, Plasmodium falciparum
EYWNELQILDLTILREYLLKD

SEQ ID NO: 3382284 - protein, 19 aa, Plasmodium falciparum
EYYEDIKYLKKEQLKAYIC

SEQ ID NO: 3382285 - protein, 19 aa, Plasmodium falciparum
EYYINNACKYNKCVENRKE

SEQ ID NO: 3382286 - protein, 21 aa, Plasmodium falciparum
FAAAYIAQYKLKKKKKKKRQL

SEQ ID NO: 3382287 - protein, 18 aa, Plasmodium falciparum
FACRYMRYDYPIGTDKYS

SEQ ID NO: 3382288 - protein, 20 aa, Plasmodium falciparum
FAEKLIYEYLNTPYYDYFDL

SEQ ID NO: 3382289 - protein, 26 aa, Plasmodium falciparum
FAGVEFPLSLIEKPKFEQPVFGLNYL

SEQ ID NO: 3382290 - protein, 28 aa, Plasmodium falciparum
FAHSTEEILYHPLFYKTKRCEDYKKGSC

SEQ ID NO: 3382291 - protein, 17 aa, Plasmodium falciparum
FAISFKNNDFKINMGIL

SEQ ID NO: 3382292 - protein, 23 aa, Plasmodium falciparum
FAISKYHFFVNIYMALKNQRNKD

SEQ ID NO: 3382293 - protein, 21 aa, Plasmodium falciparum
FAKAALEIPLFYENKTKLFTR

SEQ ID NO: 3382294 - protein, 25 aa, Plasmodium falciparum
FARPKILILCPFRYNAKEYVDLICN

SEQ ID NO: 3382295 - protein, 30 aa, Plasmodium falciparum
FASINYQHWGQPKIWYVIPPHYSDKVEDVI

SEQ ID NO: 3382296 - protein, 17 aa, Plasmodium falciparum
FASNYFEQLYEWAKILI

SEQ ID NO: 3382297 - protein, 24 aa, Plasmodium falciparum
FCDDEYLWIFNIRDSTSSLTRDNI

SEQ ID NO: 3382298 - protein, 26 aa, Plasmodium falciparum
FCEDKICDFLYIQLNMCYIRYINNDA

SEQ ID NO: 3382299 - protein, 29 aa, Plasmodium falciparum
FCESGTKYLIKYKIYNLIKNQFYQVDVHH

SEQ ID NO: 3382300 - protein, 17 aa, Plasmodium falciparum
FCFVVYKKKEGYTQAVN

SEQ ID NO: 3382301 - protein, 22 aa, Plasmodium falciparum
FCGKIKAIEFFNDRLKTIDMNM

SEQ ID NO: 3382302 - protein, 17 aa, Plasmodium falciparum
FCHLNMYTILIGTTYNE

SEQ ID NO: 3382303 - protein, 17 aa, Plasmodium falciparum
FCHYNLNDKNYLIDLNN

SEQ ID NO: 3382304 - protein, 18 aa, Plasmodium falciparum
FCKNGRMRPIYPHNHMEN

SEQ ID NO: 3382305 - protein, 18 aa, Plasmodium falciparum
FCLTNNNEIYIFSIKFFF

SEQ ID NO: 3382306 - protein, 26 aa, Plasmodium falciparum
FCNILPIYLDFILNPTLENNMFLSEV

SEQ ID NO: 3382307 - protein, 20 aa, Plasmodium falciparum
FCNKFFTPNWREQQSIFIDN

SEQ ID NO: 3382308 - protein, 18 aa, Plasmodium falciparum
FCNLLDVGGIPEWVMSLQ

SEQ ID NO: 3382309 - protein, 23 aa, Plasmodium falciparum
FCNMLYNMYIKYLCRIKNRKNIK

SEQ ID NO: 3382310 - protein, 26 aa, Plasmodium falciparum
FCNNSLPKDLLIIGFARTVQDFDTFF

SEQ ID NO: 3382311 - protein, 19 aa, Plasmodium falciparum
FCQKISTFLEYFFHNSRRE

SEQ ID NO: 3382312 - protein, 23 aa, Plasmodium falciparum
FCQVVYLDRKSFKRLLGPIEDIL

SEQ ID NO: 3382313 - protein, 24 aa, Plasmodium falciparum
FCSKYPLKKLSMPKSDLVWCYYDI

SEQ ID NO: 3382314 - protein, 19 aa, Plasmodium falciparum
FCYDHFLQYHTLIKVKDVK

SEQ ID NO: 3382315 - protein, 18 aa, Plasmodium falciparum
FDAILPKNSSCILSIGTN

SEQ ID NO: 3382316 - protein, 22 aa, Plasmodium falciparum
FDAQDFYKFIFSLYKKNICVKQ

SEQ ID NO: 3382317 - protein, 29 aa, Plasmodium falciparum
FDCGNKNPKWLSLTYAIFICLNCSGKHRQ

SEQ ID NO: 3382318 - protein, 30 aa, Plasmodium falciparum
FDCIQWKNLYSLDFIIKCFNSIGVLPNEQE

SEQ ID NO: 3382319 - protein, 25 aa, Plasmodium falciparum
FDDESLLKMNLGLSQPSNLCLNNNE

SEQ ID NO: 3382320 - protein, 30 aa, Plasmodium falciparum
FDDINKLSYVYFLLKYYFDNNPLKILNENF

SEQ ID NO: 3382321 - protein, 20 aa, Plasmodium falciparum
FDDINLFRKKFANPILIGRD

SEQ ID NO: 3382322 - protein, 24 aa, Plasmodium falciparum
FDDKTIICVGSNKDYFLSFINCKN

SEQ ID NO: 3382323 - protein, 25 aa, Plasmodium falciparum
FDDKVRYVQLKNKLLFAISNDLKLF

SEQ ID NO: 3382324 - protein, 20 aa, Plasmodium falciparum
FDDLAVGISNIFKWMDIDNK

SEQ ID NO: 3382325 - protein, 24 aa, Plasmodium falciparum
FDENLSYYLGWLEWSDLLEKHIEV

SEQ ID NO: 3382326 - protein, 29 aa, Plasmodium falciparum
FDENMKTLLYIIPSKKIYKSLNSNWKVGL

SEQ ID NO: 3382327 - protein, 20 aa, Plasmodium falciparum
FDESILYKDFLYLQNIETII

SEQ ID NO: 3382328 - protein, 23 aa, Plasmodium falciparum
FDFWKNCYDLNFSSVLPIIKEEV

SEQ ID NO: 3382329 - protein, 26 aa, Plasmodium falciparum
FDHLVALFCLFLHLSNIKGRNIYNIN

SEQ ID NO: 3382330 - protein, 17 aa, Plasmodium falciparum
FDIFKKSVDKMLNIIQA

SEQ ID NO: 3382331 - protein, 17 aa, Plasmodium falciparum
FDIQLLKNIQNWVYCKF

SEQ ID NO: 3382332 - protein, 27 aa, Plasmodium falciparum
FDKCLHDYWPFMCPPEQDSKYKPSKIF

SEQ ID NO: 3382333 - protein, 24 aa, Plasmodium falciparum
FDKESIYFKCLFSDLINDFEYIQN

SEQ ID NO: 3382334 - protein, 17 aa, Plasmodium falciparum
FDKIKLNKFLGKKKTEE

SEQ ID NO: 3382335 - protein, 24 aa, Plasmodium falciparum
FDKLKEKIILISLIKNKDIFQTLI

SEQ ID NO: 3382336 - protein, 27 aa, Plasmodium falciparum
FDKLKENKFIIYNNKLQLINNHNNNNN

SEQ ID NO: 3382337 - protein, 32 aa, Plasmodium falciparum
FDKNLTTVYDCSLLNEVYLYFKKKNVHDIVIV

SEQ ID NO: 3382338 - protein, 21 aa, Plasmodium falciparum
FDKRYFGEQYFSLLNTLNVEN

SEQ ID NO: 3382339 - protein, 27 aa, Plasmodium falciparum
FDKSIPPNFFLCYYKNCRVYLKGFTHK

SEQ ID NO: 3382340 - protein, 26 aa, Plasmodium falciparum
FDKSSKLILITYYSTLRKYNDGDNGT

SEQ ID NO: 3382341 - protein, 19 aa, Plasmodium falciparum
FDLDDTLIPTCWIRSYLYS

SEQ ID NO: 3382342 - protein, 18 aa, Plasmodium falciparum
FDLKLNMGPYSCTYTRNG

SEQ ID NO: 3382343 - protein, 26 aa, Plasmodium falciparum
FDLYNYAIDNFIYPPSLQSLVKIYLN

SEQ ID NO: 3382344 - protein, 17 aa, Plasmodium falciparum
FDNASNGTLFIVWKKEK

SEQ ID NO: 3382345 - protein, 40 aa, Plasmodium falciparum
FDNHKELFLELLSILKHDYLDIYLTNLRKIISSEVVCLKS

SEQ ID NO: 3382346 - protein, 19 aa, Plasmodium falciparum
FDNMSIFNDLWIDFSENIS

SEQ ID NO: 3382347 - protein, 25 aa, Plasmodium falciparum
FDNNTKYYMSLSKGYYIWEDGLKCL

SEQ ID NO: 3382348 - protein, 25 aa, Plasmodium falciparum
FDQDTYYRLHQCTTFFMIINNNNEN

SEQ ID NO: 3382349 - protein, 19 aa, Plasmodium falciparum
FDQIPFYQAYDTKGSYIQK

SEQ ID NO: 3382350 - protein, 24 aa, Plasmodium falciparum
FDQSLWEFYKWFLFQNGNDKEEIL

SEQ ID NO: 3382351 - protein, 23 aa, Plasmodium falciparum
FDRKNRLWVLDEQNYFYIYDTED

SEQ ID NO: 3382352 - protein, 17 aa, Plasmodium falciparum
FDRLVTEATRLIRYNKK

SEQ ID NO: 3382353 - protein, 28 aa, Plasmodium falciparum
FDRRETSEYFYLPVDCPRMKKCDDAYCP

SEQ ID NO: 3382354 - protein, 22 aa, Plasmodium falciparum
FDRRLDCWLAYENLRLLDKEPD

SEQ ID NO: 3382355 - protein, 21 aa, Plasmodium falciparum
FDSINPFYNKETPFFLDTIKN

SEQ ID NO: 3382356 - protein, 22 aa, Plasmodium falciparum
FDTKFSFNLPLLVERRDKYIQR

SEQ ID NO: 3382357 - protein, 22 aa, Plasmodium falciparum
FDTLPFCNRWLDDLGQTRHFMA

SEQ ID NO: 3382358 - protein, 27 aa, Plasmodium falciparum
FDVFSHTFYIFLSYDYKKKLSIKNFKN

SEQ ID NO: 3382359 - protein, 24 aa, Plasmodium falciparum
FDVPFNYVEFLYDKNYALIINSEK

SEQ ID NO: 3382360 - protein, 44 aa, Plasmodium falciparum
FDVRYNYNMMNDFYNYFPFNYYYYNMNNLYFNNSNYNNGPNLYN

SEQ ID NO: 3382361 - protein, 34 aa, Plasmodium falciparum
FDVSNADKFMLGVFFFWIWTNGNLWKCSDPLQDE

SEQ ID NO: 3382362 - protein, 27 aa, Plasmodium falciparum
FDYKNYWLDIHGYLLNDMSIDKIVQVR

SEQ ID NO: 3382363 - protein, 17 aa, Plasmodium falciparum
FDYTYRPILKISGEDKI

SEQ ID NO: 3382364 - protein, 18 aa, Plasmodium falciparum
FDYYYQNFKYFSILHDEY

SEQ ID NO: 3382365 - protein, 27 aa, Plasmodium falciparum
FEAYLESLNFNSLLDDTFIKYEKDLNI

SEQ ID NO: 3382366 - protein, 35 aa, Plasmodium falciparum
FECLKKFKYIFKNKNYMIFSLNLKRCIFLNGEIKD

SEQ ID NO: 3382367 - protein, 19 aa, Plasmodium falciparum
FECTLLAIDKKLLDDYNYL

SEQ ID NO: 3382368 - protein, 27 aa, Plasmodium falciparum
FEDFKEEIFLFLFSNTSANFITVQTNG

SEQ ID NO: 3382369 - protein, 17 aa, Plasmodium falciparum
FEDMIDPLMNKDNYLFC

SEQ ID NO: 3382370 - protein, 27 aa, Plasmodium falciparum
FEDPHVWIYENVLLNKTLKLKEIEKKK

SEQ ID NO: 3382371 - protein, 25 aa, Plasmodium falciparum
FEDYEKIHLFFEIKLAILMVEDDSY

SEQ ID NO: 3382372 - protein, 44 aa, Plasmodium falciparum
FEDYKKNYNFYFYYDQHFLKYPCIHIFQYKKINYFNPLNNCILF

SEQ ID NO: 3382373 - protein, 30 aa, Plasmodium falciparum
FEEKSLKNYLYKNIFFKKNYNINIDIIHQH

SEQ ID NO: 3382374 - protein, 19 aa, Plasmodium falciparum
FEELCIDYFRDTLIPVEKV

SEQ ID NO: 3382375 - protein, 18 aa, Plasmodium falciparum
FEENIFDNYLENKKSCML

SEQ ID NO: 3382376 - protein, 40 aa, Plasmodium falciparum
FEENKSSFSMLYLFGKVKFYISIIDIIHNKTNSHDLLWVP

SEQ ID NO: 3382377 - protein, 49 aa, Plasmodium falciparum
FEENNKINITIPPGLSLPDINRALLHSAYLDNITVVKKCLEKKADINYL

SEQ ID NO: 3382378 - protein, 37 aa, Plasmodium falciparum
FEETIQKCFLINLKKTLNLINKIMYLKNVEFRKYNLD

SEQ ID NO: 3382379 - protein, 28 aa, Plasmodium falciparum
FEGNKNIDISFIPRTPHSLNKSIEENNG

SEQ ID NO: 3382380 - protein, 24 aa, Plasmodium falciparum
FEGYKELHRIMYNLKNYDVSSCIE

SEQ ID NO: 3382381 - protein, 20 aa, Plasmodium falciparum
FEHFKRLLISLKNCKWKIFL

SEQ ID NO: 3382382 - protein, 22 aa, Plasmodium falciparum
FEHIKKLKILIIGLGTLGCMVA

SEQ ID NO: 3382383 - protein, 18 aa, Plasmodium falciparum
FEIFTKDILVSLKKLNIL

SEQ ID NO: 3382384 - protein, 17 aa, Plasmodium falciparum
FEIIWAIRTCHDKRIAH

SEQ ID NO: 3382385 - protein, 39 aa, Plasmodium falciparum
FEIRKIIICKYNNKIIKWMKKIHNLYIMHVYKSYKNDQN

SEQ ID NO: 3382386 - protein, 20 aa, Plasmodium falciparum
FEKIGILKRKFTSGNILDID

SEQ ID NO: 3382387 - protein, 22 aa, Plasmodium falciparum
FEKNILSFLSAYDNLTINFFNH

SEQ ID NO: 3382388 - protein, 18 aa, Plasmodium falciparum
FEKRWDKNTWKKTSNIQS

SEQ ID NO: 3382389 - protein, 25 aa, Plasmodium falciparum
FEKYKYHFYFYNITHFNIHIIFNII

SEQ ID NO: 3382390 - protein, 25 aa, Plasmodium falciparum
FEKYPFVNDLLFYDKYRFKGRITNN

SEQ ID NO: 3382391 - protein, 24 aa, Plasmodium falciparum
FELPHINILTKCDLLISKNYYHEF

SEQ ID NO: 3382392 - protein, 19 aa, Plasmodium falciparum
FELYLKYESNTKYLKGHLF

SEQ ID NO: 3382393 - protein, 18 aa, Plasmodium falciparum
FENGVLDYPYIKNRQKQI

SEQ ID NO: 3382394 - protein, 23 aa, Plasmodium falciparum
FENKIVIIVKMKYDICVKSKVFI

SEQ ID NO: 3382395 - protein, 40 aa, Plasmodium falciparum
FENLMRKHFVAKYDYIFKKLSYYITLKKEIDLCKLYMYDM

SEQ ID NO: 3382396 - protein, 43 aa, Plasmodium falciparum
FENSCVVTLVMLLSKFILKERLNLYIPMTLLEENLFRASKREA

SEQ ID NO: 3382397 - protein, 22 aa, Plasmodium falciparum
FENYNTLLDKHFKFITSVKNIS

SEQ ID NO: 3382398 - protein, 18 aa, Plasmodium falciparum
FEPQNIFFFFNKYAELRD

SEQ ID NO: 3382399 - protein, 17 aa, Plasmodium falciparum
FEQMKKEKKLFLQNIFT

SEQ ID NO: 3382400 - protein, 17 aa, Plasmodium falciparum
FERICNKHFFFSNNSYT

SEQ ID NO: 3382401 - protein, 40 aa, Plasmodium falciparum
FERSIDDKVFLMFILKYIKKYILHIIYKTFQIKLQNEIDI

SEQ ID NO: 3382402 - protein, 26 aa, Plasmodium falciparum
FETLNTKHLFIYNLQEIYFDYCHHLT

SEQ ID NO: 3382403 - protein, 19 aa, Plasmodium falciparum
FEYYRVYLANRLINNIYIS

SEQ ID NO: 3382404 - protein, 20 aa, Plasmodium falciparum
FFAFRDPIGICPLYIGYAAD

SEQ ID NO: 3382405 - protein, 28 aa, Plasmodium falciparum
FFCLFEKDIFYILKYYNISILVIDSLNF

SEQ ID NO: 3382406 - protein, 20 aa, Plasmodium falciparum
FFEIWDIMKTGYMHKNLIIS

SEQ ID NO: 3382407 - protein, 28 aa, Plasmodium falciparum
FFEKDINKFPIYCDMFNHLIHPEALRLH

SEQ ID NO: 3382408 - protein, 18 aa, Plasmodium falciparum
FFEYMRRYIVDEMKDKKQ

SEQ ID NO: 3382409 - protein, 22 aa, Plasmodium falciparum
FFFNIYDLLKKRKFRFSHFIER

SEQ ID NO: 3382410 - protein, 17 aa, Plasmodium falciparum
FFFNLESIPWTSSFFHL

SEQ ID NO: 3382411 - protein, 17 aa, Plasmodium falciparum
FFFPTKNEFFIYLKNIL

SEQ ID NO: 3382412 - protein, 18 aa, Plasmodium falciparum
FFFTRIINQWKLRLRDSA

SEQ ID NO: 3382413 - protein, 17 aa, Plasmodium falciparum
FFGEVSLIFNTLRTCDA

SEQ ID NO: 3382414 - protein, 18 aa, Plasmodium falciparum
FFGMVEQYNIILKINYCH

SEQ ID NO: 3382415 - protein, 17 aa, Plasmodium falciparum
FFIKKNYHKMDSSDKFK

SEQ ID NO: 3382416 - protein, 26 aa, Plasmodium falciparum
FFKIDQTNFSFFQFNTSFENKKNVNE

SEQ ID NO: 3382417 - protein, 20 aa, Plasmodium falciparum
FFKKNYRNSYKHHPYDYKYN

SEQ ID NO: 3382418 - protein, 17 aa, Plasmodium falciparum
FFKKYNSLHIDHTDTKK

SEQ ID NO: 3382419 - protein, 17 aa, Plasmodium falciparum
FFKPIIQTDIITDLYKD

SEQ ID NO: 3382420 - protein, 19 aa, Plasmodium falciparum
FFKTLPDFFQIQLLEEICS

SEQ ID NO: 3382421 - protein, 19 aa, Plasmodium falciparum
FFLCYKYVDELFKEGLLNQ

SEQ ID NO: 3382422 - protein, 17 aa, Plasmodium falciparum
FFLTINKLSNHGFSSLL

SEQ ID NO: 3382423 - protein, 17 aa, Plasmodium falciparum
FFMCWKKCRFNNLTKVF

SEQ ID NO: 3382424 - protein, 17 aa, Plasmodium falciparum
FFNELNDFDYNTYNISS

SEQ ID NO: 3382425 - protein, 17 aa, Plasmodium falciparum
FFNFKRFGPSTIDQHYL

SEQ ID NO: 3382426 - protein, 19 aa, Plasmodium falciparum
FFNIFLNIHIDQNIFIIHL

SEQ ID NO: 3382427 - protein, 25 aa, Plasmodium falciparum
FFNSDTFIHSLFWCNIEGFNYIGSL

SEQ ID NO: 3382428 - protein, 17 aa, Plasmodium falciparum
FFNYFQLNYKYKLLFVY

SEQ ID NO: 3382429 - protein, 17 aa, Plasmodium falciparum
FFQHMIPYHISTFIISN

SEQ ID NO: 3382430 - protein, 59 aa, Plasmodium falciparum
FFRINNTNFYNYYFDDYFYFFIKSCYDLDLYIKIQRKNIFLTDEKYFEFLKIHIMNKST

SEQ ID NO: 3382431 - protein, 18 aa, Plasmodium falciparum
FFRKNVYAIKFFRDDLRT

SEQ ID NO: 3382432 - protein, 35 aa, Plasmodium falciparum
FFRNKSEYVLYFMNSILYQIYYEVTTKILYFHDDL

SEQ ID NO: 3382433 - protein, 17 aa, Plasmodium falciparum
FFSIKDELFVKENLEFL

SEQ ID NO: 3382434 - protein, 22 aa, Plasmodium falciparum
FFSLYIYLYEFLCIHLCGSQVT

SEQ ID NO: 3382435 - protein, 21 aa, Plasmodium falciparum
FFSNITGKTLHKFFMTSVGLN

SEQ ID NO: 3382436 - protein, 17 aa, Plasmodium falciparum
FFSPTLFVLLKKYSGSS

SEQ ID NO: 3382437 - protein, 17 aa, Plasmodium falciparum
FFTLNLKNELLFKCEGC

SEQ ID NO: 3382438 - protein, 18 aa, Plasmodium falciparum
FFTTLMDRKIMNYGDVLI

SEQ ID NO: 3382439 - protein, 17 aa, Plasmodium falciparum
FFVKCDCYFRVGIYGFE

SEQ ID NO: 3382440 - protein, 17 aa, Plasmodium falciparum
FFYIDSKYVYINTENRH

SEQ ID NO: 3382441 - protein, 24 aa, Plasmodium falciparum
FGARNLRRWICSPLLDCEKIRERL

SEQ ID NO: 3382442 - protein, 18 aa, Plasmodium falciparum
FGCGWSSNKKEWTPFIHA

SEQ ID NO: 3382443 - protein, 18 aa, Plasmodium falciparum
FGDLSLKKYGLLCTGTFK

SEQ ID NO: 3382444 - protein, 30 aa, Plasmodium falciparum
FGEGSHFYVPWFQTPYIYDIKMKPKVINTT

SEQ ID NO: 3382445 - protein, 28 aa, Plasmodium falciparum
FGGNMEKAQFLKNILLASCLPQNGMGIK

SEQ ID NO: 3382446 - protein, 27 aa, Plasmodium falciparum
FGGSLKTFVHVILYPDAFKIDSHKFHE

SEQ ID NO: 3382447 - protein, 18 aa, Plasmodium falciparum
FGGYLYFHKAPNKEEFHR

SEQ ID NO: 3382448 - protein, 20 aa, Plasmodium falciparum
FGILLCRLKKYNPVTTGDIN

SEQ ID NO: 3382449 - protein, 27 aa, Plasmodium falciparum
FGKKYSMGKDYFKKEKFSTFNQKKERT

SEQ ID NO: 3382450 - protein, 24 aa, Plasmodium falciparum
FGKTKIFFRFGVLSIINEILNKNE

SEQ ID NO: 3382451 - protein, 21 aa, Plasmodium falciparum
FGLDFQPIKKYILTCANDGLI

SEQ ID NO: 3382452 - protein, 27 aa, Plasmodium falciparum
FGNEKGEYILTMLNISRDTTDVDIRSF

SEQ ID NO: 3382453 - protein, 18 aa, Plasmodium falciparum
FGNKTYINVPNNIVTKMF

SEQ ID NO: 3382454 - protein, 23 aa, Plasmodium falciparum
FGNLLNINIVVDKNLLDALAVKI

SEQ ID NO: 3382455 - protein, 21 aa, Plasmodium falciparum
FGNVYFYKYYNQKYSNMFYIS

SEQ ID NO: 3382456 - protein, 22 aa, Plasmodium falciparum
FGNYVVQYILNLGNEKVNLEIA

SEQ ID NO: 3382457 - protein, 23 aa, Plasmodium falciparum
FGRKSCLKALRTGKGKLVIVSSN

SEQ ID NO: 3382458 - protein, 36 aa, Plasmodium falciparum
FGRLKKHLLPVPSRFHYLYTTRDLAKIFYSMLLCPY

SEQ ID NO: 3382459 - protein, 26 aa, Plasmodium falciparum
FGSGDLFSCLLLSFIVKQKGNILHII

SEQ ID NO: 3382460 - protein, 23 aa, Plasmodium falciparum
FGSGWICLIGESFSFNISAKENS

SEQ ID NO: 3382461 - protein, 30 aa, Plasmodium falciparum
FGSKEIIELITFLRFLLNVDDNIIFKKAFK

SEQ ID NO: 3382462 - protein, 23 aa, Plasmodium falciparum
FGSQYFHLIVKRLNNIKIFSETK

SEQ ID NO: 3382463 - protein, 27 aa, Plasmodium falciparum
FGTSFPHILLQTYPYYATLKTPPYCSS

SEQ ID NO: 3382464 - protein, 18 aa, Plasmodium falciparum
FGVQILNIINALRKIRTP

SEQ ID NO: 3382465 - protein, 22 aa, Plasmodium falciparum
FGVVYKGWYKGMHVAVKVPVDK

SEQ ID NO: 3382466 - protein, 26 aa, Plasmodium falciparum
FHAFSKFNPLFFRPKIRGAIQEYQNT

SEQ ID NO: 3382467 - protein, 18 aa, Plasmodium falciparum
FHANMNMNNYMNGGFNMP

SEQ ID NO: 3382468 - protein, 23 aa, Plasmodium falciparum
FHEIYLSIITLKKLGYNKNEEFI

SEQ ID NO: 3382469 - protein, 17 aa, Plasmodium falciparum
FHELSALHLDYIDHTNF

SEQ ID NO: 3382470 - protein, 18 aa, Plasmodium falciparum
FHFQYKPRKLLLTNLYPW

SEQ ID NO: 3382471 - protein, 26 aa, Plasmodium falciparum
FHHTSLINIIYNLTKLKFTTASHIDV

SEQ ID NO: 3382472 - protein, 19 aa, Plasmodium falciparum
FHIFNLNDLYLYKQLLYTC

SEQ ID NO: 3382473 - protein, 18 aa, Plasmodium falciparum
FHKNFGFNDAQRIFEMFF

SEQ ID NO: 3382474 - protein, 17 aa, Plasmodium falciparum
FHKNLINSYIKVHEHIV

SEQ ID NO: 3382475 - protein, 22 aa, Plasmodium falciparum
FHKPHKCHFFIYNILEGEKGKK

SEQ ID NO: 3382476 - protein, 25 aa, Plasmodium falciparum
FHKPYDSIIIKPIPNKSIVEQNENV

SEQ ID NO: 3382477 - protein, 18 aa, Plasmodium falciparum
FHLNIDYTSFLYKNDHKF

SEQ ID NO: 3382478 - protein, 22 aa, Plasmodium falciparum
FHMIYCYILSSHNIFTKNALKG

SEQ ID NO: 3382479 - protein, 34 aa, Plasmodium falciparum
FHPEFTSRPFKSNPLFLAFVLASKKKLKDRLNKY

SEQ ID NO: 3382480 - protein, 26 aa, Plasmodium falciparum
FHPHGTYFLTYPFYILNNNKKEKRKI

SEQ ID NO: 3382481 - protein, 27 aa, Plasmodium falciparum
FHSFLCLVYFMFLENLDIFTKNCGVTL

SEQ ID NO: 3382482 - protein, 50 aa, Plasmodium falciparum
FHSLEDQRLIYGKPDWQKFLCPLCDKKYYPPNSYIKNYTHYLNEHWMNRK

SEQ ID NO: 3382483 - protein, 18 aa, Plasmodium falciparum
FHTLLLYKSIINTIYISD

SEQ ID NO: 3382484 - protein, 19 aa, Plasmodium falciparum
FHVSYVFTVLKFNLQKKKK

SEQ ID NO: 3382485 - protein, 17 aa, Plasmodium falciparum
FIAEKYINMLRKNLRKR

SEQ ID NO: 3382486 - protein, 27 aa, Plasmodium falciparum
FICESKYQLLFLRKGNDYKNIFFLEKG

SEQ ID NO: 3382487 - protein, 19 aa, Plasmodium falciparum
FICHNKKPIKLSLRHKPDL

SEQ ID NO: 3382488 - protein, 27 aa, Plasmodium falciparum
FICMGGDLIPIRYAYAGNIVALYLSIM

SEQ ID NO: 3382489 - protein, 25 aa, Plasmodium falciparum
FICTDNINFVILLKDLSEEEKKGKV

SEQ ID NO: 3382490 - protein, 17 aa, Plasmodium falciparum
FIDFYISKHVQKILNEK

SEQ ID NO: 3382491 - protein, 21 aa, Plasmodium falciparum
FIDKKFIPLVFYTLKARTEGI

SEQ ID NO: 3382492 - protein, 17 aa, Plasmodium falciparum
FIDLLSFESFSLKFLKC

SEQ ID NO: 3382493 - protein, 25 aa, Plasmodium falciparum
FIDNSFMRTCHKFKFYKSNRTDVYN

SEQ ID NO: 3382494 - protein, 21 aa, Plasmodium falciparum
FIDVLDYIFLSTNIKVRKVLK

SEQ ID NO: 3382495 - protein, 17 aa, Plasmodium falciparum
FIELIFNKRDNSINWIF

SEQ ID NO: 3382496 - protein, 36 aa, Plasmodium falciparum
FIEQDLIQWPLPYQQELFNFFIFDDSIFLGGQNRKD

SEQ ID NO: 3382497 - protein, 17 aa, Plasmodium falciparum
FIFGLDLLKRHQCLIDF

SEQ ID NO: 3382498 - protein, 21 aa, Plasmodium falciparum
FIFIIYLHYYNKISSKIFCND

SEQ ID NO: 3382499 - protein, 29 aa, Plasmodium falciparum
FIFNYSLVQYIYVKGFLPDVLLMIFAFCI

SEQ ID NO: 3382500 - protein, 19 aa, Plasmodium falciparum
FIGINMMIDKKWRLRNDHK

SEQ ID NO: 3382501 - protein, 17 aa, Plasmodium falciparum
FIGSCENNIWIKNSDID

SEQ ID NO: 3382502 - protein, 19 aa, Plasmodium falciparum
FIIDQIYVFLFTKTETNKK

SEQ ID NO: 3382503 - protein, 18 aa, Plasmodium falciparum
FIIDRYNEYTWFDKNSPK

SEQ ID NO: 3382504 - protein, 18 aa, Plasmodium falciparum
FIIVELISYLCGNSKIIS

SEQ ID NO: 3382505 - protein, 17 aa, Plasmodium falciparum
FIKANSLIMHYVGEITT

SEQ ID NO: 3382506 - protein, 18 aa, Plasmodium falciparum
FIKGQIILNKYKVVKVLS

SEQ ID NO: 3382507 - protein, 19 aa, Plasmodium falciparum
FIKIDYIKQHRILENNQKG

SEQ ID NO: 3382508 - protein, 21 aa, Plasmodium falciparum
FIKLHNNYYAILRLGKRTSYS

SEQ ID NO: 3382509 - protein, 17 aa, Plasmodium falciparum
FIKLKEFIKFNEEFKKA

SEQ ID NO: 3382510 - protein, 29 aa, Plasmodium falciparum
FIKNHDKCIRMFYALQYAGFIKTDMKNFM

SEQ ID NO: 3382511 - protein, 19 aa, Plasmodium falciparum
FIKNSIPFNFFHMVNNIYV

SEQ ID NO: 3382512 - protein, 29 aa, Plasmodium falciparum
FIKYKKKLLVVILWIKIYMSVLEEYVKEE

SEQ ID NO: 3382513 - protein, 26 aa, Plasmodium falciparum
FIKYKKYRYMYLYEDHYRVLTGIQYE

SEQ ID NO: 3382514 - protein, 30 aa, Plasmodium falciparum
FILDDKGILILIMFGLPPLYHCDDTIRALL

SEQ ID NO: 3382515 - protein, 17 aa, Plasmodium falciparum
FILFFENMRMTKKVFTK

SEQ ID NO: 3382516 - protein, 30 aa, Plasmodium falciparum
FILFTLKKNVSLLSYFFSYLLKSDRNYDHP

SEQ ID NO: 3382517 - protein, 27 aa, Plasmodium falciparum
FILNFSINFYKFVISSLILCDEKKLFS

SEQ ID NO: 3382518 - protein, 17 aa, Plasmodium falciparum
FILVRKGLFVCGLRKME

SEQ ID NO: 3382519 - protein, 22 aa, Plasmodium falciparum
FILYICLVICSKLKNSLLCGNF

SEQ ID NO: 3382520 - protein, 21 aa, Plasmodium falciparum
FIMKQIFSVLNYLHIRNICHR

SEQ ID NO: 3382521 - protein, 32 aa, Plasmodium falciparum
FINEESKYIFKYFFLFEHPHHIHFKDKINGIY

SEQ ID NO: 3382522 - protein, 18 aa, Plasmodium falciparum
FINEIYYSINLYTLKEFI

SEQ ID NO: 3382523 - protein, 32 aa, Plasmodium falciparum
FINFLMHFNIFNFYYLNKIYKYVIYLITTTNK

SEQ ID NO: 3382524 - protein, 25 aa, Plasmodium falciparum
FINGKYKIVLYGGGLLDYDFTKNYA

SEQ ID NO: 3382525 - protein, 17 aa, Plasmodium falciparum
FINIEEIHLSKLFQLQK

SEQ ID NO: 3382526 - protein, 17 aa, Plasmodium falciparum
FINIKFQKNLKYNKFIS

SEQ ID NO: 3382527 - protein, 26 aa, Plasmodium falciparum
FINLKNSNIIIIRRTSDMKQIFKMYN

SEQ ID NO: 3382528 - protein, 19 aa, Plasmodium falciparum
FINSIFSKYPLIRCICEEE

SEQ ID NO: 3382529 - protein, 18 aa, Plasmodium falciparum
FINVLNKKDKKKLGFQCI

SEQ ID NO: 3382530 - protein, 31 aa, Plasmodium falciparum
FINYLLKRNKAIYLFLYFFVNIKKETEHSYK

SEQ ID NO: 3382531 - protein, 27 aa, Plasmodium falciparum
FIPIEMLYLKYHFFYKHYYYFNNYYIN

SEQ ID NO: 3382532 - protein, 20 aa, Plasmodium falciparum
FIPLMDRILISKIVPKTTTK

SEQ ID NO: 3382533 - protein, 39 aa, Plasmodium falciparum
FIQCVYKYWLHIRKRRLLNFVLFGCRFKILFKKRRAKLL

SEQ ID NO: 3382534 - protein, 30 aa, Plasmodium falciparum
FIQDISLDNIFYIIEYRKWDSYIDCIAGAN

SEQ ID NO: 3382535 - protein, 19 aa, Plasmodium falciparum
FIQFNFILNDFFLFKGEEC

SEQ ID NO: 3382536 - protein, 45 aa, Plasmodium falciparum
FIQRNKEVLKNNLKIFFKNENIPFSFLYHKVLTILKSHYNNHVSN

SEQ ID NO: 3382537 - protein, 29 aa, Plasmodium falciparum
FIQSKEKYIIALPFFLNTSPKSSNTRNKK

SEQ ID NO: 3382538 - protein, 24 aa, Plasmodium falciparum
FIRDYLITFIQTKYDILLQQFLEI

SEQ ID NO: 3382539 - protein, 19 aa, Plasmodium falciparum
FIRNKGVYFEYYLGCIETE

SEQ ID NO: 3382540 - protein, 20 aa, Plasmodium falciparum
FISKYFYPRISYKKFSYDTF

SEQ ID NO: 3382541 - protein, 26 aa, Plasmodium falciparum
FISLNSYFLKLLFSKNTYIYYLQEKK

SEQ ID NO: 3382542 - protein, 25 aa, Plasmodium falciparum
FISLQQPCYAIIKPNANFDIEPIKI

SEQ ID NO: 3382543 - protein, 26 aa, Plasmodium falciparum
FISQMNELLLIDPLYINYVITNYFNN

SEQ ID NO: 3382544 - protein, 19 aa, Plasmodium falciparum
FITFTYGPYILHICDPFYK

SEQ ID NO: 3382545 - protein, 26 aa, Plasmodium falciparum
FITVHPKFRLFLSTLPGKEIPISLLQ

SEQ ID NO: 3382546 - protein, 19 aa, Plasmodium falciparum
FIWKFLFSHMNTEKSKEEI

SEQ ID NO: 3382547 - protein, 18 aa, Plasmodium falciparum
FIYAKWIAKKINCKFGSF

SEQ ID NO: 3382548 - protein, 26 aa, Plasmodium falciparum
FKALKEACIILLYLKRYDQFKDLRLD

SEQ ID NO: 3382549 - protein, 19 aa, Plasmodium falciparum
FKDKLCKIGKYHSNRDPFE

SEQ ID NO: 3382550 - protein, 18 aa, Plasmodium falciparum
FKDKYLGLFFGASWCKYC

SEQ ID NO: 3382551 - protein, 17 aa, Plasmodium falciparum
FKDNYILVSHGVFTYCL

SEQ ID NO: 3382552 - protein, 29 aa, Plasmodium falciparum
FKEEKKIYNFYYFSLLPFEKKNLHIYAYS

SEQ ID NO: 3382553 - protein, 20 aa, Plasmodium falciparum
FKEFDIFLFYKINNYHKYKE

SEQ ID NO: 3382554 - protein, 27 aa, Plasmodium falciparum
FKEINNLFFDIKDIYDILLCYNNMRNL

SEQ ID NO: 3382555 - protein, 24 aa, Plasmodium falciparum
FKENLIIYFGNIISYILEKNKNKI

SEQ ID NO: 3382556 - protein, 26 aa, Plasmodium falciparum
FKEQVYDIYRFLSPNTQIILSSATLP

SEQ ID NO: 3382557 - protein, 20 aa, Plasmodium falciparum
FKGFIIICEPYPEATGIYDP

SEQ ID NO: 3382558 - protein, 20 aa, Plasmodium falciparum
FKHIYIIGRRGFWQSSFTNS

SEQ ID NO: 3382559 - protein, 35 aa, Plasmodium falciparum
FKHPHYPDVRSVGMCLYYILRGKVNVNVLKKIFSD

SEQ ID NO: 3382560 - protein, 25 aa, Plasmodium falciparum
FKICSFSRKLLVNALLNLNYEVSYF

SEQ ID NO: 3382561 - protein, 22 aa, Plasmodium falciparum
FKIKNITFYNKKLEYYHLKKKK

SEQ ID NO: 3382562 - protein, 17 aa, Plasmodium falciparum
FKILLIGDSGVGKSCLL

SEQ ID NO: 3382563 - protein, 24 aa, Plasmodium falciparum
FKILTDFINTNIIKLAFNNFYSSM

SEQ ID NO: 3382564 - protein, 25 aa, Plasmodium falciparum
FKIPNTLIISKLPKYLIFTIERFSK

SEQ ID NO: 3382565 - protein, 17 aa, Plasmodium falciparum
FKKDLLLDDSQIFGDSL

SEQ ID NO: 3382566 - protein, 17 aa, Plasmodium falciparum
FKKKKRIIKARDYFSIC

SEQ ID NO: 3382567 - protein, 26 aa, Plasmodium falciparum
FKKMEIIKGFLIKNINKYGINFELLN

SEQ ID NO: 3382568 - protein, 25 aa, Plasmodium falciparum
FKKNKLETFNYIKNIMQQLKHMNIE

SEQ ID NO: 3382569 - protein, 26 aa, Plasmodium falciparum
FKKVFDVYAYWKLFYSLKDKYENEFF

SEQ ID NO: 3382570 - protein, 28 aa, Plasmodium falciparum
FKKYDDFNKYYFLIPNNKINAHIDEHPN

SEQ ID NO: 3382571 - protein, 19 aa, Plasmodium falciparum
FKLCSYYDYFKLFRQKIME

SEQ ID NO: 3382572 - protein, 19 aa, Plasmodium falciparum
FKLLKINTINISDLIWNLQ

SEQ ID NO: 3382573 - protein, 20 aa, Plasmodium falciparum
FKLVNSLYTLFKKYQVNMFD

SEQ ID NO: 3382574 - protein, 21 aa, Plasmodium falciparum
FKMISLKYFSYFKKGPKVSCG

SEQ ID NO: 3382575 - protein, 29 aa, Plasmodium falciparum
FKNDLNCNFLWRHYEKILQDINHLSIDKL

SEQ ID NO: 3382576 - protein, 24 aa, Plasmodium falciparum
FKNENWEKFLPNFKKRNVQRKKIK

SEQ ID NO: 3382577 - protein, 24 aa, Plasmodium falciparum
FKNFKDYINYINYKNYKNYKNYNN

SEQ ID NO: 3382578 - protein, 25 aa, Plasmodium falciparum
FKNGLFHGKGYYKWNYGEDYKVYEG

SEQ ID NO: 3382579 - protein, 18 aa, Plasmodium falciparum
FKNIIARNVSLSHEFPLI

SEQ ID NO: 3382580 - protein, 22 aa, Plasmodium falciparum
FKNIIDINLLKYIFQLPSNNNS

SEQ ID NO: 3382581 - protein, 21 aa, Plasmodium falciparum
FKNILNDDAYYKKLFESEGKY

SEQ ID NO: 3382582 - protein, 26 aa, Plasmodium falciparum
FKNINDLFTFHLSMLDELCIIKKCYQ

SEQ ID NO: 3382583 - protein, 18 aa, Plasmodium falciparum
FKNKPLKVPDLSFLNNSS

SEQ ID NO: 3382584 - protein, 25 aa, Plasmodium falciparum
FKNLQLLKIFNFYELINVINYIYEH

SEQ ID NO: 3382585 - protein, 31 aa, Plasmodium falciparum
FKNPELLYYEVLFYCLNRLPIQRYSIAIPIY

SEQ ID NO: 3382586 - protein, 30 aa, Plasmodium falciparum
FKNPSMTDLINIWNFIFKHVDPLIEVNKDN

SEQ ID NO: 3382587 - protein, 18 aa, Plasmodium falciparum
FKNVDMLNIYKINKDDYL

SEQ ID NO: 3382588 - protein, 25 aa, Plasmodium falciparum
FKNVPQNFFSYAFYISKNAKVNSII

SEQ ID NO: 3382589 - protein, 33 aa, Plasmodium falciparum
FKNYIEYNILPYYFLTKLNDKYFKNIILGAITD

SEQ ID NO: 3382590 - protein, 17 aa, Plasmodium falciparum
FKNYYLKLYDEITNLIL

SEQ ID NO: 3382591 - protein, 17 aa, Plasmodium falciparum
FKPRDDVLTWPSEISLL

SEQ ID NO: 3382592 - protein, 27 aa, Plasmodium falciparum
FKQYFSDIKNHKIMFLWTGDRDGDSID

SEQ ID NO: 3382593 - protein, 19 aa, Plasmodium falciparum
FKRALDLGMIYLKPTDINF

SEQ ID NO: 3382594 - protein, 22 aa, Plasmodium falciparum
FKRCCMLFHRLKNIHSDCLVVT

SEQ ID NO: 3382595 - protein, 19 aa, Plasmodium falciparum
FKRHIGNKIIWGRTNNFFY

SEQ ID NO: 3382596 - protein, 24 aa, Plasmodium falciparum
FKRKECLMKYFYTLKGPQINTERF

SEQ ID NO: 3382597 - protein, 24 aa, Plasmodium falciparum
FKRKHFHRKIIKIKMKNITLTTKN

SEQ ID NO: 3382598 - protein, 17 aa, Plasmodium falciparum
FKRKIFLDKFNKHDKEV

SEQ ID NO: 3382599 - protein, 24 aa, Plasmodium falciparum
FKRQESVSKSLLFSDKNKQIEPIE

SEQ ID NO: 3382600 - protein, 19 aa, Plasmodium falciparum
FKTCKILSYPYKRPIGYIT

SEQ ID NO: 3382601 - protein, 21 aa, Plasmodium falciparum
FKTHIPPKAFGDRVRILMYPS

SEQ ID NO: 3382602 - protein, 32 aa, Plasmodium falciparum
FKTILKNILRKKFYIMYNYLFPKRKTFYFCSY

SEQ ID NO: 3382603 - protein, 18 aa, Plasmodium falciparum
FKVLFPKYREKYLQQFSS

SEQ ID NO: 3382604 - protein, 21 aa, Plasmodium falciparum
FKVTYNMILKLLINKQINIEK

SEQ ID NO: 3382605 - protein, 20 aa, Plasmodium falciparum
FKYIHVSSHPKYRNFKFGGL

SEQ ID NO: 3382606 - protein, 20 aa, Plasmodium falciparum
FKYKNTWYELFFYNNQNNKD

SEQ ID NO: 3382607 - protein, 19 aa, Plasmodium falciparum
FKYNDTLNFILDHMDILQK

SEQ ID NO: 3382608 - protein, 37 aa, Plasmodium falciparum
FKYNFSIKRYFKILVNVSLLNYLPLNLRNISNKVYIF

SEQ ID NO: 3382609 - protein, 27 aa, Plasmodium falciparum
FKYTPIKMVTFFIKKIVKNMYENIIKS

SEQ ID NO: 3382610 - protein, 18 aa, Plasmodium falciparum
FLADNGIIKIYLINNLNK

SEQ ID NO: 3382611 - protein, 19 aa, Plasmodium falciparum
FLANMFCTCSTDNTIKIFD

SEQ ID NO: 3382612 - protein, 20 aa, Plasmodium falciparum
FLCFHKNGCEYIIKKLKEDN

SEQ ID NO: 3382613 - protein, 18 aa, Plasmodium falciparum
FLCIRIYDDDIIISKLFG

SEQ ID NO: 3382614 - protein, 19 aa, Plasmodium falciparum
FLCYIICPNVLNKEYKSYL

SEQ ID NO: 3382615 - protein, 17 aa, Plasmodium falciparum
FLDFIKHFLKIIDEKKE

SEQ ID NO: 3382616 - protein, 19 aa, Plasmodium falciparum
FLDFWNYIYIGSKDLVYSI

SEQ ID NO: 3382617 - protein, 18 aa, Plasmodium falciparum
FLDKFFYEKKVESIQPHH

SEQ ID NO: 3382618 - protein, 18 aa, Plasmodium falciparum
FLDLCNFNEFNKDDEPFY

SEQ ID NO: 3382619 - protein, 24 aa, Plasmodium falciparum
FLDMPNPWLCVDNMKKVLKERGVF

SEQ ID NO: 3382620 - protein, 31 aa, Plasmodium falciparum
FLDSDGKIFILNMYKLIIFEQLKVQNEIQNK

SEQ ID NO: 3382621 - protein, 48 aa, Plasmodium falciparum
FLDTIKNFKEDLLYKKMFENVSRKGLIFILTIQDVLIKKTKKILCNKC

SEQ ID NO: 3382622 - protein, 20 aa, Plasmodium falciparum
FLDVHTIINLSQTCKFFYKR

SEQ ID NO: 3382623 - protein, 25 aa, Plasmodium falciparum
FLENDNFMDYKFLKSLDNSYNVNSN

SEQ ID NO: 3382624 - protein, 27 aa, Plasmodium falciparum
FLERYIESVIVRIYYYIDINDTNRIYL

SEQ ID NO: 3382625 - protein, 18 aa, Plasmodium falciparum
FLFFKKNKKKNDSCDSVI

SEQ ID NO: 3382626 - protein, 22 aa, Plasmodium falciparum
FLFILLNLYINENNFIRNELIN

SEQ ID NO: 3382627 - protein, 26 aa, Plasmodium falciparum
FLFNMEILFLYNFLKNKFSEKTCSFS

SEQ ID NO: 3382628 - protein, 17 aa, Plasmodium falciparum
FLFSINNIFKNVNMYFF

SEQ ID NO: 3382629 - protein, 18 aa, Plasmodium falciparum
FLFYMNYLNKRDFKNFQN

SEQ ID NO: 3382630 - protein, 17 aa, Plasmodium falciparum
FLFYVITEYDEYGYHIT

SEQ ID NO: 3382631 - protein, 19 aa, Plasmodium falciparum
FLGKQYMNLIYNELIFIEY

SEQ ID NO: 3382632 - protein, 44 aa, Plasmodium falciparum
FLGNAFKIFYKYNDVAFFPYIWGKYFHIKLHFENLKYGDRSLHF

SEQ ID NO: 3382633 - protein, 25 aa, Plasmodium falciparum
FLGSHKYPYKGLLDFLAYKCLSEGT

SEQ ID NO: 3382634 - protein, 20 aa, Plasmodium falciparum
FLHKDHELMLLLINTIQKDL

SEQ ID NO: 3382635 - protein, 25 aa, Plasmodium falciparum
FLHKRNCCILIQSHIRRYLMVRFYK

SEQ ID NO: 3382636 - protein, 17 aa, Plasmodium falciparum
FLIALKNYITKNIKMTN

SEQ ID NO: 3382637 - protein, 22 aa, Plasmodium falciparum
FLIEKPFLIFLIPNEKNEFTHI

SEQ ID NO: 3382638 - protein, 19 aa, Plasmodium falciparum
FLIICCDGIFDVITSQEAV

SEQ ID NO: 3382639 - protein, 17 aa, Plasmodium falciparum
FLILFNILDNNKNKKRI

SEQ ID NO: 3382640 - protein, 26 aa, Plasmodium falciparum
FLISNTHFYFHSLAQHIRALQSYTIL

SEQ ID NO: 3382641 - protein, 25 aa, Plasmodium falciparum
FLKDLRSRIISLVLEYLLIIDNGYV

SEQ ID NO: 3382642 - protein, 32 aa, Plasmodium falciparum
FLKDYELMFILFYLKYEYRLPLKCEYLYLYSE

SEQ ID NO: 3382643 - protein, 25 aa, Plasmodium falciparum
FLKEKSIPTFFKCYGLISNPTYNGK

SEQ ID NO: 3382644 - protein, 24 aa, Plasmodium falciparum
FLKKHNYLYKIEIPTNLYRDEGKL

SEQ ID NO: 3382645 - protein, 25 aa, Plasmodium falciparum
FLKNSERILILTSDKKKRFLQPLLD

SEQ ID NO: 3382646 - protein, 25 aa, Plasmodium falciparum
FLKNTFDIIIFNFPFVLPTKECIEK

SEQ ID NO: 3382647 - protein, 25 aa, Plasmodium falciparum
FLKPHNIDSFFLLDLKNIYGGKQIR

SEQ ID NO: 3382648 - protein, 17 aa, Plasmodium falciparum
FLKPIIKNSHISKYKNE

SEQ ID NO: 3382649 - protein, 17 aa, Plasmodium falciparum
FLKSLISNNFIPDHLIP

SEQ ID NO: 3382650 - protein, 21 aa, Plasmodium falciparum
FLKSYISYRLCEINRFGNFYI

SEQ ID NO: 3382651 - protein, 17 aa, Plasmodium falciparum
FLLNINYNEINNIIFLE

SEQ ID NO: 3382652 - protein, 27 aa, Plasmodium falciparum
FLNGRTDVLPNELFLEVTRNENFVQEC

SEQ ID NO: 3382653 - protein, 29 aa, Plasmodium falciparum
FLNLASSYIYFLYFNLGYEQKALNICIDI

SEQ ID NO: 3382654 - protein, 23 aa, Plasmodium falciparum
FLNNILILQYYRNRLINYRNFKN

SEQ ID NO: 3382655 - protein, 32 aa, Plasmodium falciparum
FLNSQICTFFSQKLLPIIYYNNLNSLDKDIGV

SEQ ID NO: 3382656 - protein, 20 aa, Plasmodium falciparum
FLNYLKFYNIPINQFAYDPN

SEQ ID NO: 3382657 - protein, 20 aa, Plasmodium falciparum
FLNYQFDVLSLQQLAYSFSK

SEQ ID NO: 3382658 - protein, 18 aa, Plasmodium falciparum
FLPIPKDIPMELSELLKS

SEQ ID NO: 3382659 - protein, 26 aa, Plasmodium falciparum
FLQEIDKIKLVLYLEKEKYYQEYKNF

SEQ ID NO: 3382660 - protein, 27 aa, Plasmodium falciparum
FLSAYDNLTINFFNHIFSKLNNGEMNM

SEQ ID NO: 3382661 - protein, 18 aa, Plasmodium falciparum
FLSISFIYNALAATYYYG

SEQ ID NO: 3382662 - protein, 19 aa, Plasmodium falciparum
FLSTDYLNIFIVNKSSYNI

SEQ ID NO: 3382663 - protein, 42 aa, Plasmodium falciparum
FLTKEEVMSLLIWIPYWNHVIPTPAIIKPRALWTGKQIFSML

SEQ ID NO: 3382664 - protein, 18 aa, Plasmodium falciparum
FLTNWKRTYRHYSRKQNI

SEQ ID NO: 3382665 - protein, 18 aa, Plasmodium falciparum
FLVCLNFSLPRSNIISMN

SEQ ID NO: 3382666 - protein, 19 aa, Plasmodium falciparum
FLVDLIKQKKLAGKCILLA

SEQ ID NO: 3382667 - protein, 19 aa, Plasmodium falciparum
FLVPSINILYNIKFLPKNG

SEQ ID NO: 3382668 - protein, 20 aa, Plasmodium falciparum
FLYIYEYYKYNCDVFNLLSL

SEQ ID NO: 3382669 - protein, 19 aa, Plasmodium falciparum
FLYLNKLMEFITFFVVNHR

SEQ ID NO: 3382670 - protein, 25 aa, Plasmodium falciparum
FLYNKNILLKWLNNFMIYYLENTKD

SEQ ID NO: 3382671 - protein, 18 aa, Plasmodium falciparum
FMAGCYRWKNIESTFLKA

SEQ ID NO: 3382672 - protein, 23 aa, Plasmodium falciparum
FMDIYEGFYHPSVSLYMGASAKI

SEQ ID NO: 3382673 - protein, 17 aa, Plasmodium falciparum
FMDKIKKKKLKSKNDDI

SEQ ID NO: 3382674 - protein, 34 aa, Plasmodium falciparum
FMDVINNYSIPLFFRIIFLSCYFEFLNNEENEKK

SEQ ID NO: 3382675 - protein, 20 aa, Plasmodium falciparum
FMENTCVCILKFNQCSLMDL

SEQ ID NO: 3382676 - protein, 17 aa, Plasmodium falciparum
FMKKYKIVKKLGEGVYG

SEQ ID NO: 3382677 - protein, 27 aa, Plasmodium falciparum
FMKNHFFEYINFFKKKELYHIEKTKNE

SEQ ID NO: 3382678 - protein, 34 aa, Plasmodium falciparum
FMKVNELYHYMYALGVFEYAVKISLEFGSNIRMS

SEQ ID NO: 3382679 - protein, 25 aa, Plasmodium falciparum
FMNGNMNILMNVPMNEYMNAHMNTN

SEQ ID NO: 3382680 - protein, 21 aa, Plasmodium falciparum
FMRIQIIYDDIIKDELINLLN

SEQ ID NO: 3382681 - protein, 18 aa, Plasmodium falciparum
FMVLKKVGGKLLFFLSSV

SEQ ID NO: 3382682 - protein, 18 aa, Plasmodium falciparum
FMVYIQKYYDFSKTYVDL

SEQ ID NO: 3382683 - protein, 18 aa, Plasmodium falciparum
FMYNNIIIKWIRDKHVVN

SEQ ID NO: 3382684 - protein, 17 aa, Plasmodium falciparum
FNAFLKTPLSNIKVVIV

SEQ ID NO: 3382685 - protein, 27 aa, Plasmodium falciparum
FNDEDKFFFVIFVTFIFNLENEYINDQ

SEQ ID NO: 3382686 - protein, 19 aa, Plasmodium falciparum
FNDIIPQYDYKRIRTNIIN

SEQ ID NO: 3382687 - protein, 25 aa, Plasmodium falciparum
FNDKNKIIKLTKKLCKYKKKRKFND

SEQ ID NO: 3382688 - protein, 47 aa, Plasmodium falciparum
FNDKNYFNYEEYKYIVKYILPSIDDKKLKYSWSILKENIQPQNEQLN

SEQ ID NO: 3382689 - protein, 23 aa, Plasmodium falciparum
FNDRDIYLFNNKYWITKDKNQFS

SEQ ID NO: 3382690 - protein, 19 aa, Plasmodium falciparum
FNDSWNIFIEEKNDRFISI

SEQ ID NO: 3382691 - protein, 26 aa, Plasmodium falciparum
FNEANTGIFDLLENLLVRSGSNNQEN

SEQ ID NO: 3382692 - protein, 33 aa, Plasmodium falciparum
FNEEEARYLFHQILLAIKFLHSKKMALRDISLE

SEQ ID NO: 3382693 - protein, 20 aa, Plasmodium falciparum
FNEELIQKLFLNINAYNIKD

SEQ ID NO: 3382694 - protein, 25 aa, Plasmodium falciparum
FNEETCTIWDLVMKNKKKKVKKKRD

SEQ ID NO: 3382695 - protein, 25 aa, Plasmodium falciparum
FNEFVKKYFLLYKKNNKTNQHFNNT

SEQ ID NO: 3382696 - protein, 23 aa, Plasmodium falciparum
FNEKFLFYHTDSCNSDFCIPTDD

SEQ ID NO: 3382697 - protein, 18 aa, Plasmodium falciparum
FNEKLKIQNSLNDDFFDF

SEQ ID NO: 3382698 - protein, 20 aa, Plasmodium falciparum
FNENIEFFSYLFSIPNMRNK

SEQ ID NO: 3382699 - protein, 39 aa, Plasmodium falciparum
FNENKIIDQSIINKLLYLKKSFDFYMYDSVIQEIRENKN

SEQ ID NO: 3382700 - protein, 33 aa, Plasmodium falciparum
FNENRKKYTAFLPYLKHFYPNRLKDLIEQLEKY

SEQ ID NO: 3382701 - protein, 25 aa, Plasmodium falciparum
FNEPYNFDLIYINNIYFKHFISNKI

SEQ ID NO: 3382702 - protein, 19 aa, Plasmodium falciparum
FNEQYPICVKKRSSKMRPF

SEQ ID NO: 3382703 - protein, 28 aa, Plasmodium falciparum
FNERYYEDDLSFLNFPGTITSYDKNHQR

SEQ ID NO: 3382704 - protein, 17 aa, Plasmodium falciparum
FNEYIPMNGFRSIYHNN

SEQ ID NO: 3382705 - protein, 17 aa, Plasmodium falciparum
FNFLFVQNTLPTVIYNT

SEQ ID NO: 3382706 - protein, 22 aa, Plasmodium falciparum
FNFPLCILSILEKKFINNFYVL

SEQ ID NO: 3382707 - protein, 18 aa, Plasmodium falciparum
FNFVLKKDKVNLPLLNLR

SEQ ID NO: 3382708 - protein, 17 aa, Plasmodium falciparum
FNFYNKNEKRKYYENNA

SEQ ID NO: 3382709 - protein, 36 aa, Plasmodium falciparum
FNGDNIYHYVLQKKNLDVLKILKLSGKHYNYIFEKN

SEQ ID NO: 3382710 - protein, 19 aa, Plasmodium falciparum
FNGIKIWIESARFIEQTKL

SEQ ID NO: 3382711 - protein, 25 aa, Plasmodium falciparum
FNGQNNYIPIEQLAVNIPTDDKSVK

SEQ ID NO: 3382712 - protein, 21 aa, Plasmodium falciparum
FNHCAYRYTLFCRCARELGED

SEQ ID NO: 3382713 - protein, 22 aa, Plasmodium falciparum
FNHCAYRYTLFCRCARELGEDH

SEQ ID NO: 3382714 - protein, 24 aa, Plasmodium falciparum
FNHIKKYTNMYYFRGLQKCDEDDM

SEQ ID NO: 3382715 - protein, 18 aa, Plasmodium falciparum
FNHLIHPEALRLHELYMK

SEQ ID NO: 3382716 - protein, 29 aa, Plasmodium falciparum
FNIGKSIHCKKLIYISGDKRYIRKRNNKN

SEQ ID NO: 3382717 - protein, 18 aa, Plasmodium falciparum
FNIIKDLNTGLNKGYGFF

SEQ ID NO: 3382718 - protein, 19 aa, Plasmodium falciparum
FNIIRQYTDFFKSQKKKHI

SEQ ID NO: 3382719 - protein, 23 aa, Plasmodium falciparum
FNILNMFLKILINTNSFIHIKLN

SEQ ID NO: 3382720 - protein, 30 aa, Plasmodium falciparum
FNIRLDTLAHLLYYPQKPLVCTKVMEYLRF

SEQ ID NO: 3382721 - protein, 17 aa, Plasmodium falciparum
FNIWPKQCDINGNKKLL

SEQ ID NO: 3382722 - protein, 26 aa, Plasmodium falciparum
FNIYMNNYFVFVFPNFLHSSNRYKLL

SEQ ID NO: 3382723 - protein, 18 aa, Plasmodium falciparum
FNKDANWIISCDSGGVVK

SEQ ID NO: 3382724 - protein, 18 aa, Plasmodium falciparum
FNKINKNGYHILYLTARA

SEQ ID NO: 3382725 - protein, 20 aa, Plasmodium falciparum
FNKKIIIKYVLYDCKNKTYM

SEQ ID NO: 3382726 - protein, 28 aa, Plasmodium falciparum
FNKLCHTIYIFIITKYPFLQEKRINNNY

SEQ ID NO: 3382727 - protein, 25 aa, Plasmodium falciparum
FNKNDNIFFCIPTNNIQYFEVLFSV

SEQ ID NO: 3382728 - protein, 25 aa, Plasmodium falciparum
FNKNLGNLIYNISKLILHNSNNNNS

SEQ ID NO: 3382729 - protein, 25 aa, Plasmodium falciparum
FNKNNNLLKFNPIKQFYLSSDINHA

SEQ ID NO: 3382730 - protein, 19 aa, Plasmodium falciparum
FNKPIQFNQINWNLNNLCT

SEQ ID NO: 3382731 - protein, 17 aa, Plasmodium falciparum
FNKSIFMYDEYTSISCA

SEQ ID NO: 3382732 - protein, 18 aa, Plasmodium falciparum
FNLAKEKAPAIIFIDELD

SEQ ID NO: 3382733 - protein, 18 aa, Plasmodium falciparum
FNLAKFIAEKYINMLRKN

SEQ ID NO: 3382734 - protein, 17 aa, Plasmodium falciparum
FNLIKRIKNYNFKEDSI

SEQ ID NO: 3382735 - protein, 17 aa, Plasmodium falciparum
FNLILPNVSLNEDNYGY

SEQ ID NO: 3382736 - protein, 24 aa, Plasmodium falciparum
FNLKKKYVIGFLWSMVKTINIIEQ

SEQ ID NO: 3382737 - protein, 19 aa, Plasmodium falciparum
FNLLSIYFLQNIDLINNHY

SEQ ID NO: 3382738 - protein, 22 aa, Plasmodium falciparum
FNLNYHLHFCQEKKISTILFIR

SEQ ID NO: 3382739 - protein, 20 aa, Plasmodium falciparum
FNNALFNNTPLNNNFSNFMN

SEQ ID NO: 3382740 - protein, 17 aa, Plasmodium falciparum
FNNDNFNNYLYGERLDE

SEQ ID NO: 3382741 - protein, 23 aa, Plasmodium falciparum
FNNEEFIYLKVIESSIYKTEVIG

SEQ ID NO: 3382742 - protein, 17 aa, Plasmodium falciparum
FNNIDSLVIWRIKKFLS

SEQ ID NO: 3382743 - protein, 34 aa, Plasmodium falciparum
FNNISVACKYIFKKYGIRKVFIFDWDVHHDNGTQ

SEQ ID NO: 3382744 - protein, 26 aa, Plasmodium falciparum
FNNKALAFDIPLSISPDLLEHHYFKK

SEQ ID NO: 3382745 - protein, 32 aa, Plasmodium falciparum
FNNKKALNSLYKTIIFIFKLSNEKNGFNTFCK

SEQ ID NO: 3382746 - protein, 24 aa, Plasmodium falciparum
FNNKKYCMKLFYLIPCLKNNCPYY

SEQ ID NO: 3382747 - protein, 23 aa, Plasmodium falciparum
FNNKKYTKLIIKDNLCNNKYKHN

SEQ ID NO: 3382748 - protein, 36 aa, Plasmodium falciparum
FNNKNKIVYFKYKILKIHFNCFGSGDLFSCLLLSFI

SEQ ID NO: 3382749 - protein, 18 aa, Plasmodium falciparum
FNNLFLNFKRKHFHRKII

SEQ ID NO: 3382750 - protein, 28 aa, Plasmodium falciparum
FNNMMTSPLYYYYYYYYDNDPSKGYCNL

SEQ ID NO: 3382751 - protein, 26 aa, Plasmodium falciparum
FNNNNFVDGWWFRRNQEIDQIPKNEY

SEQ ID NO: 3382752 - protein, 20 aa, Plasmodium falciparum
FNNYDFETPIKILSSKKKSY

SEQ ID NO: 3382753 - protein, 34 aa, Plasmodium falciparum
FNNYELRLHFILPNFAFAIPMSLYLKMNTHLNLD

SEQ ID NO: 3382754 - protein, 30 aa, Plasmodium falciparum
FNNYKMFLNTNIFLLLKFDNIPLHTMNNQD

SEQ ID NO: 3382755 - protein, 17 aa, Plasmodium falciparum
FNPSGLLAQEKIYKNGI

SEQ ID NO: 3382756 - protein, 23 aa, Plasmodium falciparum
FNQCENVIESIFSSSKKIKYRQA

SEQ ID NO: 3382757 - protein, 30 aa, Plasmodium falciparum
FNRINDVFEFFPLCVLLDKNILCIHGGIGD

SEQ ID NO: 3382758 - protein, 30 aa, Plasmodium falciparum
FNRITKKEDFLFLINAKLYDTIKNKNNIYY

SEQ ID NO: 3382759 - protein, 25 aa, Plasmodium falciparum
FNRKDILLNIVNNFKFDNILIEKKK

SEQ ID NO: 3382760 - protein, 23 aa, Plasmodium falciparum
FNRKYILINMYIWKNFTIEERKR

SEQ ID NO: 3382761 - protein, 27 aa, Plasmodium falciparum
FNSKGQLICPAYFLWRSKLKENKKVKE

SEQ ID NO: 3382762 - protein, 25 aa, Plasmodium falciparum
FNSLNHIIKHKIYFPSKSNKSYFSS

SEQ ID NO: 3382763 - protein, 26 aa, Plasmodium falciparum
FNSSTLPYKGILLYGPPGTGKTFLAL

SEQ ID NO: 3382764 - protein, 24 aa, Plasmodium falciparum
FNSYPNNILNYNLNNQFINAYPIN

SEQ ID NO: 3382765 - protein, 18 aa, Plasmodium falciparum
FNTFNPSLNLIMNNPKKN

SEQ ID NO: 3382766 - protein, 17 aa, Plasmodium falciparum
FNTILYNTIRQNNIFFN

SEQ ID NO: 3382767 - protein, 18 aa, Plasmodium falciparum
FNTMLYVKDDYVDKCDEG

SEQ ID NO: 3382768 - protein, 26 aa, Plasmodium falciparum
FNVDTKNFIPVVYPVENKNGAYSIPR

SEQ ID NO: 3382769 - protein, 18 aa, Plasmodium falciparum
FNVKNLVQQFLEKIKYII

SEQ ID NO: 3382770 - protein, 19 aa, Plasmodium falciparum
FNVLTKLNIPAENYPFCTI

SEQ ID NO: 3382771 - protein, 24 aa, Plasmodium falciparum
FNVNNKFIPYNPNSDMLHISNNTI

SEQ ID NO: 3382772 - protein, 19 aa, Plasmodium falciparum
FNWIIKNLESPRYYSPLKW

SEQ ID NO: 3382773 - protein, 18 aa, Plasmodium falciparum
FNYDVFLISIYDSNEKKR

SEQ ID NO: 3382774 - protein, 23 aa, Plasmodium falciparum
FNYIHIHNIIYTKLSYINYHTPY

SEQ ID NO: 3382775 - protein, 17 aa, Plasmodium falciparum
FNYLEKQDYILGSSTNI

SEQ ID NO: 3382776 - protein, 23 aa, Plasmodium falciparum
FNYLNPFHNFLSFKKKNQNNFYF

SEQ ID NO: 3382777 - protein, 17 aa, Plasmodium falciparum
FNYNINYENFDESNLYA

SEQ ID NO: 3382778 - protein, 17 aa, Plasmodium falciparum
FPDIGCCYFFRKYFGRN

SEQ ID NO: 3382779 - protein, 24 aa, Plasmodium falciparum
FPDRVKPYYSFIKKALAACEHKCT

SEQ ID NO: 3382780 - protein, 27 aa, Plasmodium falciparum
FPEERIILSYVKYYYVYRLVNMKKNCD

SEQ ID NO: 3382781 - protein, 21 aa, Plasmodium falciparum
FPHNNFRHNNIPHNNFRHNNI

SEQ ID NO: 3382782 - protein, 19 aa, Plasmodium falciparum
FPHYGVVNEDFLLLKGCVA

SEQ ID NO: 3382783 - protein, 31 aa, Plasmodium falciparum
FPIHKKNCIIFLLLKYIYMWKNMNLNAHMFI

SEQ ID NO: 3382784 - protein, 17 aa, Plasmodium falciparum
FPQYGPINTPPSINKKN

SEQ ID NO: 3382785 - protein, 19 aa, Plasmodium falciparum
FPRNYTIPQTAWATRDNRR

SEQ ID NO: 3382786 - protein, 19 aa, Plasmodium falciparum
FPSNICLVLLMSGFITQEI

SEQ ID NO: 3382787 - protein, 18 aa, Plasmodium falciparum
FPTFLKNWKIIVSILNEH

SEQ ID NO: 3382788 - protein, 31 aa, Plasmodium falciparum
FPTIKGILRRGLTKEALFQFILEQGPSKAGN

SEQ ID NO: 3382789 - protein, 17 aa, Plasmodium falciparum
FPTILLSANIPLSKSVF

SEQ ID NO: 3382790 - protein, 18 aa, Plasmodium falciparum
FPVQSMVIPIFLSGRDHI

SEQ ID NO: 3382791 - protein, 26 aa, Plasmodium falciparum
FQAIIHFSHIFINTLKNLFKTRNSDE

SEQ ID NO: 3382792 - protein, 19 aa, Plasmodium falciparum
FQEVYNLCLYILEANVYNK

SEQ ID NO: 3382793 - protein, 26 aa, Plasmodium falciparum
FQFFNIFKEVRYLQSINLRVPYSIKV

SEQ ID NO: 3382794 - protein, 27 aa, Plasmodium falciparum
FQGHNKKFTFPSLSPTDVLIPGKEHEN

SEQ ID NO: 3382795 - protein, 28 aa, Plasmodium falciparum
FQIKKDIIYYFLFYKNSYEYNIYDRPDI

SEQ ID NO: 3382796 - protein, 31 aa, Plasmodium falciparum
FQKCEELFNKGIWLFKIFNNTLNEKKIFKII

SEQ ID NO: 3382797 - protein, 18 aa, Plasmodium falciparum
FQKFNFKLPIKVESGGVY

SEQ ID NO: 3382798 - protein, 28 aa, Plasmodium falciparum
FQKKLKPMVYVPYWWYNEIAFCENNLDE

SEQ ID NO: 3382799 - protein, 18 aa, Plasmodium falciparum
FQKLIIIKILRPDRLNKA

SEQ ID NO: 3382800 - protein, 26 aa, Plasmodium falciparum
FQKNIYFFEIFIYMDLIKLIDSLDIS

SEQ ID NO: 3382801 - protein, 30 aa, Plasmodium falciparum
FQLCDFKKDFFLWKPFIIFSDKNIIKKIYP

SEQ ID NO: 3382802 - protein, 18 aa, Plasmodium falciparum
FQLKNLFNDVSLNKLNTY

SEQ ID NO: 3382803 - protein, 22 aa, Plasmodium falciparum
FQNEMILKSLLLNLEGSHTNNN

SEQ ID NO: 3382804 - protein, 25 aa, Plasmodium falciparum
FQNHIWKQFTFGKLELFFNVSNGFI

SEQ ID NO: 3382805 - protein, 17 aa, Plasmodium falciparum
FQNLLKEYSMKPKFLRV

SEQ ID NO: 3382806 - protein, 24 aa, Plasmodium falciparum
FQNNILSLDIPLDSSLLNGDEEKL

SEQ ID NO: 3382807 - protein, 30 aa, Plasmodium falciparum
FQSNNERLRRMIYLLIKNLPVSEKEIFIVT

SEQ ID NO: 3382808 - protein, 25 aa, Plasmodium falciparum
FQVDEKYYFLIKQKQLESPFFSLCK

SEQ ID NO: 3382809 - protein, 32 aa, Plasmodium falciparum
FQVPLITNMKLCSLFIDSLYRKFSRQKERKSF

SEQ ID NO: 3382810 - protein, 20 aa, Plasmodium falciparum
FRFQTLISCMLSSRTKDEVT

SEQ ID NO: 3382811 - protein, 17 aa, Plasmodium falciparum
FRFVKYINNFLHKASYE

SEQ ID NO: 3382812 - protein, 17 aa, Plasmodium falciparum
FRGSRGNGNILRISLPC

SEQ ID NO: 3382813 - protein, 29 aa, Plasmodium falciparum
FRHNNIPHNNFLPNNFPHNNIPHNNFPPN

SEQ ID NO: 3382814 - protein, 17 aa, Plasmodium falciparum
FRICSLSGIYKKYSFFK

SEQ ID NO: 3382815 - protein, 19 aa, Plasmodium falciparum
FRIFLRLVLLDKECGIEAG

SEQ ID NO: 3382816 - protein, 24 aa, Plasmodium falciparum
FRINKIPLPFQIYNNFNIVVQIDL

SEQ ID NO: 3382817 - protein, 33 aa, Plasmodium falciparum
FRINSEWQLVYLDGWPHIILTSIPGVEINPGEE

SEQ ID NO: 3382818 - protein, 24 aa, Plasmodium falciparum
FRISSFLILNNEFFGYPLQFVCET

SEQ ID NO: 3382819 - protein, 18 aa, Plasmodium falciparum
FRKAVCMMIFNIENIIGK

SEQ ID NO: 3382820 - protein, 19 aa, Plasmodium falciparum
FRKDKKWNIHLSKITLKFN

SEQ ID NO: 3382821 - protein, 17 aa, Plasmodium falciparum
FRLRLALSLISGKAITI

SEQ ID NO: 3382822 - protein, 18 aa, Plasmodium falciparum
FRNVVIENAYYKNKLLYK

SEQ ID NO: 3382823 - protein, 20 aa, Plasmodium falciparum
FRPERIVAIAKRYGLHPTDC

SEQ ID NO: 3382824 - protein, 21 aa, Plasmodium falciparum
FSAAKKEVFPGFSTGIIGNNT

SEQ ID NO: 3382825 - protein, 19 aa, Plasmodium falciparum
FSCILFVNHFFYHINQKSK

SEQ ID NO: 3382826 - protein, 19 aa, Plasmodium falciparum
FSCVQSITHLFILKKRQTI

SEQ ID NO: 3382827 - protein, 22 aa, Plasmodium falciparum
FSCYIKIYWQNKKYKSCILQKN

SEQ ID NO: 3382828 - protein, 28 aa, Plasmodium falciparum
FSCYQYEKLFLKKLVYYSFNNLGNNLKA

SEQ ID NO: 3382829 - protein, 23 aa, Plasmodium falciparum
FSDKHEILIPLEGYDKKKYIIEN

SEQ ID NO: 3382830 - protein, 24 aa, Plasmodium falciparum
FSDNINWYHYPLGGQYNNIDLYKN

SEQ ID NO: 3382831 - protein, 17 aa, Plasmodium falciparum
FSEIFKKVKNKIYDNII

SEQ ID NO: 3382832 - protein, 28 aa, Plasmodium falciparum
FSEPTAIQKITWPIALSGKDLIGVAETG

SEQ ID NO: 3382833 - protein, 17 aa, Plasmodium falciparum
FSEYIFSCGYSDGLISV

SEQ ID NO: 3382834 - protein, 17 aa, Plasmodium falciparum
FSFDRNFKKKNDFKNIV

SEQ ID NO: 3382835 - protein, 27 aa, Plasmodium falciparum
FSFICSTTRNILPIRKIILFTENRKEP

SEQ ID NO: 3382836 - protein, 21 aa, Plasmodium falciparum
FSFIRNFAEKYKNVIFHGFKK

SEQ ID NO: 3382837 - protein, 27 aa, Plasmodium falciparum
FSGNFLSYIYNQFEFCCINFFDELKKK

SEQ ID NO: 3382838 - protein, 23 aa, Plasmodium falciparum
FSGSSMSYSFDKEKYLYRSNDMS

SEQ ID NO: 3382839 - protein, 24 aa, Plasmodium falciparum
FSHIYICWNSVIFPYQFEIHTKWE

SEQ ID NO: 3382840 - protein, 31 aa, Plasmodium falciparum
FSIEGRTCNICKMVFANKKLMKRHLMCVHSD

SEQ ID NO: 3382841 - protein, 26 aa, Plasmodium falciparum
FSIKNKVRGLLTYCLGKAIELLKNDF

SEQ ID NO: 3382842 - protein, 18 aa, Plasmodium falciparum
FSIQNTINIIKNYSFLYP

SEQ ID NO: 3382843 - protein, 27 aa, Plasmodium falciparum
FSKCLRNFISKIYTLKRKKIIRSPFWL

SEQ ID NO: 3382844 - protein, 26 aa, Plasmodium falciparum
FSKDNRLIFFALQNNTLLIYDIISNT

SEQ ID NO: 3382845 - protein, 17 aa, Plasmodium falciparum
FSKYVKSLPDPPPGKSR

SEQ ID NO: 3382846 - protein, 25 aa, Plasmodium falciparum
FSLIQKVVVYLKVCKELFLFQKNNL

SEQ ID NO: 3382847 - protein, 19 aa, Plasmodium falciparum
FSLLNNFINLLISVSNLLA

SEQ ID NO: 3382848 - protein, 23 aa, Plasmodium falciparum
FSLNIAELYMFRIYVQHFSDEQE

SEQ ID NO: 3382849 - protein, 31 aa, Plasmodium falciparum
FSLQRNQYKSCVYFEFVLTNINLDKYRRDIL

SEQ ID NO: 3382850 - protein, 19 aa, Plasmodium falciparum
FSMFVQSICSIPLPNDLLS

SEQ ID NO: 3382851 - protein, 29 aa, Plasmodium falciparum
FSNCQTLYDFILFFKTLLSKYSDELNNRI

SEQ ID NO: 3382852 - protein, 29 aa, Plasmodium falciparum
FSNLYKDIGIKIAIFPLSLHEEKNTDILY

SEQ ID NO: 3382853 - protein, 17 aa, Plasmodium falciparum
FSNNVWYRLYASWKQGT

SEQ ID NO: 3382854 - protein, 18 aa, Plasmodium falciparum
FSNRSKRWTICPSYICCN

SEQ ID NO: 3382855 - protein, 32 aa, Plasmodium falciparum
FSNVELSFDLLIRRFDKILRLTKKYEQLLEEN

SEQ ID NO: 3382856 - protein, 21 aa, Plasmodium falciparum
FSNWCPLKIINKGLGTFHSTD

SEQ ID NO: 3382857 - protein, 33 aa, Plasmodium falciparum
FSPCDYWLCAATDRFIRIWNLESKLIISEIYPV

SEQ ID NO: 3382858 - protein, 26 aa, Plasmodium falciparum
FSQFMKFMYVYNFLRRSKKEKTNKNN

SEQ ID NO: 3382859 - protein, 31 aa, Plasmodium falciparum
FSRAFIVNMYDKYFKKRLFDFVRYENNMGIR

SEQ ID NO: 3382860 - protein, 26 aa, Plasmodium falciparum
FSRDILSPIILFKHKLNMLKYGDNDY

SEQ ID NO: 3382861 - protein, 17 aa, Plasmodium falciparum
FSRFNLTQSCKLLYNIY

SEQ ID NO: 3382862 - protein, 18 aa, Plasmodium falciparum
FSRIKNCNYYSDTDKRKT

SEQ ID NO: 3382863 - protein, 26 aa, Plasmodium falciparum
FSRLIENELFIKYYFVQNEKNKIVNV

SEQ ID NO: 3382864 - protein, 27 aa, Plasmodium falciparum
FSSGKNLFGIPIARTTNNLFLQKIESN

SEQ ID NO: 3382865 - protein, 20 aa, Plasmodium falciparum
FSSILYIYNIHHINIDCFYP

SEQ ID NO: 3382866 - protein, 24 aa, Plasmodium falciparum
FSSNRPYLLKAPSELAIPKTASKI

SEQ ID NO: 3382867 - protein, 29 aa, Plasmodium falciparum
FSSQNKLNSIYYFNLPVSVIKQTLKEISS

SEQ ID NO: 3382868 - protein, 27 aa, Plasmodium falciparum
FSSVNYPDILPIQYLSKIQLNDVKNLS

SEQ ID NO: 3382869 - protein, 17 aa, Plasmodium falciparum
FSTFIGCTFISCNKQCS

SEQ ID NO: 3382870 - protein, 22 aa, Plasmodium falciparum
FSTFYEALPTFFNKDNFVQVKN

SEQ ID NO: 3382871 - protein, 29 aa, Plasmodium falciparum
FSTGSCGWHIMDKIYLLVGDRNVLCQFCI

SEQ ID NO: 3382872 - protein, 26 aa, Plasmodium falciparum
FSTQRFGYDVAISLSIDFYKNLGGLK

SEQ ID NO: 3382873 - protein, 18 aa, Plasmodium falciparum
FSTTLKCLNLLYKKVKTD

SEQ ID NO: 3382874 - protein, 17 aa, Plasmodium falciparum
FSTVWVATDLKSKPLKF

SEQ ID NO: 3382875 - protein, 23 aa, Plasmodium falciparum
FSTYDFILLDMLITKNIPFQIII

SEQ ID NO: 3382876 - protein, 17 aa, Plasmodium falciparum
FSYALTFKHFYDIHNVL

SEQ ID NO: 3382877 - protein, 17 aa, Plasmodium falciparum
FSYKHNENFWLKCDDDK

SEQ ID NO: 3382878 - protein, 30 aa, Plasmodium falciparum
FSYKKINHILATLLWNSKLQIYRGKGVFVA

SEQ ID NO: 3382879 - protein, 25 aa, Plasmodium falciparum
FSYKNYKERYYYDKGNRIKHNNSIT

SEQ ID NO: 3382880 - protein, 17 aa, Plasmodium falciparum
FSYYHLEPLIYNFIKTL

SEQ ID NO: 3382881 - protein, 51 aa, Plasmodium falciparum
FTACDNIQLSILLIKKILIILEEMKIFFIEQNYFAFYGTSLLFVFDSDPSK

SEQ ID NO: 3382882 - protein, 25 aa, Plasmodium falciparum
FTDIPFDHNFFPNNFVLLHMNVHIA

SEQ ID NO: 3382883 - protein, 31 aa, Plasmodium falciparum
FTDSFKYRYFYLPATWLLATLFPTYRQKTGS

SEQ ID NO: 3382884 - protein, 18 aa, Plasmodium falciparum
FTEFLNYIISRLLYKDKK

SEQ ID NO: 3382885 - protein, 21 aa, Plasmodium falciparum
FTGNYLFVIQKGLDIFKKEIN

SEQ ID NO: 3382886 - protein, 19 aa, Plasmodium falciparum
FTHICENVHFKLTRNKLEL

SEQ ID NO: 3382887 - protein, 19 aa, Plasmodium falciparum
FTHSVRIPIYPTPQNMLYN

SEQ ID NO: 3382888 - protein, 34 aa, Plasmodium falciparum
FTIITEEPAILYPKKLWTGKQLITSILKTVIDKV

SEQ ID NO: 3382889 - protein, 18 aa, Plasmodium falciparum
FTKTLSDLFYWIEYESAQ

SEQ ID NO: 3382890 - protein, 26 aa, Plasmodium falciparum
FTLCKGFAFTFLFIESYKNLDEFTKL

SEQ ID NO: 3382891 - protein, 30 aa, Plasmodium falciparum
FTNCCWLNDGILLLINKNNYIIFYDVKKEK

SEQ ID NO: 3382892 - protein, 17 aa, Plasmodium falciparum
FTNRILISIGNILKGFH

SEQ ID NO: 3382893 - protein, 22 aa, Plasmodium falciparum
FTNVIPYGLLYDKLKKEKNNDV

SEQ ID NO: 3382894 - protein, 29 aa, Plasmodium falciparum
FTQELIKQLAWIAPNLIQLNKVTITKEVF

SEQ ID NO: 3382895 - protein, 26 aa, Plasmodium falciparum
FTRQAIIKQFVWKRKMYKWLKGIFNK

SEQ ID NO: 3382896 - protein, 23 aa, Plasmodium falciparum
FTTVLFHPNIYPSGTVCLSILNE

SEQ ID NO: 3382897 - protein, 17 aa, Plasmodium falciparum
FTTYLLLEYDYSYFTFL

SEQ ID NO: 3382898 - protein, 19 aa, Plasmodium falciparum
FVDKNLPTEKYPGAVLETV

SEQ ID NO: 3382899 - protein, 27 aa, Plasmodium falciparum
FVEQEKVLKFKLYTLNNDIFSKNEKLN

SEQ ID NO: 3382900 - protein, 19 aa, Plasmodium falciparum
FVFSLNMNTQILKNKLLEM

SEQ ID NO: 3382901 - protein, 17 aa, Plasmodium falciparum
FVGRFRQNKPTGEGTWI

SEQ ID NO: 3382902 - protein, 19 aa, Plasmodium falciparum
FVHKENNIIILSKNTEDSN

SEQ ID NO: 3382903 - protein, 18 aa, Plasmodium falciparum
FVHSIIHDTFLNTSLQTT

SEQ ID NO: 3382904 - protein, 28 aa, Plasmodium falciparum
FVHYNNIYYIIVYKNFKIFNLNSFQLLV

SEQ ID NO: 3382905 - protein, 17 aa, Plasmodium falciparum
FVIGRVMLLNNIHILHS

SEQ ID NO: 3382906 - protein, 27 aa, Plasmodium falciparum
FVIKNYLNVFILYKDYTLILYSEKSQN

SEQ ID NO: 3382907 - protein, 40 aa, Plasmodium falciparum
FVIKRNKVFNKKNGKLYKFYPFYNELLLKYENDPNGKVET

SEQ ID NO: 3382908 - protein, 23 aa, Plasmodium falciparum
FVKIEYYPYFFNDIIFGINNKIN

SEQ ID NO: 3382909 - protein, 33 aa, Plasmodium falciparum
FVKISLFLFFFVHKNFIYSYKINGGFLKYENYN

SEQ ID NO: 3382910 - protein, 17 aa, Plasmodium falciparum
FVKKKILKYICKNEIIE

SEQ ID NO: 3382911 - protein, 20 aa, Plasmodium falciparum
FVKLFNCLILFLKENDHNIY

SEQ ID NO: 3382912 - protein, 21 aa, Plasmodium falciparum
FVKLIENILSLKTKYDYIFVE

SEQ ID NO: 3382913 - protein, 19 aa, Plasmodium falciparum
FVKSFAFFTRKNLAYYLRR

SEQ ID NO: 3382914 - protein, 35 aa, Plasmodium falciparum
FVKYDFSNILKCSYLFLLVLINYSKNVRVLSVDES

SEQ ID NO: 3382915 - protein, 19 aa, Plasmodium falciparum
FVLKKSLLNPSCKIIVIMN

SEQ ID NO: 3382916 - protein, 20 aa, Plasmodium falciparum
FVLKWIIERKTLNDLSASII

SEQ ID NO: 3382917 - protein, 17 aa, Plasmodium falciparum
FVLNVPIWEGILNTIDE

SEQ ID NO: 3382918 - protein, 43 aa, Plasmodium falciparum
FVMMDEHLLDIITHYIIKLNKVPLYLRFLPSYNIGSMTDIKNE

SEQ ID NO: 3382919 - protein, 19 aa, Plasmodium falciparum
FVNFKFTGDVRPWPLSKIN

SEQ ID NO: 3382920 - protein, 17 aa, Plasmodium falciparum
FVNFLEHYESDISICSN

SEQ ID NO: 3382921 - protein, 28 aa, Plasmodium falciparum
FVNGHILQGIWNSGLLEKVINYELTPSS

SEQ ID NO: 3382922 - protein, 18 aa, Plasmodium falciparum
FVNNKYVVYGLSADTAED

SEQ ID NO: 3382923 - protein, 20 aa, Plasmodium falciparum
FVNNVYHFAISYEQSLKHNE

SEQ ID NO: 3382924 - protein, 19 aa, Plasmodium falciparum
FVNQLMYDLTSFHYENYMK

SEQ ID NO: 3382925 - protein, 17 aa, Plasmodium falciparum
FVNQMPLQLFKIKLLYN

SEQ ID NO: 3382926 - protein, 17 aa, Plasmodium falciparum
FVNYDKFMIKYINKKKK

SEQ ID NO: 3382927 - protein, 24 aa, Plasmodium falciparum
FVQLCGMLVLAYKPNDILSNMPYI

SEQ ID NO: 3382928 - protein, 17 aa, Plasmodium falciparum
FVQNSFYTGLSPTEFFF

SEQ ID NO: 3382929 - protein, 18 aa, Plasmodium falciparum
FVTLIWAYEEILKNIQNQ

SEQ ID NO: 3382930 - protein, 29 aa, Plasmodium falciparum
FVTNHFMGVLIKYFLLFDFDDIQNEKETL

SEQ ID NO: 3382931 - protein, 21 aa, Plasmodium falciparum
FVTYCFTKYYALKLSKNLCIQ

SEQ ID NO: 3382932 - protein, 25 aa, Plasmodium falciparum
FVVRKKYLIFKYYIKYMQNQIQMLS

SEQ ID NO: 3382933 - protein, 17 aa, Plasmodium falciparum
FVYLKKIPTQEKQQHVS

SEQ ID NO: 3382934 - protein, 19 aa, Plasmodium falciparum
FVYLVLEYLKGGELFEYLN

SEQ ID NO: 3382935 - protein, 17 aa, Plasmodium falciparum
FVYPMFKNENIYNFSEH

SEQ ID NO: 3382936 - protein, 17 aa, Plasmodium falciparum
FWNHLKDGNVKNKVEKN

SEQ ID NO: 3382937 - protein, 21 aa, Plasmodium falciparum
FYAFSNLYPCHICKLDLLHIL

SEQ ID NO: 3382938 - protein, 17 aa, Plasmodium falciparum
FYDDYLALDLFSFLSEQ

SEQ ID NO: 3382939 - protein, 17 aa, Plasmodium falciparum
FYDFMKNDFFNIFNNNI

SEQ ID NO: 3382940 - protein, 19 aa, Plasmodium falciparum
FYDLRDIILGYDNLEDNST

SEQ ID NO: 3382941 - protein, 23 aa, Plasmodium falciparum
FYDNLKNILLYKPKENCQICLFS

SEQ ID NO: 3382942 - protein, 20 aa, Plasmodium falciparum
FYDNRQIMCPYNKKKDIFNN

SEQ ID NO: 3382943 - protein, 20 aa, Plasmodium falciparum
FYDVYGKLFDDIIKEENEEI

SEQ ID NO: 3382944 - protein, 18 aa, Plasmodium falciparum
FYDYFLEKSWSLMHIPPN

SEQ ID NO: 3382945 - protein, 18 aa, Plasmodium falciparum
FYEFFYYNHKDDNQFLFV

SEQ ID NO: 3382946 - protein, 19 aa, Plasmodium falciparum
FYEKNNFVEIKRININENF

SEQ ID NO: 3382947 - protein, 20 aa, Plasmodium falciparum
FYERNNISIFLIPYSEHSNL

SEQ ID NO: 3382948 - protein, 29 aa, Plasmodium falciparum
FYETPHSFHFLFMMEKKYNYMFKNYNHKN

SEQ ID NO: 3382949 - protein, 21 aa, Plasmodium falciparum
FYFICSKMENTKRKENDNCKE

SEQ ID NO: 3382950 - protein, 26 aa, Plasmodium falciparum
FYFSKNEWYFIRDIDFFFPSYDNICL

SEQ ID NO: 3382951 - protein, 30 aa, Plasmodium falciparum
FYHINKNINSLWKVYLSYNLLNINKCERKD

SEQ ID NO: 3382952 - protein, 23 aa, Plasmodium falciparum
FYILYLYIYKRNLVQNENVNKSN

SEQ ID NO: 3382953 - protein, 34 aa, Plasmodium falciparum
FYKDDWPFIVVCPSSIRFQWKDQALRWLSHLIRE

SEQ ID NO: 3382954 - protein, 77 aa, Plasmodium falciparum
FYKDKYWGRNLSKEHIPWAIRNWFWNGSLLYEELIPLLLEKLHSFFNCIVELRHYRFWSSSLLWVFDGGLSDKKARS

SEQ ID NO: 3382955 - protein, 18 aa, Plasmodium falciparum
FYKQEWWEWITEKERDEV

SEQ ID NO: 3382956 - protein, 17 aa, Plasmodium falciparum
FYKYIKFYEDNQNSSKH

SEQ ID NO: 3382957 - protein, 36 aa, Plasmodium falciparum
FYKYYLKSNSFIKRRLYTCNPRKLMMCEYLIKYHEQ

SEQ ID NO: 3382958 - protein, 17 aa, Plasmodium falciparum
FYLDVNNYCIRWNSKKK

SEQ ID NO: 3382959 - protein, 18 aa, Plasmodium falciparum
FYMNIWIKIKKLIKYVLS

SEQ ID NO: 3382960 - protein, 17 aa, Plasmodium falciparum
FYNILIEAFFFKTDQRK

SEQ ID NO: 3382961 - protein, 21 aa, Plasmodium falciparum
FYNKETPFFLDTIKNFKEDLL

SEQ ID NO: 3382962 - protein, 18 aa, Plasmodium falciparum
FYNLTCLPVHSIPRNPYT

SEQ ID NO: 3382963 - protein, 17 aa, Plasmodium falciparum
FYNSHFFDYKNVAILPY

SEQ ID NO: 3382964 - protein, 18 aa, Plasmodium falciparum
FYRAIFYRSKTKFDTYMH

SEQ ID NO: 3382965 - protein, 19 aa, Plasmodium falciparum
FYRILYECAQASSAKPYLV

SEQ ID NO: 3382966 - protein, 32 aa, Plasmodium falciparum
FYSHPLMCIAWALNRLLLRDEYFFKEFCKTII

SEQ ID NO: 3382967 - protein, 17 aa, Plasmodium falciparum
FYSIIKTIDDILISQNV

SEQ ID NO: 3382968 - protein, 23 aa, Plasmodium falciparum
FYSQIKIRRFFCDGKNNYINNSY

SEQ ID NO: 3382969 - protein, 20 aa, Plasmodium falciparum
FYTLPELYVDNIYNLIKRIC

SEQ ID NO: 3382970 - protein, 18 aa, Plasmodium falciparum
FYTQEAVIKALAANGMML

SEQ ID NO: 3382971 - protein, 26 aa, Plasmodium falciparum
FYVCSHIVWGLWALLQGLHSVIDFDF

SEQ ID NO: 3382972 - protein, 20 aa, Plasmodium falciparum
FYVIKNYPNTYLLSSAIKYI

SEQ ID NO: 3382973 - protein, 17 aa, Plasmodium falciparum
FYYFFNSTNLNASNHHN

SEQ ID NO: 3382974 - protein, 21 aa, Plasmodium falciparum
FYYSLECLLPHFIPPTYNGKN

SEQ ID NO: 3382975 - protein, 26 aa, Plasmodium falciparum
GAADCLYWEKYLGKIIKIYELRNNEK

SEQ ID NO: 3382976 - protein, 23 aa, Plasmodium falciparum
GACDYFQKCAFYHDSNDKNEAHI

SEQ ID NO: 3382977 - protein, 23 aa, Plasmodium falciparum
GAHKYFYHVLEKALYHKLGMEIN

SEQ ID NO: 3382978 - protein, 33 aa, Plasmodium falciparum
GAKFPTCVYYLMSIGLLSKKLLCVLAMGEWIDY

SEQ ID NO: 3382979 - protein, 24 aa, Plasmodium falciparum
GAKIDIWDYLGKSPLYIACEHECK

SEQ ID NO: 3382980 - protein, 25 aa, Plasmodium falciparum
GARISILTAILRKCPVAENVPIDFL

SEQ ID NO: 3382981 - protein, 29 aa, Plasmodium falciparum
GATCYMNALLQLLYHINIFRKAVCMMIFN

SEQ ID NO: 3382982 - protein, 24 aa, Plasmodium falciparum
GAYIEDELLLNPSSFSKYVDEIRY

SEQ ID NO: 3382983 - protein, 23 aa, Plasmodium falciparum
GCATGHPAFVMSFSFCNQTFAQL

SEQ ID NO: 3382984 - protein, 19 aa, Plasmodium falciparum
GCEEAKRLAIEWKKARIRG

SEQ ID NO: 3382985 - protein, 25 aa, Plasmodium falciparum
GCEEILEHLYFQKYNYNKLNFILPE

SEQ ID NO: 3382986 - protein, 22 aa, Plasmodium falciparum
GCIFAEMILKKPLFVGENEIDQ

SEQ ID NO: 3382987 - protein, 18 aa, Plasmodium falciparum
GCIYYPLYFDNFEQISVI

SEQ ID NO: 3382988 - protein, 18 aa, Plasmodium falciparum
GCKCGFVHLINSLTFEIF

SEQ ID NO: 3382989 - protein, 43 aa, Plasmodium falciparum
GCKKTNIQVTPSPFPQFLRDIQIYNIPQKKIRLKRTSIPLKKE

SEQ ID NO: 3382990 - protein, 25 aa, Plasmodium falciparum
GCLASDLKFLITHIALHNKKKKKLK

SEQ ID NO: 3382991 - protein, 19 aa, Plasmodium falciparum
GCLVVNSDDTMECVCCMQK

SEQ ID NO: 3382992 - protein, 25 aa, Plasmodium falciparum
GCSDYNIAVLLLYKRKNISCTPDEM

SEQ ID NO: 3382993 - protein, 31 aa, Plasmodium falciparum
GCTKEIHFYKIGKPCLMCLVDLPGYGYAECK

SEQ ID NO: 3382994 - protein, 24 aa, Plasmodium falciparum
GCTSKKLLFGKLYYNHIIASREYF

SEQ ID NO: 3382995 - protein, 27 aa, Plasmodium falciparum
GCTSNGFIYLYDLYENKLLSKICTRID

SEQ ID NO: 3382996 - protein, 17 aa, Plasmodium falciparum
GCTSQRKSFNKYKFLLN

SEQ ID NO: 3382997 - protein, 22 aa, Plasmodium falciparum
GCVEIQLCLALKKYANQLKGVD

SEQ ID NO: 3382998 - protein, 21 aa, Plasmodium falciparum
GDIFTFLNIYDKDNTKGIFIS

SEQ ID NO: 3382999 - protein, 18 aa, Plasmodium falciparum
GDIFYSWLVSCYEDKNFL

SEQ ID NO: 3383000 - protein, 27 aa, Plasmodium falciparum
GDIHGQFYDLLRLFEYGGFPPDANYLF

SEQ ID NO: 3383001 - protein, 20 aa, Plasmodium falciparum
GDILRYLTMSEFLQIAGRAG

SEQ ID NO: 3383002 - protein, 29 aa, Plasmodium falciparum
GDINNLMEHFFSFLLRKTDFITNSHNVDE

SEQ ID NO: 3383003 - protein, 47 aa, Plasmodium falciparum
GDISYKIPRKIVQCKPFISVYTIDFDLDSFLVLATDGILNVLSDEEI

SEQ ID NO: 3383004 - protein, 20 aa, Plasmodium falciparum
GDKEKKLIEKIVWPEIYNKK

SEQ ID NO: 3383005 - protein, 26 aa, Plasmodium falciparum
GDKKKKLIQTFLLSATLSLTVQLQND

SEQ ID NO: 3383006 - protein, 22 aa, Plasmodium falciparum
GDKTFVYFFKTEELHDLFCKNG

SEQ ID NO: 3383007 - protein, 24 aa, Plasmodium falciparum
GDKWTKFLNTFGKYLKIGVVEDKE

SEQ ID NO: 3383008 - protein, 22 aa, Plasmodium falciparum
GDLEFFLKRLIHTTSNDLMSNV

SEQ ID NO: 3383009 - protein, 27 aa, Plasmodium falciparum
GDLHYKRDPFLPQKDQKISAFPEITCV

SEQ ID NO: 3383010 - protein, 41 aa, Plasmodium falciparum
GDLTFSYIKTYNKHFEPYVPISYIYIEPTINAAFVGDASGV

SEQ ID NO: 3383011 - protein, 26 aa, Plasmodium falciparum
GDLVKVLDLRLALNIYLRCSSHNKIL

SEQ ID NO: 3383012 - protein, 19 aa, Plasmodium falciparum
GDNFKILIYGCMGIRTYKV

SEQ ID NO: 3383013 - protein, 23 aa, Plasmodium falciparum
GDNFYIYLNINFINTYKLDNSFD

SEQ ID NO: 3383014 - protein, 24 aa, Plasmodium falciparum
GDNIYFHKLLSHKNSNEKKYVFQE

SEQ ID NO: 3383015 - protein, 17 aa, Plasmodium falciparum
GDNIYHELFNKIKSEEY

SEQ ID NO: 3383016 - protein, 29 aa, Plasmodium falciparum
GDNQYAYINNFYHIYHNNSYNHIYRQNNI

SEQ ID NO: 3383017 - protein, 25 aa, Plasmodium falciparum
GDNTVRLWDIYTQTPIATLNDHKSW

SEQ ID NO: 3383018 - protein, 28 aa, Plasmodium falciparum
GDSDGLLRLHSTFRHDFKIFTSDEGRCQ

SEQ ID NO: 3383019 - protein, 27 aa, Plasmodium falciparum
GDSNGGLFIWNWKKMVNFKNIKAHKNV

SEQ ID NO: 3383020 - protein, 24 aa, Plasmodium falciparum
GDSRAIVCFNGNSLGMSTDHKPHL

SEQ ID NO: 3383021 - protein, 23 aa, Plasmodium falciparum
GDTNDPCIFNYTKVIKATDNNET

SEQ ID NO: 3383022 - protein, 41 aa, Plasmodium falciparum
GDVANQMKIYINYNFWSAAEIAFILRQITSLCNIQIEVRVK

SEQ ID NO: 3383023 - protein, 26 aa, Plasmodium falciparum
GDVHFLPLTLPFFNKNEKQKKIRKLL

SEQ ID NO: 3383024 - protein, 25 aa, Plasmodium falciparum
GEDGDRFNFVLSQENDNLLDGDYKN

SEQ ID NO: 3383025 - protein, 31 aa, Plasmodium falciparum
GEDHELPLCSNKFKFPELEKNIRNFDEDNDQ

SEQ ID NO: 3383026 - protein, 40 aa, Plasmodium falciparum
GEDILYSMEKLGFNDYIEPLTEYLNKWKQLKELNNSNNYH

SEQ ID NO: 3383027 - protein, 35 aa, Plasmodium falciparum
GEGGFGIVTKMRFLTFPQYYAIKKISKDHIIKSQA

SEQ ID NO: 3383028 - protein, 23 aa, Plasmodium falciparum
GEGKLYILEKRLLWINENANKKN

SEQ ID NO: 3383029 - protein, 23 aa, Plasmodium falciparum
GEGSLYQLYWMSTSWINFCSIIK

SEQ ID NO: 3383030 - protein, 25 aa, Plasmodium falciparum
GEIKNIFIQLLKALDYCHKNNIIHR

SEQ ID NO: 3383031 - protein, 25 aa, Plasmodium falciparum
GEIYEKYKINNILSLLVDNNKFQNE

SEQ ID NO: 3383032 - protein, 28 aa, Plasmodium falciparum
GEKHWLYASFNYIIADICFSLYTMNSLN

SEQ ID NO: 3383033 - protein, 36 aa, Plasmodium falciparum
GEKNIINTFNLFLPSLIKIGQLRRIQQYSYILHNII

SEQ ID NO: 3383034 - protein, 26 aa, Plasmodium falciparum
GEKRSYWLIRNSWSYYWGDEGNFRVD

SEQ ID NO: 3383035 - protein, 27 aa, Plasmodium falciparum
GEKVRILFLSLFLKKSNLLLLDEINNN

SEQ ID NO: 3383036 - protein, 22 aa, Plasmodium falciparum
GEKYAIIKYNNENIAKIVFENC

SEQ ID NO: 3383037 - protein, 29 aa, Plasmodium falciparum
GELELRAPPDFFKTKLCKFFNTSGMCPLS

SEQ ID NO: 3383038 - protein, 21 aa, Plasmodium falciparum
GELIQDIIFPGKAQMIFINFK

SEQ ID NO: 3383039 - protein, 18 aa, Plasmodium falciparum
GELIRREIWHNPLSYYLG

SEQ ID NO: 3383040 - protein, 25 aa, Plasmodium falciparum
GELLKMFFHMSFEKQYKTFIYAKWI

SEQ ID NO: 3383041 - protein, 31 aa, Plasmodium falciparum
GEMPNVSTWQFNFKFDLDSDMYAQNSIDFLK

SEQ ID NO: 3383042 - protein, 22 aa, Plasmodium falciparum
GENALINYVYLNKGNVYKNVEK

SEQ ID NO: 3383043 - protein, 19 aa, Plasmodium falciparum
GENCFIYLKSLSKELDVII

SEQ ID NO: 3383044 - protein, 23 aa, Plasmodium falciparum
GENRHWNVDLIPKFILVGGNLVK

SEQ ID NO: 3383045 - protein, 20 aa, Plasmodium falciparum
GENVINFYIPTFKNVSYLIE

SEQ ID NO: 3383046 - protein, 18 aa, Plasmodium falciparum
GENVLKKPILNIISDDEN

SEQ ID NO: 3383047 - protein, 24 aa, Plasmodium falciparum
GEPLETYIFMGPIYYQKLKHMVQD

SEQ ID NO: 3383048 - protein, 20 aa, Plasmodium falciparum
GEQNILIFDLGGGTFDVSLL

SEQ ID NO: 3383049 - protein, 25 aa, Plasmodium falciparum
GERVLHRDLKPQNIFLSTGIRHIGK

SEQ ID NO: 3383050 - protein, 25 aa, Plasmodium falciparum
GESITTLKYILRLDELFENIKSGEE

SEQ ID NO: 3383051 - protein, 21 aa, Plasmodium falciparum
GESYFKVRKLGSGAYGEVLLC

SEQ ID NO: 3383052 - protein, 27 aa, Plasmodium falciparum
GETNANFYENYLPNNNFQIINNNYVMS

SEQ ID NO: 3383053 - protein, 20 aa, Plasmodium falciparum
GEYIFNDYLYLSYGPLNIYS

SEQ ID NO: 3383054 - protein, 24 aa, Plasmodium falciparum
GEYKYFEKLFFDCLKSKIINEIKT

SEQ ID NO: 3383055 - protein, 30 aa, Plasmodium falciparum
GEYMAILSENYFLRIYKFESMKLYRVYDES

SEQ ID NO: 3383056 - protein, 18 aa, Plasmodium falciparum
GFCQFIMEPILNLCQSIM

SEQ ID NO: 3383057 - protein, 28 aa, Plasmodium falciparum
GFDKKNILWCINRKGQLLKWVKTKWDNI

SEQ ID NO: 3383058 - protein, 17 aa, Plasmodium falciparum
GFDLLKDSLIKIATMQI

SEQ ID NO: 3383059 - protein, 26 aa, Plasmodium falciparum
GFDTTIFSYCQYISYLITHIQTYLQG

SEQ ID NO: 3383060 - protein, 34 aa, Plasmodium falciparum
GFEKLSVLLISKFKLILQNCYLIFIPGKNDPCAC

SEQ ID NO: 3383061 - protein, 21 aa, Plasmodium falciparum
GFELLELLPEGSVCFAPSLAI

SEQ ID NO: 3383062 - protein, 19 aa, Plasmodium falciparum
GFFKRLLINFIPIINTVNI

SEQ ID NO: 3383063 - protein, 24 aa, Plasmodium falciparum
GFGTYQIFIDLYDIYECAHIVVPT

SEQ ID NO: 3383064 - protein, 20 aa, Plasmodium falciparum
GFIEIWNWITGELNLDLEYQ

SEQ ID NO: 3383065 - protein, 18 aa, Plasmodium falciparum
GFIKPSYVIPVENFAGKV

SEQ ID NO: 3383066 - protein, 24 aa, Plasmodium falciparum
GFKKFMNRIFPIKIPEHRKIDPLL

SEQ ID NO: 3383067 - protein, 17 aa, Plasmodium falciparum
GFLHIRLNDKYLTCSFP

SEQ ID NO: 3383068 - protein, 18 aa, Plasmodium falciparum
GFLIDEDNIINKIKELNI

SEQ ID NO: 3383069 - protein, 20 aa, Plasmodium falciparum
GFLNSYSRCYKYLREYESCV

SEQ ID NO: 3383070 - protein, 18 aa, Plasmodium falciparum
GFNCTLFCYGQTGTGKTY

SEQ ID NO: 3383071 - protein, 27 aa, Plasmodium falciparum
GFNDAQRIFEMFFGDSSPFGNDSFFSD

SEQ ID NO: 3383072 - protein, 17 aa, Plasmodium falciparum
GFNGTYMFGSMHNDIFI

SEQ ID NO: 3383073 - protein, 17 aa, Plasmodium falciparum
GFPPNFVHSLDASHLMM

SEQ ID NO: 3383074 - protein, 31 aa, Plasmodium falciparum
GFREGQVELARRKEFIFTDDGKIKKIVEEKD

SEQ ID NO: 3383075 - protein, 41 aa, Plasmodium falciparum
GFSKPPHNINFTDNKKIYTTLIQWLLNHSPENQKQLILKRS

SEQ ID NO: 3383076 - protein, 28 aa, Plasmodium falciparum
GFSNVQYYIILINIADYRKSYYKIDHFN

SEQ ID NO: 3383077 - protein, 20 aa, Plasmodium falciparum
GFYGYKLTSSILFCDTLIAC

SEQ ID NO: 3383078 - protein, 24 aa, Plasmodium falciparum
GFYSWFTFYLNRHDGLIYYFEIKD

SEQ ID NO: 3383079 - protein, 24 aa, Plasmodium falciparum
GGCTVFTFGSFFDVPIWSNFSGIM

SEQ ID NO: 3383080 - protein, 26 aa, Plasmodium falciparum
GGDVLNNSYLFNINSFNPNMNAYIYN

SEQ ID NO: 3383081 - protein, 23 aa, Plasmodium falciparum
GGEDKFLYIWEKSKKPKNIPLGY

SEQ ID NO: 3383082 - protein, 29 aa, Plasmodium falciparum
GGEKSISALALIFSIQKYINNSFIILDEV

SEQ ID NO: 3383083 - protein, 17 aa, Plasmodium falciparum
GGELYDFLLAETRLSEI

SEQ ID NO: 3383084 - protein, 28 aa, Plasmodium falciparum
GGERSLTTMLYILSIQKLTKNGFYVLDE

SEQ ID NO: 3383085 - protein, 32 aa, Plasmodium falciparum
GGFKPYCGTFLNFYTYAFGALRLAALSNHHIL

SEQ ID NO: 3383086 - protein, 24 aa, Plasmodium falciparum
GGFNTLRRMYHNIQEPMYESTEKL

SEQ ID NO: 3383087 - protein, 35 aa, Plasmodium falciparum
GGGIVKYLNIFSKLPFFYLFYPSSYKKKKRKKKFY

SEQ ID NO: 3383088 - protein, 21 aa, Plasmodium falciparum
GGILYLYKGVIPRCFLCIWQT

SEQ ID NO: 3383089 - protein, 17 aa, Plasmodium falciparum
GGIYAQYTRKRTRLVRA

SEQ ID NO: 3383090 - protein, 24 aa, Plasmodium falciparum
GGKEGWILIQDFANDGTLWKENLS

SEQ ID NO: 3383091 - protein, 18 aa, Plasmodium falciparum
GGKLLFFLSSVPNIGDLT

SEQ ID NO: 3383092 - protein, 24 aa, Plasmodium falciparum
GGLRPYGVSFLIGGYDTKDGYQLY

SEQ ID NO: 3383093 - protein, 28 aa, Plasmodium falciparum
GGNRKPTRFLCLILKLLQIQPDKDIIYE

SEQ ID NO: 3383094 - protein, 17 aa, Plasmodium falciparum
GGPPPPLPSTSTTPIIP

SEQ ID NO: 3383095 - protein, 17 aa, Plasmodium falciparum
GGRVDRLPGFRRSYRSF

SEQ ID NO: 3383096 - protein, 29 aa, Plasmodium falciparum
GGSTYYYSMLLSDYKLYSWGKYNSSCLAL

SEQ ID NO: 3383097 - protein, 24 aa, Plasmodium falciparum
GGTRNRWVLISNSIKTKTVKEVIK

SEQ ID NO: 3383098 - protein, 20 aa, Plasmodium falciparum
GGTRYIILSGLGDALPLCVQ

SEQ ID NO: 3383099 - protein, 25 aa, Plasmodium falciparum
GGVHTIPNFLLKCFKNYTKFSEPQR

SEQ ID NO: 3383100 - protein, 25 aa, Plasmodium falciparum
GGVKVNDIIIFYKGIKLPNYRIIST

SEQ ID NO: 3383101 - protein, 33 aa, Plasmodium falciparum
GGVLKGEIKDLLLLDVIPLSLGIETLGGVFTKL

SEQ ID NO: 3383102 - protein, 30 aa, Plasmodium falciparum
GGVPHKEEPILPFYVICDYVDFIERKYYVN

SEQ ID NO: 3383103 - protein, 19 aa, Plasmodium falciparum
GGYVLLRDYGLYDLTQVRF

SEQ ID NO: 3383104 - protein, 20 aa, Plasmodium falciparum
GHFPYNFFKNNEQGPYMQRS

SEQ ID NO: 3383105 - protein, 23 aa, Plasmodium falciparum
GHKKLIKRFIGKATWDMNQLVDE

SEQ ID NO: 3383106 - protein, 28 aa, Plasmodium falciparum
GHKNSLQQVVYNLKLKRASELSVPHRIL

SEQ ID NO: 3383107 - protein, 19 aa, Plasmodium falciparum
GHLGLGRLILLYDDNKITI

SEQ ID NO: 3383108 - protein, 20 aa, Plasmodium falciparum
GHLPYQCRNFISLEKFDINN

SEQ ID NO: 3383109 - protein, 26 aa, Plasmodium falciparum
GHRTYIPFFHFMIHKYTTKIIDDQIR

SEQ ID NO: 3383110 - protein, 29 aa, Plasmodium falciparum
GHSKIYYQSDQRLLFKWKASQDLNTLEWT

SEQ ID NO: 3383111 - protein, 38 aa, Plasmodium falciparum
GHSNILSCDNIFDDNLYIYMVMPFAVHGDLFEVMKNRN

SEQ ID NO: 3383112 - protein, 28 aa, Plasmodium falciparum
GHSSQLFDNEWMIIYGGITNGWIDNYAL

SEQ ID NO: 3383113 - protein, 25 aa, Plasmodium falciparum
GHTNGVHFLKYLNKSEFLLSGGNGG

SEQ ID NO: 3383114 - protein, 23 aa, Plasmodium falciparum
GHTSFVNRLKWNDDNHLLASCGS

SEQ ID NO: 3383115 - protein, 19 aa, Plasmodium falciparum
GHTSSILCLAFSPNSSHLA

SEQ ID NO: 3383116 - protein, 18 aa, Plasmodium falciparum
GHVIGHASTIRLSLRKGK

SEQ ID NO: 3383117 - protein, 18 aa, Plasmodium falciparum
GHYDWVSEVFFTKRNEVL

SEQ ID NO: 3383118 - protein, 23 aa, Plasmodium falciparum
GIAAILKFPIFYDINQAHEKGQS

SEQ ID NO: 3383119 - protein, 18 aa, Plasmodium falciparum
GICPLYIGYAADGSIWFS

SEQ ID NO: 3383120 - protein, 23 aa, Plasmodium falciparum
GIDALYFLRICSDLKDILSDVSG

SEQ ID NO: 3383121 - protein, 18 aa, Plasmodium falciparum
GIDASKFSIGLSLACQRE

SEQ ID NO: 3383122 - protein, 18 aa, Plasmodium falciparum
GIDEGLLRGIYAYGFEKP

SEQ ID NO: 3383123 - protein, 25 aa, Plasmodium falciparum
GIDIKNIILVINYQCPDHIEDYIHR

SEQ ID NO: 3383124 - protein, 36 aa, Plasmodium falciparum
GIDLSLKYFFIYIDQLILPFLVKYTWNNYALEDSID

SEQ ID NO: 3383125 - protein, 17 aa, Plasmodium falciparum
GIDTYVKESAKITNRLW

SEQ ID NO: 3383126 - protein, 18 aa, Plasmodium falciparum
GIEAVRRALLKELRTVIS

SEQ ID NO: 3383127 - protein, 20 aa, Plasmodium falciparum
GIEELLNYIIKYKTKNQYWV

SEQ ID NO: 3383128 - protein, 22 aa, Plasmodium falciparum
GIEKIPYRLPPYIQDTKISEIR

SEQ ID NO: 3383129 - protein, 17 aa, Plasmodium falciparum
GIEKIYDYLINNNKLHI

SEQ ID NO: 3383130 - protein, 26 aa, Plasmodium falciparum
GIEKKKMMQRLWGNSFYDAKTKKWSK

SEQ ID NO: 3383131 - protein, 28 aa, Plasmodium falciparum
GIERKEEVYLEKLYYAHKNKLENHIKHN

SEQ ID NO: 3383132 - protein, 24 aa, Plasmodium falciparum
GIEYSMNWLFNQLMIKRKKSLCLL

SEQ ID NO: 3383133 - protein, 19 aa, Plasmodium falciparum
GIFILQFINSIFSKYPLIR

SEQ ID NO: 3383134 - protein, 20 aa, Plasmodium falciparum
GIFIYNMNLLREILKLMTDN

SEQ ID NO: 3383135 - protein, 17 aa, Plasmodium falciparum
GIFKLKSLAFDRKNRLW

SEQ ID NO: 3383136 - protein, 18 aa, Plasmodium falciparum
GIGEKIAQLILQTALNKH

SEQ ID NO: 3383137 - protein, 23 aa, Plasmodium falciparum
GIGKMHAKWIPANVSYRIDHKVL

SEQ ID NO: 3383138 - protein, 24 aa, Plasmodium falciparum
GIGLKTILLYSLKTAYGFLHIKVK

SEQ ID NO: 3383139 - protein, 17 aa, Plasmodium falciparum
GIHYFKQHDEYSMIFCI

SEQ ID NO: 3383140 - protein, 20 aa, Plasmodium falciparum
GIICTYYDEYIKQLFLGTTD

SEQ ID NO: 3383141 - protein, 30 aa, Plasmodium falciparum
GIIDDIMIILREKYLLLYLNIQCKEKVYKY

SEQ ID NO: 3383142 - protein, 21 aa, Plasmodium falciparum
GIIDEPIVLNIYSIKCPDLSL

SEQ ID NO: 3383143 - protein, 18 aa, Plasmodium falciparum
GIIDLLFLEVPNGKNENK

SEQ ID NO: 3383144 - protein, 32 aa, Plasmodium falciparum
GIIEQWVVFFRTYFITIPFISFMNKSIQPSYL

SEQ ID NO: 3383145 - protein, 26 aa, Plasmodium falciparum
GIIHEFLRMYWCKKILNWSGNSKTAL

SEQ ID NO: 3383146 - protein, 18 aa, Plasmodium falciparum
GIIKFWYKNIGCIEFVKH

SEQ ID NO: 3383147 - protein, 17 aa, Plasmodium falciparum
GIIQRKYNCLNSFPCLH

SEQ ID NO: 3383148 - protein, 34 aa, Plasmodium falciparum
GIISSMIYYFTLHENMFIIFNYRSGTSLNINIED

SEQ ID NO: 3383149 - protein, 30 aa, Plasmodium falciparum
GIKLISELCLLYKKPFYVTCQAYKFLKIDK

SEQ ID NO: 3383150 - protein, 26 aa, Plasmodium falciparum
GILCEYIKKNIFYFLLKNVDNVDLIK

SEQ ID NO: 3383151 - protein, 17 aa, Plasmodium falciparum
GILEHTLFKGTFFPTWE

SEQ ID NO: 3383152 - protein, 33 aa, Plasmodium falciparum
GILSRYCSNIYGMQYIPRARYFLTFCKNEKCNT

SEQ ID NO: 3383153 - protein, 17 aa, Plasmodium falciparum
GILTISTLLVLNRLEAE

SEQ ID NO: 3383154 - protein, 19 aa, Plasmodium falciparum
GIMEILISRIRYISTQLNI

SEQ ID NO: 3383155 - protein, 17 aa, Plasmodium falciparum
GIMNCTMCCPKGLDPAK

SEQ ID NO: 3383156 - protein, 17 aa, Plasmodium falciparum
GINILHDDLLKEEINNI

SEQ ID NO: 3383157 - protein, 25 aa, Plasmodium falciparum
GINKNKAFSVIIDNLLNLKDDDDLS

SEQ ID NO: 3383158 - protein, 17 aa, Plasmodium falciparum
GIPEWVMSLQKKVTWVK

SEQ ID NO: 3383159 - protein, 30 aa, Plasmodium falciparum
GIPLDLLDRTLIIPTYPYKHQDILKILEQR

SEQ ID NO: 3383160 - protein, 19 aa, Plasmodium falciparum
GIPNFPLNIEFIKQNGRYK

SEQ ID NO: 3383161 - protein, 24 aa, Plasmodium falciparum
GIPRGFLIRRLCNLVFDNISHFHH

SEQ ID NO: 3383162 - protein, 30 aa, Plasmodium falciparum
GIPVDLLDRLIIIKTFPYTLKEIVQILALR

SEQ ID NO: 3383163 - protein, 24 aa, Plasmodium falciparum
GIQKQTIECLVLCKIINCDIIIVL

SEQ ID NO: 3383164 - protein, 21 aa, Plasmodium falciparum
GIQTKLLYENGKYIRILDKID

SEQ ID NO: 3383165 - protein, 25 aa, Plasmodium falciparum
GIREYNYKRLLSYQKIQTNESEDIR

SEQ ID NO: 3383166 - protein, 20 aa, Plasmodium falciparum
GIRSIFVKDLLQQLVDDDKV

SEQ ID NO: 3383167 - protein, 28 aa, Plasmodium falciparum
GISCQSFITPFIPSIYIFNKQNIEDNFF

SEQ ID NO: 3383168 - protein, 22 aa, Plasmodium falciparum
GISFYHMENMLINLGFKGVDIN

SEQ ID NO: 3383169 - protein, 17 aa, Plasmodium falciparum
GISINFMLKILSVIKEK

SEQ ID NO: 3383170 - protein, 34 aa, Plasmodium falciparum
GISLLTYQDILYAYEICFFIGKKLKFFKKEKSVL

SEQ ID NO: 3383171 - protein, 23 aa, Plasmodium falciparum
GISLVTYLRNLFEENAYEEVCIN

SEQ ID NO: 3383172 - protein, 35 aa, Plasmodium falciparum
GIVVKKHFKCVILKKSYFLQWDISDFMGNVVSVYV

SEQ ID NO: 3383173 - protein, 17 aa, Plasmodium falciparum
GIWIMDTVNEALDNLYD

SEQ ID NO: 3383174 - protein, 24 aa, Plasmodium falciparum
GIYDLYFKNFMINFIYYNLSCVYN

SEQ ID NO: 3383175 - protein, 24 aa, Plasmodium falciparum
GKAELIRLIFAYLGIEYTDKRFGV

SEQ ID NO: 3383176 - protein, 28 aa, Plasmodium falciparum
GKASCACKMKCYFFYSQNKNLTNIEKCT

SEQ ID NO: 3383177 - protein, 39 aa, Plasmodium falciparum
GKDDNTLLPSDYFIKSVPIFFFRTYIGAATKAHAYNLID

SEQ ID NO: 3383178 - protein, 35 aa, Plasmodium falciparum
GKDGFIKIYHLITGNIIMCIRAHNYPITDFDIHKS

SEQ ID NO: 3383179 - protein, 31 aa, Plasmodium falciparum
GKFLYTHNIWNNIKFWEVSILIIISEIIQEM

SEQ ID NO: 3383180 - protein, 18 aa, Plasmodium falciparum
GKFSIRLYSIQSNKSRSD

SEQ ID NO: 3383181 - protein, 24 aa, Plasmodium falciparum
GKGIMFTTYGFIDQIYNNMPVYSA

SEQ ID NO: 3383182 - protein, 28 aa, Plasmodium falciparum
GKGKEYIYLLLCLLGNKIKIFAISKYHF

SEQ ID NO: 3383183 - protein, 30 aa, Plasmodium falciparum
GKGKTNIFRNFFKNLFFFNDKNKKKKPNKM

SEQ ID NO: 3383184 - protein, 23 aa, Plasmodium falciparum
GKGWNILYKLYSQISGCVLICKN

SEQ ID NO: 3383185 - protein, 17 aa, Plasmodium falciparum
GKHRQLGTHISFVRSTG

SEQ ID NO: 3383186 - protein, 23 aa, Plasmodium falciparum
GKHYELILNLLRPIIPENCSYSV

SEQ ID NO: 3383187 - protein, 21 aa, Plasmodium falciparum
GKKDFLKITVLLPKMVPSLKK

SEQ ID NO: 3383188 - protein, 26 aa, Plasmodium falciparum
GKKEDDDFFLESLPSLPKGLPKEVIK

SEQ ID NO: 3383189 - protein, 27 aa, Plasmodium falciparum
GKKENLFFFLNVLSIYKIFIKKYISNN

SEQ ID NO: 3383190 - protein, 19 aa, Plasmodium falciparum
GKKGVFLCDPLNVNYKNTP

SEQ ID NO: 3383191 - protein, 27 aa, Plasmodium falciparum
GKKKNKRIFVFLNGINNIYHSFRRKNQ

SEQ ID NO: 3383192 - protein, 24 aa, Plasmodium falciparum
GKKLAMLCNRLYYFNINDEELLQR

SEQ ID NO: 3383193 - protein, 24 aa, Plasmodium falciparum
GKKNIRYLTLYNYNVYEFTSLPIH

SEQ ID NO: 3383194 - protein, 22 aa, Plasmodium falciparum
GKKRLSFIEEQKFNTTLGYVQN

SEQ ID NO: 3383195 - protein, 22 aa, Plasmodium falciparum
GKKTVLAQDLWFAILQSQIETG

SEQ ID NO: 3383196 - protein, 27 aa, Plasmodium falciparum
GKKYKYQWIILLPFVDKERIIKHARPL

SEQ ID NO: 3383197 - protein, 23 aa, Plasmodium falciparum
GKLDKNVNYMNKLTMNNNYVNTD

SEQ ID NO: 3383198 - protein, 17 aa, Plasmodium falciparum
GKLWSIIEPDMIGEIKV

SEQ ID NO: 3383199 - protein, 23 aa, Plasmodium falciparum
GKMERVCLFLNLANDPTIERILT

SEQ ID NO: 3383200 - protein, 36 aa, Plasmodium falciparum
GKMINASIFILRRICNHPLLHKYYYTVEDIKKISKY

SEQ ID NO: 3383201 - protein, 22 aa, Plasmodium falciparum
GKMSLLDKLLPRLKKENSRVLL

SEQ ID NO: 3383202 - protein, 21 aa, Plasmodium falciparum
GKNAIIAFKTNKLKNLYLVDQ

SEQ ID NO: 3383203 - protein, 21 aa, Plasmodium falciparum
GKNCLVFEFPIIHNTEEDSTE

SEQ ID NO: 3383204 - protein, 19 aa, Plasmodium falciparum
GKNFDIQWIRVVDVPFQEV

SEQ ID NO: 3383205 - protein, 18 aa, Plasmodium falciparum
GKNNIFCFLNPQENQKDD

SEQ ID NO: 3383206 - protein, 25 aa, Plasmodium falciparum
GKNPLIHELLLYLINNTRCKIIMLD

SEQ ID NO: 3383207 - protein, 31 aa, Plasmodium falciparum
GKNQLHYDIIIIYNFLFYGAFTIYSNKEYFN

SEQ ID NO: 3383208 - protein, 26 aa, Plasmodium falciparum
GKNSLFNMYIDCLSIFPLSSKKYLNN

SEQ ID NO: 3383209 - protein, 25 aa, Plasmodium falciparum
GKPKIAWWTSYALNKRPILGPTTTD

SEQ ID NO: 3383210 - protein, 29 aa, Plasmodium falciparum
GKPLKQMVRINYLLQASFLMNNMNPNISR

SEQ ID NO: 3383211 - protein, 28 aa, Plasmodium falciparum
GKQINSFEYIIKFEWLYSKKKEGKDYFG

SEQ ID NO: 3383212 - protein, 31 aa, Plasmodium falciparum
GKQKYAYSYTNINIWKYFNNTCYNGFDDTEG

SEQ ID NO: 3383213 - protein, 22 aa, Plasmodium falciparum
GKRIPFGFNHRSLPHFIKFDYG

SEQ ID NO: 3383214 - protein, 26 aa, Plasmodium falciparum
GKRSPQFFNPYDKDLYNLLYTNLDDT

SEQ ID NO: 3383215 - protein, 22 aa, Plasmodium falciparum
GKSLYIVNKLFGYNISPLNRIK

SEQ ID NO: 3383216 - protein, 18 aa, Plasmodium falciparum
GKSSYFYENKEKISNSDE

SEQ ID NO: 3383217 - protein, 17 aa, Plasmodium falciparum
GKSTLFKILTNKYNFVL

SEQ ID NO: 3383218 - protein, 28 aa, Plasmodium falciparum
GKTAAFVLPMLSYVKQLPPLTYETSQDG

SEQ ID NO: 3383219 - protein, 26 aa, Plasmodium falciparum
GKTEIARRISMFVDAPFIKVEATKFT

SEQ ID NO: 3383220 - protein, 26 aa, Plasmodium falciparum
GKTIQTLCFLSYLKCNKIDGPHLIVV

SEQ ID NO: 3383221 - protein, 24 aa, Plasmodium falciparum
GKTKIFIILRNKCKHIFITILLYI

SEQ ID NO: 3383222 - protein, 23 aa, Plasmodium falciparum
GKTKTFIVATISPSSLCIDETLS

SEQ ID NO: 3383223 - protein, 24 aa, Plasmodium falciparum
GKTLCFVIPILQYLIHHRNKLCPN

SEQ ID NO: 3383224 - protein, 24 aa, Plasmodium falciparum
GKTLQALALMAFYKDDWPFIVVCP

SEQ ID NO: 3383225 - protein, 21 aa, Plasmodium falciparum
GKTTVLCELIYQLIQRNYKIL

SEQ ID NO: 3383226 - protein, 18 aa, Plasmodium falciparum
GKTYSIFYIINEIQIEKE

SEQ ID NO: 3383227 - protein, 27 aa, Plasmodium falciparum
GKTYTMLGNFDFLNNLFHLCKDYNTCH

SEQ ID NO: 3383228 - protein, 21 aa, Plasmodium falciparum
GKVYFLLVRIKIKHMELDIIK

SEQ ID NO: 3383229 - protein, 17 aa, Plasmodium falciparum
GKYILIATGCRPHIPDD

SEQ ID NO: 3383230 - protein, 21 aa, Plasmodium falciparum
GKYIYKKCKSILEGNWVEGYL

SEQ ID NO: 3383231 - protein, 19 aa, Plasmodium falciparum
GKYKILSFGFVELNFVDFS

SEQ ID NO: 3383232 - protein, 29 aa, Plasmodium falciparum
GKYQDNFEFLQWFKSFFERIVDYNNEQVI

SEQ ID NO: 3383233 - protein, 27 aa, Plasmodium falciparum
GKYSPIYGYYIFLTGKLALFLDLKNEG

SEQ ID NO: 3383234 - protein, 19 aa, Plasmodium falciparum
GLATIVFKGKIYAIGGSTG

SEQ ID NO: 3383235 - protein, 19 aa, Plasmodium falciparum
GLDDRGIVIIMLDTPLHWR

SEQ ID NO: 3383236 - protein, 23 aa, Plasmodium falciparum
GLDLKMTLYRVLALSTDDGFIEF

SEQ ID NO: 3383237 - protein, 18 aa, Plasmodium falciparum
GLERVLMLFLGLNNIRKT

SEQ ID NO: 3383238 - protein, 20 aa, Plasmodium falciparum
GLFEMLSWNDVAKFTYDCMN

SEQ ID NO: 3383239 - protein, 19 aa, Plasmodium falciparum
GLFTVIERKPLSSLENNES

SEQ ID NO: 3383240 - protein, 24 aa, Plasmodium falciparum
GLGCLLLERLAIDYGKKSKLNFCS

SEQ ID NO: 3383241 - protein, 33 aa, Plasmodium falciparum
GLGESKLLLHKKKGIIRFLLRQEKTLKVVANHY

SEQ ID NO: 3383242 - protein, 25 aa, Plasmodium falciparum
GLGKSLFERLVMLGITPFRLEVQYR

SEQ ID NO: 3383243 - protein, 42 aa, Plasmodium falciparum
GLGKTLQCISLLSYLAYYFNIWGPHLVIVPTSILINWEIELK

SEQ ID NO: 3383244 - protein, 25 aa, Plasmodium falciparum
GLHYYEYIYKYIVKPLNLTEEMFVP

SEQ ID NO: 3383245 - protein, 39 aa, Plasmodium falciparum
GLIFDIYDYIMKMGYKFIKIYLSSWLYINERIIDLGGKN

SEQ ID NO: 3383246 - protein, 19 aa, Plasmodium falciparum
GLIKIWRIKTGICLKIINA

SEQ ID NO: 3383247 - protein, 44 aa, Plasmodium falciparum
GLILSYKNMFPYNLIFNNITIFKYTLIFRVLNYCKYIEHKLSEV

SEQ ID NO: 3383248 - protein, 23 aa, Plasmodium falciparum
GLISFLVTLGVVPIIRVSSNSSN

SEQ ID NO: 3383249 - protein, 23 aa, Plasmodium falciparum
GLKVANCICLFGLNKYDCIPIDT

SEQ ID NO: 3383250 - protein, 17 aa, Plasmodium falciparum
GLKYLFCLFMLRDIKKQ

SEQ ID NO: 3383251 - protein, 26 aa, Plasmodium falciparum
GLLESALIERGLIESGLLDSGSVNKN

SEQ ID NO: 3383252 - protein, 21 aa, Plasmodium falciparum
GLLKLKFTNTFLLSLMNRHFI

SEQ ID NO: 3383253 - protein, 20 aa, Plasmodium falciparum
GLLKYLEQLGFYNVGYGCMT

SEQ ID NO: 3383254 - protein, 25 aa, Plasmodium falciparum
GLLTIQRIILHFRRAYKRNDKILCF

SEQ ID NO: 3383255 - protein, 44 aa, Plasmodium falciparum
GLLTNKLFLEWDDLSVISKLRIIRMLLNLVLCESNNLKKMLGDE

SEQ ID NO: 3383256 - protein, 33 aa, Plasmodium falciparum
GLNATKDMILIDPSIFFMMLFSSEELSDYTGTL

SEQ ID NO: 3383257 - protein, 18 aa, Plasmodium falciparum
GLNIKYGFPILQTEIEAN

SEQ ID NO: 3383258 - protein, 18 aa, Plasmodium falciparum
GLNLLLNMFEQVDIKVHI

SEQ ID NO: 3383259 - protein, 31 aa, Plasmodium falciparum
GLNWIGCDKCEKWYHWICCKYSVDNPPDIEN

SEQ ID NO: 3383260 - protein, 26 aa, Plasmodium falciparum
GLPINNTPFFIKGKVALIPKDINTFF

SEQ ID NO: 3383261 - protein, 35 aa, Plasmodium falciparum
GLQAFYHKINHPAISPFLIGLFPTNNAQNIRFCIN

SEQ ID NO: 3383262 - protein, 21 aa, Plasmodium falciparum
GLQGFLMFSAVGGGTGSGFGC

SEQ ID NO: 3383263 - protein, 26 aa, Plasmodium falciparum
GLQYEDNWTYLIDSPYFYNEKINNNE

SEQ ID NO: 3383264 - protein, 19 aa, Plasmodium falciparum
GLTLPKLLERRLQTKVFKL

SEQ ID NO: 3383265 - protein, 18 aa, Plasmodium falciparum
GLTRVLVQAVLDLEKSKV

SEQ ID NO: 3383266 - protein, 17 aa, Plasmodium falciparum
GLVPFSGPQPTLPQAPF

SEQ ID NO: 3383267 - protein, 18 aa, Plasmodium falciparum
GLVPVQNLLNIKLSSEPK

SEQ ID NO: 3383268 - protein, 18 aa, Plasmodium falciparum
GLVTIEVKLLNGISYKMC

SEQ ID NO: 3383269 - protein, 31 aa, Plasmodium falciparum
GLYKLESTFHLIYHNLKLYIYKEYYEKYKLT

SEQ ID NO: 3383270 - protein, 44 aa, Plasmodium falciparum
GLYNYCYSYLIRIHEGFDIFPMEGFKFRSIVIDGANVCAKVINE

SEQ ID NO: 3383271 - protein, 23 aa, Plasmodium falciparum
GMDDIINFDFLDPPSPIVIIKGL

SEQ ID NO: 3383272 - protein, 30 aa, Plasmodium falciparum
GMFSHADVLFKMRFIDGISTVNRHALDIRQ

SEQ ID NO: 3383273 - protein, 35 aa, Plasmodium falciparum
GMKLLREKICFKMLKSIDIYITEIIMKSCFVTVYK

SEQ ID NO: 3383274 - protein, 24 aa, Plasmodium falciparum
GMKMRLCLSRILFSNNDIILLDEP

SEQ ID NO: 3383275 - protein, 28 aa, Plasmodium falciparum
GMNEILAPLYFIIFNDPLCNCTLQGEAD

SEQ ID NO: 3383276 - protein, 34 aa, Plasmodium falciparum
GMQKNIKFLKNPTKKRMYKLKKIVEILEYTIYNE

SEQ ID NO: 3383277 - protein, 19 aa, Plasmodium falciparum
GMSQYLSLPSKKKKKKRTT

SEQ ID NO: 3383278 - protein, 31 aa, Plasmodium falciparum
GMTLYAIFNKLFIFYLDKIQILSFLKENCKF

SEQ ID NO: 3383279 - protein, 23 aa, Plasmodium falciparum
GMTYDKIFLYEHVKHNGSFDPVS

SEQ ID NO: 3383280 - protein, 17 aa, Plasmodium falciparum
GMYWSFYINKRKKIRKK

SEQ ID NO: 3383281 - protein, 27 aa, Plasmodium falciparum
GNCLNKFFNILIKIIDYWGGDIIKFSG

SEQ ID NO: 3383282 - protein, 36 aa, Plasmodium falciparum
GNDDFQYVIYSLNLNNFFLTIPLNKLIISSGSSHIN

SEQ ID NO: 3383283 - protein, 23 aa, Plasmodium falciparum
GNDFYPYLSSIVPTILSVLSVLP

SEQ ID NO: 3383284 - protein, 21 aa, Plasmodium falciparum
GNDIFSLQKINVYETKKEDVH

SEQ ID NO: 3383285 - protein, 22 aa, Plasmodium falciparum
GNDNFICLMCSYVANELKMVCQ

SEQ ID NO: 3383286 - protein, 18 aa, Plasmodium falciparum
GNDRIICPLFPIKQGIYS

SEQ ID NO: 3383287 - protein, 26 aa, Plasmodium falciparum
GNEFEDYFLKRELLMGIFEKGYEKPS

SEQ ID NO: 3383288 - protein, 21 aa, Plasmodium falciparum
GNEYRYINNKLYTLVDVTREI

SEQ ID NO: 3383289 - protein, 20 aa, Plasmodium falciparum
GNFISKIFRGEHTGLLILHL

SEQ ID NO: 3383290 - protein, 24 aa, Plasmodium falciparum
GNFVSFYFCNILSEDLKDLKYSYY

SEQ ID NO: 3383291 - protein, 30 aa, Plasmodium falciparum
GNGEGRYLFSLLDRLNNFKKLKLKTSENDA

SEQ ID NO: 3383292 - protein, 24 aa, Plasmodium falciparum
GNGFLISAFVIYPLKKHYGEYLAS

SEQ ID NO: 3383293 - protein, 24 aa, Plasmodium falciparum
GNGNILRISLPCSYNTIKKKIMEL

SEQ ID NO: 3383294 - protein, 26 aa, Plasmodium falciparum
GNGTIDFPEFLTLMARKLKDTDTEEE

SEQ ID NO: 3383295 - protein, 28 aa, Plasmodium falciparum
GNHDFPCNPAPPVPIKLFIGRVPKNIEE

SEQ ID NO: 3383296 - protein, 26 aa, Plasmodium falciparum
GNHINKFRFFTPTSNNVFVRTRSLTP

SEQ ID NO: 3383297 - protein, 26 aa, Plasmodium falciparum
GNHTCPITKFLWLQNKIISADKNGCL

SEQ ID NO: 3383298 - protein, 22 aa, Plasmodium falciparum
GNIEYVRYIPNKNIAFIQFTNR

SEQ ID NO: 3383299 - protein, 26 aa, Plasmodium falciparum
GNIGALNYFYLYNKTEKKMINNNPNV

SEQ ID NO: 3383300 - protein, 33 aa, Plasmodium falciparum
GNIKNNYFFNRGIYFFNKYKIYIGKWKSNCVDG

SEQ ID NO: 3383301 - protein, 31 aa, Plasmodium falciparum
GNIKRMYDDLKYILLFQNEIVDIIIEDIRKN

SEQ ID NO: 3383302 - protein, 39 aa, Plasmodium falciparum
GNILIVIKIKIPGLDDFLFFNIKAFCTCPYIKIIPNIID

SEQ ID NO: 3383303 - protein, 27 aa, Plasmodium falciparum
GNINNFFDFFIYFFPHHMCKYRNIEKY

SEQ ID NO: 3383304 - protein, 29 aa, Plasmodium falciparum
GNKCLLFTQFIKMLDILEIFLNHLNYSFI

SEQ ID NO: 3383305 - protein, 22 aa, Plasmodium falciparum
GNKDLIGYIQKVDEMDKAGHMN

SEQ ID NO: 3383306 - protein, 23 aa, Plasmodium falciparum
GNKGLFWLKIHLANTFGKDKLSF

SEQ ID NO: 3383307 - protein, 25 aa, Plasmodium falciparum
GNKKSDIFIEELLELLINEEKKEEH

SEQ ID NO: 3383308 - protein, 22 aa, Plasmodium falciparum
GNKLNVCNACLFCNNNNSQNHM

SEQ ID NO: 3383309 - protein, 25 aa, Plasmodium falciparum
GNKLRIYALGKKKLLKKCEYKDIPE

SEQ ID NO: 3383310 - protein, 25 aa, Plasmodium falciparum
GNKMKNLFYSEFLFDYNPWNDNDVN

SEQ ID NO: 3383311 - protein, 17 aa, Plasmodium falciparum
GNLKNYYKDLPTVIIVI

SEQ ID NO: 3383312 - protein, 19 aa, Plasmodium falciparum
GNLKRWNKYEWIKVKKAYG

SEQ ID NO: 3383313 - protein, 20 aa, Plasmodium falciparum
GNLSLKEKINYFIKNNIATK

SEQ ID NO: 3383314 - protein, 31 aa, Plasmodium falciparum
GNMFNGFSLYLFYPLIYVGYFINNSMHGYGY

SEQ ID NO: 3383315 - protein, 41 aa, Plasmodium falciparum
GNMKGYIFVWEVPSGNIIKILLPPLYFFNEAKRKKKKKKKK

SEQ ID NO: 3383316 - protein, 21 aa, Plasmodium falciparum
GNMNNGFIVERANPYDRKNVS

SEQ ID NO: 3383317 - protein, 25 aa, Plasmodium falciparum
GNNCKSILICTLSSKLQYLNETAST

SEQ ID NO: 3383318 - protein, 28 aa, Plasmodium falciparum
GNNKVLKPKYLFMSVYNVLKNINVKRKL

SEQ ID NO: 3383319 - protein, 22 aa, Plasmodium falciparum
GNNNYLINFIFDALHDVEVSIY

SEQ ID NO: 3383320 - protein, 18 aa, Plasmodium falciparum
GNNYKEFLRRYLLCFFCC

SEQ ID NO: 3383321 - protein, 29 aa, Plasmodium falciparum
GNPCSNWTYLKYYIIFQVEQLEVLDGCDI

SEQ ID NO: 3383322 - protein, 24 aa, Plasmodium falciparum
GNPEIQFFTNKQKLKIARYSWKAE

SEQ ID NO: 3383323 - protein, 33 aa, Plasmodium falciparum
GNPHTEILLNKLKPYFWFASHLHVKYSALYIHN

SEQ ID NO: 3383324 - protein, 21 aa, Plasmodium falciparum
GNPMMNYMNPNMYMKYNPMKS

SEQ ID NO: 3383325 - protein, 27 aa, Plasmodium falciparum
GNSKGFLIMNFLITSSYYNLKNDILTD

SEQ ID NO: 3383326 - protein, 34 aa, Plasmodium falciparum
GNSKSNFIPFRDSKLTRLLKDSLGGNCKTVMIAN

SEQ ID NO: 3383327 - protein, 24 aa, Plasmodium falciparum
GNTYIKTGFLYINGNYSPLFICTD

SEQ ID NO: 3383328 - protein, 26 aa, Plasmodium falciparum
GNVKDLLNHKFLIKKRYIKKKPSSIY

SEQ ID NO: 3383329 - protein, 27 aa, Plasmodium falciparum
GNYDAKLKYYFLKLCSHFSYLSEASYD

SEQ ID NO: 3383330 - protein, 22 aa, Plasmodium falciparum
GNYERFLNIRLTYKNNITSGKI

SEQ ID NO: 3383331 - protein, 30 aa, Plasmodium falciparum
GNYNFKNIVITNIFLGNIPPNITEERLKNV

SEQ ID NO: 3383332 - protein, 30 aa, Plasmodium falciparum
GPDATELILSLWPTPTKLSAALNKYTHDGI

SEQ ID NO: 3383333 - protein, 31 aa, Plasmodium falciparum
GPFEYQSLLKSLLYIYNFYTNKKDNCFIYND

SEQ ID NO: 3383334 - protein, 18 aa, Plasmodium falciparum
GPISIILTPTRELSIQVK

SEQ ID NO: 3383335 - protein, 17 aa, Plasmodium falciparum
GPKEKWWRRHSSYCCGN

SEQ ID NO: 3383336 - protein, 24 aa, Plasmodium falciparum
GPKKNLFFIGATNRPELLDEALLR

SEQ ID NO: 3383337 - protein, 21 aa, Plasmodium falciparum
GPLAIISVDKNLFFNCLKDDN

SEQ ID NO: 3383338 - protein, 21 aa, Plasmodium falciparum
GPLSLLSINAILNGAKHVDAL

SEQ ID NO: 3383339 - protein, 31 aa, Plasmodium falciparum
GPLVVLEYIEKDPFIFLKNGMNSKLNHYFIC

SEQ ID NO: 3383340 - protein, 17 aa, Plasmodium falciparum
GPMYPLKIIAGYSEIKY

SEQ ID NO: 3383341 - protein, 23 aa, Plasmodium falciparum
GPPSQITVPPTPPAYLTMQNSKK

SEQ ID NO: 3383342 - protein, 41 aa, Plasmodium falciparum
GPSGSNLFIFHIPSEWTDLDLFQHFCCFGNIISSKIQRDST

SEQ ID NO: 3383343 - protein, 26 aa, Plasmodium falciparum
GPYDNELNYFTWGPGFEYEPEPQRKP

SEQ ID NO: 3383344 - protein, 17 aa, Plasmodium falciparum
GPYIKWMQKALGSKGIA

SEQ ID NO: 3383345 - protein, 26 aa, Plasmodium falciparum
GQDILFFWVARMVMVSLHLMKKLPFK

SEQ ID NO: 3383346 - protein, 23 aa, Plasmodium falciparum
GQENRPMIYINDTSAEECNNNNN

SEQ ID NO: 3383347 - protein, 23 aa, Plasmodium falciparum
GQERYRSLAPMYYRGASAAVIVY

SEQ ID NO: 3383348 - protein, 26 aa, Plasmodium falciparum
GQNINKFSLHFFLKNNNYLNNNNNNN

SEQ ID NO: 3383349 - protein, 25 aa, Plasmodium falciparum
GQNVNELFLRIAKKLPLHKKEQERC

SEQ ID NO: 3383350 - protein, 24 aa, Plasmodium falciparum
GQNYLGRIYMIIRNDIIKNYEIYT

SEQ ID NO: 3383351 - protein, 20 aa, Plasmodium falciparum
GQPTKSKRGAKSWMSFGKGK

SEQ ID NO: 3383352 - protein, 18 aa, Plasmodium falciparum
GQRTPYKYILKVAGLIQD

SEQ ID NO: 3383353 - protein, 18 aa, Plasmodium falciparum
GQVTLWKLIEDVIFEMQT

SEQ ID NO: 3383354 - protein, 25 aa, Plasmodium falciparum
GQWYDCIISKYKGDSFLITYIGYNN

SEQ ID NO: 3383355 - protein, 29 aa, Plasmodium falciparum
GQYGLLLRQYIISHLIKLQEPPPLKQKKI

SEQ ID NO: 3383356 - protein, 26 aa, Plasmodium falciparum
GQYKVKIKPVFFERKIKISENKIACL

SEQ ID NO: 3383357 - protein, 24 aa, Plasmodium falciparum
GREFRNHAYKKIGACKIFVGNISS

SEQ ID NO: 3383358 - protein, 19 aa, Plasmodium falciparum
GREPFYVDLPLPSVTERTF

SEQ ID NO: 3383359 - protein, 19 aa, Plasmodium falciparum
GRFLTLLSWTGRKKNLYSL

SEQ ID NO: 3383360 - protein, 19 aa, Plasmodium falciparum
GRHSFFNANKLLNSIEIKI

SEQ ID NO: 3383361 - protein, 34 aa, Plasmodium falciparum
GRIELWDFDFFSKDPLIIFYPNNLEASKITTLKM

SEQ ID NO: 3383362 - protein, 23 aa, Plasmodium falciparum
GRINSHIFVLNKNLYVYGGMYEY

SEQ ID NO: 3383363 - protein, 27 aa, Plasmodium falciparum
GRKKGSMQEFIEQKKKLKGLVVMPHEM

SEQ ID NO: 3383364 - protein, 24 aa, Plasmodium falciparum
GRKKKKIYFIVMNNFFSSIVEIHR

SEQ ID NO: 3383365 - protein, 29 aa, Plasmodium falciparum
GRKNYFYATYLYSHVVYNSKLHSGNISYQ

SEQ ID NO: 3383366 - protein, 27 aa, Plasmodium falciparum
GRKQKSPIILLPPYITVHELRIMLNIN

SEQ ID NO: 3383367 - protein, 18 aa, Plasmodium falciparum
GRLCLIEYGPYAGKLCFI

SEQ ID NO: 3383368 - protein, 18 aa, Plasmodium falciparum
GRNYAFVCRYVIFCNTRK

SEQ ID NO: 3383369 - protein, 19 aa, Plasmodium falciparum
GRRKCIHMFKKWIHEKNVK

SEQ ID NO: 3383370 - protein, 43 aa, Plasmodium falciparum
GRSYSDPFPFHSPNTSILEFCCSRYFSSNFPFEKTMIQNEQVQ

SEQ ID NO: 3383371 - protein, 23 aa, Plasmodium falciparum
GRTIKNWIPRRLGGGKGPARGSE

SEQ ID NO: 3383372 - protein, 27 aa, Plasmodium falciparum
GSATLRKILLILIKVVKKLKYKTFWTY

SEQ ID NO: 3383373 - protein, 34 aa, Plasmodium falciparum
GSCGSYFRVYLVPHILIYALTKYSVIQLESLFND

SEQ ID NO: 3383374 - protein, 23 aa, Plasmodium falciparum
GSDPKCRAFLPFLQQYYKTINEG

SEQ ID NO: 3383375 - protein, 33 aa, Plasmodium falciparum
GSDSLVTCKTFFKLMEMYFDNKIDDKKYSGIIY

SEQ ID NO: 3383376 - protein, 17 aa, Plasmodium falciparum
GSFAVYIEPWHSDIFEF

SEQ ID NO: 3383377 - protein, 31 aa, Plasmodium falciparum
GSFSIEVLLLLYALKINFPDRIWLIRGNHEC

SEQ ID NO: 3383378 - protein, 29 aa, Plasmodium falciparum
GSFSVEVIIFLYLAKLTFPNNVYLTRGNH

SEQ ID NO: 3383379 - protein, 19 aa, Plasmodium falciparum
GSFSWPTFGISKNTRIIDV

SEQ ID NO: 3383380 - protein, 20 aa, Plasmodium falciparum
GSGFVTFYNRDEAVNAIKCL

SEQ ID NO: 3383381 - protein, 30 aa, Plasmodium falciparum
GSGKALRLCTKFFLDGYCNKSDKCPMAHHI

SEQ ID NO: 3383382 - protein, 30 aa, Plasmodium falciparum
GSGKTAGYLLPIINHMLINDPPKHTYYEQN

SEQ ID NO: 3383383 - protein, 23 aa, Plasmodium falciparum
GSGKTFSFLCPIISNLKKENEIL

SEQ ID NO: 3383384 - protein, 35 aa, Plasmodium falciparum
GSGKTIAYLLPILNNLYFLHDYLEQIILDSYNEKE

SEQ ID NO: 3383385 - protein, 33 aa, Plasmodium falciparum
GSGKTLAFILPAFVHILAQPNLKYGDGPIVLVL

SEQ ID NO: 3383386 - protein, 21 aa, Plasmodium falciparum
GSGLGRLPYEIAKKGYRSQGN

SEQ ID NO: 3383387 - protein, 23 aa, Plasmodium falciparum
GSGSIYIQSYLQDKYKKFMTKKE

SEQ ID NO: 3383388 - protein, 34 aa, Plasmodium falciparum
GSHIKGLLINMIHKFWPSLLKHKGFLSEFVTPIV

SEQ ID NO: 3383389 - protein, 29 aa, Plasmodium falciparum
GSHMTKLINAFIHFMKYRDQLYNENGEKI

SEQ ID NO: 3383390 - protein, 19 aa, Plasmodium falciparum
GSHSLTPLSTYSSTTSSIY

SEQ ID NO: 3383391 - protein, 31 aa, Plasmodium falciparum
GSHYSTLAYVVYFLIRLYPECQLKLQSGKFD

SEQ ID NO: 3383392 - protein, 23 aa, Plasmodium falciparum
GSIAHNYYYRKIALNIMNYDYEK

SEQ ID NO: 3383393 - protein, 25 aa, Plasmodium falciparum
GSIDILIIDALFYKRKHYSHFSLYE

SEQ ID NO: 3383394 - protein, 25 aa, Plasmodium falciparum
GSIKNSFMKIFQKKKKKKKKKTKKI

SEQ ID NO: 3383395 - protein, 52 aa, Plasmodium falciparum
GSLIAHHNFYVNHHPYILNNHPNPLPGPQPIFAPPLPYTNTLTSTGNTTGAG

SEQ ID NO: 3383396 - protein, 25 aa, Plasmodium falciparum
GSLNEYLYGYYIIQSSSSLMPVLEL

SEQ ID NO: 3383397 - protein, 25 aa, Plasmodium falciparum
GSLNMYEYIYKNFQFFRQETFCITE

SEQ ID NO: 3383398 - protein, 27 aa, Plasmodium falciparum
GSNDRLIKIWDLASCKLKLTLTGHINS

SEQ ID NO: 3383399 - protein, 23 aa, Plasmodium falciparum
GSNFCRFLKYNIVDKMRTLVNTN

SEQ ID NO: 3383400 - protein, 31 aa, Plasmodium falciparum
GSNFNLNSFKLPQIPLILKTCDEGSLEGIME

SEQ ID NO: 3383401 - protein, 24 aa, Plasmodium falciparum
GSNIAPNIYLNKNSGYENCYEINE

SEQ ID NO: 3383402 - protein, 24 aa, Plasmodium falciparum
GSNIPNMYNITNIPQIVKGQDQFC

SEQ ID NO: 3383403 - protein, 29 aa, Plasmodium falciparum
GSNKEYGIIYYFVHYLYKLCNSKNKNKKK

SEQ ID NO: 3383404 - protein, 24 aa, Plasmodium falciparum
GSNKKTKFLLPNNKYKYVVKNVKE

SEQ ID NO: 3383405 - protein, 17 aa, Plasmodium falciparum
GSNVRVTLRIDYEPCIC

SEQ ID NO: 3383406 - protein, 27 aa, Plasmodium falciparum
GSPTDELWVYNFKKENWFLMKNSSGEA

SEQ ID NO: 3383407 - protein, 17 aa, Plasmodium falciparum
GSPYIKLYFNQLDVQKC

SEQ ID NO: 3383408 - protein, 25 aa, Plasmodium falciparum
GSQEPVILIDKIERCLVVEWYENNI

SEQ ID NO: 3383409 - protein, 22 aa, Plasmodium falciparum
GSQFFITLCPLPHLDGKHTIFA

SEQ ID NO: 3383410 - protein, 24 aa, Plasmodium falciparum
GSRGFFTALLKHLSRIHNYSAVET

SEQ ID NO: 3383411 - protein, 21 aa, Plasmodium falciparum
GSRNCSYIYLYDIRNVKDYIQ

SEQ ID NO: 3383412 - protein, 21 aa, Plasmodium falciparum
GSSDTFDLLYKRKIDKDDNLS

SEQ ID NO: 3383413 - protein, 24 aa, Plasmodium falciparum
GSSEFYIWSFSFYLEVRINYFSPI

SEQ ID NO: 3383414 - protein, 20 aa, Plasmodium falciparum
GSSLCDIAILVIDLMHGLEQ

SEQ ID NO: 3383415 - protein, 25 aa, Plasmodium falciparum
GSSLFLQFSFPSFLDELFIQKSNRK

SEQ ID NO: 3383416 - protein, 31 aa, Plasmodium falciparum
GSSLFSYLFSIRYKMQFFFSHVIRYLQEDII

SEQ ID NO: 3383417 - protein, 20 aa, Plasmodium falciparum
GSTCFFIDVIMISKSDFSYG

SEQ ID NO: 3383418 - protein, 26 aa, Plasmodium falciparum
GSTLLDYFMSLVPGSLDVYEIKKIMK

SEQ ID NO: 3383419 - protein, 31 aa, Plasmodium falciparum
GSTRVPFIQNFLQQYFQKPLSKTLIADESIA

SEQ ID NO: 3383420 - protein, 44 aa, Plasmodium falciparum
GSVNDAYVFCRALVKYFDFLPENILLLTDSLPSNAYIYEDFDIN

SEQ ID NO: 3383421 - protein, 19 aa, Plasmodium falciparum
GSWDVSYICLQRAFKMCYE

SEQ ID NO: 3383422 - protein, 25 aa, Plasmodium falciparum
GSYDGYVHFWQFKNMNKISASVQKI

SEQ ID NO: 3383423 - protein, 19 aa, Plasmodium falciparum
GSYFFSSCSVDYLNNESAN

SEQ ID NO: 3383424 - protein, 23 aa, Plasmodium falciparum
GSYSFKFILNINMYDFEENFYFN

SEQ ID NO: 3383425 - protein, 22 aa, Plasmodium falciparum
GSYYKYMYRNLYEETCNNKMKN

SEQ ID NO: 3383426 - protein, 24 aa, Plasmodium falciparum
GTCDIIRSLLIAQLALKHRVDKNL

SEQ ID NO: 3383427 - protein, 22 aa, Plasmodium falciparum
GTCLNRGCIPSKSLLHISHNYY

SEQ ID NO: 3383428 - protein, 20 aa, Plasmodium falciparum
GTCPSIYCENAKLLPTAISE

SEQ ID NO: 3383429 - protein, 40 aa, Plasmodium falciparum
GTDMLRIGGYLPPVEIKLYKAFEYIYGKWRNKNKGRNKYN

SEQ ID NO: 3383430 - protein, 17 aa, Plasmodium falciparum
GTDYYMTLIKKDKNVFD

SEQ ID NO: 3383431 - protein, 25 aa, Plasmodium falciparum
GTFVGSPEMFFNNIVLDVLTDFNNI

SEQ ID NO: 3383432 - protein, 25 aa, Plasmodium falciparum
GTGKTLSYLLPLIQKLINDKFDCNK

SEQ ID NO: 3383433 - protein, 26 aa, Plasmodium falciparum
GTGKTLTFCLPILNNILINKLKEYKK

SEQ ID NO: 3383434 - protein, 18 aa, Plasmodium falciparum
GTGKYNWGNSIDSTAAES

SEQ ID NO: 3383435 - protein, 17 aa, Plasmodium falciparum
GTIDYMPPEIINQIPYD

SEQ ID NO: 3383436 - protein, 22 aa, Plasmodium falciparum
GTIPFLCDFIDISKDHMKLPAI

SEQ ID NO: 3383437 - protein, 20 aa, Plasmodium falciparum
GTKKLNFLTIKKSKEGNEEK

SEQ ID NO: 3383438 - protein, 31 aa, Plasmodium falciparum
GTLEHAKSCLFLLDPLRKFFGNRVFSRKDCL

SEQ ID NO: 3383439 - protein, 17 aa, Plasmodium falciparum
GTLLNKLSTLNNKNKHG

SEQ ID NO: 3383440 - protein, 18 aa, Plasmodium falciparum
GTLYVGFRTVMGLFLLIT

SEQ ID NO: 3383441 - protein, 39 aa, Plasmodium falciparum
GTMNIKNIIFKAYYLRGIARYKLRIYKLSLKDFKESKIL

SEQ ID NO: 3383442 - protein, 25 aa, Plasmodium falciparum
GTNVQLRYFVRLNIIKGYSGNIQKE

SEQ ID NO: 3383443 - protein, 33 aa, Plasmodium falciparum
GTPIQNSIFDIFPLFRFLGIKPYGTIEWWNKEI

SEQ ID NO: 3383444 - protein, 32 aa, Plasmodium falciparum
GTPYQLIAMYRNLLVVISRRNQKNEPVFFQIV

SEQ ID NO: 3383445 - protein, 17 aa, Plasmodium falciparum
GTSAKFGLGIKLLSRKI

SEQ ID NO: 3383446 - protein, 20 aa, Plasmodium falciparum
GTSLSLYDFILNKNAKKEKS

SEQ ID NO: 3383447 - protein, 21 aa, Plasmodium falciparum
GTSSTFIPSAKLKHLESLKEE

SEQ ID NO: 3383448 - protein, 27 aa, Plasmodium falciparum
GTSVHGTFVYYPNKRKAKMWIGNYKIL

SEQ ID NO: 3383449 - protein, 23 aa, Plasmodium falciparum
GTTNNIRYKTGESTLPILSGTTN

SEQ ID NO: 3383450 - protein, 17 aa, Plasmodium falciparum
GTVNKFSFAHNYRYLYI

SEQ ID NO: 3383451 - protein, 17 aa, Plasmodium falciparum
GTYFFADGGIYEGDWVD

SEQ ID NO: 3383452 - protein, 29 aa, Plasmodium falciparum
GTYFNTYFSAFKILWLIQNNPEIKQKIDD

SEQ ID NO: 3383453 - protein, 22 aa, Plasmodium falciparum
GTYIYEEFLSTFGTDIKVYTVG

SEQ ID NO: 3383454 - protein, 27 aa, Plasmodium falciparum
GVACISWEKPYNNILLMNKNLNDNNNN

SEQ ID NO: 3383455 - protein, 21 aa, Plasmodium falciparum
GVAYVEFYTQEAVIKALAANG

SEQ ID NO: 3383456 - protein, 24 aa, Plasmodium falciparum
GVCIKRGYVLPKLRVMYLKCNSCD

SEQ ID NO: 3383457 - protein, 29 aa, Plasmodium falciparum
GVDNILLKLKFDFNFYDFARVGNIYEIIF

SEQ ID NO: 3383458 - protein, 29 aa, Plasmodium falciparum
GVEHEILTVPFFKKYLHYVKNIFYHEKQR

SEQ ID NO: 3383459 - protein, 17 aa, Plasmodium falciparum
GVFTGILRKIIYNSSTQ

SEQ ID NO: 3383460 - protein, 29 aa, Plasmodium falciparum
GVGDLGLDLIKKFLKWNPYERITASDALN

SEQ ID NO: 3383461 - protein, 22 aa, Plasmodium falciparum
GVGKSCILLRFSDDHFTESYIT

SEQ ID NO: 3383462 - protein, 18 aa, Plasmodium falciparum
GVHVNGYIIDCAFTIAFN

SEQ ID NO: 3383463 - protein, 26 aa, Plasmodium falciparum
GVIPHIHKALMNKVPLPPTAQKKPKK

SEQ ID NO: 3383464 - protein, 25 aa, Plasmodium falciparum
GVIPRCFLCIWQTLFMVTGIKILNK

SEQ ID NO: 3383465 - protein, 27 aa, Plasmodium falciparum
GVKEIHWPYYYFYICDIIYGSKMDDYF

SEQ ID NO: 3383466 - protein, 35 aa, Plasmodium falciparum
GVKRLCHIRGKMRKRVWINSGDIILVSLRDYQDSK

SEQ ID NO: 3383467 - protein, 25 aa, Plasmodium falciparum
GVLKIWDLRMNLFNISKKSSRSNKS

SEQ ID NO: 3383468 - protein, 24 aa, Plasmodium falciparum
GVMNRNSISPIYPTSIRSNNMINN

SEQ ID NO: 3383469 - protein, 19 aa, Plasmodium falciparum
GVQTLLLQKQVISEQKKRL

SEQ ID NO: 3383470 - protein, 17 aa, Plasmodium falciparum
GVRLIRTNLFYEDIKPK

SEQ ID NO: 3383471 - protein, 26 aa, Plasmodium falciparum
GVSEIFNEVKLDEGLFGALEYLKTKG

SEQ ID NO: 3383472 - protein, 17 aa, Plasmodium falciparum
GVSNSLLYDLSISTYDV

SEQ ID NO: 3383473 - protein, 20 aa, Plasmodium falciparum
GVTCIPLNYQSKGGAMAIIL

SEQ ID NO: 3383474 - protein, 34 aa, Plasmodium falciparum
GVVEFIYLRKKIRRTLYHIYKDKIYSYWRNQNND

SEQ ID NO: 3383475 - protein, 23 aa, Plasmodium falciparum
GVVPYIVEFLKYDDKTDLQFEAA

SEQ ID NO: 3383476 - protein, 19 aa, Plasmodium falciparum
GVYFEYYLGCIETESIILS

SEQ ID NO: 3383477 - protein, 17 aa, Plasmodium falciparum
GVYFLVKSYIKNIKSLC

SEQ ID NO: 3383478 - protein, 19 aa, Plasmodium falciparum
GWHRLAIPSSLRLFVNGDI

SEQ ID NO: 3383479 - protein, 22 aa, Plasmodium falciparum
GYCNIYAYNNLLYEIYDKFSNC

SEQ ID NO: 3383480 - protein, 29 aa, Plasmodium falciparum
GYDENIGFRCFYNFILDYYETININDPYS

SEQ ID NO: 3383481 - protein, 29 aa, Plasmodium falciparum
GYDFEKVIYWFAQRVDLILLIFDAHKLDI

SEQ ID NO: 3383482 - protein, 33 aa, Plasmodium falciparum
GYDGIKQVNFMNPSIFYLLSSLEKFKDFTGTPQ

SEQ ID NO: 3383483 - protein, 26 aa, Plasmodium falciparum
GYDKKKYIIENIKKFNYNISEMEMNS

SEQ ID NO: 3383484 - protein, 19 aa, Plasmodium falciparum
GYEIILEHPTSLQTEKRIV

SEQ ID NO: 3383485 - protein, 19 aa, Plasmodium falciparum
GYFEPMLPVRCCDSDRFVA

SEQ ID NO: 3383486 - protein, 20 aa, Plasmodium falciparum
GYGLVYFVLEVLKSLNIPVE

SEQ ID NO: 3383487 - protein, 27 aa, Plasmodium falciparum
GYIDIREFYFALKSLGLNFKKEQVKNI

SEQ ID NO: 3383488 - protein, 19 aa, Plasmodium falciparum
GYIHIYNLDRGKFTCISKT

SEQ ID NO: 3383489 - protein, 31 aa, Plasmodium falciparum
GYIYNYDDYMYLFMKYFQLLNIKNHNEFSYD

SEQ ID NO: 3383490 - protein, 35 aa, Plasmodium falciparum
GYKINSIKLWGYFCTSCYFFMRTNNLLFCSKCGNN

SEQ ID NO: 3383491 - protein, 26 aa, Plasmodium falciparum
GYKNARKLLWGDLWRFTKRVTRPDAR

SEQ ID NO: 3383492 - protein, 17 aa, Plasmodium falciparum
GYKRGFCQFIMEPILNL

SEQ ID NO: 3383493 - protein, 28 aa, Plasmodium falciparum
GYLNDNEFLVFLYHIYELSKNLQYSKLK

SEQ ID NO: 3383494 - protein, 21 aa, Plasmodium falciparum
GYNCLILCKGLPFHVDNSQII

SEQ ID NO: 3383495 - protein, 25 aa, Plasmodium falciparum
GYNLHKLINRIYFLSQHMNLPYNNI

SEQ ID NO: 3383496 - protein, 27 aa, Plasmodium falciparum
GYNPKILYEYVFPVIYRHLHRSVRRRL

SEQ ID NO: 3383497 - protein, 31 aa, Plasmodium falciparum
GYNQKRLLTQITPYDYRVVLNSNFCNKFFTP

SEQ ID NO: 3383498 - protein, 25 aa, Plasmodium falciparum
GYQSLLNDYLKKITDLNLKYDECYK

SEQ ID NO: 3383499 - protein, 18 aa, Plasmodium falciparum
GYRDINVQAFYRPQEDYA

SEQ ID NO: 3383500 - protein, 26 aa, Plasmodium falciparum
GYTARLIAKYKPSCTILALSASDSTV

SEQ ID NO: 3383501 - protein, 37 aa, Plasmodium falciparum
GYVIPKNYNFIISANRKLCFLIKNKDNFIYNGINSDI

SEQ ID NO: 3383502 - protein, 21 aa, Plasmodium falciparum
GYVQNVKLLNKMNKAYNVIQN

SEQ ID NO: 3383503 - protein, 24 aa, Plasmodium falciparum
HACSDYIYLLMTLSKDPEKFNYAL

SEQ ID NO: 3383504 - protein, 21 aa, Plasmodium falciparum
HADMKFKEILYDKSSKHQSDE

SEQ ID NO: 3383505 - protein, 23 aa, Plasmodium falciparum
HAKNIYQIITLINPSLFDEHKDT

SEQ ID NO: 3383506 - protein, 17 aa, Plasmodium falciparum
HAMVVIKKFLPKPILMQ

SEQ ID NO: 3383507 - protein, 29 aa, Plasmodium falciparum
HANKIITQLIKTVAYLHRCGIIHRDIKPE

SEQ ID NO: 3383508 - protein, 19 aa, Plasmodium falciparum
HASLIKRTFELYYNKYKQQ

SEQ ID NO: 3383509 - protein, 25 aa, Plasmodium falciparum
HASNMNFIYDYNYHNNYSSTNSQQL

SEQ ID NO: 3383510 - protein, 17 aa, Plasmodium falciparum
HASTIRLSLRKGKGDQR

SEQ ID NO: 3383511 - protein, 29 aa, Plasmodium falciparum
HAVNPSVLLNDKLNYLTNTLLQNKKENIL

SEQ ID NO: 3383512 - protein, 20 aa, Plasmodium falciparum
HAYAPIYKLIDIYNPENIVY

SEQ ID NO: 3383513 - protein, 22 aa, Plasmodium falciparum
HAYNLIDKKGLTRVLVQAVLDL

SEQ ID NO: 3383514 - protein, 28 aa, Plasmodium falciparum
HCATGDLRKLLQNLLYHRKKEYEKKKKV

SEQ ID NO: 3383515 - protein, 22 aa, Plasmodium falciparum
HCGATQYIQLLSFASSVHSLLN

SEQ ID NO: 3383516 - protein, 35 aa, Plasmodium falciparum
HCGNNAYVILTVAKLFWVNFKIQKARKWFYRVINL

SEQ ID NO: 3383517 - protein, 18 aa, Plasmodium falciparum
HCIIFFKTKRETHLMYLL

SEQ ID NO: 3383518 - protein, 26 aa, Plasmodium falciparum
HCKHKLVFELQLFSTFIYQIEKKLEQ

SEQ ID NO: 3383519 - protein, 27 aa, Plasmodium falciparum
HCSHGDTYFYNYLRYSVNNNGRNHNNS

SEQ ID NO: 3383520 - protein, 17 aa, Plasmodium falciparum
HDAIWSYDGNSFLLLHS

SEQ ID NO: 3383521 - protein, 40 aa, Plasmodium falciparum
HDATKYIIQLLNPILENAFYNLIYYTNSIDRLKLLYDYMH

SEQ ID NO: 3383522 - protein, 17 aa, Plasmodium falciparum
HDDLFLQYSKLCYMIFE

SEQ ID NO: 3383523 - protein, 18 aa, Plasmodium falciparum
HDDRHRSRRRLSYDKYEK

SEQ ID NO: 3383524 - protein, 24 aa, Plasmodium falciparum
HDDRQKHCFLFIDDYLTSNENKFD

SEQ ID NO: 3383525 - protein, 34 aa, Plasmodium falciparum
HDENMYKAYIWYDKKKYLYIWNKNIKVEDMRENL

SEQ ID NO: 3383526 - protein, 23 aa, Plasmodium falciparum
HDEPFLRFAYAYYGSMYDKLTNV

SEQ ID NO: 3383527 - protein, 30 aa, Plasmodium falciparum
HDFIGKKYVLLYFYPLDFTFVCPSEIIALD

SEQ ID NO: 3383528 - protein, 18 aa, Plasmodium falciparum
HDFLPYKCEYCKLIFCEF

SEQ ID NO: 3383529 - protein, 25 aa, Plasmodium falciparum
HDFQNIFNSLLTKYPHVFVYVTYSN

SEQ ID NO: 3383530 - protein, 24 aa, Plasmodium falciparum
HDIHNLKYFSFTKLLKHIDKNNYF

SEQ ID NO: 3383531 - protein, 25 aa, Plasmodium falciparum
HDIKEKLIERVMINKLTKITCHEND

SEQ ID NO: 3383532 - protein, 24 aa, Plasmodium falciparum
HDKKKKKLFFLKKQKKKNYHSSSQ

SEQ ID NO: 3383533 - protein, 29 aa, Plasmodium falciparum
HDKKVLFNTILYVYNYKHENIRKVQIQLN

SEQ ID NO: 3383534 - protein, 26 aa, Plasmodium falciparum
HDKNPFHNNLYYYKGKKIKMKNINNH

SEQ ID NO: 3383535 - protein, 26 aa, Plasmodium falciparum
HDLHNLKSYDFGLSKDLLKKDIFIYS

SEQ ID NO: 3383536 - protein, 20 aa, Plasmodium falciparum
HDMSTLKFSTKYSHKDIHIK

SEQ ID NO: 3383537 - protein, 19 aa, Plasmodium falciparum
HDNNSVNCFMNINKKTKEV

SEQ ID NO: 3383538 - protein, 23 aa, Plasmodium falciparum
HDNNVDFLNMKKNSLHISIPNNN

SEQ ID NO: 3383539 - protein, 24 aa, Plasmodium falciparum
HDPYQFKLILILQAYQEKIKINKY

SEQ ID NO: 3383540 - protein, 21 aa, Plasmodium falciparum
HDQLTSFYFNSSENNKIKSSE

SEQ ID NO: 3383541 - protein, 24 aa, Plasmodium falciparum
HDQNNAPILQPINNHLAHINDLCY

SEQ ID NO: 3383542 - protein, 24 aa, Plasmodium falciparum
HEALYKYYVLKKNNAFKSNFGGVR

SEQ ID NO: 3383543 - protein, 22 aa, Plasmodium falciparum
HECILTNVNVVWSVFNNDLLNL

SEQ ID NO: 3383544 - protein, 23 aa, Plasmodium falciparum
HEDPLHPSQLLHKKNICVPCENY

SEQ ID NO: 3383545 - protein, 17 aa, Plasmodium falciparum
HEFILRKGKYNSDEEED

SEQ ID NO: 3383546 - protein, 22 aa, Plasmodium falciparum
HEGIYPLKFKHTLKKLYMGNLT

SEQ ID NO: 3383547 - protein, 19 aa, Plasmodium falciparum
HEHLHEHLHKSILIKKKYN

SEQ ID NO: 3383548 - protein, 18 aa, Plasmodium falciparum
HEINENLTFLQIIQYLCS

SEQ ID NO: 3383549 - protein, 25 aa, Plasmodium falciparum
HEKEEKYFLKFFIEPEKLSEHNNEK

SEQ ID NO: 3383550 - protein, 42 aa, Plasmodium falciparum
HEKEFLKEFQLFMPDVNIMADKNILYVLRHSKNEKNCVFKYF

SEQ ID NO: 3383551 - protein, 26 aa, Plasmodium falciparum
HEKNKKFPIIHYKINDFKYYIKNNII

SEQ ID NO: 3383552 - protein, 18 aa, Plasmodium falciparum
HEKPWSNHGDKSMWFNYN

SEQ ID NO: 3383553 - protein, 25 aa, Plasmodium falciparum
HEKYNYVNFNLSYKTLRKKMICLRH

SEQ ID NO: 3383554 - protein, 18 aa, Plasmodium falciparum
HELIIFNKGMNERNIYFV

SEQ ID NO: 3383555 - protein, 46 aa, Plasmodium falciparum
HENITMYHFNPEKFGYKYNNGLKPSEGYLLIYPHISHNSIAPKIKK

SEQ ID NO: 3383556 - protein, 17 aa, Plasmodium falciparum
HEQNAACLYGLIHSRFI

SEQ ID NO: 3383557 - protein, 28 aa, Plasmodium falciparum
HERKCIEEIINFHDSKLKWIEENEKVEK

SEQ ID NO: 3383558 - protein, 24 aa, Plasmodium falciparum
HERKYFYENIYLRENLIDLKKKSN

SEQ ID NO: 3383559 - protein, 24 aa, Plasmodium falciparum
HESLNKFFLNKKLGKEINYFDKLN

SEQ ID NO: 3383560 - protein, 17 aa, Plasmodium falciparum
HEWETNKYIFLNQKKKE

SEQ ID NO: 3383561 - protein, 19 aa, Plasmodium falciparum
HEYESYVEILRYNDNLKNL

SEQ ID NO: 3383562 - protein, 18 aa, Plasmodium falciparum
HEYMDLRINFQELLEEKC

SEQ ID NO: 3383563 - protein, 17 aa, Plasmodium falciparum
HEYNFLNNKTACSYSYA

SEQ ID NO: 3383564 - protein, 25 aa, Plasmodium falciparum
HEYYVNQYRALYAINIRIDEDTIID

SEQ ID NO: 3383565 - protein, 17 aa, Plasmodium falciparum
HFANIFCNGRIILVLEG

SEQ ID NO: 3383566 - protein, 30 aa, Plasmodium falciparum
HFCNVCFSFLYYKKYCFYELLRIYKNYSCL

SEQ ID NO: 3383567 - protein, 38 aa, Plasmodium falciparum
HFDEKEKKKLFLYGYEQQLLYGRINWKLAEKKKITKHS

SEQ ID NO: 3383568 - protein, 25 aa, Plasmodium falciparum
HFDKRNIFLFVLNEKMIVFTQTPID

SEQ ID NO: 3383569 - protein, 30 aa, Plasmodium falciparum
HFDSTNFPSFFDYTPGIPPPYLVRSNASMD

SEQ ID NO: 3383570 - protein, 25 aa, Plasmodium falciparum
HFEVKYLCNILYSILLRLVNTLHKD

SEQ ID NO: 3383571 - protein, 19 aa, Plasmodium falciparum
HFFNQYVLSLKTLKKSRIF

SEQ ID NO: 3383572 - protein, 18 aa, Plasmodium falciparum
HFHYSSESFFKNMKSQPS

SEQ ID NO: 3383573 - protein, 17 aa, Plasmodium falciparum
HFIKKFTTLKTNKNILN

SEQ ID NO: 3383574 - protein, 17 aa, Plasmodium falciparum
HFKGDINILPYNNYIPL

SEQ ID NO: 3383575 - protein, 34 aa, Plasmodium falciparum
HFKKSHRLFKFPCCNKIFPCPTCHDLNSNHECDI

SEQ ID NO: 3383576 - protein, 25 aa, Plasmodium falciparum
HFKTKLTLKYFFLTYEEEKEENSMQ

SEQ ID NO: 3383577 - protein, 25 aa, Plasmodium falciparum
HFNEYNFSLYFLITPPYDEEERKKL

SEQ ID NO: 3383578 - protein, 26 aa, Plasmodium falciparum
HFNKDFSLLNNVTLTNFDPLDKSVSG

SEQ ID NO: 3383579 - protein, 18 aa, Plasmodium falciparum
HFNNFLACQSNVLEYLLL

SEQ ID NO: 3383580 - protein, 17 aa, Plasmodium falciparum
HFNSYKKHFFSQLINKE

SEQ ID NO: 3383581 - protein, 26 aa, Plasmodium falciparum
HFPEAFGVVFMLYIPVEINKNTVHAF

SEQ ID NO: 3383582 - protein, 25 aa, Plasmodium falciparum
HFPQCYNFFPMTWILPNEVSDFKSY

SEQ ID NO: 3383583 - protein, 19 aa, Plasmodium falciparum
HFPYNFFKNNEQGPYMQRS

SEQ ID NO: 3383584 - protein, 21 aa, Plasmodium falciparum
HFRNSFNNPLYDFYESNIYSS

SEQ ID NO: 3383585 - protein, 18 aa, Plasmodium falciparum
HFSAYLYFFKMLGDYEEY

SEQ ID NO: 3383586 - protein, 23 aa, Plasmodium falciparum
HFSQLIYSSYIFNIDKPEFINMF

SEQ ID NO: 3383587 - protein, 22 aa, Plasmodium falciparum
HFTHTLILNNIIHLLRTKYKAH

SEQ ID NO: 3383588 - protein, 26 aa, Plasmodium falciparum
HFWTNIDNYYFCNFDKSIISAFENHI

SEQ ID NO: 3383589 - protein, 20 aa, Plasmodium falciparum
HFYADWERLLAYNHGLYTLK

SEQ ID NO: 3383590 - protein, 19 aa, Plasmodium falciparum
HFYGSLALNLFFQNKSIND

SEQ ID NO: 3383591 - protein, 20 aa, Plasmodium falciparum
HFYIQRHFFIPYTILKDVVK

SEQ ID NO: 3383592 - protein, 24 aa, Plasmodium falciparum
HGCNVFINRQLIYNYPEQIFRENN

SEQ ID NO: 3383593 - protein, 25 aa, Plasmodium falciparum
HGDLNNILEFIPFSESTDLNRFIGI

SEQ ID NO: 3383594 - protein, 29 aa, Plasmodium falciparum
HGESELQPKNLPLHLLKKKNNLKNKNQTK

SEQ ID NO: 3383595 - protein, 32 aa, Plasmodium falciparum
HGGPNVSKWISYNFRRIFIRCLKEANEEMIKK

SEQ ID NO: 3383596 - protein, 25 aa, Plasmodium falciparum
HGHLSGVYCLSLHPSLDLLMSGGRD

SEQ ID NO: 3383597 - protein, 24 aa, Plasmodium falciparum
HGKIKILILDAPTNDLLPLYIKEM

SEQ ID NO: 3383598 - protein, 22 aa, Plasmodium falciparum
HGKIPTLKISLIQIFRAHLWQK

SEQ ID NO: 3383599 - protein, 19 aa, Plasmodium falciparum
HGKNYICIGYIIGNTNKLV

SEQ ID NO: 3383600 - protein, 17 aa, Plasmodium falciparum
HGLFLDIQEKDELIPHV

SEQ ID NO: 3383601 - protein, 17 aa, Plasmodium falciparum
HGLILPHIMDVAEIDLV

SEQ ID NO: 3383602 - protein, 34 aa, Plasmodium falciparum
HGMTLAHTLGLFKKKVPYFEWSENLTYLKPENTA

SEQ ID NO: 3383603 - protein, 19 aa, Plasmodium falciparum
HGQFFDLLELFHIGGLPPD

SEQ ID NO: 3383604 - protein, 23 aa, Plasmodium falciparum
HGQNWLYPFVQEEFKKIFYKHVT

SEQ ID NO: 3383605 - protein, 35 aa, Plasmodium falciparum
HGQSDVRPMPKFYKTRMCYTFLSGSYCEASKCTFA

SEQ ID NO: 3383606 - protein, 19 aa, Plasmodium falciparum
HGVFTYCLIEAIIEFKEKE

SEQ ID NO: 3383607 - protein, 17 aa, Plasmodium falciparum
HHDIVGTLSYAAPEVLN

SEQ ID NO: 3383608 - protein, 26 aa, Plasmodium falciparum
HHGLRNFDMIFVFKDYTKPVKRIDVI

SEQ ID NO: 3383609 - protein, 29 aa, Plasmodium falciparum
HHHHHHLLKYIPQWLMDKISVHSNLYIFQ

SEQ ID NO: 3383610 - protein, 20 aa, Plasmodium falciparum
HHIFNIVNYYKPEMSFFVYI

SEQ ID NO: 3383611 - protein, 37 aa, Plasmodium falciparum
HHIKKYELRRQKKITYILPSLNKKLRRDSCRLIFDPF

SEQ ID NO: 3383612 - protein, 27 aa, Plasmodium falciparum
HHNINNIPNYFIPLNNNDEKKKFLDIE

SEQ ID NO: 3383613 - protein, 23 aa, Plasmodium falciparum
HHPDHVLISAKKWKKLVKNNMEK

SEQ ID NO: 3383614 - protein, 23 aa, Plasmodium falciparum
HHPKNMFICTLPNGPTAKYSLSN

SEQ ID NO: 3383615 - protein, 25 aa, Plasmodium falciparum
HICDPFYKIFLQFENQWKLYPIYEQ

SEQ ID NO: 3383616 - protein, 27 aa, Plasmodium falciparum
HICKDEKMLFPYFIEATYDKNTDIFNE

SEQ ID NO: 3383617 - protein, 34 aa, Plasmodium falciparum
HICKRRKVFEFQVLSTIINFLKINKNIQVDNNIA

SEQ ID NO: 3383618 - protein, 25 aa, Plasmodium falciparum
HICKSYICFYYDLDYFFLCIYNSLC

SEQ ID NO: 3383619 - protein, 30 aa, Plasmodium falciparum
HICNNQIKLIKEYISYIKKNIYDLSSISEN

SEQ ID NO: 3383620 - protein, 32 aa, Plasmodium falciparum
HIDERNLLILWNDFKDFMLNFIYTIDESSDPL

SEQ ID NO: 3383621 - protein, 18 aa, Plasmodium falciparum
HIDKNPFKRFFKIGLNVT

SEQ ID NO: 3383622 - protein, 18 aa, Plasmodium falciparum
HIEALLRKYITEYVTCQM

SEQ ID NO: 3383623 - protein, 25 aa, Plasmodium falciparum
HIEDELPRIFYFLRKHIKKVDSKIK

SEQ ID NO: 3383624 - protein, 28 aa, Plasmodium falciparum
HIEDQPIKLFVIPGIREDTKFQPKTRKE

SEQ ID NO: 3383625 - protein, 32 aa, Plasmodium falciparum
HIEDVLTFFEVSFCSDLFLILCHMCKSINEVN

SEQ ID NO: 3383626 - protein, 26 aa, Plasmodium falciparum
HIEKCLLSYIIQFTIVCKYLECGKWF

SEQ ID NO: 3383627 - protein, 24 aa, Plasmodium falciparum
HIEKKKIEIYLKLHDEYVKRYAQE

SEQ ID NO: 3383628 - protein, 26 aa, Plasmodium falciparum
HIESRHANLLYEFERGITKNKKKDEL

SEQ ID NO: 3383629 - protein, 28 aa, Plasmodium falciparum
HIFEEYYDYIVYDNIRLNKPFIEKPINA

SEQ ID NO: 3383630 - protein, 20 aa, Plasmodium falciparum
HIFHLMCLYETVIRRECRKT

SEQ ID NO: 3383631 - protein, 17 aa, Plasmodium falciparum
HIFYGYLSPYNFILSNY

SEQ ID NO: 3383632 - protein, 31 aa, Plasmodium falciparum
HIGHIEFVLPLFNPLFYKELQELLNLICYHC

SEQ ID NO: 3383633 - protein, 33 aa, Plasmodium falciparum
HIHCHRHIFIVKLEFFFVFGSATNLLVGMELCD

SEQ ID NO: 3383634 - protein, 17 aa, Plasmodium falciparum
HIHDLAIKFPGLNIVLE

SEQ ID NO: 3383635 - protein, 19 aa, Plasmodium falciparum
HIIIPKELEIKLPSPGLKL

SEQ ID NO: 3383636 - protein, 21 aa, Plasmodium falciparum
HIIIYPYQHKFIDICFHSTQI

SEQ ID NO: 3383637 - protein, 19 aa, Plasmodium falciparum
HIIKLISNIPIRCYNFHTY

SEQ ID NO: 3383638 - protein, 21 aa, Plasmodium falciparum
HIINFHFPLDVITYIHRLGKI

SEQ ID NO: 3383639 - protein, 22 aa, Plasmodium falciparum
HIINNKLFLNKLNLFFNLSVKY

SEQ ID NO: 3383640 - protein, 22 aa, Plasmodium falciparum
HIISNLLHSYIVLGFDKIHFKS

SEQ ID NO: 3383641 - protein, 25 aa, Plasmodium falciparum
HIITYIYFNNIHFNCSIKNFVEFLE

SEQ ID NO: 3383642 - protein, 18 aa, Plasmodium falciparum
HIIVTFNNIIYDSLQVLK

SEQ ID NO: 3383643 - protein, 25 aa, Plasmodium falciparum
HIKDDYFYYIAFQKIKQIIDVMDMM

SEQ ID NO: 3383644 - protein, 21 aa, Plasmodium falciparum
HIKDTEFIQEQLKLLHEQLKN

SEQ ID NO: 3383645 - protein, 17 aa, Plasmodium falciparum
HIKEFIQTFCFAKNVEI

SEQ ID NO: 3383646 - protein, 36 aa, Plasmodium falciparum
HIKENLTISNFFKYYNINLYTFFVNFLNNVENYIEE

SEQ ID NO: 3383647 - protein, 26 aa, Plasmodium falciparum
HIKGSPFRIIFKNDNNMYYINKLKNI

SEQ ID NO: 3383648 - protein, 31 aa, Plasmodium falciparum
HIKKIIQTSTKSPILFIKKENFKLNQKQKQE

SEQ ID NO: 3383649 - protein, 17 aa, Plasmodium falciparum
HIKLKKCRALLNALNRT

SEQ ID NO: 3383650 - protein, 30 aa, Plasmodium falciparum
HIKLNNIYNLYCYLIKNTFFKISDKNVNIT

SEQ ID NO: 3383651 - protein, 20 aa, Plasmodium falciparum
HILCQFYVFDGKLSCIMYQR

SEQ ID NO: 3383652 - protein, 26 aa, Plasmodium falciparum
HILDGLALLQFFHWCEQKRKTKELFN

SEQ ID NO: 3383653 - protein, 33 aa, Plasmodium falciparum
HILILFQARPMLEFYKPIKKKKPKEYSGLSDFL

SEQ ID NO: 3383654 - protein, 18 aa, Plasmodium falciparum
HILKNWNRNYTIETILIS

SEQ ID NO: 3383655 - protein, 17 aa, Plasmodium falciparum
HILLIRQNIKKYQDKVI

SEQ ID NO: 3383656 - protein, 21 aa, Plasmodium falciparum
HILLKYSIRSFFKNYSFYKYI

SEQ ID NO: 3383657 - protein, 32 aa, Plasmodium falciparum
HILQEQIMLRYIEFCLYLEKLSLVKDGLHQYR

SEQ ID NO: 3383658 - protein, 28 aa, Plasmodium falciparum
HINENNFIIVYDLPILSYDLLTKELKET

SEQ ID NO: 3383659 - protein, 26 aa, Plasmodium falciparum
HINGNILKLYLYGINYFVSASSSKED

SEQ ID NO: 3383660 - protein, 20 aa, Plasmodium falciparum
HINIFKDFLVNNINLINCSN

SEQ ID NO: 3383661 - protein, 17 aa, Plasmodium falciparum
HINIIDIFYLSYKIDDY

SEQ ID NO: 3383662 - protein, 24 aa, Plasmodium falciparum
HINIMKLYEFFEDNNYYYLVSDVY

SEQ ID NO: 3383663 - protein, 23 aa, Plasmodium falciparum
HINLKYKNLFYNNSQPCVKNDFT

SEQ ID NO: 3383664 - protein, 27 aa, Plasmodium falciparum
HINNKPKMYSLWWDVMKNEKKKYNLTT

SEQ ID NO: 3383665 - protein, 23 aa, Plasmodium falciparum
HINTIINLYRPLSKRGVMYFFIL

SEQ ID NO: 3383666 - protein, 25 aa, Plasmodium falciparum
HINVFYKFLKDCNCLLFKLNNNFRS

SEQ ID NO: 3383667 - protein, 18 aa, Plasmodium falciparum
HIQIINFFNYSHFDCFVE

SEQ ID NO: 3383668 - protein, 20 aa, Plasmodium falciparum
HIQKLQYLIKNLPYTHIKEK

SEQ ID NO: 3383669 - protein, 20 aa, Plasmodium falciparum
HIRIGYKLYKIPFKSFDDNL

SEQ ID NO: 3383670 - protein, 17 aa, Plasmodium falciparum
HIRSISQSTYSYDKRER

SEQ ID NO: 3383671 - protein, 34 aa, Plasmodium falciparum
HISPDDFLKYRMSLEKFIQFTIKEHIVYIMKDEK

SEQ ID NO: 3383672 - protein, 32 aa, Plasmodium falciparum
HISSEDILSIKYFPLNIFKVKKISTCTSTLPG

SEQ ID NO: 3383673 - protein, 17 aa, Plasmodium falciparum
HISSNNPYFFNLPSTNM

SEQ ID NO: 3383674 - protein, 36 aa, Plasmodium falciparum
HISTSYLFNNLKSLGTFRKGGLTWAIYYNNNNKGVN

SEQ ID NO: 3383675 - protein, 17 aa, Plasmodium falciparum
HITILYEDVLSLPSCHY

SEQ ID NO: 3383676 - protein, 38 aa, Plasmodium falciparum
HIYELLINIYNKIIKIIKFNLIYIYKHPLTQNKVKPFL

SEQ ID NO: 3383677 - protein, 32 aa, Plasmodium falciparum
HIYKIKDSFYNLTNPSIAWSFNKIINRTTSQL

SEQ ID NO: 3383678 - protein, 26 aa, Plasmodium falciparum
HIYNKNLFFIFYKNIYELIKYFKEFL

SEQ ID NO: 3383679 - protein, 26 aa, Plasmodium falciparum
HIYYNTNSIFHVSLRQKYRLNNVNCT

SEQ ID NO: 3383680 - protein, 17 aa, Plasmodium falciparum
HKDPIKFSSLIKNKQNN

SEQ ID NO: 3383681 - protein, 23 aa, Plasmodium falciparum
HKEELHEQILFINSKKYNDEIIH

SEQ ID NO: 3383682 - protein, 31 aa, Plasmodium falciparum
HKEMIVAASFIIPYPPGFPVLVPGQIISEEI

SEQ ID NO: 3383683 - protein, 25 aa, Plasmodium falciparum
HKEQNHIFFFSFNISELIINDQVKT

SEQ ID NO: 3383684 - protein, 19 aa, Plasmodium falciparum
HKFLLLHHALMYDDIYEGE

SEQ ID NO: 3383685 - protein, 26 aa, Plasmodium falciparum
HKGIKRFFCSKCNISFGYRSSFRRHN

SEQ ID NO: 3383686 - protein, 18 aa, Plasmodium falciparum
HKGIVKYLIFKQIEQSLK

SEQ ID NO: 3383687 - protein, 19 aa, Plasmodium falciparum
HKHSSIIINDINHKFQKDQ

SEQ ID NO: 3383688 - protein, 26 aa, Plasmodium falciparum
HKIFKERFFGIFIDNGLLRKNEAENV

SEQ ID NO: 3383689 - protein, 26 aa, Plasmodium falciparum
HKIPSDYFYFACTTLRRLGWIFGEIE

SEQ ID NO: 3383690 - protein, 32 aa, Plasmodium falciparum
HKKIKKPKWHFPYKLYRVILGHSGWVNCVDVD

SEQ ID NO: 3383691 - protein, 24 aa, Plasmodium falciparum
HKLLSDTLRFLGFTIKWGIHENGY

SEQ ID NO: 3383692 - protein, 23 aa, Plasmodium falciparum
HKNIISIYDIFCNNNYICIIMDY

SEQ ID NO: 3383693 - protein, 17 aa, Plasmodium falciparum
HKNKNIIIGKRNIIFPS

SEQ ID NO: 3383694 - protein, 18 aa, Plasmodium falciparum
HKNNLVVYIDKGEKINII

SEQ ID NO: 3383695 - protein, 23 aa, Plasmodium falciparum
HKNSLYMEIKTKDNFKKSNYIAE

SEQ ID NO: 3383696 - protein, 22 aa, Plasmodium falciparum
HKNYGIVIIPDGILKKITQFKK

SEQ ID NO: 3383697 - protein, 19 aa, Plasmodium falciparum
HKPMFNKINKETNFNFVIK

SEQ ID NO: 3383698 - protein, 24 aa, Plasmodium falciparum
HKPSESFFHLFSNPQYDDIVFSTT

SEQ ID NO: 3383699 - protein, 21 aa, Plasmodium falciparum
HKPSNKHEFILRKGKYNSDEE

SEQ ID NO: 3383700 - protein, 24 aa, Plasmodium falciparum
HKRHSSFNILKSKEKFFKNSIEDK

SEQ ID NO: 3383701 - protein, 18 aa, Plasmodium falciparum
HKTCYPFFEGDNIVLLDI

SEQ ID NO: 3383702 - protein, 18 aa, Plasmodium falciparum
HKVVNSNNFLPINTFHYN

SEQ ID NO: 3383703 - protein, 26 aa, Plasmodium falciparum
HKYLSLLIWCLFKYNILHNYINKLIP

SEQ ID NO: 3383704 - protein, 19 aa, Plasmodium falciparum
HLDFKEWFSDPLNLAIEKS

SEQ ID NO: 3383705 - protein, 17 aa, Plasmodium falciparum
HLDPAIMNSTRKLRRLY

SEQ ID NO: 3383706 - protein, 24 aa, Plasmodium falciparum
HLEDARVLLNKWGYRRCEDICWLK

SEQ ID NO: 3383707 - protein, 24 aa, Plasmodium falciparum
HLEKAYVELLFREYMKINNKDLSK

SEQ ID NO: 3383708 - protein, 21 aa, Plasmodium falciparum
HLENGLFYKNVEFYQKHNLKN

SEQ ID NO: 3383709 - protein, 37 aa, Plasmodium falciparum
HLETDYKYIYKDLLKLKSLLLKKRYYKNILFEYQKNF

SEQ ID NO: 3383710 - protein, 20 aa, Plasmodium falciparum
HLETPPIHKSPITRKSKNNI

SEQ ID NO: 3383711 - protein, 19 aa, Plasmodium falciparum
HLFILKKRQTINKESSLRV

SEQ ID NO: 3383712 - protein, 20 aa, Plasmodium falciparum
HLFRIMWSEFEWENKINIHT

SEQ ID NO: 3383713 - protein, 19 aa, Plasmodium falciparum
HLHKYNVYQYYVDVDFVHY

SEQ ID NO: 3383714 - protein, 20 aa, Plasmodium falciparum
HLHNSVLYTYPSLNKYIYNN

SEQ ID NO: 3383715 - protein, 17 aa, Plasmodium falciparum
HLIFRPLADNNFFNIFV

SEQ ID NO: 3383716 - protein, 34 aa, Plasmodium falciparum
HLINDQMKIRTKPYPLMEYLFKENDDKYNEMDNH

SEQ ID NO: 3383717 - protein, 23 aa, Plasmodium falciparum
HLKERLMKRKSFYSKLFNIDDNE

SEQ ID NO: 3383718 - protein, 24 aa, Plasmodium falciparum
HLKKKKQFFIYPNKGIIKKNSFLD

SEQ ID NO: 3383719 - protein, 25 aa, Plasmodium falciparum
HLKKNKNILKNEKGFYLKKRKTSTE

SEQ ID NO: 3383720 - protein, 49 aa, Plasmodium falciparum
HLKTDNISIVIQFIKFMSFIVYEQFPLFTSFYYTITSLISLDNIKFDEY

SEQ ID NO: 3383721 - protein, 19 aa, Plasmodium falciparum
HLKTLLLDPQWKEQKDKLY

SEQ ID NO: 3383722 - protein, 21 aa, Plasmodium falciparum
HLLQKAYSPFYYPIHYYIKEK

SEQ ID NO: 3383723 - protein, 18 aa, Plasmodium falciparum
HLLYACELLKLSNQQNLN

SEQ ID NO: 3383724 - protein, 21 aa, Plasmodium falciparum
HLNIIDFQKYYQTDDLLLDTS

SEQ ID NO: 3383725 - protein, 26 aa, Plasmodium falciparum
HLNNHSIYNFVYPENKNIYDANGNLI

SEQ ID NO: 3383726 - protein, 25 aa, Plasmodium falciparum
HLNNIYLEFSLLNNFLKELKENIKK

SEQ ID NO: 3383727 - protein, 25 aa, Plasmodium falciparum
HLNNLNFIYFTTYYNFMNLNVSKDV

SEQ ID NO: 3383728 - protein, 20 aa, Plasmodium falciparum
HLNQLEKSILTFTHFCTNIS

SEQ ID NO: 3383729 - protein, 18 aa, Plasmodium falciparum
HLPFSIKLKNNFLHILNV

SEQ ID NO: 3383730 - protein, 19 aa, Plasmodium falciparum
HLPISISDSLPPLKPTHIL

SEQ ID NO: 3383731 - protein, 20 aa, Plasmodium falciparum
HLRKKLPFFKKFLNKRKIVN

SEQ ID NO: 3383732 - protein, 19 aa, Plasmodium falciparum
HLRSLLGNVGFIKDICYFN

SEQ ID NO: 3383733 - protein, 42 aa, Plasmodium falciparum
HLSEETSLIETIFDTLLYSGVISKNSFIQWFQDDDSNAELKS

SEQ ID NO: 3383734 - protein, 26 aa, Plasmodium falciparum
HLSNNMYCRLNSNPPYKSISLINNNV

SEQ ID NO: 3383735 - protein, 29 aa, Plasmodium falciparum
HLSQYKLLGILYNYYFFNIKVNKKKREFL

SEQ ID NO: 3383736 - protein, 37 aa, Plasmodium falciparum
HLSTLPYVYCCDIQLIKYFEFLKLKETCYKIIKNNKI

SEQ ID NO: 3383737 - protein, 18 aa, Plasmodium falciparum
HLTEFYGTAFLYASKNNL

SEQ ID NO: 3383738 - protein, 33 aa, Plasmodium falciparum
HLTSEWVSKLTPWSLALLKTFPQFIIKELLQVD

SEQ ID NO: 3383739 - protein, 28 aa, Plasmodium falciparum
HLVSKNPYLRLLVKLYNFLARRTNANFN

SEQ ID NO: 3383740 - protein, 17 aa, Plasmodium falciparum
HLWVFVNCLIVNPTFDS

SEQ ID NO: 3383741 - protein, 21 aa, Plasmodium falciparum
HLYFQIQEAYWWYDDMWQDKY

SEQ ID NO: 3383742 - protein, 23 aa, Plasmodium falciparum
HMARKKYYESIPKTFKGFLCMRR

SEQ ID NO: 3383743 - protein, 18 aa, Plasmodium falciparum
HMDDLFLYVVYDYKNLIH

SEQ ID NO: 3383744 - protein, 25 aa, Plasmodium falciparum
HMDPSYFIYISFKKEEKYFLNIKTK

SEQ ID NO: 3383745 - protein, 21 aa, Plasmodium falciparum
HMHIIEMLTGLKYIKSPFNIN

SEQ ID NO: 3383746 - protein, 26 aa, Plasmodium falciparum
HMIDIKIGNYFYAVSLTIIEDYDIDF

SEQ ID NO: 3383747 - protein, 29 aa, Plasmodium falciparum
HMKDIINLTLFYYYNYLEGGILKCSQNLK

SEQ ID NO: 3383748 - protein, 27 aa, Plasmodium falciparum
HMKETNVIKFIFFKNEKVIGCSYISIT

SEQ ID NO: 3383749 - protein, 23 aa, Plasmodium falciparum
HMKGYDYVYRKFSYKDLELILFS

SEQ ID NO: 3383750 - protein, 17 aa, Plasmodium falciparum
HMKSYYYDKMSESYRNN

SEQ ID NO: 3383751 - protein, 23 aa, Plasmodium falciparum
HMKTALVKLFTPKTSNLIDTQID

SEQ ID NO: 3383752 - protein, 23 aa, Plasmodium falciparum
HMKYVLSLCKIIPQYPIKYSRRC

SEQ ID NO: 3383753 - protein, 20 aa, Plasmodium falciparum
HMLALLEYYEYLKSSPFVGP

SEQ ID NO: 3383754 - protein, 33 aa, Plasmodium falciparum
HMNHTLFLLCEIHQEIIKHIKLYCHIKKEHPVI

SEQ ID NO: 3383755 - protein, 18 aa, Plasmodium falciparum
HMTKLNPKYAPLYELIGV

SEQ ID NO: 3383756 - protein, 46 aa, Plasmodium falciparum
HNAVLEGLMDLFGLKSNRLSRKIIVNELIIIQDYLRQKHDQFINSD

SEQ ID NO: 3383757 - protein, 30 aa, Plasmodium falciparum
HNCNYAHVLGELRPLPNLMNTKLCKSYKKN

SEQ ID NO: 3383758 - protein, 26 aa, Plasmodium falciparum
HNDDNYNIVLILSDNFDYIHCFVKDD

SEQ ID NO: 3383759 - protein, 17 aa, Plasmodium falciparum
HNDIIFLNIYSLTHKRI

SEQ ID NO: 3383760 - protein, 18 aa, Plasmodium falciparum
HNDILTTSYLKYYSHTNN

SEQ ID NO: 3383761 - protein, 24 aa, Plasmodium falciparum
HNDLPPLSNIYKLLKDEIPNKQWL

SEQ ID NO: 3383762 - protein, 22 aa, Plasmodium falciparum
HNDTIILIPLIAYNKLGYRIGS

SEQ ID NO: 3383763 - protein, 20 aa, Plasmodium falciparum
HNEHLINNKIKIIKNNKKFL

SEQ ID NO: 3383764 - protein, 23 aa, Plasmodium falciparum
HNENFILWAWKRRALKYDKEQFN

SEQ ID NO: 3383765 - protein, 24 aa, Plasmodium falciparum
HNENPYYKKDFSHRVPQSGAIRRE

SEQ ID NO: 3383766 - protein, 24 aa, Plasmodium falciparum
HNENYFKEWYKNISDQVRKLLIES

SEQ ID NO: 3383767 - protein, 17 aa, Plasmodium falciparum
HNFKHIYIIGRRGFWQS

SEQ ID NO: 3383768 - protein, 25 aa, Plasmodium falciparum
HNFTKNVVTLWYRAPELLLGEQCYT

SEQ ID NO: 3383769 - protein, 17 aa, Plasmodium falciparum
HNFYIYIKELGNTKIYM

SEQ ID NO: 3383770 - protein, 23 aa, Plasmodium falciparum
HNHNNMLISSSLTSPLSGNTKNI

SEQ ID NO: 3383771 - protein, 20 aa, Plasmodium falciparum
HNHYHLIPYILKIKENVDYM

SEQ ID NO: 3383772 - protein, 22 aa, Plasmodium falciparum
HNIFVEEKCLMVPPSCAPMILT

SEQ ID NO: 3383773 - protein, 26 aa, Plasmodium falciparum
HNIIKYFCEFLYKDNFPTLRSLCMIG

SEQ ID NO: 3383774 - protein, 20 aa, Plasmodium falciparum
HNIKVLFKKIASKLPNLDNT

SEQ ID NO: 3383775 - protein, 28 aa, Plasmodium falciparum
HNINKHNLFVPIYIKLLNNKIDIKNKLS

SEQ ID NO: 3383776 - protein, 25 aa, Plasmodium falciparum
HNIVKQAMVFLLPKIFNAMITQESE

SEQ ID NO: 3383777 - protein, 24 aa, Plasmodium falciparum
HNKENDLCRIFCIIFKRDNAFEDY

SEQ ID NO: 3383778 - protein, 26 aa, Plasmodium falciparum
HNKISPGDILIFNFLSNMNLEKKKNF

SEQ ID NO: 3383779 - protein, 21 aa, Plasmodium falciparum
HNKKALLLNKIISCIDNFLSR

SEQ ID NO: 3383780 - protein, 30 aa, Plasmodium falciparum
HNKKYLLNTLMKYNKIDLINIFVDICNHLK

SEQ ID NO: 3383781 - protein, 24 aa, Plasmodium falciparum
HNKNLAMQLLKDKLYNFYYELEKN

SEQ ID NO: 3383782 - protein, 34 aa, Plasmodium falciparum
HNKVMGMIKKLETLYYIINLIKSFNTYHLSDEGK

SEQ ID NO: 3383783 - protein, 25 aa, Plasmodium falciparum
HNLISYLFNFIDCKTLLKLKGCSKI

SEQ ID NO: 3383784 - protein, 22 aa, Plasmodium falciparum
HNLNFYNLYYDTLKNDLFNEHK

SEQ ID NO: 3383785 - protein, 17 aa, Plasmodium falciparum
HNLWYEHKLIDDMVAQV

SEQ ID NO: 3383786 - protein, 17 aa, Plasmodium falciparum
HNMDWFFKNENLCNMNN

SEQ ID NO: 3383787 - protein, 26 aa, Plasmodium falciparum
HNMLKKMTLLALMDLAFKKKKQREDI

SEQ ID NO: 3383788 - protein, 20 aa, Plasmodium falciparum
HNMLPYIKYIDDWIKEWNIS

SEQ ID NO: 3383789 - protein, 27 aa, Plasmodium falciparum
HNNDIPLNYIYTWNQPNVLAIYMSSYM

SEQ ID NO: 3383790 - protein, 21 aa, Plasmodium falciparum
HNNEYICPITRKYFNKHTKII

SEQ ID NO: 3383791 - protein, 18 aa, Plasmodium falciparum
HNNIKYAWRIIYDLLKGS

SEQ ID NO: 3383792 - protein, 19 aa, Plasmodium falciparum
HNNKYFLWNMDADFFTIKN

SEQ ID NO: 3383793 - protein, 33 aa, Plasmodium falciparum
HNNLHMQLMSMNPAFYMQSLNRNFNMSANERNN

SEQ ID NO: 3383794 - protein, 22 aa, Plasmodium falciparum
HNNNFHVIPCNKFKVLIKLNEI

SEQ ID NO: 3383795 - protein, 35 aa, Plasmodium falciparum
HNNNKRLVLLKEKLKYNHYYYAGKLAEKEWEENYD

SEQ ID NO: 3383796 - protein, 22 aa, Plasmodium falciparum
HNNSITYYKHYNDIRTKVEIKR

SEQ ID NO: 3383797 - protein, 25 aa, Plasmodium falciparum
HNNSYNHIYRQNNIPICNINNHAPN

SEQ ID NO: 3383798 - protein, 17 aa, Plasmodium falciparum
HNNYILHNNFHNPYNIY

SEQ ID NO: 3383799 - protein, 17 aa, Plasmodium falciparum
HNQFKDSYYNLLSNEDV

SEQ ID NO: 3383800 - protein, 26 aa, Plasmodium falciparum
HNQKKHIFVFPCNVQIILGMNGYIWI

SEQ ID NO: 3383801 - protein, 20 aa, Plasmodium falciparum
HNRAYYFFSPDDILDNIIFN

SEQ ID NO: 3383802 - protein, 24 aa, Plasmodium falciparum
HNRRTQLRDNYYYEKVDDIKKEND

SEQ ID NO: 3383803 - protein, 37 aa, Plasmodium falciparum
HNTFYSLNNSCFIKKANVLKSKLPKCKFLSASPKDEK

SEQ ID NO: 3383804 - protein, 19 aa, Plasmodium falciparum
HNYFANNFIKDLFKKSQHI

SEQ ID NO: 3383805 - protein, 29 aa, Plasmodium falciparum
HNYYYVIDDLGIPIKIFLETLSKSKNAKS

SEQ ID NO: 3383806 - protein, 17 aa, Plasmodium falciparum
HPDHTHSSKLSKNPLFI

SEQ ID NO: 3383807 - protein, 22 aa, Plasmodium falciparum
HPECIQIYLLDCIDILTLNLLE

SEQ ID NO: 3383808 - protein, 36 aa, Plasmodium falciparum
HPETKQHFLNAHIPLFLYPFLNAESKNRPFEYLRLT

SEQ ID NO: 3383809 - protein, 28 aa, Plasmodium falciparum
HPGARACHLSFFYKDKLFIHGGTNLKAE

SEQ ID NO: 3383810 - protein, 17 aa, Plasmodium falciparum
HPIIFITCGSYNSAVID

SEQ ID NO: 3383811 - protein, 25 aa, Plasmodium falciparum
HPLVPLDYQYCGQPILIGGTMGTYS

SEQ ID NO: 3383812 - protein, 20 aa, Plasmodium falciparum
HPMIQFHALTLLCSIKNQDK

SEQ ID NO: 3383813 - protein, 24 aa, Plasmodium falciparum
HPNKKINLKFLLNDNQFKVKNEEE

SEQ ID NO: 3383814 - protein, 19 aa, Plasmodium falciparum
HPNYTFYFGLGSDLICDIF

SEQ ID NO: 3383815 - protein, 29 aa, Plasmodium falciparum
HPVENCRNWPYCAFGSECIYIHPNVPCKF

SEQ ID NO: 3383816 - protein, 20 aa, Plasmodium falciparum
HPYRLNIHNNKYSRAGYVPP

SEQ ID NO: 3383817 - protein, 25 aa, Plasmodium falciparum
HQAIKILLLLLEKHVEYIKKDNRTE

SEQ ID NO: 3383818 - protein, 26 aa, Plasmodium falciparum
HQGNNKALPPLPFKTNNKYNGSQNNS

SEQ ID NO: 3383819 - protein, 23 aa, Plasmodium falciparum
HQIRDFLRVIAKGKLAYEFKYFQ

SEQ ID NO: 3383820 - protein, 41 aa, Plasmodium falciparum
HQKKNYNFVFIRYVEYKIILCKLLYININNLTIQNFIEFKN

SEQ ID NO: 3383821 - protein, 30 aa, Plasmodium falciparum
HQLINFSSYYIKFIKPLFNKNKYYNKSLYK

SEQ ID NO: 3383822 - protein, 29 aa, Plasmodium falciparum
HQNACKFIESVFLSVYYPNGRKIERRPLV

SEQ ID NO: 3383823 - protein, 20 aa, Plasmodium falciparum
HQNHYPYQYQDQGVSKEINN

SEQ ID NO: 3383824 - protein, 22 aa, Plasmodium falciparum
HQNKYLIRLYGPKTSEIINRER

SEQ ID NO: 3383825 - protein, 19 aa, Plasmodium falciparum
HQRQGGKGWGLELGREEDS

SEQ ID NO: 3383826 - protein, 18 aa, Plasmodium falciparum
HRDIKPENILLTDKSRDA

SEQ ID NO: 3383827 - protein, 18 aa, Plasmodium falciparum
HRDIKPSNIFLQITDNIL

SEQ ID NO: 3383828 - protein, 18 aa, Plasmodium falciparum
HRDLKPTNILRYDNKRIV

SEQ ID NO: 3383829 - protein, 25 aa, Plasmodium falciparum
HRGTQFIITTFRKELLEYSDNMYIV

SEQ ID NO: 3383830 - protein, 22 aa, Plasmodium falciparum
HRIRRFRCAFGLLQAKLAAEQF

SEQ ID NO: 3383831 - protein, 25 aa, Plasmodium falciparum
HRNEILKLYKFIKKKINNKLNDKKY

SEQ ID NO: 3383832 - protein, 27 aa, Plasmodium falciparum
HRNEQLLNTTFLLQKSTLENNSLEKKI

SEQ ID NO: 3383833 - protein, 19 aa, Plasmodium falciparum
HRNIKPFVRPPICSVSTAT

SEQ ID NO: 3383834 - protein, 22 aa, Plasmodium falciparum
HRNYLALKNIPYIEKQIMNCRD

SEQ ID NO: 3383835 - protein, 23 aa, Plasmodium falciparum
HRYEINPKYVPLLEAVGLTFVAK

SEQ ID NO: 3383836 - protein, 25 aa, Plasmodium falciparum
HRYLKNQIYTTAVPLIVAINPYKDL

SEQ ID NO: 3383837 - protein, 22 aa, Plasmodium falciparum
HSADIFIFLLSSKSGGCGINLI

SEQ ID NO: 3383838 - protein, 37 aa, Plasmodium falciparum
HSAEWIRRCPYYISLPSYLRYIPVACPYFIKNKNETE

SEQ ID NO: 3383839 - protein, 21 aa, Plasmodium falciparum
HSAHNFYFNGVKYSDWKFTCI

SEQ ID NO: 3383840 - protein, 18 aa, Plasmodium falciparum
HSARLRHNLAEKLRVNPG

SEQ ID NO: 3383841 - protein, 23 aa, Plasmodium falciparum
HSDLKNMFPLNHQNSKLLTHSNN

SEQ ID NO: 3383842 - protein, 25 aa, Plasmodium falciparum
HSEDETYIYIKKENIPFKKEKEKKD

SEQ ID NO: 3383843 - protein, 29 aa, Plasmodium falciparum
HSFFSQLESLWNFVRIISGLPIDAHIDLP

SEQ ID NO: 3383844 - protein, 22 aa, Plasmodium falciparum
HSFLLPYIHSLFNNLNTIHKDL

SEQ ID NO: 3383845 - protein, 20 aa, Plasmodium falciparum
HSIYLDIFILCNLKNVIKVL

SEQ ID NO: 3383846 - protein, 30 aa, Plasmodium falciparum
HSIYNQKFYILLKENIFLFLFDFIKKNNDI

SEQ ID NO: 3383847 - protein, 24 aa, Plasmodium falciparum
HSKKNLYYIIDAITIFTNDLKILK

SEQ ID NO: 3383848 - protein, 19 aa, Plasmodium falciparum
HSLCIDYMCNCFEDIYVQK

SEQ ID NO: 3383849 - protein, 31 aa, Plasmodium falciparum
HSLFNGYSLNKIILNIALYHLICNSVNEQTS

SEQ ID NO: 3383850 - protein, 17 aa, Plasmodium falciparum
HSLIFPDMRIKGNINIV

SEQ ID NO: 3383851 - protein, 17 aa, Plasmodium falciparum
HSLLRVLAKQKVINNLN

SEQ ID NO: 3383852 - protein, 34 aa, Plasmodium falciparum
HSLNIQQIQIKLYWIYYKIQMFEQSNLLSCDNKD

SEQ ID NO: 3383853 - protein, 23 aa, Plasmodium falciparum
HSLVSFLCILFVVEKLNDYVKVN

SEQ ID NO: 3383854 - protein, 19 aa, Plasmodium falciparum
HSLYFCEFYDYLIEYINNM

SEQ ID NO: 3383855 - protein, 27 aa, Plasmodium falciparum
HSMDRVVGNMRLLLTGTPLQNNSAELF

SEQ ID NO: 3383856 - protein, 20 aa, Plasmodium falciparum
HSNFFNTALFQFNHSNTFGN

SEQ ID NO: 3383857 - protein, 25 aa, Plasmodium falciparum
HSNHFSHIPPPPPPTSLYNNNNDNN

SEQ ID NO: 3383858 - protein, 22 aa, Plasmodium falciparum
HSNIHFDIILFLNNYMKSHSIS

SEQ ID NO: 3383859 - protein, 22 aa, Plasmodium falciparum
HSNIYKHMPTKCHINNISPTNA

SEQ ID NO: 3383860 - protein, 37 aa, Plasmodium falciparum
HSNLLSEDRLPISQPVLLGICKILCESLLRSSDLTIE

SEQ ID NO: 3383861 - protein, 28 aa, Plasmodium falciparum
HSPAPPPPPPPPPLYDPLISTPQGFNGM

SEQ ID NO: 3383862 - protein, 31 aa, Plasmodium falciparum
HSRRNRIYFYPYTKLLRRKRLRRISHFKEDR

SEQ ID NO: 3383863 - protein, 21 aa, Plasmodium falciparum
HSSFSCIAYWKSKRLSDSIIH

SEQ ID NO: 3383864 - protein, 17 aa, Plasmodium falciparum
HSSILLIDLKKKKKKRI

SEQ ID NO: 3383865 - protein, 30 aa, Plasmodium falciparum
HSTYIDCNGLILLMIWSYKKYICSTGSMND

SEQ ID NO: 3383866 - protein, 23 aa, Plasmodium falciparum
HSVDELRIPRIPDILLEKKDNNQ

SEQ ID NO: 3383867 - protein, 29 aa, Plasmodium falciparum
HSVFTAVCIFLYKKKIPITFIEKTQVYFD

SEQ ID NO: 3383868 - protein, 21 aa, Plasmodium falciparum
HSYLFYIFSFVKNHLQNYPFH

SEQ ID NO: 3383869 - protein, 25 aa, Plasmodium falciparum
HTFLKSHKGIMQYILKNGNTSSNKN

SEQ ID NO: 3383870 - protein, 31 aa, Plasmodium falciparum
HTFVSLNTKRQYLFKCLFDKIANFKNNAILY

SEQ ID NO: 3383871 - protein, 26 aa, Plasmodium falciparum
HTGGFKDFFLKPELLRAISESGFEHP

SEQ ID NO: 3383872 - protein, 26 aa, Plasmodium falciparum
HTGLLILHLNKFFQRVYICKPQSSRN

SEQ ID NO: 3383873 - protein, 28 aa, Plasmodium falciparum
HTGPYIFRTMKLGRIIHILQKCIDLNIL

SEQ ID NO: 3383874 - protein, 23 aa, Plasmodium falciparum
HTIQQAFQIYQAKNYFILFDVVG

SEQ ID NO: 3383875 - protein, 19 aa, Plasmodium falciparum
HTKFFYAFSNLYPCHICKL

SEQ ID NO: 3383876 - protein, 21 aa, Plasmodium falciparum
HTKMKITYLLDNITTLLCINN

SEQ ID NO: 3383877 - protein, 27 aa, Plasmodium falciparum
HTKNNIETLFINKKYWNYKQSSEKYSS

SEQ ID NO: 3383878 - protein, 21 aa, Plasmodium falciparum
HTKNNIRRGLYLASKILKDIH

SEQ ID NO: 3383879 - protein, 38 aa, Plasmodium falciparum
HTKNNSLTFIPKIFTFSTFFFQSLNFNGSYNYSKVSRW

SEQ ID NO: 3383880 - protein, 17 aa, Plasmodium falciparum
HTLINPHSHPYQLPMNN

SEQ ID NO: 3383881 - protein, 31 aa, Plasmodium falciparum
HTPLDDYIPQKLRWMAEWAEWYCKVQSQEYD

SEQ ID NO: 3383882 - protein, 28 aa, Plasmodium falciparum
HTPNLHSWFPLYIPINKIQFLKKGQNLS

SEQ ID NO: 3383883 - protein, 23 aa, Plasmodium falciparum
HTRECMIHFLKCYLYHIQNDVIK

SEQ ID NO: 3383884 - protein, 20 aa, Plasmodium falciparum
HTSFSFFNEANICKNPYYMS

SEQ ID NO: 3383885 - protein, 25 aa, Plasmodium falciparum
HTVEDLFQFVFSYTPVNFSLSYDYP

SEQ ID NO: 3383886 - protein, 30 aa, Plasmodium falciparum
HVDGDNIILTMIWNINNISLLTGSKNNFVV

SEQ ID NO: 3383887 - protein, 30 aa, Plasmodium falciparum
HVFAYKAVDGPFFMPLFDCPGCTNVHGVRG

SEQ ID NO: 3383888 - protein, 25 aa, Plasmodium falciparum
HVHVNEKLKLLLNNNSKKNKKKREK

SEQ ID NO: 3383889 - protein, 28 aa, Plasmodium falciparum
HVILTYHNLYIYRSFFQEIQLHIKENNF

SEQ ID NO: 3383890 - protein, 19 aa, Plasmodium falciparum
HVIQTIIQIILYNKNYKES

SEQ ID NO: 3383891 - protein, 20 aa, Plasmodium falciparum
HVKHCSDFSLYFLKSNYACA

SEQ ID NO: 3383892 - protein, 24 aa, Plasmodium falciparum
HVKKIIIDTLWSDPINYNDELDLQ

SEQ ID NO: 3383893 - protein, 23 aa, Plasmodium falciparum
HVKTILYNLLLGEKFIHESGIIH

SEQ ID NO: 3383894 - protein, 21 aa, Plasmodium falciparum
HVLFNKINLLNRNKNNAFKKS

SEQ ID NO: 3383895 - protein, 17 aa, Plasmodium falciparum
HVLIGMQYLHDVCKIIH

SEQ ID NO: 3383896 - protein, 35 aa, Plasmodium falciparum
HVLQLLLRLRQCCSHPLLLFSKPFFEEWNKDDMND

SEQ ID NO: 3383897 - protein, 29 aa, Plasmodium falciparum
HVLSLKQDLKTRLFFPQKSFYKMQNKEES

SEQ ID NO: 3383898 - protein, 18 aa, Plasmodium falciparum
HVLYLSEGIVTFFSNIYN

SEQ ID NO: 3383899 - protein, 21 aa, Plasmodium falciparum
HVMEPILTYEKEKMGNILFSN

SEQ ID NO: 3383900 - protein, 20 aa, Plasmodium falciparum
HVMYVWMDALINYYSSCFID

SEQ ID NO: 3383901 - protein, 20 aa, Plasmodium falciparum
HVNFLAYIKKISIRYNPCGT

SEQ ID NO: 3383902 - protein, 32 aa, Plasmodium falciparum
HVQAYKKLDLFRMPIILILHLKRFNNTNRWLR

SEQ ID NO: 3383903 - protein, 23 aa, Plasmodium falciparum
HVQHIYRNIVSPQYRHIPKPVEI

SEQ ID NO: 3383904 - protein, 18 aa, Plasmodium falciparum
HVQLIIGKVFFLLDPFKE

SEQ ID NO: 3383905 - protein, 19 aa, Plasmodium falciparum
HVRSYNIPLLVLGGGGYTI

SEQ ID NO: 3383906 - protein, 28 aa, Plasmodium falciparum
HVSFSFSEFLLFQKAANLLLPQLIGWAK

SEQ ID NO: 3383907 - protein, 22 aa, Plasmodium falciparum
HVSIPVFRHSFLNENISKPDSF

SEQ ID NO: 3383908 - protein, 18 aa, Plasmodium falciparum
HVSIYGGQKKRHVEKRKH

SEQ ID NO: 3383909 - protein, 18 aa, Plasmodium falciparum
HVSKLWKQLTAEEKNKYK

SEQ ID NO: 3383910 - protein, 17 aa, Plasmodium falciparum
HVSLVSLHLLDSGFSHY

SEQ ID NO: 3383911 - protein, 25 aa, Plasmodium falciparum
HVTCLIEILNYFFEKYDDCFSSSVV

SEQ ID NO: 3383912 - protein, 19 aa, Plasmodium falciparum
HVTTPLYKSYKGHDLKIIY

SEQ ID NO: 3383913 - protein, 20 aa, Plasmodium falciparum
HVVLGLFLYDKFVSSTKNKL

SEQ ID NO: 3383914 - protein, 31 aa, Plasmodium falciparum
HVVQKCLITLTSHQCDFIYEAILNNCVEVST

SEQ ID NO: 3383915 - protein, 34 aa, Plasmodium falciparum
HVYYTNRALCYKKQKLWKLANMDARQALNLEEES

SEQ ID NO: 3383916 - protein, 64 aa, Plasmodium falciparum
HWGIDCENKILYSTLKEWVWNETRGEKKFFNFKQLHKYVIQQNSLVRYIWIGDTGDMDRQAGEL

SEQ ID NO: 3383917 - protein, 20 aa, Plasmodium falciparum
HWGRQQLWLFLKGAGMTLDE

SEQ ID NO: 3383918 - protein, 26 aa, Plasmodium falciparum
HWKKLPMFMKFGGSPNLRMNCRYVSS

SEQ ID NO: 3383919 - protein, 27 aa, Plasmodium falciparum
HYDDKAFNMNIYYKKKFTYHNDMNNYD

SEQ ID NO: 3383920 - protein, 17 aa, Plasmodium falciparum
HYDLISSNNWDNHLRDY

SEQ ID NO: 3383921 - protein, 27 aa, Plasmodium falciparum
HYEERHFSCYFLYMVNKSILDELVNIY

SEQ ID NO: 3383922 - protein, 23 aa, Plasmodium falciparum
HYEKKWKRNPCLLLIIATTNNIN

SEQ ID NO: 3383923 - protein, 24 aa, Plasmodium falciparum
HYENKYVSILSYQNYMISIKRKEQ

SEQ ID NO: 3383924 - protein, 19 aa, Plasmodium falciparum
HYIAWKKMKKFFSSNSNID

SEQ ID NO: 3383925 - protein, 17 aa, Plasmodium falciparum
HYINAFICLPLNCKAKN

SEQ ID NO: 3383926 - protein, 28 aa, Plasmodium falciparum
HYKNSLMNLLRFYSINQNKFISLKQYVN

SEQ ID NO: 3383927 - protein, 17 aa, Plasmodium falciparum
HYLSYSSFLIKNHYHHN

SEQ ID NO: 3383928 - protein, 18 aa, Plasmodium falciparum
HYNDFWSFDLKNNVFEEI

SEQ ID NO: 3383929 - protein, 17 aa, Plasmodium falciparum
HYNSLIQSGLLNEPNKE

SEQ ID NO: 3383930 - protein, 17 aa, Plasmodium falciparum
HYNYLCRILQCFQHLTI

SEQ ID NO: 3383931 - protein, 25 aa, Plasmodium falciparum
HYNYRNMNNFGYRTNIPRSRRNNHN

SEQ ID NO: 3383932 - protein, 19 aa, Plasmodium falciparum
HYPIKVVKTKDIGWDIVSC

SEQ ID NO: 3383933 - protein, 17 aa, Plasmodium falciparum
HYPIYKKLFDYFNKVNV

SEQ ID NO: 3383934 - protein, 21 aa, Plasmodium falciparum
HYQTIILMNLLRLLEFEVVNI

SEQ ID NO: 3383935 - protein, 47 aa, Plasmodium falciparum
HYSKENFSLLKDGPPGANLFLYGIPLKWTELNLIQLVNKYGHVVGLR

SEQ ID NO: 3383936 - protein, 18 aa, Plasmodium falciparum
HYSLKVFLNICIKDLRRC

SEQ ID NO: 3383937 - protein, 31 aa, Plasmodium falciparum
HYSMHPENAIFFDYFINLKKKAIAQGYNNLV

SEQ ID NO: 3383938 - protein, 19 aa, Plasmodium falciparum
IAADTQGCLTLWNASSEIY

SEQ ID NO: 3383939 - protein, 17 aa, Plasmodium falciparum
IAALKKINFVLLEENYF

SEQ ID NO: 3383940 - protein, 23 aa, Plasmodium falciparum
IADFHFCLGSSFYIVPASSYPSK

SEQ ID NO: 3383941 - protein, 18 aa, Plasmodium falciparum
IADMLLKAILLTDELQQK

SEQ ID NO: 3383942 - protein, 19 aa, Plasmodium falciparum
IAEHELFYYFFNSTNLNAS

SEQ ID NO: 3383943 - protein, 26 aa, Plasmodium falciparum
IAEKRNRLKLLLPWLESRANEGYENI

SEQ ID NO: 3383944 - protein, 29 aa, Plasmodium falciparum
IAHIEMGIFITKLYNPIVLYVSGSNTQII

SEQ ID NO: 3383945 - protein, 24 aa, Plasmodium falciparum
IAKFRQSFLITCKKKFKEKGSKLN

SEQ ID NO: 3383946 - protein, 21 aa, Plasmodium falciparum
IAKILYSYFNIPVVGVNHCIA

SEQ ID NO: 3383947 - protein, 32 aa, Plasmodium falciparum
IALHVTRKHSLFFLKYFLLIPEEQVNIKVLQI

SEQ ID NO: 3383948 - protein, 21 aa, Plasmodium falciparum
IALQKYLLFFNQTVGDAFLDF

SEQ ID NO: 3383949 - protein, 47 aa, Plasmodium falciparum
IANLGKKYCIKLLDFLLDALFRNKYFMNRFYLWIRNICKQHKDVLKS

SEQ ID NO: 3383950 - protein, 27 aa, Plasmodium falciparum
IANYKDRIFFFKGILNKLLENLSAVKN

SEQ ID NO: 3383951 - protein, 26 aa, Plasmodium falciparum
IAPIPHLFSMKPGCASLPFLGVQLEI

SEQ ID NO: 3383952 - protein, 20 aa, Plasmodium falciparum
IARNVSLSHEFPLIHTNEEL

SEQ ID NO: 3383953 - protein, 25 aa, Plasmodium falciparum
IASHLSLPPVKIHCSLLAEDAIKHA

SEQ ID NO: 3383954 - protein, 37 aa, Plasmodium falciparum
IASLRNIYGKFYSFLPHVLLKKIILENYIYLNYEHVD

SEQ ID NO: 3383955 - protein, 17 aa, Plasmodium falciparum
IASLYIIAAFNADIKIS

SEQ ID NO: 3383956 - protein, 28 aa, Plasmodium falciparum
IATKELKKEFLLMYGRLMFSRKKLQEKE

SEQ ID NO: 3383957 - protein, 36 aa, Plasmodium falciparum
IATYHNGYFSRIRFYTLPLSGIYLEIPCHILNCVNL

SEQ ID NO: 3383958 - protein, 19 aa, Plasmodium falciparum
IAVELINVIKRLGIDSYIF

SEQ ID NO: 3383959 - protein, 25 aa, Plasmodium falciparum
ICDDLLEFFHIYGSTITLDDFLNSL

SEQ ID NO: 3383960 - protein, 26 aa, Plasmodium falciparum
ICEELLGGILYIGIILRRSQKLSSNN

SEQ ID NO: 3383961 - protein, 45 aa, Plasmodium falciparum
ICEETKIAYSIKPWLRGIIWEDKLKKWIVFFKDKNENLRISFFST

SEQ ID NO: 3383962 - protein, 20 aa, Plasmodium falciparum
ICEKTDGVRYFLFIASNTTF

SEQ ID NO: 3383963 - protein, 29 aa, Plasmodium falciparum
ICENDFYIHMWILIKKSLDLKKDVFIEMS

SEQ ID NO: 3383964 - protein, 27 aa, Plasmodium falciparum
ICEYGSVDIILLIYVLSAVQPDKMINV

SEQ ID NO: 3383965 - protein, 17 aa, Plasmodium falciparum
ICFNPNSIYMKCIVKEP

SEQ ID NO: 3383966 - protein, 23 aa, Plasmodium falciparum
ICGPYICCIFILSKKENVNIEYI

SEQ ID NO: 3383967 - protein, 17 aa, Plasmodium falciparum
ICGYSFCWLCLDNWKNH

SEQ ID NO: 3383968 - protein, 22 aa, Plasmodium falciparum
ICHMFEKRLDALRDIEKKHLNL

SEQ ID NO: 3383969 - protein, 18 aa, Plasmodium falciparum
ICIITSLILFRYINAYIS

SEQ ID NO: 3383970 - protein, 18 aa, Plasmodium falciparum
ICILAQIGMFVPCDFCEV

SEQ ID NO: 3383971 - protein, 25 aa, Plasmodium falciparum
ICINELWIILLAFKSAYSYKNVFKK

SEQ ID NO: 3383972 - protein, 17 aa, Plasmodium falciparum
ICKKDLTFLFQLSTSYD

SEQ ID NO: 3383973 - protein, 23 aa, Plasmodium falciparum
ICKKLIKQMYKYEKYLLQFSNYI

SEQ ID NO: 3383974 - protein, 17 aa, Plasmodium falciparum
ICKKNHLFGLNYFVKKI

SEQ ID NO: 3383975 - protein, 17 aa, Plasmodium falciparum
ICKYWEKQSECMSMLID

SEQ ID NO: 3383976 - protein, 30 aa, Plasmodium falciparum
ICLNEFIKNNYFYRLYKLNTSREILFNGME

SEQ ID NO: 3383977 - protein, 17 aa, Plasmodium falciparum
ICLNVKRVYSLYDLYHK

SEQ ID NO: 3383978 - protein, 26 aa, Plasmodium falciparum
ICMNELSFLYPFLDKDDRNIFDYDLF

SEQ ID NO: 3383979 - protein, 45 aa, Plasmodium falciparum
ICNFKIIRCKSSAYINYYYYYYYYYYYYYHYHYGGKYSLEKKEIK

SEQ ID NO: 3383980 - protein, 34 aa, Plasmodium falciparum
ICNILSFLSFSERWKFRLLNKSFYQAFHTKYAWA

SEQ ID NO: 3383981 - protein, 34 aa, Plasmodium falciparum
ICNKNAKLFRLLFQFFFPHISYYFDTNIDETWPT

SEQ ID NO: 3383982 - protein, 25 aa, Plasmodium falciparum
ICNMKSRFLKLEKYVNIKKKKIINI

SEQ ID NO: 3383983 - protein, 32 aa, Plasmodium falciparum
ICNNDYFVYRLYRLPIYYLLTNEHRNQFLLER

SEQ ID NO: 3383984 - protein, 17 aa, Plasmodium falciparum
ICNNFNFSMIKYSNKHN

SEQ ID NO: 3383985 - protein, 24 aa, Plasmodium falciparum
ICNNIFHKRRPSNILNSCIFTELD

SEQ ID NO: 3383986 - protein, 17 aa, Plasmodium falciparum
ICNYWDGFICNNKKNIT

SEQ ID NO: 3383987 - protein, 23 aa, Plasmodium falciparum
ICPKMWKYFHGIINQPQCPLQSF

SEQ ID NO: 3383988 - protein, 17 aa, Plasmodium falciparum
ICQLYQEKKQKKEKKKN

SEQ ID NO: 3383989 - protein, 25 aa, Plasmodium falciparum
ICRNHGYFLIVMDPSGQMPASVHKE

SEQ ID NO: 3383990 - protein, 18 aa, Plasmodium falciparum
ICSNIFKNKLFKKKKYKL

SEQ ID NO: 3383991 - protein, 32 aa, Plasmodium falciparum
ICSSISKYNYMYPQHLNFQRENYILNGYTHNI

SEQ ID NO: 3383992 - protein, 37 aa, Plasmodium falciparum
ICTNCYIHYDNFKSSYILTFINRKQKKQRKIFPVEPN

SEQ ID NO: 3383993 - protein, 25 aa, Plasmodium falciparum
ICTQCGLRDLFLTSMKIYNNNDKKG

SEQ ID NO: 3383994 - protein, 17 aa, Plasmodium falciparum
ICVKKRSSKMRPFNDTK

SEQ ID NO: 3383995 - protein, 28 aa, Plasmodium falciparum
ICVKNSCPISLLSSHDIILSKKVKEYFS

SEQ ID NO: 3383996 - protein, 17 aa, Plasmodium falciparum
ICYSYSKLLIKSEMLFY

SEQ ID NO: 3383997 - protein, 26 aa, Plasmodium falciparum
IDANKKLWMWGWNEYGQIDDTYINEK

SEQ ID NO: 3383998 - protein, 21 aa, Plasmodium falciparum
IDASSLLCKPGSVGKYLYESN

SEQ ID NO: 3383999 - protein, 20 aa, Plasmodium falciparum
IDATFFYFLSVINSYERTCS

SEQ ID NO: 3384000 - protein, 17 aa, Plasmodium falciparum
IDCGMNFDILDNNAYKV

SEQ ID NO: 3384001 - protein, 19 aa, Plasmodium falciparum
IDCVISPYKDPNIIMDRIN

SEQ ID NO: 3384002 - protein, 17 aa, Plasmodium falciparum
IDDIFKMVNLSYILKIY

SEQ ID NO: 3384003 - protein, 21 aa, Plasmodium falciparum
IDDIKHILKKSKIKNLQQNKK

SEQ ID NO: 3384004 - protein, 19 aa, Plasmodium falciparum
IDDIPRNIPILFIHSRNDS

SEQ ID NO: 3384005 - protein, 17 aa, Plasmodium falciparum
IDDKLYCNIYSSCWFYF

SEQ ID NO: 3384006 - protein, 44 aa, Plasmodium falciparum
IDDYMDTLNIFDILPLLNIYFNFFYIYGINVKALYKWKTYNIEH

SEQ ID NO: 3384007 - protein, 23 aa, Plasmodium falciparum
IDEDIMVTPFYIKSKIDKVLKNN

SEQ ID NO: 3384008 - protein, 20 aa, Plasmodium falciparum
IDENLFFNFKRFGPSTIDQH

SEQ ID NO: 3384009 - protein, 26 aa, Plasmodium falciparum
IDENYLAQVFILCNTIFFVNDVENIL

SEQ ID NO: 3384010 - protein, 18 aa, Plasmodium falciparum
IDESTIEKCYKQMRIFAE

SEQ ID NO: 3384011 - protein, 25 aa, Plasmodium falciparum
IDETIIYFNLFKLHNIMSLNILRSS

SEQ ID NO: 3384012 - protein, 19 aa, Plasmodium falciparum
IDEWEREEWFINLWNDWNE

SEQ ID NO: 3384013 - protein, 20 aa, Plasmodium falciparum
IDFCILCGCDYCDTIKGIGS

SEQ ID NO: 3384014 - protein, 20 aa, Plasmodium falciparum
IDFKSILITLLKRLRSFIEA

SEQ ID NO: 3384015 - protein, 17 aa, Plasmodium falciparum
IDFLKSEKFKLKKMIIL

SEQ ID NO: 3384016 - protein, 22 aa, Plasmodium falciparum
IDFLSKTLYLDEGPVRLQLWDT

SEQ ID NO: 3384017 - protein, 24 aa, Plasmodium falciparum
IDFNDFLDIMTIKMNLKRVAKELG

SEQ ID NO: 3384018 - protein, 25 aa, Plasmodium falciparum
IDFNPFKINLFLIGTNKGKIYLYSS

SEQ ID NO: 3384019 - protein, 25 aa, Plasmodium falciparum
IDGDTFKVKWLMDKYGIQINKTSIN

SEQ ID NO: 3384020 - protein, 24 aa, Plasmodium falciparum
IDGKYHKHYFPISQYGFENARERA

SEQ ID NO: 3384021 - protein, 29 aa, Plasmodium falciparum
IDHTIRGFLIYLIPFFNVFHNKLPLNYLL

SEQ ID NO: 3384022 - protein, 26 aa, Plasmodium falciparum
IDIDRNPIFVPAYNQRYGVLSDVEEV

SEQ ID NO: 3384023 - protein, 32 aa, Plasmodium falciparum
IDIEIVYLKIEKINISFVTLSGILTLKIQGVD

SEQ ID NO: 3384024 - protein, 36 aa, Plasmodium falciparum
IDIFQLFKYNHTYYSFYDMPWVSIYYDFFLNSICTL

SEQ ID NO: 3384025 - protein, 20 aa, Plasmodium falciparum
IDIFYELKDLVKVHEILIYK

SEQ ID NO: 3384026 - protein, 27 aa, Plasmodium falciparum
IDIIINIIEEYLPFLSSHAYGCRIVQR

SEQ ID NO: 3384027 - protein, 38 aa, Plasmodium falciparum
IDIILMQNLLTLKNVLKFINKPLLRWGSANINRIPKYV

SEQ ID NO: 3384028 - protein, 32 aa, Plasmodium falciparum
IDIKKEYNLKYVKFKLSFLNEYSPDDIKFLSH

SEQ ID NO: 3384029 - protein, 30 aa, Plasmodium falciparum
IDILIEGVNIPWLYIGTLFSTFCWHTEDNY

SEQ ID NO: 3384030 - protein, 31 aa, Plasmodium falciparum
IDINKIHFDIIDYSFIFSKNLKKFVNYLKYV

SEQ ID NO: 3384031 - protein, 30 aa, Plasmodium falciparum
IDIPSDLFCFCNYFFFKEKYITFFKNVSND

SEQ ID NO: 3384032 - protein, 29 aa, Plasmodium falciparum
IDIQEIVKYLNSCLLILYNKENENENICL

SEQ ID NO: 3384033 - protein, 18 aa, Plasmodium falciparum
IDISLIADRAKKNIFPEM

SEQ ID NO: 3384034 - protein, 19 aa, Plasmodium falciparum
IDISLKMCRQLAEVINFLH

SEQ ID NO: 3384035 - protein, 26 aa, Plasmodium falciparum
IDISTFLWCCAYINIIYKPLFDSAYN

SEQ ID NO: 3384036 - protein, 26 aa, Plasmodium falciparum
IDKIAGRKILFIGKSIRILIRSNKWN

SEQ ID NO: 3384037 - protein, 33 aa, Plasmodium falciparum
IDKKKLGWWATNKYFPCYFYKFDNTNKYQNVPR

SEQ ID NO: 3384038 - protein, 28 aa, Plasmodium falciparum
IDKNVENFVFLDFIPVTEEYLKIKETLN

SEQ ID NO: 3384039 - protein, 17 aa, Plasmodium falciparum
IDKQIIIELIKNSNDIL

SEQ ID NO: 3384040 - protein, 33 aa, Plasmodium falciparum
IDKRSEIYYSNKAYDPQYLYNSNKLSSNIKITR

SEQ ID NO: 3384041 - protein, 23 aa, Plasmodium falciparum
IDKTHIWNILSVHALMLGNFEIA

SEQ ID NO: 3384042 - protein, 25 aa, Plasmodium falciparum
IDKYQKWKYIIRDDIIFDMNSLNIK

SEQ ID NO: 3384043 - protein, 27 aa, Plasmodium falciparum
IDLDDEILIANFPFNSLRDVENLTYTN

SEQ ID NO: 3384044 - protein, 26 aa, Plasmodium falciparum
IDLDYILLFYILYFNDNQNLYIPRVC

SEQ ID NO: 3384045 - protein, 30 aa, Plasmodium falciparum
IDLEYDEMLYKKYIQKLKINKINKYKEDNN

SEQ ID NO: 3384046 - protein, 18 aa, Plasmodium falciparum
IDLHKSVEKILLYATENR

SEQ ID NO: 3384047 - protein, 30 aa, Plasmodium falciparum
IDLRNELLRRFIYSLNSWMNMRRCIVACCE

SEQ ID NO: 3384048 - protein, 26 aa, Plasmodium falciparum
IDMSKVMYDIYFLCFHKNGCEYIIKK

SEQ ID NO: 3384049 - protein, 24 aa, Plasmodium falciparum
IDNFDNVILAYEPLWAIGTGKTAT

SEQ ID NO: 3384050 - protein, 51 aa, Plasmodium falciparum
IDNFNGPFDYLNYYFLCEIVFDDFSFKSPYHCYFFLRNQFENFKNVHTNYV

SEQ ID NO: 3384051 - protein, 24 aa, Plasmodium falciparum
IDNIHIYRYISKNEKMYLSKELEE

SEQ ID NO: 3384052 - protein, 41 aa, Plasmodium falciparum
IDNINYNLFYIIENIYRGFNKKIWKILKELIDFKYCDVYTY

SEQ ID NO: 3384053 - protein, 24 aa, Plasmodium falciparum
IDNIPYESIIFLFDDFNRKEKNII

SEQ ID NO: 3384054 - protein, 20 aa, Plasmodium falciparum
IDNKALFDTFSMFGNILSCK

SEQ ID NO: 3384055 - protein, 32 aa, Plasmodium falciparum
IDNKGKLYYIGFTIIHLNYLYELQKEGYVHLN

SEQ ID NO: 3384056 - protein, 32 aa, Plasmodium falciparum
IDNLINLRKILKFHHKLFFENHSKELRKISRC

SEQ ID NO: 3384057 - protein, 31 aa, Plasmodium falciparum
IDNLNKIREDPLTLIKKIELKKKKMMDEQKR

SEQ ID NO: 3384058 - protein, 18 aa, Plasmodium falciparum
IDNLSKANFISAGKICIC

SEQ ID NO: 3384059 - protein, 21 aa, Plasmodium falciparum
IDNVFPLSPYKDSLWKVFDTG

SEQ ID NO: 3384060 - protein, 29 aa, Plasmodium falciparum
IDNYKYWQYNTILLYNVIMIYTCEWPSLF

SEQ ID NO: 3384061 - protein, 17 aa, Plasmodium falciparum
IDNYLFIQIENITKHNL

SEQ ID NO: 3384062 - protein, 24 aa, Plasmodium falciparum
IDQLILLYQKVLPTLGDYLINEGS

SEQ ID NO: 3384063 - protein, 27 aa, Plasmodium falciparum
IDQLKEKINIIIIPNKGVINNFEEILS

SEQ ID NO: 3384064 - protein, 17 aa, Plasmodium falciparum
IDQTLQYIFSLMDSQKG

SEQ ID NO: 3384065 - protein, 18 aa, Plasmodium falciparum
IDRPLFKDFWDRYIKCIK

SEQ ID NO: 3384066 - protein, 27 aa, Plasmodium falciparum
IDSLDETAFSIIKLFNSKKKNDLSTKY

SEQ ID NO: 3384067 - protein, 29 aa, Plasmodium falciparum
IDSNILIIFELFKFGFLTTEALLPPDGKT

SEQ ID NO: 3384068 - protein, 30 aa, Plasmodium falciparum
IDSSKDYLKLKLPDSIFKHIRDLTSKDVKS

SEQ ID NO: 3384069 - protein, 17 aa, Plasmodium falciparum
IDTFNTVDLLRSSLAGE

SEQ ID NO: 3384070 - protein, 28 aa, Plasmodium falciparum
IDTVRRIDLLYIQLDTLVQSFAGVCTQV

SEQ ID NO: 3384071 - protein, 33 aa, Plasmodium falciparum
IDVGPFIEIQYWRYKHRYLLFIIEELRSKEIKS

SEQ ID NO: 3384072 - protein, 20 aa, Plasmodium falciparum
IDVKNILRLLKEPICLFGED

SEQ ID NO: 3384073 - protein, 18 aa, Plasmodium falciparum
IDVKQTFQYLFENKLITI

SEQ ID NO: 3384074 - protein, 18 aa, Plasmodium falciparum
IDVPLWRDKPQLPPYCRY

SEQ ID NO: 3384075 - protein, 19 aa, Plasmodium falciparum
IDYETILDCLTKEIDHYEK

SEQ ID NO: 3384076 - protein, 19 aa, Plasmodium falciparum
IDYKENVALIFSPSLNTEL

SEQ ID NO: 3384077 - protein, 17 aa, Plasmodium falciparum
IDYLLSKKKLQEATSIL

SEQ ID NO: 3384078 - protein, 40 aa, Plasmodium falciparum
IEALMCYNYISNAIIFEKGKFLRYIFMNNVNNIIVNEHMI

SEQ ID NO: 3384079 - protein, 20 aa, Plasmodium falciparum
IEALYNKKYKIFLMDNKQII

SEQ ID NO: 3384080 - protein, 28 aa, Plasmodium falciparum
IEAQNLIKYYLLSKKYKLILVNYFEWVN

SEQ ID NO: 3384081 - protein, 26 aa, Plasmodium falciparum
IECEKHMQLLISPGDMYMFKNQSHEM

SEQ ID NO: 3384082 - protein, 21 aa, Plasmodium falciparum
IECISNIILLEKYPQCSIKIK

SEQ ID NO: 3384083 - protein, 18 aa, Plasmodium falciparum
IECKATMLKILGNKIENF

SEQ ID NO: 3384084 - protein, 18 aa, Plasmodium falciparum
IECSKKILYSCLYIEENE

SEQ ID NO: 3384085 - protein, 26 aa, Plasmodium falciparum
IECVHDYIFLYFNKKALHKHDASNEM

SEQ ID NO: 3384086 - protein, 28 aa, Plasmodium falciparum
IEDIKLYCIEILKALNYLRKMSLTHTDL

SEQ ID NO: 3384087 - protein, 32 aa, Plasmodium falciparum
IEDINTKYIKLLLIPFILGNLCYETLNINIRY

SEQ ID NO: 3384088 - protein, 20 aa, Plasmodium falciparum
IEDKEFLLTTKKSLDIRIDD

SEQ ID NO: 3384089 - protein, 18 aa, Plasmodium falciparum
IEDNNLHILLTKVKKGES

SEQ ID NO: 3384090 - protein, 26 aa, Plasmodium falciparum
IEDRMKYLLILLNDTKKNNIKIERST

SEQ ID NO: 3384091 - protein, 20 aa, Plasmodium falciparum
IEDYFIFEKKLGMGGFGEVW

SEQ ID NO: 3384092 - protein, 19 aa, Plasmodium falciparum
IEEENKVLKIFKEEKNKIN

SEQ ID NO: 3384093 - protein, 26 aa, Plasmodium falciparum
IEEFGLKSLPYIKSSLSPGSKTVQKY

SEQ ID NO: 3384094 - protein, 28 aa, Plasmodium falciparum
IEEHAIIDITRQLLHALAYCHNLKDGPN

SEQ ID NO: 3384095 - protein, 41 aa, Plasmodium falciparum
IEEIEHIKKNHGYLHFMWLKRKTLCIEIIKCIATLTEKDTK

SEQ ID NO: 3384096 - protein, 23 aa, Plasmodium falciparum
IEEIEKIHFNIFDFIDMEKQTYE

SEQ ID NO: 3384097 - protein, 24 aa, Plasmodium falciparum
IEEKEKYVNSIKLKYDNAQKELLD

SEQ ID NO: 3384098 - protein, 33 aa, Plasmodium falciparum
IEEKKKYKKLLIYYLLYNNYLKLSASNIFENAS

SEQ ID NO: 3384099 - protein, 23 aa, Plasmodium falciparum
IEEKNPFLFFPNSQLNNTISNIQ

SEQ ID NO: 3384100 - protein, 25 aa, Plasmodium falciparum
IEEKYNICMLFYKYISNSTYLVHLL

SEQ ID NO: 3384101 - protein, 24 aa, Plasmodium falciparum
IEELIKNYRQKLYDEYYEKKKIQE

SEQ ID NO: 3384102 - protein, 19 aa, Plasmodium falciparum
IEELLKRMYGFKSGEDYIN

SEQ ID NO: 3384103 - protein, 18 aa, Plasmodium falciparum
IEELLWFIRGETNGNTLL

SEQ ID NO: 3384104 - protein, 31 aa, Plasmodium falciparum
IEENKPLKFCRSFHLFPLPSGGYFIFNDLFR

SEQ ID NO: 3384105 - protein, 57 aa, Plasmodium falciparum
IEESKKVFRLLKLLGEWIKYGLVLIFVNKQIEADLLYLELYKYDYNLLVLHGGQDQT

SEQ ID NO: 3384106 - protein, 26 aa, Plasmodium falciparum
IEETLSYIISILGEKHWLYASFNYII

SEQ ID NO: 3384107 - protein, 25 aa, Plasmodium falciparum
IEEVKNLCFIYPNKCNIILNFLSNN

SEQ ID NO: 3384108 - protein, 19 aa, Plasmodium falciparum
IEFFKPYKIMEKYIIFMRD

SEQ ID NO: 3384109 - protein, 18 aa, Plasmodium falciparum
IEFYINYYKKYNDKEVVE

SEQ ID NO: 3384110 - protein, 26 aa, Plasmodium falciparum
IEGHRYMLEKWKKEKWFIVLKENWKN

SEQ ID NO: 3384111 - protein, 28 aa, Plasmodium falciparum
IEGIIHIITTFWIDIFEKRIKNIEIIQN

SEQ ID NO: 3384112 - protein, 18 aa, Plasmodium falciparum
IEHIDYGDIFLTIHDTLK

SEQ ID NO: 3384113 - protein, 17 aa, Plasmodium falciparum
IEHKKMCFKKKYVCLEC

SEQ ID NO: 3384114 - protein, 19 aa, Plasmodium falciparum
IEHLKIWKPKKNYKFKDNN

SEQ ID NO: 3384115 - protein, 24 aa, Plasmodium falciparum
IEIAKKRILTILKILEDTLEEDKN

SEQ ID NO: 3384116 - protein, 23 aa, Plasmodium falciparum
IEIFLIYSYSSYKIFKPLIFLIY

SEQ ID NO: 3384117 - protein, 23 aa, Plasmodium falciparum
IEIKKKSLLKSKLKNDDIQTIIK

SEQ ID NO: 3384118 - protein, 18 aa, Plasmodium falciparum
IEIPDTLYYDILGVGVNA

SEQ ID NO: 3384119 - protein, 27 aa, Plasmodium falciparum
IEITIKTLPRIFLYKEMINKFQNGYSK

SEQ ID NO: 3384120 - protein, 24 aa, Plasmodium falciparum
IEKDGYIIFAFNIIPITINTNKNK

SEQ ID NO: 3384121 - protein, 30 aa, Plasmodium falciparum
IEKEKLFSLIDLLFKRAIPKSLTLIAKIRE

SEQ ID NO: 3384122 - protein, 28 aa, Plasmodium falciparum
IEKESLNLYLNKLFDKYCIIVHKIRTHR

SEQ ID NO: 3384123 - protein, 26 aa, Plasmodium falciparum
IEKEYKSFYLKFEYINQNTFCIHLKK

SEQ ID NO: 3384124 - protein, 26 aa, Plasmodium falciparum
IEKFNEPILFLWRNNRSIIIGKNQNI

SEQ ID NO: 3384125 - protein, 33 aa, Plasmodium falciparum
IEKGDEECCLILLKLLYVNIILNNYNYLYHILS

SEQ ID NO: 3384126 - protein, 23 aa, Plasmodium falciparum
IEKHFPNDLLSKCPYYINNKYIT

SEQ ID NO: 3384127 - protein, 17 aa, Plasmodium falciparum
IEKHIINYGICPVSGEV

SEQ ID NO: 3384128 - protein, 17 aa, Plasmodium falciparum
IEKIICSILLSRNIKKA

SEQ ID NO: 3384129 - protein, 25 aa, Plasmodium falciparum
IEKIRSIIAYKLWKYIVKDINLIKI

SEQ ID NO: 3384130 - protein, 29 aa, Plasmodium falciparum
IEKKELLELWAPKYLYFDALKYISMIKHA

SEQ ID NO: 3384131 - protein, 18 aa, Plasmodium falciparum
IEKKFIEQLYYLCGSQYT

SEQ ID NO: 3384132 - protein, 24 aa, Plasmodium falciparum
IEKKFINENIYINKQIIACNVKNE

SEQ ID NO: 3384133 - protein, 22 aa, Plasmodium falciparum
IEKKKRNIVIPRFKICEDSEEE

SEQ ID NO: 3384134 - protein, 42 aa, Plasmodium falciparum
IEKKLPMKPNMFLTLINDLKIEFILTFEKFAIGNIKIKKKYK

SEQ ID NO: 3384135 - protein, 17 aa, Plasmodium falciparum
IEKNTEILIEERNYINE

SEQ ID NO: 3384136 - protein, 26 aa, Plasmodium falciparum
IEKQYYMHDLPWVWHKNFYTGTSHFC

SEQ ID NO: 3384137 - protein, 17 aa, Plasmodium falciparum
IEKTRDLTKLSGYIWMR

SEQ ID NO: 3384138 - protein, 17 aa, Plasmodium falciparum
IEKVIIRVKRRIDDTSI

SEQ ID NO: 3384139 - protein, 28 aa, Plasmodium falciparum
IEKVNYFHYALMYMYNYLLKHKHFNYTN

SEQ ID NO: 3384140 - protein, 39 aa, Plasmodium falciparum
IEKYIIVFMDISNTYYFYKYMMYCYIKGNLISYKYIDIY

SEQ ID NO: 3384141 - protein, 42 aa, Plasmodium falciparum
IEKYKRVHVLYLGRLLQIVEKLFKKYILKYSFHKLRIFYEYK

SEQ ID NO: 3384142 - protein, 29 aa, Plasmodium falciparum
IELFVDPSEFFVFFNISYKLITNERKKKT

SEQ ID NO: 3384143 - protein, 26 aa, Plasmodium falciparum
IELKVSYTEFLWRSFRRIDISTFNLK

SEQ ID NO: 3384144 - protein, 25 aa, Plasmodium falciparum
IELNKKFLNNYFHACYFECSDNPML

SEQ ID NO: 3384145 - protein, 18 aa, Plasmodium falciparum
IELNLDYPSITYLNVSHN

SEQ ID NO: 3384146 - protein, 29 aa, Plasmodium falciparum
IELPNLIDYCYLYYLYSMTIANSNLSRIN

SEQ ID NO: 3384147 - protein, 32 aa, Plasmodium falciparum
IELRATENLYKTALCESFIKGKCFSGQFCRYA

SEQ ID NO: 3384148 - protein, 20 aa, Plasmodium falciparum
IELRHSYYSSVLILVNDNSE

SEQ ID NO: 3384149 - protein, 36 aa, Plasmodium falciparum
IEMNNSYLVLKTYKMKCSFFLNIIKNYEENIHILEN

SEQ ID NO: 3384150 - protein, 17 aa, Plasmodium falciparum
IEMWIALARLCTYTEAQ

SEQ ID NO: 3384151 - protein, 23 aa, Plasmodium falciparum
IEMYKFFELMNSFGIILTNDEKA

SEQ ID NO: 3384152 - protein, 36 aa, Plasmodium falciparum
IENERDLNFYIKIFNFLFEIITGKNIYYQINDIHNI

SEQ ID NO: 3384153 - protein, 28 aa, Plasmodium falciparum
IENHNLDEYFFLNSKNSFNLIQHIPDSI

SEQ ID NO: 3384154 - protein, 32 aa, Plasmodium falciparum
IENKKVIHYKPQNVFISFKYSKDNIFPTNEKL

SEQ ID NO: 3384155 - protein, 17 aa, Plasmodium falciparum
IENLLSHSGTKSDNFQS

SEQ ID NO: 3384156 - protein, 17 aa, Plasmodium falciparum
IENLLYLSLQSYAQEKS

SEQ ID NO: 3384157 - protein, 19 aa, Plasmodium falciparum
IENSIYYDNKMYLGANEKT

SEQ ID NO: 3384158 - protein, 40 aa, Plasmodium falciparum
IENSNQIKMPYLTNYLIVLFLPKYRLLALINICKTSIKVN

SEQ ID NO: 3384159 - protein, 17 aa, Plasmodium falciparum
IENYNGDKLLYIKNPWG

SEQ ID NO: 3384160 - protein, 19 aa, Plasmodium falciparum
IEPILLMDPMQRRESINKL

SEQ ID NO: 3384161 - protein, 31 aa, Plasmodium falciparum
IEQLIKYKTFNILKCLFFLAQWYKRNCRYLF

SEQ ID NO: 3384162 - protein, 22 aa, Plasmodium falciparum
IEQTILERAKVKMVLDTLVVQG

SEQ ID NO: 3384163 - protein, 23 aa, Plasmodium falciparum
IERKHTFLFNDIKSMFVNVENVN

SEQ ID NO: 3384164 - protein, 18 aa, Plasmodium falciparum
IERKKEVKRLIKYKTPRA

SEQ ID NO: 3384165 - protein, 17 aa, Plasmodium falciparum
IERNKLDIYMFEEKYKD

SEQ ID NO: 3384166 - protein, 23 aa, Plasmodium falciparum
IERQVCIPMHLPISYSINIEENE

SEQ ID NO: 3384167 - protein, 53 aa, Plasmodium falciparum
IERSTIINELLFYYTYYYEYSKEMIKYLYYIFDIKELYLFLEINNMPKEIHLR

SEQ ID NO: 3384168 - protein, 26 aa, Plasmodium falciparum
IERVCCYIKHFIEPPEPLFEVMVNVF

SEQ ID NO: 3384169 - protein, 28 aa, Plasmodium falciparum
IERYTPDDIWFLNKINTLFLSVGELLDE

SEQ ID NO: 3384170 - protein, 24 aa, Plasmodium falciparum
IESDLYYLYKLLINSRTIEQIRLE

SEQ ID NO: 3384171 - protein, 21 aa, Plasmodium falciparum
IESLQHTHLYGRHLIIDFADD

SEQ ID NO: 3384172 - protein, 17 aa, Plasmodium falciparum
IESNKIHQIKILASYKL

SEQ ID NO: 3384173 - protein, 33 aa, Plasmodium falciparum
IESNKNDLINFYKDPINFLFICNQTEKRIKEIE

SEQ ID NO: 3384174 - protein, 28 aa, Plasmodium falciparum
IESSSKLIFIDKLLCQLHYENCKYVKNY

SEQ ID NO: 3384175 - protein, 17 aa, Plasmodium falciparum
IESVNFMKGKNLFIVKF

SEQ ID NO: 3384176 - protein, 41 aa, Plasmodium falciparum
IETAKKDNILLKKKLKRSTDPLFLLTLEQKNKQLCIDIENR

SEQ ID NO: 3384177 - protein, 26 aa, Plasmodium falciparum
IETDKIIFPDVLFLIGSLSVVKEIKI

SEQ ID NO: 3384178 - protein, 27 aa, Plasmodium falciparum
IETNKNFHLFLSHLNQLEKSILTFTHF

SEQ ID NO: 3384179 - protein, 33 aa, Plasmodium falciparum
IEVEKYIPRLVPVNVYVPRYFGISAKAKGEPEE

SEQ ID NO: 3384180 - protein, 21 aa, Plasmodium falciparum
IEVINYLLREGKKVYFITNNS

SEQ ID NO: 3384181 - protein, 22 aa, Plasmodium falciparum
IEVLNEYNFLTAKPVVYLVNMS

SEQ ID NO: 3384182 - protein, 17 aa, Plasmodium falciparum
IEVLQLEELKDICVVDM

SEQ ID NO: 3384183 - protein, 26 aa, Plasmodium falciparum
IEVTKRLFHYWKLTKHSWAYQFCVDM

SEQ ID NO: 3384184 - protein, 23 aa, Plasmodium falciparum
IEVYFPYELYDCQYNYMLSVLSA

SEQ ID NO: 3384185 - protein, 26 aa, Plasmodium falciparum
IEYFNDLYIYIINSNIWINLTNVYMD

SEQ ID NO: 3384186 - protein, 18 aa, Plasmodium falciparum
IEYKLYLEREEEGSFIFI

SEQ ID NO: 3384187 - protein, 28 aa, Plasmodium falciparum
IEYLRTNPLIFIDTLNNLLIIPGINFEY

SEQ ID NO: 3384188 - protein, 32 aa, Plasmodium falciparum
IEYMILCAFTRLYKKEILPKTLYVIILEINKF

SEQ ID NO: 3384189 - protein, 18 aa, Plasmodium falciparum
IEYYNLRTQIKWINDVLI

SEQ ID NO: 3384190 - protein, 18 aa, Plasmodium falciparum
IFAKILDHLLKTDLYNIS

SEQ ID NO: 3384191 - protein, 26 aa, Plasmodium falciparum
IFCLCHDKFFTIWDTVTLKTLAIIKH

SEQ ID NO: 3384192 - protein, 22 aa, Plasmodium falciparum
IFDELHYGTLSPPSLYIHKYNK

SEQ ID NO: 3384193 - protein, 19 aa, Plasmodium falciparum
IFDGVVSISALQWLCNWDK

SEQ ID NO: 3384194 - protein, 24 aa, Plasmodium falciparum
IFDIIVCIPYGVLIFFSSYSSMTE

SEQ ID NO: 3384195 - protein, 26 aa, Plasmodium falciparum
IFDYDYKHFFFRYNDLTYIKDIKLDI

SEQ ID NO: 3384196 - protein, 25 aa, Plasmodium falciparum
IFEENGYILKKMNIKYLITENANIT

SEQ ID NO: 3384197 - protein, 17 aa, Plasmodium falciparum
IFEFEKYLNIVKNKIKN

SEQ ID NO: 3384198 - protein, 17 aa, Plasmodium falciparum
IFEFIKKVNKNITYIRL

SEQ ID NO: 3384199 - protein, 21 aa, Plasmodium falciparum
IFEFIKLITNGLYNFKLFNVS

SEQ ID NO: 3384200 - protein, 23 aa, Plasmodium falciparum
IFENALLYLKKNGKIVYITCSIL

SEQ ID NO: 3384201 - protein, 18 aa, Plasmodium falciparum
IFFFCSIEYLKINFCKDC

SEQ ID NO: 3384202 - protein, 18 aa, Plasmodium falciparum
IFFFYPFNNSRDNEKNED

SEQ ID NO: 3384203 - protein, 21 aa, Plasmodium falciparum
IFFIYLIYVRSHFSQPTSSEY

SEQ ID NO: 3384204 - protein, 18 aa, Plasmodium falciparum
IFFKIIYCMNKGLSLLIN

SEQ ID NO: 3384205 - protein, 17 aa, Plasmodium falciparum
IFHMKNSVDIHFKHDLA

SEQ ID NO: 3384206 - protein, 17 aa, Plasmodium falciparum
IFHNMLPYIKYIDDWIK

SEQ ID NO: 3384207 - protein, 25 aa, Plasmodium falciparum
IFHTHMFELFVRLIFENSRTYFTIF

SEQ ID NO: 3384208 - protein, 18 aa, Plasmodium falciparum
IFIEALFIDSLSFWNFCK

SEQ ID NO: 3384209 - protein, 19 aa, Plasmodium falciparum
IFIFNLSTFVFYKTVQLPK

SEQ ID NO: 3384210 - protein, 21 aa, Plasmodium falciparum
IFINEIFYKYHHAPIFLLVNV

SEQ ID NO: 3384211 - protein, 19 aa, Plasmodium falciparum
IFINTGNNPYFLRSNNKKR

SEQ ID NO: 3384212 - protein, 18 aa, Plasmodium falciparum
IFIPFIKCKKKKAKINKW

SEQ ID NO: 3384213 - protein, 20 aa, Plasmodium falciparum
IFKKALFILRQKVINVKEAL

SEQ ID NO: 3384214 - protein, 21 aa, Plasmodium falciparum
IFKKYIDLSTNYWGAKYIILN

SEQ ID NO: 3384215 - protein, 26 aa, Plasmodium falciparum
IFKMVNLSYILKIYKLPEDLTFKNSE

SEQ ID NO: 3384216 - protein, 26 aa, Plasmodium falciparum
IFKNNEYIFKNRNLEFLKNDKKKKFQ

SEQ ID NO: 3384217 - protein, 19 aa, Plasmodium falciparum
IFKRAMIIKKWFNNLSKVT

SEQ ID NO: 3384218 - protein, 30 aa, Plasmodium falciparum
IFKVHKNGLITYWPFIRSDGSHILDVYKKQ

SEQ ID NO: 3384219 - protein, 24 aa, Plasmodium falciparum
IFLESELFYKGIIPAINVGLSVSR

SEQ ID NO: 3384220 - protein, 17 aa, Plasmodium falciparum
IFLFDTFYKVSVTDNVK

SEQ ID NO: 3384221 - protein, 20 aa, Plasmodium falciparum
IFLNKMNLTEEQKMFFLKQL

SEQ ID NO: 3384222 - protein, 18 aa, Plasmodium falciparum
IFLNVFLYVERLFDIIEP

SEQ ID NO: 3384223 - protein, 18 aa, Plasmodium falciparum
IFLRIFNILKIPAYHKTS

SEQ ID NO: 3384224 - protein, 20 aa, Plasmodium falciparum
IFMDKLIYYCTNPIIFLMQR

SEQ ID NO: 3384225 - protein, 34 aa, Plasmodium falciparum
IFMNNIFLIKYVLKYKHIFSNNLYLYILNVFCNT

SEQ ID NO: 3384226 - protein, 17 aa, Plasmodium falciparum
IFNALSKTYGYLTPDLW

SEQ ID NO: 3384227 - protein, 17 aa, Plasmodium falciparum
IFNIIKKLQGGKQLCII

SEQ ID NO: 3384228 - protein, 23 aa, Plasmodium falciparum
IFNNEEIFFNSKKINMDKGSNAK

SEQ ID NO: 3384229 - protein, 43 aa, Plasmodium falciparum
IFNSDSRFCFLEFRTVQITWLCLKLDSIPYNNYCLRIGRPHDY

SEQ ID NO: 3384230 - protein, 24 aa, Plasmodium falciparum
IFNVKMFSLINKYMNLYLPNFTKN

SEQ ID NO: 3384231 - protein, 20 aa, Plasmodium falciparum
IFPNKIYLYMSGYNDMEYIK

SEQ ID NO: 3384232 - protein, 29 aa, Plasmodium falciparum
IFPNNIMMDNSPYYKFRHSNKKPSYGSES

SEQ ID NO: 3384233 - protein, 22 aa, Plasmodium falciparum
IFPSVYNIRFHIVTKFCLITQK

SEQ ID NO: 3384234 - protein, 18 aa, Plasmodium falciparum
IFQIIKKRPEIYNPHIDI

SEQ ID NO: 3384235 - protein, 20 aa, Plasmodium falciparum
IFQIQLNEENFNALAALENE

SEQ ID NO: 3384236 - protein, 18 aa, Plasmodium falciparum
IFQKENIHLKNHLDFIYN

SEQ ID NO: 3384237 - protein, 20 aa, Plasmodium falciparum
IFQNSRFMDHTGACDTIKSG

SEQ ID NO: 3384238 - protein, 21 aa, Plasmodium falciparum
IFQYMYKLLHIILTRKKQIDS

SEQ ID NO: 3384239 - protein, 32 aa, Plasmodium falciparum
IFRNIQITDILSRYTWCLSDELPKLISSVNII

SEQ ID NO: 3384240 - protein, 27 aa, Plasmodium falciparum
IFSCPKNFFLFFYYKSKNNLFNYKDMY

SEQ ID NO: 3384241 - protein, 25 aa, Plasmodium falciparum
IFSPDLFWNICLYFKDNIMGVDPSL

SEQ ID NO: 3384242 - protein, 24 aa, Plasmodium falciparum
IFSVEFLVYRLLEFSLQHTYENIR

SEQ ID NO: 3384243 - protein, 17 aa, Plasmodium falciparum
IFTINICKSLWILLSIT

SEQ ID NO: 3384244 - protein, 18 aa, Plasmodium falciparum
IFTNIIVCLYRIANNING

SEQ ID NO: 3384245 - protein, 19 aa, Plasmodium falciparum
IFTNLIKNLYKAKNLRILC

SEQ ID NO: 3384246 - protein, 19 aa, Plasmodium falciparum
IFTPIYYFDGNSWTALERL

SEQ ID NO: 3384247 - protein, 17 aa, Plasmodium falciparum
IFTYSVLLCNRISFPHN

SEQ ID NO: 3384248 - protein, 27 aa, Plasmodium falciparum
IFVGNIPIKDVSISKLLKILNIEKSIV

SEQ ID NO: 3384249 - protein, 21 aa, Plasmodium falciparum
IFYIIIIFYNIEKVNNYKSSC

SEQ ID NO: 3384250 - protein, 18 aa, Plasmodium falciparum
IFYLRFSKCISKNNNYGY

SEQ ID NO: 3384251 - protein, 25 aa, Plasmodium falciparum
IGCCYFFRKYFGRNIGLHLGLTSLR

SEQ ID NO: 3384252 - protein, 27 aa, Plasmodium falciparum
IGCFVPCTYAKIPIFTQIMCRVGSSDI

SEQ ID NO: 3384253 - protein, 27 aa, Plasmodium falciparum
IGCGNGLFLYKLYEKGFMNLYGFDFSS

SEQ ID NO: 3384254 - protein, 31 aa, Plasmodium falciparum
IGCSYISITNLLNLGLEGGVFLLVEEYKNEY

SEQ ID NO: 3384255 - protein, 29 aa, Plasmodium falciparum
IGDMIRTQFPHSQFIIVSLKEGMFSHADV

SEQ ID NO: 3384256 - protein, 26 aa, Plasmodium falciparum
IGDNNNVFSFYNFKANKLTNLTNHNN

SEQ ID NO: 3384257 - protein, 21 aa, Plasmodium falciparum
IGEFFNDLTAWLKKNPTVYDS

SEQ ID NO: 3384258 - protein, 20 aa, Plasmodium falciparum
IGFELMLKLLSERKFLCFPS

SEQ ID NO: 3384259 - protein, 25 aa, Plasmodium falciparum
IGFENIIYLLYKLLKKKYITCPLKS

SEQ ID NO: 3384260 - protein, 22 aa, Plasmodium falciparum
IGFTAIRHLGRIKNLLTNVSSN

SEQ ID NO: 3384261 - protein, 19 aa, Plasmodium falciparum
IGHPFMYPKMDITKMNKTN

SEQ ID NO: 3384262 - protein, 19 aa, Plasmodium falciparum
IGICTYYNKLNKQKNHIIT

SEQ ID NO: 3384263 - protein, 17 aa, Plasmodium falciparum
IGIVELYKNSLSSKAVN

SEQ ID NO: 3384264 - protein, 17 aa, Plasmodium falciparum
IGIYHKFMKLKDNDFNI

SEQ ID NO: 3384265 - protein, 27 aa, Plasmodium falciparum
IGKDITWFHTVIFPTILLSANIPLSKS

SEQ ID NO: 3384266 - protein, 20 aa, Plasmodium falciparum
IGKIYVTISPYPSKSILPAQ

SEQ ID NO: 3384267 - protein, 25 aa, Plasmodium falciparum
IGKKKALMITLNYNGLLEGCVNDTV

SEQ ID NO: 3384268 - protein, 19 aa, Plasmodium falciparum
IGKVFFLLDPFKEFAFVNS

SEQ ID NO: 3384269 - protein, 26 aa, Plasmodium falciparum
IGLKYDNMWGIFRFVIDNLADKPNGN

SEQ ID NO: 3384270 - protein, 24 aa, Plasmodium falciparum
IGLSKKHFLRVLKKIKPQTSESLI

SEQ ID NO: 3384271 - protein, 21 aa, Plasmodium falciparum
IGLSNFKFVSPVYGVLAACVM

SEQ ID NO: 3384272 - protein, 25 aa, Plasmodium falciparum
IGNIKLDYVVLYIYGICIFNNDIIN

SEQ ID NO: 3384273 - protein, 23 aa, Plasmodium falciparum
IGNNALIYLLGYSTNKHKKILIK

SEQ ID NO: 3384274 - protein, 24 aa, Plasmodium falciparum
IGQEYFIYIHKRSKIKDYCPSYYS

SEQ ID NO: 3384275 - protein, 26 aa, Plasmodium falciparum
IGQTNLFIWLHYDIPDNFLIQIKGRK

SEQ ID NO: 3384276 - protein, 19 aa, Plasmodium falciparum
IGQVIKNMHILRAIEMLPT

SEQ ID NO: 3384277 - protein, 24 aa, Plasmodium falciparum
IGRTYKPFNPLLGETYELTHRKFR

SEQ ID NO: 3384278 - protein, 24 aa, Plasmodium falciparum
IGSLPVVFMELLKRKKKVPIICHE

SEQ ID NO: 3384279 - protein, 28 aa, Plasmodium falciparum
IGTIHSFCRYILYKYKGTFKILTDFINT

SEQ ID NO: 3384280 - protein, 28 aa, Plasmodium falciparum
IGTKKYPLDFFLWLLNKIYRHSNKMLKK

SEQ ID NO: 3384281 - protein, 25 aa, Plasmodium falciparum
IGTLIRSCFLLKWQCIFNIDNLNRK

SEQ ID NO: 3384282 - protein, 26 aa, Plasmodium falciparum
IGTYKKWMNILKRSNFLYIYNSINTI

SEQ ID NO: 3384283 - protein, 29 aa, Plasmodium falciparum
IGYTPVFSPTWDVREIPRVIPKYEGEQKI

SEQ ID NO: 3384284 - protein, 26 aa, Plasmodium falciparum
IHACDNLIYNILYWREELAKKLDEAP

SEQ ID NO: 3384285 - protein, 26 aa, Plasmodium falciparum
IHANIFFGDLVLLKFIPKETAKNDTQ

SEQ ID NO: 3384286 - protein, 18 aa, Plasmodium falciparum
IHAVARWKWIGSTIDSVC

SEQ ID NO: 3384287 - protein, 39 aa, Plasmodium falciparum
IHCSGHLLMVAFTDKLRIFHILYNKLKIKKEFFLKNCSC

SEQ ID NO: 3384288 - protein, 18 aa, Plasmodium falciparum
IHCVKTIRKLNHKAILIN

SEQ ID NO: 3384289 - protein, 17 aa, Plasmodium falciparum
IHDKELLSHILNSNSES

SEQ ID NO: 3384290 - protein, 29 aa, Plasmodium falciparum
IHEDSGSLVFFNTLKKELLYDKPADFYEP

SEQ ID NO: 3384291 - protein, 25 aa, Plasmodium falciparum
IHEEEIPFEIYLKDFYPIEKICELI

SEQ ID NO: 3384292 - protein, 26 aa, Plasmodium falciparum
IHEKKRIFFEVYKKYYFIEMTEYHKS

SEQ ID NO: 3384293 - protein, 19 aa, Plasmodium falciparum
IHETIINSMKFITISNNIT

SEQ ID NO: 3384294 - protein, 18 aa, Plasmodium falciparum
IHFEDAMEIIYKMGYVPS

SEQ ID NO: 3384295 - protein, 19 aa, Plasmodium falciparum
IHFQNYKCNFINADLSPFL

SEQ ID NO: 3384296 - protein, 26 aa, Plasmodium falciparum
IHFVNKKYFSLVKIKYVIVDEFDLLF

SEQ ID NO: 3384297 - protein, 37 aa, Plasmodium falciparum
IHHFNKPLNDFLEIDIKLLRWLTTIMIKTSNSLNDID

SEQ ID NO: 3384298 - protein, 27 aa, Plasmodium falciparum
IHHKRARYFFNFFQVYGILSEESSDYD

SEQ ID NO: 3384299 - protein, 21 aa, Plasmodium falciparum
IHIHKNICDHLTSGNIYNGKK

SEQ ID NO: 3384300 - protein, 17 aa, Plasmodium falciparum
IHIILSSLNFDENLELD

SEQ ID NO: 3384301 - protein, 23 aa, Plasmodium falciparum
IHINVINKYKLHISLKNDEFIFF

SEQ ID NO: 3384302 - protein, 18 aa, Plasmodium falciparum
IHKEYFSNSIFRKYTHHK

SEQ ID NO: 3384303 - protein, 19 aa, Plasmodium falciparum
IHKEYIILYNKYSSKFKFT

SEQ ID NO: 3384304 - protein, 64 aa, Plasmodium falciparum
IHKNKDLLTLFKKKDLANLKKKNLSFFMDTLKLEKIDMLIMKRIQMCLEKIKNTLLLTCTINNV

SEQ ID NO: 3384305 - protein, 17 aa, Plasmodium falciparum
IHKPNIKQEFYIYRDLK

SEQ ID NO: 3384306 - protein, 28 aa, Plasmodium falciparum
IHKYNWMYEDFYVNRLISQIMKKKKKKK

SEQ ID NO: 3384307 - protein, 20 aa, Plasmodium falciparum
IHLFHELIYSLLFSKHQKEK

SEQ ID NO: 3384308 - protein, 19 aa, Plasmodium falciparum
IHLGIIDKILLLNEDRKKC

SEQ ID NO: 3384309 - protein, 19 aa, Plasmodium falciparum
IHLIKNNSIIFSNSLSPNE

SEQ ID NO: 3384310 - protein, 27 aa, Plasmodium falciparum
IHLKNKKNLYRLLGINFTKDIKNKIKC

SEQ ID NO: 3384311 - protein, 17 aa, Plasmodium falciparum
IHLLEILCGYSHDYLRD

SEQ ID NO: 3384312 - protein, 30 aa, Plasmodium falciparum
IHLSSLKINDWGLSILIPCILRSRKLTTLN

SEQ ID NO: 3384313 - protein, 17 aa, Plasmodium falciparum
IHLYSPFCDSDILICSP

SEQ ID NO: 3384314 - protein, 19 aa, Plasmodium falciparum
IHMNNSFVNFINGNNVKKN

SEQ ID NO: 3384315 - protein, 18 aa, Plasmodium falciparum
IHNEFLLNNSFDNSIEHV

SEQ ID NO: 3384316 - protein, 26 aa, Plasmodium falciparum
IHNELESFHFFPVEKHTYVTVQNFIS

SEQ ID NO: 3384317 - protein, 28 aa, Plasmodium falciparum
IHNFKIRNFLNFKLYNSIFDTIREKNRS

SEQ ID NO: 3384318 - protein, 25 aa, Plasmodium falciparum
IHNHLHYFSLYYLTDIIYNIAILNC

SEQ ID NO: 3384319 - protein, 18 aa, Plasmodium falciparum
IHNNEELFSFDRNFKKKN

SEQ ID NO: 3384320 - protein, 17 aa, Plasmodium falciparum
IHNTPNILPNRHNSMYP

SEQ ID NO: 3384321 - protein, 19 aa, Plasmodium falciparum
IHPNILRTGIFFNKCSITT

SEQ ID NO: 3384322 - protein, 23 aa, Plasmodium falciparum
IHPQIICDGFRMALASAREALLD

SEQ ID NO: 3384323 - protein, 21 aa, Plasmodium falciparum
IHPRIITQGFDIAKGILLEFL

SEQ ID NO: 3384324 - protein, 25 aa, Plasmodium falciparum
IHPSVPKLYNLYWGYSIEILKNLSD

SEQ ID NO: 3384325 - protein, 24 aa, Plasmodium falciparum
IHPVWTVYMNRFSLFKQVYTHRKV

SEQ ID NO: 3384326 - protein, 25 aa, Plasmodium falciparum
IHQASNLLYQNLLNNPQSLLQHLNL

SEQ ID NO: 3384327 - protein, 26 aa, Plasmodium falciparum
IHQCSDFHLILFVAKVLDIETALALC

SEQ ID NO: 3384328 - protein, 19 aa, Plasmodium falciparum
IHRDIKIANLLIDNNGILK

SEQ ID NO: 3384329 - protein, 17 aa, Plasmodium falciparum
IHRDYVHSYHMKKKQKK

SEQ ID NO: 3384330 - protein, 19 aa, Plasmodium falciparum
IHRYYPLDMKMHSNIYLYD

SEQ ID NO: 3384331 - protein, 25 aa, Plasmodium falciparum
IHSFHTMKASYYNGCNLNKGGRYFK

SEQ ID NO: 3384332 - protein, 18 aa, Plasmodium falciparum
IHTIKRLNSLFKIPIDDI

SEQ ID NO: 3384333 - protein, 28 aa, Plasmodium falciparum
IHTKTTHWSYENLQLHGKKYSSFNLKND

SEQ ID NO: 3384334 - protein, 35 aa, Plasmodium falciparum
IHTLTLCLDLFINSILYPYIFYIHELNVQNKNMTE

SEQ ID NO: 3384335 - protein, 23 aa, Plasmodium falciparum
IHTNRILCQLLNNQNLKLNWIKE

SEQ ID NO: 3384336 - protein, 24 aa, Plasmodium falciparum
IHVERMMLHCWIILKNKELNNLKK

SEQ ID NO: 3384337 - protein, 17 aa, Plasmodium falciparum
IHVKTIKSSLHISVYKS

SEQ ID NO: 3384338 - protein, 18 aa, Plasmodium falciparum
IHVLWHEMGPDKTKDFLS

SEQ ID NO: 3384339 - protein, 18 aa, Plasmodium falciparum
IIAQILSILLKFDKKSFD

SEQ ID NO: 3384340 - protein, 18 aa, Plasmodium falciparum
IIARAKSMKMKRIGTINF

SEQ ID NO: 3384341 - protein, 44 aa, Plasmodium falciparum
IIASEELYSLPNSYPFFLIYYVSFCYRNSINAWNGWPSFNDLYK

SEQ ID NO: 3384342 - protein, 18 aa, Plasmodium falciparum
IICHFYAQCLRTLQEYDS

SEQ ID NO: 3384343 - protein, 24 aa, Plasmodium falciparum
IICISCFKCYFPFEFVNKCVICNS

SEQ ID NO: 3384344 - protein, 18 aa, Plasmodium falciparum
IICMPGYIDFALSDIDLT

SEQ ID NO: 3384345 - protein, 24 aa, Plasmodium falciparum
IICNKIIHEPLKNISFHNHLADHT

SEQ ID NO: 3384346 - protein, 19 aa, Plasmodium falciparum
IICSILLSRNIKKANYLVF

SEQ ID NO: 3384347 - protein, 17 aa, Plasmodium falciparum
IIDCAFTIAFNEKYDNL

SEQ ID NO: 3384348 - protein, 24 aa, Plasmodium falciparum
IIDDSTLTIYFYKLNIMKYHDTIE

SEQ ID NO: 3384349 - protein, 25 aa, Plasmodium falciparum
IIDIYNFFDILLNNNIPYYDFKIVQ

SEQ ID NO: 3384350 - protein, 33 aa, Plasmodium falciparum
IIDKALLRSGRFDQLIYISLPKYQGRVDILKKL

SEQ ID NO: 3384351 - protein, 25 aa, Plasmodium falciparum
IIDKNFILFYECLLKILLNIKFVNF

SEQ ID NO: 3384352 - protein, 24 aa, Plasmodium falciparum
IIDKNYIFKLPTAFFDTLGIFNVS

SEQ ID NO: 3384353 - protein, 18 aa, Plasmodium falciparum
IIDQIIFFNFIFTSDMMY

SEQ ID NO: 3384354 - protein, 19 aa, Plasmodium falciparum
IIDVKKQKFIIGSSYRKCD

SEQ ID NO: 3384355 - protein, 25 aa, Plasmodium falciparum
IIECVEILPQLKYGLDVNCKFTNIC

SEQ ID NO: 3384356 - protein, 31 aa, Plasmodium falciparum
IIEDDILIKTIPFPTFLFSDNIKKTKDINED

SEQ ID NO: 3384357 - protein, 33 aa, Plasmodium falciparum
IIEEPYKIKLLERKKWLWKTIIEIHMLILEEQR

SEQ ID NO: 3384358 - protein, 33 aa, Plasmodium falciparum
IIEERKIFYVGITRAKFLLYLLCSIQNNNSEKN

SEQ ID NO: 3384359 - protein, 18 aa, Plasmodium falciparum
IIEIIKYNKFYDLCVFSD

SEQ ID NO: 3384360 - protein, 28 aa, Plasmodium falciparum
IIEKIKLNEFFFRIKVYMTSHMDELKKN

SEQ ID NO: 3384361 - protein, 29 aa, Plasmodium falciparum
IIEKKVPLIVERVVPVLKVNRVEKEILTN

SEQ ID NO: 3384362 - protein, 23 aa, Plasmodium falciparum
IIEKYKLYKFLKKKKIEGYMILN

SEQ ID NO: 3384363 - protein, 26 aa, Plasmodium falciparum
IIELVYKIIHIYLFQDLTDMQNIQKK

SEQ ID NO: 3384364 - protein, 25 aa, Plasmodium falciparum
IIEMTLYNWMVFSGPITLRANKGIN

SEQ ID NO: 3384365 - protein, 20 aa, Plasmodium falciparum
IIENDVFPKILYLLKDNDDI

SEQ ID NO: 3384366 - protein, 30 aa, Plasmodium falciparum
IIENHDVILIYTFDYDIYLSIIKAKRNGKK

SEQ ID NO: 3384367 - protein, 48 aa, Plasmodium falciparum
IIENVSNVFNYVKNIYFVIIKNEKMMFYFLYNTKDVLNNIIYMENENK

SEQ ID NO: 3384368 - protein, 26 aa, Plasmodium falciparum
IIERLNEYYFCKIFQMPPAFSEGQNI

SEQ ID NO: 3384369 - protein, 36 aa, Plasmodium falciparum
IIEYLPPICESFLRYVLDIIILNPLHDIILSYDNNK

SEQ ID NO: 3384370 - protein, 19 aa, Plasmodium falciparum
IIFEKKKRIKSLKRNVILF

SEQ ID NO: 3384371 - protein, 23 aa, Plasmodium falciparum
IIFLMKHELKFLNYLKFYNIPIN

SEQ ID NO: 3384372 - protein, 19 aa, Plasmodium falciparum
IIFLNIYSLTHKRIYSILN

SEQ ID NO: 3384373 - protein, 18 aa, Plasmodium falciparum
IIFNRINNDILRDINMKK

SEQ ID NO: 3384374 - protein, 20 aa, Plasmodium falciparum
IIFYIFIHVTNKKSQVLFSV

SEQ ID NO: 3384375 - protein, 17 aa, Plasmodium falciparum
IIGLSKFSRIVDVFSRR

SEQ ID NO: 3384376 - protein, 25 aa, Plasmodium falciparum
IIGNILIFHYKYFECIMKLYKVYEG

SEQ ID NO: 3384377 - protein, 24 aa, Plasmodium falciparum
IIGNVLFPRFLSWEMKNNVNRLNL

SEQ ID NO: 3384378 - protein, 24 aa, Plasmodium falciparum
IIGQKYYLCFINQLIKHWKILNKK

SEQ ID NO: 3384379 - protein, 20 aa, Plasmodium falciparum
IIGRQYAIMKAFSILEALKE

SEQ ID NO: 3384380 - protein, 28 aa, Plasmodium falciparum
IIGTPGRILALIREKYLITDKIQHFVLD

SEQ ID NO: 3384381 - protein, 19 aa, Plasmodium falciparum
IIHFLSELQFLFTDKNFKV

SEQ ID NO: 3384382 - protein, 19 aa, Plasmodium falciparum
IIHIPKIEYRNKIVEIPVY

SEQ ID NO: 3384383 - protein, 19 aa, Plasmodium falciparum
IIHLNFNTNILYYDSTCPH

SEQ ID NO: 3384384 - protein, 34 aa, Plasmodium falciparum
IIHNKTNSHDLLWVPRCCNGSYGTFLKYNYSNMN

SEQ ID NO: 3384385 - protein, 30 aa, Plasmodium falciparum
IIHTKGIIPQIYYKIYFLADMENFDKKNYY

SEQ ID NO: 3384386 - protein, 24 aa, Plasmodium falciparum
IIIDNSFLHYSLKKYYHNINEDQQ

SEQ ID NO: 3384387 - protein, 19 aa, Plasmodium falciparum
IIIFYVCLHNFLKTSLNID

SEQ ID NO: 3384388 - protein, 19 aa, Plasmodium falciparum
IIINGFPRNYEQALLIIQN

SEQ ID NO: 3384389 - protein, 19 aa, Plasmodium falciparum
IIIPIITGYTHKFVPKWDI

SEQ ID NO: 3384390 - protein, 28 aa, Plasmodium falciparum
IIIPKGSYLYELIYPQTIHSFPVINKFN

SEQ ID NO: 3384391 - protein, 20 aa, Plasmodium falciparum
IIISKWFTIKEIKWIDNYYT

SEQ ID NO: 3384392 - protein, 17 aa, Plasmodium falciparum
IIIYLNTVGMEEELSLD

SEQ ID NO: 3384393 - protein, 25 aa, Plasmodium falciparum
IIKCRKILKWSYTYAYFSNWKSDNQ

SEQ ID NO: 3384394 - protein, 42 aa, Plasmodium falciparum
IIKDKIVNVILRPDLFTGLNRAAKGILLFGPPGTGKTMVAKW

SEQ ID NO: 3384395 - protein, 27 aa, Plasmodium falciparum
IIKFIRHFEGIYTPKLKILSKLKTKNV

SEQ ID NO: 3384396 - protein, 20 aa, Plasmodium falciparum
IIKKKIVFPKNRVNKFSTSV

SEQ ID NO: 3384397 - protein, 22 aa, Plasmodium falciparum
IIKKMYIFRYLTDKQCNLLIEA

SEQ ID NO: 3384398 - protein, 27 aa, Plasmodium falciparum
IIKKNFKLPCWIKIKNLRKNDLSNLTY

SEQ ID NO: 3384399 - protein, 19 aa, Plasmodium falciparum
IIKKNSYTYKVKDHSYYNY

SEQ ID NO: 3384400 - protein, 24 aa, Plasmodium falciparum
IIKKYNFLFVCCESPIIIYSDLKK

SEQ ID NO: 3384401 - protein, 20 aa, Plasmodium falciparum
IIKLILCEDSKKKNLRNIIS

SEQ ID NO: 3384402 - protein, 39 aa, Plasmodium falciparum
IIKNEKTITLPYIYKLIPLKYFGYKHKIKNISLGSFHTL

SEQ ID NO: 3384403 - protein, 18 aa, Plasmodium falciparum
IIKNILELERRKYAINCI

SEQ ID NO: 3384404 - protein, 25 aa, Plasmodium falciparum
IIKNNKMFFVIPNIIRRVLTIIRVE

SEQ ID NO: 3384405 - protein, 21 aa, Plasmodium falciparum
IIKNYEIYTWLLTNCNMQTDE

SEQ ID NO: 3384406 - protein, 20 aa, Plasmodium falciparum
IIKSIYVIDDFVLVKILSNE

SEQ ID NO: 3384407 - protein, 24 aa, Plasmodium falciparum
IIKSVHVYIIDFAHASLNKNQNDE

SEQ ID NO: 3384408 - protein, 25 aa, Plasmodium falciparum
IIKVQKKYDILRRKSIEKMNLRGAN

SEQ ID NO: 3384409 - protein, 17 aa, Plasmodium falciparum
IIKYFKEKKVKSVVDVG

SEQ ID NO: 3384410 - protein, 17 aa, Plasmodium falciparum
IIKYIIVTGGNMSGLGK

SEQ ID NO: 3384411 - protein, 26 aa, Plasmodium falciparum
IIKYNIFHLTYILVYTRTLDKKTKVK

SEQ ID NO: 3384412 - protein, 17 aa, Plasmodium falciparum
IIKYVPRNSKNIDWEDE

SEQ ID NO: 3384413 - protein, 18 aa, Plasmodium falciparum
IILCLNPSELKYFLKKSK

SEQ ID NO: 3384414 - protein, 21 aa, Plasmodium falciparum
IILHEFCFINYLLTIDIYNNS

SEQ ID NO: 3384415 - protein, 34 aa, Plasmodium falciparum
IILKKFELILRDLIKIYFIRFLYFEKKEENISIL

SEQ ID NO: 3384416 - protein, 17 aa, Plasmodium falciparum
IILYIEYDDKHINKEIL

SEQ ID NO: 3384417 - protein, 18 aa, Plasmodium falciparum
IIMDDVSGVILFYEDVIN

SEQ ID NO: 3384418 - protein, 17 aa, Plasmodium falciparum
IIMHPDFVEKYLQNKKN

SEQ ID NO: 3384419 - protein, 25 aa, Plasmodium falciparum
IINCNHILLFIKNKLLLTNLSFPNF

SEQ ID NO: 3384420 - protein, 18 aa, Plasmodium falciparum
IINDKPSNFFNYIYNIES

SEQ ID NO: 3384421 - protein, 24 aa, Plasmodium falciparum
IINDLLQMVHVWKKLLINDMQETK

SEQ ID NO: 3384422 - protein, 18 aa, Plasmodium falciparum
IINDSTSFLFLRKQKKKK

SEQ ID NO: 3384423 - protein, 23 aa, Plasmodium falciparum
IINFDLPYILNRGTALNLKKLKF

SEQ ID NO: 3384424 - protein, 24 aa, Plasmodium falciparum
IINFESLCIIPGKKVWCICINIMV

SEQ ID NO: 3384425 - protein, 20 aa, Plasmodium falciparum
IINFRKSYLHILLETVNFKY

SEQ ID NO: 3384426 - protein, 24 aa, Plasmodium falciparum
IINHFKKFCIPNFLKSVGKDILNF

SEQ ID NO: 3384427 - protein, 28 aa, Plasmodium falciparum
IINISQPSCVGTYKTFKDFYTHKVLKKN

SEQ ID NO: 3384428 - protein, 34 aa, Plasmodium falciparum
IINIYRNQFLFDNKFRFLLYELQQLILPHLKKSV

SEQ ID NO: 3384429 - protein, 24 aa, Plasmodium falciparum
IINKIKELNIILLQNKDEIDNLKQ

SEQ ID NO: 3384430 - protein, 19 aa, Plasmodium falciparum
IINKLIGFNLYDIHIYNIY

SEQ ID NO: 3384431 - protein, 18 aa, Plasmodium falciparum
IINKLPNIQKTKSFLVCP

SEQ ID NO: 3384432 - protein, 20 aa, Plasmodium falciparum
IINLIILCEIKLNNLYISQK

SEQ ID NO: 3384433 - protein, 34 aa, Plasmodium falciparum
IINNDMLIYGYGKYLLFFCLKDMKFIKIIDDHQS

SEQ ID NO: 3384434 - protein, 30 aa, Plasmodium falciparum
IINNPSHRIYKPPVFISKYIKDMNEDELND

SEQ ID NO: 3384435 - protein, 17 aa, Plasmodium falciparum
IINNSIKTKGFSVKKLG

SEQ ID NO: 3384436 - protein, 24 aa, Plasmodium falciparum
IINPYEFFIAYNYIEWDGKYVFDF

SEQ ID NO: 3384437 - protein, 26 aa, Plasmodium falciparum
IINQKRYIYFLLLNKKEEKAHICICS

SEQ ID NO: 3384438 - protein, 25 aa, Plasmodium falciparum
IINTYIFDITWRIVRDWMLLKDVPE

SEQ ID NO: 3384439 - protein, 27 aa, Plasmodium falciparum
IINYQTLYLVCKYLLYHNKEQLVQELF

SEQ ID NO: 3384440 - protein, 21 aa, Plasmodium falciparum
IINYYIYDMFSFVIKGEGIQC

SEQ ID NO: 3384441 - protein, 17 aa, Plasmodium falciparum
IIPTLRFQYEINMKAYI

SEQ ID NO: 3384442 - protein, 17 aa, Plasmodium falciparum
IIPTTINSNWIYCPIDG

SEQ ID NO: 3384443 - protein, 17 aa, Plasmodium falciparum
IIPVIKYTDNIIYVDCC

SEQ ID NO: 3384444 - protein, 25 aa, Plasmodium falciparum
IIQERTNIIKISPNDTLYYETDNIK

SEQ ID NO: 3384445 - protein, 20 aa, Plasmodium falciparum
IIQLINNLEVYLRNKMNINI

SEQ ID NO: 3384446 - protein, 18 aa, Plasmodium falciparum
IIQLYDSFYYKEHLIIVT

SEQ ID NO: 3384447 - protein, 33 aa, Plasmodium falciparum
IIQPYKMPMYNPNAYPPHPFYMNNNFAPYNNMP

SEQ ID NO: 3384448 - protein, 19 aa, Plasmodium falciparum
IIRILKELYIKNEVFLIHI

SEQ ID NO: 3384449 - protein, 18 aa, Plasmodium falciparum
IIRILRFKNNLISQRLLI

SEQ ID NO: 3384450 - protein, 18 aa, Plasmodium falciparum
IIRILYAYYDICLNILKN

SEQ ID NO: 3384451 - protein, 20 aa, Plasmodium falciparum
IIRKIFIESNLLCHHIVKLK

SEQ ID NO: 3384452 - protein, 26 aa, Plasmodium falciparum
IIRKNEVIFILKKNDYLLVLISIHFV

SEQ ID NO: 3384453 - protein, 20 aa, Plasmodium falciparum
IIRNYIDIMKYIYQEIYNRI

SEQ ID NO: 3384454 - protein, 21 aa, Plasmodium falciparum
IISDIDIFCSFGFICCSSIST

SEQ ID NO: 3384455 - protein, 42 aa, Plasmodium falciparum
IISHFHMDHIGALPFFTEILKYRGIILMSYPTKALSPILLLD

SEQ ID NO: 3384456 - protein, 34 aa, Plasmodium falciparum
IISIENFSITNYYGKLFILAKKVTVYLNIDHFDI

SEQ ID NO: 3384457 - protein, 24 aa, Plasmodium falciparum
IISIPYICSRWYRAPELLCGSMFY

SEQ ID NO: 3384458 - protein, 17 aa, Plasmodium falciparum
IISITFKNFPGLNQKYC

SEQ ID NO: 3384459 - protein, 29 aa, Plasmodium falciparum
IISKYNVHYYPYELYFNSYKNIYQEEKVL

SEQ ID NO: 3384460 - protein, 27 aa, Plasmodium falciparum
IISLYFDLCEIWLIQGNYRAILLLKII

SEQ ID NO: 3384461 - protein, 24 aa, Plasmodium falciparum
IISNFLTDVKYDLLKKVKINLIYL

SEQ ID NO: 3384462 - protein, 19 aa, Plasmodium falciparum
IISSITKYPLPIKNSLDAY

SEQ ID NO: 3384463 - protein, 17 aa, Plasmodium falciparum
IISVLKIEKQRALQNIN

SEQ ID NO: 3384464 - protein, 24 aa, Plasmodium falciparum
IITHKIYHPQVKIVKVSCGKRIIG

SEQ ID NO: 3384465 - protein, 28 aa, Plasmodium falciparum
IITNRIDGFWVYKVSPLLKVKGILNITN

SEQ ID NO: 3384466 - protein, 20 aa, Plasmodium falciparum
IITPFNVWYRYKGEWKEDIE

SEQ ID NO: 3384467 - protein, 17 aa, Plasmodium falciparum
IIVICYQCNNRNITNIE

SEQ ID NO: 3384468 - protein, 19 aa, Plasmodium falciparum
IIVLLLSINKPNDSILYSK

SEQ ID NO: 3384469 - protein, 19 aa, Plasmodium falciparum
IIYAWSIKEGFIKSRISCL

SEQ ID NO: 3384470 - protein, 18 aa, Plasmodium falciparum
IIYDCSCIYMTFSNSKLE

SEQ ID NO: 3384471 - protein, 20 aa, Plasmodium falciparum
IIYEIMHCLIKLDKKKKQKK

SEQ ID NO: 3384472 - protein, 22 aa, Plasmodium falciparum
IIYFNMNLFLIEAYGYGDIFNI

SEQ ID NO: 3384473 - protein, 22 aa, Plasmodium falciparum
IIYKENITFLTYFYSCINIIKE

SEQ ID NO: 3384474 - protein, 17 aa, Plasmodium falciparum
IIYKSLKYVPSLFDCTF

SEQ ID NO: 3384475 - protein, 26 aa, Plasmodium falciparum
IKCICPSRNFFGMRSYLRDISKGTSI

SEQ ID NO: 3384476 - protein, 34 aa, Plasmodium falciparum
IKCIKPQYDYILEYFLKKYFNSFLLIQKDNKELL

SEQ ID NO: 3384477 - protein, 18 aa, Plasmodium falciparum
IKCPICQGILKYGILNKK

SEQ ID NO: 3384478 - protein, 20 aa, Plasmodium falciparum
IKCSWLCQRKYLKNVKDLLK

SEQ ID NO: 3384479 - protein, 22 aa, Plasmodium falciparum
IKDEHAFYGSFLNKEKMNNKIK

SEQ ID NO: 3384480 - protein, 18 aa, Plasmodium falciparum
IKDFKFALVWGRSTKHNP

SEQ ID NO: 3384481 - protein, 22 aa, Plasmodium falciparum
IKDFNFFVNFLKQNIYSHTYCF

SEQ ID NO: 3384482 - protein, 27 aa, Plasmodium falciparum
IKDGYKYLFFFQDTNALALKVLFVCLG

SEQ ID NO: 3384483 - protein, 18 aa, Plasmodium falciparum
IKDIFLYGVNLNVDIFIL

SEQ ID NO: 3384484 - protein, 20 aa, Plasmodium falciparum
IKDILLTEPPLCSISHRKKM

SEQ ID NO: 3384485 - protein, 21 aa, Plasmodium falciparum
IKDIYTYWKNKRKKLGRPLLR

SEQ ID NO: 3384486 - protein, 30 aa, Plasmodium falciparum
IKDKVTNNSLQYGFIEFEKKEDCLNAYFEM

SEQ ID NO: 3384487 - protein, 29 aa, Plasmodium falciparum
IKDNFIITEKIINSLLYSDPFMNINSYYY

SEQ ID NO: 3384488 - protein, 23 aa, Plasmodium falciparum
IKDNYILNRLSVFQVLKLLSSIV

SEQ ID NO: 3384489 - protein, 27 aa, Plasmodium falciparum
IKDSNKLFTILFTILNVGNTLNYGDAQ

SEQ ID NO: 3384490 - protein, 27 aa, Plasmodium falciparum
IKDVAPLLYYFTYFNLYSSFYFEKQMS

SEQ ID NO: 3384491 - protein, 33 aa, Plasmodium falciparum
IKEDRKYCFNLLYEEQPYKALLLKNDMGINSSE

SEQ ID NO: 3384492 - protein, 23 aa, Plasmodium falciparum
IKEDTHFVLYKKNSLIKEQDIYT

SEQ ID NO: 3384493 - protein, 17 aa, Plasmodium falciparum
IKEEHIKEWIPINKLYI

SEQ ID NO: 3384494 - protein, 27 aa, Plasmodium falciparum
IKEENTFIYFCRCGDFFIFNENLCYEY

SEQ ID NO: 3384495 - protein, 18 aa, Plasmodium falciparum
IKEFINFLKLNFPEENLE

SEQ ID NO: 3384496 - protein, 19 aa, Plasmodium falciparum
IKEFYYLNETDKKPFPICL

SEQ ID NO: 3384497 - protein, 24 aa, Plasmodium falciparum
IKEIELQFLIIQNVTHENKGIPIS

SEQ ID NO: 3384498 - protein, 23 aa, Plasmodium falciparum
IKEKHKYYKFIKGKKYTSSIKSR

SEQ ID NO: 3384499 - protein, 28 aa, Plasmodium falciparum
IKEKRILIWLTQILTALKFLHSNHILHR

SEQ ID NO: 3384500 - protein, 17 aa, Plasmodium falciparum
IKESLEYGELLLSNVKE

SEQ ID NO: 3384501 - protein, 22 aa, Plasmodium falciparum
IKEYQIIDYFFQPNECSHPLKD

SEQ ID NO: 3384502 - protein, 25 aa, Plasmodium falciparum
IKFDKKQFFFFPSNIKKKKMNKKYH

SEQ ID NO: 3384503 - protein, 23 aa, Plasmodium falciparum
IKFKDFLFYKYECYITEGVIKEI

SEQ ID NO: 3384504 - protein, 21 aa, Plasmodium falciparum
IKFLLVLDRIRYAYNLGKILN

SEQ ID NO: 3384505 - protein, 24 aa, Plasmodium falciparum
IKGKLYLHIHKLFINKLMTSNIRK

SEQ ID NO: 3384506 - protein, 29 aa, Plasmodium falciparum
IKGKSKELNLLIKNLLNLSAKERPSALQC

SEQ ID NO: 3384507 - protein, 17 aa, Plasmodium falciparum
IKGKSKTFLLISFTPNE

SEQ ID NO: 3384508 - protein, 24 aa, Plasmodium falciparum
IKGNHINFFSINKILNKTSMNDNL

SEQ ID NO: 3384509 - protein, 41 aa, Plasmodium falciparum
IKGNTIYSFLDIDLLPTPLLFYLYDNFKILQTLICKNSKEL

SEQ ID NO: 3384510 - protein, 25 aa, Plasmodium falciparum
IKGRLIVDIYLLCKDSIKLTTYCLD

SEQ ID NO: 3384511 - protein, 21 aa, Plasmodium falciparum
IKGTPIKIYYKQKKLRKIINK

SEQ ID NO: 3384512 - protein, 18 aa, Plasmodium falciparum
IKHFENCNHFAKCNKILA

SEQ ID NO: 3384513 - protein, 17 aa, Plasmodium falciparum
IKHFFDYNKYRSKCNVT

SEQ ID NO: 3384514 - protein, 24 aa, Plasmodium falciparum
IKHFNMFQLLLIIKGLYESRMLIN

SEQ ID NO: 3384515 - protein, 33 aa, Plasmodium falciparum
IKHKIKKRTLLPKYIFDKITFFEFENGQRIWRS

SEQ ID NO: 3384516 - protein, 19 aa, Plasmodium falciparum
IKHNQFIHLIIYDGFNKKI

SEQ ID NO: 3384517 - protein, 23 aa, Plasmodium falciparum
IKHRSFHNIYKQINIINDQIDLI

SEQ ID NO: 3384518 - protein, 20 aa, Plasmodium falciparum
IKICHNISLCYYFLEDFEKS

SEQ ID NO: 3384519 - protein, 21 aa, Plasmodium falciparum
IKIDRICEYLNYTTNTMWRYM

SEQ ID NO: 3384520 - protein, 20 aa, Plasmodium falciparum
IKIEDFLFNEYLKKVSVRSQ

SEQ ID NO: 3384521 - protein, 17 aa, Plasmodium falciparum
IKIILMSATFDINIFNQ

SEQ ID NO: 3384522 - protein, 28 aa, Plasmodium falciparum
IKIKFKSMICMNNFLKAYKNTPDKWKED

SEQ ID NO: 3384523 - protein, 17 aa, Plasmodium falciparum
IKIKRLCEKIEGFEKEI

SEQ ID NO: 3384524 - protein, 37 aa, Plasmodium falciparum
IKINIHKQFLHVTDFLYHLILHIYTKFTEKNNKLKFL

SEQ ID NO: 3384525 - protein, 28 aa, Plasmodium falciparum
IKIQIINQDILPFKNLEKPLIPLSSIKN

SEQ ID NO: 3384526 - protein, 17 aa, Plasmodium falciparum
IKIQRAFKKYMKKKYIL

SEQ ID NO: 3384527 - protein, 27 aa, Plasmodium falciparum
IKKATILRIFFWVIGQYMFNEHMIINF

SEQ ID NO: 3384528 - protein, 18 aa, Plasmodium falciparum
IKKDIYLLNIRDSQNKRD

SEQ ID NO: 3384529 - protein, 23 aa, Plasmodium falciparum
IKKELLIIVQKMQNLYVKREELK

SEQ ID NO: 3384530 - protein, 26 aa, Plasmodium falciparum
IKKHPFFKNINWNDVLYKKVKPPFKP

SEQ ID NO: 3384531 - protein, 17 aa, Plasmodium falciparum
IKKIFYTFICESKYQLL

SEQ ID NO: 3384532 - protein, 31 aa, Plasmodium falciparum
IKKIYGSLYKVKKKKKIYFKLGHKKKNKKNN

SEQ ID NO: 3384533 - protein, 19 aa, Plasmodium falciparum
IKKKIICDKIKGIEKLKEP

SEQ ID NO: 3384534 - protein, 24 aa, Plasmodium falciparum
IKKKIKNFKPHKIQFFITIKSNNT

SEQ ID NO: 3384535 - protein, 25 aa, Plasmodium falciparum
IKKKKFIRFTLIKSQKNIKYLYSYS

SEQ ID NO: 3384536 - protein, 24 aa, Plasmodium falciparum
IKKKKIIIRKLPPTLTEENFFDSF

SEQ ID NO: 3384537 - protein, 23 aa, Plasmodium falciparum
IKKKKKKFLFKKKQLMNDTDENS

SEQ ID NO: 3384538 - protein, 30 aa, Plasmodium falciparum
IKKKKKKIRFPIRRIPPNEYYPNIHSIKFL

SEQ ID NO: 3384539 - protein, 27 aa, Plasmodium falciparum
IKKKKNGFIYLVKWKGYSDDENTWEPE

SEQ ID NO: 3384540 - protein, 17 aa, Plasmodium falciparum
IKKKRIKMRNHEKKRKI

SEQ ID NO: 3384541 - protein, 24 aa, Plasmodium falciparum
IKKKTLFLFGTYNLGKEKIYLSLS

SEQ ID NO: 3384542 - protein, 25 aa, Plasmodium falciparum
IKKLESLGFPKHVALEAFIACDKNE

SEQ ID NO: 3384543 - protein, 33 aa, Plasmodium falciparum
IKKMFIIEGGGDFLLFLNIYKQCEENNFSTSFC

SEQ ID NO: 3384544 - protein, 21 aa, Plasmodium falciparum
IKKNFLLNLSKENIFHKGNIG

SEQ ID NO: 3384545 - protein, 31 aa, Plasmodium falciparum
IKKNIIKLEKTFLDNVLLQVKKKNIAGNKNT

SEQ ID NO: 3384546 - protein, 28 aa, Plasmodium falciparum
IKKNLPDIIFIQFLNRILYKLDKTILKY

SEQ ID NO: 3384547 - protein, 29 aa, Plasmodium falciparum
IKKNMWTHKFHYIYPYVHFMGTKHKQNNK

SEQ ID NO: 3384548 - protein, 28 aa, Plasmodium falciparum
IKKRISFTGFYLQNLFAYSIANSVNADI

SEQ ID NO: 3384549 - protein, 17 aa, Plasmodium falciparum
IKKRKTIKQIKNLQWEK

SEQ ID NO: 3384550 - protein, 29 aa, Plasmodium falciparum
IKKSIVMLEVLRVLLCVLYYTQNVEGVTN

SEQ ID NO: 3384551 - protein, 22 aa, Plasmodium falciparum
IKKSIVSAFFTNAALPVNKTEL

SEQ ID NO: 3384552 - protein, 23 aa, Plasmodium falciparum
IKKTLHDLIFILKKFLENNMNKK

SEQ ID NO: 3384553 - protein, 19 aa, Plasmodium falciparum
IKKVIFIKTFMKALNILNE

SEQ ID NO: 3384554 - protein, 23 aa, Plasmodium falciparum
IKKVKVIPGKWEGNGLLGIHISY

SEQ ID NO: 3384555 - protein, 19 aa, Plasmodium falciparum
IKKYFIFERYNDKITIDMI

SEQ ID NO: 3384556 - protein, 27 aa, Plasmodium falciparum
IKLASECVFNFLLNYNKSNLHDLSNIG

SEQ ID NO: 3384557 - protein, 30 aa, Plasmodium falciparum
IKLDCPLCYDIFLKYLRFSILDNIIDKNYI

SEQ ID NO: 3384558 - protein, 24 aa, Plasmodium falciparum
IKLDHRSICLFSEKFNLIQTNDKL

SEQ ID NO: 3384559 - protein, 30 aa, Plasmodium falciparum
IKLEDIDLPPFYFDLIINPIPSYKIRKFNK

SEQ ID NO: 3384560 - protein, 26 aa, Plasmodium falciparum
IKLESRNMIYEYYKNLDVNECTVHII

SEQ ID NO: 3384561 - protein, 20 aa, Plasmodium falciparum
IKLNNKPSLKWRLINKESNF

SEQ ID NO: 3384562 - protein, 17 aa, Plasmodium falciparum
IKLVKKKEKLSKKGILK

SEQ ID NO: 3384563 - protein, 24 aa, Plasmodium falciparum
IKLVNIGHKLNTLMRSHYERIYDC

SEQ ID NO: 3384564 - protein, 20 aa, Plasmodium falciparum
IKLWDVKYRYIIQTYRGHKQ

SEQ ID NO: 3384565 - protein, 20 aa, Plasmodium falciparum
IKLYDYLSFINFVTFTAHTN

SEQ ID NO: 3384566 - protein, 24 aa, Plasmodium falciparum
IKNDIFGNLVFLDGSYKNMTNKMN

SEQ ID NO: 3384567 - protein, 21 aa, Plasmodium falciparum
IKNDKLLWDINTDDFHIFNLQ

SEQ ID NO: 3384568 - protein, 24 aa, Plasmodium falciparum
IKNESEFEYLLELSDKEGPNLDNP

SEQ ID NO: 3384569 - protein, 25 aa, Plasmodium falciparum
IKNFKDMKFPKAILKGLRKKNIKKP

SEQ ID NO: 3384570 - protein, 19 aa, Plasmodium falciparum
IKNFKNEYYWSIKMKYVYN

SEQ ID NO: 3384571 - protein, 28 aa, Plasmodium falciparum
IKNGKKQIFFLFPLKSLINEKMTYLKNI

SEQ ID NO: 3384572 - protein, 20 aa, Plasmodium falciparum
IKNHHTYYLKNSFLNEIGAC

SEQ ID NO: 3384573 - protein, 35 aa, Plasmodium falciparum
IKNIKNPLIVFDSFEDYIMDIKWSPTHPALFSTCS

SEQ ID NO: 3384574 - protein, 31 aa, Plasmodium falciparum
IKNIKTQVSDLLLLMQQYAIIYHNIKFVIYN

SEQ ID NO: 3384575 - protein, 19 aa, Plasmodium falciparum
IKNISEIISFLSYIKEHSL

SEQ ID NO: 3384576 - protein, 23 aa, Plasmodium falciparum
IKNIWKDDFFITSLPLSAHSIIS

SEQ ID NO: 3384577 - protein, 33 aa, Plasmodium falciparum
IKNKEKYQSLLQQFIIILKHHDNLYLQKREKLI

SEQ ID NO: 3384578 - protein, 26 aa, Plasmodium falciparum
IKNKGTINYSFKYPPKSNLKNNMKSN

SEQ ID NO: 3384579 - protein, 18 aa, Plasmodium falciparum
IKNKMYDYFDYEKNNMIH

SEQ ID NO: 3384580 - protein, 25 aa, Plasmodium falciparum
IKNKNDNILRHLNVRRKRIVQSSDE

SEQ ID NO: 3384581 - protein, 22 aa, Plasmodium falciparum
IKNKNIYLYKISNDNLKTCSNY

SEQ ID NO: 3384582 - protein, 27 aa, Plasmodium falciparum
IKNKYIHLLNMNLNFVQLLLKITNAFN

SEQ ID NO: 3384583 - protein, 23 aa, Plasmodium falciparum
IKNLLFINQYTNLILKNLYIENL

SEQ ID NO: 3384584 - protein, 24 aa, Plasmodium falciparum
IKNLYILPMTTIKMNISTGIVPCV

SEQ ID NO: 3384585 - protein, 17 aa, Plasmodium falciparum
IKNLYKAKNLRILCLSN

SEQ ID NO: 3384586 - protein, 24 aa, Plasmodium falciparum
IKNMLKKAEDILYTNRINNLYNNN

SEQ ID NO: 3384587 - protein, 18 aa, Plasmodium falciparum
IKNNSMPYSIRKNKLSYN

SEQ ID NO: 3384588 - protein, 17 aa, Plasmodium falciparum
IKNRSSTRITNAPGGNS

SEQ ID NO: 3384589 - protein, 33 aa, Plasmodium falciparum
IKNTLRIRNNTKHIFIYLITHTNIVKHKNKTFS

SEQ ID NO: 3384590 - protein, 29 aa, Plasmodium falciparum
IKNVEKNFLLYYTYIFFNYDKNDLNNNNS

SEQ ID NO: 3384591 - protein, 17 aa, Plasmodium falciparum
IKNVFSNDIIRYRDKDH

SEQ ID NO: 3384592 - protein, 24 aa, Plasmodium falciparum
IKNVKSFCLAFYYALNKKHAEAHV

SEQ ID NO: 3384593 - protein, 26 aa, Plasmodium falciparum
IKNYFTYEILLQRKIKTLLLPNVSLI

SEQ ID NO: 3384594 - protein, 22 aa, Plasmodium falciparum
IKNYKKRLLKIEKNITLLDIYK

SEQ ID NO: 3384595 - protein, 17 aa, Plasmodium falciparum
IKNYSWIVKEVIAIIIL

SEQ ID NO: 3384596 - protein, 18 aa, Plasmodium falciparum
IKNYVYLDAMFFGMSMCC

SEQ ID NO: 3384597 - protein, 30 aa, Plasmodium falciparum
IKPKRHYDLLCRILFIYAKIHPYVKYVQGM

SEQ ID NO: 3384598 - protein, 26 aa, Plasmodium falciparum
IKPKYEKYFYNFIKNVSLNDNKNMYD

SEQ ID NO: 3384599 - protein, 26 aa, Plasmodium falciparum
IKPLCICCFDILLNLIGINTIICISC

SEQ ID NO: 3384600 - protein, 25 aa, Plasmodium falciparum
IKPLIIDLYENGCVCSCFAYGQTGS

SEQ ID NO: 3384601 - protein, 36 aa, Plasmodium falciparum
IKPYIKELRNISSGKRIAWKLAKKHPLLNADINNQY

SEQ ID NO: 3384602 - protein, 25 aa, Plasmodium falciparum
IKQKSYIDLINFSKGLYLCLSNTSP

SEQ ID NO: 3384603 - protein, 30 aa, Plasmodium falciparum
IKQLEEVLHKHFILLKNLRKKNLSLNLNNL

SEQ ID NO: 3384604 - protein, 29 aa, Plasmodium falciparum
IKQNEELVQLVKIPNLKTPLIVLDNIIGQ

SEQ ID NO: 3384605 - protein, 19 aa, Plasmodium falciparum
IKRENILGFLIDNINVDKT

SEQ ID NO: 3384606 - protein, 23 aa, Plasmodium falciparum
IKRIPINLKYFLSTDKWGFNIWS

SEQ ID NO: 3384607 - protein, 26 aa, Plasmodium falciparum
IKRKKINDIINKYKKKMIIPSYEEND

SEQ ID NO: 3384608 - protein, 24 aa, Plasmodium falciparum
IKRKKYLSVFILLSKLSPSIINDT

SEQ ID NO: 3384609 - protein, 35 aa, Plasmodium falciparum
IKRKPNDFLYLLVKYKHLNKWMFPIMDFKKNYSIR

SEQ ID NO: 3384610 - protein, 25 aa, Plasmodium falciparum
IKRNKGFAFITFKNSNDATSSLILN

SEQ ID NO: 3384611 - protein, 26 aa, Plasmodium falciparum
IKRPNNNLFFEVIRGKKRKNMQGFEC

SEQ ID NO: 3384612 - protein, 21 aa, Plasmodium falciparum
IKRQRVLRRLLKRLRDSKKVD

SEQ ID NO: 3384613 - protein, 31 aa, Plasmodium falciparum
IKRTPFCIYSLNDICNHLRYGKKSANSINGM

SEQ ID NO: 3384614 - protein, 21 aa, Plasmodium falciparum
IKSEFLSFLIEEMKYDILNSK

SEQ ID NO: 3384615 - protein, 26 aa, Plasmodium falciparum
IKSEKRIRKYRTKKMLLKEAMEKGIS

SEQ ID NO: 3384616 - protein, 25 aa, Plasmodium falciparum
IKSELECFITSFNNLKKLKMKNEEI

SEQ ID NO: 3384617 - protein, 30 aa, Plasmodium falciparum
IKSFEIDLTHIFFFNKKLYKLIIEYPSDCI

SEQ ID NO: 3384618 - protein, 34 aa, Plasmodium falciparum
IKSFFNSLFSKRFGISILGIIYNGFSSNKYLLSN

SEQ ID NO: 3384619 - protein, 29 aa, Plasmodium falciparum
IKSKKLSIYFYWFLLSEAKDKIKGKLYLH

SEQ ID NO: 3384620 - protein, 17 aa, Plasmodium falciparum
IKSLYSFTPLQLTNVIY

SEQ ID NO: 3384621 - protein, 25 aa, Plasmodium falciparum
IKSSNKIIGLYNYSRYYGLREDLCK

SEQ ID NO: 3384622 - protein, 26 aa, Plasmodium falciparum
IKSSNLKTFIDHLNFFQSKCKANKGF

SEQ ID NO: 3384623 - protein, 28 aa, Plasmodium falciparum
IKSTQNYSPLFHRSIHKFELKKNLSNIR

SEQ ID NO: 3384624 - protein, 29 aa, Plasmodium falciparum
IKSYLTSFLARIFTIFSISKIYIYDDYLE

SEQ ID NO: 3384625 - protein, 18 aa, Plasmodium falciparum
IKSYNPYFNYIQTNDKIS

SEQ ID NO: 3384626 - protein, 22 aa, Plasmodium falciparum
IKTCDYTYSFLPTLDQDYSSIL

SEQ ID NO: 3384627 - protein, 22 aa, Plasmodium falciparum
IKTFYFEEFDFNFVLLGSVKKG

SEQ ID NO: 3384628 - protein, 19 aa, Plasmodium falciparum
IKTGYFYFRSGVPVITPHI

SEQ ID NO: 3384629 - protein, 23 aa, Plasmodium falciparum
IKTPLLIFATGFKKDNFSLNFYN

SEQ ID NO: 3384630 - protein, 23 aa, Plasmodium falciparum
IKTVKIIYDKNLKPRGYAFIEFE

SEQ ID NO: 3384631 - protein, 20 aa, Plasmodium falciparum
IKYAWRIIYDLLKGSSHMKK

SEQ ID NO: 3384632 - protein, 17 aa, Plasmodium falciparum
IKYCLKLAFYNIYNEIY

SEQ ID NO: 3384633 - protein, 26 aa, Plasmodium falciparum
IKYCRNLWYYNYFSRDININNYAFKK

SEQ ID NO: 3384634 - protein, 23 aa, Plasmodium falciparum
IKYDLEGFFPTSNQYRELVSCSN

SEQ ID NO: 3384635 - protein, 34 aa, Plasmodium falciparum
IKYHEACENFSILFKIFYDSLIYIVKKNEEADHV

SEQ ID NO: 3384636 - protein, 18 aa, Plasmodium falciparum
IKYKFLEDCIYLLKEERG

SEQ ID NO: 3384637 - protein, 20 aa, Plasmodium falciparum
IKYKTPRALNPKHSKVMKLL

SEQ ID NO: 3384638 - protein, 17 aa, Plasmodium falciparum
IKYLLLYDNFCTNNNKI

SEQ ID NO: 3384639 - protein, 25 aa, Plasmodium falciparum
IKYLRNLPCWNLLKLNPIHPNNIHH

SEQ ID NO: 3384640 - protein, 19 aa, Plasmodium falciparum
ILCDNKNLIFYYGHKKSVT

SEQ ID NO: 3384641 - protein, 31 aa, Plasmodium falciparum
ILCKQFIKFTVPCYHIFLKRNQINSIRQKQS

SEQ ID NO: 3384642 - protein, 30 aa, Plasmodium falciparum
ILCTFRQDFINYVIFLFSKRLHKENQIEPV

SEQ ID NO: 3384643 - protein, 30 aa, Plasmodium falciparum
ILDDFCYMTYIIKTLYFRFQSRSIRNMLKS

SEQ ID NO: 3384644 - protein, 30 aa, Plasmodium falciparum
ILDEEKIQLHNYMDYLYDIKNNNVDSSEIL

SEQ ID NO: 3384645 - protein, 17 aa, Plasmodium falciparum
ILDIGCGNGLFLYKLYE

SEQ ID NO: 3384646 - protein, 26 aa, Plasmodium falciparum
ILDIHNRLPIHSACLGGVLENVKILV

SEQ ID NO: 3384647 - protein, 34 aa, Plasmodium falciparum
ILDILCTEAIRKIKFILHILNELLKKKKNILHVY

SEQ ID NO: 3384648 - protein, 18 aa, Plasmodium falciparum
ILDIPLKESIERTKKFID

SEQ ID NO: 3384649 - protein, 17 aa, Plasmodium falciparum
ILDIYKQGNMYMHIPKN

SEQ ID NO: 3384650 - protein, 41 aa, Plasmodium falciparum
ILDKGEIYLYMKSVERAHLPSALWSRVLLSLNKKEAFNVIY

SEQ ID NO: 3384651 - protein, 17 aa, Plasmodium falciparum
ILDKINQMHYIHSNKKK

SEQ ID NO: 3384652 - protein, 27 aa, Plasmodium falciparum
ILDNTYKYIIYFIDKKIYDNAIKSIND

SEQ ID NO: 3384653 - protein, 26 aa, Plasmodium falciparum
ILDRSTKRVSILDKLNLGLKNKGNDK

SEQ ID NO: 3384654 - protein, 18 aa, Plasmodium falciparum
ILDTNISIIINKLKNDYI

SEQ ID NO: 3384655 - protein, 22 aa, Plasmodium falciparum
ILEELLEILGLYISNVPCLIIS

SEQ ID NO: 3384656 - protein, 20 aa, Plasmodium falciparum
ILEFVIYQSGVDLGLEFTLK

SEQ ID NO: 3384657 - protein, 26 aa, Plasmodium falciparum
ILEGDYCEYFYFIKQGQISIQKFNQH

SEQ ID NO: 3384658 - protein, 27 aa, Plasmodium falciparum
ILEHMYYKPEMLFKQIWTYLMNGKEML

SEQ ID NO: 3384659 - protein, 19 aa, Plasmodium falciparum
ILEKFGLSYKKSEKTSLGC

SEQ ID NO: 3384660 - protein, 23 aa, Plasmodium falciparum
ILEKHFIFDIKIPRAVYAYKTNR

SEQ ID NO: 3384661 - protein, 19 aa, Plasmodium falciparum
ILEKLLIHIQKLDKKENLT

SEQ ID NO: 3384662 - protein, 23 aa, Plasmodium falciparum
ILENGYFLTFKKHVSVLANELRS

SEQ ID NO: 3384663 - protein, 26 aa, Plasmodium falciparum
ILENINKYIIMPEFVIILKSTEELCK

SEQ ID NO: 3384664 - protein, 24 aa, Plasmodium falciparum
ILERLFVIYLCVLKEYEKHPPKIL

SEQ ID NO: 3384665 - protein, 24 aa, Plasmodium falciparum
ILEVVDFMSLLHHLTEHPVASYNE

SEQ ID NO: 3384666 - protein, 19 aa, Plasmodium falciparum
ILGDIPDADMKPPENILFV

SEQ ID NO: 3384667 - protein, 20 aa, Plasmodium falciparum
ILGGIIITPTRELVFQIFEV

SEQ ID NO: 3384668 - protein, 20 aa, Plasmodium falciparum
ILGIPLCHIMKIKKKNKNVA

SEQ ID NO: 3384669 - protein, 22 aa, Plasmodium falciparum
ILGSEKALFRALKTKSKTPKYG

SEQ ID NO: 3384670 - protein, 29 aa, Plasmodium falciparum
ILHEIQVRWKSLTKMWYKKNKNKYDTSKI

SEQ ID NO: 3384671 - protein, 27 aa, Plasmodium falciparum
ILHLTFTPRKIVPLPFPSLFYDHDSSL

SEQ ID NO: 3384672 - protein, 19 aa, Plasmodium falciparum
ILHTNILENYNFNWNKKKD

SEQ ID NO: 3384673 - protein, 20 aa, Plasmodium falciparum
ILIEHFYKNKNLYNNTWESL

SEQ ID NO: 3384674 - protein, 21 aa, Plasmodium falciparum
ILIGLKYLFDNIDEINFLILN

SEQ ID NO: 3384675 - protein, 18 aa, Plasmodium falciparum
ILIHFIQNNIILTNSMDT

SEQ ID NO: 3384676 - protein, 17 aa, Plasmodium falciparum
ILIINCIDKLIMDLRLP

SEQ ID NO: 3384677 - protein, 30 aa, Plasmodium falciparum
ILIITSILNIMKWKSLFFTFSNITIYKNEE

SEQ ID NO: 3384678 - protein, 18 aa, Plasmodium falciparum
ILIKNIPKLVPNWKKPIV

SEQ ID NO: 3384679 - protein, 17 aa, Plasmodium falciparum
ILINKLCKKKSFSGLKL

SEQ ID NO: 3384680 - protein, 18 aa, Plasmodium falciparum
ILISSVFGRIKWLKIMNE

SEQ ID NO: 3384681 - protein, 25 aa, Plasmodium falciparum
ILKEFKKYMNLIIQDGYTCAYYKDK

SEQ ID NO: 3384682 - protein, 26 aa, Plasmodium falciparum
ILKEKKSHIILLKEDLHFLNDEYDNI

SEQ ID NO: 3384683 - protein, 17 aa, Plasmodium falciparum
ILKGYDIILLRYSYEVI

SEQ ID NO: 3384684 - protein, 19 aa, Plasmodium falciparum
ILKILHLHNSVLYTYPSLN

SEQ ID NO: 3384685 - protein, 17 aa, Plasmodium falciparum
ILKKFENIIFYGNTQSD

SEQ ID NO: 3384686 - protein, 27 aa, Plasmodium falciparum
ILKKHKDLVFFLKKQQLLKLILNNNIN

SEQ ID NO: 3384687 - protein, 20 aa, Plasmodium falciparum
ILKKLYEHIFNKKIYELINV

SEQ ID NO: 3384688 - protein, 25 aa, Plasmodium falciparum
ILKLDNFLDMILNYSYYLLNDSCNK

SEQ ID NO: 3384689 - protein, 18 aa, Plasmodium falciparum
ILKLKKIATLLKKEYNKL

SEQ ID NO: 3384690 - protein, 17 aa, Plasmodium falciparum
ILKLLKVSNNKLIQNLY

SEQ ID NO: 3384691 - protein, 18 aa, Plasmodium falciparum
ILKLMYNNNGIYFDDDDE

SEQ ID NO: 3384692 - protein, 17 aa, Plasmodium falciparum
ILKMIIKYENFNSIMNQ

SEQ ID NO: 3384693 - protein, 20 aa, Plasmodium falciparum
ILKNILYLENVIEKYNIHMS

SEQ ID NO: 3384694 - protein, 19 aa, Plasmodium falciparum
ILKNIPRYNNMSSNYLLNL

SEQ ID NO: 3384695 - protein, 25 aa, Plasmodium falciparum
ILKNRKYLDILLNIINIFIDKYENK

SEQ ID NO: 3384696 - protein, 24 aa, Plasmodium falciparum
ILKPHLWNLPWRKYYENKINKIYK

SEQ ID NO: 3384697 - protein, 32 aa, Plasmodium falciparum
ILKQEFANIEECFKIHTSSINYMKVKGKGECC

SEQ ID NO: 3384698 - protein, 46 aa, Plasmodium falciparum
ILKSKRFLNVALFYDLIYNFLYKNNIFLKYFFSFSGGRFIKTFIDY

SEQ ID NO: 3384699 - protein, 24 aa, Plasmodium falciparum
ILKTNLIMMKILYNIYYAYFSSSF

SEQ ID NO: 3384700 - protein, 25 aa, Plasmodium falciparum
ILLSVICVSLTKLYLKLLSKMNNSF

SEQ ID NO: 3384701 - protein, 17 aa, Plasmodium falciparum
ILLSYFGMEFNGSAYQK

SEQ ID NO: 3384702 - protein, 21 aa, Plasmodium falciparum
ILLTMIRICIFYNDVKNLKKY

SEQ ID NO: 3384703 - protein, 36 aa, Plasmodium falciparum
ILMNPNFHIFSTYKGNILFFDLRCMLPIYQNNNLHS

SEQ ID NO: 3384704 - protein, 21 aa, Plasmodium falciparum
ILNDIYMPYRILLSKDKNYVS

SEQ ID NO: 3384705 - protein, 17 aa, Plasmodium falciparum
ILNIRKMNISTLCNILY

SEQ ID NO: 3384706 - protein, 18 aa, Plasmodium falciparum
ILNISKLPKCDILKRTNR

SEQ ID NO: 3384707 - protein, 20 aa, Plasmodium falciparum
ILNKINVNKIYYHKMNHPDE

SEQ ID NO: 3384708 - protein, 29 aa, Plasmodium falciparum
ILNKKNFFLILNYLLYIFNHNLNLLMKDK

SEQ ID NO: 3384709 - protein, 35 aa, Plasmodium falciparum
ILNLTQEEFIYISNKIHFLGFRFIEIPCVKTKNEK

SEQ ID NO: 3384710 - protein, 17 aa, Plasmodium falciparum
ILNLYKIKKTNKAIILV

SEQ ID NO: 3384711 - protein, 21 aa, Plasmodium falciparum
ILNNIFIYAPVDLFALHIHYY

SEQ ID NO: 3384712 - protein, 33 aa, Plasmodium falciparum
ILNNSQMLEAFIQGRLCLSCDSLDHPMPLCPNN

SEQ ID NO: 3384713 - protein, 20 aa, Plasmodium falciparum
ILPDHAYPKWLWKLEKPLKS

SEQ ID NO: 3384714 - protein, 29 aa, Plasmodium falciparum
ILPENKEYVIKLFFGNLAPITTEKDMHNL

SEQ ID NO: 3384715 - protein, 23 aa, Plasmodium falciparum
ILPGEFFNEKINECLNLLDKIAQ

SEQ ID NO: 3384716 - protein, 27 aa, Plasmodium falciparum
ILPIDITAHLLIPLPGGQQGPSGVLIC

SEQ ID NO: 3384717 - protein, 17 aa, Plasmodium falciparum
ILPQKKWNVYRKDAQYK

SEQ ID NO: 3384718 - protein, 22 aa, Plasmodium falciparum
ILPSRLFGHLILTTPYGIMDHE

SEQ ID NO: 3384719 - protein, 22 aa, Plasmodium falciparum
ILPTVLNYVLLPTIDMIKNDFS

SEQ ID NO: 3384720 - protein, 18 aa, Plasmodium falciparum
ILQFLKKSNTISLMEHFR

SEQ ID NO: 3384721 - protein, 24 aa, Plasmodium falciparum
ILQIRKLFKYKRINILLVTGRLIY

SEQ ID NO: 3384722 - protein, 23 aa, Plasmodium falciparum
ILQKYKGIFCNYEYYFDLEVKYN

SEQ ID NO: 3384723 - protein, 20 aa, Plasmodium falciparum
ILQNIIMQKKMKYAFDVTSI

SEQ ID NO: 3384724 - protein, 18 aa, Plasmodium falciparum
ILREAGLKPDFIFCRCEE

SEQ ID NO: 3384725 - protein, 26 aa, Plasmodium falciparum
ILREENIFFFHIIPEQTHNGLYLGCH

SEQ ID NO: 3384726 - protein, 19 aa, Plasmodium falciparum
ILREHFWHIKYIKNMTWND

SEQ ID NO: 3384727 - protein, 27 aa, Plasmodium falciparum
ILRKMNALLFFIKILCKNIILKKGSEL

SEQ ID NO: 3384728 - protein, 17 aa, Plasmodium falciparum
ILRNLLYLNDNIINNIH

SEQ ID NO: 3384729 - protein, 37 aa, Plasmodium falciparum
ILSKKRSIELGNILHNLIYGYIYKGDNVRLTIGKESK

SEQ ID NO: 3384730 - protein, 18 aa, Plasmodium falciparum
ILSLYIDPYNRYKSYNEY

SEQ ID NO: 3384731 - protein, 19 aa, Plasmodium falciparum
ILSPNILKLLKVSNNKLIQ

SEQ ID NO: 3384732 - protein, 17 aa, Plasmodium falciparum
ILSSIIHTYNIPSFFLL

SEQ ID NO: 3384733 - protein, 22 aa, Plasmodium falciparum
ILSWNPMNYFILSSTSFDSSVN

SEQ ID NO: 3384734 - protein, 23 aa, Plasmodium falciparum
ILTFMIFTILHKANTNFLVYNMA

SEQ ID NO: 3384735 - protein, 19 aa, Plasmodium falciparum
ILTIFGKKENKKKALELVL

SEQ ID NO: 3384736 - protein, 27 aa, Plasmodium falciparum
ILTKYPIDFFNKLLLKLYNIENNIYEI

SEQ ID NO: 3384737 - protein, 28 aa, Plasmodium falciparum
ILTNIKQLIIFIPTYIEYLRIHELLKKN

SEQ ID NO: 3384738 - protein, 35 aa, Plasmodium falciparum
ILTQEQWEYIEKIKNYLYATYLKEKDKEHNHILNS

SEQ ID NO: 3384739 - protein, 17 aa, Plasmodium falciparum
ILVILIYEYVKNRDINC

SEQ ID NO: 3384740 - protein, 19 aa, Plasmodium falciparum
ILVVFNEGYAPDGVWLGGT

SEQ ID NO: 3384741 - protein, 28 aa, Plasmodium falciparum
ILYDDKKVLFLFFISGNLQNFHVTSNNN

SEQ ID NO: 3384742 - protein, 23 aa, Plasmodium falciparum
ILYDYMINLPSWEYYDINRRLFL

SEQ ID NO: 3384743 - protein, 20 aa, Plasmodium falciparum
ILYKKNFLKTLKLMDRIYNK

SEQ ID NO: 3384744 - protein, 26 aa, Plasmodium falciparum
ILYKRDIFNICFIFQYMILTNEKKKV

SEQ ID NO: 3384745 - protein, 17 aa, Plasmodium falciparum
ILYLHKFNEDLGTIIPT

SEQ ID NO: 3384746 - protein, 18 aa, Plasmodium falciparum
ILYLLHEAFIECGQKKRI

SEQ ID NO: 3384747 - protein, 21 aa, Plasmodium falciparum
ILYLMNNPILLKYNNYRKLFI

SEQ ID NO: 3384748 - protein, 25 aa, Plasmodium falciparum
IMCDDQRIPKARFLGLYMPNCPEWN

SEQ ID NO: 3384749 - protein, 19 aa, Plasmodium falciparum
IMDEVRGRDIYIIHSTPAG

SEQ ID NO: 3384750 - protein, 18 aa, Plasmodium falciparum
IMDYNIYKRLALIKNDHN

SEQ ID NO: 3384751 - protein, 18 aa, Plasmodium falciparum
IMEKMFPQIVIPKNIIFD

SEQ ID NO: 3384752 - protein, 18 aa, Plasmodium falciparum
IMGTLKKYLNITHTKDLL

SEQ ID NO: 3384753 - protein, 22 aa, Plasmodium falciparum
IMKGFLKEPSVLNNPIYLNNNT

SEQ ID NO: 3384754 - protein, 28 aa, Plasmodium falciparum
IMKTGYMHKNLIISILKQFGDNLTEEES

SEQ ID NO: 3384755 - protein, 29 aa, Plasmodium falciparum
IMLDVRLRKALLYLFKYQHPTIIQKMSIC

SEQ ID NO: 3384756 - protein, 24 aa, Plasmodium falciparum
IMMHNNYQPFLYENQYNKHIHMMN

SEQ ID NO: 3384757 - protein, 30 aa, Plasmodium falciparum
IMNAQELIDIWKLLIKLINNFFPVQEKEKC

SEQ ID NO: 3384758 - protein, 18 aa, Plasmodium falciparum
IMNHLFHMKPHCNLKDKV

SEQ ID NO: 3384759 - protein, 25 aa, Plasmodium falciparum
IMNINSKFEPLPKIIISCDTIVTLN

SEQ ID NO: 3384760 - protein, 17 aa, Plasmodium falciparum
IMNIPKKGLGNEYYNYP

SEQ ID NO: 3384761 - protein, 29 aa, Plasmodium falciparum
IMNKSDPFFFLFLFNFIIKNIQNNKMMIT

SEQ ID NO: 3384762 - protein, 18 aa, Plasmodium falciparum
IMPNFFNYHEFCDRYCFK

SEQ ID NO: 3384763 - protein, 25 aa, Plasmodium falciparum
IMQRDIIYHLFDSFTAYLKKIEEEK

SEQ ID NO: 3384764 - protein, 18 aa, Plasmodium falciparum
IMRNKLKELLHKRNEYYL

SEQ ID NO: 3384765 - protein, 22 aa, Plasmodium falciparum
IMRRTIPNIYSFINLLSKLCES

SEQ ID NO: 3384766 - protein, 32 aa, Plasmodium falciparum
IMSLSKDSTFPFPPLTFIRNNTNKKRIASYNN

SEQ ID NO: 3384767 - protein, 18 aa, Plasmodium falciparum
IMTDLLSHYILRIAFSKD

SEQ ID NO: 3384768 - protein, 17 aa, Plasmodium falciparum
IMTLQMMVVIGELFRNI

SEQ ID NO: 3384769 - protein, 27 aa, Plasmodium falciparum
INAFIDICLLFHNYNYIKKLILIFNCI

SEQ ID NO: 3384770 - protein, 19 aa, Plasmodium falciparum
INALGPHPWALTFSYGRAL

SEQ ID NO: 3384771 - protein, 18 aa, Plasmodium falciparum
INALLEIGMYKENDMETL

SEQ ID NO: 3384772 - protein, 25 aa, Plasmodium falciparum
INAQFILNIIHSAEFFYFNSINQKT

SEQ ID NO: 3384773 - protein, 22 aa, Plasmodium falciparum
INARHRIFTEWSIEPTPLWTVE

SEQ ID NO: 3384774 - protein, 17 aa, Plasmodium falciparum
INARLETLHIKKSFSVL

SEQ ID NO: 3384775 - protein, 21 aa, Plasmodium falciparum
INCFLELELIFCEPSKSLWIN

SEQ ID NO: 3384776 - protein, 24 aa, Plasmodium falciparum
INCFSYYLLIQLCLFKSCLNSKVY

SEQ ID NO: 3384777 - protein, 20 aa, Plasmodium falciparum
INCSILIDWTKGFETGRATN

SEQ ID NO: 3384778 - protein, 28 aa, Plasmodium falciparum
INCSRNTLEFFLTKKYLKSSELIINEHD

SEQ ID NO: 3384779 - protein, 25 aa, Plasmodium falciparum
INDENGCYHLLTYPLEDEIENMNYY

SEQ ID NO: 3384780 - protein, 29 aa, Plasmodium falciparum
INDKRYLRYVFYYLKLLCTVKHISKHKIK

SEQ ID NO: 3384781 - protein, 27 aa, Plasmodium falciparum
INDLFRNFINCKINNLYVITTDTNKIP

SEQ ID NO: 3384782 - protein, 24 aa, Plasmodium falciparum
INDNFYIFLFYIINNKKTKHIDVN

SEQ ID NO: 3384783 - protein, 22 aa, Plasmodium falciparum
INDPIIIGDIKTKKLLFSDHNN

SEQ ID NO: 3384784 - protein, 23 aa, Plasmodium falciparum
INDQWLLICINQELKKIIKESGD

SEQ ID NO: 3384785 - protein, 35 aa, Plasmodium falciparum
INEAQKCILKIRKKKMTTFLNKIMSTPIHTKTTHW

SEQ ID NO: 3384786 - protein, 17 aa, Plasmodium falciparum
INEAYLYELTTLPDTLF

SEQ ID NO: 3384787 - protein, 26 aa, Plasmodium falciparum
INEIENYKIVLKNKGEMLLQNSSTMD

SEQ ID NO: 3384788 - protein, 23 aa, Plasmodium falciparum
INEILAPYLYNTSFICFIYSVGD

SEQ ID NO: 3384789 - protein, 17 aa, Plasmodium falciparum
INEINKLKLFIEENKMT

SEQ ID NO: 3384790 - protein, 26 aa, Plasmodium falciparum
INEIYNDRYRIEGKLGWGHFSTVWVA

SEQ ID NO: 3384791 - protein, 27 aa, Plasmodium falciparum
INEKFCAQNFLSLIQTFKNNIRKEKVL

SEQ ID NO: 3384792 - protein, 26 aa, Plasmodium falciparum
INEKSILQNILISKYVDMLNWTSEQV

SEQ ID NO: 3384793 - protein, 26 aa, Plasmodium falciparum
INEKSYQYHIYFKHKFLKEKNEINRK

SEQ ID NO: 3384794 - protein, 18 aa, Plasmodium falciparum
INEKYYFRHLSIYALQVK

SEQ ID NO: 3384795 - protein, 24 aa, Plasmodium falciparum
INELKIFIHKLNPIGTIYTTSYCY

SEQ ID NO: 3384796 - protein, 25 aa, Plasmodium falciparum
INENEFWLRYFSSIKMIIIKNFFET

SEQ ID NO: 3384797 - protein, 33 aa, Plasmodium falciparum
INENKTPFHFHWFKDDYIYFYKNKETEEYYICD

SEQ ID NO: 3384798 - protein, 25 aa, Plasmodium falciparum
INENPDFEFLFNTKVVKQENIGKDC

SEQ ID NO: 3384799 - protein, 19 aa, Plasmodium falciparum
INESLLICLKLDKKFKFKT

SEQ ID NO: 3384800 - protein, 17 aa, Plasmodium falciparum
INESYIPNYTNKSIRSV

SEQ ID NO: 3384801 - protein, 17 aa, Plasmodium falciparum
INEWLKNDIFFENILKS

SEQ ID NO: 3384802 - protein, 33 aa, Plasmodium falciparum
INFDKIEKNIMWKKLLIDMICFNNNLNVPYNES

SEQ ID NO: 3384803 - protein, 21 aa, Plasmodium falciparum
INFLDDQYLINIKSILILYNS

SEQ ID NO: 3384804 - protein, 18 aa, Plasmodium falciparum
INFLMSLKRAVLSELLII

SEQ ID NO: 3384805 - protein, 23 aa, Plasmodium falciparum
INGAIFILNPKTGQLFLKIIHTS

SEQ ID NO: 3384806 - protein, 23 aa, Plasmodium falciparum
INGKENIFAVEKVGINESGHMSN

SEQ ID NO: 3384807 - protein, 32 aa, Plasmodium falciparum
INGNYQHIIYQKNILSNFIAQIPSRIQVDDYV

SEQ ID NO: 3384808 - protein, 24 aa, Plasmodium falciparum
INHSNFDSSPFWLKNYKNISNYSN

SEQ ID NO: 3384809 - protein, 21 aa, Plasmodium falciparum
INICFICLRKFLNEEMLQRHI

SEQ ID NO: 3384810 - protein, 18 aa, Plasmodium falciparum
INIFLFRAVKKDINYIQE

SEQ ID NO: 3384811 - protein, 23 aa, Plasmodium falciparum
INIFNFKKFYNTDFSKENFTIIK

SEQ ID NO: 3384812 - protein, 26 aa, Plasmodium falciparum
INIFQKAVMMFLIELVNKTLEFKDEK

SEQ ID NO: 3384813 - protein, 37 aa, Plasmodium falciparum
INIFVTINFRNLIIDTLYLFKYIFNNKEFSLSMVDDL

SEQ ID NO: 3384814 - protein, 30 aa, Plasmodium falciparum
INIHRTLNDVWLFHIKTNKWNYLGTFTFQN

SEQ ID NO: 3384815 - protein, 18 aa, Plasmodium falciparum
INIIKKWTNKYAYKIYVK

SEQ ID NO: 3384816 - protein, 18 aa, Plasmodium falciparum
INIILKKIGASYFGDVDE

SEQ ID NO: 3384817 - protein, 17 aa, Plasmodium falciparum
INIINEKYLILEKEYEE

SEQ ID NO: 3384818 - protein, 21 aa, Plasmodium falciparum
INIIYKPLFDSAYNLIIDLIN

SEQ ID NO: 3384819 - protein, 33 aa, Plasmodium falciparum
INIIYYNDEYKNIIFINFLRLCQLNNMNVKKYH

SEQ ID NO: 3384820 - protein, 30 aa, Plasmodium falciparum
INIKDNILKSLLILLHYSLIRKKNASDIQN

SEQ ID NO: 3384821 - protein, 18 aa, Plasmodium falciparum
INILFSFHNACLSNYNKL

SEQ ID NO: 3384822 - protein, 17 aa, Plasmodium falciparum
INILMKYMDNEKKGYIN

SEQ ID NO: 3384823 - protein, 17 aa, Plasmodium falciparum
INILNKNLKYMKLKKNE

SEQ ID NO: 3384824 - protein, 21 aa, Plasmodium falciparum
INILNLYIKVEQPLILCISHI

SEQ ID NO: 3384825 - protein, 26 aa, Plasmodium falciparum
INILPYNNYIPLYKGFNNFEEYIINQ

SEQ ID NO: 3384826 - protein, 17 aa, Plasmodium falciparum
INIMIAMLETSYKSMQI

SEQ ID NO: 3384827 - protein, 25 aa, Plasmodium falciparum
ININDINLINYKKLNKNNLLSYIFK

SEQ ID NO: 3384828 - protein, 32 aa, Plasmodium falciparum
ININNPFDYFYLIRELKIVASMLNIAILIFDV

SEQ ID NO: 3384829 - protein, 21 aa, Plasmodium falciparum
INIPCNIEIPKYTRLSAYYTN

SEQ ID NO: 3384830 - protein, 23 aa, Plasmodium falciparum
INIPGFKKCLILSFVCPNCNFKT

SEQ ID NO: 3384831 - protein, 25 aa, Plasmodium falciparum
INIRKALLSGFYQQVAYKTTKGYYI

SEQ ID NO: 3384832 - protein, 20 aa, Plasmodium falciparum
INISHLWRNLHKEYLKIRKV

SEQ ID NO: 3384833 - protein, 27 aa, Plasmodium falciparum
INISTFKKHIINHIKDILLKRDVINRS

SEQ ID NO: 3384834 - protein, 37 aa, Plasmodium falciparum
INIVIKVIYINNIKKLIFKYLYLINNNFKHDGVGNIN

SEQ ID NO: 3384835 - protein, 17 aa, Plasmodium falciparum
INIVLNEEMNMPNVVNC

SEQ ID NO: 3384836 - protein, 31 aa, Plasmodium falciparum
INIVSTFYKYSLDKLIFKIYIPFDQINKHHN

SEQ ID NO: 3384837 - protein, 27 aa, Plasmodium falciparum
INIYIKDVLMNIVLDFYNIFEEELPKA

SEQ ID NO: 3384838 - protein, 25 aa, Plasmodium falciparum
INIYRLKYIYLLITSDNYLFNNFYT

SEQ ID NO: 3384839 - protein, 25 aa, Plasmodium falciparum
INKDFSELQYYNDKFMSGFNNIKKM

SEQ ID NO: 3384840 - protein, 22 aa, Plasmodium falciparum
INKELLINRKITQKCYLKINKL

SEQ ID NO: 3384841 - protein, 22 aa, Plasmodium falciparum
INKELYFIPEHSNWYKTNTQPF

SEQ ID NO: 3384842 - protein, 34 aa, Plasmodium falciparum
INKEQKYLALKNKNYKFLLHRYIQLYNVNEEHYE

SEQ ID NO: 3384843 - protein, 39 aa, Plasmodium falciparum
INKFNYYFVKLFINNKWYLIFVNLYLPYNKNNNQILSCY

SEQ ID NO: 3384844 - protein, 27 aa, Plasmodium falciparum
INKGILFMELLLYDIKFYHNSSMIEEN

SEQ ID NO: 3384845 - protein, 28 aa, Plasmodium falciparum
INKHHNYLFLLVTKKILWRYNVNFNISI

SEQ ID NO: 3384846 - protein, 31 aa, Plasmodium falciparum
INKILNLDNILSYIFKPVGSHMTKLINAFIH

SEQ ID NO: 3384847 - protein, 34 aa, Plasmodium falciparum
INKIPIPKIYLNIDDPKYLSWKILQNSGKTAFKE

SEQ ID NO: 3384848 - protein, 17 aa, Plasmodium falciparum
INKIYAQNKTICSNAPF

SEQ ID NO: 3384849 - protein, 17 aa, Plasmodium falciparum
INKKKNIKLYKKKKNKQ

SEQ ID NO: 3384850 - protein, 25 aa, Plasmodium falciparum
INKKKRFIFLLSSVGKELLLDNLLT

SEQ ID NO: 3384851 - protein, 24 aa, Plasmodium falciparum
INKKMPIEILHFFDYYINRKNELD

SEQ ID NO: 3384852 - protein, 27 aa, Plasmodium falciparum
INKLNDLNDYFFILGSTSTSRKYILKK

SEQ ID NO: 3384853 - protein, 20 aa, Plasmodium falciparum
INKNFIPCNYAKNKKKCTTT

SEQ ID NO: 3384854 - protein, 26 aa, Plasmodium falciparum
INKNGDILNSFNGNALPINYDRNEYA

SEQ ID NO: 3384855 - protein, 35 aa, Plasmodium falciparum
INKNICFDIFLFKQDFFDYDFSLGILKNKKSILNK

SEQ ID NO: 3384856 - protein, 33 aa, Plasmodium falciparum
INKNKLIENLRNTKLLLIKKRRSLNNMKKENNI

SEQ ID NO: 3384857 - protein, 24 aa, Plasmodium falciparum
INKNKMIAPPPYAGDNTASVNPHI

SEQ ID NO: 3384858 - protein, 36 aa, Plasmodium falciparum
INKQCNNTYFLKIKLYILCLIKLIEKYKLDPHSLCI

SEQ ID NO: 3384859 - protein, 20 aa, Plasmodium falciparum
INKYNIKILIKIYYDYITYI

SEQ ID NO: 3384860 - protein, 28 aa, Plasmodium falciparum
INLCNSAYYPHCTYSNPLKSIKKYSCTN

SEQ ID NO: 3384861 - protein, 29 aa, Plasmodium falciparum
INLEKCASWIYFDPLTWSKKTYNNYLNVK

SEQ ID NO: 3384862 - protein, 19 aa, Plasmodium falciparum
INLESIWQAIYTAGVYLPK

SEQ ID NO: 3384863 - protein, 20 aa, Plasmodium falciparum
INLFDYIHLTNIVGALRSLE

SEQ ID NO: 3384864 - protein, 21 aa, Plasmodium falciparum
INLFNVYKLFHNKKKKSWMIM

SEQ ID NO: 3384865 - protein, 17 aa, Plasmodium falciparum
INLFQNKYILNIDKSFF

SEQ ID NO: 3384866 - protein, 26 aa, Plasmodium falciparum
INLFYSKFFQDYITNPVLLPIKEISN

SEQ ID NO: 3384867 - protein, 29 aa, Plasmodium falciparum
INLHYPVDIELIYYLFSKCGTVEKIITFS

SEQ ID NO: 3384868 - protein, 24 aa, Plasmodium falciparum
INLKSINRFNTVSLGLKGNHNMEN

SEQ ID NO: 3384869 - protein, 19 aa, Plasmodium falciparum
INLLTPYINFGIISSQRCV

SEQ ID NO: 3384870 - protein, 23 aa, Plasmodium falciparum
INLNHMYYNFPSSYYVFNYLFND

SEQ ID NO: 3384871 - protein, 31 aa, Plasmodium falciparum
INLRKSPVLLYLYYLKQIGLALSPLSNNALF

SEQ ID NO: 3384872 - protein, 31 aa, Plasmodium falciparum
INLSNLYMKLTYLNFEIFKYLKVLDLSNNGI

SEQ ID NO: 3384873 - protein, 43 aa, Plasmodium falciparum
INLSQTCKFFYKRKFKVAYNRLIFKSYLGYNPKILYEYVFPVI

SEQ ID NO: 3384874 - protein, 19 aa, Plasmodium falciparum
INMNNKRVYAMKVVLKECN

SEQ ID NO: 3384875 - protein, 29 aa, Plasmodium falciparum
INMQNLFKNIPQPSLLFPYVLTMSNNVLN

SEQ ID NO: 3384876 - protein, 23 aa, Plasmodium falciparum
INNDLENYYFYNKHIYNSMDDLY

SEQ ID NO: 3384877 - protein, 29 aa, Plasmodium falciparum
INNEGLYKSSFYYIKLNENSRYNYNNHDD

SEQ ID NO: 3384878 - protein, 28 aa, Plasmodium falciparum
INNEIREWLLLFLLPNFIHKSIHKVTYP

SEQ ID NO: 3384879 - protein, 17 aa, Plasmodium falciparum
INNFPIHKKNCIIFLLL

SEQ ID NO: 3384880 - protein, 20 aa, Plasmodium falciparum
INNFYIIEFLEIGGIQTYSY

SEQ ID NO: 3384881 - protein, 20 aa, Plasmodium falciparum
INNIIKLYESVRNNLFKFIN

SEQ ID NO: 3384882 - protein, 20 aa, Plasmodium falciparum
INNIIYIRIDQNFLSKLMEQ

SEQ ID NO: 3384883 - protein, 27 aa, Plasmodium falciparum
INNIYDIDFFHPLTIRASSGYLLDIPF

SEQ ID NO: 3384884 - protein, 24 aa, Plasmodium falciparum
INNKKGMMKYLNKIVNPANQSYSI

SEQ ID NO: 3384885 - protein, 23 aa, Plasmodium falciparum
INNKLLCHIWEKAYQFINEYTLQ

SEQ ID NO: 3384886 - protein, 20 aa, Plasmodium falciparum
INNKMNWQKKGFMLEQNREK

SEQ ID NO: 3384887 - protein, 32 aa, Plasmodium falciparum
INNKNPYIFTCQKYFMRPSNVLHNIQNCGIHK

SEQ ID NO: 3384888 - protein, 26 aa, Plasmodium falciparum
INNKNRFCFFIYIKDFSASYSTINNN

SEQ ID NO: 3384889 - protein, 26 aa, Plasmodium falciparum
INNKRSYFIKNLYLSSLFSSDYITYI

SEQ ID NO: 3384890 - protein, 24 aa, Plasmodium falciparum
INNKSLELIPSKRPLVSYSTYDNQ

SEQ ID NO: 3384891 - protein, 33 aa, Plasmodium falciparum
INNLKVNIIMHFLNFFHLNDMYTILNDYTYYFS

SEQ ID NO: 3384892 - protein, 17 aa, Plasmodium falciparum
INNLLFKKQAKDKTYEL

SEQ ID NO: 3384893 - protein, 27 aa, Plasmodium falciparum
INNLWSSFFEPNSLYEIAGHRNEILKL

SEQ ID NO: 3384894 - protein, 24 aa, Plasmodium falciparum
INNNDKNLLILDKNKKKTSNNKKN

SEQ ID NO: 3384895 - protein, 18 aa, Plasmodium falciparum
INNNIVLDSILNNNIMNN

SEQ ID NO: 3384896 - protein, 25 aa, Plasmodium falciparum
INNNQGIILGIKPYDNINKINNVPT

SEQ ID NO: 3384897 - protein, 18 aa, Plasmodium falciparum
INNNYLNHLTNNLSHHNN

SEQ ID NO: 3384898 - protein, 25 aa, Plasmodium falciparum
INNQMNFMKWSPQGTYFILASLASE

SEQ ID NO: 3384899 - protein, 24 aa, Plasmodium falciparum
INNSQLLIDNFNLLEEKHLQLIDD

SEQ ID NO: 3384900 - protein, 22 aa, Plasmodium falciparum
INNYNMLSLIMRIPIVIKKKKP

SEQ ID NO: 3384901 - protein, 24 aa, Plasmodium falciparum
INQIKEFELMYPDGFIKYIEKGRE

SEQ ID NO: 3384902 - protein, 31 aa, Plasmodium falciparum
INQVPVIEKILYEEFLPFGNIEYVRYIPNKN

SEQ ID NO: 3384903 - protein, 24 aa, Plasmodium falciparum
INQVQKIIKLFLLLCPHNQIEQMD

SEQ ID NO: 3384904 - protein, 25 aa, Plasmodium falciparum
INRMKYYGVILFSSNLIYYINDFHE

SEQ ID NO: 3384905 - protein, 19 aa, Plasmodium falciparum
INSCCRIFYDKPIEFLHII

SEQ ID NO: 3384906 - protein, 17 aa, Plasmodium falciparum
INSIHIINNFFSPNENN

SEQ ID NO: 3384907 - protein, 23 aa, Plasmodium falciparum
INSIVVFFIGGATYEEYRDVQHL

SEQ ID NO: 3384908 - protein, 22 aa, Plasmodium falciparum
INSNFDSFILKKLKIINDPDCN

SEQ ID NO: 3384909 - protein, 33 aa, Plasmodium falciparum
INSNNNIIEPKKKKLLFFKKKINNKINTITNNI

SEQ ID NO: 3384910 - protein, 23 aa, Plasmodium falciparum
INSSYLSFVLNIGTSYYSNEEIK

SEQ ID NO: 3384911 - protein, 25 aa, Plasmodium falciparum
INSTNTSIPIYPYEYKKIRKKLETY

SEQ ID NO: 3384912 - protein, 64 aa, Plasmodium falciparum
INSVKHPMTYIKGFEYASDSINFLKALKGLPPLPFLKCKDMKPYMRLFNIVLKVIESNDYNVDN

SEQ ID NO: 3384913 - protein, 23 aa, Plasmodium falciparum
INSWIDLIFGYKQNGHNAKECFN

SEQ ID NO: 3384914 - protein, 22 aa, Plasmodium falciparum
INSYLYISWNIGNVIYRNLYNS

SEQ ID NO: 3384915 - protein, 18 aa, Plasmodium falciparum
INSYYQFCLEHFINFFTY

SEQ ID NO: 3384916 - protein, 31 aa, Plasmodium falciparum
INTCNKIFTHLIVCLLPDGGINKLRVYGEIK

SEQ ID NO: 3384917 - protein, 29 aa, Plasmodium falciparum
INTERFYYCIRYCSIFSFVLNKIIQKKVQ

SEQ ID NO: 3384918 - protein, 25 aa, Plasmodium falciparum
INTEYLPSNLLNSISINNVSQSNQI

SEQ ID NO: 3384919 - protein, 24 aa, Plasmodium falciparum
INTFCSFLKILKPPNVSALLNYND

SEQ ID NO: 3384920 - protein, 24 aa, Plasmodium falciparum
INTILYARDKYLKENGYIFPNKIY

SEQ ID NO: 3384921 - protein, 22 aa, Plasmodium falciparum
INTLKQNYYYLKKEYDLKNKEL

SEQ ID NO: 3384922 - protein, 28 aa, Plasmodium falciparum
INTNLHLLNIFIPKPVISVAVEILKKGD

SEQ ID NO: 3384923 - protein, 23 aa, Plasmodium falciparum
INTQFLMPLKIHSTINHFITTHN

SEQ ID NO: 3384924 - protein, 27 aa, Plasmodium falciparum
INTTNLNYHKYYYTYSINNMSEKKKKN

SEQ ID NO: 3384925 - protein, 21 aa, Plasmodium falciparum
INTYFVITEIKLIDIKNFCTS

SEQ ID NO: 3384926 - protein, 19 aa, Plasmodium falciparum
INTYGMTLYAIFNKLFIFY

SEQ ID NO: 3384927 - protein, 28 aa, Plasmodium falciparum
INVDKNLFRFFLETLFYEYMTDERFKST

SEQ ID NO: 3384928 - protein, 32 aa, Plasmodium falciparum
INVGDSYQVSNLPNFFLCRSELMYKNYDTQEN

SEQ ID NO: 3384929 - protein, 18 aa, Plasmodium falciparum
INVILENCVHEWFPFLKD

SEQ ID NO: 3384930 - protein, 25 aa, Plasmodium falciparum
INVKSILCIFTSKISGYLTSVGFFN

SEQ ID NO: 3384931 - protein, 22 aa, Plasmodium falciparum
INVLFDIFDLNADGFIQKSEMV

SEQ ID NO: 3384932 - protein, 29 aa, Plasmodium falciparum
INVLKYSNFIYFHIFMICVTYANQTKIVG

SEQ ID NO: 3384933 - protein, 18 aa, Plasmodium falciparum
INVLNKDGAILYKVQDEN

SEQ ID NO: 3384934 - protein, 24 aa, Plasmodium falciparum
INVQIYPLYIKYHEYSYKLCGALF

SEQ ID NO: 3384935 - protein, 21 aa, Plasmodium falciparum
INVSAQCKGILLSTVSPRKMS

SEQ ID NO: 3384936 - protein, 18 aa, Plasmodium falciparum
INYFLEICPTVLDCSRKE

SEQ ID NO: 3384937 - protein, 27 aa, Plasmodium falciparum
INYGKPYKLSCLESLAFCLYVCNYNKQ

SEQ ID NO: 3384938 - protein, 19 aa, Plasmodium falciparum
INYILSNLPCYYWYKREED

SEQ ID NO: 3384939 - protein, 25 aa, Plasmodium falciparum
INYKDRFYFEPILYNNQRDINKHMN

SEQ ID NO: 3384940 - protein, 29 aa, Plasmodium falciparum
INYLKPPVMNLIRNNIYFNRNTLGKNDKT

SEQ ID NO: 3384941 - protein, 18 aa, Plasmodium falciparum
INYLKYLNYWRNKPYIFY

SEQ ID NO: 3384942 - protein, 34 aa, Plasmodium falciparum
INYMNKKYFDDLNNIYFLLEDFTNTYKTCSNNLK

SEQ ID NO: 3384943 - protein, 19 aa, Plasmodium falciparum
INYMNLYDILNERIEYIVE

SEQ ID NO: 3384944 - protein, 32 aa, Plasmodium falciparum
INYMNRINNMSYLNNTIPLNCINVFNHINDNL

SEQ ID NO: 3384945 - protein, 26 aa, Plasmodium falciparum
INYTTPRALLAILRISQALARLRDSD

SEQ ID NO: 3384946 - protein, 44 aa, Plasmodium falciparum
INYYNSIKSDFFFLNYISISKYILLILSKFLNIHLIDKFECIHI

SEQ ID NO: 3384947 - protein, 37 aa, Plasmodium falciparum
INYYSVKWINFINRKVPILLQNKSGPCPLLCITNILL

SEQ ID NO: 3384948 - protein, 18 aa, Plasmodium falciparum
IPCPRYFSSLDLYIIRKN

SEQ ID NO: 3384949 - protein, 17 aa, Plasmodium falciparum
IPCRYIRYVKNKTVHYF

SEQ ID NO: 3384950 - protein, 21 aa, Plasmodium falciparum
IPCTYKWTRVYYNKECELVEK

SEQ ID NO: 3384951 - protein, 26 aa, Plasmodium falciparum
IPDALLMHLPHMKILLSEISDILNEA

SEQ ID NO: 3384952 - protein, 17 aa, Plasmodium falciparum
IPDIYFRNILKEFCIQK

SEQ ID NO: 3384953 - protein, 21 aa, Plasmodium falciparum
IPEALRHNLIKPYSVYTEKKK

SEQ ID NO: 3384954 - protein, 25 aa, Plasmodium falciparum
IPEDFIRQMYYTFGDYRDLCMNKNI

SEQ ID NO: 3384955 - protein, 23 aa, Plasmodium falciparum
IPEDKYHYFKTLKPTRTKFSTFK

SEQ ID NO: 3384956 - protein, 21 aa, Plasmodium falciparum
IPEYFKKYPIYYAGPAKTPDN

SEQ ID NO: 3384957 - protein, 20 aa, Plasmodium falciparum
IPFLHYDLKSAQSLVSFNKL

SEQ ID NO: 3384958 - protein, 19 aa, Plasmodium falciparum
IPFSKRYIKYLAKKYIKMH

SEQ ID NO: 3384959 - protein, 19 aa, Plasmodium falciparum
IPGLQFLEYVKKNRFNIWD

SEQ ID NO: 3384960 - protein, 27 aa, Plasmodium falciparum
IPGQTKYWQFIKLTNKIYLIDCPGIVP

SEQ ID NO: 3384961 - protein, 20 aa, Plasmodium falciparum
IPHCINYIFNYINYHKQQDK

SEQ ID NO: 3384962 - protein, 17 aa, Plasmodium falciparum
IPIAIRFSCTFNGSQEV

SEQ ID NO: 3384963 - protein, 28 aa, Plasmodium falciparum
IPIDEIREYWWALNRKEVWKALTCSGFR

SEQ ID NO: 3384964 - protein, 18 aa, Plasmodium falciparum
IPIHQWYMNNVRRNIYNT

SEQ ID NO: 3384965 - protein, 23 aa, Plasmodium falciparum
IPIIKIVLAIYYLFNDNNKESFL

SEQ ID NO: 3384966 - protein, 18 aa, Plasmodium falciparum
IPIIYYTHYNMNFLNELY

SEQ ID NO: 3384967 - protein, 26 aa, Plasmodium falciparum
IPIKNKSLNIYYAFQSHIKPPSFVFF

SEQ ID NO: 3384968 - protein, 21 aa, Plasmodium falciparum
IPKITILLFHTPTFSYKPHDK

SEQ ID NO: 3384969 - protein, 17 aa, Plasmodium falciparum
IPKKDIEIIPLKNKESL

SEQ ID NO: 3384970 - protein, 34 aa, Plasmodium falciparum
IPKKKILHFTLVDINIPILYILKKKNNVNYFNEF

SEQ ID NO: 3384971 - protein, 25 aa, Plasmodium falciparum
IPKNFTFIRWLCLTDCLLVCFFDEQ

SEQ ID NO: 3384972 - protein, 34 aa, Plasmodium falciparum
IPLEEHKDILLKIKSLPLIQKLCLYASCNVVNDT

SEQ ID NO: 3384973 - protein, 19 aa, Plasmodium falciparum
IPLIKRKCEYFNTSNLAML

SEQ ID NO: 3384974 - protein, 18 aa, Plasmodium falciparum
IPLLFSKVNNCLAFLSFK

SEQ ID NO: 3384975 - protein, 19 aa, Plasmodium falciparum
IPLPNIKTPILKKIIEYME

SEQ ID NO: 3384976 - protein, 18 aa, Plasmodium falciparum
IPNDKFSLCLWDSDVFLY

SEQ ID NO: 3384977 - protein, 20 aa, Plasmodium falciparum
IPNILDFIELILIKEINHFN

SEQ ID NO: 3384978 - protein, 21 aa, Plasmodium falciparum
IPNIYPIKVNVIYKLLNIIKK

SEQ ID NO: 3384979 - protein, 24 aa, Plasmodium falciparum
IPNKNNHVLLKPERNFISGIDNTM

SEQ ID NO: 3384980 - protein, 17 aa, Plasmodium falciparum
IPNKRYIYLNGDDSNYK

SEQ ID NO: 3384981 - protein, 23 aa, Plasmodium falciparum
IPNTICNMTCNFFVSVNNCHILE

SEQ ID NO: 3384982 - protein, 17 aa, Plasmodium falciparum
IPPIIKKIERKSNDNDN

SEQ ID NO: 3384983 - protein, 31 aa, Plasmodium falciparum
IPPRKIETKPKLPSKFNPLKKEPLKKTKTNL

SEQ ID NO: 3384984 - protein, 26 aa, Plasmodium falciparum
IPQRFRWMTEWSEYYCKALKVELEKL

SEQ ID NO: 3384985 - protein, 33 aa, Plasmodium falciparum
IPRKKQFYKTKMCPWFFSGRCDRGMECLFAHSQ

SEQ ID NO: 3384986 - protein, 32 aa, Plasmodium falciparum
IPSIEQFYKDNNFYYFLRKEKMYTGSIQPVIA

SEQ ID NO: 3384987 - protein, 26 aa, Plasmodium falciparum
IPSNTIPPCVIYYNKKKFKDNISEKN

SEQ ID NO: 3384988 - protein, 17 aa, Plasmodium falciparum
IPSTLNKDSFCSFTTVS

SEQ ID NO: 3384989 - protein, 21 aa, Plasmodium falciparum
IPSVYKIKIFLISSDKSSIIK

SEQ ID NO: 3384990 - protein, 19 aa, Plasmodium falciparum
IPTNLGIALVQSYKKFKDI

SEQ ID NO: 3384991 - protein, 27 aa, Plasmodium falciparum
IPTSLIPRYPIDWRNGGRFLLCVGMRR

SEQ ID NO: 3384992 - protein, 25 aa, Plasmodium falciparum
IPTTYDNLAIIKLIIKKKNNNNSNC

SEQ ID NO: 3384993 - protein, 24 aa, Plasmodium falciparum
IPVENIVLLYKGAPLNNFLTLKES

SEQ ID NO: 3384994 - protein, 21 aa, Plasmodium falciparum
IPVHKLACATILKALERSQIE

SEQ ID NO: 3384995 - protein, 29 aa, Plasmodium falciparum
IPYCTKYSKRIISILLMTLNKNPQKRIDT

SEQ ID NO: 3384996 - protein, 25 aa, Plasmodium falciparum
IPYENYEFGLRRMYTIDTSDLTNKQ

SEQ ID NO: 3384997 - protein, 17 aa, Plasmodium falciparum
IPYNSECSFLINVPSSI

SEQ ID NO: 3384998 - protein, 18 aa, Plasmodium falciparum
IPYPYGVLDLKLGAHKSN

SEQ ID NO: 3384999 - protein, 24 aa, Plasmodium falciparum
IPYSNFILPMLIKRKMINDLYNDN

SEQ ID NO: 3385000 - protein, 26 aa, Plasmodium falciparum
IPYSVTTFYCPVKFPYTDNIIYKSDQ

SEQ ID NO: 3385001 - protein, 24 aa, Plasmodium falciparum
IPYYNKLVLLYISKVLFNGTLNIL

SEQ ID NO: 3385002 - protein, 17 aa, Plasmodium falciparum
IQDLFSYYHEFVKSIQE

SEQ ID NO: 3385003 - protein, 24 aa, Plasmodium falciparum
IQDMNKFLYGLILLYTCDTSIDID

SEQ ID NO: 3385004 - protein, 18 aa, Plasmodium falciparum
IQDNACKELLLSFVQAKK

SEQ ID NO: 3385005 - protein, 19 aa, Plasmodium falciparum
IQEAFYKFKSLQSLNYHIV

SEQ ID NO: 3385006 - protein, 17 aa, Plasmodium falciparum
IQEILDIYYSIIRNNKN

SEQ ID NO: 3385007 - protein, 17 aa, Plasmodium falciparum
IQEIPFVDYYNYKYEKL

SEQ ID NO: 3385008 - protein, 27 aa, Plasmodium falciparum
IQEKPTRWRRIYKGLKLCEYVMKNGCE

SEQ ID NO: 3385009 - protein, 18 aa, Plasmodium falciparum
IQFVSPPELIRGLKERYI

SEQ ID NO: 3385010 - protein, 25 aa, Plasmodium falciparum
IQGNYRAILLLKIIKHKINFNYINK

SEQ ID NO: 3385011 - protein, 22 aa, Plasmodium falciparum
IQHKSLYPCTITCMMNGSIGGI

SEQ ID NO: 3385012 - protein, 18 aa, Plasmodium falciparum
IQIFNKLIYEENRAYLFI

SEQ ID NO: 3385013 - protein, 27 aa, Plasmodium falciparum
IQIKGRKKILLIPPKYIQYFNIIDSSS

SEQ ID NO: 3385014 - protein, 25 aa, Plasmodium falciparum
IQINNLFCILTKPYPYIVASCITGG

SEQ ID NO: 3385015 - protein, 40 aa, Plasmodium falciparum
IQKCKTKVFFYINPKYIIEPLKRKIYQNMSIYIENLISDV

SEQ ID NO: 3385016 - protein, 37 aa, Plasmodium falciparum
IQKGHNLWSLPFIQAAKLERLNILKYLYSVKKEIINQ

SEQ ID NO: 3385017 - protein, 27 aa, Plasmodium falciparum
IQKISYSFLIKLLYTLNFYSSLSNDDL

SEQ ID NO: 3385018 - protein, 24 aa, Plasmodium falciparum
IQKLISCNNWKQVPSIYKKSAENI

SEQ ID NO: 3385019 - protein, 26 aa, Plasmodium falciparum
IQKLKNQHILLFNSLSNQSLLLDMQN

SEQ ID NO: 3385020 - protein, 29 aa, Plasmodium falciparum
IQKNYRTYILRKKFLYMKKQILFIQDYYL

SEQ ID NO: 3385021 - protein, 18 aa, Plasmodium falciparum
IQKRNHIFCVKKSGPFCG

SEQ ID NO: 3385022 - protein, 52 aa, Plasmodium falciparum
IQLESMKCIILFCSLYKIKYFQGMHDMIISLFYLNLETYEIFCVFEKILHYY

SEQ ID NO: 3385023 - protein, 33 aa, Plasmodium falciparum
IQLLKNIQNWVYCKFSFLPNGHIFYPKSGNLKK

SEQ ID NO: 3385024 - protein, 26 aa, Plasmodium falciparum
IQLNGGIYINKFKLSLDMPINKLAVS

SEQ ID NO: 3385025 - protein, 22 aa, Plasmodium falciparum
IQLNRIPYPFPTLKLNPDIKNI

SEQ ID NO: 3385026 - protein, 19 aa, Plasmodium falciparum
IQLYPKFNKINSKLALKLF

SEQ ID NO: 3385027 - protein, 18 aa, Plasmodium falciparum
IQMCKFLLDFIHLKLIKT

SEQ ID NO: 3385028 - protein, 27 aa, Plasmodium falciparum
IQMNVLYDLIFLLKLKKKTSNLCDDNI

SEQ ID NO: 3385029 - protein, 33 aa, Plasmodium falciparum
IQNENSYINIKYFFLFILDVSNDYIIYENFLQQ

SEQ ID NO: 3385030 - protein, 27 aa, Plasmodium falciparum
IQNNDKGYMYPNYNTALNIMNPNENGD

SEQ ID NO: 3385031 - protein, 23 aa, Plasmodium falciparum
IQQYRKTLTKIVKIKTAIFHETV

SEQ ID NO: 3385032 - protein, 23 aa, Plasmodium falciparum
IQREILPHAFLKKDIIGLSETGS

SEQ ID NO: 3385033 - protein, 31 aa, Plasmodium falciparum
IQREPPINSYNNPLGFKPLNYDDPNSIPINY

SEQ ID NO: 3385034 - protein, 17 aa, Plasmodium falciparum
IQRHKIVLSKKKRKLFA

SEQ ID NO: 3385035 - protein, 24 aa, Plasmodium falciparum
IQRKIFVGGLNYYWTKDTLESYFS

SEQ ID NO: 3385036 - protein, 18 aa, Plasmodium falciparum
IQRRKLLEYYFKKNEIML

SEQ ID NO: 3385037 - protein, 19 aa, Plasmodium falciparum
IQRTMLELLNQLDGFDSRG

SEQ ID NO: 3385038 - protein, 27 aa, Plasmodium falciparum
IQSHIRRYLMVRFYKTYRQNYYASKIQ

SEQ ID NO: 3385039 - protein, 25 aa, Plasmodium falciparum
IQSSLRFAMLLLEPSRILATLEGNT

SEQ ID NO: 3385040 - protein, 19 aa, Plasmodium falciparum
IQSYKYILSVSFDYNYLKI

SEQ ID NO: 3385041 - protein, 36 aa, Plasmodium falciparum
IQTKTPYECIYKFISMPLSNPYFDLNNLYDINNISL

SEQ ID NO: 3385042 - protein, 24 aa, Plasmodium falciparum
IQTMSKFYFYIHVKLFTCNVDNLK

SEQ ID NO: 3385043 - protein, 25 aa, Plasmodium falciparum
IQTQDRSIFLYNTPQNYIPMESKQD

SEQ ID NO: 3385044 - protein, 22 aa, Plasmodium falciparum
IQTQILYNRNLIQLGLCAFRHG

SEQ ID NO: 3385045 - protein, 27 aa, Plasmodium falciparum
IQVLAKEYLCKYTFLLVGKVGSTNEYI

SEQ ID NO: 3385046 - protein, 21 aa, Plasmodium falciparum
IQVYEISNLLIAYDLSKKLLT

SEQ ID NO: 3385047 - protein, 26 aa, Plasmodium falciparum
IQYKKAFDICRFSKIYNLIFEEKKKV

SEQ ID NO: 3385048 - protein, 27 aa, Plasmodium falciparum
IQYVDNFTLIFKIYQGFHKIIRKMCML

SEQ ID NO: 3385049 - protein, 18 aa, Plasmodium falciparum
IRCLLDKIMLRRLKEQAI

SEQ ID NO: 3385050 - protein, 25 aa, Plasmodium falciparum
IRCNSLDYILRYKNNLTFNNEKTSP

SEQ ID NO: 3385051 - protein, 26 aa, Plasmodium falciparum
IRDALSRAIYGCLFLKVVERTNESIG

SEQ ID NO: 3385052 - protein, 29 aa, Plasmodium falciparum
IRDCTIIQPQWLIQLAPNLFIPADEKKIS

SEQ ID NO: 3385053 - protein, 28 aa, Plasmodium falciparum
IRDKVHDLFKLWRYHSKKLLKDFAKSFD

SEQ ID NO: 3385054 - protein, 36 aa, Plasmodium falciparum
IRDNEMFFKIWMKNYSNYLKNILMKKLRDAYNVYNN

SEQ ID NO: 3385055 - protein, 26 aa, Plasmodium falciparum
IRECVTEFIQFLTSEASDRCTREKRK

SEQ ID NO: 3385056 - protein, 17 aa, Plasmodium falciparum
IREDILQNEKFPFIFYD

SEQ ID NO: 3385057 - protein, 23 aa, Plasmodium falciparum
IREIMNDPLLKKYKFLILDEIHE

SEQ ID NO: 3385058 - protein, 18 aa, Plasmodium falciparum
IRENISLSQLNLKIKELK

SEQ ID NO: 3385059 - protein, 45 aa, Plasmodium falciparum
IRFHTEIFLKQITMLSLLRLELKRRWLRILFILECFLCKSKSHCS

SEQ ID NO: 3385060 - protein, 18 aa, Plasmodium falciparum
IRFMQSSFCRFSNIKTKA

SEQ ID NO: 3385061 - protein, 24 aa, Plasmodium falciparum
IRGNNIRYFILSDSLPLDSLLVED

SEQ ID NO: 3385062 - protein, 19 aa, Plasmodium falciparum
IRHFWKNYYEDVDGIIFVV

SEQ ID NO: 3385063 - protein, 20 aa, Plasmodium falciparum
IRHRFIHNIFDYIKDIFSNK

SEQ ID NO: 3385064 - protein, 19 aa, Plasmodium falciparum
IRILSYNILAPIYTNTKYA

SEQ ID NO: 3385065 - protein, 25 aa, Plasmodium falciparum
IRINQCLKIFFYLTANKKELDEQSK

SEQ ID NO: 3385066 - protein, 32 aa, Plasmodium falciparum
IRIPLFKEINKEIFEKLPLKLQYQILQDIKEE

SEQ ID NO: 3385067 - protein, 17 aa, Plasmodium falciparum
IRKELSEDPIISKYFRI

SEQ ID NO: 3385068 - protein, 25 aa, Plasmodium falciparum
IRKERYIAFLLDRNSDGIILLGSSI

SEQ ID NO: 3385069 - protein, 18 aa, Plasmodium falciparum
IRKINYIKKFLSTGSPVD

SEQ ID NO: 3385070 - protein, 17 aa, Plasmodium falciparum
IRKIYKDMKHIYNEYNN

SEQ ID NO: 3385071 - protein, 30 aa, Plasmodium falciparum
IRKKIKNSLKMKYPFIINFNIKKNKYQNVN

SEQ ID NO: 3385072 - protein, 23 aa, Plasmodium falciparum
IRKKKIGCLFPPCYSQLLINFCV

SEQ ID NO: 3385073 - protein, 18 aa, Plasmodium falciparum
IRKKYLKAALILHPDKKE

SEQ ID NO: 3385074 - protein, 31 aa, Plasmodium falciparum
IRKMNFYYQSFFQKYFIFINSNIKKINEMSD

SEQ ID NO: 3385075 - protein, 23 aa, Plasmodium falciparum
IRKRTLSFLMENKKYIDNFIQMN

SEQ ID NO: 3385076 - protein, 18 aa, Plasmodium falciparum
IRKYISLNILIQNSMENL

SEQ ID NO: 3385077 - protein, 19 aa, Plasmodium falciparum
IRKYNIYKMIYSYSKNVEN

SEQ ID NO: 3385078 - protein, 26 aa, Plasmodium falciparum
IRLFDHLAVILIYEELLKNPLCKITN

SEQ ID NO: 3385079 - protein, 20 aa, Plasmodium falciparum
IRLILQYLKENNLIRSFYVL

SEQ ID NO: 3385080 - protein, 26 aa, Plasmodium falciparum
IRLLKIHIFVTYNGDFFDIPYLYRRC

SEQ ID NO: 3385081 - protein, 17 aa, Plasmodium falciparum
IRLYVKRVFINDKFSES

SEQ ID NO: 3385082 - protein, 29 aa, Plasmodium falciparum
IRNGINEMILFGKVFFQKFNENILLESCG

SEQ ID NO: 3385083 - protein, 18 aa, Plasmodium falciparum
IRNHLFLYNMIIMNIEHI

SEQ ID NO: 3385084 - protein, 29 aa, Plasmodium falciparum
IRNIDKHFYYFKIKGISFLYNQIRHMVAI

SEQ ID NO: 3385085 - protein, 20 aa, Plasmodium falciparum
IRNSVQITRFLIMKSQNHIM

SEQ ID NO: 3385086 - protein, 17 aa, Plasmodium falciparum
IRPPQPSVYLFLIDVTV

SEQ ID NO: 3385087 - protein, 24 aa, Plasmodium falciparum
IRQKKHFMVKYKNYYIHYAEKVMN

SEQ ID NO: 3385088 - protein, 25 aa, Plasmodium falciparum
IRRCELFDIVLFNPPYVITGPDEMN

SEQ ID NO: 3385089 - protein, 24 aa, Plasmodium falciparum
IRREIWHNPLSYYLGLEEFDEFDD

SEQ ID NO: 3385090 - protein, 24 aa, Plasmodium falciparum
IRTCIKFLVILYIDLEEEVKYFYS

SEQ ID NO: 3385091 - protein, 23 aa, Plasmodium falciparum
IRTEYKIAFPYLYNNRPRKIAVS

SEQ ID NO: 3385092 - protein, 23 aa, Plasmodium falciparum
IRTLKLHEFLKSVFQFIRFYCIM

SEQ ID NO: 3385093 - protein, 19 aa, Plasmodium falciparum
IRVLFYKIKIIASKYKKCI

SEQ ID NO: 3385094 - protein, 24 aa, Plasmodium falciparum
IRVRWMIQVPRLYHIYKKMKLINT

SEQ ID NO: 3385095 - protein, 17 aa, Plasmodium falciparum
IRVWSAADGKFLAVYRG

SEQ ID NO: 3385096 - protein, 18 aa, Plasmodium falciparum
IRYTNLNDHLLLIKNGDF

SEQ ID NO: 3385097 - protein, 22 aa, Plasmodium falciparum
IRYVGLCTLQKLLKKDPKTLHI

SEQ ID NO: 3385098 - protein, 28 aa, Plasmodium falciparum
ISACLILFLLNLFDKPFSKLILYPGSLV

SEQ ID NO: 3385099 - protein, 21 aa, Plasmodium falciparum
ISAKIEYFQNLLREEGITPQN

SEQ ID NO: 3385100 - protein, 19 aa, Plasmodium falciparum
ISAKLSLIPVRRGYWGNKI

SEQ ID NO: 3385101 - protein, 25 aa, Plasmodium falciparum
ISAYLYNSRLYILGNWNYISKELFN

SEQ ID NO: 3385102 - protein, 21 aa, Plasmodium falciparum
ISCAWVFFERLVMKGYVHKYN

SEQ ID NO: 3385103 - protein, 26 aa, Plasmodium falciparum
ISDDDVVCKYFFKKKLKKMNEENSLL

SEQ ID NO: 3385104 - protein, 25 aa, Plasmodium falciparum
ISDEKLFFLKINLKENIHLYKMFQG

SEQ ID NO: 3385105 - protein, 18 aa, Plasmodium falciparum
ISDRLINSPALLVQGEMG

SEQ ID NO: 3385106 - protein, 23 aa, Plasmodium falciparum
ISDTLFVDFLSSLLQIDPSKRCN

SEQ ID NO: 3385107 - protein, 24 aa, Plasmodium falciparum
ISDWLEQLFVFNKNLINNGLQMNE

SEQ ID NO: 3385108 - protein, 24 aa, Plasmodium falciparum
ISEHNVITAVQLKDLLLSINESAQ

SEQ ID NO: 3385109 - protein, 23 aa, Plasmodium falciparum
ISEIKHIIKKYIYNIFSQVVNKC

SEQ ID NO: 3385110 - protein, 21 aa, Plasmodium falciparum
ISELFFSNFFSKYNYDYICAF

SEQ ID NO: 3385111 - protein, 24 aa, Plasmodium falciparum
ISENSYLLALLNKELQNVIYHILN

SEQ ID NO: 3385112 - protein, 17 aa, Plasmodium falciparum
ISEQLRKRSRTTFKLKN

SEQ ID NO: 3385113 - protein, 18 aa, Plasmodium falciparum
ISERKKNYPTRNKILNNM

SEQ ID NO: 3385114 - protein, 18 aa, Plasmodium falciparum
ISEYDFYLCLNKLNISIT

SEQ ID NO: 3385115 - protein, 23 aa, Plasmodium falciparum
ISFCSELLPFYCKSEIIHQGDIF

SEQ ID NO: 3385116 - protein, 22 aa, Plasmodium falciparum
ISFFYHVPLFQKRKLTTFALRK

SEQ ID NO: 3385117 - protein, 21 aa, Plasmodium falciparum
ISFKLKRIHNIPRNNLHNYNI

SEQ ID NO: 3385118 - protein, 17 aa, Plasmodium falciparum
ISFLKYFKNVNITCYFL

SEQ ID NO: 3385119 - protein, 23 aa, Plasmodium falciparum
ISFNSFVYTNYYSDNYFSDRTKV

SEQ ID NO: 3385120 - protein, 18 aa, Plasmodium falciparum
ISFTGNICKIAKDQTGCR

SEQ ID NO: 3385121 - protein, 32 aa, Plasmodium falciparum
ISGCFFVEKLNAYLFAMLDKCSNKTVISVFPY

SEQ ID NO: 3385122 - protein, 24 aa, Plasmodium falciparum
ISHRNTFLWGCYFIDIGETNDKRN

SEQ ID NO: 3385123 - protein, 18 aa, Plasmodium falciparum
ISHYIIECYYVSKNIFSI

SEQ ID NO: 3385124 - protein, 18 aa, Plasmodium falciparum
ISICCFYTSLYVEYMMES

SEQ ID NO: 3385125 - protein, 29 aa, Plasmodium falciparum
ISIDYFLKSIIPIKPPLRIQYLATEQIQH

SEQ ID NO: 3385126 - protein, 23 aa, Plasmodium falciparum
ISIENVLKKMKKKKKSDLCINHD

SEQ ID NO: 3385127 - protein, 25 aa, Plasmodium falciparum
ISIIKIKMLLLRRPDIKTIAEKSIV

SEQ ID NO: 3385128 - protein, 36 aa, Plasmodium falciparum
ISILLKSFLKYKYFHISLLKLLMYICNNKSYPQLRD

SEQ ID NO: 3385129 - protein, 24 aa, Plasmodium falciparum
ISIMNKLIEIIKINNIKLSNLNSD

SEQ ID NO: 3385130 - protein, 24 aa, Plasmodium falciparum
ISINIDFYIRLLVHVIDDALQTKD

SEQ ID NO: 3385131 - protein, 21 aa, Plasmodium falciparum
ISIRQKKTLWRRDDGGYGRYN

SEQ ID NO: 3385132 - protein, 26 aa, Plasmodium falciparum
ISISKFPMTTFMKLLEIMNSKYRCRL

SEQ ID NO: 3385133 - protein, 19 aa, Plasmodium falciparum
ISIYFFVNTILYKNDNLAC

SEQ ID NO: 3385134 - protein, 18 aa, Plasmodium falciparum
ISIYKIFKSWENFIYFFD

SEQ ID NO: 3385135 - protein, 44 aa, Plasmodium falciparum
ISIYQLQVVDLYLRSFFLNYFYFPVYLKTFFFKCRNVKLHIQDY

SEQ ID NO: 3385136 - protein, 34 aa, Plasmodium falciparum
ISKCLMFASYYDPIYIKLFYSYLLPCISFDKRIE

SEQ ID NO: 3385137 - protein, 27 aa, Plasmodium falciparum
ISKDDGCFWIPWKDVIKYFSHIYICWN

SEQ ID NO: 3385138 - protein, 29 aa, Plasmodium falciparum
ISKENCLDMFYVLASYYDIIKNIRENLRK

SEQ ID NO: 3385139 - protein, 37 aa, Plasmodium falciparum
ISKFIKKNEKYDWSGYLPVKIQIMKNTENKKFRILCF

SEQ ID NO: 3385140 - protein, 22 aa, Plasmodium falciparum
ISKHIYKILNISKLPKCDILKR

SEQ ID NO: 3385141 - protein, 22 aa, Plasmodium falciparum
ISKIIDCIGIIYDLLEDVVENG

SEQ ID NO: 3385142 - protein, 19 aa, Plasmodium falciparum
ISKINIQPFDKSNCKKGWN

SEQ ID NO: 3385143 - protein, 24 aa, Plasmodium falciparum
ISKKYDQFYASKKKYKNKLKELER

SEQ ID NO: 3385144 - protein, 27 aa, Plasmodium falciparum
ISKLDDTLYFLLRNNLIKKKITLTGGG

SEQ ID NO: 3385145 - protein, 17 aa, Plasmodium falciparum
ISKNRNYYYPSESKKLT

SEQ ID NO: 3385146 - protein, 23 aa, Plasmodium falciparum
ISKRTVPLVLNKLSKIKLNNTKK

SEQ ID NO: 3385147 - protein, 19 aa, Plasmodium falciparum
ISKVMSLIDKYIYDSNKIN

SEQ ID NO: 3385148 - protein, 26 aa, Plasmodium falciparum
ISLDEQMFLPFPYFTTINNIKNNNIS

SEQ ID NO: 3385149 - protein, 18 aa, Plasmodium falciparum
ISLDSSCSFKWEAHLEKE

SEQ ID NO: 3385150 - protein, 26 aa, Plasmodium falciparum
ISLELNIKLIKWKILKDLKFEHIKKL

SEQ ID NO: 3385151 - protein, 18 aa, Plasmodium falciparum
ISLIKFTYASLYKHIWKN

SEQ ID NO: 3385152 - protein, 25 aa, Plasmodium falciparum
ISLIYDFYFDMKLKKLVKWNVGPFK

SEQ ID NO: 3385153 - protein, 23 aa, Plasmodium falciparum
ISLKYKNLLYQYVYYDKNNKNEN

SEQ ID NO: 3385154 - protein, 21 aa, Plasmodium falciparum
ISLLDIKYEPGFIKNLNLCGK

SEQ ID NO: 3385155 - protein, 28 aa, Plasmodium falciparum
ISLSSKHHLFFTFYSLCKIMVFEDKISK

SEQ ID NO: 3385156 - protein, 19 aa, Plasmodium falciparum
ISLTLNSLLYINDQICIFQ

SEQ ID NO: 3385157 - protein, 29 aa, Plasmodium falciparum
ISLYIHAYTLYWHMRPFAASIIISSFNEK

SEQ ID NO: 3385158 - protein, 22 aa, Plasmodium falciparum
ISMIGQFGVGFYSAYLVADHVV

SEQ ID NO: 3385159 - protein, 31 aa, Plasmodium falciparum
ISMKKSIRFYIEFIALSLLSPKFQYNRNYYK

SEQ ID NO: 3385160 - protein, 24 aa, Plasmodium falciparum
ISMNKHIKLFKEDNIPHIIIGTPG

SEQ ID NO: 3385161 - protein, 21 aa, Plasmodium falciparum
ISNIKEYYLDGINIFEVINYV

SEQ ID NO: 3385162 - protein, 18 aa, Plasmodium falciparum
ISNKDISFFLNPLSHYSP

SEQ ID NO: 3385163 - protein, 24 aa, Plasmodium falciparum
ISNLFVDIFLNHKIVKLAGAYALD

SEQ ID NO: 3385164 - protein, 22 aa, Plasmodium falciparum
ISNMEGSLKWKLSSREKENYQR

SEQ ID NO: 3385165 - protein, 26 aa, Plasmodium falciparum
ISNNFVLARYTFPFSQLLQIIQKDKH

SEQ ID NO: 3385166 - protein, 22 aa, Plasmodium falciparum
ISNNIYNTFIPISSNDIMNNNI

SEQ ID NO: 3385167 - protein, 25 aa, Plasmodium falciparum
ISNSTYLVHLLPTIIFTLLHVVTQI

SEQ ID NO: 3385168 - protein, 17 aa, Plasmodium falciparum
ISNYLKYVNMPNGSNSL

SEQ ID NO: 3385169 - protein, 24 aa, Plasmodium falciparum
ISPRNYFTFTPLLPCLCSGTLSVN

SEQ ID NO: 3385170 - protein, 34 aa, Plasmodium falciparum
ISQESKIYSFYYKFYNILILIKKMKSNKKLGIDL

SEQ ID NO: 3385171 - protein, 28 aa, Plasmodium falciparum
ISQFFDEYDMWKCFLSNIYRYENEKCDK

SEQ ID NO: 3385172 - protein, 18 aa, Plasmodium falciparum
ISQIFVFGYSYESVLVCV

SEQ ID NO: 3385173 - protein, 34 aa, Plasmodium falciparum
ISREYIKTMRRLSNKFLIKYDSKFKKLFCKKCNS

SEQ ID NO: 3385174 - protein, 22 aa, Plasmodium falciparum
ISRFLLYINRRRRKLRSKILFN

SEQ ID NO: 3385175 - protein, 25 aa, Plasmodium falciparum
ISSDDIIFYSYLKDYSYNVIINKIV

SEQ ID NO: 3385176 - protein, 38 aa, Plasmodium falciparum
ISSEKMNFNLWPTRVNILKAVNWLVRDSIPFGSYVFYF

SEQ ID NO: 3385177 - protein, 46 aa, Plasmodium falciparum
ISSKINEILFTFPYANFLLSKYFSNFLLFIQLFRTSLDVDHMYLCK

SEQ ID NO: 3385178 - protein, 23 aa, Plasmodium falciparum
ISSNDNFFSVYGKSIRSSSFSNN

SEQ ID NO: 3385179 - protein, 25 aa, Plasmodium falciparum
ISSNELLYALRFLGVESDYSLMENK

SEQ ID NO: 3385180 - protein, 32 aa, Plasmodium falciparum
ISSQFFMHKVKFLPWEYLNSSLSLIFVVQSKD

SEQ ID NO: 3385181 - protein, 32 aa, Plasmodium falciparum
ISSSYNQHFFPNLNFLLNLHTLQILIRDKTAI

SEQ ID NO: 3385182 - protein, 22 aa, Plasmodium falciparum
ISTIFNIVFSDYIFEAKKNFIE

SEQ ID NO: 3385183 - protein, 24 aa, Plasmodium falciparum
ISTKKNILSGAKEKPVAWPSNLCN

SEQ ID NO: 3385184 - protein, 23 aa, Plasmodium falciparum
ISTSPILNKKFVYVKNNYIFQKR

SEQ ID NO: 3385185 - protein, 23 aa, Plasmodium falciparum
ISTYFNCAPIFYVPGRKYNVDIY

SEQ ID NO: 3385186 - protein, 25 aa, Plasmodium falciparum
ISVDVPVPYMVPKPVVVNVEVPVLK

SEQ ID NO: 3385187 - protein, 27 aa, Plasmodium falciparum
ISVSHEKLLLLKKKKRYFLGLKECYKH

SEQ ID NO: 3385188 - protein, 22 aa, Plasmodium falciparum
ISYDMNKLYKGTRLSYKEKHQT

SEQ ID NO: 3385189 - protein, 20 aa, Plasmodium falciparum
ISYEYFYKDTYINEHEHTKI

SEQ ID NO: 3385190 - protein, 32 aa, Plasmodium falciparum
ISYIAVDMAIYWNKFLYMNPCFTKKKKTKTKK

SEQ ID NO: 3385191 - protein, 30 aa, Plasmodium falciparum
ISYILKNIKNPNMFNMLFKKKSNNNLLDIK

SEQ ID NO: 3385192 - protein, 19 aa, Plasmodium falciparum
ISYISVMSPTNEVLKEKNT

SEQ ID NO: 3385193 - protein, 24 aa, Plasmodium falciparum
ISYKYLEHLKYSKILVYMFDINND

SEQ ID NO: 3385194 - protein, 20 aa, Plasmodium falciparum
ISYTYPDGSVWCCEGHISRL

SEQ ID NO: 3385195 - protein, 24 aa, Plasmodium falciparum
ITAEGQVMFTFLGRSEIKDYKNVK

SEQ ID NO: 3385196 - protein, 21 aa, Plasmodium falciparum
ITASLAWTLKYKKIKEKSIFG

SEQ ID NO: 3385197 - protein, 35 aa, Plasmodium falciparum
ITCLKSSLKMMYAYCLFKNLKLFYQIQYKNMNMTE

SEQ ID NO: 3385198 - protein, 17 aa, Plasmodium falciparum
ITCLLYISFHRINNFLN

SEQ ID NO: 3385199 - protein, 25 aa, Plasmodium falciparum
ITCVKWYQEFFILSGSRNCSYIYLY

SEQ ID NO: 3385200 - protein, 22 aa, Plasmodium falciparum
ITDENPFFYTLIVSSKRDENRS

SEQ ID NO: 3385201 - protein, 27 aa, Plasmodium falciparum
ITDGSFVREIKLINLLLNGNVPDEYIF

SEQ ID NO: 3385202 - protein, 27 aa, Plasmodium falciparum
ITDINALQPIFIKSTWPLAKYSILQFS

SEQ ID NO: 3385203 - protein, 30 aa, Plasmodium falciparum
ITDKPAMELIPTINVLHPYANNFNGNVCNT

SEQ ID NO: 3385204 - protein, 23 aa, Plasmodium falciparum
ITDRYIKFISLSSSTFSLNIPYC

SEQ ID NO: 3385205 - protein, 18 aa, Plasmodium falciparum
ITECLIPIFWENNKIKIK

SEQ ID NO: 3385206 - protein, 36 aa, Plasmodium falciparum
ITEEEQLLIINRLHSVLLPFMLRRVKKDVLKSLPKK

SEQ ID NO: 3385207 - protein, 24 aa, Plasmodium falciparum
ITEEKINWLQNLKFKKDSINQQIL

SEQ ID NO: 3385208 - protein, 30 aa, Plasmodium falciparum
ITEKDKFRLYRSLLKFGNPSLRLDDIQEDA

SEQ ID NO: 3385209 - protein, 28 aa, Plasmodium falciparum
ITEKKKLLFFLYLFSKNYYHLSNDNSEW

SEQ ID NO: 3385210 - protein, 29 aa, Plasmodium falciparum
ITELDTFWNAHSFFLFIKGKFQDSFEAKI

SEQ ID NO: 3385211 - protein, 24 aa, Plasmodium falciparum
ITFQEYYMAIHNLNRYIDESKCYD

SEQ ID NO: 3385212 - protein, 26 aa, Plasmodium falciparum
ITFSRNNIMLLKRILEKYNKRVFVIY

SEQ ID NO: 3385213 - protein, 32 aa, Plasmodium falciparum
ITGVSYDRKQKIWVSHWRANCKTIHKYFSVKK

SEQ ID NO: 3385214 - protein, 25 aa, Plasmodium falciparum
ITHPKMRRYIKNPRILLLDCTLEYK

SEQ ID NO: 3385215 - protein, 25 aa, Plasmodium falciparum
ITIADIFISVILYFSLNSGALNESI

SEQ ID NO: 3385216 - protein, 54 aa, Plasmodium falciparum
ITIHAYNTVVPSLWLYASISFYLTKFHLENFKLKTPCHFTLAQNTDFLNSITNN

SEQ ID NO: 3385217 - protein, 24 aa, Plasmodium falciparum
ITIKDILTLKCFIKKPFHDKITLS

SEQ ID NO: 3385218 - protein, 18 aa, Plasmodium falciparum
ITIKQILLGIQDLLDNPN

SEQ ID NO: 3385219 - protein, 17 aa, Plasmodium falciparum
ITILLRGGNQMMIEECE

SEQ ID NO: 3385220 - protein, 28 aa, Plasmodium falciparum
ITINYITKRFPFLKNVILVKSNFKCINE

SEQ ID NO: 3385221 - protein, 25 aa, Plasmodium falciparum
ITKENLMVMNKWYKGIYIVAIVKNI

SEQ ID NO: 3385222 - protein, 25 aa, Plasmodium falciparum
ITKKNFNFFGSFYSKYAKRNKNDKS

SEQ ID NO: 3385223 - protein, 27 aa, Plasmodium falciparum
ITKLDNWKVHFLYKIKSKLSVEPNVEL

SEQ ID NO: 3385224 - protein, 17 aa, Plasmodium falciparum
ITKLLKKMDNIYLGYNE

SEQ ID NO: 3385225 - protein, 23 aa, Plasmodium falciparum
ITKNIFLEILFLLSPHENINECV

SEQ ID NO: 3385226 - protein, 28 aa, Plasmodium falciparum
ITKSKVEFLCYKLIYMTLQNMHQEFLIE

SEQ ID NO: 3385227 - protein, 25 aa, Plasmodium falciparum
ITKSTIYLDIHHLKNTLLYKVSTKD

SEQ ID NO: 3385228 - protein, 31 aa, Plasmodium falciparum
ITKTQNELFSLKLPLEIKVSMALRISERLRA

SEQ ID NO: 3385229 - protein, 24 aa, Plasmodium falciparum
ITKYINEQFSLSKIQFENKMNEYV

SEQ ID NO: 3385230 - protein, 18 aa, Plasmodium falciparum
ITLIFLKEELAFWSIVQL

SEQ ID NO: 3385231 - protein, 17 aa, Plasmodium falciparum
ITLITSGYYKKGLYEFL

SEQ ID NO: 3385232 - protein, 39 aa, Plasmodium falciparum
ITLKEREYPLKSFPWPNAKCPMFFYNSTGLEEMSASGTS

SEQ ID NO: 3385233 - protein, 18 aa, Plasmodium falciparum
ITLLAILIAPFMTPLYRF

SEQ ID NO: 3385234 - protein, 19 aa, Plasmodium falciparum
ITLVRATLLPILSIGKNEK

SEQ ID NO: 3385235 - protein, 19 aa, Plasmodium falciparum
ITLYKNGFIVDDGEFRDLE

SEQ ID NO: 3385236 - protein, 29 aa, Plasmodium falciparum
ITNEDILNTPLFVEPIFNDKHNVSNDLFQ

SEQ ID NO: 3385237 - protein, 18 aa, Plasmodium falciparum
ITNGNEYRYINNKLYTLV

SEQ ID NO: 3385238 - protein, 28 aa, Plasmodium falciparum
ITNIECIYIRCYLCNSLNYSKYSPFNIN

SEQ ID NO: 3385239 - protein, 25 aa, Plasmodium falciparum
ITNIVNDILLVKNVYEDLIKEKDMH

SEQ ID NO: 3385240 - protein, 17 aa, Plasmodium falciparum
ITNQGVQTLLLQKQVIS

SEQ ID NO: 3385241 - protein, 21 aa, Plasmodium falciparum
ITNRHPFPGPGLAIRVIGEIN

SEQ ID NO: 3385242 - protein, 17 aa, Plasmodium falciparum
ITNVKKSILIKNTKKRD

SEQ ID NO: 3385243 - protein, 24 aa, Plasmodium falciparum
ITNVLIILHTFLKKYFIKRNIHIN

SEQ ID NO: 3385244 - protein, 17 aa, Plasmodium falciparum
ITNYNLIIPKELKYDLL

SEQ ID NO: 3385245 - protein, 27 aa, Plasmodium falciparum
ITQKKPSIFIKPLSNSPKTLSKIPYSK

SEQ ID NO: 3385246 - protein, 24 aa, Plasmodium falciparum
ITQYQKIMYLLNVKNKQNAYLLDL

SEQ ID NO: 3385247 - protein, 28 aa, Plasmodium falciparum
ITSLAKQTILLLLKDILNSIPHQMAPSI

SEQ ID NO: 3385248 - protein, 27 aa, Plasmodium falciparum
ITTLLQEIVSIYPQLSPPLLTTSSSNR

SEQ ID NO: 3385249 - protein, 27 aa, Plasmodium falciparum
ITTTLSYPLVNSNFVHLYPYQNSNTNN

SEQ ID NO: 3385250 - protein, 37 aa, Plasmodium falciparum
ITVSEMLTNLFNFRYKRNITIAYDYVESLIGFYQDKY

SEQ ID NO: 3385251 - protein, 24 aa, Plasmodium falciparum
IVASMLNIAILIFDVAKHEGVDSN

SEQ ID NO: 3385252 - protein, 20 aa, Plasmodium falciparum
IVDFFAEWCGPCKRIAPFYE

SEQ ID NO: 3385253 - protein, 24 aa, Plasmodium falciparum
IVDINYSYIFPKIDKRKFLNLIDE

SEQ ID NO: 3385254 - protein, 19 aa, Plasmodium falciparum
IVDLKFKNPFINEEKKRKL

SEQ ID NO: 3385255 - protein, 19 aa, Plasmodium falciparum
IVDQTNIFYLWGEDIKNSI

SEQ ID NO: 3385256 - protein, 30 aa, Plasmodium falciparum
IVDSPITKNYYLYINNFYDFVYNYNNNNII

SEQ ID NO: 3385257 - protein, 25 aa, Plasmodium falciparum
IVEELMKFLPKEKQILMYSATFPVT

SEQ ID NO: 3385258 - protein, 20 aa, Plasmodium falciparum
IVEHLLGRQVALSLASGFLL

SEQ ID NO: 3385259 - protein, 30 aa, Plasmodium falciparum
IVEIGDIFDYLHKLILLCQTKIKYYEQAYK

SEQ ID NO: 3385260 - protein, 18 aa, Plasmodium falciparum
IVEKLIFHMKNSVDIHFK

SEQ ID NO: 3385261 - protein, 19 aa, Plasmodium falciparum
IVFFPTCLCVEFFFHLFKN

SEQ ID NO: 3385262 - protein, 18 aa, Plasmodium falciparum
IVFPKNRVNKFSTSVRSL

SEQ ID NO: 3385263 - protein, 18 aa, Plasmodium falciparum
IVFTYFNENFRAHNSFVI

SEQ ID NO: 3385264 - protein, 17 aa, Plasmodium falciparum
IVFVNLLCELVGVNLYL

SEQ ID NO: 3385265 - protein, 25 aa, Plasmodium falciparum
IVIDKLYYIMCKWKNILENYAMDLL

SEQ ID NO: 3385266 - protein, 18 aa, Plasmodium falciparum
IVIIKGLELLYSLGALND

SEQ ID NO: 3385267 - protein, 18 aa, Plasmodium falciparum
IVIKKKITYNKEKEVKNI

SEQ ID NO: 3385268 - protein, 17 aa, Plasmodium falciparum
IVILIQLCEYGVSPKIL

SEQ ID NO: 3385269 - protein, 17 aa, Plasmodium falciparum
IVIVFNFEKEYIDSEVT

SEQ ID NO: 3385270 - protein, 19 aa, Plasmodium falciparum
IVIVQNFYKDINKGIIQLI

SEQ ID NO: 3385271 - protein, 39 aa, Plasmodium falciparum
IVKCAYASDKFTLFLTIEGILYGVGLINEHLLKGDMNKD

SEQ ID NO: 3385272 - protein, 42 aa, Plasmodium falciparum
IVKHTYMYINILISFFDKLNEWILVCLLKKFLQNFKSSKQLS

SEQ ID NO: 3385273 - protein, 17 aa, Plasmodium falciparum
IVKKALGIIILIHGLAS

SEQ ID NO: 3385274 - protein, 17 aa, Plasmodium falciparum
IVKKLVNMVFPKEIIDT

SEQ ID NO: 3385275 - protein, 31 aa, Plasmodium falciparum
IVKKNEEILILLYKIIYKLNIFDINKKFNKK

SEQ ID NO: 3385276 - protein, 19 aa, Plasmodium falciparum
IVKLFFEISSCLYYIHKKN

SEQ ID NO: 3385277 - protein, 18 aa, Plasmodium falciparum
IVKMYKRKLSFGKDNKKE

SEQ ID NO: 3385278 - protein, 17 aa, Plasmodium falciparum
IVLFETYDEIILSGVGK

SEQ ID NO: 3385279 - protein, 48 aa, Plasmodium falciparum
IVLKIPSSILIINIQEFNCCICKIYLSYQPILFPCCFVSSCSDCLANY

SEQ ID NO: 3385280 - protein, 22 aa, Plasmodium falciparum
IVLKNILNVYFLFDKNNQGFID

SEQ ID NO: 3385281 - protein, 17 aa, Plasmodium falciparum
IVLLKEGTDTAQGRSQI

SEQ ID NO: 3385282 - protein, 21 aa, Plasmodium falciparum
IVNIFQIYSYLYYYNKKKEMI

SEQ ID NO: 3385283 - protein, 29 aa, Plasmodium falciparum
IVNSRPFRRGGFRPRFYRGFRGGRGGFLR

SEQ ID NO: 3385284 - protein, 18 aa, Plasmodium falciparum
IVNYLNRLTDLSIDHNVE

SEQ ID NO: 3385285 - protein, 25 aa, Plasmodium falciparum
IVQAEWDIIFKKLNLIKDCGANIVL

SEQ ID NO: 3385286 - protein, 17 aa, Plasmodium falciparum
IVQKILIDELGLNYICA

SEQ ID NO: 3385287 - protein, 28 aa, Plasmodium falciparum
IVQKLLHIHMYYYFINGNGLENSLKYSF

SEQ ID NO: 3385288 - protein, 25 aa, Plasmodium falciparum
IVQSKLELFSYNKILSLLRKYEYEE

SEQ ID NO: 3385289 - protein, 24 aa, Plasmodium falciparum
IVRDSVLFTYRILSNLFKDLSLNY

SEQ ID NO: 3385290 - protein, 29 aa, Plasmodium falciparum
IVSKDVGFFNLYILDKNYKYNYHTYTKQT

SEQ ID NO: 3385291 - protein, 20 aa, Plasmodium falciparum
IVSKILYMNKKRSRIKIICM

SEQ ID NO: 3385292 - protein, 34 aa, Plasmodium falciparum
IVSLNDMWIFSFDSILWIRINYLCDDIPMGRFGM

SEQ ID NO: 3385293 - protein, 32 aa, Plasmodium falciparum
IVSPGNDIWACGVILYVLMDGRFPYEINNYMP

SEQ ID NO: 3385294 - protein, 17 aa, Plasmodium falciparum
IVSSQTMLPFSYIGLNL

SEQ ID NO: 3385295 - protein, 28 aa, Plasmodium falciparum
IVSTDEVFVYFFSQKKWYLLKGKLCNDE

SEQ ID NO: 3385296 - protein, 23 aa, Plasmodium falciparum
IVSYIPEYDLFSNRRKSNAKLCI

SEQ ID NO: 3385297 - protein, 35 aa, Plasmodium falciparum
IVTNVSGATWIYAPPELLTCHPLKQSSDYNFLDHT

SEQ ID NO: 3385298 - protein, 36 aa, Plasmodium falciparum
IVTPTNKVLILLKNKTVFILTIKERQYYLHGIQLLR

SEQ ID NO: 3385299 - protein, 21 aa, Plasmodium falciparum
IVVKHHLTMYIDVIEKLKNEI

SEQ ID NO: 3385300 - protein, 26 aa, Plasmodium falciparum
IVYEANLPFILRYIIDHKITGSSWIN

SEQ ID NO: 3385301 - protein, 50 aa, Plasmodium falciparum
IWEDNEFYLKLKNADYIRSFYFYDNSWTRPFMSLLVHKVLDDNLNLLPFY

SEQ ID NO: 3385302 - protein, 17 aa, Plasmodium falciparum
IWEESIIMLPHHVQILL

SEQ ID NO: 3385303 - protein, 28 aa, Plasmodium falciparum
IWEIKNMQINWYTLFNLSNEINNQNVHY

SEQ ID NO: 3385304 - protein, 20 aa, Plasmodium falciparum
IWKGILSMKNKENLNIIGHA

SEQ ID NO: 3385305 - protein, 18 aa, Plasmodium falciparum
IWLHTIIVIYKCVHILKS

SEQ ID NO: 3385306 - protein, 31 aa, Plasmodium falciparum
IWNDKRYITNGNIAAPFFVNNNDMILSPHYN

SEQ ID NO: 3385307 - protein, 21 aa, Plasmodium falciparum
IWRYTHLLHHFIGENGLILPR

SEQ ID NO: 3385308 - protein, 27 aa, Plasmodium falciparum
IWSDKHLFEYLLNPKLYIPGTKMIFAG

SEQ ID NO: 3385309 - protein, 36 aa, Plasmodium falciparum
IWSYDGNSFLLLHSIEGLLLISNYEEKKKRKIEKIA

SEQ ID NO: 3385310 - protein, 20 aa, Plasmodium falciparum
IYAKIEHPIIFITCGSYNSA

SEQ ID NO: 3385311 - protein, 22 aa, Plasmodium falciparum
IYALFEHLKKQNQFPLLICLDQ

SEQ ID NO: 3385312 - protein, 18 aa, Plasmodium falciparum
IYALIVRNPNIFIDHIYC

SEQ ID NO: 3385313 - protein, 34 aa, Plasmodium falciparum
IYATNSSFPPYKFISYLRPKLTPKAYHLKNNEIL

SEQ ID NO: 3385314 - protein, 18 aa, Plasmodium falciparum
IYAYCYLHRIYNKSINNK

SEQ ID NO: 3385315 - protein, 17 aa, Plasmodium falciparum
IYCDKANNIYYYGNNYK

SEQ ID NO: 3385316 - protein, 30 aa, Plasmodium falciparum
IYDCDNSLVSIINKIKKLYKCYRSMEEKYL

SEQ ID NO: 3385317 - protein, 22 aa, Plasmodium falciparum
IYDHKLVPSIIFLLNTTLQTNG

SEQ ID NO: 3385318 - protein, 18 aa, Plasmodium falciparum
IYDILLCYNNMRNLNKED

SEQ ID NO: 3385319 - protein, 24 aa, Plasmodium falciparum
IYDKIHIVLYDYLGLMVCHISFPE

SEQ ID NO: 3385320 - protein, 20 aa, Plasmodium falciparum
IYDLHEIKILSPHILKTLFQ

SEQ ID NO: 3385321 - protein, 18 aa, Plasmodium falciparum
IYDNNVMNFLLNLKTQKV

SEQ ID NO: 3385322 - protein, 34 aa, Plasmodium falciparum
IYDQNKMKLYDYLQKLLLENYFLETKMKLKNESL

SEQ ID NO: 3385323 - protein, 21 aa, Plasmodium falciparum
IYDSIYIPQINIKNIINSEEI

SEQ ID NO: 3385324 - protein, 33 aa, Plasmodium falciparum
IYDSRFSIIYLEHDLIYLKKNNLKVILNVLLSN

SEQ ID NO: 3385325 - protein, 19 aa, Plasmodium falciparum
IYDYNYMENFDYFLKKKKK

SEQ ID NO: 3385326 - protein, 19 aa, Plasmodium falciparum
IYEHLNGFVFFDFINGIKE

SEQ ID NO: 3385327 - protein, 18 aa, Plasmodium falciparum
IYEILLSLFEKKYQSKYD

SEQ ID NO: 3385328 - protein, 20 aa, Plasmodium falciparum
IYEKIDLTLLNRLLRLIVDH

SEQ ID NO: 3385329 - protein, 17 aa, Plasmodium falciparum
IYEKIKSDPIWGLYEIM

SEQ ID NO: 3385330 - protein, 25 aa, Plasmodium falciparum
IYELKIYPYKMKWLPTYATPNNTQA

SEQ ID NO: 3385331 - protein, 20 aa, Plasmodium falciparum
IYELPLHIIVPLEHENILKI

SEQ ID NO: 3385332 - protein, 18 aa, Plasmodium falciparum
IYESVVFLSAENLYVLKN

SEQ ID NO: 3385333 - protein, 27 aa, Plasmodium falciparum
IYETNILEELFILNKKKKKFVGENEAW

SEQ ID NO: 3385334 - protein, 20 aa, Plasmodium falciparum
IYEYLNTPYYDYFDLYVKTL

SEQ ID NO: 3385335 - protein, 19 aa, Plasmodium falciparum
IYFCCLNERFGGCGSVLSL

SEQ ID NO: 3385336 - protein, 24 aa, Plasmodium falciparum
IYFENECLRYLYSAQFDFSKAMEL

SEQ ID NO: 3385337 - protein, 19 aa, Plasmodium falciparum
IYFLNHIYNFIKKNKYYGN

SEQ ID NO: 3385338 - protein, 20 aa, Plasmodium falciparum
IYFLSSWKIKTAILKTIIAF

SEQ ID NO: 3385339 - protein, 34 aa, Plasmodium falciparum
IYFSFHDLYISPMRLYYFIKMKIDEIYYLDMSRK

SEQ ID NO: 3385340 - protein, 21 aa, Plasmodium falciparum
IYGMKAMASVWNRGPLSVTKF

SEQ ID NO: 3385341 - protein, 19 aa, Plasmodium falciparum
IYHDNKVTWLAYYKDSIND

SEQ ID NO: 3385342 - protein, 25 aa, Plasmodium falciparum
IYHNKLYIFDILTSYNIATIDLLHY

SEQ ID NO: 3385343 - protein, 18 aa, Plasmodium falciparum
IYIFYQLIYLKNNNKYIF

SEQ ID NO: 3385344 - protein, 18 aa, Plasmodium falciparum
IYIGVILNFITKNNNVVS

SEQ ID NO: 3385345 - protein, 20 aa, Plasmodium falciparum
IYIHPNDNLTFYRPSINKEN

SEQ ID NO: 3385346 - protein, 29 aa, Plasmodium falciparum
IYIHPNVPCKFGIYCTNYYCNYSHDHVDT

SEQ ID NO: 3385347 - protein, 20 aa, Plasmodium falciparum
IYIIDLYYIDYNYKFMIYTF

SEQ ID NO: 3385348 - protein, 20 aa, Plasmodium falciparum
IYIIIEIIYAYCYLHRIYNK

SEQ ID NO: 3385349 - protein, 22 aa, Plasmodium falciparum
IYINNNILYLCINDLTKLRLIN

SEQ ID NO: 3385350 - protein, 21 aa, Plasmodium falciparum
IYITKHFLYTQIKKAHKLVTL

SEQ ID NO: 3385351 - protein, 19 aa, Plasmodium falciparum
IYITPKLYLESIKTYHIML

SEQ ID NO: 3385352 - protein, 32 aa, Plasmodium falciparum
IYITTSYFLPPGFLRRALFSALYKGVNISFLF

SEQ ID NO: 3385353 - protein, 21 aa, Plasmodium falciparum
IYIWDKYTNKYLFHFKKHKAA

SEQ ID NO: 3385354 - protein, 25 aa, Plasmodium falciparum
IYKDNYSFIYFIFLHNINEHVEITT

SEQ ID NO: 3385355 - protein, 20 aa, Plasmodium falciparum
IYKFIKKKCIQKKKAMPWIQ

SEQ ID NO: 3385356 - protein, 20 aa, Plasmodium falciparum
IYKHYILRDLIRILRVSHSI

SEQ ID NO: 3385357 - protein, 19 aa, Plasmodium falciparum
IYKKLQKKIVFNNKILLTG

SEQ ID NO: 3385358 - protein, 25 aa, Plasmodium falciparum
IYKNDIYINDIYKKDIYKNDIYKND

SEQ ID NO: 3385359 - protein, 17 aa, Plasmodium falciparum
IYKNFSANLIEPSYFIN

SEQ ID NO: 3385360 - protein, 34 aa, Plasmodium falciparum
IYKNSLYLFGYSYLYTPLFFNNKNSIIKYVKACI

SEQ ID NO: 3385361 - protein, 24 aa, Plasmodium falciparum
IYKNTYFQLNIGKPTYYLNVNKNI

SEQ ID NO: 3385362 - protein, 25 aa, Plasmodium falciparum
IYKQGNMYMHIPKNADLMNNVSSYS

SEQ ID NO: 3385363 - protein, 20 aa, Plasmodium falciparum
IYKYHPKCSLILRINVDFKN

SEQ ID NO: 3385364 - protein, 27 aa, Plasmodium falciparum
IYKYPIKYCELNSKAFVFFIIKNVGVH

SEQ ID NO: 3385365 - protein, 17 aa, Plasmodium falciparum
IYLAKKYLKDMGIESSD

SEQ ID NO: 3385366 - protein, 29 aa, Plasmodium falciparum
IYLAKRYFRLYWIIVYHIEIPKKINIAYP

SEQ ID NO: 3385367 - protein, 20 aa, Plasmodium falciparum
IYLDLTHLPYETLKERLPGI

SEQ ID NO: 3385368 - protein, 39 aa, Plasmodium falciparum
IYLFDKYIVIRYYDLFKYCILLIFLLNNQLICVLENGYI

SEQ ID NO: 3385369 - protein, 19 aa, Plasmodium falciparum
IYLIGENNFIFLLKKGNHV

SEQ ID NO: 3385370 - protein, 20 aa, Plasmodium falciparum
IYLLNLYTPMMQKLNTIMNT

SEQ ID NO: 3385371 - protein, 18 aa, Plasmodium falciparum
IYLNDLRKHDLAHIWCFL

SEQ ID NO: 3385372 - protein, 19 aa, Plasmodium falciparum
IYLPLSVLGFVHIEVKSNN

SEQ ID NO: 3385373 - protein, 18 aa, Plasmodium falciparum
IYLRRIKPLFCYSNMIDR

SEQ ID NO: 3385374 - protein, 24 aa, Plasmodium falciparum
IYNDHYIFVYIIKDYNIYERLKYK

SEQ ID NO: 3385375 - protein, 25 aa, Plasmodium falciparum
IYNDYIYIYCKEGIKIYGIIENYII

SEQ ID NO: 3385376 - protein, 23 aa, Plasmodium falciparum
IYNDYLVLQLIRKSFDKDDESQM

SEQ ID NO: 3385377 - protein, 29 aa, Plasmodium falciparum
IYNERVEIKFRFLFSLSPITCIKFIPRHS

SEQ ID NO: 3385378 - protein, 26 aa, Plasmodium falciparum
IYNFYKHFRLFKMFQIYNLSHIEKIK

SEQ ID NO: 3385379 - protein, 19 aa, Plasmodium falciparum
IYNGLIQIIRCYKKFAPHR

SEQ ID NO: 3385380 - protein, 18 aa, Plasmodium falciparum
IYNINMYLYLLNKYDYKC

SEQ ID NO: 3385381 - protein, 26 aa, Plasmodium falciparum
IYNKFYRHFIIHYLPQIRSLDFHDIS

SEQ ID NO: 3385382 - protein, 23 aa, Plasmodium falciparum
IYNKGLGQFYAGFYAKLIESGSK

SEQ ID NO: 3385383 - protein, 24 aa, Plasmodium falciparum
IYNLNMHDYFYKSLKSNIMMEPEL

SEQ ID NO: 3385384 - protein, 27 aa, Plasmodium falciparum
IYNNSLWVYRYFILNKLSYFHDLAKMQ

SEQ ID NO: 3385385 - protein, 22 aa, Plasmodium falciparum
IYNQFCTTYIAIIFIYKEDSMH

SEQ ID NO: 3385386 - protein, 17 aa, Plasmodium falciparum
IYNVNPLSNYIKNDKES

SEQ ID NO: 3385387 - protein, 20 aa, Plasmodium falciparum
IYNYKFPSWIPKRSINNFFI

SEQ ID NO: 3385388 - protein, 17 aa, Plasmodium falciparum
IYPLKRLKVYNEPNSIE

SEQ ID NO: 3385389 - protein, 17 aa, Plasmodium falciparum
IYPLNILKKKSFNVTDR

SEQ ID NO: 3385390 - protein, 19 aa, Plasmodium falciparum
IYPNDKFIKPLFSFDKEKV

SEQ ID NO: 3385391 - protein, 19 aa, Plasmodium falciparum
IYQLVTCTVPFDGSTEWFI

SEQ ID NO: 3385392 - protein, 25 aa, Plasmodium falciparum
IYQQYNMTVTYPYGVPYINMKNKIT

SEQ ID NO: 3385393 - protein, 18 aa, Plasmodium falciparum
IYRDIDIFFSLEHKTKNL

SEQ ID NO: 3385394 - protein, 25 aa, Plasmodium falciparum
IYRGYIVHLFFNESLIFNSVRLFTK

SEQ ID NO: 3385395 - protein, 17 aa, Plasmodium falciparum
IYRIIHSDKVQASLLAK

SEQ ID NO: 3385396 - protein, 26 aa, Plasmodium falciparum
IYRLPNLYMIIYIKRFKWIYDQRTNY

SEQ ID NO: 3385397 - protein, 34 aa, Plasmodium falciparum
IYRSEYRVVVKHFPRFFKNIKEFLSRAGKVLYIH

SEQ ID NO: 3385398 - protein, 28 aa, Plasmodium falciparum
IYSDLFKVLFYELQPHYKIYIPSSNNKI

SEQ ID NO: 3385399 - protein, 24 aa, Plasmodium falciparum
IYSKQILQTALIQITYKQNVNQMK

SEQ ID NO: 3385400 - protein, 21 aa, Plasmodium falciparum
IYSKWSPYIPDLFASSTNMDT

SEQ ID NO: 3385401 - protein, 17 aa, Plasmodium falciparum
IYSLPKKNKPRCLVISD

SEQ ID NO: 3385402 - protein, 29 aa, Plasmodium falciparum
IYSNCYFSCMFWFSYYLYNYEKSLEEVLN

SEQ ID NO: 3385403 - protein, 24 aa, Plasmodium falciparum
IYSNKPPLHPKKDHWFFGPKEDFK

SEQ ID NO: 3385404 - protein, 23 aa, Plasmodium falciparum
IYSNNFMHIYDTEALFSNNTEKE

SEQ ID NO: 3385405 - protein, 22 aa, Plasmodium falciparum
IYSPNPMLDIFSPKPQINHNIY

SEQ ID NO: 3385406 - protein, 30 aa, Plasmodium falciparum
IYSQYKNTIKWGPFGNMIALGGFGNLAGDI

SEQ ID NO: 3385407 - protein, 18 aa, Plasmodium falciparum
IYSWGGFTDIPFDHNFFP

SEQ ID NO: 3385408 - protein, 25 aa, Plasmodium falciparum
IYTCEWPSLFIEWLPKVYKNDEEYA

SEQ ID NO: 3385409 - protein, 21 aa, Plasmodium falciparum
IYTIIHIFCKLKFTKYSLYNN

SEQ ID NO: 3385410 - protein, 17 aa, Plasmodium falciparum
IYTPKLINKKEALVINS

SEQ ID NO: 3385411 - protein, 26 aa, Plasmodium falciparum
IYTTNMKMPKYNFSTPINIYNDYINR

SEQ ID NO: 3385412 - protein, 19 aa, Plasmodium falciparum
IYTVLYRMLIKKINERNKI

SEQ ID NO: 3385413 - protein, 21 aa, Plasmodium falciparum
IYTYYKKYYESLFAKINIDKT

SEQ ID NO: 3385414 - protein, 17 aa, Plasmodium falciparum
IYVLKDRISYLKEKTNI

SEQ ID NO: 3385415 - protein, 17 aa, Plasmodium falciparum
IYVLSNFSIYLAFYNYT

SEQ ID NO: 3385416 - protein, 36 aa, Plasmodium falciparum
IYVQTELYIDIISSSIRNLINFKKTLEERNVELEKV

SEQ ID NO: 3385417 - protein, 20 aa, Plasmodium falciparum
IYYDFDDLLIETYRLMKDNA

SEQ ID NO: 3385418 - protein, 25 aa, Plasmodium falciparum
KAAHDAYMLLAIGNAAWPMGVTMVG

SEQ ID NO: 3385419 - protein, 24 aa, Plasmodium falciparum
KACLKCFAKQDIIYSWGGFTDIPF

SEQ ID NO: 3385420 - protein, 34 aa, Plasmodium falciparum
KACVCYIKNNDNYICFFCLYDINFCTLCKEVLTN

SEQ ID NO: 3385421 - protein, 20 aa, Plasmodium falciparum
KADINYLDKIGRSALHYACA

SEQ ID NO: 3385422 - protein, 20 aa, Plasmodium falciparum
KAEAFVHWLINEYSMENTNG

SEQ ID NO: 3385423 - protein, 25 aa, Plasmodium falciparum
KAEKDDFFFYDTKKGIWYEIISDEY

SEQ ID NO: 3385424 - protein, 25 aa, Plasmodium falciparum
KAENPKAYVFALHGITSHLRNEYLN

SEQ ID NO: 3385425 - protein, 30 aa, Plasmodium falciparum
KAETFDVPPYCELAPLIVLTKNCQLSTFEN

SEQ ID NO: 3385426 - protein, 21 aa, Plasmodium falciparum
KAFLINLKNLEYKILTFQIDE

SEQ ID NO: 3385427 - protein, 19 aa, Plasmodium falciparum
KAHIVGIDIFTGRKYEDIC

SEQ ID NO: 3385428 - protein, 25 aa, Plasmodium falciparum
KAHKSLYIIIINFTRQTLNLTDCRG

SEQ ID NO: 3385429 - protein, 17 aa, Plasmodium falciparum
KAILMKKIPAKYKMNTV

SEQ ID NO: 3385430 - protein, 29 aa, Plasmodium falciparum
KAISFLIYEQCFIEYLYEGKYFAALRCLR

SEQ ID NO: 3385431 - protein, 17 aa, Plasmodium falciparum
KAIVLFETYDEIILSGV

SEQ ID NO: 3385432 - protein, 17 aa, Plasmodium falciparum
KAIYWKNMSYLSQNKYT

SEQ ID NO: 3385433 - protein, 28 aa, Plasmodium falciparum
KAKELLLILKYIFHLNVDYDKYIFNHIY

SEQ ID NO: 3385434 - protein, 20 aa, Plasmodium falciparum
KAKIHLDNKIYRGKILIAKY

SEQ ID NO: 3385435 - protein, 22 aa, Plasmodium falciparum
KAKISIFKIFEREGQNGVPFSF

SEQ ID NO: 3385436 - protein, 22 aa, Plasmodium falciparum
KALDFLLFDMLKDNLPNNLFEI

SEQ ID NO: 3385437 - protein, 30 aa, Plasmodium falciparum
KALEQDGCLLKDKYIQVTLALNNSMQDNNK

SEQ ID NO: 3385438 - protein, 22 aa, Plasmodium falciparum
KALGIIILIHGLASHLRFGFLN

SEQ ID NO: 3385439 - protein, 18 aa, Plasmodium falciparum
KALLYSYIMRRQKYRRLR

SEQ ID NO: 3385440 - protein, 24 aa, Plasmodium falciparum
KALMDLHNFYLKDRYIKVSYTKSR

SEQ ID NO: 3385441 - protein, 27 aa, Plasmodium falciparum
KALPKSKALPILLKKNISIPKEKFTTN

SEQ ID NO: 3385442 - protein, 18 aa, Plasmodium falciparum
KAMGSACNFAWINRSSMT

SEQ ID NO: 3385443 - protein, 17 aa, Plasmodium falciparum
KAMPISLLFSNRIYENI

SEQ ID NO: 3385444 - protein, 30 aa, Plasmodium falciparum
KANFFGKAVDKWFDFIEVGKIYKISKGMIK

SEQ ID NO: 3385445 - protein, 27 aa, Plasmodium falciparum
KANKSYRDFFYRYYLNNLISDTDEQFL

SEQ ID NO: 3385446 - protein, 21 aa, Plasmodium falciparum
KANLITYNLFGIEAPIGSVEN

SEQ ID NO: 3385447 - protein, 18 aa, Plasmodium falciparum
KAPLMNPMNPEVVPPILQ

SEQ ID NO: 3385448 - protein, 24 aa, Plasmodium falciparum
KAPSKGTIKHTLEYLKRAAESRMK

SEQ ID NO: 3385449 - protein, 19 aa, Plasmodium falciparum
KAQEFWSLGFGNPFPCSGI

SEQ ID NO: 3385450 - protein, 29 aa, Plasmodium falciparum
KAQRIIQRILFRLDILDKLFILKNNSVFF

SEQ ID NO: 3385451 - protein, 30 aa, Plasmodium falciparum
KARNIYNDTCPYLLYVPRQGYFCSHHIGSQ

SEQ ID NO: 3385452 - protein, 30 aa, Plasmodium falciparum
KASDIFFNFPKFSFVIFKNRQKQVKKKLAF

SEQ ID NO: 3385453 - protein, 23 aa, Plasmodium falciparum
KASLFFYENLFIYLKELNKKKKI

SEQ ID NO: 3385454 - protein, 28 aa, Plasmodium falciparum
KASSRSHLIFIIKINRYIYSTNTIRCGK

SEQ ID NO: 3385455 - protein, 23 aa, Plasmodium falciparum
KASVIIMKNERLQKVYKGRGVND

SEQ ID NO: 3385456 - protein, 17 aa, Plasmodium falciparum
KASYIIQDLFSYYHEFV

SEQ ID NO: 3385457 - protein, 24 aa, Plasmodium falciparum
KATPNFIYKFFTEPNSQESLKWLN

SEQ ID NO: 3385458 - protein, 22 aa, Plasmodium falciparum
KATYTCLLCKRKKKINLQHLSK

SEQ ID NO: 3385459 - protein, 24 aa, Plasmodium falciparum
KAVDIFHFLCNNYISIKCPLDLIP

SEQ ID NO: 3385460 - protein, 59 aa, Plasmodium falciparum
KAYCFKHTFQYCKKSNFLNFINANKLFCFENFLYNPFNHLYNFLIGTYVFNHLNKKCSI

SEQ ID NO: 3385461 - protein, 20 aa, Plasmodium falciparum
KAYHLLLKYGAIEKKNCVKG

SEQ ID NO: 3385462 - protein, 23 aa, Plasmodium falciparum
KAYPLAKYAIMKSGGNFPYLSRH

SEQ ID NO: 3385463 - protein, 21 aa, Plasmodium falciparum
KAYTVLNQCNYVILDEADRMM

SEQ ID NO: 3385464 - protein, 18 aa, Plasmodium falciparum
KAYVPLGFVIQPLAPIPD

SEQ ID NO: 3385465 - protein, 26 aa, Plasmodium falciparum
KCAVRRCLILCPASLINNWNDEISKW

SEQ ID NO: 3385466 - protein, 31 aa, Plasmodium falciparum
KCCKLQRAYNIFIIIIFSIVKEIKNLTKELN

SEQ ID NO: 3385467 - protein, 19 aa, Plasmodium falciparum
KCCKYLHQSKYRKPYSYFK

SEQ ID NO: 3385468 - protein, 41 aa, Plasmodium falciparum
KCDHPNIIKLCGGIIHSYFDIWLVTKLVNGLDLHTIKNNMN

SEQ ID NO: 3385469 - protein, 18 aa, Plasmodium falciparum
KCDILKRTNRRYAETFLY

SEQ ID NO: 3385470 - protein, 25 aa, Plasmodium falciparum
KCDQNEYYLTKYPPNEYNPNKYHPN

SEQ ID NO: 3385471 - protein, 33 aa, Plasmodium falciparum
KCDSETLLPIANISRIMKRILPGSAKVAKESKD

SEQ ID NO: 3385472 - protein, 24 aa, Plasmodium falciparum
KCEGGVMYFPEKSLDYSRNSYKYS

SEQ ID NO: 3385473 - protein, 23 aa, Plasmodium falciparum
KCEKASILLDNPSIFEDLHIIED

SEQ ID NO: 3385474 - protein, 41 aa, Plasmodium falciparum
KCFNNKYSYRKFLKIFIQLFLDKILCIRKYIIKRKKNKNDS

SEQ ID NO: 3385475 - protein, 18 aa, Plasmodium falciparum
KCFNRPFRKSFVKDLEIK

SEQ ID NO: 3385476 - protein, 18 aa, Plasmodium falciparum
KCHHVKSYKLGKESDGWI

SEQ ID NO: 3385477 - protein, 19 aa, Plasmodium falciparum
KCIHILLSNNNFAYAAFFS

SEQ ID NO: 3385478 - protein, 18 aa, Plasmodium falciparum
KCILQTCRFLQTKGFEVT

SEQ ID NO: 3385479 - protein, 19 aa, Plasmodium falciparum
KCISLWSEELRKKSEKNNL

SEQ ID NO: 3385480 - protein, 26 aa, Plasmodium falciparum
KCITRKFHFAFLVTNIIFSKDNRLIF

SEQ ID NO: 3385481 - protein, 18 aa, Plasmodium falciparum
KCIVLGGPGFFKNDFFSY

SEQ ID NO: 3385482 - protein, 27 aa, Plasmodium falciparum
KCKEKNIPIVFALSKNLLGKCINKSRQ

SEQ ID NO: 3385483 - protein, 24 aa, Plasmodium falciparum
KCKEKNPLFYSVDFSNQKKNDIDK

SEQ ID NO: 3385484 - protein, 19 aa, Plasmodium falciparum
KCKGEKPFLLCINKNVLKK

SEQ ID NO: 3385485 - protein, 31 aa, Plasmodium falciparum
KCKIIRTYVIYNYIGLIKILKKKNKHCGNIF

SEQ ID NO: 3385486 - protein, 22 aa, Plasmodium falciparum
KCKKDLFNIREITLDNLKDINT

SEQ ID NO: 3385487 - protein, 29 aa, Plasmodium falciparum
KCKPSYEYIIPILIVLKAIGTPILQAQYN

SEQ ID NO: 3385488 - protein, 19 aa, Plasmodium falciparum
KCKRFSFGPYKYTDINTQF

SEQ ID NO: 3385489 - protein, 17 aa, Plasmodium falciparum
KCLFFTKDNLIDIEKKL

SEQ ID NO: 3385490 - protein, 24 aa, Plasmodium falciparum
KCLIEELLFERYCSAIGKNLYHKN

SEQ ID NO: 3385491 - protein, 19 aa, Plasmodium falciparum
KCNKYIYKGERFKSERRKI

SEQ ID NO: 3385492 - protein, 23 aa, Plasmodium falciparum
KCNLDDVLILWKGLGYYNRAKNL

SEQ ID NO: 3385493 - protein, 23 aa, Plasmodium falciparum
KCNQLNMIPLHKKKSIYKNEYPE

SEQ ID NO: 3385494 - protein, 31 aa, Plasmodium falciparum
KCNSKTLLPPLFLYVTFFQFKIKYLCETDNV

SEQ ID NO: 3385495 - protein, 17 aa, Plasmodium falciparum
KCPSSSYLSLNELLKFV

SEQ ID NO: 3385496 - protein, 20 aa, Plasmodium falciparum
KCSIYLMKPIKIEEQSFTNI

SEQ ID NO: 3385497 - protein, 18 aa, Plasmodium falciparum
KCSTLFHLLIRNGSIAIG

SEQ ID NO: 3385498 - protein, 24 aa, Plasmodium falciparum
KCTEGLIVITWDKFVHFFTDVEDA

SEQ ID NO: 3385499 - protein, 31 aa, Plasmodium falciparum
KCTPKKYISFLKFYWIYFNKEDLKKQNVDSF

SEQ ID NO: 3385500 - protein, 42 aa, Plasmodium falciparum
KCVHKNIMIITHLPFHLNIYNILYLLLNASLYNFDISLIKEE

SEQ ID NO: 3385501 - protein, 24 aa, Plasmodium falciparum
KCVQDIFWCYSLNNGKWTQIQNSI

SEQ ID NO: 3385502 - protein, 27 aa, Plasmodium falciparum
KCVSHPFIVKMYYAFQTKQKLYFILEY

SEQ ID NO: 3385503 - protein, 31 aa, Plasmodium falciparum
KCYANALYNSYLLQIPIRIFRHHNLENKYSP

SEQ ID NO: 3385504 - protein, 17 aa, Plasmodium falciparum
KCYDLVLDELLKVTRKK

SEQ ID NO: 3385505 - protein, 18 aa, Plasmodium falciparum
KDAYYFHKKKLNFKDRHL

SEQ ID NO: 3385506 - protein, 20 aa, Plasmodium falciparum
KDCIIFNRITKKEDFLFLIN

SEQ ID NO: 3385507 - protein, 29 aa, Plasmodium falciparum
KDCMYEKFMLYNLFSYNITCLKSSLKMMY

SEQ ID NO: 3385508 - protein, 17 aa, Plasmodium falciparum
KDCPNFSEVAKIIPQWK

SEQ ID NO: 3385509 - protein, 28 aa, Plasmodium falciparum
KDDILDNLININFKDEIKRIIQNAEATF

SEQ ID NO: 3385510 - protein, 25 aa, Plasmodium falciparum
KDDLFLTLSGLLLLGNIQFNGIEKG

SEQ ID NO: 3385511 - protein, 23 aa, Plasmodium falciparum
KDDLIPLMDPLQFLLDELIHRYI

SEQ ID NO: 3385512 - protein, 36 aa, Plasmodium falciparum
KDDSTDLYLFTYLLNIFHNSNIIVLLLSINKPNDSI

SEQ ID NO: 3385513 - protein, 23 aa, Plasmodium falciparum
KDDTFYINNKFLISENNILLEDK

SEQ ID NO: 3385514 - protein, 26 aa, Plasmodium falciparum
KDDVKKPFLVFSLPKSRNIKKRRKPI

SEQ ID NO: 3385515 - protein, 20 aa, Plasmodium falciparum
KDDVLKRYSMYLKDPKENNT

SEQ ID NO: 3385516 - protein, 25 aa, Plasmodium falciparum
KDEDNFETIFLKTRSSFSSVDSNII

SEQ ID NO: 3385517 - protein, 22 aa, Plasmodium falciparum
KDEELRKIFWEENKKFIWEGMI

SEQ ID NO: 3385518 - protein, 28 aa, Plasmodium falciparum
KDEKKNMLPRLLLKINKILDDNNLDHKK

SEQ ID NO: 3385519 - protein, 28 aa, Plasmodium falciparum
KDEKMKNFLYLFYTNKVLLQEKEELQDF

SEQ ID NO: 3385520 - protein, 26 aa, Plasmodium falciparum
KDENNILCNLLYKMKWKNIYDEKNIN

SEQ ID NO: 3385521 - protein, 22 aa, Plasmodium falciparum
KDERVKILKGELCNLIGTITAV

SEQ ID NO: 3385522 - protein, 24 aa, Plasmodium falciparum
KDFFDLYICFIDINYIFNSLSWDF

SEQ ID NO: 3385523 - protein, 21 aa, Plasmodium falciparum
KDFFSKNYILNSFSFNLMNCY

SEQ ID NO: 3385524 - protein, 21 aa, Plasmodium falciparum
KDFLLSPLKNNVLFSSSIYGV

SEQ ID NO: 3385525 - protein, 28 aa, Plasmodium falciparum
KDFSKLLLIRVLRKDRFLIALKNYITKN

SEQ ID NO: 3385526 - protein, 32 aa, Plasmodium falciparum
KDGDIYLQLFEYIWPKVMKKYKGRIIMYPSSD

SEQ ID NO: 3385527 - protein, 21 aa, Plasmodium falciparum
KDGLKLPYNFDLLLDQIDSDG

SEQ ID NO: 3385528 - protein, 23 aa, Plasmodium falciparum
KDGLLLRTYSWTVKKAIGIFLLI

SEQ ID NO: 3385529 - protein, 29 aa, Plasmodium falciparum
KDGYFLYCIDAYLPLFNSFKLAEELRSKC

SEQ ID NO: 3385530 - protein, 17 aa, Plasmodium falciparum
KDGYYPKEDYHYKNVHH

SEQ ID NO: 3385531 - protein, 27 aa, Plasmodium falciparum
KDHAAFLKYKPIIFAISIYNMSFNDTK

SEQ ID NO: 3385532 - protein, 22 aa, Plasmodium falciparum
KDHIHIFYQQFFDYYYQNFKYF

SEQ ID NO: 3385533 - protein, 27 aa, Plasmodium falciparum
KDHKKTFNIYSLLESAAQFYGEGPKYC

SEQ ID NO: 3385534 - protein, 21 aa, Plasmodium falciparum
KDHKYLAKKFQWFSPFSKSNK

SEQ ID NO: 3385535 - protein, 36 aa, Plasmodium falciparum
KDHPKNIELLYKYIMHRLYNFPFNEKPILNDYEKIF

SEQ ID NO: 3385536 - protein, 18 aa, Plasmodium falciparum
KDIFRKYPNKYESIITIL

SEQ ID NO: 3385537 - protein, 27 aa, Plasmodium falciparum
KDIGSTLLDFFLPLPTKNTNTYEKKNE

SEQ ID NO: 3385538 - protein, 19 aa, Plasmodium falciparum
KDIHNFIVNLRLGKYIFKN

SEQ ID NO: 3385539 - protein, 21 aa, Plasmodium falciparum
KDIITHVVNWFKYGGPEKNEK

SEQ ID NO: 3385540 - protein, 31 aa, Plasmodium falciparum
KDILYTYNMVFLPYHFLLTSIGEFGELVYQD

SEQ ID NO: 3385541 - protein, 19 aa, Plasmodium falciparum
KDINFEWWNSKKVSKISKD

SEQ ID NO: 3385542 - protein, 45 aa, Plasmodium falciparum
KDIPLKINFCSYKNLFYLCTRKRLYFLKLFYVKENKTLKVKNTNM

SEQ ID NO: 3385543 - protein, 29 aa, Plasmodium falciparum
KDIQGKNKLIFKYLSYDSIQKEWVVTYDY

SEQ ID NO: 3385544 - protein, 23 aa, Plasmodium falciparum
KDIRYYIYQILKALDYCHSQGIM

SEQ ID NO: 3385545 - protein, 18 aa, Plasmodium falciparum
KDISFNKNIFYPEEGNYN

SEQ ID NO: 3385546 - protein, 20 aa, Plasmodium falciparum
KDKDQLLYQKNICGGLAIAS

SEQ ID NO: 3385547 - protein, 24 aa, Plasmodium falciparum
KDKDTLINMLRKKLEIKIKDYNLI

SEQ ID NO: 3385548 - protein, 27 aa, Plasmodium falciparum
KDKFFCIFRQNFAIGIFERKKPHMNIG

SEQ ID NO: 3385549 - protein, 24 aa, Plasmodium falciparum
KDKFMKWNLRFFKVNHSKYEHFPW

SEQ ID NO: 3385550 - protein, 26 aa, Plasmodium falciparum
KDKICMQRFYYSNDYLRPVICEYKSF

SEQ ID NO: 3385551 - protein, 20 aa, Plasmodium falciparum
KDKIIFVPVGTIVRKRISCK

SEQ ID NO: 3385552 - protein, 42 aa, Plasmodium falciparum
KDKITTCHLLAYNNIIIGTDSSLFFVYNMSTNPPIYIDTKKI

SEQ ID NO: 3385553 - protein, 22 aa, Plasmodium falciparum
KDKKPLFLKYGINHITKLVENK

SEQ ID NO: 3385554 - protein, 23 aa, Plasmodium falciparum
KDKKYIILIYEYLCHAELCDEVL

SEQ ID NO: 3385555 - protein, 22 aa, Plasmodium falciparum
KDKKYKMLFKKKEGKGKPGRKK

SEQ ID NO: 3385556 - protein, 37 aa, Plasmodium falciparum
KDKLEKVAFVLRKLLARKLQLGYTPPLKFVPLSDQQE

SEQ ID NO: 3385557 - protein, 21 aa, Plasmodium falciparum
KDKLKRYSSFDQKVDIKRGDE

SEQ ID NO: 3385558 - protein, 25 aa, Plasmodium falciparum
KDKNEYEFTLNFLKPINVEESKYST

SEQ ID NO: 3385559 - protein, 26 aa, Plasmodium falciparum
KDKNLFFYYTHIIYLSLIKSQNNKIT

SEQ ID NO: 3385560 - protein, 26 aa, Plasmodium falciparum
KDKNLYNNLHITNCLLFKKETTEEVL

SEQ ID NO: 3385561 - protein, 25 aa, Plasmodium falciparum
KDKNYNALKTLKDSKRILLNCNKYI

SEQ ID NO: 3385562 - protein, 26 aa, Plasmodium falciparum
KDKQGIKAPLILKKVDKRSGVIVQAP

SEQ ID NO: 3385563 - protein, 33 aa, Plasmodium falciparum
KDKQKTFKLDMNILCYFVTAGINPPVSFDEIDS

SEQ ID NO: 3385564 - protein, 25 aa, Plasmodium falciparum
KDKSIFLWKGIYPFNKMREWNGHID

SEQ ID NO: 3385565 - protein, 20 aa, Plasmodium falciparum
KDKYFNCLRCKYICLSVVKM

SEQ ID NO: 3385566 - protein, 27 aa, Plasmodium falciparum
KDKYNKFNNIFYFLDNYKKCDNNIILI

SEQ ID NO: 3385567 - protein, 20 aa, Plasmodium falciparum
KDLEKYFSKFGKIVDIYVSR

SEQ ID NO: 3385568 - protein, 20 aa, Plasmodium falciparum
KDLFCTLYALIDIYDCYSEL

SEQ ID NO: 3385569 - protein, 23 aa, Plasmodium falciparum
KDLGHWAGLFKLDNEGNARKIIG

SEQ ID NO: 3385570 - protein, 27 aa, Plasmodium falciparum
KDLKFYSKDFVIYKNLELIYNESDVHI

SEQ ID NO: 3385571 - protein, 33 aa, Plasmodium falciparum
KDLKILRVLTKEELILKMIDGVLLRKIGVNSQN

SEQ ID NO: 3385572 - protein, 26 aa, Plasmodium falciparum
KDLKKLNLLINPFHEKLIKDTHNANF

SEQ ID NO: 3385573 - protein, 17 aa, Plasmodium falciparum
KDLLKYFNGWLLCPPSN

SEQ ID NO: 3385574 - protein, 33 aa, Plasmodium falciparum
KDLLNNNMTYIYNYPMMNTLNYSKDNNYCTYLD

SEQ ID NO: 3385575 - protein, 26 aa, Plasmodium falciparum
KDLNKNNIYYNKYSNFLVLQEYVISY

SEQ ID NO: 3385576 - protein, 21 aa, Plasmodium falciparum
KDLNLITLSEYLNNLRNVKLE

SEQ ID NO: 3385577 - protein, 23 aa, Plasmodium falciparum
KDLQNFHFSFDQAIIKFHSLKMQ

SEQ ID NO: 3385578 - protein, 29 aa, Plasmodium falciparum
KDLSRIGMPIYLNEPSSFLQRLAEDFQYI

SEQ ID NO: 3385579 - protein, 18 aa, Plasmodium falciparum
KDLVKVHEILIYKEKLET

SEQ ID NO: 3385580 - protein, 26 aa, Plasmodium falciparum
KDMIKQENIILPFAEKNIMTNDKIEK

SEQ ID NO: 3385581 - protein, 23 aa, Plasmodium falciparum
KDMKYEIKYLYFSEDDKIFISSA

SEQ ID NO: 3385582 - protein, 29 aa, Plasmodium falciparum
KDMQKYYFKLYIIIKIKYPYGIYIFNCDD

SEQ ID NO: 3385583 - protein, 66 aa, Plasmodium falciparum
KDMRINLCRDAILFILHDLETILELNIPMLSKNVNMYKLCIKHHLNYLTLIKNEEQIIPYLNVFGD

SEQ ID NO: 3385584 - protein, 23 aa, Plasmodium falciparum
KDMYKSNYYFFKSDDDYYYDEEV

SEQ ID NO: 3385585 - protein, 23 aa, Plasmodium falciparum
KDNCIRYVIFPPGHYYKNNKNKG

SEQ ID NO: 3385586 - protein, 24 aa, Plasmodium falciparum
KDNDWSYLRSGANTSFRNSIKNNE

SEQ ID NO: 3385587 - protein, 29 aa, Plasmodium falciparum
KDNEKRIFLMENYWEYSILTLHDFNVNMV

SEQ ID NO: 3385588 - protein, 29 aa, Plasmodium falciparum
KDNFHLRVRIHPFHVLRINKMLSCAGADR

SEQ ID NO: 3385589 - protein, 25 aa, Plasmodium falciparum
KDNIKNNLMFLKNQSEFLRNKNEEF

SEQ ID NO: 3385590 - protein, 26 aa, Plasmodium falciparum
KDNKINKFFKNLGRFSFTTSKKKNNK

SEQ ID NO: 3385591 - protein, 26 aa, Plasmodium falciparum
KDNKRHIIRLLSSIKYKNHLCLVFEW

SEQ ID NO: 3385592 - protein, 25 aa, Plasmodium falciparum
KDNKTNALLLKLKKKKKKKMVQMRK

SEQ ID NO: 3385593 - protein, 25 aa, Plasmodium falciparum
KDNLILFNELLKYKDEFNYLNEQKV

SEQ ID NO: 3385594 - protein, 18 aa, Plasmodium falciparum
KDNLLARFDFLFELGFEK

SEQ ID NO: 3385595 - protein, 17 aa, Plasmodium falciparum
KDNLYIFSLRSIPSNKH

SEQ ID NO: 3385596 - protein, 28 aa, Plasmodium falciparum
KDNNIHHMEHCYICSYPIQNNEQKFILH

SEQ ID NO: 3385597 - protein, 24 aa, Plasmodium falciparum
KDNVEKIHLNKMLPYLVANVVESL

SEQ ID NO: 3385598 - protein, 22 aa, Plasmodium falciparum
KDNYTIIFLFSVNESGGFQGYA

SEQ ID NO: 3385599 - protein, 30 aa, Plasmodium falciparum
KDPLAPKRALSAYMFYVKDKRLEIIKEKPE

SEQ ID NO: 3385600 - protein, 23 aa, Plasmodium falciparum
KDQVPLVYFYDKNNIRIGKFYIE

SEQ ID NO: 3385601 - protein, 23 aa, Plasmodium falciparum
KDQYINLLQFMSVPMYFTSHLKA

SEQ ID NO: 3385602 - protein, 26 aa, Plasmodium falciparum
KDRPNKHMILILNKIDLIPVSVAEKW

SEQ ID NO: 3385603 - protein, 21 aa, Plasmodium falciparum
KDRSYNLWKRITVDDIKNTHF

SEQ ID NO: 3385604 - protein, 24 aa, Plasmodium falciparum
KDRVKFLRRYSFLSLFLGAAFTYK

SEQ ID NO: 3385605 - protein, 26 aa, Plasmodium falciparum
KDSDSNMFMKKGNMYNMRYNRYTENS

SEQ ID NO: 3385606 - protein, 25 aa, Plasmodium falciparum
KDSFKENFLFFKEKILPSKKDTCVF

SEQ ID NO: 3385607 - protein, 41 aa, Plasmodium falciparum
KDSIDYCLSTYLYWLYLRRNTNIFLQNTLLIPTCMRKNDND

SEQ ID NO: 3385608 - protein, 25 aa, Plasmodium falciparum
KDSKKIKEILKKKLSLFINEKDINV

SEQ ID NO: 3385609 - protein, 23 aa, Plasmodium falciparum
KDSNYFLIPSLLLSLANLNIYDQ

SEQ ID NO: 3385610 - protein, 23 aa, Plasmodium falciparum
KDSNYLHFICSNLVNNIRGICSQ

SEQ ID NO: 3385611 - protein, 38 aa, Plasmodium falciparum
KDSSNKPYTFFVAGKFNLFSNFVLIKKLKDVGYNITYN

SEQ ID NO: 3385612 - protein, 28 aa, Plasmodium falciparum
KDSSYLVHAIIYVIELPLSVSQKYLHKK

SEQ ID NO: 3385613 - protein, 20 aa, Plasmodium falciparum
KDSVLLIPPLNFSYTHHTIK

SEQ ID NO: 3385614 - protein, 19 aa, Plasmodium falciparum
KDTFNLLNKLKTNQKNREY

SEQ ID NO: 3385615 - protein, 27 aa, Plasmodium falciparum
KDTIQKLFKVPFYPDAYFLVRDHKVVV

SEQ ID NO: 3385616 - protein, 27 aa, Plasmodium falciparum
KDTKRTSFIQYPYYLDKKKERAYTLGA

SEQ ID NO: 3385617 - protein, 22 aa, Plasmodium falciparum
KDTNIFEWVGFIKGPSGTPYEG

SEQ ID NO: 3385618 - protein, 26 aa, Plasmodium falciparum
KDTYHFNDFLKWYKINIGKLYTSEQV

SEQ ID NO: 3385619 - protein, 25 aa, Plasmodium falciparum
KDTYNKYYYALFNNNIFNQKKLYIF

SEQ ID NO: 3385620 - protein, 29 aa, Plasmodium falciparum
KDTYPHLFRWFHHISSLPEFILNQYDEEH

SEQ ID NO: 3385621 - protein, 26 aa, Plasmodium falciparum
KDVLNKLFLMLLFEITKRIDKMNTQS

SEQ ID NO: 3385622 - protein, 21 aa, Plasmodium falciparum
KDYDLYISQLKDKNINPLIRT

SEQ ID NO: 3385623 - protein, 24 aa, Plasmodium falciparum
KDYEGKYFSARYDGNTYFTRSKTK

SEQ ID NO: 3385624 - protein, 17 aa, Plasmodium falciparum
KDYFFIKFYKNQVELKE

SEQ ID NO: 3385625 - protein, 31 aa, Plasmodium falciparum
KDYICTNKYMWRFLQFLYNGGPCIKRISNNI

SEQ ID NO: 3385626 - protein, 24 aa, Plasmodium falciparum
KDYKKYFNFLITKKNKRETHKSTN

SEQ ID NO: 3385627 - protein, 18 aa, Plasmodium falciparum
KDYLYFYDIRNEKWHNIL

SEQ ID NO: 3385628 - protein, 21 aa, Plasmodium falciparum
KDYNSIYKKVLWPINHGIYDF

SEQ ID NO: 3385629 - protein, 24 aa, Plasmodium falciparum
KDYNSYMTMPYSNKKDIKYYKKKG

SEQ ID NO: 3385630 - protein, 33 aa, Plasmodium falciparum
KDYSFKSNRPYVLYMNNPLYIWDISNDKKNRIV

SEQ ID NO: 3385631 - protein, 28 aa, Plasmodium falciparum
KDYVEKHNLLYRLFLKISNNINKKKEKT

SEQ ID NO: 3385632 - protein, 17 aa, Plasmodium falciparum
KDYVSTNLYRTKIVKDD

SEQ ID NO: 3385633 - protein, 20 aa, Plasmodium falciparum
KDYVYIYLEKVINDIINISH

SEQ ID NO: 3385634 - protein, 19 aa, Plasmodium falciparum
KDYYGVLTLVDLVGCEREE

SEQ ID NO: 3385635 - protein, 26 aa, Plasmodium falciparum
KEAFLENVDRRLFPNEDFMVKEEFMD

SEQ ID NO: 3385636 - protein, 18 aa, Plasmodium falciparum
KEAKAKHPLIKFTYNMQA

SEQ ID NO: 3385637 - protein, 25 aa, Plasmodium falciparum
KEAKNIFRNFLMKFNYIKYDSDEYN

SEQ ID NO: 3385638 - protein, 23 aa, Plasmodium falciparum
KEANLFHVVFYDYEQFNTNKNIK

SEQ ID NO: 3385639 - protein, 21 aa, Plasmodium falciparum
KEAPLILTAYTQFCAVRIPDN

SEQ ID NO: 3385640 - protein, 34 aa, Plasmodium falciparum
KEASRKWKIIARNILHKEMQLLLETIHYDKYENK

SEQ ID NO: 3385641 - protein, 18 aa, Plasmodium falciparum
KEATDLIKLIYSYDATEN

SEQ ID NO: 3385642 - protein, 18 aa, Plasmodium falciparum
KEAYNYHNKLKILNKNYL

SEQ ID NO: 3385643 - protein, 20 aa, Plasmodium falciparum
KECFNLFHPLTYMHSILNEK

SEQ ID NO: 3385644 - protein, 20 aa, Plasmodium falciparum
KECIKKYSLPIIMGGSHVAT

SEQ ID NO: 3385645 - protein, 20 aa, Plasmodium falciparum
KECMMLAEKLYNKGYISYPR

SEQ ID NO: 3385646 - protein, 33 aa, Plasmodium falciparum
KECNEIFVDNFIKKYLFLKNNPHKNIISIYDIF

SEQ ID NO: 3385647 - protein, 19 aa, Plasmodium falciparum
KEDIVVKDTFNLLNKLKTN

SEQ ID NO: 3385648 - protein, 23 aa, Plasmodium falciparum
KEDKEYIIKWNKKTGVSIYYNKN

SEQ ID NO: 3385649 - protein, 17 aa, Plasmodium falciparum
KEDLLPKLPSKKSLKPY

SEQ ID NO: 3385650 - protein, 25 aa, Plasmodium falciparum
KEDLNRINLLFGFNILSISEQKNVI

SEQ ID NO: 3385651 - protein, 25 aa, Plasmodium falciparum
KEDLYSCIPILLSRKNLGDNMKKMN

SEQ ID NO: 3385652 - protein, 24 aa, Plasmodium falciparum
KEDMIIKIIDFGLSTHFEYSKKMK

SEQ ID NO: 3385653 - protein, 25 aa, Plasmodium falciparum
KEDNKFFRSEFIKDYNMNYNDCGLI

SEQ ID NO: 3385654 - protein, 23 aa, Plasmodium falciparum
KEDSILSLPPIFINSNSCEYIQV

SEQ ID NO: 3385655 - protein, 26 aa, Plasmodium falciparum
KEDTSYKLKSLYLLNEYLNVEPTNNV

SEQ ID NO: 3385656 - protein, 21 aa, Plasmodium falciparum
KEDTYYRLVDPWSTTTKMKNM

SEQ ID NO: 3385657 - protein, 38 aa, Plasmodium falciparum
KEECIAIINFLRWKKVRKNFYEILKLKKKRKENLMIYK

SEQ ID NO: 3385658 - protein, 41 aa, Plasmodium falciparum
KEEEAGQFVIPLYMRSPKPEQIPIPLYFSEGENIILPKEED

SEQ ID NO: 3385659 - protein, 24 aa, Plasmodium falciparum
KEEEKLKILQIIDNYLQKNEMFFN

SEQ ID NO: 3385660 - protein, 19 aa, Plasmodium falciparum
KEEHFYYPFNEHDAIKVLQ

SEQ ID NO: 3385661 - protein, 17 aa, Plasmodium falciparum
KEEIKLKINNCLKMIFV

SEQ ID NO: 3385662 - protein, 25 aa, Plasmodium falciparum
KEEINELFLKECINSFRLQNNKSRK

SEQ ID NO: 3385663 - protein, 18 aa, Plasmodium falciparum
KEEINKYIKLLYISIDIG

SEQ ID NO: 3385664 - protein, 67 aa, Plasmodium falciparum
KEEITMLDSWYFANKMKIIPYLFDDKPIHINLLNSLYMLHPYFKNHKTKIIIYLRFVKNKYQNIIKK

SEQ ID NO: 3385665 - protein, 34 aa, Plasmodium falciparum
KEEKKIRTKLLNAAKWKGKKIAPSGCLPISTEDI

SEQ ID NO: 3385666 - protein, 25 aa, Plasmodium falciparum
KEEKKMPPLSHMFDSIVKIKKQVDS

SEQ ID NO: 3385667 - protein, 18 aa, Plasmodium falciparum
KEEKLLINQIQALNKNKP

SEQ ID NO: 3385668 - protein, 26 aa, Plasmodium falciparum
KEEKVFVTSAYKKKLMDRELIKKDMD

SEQ ID NO: 3385669 - protein, 24 aa, Plasmodium falciparum
KEENFNFNLIINKEKKRPPKLSNN

SEQ ID NO: 3385670 - protein, 23 aa, Plasmodium falciparum
KEENIFRPLFNLNKKDKVWKRFN

SEQ ID NO: 3385671 - protein, 25 aa, Plasmodium falciparum
KEENIILLNYYYYHIKHIHTYTNDS

SEQ ID NO: 3385672 - protein, 26 aa, Plasmodium falciparum
KEENYFNHFLFIDLCLYFNQNEEDIS

SEQ ID NO: 3385673 - protein, 26 aa, Plasmodium falciparum
KEENYLDRLTNLFKYLTLGVEKNNST

SEQ ID NO: 3385674 - protein, 18 aa, Plasmodium falciparum
KEENYLLHFLKEDKTKFF

SEQ ID NO: 3385675 - protein, 27 aa, Plasmodium falciparum
KEESPIWLHIDIMVKVITPGPFYNEIG

SEQ ID NO: 3385676 - protein, 19 aa, Plasmodium falciparum
KEETTAFFMKKFFPTNEND

SEQ ID NO: 3385677 - protein, 26 aa, Plasmodium falciparum
KEEYEYYIKNLFFDILKIENIHHVYD

SEQ ID NO: 3385678 - protein, 20 aa, Plasmodium falciparum
KEFFVLPTFVNSVSMSGILF

SEQ ID NO: 3385679 - protein, 26 aa, Plasmodium falciparum
KEFKIIYIAPMKSLVFEITNLFRKKL

SEQ ID NO: 3385680 - protein, 33 aa, Plasmodium falciparum
KEFKVIDFFTIYRLDMTTFQWEKINITYNRLLN

SEQ ID NO: 3385681 - protein, 21 aa, Plasmodium falciparum
KEFLRRYLLCFFCCTDLNNCV

SEQ ID NO: 3385682 - protein, 27 aa, Plasmodium falciparum
KEFLYHVNWGILDYLIIDMPPGTNDIH

SEQ ID NO: 3385683 - protein, 17 aa, Plasmodium falciparum
KEFMRLMKTKYCRARIL

SEQ ID NO: 3385684 - protein, 18 aa, Plasmodium falciparum
KEFNNDKIRGAFFFKVKL

SEQ ID NO: 3385685 - protein, 18 aa, Plasmodium falciparum
KEGANTITFLVTSSLQGT

SEQ ID NO: 3385686 - protein, 22 aa, Plasmodium falciparum
KEGEAFMMRYAPKAKDLASRDV

SEQ ID NO: 3385687 - protein, 21 aa, Plasmodium falciparum
KEGFFFFFSSFKRSCNNNIHF

SEQ ID NO: 3385688 - protein, 17 aa, Plasmodium falciparum
KEGFVTCYIYYGTSKDI

SEQ ID NO: 3385689 - protein, 17 aa, Plasmodium falciparum
KEGGILYLYKGVIPRCF

SEQ ID NO: 3385690 - protein, 26 aa, Plasmodium falciparum
KEGSKTYIYIFLFRGEEIGKKKITDI

SEQ ID NO: 3385691 - protein, 22 aa, Plasmodium falciparum
KEHAPSYNFPMTKQKHWNVTLN

SEQ ID NO: 3385692 - protein, 17 aa, Plasmodium falciparum
KEHEPLWVINASNEEKK

SEQ ID NO: 3385693 - protein, 19 aa, Plasmodium falciparum
KEHIPDRGIEIKKYDRSSK

SEQ ID NO: 3385694 - protein, 23 aa, Plasmodium falciparum
KEHIYKCPYCEICTCSLVCSKNH

SEQ ID NO: 3385695 - protein, 18 aa, Plasmodium falciparum
KEHRILVEKLKKKIDNLK

SEQ ID NO: 3385696 - protein, 33 aa, Plasmodium falciparum
KEIADYFYINNFCLHFNGIKLYVDKKGIFSFDH

SEQ ID NO: 3385697 - protein, 18 aa, Plasmodium falciparum
KEIAPKKKSFFNISKRKG

SEQ ID NO: 3385698 - protein, 34 aa, Plasmodium falciparum
KEIDILFIIDQLYDYFYFVLYVPITTKEKDLIFF

SEQ ID NO: 3385699 - protein, 21 aa, Plasmodium falciparum
KEIEFLKNIAKEHSLKKIEKN

SEQ ID NO: 3385700 - protein, 23 aa, Plasmodium falciparum
KEIEKLTMLLVRLKHEKLYTKCN

SEQ ID NO: 3385701 - protein, 25 aa, Plasmodium falciparum
KEIEKNFMIITLFIEKKLKDLSDDV

SEQ ID NO: 3385702 - protein, 22 aa, Plasmodium falciparum
KEIFKKGVNYILLPSLPRSNNL

SEQ ID NO: 3385703 - protein, 18 aa, Plasmodium falciparum
KEIFNFLILIEEFNPFDY

SEQ ID NO: 3385704 - protein, 22 aa, Plasmodium falciparum
KEIHIPVLIFVDSIIKANMIYT

SEQ ID NO: 3385705 - protein, 21 aa, Plasmodium falciparum
KEIILFSCVMCPTQLEKKREK

SEQ ID NO: 3385706 - protein, 21 aa, Plasmodium falciparum
KEIIRALILSDINVSYLKDIK

SEQ ID NO: 3385707 - protein, 37 aa, Plasmodium falciparum
KEIKKLWNKELTFKFFNFYPFIMSSLNLMAKHKLLKD

SEQ ID NO: 3385708 - protein, 24 aa, Plasmodium falciparum
KEIKPKFPLKKKANLNFIGAAAAP

SEQ ID NO: 3385709 - protein, 25 aa, Plasmodium falciparum
KEIKYIIFELLLALSYFHSNNYIHR

SEQ ID NO: 3385710 - protein, 19 aa, Plasmodium falciparum
KEILLEYNSLNLSLSSDNI

SEQ ID NO: 3385711 - protein, 18 aa, Plasmodium falciparum
KEILLSKENIINYSLNSS

SEQ ID NO: 3385712 - protein, 26 aa, Plasmodium falciparum
KEILNCLRMISRIKKIFFDECSKMIN

SEQ ID NO: 3385713 - protein, 17 aa, Plasmodium falciparum
KEILYDKSSKHQSDELH

SEQ ID NO: 3385714 - protein, 31 aa, Plasmodium falciparum
KEIMIISQIPYYNFISWKFLTVMESFLIDKE

SEQ ID NO: 3385715 - protein, 27 aa, Plasmodium falciparum
KEINIFLKNLSFFLLSYKVIKYQVYEY

SEQ ID NO: 3385716 - protein, 24 aa, Plasmodium falciparum
KEINKILNKIYLKKKKFIQDIIGD

SEQ ID NO: 3385717 - protein, 33 aa, Plasmodium falciparum
KEIRRKVESILKIRMPHFNYGSNKNNVFLNKNV

SEQ ID NO: 3385718 - protein, 18 aa, Plasmodium falciparum
KEISYKKMLLKMNQINDT

SEQ ID NO: 3385719 - protein, 26 aa, Plasmodium falciparum
KEITLKIIRRCRIYSLKQLHTEKKNI

SEQ ID NO: 3385720 - protein, 18 aa, Plasmodium falciparum
KEITLLDILTKGGKKRKA

SEQ ID NO: 3385721 - protein, 25 aa, Plasmodium falciparum
KEIVEDIFQLNMRNPYIVNSYGNNS

SEQ ID NO: 3385722 - protein, 17 aa, Plasmodium falciparum
KEKDDIVLKIPSSILII

SEQ ID NO: 3385723 - protein, 19 aa, Plasmodium falciparum
KEKDFGLDIIKQADHLQLQ

SEQ ID NO: 3385724 - protein, 23 aa, Plasmodium falciparum
KEKDIIIYKLNKKIEEIRVYLKG

SEQ ID NO: 3385725 - protein, 25 aa, Plasmodium falciparum
KEKEDYLLSLYFKGELKKDQIIIQP

SEQ ID NO: 3385726 - protein, 24 aa, Plasmodium falciparum
KEKEFIRIAYYMNSFYKDMELREN

SEQ ID NO: 3385727 - protein, 21 aa, Plasmodium falciparum
KEKELFIKGKETLLLEGMNDG

SEQ ID NO: 3385728 - protein, 25 aa, Plasmodium falciparum
KEKERLFCEIGLPRMIPRAKVRESE

SEQ ID NO: 3385729 - protein, 20 aa, Plasmodium falciparum
KEKFGIIEFYNHENAKDAIN

SEQ ID NO: 3385730 - protein, 26 aa, Plasmodium falciparum
KEKFKKYIHSVLPIVGDYMYRVVTKN

SEQ ID NO: 3385731 - protein, 23 aa, Plasmodium falciparum
KEKFKLYYKQLIYARLKKLFMKK

SEQ ID NO: 3385732 - protein, 35 aa, Plasmodium falciparum
KEKKASVYFSNNQKFLYFAVPLMSQDKSCDYNIND

SEQ ID NO: 3385733 - protein, 26 aa, Plasmodium falciparum
KEKKEGFILSFYFATNPFFSNSVLTK

SEQ ID NO: 3385734 - protein, 25 aa, Plasmodium falciparum
KEKKKCFIVLGCGCYRIGSSVEFDW

SEQ ID NO: 3385735 - protein, 17 aa, Plasmodium falciparum
KEKKKFVLYKKKKNKSN

SEQ ID NO: 3385736 - protein, 24 aa, Plasmodium falciparum
KEKKKWIIQILEQKNNTILYFKEF

SEQ ID NO: 3385737 - protein, 27 aa, Plasmodium falciparum
KEKKNINDFFLLSKFKYSKQVIDKKEN

SEQ ID NO: 3385738 - protein, 18 aa, Plasmodium falciparum
KEKKNNDVDDINEEEDEE

SEQ ID NO: 3385739 - protein, 37 aa, Plasmodium falciparum
KEKKQIDIMYKNLSRLNLNLLLPTKKKVKKSKNSFKK

SEQ ID NO: 3385740 - protein, 21 aa, Plasmodium falciparum
KEKKQMHYHIKKIIKYKQEKD

SEQ ID NO: 3385741 - protein, 17 aa, Plasmodium falciparum
KEKLNHAVFIDKSLHSK

SEQ ID NO: 3385742 - protein, 34 aa, Plasmodium falciparum
KEKLRNWIAIFYEKMADILFVYESELFHGLAWLK

SEQ ID NO: 3385743 - protein, 22 aa, Plasmodium falciparum
KEKNLLLHKYGKEVSPCVVRFV

SEQ ID NO: 3385744 - protein, 23 aa, Plasmodium falciparum
KEKNPFFHIQPHLILKDGVAHYK

SEQ ID NO: 3385745 - protein, 22 aa, Plasmodium falciparum
KEKNYLYKYWSYSLQDILNGTE

SEQ ID NO: 3385746 - protein, 22 aa, Plasmodium falciparum
KEKQILINFIGYTLTNTQTKKN

SEQ ID NO: 3385747 - protein, 18 aa, Plasmodium falciparum
KEKRKICRIFFLTHFHAD

SEQ ID NO: 3385748 - protein, 33 aa, Plasmodium falciparum
KEKTYPSFIYTNIYKIPVLSSVHFHIFKNYIKQ

SEQ ID NO: 3385749 - protein, 33 aa, Plasmodium falciparum
KEKVKSYLFVLTRKYVLLLLEYDVKENDFITLS

SEQ ID NO: 3385750 - protein, 24 aa, Plasmodium falciparum
KEKWNEFIQYIQNLKDYTKCGVDR

SEQ ID NO: 3385751 - protein, 22 aa, Plasmodium falciparum
KEKYKYITLFNSIVVNKIEGSL

SEQ ID NO: 3385752 - protein, 25 aa, Plasmodium falciparum
KELATPLCMWKLPNKELINRNIANK

SEQ ID NO: 3385753 - protein, 25 aa, Plasmodium falciparum
KELDEILKDVIFLELGLKESKSKNE

SEQ ID NO: 3385754 - protein, 22 aa, Plasmodium falciparum
KELDQEMILDIIDNLSSFVKNK

SEQ ID NO: 3385755 - protein, 17 aa, Plasmodium falciparum
KELILAEKLKCGWGFPT

SEQ ID NO: 3385756 - protein, 35 aa, Plasmodium falciparum
KELINAYFEYTTSNLYYIFIKYENIICDMSEMNVH

SEQ ID NO: 3385757 - protein, 23 aa, Plasmodium falciparum
KELKIYILYSLSILLKNYELKKY

SEQ ID NO: 3385758 - protein, 17 aa, Plasmodium falciparum
KELKNSYLIFINTQKDT

SEQ ID NO: 3385759 - protein, 36 aa, Plasmodium falciparum
KELKSIVDFFFCINYFLKFAAHINSVYYLVIEVLKK

SEQ ID NO: 3385760 - protein, 21 aa, Plasmodium falciparum
KELKVAMRALGFEPKKEDIRK

SEQ ID NO: 3385761 - protein, 18 aa, Plasmodium falciparum
KELLFLTELIKTIKDKKN

SEQ ID NO: 3385762 - protein, 22 aa, Plasmodium falciparum
KELMQFRRYINYILSKNHSAKI

SEQ ID NO: 3385763 - protein, 20 aa, Plasmodium falciparum
KELPLYSKFFLTINDEYLEM

SEQ ID NO: 3385764 - protein, 20 aa, Plasmodium falciparum
KELRELYYKLENEQKEKVID

SEQ ID NO: 3385765 - protein, 24 aa, Plasmodium falciparum
KELRKELILKKKNYEELRLKLNHL

SEQ ID NO: 3385766 - protein, 17 aa, Plasmodium falciparum
KELTHYLSSFYYKIMNH

SEQ ID NO: 3385767 - protein, 21 aa, Plasmodium falciparum
KELYTSFNFDLKNLNYEDIED

SEQ ID NO: 3385768 - protein, 28 aa, Plasmodium falciparum
KEMGCKYVLLFLSFIPDIINLGFNIKNY

SEQ ID NO: 3385769 - protein, 17 aa, Plasmodium falciparum
KEMPIFCLLINEEKKII

SEQ ID NO: 3385770 - protein, 36 aa, Plasmodium falciparum
KEMTKQINYYLPPTLSIKIWKLAFCSSIHGVSFKTL

SEQ ID NO: 3385771 - protein, 22 aa, Plasmodium falciparum
KEMTTALLNIIKMKSSKTNVNN

SEQ ID NO: 3385772 - protein, 21 aa, Plasmodium falciparum
KENEINLLSKLQDCRNKSGKG

SEQ ID NO: 3385773 - protein, 23 aa, Plasmodium falciparum
KENEKECYLLSQKKKQSTYVFDS

SEQ ID NO: 3385774 - protein, 24 aa, Plasmodium falciparum
KENELLEIFQPFGLIESIKLKVNK

SEQ ID NO: 3385775 - protein, 28 aa, Plasmodium falciparum
KENHDFSKFLYIIKDIKNIFQTKFQTSA

SEQ ID NO: 3385776 - protein, 27 aa, Plasmodium falciparum
KENHGIHTIYFLLSSNDLIEIDKKDTL

SEQ ID NO: 3385777 - protein, 25 aa, Plasmodium falciparum
KENHLNAEKIFKYLNDLFNQEEIIN

SEQ ID NO: 3385778 - protein, 28 aa, Plasmodium falciparum
KENIHLKNHLDFIYNTEFFTELYVEDEY

SEQ ID NO: 3385779 - protein, 17 aa, Plasmodium falciparum
KENIIEKFLLNINSLSE

SEQ ID NO: 3385780 - protein, 20 aa, Plasmodium falciparum
KENIKKNHFLKSFLSGEHNY

SEQ ID NO: 3385781 - protein, 22 aa, Plasmodium falciparum
KENINFIKKDSQYLLYKNDNLP

SEQ ID NO: 3385782 - protein, 18 aa, Plasmodium falciparum
KENIQKICATPYTGSNIS

SEQ ID NO: 3385783 - protein, 25 aa, Plasmodium falciparum
KENKEIILLNIYLELSNDHLEMLLK

SEQ ID NO: 3385784 - protein, 34 aa, Plasmodium falciparum
KENKTFIYNHILFWTIKITFVNLNIRILHHEINE

SEQ ID NO: 3385785 - protein, 18 aa, Plasmodium falciparum
KENLLLEKNLGKVQILTQ

SEQ ID NO: 3385786 - protein, 18 aa, Plasmodium falciparum
KENLNSMILLNDNNSNNG

SEQ ID NO: 3385787 - protein, 24 aa, Plasmodium falciparum
KENMKHMDILNIRGKRKKNGNINM

SEQ ID NO: 3385788 - protein, 19 aa, Plasmodium falciparum
KENMVYNFLANYDKKEKKY

SEQ ID NO: 3385789 - protein, 26 aa, Plasmodium falciparum
KENNEGIVVFTYPKANTPGCTKQAEL

SEQ ID NO: 3385790 - protein, 18 aa, Plasmodium falciparum
KENNFFSEIFKKVKNKIY

SEQ ID NO: 3385791 - protein, 32 aa, Plasmodium falciparum
KENNMFHDVDNFTSLLLHINNYNEKDFMNFKN

SEQ ID NO: 3385792 - protein, 23 aa, Plasmodium falciparum
KENPKDHLYLNFLNNLENKLNRI

SEQ ID NO: 3385793 - protein, 18 aa, Plasmodium falciparum
KENSRMKQVLLKLIQKES

SEQ ID NO: 3385794 - protein, 24 aa, Plasmodium falciparum
KENTNLLGWKIKYYKGLGTSTDRE

SEQ ID NO: 3385795 - protein, 33 aa, Plasmodium falciparum
KENVYLLYEYADYDLWEFLKIRSVGVNEKITFN

SEQ ID NO: 3385796 - protein, 34 aa, Plasmodium falciparum
KENYEYEIKLYYLFKLYHYFKKKEKFKEDLLLYK

SEQ ID NO: 3385797 - protein, 24 aa, Plasmodium falciparum
KEPRGFGFVEFYDAKDAEQALKEM

SEQ ID NO: 3385798 - protein, 21 aa, Plasmodium falciparum
KEPYRNIPPSGYDKNKLLYPE

SEQ ID NO: 3385799 - protein, 25 aa, Plasmodium falciparum
KEQGPFNSYTIFNWVSNEYFEDNTL

SEQ ID NO: 3385800 - protein, 22 aa, Plasmodium falciparum
KEQKRKINPMYSDLFGRKTPDV

SEQ ID NO: 3385801 - protein, 23 aa, Plasmodium falciparum
KEQKYNLWRWGCPGDSLFSSIKV

SEQ ID NO: 3385802 - protein, 25 aa, Plasmodium falciparum
KEQLKAYICKLRKELRNYKMRELHL

SEQ ID NO: 3385803 - protein, 25 aa, Plasmodium falciparum
KEQMKYPFFIAPTYDYYISSNGYAT

SEQ ID NO: 3385804 - protein, 29 aa, Plasmodium falciparum
KEQRIVQDKIFFLEYITLNVTHMENANIY

SEQ ID NO: 3385805 - protein, 26 aa, Plasmodium falciparum
KERDKNKFLLLQNRRLKCIIIESNCN

SEQ ID NO: 3385806 - protein, 22 aa, Plasmodium falciparum
KERDMLNYSEYYKDILLKEGSQ

SEQ ID NO: 3385807 - protein, 22 aa, Plasmodium falciparum
KERGVFVIFLPCIEQVYKILEA

SEQ ID NO: 3385808 - protein, 28 aa, Plasmodium falciparum
KERICRDFKMLSNMKCKGEKPFLLCINK

SEQ ID NO: 3385809 - protein, 25 aa, Plasmodium falciparum
KERIDKKYHRVPLGYHTTKESWNNY

SEQ ID NO: 3385810 - protein, 28 aa, Plasmodium falciparum
KERIEFSYIYRWYLHIQETLLANFSTLK

SEQ ID NO: 3385811 - protein, 17 aa, Plasmodium falciparum
KERIIKNDKDLLKELQK

SEQ ID NO: 3385812 - protein, 17 aa, Plasmodium falciparum
KERNFIFHIIGNNEPFN

SEQ ID NO: 3385813 - protein, 24 aa, Plasmodium falciparum
KERRGLILLPENYIRYNLNEDNYK

SEQ ID NO: 3385814 - protein, 17 aa, Plasmodium falciparum
KERVDNFNWLKEKIQLL

SEQ ID NO: 3385815 - protein, 20 aa, Plasmodium falciparum
KESCLIFQILLKIKEDDIKE

SEQ ID NO: 3385816 - protein, 29 aa, Plasmodium falciparum
KESDFKLMKIYAIIPVKFTHNYSSILRSI

SEQ ID NO: 3385817 - protein, 19 aa, Plasmodium falciparum
KESFLYNEFYFTPCGYSCN

SEQ ID NO: 3385818 - protein, 23 aa, Plasmodium falciparum
KESIDNILLFHSLAGGSGSGLSS

SEQ ID NO: 3385819 - protein, 23 aa, Plasmodium falciparum
KESIIKNYMFLCIIKKIEENMSR

SEQ ID NO: 3385820 - protein, 29 aa, Plasmodium falciparum
KESINYIRSLPFEYKPYAILNILQHLDSD

SEQ ID NO: 3385821 - protein, 25 aa, Plasmodium falciparum
KESLDLYFKALKILKKLKDNNNNKI

SEQ ID NO: 3385822 - protein, 25 aa, Plasmodium falciparum
KESLDLYFKALKILKKLKDNNNNNK

SEQ ID NO: 3385823 - protein, 31 aa, Plasmodium falciparum
KESNLDAEQLWYLIECLIKKKNLNNLLEFFK

SEQ ID NO: 3385824 - protein, 26 aa, Plasmodium falciparum
KESVCNYFVFIYYTSKMKAPVLEDNF

SEQ ID NO: 3385825 - protein, 19 aa, Plasmodium falciparum
KETALSFLNLGYETYIVED

SEQ ID NO: 3385826 - protein, 34 aa, Plasmodium falciparum
KETIEAFNLFFMNNFFPHIILGLNNGRILLYNHE

SEQ ID NO: 3385827 - protein, 19 aa, Plasmodium falciparum
KETKIRKGMLFFSDNDTDK

SEQ ID NO: 3385828 - protein, 25 aa, Plasmodium falciparum
KETKKKAFFNFITPGSLIKQACNKH

SEQ ID NO: 3385829 - protein, 26 aa, Plasmodium falciparum
KETNDPLILHPSTSYIRNIVIKKPSN

SEQ ID NO: 3385830 - protein, 44 aa, Plasmodium falciparum
KETTEFGRNFLLKLFFFLGRYFNSKSIFMYKYISRIFEDKEESL

SEQ ID NO: 3385831 - protein, 18 aa, Plasmodium falciparum
KEVLIMYGSIRTCDKKNI

SEQ ID NO: 3385832 - protein, 30 aa, Plasmodium falciparum
KEVLKEAIIFPLKFPKLFNSSTLPYKGILL

SEQ ID NO: 3385833 - protein, 18 aa, Plasmodium falciparum
KEVLQKRFNFLEKEMIVP

SEQ ID NO: 3385834 - protein, 17 aa, Plasmodium falciparum
KEVTFFDYTLPEPVPKL

SEQ ID NO: 3385835 - protein, 21 aa, Plasmodium falciparum
KEVWDFLPPIIRDQLLMDRES

SEQ ID NO: 3385836 - protein, 22 aa, Plasmodium falciparum
KEVYTFVYNEKISNFFWYYSDV

SEQ ID NO: 3385837 - protein, 36 aa, Plasmodium falciparum
KEWISKIRNNIFLPNSVWLSALFNPISFLTAIKQKF

SEQ ID NO: 3385838 - protein, 20 aa, Plasmodium falciparum
KEYEMVIHLFLSSKNYLKII

SEQ ID NO: 3385839 - protein, 26 aa, Plasmodium falciparum
KEYHIKINYLLNLFYTSYIPEENKRN

SEQ ID NO: 3385840 - protein, 17 aa, Plasmodium falciparum
KEYNFLKELYRIQNNEQ

SEQ ID NO: 3385841 - protein, 33 aa, Plasmodium falciparum
KEYNNIYHILKLVNLPFLVPTLTEIYFIHFFND

SEQ ID NO: 3385842 - protein, 17 aa, Plasmodium falciparum
KEYTKQVLLNSKALAEC

SEQ ID NO: 3385843 - protein, 21 aa, Plasmodium falciparum
KFAKLFYDNYSNLFYCMHLHN

SEQ ID NO: 3385844 - protein, 18 aa, Plasmodium falciparum
KFCFINYADAESAKNAMD

SEQ ID NO: 3385845 - protein, 31 aa, Plasmodium falciparum
KFCKKRFMFFDFYHHFNIFIKKYISLKNKES

SEQ ID NO: 3385846 - protein, 19 aa, Plasmodium falciparum
KFCNVNVPIQARCIAVNPI

SEQ ID NO: 3385847 - protein, 19 aa, Plasmodium falciparum
KFDEKMIDLILNNGNKCYQ

SEQ ID NO: 3385848 - protein, 23 aa, Plasmodium falciparum
KFDIPVIFVLNKADIYGSNESIV

SEQ ID NO: 3385849 - protein, 34 aa, Plasmodium falciparum
KFDIRLYVLILSYYPLTIYIYRSGFARFSHTYFK

SEQ ID NO: 3385850 - protein, 20 aa, Plasmodium falciparum
KFDLIRRRNRKKSINFNYNN

SEQ ID NO: 3385851 - protein, 29 aa, Plasmodium falciparum
KFDQIFFSEDFITYDFQWVETDGVVSSYA

SEQ ID NO: 3385852 - protein, 20 aa, Plasmodium falciparum
KFDRGYISPYFINNSKDQKV

SEQ ID NO: 3385853 - protein, 23 aa, Plasmodium falciparum
KFDRRFLRVFANTSKLSEFLHPQ

SEQ ID NO: 3385854 - protein, 21 aa, Plasmodium falciparum
KFDTISRMFLSLESTYHTALN

SEQ ID NO: 3385855 - protein, 30 aa, Plasmodium falciparum
KFDYNKSFDILFPPYDNKDVYMYWNNKKND

SEQ ID NO: 3385856 - protein, 17 aa, Plasmodium falciparum
KFEDKLQIFREDELLIG

SEQ ID NO: 3385857 - protein, 18 aa, Plasmodium falciparum
KFEIPIEKVFNRSLRLKF

SEQ ID NO: 3385858 - protein, 17 aa, Plasmodium falciparum
KFFENSYIKLSKSTLKN

SEQ ID NO: 3385859 - protein, 20 aa, Plasmodium falciparum
KFFNPGKLRYDPMGPFGNEP

SEQ ID NO: 3385860 - protein, 19 aa, Plasmodium falciparum
KFFSKSQSLIGVYKNKHKK

SEQ ID NO: 3385861 - protein, 25 aa, Plasmodium falciparum
KFFSSVTFLDILYEFNVFNVKRDGH

SEQ ID NO: 3385862 - protein, 23 aa, Plasmodium falciparum
KFHSKIYDLILQPIRNKFGGCIR

SEQ ID NO: 3385863 - protein, 26 aa, Plasmodium falciparum
KFIGENYVYILLENGTYHCYPIHLLK

SEQ ID NO: 3385864 - protein, 30 aa, Plasmodium falciparum
KFIHDQRIYTYIKLVLLWKRDINIKCIIDN

SEQ ID NO: 3385865 - protein, 17 aa, Plasmodium falciparum
KFIITDENIKWLILTHD

SEQ ID NO: 3385866 - protein, 18 aa, Plasmodium falciparum
KFILFVSGLYINELNKSI

SEQ ID NO: 3385867 - protein, 20 aa, Plasmodium falciparum
KFIMPQGDLITYLNIYNKWK

SEQ ID NO: 3385868 - protein, 18 aa, Plasmodium falciparum
KFIPLVDIPLLGNKNNLL

SEQ ID NO: 3385869 - protein, 18 aa, Plasmodium falciparum
KFIPRIYINDFKLIKKEN

SEQ ID NO: 3385870 - protein, 48 aa, Plasmodium falciparum
KFKEDMILNHDIDCWPIVDCLIAFYSTGFPLKKAIEYVKKYKPITLNN

SEQ ID NO: 3385871 - protein, 17 aa, Plasmodium falciparum
KFKEFHKLCKIKKLAVT

SEQ ID NO: 3385872 - protein, 17 aa, Plasmodium falciparum
KFKGFNFCISSNKNNLE

SEQ ID NO: 3385873 - protein, 20 aa, Plasmodium falciparum
KFKIERLLKSSYKKCIYLLF

SEQ ID NO: 3385874 - protein, 17 aa, Plasmodium falciparum
KFKIYYTLPKHTNLKYI

SEQ ID NO: 3385875 - protein, 24 aa, Plasmodium falciparum
KFKKSSIIFLIQLELFLTSDENIN

SEQ ID NO: 3385876 - protein, 17 aa, Plasmodium falciparum
KFKKYKSISIFIENLDR

SEQ ID NO: 3385877 - protein, 24 aa, Plasmodium falciparum
KFKLDPPFLFIVPSSQNFPTMNIF

SEQ ID NO: 3385878 - protein, 21 aa, Plasmodium falciparum
KFKNFFNKKNMNKSGPFYSYM

SEQ ID NO: 3385879 - protein, 19 aa, Plasmodium falciparum
KFKNFFYYNNINSFDLTLL

SEQ ID NO: 3385880 - protein, 18 aa, Plasmodium falciparum
KFKNFNNNFINYIGDIRN

SEQ ID NO: 3385881 - protein, 23 aa, Plasmodium falciparum
KFKNLLFQPNRLPDIFIYPSFTN

SEQ ID NO: 3385882 - protein, 18 aa, Plasmodium falciparum
KFLFIHMNNNILKDEKKL

SEQ ID NO: 3385883 - protein, 17 aa, Plasmodium falciparum
KFLHKIIKVLEEAKYNE

SEQ ID NO: 3385884 - protein, 26 aa, Plasmodium falciparum
KFLLDSHKFNKLLELLRINEKEYLMN

SEQ ID NO: 3385885 - protein, 20 aa, Plasmodium falciparum
KFLYVDWKHLIYSKAPKSVK

SEQ ID NO: 3385886 - protein, 21 aa, Plasmodium falciparum
KFNGVPVNFLDNPHIDKKIIL

SEQ ID NO: 3385887 - protein, 17 aa, Plasmodium falciparum
KFNHNFIIYNDREEGVN

SEQ ID NO: 3385888 - protein, 21 aa, Plasmodium falciparum
KFNIPSFIEKWKGSLAYIGNH

SEQ ID NO: 3385889 - protein, 24 aa, Plasmodium falciparum
KFNKKERYPMKYPEFDGTTNETMM

SEQ ID NO: 3385890 - protein, 32 aa, Plasmodium falciparum
KFNKKMNYLLKKEDFYIYRQNFNFFPKELEVQ

SEQ ID NO: 3385891 - protein, 33 aa, Plasmodium falciparum
KFNKQNKIIRWNLPRPYFLDKINLFNNYMHNEY

SEQ ID NO: 3385892 - protein, 18 aa, Plasmodium falciparum
KFNNILMTSGYDGYIRLY

SEQ ID NO: 3385893 - protein, 26 aa, Plasmodium falciparum
KFPPNTFDALYYVLPGLSFHGYPEFI

SEQ ID NO: 3385894 - protein, 20 aa, Plasmodium falciparum
KFPVLPFHVKHLEDQRAALI

SEQ ID NO: 3385895 - protein, 24 aa, Plasmodium falciparum
KFQDTYKIYENSTSCLYINNNYET

SEQ ID NO: 3385896 - protein, 18 aa, Plasmodium falciparum
KFQSFIDFYISKHVQKIL

SEQ ID NO: 3385897 - protein, 21 aa, Plasmodium falciparum
KFRCLILVPTRELALQILKHF

SEQ ID NO: 3385898 - protein, 38 aa, Plasmodium falciparum
KFRLYIEHYFLYCNTFEFPKWIQPQYIRDINLRTPDHA

SEQ ID NO: 3385899 - protein, 24 aa, Plasmodium falciparum
KFSGDAVLVIWPLHNVLKNKKKKK

SEQ ID NO: 3385900 - protein, 18 aa, Plasmodium falciparum
KFSIFKKDTPLNKKEDSA

SEQ ID NO: 3385901 - protein, 46 aa, Plasmodium falciparum
KFSKDELYKTFIYSNFLTKALILYPSLMPYVECIIEKIKKIKNENI

SEQ ID NO: 3385902 - protein, 19 aa, Plasmodium falciparum
KFSLCLWDSDVFLYKDKTS

SEQ ID NO: 3385903 - protein, 28 aa, Plasmodium falciparum
KFSTSVRSLLLAMLNINPQNRLSLDEVM

SEQ ID NO: 3385904 - protein, 25 aa, Plasmodium falciparum
KFSYKDLELILFSLGSYNILRNAVF

SEQ ID NO: 3385905 - protein, 18 aa, Plasmodium falciparum
KFTCCLIACYIYQIKIDV

SEQ ID NO: 3385906 - protein, 19 aa, Plasmodium falciparum
KFTFLDTPGHKVFQIFRGR

SEQ ID NO: 3385907 - protein, 22 aa, Plasmodium falciparum
KFTNFFLEKFILIFENQANTLD

SEQ ID NO: 3385908 - protein, 20 aa, Plasmodium falciparum
KFVSNKWLQYNNKDIVGLLG

SEQ ID NO: 3385909 - protein, 26 aa, Plasmodium falciparum
KFVSWHINTLYKKNLIYYGSRVTIFS

SEQ ID NO: 3385910 - protein, 27 aa, Plasmodium falciparum
KFWKRYIYLWINYSIFEELYAQNIQRA

SEQ ID NO: 3385911 - protein, 28 aa, Plasmodium falciparum
KFYCIKTNLYHLYLSVPFYVIINDENIN

SEQ ID NO: 3385912 - protein, 17 aa, Plasmodium falciparum
KFYKHKVFYTRNDFLKL

SEQ ID NO: 3385913 - protein, 18 aa, Plasmodium falciparum
KFYNLDYDKETVSKTSCF

SEQ ID NO: 3385914 - protein, 24 aa, Plasmodium falciparum
KFYNNFLFKIPTGMGKTLIYDILI

SEQ ID NO: 3385915 - protein, 17 aa, Plasmodium falciparum
KFYPYFEWNDSNSCFFS

SEQ ID NO: 3385916 - protein, 18 aa, Plasmodium falciparum
KFYQIQKIIFNNGLIDMK

SEQ ID NO: 3385917 - protein, 21 aa, Plasmodium falciparum
KFYVIRKDRFLLKYPQGSNII

SEQ ID NO: 3385918 - protein, 20 aa, Plasmodium falciparum
KGANYFVYKLDGPKFSSDRC

SEQ ID NO: 3385919 - protein, 18 aa, Plasmodium falciparum
KGCILQNIKMKEGIIINK

SEQ ID NO: 3385920 - protein, 32 aa, Plasmodium falciparum
KGCRVYVGNLPWKVTWPILKNHMKKAGDVVRV

SEQ ID NO: 3385921 - protein, 23 aa, Plasmodium falciparum
KGDDYFMKAYKYTQPNKIIDYSS

SEQ ID NO: 3385922 - protein, 17 aa, Plasmodium falciparum
KGDILVFLPGQYEIELV

SEQ ID NO: 3385923 - protein, 20 aa, Plasmodium falciparum
KGDSFLITYIGYNNSEYVST

SEQ ID NO: 3385924 - protein, 23 aa, Plasmodium falciparum
KGEHIYFYNKYIMSDNKPIYNNI

SEQ ID NO: 3385925 - protein, 24 aa, Plasmodium falciparum
KGEKNDIHICGEKYIYNNIKQKKD

SEQ ID NO: 3385926 - protein, 25 aa, Plasmodium falciparum
KGESYEQIDSLNWEYSYDSNNLNNS

SEQ ID NO: 3385927 - protein, 22 aa, Plasmodium falciparum
KGEYMDGISSVPFLSDGKSIVY

SEQ ID NO: 3385928 - protein, 25 aa, Plasmodium falciparum
KGFDHLHKYYKSNGSINIPSHPNLH

SEQ ID NO: 3385929 - protein, 26 aa, Plasmodium falciparum
KGFDITKFIFLNYYLNSSENLNEVNM

SEQ ID NO: 3385930 - protein, 17 aa, Plasmodium falciparum
KGFFKNVKFTKFYNFFN

SEQ ID NO: 3385931 - protein, 24 aa, Plasmodium falciparum
KGFHKLICFSFDKKGELWAINLKK

SEQ ID NO: 3385932 - protein, 20 aa, Plasmodium falciparum
KGFVISKIDLLYFEKKKKKY

SEQ ID NO: 3385933 - protein, 24 aa, Plasmodium falciparum
KGGFQIPIFVKWMKLYDKKDMGSY

SEQ ID NO: 3385934 - protein, 25 aa, Plasmodium falciparum
KGGIVDKLNCRCTIIGASNFEINKE

SEQ ID NO: 3385935 - protein, 25 aa, Plasmodium falciparum
KGGNILKIGIILSGGPAPGGHNVIS

SEQ ID NO: 3385936 - protein, 19 aa, Plasmodium falciparum
KGIIPLLILCLQEKDNNLI

SEQ ID NO: 3385937 - protein, 22 aa, Plasmodium falciparum
KGIRHLINILLHTNKSITTFEI

SEQ ID NO: 3385938 - protein, 21 aa, Plasmodium falciparum
KGISMPLGGWYLKNEKQKKKN

SEQ ID NO: 3385939 - protein, 19 aa, Plasmodium falciparum
KGIYKLIELRTNEKKIKNL

SEQ ID NO: 3385940 - protein, 27 aa, Plasmodium falciparum
KGKESIALMYWLLAQEVLYLKGVIPRS

SEQ ID NO: 3385941 - protein, 32 aa, Plasmodium falciparum
KGKGKVFMKKGIPKLMMKFNAFSTKKMGINNL

SEQ ID NO: 3385942 - protein, 32 aa, Plasmodium falciparum
KGKKEIIICRVFLQFLQILINLICEKYEPVED

SEQ ID NO: 3385943 - protein, 31 aa, Plasmodium falciparum
KGKKFIIDGTFFIYKFMYVAWKHIINDKNRD

SEQ ID NO: 3385944 - protein, 27 aa, Plasmodium falciparum
KGKKKEIKLILLNAENKMTLCFDEKDK

SEQ ID NO: 3385945 - protein, 26 aa, Plasmodium falciparum
KGKKKTFVQWLMDERKRRLKNNLPID

SEQ ID NO: 3385946 - protein, 27 aa, Plasmodium falciparum
KGKKLLRYLDISLNNKSLHDSHILELV

SEQ ID NO: 3385947 - protein, 17 aa, Plasmodium falciparum
KGKKYIVCYNYLGKIQV

SEQ ID NO: 3385948 - protein, 25 aa, Plasmodium falciparum
KGKLRYYHNSIYWNYGALPQTYEYP

SEQ ID NO: 3385949 - protein, 24 aa, Plasmodium falciparum
KGKPFLNQVPLMSTSKKKINHIYN

SEQ ID NO: 3385950 - protein, 31 aa, Plasmodium falciparum
KGKRILRHLYRSKLIVYVIDVSNDKLKNVDD

SEQ ID NO: 3385951 - protein, 21 aa, Plasmodium falciparum
KGKRNVILFVGLQGSGKTTTC

SEQ ID NO: 3385952 - protein, 22 aa, Plasmodium falciparum
KGKTLYDFIYKKGYNKNEINDK

SEQ ID NO: 3385953 - protein, 25 aa, Plasmodium falciparum
KGKVDIPEIIFKKLPMNINADNIIE

SEQ ID NO: 3385954 - protein, 25 aa, Plasmodium falciparum
KGKVLLPVFALGRAQELLLILEEHW

SEQ ID NO: 3385955 - protein, 23 aa, Plasmodium falciparum
KGKYILEKALLSFLVIDHHGKEH

SEQ ID NO: 3385956 - protein, 29 aa, Plasmodium falciparum
KGLCIFDMLNIPLYHGWVISSDDIIFYSY

SEQ ID NO: 3385957 - protein, 25 aa, Plasmodium falciparum
KGLNIIKLINTLLLIEFRNLHKNGI

SEQ ID NO: 3385958 - protein, 19 aa, Plasmodium falciparum
KGLPPGVPQLPFPPNVNPP

SEQ ID NO: 3385959 - protein, 20 aa, Plasmodium falciparum
KGMGFTDVEKCLKALIKSKG

SEQ ID NO: 3385960 - protein, 19 aa, Plasmodium falciparum
KGMKCYRPRKKGERKRKSV

SEQ ID NO: 3385961 - protein, 30 aa, Plasmodium falciparum
KGMRMLEGANINRSLLALGNVINALVLRSK

SEQ ID NO: 3385962 - protein, 34 aa, Plasmodium falciparum
KGNIKYYNDCAHILRAMFLAKLEEKYNIIPRDLA

SEQ ID NO: 3385963 - protein, 26 aa, Plasmodium falciparum
KGNKRRIMNITNIFKIYNLKNNNENN

SEQ ID NO: 3385964 - protein, 21 aa, Plasmodium falciparum
KGNLHFFMKDYYKALQAYNKG

SEQ ID NO: 3385965 - protein, 17 aa, Plasmodium falciparum
KGNMYYTNLWIENKKMD

SEQ ID NO: 3385966 - protein, 26 aa, Plasmodium falciparum
KGNSMELFVNVLNWAIPKTEVNEMLK

SEQ ID NO: 3385967 - protein, 17 aa, Plasmodium falciparum
KGPELFILQGMIFLKMK

SEQ ID NO: 3385968 - protein, 24 aa, Plasmodium falciparum
KGPFHKPIIYTSRAKSLIAQNSRN

SEQ ID NO: 3385969 - protein, 41 aa, Plasmodium falciparum
KGPGCGLWAPLWRVWIFFLRGVIPLLERWLSNLLARQFEGR

SEQ ID NO: 3385970 - protein, 26 aa, Plasmodium falciparum
KGQPARLMWSHRDPSLRKSGTGNIFV

SEQ ID NO: 3385971 - protein, 25 aa, Plasmodium falciparum
KGRGTPPCYIGIILGTGSNGCYYEP

SEQ ID NO: 3385972 - protein, 33 aa, Plasmodium falciparum
KGRKISYNINLPKYNFNAKRTSSAWFLNPAYEN

SEQ ID NO: 3385973 - protein, 21 aa, Plasmodium falciparum
KGRVIDAPLFHSAPDNDINHT

SEQ ID NO: 3385974 - protein, 27 aa, Plasmodium falciparum
KGRVTSMEWLGDLLFSASWDQTIKCWN

SEQ ID NO: 3385975 - protein, 26 aa, Plasmodium falciparum
KGSCNPCANYFFHFSGCSKGNQCTKC

SEQ ID NO: 3385976 - protein, 31 aa, Plasmodium falciparum
KGSGRHLRVFSVKKYGYKKAKMLAIECKNSV

SEQ ID NO: 3385977 - protein, 33 aa, Plasmodium falciparum
KGSIKYAHLMCLRKWINGRLNLNDQLFSGSVFI

SEQ ID NO: 3385978 - protein, 25 aa, Plasmodium falciparum
KGSKKFVYLYIDFDNYFLNASIRNK

SEQ ID NO: 3385979 - protein, 29 aa, Plasmodium falciparum
KGSRFDIPILESLRWIFKHVAKTHLKKSS

SEQ ID NO: 3385980 - protein, 23 aa, Plasmodium falciparum
KGSSIYIEILNKTYNITKNIDII

SEQ ID NO: 3385981 - protein, 28 aa, Plasmodium falciparum
KGTVTFLNELRYLFKSFRSQVVLKNRIN

SEQ ID NO: 3385982 - protein, 26 aa, Plasmodium falciparum
KGVDQSPIITWGKIICTPKLVHGQKD

SEQ ID NO: 3385983 - protein, 20 aa, Plasmodium falciparum
KGVLLYGPPGTGKTLLARAM

SEQ ID NO: 3385984 - protein, 27 aa, Plasmodium falciparum
KGVQHPLRGLFLRYFLIQMCKDRIPDT

SEQ ID NO: 3385985 - protein, 46 aa, Plasmodium falciparum
KGVSYNDRKGSWLAYWSIGKNFQMRRFPIKKLGFEKAKELAIQCRL

SEQ ID NO: 3385986 - protein, 22 aa, Plasmodium falciparum
KGVYFSKSPRGVGKWNAYFQIA

SEQ ID NO: 3385987 - protein, 43 aa, Plasmodium falciparum
KGYNNCDVYYVFKYLLLPILEKFRPEFIFISCGFDASINDPLG

SEQ ID NO: 3385988 - protein, 20 aa, Plasmodium falciparum
KHALIRINKRNIIYLNATRY

SEQ ID NO: 3385989 - protein, 29 aa, Plasmodium falciparum
KHDDFVNIYLNLFFQARKNAILSDSQREE

SEQ ID NO: 3385990 - protein, 19 aa, Plasmodium falciparum
KHEDTKIKRVYYKNSFELP

SEQ ID NO: 3385991 - protein, 19 aa, Plasmodium falciparum
KHFNVFKYKLYFHYEKKEK

SEQ ID NO: 3385992 - protein, 25 aa, Plasmodium falciparum
KHGTFNYFLLLKRIVNKQLKNTLFL

SEQ ID NO: 3385993 - protein, 22 aa, Plasmodium falciparum
KHIAESPYLLEIKPSEAYAANC

SEQ ID NO: 3385994 - protein, 20 aa, Plasmodium falciparum
KHIEPNAKIFFPKKNNKKQG

SEQ ID NO: 3385995 - protein, 28 aa, Plasmodium falciparum
KHIFENSFELHLLIDYKKKLEDLLESTE

SEQ ID NO: 3385996 - protein, 26 aa, Plasmodium falciparum
KHIGDFMFIILSDDKKIYFLKDKEVY

SEQ ID NO: 3385997 - protein, 18 aa, Plasmodium falciparum
KHIIFQEHKIYISDEDDC

SEQ ID NO: 3385998 - protein, 20 aa, Plasmodium falciparum
KHINKYSTVLLLLDNIPQHD

SEQ ID NO: 3385999 - protein, 31 aa, Plasmodium falciparum
KHKIKNISLGSFHTLLLTYDGYVFTFGCNKR

SEQ ID NO: 3386000 - protein, 17 aa, Plasmodium falciparum
KHKKSFLQSVKKKRIKK

SEQ ID NO: 3386001 - protein, 29 aa, Plasmodium falciparum
KHKNILICSFTYCIYIYKLNISGNEKIDL

SEQ ID NO: 3386002 - protein, 25 aa, Plasmodium falciparum
KHKNLEIHILYLNIITLDISFNNLE

SEQ ID NO: 3386003 - protein, 35 aa, Plasmodium falciparum
KHKNNEYNFLIFFDIKYFLIFKDIINDPEAYNNPH

SEQ ID NO: 3386004 - protein, 29 aa, Plasmodium falciparum
KHLAKKALIIYLRHLYIVMKFKDIKKKIQ

SEQ ID NO: 3386005 - protein, 30 aa, Plasmodium falciparum
KHLLYNDTIKMDYLLNRKIEYEKLDEDQSE

SEQ ID NO: 3386006 - protein, 17 aa, Plasmodium falciparum
KHLTVYKIIQYAHALKS

SEQ ID NO: 3386007 - protein, 23 aa, Plasmodium falciparum
KHMNNFLKNACKYAMDNMFGDEN

SEQ ID NO: 3386008 - protein, 19 aa, Plasmodium falciparum
KHNCKFLIIINEKQKNYIG

SEQ ID NO: 3386009 - protein, 28 aa, Plasmodium falciparum
KHNGKVYNRFINRCFKRKLYHHEHEKNE

SEQ ID NO: 3386010 - protein, 22 aa, Plasmodium falciparum
KHNHDNFFIAKLIKRSDAVFTN

SEQ ID NO: 3386011 - protein, 28 aa, Plasmodium falciparum
KHNINSEILFFKNTYLMIKRAVNRDLIK

SEQ ID NO: 3386012 - protein, 20 aa, Plasmodium falciparum
KHNMTIILISSIMTWSKTKR

SEQ ID NO: 3386013 - protein, 30 aa, Plasmodium falciparum
KHNNYHAKWKLINDLDLVILIVYQGIQNST

SEQ ID NO: 3386014 - protein, 26 aa, Plasmodium falciparum
KHNPDIRYQLVALMAFFGTTSAITCY

SEQ ID NO: 3386015 - protein, 23 aa, Plasmodium falciparum
KHNRLFMKAYPLAEGLPEAIDKN

SEQ ID NO: 3386016 - protein, 25 aa, Plasmodium falciparum
KHNRLGNLLVWNVKDKNILCSFKIK

SEQ ID NO: 3386017 - protein, 18 aa, Plasmodium falciparum
KHPLIKFTYNMQADLERK

SEQ ID NO: 3386018 - protein, 33 aa, Plasmodium falciparum
KHQPIDPNDIPLKLYIGGLLGPLSNITEQELKQ

SEQ ID NO: 3386019 - protein, 17 aa, Plasmodium falciparum
KHQSLGIELLHFGEVIM

SEQ ID NO: 3386020 - protein, 25 aa, Plasmodium falciparum
KHSDRLKRKIPKHYSSKNKDNNLND

SEQ ID NO: 3386021 - protein, 27 aa, Plasmodium falciparum
KHSEEIILFVELMMPALKIPCFANGTQ

SEQ ID NO: 3386022 - protein, 21 aa, Plasmodium falciparum
KHSLLNIKIVDFGLSSFFSKD

SEQ ID NO: 3386023 - protein, 27 aa, Plasmodium falciparum
KHSNYYNPLFLCKVLITLGEGILVQHP

SEQ ID NO: 3386024 - protein, 25 aa, Plasmodium falciparum
KHSVKSYNPLTYSFSGLCECLSKQD

SEQ ID NO: 3386025 - protein, 20 aa, Plasmodium falciparum
KHSYEFYKNKILKIYDNGVQ

SEQ ID NO: 3386026 - protein, 25 aa, Plasmodium falciparum
KHTYINCYVIPMDLLEEAKIYFKKN

SEQ ID NO: 3386027 - protein, 19 aa, Plasmodium falciparum
KHVEYGILPLLHNYPLYTE

SEQ ID NO: 3386028 - protein, 19 aa, Plasmodium falciparum
KHVFIDMPKKHSLIIKLPL

SEQ ID NO: 3386029 - protein, 20 aa, Plasmodium falciparum
KHWRLIGWGQINKGKPLELQ

SEQ ID NO: 3386030 - protein, 20 aa, Plasmodium falciparum
KHYGKCVILFGIPYQYTLSK

SEQ ID NO: 3386031 - protein, 20 aa, Plasmodium falciparum
KHYNLKYKDPEFLKPIICRS

SEQ ID NO: 3386032 - protein, 20 aa, Plasmodium falciparum
KIAENVSDNPWWAKGQSKIK

SEQ ID NO: 3386033 - protein, 20 aa, Plasmodium falciparum
KIAILTCPFEPPKPKIKHKL

SEQ ID NO: 3386034 - protein, 26 aa, Plasmodium falciparum
KIANLKRRARELAQRYKSKEYSNHDQ

SEQ ID NO: 3386035 - protein, 21 aa, Plasmodium falciparum
KIAPGMLFNFKIEFYPKSHAN

SEQ ID NO: 3386036 - protein, 18 aa, Plasmodium falciparum
KICDKIIYIPQYGKGTAS

SEQ ID NO: 3386037 - protein, 24 aa, Plasmodium falciparum
KICELCNIIYPIFNKIFGNGFVGD

SEQ ID NO: 3386038 - protein, 23 aa, Plasmodium falciparum
KICHDLFDPLYFEYNKGYKKIMN

SEQ ID NO: 3386039 - protein, 19 aa, Plasmodium falciparum
KICKNVFTHFRWKPGENSR

SEQ ID NO: 3386040 - protein, 26 aa, Plasmodium falciparum
KICLLNLYFIKMEKPSIYFMNNKIKK

SEQ ID NO: 3386041 - protein, 19 aa, Plasmodium falciparum
KICQIYQIMKLQHGVMLVG

SEQ ID NO: 3386042 - protein, 19 aa, Plasmodium falciparum
KIDGILNQFLEKHFLSSHD

SEQ ID NO: 3386043 - protein, 17 aa, Plasmodium falciparum
KIDKSKLIFFIIDERYK

SEQ ID NO: 3386044 - protein, 22 aa, Plasmodium falciparum
KIDLINYNLSFNNNIKSDCFKN

SEQ ID NO: 3386045 - protein, 42 aa, Plasmodium falciparum
KIDNELIQILTYLKFLGPSKIQAYALPIILSSNKNLIAQSQN

SEQ ID NO: 3386046 - protein, 18 aa, Plasmodium falciparum
KIDNFLNVKLKSFYNAEN

SEQ ID NO: 3386047 - protein, 31 aa, Plasmodium falciparum
KIDNYALGMNMILFISGRFVCRQKGIECSKV

SEQ ID NO: 3386048 - protein, 31 aa, Plasmodium falciparum
KIDPLLREYIYFLHSFDPYRFTFKRLSERYL

SEQ ID NO: 3386049 - protein, 24 aa, Plasmodium falciparum
KIDRMLNHSFLFDVLKKIVDQTFK

SEQ ID NO: 3386050 - protein, 40 aa, Plasmodium falciparum
KIDVNKIKFPLIETWINKRLIEILGFEDDILYEYCISQLK

SEQ ID NO: 3386051 - protein, 18 aa, Plasmodium falciparum
KIDVTQVDDLILKKKLKE

SEQ ID NO: 3386052 - protein, 19 aa, Plasmodium falciparum
KIDYAYNTLFPKPIDIKDT

SEQ ID NO: 3386053 - protein, 26 aa, Plasmodium falciparum
KIEALEKKLHILKLRVKCFKNGYKME

SEQ ID NO: 3386054 - protein, 25 aa, Plasmodium falciparum
KIECNDNFLWMCQIKYILTEDEIKE

SEQ ID NO: 3386055 - protein, 26 aa, Plasmodium falciparum
KIEDKYLFMCGRLVFKVFYNMKKEMI

SEQ ID NO: 3386056 - protein, 19 aa, Plasmodium falciparum
KIEELKEARLIAMVEKKKK

SEQ ID NO: 3386057 - protein, 18 aa, Plasmodium falciparum
KIEELNSLFLMWGTSENP

SEQ ID NO: 3386058 - protein, 19 aa, Plasmodium falciparum
KIEELRNIIINYNEKFDRI

SEQ ID NO: 3386059 - protein, 21 aa, Plasmodium falciparum
KIEKIFFKEGNSPWLYAHKSL

SEQ ID NO: 3386060 - protein, 18 aa, Plasmodium falciparum
KIEKKNPPILIKTNNTDN

SEQ ID NO: 3386061 - protein, 29 aa, Plasmodium falciparum
KIELLYPKNYYITIFPNIYFKNIIDFLKS

SEQ ID NO: 3386062 - protein, 27 aa, Plasmodium falciparum
KIELPVFIHSYVWKNNNWYGVIHMREC

SEQ ID NO: 3386063 - protein, 27 aa, Plasmodium falciparum
KIENLTYACTYLRIPSDTDIYYNNKKN

SEQ ID NO: 3386064 - protein, 27 aa, Plasmodium falciparum
KIEPPSQILLNTPPPPSGQPPTGIQNV

SEQ ID NO: 3386065 - protein, 25 aa, Plasmodium falciparum
KIEQKLCLIWKYGKSLITFKNIYDL

SEQ ID NO: 3386066 - protein, 18 aa, Plasmodium falciparum
KIESLMGRIIAIDASMSL

SEQ ID NO: 3386067 - protein, 22 aa, Plasmodium falciparum
KIETKIIPKYIEVPVVKIVNRY

SEQ ID NO: 3386068 - protein, 35 aa, Plasmodium falciparum
KIETKKFIIPANSKYLLIIVYLPTRHGPFEKTFII

SEQ ID NO: 3386069 - protein, 24 aa, Plasmodium falciparum
KIEYRVWNPFRSKLGACLMGGVGN

SEQ ID NO: 3386070 - protein, 17 aa, Plasmodium falciparum
KIFDRYRKAYYMNGLSS

SEQ ID NO: 3386071 - protein, 20 aa, Plasmodium falciparum
KIFEKLFFETFENYIKKYIN

SEQ ID NO: 3386072 - protein, 28 aa, Plasmodium falciparum
KIFEYIRLIDIYFRILYEYNGINKLCGG

SEQ ID NO: 3386073 - protein, 19 aa, Plasmodium falciparum
KIFFKKIINSNDIIKKMML

SEQ ID NO: 3386074 - protein, 17 aa, Plasmodium falciparum
KIFFPKKNNKKQGYAIV

SEQ ID NO: 3386075 - protein, 26 aa, Plasmodium falciparum
KIFPRLIYFTLLIKSPICIALLKNFC

SEQ ID NO: 3386076 - protein, 21 aa, Plasmodium falciparum
KIFVRNPRLSIRDINLYNIKH

SEQ ID NO: 3386077 - protein, 23 aa, Plasmodium falciparum
KIGIEPPMGILIYGPPGTGKTML

SEQ ID NO: 3386078 - protein, 32 aa, Plasmodium falciparum
KIGIINREKTCPFLLRLFYKVDKEYNVDDMDI

SEQ ID NO: 3386079 - protein, 23 aa, Plasmodium falciparum
KIGQRKLLNWIIHPIRDEKKINE

SEQ ID NO: 3386080 - protein, 28 aa, Plasmodium falciparum
KIGVHIVGKLLRKLIHDVTYYRDEEERN

SEQ ID NO: 3386081 - protein, 24 aa, Plasmodium falciparum
KIGVPWCTSLTWSANGQLLYCGST

SEQ ID NO: 3386082 - protein, 23 aa, Plasmodium falciparum
KIGYHNMMYPNVNNFPSTNYQPL

SEQ ID NO: 3386083 - protein, 20 aa, Plasmodium falciparum
KIGYPILVRTTFSLGGLNSS

SEQ ID NO: 3386084 - protein, 36 aa, Plasmodium falciparum
KIHAQKYMKFKTFPPYLFIHLKRFYADENWSAKKIN

SEQ ID NO: 3386085 - protein, 19 aa, Plasmodium falciparum
KIHENFYLFRKKEKFNNSI

SEQ ID NO: 3386086 - protein, 18 aa, Plasmodium falciparum
KIHNLYKNNLEYNNLLEK

SEQ ID NO: 3386087 - protein, 20 aa, Plasmodium falciparum
KIICIFLQYIKYQSMYFKKK

SEQ ID NO: 3386088 - protein, 19 aa, Plasmodium falciparum
KIIDDIFKYSFPDITKEDL

SEQ ID NO: 3386089 - protein, 25 aa, Plasmodium falciparum
KIIEEKYITQFLLNKYHSLEENFIN

SEQ ID NO: 3386090 - protein, 33 aa, Plasmodium falciparum
KIIERPNYVPVIKYRDIPIEKIRYVPKIETVEL

SEQ ID NO: 3386091 - protein, 21 aa, Plasmodium falciparum
KIIFRITLALFKLNQQKLCEL

SEQ ID NO: 3386092 - protein, 18 aa, Plasmodium falciparum
KIIIPLKYMLLCKVLEEN

SEQ ID NO: 3386093 - protein, 17 aa, Plasmodium falciparum
KIIISKEDKYTNTNNNS

SEQ ID NO: 3386094 - protein, 25 aa, Plasmodium falciparum
KIIKNFNMLKRNINLKVLINQMIKM

SEQ ID NO: 3386095 - protein, 25 aa, Plasmodium falciparum
KIIKNNLHIYGLKKISIILHSLTKL

SEQ ID NO: 3386096 - protein, 27 aa, Plasmodium falciparum
KIIKVNPYIRVGFACRYMRYDYPIGTD

SEQ ID NO: 3386097 - protein, 29 aa, Plasmodium falciparum
KIILLLDVIIYYKYFKEELLKVVYEYILK

SEQ ID NO: 3386098 - protein, 18 aa, Plasmodium falciparum
KIILPINKKWKIENSILY

SEQ ID NO: 3386099 - protein, 19 aa, Plasmodium falciparum
KIILTYYIWEDDKIFNNFT

SEQ ID NO: 3386100 - protein, 24 aa, Plasmodium falciparum
KIINCDIIIVLNKIDLIPLHLREK

SEQ ID NO: 3386101 - protein, 22 aa, Plasmodium falciparum
KIINHILGRDFLWIPELSMNDF

SEQ ID NO: 3386102 - protein, 19 aa, Plasmodium falciparum
KIINLKYLSKKNSLKNILR

SEQ ID NO: 3386103 - protein, 17 aa, Plasmodium falciparum
KIIPRPLGKGLKINRKY

SEQ ID NO: 3386104 - protein, 24 aa, Plasmodium falciparum
KIIQTFIKSYQFFLDFGYDKNGTN

SEQ ID NO: 3386105 - protein, 26 aa, Plasmodium falciparum
KIIYENDYFLVLNKPYDIKLEKGKLD

SEQ ID NO: 3386106 - protein, 17 aa, Plasmodium falciparum
KIIYNRLVPPRSEIYTL

SEQ ID NO: 3386107 - protein, 18 aa, Plasmodium falciparum
KIIYNYLVSYSGVVNNLK

SEQ ID NO: 3386108 - protein, 19 aa, Plasmodium falciparum
KIKEFYLQTENFMKTYENE

SEQ ID NO: 3386109 - protein, 48 aa, Plasmodium falciparum
KIKEILKLYDKLFYSHFKFIPNKIYKEILRPIYTYYQNLKSNMVGGVS

SEQ ID NO: 3386110 - protein, 33 aa, Plasmodium falciparum
KIKEKKIDLILSNNLSFFKYSCMYRKRQLLHEK

SEQ ID NO: 3386111 - protein, 18 aa, Plasmodium falciparum
KIKELEIALYLNLSICYS

SEQ ID NO: 3386112 - protein, 39 aa, Plasmodium falciparum
KIKELKILEPLKRREYFFYLYIAVSLKYVEERIANVYCV

SEQ ID NO: 3386113 - protein, 24 aa, Plasmodium falciparum
KIKELWCGRMKGLMNLKLCNMERK

SEQ ID NO: 3386114 - protein, 23 aa, Plasmodium falciparum
KIKERWKVILKNNAKRYGKISEG

SEQ ID NO: 3386115 - protein, 20 aa, Plasmodium falciparum
KIKFDDFDYNYLNELHKSVS

SEQ ID NO: 3386116 - protein, 27 aa, Plasmodium falciparum
KIKFIILYFFCVLFLKDYERSEAFNLA

SEQ ID NO: 3386117 - protein, 23 aa, Plasmodium falciparum
KIKFSKLYKDISLRISKDIDMLY

SEQ ID NO: 3386118 - protein, 25 aa, Plasmodium falciparum
KIKGIHFFFILNSKVLKELGINNKE

SEQ ID NO: 3386119 - protein, 20 aa, Plasmodium falciparum
KIKIDYKFWYTQPVPKINDE

SEQ ID NO: 3386120 - protein, 26 aa, Plasmodium falciparum
KIKIFEEMLHIFLLVGFEDTGDFYVI

SEQ ID NO: 3386121 - protein, 26 aa, Plasmodium falciparum
KIKIHNGGISFLFLHKRGKFLCSASY

SEQ ID NO: 3386122 - protein, 19 aa, Plasmodium falciparum
KIKIIASKYKKCIIPFISI

SEQ ID NO: 3386123 - protein, 27 aa, Plasmodium falciparum
KIKKIKTPLILPIDPNIELLSFLPEQS

SEQ ID NO: 3386124 - protein, 26 aa, Plasmodium falciparum
KIKKNYINLLFLINKKYGSTFTFINN

SEQ ID NO: 3386125 - protein, 29 aa, Plasmodium falciparum
KIKKRIPKIDFLVLININSDNYNNIIESH

SEQ ID NO: 3386126 - protein, 20 aa, Plasmodium falciparum
KIKKYGYEILKVFHSSYQDK

SEQ ID NO: 3386127 - protein, 25 aa, Plasmodium falciparum
KIKKYMWNQYYFNVKEKKILKIPNE

SEQ ID NO: 3386128 - protein, 20 aa, Plasmodium falciparum
KIKKYQLINENLQDCIAGYQ

SEQ ID NO: 3386129 - protein, 21 aa, Plasmodium falciparum
KIKLFKHASFLNHSCFPNASY

SEQ ID NO: 3386130 - protein, 18 aa, Plasmodium falciparum
KIKLMKYIELYNIKIEIN

SEQ ID NO: 3386131 - protein, 20 aa, Plasmodium falciparum
KIKLNIYYYQSVGDLYEINH

SEQ ID NO: 3386132 - protein, 25 aa, Plasmodium falciparum
KIKNELVYIILKKALHILQKEKNIH

SEQ ID NO: 3386133 - protein, 27 aa, Plasmodium falciparum
KIKNENITFFPAIEQFNFSIEHAVSSY

SEQ ID NO: 3386134 - protein, 25 aa, Plasmodium falciparum
KIKNILIEKFLKKNMQTLYKNLYPW

SEQ ID NO: 3386135 - protein, 17 aa, Plasmodium falciparum
KIKNRLLYDENFENNSD

SEQ ID NO: 3386136 - protein, 30 aa, Plasmodium falciparum
KIKQNVIKYNKIKSHLLSMKIKLQSVKSSE

SEQ ID NO: 3386137 - protein, 20 aa, Plasmodium falciparum
KIKTLLLPNVSLIFDWKIAD

SEQ ID NO: 3386138 - protein, 25 aa, Plasmodium falciparum
KIKVIDKPFYVNKYVDKPVVIPVSK

SEQ ID NO: 3386139 - protein, 43 aa, Plasmodium falciparum
KIKVPFNAYMFYIPLTHKPYIFLFSKKNLLQYLKTKHIPIIIE

SEQ ID NO: 3386140 - protein, 17 aa, Plasmodium falciparum
KIKYDIMNLPKVTIQIT

SEQ ID NO: 3386141 - protein, 19 aa, Plasmodium falciparum
KIKYKVFYGFKKSYENEQN

SEQ ID NO: 3386142 - protein, 21 aa, Plasmodium falciparum
KIKYLSRIYRILSIKYFHIGD

SEQ ID NO: 3386143 - protein, 18 aa, Plasmodium falciparum
KILESKFILPVKYSNIYK

SEQ ID NO: 3386144 - protein, 29 aa, Plasmodium falciparum
KILFESSFIGKYIILPWIDNDPDIKNNLY

SEQ ID NO: 3386145 - protein, 21 aa, Plasmodium falciparum
KILKDFFYDIFLFCVSKNLTI

SEQ ID NO: 3386146 - protein, 19 aa, Plasmodium falciparum
KILKLFTHICENVHFKLTR

SEQ ID NO: 3386147 - protein, 18 aa, Plasmodium falciparum
KILKMRRSLKRKRKSPKN

SEQ ID NO: 3386148 - protein, 18 aa, Plasmodium falciparum
KILKNLEPGPMAPYLTLI

SEQ ID NO: 3386149 - protein, 27 aa, Plasmodium falciparum
KILKPLGECLIKLEPYLKLIELTIDFE

SEQ ID NO: 3386150 - protein, 33 aa, Plasmodium falciparum
KILLRTRMLEARKQNIPPFQLISDQPLKDICHK

SEQ ID NO: 3386151 - protein, 20 aa, Plasmodium falciparum
KILLTIGKKIYEENICIYCF

SEQ ID NO: 3386152 - protein, 25 aa, Plasmodium falciparum
KILNIPGRLFPVEIFYTLQAEKDYV

SEQ ID NO: 3386153 - protein, 19 aa, Plasmodium falciparum
KILNIQRKTSFYLIDQNEY

SEQ ID NO: 3386154 - protein, 33 aa, Plasmodium falciparum
KILPPEIFEKIEEFIIFIGKYIDKFCSICKDME

SEQ ID NO: 3386155 - protein, 30 aa, Plasmodium falciparum
KILQKNDTILFFKKKKKFMYLRKKKKKKKK

SEQ ID NO: 3386156 - protein, 22 aa, Plasmodium falciparum
KILRNRTCIIHQILNRNKENQK

SEQ ID NO: 3386157 - protein, 22 aa, Plasmodium falciparum
KILSYPYKRPIGYITSCTWSPI

SEQ ID NO: 3386158 - protein, 20 aa, Plasmodium falciparum
KILYFHDDLIQFFNDRNIYK

SEQ ID NO: 3386159 - protein, 19 aa, Plasmodium falciparum
KIMDPIPNVYFIQGEIGKD

SEQ ID NO: 3386160 - protein, 26 aa, Plasmodium falciparum
KIMEKLIYYCFFLLKYNEKNVKNEKI

SEQ ID NO: 3386161 - protein, 32 aa, Plasmodium falciparum
KIMELNNEELKIYILIFRSLCNENIKKIDFYI

SEQ ID NO: 3386162 - protein, 19 aa, Plasmodium falciparum
KIMELTNIHIENNLDILLY

SEQ ID NO: 3386163 - protein, 19 aa, Plasmodium falciparum
KIMKNIFIALDFFHSNNII

SEQ ID NO: 3386164 - protein, 19 aa, Plasmodium falciparum
KIMVKELLNYLLVADIEIK

SEQ ID NO: 3386165 - protein, 18 aa, Plasmodium falciparum
KINDFYYFNIYLMKDQDF

SEQ ID NO: 3386166 - protein, 25 aa, Plasmodium falciparum
KINDNDLFIYEYAKKQALFIYNIIK

SEQ ID NO: 3386167 - protein, 28 aa, Plasmodium falciparum
KINEQLEMFINIHPKIFNISHAKKKRKK

SEQ ID NO: 3386168 - protein, 22 aa, Plasmodium falciparum
KINFEEILNFKLNIEKVFYESL

SEQ ID NO: 3386169 - protein, 30 aa, Plasmodium falciparum
KINFVEELFFLITQLLIHFKHNLYNSVLLS

SEQ ID NO: 3386170 - protein, 25 aa, Plasmodium falciparum
KINFYGEFISLFKKHTIISKQKIFL

SEQ ID NO: 3386171 - protein, 17 aa, Plasmodium falciparum
KINIKNIIPYMKKNNYE

SEQ ID NO: 3386172 - protein, 19 aa, Plasmodium falciparum
KINIKTFIKRDINLYSKME

SEQ ID NO: 3386173 - protein, 25 aa, Plasmodium falciparum
KINLDDFFYVFFFEKNQEVDISSSI

SEQ ID NO: 3386174 - protein, 39 aa, Plasmodium falciparum
KINLFINSACPYELLLFSSLIKCNILCNVSIRNICNSLH

SEQ ID NO: 3386175 - protein, 21 aa, Plasmodium falciparum
KINLNFCNNLFIYNIETNKCF

SEQ ID NO: 3386176 - protein, 24 aa, Plasmodium falciparum
KINLPRLKLRGLPFDASEEEIKNF

SEQ ID NO: 3386177 - protein, 20 aa, Plasmodium falciparum
KINMFFCKYNEPAYVKMEKL

SEQ ID NO: 3386178 - protein, 18 aa, Plasmodium falciparum
KINNKWNTWIDYEKFHQL

SEQ ID NO: 3386179 - protein, 31 aa, Plasmodium falciparum
KINPKRKNYIFLFKYNKFFYKMLENHREERN

SEQ ID NO: 3386180 - protein, 27 aa, Plasmodium falciparum
KINPYYAKAYYRKGCSYLLLSDLKRAS

SEQ ID NO: 3386181 - protein, 17 aa, Plasmodium falciparum
KINQINNSLLYNKQYHL

SEQ ID NO: 3386182 - protein, 17 aa, Plasmodium falciparum
KINVQNRMNLFIPINKY

SEQ ID NO: 3386183 - protein, 17 aa, Plasmodium falciparum
KINYLYLDYEKITSEQG

SEQ ID NO: 3386184 - protein, 17 aa, Plasmodium falciparum
KINYYKEKYTKIINEER

SEQ ID NO: 3386185 - protein, 23 aa, Plasmodium falciparum
KIPDNLFNDIYDFVIEKVQQQIK

SEQ ID NO: 3386186 - protein, 18 aa, Plasmodium falciparum
KIPELYIQKLGLNFSYYH

SEQ ID NO: 3386187 - protein, 19 aa, Plasmodium falciparum
KIPFISSSSKRIADQIHIH

SEQ ID NO: 3386188 - protein, 20 aa, Plasmodium falciparum
KIPMLYLSNVCNNIYYFLND

SEQ ID NO: 3386189 - protein, 26 aa, Plasmodium falciparum
KIPNILTHPYHLSSYTKLLGECSAKK

SEQ ID NO: 3386190 - protein, 19 aa, Plasmodium falciparum
KIPPFLEMLDSKGLNLKEI

SEQ ID NO: 3386191 - protein, 18 aa, Plasmodium falciparum
KIPTIYKLQLFNGKEYYV

SEQ ID NO: 3386192 - protein, 27 aa, Plasmodium falciparum
KIPVVDQREILREWKPNIIKEEKKSQK

SEQ ID NO: 3386193 - protein, 19 aa, Plasmodium falciparum
KIQCYDTLTGIKIFIVHKD

SEQ ID NO: 3386194 - protein, 27 aa, Plasmodium falciparum
KIQKARKWFYRVINLNPHFGDGWATFL

SEQ ID NO: 3386195 - protein, 31 aa, Plasmodium falciparum
KIQLKPVDFIIVNDKVIVTKILVVAKWGGEL

SEQ ID NO: 3386196 - protein, 24 aa, Plasmodium falciparum
KIRDKFKEVKLIEKSLERNNSEIY

SEQ ID NO: 3386197 - protein, 17 aa, Plasmodium falciparum
KIRLHRGLRHHWGLRVR

SEQ ID NO: 3386198 - protein, 18 aa, Plasmodium falciparum
KIRPRLLAKGFFSSMKEK

SEQ ID NO: 3386199 - protein, 37 aa, Plasmodium falciparum
KISAFPEITCVTLTPEDEFLFLACDGIWDCKDGQDVV

SEQ ID NO: 3386200 - protein, 25 aa, Plasmodium falciparum
KISDFLLKHTILVRDIRLLGDTTNK

SEQ ID NO: 3386201 - protein, 27 aa, Plasmodium falciparum
KISDKNISLIFYNLLVLASNDELDLIQ

SEQ ID NO: 3386202 - protein, 19 aa, Plasmodium falciparum
KISFEYFRNCFNDLNYDIK

SEQ ID NO: 3386203 - protein, 24 aa, Plasmodium falciparum
KISHIHLILYIYSYFNTINNTFIN

SEQ ID NO: 3386204 - protein, 24 aa, Plasmodium falciparum
KISHSYFSILSKRLLNYYINDMNR

SEQ ID NO: 3386205 - protein, 24 aa, Plasmodium falciparum
KISIQKFHLAYTNNSIGKLKIAAQ

SEQ ID NO: 3386206 - protein, 24 aa, Plasmodium falciparum
KISKKTFMCLMYNIGIQIDYCLTL

SEQ ID NO: 3386207 - protein, 18 aa, Plasmodium falciparum
KISKKVISPKKKKKLFIE

SEQ ID NO: 3386208 - protein, 21 aa, Plasmodium falciparum
KISKLLRTTTLKKSLTKDVKS

SEQ ID NO: 3386209 - protein, 32 aa, Plasmodium falciparum
KISKRNMEFKLIITKFIDGFIKCTESKIYKSS

SEQ ID NO: 3386210 - protein, 19 aa, Plasmodium falciparum
KISKVPYVINDYKKKMYQH

SEQ ID NO: 3386211 - protein, 34 aa, Plasmodium falciparum
KISLENIKDLKLKKKLRHLLRSWKLEKKDEYYKK

SEQ ID NO: 3386212 - protein, 32 aa, Plasmodium falciparum
KISLNPYEIIYLQIFGLIKNTTPIPKLNLKKI

SEQ ID NO: 3386213 - protein, 22 aa, Plasmodium falciparum
KISQKKLRYLKMKDKKEEKKKK

SEQ ID NO: 3386214 - protein, 27 aa, Plasmodium falciparum
KISSKKKYFNELLNFGNKNKNVQIKTI

SEQ ID NO: 3386215 - protein, 24 aa, Plasmodium falciparum
KISSNYIIILVANKIDKNKFQVDI

SEQ ID NO: 3386216 - protein, 24 aa, Plasmodium falciparum
KISYNKFHNFDFVNNYDLSMSSIM

SEQ ID NO: 3386217 - protein, 23 aa, Plasmodium falciparum
KITGFGLYIHYSKSKYIGYWRRG

SEQ ID NO: 3386218 - protein, 34 aa, Plasmodium falciparum
KITKRVENWRLKYPQKLYKYIKDIYPHVLNKKIS

SEQ ID NO: 3386219 - protein, 25 aa, Plasmodium falciparum
KITNYHTVLYNILSYLKRKSYIEEK

SEQ ID NO: 3386220 - protein, 23 aa, Plasmodium falciparum
KITRIRNFYMRKVKICQELFREK

SEQ ID NO: 3386221 - protein, 25 aa, Plasmodium falciparum
KITSIHFRYILLELNKILQEHNFEM

SEQ ID NO: 3386222 - protein, 21 aa, Plasmodium falciparum
KITSSNLFPQKSWKGILFGDK

SEQ ID NO: 3386223 - protein, 26 aa, Plasmodium falciparum
KITYPLNILFNEGSFFFFHDTIDKYS

SEQ ID NO: 3386224 - protein, 27 aa, Plasmodium falciparum
KIVDYDMLLILIPLIEKKPWRHQNYVF

SEQ ID NO: 3386225 - protein, 31 aa, Plasmodium falciparum
KIVEKFSSFINFPVYVLKKKKILQTRKDIEQ

SEQ ID NO: 3386226 - protein, 17 aa, Plasmodium falciparum
KIVKLCLKLSPTKDILT

SEQ ID NO: 3386227 - protein, 21 aa, Plasmodium falciparum
KIVLKYKEKYKYITLFNSIVV

SEQ ID NO: 3386228 - protein, 18 aa, Plasmodium falciparum
KIVLSKKKRKLFARIDMA

SEQ ID NO: 3386229 - protein, 18 aa, Plasmodium falciparum
KIVPLIVTVVSNFKRNIN

SEQ ID NO: 3386230 - protein, 34 aa, Plasmodium falciparum
KIVQVRLYKGIFNYPQGVLLRDNIYKLNIPIRKE

SEQ ID NO: 3386231 - protein, 27 aa, Plasmodium falciparum
KIVTSLCFYFDCLFDKSTYYIKNNTHN

SEQ ID NO: 3386232 - protein, 27 aa, Plasmodium falciparum
KIYEDKFFYIYYLYLIRKLKKENRKIC

SEQ ID NO: 3386233 - protein, 24 aa, Plasmodium falciparum
KIYEKWKYENYLKTIYHAKGNNSL

SEQ ID NO: 3386234 - protein, 25 aa, Plasmodium falciparum
KIYEQELQPLLPRFSSFNSCENYLD

SEQ ID NO: 3386235 - protein, 18 aa, Plasmodium falciparum
KIYKIYNRFVNKTDDVLC

SEQ ID NO: 3386236 - protein, 20 aa, Plasmodium falciparum
KIYKLNVMGPKKWKKEVYNI

SEQ ID NO: 3386237 - protein, 41 aa, Plasmodium falciparum
KIYKMFVEIYYMKKIIRFIIFSFFKFHDIYSVFNVNTFDGV

SEQ ID NO: 3386238 - protein, 26 aa, Plasmodium falciparum
KIYKRRYQMIFNKKLFYLFQKCEELF

SEQ ID NO: 3386239 - protein, 24 aa, Plasmodium falciparum
KIYKYGVIKLADFGFSCQLKNKRQ

SEQ ID NO: 3386240 - protein, 18 aa, Plasmodium falciparum
KIYLNIINILRNITDRIH

SEQ ID NO: 3386241 - protein, 23 aa, Plasmodium falciparum
KIYLSIYMNILYKCYNILQLHFD

SEQ ID NO: 3386242 - protein, 24 aa, Plasmodium falciparum
KIYNFYLNHKLFITCVELINEHIF

SEQ ID NO: 3386243 - protein, 35 aa, Plasmodium falciparum
KIYNTNYDYVNIRRGKNIKFVLTNCNYKTNVLKVK

SEQ ID NO: 3386244 - protein, 28 aa, Plasmodium falciparum
KIYTIELMMRSLLFSSSLVLYDEHLLKL

SEQ ID NO: 3386245 - protein, 18 aa, Plasmodium falciparum
KKAHFFASDLGGYLIQLY

SEQ ID NO: 3386246 - protein, 27 aa, Plasmodium falciparum
KKALSKYYFLIGIYYHILQNMKKALMY

SEQ ID NO: 3386247 - protein, 24 aa, Plasmodium falciparum
KKANRPYSVINVYDNLHGCINKNN

SEQ ID NO: 3386248 - protein, 29 aa, Plasmodium falciparum
KKANYLVFDILFDVFMKIIKTIGYHCKKF

SEQ ID NO: 3386249 - protein, 25 aa, Plasmodium falciparum
KKASDDLLWHKMSEQFDRNNKSILE

SEQ ID NO: 3386250 - protein, 22 aa, Plasmodium falciparum
KKCDEIYHLKTLLEKEEMNNKQ

SEQ ID NO: 3386251 - protein, 23 aa, Plasmodium falciparum
KKCDFLIKNLKDSLTKNKIIFGI

SEQ ID NO: 3386252 - protein, 25 aa, Plasmodium falciparum
KKCEKYIHLLGAQKLYKTLKLCDTQ

SEQ ID NO: 3386253 - protein, 19 aa, Plasmodium falciparum
KKCHSKFVTVLLGGKRLEQ

SEQ ID NO: 3386254 - protein, 24 aa, Plasmodium falciparum
KKCHSSDIFLIRDNILNNLSNKEF

SEQ ID NO: 3386255 - protein, 28 aa, Plasmodium falciparum
KKCIEMYIKTFLKLYKYLNINKKEEEYL

SEQ ID NO: 3386256 - protein, 23 aa, Plasmodium falciparum
KKCIIPYMLNKYSIFSFQDLCSK

SEQ ID NO: 3386257 - protein, 24 aa, Plasmodium falciparum
KKCIIRIFKYMDIYLYIYNNDEQI

SEQ ID NO: 3386258 - protein, 26 aa, Plasmodium falciparum
KKCKRIERIFSVNKYGFEGARKLAIA

SEQ ID NO: 3386259 - protein, 26 aa, Plasmodium falciparum
KKCLDELYILASYDNFLKKKYETYEC

SEQ ID NO: 3386260 - protein, 34 aa, Plasmodium falciparum
KKCMLDNSYTKYFFYIFTLDMLPSIKFETFYEKN

SEQ ID NO: 3386261 - protein, 29 aa, Plasmodium falciparum
KKCNQIIKRTLSCIPYILNNNRGAFYKKH

SEQ ID NO: 3386262 - protein, 25 aa, Plasmodium falciparum
KKCVILLGDNIIRILRFKNNLISQR

SEQ ID NO: 3386263 - protein, 22 aa, Plasmodium falciparum
KKDEEFFNHINVLKVRDNDISH

SEQ ID NO: 3386264 - protein, 22 aa, Plasmodium falciparum
KKDEILKSSSFLYFLENSSKIV

SEQ ID NO: 3386265 - protein, 28 aa, Plasmodium falciparum
KKDEKAGRKLLYLIKGLSMVHDKNTEQN

SEQ ID NO: 3386266 - protein, 20 aa, Plasmodium falciparum
KKDGIKNIIFFFKCSNGEEE

SEQ ID NO: 3386267 - protein, 24 aa, Plasmodium falciparum
KKDKFKYIDFKKSLRYNYDFYKNV

SEQ ID NO: 3386268 - protein, 32 aa, Plasmodium falciparum
KKDKKFDKYYVDKIPYPYDKNGYEKTLNININ

SEQ ID NO: 3386269 - protein, 21 aa, Plasmodium falciparum
KKDKKYIRKIYKDMKHIYNEY

SEQ ID NO: 3386270 - protein, 24 aa, Plasmodium falciparum
KKDLCLLMLLFIKCKKKCKTFIYE

SEQ ID NO: 3386271 - protein, 22 aa, Plasmodium falciparum
KKDLKVLILSKLKIFNEEEINV

SEQ ID NO: 3386272 - protein, 25 aa, Plasmodium falciparum
KKDNKDLYEHINFNNIESISNYLNN

SEQ ID NO: 3386273 - protein, 23 aa, Plasmodium falciparum
KKDNYPINTISYNKNFNLDEINK

SEQ ID NO: 3386274 - protein, 24 aa, Plasmodium falciparum
KKDNYPLVKISNGIKKKYILNNKR

SEQ ID NO: 3386275 - protein, 17 aa, Plasmodium falciparum
KKDNYYYKGDTSIYYKM

SEQ ID NO: 3386276 - protein, 27 aa, Plasmodium falciparum
KKDPNNFDFLIEPLSKEKRNSVVVEKR

SEQ ID NO: 3386277 - protein, 24 aa, Plasmodium falciparum
KKDRNKLILLNKKLNLIKIVGLVL

SEQ ID NO: 3386278 - protein, 17 aa, Plasmodium falciparum
KKDTFQLYINEKEYYIC

SEQ ID NO: 3386279 - protein, 22 aa, Plasmodium falciparum
KKDVHLFISPGTLEYLRELKNR

SEQ ID NO: 3386280 - protein, 27 aa, Plasmodium falciparum
KKDVNILLLSLFNYTIIKIIKCINFFP

SEQ ID NO: 3386281 - protein, 22 aa, Plasmodium falciparum
KKEDDMHIYSIPKSNLKKSAIQ

SEQ ID NO: 3386282 - protein, 26 aa, Plasmodium falciparum
KKEEIENFVSLFYKSKDKNKSKKSHA

SEQ ID NO: 3386283 - protein, 26 aa, Plasmodium falciparum
KKEEILKRKLLFEENKKKEYYEEMEE

SEQ ID NO: 3386284 - protein, 25 aa, Plasmodium falciparum
KKEEMIYDIFLVNNFNLDLLINEEV

SEQ ID NO: 3386285 - protein, 24 aa, Plasmodium falciparum
KKEHINEPIYYINNFNTLTNTLNS

SEQ ID NO: 3386286 - protein, 30 aa, Plasmodium falciparum
KKEIDINNMKIIFYLSNLLTKEVQNSEFIK

SEQ ID NO: 3386287 - protein, 30 aa, Plasmodium falciparum
KKEILRWVVILDYGKIFLKKICKLFVVSTN

SEQ ID NO: 3386288 - protein, 22 aa, Plasmodium falciparum
KKEKILYIPQIFNEKDYLKRIS

SEQ ID NO: 3386289 - protein, 30 aa, Plasmodium falciparum
KKEKLFEQKLPNFGGQEIPIWGGIEVPNWE

SEQ ID NO: 3386290 - protein, 30 aa, Plasmodium falciparum
KKEKLQNIIRRTQLLHILDINTYKDHINNT

SEQ ID NO: 3386291 - protein, 29 aa, Plasmodium falciparum
KKEKNLNSFLQKLGFFKNSYPVTVDSLLN

SEQ ID NO: 3386292 - protein, 23 aa, Plasmodium falciparum
KKEKSLLCPLSNNLLELSDLFSN

SEQ ID NO: 3386293 - protein, 23 aa, Plasmodium falciparum
KKELHIFMELYKYKFSDHFNSDI

SEQ ID NO: 3386294 - protein, 28 aa, Plasmodium falciparum
KKELKISLYDFIMLKKKTISTNENHKDN

SEQ ID NO: 3386295 - protein, 25 aa, Plasmodium falciparum
KKELLKMLPLIRKESSCELNNLTHS

SEQ ID NO: 3386296 - protein, 19 aa, Plasmodium falciparum
KKENYIVYKKRKDNKELKN

SEQ ID NO: 3386297 - protein, 26 aa, Plasmodium falciparum
KKEQDFLMYILRIYLHMIEVKNGEEN

SEQ ID NO: 3386298 - protein, 32 aa, Plasmodium falciparum
KKEQKLVINFNLFPFKFIDLLEECILENDNCE

SEQ ID NO: 3386299 - protein, 17 aa, Plasmodium falciparum
KKERILQMNLSNISLDY

SEQ ID NO: 3386300 - protein, 20 aa, Plasmodium falciparum
KKERLCDIISAYRSICLSQY

SEQ ID NO: 3386301 - protein, 17 aa, Plasmodium falciparum
KKESFITNILLNNKYDK

SEQ ID NO: 3386302 - protein, 27 aa, Plasmodium falciparum
KKEVEKFLNYFLLYKNNNPSNILGNFV

SEQ ID NO: 3386303 - protein, 22 aa, Plasmodium falciparum
KKEVFIIKKFDKSIPPNFFLCY

SEQ ID NO: 3386304 - protein, 23 aa, Plasmodium falciparum
KKEWCNYNTLLELEKNKMIKEKE

SEQ ID NO: 3386305 - protein, 21 aa, Plasmodium falciparum
KKEYYEKAIIILNEKIENRVL

SEQ ID NO: 3386306 - protein, 18 aa, Plasmodium falciparum
KKFAFDVYDINKDGMISN

SEQ ID NO: 3386307 - protein, 18 aa, Plasmodium falciparum
KKFAIFKAGWFQTGAKGN

SEQ ID NO: 3386308 - protein, 25 aa, Plasmodium falciparum
KKFDFPFFSIYIVENYFFEKEYKEV

SEQ ID NO: 3386309 - protein, 20 aa, Plasmodium falciparum
KKFFKNFNFCLSRSARTDQG

SEQ ID NO: 3386310 - protein, 19 aa, Plasmodium falciparum
KKFIFVSKVSTLDGTLRPN

SEQ ID NO: 3386311 - protein, 22 aa, Plasmodium falciparum
KKFINMFSKDFYSKGLFQYLNA

SEQ ID NO: 3386312 - protein, 26 aa, Plasmodium falciparum
KKFIRVLKHEFPIKNVILANNKIICS

SEQ ID NO: 3386313 - protein, 29 aa, Plasmodium falciparum
KKFKISEPKFWRCKIHTLAKNKYFDELYN

SEQ ID NO: 3386314 - protein, 20 aa, Plasmodium falciparum
KKFLINNNKLDILLKKKRNH

SEQ ID NO: 3386315 - protein, 58 aa, Plasmodium falciparum
KKFPMVQGVYFDRYQQRWSVNWIEDGKRVAKYFPIKLFGFDYARRLAIYCKIHQKIPE

SEQ ID NO: 3386316 - protein, 21 aa, Plasmodium falciparum
KKFTLLMSYFLIVQDKEITPQ

SEQ ID NO: 3386317 - protein, 34 aa, Plasmodium falciparum
KKFVDMDMHLHYMIKFFLKLHKNFFENPLETDVG

SEQ ID NO: 3386318 - protein, 27 aa, Plasmodium falciparum
KKGIIFYITINYFHLINHLKLSNLEFK

SEQ ID NO: 3386319 - protein, 31 aa, Plasmodium falciparum
KKGINSFMLINFIYILTLTNNKLELAKKLSQ

SEQ ID NO: 3386320 - protein, 24 aa, Plasmodium falciparum
KKGKFQHTYILTPKLNKSKLPERK

SEQ ID NO: 3386321 - protein, 25 aa, Plasmodium falciparum
KKGKKDLLIMLINDLTHGKIKHKKE

SEQ ID NO: 3386322 - protein, 31 aa, Plasmodium falciparum
KKGKSILFFSYDYYMPQKLKFAKELIKLLNK

SEQ ID NO: 3386323 - protein, 21 aa, Plasmodium falciparum
KKGLLITYPIYENKKLKYILD

SEQ ID NO: 3386324 - protein, 26 aa, Plasmodium falciparum
KKGMLLNNAFLVIRKMGDGTFGRVLL

SEQ ID NO: 3386325 - protein, 25 aa, Plasmodium falciparum
KKGSNLFLNKFYSKGSFNSTMSKFN

SEQ ID NO: 3386326 - protein, 27 aa, Plasmodium falciparum
KKGTFVFTRLLFLSSTLDINEDRKSMI

SEQ ID NO: 3386327 - protein, 17 aa, Plasmodium falciparum
KKHELFKKKLNDIYNFL

SEQ ID NO: 3386328 - protein, 27 aa, Plasmodium falciparum
KKHRFQELLKFQNALKYGLNNNSLKNA

SEQ ID NO: 3386329 - protein, 17 aa, Plasmodium falciparum
KKHYRFCIKKLCDKIIP

SEQ ID NO: 3386330 - protein, 25 aa, Plasmodium falciparum
KKIDLFHMNSLNEDYSWVKNLRNYD

SEQ ID NO: 3386331 - protein, 17 aa, Plasmodium falciparum
KKIFILYATFELRQLNV

SEQ ID NO: 3386332 - protein, 29 aa, Plasmodium falciparum
KKIGTKKMKPFVPLEYRESFRNTFYKNEN

SEQ ID NO: 3386333 - protein, 21 aa, Plasmodium falciparum
KKIIHNINWTALINKDKYRND

SEQ ID NO: 3386334 - protein, 39 aa, Plasmodium falciparum
KKIILTCKSFCEYHYWITTIRALMFRSRKLKISRSILFS

SEQ ID NO: 3386335 - protein, 29 aa, Plasmodium falciparum
KKIINMLNQIPFIFSYKKKKIKNLVNTRE

SEQ ID NO: 3386336 - protein, 20 aa, Plasmodium falciparum
KKIKEIITPAGYKLPENLII

SEQ ID NO: 3386337 - protein, 19 aa, Plasmodium falciparum
KKIKTPFFNALKAYAERPI

SEQ ID NO: 3386338 - protein, 34 aa, Plasmodium falciparum
KKIKYSFYKPFSITYFRYFFSHFHFIKHITKDEI

SEQ ID NO: 3386339 - protein, 26 aa, Plasmodium falciparum
KKIKYYYHYDLLRKIGGANFKKGIQV

SEQ ID NO: 3386340 - protein, 24 aa, Plasmodium falciparum
KKILHDIIFLLHKYIDITKDVINN

SEQ ID NO: 3386341 - protein, 26 aa, Plasmodium falciparum
KKILHFQKNFYYNKLRFLELLCNQTN

SEQ ID NO: 3386342 - protein, 29 aa, Plasmodium falciparum
KKILKFEKILLRSYILNAYVFSNEKYKEN

SEQ ID NO: 3386343 - protein, 35 aa, Plasmodium falciparum
KKILNIFSEQNIRLVIVFLIDISFISSNTKLLSAY

SEQ ID NO: 3386344 - protein, 20 aa, Plasmodium falciparum
KKIMSRPFGVALLIGGVDKN

SEQ ID NO: 3386345 - protein, 27 aa, Plasmodium falciparum
KKINAPIDLVLLTKKLKRLPVVNFAAG

SEQ ID NO: 3386346 - protein, 23 aa, Plasmodium falciparum
KKINIAYPYFNNIILLLLEKLEI

SEQ ID NO: 3386347 - protein, 22 aa, Plasmodium falciparum
KKINKLYWAIKDTNPNASIRVI

SEQ ID NO: 3386348 - protein, 34 aa, Plasmodium falciparum
KKINKMIKNLIPLYRYIPLILQKLNTEYLVSVMN

SEQ ID NO: 3386349 - protein, 27 aa, Plasmodium falciparum
KKIQRILQYIPQSLKFLKSYISYRLCE

SEQ ID NO: 3386350 - protein, 23 aa, Plasmodium falciparum
KKISDYKCNLLYTSLDRIHKNVS

SEQ ID NO: 3386351 - protein, 29 aa, Plasmodium falciparum
KKISLFPPNIYVKDIIPLGIYNVKIVWSD

SEQ ID NO: 3386352 - protein, 26 aa, Plasmodium falciparum
KKISYDIFYHLVLTKQIQGTTNLLRS

SEQ ID NO: 3386353 - protein, 27 aa, Plasmodium falciparum
KKITSFSPVLLLNYVNKKYSFIKIIKK

SEQ ID NO: 3386354 - protein, 27 aa, Plasmodium falciparum
KKIVDIINDYKIVFKTLQKYAEKEKNI

SEQ ID NO: 3386355 - protein, 22 aa, Plasmodium falciparum
KKIYEYTYVFIPVNIENTHWSL

SEQ ID NO: 3386356 - protein, 20 aa, Plasmodium falciparum
KKIYIYGYDIYNVRNNIVKF

SEQ ID NO: 3386357 - protein, 31 aa, Plasmodium falciparum
KKKAPHYYKFNYKVCLYLNVFKEKYLTSELN

SEQ ID NO: 3386358 - protein, 20 aa, Plasmodium falciparum
KKKCFYVLLSSNDIHRYYPL

SEQ ID NO: 3386359 - protein, 18 aa, Plasmodium falciparum
KKKCLITNYIPLFHTHIL

SEQ ID NO: 3386360 - protein, 32 aa, Plasmodium falciparum
KKKDHYYVDKYHYINKYYPEKYSRKFNYNHSS

SEQ ID NO: 3386361 - protein, 30 aa, Plasmodium falciparum
KKKDLFNNQKFFIKNMYLNQNVLQSQLRNQ

SEQ ID NO: 3386362 - protein, 25 aa, Plasmodium falciparum
KKKDLLYEYENLKNRLKNITLVCNE

SEQ ID NO: 3386363 - protein, 23 aa, Plasmodium falciparum
KKKEIIYTHLFLPTRLREKINKS

SEQ ID NO: 3386364 - protein, 30 aa, Plasmodium falciparum
KKKEKTKFKKIIRYLIQNYKIKNINQANHH

SEQ ID NO: 3386365 - protein, 17 aa, Plasmodium falciparum
KKKERIIKNDKDLLKEL

SEQ ID NO: 3386366 - protein, 55 aa, Plasmodium falciparum
KKKFCRIKTFYCLKRKFLYNVDIKFLIKEKHFLKYLYLCTLKKKIQAHYNKQKRK

SEQ ID NO: 3386367 - protein, 22 aa, Plasmodium falciparum
KKKFQNIFYANCPEENYLNMKL

SEQ ID NO: 3386368 - protein, 37 aa, Plasmodium falciparum
KKKFTIKCDIWSAGVIMFFLFTKSLPFGGNTYDEVKQ

SEQ ID NO: 3386369 - protein, 17 aa, Plasmodium falciparum
KKKHIHIGLIGYPNVGK

SEQ ID NO: 3386370 - protein, 17 aa, Plasmodium falciparum
KKKIAPGMLFNFKIEFY

SEQ ID NO: 3386371 - protein, 23 aa, Plasmodium falciparum
KKKIEFMSIVDYYGGLKNNEYEF

SEQ ID NO: 3386372 - protein, 21 aa, Plasmodium falciparum
KKKIGFCSYCPRLDGFLNCFE

SEQ ID NO: 3386373 - protein, 28 aa, Plasmodium falciparum
KKKIKQSFAIKYLNLFSKSNILADVVVL

SEQ ID NO: 3386374 - protein, 17 aa, Plasmodium falciparum
KKKIKSKSYRKYLRIKE

SEQ ID NO: 3386375 - protein, 20 aa, Plasmodium falciparum
KKKILYTGKASCACKMKCYF

SEQ ID NO: 3386376 - protein, 21 aa, Plasmodium falciparum
KKKIQPMLFYQHNINSNIKQI

SEQ ID NO: 3386377 - protein, 25 aa, Plasmodium falciparum
KKKKAHLFACTYLNRKEPFPKRHID

SEQ ID NO: 3386378 - protein, 24 aa, Plasmodium falciparum
KKKKDILEKPVWKSLYDIEETVKD

SEQ ID NO: 3386379 - protein, 22 aa, Plasmodium falciparum
KKKKEMINLYSNKSNILENIKN

SEQ ID NO: 3386380 - protein, 23 aa, Plasmodium falciparum
KKKKESFLKWTPHKNIKRSYNKK

SEQ ID NO: 3386381 - protein, 24 aa, Plasmodium falciparum
KKKKEYFFNLYESNYNPFHSKDKV

SEQ ID NO: 3386382 - protein, 22 aa, Plasmodium falciparum
KKKKGNILKTYKVKLLQNNQHY

SEQ ID NO: 3386383 - protein, 31 aa, Plasmodium falciparum
KKKKHSSIYTLWIDYLISNNIDIQEFSKLRN

SEQ ID NO: 3386384 - protein, 23 aa, Plasmodium falciparum
KKKKICCVCLETKKLRDECIVKL

SEQ ID NO: 3386385 - protein, 23 aa, Plasmodium falciparum
KKKKIFNNNDYIFKMGPSETSKK

SEQ ID NO: 3386386 - protein, 23 aa, Plasmodium falciparum
KKKKIINYLCSYGNKKLNDPPDK

SEQ ID NO: 3386387 - protein, 23 aa, Plasmodium falciparum
KKKKIKLHLYSLSKNYIQIEDVQ

SEQ ID NO: 3386388 - protein, 19 aa, Plasmodium falciparum
KKKKILMYDLKITSEWKAY

SEQ ID NO: 3386389 - protein, 18 aa, Plasmodium falciparum
KKKKILRSFARLVNHSKK

SEQ ID NO: 3386390 - protein, 31 aa, Plasmodium falciparum
KKKKIQKDCFLFWLIMVKNKKEARNKIIKSF

SEQ ID NO: 3386391 - protein, 26 aa, Plasmodium falciparum
KKKKISLSKFLIKKHIIKLRKMEKLK

SEQ ID NO: 3386392 - protein, 45 aa, Plasmodium falciparum
KKKKKILKELDKCNSHFFFTYFHKGELIEYLHNQINMHIVEFDKI

SEQ ID NO: 3386393 - protein, 27 aa, Plasmodium falciparum
KKKKKKKFFFCSTFLYDNIKSNMFPNK

SEQ ID NO: 3386394 - protein, 25 aa, Plasmodium falciparum
KKKKKKLILPGHIKIKKLSACECVL

SEQ ID NO: 3386395 - protein, 29 aa, Plasmodium falciparum
KKKKKKYISYIPLHNYKILFLCLQEIFND

SEQ ID NO: 3386396 - protein, 27 aa, Plasmodium falciparum
KKKKKLIHHILFQLWMCEVDLGNIDDI

SEQ ID NO: 3386397 - protein, 32 aa, Plasmodium falciparum
KKKKKLPLFVTPKFIYDCILNYSISYPSKNKN

SEQ ID NO: 3386398 - protein, 34 aa, Plasmodium falciparum
KKKKKMNLLTRNNLKIKWILLNLNLKNDDEALIK

SEQ ID NO: 3386399 - protein, 23 aa, Plasmodium falciparum
KKKKKNFFNYHPINEANIYNING

SEQ ID NO: 3386400 - protein, 25 aa, Plasmodium falciparum
KKKKLLIHPIHLLNYVYNYNRLFCC

SEQ ID NO: 3386401 - protein, 46 aa, Plasmodium falciparum
KKKKMHFYKYSHSLYMKYNIKKMIYFIPKRIVLTTVAICIYGVHFL

SEQ ID NO: 3386402 - protein, 22 aa, Plasmodium falciparum
KKKKNIYIYFNKQGKHGHIKKE

SEQ ID NO: 3386403 - protein, 26 aa, Plasmodium falciparum
KKKKNSFFACSPLKDINLNRQKSLPP

SEQ ID NO: 3386404 - protein, 28 aa, Plasmodium falciparum
KKKKQQYFHILPFTDFYMNIEISYQIKC

SEQ ID NO: 3386405 - protein, 30 aa, Plasmodium falciparum
KKKKTLTNSLYLILYTKLRNLFGPNCGWAQ

SEQ ID NO: 3386406 - protein, 37 aa, Plasmodium falciparum
KKKLGKTMIFFCTKYHILFFSNILKHFKIHHSILYGN

SEQ ID NO: 3386407 - protein, 23 aa, Plasmodium falciparum
KKKLHLFLLSNKKRYYMSHREIE

SEQ ID NO: 3386408 - protein, 27 aa, Plasmodium falciparum
KKKLIKNGMLPCSFLLKKKNKVQPKNN

SEQ ID NO: 3386409 - protein, 32 aa, Plasmodium falciparum
KKKLKGLVVMPHEMYNLYKGKGKNLPKQWEYE

SEQ ID NO: 3386410 - protein, 21 aa, Plasmodium falciparum
KKKLYAYHTFNGSEQTRRKGY

SEQ ID NO: 3386411 - protein, 30 aa, Plasmodium falciparum
KKKMKISIRFKKPKTLIYARNPKCPRIVKS

SEQ ID NO: 3386412 - protein, 26 aa, Plasmodium falciparum
KKKNFENLLLEYTMSNNVLNTENNNA

SEQ ID NO: 3386413 - protein, 25 aa, Plasmodium falciparum
KKKNIFIDLINDPLEDIKVKHFALL

SEQ ID NO: 3386414 - protein, 35 aa, Plasmodium falciparum
KKKNINIDISKPRKLLFIIEMDGINIYIKDVLMNI

SEQ ID NO: 3386415 - protein, 19 aa, Plasmodium falciparum
KKKNMNDLFLGKHDNMLRT

SEQ ID NO: 3386416 - protein, 33 aa, Plasmodium falciparum
KKKNNMVHLLEIILKKLLLSPNYINGVVFFFKK

SEQ ID NO: 3386417 - protein, 24 aa, Plasmodium falciparum
KKKNRFYFFCKMNENKNVKNKKNI

SEQ ID NO: 3386418 - protein, 24 aa, Plasmodium falciparum
KKKNSFFITYSYWKYMSKKEKQND

SEQ ID NO: 3386419 - protein, 23 aa, Plasmodium falciparum
KKKNVLFFNPKIIKCGKYHSGAV

SEQ ID NO: 3386420 - protein, 18 aa, Plasmodium falciparum
KKKPIGSFPLNKITSIRT

SEQ ID NO: 3386421 - protein, 25 aa, Plasmodium falciparum
KKKQFFIKISLLLKKIAYEHNFFVF

SEQ ID NO: 3386422 - protein, 24 aa, Plasmodium falciparum
KKKRDFFFDVSFSFEGMKNNLIKR

SEQ ID NO: 3386423 - protein, 30 aa, Plasmodium falciparum
KKKRKENLMIYKKCFFFINAIDEYCNMCNI

SEQ ID NO: 3386424 - protein, 19 aa, Plasmodium falciparum
KKKRKEQYAYLIRNDDESS

SEQ ID NO: 3386425 - protein, 25 aa, Plasmodium falciparum
KKKSKWKSLFSSKKTKKKNLSDNFG

SEQ ID NO: 3386426 - protein, 24 aa, Plasmodium falciparum
KKKSLENKILLSKKLKEIKLQFKD

SEQ ID NO: 3386427 - protein, 31 aa, Plasmodium falciparum
KKKSTTFLHTKLPSKLLVLCENCKLPCHANY

SEQ ID NO: 3386428 - protein, 18 aa, Plasmodium falciparum
KKKTILTDILLSSTFVTF

SEQ ID NO: 3386429 - protein, 30 aa, Plasmodium falciparum
KKKTLLLSGWSFTFKCETQHLTNVCFQLIN

SEQ ID NO: 3386430 - protein, 24 aa, Plasmodium falciparum
KKKTYIVHGMEIPEQIFNMYNTSK

SEQ ID NO: 3386431 - protein, 17 aa, Plasmodium falciparum
KKKWKVHYILNKTKKKI

SEQ ID NO: 3386432 - protein, 19 aa, Plasmodium falciparum
KKKYFYHINKNINSLWKVY

SEQ ID NO: 3386433 - protein, 19 aa, Plasmodium falciparum
KKKYIFCNKNRLISNVGNK

SEQ ID NO: 3386434 - protein, 23 aa, Plasmodium falciparum
KKKYIRIFSYGYSKFKFIGKHQI

SEQ ID NO: 3386435 - protein, 26 aa, Plasmodium falciparum
KKKYKNFYIHIVNLNTLFGIYFNETE

SEQ ID NO: 3386436 - protein, 26 aa, Plasmodium falciparum
KKLCLVLDLDNTLLHASFSLLSVNVN

SEQ ID NO: 3386437 - protein, 21 aa, Plasmodium falciparum
KKLEDFVKHKKNIKENVLGKE

SEQ ID NO: 3386438 - protein, 20 aa, Plasmodium falciparum
KKLFCIILQNHTKYEHIFVI

SEQ ID NO: 3386439 - protein, 20 aa, Plasmodium falciparum
KKLFFELYMKEKDSEINIGV

SEQ ID NO: 3386440 - protein, 25 aa, Plasmodium falciparum
KKLGFQCIYCRDRQLFKKKSSVLYH

SEQ ID NO: 3386441 - protein, 30 aa, Plasmodium falciparum
KKLIHKYLKRIKIFWSFCFFKNLEYCLRQA

SEQ ID NO: 3386442 - protein, 33 aa, Plasmodium falciparum
KKLITSGLLHYSTYKVIKYFLNVLKGEPYHLDI

SEQ ID NO: 3386443 - protein, 36 aa, Plasmodium falciparum
KKLKEKEKIIWFNELKTYLLKNTLALLAAEKIVSYI

SEQ ID NO: 3386444 - protein, 34 aa, Plasmodium falciparum
KKLKKLFKEIKNNKLCKYILAKIKEIKYNKTYME

SEQ ID NO: 3386445 - protein, 26 aa, Plasmodium falciparum
KKLKKWSCIYKINKIVRKGAHGVVFS

SEQ ID NO: 3386446 - protein, 26 aa, Plasmodium falciparum
KKLKSYMFNGGRYAFAAKLKEEIKHF

SEQ ID NO: 3386447 - protein, 26 aa, Plasmodium falciparum
KKLKYAFDDIYLNNIFFSFFTSFKLM

SEQ ID NO: 3386448 - protein, 25 aa, Plasmodium falciparum
KKLKYKTFWTYLKQQKDDKKEMLNY

SEQ ID NO: 3386449 - protein, 19 aa, Plasmodium falciparum
KKLLCVLAMGEWIDYSHPI

SEQ ID NO: 3386450 - protein, 20 aa, Plasmodium falciparum
KKLMKLILNVKKEDSDAVQK

SEQ ID NO: 3386451 - protein, 24 aa, Plasmodium falciparum
KKLMNIRMMYPFTLKCNKCKTFTY

SEQ ID NO: 3386452 - protein, 24 aa, Plasmodium falciparum
KKLNCFDFILGNEILYRKENYYHI

SEQ ID NO: 3386453 - protein, 19 aa, Plasmodium falciparum
KKLNKSNFIFLIKQIEKCI

SEQ ID NO: 3386454 - protein, 23 aa, Plasmodium falciparum
KKLNQYIVTFISSSSRDEFVNKI

SEQ ID NO: 3386455 - protein, 24 aa, Plasmodium falciparum
KKLQKYMNELWGFSSSENEEEKKY

SEQ ID NO: 3386456 - protein, 18 aa, Plasmodium falciparum
KKLQLLENKIYSYITTLT

SEQ ID NO: 3386457 - protein, 22 aa, Plasmodium falciparum
KKLRKRYIILTKNFICSFKSEY

SEQ ID NO: 3386458 - protein, 22 aa, Plasmodium falciparum
KKLTVYIPCPVLLNFVCTEQKA

SEQ ID NO: 3386459 - protein, 35 aa, Plasmodium falciparum
KKLVKKCIKKYKKLLKLIKKVILLSVENGNQVNEE

SEQ ID NO: 3386460 - protein, 28 aa, Plasmodium falciparum
KKMANLEIFRYFPTPVKYRNYEAKILYS

SEQ ID NO: 3386461 - protein, 30 aa, Plasmodium falciparum
KKMCFKKKYVCLECNKIYLHLNGYNKHINK

SEQ ID NO: 3386462 - protein, 28 aa, Plasmodium falciparum
KKMEDFTELLFFPYTIKGMDISFSGYDF

SEQ ID NO: 3386463 - protein, 31 aa, Plasmodium falciparum
KKMFHNFLDAFYHFISIRIYNLFSVSNVFHE

SEQ ID NO: 3386464 - protein, 26 aa, Plasmodium falciparum
KKMGEIFFEYFDTLNLNLSVSGLMSL

SEQ ID NO: 3386465 - protein, 24 aa, Plasmodium falciparum
KKMIFFRQDILNDLIWSSSINATD

SEQ ID NO: 3386466 - protein, 22 aa, Plasmodium falciparum
KKMNFKVLFLYKQLIPEKKEDK

SEQ ID NO: 3386467 - protein, 19 aa, Plasmodium falciparum
KKMNIIYEKTIYDDNLNKK

SEQ ID NO: 3386468 - protein, 19 aa, Plasmodium falciparum
KKMNLLKKVLVDRDKKKAN

SEQ ID NO: 3386469 - protein, 40 aa, Plasmodium falciparum
KKMNSFIRDNFFLPQPIYPPYHLFDFFSSILRIGQTNLFI

SEQ ID NO: 3386470 - protein, 21 aa, Plasmodium falciparum
KKMNTFKLNIPSSIINKFNKS

SEQ ID NO: 3386471 - protein, 28 aa, Plasmodium falciparum
KKNCKIIKRLLWGELFEEKKKRIRKVSP

SEQ ID NO: 3386472 - protein, 25 aa, Plasmodium falciparum
KKNDDHTFLLSNKKIYDTYKERKSD

SEQ ID NO: 3386473 - protein, 24 aa, Plasmodium falciparum
KKNDIYFQYIIIFDINSIDHPIVC

SEQ ID NO: 3386474 - protein, 27 aa, Plasmodium falciparum
KKNDSEYLYFQNMIRNITKYNNEENDM

SEQ ID NO: 3386475 - protein, 26 aa, Plasmodium falciparum
KKNDTLCIICLQNEKKYTFTCCYEYY

SEQ ID NO: 3386476 - protein, 18 aa, Plasmodium falciparum
KKNEGSTIFFSLNGQIKK

SEQ ID NO: 3386477 - protein, 20 aa, Plasmodium falciparum
KKNEQFIPMTLKNLINVIQQ

SEQ ID NO: 3386478 - protein, 26 aa, Plasmodium falciparum
KKNFALIKNFIYPFKNKNNLYNNYKI

SEQ ID NO: 3386479 - protein, 20 aa, Plasmodium falciparum
KKNHIYCRCLKISIISSQHN

SEQ ID NO: 3386480 - protein, 20 aa, Plasmodium falciparum
KKNIDMVYKIKEYEIQIKEK

SEQ ID NO: 3386481 - protein, 23 aa, Plasmodium falciparum
KKNIEPLIIIYKPNYDPFEYIYK

SEQ ID NO: 3386482 - protein, 27 aa, Plasmodium falciparum
KKNIIIYLEKKRENWWPCVIKGDTEID

SEQ ID NO: 3386483 - protein, 20 aa, Plasmodium falciparum
KKNILFLHPYNYCKLDDNFD

SEQ ID NO: 3386484 - protein, 31 aa, Plasmodium falciparum
KKNIQIQKLLKQYIILKGYYKNVCKKYRQEN

SEQ ID NO: 3386485 - protein, 25 aa, Plasmodium falciparum
KKNKIVYLLFNFKIKKSLSYNIRLD

SEQ ID NO: 3386486 - protein, 27 aa, Plasmodium falciparum
KKNKKIIDTFYRYLNKEEKKYSSDKYS

SEQ ID NO: 3386487 - protein, 23 aa, Plasmodium falciparum
KKNKKVIFLHRRGSHLPFEYHLK

SEQ ID NO: 3386488 - protein, 18 aa, Plasmodium falciparum
KKNKKYPFSNKKINFKYF

SEQ ID NO: 3386489 - protein, 28 aa, Plasmodium falciparum
KKNKNHIISPHKITLKYKTMPIPFDHNI

SEQ ID NO: 3386490 - protein, 31 aa, Plasmodium falciparum
KKNKNTTSLFKRFKIFGKTKNAPKGEVSDLK

SEQ ID NO: 3386491 - protein, 28 aa, Plasmodium falciparum
KKNLFSLVVLDFLWKIYDITIINRDDEQ

SEQ ID NO: 3386492 - protein, 33 aa, Plasmodium falciparum
KKNLLYKLIGNIDSYFLLYTKFKVDAEAYKDLK

SEQ ID NO: 3386493 - protein, 26 aa, Plasmodium falciparum
KKNLRDVIFKIFAVINSKRFNGDMIG

SEQ ID NO: 3386494 - protein, 23 aa, Plasmodium falciparum
KKNLTNILPFEKIVEQCDINNVI

SEQ ID NO: 3386495 - protein, 22 aa, Plasmodium falciparum
KKNLTYINDLKKIFFKENAVKN

SEQ ID NO: 3386496 - protein, 39 aa, Plasmodium falciparum
KKNNNKILIDNILHNLIILFYEFYYYNQMDNFKIDLDFY

SEQ ID NO: 3386497 - protein, 43 aa, Plasmodium falciparum
KKNNTICSNCLYAYKIQICKRVEMFNFFGGKNDGLDKDALKEG

SEQ ID NO: 3386498 - protein, 18 aa, Plasmodium falciparum
KKNNYSIMAILGSQIKNL

SEQ ID NO: 3386499 - protein, 26 aa, Plasmodium falciparum
KKNQNNFYFIFYDGSNIHISPLNQIK

SEQ ID NO: 3386500 - protein, 27 aa, Plasmodium falciparum
KKNTKNDPLLLYLQTNFMKKEEENLLT

SEQ ID NO: 3386501 - protein, 25 aa, Plasmodium falciparum
KKNTNIYLFNLYFDENMKTLLYIIP

SEQ ID NO: 3386502 - protein, 24 aa, Plasmodium falciparum
KKNTYIKELYKRSGDYDNFSIHTD

SEQ ID NO: 3386503 - protein, 25 aa, Plasmodium falciparum
KKNVCIIIPDIYRPIGKYKIKTYVK

SEQ ID NO: 3386504 - protein, 25 aa, Plasmodium falciparum
KKNVNCNYELINKNLLKVAANNINN

SEQ ID NO: 3386505 - protein, 24 aa, Plasmodium falciparum
KKNVVVLHDQLDKLQLLFDNNQKK

SEQ ID NO: 3386506 - protein, 20 aa, Plasmodium falciparum
KKNYFVARSIFNIRNVNGKF

SEQ ID NO: 3386507 - protein, 17 aa, Plasmodium falciparum
KKNYMYNINNMNYMPNV

SEQ ID NO: 3386508 - protein, 25 aa, Plasmodium falciparum
KKPNLMTYGYFYKKFIMRSKKKNWL

SEQ ID NO: 3386509 - protein, 22 aa, Plasmodium falciparum
KKQCFINSSFNASLNFDKLKKG

SEQ ID NO: 3386510 - protein, 19 aa, Plasmodium falciparum
KKQEALEKKLRLIQSEQTD

SEQ ID NO: 3386511 - protein, 26 aa, Plasmodium falciparum
KKQENCSYIILAGLYTVSNDNKKECR

SEQ ID NO: 3386512 - protein, 24 aa, Plasmodium falciparum
KKQFKIKFIPLKNKSELKFYISNN

SEQ ID NO: 3386513 - protein, 22 aa, Plasmodium falciparum
KKQIDYIIHLKYYKNEYDNVTN

SEQ ID NO: 3386514 - protein, 42 aa, Plasmodium falciparum
KKQKIIKKKILISLKKRGAIFILTPIILLNKYYINLENTYME

SEQ ID NO: 3386515 - protein, 30 aa, Plasmodium falciparum
KKQKKMIWNSLNVLPIDILLKNGHDEINKE

SEQ ID NO: 3386516 - protein, 25 aa, Plasmodium falciparum
KKQRGLFSFVPLLAKIAEHLKTHHI

SEQ ID NO: 3386517 - protein, 27 aa, Plasmodium falciparum
KKQRKKKIWKTPFGNKSIYKNARERVQ

SEQ ID NO: 3386518 - protein, 23 aa, Plasmodium falciparum
KKRAERFGLLQDSEKLKARALRF

SEQ ID NO: 3386519 - protein, 23 aa, Plasmodium falciparum
KKRDMEMYILLEENKKQKEKAAK

SEQ ID NO: 3386520 - protein, 29 aa, Plasmodium falciparum
KKRESFFKKINILQKYKNYKIRKAASTFH

SEQ ID NO: 3386521 - protein, 24 aa, Plasmodium falciparum
KKRGNIFESLNSFIYNFKNNNNIN

SEQ ID NO: 3386522 - protein, 22 aa, Plasmodium falciparum
KKRKFKIIHLLYNVWKEYKHKK

SEQ ID NO: 3386523 - protein, 19 aa, Plasmodium falciparum
KKRKFTAFSIFAREKRKEY

SEQ ID NO: 3386524 - protein, 18 aa, Plasmodium falciparum
KKRKIKRPFPNDKKKELS

SEQ ID NO: 3386525 - protein, 24 aa, Plasmodium falciparum
KKRKKKIIINVRKKSQRASLSTSQ

SEQ ID NO: 3386526 - protein, 22 aa, Plasmodium falciparum
KKRKRIDFIIKYFINAAKEINN

SEQ ID NO: 3386527 - protein, 43 aa, Plasmodium falciparum
KKRKRNITYPYFMFYQINNFLINPNPFHNSFFLNEMNYCSIMH

SEQ ID NO: 3386528 - protein, 29 aa, Plasmodium falciparum
KKRKSYPSISHSPLSSIPSLYTYSNSNSE

SEQ ID NO: 3386529 - protein, 20 aa, Plasmodium falciparum
KKRLPKGSKRYVPTQEEVER

SEQ ID NO: 3386530 - protein, 38 aa, Plasmodium falciparum
KKRRRSSYYIYCRTKKYSFPRIVNVFSSVVRMCQKKEE

SEQ ID NO: 3386531 - protein, 22 aa, Plasmodium falciparum
KKRSYLSNIFFKLSYDTIENLM

SEQ ID NO: 3386532 - protein, 18 aa, Plasmodium falciparum
KKSFSLYDIKTYEYKKNI

SEQ ID NO: 3386533 - protein, 24 aa, Plasmodium falciparum
KKSHFFYTLFINQGIHFFNNITIY

SEQ ID NO: 3386534 - protein, 24 aa, Plasmodium falciparum
KKSHIHIRYKYDVFNYCLKNIKRN

SEQ ID NO: 3386535 - protein, 34 aa, Plasmodium falciparum
KKSIFDNIKIPFPLLSRFDLVFLLADNISEEKDY

SEQ ID NO: 3386536 - protein, 23 aa, Plasmodium falciparum
KKSINYKAYYKYSLYYDIQMNIS

SEQ ID NO: 3386537 - protein, 24 aa, Plasmodium falciparum
KKSKRLRWFRLKRKKKKDYVNEES

SEQ ID NO: 3386538 - protein, 25 aa, Plasmodium falciparum
KKSKYMEALINSAKRRELEKEFLIQ

SEQ ID NO: 3386539 - protein, 24 aa, Plasmodium falciparum
KKSLDFIQSYWYWKIRSESNLLNY

SEQ ID NO: 3386540 - protein, 21 aa, Plasmodium falciparum
KKSLENFFNIVLKNLYSSINF

SEQ ID NO: 3386541 - protein, 18 aa, Plasmodium falciparum
KKSLPYEKALSSTISQIN

SEQ ID NO: 3386542 - protein, 33 aa, Plasmodium falciparum
KKSPYTRFTEIFTDKLKNFTLGNRKSFRSSTVH

SEQ ID NO: 3386543 - protein, 32 aa, Plasmodium falciparum
KKSQVLFSVQPYYIYLYTKKEALLFTRFYKSM

SEQ ID NO: 3386544 - protein, 24 aa, Plasmodium falciparum
KKSRKYINLMKKVQIYHLNMIDNI

SEQ ID NO: 3386545 - protein, 23 aa, Plasmodium falciparum
KKTDMLNLIQELLSYCECLKRNR

SEQ ID NO: 3386546 - protein, 26 aa, Plasmodium falciparum
KKTDMYNWYIIQINKDVYIDSGKKGS

SEQ ID NO: 3386547 - protein, 23 aa, Plasmodium falciparum
KKTDVYWRLAFARRNINVLENVT

SEQ ID NO: 3386548 - protein, 21 aa, Plasmodium falciparum
KKTEYLLEQIKIPSWDRNNIP

SEQ ID NO: 3386549 - protein, 23 aa, Plasmodium falciparum
KKTFHRILAVYFGHERWDLVMNM

SEQ ID NO: 3386550 - protein, 36 aa, Plasmodium falciparum
KKTIDSILNMLTPWEQKILALLYEQQKMRQDVQKIK

SEQ ID NO: 3386551 - protein, 23 aa, Plasmodium falciparum
KKTIELRLPIPITKYMKKMEISK

SEQ ID NO: 3386552 - protein, 37 aa, Plasmodium falciparum
KKTKKILIDPHYHCPLCVNMYFYHYNMLTEHCSNFHK

SEQ ID NO: 3386553 - protein, 30 aa, Plasmodium falciparum
KKTKKKTFLVNQAVFFTPKKSVLNSSNEKK

SEQ ID NO: 3386554 - protein, 26 aa, Plasmodium falciparum
KKTNIEYILPLYLINNGDNIGSSAVI

SEQ ID NO: 3386555 - protein, 20 aa, Plasmodium falciparum
KKTNIFKKYYLFHNKKNNQE

SEQ ID NO: 3386556 - protein, 27 aa, Plasmodium falciparum
KKTPEAYLLNNYYLMFQQKLENQQSYT

SEQ ID NO: 3386557 - protein, 33 aa, Plasmodium falciparum
KKTTPCCTFGYYYFETFLFRNNKMIPKLKKKDC

SEQ ID NO: 3386558 - protein, 35 aa, Plasmodium falciparum
KKTVEDLFYIYKSFGFIYSIIKKANLLLSKENFDT

SEQ ID NO: 3386559 - protein, 20 aa, Plasmodium falciparum
KKVCKLCWKFLTVAIVLLDT

SEQ ID NO: 3386560 - protein, 24 aa, Plasmodium falciparum
KKVCLYKPIILLKSGKTAKAAEAA

SEQ ID NO: 3386561 - protein, 27 aa, Plasmodium falciparum
KKVEKMKWTILSERKIDKLVDIMKGEE

SEQ ID NO: 3386562 - protein, 19 aa, Plasmodium falciparum
KKVFLLIKKMKHIKKKLLK

SEQ ID NO: 3386563 - protein, 21 aa, Plasmodium falciparum
KKVLKKFLKLYRSQNKNFLPK

SEQ ID NO: 3386564 - protein, 28 aa, Plasmodium falciparum
KKVNKILKLIHILFGRKYHCFESLYNFE

SEQ ID NO: 3386565 - protein, 29 aa, Plasmodium falciparum
KKVNKNITYIRLHLEKFALKNKETIDKIE

SEQ ID NO: 3386566 - protein, 22 aa, Plasmodium falciparum
KKVPQIYWMLNHINNMFNEIKN

SEQ ID NO: 3386567 - protein, 25 aa, Plasmodium falciparum
KKVQHIFFQFVLKTLQRNNKNRLTH

SEQ ID NO: 3386568 - protein, 22 aa, Plasmodium falciparum
KKVSWAFGLIDKNFYFTDFIDE

SEQ ID NO: 3386569 - protein, 23 aa, Plasmodium falciparum
KKVWKKLIEYFLNMTKSNMNNNL

SEQ ID NO: 3386570 - protein, 34 aa, Plasmodium falciparum
KKVYVHLESPLDILVCAGLISSKKLIEAQAILKE

SEQ ID NO: 3386571 - protein, 20 aa, Plasmodium falciparum
KKWHSNFNYEEIVFPSVTLE

SEQ ID NO: 3386572 - protein, 26 aa, Plasmodium falciparum
KKYEDAYYILFSFPSTLNNESVKRIL

SEQ ID NO: 3386573 - protein, 27 aa, Plasmodium falciparum
KKYEEKSFILFRFFNNNKAYETTTKII

SEQ ID NO: 3386574 - protein, 21 aa, Plasmodium falciparum
KKYIHQIAYHESTKPDYINMN

SEQ ID NO: 3386575 - protein, 24 aa, Plasmodium falciparum
KKYIRKSDFLLALDTYPFGMGIVV

SEQ ID NO: 3386576 - protein, 19 aa, Plasmodium falciparum
KKYIYLYNKYDNATLDLNV

SEQ ID NO: 3386577 - protein, 17 aa, Plasmodium falciparum
KKYIYNCINYAYDLGSK

SEQ ID NO: 3386578 - protein, 32 aa, Plasmodium falciparum
KKYKNIPIIKRYNSMYLPYYTTNTDILYCNKQ

SEQ ID NO: 3386579 - protein, 30 aa, Plasmodium falciparum
KKYNKKILRNILNNVWLKTDMFIKESIYYG

SEQ ID NO: 3386580 - protein, 25 aa, Plasmodium falciparum
KKYQKLDIRTLNKNVQKNKEICTNC

SEQ ID NO: 3386581 - protein, 20 aa, Plasmodium falciparum
KKYSTILIKNYFQLHGPDSV

SEQ ID NO: 3386582 - protein, 25 aa, Plasmodium falciparum
KKYTYGLSHLWPVRDPRPVLEKVTG

SEQ ID NO: 3386583 - protein, 18 aa, Plasmodium falciparum
KKYWNSILSAQKYHFCNK

SEQ ID NO: 3386584 - protein, 19 aa, Plasmodium falciparum
KKYYLLKNETSPLERHNKD

SEQ ID NO: 3386585 - protein, 28 aa, Plasmodium falciparum
KLAFEEPFQLLFLMGFTIYATEGTYDFY

SEQ ID NO: 3386586 - protein, 17 aa, Plasmodium falciparum
KLAFLKTDEQFLKVSKF

SEQ ID NO: 3386587 - protein, 21 aa, Plasmodium falciparum
KLAIILATHDFFLVSKLCNRI

SEQ ID NO: 3386588 - protein, 25 aa, Plasmodium falciparum
KLASDNMLYFYQLNNFWADIGKPLD

SEQ ID NO: 3386589 - protein, 17 aa, Plasmodium falciparum
KLAYNLKLIGVSVAGII

SEQ ID NO: 3386590 - protein, 28 aa, Plasmodium falciparum
KLCAKGKWILKILQLYETSLVRHGFMLV

SEQ ID NO: 3386591 - protein, 19 aa, Plasmodium falciparum
KLCHALLHNYFDDIRNLKV

SEQ ID NO: 3386592 - protein, 31 aa, Plasmodium falciparum
KLCSESEAFFYAWLYLSCLKKINISRTKNNY

SEQ ID NO: 3386593 - protein, 29 aa, Plasmodium falciparum
KLCSVNKKKKYLWFYKNGNMNKRSILNFI

SEQ ID NO: 3386594 - protein, 19 aa, Plasmodium falciparum
KLCVMWELDLSYNYFKEIS

SEQ ID NO: 3386595 - protein, 22 aa, Plasmodium falciparum
KLDCLSKSFSKIRKINLCNSAY

SEQ ID NO: 3386596 - protein, 26 aa, Plasmodium falciparum
KLDERKYIFPFYQVYTYLKNQQHIFE

SEQ ID NO: 3386597 - protein, 21 aa, Plasmodium falciparum
KLDIKMKLFSICSNLMRKDNS

SEQ ID NO: 3386598 - protein, 25 aa, Plasmodium falciparum
KLDKVFDLVVLPKSEKERNLIDKII

SEQ ID NO: 3386599 - protein, 24 aa, Plasmodium falciparum
KLDSYNLKDFFIDNNNYNMKEEKY

SEQ ID NO: 3386600 - protein, 29 aa, Plasmodium falciparum
KLDVPSLVEICKQQLIVILKDMCSDCSTT

SEQ ID NO: 3386601 - protein, 28 aa, Plasmodium falciparum
KLDYLSIIFNFYSWYKRHFKGTLLINEN

SEQ ID NO: 3386602 - protein, 25 aa, Plasmodium falciparum
KLDYVQFVLYVNSSGQIFCMPLNLN

SEQ ID NO: 3386603 - protein, 24 aa, Plasmodium falciparum
KLEADLEWKIFYISAVNNEGESNQ

SEQ ID NO: 3386604 - protein, 39 aa, Plasmodium falciparum
KLECIEKILFFYFNVYKQRIFFLKLKSSTLIIQKNYRTY

SEQ ID NO: 3386605 - protein, 21 aa, Plasmodium falciparum
KLEEILYSIEKVHIKDKIILD

SEQ ID NO: 3386606 - protein, 28 aa, Plasmodium falciparum
KLEFEKVYCPYLLLNKKRYAGLLYTNPN

SEQ ID NO: 3386607 - protein, 20 aa, Plasmodium falciparum
KLEGKLYDYVVLTKNLKEKI

SEQ ID NO: 3386608 - protein, 33 aa, Plasmodium falciparum
KLEIIIKFKKYNTYFSAILKLKTFNTPMKNYIY

SEQ ID NO: 3386609 - protein, 18 aa, Plasmodium falciparum
KLEINGCIKIKRKGAHEE

SEQ ID NO: 3386610 - protein, 25 aa, Plasmodium falciparum
KLEKEKMNILLKDKLNELEKNVFFM

SEQ ID NO: 3386611 - protein, 19 aa, Plasmodium falciparum
KLEKLMEVYCNRLGQSMEA

SEQ ID NO: 3386612 - protein, 20 aa, Plasmodium falciparum
KLELFLPEQYPMEPPKVRFL

SEQ ID NO: 3386613 - protein, 20 aa, Plasmodium falciparum
KLEMLKRIIINWVNKKHNEF

SEQ ID NO: 3386614 - protein, 24 aa, Plasmodium falciparum
KLENALWIAEIIHDSFIVQGTHTV

SEQ ID NO: 3386615 - protein, 21 aa, Plasmodium falciparum
KLEQFEYIIYRIECKLSNMIN

SEQ ID NO: 3386616 - protein, 20 aa, Plasmodium falciparum
KLESFKCLFFTKDNLIDIEK

SEQ ID NO: 3386617 - protein, 18 aa, Plasmodium falciparum
KLESNKSLIIFPVNIHEY

SEQ ID NO: 3386618 - protein, 24 aa, Plasmodium falciparum
KLETLYKLLGFEIILEDDKIVIEF

SEQ ID NO: 3386619 - protein, 18 aa, Plasmodium falciparum
KLEWLCLDLDLVECLMAR

SEQ ID NO: 3386620 - protein, 17 aa, Plasmodium falciparum
KLEYINGAVKLLNKEMT

SEQ ID NO: 3386621 - protein, 22 aa, Plasmodium falciparum
KLFDYHFLSVKILGQSFLMHQI

SEQ ID NO: 3386622 - protein, 21 aa, Plasmodium falciparum
KLFEYDFIFNYAFNKESINNN

SEQ ID NO: 3386623 - protein, 17 aa, Plasmodium falciparum
KLFFKPHMEQFYNFSLL

SEQ ID NO: 3386624 - protein, 17 aa, Plasmodium falciparum
KLFNWIIKNLESPRYYS

SEQ ID NO: 3386625 - protein, 29 aa, Plasmodium falciparum
KLFSLIDTWFTYSKNMCLNFFDIIHKITK

SEQ ID NO: 3386626 - protein, 29 aa, Plasmodium falciparum
KLFSQENIFLFGFYIKYRNILKLFSSPRC

SEQ ID NO: 3386627 - protein, 23 aa, Plasmodium falciparum
KLGKESDGWIIQKKAKRKKKKKK

SEQ ID NO: 3386628 - protein, 18 aa, Plasmodium falciparum
KLGLFGRKMFIYNRIKGI

SEQ ID NO: 3386629 - protein, 18 aa, Plasmodium falciparum
KLGRKVIIVICYQCNNRN

SEQ ID NO: 3386630 - protein, 23 aa, Plasmodium falciparum
KLHIIRIMLEAIYFIAHYLDIFI

SEQ ID NO: 3386631 - protein, 23 aa, Plasmodium falciparum
KLHKQLYRDFKILMNIDISQIQN

SEQ ID NO: 3386632 - protein, 26 aa, Plasmodium falciparum
KLHLDTLFFIFYYQPGTYQQHLAAKE

SEQ ID NO: 3386633 - protein, 18 aa, Plasmodium falciparum
KLHNKNDVMFHMYADNNQ

SEQ ID NO: 3386634 - protein, 21 aa, Plasmodium falciparum
KLHNLIVLKIIQVIHSLDNIP

SEQ ID NO: 3386635 - protein, 20 aa, Plasmodium falciparum
KLHTNFMVYIQKYYDFSKTY

SEQ ID NO: 3386636 - protein, 27 aa, Plasmodium falciparum
KLHVRILQNSLIFHTLLQGSKKIINML

SEQ ID NO: 3386637 - protein, 24 aa, Plasmodium falciparum
KLIEKIVWPEIYNKKIDVNKIKFP

SEQ ID NO: 3386638 - protein, 38 aa, Plasmodium falciparum
KLIESINIYQRAVNAALYLFHYILHMLEITSQKNNNML

SEQ ID NO: 3386639 - protein, 21 aa, Plasmodium falciparum
KLIHFYEAYDSLPLLIEQLKS

SEQ ID NO: 3386640 - protein, 21 aa, Plasmodium falciparum
KLIINEILKKDKDILKQIILD

SEQ ID NO: 3386641 - protein, 19 aa, Plasmodium falciparum
KLIIYFPLEYIQHNILYIL

SEQ ID NO: 3386642 - protein, 20 aa, Plasmodium falciparum
KLIKFVGYPTKLSIKAFMLT

SEQ ID NO: 3386643 - protein, 19 aa, Plasmodium falciparum
KLIKIFIDGDYYYNKFLEK

SEQ ID NO: 3386644 - protein, 18 aa, Plasmodium falciparum
KLIKIKKEYINTALAVHL

SEQ ID NO: 3386645 - protein, 18 aa, Plasmodium falciparum
KLILKLYMHEKENIYKEI

SEQ ID NO: 3386646 - protein, 21 aa, Plasmodium falciparum
KLILYNNPDLILFVGEALVGN

SEQ ID NO: 3386647 - protein, 18 aa, Plasmodium falciparum
KLINIFVNNICDIIEYLC

SEQ ID NO: 3386648 - protein, 17 aa, Plasmodium falciparum
KLINMQEYKTKKLLDER

SEQ ID NO: 3386649 - protein, 20 aa, Plasmodium falciparum
KLINNFFLTINKLSNHGFSS

SEQ ID NO: 3386650 - protein, 34 aa, Plasmodium falciparum
KLINTIYREFNSRLYPIIICNILSDTKNIDINVT

SEQ ID NO: 3386651 - protein, 17 aa, Plasmodium falciparum
KLIPYLENVFIKNIFCC

SEQ ID NO: 3386652 - protein, 25 aa, Plasmodium falciparum
KLIQINEKFGILKLFKPDIYNCNNE

SEQ ID NO: 3386653 - protein, 33 aa, Plasmodium falciparum
KLIRETSLWHINKFFDIFNFKKNFALIKNFIYP

SEQ ID NO: 3386654 - protein, 35 aa, Plasmodium falciparum
KLISDFIEYYIALLKFVLFKLYKLDNMLYPPKQDN

SEQ ID NO: 3386655 - protein, 18 aa, Plasmodium falciparum
KLISKEIILLKNLDKYKP

SEQ ID NO: 3386656 - protein, 27 aa, Plasmodium falciparum
KLISKIFIDLEIPYISNVVYCYCNKFD

SEQ ID NO: 3386657 - protein, 25 aa, Plasmodium falciparum
KLIYYDVVSLIKILSKLNKLFKKIY

SEQ ID NO: 3386658 - protein, 27 aa, Plasmodium falciparum
KLKDETYLNIPIWKFYGKCQECKNEII

SEQ ID NO: 3386659 - protein, 37 aa, Plasmodium falciparum
KLKDLHYILNIKIYPIRTLVLYILYNSFFKDYNNEFI

SEQ ID NO: 3386660 - protein, 26 aa, Plasmodium falciparum
KLKEPTNSILLNKYNKYDLCEENKMG

SEQ ID NO: 3386661 - protein, 21 aa, Plasmodium falciparum
KLKESIMMMEKYKIIMNNNIQ

SEQ ID NO: 3386662 - protein, 20 aa, Plasmodium falciparum
KLKKFLHFYAELHKKCNYEE

SEQ ID NO: 3386663 - protein, 18 aa, Plasmodium falciparum
KLKKKKLLFLSKDITHHI

SEQ ID NO: 3386664 - protein, 18 aa, Plasmodium falciparum
KLKKKMHLNFIDYIKKEE

SEQ ID NO: 3386665 - protein, 26 aa, Plasmodium falciparum
KLKKKTILIYIPYKIYTTYVRKIQRK

SEQ ID NO: 3386666 - protein, 27 aa, Plasmodium falciparum
KLKNFENILCLYPYFNDYQLRKLSELI

SEQ ID NO: 3386667 - protein, 18 aa, Plasmodium falciparum
KLKNFFDISIRSSVLYHL

SEQ ID NO: 3386668 - protein, 25 aa, Plasmodium falciparum
KLKNFRLDLIDGFLYDKQSLYEREM

SEQ ID NO: 3386669 - protein, 23 aa, Plasmodium falciparum
KLKNIEKKYIYLKDICDLLNKSL

SEQ ID NO: 3386670 - protein, 18 aa, Plasmodium falciparum
KLKNPFSLLTTLGTKNKE

SEQ ID NO: 3386671 - protein, 23 aa, Plasmodium falciparum
KLKNYFIPLYTEKFSKKNVNSNS

SEQ ID NO: 3386672 - protein, 24 aa, Plasmodium falciparum
KLKSYPFFLNHIIHFNKLTKNNCF

SEQ ID NO: 3386673 - protein, 27 aa, Plasmodium falciparum
KLKYEKQVFQKAYGLSLDDDICYDNFL

SEQ ID NO: 3386674 - protein, 24 aa, Plasmodium falciparum
KLKYTVIEEGSFGVVYKGWYKGMH

SEQ ID NO: 3386675 - protein, 20 aa, Plasmodium falciparum
KLLEQTFDICITTFDLVIKE

SEQ ID NO: 3386676 - protein, 27 aa, Plasmodium falciparum
KLLESIPLVILLRNRLKYALTFDEVKM

SEQ ID NO: 3386677 - protein, 17 aa, Plasmodium falciparum
KLLFAISNDLKLFDIRV

SEQ ID NO: 3386678 - protein, 19 aa, Plasmodium falciparum
KLLFLSKDITHHIFQNVLT

SEQ ID NO: 3386679 - protein, 25 aa, Plasmodium falciparum
KLLGSFDLVGIPPAPRGVPQIEVTF

SEQ ID NO: 3386680 - protein, 33 aa, Plasmodium falciparum
KLLHAYKILLYLRYPFYLVKKKNPMLFYISESK

SEQ ID NO: 3386681 - protein, 17 aa, Plasmodium falciparum
KLLIKSEMLFYILSVQI

SEQ ID NO: 3386682 - protein, 23 aa, Plasmodium falciparum
KLLINQIQALNKNKPLLSSYSKI

SEQ ID NO: 3386683 - protein, 31 aa, Plasmodium falciparum
KLLKDFAKSFDPMFIIIRKRYRKDNLSAMYL

SEQ ID NO: 3386684 - protein, 19 aa, Plasmodium falciparum
KLLKGVCIAFYGLYGLLHN

SEQ ID NO: 3386685 - protein, 19 aa, Plasmodium falciparum
KLLKKKLIVIGLTQVIKCI

SEQ ID NO: 3386686 - protein, 24 aa, Plasmodium falciparum
KLLKKVLERVIPPTLLKIVTFEQI

SEQ ID NO: 3386687 - protein, 33 aa, Plasmodium falciparum
KLLKKYKIQGILPKKIFLIIKYSLDVDECVHNL

SEQ ID NO: 3386688 - protein, 29 aa, Plasmodium falciparum
KLLLDKEPFFFSIQLPNMLPALLSKEEEE

SEQ ID NO: 3386689 - protein, 17 aa, Plasmodium falciparum
KLLNFYCTLIKKGKYDN

SEQ ID NO: 3386690 - protein, 27 aa, Plasmodium falciparum
KLLNKIRLYITRYKILSKTKIKNKFPS

SEQ ID NO: 3386691 - protein, 20 aa, Plasmodium falciparum
KLLNYLIHCKTSYKKELKKL

SEQ ID NO: 3386692 - protein, 32 aa, Plasmodium falciparum
KLLQNNQHYIYIYIFQIEKYPKMASDIFFLTQ

SEQ ID NO: 3386693 - protein, 17 aa, Plasmodium falciparum
KLLQSVTLDWSNLTLNS

SEQ ID NO: 3386694 - protein, 21 aa, Plasmodium falciparum
KLLSDQLHLDSLYKTSDGRNK

SEQ ID NO: 3386695 - protein, 35 aa, Plasmodium falciparum
KLLYHINKNLIFLKRIQQYFYQKYINIKFSNDTND

SEQ ID NO: 3386696 - protein, 25 aa, Plasmodium falciparum
KLMLNKIIYPLFINNKLINTNVSSD

SEQ ID NO: 3386697 - protein, 20 aa, Plasmodium falciparum
KLMYKYVEPTFSYLSTLQTS

SEQ ID NO: 3386698 - protein, 19 aa, Plasmodium falciparum
KLNCLKLEKTNEILEFNKT

SEQ ID NO: 3386699 - protein, 29 aa, Plasmodium falciparum
KLNDDKIFSYAIRQYYYNLNKCTLCDKEN

SEQ ID NO: 3386700 - protein, 24 aa, Plasmodium falciparum
KLNDKYPCLFNCSYYVDSMKTIKY

SEQ ID NO: 3386701 - protein, 27 aa, Plasmodium falciparum
KLNDLKKKILIKKYLNEIALKKKNHVM

SEQ ID NO: 3386702 - protein, 21 aa, Plasmodium falciparum
KLNDRFYQICCKSIADINTHN

SEQ ID NO: 3386703 - protein, 20 aa, Plasmodium falciparum
KLNDSSYYSLKLPKFIDVCL

SEQ ID NO: 3386704 - protein, 22 aa, Plasmodium falciparum
KLNEDIFLLNDTSTFIYDEDFD

SEQ ID NO: 3386705 - protein, 24 aa, Plasmodium falciparum
KLNELRIILKEIPIMCLTATCTKN

SEQ ID NO: 3386706 - protein, 18 aa, Plasmodium falciparum
KLNGDIWQYKDPSGNVQG

SEQ ID NO: 3386707 - protein, 20 aa, Plasmodium falciparum
KLNHAVFIDKSLHSKILECK

SEQ ID NO: 3386708 - protein, 19 aa, Plasmodium falciparum
KLNHFIFQNHTKLFKYHDI

SEQ ID NO: 3386709 - protein, 18 aa, Plasmodium falciparum
KLNILVNSISKLVQSKIK

SEQ ID NO: 3386710 - protein, 24 aa, Plasmodium falciparum
KLNKKLIPIIQYKTDPYILGGLIL

SEQ ID NO: 3386711 - protein, 56 aa, Plasmodium falciparum
KLNKKRKKKIPGRIYKVIVRGKECWRAEWLVHSKNDDLRTLHPKLAGLNNDKLNFH

SEQ ID NO: 3386712 - protein, 25 aa, Plasmodium falciparum
KLNKNNLLSYIFKEEYNNIVNTKKK

SEQ ID NO: 3386713 - protein, 26 aa, Plasmodium falciparum
KLNKNYQDLFLFKDNFNVCEEDMDTI

SEQ ID NO: 3386714 - protein, 19 aa, Plasmodium falciparum
KLNLTHLCYAFSLIKIPKF

SEQ ID NO: 3386715 - protein, 27 aa, Plasmodium falciparum
KLNMDCQNIFIQKGDYKKVLNQMGEKA

SEQ ID NO: 3386716 - protein, 19 aa, Plasmodium falciparum
KLNMNVHLSWLKEKYKKEY

SEQ ID NO: 3386717 - protein, 20 aa, Plasmodium falciparum
KLNNFFVVKYVIYLKKKKKN

SEQ ID NO: 3386718 - protein, 22 aa, Plasmodium falciparum
KLNNIPYLKKLKTLILCNNKIA

SEQ ID NO: 3386719 - protein, 20 aa, Plasmodium falciparum
KLNNLYYKNKYNPVKDKNVS

SEQ ID NO: 3386720 - protein, 33 aa, Plasmodium falciparum
KLNSIFNMATNVLNNSFFYLSKEHDHKKNNHDT

SEQ ID NO: 3386721 - protein, 25 aa, Plasmodium falciparum
KLNYNRDPLLIFEFEKYLNIVKNKI

SEQ ID NO: 3386722 - protein, 17 aa, Plasmodium falciparum
KLPFEYSSFISNKLGST

SEQ ID NO: 3386723 - protein, 25 aa, Plasmodium falciparum
KLPFGWRVHILLPQDISAKMLKKQK

SEQ ID NO: 3386724 - protein, 17 aa, Plasmodium falciparum
KLPINKNLNDKQAFEGE

SEQ ID NO: 3386725 - protein, 30 aa, Plasmodium falciparum
KLQEILEMYEPPIIVFVNQKKVADIISKSI

SEQ ID NO: 3386726 - protein, 17 aa, Plasmodium falciparum
KLQIRLSHNYPNTCPEV

SEQ ID NO: 3386727 - protein, 24 aa, Plasmodium falciparum
KLQWEDKWILHKLNVYIKNANDNF

SEQ ID NO: 3386728 - protein, 24 aa, Plasmodium falciparum
KLRALFEMCFLISPATYNCVQDFK

SEQ ID NO: 3386729 - protein, 23 aa, Plasmodium falciparum
KLRHLKYSFLEYKIALENIVSCC

SEQ ID NO: 3386730 - protein, 17 aa, Plasmodium falciparum
KLRNKYLESLLNNNINN

SEQ ID NO: 3386731 - protein, 20 aa, Plasmodium falciparum
KLRNVMYFYMSHPNIRSFSL

SEQ ID NO: 3386732 - protein, 17 aa, Plasmodium falciparum
KLRQHYLNILQNKCKDI

SEQ ID NO: 3386733 - protein, 23 aa, Plasmodium falciparum
KLRSKILFNVKKVGKYIFKIYEC

SEQ ID NO: 3386734 - protein, 18 aa, Plasmodium falciparum
KLRYNIFVTRFLESNGLS

SEQ ID NO: 3386735 - protein, 26 aa, Plasmodium falciparum
KLSDKVMRMFGQELVLINSQILELSS

SEQ ID NO: 3386736 - protein, 28 aa, Plasmodium falciparum
KLSEHPFGFFFFYFYNRGSLLVMGGKAV

SEQ ID NO: 3386737 - protein, 31 aa, Plasmodium falciparum
KLSEPAHEESIYFTYRSVTPCDMNKLDETAK

SEQ ID NO: 3386738 - protein, 31 aa, Plasmodium falciparum
KLSEYIVAKEQMLYILRVMGYDEIDNIYFHP

SEQ ID NO: 3386739 - protein, 21 aa, Plasmodium falciparum
KLSFQEFMIVPVGAPSFKEAL

SEQ ID NO: 3386740 - protein, 24 aa, Plasmodium falciparum
KLSGKHYNYIFEKNNINKTPLDYI

SEQ ID NO: 3386741 - protein, 20 aa, Plasmodium falciparum
KLSLFSLQRNVVYNNLNNIL

SEQ ID NO: 3386742 - protein, 24 aa, Plasmodium falciparum
KLSLLKYDYMCQLSFLQSSILQKL

SEQ ID NO: 3386743 - protein, 26 aa, Plasmodium falciparum
KLSMQNRINFVCDELNHLIKKTLKSE

SEQ ID NO: 3386744 - protein, 19 aa, Plasmodium falciparum
KLSNLKYYRIPNFFRNKSE

SEQ ID NO: 3386745 - protein, 24 aa, Plasmodium falciparum
KLSNNYLEIYPLNIETFTYMNELF

SEQ ID NO: 3386746 - protein, 21 aa, Plasmodium falciparum
KLSRPPFYFKNEKDMINDTNG

SEQ ID NO: 3386747 - protein, 18 aa, Plasmodium falciparum
KLSSYNNLFLTLSKREMK

SEQ ID NO: 3386748 - protein, 33 aa, Plasmodium falciparum
KLSYNDMLLNLKKRNVLEEFPFNFVKQKDDSAK

SEQ ID NO: 3386749 - protein, 21 aa, Plasmodium falciparum
KLTFFQSFIHLYKEGGILYLY

SEQ ID NO: 3386750 - protein, 18 aa, Plasmodium falciparum
KLTFGGMFDKGPLYEEKK

SEQ ID NO: 3386751 - protein, 42 aa, Plasmodium falciparum
KLTIIGCQTLEWLHIFRNCSFPLLKKFEVCYYPLHHDHWYWN

SEQ ID NO: 3386752 - protein, 20 aa, Plasmodium falciparum
KLTILKYFNSYLLKNNKGKY

SEQ ID NO: 3386753 - protein, 19 aa, Plasmodium falciparum
KLTLFFAVKLYKKNIIRIK

SEQ ID NO: 3386754 - protein, 27 aa, Plasmodium falciparum
KLTNIHFLNLLYFKYQNINTKYLFIHN

SEQ ID NO: 3386755 - protein, 33 aa, Plasmodium falciparum
KLTNKYNNNYKLFKSFVFSLNNPINFSPSSKEQ

SEQ ID NO: 3386756 - protein, 17 aa, Plasmodium falciparum
KLTQYPFRKIASTAAIN

SEQ ID NO: 3386757 - protein, 25 aa, Plasmodium falciparum
KLTSKPMIYVPIKLQVDNLKNDANK

SEQ ID NO: 3386758 - protein, 28 aa, Plasmodium falciparum
KLTSNGCTFIFWIADWFAHLNNKMSGDL

SEQ ID NO: 3386759 - protein, 36 aa, Plasmodium falciparum
KLTVFNIPHLRYFFVSKDLNFIKWYSSRKQDDQCKI

SEQ ID NO: 3386760 - protein, 29 aa, Plasmodium falciparum
KLTYLGYDFLALRTFLKRGILKSIGNQIG

SEQ ID NO: 3386761 - protein, 21 aa, Plasmodium falciparum
KLVLYKIYDNLYNFQWINREN

SEQ ID NO: 3386762 - protein, 19 aa, Plasmodium falciparum
KLVPNWKKPIVIGRHAYAD

SEQ ID NO: 3386763 - protein, 21 aa, Plasmodium falciparum
KLVWLCLSYHHYYVRTIDLTV

SEQ ID NO: 3386764 - protein, 20 aa, Plasmodium falciparum
KLWNRFRNTQITTFKSKNAF

SEQ ID NO: 3386765 - protein, 19 aa, Plasmodium falciparum
KLWNYQEVYTYLKQNNISI

SEQ ID NO: 3386766 - protein, 17 aa, Plasmodium falciparum
KLWRTDRYLRHLEAVLI

SEQ ID NO: 3386767 - protein, 17 aa, Plasmodium falciparum
KLYELNLTINKNIINSN

SEQ ID NO: 3386768 - protein, 20 aa, Plasmodium falciparum
KLYLDAENLFYLLLDTHDIQ

SEQ ID NO: 3386769 - protein, 18 aa, Plasmodium falciparum
KLYLFQLVQSLRTFNYQH

SEQ ID NO: 3386770 - protein, 35 aa, Plasmodium falciparum
KLYLPVQSLYQIYLFYIYFNIYVKYLFTCYINYCN

SEQ ID NO: 3386771 - protein, 17 aa, Plasmodium falciparum
KLYNQNIYTLKYQVANI

SEQ ID NO: 3386772 - protein, 22 aa, Plasmodium falciparum
KLYRVFEKLNKLFYLPRCKPQE

SEQ ID NO: 3386773 - protein, 22 aa, Plasmodium falciparum
KLYRVQYIINNSIKTKGFSVKK

SEQ ID NO: 3386774 - protein, 21 aa, Plasmodium falciparum
KLYVLKKYDKIYKTCNYEKSV

SEQ ID NO: 3386775 - protein, 38 aa, Plasmodium falciparum
KMCEHPNVVKYFESFFWPPCYLVIVCEYLSGGTLYDLY

SEQ ID NO: 3386776 - protein, 18 aa, Plasmodium falciparum
KMCPYMNTKEKCKRFSNN

SEQ ID NO: 3386777 - protein, 27 aa, Plasmodium falciparum
KMCRQLAEVINFLHTPIKNKKNVIIHR

SEQ ID NO: 3386778 - protein, 40 aa, Plasmodium falciparum
KMDAYTFFIGTNRANALDLCQRLKLFEALHNFIKEQNNDN

SEQ ID NO: 3386779 - protein, 23 aa, Plasmodium falciparum
KMDNIYLGYNESSLFFVDTRLQR

SEQ ID NO: 3386780 - protein, 26 aa, Plasmodium falciparum
KMEETKNLIFPMDIKKIYGSLYKVKK

SEQ ID NO: 3386781 - protein, 20 aa, Plasmodium falciparum
KMETIQGKNLFLYQSSDVKH

SEQ ID NO: 3386782 - protein, 18 aa, Plasmodium falciparum
KMHILDIFKYHDFPMNMF

SEQ ID NO: 3386783 - protein, 20 aa, Plasmodium falciparum
KMHVFDLDKAKISIFKIFER

SEQ ID NO: 3386784 - protein, 20 aa, Plasmodium falciparum
KMIFVRHNIKIKCRLINIPY

SEQ ID NO: 3386785 - protein, 19 aa, Plasmodium falciparum
KMIFYPYNYDNNKYKRFSL

SEQ ID NO: 3386786 - protein, 17 aa, Plasmodium falciparum
KMIQTFSVFPLLTNESS

SEQ ID NO: 3386787 - protein, 27 aa, Plasmodium falciparum
KMIRKDYLHALVIWFDISFSACHTEVN

SEQ ID NO: 3386788 - protein, 24 aa, Plasmodium falciparum
KMITLDNYIYLKRPIMKELISYAI

SEQ ID NO: 3386789 - protein, 42 aa, Plasmodium falciparum
KMKDLNFDILKWKELYIECICILRFLFFNCKLVHADFSEYNL

SEQ ID NO: 3386790 - protein, 27 aa, Plasmodium falciparum
KMKGNMEDLIKLNYITFEKNKIVIKLE

SEQ ID NO: 3386791 - protein, 18 aa, Plasmodium falciparum
KMKHIPLSVNNKGYNKSS

SEQ ID NO: 3386792 - protein, 17 aa, Plasmodium falciparum
KMKIHYPIYFGCGLTEN

SEQ ID NO: 3386793 - protein, 27 aa, Plasmodium falciparum
KMKKGFNSLVILIKSIAYIRSSVDIFC

SEQ ID NO: 3386794 - protein, 30 aa, Plasmodium falciparum
KMKSKGCIVKYIKPLWLIEEEKRIINELIE

SEQ ID NO: 3386795 - protein, 23 aa, Plasmodium falciparum
KMKYGMPEYYRCPYYMHENRNLY

SEQ ID NO: 3386796 - protein, 17 aa, Plasmodium falciparum
KMLRNELFLYNPEYLNK

SEQ ID NO: 3386797 - protein, 19 aa, Plasmodium falciparum
KMMKIYNHSLNKYKNLINF

SEQ ID NO: 3386798 - protein, 23 aa, Plasmodium falciparum
KMNCSEHLNIVPINHNNNNIMCS

SEQ ID NO: 3386799 - protein, 25 aa, Plasmodium falciparum
KMNDGILMQINKLSQYSSKWIIKAR

SEQ ID NO: 3386800 - protein, 27 aa, Plasmodium falciparum
KMNISTLCNILYYYTKLNISNDDIINL

SEQ ID NO: 3386801 - protein, 28 aa, Plasmodium falciparum
KMNKSIFKVLNTVMFIGTIHSFCRYILY

SEQ ID NO: 3386802 - protein, 27 aa, Plasmodium falciparum
KMNRNKILYLKGLKSKELLLQKKIDYQ

SEQ ID NO: 3386803 - protein, 19 aa, Plasmodium falciparum
KMNTVDTYIPCDINENKKE

SEQ ID NO: 3386804 - protein, 19 aa, Plasmodium falciparum
KMQGRGTYFFADGGIYEGD

SEQ ID NO: 3386805 - protein, 24 aa, Plasmodium falciparum
KMSKNLPGLYDHYAFLLLNQNKCE

SEQ ID NO: 3386806 - protein, 28 aa, Plasmodium falciparum
KMSLKRNIWYNNRSNSVHSALNGALNSN

SEQ ID NO: 3386807 - protein, 30 aa, Plasmodium falciparum
KMSNMKNVDMLLLLLSNNIYNKIMSTTLYN

SEQ ID NO: 3386808 - protein, 20 aa, Plasmodium falciparum
KMSYESISLLNNFSYTLDNS

SEQ ID NO: 3386809 - protein, 18 aa, Plasmodium falciparum
KMTILKMIIKYENFNSIM

SEQ ID NO: 3386810 - protein, 17 aa, Plasmodium falciparum
KMVCKKLDQIVLNYESI

SEQ ID NO: 3386811 - protein, 23 aa, Plasmodium falciparum
KMVEFHYLFTPSDYEYGSFIMMG

SEQ ID NO: 3386812 - protein, 18 aa, Plasmodium falciparum
KMVGIKKIVLLKEKQKSL

SEQ ID NO: 3386813 - protein, 23 aa, Plasmodium falciparum
KMVPLPRYCCVNGIPLSDFTKKG

SEQ ID NO: 3386814 - protein, 25 aa, Plasmodium falciparum
KMYAKAFFELYFMEKYKRNEGVIKV

SEQ ID NO: 3386815 - protein, 18 aa, Plasmodium falciparum
KMYDIILSSEYTGLPIEH

SEQ ID NO: 3386816 - protein, 27 aa, Plasmodium falciparum
KNADNIIPKWLYFVKGVIDCEDMPLNI

SEQ ID NO: 3386817 - protein, 27 aa, Plasmodium falciparum
KNAKIAFLDFPLKQYRLHLGVQVNIND

SEQ ID NO: 3386818 - protein, 44 aa, Plasmodium falciparum
KNAKYNFVPVIIDWGLIKQLDSVMKFAFCKLVYNISCMNVLNII

SEQ ID NO: 3386819 - protein, 26 aa, Plasmodium falciparum
KNALFLYCKYVLLFYGKELLNENNVE

SEQ ID NO: 3386820 - protein, 26 aa, Plasmodium falciparum
KNCGNIFHYNCMIKWMELQKSCPLCK

SEQ ID NO: 3386821 - protein, 21 aa, Plasmodium falciparum
KNCIYAFIKYYDTLQNDLFNE

SEQ ID NO: 3386822 - protein, 25 aa, Plasmodium falciparum
KNCKQLFDIIILDPPNLIPKSKFLE

SEQ ID NO: 3386823 - protein, 23 aa, Plasmodium falciparum
KNCLCHEFVFPNFLTDRQKYKLI

SEQ ID NO: 3386824 - protein, 28 aa, Plasmodium falciparum
KNCLYNFIHTVVFFKLDLGTIHVPKKKS

SEQ ID NO: 3386825 - protein, 28 aa, Plasmodium falciparum
KNCRSGKIIGEPFPLDVVSRNKYCVEKG

SEQ ID NO: 3386826 - protein, 60 aa, Plasmodium falciparum
KNCVDYYIDILFSYTGFCDIIFSVTCGIYRKKYTCYNISTIPWFGYKNWGVLKNCMKKDM

SEQ ID NO: 3386827 - protein, 33 aa, Plasmodium falciparum
KNDDTFINIIYTNKNLFYKKKNVKWIDGFIIEK

SEQ ID NO: 3386828 - protein, 17 aa, Plasmodium falciparum
KNDENLFTTFSNAFHIP

SEQ ID NO: 3386829 - protein, 23 aa, Plasmodium falciparum
KNDFIPPVILVLNKVDLCTHNKW

SEQ ID NO: 3386830 - protein, 23 aa, Plasmodium falciparum
KNDFLGINCYIDDIGRIKKLPYN

SEQ ID NO: 3386831 - protein, 34 aa, Plasmodium falciparum
KNDGIYKNRGIYKNQFLYNFYTNDDVIYIKQITE

SEQ ID NO: 3386832 - protein, 23 aa, Plasmodium falciparum
KNDHFYKIFFSSKKVKIIKSQNH

SEQ ID NO: 3386833 - protein, 25 aa, Plasmodium falciparum
KNDITYIFYIMKEHLIYTLKEIFKK

SEQ ID NO: 3386834 - protein, 23 aa, Plasmodium falciparum
KNDKIIYAQMRRSQSDNLYKRKN

SEQ ID NO: 3386835 - protein, 37 aa, Plasmodium falciparum
KNDKITNIIIYKRMYQSFILLKKEYRDLIDEHKKKIN

SEQ ID NO: 3386836 - protein, 23 aa, Plasmodium falciparum
KNDKNLILFYNYYFNYVFDHMYL

SEQ ID NO: 3386837 - protein, 23 aa, Plasmodium falciparum
KNDKTFSNLFLLNNNISINKKKI

SEQ ID NO: 3386838 - protein, 24 aa, Plasmodium falciparum
KNDLSTVQLLLKKYPQLIQKGHNL

SEQ ID NO: 3386839 - protein, 28 aa, Plasmodium falciparum
KNDNHFCIVPFNSTNNFIISKKSFVTKN

SEQ ID NO: 3386840 - protein, 26 aa, Plasmodium falciparum
KNDNNIFLKYFLQKFTIHQIEEKKVK

SEQ ID NO: 3386841 - protein, 32 aa, Plasmodium falciparum
KNDSEKYWDNPPLHYSKKNNYDIFTLGDIKKY

SEQ ID NO: 3386842 - protein, 22 aa, Plasmodium falciparum
KNDVLVIFKKIIEYIDSPVHFS

SEQ ID NO: 3386843 - protein, 25 aa, Plasmodium falciparum
KNDVMSFNEYSLNPGLSMDDFYKNM

SEQ ID NO: 3386844 - protein, 26 aa, Plasmodium falciparum
KNDVSYFRQIKKYDYLIFDEAHFLKN

SEQ ID NO: 3386845 - protein, 19 aa, Plasmodium falciparum
KNDYNFSYKNYKERYYYDK

SEQ ID NO: 3386846 - protein, 29 aa, Plasmodium falciparum
KNDYVSLSNNFFLIKNRSYKYITVRNKIG

SEQ ID NO: 3386847 - protein, 20 aa, Plasmodium falciparum
KNECNFVYYQNYNNTNNVII

SEQ ID NO: 3386848 - protein, 25 aa, Plasmodium falciparum
KNEEDNFFFVFDDKEINKLNKIKEE

SEQ ID NO: 3386849 - protein, 26 aa, Plasmodium falciparum
KNEEHIYINKNIWKDKFDNCYNICND

SEQ ID NO: 3386850 - protein, 48 aa, Plasmodium falciparum
KNEEQIIPYLNVFGDYIQRCILPTDLPYAELYVLIDSLIHNEILPSYD

SEQ ID NO: 3386851 - protein, 25 aa, Plasmodium falciparum
KNEESYIKVLKYFKSLSPSGIHYNI

SEQ ID NO: 3386852 - protein, 36 aa, Plasmodium falciparum
KNEFGKVMTPKESFRYISWIFHGKKQGKNKLEKKIK

SEQ ID NO: 3386853 - protein, 19 aa, Plasmodium falciparum
KNEILYKSKINEAQALLIF

SEQ ID NO: 3386854 - protein, 19 aa, Plasmodium falciparum
KNEKIEPSLLLNLTETNTL

SEQ ID NO: 3386855 - protein, 31 aa, Plasmodium falciparum
KNEKNLFSSLILLIKTKRRYHRNFFVTNKDN

SEQ ID NO: 3386856 - protein, 25 aa, Plasmodium falciparum
KNEKSFIDLNFIKGYSNFIKKKCVP

SEQ ID NO: 3386857 - protein, 26 aa, Plasmodium falciparum
KNEKSFIDLNFIKGYSNFIKKKCVPY

SEQ ID NO: 3386858 - protein, 28 aa, Plasmodium falciparum
KNEKYDECWFLFQHYFERSSDVRKEMVH

SEQ ID NO: 3386859 - protein, 18 aa, Plasmodium falciparum
KNEKYRGKYHKYPLDIEA

SEQ ID NO: 3386860 - protein, 18 aa, Plasmodium falciparum
KNELENLVPYFNGRIFLE

SEQ ID NO: 3386861 - protein, 18 aa, Plasmodium falciparum
KNELLERLLKHEEKDNIN

SEQ ID NO: 3386862 - protein, 26 aa, Plasmodium falciparum
KNELNIFFNLIYILNEKYRTKISLIS

SEQ ID NO: 3386863 - protein, 18 aa, Plasmodium falciparum
KNELQNIYIFKKKKKKKK

SEQ ID NO: 3386864 - protein, 39 aa, Plasmodium falciparum
KNELTKAIILEIIIHNGYLLYHKFGDLLNERKKIKMIIL

SEQ ID NO: 3386865 - protein, 25 aa, Plasmodium falciparum
KNENFQNFVLEEIATIKNGLIMESQ

SEQ ID NO: 3386866 - protein, 17 aa, Plasmodium falciparum
KNENILYSIQYKMNTLI

SEQ ID NO: 3386867 - protein, 27 aa, Plasmodium falciparum
KNENKLKNYILILRDYENLCNDKIFNC

SEQ ID NO: 3386868 - protein, 25 aa, Plasmodium falciparum
KNEPSEIDFFKFVKKMILKCNKNDS

SEQ ID NO: 3386869 - protein, 23 aa, Plasmodium falciparum
KNEPVFFQIVKPEVRVLNNSISF

SEQ ID NO: 3386870 - protein, 24 aa, Plasmodium falciparum
KNESFFNYYINQKILKSCEIDNFM

SEQ ID NO: 3386871 - protein, 23 aa, Plasmodium falciparum
KNETKEHPTVNPVFNNNDIKQNI

SEQ ID NO: 3386872 - protein, 21 aa, Plasmodium falciparum
KNEVDEFLLVSRIAHVDLCNQ

SEQ ID NO: 3386873 - protein, 20 aa, Plasmodium falciparum
KNEYNWLRSLDTNEYDTKWD

SEQ ID NO: 3386874 - protein, 19 aa, Plasmodium falciparum
KNFILKLRVPCDQKKNKNC

SEQ ID NO: 3386875 - protein, 19 aa, Plasmodium falciparum
KNFLEYFERSWLSEDEFVL

SEQ ID NO: 3386876 - protein, 20 aa, Plasmodium falciparum
KNFMDLFMDTDMFEKKMNEE

SEQ ID NO: 3386877 - protein, 18 aa, Plasmodium falciparum
KNFPRQWNKNNITLSKNQ

SEQ ID NO: 3386878 - protein, 27 aa, Plasmodium falciparum
KNFYTTYIFDIYGKKIDILYQHLSYII

SEQ ID NO: 3386879 - protein, 27 aa, Plasmodium falciparum
KNGKITQSIFDIIYNHYVNDINQNIVK

SEQ ID NO: 3386880 - protein, 25 aa, Plasmodium falciparum
KNGLYCSPLRLLAWEVYSKLTRMNK

SEQ ID NO: 3386881 - protein, 24 aa, Plasmodium falciparum
KNGNFIEFPFNGLRIMTVIGNCLI

SEQ ID NO: 3386882 - protein, 21 aa, Plasmodium falciparum
KNGYHILYLTARAIGQADSTR

SEQ ID NO: 3386883 - protein, 21 aa, Plasmodium falciparum
KNGYLEALLRGFRSSFLTPEE

SEQ ID NO: 3386884 - protein, 31 aa, Plasmodium falciparum
KNHENDFFYTNLLYYLMDIYINKMEYIDNQY

SEQ ID NO: 3386885 - protein, 55 aa, Plasmodium falciparum
KNHENMFRMSKSQLLSLESDIKYLQSLTSYMIKPKDLYFETFEEIDVFSYDKNDE

SEQ ID NO: 3386886 - protein, 21 aa, Plasmodium falciparum
KNHIFNTLKDSTTKSNIYNLI

SEQ ID NO: 3386887 - protein, 22 aa, Plasmodium falciparum
KNHINLFKIPNFFMTTSNELSE

SEQ ID NO: 3386888 - protein, 24 aa, Plasmodium falciparum
KNHKWNIFINIYVYEYTPYIYDHI

SEQ ID NO: 3386889 - protein, 21 aa, Plasmodium falciparum
KNHLFGLNYFVKKIIQLNDIM

SEQ ID NO: 3386890 - protein, 19 aa, Plasmodium falciparum
KNIAKEHSLKKIEKNINLL

SEQ ID NO: 3386891 - protein, 36 aa, Plasmodium falciparum
KNIDEFITYIYLYKGKRFRVILSILLKNILHHIDNV

SEQ ID NO: 3386892 - protein, 25 aa, Plasmodium falciparum
KNIDEVDWFLPTQVPKRWLSRNPAD

SEQ ID NO: 3386893 - protein, 23 aa, Plasmodium falciparum
KNIDIRIIPPLRTQQVLNSFKSF

SEQ ID NO: 3386894 - protein, 28 aa, Plasmodium falciparum
KNIDKCLKPYLPLLSYLMFETDIVVNNK

SEQ ID NO: 3386895 - protein, 27 aa, Plasmodium falciparum
KNIEFFIPLLAEYYINKSKLLLSSIHW

SEQ ID NO: 3386896 - protein, 22 aa, Plasmodium falciparum
KNIEIFKIASLYIIAAFNADIK

SEQ ID NO: 3386897 - protein, 21 aa, Plasmodium falciparum
KNIFNRFNPFTLPLLGKNKLC

SEQ ID NO: 3386898 - protein, 18 aa, Plasmodium falciparum
KNIGFLKDYRRLNVAVTR

SEQ ID NO: 3386899 - protein, 21 aa, Plasmodium falciparum
KNIGFVNCFILRNNKIRWGKK

SEQ ID NO: 3386900 - protein, 21 aa, Plasmodium falciparum
KNIIIGKRNIIFPSCYMKCDK

SEQ ID NO: 3386901 - protein, 33 aa, Plasmodium falciparum
KNIINYLNFDRTIYFIFNQIKKLIKKLKNIFIS

SEQ ID NO: 3386902 - protein, 17 aa, Plasmodium falciparum
KNIISLFIKIFMSTNNT

SEQ ID NO: 3386903 - protein, 30 aa, Plasmodium falciparum
KNIKDMIPMSFINFIIHYNSLYQINNQLLL

SEQ ID NO: 3386904 - protein, 28 aa, Plasmodium falciparum
KNIKINDILYRYRKFQIPPLVQSNNKKT

SEQ ID NO: 3386905 - protein, 30 aa, Plasmodium falciparum
KNIKKDILYSIIYPYKFRLSNLNCIINIFG

SEQ ID NO: 3386906 - protein, 26 aa, Plasmodium falciparum
KNIKLDSILARGFNKSILKEIETNTN

SEQ ID NO: 3386907 - protein, 19 aa, Plasmodium falciparum
KNIKYLYSYSYIKKNILID

SEQ ID NO: 3386908 - protein, 21 aa, Plasmodium falciparum
KNIKYMYNLKDAYCLKKVNTK

SEQ ID NO: 3386909 - protein, 32 aa, Plasmodium falciparum
KNIKYNKDILKKKNINFLINKNFTSHISSSSF

SEQ ID NO: 3386910 - protein, 21 aa, Plasmodium falciparum
KNILNFIKPDDMYINSYIPYP

SEQ ID NO: 3386911 - protein, 22 aa, Plasmodium falciparum
KNILPTSLALQNLFYKLHTVNE

SEQ ID NO: 3386912 - protein, 18 aa, Plasmodium falciparum
KNIMLKNEDLKKLLDEYK

SEQ ID NO: 3386913 - protein, 21 aa, Plasmodium falciparum
KNIMYPYFRMYKSPYRARDSR

SEQ ID NO: 3386914 - protein, 24 aa, Plasmodium falciparum
KNINIDILKKQILHVSNKLNLMCD

SEQ ID NO: 3386915 - protein, 22 aa, Plasmodium falciparum
KNINIIWDPFCSTGNLIFELLS

SEQ ID NO: 3386916 - protein, 26 aa, Plasmodium falciparum
KNINLFSMRVIEWYSWHFPELKKIVT

SEQ ID NO: 3386917 - protein, 24 aa, Plasmodium falciparum
KNINNPMRMLVPGKAASFLIGRKG

SEQ ID NO: 3386918 - protein, 24 aa, Plasmodium falciparum
KNINRWHKLIDSLIYFEDAEWKKN

SEQ ID NO: 3386919 - protein, 33 aa, Plasmodium falciparum
KNINYPFVHIILYFYFKLNYINETFVFKLLNHY

SEQ ID NO: 3386920 - protein, 30 aa, Plasmodium falciparum
KNIPPKGMPKPLYSFIKNKDLNRNPINYDA

SEQ ID NO: 3386921 - protein, 27 aa, Plasmodium falciparum
KNIPQKKSLLFMKKATTGIKKVSVSKS

SEQ ID NO: 3386922 - protein, 24 aa, Plasmodium falciparum
KNIQAFHQILIKKIIEEKYITQFL

SEQ ID NO: 3386923 - protein, 26 aa, Plasmodium falciparum
KNIQNYFFFYDYRKCIYNVDGKIYIQ

SEQ ID NO: 3386924 - protein, 28 aa, Plasmodium falciparum
KNIQRKNEFIFLWPKTFHGGFNSGYNCN

SEQ ID NO: 3386925 - protein, 25 aa, Plasmodium falciparum
KNIRGLNKCLFLYKGVRNIRNRYNL

SEQ ID NO: 3386926 - protein, 21 aa, Plasmodium falciparum
KNISYRNSILTRLLQDSLGGS

SEQ ID NO: 3386927 - protein, 25 aa, Plasmodium falciparum
KNIVIQMPYACKLLFQELQTMNVFP

SEQ ID NO: 3386928 - protein, 20 aa, Plasmodium falciparum
KNIYCINFKKYYKSLQRKRK

SEQ ID NO: 3386929 - protein, 18 aa, Plasmodium falciparum
KNIYLNNNYMKILKNEEA

SEQ ID NO: 3386930 - protein, 17 aa, Plasmodium falciparum
KNIYPFFKTEEDVTYGR

SEQ ID NO: 3386931 - protein, 30 aa, Plasmodium falciparum
KNIYVIEHIDKIYYDTFLNKNPSEKSVFMN

SEQ ID NO: 3386932 - protein, 24 aa, Plasmodium falciparum
KNKAVLKPNPRFVGDNPNPFMQPP

SEQ ID NO: 3386933 - protein, 44 aa, Plasmodium falciparum
KNKDHNIKLLYNHLYLIKQREAHILRVRNYKVGYLNKGNHISRK

SEQ ID NO: 3386934 - protein, 19 aa, Plasmodium falciparum
KNKDHTIKFFASPKKTKKN

SEQ ID NO: 3386935 - protein, 26 aa, Plasmodium falciparum
KNKDSLIMFLVEIFRSLFVSNCIDKN

SEQ ID NO: 3386936 - protein, 22 aa, Plasmodium falciparum
KNKEDIYILQVEKQTLIKVISS

SEQ ID NO: 3386937 - protein, 29 aa, Plasmodium falciparum
KNKEFLVNRTNSLNIKRVRSGPLDNSQNV

SEQ ID NO: 3386938 - protein, 24 aa, Plasmodium falciparum
KNKEGGLLYEWYNKYIYNGDGKEK

SEQ ID NO: 3386939 - protein, 24 aa, Plasmodium falciparum
KNKEKYVHIVQSLTNQHILLNDYQ

SEQ ID NO: 3386940 - protein, 25 aa, Plasmodium falciparum
KNKELSPLSLIKKHGRLINNIEEIY

SEQ ID NO: 3386941 - protein, 23 aa, Plasmodium falciparum
KNKENYLFNFWNLHIDNVSNEKT

SEQ ID NO: 3386942 - protein, 17 aa, Plasmodium falciparum
KNKFDLIRRRNRKKSIN

SEQ ID NO: 3386943 - protein, 17 aa, Plasmodium falciparum
KNKFYNLDYDKETVSKT

SEQ ID NO: 3386944 - protein, 25 aa, Plasmodium falciparum
KNKIEQINLPYLPKLKKLSVQHNRL

SEQ ID NO: 3386945 - protein, 22 aa, Plasmodium falciparum
KNKIKLHFIHFYNVILYQYNNV

SEQ ID NO: 3386946 - protein, 20 aa, Plasmodium falciparum
KNKILAIPNYEEKQYYIVTN

SEQ ID NO: 3386947 - protein, 24 aa, Plasmodium falciparum
KNKKINILYFIDVSKFHVFEQLLL

SEQ ID NO: 3386948 - protein, 34 aa, Plasmodium falciparum
KNKKINIRDLDLDIYYPLLHVEQIKFRQSNQEQN

SEQ ID NO: 3386949 - protein, 24 aa, Plasmodium falciparum
KNKKNIFSYFKNICKRKKYKINSK

SEQ ID NO: 3386950 - protein, 33 aa, Plasmodium falciparum
KNKKQFYNLPTSYLNIWRWCNKRQFKSLFHYYD

SEQ ID NO: 3386951 - protein, 20 aa, Plasmodium falciparum
KNKKRNFFFSFNTDSEDYNN

SEQ ID NO: 3386952 - protein, 50 aa, Plasmodium falciparum
KNKKRNIYHLFLEYNQNVLLVQKYLKKKKILIKYINQLFEKHVLPSYNSS

SEQ ID NO: 3386953 - protein, 17 aa, Plasmodium falciparum
KNKLLFAISNDLKLFDI

SEQ ID NO: 3386954 - protein, 25 aa, Plasmodium falciparum
KNKLNITLFERLINKHKQNISFLLN

SEQ ID NO: 3386955 - protein, 26 aa, Plasmodium falciparum
KNKLPSLRKIVLMATKYSIPIPAFSA

SEQ ID NO: 3386956 - protein, 26 aa, Plasmodium falciparum
KNKLYGLIMNIIKKSLFVNYDKFMIK

SEQ ID NO: 3386957 - protein, 27 aa, Plasmodium falciparum
KNKNDLIVKIPFRTLSLKLPNAPVFKS

SEQ ID NO: 3386958 - protein, 24 aa, Plasmodium falciparum
KNKNDVIYNIPYNTNSFIDTKQNM

SEQ ID NO: 3386959 - protein, 45 aa, Plasmodium falciparum
KNKNFLKSSLSRHSLVILSIIYVLFHQNVFTSKWNEPSVLQLVNT

SEQ ID NO: 3386960 - protein, 26 aa, Plasmodium falciparum
KNKNIKLIKVPKFVSNKWLQYNNKDI

SEQ ID NO: 3386961 - protein, 24 aa, Plasmodium falciparum
KNKNKYILLLNELLSLFPAHAEKS

SEQ ID NO: 3386962 - protein, 23 aa, Plasmodium falciparum
KNKNLFFILTYMSGVQKCIYDHA

SEQ ID NO: 3386963 - protein, 23 aa, Plasmodium falciparum
KNKNNFHLFNRNIPNVYLKRAND

SEQ ID NO: 3386964 - protein, 21 aa, Plasmodium falciparum
KNKNYWSHMNLKRSEKKTLKE

SEQ ID NO: 3386965 - protein, 24 aa, Plasmodium falciparum
KNKQLLFLTATWPEQVRKLAYDFC

SEQ ID NO: 3386966 - protein, 23 aa, Plasmodium falciparum
KNKRIKKFFYNKEKHHELLSQLH

SEQ ID NO: 3386967 - protein, 25 aa, Plasmodium falciparum
KNKSEESFLYKYNIHNILKNKHFSN

SEQ ID NO: 3386968 - protein, 34 aa, Plasmodium falciparum
KNKSELKFYISNNIPFFIFAQQRKIFPTICNGEQ

SEQ ID NO: 3386969 - protein, 31 aa, Plasmodium falciparum
KNKSIYKRCYLNIRNLYLVKKNDKIKFENKL

SEQ ID NO: 3386970 - protein, 30 aa, Plasmodium falciparum
KNKSMIKDFLFFGVIDKKGQNYLGRIYMII

SEQ ID NO: 3386971 - protein, 22 aa, Plasmodium falciparum
KNKTFTDRFLNLKHQSYNSQDT

SEQ ID NO: 3386972 - protein, 19 aa, Plasmodium falciparum
KNKVYCPIELKNVYTLLED

SEQ ID NO: 3386973 - protein, 26 aa, Plasmodium falciparum
KNKYLAEIIRCELIWGPTKNKEPITP

SEQ ID NO: 3386974 - protein, 24 aa, Plasmodium falciparum
KNKYNEFFLWSTKCVDLEPSILLE

SEQ ID NO: 3386975 - protein, 17 aa, Plasmodium falciparum
KNKYQEELKRNKTLQFL

SEQ ID NO: 3386976 - protein, 19 aa, Plasmodium falciparum
KNKYVILKYDEDSLIEALE

SEQ ID NO: 3386977 - protein, 23 aa, Plasmodium falciparum
KNLCIQFFVTLKNVFIKSTNKFT

SEQ ID NO: 3386978 - protein, 20 aa, Plasmodium falciparum
KNLCSFKLSLQIEKYAKKNN

SEQ ID NO: 3386979 - protein, 29 aa, Plasmodium falciparum
KNLDVNKKNLLLNKLKDYYNNNNNNIFLI

SEQ ID NO: 3386980 - protein, 27 aa, Plasmodium falciparum
KNLENLYFDFPYNKNQIIFKPVFYPYK

SEQ ID NO: 3386981 - protein, 25 aa, Plasmodium falciparum
KNLERIIQYLFNGTLICSNVDLCKK

SEQ ID NO: 3386982 - protein, 19 aa, Plasmodium falciparum
KNLIFYYGHKKSVTCVASP

SEQ ID NO: 3386983 - protein, 26 aa, Plasmodium falciparum
KNLKDIELFNKWKKGMILLSNENGIV

SEQ ID NO: 3386984 - protein, 22 aa, Plasmodium falciparum
KNLKEKIPYHMKNKYLVMSSQN

SEQ ID NO: 3386985 - protein, 28 aa, Plasmodium falciparum
KNLKHLKVIFLLRPTYTNILRLMSELKK

SEQ ID NO: 3386986 - protein, 20 aa, Plasmodium falciparum
KNLKIVKCVCYALLGKYDNK

SEQ ID NO: 3386987 - protein, 25 aa, Plasmodium falciparum
KNLKKFVNYLKYVKDIHSCSYFISL

SEQ ID NO: 3386988 - protein, 23 aa, Plasmodium falciparum
KNLKKLLEIEYKMKKKIESFEKN

SEQ ID NO: 3386989 - protein, 26 aa, Plasmodium falciparum
KNLLHYAEIFKPFVSLRKLNYNFVEE

SEQ ID NO: 3386990 - protein, 17 aa, Plasmodium falciparum
KNLLKLFELDENKIISN

SEQ ID NO: 3386991 - protein, 45 aa, Plasmodium falciparum
KNLLTESIYAKLYKMYLTTLNNYYFILNILLPQISTHIIIHLLTF

SEQ ID NO: 3386992 - protein, 28 aa, Plasmodium falciparum
KNLNDTYIFNTFFYKKLELYDDVLKAYL

SEQ ID NO: 3386993 - protein, 28 aa, Plasmodium falciparum
KNLNTYFFHILYDYLFHVIKKENLYNIT

SEQ ID NO: 3386994 - protein, 21 aa, Plasmodium falciparum
KNLPKQWEYEFEEFSDDDSDD

SEQ ID NO: 3386995 - protein, 20 aa, Plasmodium falciparum
KNLPKVLGRILIPKTQKTGS

SEQ ID NO: 3386996 - protein, 24 aa, Plasmodium falciparum
KNLQQPVYLKYNKNVLYIDEKKSL

SEQ ID NO: 3386997 - protein, 27 aa, Plasmodium falciparum
KNLWENDIIHFFFDLVLRKKEHFKNNT

SEQ ID NO: 3386998 - protein, 24 aa, Plasmodium falciparum
KNLYEIVNILYTSNFDFSEYIMCD

SEQ ID NO: 3386999 - protein, 20 aa, Plasmodium falciparum
KNLYLVDQIYSLSPILDMKI

SEQ ID NO: 3387000 - protein, 21 aa, Plasmodium falciparum
KNLYYYYYRSLGVNQFKDVSN

SEQ ID NO: 3387001 - protein, 18 aa, Plasmodium falciparum
KNMCNILEYLNIKKAHFF

SEQ ID NO: 3387002 - protein, 22 aa, Plasmodium falciparum
KNMDRIPKNIPILFIHSKTDNI

SEQ ID NO: 3387003 - protein, 38 aa, Plasmodium falciparum
KNMDTAMNSLNMLILPKIKGVRFDKSGRRWVASWSQNG

SEQ ID NO: 3387004 - protein, 21 aa, Plasmodium falciparum
KNMFLKNCFLVRNTNVKCWRT

SEQ ID NO: 3387005 - protein, 17 aa, Plasmodium falciparum
KNMFSSVHAKVFNYFKR

SEQ ID NO: 3387006 - protein, 21 aa, Plasmodium falciparum
KNMFYFKCPYCLWSSINTVCK
